United States Patent 9,624,556 (VIRAL AND VIRAL ASSOCIATED MIRNAS AND USES THEREOF) - sequence listing, part 9

SEQ ID NO: 242591 - RNA, 64 nt, Human
gccagccgcgggcacuggugggcccugaccuccccgcggggagggugggugcuguggccccugc

SEQ ID NO: 242592 - RNA, 64 nt, Human
agacugugcucugagccucccuccccugcggggccgcggggaggcccugggaauggcaagggca

SEQ ID NO: 242593 - RNA, 64 nt, Human
agccagcagccccucucccuagacucagaggcgccgcggggagggguggccccgccgaggcuuc

SEQ ID NO: 242594 - RNA, 64 nt, Human
ggcggagcuggccccgccgccugguacucaagcccgcggggacauugggaaggggacccccgcc

SEQ ID NO: 242595 - RNA, 64 nt, Human
gggacgcuaaaagaaccgggccugccccgcccugcgcggggauaacgaaagcugaguguuuuuc

SEQ ID NO: 242596 - RNA, 64 nt, Human
cacuggucaguuccgcccccgugguaggcagacgcgcggggaaauucggacccaggagcccagc

SEQ ID NO: 242597 - RNA, 64 nt, Human
gccgccacaucacagcacaaguggcugcagccuccgcggggaaccaggcgggagggacugagug

SEQ ID NO: 242598 - RNA, 64 nt, Human
gcgccggggcacagggagggacagcgggaggugucgcggggagccuggugcccuucuagauggg

SEQ ID NO: 242599 - RNA, 64 nt, Human
gcugcccacccuggagggcugcgcccgcgccaggcgcggggacguguuucuggguucuaggccc

SEQ ID NO: 242600 - RNA, 64 nt, Human
gccggcaaaacuuuggcacuggggcacuuggcagcgcggggagcccgucgguaauuuuaauauu

SEQ ID NO: 242601 - RNA, 54 nt, Human
gcuggauccacuucaucugagccgcgcggggaccggccaccuggagccuccaca

SEQ ID NO: 242602 - RNA, 64 nt, Human
gccggcgcguucuggcgacaggggagccaggggccgcggggaagcgaggacuggccugcgcugg

SEQ ID NO: 242603 - RNA, 64 nt, Human
ggccggaccaugcugguccugaccagcuagccuacgcggggauggccgucaguucuggccacag

SEQ ID NO: 242604 - RNA, 64 nt, Human
gguguccugucuacaucuacagcuguucacuggaagcgcugagggaacaaaugguuggcaugca

SEQ ID NO: 242605 - RNA, 64 nt, Human
agggaggacucaaugcucuuuguaugccuuaugcagcgcugaucugucccuggaguucccaggu

SEQ ID NO: 242606 - RNA, 64 nt, Human
uuagcuuugcuuuucuccccauaucccaaggcgaagcgcugagauucuuccaucuaaaaaaccc

SEQ ID NO: 242607 - RNA, 64 nt, Human
cagccaugaacaaggugaggaagaagaaagaggaagcgcugaauuaucugaacuggagaagcaa

SEQ ID NO: 242608 - RNA, 64 nt, Human
cugagcagcgagccugcgucugucucagcuguccagcgcugagggccagggucuugugcugugg

SEQ ID NO: 242609 - RNA, 64 nt, Human
caacacacagggcaaguggugucgauggagucgaagcgcugaaggaauagggcggcuuuccuuc

SEQ ID NO: 242610 - RNA, 64 nt, Human
uauaaaaaacucauaaggcaagagcugagaaggaagcgcugaucuucuauuuaauuccccaccc

SEQ ID NO: 242611 - RNA, 64 nt, Human
uucccucguaguuggcaggagcuccuggaagcacagcgcugagcauggggcgcucccacucaga

SEQ ID NO: 242612 - RNA, 64 nt, Human
ucacuuuuaggauguaacuuuauaaauaaacaugagcgcugaugauuugcagaucagucuugcu

SEQ ID NO: 242613 - RNA, 64 nt, Human
accagugucuggaucccagcaucuucuccacuucagcgcugaguucaguauacacaagugucug

SEQ ID NO: 242614 - RNA, 64 nt, Human
ccugcuggcucaccgugaggcagccgcgggagggagcgcugacgucacagaagcgaaggcuuga

SEQ ID NO: 242615 - RNA, 64 nt, Human
ggucuucaucuauucaugcucuaaacaguuccuaagcgcugacugugcgcuagacacugccagg

SEQ ID NO: 242616 - RNA, 64 nt, Human
ucucagcaucaggaaaggagaaaggcagagggagagcgcugagaagacuguucacgccagagug

SEQ ID NO: 242617 - RNA, 51 nt, Human
cuauuuuggggaagacaugaaagcgcugagcugagggacgaggaagagcug

SEQ ID NO: 242618 - RNA, 64 nt, Human
cacagaaacaauugagugcgauuauuggcuucugagcgcugagcagagcagguggaagaggaac

SEQ ID NO: 242619 - RNA, 64 nt, Human
cuuggucugucucgcuuuaucugucgccccucccagcgcugagagccuccccuggcugucagca

SEQ ID NO: 242620 - RNA, 64 nt, Human
gggauggcccccggcgcgggcucuugacccgcucagcgcugaccccaccgcccuggccgaggca

SEQ ID NO: 242621 - RNA, 64 nt, Human
aggggaacgggaaauaggucuccuaggugccugaagcgcugagcaaccuggguacccugguggg

SEQ ID NO: 242622 - RNA, 64 nt, Human
ugaacacugcuucucgaauggagucuaauggucaagcgcugaagauccaugucuccucuaccac

SEQ ID NO: 242623 - RNA, 64 nt, Human
auuagcaccagcuugcuucucugccgguggggccagcgcugaacagaccgggguggagucaggg

SEQ ID NO: 242624 - RNA, 64 nt, Human
cuacgaaucuuccgauggaugaaucucccacuccagcgcugagugggagaaggcagugauuagc

SEQ ID NO: 242625 - RNA, 64 nt, Human
gcaaagcuggacucaggaauguccuccaaccagcagcgcugaccuaagagcucccugugccguc

SEQ ID NO: 242626 - RNA, 64 nt, Human
uugguuuuuuacuggguacauuuuaucauuuauuagcgcugaagagccaacauauuuguagauu

SEQ ID NO: 242627 - RNA, 64 nt, Human
agcuagaaaacugaagaugucgucugcuuacggaagcgcugaaagacuaggaugugauuuauua

SEQ ID NO: 242628 - RNA, 64 nt, Human
caaucaugcaaagaccuugccuggcccgguggcaagcgcugaaaaaccgaccgccuguaggcuc

SEQ ID NO: 242629 - RNA, 64 nt, Human
aaacaaacagaaagcaccgucgagaaauggcuccagcgcugacuagcggccaccucauuucccc

SEQ ID NO: 242630 - RNA, 64 nt, Human
cacugaggagugaaagcgccuagggcuggagaauagcgcugaguuggguuugugacucuucccu

SEQ ID NO: 242631 - RNA, 64 nt, Human
agcaaaaucuggaucuugggaccuccaaacuuauagcgcugaccaacgcacaacagguagcaga

SEQ ID NO: 242632 - RNA, 64 nt, Human
uagucuuuguccggacccuuccauaguacaccuuagcgcugagacugagccagcuuggggguca

SEQ ID NO: 242633 - RNA, 64 nt, Human
uccuggaggccccaguccccagacaguuucagccagcgcugaggaaaauauauucaacugugaa

SEQ ID NO: 242634 - RNA, 64 nt, Human
agaaggacuggaaugccaugaacuggagaaggugagcgcugaagaaccaggaugggacggggcu

SEQ ID NO: 242635 - RNA, 64 nt, Human
uaacaaaccuugauguaccaguccaauaccauguagcgcugagugauaaaguuaaaaugugcug

SEQ ID NO: 242636 - RNA, 64 nt, Human
aggaagagcgggcugaggaaacccagagggaccaagcgcugagaccaaaguugacccucgggua

SEQ ID NO: 242637 - RNA, 64 nt, Human
ugaagagccacgcagagcaggagaagaaggcugcagcgcugaggcugaaggagaaagaggccgc

SEQ ID NO: 242638 - RNA, 64 nt, Human
guaaucagaaggcauccgacugcauuaagugugcagcgcugaaaagacauuuacaacuaggcca

SEQ ID NO: 242639 - RNA, 64 nt, Human
ggcuuuguccaucccgguccccagcugagugcccagcgcugagcugggugcacggugugauucc

SEQ ID NO: 242640 - RNA, 64 nt, Human
acagaggaugaggguuguggcagggccguccaucagcgcugaccuuccgggggcccagagcuuc

SEQ ID NO: 242641 - RNA, 64 nt, Human
agccguggguggaaccaggaaccuccuccacaccagcgcugaugcccaauaaagaugcccacug

SEQ ID NO: 242642 - RNA, 64 nt, Human
gcagggcaagccaguggcguggccucugccucuaagcgcugagcauugggccccuuccccacca

SEQ ID NO: 242643 - RNA, 64 nt, Human
ggagagcuugugcacagccucuggaaggaaaggcagcgcugacuucguugggcuuuuuuccaag

SEQ ID NO: 242644 - RNA, 61 nt, Human
cugccaugguguuggauugaagauugugcugagcgcugagcuugcgcucagggcuggcuga

SEQ ID NO: 242645 - RNA, 64 nt, Human
uguccugcaaaaggagguaaguuucucaccacguagcgcugaucaucccguguugcccgugcgu

SEQ ID NO: 242646 - RNA, 64 nt, Human
cuuggcuggguggagucucugaaauguuagaagaagcgcugaagccuugauugauaguucugcc

SEQ ID NO: 242647 - RNA, 64 nt, Human
uccgcuauuuaggcucucaacaucauguagacaaagcgcugaacuugauugggaagaaguucaa

SEQ ID NO: 242648 - RNA, 55 nt, Human
gcuuuggguacagcaugugagaugaagcgcugauccuguagucaccuauuuucgu

SEQ ID NO: 242649 - RNA, 64 nt, Human
caaggguggacagacucagacccccagcaugguuagcgcugaccuucauugaggucccuuugga

SEQ ID NO: 242650 - RNA, 64 nt, Human
gaacuaccucauucggcaaauuagccccaaauugagcgcugaaucgugucccaugagaucaggc

SEQ ID NO: 242651 - RNA, 64 nt, Human
cugagcuccccuucccuucucaaagcaagaagggagcgcugaggcaugaagcccuggggaaacu

SEQ ID NO: 242652 - RNA, 64 nt, Human
augcagauaggcgguugagugggguccugggaagagcgcugaaucccucugcuugcugccuggu

SEQ ID NO: 242653 - RNA, 64 nt, Human
ccucaggugugauccgcccgccuccgccuccccaagcgcugagauuacaggugugagccaccgu

SEQ ID NO: 242654 - RNA, 64 nt, Human
ggguugcgcacagccagccgcguggaucccacgcagcgcugaaccgaaccgaguaggaagccuu

SEQ ID NO: 242655 - RNA, 64 nt, Human
gagaguguauugcuaacccuuccaggucuaguccagcgcugagauuuggugguucugcaugugu

SEQ ID NO: 242656 - RNA, 64 nt, Human
uuuguggcggaagacggggcccagcggcucccccagcgcugaagcacgggguucagcggcuccc

SEQ ID NO: 242657 - RNA, 64 nt, Human
gcgucuccucgguuuccuugccucacccgcggagagcgcugaaccuggacaagcagcggcuggg

SEQ ID NO: 242658 - RNA, 64 nt, Human
auguugcagcugugaugaccgccccagaucgguuagcgcugaguucaucaaaagggagggggug

SEQ ID NO: 242659 - RNA, 64 nt, Human
cuuaucuggguggguggggaugccuguuuacacuagcgcugacucccaacggugacggcucccu

SEQ ID NO: 242660 - RNA, 64 nt, Human
uccaaggcuuuaaagccacauuucagcaagagaaagcgcugagagcucgcagguucauuaaaga

SEQ ID NO: 242661 - RNA, 64 nt, Human
gcucaaggucaccuguuuaaugccaagauaacaaagcgcugauccaaguugcucuguaggaauu

SEQ ID NO: 242662 - RNA, 64 nt, Human
aucacccgccccuggacuucuuaguuguuucucuagcgcugagcuaucuccuaacuuuggaccu

SEQ ID NO: 242663 - RNA, 64 nt, Human
acaaguuaguuggaagccggcguucgguaucagaagcgcugauggucauauccaaucucaauau

SEQ ID NO: 242664 - RNA, 64 nt, Human
acgcuuuaagaccaucugugguuuucagugaacaagcgcugagcaccagcagcagaaaacaaca

SEQ ID NO: 242665 - RNA, 64 nt, Human
gugggucccuuucccuguuaagcagacaggaugcagcgcugacuucuuaggucagggcggaggu

SEQ ID NO: 242666 - RNA, 64 nt, Human
aaguguucuagaguguuguugcuuuuuuaaaaaaagcgcugaaguuagaccaagguauacaguu

SEQ ID NO: 242667 - RNA, 64 nt, Human
cuccggcuuucucugaaaugaacacugcucuucagcaguucaaguacuuguucucaaaacauuu

SEQ ID NO: 242668 - RNA, 64 nt, Human
caaaaguacaauaugaagccuucauuuaaucucugcaguucaucucauuucaaauguuuaugga

SEQ ID NO: 242669 - RNA, 64 nt, Human
uuccuccauccuugcugggggcccauggcuuguggcaguucagcuucacccucaggaguggccc

SEQ ID NO: 242670 - RNA, 64 nt, Human
guuuguuaugauguaaauuuuauuugguuuguacgcaguucaauuucaaaauugcuaaaaugug

SEQ ID NO: 242671 - RNA, 64 nt, Human
gccugggcuuucugaggccuuaucugaugccucugcaguucaugucccccaccaggccucgagg

SEQ ID NO: 242672 - RNA, 64 nt, Human
aaguuuacuucauuaucugcuagugucauccacagcaguucauccucauccacacuaagccauc

SEQ ID NO: 242673 - RNA, 64 nt, Human
uuggaaaagcaggagagauauucugcaucaguuugcaguucacugcaaaucuuuuacauuaagg

SEQ ID NO: 242674 - RNA, 64 nt, Human
aaagguugguggucaacaaaaaaagcaagucauagcaguucagugccuuuguugguaguuuuua

SEQ ID NO: 242675 - RNA, 64 nt, Human
uacacacuguaccuuuuccuuucauacugaugcugcaguucagggcuggaguuguuaaggcauu

SEQ ID NO: 242676 - RNA, 64 nt, Human
acugaggaggaccccagcuuuucuugccagcucagcaguucacuuccuagagcaucugucccac

SEQ ID NO: 242677 - RNA, 64 nt, Human
uggucauagaccagucucuuuguaaguuauuguggcaguucacacaguagccaccaggggucuc

SEQ ID NO: 242678 - RNA, 64 nt, Human
ccaaaguauaguacaaccacagcucagaauuccagcaguucauccagucagagcaaaaugguua

SEQ ID NO: 242679 - RNA, 64 nt, Human
gacuggcccuuaagccaaacucaggcccagaauugcaguucagaauggcaguccuggaggcagg

SEQ ID NO: 242680 - RNA, 64 nt, Human
gccaagacaguuuagcauggagcuauuccuuggugcaguucaggauaugaacacagguacaguc

SEQ ID NO: 242681 - RNA, 64 nt, Human
cuggccgauccaaggcuguggagucccagagccagcaguucacuggugcucauuccacacuggu

SEQ ID NO: 242682 - RNA, 64 nt, Human
cauaguuuaggcccauuuaccuuccccuguacuggcaguucagccgcuuacaugcacucacccu

SEQ ID NO: 242683 - RNA, 64 nt, Human
cuugcaucauaacacuaaaaguuuacaagaacaugcaguucaaugaucaaaaucauguuuuuuc

SEQ ID NO: 242684 - RNA, 64 nt, Human
cagucugaauccauggggcugaaggguaaauugagcaguucaugacccaggauaucugaaaaua

SEQ ID NO: 242685 - RNA, 64 nt, Human
acaccucugccaccccagguuuuucaucugaaaagcaguucaugucugaaacagagaaccaaac

SEQ ID NO: 242686 - RNA, 64 nt, Human
gggaugggguggucugugaauaugugacauuucugcaguucaguauccgaagguuucucuuggg

SEQ ID NO: 242687 - RNA, 64 nt, Human
ccucuucaaucagauuguaaguuaccugaaagcugcaguucacaggcuccucucuccaccaaau

SEQ ID NO: 242688 - RNA, 64 nt, Human
ccaccacgugagaauggccauaagcagauaaguagcaguucaacuggaugucucucuucuccaa

SEQ ID NO: 242689 - RNA, 64 nt, Human
augauuucccuuaacucaaaccaugcaaguuacugcaguucaucucaugggaggggcugaaaua

SEQ ID NO: 242690 - RNA, 64 nt, Human
agcuuggcucggggagaaaccugguaacauaaaagcaguucaguggcccagagguuauuuuuuu

SEQ ID NO: 242691 - RNA, 64 nt, Human
caggccaugucuaaugaccagcucgauucccugugcaguucagagggcaagugaacccaaccaa

SEQ ID NO: 242692 - RNA, 64 nt, Human
uacagcuauacccagaccuuuuauagguaaugaagcaguucaaaacuugaaagaaaacaaaacc

SEQ ID NO: 242693 - RNA, 64 nt, Human
aaaaaaugcaauuuucuggccacaagggcauagugcaguucacuuacguguugauguaguuuau

SEQ ID NO: 242694 - RNA, 64 nt, Human
ugaauugcuuaaguauaauuuauagaauuucagugcaguucauucuuaauggaaaaucugaaac

SEQ ID NO: 242695 - RNA, 64 nt, Human
aaauaguggcauuccauagcugaggguaguaggagcaguucacccugggagcagacaauaagag

SEQ ID NO: 242696 - RNA, 64 nt, Human
guaaagaaaacauuuuaaaauuacaauuagcagagcaguucauguuuaagggcaucacuuuuau

SEQ ID NO: 242697 - RNA, 64 nt, Human
uacaguauauaacuacaagauaguacauuuuguagcaguucaaagccaaaguugcuagcaucau

SEQ ID NO: 242698 - RNA, 64 nt, Human
uagguguuuaauuuucacucuucauguucaauuagcaguucaaauuaaagaagaugguuauugg

SEQ ID NO: 242699 - RNA, 64 nt, Human
gccacuaccaugcuguccauggaaggaauaaucagcaguucaguugucacaagccgcccuugaa

SEQ ID NO: 242700 - RNA, 64 nt, Human
cugucagaauaacuucuaaaagguauuuuuauaagcaguucaaguuacugaaaaccuuuuaaac

SEQ ID NO: 242701 - RNA, 64 nt, Human
ggacugugaagucaacaauaauggcaguaacagggcaguucauuccaaauccagcacugcuguu

SEQ ID NO: 242702 - RNA, 64 nt, Human
uccauaaaugucggugcauaccuuauguaagggagcaguucaauaauccaugaaagaacuuaag

SEQ ID NO: 242703 - RNA, 64 nt, Human
agggaguuucguaagcaaaauagaggacagaaaugcaguucaugaacuugcugguugguuuuuc

SEQ ID NO: 242704 - RNA, 64 nt, Human
aaauguauggcaucauuuagggaugccugagauggcaguucaugaagcacagaagauaaagaag

SEQ ID NO: 242705 - RNA, 64 nt, Human
uauaaugggaaauguuuggccaugcuugguuguugcaguucagacaaauguaacacacacacac

SEQ ID NO: 242706 - RNA, 64 nt, Human
auacaguuuuccuaaauguauaccuguaacugcagcaguucaccuauuucaaaaauuuggaauu

SEQ ID NO: 242707 - RNA, 64 nt, Human
agagagcuaauagcuaccagcuaccuacagauuugcaguucauaaucccgcauguugucaacau

SEQ ID NO: 242708 - RNA, 64 nt, Human
cucaucagaugacguggcuuugucuagacagcacgcaguucagaaagaaaugucuuuauacaaa

SEQ ID NO: 242709 - RNA, 64 nt, Human
aauauguauaaagaaaugagguugacucuucugagcaguucaucuuuuccagagguaaggguag

SEQ ID NO: 242710 - RNA, 64 nt, Human
agcuggacuguacagaacacuccaagggccaauggcaguucagcgcaaggagagggagggccca

SEQ ID NO: 242711 - RNA, 64 nt, Human
cccucugacaagcagcaccugagcagaugcugaggcaguucauuaaaccaggccucagcuucag

SEQ ID NO: 242712 - RNA, 64 nt, Human
gaauuuuuacagguucguuuuugaauugugagaggcaguucauuagcaaagauguacugggcag

SEQ ID NO: 242713 - RNA, 64 nt, Human
guuaaacguucuaaaaagaggcgaaaggaagcaagcaguucagaagagccaaggaauaaacaug

SEQ ID NO: 242714 - RNA, 64 nt, Human
aaguggugacuggguaaggaaaccacuugggguagcaguucaacaauucacuuacgaauguuua

SEQ ID NO: 242715 - RNA, 64 nt, Human
aauagguauguagugguauuaauuguuuuaaucugcaguucaccaauaauauaugaauuuagca

SEQ ID NO: 242716 - RNA, 64 nt, Human
auuuuucugaaguagccucacauguggucccccugcaguucagcaguuaacagaugacuuuuuu

SEQ ID NO: 242717 - RNA, 64 nt, Human
agacauugacagcaauucaugguucaaguauuaagcaguucauucuaccaagcugucacagguu

SEQ ID NO: 242718 - RNA, 64 nt, Human
aagauuuaaaaugugucuaauacacugauaugaagcaguucaacuuuuuggaugaauaaggacc

SEQ ID NO: 242719 - RNA, 64 nt, Human
ggauccuguucuuucagcaggugaaaaauaaaacgcaguucaaauuucaugguuuuaauuuuca

SEQ ID NO: 242720 - RNA, 64 nt, Human
cuugcagaccuccugagguacacagaauagcugagcaguucacuucagggaucaggucaucucu

SEQ ID NO: 242721 - RNA, 64 nt, Human
aauugagccauauuuuggcuaucggcuggaaccagcaguucagagaucugccuuauaaacauuu

SEQ ID NO: 242722 - RNA, 64 nt, Human
ugcguccuauaucuagcagcaugggguacguuuggcaguucacuccauuaggggguaaauaauu

SEQ ID NO: 242723 - RNA, 64 nt, Human
cugggguuucuggaugggaaauaaaaaaauaaaggcaguucauuuccccacuguggcucucucu

SEQ ID NO: 242724 - RNA, 64 nt, Human
ugauauaaagaaugaaaguagcuguaugagcagagcaguucaagggccaaacccuggaacggua

SEQ ID NO: 242725 - RNA, 64 nt, Human
caggccacagccuggccucgggaagguggcuccugcaguucagcgucccugggcccauuaaucc

SEQ ID NO: 242726 - RNA, 64 nt, Human
ucccugccuccuuugagaucugcgagcccuugcugcaguucagauucaacaaggcccucugccc

SEQ ID NO: 242727 - RNA, 64 nt, Human
gggggcgauccuaucaugacuuaacaucaagcgcgcaguucaaaacuacugucuucugucaaag

SEQ ID NO: 242728 - RNA, 64 nt, Human
gcuaagcagaaaagaaauuuggaccuugaaaccagcaguucaacauauauacuuuuugcaaaau

SEQ ID NO: 242729 - RNA, 64 nt, Human
aggaauuccagaaaauuauuaauccgugcugcuugcaguucauucauauggccccucuuaacca

SEQ ID NO: 242730 - RNA, 64 nt, Human
gcagccaaugucuagcuggaccugcccucaucuugcaguucauacaggcacuguuugagagauu

SEQ ID NO: 242731 - RNA, 64 nt, Human
agcccaaacuuucgaucuaggugggugauguguagcaguucaagggaagggugcuguguuuuca

SEQ ID NO: 242732 - RNA, 64 nt, Human
agaggaaguggaaggcaucagucccuauguauuugcaguucaccugcacuuaaggcacucuguu

SEQ ID NO: 242733 - RNA, 64 nt, Human
gcacgucuguuguaaugcaaagcauauuuggcaagcaguucaucaccaggacacuagcuaugau

SEQ ID NO: 242734 - RNA, 64 nt, Human
cugccguuuuccugcaauuccgcuuccuacuuaggcaguucagagagaacaauucuaauaaaaa

SEQ ID NO: 242735 - RNA, 64 nt, Human
aaugugauggaaaagcauugaugagaauuuauuggcaguucagauuguguuuucccaacuuagg

SEQ ID NO: 242736 - RNA, 64 nt, Human
agcccaagaacaaaggcuuucugaaucuucucaggcaguucagauuuaaagcaccauccaaacc

SEQ ID NO: 242737 - RNA, 64 nt, Human
auuucuguacuagugagaagagggaauaugcauugcaguucagcaaagccggaauucuguguug

SEQ ID NO: 242738 - RNA, 64 nt, Human
aaggacuguuaacccuccuagaagcucuaugugugcaguucagugagcgcauuuuucuuuugug

SEQ ID NO: 242739 - RNA, 64 nt, Human
gcacugcuccaguggggccaugauugguuucuaggcaguucaaagcaggauauguuaaguaaca

SEQ ID NO: 242740 - RNA, 64 nt, Human
guaugauguagguaaaaauauauaccuucgggucgcaguucaccauuuauaugugguauuaaaa

SEQ ID NO: 242741 - RNA, 64 nt, Human
uuaaacaucccaggucucauccuucaggaauuuugcaguucaaugagaagagggagacaaauau

SEQ ID NO: 242742 - RNA, 64 nt, Human
uucaugaagcuuugcuuuaagugacacuacgcgugcaguucauuucuaguucuugauagaacug

SEQ ID NO: 242743 - RNA, 64 nt, Human
uucauuugaagguggcuccugccaccugcuaauagcaguucaaacuaaauuuuuuguaucaagu

SEQ ID NO: 242744 - RNA, 64 nt, Human
acauggauguguugccccuccuccgcaugccaacgcaguucauguacaaggccccucugcaacu

SEQ ID NO: 242745 - RNA, 64 nt, Human
agggauuuuuuaaaguuaauuugggaaauuaacagcaguucacuuuauugugagucuuugccac

SEQ ID NO: 242746 - RNA, 64 nt, Human
caugugcagagcuggccaccagcacaggcuuagggcaguucagaacccacuuguuucccuauca

SEQ ID NO: 242747 - RNA, 64 nt, Human
gcaggcaagacuuuucagugacgccuuguggaacgcaguucaugauguccuagcagcucucacu

SEQ ID NO: 242748 - RNA, 64 nt, Human
ugggaggccgaggcgggcggaucaccugaggucagcaguucaagaccagccugaccaacauggu

SEQ ID NO: 242749 - RNA, 64 nt, Human
ugaguaggcggcgauuuuuguauguuaugaacaugcaguucauuauuuugugguucuauuuuac

SEQ ID NO: 242750 - RNA, 64 nt, Human
uuuucacuuuucaaagaauuuaaccuauuuuacagcaguucaguucugcuagugaguaguuuuc

SEQ ID NO: 242751 - RNA, 64 nt, Human
ccuauagucgcagcacuuugggaggccaaggugggcaguucacgugagguggggaguucgagac

SEQ ID NO: 242752 - RNA, 64 nt, Human
aguuuuaaaauuacauuuggaaaaugagaaggaggcaguucaaauauagcuuucugcaugaacu

SEQ ID NO: 242753 - RNA, 64 nt, Human
gacuuuaagaaagaucaacauauguuaagaacaugcaguucaguuuguuucagauuaauuuuuu

SEQ ID NO: 242754 - RNA, 64 nt, Human
acugcacaaaauuacagugcuaauguauaugguugcaguucacauaaagacaaaagcaucuguu

SEQ ID NO: 242755 - RNA, 64 nt, Human
aguuccucauuucaaacaguauacauacuucuuugcaguucauuauaguaaggcuuaaccugua

SEQ ID NO: 242756 - RNA, 64 nt, Human
uuuugagacagagucucacucugucacccaggcugcaguucacuggugugaucucagcucacug

SEQ ID NO: 242757 - RNA, 64 nt, Human
gaaccuuuaaaguaaaggccucaucuccuuuauugcaguucaaauccucaccauccacagcaag

SEQ ID NO: 242758 - RNA, 64 nt, Human
cacugccuagugguuugguagaucugacuuguaagcaguucauagaagcugcucaauacucaag

SEQ ID NO: 242759 - RNA, 64 nt, Human
uauacuguuugcuuuacuaaucaccuaauucauugcaguucauacuuauugacucagaguuuaa

SEQ ID NO: 242760 - RNA, 64 nt, Human
cugcaacccaaguggccuuauccgugcagugguggcaguucagaaauaaagggcccauuugugg

SEQ ID NO: 242761 - RNA, 60 nt, Human
acaaggccaagggcaaguagcggggcuggagcaguucauuacucauaccucgguccaaac

SEQ ID NO: 242762 - RNA, 64 nt, Human
agccauucacaagcauucaaaaccaaaccaaacagcaguucauauaccugccugagauaggcug

SEQ ID NO: 242763 - RNA, 64 nt, Human
ggcagagcggcagagcggcaagcagagcggcaaggcaguucaacccaauggaaauggauugaaa

SEQ ID NO: 242764 - RNA, 64 nt, Human
uaaacacaaauuugcugcacagaauaucaccauugcaguucaaaacaaaacaaaacaaaaaguc

SEQ ID NO: 242765 - RNA, 64 nt, Human
guuuuauauuauaacucugaagcaugauaaaggggcaguucacaauuuucaccauuuaaacaca

SEQ ID NO: 242766 - RNA, 64 nt, Human
agcaaauguaaaacuggauaagaaaauuauuuuggcaguucagcccuuucccuuuuucccacua

SEQ ID NO: 242767 - RNA, 64 nt, Human
guauauguuacaauaaaucucagaacuucaaguagcaguucaaaagaugucaguuuuuaaaauu

SEQ ID NO: 242768 - RNA, 64 nt, Human
acacaucugugucaucacgcacugaagacaggaagcaguucacugagucagcugguucccaagc

SEQ ID NO: 242769 - RNA, 64 nt, Human
aagaaauuguaaaauaucacauaauauagaaauggcaguucaaagagaauuguggcagauguug

SEQ ID NO: 242770 - RNA, 55 nt, Human
aagauuguggucucuuuuaaguuuugcaguucaugguaaaaugcauuuucaaacc

SEQ ID NO: 242771 - RNA, 59 nt, Human
ccaccaccucaucucugugauugugaauugcaguucaguucuuguguuuuuagacuguu

SEQ ID NO: 242772 - RNA, 64 nt, Human
gguaaacugucauuagaauaauucuuagaaauaggcaguucaagcaaagaaggcacacuguuaa

SEQ ID NO: 242773 - RNA, 64 nt, Human
uggugcaggggcaauuaccauggcagcugcucaagcaguucaggcuacagcucagguaaaaagu

SEQ ID NO: 242774 - RNA, 64 nt, Human
uuagucuuucuauguuucugcauccagauagagugcaguucaugagggagggggcgggggacug

SEQ ID NO: 242775 - RNA, 64 nt, Human
aauugguacagacugaaaccuuuauaggaguuaugcaguucagaaguggacuuuagguaaguca

SEQ ID NO: 242776 - RNA, 64 nt, Human
auuuaauggagcauguacuuauuugcauuugcuggcaguucaggcauaguuaaagugagaguuc

SEQ ID NO: 242777 - RNA, 64 nt, Human
agcuaccgaagucacccagccauucccaugagcagcaguucauuuaauugucacagcgucgcca

SEQ ID NO: 242778 - RNA, 64 nt, Human
ucuucaucuauuccuguacuaaugguuucucuuugcaguucacagagaauuuggggcucucuuc

SEQ ID NO: 242779 - RNA, 64 nt, Human
aguuucauccuaaaauauauacuacaggaaagcugcaguucauuuucaugcauggaucauuaca

SEQ ID NO: 242780 - RNA, 64 nt, Human
aggcuccuugggugaugcuggaguugucauggccgcaguucagugugagauuuuuuaccaggua

SEQ ID NO: 242781 - RNA, 64 nt, Human
acagugcuuacauauguuaauaaacugcaaaugugcaguucaguuugucucuuugcaacuccug

SEQ ID NO: 242782 - RNA, 64 nt, Human
augauaugaaccuuuuuuggguggggggugcggggcaguucacucugucucccaggcuggagug

SEQ ID NO: 242783 - RNA, 64 nt, Human
ucuuccuaucugcuucuugcggcugaggagaggagcaguucaguuuacaaaacaagugcaaauu

SEQ ID NO: 242784 - RNA, 64 nt, Human
ccuuuugcaaucagauaaauaaauaucacugaaugcaguucauccucggcccccuuucccuccg

SEQ ID NO: 242785 - RNA, 64 nt, Human
gaagaaagugcuggaaauagcuucuauauagucagcaguucaccuggagaaagaucuuaauucc

SEQ ID NO: 242786 - RNA, 64 nt, Human
cuuuagcaaguacagucaguacaucaaagacugagcaguucagugguacauaaauuuaucucgc

SEQ ID NO: 242787 - RNA, 64 nt, Human
uauguuaaguugaaguaaaagcaaguacucuggagcaguucauuuuacaguaucuacuugcaug

SEQ ID NO: 242788 - RNA, 64 nt, Human
gccacagucgugcugcuagaacagucucguagcugcaguucagcugugcuuccucagccuacua

SEQ ID NO: 242789 - RNA, 64 nt, Human
cacagagaugaccagaggauggggccacugcagugcaguucaagaggcucugguucggggaaga

SEQ ID NO: 242790 - RNA, 64 nt, Human
ccccuggauuggcuguaauuugccucgaaguucagcaguucaucuucaugggaaauuugcugag

SEQ ID NO: 242791 - RNA, 64 nt, Human
cuugcccaagugugagauuaccuuucuguuccuugcaguucaccucacuuuccguccuuuguag

SEQ ID NO: 242792 - RNA, 64 nt, Human
uggaguuauggaaaagaugcccugugccaggacagcaguucauuguuacuguaaccgauuguau

SEQ ID NO: 242793 - RNA, 64 nt, Human
aaagucuuuuggcugaauggugagcagccacugugcaguucaacguaagugugccuuaauugca

SEQ ID NO: 242794 - RNA, 64 nt, Human
cccuuccauuucacacaaagaaauagacacaacugcaguucacaaguaguacuggcuccacccc

SEQ ID NO: 242795 - RNA, 64 nt, Human
accagcccuucuguucuagggaaauaaaagucuagcaguucaaaguuuaaguuuuaagagacgu

SEQ ID NO: 242796 - RNA, 64 nt, Human
gugccuucugugugucagucccuggccacucacugcaguucaaggcccccuuuccgcucugcug

SEQ ID NO: 242797 - RNA, 64 nt, Human
uccuacugugaaaucaugucuguauuuuucuggagcaguucacauagaguagaauguggaauuu

SEQ ID NO: 242798 - RNA, 64 nt, Human
guaaaugucuuuuucccuccuuucuucuaguaaugcaguucaugggcuuuagguacuucaguua

SEQ ID NO: 242799 - RNA, 64 nt, Human
gauccacaaccuuuaacagggauccaagaucuuugcaguucaaucgaccacauaggaauuucca

SEQ ID NO: 242800 - RNA, 64 nt, Human
acaugagaggaagucggcguccuggccacgaaaugcaguucacuuuuuuuuaggcuuuuauaug

SEQ ID NO: 242801 - RNA, 64 nt, Human
auuugauauucagugcaauccauugcaugcauuagcaguucaaagauuaaauaugaucauauca

SEQ ID NO: 242802 - RNA, 64 nt, Human
agggaaaugcuuuucugcagaggccccugcuugggcaguucacagugagaccgacccccucuga

SEQ ID NO: 242803 - RNA, 64 nt, Human
cucacucaaaccagcacagggaguccucagaguugcaguucaauucauuuuaauuagaaaagua

SEQ ID NO: 242804 - RNA, 64 nt, Human
cuacuccguauuaugucucuucucguacguggcugcaguucauagcagugaggaagaucucaga

SEQ ID NO: 242805 - RNA, 64 nt, Human
gauagaagacagacucuuugaugaggucggcggagcaguucacuagccaaugaugagagcagaa

SEQ ID NO: 242806 - RNA, 64 nt, Human
ccauaggccauuuggacucugccuucaaacaaaggcaguucaguccacaggcauggaagcugug

SEQ ID NO: 242807 - RNA, 64 nt, Human
agugucuuguccuuaguaauuauuugcuuucccugcaguucaauuucuccuuggaacucuaaca

SEQ ID NO: 242808 - RNA, 64 nt, Human
caggagagauggcuuguccccugcccugaagcuggcaguucagucccuuauucugcccuguugg

SEQ ID NO: 242809 - RNA, 64 nt, Human
gaucucggcucacuucagccuccgccaccucaaggcaguucaagcaauucuccugccucagccu

SEQ ID NO: 242810 - RNA, 64 nt, Human
uuccaagaaauuaagcauaacagucucaucuacggcaguucauuacacugucaauguuaacauc

SEQ ID NO: 242811 - RNA, 64 nt, Human
aagugugcuuauuuuaaauguuacugguagaaaggcaguucagguauguguguauauaguauga

SEQ ID NO: 242812 - RNA, 64 nt, Human
cuuucaucuguuccuacugagcuggucccagccagcaguucagagcugcccucuccugggcagc

SEQ ID NO: 242813 - RNA, 64 nt, Human
uuuuuucuuuuuggggaggaguugauaugcaacugcaguucauccgcacuguaaauacauguau

SEQ ID NO: 242814 - RNA, 64 nt, Human
uccuuucuucuuaguauuugcugcauaauugagagcaguucacaucgauuuccugguaggcguc

SEQ ID NO: 242815 - RNA, 64 nt, Human
cauguucugugacauccugcuucuucuuccaaaugcaguucauugcagacaccaccauauugcu

SEQ ID NO: 242816 - RNA, 64 nt, Human
guuguugccagcaugaucuuuuuggggcuuagcagcaguucagucaaugucauauaacgcaaau

SEQ ID NO: 242817 - RNA, 64 nt, Human
agauaccuaguaugauggagcugcaaauuucauggcaguucaugcagucggucaagaggaggau

SEQ ID NO: 242818 - RNA, 64 nt, Human
ucaucacuaaaaauuuguuccuuuuucacuaugggcaguucacacaaggcaaaaacuauugaac

SEQ ID NO: 242819 - RNA, 64 nt, Human
ccaugucugagaggggugaaagaggagaccaauggcaguucagguucaagauaacggggucagg

SEQ ID NO: 242820 - RNA, 64 nt, Human
cagagggcccagaauggccccacucuguucccaagcaguucaugauacagccucaccuuuuggc

SEQ ID NO: 242821 - RNA, 50 nt, Human
cucagcacaccaaugugugagcaguucagccugcagcagaggagggcacg

SEQ ID NO: 242822 - RNA, 64 nt, Human
uguugguaaagcacaugguucaaaucuagaagaugcaguucaaaaacaagacagacucgaguug

SEQ ID NO: 242823 - RNA, 64 nt, Human
ucagguggggcaacauuccccuggaugaugcugugcaguucaaccaucuggagguggucaaacu

SEQ ID NO: 242824 - RNA, 64 nt, Human
agggugugacugaaugguggcuagauuagugggagcaguucaccuggaugaagauugagagcau

SEQ ID NO: 242825 - RNA, 64 nt, Human
ggauggggaagaggcccgucgggaguucugcauggcaguucacugcaugugcugcccccuuggg

SEQ ID NO: 242826 - RNA, 64 nt, Human
guugcagugaacaccauuucagagcucucagugugcaguucaggaauuaagauacuuggaauag

SEQ ID NO: 242827 - RNA, 64 nt, Human
guaguuuagccagacuuguuuugcuaucuuauaagcaguucagaauuagggaaugcugguuuug

SEQ ID NO: 242828 - RNA, 64 nt, Human
ucucagccugcccccgcauggcaguuccuagguugcaguucagggaagggaaacaauaaaucuc

SEQ ID NO: 242829 - RNA, 64 nt, Human
caaauuucauuucacauuuuuguaaugcuguacagcaguucacaaaaaaauguucauuguagau

SEQ ID NO: 242830 - RNA, 64 nt, Human
guucuuaccaaaaaauaaaauuacuuuguaaauagcaguucacauuuuuccacaguauaaugga

SEQ ID NO: 242831 - RNA, 64 nt, Human
ggcggaaguugcagugagccgagauugcaccacugcaguucagccuggaugaugagagugagac

SEQ ID NO: 242832 - RNA, 64 nt, Human
aagauucugagccuggaauuaggaccccauggaggcaguucaguaacuaaacuaauaaaguuuu

SEQ ID NO: 242833 - RNA, 64 nt, Human
aaagugccauuucgccauuauuugugaucgguaggcaguucagagcauaaguuaacugugaaaa

SEQ ID NO: 242834 - RNA, 64 nt, Human
gccuccucccuucccuuccacucuuuaaaguucugcaguucaccaacugguaguccauuaaauu

SEQ ID NO: 242835 - RNA, 64 nt, Human
acaacuguuuucaacuccaagagcuaaacuauuggcaguucauguuaaguuagagugagggugu

SEQ ID NO: 242836 - RNA, 64 nt, Human
ugaccaauacuacuguaaauguauuugguuuuuugcaguucacaggguauuaauaugcuacagu

SEQ ID NO: 242837 - RNA, 64 nt, Human
ucaugucagcacucaaaaaguucuggaucuuggagcaguucagauuuucagauuagggaugcuc

SEQ ID NO: 242838 - RNA, 64 nt, Human
uguguuacacccucacauuagugugcuguguggggcaguucaacacaaauguaacaauguauuu

SEQ ID NO: 242839 - RNA, 64 nt, Human
ggcuaaggcaugcuugaacuguguuugagagacagcaguucagucaguacauaauuuguuggug

SEQ ID NO: 242840 - RNA, 64 nt, Human
gcacugcagaggaucacuggaauccagaucgagcgcaguucaugcacaaggccccguugauuua

SEQ ID NO: 242841 - RNA, 64 nt, Human
augccggcuugagacuggagccccgcggugcagggcaguucaccggguccugcaggaccaggug

SEQ ID NO: 242842 - RNA, 64 nt, Human
ugcaucagcugaacgagaccauugacuacaacgagcaguucaccuggcgucugaaagagaauua

SEQ ID NO: 242843 - RNA, 64 nt, Human
uuguaguggucauggacagcuaagacugagcauagcaguucacauggucuggguaaacaaguca

SEQ ID NO: 242844 - RNA, 64 nt, Human
cccuucuaauagucugaaggaagaggcugugagggcaguucagggccagggcccacagggcauc

SEQ ID NO: 242845 - RNA, 64 nt, Human
agugccuggacggacccggagcccccgcauaucagcaguucacccaguacuccucagagacugg

SEQ ID NO: 242846 - RNA, 64 nt, Human
agauugggacaauagagacuggaagucaucaugugcaguucaccgcuucugagcuugcugcagu

SEQ ID NO: 242847 - RNA, 64 nt, Human
uacuccuuuccagaaguuccuggggcuccguguugcaguucaggacuccuugcuucuuggaccc

SEQ ID NO: 242848 - RNA, 64 nt, Human
ccugccccguggacuuaggggagcaccacgcgcugcaguucaccgaccuggccuucaagcaggc

SEQ ID NO: 242849 - RNA, 64 nt, Human
ucauaaggagugcacaaucuagauccuuuggugugcaguucacaguaggauuugggcuccuaug

SEQ ID NO: 242850 - RNA, 64 nt, Human
ugcaaucacuuuuuggaauugucuugauuuuucggcaguucaagcuauaucgaauauaguucug

SEQ ID NO: 242851 - RNA, 64 nt, Human
ccaaccauuccucuaauagccauuuaacgguacugcaguucaugggaaaauguccucauucuua

SEQ ID NO: 242852 - RNA, 64 nt, Human
acaaaaacccaccccuuuaaggaguugguaaaaagcaguucaacucuuagcuugacugagcuaa

SEQ ID NO: 242853 - RNA, 64 nt, Human
ugggaggcugaggcagguggaucaccugaggucagcaguucaaaaucagccuggccaaaaugcu

SEQ ID NO: 242854 - RNA, 64 nt, Human
gguauguuuauucuugguuuucaguagggaaauagcaguucagagagaggaagcucucuguccc

SEQ ID NO: 242855 - RNA, 64 nt, Human
guguauauuuguuugucaggcguuguguugaggagcaguucacgcacuggcugugucuauuccu

SEQ ID NO: 242856 - RNA, 64 nt, Human
ucugcccaggugucucuguuugcugcccaaggcagcaguucaugucucguccauguccauguuc

SEQ ID NO: 242857 - RNA, 64 nt, Human
cgcccacugcccuugcuguucugggaucuucgcugcaguucacgggaaacaagccugaguccgc

SEQ ID NO: 242858 - RNA, 64 nt, Human
aucuuuuuuggugugugggcgggggggguggggggcaguucagugaagucuagaagaccugcug

SEQ ID NO: 242859 - RNA, 64 nt, Human
augaccuauuuaagguaaacccauuccaacuacagcaguucagggcugauccaagcacugccuc

SEQ ID NO: 242860 - RNA, 64 nt, Human
gcuccuuaccuucucugcccugcuuuuuagaacugcaguucauuguuuuaagggauugggggag

SEQ ID NO: 242861 - RNA, 64 nt, Human
ucauccugaggauuuuaucaagaaagcagauuuggcaguucaaaagacuccugaaaugauaaau

SEQ ID NO: 242862 - RNA, 64 nt, Human
gcucuuuuauuuuuuuagguggaacugaaaggcugcaguucaguuuugggccaccugggguacu

SEQ ID NO: 242863 - RNA, 64 nt, Human
acagaaagcugaaaggaaucugcagucuccugcugcaguucaacucugcuguuuuucagucauu

SEQ ID NO: 242864 - RNA, 64 nt, Human
ccaucaggaccacucaguuaaggaagauccugaagcaguucagaaggaauaagcauuccuucuu

SEQ ID NO: 242865 - RNA, 64 nt, Human
uuacuccauuggugaaauggcccuuucccucuuugcaguucagucuaagucucguauuugcuuu

SEQ ID NO: 242866 - RNA, 64 nt, Human
uucucuuugauuuauuuuccccugcaugugagaagcaguucagaaaaaggucuauaucuccacc

SEQ ID NO: 242867 - RNA, 64 nt, Human
uuugcuuugggagaauuuggucuuaugcucauaagcaguucaugagugacaaguguagcaaaag

SEQ ID NO: 242868 - RNA, 64 nt, Human
uacaacuuugucuggguagaguuuuugaguuuuugcaguucaguaucccucugucuauucacac

SEQ ID NO: 242869 - RNA, 64 nt, Human
aaagcggaaacucuaggacuguguucaugggagagcaguucaucuguucagaacagugaggcaa

SEQ ID NO: 242870 - RNA, 64 nt, Human
uuucagggccuaaauuuaggagagugucccgagagcaguucauacaaagggcuuucucuaagac

SEQ ID NO: 242871 - RNA, 64 nt, Human
gacuuucgccucugggacaaguaagucaaugugggcaguucagucgucuggguuuuuuccccuu

SEQ ID NO: 242872 - RNA, 64 nt, Human
auguggcaaauuuuucagacaucguucauaccuugcaguucaucagugaacucauacuggagag

SEQ ID NO: 242873 - RNA, 64 nt, Human
uucgcuuuccacaguuuguuaccugcagucaacugcaguucaaaaauauuaaauggaaaauucc

SEQ ID NO: 242874 - RNA, 64 nt, Human
gagaugccugcccccgugaagcugguuggggagggcaguucaccagcauccauagaguaauaaa

SEQ ID NO: 242875 - RNA, 64 nt, Human
ucggaccguugacuuuauuugggggaguuuucccgcaguucaguuccugacugugcaaggccaa

SEQ ID NO: 242876 - RNA, 64 nt, Human
guccugguuuauauuggaccccucccuccgagcugcaguucaccuuugaccuugccucaccuuu

SEQ ID NO: 242877 - RNA, 64 nt, Human
uguuucuccugcaccccagccugucacgcuaucagcaguucaaggauuuccagcggcggauccu

SEQ ID NO: 242878 - RNA, 64 nt, Human
cagagauggauccaguuuccuggucauccccuuagcaguucacaaguuccuggcaaauguucca

SEQ ID NO: 242879 - RNA, 64 nt, Human
gaauuuuucucuuuuaaucuaucuacagcuuauagcaguucaauaaacuauacuucugggaacc

SEQ ID NO: 242880 - RNA, 64 nt, Human
auguggcaaauuuuucagacaucauucauacauugcaguucauugacacacucauacuggagag

SEQ ID NO: 242881 - RNA, 64 nt, Human
gagagcggggaugugacaugcccaaggccacggagcaguucagaguggaggcgggcuuggaacc

SEQ ID NO: 242882 - RNA, 64 nt, Human
ggggacaaucauucuuugaacauuagagaggaaggcaguucaagcuguugaaaagacuauugcu

SEQ ID NO: 242883 - RNA, 64 nt, Human
agcucuuugaaauagucugugugaaggugaaagugcaguucaguaauaaacuguguuuacucag

SEQ ID NO: 242884 - RNA, 64 nt, Human
ggaagcaccccaugccaaagcuaggguggcccuugcaguucagcaccacccuagucccuucccc

SEQ ID NO: 242885 - RNA, 64 nt, Human
cugcccuuguagcuuccccagaccccaacucacugcaguucaucugaacaaccugagcuccugg

SEQ ID NO: 242886 - RNA, 64 nt, Human
agccauuaucuaggauacuuucucucucuuucaugcaguucaaagcccagguaucucucagauc

SEQ ID NO: 242887 - RNA, 64 nt, Human
ggggaaagaauguugcuuacuuuuuaccaggagugcaguucauuuuuuucacccuguuuuugaa

SEQ ID NO: 242888 - RNA, 64 nt, Human
uacaaaagucuuucugacauacacacugcagguggcaguucaagaagaaucaaccuuuuucauu

SEQ ID NO: 242889 - RNA, 64 nt, Human
cuuuuuucucuuuugagaugaagucgcccgggcugcaguucaguggugcaaucucagcucacug

SEQ ID NO: 242890 - RNA, 64 nt, Human
cuguauuuaguaaaaauaaaucaaggcuaucggagcaguucaauaacaaagguuacuguugaga

SEQ ID NO: 242891 - RNA, 64 nt, Human
cgacagucaucuccuucugcugggagaauuagcagcaguucagggggcuuauguuauguccuug

SEQ ID NO: 242892 - RNA, 64 nt, Human
gagcugucagcacuaccucuccccgcugaaaccagcaguucauggcuuccuguggauucccucc

SEQ ID NO: 242893 - RNA, 64 nt, Human
ggauccccuguaggaggccagggaggggaacucagcaguucaggagccaccccaaaccauucug

SEQ ID NO: 242894 - RNA, 64 nt, Human
gucugugaaagccacgcagccccuggucuggaaugcaguucaggcucagcaaacugucagggug

SEQ ID NO: 242895 - RNA, 64 nt, Human
auuccaaguucuucuuucuuucugggagcagugggcaguucaugguguuagggcacucaccccc

SEQ ID NO: 242896 - RNA, 64 nt, Human
uccucagucuggucaaguuguuucuuauuugugagcaguucaggcuaucuccugauggggauga

SEQ ID NO: 242897 - RNA, 64 nt, Human
cgucaugugcuuuuaguaaauaugauuuuuaaaagcaguucaaguugacaacagcagaaacagu

SEQ ID NO: 242898 - RNA, 64 nt, Human
ugggguaagauugcgcgcuucauccccucaaaaugcaguucagccccacucccucuccaugccc

SEQ ID NO: 242899 - RNA, 64 nt, Human
guuaaggcacaucaaacacaggagucgagagagugcaguucagggaaaaaggagaggaggaaac

SEQ ID NO: 242900 - RNA, 64 nt, Human
uauaaagucaugugggccacacaagugcaguagugcaguucaccaugagggaagaauaaagagc

SEQ ID NO: 242901 - RNA, 64 nt, Human
augccauuagaagauuuucucugauauuauaugugcaguucaguuacaagaugaaaucauguuu

SEQ ID NO: 242902 - RNA, 64 nt, Human
auuuaagaugggcuucucugagguccacaucauggcaguucauuuacucuugugccaaauggca

SEQ ID NO: 242903 - RNA, 64 nt, Human
acggcagggacacacucgugagcauguguggccugcaguucaggugauacauuuaccaguguuc

SEQ ID NO: 242904 - RNA, 64 nt, Human; identical to SEQ ID NO: 242897

SEQ ID NO: 242905 - RNA, 64 nt, Human
acuggugauguaaagaauggaaguagcuguaugagcaguucaaaggccaagccguggaauggua

SEQ ID NO: 242906 - RNA, 64 nt, Human; identical to SEQ ID NO: 242905

SEQ ID NO: 242907 - RNA, 61 nt, Human
gaagccagaucugugaucccaagccgccuccuccaccgacuguacuucaucaaccuucucu

SEQ ID NO: 242908 - RNA, 61 nt, Human
caucuggaauggucuacaugccaugcggaaguccaccgaaggguuagaacaggguguccca

SEQ ID NO: 242909 - RNA, 61 nt, Human
auguuucugagggauuacagccugggaggauuccaccgaucuucacuucuagcagguuuuu

SEQ ID NO: 242910 - RNA, 64 nt, Human
ggaccuucgggcugugcccggggaaaggcaagguccggcccauccccaggcaccucacaggccc

SEQ ID NO: 242911 - RNA, 64 nt, Human
ggguacuaagaggugcuuagacaagggcuggugcccggcccagggugcccagcggggccaugcc

SEQ ID NO: 242912 - RNA, 64 nt, Human
aaagugcugggauuacaggcaugagccaccgcgcccggcccacucugccauugucuaagccacc

SEQ ID NO: 242913 - RNA, 61 nt, Human
aaaucccuucagcucuaagaacacugaaaaauccaccgauuuuuuggguaagcuucuuggc

SEQ ID NO: 242914 - RNA, 61 nt, Human
gacagucuccuuccagcucucccuaaucgacuccaccgacaaggucccuaccccagagcuu

SEQ ID NO: 242915 - RNA, 61 nt, Human
ccuuuggaagucugcgcccuugugcccugccuccaccgagccagcuuggucccuaugggcu

SEQ ID NO: 242916 - RNA, 61 nt, Human
ugaugcuccuuugcugcccccaagaguauacuccaccgagaaccaccagccacaccauuau

SEQ ID NO: 242917 - RNA, 61 nt, Human
acgggauaucuggauuuuacuugcaguggcuuccaccgaugggccaaucuucucauuucuu

SEQ ID NO: 242918 - RNA, 61 nt, Human
auaagcaugaaucaaaugguaaugcccaauauccaccgacacugcuuuucuugaaugaaca

SEQ ID NO: 242919 - RNA, 61 nt, Human
auccucgucugucaaugacaucuccuccauguccaccgaccagacccuggcaucugacacu

SEQ ID NO: 242920 - RNA, 61 nt, Human
acugggguccauuugggggguccugcuacacuccaccgauccccaaggaaguauaauaaac

SEQ ID NO: 242921 - RNA, 61 nt, Human
cgucauucaccggcgacgccgauacgguuccuccaccgaggcccaugcgaagcuuuccacu

SEQ ID NO: 242922 - RNA, 61 nt, Human
gaagcacuguguagcagugaauugucugcuuuccaccgaguacuguguuuauucucucucc

SEQ ID NO: 242923 - RNA, 61 nt, Human
cccuaggccuaccuccacuccaugaacaucauccaccgagaccucaacucccacaacugcc

SEQ ID NO: 242924 - RNA, 61 nt, Human
guaauggguuugcagugauaagucauacuuuuccaccgaaagggagggcuugggaaucccu

SEQ ID NO: 242925 - RNA, 61 nt, Human
ucgaggguccugccccuguuggccauaucuuuccaccgacggacuugaguguugcauuugu

SEQ ID NO: 242926 - RNA, 61 nt, Human
ggcccugcuuuaaccuuaaguuauagcccuguccaccgaggaaggucagggugagagccua

SEQ ID NO: 242927 - RNA, 61 nt, Human
agagcagggcuauuguaguucccagauucaauccaccgaaguguucacugucaucuguuag

SEQ ID NO: 242928 - RNA, 61 nt, Human
aauaaugcuuguaaucaggaaaguaauuucauccaccgauuucaaaaccagauucacugag

SEQ ID NO: 242929 - RNA, 64 nt, Human
uccuucugagccuccauggagaccagccugcaagccggcccagccuguccaggauacagugggg

SEQ ID NO: 242930 - RNA, 51 nt, Human
auccgccagcuccaaagugagccggcccagcaagaugaaacagggcacccc

SEQ ID NO: 242931 - RNA, 51 nt, Human
auccgccagccccaaagugagccggcccagcaagaugaaacagggcacccc

SEQ ID NO: 242932 - RNA, 61 nt, Human
gcagaaaugcaaacuccagccccaccacacauccaccgaugcauuuguggcuagaaauuuu

SEQ ID NO: 242933 - RNA, 61 nt, Human
gcaggcaugggaagagcacugguguggggguuccaccgagaaggggaccucaucuagaaaa

SEQ ID NO: 242934 - RNA, 61 nt, Human
gaggggaagcuugagcugcugcugucacuccuccaccgagggaggccucacaaaccacagg

SEQ ID NO: 242935 - RNA, 61 nt, Human
gacccugcagcuggugcucugugucuucgcuuccaccgacagccgucagacaucaggcucc

SEQ ID NO: 242936 - RNA, 61 nt, Human
cacccgauaggccuucgagcaaaagcaaagauccaccgagagaagaagagaaagaaaagaa

SEQ ID NO: 242937 - RNA, 61 nt, Human
gaaugggaccccagguuugugcucccuacucuccaccgauaaccuaucaaagggcuuugca

SEQ ID NO: 242938 - RNA, 61 nt, Human
uuuuuaaaagucaacgagagccuucgcugacuccaccgaagaggugcgccacugggagcca

SEQ ID NO: 242939 - RNA, 61 nt, Human
cgagugcacccgcuuagccuuuacauuccucuccaccgacaaaaggaaggggaaacucaau

SEQ ID NO: 242940 - RNA, 61 nt, Human
cugcuguagcugggcccugacacugucacccuccaccgacuuuguuuucucaggauggauu

SEQ ID NO: 242941 - RNA, 61 nt, Human
ucccccaucauugggccccaacgggcaugucuccaccgaauccauuuagagaaaugucaga

SEQ ID NO: 242942 - RNA, 61 nt, Human
gacagccccuuuacagguuacaucauugcaguccaccgaaaaaugguuaguuaaauguuag

SEQ ID NO: 242943 - RNA, 61 nt, Human
ccacaugggaccuggccccaggcugucacccuccaccgagccacgcagugccuggaguuga

SEQ ID NO: 242944 - RNA, 61 nt, Human
ugcugccaggaugcccaagaaaaaggucagcuccaccgaaggggcugccauggaagagccc

SEQ ID NO: 242945 - RNA, 61 nt, Human
cggucugugguagagaacucucuuccuucuuuccaccgacaggggcgagggcugcuuccuc

SEQ ID NO: 242946 - RNA, 61 nt, Human
uccuucucugggucugauuuucucacugaacuccaccgaccaacugcccuaagcccccagg

SEQ ID NO: 242947 - RNA, 61 nt, Human
acggaguggcuugagcuucuggggaugcagguccaccgagccccugaccccugucuguccc

SEQ ID NO: 242948 - RNA, 64 nt, Human
gggcuagaaagaccacuggcagaaacaggaggcuccggcccacagguuuccccaaggccucuca

SEQ ID NO: 242949 - RNA, 64 nt, Human
cucucaucugagcccacuggaggcgccgccccacccggcccacuggcagacacagacccaggca

SEQ ID NO: 242950 - RNA, 59 nt, Human
acaaggcaaagggcaagugaggcugacguccggcccaagugggcccagcccggcccgcg

SEQ ID NO: 242951 - RNA, 61 nt, Human
uaugugggcuuugcaacccuccccaaccaaguccaccgaaaguccgugaagaaaggcuuug

SEQ ID NO: 242952 - RNA, 61 nt, Human
cuagcagcugcagcagcugugccgccgcggguccaccgaggacgccaaucaaucaacccaa

SEQ ID NO: 242953 - RNA, 61 nt, Human
uguauuucaaauaaaccacaaaucaucauuuuccaccgagccacugggcagaauucacacu

SEQ ID NO: 242954 - RNA, 61 nt, Human
cccggugugaagcugcaggcugugcuccagauccaccgacccguagcaucucgucacgcca

SEQ ID NO: 242955 - RNA, 61 nt, Human
uguuuuaacaaauggauccaggauggauaaauccaccgagauaaggguuuuggucacuguc

SEQ ID NO: 242956 - RNA, 61 nt, Human
gggguguccaugacauggccugagcugggccuccaccgacugccugcucaccccugggcug

SEQ ID NO: 242957 - RNA, 61 nt, Human
ggugcacuggcaagggcaggccccuccucuguccaccgagacucuggacuugcucaggucc

SEQ ID NO: 242958 - RNA, 61 nt, Human
agacucgcuggagaggcggcucccguguccguccaccgagcacucagauggaugcugauca

SEQ ID NO: 242959 - RNA, 61 nt, Human
gcuuuuggcaaucacggacacuuuuuuccccuccaccgaaugucaggauugaaagcugccu

SEQ ID NO: 242960 - RNA, 61 nt, Human
aaaccagugauguggagcuggaguuuguccuuccaccgagacuacgagggccuuugaugcu

SEQ ID NO: 242961 - RNA, 61 nt, Human
uuucuugggacuuaccaaaggcacggaccccuccaccgacuccuucuaguucccuucccca

SEQ ID NO: 242962 - RNA, 64 nt, Human
aaagugcuaggauuauaggcuugagcuacugcgcccggcccaugguguuuuucuuuagggcucu

SEQ ID NO: 242963 - RNA, 54 nt, Human
accuggauguccugggcuagggggccggcccaggggcugggagugguuagccgg

SEQ ID NO: 242964 - RNA, 64 nt, Human
gcuccaagaagugagaauuuccgaaaaagaucugccggcccagagcacucccucuugcccuaau

SEQ ID NO: 242965 - RNA, 64 nt, Human
gcccgggaaugaauggggaggccgcugaacccacccggcccauaucccugguugccucauggcc

SEQ ID NO: 242966 - RNA, 64 nt, Human
aaagugcuggaauuacaggcaugagccaccgcgcccggcccaaucauguguuuuuguugaaaug

SEQ ID NO: 242967 - RNA, 64 nt, Human
ucugaguucagggguguggagggagcagacuccaccggcccaggcccagcuaagagggggccga

SEQ ID NO: 242968 - RNA, 64 nt, Human
gggagguggauccucugccagcaggugucuguccccggcccagcgcaucuugaaggcccuggac

SEQ ID NO: 242969 - RNA, 64 nt, Human
guuaccacccccaccccggcccgggauacugcccccggcccagauccuggccgucucaucccau

SEQ ID NO: 242970 - RNA, 60 nt, Human
aggccugcggcugccacugaguccacccgcccggcccagcugcagccacccuucucaucu

SEQ ID NO: 242971 - RNA, 64 nt, Human
ccuuccuuuuggccuccaaagccacagauguuggccggcccaccuguuuaacucuguauuuauu

SEQ ID NO: 242972 - RNA, 64 nt, Human
agcagcagcacggccuagcccaacccagcccaacccggcccaacccagcccagcccagcucagc

SEQ ID NO: 242973 - RNA, 64 nt, Human
caaaaccugcaguuccugaguaccuucuacaggcccggcccagccuaggcccgggguggccaca

SEQ ID NO: 242974 - RNA, 64 nt, Human
acccuuuucaggucuugcaggugucgacugucuuccggcccagcuccaagcccuccucugguug

SEQ ID NO: 242975 - RNA, 64 nt, Human
cccucucuggguugacugcauuucuagacucucgccggcccaggcccaucuuccaaagcaagag

SEQ ID NO: 242976 - RNA, 64 nt, Human
ucccccagccuggaccccgccggccgcgggucucccggcccaaccccaccgacccagaccaaga

SEQ ID NO: 242977 - RNA, 64 nt, Human
agaccaggcaggaccucccgaggcugcgccccggccggcccaugcguuuugugaucccaaguga

SEQ ID NO: 242978 - RNA, 64 nt, Human
ugaggacaaugacccuacagaugcucagcuacauccggcccagggugcugcaguggcacagacc

SEQ ID NO: 242979 - RNA, 64 nt, Human
uuguccugccagggugggcagacagacagauggaccggcccacacucccagaguugcuaacaug

SEQ ID NO: 242980 - RNA, 64 nt, Human
acuccccuucagcccccuggucaucccggccuucccggcccacuuccuggccaccgcaggcccc

SEQ ID NO: 242981 - RNA, 64 nt, Human
ugugagguugcccgcccgucuccuucuugucuccccggcccaggucccucccgccuccaggucc

SEQ ID NO: 242982 - RNA, 64 nt, Human
ggacgcccuccaucuccucggagccccgcgagguccggcccagcaacuucccggcauccgcgcu

SEQ ID NO: 242983 - RNA, 64 nt, Human
gguguccucgcugucugggggcugcucugcugccccggcccagguccccuugugguguugccag

SEQ ID NO: 242984 - RNA, 64 nt, Human
cccgcugcguccgcaucacucugcaucagcacugccggcccagugacaccgaguuccaccccau

SEQ ID NO: 242985 - RNA, 64 nt, Human
uccccgaggacgcgcgccggacagucggcacugaccggcccaccugguagcagaggacaccccc

SEQ ID NO: 242986 - RNA, 64 nt, Human
caggguggaggaaggagguccacuugggccucuuccggcccacaguccagacgcucaccuuucc

SEQ ID NO: 242987 - RNA, 64 nt, Human
accccggacccauccacucacuccugagagggcuccggcccagaaugggaaccucagagaagag

SEQ ID NO: 242988 - RNA, 64 nt, Human
gaaggcuuccuggguuugcaacacuaacggccauccggcccaaggaugccaggaucugcaaagc

SEQ ID NO: 242989 - RNA, 64 nt, Human
gacuccagcguugcugucuugccagugccggcccccggcccaguucagggacagaauuauagug

SEQ ID NO: 242990 - RNA, 64 nt, Human
gggccuccagggcagcaggcaccaccuccauaucccggcccacauccagcuggacccccuguca

SEQ ID NO: 242991 - RNA, 64 nt, Human
cccacaaggggcaggugggggcuugguugcugacccggcccaaguccccacagagcaccuucug

SEQ ID NO: 242992 - RNA, 64 nt, Human
gggccggcgaugcggcugccggcgcccccccgccccggcccaggcgcccgcgggcgggggcugc

SEQ ID NO: 242993 - RNA, 64 nt, Human
guggccugcugugccuggugccaacaggggcaucccggcccauaccccuccagacaggaagcau

SEQ ID NO: 242994 - RNA, 64 nt, Human
gugaaaacggguucuguaguauuuguaaaaaggcccggcccaggaccacugugagcuggaaaag

SEQ ID NO: 242995 - RNA, 64 nt, Human
aaagugcuaggauuacaggcaugagccacagcacccggcccagaauaagaauacugucuuggaa

SEQ ID NO: 242996 - RNA, 60 nt, Human
ugagcaagagacuggccuaagcagccaggcccggcccagggagcuacaaacccaccaaua

SEQ ID NO: 242997 - RNA, 64 nt, Human
gcugccugugauacccaucagcccacugccccggccggcccagauaggucugccucugccuucc

SEQ ID NO: 242998 - RNA, 64 nt, Human
aaagugcugggauuaccggcguaagccaccacgcccggcccacucugaaguaaucuuaagaaga

SEQ ID NO: 242999 - RNA, 64 nt, Human
accgugcauaggcaaaaggaguggagcacagcguccggcccaguguguuuccgguucugaguca

SEQ ID NO: 243000 - RNA, 53 nt, Human
aggaaggcgacagccccuaggggccggcccaacuuagacgcggcucuccuccg

SEQ ID NO: 243001 - RNA, 64 nt, Human
aaagugcugggauuacagacgugagccaccacucccggcccauagaagguuuuuugcuggauaa

SEQ ID NO: 243002 - RNA, 64 nt, Human
aaagugcugggauuacaggagugagccaccgcucccggcccagaacuuuuaauaaauauaaaua

SEQ ID NO: 243003 - RNA, 64 nt, Human
gcuuccccugccuucucucugccguggcccagagccggcccagcugcacacacacaccaugcuc

SEQ ID NO: 243004 - RNA, 64 nt, Human
ggcuaccucaguuuccccauuuuggccagacucaccggcccacugggguggugauguuuucguu

SEQ ID NO: 243005 - RNA, 64 nt, Human
ugaggaggacacguguccucauggagagggugcuccggcccaggcgggggagucagugcccagu

SEQ ID NO: 243006 - RNA, 64 nt, Human
gccgagugcugugcacggaagaaacaaagacaucccggcccaaggcgcagcgggagcgcacagg

SEQ ID NO: 243007 - RNA, 64 nt, Human
agcccaccaagcuguagggccgcccggaguccugccggcccacaggcccaucccggcggggcac

SEQ ID NO: 243008 - RNA, 64 nt, Human
ggagcaagaaggauugaggcugggccuuccccugccggcccagaggggcuucuguccugugugu

SEQ ID NO: 243009 - RNA, 64 nt, Human
ccggggcugguccgaugguuggcaaaacuugacuccggcccaguccccacucuuggggacuuag

SEQ ID NO: 243010 - RNA, 64 nt, Human
caaagugcugggauuaaggcgugagccacugcgcccggcccaagagaauaggggagccaaggag

SEQ ID NO: 243011 - RNA, 64 nt, Human
gacuucuuggugccagguuggugugagccugggcccggcccacucagcggcccacauuggccag

SEQ ID NO: 243012 - RNA, 64 nt, Human
gccacauucaaucgcccaacuacccagacgauuaccggcccagcaaagucugcaucuggcggau

SEQ ID NO: 243013 - RNA, 64 nt, Human
caggaaucgugaaggagcugagaaaucuuccucuccggcccacugucuguggcccauugucauu

SEQ ID NO: 243014 - RNA, 64 nt, Human
ggugccccaggccucugugccacuccucacacacccggcccagugggagccuguccugguuccu

SEQ ID NO: 243015 - RNA, 64 nt, Human
agccuucuccauaucuccauggcccugucccaggccggcccagaugugucccccccaggccuug

SEQ ID NO: 243016 - RNA, 64 nt, Human
caucagggaggagccuuaaguuccacuagagccuccggcccagggaggccagaaucagcacaau

SEQ ID NO: 243017 - RNA, 64 nt, Human
gacuuccauggcuucugaguacaaggccagccccccggcccaccagcuuucggaaugccugcuu

SEQ ID NO: 243018 - RNA, 64 nt, Human
gcacucgcucucccggcagaggggccagaaucgcccggcccagcccuggagcccccuccacucc

SEQ ID NO: 243019 - RNA, 64 nt, Human
uuugccuaggacucuccagggucgcugauccuccccggcccagggcugccaggaacaaguuccu

SEQ ID NO: 243020 - RNA, 64 nt, Human
gggcccaccaccugcaucugcgacuagagagcacccggcccacguuggguucucagugcuuucu

SEQ ID NO: 243021 - RNA, 56 nt, Human
cugacaaggagcaggccugagcgaggccggcccagcacagcaagcagcaggaccgc

SEQ ID NO: 243022 - RNA, 64 nt, Human
aguccuggaugaauccugcagguuuuugguugcaccggcccagggaggaagcgggggguuuguc

SEQ ID NO: 243023 - RNA, 64 nt, Human
gccagcgucuguugaaggaugaagcagcuccuguccggcccagcccugccucacagcugugcga

SEQ ID NO: 243024 - RNA, 64 nt, Human
cgcagacagacagacagacggacgggacagcggcccggcccacgcagagccccggagcaccacg

SEQ ID NO: 243025 - RNA, 64 nt, Human
cccgcugcaccacgggguugcucuguucuccuguccggcccagacucuucuguguggcgccgcc

SEQ ID NO: 243026 - RNA, 64 nt, Human
ccagcaccucggagcccccuucacacgcccccuaccggcccauguuucuauuugcauuuccccc

SEQ ID NO: 243027 - RNA, 64 nt, Human
agcacuaaagaagccucuucuauuuaaugcagacccggcccagagacugugcgugccacuacca

SEQ ID NO: 243028 - RNA, 64 nt, Human
cccucuggccagcugcacagccugugggaggugcccggcccaggcugggugugggggaagcugg

SEQ ID NO: 243029 - RNA, 64 nt, Human
uaagcacuaugcugcuaguuacaguguaggcaccccggcccagcagcccagcagcccacaugug

SEQ ID NO: 243030 - RNA, 64 nt, Human
auccagagagcagcugggcugcucccgccccagcccggcccagggugaaggaagaggcacgugc

SEQ ID NO: 243031 - RNA, 64 nt, Human
cucugcaagccacuuuuccaugccaagcauccacccggcccacaggcauguuucugccgccacu

SEQ ID NO: 243032 - RNA, 64 nt, Human
aacggggcggcgagggcggcgagggcgccgagguccggcccaucccaguccuguggggcuggcc

SEQ ID NO: 243033 - RNA, 64 nt, Human
cauccaggauuaggauaagguacuuaaguaccugccggcccacugugcacugcuugugagaaaa

SEQ ID NO: 243034 - RNA, 64 nt, Human
aaagugcugggauuacaggcgugagccaccaugcccggcccauaaguaccguuuuugagguuca

SEQ ID NO: 243035 - RNA, 64 nt, Human
acgcgugcugcagauguggggagucuggaaacacccggcccacgcgugcugcagauguggggag

SEQ ID NO: 243036 - RNA, 64 nt, Human
acgcgugcugcagauguggggagccuggaaacacccggcccacgcgugcugcagauguggggag

SEQ ID NO: 243037 - RNA, 64 nt, Human; identical to SEQ ID NO: 243036

SEQ ID NO: 243038 - RNA, 64 nt, Human
guuaagaccugugacguggggagccuggaaacacccggcccacgcgugcugcagauguggggag

SEQ ID NO: 243039 - RNA, 64 nt, Human
aaagugcugggauuacaggcgugagccaccacgcccggcccacuugcacauuuucaaaguaguc

SEQ ID NO: 243040 - RNA, 64 nt, Human
uuguuccuucugcuucucccuggcugaccccuggccggcccaggccuccacgggggcggcaggc

SEQ ID NO: 243041 - RNA, 64 nt, Human
ugaugguggauagcgcagaggaucagaagauucaccggcccauggcucccaaggaggugagaga

SEQ ID NO: 243042 - RNA, 64 nt, Human
uucugucccucacacugugaccugaccagccccaccggcccauccuggucauguuacugcauuu

SEQ ID NO: 243043 - RNA, 64 nt, Human
aaagugcugagauuacaggcaugagucacuacgcccggcccaugucugucugucuugaugugug

SEQ ID NO: 243044 - RNA, 64 nt, Human
agauguauuuauuguacaaaccaugugagcccggccggcccagccaggccaucucacguguaca

SEQ ID NO: 243045 - RNA, 64 nt, Human
ucuccaucuaaaauuccuagggcaagcuuccaacccggcccaagggccgcauguggcccaggau

SEQ ID NO: 243046 - RNA, 64 nt, Human
cugcccccaaagccaagaagaucaagucucagcaccggcccacccaaagauucuggcccaacuc

SEQ ID NO: 243047 - RNA, 64 nt, Human
aaucaguccauagagacgaacagaaugagaccuuccggcccaagcguggcgcugcgggcacuuu

SEQ ID NO: 243048 - RNA, 64 nt, Human
gcccagaugaggaaggaacccccucaccaccugcccggcccaggagcgcagcugcauuuggggu

SEQ ID NO: 243049 - RNA, 64 nt, Human
ccaccccccgcaccgccgacgccgccucguucguccggcccagccugaccaaugccgcggugga

SEQ ID NO: 243050 - RNA, 53 nt, Human
ugagcagcaccucgaguuagaacccggcccacguagggcggcacucacacgcg

SEQ ID NO: 243051 - RNA, 64 nt, Human
gagaggagguaacgaggagggcggacuccaggccccggcccagagauuuggacuuggcuggcuu

SEQ ID NO: 243052 - RNA, 64 nt, Human
cgccccggcauuauuuuauucccaagccagcagaccggcccagacagccaggcuguggcugguc

SEQ ID NO: 243053 - RNA, 64 nt, Human
cagaucgcaggguaggaacgagucuggccuggugccggcccaguguuuccucagcucauccgcc

SEQ ID NO: 243054 - RNA, 64 nt, Human
aaagugcugggauuacaggcgugagccaccaugcccggcccaaauauuuuuuauucaggauggu

SEQ ID NO: 243055 - RNA, 64 nt, Human
ccaaccccacccacacugcugccuggugcucccgccggcccacagggccuccguccccaggucc

SEQ ID NO: 243056 - RNA, 64 nt, Human
aaagugcugggauuacaggcgugagccaccgugcccggcccaaaggggaaacucuugugggagg

SEQ ID NO: 243057 - RNA, 64 nt, Human
cccagcagagucccggugcccucuguccccacugccggcccauguucucucuccggaggucacc

SEQ ID NO: 243058 - RNA, 64 nt, Human
aaagugcugggauuacaggcgugagccaccgugcccggcccaggacuuuuaaaacaagcauccc

SEQ ID NO: 243059 - RNA, 64 nt, Human
agcgcagagccggcaaagugagaugcacgccgucccggcccauagacaaguggcgcugggguuu

SEQ ID NO: 243060 - RNA, 64 nt, Human
gugacgcuguuagcgccucagcuggcggugacagccggcccagcguggcgccaccacacaccgc

SEQ ID NO: 243061 - RNA, 64 nt, Human
aggagcccccggcccccugagcgcccgggcuggcccggcccaccgcggggggggggcagcgggc

SEQ ID NO: 243062 - RNA, 64 nt, Human
acuuaaugaagaagugcccacaugcuggcaggggccggcccacucuggccagccagauacugcu

SEQ ID NO: 243063 - RNA, 64 nt, Human
aaauguuauucccuguccacccugccccaucuggccggcccagcccaguccaggaccuggcugg

SEQ ID NO: 243064 - RNA, 64 nt, Human
uggggacauggccagcugacggacaacugagucuccggcccaccuaccaccgccagccaggauc

SEQ ID NO: 243065 - RNA, 64 nt, Human
guagacccacccaacacacuccugcacacuggccccggcccacggcacagcaauccccugcgcg

SEQ ID NO: 243066 - RNA, 53 nt, Human
ucaugccugcccagaaaugaagcccggcccacacccgacaccagcccugcugc

SEQ ID NO: 243067 - RNA, 64 nt, Human
aaagugcuggcauuacaggugugagccacggugcccggcccacaauuaauuuuagaacauuuuc

SEQ ID NO: 243068 - RNA, 64 nt, Human
cccgugcuuuucugcggcuguguaguaaaucuccccggcccagcuggcgaacccugggccaucc

SEQ ID NO: 243069 - RNA, 64 nt, Human
gagggacucgcaggcgucagggggcagccuugucccggcccagugugugugaccagggcgggag

SEQ ID NO: 243070 - RNA, 64 nt, Human
ucgugcaucuguguguccugggagcugccugcucccggcccacccucuaggaggcucuggcuca

SEQ ID NO: 243071 - RNA, 64 nt, Human
agccccucucugggugccagguacgacgcuugccccggcccacccuccauccccacccuccauc

SEQ ID NO: 243072 - RNA, 64 nt, Human
gaugaauaaauugaggcacagaaagauuaaguuaccggcccaaggugacacagugaggaggugg

SEQ ID NO: 243073 - RNA, 64 nt, Human
cggccucgucgcacacugccuguggcccccgagcccggcccagccccaggccagucagccgcag

SEQ ID NO: 243074 - RNA, 64 nt, Human
uucccgccuugcgcucgggggagcccccgcgcccccggcccagcgcgggaggcggggcgagccg

SEQ ID NO: 243075 - RNA, 64 nt, Human
gguaggggccgagugggguuugaaggcagccggcccggcccagcccaggagcgcuauuuauugc

SEQ ID NO: 243076 - RNA, 64 nt, Human
cugcugagggcgagcauccugcugggcucucugcccggcccaccccuccaaggggcuggccugu

SEQ ID NO: 243077 - RNA, 64 nt, Human
cggggcaacugagccgggccucgccgcgacccuuccggcccaucuaucgggcaccggggcuccg

SEQ ID NO: 243078 - RNA, 64 nt, Human
gugaccgagauccucgauuacuggggacccaauuccggcccauugacguggcgccucaccccug

SEQ ID NO: 243079 - RNA, 64 nt, Human
ggcugcccacggcgcuucugcugagacccugcccccggcccaggugucucggaggguggcugcc

SEQ ID NO: 243080 - RNA, 64 nt, Human
gccaggcaggggugggagagccagcucucucuacccggcccagagaccccuuccuuuccucugc

SEQ ID NO: 243081 - RNA, 64 nt, Human
aggucucgugggauaccugaaaugcacccgcuucccggcccaugcaggagguaaaccgccucuc

SEQ ID NO: 243082 - RNA, 64 nt, Human
gcaccuccucccucucccuucaccucaccccugcccggcccaagcucuacuuguguacagugua

SEQ ID NO: 243083 - RNA, 64 nt, Human
gaccgacgacuacugagggggcagccccccgcccccggcccaccuggguaacacggccuccggg

SEQ ID NO: 243084 - RNA, 64 nt, Human
uggcucaggcagggccacggcugggcuccagcugccggcccagcggaucgucgcccgaucagug

SEQ ID NO: 243085 - RNA, 64 nt, Human
aaaaugcgagacucugauggaaugugccaccuguccggcccagugccagcuccagugccgcucc

SEQ ID NO: 243086 - RNA, 64 nt, Human
gauuucaguagaacagggagcgaagcaaaaccacccggcccacaagagacaacagaguauucag

SEQ ID NO: 243087 - RNA, 64 nt, Human
auauguguguacacuucugacuggugaucagggcccggcccacggcccugagcggcugcagccu

SEQ ID NO: 243088 - RNA, 64 nt, Human
acgggauugaaggguccugccggugggacccuguccggcccagugccacugccccccgaggcug

SEQ ID NO: 243089 - RNA, 64 nt, Human
augggccugggcacgcggcccucuccugucagugccggcccacccaccagcaggcccccaaccc

SEQ ID NO: 243090 - RNA, 64 nt, Human
ucuggaacgcagggcccgggcccuccagccccgcccggcccagguauccucccugagccucagu

SEQ ID NO: 243091 - RNA, 64 nt, Human
cggggcucgguggacgggcccagggugggagcggccggcccaccuguccccucgggaggggagc

SEQ ID NO: 243092 - RNA, 64 nt, Human
gugcuggggaguuccccccuccgagcccuccuucccggcccaaccugagggauguggauuuggg

SEQ ID NO: 243093 - RNA, 64 nt, Human
ggcaagcagccggagacaaaacgccuuaaagcccccggcccagcccugcagguauauugcaggg

SEQ ID NO: 243094 - RNA, 64 nt, Human
cccagggagguguuugcuguccgaaggaccugggccggcccaugggagccugggguucugucca

SEQ ID NO: 243095 - RNA, 64 nt, Human
ucccaggaaucccagggggcagcacagccggcccccggcccacguuuucgguggaaaauuagag

SEQ ID NO: 243096 - RNA, 64 nt, Human
cagagcugagagcgaagcagaaggggcucccuguccggcccacgugcccuuucccucgacgaca

SEQ ID NO: 243097 - RNA, 64 nt, Human
ggagaccauccccccgaugggaccagcagccccgccggcccacugggggucccucuuaacaucu

SEQ ID NO: 243098 - RNA, 64 nt, Human
cugggguccccccucccuguaaugcacuccugccccggcccaaccucgcccucucucaccagcc

SEQ ID NO: 243099 - RNA, 64 nt, Human
caggccuccagcuccugggauccgggaguccaucccggcccagcacccccagcauccccgugua

SEQ ID NO: 243100 - RNA, 64 nt, Human
uuccuaccagcaggaggagccagaggccagagucccggcccagaguggugaguagagugcccag

SEQ ID NO: 243101 - RNA, 64 nt, Human
gcaggucccgccuguuccagggcaggacccgggcccggcccaccggcccccuggcuugggaagg

SEQ ID NO: 243102 - RNA, 64 nt, Human
uuucgggacuugccccagggaagccgucaccggcccggcccaucauguuuuuggauuuuuuuuu

SEQ ID NO: 243103 - RNA, 64 nt, Human
gcagcccccaccuccguccugacccgacgggggcccggcccacugccuacccucgagucccgca

SEQ ID NO: 243104 - RNA, 64 nt, Human
ugggaccccacuccgagggcagcucccggccuugccggcccaauaaaggacuucagaaguguuc

SEQ ID NO: 243105 - RNA, 64 nt, Human
aaaaagcgaaccgugaggaggggugugggcacccccggcccagugcccccugguggaaugcggg

SEQ ID NO: 243106 - RNA, 64 nt, Human
agggcaggccugcgugggcuggaggcgggcgaggccggcccacccccucgcuggcacugacuuu

SEQ ID NO: 243107 - RNA, 64 nt, Human
cguuccgcaagaggaugaugcuggccuaccgcuuccggcccaacccccugguacgcauguccuc

SEQ ID NO: 243108 - RNA, 64 nt, Human
aaagugcugugauuacaggcuuaagccacagcgcccggcccaaaguguucuuuuuuccuugaaa

SEQ ID NO: 243109 - RNA, 64 nt, Human
acccucaacccgcccugcagccucggccuccgccccggcccaccaccucgcuacugcuggaacc

SEQ ID NO: 243110 - RNA, 64 nt, Human
uacagaaugucaacaucacacugugcauccucuuccggcccaucacuagccagcuuccucgcau

SEQ ID NO: 243111 - RNA, 64 nt, Human
agcuccccucgacucaagcccuuguccucauuauccggcccagaccaaagauucccucaucccu

SEQ ID NO: 243112 - RNA, 64 nt, Human
agccaguguccuagcaaagcuggaugggguugggccggcccacaggggggaccccuccuacccu

SEQ ID NO: 243113 - RNA, 64 nt, Human
uuccuaacccuggaagcgagaggaugagaggaggccggcccagcuccuucuuucaggguggggg

SEQ ID NO: 243114 - RNA, 64 nt, Human
uuccugcguaaaccgggcgcucaggcgcuuggacccggcccaagauuugacuccgguucucacc

SEQ ID NO: 243115 - RNA, 64 nt, Human
caaacguccuuccucacggggcgccuccgccaagccggcccagcugcaccccucccuuccugga

SEQ ID NO: 243116 - RNA, 64 nt, Human
aggagaccacccccgagcuugccucagggccaagccggcccaacccaaccacucggggccccca

SEQ ID NO: 243117 - RNA, 64 nt, Human
cgugguggacuagauagauggacgucggcaacucccggcccagccuccauacugcggucuuuuu

SEQ ID NO: 243118 - RNA, 64 nt, Human
ucuagagggaaaagcuagaggcacaggguuucugccggcccacaacugcugucuugauuugcau

SEQ ID NO: 243119 - RNA, 64 nt, Human
cagcuccacacaguaguccccacguggcccacucccggcccaggcugcuuuccgugucuucagu

SEQ ID NO: 243120 - RNA, 64 nt, Human
ccucguguagaugugcugcagccuugggcccuccccggcccacguccuccguugacacagcuuc

SEQ ID NO: 243121 - RNA, 64 nt, Human
ggauaaauaaacagccugugagcacacaggcagcccggcccaguguauguggucugugccuugg

SEQ ID NO: 243122 - RNA, 64 nt, Human
cgcugugaugacgagcuggcugauuggcccugggccggcccauucuucacacgccugccagaag

SEQ ID NO: 243123 - RNA, 60 nt, Human
augucgccuacaacaugugagcgcagcacaccggcccaggugccggagaugaaugagccc

SEQ ID NO: 243124 - RNA, 64 nt, Human
ccuguggacgccuggcccacccugaguggcggcgccggcccaccugggagccucagaucccccu

SEQ ID NO: 243125 - RNA, 64 nt, Human
aguguuugcccuuuggccagugacgugguucaucccggcccauguugagccaugaguggaguuu

SEQ ID NO: 243126 - RNA, 64 nt, Human
cagauaggaguccaggguaugacugauggaggccccggcccacgugaccagcaaggucagaggc

SEQ ID NO: 243127 - RNA, 64 nt, Human
ugcugcuucucacuggcccagacucugagcuccaccggcccagucugcacggcccaucugcuuc

SEQ ID NO: 243128 - RNA, 64 nt, Human
caucucccagucucccugccccccaugccccagaccggcccaccagggacuagccgcugucgca

SEQ ID NO: 243129 - RNA, 54 nt, Human
gacggcggcugccagagugagugcccggcccaccagggacugcagcugcaccag

SEQ ID NO: 243130 - RNA, 64 nt, Human
ccccaggugcucucugccccucaugccccucucaccggcccagugccccgacucuccaggcuuu

SEQ ID NO: 243131 - RNA, 64 nt, Human
ccagucauucuagagggauccaccgccacacuggccggcccacguccugggugcugucaugccc

SEQ ID NO: 243132 - RNA, 64 nt, Human
aaagugcugagauuacaggugugagccaccgugcccggcccauucuaaggguuuucuuugaaga

SEQ ID NO: 243133 - RNA, 64 nt, Human
aaagugcugggauuacaggugugagccaccgugcccggcccagauagguugaucuuaauguaac

SEQ ID NO: 243134 - RNA, 64 nt, Human
uuccagucaccuaacuucccuuccucaggcucccccggcccacccugcucagugaccccacagg

SEQ ID NO: 243135 - RNA, 64 nt, Human
aagccuuaagcugcaggauucucaccagcuguguccggcccaguuuuggggugugaccucaauu

SEQ ID NO: 243136 - RNA, 64 nt, Human
cuacccaagcagccccgcccucuuccccucaaccccggcccaggccgcccuggccgcccgccug

SEQ ID NO: 243137 - RNA, 64 nt, Human
gcagcccaggaagcagcacacgcggccguggggaggcaggcaccgggcaugucggcgccucugg

SEQ ID NO: 243138 - RNA, 64 nt, Human
cagccucacccgaaaggccagccuggggcucuccggcaggcagcccgagaccugcacagaugaa

SEQ ID NO: 243139 - RNA, 64 nt, Human
aagggcgaguggccgguccccgcugugccaggugggcaggcaggagcaaggccugcgagggagg

SEQ ID NO: 243140 - RNA, 64 nt, Human
gccccgggacuguuuucuuuuuaauaaagccacaggcaggcaucguagcuccacagcccgaggg

SEQ ID NO: 243141 - RNA, 64 nt, Human
gauguaauauaucaaagucagggaugaggagcaggaggacuauucaagauaaacuucuguaacc

SEQ ID NO: 243142 - RNA, 64 nt, Human
acuagcuguggcauuccagguggagaaccugacagaggacuaagaaguuaucuaauguaaaaga

SEQ ID NO: 243143 - RNA, 64 nt, Human
uagagaugucuguguucuuggaguauuucacacugaggacuaaucugcuaucuucauuccaguc

SEQ ID NO: 243144 - RNA, 64 nt, Human
augaaugacgagauuggaguacacugucaccaagggcaggcaaagaugcccucugggguugucu

SEQ ID NO: 243145 - RNA, 64 nt, Human
gcugcccuuuggccaacaggguagauuucucuugggcaggcagagaguacagacugcagacauu

SEQ ID NO: 243146 - RNA, 64 nt, Human
cugggucauauggugcagacugugaccagcaccaggcaggcaguccugucugcguguggaggag

SEQ ID NO: 243147 - RNA, 64 nt, Human
gguggccacccuggugaggacaccugucccccagggcaggcaccuucucuuuuccagagccugg

SEQ ID NO: 243148 - RNA, 64 nt, Human
cccagggugagaaagccccaucccgggggccguuggcaggcagggaagcaggaaccccaccgug

SEQ ID NO: 243149 - RNA, 64 nt, Human
gugggugaaaaugucccaucugcaccaguacacaggcaggcauuaucauucuucaccuacuuuu

SEQ ID NO: 243150 - RNA, 64 nt, Human
gcucuaccuuggaucugcuaguaaauaacuaauaggcaggcaguuauuuggguaaggaaaaaag

SEQ ID NO: 243151 - RNA, 64 nt, Human
cucuucucugggacuugugggccucagggcuuggggcaggcaugggacuggcccaggcacacag

SEQ ID NO: 243152 - RNA, 64 nt, Human
aauauguuuuaaaugucccauuucaccauugccaggcaggcauucuuccuucagggagaggaug

SEQ ID NO: 243153 - RNA, 64 nt, Human
ccucagagaugcaucugggagagguggggaagauggcaggcaaggguacccuuggccaggacuc

SEQ ID NO: 243154 - RNA, 64 nt, Human
accugagagugggggagcuaagccaugagguaggggcaggcaagagagaggauucagacgcucu

SEQ ID NO: 243155 - RNA, 64 nt, Human
cuagaacaucccugggcaaguggauggcccagcaggcaggcacuguggcccuucuguccaccag

SEQ ID NO: 243156 - RNA, 64 nt, Human
agagggccagagaugcccgcgugguagggcugcuggcaggcacacuggguguagcccaacaccg

SEQ ID NO: 243157 - RNA, 64 nt, Human
ucacaccuguaaucccagcacuuugggaggccaaggcaggcaaucaccugaggucaggaguuca

SEQ ID NO: 243158 - RNA, 64 nt, Human; identical to SEQ ID NO: 142950

SEQ ID NO: 243159 - RNA, 64 nt, Human
aauuguccuagccuuccauugcuaugcacugaaugaggacuacucucgugugugugugugugug

SEQ ID NO: 243160 - RNA, 64 nt, Human
uguggcaucuuggaaacaguccuuaguucugugggaggacuagaaacagccgcggggcgaaggc

SEQ ID NO: 243161 - RNA, 64 nt, Human
ggcuggagcgcuaccugugagccugcgccgcgcgggcaggcaccugugcgaccugugccccgga

SEQ ID NO: 243162 - RNA, 64 nt, Human
cuaauuuacuuccacugaaccauccaagaccucuggcaggcagggaaaugggcagugaugcaaa

SEQ ID NO: 243163 - RNA, 64 nt, Human
acuuagauauuggcacacacaaggaacaacuguuggcaggcaguaucgauuuuaugaagagaaa

SEQ ID NO: 243164 - RNA, 64 nt, Human
cucauuuuccuguuuacacuggggauuuggagggggcaggcaaagucaaagugaaugaccucug

SEQ ID NO: 243165 - RNA, 64 nt, Human
acaaggauggcaaggggugggcauuggggugccaggcaggcauguacagacucuauaucucuau

SEQ ID NO: 243166 - RNA, 64 nt, Human
ccaccccggggacccugugacauggugccugagaggcaggcauagaggcuucuccgccagccuc

SEQ ID NO: 243167 - RNA, 64 nt, Human
agcaggugagcaaaaugcugcuuucugccuugguggcaggcagagaacugucucguacuagaau

SEQ ID NO: 243168 - RNA, 64 nt, Human
cuguuauccuguuggccuccuauguauuggucaaggcaggcaucucuguucucugaacauucau

SEQ ID NO: 243169 - RNA, 64 nt, Human
acaagaaguacaaccaacaggaaccagcgccaagggcaggcagcggccuccuugcuccccuccc

SEQ ID NO: 243170 - RNA, 64 nt, Human
uggaaucuaggaaaacucugagcuacugcauuuaggcaggcacuuuaauaccaaacuguaacau

SEQ ID NO: 243171 - RNA, 64 nt, Human
agauuuuuagauuuuuuuuuuccuuggggaaacuggcaggcaauggggguuagggagguugggg

SEQ ID NO: 243172 - RNA, 64 nt, Human
gggaaaacugagccccaggaaaaccuaaccacugggcaggcagaauuuguuugagggauagaac

SEQ ID NO: 243173 - RNA, 64 nt, Human
ucugugccugggaucgugcauuugaggggccaggggcaggcagggcugcagagggagacggccc

SEQ ID NO: 243174 - RNA, 64 nt, Human
gggaccagaaugaggauacgugagaaauagacccggcaggcagucagacugaaugggagcugga

SEQ ID NO: 243175 - RNA, 64 nt, Human
cuucugcuaagcucagaggcuggggcuaaagcaugaggacuaugccagcuauagaacuuggacu

SEQ ID NO: 243176 - RNA, 64 nt, Human
aaauuguacaaaguauguaggauguuuuguuauagaggacuauaguggaagugaaagcauucug

SEQ ID NO: 243177 - RNA, 64 nt, Human
gaauaaaggaagauauguuccacauuccuggauggaggacuacacacauuauggaaagaccuca

SEQ ID NO: 243178 - RNA, 64 nt, Human
gaacuucagaaaccccccagccaaguaagcugugggcaggcaagcccuucagucaccugguggc

SEQ ID NO: 243179 - RNA, 64 nt, Human
aguaaggucaggauuagacuucaggcauucauaaggcaggcacuaucagaaaguguacgccaac

SEQ ID NO: 243180 - RNA, 56 nt, Human
gaaaccccuuggccaaguaagcugugggcaggcaagcccuucggucaccuguuggc

SEQ ID NO: 243181 - RNA, 64 nt, Human
ucaugccuguaaucccaacacuuaggguggcugaggcaggcagaucaccuggggucaggaguuc

SEQ ID NO: 243182 - RNA, 64 nt, Human
uuuuggguccucauguuauuuauugccgaaaccaggcaggcaaccccaagggcaccaaccaggg

SEQ ID NO: 243183 - RNA, 64 nt, Human
ucaugccuguaaucccaacacuuugggaggccaaggcaggcagaucacuuaaggccaggaguuc

SEQ ID NO: 243184 - RNA, 64 nt, Human
ggcgccugggccgcagcccagcaguaguuggagaggcaggcagagggcagugguucucccaaau

SEQ ID NO: 243185 - RNA, 64 nt, Human
ucacaccuauaaccccagcacuuugggaggccaaggcaggcagaucaccugaagucaggaguuc

SEQ ID NO: 243186 - RNA, 64 nt, Human
aaggggccuugagcaucaggcccagacagagccuggcaggcauccuggcgggaaggaccagguc

SEQ ID NO: 243187 - RNA, 64 nt, Human
ccaccgugccgaaggagcucugccagugggccugggcaggcagccacagagggcauguuaucug

SEQ ID NO: 243188 - RNA, 64 nt, Human
uaggaccagaggaugucuaguucuaggcugagcuggcaggcagcuauuaccccgguucuuuccc

SEQ ID NO: 243189 - RNA, 64 nt, Human
uuccagcugagugaagcuaggcaaauggagugggggcaggcaucuauuccugcccccaucaugc

SEQ ID NO: 243190 - RNA, 64 nt, Human
gaccgcuuguggauggagaaggggagagcaucuaggcaggcaaacagaagggaaguggaguuaa

SEQ ID NO: 243191 - RNA, 64 nt, Human
gugacaguuuccccggugugagcccggugagggcggcaggcagggguuauccggccccacuuuc

SEQ ID NO: 243192 - RNA, 64 nt, Human
ggacucuuccaucagagaugggaaaaccauuggggaggacuaggacccauaugggaauuauuac

SEQ ID NO: 243193 - RNA, 64 nt, Human
caauaaaaugagcuaaaugggcuaggugaauuuggaggacuacuucaguccuaacuuauaguau

SEQ ID NO: 243194 - RNA, 64 nt, Human
ccaccuguuuucugccgugaccuuuggucccauugaggacuaaggaucgggacccuuucuuuac

SEQ ID NO: 243195 - RNA, 64 nt, Human
cuuuuguauuauagacaaauauauaaauaauaaaggcaggcaacuuucauuugcacuaauguac

SEQ ID NO: 243196 - RNA, 64 nt, Human
ucuacaaaaaguacaaaaauuagucgggcgugauggcaggcaucuguagucccagcuacuuggg

SEQ ID NO: 243197 - RNA, 64 nt, Human
ucacaccuguaaucccagcacuuugggaggccuaggcaggcagacugagcucaggagcuugaga

SEQ ID NO: 243198 - RNA, 64 nt, Human
aucuccauggucucauuugaaagugagcgaggcaggcaggcaugaucccauuuuccagauaagg

SEQ ID NO: 243199 - RNA, 64 nt, Human
uuucaucuccauggucucauuugaaagugagcgaggcaggcaggcaugaucccauuuuccagau

SEQ ID NO: 243200 - RNA, 64 nt, Human
gcugcagugaaggggucucuagggcuuugggauuggcaggcacacugugagaccaacaacuccu

SEQ ID NO: 243201 - RNA, 64 nt, Human
cucacgccuguaaucccaguacuugggaggccaaggcaggcauaucaacuugaggccaggaguu

SEQ ID NO: 243202 - RNA, 64 nt, Human
uguucaugcacacauuccuccaugggguggggaaggcaggcaugggguguggcccucggagaag

SEQ ID NO: 243203 - RNA, 64 nt, Human
aguggcuccugggagcagaaaaggaauugaggugggcaggcagaagagccuggauugcucacug

SEQ ID NO: 243204 - RNA, 64 nt, Human
cagggugacgugugccuaugcaauggggugguaaggcaggcacgaagaguccaaaaaaucuagg

SEQ ID NO: 243205 - RNA, 64 nt, Human
auugaaaagguuucuucaucugggucuugcaggaggcaggcaacaccaggagcagaaaugaaag

SEQ ID NO: 243206 - RNA, 64 nt, Human
ccagccucuuggggcugggacuuucucacccugcggcaggcacaacagaugcugggacccaguc

SEQ ID NO: 243207 - RNA, 64 nt, Human
cagguccucacagcagucacaggcccaggaaggcggcaggcagagaaguggagugacuauuugg

SEQ ID NO: 243208 - RNA, 64 nt, Human
cacgagagaccucguggcagcaugugaucuggaaggcaggcaggacgggggcguuggggagcca

SEQ ID NO: 243209 - RNA, 64 nt, Human
aguuucuggauauugacuuaagaacuguuaggaagaggacuagaaaaggcuuccccugccuauc

SEQ ID NO: 243210 - RNA, 64 nt, Human
agaaggaggccccgaguuagaaaaaguagcuauggaggacuacaaggauaacccagcauuugcg

SEQ ID NO: 243211 - RNA, 54 nt, Human
gagcugcccacacuguauaggacggaggacuauuuuccuguggacgccggggaa

SEQ ID NO: 243212 - RNA, 64 nt, Human
ucccaccucagccucccauguagcaggaaccacaggcaggcaccaccauacccagcuaauuuuu

SEQ ID NO: 243213 - RNA, 64 nt, Human
aacagggacuugaauuagcagagucuaaaaucagggcaggcaaacgauaaucugagugcaaguc

SEQ ID NO: 243214 - RNA, 64 nt, Human
gagcacagcuuagcuggggcgagaugcaugugaaggcaggcagugccaagauuccgcuuccuuu

SEQ ID NO: 243215 - RNA, 64 nt, Human
agauggaccaggcgguggacagauggguagauguggcaggcaugucaucgacagcacagaaggg

SEQ ID NO: 243216 - RNA, 64 nt, Human
uccccagaaagcaggacagaaagaaggagggacaggcaggcagcaggaggggcgagcugggagg

SEQ ID NO: 243217 - RNA, 64 nt, Human
caggagcuuuacucauggcagaaggcaaagcaaaggcaggcacuucacacaguaaaagcaggag

SEQ ID NO: 243218 - RNA, 64 nt, Human
acaggcuuaauuaggccacaguacagugauccaaggcaggcaaggcagccaggacaggggagcc

SEQ ID NO: 243219 - RNA, 64 nt, Human
aucaacguacagugagcucuuugaagccaaccaaggcaggcagaacccucuuaaauaugagacu

SEQ ID NO: 243220 - RNA, 64 nt, Human
ucaugccuguaaucccaguacucugggaagccaaggcaggcagaucacuugaggucaggaguuc

SEQ ID NO: 243221 - RNA, 64 nt, Human
uguacuaaaaauacaaaauuuagcuuggccugguggcaggcaccuguaaucccagcugcccaag

SEQ ID NO: 243222 - RNA, 64 nt, Human
ucacgccuauaauccuaucacuuugggaggccuaggcaggcagaucaccugaggucaggaguuc

SEQ ID NO: 243223 - RNA, 64 nt, Human
ggaguugaaagcccaguuucugacacacaggccuggcaggcaggacuccuugugcucccagcag

SEQ ID NO: 243224 - RNA, 64 nt, Human
agucaaggcagugggaugggcggcugaggaacggggcaggcaaggucacugcucagucacgucc

SEQ ID NO: 243225 - RNA, 64 nt, Human
uauuuacuuaguagcaucacugugugucuuagcaggcaggcagugucuggccauuauugcguuc

SEQ ID NO: 243226 - RNA, 64 nt, Human
cugagcucugccucaacuccacccucugcgaccggaggacuaugccccuaguaacugcugucgg

SEQ ID NO: 243227 - RNA, 64 nt, Human
cccacccaucucuggagagcccucugcacccaaagaggacuagagaugccgagcggccaugaga

SEQ ID NO: 243228 - RNA, 64 nt, Human
ccugugaaggaacgcugucucuuugcaaaguaaggaggacuaagggaaaaugaugguaccaugu

SEQ ID NO: 243229 - RNA, 64 nt, Human
agcaccuauuuugaauuaaugugagaccacagguggcaggcagauuccugcuuggcauaagcau

SEQ ID NO: 243230 - RNA, 64 nt, Human
cuuuaugaaagacaucacauggcauccagggccaggcaggcagcuugaggugccuuuacgagaa

SEQ ID NO: 243231 - RNA, 64 nt, Human
uccaaggugggucaggagguucuggccccgcuggggcaggcagggcagggucugugaagcuuaa

SEQ ID NO: 243232 - RNA, 64 nt, Human
ggaggaucccaggauaaacacugcugggcaggcgggcaggcaggccuggggcugcccugcucac

SEQ ID NO: 243233 - RNA, 64 nt, Human
agguuuauaugugaauauaagugucccugaauggggcaggcauuaaauagaagaaucccugcug

SEQ ID NO: 243234 - RNA, 64 nt, Human
auacaaacccugaaaagagaauccaugugcuacuggcaggcaacauuuuuuaaagcucuuucag

SEQ ID NO: 243235 - RNA, 64 nt, Human
ugcaggcaagguacccgaagaagcagaggcugagggcaggcaaagccugugugacuguggcagu

SEQ ID NO: 243236 - RNA, 64 nt, Human
cccuagaaagccaugugcagccaccaguccauugggcaggcagauguuccuaauaaagcuucug

SEQ ID NO: 243237 - RNA, 64 nt, Human
ucagguguguugcagugucugcuggagacauugaggcaggcacugccaaaacaucaaccugcca

SEQ ID NO: 243238 - RNA, 64 nt, Human
gcuaaugggacugacgcuacauggggcucacucaggcaggcacgcgcuucauacaaagcaucuc

SEQ ID NO: 243239 - RNA, 64 nt, Human
gcccccgcacgaaucaccuccugcuggcuaccggggcaggcaugcacccggugccagccccgcu

SEQ ID NO: 243240 - RNA, 64 nt, Human
gaagaggcucccaacccagagugucccugugggaggcaggcagaaggugacaauugacacgauu

SEQ ID NO: 243241 - RNA, 64 nt, Human
aaggaaauagaggacgaaggccuguguguugccaggcaggcaccugggcuuucuggaauccaaa

SEQ ID NO: 243242 - RNA, 64 nt, Human
cccacacgaagucaccagcccauagguccagggaggcaggcaguuaacugagaauuggagagga

SEQ ID NO: 243243 - RNA, 64 nt, Human
aaauuagcugagcaugguggugggcuccuguagucccagcuacuugggaggcugaggcaggaga

SEQ ID NO: 243244 - RNA, 64 nt, Human
aaauuagccaggcaugguagcaggugccuguaaucccagcuacuggggaaagcugaggcaggag

SEQ ID NO: 243245 - RNA, 64 nt, Human
ucuagcuuuguuguccucccaggaaccaaaaaaccccagcuauuuucugaccaaaauguguuuc

SEQ ID NO: 243246 - RNA, 64 nt, Human
ccccucccaaggggcaauucugaaccccaucuuuggcaggcauacauauuucacuguuuccaaa

SEQ ID NO: 243247 - RNA, 64 nt, Human
agacugcagaccagugcuucacuguguggaguggggcaggcaggggcuggaccccagggacuug

SEQ ID NO: 243248 - RNA, 64 nt, Human
cacagggaucuucugaaguugcuuugaaucaaaaggcaggcagugcugguuccucugccugugu

SEQ ID NO: 243249 - RNA, 64 nt, Human
guuuuuguggcuuuguucaaugcuuccacucuagggcaggcagagcagucuauacucucccaag

SEQ ID NO: 243250 - RNA, 64 nt, Human
ucacgccuguaaucccaacacuuugggaggcugaggcaggcagaucacgaggucaggaguucga

SEQ ID NO: 243251 - RNA, 64 nt, Human
aacccuuggcccaaagacucaccaggugggacguggcaggcaggccucaguugaggacgugaug

SEQ ID NO: 243252 - RNA, 64 nt, Human
gccagaauuguugccugagcgugccaggcugcagggcaggcaguaaaaggcccccacauacccu

SEQ ID NO: 243253 - RNA, 64 nt, Human
cucaucagcuuuuuuaccauugagccaggagugcggcaggcaguaccugccugacccuucaagg

SEQ ID NO: 243254 - RNA, 64 nt, Human
ucaggcguccaucugaugcaugggaccaacauaaggcaggcagggauacaaggcagucuggaaa

SEQ ID NO: 243255 - RNA, 64 nt, Human
ccuggcauaaaaagugcucaaacacaccagagggggcaggcaccagccaggguaugauggcuac

SEQ ID NO: 243256 - RNA, 64 nt, Human
acguugccugagcccaaauguguaguguggucugggcaggcagaccuuuagguuuugcugcuua

SEQ ID NO: 243257 - RNA, 64 nt, Human
caugaaggauaaaccaacuuauuuguauaccuaaggcaggcauuuggaucaguaacauguuuua

SEQ ID NO: 243258 - RNA, 64 nt, Human
ucccccagcccacgcuuaggaaugcuuggccucuggcaggcaggcagcuguacccaagcuggug

SEQ ID NO: 243259 - RNA, 64 nt, Human
ccagcccacgcuuaggaaugcuuggccucuggcaggcaggcagcuguacccaagcuggugggca

SEQ ID NO: 243260 - RNA, 64 nt, Human
aaauuagccaggcaugguggcacacgccuauagucccagcuacucaggaggcugaggcaggaga

SEQ ID NO: 243261 - RNA, 64 nt, Human
uaccccaucuccaagauaagccugagccuuagcucccagcuagggggcguuauuuauggaccac

SEQ ID NO: 243262 - RNA, 64 nt, Human
aaauuagccggccaugguggcaggugcuuguaaucccagcuacuugggaggcugaggcaggaga

SEQ ID NO: 243263 - RNA, 64 nt, Human
caccugcaggccagucucaacccucccccaggugggcaggcacuugauggcuacaaauaaaugu

SEQ ID NO: 243264 - RNA, 64 nt, Human
uuauuuaaacucacuuaauuaaggaaaauauuuucccagcuagaaaaguauacucauucucauu

SEQ ID NO: 243265 - RNA, 64 nt, Human
aaauuagccgggcgugguggcaccugccuguaaucccagcuacuugggaggcugaggcaggaga

SEQ ID NO: 243266 - RNA, 64 nt, Human
gaagagagguggggguggaggggaauuagucugucccagcuagagggagauaaagagggcuagu

SEQ ID NO: 243267 - RNA, 64 nt, Human
aaauuagccaggugugguggugcacaccuguggucccagcuacuugggaggcugaggugggaaa

SEQ ID NO: 243268 - RNA, 64 nt, Human
cuacuuuggagacugaggugggaguaccccuugagccugggaggcgcagguugcagugaaccaa

SEQ ID NO: 243269 - RNA, 64 nt, Human
acacugcucuuuuugauuuuauuuguacuuuuuggccugggauauggguuuuaaauggacauug

SEQ ID NO: 243270 - RNA, 64 nt, Human
guauuugcagaauacacaaggucauuucccaguggccugggagaggcagugagccuucucucca

SEQ ID NO: 243271 - RNA, 64 nt, Human
caaaggugguggugguuugggucaucagaggacugccugggacgguucagcgggcacggagcgc

SEQ ID NO: 243272 - RNA, 64 nt, Human
gagcacucgcggcgugggugggcugaguggaggugccugggagcugccuaaauucagaagccuc

SEQ ID NO: 243273 - RNA, 64 nt, Human
uucugugagggagaaucagggcucgggaagccacgccugggaaggcaggacacaggacacagca

SEQ ID NO: 243274 - RNA, 64 nt, Human
aggugcgguguggccaccgccacccucauccccugccugggaggcucucccaggggcugauggg

SEQ ID NO: 243275 - RNA, 64 nt, Human
cuuucuuuccucaucuccccacuccccacucucagccugggagacuccugccaagcccucauua

SEQ ID NO: 243276 - RNA, 64 nt, Human
acagcguuugggaaacaagacuuuuccugcaauagccugggaaggaauaaaaggauagaguguu

SEQ ID NO: 243277 - RNA, 64 nt, Human
cccuguauuaggccauuaugauuagagauaagcagccugggagaaacauacaagaccuguggcu

SEQ ID NO: 243278 - RNA, 64 nt, Human; identical to SEQ ID NO: 195458

SEQ ID NO: 243279 - RNA, 64 nt, Human; identical to SEQ ID NO: 195468

SEQ ID NO: 243280 - RNA, 64 nt, Human; identical to SEQ ID NO: 195474

SEQ ID NO: 243281 - RNA, 64 nt, Human; identical to SEQ ID NO: 195479

SEQ ID NO: 243282 - RNA, 64 nt, Human
ccacucgcaucugggcaauguugacauuugagguggcaggcaggaugccugccuucuaauauau

SEQ ID NO: 243283 - RNA, 64 nt, Human
uccacaagcagaggcccccucgaugggagggaguggcaggcaggagaagguggcgcugccaggu

SEQ ID NO: 243284 - RNA, 64 nt, Human
uggugcugggggagcugcagauggcccuggagugggcaggcaggccagggcugcgcaucagugg

SEQ ID NO: 243285 - RNA, 64 nt, Human
guccccacccccgcccuuggugcugucauaaaagggcaggcaggggcaggcugaggaguugccc

SEQ ID NO: 243286 - RNA, 64 nt, Human
cuuccagaacagucugccccucaaggaaggguggggcaggcaguacccccaagcaggcugcucc

SEQ ID NO: 243287 - RNA, 64 nt, Human
aggaaacaguucuuuaaaguuaggaaagggaguaggcaggcauguguuggcaaaggcuguuaau

SEQ ID NO: 243288 - RNA, 64 nt, Human
ggaaaauuagauaagcaccuggcaucuaauggcaggcaggcacucaagaaaugaauuaacuaca

SEQ ID NO: 243289 - RNA, 64 nt, Human
aacuggaaaauuagauaagcaccuggcaucuaauggcaggcaggcacucaagaaaugaauuaac

SEQ ID NO: 243290 - RNA, 64 nt, Human
ccucaaacaaacccaaagggggaggguagggcagggcaggcagauuggaaaucugccugcagau

SEQ ID NO: 243291 - RNA, 64 nt, Human
ggcccaugaugacauuucaugaggcccagaugugggcaggcagcccgggcugcacuaugcgguc

SEQ ID NO: 243292 - RNA, 64 nt, Human
caccagugaccauguucauccacugugaccacuaggcaggcacugcucucugcagaggggguca

SEQ ID NO: 243293 - RNA, 64 nt, Human
ccaggcuaaauaugugccuuccucagggcuguggggcaggcacuagggggccuuucccuuccuu

SEQ ID NO: 243294 - RNA, 64 nt, Human
gcuguggaguucaaaugucgaugcuacccuggcuggcaggcaccguggugugagcggaagagca

SEQ ID NO: 243295 - RNA, 64 nt, Human
ccuuaucagagcuaagggugggugcucagaauaaggcaggcauugaggaagagucuugguuucu

SEQ ID NO: 243296 - RNA, 64 nt, Human
cagaggaauagcucagccugaacagugugauggucccagcuacuacaucagaugcgguuuuuuu

SEQ ID NO: 243297 - RNA, 64 nt, Human
auugaagccaggcaugaaggcuggcgcccguaaucccagcuacuaaggcuggaggaucacuuca

SEQ ID NO: 243298 - RNA, 64 nt, Human
aaauuagcugggcgugguggugcaugccugaaaucccagcuacuugggaggcugaggcaggaga

SEQ ID NO: 243299 - RNA, 64 nt, Human
ucccccuacugaggccagcugagguacaggcaggggcaggcaggaccaccagcagggggcugcc

SEQ ID NO: 243300 - RNA, 64 nt, Human
ucuauuaaaaauacaaaaauuagcugggcaugauggcaggcaccuguaaucccagcuacucggg

SEQ ID NO: 243301 - RNA, 64 nt, Human
ugaaugacaugcucacagucacacagcaggcaguggcaggcaguagugaagucggcucuaugga

SEQ ID NO: 243302 - RNA, 64 nt, Human
cuccagggggcccagggugccugcacuuugcuguggcaggcagauugggugguagugggagguu

SEQ ID NO: 243303 - RNA, 64 nt, Human
gaauuuugaaacuucucagaaauuaaucugaaauggcaggcaguaagugcagcagaaucuggca

SEQ ID NO: 243304 - RNA, 64 nt, Human
uuucaaugauagucuucauuuuuaaaaacaaaaaggcaggcagacagaaauaaugauguuuucu

SEQ ID NO: 243305 - RNA, 64 nt, Human
ucuaauaaaaauacaaaaauuagccaggcgugguggcaggcaccuguaaucccagcuacucggg

SEQ ID NO: 243306 - RNA, 64 nt, Human
agugacuugggccuucacaaacaggguguggaguggcaggcagaggccucuaaaucucagggca

SEQ ID NO: 243307 - RNA, 64 nt, Human
uacaacggaggccugcgacccugggggcacaggaggcaggcauggcccugggcggggcgugggg

SEQ ID NO: 243308 - RNA, 64 nt, Human
ccuucaccuggcacaggacaugcaagauaaauagggcaggcacguguuuggguguccucucuuu

SEQ ID NO: 243309 - RNA, 64 nt, Human
agggggaccugggaccugcggcuuaguucccugaggcaggcagggcuuauuggggccauuucau

SEQ ID NO: 243310 - RNA, 64 nt, Human
gugucugucaggaugguccccccgaggcgcucugggcaggcauccugguguccugagaggcucu

SEQ ID NO: 243311 - RNA, 64 nt, Human
ugagccccgcccugccaugagguuuuccuccccaggcaggcaggaggccgcggggagcacgugg

SEQ ID NO: 243312 - RNA, 64 nt, Human
agauggcagcuuggaucucagguacagcuccaggggcaggcagugcccagcuggaccugguggc

SEQ ID NO: 243313 - RNA, 64 nt, Human; identical to SEQ ID NO: 195488

SEQ ID NO: 243314 - RNA, 64 nt, Human; identical to SEQ ID NO: 195493

SEQ ID NO: 243315 - RNA, 64 nt, Human; identical to SEQ ID NO: 195498

SEQ ID NO: 243316 - RNA, 64 nt, Human; identical to SEQ ID NO: 195505

SEQ ID NO: 243317 - RNA, 64 nt, Human
gggagaugcgggaagcugacccagugguccucuaggcaggcagggugcuccuggugucugccca

SEQ ID NO: 243318 - RNA, 56 nt, Human
gcagauccgucacagacuaaggagauggcaggcauugacagcuucacuccaugaag

SEQ ID NO: 243319 - RNA, 64 nt, Human
cuacuaaaaauacaaaaaaugagccgggugcaauggcaggcaccuauaaugccagcuacucggg

SEQ ID NO: 243320 - RNA, 64 nt, Human
uguaaggcuuugagacaugcuacugaauuuggagggcaggcacgaagaacagugagauugucaa

SEQ ID NO: 243321 - RNA, 64 nt, Human
aguuggucaaacuuguuuucuuuuuauaacucauggcaggcaucuguaagaaguagagaaccca

SEQ ID NO: 243322 - RNA, 64 nt, Human
cgcuacgggacccgagccgucccagaaaccaaagggcaggcacggcagcaaacgccugagguaa

SEQ ID NO: 243323 - RNA, 64 nt, Human
acuaaaaaugcaaaaaaaauuagccgggcgugguggcaggcaccuguagucccagcuacucggg

SEQ ID NO: 243324 - RNA, 64 nt, Human
ucaugccuguaauccuagcacuuugggaggcugaggcaggcaaucacuugaggucaggaguucg

SEQ ID NO: 243325 - RNA, 64 nt, Human
ucacaccuguaaucccagcacuuugggaggcugaggcaggcagaucaugaugucaggaguuuga

SEQ ID NO: 243326 - RNA, 64 nt, Human
ucacgucuguaaucccagcaccuugggaggcccaggcaggcagaucaccugaggucgggaguuc

SEQ ID NO: 243327 - RNA, 64 nt, Human
aacaaaaaaaggauggggcugggcuggagaggguggcaggcagugguuguggcaguggagcugg

SEQ ID NO: 243328 - RNA, 64 nt, Human
aggaagcugguaugaguaaggccuugagggugcaggcaggcagcccuguaccccacccacauag

SEQ ID NO: 243329 - RNA, 64 nt, Human
ugaggcugcuguuggggguggggggaggggaaugggcaggcaagccagucuucugucuuccuuu

SEQ ID NO: 243330 - RNA, 64 nt, Human
ggcggguugggguccgcggguccucacaccgcacggcaggcacagaggcucgccaggcccugau

SEQ ID NO: 243331 - RNA, 64 nt, Human; identical to SEQ ID NO: 195508

SEQ ID NO: 243332 - RNA, 64 nt, Human; identical to SEQ ID NO: 195513

SEQ ID NO: 243333 - RNA, 64 nt, Human; identical to SEQ ID NO: 195517

SEQ ID NO: 243334 - RNA, 64 nt, Human; identical to SEQ ID NO: 195525

SEQ ID NO: 243335 - RNA, 64 nt, Human
cagagaagccuccaccugaggauggggaggaccuggcaggcagcuuccacggcagggcugggaa

SEQ ID NO: 243336 - RNA, 64 nt, Human
ucacaccuguaaucccagcgcuuugggaggcuaaggcaggcagaucacuugagaccagcuuggg

SEQ ID NO: 243337 - RNA, 64 nt, Human
gcagagcuaagaauggagugaagaaaggcaguauggcaggcaccagcaaagaguugagggcugu

SEQ ID NO: 243338 - RNA, 64 nt, Human
cauucucacuuguacuuugauuucuuauuucuugggcaggcaauuugaggaaagaagaaauggc

SEQ ID NO: 243339 - RNA, 64 nt, Human
ucaguuccaugguguuaauuugaaaugccuuaauggcaggcaaaaaccagucauuucauuuuug

SEQ ID NO: 243340 - RNA, 64 nt, Human
gcugugcuguggcccaggccagagccugugggcaggcaggcagggcauagcgacagugugggac

SEQ ID NO: 243341 - RNA, 64 nt, Human
cccugcugugcuguggcccaggccagagccugugggcaggcaggcagggcauagcgacagugug

SEQ ID NO: 243342 - RNA, 64 nt, Human
ggggcuguggccucucagggggcagccucuccauggcaggcaucccugccuugggcugcccucc

SEQ ID NO: 243343 - RNA, 64 nt, Human
ucuaucauauggagcgagguguuggggaaggcggggcaggcagccuguugcaggcaggggaagg

SEQ ID NO: 243344 - RNA, 64 nt, Human
uuucaguguuguguucagccaaggggacggucugggcaggcagcuuaagugugaguuuagucac

SEQ ID NO: 243345 - RNA, 64 nt, Human
cacaucaccacagcucccuagggucugccgagaaggcaggcagucuuuggguucuguucuuugu

SEQ ID NO: 243346 - RNA, 64 nt, Human
ugccaccacagggcaccagggaugauccugauguggcaggcaggggagacucacagaaaaaucu

SEQ ID NO: 243347 - RNA, 64 nt, Human
gcauucucauaccugcccacagcuccauuuuggaggcaggcagguuggugccugacagacaacc

SEQ ID NO: 243348 - RNA, 64 nt, Human
uaaaccguggcugucuccugcagugagccaccgcggcaggcacguugacuguuuuacugacauc

SEQ ID NO: 243349 - RNA, 64 nt, Human
aaauuagccaggcgugguggcaggcgccuguagucccagcuacucaggaggcugaggcaggaga

SEQ ID NO: 243350 - RNA, 64 nt, Human
aaauuagccaggcauaguggcgcgcgccuauaaucccagcuacugggaggcugaggcgggagaa

SEQ ID NO: 243351 - RNA, 64 nt, Human
aaauuggcugggugcggugguacaugccuguagucccagcuacuugggaggcugaggcaggaga

SEQ ID NO: 243352 - RNA, 64 nt, Human
caggacucaucaggaccucccuggaccccugcagggcaggcagcuugggcccgagcccaagcau

SEQ ID NO: 243353 - RNA, 64 nt, Human
cagagcaccuugaaggagacccuugacugugacuggcaggcaggugaggggcacagcaccccuc

SEQ ID NO: 243354 - RNA, 64 nt, Human
ucacgccuguaaucccaacaccuugggaggccaaggcaggcagaucacgacaucaggagaucga

SEQ ID NO: 243355 - RNA, 64 nt, Human
agaaaguggaagagaccacaaagcgcaggcaauuggcaggcagugggggagccagggcucugca

SEQ ID NO: 243356 - RNA, 64 nt, Human
gcaucacccucugcucgcaccauuguuuuaauacggcaggcagcuucaccugcggcugccccca

SEQ ID NO: 243357 - RNA, 64 nt, Human
gaaguguuuacacauggagagaugccccauggugggcaggcagaugaugaaguacuggcaggua

SEQ ID NO: 243358 - RNA, 64 nt, Human
gcugccggcaccgcccuccugcugccagagacgaggcaggcacagcugccagagaccauccagg

SEQ ID NO: 243359 - RNA, 64 nt, Human
gacugucuuuccuauagacuguaagcuccaugagggcaggcacauguuguucucauugaccgug

SEQ ID NO: 243360 - RNA, 64 nt, Human
ggacccacaaaacuaaccuaguucaggguucucaggcaggcaguucugcuucagcuuagagcag

SEQ ID NO: 243361 - RNA, 64 nt, Human
gguuagcuguacauucauugaggaacuguugauuggcaggcacugauucucuagaacacugggc

SEQ ID NO: 243362 - RNA, 64 nt, Human
gaauaguccuucuagagguaacuuggauagccuaggcaggcaacuuaucauguggugaaggccg

SEQ ID NO: 243363 - RNA, 64 nt, Human
gucuaucucagccuaguguucugcagcacacaugggcaggcaguuuacucacacugacagguga

SEQ ID NO: 243364 - RNA, 64 nt, Human
cuugugacuugacgugauaaaaguucauuuauugggcaggcaaaguccucugcaggccuggaaa

SEQ ID NO: 243365 - RNA, 64 nt, Human
ucaugccuguaaucccagcacuuugggaguccaaggcaggcauaucauuugaggucaggaguuu

SEQ ID NO: 243366 - RNA, 64 nt, Human
ggauguucaguggauaucggucacaugccagguccccagcuacgcauucaaggauggauaauau

SEQ ID NO: 243367 - RNA, 64 nt, Human
aaauuagccaggcgugguggugugccccuguaaucccagcuacucaggaggcugaagcaggaga

SEQ ID NO: 243368 - RNA, 64 nt, Human
ggaagacgguggaaacccgaggauguguggguuucccagcuaacggacaagcuccccugccaca

SEQ ID NO: 243369 - RNA, 64 nt, Human
ugugacacguguacugcagaguguuucaaaaccgggcaggcaauuagcaaugggaaauaagugg

SEQ ID NO: 243370 - RNA, 64 nt, Human
cccaaggcgacuaagagacagccuccuuggcaagggcaggcaccacuuuguagcaacuugggca

SEQ ID NO: 243371 - RNA, 64 nt, Human
ugugcccacugucucuuccacuuggucuggguuuggcaggcacugccugcuacuugagggccag

SEQ ID NO: 243372 - RNA, 64 nt, Human
gguuuuucuccuuguauggacugcucgcuccaagggcaggcagagcucaugaaugccucuuauc

SEQ ID NO: 243373 - RNA, 64 nt, Human
cuccagcgagucuuccccguguguccucaucugcggcaggcaggagagggggagcaaacaggaa

SEQ ID NO: 243374 - RNA, 64 nt, Human
cuuggccugcacaguagcaaugcugggagcuagaggcaggcagggcaguugggucccuugccag

SEQ ID NO: 243375 - RNA, 64 nt, Human
aucucuacuaaaaauacaaaaaauuagguguaguggcaggcaccuguaaucccagcuacucggg

SEQ ID NO: 243376 - RNA, 64 nt, Human
ucuacuaaaaauacaaaaaucagccgggucucauggcaggcaccuguaaucccaucuacugagg

SEQ ID NO: 243377 - RNA, 64 nt, Human
uguagagcuugguuaucggccggcccgguggcuuggcaggcagugcugugcgcugcucauggag

SEQ ID NO: 243378 - RNA, 64 nt, Human
uaaaaaugcaaaaaaaaaauuaaccgggcgugguggcaggcaucuauaaucccagcuacuuggg

SEQ ID NO: 243379 - RNA, 64 nt, Human
cccuucaagcgcuguaaagcaccaacccggaaguggcaggcacagaaggaagggcuggauuggg

SEQ ID NO: 243380 - RNA, 64 nt, Human
aaaacccucacagaaagucaucgaggcaaaaagaggcaggcaguggagucucccugucgacagu

SEQ ID NO: 243381 - RNA, 64 nt, Human
gucaccaagcccucucccgacccaggcuuuguggggcaggcaccugguaccaaggguaacccgg

SEQ ID NO: 243382 - RNA, 64 nt, Human
ugcagcugggauugaaaguaaucagucgugagcaggcaggcaggagguccuguuagcccugccu

SEQ ID NO: 243383 - RNA, 64 nt, Human
auggcuaggaauguuugacucccuuaaucucuuccccagcuacagaggaaucuuuucucugccu

SEQ ID NO: 243384 - RNA, 64 nt, Human
gcagagaaagguguccaagcugucuucagccuuccccagcuaaagagcagaggagggccugggc

SEQ ID NO: 243385 - RNA, 64 nt, Human
ugaggaaacggguccagggcagucgugugucuuacccagcuacacagggugacauuuuggucua

SEQ ID NO: 243386 - RNA, 61 nt, Human
aggagccgcuggugcagugagcauagcagguggcaggcagcaccaucauucaucuuucuca

SEQ ID NO: 243387 - RNA, 64 nt, Human
ucagguugugggguauuuguuucuacuccagccuggcaggcaaggcuaaaaccugagauuaucg

SEQ ID NO: 243388 - RNA, 64 nt, Human
ggaugccugaggagugcgagcuccacagcaacauggcaggcaggagguccucagaaggugucag

SEQ ID NO: 243389 - RNA, 64 nt, Human
gcacauccuuaaaauaucagcacaaguugggggaggcaggcaauggaauauaauggaauauucu

SEQ ID NO: 243390 - RNA, 64 nt, Human
ucuaugaaaaauauaaaaauuagcugggcaugguggcaggcaccuguaaucccagcuacucggg

SEQ ID NO: 243391 - RNA, 64 nt, Human
cuucagcuuccaggaugcuucucuggaaccucaaggcaggcagcccaggcccugggccugaucu

SEQ ID NO: 243392 - RNA, 64 nt, Human
gcagagagacucuguggcgcggggcauccuaugaggcaggcacccugggcagagagaugcagug

SEQ ID NO: 243393 - RNA, 64 nt, Human
ucaugccuguaaucccagcacuuugggaggccaaggcaggcagaucacuugaggucaggcguuu

SEQ ID NO: 243394 - RNA, 64 nt, Human
ccaggagacaccagggccagagugaccacagcagggcaggcaucaugugugugugugugugugg

SEQ ID NO: 243395 - RNA, 64 nt, Human
gaaagaaaggauauaggaagagagggaagcagaaggcaggcauuuuucuauuuuccccacaaau

SEQ ID NO: 243396 - RNA, 64 nt, Human
ucacgccuauaaucccagcacuuugggaggccaaggcaggcagaucauuugagaucaggaguuu

SEQ ID NO: 243397 - RNA, 64 nt, Human
uuucaguaaagguuggagucaauaugcucugguuggcaggcaacccuguagucauggagaaagg

SEQ ID NO: 243398 - RNA, 64 nt, Human
ccugcugaaacuuuuaacuggaaaccucacaccuggcaggcagcacucucugcagccgugcccu

SEQ ID NO: 243399 - RNA, 64 nt, Human
acuggacggauaacaagaaaaaaauccuaacacaggcaggcaccagaaauaaaugucucagcac

SEQ ID NO: 243400 - RNA, 64 nt, Human
aaauuagccgggcguggcggcacaugccuguaaucccagcuacaugggaggcugaggugggaga

SEQ ID NO: 243401 - RNA, 64 nt, Human
gcuuuuuuggcagauaaacccaacagaggugaggcccagcuaguaaucccuuuuagugggaaag

SEQ ID NO: 243402 - RNA, 64 nt, Human
aaauuagcuggauauggugguaugugccuguaaucccagcuacuugggaggcugaggcaggaga

SEQ ID NO: 243403 - RNA, 64 nt, Human
guggcucaugccuauaagcacccugggaggccgaggcaggcagauuauuugagcucaggaguuu

SEQ ID NO: 243404 - RNA, 64 nt, Human
cuggagaagaaugaaaagaacucccaagaaaccaggcaggcagaagcuccugaaugcuggacua

SEQ ID NO: 243405 - RNA, 64 nt, Human
uguacuaaaaauacaaaaauuagccggacaugguggcaggcaccuguaaucccagcuacuuggg

SEQ ID NO: 243406 - RNA, 64 nt, Human
gcaccaaggguguuuccuguuggggugugucucaggcaggcagcugcgucuuguuggugauaac

SEQ ID NO: 243407 - RNA, 64 nt, Human
gcuggaagagaggccuggcccaugcuccucucagggcaggcacauguacggggcauacaaggca

SEQ ID NO: 243408 - RNA, 64 nt, Human
ucaguggacucagugaagaucugcccucagcgugggcaggcacauccacuugguuggggaccca

SEQ ID NO: 243409 - RNA, 64 nt, Human
cuggagaaguuuuuguaaaccaaacagacaagcaggcaggcagccugagagcuggcccaggggu

SEQ ID NO: 243410 - RNA, 64 nt, Human
cugcuucccggcaugccuucauuuugcuauggggggcaggcaggggggauggaaaauaaguaga

SEQ ID NO: 243411 - RNA, 64 nt, Human
ggcagugagccccgcugaccccgggccagcacuuggcaggcaggaggugcggucuccagagugg

SEQ ID NO: 243412 - RNA, 64 nt, Human
ucccgccuguaaucucagcacuuugggaggccaaggcaggcaaucaccugagggcaggagacca

SEQ ID NO: 243413 - RNA, 64 nt, Human
uguguacuuguguuuuuuaaucagcauuaacaugggcaggcacccucauuuauagaugucagga

SEQ ID NO: 243414 - RNA, 64 nt, Human
acacugaggcggaagaucgcaagucagaguggcuggcaggcacaaccuccuggcacaccagagg

SEQ ID NO: 243415 - RNA, 64 nt, Human
uauccuuugcaugggaggagaguuacucuugaaaggcaggcagcuuaaguggacaauguuuugu

SEQ ID NO: 243416 - RNA, 64 nt, Human
aaaccaaaguccucugggguagggagcagggcugggcaggcauucugggggcagggugggggag

SEQ ID NO: 243417 - RNA, 64 nt, Human
aaauuagcugggcaugguggcaggagccuguaaucccagcuauucuggagguggagacaggaga

SEQ ID NO: 243418 - RNA, 64 nt, Human
gggguguggagggagcagacuccaccggcccaggcccagcuaagagggggccgaccccuuuccc

SEQ ID NO: 243419 - RNA, 64 nt, Human
aaacuagcugggcgugguggcaggagccuguagucccagcuacucgggaggcugaggcaggaga

SEQ ID NO: 243420 - RNA, 64 nt, Human
ccuccagcugucagagggugagcagggcccuggaggcaggcacccccuccuccuccuccccguc

SEQ ID NO: 243421 - RNA, 64 nt, Human
cuaaauaacucaagaucuuucuggaaugucuucuggcaggcaggugccacugucagcuuuucuc

SEQ ID NO: 243422 - RNA, 64 nt, Human
agcuucaggggauaugcucgucccgggcaccgguggcaggcagcuggccuucuggacuaaggca

SEQ ID NO: 243423 - RNA, 64 nt, Human
uggugucuuguuuucuuucuccuccaugugucuuggcaggcacucauuucuguggcugucggcc

SEQ ID NO: 243424 - RNA, 64 nt, Human
aaguacacacuauuuauuuuuugguuuugucagaggcaggcaggauuuuggagcuggaagaauc

SEQ ID NO: 243425 - RNA, 64 nt, Human
auagucccucugcagagccucgcacuggggccagggcaggcaccagccccaggcggccagucgg

SEQ ID NO: 243426 - RNA, 64 nt, Human
gaggacaguggcugaguggaggcgcccagaccugggcaggcagcaggcucaggcccacaccuug

SEQ ID NO: 243427 - RNA, 64 nt, Human
gcuuuaggguuaaaucauuuaagguccuuuuauaggcaggcacuaguaacuaaaacugaaaacu

SEQ ID NO: 243428 - RNA, 64 nt, Human
gagauuuugcuaugugacauaacaaaauacagcuggcaggcauucauauuaaugacaacauaca

SEQ ID NO: 243429 - RNA, 64 nt, Human
cuauuagagcaguuacugucuguucaguucguuuggcaggcacacacaguggcauaaauucuau

SEQ ID NO: 243430 - RNA, 64 nt, Human
aaaucuccccccccacaggacauacuaguucccuggcaggcaagggcuuccaacugaggcagug

SEQ ID NO: 243431 - RNA, 64 nt, Human
aucauccucucagcagucuuccugucacccgccuggcaggcagaaggagcugcagucccacgug

SEQ ID NO: 243432 - RNA, 64 nt, Human
ccauucccuccaccuccaagacagguggcggccgggcaggcacucuuaagcccaccucccccuc

SEQ ID NO: 243433 - RNA, 64 nt, Human
aaaacuaaguggugagcaugcauugugguguagaggcaggcauuauguaggauaagagcuccgg

SEQ ID NO: 243434 - RNA, 64 nt, Human
acuguauucuuggucaucucaaauggcgucuaaacccagcuacuuugcauuccagaaguuucca

SEQ ID NO: 243435 - RNA, 64 nt, Human
aaauuagccgggcguaguggcgggcgccuguagucccagcuacuugggaggcugaggcaggaga

SEQ ID NO: 243436 - RNA, 64 nt, Human
caucagugaucucacuaaaaauauacagcuacuucccagcuaaucuccacccaaugaaugauga

SEQ ID NO: 243437 - RNA, 64 nt, Human
agagagcaggcaggcccacugcugcugagaacagggcaggcacgggcagcuccuguucugccuu

SEQ ID NO: 243438 - RNA, 64 nt, Human
cacucccuaaagaaaccuauuggcagcuucaacaggcaggcaauaaucucuucccagaaccacu

SEQ ID NO: 243439 - RNA, 64 nt, Human
ccugaaauaacauuagaacauacaggaaaaacgaggcaggcagaucacuuuaggucaggaguuc

SEQ ID NO: 243440 - RNA, 64 nt, Human
cagaggauggccagugucugucccgggguccuguggcaggcagcgccaagcaaccuggguccaa

SEQ ID NO: 243441 - RNA, 64 nt, Human
ccucgagcucuuggauguuguauuucagaucaggggcaggcaccggaguugaggcugugcgccu

SEQ ID NO: 243442 - RNA, 64 nt, Human
acgguagcacuuacagcugaagccaucagcaucuggcaggcacaccugagucaccauguagcgc

SEQ ID NO: 243443 - RNA, 64 nt, Human
uugcaauaaaggaaagguuuguggcgccugucauggcaggcaucucauggagcuccguguggcu

SEQ ID NO: 243444 - RNA, 64 nt, Human
acccuuucacuaugcccucaaccugggagcaucuggcaggcaggggggcagguacacacacacc

SEQ ID NO: 243445 - RNA, 64 nt, Human
ccugcaggugucggggugugggggggcaaggaggggcaggcacacaccaugucugaccugaacc

SEQ ID NO: 243446 - RNA, 64 nt, Human
acggcaaggugcgauguaugucuaacuuauugauggcaggcagcccccugugcccccuaagccu

SEQ ID NO: 243447 - RNA, 64 nt, Human
aguguguguaugugugugugucagagggagaccuggcaggcaccucuuugagaguagcuguggu

SEQ ID NO: 243448 - RNA, 64 nt, Human
ggcugaagccucuggaggcaguugguugggggcgggcaggcaggaggcccucccuccacccccc

SEQ ID NO: 243449 - RNA, 64 nt, Human
cuaccuccucugacccauccacauccuugcggcuggcaggcaggauguuuugaaauggugcagc

SEQ ID NO: 243450 - RNA, 64 nt, Human
gaacauguccauauuugaaggcugccucaggccuggcaggcagaagcagcuguggucccuggag

SEQ ID NO: 243451 - RNA, 64 nt, Human
aaauuugcugagcgugguggugugcaccuguaaucccagcuacucgagaggccaaggcaugaga

SEQ ID NO: 243452 - RNA, 64 nt, Human
aaauuagccagccaugguggcgggcgccuguaaucccagcuacuugggaggcugaggcaggaga

SEQ ID NO: 243453 - RNA, 64 nt, Human
aaauuagccaggcguggucgugggcaccuguagucccagcuacucagggggcugaggcaggaga

SEQ ID NO: 243454 - RNA, 64 nt, Human
gugucccuuuggaccagucucccaagaggagaggggcaggcaggaaagaguggggauccuaagg

SEQ ID NO: 243455 - RNA, 57 nt, Human
ccuucuuuucauggugguagcuccagaggcaggcagaggaaauauugucagagacug

SEQ ID NO: 243456 - RNA, 64 nt, Human
ggguccaguguaggagagagcugguccugggccuggcaggcaagagugugggcauccuuuccug

SEQ ID NO: 243457 - RNA, 64 nt, Human
ucugccugggacugagcgaguggacuuagggcugggcaggcaguagccaccagagggcagcagc

SEQ ID NO: 243458 - RNA, 64 nt, Human
uuccccacacccaagaggaggauuggugguagggggcaggcagaggggguggggagaaguuucc

SEQ ID NO: 243459 - RNA, 64 nt, Human
caaaagacagcugaaaacaagaacuucaccggugggcaggcaagaauucucuucuggaaaauga

SEQ ID NO: 243460 - RNA, 64 nt, Human
uuuuuugcauccaucagagacugcaccucuguguggcaggcagggcauggguuuuaguccuggc

SEQ ID NO: 243461 - RNA, 64 nt, Human
ugacagcccugccuucugcccucugcccugcaugggcaggcauuuguucccuaccuggguggcc

SEQ ID NO: 243462 - RNA, 64 nt, Human
caauuccuuccaugucgccccagagugcccaggaggcaggcagugcggggugcccaggcagacg

SEQ ID NO: 243463 - RNA, 64 nt, Human
agggccuggugaugcuguccucuguaccggaaauggcaggcacugucagauuuccacucuucug

SEQ ID NO: 243464 - RNA, 64 nt, Human
aaguuuauuuucgugugagaugccagccccuccgggcaggcaagggcucugaagauuuggcaac

SEQ ID NO: 243465 - RNA, 64 nt, Human
ugguguuuuaaagccacaaguagggaagauaucuggcaggcagaaagaagucugugaugauaaa

SEQ ID NO: 243466 - RNA, 64 nt, Human
ccgacuggggcgggagacggggcgguucugaucuggcaggcagccaggaucccugacccuuggc

SEQ ID NO: 243467 - RNA, 64 nt, Human
uuugaggacacguggugauacagauagcaugugaggcaggcaugguggcucauguuuguaaauc

SEQ ID NO: 243468 - RNA, 64 nt, Human; identical to SEQ ID NO: 195531

SEQ ID NO: 243469 - RNA, 64 nt, Human; identical to SEQ ID NO: 195535

SEQ ID NO: 243470 - RNA, 64 nt, Human; identical to SEQ ID NO: 195545

SEQ ID NO: 243471 - RNA, 64 nt, Human; identical to SEQ ID NO: 195550

SEQ ID NO: 243472 - RNA, 64 nt, Human
ccucugccaaggaaauaauauggaccauuuaccuggcaggcagucugcucucucucaggaucac

SEQ ID NO: 243473 - RNA, 64 nt, Human
aguggaugccuuagaagggagagggaaggagggaggcaggcauagcaucugaacccaguguggg

SEQ ID NO: 243474 - RNA, 64 nt, Human
cugaaugugcgggggagagggcugggggccggagggcaggcaaggccuggggggugcucgugau

SEQ ID NO: 243475 - RNA, 64 nt, Human
ggcuuucagggaggcccugugccccuugacaacuggcaggcaggcucccagggacaccugggag

SEQ ID NO: 243476 - RNA, 64 nt, Human
cuaacucuguaccuaccaucuccugccucccuuaggcaggcaccuccaaccaccacacacuccc

SEQ ID NO: 243477 - RNA, 64 nt, Human
caccccgcuggcucccagaucagggugggccugaggcaggcagccgaccugaggccugggggca

SEQ ID NO: 243478 - RNA, 57 nt, Human
ucguauugggguuuuccuagacuaugaggcaggcauugucucauuuuucaaugucac

SEQ ID NO: 243479 - RNA, 64 nt, Human
guaggggcaagcaggcaaagaguacuauccacauggcaggcagguggcuuugugucuggaaagc

SEQ ID NO: 243480 - RNA, 64 nt, Human
cuggagaggguugggaagccuuccgucugcggugggcaggcagccucacccugggcccacagac

SEQ ID NO: 243481 - RNA, 64 nt, Human
uaacccacuaaucaguucuuagauucaggggaagggcaggcaccaacaacucagaaugggggcu

SEQ ID NO: 243482 - RNA, 64 nt, Human
acccacaggggcucacugccccacacccgcuccaggcaggcacccagcugggcauuucaccugc

SEQ ID NO: 243483 - RNA, 64 nt, Human
ggcacugcuggguggcccauccccccucaccaggggcaggcacagcacagggauccgacuugaa

SEQ ID NO: 243484 - RNA, 64 nt, Human
aaccagccaggccaggcaaccaguggcccccaaaggcaggcaggauccucaggccccagccgcg

SEQ ID NO: 243485 - RNA, 64 nt, Human
gccagugaaggaccagggaccaggccagggugcgggcaggcaucacugucucuagggguuuggc

SEQ ID NO: 243486 - RNA, 64 nt, Human
cgaguagcugagacuaccggcgcacgccaccacgcccagcuaauuguuuuguauuuuuaguaga

SEQ ID NO: 243487 - RNA, 64 nt, Human; identical to SEQ ID NO: 195555

SEQ ID NO: 243488 - RNA, 64 nt, Human; identical to SEQ ID NO: 195564

SEQ ID NO: 243489 - RNA, 64 nt, Human; identical to SEQ ID NO: 195569

SEQ ID NO: 243490 - RNA, 64 nt, Human
uuaugccuguaaucucagcacuuugggaggccaaggcaggcagaucaugaggucaagagaucaa

SEQ ID NO: 243491 - RNA, 64 nt, Human
ucacgucuguaaucccagcacuuugggaggcugaggcaggcagaucaccugauaucaagaguuu

SEQ ID NO: 243492 - RNA, 64 nt, Human
cccaguguccccuuuuauugcugcuuuuccuuggggcaggcagugaugcuggaugcuccuucca

SEQ ID NO: 243493 - RNA, 59 nt, Human
ugggaagcucuggaagcugagacacuggcggcaggcaccuagcuaugugaccacuggcc

SEQ ID NO: 243494 - RNA, 64 nt, Human
ccgcgccuauaauccuagcacuuugggaggccgaggcaggcagaucacggggucaggagaucaa

SEQ ID NO: 243495 - RNA, 64 nt, Human
caugacugaggcaggcauggaguugggcguuaggggcaggcagagggccuuugcuacacugcug

SEQ ID NO: 243496 - RNA, 64 nt, Human
accccuuccagaagcaaaaacaaaccaugacugaggcaggcauggaguugggcguuaggggcag

SEQ ID NO: 243497 - RNA, 64 nt, Human
ccaucccaugauuuguuccugucugaggcauagaggcaggcaagccguggauuuugcacauggu

SEQ ID NO: 243498 - RNA, 64 nt, Human
ccggccuuucccugugacuuacgugucugucaccggcaggcagcccuacaaauccuggugaccu

SEQ ID NO: 243499 - RNA, 64 nt, Human
gcagacacgcgcccuggcauguggggccugggugggcaggcaggaccugggcccucccacccau

SEQ ID NO: 243500 - RNA, 64 nt, Human
cugcucagcucagcccggcugcggaggaacccuuggcaggcagaaccuggaggugucagaggcu

SEQ ID NO: 243501 - RNA, 64 nt, Human
uccccuggcacucugacugcaugcugaugagcaaggcaggcaggucugagaggcgaaacgaauc

SEQ ID NO: 243502 - RNA, 64 nt, Human
ugugcugugcacaccugcucucuccucucucccaggcaggcagcugcaggcgcucuccuccuuc

SEQ ID NO: 243503 - RNA, 64 nt, Human
aauacuaaaggaugccauccucuggaauccuaauggcaggcaaagggagagaggaagggugacg

SEQ ID NO: 243504 - RNA, 64 nt, Human
aaaaagcagccaggcgugguggcacaucuguggucccagcuacuugagaggcugagccaggagg

SEQ ID NO: 243505 - RNA, 64 nt, Human
ugaguagcugggauuacaggugugcaccaccguacccagcuaauuuuuguauuuuaguagagac

SEQ ID NO: 243506 - RNA, 64 nt, Human
aaaucgucugggcacaguggcucacgccuguagucccagcuacuugggaggcugaggcaggaga

SEQ ID NO: 243507 - RNA, 64 nt, Human
agaugcagacuacagucccugcaauugggucucuggcaggcaauaguugaaggacuccuguucc

SEQ ID NO: 243508 - RNA, 64 nt, Human
agcacggacauggucuguccugacagcacuccucggcaggcauggcuggugccugaagacccca

SEQ ID NO: 243509 - RNA, 64 nt, Human
ggacauuugcugagcaaggagaaccgaugugaauggcaggcagauaacaugcacacaugaagcu

SEQ ID NO: 243510 - RNA, 64 nt, Human
cuauuccaugagaaaagcagagaaccccaaagugggcaggcaaccccgacgagagcuuaucccu

SEQ ID NO: 243511 - RNA, 64 nt, Human
ggcaaaugggaagcaaagucaugucuuaugugguggcaggcagggggacuugugcacaggaacu

SEQ ID NO: 243512 - RNA, 64 nt, Human
ucuugccuguaaucccagcacuuugggaggccgaggcaggcagaucacaaggucaggaguucga

SEQ ID NO: 243513 - RNA, 64 nt, Human
cauaccuguaaaucccagcacuuugggaggccgaggcaggcagaucaccugaggucaagaguuc

SEQ ID NO: 243514 - RNA, 64 nt, Human
gauagcuacugacagccuccugcugcccuacccuggcaggcacaggcgcagcuggcuggggggc

SEQ ID NO: 243515 - RNA, 64 nt, Human
cuacuaaaaauacaaaaaauuagccaggagugguggcaggcaccuguagucccagcuacuuggg

SEQ ID NO: 243516 - RNA, 64 nt, Human
cugcccgccgugcccugcaguaccucaagaucauggcaggcagcaagugaagccccagcuggac

SEQ ID NO: 243517 - RNA, 64 nt, Human
cuuggaucucuuggauaggaguuggugaauagaaggcaggcagcaucacacuggggucacugac

SEQ ID NO: 243518 - RNA, 64 nt, Human
ugcuuagaaagguccccuugucucagccuugcagggcaggcaugccagucucugccaguuccac

SEQ ID NO: 243519 - RNA, 64 nt, Human
gaaucagcugaugaaggggugggcagcaguguggggcaggcaccccacuggcugcagcuagccc

SEQ ID NO: 243520 - RNA, 64 nt, Human
gaaagcuggucuucaggcucucagucccaggcugggcaggcacggucacuucacuucagccuuu

SEQ ID NO: 243521 - RNA, 64 nt, Human
aaauuagcugggcgugguggcauaugccuguggucccagcuacucagaaggcaaguggugaugg

SEQ ID NO: 243522 - RNA, 64 nt, Human; identical to SEQ ID NO: 195572

SEQ ID NO: 243523 - RNA, 64 nt, Human; identical to SEQ ID NO: 195581

SEQ ID NO: 243524 - RNA, 64 nt, Human; identical to SEQ ID NO: 195585

SEQ ID NO: 243525 - RNA, 64 nt, Human
uagaacuacaaagagaaauaaaauccauucucacggcaggcaaaucagugagaaaaauguaaag

SEQ ID NO: 243526 - RNA, 64 nt, Human
gaaucuuggaaaaacccccuuccaggagaggaugggcaggcauuuaaaaaguaccauuuuugug

SEQ ID NO: 243527 - RNA, 64 nt, Human
gccugagcccagggaggccgaagcuaacagggaaggcaggcagggcucuccuggcuucccaucc

SEQ ID NO: 243528 - RNA, 64 nt, Human
ucacgucuguaaucccagcgcuuugggaggccgaggcaggcagaucaccugaggucgggaguug

SEQ ID NO: 243529 - RNA, 64 nt, Human
acaaaaaaaaaaaaaaaaaacaaacagaggcagaggcaggcaguagcaagaaagcagagcguaa

SEQ ID NO: 243530 - RNA, 64 nt, Human
gguuuccagaguugcuagguuugggaguggaaggggcaggcagugcacuugccccuccucaugc

SEQ ID NO: 243531 - RNA, 64 nt, Human
gguggaggaagaagugguggagccucagggccagggcaggcaggagcaggcacugaugcuagag

SEQ ID NO: 243532 - RNA, 64 nt, Human
aaaauuccacaucccaccagaagacagggguguuggcaggcauacuccuaucuccuccucuugg

SEQ ID NO: 243533 - RNA, 64 nt, Human
caagaagccagcuuuuggggaaggcagguccugaggcaggcacugcccuguggucuuccccagg

SEQ ID NO: 243534 - RNA, 64 nt, Human
acccuuggcuugagucccacgugggggaggaggaggcaggcagcaccagcagggguccaccaag

SEQ ID NO: 243535 - RNA, 64 nt, Human
gugaaagggaacaaggaaggugaugugugagucuggcaggcaggagaagggguguucauagaag

SEQ ID NO: 243536 - RNA, 64 nt, Human
cuaaaaaaaaauacaaaaauuagccgggcgugguggcaggcaccuguaaucccagcuacuuggg

SEQ ID NO: 243537 - RNA, 64 nt, Human
uuuuagcuucccuuaagaauuuuugaagugacugggcaggcagcagaaauuaaaugaauuuuuc

SEQ ID NO: 243538 - RNA, 64 nt, Human
caggaaaacugcaaaaaaugggaaguaagguccuggcaggcagacccggcauguagccgcuggc

SEQ ID NO: 243539 - RNA, 64 nt, Human
aaauuagccgggcgugguggcgggcgccuguagucccagcuacucgggaggcugaugcagaaga

SEQ ID NO: 243540 - RNA, 64 nt, Human
aaauuagccgggcaugguggugcacaccuguagucccagcuauucuccaggcugaggugggagg

SEQ ID NO: 243541 - RNA, 64 nt, Human
aaauuagccgggcgugguggcgggcaccuauagucccagcuacucagaagccugaggcugggaa

SEQ ID NO: 243542 - RNA, 64 nt, Human
ucaugccuauaauuccagcacuuugggaggccaaggcaggcagaucacuuugaggucaggaguu

SEQ ID NO: 243543 - RNA, 64 nt, Human
aaaacagagcugaaaacggacuuugggaggccgaggcaggcagaucaccugaggucaggaguuu

SEQ ID NO: 243544 - RNA, 64 nt, Human
cauauuucagcagugcagccggggggcagggaagggcaggcagggucuguuggggucucuuuuu

SEQ ID NO: 243545 - RNA, 64 nt, Human
uauuuuccaaguauuuacugaauucguauuugguggcaggcaguauacuguguaauuuuuagug

SEQ ID NO: 243546 - RNA, 64 nt, Human
uuucuuuuuccuuucuuucgugggcugagaaaggggcaggcaaaaugaagcuggccacugaaaa

SEQ ID NO: 243547 - RNA, 64 nt, Human
uuuaaugugacaguguucaguaaacaaaucaguuggcaggcaccagaagaagaauggauuguau

SEQ ID NO: 243548 - RNA, 64 nt, Human
gcccucggagguccagcugggccuccugccuccgggcaggcaagguuuacacugcggaagccaa

SEQ ID NO: 243549 - RNA, 64 nt, Human
uacccaggggcuuccuauccuggggccuaccccgggcaggcacccccaggggcuuauccuggac

SEQ ID NO: 243550 - RNA, 64 nt, Human
acgcccuucuaguccaaccccccucaaugagagaggcaggcagaucucacccagcacuaggaca

SEQ ID NO: 243551 - RNA, 64 nt, Human
ccccagugcagcucgugauuggaaacucaccaucggcaggcagugguucgguuuaagagauggc

SEQ ID NO: 243552 - RNA, 64 nt, Human
gagccugcacuguccucgccugcagccucagaggggcaggcauccccgcacagacuugacuggc

SEQ ID NO: 243553 - RNA, 64 nt, Human
ucaguucaaauccccacugggauuguuuuguuggggcaggcagggaggaauaauguuaguaccc

SEQ ID NO: 243554 - RNA, 64 nt, Human
acuacaugugaucugccuggugaaggcuaucuggggcaggcacaaauugguggaaaucacaucu

SEQ ID NO: 243555 - RNA, 64 nt, Human
uaaaaguaauaaaaaaugaaauuauuuagaacggggcaggcaaacuacauccugcaggccaaau

SEQ ID NO: 243556 - RNA, 64 nt, Human
ucauuggccgacaucacaguuuuccuguuucccacccagcuaaaaaccguuguuugcuuuaaau

SEQ ID NO: 243557 - RNA, 64 nt, Human
aaacuaguugggcauaguggcaugugccuguagucccagcuacucaggaggcugaggcaggaga

SEQ ID NO: 243558 - RNA, 64 nt, Human
ugggagaacagucucagcacaauugagcagcuugcccagcuaggagcagcagcaacacgagacc

SEQ ID NO: 243559 - RNA, 64 nt, Human
cagaaaccccugcccuuucccuucagaaaacgauggcaggcauuccucugaguuuacaagcaga

SEQ ID NO: 243560 - RNA, 64 nt, Human
uaugguaugcuggccagcacccucuccuggggguggcaggcacacagcagccccccagcacuaa

SEQ ID NO: 243561 - RNA, 64 nt, Human
caccuccaggcuuccgggagcccagagagcauguggcaggcaguggggccucuucaucagcagc

SEQ ID NO: 243562 - RNA, 64 nt, Human
ugcugagcaaaguucagcaaguagagcagaguuuggcaggcaggugccaggaacuccccuucuu

SEQ ID NO: 243563 - RNA, 64 nt, Human
gagggcuaggcacggagggaaggucagaggagaaggcaggcagggcccagugagaggggagcau

SEQ ID NO: 243564 - RNA, 64 nt, Human
uaaugccuagcuugaggggucugcaguccaguagggcaggcagucagguccaugugcacugcaa

SEQ ID NO: 243565 - RNA, 64 nt, Human
aagaccaccaccucagaguauggagcucagagagggcaggcaugaaguuuccuuggcuggugca

SEQ ID NO: 243566 - RNA, 64 nt, Human
uucacaguugagugcaucccagcauucuguuccgggcaggcauuucaggaagaccgccuuguag

SEQ ID NO: 243567 - RNA, 64 nt, Human
cugacccuggcucaccccucuuccuaggccugggggcaggcaguuccuaccauguaccccucuc

SEQ ID NO: 243568 - RNA, 64 nt, Human
ucacgccuguaaucccagcacuuugggaggcugaggcaggcagaucaccugaggcuaggaguug

SEQ ID NO: 243569 - RNA, 64 nt, Human
aagaagacauaauacaugauaaggaauuaccuaaggcaggcagcaaguagauuaggaaucaaug

SEQ ID NO: 243570 - RNA, 64 nt, Human
ggcuccagaguuugagauuugaggcaagagguggggcaggcagauugccucacuuaacuuaaau

SEQ ID NO: 243571 - RNA, 64 nt, Human
gagaucccacuguuagcaagaaaaggcuguccaaggcaggcagugugguaguugucugauuuug

SEQ ID NO: 243572 - RNA, 64 nt, Human
gucccuacacucaauucacugugugagcuggaguggcaggcagggaugcugcuucuguucccuc

SEQ ID NO: 243573 - RNA, 64 nt, Human
ccccgcgaccggagcgccgcucuccgcuucuccacccagcuaacuucugcucgucuuucagagc

SEQ ID NO: 243574 - RNA, 64 nt, Human
acauacccuuggauccccacaguuugguccuccucccagcuaccccuuuauaguaugacgaguu

SEQ ID NO: 243575 - RNA, 64 nt, Human
aauuuagccgggcaugguagcaggcgcuuguaaucccagcuacuugggaggcugaggcuggaga

SEQ ID NO: 243576 - RNA, 64 nt, Human
cucugccuagcucuucccagaggaugugguuuggggcaggcagguauggaucacauaggaugcg

SEQ ID NO: 243577 - RNA, 64 nt, Human
gccacugcggugccagugccccccugaggacuagggcaggcagcugggggcacuugguuccaug

SEQ ID NO: 243578 - RNA, 64 nt, Human
gaucaccuguuuggcagguccuggacuggggccgggcaggcaggggcagggaggcgccccgggu

SEQ ID NO: 243579 - RNA, 64 nt, Human
cuggccggguaagggugccuagcugcccacagagggcaggcacucccauccauccauccgucca

SEQ ID NO: 243580 - RNA, 64 nt, Human
gagcucucuaggaggggccugggggucugguuggggcaggcaggagcagugugguaguacuggg

SEQ ID NO: 243581 - RNA, 64 nt, Human
aagacaaaacggaagcugggaagcuucccuugagggcaggcaggagguggaguugcagcuguug

SEQ ID NO: 243582 - RNA, 55 nt, Human
accaggugcccgccuacuagcggcuggcaggcacagaccagggcuccaaggccac

SEQ ID NO: 243583 - RNA, 64 nt, Human
ucugguggcagcuuucuguggccccugcuguguuggcaggcagguuugcguggugaggagcggg

SEQ ID NO: 243584 - RNA, 64 nt, Human
ggcauggcgaugggggagggcgagggcgagaaagggcaggcacucugcgaauuaaaggccuugg

SEQ ID NO: 243585 - RNA, 64 nt, Human
guugagaggacccaugaaggaagcaaggacacggggcaggcaccuggauguugagaguggagau

SEQ ID NO: 243586 - RNA, 64 nt, Human
gcugacuuugagaucuuuguucccugaggugccaggcaggcaacuuuagcacaugaugaaaaca

SEQ ID NO: 243587 - RNA, 64 nt, Human
cuacggauccaggccauuccugggugagcccuugggcaggcauguuuggagaugagagaggcuu

SEQ ID NO: 243588 - RNA, 64 nt, Human
agggcugaggagugcgggugcacagcgcgggacuggcaggcagcuccaccugcugccccagugc

SEQ ID NO: 243589 - RNA, 64 nt, Human
uagauucuaucaaaaggaacaggguuuuccuagaggcaggcagccuggugguauggcacagcag

SEQ ID NO: 243590 - RNA, 64 nt, Human; identical to SEQ ID NO: 195588

SEQ ID NO: 243591 - RNA, 64 nt, Human; identical to SEQ ID NO: 195591

SEQ ID NO: 243592 - RNA, 64 nt, Human; identical to SEQ ID NO: 195599

SEQ ID NO: 243593 - RNA, 64 nt, Human; identical to SEQ ID NO: 195603

SEQ ID NO: 243594 - RNA, 64 nt, Human
cuaccaaaaauacaaaaaauuagccagauauuguggcaggcacuuuuaaucccagcuacucggg

SEQ ID NO: 243595 - RNA, 64 nt, Human
cucaggcucacaaaaguuggcaaaaugcgggcugggcaggcagcucggggcagggagcagcagu

SEQ ID NO: 243596 - RNA, 64 nt, Human
gccucuuccugaaugggacgccuggggcuuucagggcaggcagcugugcauguucucucaacua

SEQ ID NO: 243597 - RNA, 64 nt, Human
ucuggcagaaauagucgaguuguauugccagccaggcaggcacauggcccaggcagcugucaau

SEQ ID NO: 243598 - RNA, 64 nt, Human
agggcugggugggugcagccagcgugcgggaacgggcaggcagccucccgcugccagucuucgc

SEQ ID NO: 243599 - RNA, 64 nt, Human
ccagcugaaagccccuccgggaggcagguuggaaggcaggcaccacggcagguuuuccgcgaug

SEQ ID NO: 243600 - RNA, 64 nt, Human
gcccacagccacagccacagcugaggaguggccgggcaggcagcaggcuccccagccagggcuu

SEQ ID NO: 243601 - RNA, 64 nt, Human
agcucucacagcgcuaaggaagcaggcccaggcuggcaggcaucucggcuugcaggaggccaac

SEQ ID NO: 243602 - RNA, 64 nt, Human
gagaagcgggcuccuaaugaggugggaaagccacggcaggcagcgagcagcccaggccagcuuu

SEQ ID NO: 243603 - RNA, 64 nt, Human
ucaggccuguaaucccagcacuuugggaagcccaggcaggcagaucacuugaggucaggaguuc

SEQ ID NO: 243604 - RNA, 64 nt, Human
aaucagaagucucacugguggggcugggggugggggcaggcaggaggcauggaugggaaccuga

SEQ ID NO: 243605 - RNA, 64 nt, Human
gagcugugcucagcacaggccugggaccucccccggcaggcaccuguggggggugcagcucccg

SEQ ID NO: 243606 - RNA, 64 nt, Human
guuuaggguggggggggggcgcggcugggaggagggcaggcaucggggagccgggagccugacc

SEQ ID NO: 243607 - RNA, 64 nt, Human
aggacugagggcagugcccuuugagaucuggggaggcaggcauuccugaagggaacuagaggug

SEQ ID NO: 243608 - RNA, 64 nt, Human
cuguggggaguguuuuuguaucacaaagauuagagaggacuacacaucagggcuugauuuauug

SEQ ID NO: 243609 - RNA, 64 nt, Human
gcugggauuacaggugugacccacugcgcacagccccagcuaauuuucauauuuuuaguagaga

SEQ ID NO: 243610 - RNA, 64 nt, Human
uugugaacccccagcauguguuucugacuuuucucccagcuaccuucucaggugccagcugcug

SEQ ID NO: 243611 - RNA, 64 nt, Human
uguggaaugcagcauuaccugcuggacagagcagggcaggcaguucuaugccuuggagcuccug

SEQ ID NO: 243612 - RNA, 64 nt, Human
gggcuccagcugcuggaauccuaccaucccaggaggcaggcacagccagggagaggggaggagu

SEQ ID NO: 243613 - RNA, 64 nt, Human
ugcccagcccagcagcuucuguugucuaacguauggcaggcagacugggagcaggaaaacagag

SEQ ID NO: 243614 - RNA, 64 nt, Human
ggaaguugagggaaaguuuagacaucugcagagaggcaggcagcccagcccaggggacccguuc

SEQ ID NO: 243615 - RNA, 64 nt, Human
gccggugacuuacuguacagcaggcaggagggugggcaggcaaccuccccgggcaggguccugg

SEQ ID NO: 243616 - RNA, 64 nt, Human
auagagcuggggugggguggaucccuauaccuggggcaggcagccccaaagugggggaggggga

SEQ ID NO: 243617 - RNA, 64 nt, Human
uacuaaaaauacaaaaaaauuagucggacaugguggcaggcaccuguagucccagcuacucggg

SEQ ID NO: 243618 - RNA, 64 nt, Human
cucuucaucuggcuguucauuuagcagcuccgagggcaggcaugguggcucaugccuguaaucc

SEQ ID NO: 243619 - RNA, 64 nt, Human
uucauuccauuaaauuaaaaaauacugacuggcuggcaggcaggugccaugucugggaacaggg

SEQ ID NO: 243620 - RNA, 64 nt, Human
agaugggaugacugcgggucaguguacaggaagaggcaggcacuggcuggcucagcuccacucg

SEQ ID NO: 243621 - RNA, 64 nt, Human
ucuuugaccacgucaucgggccagaaggcgugcuggcaggcaaggugaggccugccagaggcua

SEQ ID NO: 243622 - RNA, 64 nt, Human
auaugugugauuccaccguuagaugagcccuuggggcaggcaguuugggaugugcucuuggggg

SEQ ID NO: 243623 - RNA, 64 nt, Human
aagccugagggaaaggccagcacucgcuagcaguggcaggcagaggcccaggcugccguccccu

SEQ ID NO: 243624 - RNA, 64 nt, Human
ugcccaggcuagaugugucuuaucccaauccuuuggcaggcaugcagcuccacaggcgauuucu

SEQ ID NO: 243625 - RNA, 64 nt, Human
cgaguagcuggaauuacaagugcgcacuaccacacccagcuaauuuuugcauuuuuacuugaca

SEQ ID NO: 243626 - RNA, 64 nt, Human
aaauuagcugggugcgcuggcaugugccuguggucccagcuacucaggaggcugaggcaggagg

SEQ ID NO: 243627 - RNA, 64 nt, Human
aaauuagcugggcgugguggcacaugccuguaaucccagcuacuugggaggcugaguugggagg

SEQ ID NO: 243628 - RNA, 64 nt, Human
ggggcuggcuggggccuuaaugugaaaagacaguggcaggcagcuggaguagagcgagcccagc

SEQ ID NO: 243629 - RNA, 64 nt, Human
ucagguccaggggaguccagugggcaggacccuuggcaggcaagccccucccuucacucccagg

SEQ ID NO: 243630 - RNA, 64 nt, Human
gggcagcaaggcagggcagcccagagguggcagcggcaggcaaucuggucacuaggucuuugug

SEQ ID NO: 243631 - RNA, 64 nt, Human
cggcucaccagugccaccugcgggggagggacggggcaggcaggagucugggaggcggguccgc

SEQ ID NO: 243632 - RNA, 64 nt, Human
ccggaaacaagugucugaguggcugggcggggccggcaggcacagggaggagguacagaagccg

SEQ ID NO: 243633 - RNA, 64 nt, Human
agguucaaaugcuagagaacugagaagcccugguggcaggcauggucuggagugcugggcagau

SEQ ID NO: 243634 - RNA, 64 nt, Human
ucuguggugccugcagcaggagccaggaacgcccggcaggcaggcgcucucccgccagugucug

SEQ ID NO: 243635 - RNA, 64 nt, Human
ucaagccuguaaucccagcacuuugggaggccgaggcaggcagaucacgaggucaggagaucca

SEQ ID NO: 243636 - RNA, 64 nt, Human
uauuuuguguccauggaacguuuauagacauggaggcaggcaauaaauuccuccaauaauuuuu

SEQ ID NO: 243637 - RNA, 64 nt, Human
cucacaccuguaaucucaacgcuuugggaggggaggcaggcagauaacuugagaucaggaguuc

SEQ ID NO: 243638 - RNA, 64 nt, Human
uuagagagggcuaaacaagggcagugagaagacuggcaggcagcagaaaucauuuucuuuuuga

SEQ ID NO: 243639 - RNA, 64 nt, Human
gagcuugucuuggggaggguucuggguggaagcuggcaggcauacagcacccucuacccuccgu

SEQ ID NO: 243640 - RNA, 64 nt, Human
cccagagggucuuacuguuccaggguggccccagggcaggcaggggccacacuaugccugcgcc

SEQ ID NO: 243641 - RNA, 64 nt, Human
gagccuacaaguggucuggguuagaggcgagccuggcaggcagcacagacugaacucagaggua

SEQ ID NO: 243642 - RNA, 64 nt, Human
accaccuccuaaauccugacagcacuguuugcuucccagcuagaccugugugagaggugucugg

SEQ ID NO: 243643 - RNA, 64 nt, Human
agccuguaaucuaaaugcuggcucaaauuuauuccccagcuacuucuuauaccacuauucuuuu

SEQ ID NO: 243644 - RNA, 64 nt, Human
ugaguagcugcgacuaugggcgugugccaccaugcccagcuaauuuuugcauuuuuaguagaga

SEQ ID NO: 243645 - RNA, 64 nt, Human
auucucaaaagaguaaaguuuaugaaaagaaaguggcaggcaaacacaacucuugacugcccuc

SEQ ID NO: 243646 - RNA, 64 nt, Human
cuggaugccugugcagcagaacagaggcaacgguggcaggcagguggaggcugcgcacagcuuc

SEQ ID NO: 243647 - RNA, 64 nt, Human
cugccagggcacagauaggcaggaccccagagagggcaggcagccacgcccugcacuguggaga

SEQ ID NO: 243648 - RNA, 64 nt, Human
gaggcguggccaccaccagaugcucccugucuggggcaggcagggccguuuacucaccaggccc

SEQ ID NO: 243649 - RNA, 64 nt, Human
acgggcauagaccccacagggcagcagcaaauguggcaggcaauccaggcagucguuaaaaaca

SEQ ID NO: 243650 - RNA, 64 nt, Human
auuucaggccucuacacuucugcuuacuggugugggcaggcacuaguggacgucagcuucuuca

SEQ ID NO: 243651 - RNA, 64 nt, Human
cuccuccuucccuccaugcaccaucacuguggcuggcaggcaucggacagccucauccagaccc

SEQ ID NO: 243652 - RNA, 64 nt, Human
cuggauucucugccugccacugucaggguuaagcggcaggcaggauugggcuuuucuggcuucu

SEQ ID NO: 243653 - RNA, 64 nt, Human
accaaugggcugcaguauuauagcccccaggccuggcaggcaugcgcugggcuagagaaaggug

SEQ ID NO: 243654 - RNA, 64 nt, Human
agcuccugguuacccccuugucugacugcuugguggcaggcacccugccugugagggccacuuu

SEQ ID NO: 243655 - RNA, 64 nt, Human
gcagggacacccacgcccuucucuccagaagccgggcaggcagaauccggccagacgacggggc

SEQ ID NO: 243656 - RNA, 64 nt, Human
uacuauagguccagaaguccuuauguuaagcccuggcaggcagguguuuauuaaaauucugaau

SEQ ID NO: 243657 - RNA, 64 nt, Human
cuaucuucagugacgggugacggcucagggagauggcaggcagauugggcucuaagucauuauu

SEQ ID NO: 243658 - RNA, 64 nt, Human
aggcuucuacagacuguaggauucaagucugcagggcaggcacucgggaagggaagauggaugu

SEQ ID NO: 243659 - RNA, 64 nt, Human
acuuugccauggaggacugagcguugccuuuucucccagcuaccucccaaagcagccugaccug

SEQ ID NO: 243660 - RNA, 64 nt, Human; identical to SEQ ID NO: 195608

SEQ ID NO: 243661 - RNA, 64 nt, Human; identical to SEQ ID NO: 195613

SEQ ID NO: 243662 - RNA, 64 nt, Human; identical to SEQ ID NO: 195622

SEQ ID NO: 243663 - RNA, 64 nt, Human
gagacgagaaacuccaggcucugagcccggcgugggcaggcagcggagccaggggcugugacag

SEQ ID NO: 243664 - RNA, 64 nt, Human
ggcauggguggagcagaggggcucccucaccccgggcaggcaaaggcaguggguagaggaggca

SEQ ID NO: 243665 - RNA, 64 nt, Human
aaaaaaacccaaaccaaaaacgcaaaccaaagcaggcaggcagacagcugcugggggaaauccu

SEQ ID NO: 243666 - RNA, 64 nt, Human
ucaugccuguagucccagcacucuguggggccgaggcaggcagaucgcuugaggucaggaguuc

SEQ ID NO: 243667 - RNA, 64 nt, Human
uugcguccccguccgucacaugugccaaaucccuggcaggcagauggcuccugccccauauucu

SEQ ID NO: 243668 - RNA, 64 nt, Human
caggccuccagcagguccuaauccugugugccagggcaggcagugccccaggggcaccacgccu

SEQ ID NO: 243669 - RNA, 64 nt, Human
accucucuuguagcucucugaccuccuccuucauggcaggcaucgccauucuugcugaaccguu

SEQ ID NO: 243670 - RNA, 64 nt, Human
uaggccugggcgauagacucuuccucagcagccuggcaggcaggaaacagacauaggaccccag

SEQ ID NO: 243671 - RNA, 53 nt, Human
cagcuggggggucaggauagaccggcaggcaagaagcccaagaagauaauuag

SEQ ID NO: 243672 - RNA, 64 nt, Human
ucacgccuguaaucccagcacuuugggaggccgaggcaggcagaucacgaggucaggaguucga

SEQ ID NO: 243673 - RNA, 64 nt, Human
gggggcacucugugaagugggggacagggaguggggcaggcagugguugguggguggugugcaa

SEQ ID NO: 243674 - RNA, 64 nt, Human
ccaggccuguaaucccaucacuuugggaggugcaggcaggcagauggcuugagcccaggaauuc

SEQ ID NO: 243675 - RNA, 64 nt, Human
gaaugugaagugacuccccaaccccuuuggccauggcaggcaccuuuuggacugggcugccacu

SEQ ID NO: 243676 - RNA, 64 nt, Human
ugagcuggcuuggacccauuugaggacugaacuaggcaggcaauggcuccagugcccucccucu

SEQ ID NO: 243677 - RNA, 64 nt, Human
aaccaagccgaaggcugcuggcugggcugccuagcccagcuaagaucuuccuucagcccaccuc

SEQ ID NO: 243678 - RNA, 64 nt, Human
cuaguaguugggauuacaggcacaugccaccaugcccagcuaaauuuuuaauauuuuuguagag

SEQ ID NO: 243679 - RNA, 64 nt, Human
ccaacacugagcaaguaugcuguggagucccaaccccagcuacucugaucccucugggggcucu

SEQ ID NO: 243680 - RNA, 64 nt, Human
gcacucccaaugcagcgccuugucagccaaggugggcaggcagggacuguggcagcuuaugucc

SEQ ID NO: 243681 - RNA, 64 nt, Human
caucaaaggaugaccccuaaacacagaggagcggggcaggcagggaggcaaugacuggagcuac

SEQ ID NO: 243682 - RNA, 64 nt, Human
ucacgccgguaaucccagcacuuugggaggccaaggcaggcagauaacaaagucaggagauuga

SEQ ID NO: 243683 - RNA, 64 nt, Human
ccucugcaugcagucaaagccacugucacaagccggcaggcacuggugaggaggcacuaaggag

SEQ ID NO: 243684 - RNA, 64 nt, Human
gcugccugucucuggaggugucaggcaggcagguggcaggcagcucacccacccaccccauggg

SEQ ID NO: 243685 - RNA, 64 nt, Human
ggaagggaggggcugccugucucuggaggugucaggcaggcagguggcaggcagcucacccacc

SEQ ID NO: 243686 - RNA, 64 nt, Human
ugggaaguggccccagccaucuccucuagaccaaggcaggcagccccgacaucugcuuccucua

SEQ ID NO: 243687 - RNA, 64 nt, Human
cuaaccaauugcacaacuccguucucgggguggcggcaggcaggggaggcuuggacgccggugg

SEQ ID NO: 243688 - RNA, 64 nt, Human
accuguggacagcccuccuguccccaagcuuucaggcaggcacugaaacgcaccgaacuuccac

SEQ ID NO: 243689 - RNA, 64 nt, Human
aggaggggaagagagaggagccccacuucacuccggcaggcagaccugcuggagcugcuuugca

SEQ ID NO: 243690 - RNA, 64 nt, Human
guauuuauuuauugaagugugaaauugagcaauaggcaggcaccaccguccccagagcagguca

SEQ ID NO: 243691 - RNA, 64 nt, Human
ggaggcugcggaccauggggacucagcucugcauggcaggcagaggcccagggacacugacgug

SEQ ID NO: 243692 - RNA, 64 nt, Human
ccccagccccguccucccaccaccccagggggcaggcaggcaggcccccucccgugcgaaacug

SEQ ID NO: 243693 - RNA, 64 nt, Human
uucuccccagccccguccucccaccaccccagggggcaggcaggcaggcccccucccgugcgaa

SEQ ID NO: 243694 - RNA, 64 nt, Human
gcagagaaagaaguccuuucucuuuauugaguucgaggacuacaaccaauuuacacugccaucu

SEQ ID NO: 243695 - RNA, 64 nt, Human
uauaaugugcuauuaauggaaccaauaguaauucgaggacuaguugggagauucugggguaauc

SEQ ID NO: 243696 - RNA, 64 nt, Human
aaauuaacuagguguggugcugcacgccuguggucccagcuauucaggaggcugaggugggagg

SEQ ID NO: 243697 - RNA, 64 nt, Human
caggggcaauggaugguaaagcccuuuggcucuuggcaggcagacuuuccaggaagaggcucca

SEQ ID NO: 243698 - RNA, 64 nt, Human
uauagucccagcacuuugggaggccaaggugcaaggcaggcagaucauuugaggucagaaauuc

SEQ ID NO: 243699 - RNA, 64 nt, Human
agucugaauaaacgagaccgggaaagacaucccuggcaggcaucagaacuauuuugcacaugau

SEQ ID NO: 243700 - RNA, 64 nt, Human
ucacuccuguaaucccagcacuuugggaggccgaggcaggcagaugaccugaguuugggaguuu

SEQ ID NO: 243701 - RNA, 64 nt, Human
ucuagaacuagcaaaacaucuuuuccugauggcuggcaggcaguucuagaagccacagugccca

SEQ ID NO: 243702 - RNA, 64 nt, Human
aaaaaaaaaaaaaaaagaaagugaugcacagaguggcaggcagaccauccacauaaguuuuaua

SEQ ID NO: 243703 - RNA, 64 nt, Human
ucuggggagggcuagcccaaaaccucccgcaucgggcaggcacccccugaaguacuuccuucag

SEQ ID NO: 243704 - RNA, 59 nt, Human
aguauaagcacaugggcuagaggccguuaggcaggcacccccuauuccugcucccccaa

SEQ ID NO: 243705 - RNA, 64 nt, Human
cccagcuccgccucuguccucgcuccacguuucaggcaggcaccuagcaauuccaucacccgua

SEQ ID NO: 243706 - RNA, 64 nt, Human
ugaagagcagccaggaggccagcauggcuggagaggcaggcauaggcagggaaccgagcagcag

SEQ ID NO: 243707 - RNA, 64 nt, Human
cuucugggguuauuuaugaaaggagugauccuggggcaggcaggaggcagugggcuucauggcu

SEQ ID NO: 243708 - RNA, 64 nt, Human
uccaaugugcucagccaggcuggaggcggcaggcggcaggcagcaggcuguggaggaggccccu

SEQ ID NO: 243709 - RNA, 64 nt, Human
ggccugcgcagcgagcaggcgugugcguguguggggcaggcaggauguggugcaggcagguucc

SEQ ID NO: 243710 - RNA, 64 nt, Human
uccugaacugagcugccucuaccguggugggcugggcaggcaugugccccccuagucagagggc

SEQ ID NO: 243711 - RNA, 64 nt, Human
agguagguagggcugauggugcgcacuccuuaaagaggacuauuuagccucucccccagugcuu

SEQ ID NO: 243712 - RNA, 64 nt, Human
gcugugggaagagagaugagggucagauaggugggaggacuaacuuccagggugccaagaagga

SEQ ID NO: 243713 - RNA, 64 nt, Human
gggaaagcagugcagaccacuuauuaagcccgcugaggacuagcuuucugucuuucauacauuu

SEQ ID NO: 243714 - RNA, 64 nt, Human
auccuugcugggauccuggaggacuuugugcaugggcaggcauccuucugugcugcagcgggca

SEQ ID NO: 243715 - RNA, 64 nt, Human
aggagcugcucugacgccaggugccaaggcuucaggcaggcaggcccaggaugggcguuugcug

SEQ ID NO: 243716 - RNA, 64 nt, Human
ccucucugcugcugcguuggcagaacccugggugggcaggcacccggaggaggagcagcagcug

SEQ ID NO: 243717 - RNA, 64 nt, Human
ugagcccuggaaggguggggguggggcgggggaaggcaggcagagcccccucuccgggcgccau

SEQ ID NO: 243718 - RNA, 64 nt, Human
uccaucccagaugccugaagccacugcagggcagggcaggcagggggggcuucccgcccuccug

SEQ ID NO: 243719 - RNA, 64 nt, Human
uuggugcuuuguggcucaccacagccaucuguggggcaggcacacacaccucccgccagcucca

SEQ ID NO: 243720 - RNA, 64 nt, Human
gugguggugagugucagcaucuacaguacagccaggcaggcaggaccuugaggaaucagacuau

SEQ ID NO: 243721 - RNA, 64 nt, Human
ugaggauugcugcccgucugcugaugugaccaguggcaggcacagguccagggagacagacucu

SEQ ID NO: 243722 - RNA, 64 nt, Human
gugcgcuucccucucuugccgcagcauacacgagggcaggcaguggccuugucacuguaucuug

SEQ ID NO: 243723 - RNA, 64 nt, Human
guaugucaggaggccacagggagcagaggagcggggcaggcagccacagggcccugcggggagc

SEQ ID NO: 243724 - RNA, 64 nt, Human
uuuccacacaggcccaugcccuccguccuggcagggcaggcagagcucagcacagccucacccc

SEQ ID NO: 243725 - RNA, 64 nt, Human
accaggcugaggccccuccaggccaggguccuggggcaggcaucucagggagcagccagcccag

SEQ ID NO: 243726 - RNA, 64 nt, Human
aaucuagaauugcaaagccagccuuuauuucccuggcaggcagccuugccagaaggcagagagg

SEQ ID NO: 243727 - RNA, 64 nt, Human
ucacaccuguaaucccagcacuuugggaggcugaggcaggcagaucaugaggucaagagaucga

SEQ ID NO: 243728 - RNA, 64 nt, Human
acagcuccaugggcauggggaaggcacugaaacagaggacuauaaaacauccuucucuuauucu

SEQ ID NO: 243729 - RNA, 64 nt, Human
uguacugcggacuccacgaguucuuuucuggugggaggacuauauugccccaugccauuaguug

SEQ ID NO: 243730 - RNA, 64 nt, Human
aaccuagagaagcuaaaaccugagcuagaagcuggaggacuagaaccuggagggcuggaaucug

SEQ ID NO: 243731 - RNA, 64 nt, Human
ucacaccuguaaucucagcacuuugggaggccaaggcaggcagaucacuugaggucaggaguuc

SEQ ID NO: 243732 - RNA, 64 nt, Human
agaacucagaggcuacaguuucuacaggcaauuuggcaggcaggggcuagggaaugccugcugc

SEQ ID NO: 243733 - RNA, 64 nt, Human
ccguuaaugcuuuuggaaacaauugacaaaauagggcaggcagcucaucucauguccugaaguu

SEQ ID NO: 243734 - RNA, 64 nt, Human
gaaaccaaaugaacgggaccugcuggccucaggaggcaggcagaguuuaaaauaaaacuuucuc

SEQ ID NO: 243735 - RNA, 64 nt, Human
gccuuuagagaugugaguugugaggcacuggggaggcaggcacacguccuccagcccaagacug

SEQ ID NO: 243736 - RNA, 64 nt, Human
gcacaggggaggccgagcauaaccaggggugaggggcaggcagcaguuguaguuacugccgcgg

SEQ ID NO: 243737 - RNA, 64 nt, Human
acggucacagcacccaaaccgcaggcccugcucuggcaggcaggcaaagcuaggcagaagagga

SEQ ID NO: 243738 - RNA, 64 nt, Human
ucacagcacccaaaccgcaggcccugcucuggcaggcaggcaaagcuaggcagaagaggauucc

SEQ ID NO: 243739 - RNA, 64 nt, Human
ucccccuccggccacccuagaccaggguccgagaggcaggcaggagccacucaugucuucccca

SEQ ID NO: 243740 - RNA, 64 nt, Human
ccagguuugaaagacccaacuggagcguggggcgggcaggcagggguuagugaaaggacacuuc

SEQ ID NO: 243741 - RNA, 64 nt, Human
cauuuuccuucuggugcugugaagaccauaggcuggcaggcagcugagaugaacugucuuuacc

SEQ ID NO: 243742 - RNA, 64 nt, Human
ugagcugucugcugggcuccguagagcgguggugggcaggcaccuuggcaucugugcagagacg

SEQ ID NO: 243743 - RNA, 64 nt, Human
ucagaggacugaaucugggaccuguguuccccccggcaggcagggacaagauggcauggcaagc

SEQ ID NO: 243744 - RNA, 64 nt, Human
ucacaccuguaauccuagcacauugggaggccaaggcaggcacaucaccugaguucaggaguuc

SEQ ID NO: 243745 - RNA, 64 nt, Human
ggguuggcuggaagcccugggugggggguugggggaggacuaauggggagucggggaauauuug

SEQ ID NO: 243746 - RNA, 64 nt, Human
ugucuuggugggccugagccaagcacagguguuugaggacuacaguucaucucaggguuucuug

SEQ ID NO: 243747 - RNA, 64 nt, Human
ucagccuggcuaugccgccaccggccccgcccaugaggacuaggagcccagccuugcgccgcau

SEQ ID NO: 243748 - RNA, 64 nt, Human
ucuaaaggcggagggucucccugggcacccugcaggcaggcagaccacgguguggggggugccc

SEQ ID NO: 243749 - RNA, 64 nt, Human
ugccccaguggugcgggccaggucuggcgccaggggcaggcagcuaggcagggagggggcuggg

SEQ ID NO: 243750 - RNA, 64 nt, Human
cuucagcccuuccuaaacccagaccugcgguccaggcaggcacugggcugugcccacucgagcu

SEQ ID NO: 243751 - RNA, 64 nt, Human
uuuucaacauuuaguaacuugucucagggcagagggcaggcagggggaccgaggggcagcagau

SEQ ID NO: 243752 - RNA, 64 nt, Human
uucucucccucagaagccucaggacccaacagguggcaggcaguggacagggugcccgccccac

SEQ ID NO: 243753 - RNA, 64 nt, Human
cugcucugagcagagaugaguggugguuggcaggggcaggcaacuuugggugcugcugaugccu

SEQ ID NO: 243754 - RNA, 64 nt, Human
uucuuuacaguggcacucaggcuggcccagccagggcaggcagaagcuagggccuggggggugg

SEQ ID NO: 243755 - RNA, 64 nt, Human
ugccccauguauuuaacaguaauacaggaagcauggcaggcaccaugcaaaccaaggauggaug

SEQ ID NO: 243756 - RNA, 54 nt, Human
aauuggaauaccgacagugagcagggcaggcagacucaacuaagcccggaccug

SEQ ID NO: 243757 - RNA, 64 nt, Human
cacugaaccugccucauggcaccagagugaacagggcaggcagguaguaggcccagcuggggaa

SEQ ID NO: 243758 - RNA, 64 nt, Human
guuccauccacgcucaagacccgcccuuagaccaggcaggcaaaggcccccaucacacucggcc

SEQ ID NO: 243759 - RNA, 64 nt, Human
acucacuugguguagacagauggccagggugggaggcaggcagcugccugcucugcgccgagcc

SEQ ID NO: 243760 - RNA, 64 nt, Human
cagccccagccuuaggccaggcccugggagggcaggcaggcaaaggggagaccagagggucugu

SEQ ID NO: 243761 - RNA, 64 nt, Human
gccacagccccagccuuaggccaggcccugggagggcaggcaggcaaaggggagaccagagggu

SEQ ID NO: 243762 - RNA, 64 nt, Human
uaaguagcugggacuacaggcacgugccaccaggcccagcuaauuuuuguguuuuguuagagau

SEQ ID NO: 243763 - RNA, 64 nt, Human
ccaguagcugggauuagaggcaugugccaucauacccagcuaauuuuuguauuuuuuauuuuuu

SEQ ID NO: 243764 - RNA, 64 nt, Human
auaauagcugggugugguggcaugcgcauguagucccagcuacucagaaggaugaggugggagg

SEQ ID NO: 243765 - RNA, 64 nt, Human
ucucccugcaguaggcaccagcucuaccucccccggcaggcaauguccuggcuucucagcccag

SEQ ID NO: 243766 - RNA, 64 nt, Human
guagcccugcaccguggccagaaacccauccacaggcaggcaguggcugggguccgggugcccc

SEQ ID NO: 243767 - RNA, 64 nt, Human
caggggguucccccaaacuuucgaaguaggcccuggcaggcagcugggagccauccugaagagc

SEQ ID NO: 243768 - RNA, 64 nt, Human
ucuacuaaagauagaaaaauuagcuggacaugguggcaggcaccuguaaucccagcuacucgga

SEQ ID NO: 243769 - RNA, 64 nt, Human
gggugggugggugguuuggccuugaggacgcuagggcaggcagcacaccuggauguggacuugg

SEQ ID NO: 243770 - RNA, 64 nt, Human
ucuacuaaaaauacaaaaauuagccgggcaugguggcaggcaccuguaaucccagcuacuaggg

SEQ ID NO: 243771 - RNA, 64 nt, Human
caaacuuuucagcguuggauaaaaugauugaugaggcaggcagaaggaauguagguuucaggug

SEQ ID NO: 243772 - RNA, 64 nt, Human
caaagcuaauugaucugucacacucaggcucaugggcaggcacaagaaggggaauaaaggggcu

SEQ ID NO: 243773 - RNA, 64 nt, Human
caugaggauaacauuggcgggaggggaguuaacuggcaggcauggcaagguugcauauguaaua

SEQ ID NO: 243774 - RNA, 64 nt, Human
ucuacaaaaaauacaaaaauuagccgggcgugguggcaggcaccuguagucccagauacucggg

SEQ ID NO: 243775 - RNA, 57 nt, Human
aagacauuccuuauguguagugucccuggcaggcauuugucaggccauauguuuuaa

SEQ ID NO: 243776 - RNA, 57 nt, Human
aagacauuccuuauguguagugucccuggcaggcauuuaccaggccaugugcuuuaa

SEQ ID NO: 243777 - RNA, 64 nt, Human
caauaaaccuccugcccuccccuccccagcaggaggcaggcauggaccacaucccuggauuuug

SEQ ID NO: 243778 - RNA, 64 nt, Human
gcaucaaguggcagcuggcuuccuggggugaagaggcaggcaccccagaguccucaacuggacc

SEQ ID NO: 243779 - RNA, 64 nt, Human
uugaagguuugaaaaacaaccaaagaaagggagugaggacuauggcugcauguccucugcuugc

SEQ ID NO: 243780 - RNA, 64 nt, Human
aguggggagaaaagucuguuugccucaggagugugaggacuacacuagugaaagcgccuggcgg

SEQ ID NO: 243781 - RNA, 64 nt, Human
accaguuugcauuccccuaauguggaaaaaguaagaggacuacucagcacuguuugaagauugc

SEQ ID NO: 243782 - RNA, 64 nt, Human
uuacgccuguaaucucagcacuuugggaggccaaggcaggcagaucacgaggucaggaguucga

SEQ ID NO: 243783 - RNA, 64 nt, Human
cucugaugggaauauugccaguccugcuuuuccuggcaggcauuugccggccuaugugcuuuaa

SEQ ID NO: 243784 - RNA, 64 nt, Human
aguccucacucuucaaggaggcccacugugucuaggcaggcaagagaauugaaaugaggugcca

SEQ ID NO: 243785 - RNA, 64 nt, Human
ggccacuuccuaucugauuuuucccagcaaaugaggcaggcaauucuaagaucuuccacaaaac

SEQ ID NO: 243786 - RNA, 64 nt, Human
cccaaggcugugcguuccugagggccaggucgggggcaggcauggaggggaggaaaggcguccc

SEQ ID NO: 243787 - RNA, 64 nt, Human
agguggcccugcuguucuaggcucugugggcauaggcaggcagaguggaacccugccuccaugc

SEQ ID NO: 243788 - RNA, 64 nt, Human
cuuucagcaggcagccuuggcgguuuaucgcccuggcaggcaggggcccugcagcucucaugcu

SEQ ID NO: 243789 - RNA, 64 nt, Human
ucaugccugcaaucccagcacuuugggaggccaaggcaggcagaucaccugaggucaggaguuu

SEQ ID NO: 243790 - RNA, 64 nt, Human
cggcucccacagcagagccaggugagggggggccugccaggacuagacagaaguggggcggccu

SEQ ID NO: 243791 - RNA, 64 nt, Human
agcgcagcuuucuuggauaaucugaauucccaagugccaggaguaggauuucauuauaaaauua

SEQ ID NO: 243792 - RNA, 64 nt, Human
aagccccccaagcaaaagaagagguugaguuugcugccaggauucagaucagcccuucccaggg

SEQ ID NO: 243793 - RNA, 64 nt, Human
ucuaggaugagacagaaaaugaaagcauguuguuugccaggacacuguggguuuauauugaugu

SEQ ID NO: 243794 - RNA, 64 nt, Human
caggccgaggccacugcggugccagugccccccugaggacuagggcaggcagcugggggcacuu

SEQ ID NO: 243795 - RNA, 64 nt, Human
aggugcauguccucuuguugcugagucugcagaugaggacuagggcuuauccaugccugggaaa

SEQ ID NO: 243796 - RNA, 64 nt, Human
guaugcucugccuuuuuaaccacugacauguaaggaggacuacugucuagcaucagcuuauggg

SEQ ID NO: 243797 - RNA, 64 nt, Human
gggucaaagcuguguccuuucccuuaccucccucugccaggacuugcugcagagcugcugagag

SEQ ID NO: 243798 - RNA, 64 nt, Human
acagccuugggcccuagguaccccagcugaucagugccaggagagaccagagccucuggaggcu

SEQ ID NO: 243799 - RNA, 64 nt, Human
acccccuccucugagcucugaauaugggacccagugccaggagcuggaagacaagguguuucug

SEQ ID NO: 243800 - RNA, 64 nt, Human
ugggcuuugggguagugcccaagccuggucguguugccaggaguggugacaagaaaugcagcuu

SEQ ID NO: 243801 - RNA, 64 nt, Human
ccccuugggcaucgcuuccccugcccuuugguagugccaggaccaggccaaugaugcuucucag

SEQ ID NO: 243802 - RNA, 64 nt, Human
caguguuaccuguuagcucccuguggggcaggagugccaggaccagccuguaccuugcuguggg

SEQ ID NO: 243803 - RNA, 64 nt, Human
cacucacucugggugccuccuccccagguggaggugccaggaagcucccucccucacugugggg

SEQ ID NO: 243804 - RNA, 64 nt, Human
uuaaacaugaagaaaacuuguauauucuaauguuugccaggaaaggcuagguucaguagaugag

SEQ ID NO: 243805 - RNA, 64 nt, Human
ggaauguggucugcccuccaccagagcuccugccugccaggacuggaccagagcagccaggcug

SEQ ID NO: 243806 - RNA, 64 nt, Human
agcaauacaugugcagggguugcugcuuucccagugccaggagaacccccgcuccgagucagcc

SEQ ID NO: 243807 - RNA, 64 nt, Human
gaugcuuagcuguccuaaaugaugguuugcucaaugccaggacuggguuucuggugaugaauga

SEQ ID NO: 243808 - RNA, 64 nt, Human
cauuccuuuaaagggaucugugcuacacaaaauaugccaggaccucacagacaaagccauugcu

SEQ ID NO: 243809 - RNA, 64 nt, Human
cccccaggcaagggcagcugccagcauggugcucugccaggacagguuucccugaaggaagcug

SEQ ID NO: 243810 - RNA, 64 nt, Human
agugcaaaauccauguucuaacauauguaauaauugccaggaguacagugcucuuguugaucuu

SEQ ID NO: 243811 - RNA, 64 nt, Human
guguuuaaagucaacaaccaugccagggauugaggaggacuacuauuugaagcaaugggcacug

SEQ ID NO: 243812 - RNA, 64 nt, Human
uauaggauaguacacguuccccaggcccauaacagaggacuaaaaucucugaauuuuaaagaca

SEQ ID NO: 243813 - RNA, 64 nt, Human
auuugauucuaccugcaaacaaauuuuuauuggugaggacuauuuuugagcugacacucccucu

SEQ ID NO: 243814 - RNA, 64 nt, Human
ccugcaaauaguauaaacaacacuaaauuuacugugccaggaaaucuuccugaacuccuugaac

SEQ ID NO: 243815 - RNA, 64 nt, Human
guaucaaugaaauacauauugucaugucaguucuugccaggaacuucucaacaaaauggaauuu

SEQ ID NO: 243816 - RNA, 64 nt, Human
ugccacuguuggccaugucguaaggcagcagcugugccaggauagcuggguccauucagagcac

SEQ ID NO: 243817 - RNA, 64 nt, Human
cauuuugguaggccgaggagggcagaucacuuggugccaggaguucuagaccagccuggccaac

SEQ ID NO: 243818 - RNA, 64 nt, Human
cgaguuugccugaagcucugcugcuggcuucuccugccaggaagugaacaauggcggcggugug

SEQ ID NO: 243819 - RNA, 64 nt, Human
ggaguuaaccuuggaaguugacuauuuuaaugucugccaggaguucuaauccugccucuguucc

SEQ ID NO: 243820 - RNA, 64 nt, Human
gaucauuuuaucacauuagacuggggcagaacucugccaggauuuaggaauauuuucagaacag

SEQ ID NO: 243821 - RNA, 64 nt, Human
ccuggagcgcggccuccagcugccgcaauuuccaugccaggauauuuuuccgcaaaucagucgg

SEQ ID NO: 243822 - RNA, 64 nt, Human
uauggaugcagcuaaccaaagauccugcgugcagugccaggaccuggccgcacuguacauuaag

SEQ ID NO: 243823 - RNA, 64 nt, Human
agccgcagcaccaagggcuugcugccuuguuuccugccaggagcgcccugacaucccaaaacca

SEQ ID NO: 243824 - RNA, 64 nt, Human
ucuggggugucugcccucugucggcccugcuuccugccaggacguggccucuuccgauccuuuu

SEQ ID NO: 243825 - RNA, 64 nt, Human
gaaaagccagugucuuucugagguaaauaauuucugccaggaaacuucccagccccaccagcag

SEQ ID NO: 243826 - RNA, 64 nt, Human
aucugaacaaccuuggcucuguggccauucaaccugccaggacuaacauuucuggauuugugaa

SEQ ID NO: 243827 - RNA, 64 nt, Human
augauuuugcuccuaguuuuggaguuugaauuucugccaggauugaauuauuuugaaaucuccu

SEQ ID NO: 243828 - RNA, 64 nt, Human
acugagacugcagaaagcaaaaccauggauaagggaggacuacuacaaaagcauuaaauugaua

SEQ ID NO: 243829 - RNA, 64 nt, Human
uguuauccuguauaccuccuccagccaugaaguagaggacuaaccauguguuauguuuucgaaa

SEQ ID NO: 243830 - RNA, 64 nt, Human
aaauuagccaggcauggugccgcauaacuauaaucccagcuacuugggaggcugaggcaggaga

SEQ ID NO: 243831 - RNA, 64 nt, Human
gaggggaccaucgagguggcgaguguggacacccugccaggacugcagcccccauggugaugcu

SEQ ID NO: 243832 - RNA, 64 nt, Human
aauugcuagcuguagugugacacauuguaguguuugccaggaaaggagccagucaugccggaaa

SEQ ID NO: 243833 - RNA, 64 nt, Human
cugccuguugggccaggagccuccugcccuuaccugccaggaagccagcaggcucucaggccag

SEQ ID NO: 243834 - RNA, 64 nt, Human
accggggccuuggucccagacagcuggacccauuugccaggauuggcacaagcucccuggugag

SEQ ID NO: 243835 - RNA, 64 nt, Human
aucagcaaaagccaaagaauuagcauacacugugugccaggaggugaagaaauugguggguuuu

SEQ ID NO: 243836 - RNA, 64 nt, Human
gguucugguuaaacagcuguacuuuugauagcugugccaggaaggguuaggaccaacuacaaau

SEQ ID NO: 243837 - RNA, 64 nt, Human
auucgcauauuugccuauucuuucacccucugagugccaggagaugagaggcuggggguacaca

SEQ ID NO: 243838 - RNA, 64 nt, Human
gugcucuuggcugcugugcugggacagaaugggaugccaggaagagaagaaagggggugcaguc

SEQ ID NO: 243839 - RNA, 64 nt, Human
aaccagcagagucuccccuuuuccugagccagagugccaggaacacuguggacgucuuuguuca

SEQ ID NO: 243840 - RNA, 64 nt, Human
acugacgucaaauccccaagucgacucaagaggcugccaggaagcagagaugcagaccccaagg

SEQ ID NO: 243841 - RNA, 64 nt, Human
uuaccaaaagagaagcagucugggccagaugcccugccaggaaagggacauggacccacgugcu

SEQ ID NO: 243842 - RNA, 64 nt, Human
aaucagcaaacgcagugaguaucaaccugauuguugccaggaaauccuuaugaauuaaaacaau

SEQ ID NO: 243843 - RNA, 64 nt, Human
aagccaaaugaaccccuauugggcaccucugugaugccaggagcgaacuggugagcccagcgcc

SEQ ID NO: 243844 - RNA, 64 nt, Human
cacagccaccuccacccccaagaaaccuccauccugccaggagcagccuccaagaaacuuuuaa

SEQ ID NO: 243845 - RNA, 64 nt, Human
uuacaaaaauuauaaaaaaugaauuaguacuggcgaggacuaaaugaaacaauaauuuuucauu

SEQ ID NO: 243846 - RNA, 64 nt, Human
uggauuuuaauaauaaacugccucucauuuuuaugaggacuagagcuauaguuucugcagcucu

SEQ ID NO: 243847 - RNA, 64 nt, Human
uauaaaagaguguccuaacaguccccgggcuagagaggacuaaggaaaacagagagaguguuac

SEQ ID NO: 243848 - RNA, 64 nt, Human
aaggccaaggaggagcggcgcauggaccagaugaugccaggaaagaccaaagcagaugcugcug

SEQ ID NO: 243849 - RNA, 64 nt, Human
ccuggcccaggugagcaagguggaggccuugcagugccaggaggagggcugccgccauggggca

SEQ ID NO: 243850 - RNA, 64 nt, Human
guagauauaccaacaaaacuucagacuguaaaauugccaggaugcaguuuuccccuugauuggc

SEQ ID NO: 243851 - RNA, 64 nt, Human
ucuccuugcuccuggccuugcugaccucagcgguugccaggaaggggugagcacagagugccuc

SEQ ID NO: 243852 - RNA, 64 nt, Human
cacgccccaauuuucagguaguacuaagaguaugugccaggaaacucuugcuauugaauugaga

SEQ ID NO: 243853 - RNA, 64 nt, Human
caugauggucacuuaaaaugugcaguaauagcacugccaggaucaagcaugaaaggcuuuuaaa

SEQ ID NO: 243854 - RNA, 64 nt, Human
ugucacagcaacugggguggcauuugcugcccagugccaggaauaguaacauuaugaaugccag

SEQ ID NO: 243855 - RNA, 64 nt, Human
gggaauauuaguuuuuaauuuggaucgacugaggugccaggagaaacugcagucccagguaucc

SEQ ID NO: 243856 - RNA, 64 nt, Human
gcaaaucaguagagugaggugauccuuagcaacgugccaggacacuuccugugugccugcaguu

SEQ ID NO: 243857 - RNA, 64 nt, Human
caggguugucccuccaguucccuccugagggcugugccaggaugacugucucaugcccccucug

SEQ ID NO: 243858 - RNA, 64 nt, Human
ggcugguccugagucuuggccugccucccagcccugccaggaggcugcggccuagggguccacg

SEQ ID NO: 243859 - RNA, 64 nt, Human
aaaagaggcccugccauacacccugcguacccacugccaggacccucucagacaagcguggcac

SEQ ID NO: 243860 - RNA, 64 nt, Human
cucccggccaggcuucgugcuggggugggccaugugccaggacaggagggucccggcggaaagc

SEQ ID NO: 243861 - RNA, 64 nt, Human
cgugggucuguguguccgugaagugagucccgucugccaggagcugacgaaccacgaaugcuuc

SEQ ID NO: 243862 - RNA, 63 nt, Human
agugucuuccaguccccugacgaggacgaggaggaggacuaugagcaguggcuggagaucaaa

SEQ ID NO: 243863 - RNA, 64 nt, Human
uagccagcuuccucgcaucuucaccagcauuggagaggacuacgaugagugugugcugccguuc

SEQ ID NO: 243864 - RNA, 64 nt, Human
ggcuggcuuggccaugccuuucugugccuuuaaugaggacuaagaagcaagauugggccacacu

SEQ ID NO: 243865 - RNA, 64 nt, Human
gcagacacgugcccucugggugaugucugucugcugccaggauggagcagaggagcgccacaca

SEQ ID NO: 243866 - RNA, 64 nt, Human
cuggaauagcagacauccuuuugaacacuaaugaugccaggaagagaguaaggcuagaggagga

SEQ ID NO: 243867 - RNA, 64 nt, Human
ccagugaggaagaugccucugucuuucccacgacugccaggagauagggaagcccagccaggac

SEQ ID NO: 243868 - RNA, 64 nt, Human
ggggguuggggagcaggccagauggaggugguggugccaggaagaaauggagcgaugacugacu

SEQ ID NO: 243869 - RNA, 64 nt, Human
uaaaacaggccaucccaccaccucuaccugcucaugccaggagaauccauaacugccuagaggc

SEQ ID NO: 243870 - RNA, 64 nt, Human
ugauggccaccagcuucugcguccucuuaucuucugccaggaucaccuccgagaaggccccccu

SEQ ID NO: 243871 - RNA, 64 nt, Human
aucaagaaaaaggucugaggcagaauccaagaucugccaggaaacacacaacaaaacaucugcu

SEQ ID NO: 243872 - RNA, 64 nt, Human
ucuugcaagcuccaguagcuccgcgugucucauuugccaggaagauggguucccacguagcaaa

SEQ ID NO: 243873 - RNA, 64 nt, Human
ccccaaccuccaucgccuugcagguuuucuucacugccaggaguagugagcuguacgaguccac

SEQ ID NO: 243874 - RNA, 64 nt, Human
ucgggcuuccucauccugccuguucccccacaccugccaggauauggacaucuugggauaucuc

SEQ ID NO: 243875 - RNA, 64 nt, Human
uggagccuguagggaguuuuccaggcagguccuuugccaggacagcaugguccugcccuguugu

SEQ ID NO: 243876 - RNA, 64 nt, Human
cuacaaacgcagacaagcuccacuaccccuaaccugccaggaugcucaaguccacugucacaau

SEQ ID NO: 243877 - RNA, 64 nt, Human
uaggggcacccaagcuaaggguauuagccaaagaugccaggauggguagcuagcccauguuuag

SEQ ID NO: 243878 - RNA, 64 nt, Human
acuggcagcucagaauuauucuggaaagaaagccugccaggaaauaaauucaaauacaguauga

SEQ ID NO: 243879 - RNA, 64 nt, Human
cgcugagaaaguccuugcugggaaaucgaagauugaggacuacuuuccagaauuugcucgcuac

SEQ ID NO: 243880 - RNA, 64 nt, Human
ugcucaugauuccaaggaucagccuggaugccuagaggacuagaucaccuuaguuugauucuau

SEQ ID NO: 243881 - RNA, 64 nt, Human
cccagcuuuaagauaucuagcagaaacuauagcugaggacuaaggaauucugcagcuugcagau

SEQ ID NO: 243882 - RNA, 64 nt, Human
uguugcuuugcuuucuuguggacagcuuguaguuugccaggauuuuuucagcuggaaagauacg

SEQ ID NO: 243883 - RNA, 64 nt, Human
gcaggccagggcugcgcaucaguggacacauugcugccaggaagagcugcgacggugaggcggg

SEQ ID NO: 243884 - RNA, 64 nt, Human
ggagccagaagccaaucuacaaucucuuuuuguuugccaggacaugcaauaaaauuuaaaaaau

SEQ ID NO: 243885 - RNA, 64 nt, Human
gguuugcaacacuaacggccauccggcccaaggaugccaggaucugcaaagcacugcucgaaga

SEQ ID NO: 243886 - RNA, 64 nt, Human
ugccagcccaaaugcagggcaugggcucugguucugccaggagccugugacacccccaggaagg

SEQ ID NO: 243887 - RNA, 64 nt, Human
caucagaauagaacccaaagggcuuaggaaggccugccaggauaacaagaaggcccuguauuca

SEQ ID NO: 243888 - RNA, 64 nt, Human
gaaucuucuguggacaucgaccucuuagugaugcugccaggauaauuucugcuugccaugggca

SEQ ID NO: 243889 - RNA, 64 nt, Human
ggcacaucuggagcugaagcguuacuacagcaucugccaggacacugccuuggguggaccaggc

SEQ ID NO: 243890 - RNA, 64 nt, Human
aauggcugagccugguucugcaggggaggaaggcugccaggagcugaggggcuagcaccugcau

SEQ ID NO: 243891 - RNA, 64 nt, Human
uguuuaguagcaccccuggccucuacccacuaggugccaggaaugcgccaccccauccuccacc

SEQ ID NO: 243892 - RNA, 54 nt, Human
gcccagaguugcaguuguaacuguugccaggacacauggccauaaauaauagaa

SEQ ID NO: 243893 - RNA, 64 nt, Human
aacucuugauuauccacguguggauuauccaccaugccaggaagacccauaacugguuuuaaca

SEQ ID NO: 243894 - RNA, 64 nt, Human
agucccauguguggcagcauugucccacuucagaugccaggagugggcucauccuagaggagcg

SEQ ID NO: 243895 - RNA, 64 nt, Human
uucccuccaccuagacugccugcugagggggcagugccaggagguugccuguccuuggggaaga

SEQ ID NO: 243896 - RNA, 64 nt, Human
uuuccacgggguuggguugccggucagagcuuaagaggacuagcacccugcaaugccccucuuc

SEQ ID NO: 243897 - RNA, 64 nt, Human
auuuuaugugucucuugcacuacaccucuguugugaggacuaccauuuuggagaagguucuguu

SEQ ID NO: 243898 - RNA, 64 nt, Human
caguggaaggaguuccugcuaaggggaggugcaggaggacuaauuuauuauugugcaacugcca

SEQ ID NO: 243899 - RNA, 64 nt, Human
auaauaagccauggcugaccucuggagcaccaggugccaggacuugucuccauguguauccaug

SEQ ID NO: 243900 - RNA, 64 nt, Human
aguccuauacagugaagaauuguccugcucaagaugccaggauuucccccagugagaacaugcu

SEQ ID NO: 243901 - RNA, 64 nt, Human
gcaaccaugcuucucauucccuugacucaugucuugccaggaugguuagauacacagcauguug

SEQ ID NO: 243902 - RNA, 64 nt, Human
aauuagcuaacauggguauuuuugaacauauuuuugccaggaagaugaaaaucacauaguauga

SEQ ID NO: 243903 - RNA, 64 nt, Human
caaacaagccugugccgggguguccuggaaucugugccaggacuguguuuuuagcccuucaccu

SEQ ID NO: 243904 - RNA, 64 nt, Human
ccugugacugcaacgucuuacugauugggacaguugccaggaggauaccaacuugauagcagag

SEQ ID NO: 243905 - RNA, 64 nt, Human
uugaagggagauuggcaccuaguggcugggagcuugccaggaacccaguggccagggagcgugg

SEQ ID NO: 243906 - RNA, 64 nt, Human
ccgugguacauucacagcacgggcacagcugcugugccaggacugugacucauucccaguaaaa

SEQ ID NO: 243907 - RNA, 64 nt, Human
uuuagcauuuaauaguuugcuugucuuccacuccugccaggaaguguuuauuugccucuaauug

SEQ ID NO: 243908 - RNA, 64 nt, Human
uggugacccccauacauuccucccugcuccccacugccaggaggaccacuguccccagccagcc

SEQ ID NO: 243909 - RNA, 64 nt, Human
gggcugagcagagcccauccaggacacuccacacugccaggacacacccaggcggcccgcccuu

SEQ ID NO: 243910 - RNA, 64 nt, Human
acuucacagguccaugggucugacccuuggacucugccaggaucaacugcccagagugccagag

SEQ ID NO: 243911 - RNA, 64 nt, Human
gguauguuuugaaaagaguaauuuaacuuuugggugccaggaaauggguuuucucaaaguccau

SEQ ID NO: 243912 - RNA, 64 nt, Human
caugccacaaccacggucacaccucacugucaucugccaggacguuuguugaacaaaacugacc

SEQ ID NO: 243913 - RNA, 64 nt, Human
aaaacugauuuuucccauaaauauuuuuacuucagaggacuaggaccauuuuguuuugggcccu

SEQ ID NO: 243914 - RNA, 64 nt, Human
ggccccuuggugaaccugaugcagguaagaugcugaggacuaaaaccauuuuuuuugcacccaa

SEQ ID NO: 243915 - RNA, 64 nt, Human
uuuuguuucguuucguuuuguauuuucuguaacagaggacuauccucagucugcauguaacuuu

SEQ ID NO: 243916 - RNA, 64 nt, Human
cccaccugucucacaagaacuucacucaaccccgugccaggacucagcaguggccuggacaaca

SEQ ID NO: 243917 - RNA, 64 nt, Human
cugcugagaagcagugccauuaccaauuaauucuugccaggagugagagagagcuguaucuuua

SEQ ID NO: 243918 - RNA, 64 nt, Human
gagguauauuuaaagauuuuuuuuuucauccuggugccaggaauauaaaaaagaguggauauau

SEQ ID NO: 243919 - RNA, 63 nt, Human
ugauucacaaguccuugugacccaaacuccuacugccaggagguggaggaaggagcaggugcu

SEQ ID NO: 243920 - RNA, 64 nt, Human
aggaagcaugagggcaacuauagugaggccuuauugccaggagggaggguuuugguugcuggcg

SEQ ID NO: 243921 - RNA, 64 nt, Human
ggguagcaggagucagggggcuguacccugggggugccaggaaaugcucucugaccuaucaaua

SEQ ID NO: 243922 - RNA, 64 nt, Human
agugucccgcucuccugcuuaccuaggaggugagugccaggaaaauacaccaaaugcuucuagu

SEQ ID NO: 243923 - RNA, 64 nt, Human
caguguuggcagcuucaagaagagaagaccuucuugccaggacauaaaaugauacccuccucug

SEQ ID NO: 243924 - RNA, 64 nt, Human
cucagagucacaccacuggcugccagucagggccugccaggagucuacacagcucugaaccuuc

SEQ ID NO: 243925 - RNA, 64 nt, Human
uuuauuaguauauuacuguuauuuaacguuugucugccaggauguauggaauguuucauacucu

SEQ ID NO: 243926 - RNA, 64 nt, Human
auuuacaaauauacaagcaaauaauauaauauuaugccaggauagaaaugaacaugccaugguu

SEQ ID NO: 243927 - RNA, 64 nt, Human
cgcaccuccauugugcaggcagcugccggaggggugccaggagggggcagcaacaacggcaaga

SEQ ID NO: 243928 - RNA, 64 nt, Human
aggaggagccggggacucccaggcuggagagcacugccaggacccaccacuggaagcaggaugg

SEQ ID NO: 243929 - RNA, 64 nt, Human
uucuuuaaaggaaaaguugauuauguauguggggugccaggaccacugccuugaaagcaagugu

SEQ ID NO: 243930 - RNA, 64 nt, Human
ucauucacgggacuaguuagcuuuaagcacccuagaggacuaggguaaucugacuucucacuuc

SEQ ID NO: 243931 - RNA, 64 nt, Human
uggcucuugacugugaugcccgcaauucucaaaggaggacuaaggaccggcacuguggagcacc

SEQ ID NO: 243932 - RNA, 64 nt, Human
aaggagccagcagaaccuucccacaugcugaagcgaggacuagaggcuggaggccaagcagcug

SEQ ID NO: 243933 - RNA, 64 nt, Human
cacuuugggaggccaaggcagguagaucacuugaugccaggaguuccagaccaggcuggccgac

SEQ ID NO: 243934 - RNA, 64 nt, Human
cuacccauauugcacugagcuugccaguggugacugccaggaacguccuaugauccacuuuguu

SEQ ID NO: 243935 - RNA, 64 nt, Human
ugaaagcaaucuaggucacuagcacagaggaaguugccaggaagguggcuucagcaccuccagg

SEQ ID NO: 243936 - RNA, 64 nt, Human
gagaaauuacagguuccuuuugaagcucaacuguugccaggagauggaauaucaaugcccaaca

SEQ ID NO: 243937 - RNA, 64 nt, Human
uggaaaugagaggaccuccacagccccgccucccugccaggaugcuagauuauuggcugggagg

SEQ ID NO: 243938 - RNA, 64 nt, Human
agagaagaggccuggaacucgggcagcacugcagugccaggaggcaggcggggaaccgaggcaa

SEQ ID NO: 243939 - RNA, 64 nt, Human
gacgacaaaucgguaaggcuuauucaugguucauugccaggagcagauaugcuuuugagaucac

SEQ ID NO: 243940 - RNA, 64 nt, Human
gguccgcccagggacccacauggacuaaaggcaaugccaggagcccugaaggagccagcagaac

SEQ ID NO: 243941 - RNA, 64 nt, Human
aagucacuugagacacauucucaguuuguugcagugccaggaaugcugcgcugcugcugcugcg

SEQ ID NO: 243942 - RNA, 64 nt, Human
ggcauccaaggaagggauguauuuguaguguuauugccaggaaaggagaguacuuugguuucug

SEQ ID NO: 243943 - RNA, 64 nt, Human
aggggaucugggcaccugugccuugaggagaugcugccaggagcaugggacucugacaguccuu

SEQ ID NO: 243944 - RNA, 64 nt, Human
aggcuaacauauuuacucuugucuaacuuaagagugccaggaaagcagaugcuuagauuuugug

SEQ ID NO: 243945 - RNA, 64 nt, Human
gggaccgugcgagcugccguguggguuagucgggugccaggacaaugaaauacuccagcaccug

SEQ ID NO: 243946 - RNA, 64 nt, Human
accauggggaagucagcugaaacuugucuuguuuugccaggaaaggaaguaguugccuuugguc

SEQ ID NO: 243947 - RNA, 64 nt, Human
ugggagacccuguggccggcacccaccuccacacgaggacuaagcucugauuuuuuuaucuugc

SEQ ID NO: 243948 - RNA, 64 nt, Human
gugugcuaaguaauguuuuuuaaagcacaggcuugaggacuaugguuuacauccuguuggaaac

SEQ ID NO: 243949 - RNA, 64 nt, Human
uuaagauucuccuuuuguacugggaaacaggcuggaggacuaugguccucaaguuuagaccaag

SEQ ID NO: 243950 - RNA, 64 nt, Human
auuucaugucacuaaacaagaaaucugacaauagugccaggaaacuaauuuccugauacauuaa

SEQ ID NO: 243951 - RNA, 64 nt, Human
ccuccauccagaaccuaagggcugaagcaaaggcugccaggacccuugaagaugcuuuuggcuc

SEQ ID NO: 243952 - RNA, 64 nt, Human
cagucaggguuucucuugaauuauuuuggaacaaugccaggauccaaacugauuaaguuacagu

SEQ ID NO: 243953 - RNA, 64 nt, Human
uuuuugaagaguuuuucaauauauacccuacccuugccaggaagagaaguaaaauccucagguu

SEQ ID NO: 243954 - RNA, 64 nt, Human
cgccugagcucacucggcacccugcaaaauuugaugccaggacacgcuuuggaggcgauuuacc

SEQ ID NO: 243955 - RNA, 64 nt, Human
gccgcucauucacccaacaaaacugugucuuaucugccaggaaagaccagccucacuccuggga

SEQ ID NO: 243956 - RNA, 64 nt, Human
cgucuguuaugcugugacacauggccccucccccugccaggagcuuuggaccuaauccaagcau

SEQ ID NO: 243957 - RNA, 64 nt, Human
uuccuaagcaagaaauaacaggaaagaucccuuaugccaggaggccugccauacucaggauaag

SEQ ID NO: 243958 - RNA, 64 nt, Human
ugguccugagaccugacaagcacugcuaggcgagugccaggacuccccaggccaggccaccagg

SEQ ID NO: 243959 - RNA, 64 nt, Human
ugggagcugucugucuuuccccuacccccaaggaugccaggaagacguccaccauuagccaugu

SEQ ID NO: 243960 - RNA, 64 nt, Human
cuuugccuguagagccagccuugguuggaccuauugccaggaauguuucagcugcaguugaaga

SEQ ID NO: 243961 - RNA, 64 nt, Human
aaguauuugagagagagaaccuuuccacucccacugccaggauuuuguauugccaucgggugcc

SEQ ID NO: 243962 - RNA, 64 nt, Human
uggguggggucuuucccuuuacagacggggcagaugccaggacucagcccauccugaggaggac

SEQ ID NO: 243963 - RNA, 64 nt, Human
acaccuucgagucugagcgcuuguggcuagaguuugccaggagggaggaaaccagugacccuga

SEQ ID NO: 243964 - RNA, 64 nt, Human
ggugcuccuaacaccugugagaugguccugucgagaggacuaggaaccgauaggaggagagucc

SEQ ID NO: 243965 - RNA, 64 nt, Human
aguuucucaggcuggggagcacagaggggaggaggaggacuaaaugaaaaguuguucccagccu

SEQ ID NO: 243966 - RNA, 64 nt, Human
acaucuggucucgcugguuagugccucguuggcugaggacuaggugugcauuucuccuagcuuu

SEQ ID NO: 243967 - RNA, 64 nt, Human
ccgugggaggagaugccggggaccugggccgcgcugccaggaccucugcugugucucgcccacc

SEQ ID NO: 243968 - RNA, 64 nt, Human
gacauaugcuucccagagacugguauuguggcugugccaggaguacaugugagacuaugggagg

SEQ ID NO: 243969 - RNA, 64 nt, Human
ccucgcccucugcccucuugcugcuucuccacauugccaggaaaagcugcugacgccugcccuc

SEQ ID NO: 243970 - RNA, 64 nt, Human
gaauccaaaagucugcuucacugagaugcuaccuugccaggacaagaaccaagaacucuaacug

SEQ ID NO: 243971 - RNA, 64 nt, Human
caauucauagaauaacaacugcugggaauauccgugccaggaaaagaaaaauuucuggcaaaua

SEQ ID NO: 243972 - RNA, 64 nt, Human
cccuauguguggggacuggcugcccccuagagccugccaggagcagaagccuggagggguggca

SEQ ID NO: 243973 - RNA, 64 nt, Human
gacugcugcaagcucugccuucaccaguagcuggugccaggacagagcucugggacagcaggca

SEQ ID NO: 243974 - RNA, 64 nt, Human
ggacccaggagccccggcggcgcagcugcaagguugccaggacccacccucaucccuggcaccg

SEQ ID NO: 243975 - RNA, 64 nt, Human
aggaaaaaucccuugugauuggauguuuacuaucugccaggaaacugguacucaagauguugaa

SEQ ID NO: 243976 - RNA, 64 nt, Human
cuuuuuguagaaggagagagaagaagaugaaguuugccaggagggcccauauuuuuucagcuga

SEQ ID NO: 243977 - RNA, 64 nt, Human
cagcugacuccagaguaagagagggcccuuccccugccaggacccacggugcuauccauucagu

SEQ ID NO: 243978 - RNA, 64 nt, Human
uggcccugaauccaucugaccagcugcugguaucugccaggacuggcaguucugauuuaguuag

SEQ ID NO: 243979 - RNA, 64 nt, Human
gaggaaguacugcuaucucgcauucuucucagguugccaggaaauguuucucuaacccuuucaa

SEQ ID NO: 243980 - RNA, 64 nt, Human
auuccacaccucucuuccccagccgcaacgggggugccaggagccccaggcugagggcuucccc

SEQ ID NO: 243981 - RNA, 64 nt, Human
aacgucaaacgucaaauguuugcuuuguuaccuggaggacuaaauguagaugucuuuaguauac

SEQ ID NO: 243982 - RNA, 64 nt, Human
gucuuggugaaccuggauccgaguccaugaguuugaggacuacaguucaucacaggguucagca

SEQ ID NO: 243983 - RNA, 64 nt, Human
ucuuuuucuccuugacaaaauccagcuuuuguaugaggacuauagggugaauucucugauuagu

SEQ ID NO: 243984 - RNA, 64 nt, Human
cuggcagagcccagcggccaccacccgucaacccugccaggagcugagggcaccacccagcaac

SEQ ID NO: 243985 - RNA, 64 nt, Human
gaacaguuuucuuuuaaaauuuugagauuaagaaugccaggaauauugucauccuuugagcugc

SEQ ID NO: 243986 - RNA, 64 nt, Human
ccacccaggagagggaugggacacagcacugggcugccaggauuccccuggcccgucugggcca

SEQ ID NO: 243987 - RNA, 64 nt, Human
cagaacagauagacagacugaagccacugaacucugccaggagucaacaugagauuccuuuugc

SEQ ID NO: 243988 - RNA, 64 nt, Human
gcaccugcaccccagaaggugugagcugucucucugccaggagcuaagguucauuaggggauug

SEQ ID NO: 243989 - RNA, 64 nt, Human
uuucuccccauuuccaauugggacucccauucuuugccaggagaucuuacccaucccuuuucag

SEQ ID NO: 243990 - RNA, 64 nt, Human
gauggcugggaucccuccccuguacccuucucacugccaggagaacuacgugugaagguauuca

SEQ ID NO: 243991 - RNA, 64 nt, Human
caugaauaagacccuaggcccaagucugguguggugccaggauggcacaguuucccucuuccuu

SEQ ID NO: 243992 - RNA, 64 nt, Human
ucuccagggucgcugauccuccccggcccagggcugccaggaacaaguuccucucugcaggauc

SEQ ID NO: 243993 - RNA, 64 nt, Human
cagacugccucucccugggccgggguggccugggugccaggaggaggggagcauaccccacacc

SEQ ID NO: 243994 - RNA, 64 nt, Human
uguggaguuccugcuccguggacugcagucggcaugccaggacccgccagccccgcucccaccu

SEQ ID NO: 243995 - RNA, 64 nt, Human
cagguccccggccagcugggccccucccaggcacugccaggaagccccagcugccccuggcggg

SEQ ID NO: 243996 - RNA, 64 nt, Human
ccuaggcugcgucgggcaugcuuggaagcuggccugccaggaccuuccacccuggggccugugu

SEQ ID NO: 243997 - RNA, 64 nt, Human
ugagcaccuaaacguuucagggcugaaaugggguugccaggacaacaagcauggcaggggcgaa

SEQ ID NO: 243998 - RNA, 64 nt, Human
aagguguccuuuuguaaaaaucagcaauucuccagaggacuaucucacauaagucaucuuauga

SEQ ID NO: 243999 - RNA, 64 nt, Human
uauuacagguagguagugcuuaagaaaagucauggaggacuaaagccuaaguccuuuucacuuu

SEQ ID NO: 244000 - RNA, 64 nt, Human
aaauuagcugggugugguggcaugugccuauaaucccagcuacuugggagguugaagcagaauu

SEQ ID NO: 244001 - RNA, 64 nt, Human
agcacacaggacaggcuggugcaccuccaggcugugccaggaaacccgcugccuuugcgucacc

SEQ ID NO: 244002 - RNA, 64 nt, Human
ugugugccugggagaggcucugucuccuuccugcugccaggaccugugccuagacuuagcaugc

SEQ ID NO: 244003 - RNA, 64 nt, Human
uuuaguuagauuguaggcuuccuggggccucccaugccaggacugcaaagugauccagcccuac

SEQ ID NO: 244004 - RNA, 64 nt, Human
gcagcccuccuucccuuccauuuggaggagguggugccaggagccugcccgcuuaccucugcug

SEQ ID NO: 244005 - RNA, 64 nt, Human
agcaggggaaacaaggggcuucgagcacgcuccaugccaggaggcaucuguugauuucugacca

SEQ ID NO: 244006 - RNA, 64 nt, Human
uguggauuuuuuaaagcuuuucuguucacccuccugccaggaaaaucccagaaagcuuaaugau

SEQ ID NO: 244007 - RNA, 64 nt, Human
ggaggagcaagaagaucccagugcuugcccugccugccaggaacucugugauaacauagauuga

SEQ ID NO: 244008 - RNA, 64 nt, Human
gcaagugcuucugacaucaccagagccagccccaugccaggaacuaaggaugucauguagaucg

SEQ ID NO: 244009 - RNA, 64 nt, Human
cucucuuuucucccguuuucagcuguagaguagcugccaggaggacuuggccacccggcccugu

SEQ ID NO: 244010 - RNA, 64 nt, Human
gagaacugguuggaguuauggaaaagaugcccugugccaggacagcaguucauuguuacuguaa

SEQ ID NO: 244011 - RNA, 64 nt, Human
aaaaaacaaaaaaaacauauauacugcuguaucaugccaggauuuaucagcauucccaagggag

SEQ ID NO: 244012 - RNA, 64 nt, Human
agauggugcccagcaggccaaacccaccugccucugccaggaacagccaacuccaugggaacuc

SEQ ID NO: 244013 - RNA, 64 nt, Human
cucagagcccaggagcugcguggacaguguggggugccaggaggaggggcgguggcugguccuc

SEQ ID NO: 244014 - RNA, 64 nt, Human
aagccagcucccccuccugaccucucguggccauugccaggagcccacccuggucacgcuggcc

SEQ ID NO: 244015 - RNA, 64 nt, Human
cgccuggccuauaccaguauuuucuaguuuaaaggaggacuacauuaacucuuauuguuguguu

SEQ ID NO: 244016 - RNA, 64 nt, Human
aaagcugcuaacuggugacaggguggaucauggugaggacuagggguaaggucagggaaugcuu

SEQ ID NO: 244017 - RNA, 64 nt, Human
guucaugauagacacaaugaaauccacccucaaagaggacuacuucggauacaaucacagcaac

SEQ ID NO: 244018 - RNA, 64 nt, Human
gggaccccuugccagggagacccccgaaccuuugugccaggacaccuccugguccccugcaccu

SEQ ID NO: 244019 - RNA, 64 nt, Human
ucaaaaaauaauaaugaaacuuuccaaaacaaagugccaggaccagcuggguucacugaugugu

SEQ ID NO: 244020 - RNA, 64 nt, Human
ugcuucaucugguggacugugggagcagaggcauugccaggacuugggaaacagucacugugaa

SEQ ID NO: 244021 - RNA, 64 nt, Human
ggugacucugaaagacagagagggcuccuguggcugccaggagggcuugacucagacccccugc

SEQ ID NO: 244022 - RNA, 64 nt, Human
aggaugcacagaaaacacacugacugugggacugugccaggaugcauuuggaaagauagagcau

SEQ ID NO: 244023 - RNA, 64 nt, Human
uagcuguggcccagacaucggcccugcccagaauugccaggaggaggcuuugcaggcucuagag

SEQ ID NO: 244024 - RNA, 64 nt, Human
ggaguucuuccgugagggcugccaggggguggugugccaggaccucaggcugggccuuugugcu

SEQ ID NO: 244025 - RNA, 64 nt, Human
aauuaaaauaccugacuuuagagagaguaaaaugugccaggagccauaggaauaucuguauguu

SEQ ID NO: 244026 - RNA, 64 nt, Human
gcuugccugaguuuaaugaggauauuauaucaggugccaggaaucccuugggucagcuccuauc

SEQ ID NO: 244027 - RNA, 64 nt, Human
aggguggagagccaccaagagggacgccugggggugccaggaccagucaaccugggcaaagccu

SEQ ID NO: 244028 - RNA, 64 nt, Human
accaguugcuucugcagcccgcagaugccagcgaugccaggaaacaaguugaaauccaggaauc

SEQ ID NO: 244029 - RNA, 64 nt, Human
cggggucuuuuccauuuauagagaaugauguaacugccaggacacuuuuguguuugcccaggac

SEQ ID NO: 244030 - RNA, 64 nt, Human
cacuugggcacccacgcuucuguccacuucugguugccaggagacagcaagcaaagccagcagg

SEQ ID NO: 244031 - RNA, 64 nt, Human
uggcucacuucugcccaccugccggcaacaccagugccaggaaaaggccaaaagaaugucuguu

SEQ ID NO: 244032 - RNA, 64 nt, Human
ugucuuuaacccaggagcccagggguagacaaaggaggacuaagguaaucaauuugcaccuuuu

SEQ ID NO: 244033 - RNA, 64 nt, Human
ggcuggaggacuaugguccucaaguuuagaccaagaggacuauggucucaagguucaccaugag

SEQ ID NO: 244034 - RNA, 64 nt, Human
cgugccgguggagcccgagcggacagcggaauacgaggacuacggcgcagacgagccugcagag

SEQ ID NO: 244035 - RNA, 64 nt, Human
uuuuacaggacucccggaaggccacucauggccaugccaggagcuuucucagaaacagucauaa

SEQ ID NO: 244036 - RNA, 64 nt, Human
ugcuugguuaaggagggagugggccagaccagagugccaggagcuaauggagccaggccugacu

SEQ ID NO: 244037 - RNA, 64 nt, Human
ugccacaggugcccaagaagauggaggaucccugugccaggagccaaccuggucuucccgaggg

SEQ ID NO: 244038 - RNA, 64 nt, Human
uuuuuucuuuccuuuguuguucuguuuccuauuuugccaggaaguauuuccauaguugcugaga

SEQ ID NO: 244039 - RNA, 64 nt, Human
cucuggaccucaccugcagauacaguuccccccuugccaggagcaucugcaugugguacuucuc

SEQ ID NO: 244040 - RNA, 64 nt, Human
ugccgggaaguuccuguguugugcugaugauuugugccaggauacauauucaguaccugugggg

SEQ ID NO: 244041 - RNA, 64 nt, Human
accuuuucaaauaggcucauuugggagauucuuuugccaggagagauucaacuuuccaaucuaa

SEQ ID NO: 244042 - RNA, 64 nt, Human
cuucuagguuaggauuguccugacucacuaaagaugccaggauauuggggcugaggggaguuug

SEQ ID NO: 244043 - RNA, 64 nt, Human
ggggcugcagaagacugacuguggaugugccauuugccaggaagguaucuaacuuggcuuugug

SEQ ID NO: 244044 - RNA, 64 nt, Human
ccccgcccucugcgucccccagcccucaggccagugccaggacagcuggcugcugacaggaugu

SEQ ID NO: 244045 - RNA, 55 nt, Human
ccaacgagcugaagcuuuaacaggcugccaggagcgggggcggcgggggcgggcc

SEQ ID NO: 244046 - RNA, 64 nt, Human
uggcacugacauuaaguaguggggggacaguccaugccaggacacccuggaguagccuuccccc

SEQ ID NO: 244047 - RNA, 64 nt, Human
gaugcccccucguggcugcucccagggcugcaccugccaggaccuaauguucuuaggucccucu

SEQ ID NO: 244048 - RNA, 64 nt, Human
cugugcugucgaggcgccugcucgcuuacucgccugccaggaggccgggcucucaguuuggggu

SEQ ID NO: 244049 - RNA, 64 nt, Human
caaaaaaauuuacuuguauauaaugcaccuucaggaggacuauguccuuugaugcuauaaaaua

SEQ ID NO: 244050 - RNA, 64 nt, Human
uuucaguggcaauggacacauuagccuuuuacaagaggacuagaguucaucaagccuugaaagg

SEQ ID NO: 244051 - RNA, 64 nt, Human
aucacuaugccgagcaagaaaaguggaucucagggaggacuagcagccccugguuaagggagau

SEQ ID NO: 244052 - RNA, 64 nt, Human
cgcauguccuacaaucugcucuuagacacggccuugccaggagagccugcccucagacugcagg

SEQ ID NO: 244053 - RNA, 64 nt, Human
ccagucaagaagaaaaagguuugcauucucacauugccaggaugauaaguuccuuuccuuuucu

SEQ ID NO: 244054 - RNA, 64 nt, Human
cucucugagacugcuaaguaggggcagugaugguugccaggacgaauugagauaauaucuguga

SEQ ID NO: 244055 - RNA, 64 nt, Human
uacuuaauuuaaagugugaacuuaauauauaagaugccaggaccaucauauugaugacaaaaau

SEQ ID NO: 244056 - RNA, 64 nt, Human
cagagacugccuggucgccagcgcucaccaugggugccaggaugcuucgcagaggcacugugcu

SEQ ID NO: 244057 - RNA, 64 nt, Human
ccagcgccaucuuucagaaggccucaucuccacuugccaggagccccgacaccacccuuggaga

SEQ ID NO: 244058 - RNA, 64 nt, Human
caguagucacacccucacagcuggccugcccucuugccaggauauuuauuugugcuauucacuc

SEQ ID NO: 244059 - RNA, 64 nt, Human
cuccaccccuagacccuggcugacuuggacaaucugccaggacagaagcuggguuuucugucua

SEQ ID NO: 244060 - RNA, 64 nt, Human
cgcccccgcucuagcucacuguugccucgcugucugccaggaggcccugccauccuugggcccu

SEQ ID NO: 244061 - RNA, 64 nt, Human
cagccuguuccacaggcaccccugcaggaggcgcugccaggagagccuuccaucucggggcucu

SEQ ID NO: 244062 - RNA, 64 nt, Human
uuuuagaguuacauuaugcuuggcaugaauaaggugccaggaaaacaguuuaaaauuauacauc

SEQ ID NO: 244063 - RNA, 64 nt, Human
ugaccuuuaccuccuuucagcuguuucaaacaggugccaggauaccuaugucuuagaauuagag

SEQ ID NO: 244064 - RNA, 64 nt, Human
uccaucccucuccucugcccucugcucuaauugcugccaggauugucacuccaaaccuuacucu

SEQ ID NO: 244065 - RNA, 64 nt, Human
cugagagguuaagucacucacccaaaauuuccacugccaggaagugguagugaugggauucaaa

SEQ ID NO: 244066 - RNA, 64 nt, Human; identical to SEQ ID NO: 142967

SEQ ID NO: 244067 - RNA, 64 nt, Human; identical to SEQ ID NO: 142968

SEQ ID NO: 244068 - RNA, 60 nt, Human; identical to SEQ ID NO: 142969

SEQ ID NO: 244069 - RNA, 64 nt, Human
aaauucaagucauggggagauuccugcuaggugaugccaggaaucucaaugaccuguugauuag

SEQ ID NO: 244070 - RNA, 64 nt, Human
ggguagugggcuaagucgaggguccagccucuucugccaggaagcccuucuugcuuuugagaga

SEQ ID NO: 244071 - RNA, 64 nt, Human
gcugcugcugcugcugccaguggccucuucugggugccaggagaggggaaggaccuuugucugg

SEQ ID NO: 244072 - RNA, 64 nt, Human
ccuguguugcagguacaaccggaugccagccccgugccaggagccuggagggaaguuggggaaa

SEQ ID NO: 244073 - RNA, 64 nt, Human
cagcagccuacgcuaauaggaccacuggacucuuugccaggauggcuuuuccugcuguacugaa

SEQ ID NO: 244074 - RNA, 64 nt, Human
uucuggaagacuucagaagauugagccucacuggugccaggaagccaaagcuuacuuuguagaa

SEQ ID NO: 244075 - RNA, 64 nt, Human
guaguugugccuacuuauccccuggcagaggggaugccaggaccauggacaugaggcuugccca

SEQ ID NO: 244076 - RNA, 64 nt, Human
ucaugucguuuccuuccugcuccugcugcacagcugccaggagugcucugccuggagucugcag

SEQ ID NO: 244077 - RNA, 64 nt, Human
ggaugcucaccugugccaucuguccuccugucugugccaggaggcaccugaguucucugcuguu

SEQ ID NO: 244078 - RNA, 64 nt, Human
aaaguauagaaauauauuuaauguggaaugucaaugccaggauuucucauuaacaauauuuuau

SEQ ID NO: 244079 - RNA, 64 nt, Human
caagagauuagaaauauaaaccuugccuggcucuugccaggagauaacaaaauggguugcugau

SEQ ID NO: 244080 - RNA, 64 nt, Human
ccaggugggaguagcccagcgaaggcacuugggcugccaggaacaggaggcgugggaaacucug

SEQ ID NO: 244081 - RNA, 62 nt, Human
aaauuaaaagcaucauuuaaccauagacaauuugccaggaucuaggaaccaccuaaugguag

SEQ ID NO: 244082 - RNA, 64 nt, Human
gaagcagacacaggccaggccugggccaggagucugccaggagccaggagcgccuacaccuccc

SEQ ID NO: 244083 - RNA, 64 nt, Human; identical to SEQ ID NO: 142965

SEQ ID NO: 244084 - RNA, 64 nt, Human; identical to SEQ ID NO: 142970

SEQ ID NO: 244085 - RNA, 62 nt, Human
agggggagcagaccccugagaucugggcauaggcaccgcauucugaucuggacaaagucggg

SEQ ID NO: 244086 - RNA, 64 nt, Human
ugccaggagccagauucgggaaccguaacugaugugccaggaauggugcauugauucccaguuc

SEQ ID NO: 244087 - RNA, 64 nt, Human
agcuguaaacagacaucugcauuuccuagugagcugccaggagccagauucgggaaccguaacu

SEQ ID NO: 244088 - RNA, 64 nt, Human
ucacacccugagaauucugggagccagucugccaugccaggagucacuggacauguucauccua

SEQ ID NO: 244089 - RNA, 64 nt, Human
auguggccacuugacuuguggaaggccaucuugaugccaggacacacaggaagccccuguguga

SEQ ID NO: 244090 - RNA, 64 nt, Human
ugucaauuccgagaucuaaucucccccuacgcucugccaggaauucuuucagaccucacuagca

SEQ ID NO: 244091 - RNA, 64 nt, Human
gcauuaugaaugagugcagcauuccuguccucugugccaggauuuggucuuagaauccauguca

SEQ ID NO: 244092 - RNA, 64 nt, Human
acugggagaaggguggccugcugggccgucuggcugccaggaagaaggugaguggccugucggc

SEQ ID NO: 244093 - RNA, 64 nt, Human
gaaacccaggaggagaguguggaguccagagugcugccaggacccaggcacaggcguuagcucc

SEQ ID NO: 244094 - RNA, 64 nt, Human
aaaacucuaaucaaaagaggaaaauuuuggaauaugccaggaauaguggaauuuuauuuuuuaa

SEQ ID NO: 244095 - RNA, 64 nt, Human
cugaagcucuuggagggaagggcucuccucacccugccaggaagcuucuuaacaugugacagga

SEQ ID NO: 244096 - RNA, 64 nt, Human
ugaugcaggccccaaggaccccuuugcugaccucugccaggacccacacagcuucgauggaucu

SEQ ID NO: 244097 - RNA, 64 nt, Human
uuuuuguuuuugguuuuaauuugcagagauuugcugccaggaaucaauuuugaggguucagauu

SEQ ID NO: 244098 - RNA, 64 nt, Human
auggggagugugcauucugaggucuaacccggggugccaggaacacacacauccuccaucccag

SEQ ID NO: 244099 - RNA, 64 nt, Human
ggcucccacugcccccugagauguacacccugauugccaggaaaacagacugcuguguucagua

SEQ ID NO: 244100 - RNA, 62 nt, Human
cucaccgagaccagccucaucucggggaaccugcaccgcaucggagauaucaccuccugcuc

SEQ ID NO: 244101 - RNA, 62 nt, Human
auuaucguuaagcaaauguacaauaugcucaggcaccgcagagagcugggcacgggcccaug

SEQ ID NO: 244102 - RNA, 62 nt, Human
ugccugauggcugaugccggcccggcaaauaggcaccgcacuuuacucuugggacucgggga

SEQ ID NO: 244103 - RNA, 62 nt, Human
ccagguugaggcccacaacacggugaccucuggcaccgcaaccacagucauugagauacaag

SEQ ID NO: 244104 - RNA, 64 nt, Human
agcuuaagccacuccccuugccucucaggaauuuugccaggauggggcacagcagcucagguuu

SEQ ID NO: 244105 - RNA, 64 nt, Human
gcagccacccugaggagucugagguccugagcacugccaggagggacaaaggagccugugaacc

SEQ ID NO: 244106 - RNA, 64 nt, Human
cagagacacuuugucuaguguauucucuucacagugccaggaaagagugguuucugcgugugua

SEQ ID NO: 244107 - RNA, 64 nt, Human
uccccaggacgaguuuucacuagagggcccacgaugccaggauucugauucaucuuccucccaa

SEQ ID NO: 244108 - RNA, 64 nt, Human
guuccccaagaguaucugauuccucugcugucccugccaggagcugaagggugggaacaacaaa

SEQ ID NO: 244109 - RNA, 64 nt, Human
cucccaacugcaggaagcccaggaggcugaugccugccaggaggagcuggcacugaagguggaa

SEQ ID NO: 244110 - RNA, 64 nt, Human
gaauuuuggguggaauaauuaguuucugaaggcuugccaggacuccugagcagguaggcucuag

SEQ ID NO: 244111 - RNA, 64 nt, Human
ucuucuagacugcauuagauucauucaucucauuugccaggacauguuggccagaggucugggc

SEQ ID NO: 244112 - RNA, 64 nt, Human
ggcucugggcuugacggucuccagcuccccuuucugccaggaagccaccccuuagcacuccccc

SEQ ID NO: 244113 - RNA, 64 nt, Human
cgcacacacugggaccuagcauaguuccugccuaugccaggagcuggcucuguguuuaagaaaa

SEQ ID NO: 244114 - RNA, 64 nt, Human
uaaggucacguuuacuauuucagaggaaauaucuugccaggauaccuacccauccuuauagaac

SEQ ID NO: 244115 - RNA, 64 nt, Human
ucugacugucaggcugggccugccuccuugucccugccaggaauuuccaacaaaccccaccacc

SEQ ID NO: 244116 - RNA, 64 nt, Human
ggccaccaugccuggucagcaccaauucaagccaugccaggaaucugccuaccugccagguuca

SEQ ID NO: 244117 - RNA, 64 nt, Human
auaguagguacugaaugaaugaaugaacaaggggugccaggagacugcuacucccaguccuucc

SEQ ID NO: 244118 - RNA, 64 nt, Human; identical to SEQ ID NO: 142960

SEQ ID NO: 244119 - RNA, 62 nt, Human
ucccguuugucucagugucccugcaacaagcagcaccgcagacuguaauaaaaggugggguu

SEQ ID NO: 244120 - RNA, 62 nt, Human
gcacacaggacacggguggaucccaacaggcagcaccgcaccucugcccgccucccgcacug

SEQ ID NO: 244121 - RNA, 62 nt, Human
accacacaacacaccacaccccacaccgcacugcaccgcaccgcaccgcaccguaccucgcc

SEQ ID NO: 244122 - RNA, 64 nt, Human
ccuauuugauuauuaaagugagcuauguguuaagugccaggacauuucuagcuuuugugagaau

SEQ ID NO: 244123 - RNA, 64 nt, Human
uuuaaauguccauuuucauuuauaggccaaauccugccaggaaaguaaccagaucucuggauuu

SEQ ID NO: 244124 - RNA, 64 nt, Human
ugcaaaaggacaaaaacaacucccgugauaugauugccaggagauucuguuuccccauuucuau

SEQ ID NO: 244125 - RNA, 64 nt, Human
gaagauuuuuauacauguuuucuauuuccgacaaugccaggaggcuucauugacguuguagucu

SEQ ID NO: 244126 - RNA, 59 nt, Human
ugugcaugaagaaccugugagccggcgcgugccaggaagggccauuuuggugcuuauuc

SEQ ID NO: 244127 - RNA, 64 nt, Human
gccacgccggcagcuuccagcccugccgcagaagugccaggauguccaucagccacucgccagg

SEQ ID NO: 244128 - RNA, 64 nt, Human
agauuccacugagguuagaguccauuuacaaagcugccaggaaaccggccacuucuaguaaacc

SEQ ID NO: 244129 - RNA, 64 nt, Human
cuuguugccucucaagguggacuauucuguuuucugccaggacacugccauucaugcauuguca

SEQ ID NO: 244130 - RNA, 64 nt, Human
ccucaugaugcaauuaucuuacucagaggagauuugccaggaaauucucuccguuacaugcauu

SEQ ID NO: 244131 - RNA, 64 nt, Human
aucagcccacguggugugguuggugaacagugcaugccaggaggaagcagucccuccucaccag

SEQ ID NO: 244132 - RNA, 64 nt, Human
aagcugcaggcacacacgccuucaugccagugcaugccaggaagcacguucacuagacuaaaac

SEQ ID NO: 244133 - RNA, 64 nt, Human
gcugaggccgggcuugagaggagagcgcuggccaugccaggagagaacccacgcacaugcacac

SEQ ID NO: 244134 - RNA, 64 nt, Human
gaugacgcccagcacagcagcaggacacaccaugugccaggaaaugaccucagcaagaaaccuc

SEQ ID NO: 244135 - RNA, 64 nt, Human
acuucagugccugggugcucaggcuuugcccaggugccaggagaaggugugagcaugagccuau

SEQ ID NO: 244136 - RNA, 64 nt, Human
ggaggacugguacccacaaagcaacauguaccgagaggacuaaaugucaucuacgugcauguga

SEQ ID NO: 244137 - RNA, 64 nt, Human
cgcugccuuaggugccuucugcucucuggaaccagaggacuagcugacuuuugccaaggagcag

SEQ ID NO: 244138 - RNA, 64 nt, Human
auauuuaaaugcaacuuauugcuauagaagcaaagaggacuaaagggcaaaauucuagagagug

SEQ ID NO: 244139 - RNA, 64 nt, Human
acucgcgggcccuaggacccuaggaugccauucuugccaggaggaggaaugagagugauguugg

SEQ ID NO: 244140 - RNA, 55 nt, Human
caucucgagguggagcuuagccccgugccaggagcaaugggacuggagucagaug

SEQ ID NO: 244141 - RNA, 64 nt, Human
acucacucuucauucagaagacugguggcccacgugccaggaccaccccaccucucuugcugcc

SEQ ID NO: 244142 - RNA, 51 nt, Human
gccuggaagggcacuucugagugccaggaaaggcagcuuuagugcagaccu

SEQ ID NO: 244143 - RNA, 64 nt, Human
aaagggacugcugugggccaaagccaagcccaucugccaggacgagguaaugucagagcuccau

SEQ ID NO: 244144 - RNA, 64 nt, Human
cagacccaagcuuguggcaccaggcaucugauggugccaggaaagccacuggaauugucacacg

SEQ ID NO: 244145 - RNA, 64 nt, Human
ugaacuuccugucucccaccucagcacuaguccaugccaggacaccagcugacaauuucuuggu

SEQ ID NO: 244146 - RNA, 64 nt, Human
aucacaaaucucuuaauauuuauaaacuaccugaugccaggagcuuagggcuuugcauuguguc

SEQ ID NO: 244147 - RNA, 64 nt, Human
acaggugugacacagccacagcagaggcaaggggugccaggaguccccagcggcauccucgggg

SEQ ID NO: 244148 - RNA, 64 nt, Human
guccgaccuccgaggcaggggccggggucacaccugccaggacuccgcuucuccgugucccagc

SEQ ID NO: 244149 - RNA, 64 nt, Human
caucugaucuaaagacuggcuccagaccccgggcugccaggauuaugcaguccacuuggucuac

SEQ ID NO: 244150 - RNA, 64 nt, Human
cugggguucucuacaggccucuuccuguugugacugccaggauaaagcuuccgggaaaacagcu

SEQ ID NO: 244151 - RNA, 64 nt, Human
aguucagcaaguagagcagaguuuggcaggcaggugccaggaacuccccuucuuccuggagugc

SEQ ID NO: 244152 - RNA, 64 nt, Human
auaguuuuaaaggaugugaucugguccccuuggaugccaggagagaauccaguugaacuugcuc

SEQ ID NO: 244153 - RNA, 62 nt, Human
ggagggaagcauuggaacuggaguugugcacagcaccgcagcuagugggccuggcugggggu

SEQ ID NO: 244154 - RNA, 62 nt, Human
acagcgaacacucgccugaacuuccuuuuggagcaccgcauggucuugccagcuaccaggag

SEQ ID NO: 244155 - RNA, 62 nt, Human
guaggcugugugggguggaugaacccugaagcgcaccgcacugucugccccaaugucuaaca

SEQ ID NO: 244156 - RNA, 62 nt, Human
caggcagguaggcugcagccaggagcucccuggcaccgcaggaccucgugguacucuugccu

SEQ ID NO: 244157 - RNA, 64 nt, Human
cauggcuggcuggggcuuuagccaagccaccuacugccaggaauuggagccucaguucccuccu

SEQ ID NO: 244158 - RNA, 64 nt, Human
cuuagaacuuggacuuuuccccugugaagggggcugccaggacaucucagcacucccgccugga

SEQ ID NO: 244159 - RNA, 64 nt, Human
gucucuuccccuguuuuuaagucccauguggggcugccaggagccaagagcaugccuucaugcc

SEQ ID NO: 244160 - RNA, 64 nt, Human
ggucagacugaaguguuccaggacaugcugcccaugccaggagauccaacccaggggacuggca

SEQ ID NO: 244161 - RNA, 64 nt, Human
agggguuuccuuuuccauuugccaaguuccauugugccaggacugccgugcuccacugagcucc

SEQ ID NO: 244162 - RNA, 64 nt, Human
aaugguuuuagcuagagucagaccagaaugaaaaugccaggagcugguacacuacagauguagu

SEQ ID NO: 244163 - RNA, 64 nt, Human
acacuagccaaacucuaauuaauucucaaaucacugccaggaguucuugcuccuggcugcaggc

SEQ ID NO: 244164 - RNA, 64 nt, Human
cauuuuuaaaauuuaauuuuuaaguaaaggaauuugccaggauaucugcaucaagaguacugua

SEQ ID NO: 244165 - RNA, 64 nt, Human
uggcucugcccuggcuguggggguggagggaccuugccaggaugaaccccccagucccaggcac

SEQ ID NO: 244166 - RNA, 64 nt, Human
uccuagcggggaugggcggggccgccugugcagaugccaggagggcucgagcuggacacuccug

SEQ ID NO: 244167 - RNA, 64 nt, Human
auugagaaaaugauucacgaauuccaaaucagauugccaggaagaaauaggacgugacgguacu

SEQ ID NO: 244168 - RNA, 64 nt, Human
acaccagcccuguccuagcccuucaguaagaccuugccaggagaggagaaggaugccugggugc

SEQ ID NO: 244169 - RNA, 64 nt, Human
cagugacguggccugcggccgggcugcccuucgcugccaggacaccugccccagcgcggcuugg

SEQ ID NO: 244170 - RNA, 64 nt, Human
ggagacuuuggucaguuaccugggaauucugggcugccaggaaacgauuugggccucugucagu

SEQ ID NO: 244171 - RNA, 64 nt, Human; identical to SEQ ID NO: 142955

SEQ ID NO: 244172 - RNA, 62 nt, Human
ccucccugcucugagacacaccccuguggcgagcaccgcagaaacgggaagccacuacuuaa

SEQ ID NO: 244173 - RNA, 62 nt, Human
uaaacacagcagccuccucucuuccugccugagcaccgcagcgggagccagcagggggcagc

SEQ ID NO: 244174 - RNA, 62 nt, Human
gguagccccggccugggucaucaggcacagaggcaccgcaacaccaccugcggcaacuccag

SEQ ID NO: 244175 - RNA, 64 nt, Human
aggaaacuguccuggcugggcugagucaggaccuugccaggacgggcuguaccccuggcuucua

SEQ ID NO: 244176 - RNA, 50 nt, Human
agugcagcugcugcgacugaugccaggacaaccuuucucccagauguaaa

SEQ ID NO: 244177 - RNA, 50 nt, Human
agugcagcugcugugccugaugccaggacagcugugcucucagauguaaa

SEQ ID NO: 244178 - RNA, 64 nt, Human
ucagggccagagcccuggcggaggagaggcccuuugccaggagcacagcagcagcucgccuacc

SEQ ID NO: 244179 - RNA, 64 nt, Human
cccccucccuugugguuucagcacagaaccugaaugccaggaaaaauuccugggccaagaagcu

SEQ ID NO: 244180 - RNA, 64 nt, Human
cugcuuuuaaaagugcacauuaaaaaggaaaguuugccaggaggaacaaagagauugugguggu

SEQ ID NO: 244181 - RNA, 64 nt, Human
uaauaccuuuaucucuggccacucaaaaaugcagugccaggagugcuaaaccuagaggccaaua

SEQ ID NO: 244182 - RNA, 64 nt, Human
ucagacaaugaaaccuucuccucuggggcuuuguugccaggaagauuagaacuaaauuuauuuu

SEQ ID NO: 244183 - RNA, 64 nt, Human
ggucgcuccaucacccaaacaaaagaacaagguuugccaggauguccgagugcccccuggcccu

SEQ ID NO: 244184 - RNA, 64 nt, Human
cuccgggaagacccgcccaucccaggacuccagaugccaggagcccugcugcccacaugcaagg

SEQ ID NO: 244185 - RNA, 64 nt, Human
gcacgcguaggcaucuccacgcuggaggggggccugccaggacuccugucucugggugaggccg

SEQ ID NO: 244186 - RNA, 64 nt, Human
ugcuccaggagccugcgcggcucgccuggaaacgugccaggacacuguccuggugcccagccca

SEQ ID NO: 244187 - RNA, 64 nt, Human
acacauuugcacugccgggaauggacacuggaagugccaggaggaaggaaggcugguuuggugg

SEQ ID NO: 244188 - RNA, 64 nt, Human
aaaaaccuaaauucuccaaccaauuuuuuuaaacugccaggaacacccaaaaauauuuuuaaau

SEQ ID NO: 244189 - RNA, 64 nt, Human
acacggggcccugcaggcuguggauaugcacucagaggacuaagggggugcucugcaagcgaga

SEQ ID NO: 244190 - RNA, 64 nt, Human
gaacuugaagauuacauaaaagugcagaaagccagaggacuagagccaaaaacuuguuucagaa

SEQ ID NO: 244191 - RNA, 64 nt, Human
gaacuugaagauuacaucaaaguacagaaagccagaggacuagauccaaagacuuguuucagaa

SEQ ID NO: 244192 - RNA, 64 nt, Human
gagugugcagauuacaucaaugugcagaaagccagaggacuagaggccaagacuuguuucagaa

SEQ ID NO: 244193 - RNA, 64 nt, Human
gucguguccauccuccauggcacagcccuccugcugccaggaccugcuugaacuaccagggcca

SEQ ID NO: 244194 - RNA, 64 nt, Human
auuggggaaucaggaaaggaaagacugagaugguugccaggacuugggguggcccaccugugga

SEQ ID NO: 244195 - RNA, 64 nt, Human
agaguggacgaugaggaggauacuguggccccgcugccaggacaucuguugggcccagguaaug

SEQ ID NO: 244196 - RNA, 64 nt, Human
ccgugugucugaagcagugagugguccacacaggugccaggagugcccauaugagaugacgagg

SEQ ID NO: 244197 - RNA, 64 nt, Human
cacaauuuccuggguuccaccaagcagcgaaaacugccaggaugaaugaggaaaaaacccagcc

SEQ ID NO: 244198 - RNA, 64 nt, Human
gcagggggaaaaggugcacuuggccaguggcgccugccaggagugaguccaugcguugucugcc

SEQ ID NO: 244199 - RNA, 64 nt, Human
cggggccugggcaggagggaggugcuucuaguucugccaggagacagguuagcugcuccccacg

SEQ ID NO: 244200 - RNA, 64 nt, Human
agaaacccccuuggaggagcuguguaugcgggggugccaggaagggcauagcuccugcccccag

SEQ ID NO: 244201 - RNA, 64 nt, Human
gccggaggcugaggaaaggaagagggcacggaguugccaggagcaaaccaaagugaagagagag

SEQ ID NO: 244202 - RNA, 64 nt, Human
uuuaugcaaaucuuugacgggguuuuccuuguccugccaggauuaaaagccaugaguuucuugu

SEQ ID NO: 244203 - RNA, 64 nt, Human
auaaaaguugacuguacuaaaaauguauacuuguugccaggaaggugaccucaaaaauuaaaag

SEQ ID NO: 244204 - RNA, 64 nt, Human
uagcugugcccccucugguuauuuauuuccuuagugccaggagggcacagcaggggagcccuga

SEQ ID NO: 244205 - RNA, 64 nt, Human
cccgcagucagcagccauuccuggcagugaacucugccaggacugaagcuguggcuuuauccau

SEQ ID NO: 244206 - RNA, 64 nt, Human
uugcugggagaauuaagcauuauccugaagacucugccaggagaggauaauuggaaguucucuu

SEQ ID NO: 244207 - RNA, 62 nt, Human
acaacacaccacaccccacaccgcacugcaccgcaccgcaccgcaccguaccucgccacauc

SEQ ID NO: 244208 - RNA, 64 nt, Human
ugucugccuuccuuuccaagaccguuggugccuagaggacuagaaucguguccuauuuaacuuu

SEQ ID NO: 244209 - RNA, 64 nt, Human
ugugugugcguggggacagaggccuggaaaugcggaggacuauacagagaaggcagguuuugug

SEQ ID NO: 244210 - RNA, 64 nt, Human
uuugaauaauguagugcagucacccuguggcaaaugccaggacagcugcaggugcccauuagca

SEQ ID NO: 244211 - RNA, 64 nt, Human
uacccacacauuccagggcuggggugagccugacugccaggaccccaggucaggggcucccuac

SEQ ID NO: 244212 - RNA, 64 nt, Human
ggcagagaccucuuuguugcguuuugugcuuugaugccaggaaugccgccuaguuuaugucccc

SEQ ID NO: 244213 - RNA, 64 nt, Human
agggcccuccgaccacuuccaggggaaccugccaugccaggaaccuguccuaaggaaccuuccu

SEQ ID NO: 244214 - RNA, 64 nt, Human
cagaggcuuaugaagauauucagauacucuucuaugccaggaagcacaaagacuuuguugagau

SEQ ID NO: 244215 - RNA, 64 nt, Human
gcacugggccggcagccugguucccucuuuccugugccaggacucucuuucuuccacuacccuc

SEQ ID NO: 244216 - RNA, 64 nt, Human
cggccagcaggcaccuggcacccaccuucccugcugccaggaugcccaagaaaaaggucagcuc

SEQ ID NO: 244217 - RNA, 64 nt, Human
acaaggcucaguggaucuggucugaguuucaaucugccaggaacuccugggccucaugcccagu

SEQ ID NO: 244218 - RNA, 64 nt, Human
acuaggccuacugcccagcaagccagucuggcacugccaggaccuccuguggcacccuucaagc

SEQ ID NO: 244219 - RNA, 64 nt, Human
aaggaauuauucccaugaguuggcugggaauaagugccaggauggaaugaugggucaguuguau

SEQ ID NO: 244220 - RNA, 64 nt, Human
caacucaguggauguucucugaaugcuuacugggugccaggaccacagagagauguuagucacu

SEQ ID NO: 244221 - RNA, 64 nt, Human
cugccuggcccugcucaccccuacgccucgcccuugccaggaggggaguggcagugaggagggg

SEQ ID NO: 244222 - RNA, 64 nt, Human
uguuuguggagucgaggagccaaccccagccuccugccaggaucaccucggcggucacacucca

SEQ ID NO: 244223 - RNA, 64 nt, Human
cacccugccugggacaucgcuggaaccugcaccaugccaggaucaugggaccaggcgagagggc

SEQ ID NO: 244224 - RNA, 62 nt, Human
augugcaaacucacuucugaggggggacccuggcaccgcauuagagcucgaaauaaaggcga

SEQ ID NO: 244225 - RNA, 64 nt, Human
ccauuugucaucguuccccaccccuucgacaugcugccaggaaacaagggaaggggccucccuc

SEQ ID NO: 244226 - RNA, 64 nt, Human
ggaucgggcggaagcugcugggacccuccugggcugccaggauuuagcagggagguggcuggcu

SEQ ID NO: 244227 - RNA, 64 nt, Human
cuccagaaccugacaaggcaccagcaggaccccuugccaggagcaugucugugcagcaguguuu

SEQ ID NO: 244228 - RNA, 64 nt, Human
gccccgcccaccuccucuugucaauggccccaucugccaggaagguugaggacucccagguuuc

SEQ ID NO: 244229 - RNA, 64 nt, Human
auauauauuucuaaguguaacuguccuuccucugugccaggaaacgggagggggcugauccucu

SEQ ID NO: 244230 - RNA, 64 nt, Human
guguauuuuuuuagcgaauaugauuugcaugucuugccaggaguuaagcggccucugggguguu

SEQ ID NO: 244231 - RNA, 64 nt, Human
guuguguggaagccaaggcugggucugacaucccugccaggaagcagguuggacagaaaccacu

SEQ ID NO: 244232 - RNA, 64 nt, Human
gcuggggucaaagacuuguguccccaccucaggcugccaggauggcgugugugccgugacaggg

SEQ ID NO: 244233 - RNA, 64 nt, Human
ccucauugugacuuaugaggagcaagccuguugcugccaggagacuuggggagcaggacacuug

SEQ ID NO: 244234 - RNA, 64 nt, Human
agauagcuugaauuuaaugaaauagaauucagugugccaggaguuagguucauaccaggugggg

SEQ ID NO: 244235 - RNA, 64 nt, Human
uaaagcccaugccccaacucugccagcccccaccugccaggacguucuagcaggacaucggugc

SEQ ID NO: 244236 - RNA, 64 nt, Human
uguacuucaccucuuggcuguggaggaacuuaguugccaggaaauuuuuuuuuuuuuuuucaga

SEQ ID NO: 244237 - RNA, 64 nt, Human
ugggcuuuugcuguccucuucucacgcagaguucugccaggagggugugcugugggggucagac

SEQ ID NO: 244238 - RNA, 64 nt, Human
aaacagacgccauccuacaccuaucagcccugccugccaggagaacagaacacacuccuggucu

SEQ ID NO: 244239 - RNA, 64 nt, Human
ccgcccugcccccuccagucccccacccugccgagaggacuaguauggggugggaggccccacc

SEQ ID NO: 244240 - RNA, 64 nt, Human
auaugaacagggcccaggccuggagcguuugcugugccaggaggcggcagcucuucugggcaga

SEQ ID NO: 244241 - RNA, 64 nt, Human
caagaccacgcccagcaaaaguggucggcugcagugccaggaccacccuugccugcagccuuug

SEQ ID NO: 244242 - RNA, 64 nt, Human
auuacaaaugucucagcauugguuaacuaauuuuugccaggaccauuauugaucaagcaaauaa

SEQ ID NO: 244243 - RNA, 64 nt, Human
ucacauaugcagguucguuuucauucuagggcagugccaggaaguauauugauagcuuuguagg

SEQ ID NO: 244244 - RNA, 64 nt, Human
gaauacaguagcaaaacauaaauuaaaacucaaaugccaggacaaaauaaaacaauauaccaga

SEQ ID NO: 244245 - RNA, 64 nt, Human
acgucaccccugccaggcaagcccagggcacagaugccaggauggcuucucccucucagugcga

SEQ ID NO: 244246 - RNA, 64 nt, Human
accugguaccacucagaaccuccaacugacugaaugccaggagcugaacauuaauaugugcaaa

SEQ ID NO: 244247 - RNA, 64 nt, Human
accugggcaagcuggcggcuggggucccagcagcugccaggagcacggcucuguccccagccug

SEQ ID NO: 244248 - RNA, 64 nt, Human
ggaaaaugcaggcugaguggggcgaccuccugccugccaggagcccccuuucaggacacagcgg

SEQ ID NO: 244249 - RNA, 64 nt, Human
cucccagcggaacuggcacgacuccgucaccgccugccaggaagugagggcccagcucgucgua

SEQ ID NO: 244250 - RNA, 50 nt, Human
agaacuuugaugacgagugaugccaggaagccaggccaccgaagccccca

SEQ ID NO: 244251 - RNA, 64 nt, Human
acuuuuguagaaaucgggguucccucuuucucucugccaggaccccauagagucacagcuuuug

SEQ ID NO: 244252 - RNA, 64 nt, Human
gggguucgggugcugcagaccuggaacucccuucugccaggauguuggcagccgguuguaagcc

SEQ ID NO: 244253 - RNA, 64 nt, Human
ccucuccccucucugcuccagacucacuugccauugccaggagauggccccaacaagcaccccg

SEQ ID NO: 244254 - RNA, 64 nt, Human
gaccguguggaacaggaacagcuggaguggaguugaggacuauuagaacugguuccccucacca

SEQ ID NO: 244255 - RNA, 64 nt, Human
gugcccaguccaucagcagugauggaauuugcuggaggacuaggccagagcaagccucacugcc

SEQ ID NO: 244256 - RNA, 64 nt, Human
gagggaagaggagaggaggucagaggaccugggugaggacuagggcaucaaggucgugugugug

SEQ ID NO: 244257 - RNA, 64 nt, Human
gacugggcugccacugcuugggcagaguaaaaggugccaggaggagcauggguguggaaguccu

SEQ ID NO: 244258 - RNA, 64 nt, Human
ccuccucugacaaacuggucugguacccaccaugugccaggauccacccuggccucuuuuuacc

SEQ ID NO: 244259 - RNA, 64 nt, Human
gcugccacaggcaggugagggaccccugagaagaugccaggacuuauaguacccccucaggaca

SEQ ID NO: 244260 - RNA, 64 nt, Human
cucgccagcccucuggggcauugugggagaugccugccaggaaugagcaagcucuguugcucgg

SEQ ID NO: 244261 - RNA, 64 nt, Human
cuaccagggaggcugaggugggaggauugcuugaugccaggaguuagggaauauagugcaccgu

SEQ ID NO: 244262 - RNA, 64 nt, Human
cuccugccuggccuggccugggacaccuccucucugccaggaggcaauaaaagccagcgccggg

SEQ ID NO: 244263 - RNA, 64 nt, Human
cucccugcuguccucucucccccggccucccagcugccaggaauuucugcgccuguccaggcuc

SEQ ID NO: 244264 - RNA, 64 nt, Human
cagagugguggagccuugggaacagaucugaugaugccaggagguuccgggagacaauuuaggg

SEQ ID NO: 244265 - RNA, 64 nt, Human
gaaaaaauuuuugugccuaacuuuguggccuggcugccaggauuuccugugagcccagugagga

SEQ ID NO: 244266 - RNA, 64 nt, Human
guggcuuagagaauguaacugaccaaagucacacugccaggaacuggaagcacuaggauuugac

SEQ ID NO: 244267 - RNA, 64 nt, Human
agacucugacuuuuauuucgccucucuccuuggcugccaggaagcucauagcuauuuauacuca

SEQ ID NO: 244268 - RNA, 64 nt, Human
cccagcuuugggguggugcugacgcucccaggggugccaggagccacugggacagggugaggcu

SEQ ID NO: 244269 - RNA, 64 nt, Human
ccugcuggccuuggagaagcaaaaagccagggugugccaggagaagggcaugaagcgaggaccc

SEQ ID NO: 244270 - RNA, 64 nt, Human
caggggccgggguuggggagacuaugucgccagaugccaggacgcccucaccccguuugcauau

SEQ ID NO: 244271 - RNA, 64 nt, Human
uacugguuugacagcaauuucauauauaauuauugaggacuacacaccaauugaagaaacugcc

SEQ ID NO: 244272 - RNA, 64 nt, Human
uguugaaaaauauaggcccauaaaugcaucuuuugaggacuauuuuccuauguuuauguacucu

SEQ ID NO: 244273 - RNA, 64 nt, Human
ccccgcaggccgcugaaccaaaggccuagauggggaggacuaggagagcgagggggcccccagc

SEQ ID NO: 244274 - RNA, 64 nt, Human
aucuccccaguuucauuccuugguccuuacuccaugccaggacuugugcacaucuuuuuggagc

SEQ ID NO: 244275 - RNA, 64 nt, Human
ugguucaccugagaggcugguguggggccugggcugccaggaaccucauuuuccuggggccuca

SEQ ID NO: 244276 - RNA, 64 nt, Human
cuuaccugggaccucacacgcugggcuucacggcugccaggagccucuccccuccagaagacuu

SEQ ID NO: 244277 - RNA, 64 nt, Human
ugacuuaccugggauuucacuugccgggcuucacugccaggagccuccccugcuggggaccuug

SEQ ID NO: 244278 - RNA, 64 nt, Human
gaaaaagaacaagccacagaaacgggcucgcucgugccaggacacagcagugucuuucaaaaaa

SEQ ID NO: 244279 - RNA, 64 nt, Human
cugggaacaagacugcgggcucugcccccagcucugccaggacggcugcaagaccagcuggccc

SEQ ID NO: 244280 - RNA, 64 nt, Human
ugcuacagacccugcccuggggcccacacacuccugccaggaagcccuacaucaauaaaguucu

SEQ ID NO: 244281 - RNA, 64 nt, Human
ugaggggggugcccgggguccuccuucccuacccugccaggagggccccgcuggugggagacag

SEQ ID NO: 244282 - RNA, 64 nt, Human
gcccuccaagccagguugaggucugguaacagaaugccaggaagggggccuggaagaccaccug

SEQ ID NO: 244283 - RNA, 64 nt, Human
cccuugucuuuuuccagacuguuaagccaagaccugccaggagugucucuaagagauccaggag

SEQ ID NO: 244284 - RNA, 64 nt, Human
guggcaaaauuuuuaaugaauacucacaccuuauugccaggaaagcauuuauacuugagaaaaa

SEQ ID NO: 244285 - RNA, 64 nt, Human
cccucucucacucugccuucaguggagcuagaccugccaggagcacuuggccugcaggggcagg

SEQ ID NO: 244286 - RNA, 64 nt, Human
ccuugagguuauguccuuuuccauuaaguacaugugccaggaaacaagagagagagaaaguaaa

SEQ ID NO: 244287 - RNA, 64 nt, Human
gcugugcauggggugagacccagagcgguaucuuugccaggaugggggcgucugcagaacuaga

SEQ ID NO: 244288 - RNA, 64 nt, Human; identical to SEQ ID NO: 142952

SEQ ID NO: 244289 - RNA, 64 nt, Human; identical to SEQ ID NO: 142953

SEQ ID NO: 244290 - RNA, 64 nt, Human; identical to SEQ ID NO: 142954

SEQ ID NO: 244291 - RNA, 64 nt, Human
ucugacacacagagggagugcccuagauaugaauugccaggauguuugaguaaauauguguccu

SEQ ID NO: 244292 - RNA, 64 nt, Human
cacuggcacccacagcaggacuccgccagucugaugccaggacugaauaaaguguauuugcccc

SEQ ID NO: 244293 - RNA, 64 nt, Human
uugugguucauucucaggcugggguggacucagaugccaggaaagggacagccucccauuguca

SEQ ID NO: 244294 - RNA, 53 nt, Human
ucuggcucacggugaaauaagcuugccaggaggcuggcaguacagagugcagc

SEQ ID NO: 244295 - RNA, 64 nt, Human
cccuguuggcaaacauucccuuccauggucagccugccaggaggaggggagucaccuuggggcu

SEQ ID NO: 244296 - RNA, 64 nt, Human
ccucaggugauccccccaccuuggccucccaaagugccaggauuacaggcaugagccacugugu

SEQ ID NO: 244297 - RNA, 64 nt, Human
gaauaggccaggcuccauccggaggcagggaccaugccaggaggagccccuguggucacggcau

SEQ ID NO: 244298 - RNA, 64 nt, Human
cccgcagccuuguugagagccacacuucugcccaugccaggagccagcugugugaccauccagg

SEQ ID NO: 244299 - RNA, 64 nt, Human
agagguucucagcaucaggccaccuccaccccaaugccaggauagauguauucuagaguagggg

SEQ ID NO: 244300 - RNA, 64 nt, Human
ggugaucacguggucacggcaaaggaagacgugaugccaggaccagucccagagcaggaauggg

SEQ ID NO: 244301 - RNA, 64 nt, Human
agggacugaccucaggaccuuccagguuccucugugccaggaaugagaggccaggcccgauccu

SEQ ID NO: 244302 - RNA, 64 nt, Human
ucucccagauguaaguuguuuugcaaacucaguuugccaggauuucuuucuuuccuaaucuuaa

SEQ ID NO: 244303 - RNA, 64 nt, Human
ggaggugggguuuauugggaugcuggagaagagcugccaggaaguguuuuuucugggucaguaa

SEQ ID NO: 244304 - RNA, 64 nt, Human
auuauuuucucagucauccuggcagccaaaaaugugccaggaaaagaaagaauguggagcacgc

SEQ ID NO: 244305 - RNA, 62 nt, Human
aggggucucuaauaauccccacuuggaauucagcaccgcaaggaaauuauggguaugugagc

SEQ ID NO: 244306 - RNA, 64 nt, Human
gaccgguuaaggagaagccagaguuagaguaggagaggacuaauucucagcagcaguggaggug

SEQ ID NO: 244307 - RNA, 64 nt, Human
ccccacuuucaagucacccuugccacugaggaccgaggacuaugcuaugaugaggauuaaggug

SEQ ID NO: 244308 - RNA, 64 nt, Human
cgugaagcuagaaaaauaaaugagcccaggcauagaggacuagagcccaggugcacgguuagcu

SEQ ID NO: 244309 - RNA, 64 nt, Human
ucccauccucacccaggccaaggcccaggggcucugccaggacaccacaugggagggggcucag

SEQ ID NO: 244310 - RNA, 64 nt, Human
uuguaucucuucauuuaagaauuauuugaaugccugccaggagccagauuuguucuggguauua

SEQ ID NO: 244311 - RNA, 64 nt, Human
ggccuuccucccuuccuuucacagccggucucucugccaggaaaugggggaaggaacuagaacc

SEQ ID NO: 244312 - RNA, 64 nt, Human
augugacaacacuaugaugucauuuggaaggauuugccaggacagacugauucugaguccuggg

SEQ ID NO: 244313 - RNA, 64 nt, Human
gacugccagggaucggagugcgggccgcgcacggugccaggauuccgccgaggggaagccgcuc

SEQ ID NO: 244314 - RNA, 64 nt, Human
gccugugaccgggguccugaggcuggggcuuuugugccaggagugggugggacacagagacccc

SEQ ID NO: 244315 - RNA, 64 nt, Human
augccuuccugaagagcccucuccaccugcaaggugccaggacugggagggaaaguccagggcc

SEQ ID NO: 244316 - RNA, 64 nt, Human
augaaaauaagguaagcaaaaaccaacuccauuuugccaggauuuuguugugcugagauugcca

SEQ ID NO: 244317 - RNA, 60 nt, Human
aaauccgggcagagagguaaaacaccugaaugccaggaaacaggaagauuagacacugug

SEQ ID NO: 244318 - RNA, 64 nt, Human
agcuacucgggagucugaggcagaggauggcaugugccaggaguuugaggcugcagugcacuau

SEQ ID NO: 244319 - RNA, 64 nt, Human
gaggccauuccagugucuucuagaaagacucgcuugccaggagugcguucuuuguugaaaaaug

SEQ ID NO: 244320 - RNA, 64 nt, Human
uccagcaacaggaacucucucuuuucaccuuugcugccaggaaucucagagauaauuuagugcu

SEQ ID NO: 244321 - RNA, 64 nt, Human
gaccucgugauccgcccgccuuggccuucuaaagugccaggauuacaggugugagccacugggc

SEQ ID NO: 244322 - RNA, 64 nt, Human
cguuacuucagcccaugaaaauggcauccagggcugccaggagauucagagcucaaaacaaggc

SEQ ID NO: 244323 - RNA, 55 nt, Human; identical to SEQ ID NO: 142957

SEQ ID NO: 244324 - RNA, 64 nt, Human; identical to SEQ ID NO: 142958

SEQ ID NO: 244325 - RNA, 64 nt, Human; identical to SEQ ID NO: 142959

SEQ ID NO: 244326 - RNA, 64 nt, Human
agcggagccaggcgcuuagaggaagaccaaaugcugccaggacacggauuguccagggauuaca

SEQ ID NO: 244327 - RNA, 64 nt, Human
ggcuugaccagucacguugggagaagagagagagugccaggagacccugagggcagccgguucc

SEQ ID NO: 244328 - RNA, 64 nt, Human
ggggccgccuacuccugcaaaugcuugugacagaugccaggagguagaugugugcuggccaaua

SEQ ID NO: 244329 - RNA, 64 nt, Human
ccucgucuccccuuacuccacagggagccucccuugccaggaccagggcugcgacggccaugcu

SEQ ID NO: 244330 - RNA, 64 nt, Human
ugccacccuaggcagggaaagcugucaagacuccugccaggaauggggggugcugagucaucuc

SEQ ID NO: 244331 - RNA, 64 nt, Human
cccugggccuugggcuccgugugggagaccggccugccaggaggacccagggcucuguaaguag

SEQ ID NO: 244332 - RNA, 64 nt, Human
ccaagaagccccugcuggaggacgacccucagggugccaggaagaucucgucggagccuguucc

SEQ ID NO: 244333 - RNA, 64 nt, Human
guccuguugagaauuuuuagaucuggacuggaacugccaggaccaccgccuccagggagucgcu

SEQ ID NO: 244334 - RNA, 64 nt, Human
ggggucuccucacaguugcuucucagcucagcugugccaggaucuuguugagucaggucagcug

SEQ ID NO: 244335 - RNA, 64 nt, Human
ccuuaacuucauauugugagacugcucggucaagugccaggagauugugauugggagaggguaa

SEQ ID NO: 244336 - RNA, 64 nt, Human
cauggccagaugacggaaacagggucugaccaagugccaggaagaccugugcuauaaaccaccc

SEQ ID NO: 244337 - RNA, 64 nt, Human
ccacugcccacaagagccucugccgggggugggaugccaggacacccccucccacacucaggac

SEQ ID NO: 244338 - RNA, 50 nt, Human
caaaggaagaaggagcuuaaugccaggaacagauuuugcaguuggugggg

SEQ ID NO: 244339 - RNA, 64 nt, Human
gugccaugagggcagaggugcuaccuggccuuccugccaggagcucuccacccacucacauucc

SEQ ID NO: 244340 - RNA, 64 nt, Human; identical to SEQ ID NO: 142962

SEQ ID NO: 244341 - RNA, 64 nt, Human; identical to SEQ ID NO: 142963

SEQ ID NO: 244342 - RNA, 64 nt, Human; identical to SEQ ID NO: 142964

SEQ ID NO: 244343 - RNA, 64 nt, Human
uuggaucauaggagagcacuugcucuccugccucugccaggagagggcuuguuccuccaacucu

SEQ ID NO: 244344 - RNA, 64 nt, Human
guuuucgaauuaggaguagagagaucugaccucuugccaggaaugcccauggaucaugugauug

SEQ ID NO: 244345 - RNA, 64 nt, Human
gccucagguggcagauguuugaggaaaggaauuaugccaggaaggugggaccggguuauggucg

SEQ ID NO: 244346 - RNA, 64 nt, Human
aaucaggagcagcgggcucacccaggcaccugucugccaggaggccacguguguccugcccacc

SEQ ID NO: 244347 - RNA, 64 nt, Human
gggaagggucagggcuucuguggaacuuggaacgugccaggaccaccugcaaaagccagggugc

SEQ ID NO: 244348 - RNA, 64 nt, Human
ucccaucccacucggugcuguuggguaggggcccugccaggaacugaccagcucagcgaggagc

SEQ ID NO: 244349 - RNA, 64 nt, Human
gucucagggaagccuugaaaaccacggagguggaugccaggaaagggcccauguggcagaaggc

SEQ ID NO: 244350 - RNA, 64 nt, Human
gucuguauuucccggcagaguauacgcccuugaaugccaggaacuuguuuccuuagucuuuuuu

SEQ ID NO: 244351 - RNA, 64 nt, Human
aaucuuugugcagccugaaggaucaguguaguaaugccaggaaagugcuuuuuaccuaagacuu

SEQ ID NO: 244352 - RNA, 64 nt, Human
augucaagauucagcuaguggccaagagaugcagugccaggaacccuuaaacaguugcacagca

SEQ ID NO: 244353 - RNA, 64 nt, Human
aggauauuauaaguaugcugauggaaaucuauauugccaggaaaagcuauucauuaugcguugu

SEQ ID NO: 244354 - RNA, 64 nt, Human
cuaagucugaggaagggagaagggggcagcugucugccaggagucuggcucuuuugcucauagc

SEQ ID NO: 244355 - RNA, 64 nt, Human
ggcugcagcaggaguaggagcagaugaggcgucuugccaggaaccucaggaggagggggcccgg

SEQ ID NO: 244356 - RNA, 64 nt, Human
uauccaacaugccaaaaaugcucaugccaguuaaugccaggaaaaaaaucaccgacacacuacu

SEQ ID NO: 244357 - RNA, 64 nt, Human
cgugguggagaacacaccuguggcuaucuuaugugaggacuagaggugaagaggagauggacac

SEQ ID NO: 244358 - RNA, 64 nt, Human
cuuuuuggaugggaccagaacuuaacauuuuccugaggacuaggaagcucaucagacacuggaa

SEQ ID NO: 244359 - RNA, 64 nt, Human
uguuguuuaacuugauguugaccuuuuggauuaagaggacuaucagauuaaagcaaaauguaau

SEQ ID NO: 244360 - RNA, 64 nt, Human
uuugaugccccaaaauaaagugagaaugguaauuugccaggaauucuucauaacaguaucuuac

SEQ ID NO: 244361 - RNA, 64 nt, Human
ggugauacauuuaccaguguucuuguuuguguggugccaggaaauugauuuuggaaaaagugaa

SEQ ID NO: 244362 - RNA, 59 nt, Human
ggagaagcacggccagcuagcacggccagugccaggaccgggccgagggaggccagacc

SEQ ID NO: 244363 - RNA, 64 nt, Human
gcaugggagaugccuguguaauuucguccgaagcugccaggaagaagaacagaacuuugugugu

SEQ ID NO: 244364 - RNA, 64 nt, Human
caguauuugcaaccaagguggucgggcaaaguauugccaggagauacugaaaaucauccagaag

SEQ ID NO: 244365 - RNA, 64 nt, Human; identical to SEQ ID NO: 142941

SEQ ID NO: 244366 - RNA, 64 nt, Human; identical to SEQ ID NO: 142942

SEQ ID NO: 244367 - RNA, 64 nt, Human; identical to SEQ ID NO: 142943

SEQ ID NO: 244368 - RNA, 64 nt, Human; identical to SEQ ID NO: 142944

SEQ ID NO: 244369 - RNA, 64 nt, Human; identical to SEQ ID NO: 142945

SEQ ID NO: 244370 - RNA, 64 nt, Human; identical to SEQ ID NO: 142946

SEQ ID NO: 244371 - RNA, 64 nt, Human; identical to SEQ ID NO: 142947

SEQ ID NO: 244372 - RNA, 64 nt, Human; identical to SEQ ID NO: 142948

SEQ ID NO: 244373 - RNA, 64 nt, Human; identical to SEQ ID NO: 142949

SEQ ID NO: 244374 - RNA, 62 nt, Human
cuuggaguuuggaacucuacccugguaggaaagcaccgcagcauguggggaagcaagacguc

SEQ ID NO: 244375 - RNA, 62 nt, Human
ggggcgacggcugccccggacgacugcgcugggcaccgcaugucccgggccgagugaggucg

SEQ ID NO: 244376 - RNA, 62 nt, Human
cucccuuccacaccugcccaccucaccucacugcaccgcaccgcaccagagccagagcagcu

SEQ ID NO: 244377 - RNA, 62 nt, Human
uuccacaccugcccaccucaccucacugcaccgcaccgcaccagagccagagcagcugcuug

SEQ ID NO: 244378 - RNA, 62 nt, Human
gauccugaucccucuugcuucuuuucccuccugcaccgcagcuugccaucccugcccuucug

SEQ ID NO: 244379 - RNA, 51 nt, Human
auaccuauuguucuauauaaagcaccgcaacugagaacagagcaauggcag

SEQ ID NO: 244380 - RNA, 62 nt, Human
aagcugccaccuaacaggagucacccaggaaagcaccgcacaggcuggcgcgggacagacuc

SEQ ID NO: 244381 - RNA, 62 nt, Human
agcuugcauccuugaggcucagggaugagagggcaccgcaaggcacccagccuuaccccaca

SEQ ID NO: 244382 - RNA, 62 nt, Human
cccaugcaagcagaggaccagggccuuuucuggcaccgcaguuuuguuuuaaaacuggaccu

SEQ ID NO: 244383 - RNA, 62 nt, Human
cacgcugcuggcgcucaugggcccugguguuugcaccgcacuuuguaaucagucccgugguu

SEQ ID NO: 244384 - RNA, 62 nt, Human
ccuggcccagagcuggaguggcuggauguggagcaccgcaccguggcuggaguccugagcag

SEQ ID NO: 244385 - RNA, 62 nt, Human
gccuccaugugcgcgcgcguguggagcugugugcaccgcaugugugcuuuccacaggggcgu

SEQ ID NO: 244386 - RNA, 62 nt, Human
ggaaggacacucuuggcucguuugggcucaaggcaccgcagccugucagccaacauugccuu

SEQ ID NO: 244387 - RNA, 62 nt, Human
gugauuuugugaggcuugucccuauguaggaugcaccgcaggccccuggccacugaaagagu

SEQ ID NO: 244388 - RNA, 62 nt, Human
uuguguucugaucacuggucugugcccucacagcaccgcacaucgacacacuguacuuauuu

SEQ ID NO: 244389 - RNA, 62 nt, Human
aucuggagcaccaaggacuuccugcagcgagagcaccgcagcaugagagccaacguggagcu

SEQ ID NO: 244390 - RNA, 62 nt, Human
ccacaguggugacggcaggauggcccugcucagcaccgcaagagccauggcugucccuguug

SEQ ID NO: 244391 - RNA, 62 nt, Human
uccaccccgucccccacggugggcacugcccagcaccgcaugccacguguccggaauaaauu

SEQ ID NO: 244392 - RNA, 62 nt, Human
gacucgcacacacucgugucauccagaugugagcaccgcacccagcggcaaagagcccuccc

SEQ ID NO: 244393 - RNA, 62 nt, Human
agucugguuuugagagcaggggcuguucugcagcaccgcagggaagggaggagagauaccug

SEQ ID NO: 244394 - RNA, 64 nt, Human
cccuggucccucguccacaggggcaggccugggacccagcuacucuguccaggccacuguggcc

SEQ ID NO: 244395 - RNA, 64 nt, Human
aaauuagccaggcaucguggugggugccuguaaucccagcuauucaggaggcugaggcaggaga

SEQ ID NO: 244396 - RNA, 64 nt, Human
aaauuagcugggcgugguggugggcaccuguagucccagcuacucgggaggcugaggcaggaga

SEQ ID NO: 244397 - RNA, 64 nt, Human
agaguagcugggacuacaaacgugugucaccaggcccagcuaauuuuuguauuuuuaauaaaga

SEQ ID NO: 244398 - RNA, 64 nt, Human
aaauuagccuggcguaauggcaggcgccuauaaucccagcuacucaggaggcugaagcagaaga

SEQ ID NO: 244399 - RNA, 64 nt, Human
aaauuagccgggcaugguggcacacgccuguagucccagcuacucaggaggcugaggcaggaga

SEQ ID NO: 244400 - RNA, 64 nt, Human
uguguagcugggcgugguggugggugccuguaaucccagcuacucgagaggccaaggcaggaga

SEQ ID NO: 244401 - RNA, 64 nt, Human
ugaguagcugggauuauaggcgugcaccaccaugcccagcuaauuuuuguauuuuuaguagaga

SEQ ID NO: 244402 - RNA, 64 nt, Human
cgaguagcugggacugcaggcacacacugccacgcccagcuaauuuuuugcauuuuaguagaga

SEQ ID NO: 244403 - RNA, 64 nt, Human
aaaaaaaaaaaggcaugguggcacgcacuguagucccagcuacucaggagacugaggcuagaag

SEQ ID NO: 244404 - RNA, 64 nt, Human
guuggagcugggugcaguggcuugugccuguagucccagcuacuugggaggcugaggcaggagg

SEQ ID NO: 244405 - RNA, 64 nt, Human
aaauuagccgggcgugguggcgugugccuguagucccagcuacuugcgaggcugaggcaggaga

SEQ ID NO: 244406 - RNA, 64 nt, Human
agauuaccugggcaugguggugcaugccuauaaucccagcuacucaggaggcugaggcagaauu

SEQ ID NO: 244407 - RNA, 64 nt, Human
ugggacaugggcaccucgggaggcccgggcccugcccagcuacaguuccaccccucagcuugag

SEQ ID NO: 244408 - RNA, 64 nt, Human
cgccccaacacuguccuucccugccacuucaacccccagcuaauaaaccagauuccagaguacu

SEQ ID NO: 244409 - RNA, 64 nt, Human
aaauuagcuggcugugguggugggcaccuguaaucccagcuacucgggaggcugaggcaggaga

SEQ ID NO: 244410 - RNA, 64 nt, Human
agacuaagcccugucgagacacuugccuucuucacccagcuaaucuguagggcuggaccuaugu

SEQ ID NO: 244411 - RNA, 64 nt, Human
aucagagggguucauuauaccccuggcuagagaacccagcuacugacaugcaagcagcuugggg

SEQ ID NO: 244412 - RNA, 64 nt, Human
uaaagugcugggauuacaggcgugagccacugcgcccagcuauacuguauauuuuaagaaguuc

SEQ ID NO: 244413 - RNA, 64 nt, Human
caauuagcugggcaugguggccggcgccuguaaucccagcuacuagggaggcugagacacacga

SEQ ID NO: 244414 - RNA, 64 nt, Human
ugaguagcugggauuacaggcacccaccacuaugcccagcuaauuuuuuuauuuuuaguagaga

SEQ ID NO: 244415 - RNA, 64 nt, Human
accugaugcuauggucagguuauacuccuccucccccagcuaucuauauggaauugcuuaccaa

SEQ ID NO: 244416 - RNA, 64 nt, Human
aaauuagucgggcgugauggcaggcaucuguagucccagcuacuugggaagcugaagugggagg

SEQ ID NO: 244417 - RNA, 64 nt, Human
aaauuagccgggcaugguggcacgcgccuguagucccagcuacacgggaggcugaggcaggaga

SEQ ID NO: 244418 - RNA, 64 nt, Human
aaauuagccaggcgugguggcgggcuccuguaaucccagcuacuuuggaggcgaggcacgagaa

SEQ ID NO: 244419 - RNA, 64 nt, Human
caaaaagccaagugugguggugugcaccuauagucccagcuacucaggaagcugagacaagagg

SEQ ID NO: 244420 - RNA, 64 nt, Human
aaauuaccugggccugguggcacacgccuguagucccagcuacuugggaggcugaggcaggaga

SEQ ID NO: 244421 - RNA, 64 nt, Human
uuuaauuagcugugcgcaauugcucaugcauagucccagcuacccaggaggcugaggugggagg

SEQ ID NO: 244422 - RNA, 64 nt, Human
aaauuagcugggcaugguggcaugugccuauagucccagcuacucaggaggcugaggcaggaga

SEQ ID NO: 244423 - RNA, 64 nt, Human
caaguagcugggacuacaggcacacgccaccacacccagcuaauuuuuuguauuuuuaguagag

SEQ ID NO: 244424 - RNA, 64 nt, Human
aaauuagccaggcgugguggcacacgccuguaaacccagcuacuugggaggcugaggcaggaga

SEQ ID NO: 244425 - RNA, 64 nt, Human
gagaaacauacucucccuggcguccucccuucgccccagcuagcuugagcuucugcccuaugac

SEQ ID NO: 244426 - RNA, 64 nt, Human
ugggauuacagguucccccccaccuucccccacacccagcuaauuuuuguguuuuuaguagaga

SEQ ID NO: 244427 - RNA, 64 nt, Human
cauaugagaagaagguaaauggaagccuccuagccccagcuagaaguauuguuucugccugugg

SEQ ID NO: 244428 - RNA, 64 nt, Human
cgaguagcuggaauuauaggcgugcaccaccacgcccagcuaauuuuuguauuuuuaguaaaga

SEQ ID NO: 244429 - RNA, 64 nt, Human
aaauuagccgagcacgguggugcaugccuguaaucccagcuacuugggaggcugaggcacgaga

SEQ ID NO: 244430 - RNA, 64 nt, Human
aaauuauccaggcaugguggcguacgccuguagucccagcuacucaggaggcugaggcaggaga

SEQ ID NO: 244431 - RNA, 64 nt, Human
gaauuagucaggcgugguggugggcgccuguaaucccagcuacucaggaggcugaggcaggaga

SEQ ID NO: 244432 - RNA, 64 nt, Human
ucaugugaaacacaacacguuuuccucucugagucccagcuauggggaacaucuggagucagca

SEQ ID NO: 244433 - RNA, 64 nt, Human
aaauuagccaggcgugguggugcaccccuaaaaucccagcuacuugagagacugaggcaggaga

SEQ ID NO: 244434 - RNA, 64 nt, Human
aaauuagccaggugugguggcacacaucuguagucccagcuacucuggaggcugagacaggaga

SEQ ID NO: 244435 - RNA, 64 nt, Human
cucuaccagguggcccagcuccauacucuguccccccagcuaauacccagagcacccagaucag

SEQ ID NO: 244436 - RNA, 64 nt, Human
ucacccuuuuuugugauuugcaaugaugugcuugcccagcuaacuuuugaauugcacuuuuuaa

SEQ ID NO: 244437 - RNA, 64 nt, Human
caguuucaccaucuuugaggugaggguggggugccccagcuaggaagcaagaucgcugugcuag

SEQ ID NO: 244438 - RNA, 64 nt, Human
aaauuagcugggcgugguaguacaugccuguaaucccagcuacacuggaggcugagucaggaga

SEQ ID NO: 244439 - RNA, 64 nt, Human
aaauuagccgggcaugcuggcacgcaccaguaaucccagcuacuugggaggcugaggcaggaga

SEQ ID NO: 244440 - RNA, 64 nt, Human
aaauuagcugggcgugguggcgggcaccuguaaucccagcuacuugggagacugaggcaggaga

SEQ ID NO: 244441 - RNA, 64 nt, Human
aaauuagccaggcgugauggcacgugucuguaaucccagcuacucuggagacugaggugggaga

SEQ ID NO: 244442 - RNA, 64 nt, Human
aaauuagccgggcaugguggcgcgcaccuguaaucccagcuacuugggaggcugaggcaagaga

SEQ ID NO: 244443 - RNA, 56 nt, Human
acaucaauguuccugccugacaacuccccagcuaucccccaaccccaggcucggac

SEQ ID NO: 244444 - RNA, 64 nt, Human
aaauuagccaagcaugguggcaggcgccuguagucccagcuacuugggaggcugaggcaggaga

SEQ ID NO: 244445 - RNA, 64 nt, Human
caaguagcugggauuacaggcaugcaccaccaugcccagcuaauuuuuguauuuuuaguagaga

SEQ ID NO: 244446 - RNA, 64 nt, Human
cgaguagcugggauuacaggcaugcgucaccacucccagcuaauuuuguauuuucaguagagac

SEQ ID NO: 244447 - RNA, 64 nt, Human
aaauuaacugggcauccugucaugcgccugucaucccagcuacuugagaggcugaagcagaaga

SEQ ID NO: 244448 - RNA, 64 nt, Human
cauguagcaggaaccacaggcaggcaccaccauacccagcuaauuuuuguauuuuuuguagaga

SEQ ID NO: 244449 - RNA, 64 nt, Human
ugaguagcugggaucauaggcacgcgccaccacacccagcuaauuuuuuguauuuuuaguaaag

SEQ ID NO: 244450 - RNA, 64 nt, Human
caaguagcugggauuacaggcacccaccaccucacccagcuaauuuuuguauuuucaguagaga

SEQ ID NO: 244451 - RNA, 64 nt, Human
cgaguagcugggauuaugggcgcccaccaccaugcccagcuaauuuuuguauuuuuuuuuuuua

SEQ ID NO: 244452 - RNA, 64 nt, Human
aaauuagcugggcguggcggugcgcaacuguagucccagcuacucgggaggcugaggcaggaga

SEQ ID NO: 244453 - RNA, 64 nt, Human
ucuacccuugguaccacaacucuguaugggguugcccagcuacucuuccuuucaguugcagucc

SEQ ID NO: 244454 - RNA, 64 nt, Human
ccgaguagcugggauuacaggcaugcgccacuaccccagcuaauuuuguauuuuuaguagagau

SEQ ID NO: 244455 - RNA, 64 nt, Human
cgaguagcugggauuacaggcaccugccaccacgcccagcuaauuuuuguauuuuuaguaaaga

SEQ ID NO: 244456 - RNA, 64 nt, Human
aaacuagccggguauggugguacaugccuguaaucccagcuacucaggaggcugagacaggaga

SEQ ID NO: 244457 - RNA, 64 nt, Human
aaauuagcugggugugguagcacgcaccuguagucccagcuacuugggaggcugaagcaggaga

SEQ ID NO: 244458 - RNA, 64 nt, Human
aaauuggcuggacaugguggcgcaugucuguaaucccagcuacuguaaucucagcuacuuggga

SEQ ID NO: 244459 - RNA, 64 nt, Human
aaauuagccaggcaugguggcgugugccaguaaucccagcuacuugggaggcugaggcgcgaga

SEQ ID NO: 244460 - RNA, 64 nt, Human
aauaaaaagccagacuggugguauguaucugugucccagcuaauugggagggugaguugggagg

SEQ ID NO: 244461 - RNA, 64 nt, Human
uaauuaguugggcguaguggugcaugccuguaaucccagcuacucuggagacagguggagggga

SEQ ID NO: 244462 - RNA, 64 nt, Human
aauuagccgggcgugguggcagaucccuuguagucccagcuacucgggaggcugaggcaggaga

SEQ ID NO: 244463 - RNA, 64 nt, Human
agaauuagccaggcaugguggcacaugccuguaacccagcuacucgggaggcugaagcaggaga

SEQ ID NO: 244464 - RNA, 64 nt, Human
aaaugagcuaggcaugguggcacacgccuguaaucccagcuacaccugaggcugaggcaggaga

SEQ ID NO: 244465 - RNA, 64 nt, Human
aaauuagccgagcgugguggugcgugccuguagucccagcuacuuaggaggcugaggcaugaga

SEQ ID NO: 244466 - RNA, 64 nt, Human
aaauuagcugggcgugguggcauguggcuguagucccagcuacucgggaggcugaggcacgaga

SEQ ID NO: 244467 - RNA, 64 nt, Human
aaauuagccaagcauaguggcacaccccuguagucccagcuacuugggaggcugaggugggagg

SEQ ID NO: 244468 - RNA, 64 nt, Human
ugccucagccucccgaguggcuggcaucaccacgcccagcuaauuuuuguauuuuuaguagaga

SEQ ID NO: 244469 - RNA, 64 nt, Human
ccagacucucaucuugaugucuugauggauggaccccagcuagucagacaugauccuccagauu

SEQ ID NO: 244470 - RNA, 64 nt, Human
aaauuagcugggcgugguggcaggcgccuguggucccagcuacucgggaggcugaggcaggaga

SEQ ID NO: 244471 - RNA, 64 nt, Human
cauauagcuggaacuacaguugugcacuaccacacccagcuaauuuuuugauuucuuguggaga

SEQ ID NO: 244472 - RNA, 64 nt, Human
aaauuggcuggguguggugucacaugccaguaaccccagcuacuagggaggcugaggcaggaga

SEQ ID NO: 244473 - RNA, 64 nt, Human
cauauagcugggauuauaggugccugccaccaugcccagcuaauuuuuguguuuuuaguagaga

SEQ ID NO: 244474 - RNA, 64 nt, Human
aaauuagccagguguggcggcgagcaccuguaaucccagcuacucgggaggcugagacaggaga

SEQ ID NO: 244475 - RNA, 64 nt, Human
aaauuaacugagcgugguggugggcgccuguagucccagcuacucaggaggcuaaggcaggaga

SEQ ID NO: 244476 - RNA, 64 nt, Human
aaauuagccaggcgugguggcuggcgccuguaaucccagcuacucaggagguugaggcagcaga

SEQ ID NO: 244477 - RNA, 64 nt, Human
aaaauagcuugguaugguggcacaugccuguaaucccagcuacuuuggaggcucaggcacaaga

SEQ ID NO: 244478 - RNA, 64 nt, Human
uuauucagccccgggaguggcgcgcgccaccacgcccagcuaauuuguguauuuucagcagaga

SEQ ID NO: 244479 - RNA, 64 nt, Human
ccaaguagcugggauuacagugccugccaccaugcccagcuaauuuuuugcauuuuuaguagag

SEQ ID NO: 244480 - RNA, 64 nt, Human
acacggugaaaccccuuaucuaugcgccuguagucccagcuacccaggaggcugaagcaggaua

SEQ ID NO: 244481 - RNA, 64 nt, Human
aaauuagcugggugugguggugcacuccuguaaucccagcuacucagaaggcugagguacaaga

SEQ ID NO: 244482 - RNA, 64 nt, Human
ugggauuacaggcgugagccaccgcgccuggccacccagcuaaguuuguauuuuuguuggagac

SEQ ID NO: 244483 - RNA, 64 nt, Human
cgagcagcugggauuauaggcguccaccaccacgcccagcuaauuuuuguauuuuuaguagaaa

SEQ ID NO: 244484 - RNA, 64 nt, Human
aaauuagacgggcaugguggcgcacaccuguaaucccagcuacuugggaggcugaggcaggaga

SEQ ID NO: 244485 - RNA, 64 nt, Human
aaauuagccgggcaugauggugguggccuguaaucccagcuacuugggaggcugagacaggaga

SEQ ID NO: 244486 - RNA, 64 nt, Human
ggaggagccagcugcaguaguauccgccuguagucccagcuacucaggaggcugagacaggagg

SEQ ID NO: 244487 - RNA, 64 nt, Human
ugaguagcugggauuacacgcacaugccaccacacccagcuaauuuuugcauuuuuaguagaga

SEQ ID NO: 244488 - RNA, 64 nt, Human
aaauuagccgggcauggugacgugcaccuguagucccagcuacuagauaggcugaggcaggaga

SEQ ID NO: 244489 - RNA, 64 nt, Human
aaauuagccaggcaugguggcgggcgccuguagucccagcuacuuggaaggcugagacaggaga

SEQ ID NO: 244490 - RNA, 64 nt, Human
aaauuagcugggcgugguagugcgugccuguaaucccagcuacuugggaggcugagguagaaga

SEQ ID NO: 244491 - RNA, 64 nt, Human
uuaguagcugggaccacagacaucugucaccacacccagcuaacuuuuuguauuuuugguagag

SEQ ID NO: 244492 - RNA, 64 nt, Human
aaauuagcugggcaucauggcacacaccuguagucccagcuacuuaggaggcugagaugggagg

SEQ ID NO: 244493 - RNA, 64 nt, Human
agaauacccaggugugguagugcaugccuguagucccagcuacuuuggagacugaggugggagu

SEQ ID NO: 244494 - RNA, 64 nt, Human
aaauuaguugggugugguggcgggugccuguaaucccagcuacucaggaggcugaggcaggaga

SEQ ID NO: 244495 - RNA, 64 nt, Human
aaauuagccagguguggagguacaugccuguaaucccagcuacucaggaggcugaggcagaaga

SEQ ID NO: 244496 - RNA, 64 nt, Human
aaauuagccaggcgugguggcacgugccuguagucccagcuacuccggaggcugaggcaggaga

SEQ ID NO: 244497 - RNA, 64 nt, Human
aaauuagccggucaugguggugcaugucugcaaacccagcuacucgggaggcugaagcaggaga

SEQ ID NO: 244498 - RNA, 64 nt, Human
aaauuagccgggcgugauggugggcaccucuaaucccagcuacuugggaggcugagggcaggag

SEQ ID NO: 244499 - RNA, 64 nt, Human
aaauuagccaggcaugguggugugggccugcagucccagcuaccugggaggcugagucaggaaa

SEQ ID NO: 244500 - RNA, 64 nt, Human
aaauuagccgggcaugguggcaggugccuguaaucccagcuacucagggggcugaggcagggga

SEQ ID NO: 244501 - RNA, 64 nt, Human
aaauuagccgggagugguggugcgugccuguagucccagcuacuugggaggcugaggcaggaga

SEQ ID NO: 244502 - RNA, 64 nt, Human
aaauaucucacuucucccaaauaguauguggacucccagcuaagcagaaaacuauugucauuca

SEQ ID NO: 244503 - RNA, 64 nt, Human
cgaguagcugggacuacaggugagccccagcaugcccagcuaauuuuuuuuaauuuuuaguaga

SEQ ID NO: 244504 - RNA, 64 nt, Human
ugaguagcugggaccacaggcgacugccaccacacccagcuaauuuuuuguauuuuuaguagag

SEQ ID NO: 244505 - RNA, 64 nt, Human
cauuccccauucauggcacagagcaguggcagggcccagcuagcaggcucuucuggccuccuug

SEQ ID NO: 244506 - RNA, 64 nt, Human
uaggauggaguuccuuuucuuucuguuguuguuucccagcuacaaccaacuaaagacacaaaug

SEQ ID NO: 244507 - RNA, 64 nt, Human
ccacaggucccuccacucauauggccucucccuccccagcuaguggaggggaagcagucuggac

SEQ ID NO: 244508 - RNA, 64 nt, Human
aaauuagcugggcaugguggcgcauaccuguaaucccagcuacuugggaggcugaggcaagaga

SEQ ID NO: 244509 - RNA, 64 nt, Human
aaauuagccaggcaugguggcgcaugccuguaaucccagcuacuagagaggcugaggcaggaga

SEQ ID NO: 244510 - RNA, 64 nt, Human
cgaauagcugggauuacaggcacgccucaccacgcccagcuaauuucuguauuuuuagaagaga

SEQ ID NO: 244511 - RNA, 64 nt, Human
ugccucagccuccugaguagugugugccaccacgcccagcuaauuuuuuaauuuuuaguagaga

SEQ ID NO: 244512 - RNA, 64 nt, Human
uuuuucuaauagucucaugucuuuuaaucuuaaccccagcuaaaugacucugaggaccaacagu

SEQ ID NO: 244513 - RNA, 64 nt, Human
aaauuauccgggcaugggggcacacaccgguaaucccagcuacucaggaggcugagacaggaga

SEQ ID NO: 244514 - RNA, 64 nt, Human
caaguaacugggauuacaggcaugugucaccaugcccagcuaauuuuuuuguauuuuuaguaga

SEQ ID NO: 244515 - RNA, 64 nt, Human
aaauuagccgggugugguggcacacaccaguaaucccagcuacucaggaggcugaagcaggaga

SEQ ID NO: 244516 - RNA, 64 nt, Human
gcugcacuggccucuaggacucacagcagccagccccagcuaggaacgggcaggacuuggggca

SEQ ID NO: 244517 - RNA, 64 nt, Human
acaaucccuuucagaaaacauuaguggccgcugccccagcuacagagacggccgaaaugcuuuc

SEQ ID NO: 244518 - RNA, 64 nt, Human
aaauuagccggguguggugucgggcaccuguagucccagcuacucaggaggcugaggcaggaga

SEQ ID NO: 244519 - RNA, 64 nt, Human
ucuuuugaccaagaccucaagagagccagaacuacccagcuaagccuuuuacuaaauuucugaa

SEQ ID NO: 244520 - RNA, 64 nt, Human
cgaguagcugggauuacaggcaugcuccaccaugcccagcuaauuuuguauuuuuaguagaaac

SEQ ID NO: 244521 - RNA, 64 nt, Human
aaaaaagccaggcaugguggcacacaccuguaaucccagcuacucgggaggcugaggaaggaga

SEQ ID NO: 244522 - RNA, 64 nt, Human
aaauuagcugggcaugguggcacacaccuguagucccagcuacuugggaggcugaggcaggaga

SEQ ID NO: 244523 - RNA, 64 nt, Human
aaauuagcugggcaugacggccagagcccauggucccagcuacucgagaggcugagguaagagc

SEQ ID NO: 244524 - RNA, 64 nt, Human
caaguagcugggacuacagguguacgccaccacacccagcuaauuuuuguauuuuuaguaggga

SEQ ID NO: 244525 - RNA, 64 nt, Human
cgaguagcugggauuacaggcaugcgcuaacacacccagcuaauuuuguauuuuuaguagagac

SEQ ID NO: 244526 - RNA, 64 nt, Human
aagguauuggcuguucuauagaugcagugauugucccagcuagcucuguuaccagccuuuuggu

SEQ ID NO: 244527 - RNA, 64 nt, Human
caaguagcugggauuguaagaguaugccaccacgcccagcuacuuuuuguauuuuuaguagaga

SEQ ID NO: 244528 - RNA, 64 nt, Human
uguauguguguuccuugaagccaggugcagaguucccagcuacugcagcuugggauuugguggg

SEQ ID NO: 244529 - RNA, 64 nt, Human
aaauuagcugggcaugguggcacauaccuguaaucccagcuacucgggaggcugaaacaggaga

SEQ ID NO: 244530 - RNA, 64 nt, Human
caaguagcugggacuacaggcguucacuacuacacccagcuaauuuuuaaguuuuuuauagaga

SEQ ID NO: 244531 - RNA, 64 nt, Human
caaguagcuggaacuacaggcucaugccacugcgcccagcuaauuuuuguauuuuucguagaga

SEQ ID NO: 244532 - RNA, 64 nt, Human
aaguuagcuggggcugguggugggcaucuguagucccagcuaauuggaagggugaggcgggagg

SEQ ID NO: 244533 - RNA, 64 nt, Human
ugaguagcugagaccacaggcacccgccaccacacccagcuauuuuuuuguauuuuuaguagag

SEQ ID NO: 244534 - RNA, 64 nt, Human
ugaguagcugauacuacaggcacccaccaccacgcccagcuaauuuuuuuguauuuuuaguaga

SEQ ID NO: 244535 - RNA, 64 nt, Human
aaauuagaugggugugguguuucgcgucuguagucccagcuauuugggaagcugaggugggagg

SEQ ID NO: 244536 - RNA, 64 nt, Human
caauuuagaaucacuuuuccucuguccccuucuccccagcuaagaauguguggcaccuccauca

SEQ ID NO: 244537 - RNA, 64 nt, Human
aaauuagcugggcaugguggcgugcgccuguagucccagcuacuugggaggcugaggcaggaga

SEQ ID NO: 244538 - RNA, 64 nt, Human
ccaguagcugggauuacaggcaccuaccaccuugcccagcuaauuuaguuuccugguaaacaca

SEQ ID NO: 244539 - RNA, 64 nt, Human
caaauagcugggaucacuggcacaaaccaccaugcccagcuaauuuuguauuuuuuguagagac

SEQ ID NO: 244540 - RNA, 64 nt, Human
aaaaaauuagccgggcguggugggcacccguaaucccagcuacucaggaggcugaggcaggaga

SEQ ID NO: 244541 - RNA, 64 nt, Human
aaauuagccaggugugguggcaugugccuguggucccagcuacucaggaggcugaggugggaaa

SEQ ID NO: 244542 - RNA, 64 nt, Human
caauuagccaggcaugguggugcaugccuguaaucccagcuacucagaggcugaggcaggagaa

SEQ ID NO: 244543 - RNA, 64 nt, Human
gggcccacuagcagcccccagcaucucccacccacccagcuagggcagaggggucaggaugucu

SEQ ID NO: 244544 - RNA, 64 nt, Human
gcucgaaccacccauuugagaugucacuguggcccccagcuagaggcccagggcugggagcauu

SEQ ID NO: 244545 - RNA, 64 nt, Human
aaauuagcugggcaugauggcaggcaccuguaaucccagcuacucgggaggcugaggcaggaga

SEQ ID NO: 244546 - RNA, 64 nt, Human
aaauuaccugggcauuguggggcacaccuguugucccagcuacucuggaggcugaguccggagg

SEQ ID NO: 244547 - RNA, 64 nt, Human
agucuuuguaagggcucucugugguuugacuuaccccagcuaccguuaaaugaggacaaaucac

SEQ ID NO: 244548 - RNA, 64 nt, Human
cucacuauccuguaagguuauccaaguagcuuagcccagcuaaguucuaucagagacccaaauu

SEQ ID NO: 244549 - RNA, 64 nt, Human
aaggugaaaaugaaguagcugugagaauaccugucccagcuaucaaugagcacaacauuucagu

SEQ ID NO: 244550 - RNA, 64 nt, Human
ccugaguagcuagguacaggcaccugccaccacacccagcuaauuuuuuguauuuuuaguagag

SEQ ID NO: 244551 - RNA, 64 nt, Human
aauuugggcuggugagauuaauuuuuuuuaauaucccagcuagagauauggccuuuaacugacc

SEQ ID NO: 244552 - RNA, 64 nt, Human
aaauuaguuaggugugguggcaugcacuuguagucccagcuacucaagaggcugaggcagaagg

SEQ ID NO: 244553 - RNA, 64 nt, Human
ugaguagcugggacuacaggugccugccaccacacccagcuaauuuuuuuuguauuuuuaguag

SEQ ID NO: 244554 - RNA, 64 nt, Human
ugaguagcugggauuauaggcaugcaccaccacacccagcuauuuuuuguauuuuuacuggaga

SEQ ID NO: 244555 - RNA, 64 nt, Human
aaauuagccgggcgugauggcacaugccuuuagucccagcuacucgggaggcugaggcaugaga

SEQ ID NO: 244556 - RNA, 64 nt, Human
gaguaaacauuuugcuccuaagcugaagggaaugcccagcuauuuaguaagugauaaguuucuu

SEQ ID NO: 244557 - RNA, 64 nt, Human
uuagccaggugugguggcacgcaucuaucagagucccagcuacucaggaggcugaggcaggaga

SEQ ID NO: 244558 - RNA, 64 nt, Human
caaguagcugggacuacaggugcaugccaccacgcccagcuacuuuuuuguguauuuuaguaga

SEQ ID NO: 244559 - RNA, 64 nt, Human
aaauuagcuggguguguuggcacaugccuguagucccagcuacuugagaggcugaggcaagaga

SEQ ID NO: 244560 - RNA, 64 nt, Human
acauuagccgggcgugguggugggugccuguagucccagcuacucuggaggcugaggcaggaga

SEQ ID NO: 244561 - RNA, 64 nt, Human
acauuagccgggcgugguggcacauuccuguaaucccagcuacucgggaggcugaggcaggaga

SEQ ID NO: 244562 - RNA, 64 nt, Human
ucccgggagaggcggugugggggcccgggcccugcccagcuacgcagaaagcagccggagccuc

SEQ ID NO: 244563 - RNA, 64 nt, Human
aaauuagccaggcgugguggcaggcaccuguaaucccagcuacucgggaggcugaggcaggaga

SEQ ID NO: 244564 - RNA, 64 nt, Human
aaauuagcugggugcgguggcaggugccuguaaucccagcuacuugggacacugaggcaggaga

SEQ ID NO: 244565 - RNA, 64 nt, Human
ugaguagcugugacuacaggcaggugccaccaugcccagcuaauuuuuuguauuuucaguagag

SEQ ID NO: 244566 - RNA, 64 nt, Human
cgaguagcuggaauugcagacacccaucaccacgcccagcuaauuuuauguauuuuuaguagag

SEQ ID NO: 244567 - RNA, 64 nt, Human
gcagaagaaauaagugcauucuucugcuuuucaccccagcuaucaauacaugcaucuuuaucag

SEQ ID NO: 244568 - RNA, 64 nt, Human
aaauuagucaggcgugguagugggugccuguaaucccagcuacucgggaggcuaaggcaggaga

SEQ ID NO: 244569 - RNA, 64 nt, Human
aaauuagcugggugugguggcgugugccuguaaucccagcuacuugggaggcugaggcaggaga

SEQ ID NO: 244570 - RNA, 64 nt, Human
uuaacucccucagcuaaaacuggcauuacugacucccagcuauauuucuccagacuugcauuuu

SEQ ID NO: 244571 - RNA, 64 nt, Human
aaaguagccagccgugaugacaggcaccuguaaucccagcuacucgggaggcugaggcaugaga

SEQ ID NO: 244572 - RNA, 64 nt, Human
ugagcagcugggacuacaggcgcaugccaccaugcccagcuaauuuuuguauuuuuaguagagg

SEQ ID NO: 244573 - RNA, 64 nt, Human
aaauuagccaggcgugguggcacgugccuguagucccagcuacuugggaggcuaagucaggaga

SEQ ID NO: 244574 - RNA, 64 nt, Human
uaaugugccaggcgcaaugggauaugccugcaggcccagcuacacgggaggccaaggcaggagg

SEQ ID NO: 244575 - RNA, 64 nt, Human
aaauuagccggacgcaguggcacgcgccuguaaucccagcuacucaagaggcugaggcacgaga

SEQ ID NO: 244576 - RNA, 64 nt, Human
aaauuagcugggcaugguggcaggcgccuguaaucccagcuacucaggaggcugaggcaggaga

SEQ ID NO: 244577 - RNA, 64 nt, Human
agagcaacugggacaacaggcgcccgucaccacgcccagcuaauuuuuuguauuuuuaguagag

SEQ ID NO: 244578 - RNA, 64 nt, Human
uuuuuaacucuuagaagaauucagaggaaauuaacccagcuaaguaaaaaaucugucuugauuu

SEQ ID NO: 244579 - RNA, 64 nt, Human
caaguagcugggacuacaggcaccugccaccaugcccagcuaauuuuuuuuuuuucaguagaga

SEQ ID NO: 244580 - RNA, 64 nt, Human
aaauuagcugggcgugguggccggcgccuguagucccagcuacucaugagguugaggcaggaga

SEQ ID NO: 244581 - RNA, 64 nt, Human
caaguagcugggauuacaggcacccgccaccacgcccagcuaauuuuuguauuuuuguagagau

SEQ ID NO: 244582 - RNA, 64 nt, Human
ugaguagcugggauuauaggcaugcaccaccaugcccagcuaauuuuguauuuuuauuagagac

SEQ ID NO: 244583 - RNA, 64 nt, Human
aaauuagcuggguguggugguguguaccuguagucccagcuacccaggaagcuaaggcaggaga

SEQ ID NO: 244584 - RNA, 64 nt, Human
ugaguagcugggacuacaggcgccugccaccacgcccagcuaauuuuuguauuuuuaguagaga

SEQ ID NO: 244585 - RNA, 64 nt, Human
aacuuagcuaggccugguugcauacgccuguguucccagcuacucaggaggcugaagcaggagg

SEQ ID NO: 244586 - RNA, 64 nt, Human
caugucccucguggcucagggugccccaggccugcccagcuagugcuguccucccaucuccugu

SEQ ID NO: 244587 - RNA, 64 nt, Human
uuuuaauuaauuuauuuauaauuuacuguguguucccagcuaacucuauuuuuuuuuucacuug

SEQ ID NO: 244588 - RNA, 64 nt, Human
uagcugggcgugguggcacaugccaguagguagucccagcuacucgagguugcuccagcucagg

SEQ ID NO: 244589 - RNA, 64 nt, Human
aaauuagcuaggcaugguggcgugcaccuauagucccagcuauucaggaggcugaggugggagg

SEQ ID NO: 244590 - RNA, 64 nt, Human
ugaguagcugggacuacaggugugugccaccaugcccagcuaauuuuuaauuguuuuguagaaa

SEQ ID NO: 244591 - RNA, 64 nt, Human
caaguagcugggacuacaggugcgugccaccacgcccagcuaaauuuuguauuuuuaguggaga

SEQ ID NO: 244592 - RNA, 64 nt, Human
aauuuagcuaggcauggcggcgcaugccugcaaucccagcuacuuggaaggcugaggcaggaga

SEQ ID NO: 244593 - RNA, 64 nt, Human
ugaguagcuaggacuauggguacauuccacagugcccagcuaauuuuuguuuuguuuucuuuuu

SEQ ID NO: 244594 - RNA, 64 nt, Human
caaguagcugggauuacaggcacgugccaccacgcccagcuaauuuuuguauuuuuaguagaga

SEQ ID NO: 244595 - RNA, 64 nt, Human
aaauuagccgggcgugauggcggacgccuguagucccagcuacucgggaggcugagacagaaga

SEQ ID NO: 244596 - RNA, 64 nt, Human
aaauuagcuuggcaugguggcacgugccuguagucccagcuacaugggaggcugaggugggagg

SEQ ID NO: 244597 - RNA, 64 nt, Human; identical to SEQ ID NO: 243435

SEQ ID NO: 244598 - RNA, 64 nt, Human
cgaguagcugggauuacaggcaugcaccaccacacccagcuaauuuuguauuuuuaguagaggc

SEQ ID NO: 244599 - RNA, 64 nt, Human
caagcagcugggauuacaggugcccgccaccacgcccagcuaauuuuugcauuuuuaguagaga

SEQ ID NO: 244600 - RNA, 64 nt, Human
caaguagcugugacuaaaggugcacgccgccaugcccagcuaauuuuuuguauuuuaguagaga

SEQ ID NO: 244601 - RNA, 64 nt, Human
caaguagcugggauuacaggcacccaccaccaugcccagcuaauuuuuuguauuuuuaguagag

SEQ ID NO: 244602 - RNA, 64 nt, Human
aaauuagccaggcauaguggugcaugccuguagucccagcuacuugggaugcugaggcaggaag

SEQ ID NO: 244603 - RNA, 64 nt, Human
ugaguagaugggauuacaggcgccugccaccacgcccagcuaauuuuuuguauucuuaguagag

SEQ ID NO: 244604 - RNA, 64 nt, Human
aaauuagccaggcuugguggcacacgccuguaaucccagcuacucagauggcugaggcaggaga

SEQ ID NO: 244605 - RNA, 64 nt, Human
aaauuagccgggcgugguggcaggcaccuguagucccagcuacucgggaggcugaggcaggaga

SEQ ID NO: 244606 - RNA, 64 nt, Human
aaauuagccgggcaugauggcgggugccuguaaucccagcuacucgggaggcugaggcaggaga

SEQ ID NO: 244607 - RNA, 64 nt, Human
aaauuagcugggcaugguggcgcacaccuguagucccagcuacuccggaggcugaggcaggaga

SEQ ID NO: 244608 - RNA, 64 nt, Human
aaauuagccagaugugguggcgcacaccuguaaucccagcuacucaggaagcugaggcaggaaa

SEQ ID NO: 244609 - RNA, 64 nt, Human
aaauuagccgggcaugguggcaggugccuguagucccagcuacucggcaggcugcagcaggaaa

SEQ ID NO: 244610 - RNA, 64 nt, Human
cuaguagcugggacuacgggugcacgccaccaugcccagcuaauuuuuguauuuugaguagaga

SEQ ID NO: 244611 - RNA, 64 nt, Human
aaauuagccggacgugguggugcgcgcauguaaucccagcuacucgggaggcugaggcggaaga

SEQ ID NO: 244612 - RNA, 64 nt, Human
caaguagcugggauuacaggcaugcaccaccacgcccagcuaauuuuuauauucuuuaguaaag

SEQ ID NO: 244613 - RNA, 64 nt, Human
aaaauuagucggcauggugguggguggcuguaaucccagcuacucaggaggcugaggcagaaga

SEQ ID NO: 244614 - RNA, 64 nt, Human
aaauuagcugggcaugguggugcgugccugaagucccagcuacucgggaagcugaggcagaaga

SEQ ID NO: 244615 - RNA, 64 nt, Human
ugaguagcugggauuauaggcacaugccaccgcgcccagcuaauuuuuguauuuuuaguagaga

SEQ ID NO: 244616 - RNA, 64 nt, Human
aaauuagccaggcaugguggcacaugcuuguaaucccagcuacucgggaggcugaggcaggaga

SEQ ID NO: 244617 - RNA, 64 nt, Human
caaguagcugggacuacaggcaugagccaucacacccagcuaguuuuuuguauuuuuaguaaag

SEQ ID NO: 244618 - RNA, 64 nt, Human
aaauuagccgggugugguggcgggcgccuguagucccagcuacucuggaggcugaggcaggaga

SEQ ID NO: 244619 - RNA, 64 nt, Human
aaauuagcggggcaugguggcacgcgccuguagucccagcuacucaggaggcugaggcaggaga

SEQ ID NO: 244620 - RNA, 64 nt, Human
ugagccccccugaugagcagucagugcuucugggcccagcuaaggaagccaucuguucccagca

SEQ ID NO: 244621 - RNA, 64 nt, Human
aaaugagucggacaugguggugcaugccuguaaucccagcuacuugggaggcugagacaggaga

SEQ ID NO: 244622 - RNA, 64 nt, Human
aaauuagccgggcgugguugcgggcaccuguagucccagcuacucaggaggcugaggcgggaga

SEQ ID NO: 244623 - RNA, 64 nt, Human
aaauuacccgggcaugguggugggcgccuguagucccagcuacucgggaggcugaggcaggaga

SEQ ID NO: 244624 - RNA, 64 nt, Human
aaauuagcugggggugguagcacauaccuguaaucccagcuacucaggaggcugaggcaggaga

SEQ ID NO: 244625 - RNA, 64 nt, Human
aaauuagcugggugugguggugcaugccuguagucccagcuacucgggaggcugaggugggagg

SEQ ID NO: 244626 - RNA, 64 nt, Human
auauuagccgggcgugguggugcaugccuguaaucccagcuacuagggaggcugaggcaggaga

SEQ ID NO: 244627 - RNA, 64 nt, Human
ugucaugggggggaaaaacccaacuuggugaacucccagcuaaacaaccaagacuucacugaag

SEQ ID NO: 244628 - RNA, 64 nt, Human
caaguagcugggauuacgggcgcccaccaccacgcccagcuaauuuuuuuuuuuuuuuucuuga

SEQ ID NO: 244629 - RNA, 64 nt, Human
aaauuagccgggcgugguggcgggcgccugcagucccagcuacucaggaggcugaggcaggaga

SEQ ID NO: 244630 - RNA, 64 nt, Human; identical to SEQ ID NO: 244602

SEQ ID NO: 244631 - RNA, 64 nt, Human
ucaccaauaccuuugaggucccugaguaauccaccccagcuaaaggcaaacccuucaaucaagu

SEQ ID NO: 244632 - RNA, 64 nt, Human
cagccucccaaguagcugggauuacaccaccaugcccagcuacuaaaaauacuuguauuuuuag

SEQ ID NO: 244633 - RNA, 64 nt, Human
caaauagcuggaacuacaggcauauaccgccacacccagcuaauuuuauuuuuugaaaagacaa

SEQ ID NO: 244634 - RNA, 64 nt, Human
caauuuacugggauuacaggcaccugccaccacgcccagcuaauuuuuguauuuuuaguagaga

SEQ ID NO: 244635 - RNA, 64 nt, Human
caaguagcugggauuacaggcaugugccaccaugcccagcuaauuuuguuuuuuuuuuagucga

SEQ ID NO: 244636 - RNA, 64 nt, Human
cgguuagcuggguggaauggcccaugccuguagucccagcuacucaggaggcucagcagcagga

SEQ ID NO: 244637 - RNA, 64 nt, Human
caaguagcugggauuacaagugugcgccaccacacccagcuaauuuuuuauuuuuaguagagau

SEQ ID NO: 244638 - RNA, 64 nt, Human
uaaacacgaacauacagugcacaugaacgcugcucccagcuagggcccucuggucagacugcug

SEQ ID NO: 244639 - RNA, 64 nt, Human
uuugcccuccuugugccccucucagcuuuccauccccagcuaggaagaaagaauggcacucuug

SEQ ID NO: 244640 - RNA, 64 nt, Human
gagccugucagucgccaucauaccucgagugaggcccagcuagauaaugacuuguccaagaugg

SEQ ID NO: 244641 - RNA, 64 nt, Human
ugaguggcugggauuacaggcaugcaccaccaugcccagcuaauuuguuguauuuuuaguagag

SEQ ID NO: 244642 - RNA, 64 nt, Human
aagcuaaaucuaggugagguuuccccuuagggagcccagcuauuuacaaaguacacacgaggga

SEQ ID NO: 244643 - RNA, 64 nt, Human
aaauuagacaggcgugguguugggugccuguaaucccagcuacuggggaggcugaggcgggaga

SEQ ID NO: 244644 - RNA, 64 nt, Human
ucagccuccugaguagcuggugcgcacgaccauacccagcuaauguuuuauuuuuuguagagac

SEQ ID NO: 244645 - RNA, 64 nt, Human
gcacaggaguguccucuucccucucugcagacuucccagcuaggaagagcaggacuccaggccc

SEQ ID NO: 244646 - RNA, 64 nt, Human
gcgaaaacaggagaguuagucgcccuacagaaaacccagcuagacuauuggguaugaacuaaaa

SEQ ID NO: 244647 - RNA, 64 nt, Human
aaauuagccgggcuuuguggcaugugccuguaaucccagcuauuuggcaggcugaggcaugaga

SEQ ID NO: 244648 - RNA, 64 nt, Human
aaauuagucggaugugguggcaggugccuguagucccagcuacucuggaggcugaggcaggaga

SEQ ID NO: 244649 - RNA, 64 nt, Human
aaaauuagccgggcauggugguaggggccuguaacccagcuacucgugaggccaaggcaggaga

SEQ ID NO: 244650 - RNA, 64 nt, Human
aaauuagccgggcauggugacgggcaccuguagucccagcuacucgggaggcugaggcaggaga

SEQ ID NO: 244651 - RNA, 64 nt, Human
ugaguagcuggggcuacaggcgucugccaccaugcccagcuacuuuuuuguauuuuuaguagau

SEQ ID NO: 244652 - RNA, 64 nt, Human
cgaauagcugggauuacagacaggcaccaccacacccagcuaauuuuuguauuuuuuguagaga

SEQ ID NO: 244653 - RNA, 64 nt, Human
caaguagcugggacuacaugcacaugacacuaugcccagcuaauuuuuuauuuuguagauaaua

SEQ ID NO: 244654 - RNA, 64 nt, Human
ucccucuuuggcuccccuguaccuuuugaggagccccagcuacccuuuuucuccagcugggcuc

SEQ ID NO: 244655 - RNA, 64 nt, Human
caaguagcugggacuacaggcauaugccaucacacccagcuaauuuuuguuuuucuguagagac

SEQ ID NO: 244656 - RNA, 64 nt, Human
cauggauccuggaugaaucccaguucuuccccugcccagcuauugggagcuggccuaaguauug

SEQ ID NO: 244657 - RNA, 64 nt, Human
aaaugagcugggugugguggcgcgugccuguagucccagcuacucgagaggcuaaggcaggaaa

SEQ ID NO: 244658 - RNA, 64 nt, Human
aaaauuagccaggcacguuccaggcaccugugaucccagcuacuuagaggcugaggcagaagaa

SEQ ID NO: 244659 - RNA, 64 nt, Human
aaauuauccaggcgugguggugcacgccuguaaucccagcuacucaggaggcuaaggcaggaga

SEQ ID NO: 244660 - RNA, 64 nt, Human
gggaguucccccagaucaguaccccccaccccuccccagcuaguagcaugaccaggagaggguu

SEQ ID NO: 244661 - RNA, 64 nt, Human
ccucuagcugggugugguggcaugcaccuguagucccagcuauuugggaggcugaugcaggaga

SEQ ID NO: 244662 - RNA, 64 nt, Human
ugaguaguugggauuacaggcgcccaccaccaugcccagcuaauuuuuguguuuuuauuggagg

SEQ ID NO: 244663 - RNA, 64 nt, Human
ugaguagcugggacuacaggugugcaccaacaugcccagcuaauuuuuuauauuuuuaguagag

SEQ ID NO: 244664 - RNA, 64 nt, Human
aaauuagccaggcuuaguggcgggcaucuguagucccagcuacucaggaggcugaggcaggaga

SEQ ID NO: 244665 - RNA, 64 nt, Human
aaauuagcugggcauggcagugcgugccugcaaucccagcuacucaggaagcugaggcaggaga

SEQ ID NO: 244666 - RNA, 64 nt, Human
aaauuagccaggugugguaggaugcaccuguaaucccagcuacuuaggaggccgagacaggaga

SEQ ID NO: 244667 - RNA, 64 nt, Human
cgaguagcugggauuauaggcacccaccaccacgcccagcuaauuuuuguauuauuaguagaga

SEQ ID NO: 244668 - RNA, 64 nt, Human
aaaugagcccgguauguuggcauaugccuguaaucccagcuacucgagaggcugagacacgaaa

SEQ ID NO: 244669 - RNA, 64 nt, Human
aaauaacuggcaguaaucaaacgaagacacuguccccagcuaccagcuacgccaaaccucggca

SEQ ID NO: 244670 - RNA, 64 nt, Human
aaauuugccaggcgugguggcgggugccuguaaucccagcuacuugggaggcugaggcaagaga

SEQ ID NO: 244671 - RNA, 64 nt, Human
caaguagcugagacuacaagcacccaccaucacacccagcuaauuuuguauuuuucaguagaga

SEQ ID NO: 244672 - RNA, 64 nt, Human
aaauuagcccggcauguuggugcacgcuuguaaucccagcuacucaggagucugaggcacgaga

SEQ ID NO: 244673 - RNA, 64 nt, Human
aaauuagccaggcgugguggcacgugccuguaaucccagcuacuugggaggcugaggcaggaga

SEQ ID NO: 244674 - RNA, 64 nt, Human
ugaguagcugggauuacaggugugcgccaccacgcccagcuaauuuuuuguauuuuuaguagag

SEQ ID NO: 244675 - RNA, 64 nt, Human
cgaguagcugggauuacaggcacuugccaccauucccagcuaauuuuuguauuuuuaguagaga

SEQ ID NO: 244676 - RNA, 64 nt, Human
ucugacacaggaucagcugcacuuaagaaaucaucccagcuaaguucauuauuccucauggggu

SEQ ID NO: 244677 - RNA, 64 nt, Human
aaauuagccgagagugguggcaugcaccugucaucccagcuacucgggaggcugaggcaggaga

SEQ ID NO: 244678 - RNA, 64 nt, Human
ugaguagcuaggacuacaggcacacacuacugugcccagcuaacuuauuuuuauuuuuuaugga

SEQ ID NO: 244679 - RNA, 64 nt, Human
ccagguuccugggcuucugcugcccccucaggaccccagcuaaccucagaacaacuaacucaug

SEQ ID NO: 244680 - RNA, 64 nt, Human
aaauuagcuggacaugguggcacgugccuguaaucccagcuacucaggaggcugaggcaggaga

SEQ ID NO: 244681 - RNA, 64 nt, Human
aaauuagccgggugugguggcacacgccuguagucccagcuacucgggaggcugaggcagaaga

SEQ ID NO: 244682 - RNA, 64 nt, Human
caaaaaauuagguguaguggcaggcaccuguaaucccagcuacucgggaggcugaggcaggaga

SEQ ID NO: 244683 - RNA, 64 nt, Human
ugaguaacugggacuacaggcgcccgccaccacgcccagcuaauuuuuuguauuuuuaguagag

SEQ ID NO: 244684 - RNA, 64 nt, Human
aaauuagcuggguguggugguacauaccuguagucccagcuacucagaaggcugaggugggagg

SEQ ID NO: 244685 - RNA, 64 nt, Human
cgaguagcugggacuacaggcaccugccaccgcgcccagcuaauuuuuuuguauuuuuaguaga

SEQ ID NO: 244686 - RNA, 64 nt, Human
aaauuagcugggcguggugguguaccccuguaaucccagcuacucgggaggcugagacaggaga

SEQ ID NO: 244687 - RNA, 64 nt, Human
cuaguagcugggacuacagggauguaccaccacacccagcuaaucuucaucuaaucuuaaaacu

SEQ ID NO: 244688 - RNA, 64 nt, Human
acauguaagcugagcacgguggcaugccuauagucccagcuacuugagaggcugaggcaggagg

SEQ ID NO: 244689 - RNA, 64 nt, Human
aaauaaucugggcuuuguagcauaugccuguggucccagcuacugaggaggcugaggugggagg

SEQ ID NO: 244690 - RNA, 64 nt, Human
gcaguacaaauauuaauugaccacuuccuuggcccccagcuacaaugaaaaagaagaauuaugc

SEQ ID NO: 244691 - RNA, 64 nt, Human
aaauuagcuugguguggugcccucugccuauagccccagcuacuugggaggcugaggugggagg

SEQ ID NO: 244692 - RNA, 64 nt, Human
aaauuagccgggcgugguggcacaugccuguaaucccagcuacucaggaggcugaggcggagaa

SEQ ID NO: 244693 - RNA, 64 nt, Human
guugaggucauucagcuuccugaguaccacauuccccagcuacuuagacacggguuaaaauauu

SEQ ID NO: 244694 - RNA, 64 nt, Human
aaauuaaccgggcgugguggcaggcaucuauaaucccagcuacuugggaggcugaggcaggaga

SEQ ID NO: 244695 - RNA, 64 nt, Human
cgaguagcugggauuacaggugcucaccaccacacccagcuaauuuuuguauuuuuaguagaga

SEQ ID NO: 244696 - RNA, 64 nt, Human
ugaguagcuggaacuacaggugugcgccaccacgcccagcuaauuuuuguaauuuuaguagaga

SEQ ID NO: 244697 - RNA, 64 nt, Human
aaauaauagacagcaaucaaacgaagacacuguucccagcuaccagcuaugccaaaccuuggca

SEQ ID NO: 244698 - RNA, 64 nt, Human
cgaguagcugggacuacaggagcucgccaccacacccagcuaauuuuuuuuuuuuuuuuuuuau

SEQ ID NO: 244699 - RNA, 64 nt, Human
ugaguagcugggauaaugggcgugugccaccaugcccagcuaauuuuuguauuuuuaguauaga

SEQ ID NO: 244700 - RNA, 64 nt, Human
aaauuagcugcgugugguggcaggccccuguaaucccagcuaauugggaggcugaagcaggaga

SEQ ID NO: 244701 - RNA, 64 nt, Human
aagaauugaugcgagccaggaacaugucuguagucccagcuacuugggcacacgccuguagucc

SEQ ID NO: 244702 - RNA, 64 nt, Human
caggaugcccaccgcugcuucagcugccuccucgcccagcuacccuuuggccccauugggcccu

SEQ ID NO: 244703 - RNA, 64 nt, Human
gugaaugcuugcaugcauucacacgugugugugucccagcuaguucacuccuuucgccgugcgu

SEQ ID NO: 244704 - RNA, 64 nt, Human
aacuuagcuggcauugguggcgcaugccuauagucccagcuacuugggagguugagguaggagg

SEQ ID NO: 244705 - RNA, 64 nt, Human
aaauuagcugggugugguugcacacgccuguaaucccagcuacucaggaggcugagggaggaga

SEQ ID NO: 244706 - RNA, 64 nt, Human
caauuagcagggcaugguggugcacgucuguagucccagcuacucaggaggcugaggcagaaga

SEQ ID NO: 244707 - RNA, 64 nt, Human
aaauuagcugggcauggcggcaugcgccuguagucccagcuacucccuccagaggcugagaauu

SEQ ID NO: 244708 - RNA, 64 nt, Human
uuagccaggcauaguggcgcaugccuguuguagccccagcuacucaagaggcugaggcaggaga

SEQ ID NO: 244709 - RNA, 64 nt, Human
uuccaggccuggugugguggcucacgccuguagccccagcuauugcaccacugcucuccaagcu

SEQ ID NO: 244710 - RNA, 64 nt, Human
aaauuaguuggguguuauggugcaugccuguaaucccagcuacucgggaggcugaggcaggaga

SEQ ID NO: 244711 - RNA, 64 nt, Human
aaguuagccgggugugguggcacgcgccuguaaucccagcuacucaggaggcugaggcaggaga

SEQ ID NO: 244712 - RNA, 64 nt, Human
aaauuagccgggcaugauggugggcaccuguaaucccagcuacuugggaggcugaggcaggaga

SEQ ID NO: 244713 - RNA, 64 nt, Human
ggugaggccagguacaguggcgcacaccuguaaucccagcuacucugaagccugaggcagaauc

SEQ ID NO: 244714 - RNA, 64 nt, Human
agggcagcccggcgcaggggcaugcgccuagaaucccagcuacucggaaggccaaggcaggagg

SEQ ID NO: 244715 - RNA, 64 nt, Human
aaauuagcugggcaugguggugcaugccuguaaucccagcuacuugggaggccgaggcaggaga

SEQ ID NO: 244716 - RNA, 64 nt, Human
uagccuagcgugguggcuggcgggcgccuguagucccagcuauuugggaggcuaaggcaggaga

SEQ ID NO: 244717 - RNA, 64 nt, Human
aaguuagcugggcuuggcggugugcgccuguagucccagcuacucaggaggcugaggcaggaga

SEQ ID NO: 244718 - RNA, 64 nt, Human
caaauagcugggauuacaggugcaugccaccacacccagcuaauuuuuguauuuuuaguagaga

SEQ ID NO: 244719 - RNA, 64 nt, Human
aaauuaguugggcaugguggcaugcaccuguagucccagcuaccugggaggcugaggcaggaga

SEQ ID NO: 244720 - RNA, 64 nt, Human
acuuuagaaacaaaugaaaaaggcaauugaaaaucccagcuauuucaccuagauggaauagcca

SEQ ID NO: 244721 - RNA, 64 nt, Human
aaauuagccaggcgcgguggcgggggccuguaaucccagcuacucaggaggcugaggcagaaga

SEQ ID NO: 244722 - RNA, 64 nt, Human
aguuaugcauaacaacacuagaagaagguguuagcccagcuaacuuugcuucugggaaggcuau

SEQ ID NO: 244723 - RNA, 64 nt, Human
aaauuagcugggcaugguggcaggcaccuguaaucccagcuacucgggaggcugaggcaggaga

SEQ ID NO: 244724 - RNA, 64 nt, Human
cuuaaaaauuauccggguaccgugcaugugcagucccagcuacucaggaggcugaggcaggagg

SEQ ID NO: 244725 - RNA, 64 nt, Human
caaguagcugggacuacagguguucgccaccaugcccagcuaauuuuuuuguagagauggaguu

SEQ ID NO: 244726 - RNA, 64 nt, Human
aaauuagccaagugugguaauguucaccugcagucccagcuacuugggaggccaaggcacgaga

SEQ ID NO: 244727 - RNA, 64 nt, Human
aaauuagccaggcgugguggugcacaccuguagucccagcuacucgggaggcugagacaggaga

SEQ ID NO: 244728 - RNA, 64 nt, Human
aaaguagccgggcguggugaugcgugccuguaaucccagcuacccaggaaggcugaggcggcag

SEQ ID NO: 244729 - RNA, 64 nt, Human
aaauuagccaggcguggugguacaugccuguaaucccagcuacucaggaggcugaggcaggaga

SEQ ID NO: 244730 - RNA, 64 nt, Human
auuuugagccuuuuuuuuuaagcuuggcaaacaucccagcuaaucaaaauagucauauuccuga

SEQ ID NO: 244731 - RNA, 64 nt, Human
ugacuagcugggacuacuggugugcaccaccacacccagcuaauuuucaauuuuucauagagac

SEQ ID NO: 244732 - RNA, 64 nt, Human
aaauuagccaggcaugguggugcacacuuguagucccagcuacucaggaggcugaggugggaga

SEQ ID NO: 244733 - RNA, 64 nt, Human
uucccuuaccuuggaguuugcuuuguuagucuuccccagcuaaaaagagaaaugcaauccaaaa

SEQ ID NO: 244734 - RNA, 64 nt, Human
aaauuagccuggcgugguggugcacaccuguaaucccagcuacucuggaggcugaggcaggaga

SEQ ID NO: 244735 - RNA, 64 nt, Human
aaauuagcugggugugguggcgggcaccuguaaucccagcuacucgggaggcuguggcaggaga

SEQ ID NO: 244736 - RNA, 64 nt, Human
gcuggcgucugccgucugaggcuggagcgcaguccccagcuagcgucucggcccuugccgcccc

SEQ ID NO: 244737 - RNA, 64 nt, Human
aaccacugucuagagcaacuuuucuuggaacugucccagcuaccaagucagacaccaagguuua

SEQ ID NO: 244738 - RNA, 64 nt, Human
aaauuagccgggcaugguggcaggcgccuauaaucccagcuacuggggaggcugaggcaggaga

SEQ ID NO: 244739 - RNA, 64 nt, Human
aaauuagccgagcguagugacgggugcccguaaucccagcuacucaggaggcugagacaggaga

SEQ ID NO: 244740 - RNA, 64 nt, Human
aaauuagccgggcgcgguggcgggcgccuguagucccagcuacuugggaggcugaggcaggaga

SEQ ID NO: 244741 - RNA, 64 nt, Human
aaauuaaccaggcuuggugguguaugccuguaaucccagcuacuugggaggcugaggcaggaga

SEQ ID NO: 244742 - RNA, 64 nt, Human
aaaugagccgggcaugguggugcaugccuguaagcccagcuauucgggaggcugagguaggaga

SEQ ID NO: 244743 - RNA, 64 nt, Human
aaauuagcugggcaugguggggcaugccuguagucccagcuacucagaagggugaggcagaauu

SEQ ID NO: 244744 - RNA, 64 nt, Human
aaaucagcuggguguggugccgcgugccuguaaucccagcuacuugggaggcugaggcauaaga

SEQ ID NO: 244745 - RNA, 64 nt, Human
cacuuggcugggcacaguggcacaugccuguaaucccagcuacuuggcaggcugaggugggaga

SEQ ID NO: 244746 - RNA, 64 nt, Human
cuugaagcugggugugacggugcacaccucuagucccagcuacucgggaggccaagacagaagg

SEQ ID NO: 244747 - RNA, 64 nt, Human
cgaguagcugggacuaaaggcgugugccaccaugcccagcuaauucuuguauuuuuaguagaga

SEQ ID NO: 244748 - RNA, 64 nt, Human
aaauuagcugggugugauggcgcaugccuguaaucccagcuacuugggaggcugaggcaggaga

SEQ ID NO: 244749 - RNA, 64 nt, Human
cgaguagcuggaacuacaggcacacacugccgcgcccagcuaauuuuuuguauuuuuuaguaga

SEQ ID NO: 244750 - RNA, 64 nt, Human
aagucagccaggcguuguggugcaugcuuguggucccagcuacuuugggagguugaggcaggag

SEQ ID NO: 244751 - RNA, 64 nt, Human
caauuggcuaggacugcaggcacacaccaccagacccagcuaauguaauuucuaucuauaugug

SEQ ID NO: 244752 - RNA, 64 nt, Human
agccgggcguggugguggagcgcacgccuguagucccagcuacucgggaggcugaggcaggaga

SEQ ID NO: 244753 - RNA, 64 nt, Human
aaauuagccgggugucguggcacacaccuguaaucccagcuauuugggaggccaaggcaggaga

SEQ ID NO: 244754 - RNA, 64 nt, Human
aaacuagcugggggugguggugcaugccuguggucccagcuacuugggaggcuaagguagaaga

SEQ ID NO: 244755 - RNA, 64 nt, Human
caaaauguugggaccacgggugugagccaccgcgcccagcuagcuccuguguuuuguuuuuguu

SEQ ID NO: 244756 - RNA, 64 nt, Human
aaauuagccggguguggcggugcacgccuguagucccagcuacucaggaggcuaaggcaggaga

SEQ ID NO: 244757 - RNA, 64 nt, Human
cagguagcugggacuacaggcgugcaccaccacacccagcuaauuuuuaaguuuuuuuuuuuuu

SEQ ID NO: 244758 - RNA, 64 nt, Human
auauuagccgggcauggugucaggcaccuguaaucccagcuacuugggaggcugaggcaggaga

SEQ ID NO: 244759 - RNA, 64 nt, Human
aaauuagcugggcaugguggcacgugccuguggucccagcuacuugggaggcugaggugggagc

SEQ ID NO: 244760 - RNA, 64 nt, Human
aauuagccggguguugguggugugcaccuguaaucccagcuacucaggaggccggggcaggaga

SEQ ID NO: 244761 - RNA, 64 nt, Human
aaauuagcugggcuugauggcaugcgccuguaaucccagcuacucgggagguugaggcaggaga

SEQ ID NO: 244762 - RNA, 64 nt, Human
aaauuggcagggugugguggcacaugccuauaaucccagcuacuugggaggcuaaggcaggaga

SEQ ID NO: 244763 - RNA, 64 nt, Human
aaauuagccagacaugguggcacaugccuuuagucccagcuacucuggaggcugaaguuggagg

SEQ ID NO: 244764 - RNA, 64 nt, Human
ugaguagcugggauuacaggcacacaccaccacgcccagcuaauuuuuguauuuuuaguagagg

SEQ ID NO: 244765 - RNA, 64 nt, Human
caaguagcugggacuacaggcaugcgccaccacgcccagcuaauuuuuguauuuuuaguagaga

SEQ ID NO: 244766 - RNA, 64 nt, Human
aaauuagccggacaugguggcaggcaccuguaaucccagcuacuugggaggcugagucaggaga

SEQ ID NO: 244767 - RNA, 64 nt, Human
ccugcuagagaggcagugaacaccacagcuucuccccagcuaggugccuuuuacaucggguuug

SEQ ID NO: 244768 - RNA, 64 nt, Human
aaauuagccagguguguuggcacaugccuguagucccagcuacgugggaggcugaggcacgaga

SEQ ID NO: 244769 - RNA, 64 nt, Human
auuagccaggcgugguggcaggcgccuguagaaucccagcuacucgggaggcugaggcaggaga

SEQ ID NO: 244770 - RNA, 64 nt, Human
aaaguagcuggguguggugcugggugccuguaaucccagcuacucgggaggcugaagcaggaga

SEQ ID NO: 244771 - RNA, 64 nt, Human
aaauuagccaggcgugguggcgggcgccuguagucccagcuacuugggaggcugaggcaggaga

SEQ ID NO: 244772 - RNA, 64 nt, Human
aaauuugcugggagugguggugcaugccuguaaucccagcuacuuggaaggcugaggcaggaga

SEQ ID NO: 244773 - RNA, 64 nt, Human
cgaguagcugggauuacaggcacccaccaccacgcccagcuaauuuuuguauuuuuaguagaaa

SEQ ID NO: 244774 - RNA, 64 nt, Human
aaauuagcuuggcaugguggugcgugccuguaaucccagcuacucgggaggcuggggcaggaga

SEQ ID NO: 244775 - RNA, 64 nt, Human
ccuuuccacaaccucuaccuucccacucaccuuccccagcuacaaaaaucuguauuauccucuu

SEQ ID NO: 244776 - RNA, 64 nt, Human
aaauuagccaggcgugguggcaggcgccuguagucccagcuacucgggaggcugaggcagaaga

SEQ ID NO: 244777 - RNA, 64 nt, Human
uaaguagcuggguuuacaggcacccaccaccaugcccagcuaauuuuuguauuuuuaauagaga

SEQ ID NO: 244778 - RNA, 64 nt, Human
uuaacacagauguuuuuuaccuguuaacaucucacccagcuaguguuccucagaacaaagauug

SEQ ID NO: 244779 - RNA, 64 nt, Human
aaauuagccaggcacgguggcacacacuuguagccccagcuacuagggaggcugaggagggagg

SEQ ID NO: 244780 - RNA, 64 nt, Human
aaauuagccgggcguggugguggaagccuguagucccagcuacuccggaggcugaggcaggaga

SEQ ID NO: 244781 - RNA, 64 nt, Human
aaauuagcugggcgugguggugggcaccuguagucccagcuacucaggaggcugaggcaggaga

SEQ ID NO: 244782 - RNA, 64 nt, Human
ccuucugccacgauuguaaguuuccugaggccuucccagcuauguggaacugugaguuaauuaa

SEQ ID NO: 244783 - RNA, 64 nt, Human
aaaagagucaggccugguggugugcgccuguaaucccagcuacucgggaggcugaggcaggacg

SEQ ID NO: 244784 - RNA, 64 nt, Human
aaauuagccaggugugguggcgcauaccuguagucccagcuacuugggaggcugaggcaggaga

SEQ ID NO: 244785 - RNA, 64 nt, Human
aaauuagccgggcgugguggugcucaccuguaaucccagcuacccaggaggcugaggcaagaga

SEQ ID NO: 244786 - RNA, 64 nt, Human
aaauuagcugggcgugguggcucaugccuguaaucccagcuacucaggaggcugaggcaggagg

SEQ ID NO: 244787 - RNA, 64 nt, Human
aaauuagcuggaugcgauagcacgugccuguagucccagcuacucgggaggcugaggcuggaga

SEQ ID NO: 244788 - RNA, 64 nt, Human
caaccuuacauaguauauagaacugauggguuuacccagcuacccaguagcauaacuuuucaca

SEQ ID NO: 244789 - RNA, 64 nt, Human
aaaauagccaggcaugguggcgcacgccuguggucccagcuacuugggaggcugaggcaugaga

SEQ ID NO: 244790 - RNA, 64 nt, Human
aaauuagcugggcaugguggugcaugccuguaaucccagcuacucgggaggcugaggcaggaga

SEQ ID NO: 244791 - RNA, 64 nt, Human
aaauuaguugcgugugguggcacaucccuauagucccagcuacuugggaggcugagguggaagg

SEQ ID NO: 244792 - RNA, 64 nt, Human
aaauuagccgggcaugguggugggcgccuguaaucccagcuacucagaaggcugaggcaggaga

SEQ ID NO: 244793 - RNA, 64 nt, Human
aaauuagcugggcgugguggugcaugccuguaaucccagcuacucgggaggcugaggcaggaga

SEQ ID NO: 244794 - RNA, 64 nt, Human
ccuaguagcugggacuacagcacccaccaccacacccagcuaauuuuuguauuuuuaguagaga

SEQ ID NO: 244795 - RNA, 64 nt, Human
ugaaaagcugggauuacagggcccugccaccaagcccagcuaauuguauuuuuaguagagacag

SEQ ID NO: 244796 - RNA, 64 nt, Human
guccggggguugccaccagagacggcuuuguucucccagcuaaggccguggagcugcuguguga

SEQ ID NO: 244797 - RNA, 64 nt, Human
aaauuagccaggugugguggugugcaccuguagucccagcuauuugggaggcugaggugggaga

SEQ ID NO: 244798 - RNA, 64 nt, Human
ggcggagccucgagcgggccccuccuccuccguucccagcuacccccgaccucgcgcacgcccu

SEQ ID NO: 244799 - RNA, 64 nt, Human
ucuucaccguuuuuugauacuaucuucccccacccccagcuacccauaggggcugcagaguuau

SEQ ID NO: 244800 - RNA, 64 nt, Human
aaauacaaaaaauuagcugggugugguggcgggucccagcuacucgggaggcugaggcaggaga

SEQ ID NO: 244801 - RNA, 64 nt, Human
auuaauuuauaaauuuaauaaaucccaauauaaucccagcuagugcuuuuuccuuauuauaauu

SEQ ID NO: 244802 - RNA, 64 nt, Human
aaauuaucggggugcaauggcaugcaucuguaaucccagcuauucaagaggcugaggcaugagg

SEQ ID NO: 244803 - RNA, 64 nt, Human
uacugcccccacaccuccugacaccuccauauaccccagcuauaucugcuuuaaggaguuuucc

SEQ ID NO: 244804 - RNA, 64 nt, Human
aaauuagcugggcgugguggugcaugccuguaaucccagcuacuagggaggcugaggcaagaga

SEQ ID NO: 244805 - RNA, 64 nt, Human
guucaagaccagccuguacgugcgugccuguagucccagcuacucgggaggcugagaugggaga

SEQ ID NO: 244806 - RNA, 64 nt, Human
ccaguagcugggauuacaggcucaugccaccaugcccagcuaauuuuuguauuauuauuauugu

SEQ ID NO: 244807 - RNA, 64 nt, Human
aaaaauuagcugggcacgguguuguaccucuagucccagcuacuugggaggcuuagucaggagg

SEQ ID NO: 244808 - RNA, 64 nt, Human
cuccugggcccaagugauccuuccaccucagucucccagcuaauugagaccacaggcuuguuac

SEQ ID NO: 244809 - RNA, 64 nt, Human
aaauuagccgggcaugguggcaugugccuguauucccagcuacucaugaggcugaggcaggaga

SEQ ID NO: 244810 - RNA, 64 nt, Human
aaauuagccaggcaugguggcacgugccuguaaucccagcuacucgggaggcugaggcaggaga

SEQ ID NO: 244811 - RNA, 64 nt, Human
uggcagaccaggcgugguggcgggcacuuguaaucccagcuacucccaaggcugaggcaggaga

SEQ ID NO: 244812 - RNA, 64 nt, Human
ugaguagcugggauuacaggcgcguaucaccauacccagcuaauuuuuguauuuuuaguagaga

SEQ ID NO: 244813 - RNA, 64 nt, Human
cgaccuccacaggguuacauuguaauauauaugccccagcuaaccugucugaugguggcaucuu

SEQ ID NO: 244814 - RNA, 64 nt, Human
aaauuagcugggcgugguggugggugucuguaaucccagcuauucgggaggcugaggcaggaga

SEQ ID NO: 244815 - RNA, 64 nt, Human
caaauagcuaggacuacaggcgugcgugaccaagcccagcuaauuuuugcauuuuuuguagaga

SEQ ID NO: 244816 - RNA, 64 nt, Human
aaauuagccgggcgugguggcacacgccuguagucccagcuacucaggaggcugaggcaggaga

SEQ ID NO: 244817 - RNA, 64 nt, Human
aaauuagccgggcgugguggugggcaccuguagucccagcuacucgggaggcugaggcaggaga

SEQ ID NO: 244818 - RNA, 64 nt, Human
aaauuagcugggcacaguggcucccuccuguagucccagcuacuugggaggcugagaugggagg

SEQ ID NO: 244819 - RNA, 64 nt, Human
guuugaaauauagcuguucuuuaugcauaaaacacccagcuaggaccauuacugccagagaaaa

SEQ ID NO: 244820 - RNA, 64 nt, Human
caaguagcugggauuacaggcacccgccaccacacccagcuaauuuuuuguauauuuaguagag

SEQ ID NO: 244821 - RNA, 64 nt, Human
aaauuagcucagugugguggcacacacuuguaaucccagcuacucaggaggcugaggcaugaga

SEQ ID NO: 244822 - RNA, 64 nt, Human
aaauuagccaggcgugguggcgggcgccuguaaucccagcuacucaggaggcugaggcagcaga

SEQ ID NO: 244823 - RNA, 64 nt, Human
aaauuagccaggcgugguggcuggcaccuguagucccagcuacuugggaggcugaggcaggaga

SEQ ID NO: 244824 - RNA, 64 nt, Human
aaauuagccgggcgugguggcacacuccuguaaucccagcuacuggggaggcugaggcacgaga

SEQ ID NO: 244825 - RNA, 64 nt, Human
acuucggcagauacugucucuuucaugaguuuuucccagcuacaccuuucuccuuuguacuuug

SEQ ID NO: 244826 - RNA, 64 nt, Human
cauggugaaaccccaucucuccugggcauguagucccagcuacucgggaggcugaggcaggaga

SEQ ID NO: 244827 - RNA, 64 nt, Human
agccuaagaaauauuuucucaauguaauucccuucccagcuacccaaaugcuacagagaaaugu

SEQ ID NO: 244828 - RNA, 64 nt, Human
uggauggggaccugaaaaagagaauguugauagccccagcuaagacccccaaucagcuguggga

SEQ ID NO: 244829 - RNA, 64 nt, Human
ugaaauuaaaacuauucaugcuacccagccauuacccagcuaaauaaucuuacucuagauaccu

SEQ ID NO: 244830 - RNA, 64 nt, Human
aaaguagccaggcaugguggcgcaugcguguaaucccagcuacuugggaggcugaggcaggaga

SEQ ID NO: 244831 - RNA, 64 nt, Human
caaguagcugggacuacaggcacacaccaccacgcccagcuaauuuuuguauuucuuuuuuuuu

SEQ ID NO: 244832 - RNA, 64 nt, Human
cuucacauacaucaugacgaggauggcagcucuucccagcuacugagcacuugcuucccaagug

SEQ ID NO: 244833 - RNA, 64 nt, Human
uuccccugggggcccuccuuuccccugcucccugcccagcuacggggcccuccuuucagccuug

SEQ ID NO: 244834 - RNA, 64 nt, Human
caggcuguugggacugggacccucccuacccugccccagcuagacaaauaaaccccagcaggcc

SEQ ID NO: 244835 - RNA, 64 nt, Human
ucacagaugauaccaacagugaagcuguggaaugcccagcuaguuaaagaaugcaaaggaaaau

SEQ ID NO: 244836 - RNA, 64 nt, Human
aaauuagccaggcaugguggugggcgccuguagucccagcuacucaggaggcugaggcaggaga

SEQ ID NO: 244837 - RNA, 64 nt, Human
ugcucucaccaccuaugaaacucggggaaaccagcccagcuaaguccggagugaaggagccucu

SEQ ID NO: 244838 - RNA, 64 nt, Human
aaaaaggccaggcacgguggcucaugccuguaaucccagcuacgcaggaggccaaggcaggaga

SEQ ID NO: 244839 - RNA, 64 nt, Human
aaaaauagccagguguggggugcaugccuggaaucccagcuacuugagaggcugaggcacgaga

SEQ ID NO: 244840 - RNA, 64 nt, Human
aaauuaccugggcaugguggcaggugcuuauaaucccagcuacucugggggccaaggcaggaga

SEQ ID NO: 244841 - RNA, 64 nt, Human
uaaaacugcccaauacugagagguguuuucuacacccagcuagaggagcacacuccauuuuccc

SEQ ID NO: 244842 - RNA, 64 nt, Human
ccucuacuaacaaucagcuccuuccuggagacugcccagcuaaagcaauaugcauuuaaauaca

SEQ ID NO: 244843 - RNA, 64 nt, Human
gaagaagcuggacauggugggaugggcauguggucccagcuacucuggaagcugaggugagagg

SEQ ID NO: 244844 - RNA, 64 nt, Human
ugcgaugugcgugucuguuagaauaggcucucuacccagcuagaacaccuuccagacacuugcu

SEQ ID NO: 244845 - RNA, 64 nt, Human
ggaguagcugggacuacaggugcccaccaccacacccagcuaauuuuuuuguauuuuuaguaga

SEQ ID NO: 244846 - RNA, 64 nt, Human
aguagccggggagcuacaagcaugcaccaccacacccagcuaauuuuuuuuuuuuuuuugagag

SEQ ID NO: 244847 - RNA, 64 nt, Human
aaauuagcugggcgugguggcgagcgccuguagucccagcuacucgggaggcugaggcaggaga

SEQ ID NO: 244848 - RNA, 64 nt, Human
ugaugucuccuaagcaccuguaaugugcgagggacccagcuaauaacugaucucguuuuuucuu

SEQ ID NO: 244849 - RNA, 64 nt, Human
guuucagcuaggcacagugguacaugccuguaaucccagcuacuugggaggcugaggugggagg

SEQ ID NO: 244850 - RNA, 64 nt, Human
caaagugcugagauuacaggcaugggccaccacgcccagcuaguuccucuuuugauaaggcugu

SEQ ID NO: 244851 - RNA, 64 nt, Human
acggugccagcugaggcugaggcaugcagcagcccccagcuaccuuugcuuagggcuggggugg

SEQ ID NO: 244852 - RNA, 64 nt, Human
aaauuagcugagcgugguggcgggcgccuguaaucccagcuacuugggaggcugaggcaggaga

SEQ ID NO: 244853 - RNA, 64 nt, Human
aguuacaguacuuguuugacuuagguuuaagaggcccagcuaccuaucucugaccuuuucaaau

SEQ ID NO: 244854 - RNA, 64 nt, Human
cugcucaaugcaauacacuguucagugcuauucucccagcuagguuuauccaugaaggacugag

SEQ ID NO: 244855 - RNA, 64 nt, Human
aaauuagccagucacguuggugucugccuguggucccagcuacucgggaggcugaggcacaaga

SEQ ID NO: 244856 - RNA, 64 nt, Human
aaauuagccagacaugauggcgggugccucuaaucccagcuacuggggaggcugaggugggaga

SEQ ID NO: 244857 - RNA, 64 nt, Human
aauuuagccgggcgcgguggcgggcaccuguagucccagcuacuugggaggcugaggcaggaga

SEQ ID NO: 244858 - RNA, 64 nt, Human
ugagcagcugggauuacaggcaaacgccaccacacccagcuaaauuuuuuuuuuuuuuuuugua

SEQ ID NO: 244859 - RNA, 64 nt, Human
aaauuagcugggugugguggcagucaccuguagucccagcuacuugggaggcugaggcaggaga

SEQ ID NO: 244860 - RNA, 64 nt, Human
caaguagcugggacuauaggcacacgccaccacgcccagcuaauuuuuauauuuuuaguagaga

SEQ ID NO: 244861 - RNA, 64 nt, Human
uacccccacuccaucccccaggggaacaccccugcccagcuacuuuccuaaugaaauaaagagc

SEQ ID NO: 244862 - RNA, 64 nt, Human
uaagcaucuggguugccauggcaauggcaugccccccagcuacuguaugcccccgacccccgca

SEQ ID NO: 244863 - RNA, 64 nt, Human
ccaguagcugagauugcaggcacaugccaccacgcccagcuaauauuuuguauuuucaguaggg

SEQ ID NO: 244864 - RNA, 64 nt, Human
agauuagccaggcgugguggugagcgccuguagucccagcuacuugggaugcugaggugggagg

SEQ ID NO: 244865 - RNA, 64 nt, Human
aaauuagccuggcgugguggcgcaugccuguaaucccagcuacucaggaggcuaaggcaggaga

SEQ ID NO: 244866 - RNA, 64 nt, Human
gcugugaacucagagccccucccugcuaccaaggcccagcuauggccccaggguugaaaaguua

SEQ ID NO: 244867 - RNA, 64 nt, Human
ucucaaguuuguuuuucucaggauauuguccuggcccagcuacuccuuuaccugugagaagauc

SEQ ID NO: 244868 - RNA, 64 nt, Human
cagaccgggguucccgugugccugagcggaccuucccagcuagaauucacuccacuuggacaug

SEQ ID NO: 244869 - RNA, 64 nt, Human
aaauuaaccaggcaugguggcaugcaccuguagucccagcuacuuggggugcugaggcgggagg

SEQ ID NO: 244870 - RNA, 64 nt, Human
aaaauagcugggcaugguggcacgcaccucuacucccagcuacuaggaggcugaggcaggagaa

SEQ ID NO: 244871 - RNA, 64 nt, Human
aaaacagccaagcuuggugguaugugccuguggucccagcuacuggggaggcugaggugggagg

SEQ ID NO: 244872 - RNA, 64 nt, Human
aaauuagcugggcgugguggugggugccuguaaucccagcuacucgggaggcugaggcaggaga

SEQ ID NO: 244873 - RNA, 64 nt, Human
aaaguagcuggggaugguggcacacaccuguagucccagcuacucaggagguugaggugggaag

SEQ ID NO: 244874 - RNA, 64 nt, Human
agcgggauuacaggcgcccaccaccaaaaauuagcccagcuaauuuuuguauuuuuaguagaga

SEQ ID NO: 244875 - RNA, 64 nt, Human
aaauuagccggguguggugaugcacaccuguaaucccagcuacucgggaggcugaggcacaaga

SEQ ID NO: 244876 - RNA, 64 nt, Human
aaauuagccaggcgugguggcacgcgccuguagucccagcuacucgggaggcugaggcaggaag

SEQ ID NO: 244877 - RNA, 64 nt, Human
aaauuagccaggcaugguggcaggugccuguagucccagcuacucgggaagcugaggcagaaga

SEQ ID NO: 244878 - RNA, 64 nt, Human
cagcugcugugucagagcggaggcacauuggugacccagcuaaggguguucgugucagugcugg

SEQ ID NO: 244879 - RNA, 64 nt, Human
ccggcacgguggcuggcgccuguaguccuguagucccagcuacucgggaggcugaggcaggaga

SEQ ID NO: 244880 - RNA, 64 nt, Human
aaauuagccgggugcgguggcacacaccuguaaucccagcuaccggggaggcugaggcaggaga

SEQ ID NO: 244881 - RNA, 64 nt, Human
cugugguuuccuuucacaugccaucccuuaaaaucccagcuacacgccuucccauuccuucccc

SEQ ID NO: 244882 - RNA, 64 nt, Human
ggacaacuuacugcagggccaaaaaagggacugucccagcuagaacugugagaguauacauagg

SEQ ID NO: 244883 - RNA, 64 nt, Human
ugcaagacugcuccucucgucucaaaaugacccacccagcuagagcacuguacacccccagugg

SEQ ID NO: 244884 - RNA, 64 nt, Human
ucaagaaugggccacacacagcuagaaguccucucccagcuagaaguccuguccccacucuccu

SEQ ID NO: 244885 - RNA, 64 nt, Human
ugaguagcugggacuauaggugcaugccaccaugcccagcuaauuuuuguauuuuuaguagaga

SEQ ID NO: 244886 - RNA, 64 nt, Human
acagcaggugcugagcaaagggaacagugaggugcccagcuagcugcagagccacccuguguug

SEQ ID NO: 244887 - RNA, 64 nt, Human
acucaugccgggcgugguggcacgcgccuguaaucccagcuacccaggaggcugaggcaggaga

SEQ ID NO: 244888 - RNA, 64 nt, Human
aaauuagccgggcauggugguggguaccuguagucccagcuacuccggaggcugaggcaggaga

SEQ ID NO: 244889 - RNA, 64 nt, Human
ugaguagcugggauuacaggaacgcgccaccacgcccagcuaauuccuguauuuuuaguagaga

SEQ ID NO: 244890 - RNA, 64 nt, Human
aaauuagccgggcgugguggcgggcgccuguaaucccagcuacuugggaggcugaggcaggaga

SEQ ID NO: 244891 - RNA, 64 nt, Human
aaauuagccgggugugguggugggcaccuguagucccagcuacucgggaggcugaggcaggaga

SEQ ID NO: 244892 - RNA, 64 nt, Human
ggaaacugaaguucugaaaaucuccuuccagggccccagcuaacuaaugccauaggugagauuc

SEQ ID NO: 244893 - RNA, 64 nt, Human
aaauuagcugggcgugguggcacguuccugcaaucccagcuacucauaaggcugaggugggagg

SEQ ID NO: 244894 - RNA, 64 nt, Human
ugucucuugcagcucuucaggcagugcaggacaacccagcuaugcccacaugcucaagcccaga

SEQ ID NO: 244895 - RNA, 64 nt, Human
aguagcugggauuacaaaagcauguggccccacgcccagcuaaguuuuguauuuuuaguagaca

SEQ ID NO: 244896 - RNA, 64 nt, Human
aaauuagccaggcaugguggcauuugccuguaaucccagcuacucgggaggcugaggcaggaga

SEQ ID NO: 244897 - RNA, 64 nt, Human
ugaguagcugggacuacaggcaugcaccaccacgcccagcuaauuuuuguguuuuuaguagaga

SEQ ID NO: 244898 - RNA, 64 nt, Human
aaguuagcugggcgugguggcacacaccuguagucccagcuacucaggaggcugaggcaggaga

SEQ ID NO: 244899 - RNA, 64 nt, Human
aaauuagcugaguguagugacgcaugcccucaaucccagcuacucaagaggcugaggcaggaga

SEQ ID NO: 244900 - RNA, 64 nt, Human
gaauuagcugggcgugguggcgugugccuguaaucccagcuauuugggaggcugaggcaggaga

SEQ ID NO: 244901 - RNA, 64 nt, Human
aaauuagcuaggcguagugguuggcaccuauagucccagcuacucggaaggcugaagcaggaga

SEQ ID NO: 244902 - RNA, 64 nt, Human
caugauauaauccacccaugcaaauagcuacuggcccagcuaccauuuaccauuugccuacaga

SEQ ID NO: 244903 - RNA, 64 nt, Human
aaugguuaacaaauaucacagcauccagggauugcccagcuauagugugggugcccuacugaac

SEQ ID NO: 244904 - RNA, 64 nt, Human
aaauuagccaggcgugguggcguacgccuguaaucccagcuacucaggaggcaggagaaucgcu

SEQ ID NO: 244905 - RNA, 64 nt, Human
aaauuagccggggguggugacaugugccuguaaucccagcuacucaggaggcuaaggcaggaga

SEQ ID NO: 244906 - RNA, 64 nt, Human
acauuagccaggugugguggcacgcgccuguaaucccagcuacucgggaggcugaggcagaagg

SEQ ID NO: 244907 - RNA, 64 nt, Human
aaauuagacgagcguggugguggacaccuguagucccagcuacuugggaggcugaggcaggaga

SEQ ID NO: 244908 - RNA, 64 nt, Human
aaauuagccaggagugguggcaggcaccuguagucccagcuacuugggaggcugaggcaggaga

SEQ ID NO: 244909 - RNA, 64 nt, Human
cuuuaagcugugauguuguauauauacaaugccucccagcuagacuguaagcccuuuggggaca

SEQ ID NO: 244910 - RNA, 64 nt, Human
caaguagcugggauuacaggcgccugccaccacgcccagcuaauuuuuuguauuuuuaguagag

SEQ ID NO: 244911 - RNA, 64 nt, Human
ucaucuuuucacuggaggacaggaggcuauggggcccagcuacgcaccuggagauccugaacug

SEQ ID NO: 244912 - RNA, 64 nt, Human
acaaagcccaggcaugguggugcacaccuguacucccagcuacucgggugguuuacacaggagg

SEQ ID NO: 244913 - RNA, 64 nt, Human
aaauuagccaggcgugguggugggcaccuguagucccagcuacucaggaggcugaggcaggaga

SEQ ID NO: 244914 - RNA, 64 nt, Human
gaacuagcugggcaugguggcgcaugcauguagucccagcuacuccugaggcucagucaggaga

SEQ ID NO: 244915 - RNA, 64 nt, Human
aaauuagccaggcgugguggcgcaugccuguaaucccagcuacucgggaggcugaggcaggaga

SEQ ID NO: 244916 - RNA, 64 nt, Human
ugguuagccuggugugguggugcacaccuguaaucccagcuacuugggagacugagacaugaga

SEQ ID NO: 244917 - RNA, 64 nt, Human
caaguagcugagacuacaggcacgagccaccacacccagcuaauuuuuaaguuuucuuguagag

SEQ ID NO: 244918 - RNA, 64 nt, Human
aagauuucuaaaguaugcccuucauccuucugggcccagcuaggagaaugaagugugguguugg

SEQ ID NO: 244919 - RNA, 64 nt, Human
cuuccuccaucuaucugauuccauuccuuccacacccagcuaaaguuagaggagauacauauag

SEQ ID NO: 244920 - RNA, 64 nt, Human
ugagaagcucggacuacaggcacgagccaccaugcccagcuaauuuucuuuuuuuguuuuguuu

SEQ ID NO: 244921 - RNA, 64 nt, Human
aaaucagccagacaugguggcaugcaccugcaaucccagcuacucgggaggcugaggcacaaga

SEQ ID NO: 244922 - RNA, 64 nt, Human
caaguaggugggauuacaggcgcccgccaccacgcccagcuaauuuuuguauuuuuaguagaga

SEQ ID NO: 244923 - RNA, 64 nt, Human
aaauuagccaggcaugguggcgugcgccugcagucccagcuacuugggaggcugaguugggagg

SEQ ID NO: 244924 - RNA, 64 nt, Human
gacugcagacccggccugguggggccagagaguccccagcuagggaccugcacguggacguggg

SEQ ID NO: 244925 - RNA, 64 nt, Human
aaauuagccagguaugguggugaacaccuguaaucccagcuacuuggaaggcugaggcauagga

SEQ ID NO: 244926 - RNA, 64 nt, Human
cccaaguagcugggaauacaggcacgccaccaugcccagcuaauuuuuguauuuucaguagaaa

SEQ ID NO: 244927 - RNA, 64 nt, Human
aaauuagccgggcguggugacacgugccuguagucccagcuacucgggaggcugaggcaggaga

SEQ ID NO: 244928 - RNA, 64 nt, Human
aaauuagccgggcgugguggcgggcgccuguaaucccagcuacuugggaagcugaggcgggaga

SEQ ID NO: 244929 - RNA, 64 nt, Human
aaauuagccaggcgugguagcaggcaccuguaaucccagcuacuugggaggcugaggcaggaga

SEQ ID NO: 244930 - RNA, 64 nt, Human
aaauuagcugggcgugguggcacgugccuguaaucccagcuacucgggaggcugaggcaggaga

SEQ ID NO: 244931 - RNA, 64 nt, Human
aaaauagccgggcaugguggcgcaagccuguaaucccagcuacucaggaggcugaggcagaaga

SEQ ID NO: 244932 - RNA, 64 nt, Human
aaauuagcugggcaugguggcaugcgccuguaaucccagcuacucaggaggcugagacagaaga

SEQ ID NO: 244933 - RNA, 64 nt, Human
aaauuagcugggcaugauggcacgcaccugcagucccagcuacuugggaggcugaggcaggaga

SEQ ID NO: 244934 - RNA, 64 nt, Human
uguacacacccuauuaacuccuuggcuguggucccccagcuacaccaccagcccagguccuggc

SEQ ID NO: 244935 - RNA, 64 nt, Human
aaauuagccgagcaugguggccugugccuguaaacccagcuacucaggagguuggggcagaauu

SEQ ID NO: 244936 - RNA, 64 nt, Human
uguccucagccuugccagagauccaaaagaagcccccagcuaagaaccuggaacuuggggaguu

SEQ ID NO: 244937 - RNA, 64 nt, Human
agcugggauuacaggcacacaccaccacaccuggcccagcuaauucuuuuuuguauuuuuagua

SEQ ID NO: 244938 - RNA, 64 nt, Human
ccaguagcugggauuacagaucugcaccaccaugcccagcuaauuuuguauuuuuaguagagac

SEQ ID NO: 244939 - RNA, 64 nt, Human
uuaagcccccaacacgagaggaaagcugcugacucccagcuauagccaugggcacuuggccccc

SEQ ID NO: 244940 - RNA, 64 nt, Human
ugaguagcugggauuauaggcacgcaccaccacgcccagcuaauuuuuuguauuuuuaguagag

SEQ ID NO: 244941 - RNA, 64 nt, Human
aaauuagccgggcgugguggcaggcaccuguaaucccagcuacuugggaggcugaggcaggaga

SEQ ID NO: 244942 - RNA, 64 nt, Human
aaauuagucgggcgugguggugcaugccuguaaucccagcuacuggggaggcugaggcaggaga

SEQ ID NO: 244943 - RNA, 64 nt, Human
aaauuagccagcugugguggcgggcgccuguagucccagcuacucaggaggcugaggcaggaga

SEQ ID NO: 244944 - RNA, 64 nt, Human
aaauuagccaggcgugguggugggugccuguagucccagcuacucaggaggcugaggcaggaga

SEQ ID NO: 244945 - RNA, 64 nt, Human
aaaacuagccagccugguggcgggcgccuguagucccagcuacuuggaaggcugaggcaggaga

SEQ ID NO: 244946 - RNA, 64 nt, Human
ggaccaaggagcuuccaucuagugacaagugacccccagcuaucgccucuugccuuccccugug

SEQ ID NO: 244947 - RNA, 64 nt, Human
aguagcugggauugcagguacccaucagcccaugcccagcuaauuuuguauuuuuaguagagau

SEQ ID NO: 244948 - RNA, 64 nt, Human
gggaacuggaauggagagacccagguacuaaaaucccagcuaacguggcagaggaguugcgggu

SEQ ID NO: 244949 - RNA, 64 nt, Human
gaucucaggucuaaggcuuccuuucccucccucucccagcuaguuugugcuaauuaagagaccu

SEQ ID NO: 244950 - RNA, 64 nt, Human
cgaguagcugggauuacaggcaugggccaccacacccagcuaauuuuuuguguuuucuuuuuag

SEQ ID NO: 244951 - RNA, 64 nt, Human
ugaguagcugggauuacagacacccgccauggcacccagcuaauuuuguauuuuuaguagagau

SEQ ID NO: 244952 - RNA, 64 nt, Human
aaauuagcuggguauguuggugcaggcuugcaaucccagcuacuugggacgcugaggugggagg

SEQ ID NO: 244953 - RNA, 64 nt, Human
auuuuggcagggugcuguggugcuugcauguagucccagcuauucaggaauauugcuugagucc

SEQ ID NO: 244954 - RNA, 64 nt, Human
aaaauuagccgggugcaguggugaggccuguaaucccagcuacucaggaggcugaggcaggaga

SEQ ID NO: 244955 - RNA, 64 nt, Human
aaauuagcugggcaugguggcgcaugccuguaaucccagcuacugggaaggcugagguaggaga

SEQ ID NO: 244956 - RNA, 64 nt, Human
aaauuagcugggcauaguggcggguaccuauaaucccagcuacucgggaggcugaggcacgaga

SEQ ID NO: 244957 - RNA, 64 nt, Human
cgaguagcugggacuacaggcaugcaccaccacgcccagcuaauuuuuguauuuuuagcagaga

SEQ ID NO: 244958 - RNA, 64 nt, Human
aaauuagcugggcgugguggcacgugccuguaaucccagcuacucaggaggcugaggcaggaga

SEQ ID NO: 244959 - RNA, 64 nt, Human
ugcugugcuguggaccagcuguguggaucucuagcccagcuacagcagaauacauuuuaccagc

SEQ ID NO: 244960 - RNA, 64 nt, Human
aaauuggccgggcaugguggcaugugccuguagucccagcuacuugggaggcugaggcaggaga

SEQ ID NO: 244961 - RNA, 64 nt, Human
acaaaaauuaggcauaguggugcacgccugcagucccagcuacucaggagguugaggcagaaga

SEQ ID NO: 244962 - RNA, 64 nt, Human
ugaguagcugggauuacaggcgcgugccaccacgcccagcuaauuuuuuguauuuuuaguugag

SEQ ID NO: 244963 - RNA, 64 nt, Human
aaauuagccgggugcaguggcgugcaccuguaaucccagcuacucuggaggcugaggcaggaga

SEQ ID NO: 244964 - RNA, 64 nt, Human
auaaccuuuucuuuuaucaugucucgcuaauaaccccagcuauugucuguuguguucagcugag

SEQ ID NO: 244965 - RNA, 64 nt, Human
cgaguagcugggacuacaggcgugugccaccaugcccagcuaauuuuuuguacuuuuaguagag

SEQ ID NO: 244966 - RNA, 64 nt, Human
aaauuagcugggcgugguggcaugcgccuguaaucccagcuacccaggaggcugaggcaggaga

SEQ ID NO: 244967 - RNA, 64 nt, Human
aaaccacagcaucaaagacaucccaaauaacaugcccagcuagcucuguacuacagagcccugc

SEQ ID NO: 244968 - RNA, 64 nt, Human
aaauuaucugauccuuguggcacacaacuguggucccagcuacaggggaggcugagacgcaagg

SEQ ID NO: 244969 - RNA, 64 nt, Human
aacuuagcuggguguaacggcggaugccuguaaucccagcuacuugggaggcugaggcaggaga

SEQ ID NO: 244970 - RNA, 64 nt, Human
guuuaauccgaguguggugguguucaccuuuaaucccagcuacuugggaggcugaggugggagg

SEQ ID NO: 244971 - RNA, 64 nt, Human
cgaguggcugggauuagcggcaugcaccaccacgcccagcuauuuuuguauuuuuaguagagau

SEQ ID NO: 244972 - RNA, 64 nt, Human
aaauuagccgggcaugguggcacaugccuguaaucccagcuacucaggaggcugaggcaggaga

SEQ ID NO: 244973 - RNA, 64 nt, Human
cgaguagcuaggauuacaggcgcccgccacuacgcccagcuaauuugugguauuuuuaguagag

SEQ ID NO: 244974 - RNA, 64 nt, Human
caauuagccgggcgugguggggugcgcuuguaaucccagcuacucaggaggcugaggcaggaga

SEQ ID NO: 244975 - RNA, 64 nt, Human
accauggggcaucccaagugggguccucacccaucccagcuacugcagcucuguauuacuuugu

SEQ ID NO: 244976 - RNA, 64 nt, Human
caaguagcugagaugacaggcgugugccaccacgcccagcuaauuuuuguauuuuuaguagcga

SEQ ID NO: 244977 - RNA, 64 nt, Human
aaauuagccaggcgugguggcgggcgccuguaaucccagcuacucgggaagcugaggcaggaga

SEQ ID NO: 244978 - RNA, 64 nt, Human
aaauuagcugggcgugguggcacacgccuguaaucccagcuacucaggaggcugaggcuggaga

SEQ ID NO: 244979 - RNA, 64 nt, Human
caaguagcugggauuacaggugccugccaccaugcccagcuaauuuuuguauuuuuaguagaaa

SEQ ID NO: 244980 - RNA, 64 nt, Human
cuuuaagccaggugugguagcaugugccuauagucccagcuacuugggagguggaggugggagg

SEQ ID NO: 244981 - RNA, 64 nt, Human
cgaguagcugggauuacaggcaugcaccaccacgcccagcuaauuuuguauuuuuaguagagac

SEQ ID NO: 244982 - RNA, 64 nt, Human
ugaaaaauaaauaaauaaauaaauaaacaccacacccagcuaauuuuuguauuuuuaguagaga

SEQ ID NO: 244983 - RNA, 64 nt, Human
gcaguguugucggccgaggccugagcucgcccugcccagcuacugaccucaggucgaggggccc

SEQ ID NO: 244984 - RNA, 64 nt, Human
aagagcaagugcagguaugaaaugcgaagauugccccagcuaaaaguggacaaguccgcuuugu

SEQ ID NO: 244985 - RNA, 64 nt, Human
aaugcugcugggcacagugaugugcaguuauagucccagcuacuugggaggccaaggcaggagg

SEQ ID NO: 244986 - RNA, 64 nt, Human
cucuugucucaguccccugagacaaucccccacgcccagcuacauauuuuuuguggauacaggg

SEQ ID NO: 244987 - RNA, 64 nt, Human
auuugagccacgcauagugucacgcaccugugaucccagcuacuuaggagguugaggcugggag

SEQ ID NO: 244988 - RNA, 64 nt, Human
aaauuagcagggagugguggugcacaccuguaaucccagcuacucuggaggcugaggcaaaaga

SEQ ID NO: 244989 - RNA, 64 nt, Human
aaauuagccggguaugauggugugugccucuagucccagcuacuugggaggcugaggucagagg

SEQ ID NO: 244990 - RNA, 64 nt, Human
cauguggcugggacuauaggugcaugccaccacacccagcuaauuaaaaaaauuuuuugugugg

SEQ ID NO: 244991 - RNA, 64 nt, Human
aaauuagccagacgugguggcaugcgccuguaaucccagcuacucaggaagcugaggcgagaga

SEQ ID NO: 244992 - RNA, 64 nt, Human
aaauuagccgggcgugguggcgggcgcccauagucccagcuacucgggaggcugagacaggaga

SEQ ID NO: 244993 - RNA, 64 nt, Human
aaauuagccaggcaugguggcacgugccuguaaucccagcuacucgcaaggcugaggcaggaga

SEQ ID NO: 244994 - RNA, 64 nt, Human
ugaguagcugggauuauaggcacacaccaccacacccagcuaaucuuuuuguauuuuuuuuuuu

SEQ ID NO: 244995 - RNA, 64 nt, Human
ugggaacucccugacuauuccgcugcugcaggaacccagcuagcuggccagguggggaggggcu

SEQ ID NO: 244996 - RNA, 64 nt, Human
cgaguagcugggacuacaggcaugugccaccacgcccagcuaaguuuugcauuaucaguagaga

SEQ ID NO: 244997 - RNA, 64 nt, Human
aaucuagccaggcgugguggugcgugccuguagucccagcuacuuggggggcugagguggcagg

SEQ ID NO: 244998 - RNA, 64 nt, Human
ggaggauuccauuuggcagagcuucuuccaggugcccagcuauaccugugccucggcuuuucuc

SEQ ID NO: 244999 - RNA, 64 nt, Human
aauguauccagacauggugguguguaccuguagucccagcuacucaggaggcaaagaugggagg

SEQ ID NO: 245000 - RNA, 64 nt, Human
cgaguagcugggacuacaggugcccgccaccacgcccagcuaauuuuuuguauuuuuaguagag

SEQ ID NO: 245001 - RNA, 64 nt, Human
aaauuagcugggcauaguggugggugccuguaaucccagcuacuugggaggcugagacaggaga

SEQ ID NO: 245002 - RNA, 64 nt, Human
uuaaucuggacacacuguuacacgugccuguagucccagcuacucgauagccugaggugggaga

SEQ ID NO: 245003 - RNA, 64 nt, Human
aagugcaugcauugagcugccuccagccugguggcccagcuauuaccacacuugggguuuaaau

SEQ ID NO: 245004 - RNA, 64 nt, Human
aaauuagcugggcgugguggugggcgccuguaaucccagcuacucgggagguuuaggcaggaga

SEQ ID NO: 245005 - RNA, 64 nt, Human
aaauuagccaggugugguggcaugugccuguaaucccagcuacucaggaggcugagacaggaga

SEQ ID NO: 245006 - RNA, 64 nt, Human
aaauuagcugggcaugguggugggcgccuauaaucccagcuauucuggaggcugaggcaggaau

SEQ ID NO: 245007 - RNA, 64 nt, Human
caaguagcugggauuacaggcacccaccaccaugcccagcuaauuuuuguauuuuuaauagaga

SEQ ID NO: 245008 - RNA, 64 nt, Human
aaauuagccgggaguggugucgggcgacuguagucccagcuacucgcgaggcugaggcaggaga

SEQ ID NO: 245009 - RNA, 64 nt, Human
aaauuagcugggugugggggcgugcgccuguagucccagcuacuugggaggcugaggcaggaga

SEQ ID NO: 245010 - RNA, 64 nt, Human
gguugaacugggcaugguggcacauaacugcaaucccagcuacuuuggaggcagggaugggagg

SEQ ID NO: 245011 - RNA, 64 nt, Human
uuagccgggcauugugguggugcaugccuguaaucccagcuacucgggaagcugagguaggaga

SEQ ID NO: 245012 - RNA, 64 nt, Human
ucaguggaccaggaagcaagaggggaagcgggaucccagcuagacuuagaacuuggacuuuucc

SEQ ID NO: 245013 - RNA, 64 nt, Human
uuggguguuuuuuuuuaauuuaauuuuaaauuaucccagcuauuagauagaagggauguuacug

SEQ ID NO: 245014 - RNA, 64 nt, Human
gaaauuagccagggugguggugcacaccuguaaucccagcuaccugggaggcugcggcaggaga

SEQ ID NO: 245015 - RNA, 64 nt, Human
cggcagaccccucuuccuacagcccccucuccagcccagcuaccuccucgccaagugggaaugc

SEQ ID NO: 245016 - RNA, 64 nt, Human
ugacagcaaagauccacuuuggcaggagcccugacccagcuaggagguagucuggagggcuggu

SEQ ID NO: 245017 - RNA, 64 nt, Human
aaauuagccgggcaugguagugcacgccuguaaucccagcuacucaggaggcugaggcacgaga

SEQ ID NO: 245018 - RNA, 64 nt, Human
uuucaccuucaggugauaaggauuuuuuuuuucucccagcuagugcuaucuuucucaaaauaau

SEQ ID NO: 245019 - RNA, 64 nt, Human
gaaaaagcugagcucauaggugcccagccagccucccagcuaaaggugcucagagccccacugc

SEQ ID NO: 245020 - RNA, 64 nt, Human
uuauuagcugggcaugguggugugugccuguaaucccagcuacucaggaggaugaggcaggaga

SEQ ID NO: 245021 - RNA, 64 nt, Human
aaauuagccgggcgugguggcgggcgccuguagucccagcuacucggagaggcugaggcaggag

SEQ ID NO: 245022 - RNA, 64 nt, Human
ugaguagcugggacuacaggcaccugccaccacgcccagcuaauuuuuguauuuuuaguggaga

SEQ ID NO: 245023 - RNA, 64 nt, Human
aaauuagccagguguagggguaggcaccuggcaucccagcuacuccaggggcugaggugacagc

SEQ ID NO: 245024 - RNA, 64 nt, Human
aaauuagcugggcaugguggcaugcucccguagucccagcuacucgggaggcugaggcaggaga

SEQ ID NO: 245025 - RNA, 64 nt, Human
aaauuagcugagcaugguggugugugccuguagucccagcuacuauggagguugaggugggagg

SEQ ID NO: 245026 - RNA, 64 nt, Human
aaauuagccaggcaugguggcaagcgccuguagucccagcuacucuggaggcugaggcaggaga

SEQ ID NO: 245027 - RNA, 64 nt, Human
uauuagcugggcguagguggugcacaccuguagucccagcuacuggggaggcugaggcaggaga

SEQ ID NO: 245028 - RNA, 64 nt, Human
gccucccucaggcucuguggagggcauuugcugccccagcuacuaaggugcuaggaauucguaa

SEQ ID NO: 245029 - RNA, 64 nt, Human
caaguagcugggauuacagaaagccgccaccgugcccagcuaauuuuuguauuuuuguuggcca

SEQ ID NO: 245030 - RNA, 64 nt, Human
ccaguagcugggauuacaggcacccaccaccaugcccagcuaauuguuguauguuuaguagaga

SEQ ID NO: 245031 - RNA, 64 nt, Human
cgaguagcugggauuacaggcacacaccaccacgcccagcuaguuuuuuuguauuuuuaguaga

SEQ ID NO: 245032 - RNA, 64 nt, Human
gaauuagccgggcgugguggcgcaugcccauaaucccagcuacugaggagacuugagguaggag

SEQ ID NO: 245033 - RNA, 64 nt, Human
aaauuagccggaugugguggugcaugccuguagucccagcuacucgggaggcugagugaggcag

SEQ ID NO: 245034 - RNA, 64 nt, Human
aaauuagccgggcgugguggcgggcgccuguagucccagcuacucuggaggcugaggcaggaga

SEQ ID NO: 245035 - RNA, 64 nt, Human
ccuggguagcugggauuacaagcacccaaccacgcccagcuaauuuuuguauuuucgguagaga

SEQ ID NO: 245036 - RNA, 64 nt, Human
gccuguuccugcgucugcggagcggcccuugucucccagcuaucuauaaccuuagcuagagugu

SEQ ID NO: 245037 - RNA, 64 nt, Human
gcuugguucccagggacagucagggccucgggggcccagcuauguacaacgaagcugucgaagg

SEQ ID NO: 245038 - RNA, 64 nt, Human
cgaguagcugggauuacaggcaccugucaccacacccagcuaauuuuuguauuuuuaguagaga

SEQ ID NO: 245039 - RNA, 64 nt, Human
aaauuagccaagugugauggcacauaccuguaaucccagcuacuuggaauuggaaaucgccuga

SEQ ID NO: 245040 - RNA, 64 nt, Human
ccaacuugaguugcaucaucuuggaaccaggaagcccagcuaaagccaagagaccagagagucc

SEQ ID NO: 245041 - RNA, 64 nt, Human
aaauuagcugggcaugguggcgcacaccuguagucccagcuacucuggaggcugaggcagggga

SEQ ID NO: 245042 - RNA, 64 nt, Human
aaauuagcugggugcaguggcgcaugcuuguaaucccagcuacucaggaggcagaggcaggaga

SEQ ID NO: 245043 - RNA, 64 nt, Human
aaauuagccacaugugcuggcacuuaccuguagucccagcuacuugggaagcagaggcuggagg

SEQ ID NO: 245044 - RNA, 64 nt, Human
gaauuagcugggugugguggcacgcgccuguaaucccagcuacuuaggaggcugaggcaggaga

SEQ ID NO: 245045 - RNA, 64 nt, Human
aaauuaacugggugugguggcgggcgccuguaaucccagcuacugagggggcugaggcaugaga

SEQ ID NO: 245046 - RNA, 64 nt, Human
acaaaauccaggcgugguggcacacaccuguagucccagcuacucaggagguugagguaggaga

SEQ ID NO: 245047 - RNA, 64 nt, Human
aaauuagccaggcaugauggugcaugccuuuaaacccagcuacugaggaggcugaggcaugaga

SEQ ID NO: 245048 - RNA, 64 nt, Human
ugaguagcugggauuacagguuccugcuaccacgcccagcuaauuuuuguauuuuuaguagaga

SEQ ID NO: 245049 - RNA, 64 nt, Human
aaauuagccaggugugguggugcaugccuguaaucccagcuacucgggaggcugaggcaggaaa

SEQ ID NO: 245050 - RNA, 64 nt, Human
aauuuacucaggcaugauggcccauacuuguaaucccagcuauugggaaggaugagaugggagg

SEQ ID NO: 245051 - RNA, 64 nt, Human
ucagacgggcacagugguggugcccaccugugaucccagcuacucaggaggcugaggcaggaga

SEQ ID NO: 245052 - RNA, 64 nt, Human
aauauagccgggccugguggcgcacgccuguagucccagcuacucgggaggcugagguaggagg

SEQ ID NO: 245053 - RNA, 64 nt, Human
aaauuagccaggcgugguggcgggcgccuguaaucccagcuacuugggaggcugaggcaggaga

SEQ ID NO: 245054 - RNA, 64 nt, Human
aaauuagccagauauuguggcaggcacuuuuaaucccagcuacucgggaggcugaggcaggaga

SEQ ID NO: 245055 - RNA, 64 nt, Human
caugagaacauuauacuggaaguuacaugugauacccagcuaaagaauacauaucagaauauau

SEQ ID NO: 245056 - RNA, 64 nt, Human
uaauuagccaggcacaguggcaugcgccugugaucccagcuacuuggaaggcugaggugagagg

SEQ ID NO: 245057 - RNA, 64 nt, Human
aaauuagccgggugugguggugggcaccugucgucccagcuacuagggaggcugaggcaggaga

SEQ ID NO: 245058 - RNA, 64 nt, Human
aaauuagccagguauaguggcaggaaccuguaaucccagcuacaggggaggcugaggcaggaga

SEQ ID NO: 245059 - RNA, 64 nt, Human
guccugauaagacguccaccccccagggccaggucccagcuauguagacccccgcccccaccuc

SEQ ID NO: 245060 - RNA, 64 nt, Human
aaauuaauugggcauggugguggacaccuguaaucccagcuacuagggaggcugaggcaggaga

SEQ ID NO: 245061 - RNA, 64 nt, Human
aaauaagcugggcguggugguacacaccuguggucccagcuacuagggaggcugagccaggaag

SEQ ID NO: 245062 - RNA, 64 nt, Human
aaauuagccgggcgugguggcgggcgccuguagucccagcuacucgggaggcugaggcaggaga

SEQ ID NO: 245063 - RNA, 64 nt, Human
uaaaaaauuaggcaugguggugcaugccuguauucccagcuacucaggagguugaggugggagg

SEQ ID NO: 245064 - RNA, 64 nt, Human
aaauuagccaggcaugguggcaggcgccuguaaucccagcuacucgggaggccaaggcaggaga

SEQ ID NO: 245065 - RNA, 64 nt, Human
cgaguagcugggacuacaggcgugagccagcacgcccagcuaauuuuuguauuuuuaguagaga

SEQ ID NO: 245066 - RNA, 64 nt, Human
aaauuagcugggcgugguggcgugcaccuguagucccagcuacucaggauccugaggcaugaga

SEQ ID NO: 245067 - RNA, 64 nt, Human
uuacaaaaauacaaaaauuagcuggacguguagucccagcuacuuaggaggcugaggggcaagg

SEQ ID NO: 245068 - RNA, 64 nt, Human
ugaauaccugggacuucaggcacgcgccacuacacccagcuaauuuuuaaacuauaauuuuuuu

SEQ ID NO: 245069 - RNA, 64 nt, Human
uugggguugguucuggguggugaaccggggcagacccagcuaauggauuaaaaaacugcccuuc

SEQ ID NO: 245070 - RNA, 64 nt, Human
ugaguagcugggacuacaggcgcccgccaccaugcccagcuaauuuuuuguauuuuuauagagg

SEQ ID NO: 245071 - RNA, 64 nt, Human
aaauuaguccggcgugguggcacacuccuguaaucccagcuacuuaggaggcugaggugggaga

SEQ ID NO: 245072 - RNA, 64 nt, Human
aaauuagccaggcaggguggugcaugccuguagucccagcuacuugggaggcugaggcaggaga

SEQ ID NO: 245073 - RNA, 64 nt, Human
ggaguucuaggaacucagugcaauacgggagugacccagcuacugaaccagccacgaacagccc

SEQ ID NO: 245074 - RNA, 64 nt, Human
aauuuagccgggcgugguggugcaggccuguaaucccagcuacucgggaggcuaaagcaggaga

SEQ ID NO: 245075 - RNA, 64 nt, Human
aaacuagccgggcacaguggcgugcgccuguagucccagcuacucgggaggcugaggcaggagg

SEQ ID NO: 245076 - RNA, 64 nt, Human
aaauuagccaggcgugguggcgagcaccugucaucccagcuacuugggaggccuaggcgugaga

SEQ ID NO: 245077 - RNA, 64 nt, Human
agugauaccuauuacggaugaguucuggaaaagacccagcuaugauucauaaaaacacuucugg

SEQ ID NO: 245078 - RNA, 64 nt, Human
aaauuagccagguguggugguacaugccuguaaucccagcuacuagggaggcugaggcaggaga

SEQ ID NO: 245079 - RNA, 64 nt, Human
caugagauacuaagugguggagccaagauuugaacccagcuagaaugugccuguguacuggaca

SEQ ID NO: 245080 - RNA, 64 nt, Human
agguguggcggcguaaucccagcuggccuguaaucccagcuacuugggaggcugaggcagaacu

SEQ ID NO: 245081 - RNA, 64 nt, Human
cgaguagcugggaguacaggcacacaccaccacacccagcuaauuuuuguauuuuuaguagaga

SEQ ID NO: 245082 - RNA, 64 nt, Human
aaauuagcugggugugguggcgcaugccuguaaucccagcuacuugggagacugaggcaagaga

SEQ ID NO: 245083 - RNA, 64 nt, Human
aaauuagcuggacaugguaaugaaugccuguagucccagcuacuccggacacugaugugagagg

SEQ ID NO: 245084 - RNA, 64 nt, Human
ugaguagcugggacuacaggcaugcaccaccacgcccagcuaauuuuucuuauuuuuuguagag

SEQ ID NO: 245085 - RNA, 64 nt, Human
cugguuugacucauuaauuucucucaauuugggucccagcuaaagagguggggugaagcugggg

SEQ ID NO: 245086 - RNA, 64 nt, Human
ugaguagcuggcacuguaggcauguaccaccaugcccagcuaauuuuuauauuuuuaguagaga

SEQ ID NO: 245087 - RNA, 64 nt, Human
cgagcagcuggaauuacaggcacgugccacgacacccagcuaauuuuuguauuuuuaguagaga

SEQ ID NO: 245088 - RNA, 64 nt, Human
cgaguagcugggauuacaggugcccaccaccgcgcccagcuaauuuuuuaauuuuuaguagaga

SEQ ID NO: 245089 - RNA, 64 nt, Human
aaguuagccgggcguaguggcacaugccuguaaucccagcuacccggggaggcugaggcaggag

SEQ ID NO: 245090 - RNA, 64 nt, Human
aaauuagucggacaugguggcaggcaccuguagucccagcuacucgggaggcugaggcaggaga

SEQ ID NO: 245091 - RNA, 64 nt, Human
aaauuagcuaggcgggguagugcaugccuguaaucccagcuacucaggaggcugaggccggaga

SEQ ID NO: 245092 - RNA, 64 nt, Human
aucuugugcagggacauggugagugcccugaugccccagcuagcaggagcuacugugcucaucu

SEQ ID NO: 245093 - RNA, 64 nt, Human
acaugccguuucaugucaccugcuacagcucucccccagcuaguaugaugauccuguuuuacaa

SEQ ID NO: 245094 - RNA, 64 nt, Human
gcauuagccgagccugguggugcgugccuguaaucccagcuacucaggaggcugaggcaggaga

SEQ ID NO: 245095 - RNA, 64 nt, Human
agaggcuucugucuuauuugaaggccagcccacacccagcuacuuuaacaccagguuuauggaa

SEQ ID NO: 245096 - RNA, 64 nt, Human
uuagagcugccugugccuuuugccauccccucaacccagcuaugguucucucgcaagggaaguc

SEQ ID NO: 245097 - RNA, 64 nt, Human
caaguagcugggauuacaggugugugccgcaaugcccagcuaauuuuuguguuuuuaguagaga

SEQ ID NO: 245098 - RNA, 64 nt, Human
ggcaugguggcacacaccuguaguccccuguagucccagcuacucgggaggcugaggcaggaga

SEQ ID NO: 245099 - RNA, 64 nt, Human
aaaauagccgggcgugguggcaggcgccuguaaucccagcuacuggggaggcugaggcaggaga

SEQ ID NO: 245100 - RNA, 64 nt, Human
uagagagccgcucuguuuccucccagaagcaucucccagcuaagcucgcauuauuuuucuccuc

SEQ ID NO: 245101 - RNA, 64 nt, Human
aaaaauuagccaggugguggcacacgccuguaaucccagcuacucaggaggcugaggcaggaga

SEQ ID NO: 245102 - RNA, 64 nt, Human
cugacugaaaaaauuaggugugcacaccuguaaucccagcuaccugggaggcugagguaugagg

SEQ ID NO: 245103 - RNA, 64 nt, Human
cucggaccuccaggcggcucagugcugccugcggcccagcuaaggggccuggccacugggugcc

SEQ ID NO: 245104 - RNA, 64 nt, Human
aaauuagcccggcgugguggugcacgccuguaaucccagcuacucgggaggcugaggcaggaga

SEQ ID NO: 245105 - RNA, 64 nt, Human
aaauuagccgggcaugguggugcacgccucuaaucccagcuacucgggaggcugaggcaggaga

SEQ ID NO: 245106 - RNA, 64 nt, Human
aaacuagccaggcgugguggugggcaccuguaaucccagcuacuugggaggcugaggcaggaga

SEQ ID NO: 245107 - RNA, 64 nt, Human
aaaucagccaggcgugguggcagaccccuguaaucccagcuacucaagaggcugagguaggaga

SEQ ID NO: 245108 - RNA, 64 nt, Human
auacaagccgggcgugguggcgcaugccuguaaucccagcuacucaggaggcugaggcaggaaa

SEQ ID NO: 245109 - RNA, 64 nt, Human
ugaguagcugggacuacaggcucaugccaucaugcccagcuaauauuuuuuuauuuucguggag

SEQ ID NO: 245110 - RNA, 64 nt, Human
aaacuagcugggcgugguggcgggcgccuauaaucccagcuacuugggaggcugaggcaggaga

SEQ ID NO: 245111 - RNA, 64 nt, Human
gaaaaguugcugucaucaaaauggcagccuuuuccccagcuacuguuuuuggggccaagauggc

SEQ ID NO: 245112 - RNA, 64 nt, Human
cgaguagcugggauuacaggugccugccaccacacccagcuaauguuuuguauuuuuaguagag

SEQ ID NO: 245113 - RNA, 64 nt, Human
agaguagcuggaacuacaggugcccgccacuaugcccagcuaauuuuuguauuuuuuaguagag

SEQ ID NO: 245114 - RNA, 64 nt, Human
aaauuagccgggcgugguggcccacgccuguaaucccagcuacucgggaggcuaaggcaggaaa

SEQ ID NO: 245115 - RNA, 64 nt, Human
aaauuagccgggcgugguagcgggcgccuguagucccagcuacucgggaggcugaggcaggaga

SEQ ID NO: 245116 - RNA, 64 nt, Human
aaauuagccaggcaugauggugugcaccuguagucccagcuacucaggaggcugaggcaggaga

SEQ ID NO: 245117 - RNA, 64 nt, Human
aaaaaugccaggugugguggggugcaccuguagucccagcuacuagggaggcugagccaggagg

SEQ ID NO: 245118 - RNA, 64 nt, Human
aaaauuagcuggguguggugacgcuugccuguaucccagcuacucaggaagcugagacacgaga

SEQ ID NO: 245119 - RNA, 64 nt, Human
ccaaguagcugggauuacaggcaugugcaacucacccagcuaauuuuguauuuuuaguagagac

SEQ ID NO: 245120 - RNA, 64 nt, Human
aagccccugcuccagaagauagcuucaccccaaucccagcuaccucaaccaaugccaaaaaaag

SEQ ID NO: 245121 - RNA, 64 nt, Human
gcaaaccaccugcuacaggaccaccugcugccaccccagcuauugcauuuccagcugcugccag

SEQ ID NO: 245122 - RNA, 64 nt, Human
gcccgggucaggacccugcucuccuggcgcaguucccagcuaucuccccugcuccucugcuggu

SEQ ID NO: 245123 - RNA, 64 nt, Human
aaauuagccgggugugguggcaggcgccugaaaucccagcuacucaagaggcugaggcaggaga

SEQ ID NO: 245124 - RNA, 64 nt, Human
aaauuagcugggugugguggugggcgccuguagucccagcuacucgggaggcugaggcaggaga

SEQ ID NO: 245125 - RNA, 64 nt, Human
aaauuagcugggcaugguugcgcaugccuguaaucccagcuacuuuggaggcugagguggggag

SEQ ID NO: 245126 - RNA, 64 nt, Human
aaaucugccgggcgugguggcacacgccugaagucccagcuacucaggaggcugaggcaagaga

SEQ ID NO: 245127 - RNA, 64 nt, Human
aaauuagccaggcgcgguggcgggugccuguagucccagcuacucgggaggcugaggcaggaga

SEQ ID NO: 245128 - RNA, 64 nt, Human
ugaguagcugggacuacaggugugcaccaccaugcccagcuaguuuuuguauuuuuaguagaga

SEQ ID NO: 245129 - RNA, 64 nt, Human
aaauuagccaggcgugguggugggcgccuguagucccagcuacuugggaggcugaggcaggaga

SEQ ID NO: 245130 - RNA, 64 nt, Human
ggcagcaucagugauuacaagaaaaaugcuaagucccagcuauggauuucaggccucuacacuu

SEQ ID NO: 245131 - RNA, 64 nt, Human
aaauuagcuggaugugguggcauacacuuguagucccagcuacuuggcaggcugaggcagaaga

SEQ ID NO: 245132 - RNA, 64 nt, Human
guccuaaugugcugcccagaaaccucaacuguuccccagcuacugaggggcacugucagcgaga

SEQ ID NO: 245133 - RNA, 64 nt, Human
aagaaauuagccggguguggcacgcaccuguagucccagcuacuugggagccugaggcaggaga

SEQ ID NO: 245134 - RNA, 64 nt, Human
aaauuagccgggcaugguggugugcgccuguaaucccagcuacuggggaggcugaggcagaaga

SEQ ID NO: 245135 - RNA, 64 nt, Human
aucagggcucagggccuucacuucaagggcccuccccagcuacucgggaggcugaggcaggaga

SEQ ID NO: 245136 - RNA, 64 nt, Human
aaauuagcugggcaugguugcaggcgccuguagucccagcuacuugggaggcugaggcaggaga

SEQ ID NO: 245137 - RNA, 64 nt, Human
cuaguagcugggauuacaggcaugcaccaccauacccagcuaauuucuguauuuuuaguagaga

SEQ ID NO: 245138 - RNA, 64 nt, Human
aaauuagcuggaugugguggugcacaccugugaucccagcuacuugggaggcugaggugggaga

SEQ ID NO: 245139 - RNA, 64 nt, Human
caaguagcugguuguggcgccgcaugccuguagucccagcuacucgggaggcugaggcagggga

SEQ ID NO: 245140 - RNA, 64 nt, Human
ggugccucauacucaguauugaaaaccacuacaucccagcuaccuauaaugcugucagcucaaa

SEQ ID NO: 245141 - RNA, 64 nt, Human
aaauuagccaggcaugguggcgggcaccuguagucccagcuacuugggaggcugaggcaggaga

SEQ ID NO: 245142 - RNA, 64 nt, Human
ggggcuccccaggcccagggcucaacuucauggccccagcuauauccccccaguuccacacuaa

SEQ ID NO: 245143 - RNA, 64 nt, Human
aacacaucuucaaggcggcagagcugugcgcccacccagcuauugaaaaggacuuucugugggc

SEQ ID NO: 245144 - RNA, 64 nt, Human
gucccaccauguuacccagccuggucucaaacuccccagcuaaagcaguccuccagccucggcc

SEQ ID NO: 245145 - RNA, 64 nt, Human
ugaguagcugggaugacaggcacccgccaccacacccagcuaauuuuuguacuuuuaguagaga

SEQ ID NO: 245146 - RNA, 64 nt, Human
aaauuagccggacaugguggcgaaugacuguaaucccagcuacucaggaggcugaggcaggaga

SEQ ID NO: 245147 - RNA, 64 nt, Human
auucuacuugcucacaugguggucuaagaaauuucccagcuauagaaaucucucuauuuuugcc

SEQ ID NO: 245148 - RNA, 64 nt, Human
aaauuagcugggcguguuggcacacaccuguaaucccagcuacucaggaggcugaggcaggaga

SEQ ID NO: 245149 - RNA, 64 nt, Human
aaauuagcugggcaugauggcgagugucuguaaucccagcuacucaggaggcugaggcgggaga

SEQ ID NO: 245150 - RNA, 64 nt, Human
aaauuagccgggcgugguggcgggcaccuguagucccagcuacacgggaggcugaggcaggaga

SEQ ID NO: 245151 - RNA, 64 nt, Human
aaaaagcugggcugugguggcaggcgccuguaaucccagcuacucaggaggcugaggcaggaga

SEQ ID NO: 245152 - RNA, 64 nt, Human
caaauagcugggauuacaguugccugccaccacgcccagcuaauuuuuauauuuuuaguacaga

SEQ ID NO: 245153 - RNA, 64 nt, Human
aaauuagccaggcgugguggcaggugccuguaaucccagcuacuugggaggcugaggcaugaga

SEQ ID NO: 245154 - RNA, 64 nt, Human
aaauuagccgggcaugguggugcaugccuguaaucccagcuacucgggaggcugaggcaggaga

SEQ ID NO: 245155 - RNA, 64 nt, Human
aaauuagcuaggugugguggugcgcaccuguggucccagcuacucgggaggcuguggugggagg

SEQ ID NO: 245156 - RNA, 64 nt, Human
aaaaaaguuaggcguggcgaugugcaccuguagucccagcuacucgggggcugagccaggcgga

SEQ ID NO: 245157 - RNA, 64 nt, Human
aaauuagccuggugugguggcccgcaccuguggucccagcuacccgggaggcugaguugggagg

SEQ ID NO: 245158 - RNA, 64 nt, Human
cuccauccguaccuugccuagccucucccucucccccagcuagucccugagcaauacggcagac

SEQ ID NO: 245159 - RNA, 64 nt, Human
augaugccgucaugcugcuggccugagacaguaucccagcuacaacaggacgacaccggguuca

SEQ ID NO: 245160 - RNA, 64 nt, Human
aaauuagccgggcgugguggcgggcaccuguagucccagcuacucgggaggcugaggcaggaga

SEQ ID NO: 245161 - RNA, 64 nt, Human
aaaucagcuggguacgguggcacgugccugugaucccagcuacuugggaggcugaggcaggagg

SEQ ID NO: 245162 - RNA, 64 nt, Human
ugaguagcugggacuacaggcacccgccaccaugcccagcuaauuuuuguauuuuuaguagaga

SEQ ID NO: 245163 - RNA, 64 nt, Human
cccccagccggccugagugggggauauugacacccccagcuaaagcacaagcaccuuagucacc

SEQ ID NO: 245164 - RNA, 64 nt, Human
aaauuagccaaguuugguggcaugcaccuguaaucccagcuacuugggaggcugaggcaggaga

SEQ ID NO: 245165 - RNA, 64 nt, Human
aaguuagcuggucaugguggugcgggccuguaaucccagcuacucgggaggcugaugcgggaga

SEQ ID NO: 245166 - RNA, 64 nt, Human
aaauacaaaaauuauggugacgccugccuguagucccagcuacucgggaggcugaggcaggagg

SEQ ID NO: 245167 - RNA, 64 nt, Human
aaauuacccggacgugguggcgcaugccuguaaucccagcuacuugggagccugaggcgggaga

SEQ ID NO: 245168 - RNA, 64 nt, Human
aaauuagccagacgugguggugcacgccuuuaaucccagcuacucgggaggcugaggcaggaga

SEQ ID NO: 245169 - RNA, 64 nt, Human
aaauuagcugggcuugguggcuggcgccuguaaucccagcuacucaggagacugaggcagaagg

SEQ ID NO: 245170 - RNA, 64 nt, Human
gugguggugggcaccuguacuggggaggugcccacccagcuacuggggaggcugagucaggaga

SEQ ID NO: 245171 - RNA, 64 nt, Human
aaauuagccgggcgugguggcggccgccuguaaucccagcuacuugggaggcugaggcgugaga

SEQ ID NO: 245172 - RNA, 64 nt, Human
auagaggccagacacgguggcgcaugccuguagucccagcuaacugggaggcugaggcaggagg

SEQ ID NO: 245173 - RNA, 64 nt, Human
aaauuagccaugcguaguggugcaugccuguaaucccagcuacucgggaggcugaggcaggaga

SEQ ID NO: 245174 - RNA, 64 nt, Human
caaguagcugggauaacaggugccagccaccaugcccagcuaauuuguguauuucuaguagaga

SEQ ID NO: 245175 - RNA, 64 nt, Human
aaauuagccgggcaugguggcacaugccuauagucccagcuacucaggagguuaaggcaagaga

SEQ ID NO: 245176 - RNA, 64 nt, Human
aaauuagccgggugugguggcgugcgccuguagucccagcuacucgggaggcugaagcagaaga

SEQ ID NO: 245177 - RNA, 64 nt, Human
ccaguagcugggacuacaggcgcccgccaccacgcccagcuaauuuuuuguauuuucauuagag

SEQ ID NO: 245178 - RNA, 64 nt, Human
uguauagccagaugcaguggcacaugccuguaaucccagcuacuugggaggcugauagaagaag

SEQ ID NO: 245179 - RNA, 64 nt, Human
aaauuagcugggcgugguggcgcaugccuauaaucccagcuacuugggaggcugagguaggaga

SEQ ID NO: 245180 - RNA, 64 nt, Human
aaauuagccgggugugguggcacacaccuguagucccagcuacucgggaggcugaggcaggaga

SEQ ID NO: 245181 - RNA, 64 nt, Human
acccuccuggggacuacaggugcgugcuaccauacccagcuaauuuaaacaaauuuuuuuuuug

SEQ ID NO: 245182 - RNA, 64 nt, Human
caaagcgcuaggauuccaggugugagcuacugugcccagcuaaaauagggauuuuuauauuaaa

SEQ ID NO: 245183 - RNA, 64 nt, Human
aaauuagcuaggcauuguggggggugccuguaaucccagcuacucaggaggcugaggcaggaaa

SEQ ID NO: 245184 - RNA, 64 nt, Human
agcucugaaaugcgaugugaucuguaccaggucacccagcuaugcugcaaaguggguuggccaa

SEQ ID NO: 245185 - RNA, 64 nt, Human
ugauuggccgagcaugguggugcacaccaguauucccagcuacucuggaggcugaggcggaggc

SEQ ID NO: 245186 - RNA, 64 nt, Human
cgaguagcugggacuacaggugcccgccaccacacccagcuaauuuuuuguauuuuuaguagag

SEQ ID NO: 245187 - RNA, 64 nt, Human
aaagccaggugugguuguggcgggugccuguagucccagcuacucaggaggcugagguaggaug

SEQ ID NO: 245188 - RNA, 64 nt, Human
aaauuagccgggugugguggcacaugccuguaaucccagcuacuccggaagcugaggcaggaga

SEQ ID NO: 245189 - RNA, 64 nt, Human
cagccuccugaguagcugggacuacaggccccugcccagcuaauuuuuuguauuuuuuuuuagu

SEQ ID NO: 245190 - RNA, 64 nt, Human
ccaugguggggcuaggcuggggcucaccccccuccccagcuauuuuaugucuguaauuaaauau

SEQ ID NO: 245191 - RNA, 64 nt, Human
aaauuaacugggcaugguagugggugccuguaaucccagcuacuugggaggcugaggugggaga

SEQ ID NO: 245192 - RNA, 64 nt, Human
agaaacuggggucuuccucucccccgaaccucuccccagcuagucuucccucuguucuuccugc

SEQ ID NO: 245193 - RNA, 64 nt, Human
ugaguagcugggacugcaggcacgcgccaccacgcccagcuaauuuuuguauuugaguagagac

SEQ ID NO: 245194 - RNA, 64 nt, Human
aaauuagccaggcgugguggugcacaccuguaaucccagcuacucgggaggcugaggcaagaga

SEQ ID NO: 245195 - RNA, 64 nt, Human
cgaguagcuaggauuacaggugcgugccaccacgcccagcuaauuuuuauauguuuaguggaaa

SEQ ID NO: 245196 - RNA, 64 nt, Human
caccagugugcauacagucauggaguuggguauucccagcuaccagggaggcugaggugggagg

SEQ ID NO: 245197 - RNA, 64 nt, Human
caaguagcugggauuacaggcguguaccaccauacccagcuaauuuuuguauuuuuaguagaga

SEQ ID NO: 245198 - RNA, 64 nt, Human
aaaauuagcuggaugugguggcagugccuguaaucccagcuauuugggaggcugaggcaggaga

SEQ ID NO: 245199 - RNA, 64 nt, Human
caaguagcuggaauuacaggcacauaccacugcacccagcuaauuuuuguauuuuuaguagaga

SEQ ID NO: 245200 - RNA, 64 nt, Human
ugaguagcugggauuacaggugugcgccgccacacccagcuaauuuuguauuuuuaguagagac

SEQ ID NO: 245201 - RNA, 64 nt, Human
aaauuagccaggcgugguggcgugcauuuguaaucccagcuacacaggaggcugaggcaggaga

SEQ ID NO: 245202 - RNA, 64 nt, Human
ugaguaccugagauuacaggcacccaccaccaugcccagcuaauuuuuguauuuuuaauagaaa

SEQ ID NO: 245203 - RNA, 64 nt, Human
ugaguagcugggauuaugaguacacaccaccacgcccagcuaauuuuuguguuuuuaguggaga

SEQ ID NO: 245204 - RNA, 64 nt, Human
aaauuagcuaggcaugguggcgggcuccuguagucccagcuacucaggaggcugaggcaggaga

SEQ ID NO: 245205 - RNA, 64 nt, Human
caaguagcugggacuacaggcgccugccaccacgcccagcuaguuuuuuuuuuuuuuuguauuu

SEQ ID NO: 245206 - RNA, 64 nt, Human
acaccugggaaguggggccggccacagccauagccccagcuagugaccccaguuagcacccacc

SEQ ID NO: 245207 - RNA, 64 nt, Human
ccugaugacacccugcgagaccuggagcguagggcccagcuagcccgcaccuggauuuccaccg

SEQ ID NO: 245208 - RNA, 64 nt, Human
aaauuagccgggugugguggcgcgugccuauaaucccagcuacucgggaggcugaggcaggaga

SEQ ID NO: 245209 - RNA, 64 nt, Human
aaaauagccgggccugguggcgggcgccuguagucccagcuacuugguaggcugaggcaggaga

SEQ ID NO: 245210 - RNA, 64 nt, Human
aaauuugccgggcgugguggugcaugccuguaaucccagcuacuugggaagcugaggcaggaga

SEQ ID NO: 245211 - RNA, 64 nt, Human
guuuuggcugggcaugauggugagcgccugcagucccagcuacuugggaggcuaagcccaguuc

SEQ ID NO: 245212 - RNA, 64 nt, Human
aaguacaaaaauuagcugggcgugcaccacugcgcccagcuaauucuuguauuuuugguagaga

SEQ ID NO: 245213 - RNA, 64 nt, Human
aaaaauuuagccagguguggugggcaccuguaaucccagcuacuugggaggcugaggcaaguga

SEQ ID NO: 245214 - RNA, 55 nt, Human
agaaggaugucagugugugaccugccccagcuaccaccgccaccugcuuccaggc

SEQ ID NO: 245215 - RNA, 64 nt, Human
aucucuacaaaauguggugacacaugccuguagucccagcuacucaggaggcuggggaaggaag

SEQ ID NO: 245216 - RNA, 64 nt, Human
caaagugcuaggauuccaggcgugagccaucgugcccagcuagacgucuuccuuuuuuuuuuuu

SEQ ID NO: 245217 - RNA, 64 nt, Human
aaaguagcugggauuacaggcaugcgccaccacacccagcuaauuuuuuguauuugguagagau

SEQ ID NO: 245218 - RNA, 64 nt, Human
aaacuagccaggcgugguggugcgcgccuguagucccagcuacuugggaggcugagcccuggag

SEQ ID NO: 245219 - RNA, 64 nt, Human
aaauuacccggaugugauggcacaugccuguaaucccagcuacucaggaggcugaggcaggaua

SEQ ID NO: 245220 - RNA, 64 nt, Human
aaaaguagcagguguggugguaugccccuguagucccagcuacuugggaggcugaggugggaag

SEQ ID NO: 245221 - RNA, 64 nt, Human
aacuuagccaggcaugguggugcgcaccuguagucccagcuacucuggaggcugaggcagggga

SEQ ID NO: 245222 - RNA, 64 nt, Human
caaguagcugggauuacaagugcccaccaccaugcccagcuaauuuuuauauuuuuaguagaga

SEQ ID NO: 245223 - RNA, 64 nt, Human
aaauuagccaggcaugguggcaccugccuguaaucccagcuacuugggaggcugaggcaggaga

SEQ ID NO: 245224 - RNA, 64 nt, Human
aaauuggcugggcaugguggcgggugccuguaaucccagcuacuggggaggcugaggcaggaga

SEQ ID NO: 245225 - RNA, 64 nt, Human
aauuagccaggcaugguggugugcaccugagaaucccagcuacucagaagguugagacaaaggg

SEQ ID NO: 245226 - RNA, 64 nt, Human
aaaugaaccaggcaugguagugcaugccucuaaucccagcuacucaggaggcuaaggcaggaga

SEQ ID NO: 245227 - RNA, 64 nt, Human
aucuucagauuucucuguauuuauuauguguauccccagcuauguaugcagcacagcccaucuc

SEQ ID NO: 245228 - RNA, 64 nt, Human
uaaguagcugggauuacaggcacccaccaccaugcccagcuaauuuuuguauuuuaguagagac

SEQ ID NO: 245229 - RNA, 64 nt, Human
aaauuagccgggcgugguggcgggcgccuguagucccagcuaugcgagaggcugaggcaggaga

SEQ ID NO: 245230 - RNA, 64 nt, Human
aaauuagccaggaguaguggcgcaugccuguagucccagcuacuugggaggcugaugcaugaga

SEQ ID NO: 245231 - RNA, 64 nt, Human
aaauuagccaggcaugguggugcaugccuguaaucccagcuacuugggaggcuaaggcaggaga

SEQ ID NO: 245232 - RNA, 64 nt, Human
caaguagcugggauuacaggcaugcgccaccaugcccagcuaauuguauuuuaguagauaugga

SEQ ID NO: 245233 - RNA, 64 nt, Human
aaauuagccaggcguggucacaugcgccuguaaucccagcuacucgggcagcugagacaggaga

SEQ ID NO: 245234 - RNA, 64 nt, Human
aaaauuagccaggcaugguggugccgccuguagucccagcuacucaggaggcuugggugggagg

SEQ ID NO: 245235 - RNA, 64 nt, Human
gacucaccuguucucacgcccuguuuuaauuuaacccagcuaugggaugccagauaacagaauu

SEQ ID NO: 245236 - RNA, 64 nt, Human
aaauuagcugaggguggugacgcaugccuguaaucccagcuacucgggaggcugaggcagagaa

SEQ ID NO: 245237 - RNA, 64 nt, Human
aaauuagcugggcacgguggugugugccuguagucccagcuacuggugaggcugaggcuggagg

SEQ ID NO: 245238 - RNA, 64 nt, Human
aaauuagccgggugugguggggugcgcuuguaaucccagcuacucgggaggcugaggcaggaga

SEQ ID NO: 245239 - RNA, 64 nt, Human
aaauuagcugggcgugguggcgcgcgccuguaaucccagcuacucaggaggcugaggcagauga

SEQ ID NO: 245240 - RNA, 64 nt, Human
aaauuagccgggcaugguggugcacgccuauagucccagcuacucgggaggcugagguaggaga

SEQ ID NO: 245241 - RNA, 64 nt, Human
gaguagcugggauuacaggcaugcaccaccacagcccagcuaauuuuuuguauuuuuaguagag

SEQ ID NO: 245242 - RNA, 64 nt, Human
aaauuagccgggugcgguggcgggcaccuguagucccagcuacucgggaggcugaggcaggaga

SEQ ID NO: 245243 - RNA, 64 nt, Human
aaauuagcugagugugguggcacaugccugugaucccagcuacucaggaagcugaggcagaaag

SEQ ID NO: 245244 - RNA, 64 nt, Human
cccaccuugggccucaccuccuccaggaagccuucccagcuacccgaagcucagguggccuucu

SEQ ID NO: 245245 - RNA, 64 nt, Human
aaauuagccgggcaugguggcgggcgccuaaaaucccagcuacucgggagacuaggcagagaau

SEQ ID NO: 245246 - RNA, 64 nt, Human
aaauuagccuggugugguggcgagugccuguaaucccagcuauucaggagggugaggcagaaga

SEQ ID NO: 245247 - RNA, 64 nt, Human
aaauuagccaggcgugguugugggcgccuguagucccagcuacucaggaggcugaggcaggaga

SEQ ID NO: 245248 - RNA, 64 nt, Human
aaauuagccgggcgugguggcaggugccuguaaucccagcuacuugggaggcugaggcaggaga

SEQ ID NO: 245249 - RNA, 64 nt, Human
caauuagcuaggccugguggcgugcgccuguaaucccagcuauauaggaggcugaggcaggaga

SEQ ID NO: 245250 - RNA, 64 nt, Human
aaauuagcugggugugguggugcacgccuguaaucccagcuacucgggaggcugaggcaggaga

SEQ ID NO: 245251 - RNA, 64 nt, Human
aaauuagccaggcaugguggcgggcaccuguagucccagcuacucaggaggcugaggcaggaga

SEQ ID NO: 245252 - RNA, 64 nt, Human
ccuuggagaggguccuggagagaauuuccucuuccccagcuaaauacccugccugcaacugaag

SEQ ID NO: 245253 - RNA, 64 nt, Human
agacccagcuaaagucaccugccuguucuaaaggcccagcuacagccaaucagccgauuuccug

SEQ ID NO: 245254 - RNA, 64 nt, Human
gacccagcuuuauucaccugacuguuuccagagacccagcuaaagucaccugccuguucuaaag

SEQ ID NO: 245255 - RNA, 64 nt, Human
cuuggacagacuguuucucaguuauuuccagagacccagcuacaguucccuggcuguuucuaga

SEQ ID NO: 245256 - RNA, 64 nt, Human
aaauuaguuugacgggguggcgugugccuauggucccagcuacucaggaggcugaggcaggaga

SEQ ID NO: 245257 - RNA, 64 nt, Human
cgauuagcugggaucacaggugugcaccaccaugcccagcuaauuauuuauuucuuuuguauuu

SEQ ID NO: 245258 - RNA, 64 nt, Human
aaauuagccaggcauaguugugggcaccuguaaucccagcuacccgggaggcugaggcaggaga

SEQ ID NO: 245259 - RNA, 64 nt, Human
aaauuagccgggcaugguagcaggugccuguagucccagcuacucgggaggcugaggcaggaga

SEQ ID NO: 245260 - RNA, 64 nt, Human
aaauuaucugggcauaguagugugugccuguaaucccagcuacuugggaagcugaggcaggaga

SEQ ID NO: 245261 - RNA, 64 nt, Human
ugaguagcugggcugacaggcacccaccaccacacccagcuaauuuuuauguuuuuaguagaga

SEQ ID NO: 245262 - RNA, 64 nt, Human
gcugcccccagaacucccuucaagggaggacuuccccagcuaugggaagugccaucaggguggc

SEQ ID NO: 245263 - RNA, 64 nt, Human
uauacuaaaaaaaauacaaaaauuagcugggcaucccagcuaugcagaagcugaagcacaagaa

SEQ ID NO: 245264 - RNA, 64 nt, Human
aaauuagcugggcaugguggugcaugccuguagucccagcuacucaggaggcugagguaggaga

SEQ ID NO: 245265 - RNA, 64 nt, Human
uguaaaguuauuuggugucauugaccaauugcaucccagcuaaaaagcaagaggcaucguugcc

SEQ ID NO: 245266 - RNA, 64 nt, Human
uguauccugagguuccuagaucucacugaacuggcccagcuaaggagaccuggacucugggugu

SEQ ID NO: 245267 - RNA, 64 nt, Human
aagaugguggcuuuaaccugacugucuaaaaauucccagcuaagccuuuuccucuacucucuuc

SEQ ID NO: 245268 - RNA, 64 nt, Human
ggcagccuugggcaccugccaugucccuccuuuccccagcuauccccgcucugaccuugauuuu

SEQ ID NO: 245269 - RNA, 64 nt, Human
uacugauuguuuaagugugcauuaguugugucuccccagcuagauuguaagcuccuggaggaca

SEQ ID NO: 245270 - RNA, 64 nt, Human
uaagcagcugggacuacaggcgcaugcaaccauacccagcuaauuuauuuuuagcagagauggg

SEQ ID NO: 245271 - RNA, 64 nt, Human
uacaaaaauuagccgggugggacacgccuguaaucccagcuacucaagaggcugaggcaggaga

SEQ ID NO: 245272 - RNA, 64 nt, Human
aaauuagccagguaugguggugcauaccuguaaucccagcuacucgggaaccugaggcaggaga

SEQ ID NO: 245273 - RNA, 64 nt, Human
aaauuagccaggcgugguggcggucaccuguagucccagcuacucgggaggcugaagcaggaga

SEQ ID NO: 245274 - RNA, 64 nt, Human
cacagucagagaguagauugugcaugugugagcacccagcuacuggggacgggggcucucccac

SEQ ID NO: 245275 - RNA, 64 nt, Human
ugaguagcugggauuacaggcauguaccaccacacccagcuaauuuuguauuuuuaguagagau

SEQ ID NO: 245276 - RNA, 64 nt, Human
cagguagcaggaacuauaggcaugugccaccaugcccagcuaauuuuuuuauuuuuuguagaga

SEQ ID NO: 245277 - RNA, 64 nt, Human
agggugugugugacuacaaguacacacuaccacgcccagcuaauguguguuuuuguagagaugg

SEQ ID NO: 245278 - RNA, 64 nt, Human
cgaguagcugagacuacaggcaccugccaccauacccagcuaaguuauguauuuuuaguagaga

SEQ ID NO: 245279 - RNA, 64 nt, Human
aaauuagccgggugugguggcgcaugccuguaaucccagcuacuugggaggcugaggcagaauu

SEQ ID NO: 245280 - RNA, 64 nt, Human
gccagugcuggucacuaaccaacaagguuggcaccccagcuaccccuucuuugcagggcuaagg

SEQ ID NO: 245281 - RNA, 64 nt, Human
gcgugaagcugaagcucugucccuauucccccagcccagcuagcugaucacaccaacagauccu

SEQ ID NO: 245282 - RNA, 64 nt, Human
caaguagcugggauuacaggugcccaccaucaugcccagcuaauuuuuuguauuuuuaguagag

SEQ ID NO: 245283 - RNA, 64 nt, Human
aaauuagucagguguggcggugcgugccuguaaucccagcuauucaggaggcugaggcaccaga

SEQ ID NO: 245284 - RNA, 64 nt, Human
aaauuagccaggcaugguggcacacaccuguagucccagcuacucgggagcccaacgcacgaga

SEQ ID NO: 245285 - RNA, 64 nt, Human
aaauuagccgggcguuguggcgggcaccuggagucccagcuacuccggaggcugagggaggaga

SEQ ID NO: 245286 - RNA, 64 nt, Human
gcugggugugguggugggggugggcgccuguagucccagcuacgugggaggcugaggcagcaga

SEQ ID NO: 245287 - RNA, 64 nt, Human
aaauuagcugggcgugguggcgggcgccuguaaucccagcuacuugggaggcugaggcaggaga

SEQ ID NO: 245288 - RNA, 64 nt, Human
ggguagaaaaugauaaaaauagacuauugacugacccagcuaagaaucgugggcugagcagagu

SEQ ID NO: 245289 - RNA, 64 nt, Human
aaaauagcuggguguggugguacgugccuguagucccagcuacuucggggacugaggugggagg

SEQ ID NO: 245290 - RNA, 64 nt, Human
aaauuaguuggacaugauggugugcaccuauagucccagcuacucgggaggcugaagcagaagg

SEQ ID NO: 245291 - RNA, 64 nt, Human
aaauuagccaggcaggguggcaugugccuuuaaucccagcuacagggaggcugaggcaggagaa

SEQ ID NO: 245292 - RNA, 64 nt, Human
aaauuagcuaggcaugauggcgcaugccuauaaucccagcuacucgagugccugaggcaggaga

SEQ ID NO: 245293 - RNA, 64 nt, Human
aaaauuagcugggugugguggcggcgccuguaaucccagcuacuugggaggcuaaggcaugaga

SEQ ID NO: 245294 - RNA, 64 nt, Human
aaauuagccaggcgugauggcucaugccuguaaucccagcuacucgggaggcugaggcaggaga

SEQ ID NO: 245295 - RNA, 64 nt, Human
gccucccagcagagggccccaggaucuccaaggucccagcuauggcuuuggacaacguggcuuc

SEQ ID NO: 245296 - RNA, 64 nt, Human
aaauuagccaggcgugguggcacaugccuguaaucccagcuacucgggaggcugaggcaggaga

SEQ ID NO: 245297 - RNA, 64 nt, Human
aacaugacaacgccagggugaacacacgccacuucccagcuaggagugcacuuuaugggacugu

SEQ ID NO: 245298 - RNA, 64 nt, Human
ggaacucacuggaaagugacgcgcauggacggggcccagcuaggcgccaggacuuggccucacc

SEQ ID NO: 245299 - RNA, 64 nt, Human
aaauuagcugggugugguggugggugccuguaaucccagcuacaugggagccugaggcaugaga

SEQ ID NO: 245300 - RNA, 64 nt, Human
ccaguccuucccagaugauggcugccugugggaccccagcuacucccccagacccaaguucugc

SEQ ID NO: 245301 - RNA, 64 nt, Human
aaauuagccgggugugguggugggcgccuguagucccagcuacuugggaggcugaggcaggaga

SEQ ID NO: 245302 - RNA, 64 nt, Human
gccugccguguccaggauucaugaccaguagcagcccagcuaugccugccacgucucauggccc

SEQ ID NO: 245303 - RNA, 64 nt, Human
aaauuagccgggcgugguggcgggcgccuguagucccagcuacucugaagacugaggcaggaga

SEQ ID NO: 245304 - RNA, 64 nt, Human
uggaguagcugggccuacagugugugcugccacacccagcuaauacagucuuucuacucccgcu

SEQ ID NO: 245305 - RNA, 64 nt, Human
aaauuagccagauguggcggcaugucccuguggucccagcuacucaggaggcugaggugggagg

SEQ ID NO: 245306 - RNA, 64 nt, Human
ccaaguagcugggacugcaggcgcgcacaccacgcccagcuaauuuuuguauuuuuaguagaga

SEQ ID NO: 245307 - RNA, 64 nt, Human
aaauuagccgggcaugguggcgcgugccuguaaucccagcuacuugguaggccgaggcaggaga

SEQ ID NO: 245308 - RNA, 64 nt, Human
aaauuaguugggcaugguggcacacaccuguaaucccagcuacucggaggcugaggcacaagaa

SEQ ID NO: 245309 - RNA, 64 nt, Human
gcagccccccaccuucuggcccucccaccagaggcccagcuaccaaggccacauuguccaccac

SEQ ID NO: 245310 - RNA, 64 nt, Human
caaguagcugggacuacaggcgccuaccaccaugcccagcuaauuuuuguauuuuuaauagaga

SEQ ID NO: 245311 - RNA, 64 nt, Human
aauuagcgaggcguggugggcgggcgccuguaaucccagcuacuugggaggcugaggcagaaga

SEQ ID NO: 245312 - RNA, 64 nt, Human
aaauuagccaugcaugguggcucaugccuguagucccagcuacuugggaggcugaggcaggagg

SEQ ID NO: 245313 - RNA, 64 nt, Human
aaauuagccaggcgugguggcgggcgccuguagucccagcuacucuggaggcugaggcaggaga

SEQ ID NO: 245314 - RNA, 64 nt, Human
aaauaagcugggcgugguggcaggcgccuauaaucccagcuacucgggaggcugaggcaggaga

SEQ ID NO: 245315 - RNA, 64 nt, Human
aaauuagcugggcgugguggcggaugccuguagucccagcuacucaggaggcugaggcaggaga

SEQ ID NO: 245316 - RNA, 64 nt, Human
ucaucaagagcuccuucugcccuuguaagcccaucccagcuacuuguaaccaucucuaagggca

SEQ ID NO: 245317 - RNA, 64 nt, Human
aaauuaucugggcaugguggugcaugccuguaaucccagcuauucggaaggcugaggcaggaga

SEQ ID NO: 245318 - RNA, 64 nt, Human
aaauuagccgggugugguggcacaugccuguaaucccagcuacucgggaagcugaggcaggaga

SEQ ID NO: 245319 - RNA, 64 nt, Human
aaauuaguucaucgggguggcacacaucaguagucccagcuacucugcaggcugaggugggagg

SEQ ID NO: 245320 - RNA, 64 nt, Human
aaauuagccgggugugguagugcaugccuguagucccagcuacuugggaggcugaagugggagg

SEQ ID NO: 245321 - RNA, 64 nt, Human
aaauuauccgggcgugguggcacaugacuguaaucccagcuacucaggaggcugaggcaggagg

SEQ ID NO: 245322 - RNA, 64 nt, Human
aaaaaagcuggguaugguggcgcaugccuuuaaucccagcuacucgggaggcugaggcacgaga

SEQ ID NO: 245323 - RNA, 64 nt, Human
gagaguagcuaggacuacaggcgcagccaccacacccagcuaguuuuuuauuuuaauuuuuugu

SEQ ID NO: 245324 - RNA, 64 nt, Human
aaauuagccgggcaugguggcgugcaccuguaaucccagcuacucaggaggcugaggcaggaga

SEQ ID NO: 245325 - RNA, 64 nt, Human
caacauuccaccccagcaggacagugaccccagucccagcuaacucugaccugggagcccucag

SEQ ID NO: 245326 - RNA, 64 nt, Human
aaauuagccaagugcaguggcaugugcuuguaaucccagcuacucuggaggcugaggcaggaga

SEQ ID NO: 245327 - RNA, 64 nt, Human
aaacuuagcugguuagguggugcaugccuguagucccagcuacucgggaggccgaggcagaaga

SEQ ID NO: 245328 - RNA, 64 nt, Human
aaauuagccaagugugguggugugcaccuguagucccagcuacucgggaagcugguagaaagac

SEQ ID NO: 245329 - RNA, 64 nt, Human
agggagaggcuggcccgugucacugccucugucacccagcuauccucgcacucaaagccaucca

SEQ ID NO: 245330 - RNA, 64 nt, Human
aaauuagcuggacaugguggcaggcaccuguaaucccagcuacucggaaggcugaggaaggaga

SEQ ID NO: 245331 - RNA, 64 nt, Human
aaauuagcugggcgugguggcgugcaccuguaaucccagcuacucaggaggcugagacaggaca

SEQ ID NO: 245332 - RNA, 64 nt, Human; identical to SEQ ID NO: 244468

SEQ ID NO: 245333 - RNA, 64 nt, Human
aaguuagccaggugugaugaugugcaccuauagucccagcuacuugggaggcugcagcuguggc

SEQ ID NO: 245334 - RNA, 64 nt, Human
aaauuagccgggcaugguggcaggcaccuguaaucccagcuacuagggaggcuuuugaacccag

SEQ ID NO: 245335 - RNA, 64 nt, Human
aaauuagccacgcaugguggcacacaccuguggucccagcuacucgggaggcugaggugggagg

SEQ ID NO: 245336 - RNA, 64 nt, Human
cgaguagcugggauuaugggcgcccgccaccacgcccagcuaauuuuuguauuuuuaguagaga

SEQ ID NO: 245337 - RNA, 64 nt, Human
guuuccuaguagucccccaucccuuccucccuuacccagcuaugauucaguugucucugcccuc

SEQ ID NO: 245338 - RNA, 64 nt, Human
aaauuagcugggcgugguagugcaugccuguaaucccagcuacuugggaggcugaggcaggaga

SEQ ID NO: 245339 - RNA, 64 nt, Human
aaauuaacugggugugguggcgcgugccuguaaucccagcuacucgggaagcugaggcagguga

SEQ ID NO: 245340 - RNA, 64 nt, Human
ugaguagcugggauuacaggcacacaccaccaugcccagcuaacuuuuguauuuuuggcggaga

SEQ ID NO: 245341 - RNA, 64 nt, Human; identical to SEQ ID NO: 245062

SEQ ID NO: 245342 - RNA, 64 nt, Human
aaauuaacugggcaccaugacacacaccaguagucccagcuacuagggaggcaggaggaucacu

SEQ ID NO: 245343 - RNA, 64 nt, Human
uaaaaaauuagccaugguggugugcaccuguggucccagcuacuccagaggcugaggugggaag

SEQ ID NO: 245344 - RNA, 64 nt, Human
ccugccucagcgauuacaggaaugcaccaccacgcccagcuaauuuuguagagaugggguuucu

SEQ ID NO: 245345 - RNA, 64 nt, Human
aaauuagccgggcgugguggugcgugccuguagucccagcuacucgaaagguugaggcaagaga

SEQ ID NO: 245346 - RNA, 64 nt, Human
aacccucaugccuggaccccugagagcuucugaucccagcuauuagggacagaagaagccucca

SEQ ID NO: 245347 - RNA, 64 nt, Human
aaauuagcugggugugguggcaggagccuguaaucccagcuacacaggaggcugaggcacgaga

SEQ ID NO: 245348 - RNA, 64 nt, Human
gaaggguacuggagcuaauuuuuucuuccaguuucccagcuacccugccccagggaauuguguu

SEQ ID NO: 245349 - RNA, 64 nt, Human
caauacucccuucuuccugcccccacaccccauccccagcuagcccaagcuccaggucaggagg

SEQ ID NO: 245350 - RNA, 64 nt, Human
cuugaagccaggcaugguggcccacaccuguggucccagcuacucaggaggcugaggugggagg

SEQ ID NO: 245351 - RNA, 64 nt, Human
ucccuccccugcuaaucugaacuguguccugaaccccagcuauuggccaggccccuguuacaaa

SEQ ID NO: 245352 - RNA, 64 nt, Human
ccuggcccgccccucgcugcugcuacuacccgagcccagcuacauuccucagcugccaagcacu

SEQ ID NO: 245353 - RNA, 64 nt, Human
aaauuagucgggugucauugugcauaccuguagucccagcuauucaggagcugugguaggagga

SEQ ID NO: 245354 - RNA, 64 nt, Human
aauuuacccaggcacggcggcggacgcccaucaucccagcuacuugggaggcugaggcaggaga

SEQ ID NO: 245355 - RNA, 64 nt, Human
aaacuagccagaugcgguggcacccgccuguaaucccagcuacucgggaggcugaggcggaaga

SEQ ID NO: 245356 - RNA, 63 nt, Human
ggcgaccuccuuggccaagucugccuuucacccuggggugagcaucaguccuggcucugcugg

SEQ ID NO: 245357 - RNA, 63 nt, Human
aaaaaccaaggcccccuucccccaccucuuccauggggugagacuugagcagaacaggggcuu

SEQ ID NO: 245358 - RNA, 63 nt, Human
aaauguucuggguggggguagaaugaggugggguggggugagcuggcuuuggaauucuagggg

SEQ ID NO: 245359 - RNA, 63 nt, Human
uaacauagccccugcuuggaggcccuucucugauggggugacauaaucccuuccuccugggaa

SEQ ID NO: 245360 - RNA, 63 nt, Human
uggggaagagauuugaggaggaaagaaaggagauggggugagaggguuuuuaagucugaaacu

SEQ ID NO: 245361 - RNA, 63 nt, Human
aacuugacucugucccucuacaugucucuuuaauggggugagggugggggagagagggaauua

SEQ ID NO: 245362 - RNA, 63 nt, Human
acaccaugagccuccucgucacccuucuccuuuuggggugagagaccagcagcccaagggcuc

SEQ ID NO: 245363 - RNA, 63 nt, Human
cauaaucccuuccuccugggaaacaccagcuuuuggggugauagcacuuucaggcaggagcua

SEQ ID NO: 245364 - RNA, 63 nt, Human
cuuuccuagccagccgcacagucuaggcccuuguggggugaagaauggagggaggagcaggcu

SEQ ID NO: 245365 - RNA, 63 nt, Human
cugcccagacaggcugagccugggcgugguggguggggugauggcucuggggagcggcugcca

SEQ ID NO: 245366 - RNA, 63 nt, Human
uuagacauuacagguuaugcuuugagaucucuuuggggugaaggauugaaauuaaacccugag

SEQ ID NO: 245367 - RNA, 63 nt, Human
cuuguugcccuugaaacuugaaaauagggauucuggggugaggauacaaagacauugucuugc

SEQ ID NO: 245368 - RNA, 63 nt, Human
ugaggaaggagcuagggaaagagauagacacaauggggugaaaacaauuuugccgccccugcc

SEQ ID NO: 245369 - RNA, 63 nt, Human
uugggggagagcucaaguuggucaggcaacagcuggggugauggccugugagccacaggccac

SEQ ID NO: 245370 - RNA, 63 nt, Human
gugggauggcccacaccugggggaccuggcagauggggugaguuggguaaggaagaugaugcu

SEQ ID NO: 245371 - RNA, 63 nt, Human
cuaagaagguauuggggcagaggcuccccaaauuggggugaucccccaaggagugauacauau

SEQ ID NO: 245372 - RNA, 63 nt, Human
aaaucugucuccaggcuggagaggcaggagcccuggggugagaaaagcaaaaaacaaacaaaa

SEQ ID NO: 245373 - RNA, 63 nt, Human
aacucagcaggcuaaguugcgggguauauaaauuggggugaugaccccauagaccuaacugug

SEQ ID NO: 245374 - RNA, 63 nt, Human
gaauuacugucuagauggucugcagaacguguuuggggugagugggagugaggggcaauguua

SEQ ID NO: 245375 - RNA, 63 nt, Human
agcuggucccagucuugcgccuggcccucuuccuggggugauuuuccucgguggaggaggccc

SEQ ID NO: 245376 - RNA, 63 nt, Human
gaccaucaaagcagacuuuugugggcuccucuuuggggugaccacugcuuucaaagccaucug

SEQ ID NO: 245377 - RNA, 63 nt, Human
agugccauagccaggcucucugcugcccagcgcuggggugaggcugccguugucagcguggac

SEQ ID NO: 245378 - RNA, 59 nt, Human
cugaccuggaggaucucuagucacuguuauggggugauaagaggacuucuuggggccag

SEQ ID NO: 245379 - RNA, 63 nt, Human
ggaggagaugcugccccugugguuggaacauccuggggugacccccgacccagccucgcuggg

SEQ ID NO: 245380 - RNA, 63 nt, Human
caggugucuccuugcugucaucccacauagcccuggggugaaugugaauccagagucuauuuu

SEQ ID NO: 245381 - RNA, 63 nt, Human
ugaagggagcauggcgagacccauuggauggauuggggugaacaguucaggucccaugcuugg

SEQ ID NO: 245382 - RNA, 63 nt, Human
ucgcaggggccauuggggagcacagggccaggcuggggugaggagagcuccccuguuuucugu

SEQ ID NO: 245383 - RNA, 63 nt, Human
auaguuucaucucagcccccauuagagagaaguuggggugaauucuggaaaaaugucucuuuu

SEQ ID NO: 245384 - RNA, 63 nt, Human
gaugcaguccuagcguagcgaacguuccuggaguggggugaaggauaucaauauacuaaguuu

SEQ ID NO: 245385 - RNA, 63 nt, Human
agguauagcauuuaguccagauuugagaaaguuuggggugaacaagguaagaaagauuuuuuu

SEQ ID NO: 245386 - RNA, 63 nt, Human
gccacuccagcuugcccuuccacugccacucacuggggugaggcugggggucagcuuggugag

SEQ ID NO: 245387 - RNA, 63 nt, Human
uuaggcugcugggauggugggcuucagggcagguggggugagaauugggcggcucugaagcaa

SEQ ID NO: 245388 - RNA, 63 nt, Human
guuaagauugccacaguuccgaucucaacaguguggggugaaacaagaagacuguaucuucag

SEQ ID NO: 245389 - RNA, 63 nt, Human
acuauguuuccccccuuuucagaauagaacuauuggggugaggauaaggggugggggagaaaa

SEQ ID NO: 245390 - RNA, 63 nt, Human
uuccauggugcuccaguccacugaucuugggucuggggugauccaaauaccaccccagcucca

SEQ ID NO: 245391 - RNA, 63 nt, Human
ucucuccucuaaaauagcaagucugggaaauccuggggugaguggagucaccccacucccagu

SEQ ID NO: 245392 - RNA, 63 nt, Human
uauuuuuaacugacucuuuggaauccccugggguggggugagggguaaguuuaggcuuucgcg

SEQ ID NO: 245393 - RNA, 63 nt, Human
cuaggaucaccccccgcccuaaggggccuggccuggggugacguggccaggcagacugucugc

SEQ ID NO: 245394 - RNA, 63 nt, Human
ucauuuuccauucccuucacuguggcuaagggguggggugaggggauggagagggagggcugc

SEQ ID NO: 245395 - RNA, 63 nt, Human
agacgggcgaaacaacugaugggggaagauaccuggggugagaagaugagaaagaaaugaugc

SEQ ID NO: 245396 - RNA, 63 nt, Human
uggugaucgaguggucuguguuccuauugcugguggggugauagggugggcuaaaaaccaugc

SEQ ID NO: 245397 - RNA, 63 nt, Human
uacauucuuuuaauucugggaaauuagaaaaaguggggugaucuuuccaggaaaaacaugugu

SEQ ID NO: 245398 - RNA, 63 nt, Human
uuuuaauaagaauuacaaagacaauggcauacuuggggugagagggagcugaggaugucugag

SEQ ID NO: 245399 - RNA, 63 nt, Human
ugggcugagucccugggcucagaccuagcagcguggggugagucccugggcucaguccuagcu

SEQ ID NO: 245400 - RNA, 63 nt, Human
agcaauaguugauaggaugugaggguguuaccuuggggugaaguggagaaggucccaggugaa

SEQ ID NO: 245401 - RNA, 63 nt, Human
ugccauugccacucuacauggaaagauucugaauggggugagacuuaaaguuaugcuggcaga

SEQ ID NO: 245402 - RNA, 63 nt, Human
cuuaaaaagaacauuauaacugauuguugugaauggggugaauuuguuaaaaugaguaacuuu

SEQ ID NO: 245403 - RNA, 63 nt, Human
uagaaagccccuauaauguggaauaugcauauguggggugaaaccguauacuacuuucacugc

SEQ ID NO: 245404 - RNA, 63 nt, Human
auacaguggaggagucugagaagcagggaugccuggggugaucagcuccaaccaguggcagca

SEQ ID NO: 245405 - RNA, 63 nt, Human
ccccggagcccucccagcccucaggccugcgccuggggugagcugagcccgggacuccgccuu

SEQ ID NO: 245406 - RNA, 63 nt, Human
ucuuacuuccuuuguuacagggagggguuggcuuggggugaaaaguucugcccuccgcaggga

SEQ ID NO: 245407 - RNA, 63 nt, Human
guagcaugggggcaagaggcgugggauggggauuggggugagauggaugggagcccgcuggag

SEQ ID NO: 245408 - RNA, 63 nt, Human
gugguuuauggcaauaugaauggagcuuauuacuggggugagggacagcuuacuccauuugac

SEQ ID NO: 245409 - RNA, 63 nt, Human
gcuuagcuacaaaugccugucagucggagagaauggggugagcagccaccauucccaccagcu

SEQ ID NO: 245410 - RNA, 63 nt, Human
accuuugggugguaaugacuacggagcuaaaguuggggugacaaggaugggguaaaagaaaac

SEQ ID NO: 245411 - RNA, 63 nt, Human
ccugcaggcgugaccugacagcccaaggguggguggggugagggcuugaggacuugggcggga

SEQ ID NO: 245412 - RNA, 63 nt, Human
ugacagucagggaaggaugccucggagcugagguggggugagacagagugggagagauuacgg

SEQ ID NO: 245413 - RNA, 63 nt, Human
cuguucccuuccuguagcagcagcauuuaugaauggggugaauggggcuauugucgacggcac

SEQ ID NO: 245414 - RNA, 63 nt, Human
cuccaguuccuagaauaugaagagugcugucguuggggugaaaccaugagacugacagaucug

SEQ ID NO: 245415 - RNA, 63 nt, Human
uaaucuguguauucuuuuucuccuacuuuuuacuggggugagaggggcaugaagagaaauacg

SEQ ID NO: 245416 - RNA, 63 nt, Human
auuuugguaaaaaccuguagcgauucguuacacuggggugagaagagauaagagaaaugaaag

SEQ ID NO: 245417 - RNA, 63 nt, Human
ggaagaggguugugccaagguauugaugacaaauggggugauuugcuucauugagaucuugcu

SEQ ID NO: 245418 - RNA, 63 nt, Human
guagggcaguaacauuggguccugggucuuucauggggugaugcugggcuggcucccucuugg

SEQ ID NO: 245419 - RNA, 63 nt, Human
agauuccucauucagagugcccucuugugugacuggggugaugugcagcuuccauaauggaug

SEQ ID NO: 245420 - RNA, 63 nt, Human
aaaugugucagccauauguauggggcuuccauuuggggugaggagaaaguucuggaacuagau

SEQ ID NO: 245421 - RNA, 63 nt, Human
uaccgcgucuacccugggauucaggaaaaggccuggggugacccggcacccccugcagcuugu

SEQ ID NO: 245422 - RNA, 59 nt, Human
uuguaaguaaguaucgcugaaguugcugguggggugaagaggugggaagguccuggagu

SEQ ID NO: 245423 - RNA, 63 nt, Human
ggcuuuuugauaaacugcggccugcucucaggguggggugacuauuuuugaauuccuauuuau

SEQ ID NO: 245424 - RNA, 63 nt, Human
uagucuugucucucucauaugcuagguagcaaauggggugauauuuuuauagaagugggcaaa

SEQ ID NO: 245425 - RNA, 58 nt, Human
aggagaagaagcauaaaugaagccucuuuggggugaagccuggacaucccaucgaaug

SEQ ID NO: 245426 - RNA, 63 nt, Human
guuugauaguguuuuuaaaaguaauauauaauguggggugaaaugggaguagggggguggaca

SEQ ID NO: 245427 - RNA, 63 nt, Human
cagagguacuguuggguccuugucuugugagccuggggugagcucucuguacauguuguuguu

SEQ ID NO: 245428 - RNA, 63 nt, Human
ucaacagugugccucuguaguguggccuggugcuggggugaaggugagcugggcaaaggagaa

SEQ ID NO: 245429 - RNA, 63 nt, Human
caagccugaguagagcccaugcaaaggaagggauggggugagcgcaaggccuguggucagcag

SEQ ID NO: 245430 - RNA, 63 nt, Human
ucaaacuggagagaagcaagccagccaauagaauggggugauuuacagggauuucuguuuacu

SEQ ID NO: 245431 - RNA, 63 nt, Human
acugacauuucuucuagugaugaugguucacguuggggugauuuaauccaguuauaagaagaa

SEQ ID NO: 245432 - RNA, 63 nt, Human
uauugaaggaauuugggaggaggaaaagaaaccuggggugaauacuuauuuucagugcaucau

SEQ ID NO: 245433 - RNA, 63 nt, Human
gaaguucagccguugaacacauaggaaugucuguggggugacucuacugugcuuuaucuuuua

SEQ ID NO: 245434 - RNA, 63 nt, Human
ugcucaaguuugauucuguaccagaucuggguuuggggugauggcuugucgggggugggaggg

SEQ ID NO: 245435 - RNA, 63 nt, Human
ugcccaggacuaaggcccacggucacugugggcuggggugauggugucugaccaguggggaga

SEQ ID NO: 245436 - RNA, 63 nt, Human
gauggugauacaugucauuaguugcaacuucuuuggggugaucuauaguuugaaaacuaaaac

SEQ ID NO: 245437 - RNA, 63 nt, Human
cugagucaggguuggguuuuuuuuaaggggcuguggggugaaauguugacuggaagccaccca

SEQ ID NO: 245438 - RNA, 63 nt, Human
aggggguugggaggaaagugucuacuaggaggguggggugagauucuguguugauguaggagg

SEQ ID NO: 245439 - RNA, 63 nt, Human
gucuguauccugggccucagcaagccaugccccuggggugaggggaggcaucucccaccagcu

SEQ ID NO: 245440 - RNA, 63 nt, Human
ggcuggguugggaguagggugucccagugggguuggggugagcaggcugcugggaucccaugg

SEQ ID NO: 245441 - RNA, 63 nt, Human
cacaggagaggggcuucucuuccuggcuggggcuggggugaacuggaggcugguuaaguugca

SEQ ID NO: 245442 - RNA, 63 nt, Human
gagucucacuuuguugcccaggcuggagcgcaguggggugaucucaucucccugcaaccuccg

SEQ ID NO: 245443 - RNA, 63 nt, Human
ccucagcugaaugccuccuguggggaaagggguuggggugacagucaucaucagggccugggg

SEQ ID NO: 245444 - RNA, 63 nt, Human
cagagacccucggaccccugcagggccuggacuuggggugaacagggcuucagucagcgcaag

SEQ ID NO: 245445 - RNA, 63 nt, Human
agcgcccuaaagcagcaccagaugcuuuggaauuggggugaaacacccacauggcagccugcu

SEQ ID NO: 245446 - RNA, 63 nt, Human
cgcauggaauggggcuaaggugggagugaacacuggggugaauaaauuuuaaaucaauucaag

SEQ ID NO: 245447 - RNA, 63 nt, Human
uggaugggaaugauaguguaucucagcgggggguggggugacaucguucccuggggacauugg

SEQ ID NO: 245448 - RNA, 63 nt, Human
ccaccucugcagggguuuccucuucagccugccuggggugagaggucagugcaccacagccga

SEQ ID NO: 245449 - RNA, 63 nt, Human
uuugaauaaggcaaauuaggagaaagcccagguuggggugaaaucagacuuaacagauacaug

SEQ ID NO: 245450 - RNA, 63 nt, Human
agaugagugucagguuuucaggagagaaugaguuggggugagcccagagucugaaacuccuga

SEQ ID NO: 245451 - RNA, 63 nt, Human
aaacaaccuuuuugaaaaauuagagguuggggauggggugaaaaauuggcccuuguaugggag

SEQ ID NO: 245452 - RNA, 61 nt, Human
caaagcaggaugaugacugaaucuuggauuauggggugaagaggaguacagacuagguucc

SEQ ID NO: 245453 - RNA, 63 nt, Human
uucuucauuguaaaauacggaucauuuguauuuuggggugauaaaauaguucaccauggguau

SEQ ID NO: 245454 - RNA, 63 nt, Human
gaaaucuuagugugauacaucucucauacaguuuggggugaauuguaaaaaugaagaacuaua

SEQ ID NO: 245455 - RNA, 63 nt, Human
aauuuauaguaguagacuguaaaagauucauuuuggggugauaucuguauauauaacuuguuu

SEQ ID NO: 245456 - RNA, 63 nt, Human
ggcugugccaucuuugggcacugccaagggaguuggggugaugggcuucuuucugcacuggag

SEQ ID NO: 245457 - RNA, 63 nt, Human
ucucucuguuuaaauguaguaggucuaagggguuggggugacaagauucugcaugucuaagaa

SEQ ID NO: 245458 - RNA, 63 nt, Human
gggugcaccgccccuaucucucacccacguaaguggggugaugcugauuuagucucugcuuuu

SEQ ID NO: 245459 - RNA, 63 nt, Human
acuccugccaugcauugaagggucaaugcauuuuggggugagcucuggguuuaggggcccccu

SEQ ID NO: 245460 - RNA, 63 nt, Human
auuauacgguaccaucacaucauuuguggaaauuggggugacuguauagcugggauugggcua

SEQ ID NO: 245461 - RNA, 63 nt, Human
gcugacuggguauucuaaugaggagcugggaaguggggugacauagcugaccuuaguaucaac

SEQ ID NO: 245462 - RNA, 63 nt, Human
gggggcagaccaguggggaucugaucccaaagauggggugaccccagggucagggaggcugcc

SEQ ID NO: 245463 - RNA, 63 nt, Human
aggcccauaguggugggaagccaguuggccagcuggggugagaaggccgcgaagccaugggca

SEQ ID NO: 245464 - RNA, 63 nt, Human
ucagggaaaugaacaaaagggacgcagguuauuuggggugaguggguggugggagccuggagc

SEQ ID NO: 245465 - RNA, 63 nt, Human
cagcaguggacugcaggggaaagagcagugauuuggggugaguaggcuucaauucccagcucu

SEQ ID NO: 245466 - RNA, 63 nt, Human
auuuaaaaaugggagaucauggugaauucucacuggggugauuaguggaggaagucuggggag

SEQ ID NO: 245467 - RNA, 63 nt, Human
auugggagugacagguugggaugugggaaugacuggggugaggcagggucaagugcuacgggc

SEQ ID NO: 245468 - RNA, 63 nt, Human
ggcugacacauagaagguggccacauaggucucuggggugagaagacagcaagaaaacugccu

SEQ ID NO: 245469 - RNA, 63 nt, Human
uuugggggagggcugcgacgcuugcucuguuuguggggugacgggacucaggcgggacagugc

SEQ ID NO: 245470 - RNA, 63 nt, Human
acuguccuaagggccuguagugaccggcagggcuggggugagaccccucccuuccagaaucca

SEQ ID NO: 245471 - RNA, 63 nt, Human
cagcccuaauccucuggacgcuuguguagggccuggggugaauucccugucccccaugguacc

SEQ ID NO: 245472 - RNA, 63 nt, Human
agaaggggagcuuuuucagaaacagggcagcaguggggugaaauuuucuuaaccccuaagacu

SEQ ID NO: 245473 - RNA, 63 nt, Human
aaacgucaaguuauucauuuuacuuuuucauuuuggggugaagauucaguuucagucuuuuga

SEQ ID NO: 245474 - RNA, 63 nt, Human
uuacauucucaauuggggacaaaaauugguucuuggggugaaaaaauauuagauauggcuugu

SEQ ID NO: 245475 - RNA, 63 nt, Human
aucuuugaugcagcuuuaagaugguggggaggauggggugaauuuaggaaaggaauuuguggu

SEQ ID NO: 245476 - RNA, 63 nt, Human
acucauugaaagauuccaguuguauuugucaccuggggugacaagaccagacaggcuuuccca

SEQ ID NO: 245477 - RNA, 63 nt, Human
cgagagggaagaccuucuuuggggccgugaugguggggugagggaauaugagugcguggugcg

SEQ ID NO: 245478 - RNA, 63 nt, Human
ucuagggaccaacugggacucauuauggaagaauggggugagaggagacaugaggaaagaccc

SEQ ID NO: 245479 - RNA, 63 nt, Human
gagucucugaauuugucggguucucccaugauuuggggugauuucucacccucuguccuuccc

SEQ ID NO: 245480 - RNA, 63 nt, Human
gcaggguggggggccauguucccagaaccuugauggggugagaaguacagggcagaaccaaga

SEQ ID NO: 245481 - RNA, 63 nt, Human
ggacccuuugggaaugggucaugaaagcugccauggggugaggaaagaggagacagugggaga

SEQ ID NO: 245482 - RNA, 50 nt, Human
ggcacacgcuggacuccugauggggugagacuaucuacugucuuuugaag

SEQ ID NO: 245483 - RNA, 63 nt, Human
aggagcugggggagcgguggccagcccauuuucuggggugaggcuugacuuggagaaaggcag

SEQ ID NO: 245484 - RNA, 63 nt, Human
accaagagugaacccuaaugccagcuauagauuuggggugauuaucguugccacugaagguuc

SEQ ID NO: 245485 - RNA, 63 nt, Human
gcagccauuggugguugcagggccccagagggcuggggugaccuggcaucccggggcucccca

SEQ ID NO: 245486 - RNA, 63 nt, Human
gaugaagccaggcgucgcccccuccgggagcccuggggugagccgccggggccccccugcugc

SEQ ID NO: 245487 - RNA, 63 nt, Human
uaccugguguacacaucgggguggguugauauauggggugagaaguuugggcugaucgccagu

SEQ ID NO: 245488 - RNA, 63 nt, Human
acccaggagggcacagccaaggaaugagcccuguggggugacgcuucagggcagagcugccuu

SEQ ID NO: 245489 - RNA, 63 nt, Human
cauaaagcaggguggcuguccauccacugauucuggggugagaagcgauuucuaccucgcaag

SEQ ID NO: 245490 - RNA, 63 nt, Human
uuuagggacuuugacuaccacauguucuuuucuuggggugauuuaaucaccugggagcaucug

SEQ ID NO: 245491 - RNA, 63 nt, Human
uaccugguguacacaucgggguggguugauauauggggugagaaguuuaggcugaucgccagu

SEQ ID NO: 245492 - RNA, 63 nt, Human
ugggacccccaagcuguguccuaugaagggguguggggugagguagugaaaagggcgguaguu

SEQ ID NO: 245493 - RNA, 63 nt, Human
cccugugccccgcuggauugcacuuugagcccguggggugaggaguuggcaauuuggagagac

SEQ ID NO: 245494 - RNA, 63 nt, Human
gaggcugauuacuuacugcaccaaagcuaucacuggggugagauuuacuguuuggacaaauuu

SEQ ID NO: 245495 - RNA, 63 nt, Human
acaguuucgagaggcccgugccaugagaccgccuggggugagcaaggcgaccugggcugcugc

SEQ ID NO: 245496 - RNA, 63 nt, Human
ugacuguucuuguggaucuuguguccagggacauggggugacaugccucguauguguuagagg

SEQ ID NO: 245497 - RNA, 63 nt, Human
gcaugauuagagugcccaccgcauuagggauguuggggugagucagugugaccccacgugcac

SEQ ID NO: 245498 - RNA, 63 nt, Human
caaaccaagaagugggugcccuugguagcagccuggggugaccucuagagcuggaggcugugg

SEQ ID NO: 245499 - RNA, 63 nt, Human
gugacgcaggaacacugggggagucugaaugauuggggugaagacaucccuggagugaaggac

SEQ ID NO: 245500 - RNA, 63 nt, Human
gaccucuuaugagggaccaauucaggucccuuauggggugaacacuguugaagacugguuaau

SEQ ID NO: 245501 - RNA, 63 nt, Human
aagaggagaaaagggaauuuugucuuuaugggguggggugauuuucuccuaggguuaugucca

SEQ ID NO: 245502 - RNA, 63 nt, Human
ugcccaguccccguuacucuuagagaaaggaguuggggugagggccagagcuggcaguggaaa

SEQ ID NO: 245503 - RNA, 63 nt, Human
gcgcugaggaugagagggcacagggagguggguuggggugaggccacaugcggaggggcgggg

SEQ ID NO: 245504 - RNA, 63 nt, Human
ggcccugauccggggugacuggaaccggggcgguggggugaggguggccagcguacaacaggu

SEQ ID NO: 245505 - RNA, 63 nt, Human
aggugguagugaguaaugugccccugaaaccaguggggugacugacaagccucuuuaaucugu

SEQ ID NO: 245506 - RNA, 63 nt, Human
uugaaauucuuucaaaucagcugaaaauuugguuggggugaauugaugguuuuugagaaguag

SEQ ID NO: 245507 - RNA, 63 nt, Human
aaagggaaaagugauagaaauggggguggcaaguggggugaguggaugaagguggguauuggg

SEQ ID NO: 245508 - RNA, 63 nt, Human
ggaugcuggauuccccaagaacaaguuacccucuggggugaggcuauuccagcgagcugggac

SEQ ID NO: 245509 - RNA, 63 nt, Human
cuggagccguuugaguucacaagagucucuacuuggggugacagugcucacguggcucgacua

SEQ ID NO: 245510 - RNA, 63 nt, Human
gcggagcugagcuguguaugggauccaggaggcuggggugauuuauuuuaugggauuccugga

SEQ ID NO: 245511 - RNA, 63 nt, Human
acaugccacuauuaagcugcuaauuguuccuguuggggugacagauacugaauguauacguau

SEQ ID NO: 245512 - RNA, 63 nt, Human
ccaagcggccuuggauggaugaagucagagagguggggugagggugagcuuacucagggcccc

SEQ ID NO: 245513 - RNA, 63 nt, Human
cucccuuguaauuaugaaaaguucuuugguuucuggggugaauucuacccauguauaaugagg

SEQ ID NO: 245514 - RNA, 63 nt, Human
ccugauggcccccucugacauaaacugcacaccuggggugauggcuuaaagccagaaagagcu

SEQ ID NO: 245515 - RNA, 63 nt, Human
uuguguguuccaguccuggccuggaauggguaauggggugaguuaacccaccgcccagcuggc

SEQ ID NO: 245516 - RNA, 63 nt, Human
guaggugcugggcuccugggagggcccagaugauggggugaggcaugucuuuccagaacuuuc

SEQ ID NO: 245517 - RNA, 63 nt, Human
uaccuucuguccuagaagacacagacugacagauggggugaaggccuggggaccucagagaac

SEQ ID NO: 245518 - RNA, 63 nt, Human
auggaggcaggggacaagggaggcaguggcuaguggggugaacagcuggugccaaauagcccc

SEQ ID NO: 245519 - RNA, 63 nt, Human
gacaaugagauaaauguuaggaagggggagguauggggugacuucccugcaguccugggggcc

SEQ ID NO: 245520 - RNA, 63 nt, Human
gggaaggaagcuuggcugcucaguuucugagucuggggugagauaauguucugggaagggaca

SEQ ID NO: 245521 - RNA, 63 nt, Human
gccucacaugugaacacccgugucuggguugccuggggugauccucccuccugcgugguggcu

SEQ ID NO: 245522 - RNA, 63 nt, Human
ccuuuuagccuaguucauccaauccucacuggguggggugaggaccacuccuguacacugaau

SEQ ID NO: 245523 - RNA, 63 nt, Human
acgugguggggggccuuccucccucagaggccauggggugagaggggcucaggcagccaagga

SEQ ID NO: 245524 - RNA, 63 nt, Human
accagaggggggcuucgagguggucccugguacuggggugaccgaguggacagcccagggugc

SEQ ID NO: 245525 - RNA, 63 nt, Human
cccccaggucccuccagccucagccaagcaacauggggugaaccucagcacucccacaccucc

SEQ ID NO: 245526 - RNA, 63 nt, Human
ugguccuuagugcagagcccguccuuuuguacuuggggugaccccagcagccaauuauccggc

SEQ ID NO: 245527 - RNA, 63 nt, Human
gaaauuuaugaagaauguuauugccccagaauauggggugagagagaacugcacuuuuuuaau

SEQ ID NO: 245528 - RNA, 63 nt, Human
agacaagccagugagcucuccccuugggaucacuggggugaucagucagcagauugauucuca

SEQ ID NO: 245529 - RNA, 63 nt, Human
uucauaaagaaacguaggguguguaugugaaaguggggugagguucccugguugaguagguuu

SEQ ID NO: 245530 - RNA, 63 nt, Human
guaccccaaggcccccuggcugugcugaggggcuggggugagcgcuccauguucacaugagca

SEQ ID NO: 245531 - RNA, 63 nt, Human
auuuuaggaaauuuaagacuagauacucguguguggggugaggggagggaguauuugguaugu

SEQ ID NO: 245532 - RNA, 63 nt, Human
gauuuagggggugccucauggggugggcaggccuggggugaaaugagaaaggcccagaacgug

SEQ ID NO: 245533 - RNA, 63 nt, Human
gauggaggaggccagcagcuagccauugcacacuggggugaugggugggggcggugacugccc

SEQ ID NO: 245534 - RNA, 63 nt, Human
cccuugcuggaaggcucagcucuuuggggggucuggggugaccuccccaccuccuggaaaacu

SEQ ID NO: 245535 - RNA, 63 nt, Human
uugugccugaaaaccacggggccuguccccagcuggggugagcgcucagagggccuggggccc

SEQ ID NO: 245536 - RNA, 63 nt, Human
ggguuagugaggaaggaggauuugggguggggguggggugauugaauauuuguauaaaaagca

SEQ ID NO: 245537 - RNA, 63 nt, Human
cggugcugucacugcccaucuucggugacacccuggggugaggugcucagcaccuuccucucg

SEQ ID NO: 245538 - RNA, 63 nt, Human
uuagccuuuuggcugguguugaaugucuuuagcuggggugaccuggagugaccugggacggug

SEQ ID NO: 245539 - RNA, 64 nt, Human; identical to SEQ ID NO: 242566

SEQ ID NO: 245540 - RNA, 64 nt, Human; identical to SEQ ID NO: 240403

SEQ ID NO: 245541 - RNA, 64 nt, Human; identical to SEQ ID NO: 240404

SEQ ID NO: 245542 - RNA, 64 nt, Human; identical to SEQ ID NO: 240405

SEQ ID NO: 245543 - RNA, 63 nt, Human
aaguuugcugaacgaggacucacagcugcaacguggggugauuguauugaucaaaacccacug

SEQ ID NO: 245544 - RNA, 63 nt, Human
uccacucagaggacacuacuuuucugaaagcucuggggugacuaaugaugaguuccuaauaaa

SEQ ID NO: 245545 - RNA, 63 nt, Human
ugcgccugggaucucgccaaccccucucucauuuggggugacugaauucacagauuuuuuuuu

SEQ ID NO: 245546 - RNA, 63 nt, Human
uucaccuccaccagugagaccacggggccacuguggggugagggaaggagcgcuuggagucag

SEQ ID NO: 245547 - RNA, 63 nt, Human
guuuuggagacuacacaaugaaaacacaucuguuggggugaucagacccaacacccggccaug

SEQ ID NO: 245548 - RNA, 63 nt, Human
guuuuaugucauccuacagaugucuucaagaccuggggugaguuaucaaugcaagaaugguuc

SEQ ID NO: 245549 - RNA, 63 nt, Human
aaguguugucagcacuggaggagaccccgccaguggggugaggccagccaagucccuguguua

SEQ ID NO: 245550 - RNA, 63 nt, Human
cccuuaccaaagagaagaaccacucucuggcgcuggggugaccugcuggcugggccuguaagg

SEQ ID NO: 245551 - RNA, 63 nt, Human
uaggcgguaugggaauggcuaccgggacucuaauggggugaaagagaggggaggcuugccuuu

SEQ ID NO: 245552 - RNA, 63 nt, Human
ugccuucaguucccuuaagguaguucuugccucuggggugaguggcuuucaaagccuuuuagc

SEQ ID NO: 245553 - RNA, 63 nt, Human
ccuacaucaggaagacaggcccaaauucaggcauggggugaaauaggagaugcccuguagccu

SEQ ID NO: 245554 - RNA, 63 nt, Human
uaguuagugcauaauggauacaaaguuucugauuggggugaugagaaaguucuggagguggau

SEQ ID NO: 245555 - RNA, 63 nt, Human
cuaaucauggaaguuccauuuuaaugauucuguuggggugaacuugggagcaaugagauguuu

SEQ ID NO: 245556 - RNA, 63 nt, Human
uugagugcaguccugaucagagccgugguccuuuggggugaacuaccuugguucccccacuga

SEQ ID NO: 245557 - RNA, 63 nt, Human
uaaaagcucccugaagggcaauaucauuuggcuuggggugaucaguguuuacuuauugaucuu

SEQ ID NO: 245558 - RNA, 63 nt, Human
augugaggguagggaaaauguggauaacauuacuggggugagggaggcauuguucuuuaguug

SEQ ID NO: 245559 - RNA, 64 nt, Human; identical to SEQ ID NO: 240458

SEQ ID NO: 245560 - RNA, 64 nt, Human; identical to SEQ ID NO: 240459

SEQ ID NO: 245561 - RNA, 64 nt, Human; identical to SEQ ID NO: 240475

SEQ ID NO: 245562 - RNA, 64 nt, Human; identical to SEQ ID NO: 240476

SEQ ID NO: 245563 - RNA, 63 nt, Human
gggugaauggaaucauaagcaaagguuguguucuggggugaggaucaugagagagauauuuau

SEQ ID NO: 245564 - RNA, 63 nt, Human
aaacucagagauacagagggcuugguuugaaguuggggugagaugaaaccuuugcucugagcc

SEQ ID NO: 245565 - RNA, 63 nt, Human
uaacaggagcuuggagcaacugcgggguccucauggggugagcccaggcccugccacaaccua

SEQ ID NO: 245566 - RNA, 63 nt, Human
acuccaucagggaacagggcagcucuguuugaauggggugaaaaacagcaaaauuaauucuua

SEQ ID NO: 245567 - RNA, 63 nt, Human
caacaccuccagcguccccgccccagcuuccgguggggugaugcggucacccugcaaaagacu

SEQ ID NO: 245568 - RNA, 63 nt, Human
ccuucuggugggcauuugguauguccuuucucuuggggugauuucugauguuuuuacucuaua

SEQ ID NO: 245569 - RNA, 63 nt, Human
agcccccgggacaccguggggaaggggugcagguggggugauggccagaggaaugaugggcuu

SEQ ID NO: 245570 - RNA, 62 nt, Human
aggaucuaucugaggccuagaggccuggagcuuggggugaggaagagggagggauggacaag

SEQ ID NO: 245571 - RNA, 63 nt, Human
gguggucugcucgggcccaggccaucuuccagguggggugaggcagugggucccacuuccccu

SEQ ID NO: 245572 - RNA, 63 nt, Human
ggugggagacuuuguagauguugggcuauauguuggggugaugguagcuccugauguaauuuu

SEQ ID NO: 245573 - RNA, 63 nt, Human
gggagagagcgccuaggagcugccugccccagcuggggugacggcuguagggcugggucuaug

SEQ ID NO: 245574 - RNA, 63 nt, Human
gggagcuucucuucucaacaggccuugcgaggcuggggugagaggugauagaggcagcacugu

SEQ ID NO: 245575 - RNA, 63 nt, Human
gaggcccugccuggcuuguggagggacagacauuggggugauuggacaagagggucuggcugg

SEQ ID NO: 245576 - RNA, 63 nt, Human
cugaccucugcuuugggguuccuggggugggcuuggggugaguguaguucuggccuagcagca

SEQ ID NO: 245577 - RNA, 63 nt, Human
cccaucuggaugugaggugggguggagacaucauggggugauugcagaaagggggaguggcgg

SEQ ID NO: 245578 - RNA, 63 nt, Human
ggaggaggcagcagcgagguccugcgguacccauggggugaugcuacuucugcaugcaucuac

SEQ ID NO: 245579 - RNA, 63 nt, Human
agcgagcugagaucacaccacugcacuccagccuggggugauagaacaagacccugucucaaa

SEQ ID NO: 245580 - RNA, 63 nt, Human
aagcuaagccucgggcuaauuuccccauagccguggggugacuucccuggucaccaaggcagu

SEQ ID NO: 245581 - RNA, 63 nt, Human
cagagccacccugugguccugauagcuccuggguggggugacgacauccuucuccucaggucu

SEQ ID NO: 245582 - RNA, 63 nt, Human
gaggaggaagaaaaucaaaaccacccuacucccuggggugaggaaagaacaggaggggaggag

SEQ ID NO: 245583 - RNA, 63 nt, Human
augacuuugggggcuuuuguuaguaaggguggguggggugauggguugcagacggaggucagg

SEQ ID NO: 245584 - RNA, 63 nt, Human
ucauuccucuuucccuucuuuuagcaauaagucuggggugagguggggagggaggcugcaggg

SEQ ID NO: 245585 - RNA, 63 nt, Human
gaggaccagagccugucucagggaauugccugcuggggugaugcagggaggaggggaggugca

SEQ ID NO: 245586 - RNA, 63 nt, Human
gggguugaggggccaccaccacacaugccuuucuggggugaagcccuuuggcugccccacucu

SEQ ID NO: 245587 - RNA, 63 nt, Human
agagccucugggggaaaaaagagcccuuauuuguggggugagauuggggguuggaccagagug

SEQ ID NO: 245588 - RNA, 63 nt, Human
aaagcuaagccucggcuaauuuccccguagccguggggugacuucccuggucaccaaggcagu

SEQ ID NO: 245589 - RNA, 63 nt, Human
acgcagcgucugaggugcagggcccaggugugcuggggugacaaagccccgagcuguggugau

SEQ ID NO: 245590 - RNA, 63 nt, Human
aggccaggggcuaggaguucuaagaacagaggcuggggugaggguggcacccaggcagcugca

SEQ ID NO: 245591 - RNA, 63 nt, Human
agggccagcuucccuugggggcccuuuaaggaauggggugaaugaaauugugucauuucuaua

SEQ ID NO: 245592 - RNA, 63 nt, Human
gugaaugauucauuauuccaccccgagguuugcuggggugaggggaagaaucgaugcugcuuu

SEQ ID NO: 245593 - RNA, 63 nt, Human
auuuuaaaauuauaagcauaggauuuuauauuuuggggugaaagaauuaucuggcacauuagg

SEQ ID NO: 245594 - RNA, 63 nt, Human
ggugaugauuuuagugguggggugggguggggguggggugacauuagcuaguggucagggagg

SEQ ID NO: 245595 - RNA, 63 nt, Human
gagccggggacuucugaaauagagcuggcucccuggggugacaauguauauaugcaaauaaau

SEQ ID NO: 245596 - RNA, 63 nt, Human
gucugagagguuuuacauccccugccagcaugguggggugacacgagaccuguaagcaggugg

SEQ ID NO: 245597 - RNA, 63 nt, Human
uaacuguucaaacucaggccugugugacuccauuggggugagaggugaaagcauaacaugggu

SEQ ID NO: 245598 - RNA, 63 nt, Human
cacccccacagagagaacuuguggcucuggggcuggggugagggcuggugguuggugaaagcc

SEQ ID NO: 245599 - RNA, 63 nt, Human
agucauugaagacuugucagaccaucaaucucuuggggugauuaaucaaauuacccacccaag

SEQ ID NO: 245600 - RNA, 64 nt, Human; identical to SEQ ID NO: 240477

SEQ ID NO: 245601 - RNA, 64 nt, Human; identical to SEQ ID NO: 242567

SEQ ID NO: 245602 - RNA, 64 nt, Human; identical to SEQ ID NO: 242568

SEQ ID NO: 245603 - RNA, 63 nt, Human
agucauuucagauugaccauauucagacagucauggggugaaauaauucacuuaccuccaaaa

SEQ ID NO: 245604 - RNA, 63 nt, Human
uuugggacaccuuggugcauuaaggaaacacccuggggugaaagcccuugaauucauccucau

SEQ ID NO: 245605 - RNA, 63 nt, Human
aaugccugcugcuuguuuacccuuuggaaacccuggggugaccaagguuuggaaagccaccug

SEQ ID NO: 245606 - RNA, 63 nt, Human
cauauuauuacuuuuuuggggacgggggguggguggggugaagagaucuugugauuuuuaaga

SEQ ID NO: 245607 - RNA, 63 nt, Human
ggcuucuggcagcuggacaucagccccagguauuggggugauuuuggucaugacagugugccu

SEQ ID NO: 245608 - RNA, 63 nt, Human
acaucugccucagacuggagggggcucagcuccuggggugauaucuagccugcuugugagcuc

SEQ ID NO: 245609 - RNA, 63 nt, Human; identical to SEQ ID NO: 245608

SEQ ID NO: 245610 - RNA, 63 nt, Human
agggaagggacgcagggucuccgacaggugcucuggggugacucuucuguggagcuuuacccu

SEQ ID NO: 245611 - RNA, 63 nt, Human
guacacucuucccaaaugccaagagugcagcgguggggugagauucagauauucauuuauuuc

SEQ ID NO: 245612 - RNA, 63 nt, Human
aaccuaaacagugaaaauaugcacuguaaaggguggggugauguggcuuaacaaucagacuuc

SEQ ID NO: 245613 - RNA, 63 nt, Human
uacugauuuuuccuguugauucaaauagacuaauggggugaaaguuauuaggagagauacucu

SEQ ID NO: 245614 - RNA, 63 nt, Human
augucggggggguggggcacgggguaggggaaauggggugaacggugcuggcaguucggcuag

SEQ ID NO: 245615 - RNA, 63 nt, Human
aggaaggggaacaucacacucuagggacuguuguggggugaggggaggggugagggauagcau

SEQ ID NO: 245616 - RNA, 63 nt, Human
acccagcgaggagccaacuaucccaaauauaccuggggugaaauauaccaaauucugcaucuc

SEQ ID NO: 245617 - RNA, 63 nt, Human
ugcccaauuuugcagggagcauggcugugaggauggggugaacucacgcacagccaaggacuc

SEQ ID NO: 245618 - RNA, 63 nt, Human
cugggguggccguccucggccgguuagggaauuuggggugagguuccucaggagcccucacuc

SEQ ID NO: 245619 - RNA, 63 nt, Human
agagaaaaagcugagacuccuggggaaugacguuggggugauggaguccggggaaagagaggu

SEQ ID NO: 245620 - RNA, 63 nt, Human
uacagaucuugauucauagugacauuccauaaguggggugacagcaaaugacuugcagguagu

SEQ ID NO: 245621 - RNA, 63 nt, Human
cgggguacguuaaagggagagccagagaacucauggggugaggauggaguccgaggagacugc

SEQ ID NO: 245622 - RNA, 63 nt, Human
ucgggcuuguaacugucugagccccggauccgguggggugaaagcagccagcucaucccagug

SEQ ID NO: 245623 - RNA, 63 nt, Human
uguaccccaugguagccucugaggaggacgcuguggggugagguccagggcugccuccucaug

SEQ ID NO: 245624 - RNA, 63 nt, Human
cagcugucucuggagggcccagugccacuccucuggggugaccuuucugcucagcuggugggu

SEQ ID NO: 245625 - RNA, 63 nt, Human
ugaaagaggguggaugcagcugcuuguguuucuuggggugacugucauugguaauacggacac

SEQ ID NO: 245626 - RNA, 63 nt, Human
guaacagccaggaguguuaagcguucagugauguggggugaaaaguuacuaccugucaagguu

SEQ ID NO: 245627 - RNA, 63 nt, Human
auuauaaaagucccugauaaaaguuuuguuuacuggggugaacaucuuuccaguaaccaggua

SEQ ID NO: 245628 - RNA, 63 nt, Human
cagugccucguggacagauggucauuuagccucuggggugaaauacuugcaauaccaggucac

SEQ ID NO: 245629 - RNA, 63 nt, Human
ccagaaaugucuugccucuggucucugaaaagcuggggugagugguuaccucaaagacaauug

SEQ ID NO: 245630 - RNA, 63 nt, Human
uguuuauauacauuaacuaaaucaguacaaguuuggggugaaaaggaaauuuuuaauccaucu

SEQ ID NO: 245631 - RNA, 63 nt, Human
cucccgagguccagccacucucccuggggccucuggggugagagcagcuuccgauaggaccug

SEQ ID NO: 245632 - RNA, 63 nt, Human
uuuauaaacacuguucucagaagagucacaguuuggggugagaucuggaaaucaagaaauggg

SEQ ID NO: 245633 - RNA, 63 nt, Human
ugguuucuaucacaugagaagggguuguuuuuuuggggugacucggacugaauuccccauacu

SEQ ID NO: 245634 - RNA, 63 nt, Human
ucgggcauacguuuucugcaaugguuuaguggcuggggugagccacuggcagugugcuuaccu

SEQ ID NO: 245635 - RNA, 63 nt, Human
agaggaggaauuccuaggagccaaagaguuuuguggggugaggguaaauaaauggcccaaaug

SEQ ID NO: 245636 - RNA, 63 nt, Human
gcugcccagcgugacugagggcccccuggguuguggggugagaggaugugaguggccgggugg

SEQ ID NO: 245637 - RNA, 63 nt, Human
ggaugggcuggagagccucucugugcagcgguguggggugagcccugcuguggccuccuugug

SEQ ID NO: 245638 - RNA, 63 nt, Human
uuccaggcgaucuaaggugucauuucucccuccuggggugacccuuaggcgcuaauaugauua

SEQ ID NO: 245639 - RNA, 52 nt, Human
ucuggggcuauuuugcuuaguguggggugaacccagggguccaaacucuguu

SEQ ID NO: 245640 - RNA, 63 nt, Human
gagaauucagcagcccagacugagggucugggauggggugaaccuuccgcaccagagggacac

SEQ ID NO: 245641 - RNA, 63 nt, Human
aguaagucaggcgcuucugcggcggcuccaguguggggugaggcagugagguuaggcccagag

SEQ ID NO: 245642 - RNA, 63 nt, Human
gcaaauguaaaaacucauaaaacagguaaacaguggggugauuucauuugccauaauucacau

SEQ ID NO: 245643 - RNA, 63 nt, Human
ugucaggguaccuguuagccccugacaacucaguggggugaaguuuuggaggucagagucugc

SEQ ID NO: 245644 - RNA, 63 nt, Human
gugagagcugcaugugagccugugaccgugagcuggggugagcugggccgcaccuacccuggg

SEQ ID NO: 245645 - RNA, 63 nt, Human
gggcucgggaagggagcuggggcggugagggcauggggugaggcauggcgaugggggagggcg

SEQ ID NO: 245646 - RNA, 63 nt, Human
agagccagggaaauaaggucugaggauucaggauggggugaaaggugguugcuuaaaggaaaa

SEQ ID NO: 245647 - RNA, 63 nt, Human
cugcggugcuccccagaaaaggggaaggggcaguggggugagaagguccuggcuccccuucuc

SEQ ID NO: 245648 - RNA, 63 nt, Human
ccuggguucagagcauaaugcauaugugaagcauggggugacauuccuacugucauggguuug

SEQ ID NO: 245649 - RNA, 63 nt, Human
ucgugucuuggggguggaaagguagggaugaauuggggugauagaacccuggugaauucagag

SEQ ID NO: 245650 - RNA, 63 nt, Human
guucagagccugggucucagcgcgggacccgucuggggugaagaccuuggggcuguugugagu

SEQ ID NO: 245651 - RNA, 63 nt, Human
ugagcugggucagggcuggggaguugugcaggcuggggugacccuucccccaucauugggccc

SEQ ID NO: 245652 - RNA, 63 nt, Human
ugcauccggcuuggguacacaggcccagaggacuggggugacucacgggcccugugcugugau

SEQ ID NO: 245653 - RNA, 63 nt, Human
ggugggauuccaaggugaggcccaacugaaucguggggugagcuuuauagccaguagaggugg

SEQ ID NO: 245654 - RNA, 52 nt, Human
gggaggagaaggcggaguaagguggggugaggcggaucccgcgcgcaguucc

SEQ ID NO: 245655 - RNA, 63 nt, Human
aaagagcauuuuccaaggcuguuuugauaacccuggggugauaagcagugagcccucacacac

SEQ ID NO: 245656 - RNA, 63 nt, Human
gucccacccgguuucuccugauuauggcugcuguggggugaggggagggaggggcagccccga

SEQ ID NO: 245657 - RNA, 63 nt, Human
agaagacugugcggcacaggaaacagcaaacaguggggugaucugcagcccagagaccuucaa

SEQ ID NO: 245658 - RNA, 63 nt, Human
gggacggagaaugacucaggcagggccccaggguggggugaggagguuccugcucuggcaggu

SEQ ID NO: 245659 - RNA, 63 nt, Human
gcaguggaccccaggcaccccccuuugaggagguggggugaacugcuccuuggcagggauuug

SEQ ID NO: 245660 - RNA, 63 nt, Human
cugacccccugcccuccugcggccauccugaguuggggugaggccugggcagccggagggcag

SEQ ID NO: 245661 - RNA, 63 nt, Human
ucgugaaagaguagccggcuucagugccugccuuggggugaggaagacaccucugccccagug

SEQ ID NO: 245662 - RNA, 63 nt, Human
gagaguguuucuucacucaacucagguggcauuuggggugacaucucaaaggccaggaauucc

SEQ ID NO: 245663 - RNA, 63 nt, Human
aauuucucucaauuugggucccagcuaaagagguggggugaagcuggggacagcuuuccuggg

SEQ ID NO: 245664 - RNA, 63 nt, Human
cccagcuccucacauacccacacauuccagggcuggggugagccugacugccaggaccccagg

SEQ ID NO: 245665 - RNA, 63 nt, Human
aguguugccugcauuucucccaggacuuggggguggggugaaaagcguacaaaagauacuuaa

SEQ ID NO: 245666 - RNA, 63 nt, Human
cuccugguugccuuuucccagccaguuuucaguuggggugaagguuucugcaagugugagguc

SEQ ID NO: 245667 - RNA, 63 nt, Human
uccugcaucagcuggugaugaagaggagcaugcuggggugagacugggauucuggcuucucuu

SEQ ID NO: 245668 - RNA, 63 nt, Human
caggcucuaaacaagcagggagagggggugggguggggugagaguguguggaguaaggacauu

SEQ ID NO: 245669 - RNA, 63 nt, Human
ucaugaccaaacaggcuuguuggggacauaucauggggugagcuuugaagugcugguggucca

SEQ ID NO: 245670 - RNA, 63 nt, Human
ggcuuuugaagucaagccaguuuccagaagggcuggggugagauccugaccugugcagagagu

SEQ ID NO: 245671 - RNA, 63 nt, Human
cuccaaagccagacuaacagcucuccaagcccuuggggugacucggcuuccaggagcuguugg

SEQ ID NO: 245672 - RNA, 63 nt, Human
uucacagcuacucgggagguugaggcaggagaauggggugaacccgggaggaagagcuugcag

SEQ ID NO: 245673 - RNA, 63 nt, Human
aacugaagccacuuggcccagaaagcugcggauuggggugauaaggggccuugcucugagcac

SEQ ID NO: 245674 - RNA, 63 nt, Human
uggcuuccagccccuucgggguggugcucaguguggggugaugguaucauagaggaccacggc

SEQ ID NO: 245675 - RNA, 63 nt, Human
aaggauauccguaugauguaugggguaucucccuggggugauucucccauugauuuugaagau

SEQ ID NO: 245676 - RNA, 63 nt, Human
gguuguagagaacucuuuguaagcaauaaaguuuggggugaugacaaauguuuccaggccauc

SEQ ID NO: 245677 - RNA, 63 nt, Human
agugacacuguaggagcauagcaagccaggagauggggugaagggacacagucuugagcuguc

SEQ ID NO: 245678 - RNA, 63 nt, Human
gugugcgcugcagcguugcggggugggagaauguggggugaggguucuuaccaguuuuuuuug

SEQ ID NO: 245679 - RNA, 63 nt, Human
ucugcaucucagcccacccccaaccccaccguuuggggugagaagcagaaucugugcuucccc

SEQ ID NO: 245680 - RNA, 63 nt, Human
aaccaguauuauuucaauuauggcacuugggaguggggugagagcuaaacauugcacagggaa

SEQ ID NO: 245681 - RNA, 63 nt, Human
ugguggccugggaucuggcacacucccucuccuuggggugagggacagagccccacgcuguug

SEQ ID NO: 245682 - RNA, 55 nt, Human
ucaccggccgaucggccugaugcccuggggugauggggacccccucgcugucucc

SEQ ID NO: 245683 - RNA, 63 nt, Human
cuacacagcucagcagacauccacacacaguaauggggugagcucacaaccaccauucaguca

SEQ ID NO: 245684 - RNA, 63 nt, Human
cuggguccuugcuggggccgcagacacguaggcuggggugaggagugucugcugucacccucu

SEQ ID NO: 245685 - RNA, 63 nt, Human
caaucuucaccuucccuugccaacagagggcacuggggugaauucaagauuuucaucgagguc

SEQ ID NO: 245686 - RNA, 63 nt, Human
uguagguccugaggccagggauuuuuaauuaaauggggugauggguggccaauaccacaauuc

SEQ ID NO: 245687 - RNA, 63 nt, Human
augcuccucucccuggcuccggggagaagggcuuggggugaccugaagggaaccauccuggua

SEQ ID NO: 245688 - RNA, 63 nt, Human
acccuuucuugacugagacgcaugagugccuucuggggugagagcagccccaggguuuaaguu

SEQ ID NO: 245689 - RNA, 63 nt, Human
uuucuauuugggucuuaacccaugguucucagcuggggugacacugcuccucuagaagcaggu

SEQ ID NO: 245690 - RNA, 63 nt, Human
gacacacgggccagcagccgcgaaccuugaagcuggggugaccgcaggagacccuguaaggcc

SEQ ID NO: 245691 - RNA, 63 nt, Human
ggacaacacggaggauauccagcuuccccggucuggggugaggaauguggggagcuugggcau

SEQ ID NO: 245692 - RNA, 63 nt, Human
ggccaaggcgcuggccccccaaucucaggcaguuggggugaggccgugccucuuugggggcua

SEQ ID NO: 245693 - RNA, 63 nt, Human
gcugcugcucuggggucuccgggggccacagcuuggggugaguugaagaccucaggggaugug

SEQ ID NO: 245694 - RNA, 63 nt, Human
ggguugcccccccgccagugccuuggauauuucuggggugacuggacuggcgccccugggcca

SEQ ID NO: 245695 - RNA, 63 nt, Human
aucucuguaagcacaaagggacuccgauguggguggggugaggagagaggcagccccggccug

SEQ ID NO: 245696 - RNA, 63 nt, Human
gauguuuuuggggucuguuccugcacucacccauggggugagcugguuauuuuagcaacaauc

SEQ ID NO: 245697 - RNA, 63 nt, Human
uuuauauaagucuguuauuuauuauuaauuuauuggggugaccuucuuggggacucgggggcu

SEQ ID NO: 245698 - RNA, 63 nt, Human
auugggagcucugccugccggcaacuuugcugauggggugauugcugcuucugggggguaagg

SEQ ID NO: 245699 - RNA, 63 nt, Human
cccagggagcccacagaggcacucagugggugguggggugauggauacacaucuaucaggcac

SEQ ID NO: 245700 - RNA, 63 nt, Human
caagucagguccuuuucugaugguggcuggggcuggggugagcucagggaggggaagaggaga

SEQ ID NO: 245701 - RNA, 63 nt, Human
acuaggucucugggcccuugugcuuccuguggguggggugagggccaaaggcuaugguuuccu

SEQ ID NO: 245702 - RNA, 63 nt, Human
gggggcgggcagcucccaggcccuugggcaggcuggggugacggcagaggccacagcaccagc

SEQ ID NO: 245703 - RNA, 63 nt, Human
gaggccuccagaggauguggcagugagggacgauggggugaagucagcugggcauucaaagaa

SEQ ID NO: 245704 - RNA, 63 nt, Human
ugcugccauuuccugaagaccggggcaucgggguggggugauaaaggauacaaccugcacagg

SEQ ID NO: 245705 - RNA, 63 nt, Human
ugcugggcucuggacaggugguaaagacacuuguggggugagucaucccuacucccaacaucu

SEQ ID NO: 245706 - RNA, 63 nt, Human
cagcaaucaauauuugaguguaaggaaacugucuggggugauuccuagaagaucauuaaacug

SEQ ID NO: 245707 - RNA, 63 nt, Human
aggcagguggccuccacccacguucucccguccuggggugaggcuuccuguggcccagcccgc

SEQ ID NO: 245708 - RNA, 63 nt, Human
gaccgccacaugugcuuuucugccgggaaucccuggggugaacgcauguuuuaugggcguuuc

SEQ ID NO: 245709 - RNA, 63 nt, Human
cagagcccuggcaccagagacgccaagagccuguggggugacucggagcagcagguguggccc

SEQ ID NO: 245710 - RNA, 63 nt, Human
guuucccaccccagguuccuccaggccaagucauggggugaugaggaguuggggcccugucug

SEQ ID NO: 245711 - RNA, 63 nt, Human
cgaggggagucugcccuggugcccacugggcuguggggugaccacacuguacuuggggcuggg

SEQ ID NO: 245712 - RNA, 63 nt, Human
cucuagagugugaauauaugaaaggagucagaguggggugaaagucuauaaauguaagacauu

SEQ ID NO: 245713 - RNA, 63 nt, Human
uggacggccccuuggcuggcuccuggcccuacuuggggugauggcccgccugugagcugcuga

SEQ ID NO: 245714 - RNA, 63 nt, Human
gggagggagggcauuggcaugcggcgcugugcauggggugagacccagagcgguaucuuugcc

SEQ ID NO: 245715 - RNA, 63 nt, Human
uuuguuuugagcagacaggcuaaaaugugaacguggggugagggaucacugccaaaaugguac

SEQ ID NO: 245716 - RNA, 63 nt, Human
gucugugggggcauccugcagggcauuguguccuggggugacgucccuugugacaacaccacc

SEQ ID NO: 245717 - RNA, 63 nt, Human
aggaauggguguuugagugcagagacacuggucuggggugauccauggaggaccauuaaaaug

SEQ ID NO: 245718 - RNA, 63 nt, Human
acuuuaauuuuaaaacacuugaugcuggcuggguggggugacucacgccuguaaucccagcac

SEQ ID NO: 245719 - RNA, 63 nt, Human
cagacuuuggcugagaacagccccuggagaacauggggugacugcuaccauaggucuggaagu

SEQ ID NO: 245720 - RNA, 63 nt, Human
cgcuggagcaugagcucuguguguaccgagaacuggggugauguuuuacuuuucacaguaugg

SEQ ID NO: 245721 - RNA, 63 nt, Human
aauuuuccuguuuauuguacaugauggguuagguggggugaaugugguacaggaauguccugu

SEQ ID NO: 245722 - RNA, 63 nt, Human
acagugggagcccugaccuuggcugacuggggcuggggugagagaggaaagaccuacauuccc

SEQ ID NO: 245723 - RNA, 63 nt, Human
agucccugagaugugcucuuguuguuuggcauuuggggugacagggagugacccagaggccac

SEQ ID NO: 245724 - RNA, 63 nt, Human
gcgugcagagcagugaugcuggaggacacaccauggggugaagccaucccaaggcugacagcu

SEQ ID NO: 245725 - RNA, 63 nt, Human
ccucuccuccaugcugcugccccuggucccagguggggugagcuggcaccagcuccuguggaa

SEQ ID NO: 245726 - RNA, 63 nt, Human
ccucaaguuauucauuuuauuuuguuuucauuuuggggugaagauucaguuucagucuuuugg

SEQ ID NO: 245727 - RNA, 63 nt, Human
cucugggccuugaaaauccuugcccuuaucauuuggggugaaggagacauuucuguccuuggc

SEQ ID NO: 245728 - RNA, 63 nt, Human
ugguuguguauaauggagcuaacuccuaagcgguggggugaauguggccgccuuaguucugaa

SEQ ID NO: 245729 - RNA, 63 nt, Human
uaucuuagcugcacuccaacauugcauccuuucuggggugaagaaucugggccaaccaggggu

SEQ ID NO: 245730 - RNA, 63 nt, Human
ggggucaggccaggccuggguccugcccucccauggggugacucaugaccccuccagccagga

SEQ ID NO: 245731 - RNA, 63 nt, Human
aguaaccguagugccaaaauuucaguucaguaauggggugaacaauauggagagagaccuggg

SEQ ID NO: 245732 - RNA, 63 nt, Human
cuuguaaggggaacagaaacauuuuuguucuuauggggugagaauauagacagugcccuuggu

SEQ ID NO: 245733 - RNA, 63 nt, Human
caguagacaugcuggucaaagagcagucaucauuggggugaaguguucuugacaguuuaauau

SEQ ID NO: 245734 - RNA, 63 nt, Human
aggagaccugcucccuaucugcgcacccggagguggggugaggacggugacgaagguacccag

SEQ ID NO: 245735 - RNA, 63 nt, Human
ccucgaggaggacacaccagggucucagccuuuuggggugaacgaggaugaggcaucugaucu

SEQ ID NO: 245736 - RNA, 63 nt, Human
cagggcuaagggccaggguguucuucugcacccuggggugaggacggcuuggagggagaccag

SEQ ID NO: 245737 - RNA, 63 nt, Human
aggagaccugcucccuaugugcacacccggagguggggugaggacggugacgaagguacccag

SEQ ID NO: 245738 - RNA, 63 nt, Human
gcucucagcagguuuucugcauggaagggaagguggggugauagggagggcagccagaaaaga

SEQ ID NO: 245739 - RNA, 64 nt, Human; identical to SEQ ID NO: 242562

SEQ ID NO: 245740 - RNA, 64 nt, Human; identical to SEQ ID NO: 242563

SEQ ID NO: 245741 - RNA, 64 nt, Human; identical to SEQ ID NO: 242564

SEQ ID NO: 245742 - RNA, 64 nt, Human; identical to SEQ ID NO: 242565

SEQ ID NO: 245743 - RNA, 63 nt, Human
gcaccucccagccagguggcccugcccgaccuguggggugaggcagccaagguuccuuccauc

SEQ ID NO: 245744 - RNA, 63 nt, Human
acccgaucccugggguagggcaccacccccuccuggggugagagcgcagugcacucccgugcu

SEQ ID NO: 245745 - RNA, 63 nt, Human
acaguuggacccgugauucucagggugcugugauggggugaggguagggggagcauuuguuau

SEQ ID NO: 245746 - RNA, 63 nt, Human
uuuuuaaggaagccagaagcaucccauggaccauggggugaguguccuccaagagcccccuga

SEQ ID NO: 245747 - RNA, 63 nt, Human
gggucaagugucucaucauacuggcacuguugcuggggugacggcagaauucagaacuucaau

SEQ ID NO: 245748 - RNA, 63 nt, Human
gaaccuggguuagaaacccuggccaggcgaacguggggugauucacagcacaaaagaccucac

SEQ ID NO: 245749 - RNA, 63 nt, Human
auuggcaguccuuuugcagggcagugugugugguggggugacaccgcuguggcuuagcccaag

SEQ ID NO: 245750 - RNA, 63 nt, Human
uacaagcuggagaggaaggagauucuggcauguuggggugagggcagagggacagaugagggg

SEQ ID NO: 245751 - RNA, 63 nt, Human
gcuugcuggccacaaggaaaaggaggaggugucuggggugagggaguuagggagagagaagca

SEQ ID NO: 245752 - RNA, 63 nt, Human
uaccugggaauaccuuuuauuuuuuuuuuaccuuggggugaugguuccaaaccauaaauguga

SEQ ID NO: 245753 - RNA, 63 nt, Human
auuccaaggcggggucacgguaccagcagcacuuggggugaggccuccaaagcuuccucagaa

SEQ ID NO: 245754 - RNA, 63 nt, Human
ggaugcagaguucccuagagagacuugcacugauggggugacuucugcuuugguccuuccacc

SEQ ID NO: 245755 - RNA, 63 nt, Human
cugggccccggccccuaaaacauucauuaagucuggggugaagauuuggaaucuugaaugcuu

SEQ ID NO: 245756 - RNA, 63 nt, Human
uuuccaaggggcaucaaguggcagcuggcuuccuggggugaagaggcaggcaccccagagucc

SEQ ID NO: 245757 - RNA, 63 nt, Human
gauucuagagagugaaguaauugcagaagcaguuggggugaagaaaacugucaaauaugaagc

SEQ ID NO: 245758 - RNA, 63 nt, Human
aaugcuauacuguccugcuuguacaacaugguuuggggugaaggggaggaaaguauuaaaaaa

SEQ ID NO: 245759 - RNA, 64 nt, Human; identical to SEQ ID NO: 242558

SEQ ID NO: 245760 - RNA, 64 nt, Human; identical to SEQ ID NO: 242559

SEQ ID NO: 245761 - RNA, 64 nt, Human; identical to SEQ ID NO: 242560

SEQ ID NO: 245762 - RNA, 64 nt, Human; identical to SEQ ID NO: 242561

SEQ ID NO: 245763 - RNA, 64 nt, Human; identical to SEQ ID NO: 242569

SEQ ID NO: 245764 - RNA, 64 nt, Human; identical to SEQ ID NO: 242570

SEQ ID NO: 245765 - RNA, 64 nt, Human; identical to SEQ ID NO: 242571

SEQ ID NO: 245766 - RNA, 64 nt, Human; identical to SEQ ID NO: 242572

SEQ ID NO: 245767 - RNA, 64 nt, Human; identical to SEQ ID NO: 242573

SEQ ID NO: 245768 - RNA, 64 nt, Human; identical to SEQ ID NO: 242574

SEQ ID NO: 245769 - RNA, 64 nt, Human; identical to SEQ ID NO: 242575

SEQ ID NO: 245770 - RNA, 64 nt, Human; identical to SEQ ID NO: 242576

SEQ ID NO: 245771 - RNA, 64 nt, Human; identical to SEQ ID NO: 242577

SEQ ID NO: 245772 - RNA, 64 nt, Human; identical to SEQ ID NO: 242578

SEQ ID NO: 245773 - RNA, 64 nt, Human; identical to SEQ ID NO: 242579

SEQ ID NO: 245774 - RNA, 64 nt, Human; identical to SEQ ID NO: 242580

SEQ ID NO: 245775 - RNA, 64 nt, Human; identical to SEQ ID NO: 242581

SEQ ID NO: 245776 - RNA, 64 nt, Human; identical to SEQ ID NO: 242582

SEQ ID NO: 245777 - RNA, 59 nt, Human; identical to SEQ ID NO: 242583

SEQ ID NO: 245778 - RNA, 64 nt, Human; identical to SEQ ID NO: 242584

SEQ ID NO: 245779 - RNA, 64 nt, Human; identical to SEQ ID NO: 242585

SEQ ID NO: 245780 - RNA, 64 nt, Human; identical to SEQ ID NO: 242586

SEQ ID NO: 245781 - RNA, 64 nt, Human; identical to SEQ ID NO: 242587

SEQ ID NO: 245782 - RNA, 64 nt, Human; identical to SEQ ID NO: 242588

SEQ ID NO: 245783 - RNA, 64 nt, Human; identical to SEQ ID NO: 242589

SEQ ID NO: 245784 - RNA, 64 nt, Human; identical to SEQ ID NO: 242590

SEQ ID NO: 245785 - RNA, 64 nt, Human; identical to SEQ ID NO: 242591

SEQ ID NO: 245786 - RNA, 64 nt, Human; identical to SEQ ID NO: 242592

SEQ ID NO: 245787 - RNA, 64 nt, Human; identical to SEQ ID NO: 242593

SEQ ID NO: 245788 - RNA, 64 nt, Human; identical to SEQ ID NO: 242594

SEQ ID NO: 245789 - RNA, 64 nt, Human; identical to SEQ ID NO: 242595

SEQ ID NO: 245790 - RNA, 64 nt, Human; identical to SEQ ID NO: 242596

SEQ ID NO: 245791 - RNA, 64 nt, Human; identical to SEQ ID NO: 242597

SEQ ID NO: 245792 - RNA, 64 nt, Human; identical to SEQ ID NO: 242598

SEQ ID NO: 245793 - RNA, 64 nt, Human; identical to SEQ ID NO: 242599

SEQ ID NO: 245794 - RNA, 64 nt, Human; identical to SEQ ID NO: 242600

SEQ ID NO: 245795 - RNA, 54 nt, Human; identical to SEQ ID NO: 242601

SEQ ID NO: 245796 - RNA, 64 nt, Human; identical to SEQ ID NO: 242602

SEQ ID NO: 245797 - RNA, 64 nt, Human; identical to SEQ ID NO: 242603

SEQ ID NO: 245798 - RNA, 64 nt, Human
uuugaaauuugagcucauuugcaaacccgagucugccugggaacccgcacugugccugggugua

SEQ ID NO: 245799 - RNA, 64 nt, Human
cgggagccugcuguccaguccuggccgggccaaggccugggaaacugugaaagucagaaaggcc

SEQ ID NO: 245800 - RNA, 64 nt, Human
ugggcaucgcggucugggguugggacguguaagcgccugggagagccuagaccaggcuccgggc

SEQ ID NO: 245801 - RNA, 64 nt, Human
cugguagagaggagacgagaggcuuuuucagugggccugggacaguggcugcucuugacuuugu

SEQ ID NO: 245802 - RNA, 64 nt, Human
cuuuauuuuuggaggcaaugaauggagcaccucggccugggacccucaguguaggguuuucuga

SEQ ID NO: 245803 - RNA, 64 nt, Human
cgcugcgcccggcccugccccgggccuuccucgugccugggaggucguucuagggaugcuccug

SEQ ID NO: 245804 - RNA, 64 nt, Human
ugagcuccugcuggcaucuggagaacaccccugugccugggacaggggaggacccuucuuuugg

SEQ ID NO: 245805 - RNA, 64 nt, Human; identical to SEQ ID NO: 195627

SEQ ID NO: 245806 - RNA, 64 nt, Human; identical to SEQ ID NO: 195632

SEQ ID NO: 245807 - RNA, 64 nt, Human; identical to SEQ ID NO: 195641

SEQ ID NO: 245808 - RNA, 64 nt, Human
cccuuucuggccagggaggcauugcugcaggugagccugggaugcccuugccacccgugguugg

SEQ ID NO: 245809 - RNA, 64 nt, Human
cgacgguuuccacagcgagcgccagcuccggccagccugggacagcucaucccagccgacuaca

SEQ ID NO: 245810 - RNA, 64 nt, Human
ucgccacaggaccuggaguuaucaggggucaggcgccugggaaggggccuuugguggccacccu

SEQ ID NO: 245811 - RNA, 64 nt, Human
ggccagguuugcuggccauagauaccuuugggcugccugggacaggcuccugaggaggauugag

SEQ ID NO: 245812 - RNA, 64 nt, Human
cagagccauucuugguggugagccuagacucugagccugggaugugcuuugagaucccuccccg

SEQ ID NO: 245813 - RNA, 64 nt, Human
caucacugaggcugcgggcaccacgcgggguccggccugggauccaggcuaagggccggcggaa

SEQ ID NO: 245814 - RNA, 64 nt, Human
aaucccggcgcggguuccgcugacgcagcgccccgccugggagccgcgggcaggcgagacuggc

SEQ ID NO: 245815 - RNA, 64 nt, Human
cccagaccucccaguggggacggggcagggccuggccugggaagagcacagcugcagaucccag

SEQ ID NO: 245816 - RNA, 64 nt, Human
guuccugguuuuaguaaacccagcugccugcauugccugggacuagaggcuggggaggcuacca

SEQ ID NO: 245817 - RNA, 64 nt, Human
ucccauuuccugagaccacagagagaggggagaagccugggauugacagaagcuucugcccacc

SEQ ID NO: 245818 - RNA, 64 nt, Human
gucacccaacagagggguccugagaagucuggcugccugggaugcccccugcccccuccuggaa

SEQ ID NO: 245819 - RNA, 64 nt, Human
uuugcagacuggacccuuaccgguggcucuuccugccugggacccucccgcagagucccacuag

SEQ ID NO: 245820 - RNA, 64 nt, Human
cccaggaggggaccagaggggaugcugugucgcugccugggaucuugggguuggccuuugcaug

SEQ ID NO: 245821 - RNA, 64 nt, Human
uuaaggguaagccccacagcgggcagcacaaacagccugggagccacugugccugugcuucucu

SEQ ID NO: 245822 - RNA, 64 nt, Human
ccuggcuaaacguuggugaaaguuauaaccuccugccugggagaaaauauacaucaccuaaaau

SEQ ID NO: 245823 - RNA, 64 nt, Human; identical to SEQ ID NO: 195457

SEQ ID NO: 245824 - RNA, 64 nt, Human; identical to SEQ ID NO: 195646

SEQ ID NO: 245825 - RNA, 64 nt, Human; identical to SEQ ID NO: 195649

SEQ ID NO: 245826 - RNA, 64 nt, Human
acauucuaaaauauagauuaagaauacuuaaaaugccugggauaguucuugggacuaacaacau

SEQ ID NO: 245827 - RNA, 64 nt, Human
gcaagucgacauagcucacagggaacucugggaagccugggauguaggcgcuggagcuccaguu

SEQ ID NO: 245828 - RNA, 64 nt, Human
ugucacugucccugggccacccagugaaagcaaagccugggaaucugcucauuguuguuugggc

SEQ ID NO: 245829 - RNA, 64 nt, Human
uccuuuaccccugaguuccuuacuguucccccaagccugggagcagucuaucccccaacccugc

SEQ ID NO: 245830 - RNA, 64 nt, Human
agcaaaaauaacuuuggagccuucugggaagugugccugggauucuucagugguuucaggcaga

SEQ ID NO: 245831 - RNA, 64 nt, Human
gcuagaggcaacaggucuaggguuaaggauuaaggccugggaauuggagucucaccauggcucc

SEQ ID NO: 245832 - RNA, 64 nt, Human
cuuuuuccuucuaagucaugucugcugccugugagccugggaaggagugcuuucaaaaccugua

SEQ ID NO: 245833 - RNA, 64 nt, Human
ucacucauggacccuggagccagccacugaccccgccugggaacaacagucauucuuccucuuu

SEQ ID NO: 245834 - RNA, 64 nt, Human
aaaaacugugagagauugugucugccccugcccugccugggacccacagggagacuauaaucuc

SEQ ID NO: 245835 - RNA, 64 nt, Human
auacuuggggggcugaggugggaggaucucuugagccugggaggucaaggcugcagugagccga

SEQ ID NO: 245836 - RNA, 64 nt, Human
uccccuuuagcugccuccuauugaucucagggaagccugggagucccuucucaccccucaaccu

SEQ ID NO: 245837 - RNA, 64 nt, Human
gcggggaggugccugagcuggggccuggagaggggccugggaaaggaaaaccagggauagcuau

SEQ ID NO: 245838 - RNA, 64 nt, Human
cagaagcaaggaaguaagggagucauugccuugggccugggaaucuaagugggagacaauauua

SEQ ID NO: 245839 - RNA, 64 nt, Human
ucacccaucuuucuguuugucauucuuaucuccagccugggaaaaguucuccuuauuuguuuag

SEQ ID NO: 245840 - RNA, 64 nt, Human
aguauggacuauggaaaaacaaauuugcacaauggccugggaaguugaggucacuuuuuacagg

SEQ ID NO: 245841 - RNA, 64 nt, Human; identical to SEQ ID NO: 195656

SEQ ID NO: 245842 - RNA, 64 nt, Human; identical to SEQ ID NO: 195659

SEQ ID NO: 245843 - RNA, 64 nt, Human; identical to SEQ ID NO: 195663

SEQ ID NO: 245844 - RNA, 64 nt, Human
gagguaguauugaagccucggcuuucccucuggagccugggacccuguuuacaguugcacaucu

SEQ ID NO: 245845 - RNA, 64 nt, Human
guuaacuacccuacaccucugggcccugcaggaggccugggagggcaaggguccuacggaggga

SEQ ID NO: 245846 - RNA, 64 nt, Human
acacuagacaugccaacucgggagcauucugccugccugggaacgggguggacgagggaguguc

SEQ ID NO: 245847 - RNA, 64 nt, Human
ccagacucugcucucccagcacugacucacuccugccugggaggggaaugcagcauucaugcug

SEQ ID NO: 245848 - RNA, 64 nt, Human
ggcaugcuuggaugcccagcuguguccagagguggccugggaccgccaguugcacgccugccac

SEQ ID NO: 245849 - RNA, 64 nt, Human
gugugcacacguguguaugagugcgcagaucugugccugggaucgugcauuugaggggccaggg

SEQ ID NO: 245850 - RNA, 64 nt, Human
gggucugcccugcccauacugagccugccaaagugccugggaagcccacccagauucugaaaca

SEQ ID NO: 245851 - RNA, 64 nt, Human
cacgggcuggggcucagcuccuuggagagggccugccugggacugagggggccagggcuggguc

SEQ ID NO: 245852 - RNA, 64 nt, Human
gccccggugaccuuggggccuccgacccugugcagccugggacaaaacuguuuccgguuggccg

SEQ ID NO: 245853 - RNA, 64 nt, Human
cucuuggucccuggucccucguccacaggggcaggccugggacccagcuacucuguccaggcca

SEQ ID NO: 245854 - RNA, 64 nt, Human
cuaagcccucgaaccaaggcagccuccagagccagccugggacucccagugaacuuacacuugg

SEQ ID NO: 245855 - RNA, 64 nt, Human
ugggccgaggacguugccuguagaauccuccucugccugggaguggcucuguguggaccagucc

SEQ ID NO: 245856 - RNA, 64 nt, Human
uggcgguucuuuccuaucucauuacccgcuaggggccugggagcccuguggcuggaucugagug

SEQ ID NO: 245857 - RNA, 64 nt, Human
ccccgcccagaacgcaggugcuggcgcccguucugccugggaccccgggaaccucuccugccgg

SEQ ID NO: 245858 - RNA, 64 nt, Human
cacgaggaguagccagguaggcgagacacaaaaggccugggacagggucaguacaagucagguc

SEQ ID NO: 245859 - RNA, 64 nt, Human; identical to SEQ ID NO: 195666

SEQ ID NO: 245860 - RNA, 64 nt, Human; identical to SEQ ID NO: 195667

SEQ ID NO: 245861 - RNA, 64 nt, Human; identical to SEQ ID NO: 195668

SEQ ID NO: 245862 - RNA, 64 nt, Human
caagggaggugcuggagagggauuaaccugugcugccugggacccucagggucuuagguugggg

SEQ ID NO: 245863 - RNA, 64 nt, Human
uggacuuccuugguuuggacacaguguuccagcugccugggaggcuuuuggugguccccacagc

SEQ ID NO: 245864 - RNA, 64 nt, Human
agggugggccugccuuuugcuaagcgaucucuaugccugggaugcccuuuauuccaggaggcau

SEQ ID NO: 245865 - RNA, 64 nt, Human
acuucucuuuauagguuucaggucuccuaugggugccugggaaguccuugaaaguggacuguuc

SEQ ID NO: 245866 - RNA, 64 nt, Human
guagcuucugggccaaaggucagggugggcgggggccugggaauacagccuguggaggcugcuu

SEQ ID NO: 245867 - RNA, 64 nt, Human
uggagguuaguggaggccccuccccaagcagggagccugggaugggcagggagugauagccaaa

SEQ ID NO: 245868 - RNA, 64 nt, Human
gaaacagauggagcucuugggcccagccagcugggccugggacuucugccucugccgccuccag

SEQ ID NO: 245869 - RNA, 64 nt, Human
aggcauuccaggguugaaucuugucccagccucagccugggacaccuagguggagagagugguc

SEQ ID NO: 245870 - RNA, 64 nt, Human
ugauaaaugucucaguauuuuuauaauaugauaagccugggauucuacuuuuaggguuauuugu

SEQ ID NO: 245871 - RNA, 64 nt, Human
uguguugagccugggauggaggagcccuaggccagccugggauaagagucccacagucuaggga

SEQ ID NO: 245872 - RNA, 64 nt, Human
cacaguuccuccccuaaucugguuucuguguugagccugggauggaggagcccuaggccagccu

SEQ ID NO: 245873 - RNA, 64 nt, Human
cccaagucucagaaaacccagacuugggacaacugccugggaacuaggaugcuagagcaguucu

SEQ ID NO: 245874 - RNA, 64 nt, Human
aguuuaggcuuucgcggaggggaggagacauggagccugggaacuccuuguucuccccucugcu

SEQ ID NO: 245875 - RNA, 64 nt, Human
gugggugcuggcugagcuuugggccgggaaggcagccugggaaucugaggcuggagacaggggu

SEQ ID NO: 245876 - RNA, 64 nt, Human
ggauggagcaucaacagcagggugggcuuguggggccugggaggggcaauccucaaaugcgggg

SEQ ID NO: 245877 - RNA, 64 nt, Human; identical to SEQ ID NO: 195669

SEQ ID NO: 245878 - RNA, 64 nt, Human; identical to SEQ ID NO: 195670

SEQ ID NO: 245879 - RNA, 64 nt, Human; identical to SEQ ID NO: 195675

SEQ ID NO: 245880 - RNA, 64 nt, Human
uccgcuuggagcuauuuuccaggcuucugcuggggccugggacaacugcucccaccuccugaca

SEQ ID NO: 245881 - RNA, 64 nt, Human
uugcagugagcugagaucacaccacugcacuccagccugggagagacagagugagacuccaucu

SEQ ID NO: 245882 - RNA, 64 nt, Human
ucuuguuucugugguugguucuagccccugcagagccugggagcugcaggaacugucugagaaa

SEQ ID NO: 245883 - RNA, 64 nt, Human
cuacagagcuucacgcucuccgcuccaccccuuagccugggaacccaccgcaggugugaguucu

SEQ ID NO: 245884 - RNA, 64 nt, Human
gagagggucacuugagcccaggaguucuagacaagccugggaaacauagcaagaucucauccuu

SEQ ID NO: 245885 - RNA, 64 nt, Human
gccugaggucccaccccacuaaagggcuccccaggccugggaucugacaccaucaccaguagga

SEQ ID NO: 245886 - RNA, 64 nt, Human
acccuccgguggcccaggugccuaccucccucaagccugggaaggugggucuggggaaaguggg

SEQ ID NO: 245887 - RNA, 64 nt, Human
gcuuaggauauucucauguuucugagggauuacagccugggaggauuccaccgaucuucacuuc

SEQ ID NO: 245888 - RNA, 64 nt, Human
uggggaucugggugaaggggguugaguagcgacugccugggagauggcuguuaguaggucugug

SEQ ID NO: 245889 - RNA, 64 nt, Human
gguaguaugauauagcauaguagaaggagauuuggccugggaguuuggacaccaaaguucuagc

SEQ ID NO: 245890 - RNA, 64 nt, Human
caaaaguaaauagaaaagacauugaaucaccaaggccugggaucaaccugggcuguccacacag

SEQ ID NO: 245891 - RNA, 64 nt, Human
agagacccggacacggccugguguguggcuugcugccugggagggaugcacagggccucuggag

SEQ ID NO: 245892 - RNA, 64 nt, Human
gccucugugcgauccgagucgcggucuccggggugccugggagggccgaaccacuggugagggc

SEQ ID NO: 245893 - RNA, 64 nt, Human
guaggaacauacagaauguugcacuaauuugguagccugggaauuuuuuuuauugugcaguaug

SEQ ID NO: 245894 - RNA, 64 nt, Human
ugggagcccgcuggagcuugucuucccuaacauagccugggagaccaccccuugccacuugggc

SEQ ID NO: 245895 - RNA, 64 nt, Human; identical to SEQ ID NO: 195676

SEQ ID NO: 245896 - RNA, 64 nt, Human; identical to SEQ ID NO: 195677

SEQ ID NO: 245897 - RNA, 64 nt, Human; identical to SEQ ID NO: 195678

SEQ ID NO: 245898 - RNA, 64 nt, Human
aaaaauaaaaaauuaaccaggugugguggcacgugccugggagucccagcgacuugggaggcug

SEQ ID NO: 245899 - RNA, 64 nt, Human
cgacuugggaggcugaggugggaggauuguuugagccugggaggucgaggcuguagugagcccu

SEQ ID NO: 245900 - RNA, 64 nt, Human
ccuccuugucuaguuucccacauuccaaaagggggccugggaugcuagccccagagaugccagc

SEQ ID NO: 245901 - RNA, 64 nt, Human
auucacucacuuuacuuagaacagagauauaagggccugggaugcauuuauuuuaucaauacca

SEQ ID NO: 245902 - RNA, 64 nt, Human
cauugacagagggacaagcaaugggcuggcugaggccugggaccacuuggccuucuccucggag

SEQ ID NO: 245903 - RNA, 64 nt, Human
augagaugagaucaauacuacugauccaucuguagccugggaaggagacaggacauuccuguac

SEQ ID NO: 245904 - RNA, 64 nt, Human
guucuggcuacaccagagcaccaagagcccacuugccugggauggccccacacugucacucagc

SEQ ID NO: 245905 - RNA, 64 nt, Human
gcuacucuggagacagguggaggggauugcuugagccugggaagcugaggcugcaguagccaug

SEQ ID NO: 245906 - RNA, 64 nt, Human
auuccagcaaucugcagguagggagugggucccagccugggagccugcugucaggagcaggcag

SEQ ID NO: 245907 - RNA, 64 nt, Human
gcccuggggaagaggccuugggggucugcucugugccugggaucaguggggccccaaagcccag

SEQ ID NO: 245908 - RNA, 64 nt, Human
ugucugcauggcagaagcgucucccuuggccacggccugggagggugguuccuguucucagcau

SEQ ID NO: 245909 - RNA, 64 nt, Human
uguugucaguucccguguucugagaagaggucaugccugggaggaagggaucgucaugcugcau

SEQ ID NO: 245910 - RNA, 64 nt, Human
auuuuaggaggccuaggcaggagcaaucacuugugccugggaguucuagacuagccugggcgag

SEQ ID NO: 245911 - RNA, 64 nt, Human
ugcucugccuggcucgaugucugcuucuuccccagccugggauccuucgugcuucaaggccugg

SEQ ID NO: 245912 - RNA, 64 nt, Human
uuauacugauucuacucugcuuuuauccuuuggagccugggagacuccccaaaaagguaaaugc

SEQ ID NO: 245913 - RNA, 64 nt, Human; identical to SEQ ID NO: 195662

SEQ ID NO: 245914 - RNA, 64 nt, Human; identical to SEQ ID NO: 195664

SEQ ID NO: 245915 - RNA, 64 nt, Human; identical to SEQ ID NO: 195665

SEQ ID NO: 245916 - RNA, 64 nt, Human
agguugauaucaaucaccagccucccacuguggugccugggagugaccugguaaagugcaacgu

SEQ ID NO: 245917 - RNA, 64 nt, Human
agggagcaggagcccagggcgcccugggagcugagccugggacuuccaggaccuccccucaggu

SEQ ID NO: 245918 - RNA, 64 nt, Human
ugcuccaaccugauuggacaaaggaagcucuauggccugggagagagacuauucuuaauuuuuc

SEQ ID NO: 245919 - RNA, 64 nt, Human
ccagaauggugccuguuucucucugugucucaaugccugggacuggagguugauaguuuaagug

SEQ ID NO: 245920 - RNA, 64 nt, Human
ugcugggagaggcggccagagccuggggccuccagccugggacugcugugaugggguaucacgg

SEQ ID NO: 245921 - RNA, 64 nt, Human
gaugugccuauuagggcuccguaagaacucagaugccugggaagcccagccccucaggugcccc

SEQ ID NO: 245922 - RNA, 64 nt, Human
aauguaauuggaacaguuaucuuugauuagacaagccugggaagagaauguugaggugcagagc

SEQ ID NO: 245923 - RNA, 57 nt, Human
uucuggcacagaccgccuagcagugcugccugggaacuaacacgugccucguaaagg

SEQ ID NO: 245924 - RNA, 64 nt, Human
uuaugagccgacuucuuugguguucuggccucuggccugggaaaagggcaggagccuagaggag

SEQ ID NO: 245925 - RNA, 64 nt, Human
uugcagucagccgagaucacgccacugcacuccagccugggagacagagugagacuccgucuca

SEQ ID NO: 245926 - RNA, 64 nt, Human
caguagccaauuucauuuacugcauuacucuuuggccugggaacccuguggucugcacuacaug

SEQ ID NO: 245927 - RNA, 64 nt, Human
gacagugggagcgacugagcaacaggaggacucagccugggacaggccccagagagucacacaa

SEQ ID NO: 245928 - RNA, 64 nt, Human
aggggucccagaaagggacagggaaauaaauggugccugggaugagauucaaucuauauuuguc

SEQ ID NO: 245929 - RNA, 64 nt, Human
gaagggaugugaggcacuguggggcaggacaagggccugggauuugguucguuugcucuucugg

SEQ ID NO: 245930 - RNA, 64 nt, Human
gaggcugagaugggaggauugaucgaucgcuugagccugggagguggaggcuacugugagccau

SEQ ID NO: 245931 - RNA, 64 nt, Human; identical to SEQ ID NO: 195658

SEQ ID NO: 245932 - RNA, 64 nt, Human; identical to SEQ ID NO: 195679

SEQ ID NO: 245933 - RNA, 64 nt, Human; identical to SEQ ID NO: 195680

SEQ ID NO: 245934 - RNA, 64 nt, Human
caggggcuucugggaaauacagguuuuggauucugccugggaagagagucauaguaugaagaag

SEQ ID NO: 245935 - RNA, 64 nt, Human
caggguccuucccaccagacucagggaagggaugccccauuaaagugacaaaaggguggggugu

SEQ ID NO: 245936 - RNA, 64 nt, Human
cuuggaaauucuuggugcauuaaaugaagccuuaccccauuacugcgguucuuccuguaagggg

SEQ ID NO: 245937 - RNA, 64 nt, Human
ucuacaacugauaaaaccuuaugauucuuuucucccccauuaugccccuauauauaucaagauu

SEQ ID NO: 245938 - RNA, 64 nt, Human
ugaaaagugguuuucuuaaugcagcccugcugguccccauuaacaauugcuugaaauucacaug

SEQ ID NO: 245939 - RNA, 63 nt, Human
augcaccccagguucgcugaucuaucaacaucaccccauuaagaauacaaagcacuacauucu

SEQ ID NO: 245940 - RNA, 64 nt, Human
ggaugccuccuucuaagaacuggaaguucucauuccccauuaugaacugagcuauaauauggag

SEQ ID NO: 245941 - RNA, 64 nt, Human
ggaugccuccuucuaagaaccagaaguucucauuccccauuaugaacugagcuauaauauggag

SEQ ID NO: 245942 - RNA, 64 nt, Human
ugggguagggggcaccccuacagugggaccccucccccauuauucuuucuguccagccccuccc

SEQ ID NO: 245943 - RNA, 64 nt, Human
caauuccccagggaaggaaacuguuguguccaauccccauuaaagacaaauugaucagugcuuc

SEQ ID NO: 245944 - RNA, 64 nt, Human
cauaucuuugagauaauuaaacuaauuuuuucuuccccauuagggauuaugcugaauuuguaug

SEQ ID NO: 245945 - RNA, 64 nt, Human
auaccauguacauaauucuugcuaugaaaaguuuccccauuauuuugguuuaucuucuuuugaa

SEQ ID NO: 245946 - RNA, 64 nt, Human
uggaugugccacaugacaggcaauaauauauuggccccauuagcccuuccuggagcagucauaa

SEQ ID NO: 245947 - RNA, 64 nt, Human
auuuuaaaggguucccucauaaaaaaauguuauuccccauuaucacaucaguacacugcuuuga

SEQ ID NO: 245948 - RNA, 64 nt, Human
uucuuccuucuccucuaccccuccuuccaccccuccccauuagaguaguguggagauaaggcug

SEQ ID NO: 245949 - RNA, 64 nt, Human
cuuuucccacugguucuuggcuuccuuuagagaccccgguaauuguggaaccuagggaaugggg

SEQ ID NO: 245950 - RNA, 64 nt, Human
augggaggcugcuaacccgcccucuccaguccaccccgguaaaagagcuguuccccacccccag

SEQ ID NO: 245951 - RNA, 64 nt, Human
aaccuccaggcaggaaccggcucgccacccucugcccgguaagggcugcccaagaaagcauuac

SEQ ID NO: 245952 - RNA, 64 nt, Human
uuaccaaacagcacuaucccaggaacuauugucugccugggaacacucaguagggagacacuuu

SEQ ID NO: 245953 - RNA, 64 nt, Human
cuaccacgagggccucugaggaaccuccuuccaggccugggaugagggggcgaugucugcuggc

SEQ ID NO: 245954 - RNA, 64 nt, Human
uuucacugacuuagaaccaggcgagagacuuguggccugggagagcuggggaagcuucuuaaau

SEQ ID NO: 245955 - RNA, 62 nt, Human
augaugucagcuaccucugacccugcccuccagccugggacaauaaaagccuuuuuucuaga

SEQ ID NO: 245956 - RNA, 64 nt, Human
cuggcucaggagugcuggaaaagcucacgccucggccugggagccuggccucuugauauaccuc

SEQ ID NO: 245957 - RNA, 64 nt, Human
uguuccccgucugcaccugaaggguugucgccuggccugggagagccucuuccagguuuugacc

SEQ ID NO: 245958 - RNA, 64 nt, Human
uugguucucagucaucucugcaagggacccugacgccugggagaucagagccacugacccuuua

SEQ ID NO: 245959 - RNA, 64 nt, Human
caggcauuaaaugaauggucucuuggccaccccagccugggaagaacauuuuccugaacaauuc

SEQ ID NO: 245960 - RNA, 64 nt, Human
aaccaccauucacugaguagcuaauggguuuggggccugggacauuccaucugagguccuuccu

SEQ ID NO: 245961 - RNA, 64 nt, Human
caaaggggacagcugugugacauuuggagagggggccugggacuuccaugccuuaaaccuaccu

SEQ ID NO: 245962 - RNA, 64 nt, Human
gacugagcagauugagugaugcuggggcagagaggccugggaggaaagguguucagccagucgu

SEQ ID NO: 245963 - RNA, 64 nt, Human
ucaguauuuuccuggcacuacaaagagugggaaggccugggauuugcugcugcucccuuagagc

SEQ ID NO: 245964 - RNA, 64 nt, Human
ucccacucauuacaaauaaagaaagguggugugagccugggaagugggugucuccaguuccaug

SEQ ID NO: 245965 - RNA, 64 nt, Human
cuacucuggaggcugaguccggaggaacguuugagccugggaguuugaguuugcagcuugcagu

SEQ ID NO: 245966 - RNA, 64 nt, Human
cuaagaaucacuugagacuaggaguucaagaucagccugggaaacauagugagaccccgucucu

SEQ ID NO: 245967 - RNA, 64 nt, Human; identical to SEQ ID NO: 195681

SEQ ID NO: 245968 - RNA, 64 nt, Human; identical to SEQ ID NO: 195682

SEQ ID NO: 245969 - RNA, 58 nt, Human; identical to SEQ ID NO: 195683

SEQ ID NO: 245970 - RNA, 64 nt, Human
ucugguuugggagaucagaugaacaagugcauaagccugggaugcugguggaggacuggagaga

SEQ ID NO: 245971 - RNA, 64 nt, Human
aagagacauaucucucagcuuuuucaggaggcgugccugggaauccaggaacuuuuugaugcua

SEQ ID NO: 245972 - RNA, 64 nt, Human
gggacauggcaauguuaccagcccaccuucugaagccugggaggugugaacccagggcccgcca

SEQ ID NO: 245973 - RNA, 64 nt, Human
augagucuuaaguagguucaugaucuacauuggggccugggauuauuuuuuuaauuuuaaguuu

SEQ ID NO: 245974 - RNA, 64 nt, Human
accuauuacuucacacaccucaaauacaaaaagugccugggaacgucgaugagguauuaaagga

SEQ ID NO: 245975 - RNA, 64 nt, Human
ggucugcauaucugauguucagguagaccugggcgccugggaacgaggccaucagcugccaugc

SEQ ID NO: 245976 - RNA, 64 nt, Human
gauuccuacagugaaaacauuuuuggugauaucugccugggaaaucucucuuccuaaaguauuu

SEQ ID NO: 245977 - RNA, 62 nt, Human
cucuguacgaugacuccuaacaauggaauauggccugggaugaggauuaacuguucuuuauu

SEQ ID NO: 245978 - RNA, 64 nt, Human
uaaaagcaggcuucuaugaaagacucaaaaagcugccugggaggcagauggaacuugagccugu

SEQ ID NO: 245979 - RNA, 64 nt, Human
uuuucugcagcaagcacugucaagacagcggcaggccugggauggagcccaucucuccaguucc

SEQ ID NO: 245980 - RNA, 64 nt, Human
gccugcgccugaguucgcggguccuccgcaggccgccugggaaccggagccuggcgugccggag

SEQ ID NO: 245981 - RNA, 64 nt, Human
ugcuccucugcccgcggguggcuggagccccaucgccugggacgccccuuucucuugcuguuua

SEQ ID NO: 245982 - RNA, 64 nt, Human
gggagacggugggccuuguccccugccugugccugccugggaguuuuguauucaucuuuuguau

SEQ ID NO: 245983 - RNA, 64 nt, Human
ggaacccuggcccaauuccucagaccccagaguggccugggacccaagcugccgcagcugagug

SEQ ID NO: 245984 - RNA, 64 nt, Human
cucugaaguccagguaccugcacaagcaggaagcgccugggagucccggaaggaggagagcgca

SEQ ID NO: 245985 - RNA, 64 nt, Human; identical to SEQ ID NO: 195651

SEQ ID NO: 245986 - RNA, 64 nt, Human; identical to SEQ ID NO: 195684

SEQ ID NO: 245987 - RNA, 64 nt, Human; identical to SEQ ID NO: 195685

SEQ ID NO: 245988 - RNA, 64 nt, Human
ggcuuuggagucagauuuuaguuaacaauaaugagccugggagcaguaguacuaaggcgucuuu

SEQ ID NO: 245989 - RNA, 64 nt, Human
aggcggauugcuugagcccaggaguuugagggcagccugggaaacauggcuaaauccguguuca

SEQ ID NO: 245990 - RNA, 64 nt, Human
gcagugaaggcacuggucuuaagugagaauauuugccugggaguagagauaaagacacaaaccg

SEQ ID NO: 245991 - RNA, 64 nt, Human
ugcagacaagagcaaucccugacaugacauuauagccugggaaagggcuggcucacugaugaga

SEQ ID NO: 245992 - RNA, 64 nt, Human
caauucauucuuugcagcuaauuaagccgaagaagccugggaaucaaguuugaaacaaagauua

SEQ ID NO: 245993 - RNA, 64 nt, Human
uaacaagugucgaguccccaaggcugggggccgagccugggaaugggggugaguggagggcucc

SEQ ID NO: 245994 - RNA, 64 nt, Human
uuacucaggaggcugaggcgagagaaucgcuugagccugggacauugaggcugcagugaacugu

SEQ ID NO: 245995 - RNA, 64 nt, Human
guguccccaucaugccucucaauggggccugcaagccugggaacuugggcaucguugggccagc

SEQ ID NO: 245996 - RNA, 64 nt, Human
agccaucuaucucugcucacucuccaauugacccgccugggaacaagggaugaggaggaguugg

SEQ ID NO: 245997 - RNA, 64 nt, Human
auccaccugccagagaaacacaggcucagaggaugccugggaacagggaggaugggauuagugg

SEQ ID NO: 245998 - RNA, 64 nt, Human
aauguaggccacaaaccacaguaguauuagcagugccugggaccuccucaacaacagaaauugc

SEQ ID NO: 245999 - RNA, 64 nt, Human
guugcucuggcaggggcagaauccucacaggaucgccugggaggugaggugugugugacccacu

SEQ ID NO: 246000 - RNA, 64 nt, Human
gugugugcucucagggaagggcccaggaucccaugccugggaggagcugccagagagaagcaaa

SEQ ID NO: 246001 - RNA, 64 nt, Human
uggagaggcuggaccccgcuuugaagagggugcagccugggaagggcggccuugcuggggacug

SEQ ID NO: 246002 - RNA, 64 nt, Human
cacccagauuucucuaucuuugcuguguuuuauggccugggacugaguccacacggauagauuu

SEQ ID NO: 246003 - RNA, 64 nt, Human
gccacaugaauagaagaauuuuccucaagauggacccgguaaauauaaccacaaggaagcgaaa

SEQ ID NO: 246004 - RNA, 64 nt, Human
gaaacacguaucccaccugacauguccuucugagcccgguaagagcaaaagaauggcagaaaag

SEQ ID NO: 246005 - RNA, 64 nt, Human
ggcuccacuguuuaccucuugcuauguauuuucucccgguaaaaaugaauugaaccauuucaac

SEQ ID NO: 246006 - RNA, 64 nt, Human
aggcaggcuugggcugggccaggacacguggggugccugggacgcugcuugccaugcacaguga

SEQ ID NO: 246007 - RNA, 64 nt, Human
aggagagcuccccuguuuucuguuuaauugaugagccugggaaaggaguguguucugccugccc

SEQ ID NO: 246008 - RNA, 64 nt, Human
ggauucuuggaagcagcuugaguguuuucaucuugccugggaagcccaggaauuccaccugguc

SEQ ID NO: 246009 - RNA, 64 nt, Human
cuacucgggaggcugaggugggaggaucccgugagccugggagguggaguuugcagugagcuaa

SEQ ID NO: 246010 - RNA, 64 nt, Human
agucaaaauguguuccuugaucccagauguuguggccugggaaagcccucauugcuacaguaca

SEQ ID NO: 246011 - RNA, 64 nt, Human
uuaggccauuggucuuugaugucauagauuccaggccugggagguguuaugucucuucagcugg

SEQ ID NO: 246012 - RNA, 64 nt, Human
uggaggcagcuccuucuaaaagaaaauuuaaaaugccugggaguggcuauagggguagcucuuu

SEQ ID NO: 246013 - RNA, 64 nt, Human
ucugcaaaccaacaggcuaccaacuuguauccaggccugggaauggauuagguuucagcagagc

SEQ ID NO: 246014 - RNA, 64 nt, Human
uuuccauugucuuuggcucucacaggagcuagcugccugggaggaauuguuaacugaguaccag

SEQ ID NO: 246015 - RNA, 64 nt, Human
aauuuuaaaagggcuagaaaaaaaugauugaccagccugggaaacauaacaagaccccgucucu

SEQ ID NO: 246016 - RNA, 64 nt, Human
cccccuggacagaaucagcauuucagcucagcuggccugggaugggccaggcugguccuggcug

SEQ ID NO: 246017 - RNA, 64 nt, Human
gccuggcagauaaagagcagagggcacuugcagggccugggaugagcagucuucaagcuguggu

SEQ ID NO: 246018 - RNA, 64 nt, Human
uugcagugagccgagaucacgccacugcacuccagccugggagacagagcgagacucugucuca

SEQ ID NO: 246019 - RNA, 64 nt, Human
auucaugauucugguggagauuccuucuuccagggccugggaggauagggcuaaucccaagggu

SEQ ID NO: 246020 - RNA, 64 nt, Human
uaaacuuuccugaguuuagaaauuuaguccuuuggccugggagguccaggcugcaaugagccaa

SEQ ID NO: 246021 - RNA, 64 nt, Human; identical to SEQ ID NO: 195640

SEQ ID NO: 246022 - RNA, 64 nt, Human
gaccccauggacccuagcucauacucagacgccccccgguaagugacaaccccucuugacucag

SEQ ID NO: 246023 - RNA, 64 nt, Human
accaaccgguaaccaccacuuccccacaccgccgcccgguaauuauuugcauuacaaaccggag

SEQ ID NO: 246024 - RNA, 64 nt, Human
cugcaaugagccaagaucacgccacugaacuccagccugggagacagcaagacccugucugaaa

SEQ ID NO: 246025 - RNA, 64 nt, Human
uggaagcacugcuguguccgcuuucaugaacacagccugggaccagggcauauuaaaggcuuuu

SEQ ID NO: 246026 - RNA, 64 nt, Human; identical to SEQ ID NO: 246025

SEQ ID NO: 246027 - RNA, 64 nt, Human
uggccagggacaucugccaaaggaaggaacuguagccugggagaaugguuacuuuggcauuagg

SEQ ID NO: 246028 - RNA, 64 nt, Human
uccuucacuguucccucuggcuucccauaguggggccugggaggguuccccuggccuuaaaagg

SEQ ID NO: 246029 - RNA, 64 nt, Human
ccucuucacuguggccacagcccccuugcccuccgccugggaucugaguacauauuguggugau

SEQ ID NO: 246030 - RNA, 64 nt, Human
ggguuucuaucugcuaagcacccagcagguuggggccugggacucagcucucucugcgguagag

SEQ ID NO: 246031 - RNA, 64 nt, Human
cuacuugggaggcuggggcaggagaauugccugagccugggaaguggaaguugcagugagccaa

SEQ ID NO: 246032 - RNA, 64 nt, Human
accuccagagaugugcaaacagcugggaggaaaagccugggaguggggggccucgucgggagga

SEQ ID NO: 246033 - RNA, 64 nt, Human
gugaguggcugugcggaggccuguguucgggagggccugggagaaggagggcacccagcacccc

SEQ ID NO: 246034 - RNA, 64 nt, Human
cggagaugccagaggagcccucuagggguccgaugccugggaggaccagaagccaacagcaaaa

SEQ ID NO: 246035 - RNA, 64 nt, Human
aggcugccuaggaggcaguaaauccagucacagugccugggaggggcccauccuuccaaaaugu

SEQ ID NO: 246036 - RNA, 64 nt, Human
uacaaaacuuagugugaaacagagcacuugcagagccugggacaaccuccuuauugaagggaag

SEQ ID NO: 246037 - RNA, 64 nt, Human
cacaucauguaucacuuuuuucuuaaauaaagaagccugggacacaguagauagacacacuuau

SEQ ID NO: 246038 - RNA, 64 nt, Human
gacagauuugugcgcugagccagacuccaggguugccugggaacagucucuccccaagaucacc

SEQ ID NO: 246039 - RNA, 64 nt, Human
cucccgagaggcccccaaauccuagcuccaguuccccgguaaggacagggacaggaccugcaga

SEQ ID NO: 246040 - RNA, 62 nt, Human
cuguaaucccagcacuuugggaggccuaggcgggcggucagggguucgagaccagucuggcc

SEQ ID NO: 246041 - RNA, 62 nt, Human
ggcaggcauccccgcacagacuugacuggcagggcggucacgggaccugcgggcuggcuccg

SEQ ID NO: 246042 - RNA, 64 nt, Human
aaguuggccugcccggccuuugggacaucugugugccugggaggcugccaggggguggggcuuc

SEQ ID NO: 246043 - RNA, 64 nt, Human
aucugaaccuggucucagcaggcagguggcuggggccugggagaggccaggugaaugggaggcc

SEQ ID NO: 246044 - RNA, 64 nt, Human
uggaaagguuaauguucuaguuucuggaagguaagccugggagacacauaagcaauucacugcu

SEQ ID NO: 246045 - RNA, 64 nt, Human
agaguuauccuucuucccugccuuggaagcccuggccugggaggaggucauaccccaccguugg

SEQ ID NO: 246046 - RNA, 64 nt, Human
gccugcuucugcccccuccugauuucccuaaggagccugggaugauguuggucaaaugaccuag

SEQ ID NO: 246047 - RNA, 64 nt, Human
ccccaaaguugcucaccgacucaccugcgcaagugccugggauucuaccguaauugcuuugugc

SEQ ID NO: 246048 - RNA, 64 nt, Human
ggggcauuucagguuuccaaagaaaggaauguaugccugggaaagacagcaggagauuggugac

SEQ ID NO: 246049 - RNA, 64 nt, Human
cucagacauggcuuccuuauugcuggaagaggaggccugggaguugacauucagcacucuucca

SEQ ID NO: 246050 - RNA, 64 nt, Human
aauuuucagagagaaauagauaaaacacgccacagccugggaaggagcgugcucuacccugugc

SEQ ID NO: 246051 - RNA, 64 nt, Human
ccaggaguauggcugaggccuugcccacccaccugccugggaagugcagaguggauggacgggu

SEQ ID NO: 246052 - RNA, 64 nt, Human
cugaguccucugccccuuccaaggacacuaaugagccugggaggguggcagggaggaggggaca

SEQ ID NO: 246053 - RNA, 64 nt, Human
auggggagcaguuugggggcggccggcagcaggagccugggaaagaggcccucgccaggugaug

SEQ ID NO: 246054 - RNA, 64 nt, Human
gccacccugaggaccaccuggccaugcgugcacagccugggaaaagacaguuacucacgggagc

SEQ ID NO: 246055 - RNA, 64 nt, Human
ccacccucccccuagccagccaggcagcuucucugccugggaggggagccuggaccccccucuu

SEQ ID NO: 246056 - RNA, 64 nt, Human
acagaggacggggcacugugcugggagccagggggccugggaggagccgagaccagccuuuuac

SEQ ID NO: 246057 - RNA, 64 nt, Human; identical to SEQ ID NO: 195648

SEQ ID NO: 246058 - RNA, 62 nt, Human
gcuccuuggggucugccugcccacccacaugagcccgcgaguauggcagcaggacaagccag

SEQ ID NO: 246059 - RNA, 62 nt, Human
ugccaagcacaccucgcucccagcacaccacagcccgcgaccucagggcagggagcagagca

SEQ ID NO: 246060 - RNA, 64 nt, Human
ugaggaauucaauaugaucacuuuuuccuucuuugccugggagagguuaagaggagguuucgaa

SEQ ID NO: 246061 - RNA, 64 nt, Human
gauugcucagaguuccuuuagggcagagcugagggccugggauccaggaaccagugggauugga

SEQ ID NO: 246062 - RNA, 64 nt, Human
ugggggccacaccaggucgcagcaaauggcuucagccugggacgccaguguuuuaugcucuuag

SEQ ID NO: 246063 - RNA, 64 nt, Human
uugcagugagcagagaucgugccauugcacuccagccugggaacaagagugaaacucucaaaag

SEQ ID NO: 246064 - RNA, 64 nt, Human
guugggccaagggcagagggggcugcaccugcgggccugggaagcauugcucaggguggggggc

SEQ ID NO: 246065 - RNA, 64 nt, Human
acgccggugguggaacuggucaaacuccacgcccgccugggagguugucagguugcuguggaug

SEQ ID NO: 246066 - RNA, 64 nt, Human
gaacuauuagacaugaaaucugaggaaggugcuugccugggaccaguggcagggaccccggaac

SEQ ID NO: 246067 - RNA, 64 nt, Human
cuuccgacuuccuuacaggaugaggcugggcauugccugggacagccuauguaaggccaugugc

SEQ ID NO: 246068 - RNA, 64 nt, Human
acuugguguaguagccagaauucguaaagcuguugccugggagcuugguacuuucccuccaggc

SEQ ID NO: 246069 - RNA, 64 nt, Human
ggagauagcugggggacaagggcagacggccccugccugggaaaaaccacacucacaccccacc

SEQ ID NO: 246070 - RNA, 64 nt, Human
gaugacuacaguucacuuugccccuccuucccuugccugggagagagccuaccuagacagugca

SEQ ID NO: 246071 - RNA, 64 nt, Human
cacugucacacgcauagauccacgaggcaccaaggccugggagcaucgacgugaagucccacgu

SEQ ID NO: 246072 - RNA, 64 nt, Human
uccgccagugcuuucaguaggaagagcugaggcugccugggaggcccggggcgaccggaaaagg

SEQ ID NO: 246073 - RNA, 64 nt, Human
gaagucucugggaucccgcugugggucugagauggccugggaaggaccuuguggacaaugguuu

SEQ ID NO: 246074 - RNA, 64 nt, Human
cuguuuuuagaauucagagcccuugcuggggggugccugggagaugggguaagaagagcuuuca

SEQ ID NO: 246075 - RNA, 64 nt, Human; identical to SEQ ID NO: 195609

SEQ ID NO: 246076 - RNA, 64 nt, Human; identical to SEQ ID NO: 195610

SEQ ID NO: 246077 - RNA, 64 nt, Human; identical to SEQ ID NO: 195611

SEQ ID NO: 246078 - RNA, 64 nt, Human
aagcguccccccagauccccguuccccccagguggccugggagguggcccccucgaggaugacu

SEQ ID NO: 246079 - RNA, 64 nt, Human
acagugccuuggucaucccacauccccggaccccgccugggacccccaagcuguguccuaugaa

SEQ ID NO: 246080 - RNA, 64 nt, Human
cuacucagguggcugaggcauaagaauugcuugagccugggaggcagagauugcacugagccga

SEQ ID NO: 246081 - RNA, 64 nt, Human
ccccaggguggcccacaccuguuccuagcagggcgccugggaaucuagaacaguuuagagggga

SEQ ID NO: 246082 - RNA, 64 nt, Human
cuuccugcagccucuuccgcucgccggcugcggcgccugggacgguugcggugggucugggcgc

SEQ ID NO: 246083 - RNA, 64 nt, Human
ugggcaagcauuaguggcuucagauuggagaccagccugggacuucccugcagugagagagcau

SEQ ID NO: 246084 - RNA, 64 nt, Human
guggagacuccucggaagccccugcuuccagaaagccugggaagaacugcccuucugcaaaggg

SEQ ID NO: 246085 - RNA, 64 nt, Human
cugccuuaagcugugaucaugccacugcauuccagccugggagagagagaggaccugucuguug

SEQ ID NO: 246086 - RNA, 64 nt, Human
gcccuggggugggcuccaggaaaacgcugguuaggccugggauugagcuaaccugaaacaaagg

SEQ ID NO: 246087 - RNA, 64 nt, Human
ccccaaacagcaugugcucagccccagaccugccgccugggaaucaggauuccuucuuccccaa

SEQ ID NO: 246088 - RNA, 64 nt, Human
guccugggcacacuuuuugcaggcaacaaaaugugccugggagugauggauuuuaaugugcucc

SEQ ID NO: 246089 - RNA, 64 nt, Human
uguggucccagcuacuugggaggcugaggugggagccugggaggucaaggcugcagugagccau

SEQ ID NO: 246090 - RNA, 64 nt, Human
uaauguagcaugauuuuucaaggauuguuaacaugccugggauugggaaagauaggacuaaagu

SEQ ID NO: 246091 - RNA, 64 nt, Human
agggaccagugggggcuguaggguaagccccugagccugggaccuacaugugguuugcguaaua

SEQ ID NO: 246092 - RNA, 64 nt, Human
ugagcccacggcucagugggcuucacauaccucugccugggaaucuucuuuccuccccucccau

SEQ ID NO: 246093 - RNA, 64 nt, Human; identical to SEQ ID NO: 195618

SEQ ID NO: 246094 - RNA, 64 nt, Human; identical to SEQ ID NO: 195619

SEQ ID NO: 246095 - RNA, 64 nt, Human; identical to SEQ ID NO: 195620

SEQ ID NO: 246096 - RNA, 56 nt, Human
ucauagccacugagaucugaggggcugccugggaaggcgagucuggggaccuggca

SEQ ID NO: 246097 - RNA, 64 nt, Human
gggccagcuccaggagggcuugagagcucagccugccugggagagcccuuguggcgaggcauua

SEQ ID NO: 246098 - RNA, 64 nt, Human
aacaacaaaacaauuacuaaugagguacgcugaggccugggagucucuugacuccacuacuuaa

SEQ ID NO: 246099 - RNA, 64 nt, Human
uguggacauauguuuucauuucucuuugguauaugccugggagcagauuugcuggaucauauga

SEQ ID NO: 246100 - RNA, 64 nt, Human
ugcuugccaucucuagggauugggggauuggcuagccugggaggaucagucuguccaggucagc

SEQ ID NO: 246101 - RNA, 64 nt, Human
gcugggcucccgugucuucucacagggcucgcacgccugggagguggcccuuggggggcugcag

SEQ ID NO: 246102 - RNA, 64 nt, Human
uucaugcccaaaaggaacagaaguuccaacuauugccugggaucuugcgaaaagcgagguuccc

SEQ ID NO: 246103 - RNA, 64 nt, Human
gacuccagcaccguggggcugcccuccuccaugcgccugggagcacaaaggccccgguagugaa

SEQ ID NO: 246104 - RNA, 64 nt, Human
acucagcucacugccuacauccaguggccacauagccugggacccuccuuugaaacauccuuua

SEQ ID NO: 246105 - RNA, 64 nt, Human
aagauaaauagucuugucucuuaaugcguagggggccugggaagaauauuaaaauuuuaaucaa

SEQ ID NO: 246106 - RNA, 64 nt, Human
gggaggauugcuugagcccagaaguucgagacuagccugggaaacauaggaagcccucgucucu

SEQ ID NO: 246107 - RNA, 64 nt, Human
uauuucuuuggaccccaggcacuaggggccaccugccugggagucucccugccucacuccucua

SEQ ID NO: 246108 - RNA, 64 nt, Human
cauuacagaacugcagcuuuucuacucugaaaaggccugggagcagaauggcuggccugcugug

SEQ ID NO: 246109 - RNA, 64 nt, Human
cccaucccugaaaugucuuauuuucaagugccuggccugggaaagaaggggaagaaacaauugc

SEQ ID NO: 246110 - RNA, 64 nt, Human
uacuugggaggcugaggugggagggauugcuuaagccugggaggcagagguugcagugagccga

SEQ ID NO: 246111 - RNA, 64 nt, Human; identical to SEQ ID NO: 195623

SEQ ID NO: 246112 - RNA, 64 nt, Human; identical to SEQ ID NO: 195624

SEQ ID NO: 246113 - RNA, 64 nt, Human; identical to SEQ ID NO: 195625

SEQ ID NO: 246114 - RNA, 64 nt, Human
cuggggcuggagaggccgcugcaccaccacccgagccugggagccagcgucccagccuaaucac

SEQ ID NO: 246115 - RNA, 64 nt, Human
cucccagugccuucugggaagggagagggccucugccugggacacugcgggacagaggguggcu

SEQ ID NO: 246116 - RNA, 64 nt, Human
cccuucuccaaccccuucauaagcuugggccacugccugggacccagcagacacugcccaggac

SEQ ID NO: 246117 - RNA, 64 nt, Human
gggggagcacugagaagcacagcacaggggcucagccugggauccggugauggucugggcagag

SEQ ID NO: 246118 - RNA, 64 nt, Human
gacgggcugguauagucccaggcuggagcuggaugccugggaaccacucaccuccuucugugcc

SEQ ID NO: 246119 - RNA, 64 nt, Human
uuuuuucggaggggguugguggggaggucgggaugccugggaucccuuccuggagaggcaggcu

SEQ ID NO: 246120 - RNA, 64 nt, Human
accaaugcccccuccccuucagcugugacaucgugccugggaaggcgaaauauacccccagccc

SEQ ID NO: 246121 - RNA, 64 nt, Human
cgccagggagcaccuggugagucugccggcgguggccugggauuggcugugaggucccuccgca

SEQ ID NO: 246122 - RNA, 64 nt, Human
cuguccaggaagagcuguguggccuggcaagcaagccugggagccggcgggaggucugccaggc

SEQ ID NO: 246123 - RNA, 64 nt, Human
aggcaggaccaggcauuuagcuaguuagagacucgccugggaaauugcuccauuccugaguaaa

SEQ ID NO: 246124 - RNA, 64 nt, Human
ggaccgugaguguggggcugggcagaggcggucagccugggagucccggaggccaggcugcaca

SEQ ID NO: 246125 - RNA, 64 nt, Human
cucagcugagggaagguacgagcucccugcuggagccugggacccauggcacaggccaggcagc

SEQ ID NO: 246126 - RNA, 64 nt, Human
agcauacuuuguuguuaguaaauagaugaggcaugccugggaaaugcucccuuggcauaaauag

SEQ ID NO: 246127 - RNA, 64 nt, Human
uagucuucuuccagaaacagagaaggggaugugugccugggagaggcucugucuccuuccugcu

SEQ ID NO: 246128 - RNA, 64 nt, Human
uaauguauuaauaccacugagaccuucaggccuugccugggauaucacuucauccugaaguuug

SEQ ID NO: 246129 - RNA, 64 nt, Human; identical to SEQ ID NO: 195626

SEQ ID NO: 246130 - RNA, 62 nt, Human
ccuccacucgcucgggcucaccccaagccccagcccgcgaggccuccccuccgccugauuuc

SEQ ID NO: 246131 - RNA, 62 nt, Human
agccugccagggaaucacagagacaucggggugcccgcgauggcccucaugaagccaugccu

SEQ ID NO: 246132 - RNA, 64 nt, Human
gcugucugacuauccauccaucauaaccaccccagccugggaaggagagcuugcuuuuguugcu

SEQ ID NO: 246133 - RNA, 64 nt, Human
aaugaaaagcacaccuacccuuuggcguaauccugccugggaaggagagagguuuagugccaug

SEQ ID NO: 246134 - RNA, 64 nt, Human
gaaucacaugcggcaagaggcaacuggcuccacagccugggaugcugccguaccaagaggaaag

SEQ ID NO: 246135 - RNA, 64 nt, Human
agccgcgaggacugagggcgguauacggugcggggccugggaugcccgcgccacccgcagcccc

SEQ ID NO: 246136 - RNA, 64 nt, Human
guaagcccucagcauccugaauacaucauccgcagccugggaaccuucucccucguacagcaca

SEQ ID NO: 246137 - RNA, 64 nt, Human
uuccucccuuuaaauugagccccuaagagcacuggccugggagucagacagaccuggguucaag

SEQ ID NO: 246138 - RNA, 64 nt, Human
cuacucaggaggcugaggcacgagaaucgcuugagccugggaggcagagguugcagugagcuga

SEQ ID NO: 246139 - RNA, 64 nt, Human
accuucuaggccugcuuuccagacuucugagauagccugggaugagcaauccuguuauaguaca

SEQ ID NO: 246140 - RNA, 64 nt, Human
guucaaacaugucuccacuacccuguuaagagcagccugggaacguacaggccaucaagacuau

SEQ ID NO: 246141 - RNA, 64 nt, Human
cuacuugggaggcuuagucaggaggaucucuugagccugggaggucaaggcugcagugaaccau

SEQ ID NO: 246142 - RNA, 64 nt, Human
ugaugucuggcccuggggaauggcaccaguuccagccugggaaucaacccaguuccugagugcc

SEQ ID NO: 246143 - RNA, 64 nt, Human
uccugggacaagggucaagccaggaugggcccaggccugggaucccccaccccaggacccccag

SEQ ID NO: 246144 - RNA, 64 nt, Human
aaguuuucccucuuuuguggugaggaggacacaggccugggaaaaauaggaacagaguucuugu

SEQ ID NO: 246145 - RNA, 64 nt, Human
acuggcaggggagacaggagccuagcggagcccagccugggagcccagaggguggcaagaacag

SEQ ID NO: 246146 - RNA, 64 nt, Human
aggucacugagaaaugccacagaaugugcaggaagccugggaggcuucugugaggaaugugagg

SEQ ID NO: 246147 - RNA, 64 nt, Human; identical to SEQ ID NO: 195628

SEQ ID NO: 246148 - RNA, 64 nt, Human; identical to SEQ ID NO: 195629

SEQ ID NO: 246149 - RNA, 64 nt, Human; identical to SEQ ID NO: 195630

SEQ ID NO: 246150 - RNA, 64 nt, Human
gcacuaaggcaggaggguuggagggcugggugcagccugggaguccgaugguuuucagcaggag

SEQ ID NO: 246151 - RNA, 64 nt, Human
ccagacgcacacuguccgagcccucugcucagccgccugggacccaccagggugcagcugggcu

SEQ ID NO: 246152 - RNA, 64 nt, Human
cccuccucugucaucacagcgccagggcagcugugccugggacaggagccacacagucagaggg

SEQ ID NO: 246153 - RNA, 64 nt, Human
ucuuuuuuuuugugacuccuguggacuccacugcgccugggaucucgccaaccccucucucauu

SEQ ID NO: 246154 - RNA, 64 nt, Human
cuacuugggaggcugagaugggaggaccauuugagccugggagaucgaggcugcagugagccaa

SEQ ID NO: 246155 - RNA, 64 nt, Human
acucaggaggcagagacgugggaggaucgcuugagccugggagauugaggcugcacugagcugu

SEQ ID NO: 246156 - RNA, 64 nt, Human
ggguucauucuggugacacagcaacagaugccuggccugggaacccagggauuucaccuccacc

SEQ ID NO: 246157 - RNA, 64 nt, Human
uaacaaguuuacuuccggucugcuagcacccucagccugggagcuacugccagaggcuggcgua

SEQ ID NO: 246158 - RNA, 64 nt, Human
cuccuggggccucuugggucccccacgugacagugccugggaauguauuauucugcagcaugac

SEQ ID NO: 246159 - RNA, 64 nt, Human
cuugcuucuugcguugauacuuugccccagaaaggccugggauucauucugguucuuaucaggg

SEQ ID NO: 246160 - RNA, 64 nt, Human
ggggaggcuggagcuccaugcacguaguccagaugccugggaaggaacaucucccuuccagcau

SEQ ID NO: 246161 - RNA, 64 nt, Human
gccccuggagggccuggcauguuuguccugcucugccugggacugagcgaguggacuuagggcu

SEQ ID NO: 246162 - RNA, 64 nt, Human
acuggggucugaagaucagggucaguguggcugugccugggaauuccagaccugagguugggaa

SEQ ID NO: 246163 - RNA, 64 nt, Human
uucuaccuaggacucuucccuggagucaugggcugccugggacccaggacccaugagggggcug

SEQ ID NO: 246164 - RNA, 64 nt, Human
guauuuagacuccaaaguuuauacugagcucagugccugggaccgcuccagcugcacugcagcc

SEQ ID NO: 246165 - RNA, 64 nt, Human; identical to SEQ ID NO: 195637

SEQ ID NO: 246166 - RNA, 64 nt, Human; identical to SEQ ID NO: 195638

SEQ ID NO: 246167 - RNA, 64 nt, Human; identical to SEQ ID NO: 195639

SEQ ID NO: 246168 - RNA, 64 nt, Human
aaucauuucuaggacacagugaucagggaagggugccugggacuuggagggucccauguaugga

SEQ ID NO: 246169 - RNA, 64 nt, Human
gucaguggcgacucgguuccuggggcugcagccagccugggacuuuuguaagaauuuuugggug

SEQ ID NO: 246170 - RNA, 64 nt, Human
ucuuggauagcuaauaaugagcuauuaaaacucagccugggacaguuuaucaugaagccugugg

SEQ ID NO: 246171 - RNA, 55 nt, Human
auguaauuaagacguguugagauuggccugggaauaucaucauuuucuaguugac

SEQ ID NO: 246172 - RNA, 64 nt, Human
ccaacacuuugggaggccaggaguuuugagaccagccugggaaacaucugucucuacaaaaaaa

SEQ ID NO: 246173 - RNA, 64 nt, Human
gcagccgcuccucagaggccugugcccaucgcaggccugggaggaaagugggcgcagagcccuc

SEQ ID NO: 246174 - RNA, 64 nt, Human
uggcugggcccacggaaggucggccugggauguggccugggacugcugcucugcuggcugcugu

SEQ ID NO: 246175 - RNA, 64 nt, Human
gcucauagggaauggcugggcccacggaaggucggccugggauguggccugggacugcugcucu

SEQ ID NO: 246176 - RNA, 64 nt, Human
accgucuuuucaaauggccugggagagucaaauggccugggagagggggccugcccuucucugc

SEQ ID NO: 246177 - RNA, 64 nt, Human
aaugguaugugaagaugcaccgucuuuucaaauggccugggagagucaaauggccugggagagg

SEQ ID NO: 246178 - RNA, 64 nt, Human
cuacucugggggccaaggcaggagaauugcuugagccugggagauggagguugcagugagcuga

SEQ ID NO: 246179 - RNA, 64 nt, Human
gcuaaggaaauggggauuugagcacaacaggaaagccugggaggguuguugggaugcaaggagg

SEQ ID NO: 246180 - RNA, 64 nt, Human
gagaggguccaagggugauggagaaggaagcauggccugggagcuuggaagggagggguggugg

SEQ ID NO: 246181 - RNA, 64 nt, Human
gugccugugugugaaccugggggccauccugguggccugggagcgugaggagaggcccccugug

SEQ ID NO: 246182 - RNA, 64 nt, Human
gcuggccccuagugagugggcucgagggaggguugccugggaaccccaggaauugacccugagu

SEQ ID NO: 246183 - RNA, 64 nt, Human; identical to SEQ ID NO: 195642

SEQ ID NO: 246184 - RNA, 64 nt, Human; identical to SEQ ID NO: 195643

SEQ ID NO: 246185 - RNA, 64 nt, Human; identical to SEQ ID NO: 195644

SEQ ID NO: 246186 - RNA, 64 nt, Human
cuauugguaaggcugagguggaagguucacuugagccugggagguggagguuguagugagccaa

SEQ ID NO: 246187 - RNA, 64 nt, Human
uccuacuaacucugagcugaagccgacgucgccagccugggagcgaccacuuuggcugcgggga

SEQ ID NO: 246188 - RNA, 64 nt, Human
cuugugcugcugccuagacaguagggauguaaaggccugggagcuagacccuccccaagcccau

SEQ ID NO: 246189 - RNA, 64 nt, Human
ugagugaggaagggaauggaccagggagucccaggccugggacccagagccaagaaagcugaga

SEQ ID NO: 246190 - RNA, 64 nt, Human
ccaacaaauucagccuccucucccaggggccucagccugggaagucaccaagcagaucccuccu

SEQ ID NO: 246191 - RNA, 64 nt, Human
uauagugcggggcccugcgacugguaccgugagcgccugggaugagguuugggcggauuucggg

SEQ ID NO: 246192 - RNA, 64 nt, Human
uggaauugagugcucauggguuggccucauaucagccugggaguuauuuuugauauguagaaug

SEQ ID NO: 246193 - RNA, 64 nt, Human
caggucaccagccugacugcacacagcuaggcaugccugggaauccugcugccagagaaccauu

SEQ ID NO: 246194 - RNA, 64 nt, Human
uagcaccuccccuugcgugcuuuaaaugacaucugccugggauguaccacaaccauauguuacc

SEQ ID NO: 246195 - RNA, 64 nt, Human
acaccagcagauccccaggggcugcugggcaguggccugggaaugggguggauugugagaaagu

SEQ ID NO: 246196 - RNA, 64 nt, Human
ggaucugaaguagagaucagcaggaagccuugcugccugggacauagagaucaucuggccaccc

SEQ ID NO: 246197 - RNA, 64 nt, Human
gguuccucgaacucugcaccuuccuccaccaggagccugggauauggcuccaucugccuucagg

SEQ ID NO: 246198 - RNA, 64 nt, Human
uggacuuuguuaaaauaauaggcggaaagaagaggccugggaagggcccccagucuuuuggaau

SEQ ID NO: 246199 - RNA, 64 nt, Human
ugcauuuuugacuuaugggccgaggcuguucugagccugggaagauguaccuaugucaagagaa

SEQ ID NO: 246200 - RNA, 64 nt, Human
ccucguggggcagagggcccggggccgccgccuggccugggagucccucccugguuuuuauucu

SEQ ID NO: 246201 - RNA, 64 nt, Human; identical to SEQ ID NO: 195607

SEQ ID NO: 246202 - RNA, 55 nt, Human; identical to SEQ ID NO: 189045

SEQ ID NO: 246203 - RNA, 62 nt, Human
uggaagagugacugcuaagucccuuugcuccugcccgcgagagacugucgggaaguugaccc

SEQ ID NO: 246204 - RNA, 64 nt, Human
ggccaggagacacauggcuggacaaggcuuugcagccugggagaccccgacuuucucuaaccca

SEQ ID NO: 246205 - RNA, 64 nt, Human
caacagacgggcgccaccaaagccaggcccugaggccugggaguccuggacugagaaagggggu

SEQ ID NO: 246206 - RNA, 64 nt, Human
ggcaucacugucucuagggguuuggcuacuguuggccugggagcugagagaaggcacugagagg

SEQ ID NO: 246207 - RNA, 64 nt, Human
caccaucugcauguccccacugggccugagucuagccugggagccaggauacugggguccuuuu

SEQ ID NO: 246208 - RNA, 64 nt, Human
gcaauuacuuuguucacuguaugcacccgcgggggccugggaguccccauuugcagguggguag

SEQ ID NO: 246209 - RNA, 64 nt, Human
cuacuggggaggcugaggugggaggaucguuugagccugggaggcagagguugcagugaucagg

SEQ ID NO: 246210 - RNA, 64 nt, Human
auuuacuuauuaguuuuuaaaaauugcgcuacuugccugggaaacauagcagaccucguuucua

SEQ ID NO: 246211 - RNA, 64 nt, Human
uuacagugagcaaagauugugccacuacacuccagccugggagacagagcgagacucuugucuc

SEQ ID NO: 246212 - RNA, 64 nt, Human
uccuuccugcccauggcacccuccucugcugucugccugggagcccuaggcucucuagggcccc

SEQ ID NO: 246213 - RNA, 64 nt, Human
auuauccccuguugucuccuguagcuuugauaaugccugggagauuccuugguguaagugucau

SEQ ID NO: 246214 - RNA, 64 nt, Human
caguaaagggaagggugggcuuaaugggagcuuugccugggaccugaaccuggagcacuuaccg

SEQ ID NO: 246215 - RNA, 64 nt, Human
cucuccagcucucuuguuuaugcaaacgccgagcgccugggaggcucgguaggaggagucuucc

SEQ ID NO: 246216 - RNA, 64 nt, Human
ugucacuggcuucagugaacacagacacugcagagccugggagcaggggaggggaauaguugag

SEQ ID NO: 246217 - RNA, 64 nt, Human
gaaucggucucauuagagugacucuuagaagguggccugggacuagacagccccucugagcaca

SEQ ID NO: 246218 - RNA, 64 nt, Human
acccagcuuggucucuccugaguccuccacccuggccugggauuggccagggagcagggcgggc

SEQ ID NO: 246219 - RNA, 64 nt, Human; identical to SEQ ID NO: 195602

SEQ ID NO: 246220 - RNA, 64 nt, Human; identical to SEQ ID NO: 195612

SEQ ID NO: 246221 - RNA, 64 nt, Human; identical to SEQ ID NO: 195647

SEQ ID NO: 246222 - RNA, 64 nt, Human
ccuugcagagccugaagccuggggagaaggcccagccugggacccucugggcugcuguggcucc

SEQ ID NO: 246223 - RNA, 64 nt, Human
uugcagugagccgagaucacaccacugcacuccagccugggagacagaacgagacuccuaauca

SEQ ID NO: 246224 - RNA, 54 nt, Human
ucugugcugaaagacgcugaaacugccugggauguuuucgggaacaagaaugua

SEQ ID NO: 246225 - RNA, 64 nt, Human
gagaguugucuguuauguucacuguauucuaagugccugggauaaagcugucucaugggugcuc

SEQ ID NO: 246226 - RNA, 64 nt, Human
cuuacuggcaaccacacaacucagggaaaggaaugccugggagugggggugcaggcgggcagca

SEQ ID NO: 246227 - RNA, 64 nt, Human
aaaagcuuccccuuggcuguggcccucuguguaugccugggauccuuccaagcacucauagccc

SEQ ID NO: 246228 - RNA, 64 nt, Human
ggccauguagcaaguggggaaauacauccaaagggccugggaguuggggggugcccaacgcaau

SEQ ID NO: 246229 - RNA, 64 nt, Human
aauauaaaauuaaucauuucucaccaaagaguaugccugggagccuccagcuguuaaaagacaa

SEQ ID NO: 246230 - RNA, 64 nt, Human
agggaggugaggaagaggaaaagcccucuugucagccugggaagaccuuuucgagggagucucc

SEQ ID NO: 246231 - RNA, 64 nt, Human
guuccaacuucaagccgguaacugcacacaacaggccugggagcgaacugugugaaggaccuua

SEQ ID NO: 246232 - RNA, 64 nt, Human
cuccugggacgagaaggacucauccagcaaaguugccugggauucaaaauaaaggcauugcaga

SEQ ID NO: 246233 - RNA, 64 nt, Human
ucccagcuacucaggaggcaggagaaucgcuugagccugggaggcagaggcugcggugagccga

SEQ ID NO: 246234 - RNA, 64 nt, Human
gggaccuugccaggccuggugucugaggacaggagccugggagaggcggguggagcgugaagca

SEQ ID NO: 246235 - RNA, 64 nt, Human
cugcagugagcuaugauugugccacuguacuccagccugggagauagagcaagacuccaucucu

SEQ ID NO: 246236 - RNA, 64 nt, Human
acaggcggggcuggaauucuggcggagggcaugagccugggacuccaugucacguuuccuucug

SEQ ID NO: 246237 - RNA, 64 nt, Human; identical to SEQ ID NO: 195584

SEQ ID NO: 246238 - RNA, 64 nt, Human; identical to SEQ ID NO: 195631

SEQ ID NO: 246239 - RNA, 64 nt, Human; identical to SEQ ID NO: 195650

SEQ ID NO: 246240 - RNA, 64 nt, Human
cugcagugagcugagauugugccacugcacuccagccugggagacagagcaagacucagucuca

SEQ ID NO: 246241 - RNA, 64 nt, Human
gcacccucccuuaggaaugaggagugggcaucaggccugggacacugcucuccuuccccgcccc

SEQ ID NO: 246242 - RNA, 64 nt, Human
uuggagcaggagugaagauguuucauuaucuugggccugggaaaccacuuccccaggcuucucc

SEQ ID NO: 246243 - RNA, 64 nt, Human
cuaaaaguggcaacauuugcccccagaauugggggccugggaacacuggaccugcuccuucucc

SEQ ID NO: 246244 - RNA, 64 nt, Human
cacacuuuucaggugccacuguaagguucucucagccugggaaacuaucaacucuuucuuuaaa

SEQ ID NO: 246245 - RNA, 64 nt, Human
cuacuugggagacugagacaugagaaucgcuugagccugggaggcggagguugcaaugagccaa

SEQ ID NO: 246246 - RNA, 64 nt, Human
cuacucggaaggcugaggcaggaggaucacuugagccugggaauucgaagcugcagugagcuau

SEQ ID NO: 246247 - RNA, 64 nt, Human
augaaaccucagccuaaaacucauaggacugacugccugggaggaggguuaggucugcuucuuc

SEQ ID NO: 246248 - RNA, 64 nt, Human
ggcgggcgguggccuagagacccaggaccugggcgccugggaaaauggaaugcaacccacauug

SEQ ID NO: 246249 - RNA, 64 nt, Human
cagugcugucacugcagaaggccagauggcaggugccugggacaggggcaggugccccggggag

SEQ ID NO: 246250 - RNA, 64 nt, Human
acaguuugaguuagguuuaccucccccuuucugugccugggaacuguuugguccagcuuuagaa

SEQ ID NO: 246251 - RNA, 64 nt, Human
uuguagugagcccagauugugccacugcucuccagccugggaggcacagcaaacugucccccaa

SEQ ID NO: 246252 - RNA, 64 nt, Human
cuacuugggaggcugaguugggaggaucacuugagccugggagguugaggcugcagugaacuga

SEQ ID NO: 246253 - RNA, 64 nt, Human
aggaggaucacuugagcccaggaguucaagaccagccugggaacacagcgagacccucucauua

SEQ ID NO: 246254 - RNA, 64 nt, Human
gguuuuucccuuuugccuaaaucagaacucaacagccugggaaaaucacugacaaauaguggau

SEQ ID NO: 246255 - RNA, 64 nt, Human; identical to SEQ ID NO: 195571

SEQ ID NO: 246256 - RNA, 64 nt, Human; identical to SEQ ID NO: 195594

SEQ ID NO: 246257 - RNA, 64 nt, Human; identical to SEQ ID NO: 195621

SEQ ID NO: 246258 - RNA, 55 nt, Human
ccucaaggaauccucucugaaugcagccugggacccaggugagggaggauggagg

SEQ ID NO: 246259 - RNA, 64 nt, Human
ugcuuugucauauagcacagaaguccuccacacugccugggacaguguccugcauccacacagu

SEQ ID NO: 246260 - RNA, 64 nt, Human
aguccagagcccaccuccucaguuccuguggauagccugggaggcagguagaacagaacucaca

SEQ ID NO: 246261 - RNA, 64 nt, Human
cccucccagccuaccccuccugcgcugccccagagccugggaaggaggccgcuaugcaggguag

SEQ ID NO: 246262 - RNA, 64 nt, Human
cuaccugggaggcugaggcgggagaaucaccugagccugggaggucgaggcugcagcgagccga

SEQ ID NO: 246263 - RNA, 64 nt, Human
ugacaucuacguauggcuccacaccuccaaugcugccugggagccagggugagagucugggucc

SEQ ID NO: 246264 - RNA, 64 nt, Human
guggcccaaaggcuaugcuugccuccggcugagugccugggauaggccuuuucuaugucucccc

SEQ ID NO: 246265 - RNA, 64 nt, Human
ccauugaaucagugaacuagaaagaucugauuuggccugggaccaguguucaaguugguuuggu

SEQ ID NO: 246266 - RNA, 64 nt, Human
uaugaauuaauaugcacuuucugaaaacucuaaagccugggaaacauuuuaguuuuuguuaagg

SEQ ID NO: 246267 - RNA, 64 nt, Human
augcagcacaagaaggggagcugucagucguguggccugggagaaccaggagccgccggccagg

SEQ ID NO: 246268 - RNA, 64 nt, Human
aggauguucuguuuaaucaacagcucagccagcugccugggaguuuuggcauuaagccccgccu

SEQ ID NO: 246269 - RNA, 64 nt, Human
guccuugagccacaagaaguggaggggagaccaugccugggaacagacccccuuuucacagcag

SEQ ID NO: 246270 - RNA, 64 nt, Human
uggagccacgggauggggugggggagccccaugggccugggaaggagggugcuguggagggggc

SEQ ID NO: 246271 - RNA, 64 nt, Human
aggaggccuggccugggcacacgcacugacgugggccugggagauugucccagggccuugugga

SEQ ID NO: 246272 - RNA, 64 nt, Human
uguguaaucagccugagugugaaaguuaauggaggccugggaacaggguuuauacuaaguagug

SEQ ID NO: 246273 - RNA, 64 nt, Human; identical to SEQ ID NO: 195546

SEQ ID NO: 246274 - RNA, 64 nt, Human; identical to SEQ ID NO: 195547

SEQ ID NO: 246275 - RNA, 64 nt, Human; identical to SEQ ID NO: 195548

SEQ ID NO: 246276 - RNA, 64 nt, Human
uugcagugagccgagagcaugccgcugcacuccagccugggagacugcaucucaaaaaagaaaa

SEQ ID NO: 246277 - RNA, 64 nt, Human
uugcagugagcugagaucgcaccacugcacuccagccugggagauacagcgagacugucuccaa

SEQ ID NO: 246278 - RNA, 64 nt, Human
ccaaggacugccgcgccuccuggccaggcagggcgccugggagaaccccuacacugcccuggcc

SEQ ID NO: 246279 - RNA, 64 nt, Human
ccaucaugacuagacgagaaccgucuuuacccgggccugggagcucagugacauaaaugcugaa

SEQ ID NO: 246280 - RNA, 64 nt, Human
uucugaggaagccaagacgccaggagaggcucaggccugggagucaguaguuuccuaagaggga

SEQ ID NO: 246281 - RNA, 64 nt, Human
cuagcacugugacaccaccccuaaaucacuuugagccugggaaauaagcccccucaacuaccau

SEQ ID NO: 246282 - RNA, 64 nt, Human
ccucccaggcccagagcuagcugacuguguaugagccugggagaaugugucuccuccacagugg

SEQ ID NO: 246283 - RNA, 64 nt, Human
agcugggacaccaagaacaagcuguuagaucacugccugggaggcuuggcuuaguacucucauc

SEQ ID NO: 246284 - RNA, 64 nt, Human
uugugaugagccaaggucaugccacugcacuccagccugggagacagagcaagacuccaucuca

SEQ ID NO: 246285 - RNA, 64 nt, Human
aguuggcaguggggagauuuccacuguggaaaccgccugggaauuccggccagcagcuuccucc

SEQ ID NO: 246286 - RNA, 64 nt, Human
aaaucaugaaauuaaagucugaggacgagagcacgccugggagcgaaagcuggccuuuuuucua

SEQ ID NO: 246287 - RNA, 64 nt, Human
acugagcuccuuuguuccucccccuccagccuuugccugggaacugguccuuguuugccgggcu

SEQ ID NO: 246288 - RNA, 64 nt, Human
acgugcacaaaaccacugccagauaaccagaggggccugggaagggagaagaauuaguguauuu

SEQ ID NO: 246289 - RNA, 64 nt, Human
ucagggcaaaaggugagguggugaaguggcccgggccugggaacugcuggcucuaagaaccuuc

SEQ ID NO: 246290 - RNA, 64 nt, Human
cuacuuggggggcugagguggcaggaucgcuugagccugggagguugagacugcagugagccaa

SEQ ID NO: 246291 - RNA, 64 nt, Human; identical to SEQ ID NO: 195551

SEQ ID NO: 246292 - RNA, 64 nt, Human; identical to SEQ ID NO: 195552

SEQ ID NO: 246293 - RNA, 64 nt, Human; identical to SEQ ID NO: 195553

SEQ ID NO: 246294 - RNA, 64 nt, Human
gaaaccuacauuccgucaguuuccgaaugcgagggccugggaugaauuuggugccuuuccauau

SEQ ID NO: 246295 - RNA, 64 nt, Human
accucacccacugugacccgccgcuuccccuucagccugggaccaggcuuuccuagaucccagc

SEQ ID NO: 246296 - RNA, 64 nt, Human
ggauggcugggucccccagccccugccagcagcugccugggaaggccguguuucagcccugaug

SEQ ID NO: 246297 - RNA, 64 nt, Human
uccaggagacccuagaugugcucguacucccucggccugggauuucagagcuggaaauauagaa

SEQ ID NO: 246298 - RNA, 64 nt, Human
cuauccaugcacuuggguggaggggagucucugugccugggaauuaggaccccugcuccaacca

SEQ ID NO: 246299 - RNA, 64 nt, Human
cagccuggauccuuccagagcaucccuccuggaggccugggaugggguaggucugcagcuagcc

SEQ ID NO: 246300 - RNA, 64 nt, Human
uuacugagguuugagagaacaucccuccaggggagccugggagcugcucucccagucuaagcau

SEQ ID NO: 246301 - RNA, 64 nt, Human
ggauggcaaugugauuggugcuauaacucaggcagccugggagucaggaacccagacaaggaau

SEQ ID NO: 246302 - RNA, 64 nt, Human
guuuaccccuguggugugguuuaaaaaucuauaggccugggaauuccgauccuagcugcagauc

SEQ ID NO: 246303 - RNA, 64 nt, Human
agggacuggaaaccuuccuccucgggaaagaaaugccugggaggaagggaagccugauauucag

SEQ ID NO: 246304 - RNA, 64 nt, Human
guccugagguacagagccacugccaccacuggcggccugggaccagcugggugucagccacgga

SEQ ID NO: 246305 - RNA, 64 nt, Human
cgucuuggcuccaccucuguccucucucuagccugccugggaaugaaugaagcucuguuagaaa

SEQ ID NO: 246306 - RNA, 64 nt, Human
ucaaguaagcgacauaguaguucagguggcccaugccugggaucuucucuaugauugauacaug

SEQ ID NO: 246307 - RNA, 64 nt, Human
cuacucgggaggcugaggcaggagaaucacuugagccugggaggcagaaguugcagugagccga

SEQ ID NO: 246308 - RNA, 64 nt, Human
agcaguaaggaagaggaauauauagcaacucagggccugggaauuguggggcaauccguucuua

SEQ ID NO: 246309 - RNA, 64 nt, Human; identical to SEQ ID NO: 195645

SEQ ID NO: 246310 - RNA, 60 nt, Human; identical to SEQ ID NO: 189052

SEQ ID NO: 246311 - RNA, 62 nt, Human
uuccagaucugggccaaucauccuggacagaggcccgcgaggcagcuuugcccuguccaccu

SEQ ID NO: 246312 - RNA, 64 nt, Human
uugcagugagccgagaucgcgccacggcacuccagccugggagacagagcaagacuccgucuca

SEQ ID NO: 246313 - RNA, 64 nt, Human
cuagccacagcgcgggccuugugcuggaguuugagccugggacagggagagggaggcuuggaga

SEQ ID NO: 246314 - RNA, 64 nt, Human
cagggaagaugcauaagcacuaagcugugugccugccugggagacuuccuugugucagggcagg

SEQ ID NO: 246315 - RNA, 64 nt, Human
caucgaggagcuccagcuguugggacaccaaggagccugggagcacgcagaggccuguguucac

SEQ ID NO: 246316 - RNA, 64 nt, Human
aauuugccaggauaucugcaucaagaguacuguagccugggaaaccugaacaccugaaaugcau

SEQ ID NO: 246317 - RNA, 64 nt, Human
ggggcucuacugccaucuauagaugguguccugggccugggaaacuagguucccagggguugag

SEQ ID NO: 246318 - RNA, 64 nt, Human
ugcuauuccuccugucccaaccugggagguccuagccugggagaucaaggcuacagugagccgc

SEQ ID NO: 246319 - RNA, 64 nt, Human
aggaggcagcgcccaucucagcagcaccaggacugccugggacucccuggcaacccagcaccgg

SEQ ID NO: 246320 - RNA, 64 nt, Human
gccucgagggagcugcaucuugcagccguguggagccugggacuuugagcagcagggagugcau

SEQ ID NO: 246321 - RNA, 64 nt, Human
cuuagaaaaagcuuuccugaaucccucugacguugccugggaucuuucuguugauucgucuuuu

SEQ ID NO: 246322 - RNA, 64 nt, Human
augcucaggcagcuaagggaggacgccugcccacgccugggacagaaggcuucacugcuaauca

SEQ ID NO: 246323 - RNA, 64 nt, Human
ggcugcacacuccuggacugggcuagccugcacugccugggaaagucggccgagggcccaaagc

SEQ ID NO: 246324 - RNA, 64 nt, Human
ggccacggagacucugcuccugcauggaaagggagccugggagccagcagcccacgccugggga

SEQ ID NO: 246325 - RNA, 64 nt, Human
aguggcucuuuuuagcuaggcgaguacagacggggccugggagggggcagagauguuccccagg

SEQ ID NO: 246326 - RNA, 64 nt, Human
agccuuucuagaaggcagacuuagccccagcagagccugggaggaaggcggccgcuggggcucc

SEQ ID NO: 246327 - RNA, 64 nt, Human; identical to SEQ ID NO: 195556

SEQ ID NO: 246328 - RNA, 64 nt, Human; identical to SEQ ID NO: 195561

SEQ ID NO: 246329 - RNA, 64 nt, Human; identical to SEQ ID NO: 195562

SEQ ID NO: 246330 - RNA, 64 nt, Human
cgggcuccagcgauucuccugccucccugccucagccugggaccugaguagcugggaccacagg

SEQ ID NO: 246331 - RNA, 64 nt, Human
uauucccgggguaccaagcagcugcacagucggugccugggaggcacguagaggcccagagagu

SEQ ID NO: 246332 - RNA, 64 nt, Human
agaguggaguuacugcagggaagcuaccggaccugccugggagccagugaagggcgagucaggg

SEQ ID NO: 246333 - RNA, 64 nt, Human
cugagucugcagaugaggacuagggcuuauccaugccugggaaaugccaccuccuggaaggcag

SEQ ID NO: 246334 - RNA, 64 nt, Human
guccacgugugugugugauugcacgugccugugggccugggauaaugcccaugguacuccaugc

SEQ ID NO: 246335 - RNA, 64 nt, Human
uugaaacaaaugaggguuggguaggagcuuccaggccugggauuuacaccacgccuagcccagc

SEQ ID NO: 246336 - RNA, 64 nt, Human
caguggaggccgagucuguccuggaaccaggcuugccugggacggcugagcugggcagcuggaa

SEQ ID NO: 246337 - RNA, 64 nt, Human
ccagggccagcuuggcgauaggugccucaaggcugccugggagccccgccucccuaccauggug

SEQ ID NO: 246338 - RNA, 64 nt, Human
gggaggggcucugccgcuuagcagagaagaaagggccugggagguggugggagggagaaggaag

SEQ ID NO: 246339 - RNA, 64 nt, Human
gccuuccccagugggaaguuagggaagcucaggagccugggaccccgcaugucccaaaauggga

SEQ ID NO: 246340 - RNA, 64 nt, Human
aaacccauacuacacaucccacuucugggucuuugccugggauguugcugacacccagaaaguc

SEQ ID NO: 246341 - RNA, 64 nt, Human
cuggccugugucuaguuguuugauucagacagcugccugggaucccucauccucauacccaccc

SEQ ID NO: 246342 - RNA, 64 nt, Human
ugagggucuggcacauccuuaauccugugccccugccugggacagaaauguggcuccaguugcu

SEQ ID NO: 246343 - RNA, 64 nt, Human
ccuggagcuacagggacagggagccaucauuccugccugggaauccuggaagacuuccugcagg

SEQ ID NO: 246344 - RNA, 64 nt, Human
aaggcgccaucuggugucugcauggguguuggcagccugggagugaucacugcacgcccaucgu

SEQ ID NO: 246345 - RNA, 64 nt, Human; identical to SEQ ID NO: 195565

SEQ ID NO: 246346 - RNA, 64 nt, Human; identical to SEQ ID NO: 195566

SEQ ID NO: 246347 - RNA, 64 nt, Human; identical to SEQ ID NO: 195567

SEQ ID NO: 246348 - RNA, 64 nt, Human
auuuuuuaagagacaguuucgcuccaucgcccaggccugggaugcagugaugugaucauagcuc

SEQ ID NO: 246349 - RNA, 64 nt, Human
gcugaccagagcaagaucugggcaagcagagagugccugggacaggacugugaccugguggaca

SEQ ID NO: 246350 - RNA, 64 nt, Human
ccucugcagagacucccuucaccucgcacuuacugccugggaaccacggcccuucucuucugug

SEQ ID NO: 246351 - RNA, 64 nt, Human
cucuggccaggguugcuuggagaaggcucagugugccugggacagggcuuaccaccugccacca

SEQ ID NO: 246352 - RNA, 64 nt, Human
aagaauagcugcuuccgcccccggauuugcucaggccugggaauccgcugacugaaggccucuu

SEQ ID NO: 246353 - RNA, 64 nt, Human
gucuccacgugguguguuucgugggaacaacugggccugggauggggcuucacugcugugacuu

SEQ ID NO: 246354 - RNA, 64 nt, Human
uccccccgcugucuuugaguugugguggacgcuggccugggaugagagggcccagaagaccuuc

SEQ ID NO: 246355 - RNA, 64 nt, Human
caccuugcaagccucgagcuguagccacccucaggccugggaagaggccugggccgaccucaca

SEQ ID NO: 246356 - RNA, 64 nt, Human
gaggggcugggaagggccguucugggcucaccuggccugggagacccaucuggucccugcgucc

SEQ ID NO: 246357 - RNA, 64 nt, Human
cacaauucugacccgccaccucuccaggggcggugccugggauggccacccaucaggacagcca

SEQ ID NO: 246358 - RNA, 64 nt, Human
aaaccccagguuauuucuucccugcccagagccagccugggauugucagccuucaauccccuuu

SEQ ID NO: 246359 - RNA, 64 nt, Human
uccucauagguagguggccuuggccuucaucccagccugggaugcuccauugcauuugucaccu

SEQ ID NO: 246360 - RNA, 64 nt, Human
aaagcaccccugaguuccaucuuccugacauguugccugggaugugacgggccugacaucuccc

SEQ ID NO: 246361 - RNA, 64 nt, Human
cacucaagguguucguggggcuggcuccugaagggccugggaggguccaucagcugccuccagc

SEQ ID NO: 246362 - RNA, 64 nt, Human
ccucugacccccucuuccucacauggggucgggggccugggaguucauucuggaccagcccacc

SEQ ID NO: 246363 - RNA, 64 nt, Human; identical to SEQ ID NO: 195544

SEQ ID NO: 246364 - RNA, 64 nt, Human; identical to SEQ ID NO: 195549

SEQ ID NO: 246365 - RNA, 64 nt, Human; identical to SEQ ID NO: 195570

SEQ ID NO: 246366 - RNA, 64 nt, Human
guccuugugacacuggccugucugaacucaccuggccugggaagcaccgucugcccgggcccaa

SEQ ID NO: 246367 - RNA, 64 nt, Human
aauuggcaaagguuccuaaaugguaaucuggccggccugggagaaagacucacgagaaaagcca

SEQ ID NO: 246368 - RNA, 64 nt, Human
ugguucuuggaaguaaugucgucuugugacauuggccugggacaaucauuguggguagguaguu

SEQ ID NO: 246369 - RNA, 64 nt, Human
cccgagcgcagaggcggagcugugcucagcacaggccugggaccucccccggcaggcaccugug

SEQ ID NO: 246370 - RNA, 64 nt, Human
agccagucugccucuuccuccuacuucugcuguagccugggaccagaccuggccaaggucagcc

SEQ ID NO: 246371 - RNA, 64 nt, Human
uguuuucucugucugcugucuaacccugugccuugccugggauaaggacaaugaugagguuacu

SEQ ID NO: 246372 - RNA, 64 nt, Human
guacucagccugaccccuaggucugguccugccagccugggaugggggucaauguaugcuacac

SEQ ID NO: 246373 - RNA, 64 nt, Human
agugacccuuggccaccagaccacagaggauggagccugggaagcagcgaggaaaucacagccc

SEQ ID NO: 246374 - RNA, 64 nt, Human
ccagacaagaggugaccaggcccggacagaaauggccugggaaguagcagaagcagugcagcag

SEQ ID NO: 246375 - RNA, 64 nt, Human
ccuuuccaguccuccaccccaccccuggagcccagccugggagcgcaaaacccaagaagcggcc

SEQ ID NO: 246376 - RNA, 57 nt, Human
ccaacccuuuccuucucuagugccugggccugggacccacccagagcaccugugcug

SEQ ID NO: 246377 - RNA, 64 nt, Human
agugagggaaccauuuccucucacagacaaagaggccugggauauuaggacuuugggguuugag

SEQ ID NO: 246378 - RNA, 64 nt, Human
auccccacuucccaggcccagccuuuccaacccugccugggaucugggcuuuaaugcagaggcc

SEQ ID NO: 246379 - RNA, 64 nt, Human
gaagggacaaaagguacuggugagggcaagaggugccugggaggaguggcccugauccaggaaa

SEQ ID NO: 246380 - RNA, 64 nt, Human
agaugcgguggcuaaaggucccaaggcaaggggugccugggaaccuuccugucuucauccuuag

SEQ ID NO: 246381 - RNA, 64 nt, Human; identical to SEQ ID NO: 195534

SEQ ID NO: 246382 - RNA, 64 nt, Human; identical to SEQ ID NO: 195554

SEQ ID NO: 246383 - RNA, 64 nt, Human; identical to SEQ ID NO: 195657

SEQ ID NO: 246384 - RNA, 64 nt, Human
cccagagcuggacagacaucacaggauaacccaggccugggaggaggccccacggccugcuggu

SEQ ID NO: 246385 - RNA, 64 nt, Human
ggaugaguccccugugagauuuugcuuuuccacugccugggaugaugcaguuugaagaggcccu

SEQ ID NO: 246386 - RNA, 64 nt, Human
gauccugaacggcaucaaggugcugaagcuguacgccugggagcccagcuuccugaagcaggug

SEQ ID NO: 246387 - RNA, 64 nt, Human
cuguagugagccaagauagcaccacugcacuccagccugggagacagagugagacuccgucuca

SEQ ID NO: 246388 - RNA, 64 nt, Human
gcagccggaauagagccucgucuggcaagucggggccugggacacuucccugggccucaacaag

SEQ ID NO: 246389 - RNA, 64 nt, Human
ugccucauccuaccgggugucccuuugccacccugccugggacaucgcuggaaccugcaccaug

SEQ ID NO: 246390 - RNA, 64 nt, Human
cuauugccucaggguugacaacagggugauggaggccugggacgcuguucagaggggugaccca

SEQ ID NO: 246391 - RNA, 64 nt, Human
cgaguguauuauaaaaucgugggggagaugcccggccugggaugcuguuuggagacggaauaaa

SEQ ID NO: 246392 - RNA, 64 nt, Human
gcugcagcugcacagccucugcuacaccugggcugccugggaggcuuccugguguggugucugg

SEQ ID NO: 246393 - RNA, 64 nt, Human
cacaggagagggagagauuccagcucacugcgcagccugggaggaggcguggauccuggcacgc

SEQ ID NO: 246394 - RNA, 64 nt, Human
ccagagggcuggaugccugccgguccccgagcaagccugggaacucaggaaaauucacaggacu

SEQ ID NO: 246395 - RNA, 64 nt, Human
agucucuuucugugaaggcuuuuuuuuuccuuuggccugggaauuuuucccauuuuuaugaagg

SEQ ID NO: 246396 - RNA, 64 nt, Human
cuaccugggaggcugagguaugaggauugcuugagccugggaguuugaggcugcagugagcuau

SEQ ID NO: 246397 - RNA, 64 nt, Human
gguuuaguaaaagccucccacacaccuccccguggccugggacguggcugguaguguuugugug

SEQ ID NO: 246398 - RNA, 64 nt, Human
ugggaugaacaagcaacgcagaccacaagcgagugccugggagggaguggcccagggugguucu

SEQ ID NO: 246399 - RNA, 61 nt, Human; identical to SEQ ID NO: 195573

SEQ ID NO: 246400 - RNA, 64 nt, Human; identical to SEQ ID NO: 195574

SEQ ID NO: 246401 - RNA, 64 nt, Human; identical to SEQ ID NO: 195575

SEQ ID NO: 246402 - RNA, 64 nt, Human
uucagcagcauauaccuucacacuagguuucagagccugggaagaggaauauuaagacaucuua

SEQ ID NO: 246403 - RNA, 64 nt, Human
gggaccgccuggcccucccucccuagcccuuccagccugggacacacacacacacacacacaca

SEQ ID NO: 246404 - RNA, 64 nt, Human
gcugguguaaaccuacagccagcagcagucuggagccugggagccuccugaagucccgggugaa

SEQ ID NO: 246405 - RNA, 64 nt, Human
cccguccuggggucucuguccccacuuccuucuggccugggaggucuguaauuccugucuccug

SEQ ID NO: 246406 - RNA, 64 nt, Human
ccaccuuuccagcaagacccccaguggcugcccagccugggagcaccucuuugcuuuucacacc

SEQ ID NO: 246407 - RNA, 64 nt, Human
ccuucuccagaggcugucacugcaggagccgugggccugggaagacuuggaagcggccucucuc

SEQ ID NO: 246408 - RNA, 64 nt, Human
ucccacccucuggaggccugggaaccuggcugcagccugggaaggcuggagaggcagacggugg

SEQ ID NO: 246409 - RNA, 64 nt, Human
cuaccugcaccugcuguggucccacccucuggaggccugggaaccuggcugcagccugggaagg

SEQ ID NO: 246410 - RNA, 64 nt, Human
gguggagagggacuacguggaagaccuggggccagccugggaccaagggauguggaguccaggc

SEQ ID NO: 246411 - RNA, 64 nt, Human
caggcuggaggacagggccagccacccucccacggccugggaggaagagaggccuucugggacu

SEQ ID NO: 246412 - RNA, 64 nt, Human
guugaguagaaagggugugggcggguauagauuggccugggaguguuacaguagggagcaggcu

SEQ ID NO: 246413 - RNA, 64 nt, Human
gcggaugggagcuguuccuggacagccuucuacugccugggaagugauggaacaggaacucagg

SEQ ID NO: 246414 - RNA, 64 nt, Human
gcgcuggugguggcugucuggacacguccuuagcgccugggaaccaggacauaaaagcgccucc

SEQ ID NO: 246415 - RNA, 64 nt, Human
uacugugcaggccugucccugggaguguucccgugccugggagaguggaccugugcugugagug

SEQ ID NO: 246416 - RNA, 64 nt, Human
agaaagguguccgccaaccuccucagucucccaggccugggacaggcagaacaggguguggcug

SEQ ID NO: 246417 - RNA, 64 nt, Human; identical to SEQ ID NO: 195530

SEQ ID NO: 246418 - RNA, 64 nt, Human; identical to SEQ ID NO: 195582

SEQ ID NO: 246419 - RNA, 64 nt, Human; identical to SEQ ID NO: 195583

SEQ ID NO: 246420 - RNA, 64 nt, Human
cacuuugggaggcugaagugggaggaucgcuugagccugggaguucaagaccagccugggcaac

SEQ ID NO: 246421 - RNA, 64 nt, Human
ccccagagagaacccaguucuagguacugucugggccugggaggcgagagcagugcccagggga

SEQ ID NO: 246422 - RNA, 64 nt, Human
auccggcuugggcauccccaaugaacucugcccugccugggacucuauuuauucugauuaaagg

SEQ ID NO: 246423 - RNA, 64 nt, Human
gagccuuggcccacacugaggcuuaggccucucugccugggaugggcucccacccuccccugag

SEQ ID NO: 246424 - RNA, 64 nt, Human
cgaucgcccaggcuggagcuggccccgcuugguggccugggaucuggcacacucccucuccuug

SEQ ID NO: 246425 - RNA, 64 nt, Human
cuuugauuugguuuaaaccugagcugguuguggagccugggaaagguggaagagagagaggucc

SEQ ID NO: 246426 - RNA, 64 nt, Human
caucccugcuguuugcaucugagagcagcauggggccugggaggucggccugugugcccagcuc

SEQ ID NO: 246427 - RNA, 64 nt, Human
guuugggcuguuccacgcuuggcucaccauugccgccugggacuuaaccugcucaggcgggccu

SEQ ID NO: 246428 - RNA, 64 nt, Human
gaagcacugguucuguugaaguuaaguuuauuaagccugggaacauuaaaagcuaauuuauaaa

SEQ ID NO: 246429 - RNA, 64 nt, Human
agaauaacugaggccgcagaugcaugaaauuugggccugggaaggcuaugcugguuuuggagug

SEQ ID NO: 246430 - RNA, 64 nt, Human
aaggagaagggaggaacugggccuggggcuggaggccugggaucccuccuuugugggucgcaca

SEQ ID NO: 246431 - RNA, 64 nt, Human
ugagauucccagagagucgucacaccaguguuaugccugggagugccacuggcauaccgcaggu

SEQ ID NO: 246432 - RNA, 64 nt, Human
cccagcagcugccaggagcacggcucuguccccagccugggaaagccccugccccuccucuccc

SEQ ID NO: 246433 - RNA, 64 nt, Human
aacgugggcggggggccguuuccugacacuaccagccugggaggcccagguguagcgguccgag

SEQ ID NO: 246434 - RNA, 64 nt, Human
uggagcacguccgggcaguggagggagggacacagccugggacaggaagccucuuggguuggag

SEQ ID NO: 246435 - RNA, 52 nt, Human; identical to SEQ ID NO: 195512

SEQ ID NO: 246436 - RNA, 64 nt, Human; identical to SEQ ID NO: 195563

SEQ ID NO: 246437 - RNA, 64 nt, Human; identical to SEQ ID NO: 195586

SEQ ID NO: 246438 - RNA, 64 nt, Human
gcuggugacauguccaggguuccagggcccgguggccugggagcugcuuucuccccacuggcug

SEQ ID NO: 246439 - RNA, 64 nt, Human
ccccggcacaggauggggcaggcucuggcacagugccugggacuggcaggguggcugagcggcu

SEQ ID NO: 246440 - RNA, 64 nt, Human
uugcagugagccgagaucgcaccacugcacuccagccugggagacagagcgagacuccgucuca

SEQ ID NO: 246441 - RNA, 64 nt, Human
cagcuggagcacagagagggacccugggaacuuggccugggaagcccagagcaggaagccacag

SEQ ID NO: 246442 - RNA, 64 nt, Human
guauggaagggagcguucacaccgccagccucgggccugggauuugaggagggcccuagaccuc

SEQ ID NO: 246443 - RNA, 64 nt, Human
gugucggccauccaggaagaacuguacuggccaagccugggaccacacgucugcagagauccug

SEQ ID NO: 246444 - RNA, 64 nt, Human
aaaaagucggaaugcucucgacggccucgucccagccugggacaggcccccuuuccccucucuc

SEQ ID NO: 246445 - RNA, 64 nt, Human
uggggagcuuccugucgccuugcguggguguggggccugggaggagguccuggggcgugcaccc

SEQ ID NO: 246446 - RNA, 64 nt, Human
ccacucaagaggcacaggcgggaggaucacuugagccugggagguugugguugcagugagcuau

SEQ ID NO: 246447 - RNA, 64 nt, Human
gcacagccaacagccaccagcagccaggagacaggccugggacgggcucucccucacagccucc

SEQ ID NO: 246448 - RNA, 64 nt, Human
uggaaacaguuuaggccaauugggauucucauucgccugggaaagaacuugauucucaaauagu

SEQ ID NO: 246449 - RNA, 64 nt, Human
gcagagucccagcccuggcuggggcagggccccggccugggacucagcauuucugauaugccuu

SEQ ID NO: 246450 - RNA, 64 nt, Human
ucuggggacacagcugccgugaccagggaggccagccugggagguccagaugcccagggagaau

SEQ ID NO: 246451 - RNA, 64 nt, Human
gcaggggaaucacuagaacccaggaggcacuccagccugggagacagagugagacuccaucuca

SEQ ID NO: 246452 - RNA, 64 nt, Human
cuacuugggagguuaaggugggaggaucacuugagccugggagauagaggcuugcagugagccg

SEQ ID NO: 246453 - RNA, 64 nt, Human; identical to SEQ ID NO: 195590

SEQ ID NO: 246454 - RNA, 64 nt, Human; identical to SEQ ID NO: 195660

SEQ ID NO: 246455 - RNA, 64 nt, Human; identical to SEQ ID NO: 195661

SEQ ID NO: 246456 - RNA, 64 nt, Human
gaaucucacugagugccccaggagagcgagaggcgccugggaucugagaggaggcugcugggcc

SEQ ID NO: 246457 - RNA, 64 nt, Human
aagaagauaacuugaggucaggaguucaagaccagccugggaaacauagcaagaccccaucucu

SEQ ID NO: 246458 - RNA, 64 nt, Human
cuggggcagccucugccaggcuugggugugccuggccugggacugagggguccaggcgaccaga

SEQ ID NO: 246459 - RNA, 64 nt, Human
ccaggcugccugcugaagucugaaguggggucuggccugggaggaggucugauaagugccuuca

SEQ ID NO: 246460 - RNA, 64 nt, Human
cccgagggccugaggagagggagcugugggccacgccugggaggggcccagcugggguuacugg

SEQ ID NO: 246461 - RNA, 64 nt, Human
cagagacugcaccagcgcagccagcaggagccuggccugggaggacgauuuauuauuacacugg

SEQ ID NO: 246462 - RNA, 64 nt, Human
cuccacguuugcugugaccaacagggaggacagggccugggacuguucucccagauccgccacu

SEQ ID NO: 246463 - RNA, 64 nt, Human
auagguccugccucuucaauccuggcuuucuagggccugggaugaucauugcuagaacugagag

SEQ ID NO: 246464 - RNA, 64 nt, Human
acagcaugcccggcuccucccagaaccagucccagccugggaggaucaaggccuggaucccggg

SEQ ID NO: 246465 - RNA, 64 nt, Human
cuccccuggccccagcccucuccugccuggccuggccugggacaccuccucucugccaggaggc

SEQ ID NO: 246466 - RNA, 64 nt, Human
cuggugacagagaagacaccaggguuugggggaugccugggacuuuccuccggccuuuuguauu

SEQ ID NO: 246467 - RNA, 64 nt, Human
gggauuuucuugugauaucugauuccccagugaggccugggacguuuuuaagaucgcugugugu

SEQ ID NO: 246468 - RNA, 64 nt, Human
auuauauacagguugaguaucccuucuccaaaaugccugggaucagaagcauuuuggauuucag

SEQ ID NO: 246469 - RNA, 64 nt, Human
gccccuucccccagcacgguuccuccucuccccagccugggaagaugucucacuguccaccucc

SEQ ID NO: 246470 - RNA, 64 nt, Human
ugugauguagaccaaagucguugccccucccugggccugggaaccagucggaacuggguuccag

SEQ ID NO: 246471 - RNA, 64 nt, Human; identical to SEQ ID NO: 195504

SEQ ID NO: 246472 - RNA, 64 nt, Human; identical to SEQ ID NO: 195580

SEQ ID NO: 246473 - RNA, 64 nt, Human; identical to SEQ ID NO: 195589

SEQ ID NO: 246474 - RNA, 64 nt, Human
aggaggaucacuuaagcgcagaagaucaagaccagccugggaaauauagcaagaccuuaucucu

SEQ ID NO: 246475 - RNA, 64 nt, Human
uguaaucaaguuuuuccagccuccaagucaccuggccugggaaaguacuugccucauguugcuc

SEQ ID NO: 246476 - RNA, 64 nt, Human
cccagaccacacagaagucuggucaccucugggcgccugggauggucaccgaagagaagcacgc

SEQ ID NO: 246477 - RNA, 64 nt, Human
acuaagaaaaucaaauuuuuaaaaguuauuuauggccugggaaacaauuugcauuuguccccaa

SEQ ID NO: 246478 - RNA, 64 nt, Human
uugccugaagcuucaccugccugaggacucaccugccugggacggucaccuguugcagcuucac

SEQ ID NO: 246479 - RNA, 64 nt, Human
cccucugccccugcccagggcuccccaacuauaggccugggacccccgcccagcuuggggggcu

SEQ ID NO: 246480 - RNA, 64 nt, Human
aauuuauuaggugggaauuuccucuuccuaauaagccugggagugcuaugggagacuggggucu

SEQ ID NO: 246481 - RNA, 64 nt, Human
uguucagcgugugcugaggcacaauggcagcccugccugggaggacuggaccaggcaguggcug

SEQ ID NO: 246482 - RNA, 64 nt, Human
uggugaaaugacgccccucccccaccugcccauggccugggacucucugcgauguacauaacua

SEQ ID NO: 246483 - RNA, 64 nt, Human
aacgaagcgccaaccuuccuuucggaguaauccugccugggaaggagagauuuuuagugacaug

SEQ ID NO: 246484 - RNA, 64 nt, Human
cucaggaaggaacacacacccauuaucugugugugccugggaguccauacaauguccauacaug

SEQ ID NO: 246485 - RNA, 64 nt, Human
ggccgccgcggacccugcgcacucucuggucaucgccugggaggaagaugccaccgccgcagca

SEQ ID NO: 246486 - RNA, 64 nt, Human
cugagccggggcugguuuucuaugaacgauuccggccugggaugcgggccaggcugcaggcggc

SEQ ID NO: 246487 - RNA, 64 nt, Human
agaaacauuuuauuuguggacuacagcuuauucagccugggaaaaauaauguuggagaaauacu

SEQ ID NO: 246488 - RNA, 64 nt, Human
cuucuugcaagacagccugacugugccuuccagggccugggaccauuggcugggaccccucauu

SEQ ID NO: 246489 - RNA, 64 nt, Human; identical to SEQ ID NO: 195475

SEQ ID NO: 246490 - RNA, 64 nt, Human; identical to SEQ ID NO: 195476

SEQ ID NO: 246491 - RNA, 64 nt, Human; identical to SEQ ID NO: 195477

SEQ ID NO: 246492 - RNA, 64 nt, Human
ccucccauuccucuggucccugccuuggucccuugccugggaagagggcgaggaggccaguggu

SEQ ID NO: 246493 - RNA, 64 nt, Human
guuucaguaauaauccucacuuccaucagaaucugccugggagggagcuuuuacaauguacaag

SEQ ID NO: 246494 - RNA, 64 nt, Human
ccaaccucccguacggcgccccuccugacucccugccugggaccacacaccccugggauagaaa

SEQ ID NO: 246495 - RNA, 64 nt, Human
caucccccagcaagccagccaccugcccagccgggccugggaugggccaccacaccacuggaua

SEQ ID NO: 246496 - RNA, 64 nt, Human
ggcugaggcccugacguggaugggcaaacugcaggccugggaaggcagcaagccgggccguccg

SEQ ID NO: 246497 - RNA, 64 nt, Human
ccaggcccugagccccacuucugccuucaccucugccugggacccgagcugggcuccugggccu

SEQ ID NO: 246498 - RNA, 64 nt, Human
uccuccaucacuuccccuagcuccacucuuguuggccugggaacuucuuggaacuuuaacuccu

SEQ ID NO: 246499 - RNA, 53 nt, Human
gcugugacuuuuuuugcugagcagccugggaucgcucuacgaauuacacagga

SEQ ID NO: 246500 - RNA, 64 nt, Human
caacucagggggcugaggugggagaauggcuugagccugggaggcagagguugcagugagcuga

SEQ ID NO: 246501 - RNA, 64 nt, Human
aaccccaccagcugcugcuacaggaccugggauugccugggacucccaccuuccuaucaauucu

SEQ ID NO: 246502 - RNA, 64 nt, Human
ugaggaugccgccccggacaguggcaccugggaagccugggaguguuugucccaucgguagcuu

SEQ ID NO: 246503 - RNA, 64 nt, Human
ccucuugauuaagagauucuccuuccaggccuaagccugggauuugggccagagauaagaaucc

SEQ ID NO: 246504 - RNA, 64 nt, Human
ugcagccucccugcucccagcccaaggccagucggccugggaaguucacugccccaacucuuuu

SEQ ID NO: 246505 - RNA, 64 nt, Human
caccauggaaugaaccccccgcccaugcuguccggccugggaaacccucuccaucucccaaggc

SEQ ID NO: 246506 - RNA, 64 nt, Human
uauuagcaucuuccugcagggacuugggcccauggccugggagguugguuugggauugggguug

SEQ ID NO: 246507 - RNA, 64 nt, Human; identical to SEQ ID NO: 195480

SEQ ID NO: 246508 - RNA, 64 nt, Human; identical to SEQ ID NO: 195485

SEQ ID NO: 246509 - RNA, 64 nt, Human; identical to SEQ ID NO: 195486

SEQ ID NO: 246510 - RNA, 64 nt, Human
ggauucuggggucugggccaguggccauagugaagccugggaaugaguguuacugcagcaucug

SEQ ID NO: 246511 - RNA, 64 nt, Human
agccuccgucuucugguccacucugcucugagcagccugggaugcugaacucuucagagagauu

SEQ ID NO: 246512 - RNA, 64 nt, Human
cuggaaaagguaaaugcuuguauauauuuuugcagccugggaucucccuacuccauuuuuuccu

SEQ ID NO: 246513 - RNA, 64 nt, Human
ccuucggcuucugagccagcaguaggggggcucggccugggagucgggcggccccggucaggcc

SEQ ID NO: 246514 - RNA, 64 nt, Human
cuuccccuccaggagggaccacccucccugacuggccugggauaucuuuacaagcaggcacugu

SEQ ID NO: 246515 - RNA, 64 nt, Human
gaugcugacaggaugaagauuuaggaauaaauaugccugggaagagacugggaagguucuaggg

SEQ ID NO: 246516 - RNA, 64 nt, Human
uuuuuuuuuuuuuuugagaaggagucugucuccagccugggagggugagacuccaucuaaaaaa

SEQ ID NO: 246517 - RNA, 64 nt, Human
guuuccuuucaggaggguccccagcugguccagggccugggaaauuucuacuuauccucauuac

SEQ ID NO: 246518 - RNA, 64 nt, Human
ucuucugcccccugucggccaggugaggucagcagccugggagagugcccccaagagaugaggg

SEQ ID NO: 246519 - RNA, 64 nt, Human
ucucccagaacuauucugggggcccgacaggugggccugggaggaagauguuuacauuuuuaaa

SEQ ID NO: 246520 - RNA, 64 nt, Human
ucagggagcugagcgugcaggcgcuccagggcaggccugggacagagucaaggcucagagaaua

SEQ ID NO: 246521 - RNA, 64 nt, Human
guggagguaacgaucacccaggccagucuccucugccugggaugcgcccucugagaggaggccu

SEQ ID NO: 246522 - RNA, 64 nt, Human
acacuccagaggcugucgugggaggaucaugugagccugggaggucaaggcugcagugagccgu

SEQ ID NO: 246523 - RNA, 64 nt, Human
gucaggcagaggccagccugcacuggagucugaggccugggaccccccccucccacccccuaac

SEQ ID NO: 246524 - RNA, 64 nt, Human
uccagcggccaguucacuacgcaguaucucuggggccugggaccagccacgugccgagcuguca

SEQ ID NO: 246525 - RNA, 54 nt, Human; identical to SEQ ID NO: 195524

SEQ ID NO: 246526 - RNA, 64 nt, Human; identical to SEQ ID NO: 195592

SEQ ID NO: 246527 - RNA, 64 nt, Human; identical to SEQ ID NO: 195593

SEQ ID NO: 246528 - RNA, 64 nt, Human
auggccuuucccuucugcaggugcgggcaggugggccugggaccggugcuggggccucuccuug

SEQ ID NO: 246529 - RNA, 64 nt, Human
ccucugcauggcuucucagacuugggaccugggugccugggauccuggcagacagagguugugu

SEQ ID NO: 246530 - RNA, 64 nt, Human
uaggcggacacacccugggcccugagcauccagagccugggaugggcuuuucccugugggccag

SEQ ID NO: 246531 - RNA, 64 nt, Human
uccugcccccaagacugcucugguggaaaauccagccugggagccccuggaguggcaggcccug

SEQ ID NO: 246532 - RNA, 64 nt, Human
gguugggccaucguggguucccugagcccagccagccugggaccucccaaaguggguggcuuac

SEQ ID NO: 246533 - RNA, 64 nt, Human
cggacuggggccaugaucgggcccgggggccugagccugggaccccaccccguguuaaugaaaa

SEQ ID NO: 246534 - RNA, 64 nt, Human
gagccuggucacacaaggggcgagcaccaggccagccugggacuggccagagcugggcccaagc

SEQ ID NO: 246535 - RNA, 64 nt, Human
aggcagggugcucugcccacuccaucaccaugaagccugggauugggccacgaggaacaaacag

SEQ ID NO: 246536 - RNA, 64 nt, Human
gugaguucaggugggggcucccugcugcccccaggccugggagcuugaagcccucccggcaucu

SEQ ID NO: 246537 - RNA, 64 nt, Human
uaguuuuggaaccauacucacucacucuccaccagccugggaaaugaauauuggguccucagcc

SEQ ID NO: 246538 - RNA, 64 nt, Human
uuuccuggcuggguggggugggggguaucaaggagccugggacgugaggccccacucucgcccc

SEQ ID NO: 246539 - RNA, 64 nt, Human
ccugugucagcaccaucuucaggugcuuagaauggccugggagccuguucugucuugcaucuuc

SEQ ID NO: 246540 - RNA, 64 nt, Human
acagaaggcucagggcaccgaggugcacuugccggccugggaggugucccacugaagccccgcg

SEQ ID NO: 246541 - RNA, 64 nt, Human
ugagggaggggcgacgggggaggggggugauggugccugggagccugcgugugcagccggugcu

SEQ ID NO: 246542 - RNA, 64 nt, Human
cucagcucccaguccuugugcuuuuuggagcuaagccugggaugaccaaauucaccccagcucc

SEQ ID NO: 246543 - RNA, 64 nt, Human; identical to SEQ ID NO: 195489

SEQ ID NO: 246544 - RNA, 64 nt, Human; identical to SEQ ID NO: 195490

SEQ ID NO: 246545 - RNA, 64 nt, Human; identical to SEQ ID NO: 195491

SEQ ID NO: 246546 - RNA, 64 nt, Human
gugggauccagcgagaggccagggcuuggagugggccugggaccaggaaggaccucuaggcugu

SEQ ID NO: 246547 - RNA, 64 nt, Human
auuccgucagaagagacuguaauccgugucgucagccugggagccuuccccaguguaauguagc

SEQ ID NO: 246548 - RNA, 64 nt, Human
cauguugcugaaagcuguuuggaagaaacagguggccugggaguagauauuguccuagaugcug

SEQ ID NO: 246549 - RNA, 64 nt, Human
cccaggagguauucgaccugcacuggcgugccuggccugggauuuggugacggagaggagggcu

SEQ ID NO: 246550 - RNA, 64 nt, Human
ggagugggaacacucagagaaaggggagaucugggccugggaagauuccggggcaggggugagc

SEQ ID NO: 246551 - RNA, 64 nt, Human
gcagguugggcacuagaaaaggcccccacuggcugccugggagccccacaccaccgggccagug

SEQ ID NO: 246552 - RNA, 64 nt, Human
ugucuugcacuccagagcugaccuccaccgcccagccugggaagucauuguagggagugagaca

SEQ ID NO: 246553 - RNA, 64 nt, Human
gaggcggggaggagcagcugggacccagaacugagccugggagggauccgacagaaaagcucag

SEQ ID NO: 246554 - RNA, 64 nt, Human
gccaaggggcagccuccugucaagguagcuagaggccugggaaaggagauagccuugcuccggc

SEQ ID NO: 246555 - RNA, 64 nt, Human
guggugccgggggcagggugcgugggaggacggagccugggagcggggcggggccgccgcgcaa

SEQ ID NO: 246556 - RNA, 64 nt, Human
ugggcuccugcccaggacaggcaccagggucauggccugggaccuggacacuggccccuccacc

SEQ ID NO: 246557 - RNA, 64 nt, Human
guaaacguucaggaggaccagggcagcaucuggggccugggauggccacagaaggggcaggcca

SEQ ID NO: 246558 - RNA, 64 nt, Human
gucucugcgaagucaaaggccugacagcucuguggccugggaauccauuuuccugcggcagagc

SEQ ID NO: 246559 - RNA, 64 nt, Human
cacguguauuggagcccagaagaggggcuguguggccugggaauaccauguggaagguugggcu

SEQ ID NO: 246560 - RNA, 64 nt, Human
caaaacacuucugagcuuuucuugccauuugguugccugggaccuggaaaguguuuagauucuu

SEQ ID NO: 246561 - RNA, 64 nt, Human; identical to SEQ ID NO: 195494

SEQ ID NO: 246562 - RNA, 64 nt, Human; identical to SEQ ID NO: 195495

SEQ ID NO: 246563 - RNA, 64 nt, Human; identical to SEQ ID NO: 195496

SEQ ID NO: 246564 - RNA, 64 nt, Human
ggguagcaggcugcaggaguggggucucugcacagccugggauggggcuuggggcuggggccug

SEQ ID NO: 246565 - RNA, 64 nt, Human
cacacguccggggcacccacgaggagggcccccagccugggagacuggcccugcggccuccacg

SEQ ID NO: 246566 - RNA, 64 nt, Human
gggcggauuacuugagcccaggaguucgggaccagccugggaaauauagugaaacuccuguccc

SEQ ID NO: 246567 - RNA, 64 nt, Human
augggcacucaggugugggccgaaccugauaccugccugggacagccacuggaaacuuuuggga

SEQ ID NO: 246568 - RNA, 64 nt, Human
ccugaggggcagaggagcagagaugcaucagcucgccugggacuggcucugugauaaaaagacc

SEQ ID NO: 246569 - RNA, 64 nt, Human
gagccaaacaaugaaugccccucuuagguauuccgccugggauuuuguuuugucuguucccuaa

SEQ ID NO: 246570 - RNA, 64 nt, Human
uugcucccaagaggaggagagggaggcugcagaugccugggacucagaccaggaagcugugggc

SEQ ID NO: 246571 - RNA, 64 nt, Human
guucuucguucucuuccccgugaucuucccugcagccugggauggccagggucugauggcugga

SEQ ID NO: 246572 - RNA, 64 nt, Human
caggcucuuggggaggcagagaagccaccuucaggccugggaaggaagacacugggaggaggag

SEQ ID NO: 246573 - RNA, 64 nt, Human
agccccgccuaguggugggcccugaugcugccaggccugggaccucccacugcccccuccacug

SEQ ID NO: 246574 - RNA, 64 nt, Human
ucugggcccaggcaccucugaguccauagaccaggccugggagaaugccaagcugccugcccga

SEQ ID NO: 246575 - RNA, 64 nt, Human
ugggggaccccuuccuccugacuccagcacccaggccugggaagagcucggccccgaucagccu

SEQ ID NO: 246576 - RNA, 64 nt, Human
accugacuggucuuggcuggggucaggggcuggugccugggagcugaugaagcaggugccaggg

SEQ ID NO: 246577 - RNA, 64 nt, Human
cccguguccugggcagcuucuguuucccucugcugccugggagcugaggcacccgugccagugg

SEQ ID NO: 246578 - RNA, 64 nt, Human
gguguuccuggaaggcagaugagcuggucauuucgccugggacucggcaccuuuccgagugcag

SEQ ID NO: 246579 - RNA, 64 nt, Human; identical to SEQ ID NO: 195473

SEQ ID NO: 246580 - RNA, 64 nt, Human; identical to SEQ ID NO: 195478

SEQ ID NO: 246581 - RNA, 64 nt, Human; identical to SEQ ID NO: 195499

SEQ ID NO: 246582 - RNA, 64 nt, Human
uggccuggggccaucaagaucaaagaaccaggaggccugggagaugcagcuggauggggcggcc

SEQ ID NO: 246583 - RNA, 64 nt, Human
gugcucaucaagaauacagacgugcaggcagcccgccugggaaacaucauccacgccaugauca

SEQ ID NO: 246584 - RNA, 64 nt, Human
acggggauagaaugguuuccacugaggacauucagccugggaaggaggaagucaccagcucgag

SEQ ID NO: 246585 - RNA, 60 nt, Human
uucuacuaccccuaguguagcuuugacagagccugggaaggagagacgaggaggcaugcc

SEQ ID NO: 246586 - RNA, 64 nt, Human
cuacucgggaggcugaggugggaggaucgcuggagccugggaaguugaggcugcagugagccgu

SEQ ID NO: 246587 - RNA, 64 nt, Human
gugugggguuggggaguaggggggaucccacauugccugggacaucugaaugcugauacgaaug

SEQ ID NO: 246588 - RNA, 64 nt, Human
agagucuuaucugagcugagccaggcuagcuggagccugggauuucuaugcaguggccccuuag

SEQ ID NO: 246589 - RNA, 64 nt, Human
agcuaacccagguccccucauuccuucaacuugugccugggagugugugguguuagggugcagc

SEQ ID NO: 246590 - RNA, 64 nt, Human
aaagcaggaugcaggaugggaggacaggaaggcagccugggacauuuaaaaaaauaaaaaugaa

SEQ ID NO: 246591 - RNA, 64 nt, Human
cuguguccaugaucugagugauagcugcacugcugccugggauugcagcugaggugggagugga

SEQ ID NO: 246592 - RNA, 64 nt, Human
agacucaggcagagcagcuccacaaccaccuccagccugggagauaggccuugcuugcugccuu

SEQ ID NO: 246593 - RNA, 64 nt, Human
uauggaauauggauggaucacuuguaaggacagugccugggaacugguguagcugcaaggauug

SEQ ID NO: 246594 - RNA, 64 nt, Human
uguauucggcagaaaagggacucagguaagcccagccugggaugagagcagaaaagcauucaag

SEQ ID NO: 246595 - RNA, 64 nt, Human
ugggagacugagaugggaggaucgcuugagaccagccugggaaacauagugagacccuuucucu

SEQ ID NO: 246596 - RNA, 64 nt, Human
cuugggcaacaguccagaagcaucaggggcuccggccugggauguuucugaacuuugggaguua

SEQ ID NO: 246597 - RNA, 64 nt, Human; identical to SEQ ID NO: 195467

SEQ ID NO: 246598 - RNA, 64 nt, Human; identical to SEQ ID NO: 195487

SEQ ID NO: 246599 - RNA, 64 nt, Human; identical to SEQ ID NO: 195506

SEQ ID NO: 246600 - RNA, 64 nt, Human
gggcggaucacuugagcucaggaguuuaagaccagccugggaaaugugguaaaacuccgacucu

SEQ ID NO: 246601 - RNA, 64 nt, Human
ucuaugccuccugauccagaccaggcauugcccagccugggaaucuuuucuuugugggaaucaa

SEQ ID NO: 246602 - RNA, 64 nt, Human
ccauauaccuugacuuggauuuugacaggagggagccugggaaaauaauuuuuuccuccaagau

SEQ ID NO: 246603 - RNA, 64 nt, Human
augucccagaaaugucaugagauugcuguguguugccugggacacagaucaagggccuaucuug

SEQ ID NO: 246604 - RNA, 64 nt, Human
gggaugaacaaggggauggcuuugauccaauggagccugggaggugugcccagaaagcuugucu

SEQ ID NO: 246605 - RNA, 64 nt, Human
cccccaaguugggacgccuuguuuagcuuugcuugccugggacuguugccuuguaccgaugaug

SEQ ID NO: 246606 - RNA, 64 nt, Human
gaccccaccagcaacaccuacacccuugucaccugccugggacuccuaugauggccuggugguu

SEQ ID NO: 246607 - RNA, 64 nt, Human
gauuuggggaagcugaagcagaaagauugcuugagccugggaguuugagacuggccugggcagc

SEQ ID NO: 246608 - RNA, 64 nt, Human
gccuggccagugugccacauuaaauacccgugcaggcgcggagaagcaaccggcacccccuucc

SEQ ID NO: 246609 - RNA, 64 nt, Human
uggcgcgcgugggcccgcugccguggcucugggcggcgcggacgcgcguagcgcgggagcaggg

SEQ ID NO: 246610 - RNA, 64 nt, Human; identical to SEQ ID NO: 195568

SEQ ID NO: 246611 - RNA, 64 nt, Human; identical to SEQ ID NO: 195600

SEQ ID NO: 246612 - RNA, 64 nt, Human; identical to SEQ ID NO: 195601

SEQ ID NO: 246613 - RNA, 64 nt, Human
aggacuagucucauuucucugagaagaaaacuaaggcgcggaaauuugucuaagaucacauaac

SEQ ID NO: 246614 - RNA, 64 nt, Human
accucaccaaagcucugagcccugcuagccuugaggcgcggacccucccccauaccucccacag

SEQ ID NO: 246615 - RNA, 64 nt, Human
cuccacggccuguacucgguuuacaccgcgggcgggcgcggagggaggcugcguuuccuccgcu

SEQ ID NO: 246616 - RNA, 64 nt, Human
ggguuggggguuggguggggcuggacggggacgaggcgcggagaggcggcgggaaagagcuucg

SEQ ID NO: 246617 - RNA, 64 nt, Human
acgcgggccggcggccggagcggggaagggcgcgggcgcggaggacgcacgcggggccccggcu

SEQ ID NO: 246618 - RNA, 64 nt, Human
gacacuaaggccccaacaucgcgggaccugcuguggcgcggauucuuaggaacgcuguucuagc

SEQ ID NO: 246619 - RNA, 64 nt, Human
cagcgcccgaguggcggagcugcugcugcuccacggcgcggagcccaacugcgccgaccccgcc

SEQ ID NO: 246620 - RNA, 64 nt, Human
cagcgcccgcguggcggagcugcugcugcuccacggcgcggagcccaacugcgcagacccugcc

SEQ ID NO: 246621 - RNA, 64 nt, Human
guacacccagcacuuugcgaccugcggcccagcaggcgcggaggauggcggggaggaagccagc

SEQ ID NO: 246622 - RNA, 64 nt, Human
cggggaguauugaauggugguggaaggguagagaggcgcggagugaaccccacgcccugucuaa

SEQ ID NO: 246623 - RNA, 62 nt, Human; identical to SEQ ID NO: 84439

SEQ ID NO: 246624 - RNA, 64 nt, Human
acugguuauguugauagaaugauaaaaagggucgggcgcggaggcucacgccuguaaucccagc

SEQ ID NO: 246625 - RNA, 64 nt, Human
ggaugcggcuugggcgcucuucggggaccuccguggcgcggaagacccgagccugccgggggga

SEQ ID NO: 246626 - RNA, 64 nt, Human
acccggcccggagagggaggaggaggccuccaggggcgcggagcucuggggaugggcgucgggc

SEQ ID NO: 246627 - RNA, 64 nt, Human
uucacgaaaaggucuaaaugaauugcgugugcagggcgcggauuuaaaguccaauuucucauga

SEQ ID NO: 246628 - RNA, 64 nt, Human; identical to SEQ ID NO: 195509

SEQ ID NO: 246629 - RNA, 64 nt, Human; identical to SEQ ID NO: 195510

SEQ ID NO: 246630 - RNA, 64 nt, Human; identical to SEQ ID NO: 195511

SEQ ID NO: 246631 - RNA, 64 nt, Human
accggaacauugugacuuggaccuuuucaggaguggcgcggauguuacaggaaaugcugucgga

SEQ ID NO: 246632 - RNA, 64 nt, Human
uagcagcugagggggacccggggaggcuggacagggcgcggaacccugucauggaugacaaggc

SEQ ID NO: 246633 - RNA, 64 nt, Human
aggccccuugucuguucccacggacgggggcucgggcgcggacuaagcaggggggaucucccgc

SEQ ID NO: 246634 - RNA, 64 nt, Human
ggcgagcacccugcagcugggcgggcaggcggcaggcgcggaacugacccucucgcgggacuga

SEQ ID NO: 246635 - RNA, 64 nt, Human
cacugcacagccagucaccgcggucucagucaucggcgcggauggcuaugcuggggucccaggg

SEQ ID NO: 246636 - RNA, 64 nt, Human
acuggagagacucuccccaccucugucuggguggggcgcggaccccucacugugcgccugugca

SEQ ID NO: 246637 - RNA, 64 nt, Human
ggagcugagcguggcgcaagcgggccagggcgcgggcgcggaccccgggccggugcugcuccgc

SEQ ID NO: 246638 - RNA, 64 nt, Human
cccagggcgccugacaaacaccauggugugugcaggcgcggagggcagaggcgcagaauccugu

SEQ ID NO: 246639 - RNA, 64 nt, Human
gccggaggagacgcugcaauaaagguugggagaaggcgcggaaaggagaggagcuggggccuug

SEQ ID NO: 246640 - RNA, 64 nt, Human
ccucuccuugcugugugugagggcccagguggaaggcgcggaccugacagcauuccaauaaagc

SEQ ID NO: 246641 - RNA, 64 nt, Human
ucuacaagucccgggccccccaguucacgauucuggcgcggacuucgcucccccaagacaacac

SEQ ID NO: 246642 - RNA, 64 nt, Human
aggacucuuagcugagguucgggauauaccccgaggcgcggaaccauagauauaacagugguaa

SEQ ID NO: 246643 - RNA, 64 nt, Human; identical to SEQ ID NO: 195492

SEQ ID NO: 246644 - RNA, 64 nt, Human; identical to SEQ ID NO: 195514

SEQ ID NO: 246645 - RNA, 64 nt, Human; identical to SEQ ID NO: 195515

SEQ ID NO: 246646 - RNA, 64 nt, Human
ggcggcgugggcgaggccugacacaggccagccuuggcacgaggggggccagggguucugagaa

SEQ ID NO: 246647 - RNA, 64 nt, Human
agagucucgcuuuguuucccaggcuggagugcaguggcacgaucucggcucacugcaaccucug

SEQ ID NO: 246648 - RNA, 64 nt, Human
cggagccuugcucuguugccagacuggagugcaguggcacgaucucggcucacugcaaccucug

SEQ ID NO: 246649 - RNA, 64 nt, Human
uuccgacuugucccucucucagcccuccauggccuggcacgaggggauggggaugcuuccgccu

SEQ ID NO: 246650 - RNA, 64 nt, Human; identical to SEQ ID NO: 195507

SEQ ID NO: 246651 - RNA, 64 nt, Human; identical to SEQ ID NO: 195518

SEQ ID NO: 246652 - RNA, 64 nt, Human; identical to SEQ ID NO: 195523

SEQ ID NO: 246653 - RNA, 64 nt, Human
aauggaaggcaacacugaauaggaguuaagggaauggcacgaucacagugagagagcugcacuc

SEQ ID NO: 246654 - RNA, 64 nt, Human
agagucuugcucugucgcccagguuggagugcaguggcacgaucucggcucacugcacccucug

SEQ ID NO: 246655 - RNA, 64 nt, Human
cugaccacacagcuccuuccuccucucccagcacuggcacgaagugcucccuguaaguaugaag

SEQ ID NO: 246656 - RNA, 64 nt, Human
ggaguuuugcucugucgcgcaggguggagugcgguggcacgaucucggcucacugcaaccucug

SEQ ID NO: 246657 - RNA, 64 nt, Human
ggagucuugcccuguugcccaggcuggagugcaguggcacgaucucggcucacugcaaccuccg

SEQ ID NO: 246658 - RNA, 64 nt, Human
agggucuugcucugucgcccaggcuggagugcaguggcacgaucauggcucacugcagccuuga

SEQ ID NO: 246659 - RNA, 64 nt, Human
acaaagaccuugcuugaaaccacaaaaguuuugcuggcacgaaagaaacuagauggaaauauau

SEQ ID NO: 246660 - RNA, 64 nt, Human
ggccgugugggacgaguggaggccgcggccuggcuggcacgagagcccacgcccgcuucuguau

SEQ ID NO: 246661 - RNA, 64 nt, Human
aucagaugagcugcagcucccaaauuucaaauuuuggcacgaugaauuauuuuuguuucucuuu

SEQ ID NO: 246662 - RNA, 64 nt, Human
agagucucacuuugucacccaggcuggagugcaguggcacgaucucagcucacugcaagcucug

SEQ ID NO: 246663 - RNA, 64 nt, Human
uaaugggauaugggguuacuucagccacccuuucuggcacgaaauggcugaagugcauggguca

SEQ ID NO: 246664 - RNA, 64 nt, Human
auaggaagggacucuguguauuauucagguuuauuggcacgaagauacuuguuuuaaguuccuu

SEQ ID NO: 246665 - RNA, 64 nt, Human
guggcgcugcugacagggccgaggucgcaggcgguggcacgagcccgagucucgcugcugcgcu

SEQ ID NO: 246666 - RNA, 64 nt, Human
gguuggcugagggcacccuccuucucugcacccuuggcacgagggcagggcuggcucucccaau

SEQ ID NO: 246667 - RNA, 64 nt, Human
gaguuucacucuugucacccaggcuggaguacaguggcacgaucucggcuuauggcaaccuccg

SEQ ID NO: 246668 - RNA, 64 nt, Human
ggcgucuugcugugucacccaggcuggagugcaguggcacgaucucagcucacugcagccuccu

SEQ ID NO: 246669 - RNA, 64 nt, Human; identical to SEQ ID NO: 195526

SEQ ID NO: 246670 - RNA, 64 nt, Human; identical to SEQ ID NO: 195527

SEQ ID NO: 246671 - RNA, 64 nt, Human; identical to SEQ ID NO: 195528

SEQ ID NO: 246672 - RNA, 64 nt, Human; identical to SEQ ID NO: 195529

SEQ ID NO: 246673 - RNA, 64 nt, Human
ggagucuugcucugucacccaggcuggagugccguggcacgaucucagcucacugcaaccucca

SEQ ID NO: 246674 - RNA, 64 nt, Human
ggagucucgcucuguugcccagguuggagugcaguggcacgaucucggcucacugcaaccucac

SEQ ID NO: 246675 - RNA, 64 nt, Human
ggagucucacucuguugcccaggcuggagugcaauggcacgaucucggcucacugaaaccucug

SEQ ID NO: 246676 - RNA, 64 nt, Human
gaguuucacucuuguugcccaggcuggagugcaauggcacgaucucggcucaccgcaaccucug

SEQ ID NO: 246677 - RNA, 64 nt, Human; identical to SEQ ID NO: 246675

SEQ ID NO: 246678 - RNA, 64 nt, Human
gaauguaaagagacgcccuucacauguugagaaauggcacgauuucacguuaucagugcaguuc

SEQ ID NO: 246679 - RNA, 64 nt, Human
cgccugccacacagcgugcgcuugcgugucacucuggcacgaaaccugucugccucuguggauc

SEQ ID NO: 246680 - RNA, 64 nt, Human
augaaaagugaggccaucagaaauagaaaaugccuggcacgaacagucuaucuaaauucucaau

SEQ ID NO: 246681 - RNA, 64 nt, Human
gagucuuggucuugucacccaggcuggagugcaguggcacgaucucggcucacuacaaccuccg

SEQ ID NO: 246682 - RNA, 64 nt, Human
cucugcccccauucucagacuaugagaagauguuuggcacgaaaugccauggcugugacuucaa

SEQ ID NO: 246683 - RNA, 64 nt, Human
agggucuugcucaauuucuuaggcuggagugcaguggcacgaucauagcucacugaaguuucga

SEQ ID NO: 246684 - RNA, 64 nt, Human
uuucgcucuugucccccaggcuggaguggugcaguggcacgaucucaggucacugcaaccucug

SEQ ID NO: 246685 - RNA, 64 nt, Human
gaguuucgcucuugucacccaggcuggagugcaauggcacgaucuuggcucacugcaaccucag

SEQ ID NO: 246686 - RNA, 64 nt, Human
gagucuugcuccugucgcccaggcuggagugcaauggcacgaucucggcucacugcaaccuccg

SEQ ID NO: 246687 - RNA, 64 nt, Human
agagucucgcucuguugcccaggcuggagugcaguggcacgaucucggcucacggcacgcuccg

SEQ ID NO: 246688 - RNA, 64 nt, Human
ggaguguugcucugucacccaagcuggagugcaguggcacgaucuuggcucacuccaaccucca

SEQ ID NO: 246689 - RNA, 64 nt, Human; identical to SEQ ID NO: 195587

SEQ ID NO: 246690 - RNA, 64 nt, Human; identical to SEQ ID NO: 195604

SEQ ID NO: 246691 - RNA, 64 nt, Human; identical to SEQ ID NO: 195605

SEQ ID NO: 246692 - RNA, 64 nt, Human; identical to SEQ ID NO: 195606

SEQ ID NO: 246693 - RNA, 64 nt, Human
ggagucuggcucugucacccaggcuagagugcaauggcacgaucucggcucacugcaagcucug

SEQ ID NO: 246694 - RNA, 64 nt, Human
agagucuugcucugucacccaggcuggagugcaguggcacgaucucggcucacugcaagcucug

SEQ ID NO: 246695 - RNA, 64 nt, Human
gcaugacaaacuguggccgaccgcagcugugccguggcacgauggcgaggaagccagccccaag

SEQ ID NO: 246696 - RNA, 64 nt, Human
agagucucgcucugucgcccaggcuggagggcaguggcacgaucucagcucacugcaagcucca

SEQ ID NO: 246697 - RNA, 64 nt, Human
acaggcucacucugucacccaggccagagugcaguggcacgaucauaguuaccgcagcaucaaa

SEQ ID NO: 246698 - RNA, 53 nt, Human
ccaaacaggaugaacucuaaaccuggcacgaaccagauggugccagggaguac

SEQ ID NO: 246699 - RNA, 64 nt, Human
uagauccuaggucccuuuuccucccgaguuuggcuggcacgagagcuagcccagcacaugaagc

SEQ ID NO: 246700 - RNA, 64 nt, Human
ggagucuuagucugucacugaggcuggaguacaguggcacgaucuuggcucacugcaaccucca

SEQ ID NO: 246701 - RNA, 64 nt, Human
cacaacgugggcuuaaagcagaagccccacagccuggcacgaaggccccgccuggguuagguga

SEQ ID NO: 246702 - RNA, 64 nt, Human
agagucuugcucuguugcccaggcuggagugcaguggcacgaucuuggcucacugcaaccuccg

SEQ ID NO: 246703 - RNA, 64 nt, Human
aucagauugguaacuuaucgccuguuguccagauuggcacgaaccuuuucuuccacuuaauuau

SEQ ID NO: 246704 - RNA, 64 nt, Human
ggcuucucuggggcacuuggggcuauguacaaccuggcacgauccagaaagggugcaaacaaaa

SEQ ID NO: 246705 - RNA, 64 nt, Human
ccugaaggguggucccugagggucugcccagccuuggcacgagagguugguuccagccccuggc

SEQ ID NO: 246706 - RNA, 64 nt, Human
ggggucuggcucugucacccaggcuggagugcaguggcacgauuauggcucauugcagccucga

SEQ ID NO: 246707 - RNA, 64 nt, Human
acagucucgcccugucacccaggcuggagugcaguggcacgaucucagcucacugcaaccuacg

SEQ ID NO: 246708 - RNA, 64 nt, Human
ugauaagcaugguugguuccggugaguguagggauggcacgauaccagggcagccucuugaaaa

SEQ ID NO: 246709 - RNA, 64 nt, Human; identical to SEQ ID NO: 195497

SEQ ID NO: 246710 - RNA, 64 nt, Human; identical to SEQ ID NO: 195516

SEQ ID NO: 246711 - RNA, 64 nt, Human; identical to SEQ ID NO: 195532

SEQ ID NO: 246712 - RNA, 64 nt, Human; identical to SEQ ID NO: 195533

SEQ ID NO: 246713 - RNA, 64 nt, Human
ccugaauacuuccugccccaggcggucaggguuauggcacgaugcagguggcacucaggggcua

SEQ ID NO: 246714 - RNA, 64 nt, Human
ggagucucacucuguugcccaggcuggagugcaguggcacgaucucggcucacugcaggcucug

SEQ ID NO: 246715 - RNA, 64 nt, Human
aaguuuugcucuuguuccccaggcuggagugcaauggcacgaucucgguucacugcaaccucca

SEQ ID NO: 246716 - RNA, 64 nt, Human
agagucuugcucuguugcucaggcuggaguacaguggcacgaucucagcucacugcacugcaau

SEQ ID NO: 246717 - RNA, 64 nt, Human
aguuuugcucuuuguugcccaggcuggagugcaguggcacgaucucggcucacugcaaccuccg

SEQ ID NO: 246718 - RNA, 64 nt, Human
agggucuugcucugucacccaggcuggggcgcaauggcacgaucuuggcucacugcaaccucug

SEQ ID NO: 246719 - RNA, 64 nt, Human
uauacauaaaaaugguaacaaacucuguuuucuuuggcacgauauuaauauuuuggaaguaauc

SEQ ID NO: 246720 - RNA, 64 nt, Human
uuuuuuagucuguuaauaugguacauuacauugauggcacgauauguuaaaccaaccuuucauu

SEQ ID NO: 246721 - RNA, 64 nt, Human
ggaguaacuuuccgucuuggaaggguggcucugauggcacgaugucaacuugagauucuuccua

SEQ ID NO: 246722 - RNA, 64 nt, Human
gaagucuugcugugucacguaggcuggagugcaauggcacgaucgugucucauugcaacuuccg

SEQ ID NO: 246723 - RNA, 64 nt, Human
gacagcgacaaaccugaggccgugucuaggaggcuggcacgacugcuucagcagagaccaaaua

SEQ ID NO: 246724 - RNA, 64 nt, Human
ggagucuugcucuguugcccacauuggagugcaguggcacgaucucagcucauugcagccuccg

SEQ ID NO: 246725 - RNA, 64 nt, Human
cgagguggaaguccgcacaugucggugguauuuauggcacgauuccuuuggauggcuucauuug

SEQ ID NO: 246726 - RNA, 64 nt, Human
gaguuuugcucuuguuguccaggcuggagugcaauggcacgaucucagcucacugcaaccuccg

SEQ ID NO: 246727 - RNA, 64 nt, Human
auccccauguagcuuugcauagcaacggcacacguggcacgauuccagcagaguuuaucucaca

SEQ ID NO: 246728 - RNA, 64 nt, Human
ggagucucgcucuguugcccaggcuggagugcaguggcacgaucuuggcucacugcaagcucug

SEQ ID NO: 246729 - RNA, 64 nt, Human; identical to SEQ ID NO: 195459

SEQ ID NO: 246730 - RNA, 64 nt, Human; identical to SEQ ID NO: 195460

SEQ ID NO: 246731 - RNA, 64 nt, Human; identical to SEQ ID NO: 195461

SEQ ID NO: 246732 - RNA, 64 nt, Human; identical to SEQ ID NO: 195466

SEQ ID NO: 246733 - RNA, 64 nt, Human
agagaggcucccucaugggcugcuccauugaugauggcacgaacaugaccuauggaaccucucc

SEQ ID NO: 246734 - RNA, 64 nt, Human
gaguuucacucuuguugcccaggcuggaaugcaauggcacgaucucggcucacggcaacccccg

SEQ ID NO: 246735 - RNA, 64 nt, Human
cuccaaccauguccucucccccucagccuguggguggcacgagcaaggacugacauccgcacag

SEQ ID NO: 246736 - RNA, 64 nt, Human
guggagucuugcugucuccccggcuggagcgcaguggcacgaucgcggcucacugcagccucca

SEQ ID NO: 246737 - RNA, 64 nt, Human
caaaucuugcucuguggcccaggcuggagugcaguggcacgaucucagcucacugcaaccucca

SEQ ID NO: 246738 - RNA, 64 nt, Human
cacaucgugcuggagacacgaguuucuaagcagcuggcacgagggcugcugacggcaugggucg

SEQ ID NO: 246739 - RNA, 64 nt, Human
gcaccuucuuggccugacagaccauugguggggcuggcacgaauccagaucuggauccuacauc

SEQ ID NO: 246740 - RNA, 64 nt, Human
ggggagggaggcagagcuggcuggcucagcuaaguggcacgaugacgcaugaaggagauuaugu

SEQ ID NO: 246741 - RNA, 64 nt, Human
agacggcgcaccuaucacccaggcuggaguggaguggcacgaucuuggcucacugcaaccucuu

SEQ ID NO: 246742 - RNA, 64 nt, Human
agaaucucgugcugcugcccaggcuggagugcaguggcacgaucugcaaacuccgccuccuggg

SEQ ID NO: 246743 - RNA, 64 nt, Human
acagucucgcuuuguugcccaggcuggggugcaguggcacgaucgcggcucacugcaaccucca

SEQ ID NO: 246744 - RNA, 64 nt, Human
gagcuaauggucacauugauaguugauuacacuguggcacgaauuaaugcagaacacuguuauu

SEQ ID NO: 246745 - RNA, 64 nt, Human
gaguuucacucuuguugcccaggcuggagugcaauggcacgaucuuggcucacugcaaccucug

SEQ ID NO: 246746 - RNA, 64 nt, Human
aaacuguuacuucaugucuaacucccagcggaacuggcacgacuccgucaccgccugccaggaa

SEQ ID NO: 246747 - RNA, 64 nt, Human
agguccuagugauucucucaacccuaacaccgucuggcacgauugugaccgcugaaguacacca

SEQ ID NO: 246748 - RNA, 64 nt, Human
agagucucacucugucacccaggcuggagugcaguggcacgaucuuggcucacugcaaccuccg

SEQ ID NO: 246749 - RNA, 64 nt, Human; identical to SEQ ID NO: 195536

SEQ ID NO: 246750 - RNA, 64 nt, Human; identical to SEQ ID NO: 195537

SEQ ID NO: 246751 - RNA, 64 nt, Human; identical to SEQ ID NO: 195542

SEQ ID NO: 246752 - RNA, 64 nt, Human; identical to SEQ ID NO: 195543

SEQ ID NO: 246753 - RNA, 64 nt, Human
guagucuugcucugucacccaggcuggagugcaguggcacgaucucggcucacuguaaccucca

SEQ ID NO: 246754 - RNA, 64 nt, Human
ggaaucucgcucugucgcccaggcuggagugcaguggcacgaucucaacucacugcaagcuccg

SEQ ID NO: 246755 - RNA, 64 nt, Human
ggagucuugcucugucgcccagguuggagugcaguggcacgaucucagcucacugcaaccuccu

SEQ ID NO: 246756 - RNA, 64 nt, Human
agacagaauguccgucugucugcccaggcuggaguggcacgaucucagcucacugcagccucca

SEQ ID NO: 246757 - RNA, 64 nt, Human
cuccaugcccccucaucuuccaguucuugcuuaguggcacgaccucuuuccauagcauaaaugc

SEQ ID NO: 246758 - RNA, 64 nt, Human
gauuuucgcucuugucgcccaggcuggaguacaauggcacgaucuuggcucacugcaaccuccg

SEQ ID NO: 246759 - RNA, 64 nt, Human
cuccaugaccuaccucuaugaggacagcaauguauggcacgacaucucagacuuccucgucuau

SEQ ID NO: 246760 - RNA, 64 nt, Human
ggagucuugcccuguugcccaugcuggagugcaauggcacgaucucagcucacugcaaccucca

SEQ ID NO: 246761 - RNA, 64 nt, Human
gaguuucacgcuuauugcccaggcuggagugcaauggcacgaucucagcucaccacaaccucca

SEQ ID NO: 246762 - RNA, 64 nt, Human
acggucuggcucugucgccuaagcuggagugugguggcacgaucacagcucacugcagccucca

SEQ ID NO: 246763 - RNA, 64 nt, Human
ccugcccacucuuaccgagcaagguggguggcucuggcacgagucccccagggggagagcaugg

SEQ ID NO: 246764 - RNA, 64 nt, Human
ccaggaggagggugccuggccccaguacccaggguggcacgacugggcuaaguggacacugagc

SEQ ID NO: 246765 - RNA, 64 nt, Human
aaauaugcagcaaaaaccaauacaacaaaacgaguggcacgauuuauuucaaacuaggccagcu

SEQ ID NO: 246766 - RNA, 64 nt, Human
ggauggagucucugucacccaggcuggcgugcaauggcacgaucuuggcucacugcaagcuucc

SEQ ID NO: 246767 - RNA, 64 nt, Human
aggccucagaacugugugugcgggacaggguggcuggcacgagaugugugggacugggacgcuu

SEQ ID NO: 246768 - RNA, 64 nt, Human
ggagacucacucuguugcccagacuggagugcaguggcacgaucuuggcuuacuacaaccuccg

SEQ ID NO: 246769 - RNA, 64 nt, Human; identical to SEQ ID NO: 195469

SEQ ID NO: 246770 - RNA, 64 nt, Human; identical to SEQ ID NO: 195470

SEQ ID NO: 246771 - RNA, 64 nt, Human; identical to SEQ ID NO: 195471

SEQ ID NO: 246772 - RNA, 64 nt, Human; identical to SEQ ID NO: 195472

SEQ ID NO: 246773 - RNA, 64 nt, Human
gagucuugcuccuguugugcaggcuguagugcaguggcacgaucuuggcucacugcaaccucca

SEQ ID NO: 246774 - RNA, 64 nt, Human
uggauuaucuuccacacaugaauuuucucucuccuggcacgaauauaaagcacaucucuuaacu

SEQ ID NO: 246775 - RNA, 64 nt, Human; identical to SEQ ID NO: 195435

SEQ ID NO: 246776 - RNA, 64 nt, Human; identical to SEQ ID NO: 195436

SEQ ID NO: 246777 - RNA, 64 nt, Human; identical to SEQ ID NO: 195437

SEQ ID NO: 246778 - RNA, 64 nt, Human; identical to SEQ ID NO: 195438

SEQ ID NO: 246779 - RNA, 64 nt, Human; identical to SEQ ID NO: 195439

SEQ ID NO: 246780 - RNA, 64 nt, Human; identical to SEQ ID NO: 195440

SEQ ID NO: 246781 - RNA, 64 nt, Human; identical to SEQ ID NO: 195441

SEQ ID NO: 246782 - RNA, 64 nt, Human; identical to SEQ ID NO: 195442

SEQ ID NO: 246783 - RNA, 64 nt, Human; identical to SEQ ID NO: 195447

SEQ ID NO: 246784 - RNA, 64 nt, Human; identical to SEQ ID NO: 195448

SEQ ID NO: 246785 - RNA, 64 nt, Human; identical to SEQ ID NO: 195449

SEQ ID NO: 246786 - RNA, 64 nt, Human; identical to SEQ ID NO: 195450

SEQ ID NO: 246787 - RNA, 64 nt, Human; identical to SEQ ID NO: 195451

SEQ ID NO: 246788 - RNA, 64 nt, Human; identical to SEQ ID NO: 195452

SEQ ID NO: 246789 - RNA, 64 nt, Human; identical to SEQ ID NO: 195453

SEQ ID NO: 246790 - RNA, 64 nt, Human; identical to SEQ ID NO: 195454

SEQ ID NO: 246791 - RNA, 64 nt, Human; identical to SEQ ID NO: 195455

SEQ ID NO: 246792 - RNA, 64 nt, Human; identical to SEQ ID NO: 195456

SEQ ID NO: 246793 - RNA, 64 nt, Human; identical to SEQ ID NO: 195686

SEQ ID NO: 246794 - RNA, 64 nt, Human; identical to SEQ ID NO: 195687

SEQ ID NO: 246795 - RNA, 64 nt, Human; identical to SEQ ID NO: 195688

SEQ ID NO: 246796 - RNA, 64 nt, Human; identical to SEQ ID NO: 195689

SEQ ID NO: 246797 - RNA, 64 nt, Human; identical to SEQ ID NO: 195694

SEQ ID NO: 246798 - RNA, 64 nt, Human; identical to SEQ ID NO: 195695

SEQ ID NO: 246799 - RNA, 64 nt, Human; identical to SEQ ID NO: 195696

SEQ ID NO: 246800 - RNA, 64 nt, Human; identical to SEQ ID NO: 195697

SEQ ID NO: 246801 - RNA, 64 nt, Human; identical to SEQ ID NO: 195698

SEQ ID NO: 246802 - RNA, 64 nt, Human; identical to SEQ ID NO: 195699

SEQ ID NO: 246803 - RNA, 64 nt, Human; identical to SEQ ID NO: 195700

SEQ ID NO: 246804 - RNA, 64 nt, Human; identical to SEQ ID NO: 195701

SEQ ID NO: 246805 - RNA, 64 nt, Human; identical to SEQ ID NO: 195702

SEQ ID NO: 246806 - RNA, 64 nt, Human; identical to SEQ ID NO: 195703

SEQ ID NO: 246807 - RNA, 64 nt, Human; identical to SEQ ID NO: 195704

SEQ ID NO: 246808 - RNA, 64 nt, Human; identical to SEQ ID NO: 195705

SEQ ID NO: 246809 - RNA, 64 nt, Human; identical to SEQ ID NO: 195706

SEQ ID NO: 246810 - RNA, 64 nt, Human; identical to SEQ ID NO: 195707

SEQ ID NO: 246811 - RNA, 64 nt, Human; identical to SEQ ID NO: 195708

SEQ ID NO: 246812 - RNA, 64 nt, Human; identical to SEQ ID NO: 195712

SEQ ID NO: 246813 - RNA, 64 nt, Human; identical to SEQ ID NO: 195713

SEQ ID NO: 246814 - RNA, 64 nt, Human; identical to SEQ ID NO: 195714

SEQ ID NO: 246815 - RNA, 64 nt, Human; identical to SEQ ID NO: 195715

SEQ ID NO: 246816 - RNA, 64 nt, Human; identical to SEQ ID NO: 195716

SEQ ID NO: 246817 - RNA, 64 nt, Human; identical to SEQ ID NO: 195717

SEQ ID NO: 246818 - RNA, 64 nt, Human; identical to SEQ ID NO: 195718

SEQ ID NO: 246819 - RNA, 64 nt, Human; identical to SEQ ID NO: 195719

SEQ ID NO: 246820 - RNA, 64 nt, Human; identical to SEQ ID NO: 195720

SEQ ID NO: 246821 - RNA, 64 nt, Human; identical to SEQ ID NO: 195721

SEQ ID NO: 246822 - RNA, 64 nt, Human; identical to SEQ ID NO: 195722

SEQ ID NO: 246823 - RNA, 64 nt, Human; identical to SEQ ID NO: 195723

SEQ ID NO: 246824 - RNA, 64 nt, Human; identical to SEQ ID NO: 195724

SEQ ID NO: 246825 - RNA, 64 nt, Human; identical to SEQ ID NO: 195725

SEQ ID NO: 246826 - RNA, 64 nt, Human; identical to SEQ ID NO: 195726

SEQ ID NO: 246827 - RNA, 64 nt, Human; identical to SEQ ID NO: 195731

SEQ ID NO: 246828 - RNA, 64 nt, Human; identical to SEQ ID NO: 195732

SEQ ID NO: 246829 - RNA, 64 nt, Human; identical to SEQ ID NO: 195733

SEQ ID NO: 246830 - RNA, 64 nt, Human; identical to SEQ ID NO: 195734

SEQ ID NO: 246831 - RNA, 64 nt, Human; identical to SEQ ID NO: 195735

SEQ ID NO: 246832 - RNA, 64 nt, Human; identical to SEQ ID NO: 195736

SEQ ID NO: 246833 - RNA, 64 nt, Human; identical to SEQ ID NO: 195737

SEQ ID NO: 246834 - RNA, 55 nt, Human; identical to SEQ ID NO: 195738

SEQ ID NO: 246835 - RNA, 64 nt, Human; identical to SEQ ID NO: 195739

SEQ ID NO: 246836 - RNA, 64 nt, Human; identical to SEQ ID NO: 195740

SEQ ID NO: 246837 - RNA, 64 nt, Human; identical to SEQ ID NO: 195741

SEQ ID NO: 246838 - RNA, 64 nt, Human; identical to SEQ ID NO: 195742

SEQ ID NO: 246839 - RNA, 64 nt, Human; identical to SEQ ID NO: 195743

SEQ ID NO: 246840 - RNA, 64 nt, Human; identical to SEQ ID NO: 195744

SEQ ID NO: 246841 - RNA, 64 nt, Human; identical to SEQ ID NO: 195745

SEQ ID NO: 246842 - RNA, 64 nt, Human; identical to SEQ ID NO: 195750

SEQ ID NO: 246843 - RNA, 64 nt, Human; identical to SEQ ID NO: 195751

SEQ ID NO: 246844 - RNA, 64 nt, Human; identical to SEQ ID NO: 195752

SEQ ID NO: 246845 - RNA, 64 nt, Human; identical to SEQ ID NO: 195753

SEQ ID NO: 246846 - RNA, 64 nt, Human; identical to SEQ ID NO: 195754

SEQ ID NO: 246847 - RNA, 64 nt, Human; identical to SEQ ID NO: 195755

SEQ ID NO: 246848 - RNA, 64 nt, Human; identical to SEQ ID NO: 195756

SEQ ID NO: 246849 - RNA, 64 nt, Human; identical to SEQ ID NO: 195757

SEQ ID NO: 246850 - RNA, 64 nt, Human; identical to SEQ ID NO: 195758

SEQ ID NO: 246851 - RNA, 64 nt, Human; identical to SEQ ID NO: 195759

SEQ ID NO: 246852 - RNA, 64 nt, Human; identical to SEQ ID NO: 195760

SEQ ID NO: 246853 - RNA, 64 nt, Human; identical to SEQ ID NO: 195761

SEQ ID NO: 246854 - RNA, 64 nt, Human; identical to SEQ ID NO: 195762

SEQ ID NO: 246855 - RNA, 64 nt, Human; identical to SEQ ID NO: 195763

SEQ ID NO: 246856 - RNA, 64 nt, Human; identical to SEQ ID NO: 195764

SEQ ID NO: 246857 - RNA, 64 nt, Human; identical to SEQ ID NO: 195769

SEQ ID NO: 246858 - RNA, 64 nt, Human; identical to SEQ ID NO: 195770

SEQ ID NO: 246859 - RNA, 64 nt, Human; identical to SEQ ID NO: 195771

SEQ ID NO: 246860 - RNA, 64 nt, Human; identical to SEQ ID NO: 195772

SEQ ID NO: 246861 - RNA, 64 nt, Human; identical to SEQ ID NO: 195773

SEQ ID NO: 246862 - RNA, 64 nt, Human; identical to SEQ ID NO: 195774

SEQ ID NO: 246863 - RNA, 64 nt, Human; identical to SEQ ID NO: 195775

SEQ ID NO: 246864 - RNA, 64 nt, Human; identical to SEQ ID NO: 195776

SEQ ID NO: 246865 - RNA, 64 nt, Human; identical to SEQ ID NO: 195777

SEQ ID NO: 246866 - RNA, 64 nt, Human; identical to SEQ ID NO: 195778

SEQ ID NO: 246867 - RNA, 64 nt, Human; identical to SEQ ID NO: 195779

SEQ ID NO: 246868 - RNA, 64 nt, Human; identical to SEQ ID NO: 195780

SEQ ID NO: 246869 - RNA, 64 nt, Human; identical to SEQ ID NO: 195781

SEQ ID NO: 246870 - RNA, 64 nt, Human; identical to SEQ ID NO: 195782

SEQ ID NO: 246871 - RNA, 64 nt, Human; identical to SEQ ID NO: 195783

SEQ ID NO: 246872 - RNA, 64 nt, Human; identical to SEQ ID NO: 195788

SEQ ID NO: 246873 - RNA, 64 nt, Human; identical to SEQ ID NO: 195789

SEQ ID NO: 246874 - RNA, 64 nt, Human; identical to SEQ ID NO: 195790

SEQ ID NO: 246875 - RNA, 64 nt, Human; identical to SEQ ID NO: 195791

SEQ ID NO: 246876 - RNA, 64 nt, Human; identical to SEQ ID NO: 195792

SEQ ID NO: 246877 - RNA, 64 nt, Human; identical to SEQ ID NO: 195793

SEQ ID NO: 246878 - RNA, 64 nt, Human; identical to SEQ ID NO: 195794

SEQ ID NO: 246879 - RNA, 64 nt, Human; identical to SEQ ID NO: 195795

SEQ ID NO: 246880 - RNA, 64 nt, Human; identical to SEQ ID NO: 195796

SEQ ID NO: 246881 - RNA, 64 nt, Human; identical to SEQ ID NO: 195797

SEQ ID NO: 246882 - RNA, 64 nt, Human; identical to SEQ ID NO: 195798

SEQ ID NO: 246883 - RNA, 64 nt, Human; identical to SEQ ID NO: 195799

SEQ ID NO: 246884 - RNA, 64 nt, Human; identical to SEQ ID NO: 195800

SEQ ID NO: 246885 - RNA, 64 nt, Human; identical to SEQ ID NO: 195801

SEQ ID NO: 246886 - RNA, 64 nt, Human; identical to SEQ ID NO: 195802

SEQ ID NO: 246887 - RNA, 64 nt, Human; identical to SEQ ID NO: 195807

SEQ ID NO: 246888 - RNA, 64 nt, Human; identical to SEQ ID NO: 195808

SEQ ID NO: 246889 - RNA, 64 nt, Human; identical to SEQ ID NO: 195809

SEQ ID NO: 246890 - RNA, 64 nt, Human; identical to SEQ ID NO: 195810

SEQ ID NO: 246891 - RNA, 64 nt, Human; identical to SEQ ID NO: 195811

SEQ ID NO: 246892 - RNA, 64 nt, Human; identical to SEQ ID NO: 195812

SEQ ID NO: 246893 - RNA, 58 nt, Human; identical to SEQ ID NO: 195813

SEQ ID NO: 246894 - RNA, 64 nt, Human; identical to SEQ ID NO: 195814

SEQ ID NO: 246895 - RNA, 64 nt, Human; identical to SEQ ID NO: 195815

SEQ ID NO: 246896 - RNA, 64 nt, Human; identical to SEQ ID NO: 195816

SEQ ID NO: 246897 - RNA, 64 nt, Human; identical to SEQ ID NO: 195817

SEQ ID NO: 246898 - RNA, 64 nt, Human; identical to SEQ ID NO: 195818

SEQ ID NO: 246899 - RNA, 64 nt, Human; identical to SEQ ID NO: 195819

SEQ ID NO: 246900 - RNA, 64 nt, Human; identical to SEQ ID NO: 195820

SEQ ID NO: 246901 - RNA, 64 nt, Human; identical to SEQ ID NO: 195821

SEQ ID NO: 246902 - RNA, 64 nt, Human; identical to SEQ ID NO: 195822

SEQ ID NO: 246903 - RNA, 64 nt, Human; identical to SEQ ID NO: 195823

SEQ ID NO: 246904 - RNA, 64 nt, Human; identical to SEQ ID NO: 195824

SEQ ID NO: 246905 - RNA, 64 nt, Human; identical to SEQ ID NO: 195825

SEQ ID NO: 246906 - RNA, 64 nt, Human; identical to SEQ ID NO: 195826

SEQ ID NO: 246907 - RNA, 64 nt, Human; identical to SEQ ID NO: 195827

SEQ ID NO: 246908 - RNA, 64 nt, Human; identical to SEQ ID NO: 195828

SEQ ID NO: 246909 - RNA, 64 nt, Human; identical to SEQ ID NO: 195829

SEQ ID NO: 246910 - RNA, 64 nt, Human; identical to SEQ ID NO: 195830

SEQ ID NO: 246911 - RNA, 64 nt, Human; identical to SEQ ID NO: 195831

SEQ ID NO: 246912 - RNA, 64 nt, Human; identical to SEQ ID NO: 195832

SEQ ID NO: 246913 - RNA, 64 nt, Human; identical to SEQ ID NO: 195833

SEQ ID NO: 246914 - RNA, 64 nt, Human; identical to SEQ ID NO: 195834

SEQ ID NO: 246915 - RNA, 64 nt, Human; identical to SEQ ID NO: 195835

SEQ ID NO: 246916 - RNA, 64 nt, Human; identical to SEQ ID NO: 195836

SEQ ID NO: 246917 - RNA, 64 nt, Human; identical to SEQ ID NO: 195838

SEQ ID NO: 246918 - RNA, 64 nt, Human; identical to SEQ ID NO: 195839

SEQ ID NO: 246919 - RNA, 64 nt, Human; identical to SEQ ID NO: 195840

SEQ ID NO: 246920 - RNA, 64 nt, Human; identical to SEQ ID NO: 195841

SEQ ID NO: 246921 - RNA, 64 nt, Human; identical to SEQ ID NO: 195842

SEQ ID NO: 246922 - RNA, 64 nt, Human; identical to SEQ ID NO: 195843

SEQ ID NO: 246923 - RNA, 64 nt, Human; identical to SEQ ID NO: 195844

SEQ ID NO: 246924 - RNA, 50 nt, Human; identical to SEQ ID NO: 195845

SEQ ID NO: 246925 - RNA, 64 nt, Human; identical to SEQ ID NO: 195846

SEQ ID NO: 246926 - RNA, 64 nt, Human; identical to SEQ ID NO: 195847

SEQ ID NO: 246927 - RNA, 64 nt, Human; identical to SEQ ID NO: 195848

SEQ ID NO: 246928 - RNA, 64 nt, Human; identical to SEQ ID NO: 195849

SEQ ID NO: 246929 - RNA, 64 nt, Human; identical to SEQ ID NO: 195850

SEQ ID NO: 246930 - RNA, 64 nt, Human; identical to SEQ ID NO: 195851

SEQ ID NO: 246931 - RNA, 64 nt, Human; identical to SEQ ID NO: 195852

SEQ ID NO: 246932 - RNA, 64 nt, Human; identical to SEQ ID NO: 195857

SEQ ID NO: 246933 - RNA, 64 nt, Human; identical to SEQ ID NO: 195858

SEQ ID NO: 246934 - RNA, 64 nt, Human; identical to SEQ ID NO: 195859

SEQ ID NO: 246935 - RNA, 64 nt, Human; identical to SEQ ID NO: 195860

SEQ ID NO: 246936 - RNA, 61 nt, Human; identical to SEQ ID NO: 195861

SEQ ID NO: 246937 - RNA, 64 nt, Human; identical to SEQ ID NO: 195862

SEQ ID NO: 246938 - RNA, 64 nt, Human; identical to SEQ ID NO: 195863

SEQ ID NO: 246939 - RNA, 64 nt, Human; identical to SEQ ID NO: 195864

SEQ ID NO: 246940 - RNA, 64 nt, Human; identical to SEQ ID NO: 195865

SEQ ID NO: 246941 - RNA, 64 nt, Human; identical to SEQ ID NO: 195866

SEQ ID NO: 246942 - RNA, 64 nt, Human; identical to SEQ ID NO: 195867

SEQ ID NO: 246943 - RNA, 64 nt, Human; identical to SEQ ID NO: 195868

SEQ ID NO: 246944 - RNA, 64 nt, Human; identical to SEQ ID NO: 195869

SEQ ID NO: 246945 - RNA, 64 nt, Human; identical to SEQ ID NO: 195870

SEQ ID NO: 246946 - RNA, 64 nt, Human; identical to SEQ ID NO: 195871

SEQ ID NO: 246947 - RNA, 64 nt, Human; identical to SEQ ID NO: 195876

SEQ ID NO: 246948 - RNA, 64 nt, Human; identical to SEQ ID NO: 195877

SEQ ID NO: 246949 - RNA, 64 nt, Human; identical to SEQ ID NO: 195878

SEQ ID NO: 246950 - RNA, 64 nt, Human; identical to SEQ ID NO: 195879

SEQ ID NO: 246951 - RNA, 64 nt, Human; identical to SEQ ID NO: 195880

SEQ ID NO: 246952 - RNA, 64 nt, Human; identical to SEQ ID NO: 195881

SEQ ID NO: 246953 - RNA, 64 nt, Human; identical to SEQ ID NO: 195882

SEQ ID NO: 246954 - RNA, 64 nt, Human; identical to SEQ ID NO: 195883

SEQ ID NO: 246955 - RNA, 64 nt, Human; identical to SEQ ID NO: 195884

SEQ ID NO: 246956 - RNA, 64 nt, Human; identical to SEQ ID NO: 195885

SEQ ID NO: 246957 - RNA, 64 nt, Human; identical to SEQ ID NO: 195886

SEQ ID NO: 246958 - RNA, 64 nt, Human; identical to SEQ ID NO: 195887

SEQ ID NO: 246959 - RNA, 64 nt, Human; identical to SEQ ID NO: 195888

SEQ ID NO: 246960 - RNA, 64 nt, Human; identical to SEQ ID NO: 195889

SEQ ID NO: 246961 - RNA, 64 nt, Human; identical to SEQ ID NO: 195890

SEQ ID NO: 246962 - RNA, 64 nt, Human; identical to SEQ ID NO: 195895

SEQ ID NO: 246963 - RNA, 64 nt, Human; identical to SEQ ID NO: 195896

SEQ ID NO: 246964 - RNA, 64 nt, Human; identical to SEQ ID NO: 195897

SEQ ID NO: 246965 - RNA, 64 nt, Human; identical to SEQ ID NO: 195898

SEQ ID NO: 246966 - RNA, 64 nt, Human; identical to SEQ ID NO: 195899

SEQ ID NO: 246967 - RNA, 64 nt, Human; identical to SEQ ID NO: 195900

SEQ ID NO: 246968 - RNA, 64 nt, Human; identical to SEQ ID NO: 195901

SEQ ID NO: 246969 - RNA, 64 nt, Human; identical to SEQ ID NO: 195902

SEQ ID NO: 246970 - RNA, 64 nt, Human; identical to SEQ ID NO: 195903

SEQ ID NO: 246971 - RNA, 64 nt, Human; identical to SEQ ID NO: 195904

SEQ ID NO: 246972 - RNA, 64 nt, Human; identical to SEQ ID NO: 195905

SEQ ID NO: 246973 - RNA, 64 nt, Human; identical to SEQ ID NO: 195906

SEQ ID NO: 246974 - RNA, 64 nt, Human; identical to SEQ ID NO: 195907

SEQ ID NO: 246975 - RNA, 53 nt, Human; identical to SEQ ID NO: 195908

SEQ ID NO: 246976 - RNA, 64 nt, Human; identical to SEQ ID NO: 195909

SEQ ID NO: 246977 - RNA, 64 nt, Human; identical to SEQ ID NO: 195914

SEQ ID NO: 246978 - RNA, 64 nt, Human; identical to SEQ ID NO: 195915

SEQ ID NO: 246979 - RNA, 64 nt, Human; identical to SEQ ID NO: 195916

SEQ ID NO: 246980 - RNA, 51 nt, Human; identical to SEQ ID NO: 195917

SEQ ID NO: 246981 - RNA, 64 nt, Human; identical to SEQ ID NO: 195918

SEQ ID NO: 246982 - RNA, 64 nt, Human; identical to SEQ ID NO: 195919

SEQ ID NO: 246983 - RNA, 64 nt, Human; identical to SEQ ID NO: 195920

SEQ ID NO: 246984 - RNA, 64 nt, Human; identical to SEQ ID NO: 195921

SEQ ID NO: 246985 - RNA, 64 nt, Human; identical to SEQ ID NO: 195922

SEQ ID NO: 246986 - RNA, 64 nt, Human; identical to SEQ ID NO: 195923

SEQ ID NO: 246987 - RNA, 64 nt, Human; identical to SEQ ID NO: 195924

SEQ ID NO: 246988 - RNA, 64 nt, Human; identical to SEQ ID NO: 195925

SEQ ID NO: 246989 - RNA, 64 nt, Human; identical to SEQ ID NO: 195926

SEQ ID NO: 246990 - RNA, 64 nt, Human; identical to SEQ ID NO: 195927

SEQ ID NO: 246991 - RNA, 64 nt, Human; identical to SEQ ID NO: 195928

SEQ ID NO: 246992 - RNA, 64 nt, Human; identical to SEQ ID NO: 195933

SEQ ID NO: 246993 - RNA, 64 nt, Human; identical to SEQ ID NO: 195934

SEQ ID NO: 246994 - RNA, 64 nt, Human; identical to SEQ ID NO: 195935

SEQ ID NO: 246995 - RNA, 64 nt, Human; identical to SEQ ID NO: 195936

SEQ ID NO: 246996 - RNA, 64 nt, Human; identical to SEQ ID NO: 195937

SEQ ID NO: 246997 - RNA, 64 nt, Human; identical to SEQ ID NO: 195938

SEQ ID NO: 246998 - RNA, 64 nt, Human; identical to SEQ ID NO: 195939

SEQ ID NO: 246999 - RNA, 61 nt, Human; identical to SEQ ID NO: 195940

SEQ ID NO: 247000 - RNA, 64 nt, Human; identical to SEQ ID NO: 195941

SEQ ID NO: 247001 - RNA, 64 nt, Human; identical to SEQ ID NO: 195942

SEQ ID NO: 247002 - RNA, 64 nt, Human; identical to SEQ ID NO: 195943

SEQ ID NO: 247003 - RNA, 64 nt, Human; identical to SEQ ID NO: 195944

SEQ ID NO: 247004 - RNA, 64 nt, Human; identical to SEQ ID NO: 195945

SEQ ID NO: 247005 - RNA, 64 nt, Human; identical to SEQ ID NO: 195946

SEQ ID NO: 247006 - RNA, 64 nt, Human; identical to SEQ ID NO: 195947

SEQ ID NO: 247007 - RNA, 64 nt, Human; identical to SEQ ID NO: 195952

SEQ ID NO: 247008 - RNA, 64 nt, Human; identical to SEQ ID NO: 195953

SEQ ID NO: 247009 - RNA, 64 nt, Human; identical to SEQ ID NO: 195954

SEQ ID NO: 247010 - RNA, 64 nt, Human; identical to SEQ ID NO: 195955

SEQ ID NO: 247011 - RNA, 64 nt, Human; identical to SEQ ID NO: 195956

SEQ ID NO: 247012 - RNA, 64 nt, Human; identical to SEQ ID NO: 195957

SEQ ID NO: 247013 - RNA, 64 nt, Human; identical to SEQ ID NO: 195958

SEQ ID NO: 247014 - RNA, 64 nt, Human; identical to SEQ ID NO: 195959

SEQ ID NO: 247015 - RNA, 64 nt, Human; identical to SEQ ID NO: 195960

SEQ ID NO: 247016 - RNA, 64 nt, Human; identical to SEQ ID NO: 195961

SEQ ID NO: 247017 - RNA, 64 nt, Human; identical to SEQ ID NO: 195962

SEQ ID NO: 247018 - RNA, 64 nt, Human; identical to SEQ ID NO: 195963

SEQ ID NO: 247019 - RNA, 64 nt, Human; identical to SEQ ID NO: 195964

SEQ ID NO: 247020 - RNA, 64 nt, Human; identical to SEQ ID NO: 195965

SEQ ID NO: 247021 - RNA, 64 nt, Human; identical to SEQ ID NO: 195966

SEQ ID NO: 247022 - RNA, 64 nt, Human; identical to SEQ ID NO: 195971

SEQ ID NO: 247023 - RNA, 52 nt, Human; identical to SEQ ID NO: 195972

SEQ ID NO: 247024 - RNA, 64 nt, Human; identical to SEQ ID NO: 195973

SEQ ID NO: 247025 - RNA, 64 nt, Human; identical to SEQ ID NO: 195974

SEQ ID NO: 247026 - RNA, 64 nt, Human; identical to SEQ ID NO: 195975

SEQ ID NO: 247027 - RNA, 64 nt, Human; identical to SEQ ID NO: 195976

SEQ ID NO: 247028 - RNA, 64 nt, Human; identical to SEQ ID NO: 195977

SEQ ID NO: 247029 - RNA, 64 nt, Human; identical to SEQ ID NO: 195978

SEQ ID NO: 247030 - RNA, 55 nt, Human; identical to SEQ ID NO: 195979

SEQ ID NO: 247031 - RNA, 64 nt, Human; identical to SEQ ID NO: 195980

SEQ ID NO: 247032 - RNA, 64 nt, Human; identical to SEQ ID NO: 195981

SEQ ID NO: 247033 - RNA, 64 nt, Human; identical to SEQ ID NO: 195982

SEQ ID NO: 247034 - RNA, 64 nt, Human; identical to SEQ ID NO: 195983

SEQ ID NO: 247035 - RNA, 64 nt, Human; identical to SEQ ID NO: 195984

SEQ ID NO: 247036 - RNA, 64 nt, Human; identical to SEQ ID NO: 195985

SEQ ID NO: 247037 - RNA, 64 nt, Human; identical to SEQ ID NO: 195989

SEQ ID NO: 247038 - RNA, 64 nt, Human; identical to SEQ ID NO: 195990

SEQ ID NO: 247039 - RNA, 64 nt, Human; identical to SEQ ID NO: 195991

SEQ ID NO: 247040 - RNA, 64 nt, Human
guaccccguaggaauuuccaguuucccuugaucuagaugggauucuuauaaaaauucaaccuca

SEQ ID NO: 247041 - RNA, 64 nt, Human
ugcaugagacucaacaucaggauccacagcuuaaagaugggaauucagguaugaaagaaaacag

SEQ ID NO: 247042 - RNA, 64 nt, Human
aauccaaagaccaccuagggcggggcugggugggagaugggagggccaacugcgagcugcucca

SEQ ID NO: 247043 - RNA, 64 nt, Human
gcugggauuacaggugugccaccgcgcccggccaagaugggaguauuuuuauggccauuuuaca

SEQ ID NO: 247044 - RNA, 64 nt, Human
ggccaagaugggaguauuuuuauggccauuuuacagaugggagaacagucucagcacaauugag

SEQ ID NO: 247045 - RNA, 64 nt, Human
gugguccugaacuggggccggguggggaagagugagaugggauaacauagccccugcuuggagg

SEQ ID NO: 247046 - RNA, 64 nt, Human
gaacucuuguccccccaggcuccccaccucugcaagaugggauacacucuucaggaccacaguu

SEQ ID NO: 247047 - RNA, 64 nt, Human
ugcaagccagguucaacccuugccucaagaaaucagaugggaccaauuuaguguccuuccaccu

SEQ ID NO: 247048 - RNA, 64 nt, Human
cugaggggagaggggugggucuccugagccacucagaugggaaagucccuuacucggccccucc

SEQ ID NO: 247049 - RNA, 64 nt, Human
uuuucuuaauagauucuggauuccacucacagggagaugggauuccuuucuuguccaaacaaag

SEQ ID NO: 247050 - RNA, 64 nt, Human
gacaaaagcugguuagguuuggguuugauacuuuagaugggaaagugaggggcuugagaaagug

SEQ ID NO: 247051 - RNA, 64 nt, Human
cauggaacagcaaauagggcccagugaugccagaagaugggagggaggagccaaccuugcugcc

SEQ ID NO: 247052 - RNA, 64 nt, Human
gagagcuucuuuuuguuucuaccuggccaaaguuagaugggacaaagaugaauggcaugucccu

SEQ ID NO: 247053 - RNA, 64 nt, Human
uagauagagauggugucaaggaggugcaggauggagaugggagauuucauggagccuggucagc

SEQ ID NO: 247054 - RNA, 64 nt, Human
agagacuugcauaaaagcagagguuugggggcucagaugggacaagaagccgccucuggacuau

SEQ ID NO: 247055 - RNA, 64 nt, Human
ggcaacccaggaaacaugauguuuuaagcugcuaagaugggaugugccgauccuugucaaaaug

SEQ ID NO: 247056 - RNA, 64 nt, Human
cugcgcuugcuuuucuguauuuuauuuagacaagagaugggaaugaggugggagguggaagaag

SEQ ID NO: 247057 - RNA, 64 nt, Human
agggccccaccucagaucaaagcagcucuggaugagaugggaccugcagcucucccuccacaag

SEQ ID NO: 247058 - RNA, 64 nt, Human
auaguuugacgugcagcaugcacaccaggccuuaagaugggaauguagcuuaaugauuuucugu

SEQ ID NO: 247059 - RNA, 64 nt, Human
uucagaaauuaugguuucuaccuuuuuaaaaaguagaugggauugugucaaucuugguuaauga

SEQ ID NO: 247060 - RNA, 64 nt, Human
agggugugcucccacgagacuuucagcauccaguagaugggaccucgaggcucgagcugaagca

SEQ ID NO: 247061 - RNA, 64 nt, Human
uccugucaauauguuuauuuccucugucuacagcagaugggagucuucucuuuuagacaggggc

SEQ ID NO: 247062 - RNA, 64 nt, Human
uaggcuacccaccacuggguagggauuucuguaaagaugggaaaggcugauagauugaaauaag

SEQ ID NO: 247063 - RNA, 64 nt, Human
gccacaugggaagugaaagcugagaagggaaggcagaugggagaagccaaugggaacuucucag

SEQ ID NO: 247064 - RNA, 64 nt, Human
gcagccuuuggggccuaugacacuuagugcccuuagaugggauacaucuugccucggccccaag

SEQ ID NO: 247065 - RNA, 64 nt, Human
aguuagcaaauugagucuuuuaggacagauucucagaugggaugaucuggaggaggaggaaaaa

SEQ ID NO: 247066 - RNA, 64 nt, Human
gcacuuauucucaagaagaacaucuuuaugguaaagaugggagcccaguuucacugccauauac

SEQ ID NO: 247067 - RNA, 64 nt, Human
agccuugcuucucacuggcaguguugagcuuuggagaugggaugguugcuaugccaagccuugu

SEQ ID NO: 247068 - RNA, 64 nt, Human
ugccucagccuccugaguaguugggauuaccaguagaugggacuacaggcaccugccaacacgc

SEQ ID NO: 247069 - RNA, 64 nt, Human
uugucuuucuucauagcuucucugcuuggcaaagagaugggagggggccagauacugacuaccu

SEQ ID NO: 247070 - RNA, 64 nt, Human
uuaacgcaaagaccaugcacaucaucagagacugagaugggagaggccugagacggagaggugc

SEQ ID NO: 247071 - RNA, 64 nt, Human
acagaaggugugaacugaccucuaaagcagcgugagaugggaaugaucuagaaaacuuuggauu

SEQ ID NO: 247072 - RNA, 64 nt, Human
caccacgcucggcuaauuuuuguauuuuuaguagagaugggauuucaccauguuggccaggcug

SEQ ID NO: 247073 - RNA, 64 nt, Human
aaauagauauuuaguucaguggugcuuaugggggagaugggacuagaacuuaagugugagacuu

SEQ ID NO: 247074 - RNA, 64 nt, Human
cagaugcguugguccauaaaggauuguaucaaguagaugggacaacauucugcucugaacgaaa

SEQ ID NO: 247075 - RNA, 64 nt, Human
gccuguuucccaaucugcaaagugugaagggauuagaugggauggucucugaggcucuuugugg

SEQ ID NO: 247076 - RNA, 64 nt, Human
agaauggguuguucucuugggaagucaggguaucagaugggauggacauccaggucuucucucu

SEQ ID NO: 247077 - RNA, 64 nt, Human
gugggucucacccuuuaaggaugcugaggccuagagaugggaagugacuugcucaaggucacac

SEQ ID NO: 247078 - RNA, 64 nt, Human
gagaagcugcugggaucggaccagccacuguggcagaugggagccaagcuugaggacugcuggu

SEQ ID NO: 247079 - RNA, 64 nt, Human
gcaacuccaaagaaucugugaugccacugaaaugagaugggaaugauccagcucuuucagcauc

SEQ ID NO: 247080 - RNA, 64 nt, Human
ccaccagcugacggaaagcagccuucuguacaacagaugggagggugaagggggcagaaugaaa

SEQ ID NO: 247081 - RNA, 64 nt, Human
uccauugcgacauugugaaggcuuaaaugaguuuagaugggaaauagcguuguuaucgccuugg

SEQ ID NO: 247082 - RNA, 64 nt, Human
ggguucuuggaagcagcucuuaugcuacucauagagaugggauugacuuuauuuuuuuauagug

SEQ ID NO: 247083 - RNA, 64 nt, Human
uggucagaguucauauaaucugucuguucccuggagaugggaauagaggaugaugacaguuuau

SEQ ID NO: 247084 - RNA, 64 nt, Human
cuggacuugggguaagcagugggguugggaccucagaugggaaggguggugcuaagauccuccu

SEQ ID NO: 247085 - RNA, 64 nt, Human
gccgaguuagaagguggagaugaugauauugaagagaugggagaagaagauagugaggucauug

SEQ ID NO: 247086 - RNA, 64 nt, Human
gacaccaucuuaauuagaugcagggacagggaucagaugggacaauaucaaauuuacuuugugc

SEQ ID NO: 247087 - RNA, 64 nt, Human
acuuugacggugagaagucuccaccuggucuuccagaugggagucauauucccacaauaagcag

SEQ ID NO: 247088 - RNA, 64 nt, Human
uaucuaaucauuguuaaugugagaacauuucugaagaugggaaagacaaauuauguagcucaca

SEQ ID NO: 247089 - RNA, 64 nt, Human
gaugugggcuuguguuuugucacugugaagggggagaugggagaggagccuguuuugggguggg

SEQ ID NO: 247090 - RNA, 64 nt, Human
ucaguuuuaacacccagcccagugguucuuucauagaugggaaccuguuucuacaaacacuucc

SEQ ID NO: 247091 - RNA, 64 nt, Human
uuuuacaagaucuugcaugcuacucuuagauagaagaugggaaaaccaugguaauaaaauauga

SEQ ID NO: 247092 - RNA, 64 nt, Human
ccaaggcuaccuacugcaggagggccaacaggugagaugggaagaauggaaacagggaccgauu

SEQ ID NO: 247093 - RNA, 64 nt, Human
agucugcacugaccccagggcugggcugacaucaagaugggagcccagcccacgggcuuuauaa

SEQ ID NO: 247094 - RNA, 64 nt, Human
ggaaguccuaguuuuaaggaaaccacugaaauauagaugggaaauguggacuuuacaaguauau

SEQ ID NO: 247095 - RNA, 64 nt, Human
ugccaugcugagcuccaagggugcuaccaggggaagaugggaucuauagagucucugggcccug

SEQ ID NO: 247096 - RNA, 64 nt, Human
ugaccguggcuccagccaccccgggacauugcuaagaugggagggcuguucuuaaaucacucgu

SEQ ID NO: 247097 - RNA, 64 nt, Human
cacugucaugcaccuauuuuuagauugggcagggagaugggaggagucgugauuuuuacuuuga

SEQ ID NO: 247098 - RNA, 64 nt, Human
uuggguuauuuuguagcggugccaguauuucaguagaugggauuucagccaaguagguuccccu

SEQ ID NO: 247099 - RNA, 64 nt, Human
cucaugccuguaaucccagcacuuugggaggcugagaugggaggaucacuugaagccaggaguu

SEQ ID NO: 247100 - RNA, 64 nt, Human
ccacauaauugguguugauuggaaacuuuuucugagaugggacagaacugcuggguugucuuuu

SEQ ID NO: 247101 - RNA, 64 nt, Human
ggggggacauucagacgggcaguguuagaggaggagaugggagcggugacuacacacacacaca

SEQ ID NO: 247102 - RNA, 64 nt, Human
cuucaaggauaugauauguuaaugaauccaaagaagaugggagagagauuuaacuuuuuugccu

SEQ ID NO: 247103 - RNA, 64 nt, Human
aauauuuuuguuuauagaauugaagguucuuaucagaugggauacuggggacuauaaacaaugg

SEQ ID NO: 247104 - RNA, 64 nt, Human
agggguaaaagaaagaccgaguucauugaagcagagaugggagguggugaggcguccucaccuc

SEQ ID NO: 247105 - RNA, 64 nt, Human
agccuggccaggccgcaccccuugcugucucagcagaugggauauaggaagcuccugggcuuag

SEQ ID NO: 247106 - RNA, 64 nt, Human
gucacaaaucagcaggcacaagaacuguccaugaagaugggaaauagccuuaaggcugaugcag

SEQ ID NO: 247107 - RNA, 64 nt, Human
uuaaaauggcacuuuauaaaagggaauagagaagagaugggacuauuucuauauuuaaaugcug

SEQ ID NO: 247108 - RNA, 64 nt, Human
acgcagccgauggguugguguuugggaaauucugagaugggagugagaucugaucggauccugg

SEQ ID NO: 247109 - RNA, 64 nt, Human
aucauuagcccacauaccaguaacuuauacuuaaagaugggauggaguuauaaagugcuuuuau

SEQ ID NO: 247110 - RNA, 64 nt, Human
gaacuugguaccugcagaguggcugcaguuaaauagaugggaguuuaaauuugagaaucaaaca

SEQ ID NO: 247111 - RNA, 64 nt, Human
aaucuaaacugcaggcucggaaagccuuaagcaaagaugggaggauuuuuggagaauccaucau

SEQ ID NO: 247112 - RNA, 64 nt, Human
cagauguacaggauaaugguauaaaucaaaagagagaugggaugguaucuaaaaacucaaguau

SEQ ID NO: 247113 - RNA, 64 nt, Human
ugcuuuucucuccacaggugccuggaagggguccagaugggaaugcacacaaccuccgcuuuga

SEQ ID NO: 247114 - RNA, 64 nt, Human
ugagugccuguaaucacagcuacuugggaggcugagaugggagaaucacuugaacccgggaggc

SEQ ID NO: 247115 - RNA, 64 nt, Human
ucagucugucuccauccuuucaccccuucccuggagaugggagguggggaaugaauggaagcug

SEQ ID NO: 247116 - RNA, 64 nt, Human
cacagaggugaccucuguccugaggcuucucaacagaugggaaguggcuguggucucacuggau

SEQ ID NO: 247117 - RNA, 64 nt, Human
gagucugugccccuggaccuggggaguggauaucagaugggauaucuccuuccauuccccgguc

SEQ ID NO: 247118 - RNA, 64 nt, Human
uaaagucacagaaugacagaccugugauuugucaagaugggauuuggaagacaagugaaugcaa

SEQ ID NO: 247119 - RNA, 64 nt, Human
cccauuuaaaauaaaauacauucucauuaacuuuagaugggaaauaagguuguauguugaugga

SEQ ID NO: 247120 - RNA, 64 nt, Human
cuuuggacaacugacaauaugauuuuaaauuugaagaugggauguguacauguuggguauccua

SEQ ID NO: 247121 - RNA, 64 nt, Human
gcccuagaguucuuuucccugagaaaggagaaaaagaugggauugccacucacccacccacacu

SEQ ID NO: 247122 - RNA, 64 nt, Human
aauaaggaaaacagcucaguuugggaaguaucagagaugggauucaaacccagauccucugguc

SEQ ID NO: 247123 - RNA, 64 nt, Human
agagcauuuauuguguuuuggaacauuaauugugagaugggauuuuucaauuuuauuauuuuau

SEQ ID NO: 247124 - RNA, 64 nt, Human
cacacaccuguagucccagcuacuuaggaggcugagaugggaggauugaucgaucgcuugagcc

SEQ ID NO: 247125 - RNA, 64 nt, Human
uuucugaaaaccaaugcgacaaauaaaguuggggagaugggaaucuuugacaaacaaauuauuu

SEQ ID NO: 247126 - RNA, 64 nt, Human
ucuaaauccgauuuuuacuauaaaauuggaaaauagaugggaggggugucauucauuguucaaa

SEQ ID NO: 247127 - RNA, 64 nt, Human
ggaacagguuaagaaaacuauguaaauguaggaaagaugggaggaaauaaagcccuguucugga

SEQ ID NO: 247128 - RNA, 64 nt, Human
ucauuuuuuuucccuuuuaguuaagcaugacuuuagaugggaagccuguguaucguggagaaac

SEQ ID NO: 247129 - RNA, 64 nt, Human
guucaagugauucuccugccucagccuccugaguagaugggacuguaggcaccugccacuaugc

SEQ ID NO: 247130 - RNA, 64 nt, Human
uauggaguuuauaacucuaggaccaauuguagucagaugggacauuugcuuugcacucacuaau

SEQ ID NO: 247131 - RNA, 64 nt, Human
uugaaagauuugggauuuuuucccaccucaucauagaugggaacuuuuguuuucagugcaaaca

SEQ ID NO: 247132 - RNA, 64 nt, Human
acaggugguggagggccuuggcuucugcuaagugagaugggaaccacuggaggguuugaacaga

SEQ ID NO: 247133 - RNA, 64 nt, Human
agagccugccuggagcguuucuagcaagugagagagaugggagcuccucuccuggaggauugca

SEQ ID NO: 247134 - RNA, 64 nt, Human
agccugagugaccaaauuuuggucuggugggaacagaugggaaccagcucaauuggguguccac

SEQ ID NO: 247135 - RNA, 64 nt, Human
ccucaguggcugucguuuguuaacaucaucaggaagaugggaaaggucaggcagaauuuuucug

SEQ ID NO: 247136 - RNA, 64 nt, Human
uagaugcaggcugaaaagaaaaggaagugggcuaagaugggaaaaauauaaaaagauuuaaaau

SEQ ID NO: 247137 - RNA, 64 nt, Human
gcucaagccaucccccaaccuuggccucucgaguagaugggauuauaggcaugugccacggugc

SEQ ID NO: 247138 - RNA, 64 nt, Human
aauaauagagagcuauggagucaaggcauguuuaagaugggagguagagcaugccaauauugau

SEQ ID NO: 247139 - RNA, 64 nt, Human
auugauggcaacagucaagauggugugaugagagagaugggaggggcacaaagaggaggacccc

SEQ ID NO: 247140 - RNA, 64 nt, Human
uaaaaucucagagguagggcugccaccaaggugaagaugggaacgcagaugauccaugaguuug

SEQ ID NO: 247141 - RNA, 64 nt, Human
cugguaaccugauggugauguggccagggugccgagaugggacagcaaagaugaugggcucugc

SEQ ID NO: 247142 - RNA, 64 nt, Human
auuuuugagccacuaucuauuguugaauauuuuaagaugggaugagggaggaacuaauaagggc

SEQ ID NO: 247143 - RNA, 64 nt, Human
caggauaccucaccgaagaagccacacugauccaagaugggagguuuuaaaaacucuacagugg

SEQ ID NO: 247144 - RNA, 64 nt, Human
ccuuugccccccagagacugacucucagagccagagaugggaugugugagugugugugugugug

SEQ ID NO: 247145 - RNA, 64 nt, Human
cugccagcaaccuugagaggaaggacaagaagaaagaugggauagaauuuaaauagagaagaau

SEQ ID NO: 247146 - RNA, 64 nt, Human
cuguagugauggaggaagggggucacuuauauaaagaugggacacuuuaauaaagacaggauau

SEQ ID NO: 247147 - RNA, 64 nt, Human
uuucuuaauaugauugggaucagggaaugggagaagaugggagcuaagaauguaaagucagaaa

SEQ ID NO: 247148 - RNA, 64 nt, Human
ucauccucccagaaucuaccaguuuaugguagaaagaugggaaccuuauuugaauguguuuuuu

SEQ ID NO: 247149 - RNA, 64 nt, Human
gguuuaugcaaauacagcaaacuuuuauuuaaguagaugggagaauauguuuaaaauauuagga

SEQ ID NO: 247150 - RNA, 64 nt, Human
cugaguuucuucuuuggaaaccaucacuauugagagaugggaaaaaccugaauguauaaagcau

SEQ ID NO: 247151 - RNA, 64 nt, Human
cacggaguggcuuugacagauugauaacuuuguaagaugggagacaucugaaauauucauguuu

SEQ ID NO: 247152 - RNA, 64 nt, Human
ggcuucuugccuucauaaggcacagagcagauggagaugggacaguggagccaguuugguuuuc

SEQ ID NO: 247153 - RNA, 64 nt, Human
cacaagauggaaggcaggugaggaugucaggaugagaugggaccagguagccgaggacagugag

SEQ ID NO: 247154 - RNA, 64 nt, Human
ggcucucccuccaggcugcugcugggcaugucauagaugggaugaaugaccaucugggguaugg

SEQ ID NO: 247155 - RNA, 64 nt, Human
uagcuuccuaaggggggagggaaccgaguuaucaagaugggaggauuuuucuuuucucucuguc

SEQ ID NO: 247156 - RNA, 64 nt, Human
uauaaaauuacauauucugaaagaggauuccgaaagaugggacugguugacucuucacaugaug

SEQ ID NO: 247157 - RNA, 64 nt, Human
aaaaagaaaggcuacgaugacugggcaagaagaaagaugggaaacugaauaaagcaguugauca

SEQ ID NO: 247158 - RNA, 64 nt, Human
cugccccucagagacugaaauuacggguaccugaagaugggagccuuuaccuuuuaugcaaaag

SEQ ID NO: 247159 - RNA, 64 nt, Human
gccacccuacaaguuguccucaaggucauccuggagaugggauccaggacguggggccaugacu

SEQ ID NO: 247160 - RNA, 64 nt, Human
cgaaggaaaagaguauaguagccugagaaucaggagaugggaguuuuagucguaggccuuauga

SEQ ID NO: 247161 - RNA, 64 nt, Human
uagagaagggaaaaguugcuggagcacggagugaagaugggaggagcuguuagcaaggcccacu

SEQ ID NO: 247162 - RNA, 64 nt, Human
aaaacauuuuaaguuuuacugauaauuugagguuagaugggaggaugaauugucacaucuaucc

SEQ ID NO: 247163 - RNA, 64 nt, Human
augccuguagucccagauacuugggagugggcugagaugggagaaucgcuugagcccaggaggu

SEQ ID NO: 247164 - RNA, 64 nt, Human
gcagcagugauggauuuauaguuccuccaaacaaagaugggaccccucccgagggaaguucaaa

SEQ ID NO: 247165 - RNA, 64 nt, Human
cagaacggauuucauuucuaauggagggggccagagaugggaaaauuucuuguucaguccgggg

SEQ ID NO: 247166 - RNA, 64 nt, Human
ccagaggcaauguaauaugcuguaaggcuagugcagaugggagcuuuuuagaaggggcuaagug

SEQ ID NO: 247167 - RNA, 64 nt, Human
cacaugccuguggccccagccacucugaacgcugagaugggaaggucacuugagcccaggaccc

SEQ ID NO: 247168 - RNA, 64 nt, Human
gguuaauuguuuuuuuuuaauuuaucuuuuguagagaugggaucucacuauguugcucaggcug

SEQ ID NO: 247169 - RNA, 64 nt, Human
cccgcuuuuugaugaggaagaagacaauuggauaagaugggacagcacuuauaaugaaauaaaa

SEQ ID NO: 247170 - RNA, 64 nt, Human
auaaaccaggcaauguaaguguucgagguguugaagaugggaaggauuugcagggcugagucua

SEQ ID NO: 247171 - RNA, 64 nt, Human
aguuauaucaaaagccugaaguggaaugaccaaaagaugggacuccuccuuuauuccagcaugg

SEQ ID NO: 247172 - RNA, 64 nt, Human
aguuauaucaaaagccugaaguggaaugacugaaagaugggacuccuccuuuauuucagcaugg

SEQ ID NO: 247173 - RNA, 64 nt, Human
guaauuaaaaguaauaugguggcuuuaaguguagagaugggauggcaaaugcugugaaugcaga

SEQ ID NO: 247174 - RNA, 64 nt, Human
uaucagccuuauuaccagagcaaauccuuccuucagaugggauaguuuacugacuaguuggagc

SEQ ID NO: 247175 - RNA, 64 nt, Human
uaaacgcuacucuggauuguuguaaauauuagugagaugggaggauuuacagaagaaaagcaag

SEQ ID NO: 247176 - RNA, 64 nt, Human
guucaagcgauucuccagccucagcuuccugaguagaugggauuacaggcgccugccaccacgc

SEQ ID NO: 247177 - RNA, 64 nt, Human
ggaguguucuguaucaacauuuggguugguauucagaugggaauucaaauaugaauccucucug

SEQ ID NO: 247178 - RNA, 64 nt, Human
uguuaagaccuccuauugaguuuuccagguccucagaugggaauugcacaguaggauguggaac

SEQ ID NO: 247179 - RNA, 64 nt, Human
aaagcugguggcacguuuuacauaagggaaugucagaugggagaugcuaguugccauuuuaaca

SEQ ID NO: 247180 - RNA, 64 nt, Human
uaaauacuugauuuuaaccaaugagacuacaggcagaugggacuaaguguuuaugggacaauua

SEQ ID NO: 247181 - RNA, 64 nt, Human
uccagcuucuuucugaagcaugacccaucuccagagaugggauuugagaaaucagugagagcuu

SEQ ID NO: 247182 - RNA, 64 nt, Human
caggaucaaggaauuaggguggucuacuugaggcagaugggauaguagcugggaacuguucccu

SEQ ID NO: 247183 - RNA, 64 nt, Human
guguuuuuaagcaucccuugggcuuuggauuuggagaugggaagagcaucuccaggcaaugagu

SEQ ID NO: 247184 - RNA, 64 nt, Human
ggagcagaagaaggagucccucacccuaggugugagaugggauucuggaagcuuccugaaggau

SEQ ID NO: 247185 - RNA, 64 nt, Human
ccucagucuuggaguccuguugggugaaugaggcagaugggaaagagccucaccagcagcugcu

SEQ ID NO: 247186 - RNA, 64 nt, Human
ccuuaccagagguagccucugcaaauggcauaccagaugggacucuaagaugcuuguguggugg

SEQ ID NO: 247187 - RNA, 64 nt, Human
uuuuacauuuuauagcugcgugcgaaaggcuuccagaugggagacccaucucucuugugcucca

SEQ ID NO: 247188 - RNA, 64 nt, Human
ucucgggaugugugaugaacucccaggagagggaagaugggagccagggcaagauaggaagcuc

SEQ ID NO: 247189 - RNA, 64 nt, Human
cucuaacuccuggccucaagccauccucccaaauagaugggacuacugaugcacacugccaugc

SEQ ID NO: 247190 - RNA, 64 nt, Human
caacacaaggcuccaagaccuaggcucauggacgagaugggaaggcacagggagaagggauaac

SEQ ID NO: 247191 - RNA, 64 nt, Human
aaaaaauuaaagauaacauuauaauguagaauacagaugggacauaguccuuguaagcuucccu

SEQ ID NO: 247192 - RNA, 64 nt, Human
ccaccacucacaguagccuugcugaagccaucacagaugggagaaggccaugccagccacgucc

SEQ ID NO: 247193 - RNA, 64 nt, Human
caauggaaauucccguguugcuucaaacugagacagaugggacuuaacaggcaaugggguccac

SEQ ID NO: 247194 - RNA, 64 nt, Human
gagugggcuccaagcacaaacugccauuggcuauagaugggacuguguccccccaaaauucaug

SEQ ID NO: 247195 - RNA, 64 nt, Human
guuaucagaggaagaggucccaaauuuggaguaaagaugggagaaaauaaauaugugcuauuuc

SEQ ID NO: 247196 - RNA, 64 nt, Human
agcccuuccuugccuacugucaguggcuuugccaagaugggaggaggccagugcccacuugccc

SEQ ID NO: 247197 - RNA, 64 nt, Human
gaaggccuggggaggaggagugaagucugugcauagaugggagagccuucugcucagaggcuca

SEQ ID NO: 247198 - RNA, 64 nt, Human
ccuuggcuguggagaagcacuccaggccgcuagcagaugggacuggcauuccagagggucaaga

SEQ ID NO: 247199 - RNA, 64 nt, Human
cacugugccaagcuaauuuuuuuauuuuuuguagagaugggauuucaccauguuacucaggcug

SEQ ID NO: 247200 - RNA, 64 nt, Human
ccaagagcucccacugcaagacaaguguuggggaagaugggagguugugggugaggccucuaaa

SEQ ID NO: 247201 - RNA, 64 nt, Human
ugccuacaucuggggcaagcagcacaccggcugcagaugggacagccagcccugccuaucugga

SEQ ID NO: 247202 - RNA, 64 nt, Human
aaguaaaaugcccugacugaauucucuugagacuagaugggacauacauauauagagagagagu

SEQ ID NO: 247203 - RNA, 64 nt, Human
cucacgccuguaauuccagugcuuugggaggccaagaugggaggaucauuugagcccaggaguu

SEQ ID NO: 247204 - RNA, 64 nt, Human
uauugaauugacuggauccacuaaaccaacacuaagaugggaaaacacacaugguuuggagcaa

SEQ ID NO: 247205 - RNA, 64 nt, Human
agcauccagguuccacuuuccuaggagagaguggagaugggaagacagggaaaggaaggcagca

SEQ ID NO: 247206 - RNA, 64 nt, Human
uuuacccucugagaaacaugaaucccacugggacagaugggaagaacacccuucuccgucuccc

SEQ ID NO: 247207 - RNA, 64 nt, Human
ccuauguaaugagcuagaaacuaaaguacaaacuagaugggacauccagucccuuugauagaua

SEQ ID NO: 247208 - RNA, 64 nt, Human
acagugaccagggccauggccggucccucuggggagaugggacacggcuccuggcagcacccag

SEQ ID NO: 247209 - RNA, 64 nt, Human
gagccccucccuuggucagacucugggacuccugagaugggagaggcagggaucagaggacgaa

SEQ ID NO: 247210 - RNA, 64 nt, Human
uuuugcucucauagaaauaacuuuuuaauuuaguagaugggaaaauugacuucguauuucccca

SEQ ID NO: 247211 - RNA, 64 nt, Human
uaagugccuguaguccuagcuacuugggaggcugagaugggaggaugucuugagcccgggaggu

SEQ ID NO: 247212 - RNA, 64 nt, Human
auaugcucuugucaaaacugcauuuguuguauaaagaugggaucgguguaguuaaaaacuugcg

SEQ ID NO: 247213 - RNA, 64 nt, Human
ucugcugaaggcagucauaucaaaggguaaagaaagaugggaggaaaacucaguaagaauuaua

SEQ ID NO: 247214 - RNA, 64 nt, Human
cgagcguuugagaagagggcauggcgcuggagugagaugggauuuggcgucucguuuuuggcua

SEQ ID NO: 247215 - RNA, 64 nt, Human
auguucauuuaaaaacaaucauuuuggagggcugagaugggaaauaaaaguaguuaaauaacau

SEQ ID NO: 247216 - RNA, 64 nt, Human
aggcccuugguguuacacgauggaucccaaagucagaugggaguacugcaaccugacacgaugc

SEQ ID NO: 247217 - RNA, 64 nt, Human
uugaagaugcucccuggcggcccccaagcagacuagaugggaggaggcgccgcucagccccuca

SEQ ID NO: 247218 - RNA, 64 nt, Human
uuaaacugagugcugggagugaguugguaauaugagaugggaaggaauguugacuugcuaacau

SEQ ID NO: 247219 - RNA, 64 nt, Human
cauucauaccaaagagaacucaugaauguaaugaagaugggaagauauuuaucaaauucaggcu

SEQ ID NO: 247220 - RNA, 64 nt, Human
cagaaaaaccuauuguucuaaaagugcacuuaagagaugggauuacaaguggacccugacuuuc

SEQ ID NO: 247221 - RNA, 64 nt, Human
cuugucaacgcacuuucuaaaucuagaucagcagagaugggagugauuuucuggaaagagaugu

SEQ ID NO: 247222 - RNA, 64 nt, Human
uuucaaaacugcccuaggccauugcagcauccuuagaugggacgcauaaucauuaccuuaaagc

SEQ ID NO: 247223 - RNA, 64 nt, Human
ggccauauuuuggaacacugaccuagacauguccagaugggagucccauuccuagcagacaagc

SEQ ID NO: 247224 - RNA, 64 nt, Human
gcucacuuggucugagcucagcugaaugcagggaagaugggacagagugacauuucuccucugu

SEQ ID NO: 247225 - RNA, 64 nt, Human
caucuugaaaacucguggaaagggaaaggggaggagaugggacuuugaccacacacagugaugc

SEQ ID NO: 247226 - RNA, 64 nt, Human
acuaguggggcuuaaugaaggucauaaguuucugagaugggagagcaacaaguagagaugaagu

SEQ ID NO: 247227 - RNA, 64 nt, Human
cuggagggagauguuuaagagggguuaacacaucagaugggagggucagcccggugaccucuaa

SEQ ID NO: 247228 - RNA, 64 nt, Human
ugugaguaggcauuaauuaugggugcggcuacuaagaugggaaaaacuaucacgacaguggcac

SEQ ID NO: 247229 - RNA, 64 nt, Human
cagcauggaagaugugugcucuggcucggauaagagaugggacaucauucagucacuaguugga

SEQ ID NO: 247230 - RNA, 64 nt, Human
cuacaagccagguggauucugguccuaacuaaagagaugggaguucaccugagggcaagaagua

SEQ ID NO: 247231 - RNA, 64 nt, Human
auaaccaaacauaagcuagcuagucuugucuaauagaugggauuuacuauaggugaagauagcc

SEQ ID NO: 247232 - RNA, 64 nt, Human
guucucugugcugggcaggcucucguggggcaggagaugggaggggagagaccagcucuccagc

SEQ ID NO: 247233 - RNA, 64 nt, Human
gcccugggcaguuugcccucucccaucuggacuuagaugggagggcauagcagaucuugaaggg

SEQ ID NO: 247234 - RNA, 64 nt, Human
acaagucucgggugagcguaaaugggucaugacaagaugggacagcaacaaaaucauggcuuag

SEQ ID NO: 247235 - RNA, 64 nt, Human
augauguauaaugcauccugaugggaaggcaugcagaugggauuuguuagaagacagaaggaaa

SEQ ID NO: 247236 - RNA, 64 nt, Human
aggcagucccaugggaggugggucuggccaauggagaugggacaggaaauuuuccaagacgcuu

SEQ ID NO: 247237 - RNA, 64 nt, Human
aauggucccaauuaagaaauuccauacuucucucagaugggaacaguaaagaaagcagaaucaa

SEQ ID NO: 247238 - RNA, 64 nt, Human
gcggcaggccagugaaggcguuuuccuagccuggagaugggaaaauaugcuuggcagagacagg

SEQ ID NO: 247239 - RNA, 64 nt, Human
guuaauucauccuguugaauugcaccaucgugaaagaugggaaaaaucgugaugauggguaagg

SEQ ID NO: 247240 - RNA, 64 nt, Human
acucugcaggcccuggaacauugggccugaguggagaugggagacagaggcaggccagaagguu

SEQ ID NO: 247241 - RNA, 64 nt, Human
accacgggaaagccgccgaccugugacucgcuugagaugggaaagcggcgccacagaccccggg

SEQ ID NO: 247242 - RNA, 64 nt, Human
gauuuuuuaagauagaaagauuaaaaagaaagaaagaugggaagaaaaugaaugucagucaagg

SEQ ID NO: 247243 - RNA, 64 nt, Human
aagaaaguuguacuuccuggcugggaguauuaggagaugggaguagagauucacuuuuaaguuc

SEQ ID NO: 247244 - RNA, 64 nt, Human
gccauucagaaaccauugagcaaaauaagucuauagaugggacugaaacuucuauuugugugaa

SEQ ID NO: 247245 - RNA, 64 nt, Human
uaaaaaauaaaaaaaagaggucacuaaaagaccaagaugggaaacguaacauggaauacaagcu

SEQ ID NO: 247246 - RNA, 64 nt, Human
aacaucuuuggaggaugggagagaacaggagggaagaugggaaacaaaauagagaauucuuaag

SEQ ID NO: 247247 - RNA, 64 nt, Human
ccauuccaucccccagaucccacugcugccaaagagaugggacaaggaaccucucucuagccuc

SEQ ID NO: 247248 - RNA, 64 nt, Human
uucaggacuuggucugauuucaggauacucugucagaugggaagacaugaaugcacacuagccu

SEQ ID NO: 247249 - RNA, 64 nt, Human
uaaaacauuuuaauaauuuuugaaaauuaauuaaagaugggaauaagugcaaaagaggauucuu

SEQ ID NO: 247250 - RNA, 64 nt, Human
guuugggggccacggagagaagggagagcucgugagaugggaagaaguuuccgcuggauucucc

SEQ ID NO: 247251 - RNA, 64 nt, Human
gcaauggcuuugugggaucauaugucuuggccaaagaugggaaaaccuauguugaagaggcagc

SEQ ID NO: 247252 - RNA, 64 nt, Human
ccuggcccuggcacuugucagggucagccuaaggagaugggaauaaagaggccagagagcacca

SEQ ID NO: 247253 - RNA, 64 nt, Human
gcucaugccuuaaucccagcacuuugggaggucaagaugggaggauugcuugagcccagaaguu

SEQ ID NO: 247254 - RNA, 64 nt, Human
gaguuuucaagaugucaacuucaggcugaucagcagaugggaugugaaaaauacuacccuauuc

SEQ ID NO: 247255 - RNA, 64 nt, Human
gccaaggcuugggaaccauuugcauccaggaguuagaugggaacaagugucacuccuggucacc

SEQ ID NO: 247256 - RNA, 64 nt, Human
cugggaucccaaauggacccuuuuaacuuucugaagaugggaccguccccuggaggaaagucau

SEQ ID NO: 247257 - RNA, 64 nt, Human
ucuguauuuuacaaguuaggaagcagaggaucagagaugggaaaggacuagcccaaggccaaca

SEQ ID NO: 247258 - RNA, 64 nt, Human
gcaauccaaccaaagccauuacauuuuuugaguuagaugggacucucuggauaguugaaccucu

SEQ ID NO: 247259 - RNA, 64 nt, Human
agggcugggccaccagggaucacagaccacaggaagaugggagguggaagcagaggcccugccc

SEQ ID NO: 247260 - RNA, 64 nt, Human
cgggcucugaguucuguacuggaauugaguguaaagaugggaagagaacugggcugacuccagg

SEQ ID NO: 247261 - RNA, 64 nt, Human
cccuaagucccagccucugcaauacacaguuaccagaugggaaugcagcacaguggcacagaga

SEQ ID NO: 247262 - RNA, 64 nt, Human
agaugguacaagaggcugguagaguaacuguccgagaugggaugccugagcucuugaagcugcc

SEQ ID NO: 247263 - RNA, 64 nt, Human
cuuagcaugcccuucacugcagugucaggccuuuagaugggacccagcgaaaauguggcccuuc

SEQ ID NO: 247264 - RNA, 64 nt, Human
uucccuuugcugcacccacagcgcuugccagccgagaugggagccuagcuaauaauccauaucc

SEQ ID NO: 247265 - RNA, 64 nt, Human
acaaaagcaaacugcauuuuuaaaaaucuuucugagaugggagaaaauguauucuccuuuccua

SEQ ID NO: 247266 - RNA, 64 nt, Human
ucauuaucauuaaaauaaauuuucacuguauuugagaugggaggguuaaggcucagggauuuua

SEQ ID NO: 247267 - RNA, 64 nt, Human
cggcccauguuucuauuugcauuucccccuccucagaugggaagccuggcaaagcugcccaacc

SEQ ID NO: 247268 - RNA, 64 nt, Human
augagcugaguggagccaggcuggcccagagcugagaugggagugcgguacaaucuggagccca

SEQ ID NO: 247269 - RNA, 64 nt, Human
caaugucaugucugugauugccuucuuacaacagagaugggagcugagugcuagaguaggugca

SEQ ID NO: 247270 - RNA, 64 nt, Human
guugagacaggauuugauaagucuaggaaaagaaagaugggaaaacgggauuccuuuucagaag

SEQ ID NO: 247271 - RNA, 64 nt, Human
ccuccacuugaaaccuuaugauuuucccaaggggagaugggacagugucaucuaaauauuccga

SEQ ID NO: 247272 - RNA, 64 nt, Human
ugcgugccuguagucccagcuacucgggaggcugagaugggagaaucacuugaaccugggaggc

SEQ ID NO: 247273 - RNA, 64 nt, Human
agagagaguguuuugguuacaucagaaauaauugagaugggaaagaauagugcagcuccauaga

SEQ ID NO: 247274 - RNA, 64 nt, Human
uauaaaauggcguggggggaagggggaaggauggagaugggaggagaggguaaaagaauaguac

SEQ ID NO: 247275 - RNA, 64 nt, Human
ggcugagccacaaggcccccgauggcccaggagcagaugggaggaccccgaggccagacgcaca

SEQ ID NO: 247276 - RNA, 64 nt, Human
gaaagcaggcaagacuuuuucucuguguuaggaaagaugggaaaugguuucuguaaccauuguu

SEQ ID NO: 247277 - RNA, 64 nt, Human
cucccuccuguagucccagcuacuugggaggcugagaugggaggaccauuugagccugggagau

SEQ ID NO: 247278 - RNA, 64 nt, Human
uuucuuugcagacaaggucuagaugcggagucagagaugggacugaauggggagggauccuuug

SEQ ID NO: 247279 - RNA, 64 nt, Human
caucucccauugcugcagaggcauaagacagaagagaugggaagugaaugcccgauguggugaa

SEQ ID NO: 247280 - RNA, 64 nt, Human
agcuggccugggccaggacggcagguggcccuggagaugggaaagugucugugucgaggcgcug

SEQ ID NO: 247281 - RNA, 64 nt, Human
aaugaaagggaaagugaaaaauuaaggggacaaaagaugggaugugaaaagaagaauucuaguu

SEQ ID NO: 247282 - RNA, 64 nt, Human
cuuaauaaaugccagggaaucugaccuggaaggcagaugggagggggcuggucuggcuguggcc

SEQ ID NO: 247283 - RNA, 64 nt, Human
uaaugaugagacagugaauuuuuuuuuuuuuucgagaugggaguuucacucuuauugcccaggc

SEQ ID NO: 247284 - RNA, 64 nt, Human
auucaaauguggcugugauuucugcauauaucauagaugggauccuucugagaauacuggaaua

SEQ ID NO: 247285 - RNA, 64 nt, Human
aauucuucuuccaauguggcccagggaagccaaaagaugggacaccccugcuguaaaguuucau

SEQ ID NO: 247286 - RNA, 64 nt, Human
ucaauagauggacaaaagaaacaacaaccccaggagaugggaccugaucaugcaaccuggcacu

SEQ ID NO: 247287 - RNA, 64 nt, Human
uugagagagagccaccaggaaggcgcaucuuagcagaugggaggaacugcugagagaagauggg

SEQ ID NO: 247288 - RNA, 64 nt, Human
guggcucuguccuaccuccacucucugccccuaaagaugggaggagaccagcgguccauggguc

SEQ ID NO: 247289 - RNA, 64 nt, Human
ccccggagacggagcuuccugagggcagggaggcagaugggacaggugggucugggggucaggu

SEQ ID NO: 247290 - RNA, 64 nt, Human
cccucacccagcacagcucugccuggacuuggagagaugggaggcagacccccaccaccauaca

SEQ ID NO: 247291 - RNA, 64 nt, Human
cugcagcugaggucgccggcgccuuuuucuuuuuagaugggaaggaggccaggaaagggucagc

SEQ ID NO: 247292 - RNA, 64 nt, Human
gcuaagucacccagagcacaggagcugccaugucagaugggaaaucugccuaugucauaccgug

SEQ ID NO: 247293 - RNA, 64 nt, Human
gccucucugcuguaagaccccagcuuuuccuggaagaugggacucugggguguguggugcucac

SEQ ID NO: 247294 - RNA, 64 nt, Human
gcggcagagaaagaagaaagaccuagaagguuguagaugggaaaucaggaaugauuugaacuga

SEQ ID NO: 247295 - RNA, 64 nt, Human
gccauggcucucugagccugaggauggaaaugggagaugggagcuguuuugucagugucuuggg

SEQ ID NO: 247296 - RNA, 64 nt, Human
cccucccaggccucugugggcccuugucgggcacagaugggaucacaguaaauuauuggauggu

SEQ ID NO: 247297 - RNA, 64 nt, Human
cauuaaguaauuauguuuggucuauuguaauuacagaugggaccacucaggggcaaaggucuga

SEQ ID NO: 247298 - RNA, 64 nt, Human
ggcuuuccuuguggcagaggaugucucaaacuucagaugggaggaaagagagcaggacucacag

SEQ ID NO: 247299 - RNA, 64 nt, Human
cugguagggaagggacgagucuaggcugagggcaagaugggaggucagaggugacagaagcguu

SEQ ID NO: 247300 - RNA, 64 nt, Human
acugggggucuuuuagcuccauaagcaagugagcagaugggacaaguuagucuuuucucccuag

SEQ ID NO: 247301 - RNA, 64 nt, Human
aaaccaccaacugcccuugguggcagguggguggagaugggaugcgugccaaccucagaugcca

SEQ ID NO: 247302 - RNA, 64 nt, Human
aucauuagcccacauaccaguaacuuauacuuaaagaugggauggaguuguaaagugcuuuuau

SEQ ID NO: 247303 - RNA, 64 nt, Human
ucacugaauuaaaugcuuauuguauugagaaccaagaugggaccugaggacacaaagaugagcu

SEQ ID NO: 247304 - RNA, 64 nt, Human
aaaguacucuguccauaaaagauuuguacuguuuagaugggagaaaccucuagagagaguaaaa

SEQ ID NO: 247305 - RNA, 64 nt, Human
uuucuuuucugugguugcagccugaccaaaagugagaugggaagggcuuaucuagccaaagagc

SEQ ID NO: 247306 - RNA, 64 nt, Human
uuuccuuuuuuuuuuuuuuuugccacauuggcagagaugggaccuaagggucccaccccucacc

SEQ ID NO: 247307 - RNA, 64 nt, Human
caccaugcccgacuaauuuuuguauuuugaguagagaugggaguuucaccauguuggccaggcu

SEQ ID NO: 247308 - RNA, 64 nt, Human
cgaaaagcacuuugaaaaauuguucccgagcgauagaugggaugguuuaugcaagucaugcuga

SEQ ID NO: 247309 - RNA, 64 nt, Human
uccccuucucagacucuuagcucuuaaaauucaaagaugggauauucuaacugguaguggugca

SEQ ID NO: 247310 - RNA, 64 nt, Human
gugucuaugggaaaugagugguuggaagcccagcagaugggagcaccuggacuuggggguaggg

SEQ ID NO: 247311 - RNA, 64 nt, Human
accagggaccaggagcauggugaagccaaguggcagaugggagccaaccuggauggggguuugg

SEQ ID NO: 247312 - RNA, 54 nt, Human
ccagaauggcacagaaguaggggaagaugggauaggacaggcugggaacaggua

SEQ ID NO: 247313 - RNA, 64 nt, Human
cucccuaucccauccccagccuccacccccauccagaugggacucacguggcuucaacagcuuu

SEQ ID NO: 247314 - RNA, 64 nt, Human
aaaauugaagauuggggugguggaggcaguagggagaugggauugggcaccucccccgugcugg

SEQ ID NO: 247315 - RNA, 64 nt, Human
aucuaaauugaauaaugguaccagauaaaauuauagaugggaaugaagcuuguguauccauuau

SEQ ID NO: 247316 - RNA, 64 nt, Human
ugccuguaaucccagccagcacuuugggaggcugagaugggaagaucacuugagcccagaauua

SEQ ID NO: 247317 - RNA, 64 nt, Human
ugaugcugaccuaugauaagguugaguauuuauuagaugggaagggaaauuuggggauuauuua

SEQ ID NO: 247318 - RNA, 64 nt, Human
cuguuaagccgaccaagaucccucccugcaagacagaugggaauguguauaauaacuagguauu

SEQ ID NO: 247319 - RNA, 64 nt, Human
aagcggaaaugccaguuccuccuguauuccauugagaugggauuucacauuuuccucucaucaa

SEQ ID NO: 247320 - RNA, 64 nt, Human
agcacaugauuuagugggugggccaugaaacuagagaugggauuugggggugaauuugucaaua

SEQ ID NO: 247321 - RNA, 64 nt, Human
ucagcucugacaaugaagaugaugaugaugaagaagaugggaauuaccuucaucccucucucuu

SEQ ID NO: 247322 - RNA, 64 nt, Human
ccacuaucuacuagaauuucucauauuuaaaccaagaugggagacuaggucauuaggaaaauau

SEQ ID NO: 247323 - RNA, 64 nt, Human
uuccaugguacgcgcgaauuguucuggaagucacagaugggaagacagaagcgccccugagugc

SEQ ID NO: 247324 - RNA, 64 nt, Human
ggcacaugccuacucccagcucccaaggagacugagaugggaggaucccuggagcccugaagau

SEQ ID NO: 247325 - RNA, 64 nt, Human
uuaaaugagcugcaagagagaaaaaucugacaggagaugggauuuuaccugaauggagcauacu

SEQ ID NO: 247326 - RNA, 64 nt, Human
cuacgcucacagcaacugcuuaccugcuccaagaagaugggaggaaggggagccccguccucca

SEQ ID NO: 247327 - RNA, 64 nt, Human
uaaugaaugaaacuaggggaauuucaggggacagagaugggauuuguuguaugauaaacuguau

SEQ ID NO: 247328 - RNA, 64 nt, Human
gcaucagaaaaugcagccuuaaacaguguccaggagaugggaugguaccuccuaggaguacaag

SEQ ID NO: 247329 - RNA, 64 nt, Human
gaugccccaaagcgauuuuuuuuaaccaaaaggaagaugggaagccaaacuccaucaugauggg

SEQ ID NO: 247330 - RNA, 64 nt, Human
aagguuuguagauacuuuuuuuguuccuguucauagaugggaagcuuccuuauaacugaugcag

SEQ ID NO: 247331 - RNA, 64 nt, Human
gguaggcaaguuugcuucuagggaguuagcauguagaugggauauugggaugaggaaaggaaaa

SEQ ID NO: 247332 - RNA, 64 nt, Human
auggugaccaggcucuggagaaggcaaggccugaagaugggagauuccuaaguggaggagaacu

SEQ ID NO: 247333 - RNA, 64 nt, Human
gcucuggagggcgccuaggagucggugucgccuaagaugggauaauggcuucaggcaacuccua

SEQ ID NO: 247334 - RNA, 64 nt, Human
cagcagcuagaauuuccaggggaaaguacuggagagaugggauccuucuagauacagggcucaa

SEQ ID NO: 247335 - RNA, 64 nt, Human
uauuuuaagggacauacuaguuuuagggauuuucagaugggaagcugcauuuuuaggauugccc

SEQ ID NO: 247336 - RNA, 64 nt, Human
acuguguaucuaauuauauuacauuacucuguucagaugggaugguuacuaccacuuguccaug

SEQ ID NO: 247337 - RNA, 64 nt, Human
cugcggccagcaccauuucacacacacuccuuguagaugggagccagaggaaaccugaacgugg

SEQ ID NO: 247338 - RNA, 64 nt, Human
aguuuaaucuagcuaaacacugguccugcuccugagaugggauccuauguguuuggaaaacgug

SEQ ID NO: 247339 - RNA, 64 nt, Human
cucgugcauguaauccuagcacuuugggaggcugagaugggaggaucacuugaggccaagaguu

SEQ ID NO: 247340 - RNA, 64 nt, Human
aaccagugccaaauucugaaugccagaugggaugagaugggauguuaaaccacuucuuauuacc

SEQ ID NO: 247341 - RNA, 64 nt, Human
auauuucaauaaccagugccaaauucugaaugccagaugggaugagaugggauguuaaaccacu

SEQ ID NO: 247342 - RNA, 64 nt, Human
aagggcuuggucuggauucccagaagcauagcuuagaugggaccacagugggcaauuuugaccu

SEQ ID NO: 247343 - RNA, 64 nt, Human
aagacugcuucuaaaguaauuuuuguaaguaaugagaugggaugguaaucuaguaauuugacuu

SEQ ID NO: 247344 - RNA, 64 nt, Human
acaaaguugcuagaugcucuuguugacuuccagcagaugggaugggggaaacacagcaguucuu

SEQ ID NO: 247345 - RNA, 64 nt, Human
ugaagaggccuggaaacgagagucuuaauugaggagaugggagacucgaacucuagcccuggau

SEQ ID NO: 247346 - RNA, 64 nt, Human
aauccugcacagccaaccuggaauaccaaagauuagaugggagauagauaccaaugauuuagau

SEQ ID NO: 247347 - RNA, 64 nt, Human
ggcccaaacccccagcaccccggaagcagaggugagaugggagcagcuugggagccccccauug

SEQ ID NO: 247348 - RNA, 64 nt, Human
uguaucuucaguauauauauuuuguuuguuuuagagaugggaucucaccauguugcccaggcua

SEQ ID NO: 247349 - RNA, 64 nt, Human
ugauuuaagaacaauuauuuaagaucgucucagaagaugggaucuucguuucaagaaaagggaa

SEQ ID NO: 247350 - RNA, 64 nt, Human
uuccaguuuuagccaggcauugguuaaaagaguuagaugggaugaugcucagacucaucugauc

SEQ ID NO: 247351 - RNA, 64 nt, Human
gguauuuccagugaauggaaacguugaaauuuauagaugggacaaugcacauacuucauaugua

SEQ ID NO: 247352 - RNA, 64 nt, Human
ugaagcugugacuaggcuggaguugcuuccuugaagaugggacuccuuggguaucaagaccuau

SEQ ID NO: 247353 - RNA, 64 nt, Human
guauccuucugcaggaagacccgccaaauagaagagaugggacaaaaauaggaaugguguguga

SEQ ID NO: 247354 - RNA, 64 nt, Human
ucauuccuugguucugaaacucuguggaggaggaagaugggagcugaugagaaucaaaguggaa

SEQ ID NO: 247355 - RNA, 64 nt, Human
ugaccucaccuugggaugucaccaaaggcagagcagaugggacugucaaaguugugcugcccuc

SEQ ID NO: 247356 - RNA, 64 nt, Human
cauuuuagaaaagccgaacaguagauagucuccaagaugggaaacaugucgugugucugcacgc

SEQ ID NO: 247357 - RNA, 64 nt, Human
gcaucaaggcuccuugguguggccacagcagaccagaugggaaauuauuuguguugaguggaaa

SEQ ID NO: 247358 - RNA, 64 nt, Human
uguguaccuguagucccagcuacucaggaggcaaagaugggaggauuacuugagcccaggaggu

SEQ ID NO: 247359 - RNA, 64 nt, Human
gugcuggggccaaaggagacacuagaaaagugguagaugggacagguaaguggcagaggugagg

SEQ ID NO: 247360 - RNA, 64 nt, Human
gaauggcuacugcugaguccuuugggguugagggagaugggagcuagggggaggggagggagau

SEQ ID NO: 247361 - RNA, 64 nt, Human
caaacaccacuuuguaaaaggacucuuccaucagagaugggaaaaccauuggggaggacuagga

SEQ ID NO: 247362 - RNA, 53 nt, Human
uggaggggaggugcuguuaggguagaugggaaauggggcuagggaggugaaag

SEQ ID NO: 247363 - RNA, 64 nt, Human
cuaucgaagaauaauggcuuguuccacuggccaaagaugggacaauuugaacaucaaaagagau

SEQ ID NO: 247364 - RNA, 64 nt, Human
uaacaugguccaggaucaucauucuucugacucuagaugggacacuugacagugacuugaaaca

SEQ ID NO: 247365 - RNA, 64 nt, Human
ggcuuugugccuuucaucuuuaacugggcaccugagaugggaaccaauggggaccaucccagac

SEQ ID NO: 247366 - RNA, 64 nt, Human
gugugaacaucauggagugcacuuauacaaaccuagaugggacaccuaugacccacccaggcca

SEQ ID NO: 247367 - RNA, 64 nt, Human
cuucauuuuaacagauggggaaagugagcccccaagaugggaaagaaccacacagcuaagggag

SEQ ID NO: 247368 - RNA, 64 nt, Human
guggcucacauuuccugccagcuacaccacaggcagaugggagucgggguggcacaaacaauag

SEQ ID NO: 247369 - RNA, 64 nt, Human
guauucauauuaaguguuuuauuuuccauauuagagaugggaagggaaccuuauguguauuuua

SEQ ID NO: 247370 - RNA, 64 nt, Human
agcggaucucccacuuugcauggcugucuuuuacagaugggaaaacugaggccugaugcuggag

SEQ ID NO: 247371 - RNA, 64 nt, Human
uacuagcucuguuaguuccagccugcuauaccucagaugggagagagccagagagaggagugag

SEQ ID NO: 247372 - RNA, 64 nt, Human
cuggcagggacuucuggguuaugggagaaaccagagaugggaaugaggaaaauaugaacuacag

SEQ ID NO: 247373 - RNA, 64 nt, Human
uguguucugggggguuuggggugggagggaaugcagaugggaguugggggaggggaggauacag

SEQ ID NO: 247374 - RNA, 64 nt, Human
acagggguggcgcacagcucugggaccacucagaagaugggauguguggguggaggaugccuug

SEQ ID NO: 247375 - RNA, 64 nt, Human
uccuuguccucaaaauacuuccagaagaacaaccagaugggaaggaccuugguugggacucuuu

SEQ ID NO: 247376 - RNA, 64 nt, Human
caaauguccucagguaguuuggagcaucucuaugagaugggauuaugcagauggccuauggaaa

SEQ ID NO: 247377 - RNA, 64 nt, Human
uggcacccgccuguaguccagcuacuugaggcugagaugggaggaugagggaggucggggcugc

SEQ ID NO: 247378 - RNA, 64 nt, Human
uccugcaggagucagcguucaaucuugaccuugaagaugggaaggauguucuuuuuacguacca

SEQ ID NO: 247379 - RNA, 64 nt, Human
agguggugggcaggagggaggagugagacuuaucagaugggacgcuugccccaagacuguggga

SEQ ID NO: 247380 - RNA, 64 nt, Human
cccauacuuguaaucccagcuauugggaaggaugagaugggaggauggcuugaggccagagguu

SEQ ID NO: 247381 - RNA, 64 nt, Human
guuaugaaaccgucuguggccucaugacagcgagagaugggaauacacuagaaggaucucuuuu

SEQ ID NO: 247382 - RNA, 64 nt, Human
cauauaguggaaaucugccaauacuaauugguggagaugggaacuguaaaagaucaaguaugcu

SEQ ID NO: 247383 - RNA, 64 nt, Human
acagccagcccuugccagcugacgucacagucuaagaugggaaacugugguacagauagacaug

SEQ ID NO: 247384 - RNA, 64 nt, Human
ggguuugguccuugaacaagaugugggccuugcaagaugggagaguaaaccuugaagggcuuua

SEQ ID NO: 247385 - RNA, 64 nt, Human
gcggggagacagcucucucucccaccuccuccccagaugggaggagagccugaggcccaagcag

SEQ ID NO: 247386 - RNA, 64 nt, Human
uuuaauguucacucacugcauuaaauaacaacaaagaugggacaaaacccacuaauacuguggg

SEQ ID NO: 247387 - RNA, 64 nt, Human
cucagcuguuuuuaaaugaaugugugugaggaacagaugggaaaguugggagaucugucuacag

SEQ ID NO: 247388 - RNA, 64 nt, Human
uucagcugcccuaagcugcaccagcgcuuugccaagaugggauggggaggggguaugagaacug

SEQ ID NO: 247389 - RNA, 64 nt, Human
aucaauauccauucacucuacgaguugugcagaaagaugggaacuccugugcuuggugcccaca

SEQ ID NO: 247390 - RNA, 64 nt, Human
agaggagacgaagaguuugggacagugggggaggagaugggaagggaugggauuucuggguccc

SEQ ID NO: 247391 - RNA, 64 nt, Human
agauggggcugguuccugcugcagugaggggaacagaugggacaauaaagacuggagacucagu

SEQ ID NO: 247392 - RNA, 64 nt, Human
cagccucauuuccccagcuucccugauuucuuccagaugggacguuuuauuugugugcucuccc

SEQ ID NO: 247393 - RNA, 64 nt, Human
gacaggaaggaaggaacacugggcagaaccagagagaugggacaugguagacuguggcccagac

SEQ ID NO: 247394 - RNA, 64 nt, Human
aaaccuuuaaaaaaaaaucugauuuaugcagcagagaugggacagccacuuuuucuuuuuaauu

SEQ ID NO: 247395 - RNA, 64 nt, Human
uuaagaauaccacuuuuuagaaaaauuacgauagagaugggaucucacuagguugcccaggcug

SEQ ID NO: 247396 - RNA, 64 nt, Human
ucccccccccaucaaguuuggugggcagagcuacagaugggacccaagggaguggccgagccuc

SEQ ID NO: 247397 - RNA, 64 nt, Human
caggcuaauuuuuauauuuuuagaauuuuagaagagaugggauuucaucauguuggccaggcug

SEQ ID NO: 247398 - RNA, 64 nt, Human
ucccguuuuggugccacacugggguggggaugggagaugggaugucuuugcauaucucucucau

SEQ ID NO: 247399 - RNA, 64 nt, Human
gacuuaaaugccuucuuauccaauauaucuucucagaugggaugacugcgggucaguguacagg

SEQ ID NO: 247400 - RNA, 64 nt, Human
ccccaccccuuccccacugccugcccacccguggagaugggaugcuugccuagggccuggucca

SEQ ID NO: 247401 - RNA, 64 nt, Human
ccuggcauccccaggggaauggcagcagugagguagaugggaggacauuucuggucagggaacu

SEQ ID NO: 247402 - RNA, 64 nt, Human
caaggcuuugcuuuuugaaauugcaacucaaaugagaugggaugaaauccuaugacaguaagca

SEQ ID NO: 247403 - RNA, 64 nt, Human
aagaccaaagccucagggaagauaagagauauggagaugggagggggaggacaaggggcagaga

SEQ ID NO: 247404 - RNA, 64 nt, Human
cuucagcugaguauaguucaacaguuuugcugacagaugggaacaaucuuuuuuuuuuuuuucc

SEQ ID NO: 247405 - RNA, 64 nt, Human
aagagaaaccguaaggugcuuccuuuaagugaaaagaugggaagaaaacagucauaugcugaau

SEQ ID NO: 247406 - RNA, 64 nt, Human
uuggcuuauaagggauagaacuugagacaguagcagaugggacaugguguuugauugugagaau

SEQ ID NO: 247407 - RNA, 64 nt, Human
agucagaacagguggacuuugcuuugaauauuuuagaugggacaaaaauuguucaucuucggaa

SEQ ID NO: 247408 - RNA, 64 nt, Human
gaucgggaguuagggagaaggguguauuugggcuagaugggagggugggagcagagucggguuu

SEQ ID NO: 247409 - RNA, 64 nt, Human
uccaggggaugccauccagccuguaggaaaccaaagaugggaaguggcuccuagggggcugacu

SEQ ID NO: 247410 - RNA, 64 nt, Human
gacuggugagcagacuggugggaucugugcccagagaugggacugggagggcccacuucagggu

SEQ ID NO: 247411 - RNA, 64 nt, Human
gcuucugccccuaggguuuccggagggagagccgagaugggaugggggagccuggggguccccc

SEQ ID NO: 247412 - RNA, 64 nt, Human
aacacugcacaugacaggauggguccucucauacagaugggaugggguuagaaagccagagcca

SEQ ID NO: 247413 - RNA, 64 nt, Human
gaccagcuguuggccucucuguuaacucagaaagagaugggagguugggggaggugagcauaaa

SEQ ID NO: 247414 - RNA, 64 nt, Human
accucugcccugugagcccauccauaaggcucucagaugggacauugugggaaaggcuuuggcc

SEQ ID NO: 247415 - RNA, 64 nt, Human
gccagaauauaagagcaaguguuaucuacuuuuuagaugggaauugcagaagcugcaucaaaag

SEQ ID NO: 247416 - RNA, 64 nt, Human
ucaucacuaguggcaaaugaccuuccaaguaagcagaugggaacugaauuguguuuucagguuu

SEQ ID NO: 247417 - RNA, 64 nt, Human
aagggagcagagagauaagaggacagaagaauggagaugggaaaauccaccaaauuccaaccca

SEQ ID NO: 247418 - RNA, 64 nt, Human
aggagauaaacaggguacuguacuggagaauaacagaugggaugcuucagguaggacaucaagg

SEQ ID NO: 247419 - RNA, 64 nt, Human
accuuguggaaucuguuuccuauauuugaauauuagaugggaaaauuagugucuagaaauacuc

SEQ ID NO: 247420 - RNA, 64 nt, Human
agugguagaugaaguuauaucauggggucaggggagaugggaaaauuuuaaguuuuugucuaac

SEQ ID NO: 247421 - RNA, 64 nt, Human
gcagccucggcagggcagguacaggggccaccucagaugggagccugggucccugccuccgcuc

SEQ ID NO: 247422 - RNA, 64 nt, Human
uuacuugcacuuguuauucgaaccacugagagcgagaugggaagcauagauaucuauauuuuua

SEQ ID NO: 247423 - RNA, 64 nt, Human
acgccgagggaguggagcuccugggugcguguccagaugggaaaggcagggucguaucuguggg

SEQ ID NO: 247424 - RNA, 64 nt, Human
cacagagaagaaagccauguggcggcagaggcagagaugggagugaugcggacggacacaaacu

SEQ ID NO: 247425 - RNA, 64 nt, Human
cuucuuacuguugagguucaacaagcugaggaguagaugggaauuugagggagaauacagagau

SEQ ID NO: 247426 - RNA, 64 nt, Human
agacgugggugaccauguuguuuguggggugcagagaugggagggguggggcccacccuggaag

SEQ ID NO: 247427 - RNA, 64 nt, Human
gaguaaucuucagguccuccguguucuggagcugagaugggaaugagccccuacacagaaugga

SEQ ID NO: 247428 - RNA, 64 nt, Human
gagagauugagacacucuaaauaaauaauaaccaagaugggaaauuucccugccagaccuuguu

SEQ ID NO: 247429 - RNA, 64 nt, Human
cucccuggacggcccucgcggucccugcagcccaagaugggacucagacccugugccccagagc

SEQ ID NO: 247430 - RNA, 64 nt, Human
aaaccaagagccggagguggcccccuuguccugcagaugggaaaacaggauggggagcuggcaa

SEQ ID NO: 247431 - RNA, 64 nt, Human
cugacaugugaggcaagcuaaggccuggagggucagaugggagaccaggucccaagggagcaag

SEQ ID NO: 247432 - RNA, 64 nt, Human
cuucccaggaguacaccccaacagcacccucuccagaugggagugcccccaacagcacccucuc

SEQ ID NO: 247433 - RNA, 64 nt, Human
cggauuagcgagccuguucuugauuaaaccaacuagaugggagcuuguuccucugcugcauugu

SEQ ID NO: 247434 - RNA, 64 nt, Human
uccccaccccaccucccucacuucacugcauuccagaugggacauguuccauagccuugcuggg

SEQ ID NO: 247435 - RNA, 64 nt, Human
gggcagcaggaggcaaggguuccuccaucugcccagaugggagaauagggggcuggacuggggc

SEQ ID NO: 247436 - RNA, 64 nt, Human
guucaagcgauucuccugucucagccuccugaguagaugggacuacaggcacaggccauuaugc

SEQ ID NO: 247437 - RNA, 64 nt, Human
uggagcucacgaguuugagaacagccuagccaacagaugggagcuacuuuucccagccuuuauu

SEQ ID NO: 247438 - RNA, 64 nt, Human
ucugcuggcucuccccugagaucuggacagaggaagaugggagggugcucaucacccccccagc

SEQ ID NO: 247439 - RNA, 64 nt, Human
aagaagauuaucugggacacugauacugacagggagaugggacauucugagggacccggaggca

SEQ ID NO: 247440 - RNA, 64 nt, Human
cuucccagggcugcaggcgggcggagguuccaggagaugggacuucagggagaccuggcuuggg

SEQ ID NO: 247441 - RNA, 64 nt, Human
gcagcuucuaacugguaaaaagauccagggauggagaugggaagguuagaaaggcagcccucac

SEQ ID NO: 247442 - RNA, 64 nt, Human
agaaaggguagaauucuggcugguagagcaggugagaugggacauuccaaagaacagccugagc

SEQ ID NO: 247443 - RNA, 64 nt, Human
gggcgagcuuucucuccgacuuccccugggcaagagaugggacaagcagucccuuaauauugag

SEQ ID NO: 247444 - RNA, 64 nt, Human
acgccaaccuuagaaucaugaacuguagucacagagaugggaaggcagccuccugccugcccug

SEQ ID NO: 247445 - RNA, 64 nt, Human
agggagcgauacuaaggcagacucagcuuuuuaaagaugggaggucaggagguggaagugagag

SEQ ID NO: 247446 - RNA, 64 nt, Human
cacuaccacgcccagcuaauguguguuuuuguagagaugggauuuugccauguugcccaggcug

SEQ ID NO: 247447 - RNA, 64 nt, Human
aagggacuguaacuccugucucaggaauggggauagaugggagguucuugaagccccaggcgaa

SEQ ID NO: 247448 - RNA, 64 nt, Human
ggauucagcuauucuggaagaucagcacccuaagagaugggacuaggaccugagccugguccug

SEQ ID NO: 247449 - RNA, 64 nt, Human
uucagggccccagcugccccccaggauggauaugagaugggagaggugagugggggaccuucac

SEQ ID NO: 247450 - RNA, 64 nt, Human
caccacacccggcuaauuuuuggauuuuuaguagagaugggauuucaccguauuagccaggaug

SEQ ID NO: 247451 - RNA, 64 nt, Human
gaguggaguucucuguucuagagugacaggcaccagaugggaugggcuuucucagugucagcac

SEQ ID NO: 247452 - RNA, 64 nt, Human
uggggaaccuuuggugugccaagaggagguggguagaugggaguggggcucggucccccaggcc

SEQ ID NO: 247453 - RNA, 64 nt, Human
cuggcacaggccaccacugcggugcugugccuucagaugggaggugggcgcgguggccuccucc

SEQ ID NO: 247454 - RNA, 64 nt, Human
cacagacuauucugaggcacagagcggggacuuaagaugggaaagagaaagcaucggagccauu

SEQ ID NO: 247455 - RNA, 64 nt, Human
ugcccugcauuucuaccaaguccugugaauaaagagaugggagauuugauuccgucagaagaga

SEQ ID NO: 247456 - RNA, 64 nt, Human
agcguuggauugugccggcuaagaccugccagggagaugggacccuugugccaccugggccagc

SEQ ID NO: 247457 - RNA, 64 nt, Human
ugggcuccuccagggugugugcucgcccugcgguagaugggagggaggcucaggucccuggggc

SEQ ID NO: 247458 - RNA, 64 nt, Human
ccaaagucaggcaucacuguuagucuuuugggacagaugggacagauguucacuuuaauguuuu

SEQ ID NO: 247459 - RNA, 64 nt, Human
gaguugcauuucucauuuuaaugagcauauggaaagaugggaacagaauuucagucuugcagcc

SEQ ID NO: 247460 - RNA, 64 nt, Human
uucaugccuguaauaccagcguuuugggaggcugagaugggaggauugcuugagcccaggaggu

SEQ ID NO: 247461 - RNA, 64 nt, Human
gacccucaagaaaaugacggagaacaucccagacagaugggacucaagcaggaugggugcuaua

SEQ ID NO: 247462 - RNA, 64 nt, Human
ccucucugguccucagcuuccuccaucauggaggagaugggaucauggauuuucugggcauaag

SEQ ID NO: 247463 - RNA, 64 nt, Human
gagcgcuccgaccagacagcgucucauuggccaaagaugggaggguuccgcuuaaagaccgccu

SEQ ID NO: 247464 - RNA, 64 nt, Human
aaaagaaagcaaaggaacagaaggaaggaaagaaagaugggaggaagugcagcaggaauagcac

SEQ ID NO: 247465 - RNA, 64 nt, Human
cauuuuaccauugcuguugggaggaagcagaggcagaugggaaagcagagagaggagcgcgcuu

SEQ ID NO: 247466 - RNA, 64 nt, Human
uaacuauuaaucuaguucaaugcccuuauuuuacagaugggaaaacugaggccuggagguagga

SEQ ID NO: 247467 - RNA, 64 nt, Human
cucuuuauuaagguauuacguugaguuugcaaccagaugggaaaaaucacaaaaaugagaaggg

SEQ ID NO: 247468 - RNA, 64 nt, Human
uguguuuuguaucgguauuugauuuuuagugggcagaugggagaaggaaagguuauuuauucua

SEQ ID NO: 247469 - RNA, 64 nt, Human
augaaugagaaguuugacuugguguauaaacagaagaugggaaagugugaccucacguuugacu

SEQ ID NO: 247470 - RNA, 64 nt, Human
ugggguggcaguuggcacagcgcagaugcgguagagaugggaggaaacccagcuccucacuucc

SEQ ID NO: 247471 - RNA, 64 nt, Human
aaguaggcuucagugcauaccaggguaucacuggagaugggaguuagugaaggggugacucccu

SEQ ID NO: 247472 - RNA, 64 nt, Human
cauccuccccaguuuaccacuuuguucuaauaggagaugggaacacgagaaguuugauggcuuu

SEQ ID NO: 247473 - RNA, 64 nt, Human
aacuguuaccaaaaaacaacugucaguuuuauugagaugggaaaaauguaaaccuauuuuuauu

SEQ ID NO: 247474 - RNA, 64 nt, Human
ggccacgugugagagagaagaaaaugguggccggagaugggagggcccaaggaaccuccuggga

SEQ ID NO: 247475 - RNA, 64 nt, Human
gauucaggaagguaggcaggacgugagagaagggagaugggagagagauuuaagacaaagggug

SEQ ID NO: 247476 - RNA, 64 nt, Human
uuuugcagauuacccagcuuuguucuuguuauaaagaugggagcaguguucuuuccagaugucu

SEQ ID NO: 247477 - RNA, 64 nt, Human
cauaggcucugcuugugggaucagcagaggcuuaagaugggauacauggccugugcagugaggg

SEQ ID NO: 247478 - RNA, 64 nt, Human
aaagcugccccaucuggggacgauauggggagggagaugggaggggaaaggggagaggguuuuu

SEQ ID NO: 247479 - RNA, 64 nt, Human
cccucucccucucucugggaccacuggguacaagagaugggaugcuccgacagcgucuccaauu

SEQ ID NO: 247480 - RNA, 64 nt, Human
gcugaaugcaagaaguggggcagcagcaguggagagaugggacaauuagauaaauguccauucu

SEQ ID NO: 247481 - RNA, 64 nt, Human
uacccucuggagauaaaauaaaaagaugaagcugagaugggacaggaucaaaguugaugaaaua

SEQ ID NO: 247482 - RNA, 64 nt, Human
acagguuacaguacauuuccucuguauguaaauuagaugggauaauagaauucauaacccauaa

SEQ ID NO: 247483 - RNA, 64 nt, Human
cucaugcuuguaaucucaccacuuugggaggccaagaugggaggagugcuugagguuaggcguu

SEQ ID NO: 247484 - RNA, 64 nt, Human
cucaugccuguaaucccagcacuuugggagacugagaugggaggaucgcuugagaccagccugg

SEQ ID NO: 247485 - RNA, 64 nt, Human
gaccgaauuuggcaagaaugaaauggugucauaaagaugggaggggaggguguuuugauaaaau

SEQ ID NO: 247486 - RNA, 64 nt, Human
cucuucuccucuguuucgugaaggcaggggacacagaugggagagauugagccaagucagccuu

SEQ ID NO: 247487 - RNA, 64 nt, Human
uggucaugggaagccagcacagcagaggcucccugaccgggaggccugccugcuuuucagguug

SEQ ID NO: 247488 - RNA, 64 nt, Human
cucugcaucuggcauuucugcucucuaugcuugagaccgggagguuuaggcucagauaagugag

SEQ ID NO: 247489 - RNA, 52 nt, Human
cugccuggggcaggagcugagugaccgggagaucccacugacccccguugac

SEQ ID NO: 247490 - RNA, 64 nt, Human
gugugugcuccugcaucuugucugggagugcagugaccgggaccagaaccuuccccaccucaau

SEQ ID NO: 247491 - RNA, 64 nt, Human
aauccccaucccacccccaggaggccggggcuacgaccgggaccacguggugcuaugggagccg

SEQ ID NO: 247492 - RNA, 64 nt, Human
aaauccacgaauucuucuggggucaggugccacugaccgggauccaguuccaguucccauggug

SEQ ID NO: 247493 - RNA, 64 nt, Human
cauuuuguuagcgucagcuaggccaauaggaacagaccgggaccuugucucacacugaugauac

SEQ ID NO: 247494 - RNA, 64 nt, Human
gaggagacgcccaugccccucaggggaaaguggagaccgggacaccagaggccgcgguguuugg

SEQ ID NO: 247495 - RNA, 64 nt, Human
gccccccguggcuggcaccgcgugccaugcauacgaccgggagguccaccugcguugugagcuc

SEQ ID NO: 247496 - RNA, 64 nt, Human
aaguaucacauaguuaaauuuuucagucagugaagaccgggagggaaugucagugaauuggcuu

SEQ ID NO: 247497 - RNA, 64 nt, Human
agcuacuuggcaggcuaacgcaggagaaucacuugaccgggagacagagguugcagugagcuga

SEQ ID NO: 247498 - RNA, 64 nt, Human
ccagcaugaugcagcgugaggacagcugagcagggaccgggacagcccucaccgcaugcgugug

SEQ ID NO: 247499 - RNA, 64 nt, Human
gaguuggaagguugcauaggguuuccucauuggagaccgggaaauucuauucuugggauaaaua

SEQ ID NO: 247500 - RNA, 64 nt, Human
ccaucuuggcaagguucagucugaauggcauggagaccgggagauagagggguuuuagauuuuu

SEQ ID NO: 247501 - RNA, 64 nt, Human
gggggcuccaggguugcagaguaugagugacacagaccgggacuauuccauuagccuguggucu

SEQ ID NO: 247502 - RNA, 64 nt, Human
ucaggcacaugaagguggagugugaccuugaugugaccgggaucccacucugauugcauccauu

SEQ ID NO: 247503 - RNA, 64 nt, Human
gcgugacaguuaccggcuggagagccggaggugggaccgggagcaggggaccguagaaccgggc

SEQ ID NO: 247504 - RNA, 64 nt, Human
aagagaaacauccuucaaaggacaguguuguuuugaccgggagaucuagagagugcucagaauu

SEQ ID NO: 247505 - RNA, 64 nt, Human
guucucaugugcucauccucuugguuuccccaaagaccgggagggucacggauggggcgugcag

SEQ ID NO: 247506 - RNA, 64 nt, Human
ccucuuccccccucacccuagggugucccgagaugaccgggacgccuggccccugguggggggg

SEQ ID NO: 247507 - RNA, 64 nt, Human
cagagcugcuggagcagcaccaagagccagucuugaccgggaugaggcccacagacagguuguc

SEQ ID NO: 247508 - RNA, 64 nt, Human
uuccucaguggugaggggagcugccuacagguuggaccgggaggcaguggcuuggagaggcagc

SEQ ID NO: 247509 - RNA, 64 nt, Human
caagccugucugagacucacaggaaggaggagccgaccgggaauaaccuuccauacauuuuuuu

SEQ ID NO: 247510 - RNA, 64 nt, Human
ggcggcucagcagugcaaugggcugacagccuuggaccgggagucagaagccuggguucugguu

SEQ ID NO: 247511 - RNA, 64 nt, Human
acaacuccucaccaguucauccugaggcugggaggaccgggaugcuggauucuguuuuccgaag

SEQ ID NO: 247512 - RNA, 64 nt, Human
ucccgcccacucacccaggagcuggcugggccaggaccgggagagggagcacugcugcccuccu

SEQ ID NO: 247513 - RNA, 64 nt, Human
agguuugagucccuccaaagggcaguggguggaggaccgggagcuuugggugaccagccacuca

SEQ ID NO: 247514 - RNA, 64 nt, Human
uccuaaagaccaaaauauucuacccauaugucaggaccgggauuuucuacccagagaccugcau

SEQ ID NO: 247515 - RNA, 64 nt, Human
ugccuuccagccugaggcucccgcagcccacccugaccgggacugguaagcagggccucgcccc

SEQ ID NO: 247516 - RNA, 64 nt, Human
gcaccgagaggguguguggcuccggggcccuggggaccgggacagccgcuccagcuucugcacu

SEQ ID NO: 247517 - RNA, 64 nt, Human
gagguggcagcagccccgagggacgcccccagaggaccgggaggcaccccacccuccccaccag

SEQ ID NO: 247518 - RNA, 51 nt, Human
gaaccccgucccgccucugaggaccgggagacagcccacaggccagaguug

SEQ ID NO: 247519 - RNA, 64 nt, Human
gugguggguggaggaaccccgucccgccucugaggaccgggagacagcccacaggccagaguug

SEQ ID NO: 247520 - RNA, 64 nt, Human
uuggucugucggaagcuguccucgugcuuuccuggaccgggagagucccgguccccucgggagg

SEQ ID NO: 247521 - RNA, 64 nt, Human
acaucccugucuguuggucuccauggccacuguggaccgggacccuugggggaagccugcccau

SEQ ID NO: 247522 - RNA, 64 nt, Human
cauaccagagccagaggucagugcugaagacguggaccgggagaaugaguacauaagcaggcug

SEQ ID NO: 247523 - RNA, 64 nt, Human
agaguccauguaacaguguagaugcagacucaccgaccgggaccucagacgcgagggaaaggag

SEQ ID NO: 247524 - RNA, 64 nt, Human
cccccaggcccccgcacaccucccucagcaccaagaccgggacccccccacccacgugucucau

SEQ ID NO: 247525 - RNA, 64 nt, Human
ccuucuugagucacugccuguguaguacauaccugaccgggaguccaaaccaccuuggugcucu

SEQ ID NO: 247526 - RNA, 64 nt, Human
cacagcucugcagaggauggagcuugcuccgggggaccgggacugucuguucucagggaccauc

SEQ ID NO: 247527 - RNA, 64 nt, Human
aaguggccacccauccaggcccuggccagugugggaccgggacgggaaggaagaaggaggcuag

SEQ ID NO: 247528 - RNA, 64 nt, Human
gaggcugggaagggcaaaguguggagagaggagugaccgggacuggagccagggucuggggaga

SEQ ID NO: 247529 - RNA, 64 nt, Human
gcagccguaagggaaaaggguguccagaacuagcgaccgggagagcuuuucuuuaacgauauca

SEQ ID NO: 247530 - RNA, 64 nt, Human
cucaggcagaggcgccugucccugcuucuuuucugaccgggaaauaaaugccccugaaggagcu

SEQ ID NO: 247531 - RNA, 64 nt, Human
gucaaugaaugccggggacagagaggggcagguugaccgggacuucaaagccgugaucgugaau

SEQ ID NO: 247532 - RNA, 64 nt, Human
gccaagauucaggcugcaggggaagaaagaacaugaccgggagguugugaccccaacccaaggu

SEQ ID NO: 247533 - RNA, 64 nt, Human
auccaggcccggccccuccccgcuuccgcacagggaccgggaccgggaccgugagcgggagcgc

SEQ ID NO: 247534 - RNA, 64 nt, Human
gcccggccccuccccgcuuccgcacagggaccgggaccgggaccgugagcgggagcgcagagag

SEQ ID NO: 247535 - RNA, 64 nt, Human
gcggaggcgcuccagggagcggagcaaggacaaggaccgggaccggaagcggcgaagcagccgg

SEQ ID NO: 247536 - RNA, 64 nt, Human
cccugacgguccagaggaaaagggccgggaucgugaccgggagcgacggcggagccaccggagc

SEQ ID NO: 247537 - RNA, 64 nt, Human
gcggagccaccggagcgagcgcgagcggcgccgggaccgggaucgugaccgugaccgugaccgc

SEQ ID NO: 247538 - RNA, 64 nt, Human
gaagaguagccgugagggaggcggggaccagccagaccgggagcaaaccgucccuuguccccgu

SEQ ID NO: 247539 - RNA, 64 nt, Human
ccacggggccccuucaggggcugaacgcggcccggaccgggaacggaggcggccagcggcgccc

SEQ ID NO: 247540 - RNA, 64 nt, Human
auugucauuuguuuugagcagucugaauaaacgagaccgggaaagacaucccuggcaggcauca

SEQ ID NO: 247541 - RNA, 64 nt, Human
acugucacucuagcaucuuugaggacugcgacaggaccgggacagcaggccccuugacagcccc

SEQ ID NO: 247542 - RNA, 64 nt, Human
uccaaguugucaacuuaagcgucuguuuaccaaagaccgggaacaggggcccaaacauguccag

SEQ ID NO: 247543 - RNA, 64 nt, Human
acagcuuaggguuuggugcgggccacggggaggggaccgggaagcgcuggggcuuguuucuguu

SEQ ID NO: 247544 - RNA, 55 nt, Human
ggcuggcuggcaugaucuaggaagggaccgggagccugcguggccuggggcugcc

SEQ ID NO: 247545 - RNA, 64 nt, Human
caggccugaagaccacccucccgagaggaaccagcccgguaagagggcacacgcugaugcggcu

SEQ ID NO: 247546 - RNA, 64 nt, Human
gaaucaaaagcuugagcacaaacagauaccucagcccgguaagcugcagcucugcucaacugcg

SEQ ID NO: 247547 - RNA, 64 nt, Human
agggucaggucauguuugaaaccaugcuuggcuggaccgggacccauggcaagagcaccugggc

SEQ ID NO: 247548 - RNA, 64 nt, Human
aaucuaccugcaccccugacccacccaggaguuggaccgggaguugggaagccuaggucuuagu

SEQ ID NO: 247549 - RNA, 64 nt, Human
ugccuccuccacucuauaagcagucaucuugggagaccgggaggagaagguggugggcuagucc

SEQ ID NO: 247550 - RNA, 64 nt, Human
accccaucccgacccugucuccgccaccucgcagccccauuaaagcgcucucaucugggcuccg

SEQ ID NO: 247551 - RNA, 64 nt, Human
ggccugccuugaagccacugaagcugggauuccuccccauuagagucagccuucccccucccag

SEQ ID NO: 247552 - RNA, 64 nt, Human
gcacagucacugggcuugggaggcaaugcuccauccccauuauauuacaaauaaagaugcccua

SEQ ID NO: 247553 - RNA, 62 nt, Human
gagcuggggcccacguggcaucgauccucccugcccgcgaagugacaguuuacaaaauuauu

SEQ ID NO: 247554 - RNA, 62 nt, Human
ucagggcgcgcacagcccagcagcccgaggccgcccgcgacuagcccccaccguaguauuua

SEQ ID NO: 247555 - RNA, 62 nt, Human
uguggccaugacccugccucucccaggcaggggcccgcgauguggaacugcugccacugagg

SEQ ID NO: 247556 - RNA, 64 nt, Human
uggaaagacucaauagugagaauauagccucccaccccauuaacuucgcucccaugggagaugg

SEQ ID NO: 247557 - RNA, 64 nt, Human
gaaacugaaguguuagacacuaugugucccaccaccccauuacagagacauaugacaauguuca

SEQ ID NO: 247558 - RNA, 64 nt, Human
uaagaugaaagcaaaugauucagcucccuuauacccccauuaaauucacuuucaauuccacucu

SEQ ID NO: 247559 - RNA, 64 nt, Human
aguuuaauguaaaucugacaggagcauucugaagccccauuaggaaaaaauuuaaaugguuccu

SEQ ID NO: 247560 - RNA, 64 nt, Human
acuauagcaaaagaagaucguuccauauuguacgccccauuaaauuacaguguuucuuaaugaa

SEQ ID NO: 247561 - RNA, 64 nt, Human
ucacuucauuuccuguauuauaugugauguuuuuccccauuaaaauaccagagauaauggagau

SEQ ID NO: 247562 - RNA, 64 nt, Human
ggaucucagaauauauucguccacccccucggcaccccauuaccccgagucccaccgugugucc

SEQ ID NO: 247563 - RNA, 64 nt, Human
cuuccacaggauuugagaauaguuucaucucagcccccauuagagagaaguuggggugaauucu

SEQ ID NO: 247564 - RNA, 64 nt, Human
ccccgccccacgccugccagcaaagccucgcuaaccccauuacaacagcuccaggacaucucag

SEQ ID NO: 247565 - RNA, 64 nt, Human
uguuugaauuuuuccaaagcaaaacucacuuugaccccauuaagaggcaagccuggcacaucua

SEQ ID NO: 247566 - RNA, 64 nt, Human
gcaucccugagacagggagggaagaaugaacacuccccauuaacagauggaaaaacugaggcuu

SEQ ID NO: 247567 - RNA, 64 nt, Human
aagaaucaguugaguaaaauguguaauauuuauuccccauuaauaacugacuaggaaggacuaa

SEQ ID NO: 247568 - RNA, 64 nt, Human
agaacuguguauguacaagagaaauccugcauaaccccauuaggaguagauggugcccggccua

SEQ ID NO: 247569 - RNA, 64 nt, Human
cugagcugccugagccuggugcaaaaggauuggcccccauuauggugcuucugaauaaaucuug

SEQ ID NO: 247570 - RNA, 64 nt, Human
cucaguuccucaccaucaucaucuugucuaagacccccauuauaauauucaugcgcugcuuuuu

SEQ ID NO: 247571 - RNA, 62 nt, Human
gcgaggccaccccccuccauccugggggaagcgcccgcgaaaaccguggagagaagccgccg

SEQ ID NO: 247572 - RNA, 62 nt, Human
uaggaccaacagggucaccaagcagacagggagcccgcgagaaucauucaaaacauccccag

SEQ ID NO: 247573 - RNA, 62 nt, Human
cacgaggcugcuuccgcagggaacccuggccugcccgcgacuucgcaucagggaccgcaugc

SEQ ID NO: 247574 - RNA, 64 nt, Human
acguaugacuugaguacaaaaggauuguuuuaauccccauuauucuggaaagugcauccuaguc

SEQ ID NO: 247575 - RNA, 64 nt, Human
agaaaaaacaccaccaaaugacaagucacacccuccccauuaguauccuguuaggggaaaauag

SEQ ID NO: 247576 - RNA, 64 nt, Human
cuggaaaagcagcauagagaugcagacaccccagccccauuauuaaaucaaccugagccacaug

SEQ ID NO: 247577 - RNA, 64 nt, Human
gaccauacagagauguagaaagaacauaaauuguccccauuaccuuaagguaaucacugcuaac

SEQ ID NO: 247578 - RNA, 64 nt, Human
gcagggggcaaguuggucugugugaauuaugggaccccauuacuuuuccugagacuggucaccu

SEQ ID NO: 247579 - RNA, 64 nt, Human
ggcuagaauggggauuucagguuucuaugagccuccccauuaccccuaaaguagaacauuuuuu

SEQ ID NO: 247580 - RNA, 64 nt, Human
ggagaaacucccgguguguuucugacccuuucagccccauuaaagcuccugagcucuccgcugc

SEQ ID NO: 247581 - RNA, 64 nt, Human
agaagacuuccuuuucuaccaccacacuacugccccccauuaagguucuugugguuuacccauc

SEQ ID NO: 247582 - RNA, 64 nt, Human
augcauuguaauuaaaauuuaaguuuuucuuuucccccauuaguaaacauuuagugcuacauau

SEQ ID NO: 247583 - RNA, 64 nt, Human
gaaggcuaccccuugggaaggcuggugccccaugccccauuacaggcucacacccagucugauc

SEQ ID NO: 247584 - RNA, 64 nt, Human
gaacagacuaugucuggggaaagaacggauuaugccccauuaaauaacaaguuguguucaagag

SEQ ID NO: 247585 - RNA, 64 nt, Human
uugguucuggcauuuuguucccaccauccccuucccccauuaacuuccccccugcuugccaucc

SEQ ID NO: 247586 - RNA, 64 nt, Human
cccugcccucagccuguugccccugccucccaaaccccauuagucuagccuuguagcuguuacu

SEQ ID NO: 247587 - RNA, 64 nt, Human
acaucuguauuccagccugggcaauagagcaaguccccauuacuaaaaaacccaaaaggccaaa

SEQ ID NO: 247588 - RNA, 64 nt, Human
aucuuugucaagggcauaaauauaucauucauacccccauuaaauuuuguuagaaaaauuacca

SEQ ID NO: 247589 - RNA, 62 nt, Human
agaacaucuuccuucucuaccaucacuccuguggcggucaccaccaccaccucucccgcccu

SEQ ID NO: 247590 - RNA, 62 nt, Human
cucacgggccacgugggcaccguguaugcccuggcggucaucucgacgccagaccagaccaa

SEQ ID NO: 247591 - RNA, 62 nt, Human
uggccaagcaggguuugugaucaggccccuggggcggucaauaauuguggagaggagagaau

SEQ ID NO: 247592 - RNA, 64 nt, Human
aacagcuguggggaccuucccacucuugacagagccccauuaaggcaucuggguggguuuuaaa

SEQ ID NO: 247593 - RNA, 64 nt, Human
ccuggagaauaaaauauccucagcccugaugccuccccauuauguaacacccaaccgcucucac

SEQ ID NO: 247594 - RNA, 64 nt, Human
ugggcagguggccacagcaggacugaggacaggcccccauuauccuaggggugcgcucaccugc

SEQ ID NO: 247595 - RNA, 64 nt, Human
ucugcacccuuucaccaccucgaggagauuugcuccccauuagcgaaugaaauugaugcagucc

SEQ ID NO: 247596 - RNA, 64 nt, Human
auaguggcagguauuuauuccuucugaauauauaccccauuauaggaauaacuguuacuuauuu

SEQ ID NO: 247597 - RNA, 64 nt, Human
guuuuuaaaaaauccuuuacgucuuguguaauuaccccauuauuaaauucaaguccuugaaaau

SEQ ID NO: 247598 - RNA, 64 nt, Human
cacugagaaaugggugugggcacugacaguucucccccauuauuuggccaggaauugagcuugg

SEQ ID NO: 247599 - RNA, 64 nt, Human
ucaugaagagaaaauuaguagcauuucuuucucuccccauuauuuauugguuuuccucacuaau

SEQ ID NO: 247600 - RNA, 64 nt, Human
ugucucaauugcuggccuuuggcuaccuguacuuccccauuauggcagcccauucagucuugag

SEQ ID NO: 247601 - RNA, 64 nt, Human
aaaaaugaagaacuauaauuuauguagugaaauaccccauuagaagaggauuuuuugggggacu

SEQ ID NO: 247602 - RNA, 64 nt, Human
uauuaacuccauuccaggugacauggauaaagagccccauuauuuucacagugccagccucuac

SEQ ID NO: 247603 - RNA, 64 nt, Human
aggagcagcucuuaagaaacagaauacuaagggcccccauuacuguguggcccugggcauccuc

SEQ ID NO: 247604 - RNA, 64 nt, Human
aacuguuuucucugauuuguauuuagauuccuccccccauuauucacaaucauauuguauuucg

SEQ ID NO: 247605 - RNA, 64 nt, Human
ugguuuuauauuucggagggaaaggauuauuuggccccauuaagaauuaagaggcugggugcgg

SEQ ID NO: 247606 - RNA, 64 nt, Human
aaaaauuuacauuuaaaaaaaauguuguuucuauccccauuacaacuuguuuaauuuuaauuuu

SEQ ID NO: 247607 - RNA, 64 nt, Human
ggugacucacgccuauaaucccagcacuuugggaggccgagaugggugaaucaugaggucagga

SEQ ID NO: 247608 - RNA, 64 nt, Human
cagcgggccaggcaggcugggugggagggaggagggccgagacaggagcagcccacccagcaga

SEQ ID NO: 247609 - RNA, 64 nt, Human
gguaggaugcaccuguaaucccagcuacuuaggaggccgagacaggagaaucgcucgaacccag

SEQ ID NO: 247610 - RNA, 64 nt, Human
uuaacguaucacccaaagcauguaugugaucuuuccccauuaguaucuuuuucucaaaugccau

SEQ ID NO: 247611 - RNA, 64 nt, Human
uauaagaaccauaagugcugguauuuauucacuuccccauuacgauguaaaucuucugaacugc

SEQ ID NO: 247612 - RNA, 64 nt, Human
ugucaucagcaaagagaaaaagcacagguuagcuccccauuagauggaaaaguguagggacuga

SEQ ID NO: 247613 - RNA, 64 nt, Human
ugagggauggcaguuucacuuugcaucagcuuucccccauuaucucucagauccacuuaaggaa

SEQ ID NO: 247614 - RNA, 64 nt, Human
auuuguauguaaauguacagaaauaaaaacguugccccauuaacagauuuccucuggaaugucu

SEQ ID NO: 247615 - RNA, 64 nt, Human
ggaguacuugcuauaaagccaccugucaacaaacccccauuauguacagaauaggaccuaucca

SEQ ID NO: 247616 - RNA, 64 nt, Human
uucugacucuuaauauucacuuuggugcuacuacccccauuaccugagggaaacuggccagguc

SEQ ID NO: 247617 - RNA, 64 nt, Human
ugggcaugaagaagggagcacagcagcuacuagaccccauuagcaccucauuagcccacaagcc

SEQ ID NO: 247618 - RNA, 64 nt, Human
gccaucuucauccuucuuagaaagagaucuauuaccccauuaggggagacagagagagugaaug

SEQ ID NO: 247619 - RNA, 64 nt, Human
guucagccagcagccuccuaagcccaccuuccucccccauuagagaacacccauccuaggugcu

SEQ ID NO: 247620 - RNA, 64 nt, Human
uuaaggaucucugaaacauauuuauaguuuaauaccccauuaccagcauuuacuaugccacaga

SEQ ID NO: 247621 - RNA, 64 nt, Human
agagaggccuugucccagaggcugccccaccccuccccauuagcuuucaauuccguagccagcu

SEQ ID NO: 247622 - RNA, 64 nt, Human
ggugcuuugggaucuaagugugguuugugacuauccccauuauuuaagcauuugggggucucac

SEQ ID NO: 247623 - RNA, 64 nt, Human
ucuaaacuuaucuggugcauucuccccaccccacccccauuauauaagggcuauuuuagaugcu

SEQ ID NO: 247624 - RNA, 64 nt, Human
uaaucuauuaugcccgacaucuuuuaaucauucaccccauuacuucuugucaacaaaaaauaua

SEQ ID NO: 247625 - RNA, 64 nt, Human
aaucacuugaaccccggaggcggagguuguagugggccgagauugugccacugcgcuccagcgu

SEQ ID NO: 247626 - RNA, 64 nt, Human
aguggcucacaccuguaaucccaacauuuugggaggccgagaaggguggaucaugaggucagga

SEQ ID NO: 247627 - RNA, 64 nt, Human
uugccuagaaagggcuucccggugcugauggagaggccgagacccuucuguuggacaggcugcc

SEQ ID NO: 247628 - RNA, 64 nt, Human
cagacccuuuccccaccuuccuuaccuccucuucccccauuaaggcagcucauccaagcuugua

SEQ ID NO: 247629 - RNA, 64 nt, Human
guuuuuuuuuuuuauugucuucaaagaggaagggccccauuaaagggugaacuuguaauaaauu

SEQ ID NO: 247630 - RNA, 64 nt, Human
uacguaauuuaaacaaauuuagaagaaaaaaccaccccauuaaaaagugggcaaaggacaugaa

SEQ ID NO: 247631 - RNA, 64 nt, Human
gcccuugucucggagacgguguuuuccucccuugccccauuaucuuuucaccucccaggucuac

SEQ ID NO: 247632 - RNA, 64 nt, Human
agaucucucuaaaaauaaacagaugaaaaucuauccccauuaucgauacagaauuugugaacgu

SEQ ID NO: 247633 - RNA, 64 nt, Human
ucaccaguuaaugcacauucuucuucccuccuccccccauuaauauguauacugaaaaaugugc

SEQ ID NO: 247634 - RNA, 64 nt, Human
gcgucucccgccuccaggaucuccucucaccugcccccauuaaagcucugccacucaugcaggc

SEQ ID NO: 247635 - RNA, 64 nt, Human
gacuuaguggagauggaagcccauuaauuggguuccccauuaaaucguuuacauacaagaacac

SEQ ID NO: 247636 - RNA, 64 nt, Human
aaagggcaaguucauugugcuacccucccaauucccccauuauggaguaaccaguauuauucag

SEQ ID NO: 247637 - RNA, 64 nt, Human
gcuuauuuaagcuuggacaguuuucagagacaaaccccauuaagaauuacucuuuucacauggc

SEQ ID NO: 247638 - RNA, 64 nt, Human
uguccucaagauuuuuaguuuggcccaaguguggccccauuagcgacacccuccucuaccagca

SEQ ID NO: 247639 - RNA, 64 nt, Human
gggucuuucuaaguuaauacugugagcauugagcccccauuaaaacucuuuuuuacuucagaaa

SEQ ID NO: 247640 - RNA, 64 nt, Human
uauuuaagcaaauacuuaaguccaagcaaaucauccccauuaaaaagcuuuuccuguaggcuag

SEQ ID NO: 247641 - RNA, 64 nt, Human
accuucaaauaauuggcuuugcagauauuggauaccccauuaaaucugacagucucaaauuuuu

SEQ ID NO: 247642 - RNA, 64 nt, Human
uuuauauccauguaacauggguaaccucacuucaccccauuauuagauauuugaguuauaucua

SEQ ID NO: 247643 - RNA, 64 nt, Human
uccgcucugacgcagggccgaggugggcaguccaggccgagaggccggcggcccugaaggugag

SEQ ID NO: 247644 - RNA, 64 nt, Human
ggugucucacaccuguaaucccagcacuuugggaggccgagauggguggaucaugaggucagca

SEQ ID NO: 247645 - RNA, 64 nt, Human
ccaccaagaguacugacauuuagaguuguuuaaaggccgagaacuggaaacagccuuucccuca

SEQ ID NO: 247646 - RNA, 64 nt, Human
uggugauggaaaaacguucucagcuuuaagacacccccauuaggcagacacuggguucugugac

SEQ ID NO: 247647 - RNA, 64 nt, Human
acuuaggcuggagacagggaggccuuccacucugccccauuagcuuagaaaaucaagauucagu

SEQ ID NO: 247648 - RNA, 64 nt, Human
cgacucaaaauaagugcucuuggggguggcucuaccccauuaccucccccagccacaacuccug

SEQ ID NO: 247649 - RNA, 64 nt, Human
acagugaaaagacagaagaggcaauaccagcaguccccauuacagucuccaccuccccgucuuc

SEQ ID NO: 247650 - RNA, 64 nt, Human
uuaguggggcugagagaugugggggccccuccagccccauuauagugcaccugaagggguccac

SEQ ID NO: 247651 - RNA, 64 nt, Human
uaaggugaccacuggccucuaggaaaccuucuacccccauuaucuuaccucaacuguuuccucu

SEQ ID NO: 247652 - RNA, 64 nt, Human
cuucagugggccuugcccuuuguacagccuccacccccauuaaaacugcucuggacuugcuggc

SEQ ID NO: 247653 - RNA, 64 nt, Human
cuucaguguuuucuacaauacuccuccugccccgccccauuaaaacaguucuuuuguuaagaaa

SEQ ID NO: 247654 - RNA, 64 nt, Human
acuaacaugcagaaucuacccaauaccacacugcccccauuaauggaauuaaauugggaaaaac

SEQ ID NO: 247655 - RNA, 58 nt, Human
aguuuaaaaggggaaaauaaauguguuuccccauuauaccuccuucaccccagaauau

SEQ ID NO: 247656 - RNA, 64 nt, Human
cccgccugggcuccccuugcugcccuugccuguuccccauuagcacaggaguagcagcagcagg

SEQ ID NO: 247657 - RNA, 64 nt, Human
gcucuuggaaggagucaggcaaggauugugcuucccccauuauacaggugacaaaacugagucc

SEQ ID NO: 247658 - RNA, 64 nt, Human
ucuaggcccucugcuggugcuguggaggccaagaccccauuaagccuaaaggugauggguccuc

SEQ ID NO: 247659 - RNA, 64 nt, Human
aagagguguuuauuuuuuaacuaacagccucccaccccauuaagacucaccaggagaggucuga

SEQ ID NO: 247660 - RNA, 64 nt, Human
ucaggauagcagagucugaaaauaccuuggucucccccauuaugugagcccuuacuugagagcu

SEQ ID NO: 247661 - RNA, 64 nt, Human
ugugaccuuguggugggagagcagagguggacgcggccgagagcccuacagagaagcuggcugg

SEQ ID NO: 247662 - RNA, 64 nt, Human
gguggcucacgccuguaaucccagcacuuugggaggccgagacgggcggaucaccugaggucag

SEQ ID NO: 247663 - RNA, 64 nt, Human
gaccuugaggaggccucccacgaagggcgaagauggccgagaugauccuaaaaauaaccgaaga

SEQ ID NO: 247664 - RNA, 64 nt, Human
acagaguuggagaaaaaagaauagacucauuuuuccccauuauugguauguaggcauugguaca

SEQ ID NO: 247665 - RNA, 64 nt, Human
aaguaugggcagugauggcgcucugggggccacagugggcuaucuaggcccucccucaccugag

SEQ ID NO: 247666 - RNA, 64 nt, Human
guucccagcuaucuccccugcuccucugcugguggugggcuaauaaagcugacuuucugguuga

SEQ ID NO: 247667 - RNA, 64 nt, Human
gccacaguuggaacaguccccugggugucagaaggugggcuagggccuccugcaggguuguggg

SEQ ID NO: 247668 - RNA, 64 nt, Human
uggggaagauggagcaaaccuagcccccaagccggugggcuagaaaguacaagaaaaggcagca

SEQ ID NO: 247669 - RNA, 64 nt, Human
gauuaagaugccauaauagugcuguauuugcagugugggcuaagacaaaguauauuaauaagcu

SEQ ID NO: 247670 - RNA, 64 nt, Human
augccucaaaugucucaguguguuuggcucauacgugggcuauacuguauuauuuugguaugcu

SEQ ID NO: 247671 - RNA, 64 nt, Human
accugacauucuaagauaucaagacacuuaauaugugggcuauuagcugcuuauuuaaauguug

SEQ ID NO: 247672 - RNA, 64 nt, Human
cucugagagaaaaucaacauugcaccacguaggggugggcuaugggcuguauuuauugugaauc

SEQ ID NO: 247673 - RNA, 64 nt, Human
auacgccgccucgccugccacggcugccagcuucgugggcuacagcuacccugccgccgugccc

SEQ ID NO: 247674 - RNA, 64 nt, Human
uuggucggcagccuucugggcagaccuugaccucgugggcuagggaugacuaaaauauuuauuu

SEQ ID NO: 247675 - RNA, 64 nt, Human
ccggcuacguuucaugucaggcuugcuuugccuugugggcuacucagugcagaaccugcuguaa

SEQ ID NO: 247676 - RNA, 64 nt, Human
aauaaaaugaaggaaugucuucaaucauauuuuagugggcuauuuauaaauagucuugaaguca

SEQ ID NO: 247677 - RNA, 64 nt, Human
cuaccccugaagacugaggcccugcagcuaccaggugggcuagaagguaacuggaacaggccug

SEQ ID NO: 247678 - RNA, 64 nt, Human
ggccucagcuuucccuccggaaggcugggaggaggugggcuagaugaucuuuggagcuuaagga

SEQ ID NO: 247679 - RNA, 64 nt, Human
agcagucaucuugggagaccgggaggagaagguggugggcuaguccuguguccuccuccacuuc

SEQ ID NO: 247680 - RNA, 64 nt, Human
caacguccagggcccagaacccugaggagugagcggccgagacgcugcuccccaccccccaccu

SEQ ID NO: 247681 - RNA, 64 nt, Human
uucagugucugaucgauaaccuggagaaccagcuggccgagauccgcugcgaccuggagcgaca

SEQ ID NO: 247682 - RNA, 64 nt, Human
aaguuuucuaagcuuuugauaaugugaagcuccaggccgagaggaugcuguugagcacauugca

SEQ ID NO: 247683 - RNA, 64 nt, Human
aaauguuugguuuuuucucuuaaaaaaaauaacaccccauuaccaaaagaaaagguaagguggc

SEQ ID NO: 247684 - RNA, 64 nt, Human
ccucaguuuuuuccgucuaguccgccaccucauuccccauuaagucaugggcauauccccagug

SEQ ID NO: 247685 - RNA, 64 nt, Human
acauaccaucacuuggcaauuuuuuagaauaagaccccauuauuaucuauugcuauaaaccuag

SEQ ID NO: 247686 - RNA, 64 nt, Human
uaaugggcauuguguacaaauugcuucucaccauccccauuagaccuacgaauaaagcauccgg

SEQ ID NO: 247687 - RNA, 64 nt, Human
uauuuaggaaguaaaauuugcuucauggucaugaccccauuagucaguguuacagcuguguugg

SEQ ID NO: 247688 - RNA, 64 nt, Human
gcucuucuggucagccccacccugggggccauuuccccauuaacuacccccagcccgaggcagg

SEQ ID NO: 247689 - RNA, 64 nt, Human
auaugcugcucauccccaccugucuucaacagcuccccauuacccucaggacaaugucugaacu

SEQ ID NO: 247690 - RNA, 64 nt, Human
aauuaaacaagaaaaaaagugggaaaagggcaucccccauuagguuucaauacuuugcacuucu

SEQ ID NO: 247691 - RNA, 64 nt, Human
cgcuggggaaagcgggaagcgcucgcucccuuucccccauuagugcucucucugccuggauccc

SEQ ID NO: 247692 - RNA, 64 nt, Human
gggucccggcguccugagaguccagggcaccuccccccauuagcuguaagguuuccugucaggu

SEQ ID NO: 247693 - RNA, 64 nt, Human
cuuggucucuguuaaugacgucucucccucuaaaccccauuaaggacugggagaggcagagcaa

SEQ ID NO: 247694 - RNA, 64 nt, Human
aaaaaauuuauaacguguucaauauuuucuuuucccccauuaaucaguucauuagaaauauuuu

SEQ ID NO: 247695 - RNA, 64 nt, Human
aaagggaaccaaaucucauuaauuaauuguucucccccauuaccccacugaaugaauggccaua

SEQ ID NO: 247696 - RNA, 64 nt, Human
cuggccccuucccgacccccacccgccauucagaccccauuaagaagguuggcuuggccaggca

SEQ ID NO: 247697 - RNA, 64 nt, Human
ggacuuaauaccagccggauaccucuggcccccaccccauuacuguaccucuggagucacuacu

SEQ ID NO: 247698 - RNA, 64 nt, Human
gccucugagcccaggccuccugccacaaagacugggccgagagauggggcuggguaagcgggug

SEQ ID NO: 247699 - RNA, 64 nt, Human
guaccugcugaacguguauccagauggacugacaggccgagagcggauggacuacaugaaacgc

SEQ ID NO: 247700 - RNA, 64 nt, Human
cucugcccggcccuacugagauucccaaggagaaggccgagagggggcgcuccaggucuggagc

SEQ ID NO: 247701 - RNA, 64 nt, Human
guacgagggauguggagcacaaaagccucucaucccccauuaaccagggcaccaagcccacagg

SEQ ID NO: 247702 - RNA, 64 nt, Human
ccucagcaauuauuuuccuuuuuguuccccccaaccccauuaaaaaaauuuuuuuuugauuuuu

SEQ ID NO: 247703 - RNA, 64 nt, Human
guuuugucucagcuauuuuguagcagacucgugcccccauuagugugccucuuuggaaauuauc

SEQ ID NO: 247704 - RNA, 64 nt, Human
ugagcguaaaaggcccucuaaccuaugcagguuuccccauuaugcauauagaaaaugcuaguau

SEQ ID NO: 247705 - RNA, 64 nt, Human
caaccuguguuucuuuuuuuacugaggaguuaguccccauuaguucuuguaucacauuuucauu

SEQ ID NO: 247706 - RNA, 64 nt, Human
ucccugaccccagaccgcugccaagccuguucucccccauuacaacauggucucacucagggcc

SEQ ID NO: 247707 - RNA, 64 nt, Human
accagguucucaagacacgaguccccuuguuccuccccauuaaaggggguuugucagaagcaag

SEQ ID NO: 247708 - RNA, 64 nt, Human
ugaagugcgauuucugcuuuuguguaccccaccaccccauuaccacagcugccuuuguguguuu

SEQ ID NO: 247709 - RNA, 64 nt, Human
gagccccuagcucuucucuagccuggggccuuggccccauuaggagaaggagaaaugacuggaa

SEQ ID NO: 247710 - RNA, 64 nt, Human
ccacguuugaaguuagcaacugcuuaaaguuauaccccauuaaaauugcuuucucaaaaguuug

SEQ ID NO: 247711 - RNA, 64 nt, Human
gccgacacugcagcagaaucucuccgggugggagccccauuauucauucucccuuuauugauuc

SEQ ID NO: 247712 - RNA, 64 nt, Human
uuacugcugccacaaucagcaugguuguauagugccccauuaggccauuuacauacccagaguu

SEQ ID NO: 247713 - RNA, 64 nt, Human
agcuaaccuugguuuuaaaaauuagcauuagcacccccauuauauuaauuuucagggauaguaa

SEQ ID NO: 247714 - RNA, 64 nt, Human
cgaggcagcagugcccccaccguggccccccacgccccauuaacccccacacccccauuccgcg

SEQ ID NO: 247715 - RNA, 64 nt, Human
gagccaccucuggaugaacugcccccagcccccgccccauuaaagacccggaagccugacugug

SEQ ID NO: 247716 - RNA, 64 nt, Human
uaugauuuggcuacagaccaggcagggaaagagacccgguaauuggagggugagccucgggggg

SEQ ID NO: 247717 - RNA, 64 nt, Human
ccugcaucaacuguugcaaaucccguuucucucucccgguaaggggacaaauuauacuuuauuc

SEQ ID NO: 247718 - RNA, 64 nt, Human
cuuucuuuggauaggaucaguucuuaagagcagccccgguaacuggaggaaugggagccguuuu

SEQ ID NO: 247719 - RNA, 64 nt, Human
caggaauggggguagauccauguccuccacugucccccauuaguucuguccccuucacaaugag

SEQ ID NO: 247720 - RNA, 64 nt, Human
gaggaaauuguagcagcuuuucacguuucccaguccccauuagagggcuugagaccuuguaccu

SEQ ID NO: 247721 - RNA, 64 nt, Human
cugggggccuggguccuacccugucuggucaugaccccauuagguauggagagcugggaggagg

SEQ ID NO: 247722 - RNA, 64 nt, Human
gugauagcauuucagugacaucuucuuuggccccccccauuaggugcugugcccacuucuuuuu

SEQ ID NO: 247723 - RNA, 64 nt, Human
uccacuggggacagaggcaggggcaaguggcucuccccauuaccuucucaagaccucaguggga

SEQ ID NO: 247724 - RNA, 64 nt, Human
aagaacucaaacaaaucaacaaugagaaaaacaaccccauuaaaaacugggcaaaggccaugaa

SEQ ID NO: 247725 - RNA, 64 nt, Human
uuugguggccacuucacccccaacccugucucacccccauuaucccuccucaauuggaggcugg

SEQ ID NO: 247726 - RNA, 64 nt, Human
agcacaggacaccccccaccccaccccaccauguccccauuacaccagagggccaucgugacgu

SEQ ID NO: 247727 - RNA, 64 nt, Human
uuuuguaguuguguguguguguuuuugccuugguccccauuaugggaugcauuaggacuggccu

SEQ ID NO: 247728 - RNA, 64 nt, Human
gccagggcugggggugagaaggggagucauuacuccccauuaccuagggccccuccaaaagagu

SEQ ID NO: 247729 - RNA, 64 nt, Human
auucuugaaucacccaacccuggaucagaaaccuccccauuaacaaacacugccccuuaagucc

SEQ ID NO: 247730 - RNA, 64 nt, Human
gagaccccuguuagccagcccucgaucauugaggccccauuauuaacagauacucccauaauaa

SEQ ID NO: 247731 - RNA, 64 nt, Human
uauuuuauuuuugguuuguauuauuuuuauuuggccccauuauuuuaaauaggaaaaacaguau

SEQ ID NO: 247732 - RNA, 64 nt, Human
ugcugggauuacaaaugugagccaccacaucuggccccauuauuuuauuuuugguuuguauuau

SEQ ID NO: 247733 - RNA, 64 nt, Human
uuuaaggacacccgugccccaagcccaccuggggccccauuaaagauggagagaggacugcgga

SEQ ID NO: 247734 - RNA, 64 nt, Human
gaaccaaccaaugaaaacagucccaucgcucuuacccgguaaguaaacagucagaaaauuagca

SEQ ID NO: 247735 - RNA, 62 nt, Human
gaagaggauacuaaagagaggggaacgggaaugcccgcgacagaguccacauugccuguuuc

SEQ ID NO: 247736 - RNA, 62 nt, Human
auggauggauggauggaugagcgagaacccgcgcccgcgaacaaagagcgaaccaaagcgau

SEQ ID NO: 247737 - RNA, 64 nt, Human
ugaccucagaggccuaagcaacuggggccaucccccccauuagaggggcccccaaaacuugguu

SEQ ID NO: 247738 - RNA, 64 nt, Human
ucuggacgcgccuggccacuccgaaggcuuuucaccccauuauggccaaauaguauagggccac

SEQ ID NO: 247739 - RNA, 64 nt, Human
aagucauacuguguagaauuucuauuuucuuuuuccccauuaaaagaggaccaaacaauucuuu

SEQ ID NO: 247740 - RNA, 64 nt, Human
agggagccaugcugcugaauucugguuggcauuuccccauuauguaaaaugggguguuggguag

SEQ ID NO: 247741 - RNA, 64 nt, Human
aacuaagaaguccuuuaagaauuuauaauccguuccccauuaacuuaauuuagcuuuuccauca

SEQ ID NO: 247742 - RNA, 64 nt, Human
ggcugcuggcugaggguucugcuguccugugccaccccauuaaagugcaguucccuccgggcca

SEQ ID NO: 247743 - RNA, 64 nt, Human
caccuauaaaacagggaaauugaauaaccaucuaccccauuagucagcauuuucuugagauaca

SEQ ID NO: 247744 - RNA, 64 nt, Human
ugggggcaaaucaggacacaacagagggcagaggccccauuagcuuuaaaauguagccccaggu

SEQ ID NO: 247745 - RNA, 64 nt, Human
accuacccuaccuacuccuacccccaacccccuuccccauuaaugugaguaaugaauuagccug

SEQ ID NO: 247746 - RNA, 64 nt, Human
cagcacagcgaagacugcuaaaugcacugaccccccccauuagaaugugauuuuuguuccuuuu

SEQ ID NO: 247747 - RNA, 64 nt, Human
uaauauaaaaggaaaucccacagucuagauauagccccauuacuacaaaaugcuaaaauauuua

SEQ ID NO: 247748 - RNA, 64 nt, Human
ugcuucaggcuaagagcugccucgcucuuuguccccccauuaggauucuauuacauaugcaauu

SEQ ID NO: 247749 - RNA, 64 nt, Human
uuccacaaucguauuugaugaaagaaacuucaguccccauuauuaccugugucuuugccaagcu

SEQ ID NO: 247750 - RNA, 64 nt, Human
ccagccccaaacuaagauaucccucacacccagcccccauuaccuagggacaagagucuucccc

SEQ ID NO: 247751 - RNA, 55 nt, Human
agggcaaaagugucuguuaaaaaugccccauuaggccaggaucugcugacauaau

SEQ ID NO: 247752 - RNA, 64 nt, Human
cccguucgccucuuucuguuucugugugaacuuucccgguaauaucacucguuaaauagguuuu

SEQ ID NO: 247753 - RNA, 64 nt, Human
gaaccugagggcaaagaugguggcugugucucuccccgguaaugucacuguuuuuauuccuucc

SEQ ID NO: 247754 - RNA, 64 nt, Human
ucccuggaggcagcugaccaaugaugggcggugacccgguaaccgaggcggcaaggaggccagg

SEQ ID NO: 247755 - RNA, 64 nt, Human
ucucaggucccaggcuccuaugcaaguuuuuuuuccccauuauaucacacuuaucuagcaaggg

SEQ ID NO: 247756 - RNA, 64 nt, Human
uauuacuguacaugggacuaugcuuuucucaaagccccauuaacugcuuccuauaauuuugaua

SEQ ID NO: 247757 - RNA, 64 nt, Human
auuggaguuugggguauaaaacacuccucccugcccccauuaguauuuauauugaucuuucaga

SEQ ID NO: 247758 - RNA, 64 nt, Human
cugccauuagaccuucuuaucauccauacuaaagccccauuauuuagauugagcuugugcauaa

SEQ ID NO: 247759 - RNA, 64 nt, Human
guccaugaggcagcaaggccagugcugugccaagcccgguaaggccaagugccgaggcccagcc

SEQ ID NO: 247760 - RNA, 64 nt, Human
cucguugacaaaggguaaaacaugcucacucccacccgguaaucauuuuuuucuuuuuuuaaaa

SEQ ID NO: 247761 - RNA, 64 nt, Human
uaacggugucgaggugagccagggccagggggaccccgguaaaguuuaguugaggcuggggaag

SEQ ID NO: 247762 - RNA, 64 nt, Human
aacagaauaauucguaauuuaagaaagcccuuaucccgguaacaugaauguugaugaacaaaug

SEQ ID NO: 247763 - RNA, 64 nt, Human
cuucacccugaauuuagacuuugcucuguguucucccgguaacugucagacaaaaaguuuauug

SEQ ID NO: 247764 - RNA, 64 nt, Human
gcuggagucuggcaccccuuccccaaucccauagcccgguaaugacuggguccagagccucgug

SEQ ID NO: 247765 - RNA, 64 nt, Human
aacauauagaaaaauguauagaugcuuggacagacccgguaauggguggccauugguaaauguu

SEQ ID NO: 247766 - RNA, 64 nt, Human
caaagcugaaaaauggucugucauaaauuauuuccccgguaauuuuugaaaggaaaaauguaua

SEQ ID NO: 247767 - RNA, 64 nt, Human
cucugcagcucacccuuggcuuguuuuccgcaaacccgguaaacgcaagcccuuggggcagaug

SEQ ID NO: 247768 - RNA, 64 nt, Human
ugucagugucaccuugguuugcaaaacccauauccccgguaaaaugaggccggacagaggggcu

SEQ ID NO: 247769 - RNA, 64 nt, Human
cccgcacccagcaggggacaggcacucaggagggcccgguaaaggcugagaugaaguggacuga

SEQ ID NO: 247770 - RNA, 64 nt, Human
ggagcaaggaggggaugagcgguaccuugggagacccgguaaaagucuaaagaauugagaauuu

SEQ ID NO: 247771 - RNA, 64 nt, Human
aaagaagcccguauuucucagucaguccuagaaccccgguaaguaauuaacagagaauaaaaau

SEQ ID NO: 247772 - RNA, 64 nt, Human
caccaccaaccuauagcaggcaccaaagcaagugcccgguaaauaccaauaagaaauuaaggaa

SEQ ID NO: 247773 - RNA, 54 nt, Human; identical to SEQ ID NO: 189046

SEQ ID NO: 247774 - RNA, 64 nt, Human
cuaagaccgagaaauuuaaagaaucggacagauggacgcagagaaccagagggcaaugugggac

SEQ ID NO: 247775 - RNA, 64 nt, Human
cagugguuccuaucucagggauacuggacuuucugacgcagaugaacaauuaaggggaaaagcu

SEQ ID NO: 247776 - RNA, 64 nt, Human
gagcuucauaaagucuuugaagugacuucacagagacgcagacaugugcacuugaagaugcugc

SEQ ID NO: 247777 - RNA, 64 nt, Human
uccucucauacucccugagacucugagaacaguggacgcagagggaagagaugaucauuggaag

SEQ ID NO: 247778 - RNA, 64 nt, Human
ccugugagcgggagcucgcccugcgccugcagcagacgcagagcuugcauucucuccggagcau

SEQ ID NO: 247779 - RNA, 64 nt, Human
gccuuccgagcacacauaaaagcacaaagacagagacgcagagagagagagagagccacggaga

SEQ ID NO: 247780 - RNA, 64 nt, Human
accuucaggucgcgcaccuucgcugaaggaagaugacgcagagcuuuaucugaaaucagagggg

SEQ ID NO: 247781 - RNA, 64 nt, Human
gcucaagccacagcucccaggccccuggcucaaagacgcagacaaggccugagcagugcucucg

SEQ ID NO: 247782 - RNA, 64 nt, Human
gucucccacaggccugugaguugccucggcauaugacgcagaaccccaacuguuacaacuuagu

SEQ ID NO: 247783 - RNA, 64 nt, Human
uucauuuuuguauuuauuucauuuaaaaucaugugacgcagaauaguuuugcaauguguauaua

SEQ ID NO: 247784 - RNA, 64 nt, Human
auugagauguaauucagauuaggacacagugugugacgcagauaacugguuacucagcucccug

SEQ ID NO: 247785 - RNA, 64 nt, Human
uccaggacaugggcccgggcccgguguggggguagacgcagagggcagaggguagcccuuggua

SEQ ID NO: 247786 - RNA, 64 nt, Human
guggaagagugcaaggucugccaggucagauggagacgcagaaccugcuggugcaagcugggca

SEQ ID NO: 247787 - RNA, 64 nt, Human
acaacuccagucaugggaccaggaggagcucugggacgcagacacauuccuuggauguugauuu

SEQ ID NO: 247788 - RNA, 64 nt, Human
cugccaugcccucuuuguuuccuuaucucccucagacgcagaguuuuuaguuucucuagaaauu

SEQ ID NO: 247789 - RNA, 64 nt, Human
ccuaggccuuguugaaggcuucaucaggaaaugugacgcagagauugugcugcugugcuucaua

SEQ ID NO: 247790 - RNA, 64 nt, Human
agaaagaguauggagagaaaaagaggcacaccuggacgcagagcccugccagcgcccuccucug

SEQ ID NO: 247791 - RNA, 64 nt, Human
cccuguaugcucagaaaacauugauuugagcauagacgcagagacugaaaaaaaaauuuacuuu

SEQ ID NO: 247792 - RNA, 64 nt, Human
ggcccagcccuccuggggagacgugacucugguggacgcagagcacuuaguuacccuggacgcu

SEQ ID NO: 247793 - RNA, 64 nt, Human
uccaggaaccgugacguccaaggaaccaaacccagacgcagaacaauaaaauaaauuccguacu

SEQ ID NO: 247794 - RNA, 64 nt, Human
ugccccaaaugcagcuucauuuuccagauaccuugacgcagaauaaauuuuuucaucauuuagg

SEQ ID NO: 247795 - RNA, 64 nt, Human
cuguacuauuccacccuuuggacgccucauccaggacgcagaggacucuagguuuaacauuuug

SEQ ID NO: 247796 - RNA, 64 nt, Human
ugcugcaagugagcugggagugaccagaagaaaugacgcagaagugaaaugaacuuuuuauaag

SEQ ID NO: 247797 - RNA, 64 nt, Human
ucagaggcaguggugugggagcccugucugcaaggacgcagaauaagcagugagggcggcugca

SEQ ID NO: 247798 - RNA, 64 nt, Human
cgcugcagccagaggccgcacgcugcacugucgcgacgcagagaggcuucugugcaggcuggga

SEQ ID NO: 247799 - RNA, 64 nt, Human
ugcacuacaguuuuagcggggagggggauaggaagacgcagagcaaaugagcuccggagucccu

SEQ ID NO: 247800 - RNA, 64 nt, Human
cugaugucuaccagaagcccuguguguggauggugacgcagaggacgucucuaugccggugacu

SEQ ID NO: 247801 - RNA, 64 nt, Human
uuguuuuugauuuuuuuuuauuaugaaucuccuggacgcagaggugacagugggagcuggccug

SEQ ID NO: 247802 - RNA, 64 nt, Human
gcgugcugaagaguguggcugugaagcuggggaagacgcagaaggugaaggugcucacgggcac

SEQ ID NO: 247803 - RNA, 64 nt, Human
cccgggcugcacuggugugggcugcacaggcacagacgcagacggccccggccguguccugugg

SEQ ID NO: 247804 - RNA, 64 nt, Human
agguguuugcacugccgcuggcccaccugcugcagacgcagaaucagggcuauacccacuucug

SEQ ID NO: 247805 - RNA, 64 nt, Human
aaaagguauauaugcauauaucuauauauaauaugacgcagaaauaaaucuaugagaaaucuau

SEQ ID NO: 247806 - RNA, 64 nt, Human
agaaguguggccugaguugaauuucugggaggaugacgcagaugucugcugcagagcugggcug

SEQ ID NO: 247807 - RNA, 64 nt, Human
uuucuaggcuuuauaaaguccaauuucaaauucagacgcagaacucuucagauuucuacaaaaa

SEQ ID NO: 247808 - RNA, 64 nt, Human
cgccccgaagcagccuccugaaaccaaaacgcccgacgcagacgcggugggagacguggguguc

SEQ ID NO: 247809 - RNA, 64 nt, Human
ggagcuuugggccucagggcgccuagaaggcgaggacgcagaccugaaggcggccggugagcgg

SEQ ID NO: 247810 - RNA, 64 nt, Human
gcaguauuauaaguuaucauggaacuauaugguggacgcagaccuugagaacaaccuaaauuau

SEQ ID NO: 247811 - RNA, 64 nt, Human
aggcugaacucuucagaacacacagacuuucugugacgcagacagaggggauggggauagagga

SEQ ID NO: 247812 - RNA, 64 nt, Human
ccuugcuuggaaggggugacucugagcacagguagacgcagacgugugcagagaaugugcucuu

SEQ ID NO: 247813 - RNA, 64 nt, Human
acaacauuuuugucuauggugaacugcuguaaaugacgcagagaaaugccuaaaaaggacaggu

SEQ ID NO: 247814 - RNA, 64 nt, Human
cggcccggugaccgcgcggauucaggauugcggggacgcagaaagguuaaggcacuuuuaaaaa

SEQ ID NO: 247815 - RNA, 64 nt, Human
ugcagaugguucugaggaggaaacggacacucgagacgcagacuucaauggaaccaaggccagu

SEQ ID NO: 247816 - RNA, 51 nt, Human
gggacaggaguuaccacugaggacgcagaagugacuucugcuugaggacgu

SEQ ID NO: 247817 - RNA, 64 nt, Human
gugggaggauguggggaagggggaaagcggugaggacgcagagugcaggcuguggccucggcau

SEQ ID NO: 247818 - RNA, 64 nt, Human
gucuggagggccccgugguuccuggagaaagcaggacgcagagaagaacaaaugaggcucaccc

SEQ ID NO: 247819 - RNA, 58 nt, Human
ugccccuaacccaccucuaacccucauggacgcagaccucacgggacgggccucaucc

SEQ ID NO: 247820 - RNA, 64 nt, Human
gcuugucugggcgagauggacaggugaggucgaggacgcagagggcagaggcccaguggagccu

SEQ ID NO: 247821 - RNA, 64 nt, Human
agcaguuuuaauaacuuuaaaaguacuucagauagacgcagaaaauuggugagugguugaccaa

SEQ ID NO: 247822 - RNA, 64 nt, Human
guuugauuguauuacucuguuccacugguucuaagacgcagagcuucucacaucucaaucagga

SEQ ID NO: 247823 - RNA, 60 nt, Human
ccacucuggccauccacuagcccagggggggacgcagaccccacacuccauggagucugg

SEQ ID NO: 247824 - RNA, 64 nt, Human
acccucccccagccagauacggaauaaaacuacagacgcagacgucggaauaaauggugucguu

SEQ ID NO: 247825 - RNA, 64 nt, Human
acgcagacagucacaccacggggacacacggacagacgcagacggacacagcgacaugccccag

SEQ ID NO: 247826 - RNA, 64 nt, Human
guaggggcucaggccacccucccugccacguggagacgcagaggccgaacccaaacuggggcca

SEQ ID NO: 247827 - RNA, 64 nt, Human
uccaccucuggaggguccccagagacccacgcccgacgcagacccggaggagcaucagcaaggg

SEQ ID NO: 247828 - RNA, 64 nt, Human
ugccugggaagagggcgaggaggccagugguggggacgcagaggguccucagagcaggagugac

SEQ ID NO: 247829 - RNA, 64 nt, Human
ggagacaaugaccuggagggugggguauggcagagacgcagaagagaggaacagaaauccagag

SEQ ID NO: 247830 - RNA, 64 nt, Human
cuucauuagagcgaggcagcccuuggccgguggggacgcagagccccagcagguggugcacgac

SEQ ID NO: 247831 - RNA, 64 nt, Human
uggcaggagacacuggucucagaggagggauagagacgcagauuucagauguaagaagcccgau

SEQ ID NO: 247832 - RNA, 64 nt, Human
acaggagcccagacaaagcccaggccugucaagagacgcagagggccccugccaggguuggccc

SEQ ID NO: 247833 - RNA, 64 nt, Human
uccgagugcagcuggagggaucugagcgcaggaagacgcagaacaacagaaauagccgccccuc

SEQ ID NO: 247834 - RNA, 64 nt, Human
acggaaguaaaccugaacaaacccuuuaaauggggacgcagaugaguccucgguaaaccgagga

SEQ ID NO: 247835 - RNA, 64 nt, Human
cagcuaaaucaugacaccuucaauuugccaucaugacgcagaccuguauacauuagguuaaauc

SEQ ID NO: 247836 - RNA, 64 nt, Human
accaucucccagaaaccugaaagcaccugccaaugacgcagauaacccuggcccuacagccugc

SEQ ID NO: 247837 - RNA, 64 nt, Human
cagcuaaaucauggcaccuucaauuugccaucgugacgcagaccuguauaaauuagguuaaaga

SEQ ID NO: 247838 - RNA, 64 nt, Human
uguugggccuccugcugcaaaacaauaaacagaggacgcagagguccuccugccuggccacgca

SEQ ID NO: 247839 - RNA, 64 nt, Human; identical to SEQ ID NO: 91719

SEQ ID NO: 247840 - RNA, 64 nt, Human; identical to SEQ ID NO: 91720

SEQ ID NO: 247841 - RNA, 64 nt, Human; identical to SEQ ID NO: 91721

SEQ ID NO: 247842 - RNA, 64 nt, Human; identical to SEQ ID NO: 91722

SEQ ID NO: 247843 - RNA, 64 nt, Human; identical to SEQ ID NO: 91723

SEQ ID NO: 247844 - RNA, 64 nt, Human; identical to SEQ ID NO: 91724

SEQ ID NO: 247845 - RNA, 64 nt, Human; identical to SEQ ID NO: 91725

SEQ ID NO: 247846 - RNA, 64 nt, Human; identical to SEQ ID NO: 91726

SEQ ID NO: 247847 - RNA, 64 nt, Human; identical to SEQ ID NO: 91727

SEQ ID NO: 247848 - RNA, 64 nt, Human; identical to SEQ ID NO: 91728

SEQ ID NO: 247849 - RNA, 64 nt, Human; identical to SEQ ID NO: 91729

SEQ ID NO: 247850 - RNA, 64 nt, Human; identical to SEQ ID NO: 91730

SEQ ID NO: 247851 - RNA, 64 nt, Human; identical to SEQ ID NO: 91731

SEQ ID NO: 247852 - RNA, 64 nt, Human; identical to SEQ ID NO: 91732

SEQ ID NO: 247853 - RNA, 64 nt, Human; identical to SEQ ID NO: 91733

SEQ ID NO: 247854 - RNA, 64 nt, Human; identical to SEQ ID NO: 91734

SEQ ID NO: 247855 - RNA, 64 nt, Human; identical to SEQ ID NO: 91735

SEQ ID NO: 247856 - RNA, 64 nt, Human; identical to SEQ ID NO: 91736

SEQ ID NO: 247857 - RNA, 64 nt, Human; identical to SEQ ID NO: 91737

SEQ ID NO: 247858 - RNA, 64 nt, Human; identical to SEQ ID NO: 91738

SEQ ID NO: 247859 - RNA, 64 nt, Human; identical to SEQ ID NO: 91739

SEQ ID NO: 247860 - RNA, 64 nt, Human; identical to SEQ ID NO: 91740

SEQ ID NO: 247861 - RNA, 64 nt, Human; identical to SEQ ID NO: 91741

SEQ ID NO: 247862 - RNA, 64 nt, Human; identical to SEQ ID NO: 91742

SEQ ID NO: 247863 - RNA, 64 nt, Human; identical to SEQ ID NO: 91743

SEQ ID NO: 247864 - RNA, 64 nt, Human; identical to SEQ ID NO: 91744

SEQ ID NO: 247865 - RNA, 64 nt, Human; identical to SEQ ID NO: 91745

SEQ ID NO: 247866 - RNA, 64 nt, Human; identical to SEQ ID NO: 91746

SEQ ID NO: 247867 - RNA, 64 nt, Human; identical to SEQ ID NO: 91747

SEQ ID NO: 247868 - RNA, 64 nt, Human; identical to SEQ ID NO: 91748

SEQ ID NO: 247869 - RNA, 64 nt, Human; identical to SEQ ID NO: 91749

SEQ ID NO: 247870 - RNA, 64 nt, Human; identical to SEQ ID NO: 91750

SEQ ID NO: 247871 - RNA, 64 nt, Human; identical to SEQ ID NO: 91751

SEQ ID NO: 247872 - RNA, 64 nt, Human; identical to SEQ ID NO: 91752

SEQ ID NO: 247873 - RNA, 64 nt, Human; identical to SEQ ID NO: 91753

SEQ ID NO: 247874 - RNA, 64 nt, Human; identical to SEQ ID NO: 91754

SEQ ID NO: 247875 - RNA, 64 nt, Human; identical to SEQ ID NO: 91755

SEQ ID NO: 247876 - RNA, 64 nt, Human; identical to SEQ ID NO: 91756

SEQ ID NO: 247877 - RNA, 64 nt, Human; identical to SEQ ID NO: 91757

SEQ ID NO: 247878 - RNA, 64 nt, Human; identical to SEQ ID NO: 91758

SEQ ID NO: 247879 - RNA, 64 nt, Human; identical to SEQ ID NO: 91759

SEQ ID NO: 247880 - RNA, 64 nt, Human; identical to SEQ ID NO: 91760

SEQ ID NO: 247881 - RNA, 64 nt, Human; identical to SEQ ID NO: 91761

SEQ ID NO: 247882 - RNA, 64 nt, Human; identical to SEQ ID NO: 91762

SEQ ID NO: 247883 - RNA, 64 nt, Human; identical to SEQ ID NO: 91763

SEQ ID NO: 247884 - RNA, 64 nt, Human; identical to SEQ ID NO: 91764

SEQ ID NO: 247885 - RNA, 64 nt, Human; identical to SEQ ID NO: 91765

SEQ ID NO: 247886 - RNA, 64 nt, Human; identical to SEQ ID NO: 91766

SEQ ID NO: 247887 - RNA, 64 nt, Human; identical to SEQ ID NO: 91767

SEQ ID NO: 247888 - RNA, 64 nt, Human; identical to SEQ ID NO: 91768

SEQ ID NO: 247889 - RNA, 64 nt, Human; identical to SEQ ID NO: 91769

SEQ ID NO: 247890 - RNA, 64 nt, Human; identical to SEQ ID NO: 91770

SEQ ID NO: 247891 - RNA, 64 nt, Human; identical to SEQ ID NO: 91771

SEQ ID NO: 247892 - RNA, 64 nt, Human; identical to SEQ ID NO: 91772

SEQ ID NO: 247893 - RNA, 64 nt, Human; identical to SEQ ID NO: 91773

SEQ ID NO: 247894 - RNA, 64 nt, Human; identical to SEQ ID NO: 91774

SEQ ID NO: 247895 - RNA, 64 nt, Human; identical to SEQ ID NO: 91775

SEQ ID NO: 247896 - RNA, 64 nt, Human; identical to SEQ ID NO: 91776

SEQ ID NO: 247897 - RNA, 64 nt, Human; identical to SEQ ID NO: 91777

SEQ ID NO: 247898 - RNA, 64 nt, Human; identical to SEQ ID NO: 91778

SEQ ID NO: 247899 - RNA, 64 nt, Human; identical to SEQ ID NO: 91779

SEQ ID NO: 247900 - RNA, 64 nt, Human; identical to SEQ ID NO: 91780

SEQ ID NO: 247901 - RNA, 64 nt, Human; identical to SEQ ID NO: 91781

SEQ ID NO: 247902 - RNA, 64 nt, Human; identical to SEQ ID NO: 91782

SEQ ID NO: 247903 - RNA, 64 nt, Human; identical to SEQ ID NO: 91783

SEQ ID NO: 247904 - RNA, 64 nt, Human; identical to SEQ ID NO: 91784

SEQ ID NO: 247905 - RNA, 64 nt, Human; identical to SEQ ID NO: 91785

SEQ ID NO: 247906 - RNA, 64 nt, Human; identical to SEQ ID NO: 91786

SEQ ID NO: 247907 - RNA, 64 nt, Human; identical to SEQ ID NO: 91787

SEQ ID NO: 247908 - RNA, 64 nt, Human; identical to SEQ ID NO: 91788

SEQ ID NO: 247909 - RNA, 64 nt, Human; identical to SEQ ID NO: 91789

SEQ ID NO: 247910 - RNA, 64 nt, Human; identical to SEQ ID NO: 91790

SEQ ID NO: 247911 - RNA, 64 nt, Human; identical to SEQ ID NO: 91791

SEQ ID NO: 247912 - RNA, 64 nt, Human; identical to SEQ ID NO: 91792

SEQ ID NO: 247913 - RNA, 64 nt, Human; identical to SEQ ID NO: 91793

SEQ ID NO: 247914 - RNA, 64 nt, Human; identical to SEQ ID NO: 91794

SEQ ID NO: 247915 - RNA, 64 nt, Human; identical to SEQ ID NO: 91795

SEQ ID NO: 247916 - RNA, 64 nt, Human; identical to SEQ ID NO: 91796

SEQ ID NO: 247917 - RNA, 64 nt, Human; identical to SEQ ID NO: 91797

SEQ ID NO: 247918 - RNA, 64 nt, Human; identical to SEQ ID NO: 91798

SEQ ID NO: 247919 - RNA, 64 nt, Human; identical to SEQ ID NO: 91799

SEQ ID NO: 247920 - RNA, 64 nt, Human; identical to SEQ ID NO: 91800

SEQ ID NO: 247921 - RNA, 64 nt, Human; identical to SEQ ID NO: 91801

SEQ ID NO: 247922 - RNA, 64 nt, Human; identical to SEQ ID NO: 91802

SEQ ID NO: 247923 - RNA, 64 nt, Human; identical to SEQ ID NO: 91803

SEQ ID NO: 247924 - RNA, 64 nt, Human; identical to SEQ ID NO: 91804

SEQ ID NO: 247925 - RNA, 64 nt, Human; identical to SEQ ID NO: 91805

SEQ ID NO: 247926 - RNA, 64 nt, Human; identical to SEQ ID NO: 91806

SEQ ID NO: 247927 - RNA, 64 nt, Human; identical to SEQ ID NO: 91807

SEQ ID NO: 247928 - RNA, 64 nt, Human; identical to SEQ ID NO: 91808

SEQ ID NO: 247929 - RNA, 64 nt, Human; identical to SEQ ID NO: 91809

SEQ ID NO: 247930 - RNA, 64 nt, Human; identical to SEQ ID NO: 91810

SEQ ID NO: 247931 - RNA, 64 nt, Human; identical to SEQ ID NO: 91811

SEQ ID NO: 247932 - RNA, 64 nt, Human; identical to SEQ ID NO: 91812

SEQ ID NO: 247933 - RNA, 64 nt, Human; identical to SEQ ID NO: 91813

SEQ ID NO: 247934 - RNA, 64 nt, Human; identical to SEQ ID NO: 91814

SEQ ID NO: 247935 - RNA, 64 nt, Human; identical to SEQ ID NO: 91815

SEQ ID NO: 247936 - RNA, 64 nt, Human; identical to SEQ ID NO: 91816

SEQ ID NO: 247937 - RNA, 64 nt, Human; identical to SEQ ID NO: 91817

SEQ ID NO: 247938 - RNA, 64 nt, Human; identical to SEQ ID NO: 91818

SEQ ID NO: 247939 - RNA, 64 nt, Human; identical to SEQ ID NO: 91819

SEQ ID NO: 247940 - RNA, 64 nt, Human; identical to SEQ ID NO: 91820

SEQ ID NO: 247941 - RNA, 64 nt, Human; identical to SEQ ID NO: 91821

SEQ ID NO: 247942 - RNA, 64 nt, Human; identical to SEQ ID NO: 91822

SEQ ID NO: 247943 - RNA, 64 nt, Human; identical to SEQ ID NO: 91823

SEQ ID NO: 247944 - RNA, 64 nt, Human; identical to SEQ ID NO: 91824

SEQ ID NO: 247945 - RNA, 64 nt, Human; identical to SEQ ID NO: 91825

SEQ ID NO: 247946 - RNA, 64 nt, Human; identical to SEQ ID NO: 91826

SEQ ID NO: 247947 - RNA, 64 nt, Human; identical to SEQ ID NO: 91827

SEQ ID NO: 247948 - RNA, 64 nt, Human; identical to SEQ ID NO: 91828

SEQ ID NO: 247949 - RNA, 64 nt, Human; identical to SEQ ID NO: 91829

SEQ ID NO: 247950 - RNA, 64 nt, Human; identical to SEQ ID NO: 91830

SEQ ID NO: 247951 - RNA, 64 nt, Human; identical to SEQ ID NO: 91831

SEQ ID NO: 247952 - RNA, 64 nt, Human; identical to SEQ ID NO: 91832

SEQ ID NO: 247953 - RNA, 64 nt, Human; identical to SEQ ID NO: 91833

SEQ ID NO: 247954 - RNA, 64 nt, Human; identical to SEQ ID NO: 91834

SEQ ID NO: 247955 - RNA, 64 nt, Human; identical to SEQ ID NO: 91835

SEQ ID NO: 247956 - RNA, 64 nt, Human; identical to SEQ ID NO: 91836

SEQ ID NO: 247957 - RNA, 64 nt, Human; identical to SEQ ID NO: 91837

SEQ ID NO: 247958 - RNA, 64 nt, Human; identical to SEQ ID NO: 91838

SEQ ID NO: 247959 - RNA, 64 nt, Human; identical to SEQ ID NO: 91839

SEQ ID NO: 247960 - RNA, 64 nt, Human; identical to SEQ ID NO: 91840

SEQ ID NO: 247961 - RNA, 64 nt, Human; identical to SEQ ID NO: 91841

SEQ ID NO: 247962 - RNA, 64 nt, Human; identical to SEQ ID NO: 91842

SEQ ID NO: 247963 - RNA, 64 nt, Human; identical to SEQ ID NO: 91843

SEQ ID NO: 247964 - RNA, 64 nt, Human; identical to SEQ ID NO: 91844

SEQ ID NO: 247965 - RNA, 64 nt, Human; identical to SEQ ID NO: 91845

SEQ ID NO: 247966 - RNA, 64 nt, Human; identical to SEQ ID NO: 91846

SEQ ID NO: 247967 - RNA, 64 nt, Human; identical to SEQ ID NO: 91847

SEQ ID NO: 247968 - RNA, 64 nt, Human; identical to SEQ ID NO: 91848

SEQ ID NO: 247969 - RNA, 64 nt, Human; identical to SEQ ID NO: 91849

SEQ ID NO: 247970 - RNA, 64 nt, Human; identical to SEQ ID NO: 91850

SEQ ID NO: 247971 - RNA, 63 nt, Human
uauuauuuugacgguuuuuuuuuucggggcaggggaccuuaccuguaagacuuuuaaagauuu

SEQ ID NO: 247972 - RNA, 63 nt, Human
uuaaagugagaggggcaccaacagacaauucggggaccuuaggccccuuccugaggcacacuu

SEQ ID NO: 247973 - RNA, 63 nt, Human
cuuagaauccuuuuauucccugggucucuaaugggaccuuaaagaccaucugguaucaucuuc

SEQ ID NO: 247974 - RNA, 63 nt, Human
gacuugagcuuggcuaaauuuccugaagguggaggaccuuagaguugcuccaaguaaacuuuc

SEQ ID NO: 247975 - RNA, 63 nt, Human
uaaacucaucaguugcaaagauugccuauaaaaggaccuuaggauuuaaggaaggggcuucuu

SEQ ID NO: 247976 - RNA, 63 nt, Human
cugccugccagagaugggccuggggccugaugaggaccuuagcgcugcucguucuccuuuucu

SEQ ID NO: 247977 - RNA, 63 nt, Human
uaaccagagauucagauucaaagacugaggauaggaccuuagcauuguagcuauuuaaaguuu

SEQ ID NO: 247978 - RNA, 63 nt, Human
gcuguggacaccaccuauuuucuuuguuggaaaggaccuuaccuguguuucaagcuaccuuca

SEQ ID NO: 247979 - RNA, 63 nt, Human
guuguuguuguuguuuuaaagcaguccaaauuuggaccuuagcaaucaugucuuuuguauagg

SEQ ID NO: 247980 - RNA, 63 nt, Human
uaaugugccuuuaacucuagggaccugccucacggaccuuagggaaaaaccucaaccugaaag

SEQ ID NO: 247981 - RNA, 63 nt, Human
ucuaggauaauuagauagguauuucagaaaauuggaccuuaaaacuuugcuucuuuggaaagg

SEQ ID NO: 247982 - RNA, 63 nt, Human
ucaaauuuggcaaguguauuacuagcaggagauggaccuuaaauuaugacaacuuuauauuuu

SEQ ID NO: 247983 - RNA, 63 nt, Human
ccagagugacaaaguugauucaccccuuuuuggggaccuuaauauauuuuuuaagggaugugc

SEQ ID NO: 247984 - RNA, 63 nt, Human
ucugccucuauuuuuguuggggggugggagaggggaccuuaaaauguguacagugaacaaaug

SEQ ID NO: 247985 - RNA, 63 nt, Human
agugcagacuuugcuuccuccuuuuguuucaaaggaccuuaucuacccauuaacacuuguuag

SEQ ID NO: 247986 - RNA, 63 nt, Human
cuacuccuggccacuuaggagagcugaauuuauggaccuuaauuauuaaauguuuauaaggug

SEQ ID NO: 247987 - RNA, 63 nt, Human
uauguucagauuauuggagacuaauucuaauguggaccuuagaauacaguuuugaguagaguu

SEQ ID NO: 247988 - RNA, 63 nt, Human
gaauaauugagaucuucuguucauuuguuccuuggaccuuaaucauuugcauuuuggagaaaa

SEQ ID NO: 247989 - RNA, 63 nt, Human
aaaauugauauuauuuuccuuuucuuauaugaaggaccuuauuuggcauauaaaauuuuauaa

SEQ ID NO: 247990 - RNA, 63 nt, Human
aaaauggacauugagauacuaucauuaacauuaggaccuuagaauuuuggguauuguaaucug

SEQ ID NO: 247991 - RNA, 63 nt, Human
cacaggguuggucaauggcuuuuggaacuggaaggaccuuagaacuuaucuguuaugcuccug

SEQ ID NO: 247992 - RNA, 63 nt, Human
gaugagggugacugucaaguacaagcaagacugggaccuuagaaaucauuguagaaacacagu

SEQ ID NO: 247993 - RNA, 63 nt, Human
caaaggaaacuuugcagaugugauuaaagcuaaggaccuuaagacagaguauccugggggugg

SEQ ID NO: 247994 - RNA, 63 nt, Human
gaaguuagauccugcuaaauuucaauuaagaggggaccuuaaaauaaggaucaaucucuuauu

SEQ ID NO: 247995 - RNA, 63 nt, Human
cugggccagggccccagagcuccugccugagcuggaccuuaugcaaacauuucugugccugcu

SEQ ID NO: 247996 - RNA, 63 nt, Human
cuaagggaaugaguuugggcggccccucauaaaggaccuuagaggcagggaacagcaaugcca

SEQ ID NO: 247997 - RNA, 63 nt, Human
gcuucaaaucagaagcagaaacuggcaggccauggaccuuaauugucccucagguagauuuug

SEQ ID NO: 247998 - RNA, 63 nt, Human
uugagaagaccucaccuagaaauugacacaaguggaccuuaggccuuccucucuccagauguu

SEQ ID NO: 247999 - RNA, 63 nt, Human
ucaagcaaggcucuaggagguagucacugagcuggaccuuaaacacaucugcaggagcucaca

SEQ ID NO: 248000 - RNA, 63 nt, Human
gcucuuccuuuuaauaacagugaugaauugucaggaccuuauuuaggaaacccugaccuaccc

SEQ ID NO: 248001 - RNA, 63 nt, Human
gcuacucuguuuaaaucugccacuuucuggacuggaccuuaguacuguaaauucuuuuuaaag

SEQ ID NO: 248002 - RNA, 63 nt, Human
ggauuacaggcaugagccaccacaucuggccuaggaccuuaaauauuggaaagcauucucaaa

SEQ ID NO: 248003 - RNA, 63 nt, Human
ccuaguuuaccaaaauuaacaaagggggggaaaggaccuuagaacuuuuuaagguaaaaucaa

SEQ ID NO: 248004 - RNA, 63 nt, Human
uuugcacuauugaugugauacuguagccagccaggaccuuacugaucucagcauaauaaugcu

SEQ ID NO: 248005 - RNA, 63 nt, Human
gccucuucucguuucagccucaguauuauguagggaccuuaugcaauuucuuuuucuuuugaa

SEQ ID NO: 248006 - RNA, 63 nt, Human
cauguuuaaaaagaccuuaguaguuugcaggcuggaccuuaauuggacuuauuuucuuugaaa

SEQ ID NO: 248007 - RNA, 63 nt, Human
acuggucagucacaucuuacggcgaagggagagggaccuuaggggagcagagaagacaggcaa

SEQ ID NO: 248008 - RNA, 63 nt, Human
gagaccaccaaacugucuugaaggcaugucuauggaccuuaaguccaugucuauguuuucagc

SEQ ID NO: 248009 - RNA, 63 nt, Human
cuuucuuccugaccaccgauugagacgucuccaggaccuuaggggcagauccguuuucucacu

SEQ ID NO: 248010 - RNA, 63 nt, Human
cacucuaagagcaucuugaccaaguugagaaggggaccuuaaguuugguuugcggcaaacagc

SEQ ID NO: 248011 - RNA, 63 nt, Human
gguucucucugaccuuucaucguaaagugcuggggaccuuaagugauuugccuguaauuuugg

SEQ ID NO: 248012 - RNA, 63 nt, Human
acugcugagcuugcugugcuucaaacuacuacuggaccuuauuuuggaacuaugguagccaga

SEQ ID NO: 248013 - RNA, 63 nt, Human
gcuuucuagaaagauccaaucuuuggguuggaaggaccuuaaaggucaucuaguuuagccucc

SEQ ID NO: 248014 - RNA, 63 nt, Human
caaccagacagagggucacaguguuuacacuuuggaccuuacgaucaggcacaggucaggggu

SEQ ID NO: 248015 - RNA, 63 nt, Human
uaaguguaauaaaaaucccuuugcauucuuucuggaccuuaaaugguagaggaaaaggcucgu

SEQ ID NO: 248016 - RNA, 63 nt, Human
ucggcucugugcguucagucccucaggaaccguggaccuuaauuuaccuugcuaaguucagac

SEQ ID NO: 248017 - RNA, 63 nt, Human
ccccacaccuagacucaguaaggaagucggguuggaccuuaacaucugcauuggacaacucca

SEQ ID NO: 248018 - RNA, 63 nt, Human
gccagaagcccuggggggaagcccugcuacccuggaccuuacaccgggugugggaaucagccu

SEQ ID NO: 248019 - RNA, 63 nt, Human
ugccacauuaauauguugcuagggccccugcuaggaccuuaagaaggagcucaugugagucag

SEQ ID NO: 248020 - RNA, 63 nt, Human
gagacagacaucagugaugauaaaaaaaaaaauggaccuuaagaaacuauuuacucuguaauc

SEQ ID NO: 248021 - RNA, 63 nt, Human
gcacacaacaggccugggagcgaacugugugaaggaccuuaauucaaaucagagaaaaucauu

SEQ ID NO: 248022 - RNA, 63 nt, Human
ugccuggaugaggcacuucugucaauuuuuucaggaccuuaguuccagcagcagaauggaaaa

SEQ ID NO: 248023 - RNA, 63 nt, Human
uuucucccugagacccauaagguucaucuuaugggaccuuaauuugucuugcauggacauuug

SEQ ID NO: 248024 - RNA, 63 nt, Human
guuacucugcacauggaccagaaaaaguauaugggaccuuaagcucaccuucuuuacuuguau

SEQ ID NO: 248025 - RNA, 63 nt, Human
gcuccuuagcccaccugguuugcaggugcagggggaccuuaggcacgccccaagcaccaggca

SEQ ID NO: 248026 - RNA, 63 nt, Human
uuacuguugccuacuucugaccaagaagaaaaaggaccuuaguauuuagcauaaaauuccagc

SEQ ID NO: 248027 - RNA, 63 nt, Human
uggcucccacagaacccaaggcagguacacaaaggaccuuagaugagaucuggcauaugcacc

SEQ ID NO: 248028 - RNA, 63 nt, Human
cucuaugugagucucaggaagugaauuaaauuuggaccuuauguuuuacucuuguuuuuuuuu

SEQ ID NO: 248029 - RNA, 63 nt, Human
gcacaaaaugggacugcugaagaguggacaguuggaccuuacuuuggugaccccauacauuug

SEQ ID NO: 248030 - RNA, 63 nt, Human
agauauaauuaaccugauccaaaugaguaaaguggaccuuagaaaggcuaagugaucuuucuc

SEQ ID NO: 248031 - RNA, 63 nt, Human
uuuaaacuuaaaaauuauuuaauacagcuauauggaccuuauaaaauugauuucuuauuuauu

SEQ ID NO: 248032 - RNA, 63 nt, Human
aaaccuuaaauccagagauagcagccucgauagggaccuuaaaaggauucacaaaaacuuuug

SEQ ID NO: 248033 - RNA, 63 nt, Human
aucuucccuagaggguuccuguagaccuagggaggaccuuaucugugcgugaaacacaccagg

SEQ ID NO: 248034 - RNA, 63 nt, Human
aacuaccuuauuuuguauuucacuuaagguggaggaccuuaacuaaaggaccauauuuauuca

SEQ ID NO: 248035 - RNA, 63 nt, Human
ccagucuuuucccuaguuccugaaacuuuccuaggaccuuaagagaauaguaggagguccuau

SEQ ID NO: 248036 - RNA, 63 nt, Human
aaccuggacacagcuccucaagacagguagcauggaccuuaaggcgacaagagaggggcccca

SEQ ID NO: 248037 - RNA, 63 nt, Human
cagcggguggccuuaggggcugugaggcaguggggaccuuauugaugaaagaaaccgucuuug

SEQ ID NO: 248038 - RNA, 63 nt, Human
aaggcuugguugcucccaggcugcuguucucagggaccuuaaaagggaccugguuagucuugg

SEQ ID NO: 248039 - RNA, 63 nt, Human
cuagcucgugagaugaaagaacagaaguuguuuggaccuuagagccauuguccacaaucacgg

SEQ ID NO: 248040 - RNA, 63 nt, Human
guuuuacccagcaccuccggacacucaccuucaggaccuuaauaaaauuauucacuugguaag

SEQ ID NO: 248041 - RNA, 63 nt, Human
uccuuuuaccauuuuaucuuaucuugcuuuggaggaccuuaaaugcuacugaaacuuaccuga

SEQ ID NO: 248042 - RNA, 63 nt, Human
ucccgccccagggcccacuagcauccacugauuggaccuuauggucacccaacucaaggacag

SEQ ID NO: 248043 - RNA, 63 nt, Human
cucugccaggagaggauaauuggaaguucucuuggaccuuaccuuaugugccuuucuucauug

SEQ ID NO: 248044 - RNA, 63 nt, Human
gaacaaaaaguauucccugcaagcacuaugaauggaccuuacuacucucuuugacagaagacu

SEQ ID NO: 248045 - RNA, 63 nt, Human
cccccgcaagccccagccccgaggaccguccauggaccuuauuuuuauaugagauuaauaaag

SEQ ID NO: 248046 - RNA, 63 nt, Human
aguccucgacuuaucaccacaccacugccccaaggaccuuacaggcccucccuguuaauaaac

SEQ ID NO: 248047 - RNA, 63 nt, Human
cuggggaucuucccacaggagggccagcgcuguggaccuuacaacgccgagugcacugcauuc

SEQ ID NO: 248048 - RNA, 63 nt, Human
agugaacacauuuuacucuagaggcaucaccugggaccuuacuccucuuuccuuccuuccucc

SEQ ID NO: 248049 - RNA, 63 nt, Human
aagguuguuaaaauacagcuaaaguugguggggggaccuuaccaccccucagagugcugcuuc

SEQ ID NO: 248050 - RNA, 63 nt, Human
caggcucugcccaccaaggugcccucuccccggggaccuuagggugagcuugcuuuuggcagg

SEQ ID NO: 248051 - RNA, 63 nt, Human
uuucaaaggugguuauuauaacauacuagcaauggaccuuacuacuguaaggaauguagaaau

SEQ ID NO: 248052 - RNA, 63 nt, Human
cugccaugccuggugacccaccauggacauacuggaccuuaauuccucugcuucugugcuccc

SEQ ID NO: 248053 - RNA, 63 nt, Human
uguagcuauguuguacucucuaaaccugcccagggaccuuaccagauucgugucacugccagu

SEQ ID NO: 248054 - RNA, 63 nt, Human
cuucaaagacacauggcagugcagcauggagauggaccuuauaaauguaaguugugugggaaa

SEQ ID NO: 248055 - RNA, 63 nt, Human
caucuucuugaucagaggguucuuacuggaucaggaccuuaugagugugacaaacgugggaua

SEQ ID NO: 248056 - RNA, 63 nt, Human
aaucacuuagagaacuuaaaaauacaguuuccuggaccuuauccaagaccuacugagugagaa

SEQ ID NO: 248057 - RNA, 63 nt, Human
ccagcgagaaaggaggggaagccccuucuccggggaccuuaucuguggacucaggaaugaugg

SEQ ID NO: 248058 - RNA, 63 nt, Human
cugcuguuggaugagagugagugaguaugcucuggaccuuauccuugaaagaugaucaaaagc

SEQ ID NO: 248059 - RNA, 63 nt, Human
acuagugauucacuggggcauuauuuuguuagaggaccuuaaaauuguuuauuuuuuaaaugu

SEQ ID NO: 248060 - RNA, 63 nt, Human
gucagaaaggugcagagaugaaaagauuuugaaggaccuuaugaaauaugaugggaauauugg

SEQ ID NO: 248061 - RNA, 63 nt, Human
cccacugcuggaacagaggcuccaagaaaacagggaccuuauuauucauuacugcauccccag

SEQ ID NO: 248062 - RNA, 63 nt, Human
caagaagauccacgugguguuaggaacaauacaggaccuuaaggaugggggaaucagcaggug

SEQ ID NO: 248063 - RNA, 63 nt, Human
uuagaaauacagcuuuuaaaauauugugguucuggaccuuacaagaacaagaugguuugauuu

SEQ ID NO: 248064 - RNA, 63 nt, Human
aacaaaaaugguacuuucguuguauuaauugcaggaccuuaacagguagucacaauagaaggg

SEQ ID NO: 248065 - RNA, 63 nt, Human
auaaccuugggcuaguauauuuuuuccaauaugggaccuuagucuuacuacugaugaguucua

SEQ ID NO: 248066 - RNA, 63 nt, Human
cagcugcucagcaccacuuucauucuggaccugggaccuuaggagccgggugacagcacuaac

SEQ ID NO: 248067 - RNA, 63 nt, Human
aaugauacuuugcacugggcuguacgacagugaggaccuuagggcaugaagccuuuuuccugg

SEQ ID NO: 248068 - RNA, 63 nt, Human
uggcuuuggcaaggacuggauuggggggacaugggaccuuacgcuugugggggucugcgggcu

SEQ ID NO: 248069 - RNA, 63 nt, Human
guuugcaggccugcacaggcuggggaguccucaggaccuuaggaccuucauccaggggcuggg

SEQ ID NO: 248070 - RNA, 59 nt, Human
uccucaccaccuggaagugagucccaccuggaccuuaucaaaacuacucacuccaccug

SEQ ID NO: 248071 - RNA, 63 nt, Human
uuuguccuuugcuccugcuccccgugggaccugggaccuuaaagcguugcagguuccugauuu

SEQ ID NO: 248072 - RNA, 64 nt, Human
ugucuuccucaucucuguagcaccaagccugauagaucuguauaugguaaacagggguuuaacc

SEQ ID NO: 248073 - RNA, 64 nt, Human
acuaauuuguaucuguuuaacucauauucugcacgaucuguauauaguacaucaaacuuagagg

SEQ ID NO: 248074 - RNA, 64 nt, Human
cuauugucuguguauucugcucucuuuagcagaugaucuguaauuuggucauuguucuguuaua

SEQ ID NO: 248075 - RNA, 64 nt, Human
ugguuacuaggauucagaaguaaaucuauuuagugaucuguaaauaauugaaguaauguaacac

SEQ ID NO: 248076 - RNA, 64 nt, Human
ugccaucaagaugagagaacuggaggaguuccuugaucuguauauacaauaacauaauuuguac

SEQ ID NO: 248077 - RNA, 64 nt, Human
agccuuuguccuuguccuggccuccugcucuccagaucuguaaacugggcucaaggacuguaca

SEQ ID NO: 248078 - RNA, 64 nt, Human
agcagguaagagcugaugugagugugugugaugggaucuguaaggaacuggaacacacaugucc

SEQ ID NO: 248079 - RNA, 64 nt, Human
acucuaugcucuggaaaaccugaggccaaauauugaucuguauuaagcuccagugcuuuaucca

SEQ ID NO: 248080 - RNA, 64 nt, Human
acuggcacagggaggcuacaacuaagcagccucagaucuguaaaguugauuggugcuuucuaaa

SEQ ID NO: 248081 - RNA, 64 nt, Human
ccuaugucuuucaggaaaaauaauuauagcagcugaucuguaaaugacuuuaaaagcuauuuua

SEQ ID NO: 248082 - RNA, 64 nt, Human
aggaaaagagaaggaaagugauuuuuuuccacaagaucuguaauguuauuuccacuuauaaagg

SEQ ID NO: 248083 - RNA, 64 nt, Human
aauuuaggucugccagaaaauucuaucugugauagaucuguaaagagggucagggguuagaguu

SEQ ID NO: 248084 - RNA, 64 nt, Human
uugcaaagguugggucugacaguaccaguuguuagaucuguagggacuuguacaacauugugga

SEQ ID NO: 248085 - RNA, 64 nt, Human
cuauauaacacaaaucauccccaaaacccaucaugaucuguaaagcagcugcaaagaaugaagu

SEQ ID NO: 248086 - RNA, 64 nt, Human
cagaugccuccugcuuggauucugaguggucagagaucuguaaagcaugacuuucaaggauggu

SEQ ID NO: 248087 - RNA, 64 nt, Human
ggcaagucuuuaggucuuuguaagaacuaaagaagaucuguaauuuuuauuuucacccucugua

SEQ ID NO: 248088 - RNA, 64 nt, Human
gaaaauagaacuagaucuguaaagucuggaacuagaucuguaacguccuuauaggugucacuag

SEQ ID NO: 248089 - RNA, 64 nt, Human
guuuccccaucuguaacuugagaaaauagaacuagaucuguaaagucuggaacuagaucuguaa

SEQ ID NO: 248090 - RNA, 64 nt, Human
caucuuuugucaaaccauuaagaguuagaaagaugaucuguaucaacagaucuaguuucuugca

SEQ ID NO: 248091 - RNA, 64 nt, Human
cagccauucugcaaaguguauugauguguauagugaucuguauaaagucaguaguucuuagcug

SEQ ID NO: 248092 - RNA, 64 nt, Human
cagaggagggacucagauuuauuuacucuugcuggaucuguagugauggaguuccuucuggugu

SEQ ID NO: 248093 - RNA, 64 nt, Human
gaauuugccuaauaugaugacuguuuuuaauauggaucuguauguguucuauucagcacaagga

SEQ ID NO: 248094 - RNA, 64 nt, Human
ggaucaccacuguaagcacacuuuauuugcauuugaucuguauuuguauaugcugaugcaauga

SEQ ID NO: 248095 - RNA, 64 nt, Human
acaaccuuaaguaaucucaauaauaaaauuuucugaucuguauuauauccaguguuggguuuau

SEQ ID NO: 248096 - RNA, 64 nt, Human
accugagccaacgccucccugugaaacuguugcugaucuguaguacaguaccaggaagaaaccu

SEQ ID NO: 248097 - RNA, 64 nt, Human
agagcuaugauuccuucccaguucuaagagauacgaucuguaagucccuaugucaccacauugc

SEQ ID NO: 248098 - RNA, 64 nt, Human
guugggucuuucaggcugguuuugguuuguauuagaucuguauaguuuaacuagugauuuaguu

SEQ ID NO: 248099 - RNA, 64 nt, Human
ggaccuugaaucgauaaguguaaauacagcuuuugaucuguaaugcuuuuauacaaaaguuuau

SEQ ID NO: 248100 - RNA, 64 nt, Human
gugacuuuggggucauuauguucgugcugcaagugaucuguaaucccuaugaguauauauauau

SEQ ID NO: 248101 - RNA, 64 nt, Human
auuuucucaguuaaauuuccucaccuucacuauugaucuguaauuuuuauuuuaaaaacagcuu

SEQ ID NO: 248102 - RNA, 64 nt, Human
ccuccuugcccauccuucaccggugccuuugggggaucuguaggaggugggaccuucugugggg

SEQ ID NO: 248103 - RNA, 64 nt, Human
gaagcuuuuuaauaaagaaauugcauuuauaaaugaucuguauuagaauauaauaaaucuccag

SEQ ID NO: 248104 - RNA, 64 nt, Human
uuuuuuccuuuauguucucaccguuugaaugcaugaucuguauggggcaauacuauugcauuuu

SEQ ID NO: 248105 - RNA, 64 nt, Human
uuccucuaguucaugucuguagucccuauagaaugaucuguaauaaaauaguauacuggacugu

SEQ ID NO: 248106 - RNA, 64 nt, Human
cgacccaaguacugcuguauccuguguaguacuagaucuguaucucuugucugaauuaaacauu

SEQ ID NO: 248107 - RNA, 64 nt, Human
cuguuugagaugugaugcugguaccacuggaaucgaucuguacuguaauuuuguuuguaauccu

SEQ ID NO: 248108 - RNA, 64 nt, Human
uguguguaaauuauuucauauagggaagaguucugaucuguaccuaugguucuuauugaaaaca

SEQ ID NO: 248109 - RNA, 64 nt, Human
agcugaauaaggggucagaacuucugaaaccagagaucuguaaucaucucuauuggccuggggu

SEQ ID NO: 248110 - RNA, 64 nt, Human
aguagccuuggcucacauaagacauguuucaugugaucuguauccuggcauaccaguuauauuu

SEQ ID NO: 248111 - RNA, 64 nt, Human
ccaacuucaugggucacuuuuucuggaaaauaaugaucuguacagacaggacagaaugaaacuc

SEQ ID NO: 248112 - RNA, 64 nt, Human
aaugcugaggccaggccuuuuagagcuuucauuugaucuguaucugaucuuucauuuccugcca

SEQ ID NO: 248113 - RNA, 64 nt, Human
uaaaaaauauauguuucauuuaaucuucacaaaagaucuguagaguaagcaaagagaggcaaaa

SEQ ID NO: 248114 - RNA, 64 nt, Human
cauagcuccaacccccaacuucccccagacuuuagaucuguauugguauuaccuacuggacauc

SEQ ID NO: 248115 - RNA, 64 nt, Human
auugaaagcacuaugaauuuguccauuuaaaaaugaucuguaguuuuuuuggugcuauaacauu

SEQ ID NO: 248116 - RNA, 64 nt, Human
guguagaaaaggaagacauaagaaacuccauuuugaucuguacuaagaaaaauuguuucugcuu

SEQ ID NO: 248117 - RNA, 64 nt, Human
augcgcauccccacccacaacccuuuacccugaugaucuguauuauauuuuaauguauauguga

SEQ ID NO: 248118 - RNA, 64 nt, Human
cugcuguugguuuuaauuuuguaaccuguggccugaucuguaaauaaaacuuacauuuuucaau

SEQ ID NO: 248119 - RNA, 64 nt, Human
cuguuuuuuauaucugucauguacauugcauuuugaucuguaacugcacaacccugggguuugc

SEQ ID NO: 248120 - RNA, 64 nt, Human
uuuuauugcagccauauccacuuauccaucuuaagaucuguagcugggauuuucugacuuguaa

SEQ ID NO: 248121 - RNA, 64 nt, Human
uaugggaauguuuuguagauaauaaaacuuacaugaucuguacuuccacgugacugggugcuga

SEQ ID NO: 248122 - RNA, 64 nt, Human
cccuuuccaaaagcccagagaugcccugggcucagaucuguaauucucccaggagcugugauag

SEQ ID NO: 248123 - RNA, 64 nt, Human
uagccuuucugugaaccagaugugguuuggggcagaucuguaguaaacaauggugauuuuauuu

SEQ ID NO: 248124 - RNA, 64 nt, Human
caggucagaaauuguguucuuugacaacagauuggaucuguaauguugauuagucuuuagccau

SEQ ID NO: 248125 - RNA, 64 nt, Human
accucgccgggggaccagggagugcacgucuguagaucuguacauaucugggccuuuggaggcc

SEQ ID NO: 248126 - RNA, 64 nt, Human
gacuugccacacacugccaauucauaauccgcaggaucuguagaagacauuuugggaaacacug

SEQ ID NO: 248127 - RNA, 64 nt, Human
acuagcuaagaugcucaaucucuaaaaaaaaaaggaucuguauucgugagaguagagagaaagg

SEQ ID NO: 248128 - RNA, 64 nt, Human
caccccaucaucacuggaggcaaauuucagcauagaucuguaggauuuuuagaagaccgugggc

SEQ ID NO: 248129 - RNA, 64 nt, Human
gcuuuauaaaaaugggaaaaaaaguauacuuaaggaucuguaguaauaacugcuuuacaaaauc

SEQ ID NO: 248130 - RNA, 64 nt, Human
cauacauacucugugguaauagagacuugagcuggaucuguacugcacuggaguaagcaagaaa

SEQ ID NO: 248131 - RNA, 64 nt, Human
cucuaaauguaguauaauuugccuuuuaaccuuugaucuguaucuugcaauagaauggcuuugg

SEQ ID NO: 248132 - RNA, 64 nt, Human
ugaucguuucuuuuaaaaaugauuuggggaacuugaucuguacuguaauuuuacuaauuccuug

SEQ ID NO: 248133 - RNA, 64 nt, Human
gugaaccuauugauaaagaauauuuauaaaaacugaucuguaggccuguacuaaucucuacgca

SEQ ID NO: 248134 - RNA, 64 nt, Human
ucagugggugcuuggcugugcuggaugauauguugaucuguauuggauaaggaccaaugacagc

SEQ ID NO: 248135 - RNA, 64 nt, Human
uaauuauuuuauucauaaauggugauaguccccagaucuguacaccuuuaucacucccugccgu

SEQ ID NO: 248136 - RNA, 64 nt, Human
uauaagcuagcacauaauuauccuucuguucuuagaucuguaucuucauaauaaaaaauuuugc

SEQ ID NO: 248137 - RNA, 64 nt, Human
uuuaaguuuuucccauucaggaaaacaacauugugaucuguacuacaggaaccaaaugucaugc

SEQ ID NO: 248138 - RNA, 64 nt, Human
acuaucuacuaggacagauaagcugaacagugaugaucuguagacauuuauggacugaauguaa

SEQ ID NO: 248139 - RNA, 64 nt, Human
auuaauuacugugauauacuuucauccguuuuaugaucuguaaaauaaaaacucagcugggucc

SEQ ID NO: 248140 - RNA, 64 nt, Human
auauauguagaacaugacugccuaucaguagauugaucuguauuuaauauucguuaauuaaauc

SEQ ID NO: 248141 - RNA, 64 nt, Human
acuguggccuaccagcaucuggaagugugugcucgaucuguaugugugcagaggugguguggau

SEQ ID NO: 248142 - RNA, 64 nt, Human
gaaaaacaaacuacccgcaucuucuguuaggcaggaucuguacaauaauaauuaugaguuugcu

SEQ ID NO: 248143 - RNA, 64 nt, Human
ggugauaugcuugaucuacacagagaugugacuugaucuguagcaccaaugcaauguaggucuc

SEQ ID NO: 248144 - RNA, 64 nt, Human
auggaaugauagguugaucagauucaguaaaguugaucuguaugcauuuucccaucucaagcau

SEQ ID NO: 248145 - RNA, 64 nt, Human
gcacuugugucugcagauuauuuaaguggcuuuugaucuguaaauaaaaucagugcacugugca

SEQ ID NO: 248146 - RNA, 64 nt, Human
uguggcucuuguuuucauuuuuguuguacguguagaucuguaaauaaaauugcaguauuuaaag

SEQ ID NO: 248147 - RNA, 64 nt, Human
augagccaaucuccuuaauaaaugccugcucauagaucuguaucuacaucuauaucuguaugug

SEQ ID NO: 248148 - RNA, 64 nt, Human
uaaaaucucacaaacccccugacauagucucagagaucuguagggccgagguuacauuuggaga

SEQ ID NO: 248149 - RNA, 64 nt, Human
ccucugauauuuucacagccuguuaguggcggcugaucuguagagguaugaaaauacagcccca

SEQ ID NO: 248150 - RNA, 64 nt, Human
cacuaauauuaaauaauauugauaauaacaaaaagaucuguauuaagguuuauggcugcaauaa

SEQ ID NO: 248151 - RNA, 64 nt, Human
ggaugaggccacugaaagaucugcuucauucuuugaucuguauucugaaguuccagauuguuca

SEQ ID NO: 248152 - RNA, 64 nt, Human
uccauuuggaugcuaauguucauuggacauacuugaucuguauuuagauuucauacaacuuaca

SEQ ID NO: 248153 - RNA, 64 nt, Human
guccacaggaacaugagauuuagcagacuaaggagaucuguaaagaaugaaccauaccacaagg

SEQ ID NO: 248154 - RNA, 64 nt, Human
ccaaagcagucaacagugauuucuuaagcaauuugaucuguaccuuuacuugugaaagguaugc

SEQ ID NO: 248155 - RNA, 64 nt, Human
ugauaccaugguauauugacucuuagaugcuauugaucuguagcaccauuuuuuacaaacgacu

SEQ ID NO: 248156 - RNA, 64 nt, Human
cuauuacaacuugcuauagaaaguugguacaaaugaucuguacuuuaaacuacaguuaggaauc

SEQ ID NO: 248157 - RNA, 64 nt, Human
cggcaagguuauagauacagccucuagcucuucagaucuguacaugcaguauuuaauuuccucu

SEQ ID NO: 248158 - RNA, 64 nt, Human
ugcugugcgagaaauauuuacagcacauuaaaacgaucuguauuauuaaauaaauaauuuucaa

SEQ ID NO: 248159 - RNA, 64 nt, Human
cuaccucccucacaugaaccuguuccucucucaggaucuguauguaagugaaaagcaucaccau

SEQ ID NO: 248160 - RNA, 64 nt, Human
augcauauaugaaaacaauacuaaauaaacaucugaucuguauaaaaauguaaauuaguuugac

SEQ ID NO: 248161 - RNA, 64 nt, Human
cccucagugucuaguuuaaggcuuuuagaagauugaucuguagcaauuauuuaaugaauugaau

SEQ ID NO: 248162 - RNA, 64 nt, Human
caucaaguggcauuuuguuccuguguuuaauagugaucuguauacagcugugcacauauuguca

SEQ ID NO: 248163 - RNA, 64 nt, Human
gaccaaugcaagucucuaaguuguuuuuauaaaugaucuguaguuccguggcuugcaugggugc

SEQ ID NO: 248164 - RNA, 64 nt, Human
uuucuacuguaaagaaauauacuuuucuauuaaagaucuguacauauuuuuacaguaaaaugcu

SEQ ID NO: 248165 - RNA, 64 nt, Human
uaccuugaguggccugcacgaacaugacagcccugaucuguauuuccuuuccauucagaaaacc

SEQ ID NO: 248166 - RNA, 64 nt, Human
aaaaacuguaauauccuuuagaaaugcucuagaagaucuguauuguguagaaugaucauguauu

SEQ ID NO: 248167 - RNA, 64 nt, Human
gcacaggcuguugaagcauuuucucagaggaguggaucuguagaagucugucuuucuauagaaa

SEQ ID NO: 248168 - RNA, 64 nt, Human
ucagugagauggaacuguaaauaauuguucugcugaucuguaguguugcuguuaccuucugggu

SEQ ID NO: 248169 - RNA, 64 nt, Human
uuaggagucucuggaggacagauuaaaaaccagugaucuguaauuuguagcucuuccugcugau

SEQ ID NO: 248170 - RNA, 64 nt, Human
agaauagaguuggucuggauugaugaucacugaggaucuguaugugaggcacccauaacaguag

SEQ ID NO: 248171 - RNA, 64 nt, Human
gaggaaggaaugaaaccuguuucaacauggaaaugaucuguauugacuaauacaccaguccaca

SEQ ID NO: 248172 - RNA, 64 nt, Human
ggguucccuggaaaaccagucccaggguuccuaugaucuguaguuucuaccuggauuauaacug

SEQ ID NO: 248173 - RNA, 64 nt, Human
cuuuuguguguuuuuaaaaauuagaugcaaacuagaucuguaugcagauguaguuuuuagcagg

SEQ ID NO: 248174 - RNA, 64 nt, Human
cucggauagauugagauguucuuucacaucagaugaucuguaacacuguaagauacugaucuuu

SEQ ID NO: 248175 - RNA, 64 nt, Human
uccuccaaggugguuuucuucucuuaaauaacucgaucuguacccagcuggguagcagccagca

SEQ ID NO: 248176 - RNA, 64 nt, Human
cacgauuaguuuacagaacugaaaaggaaucugagaucuguacuguaucaggauuacaaaggau

SEQ ID NO: 248177 - RNA, 64 nt, Human
acuucuuccuauuguaaucgugugccauggaucugaucuguaccaugacccuacauaaggcugg

SEQ ID NO: 248178 - RNA, 64 nt, Human
aaaaaaaaucaaacagcagaagaccaaggcaucagaucuguaaugacccuaaaguuaguguggu

SEQ ID NO: 248179 - RNA, 64 nt, Human
cacaauuaguuuacagaauggaaaaggagucugagaucuguacuguuucaggauuacaaaggaa

SEQ ID NO: 248180 - RNA, 64 nt, Human
gagucucagaguggaacaaagagugggaagaggugaucuguaauguuacaaauugugcuauuac

SEQ ID NO: 248181 - RNA, 64 nt, Human
cacaaagcccaucucugguuugagaauucauuuugaucuguaucuacaccacccaaaguuaggc

SEQ ID NO: 248182 - RNA, 64 nt, Human
ccugacuaaaucagggcugggcuuagacagaguugaucuguagaauaucuuuaaaggagagaug

SEQ ID NO: 248183 - RNA, 64 nt, Human
aauacauuuuugccaagacaugaaguuuuauaaagaucuguauaauugccugaaucaccagcac

SEQ ID NO: 248184 - RNA, 64 nt, Human
uuacaagcaggugucauggcaggaaggaagaccagaucuguaugauuuguuccauuuuuaauaa

SEQ ID NO: 248185 - RNA, 64 nt, Human
uguucgggggacaacuuguaucuuucuagcagcagaucuguaguuuguauagccucaacaacaa

SEQ ID NO: 248186 - RNA, 64 nt, Human
guugggucuuucaggcugguuuugguuuguauuagaucuguauaguuuaauuaacuggugauuu

SEQ ID NO: 248187 - RNA, 64 nt, Human
agacuuccagucacugagucucccaggcccccuugaucuguaccccaccccuaucuaacaccac

SEQ ID NO: 248188 - RNA, 64 nt, Human
gaccuaaaguugaaggguuuagaguuuuuaaccugaucuguagagcagagagguugaaagcacu

SEQ ID NO: 248189 - RNA, 64 nt, Human
ucaaaauaauucuaaaucccucgauauuuuuaaagaucuguaaguaacuucacauuaaaaaaug

SEQ ID NO: 248190 - RNA, 64 nt, Human
aagaugaugaacuaaauguugaagacaaguuugagaucuguaaaaugugauuuuuuacuuccac

SEQ ID NO: 248191 - RNA, 64 nt, Human
uuaaauaaggcaggguuuauaugcacuuucuuccgaucuguaccugagagguuuguggaaaaga

SEQ ID NO: 248192 - RNA, 64 nt, Human
cauggccucccugaugucaggaugccuuuguuaggaucuguauuugcccuuaauuuuguugaaa

SEQ ID NO: 248193 - RNA, 64 nt, Human
augucuguuggagcuauucccauacccacugaaggaucuguagucuugucuucauucuauguag

SEQ ID NO: 248194 - RNA, 64 nt, Human
auucuugcuguuaagaaacaauuucguuuaaugggaucuguacaacugauuuuaaaaaaaugcu

SEQ ID NO: 248195 - RNA, 64 nt, Human
cuggcuuuacccaaaagaaaauuaaacuuucuuugaucuguacaaguugaucaaacaaaugggg

SEQ ID NO: 248196 - RNA, 64 nt, Human
gagggauaaccccaggcacuguuuggagccauaagaucuguaucuagaaagagaucacccacuc

SEQ ID NO: 248197 - RNA, 64 nt, Human
uaaacaaguagacauuuuguuauuaaaaaaaugugaucuguaauuucuuugugcagaaugauuu

SEQ ID NO: 248198 - RNA, 64 nt, Human
cauuaaauuguacauggcaaauaaaucccagaaggaucuguagaugaggcaccugcuuuuucuu

SEQ ID NO: 248199 - RNA, 64 nt, Human
aaaccuagucaaacaaggaagcuguaggugaggagaucuguauaauauucuaauuuaaguaagu

SEQ ID NO: 248200 - RNA, 64 nt, Human
auucucaucgcccauuuuucaaacuuguuacauugaucuguacauuauuuuaagccacauguuu

SEQ ID NO: 248201 - RNA, 64 nt, Human
cacuuaaauacagugacaggacagcaacuucagggaucuguaaagaucauuuaaauggagugcu

SEQ ID NO: 248202 - RNA, 64 nt, Human
gaauuggcauagauucugguguuaaaauagacuggaucuguauuaucugaggguuaguaacuaa

SEQ ID NO: 248203 - RNA, 64 nt, Human
ggcacagcuaguuuucccgauuuggauaaaaguugaucuguauagucaacaucuugaacuauau

SEQ ID NO: 248204 - RNA, 64 nt, Human
uuugaauuuuucuuugucuuugaagacauugugagaucuguaauuuuuuuuuuuuguagaaaau

SEQ ID NO: 248205 - RNA, 64 nt, Human
auuugcuuuaacuauuauggguuauauugcaaaugaucuguacuuuaggguagaauucaauauu

SEQ ID NO: 248206 - RNA, 64 nt, Human
accauacaaaaauugugucauugaggacaauggugaucuguaauuuuaguugaguauguuuaug

SEQ ID NO: 248207 - RNA, 64 nt, Human
cauaauuuagcaaccauuuaucauggaugaaagagaucuguaaaaccugcccaggaacuuacag

SEQ ID NO: 248208 - RNA, 64 nt, Human
aucauguuugcuaaagagaaaucuggaagugugagaucuguaagaaaugaaagaaaugacucuu

SEQ ID NO: 248209 - RNA, 64 nt, Human
aaacugggcuugucacauuguauuguauuuuugugaucuguaaugaaaagaaucuguacugcaa

SEQ ID NO: 248210 - RNA, 64 nt, Human
agcuuggagggauggagaggcggccucgugccaugaucuguauuuaaugguuuuuauuucucgg

SEQ ID NO: 248211 - RNA, 64 nt, Human
aagaaaucugaauccaugucauucauaaccccuugaucuguagugucaugggugcugccgcagg

SEQ ID NO: 248212 - RNA, 64 nt, Human
ugcacuuuuuguguguguugauccugguuucccagaucuguauuucaguguuuacaagggagga

SEQ ID NO: 248213 - RNA, 64 nt, Human
acauccgcaggcaccagggaaagucuccuggggcgaucuguaaauaaaccuuuuuuucuuuugu

SEQ ID NO: 248214 - RNA, 64 nt, Human
auagcuggggcuucaccagucugucuacuguggugaucuguagacuucugguuguauuucuaua

SEQ ID NO: 248215 - RNA, 64 nt, Human
uauccacauuggcuuauucuggaggaaaagcagugaucuguaaaacaaaucaagaauauauuaa

SEQ ID NO: 248216 - RNA, 64 nt, Human
ggcccagucagguuacacaaaacugaucaucacagaucuguagaacuauacaaaagugcuaaca

SEQ ID NO: 248217 - RNA, 64 nt, Human
guucucagaguuguacauauguuucacaguacaggaucuguacauaaaaguuucuuuccuaaac

SEQ ID NO: 248218 - RNA, 64 nt, Human
cugcaggacccuccagggccugcgggcauaaccugaucuguagcugggcucagccacaggccuu

SEQ ID NO: 248219 - RNA, 64 nt, Human
gggccuagcauuuuuucuacuguaaacguagcaagaucuguauaugaauauguauauguauaug

SEQ ID NO: 248220 - RNA, 64 nt, Human
aagacccuaaaucugaggaaucaacagggcagcagaucuguauauuuuuuucuaagagaaaaug

SEQ ID NO: 248221 - RNA, 64 nt, Human
aggggcuaagaagguuguccuugccuaaugcucugaucuguaagugaauagggcagaacaguuc

SEQ ID NO: 248222 - RNA, 64 nt, Human
aacuaggguuuauucuauauaaugaauauuuauagaucuguaacauuuguuucaaaaugcuguu

SEQ ID NO: 248223 - RNA, 64 nt, Human
cauugacgagcaugagcuggaugcccuuuugaaggaucuguacgagaaaaacaaaaaggugagc

SEQ ID NO: 248224 - RNA, 64 nt, Human
uggugacaugcaccaacagccguauguguacugugaucuguaagaaguacaaugccaucugucu

SEQ ID NO: 248225 - RNA, 64 nt, Human
guagcaugacugaucugcaauuuaaaauuccugugaucuguaaaaaaaaaaaaaaaaaaaaaca

SEQ ID NO: 248226 - RNA, 64 nt, Human
cagucucacuggaugggaaacucacagaugagcugaucuguaagucacucugccccaggaggcc

SEQ ID NO: 248227 - RNA, 64 nt, Human
ggauacucucccaaccagccaaggaauaaaagcugaucuguauguagggcagaaguguggcaaa

SEQ ID NO: 248228 - RNA, 64 nt, Human
ucugcacgccuggggcagggacuuuugaguuuaggaucuguauuuucuaaguccccaguucucc

SEQ ID NO: 248229 - RNA, 64 nt, Human
gagccaagugcuuaaaaaguuaauaaaauaaaaugaucuguaugauaccugcaauugaaaagcc

SEQ ID NO: 248230 - RNA, 64 nt, Human
auauuugcuggaggagcaaaugaccgguggguacgaucuguaucuuuuagccaugauggacugc

SEQ ID NO: 248231 - RNA, 55 nt, Human
ugcucugucuucucuugcagaguuggaucuguagcgguccuuuggagagugugug

SEQ ID NO: 248232 - RNA, 64 nt, Human
augacuuacuuagaauuuauccuuuauuuuaaaugaucuguacuaucuagugucuaaaacacua

SEQ ID NO: 248233 - RNA, 64 nt, Human
uguuguuucggccucagugagguugccuggaugggaucuguauuagacuugagugcaggucucu

SEQ ID NO: 248234 - RNA, 64 nt, Human
aaauuucuucauuuugauuaagagaccucuuuuugaucuguauugggcuaaccagagccaaaua

SEQ ID NO: 248235 - RNA, 64 nt, Human
uuuccaaaauaaucuauauuaaaugaggguuucugaucuguacuuuguguuuagcuaccuuuuu

SEQ ID NO: 248236 - RNA, 64 nt, Human
cagguuucucccuggauacucuuggcccaccgcagaucuguagccagucagaggaggaggagaa

SEQ ID NO: 248237 - RNA, 64 nt, Human
auguuaaguggagaaaggguuuugcaaacugaaagaucuguagagaguagcaguauuucauugg

SEQ ID NO: 248238 - RNA, 64 nt, Human
caaauccacacuugucaauagccucuuccucacugaucuguaccgggaccggaaacuucuuggu

SEQ ID NO: 248239 - RNA, 64 nt, Human
ggacugucagauucaucugaacuggaccaguguugaucuguaauguaauagaaaaucugauaga

SEQ ID NO: 248240 - RNA, 64 nt, Human
agugaaccauugcuuaagauaaaaaacuuaacuagaucuguaaauguacagaauagcaucagau

SEQ ID NO: 248241 - RNA, 64 nt, Human
uuauauuuuguaugaauuguuucuaacaaaccuugaucuguauauacuugugagggguuguuug

SEQ ID NO: 248242 - RNA, 64 nt, Human
guuaucaucauacaaaaaucacaaacaaaaaggagaucuguauucggguaucaaacgguugauc

SEQ ID NO: 248243 - RNA, 64 nt, Human
uaccugcacaccuaaaacacuaggccacgcaucugaucuguagucacaugacuaagccaagagg

SEQ ID NO: 248244 - RNA, 64 nt, Human
uuuugugucuugcuuauuucacucaauuuuuuaagaucuguacauuauugcauguggcaguagu

SEQ ID NO: 248245 - RNA, 64 nt, Human
ccugaggggaaacugaagcucugaaaugcgaugugaucuguaccaggucacccagcuaugcugc

SEQ ID NO: 248246 - RNA, 64 nt, Human
uauuuggcgcucccuggugcuugcccagcuuuuugaucuguaggauuaugccuuuugcaaaauu

SEQ ID NO: 248247 - RNA, 64 nt, Human
ugucauuaguauuagugaauucacguaaaaggaagaucuguagacauaauaaauguagaaaugc

SEQ ID NO: 248248 - RNA, 64 nt, Human
agaggaaccuggacauggucccgggcaucugaaugaucuguaggggagggaguucaaauaaagc

SEQ ID NO: 248249 - RNA, 64 nt, Human
ccacaccaucaccacugcuuucucuuccaacagugaucuguauucuuaguuucauuauuuucuu

SEQ ID NO: 248250 - RNA, 64 nt, Human
uugacuuugcagcuacuaauuuugacaccuuuuagaucuguauaaaaguguguuguguugaagc

SEQ ID NO: 248251 - RNA, 64 nt, Human
cucauugacuugguuccagaauuuuguaauucuggaucuguauaaggaauggcaucagaacaau

SEQ ID NO: 248252 - RNA, 64 nt, Human
cugcaggcaaacauccugugucugcuuugauggagaucuguaauaaaagaagguggcaaccacc

SEQ ID NO: 248253 - RNA, 64 nt, Human
auuauuacguggcaaaaucccucuggcccacacagaucuguaauucacuaggcucguguuugcu

SEQ ID NO: 248254 - RNA, 64 nt, Human
caguggacugaauuguauggaaggaaauugaucagaucuguaauucacaacuguggaaaccuac

SEQ ID NO: 248255 - RNA, 64 nt, Human
uuaugacacguauguacuagugaacaccguccucgaucuguacgaaaugugaaauguuuaggga

SEQ ID NO: 248256 - RNA, 64 nt, Human
uggaucuuuuuaaaacuaaugaguaugaacuugagaucuguauaaauaagagcaugauuugaaa

SEQ ID NO: 248257 - RNA, 64 nt, Human
ugcagucagcacccguaacccggcuaugaccagggaucuguaagcccuguggcuccacaggugc

SEQ ID NO: 248258 - RNA, 64 nt, Human
ggccucuugccuggggccacucucccacccucucgaucuguauauccuccaguccaagauuaaa

SEQ ID NO: 248259 - RNA, 64 nt, Human
uguuugaaauaugagaauaugcggcuuaaacuuugaucuguaaggagcggggccguggccguuu

SEQ ID NO: 248260 - RNA, 64 nt, Human
gggcauguggguggguaaaugauguaaaugaugugaucuguacaaguauguggagcaugaaugc

SEQ ID NO: 248261 - RNA, 64 nt, Human
uuuuguuuuggaugauggggcagggguuucagaagaucuguaaaacaaauuaaggugcgaacaa

SEQ ID NO: 248262 - RNA, 64 nt, Human
gguguuuuuguguuuucucuuuauaaggcaaaaagaucuguauuuacacuccuucaccuaggga

SEQ ID NO: 248263 - RNA, 64 nt, Human
guuuguuuaccaagcuaugugacuucucccaaaggaucuguacuuucuuuccuuacaacagcuu

SEQ ID NO: 248264 - RNA, 64 nt, Human
aguacaugcuacucaagauauuaagagauaacaagaucuguagaucugcuauugaaucagaauc

SEQ ID NO: 248265 - RNA, 64 nt, Human
ugugugcgugcaugcacauauguguauguguguggaucuguacacacacacguauauauggcca

SEQ ID NO: 248266 - RNA, 64 nt, Human
uuaaagauaauuuagauuucaguucaccucuguggaucuguaucaguuucaaaaacguagaaag

SEQ ID NO: 248267 - RNA, 58 nt, Human
agcaggaggcuggauccuaggccccugggaucuguacccaggaccuggagaauaccac

SEQ ID NO: 248268 - RNA, 64 nt, Human
uagccauaaaugcguauauauacccauagggcuagaucuguaucuuaguguagcgauguauaca

SEQ ID NO: 248269 - RNA, 64 nt, Human
acagauuuuucuggaagacauggauuagcuggaagaucuguauuugauggaagaccuugaaauu

SEQ ID NO: 248270 - RNA, 64 nt, Human
uaaaaaaauggaaauaccuucucccuuauuuugugaucuguaacaggguagugugguauuguaa

SEQ ID NO: 248271 - RNA, 64 nt, Human; identical to SEQ ID NO: 245798

SEQ ID NO: 248272 - RNA, 64 nt, Human; identical to SEQ ID NO: 245799

SEQ ID NO: 248273 - RNA, 64 nt, Human; identical to SEQ ID NO: 245800

SEQ ID NO: 248274 - RNA, 64 nt, Human; identical to SEQ ID NO: 245801

SEQ ID NO: 248275 - RNA, 64 nt, Human; identical to SEQ ID NO: 245802

SEQ ID NO: 248276 - RNA, 64 nt, Human; identical to SEQ ID NO: 245803

SEQ ID NO: 248277 - RNA, 64 nt, Human; identical to SEQ ID NO: 245804

SEQ ID NO: 248278 - RNA, 64 nt, Human; identical to SEQ ID NO: 245808

SEQ ID NO: 248279 - RNA, 64 nt, Human; identical to SEQ ID NO: 245809

SEQ ID NO: 248280 - RNA, 64 nt, Human; identical to SEQ ID NO: 245810

SEQ ID NO: 248281 - RNA, 64 nt, Human; identical to SEQ ID NO: 245811

SEQ ID NO: 248282 - RNA, 64 nt, Human; identical to SEQ ID NO: 245812

SEQ ID NO: 248283 - RNA, 64 nt, Human; identical to SEQ ID NO: 245813

SEQ ID NO: 248284 - RNA, 64 nt, Human; identical to SEQ ID NO: 245814

SEQ ID NO: 248285 - RNA, 64 nt, Human; identical to SEQ ID NO: 245815

SEQ ID NO: 248286 - RNA, 64 nt, Human; identical to SEQ ID NO: 245816

SEQ ID NO: 248287 - RNA, 64 nt, Human; identical to SEQ ID NO: 245817

SEQ ID NO: 248288 - RNA, 64 nt, Human; identical to SEQ ID NO: 245818

SEQ ID NO: 248289 - RNA, 64 nt, Human; identical to SEQ ID NO: 245819

SEQ ID NO: 248290 - RNA, 64 nt, Human; identical to SEQ ID NO: 245820

SEQ ID NO: 248291 - RNA, 64 nt, Human; identical to SEQ ID NO: 245821

SEQ ID NO: 248292 - RNA, 64 nt, Human; identical to SEQ ID NO: 245822

SEQ ID NO: 248293 - RNA, 64 nt, Human; identical to SEQ ID NO: 245826

SEQ ID NO: 248294 - RNA, 64 nt, Human; identical to SEQ ID NO: 245827

SEQ ID NO: 248295 - RNA, 64 nt, Human; identical to SEQ ID NO: 245828

SEQ ID NO: 248296 - RNA, 64 nt, Human; identical to SEQ ID NO: 245829

SEQ ID NO: 248297 - RNA, 64 nt, Human; identical to SEQ ID NO: 245830

SEQ ID NO: 248298 - RNA, 64 nt, Human; identical to SEQ ID NO: 245831

SEQ ID NO: 248299 - RNA, 64 nt, Human; identical to SEQ ID NO: 245832

SEQ ID NO: 248300 - RNA, 64 nt, Human; identical to SEQ ID NO: 245833

SEQ ID NO: 248301 - RNA, 64 nt, Human; identical to SEQ ID NO: 245834

SEQ ID NO: 248302 - RNA, 64 nt, Human; identical to SEQ ID NO: 245835

SEQ ID NO: 248303 - RNA, 64 nt, Human; identical to SEQ ID NO: 245836

SEQ ID NO: 248304 - RNA, 64 nt, Human; identical to SEQ ID NO: 245837

SEQ ID NO: 248305 - RNA, 64 nt, Human; identical to SEQ ID NO: 245838

SEQ ID NO: 248306 - RNA, 64 nt, Human; identical to SEQ ID NO: 245839

SEQ ID NO: 248307 - RNA, 64 nt, Human; identical to SEQ ID NO: 245840

SEQ ID NO: 248308 - RNA, 64 nt, Human; identical to SEQ ID NO: 245844

SEQ ID NO: 248309 - RNA, 64 nt, Human; identical to SEQ ID NO: 245845

SEQ ID NO: 248310 - RNA, 64 nt, Human; identical to SEQ ID NO: 245846

SEQ ID NO: 248311 - RNA, 64 nt, Human; identical to SEQ ID NO: 245847

SEQ ID NO: 248312 - RNA, 64 nt, Human; identical to SEQ ID NO: 245848

SEQ ID NO: 248313 - RNA, 64 nt, Human; identical to SEQ ID NO: 245849

SEQ ID NO: 248314 - RNA, 64 nt, Human; identical to SEQ ID NO: 245850

SEQ ID NO: 248315 - RNA, 64 nt, Human; identical to SEQ ID NO: 245851

SEQ ID NO: 248316 - RNA, 64 nt, Human; identical to SEQ ID NO: 245852

SEQ ID NO: 248317 - RNA, 64 nt, Human; identical to SEQ ID NO: 245853

SEQ ID NO: 248318 - RNA, 64 nt, Human; identical to SEQ ID NO: 245854

SEQ ID NO: 248319 - RNA, 64 nt, Human; identical to SEQ ID NO: 245855

SEQ ID NO: 248320 - RNA, 64 nt, Human; identical to SEQ ID NO: 245856

SEQ ID NO: 248321 - RNA, 64 nt, Human; identical to SEQ ID NO: 245857

SEQ ID NO: 248322 - RNA, 64 nt, Human; identical to SEQ ID NO: 245858

SEQ ID NO: 248323 - RNA, 64 nt, Human; identical to SEQ ID NO: 245862

SEQ ID NO: 248324 - RNA, 64 nt, Human; identical to SEQ ID NO: 245863

SEQ ID NO: 248325 - RNA, 64 nt, Human; identical to SEQ ID NO: 245864

SEQ ID NO: 248326 - RNA, 64 nt, Human; identical to SEQ ID NO: 245865

SEQ ID NO: 248327 - RNA, 64 nt, Human; identical to SEQ ID NO: 245866

SEQ ID NO: 248328 - RNA, 64 nt, Human; identical to SEQ ID NO: 245867

SEQ ID NO: 248329 - RNA, 64 nt, Human; identical to SEQ ID NO: 245868

SEQ ID NO: 248330 - RNA, 64 nt, Human; identical to SEQ ID NO: 245869

SEQ ID NO: 248331 - RNA, 64 nt, Human; identical to SEQ ID NO: 245870

SEQ ID NO: 248332 - RNA, 64 nt, Human; identical to SEQ ID NO: 245871

SEQ ID NO: 248333 - RNA, 64 nt, Human; identical to SEQ ID NO: 245872

SEQ ID NO: 248334 - RNA, 64 nt, Human; identical to SEQ ID NO: 245873

SEQ ID NO: 248335 - RNA, 64 nt, Human; identical to SEQ ID NO: 245874

SEQ ID NO: 248336 - RNA, 64 nt, Human; identical to SEQ ID NO: 245875

SEQ ID NO: 248337 - RNA, 64 nt, Human; identical to SEQ ID NO: 245876

SEQ ID NO: 248338 - RNA, 64 nt, Human; identical to SEQ ID NO: 245880

SEQ ID NO: 248339 - RNA, 64 nt, Human; identical to SEQ ID NO: 245881

SEQ ID NO: 248340 - RNA, 64 nt, Human; identical to SEQ ID NO: 245882

SEQ ID NO: 248341 - RNA, 64 nt, Human; identical to SEQ ID NO: 245883

SEQ ID NO: 248342 - RNA, 64 nt, Human; identical to SEQ ID NO: 245884

SEQ ID NO: 248343 - RNA, 64 nt, Human; identical to SEQ ID NO: 245885

SEQ ID NO: 248344 - RNA, 64 nt, Human; identical to SEQ ID NO: 245886

SEQ ID NO: 248345 - RNA, 64 nt, Human; identical to SEQ ID NO: 245887

SEQ ID NO: 248346 - RNA, 64 nt, Human; identical to SEQ ID NO: 245888

SEQ ID NO: 248347 - RNA, 64 nt, Human; identical to SEQ ID NO: 245889

SEQ ID NO: 248348 - RNA, 64 nt, Human; identical to SEQ ID NO: 245890

SEQ ID NO: 248349 - RNA, 64 nt, Human; identical to SEQ ID NO: 245891

SEQ ID NO: 248350 - RNA, 64 nt, Human; identical to SEQ ID NO: 245892

SEQ ID NO: 248351 - RNA, 64 nt, Human; identical to SEQ ID NO: 245893

SEQ ID NO: 248352 - RNA, 64 nt, Human; identical to SEQ ID NO: 245894

SEQ ID NO: 248353 - RNA, 64 nt, Human; identical to SEQ ID NO: 245898

SEQ ID NO: 248354 - RNA, 64 nt, Human; identical to SEQ ID NO: 245899

SEQ ID NO: 248355 - RNA, 64 nt, Human; identical to SEQ ID NO: 245900

SEQ ID NO: 248356 - RNA, 64 nt, Human; identical to SEQ ID NO: 245901

SEQ ID NO: 248357 - RNA, 64 nt, Human; identical to SEQ ID NO: 245902

SEQ ID NO: 248358 - RNA, 64 nt, Human; identical to SEQ ID NO: 245903

SEQ ID NO: 248359 - RNA, 64 nt, Human; identical to SEQ ID NO: 245904

SEQ ID NO: 248360 - RNA, 64 nt, Human; identical to SEQ ID NO: 245905

SEQ ID NO: 248361 - RNA, 64 nt, Human; identical to SEQ ID NO: 245906

SEQ ID NO: 248362 - RNA, 64 nt, Human; identical to SEQ ID NO: 245907

SEQ ID NO: 248363 - RNA, 64 nt, Human; identical to SEQ ID NO: 245908

SEQ ID NO: 248364 - RNA, 64 nt, Human; identical to SEQ ID NO: 245909

SEQ ID NO: 248365 - RNA, 64 nt, Human; identical to SEQ ID NO: 245910

SEQ ID NO: 248366 - RNA, 64 nt, Human; identical to SEQ ID NO: 245911

SEQ ID NO: 248367 - RNA, 64 nt, Human; identical to SEQ ID NO: 245912

SEQ ID NO: 248368 - RNA, 64 nt, Human; identical to SEQ ID NO: 245916

SEQ ID NO: 248369 - RNA, 64 nt, Human; identical to SEQ ID NO: 245917

SEQ ID NO: 248370 - RNA, 64 nt, Human; identical to SEQ ID NO: 245918

SEQ ID NO: 248371 - RNA, 64 nt, Human; identical to SEQ ID NO: 245919

SEQ ID NO: 248372 - RNA, 64 nt, Human; identical to SEQ ID NO: 245920

SEQ ID NO: 248373 - RNA, 64 nt, Human; identical to SEQ ID NO: 245921

SEQ ID NO: 248374 - RNA, 64 nt, Human; identical to SEQ ID NO: 245922

SEQ ID NO: 248375 - RNA, 57 nt, Human; identical to SEQ ID NO: 245923

SEQ ID NO: 248376 - RNA, 64 nt, Human; identical to SEQ ID NO: 245924

SEQ ID NO: 248377 - RNA, 64 nt, Human; identical to SEQ ID NO: 245925

SEQ ID NO: 248378 - RNA, 64 nt, Human; identical to SEQ ID NO: 245926

SEQ ID NO: 248379 - RNA, 64 nt, Human; identical to SEQ ID NO: 245927

SEQ ID NO: 248380 - RNA, 64 nt, Human; identical to SEQ ID NO: 245928

SEQ ID NO: 248381 - RNA, 64 nt, Human; identical to SEQ ID NO: 245929

SEQ ID NO: 248382 - RNA, 64 nt, Human; identical to SEQ ID NO: 245930

SEQ ID NO: 248383 - RNA, 64 nt, Human; identical to SEQ ID NO: 243268

SEQ ID NO: 248384 - RNA, 64 nt, Human; identical to SEQ ID NO: 243269

SEQ ID NO: 248385 - RNA, 64 nt, Human; identical to SEQ ID NO: 243270

SEQ ID NO: 248386 - RNA, 64 nt, Human; identical to SEQ ID NO: 243271

SEQ ID NO: 248387 - RNA, 64 nt, Human; identical to SEQ ID NO: 243272

SEQ ID NO: 248388 - RNA, 64 nt, Human; identical to SEQ ID NO: 243273

SEQ ID NO: 248389 - RNA, 64 nt, Human; identical to SEQ ID NO: 243274

SEQ ID NO: 248390 - RNA, 64 nt, Human; identical to SEQ ID NO: 243275

SEQ ID NO: 248391 - RNA, 64 nt, Human; identical to SEQ ID NO: 243276

SEQ ID NO: 248392 - RNA, 64 nt, Human; identical to SEQ ID NO: 243277

SEQ ID NO: 248393 - RNA, 64 nt, Human; identical to SEQ ID NO: 245934

SEQ ID NO: 248394 - RNA, 64 nt, Human; identical to SEQ ID NO: 245952

SEQ ID NO: 248395 - RNA, 64 nt, Human; identical to SEQ ID NO: 245953

SEQ ID NO: 248396 - RNA, 64 nt, Human; identical to SEQ ID NO: 245954

SEQ ID NO: 248397 - RNA, 62 nt, Human; identical to SEQ ID NO: 245955

SEQ ID NO: 248398 - RNA, 64 nt, Human; identical to SEQ ID NO: 245956

SEQ ID NO: 248399 - RNA, 64 nt, Human; identical to SEQ ID NO: 245957

SEQ ID NO: 248400 - RNA, 64 nt, Human; identical to SEQ ID NO: 245958

SEQ ID NO: 248401 - RNA, 64 nt, Human; identical to SEQ ID NO: 245959

SEQ ID NO: 248402 - RNA, 64 nt, Human; identical to SEQ ID NO: 245960

SEQ ID NO: 248403 - RNA, 64 nt, Human; identical to SEQ ID NO: 245961

SEQ ID NO: 248404 - RNA, 64 nt, Human; identical to SEQ ID NO: 245962

SEQ ID NO: 248405 - RNA, 64 nt, Human; identical to SEQ ID NO: 245963

SEQ ID NO: 248406 - RNA, 64 nt, Human; identical to SEQ ID NO: 245964

SEQ ID NO: 248407 - RNA, 64 nt, Human; identical to SEQ ID NO: 245965

SEQ ID NO: 248408 - RNA, 64 nt, Human; identical to SEQ ID NO: 245966

SEQ ID NO: 248409 - RNA, 64 nt, Human; identical to SEQ ID NO: 245970

SEQ ID NO: 248410 - RNA, 64 nt, Human; identical to SEQ ID NO: 245971

SEQ ID NO: 248411 - RNA, 64 nt, Human; identical to SEQ ID NO: 245972

SEQ ID NO: 248412 - RNA, 64 nt, Human; identical to SEQ ID NO: 245973

SEQ ID NO: 248413 - RNA, 64 nt, Human; identical to SEQ ID NO: 245974

SEQ ID NO: 248414 - RNA, 64 nt, Human; identical to SEQ ID NO: 245975

SEQ ID NO: 248415 - RNA, 64 nt, Human; identical to SEQ ID NO: 245976

SEQ ID NO: 248416 - RNA, 62 nt, Human; identical to SEQ ID NO: 245977

SEQ ID NO: 248417 - RNA, 64 nt, Human; identical to SEQ ID NO: 245978

SEQ ID NO: 248418 - RNA, 64 nt, Human; identical to SEQ ID NO: 245979

SEQ ID NO: 248419 - RNA, 64 nt, Human; identical to SEQ ID NO: 245980

SEQ ID NO: 248420 - RNA, 64 nt, Human; identical to SEQ ID NO: 245981

SEQ ID NO: 248421 - RNA, 64 nt, Human; identical to SEQ ID NO: 245982

SEQ ID NO: 248422 - RNA, 64 nt, Human; identical to SEQ ID NO: 245983

SEQ ID NO: 248423 - RNA, 64 nt, Human; identical to SEQ ID NO: 245984

SEQ ID NO: 248424 - RNA, 64 nt, Human; identical to SEQ ID NO: 245988

SEQ ID NO: 248425 - RNA, 64 nt, Human; identical to SEQ ID NO: 245989

SEQ ID NO: 248426 - RNA, 64 nt, Human; identical to SEQ ID NO: 245990

SEQ ID NO: 248427 - RNA, 64 nt, Human; identical to SEQ ID NO: 245991

SEQ ID NO: 248428 - RNA, 64 nt, Human; identical to SEQ ID NO: 245992

SEQ ID NO: 248429 - RNA, 64 nt, Human; identical to SEQ ID NO: 245993

SEQ ID NO: 248430 - RNA, 64 nt, Human; identical to SEQ ID NO: 245994

SEQ ID NO: 248431 - RNA, 64 nt, Human; identical to SEQ ID NO: 245995

SEQ ID NO: 248432 - RNA, 64 nt, Human; identical to SEQ ID NO: 245996

SEQ ID NO: 248433 - RNA, 64 nt, Human; identical to SEQ ID NO: 245997

SEQ ID NO: 248434 - RNA, 64 nt, Human; identical to SEQ ID NO: 245998

SEQ ID NO: 248435 - RNA, 64 nt, Human; identical to SEQ ID NO: 245999

SEQ ID NO: 248436 - RNA, 64 nt, Human; identical to SEQ ID NO: 246000

SEQ ID NO: 248437 - RNA, 64 nt, Human; identical to SEQ ID NO: 246001

SEQ ID NO: 248438 - RNA, 64 nt, Human; identical to SEQ ID NO: 246002

SEQ ID NO: 248439 - RNA, 64 nt, Human; identical to SEQ ID NO: 246006

SEQ ID NO: 248440 - RNA, 64 nt, Human; identical to SEQ ID NO: 246007

SEQ ID NO: 248441 - RNA, 64 nt, Human; identical to SEQ ID NO: 246008

SEQ ID NO: 248442 - RNA, 64 nt, Human; identical to SEQ ID NO: 246009

SEQ ID NO: 248443 - RNA, 64 nt, Human; identical to SEQ ID NO: 246010

SEQ ID NO: 248444 - RNA, 64 nt, Human; identical to SEQ ID NO: 246011

SEQ ID NO: 248445 - RNA, 64 nt, Human; identical to SEQ ID NO: 246012

SEQ ID NO: 248446 - RNA, 64 nt, Human; identical to SEQ ID NO: 246013

SEQ ID NO: 248447 - RNA, 64 nt, Human; identical to SEQ ID NO: 246014

SEQ ID NO: 248448 - RNA, 64 nt, Human; identical to SEQ ID NO: 246015

SEQ ID NO: 248449 - RNA, 64 nt, Human; identical to SEQ ID NO: 246016

SEQ ID NO: 248450 - RNA, 64 nt, Human; identical to SEQ ID NO: 246017

SEQ ID NO: 248451 - RNA, 64 nt, Human; identical to SEQ ID NO: 246018

SEQ ID NO: 248452 - RNA, 64 nt, Human; identical to SEQ ID NO: 246019

SEQ ID NO: 248453 - RNA, 64 nt, Human; identical to SEQ ID NO: 246020

SEQ ID NO: 248454 - RNA, 64 nt, Human; identical to SEQ ID NO: 246024

SEQ ID NO: 248455 - RNA, 64 nt, Human; identical to SEQ ID NO: 246025

SEQ ID NO: 248456 - RNA, 64 nt, Human; identical to SEQ ID NO: 246025

SEQ ID NO: 248457 - RNA, 64 nt, Human; identical to SEQ ID NO: 246027

SEQ ID NO: 248458 - RNA, 64 nt, Human; identical to SEQ ID NO: 246028

SEQ ID NO: 248459 - RNA, 64 nt, Human; identical to SEQ ID NO: 246029

SEQ ID NO: 248460 - RNA, 64 nt, Human; identical to SEQ ID NO: 246030

SEQ ID NO: 248461 - RNA, 64 nt, Human; identical to SEQ ID NO: 246031

SEQ ID NO: 248462 - RNA, 64 nt, Human; identical to SEQ ID NO: 246032

SEQ ID NO: 248463 - RNA, 64 nt, Human; identical to SEQ ID NO: 246033

SEQ ID NO: 248464 - RNA, 64 nt, Human; identical to SEQ ID NO: 246034

SEQ ID NO: 248465 - RNA, 64 nt, Human; identical to SEQ ID NO: 246035

SEQ ID NO: 248466 - RNA, 64 nt, Human; identical to SEQ ID NO: 246036

SEQ ID NO: 248467 - RNA, 64 nt, Human; identical to SEQ ID NO: 246037

SEQ ID NO: 248468 - RNA, 64 nt, Human; identical to SEQ ID NO: 246038

SEQ ID NO: 248469 - RNA, 64 nt, Human; identical to SEQ ID NO: 246042

SEQ ID NO: 248470 - RNA, 64 nt, Human; identical to SEQ ID NO: 246043

SEQ ID NO: 248471 - RNA, 64 nt, Human; identical to SEQ ID NO: 246044

SEQ ID NO: 248472 - RNA, 64 nt, Human; identical to SEQ ID NO: 246045

SEQ ID NO: 248473 - RNA, 64 nt, Human; identical to SEQ ID NO: 246046

SEQ ID NO: 248474 - RNA, 64 nt, Human; identical to SEQ ID NO: 246047

SEQ ID NO: 248475 - RNA, 64 nt, Human; identical to SEQ ID NO: 246048

SEQ ID NO: 248476 - RNA, 64 nt, Human; identical to SEQ ID NO: 246049

SEQ ID NO: 248477 - RNA, 64 nt, Human; identical to SEQ ID NO: 246050

SEQ ID NO: 248478 - RNA, 64 nt, Human; identical to SEQ ID NO: 246051

SEQ ID NO: 248479 - RNA, 64 nt, Human; identical to SEQ ID NO: 246052

SEQ ID NO: 248480 - RNA, 64 nt, Human; identical to SEQ ID NO: 246053

SEQ ID NO: 248481 - RNA, 64 nt, Human; identical to SEQ ID NO: 246054

SEQ ID NO: 248482 - RNA, 64 nt, Human; identical to SEQ ID NO: 246055

SEQ ID NO: 248483 - RNA, 64 nt, Human; identical to SEQ ID NO: 246056

SEQ ID NO: 248484 - RNA, 64 nt, Human; identical to SEQ ID NO: 246060

SEQ ID NO: 248485 - RNA, 64 nt, Human; identical to SEQ ID NO: 246061

SEQ ID NO: 248486 - RNA, 64 nt, Human; identical to SEQ ID NO: 246062

SEQ ID NO: 248487 - RNA, 64 nt, Human; identical to SEQ ID NO: 246063

SEQ ID NO: 248488 - RNA, 64 nt, Human; identical to SEQ ID NO: 246064

SEQ ID NO: 248489 - RNA, 64 nt, Human; identical to SEQ ID NO: 246065

SEQ ID NO: 248490 - RNA, 64 nt, Human; identical to SEQ ID NO: 246066

SEQ ID NO: 248491 - RNA, 64 nt, Human; identical to SEQ ID NO: 246067

SEQ ID NO: 248492 - RNA, 64 nt, Human; identical to SEQ ID NO: 246068

SEQ ID NO: 248493 - RNA, 64 nt, Human; identical to SEQ ID NO: 246069

SEQ ID NO: 248494 - RNA, 64 nt, Human; identical to SEQ ID NO: 246070

SEQ ID NO: 248495 - RNA, 64 nt, Human; identical to SEQ ID NO: 246071

SEQ ID NO: 248496 - RNA, 64 nt, Human; identical to SEQ ID NO: 246072

SEQ ID NO: 248497 - RNA, 64 nt, Human; identical to SEQ ID NO: 246073

SEQ ID NO: 248498 - RNA, 64 nt, Human; identical to SEQ ID NO: 246074

SEQ ID NO: 248499 - RNA, 64 nt, Human; identical to SEQ ID NO: 246078

SEQ ID NO: 248500 - RNA, 64 nt, Human; identical to SEQ ID NO: 246079

SEQ ID NO: 248501 - RNA, 64 nt, Human; identical to SEQ ID NO: 246080

SEQ ID NO: 248502 - RNA, 64 nt, Human; identical to SEQ ID NO: 246081

SEQ ID NO: 248503 - RNA, 64 nt, Human; identical to SEQ ID NO: 246082

SEQ ID NO: 248504 - RNA, 64 nt, Human; identical to SEQ ID NO: 246083

SEQ ID NO: 248505 - RNA, 64 nt, Human; identical to SEQ ID NO: 246084

SEQ ID NO: 248506 - RNA, 64 nt, Human; identical to SEQ ID NO: 246085

SEQ ID NO: 248507 - RNA, 64 nt, Human; identical to SEQ ID NO: 246086

SEQ ID NO: 248508 - RNA, 64 nt, Human; identical to SEQ ID NO: 246087

SEQ ID NO: 248509 - RNA, 64 nt, Human; identical to SEQ ID NO: 246088

SEQ ID NO: 248510 - RNA, 64 nt, Human; identical to SEQ ID NO: 246089

SEQ ID NO: 248511 - RNA, 64 nt, Human; identical to SEQ ID NO: 246090

SEQ ID NO: 248512 - RNA, 64 nt, Human; identical to SEQ ID NO: 246091

SEQ ID NO: 248513 - RNA, 64 nt, Human; identical to SEQ ID NO: 246092

SEQ ID NO: 248514 - RNA, 56 nt, Human; identical to SEQ ID NO: 246096

SEQ ID NO: 248515 - RNA, 64 nt, Human; identical to SEQ ID NO: 246097

SEQ ID NO: 248516 - RNA, 64 nt, Human; identical to SEQ ID NO: 246098

SEQ ID NO: 248517 - RNA, 64 nt, Human; identical to SEQ ID NO: 246099

SEQ ID NO: 248518 - RNA, 64 nt, Human; identical to SEQ ID NO: 246100

SEQ ID NO: 248519 - RNA, 64 nt, Human; identical to SEQ ID NO: 246101

SEQ ID NO: 248520 - RNA, 64 nt, Human; identical to SEQ ID NO: 246102

SEQ ID NO: 248521 - RNA, 64 nt, Human; identical to SEQ ID NO: 246103

SEQ ID NO: 248522 - RNA, 64 nt, Human; identical to SEQ ID NO: 246104

SEQ ID NO: 248523 - RNA, 64 nt, Human; identical to SEQ ID NO: 246105

SEQ ID NO: 248524 - RNA, 64 nt, Human; identical to SEQ ID NO: 246106

SEQ ID NO: 248525 - RNA, 64 nt, Human; identical to SEQ ID NO: 246107

SEQ ID NO: 248526 - RNA, 64 nt, Human; identical to SEQ ID NO: 246108

SEQ ID NO: 248527 - RNA, 64 nt, Human; identical to SEQ ID NO: 246109

SEQ ID NO: 248528 - RNA, 64 nt, Human; identical to SEQ ID NO: 246110

SEQ ID NO: 248529 - RNA, 64 nt, Human; identical to SEQ ID NO: 246114

SEQ ID NO: 248530 - RNA, 64 nt, Human; identical to SEQ ID NO: 246115

SEQ ID NO: 248531 - RNA, 64 nt, Human; identical to SEQ ID NO: 246116

SEQ ID NO: 248532 - RNA, 64 nt, Human; identical to SEQ ID NO: 246117

SEQ ID NO: 248533 - RNA, 64 nt, Human; identical to SEQ ID NO: 246118

SEQ ID NO: 248534 - RNA, 64 nt, Human; identical to SEQ ID NO: 246119

SEQ ID NO: 248535 - RNA, 64 nt, Human; identical to SEQ ID NO: 246120

SEQ ID NO: 248536 - RNA, 64 nt, Human; identical to SEQ ID NO: 246121

SEQ ID NO: 248537 - RNA, 64 nt, Human; identical to SEQ ID NO: 246122

SEQ ID NO: 248538 - RNA, 64 nt, Human; identical to SEQ ID NO: 246123

SEQ ID NO: 248539 - RNA, 64 nt, Human; identical to SEQ ID NO: 246124

SEQ ID NO: 248540 - RNA, 64 nt, Human; identical to SEQ ID NO: 246125

SEQ ID NO: 248541 - RNA, 64 nt, Human; identical to SEQ ID NO: 246126

SEQ ID NO: 248542 - RNA, 64 nt, Human; identical to SEQ ID NO: 246127

SEQ ID NO: 248543 - RNA, 64 nt, Human; identical to SEQ ID NO: 246128

SEQ ID NO: 248544 - RNA, 64 nt, Human; identical to SEQ ID NO: 246132

SEQ ID NO: 248545 - RNA, 64 nt, Human; identical to SEQ ID NO: 246133

SEQ ID NO: 248546 - RNA, 64 nt, Human; identical to SEQ ID NO: 246134

SEQ ID NO: 248547 - RNA, 64 nt, Human; identical to SEQ ID NO: 246135

SEQ ID NO: 248548 - RNA, 64 nt, Human; identical to SEQ ID NO: 246136

SEQ ID NO: 248549 - RNA, 64 nt, Human; identical to SEQ ID NO: 246137

SEQ ID NO: 248550 - RNA, 64 nt, Human; identical to SEQ ID NO: 246138

SEQ ID NO: 248551 - RNA, 64 nt, Human; identical to SEQ ID NO: 246139

SEQ ID NO: 248552 - RNA, 64 nt, Human; identical to SEQ ID NO: 246140

SEQ ID NO: 248553 - RNA, 64 nt, Human; identical to SEQ ID NO: 246141

SEQ ID NO: 248554 - RNA, 64 nt, Human; identical to SEQ ID NO: 246142

SEQ ID NO: 248555 - RNA, 64 nt, Human; identical to SEQ ID NO: 246143

SEQ ID NO: 248556 - RNA, 64 nt, Human; identical to SEQ ID NO: 246144

SEQ ID NO: 248557 - RNA, 64 nt, Human; identical to SEQ ID NO: 246145

SEQ ID NO: 248558 - RNA, 64 nt, Human; identical to SEQ ID NO: 246146

SEQ ID NO: 248559 - RNA, 64 nt, Human; identical to SEQ ID NO: 246150

SEQ ID NO: 248560 - RNA, 64 nt, Human; identical to SEQ ID NO: 246151

SEQ ID NO: 248561 - RNA, 64 nt, Human; identical to SEQ ID NO: 246152

SEQ ID NO: 248562 - RNA, 64 nt, Human; identical to SEQ ID NO: 246153

SEQ ID NO: 248563 - RNA, 64 nt, Human; identical to SEQ ID NO: 246154

SEQ ID NO: 248564 - RNA, 64 nt, Human; identical to SEQ ID NO: 246155

SEQ ID NO: 248565 - RNA, 64 nt, Human; identical to SEQ ID NO: 246156

SEQ ID NO: 248566 - RNA, 64 nt, Human; identical to SEQ ID NO: 246157

SEQ ID NO: 248567 - RNA, 64 nt, Human; identical to SEQ ID NO: 246158

SEQ ID NO: 248568 - RNA, 64 nt, Human; identical to SEQ ID NO: 246159

SEQ ID NO: 248569 - RNA, 64 nt, Human; identical to SEQ ID NO: 246160

SEQ ID NO: 248570 - RNA, 64 nt, Human; identical to SEQ ID NO: 246161

SEQ ID NO: 248571 - RNA, 64 nt, Human; identical to SEQ ID NO: 246162

SEQ ID NO: 248572 - RNA, 64 nt, Human; identical to SEQ ID NO: 246163

SEQ ID NO: 248573 - RNA, 64 nt, Human; identical to SEQ ID NO: 246164

SEQ ID NO: 248574 - RNA, 64 nt, Human; identical to SEQ ID NO: 246168

SEQ ID NO: 248575 - RNA, 64 nt, Human; identical to SEQ ID NO: 246169

SEQ ID NO: 248576 - RNA, 64 nt, Human; identical to SEQ ID NO: 246170

SEQ ID NO: 248577 - RNA, 55 nt, Human; identical to SEQ ID NO: 246171

SEQ ID NO: 248578 - RNA, 64 nt, Human; identical to SEQ ID NO: 246172

SEQ ID NO: 248579 - RNA, 64 nt, Human; identical to SEQ ID NO: 246173

SEQ ID NO: 248580 - RNA, 64 nt, Human; identical to SEQ ID NO: 246174

SEQ ID NO: 248581 - RNA, 64 nt, Human; identical to SEQ ID NO: 246175

SEQ ID NO: 248582 - RNA, 64 nt, Human; identical to SEQ ID NO: 246176

SEQ ID NO: 248583 - RNA, 64 nt, Human; identical to SEQ ID NO: 246177

SEQ ID NO: 248584 - RNA, 64 nt, Human; identical to SEQ ID NO: 246178

SEQ ID NO: 248585 - RNA, 64 nt, Human; identical to SEQ ID NO: 246179

SEQ ID NO: 248586 - RNA, 64 nt, Human; identical to SEQ ID NO: 246180

SEQ ID NO: 248587 - RNA, 64 nt, Human; identical to SEQ ID NO: 246181

SEQ ID NO: 248588 - RNA, 64 nt, Human; identical to SEQ ID NO: 246182

SEQ ID NO: 248589 - RNA, 64 nt, Human; identical to SEQ ID NO: 246186

SEQ ID NO: 248590 - RNA, 64 nt, Human; identical to SEQ ID NO: 246187

SEQ ID NO: 248591 - RNA, 64 nt, Human; identical to SEQ ID NO: 246188

SEQ ID NO: 248592 - RNA, 64 nt, Human; identical to SEQ ID NO: 246189

SEQ ID NO: 248593 - RNA, 64 nt, Human; identical to SEQ ID NO: 246190

SEQ ID NO: 248594 - RNA, 64 nt, Human; identical to SEQ ID NO: 246191

SEQ ID NO: 248595 - RNA, 64 nt, Human; identical to SEQ ID NO: 246192

SEQ ID NO: 248596 - RNA, 64 nt, Human; identical to SEQ ID NO: 246193

SEQ ID NO: 248597 - RNA, 64 nt, Human; identical to SEQ ID NO: 246194

SEQ ID NO: 248598 - RNA, 64 nt, Human; identical to SEQ ID NO: 246195

SEQ ID NO: 248599 - RNA, 64 nt, Human; identical to SEQ ID NO: 246196

SEQ ID NO: 248600 - RNA, 64 nt, Human; identical to SEQ ID NO: 246197

SEQ ID NO: 248601 - RNA, 64 nt, Human; identical to SEQ ID NO: 246198

SEQ ID NO: 248602 - RNA, 64 nt, Human; identical to SEQ ID NO: 246199

SEQ ID NO: 248603 - RNA, 64 nt, Human; identical to SEQ ID NO: 246200

SEQ ID NO: 248604 - RNA, 64 nt, Human; identical to SEQ ID NO: 246204

SEQ ID NO: 248605 - RNA, 64 nt, Human; identical to SEQ ID NO: 246205

SEQ ID NO: 248606 - RNA, 64 nt, Human; identical to SEQ ID NO: 246206

SEQ ID NO: 248607 - RNA, 64 nt, Human; identical to SEQ ID NO: 246207

SEQ ID NO: 248608 - RNA, 64 nt, Human; identical to SEQ ID NO: 246208

SEQ ID NO: 248609 - RNA, 64 nt, Human; identical to SEQ ID NO: 246209

SEQ ID NO: 248610 - RNA, 64 nt, Human; identical to SEQ ID NO: 246210

SEQ ID NO: 248611 - RNA, 64 nt, Human; identical to SEQ ID NO: 246211

SEQ ID NO: 248612 - RNA, 64 nt, Human; identical to SEQ ID NO: 246212

SEQ ID NO: 248613 - RNA, 64 nt, Human; identical to SEQ ID NO: 246213

SEQ ID NO: 248614 - RNA, 64 nt, Human; identical to SEQ ID NO: 246214

SEQ ID NO: 248615 - RNA, 64 nt, Human; identical to SEQ ID NO: 246215

SEQ ID NO: 248616 - RNA, 64 nt, Human; identical to SEQ ID NO: 246216

SEQ ID NO: 248617 - RNA, 64 nt, Human; identical to SEQ ID NO: 246217

SEQ ID NO: 248618 - RNA, 64 nt, Human; identical to SEQ ID NO: 246218

SEQ ID NO: 248619 - RNA, 64 nt, Human; identical to SEQ ID NO: 246222

SEQ ID NO: 248620 - RNA, 64 nt, Human; identical to SEQ ID NO: 246223

SEQ ID NO: 248621 - RNA, 54 nt, Human; identical to SEQ ID NO: 246224

SEQ ID NO: 248622 - RNA, 64 nt, Human; identical to SEQ ID NO: 246225

SEQ ID NO: 248623 - RNA, 64 nt, Human; identical to SEQ ID NO: 246226

SEQ ID NO: 248624 - RNA, 64 nt, Human; identical to SEQ ID NO: 246227

SEQ ID NO: 248625 - RNA, 64 nt, Human; identical to SEQ ID NO: 246228

SEQ ID NO: 248626 - RNA, 64 nt, Human; identical to SEQ ID NO: 246229

SEQ ID NO: 248627 - RNA, 64 nt, Human; identical to SEQ ID NO: 246230

SEQ ID NO: 248628 - RNA, 64 nt, Human; identical to SEQ ID NO: 246231

SEQ ID NO: 248629 - RNA, 64 nt, Human; identical to SEQ ID NO: 246232

SEQ ID NO: 248630 - RNA, 64 nt, Human; identical to SEQ ID NO: 246233

SEQ ID NO: 248631 - RNA, 64 nt, Human; identical to SEQ ID NO: 246234

SEQ ID NO: 248632 - RNA, 64 nt, Human; identical to SEQ ID NO: 246235

SEQ ID NO: 248633 - RNA, 64 nt, Human; identical to SEQ ID NO: 246236

SEQ ID NO: 248634 - RNA, 64 nt, Human; identical to SEQ ID NO: 246240

SEQ ID NO: 248635 - RNA, 64 nt, Human; identical to SEQ ID NO: 246241

SEQ ID NO: 248636 - RNA, 64 nt, Human; identical to SEQ ID NO: 246242

SEQ ID NO: 248637 - RNA, 64 nt, Human; identical to SEQ ID NO: 246243

SEQ ID NO: 248638 - RNA, 64 nt, Human; identical to SEQ ID NO: 246244

SEQ ID NO: 248639 - RNA, 64 nt, Human; identical to SEQ ID NO: 246245

SEQ ID NO: 248640 - RNA, 64 nt, Human; identical to SEQ ID NO: 246246

SEQ ID NO: 248641 - RNA, 64 nt, Human; identical to SEQ ID NO: 246247

SEQ ID NO: 248642 - RNA, 64 nt, Human; identical to SEQ ID NO: 246248

SEQ ID NO: 248643 - RNA, 64 nt, Human; identical to SEQ ID NO: 246249

SEQ ID NO: 248644 - RNA, 64 nt, Human; identical to SEQ ID NO: 246250

SEQ ID NO: 248645 - RNA, 64 nt, Human; identical to SEQ ID NO: 246251

SEQ ID NO: 248646 - RNA, 64 nt, Human; identical to SEQ ID NO: 246252

SEQ ID NO: 248647 - RNA, 64 nt, Human; identical to SEQ ID NO: 246253

SEQ ID NO: 248648 - RNA, 64 nt, Human; identical to SEQ ID NO: 246254

SEQ ID NO: 248649 - RNA, 55 nt, Human; identical to SEQ ID NO: 246258

SEQ ID NO: 248650 - RNA, 64 nt, Human; identical to SEQ ID NO: 246259

SEQ ID NO: 248651 - RNA, 64 nt, Human; identical to SEQ ID NO: 246260

SEQ ID NO: 248652 - RNA, 64 nt, Human; identical to SEQ ID NO: 246261

SEQ ID NO: 248653 - RNA, 64 nt, Human; identical to SEQ ID NO: 246262

SEQ ID NO: 248654 - RNA, 64 nt, Human; identical to SEQ ID NO: 246263

SEQ ID NO: 248655 - RNA, 64 nt, Human; identical to SEQ ID NO: 246264

SEQ ID NO: 248656 - RNA, 64 nt, Human; identical to SEQ ID NO: 246265

SEQ ID NO: 248657 - RNA, 64 nt, Human; identical to SEQ ID NO: 246266

SEQ ID NO: 248658 - RNA, 64 nt, Human; identical to SEQ ID NO: 246267

SEQ ID NO: 248659 - RNA, 64 nt, Human; identical to SEQ ID NO: 246268

SEQ ID NO: 248660 - RNA, 64 nt, Human; identical to SEQ ID NO: 246269

SEQ ID NO: 248661 - RNA, 64 nt, Human; identical to SEQ ID NO: 246270

SEQ ID NO: 248662 - RNA, 64 nt, Human; identical to SEQ ID NO: 246271

SEQ ID NO: 248663 - RNA, 64 nt, Human; identical to SEQ ID NO: 246272

SEQ ID NO: 248664 - RNA, 64 nt, Human; identical to SEQ ID NO: 246276

SEQ ID NO: 248665 - RNA, 64 nt, Human; identical to SEQ ID NO: 246277

SEQ ID NO: 248666 - RNA, 64 nt, Human; identical to SEQ ID NO: 246278

SEQ ID NO: 248667 - RNA, 64 nt, Human; identical to SEQ ID NO: 246279

SEQ ID NO: 248668 - RNA, 64 nt, Human; identical to SEQ ID NO: 246280

SEQ ID NO: 248669 - RNA, 64 nt, Human; identical to SEQ ID NO: 246281

SEQ ID NO: 248670 - RNA, 64 nt, Human; identical to SEQ ID NO: 246282

SEQ ID NO: 248671 - RNA, 64 nt, Human; identical to SEQ ID NO: 246283

SEQ ID NO: 248672 - RNA, 64 nt, Human; identical to SEQ ID NO: 246284

SEQ ID NO: 248673 - RNA, 64 nt, Human; identical to SEQ ID NO: 246285

SEQ ID NO: 248674 - RNA, 64 nt, Human; identical to SEQ ID NO: 246286

SEQ ID NO: 248675 - RNA, 64 nt, Human; identical to SEQ ID NO: 246287

SEQ ID NO: 248676 - RNA, 64 nt, Human; identical to SEQ ID NO: 246288

SEQ ID NO: 248677 - RNA, 64 nt, Human; identical to SEQ ID NO: 246289

SEQ ID NO: 248678 - RNA, 64 nt, Human; identical to SEQ ID NO: 246290

SEQ ID NO: 248679 - RNA, 64 nt, Human; identical to SEQ ID NO: 246294

SEQ ID NO: 248680 - RNA, 64 nt, Human; identical to SEQ ID NO: 246295

SEQ ID NO: 248681 - RNA, 64 nt, Human; identical to SEQ ID NO: 246296

SEQ ID NO: 248682 - RNA, 64 nt, Human; identical to SEQ ID NO: 246297

SEQ ID NO: 248683 - RNA, 64 nt, Human; identical to SEQ ID NO: 246298

SEQ ID NO: 248684 - RNA, 64 nt, Human; identical to SEQ ID NO: 246299

SEQ ID NO: 248685 - RNA, 64 nt, Human; identical to SEQ ID NO: 246300

SEQ ID NO: 248686 - RNA, 64 nt, Human; identical to SEQ ID NO: 246301

SEQ ID NO: 248687 - RNA, 64 nt, Human; identical to SEQ ID NO: 246302

SEQ ID NO: 248688 - RNA, 64 nt, Human; identical to SEQ ID NO: 246303

SEQ ID NO: 248689 - RNA, 64 nt, Human; identical to SEQ ID NO: 246304

SEQ ID NO: 248690 - RNA, 64 nt, Human; identical to SEQ ID NO: 246305

SEQ ID NO: 248691 - RNA, 64 nt, Human; identical to SEQ ID NO: 246306

SEQ ID NO: 248692 - RNA, 64 nt, Human; identical to SEQ ID NO: 246307

SEQ ID NO: 248693 - RNA, 64 nt, Human; identical to SEQ ID NO: 246308

SEQ ID NO: 248694 - RNA, 64 nt, Human; identical to SEQ ID NO: 246312

SEQ ID NO: 248695 - RNA, 64 nt, Human; identical to SEQ ID NO: 246313

SEQ ID NO: 248696 - RNA, 64 nt, Human; identical to SEQ ID NO: 246314

SEQ ID NO: 248697 - RNA, 64 nt, Human; identical to SEQ ID NO: 246315

SEQ ID NO: 248698 - RNA, 64 nt, Human; identical to SEQ ID NO: 246316

SEQ ID NO: 248699 - RNA, 64 nt, Human; identical to SEQ ID NO: 246317

SEQ ID NO: 248700 - RNA, 64 nt, Human; identical to SEQ ID NO: 246318

SEQ ID NO: 248701 - RNA, 64 nt, Human; identical to SEQ ID NO: 246319

SEQ ID NO: 248702 - RNA, 64 nt, Human; identical to SEQ ID NO: 246320

SEQ ID NO: 248703 - RNA, 64 nt, Human; identical to SEQ ID NO: 246321

SEQ ID NO: 248704 - RNA, 64 nt, Human; identical to SEQ ID NO: 246322

SEQ ID NO: 248705 - RNA, 64 nt, Human; identical to SEQ ID NO: 246323

SEQ ID NO: 248706 - RNA, 64 nt, Human; identical to SEQ ID NO: 246324

SEQ ID NO: 248707 - RNA, 64 nt, Human; identical to SEQ ID NO: 246325

SEQ ID NO: 248708 - RNA, 64 nt, Human; identical to SEQ ID NO: 246326

SEQ ID NO: 248709 - RNA, 64 nt, Human; identical to SEQ ID NO: 246330

SEQ ID NO: 248710 - RNA, 64 nt, Human; identical to SEQ ID NO: 246331

SEQ ID NO: 248711 - RNA, 64 nt, Human; identical to SEQ ID NO: 246332

SEQ ID NO: 248712 - RNA, 64 nt, Human; identical to SEQ ID NO: 246333

SEQ ID NO: 248713 - RNA, 64 nt, Human; identical to SEQ ID NO: 246334

SEQ ID NO: 248714 - RNA, 64 nt, Human; identical to SEQ ID NO: 246335

SEQ ID NO: 248715 - RNA, 64 nt, Human; identical to SEQ ID NO: 246336

SEQ ID NO: 248716 - RNA, 64 nt, Human; identical to SEQ ID NO: 246337

SEQ ID NO: 248717 - RNA, 64 nt, Human; identical to SEQ ID NO: 246338

SEQ ID NO: 248718 - RNA, 64 nt, Human; identical to SEQ ID NO: 246339

SEQ ID NO: 248719 - RNA, 64 nt, Human; identical to SEQ ID NO: 246340

SEQ ID NO: 248720 - RNA, 64 nt, Human; identical to SEQ ID NO: 246341

SEQ ID NO: 248721 - RNA, 64 nt, Human; identical to SEQ ID NO: 246342

SEQ ID NO: 248722 - RNA, 64 nt, Human; identical to SEQ ID NO: 246343

SEQ ID NO: 248723 - RNA, 64 nt, Human; identical to SEQ ID NO: 246344

SEQ ID NO: 248724 - RNA, 64 nt, Human; identical to SEQ ID NO: 246348

SEQ ID NO: 248725 - RNA, 64 nt, Human; identical to SEQ ID NO: 246349

SEQ ID NO: 248726 - RNA, 64 nt, Human; identical to SEQ ID NO: 246350

SEQ ID NO: 248727 - RNA, 64 nt, Human; identical to SEQ ID NO: 246351

SEQ ID NO: 248728 - RNA, 64 nt, Human; identical to SEQ ID NO: 246352

SEQ ID NO: 248729 - RNA, 64 nt, Human; identical to SEQ ID NO: 246353

SEQ ID NO: 248730 - RNA, 64 nt, Human; identical to SEQ ID NO: 246354

SEQ ID NO: 248731 - RNA, 64 nt, Human; identical to SEQ ID NO: 246355

SEQ ID NO: 248732 - RNA, 64 nt, Human; identical to SEQ ID NO: 246356

SEQ ID NO: 248733 - RNA, 64 nt, Human; identical to SEQ ID NO: 246357

SEQ ID NO: 248734 - RNA, 64 nt, Human; identical to SEQ ID NO: 246358

SEQ ID NO: 248735 - RNA, 64 nt, Human; identical to SEQ ID NO: 246359

SEQ ID NO: 248736 - RNA, 64 nt, Human; identical to SEQ ID NO: 246360

SEQ ID NO: 248737 - RNA, 64 nt, Human; identical to SEQ ID NO: 246361

SEQ ID NO: 248738 - RNA, 64 nt, Human; identical to SEQ ID NO: 246362

SEQ ID NO: 248739 - RNA, 64 nt, Human; identical to SEQ ID NO: 246366

SEQ ID NO: 248740 - RNA, 64 nt, Human; identical to SEQ ID NO: 246367

SEQ ID NO: 248741 - RNA, 64 nt, Human; identical to SEQ ID NO: 246368

SEQ ID NO: 248742 - RNA, 64 nt, Human; identical to SEQ ID NO: 246369

SEQ ID NO: 248743 - RNA, 64 nt, Human; identical to SEQ ID NO: 246370

SEQ ID NO: 248744 - RNA, 64 nt, Human; identical to SEQ ID NO: 246371

SEQ ID NO: 248745 - RNA, 64 nt, Human; identical to SEQ ID NO: 246372

SEQ ID NO: 248746 - RNA, 64 nt, Human; identical to SEQ ID NO: 246373

SEQ ID NO: 248747 - RNA, 64 nt, Human; identical to SEQ ID NO: 246374

SEQ ID NO: 248748 - RNA, 64 nt, Human; identical to SEQ ID NO: 246375

SEQ ID NO: 248749 - RNA, 57 nt, Human; identical to SEQ ID NO: 246376

SEQ ID NO: 248750 - RNA, 64 nt, Human; identical to SEQ ID NO: 246377

SEQ ID NO: 248751 - RNA, 64 nt, Human; identical to SEQ ID NO: 246378

SEQ ID NO: 248752 - RNA, 64 nt, Human; identical to SEQ ID NO: 246379

SEQ ID NO: 248753 - RNA, 64 nt, Human; identical to SEQ ID NO: 246380

SEQ ID NO: 248754 - RNA, 64 nt, Human; identical to SEQ ID NO: 246384

SEQ ID NO: 248755 - RNA, 64 nt, Human; identical to SEQ ID NO: 246385

SEQ ID NO: 248756 - RNA, 64 nt, Human; identical to SEQ ID NO: 246386

SEQ ID NO: 248757 - RNA, 64 nt, Human; identical to SEQ ID NO: 246387

SEQ ID NO: 248758 - RNA, 64 nt, Human; identical to SEQ ID NO: 246388

SEQ ID NO: 248759 - RNA, 64 nt, Human; identical to SEQ ID NO: 246389

SEQ ID NO: 248760 - RNA, 64 nt, Human; identical to SEQ ID NO: 246390

SEQ ID NO: 248761 - RNA, 64 nt, Human; identical to SEQ ID NO: 246391

SEQ ID NO: 248762 - RNA, 64 nt, Human; identical to SEQ ID NO: 246392

SEQ ID NO: 248763 - RNA, 64 nt, Human; identical to SEQ ID NO: 246393

SEQ ID NO: 248764 - RNA, 64 nt, Human; identical to SEQ ID NO: 246394

SEQ ID NO: 248765 - RNA, 64 nt, Human; identical to SEQ ID NO: 246395

SEQ ID NO: 248766 - RNA, 64 nt, Human; identical to SEQ ID NO: 246396

SEQ ID NO: 248767 - RNA, 64 nt, Human; identical to SEQ ID NO: 246397

SEQ ID NO: 248768 - RNA, 64 nt, Human; identical to SEQ ID NO: 246398

SEQ ID NO: 248769 - RNA, 64 nt, Human; identical to SEQ ID NO: 246402

SEQ ID NO: 248770 - RNA, 64 nt, Human; identical to SEQ ID NO: 246403

SEQ ID NO: 248771 - RNA, 64 nt, Human; identical to SEQ ID NO: 246404

SEQ ID NO: 248772 - RNA, 64 nt, Human; identical to SEQ ID NO: 246405

SEQ ID NO: 248773 - RNA, 64 nt, Human; identical to SEQ ID NO: 246406

SEQ ID NO: 248774 - RNA, 64 nt, Human; identical to SEQ ID NO: 246407

SEQ ID NO: 248775 - RNA, 64 nt, Human; identical to SEQ ID NO: 246408

SEQ ID NO: 248776 - RNA, 64 nt, Human; identical to SEQ ID NO: 246409

SEQ ID NO: 248777 - RNA, 64 nt, Human; identical to SEQ ID NO: 246410

SEQ ID NO: 248778 - RNA, 64 nt, Human; identical to SEQ ID NO: 246411

SEQ ID NO: 248779 - RNA, 64 nt, Human; identical to SEQ ID NO: 246412

SEQ ID NO: 248780 - RNA, 64 nt, Human; identical to SEQ ID NO: 246413

SEQ ID NO: 248781 - RNA, 64 nt, Human; identical to SEQ ID NO: 246414

SEQ ID NO: 248782 - RNA, 64 nt, Human; identical to SEQ ID NO: 246415

SEQ ID NO: 248783 - RNA, 64 nt, Human; identical to SEQ ID NO: 246416

SEQ ID NO: 248784 - RNA, 64 nt, Human; identical to SEQ ID NO: 246420

SEQ ID NO: 248785 - RNA, 64 nt, Human; identical to SEQ ID NO: 246421

SEQ ID NO: 248786 - RNA, 64 nt, Human; identical to SEQ ID NO: 246422

SEQ ID NO: 248787 - RNA, 64 nt, Human; identical to SEQ ID NO: 246423

SEQ ID NO: 248788 - RNA, 64 nt, Human; identical to SEQ ID NO: 246424

SEQ ID NO: 248789 - RNA, 64 nt, Human; identical to SEQ ID NO: 246425

SEQ ID NO: 248790 - RNA, 64 nt, Human; identical to SEQ ID NO: 246426

SEQ ID NO: 248791 - RNA, 64 nt, Human; identical to SEQ ID NO: 246427

SEQ ID NO: 248792 - RNA, 64 nt, Human; identical to SEQ ID NO: 246428

SEQ ID NO: 248793 - RNA, 64 nt, Human; identical to SEQ ID NO: 246429

SEQ ID NO: 248794 - RNA, 64 nt, Human; identical to SEQ ID NO: 246430

SEQ ID NO: 248795 - RNA, 64 nt, Human; identical to SEQ ID NO: 246431

SEQ ID NO: 248796 - RNA, 64 nt, Human; identical to SEQ ID NO: 246432

SEQ ID NO: 248797 - RNA, 64 nt, Human; identical to SEQ ID NO: 246433

SEQ ID NO: 248798 - RNA, 64 nt, Human; identical to SEQ ID NO: 246434

SEQ ID NO: 248799 - RNA, 64 nt, Human; identical to SEQ ID NO: 246438

SEQ ID NO: 248800 - RNA, 64 nt, Human; identical to SEQ ID NO: 246439

SEQ ID NO: 248801 - RNA, 64 nt, Human; identical to SEQ ID NO: 246440

SEQ ID NO: 248802 - RNA, 64 nt, Human; identical to SEQ ID NO: 246441

SEQ ID NO: 248803 - RNA, 64 nt, Human; identical to SEQ ID NO: 246442

SEQ ID NO: 248804 - RNA, 64 nt, Human; identical to SEQ ID NO: 246443

SEQ ID NO: 248805 - RNA, 64 nt, Human; identical to SEQ ID NO: 246444

SEQ ID NO: 248806 - RNA, 64 nt, Human; identical to SEQ ID NO: 246445

SEQ ID NO: 248807 - RNA, 64 nt, Human; identical to SEQ ID NO: 246446

SEQ ID NO: 248808 - RNA, 64 nt, Human; identical to SEQ ID NO: 246447

SEQ ID NO: 248809 - RNA, 64 nt, Human; identical to SEQ ID NO: 246448

SEQ ID NO: 248810 - RNA, 64 nt, Human; identical to SEQ ID NO: 246449

SEQ ID NO: 248811 - RNA, 64 nt, Human; identical to SEQ ID NO: 246450

SEQ ID NO: 248812 - RNA, 64 nt, Human; identical to SEQ ID NO: 246451

SEQ ID NO: 248813 - RNA, 64 nt, Human; identical to SEQ ID NO: 246452

SEQ ID NO: 248814 - RNA, 64 nt, Human; identical to SEQ ID NO: 246456

SEQ ID NO: 248815 - RNA, 64 nt, Human; identical to SEQ ID NO: 246457

SEQ ID NO: 248816 - RNA, 64 nt, Human; identical to SEQ ID NO: 246458

SEQ ID NO: 248817 - RNA, 64 nt, Human; identical to SEQ ID NO: 246459

SEQ ID NO: 248818 - RNA, 64 nt, Human; identical to SEQ ID NO: 246460

SEQ ID NO: 248819 - RNA, 64 nt, Human; identical to SEQ ID NO: 246461

SEQ ID NO: 248820 - RNA, 64 nt, Human; identical to SEQ ID NO: 246462

SEQ ID NO: 248821 - RNA, 64 nt, Human; identical to SEQ ID NO: 246463

SEQ ID NO: 248822 - RNA, 64 nt, Human; identical to SEQ ID NO: 246464

SEQ ID NO: 248823 - RNA, 64 nt, Human; identical to SEQ ID NO: 246465

SEQ ID NO: 248824 - RNA, 64 nt, Human; identical to SEQ ID NO: 246466

SEQ ID NO: 248825 - RNA, 64 nt, Human; identical to SEQ ID NO: 246467

SEQ ID NO: 248826 - RNA, 64 nt, Human; identical to SEQ ID NO: 246468

SEQ ID NO: 248827 - RNA, 64 nt, Human; identical to SEQ ID NO: 246469

SEQ ID NO: 248828 - RNA, 64 nt, Human; identical to SEQ ID NO: 246470

SEQ ID NO: 248829 - RNA, 64 nt, Human; identical to SEQ ID NO: 246474

SEQ ID NO: 248830 - RNA, 64 nt, Human; identical to SEQ ID NO: 246475

SEQ ID NO: 248831 - RNA, 64 nt, Human; identical to SEQ ID NO: 246476

SEQ ID NO: 248832 - RNA, 64 nt, Human; identical to SEQ ID NO: 246477

SEQ ID NO: 248833 - RNA, 64 nt, Human; identical to SEQ ID NO: 246478

SEQ ID NO: 248834 - RNA, 64 nt, Human; identical to SEQ ID NO: 246479

SEQ ID NO: 248835 - RNA, 64 nt, Human; identical to SEQ ID NO: 246480

SEQ ID NO: 248836 - RNA, 64 nt, Human; identical to SEQ ID NO: 246481

SEQ ID NO: 248837 - RNA, 64 nt, Human; identical to SEQ ID NO: 246482

SEQ ID NO: 248838 - RNA, 64 nt, Human; identical to SEQ ID NO: 246483

SEQ ID NO: 248839 - RNA, 64 nt, Human; identical to SEQ ID NO: 246484

SEQ ID NO: 248840 - RNA, 64 nt, Human; identical to SEQ ID NO: 246485

SEQ ID NO: 248841 - RNA, 64 nt, Human; identical to SEQ ID NO: 246486

SEQ ID NO: 248842 - RNA, 64 nt, Human; identical to SEQ ID NO: 246487

SEQ ID NO: 248843 - RNA, 64 nt, Human; identical to SEQ ID NO: 246488

SEQ ID NO: 248844 - RNA, 64 nt, Human; identical to SEQ ID NO: 246492

SEQ ID NO: 248845 - RNA, 64 nt, Human; identical to SEQ ID NO: 246493

SEQ ID NO: 248846 - RNA, 64 nt, Human; identical to SEQ ID NO: 246494

SEQ ID NO: 248847 - RNA, 64 nt, Human; identical to SEQ ID NO: 246495

SEQ ID NO: 248848 - RNA, 64 nt, Human; identical to SEQ ID NO: 246496

SEQ ID NO: 248849 - RNA, 64 nt, Human; identical to SEQ ID NO: 246497

SEQ ID NO: 248850 - RNA, 64 nt, Human; identical to SEQ ID NO: 246498

SEQ ID NO: 248851 - RNA, 53 nt, Human; identical to SEQ ID NO: 246499

SEQ ID NO: 248852 - RNA, 64 nt, Human; identical to SEQ ID NO: 246500

SEQ ID NO: 248853 - RNA, 64 nt, Human; identical to SEQ ID NO: 246501

SEQ ID NO: 248854 - RNA, 64 nt, Human; identical to SEQ ID NO: 246502

SEQ ID NO: 248855 - RNA, 64 nt, Human; identical to SEQ ID NO: 246503

SEQ ID NO: 248856 - RNA, 64 nt, Human; identical to SEQ ID NO: 246504

SEQ ID NO: 248857 - RNA, 64 nt, Human; identical to SEQ ID NO: 246505

SEQ ID NO: 248858 - RNA, 64 nt, Human; identical to SEQ ID NO: 246506

SEQ ID NO: 248859 - RNA, 64 nt, Human; identical to SEQ ID NO: 246510

SEQ ID NO: 248860 - RNA, 64 nt, Human; identical to SEQ ID NO: 246511

SEQ ID NO: 248861 - RNA, 64 nt, Human; identical to SEQ ID NO: 246512

SEQ ID NO: 248862 - RNA, 64 nt, Human; identical to SEQ ID NO: 246513

SEQ ID NO: 248863 - RNA, 64 nt, Human; identical to SEQ ID NO: 246514

SEQ ID NO: 248864 - RNA, 64 nt, Human; identical to SEQ ID NO: 246515

SEQ ID NO: 248865 - RNA, 64 nt, Human; identical to SEQ ID NO: 246516

SEQ ID NO: 248866 - RNA, 64 nt, Human; identical to SEQ ID NO: 246517

SEQ ID NO: 248867 - RNA, 64 nt, Human; identical to SEQ ID NO: 246518

SEQ ID NO: 248868 - RNA, 64 nt, Human; identical to SEQ ID NO: 246519

SEQ ID NO: 248869 - RNA, 64 nt, Human; identical to SEQ ID NO: 246520

SEQ ID NO: 248870 - RNA, 64 nt, Human; identical to SEQ ID NO: 246521

SEQ ID NO: 248871 - RNA, 64 nt, Human; identical to SEQ ID NO: 246522

SEQ ID NO: 248872 - RNA, 64 nt, Human; identical to SEQ ID NO: 246523

SEQ ID NO: 248873 - RNA, 64 nt, Human; identical to SEQ ID NO: 246524

SEQ ID NO: 248874 - RNA, 64 nt, Human; identical to SEQ ID NO: 246528

SEQ ID NO: 248875 - RNA, 64 nt, Human; identical to SEQ ID NO: 246529

SEQ ID NO: 248876 - RNA, 64 nt, Human; identical to SEQ ID NO: 246530

SEQ ID NO: 248877 - RNA, 64 nt, Human; identical to SEQ ID NO: 246531

SEQ ID NO: 248878 - RNA, 64 nt, Human; identical to SEQ ID NO: 246532

SEQ ID NO: 248879 - RNA, 64 nt, Human; identical to SEQ ID NO: 246533

SEQ ID NO: 248880 - RNA, 64 nt, Human; identical to SEQ ID NO: 246534

SEQ ID NO: 248881 - RNA, 64 nt, Human; identical to SEQ ID NO: 246535

SEQ ID NO: 248882 - RNA, 64 nt, Human; identical to SEQ ID NO: 246536

SEQ ID NO: 248883 - RNA, 64 nt, Human; identical to SEQ ID NO: 246537

SEQ ID NO: 248884 - RNA, 64 nt, Human; identical to SEQ ID NO: 246538

SEQ ID NO: 248885 - RNA, 64 nt, Human; identical to SEQ ID NO: 246539

SEQ ID NO: 248886 - RNA, 64 nt, Human; identical to SEQ ID NO: 246540

SEQ ID NO: 248887 - RNA, 64 nt, Human; identical to SEQ ID NO: 246541

SEQ ID NO: 248888 - RNA, 64 nt, Human; identical to SEQ ID NO: 246542

SEQ ID NO: 248889 - RNA, 64 nt, Human; identical to SEQ ID NO: 246546

SEQ ID NO: 248890 - RNA, 64 nt, Human; identical to SEQ ID NO: 246547

SEQ ID NO: 248891 - RNA, 64 nt, Human; identical to SEQ ID NO: 246548

SEQ ID NO: 248892 - RNA, 64 nt, Human; identical to SEQ ID NO: 246549

SEQ ID NO: 248893 - RNA, 64 nt, Human; identical to SEQ ID NO: 246550

SEQ ID NO: 248894 - RNA, 64 nt, Human; identical to SEQ ID NO: 246551

SEQ ID NO: 248895 - RNA, 64 nt, Human; identical to SEQ ID NO: 246552

SEQ ID NO: 248896 - RNA, 64 nt, Human; identical to SEQ ID NO: 246553

SEQ ID NO: 248897 - RNA, 64 nt, Human; identical to SEQ ID NO: 246554

SEQ ID NO: 248898 - RNA, 64 nt, Human; identical to SEQ ID NO: 246555

SEQ ID NO: 248899 - RNA, 64 nt, Human; identical to SEQ ID NO: 246556

SEQ ID NO: 248900 - RNA, 64 nt, Human; identical to SEQ ID NO: 246557

SEQ ID NO: 248901 - RNA, 64 nt, Human; identical to SEQ ID NO: 246558

SEQ ID NO: 248902 - RNA, 64 nt, Human; identical to SEQ ID NO: 246559

SEQ ID NO: 248903 - RNA, 64 nt, Human; identical to SEQ ID NO: 246560

SEQ ID NO: 248904 - RNA, 64 nt, Human; identical to SEQ ID NO: 246564

SEQ ID NO: 248905 - RNA, 64 nt, Human; identical to SEQ ID NO: 246565

SEQ ID NO: 248906 - RNA, 64 nt, Human; identical to SEQ ID NO: 246566

SEQ ID NO: 248907 - RNA, 64 nt, Human; identical to SEQ ID NO: 246567

SEQ ID NO: 248908 - RNA, 64 nt, Human; identical to SEQ ID NO: 246568

SEQ ID NO: 248909 - RNA, 64 nt, Human; identical to SEQ ID NO: 246569

SEQ ID NO: 248910 - RNA, 64 nt, Human; identical to SEQ ID NO: 246570

SEQ ID NO: 248911 - RNA, 64 nt, Human; identical to SEQ ID NO: 246571

SEQ ID NO: 248912 - RNA, 64 nt, Human; identical to SEQ ID NO: 246572

SEQ ID NO: 248913 - RNA, 64 nt, Human; identical to SEQ ID NO: 246573

SEQ ID NO: 248914 - RNA, 64 nt, Human; identical to SEQ ID NO: 246574

SEQ ID NO: 248915 - RNA, 64 nt, Human; identical to SEQ ID NO: 246575

SEQ ID NO: 248916 - RNA, 64 nt, Human; identical to SEQ ID NO: 246576

SEQ ID NO: 248917 - RNA, 64 nt, Human; identical to SEQ ID NO: 246577

SEQ ID NO: 248918 - RNA, 64 nt, Human; identical to SEQ ID NO: 246578

SEQ ID NO: 248919 - RNA, 64 nt, Human; identical to SEQ ID NO: 246582

SEQ ID NO: 248920 - RNA, 64 nt, Human; identical to SEQ ID NO: 246583

SEQ ID NO: 248921 - RNA, 64 nt, Human; identical to SEQ ID NO: 246584

SEQ ID NO: 248922 - RNA, 60 nt, Human; identical to SEQ ID NO: 246585

SEQ ID NO: 248923 - RNA, 64 nt, Human; identical to SEQ ID NO: 246586

SEQ ID NO: 248924 - RNA, 64 nt, Human; identical to SEQ ID NO: 246587

SEQ ID NO: 248925 - RNA, 64 nt, Human; identical to SEQ ID NO: 246588

SEQ ID NO: 248926 - RNA, 64 nt, Human; identical to SEQ ID NO: 246589

SEQ ID NO: 248927 - RNA, 64 nt, Human; identical to SEQ ID NO: 246590

SEQ ID NO: 248928 - RNA, 64 nt, Human; identical to SEQ ID NO: 246591

SEQ ID NO: 248929 - RNA, 64 nt, Human; identical to SEQ ID NO: 246592

SEQ ID NO: 248930 - RNA, 64 nt, Human; identical to SEQ ID NO: 246593

SEQ ID NO: 248931 - RNA, 64 nt, Human; identical to SEQ ID NO: 246594

SEQ ID NO: 248932 - RNA, 64 nt, Human; identical to SEQ ID NO: 246595

SEQ ID NO: 248933 - RNA, 64 nt, Human; identical to SEQ ID NO: 246596

SEQ ID NO: 248934 - RNA, 64 nt, Human; identical to SEQ ID NO: 246600

SEQ ID NO: 248935 - RNA, 64 nt, Human; identical to SEQ ID NO: 246601

SEQ ID NO: 248936 - RNA, 64 nt, Human; identical to SEQ ID NO: 246602

SEQ ID NO: 248937 - RNA, 64 nt, Human; identical to SEQ ID NO: 246603

SEQ ID NO: 248938 - RNA, 64 nt, Human; identical to SEQ ID NO: 246604

SEQ ID NO: 248939 - RNA, 64 nt, Human; identical to SEQ ID NO: 246605

SEQ ID NO: 248940 - RNA, 64 nt, Human; identical to SEQ ID NO: 246606

SEQ ID NO: 248941 - RNA, 64 nt, Human; identical to SEQ ID NO: 246607

SEQ ID NO: 248942 - RNA, 64 nt, Human
ccgccuuccccagcagccgcagguggugccagccacuccacagagcccgagggaugaucuagcc

SEQ ID NO: 248943 - RNA, 64 nt, Human
gccaugacacgugguucuggugggaugcacagucacuccacauccaccauugaaggaaaggaaa

SEQ ID NO: 248944 - RNA, 64 nt, Human
cacauuuuacuuccuuccccuguuguccaguccaacuccacagucacucuuaaaacuucucucu

SEQ ID NO: 248945 - RNA, 64 nt, Human
caauaagcagauaccacuuaagauaggagucuaaacuccacagaaaaggauaauaccaagagcu

SEQ ID NO: 248946 - RNA, 64 nt, Human
uucuuccacccucucacuuuccugccuguuccccacuccacaggagggagcugacguuggcuug

SEQ ID NO: 248947 - RNA, 64 nt, Human
agaugggcuauuuguucuuuggaaugacugcuccacuccacacucacaccucuauucacagacc

SEQ ID NO: 248948 - RNA, 64 nt, Human
uuucuccucccuuccuuuucccugcuuccaggaaacuccacaucugccuuaaaaccaaagaggg

SEQ ID NO: 248949 - RNA, 64 nt, Human
ugcagacaccugccuuaacacacacaccucuaggacuccacaguuuugccuuaaaggaccuucc

SEQ ID NO: 248950 - RNA, 64 nt, Human
caccucugcaguggggaccacacuagcagcccugacuccacacuccuccuggggacccaagagg

SEQ ID NO: 248951 - RNA, 64 nt, Human
gaccaauaaauauaaaauaugguaauuggaauuaacuccacaccauaguaugcauuguuauaca

SEQ ID NO: 248952 - RNA, 64 nt, Human
cucgcugggagagauggacucuguccucagcaacacuccacagcagaaagggguagcagguacc

SEQ ID NO: 248953 - RNA, 64 nt, Human
cccgaacccucugaugcucccggagacuccuccgacuccacaccucucgcggcagcugucauuu

SEQ ID NO: 248954 - RNA, 64 nt, Human
ccaccccuggcuggucuguggcccaaggaaggccacuccacauuaagcugcccaauaaacugcu

SEQ ID NO: 248955 - RNA, 64 nt, Human
ugcccagcaagagggaaagcagaccccuuuagucacuccacaagcaauagcuccaugagaggca

SEQ ID NO: 248956 - RNA, 64 nt, Human
uggaaccacccuccccagaggcugcauugaggagacuccacagacugaaaagugaguuugcaga

SEQ ID NO: 248957 - RNA, 64 nt, Human
agugggucgagcgccugagauccuguucaccaggacuccacagagcuggcucugcucagaagcc

SEQ ID NO: 248958 - RNA, 64 nt, Human
caggagccugaaggaaucugaaggcacuggaaucacuccacacacccaaagccucuggacuucu

SEQ ID NO: 248959 - RNA, 64 nt, Human
gaaugcuggaaugaugucuguuggaaaacccaggacuccacacacaaaacuccugggauuuugu

SEQ ID NO: 248960 - RNA, 64 nt, Human
uguaauauguauguguucauguaugaaaauuuuuacuccacacagguguuucaguagagugggg

SEQ ID NO: 248961 - RNA, 63 nt, Human
agggcgggccuuccauguucucucacccgcuucaacuccacauuguccaagucacagaaaaag

SEQ ID NO: 248962 - RNA, 64 nt, Human
cuaaauuacaucaggacaaagagacagacuauuaacuccacaguuaauuaaggacguauguucc

SEQ ID NO: 248963 - RNA, 64 nt, Human
gcgauagguagccccugagaaauuuaucacuauaacuccacaggaaauaugacuuggaagugcu

SEQ ID NO: 248964 - RNA, 64 nt, Human
cagcaccuggaggggcaccagguggaggguuugcacuccacacaucuuucuugaaugaaugaaa

SEQ ID NO: 248965 - RNA, 64 nt, Human
aagaugccacauguuaguauaucagugagaggugacuccacagugcucucuggagaagcaauau

SEQ ID NO: 248966 - RNA, 64 nt, Human
uucuuagcugaaccucaacugugaggaaucuaugacuccacagauguccuuggugcacauaggc

SEQ ID NO: 248967 - RNA, 64 nt, Human
uaaaaugcagaguuggacuacacgauuucuucccacuccacaaucugucauccuaguauagauc

SEQ ID NO: 248968 - RNA, 64 nt, Human
gugggagccaccacuccugccugcccccacacccacuccacaccaguaauaaaaagccaccaca

SEQ ID NO: 248969 - RNA, 64 nt, Human
uauuuccaccuccucccacaaccccccacacuccacuccacacucuugagucucuuuaccuaau

SEQ ID NO: 248970 - RNA, 64 nt, Human
cucuaugguaacaucacuaaaugugggcauagaaacuccacagcuguuuacaaauuugguuaca

SEQ ID NO: 248971 - RNA, 64 nt, Human
uccuguaccuugacaugcaaaaggcucuccuaauacuccacauucaaacugaagaggaaaauug

SEQ ID NO: 248972 - RNA, 64 nt, Human
uaacuuuuuuuuuucuuuauaagaaagccugaguacuccacacugcacaauaacuccucccagg

SEQ ID NO: 248973 - RNA, 64 nt, Human
guacuugauuucaggucaauaacgguccccccucacuccacacuggcacguuugugagaagaaa

SEQ ID NO: 248974 - RNA, 64 nt, Human
guagucucagguaaugaaggcacagcacagcaguacuccacauuguuuccuauuuggacauaga

SEQ ID NO: 248975 - RNA, 64 nt, Human
uggaaucaacuuguaugaaaccuugucaaaauguacuccacaaguauguacaauuaaguauuuu

SEQ ID NO: 248976 - RNA, 64 nt, Human
ggucuuccagggaaauaaucauuuuguacuauuuacuccacauacaauguaagugcuuuuaaug

SEQ ID NO: 248977 - RNA, 64 nt, Human
gaagguauucuucauuuuaauugcuuuugggauuacuccacaucuuuguuuauuucuugacuaa

SEQ ID NO: 248978 - RNA, 64 nt, Human
ccacuucucugaugucagaugcaugcagaccuguacuccacaugcaacccaacagcagugcagu

SEQ ID NO: 248979 - RNA, 64 nt, Human
uauucuggcaauuuaauauacccccuacaaaagcacuccacagcuuuuacacuauuuugacuuu

SEQ ID NO: 248980 - RNA, 64 nt, Human
aguuacaacaacugaauucuaauauggauuaaaaacuccacauaaauauuuuuccccaugcguc

SEQ ID NO: 248981 - RNA, 64 nt, Human
gauuaaaacuggugcuuaaaguuuauuacccacaacuccacagucucuguguaaaccacucgac

SEQ ID NO: 248982 - RNA, 64 nt, Human
cgcccucaucccaagguccgucccaugacauaacacuccacacccgccccagccaacuucaugg

SEQ ID NO: 248983 - RNA, 64 nt, Human
caaauuccuaggaagacacagaauaccaaaucugacuccacaagaaauagauguugugaauaga

SEQ ID NO: 248984 - RNA, 64 nt, Human
gauguagggucaagguuuuugugacaacaggcagacuccacacagagaggauaugaugagaaua

SEQ ID NO: 248985 - RNA, 64 nt, Human
caauguuuguuuuuauuuuuggcuuuaugucuauacuccacagagagcuuuuuaaguaaugaau

SEQ ID NO: 248986 - RNA, 64 nt, Human
ucugaugcaggucugcugccccgacggggccaggacuccacagcgcuuucucagucacaagcca

SEQ ID NO: 248987 - RNA, 64 nt, Human
uuaugauuuccucuccuauaauuauuucuguagcacuccacacugaucuuuggaaacuugcccc

SEQ ID NO: 248988 - RNA, 64 nt, Human
gaccaagagcaggcaaagacacgggaacugaaaaacuccacaggguuuggagaauagaaaugaa

SEQ ID NO: 248989 - RNA, 64 nt, Human
ggacauuccaucugagguccuuccugaacaugucacuccacagcagaggaccgguugcagcuua

SEQ ID NO: 248990 - RNA, 64 nt, Human
aggcaauagguaaauggggcccauuaggucccucacuccacagagugagccagugagggcaguc

SEQ ID NO: 248991 - RNA, 64 nt, Human
cacuucauagaccccuaggcugcugugcggugggacuccacaugcgccggaaggagcuucaggu

SEQ ID NO: 248992 - RNA, 64 nt, Human
ucaugaucuacaaaacaaaaucauagugacuaggacuccacagugaagaugguugacuagugac

SEQ ID NO: 248993 - RNA, 64 nt, Human
gggaugaaugaccaucugggguauggugggcugaacuccacaaggucguuggaaugaauuuuga

SEQ ID NO: 248994 - RNA, 64 nt, Human
ggaauaaugaguuagaacuauuaaaacagccaaaacuccacagucaauauuaguaauuucuugc

SEQ ID NO: 248995 - RNA, 64 nt, Human
uguugcggugaaucuggaagccggagcaagggccacuccacaggcucuuuggcacagcagggcu

SEQ ID NO: 248996 - RNA, 64 nt, Human
ggcuuggugauaacguauagaauaacagacggggacuccacacccaggccuuuuuuaacggugu

SEQ ID NO: 248997 - RNA, 64 nt, Human
uauauuauugaaacuuuuauucauuuuagaguaaacuccacaucuuugcacuaccuguuugccu

SEQ ID NO: 248998 - RNA, 64 nt, Human
augauauuuaaagcaauaauuuuuuguaugucauacuccacaauuuacauguauauuacagcca

SEQ ID NO: 248999 - RNA, 64 nt, Human
aagggccacagagaacucauguguucagcucaagacuccacaggaauucaacccccagaaagac

SEQ ID NO: 249000 - RNA, 64 nt, Human
aaacauucauauccacaaaauuuucugcuaaaugacuccacacucagccuucucuacccugaac

SEQ ID NO: 249001 - RNA, 63 nt, Human
ccaucguucacacucuaugaugaggagauucagacuccacaguguauauauuuugccauuuau

SEQ ID NO: 249002 - RNA, 64 nt, Human
ugaauuacgugccuccauaaccugaacugugccgacuccacaaaacgauuauguacucuucuga

SEQ ID NO: 249003 - RNA, 64 nt, Human
cgaugauacuguuucuugcacugaauauauaaacacuccacaguguuuauauugggaagauauu

SEQ ID NO: 249004 - RNA, 64 nt, Human
gccagcagggggcugagcagagcccauccaggacacuccacacugccaggacacacccaggcgg

SEQ ID NO: 249005 - RNA, 64 nt, Human
aauuucccuuccgccacggaguucgaaaccaucuacuccacacaugcaggaggcggguggcacg

SEQ ID NO: 249006 - RNA, 64 nt, Human
ucuggguuugggaguggaguauuaugugacugggacuccacaaaauauuuauauuauuuucaag

SEQ ID NO: 249007 - RNA, 64 nt, Human
gccccuagacggccuuuccuuuugcacuuucugaacuccacaaaaccuccuuugugacuggcuc

SEQ ID NO: 249008 - RNA, 64 nt, Human
uccugggcuuauggccggucacagccucagugugacuccacaguggccccuguagccgggcaag

SEQ ID NO: 249009 - RNA, 64 nt, Human
ggaccucuuagucucugcccuauacgccgccuucacuccacagccucaccccucccacccccau

SEQ ID NO: 249010 - RNA, 64 nt, Human
gcaccuggagauguuugcugggagauagacucccacuccacaaaggugcuggguggcucuccgg

SEQ ID NO: 249011 - RNA, 64 nt, Human
ugcuaauuuuagucccaggaccagacauccccagacuccacagauguaaugaaguccccgaaug

SEQ ID NO: 249012 - RNA, 64 nt, Human
ccucccuuccagaauccaggccccaucucccccaacuccacagccccucccgagccucaaggca

SEQ ID NO: 249013 - RNA, 64 nt, Human
aucgaucuuacacauucuguguauaaagaccuuaacuccacaggacggacauuuuagaguuuaa

SEQ ID NO: 249014 - RNA, 64 nt, Human
uguuuguuuuuagagaacacuucuaaggcgagccacuccacacccaggggaguuaaagcacaug

SEQ ID NO: 249015 - RNA, 64 nt, Human
cugagguucaguucuucuuugugaaccugugaguacuccacaguuuacugggggaaaaggcuuc

SEQ ID NO: 249016 - RNA, 64 nt, Human
uggugugcagccccucuccucucuguccccugacacuccacagugugccugcaacccaaguggc

SEQ ID NO: 249017 - RNA, 64 nt, Human
gagcagcugccagcugagcucugucaccagggguacuccacaggaggagcaggugcugacuuuc

SEQ ID NO: 249018 - RNA, 64 nt, Human
ugguuuauaggaaaugaucaaaugauccaaaaaaacuccacauuuuuuaagaaguuggaauuug

SEQ ID NO: 249019 - RNA, 64 nt, Human
caugaucuuucugcaggaaauagucacucaucccacuccacauaagggguuuaguaagagaagu

SEQ ID NO: 249020 - RNA, 64 nt, Human
gcaaaauucacagaaacuaaacuccacccuugggacuccacaacaacaacaacaacaaaauuua

SEQ ID NO: 249021 - RNA, 64 nt, Human
aaagacaaggggccaggagccaacaccagaggccacuccacaaccccagcgccagucagcaagg

SEQ ID NO: 249022 - RNA, 64 nt, Human
uccuggcuugagguaggggcucuuaagguacagaacuccacaaaccuuccaaaucuggaggagg

SEQ ID NO: 249023 - RNA, 64 nt, Human
uaaaaaaaucaacauacugauaaaaugacuuuguacuccacaaaauuaugacugaaagguuuau

SEQ ID NO: 249024 - RNA, 64 nt, Human
agcgugaagggacauaucacugaccuucauaaccacuccacaaccaugaauauuugacaaauuu

SEQ ID NO: 249025 - RNA, 64 nt, Human
aauaugaauuagguguacuguacugaagaacaguacuccacaaacaugggugguaacaagaguu

SEQ ID NO: 249026 - RNA, 64 nt, Human
aaccaaacucugucuuggagccuccuuuuagcucacuccacaaguaaauggauuuaaucaaagg

SEQ ID NO: 249027 - RNA, 64 nt, Human
cuacagcuguuaucuuuccucuccuacaaagaauacuccacacauaaaaacuuagguaaaugac

SEQ ID NO: 249028 - RNA, 64 nt, Human
aaagauaaauuuguugaauauugguaauuaaaagacuccacauaaguccauuaacugcuuucca

SEQ ID NO: 249029 - RNA, 64 nt, Human
ggggauuuuuuuaaaauccugaugcccaacuugcacuccacauuaauuaacaugucuaggagug

SEQ ID NO: 249030 - RNA, 64 nt, Human
uucucaagggaaccccauucacaugccccuccuaacuccacaagcgaggguagcagaggcucuc

SEQ ID NO: 249031 - RNA, 64 nt, Human
gcccacccggcccggcugagcccugccccacccaacuccacagggcuguuuugccuccccacgg

SEQ ID NO: 249032 - RNA, 64 nt, Human
auucugugccuaccugcuccaucuaaagcagaaaacuccacaacuaagaucucuucuaacauuu

SEQ ID NO: 249033 - RNA, 64 nt, Human
cuuagcuugucuucuuggcaauucacaaugccucacuccacacccuaaaacuggagcguccccu

SEQ ID NO: 249034 - RNA, 64 nt, Human
ccagcacgucugugugaguaacgggacaguaaacacuccacauucuucaguuuuucacuucuac

SEQ ID NO: 249035 - RNA, 64 nt, Human
uauaucccaucaacagggcaugaggguucugaugacuccacaucccucagugcuuuuuauuauc

SEQ ID NO: 249036 - RNA, 64 nt, Human
ugucgaauccagugcacucaaguuuggccaagggacuccacagcacccagaagacugcaugccu

SEQ ID NO: 249037 - RNA, 64 nt, Human
cagucugaauuuuggaaaagaaugcaauaguuguacuccacagucaguggaacuguucccugag

SEQ ID NO: 249038 - RNA, 64 nt, Human
aggccaggcugaccccaccagccagucagcuacaacuccacaucaacuccacaugcgcccagcu

SEQ ID NO: 249039 - RNA, 64 nt, Human
accccaccagccagucagcuacaacuccacaucaacuccacaugcgcccagcucgagacugaug

SEQ ID NO: 249040 - RNA, 64 nt, Human
cuaagaagcagggcuugccucuguccucccggggacuccacagggauauucgugcagggcaggg

SEQ ID NO: 249041 - RNA, 64 nt, Human
cauuugcuugugcucaguauuuagaaaugcauacacuccacauuucuccccauuuccaauuggg

SEQ ID NO: 249042 - RNA, 64 nt, Human
cagugcaugucugcuucaauuagcagaugccgcaacuccacacaguguguaaaauauauacaac

SEQ ID NO: 249043 - RNA, 64 nt, Human
aauacaucuuuaucaaugaccagugcaguacagaacuccacauauacaacuuccgucauuaccu

SEQ ID NO: 249044 - RNA, 64 nt, Human
caaaguggaaggucagaccagaugaugcucugguacuccacagugcucaccuguaucacugcag

SEQ ID NO: 249045 - RNA, 64 nt, Human
ggaugugggagggcucuaaaguuagaggucaccaacuccacagaugaaacaguucaauaaugag

SEQ ID NO: 249046 - RNA, 64 nt, Human
caggcucguuaccccugugccugugucucuacacacuccacacccccucaaacucuguuuaucu

SEQ ID NO: 249047 - RNA, 64 nt, Human
gaggccuccgggaugucccaucccaagccaucacacuccacaaaaacauuuaauuuauggaucc

SEQ ID NO: 249048 - RNA, 64 nt, Human
ucccaagggacacagcgguaggaauggugcuuaaacuccacagguaucagagaggguguaacua

SEQ ID NO: 249049 - RNA, 64 nt, Human
cugaaaaacugcuuacaauucauguuuucuagccacuccacaaaccacuaaaauuuuaguuuua

SEQ ID NO: 249050 - RNA, 64 nt, Human
aucugccuauuacucagccuaaggaaacaaguacacuccacacaugcauaaaggaaaucaaaug

SEQ ID NO: 249051 - RNA, 64 nt, Human
ggaugacuaaaacaaagggaagaacuuuuuaugaacuccacaggaaguaguaaagcuuuuuuuu

SEQ ID NO: 249052 - RNA, 64 nt, Human
cccgacgugaguuagaugagggagaguuuguguaacuccacacccaggaggguaagccacuuua

SEQ ID NO: 249053 - RNA, 64 nt, Human
agaagagaacuuuacgagcgugacauuaugcauuacuccacauccacccuuuaagaauugauuu

SEQ ID NO: 249054 - RNA, 64 nt, Human
cuccgcccucuugcacaccagggccgcucgugggacuccacauccuccagcccccacaauccug

SEQ ID NO: 249055 - RNA, 64 nt, Human
uccaccuggccagggaggacggagacuuugaccuacuccacauggagaggcaaccaugucugga

SEQ ID NO: 249056 - RNA, 64 nt, Human
ucccuuggcugacgcccagguacucagcuggcccacuccacagccaggccuggcccugcccuuc

SEQ ID NO: 249057 - RNA, 64 nt, Human
uuuuauagcugcuucagugagaauucccucgucgacuccacagggaccuuucagacaaaaaugc

SEQ ID NO: 249058 - RNA, 64 nt, Human
gaaggaaucugugcagaugagcagucacacuguuacuccacagcggaggagaccagcucagagg

SEQ ID NO: 249059 - RNA, 64 nt, Human
acagcuucucuuugccauuuguggauuucacaucacuccacacagaaacauuacagccuggcau

SEQ ID NO: 249060 - RNA, 64 nt, Human
augggccccagauaccaugaugcugagcccggaaacuccacauccugugggaccugggccauag

SEQ ID NO: 249061 - RNA, 64 nt, Human
gguccaagaucuagaccagguacucaaccaccccacuccacaugcaacuguccccaacccaugc

SEQ ID NO: 249062 - RNA, 64 nt, Human
guguggcauggccugcuguauaccccaccccaguacuccacagcaccuuguacaguaggcaugg

SEQ ID NO: 249063 - RNA, 64 nt, Human
guaauaugcgacugcgaacacugaacucuacgccacuccacaaaugauguuuucaggugucaug

SEQ ID NO: 249064 - RNA, 64 nt, Human
aaaaauuaaggcaacugaacaaaaaaaugcucacacuccacaucccgugaugcaccucccaggc

SEQ ID NO: 249065 - RNA, 64 nt, Human
gugacucaggcuuacgauggugacggcaacaagaacuccacaguucccaggcuggggaugcuuu

SEQ ID NO: 249066 - RNA, 64 nt, Human
caauaucuguucguguugaggagaugaggugcagacuccacacuggggucuuagaggcaccagu

SEQ ID NO: 249067 - RNA, 64 nt, Human
agaaaaucgaugaagauuguauuuuugcaccuuaacuccacauugcuuuauugguuaauuuaua

SEQ ID NO: 249068 - RNA, 63 nt, Human
agacugugcucucuguggugccucucuuggcucuacuccacagauaccagaccucuucuaaga

SEQ ID NO: 249069 - RNA, 64 nt, Human
uguggagauugguuccuagugaguuuuguggccuacuccacauuuguucuuccuuccucagggu

SEQ ID NO: 249070 - RNA, 64 nt, Human
ccuaguugguuucauguauguuacacaugcuuccacuccacaguaccuaauuucucucuguccc

SEQ ID NO: 249071 - RNA, 64 nt, Human
cccagagaaauuucuggaaucugauugagucuccacuccacaagcacucaggguuccccagcag

SEQ ID NO: 249072 - RNA, 64 nt, Human
acugacauucucuagucgacugccagggccuuagacuccacauguccauuuuuguucagguaua

SEQ ID NO: 249073 - RNA, 64 nt, Human
agccuugaacaaccagauggugacccagaacaggacuccacacagcguuugccaccagaaacca

SEQ ID NO: 249074 - RNA, 64 nt, Human
auuuuaagaauaucuucacgaacuugacccuccuacuccacauugcaacauuuccaucagacag

SEQ ID NO: 249075 - RNA, 64 nt, Human
ggacaaaaugaccaaagacugucagauuucuuagacuccacaggaccaaaccauagaacaauuu

SEQ ID NO: 249076 - RNA, 64 nt, Human
uugugagugucugcuguccuuggcaccccugcccacuccacacuccuggaauaccucuucccua

SEQ ID NO: 249077 - RNA, 64 nt, Human
caaggauguuccaaaaccccaccucccuuuauugacuccacauuccccuccaguguucccuccu

SEQ ID NO: 249078 - RNA, 64 nt, Human
auaucuguguccagacguguucuauugguaucucacuccacaucccagccacucuaucaaggga

SEQ ID NO: 249079 - RNA, 64 nt, Human
uccucaucacacacaugucaucagggcccucugcacuccacaugaugaggucagacccacacgg

SEQ ID NO: 249080 - RNA, 64 nt, Human
auacauuauucaucaaaagaaauguuacauguguacuccacaggcauagucuuuguuaugauga

SEQ ID NO: 249081 - RNA, 64 nt, Human
caaaugaucauccugaggaucugagcuucccuagacuccacacaauaaccuuggggcacccuuu

SEQ ID NO: 249082 - RNA, 64 nt, Human
ucacugaccaaaaauucacugaccaaccaaccaaacuccacacuucaucugaucccccauagac

SEQ ID NO: 249083 - RNA, 64 nt, Human
aauucuccagggaauuaaagagcuuggaaggagcacuccacagucggagguguaaucauauugg

SEQ ID NO: 249084 - RNA, 64 nt, Human
ugguguuaauauacaaacguacaccccaucuuuaacuccacagaccaagacuggaguaagaccu

SEQ ID NO: 249085 - RNA, 64 nt, Human
gccauuaugcuugacaugguuuccaaaaaaugguacuccacauauuucagugaggguaaguauu

SEQ ID NO: 249086 - RNA, 64 nt, Human
cccagggcucugcagcaccucaccugagaccuccacuccacaucugcaucacucauggaacacu

SEQ ID NO: 249087 - RNA, 64 nt, Human
uaccauagcagauuauccauuucaauuuuuuuuuacuccacaggaaaauguaagcuacuuuguc

SEQ ID NO: 249088 - RNA, 64 nt, Human
gauggccauuugaucucuaaaaggaauuuuguacacuccacagaacuccuaucuauaguaaaau

SEQ ID NO: 249089 - RNA, 64 nt, Human
ccuggggucagugacacugucaggccaaccaugcacuccacaaaggggagcauuuggaaaugaa

SEQ ID NO: 249090 - RNA, 64 nt, Human
gauggccaaccaaggggccacccagggaccucuaacuccacacauccuccacccgggggggugg

SEQ ID NO: 249091 - RNA, 64 nt, Human
ccgaggaguugggggaccaucccagcagguaaugacuccacagggaagaggcacuguagcagcu

SEQ ID NO: 249092 - RNA, 64 nt, Human
gguugagccgccccaggguaugaggagaugaauaacuccacagcuccuccuggacccugcgcgg

SEQ ID NO: 249093 - RNA, 64 nt, Human
ucucugacuucucuaccuccucugugcucaggugacuccacaucuucugccccagugugucccc

SEQ ID NO: 249094 - RNA, 64 nt, Human
gagaaauccacugaaggaaaaaacccaaauuuccacuccacaaagaaaacagcugcaagccccc

SEQ ID NO: 249095 - RNA, 64 nt, Human
gguggccuucaugguagagcuugacccaagaacuacuccacauucggauggcccagacugacuc

SEQ ID NO: 249096 - RNA, 64 nt, Human
cuuaugugcuagggauaaaucaagaguccucagcacuccacauucccaaaaaaucccaggaacu

SEQ ID NO: 249097 - RNA, 64 nt, Human
aucaugguccagucuucggguuucaccuccuaguacuccacaagcugcuccucucucuguggcc

SEQ ID NO: 249098 - RNA, 64 nt, Human
gugcaccccaggaaggccccguagaccuccgaagacuccacaagaaacuaauggaucacugguc

SEQ ID NO: 249099 - RNA, 64 nt, Human
uagaaccauucagccuacccuguauuugccauaaacuccacaauucacaccaaaaugucuguac

SEQ ID NO: 249100 - RNA, 64 nt, Human
agaaaugcaguauugcuuugaccugccauguggcacuccacaaugucaauugcaguuuacacac

SEQ ID NO: 249101 - RNA, 64 nt, Human
ucagccucugacagucaggaugaagccccaugccacuccacacugcugggacauggcagggacu

SEQ ID NO: 249102 - RNA, 64 nt, Human
ggguccaggaauggugcuuuaugugagauaccccacuccacaucaacauuccagggaugagcca

SEQ ID NO: 249103 - RNA, 64 nt, Human
cugggauggggugaaccuuccgcaccagagggacacuccacagaagccacagcccaguaaguca

SEQ ID NO: 249104 - RNA, 64 nt, Human
agaagacuucggaagcacauuguguucauaauguacuccacaauggccaguccaauugcuaucu

SEQ ID NO: 249105 - RNA, 64 nt, Human
uuuccagcaaaccacgcuaacuagcugaccacagacuccacaguggggggacgggcgcaguaug

SEQ ID NO: 249106 - RNA, 64 nt, Human
uuugguuccauccuuaccaccacaccacacgcacacuccacaugcccagcagaguggcacuugg

SEQ ID NO: 249107 - RNA, 64 nt, Human
guuuacucagggucugauguuggaaucugcuccaacuccacacccuagcccuuacauguccucc

SEQ ID NO: 249108 - RNA, 56 nt, Human
cccaaacuccgaagacuugaacacucacuccacaacccaagaaucugcagcuaacu

SEQ ID NO: 249109 - RNA, 64 nt, Human
acacauccaugugccgggaggauggugcaccccaacuccacaaggacccuuccagaccucaccc

SEQ ID NO: 249110 - RNA, 64 nt, Human
uccaugggggggucaccggccuguugcuacugcaacuccacaccauucuuggugcuggggugug

SEQ ID NO: 249111 - RNA, 64 nt, Human
cuuuuccucuggacaaaaugacagcauccuggcgacuccacaguggagcugagcgccacucccu

SEQ ID NO: 249112 - RNA, 64 nt, Human
accucgugguacucuugccuuagauuuuacacacacuccacagccaagcacugccacgguccuc

SEQ ID NO: 249113 - RNA, 64 nt, Human
uucaagacuagaauagggggauauaauacauauuacuccacaccuuuuaugaaucaaauaugau

SEQ ID NO: 249114 - RNA, 64 nt, Human
cccccaacacaggaacgcucauggacaccugcacacuccacagaagacguuggcaugugaggcc

SEQ ID NO: 249115 - RNA, 64 nt, Human
uauaaagaacaauaagucauucaccuagaugucaacuccacaagaugaaucuuauaaacuauau

SEQ ID NO: 249116 - RNA, 58 nt, Human
cccaaugggcaggacccugaggauggggacuccacagccucuccaaguucagagugag

SEQ ID NO: 249117 - RNA, 64 nt, Human
ugagcagccuccuaccuccccugccugagcccucacuccacagcccucccagguaccuagcaga

SEQ ID NO: 249118 - RNA, 64 nt, Human
ggaccaaagauacauguaaaauagggcuuuguaaacuccacagggacuguucuauagcagucau

SEQ ID NO: 249119 - RNA, 64 nt, Human
caucuaucuuuugcuguccuguccagucccaucaacuccacacugugccauuuguggcaucguu

SEQ ID NO: 249120 - RNA, 64 nt, Human
gagucucccaggcucacauuaaaccagggguuuuacuccacauccuucccccagacacuguucc

SEQ ID NO: 249121 - RNA, 64 nt, Human
uuagacacuuuucuagaacaggcaugcccugcaaacuccacagacacugacuguuuuuguccua

SEQ ID NO: 249122 - RNA, 64 nt, Human
agugugggacuccccgcuucauccccaccgucccacuccacagccuucccgaaacauucccugg

SEQ ID NO: 249123 - RNA, 64 nt, Human
gaguacagcaaaugugugacauuauuuugcuacuacuccacacuacuuagacaucauguaguuc

SEQ ID NO: 249124 - RNA, 54 nt, Human
agagaacucacacuggauaaacccacuccacaugugcuggggacauaggaagac

SEQ ID NO: 249125 - RNA, 64 nt, Human
ccagcaugcagggggccuuccucuaaagacaaggacuccacaugcuuuucuuuuucuaauaaac

SEQ ID NO: 249126 - RNA, 64 nt, Human
uuccucggaguagaaggguguacagggggcccagacuccacagugacuugccacauuugccccc

SEQ ID NO: 249127 - RNA, 64 nt, Human
agucgcccugucagcacgcacaugcuugggacccacuccacacacucccugccagcuuuguugc

SEQ ID NO: 249128 - RNA, 64 nt, Human
gcugacccaggaaaggccagaccugccccuccaaacuccacaguaugggacccuggagggcuag

SEQ ID NO: 249129 - RNA, 64 nt, Human
ugcuugcccugggccuaucccaugaggcccagugacuccacaaccucccugaggaggggaugga

SEQ ID NO: 249130 - RNA, 64 nt, Human
gaagugaccuuccuggaggaggugggcagcucagacuccacaugcugguggugccugaggucug

SEQ ID NO: 249131 - RNA, 64 nt, Human
ucagcucugaaggccgugagaccccugauuucccacuccacacccuauauuucuguguaugugu

SEQ ID NO: 249132 - RNA, 64 nt, Human
uccaaggaauacugagaugaaaugugguaaaucaacuccacagaaccaccaaaaagaaaaugag

SEQ ID NO: 249133 - RNA, 64 nt, Human
acccuggccauccacuagcccggaggguacgcagacuccacacucaguagaaggagacucagga

SEQ ID NO: 249134 - RNA, 64 nt, Human
uccuuccuggagaugccuucagccagcaucccagacuccacaguuauuuaugaaugaugucgug

SEQ ID NO: 249135 - RNA, 64 nt, Human
uaggccuaggcaguccacuucgggaggugggggcacuccacacuggggggcccugcagcuccag

SEQ ID NO: 249136 - RNA, 64 nt, Human
guccccggacaguucagacacccuuggggauggcacuccacacacgacagagaugcaggggcca

SEQ ID NO: 249137 - RNA, 64 nt, Human
cuugauccaacgcuacauguauucagcuuuuaaaacuccacaaauuuuucauacuccuuaaaua

SEQ ID NO: 249138 - RNA, 64 nt, Human
cuguucagguggaccaaagcaccuugacacaaggacuccacacugugcucucuaguagcacaag

SEQ ID NO: 249139 - RNA, 64 nt, Human
agggaaaauaaggccagaaacuucugagcagauaacuccacaaauggaaauuuaguacuuucuu

SEQ ID NO: 249140 - RNA, 64 nt, Human
acagggcagcugcguuuuaggaagagcaaaugaaacuccacaccauucuucuagaucucuggug

SEQ ID NO: 249141 - RNA, 64 nt, Human
uucugcacacuccugcgaaagucggugaacauucacuccacauugaccccucccuagccuggca

SEQ ID NO: 249142 - RNA, 64 nt, Human
acaguuccaggagcggcuucccucgucuccccuuacuccacagggagccucccuugccaggacc

SEQ ID NO: 249143 - RNA, 64 nt, Human
gcagcaaagaagcuggggugguguggagggcccuacuccacacccuagagcugugaugcugagc

SEQ ID NO: 249144 - RNA, 64 nt, Human
cugugggcgguuucuggggaugucccaggguggaacuccacaugcuggugcauauacgcccuug

SEQ ID NO: 249145 - RNA, 64 nt, Human
agguguaauuuuuuuguucuauuuuuuuccacguacuccacagccaacaucacgagguguaauu

SEQ ID NO: 249146 - RNA, 64 nt, Human
uuuauuccucagucaugguuuucuaaauaucuguacuccacauuccauuuuaauugauaugagg

SEQ ID NO: 249147 - RNA, 64 nt, Human
ugguaacagagaauugauuuucauaugaaucuuaacuccacaguaaaauaguugacaucauaau

SEQ ID NO: 249148 - RNA, 64 nt, Human
augggaguaagguuauccuuagaaauuuaaaauaacuccacaguaaaauagguagaaucugaag

SEQ ID NO: 249149 - RNA, 64 nt, Human
uaggaggcguuuaaaacaaagauccaguucauuuacuccacaguuauucccagggcuggcccua

SEQ ID NO: 249150 - RNA, 64 nt, Human
uccacuucacaguucugaaggcugagucagccccacuccacaguuaggccaagaauuagauuuu

SEQ ID NO: 249151 - RNA, 64 nt, Human
uuggggggcacagaggggagaagcucuuucccccacuccacauuccuuuuguugccaagauccu

SEQ ID NO: 249152 - RNA, 64 nt, Human
ucggguuuuaucaacugucaauauaaaaggcaguacuccacagaaugauguugaaaaacuucuu

SEQ ID NO: 249153 - RNA, 64 nt, Human
uuggcccuggaaccuccaucccacucuuguuaugacuccacaguguccagacuaauuugugcau

SEQ ID NO: 249154 - RNA, 64 nt, Human
gcaaaacaucagauuucaccaaagaaccaaagugacuccacaauugggaugccgacacaccuug

SEQ ID NO: 249155 - RNA, 64 nt, Human
caucucuccgaaccuggcuucgccugucccuuucacuccacacccucuggccuucugccuugag

SEQ ID NO: 249156 - RNA, 64 nt, Human
uccugggaagaguggauaacucagaagucacuguacuccacagagccucacugcagugucuaaa

SEQ ID NO: 249157 - RNA, 64 nt, Human
gacgcaguagccuugcuguagggaguugaagaguacuccacaacaguaucuuaaguuuaacugg

SEQ ID NO: 249158 - RNA, 64 nt, Human
uucagugaaaacaaguccuuccauaauaguaacaacuccacagauuuccucucuaaauuuuuau

SEQ ID NO: 249159 - RNA, 64 nt, Human
aggagaucaagcccagcaaugguggcagaaucuuacuccacagacuucagcagacuagucauuu

SEQ ID NO: 249160 - RNA, 64 nt, Human; identical to SEQ ID NO: 248942

SEQ ID NO: 249161 - RNA, 64 nt, Human; identical to SEQ ID NO: 248943

SEQ ID NO: 249162 - RNA, 64 nt, Human; identical to SEQ ID NO: 248944

SEQ ID NO: 249163 - RNA, 64 nt, Human; identical to SEQ ID NO: 248945

SEQ ID NO: 249164 - RNA, 64 nt, Human; identical to SEQ ID NO: 248946

SEQ ID NO: 249165 - RNA, 64 nt, Human; identical to SEQ ID NO: 248947

SEQ ID NO: 249166 - RNA, 64 nt, Human; identical to SEQ ID NO: 248948

SEQ ID NO: 249167 - RNA, 64 nt, Human; identical to SEQ ID NO: 248949

SEQ ID NO: 249168 - RNA, 64 nt, Human; identical to SEQ ID NO: 248950

SEQ ID NO: 249169 - RNA, 64 nt, Human; identical to SEQ ID NO: 248951

SEQ ID NO: 249170 - RNA, 64 nt, Human; identical to SEQ ID NO: 248952

SEQ ID NO: 249171 - RNA, 64 nt, Human; identical to SEQ ID NO: 248953

SEQ ID NO: 249172 - RNA, 64 nt, Human; identical to SEQ ID NO: 248954

SEQ ID NO: 249173 - RNA, 64 nt, Human; identical to SEQ ID NO: 248955

SEQ ID NO: 249174 - RNA, 64 nt, Human; identical to SEQ ID NO: 248956

SEQ ID NO: 249175 - RNA, 64 nt, Human; identical to SEQ ID NO: 248957

SEQ ID NO: 249176 - RNA, 64 nt, Human; identical to SEQ ID NO: 248958

SEQ ID NO: 249177 - RNA, 64 nt, Human; identical to SEQ ID NO: 248959

SEQ ID NO: 249178 - RNA, 64 nt, Human; identical to SEQ ID NO: 248960

SEQ ID NO: 249179 - RNA, 63 nt, Human; identical to SEQ ID NO: 248961

SEQ ID NO: 249180 - RNA, 64 nt, Human; identical to SEQ ID NO: 248962

SEQ ID NO: 249181 - RNA, 64 nt, Human; identical to SEQ ID NO: 248963

SEQ ID NO: 249182 - RNA, 64 nt, Human; identical to SEQ ID NO: 248964

SEQ ID NO: 249183 - RNA, 64 nt, Human; identical to SEQ ID NO: 248965

SEQ ID NO: 249184 - RNA, 64 nt, Human; identical to SEQ ID NO: 248966

SEQ ID NO: 249185 - RNA, 64 nt, Human; identical to SEQ ID NO: 248967

SEQ ID NO: 249186 - RNA, 64 nt, Human; identical to SEQ ID NO: 248968

SEQ ID NO: 249187 - RNA, 64 nt, Human; identical to SEQ ID NO: 248969

SEQ ID NO: 249188 - RNA, 64 nt, Human; identical to SEQ ID NO: 248970

SEQ ID NO: 249189 - RNA, 64 nt, Human; identical to SEQ ID NO: 248971

SEQ ID NO: 249190 - RNA, 64 nt, Human; identical to SEQ ID NO: 248972

SEQ ID NO: 249191 - RNA, 64 nt, Human; identical to SEQ ID NO: 248973

SEQ ID NO: 249192 - RNA, 64 nt, Human; identical to SEQ ID NO: 248974

SEQ ID NO: 249193 - RNA, 64 nt, Human; identical to SEQ ID NO: 248975

SEQ ID NO: 249194 - RNA, 64 nt, Human; identical to SEQ ID NO: 248976

SEQ ID NO: 249195 - RNA, 64 nt, Human; identical to SEQ ID NO: 248977

SEQ ID NO: 249196 - RNA, 64 nt, Human; identical to SEQ ID NO: 248978

SEQ ID NO: 249197 - RNA, 64 nt, Human; identical to SEQ ID NO: 248979

SEQ ID NO: 249198 - RNA, 64 nt, Human; identical to SEQ ID NO: 248980

SEQ ID NO: 249199 - RNA, 64 nt, Human; identical to SEQ ID NO: 248981

SEQ ID NO: 249200 - RNA, 64 nt, Human; identical to SEQ ID NO: 248982

SEQ ID NO: 249201 - RNA, 64 nt, Human; identical to SEQ ID NO: 248983

SEQ ID NO: 249202 - RNA, 64 nt, Human; identical to SEQ ID NO: 248984

SEQ ID NO: 249203 - RNA, 64 nt, Human; identical to SEQ ID NO: 248985

SEQ ID NO: 249204 - RNA, 64 nt, Human; identical to SEQ ID NO: 248986

SEQ ID NO: 249205 - RNA, 64 nt, Human; identical to SEQ ID NO: 248987

SEQ ID NO: 249206 - RNA, 64 nt, Human; identical to SEQ ID NO: 248988

SEQ ID NO: 249207 - RNA, 64 nt, Human; identical to SEQ ID NO: 248989

SEQ ID NO: 249208 - RNA, 64 nt, Human; identical to SEQ ID NO: 248990

SEQ ID NO: 249209 - RNA, 64 nt, Human; identical to SEQ ID NO: 248991

SEQ ID NO: 249210 - RNA, 64 nt, Human; identical to SEQ ID NO: 248992

SEQ ID NO: 249211 - RNA, 64 nt, Human; identical to SEQ ID NO: 248993

SEQ ID NO: 249212 - RNA, 64 nt, Human; identical to SEQ ID NO: 248994

SEQ ID NO: 249213 - RNA, 64 nt, Human; identical to SEQ ID NO: 248995

SEQ ID NO: 249214 - RNA, 64 nt, Human; identical to SEQ ID NO: 248996

SEQ ID NO: 249215 - RNA, 64 nt, Human; identical to SEQ ID NO: 248997

SEQ ID NO: 249216 - RNA, 64 nt, Human; identical to SEQ ID NO: 248998

SEQ ID NO: 249217 - RNA, 64 nt, Human; identical to SEQ ID NO: 248999

SEQ ID NO: 249218 - RNA, 64 nt, Human; identical to SEQ ID NO: 249000

SEQ ID NO: 249219 - RNA, 63 nt, Human; identical to SEQ ID NO: 249001

SEQ ID NO: 249220 - RNA, 64 nt, Human; identical to SEQ ID NO: 249002

SEQ ID NO: 249221 - RNA, 64 nt, Human; identical to SEQ ID NO: 249003

SEQ ID NO: 249222 - RNA, 64 nt, Human; identical to SEQ ID NO: 249004

SEQ ID NO: 249223 - RNA, 64 nt, Human; identical to SEQ ID NO: 249005

SEQ ID NO: 249224 - RNA, 64 nt, Human; identical to SEQ ID NO: 249006

SEQ ID NO: 249225 - RNA, 64 nt, Human; identical to SEQ ID NO: 249007

SEQ ID NO: 249226 - RNA, 64 nt, Human; identical to SEQ ID NO: 249008

SEQ ID NO: 249227 - RNA, 64 nt, Human; identical to SEQ ID NO: 249009

SEQ ID NO: 249228 - RNA, 64 nt, Human; identical to SEQ ID NO: 249010

SEQ ID NO: 249229 - RNA, 64 nt, Human; identical to SEQ ID NO: 249011

SEQ ID NO: 249230 - RNA, 64 nt, Human; identical to SEQ ID NO: 249012

SEQ ID NO: 249231 - RNA, 64 nt, Human; identical to SEQ ID NO: 249013

SEQ ID NO: 249232 - RNA, 64 nt, Human; identical to SEQ ID NO: 249014

SEQ ID NO: 249233 - RNA, 64 nt, Human; identical to SEQ ID NO: 249015

SEQ ID NO: 249234 - RNA, 64 nt, Human; identical to SEQ ID NO: 249016

SEQ ID NO: 249235 - RNA, 64 nt, Human; identical to SEQ ID NO: 249017

SEQ ID NO: 249236 - RNA, 64 nt, Human; identical to SEQ ID NO: 249018

SEQ ID NO: 249237 - RNA, 64 nt, Human; identical to SEQ ID NO: 249019

SEQ ID NO: 249238 - RNA, 64 nt, Human; identical to SEQ ID NO: 249020

SEQ ID NO: 249239 - RNA, 64 nt, Human; identical to SEQ ID NO: 249021

SEQ ID NO: 249240 - RNA, 64 nt, Human; identical to SEQ ID NO: 249022

SEQ ID NO: 249241 - RNA, 64 nt, Human; identical to SEQ ID NO: 249023

SEQ ID NO: 249242 - RNA, 64 nt, Human; identical to SEQ ID NO: 249024

SEQ ID NO: 249243 - RNA, 64 nt, Human; identical to SEQ ID NO: 249025

SEQ ID NO: 249244 - RNA, 64 nt, Human; identical to SEQ ID NO: 249026

SEQ ID NO: 249245 - RNA, 64 nt, Human; identical to SEQ ID NO: 249027

SEQ ID NO: 249246 - RNA, 64 nt, Human; identical to SEQ ID NO: 249028

SEQ ID NO: 249247 - RNA, 64 nt, Human; identical to SEQ ID NO: 249029

SEQ ID NO: 249248 - RNA, 64 nt, Human; identical to SEQ ID NO: 249030

SEQ ID NO: 249249 - RNA, 64 nt, Human; identical to SEQ ID NO: 249031

SEQ ID NO: 249250 - RNA, 64 nt, Human; identical to SEQ ID NO: 249032

SEQ ID NO: 249251 - RNA, 64 nt, Human; identical to SEQ ID NO: 249033

SEQ ID NO: 249252 - RNA, 64 nt, Human; identical to SEQ ID NO: 249034

SEQ ID NO: 249253 - RNA, 64 nt, Human; identical to SEQ ID NO: 249035

SEQ ID NO: 249254 - RNA, 64 nt, Human; identical to SEQ ID NO: 249036

SEQ ID NO: 249255 - RNA, 64 nt, Human; identical to SEQ ID NO: 249037

SEQ ID NO: 249256 - RNA, 64 nt, Human; identical to SEQ ID NO: 249038

SEQ ID NO: 249257 - RNA, 64 nt, Human; identical to SEQ ID NO: 249039

SEQ ID NO: 249258 - RNA, 64 nt, Human; identical to SEQ ID NO: 249040

SEQ ID NO: 249259 - RNA, 64 nt, Human; identical to SEQ ID NO: 249041

SEQ ID NO: 249260 - RNA, 64 nt, Human; identical to SEQ ID NO: 249042

SEQ ID NO: 249261 - RNA, 64 nt, Human; identical to SEQ ID NO: 249043

SEQ ID NO: 249262 - RNA, 64 nt, Human; identical to SEQ ID NO: 249044

SEQ ID NO: 249263 - RNA, 64 nt, Human; identical to SEQ ID NO: 249045

SEQ ID NO: 249264 - RNA, 64 nt, Human; identical to SEQ ID NO: 249046

SEQ ID NO: 249265 - RNA, 64 nt, Human; identical to SEQ ID NO: 249047

SEQ ID NO: 249266 - RNA, 64 nt, Human; identical to SEQ ID NO: 249048

SEQ ID NO: 249267 - RNA, 64 nt, Human; identical to SEQ ID NO: 249049

SEQ ID NO: 249268 - RNA, 64 nt, Human; identical to SEQ ID NO: 249050

SEQ ID NO: 249269 - RNA, 64 nt, Human; identical to SEQ ID NO: 249051

SEQ ID NO: 249270 - RNA, 64 nt, Human; identical to SEQ ID NO: 249052

SEQ ID NO: 249271 - RNA, 64 nt, Human; identical to SEQ ID NO: 249053

SEQ ID NO: 249272 - RNA, 64 nt, Human; identical to SEQ ID NO: 249054

SEQ ID NO: 249273 - RNA, 64 nt, Human; identical to SEQ ID NO: 249055

SEQ ID NO: 249274 - RNA, 64 nt, Human; identical to SEQ ID NO: 249056

SEQ ID NO: 249275 - RNA, 64 nt, Human; identical to SEQ ID NO: 249057

SEQ ID NO: 249276 - RNA, 64 nt, Human; identical to SEQ ID NO: 249058

SEQ ID NO: 249277 - RNA, 64 nt, Human; identical to SEQ ID NO: 249059

SEQ ID NO: 249278 - RNA, 64 nt, Human; identical to SEQ ID NO: 249060

SEQ ID NO: 249279 - RNA, 64 nt, Human; identical to SEQ ID NO: 249061

SEQ ID NO: 249280 - RNA, 64 nt, Human; identical to SEQ ID NO: 249062

SEQ ID NO: 249281 - RNA, 64 nt, Human; identical to SEQ ID NO: 249063

SEQ ID NO: 249282 - RNA, 64 nt, Human; identical to SEQ ID NO: 249064

SEQ ID NO: 249283 - RNA, 64 nt, Human; identical to SEQ ID NO: 249065

SEQ ID NO: 249284 - RNA, 64 nt, Human; identical to SEQ ID NO: 249066

SEQ ID NO: 249285 - RNA, 64 nt, Human; identical to SEQ ID NO: 249067

SEQ ID NO: 249286 - RNA, 63 nt, Human; identical to SEQ ID NO: 249068

SEQ ID NO: 249287 - RNA, 64 nt, Human; identical to SEQ ID NO: 249069

SEQ ID NO: 249288 - RNA, 64 nt, Human; identical to SEQ ID NO: 249070

SEQ ID NO: 249289 - RNA, 64 nt, Human; identical to SEQ ID NO: 249071

SEQ ID NO: 249290 - RNA, 64 nt, Human; identical to SEQ ID NO: 249072

SEQ ID NO: 249291 - RNA, 64 nt, Human; identical to SEQ ID NO: 249073

SEQ ID NO: 249292 - RNA, 64 nt, Human; identical to SEQ ID NO: 249074

SEQ ID NO: 249293 - RNA, 64 nt, Human; identical to SEQ ID NO: 249075

SEQ ID NO: 249294 - RNA, 64 nt, Human; identical to SEQ ID NO: 249076

SEQ ID NO: 249295 - RNA, 64 nt, Human; identical to SEQ ID NO: 249077

SEQ ID NO: 249296 - RNA, 64 nt, Human; identical to SEQ ID NO: 249078

SEQ ID NO: 249297 - RNA, 64 nt, Human; identical to SEQ ID NO: 249079

SEQ ID NO: 249298 - RNA, 64 nt, Human; identical to SEQ ID NO: 249080

SEQ ID NO: 249299 - RNA, 64 nt, Human; identical to SEQ ID NO: 249081

SEQ ID NO: 249300 - RNA, 64 nt, Human; identical to SEQ ID NO: 249082

SEQ ID NO: 249301 - RNA, 64 nt, Human; identical to SEQ ID NO: 249083

SEQ ID NO: 249302 - RNA, 64 nt, Human; identical to SEQ ID NO: 249084

SEQ ID NO: 249303 - RNA, 64 nt, Human; identical to SEQ ID NO: 249085

SEQ ID NO: 249304 - RNA, 64 nt, Human; identical to SEQ ID NO: 249086

SEQ ID NO: 249305 - RNA, 64 nt, Human; identical to SEQ ID NO: 249087

SEQ ID NO: 249306 - RNA, 64 nt, Human; identical to SEQ ID NO: 249088

SEQ ID NO: 249307 - RNA, 64 nt, Human; identical to SEQ ID NO: 249089

SEQ ID NO: 249308 - RNA, 64 nt, Human; identical to SEQ ID NO: 249090

SEQ ID NO: 249309 - RNA, 64 nt, Human; identical to SEQ ID NO: 249091

SEQ ID NO: 249310 - RNA, 64 nt, Human; identical to SEQ ID NO: 249092

SEQ ID NO: 249311 - RNA, 64 nt, Human; identical to SEQ ID NO: 249093

SEQ ID NO: 249312 - RNA, 64 nt, Human; identical to SEQ ID NO: 249094

SEQ ID NO: 249313 - RNA, 64 nt, Human; identical to SEQ ID NO: 249095

SEQ ID NO: 249314 - RNA, 64 nt, Human; identical to SEQ ID NO: 249096

SEQ ID NO: 249315 - RNA, 64 nt, Human; identical to SEQ ID NO: 249097

SEQ ID NO: 249316 - RNA, 64 nt, Human; identical to SEQ ID NO: 249098

SEQ ID NO: 249317 - RNA, 64 nt, Human; identical to SEQ ID NO: 249099

SEQ ID NO: 249318 - RNA, 64 nt, Human; identical to SEQ ID NO: 249100

SEQ ID NO: 249319 - RNA, 64 nt, Human; identical to SEQ ID NO: 249101

SEQ ID NO: 249320 - RNA, 64 nt, Human; identical to SEQ ID NO: 249102

SEQ ID NO: 249321 - RNA, 64 nt, Human; identical to SEQ ID NO: 249103

SEQ ID NO: 249322 - RNA, 64 nt, Human; identical to SEQ ID NO: 249104

SEQ ID NO: 249323 - RNA, 64 nt, Human; identical to SEQ ID NO: 249105

SEQ ID NO: 249324 - RNA, 64 nt, Human; identical to SEQ ID NO: 249106

SEQ ID NO: 249325 - RNA, 64 nt, Human; identical to SEQ ID NO: 249107

SEQ ID NO: 249326 - RNA, 56 nt, Human; identical to SEQ ID NO: 249108

SEQ ID NO: 249327 - RNA, 64 nt, Human; identical to SEQ ID NO: 249109

SEQ ID NO: 249328 - RNA, 64 nt, Human; identical to SEQ ID NO: 249110

SEQ ID NO: 249329 - RNA, 64 nt, Human; identical to SEQ ID NO: 249111

SEQ ID NO: 249330 - RNA, 64 nt, Human; identical to SEQ ID NO: 249112

SEQ ID NO: 249331 - RNA, 64 nt, Human; identical to SEQ ID NO: 249113

SEQ ID NO: 249332 - RNA, 64 nt, Human; identical to SEQ ID NO: 249114

SEQ ID NO: 249333 - RNA, 64 nt, Human; identical to SEQ ID NO: 249115

SEQ ID NO: 249334 - RNA, 58 nt, Human; identical to SEQ ID NO: 249116

SEQ ID NO: 249335 - RNA, 64 nt, Human; identical to SEQ ID NO: 249117

SEQ ID NO: 249336 - RNA, 64 nt, Human; identical to SEQ ID NO: 249118

SEQ ID NO: 249337 - RNA, 64 nt, Human; identical to SEQ ID NO: 249119

SEQ ID NO: 249338 - RNA, 64 nt, Human; identical to SEQ ID NO: 249120

SEQ ID NO: 249339 - RNA, 64 nt, Human; identical to SEQ ID NO: 249121

SEQ ID NO: 249340 - RNA, 64 nt, Human; identical to SEQ ID NO: 249122

SEQ ID NO: 249341 - RNA, 64 nt, Human; identical to SEQ ID NO: 249123

SEQ ID NO: 249342 - RNA, 54 nt, Human; identical to SEQ ID NO: 249124

SEQ ID NO: 249343 - RNA, 64 nt, Human; identical to SEQ ID NO: 249125

SEQ ID NO: 249344 - RNA, 64 nt, Human; identical to SEQ ID NO: 249126

SEQ ID NO: 249345 - RNA, 64 nt, Human; identical to SEQ ID NO: 249127

SEQ ID NO: 249346 - RNA, 64 nt, Human; identical to SEQ ID NO: 249128

SEQ ID NO: 249347 - RNA, 64 nt, Human; identical to SEQ ID NO: 249129

SEQ ID NO: 249348 - RNA, 64 nt, Human; identical to SEQ ID NO: 249130

SEQ ID NO: 249349 - RNA, 64 nt, Human; identical to SEQ ID NO: 249131

SEQ ID NO: 249350 - RNA, 64 nt, Human; identical to SEQ ID NO: 249132

SEQ ID NO: 249351 - RNA, 64 nt, Human; identical to SEQ ID NO: 249133

SEQ ID NO: 249352 - RNA, 64 nt, Human; identical to SEQ ID NO: 249134

SEQ ID NO: 249353 - RNA, 64 nt, Human; identical to SEQ ID NO: 249135

SEQ ID NO: 249354 - RNA, 64 nt, Human; identical to SEQ ID NO: 249136

SEQ ID NO: 249355 - RNA, 64 nt, Human; identical to SEQ ID NO: 249137

SEQ ID NO: 249356 - RNA, 64 nt, Human; identical to SEQ ID NO: 249138

SEQ ID NO: 249357 - RNA, 64 nt, Human; identical to SEQ ID NO: 249139

SEQ ID NO: 249358 - RNA, 64 nt, Human; identical to SEQ ID NO: 249140

SEQ ID NO: 249359 - RNA, 64 nt, Human; identical to SEQ ID NO: 249141

SEQ ID NO: 249360 - RNA, 64 nt, Human; identical to SEQ ID NO: 249142

SEQ ID NO: 249361 - RNA, 64 nt, Human; identical to SEQ ID NO: 249143

SEQ ID NO: 249362 - RNA, 64 nt, Human; identical to SEQ ID NO: 249144

SEQ ID NO: 249363 - RNA, 64 nt, Human; identical to SEQ ID NO: 249145

SEQ ID NO: 249364 - RNA, 64 nt, Human; identical to SEQ ID NO: 249146

SEQ ID NO: 249365 - RNA, 64 nt, Human; identical to SEQ ID NO: 249147

SEQ ID NO: 249366 - RNA, 64 nt, Human; identical to SEQ ID NO: 249148

SEQ ID NO: 249367 - RNA, 64 nt, Human; identical to SEQ ID NO: 249149

SEQ ID NO: 249368 - RNA, 64 nt, Human; identical to SEQ ID NO: 249150

SEQ ID NO: 249369 - RNA, 64 nt, Human; identical to SEQ ID NO: 249151

SEQ ID NO: 249370 - RNA, 64 nt, Human; identical to SEQ ID NO: 249152

SEQ ID NO: 249371 - RNA, 64 nt, Human; identical to SEQ ID NO: 249153

SEQ ID NO: 249372 - RNA, 64 nt, Human; identical to SEQ ID NO: 249154

SEQ ID NO: 249373 - RNA, 64 nt, Human; identical to SEQ ID NO: 249155

SEQ ID NO: 249374 - RNA, 64 nt, Human; identical to SEQ ID NO: 249156

SEQ ID NO: 249375 - RNA, 64 nt, Human; identical to SEQ ID NO: 249157

SEQ ID NO: 249376 - RNA, 64 nt, Human; identical to SEQ ID NO: 249158

SEQ ID NO: 249377 - RNA, 64 nt, Human; identical to SEQ ID NO: 249159

SEQ ID NO: 249378 - RNA, 64 nt, Human
ugccuacuguccgacaggaugccuugauccucgugcgacccacccuguguauccucccuagacu

SEQ ID NO: 249379 - RNA, 64 nt, Human
ugaucccauauuuccuacucaccuuccaaauggugcgacccaacuucauuuguuuacuugaaaa

SEQ ID NO: 249380 - RNA, 64 nt, Human
aggacuggccucccugaucucucuccucauggcagcgacccaccuccaguccccuggacaaucg

SEQ ID NO: 249381 - RNA, 64 nt, Human
gggacacucagcgggaagggggcuggcaucgccagcgacccacacauuccucacguagcuucug

SEQ ID NO: 249382 - RNA, 64 nt, Human
gcucggaggcaucugugcgaaggugcagcuagcggcgacccaguguacgucccgccccggccaa

SEQ ID NO: 249383 - RNA, 64 nt, Human
caggagaaucgcuugaacccgggaggcggagguugcgacccaaagcuuaugaaagaagaacaaa

SEQ ID NO: 249384 - RNA, 64 nt, Human
ggagccuccugggggcuccggcggcggcgcgggcgcgacccaucccgcuggcgcuccccgcucg

SEQ ID NO: 249385 - RNA, 64 nt, Human
caggccugaaugagcaggaaacaaaaaaggccuugcgacccagcugccauaaccaccuuagaac

SEQ ID NO: 249386 - RNA, 64 nt, Human
agggguagagagucagccucccucccuuccagcagcgacccagcuucccuccacuuccaggugg

SEQ ID NO: 249387 - RNA, 64 nt, Human
ccuuaaguuuucuccccucucagcaauaggaguagcgacccagguggagcugagauuaggccuc

SEQ ID NO: 249388 - RNA, 58 nt, Human
augacagcauauuaaagugagugacccugcgacccacucuuuggaccagcagcggaug

SEQ ID NO: 249389 - RNA, 64 nt, Human
ccugugcgccuugugacauuuauugguguuggccgcgacccacacaccuuuggccucaucgcug

SEQ ID NO: 249390 - RNA, 64 nt, Human
uccugaccaauuuauuuguuguuuucuguggguugcgacccaugcaaucaaaaagcaaaauuuu

SEQ ID NO: 249391 - RNA, 64 nt, Human
cccuugguggucuaaacggaugcugcuggguguugcgacccaggacgagaugccuuguuucuuu

SEQ ID NO: 249392 - RNA, 64 nt, Human
ucauguaccuacgccacagacagccagagggaaagcgacccagacagcagccccuccucgacag

SEQ ID NO: 249393 - RNA, 50 nt, Human
agacauccaucaccuacugagcgacccagcagccaccuccuuccugaaca

SEQ ID NO: 249394 - RNA, 64 nt, Human
gccagucauuucucagugaaauaaauacaauaccagaguacauuauggguuuuauugcuuucuu

SEQ ID NO: 249395 - RNA, 64 nt, Human
guuugaggaccauguagccuuuaagaaggaauuaagaguacacugauaauugcaacuguuucuu

SEQ ID NO: 249396 - RNA, 64 nt, Human
acuccugguguucgccccggacaagcgguuaagcgcgacccaggcacugcagcaccccuacgug

SEQ ID NO: 249397 - RNA, 64 nt, Human
aaacucgaaccguuucacugucagccugcccucggcgacccaucacuggguaugcuauuguaca

SEQ ID NO: 249398 - RNA, 64 nt, Human
cugguucgagcggugaagccgcgcuccccuggaagcgacccaggggaggccaaguugucagcuu

SEQ ID NO: 249399 - RNA, 64 nt, Human
uuauaagaagagaagaucuugagugaagcagcacgcgacccaggugugugugaauugaauggag

SEQ ID NO: 249400 - RNA, 64 nt, Human
ugaacugucagaaagcaaaggugucacuaucuuagcgacccaagugguggugucagcacucaaa

SEQ ID NO: 249401 - RNA, 64 nt, Human
cggagcaggcgggcugaggagaguggaaaaggaagcgacccagaaauggcagggacacuucucu

SEQ ID NO: 249402 - RNA, 64 nt, Human
cuagcgccuucgggacgccggggacucugcggcggcgacccacgagcucgcggcccgcgcccgg

SEQ ID NO: 249403 - RNA, 64 nt, Human
aaagaaacauuuguuugcauaggaauucaugaaggcgacccaaccuggaaaaagaacuauucac

SEQ ID NO: 249404 - RNA, 64 nt, Human
aagggcagcugcuuuuccugucuuuugugcaugggcgacccauuacaguaugagauaagauuga

SEQ ID NO: 249405 - RNA, 64 nt, Human
agccaggagagagggggcucaccucuuauccucggcgacccacugcacaagcaggccgcucucc

SEQ ID NO: 249406 - RNA, 64 nt, Human
guccuagccugggagaucaaggcuacagugagccgcgacccaucgcacaccugcacuccagucc

SEQ ID NO: 249407 - RNA, 64 nt, Human
ggucugcaugacacuaagacgcuuguccacagcggcgacccaggccuccaagcuugcacagagg

SEQ ID NO: 249408 - RNA, 64 nt, Human
ggaagcggcccuaagggagugucuaagaacaaaagcgacccauucagagacugucccugaaacc

SEQ ID NO: 249409 - RNA, 64 nt, Human
cagaggccagaguuuggugggggcagauggcagggcgacccaaaagaugcagaaaagguagacu

SEQ ID NO: 249410 - RNA, 64 nt, Human
augcuggaggcaugccugcagaaggacuguugaugcgacccaaagauacagcggugggaucucu

SEQ ID NO: 249411 - RNA, 64 nt, Human
gcucaggacacgcuccuauaggaccaagauggaugcgacccaagacccaggaggcccagcugcu

SEQ ID NO: 249412 - RNA, 62 nt, Human
gacugagagggagucagcaggcaugcugcgguggcggucacucccucugccacuauccccag

SEQ ID NO: 249413 - RNA, 62 nt, Human
ugguggguggguugagcuuuagggaaguauauggcggucauuccuggugcgccuaucggugu

SEQ ID NO: 249414 - RNA, 62 nt, Human
agccaaccccagccuccugccaggaucaccucggcggucacacuccagccaaauaguguucu

SEQ ID NO: 249415 - RNA, 62 nt, Human
uagccagagggucaggagagaaugggggaggaggcggucaggcugcugaggaaacaccacag

SEQ ID NO: 249416 - RNA, 64 nt, Human
gguuuugcuuccugcuggaggcagggcaccugcugcgacccagauucuucugcaggaugugucu

SEQ ID NO: 249417 - RNA, 64 nt, Human
cuuagcugagcugggaggagcagggugagggugggcgacccaggauucccccuccccuucccaa

SEQ ID NO: 249418 - RNA, 64 nt, Human
ggggcaacuccgagugggugcucaagucccccccgcgacccacccgcggaguggggggcccccu

SEQ ID NO: 249419 - RNA, 64 nt, Human
uggauucuggucccugcugucccugccuggcugagcgacccagggcaggucccgucccugucug

SEQ ID NO: 249420 - RNA, 64 nt, Human
ggugaccgcccgccucuguccugcgagggccggugcgacccaguugcugggggcuugguuuccu

SEQ ID NO: 249421 - RNA, 64 nt, Human
cacccccaaguguugggccaucugccaagagacagcgacccaaagccgaaggacagguggccug

SEQ ID NO: 249422 - RNA, 64 nt, Human
gcagugaugacacaggcacuggcccccggagggagcgacccagccggcggcugaccacaggcac

SEQ ID NO: 249423 - RNA, 64 nt, Human
guuuuuguuuuuguuuuuuuaaaggaaacuauuugugggcuauaggaaacuuucugaugccucc

SEQ ID NO: 249424 - RNA, 62 nt, Human
ccaagcaccaccaaacacaguguaugaaggggggcggucaucauuucacuugucaggagugu

SEQ ID NO: 249425 - RNA, 62 nt, Human
cucuggaagcaucugugucauggccaucgcccggcggucagugggcuucagaugggccugug

SEQ ID NO: 249426 - RNA, 62 nt, Human
gagaaauguggcuuuguuccaccuggcucaccggcggucagaauuuaagguuaucucucuug

SEQ ID NO: 249427 - RNA, 64 nt, Human
agugacauaaaucuuuaguucggggcaagccagggugggcuagggugguaagcuggaggacuuc

SEQ ID NO: 249428 - RNA, 64 nt, Human
cugcugcaggagcaugcacagcggugcuauguccgugggcuauuccgcagcuugcagcaagcac

SEQ ID NO: 249429 - RNA, 64 nt, Human
uaucucaaguucaaaggccaaaaccugagaagcggugggcuaagauagguccuacugcaaacca

SEQ ID NO: 249430 - RNA, 64 nt, Human
gguuuuucuaaauuccaacauuuaaaaggcaauugugggcuauuuuuauuuuuuaauauuuuga

SEQ ID NO: 249431 - RNA, 64 nt, Human
cuguccguggccagcaccccggggcccgggaggggugggcuacuagagucagagcggguuuggg

SEQ ID NO: 249432 - RNA, 64 nt, Human
caaauauucacuggccccuacuuuguggcaaucugugggcuacaugcuggggucaaggcaguag

SEQ ID NO: 249433 - RNA, 64 nt, Human
aaacacuugacugcuccuagcagaugauacagcagugggcuacauacaaugagagcccugagcc

SEQ ID NO: 249434 - RNA, 64 nt, Human
gaguuuagugugauaaaggcaguauuucagacuggugggcuagccaauagaguugggacaauug

SEQ ID NO: 249435 - RNA, 64 nt, Human
uggucuguguuccuauugcugguggggugauagggugggcuaaaaaccaugcacucuggaauuu

SEQ ID NO: 249436 - RNA, 64 nt, Human
agcaucauagacauccaacagcaccagcaggagagugggcuagccugcuggaugcuguucgugc

SEQ ID NO: 249437 - RNA, 64 nt, Human
uauaagacuguaugaacaaggugauaucuucauagugggcuauuacaggcaggaaaauguuuua

SEQ ID NO: 249438 - RNA, 64 nt, Human
accccccaucucagcccuuuauuuuaucuuucaugugggcuaaugugaggauaaucuuacagau

SEQ ID NO: 249439 - RNA, 64 nt, Human
ggcacagguuacucaugaugcuucugcagagacugugggcuacaccacauauguuauuuggaaa

SEQ ID NO: 249440 - RNA, 64 nt, Human
ggugugcuccauacccagcgguucuucaugaguagugggcuaugcaggagcuucugggagauuu

SEQ ID NO: 249441 - RNA, 64 nt, Human
ccagauagccuagggugagggugacagagggacagugggcuaugccacuaggcccuggucuggc

SEQ ID NO: 249442 - RNA, 64 nt, Human
acccaagugaugucacuaccaaggccaaaugauggugggcuaaauuuuaauucucaaaagugua

SEQ ID NO: 249443 - RNA, 62 nt, Human
cacgccuguaaucccagacuuugagaggccaaggcggucacgaggucaggaguucgagacca

SEQ ID NO: 249444 - RNA, 62 nt, Human
cuaaaaauacaaaaaaauuagccaggcgugguggcggucaccuguagucccagcuacucggg

SEQ ID NO: 249445 - RNA, 62 nt, Human
cauguggcccccauaggccucuguggcugcaaggcggucaguugcugcuugucccagcaggu

SEQ ID NO: 249446 - RNA, 64 nt, Human
ugaaggaacuuccaaauggaacucccgauuucaggugggcuaaaagagggcuuagguuuggaaa

SEQ ID NO: 249447 - RNA, 64 nt, Human
aucccauagcaccccgcccuugccccaucacccugugggcuacaugcaggacacggcaugggcc

SEQ ID NO: 249448 - RNA, 64 nt, Human
cagaaaucagaucagcccucaaagaauggggucugugggcuaguuaaaauagaaauaaacuuuu

SEQ ID NO: 249449 - RNA, 64 nt, Human
aaaaagaaaggauauagauuccuugaguggaauagugggcuagauuaauauaccgaaauauuuc

SEQ ID NO: 249450 - RNA, 64 nt, Human
aagccuggauugugaagguauuaagaaucggucugugggcuacugaguggguccuuaggauacu

SEQ ID NO: 249451 - RNA, 64 nt, Human
gcucuggacuccacggaugcgugggcagaggaaugugggcuauguagucauaauaaauuaggac

SEQ ID NO: 249452 - RNA, 64 nt, Human
ucaaaaaauagaugcaggcugaaaagaaaaggaagugggcuaagaugggaaaaauauaaaaaga

SEQ ID NO: 249453 - RNA, 64 nt, Human
cucccugucaccugccuccucaucauggaagggggugggcuaugaaagccggucucaaagauaa

SEQ ID NO: 249454 - RNA, 64 nt, Human
uuuuuauauccacuaaaaucaaacaauucagggagugggcuaagcacgggccauaugaauaaca

SEQ ID NO: 249455 - RNA, 64 nt, Human
uggaucaguaggagaagcugagugcaaaugccaugugggcuagaguaugggaagguugaaaauu

SEQ ID NO: 249456 - RNA, 64 nt, Human
uuuuuuuuuuuuggucucuuuugguggggugggggugggcuaaagccauaggaagaaaaaugug

SEQ ID NO: 249457 - RNA, 64 nt, Human
uuauuccacuucgguagaggauuucuaguuucuugugggcuaauuaaauaaaucauuaauacuc

SEQ ID NO: 249458 - RNA, 64 nt, Human
uaaagugucuccagcugugaacccaggaggucaagugggcuauuaaaaucuaacguugaguaaa

SEQ ID NO: 249459 - RNA, 64 nt, Human
ugcccaacguggagcgggcagugugauaggcugggugggcuaagcagccuagucuaugugggug

SEQ ID NO: 249460 - RNA, 64 nt, Human
guguauaaguggaaagggcauuuuucacauauaagugggcuaaccaauauuuucaaaagaacuu

SEQ ID NO: 249461 - RNA, 64 nt, Human
ggguccuugagaauacuucuguuauugagacccugugggcuacuuguacuguaccuccucucaa

SEQ ID NO: 249462 - RNA, 62 nt, Human
caaggggugauggccggcugguugugggcacuggcggucaaguguggaggagagggguggag

SEQ ID NO: 249463 - RNA, 54 nt, Human
aggcgacgcuaaguugcugaucguggcggucaguggugucucucaccucaaauu

SEQ ID NO: 249464 - RNA, 62 nt, Human
cugccugcguaucugucucugagaauccucggggcggucaggggaugucaggaggggaagga

SEQ ID NO: 249465 - RNA, 64 nt, Human
gcuucuggguagcugggcuucuggaaggguggcagugggcuacucccugcucagcgcuccccug

SEQ ID NO: 249466 - RNA, 64 nt, Human
auuggacaucaacaaggcuagaagggucagggaagugggcuaaaggaacagauuccuagagauu

SEQ ID NO: 249467 - RNA, 64 nt, Human
aauaaauccuuuguuauuauaacuguccagaagugugggcuauguauuaucugaucagucuaug

SEQ ID NO: 249468 - RNA, 64 nt, Human
gcaaugcuaucuaaccagaauacauaggggaacugugggcuaggcaaacaaaauagaaaaaagu

SEQ ID NO: 249469 - RNA, 64 nt, Human
cccgaaaccccugcuugggaagggaagcugucgggugggcuaggacugacccuugugguguuuu

SEQ ID NO: 249470 - RNA, 64 nt, Human
aucccaguaacaucuaaaaaugcaauucggaaaagugggcuaacaccaauucacucagcagcag

SEQ ID NO: 249471 - RNA, 64 nt, Human
ggaaaacugucagaaucaguuuucccauaaaagggugggcuagcauugcagcugcauuugggac

SEQ ID NO: 249472 - RNA, 64 nt, Human
acugaaaaccaccugggggcaggacccacagccagugggcuaagaccuuuaaaaaauuuuuuuc

SEQ ID NO: 249473 - RNA, 64 nt, Human
uucaaaggagccuaguugaagugcuauuaugagugugggcuauggaaagacagcuuuuccuaca

SEQ ID NO: 249474 - RNA, 64 nt, Human
ugacuuguguuccugaacuaugacacaugaauaugugggcuaagaaauaguuccucuugauaaa

SEQ ID NO: 249475 - RNA, 64 nt, Human
ggggauacgccauccacccuggcucuugucccaagugggcuacauuugaagaauucacccaggc

SEQ ID NO: 249476 - RNA, 64 nt, Human
cgggaacuuggagagggagcuuggagaacucacugugggcuaggguggucagaggaagccagca

SEQ ID NO: 249477 - RNA, 64 nt, Human
ugugccuccuagacacccgcccugcccuucccuggugggcuauugaagauacacaagagggacu

SEQ ID NO: 249478 - RNA, 64 nt, Human
uccuaguggguguuccuguuucuccuggcccugggugggcuagggccugauucgggaagaugcc

SEQ ID NO: 249479 - RNA, 64 nt, Human
uugaucaagucauauucguuuucuucuucggcuggugggcuacccagagcgagcacgcuucucu

SEQ ID NO: 249480 - RNA, 64 nt, Human
aacgguuauuucuguuucuuaaaaaguauuguuagugggcuauuaaacuuggauuuuucuuuuu

SEQ ID NO: 249481 - RNA, 62 nt, Human
cuuguggagauggcuuugcggcggugugagcuggcggucaggagugagggcccagccuuccc

SEQ ID NO: 249482 - RNA, 62 nt, Human
uccgcuguuuuggggucuuaggguacagcccaggcggucacugcccaccugccaggcugcag

SEQ ID NO: 249483 - RNA, 62 nt, Human
cggcugcagugggacauuccaaaacagugccaggcggucaucgagaguuccuaccagguggc

SEQ ID NO: 249484 - RNA, 64 nt, Human
aaaaaaaaaaaaaaaaaaaaagccaggcaugguggugggcuacucuggaggcccuugaggauca

SEQ ID NO: 249485 - RNA, 64 nt, Human
caguggcucauagagccgaguaugagcccuagcugugggcuagaaauguccuuaauaaacaucc

SEQ ID NO: 249486 - RNA, 64 nt, Human
gaccuuggagccaggcaugcucagagaagccuaggugggcuaccaugaccccgaggaagagcag

SEQ ID NO: 249487 - RNA, 64 nt, Human
aaauggaauuucucaucugccggcauuauuaagggugggcuagguuggauggaaggugaaaggg

SEQ ID NO: 249488 - RNA, 64 nt, Human
aacugccuucuuauacuacagaacaugcauuagugugggcuauauagcuguggcucaugcuacc

SEQ ID NO: 249489 - RNA, 64 nt, Human
caaccugguuccugcuaacugccagauugaaugugugggcuagaaugccugcacauuuaguuaa

SEQ ID NO: 249490 - RNA, 64 nt, Human
cacugacuaaagucaggcuggagucaugaggguagugggcuaagucgaggguccagccucuucu

SEQ ID NO: 249491 - RNA, 64 nt, Human
gugccccccgucccaccuuuuuccugugcucuaggugggcuaagugccucccuagaggacucca

SEQ ID NO: 249492 - RNA, 64 nt, Human
gcaugcaaaucucugaugguggcuuccagggcuugugggcuagagagagccacuuacaaagucg

SEQ ID NO: 249493 - RNA, 64 nt, Human
uaccuaacugccaaucaacacacugccaaugcgggugggcuaagccgccaggaugccugcagca

SEQ ID NO: 249494 - RNA, 64 nt, Human
ucccccauacugguagauaaagcaaacuuuauaagugggcuauugaaagaaaaguuacaagcuu

SEQ ID NO: 249495 - RNA, 64 nt, Human
gccucaaccacaauucuuccaugcuggggcugaugugggcuaguaagacuccaguucuuagagg

SEQ ID NO: 249496 - RNA, 64 nt, Human
cuaucagggauauuuuggggggggaugguaaagggugggcuaaggaacagacccugggauuagg

SEQ ID NO: 249497 - RNA, 64 nt, Human
aaaaagaaggugcuugcagguuuacaguguauaugugggcuauugaagagcccucugagcucgg

SEQ ID NO: 249498 - RNA, 64 nt, Human
uuuuuauggaugggauuugagaggccaaaggugagugggcuauuggccuucucccugaaggcuc

SEQ ID NO: 249499 - RNA, 64 nt, Human
uccagcugcguggucuccgcagaccaggcucugugugggcuagaggaaugucgcccauuacucc

SEQ ID NO: 249500 - RNA, 64 nt, Human
ccagggcccucagggaggggacccugcggcuagagugggcuaggcccuggcuuugcccgucaga

SEQ ID NO: 249501 - RNA, 64 nt, Human
ccagccagucugacaucugacguuuuccugcaaggugggcuaauaaagggaaggcuuucaggag

SEQ ID NO: 249502 - RNA, 64 nt, Human
ccaacuauguuuauuaaaaugugugaaacugaaagugggcuagguucuaccaaggcuguggaac

SEQ ID NO: 249503 - RNA, 64 nt, Human
uuuacuuugccagaaggagccuuuaggaguauaugugggcuaaucagagguuaauaauguccuc

SEQ ID NO: 249504 - RNA, 64 nt, Human
acugaccaugaucaaucuagcauauguauguucagugggcuagccuugguccucagggacagug

SEQ ID NO: 249505 - RNA, 64 nt, Human
agcaauuacggggugaccuuaugagaaacugcaugugggcuaugggagggguuggucccugguc

SEQ ID NO: 249506 - RNA, 64 nt, Human
gggcuccucgcgcacccgcgcugggggcccccgggugggcuaggccgguucugagcaaccccca

SEQ ID NO: 249507 - RNA, 64 nt, Human
gccucccuuuucaguaccuuugaacagcaaccaugugggcuacucaugaugggcuugauucuuu

SEQ ID NO: 249508 - RNA, 64 nt, Human
ugaccuguguguggcuggugcagccuggcaccaagugggcuaccuguuaggaacaugaauaccu

SEQ ID NO: 249509 - RNA, 64 nt, Human
aaauggcuucccauucuuucuauucagcuucuaagugggcuauucauuugugcucuccucuuuu

SEQ ID NO: 249510 - RNA, 64 nt, Human
gccacuacggaauaguuggcuaggaccccuccaugugggcuaguugggcuuccucauaguaugg

SEQ ID NO: 249511 - RNA, 64 nt, Human
auuccaucaggcaguuaguuccuugaugucaguagugggcuaaaggcagcuuacuguguguuug

SEQ ID NO: 249512 - RNA, 64 nt, Human
agcggaggcucaugguggggcuggggccccagaggugggcuagguguaaggcaucaguugccgu

SEQ ID NO: 249513 - RNA, 64 nt, Human
aguaagagcaaauuucaucuuuccaaauugaugggugggcuaguaauaaaauauuuaaaaaaaa

SEQ ID NO: 249514 - RNA, 64 nt, Human
uguaaguguucuuaaaaccuguaaacuucauucugugggcuaguggugugggacaaaauauucc

SEQ ID NO: 249515 - RNA, 64 nt, Human
caccucaagcagcacugcagucucccaucuccucgugggcuaagcaucaccgcuuccacgugug

SEQ ID NO: 249516 - RNA, 63 nt, Human
ccgaggagucggugugaggccgcgugcgucucugucguggacacgcgugauugacccuuuaac

SEQ ID NO: 249517 - RNA, 64 nt, Human
guuuuuaaaaaggugauaacuuuuauuagcucuugugggcuaucaagagaauuggaacaaaacc

SEQ ID NO: 249518 - RNA, 61 nt, Human
ugauucuuauggaaguucuaacaauauauggugguuccaacaccugcagugaguuuaauga

SEQ ID NO: 249519 - RNA, 61 nt, Human
gcucugaggcugagguguguucccccuugccugguuccagcugucagagggauaccauccu

SEQ ID NO: 249520 - RNA, 61 nt, Human
aagacuguuauggaaggcuggguuaaaguuaugguuccagaagcuuccaaauccugaaaua

SEQ ID NO: 249521 - RNA, 61 nt, Human
aaauugauacaaacagaaucaggacagaaaaugguuccauuuugcccaguguuguaccaca

SEQ ID NO: 249522 - RNA, 61 nt, Human
auucuuugcauauaucuagcuacucccuaaaugguuccauccaaggcuuagaguacccaaa

SEQ ID NO: 249523 - RNA, 61 nt, Human
uguuucuuacaauacccacggagcacuuuuaugguuccagccgagcguuccugaaaugaac

SEQ ID NO: 249524 - RNA, 61 nt, Human
gccugcuaauagcugcuaggguaggaaagcgugguuccaagaaagauccacccucaaaugu

SEQ ID NO: 249525 - RNA, 61 nt, Human
uaauauuucuucuaggcccugaaagcagauuugguuccauaccucuuaaaauuacucgaag

SEQ ID NO: 249526 - RNA, 61 nt, Human
ccccaggaaggagggacagcauuucucuggcugguuccacuaaaugugccagcccaaaugc

SEQ ID NO: 249527 - RNA, 61 nt, Human
cucgccaacacuacccaggacucuugcuaccugguuccaacuccagacaaccacuaugcca

SEQ ID NO: 249528 - RNA, 61 nt, Human
aauccagucuaucauuguuggacauuuggguugguuccaagucuuugcuauugugaauagu

SEQ ID NO: 249529 - RNA, 61 nt, Human
aacagaugcuugaaauaugcacuuagcacuuugguuccacaucugucuggguaaaccauga

SEQ ID NO: 249530 - RNA, 61 nt, Human
uauccagucaucucuugauggacccuuagguugguuccauaacuuugcuauuacgaauagu

SEQ ID NO: 249531 - RNA, 61 nt, Human
aggguggcuuccucccauccucccaucucagugguuccauggcgcucccuucggcacgugc

SEQ ID NO: 249532 - RNA, 61 nt, Human
caagucagccauauuguucucuggcuaaguuugguuccagccaacgucaucugcucuucag

SEQ ID NO: 249533 - RNA, 64 nt, Human
aucuccuccuuccuggucacauucaaaccuucccagaguacaaagggguauguagaaaggauuc

SEQ ID NO: 249534 - RNA, 64 nt, Human
acaucuauaaaauguaaugggauugcagagcugcagaguacaguguaacaguacucucaugcaa

SEQ ID NO: 249535 - RNA, 64 nt, Human
uuaacuuaggauccaaacauguccaaaauaaugcagaguacauaugcaaucacucguuuaugcu

SEQ ID NO: 249536 - RNA, 64 nt, Human
agggucuaugucaucaucccuuuugcuuaugguagugggcuaacauaacagccccuuucucaag

SEQ ID NO: 249537 - RNA, 64 nt, Human
gcuuauuacaacacaugcggaccaagaggggcuugugggcuagaggcugaccagcagcguuuau

SEQ ID NO: 249538 - RNA, 64 nt, Human
cauucucucucucugacuuucuguuuaaucaucugugggcuaauucccccuucucuggugccau

SEQ ID NO: 249539 - RNA, 64 nt, Human
uuacugaaaauguuuucaaaggaagguaucagcugugggcuaauugccaccaauuucagccugc

SEQ ID NO: 249540 - RNA, 64 nt, Human
aagcugggagauagggaacagaagaggguagugggugggcuaggggggcugccuuauuuaaagu

SEQ ID NO: 249541 - RNA, 64 nt, Human
aauaauugcacaacuaaaaagacauuagaacugugugggcuauaaguguucuuaucacugagac

SEQ ID NO: 249542 - RNA, 64 nt, Human
uuuuuaauuacaauggaaauuuaaacauuuuuaugugggcuacacaauggauggcucuucuuaa

SEQ ID NO: 249543 - RNA, 62 nt, Human
gcacugaccugcgucggguggugaccguggcuggcggucacgcccucagccccuccgggcac

SEQ ID NO: 249544 - RNA, 62 nt, Human
ccucccgccagacugccuggguccuggcgccuggcggucaccuggugccuacuguccgacag

SEQ ID NO: 249545 - RNA, 62 nt, Human
auaggucccgagcagcaggacuggaggccuguggcggucagggcaggggucugugucuccac

SEQ ID NO: 249546 - RNA, 62 nt, Human
ggcaccaggacccaaggcaggcuguuccuuggggcggucagaccccagucaggagcaaugac

SEQ ID NO: 249547 - RNA, 62 nt, Human
acauguaauacaaaacaaacauguaguuugaaggcggucagauuucuuugagaaaucuuugu

SEQ ID NO: 249548 - RNA, 62 nt, Human
agcaggugggaacccugggccuggaugugaggggcggucaggaagggguacagguggguucc

SEQ ID NO: 249549 - RNA, 62 nt, Human
aguacccucuaaaaaagagaaaaaaaaaaucaggcggucaaacuuagagcaacauugucuua

SEQ ID NO: 249550 - RNA, 62 nt, Human
ggucacagguuuuaugggacuuuggugagcugggcggucaugguuuugaaauaaauguauuu

SEQ ID NO: 249551 - RNA, 62 nt, Human
ugugggcccggaguaaucaggcagccuucauaggcggucaugugugcaugugagcacaugcg

SEQ ID NO: 249552 - RNA, 62 nt, Human
ggcgggcauggcguggaggaggagggaggccgggcggucacagcauggaggaggagggaggc

SEQ ID NO: 249553 - RNA, 62 nt, Human
ccagucugugcuggauuauugauauuguugguggcggucaccauuccuggaaagggacuguc

SEQ ID NO: 249554 - RNA, 62 nt, Human
cccaggaacuugguuaugguugucucaaguucggcggucaggccuacagcgacguggaacac

SEQ ID NO: 249555 - RNA, 62 nt, Human
ggggcuggaccgugaguguggggcugggcagaggcggucagccugggagucccggaggccag

SEQ ID NO: 249556 - RNA, 62 nt, Human
ugacacagccaaccugaauacuuccugccccaggcggucaggguuauggcacgaugcaggug

SEQ ID NO: 249557 - RNA, 63 nt, Human
gacaggacauuugacaugagucuccagauagaugucguggacuccagcucuacgucccacauu

SEQ ID NO: 249558 - RNA, 63 nt, Human
ucuuggggaaaccucagaacuggucuauuuggugucguggaaccucuuacugcuuucaauaca

SEQ ID NO: 249559 - RNA, 63 nt, Human
aaagauaaagucuuuugugaauuauuuccugaagucguggaggagauuaaacaaaaacagaaa

SEQ ID NO: 249560 - RNA, 63 nt, Human
uacagcaaacucagcacagccaagaagccucaggucguggagaacauggauuaggauccuaga

SEQ ID NO: 249561 - RNA, 63 nt, Human
ccuccccugagggauuaacagcaaugaugggcagucguggaguuggggggguuggggguggga

SEQ ID NO: 249562 - RNA, 50 nt, Human
cacaguuggacaugauauaggucguggauguauggggaaucuaagagagc

SEQ ID NO: 249563 - RNA, 63 nt, Human
uggacauuggggcucuuaagaaaguugacauuugucguggaaugacuuuggaaagacuucuaa

SEQ ID NO: 249564 - RNA, 63 nt, Human
gucuccgagcuacuccguaccucccucugccaggucguggaguuaggccccagucccuacuug

SEQ ID NO: 249565 - RNA, 63 nt, Human
uuuuuaaaguuuucauuugugccacaaaaaucugucguggaauauauuuuauuuucauuaauu

SEQ ID NO: 249566 - RNA, 63 nt, Human
cggcauguagcucaugaucuaugcuguuucuaugucguggaagcacuggauggggguagugag

SEQ ID NO: 249567 - RNA, 63 nt, Human
caauucagcaaggcuuucauauccuugcugugggucguggauaaggagcuuauucagguuucc

SEQ ID NO: 249568 - RNA, 54 nt, Human
acccugauaaagucacuuaagggagucguggaggcuaaaauacaaccgagaggg

SEQ ID NO: 249569 - RNA, 63 nt, Human
uuggaagugugucuuuugaaugcagaaaacaaagucguggacaaccaggcugggacccagggc

SEQ ID NO: 249570 - RNA, 63 nt, Human
gccuuuggaugaccuauuugaaaaccacugaaagucguggaggaaugggcaagaaccaccuca

SEQ ID NO: 249571 - RNA, 63 nt, Human
uuguagucugugccugaagucuguguuuguguugucguggagacaaggccuuugagccccacc

SEQ ID NO: 249572 - RNA, 63 nt, Human
gguccuucugcuggauacaggcaccaagaggcggucguggagcagggagcugcgccuuccugg

SEQ ID NO: 249573 - RNA, 53 nt, Human
ggaugaauaaaccaguaugacuagucguggagaugucuucguacaguucuucg

SEQ ID NO: 249574 - RNA, 63 nt, Human
gcgccuuccuccgugacgccuucagcuucuuuugucguggaugcuucgugggaaugcccagag

SEQ ID NO: 249575 - RNA, 63 nt, Human
ugugcagccuguggguagucggcuggugucccugucguggagcuggggugcgugaucuggugc

SEQ ID NO: 249576 - RNA, 63 nt, Human
ugcuaguggggaggccacacccacaagcgcugcgucguggaagucaccccauuuccccagcca

SEQ ID NO: 249577 - RNA, 63 nt, Human
ggauuuucagcagagcgucgguggggcugggccgucguggagguggccccaggagucauaugg

SEQ ID NO: 249578 - RNA, 63 nt, Human
gaauccuggaggaggaaauaaagggaaagggaagucguggagaggcagggaaaaugguuaagc

SEQ ID NO: 249579 - RNA, 63 nt, Human
ucagagcagccggagggaggggggaggucggaggucguggaggugguuuguguaucuuacugg

SEQ ID NO: 249580 - RNA, 63 nt, Human
ccccgucugagaaggaucuuguguucaguuagagucguggaaaaaucccugauccuucaaggu

SEQ ID NO: 249581 - RNA, 63 nt, Human
accagcagaaaugcccccauucucccagucucugucguggagccauugaacagcugugagcca

SEQ ID NO: 249582 - RNA, 63 nt, Human
gacuggcucccccaucugcuccaagggagcguggucguggaagaaacaacccaccugaaggcc

SEQ ID NO: 249583 - RNA, 63 nt, Human
cccguggaggcugcucggggugcacaggagggggucguggagagcuaggagcaaagccuguuc

SEQ ID NO: 249584 - RNA, 63 nt, Human
gcguggggcucccugccuucuggacuccugaaggucguggauggauggaaggcacacagcccg

SEQ ID NO: 249585 - RNA, 63 nt, Human
cauguuaaaggcuuuuuauauagguaaacucaugucguggagguuuguuguacagauuauuuc

SEQ ID NO: 249586 - RNA, 63 nt, Human
ugucuguuuccugucccugguaggggaagugaugucguggauggggaggggugggcaggguag

SEQ ID NO: 249587 - RNA, 63 nt, Human
guucugcgugucccuucccagcgcugcuggucagucguggagcgccaucaugucuuaccagug

SEQ ID NO: 249588 - RNA, 63 nt, Human
agucuguuuguuccaauggguugagcugucuuugucguggagaucuggaacuuugcacauguc

SEQ ID NO: 249589 - RNA, 63 nt, Human
gccgggcagacuuuaaucggggugguggcaauggucguggaggccgagggcgaggaggugagg

SEQ ID NO: 249590 - RNA, 63 nt, Human
auuuggagcaagugacaugccauccauucugccgucguggaauuaaaucacggauggcagauu

SEQ ID NO: 249591 - RNA, 63 nt, Human
agaaaggaaacagauuugcaaacuuuaaagucugucguggauuuauuuauccucagauuauug

SEQ ID NO: 249592 - RNA, 63 nt, Human
caucccugugaccccuccccagugccucuccuggucguggaaggugcuacuccagugcccacc

SEQ ID NO: 249593 - RNA, 63 nt, Human
cuacugaggcgcccucagucugcgcggauaaaugucguggagcccuuuuuguauggaaacguu

SEQ ID NO: 249594 - RNA, 63 nt, Human
ccacacuuugaagaauacagaccccaguaucuagucguggauauaauuaaaacgcugaagacc

SEQ ID NO: 249595 - RNA, 63 nt, Human
aaugggagcggugggggugggaagguaaggauggucguggaagaaggcaggauggaacucggc

SEQ ID NO: 249596 - RNA, 63 nt, Human
uauuaacaucaucuuagacuuugcaagcagagagucguggaaucaaaucugugcucuuucauu

SEQ ID NO: 249597 - RNA, 63 nt, Human
uuguguaauaaaauggcgaguuguuuuucaguugucguggacccccagguugcaaguuacaua

SEQ ID NO: 249598 - RNA, 63 nt, Human
gucuccuuuugcauuuuugccgagaccagcugggucguggagacccuaacccaguggcucuag

SEQ ID NO: 249599 - RNA, 63 nt, Human
ggaaaacagcggaccugcccagagcagggaggugucguggaacuggguagacccccugcagcg

SEQ ID NO: 249600 - RNA, 63 nt, Human
aguggucuggggagcccccaggcacaccuaagcgucguggagcauuguucugccacagcccug

SEQ ID NO: 249601 - RNA, 63 nt, Human
cuggcuguuugagauucucaaaggagcgagcaugucguggacacacacagacuauuuuuagau

SEQ ID NO: 249602 - RNA, 61 nt, Human
ccgacggaucacagugaaagggauuccucccacgccagaucugcacaacgaggcaagacag

SEQ ID NO: 249603 - RNA, 61 nt, Human
cccuuaaaagcauuacuuuaacugguagggaacgccagaaacuuuucaguccagcuauuca

SEQ ID NO: 249604 - RNA, 61 nt, Human
uguggacucaguaugauaacugagaugggggacgccagacaugugaggacgcuguccuccg

SEQ ID NO: 249605 - RNA, 61 nt, Human
acauggcagaggggcaccccggcccggaaagacgccagagccagcaggggcuguuucgggc

SEQ ID NO: 249606 - RNA, 61 nt, Human
gugcauaugaaaugggagaggagaugccaaaacgccagaugaaagcaaucaaguuucuucu

SEQ ID NO: 249607 - RNA, 61 nt, Human
caaaccacugacccacagacucugcaccccgacgccagagauaccuggagcgacggcugcu

SEQ ID NO: 249608 - RNA, 61 nt, Human
uacaugaggaucuuccacaauuucagaaugcacgccagagcugaagggggaaacuugguaa

SEQ ID NO: 249609 - RNA, 53 nt, Human
aaccaagucaagacuggugauucacgccagacgucugcccgcuggugggggac

SEQ ID NO: 249610 - RNA, 61 nt, Human
ugaauguuccaaaaugguagagugguagaaaacgccagaguaguuuagagcagaggaaaau

SEQ ID NO: 249611 - RNA, 61 nt, Human
ccacccccagcucaggggaccuuuugucugaacgccagagcuacugaccaggucggggggc

SEQ ID NO: 249612 - RNA, 64 nt, Human
ccacugugaguacugacauuuagagcuguuuaaaggccgagaacuggaaacagccuuuccucca

SEQ ID NO: 249613 - RNA, 64 nt, Human
uugcugcaaauucugcagcugucugcugcucuaaagaguacagugcacuagagggaaguguucc

SEQ ID NO: 249614 - RNA, 64 nt, Human
acacuggaaaugaguucuggguaagugaguuauaagaguacaugcucuaguaacucugguaguc

SEQ ID NO: 249615 - RNA, 61 nt, Human
uucuacucccacugcuccuaccacuccagcaacgccagauaaugcaucacaggaagaacuc

SEQ ID NO: 249616 - RNA, 61 nt, Human
uauucaugaagguggguucaccaugccccagacgccagaaggucagccguugaucaaugga

SEQ ID NO: 249617 - RNA, 61 nt, Human
agccagcuccccuucuccucuaacuauuggaacgccagaaagucagagaaagccuuccauu

SEQ ID NO: 249618 - RNA, 61 nt, Human
aagugugaaagaacacugugaggucccagcaacgccagacuauauuaagguaaguagaaag

SEQ ID NO: 249619 - RNA, 61 nt, Human
acucaagaugccuccugucagaugacacaugacgccagauaaaauguucagugcaaucaga

SEQ ID NO: 249620 - RNA, 61 nt, Human
augaccguggccucccucucagagggggagaacgccagagcccuggcuggugaugugcugg

SEQ ID NO: 249621 - RNA, 61 nt, Human
ucccaaugagggucccucucagagcgggagaacgccagagcccuggauggugaugcgcugg

SEQ ID NO: 249622 - RNA, 61 nt, Human
ucccaaugagggucccucucagaaagggagaacgccagagcccuggcuggugacaugcugg

SEQ ID NO: 249623 - RNA, 61 nt, Human
uuguucccuaaugagaagucaacagugaaauacgccagaacugcuuuaucccacggaaaau

SEQ ID NO: 249624 - RNA, 61 nt, Human
uggaagacuagucuauugguuaccgguguauacgccagaauacacugaagagauggugccu

SEQ ID NO: 249625 - RNA, 61 nt, Human
agaaaaaaaggucaagcaguuuucacuugucacgccagaagcacacuugaggcugcagucg

SEQ ID NO: 249626 - RNA, 61 nt, Human
gguuaguagucauggaaaugacacauaaaguacgccagaaguuugauggaacguguuagaa

SEQ ID NO: 249627 - RNA, 61 nt, Human
gaugggguaggagacagcugggaggcuccgcacgccagaggccuugccuuucagaagaacc

SEQ ID NO: 249628 - RNA, 61 nt, Human
uguggaugauucagaguuaaaagauaaaaagacgccagaguucucgcugaagaaugugaga

SEQ ID NO: 249629 - RNA, 61 nt, Human
cuccauggcaauuuuuuucuauuuauaaucuacgccagaaggccgggugcccaggagcuga

SEQ ID NO: 249630 - RNA, 61 nt, Human
gcagcaagcgcacccucuccccacucuccccacgccagagcggcuuccagagcagaugcug

SEQ ID NO: 249631 - RNA, 64 nt, Human
ggaggguggggugagauucuguguugauguaggaggccgagaaggcccuuaacucaaaguagcu

SEQ ID NO: 249632 - RNA, 64 nt, Human
ccccauccccccgggauugggcaaggucagacuuagaguacagcuguuuuccuccccucugugu

SEQ ID NO: 249633 - RNA, 64 nt, Human
uugugaaaauauuauuaacacuggggacuccuuaagaguacaucagaguucucucuaggaaucc

SEQ ID NO: 249634 - RNA, 58 nt, Human
aagcaaaaggccuguucugaguggggagacgccagaggagccucacggucacguccaa

SEQ ID NO: 249635 - RNA, 61 nt, Human
ugaacagagccugaggcggaugcagcccgcgacgccagaggaagcacgugcacuaacuggg

SEQ ID NO: 249636 - RNA, 61 nt, Human
acuucacuuuauccucugguuuuagggccagacgccagaagccaugugucaauuuuacccu

SEQ ID NO: 249637 - RNA, 61 nt, Human
uugcugcuguccccagaccuccugugacaccacgccagaucacagggcaccaggccagaga

SEQ ID NO: 249638 - RNA, 61 nt, Human
cuccucgccacuccugcucuuucuccacugcacgccagaggcccauuuacuccuggggcag

SEQ ID NO: 249639 - RNA, 61 nt, Human
ggcagaaagcaguguauuaagguguugaauuacgccagaagaccugaaaugccuuguaccu

SEQ ID NO: 249640 - RNA, 61 nt, Human
ucacugugaagagaagaacccgaaccuuaagacgccagaucccugagagucuuucuggcug

SEQ ID NO: 249641 - RNA, 61 nt, Human
ccauacccaggcuggcuccuggggcgacgccacgccagagggaggguuuaguacaugggag

SEQ ID NO: 249642 - RNA, 61 nt, Human
cugucuugcuccuauggagucacauaagccaacgccagagccccuccaccucaggccccag

SEQ ID NO: 249643 - RNA, 61 nt, Human
accguaacacuccguaaacagcccagcuguaacgccagaccgagacgaacacucugccuaa

SEQ ID NO: 249644 - RNA, 61 nt, Human
cgaacguggaugaaaaccacagggauuccggacgccagaccccauuuuauacuucacuuuu

SEQ ID NO: 249645 - RNA, 61 nt, Human
gggcaccguguaugcccuggcggucaucucgacgccagaccagaccaaagucuucagugca

SEQ ID NO: 249646 - RNA, 61 nt, Human
gccacaagacccuuguggucccaccccacacacgccagauucuuuccugaggcugggcucc

SEQ ID NO: 249647 - RNA, 61 nt, Human
uuuccuccaaucucuguagccccagaagugaacgccagacaggaacacgcauguguguaua

SEQ ID NO: 249648 - RNA, 61 nt, Human
ucagccuccauccuacccccugugccuugucacgccagacuucccacggcuccucgagauc

SEQ ID NO: 249649 - RNA, 61 nt, Human
ucuacucucauccuaggaauaaagcauuuccacgccagaguaguuugggcugggggccagg

SEQ ID NO: 249650 - RNA, 64 nt, Human
gugugauuuuaaaaauguggauuaaacucucgauagaguacauaaaguaaaggagaacagcuau

SEQ ID NO: 249651 - RNA, 64 nt, Human
cccaucuuccugaugcacauuugcugugcgagccagaguacagucauaacacgguauucgcauu

SEQ ID NO: 249652 - RNA, 64 nt, Human
ccaggucagcgaggccccagauaccagagcaucaagaguacaggaaauacaguuaaugcagggc

SEQ ID NO: 249653 - RNA, 61 nt, Human
ccccucucauucccuccccagaauggaggcaacgccagaauccagcaccggccccauuuac

SEQ ID NO: 249654 - RNA, 61 nt, Human
gcagggcucucacuggcggugcccaggacggacgccagauggcugcgcgcuuugucagcag

SEQ ID NO: 249655 - RNA, 61 nt, Human
cuggccgguccccccacugcugcugcuaucaacgccagaauaaacacacucugugggucuc

SEQ ID NO: 249656 - RNA, 61 nt, Human
uuggccacccuaugacuaacuggaagaggacacgccagagcuucagugagguuuccgagcc

SEQ ID NO: 249657 - RNA, 52 nt, Human
gccagccgcucaggugguagccacgccagagcggggucgccucugggccucu

SEQ ID NO: 249658 - RNA, 61 nt, Human
cagaggaugcuguucuucagugcugaaauccacgccagaaugucgguguucaugaagucac

SEQ ID NO: 249659 - RNA, 61 nt, Human
uggugaccucucagaugccagcgaccugaagacgccagagaagcagagugccaauggcucu

SEQ ID NO: 249660 - RNA, 64 nt, Human
aggcacagguguaaaaaggggagauuucagaagacgggcgaaacaacugaugggggaagauacc

SEQ ID NO: 249661 - RNA, 64 nt, Human
cuggcgccgccaccgagacugagccuccugcagacgggcgaagccgccugcugcagcccaggaa

SEQ ID NO: 249662 - RNA, 64 nt, Human
augucacugcucguguggucuccagcaagggauucgggcgaagacaaacggaugcacccgucuu

SEQ ID NO: 249663 - RNA, 64 nt, Human
acaccuguaaucccagcacuuugggaggcugaggcgggcgaaucauuugaggugaggaauucga

SEQ ID NO: 249664 - RNA, 64 nt, Human
acgccuguaaucccagcacuuugggaggccgaggcgggcgaaucacgaggucaggaguucaaga

SEQ ID NO: 249665 - RNA, 64 nt, Human
gggagagaaaaccuuccagcagcccaguaaacugcgggcgaagagaucuacccgucucccuccc

SEQ ID NO: 249666 - RNA, 64 nt, Human
acauguugaauuuuaucaggugguuacauaagcaagaguacaucaaacuguauuauuugaaagu

SEQ ID NO: 249667 - RNA, 64 nt, Human
cacuuuccugaagagaaguucucuuuaugaauuaagaguacaaaauccucugagaugaagcaac

SEQ ID NO: 249668 - RNA, 64 nt, Human
gcgggggacagggucuuacucugucacucaggccagaguacaauaguaugaucucggcucacug

SEQ ID NO: 249669 - RNA, 64 nt, Human
ccuuccucaccuggcucugccucccccgugcucucgggcgaaguggguucuugugccuuccccu

SEQ ID NO: 249670 - RNA, 64 nt, Human
ggaggaagacugcucugagcgugcggccuuguuacgggcgaaaggccacuggccauuccugggg

SEQ ID NO: 249671 - RNA, 64 nt, Human
caguucuaccacuccugcaagcaguauggcaucacgggcgaaaauguccgaggagaacugcugg

SEQ ID NO: 249672 - RNA, 64 nt, Human
ggggagacagagaccaagagcaggggauagaagccgggcgaaguggcccaugccuguaaucuca

SEQ ID NO: 249673 - RNA, 61 nt, Human
cagacuaauuggaauuguugaagcugcucccugguuccacucuggagaguaaucugggaca

SEQ ID NO: 249674 - RNA, 61 nt, Human
cugccuggcacuggcugaugggcaccucuguugguuccaucagccagagcucugccaaagg

SEQ ID NO: 249675 - RNA, 61 nt, Human
gccacugagauggcaccugucaaaagagcagugguuccauuucuagauuguggaucuucag

SEQ ID NO: 249676 - RNA, 61 nt, Human
gggggccaucaaaagcaucgggauuuggcauugguuccagaugagcuuuuaaagcaaacau

SEQ ID NO: 249677 - RNA, 61 nt, Human
ccacccucugcuucccuccuccucgugauccugguuccauagccaacacuggggcuuuugu

SEQ ID NO: 249678 - RNA, 61 nt, Human
aaaauuagccaaguauggugacaggcaccuaugguuccagcuacucaggaggcugaggugg

SEQ ID NO: 249679 - RNA, 61 nt, Human
cccguauccaacaggcacaucuccuccuuugugguuccacuuccccugugcagaucguggg

SEQ ID NO: 249680 - RNA, 61 nt, Human
ugucucccuguggaugaaacugcugcugaaaugguuccaauuuuuaggaaucugcuuaccc

SEQ ID NO: 249681 - RNA, 61 nt, Human
gcugggagccagaacuuugccugcccucccuugguuccagucucucuucucucucucugcc

SEQ ID NO: 249682 - RNA, 61 nt, Human
uuucccuuccccaaaccaugugcuuauuagaugguuccacucaggaagcaaggaagcuaaa

SEQ ID NO: 249683 - RNA, 64 nt, Human
auuuuuaguggccucuacugauaauaccuacccuagaguacauaaaaauuauauuaaaagagga

SEQ ID NO: 249684 - RNA, 64 nt, Human
cuccuacuuuuucuuuaucaauuaaauagcucagagaguacaucugccauaucucuaauagaau

SEQ ID NO: 249685 - RNA, 64 nt, Human
cauggcaaagcccuuucucucccaagccccaggcagaguacaagcucauuuuucucggugguua

SEQ ID NO: 249686 - RNA, 61 nt, Human
gccucaggagcgagacuucaaggacucaguuugguuccacccaguugaaagacacccagug

SEQ ID NO: 249687 - RNA, 61 nt, Human
auuaaaaucaaaccuguaucagcaaguuaaaugguuccauuucugugauuuuucuauuauu

SEQ ID NO: 249688 - RNA, 61 nt, Human
agcagaccccagacucuccccuugccagacgugguuccagacggggagacgcaccucgucc

SEQ ID NO: 249689 - RNA, 61 nt, Human
gaaguccugggcaggagguggcuuuggugguugguuccaaaguugaaaaugcuugcaguuu

SEQ ID NO: 249690 - RNA, 61 nt, Human
uggaggaagccaggcgaguggggcccaggacugguuccagugagagaaaccaaccacaggc

SEQ ID NO: 249691 - RNA, 61 nt, Human
ugugugaauguucugaucacuaccacccagcugguuccagcccuggccaagguucuccuau

SEQ ID NO: 249692 - RNA, 61 nt, Human
aucugugggggcuuccucuccuuccacccucugguuccaauuuccuguucuaagcaggacu

SEQ ID NO: 249693 - RNA, 61 nt, Human
cucuccuggagcuguucuggucucagaggcuugguuccauuucucaccugaacagaugagu

SEQ ID NO: 249694 - RNA, 61 nt, Human
ccgccccauccacaggcacagcccggcagagugguuccaccuccccaugggcccaaggaug

SEQ ID NO: 249695 - RNA, 61 nt, Human
cuccuccuucuuccagugaagcacgaggucuugguuccaggguuccuggccaggugccccc

SEQ ID NO: 249696 - RNA, 61 nt, Human
ccugugcccacaucccaggcuucacccugaaugguuccaugccugaggguggagacuaagc

SEQ ID NO: 249697 - RNA, 61 nt, Human
uguuuaggauugccuuggcuaggcucuuuuuugguuccauaugaauuuuaaaguaguuucu

SEQ ID NO: 249698 - RNA, 61 nt, Human
caaguuuucucaaccuagggaaaaagaacuaugguuccauauucaaaauaaauauuauaga

SEQ ID NO: 249699 - RNA, 61 nt, Human
gaccagcccuaggagucugcgagagccuccuugguuccaucgugaagccauaaacaggaau

SEQ ID NO: 249700 - RNA, 61 nt, Human
cuguuuuguaagcuuuaagcgcaacauuucuugguuccaauaaagcauuuuacaagaucuu

SEQ ID NO: 249701 - RNA, 61 nt, Human
cugauauucaaaugcuguaguguugaauacuugguuccaugagccaugccuuucuguauag

SEQ ID NO: 249702 - RNA, 64 nt, Human
guccagcaugucuggcuugcaccuaguaaagcagggccgagacagaaagaaaauagauucucaa

SEQ ID NO: 249703 - RNA, 64 nt, Human
ucagggggaggacgugguggcugaacucuaguggggccgagacuauucagagccaguaggaggc

SEQ ID NO: 249704 - RNA, 64 nt, Human
cgucuuccugucccaucugcucagagagagguggggccgagacuugcuggagagcuucccuccu

SEQ ID NO: 249705 - RNA, 61 nt, Human
ggagccccauugccccggcagcucuggccugugguuccagaagcugagaaaacuccacugg

SEQ ID NO: 249706 - RNA, 61 nt, Human
gauguggugacaugcaggguucaaguguucuugguuccaggcaccucccggcucacgggga

SEQ ID NO: 249707 - RNA, 61 nt, Human
ccucuguccugcuaggucucccaccuucccuugguuccaaaagccagggugucuaugucca

SEQ ID NO: 249708 - RNA, 61 nt, Human
gauaacuggcuaaucauauuaaaggacuaugugguuccagcucaacuuuuaauauauuguc

SEQ ID NO: 249709 - RNA, 61 nt, Human
uacacugccguguuuggaccauuggcaagccugguuccacuccucaggggcuccuggcagu

SEQ ID NO: 249710 - RNA, 61 nt, Human
uguaaaguguccgucugugucugugagggauugguuccaggaccccuguggcuaccaaaau

SEQ ID NO: 249711 - RNA, 61 nt, Human
guuggaggugauuugucuggguucuuccuuuugguuccagaaggaacugucagucaucagc

SEQ ID NO: 249712 - RNA, 61 nt, Human
ccacucugaccucuugucaguuuccuguuccugguuccaucuuuuugaaaaaggcccuccu

SEQ ID NO: 249713 - RNA, 61 nt, Human
uuucucuagcaaguguaagcagaauggagugugguuccaagagauccaucaagacaauggg

SEQ ID NO: 249714 - RNA, 61 nt, Human
aauccagucuaucauuguuggacauuuggguugguuccaagucuuugcuauugugaauaau

SEQ ID NO: 249715 - RNA, 61 nt, Human
uaggauugaauuggugaugcgggcucuuuuuugguuccauaugaacuuuaaaguaguuuuu

SEQ ID NO: 249716 - RNA, 61 nt, Human
aaaagcaaagagccauuuuguccuguuuucuugguuccaucaaucuguuuauuaaacauca

SEQ ID NO: 249717 - RNA, 61 nt, Human
uaugccaaggucaacaagccauaccauccacugguuccagcugacagguaauaaacuuagu

SEQ ID NO: 249718 - RNA, 61 nt, Human
ccucuucagguucuuaagggauucuccguuuugguuccauuuuguacacguuuggaaaaua

SEQ ID NO: 249719 - RNA, 61 nt, Human
ccagccuggcugccagggagggugggccucuugguuccaggcucuugaaauagugcagccu

SEQ ID NO: 249720 - RNA, 61 nt, Human
agcaacauguguaucugccgauuguucuccaugguuccaacaaauugcaaauaaaacugua

SEQ ID NO: 249721 - RNA, 64 nt, Human
cagugcucacgccugucaucccagcacuuugggaggccgagacgggaggaucaguugaggucag

SEQ ID NO: 249722 - RNA, 64 nt, Human
ggugguucaugccuguaaucccagcacuaugggaggccgagacgggcggaucacgaggucagga

SEQ ID NO: 249723 - RNA, 64 nt, Human
ggaggcucauguaaguaaucccagcacuuugggaggccgagacgggcccaugacaaggucagga

SEQ ID NO: 249724 - RNA, 61 nt, Human
gugccuucgucuuucccauggggagggauucugguuccagggucccucuguguauuugcuu

SEQ ID NO: 249725 - RNA, 61 nt, Human
agaagccugggucacagcacccagaacugcaugguuccauuuucuccggggcuguggggcc

SEQ ID NO: 249726 - RNA, 61 nt, Human
uccucacaauaauucuguagccaagcagaauugguuccauuugacagaugaagaaauugag

SEQ ID NO: 249727 - RNA, 61 nt, Human
auggauucaucaauaucaugagcacuuuugcugguuccagucaaaucaauggcauuuaaua

SEQ ID NO: 249728 - RNA, 61 nt, Human
accuuuuuuuuuuuuuuacuuagucuguguuugguuccaccaguuuuaugcugccuuucua

SEQ ID NO: 249729 - RNA, 61 nt, Human
guucagaagacuaaccagcuuagucagaagaugguuccauggaagaaaaaggccaaggagu

SEQ ID NO: 249730 - RNA, 61 nt, Human
caguuaggauguaaauauacauaagaacuuuugguuccaaauguuaaaacugccagcaucu

SEQ ID NO: 249731 - RNA, 61 nt, Human; identical to SEQ ID NO: 249528

SEQ ID NO: 249732 - RNA, 61 nt, Human
aauauagucauccuuuaguauccaaggggauugguuccaggacuccugaagaucccaaaau

SEQ ID NO: 249733 - RNA, 61 nt, Human
cgcugauauauguguuuuucacauuugcgaaugguuccauucucucuccuguacuuuuucc

SEQ ID NO: 249734 - RNA, 61 nt, Human
uucuggcaggggcccagggauccaggggaccugguuccaaucucagcccugcugucaccac

SEQ ID NO: 249735 - RNA, 61 nt, Human
ccaaggguugggaaaauccaaauucucuuccugguuccagcacugauuuuguacauaaaca

SEQ ID NO: 249736 - RNA, 61 nt, Human
gaugcaugugacuccauucaguuggggauuuugguuccauguggauccauacuaaguauuc

SEQ ID NO: 249737 - RNA, 61 nt, Human
aaauaagguguaaauggugcuuuguuccugcugguuccaagcucagaaaccaagacuagcu

SEQ ID NO: 249738 - RNA, 61 nt, Human
cauuuguucuggaauccuacguguuggucugugguuccaugcauuagcuguuuguaaauaa

SEQ ID NO: 249739 - RNA, 61 nt, Human
gccaggaaaaaugaccaaccacagaaccaagugguuccaguggaaacucagcagcugcugg

SEQ ID NO: 249740 - RNA, 64 nt, Human
ccauccuggacugauggccacccgcccacagccaggccgagagcagacaccagcagcccuguca

SEQ ID NO: 249741 - RNA, 64 nt, Human
caaaguauaaaacaaaaucuagccccuucuucagggccgagagaauuuugagcacuagccgucu

SEQ ID NO: 249742 - RNA, 64 nt, Human
guacaaaccaaguugcccucuccgagcuaggcccggccgagagcgccuuagcucgagucggauc

SEQ ID NO: 249743 - RNA, 61 nt, Human
cugcacagagcucuccagcuccaagaccuguugguuccaagcccuggagccaacugcugcu

SEQ ID NO: 249744 - RNA, 64 nt, Human
ccagcuggagggccacaugcacacacagccuagcugcccccagggagcucugcugcccuugcug

SEQ ID NO: 249745 - RNA, 64 nt, Human
auagagucacuggcaugaugcccucgcucccccaugcccccacaucccaguggggcauaacuag

SEQ ID NO: 249746 - RNA, 64 nt, Human
gacccacccgucugugaauguguccacucucuucugcccccagccauauuuggggaggauggac

SEQ ID NO: 249747 - RNA, 64 nt, Human
ggagaggggaggugucacacaacuuggagguaaaugcccccaggccgcauguggcuucauuaua

SEQ ID NO: 249748 - RNA, 64 nt, Human
cuuggauacagggagcagccaggagacucccuagugcccccaccauggcgggugucacucacgc

SEQ ID NO: 249749 - RNA, 64 nt, Human
ggaugucuguuugccucuuagagacaggugucucugcccccacaccgcuacuggggucuaaugg

SEQ ID NO: 249750 - RNA, 64 nt, Human
guucuuccuggugcaggggcugaaauaacccagaugcccccacccugccacauacuagaugcag

SEQ ID NO: 249751 - RNA, 64 nt, Human
uauuuuucuucuuaaaugugcaucaaucaugccuugcccccaaccuuuaaauauauucuuagac

SEQ ID NO: 249752 - RNA, 64 nt, Human
ccuugcagggcagacagugccuggcacugaggggugcccccagaccccgcugggacuggaugug

SEQ ID NO: 249753 - RNA, 64 nt, Human
gcccagcucugccucgcagcccccucagcaugggugcccccagaaguaagcagcucuuggaccc

SEQ ID NO: 249754 - RNA, 64 nt, Human
gaugugguucagguggggucuccagaaggcugcuugcccccagagagccaucucuuccauuuuu

SEQ ID NO: 249755 - RNA, 64 nt, Human
gaugaaaugagccaccgugaacagacaucugccaugcccccaggugggcuucgguggcccuacc

SEQ ID NO: 249756 - RNA, 64 nt, Human
aaaguuguuucucaguuguuuuugcuuuuaacuuugcccccaacguuuaaagggagugaucugc

SEQ ID NO: 249757 - RNA, 64 nt, Human
accugagccuguccguccaccaggaguggggagaugcccccauccaguccuggaggacccgcug

SEQ ID NO: 249758 - RNA, 64 nt, Human
aggagcucuguggaccaagacaaagcuggacuagagaguacaguucaaacuuggcaguuucucu

SEQ ID NO: 249759 - RNA, 64 nt, Human
gaaaaaaaaaaugaaucauguuaggcuuuaggugagaguacauuuuuuacaaaguagcuauagu

SEQ ID NO: 249760 - RNA, 64 nt, Human
ucccccgggucaccuuuugccuggucauccuguuagaguacaucuuuggaaauccaggguaaua

SEQ ID NO: 249761 - RNA, 61 nt, Human
ugguuugaaggaacucagcaguaugaugaucugguuccaggggaaaaaaauagcugguugg

SEQ ID NO: 249762 - RNA, 61 nt, Human
ugagaucagauguggccaagggaaggagcucugguuccagagaauuugcacaaaguucccu

SEQ ID NO: 249763 - RNA, 61 nt, Human
gggaccaaauuucugcagaggccuugccggaugguuccauaacuguagagucuaauugcua

SEQ ID NO: 249764 - RNA, 61 nt, Human
caaucucggcucacugcaaccuccgccuccuugguuccagcaauucuucugccucagccuc

SEQ ID NO: 249765 - RNA, 61 nt, Human
ggagaaagggagucaggcgcauugggaaucgugguuccagucugguugcagaaucugcaca

SEQ ID NO: 249766 - RNA, 61 nt, Human
cccagggugaaacaugcuucuucucuuccugugguuccauccgaaggauuguggugagccc

SEQ ID NO: 249767 - RNA, 61 nt, Human
ccaagaugaugaguucagccuuuaucccucgugguuccacuagauguaacuuaaaggaguu

SEQ ID NO: 249768 - RNA, 61 nt, Human
gcuuuacuauguacacugaggucuguucuaaugguuccauuuagacuacuuuccucuucua

SEQ ID NO: 249769 - RNA, 61 nt, Human
ugcaggaacguugaauauuggcaaugauuccugguuccagaaagggcuggagcagaagggc

SEQ ID NO: 249770 - RNA, 61 nt, Human
gugaucuugcugaagacuacaggcagccaaaugguuccagauacuucagcuuuguguaucu

SEQ ID NO: 249771 - RNA, 61 nt, Human
uauuucucauagcaggaaauguagagguagaugguuccaguaucagcauagugacuaaacu

SEQ ID NO: 249772 - RNA, 61 nt, Human
ggaauugucaggucucagcuucgaaaaguccugguuccacugacaggacacauucuuuagu

SEQ ID NO: 249773 - RNA, 61 nt, Human
augcaugauucuaagaacuggaagaaccuggugguuccauuugcaaaggcugugugugaaa

SEQ ID NO: 249774 - RNA, 61 nt, Human
ucuuucaaaaguagagcaaaacuauagguuuugguuccacaaucucuacgacuaaucaccu

SEQ ID NO: 249775 - RNA, 61 nt, Human
gauuccaacccagcccuggacugaggauggaugguuccaugagcccccagaugaaaaccug

SEQ ID NO: 249776 - RNA, 61 nt, Human
aagucaauaauuaagcaaauugcuuaacacuugguuccaguuccugccuaucuggaguuua

SEQ ID NO: 249777 - RNA, 64 nt, Human
aaucgcuugaaccagggagucagagguugcauugggccgagaucacaccacuacacuccagccu

SEQ ID NO: 249778 - RNA, 64 nt, Human
ggccccgcuggucacucaacagaguauuucccuuggccgagauggaaguuuugucccaauagau

SEQ ID NO: 249779 - RNA, 64 nt, Human; identical to SEQ ID NO: 249778

SEQ ID NO: 249780 - RNA, 61 nt, Human
guuuugaguauuugaauuuagagaaacaacaugguuccaagaaggaggguguaaaaccugu

SEQ ID NO: 249781 - RNA, 61 nt, Human
uaccaaagugggcucagaaacugucaucuccugguuccaaguucgggcucuggcagcccag

SEQ ID NO: 249782 - RNA, 61 nt, Human
uucauggaucuucaugcagccauacaaacccugguuccaacagaauggugaauuuucgaca

SEQ ID NO: 249783 - RNA, 61 nt, Human
auuguuauuuuuaacaugaaucuaaaguuuaugguuccagggacuuuuuauuugacccaac

SEQ ID NO: 249784 - RNA, 61 nt, Human
aaacacauagcaguguuccauagacuuggcuugguuccagugucagaagcaagcauaauca

SEQ ID NO: 249785 - RNA, 61 nt, Human
uagcuauuaucugccaguuguuaagagguuuugguuccaaacucaaccagcaauguugaga

SEQ ID NO: 249786 - RNA, 61 nt, Human
gcacaguacauugauuaacacaaacucacauugguuccaggucucaacguucaggcuuacu

SEQ ID NO: 249787 - RNA, 61 nt, Human
ucuugagcagagggagcacauuuuguggaccugguuccaccuuuccauuccaaaccaccug

SEQ ID NO: 249788 - RNA, 61 nt, Human
uuugaguguauauaaugcagcauuagcaauaugguuccaauagaggaguuaaauauauauu

SEQ ID NO: 249789 - RNA, 61 nt, Human
guccuuccccaguuccuaucucccacccgccugguuccagccccauccccucucccacuga

SEQ ID NO: 249790 - RNA, 61 nt, Human
cuccuugacucugccguuuccuaauaagaccugguuccacaucucacucccagugucuccu

SEQ ID NO: 249791 - RNA, 61 nt, Human
cccuccugcuccucccugccccccaagguucugguuccauuuuuccucuguucacaaacua

SEQ ID NO: 249792 - RNA, 61 nt, Human
ggauuuggcauauagucaucuauagggggauugguuccaggauccccugcagaugccaaaa

SEQ ID NO: 249793 - RNA, 60 nt, Human
aagggaugauaaaaacuugagcaccauugcugguuccauuuagcuuacauguaaauguaa

SEQ ID NO: 249794 - RNA, 61 nt, Human
uuacagucaucccucagugucugugggggauugguuccaguuaccccuauagauaccaaaa

SEQ ID NO: 249795 - RNA, 61 nt, Human
cugcuguacaguggguauaguauuuugguuuugguuccagauugugcaaucuuuaagaaaa

SEQ ID NO: 249796 - RNA, 64 nt, Human
aguggcucacgccuguaaucccagcacuuuggcaggccgagaugggcggaucuuuugaggucag

SEQ ID NO: 249797 - RNA, 64 nt, Human
gguaggagugcaacccaggagcaacgcucaagguggccgagaugcagggaggauuguggcgauc

SEQ ID NO: 249798 - RNA, 64 nt, Human
ggugucugggccaccuucagaagguggaugugguggccgagaccccguccacggagggugaugg

SEQ ID NO: 249799 - RNA, 61 nt, Human
ugaaaagaucucaugacugagauguggacuuugguuccauguuuucauuguaagaaagcag

SEQ ID NO: 249800 - RNA, 61 nt, Human
uuacugcauucucaauuagaaaacugcaauuugguuccaccacauucugacuacuacagua

SEQ ID NO: 249801 - RNA, 61 nt, Human
augaaaugauacugguuucuccacaggaauaugguuccauuaggcugggagcaaaaacaau

SEQ ID NO: 249802 - RNA, 61 nt, Human
gaaaggccuauguuacugacggaagaaguauugguuccagacuuccuauaagacugucugc

SEQ ID NO: 249803 - RNA, 61 nt, Human
ugcuaaacuguugggaaagcucuguagagcaugguuccagugaggccaagauugaaauuug

SEQ ID NO: 249804 - RNA, 61 nt, Human
cagagcacuuuggucuagacuaggcuuugggugguuccaauugguggagagaagcucugag

SEQ ID NO: 249805 - RNA, 61 nt, Human
auauucuccuagggcucaaacuacucucuauugguuccaggauaaugacaaauugaaccau

SEQ ID NO: 249806 - RNA, 61 nt, Human
aacaucuguuaacuauuucagugacuuuaucugguuccaagaggcuguggccaauggcaag

SEQ ID NO: 249807 - RNA, 61 nt, Human
uguuaaugaagauuuaauuuuuaaauacaggugguuccaagcuuucaaauagguuaugcuc

SEQ ID NO: 249808 - RNA, 61 nt, Human
uuguaguuuaaaaacugucagcaguuucauaugguuccaccuaauauuauugaagacaauu

SEQ ID NO: 249809 - RNA, 61 nt, Human
ggaccgcuggcaccccccuucccucccuucuugguuccauuuccauccaugacagguacag

SEQ ID NO: 249810 - RNA, 61 nt, Human
gagugauaauuugguagcucuguauguaugcugguuccaacuguuuaaucccuucugucuu

SEQ ID NO: 249811 - RNA, 61 nt, Human
agcuuuauuucaaaucucuuccuucccuggcugguuccaucuaguaccagaggccucuuuu

SEQ ID NO: 249812 - RNA, 61 nt, Human
gggauuauaggcuugagccaccacgcccggcugguuccaugcaucuuaccuggaugacuug

SEQ ID NO: 249813 - RNA, 61 nt, Human
gcuauagaggauacaugaaaaguaugagaucugguuccauccaguaagacauuuuaauaga

SEQ ID NO: 249814 - RNA, 61 nt, Human
ucuuugccagucucauuuucaucuucuuccaugguuccacagaagcuuuguuucuugggca

SEQ ID NO: 249815 - RNA, 64 nt, Human
cuaguguuccucagaacaaagauuggaaaaagcuggccgagaaccauuuauacauagaggaagg

SEQ ID NO: 249816 - RNA, 64 nt, Human
aguugcucauccauguaaucccagcacugugggaggccgagacggguggaucacaaggucagga

SEQ ID NO: 249817 - RNA, 64 nt, Human
ugccagcugcccuugcagggugggugagcucucaggccgagagccuuauuuaccuagugcaaaa

SEQ ID NO: 249818 - RNA, 61 nt, Human
acgaaauauugccaagagauuguuauguguuugguuccagccuaaaaaugauuuuguagug

SEQ ID NO: 249819 - RNA, 61 nt, Human
aaagcaggauacauuuuacuaaaagguucauugguuccaaucacagcucauagguagagca

SEQ ID NO: 249820 - RNA, 61 nt, Human
uugcaauuuugcuuucuagugcccuauagaaugguuccauuauggcugcguuggauugaca

SEQ ID NO: 249821 - RNA, 61 nt, Human
uuggcguucugaccccacagggacugguggcugguuccagggcucgucccggcauuucaug

SEQ ID NO: 249822 - RNA, 61 nt, Human
cagaacagcgccgcccgggcagacggcugcuugguuccagagccgcuguacugagcaccuc

SEQ ID NO: 249823 - RNA, 61 nt, Human
ccugcagcucaacgagacccaagugaagaucugguuccagaaccgccgaaugaagcaaaag

SEQ ID NO: 249824 - RNA, 61 nt, Human
gcucaaccucaccgagaggcaggucaagaucugguuccagaaccgcaggaugaaaaugaag

SEQ ID NO: 249825 - RNA, 61 nt, Human
ccuggcuuuucuuucuaccaaaugagggucuugguuccagccugccacucaggcccaaagc

SEQ ID NO: 249826 - RNA, 61 nt, Human
auccugccacucccgucgcagagcccuuuaaugguuccaaacccuaaguccacacauagcc

SEQ ID NO: 249827 - RNA, 61 nt, Human
agggaaaaaaaugaaaaagaauaagucacauugguuccauggccacaaaccauucagauca

SEQ ID NO: 249828 - RNA, 61 nt, Human
aagaggaauggcccucauucaguaaguucugugguuccaguaaggauuuuuauguacauac

SEQ ID NO: 249829 - RNA, 61 nt, Human
uuauucauaaagagaaaaugaugaguuuuuaugguuccaaugaaauauguugggguuuuuu

SEQ ID NO: 249830 - RNA, 61 nt, Human
aaguucuggggagcauuccaaagcaguauauugguuccaauuagaguuuacuuuuuuugua

SEQ ID NO: 249831 - RNA, 61 nt, Human
gaggacacagaagaguuguauagcaccagauugguuccaaauaguuaauggaugugugcac

SEQ ID NO: 249832 - RNA, 61 nt, Human
uuuuuuuuuucuucucaaaaauucuguucauugguuccacucagcaucaagaagacaggga

SEQ ID NO: 249833 - RNA, 61 nt, Human
aagcagugcagggugucuccaucgagcuguuugguuccauguguguuuaacaugugcagaa

SEQ ID NO: 249834 - RNA, 64 nt, Human
uucuguccauguugggcauaagggaugaaaacuuggccgagacuaauguguggcccacagcuuu

SEQ ID NO: 249835 - RNA, 64 nt, Human
ggcggcucacgccuguaaucccagcacuuugggaggccgagacaggcggaucaccugaggucgg

SEQ ID NO: 249836 - RNA, 64 nt, Human
ggggucacgguggagacggacacgggcguggggcggccgagaccugcacggcccagcgggcacc

SEQ ID NO: 249837 - RNA, 61 nt, Human
aauccagucuauuguuguuggacauuuggguugguuccaagucuuugcuauugugaauagu

SEQ ID NO: 249838 - RNA, 61 nt, Human
aucauauaauaaguacuggcuuacagcuaagugguuccaaauacugguaauuaaaacaaug

SEQ ID NO: 249839 - RNA, 61 nt, Human
aacaacuagauguuccuagacauuuucuuuaugguuccaagugcaaaacagguguucuuau

SEQ ID NO: 249840 - RNA, 61 nt, Human
ccaaagaaucagcugcucuacaggaauagcaugguuccagugaauuagagaaaaccugcug

SEQ ID NO: 249841 - RNA, 61 nt, Human
cagugagugcuuagggcaaagagagcuccccugguuccauuccuucugccacccaaacccu

SEQ ID NO: 249842 - RNA, 61 nt, Human
aaaaucagcugggggugguggcacaugccugugguuccagccacucaggaggucgaggugg

SEQ ID NO: 249843 - RNA, 61 nt, Human
uguuucuaucaacuauaucaugacuaucuauugguuccauaacucuguaucauguguauuu

SEQ ID NO: 249844 - RNA, 61 nt, Human
augcggucggaggauuguguugcuguggacgugguuccaacauucacuccuaucucauuag

SEQ ID NO: 249845 - RNA, 61 nt, Human
guuuguccuggcggggaauaaaagggaucauugguuccagucacagguguaguaauugugg

SEQ ID NO: 249846 - RNA, 61 nt, Human
agugcaguugugauuucuguggaucccagcuugguuccaggaauuuugugugauuggcuua

SEQ ID NO: 249847 - RNA, 61 nt, Human
gaagagucauguggggugggaaccuggggugugguuccagaaauguuuuuggcaacaggag

SEQ ID NO: 249848 - RNA, 61 nt, Human; identical to SEQ ID NO: 249847

SEQ ID NO: 249849 - RNA, 61 nt, Human
gacacauuuugccauguaaacuaacauucacugguuccagggauuaaggaaugaaccucuu

SEQ ID NO: 249850 - RNA, 61 nt, Human
auuuuagacugacugaacgaaacccagaggcugguuccagagcucugucccugagaacaca

SEQ ID NO: 249851 - RNA, 61 nt, Human
cuucaacaggagaauuuuacuguguuucuuuugguuccauuguuuggagacauuccugggc

SEQ ID NO: 249852 - RNA, 61 nt, Human
uuguccugcugaccccagcagacccuccuguugguuccagcgaagaccacaggcauuccuu

SEQ ID NO: 249853 - RNA, 64 nt, Human
gacauuuuugguuuaaaggagccuucucaucucuggccgagaacacugcugggcucccagguag

SEQ ID NO: 249854 - RNA, 64 nt, Human
uuggaggccagccagugaccugaggaagcgugaaggccgagaagcaagaaagaaacccgacaga

SEQ ID NO: 249855 - RNA, 64 nt, Human
cggguacugagagucugcacuuaacaagcucccaggccgagaagccagugcggcagguucacag

SEQ ID NO: 249856 - RNA, 61 nt, Human
auggggaggucgccccugggagggcaggcguugguuccaagccgguucccgucccuggcgc

SEQ ID NO: 249857 - RNA, 61 nt, Human
ccccaccaacauccugcagggauggggucagugguuccaccuucacaggccacuuugaagg

SEQ ID NO: 249858 - RNA, 61 nt, Human
gccuuucaggugggccgcuuccuuggcuaccugguuccagggggcuguuuuguaaugagau

SEQ ID NO: 249859 - RNA, 61 nt, Human
guguaucacagcaguaccucucauggcuuuuugguuccagcagugagggcauuggugagau

SEQ ID NO: 249860 - RNA, 61 nt, Human
agaucuccaccauugggugagccggagccugugguuccaggggagauccagaaugcaugug

SEQ ID NO: 249861 - RNA, 61 nt, Human
aaaaugugggugucuccaggcacgggaaacuugguuccauuguuauauuguccuaugcuuc

SEQ ID NO: 249862 - RNA, 61 nt, Human
gaggugcugcuuuucugccccaccugccggcugguuccagcagcgcuggggcccagcuggg

SEQ ID NO: 249863 - RNA, 61 nt, Human
ccuguggauaacauugcuagcgagccgccucugguuccacucagcuugguuccugcccccg

SEQ ID NO: 249864 - RNA, 61 nt, Human
ugagggucugcccagccuuggcacgagagguugguuccagccccuggcagggcuuccuucc

SEQ ID NO: 249865 - RNA, 61 nt, Human
uaucuagcucuucauggugcugcuccugcuaugguuccacagggcuucuucucgcagguca

SEQ ID NO: 249866 - RNA, 61 nt, Human
ugaccccauucuggauuuguuugguuugguuugguuccaguuaaaagagaggacaggaacu

SEQ ID NO: 249867 - RNA, 61 nt, Human
ccuuucaccucugcaccuaguuuuuucccauugguuccagacaaaggugacuuauaaauau

SEQ ID NO: 249868 - RNA, 61 nt, Human
auuuggaaaaguuaggaaaccuuuaggauucugguuccagccaggguugaggaaaagaccu

SEQ ID NO: 249869 - RNA, 61 nt, Human
agucaggaaaccagcucguggacaggggcuuugguuccaaaacuuggacaaaccugaugcc

SEQ ID NO: 249870 - RNA, 61 nt, Human
ucauguuuuucaaaauauuuuucaagguggcugguuccauuuaaaaaucaucuuuuuauau

SEQ ID NO: 249871 - RNA, 61 nt, Human
cuaaucaucuaccugcuacuacuguaaaccaugguuccagcagccuguuccacacccccac

SEQ ID NO: 249872 - RNA, 64 nt, Human
aguccucagagguccaccucuuacccuacagacuggccgagaccauaucaaguauuaaaaccau

SEQ ID NO: 249873 - RNA, 64 nt, Human
aacuuuggguuaugccuccuggacgcaaauuaaaggccgagaaagaggccuugccaucaaugga

SEQ ID NO: 249874 - RNA, 64 nt, Human
cacgugcacacuggccucuuuucauuucacuaguggccgagacacccucucuggcauuuaucac

SEQ ID NO: 249875 - RNA, 61 nt, Human
cgggggccuugggagaguuuaaggcaccugcugguuccaggaccucgcuuuccaucuguuc

SEQ ID NO: 249876 - RNA, 61 nt, Human
aagauuauccaggcaugguggugcaugccuaugguuccagcuacucgggaggcugaagcgg

SEQ ID NO: 249877 - RNA, 61 nt, Human
acacugacagagaaaaaaugcuacugucuguugguuccaauauucucccacugcuagagcu

SEQ ID NO: 249878 - RNA, 61 nt, Human
uguagugaagagcuuguguuccuccuaguagugguuccagaacugguucauguuaucuauu

SEQ ID NO: 249879 - RNA, 61 nt, Human
uuauacuucaccaacaaaacuuggccucuuuugguuccacucugccacccugccauuggaa

SEQ ID NO: 249880 - RNA, 61 nt, Human
cccccacccucggagaugcugcugcagugagugguuccacugccuggauaacccuugagga

SEQ ID NO: 249881 - RNA, 53 nt, Human
ucuacuguguccacuccugaggaugguuccagggaaauaccgccagaaaacaa

SEQ ID NO: 249882 - RNA, 61 nt, Human
ccuucggagccucuggaagcuuagggcacauugguuccagccuagccaguuucucacccug

SEQ ID NO: 249883 - RNA, 61 nt, Human
gagcggcaagugaacagucacggggaggugcugguuccaugccugcucucgaggcagcagu

SEQ ID NO: 249884 - RNA, 61 nt, Human
gucuugcccucucugugggauaucacaucagugguuccaagauuucaaaguggugaaauga

SEQ ID NO: 249885 - RNA, 61 nt, Human
agcagggcggugccccagggacaaaccccgaugguuccaucaacuuggacaaccugcaguc

SEQ ID NO: 249886 - RNA, 61 nt, Human
cacgcagaccccgggcuccaguuuuuaacgaugguuccaucaauaccugauccagaauguu

SEQ ID NO: 249887 - RNA, 61 nt, Human
auuuuauaaaugccuauuuuaacaucauuuaugguuccagagaugcauacacuuuuuucug

SEQ ID NO: 249888 - RNA, 61 nt, Human
aacgaagagggauucaugugucugucucaguugguuccaaaugaaaccagggagcagggga

SEQ ID NO: 249889 - RNA, 60 nt, Human
uguuaaaaacucacauuuuaaaagcaaauuuugguuccaauucuguauuuuguauaauug

SEQ ID NO: 249890 - RNA, 61 nt, Human
uucuggaaagugcagaauucuuuugguucuuugguuccagagagagagaagaugcuugugc

SEQ ID NO: 249891 - RNA, 64 nt, Human
cagugugugguauucuuucgagguauucuuuccaggccgagauugagcaccucauguaccuacg

SEQ ID NO: 249892 - RNA, 64 nt, Human
gaggagaaagccugagugaguaacaccucauucuggccgagaguagggcagcugccuccagacu

SEQ ID NO: 249893 - RNA, 64 nt, Human
gguggcucaugccuguaaucccagcacuuugggaggccgagacaggcagaucacgaggucagga

SEQ ID NO: 249894 - RNA, 61 nt, Human
aacaggcuccugucacugagcuaaucugccuugguuccauuuccuuauucucaauuuauca

SEQ ID NO: 249895 - RNA, 61 nt, Human
uagaaacagcugaguaucguaguuucauauaugguuccagcuaauacaugcaauguggcug

SEQ ID NO: 249896 - RNA, 61 nt, Human
auaucccaaacguacugaaugaaacugauuuugguuccacaagcaguguuuggguguugcc

SEQ ID NO: 249897 - RNA, 61 nt, Human
aucaaaaccccaaacaaacacugugguuguuugguuccauuauagcacaauuuugugccau

SEQ ID NO: 249898 - RNA, 61 nt, Human
caguguggggugggggauuuugcauugggguugguuccauuucggccaccaggacugcccc

SEQ ID NO: 249899 - RNA, 61 nt, Human
agguugggguuccagaaaggcaucugugugaugguuccauugaugugggauuucccuacuu

SEQ ID NO: 249900 - RNA, 61 nt, Human
auauuagacaaaaauauagaauuaaaaccuuugguuccaaaaugggaaagguuccacgaua

SEQ ID NO: 249901 - RNA, 61 nt, Human
ugguauucugucucuacugaauaaauacaaaugguuccagccuaucaggacugcacucucu

SEQ ID NO: 249902 - RNA, 61 nt, Human
ugagaucuacugggacugcaaccuagaccguugguuccaucacugccgucccaaauacagu

SEQ ID NO: 249903 - RNA, 61 nt, Human
uucuuucuuccucuuccaguguuccauugagugguuccauuuugccuguguggggcugaca

SEQ ID NO: 249904 - RNA, 61 nt, Human
ggacaucuagguuccaauucauucacauucuugguuccagauaaaaucaacuguuuauauc

SEQ ID NO: 249905 - RNA, 61 nt, Human
ugcucccagauguccuuucucccuggucaguugguuccauuaacguuugcuacuuagugau

SEQ ID NO: 249906 - RNA, 61 nt, Human
caccuccauccauuuuccugcuuagggucccugguuccaguuauuuucagaaagcacaaag

SEQ ID NO: 249907 - RNA, 61 nt, Human
auaucccacuauacaaaugcaaaugguugccugguuccauuuaugcaagggagccaguacu

SEQ ID NO: 249908 - RNA, 61 nt, Human
aucaauccuguuagcuuucagucaucagccaugguuccaagcauggaacuaccauuuccuc

SEQ ID NO: 249909 - RNA, 61 nt, Human
agaauuuaaaguuuucagagauuguuaaaacugguuccaauuuuuuggucauuucucagaa

SEQ ID NO: 249910 - RNA, 64 nt, Human
uauagguuauuuuguagagcugaguguuaauacgggccgagaaauaaaaguaucuucugcuccg

SEQ ID NO: 249911 - RNA, 64 nt, Human
ggugguucacaccuguaaucccggcauuuugggaggccgagauagguggaucaccugaagucag

SEQ ID NO: 249912 - RNA, 64 nt, Human
ugggcugaauuuugcugaucagcuggguaguuuuggccgagaacugcacuugccucaguguucu

SEQ ID NO: 249913 - RNA, 60 nt, Human
ucuggcuagaguuagcaauaaaaaguucaaaugguuccagauuccagugucaaaggagug

SEQ ID NO: 249914 - RNA, 61 nt, Human
auugcugagcucaaauugaugugaaaugccaugguuccaguugaauuuuaagcauauuuuc

SEQ ID NO: 249915 - RNA, 61 nt, Human
gguuuauacuauuuauuaaaaccauucugcuugguuccacaaucaucuauugaguguacau

SEQ ID NO: 249916 - RNA, 61 nt, Human
uguaaaaaacaccccagcauuuuaggugucuugguuccauuuacagcacugagguaaucuu

SEQ ID NO: 249917 - RNA, 61 nt, Human
augacucacuggggguuuaagagaucaggauugguuccacugucugggguuaguguuuuac

SEQ ID NO: 249918 - RNA, 61 nt, Human
ccugggaggcuuggcuuaguacucucaucucugguuccauuccaguucagcuaagucuugc

SEQ ID NO: 249919 - RNA, 61 nt, Human
uggccucauccucccgcccugggcuggccucugguuccaucacguuugucacugccguuua

SEQ ID NO: 249920 - RNA, 61 nt, Human
aaaacacuguucuuacccucgaacccugaugugguuccauuauguaaauauuucaaauauu

SEQ ID NO: 249921 - RNA, 61 nt, Human
ggaucuuccugcuacccucuuggauucuaagugguuccaagcuuaacuugagaccuucccu

SEQ ID NO: 249922 - RNA, 61 nt, Human
uucagucagugacagaccucauauauggcagugguuccauaagauuacaauacuguauuuu

SEQ ID NO: 249923 - RNA, 61 nt, Human
gccacugagauggcaccugucaaaagagcagugguuccauuucuagauuauggaucuucgg

SEQ ID NO: 249924 - RNA, 61 nt, Human
uagauggaaguuguucuucgucacuuaauguugguuccaguccuucaacuguucauaucua

SEQ ID NO: 249925 - RNA, 61 nt, Human
cuuccaggucaggaugcacauuucuggauugugguuccaugcagccuuggggcauuauggg

SEQ ID NO: 249926 - RNA, 61 nt, Human
guaucccuaauccugaaaucugaaacacuugugguuccaagcauuuuggauaaggcaaauu

SEQ ID NO: 249927 - RNA, 61 nt, Human
ggcuuuuuauuucauauuauuaguaguaucaugguuccauuacaggccuauuaacaucaua

SEQ ID NO: 249928 - RNA, 61 nt, Human
uugaggaaggaaaucuggcccuuggguuuccugguuccacugcuacugacccagaggggaa

SEQ ID NO: 249929 - RNA, 64 nt, Human
aguggcucacgccuguaaucccagcacuuuggaaggccgagaugggcgaaucacaaggucagga

SEQ ID NO: 249930 - RNA, 64 nt, Human
gacuaggacccauaugggaauuauuaccucucagggccgagaggacagaauggauauaaucuga

SEQ ID NO: 249931 - RNA, 64 nt, Human
ccaccaagaguacugacauuuagaguuguuuaaaggccgagaacuggaaacagccuuuuccuca

SEQ ID NO: 249932 - RNA, 61 nt, Human
cauacacugacccagagcaaagcuuucccuaugguuccaaagacaacuaguauucaacaaa

SEQ ID NO: 249933 - RNA, 61 nt, Human
aaggggauggcagcuacugccaccuuccagaugguuccauggaguucugaucuuugggcau

SEQ ID NO: 249934 - RNA, 61 nt, Human
guaccucuagcuguucuuuuuuguacuuuucugguuccaaaccaguuuauucugugguucu

SEQ ID NO: 249935 - RNA, 61 nt, Human
uccaguauggagaagagaaaguuuaauuauuugguuccaucuagaaaagcaacaacuuaaa

SEQ ID NO: 249936 - RNA, 61 nt, Human
cuauauuucguacauauauaaguauuauucaugguuccaagcaaugaguguaauguauuuu

SEQ ID NO: 249937 - RNA, 61 nt, Human
ucuuagggaaggauacaaaagcaugugagacugguuccauggccucuucagaucucuaacu

SEQ ID NO: 249938 - RNA, 61 nt, Human
uuaccaacauacuuuuuaaauguuuugcuauugguuccauauuuauuuagauuuauaagug

SEQ ID NO: 249939 - RNA, 61 nt, Human
guuuuuggauccaggcaucuuuucugaauccugguuccaucaguauaccugcucuccuaug

SEQ ID NO: 249940 - RNA, 61 nt, Human
cugaggacuagggcaggcagcugggggcacuugguuccauggagccuggauaaacagugcu

SEQ ID NO: 249941 - RNA, 61 nt, Human
ugggauugcuguguuuccuuuuaauuauuugugguuccaaacaauuauuguuugaacuuuu

SEQ ID NO: 249942 - RNA, 61 nt, Human
uugcaaggagaguuccaguugacgugguguuugguuccauggcgggguacccuagggauuc

SEQ ID NO: 249943 - RNA, 53 nt, Human
agaagacaacaagacccuaguccugguuccaauuuaggugguggugaugaccu

SEQ ID NO: 249944 - RNA, 61 nt, Human
acugaagcugccucccuucacccugggacugugguuccaaggaugagagcagggguuggag

SEQ ID NO: 249945 - RNA, 61 nt, Human
aauccugauuccaagauguccugagaucuugugguuccaugagaauuauuacuuuaaaaac

SEQ ID NO: 249946 - RNA, 61 nt, Human
uugcaagaagaguuccaguugaugugguguuugguuccauggcgggguacccuagggauuc

SEQ ID NO: 249947 - RNA, 61 nt, Human
gaccucguuuuaagaaacuagcagauuuguaugguuccaaagacacuuuugaugacgauuc

SEQ ID NO: 249948 - RNA, 64 nt, Human
uuggggggcgugcauguguuggugcugaccuccaggccgagaugugcaacacucagguaggccu

SEQ ID NO: 249949 - RNA, 64 nt, Human
cuuugaaaauuuggaauuucugauaccuccagugggccgagagacacgguggguaaaggaugug

SEQ ID NO: 249950 - RNA, 64 nt, Human
agugcugggauuacaggugugagccaccgcgcccggccgagaaugacaucuuaaagccaccauu

SEQ ID NO: 249951 - RNA, 61 nt, Human
ccacugcucaccucaaacaguacaaagaaagugguuccauauuuuacaaacagaagaguag

SEQ ID NO: 249952 - RNA, 61 nt, Human
ccgucccguuguguuaggaagggugaguggcugguuccagggugggccggugccagcuccg

SEQ ID NO: 249953 - RNA, 61 nt, Human
cauggggguacacauacacagcuuccucuuuugguuccauccuuaccaccacaccacacgc

SEQ ID NO: 249954 - RNA, 61 nt, Human
aagggcagcugaccaccugccagccccucucugguuccagaagauuacccuucgcaccggc

SEQ ID NO: 249955 - RNA, 61 nt, Human
aggcagacaugggagugccaagguggccagaugguuccaggacuacaaugucuuuauuuuu

SEQ ID NO: 249956 - RNA, 61 nt, Human
cauucuggaccagcacugacagccuagccagugguuccagguccagcccugacuucauccu

SEQ ID NO: 249957 - RNA, 61 nt, Human
ucuucccaagcgugagagagugacugacacuugguuccauccauuuaggggccuugccauc

SEQ ID NO: 249958 - RNA, 61 nt, Human
ucugagugaggaaaaaauuaaaaagaaaaacugguuccauguacugugaacuugaaaacuu

SEQ ID NO: 249959 - RNA, 61 nt, Human
cacacaagcacauuggggcaccuggaaauauugguuccaggcuccuguucucuggacuuca

SEQ ID NO: 249960 - RNA, 61 nt, Human
gcauugugcguguccggaaaagggcuccauuugguuccagcccacuccccucugcaagugc

SEQ ID NO: 249961 - RNA, 61 nt, Human
guacacuuauccuuugguauacucgggggauugguuccaggaccacccauguauacgaaaa

SEQ ID NO: 249962 - RNA, 61 nt, Human
agauuuucucaguaauguuuuuguuagcuuuugguuccauuuuuuauugugcaugcagaau

SEQ ID NO: 249963 - RNA, 61 nt, Human
uggggaaagaugggguagaguguagauggcuugguuccagaggugagggggccagggcugc

SEQ ID NO: 249964 - RNA, 61 nt, Human
gguccugaagagcacuggacuaagagucuagugguuccagggcccugaccaguaggugcuc

SEQ ID NO: 249965 - RNA, 61 nt, Human
aaccccagaucaucugaaacuacuaacuuugugguuccagauuuuuuuuaaucuccuacuu

SEQ ID NO: 249966 - RNA, 61 nt, Human
gcgccauuuacacuguagucuguacaaccugugguuccacgugcauguucggcaccugucu

SEQ ID NO: 249967 - RNA, 64 nt, Human
auggcaguaggcucuaagugggugacuggccacaggccgagaaaaggguacagccucuaggugg

SEQ ID NO: 249968 - RNA, 64 nt, Human
cuguuuugugaugcccccagacacugucauccugggccgagaagaaccugcuagcuugacauac

SEQ ID NO: 249969 - RNA, 64 nt, Human
acguaguugguucuuacccccaggugucacacggggccgagagcugagcaagaauuuggaaugg

SEQ ID NO: 249970 - RNA, 61 nt, Human
ccugugccugacggagaggcagaucaagauaugguuccagaaccgacgcaugaaguggaaa

SEQ ID NO: 249971 - RNA, 61 nt, Human
agacuuuuuuuuuuuuuuuuuugaguccggcugguuccaaucacaguagcuugauugcuuu

SEQ ID NO: 249972 - RNA, 61 nt, Human
cucacagccucuguaucucugcaggccauacugguuccauuguucuguauaauacugaaua

SEQ ID NO: 249973 - RNA, 61 nt, Human
ccaucauggugucaggaaggcugagauguauugguuccauccaacaccugaaaagcaaauu

SEQ ID NO: 249974 - RNA, 61 nt, Human
cuuaguacuguguuuuuaagaagaaauaauuugguuccagauguguuagaggaucuuuugu

SEQ ID NO: 249975 - RNA, 61 nt, Human
agauuacauucucaauuagaaaacugcaauuugguuccaccacauccugacuacuaccgua

SEQ ID NO: 249976 - RNA, 61 nt, Human
cuugaaauguuccacuucuuguucugggaggugguuccaagggugucugcuuuuggccagg

SEQ ID NO: 249977 - RNA, 61 nt, Human
accucugccugagccugcugcuagcccugccugguuccaccagacuggcgugucauuggac

SEQ ID NO: 249978 - RNA, 61 nt, Human
cagagaaugaccuuuuuguguuuggaacacuugguuccaugaaaaguaugcuuuguguuuu

SEQ ID NO: 249979 - RNA, 61 nt, Human
cugaugaucaagggcugucuucucucaagcaugguuccaacucugugucacuuuuuagcgu

SEQ ID NO: 249980 - RNA, 61 nt, Human
uuuguauuuaaauggauuaaaagauccccggugguuccaugaagaauuuguaaagaucacu

SEQ ID NO: 249981 - RNA, 61 nt, Human
gccgcgcggccgcuuugguuuuuuguuugguugguuccauuuucuuuuuuucuuuuuuuuu

SEQ ID NO: 249982 - RNA, 61 nt, Human
ugucuuuguauggcuugccagcuaacaauagugguuccaucuuuaaggaagaagaauguuu

SEQ ID NO: 249983 - RNA, 61 nt, Human
ccacggaagcgaggucccagaaggccagcggugguuccaggagcaacagcucccaaacccu

SEQ ID NO: 249984 - RNA, 61 nt, Human
uacguaugucuccaugaguucugggcuccacugguuccaauugagcuccagcccugguuuu

SEQ ID NO: 249985 - RNA, 61 nt, Human
uucuuuuguggauucgucauuucccaugcccugguuccagauacauuuugaaaaccuucca

SEQ ID NO: 249986 - RNA, 52 nt, Human
acaaaggaaaucaucucuagguggccgagaagauuugauuuucuuuaaaaag

SEQ ID NO: 249987 - RNA, 64 nt, Human
gccgggcggccgggaggcuggucuggcuuagcugggccgagaggccggagggccgaguuagagc

SEQ ID NO: 249988 - RNA, 64 nt, Human
cccauccaugaacucgaugggccccuccugugccggccgagaggcacacacugccuucacgacg

SEQ ID NO: 249989 - RNA, 61 nt, Human
gaccaaagaccaaaaaaaaaaaaaagaccugugguuccagaaagcucauuaguugagauuc

SEQ ID NO: 249990 - RNA, 61 nt, Human
caguggcaauucuagauaucugagauuuugcugguuccaguuugcccaauggaguugagaa

SEQ ID NO: 249991 - RNA, 61 nt, Human
ucaagaugagugcccgggcaugagaagcacaugguuccaugagcaggacccaucucucuuc

SEQ ID NO: 249992 - RNA, 61 nt, Human
acucucccaggagucgcugaucacugggaccugguuccagccguuugcaggggaggcggcu

SEQ ID NO: 249993 - RNA, 61 nt, Human
uaugguuauccccuaaccauaugcaggggauugguuccagacccccuaagcauaccuaaau

SEQ ID NO: 249994 - RNA, 61 nt, Human
guacagucaucccuugauaccugcuggguauugguuccagcacuccgugagccauguccag

SEQ ID NO: 249995 - RNA, 58 nt, Human
gcgccggggacuccggcuagaagccgggugguuccagccauuccugcagccaagggca

SEQ ID NO: 249996 - RNA, 61 nt, Human
auauggucaucccuugguauccauggggaauugguuccaggauccuccacugaugguaaaa

SEQ ID NO: 249997 - RNA, 61 nt, Human
uguggcagaggcagugcuguguuuaucacacugguuccauuuccuugcaaauaagaagucu

SEQ ID NO: 249998 - RNA, 61 nt, Human
aacugucccugccucuggcacccccuuucauugguuccauccauccccacaacagccugcc

SEQ ID NO: 249999 - RNA, 61 nt, Human
caucuaccucccgaccuaccaccccacuggcugguuccagaacgucucucaccuagaccuu

SEQ ID NO: 250000 - RNA, 61 nt, Human
acagaugggugugcuaaucauugugccuugaugguuccacgauguauccggguguggaaau

SEQ ID NO: 250001 - RNA, 61 nt, Human
uaaggagggacccuaacguucugcccuugccugguuccauauggcuccuuccagcccugcc

SEQ ID NO: 250002 - RNA, 61 nt, Human
aguguugcccaggucaggaguguuuucuuggugguuccagcccccaucaauugaacuguuu

SEQ ID NO: 250003 - RNA, 61 nt, Human
cugaagcagcuugagcuccaaagugcacaucugguuccaacuugccugaugcuuagcucau

SEQ ID NO: 250004 - RNA, 61 nt, Human
cucuguccuuccaaguggggccccgacacuuugguuccagucaucgaggggguugggaagg

SEQ ID NO: 250005 - RNA, 64 nt, Human
gaagguuccggcacgaaucccauccccacgucugggccgagaaagcagcccggguccggaaggu

SEQ ID NO: 250006 - RNA, 64 nt, Human
agugaaaggaauucccaucaggacucagaccccaggccgagaucuugcccugaauguacccugc

SEQ ID NO: 250007 - RNA, 64 nt, Human
uggggcuggaauaaagaggugccuucagcuggugggccgagaggcaggaagcagccuuccuugg

SEQ ID NO: 250008 - RNA, 61 nt, Human
aggagagaaaguuucugccuggcccugcaucugguuccagcccaccugcccuccccuuuuu

SEQ ID NO: 250009 - RNA, 61 nt, Human
aggcaguuuucuuuguucucagacuaauggaugguuccagagaaggaaaugaaaggugcug

SEQ ID NO: 250010 - RNA, 61 nt, Human
ggaggcugcccacauccccacaugugcacugugguuccaguguagcugcugugagcccacu

SEQ ID NO: 250011 - RNA, 61 nt, Human
auacaaaaaauuagccggguuccaucaccugugguuccagcugaggugggaggaucacuug

SEQ ID NO: 250012 - RNA, 61 nt, Human
guggccgaaucaggcugaggaaucuacggcuugguuccagcugugcagcugacuucuguga

SEQ ID NO: 250013 - RNA, 61 nt, Human
gcccgcuggacagcacuaucucuaccagcggugguuccagccuucugauaaucacuggccu

SEQ ID NO: 250014 - RNA, 61 nt, Human
gcacuucauggucucacuggaccauuccaugugguuccacgcccccuuccgagcugaccac

SEQ ID NO: 250015 - RNA, 61 nt, Human
auuuaggaauuuuaaacuuuagaugaucauuugguuccauuuuuauuucauuuuuauuuuu

SEQ ID NO: 250016 - RNA, 61 nt, Human
aaauguuuagugcuaaugagcagaaaaugaaugguuccauaauaaauugauaucugauuaa

SEQ ID NO: 250017 - RNA, 61 nt, Human
gccgcucugcucucucauacgcguguauguuugguuccaugucacagcccccuaggagcca

SEQ ID NO: 250018 - RNA, 61 nt, Human
ccuaauuuauucuaaauuuuaagugguucuuugguuccagugcuuuauguuguuguuguuu

SEQ ID NO: 250019 - RNA, 61 nt, Human
aguggcauggaaguauaauaacucauugacuugguuccagaauuuuguaauucuggaucug

SEQ ID NO: 250020 - RNA, 61 nt, Human
aggcaagggggagggugcuuauccgugucucugguuccagcuuccugucuuugcucccucc

SEQ ID NO: 250021 - RNA, 61 nt, Human
uaaaccgugaugcgguugucacuuaguucugugguuccagcagaucucagugggcugguug

SEQ ID NO: 250022 - RNA, 61 nt, Human
caaguucugcagaacuaacccccagcaggccugguuccacccugggcagcacccccucuag

SEQ ID NO: 250023 - RNA, 61 nt, Human
ucuuauucacuuuuguaaacagcuaauagcaugguuccaauuuuuuuuaaguucacuuuuu

SEQ ID NO: 250024 - RNA, 64 nt, Human
aaaaaaaauugccuguaaucccagcacuucaggaggccgagaugggcagaucuugaggucggua

SEQ ID NO: 250025 - RNA, 64 nt, Human
gcaccugccggcgacacuccugccgguaguuuagggccgagacggcuagcuucacgccacccuu

SEQ ID NO: 250026 - RNA, 64 nt, Human
aguggcucaugccuguaauccuagcacuuugagaggccgagauaggcggauugcuugagcccag

SEQ ID NO: 250027 - RNA, 61 nt, Human
acagaaaugcucugauuagaaaggaaaugaaugguuccacucaaauguccugcaauuuagg

SEQ ID NO: 250028 - RNA, 57 nt, Human
uucuagacugccauuacuaagagaggcugguuccagaggaugcaucuggcucaccgg

SEQ ID NO: 250029 - RNA, 61 nt, Human
cggcuggugggugcucgggggacggccguguugguuccauguaacuguggaacucauuuca

SEQ ID NO: 250030 - RNA, 61 nt, Human
aucccaggcuggauggaguggcuggaaggaaugguuccaaacaacaccaccgagaucuccc

SEQ ID NO: 250031 - RNA, 61 nt, Human
aagcgaccuguggacuaaaaucugccacgauugguuccagcaagugugagcagagaccccg

SEQ ID NO: 250032 - RNA, 61 nt, Human
ggacuuguuugaaagaaagaggaguggaaaaugguuccaggagggaagagguucuuugaga

SEQ ID NO: 250033 - RNA, 61 nt, Human
ggcccagcuggaggcagcugggugaggguccugguuccagcagagcacuggggcccaucca

SEQ ID NO: 250034 - RNA, 61 nt, Human
ccugacagucaccugggguccccccucucccugguuccaccuuucugaggaggagccugga

SEQ ID NO: 250035 - RNA, 61 nt, Human
cuccucucuuuguguguagcgguuugaauguugguuccaugccuggcccagccccaccuca

SEQ ID NO: 250036 - RNA, 61 nt, Human
ggagaaagcugauggagccaggacagagaucugguuccagcuuucagccacuagcuuccug

SEQ ID NO: 250037 - RNA, 61 nt, Human
gggcauccacuccuuuuccugcaagagaugaugguuccauugcucuuggcuucaugguguu

SEQ ID NO: 250038 - RNA, 61 nt, Human
accaaggaucaaugaaaugcacauaauuaacugguuccaucaagacugugcacccaggccu

SEQ ID NO: 250039 - RNA, 61 nt, Human
auucccagaccccagcccuuugugcucacccugguuccacuggucucaaaagucaccugcc

SEQ ID NO: 250040 - RNA, 61 nt, Human
guucuaauaguguuuaaauguacugguaaccugguuccaauaguuguguuugcccaagccu

SEQ ID NO: 250041 - RNA, 61 nt, Human
ccccaggguuuacaugaagcagaaccuucuuugguuccauguugacugacuuauggcauga

SEQ ID NO: 250042 - RNA, 61 nt, Human
uaccuuuuauuuuuuuuuuaccuuggggugaugguuccaaaccauaaaugugauuauaguu

SEQ ID NO: 250043 - RNA, 64 nt, Human
aggggcuguccaggccuucucccccacacccucaggccgagauccgugagagacccacuuugcu

SEQ ID NO: 250044 - RNA, 64 nt, Human
gccgucaggacccaccaugucugccccaucacgcggccgagacauggcuugccacagcucuuga

SEQ ID NO: 250045 - RNA, 64 nt, Human
ggccaggauugccacuccuguuucagaggaagcaggccgagagacuugcaccuuggccaagcca

SEQ ID NO: 250046 - RNA, 61 nt, Human
aucgaggcaggcuuuuccagcaucacuguccugguuccaucucugcuauaugggaaugaaa

SEQ ID NO: 250047 - RNA, 61 nt, Human
uuuccacuuuuugacaccuuauccugauguaugguuccaggauuuggauuuugauuuucca

SEQ ID NO: 250048 - RNA, 61 nt, Human
cagagaguuuucaaguuuuugcagauguaggugguuccagcuuuucuuucuccccuacucc

SEQ ID NO: 250049 - RNA, 61 nt, Human
uuucauaugauaucagccaagaguuuuccugugguuccagcccaucuucccuaaucacaau

SEQ ID NO: 250050 - RNA, 61 nt, Human
guguguuuugaggccaugaugauuacauuugugguuccaaaauaauuuuuuuaaauauuaa

SEQ ID NO: 250051 - RNA, 64 nt, Human
cugaccuccugcacaacgucagccagaacaucgcggccgagacccgggcugaggacccgccgug

SEQ ID NO: 250052 - RNA, 64 nt, Human
cuaggacacuggugcacuacaccccaugccugggggccgagauucuccagcagaaagaugcaau

SEQ ID NO: 250053 - RNA, 64 nt, Human
gacuccuccaucuucggcagcucuggcucaaagaggccgagaaacccaguucuccugggccaag

SEQ ID NO: 250054 - RNA, 64 nt, Human
ccaugcugggcccuccaggccaagagucucagcuggccgagaguccaggccuugccucccccga

SEQ ID NO: 250055 - RNA, 64 nt, Human
ccagagggaggucgugaagggccccggugcugugggccgagagccgccugccgcgccagacgug

SEQ ID NO: 250056 - RNA, 64 nt, Human
ucaacucauugccuguaaucccagcacuuugggaggccgagacggguggaucacgaggucagga

SEQ ID NO: 250057 - RNA, 64 nt, Human
accuaggccuacccugaaugcuucuugcuaaccaggccgagaggccacacacuugcccccccau

SEQ ID NO: 250058 - RNA, 64 nt, Human
agugguucaugccuguaaucccagaacuucgggaggccgagacaggcagaucacgaggucaaca

SEQ ID NO: 250059 - RNA, 64 nt, Human
gccagcacaccuaacccauggauguggaaccuacggccgagaaggaauguugcaugagucggau

SEQ ID NO: 250060 - RNA, 64 nt, Human
acuaccuguuugaaaaagcagaagucaacuuuugggccgagacccugaucuuugugaaauaccu

SEQ ID NO: 250061 - RNA, 64 nt, Human
gcucaacugauuucuuguccaaugauccuugcguggccgagauccagcuucaacgaaccagcua

SEQ ID NO: 250062 - RNA, 64 nt, Human
caugcugcaggccacuacggcugcucggcaggagggccgagaguuuggacccacauagcugcaa

SEQ ID NO: 250063 - RNA, 64 nt, Human
gcuuccacccagccaagcccacaucacaucuccuggccgagagcagccacugccacucagucug

SEQ ID NO: 250064 - RNA, 64 nt, Human
aguguugggauuacaggcuugagccaccgcacccggccgagaauauguguuguuauuuaugacu

SEQ ID NO: 250065 - RNA, 64 nt, Human
uuaaaaacugugauuuuuaucacaagggaggggaggccgagagucagacugauagacaccauag

SEQ ID NO: 250066 - RNA, 64 nt, Human
ccgggauuguuuccccaaguuguuacgccuggacggccgagaguuauccgcaccagugauuguu

SEQ ID NO: 250067 - RNA, 64 nt, Human
cgccagcuagcuccauagggaagccugugucuccugcccccagggcgcacccucagugcaggca

SEQ ID NO: 250068 - RNA, 64 nt, Human
ccucagaggugacacccauugggcccuuccggcaugcccccaguuacuguaaauguggccccca

SEQ ID NO: 250069 - RNA, 64 nt, Human
ggcugggagacggcagaagagauagaaucagggcugcccccacagagugggacccaaggggcua

SEQ ID NO: 250070 - RNA, 53 nt, Human
gguggaacauggugcccugagccugcccccacccgccauccucucugcccucu

SEQ ID NO: 250071 - RNA, 64 nt, Human
uaaacuauaagacguaguuuuaauuaauaaauauugcccccagauuguauuuauauuauccccc

SEQ ID NO: 250072 - RNA, 64 nt, Human
gaaauugucuuaagcaacagccccaaaugcuggcugcccccagccaagcauuggggccgccauc

SEQ ID NO: 250073 - RNA, 64 nt, Human
cuugcagcuguugagcgcaccuaaccacuggucaugcccccaccccugcucuccgcacccgcuu

SEQ ID NO: 250074 - RNA, 64 nt, Human
cuuuaguuuuuaaaguaaaauucauuuuauuugcagaguacacuuguaugguagacuguuaaag

SEQ ID NO: 250075 - RNA, 64 nt, Human
ccaagcccaccccauugccaacagggccagggcaagaguacacacaggggccucauaccauaug

SEQ ID NO: 250076 - RNA, 64 nt, Human
uaggaaauauuuuuguuguuguuuuguuucuuaaagaguacagaggccauugaagccuuuugcu

SEQ ID NO: 250077 - RNA, 64 nt, Human
cugccucuuuggcuucauggguuuuucugcuuccugcccccacccccacaugugcaauccucaa

SEQ ID NO: 250078 - RNA, 64 nt, Human
gauccccggggaggcaggucccaggagcagacccugcccccagcccccacagacacaccccaau

SEQ ID NO: 250079 - RNA, 64 nt, Human
cguuuccugggguuucuuugcccaugggguucucugcccccacccccggcccuuuguuugacuu

SEQ ID NO: 250080 - RNA, 54 nt, Human
auuacacagcugacuacugaggggugcccccaucccauccaccccuucucuuca

SEQ ID NO: 250081 - RNA, 64 nt, Human
gccccaggcaggccucgccuccagcagccccaccugcccccagccucugugacagugaccgucu

SEQ ID NO: 250082 - RNA, 64 nt, Human
uuccuaaauuucaguaggcuuuaugcuguguuuaugcccccaauuuauuuuaacaaaagaagau

SEQ ID NO: 250083 - RNA, 64 nt, Human
aacagcagggaagccaagcacccauucaucccccugcccccaucugacugcguagcugagaggg

SEQ ID NO: 250084 - RNA, 64 nt, Human
aaaugcugcaugaacacauuuucaggggagccugugcccccaggcgggggucgggcagccccag

SEQ ID NO: 250085 - RNA, 64 nt, Human
acucgaccgcccucagguguuggugaaacagagcugcccccaggcucgcugggcauaggcuucc

SEQ ID NO: 250086 - RNA, 64 nt, Human
ugcuuccucaccuugagaguaaagugcugcccucugcccccaacacacacacauaucaauuccu

SEQ ID NO: 250087 - RNA, 64 nt, Human
ggauggacgagugagcuaccaggaagaggggcgcugcccccacagauccauccuuuugcuucau

SEQ ID NO: 250088 - RNA, 64 nt, Human
gugcccucucccuuuguccccccagagagacauaugcccccagagagagcaaaucgaagcgugg

SEQ ID NO: 250089 - RNA, 64 nt, Human
uccuguagcauagccaggcacugccagucaccugugcccccauugcugucagcagaugucuugg

SEQ ID NO: 250090 - RNA, 64 nt, Human
uagaggcuagcuucugcuuuucugcccuggcugcugcccccaccccggggacccugugacaugg

SEQ ID NO: 250091 - RNA, 64 nt, Human
uuccucugccugccccgcccccaguccccaccccugcccccagccccggggugaguccauucuc

SEQ ID NO: 250092 - RNA, 64 nt, Human
gcuuuuaucucagaaccccauggguuccagaccaagaguacaggaaaucaaauuguuguccugu

SEQ ID NO: 250093 - RNA, 64 nt, Human
agccuauauccugagacuaaguggaagugggaaaagaguacaagagaagagacaaaguggggau

SEQ ID NO: 250094 - RNA, 64 nt, Human
ugagaguacaccccaacagcacccucuccagaugagaguacaccccaacagcacccucuccaga

SEQ ID NO: 250095 - RNA, 64 nt, Human
uaagaucaaaccccauggagcagccagcguuagaugcccccacccaccuguacucuggagagac

SEQ ID NO: 250096 - RNA, 64 nt, Human
ugcuggcuuuacuaagccagccacacuuggagucugcccccaagcucucucacugaaugcugcc

SEQ ID NO: 250097 - RNA, 64 nt, Human
auuugguaaaaugcugguuagguugagucuuccuugcccccacucagucaucuuuguaugaauc

SEQ ID NO: 250098 - RNA, 64 nt, Human
ucagugugguuauuuuuucuuugguugguuuuugugcccccauucuacuucccacccuccugcc

SEQ ID NO: 250099 - RNA, 64 nt, Human
cagauuuaugaggaaagaaagggacagcauuugcugcccccaccccucuuuuccaguccuugcc

SEQ ID NO: 250100 - RNA, 64 nt, Human
cacucucccaacccaucaccgugacugcaguuccugcccccauucucuuggggucagggagggg

SEQ ID NO: 250101 - RNA, 64 nt, Human
ggacccugagguggcaccguacucaguguugugaugcccccaccuagggaggacucaaugcucu

SEQ ID NO: 250102 - RNA, 64 nt, Human
agcauaaaaggcauuaggugggcauuuuucugugugcccccaaaaagcuccauggaaacaggca

SEQ ID NO: 250103 - RNA, 64 nt, Human
uuauuuauuuauuuguuccuuuguucccuacccgugcccccagugucuucccugcugaguacca

SEQ ID NO: 250104 - RNA, 64 nt, Human
caucuuuuaggaaagacucgcuggggucugguacugcccccaggacuaguggagguucucugcc

SEQ ID NO: 250105 - RNA, 64 nt, Human
ucuggcucucucuguacccuuccuggugcugccgugcccccaggaggagaugaccagugccuug

SEQ ID NO: 250106 - RNA, 64 nt, Human
aaccucucuagcuaaugugugguuucuccuucccugcccccaccccuaggcucaccucugcagu

SEQ ID NO: 250107 - RNA, 64 nt, Human
gccaugcaaccagauguguugugagugggcagcgugcccccacgcuggaguaacuccgcacgcu

SEQ ID NO: 250108 - RNA, 64 nt, Human
uaugauauuuguagugccggggcucgcacacugcugcccccagccuguagaggacuuucuucag

SEQ ID NO: 250109 - RNA, 64 nt, Human
cucaucauaauucaaguguucuuccacacagcguugcccccacaaccacgccggacgugccccc

SEQ ID NO: 250110 - RNA, 64 nt, Human
uuuggggaggcagguaccccagggcagcaggcucagaguacagucccuucagcagagggcacag

SEQ ID NO: 250111 - RNA, 64 nt, Human
aauguccaguaagaucacuguuuagauuugccauagaguacacugccugccuuaagugaggaaa

SEQ ID NO: 250112 - RNA, 64 nt, Human
aucuguauuccaauuguagaggugaguuuuguuaagaguacaauugcaaaucuuaucuauauag

SEQ ID NO: 250113 - RNA, 64 nt, Human
ccucacuggccuccagugggauucacuccugcccugcccccaccuucccagucccacaggccac

SEQ ID NO: 250114 - RNA, 64 nt, Human
ugcuggcaggggcuggcacccaugggacacccucugcccccagccgcagccugucagagcucug

SEQ ID NO: 250115 - RNA, 64 nt, Human
gguggaggaaggugcugagcuuagccuugugcccugcccccaucuccccaggccuccagccucu

SEQ ID NO: 250116 - RNA, 64 nt, Human
cuguagccauggcucaggcaagccccucagcccuugcccccaucccucggacccaccaaacugc

SEQ ID NO: 250117 - RNA, 64 nt, Human
ccuuccaucagccuuaacccugggaaaugccugcugcccccaaugacucuugguuucgucuccc

SEQ ID NO: 250118 - RNA, 64 nt, Human
cccacgccagcgagcaggcugccugcccaccccgugcccccagccagcuggcugugccagggca

SEQ ID NO: 250119 - RNA, 64 nt, Human
ggggucaggaacaguggcugggugggcccagaacugcccccacugucccccuacccaccgaugg

SEQ ID NO: 250120 - RNA, 64 nt, Human
agcccccucccaggaguggucagcgggucacagcugcccccacucuauaagcagggcuaauugu

SEQ ID NO: 250121 - RNA, 61 nt, Human
gggaccuguugauuaauugaguggcccugccugcccccagcagccugcccccgacucuacc

SEQ ID NO: 250122 - RNA, 64 nt, Human
ccagauucaucaugucuguugugaccaggaaagcugcccccaucugcaggaagccacuaugcca

SEQ ID NO: 250123 - RNA, 64 nt, Human
accccaugugugcacauucaggagcgacagucucugcccccauucccuugagaggggcuggaug

SEQ ID NO: 250124 - RNA, 64 nt, Human
ccaucucuagguggcucaguccauggccacucccugcccccagccuggcuggacagcaaggaau

SEQ ID NO: 250125 - RNA, 64 nt, Human
ggaugaguuauagcuguucugaccaggcguccucugcccccagggagaggcugcuggaugguga

SEQ ID NO: 250126 - RNA, 64 nt, Human
cucaccccgggcauccugcccgccgccugcucucugcccccauccccucgacgacccccgcccc

SEQ ID NO: 250127 - RNA, 64 nt, Human
ccucaucugugggaagggagucccuggcuuauacugcccccaccacagcuccuugcccuggcca

SEQ ID NO: 250128 - RNA, 64 nt, Human
cccuucaccgcccccagggaggguuucccaccucagaguacaccgaggggaccugcagaggggg

SEQ ID NO: 250129 - RNA, 64 nt, Human
agauuccgccuccaaguuuagcccaaguuuguggagaguacagacugcguuggcugggcuuccg

SEQ ID NO: 250130 - RNA, 64 nt, Human
uuggauaauuaauauauugcuuucagaugcugggagaguacauuaacugagugaugcgcaacuu

SEQ ID NO: 250131 - RNA, 64 nt, Human
cuaggcaaauggagugggggcaggcaucuauuccugcccccaucaugccccacacccaucaguc

SEQ ID NO: 250132 - RNA, 64 nt, Human
agugcagacugucuaaaugcccccagcccaccccugcccccauuugcagccuugguguucguuc

SEQ ID NO: 250133 - RNA, 51 nt, Human
ccccagugcagacugucuaaaugcccccagcccaccccugcccccauuugc

SEQ ID NO: 250134 - RNA, 64 nt, Human
ggaggagaucagaaaaucccucugacaucuccacugcccccaaagaccuccguugaacauucug

SEQ ID NO: 250135 - RNA, 64 nt, Human
aucaauuucuguuuugaaggugcugggacucuggugcccccaacccugggcauccucaggcuuu

SEQ ID NO: 250136 - RNA, 64 nt, Human
caccacaaagcaaugaaucauuaucaucucaacaugcccccaauuucucucccaaucacccuca

SEQ ID NO: 250137 - RNA, 64 nt, Human
agcgugaauuugggggauuuuucaguggaacccuugcccccaaaugucgaccagcccccaaaug

SEQ ID NO: 250138 - RNA, 64 nt, Human
gcuaggggcucgggguggagggucucagcucugcugcccccaccccaguacuagccuagcuucc

SEQ ID NO: 250139 - RNA, 64 nt, Human
uugugugcucuccauucugcuccuuccccaucguugcccccauuucugaggugcacugggaggc

SEQ ID NO: 250140 - RNA, 64 nt, Human
uucuugcccuuaagugcuuuugcugcuauuuuuuugcccccaguuccacaagauccaaccaaga

SEQ ID NO: 250141 - RNA, 64 nt, Human
cacuuccagaaccagcuucaacauaugucuacauugcccccaaguuaauaaagugccaacccuu

SEQ ID NO: 250142 - RNA, 64 nt, Human
uccuugauucacaaugaaaugcucuccuuuccccugcccccagaccuuuuauccacuuaccuag

SEQ ID NO: 250143 - RNA, 64 nt, Human
ggagcuggccuaggugggagccaccacuccugccugcccccacacccacuccacaccaguaaua

SEQ ID NO: 250144 - RNA, 64 nt, Human
ccauccccaucuaucugugcccugagcauggcucugcccccaggucgucuugcacaccuuggca

SEQ ID NO: 250145 - RNA, 64 nt, Human
uuaaggcaguaauugcauuuuaucugucucaugaugcccccagagaacuuccaacucaguagga

SEQ ID NO: 250146 - RNA, 64 nt, Human
uagcgaagcgccccuugucugguggacacgugacucgcgugacuuuaccuaucauuggagacga

SEQ ID NO: 250147 - RNA, 64 nt, Human
aguuuuguaucuacauuuuuccccuccugggguuugcggggacagggacagaacuacaggaguc

SEQ ID NO: 250148 - RNA, 64 nt, Human
gugcaacgucugcaucauccugguggcuagccagugcggggaggcccugcccugggauaccagu

SEQ ID NO: 250149 - RNA, 64 nt, Human
uccucccaccucccccucccccuucucccaccccugcccccacuuccuguuugggccccucucc

SEQ ID NO: 250150 - RNA, 64 nt, Human
caggagugaggcauggugacagcaguccccuaugugcccccaagucaucugagcauuggugugc

SEQ ID NO: 250151 - RNA, 64 nt, Human
aauaagcccauguuuuuggcuuccugaaccuuuuugcccccacuuuuagacauaccccagagcc

SEQ ID NO: 250152 - RNA, 64 nt, Human
guaagaguugcagugggcaggugacccuccucccugcccccauccuuugcuuccucaagcuccc

SEQ ID NO: 250153 - RNA, 64 nt, Human
gucuccugccuucugggcccagcccuggggccugugcccccagaggccuacaggggcaccaugc

SEQ ID NO: 250154 - RNA, 64 nt, Human
cuggagugagcugagcagaaguuuugugcccgccugcccccauccccuccaggccacguuuuag

SEQ ID NO: 250155 - RNA, 64 nt, Human
ugaauucccagguuggccugguggccaugucgccugcccccagcacuccucugucucugcucuu

SEQ ID NO: 250156 - RNA, 64 nt, Human
acaaagguugcuuucccccuuuuuguucuuuuuaugcccccaagcacuuucugcaguagcuaga

SEQ ID NO: 250157 - RNA, 64 nt, Human
uccucugacggcaggaaaacuggacaugaaugacugcccccacgccccuccccugcagaguggc

SEQ ID NO: 250158 - RNA, 64 nt, Human
ugguagggagacaggaaacugcguuuuagccuugugcccccaaaccaagcucauccugcucagg

SEQ ID NO: 250159 - RNA, 64 nt, Human
agaacaccuuuacaauaguuuaaacagucauucaugcccccagugucuaggaagauaacagcca

SEQ ID NO: 250160 - RNA, 50 nt, Human
auaugcacaagagcaagugaugcccccagcgcccccagcccagcccacuc

SEQ ID NO: 250161 - RNA, 64 nt, Human
ucuucucaggcccuuuuuagucccuuuccaaagcugcccccaccacccugcuccucuggccuca

SEQ ID NO: 250162 - RNA, 64 nt, Human
gaacucagaugccugggaagcccagccccucaggugcccccacacacagccuucccuugacgcc

SEQ ID NO: 250163 - RNA, 64 nt, Human
agcacuggcagcucccaccuccuccucccgccccugcccccacccccggagccugcaaaagugu

SEQ ID NO: 250164 - RNA, 64 nt, Human
agacccgugggcagguggggcaugggcccuggccugcggggaccugcuggggugugagggcaga

SEQ ID NO: 250165 - RNA, 64 nt, Human
uacaauccccgcagagucuccggugcagacgcgcugcggggauggggagcggcgugccaaucug

SEQ ID NO: 250166 - RNA, 64 nt, Human
gggcaugacaucugucagguggcaccgagcaggaugcggggauggacccuagauaccacagccu

SEQ ID NO: 250167 - RNA, 64 nt, Human
auuaggagaaaaugggcaauaaucaucucuguuuugcccccauucuacuacccaccacugccca

SEQ ID NO: 250168 - RNA, 64 nt, Human
agcucagugagaagggcccuguauucaccuccacugcccccaggggcuguggacaaaccggcug

SEQ ID NO: 250169 - RNA, 64 nt, Human
uauuuccuggggagcccugaggcuuuucuucuccugcccccaagcaccuccagcggugaugagc

SEQ ID NO: 250170 - RNA, 64 nt, Human
cucuggcucugaagggacaaaggcuucuggcuuuugcccccagccccuuggauaccaguaauuc

SEQ ID NO: 250171 - RNA, 64 nt, Human
agcccaggagucagugcuggugguuggagggaccugcccccacugguucauuuaacccucuguc

SEQ ID NO: 250172 - RNA, 64 nt, Human
ugggucaucgggaauacuagggagaagguuucauugcccccagggcacuucacagagugugcug

SEQ ID NO: 250173 - RNA, 64 nt, Human
gauagagggucccucucugcuccccagcagcuccugcccccaaggccugacuguauauacugua

SEQ ID NO: 250174 - RNA, 64 nt, Human
cuccaggccaucccauagccccuccucuucuggcugcccccaaugccccgaggccuggggagcc

SEQ ID NO: 250175 - RNA, 64 nt, Human
gggucccugggcucuggacaagcacugggggacgugcccccagagccacccacuucucauccca

SEQ ID NO: 250176 - RNA, 64 nt, Human
gcagaacacauuucaaaugaguuuugcuaugggcugcccccaggguggcaauuuauuuuaagag

SEQ ID NO: 250177 - RNA, 64 nt, Human
cguggagaaacaagagaccaacuuuuucauucccugcccccaauuucccagacuagauuucaag

SEQ ID NO: 250178 - RNA, 64 nt, Human
aauggcccuucgcucucccccagccccaccaugaugcccccaugccugggcgugggggaagauc

SEQ ID NO: 250179 - RNA, 64 nt, Human
ggccaccaccuguaggaccuccucccacccacgcugcccccagagcuugggcugcccuccugcu

SEQ ID NO: 250180 - RNA, 64 nt, Human
ccggccuccuucaccuuucucaucuccagagcccugcccccaauacucugucuggguuaggauc

SEQ ID NO: 250181 - RNA, 64 nt, Human
gggacuggggaggcgcagccuagacccaauugcuugcccccaugaggcuagcacuaauaggaaa

SEQ ID NO: 250182 - RNA, 64 nt, Human
agcuugcugcccgccgcacgcacgcgcgccugcgugcggggaugcgcgcgagugugugcgugcu

SEQ ID NO: 250183 - RNA, 64 nt, Human
ccucccagacccagccccuuuuccuccauugaugugcggggagcuccucccgccacgcguuaau

SEQ ID NO: 250184 - RNA, 64 nt, Human
gagaaagaagaggcacuagucuaaaaggcugcauugcggggagagaugagacaggcagaggagg

SEQ ID NO: 250185 - RNA, 64 nt, Human
uuuauuuaaaacaaaacaacacaaaaaaacaaugugcccccagaugucagaaugaggcgacuag

SEQ ID NO: 250186 - RNA, 64 nt, Human
ucccccauaccucccacaguaucccagcgccucaugcccccaaccccaagcccugcccuucacc

SEQ ID NO: 250187 - RNA, 64 nt, Human
auggucacaaggcugccuuguugggcaggcguauugcccccaguuccucuucugcuggccugua

SEQ ID NO: 250188 - RNA, 64 nt, Human
ccacugagaaaacuuacuuacuucaggcauccagugcccccacccaggguucaggcccugucua

SEQ ID NO: 250189 - RNA, 64 nt, Human
ggacuguggugacuucugcugcuggccccgccccugcccccagagcguccuuggcugccgucug

SEQ ID NO: 250190 - RNA, 64 nt, Human
augagaacagcaccaagccauucaugggggaaucugcccccaugacccagaccccucccguuag

SEQ ID NO: 250191 - RNA, 64 nt, Human
ggcugggggugucagcauucccagcuuuccaagcugcccccaggcggcagagucugaggguccc

SEQ ID NO: 250192 - RNA, 64 nt, Human
gcugccacacccagcucaggccugggccagccccugcccccagcccacugagggggugggcuua

SEQ ID NO: 250193 - RNA, 64 nt, Human
aaccucaggcaauuccuaccucuucaccugacccugcccccacuugccauaaaacuuagcuaag

SEQ ID NO: 250194 - RNA, 64 nt, Human
cccagacagcacugccucuuccuccccaccccacugcccccaccuuaaugugaauuugacugau

SEQ ID NO: 250195 - RNA, 64 nt, Human
gccgcgccagcugccgggacacugcugccagaccugcccccaggguaagucuugcuccgcccug

SEQ ID NO: 250196 - RNA, 64 nt, Human
cuuugcugucucaggcacuacaugucauugaucuugcccccaauccugcuccuccucucauguu

SEQ ID NO: 250197 - RNA, 64 nt, Human
gcuagucacaggagggagagagaggcaguguacuugcccccaucuccuggagggaggugcguug

SEQ ID NO: 250198 - RNA, 64 nt, Human
ugcucccaggccaguaagggaaauagaaaaacccugcccccaaauaagaagggauggauuccaa

SEQ ID NO: 250199 - RNA, 64 nt, Human
ggcccagcuccccaagaaagccucagccauucacugcccccagcucuucuccccagguguguug

SEQ ID NO: 250200 - RNA, 64 nt, Human
gugugugcgcacgcugggcggguucgugcauacaugcggggaccccagacugucagcacaggga

SEQ ID NO: 250201 - RNA, 64 nt, Human
cuguuguagaugacagagcuuuuuguuucacagcugcggggauucugcugaccaucuuuuagaa

SEQ ID NO: 250202 - RNA, 64 nt, Human
aauaaaaugugugggguuggguccccugcgcgccugcggggaacguaggcgggagucgugcccc

SEQ ID NO: 250203 - RNA, 64 nt, Human
ggcccuucucagccacacuucccaccccagggggugcccccaggcugaucucauuucugauguu

SEQ ID NO: 250204 - RNA, 64 nt, Human
ucaccugagucuggccccuccagcgggcagggagugcggggaugcggaucagcugggaggagga

SEQ ID NO: 250205 - RNA, 64 nt, Human
ggagaaguggagggagaggcccugggccugucccugcggggaaaucuuuuauggaagaagggcu

SEQ ID NO: 250206 - RNA, 64 nt, Human
cugacucuugaggguuggggcugcacuuauuuauugcggggagacagcucucucucccaccucc

SEQ ID NO: 250207 - RNA, 64 nt, Human
ggaguggcuaagccucuccugacgaggcuccucaugcggggagagggcugggguccagggguuu

SEQ ID NO: 250208 - RNA, 64 nt, Human
cucuggauaaaacgaacaaaagaauuagaauuccugcggggaauauauacaagacuuuauuuag

SEQ ID NO: 250209 - RNA, 57 nt, Human
gcgagccucaccccacuuaacauauccugcggggaggaggagccccaggggugcuag

SEQ ID NO: 250210 - RNA, 64 nt, Human
gcagaccaagcgcuucguggcagggaaagcagcgugcggggaagucacugaaaagugcugccua

SEQ ID NO: 250211 - RNA, 64 nt, Human
ugucaaauauacacuucuugaucucccuucuguuugcggggaucuuacuauuugaugggucacu

SEQ ID NO: 250212 - RNA, 64 nt, Human
aagcaaggagagacucuaguuaagaggugcuggcugcggggauccagacagggcacauuggggg

SEQ ID NO: 250213 - RNA, 64 nt, Human
uggcuguccugaguggugagcaucuuagcuuagcaccaaccaacacagucucaccuagaaaaca

SEQ ID NO: 250214 - RNA, 64 nt, Human
aaacagaugacaucccagaugcagaccaugggcaaccaaccauugcacuggccaaaucauuauu

SEQ ID NO: 250215 - RNA, 64 nt, Human
cccaggacuugaugaccacacggggcagagagaaaccaaccaaggccagcaccuccgucggaag

SEQ ID NO: 250216 - RNA, 64 nt, Human
auagccuuacuguaagugcaauaguugacuuuuaaccaaccaccaccaccaccaaaaccaguuu

SEQ ID NO: 250217 - RNA, 64 nt, Human
agaacuguuucaaguacucaagacugacuuacagaccaaccaaccaccuugcuggaacccuugc

SEQ ID NO: 250218 - RNA, 64 nt, Human
cauugcucucccucgugcuccccaaaucaccacaaccaaccaauaccgcgauccaugagggacu

SEQ ID NO: 250219 - RNA, 64 nt, Human
uggcugacagaccuucuggccagacagacuccuaaccaaccagauggacugccagacaggcaga

SEQ ID NO: 250220 - RNA, 64 nt, Human
gacuucaggaaaaaucaacccagcaccagcagcuaccaaccaccauuccaucucuucacuugaa

SEQ ID NO: 250221 - RNA, 64 nt, Human
gaugguguuuacucagaaccugcuccuggaguacaccaaccagaccacucaggcacgccccagg

SEQ ID NO: 250222 - RNA, 64 nt, Human
aaagaaaggcccucugcucaucaagaaaguggcuaccaaccagggucccaaagcccaaccucag

SEQ ID NO: 250223 - RNA, 64 nt, Human
cucccaccgggucugggcucuggaaggagccagaugcccccagaaaggugggugguggagacgg

SEQ ID NO: 250224 - RNA, 64 nt, Human
gaacucauucaugaggaaucugaugcuccuuugcugcccccaagaguauacuccaccgagaacc

SEQ ID NO: 250225 - RNA, 64 nt, Human
aggggcugccuggcauuacuccuccaaagacugcugcccccagaacaggcagggggugugggag

SEQ ID NO: 250226 - RNA, 64 nt, Human
ucccaaaacccuuacagugaagauguuuacucauugcccccaccucugguccacacuagaaaga

SEQ ID NO: 250227 - RNA, 64 nt, Human
caugucauuucucuauuucugugacgcgcccccaugcccccaccccaccacaagaggcaggagg

SEQ ID NO: 250228 - RNA, 64 nt, Human
uggagacgcuauguuuuuuugaauauaauuaacuugcccccaacucaaaauagcugucuguguu

SEQ ID NO: 250229 - RNA, 64 nt, Human
aaauuugucuuuucucauguccagaguucuauccugcccccacuguccacuguagggucauccg

SEQ ID NO: 250230 - RNA, 64 nt, Human
ggcagaaggaucaggugaccuucgcaacaaaguuugcccccaccucacauaggacccggaagca

SEQ ID NO: 250231 - RNA, 64 nt, Human
gucuuccaucagcagugauugaaguaucuguaccugcccccacucagcauuucggugcuucccu

SEQ ID NO: 250232 - RNA, 64 nt, Human
uuguuccuagaggagacagccugucucuccuuguugcccccaaagcccaugcccugccguggug

SEQ ID NO: 250233 - RNA, 64 nt, Human
ggcuccaguggcugcgauuaucggguucgguaaaugcccccacgugcuugugucucuuuccccc

SEQ ID NO: 250234 - RNA, 64 nt, Human
gauggacuuacuaagggaaaggugagaugaacacugcccccaaggagggggugaaauaugaucu

SEQ ID NO: 250235 - RNA, 64 nt, Human
uggcagaugggccaguccagggccuaccccgccuugcccccagaucccacugggguccauuugg

SEQ ID NO: 250236 - RNA, 64 nt, Human
ugccagcucugcugccaccucugacaggugugccugcccccaucucuucugauugcuguuaaca

SEQ ID NO: 250237 - RNA, 64 nt, Human
cacaccugccucuuccugcagccucacuucuaccugcccccaucauaagggcacugagcccuuc

SEQ ID NO: 250238 - RNA, 64 nt, Human
cuguccauaacugaaguauucacuacucuuguaaaccaaccaagaggaggagaaagaugaccca

SEQ ID NO: 250239 - RNA, 64 nt, Human
ucacauguacagcuuucuacuucuuuguaagaacaccaaccaaccaagguuuaagugauuaaua

SEQ ID NO: 250240 - RNA, 64 nt, Human
auauaaauuaaaaaggaaagaaaacuaacaaccaaccaaccaaccaaccaaccacaaaccaccc

SEQ ID NO: 250241 - RNA, 64 nt, Human
cuuaaacaguagugcacaaaauaugcugcuuacgugcccccagcccacugccuccaagucaggc

SEQ ID NO: 250242 - RNA, 64 nt, Human
gccauggggaacaccuccauugguguggccaagcugcccccauuccuauccaccccucucccca

SEQ ID NO: 250243 - RNA, 64 nt, Human
guaguaccaaucaaugucacaugaacaaacaagcugcccccaggguaccauuuggggaggggaa

SEQ ID NO: 250244 - RNA, 64 nt, Human
uugcuuugucuguguauuagcucuuuccauucuuugcccccagcaugaguuaacucgcguggac

SEQ ID NO: 250245 - RNA, 64 nt, Human
cccaggccucccuccugccccuccuccuaccggaugcccccagcacuccccucucaaaccaggu

SEQ ID NO: 250246 - RNA, 64 nt, Human
aacaaaguucaaaucggggcagaggcugcacuugugcccccagauguuucugaggagccagacu

SEQ ID NO: 250247 - RNA, 64 nt, Human
aucacgucagauuuggagcugguagcgcuuacgaugcccccacgugugaacaucugucuugguc

SEQ ID NO: 250248 - RNA, 64 nt, Human
cccucccaucuuaguucacaaagucagguugauuugcccccagcugucaaagcagacuaccugu

SEQ ID NO: 250249 - RNA, 64 nt, Human
cagagugagggaaugguaguuaaggcuucuuuuuugcccccagauacauggugaugguuagcau

SEQ ID NO: 250250 - RNA, 64 nt, Human
cguguuggggcgggcguuggguuuggggggacggugcccccagcccaggaucgggcacucagug

SEQ ID NO: 250251 - RNA, 64 nt, Human
gcaggcaggcagggcauagcgacagugugggaccugcccccagcuucugccacgcuuuaugccc

SEQ ID NO: 250252 - RNA, 52 nt, Human
cgggacccacggccgagugaucugcccccauuuuguacgcccgaguuuccga

SEQ ID NO: 250253 - RNA, 64 nt, Human
cagcuugggcccgagcccaagcauuuggcucugcugcccccaaggggacaggaagccucuuggg

SEQ ID NO: 250254 - RNA, 64 nt, Human
aguguaaacuuccguucauugcucuccagucacaugcccccacuuccccacaggugaaaguuuu

SEQ ID NO: 250255 - RNA, 64 nt, Human
guccuguuccuuguaggauguuuaguagcaucccugcccccaccuacuagaugccaggggcacu

SEQ ID NO: 250256 - RNA, 64 nt, Human
agggaacacacugagaugacuuagacucugguccaccaaccagacccuuggaaaggaauacuaa

SEQ ID NO: 250257 - RNA, 64 nt, Human
uuccgaaggagcuacgucuuaggugaaaguuaugaccaaccagauuaaacucuacccacauccu

SEQ ID NO: 250258 - RNA, 64 nt, Human
ccacaggagcuguaaaagucaugguugacugccuaccaaccauauuuguuagcagagccccucu

SEQ ID NO: 250259 - RNA, 64 nt, Human
gccacuaucacgaucaagauacaaauauuuucauugcccccaaaauucucauacccccuuuccc

SEQ ID NO: 250260 - RNA, 64 nt, Human
gaugcagcuggaaaagggucuugggaaauaugaaugcccccagcuggcccgugacagacuccug

SEQ ID NO: 250261 - RNA, 64 nt, Human
cccaggauggcaggccaccugacucucaccucugugcccccagcuuccggcucccucuucuccc

SEQ ID NO: 250262 - RNA, 64 nt, Human
uacgucuguaggguccccugaaaaucccacuuccugcccccagaaagggccuuuauuuccaacu

SEQ ID NO: 250263 - RNA, 64 nt, Human
guaaacaggcucaucucugaguucucaggacccuugcccccacccccauuuuuuuaaugaaaaa

SEQ ID NO: 250264 - RNA, 64 nt, Human
uuguuuuaauacggcaggcagcuucaccugcggcugcccccaugaccuagugcuaggcguggac

SEQ ID NO: 250265 - RNA, 64 nt, Human
gacacucuucugaauugacuguauuucagugagcugcccccaaaucaaguuuagugcccucauc

SEQ ID NO: 250266 - RNA, 64 nt, Human
augcuggaggaagugccaucugcauggccacucuugcccccaagggcccaggcuguggcugaca

SEQ ID NO: 250267 - RNA, 64 nt, Human
cuaggaaagagagaacaagcaagccggggcuaccugcccccagguggccaccaaguuguggaag

SEQ ID NO: 250268 - RNA, 64 nt, Human
agcagaaagacuggacggggaaaccuaucaauccugcccccagccauggugaggaagccccaag

SEQ ID NO: 250269 - RNA, 64 nt, Human
aagcauccagggcagaggaagccacaucucccggugcccccaaccccagcugcagccuccuccc

SEQ ID NO: 250270 - RNA, 64 nt, Human
gggagccuuugccaugguacuuagguagggugugugcccccagauuuaaccauuccauaaucau

SEQ ID NO: 250271 - RNA, 64 nt, Human
cacaaaguauggguuuggccauaagcucauaugcugcccccaaagacuggggagagcugugugc

SEQ ID NO: 250272 - RNA, 61 nt, Human
gccuccugcuaagacccugagcccugacaucugcccccagccccaacccucagaugcuuca

SEQ ID NO: 250273 - RNA, 64 nt, Human
gaggacaccagggugggggugaaggagacacuacugcccccaccccugacagcccccaccccau

SEQ ID NO: 250274 - RNA, 64 nt, Human
gugauuccaaugugcagacaaauuugaaaacugaaccaaccacaggaacaucaaguacacugug

SEQ ID NO: 250275 - RNA, 64 nt, Human
uuguugacugcaguuucggaaguuugaucugagaaccaaccauagaauguuucaguucuaggaa

SEQ ID NO: 250276 - RNA, 64 nt, Human
ucuuccuuuccugugcaccccacccuguaacagcaccaaccaccaggauuggacaucaccgagg

SEQ ID NO: 250277 - RNA, 64 nt, Human
aaggcagaagagacgucccgcuucugugauuuggugcccccauaucagacaaugaauuuggaag

SEQ ID NO: 250278 - RNA, 64 nt, Human
cacaccggugguaucuaccccagaugccugccucugcccccacucuggccuccucuuggcaucg

SEQ ID NO: 250279 - RNA, 64 nt, Human
gccaauucaccuaauuuuuauacugaaauguagaugcccccaacaugauuuuggaaagauauaa

SEQ ID NO: 250280 - RNA, 64 nt, Human
gagaacaggaggcucacaaaagaacgauuuucagugcccccagcaaggcugcacccuccuugau

SEQ ID NO: 250281 - RNA, 64 nt, Human
uugccuuucaaacuggaaaccccagagaaaacggugcccccaccugucgccccuauggacuccc

SEQ ID NO: 250282 - RNA, 64 nt, Human
ucacagccucacaccuuguccuuccaccccugccugcccccacccagccugcuucuuguccagc

SEQ ID NO: 250283 - RNA, 64 nt, Human
aagggugcagagccccuggcacagccaacccuguugcccccagugccgcugcccagcuucggcc

SEQ ID NO: 250284 - RNA, 64 nt, Human
uuacucaaagaguauauguucccuccaggucagcugcccccaaacccccuccuuacgcuuuguc

SEQ ID NO: 250285 - RNA, 64 nt, Human
cuguuugaaguagugccaggguccccugggaagaugcccccaagacaccugccccaagugggug

SEQ ID NO: 250286 - RNA, 64 nt, Human
uuaaaugcuuucauuuauugaaaaaaaaaaaaaaugcccccaaagcacuaugcuggucaugaac

SEQ ID NO: 250287 - RNA, 64 nt, Human
uuugaaugagggagcccuuuggggcaaauucaggugcccccauugccucaggcuggcccugguc

SEQ ID NO: 250288 - RNA, 64 nt, Human
ccagccagcggaacaguuucuauuacccccucccugcccccagacccaugugauuucugcuuuc

SEQ ID NO: 250289 - RNA, 64 nt, Human
gacuuaauuauuugccuuuugaaaucacuguaaaugcccccauccgguuccucuucuucccagg

SEQ ID NO: 250290 - RNA, 64 nt, Human
uuucggaugccaacuggcccacuccccaagcacuugcccccagcuugcgaccauuggcacuggg

SEQ ID NO: 250291 - RNA, 64 nt, Human
gguccccagggcauuuucauggcaaguaccccucugcccccacuccagcagugcuucccaaagu

SEQ ID NO: 250292 - RNA, 64 nt, Human
uccuaauaccauuuggagcuggacaacauuugacaccaaccaaucauacuggacaaggcccuua

SEQ ID NO: 250293 - RNA, 64 nt, Human
cccaagcaccaugucagugucguacaaucuaccaaccaaccagugcugaagagauuuuagaacc

SEQ ID NO: 250294 - RNA, 64 nt, Human
cccagacuuccgccgggucuaccugccuuaugucaccaaccagaccuaucaggaacgcaccuuc

SEQ ID NO: 250295 - RNA, 64 nt, Human
uuaaagcaguaguccacaaaguauucugcucaugugcccccaaaaguauuuugaaaaaucaugu

SEQ ID NO: 250296 - RNA, 64 nt, Human
ugccccauuguggaccacccacacugagaccaccugcccccaccucaguuauuguuuugauguc

SEQ ID NO: 250297 - RNA, 64 nt, Human
auacuuauuguuuggcaggucauccacacacuucugcccccacugcauugaauuuuuugcuuau

SEQ ID NO: 250298 - RNA, 64 nt, Human
auuuggugcauauuuugcaacauugagagaaaacugcccccaucucaagcaagaauggcguugg

SEQ ID NO: 250299 - RNA, 64 nt, Human
ccugugucccccacuuccacucaggaaauugggcugcccccaaccuggccacugaaugucucca

SEQ ID NO: 250300 - RNA, 64 nt, Human
uacuugaccaccccgucgagccccaucgggccgcugcccccaugcucgcgcugggcagggaccg

SEQ ID NO: 250301 - RNA, 64 nt, Human
auggugggcuuagccucuuugaaaaguucugccuugcccccacaggugggcacauccugugucu

SEQ ID NO: 250302 - RNA, 64 nt, Human
uucacagacacugaccucagaggccccacucuggugcccccagacccugggcccccagccucug

SEQ ID NO: 250303 - RNA, 64 nt, Human
agcucccccucccauagggcugcccaccaagcccugcccccagcccaagaggagcccccacugc

SEQ ID NO: 250304 - RNA, 64 nt, Human
auuuuguguuaaauuuuaguucccuguuguuuaaugcccccaaaauaugcagaccuuugggaau

SEQ ID NO: 250305 - RNA, 64 nt, Human
uccucaaaaucugcuucucggaucucccucagucugcccccagcccccaaacuccuccuggcua

SEQ ID NO: 250306 - RNA, 64 nt, Human
acuucaccaccggcacacagcuugccccugucuuugcccccaaagguauuuugugucuaguguc

SEQ ID NO: 250307 - RNA, 64 nt, Human
agcguuuccucuaacagggaccagcucuccgcuuugcccccacgggguuccucuaaccagaacc

SEQ ID NO: 250308 - RNA, 64 nt, Human
cgucuaaauugcugcucuggaauaaggugauuucugcccccagauucuucccuagccgguagau

SEQ ID NO: 250309 - RNA, 64 nt, Human
gaauucacucuaauuauaaacagggaguguaaacugcccccagauguuccugggcuggguaaaa

SEQ ID NO: 250310 - RNA, 64 nt, Human
uggaggagggaggcgugggaugggaauagcagaaaccaaccaugucuucagugauugaaacuca

SEQ ID NO: 250311 - RNA, 64 nt, Human
gugcuuggcacucaaggaucuuccaaaacagaggaccaaccagucuucugaaggucaugcccac

SEQ ID NO: 250312 - RNA, 64 nt, Human
gccgguggccuccagcagcaccacagagcuccagaccaaccaccccaagugccguuuggauggg

SEQ ID NO: 250313 - RNA, 64 nt, Human
acauauuuuuguaucaguauugaauuuuggacagugcccccauauaaggaaguuacuguuuuaa

SEQ ID NO: 250314 - RNA, 64 nt, Human
aaacucuuccguccuuaaugucuuccauggcuauugcccccacaauggucucuuuucucccugc

SEQ ID NO: 250315 - RNA, 64 nt, Human
ccuacugucugccaguacucaugugaguuguaugugcccccagugcuacauacgcagguaugcg

SEQ ID NO: 250316 - RNA, 64 nt, Human
ucagcauggggggcaguggggcacacguuagggcugcccccauuccagugguggaggcgcugug

SEQ ID NO: 250317 - RNA, 64 nt, Human
agccgggcgggggcucggggcucggccuccuaccugcccccaacccacccuccaccccgucccc

SEQ ID NO: 250318 - RNA, 64 nt, Human
cgggcgucucccgccuccaggaucuccucucaccugcccccauuaaagcucugccacucaugca

SEQ ID NO: 250319 - RNA, 64 nt, Human
gugauuccaaaaauguuucugagcccuggaccccugcccccaaaauauuuucaucuuuccccca

SEQ ID NO: 250320 - RNA, 64 nt, Human
gaaagcacuaggagcucuuuuggggguguaguggugcccccacaugaacaugauggacacccuu

SEQ ID NO: 250321 - RNA, 64 nt, Human
gcuucuacccucagugcaagaccagugccagaugugcccccacuuccugccuccugaagccuuc

SEQ ID NO: 250322 - RNA, 64 nt, Human
gcaaagaggacugagaauacuuuggcuuaaauuuugcccccagaaucuuguuguuugccuacug

SEQ ID NO: 250323 - RNA, 64 nt, Human
auagcuaguguuugauucacuagugcuuacaaauugcccccauguguaggggacacagaacccu

SEQ ID NO: 250324 - RNA, 64 nt, Human
ccuuucuccagcaagcacuguccucugggcaguuugcccccaucccucccagugcuggcuccag

SEQ ID NO: 250325 - RNA, 64 nt, Human
gccguuaggccucccagguccuuaggaucaggguugcccccagaaccccuucccauauccucca

SEQ ID NO: 250326 - RNA, 64 nt, Human
agccucucacagugcugauuuaccucccccaaaaugcccccaaacccccaugcaaguuuacagc

SEQ ID NO: 250327 - RNA, 64 nt, Human
agcuggggagguggggaagauucgggcaugugagugcccccagaacuguccuggcuccuuccgu

SEQ ID NO: 250328 - RNA, 64 nt, Human
uaaacaccagcacccgucuuuuccccaaccuaaaaccaaccaccagcauuucacuacaggacca

SEQ ID NO: 250329 - RNA, 64 nt, Human
cuggcucuccgugucugacgaccucaccagcgucaccaaccauggcuaccgcgugcagguggag

SEQ ID NO: 250330 - RNA, 64 nt, Human
gaugcaguagacagugcuaugcuguggauauaauaccaaccagaaauuggcauuuauaaaccug

SEQ ID NO: 250331 - RNA, 64 nt, Human
cagcucuguagaaagaauguguugccuccuaccuugcccccaaguucugauuuuuaauuucuau

SEQ ID NO: 250332 - RNA, 64 nt, Human
acagaagagccagccaagaucacccaggagcuugugcccccagaugggccaaagaaagagccua

SEQ ID NO: 250333 - RNA, 64 nt, Human
accacaggaagaugggagguggaagcagaggcccugcccccaccccuuccugucucacucuucu

SEQ ID NO: 250334 - RNA, 64 nt, Human
gaggcaccaaccucuccccgcagggcaaagccugugcccccaucaucucacuccuuugccugca

SEQ ID NO: 250335 - RNA, 64 nt, Human
uggcuccuuuccuuuggcagguuggggaagggcuugcccccagccuuaggauuucaggguuuga

SEQ ID NO: 250336 - RNA, 64 nt, Human
aaaccucucacucccaaguuucuuugaggccacuugcccccaagcacuucacaauagacccucg

SEQ ID NO: 250337 - RNA, 64 nt, Human
cuggcuggcaggagucaggccccagcagcccuccugcccccaaagcuuuccgagucuggugggc

SEQ ID NO: 250338 - RNA, 64 nt, Human
agcuaugauaugccacugcugccaacucauccucugcccccaccucgaaacccacaguccccag

SEQ ID NO: 250339 - RNA, 64 nt, Human
ggcuggccgguccaccccgucccggccccgcgcgugcccccagcguggggcuaacgggcgccuu

SEQ ID NO: 250340 - RNA, 64 nt, Human
cacagcacaugggagaagggcauuuggcaucugcugcccccagggucuuccucauccaccacuu

SEQ ID NO: 250341 - RNA, 64 nt, Human
cagucccuguacaucuaauauauacugauuuguuugcccccagagaauuuuuaagguaucugcc

SEQ ID NO: 250342 - RNA, 64 nt, Human
ggcuuuccagaugaccaggacgagugggauauuuugcccccaacuuggcucggcaugugaauuc

SEQ ID NO: 250343 - RNA, 64 nt, Human
ucucccacccagaucaacauccccccaaccccugugcccccaucaucuggaccccagagccagc

SEQ ID NO: 250344 - RNA, 64 nt, Human
gcaucuaucugucugccaccagcccaccccacccugcccccacccucacccacgcuucugcuca

SEQ ID NO: 250345 - RNA, 64 nt, Human
ucaacguaagugugccuuaauugcacagagguacugcccccacaccuccugacaccuccauaua

SEQ ID NO: 250346 - RNA, 64 nt, Human
agagccugagacuuggaggugccagaggccccccaccaaccagcccagccacuguugcuggcug

SEQ ID NO: 250347 - RNA, 64 nt, Human
ccccugccuccccuccaccugccccagugcccagaccaaccaaggcccugacagcccugccuuc

SEQ ID NO: 250348 - RNA, 64 nt, Human
uggugccaaauugcuggugucucucuuuggagaaaccaaccagauacaucugcuggagagccca

SEQ ID NO: 250349 - RNA, 64 nt, Human
ucagcaaagccugaagaaguggggcuggauacccugcccccaccauaucccuaccaucccuucu

SEQ ID NO: 250350 - RNA, 55 nt, Human
acuuggaacugcucagcuaggcaggugcccccaucccccccgcauucuggccuag

SEQ ID NO: 250351 - RNA, 64 nt, Human
ggggcuggcaaacuugacgaccccaacuccugccugcccccacugugacuccggugcuguuugc

SEQ ID NO: 250352 - RNA, 64 nt, Human
gucccaggaagggcuagggacaucggaggggaccugcccccacacccucugcucagccccugga

SEQ ID NO: 250353 - RNA, 64 nt, Human
agacacacucccaugacgcccacagcugccccuuugcccccagcucagucaagccgccacaugc

SEQ ID NO: 250354 - RNA, 64 nt, Human
ucguuuugcacacaacauucaaaacacuucauauugcccccacuuguugaaaaauaaauguagu

SEQ ID NO: 250355 - RNA, 64 nt, Human
agaccugcacagucacuagauuaauucauuaaaaugcccccacccugauguaauugacauuaca

SEQ ID NO: 250356 - RNA, 64 nt, Human
gaaaggcagcuucacccaguuuucuggacucucaugcccccaucuccgaccugggagacuucag

SEQ ID NO: 250357 - RNA, 64 nt, Human
ucucucucugucccggcagcccaggauggccuggugcccccaccugcugcagcaggagccccaa

SEQ ID NO: 250358 - RNA, 64 nt, Human
gcuccagagaacacaccagcuauuuaugagccucugcccccaggcugggccugucacuggcaua

SEQ ID NO: 250359 - RNA, 64 nt, Human
cucagggucugaagcagcugcugucucccuccucugcccccauccccuggcucuccccugggca

SEQ ID NO: 250360 - RNA, 64 nt, Human
cuugggaagccugaggcgggccucugccucucccugcccccagcacaauuggcagagaugaggc

SEQ ID NO: 250361 - RNA, 64 nt, Human
caaggcccugugccauagggguggccacccgaccugcccccagaacuuuuggauacuggaggca

SEQ ID NO: 250362 - RNA, 64 nt, Human
acacauggaagaauguuuaucggcugggcugcagugcccccacccucaccuucuccuggugcau

SEQ ID NO: 250363 - RNA, 64 nt, Human
auuuauugugagaauggcuacacuucuuuaggaaugcccccacuuacaaccagguggguggaac

SEQ ID NO: 250364 - RNA, 64 nt, Human
caccuaugccacuuuucucuucaaugccuuugacaccaaccaugauggcucggucaguuuugag

SEQ ID NO: 250365 - RNA, 64 nt, Human
ugccccccgguaugggaaccagcaccucccaccaaccaaccacacccggugggggcacagcaca

SEQ ID NO: 250366 - RNA, 64 nt, Human
ccgaugccccccgguaugggaaccagcaccucccaccaaccaaccacacccggugggggcacag

SEQ ID NO: 250367 - RNA, 64 nt, Human
aggacuccacugaugagagauccagccaaagagcugcccccagggguaugagggcaccagcugg

SEQ ID NO: 250368 - RNA, 64 nt, Human
aagacagaggcucuguggcgggggucccugagagugcccccacccaucucaugccccagggacc

SEQ ID NO: 250369 - RNA, 64 nt, Human
uuuuaaaaucugucacguagaacuuggauguaccugcccccaauccaugaaccaagaccauuga

SEQ ID NO: 250370 - RNA, 64 nt, Human
cuugucugucuuggaaagugugggcagccacagaugcccccaaaucagagcucacagugaguga

SEQ ID NO: 250371 - RNA, 64 nt, Human
uccagugcccucuccucgaugccucgcuccuuccugcccccacuccccuggcuuaggcagguag

SEQ ID NO: 250372 - RNA, 64 nt, Human
gccagagugccuacccacuguggccccggugcucugcccccacgccccgaccaucuggucuugg

SEQ ID NO: 250373 - RNA, 64 nt, Human
uuucagucauuccuuguaggauaugguuuagcugugcccccaccuaaaauaucaucuugaauug

SEQ ID NO: 250374 - RNA, 64 nt, Human
uauaacauguucccuuuuguuuuguaaauaaaugugcccccaaguuguuaauguuauauuaaaa

SEQ ID NO: 250375 - RNA, 64 nt, Human
caccugccaccugagaagauggaaaggaaggagcugcccccagagcaucaguccuugaagagca

SEQ ID NO: 250376 - RNA, 64 nt, Human
uuccuucugucucuuuagcugccagagacauuuaugcccccagcaccaauuacugcuccaguua

SEQ ID NO: 250377 - RNA, 64 nt, Human
guuuccuaaauacuggccuggccugugccgccccugcccccacuacucacaaguuucugagccc

SEQ ID NO: 250378 - RNA, 64 nt, Human
gcuccaccuuugcaaagaaaggaaaaacacaaauugcccccagauuggcccaguggcaugccau

SEQ ID NO: 250379 - RNA, 64 nt, Human
guaucccacguacucuaucuuccauuccucgcccugcccccagaggccaggagcucugcccuug

SEQ ID NO: 250380 - RNA, 64 nt, Human
cucucucauaugcccaacacgaccacugccucccugcccccacaccugcacccaaacagacaca

SEQ ID NO: 250381 - RNA, 64 nt, Human
cugacuaacaugcagaaucuacccaauaccacacugcccccauuaauggaauuaaauugggaaa

SEQ ID NO: 250382 - RNA, 64 nt, Human
ccgaugccccccaguaugggaaccagcaccucccaccaaccagccacacccggugggggcacag

SEQ ID NO: 250383 - RNA, 64 nt, Human
ccgaugccccccggugugggaaccagcaccucccaccaaccagccacacccagugggggcacag

SEQ ID NO: 250384 - RNA, 64 nt, Human
ggggggcccccgggugcagaaaacagcaccucccaccaaccagccacucccgguggggacacag

SEQ ID NO: 250385 - RNA, 64 nt, Human
ggggugggcugcucccagaaucugcucagcuuucugcccccaccaacacccuccaaccaggccu

SEQ ID NO: 250386 - RNA, 64 nt, Human
cugggcacagugcugccccuugcaagccauaacgugcccccagaguguagggggccuugcggaa

SEQ ID NO: 250387 - RNA, 64 nt, Human
gagucacaggggccaaaggccugagaccccacccugcccccaaacuggcuaagacagcuuucag

SEQ ID NO: 250388 - RNA, 64 nt, Human
gaggccucagcccuggggagggagggggcacuggugcccccagccucuccaacccccaaacugc

SEQ ID NO: 250389 - RNA, 64 nt, Human
ccaucuggccaagcuugaggaagauguguggccuugcccccaauuccaucagaccaaggcugca

SEQ ID NO: 250390 - RNA, 64 nt, Human
uccccagcaggcuccccacugucagccacacaccugcccccaucacaccaagccgaccucagag

SEQ ID NO: 250391 - RNA, 64 nt, Human
caagacccaggcaauuuugccccucuuucccacaugcccccauaugucugagccaaacugcacu

SEQ ID NO: 250392 - RNA, 64 nt, Human
gggcuagucggaggaucauaagcaagcucagaccugcccccaguucaguacuugaccacauccc

SEQ ID NO: 250393 - RNA, 64 nt, Human
gcaaugguaacugcaccugggcagcuccucccugugcccccagccucagcccaacuucuuaccc

SEQ ID NO: 250394 - RNA, 64 nt, Human
gaaagcaucacugccuuggccccucccucccggcugcccccaucaccucuacugucuccucccu

SEQ ID NO: 250395 - RNA, 64 nt, Human
aaacauugagccugcaggcuuugagugggaguguugcccccaggagccuuaucucagccaauua

SEQ ID NO: 250396 - RNA, 64 nt, Human
uauuggccagcaggaaagcaagcucuccagagaaugcccccaguuaaauaccuccucuaccuuu

SEQ ID NO: 250397 - RNA, 64 nt, Human
cccuagagcccucuccucccucugucccucuccuugcccccagugccucaccuuccaacacucc

SEQ ID NO: 250398 - RNA, 64 nt, Human
ugcagcccaugcuugaugccagcaacccagauccugcccccaaagccaagaagaucaagucuca

SEQ ID NO: 250399 - RNA, 64 nt, Human
ugugggcaagggcucagccucucugcccacagagugcccccacguggaacauucuggagcuggc

SEQ ID NO: 250400 - RNA, 64 nt, Human
ccaggaccucaacucggccaucacauaucgaauuaccaaccacucacacuuccggauggaggga

SEQ ID NO: 250401 - RNA, 64 nt, Human
cccagcacccucacucugagcccugacguccuccaccaaccacgggcuccaggaccccuuugcu

SEQ ID NO: 250402 - RNA, 64 nt, Human
cuccauuauccauucccaagaugccugaucagaaaccaaccaugaaugaaccccuggcuccuuc

SEQ ID NO: 250403 - RNA, 59 nt, Human
uugauggaccagacaaauaggaugauggcugcccccacacaauaaaugguaacauagga

SEQ ID NO: 250404 - RNA, 64 nt, Human
ccucccucugacuucugggcgccagauccugccgugcccccauccuggcuguuggggguguccu

SEQ ID NO: 250405 - RNA, 64 nt, Human
ugaccuggggcguaauaaagaugaccuggaccccugcccccacuaucuggaguuuuccaugcug

SEQ ID NO: 250406 - RNA, 64 nt, Human
uugcacccuaccuauggggccuggguuggcuuccugcccccagcugcagcuauccugacacagu

SEQ ID NO: 250407 - RNA, 64 nt, Human
cagccugggacccucugggcugcuguggcuccucugcccccacagauccuauccuccaagccag

SEQ ID NO: 250408 - RNA, 64 nt, Human
cccucccucucccaccucaucuucguguccuuccugcccccagcucaccccacucccuucugcc

SEQ ID NO: 250409 - RNA, 64 nt, Human
cuuggggaguacagggaaguaccugcagugacccugcccccaugaccuuggccaggcaggauga

SEQ ID NO: 250410 - RNA, 64 nt, Human
gaaggccugagugcaagcacccuugcuccuguacugcccccagcagcgcagucugggguauuuc

SEQ ID NO: 250411 - RNA, 64 nt, Human
acccuccguguguuagacucuuguccuucuguccugcccccacagcugcugcucacuuauccug

SEQ ID NO: 250412 - RNA, 64 nt, Human
gaagucaaguauucuuggcucuucuuucucccucugcccccauuuaagacaaugucacucaccc

SEQ ID NO: 250413 - RNA, 64 nt, Human
uucuuggccaugggaggccuuucccuaagccagcugcccccagagccacaguuccccuaugugg

SEQ ID NO: 250414 - RNA, 64 nt, Human
ccgcccuuagucccccaacucugagcccauguucugcccccagcccaaaggggacaggccucac

SEQ ID NO: 250415 - RNA, 64 nt, Human
cccaggaguccagccaggggcugccuccauguccugcccccaugagagcccuuucuuuucaagg

SEQ ID NO: 250416 - RNA, 64 nt, Human
auucugcuccccuagagaccucuuguacagaaguugcccccaggugguggggccccuccuugcc

SEQ ID NO: 250417 - RNA, 64 nt, Human
gauauguacaucucuuauuuucuuacauuauuuaugcccccaaauuauauuuauguauguaagu

SEQ ID NO: 250418 - RNA, 64 nt, Human
uaagaauugaaaagauggggcauucgucacagagagaguacaucugugaacaaguaaacucuac

SEQ ID NO: 250419 - RNA, 64 nt, Human
cuuccaccuccccacaggugagugacuggugggaagaguacaucuaccuucgaggcaggagccc

SEQ ID NO: 250420 - RNA, 64 nt, Human
gaugauuucccgucccaaggacucugugaaguuuagaguacaguuuguugggguccaaaagaca

SEQ ID NO: 250421 - RNA, 64 nt, Human
ucuucuagcugccggccucuggaggcuccgagccugcccccagagacgucccugccccuccagg

SEQ ID NO: 250422 - RNA, 64 nt, Human
cuucucugcaggccagcaagccugcagcagcaggugcccccacgucaggugcugacugucugcu

SEQ ID NO: 250423 - RNA, 64 nt, Human
gccauguuugauggggacagcuaccacuguccucugcccccauuccccuuucagcucccaugag

SEQ ID NO: 250424 - RNA, 64 nt, Human
cgacugccuucucugacauccccaccuuccucugugcccccauagcacuguguauaccgcuacu

SEQ ID NO: 250425 - RNA, 64 nt, Human
gcuguugacuuaucugcgcuuguuccaacucuuaugcccccaaccugcccuaccaccaccacgc

SEQ ID NO: 250426 - RNA, 64 nt, Human
aggugacugagauuguagggggggcauuuuugguugcccccaugcgugggggcacuacuaagaa

SEQ ID NO: 250427 - RNA, 64 nt, Human
cucccccccccccaccgugcccuccaucacgcccugcccccagggugguucauuucccagcccu

SEQ ID NO: 250428 - RNA, 64 nt, Human
ccccagccucuccugcucucucagaaccucccucugcccccaccccccaucugucucuuccucc

SEQ ID NO: 250429 - RNA, 64 nt, Human
uggcugggcugaccgcaaaaggugccuuacacacugcccccacccucagccguugccccaucag

SEQ ID NO: 250430 - RNA, 64 nt, Human
ugggaaagagucacacuccugacccuuaguacucugcccccaccucucuuuacugugggaaaac

SEQ ID NO: 250431 - RNA, 64 nt, Human
aucugugauuauuuucuuaaugacaauguacauaugcccccauccauguuaauuauuaucuaau

SEQ ID NO: 250432 - RNA, 64 nt, Human
gcuccucuccugggccccugcucuucccgagagcugcccccaaaucagacauaccucuguggcu

SEQ ID NO: 250433 - RNA, 64 nt, Human
uuguguuuuagggugaaacuuaaaaaaaaaauucugcccccaccuagaucauauuuaaagaucu

SEQ ID NO: 250434 - RNA, 64 nt, Human
cuccuccccucuucucuuuugcccccucccuuccugcccccagucuggguuacucuucgcuucu

SEQ ID NO: 250435 - RNA, 64 nt, Human
gauguggaaaugagguugggggaaccagcagaaaugcccccauucucccagucucugucgugga

SEQ ID NO: 250436 - RNA, 64 nt, Human
ucuaugacccagcauggguuagugcuauggugggagaguacauugaaggccuggaauuagcuug

SEQ ID NO: 250437 - RNA, 64 nt, Human
aggucuaaccccagauaaauagccaacaggguguagaguacauuuuacaccccaaagagugugc

SEQ ID NO: 250438 - RNA, 64 nt, Human
uuuuccugccacagaagcuuuaaauuuuccccuaagaguacaaagccaagagagugugguuuau

SEQ ID NO: 250439 - RNA, 64 nt, Human
uccucucccaacucaagguucuagugggaaggggugcccccaggcucucauguuccuggcguga

SEQ ID NO: 250440 - RNA, 64 nt, Human
cugucucacuccuugccccacacacacuugucccugcccccacccuucugaguccuuccuggau

SEQ ID NO: 250441 - RNA, 64 nt, Human
acauuaccagguuauaaaacauaacucacaccccugcccccaccccaugcccccacccuccccu

SEQ ID NO: 250442 - RNA, 64 nt, Human
auaaaacauaacucacaccccugcccccaccccaugcccccacccuccccucacacacaaauug

SEQ ID NO: 250443 - RNA, 64 nt, Human
gcgcggugccccuuccucuccucaggcuccuccuugcccccaccuugccccaggaaaggccaaa

SEQ ID NO: 250444 - RNA, 64 nt, Human
uuguuuuucaaggacaaggacuuugauuuauuucugcccccacccugguacugccuggugccug

SEQ ID NO: 250445 - RNA, 64 nt, Human
ucccccacagacccuaccccaagaccccuagcccugcccccauccccccaagcccuagagcucc

SEQ ID NO: 250446 - RNA, 64 nt, Human
gacuagucccuucugggguaucagagccuuagggugcccccauccccuuccccagucaacugug

SEQ ID NO: 250447 - RNA, 64 nt, Human
accuaggaccgccagcagagcggggggaucucccugcccccaccccaguuccccaacccacucc

SEQ ID NO: 250448 - RNA, 64 nt, Human
ucccugggaagguccagcuaaaaguggcaacauuugcccccagaauugggggccugggaacacu

SEQ ID NO: 250449 - RNA, 64 nt, Human
ggaccccuuggcauagggcccugccccgucggacugcccccagaaagccuccugcccccugcca

SEQ ID NO: 250450 - RNA, 64 nt, Human
uaauguguauauuuaauuucuucaaguucuuaccugcccccauccuuuuuuguauaugaugugu

SEQ ID NO: 250451 - RNA, 64 nt, Human
aguuacauggacucuuuucugucuccugggucccugcccccaccacucuggguuccauuugugg

SEQ ID NO: 250452 - RNA, 64 nt, Human
acuuaucccaaaacuuuaguggcuuaaaaaaaccugcccccaacuguuagucaaucugagcugg

SEQ ID NO: 250453 - RNA, 64 nt, Human
ugaacucaugcacgcacacccacgugccuguacuugcccccaggcuggaagagaagagacagaa

SEQ ID NO: 250454 - RNA, 64 nt, Human
uuccauguaaaggaggggagagugcucagaguccagaguacaaauccaagccuaucauuguagu

SEQ ID NO: 250455 - RNA, 64 nt, Human
cuucucucgcgcgccuauugauuuguuucugaggagaguacaccguucacuauuguagaguaac

SEQ ID NO: 250456 - RNA, 64 nt, Human
ugcucccuucugcuuuagaagugacuagguacugagaguacaaacacucccacuuuauaaugaa

SEQ ID NO: 250457 - RNA, 64 nt, Human
aagcccuuggaauuuucuggcacuuccucucuauugcccccaccaccaccacccccaucacugc

SEQ ID NO: 250458 - RNA, 64 nt, Human
cuaacuggugugagucaaaugcccccugagugacugcccccagcccaggccagaagaccucccu

SEQ ID NO: 250459 - RNA, 64 nt, Human
ucuguaggucccuggugcuuccaguacugcacuuugcccccaaggucuuugacuucauuuccug

SEQ ID NO: 250460 - RNA, 64 nt, Human
gcugggguccuacccagccuggaucugagcucugugcccccagccggguuguucccagccugag

SEQ ID NO: 250461 - RNA, 64 nt, Human
ccucccaguaggcaguagucagaacuggaugggcugcccccagccagcucccagcagcuucucc

SEQ ID NO: 250462 - RNA, 64 nt, Human
cccagagaagaaccagcuccacggcuccugcuucugcccccaggguucgugggcucugggcuug

SEQ ID NO: 250463 - RNA, 64 nt, Human
aggauguuuccccaaggccagcuacaagccccucugcccccaugccuuucuugggccuucacua

SEQ ID NO: 250464 - RNA, 64 nt, Human
cccaaagauggggugaccccagggucagggaggcugcccccaggccuguauauuuaaccccuau

SEQ ID NO: 250465 - RNA, 64 nt, Human
aaacucuguugcaagugcaauaaaucugacccagugcccccacugaccagaacuagaaucugug

SEQ ID NO: 250466 - RNA, 64 nt, Human
uucuuugagaaaggauuaagauacacuccugcugugcccccaucuuuccuccaaacuccugccu

SEQ ID NO: 250467 - RNA, 64 nt, Human
gccuuccaggagguggcuuuguuccgugccucccugcccccaucgucacuaccaggucugguac

SEQ ID NO: 250468 - RNA, 64 nt, Human
ugaggcccagggccugagcucucuuccccagcauugcccccacccggaaaccccaccuuuggag

SEQ ID NO: 250469 - RNA, 64 nt, Human
cuggcuccccuacuaacgucccccucuucgcccuugcccccauccccacccgccccucucccgg

SEQ ID NO: 250470 - RNA, 64 nt, Human
gcccccaacuccccgggcccggccccugcccugcugcccccaacagcgucuggcuccccuacua

SEQ ID NO: 250471 - RNA, 64 nt, Human
cccuccccugcagcgacucggacccgcuacugccugcccccaacuccccgggcccggccccugc

SEQ ID NO: 250472 - RNA, 51 nt, Human
acauugaucaagauuuguaggaccaaccaaccuaagagcaauaaauguuuu

SEQ ID NO: 250473 - RNA, 64 nt, Human
cuugucauuuucaguacauauuuuacuauuccacaccaaccauaauuacaacaagggauuuuuc

SEQ ID NO: 250474 - RNA, 64 nt, Human
accauguaaauccaaaucucugcaauccuguggcaccaaccaguggugcucauucuauuguuua

SEQ ID NO: 250475 - RNA, 64 nt, Human
uucuuuguauguauuucugauguguucucugaucugcccccacuguccugugaggacagcugag

SEQ ID NO: 250476 - RNA, 64 nt, Human
gaggggcuggccaggucuggaggggccucaggggugcccccagcccggcacccagcgcuuucgc

SEQ ID NO: 250477 - RNA, 64 nt, Human
cuggccgaaguggccgcaggcugugcccccgagcugcccccacccccucacagggucccucaga

SEQ ID NO: 250478 - RNA, 64 nt, Human
acaauucagaagcaucaccaugcaugguggcgaaugcccccaaacucucccccaaauguauuuc

SEQ ID NO: 250479 - RNA, 64 nt, Human
cucagccucccacguggcugggauuacaggugccugcccccauggcuaauuuuuuguauuuuuu

SEQ ID NO: 250480 - RNA, 64 nt, Human
uauuuauggcacgauuccuuuggauggcuucauuugcccccagacuguaugaaaacaucuccga

SEQ ID NO: 250481 - RNA, 64 nt, Human
gccugauaaauugagggcacuuguacccucccugugcccccagaagguucuuggagagaagugc

SEQ ID NO: 250482 - RNA, 64 nt, Human
uauuauaagcaugacauguuuacuauaaaccuuuugcccccauaauuucuuuuuuuaaaggaaa

SEQ ID NO: 250483 - RNA, 64 nt, Human
cuaaaucccagaaaagaggaagacagauuuaaagugcccccacccccauuuguuucaaagaggu

SEQ ID NO: 250484 - RNA, 64 nt, Human
caaaguugucacagguuuuuguuguuguuuuuauugcccccaaaauuacauguuaauuuccauu

SEQ ID NO: 250485 - RNA, 64 nt, Human
uaaccuggacaccuuuugaggaauauucucagauugcccccaugcuguuuauaagacauuguuc

SEQ ID NO: 250486 - RNA, 64 nt, Human
gaggauggacugggcccgcagaugcccugaccucugcccccagguagcaggacacuccauugga

SEQ ID NO: 250487 - RNA, 64 nt, Human
cuccaugcccaucagucucugcaguuucucuaccugcccccagagcugaggccaucugcaagcc

SEQ ID NO: 250488 - RNA, 64 nt, Human
gcugcuugugaccuugacuugccaugaaggcaccugcccccacagcuccuugcaaacuaugagu

SEQ ID NO: 250489 - RNA, 64 nt, Human
gaggauggaacucagaaugaaacugcaacccaccugcccccagcccugccccucgcccugaugc

SEQ ID NO: 250490 - RNA, 64 nt, Human
gagaauaaagacgucuccucaggacccucccaggagaguacauggcauugagacaucuggcggc

SEQ ID NO: 250491 - RNA, 64 nt, Human
gugauaauggccaaaagugguucucucucauuaaaccaaccaguaaaagcguauccuauuuuuu

SEQ ID NO: 250492 - RNA, 64 nt, Human
uucugcauuauuuauauucaacugacagacaaaaaccaaccaacgacaaaacaaaaacccccaa

SEQ ID NO: 250493 - RNA, 64 nt, Human
cgaagcuggagaggggcgugcugcggggcccugaugcccccacccaccucgguccagcgcggcc

SEQ ID NO: 250494 - RNA, 64 nt, Human
gcacacuuguaucuuuuaccuucccuuugccccaugcccccaaacugcuuaggucuucucuguc

SEQ ID NO: 250495 - RNA, 64 nt, Human
caccccugcaccagagccugcucuuagcucccggugcccccagaccccgcagcucugugcccgg

SEQ ID NO: 250496 - RNA, 64 nt, Human
uuugagcgcgggauauggcuugcccuuguccgugugcccccaggacuuugccucuacagcauuu

SEQ ID NO: 250497 - RNA, 64 nt, Human
ugcagaguccugcagagccucugggcugggcuggugcccccaggagauggagggccugguggau

SEQ ID NO: 250498 - RNA, 64 nt, Human
ccgccuccauuccuacuaaggggcucugagcuucugcccccagaaucauuccaaccgacccacu

SEQ ID NO: 250499 - RNA, 64 nt, Human
uguucacuaucaguggucguguaccuucuccaccugcccccaggaaaaagagucucccccuuaa

SEQ ID NO: 250500 - RNA, 64 nt, Human
gcuggcacuacaccuucguaacugcuguucccacugcccccacaacacuccaaucuccaccuuc

SEQ ID NO: 250501 - RNA, 64 nt, Human
gcucaaguccaagggguagucugccuucccaggcugcccccaggguuucugcacugguccccuc

SEQ ID NO: 250502 - RNA, 64 nt, Human
ucaguuguuaacuucuacauucaaggcuuaucucugcccccauugauuuuuaaccucaaaaugg

SEQ ID NO: 250503 - RNA, 64 nt, Human
aagugcucuguguucucagucuucccuuuuuuucugcccccauucuuacuuugucccaggcaug

SEQ ID NO: 250504 - RNA, 64 nt, Human
auccuccucccugucuggugucuggucugucgacugcccccagcugcugucuaaagcaugcgca

SEQ ID NO: 250505 - RNA, 64 nt, Human
ugucacccagagcccgaugaggggugccagcaggugcccccacgaguggggccuuggcccaagc

SEQ ID NO: 250506 - RNA, 64 nt, Human
gccccucugccuaugucccucugccuccuccccaugcccccaguugcuguggcuugauucugcu

SEQ ID NO: 250507 - RNA, 64 nt, Human
cccuucggaccugcccugccaguggagccagcagugcccccagcacuguccccaccuugcuagg

SEQ ID NO: 250508 - RNA, 64 nt, Human
aauguauuucaucucauguuuucuuauugucacaagaguacaguuaaugcugcgugcugcugaa

SEQ ID NO: 250509 - RNA, 64 nt, Human
ucccgccccuccuguccucuguguucccgcggaaaccaaccaaaccgugcgcugugacccauug

SEQ ID NO: 250510 - RNA, 64 nt, Human
cauggaaaaauugucuccuaauuuggggagaugaaccaaccaaucaaugacaagaaaacgcuua

SEQ ID NO: 250511 - RNA, 64 nt, Human
accugcccugcggaccguggaaaauaaaaggcucugcccccagugugagugugaccgguuguac

SEQ ID NO: 250512 - RNA, 50 nt, Human
cccaggagagccgccucugaugcccccaucccacugggacauuuagcaag

SEQ ID NO: 250513 - RNA, 64 nt, Human
accugccacauuuauaaaauaaugguuuuaucccugcccccaaaucaucagguuccucggguuu

SEQ ID NO: 250514 - RNA, 64 nt, Human
aacucuuucccuauaggaaacuuacuccgcguccugcccccaccuccuaaauaaauaaaggaau

SEQ ID NO: 250515 - RNA, 64 nt, Human
ggguggauauccaaaccaaaaagaagaaaacagaugcccccagaaggggccagugcgggcagcc

SEQ ID NO: 250516 - RNA, 64 nt, Human
aucagcccguuagcuguaacuuggagcuccacucugcccccagaaaggggcugcccuggggugu

SEQ ID NO: 250517 - RNA, 64 nt, Human
uguaguacuuuuguguaaaacuugucuuccccuuugcccccaacuuuuuuuuuuuuuuuuuugu

SEQ ID NO: 250518 - RNA, 64 nt, Human
gcaugugcccaagaggggccuccccgcaggcacuugcccccacugugcccaggagcucucuagg

SEQ ID NO: 250519 - RNA, 64 nt, Human
ggaggcccaccucaaggagugcgagcacaucaaaugcccccacuccaaguacgggugagugggg

SEQ ID NO: 250520 - RNA, 64 nt, Human
ugcuggccuccagucccaucucccccaacacaugugcccccaaaaagugagccaggcaccucug

SEQ ID NO: 250521 - RNA, 64 nt, Human
guugggcagccuagagguguugggaacccuggccugcccccaccuccccaguaauuguuuccuu

SEQ ID NO: 250522 - RNA, 64 nt, Human
ccacuccggggccugugccgccagaaccgggcucugcccccauacgcugcccucgcagccuggc

SEQ ID NO: 250523 - RNA, 64 nt, Human
gaccaccagccauggucuaaggacauggaucgggugcccccagacgugugcacaggggacccuc

SEQ ID NO: 250524 - RNA, 64 nt, Human
gcccagggcgcugggucugguggggacgcgggggugcccccaauggugcagcugcagcagucac

SEQ ID NO: 250525 - RNA, 64 nt, Human
uaaccacgccuauuaagcggagguguucccaggcugcccccaacacuccaggcccugcccccuc

SEQ ID NO: 250526 - RNA, 64 nt, Human
ugaggagaagcaaaauggcacagggcuaguugccaccaaccaauuuacugaugaaugaagccca

SEQ ID NO: 250527 - RNA, 64 nt, Human
gcuuugugagcagagcuccuuccccucuccccgggaacggcagggcacugggaccucuggucgg

SEQ ID NO: 250528 - RNA, 64 nt, Human
ccaggggccuccaagcauaggauuuggaagacaggaacggcacaggcguccaggaaagcagcug

SEQ ID NO: 250529 - RNA, 64 nt, Human
agccccgguucccccaacauguucccguucacucugcccccacccccaaaggcucagccucuaa

SEQ ID NO: 250530 - RNA, 64 nt, Human
uuaauggcucaguccccuucaccccauuuccaagugcccccaggacuccugggcccugcuuccc

SEQ ID NO: 250531 - RNA, 64 nt, Human
ggggacucuggaacaccauggacccugggggcugugcccccaucuccuccccaccccaggucua

SEQ ID NO: 250532 - RNA, 64 nt, Human
gugggcuucagggcgcacagcaugagaggcucugugcccccaucacccucguuuccagugaauu

SEQ ID NO: 250533 - RNA, 64 nt, Human
gguugucggggguguggggcugcccuggggcccgugcccccaccaggccagccccugcuggguu

SEQ ID NO: 250534 - RNA, 64 nt, Human
ugggcaugagggguuccuccccuccagcucccugugcccccaggguccugggaggagagacacu

SEQ ID NO: 250535 - RNA, 64 nt, Human
gcagggguagcugaguuccuggagaccccuuuuuugcccccagguuccccagagggcaacgcca

SEQ ID NO: 250536 - RNA, 64 nt, Human
ugggggaccaugugccucuaggcagugacuagggugcccccaccccucaggaagaacacaggug

SEQ ID NO: 250537 - RNA, 64 nt, Human
aggagcauucaagcucuggauugggcagcagaugugcccccagucccgcaggcuguguuccagg

SEQ ID NO: 250538 - RNA, 64 nt, Human
gacggcugcauuggauuguacaacuguuuugugaugcccccagacacugucauccugggccgag

SEQ ID NO: 250539 - RNA, 64 nt, Human
uguuucccuguuguuaagugaaggaggccgccccugcccccaccugagaaggcagagcaguguc

SEQ ID NO: 250540 - RNA, 64 nt, Human
ugcgcuacugcuuaccuccuccacucccccugccugcccccagcaucuggacaagcuaauagca

SEQ ID NO: 250541 - RNA, 64 nt, Human
ccuguccccacagucagccuccugucccugcuggugcccccacacccaccuacccugugcuuuu

SEQ ID NO: 250542 - RNA, 64 nt, Human
gacuuccucccacugucugcccugaacccacugcugcccccagaaaaaggccgggugacaccgg

SEQ ID NO: 250543 - RNA, 64 nt, Human
ggggucccuccaagugguccacaagcuucuguccugcccccaaggaggcagccuggaccacucc

SEQ ID NO: 250544 - RNA, 64 nt, Human
aaacaaaagcaauugugaaaauguguuuacuucagaacggcacuacauaaaugugaaaaguugu

SEQ ID NO: 250545 - RNA, 64 nt, Human
aaggccgaauccaaguuucaugugguaggacagagaacggcaaucuacaaaacuacaccaagcc

SEQ ID NO: 250546 - RNA, 64 nt, Human
aaaauaacagguuaugaggaaaugagcgauauaugaacggcauaaaaacagaaauuacccagua

SEQ ID NO: 250547 - RNA, 64 nt, Human
ccaggaugggcugcuccugggccuggugagcuacugcccccaaccuacccucuagaggggcugg

SEQ ID NO: 250548 - RNA, 64 nt, Human
caaaucgccaccugugccuuuccucuggcccugcugcccccacacccaacuccgagggcccacg

SEQ ID NO: 250549 - RNA, 64 nt, Human
ucugguacaacuggcauucaaaucuaggucagucugcccccagagccacuacccuuaccccuca

SEQ ID NO: 250550 - RNA, 64 nt, Human
cugcugugcugccuccugggcuccagcccuccccugcccccagcccguccccugcccagggcac

SEQ ID NO: 250551 - RNA, 64 nt, Human
gcacgaguguguugcacguuuacacagggugggcugcccccacccugcacuaccuauuuuugug

SEQ ID NO: 250552 - RNA, 64 nt, Human
gguggaacccaauguuuacauucucuucugucucugcccccaccccaugcagcgcuuugaggaa

SEQ ID NO: 250553 - RNA, 64 nt, Human
uacauagcagcccuucagauaaucacaaccacuuugcccccaaguuuucagguuaaguagcaug

SEQ ID NO: 250554 - RNA, 64 nt, Human
ccuugagugggucccccccuacccaucuagcuguugcccccaugguaagaucaagaaaaugccc

SEQ ID NO: 250555 - RNA, 64 nt, Human
gagccuggagaaagggagcaagcugcccccuccuugcccccaaggaugaggcuggacugaggca

SEQ ID NO: 250556 - RNA, 64 nt, Human
acugcagugaaguaaaacaggaaucaaucuugccugcccccagcucacacucagcgugggaccc

SEQ ID NO: 250557 - RNA, 64 nt, Human
ggaugagggaaaagaaaaagauugagagaauuugugcccccaaccauuuccucagacucuaaga

SEQ ID NO: 250558 - RNA, 64 nt, Human
agcccaagggucagcccucuugacugucacaugcugcccccacccagccuaaaauaaagagcuc

SEQ ID NO: 250559 - RNA, 64 nt, Human
ggcccaggagcucggacugcugguccuggagagcugcccccagaagaagcuggagugcauaggu

SEQ ID NO: 250560 - RNA, 64 nt, Human
guguaugcgggggugccaggaagggcauagcuccugcccccaggccuaggcaugcugcuugcuc

SEQ ID NO: 250561 - RNA, 64 nt, Human
accucacaccaacaccucccauuaucacucucucugcccccauuccuucaagaggagacccuuu

SEQ ID NO: 250562 - RNA, 64 nt, Human
gcuucuuuuauugguuuccaaagaaacaaaccaaaccaaccagcucuuggaugugaagauaaaa

SEQ ID NO: 250563 - RNA, 63 nt, Human
gcuacccuagggaagagccggugacgugcacaggccgagcagcacggcuggugagcugcaggc

SEQ ID NO: 250564 - RNA, 64 nt, Human
gaccugcccccuccucaggcaucugggagggcccugcccccaugggcuuuacccuucccugcgg

SEQ ID NO: 250565 - RNA, 64 nt, Human
ggacuauuccaccuccuuccccugagcccagaucugcccccaccauccuuucucuggcuucuuu

SEQ ID NO: 250566 - RNA, 64 nt, Human
aaggacuugaagcccggcaucuuccgaccugcccugcccccaccccugccugagcggaguccua

SEQ ID NO: 250567 - RNA, 64 nt, Human
cuguuugcacuuaucugaaaucuucccucuuggcugcccccagguauuuacuguggagaacauu

SEQ ID NO: 250568 - RNA, 64 nt, Human
augauaaaagaaacgaaucaccagugucugucagugcccccacugcuccuccucauaccagcau

SEQ ID NO: 250569 - RNA, 64 nt, Human
ccuguuuuucuggguggccucgggacaccugcccugcccccacgagggucaggacugugacucu

SEQ ID NO: 250570 - RNA, 64 nt, Human
ccuuucuaccgaccaugugaccccgcaccagcccugcccccaccugcccucccgggcaguacug

SEQ ID NO: 250571 - RNA, 64 nt, Human
ccccacugugaaggggcuggccaggggcccgagcugcccccacccccggccucagccaccagca

SEQ ID NO: 250572 - RNA, 64 nt, Human
uggcacccaccgucucggcccugaaccacgaggcugcccccauccagccacggagggaggcacc

SEQ ID NO: 250573 - RNA, 64 nt, Human
uugccacagcucaacucgggggcgccuggagggaugcccccaggcagccaccaguggaccuagc

SEQ ID NO: 250574 - RNA, 64 nt, Human
aaaaaaaaagaauaaugacccggcccccgcccucugcccccagcugcuccucgcaguucgguua

SEQ ID NO: 250575 - RNA, 64 nt, Human
uccaccacucaccucuugguuagcgggagugugcugcccccacccccacccccgcacccccauu

SEQ ID NO: 250576 - RNA, 64 nt, Human
cauagaucuaaggggcaaacagauacuaguuaacugcccccaccucugucucccugucuucuuu

SEQ ID NO: 250577 - RNA, 64 nt, Human
cuucuguguauauaguuaguuuuauaacccugaaugcccccacccuuccccuaagcacacaggg

SEQ ID NO: 250578 - RNA, 64 nt, Human
auuguuuugucucagcuauuuuguagcagacucgugcccccauuagugugccucuuuggaaauu

SEQ ID NO: 250579 - RNA, 64 nt, Human
gaacccugugagccugagacagagagggccaggcaccaaccacaaggcgggaaaguccaugggu

SEQ ID NO: 250580 - RNA, 63 nt, Human
aacaguccaggacagcugcauggcacccggcgggccgagcaugccauggguccgcucugcaug

SEQ ID NO: 250581 - RNA, 63 nt, Human
aaagugcuaagaacaggaauccucuuggugggggccgagcagggggcaaggagcccaggcccc

SEQ ID NO: 250582 - RNA, 64 nt, Human
gaggauugggaaaccccacugucagcucugcaucugcccccacuacccuccucugcccuauucu

SEQ ID NO: 250583 - RNA, 64 nt, Human
acagccucagcucaugucuggcugugacacacacugcccccagcuucccuuggucagccccacu

SEQ ID NO: 250584 - RNA, 64 nt, Human
uagugaugaugucaucguccaucccaucuuccuuugcccccaggaaaggacgcauccaccggua

SEQ ID NO: 250585 - RNA, 64 nt, Human
ccucucucuuuugcccugcucuccacaccagaaaugcccccaggugcuuggcugccucagaggu

SEQ ID NO: 250586 - RNA, 64 nt, Human
accaagcuuggccucugacucccgucucugugcuugcccccaucucagggaccaugaugucuca

SEQ ID NO: 250587 - RNA, 64 nt, Human
gauguagacgccacccugcccacccccgggauccugcccccaagucauuuccguccccccccag

SEQ ID NO: 250588 - RNA, 64 nt, Human
guugguuggcagcaaggcugauccagaccccuucugcccccacugcccucauccaggccucuga

SEQ ID NO: 250589 - RNA, 64 nt, Human
cguccgccuggcccaccaacccgcccaccuugacugcccccagaagugugucuugagaccuccu

SEQ ID NO: 250590 - RNA, 64 nt, Human
caggugugaccaucucucgugccugccaccucuuugcccccaggcuuuuuugcugugagggagc

SEQ ID NO: 250591 - RNA, 64 nt, Human
caggggacuccgcagcgggccccugccuuccacaugcccccaccauuuuucuuugccgguuugc

SEQ ID NO: 250592 - RNA, 64 nt, Human
cgagcccuugcuccuuaggauccccgcccccaccugcccccaaugcacacacagacccaccggg

SEQ ID NO: 250593 - RNA, 64 nt, Human
cagccagcucuuaccuccuccugguugcuuuucuugcccccaccccaaguuuauuuuuguuuuc

SEQ ID NO: 250594 - RNA, 64 nt, Human
ccaguguccccugccccccucuucccccaccccaugcccccaauucuguggcgcauccagauug

SEQ ID NO: 250595 - RNA, 64 nt, Human
auccuucccccagcugcuuccucggggaggccccugcccccacccugccagcccuucccagucu

SEQ ID NO: 250596 - RNA, 64 nt, Human
cagagggguagcugggaucaugcuagucacuuccugcccccaggcaccgugccaaagacuggau

SEQ ID NO: 250597 - RNA, 64 nt, Human
gccccauucuaggacucuggggaucccaaacccuagaguacacacgucccaaacuccccugugc

SEQ ID NO: 250598 - RNA, 63 nt, Human
cggccccaccgaggccugagcacguucccgggugccgagcacugccuccgggcuucccccaag

SEQ ID NO: 250599 - RNA, 63 nt, Human
gacggugucugaccggaggauguggccgugcccgccgagcacucuugaucugagcugaccugu

SEQ ID NO: 250600 - RNA, 64 nt, Human
guguccugagcccgugucauucuuccaaccucccugcccccacacacuuaucccagacacaaca

SEQ ID NO: 250601 - RNA, 64 nt, Human
ugaggaguuagguucaucacaaauacacacacacugcccccaacccucugccguugccucucuc

SEQ ID NO: 250602 - RNA, 64 nt, Human
ucucccugugccuggagaguuacagccagcaaggugcccccaucuuagagugugguguccaaac

SEQ ID NO: 250603 - RNA, 64 nt, Human
gcccucccuuccccccucccugucugguguccugugcccccaucugucugucuauauuugucug

SEQ ID NO: 250604 - RNA, 64 nt, Human
agcuuggcgaccgccucaguguggagcuggacacugcccccacccuugaccucaacaggguccu

SEQ ID NO: 250605 - RNA, 58 nt, Human
gcaggaccuccuccugcugagaccccaaugcccccacagagcaauacacugaagccua

SEQ ID NO: 250606 - RNA, 64 nt, Human
cuaaaguuucucagagccugucacaaaggccggcugcccccaaaggucucaacuccucaucauu

SEQ ID NO: 250607 - RNA, 64 nt, Human
ccucagcuucccaucucugcccgcuugcuuccccugcccccaaccccugccuccucuauccccc

SEQ ID NO: 250608 - RNA, 64 nt, Human
cugggggcugggcuggggguuagggcugggacugugcccccacacugcgccucagcuucccauc

SEQ ID NO: 250609 - RNA, 64 nt, Human
caaagaggaaagauugaauccuaaaggggaucccugcccccaugggaggcccccuacuagaagg

SEQ ID NO: 250610 - RNA, 64 nt, Human
gacagggagggucagagggaggccggcugcuuccugcccccacccuuuccccgggccugcugug

SEQ ID NO: 250611 - RNA, 64 nt, Human
gggucacucugggcaaagagaagguccucagccaugcccccagcaccuugcacauaggugucug

SEQ ID NO: 250612 - RNA, 64 nt, Human
ggaacagggcuggggcuggguuggaacaggugugugcccccaccacagcucuaugacucuguuc

SEQ ID NO: 250613 - RNA, 64 nt, Human
auagacuauacacaugggguggaaaggccaggccugcccccaucucguugguguggcucugcgu

SEQ ID NO: 250614 - RNA, 64 nt, Human
ugggacaaaauguuaaguaauuugcaguauguagugcccccaguauugggauuuuugagcuaau

SEQ ID NO: 250615 - RNA, 64 nt, Human
cacaaaaggucacacaagccaaccaugucaugccagaguacaaaacacauaguucuuuccccgc

SEQ ID NO: 250616 - RNA, 64 nt, Human
cagugguguacuguuauacuucagagaaaggguaagaguacaucuaguucaguuccuaugaggu

SEQ ID NO: 250617 - RNA, 64 nt, Human
agguuagugacaguuauuccugaaauacaggagcagaguacagucuguugugguuucccggauu

SEQ ID NO: 250618 - RNA, 64 nt, Human
gucuccccuugcaagggugccucuguucugucccugcccccaccucaccuucucuacuccucca

SEQ ID NO: 250619 - RNA, 64 nt, Human
uggccaccgggagcucuuggcugcaucuucucccugcccccaccccacuaugaccuuugacccu

SEQ ID NO: 250620 - RNA, 64 nt, Human
cagaggguggucacagcauguguccucugacguaugcccccaaagcucuccagccagacugagg

SEQ ID NO: 250621 - RNA, 64 nt, Human
ucacucaauugggagguggcauucuugucccuguugcccccaucucuacccccuuuuguuaaug

SEQ ID NO: 250622 - RNA, 64 nt, Human
gugcccuugcuggggacguggcugugcccucaguugcccccagggcugggugcccaccaugccc

SEQ ID NO: 250623 - RNA, 64 nt, Human
cucuuuauuuucagugcuuuuuguuuggccucccugcccccauguuuuucuggcugggagcucc

SEQ ID NO: 250624 - RNA, 64 nt, Human
ccgcuccugcgugcgcccccaccugguccccggaugcccccaccaccuggacagaggccacacu

SEQ ID NO: 250625 - RNA, 64 nt, Human
uugcagauggccagugucacggugaaggcuggguugcccccacgggucuagggagaacgaacuc

SEQ ID NO: 250626 - RNA, 64 nt, Human
aagacuccucaggcagcgugugggucccgcacucugcccccauuuccccgauguccccugcggg

SEQ ID NO: 250627 - RNA, 64 nt, Human
caccaucucaacuuugcccgcucaccaugucccuugcccccauguagcccauuucccagguuau

SEQ ID NO: 250628 - RNA, 64 nt, Human
cuuagccucccagguagcugggacuacaagcgugugcccccacagccagcuaauuuuuguauuu

SEQ ID NO: 250629 - RNA, 64 nt, Human
ucagacacauccucggacacacaugcggucuuggugcccccagguucaauccugcguuagcucu

SEQ ID NO: 250630 - RNA, 64 nt, Human
aaucuuaauaacaauugugaguggcuguuugaguugcccccaccauguccuuagaucuaaucug

SEQ ID NO: 250631 - RNA, 64 nt, Human
ucugugugaagaucacguuccuucccccgcaaugugcccccagacgcacgugggucuucagggg

SEQ ID NO: 250632 - RNA, 64 nt, Human
gagccgccagucugacccuugucaccgcacgcucugcccccaccccguugcaagaggucacacc

SEQ ID NO: 250633 - RNA, 64 nt, Human
aguccaguuaaaucuuugguuucaguaugucugaagaguacagugagagguuaauuucugcuca

SEQ ID NO: 250634 - RNA, 64 nt, Human
gaaaaggucacuuguaaacagaggagaaagggaaagaguacaaagcccuaaguuuauuguaagu

SEQ ID NO: 250635 - RNA, 64 nt, Human
caaaacaaaacaaaacaacaaaaaaagaaaaggcagaguacaaggagauacauguaacaagaga

SEQ ID NO: 250636 - RNA, 64 nt, Human
ucuaagugcaauacuuggcccgccggcuucccgcugcccccaucgcgcucacgcaauaaccggc

SEQ ID NO: 250637 - RNA, 64 nt, Human
ccgugaugaauguacugacgagccgaggcagcagugcccccaccguggccccccacgccccauu

SEQ ID NO: 250638 - RNA, 64 nt, Human
aauggagucugggggagggggaaccccggggacaugcccccacccgggaggggccgguaacccc

SEQ ID NO: 250639 - RNA, 64 nt, Human
agacccucauuugccacccagaccaaugugagccugcccccagcccccucucauuggaaguggc

SEQ ID NO: 250640 - RNA, 64 nt, Human
ucucccuucaccccgcccccagggccuucccuucugcccccaggcgggcuccccgcugcuccag

SEQ ID NO: 250641 - RNA, 64 nt, Human
uugaccucagcuucggagccaccucuggaugaacugcccccagcccccgccccauuaaagaccc

SEQ ID NO: 250642 - RNA, 63 nt, Human
gcaguggccaguggccuuagagggagccugcccugcccccaccgcccaccaccuccuccccuu

SEQ ID NO: 250643 - RNA, 64 nt, Human
cauguuuaaaaagucauagaugucaucuucucucugcccccagggaggaaagccaccuucucuu

SEQ ID NO: 250644 - RNA, 64 nt, Human
cagcacacaggagccccccacaacgaagaguuagugcccccaaacgucacuguugcugagguug

SEQ ID NO: 250645 - RNA, 64 nt, Human
uuuuuuucuguuuucuuuuuuuccccuuucccccugcccccacccacggggccuuuuuuuggag

SEQ ID NO: 250646 - RNA, 64 nt, Human
gggggucucccguuuccugugccugcaccagcccugcccccauugcgucugcacaccccugcgu

SEQ ID NO: 250647 - RNA, 64 nt, Human
cccccagcaaagcccccagagcccaggcucggccugcccccaccccauucccgcagugggagca

SEQ ID NO: 250648 - RNA, 64 nt, Human
gggcucuucucauuucaccccucccuuucuccccugcccccaggacugggccacuucugggugg

SEQ ID NO: 250649 - RNA, 64 nt, Human
caccacagugaccacacccucacuggcucggcccugcccccaguauacugaccauuccccagcc

SEQ ID NO: 250650 - RNA, 64 nt, Human
gcucccugcccuugagccccucagccguuugcccugcccccaccucggcuccauggugggaggg

SEQ ID NO: 250651 - RNA, 64 nt, Human
gucuugagacagggucuggcucuguuggcagacuagaguacaguggugagaucacaguucauug

SEQ ID NO: 250652 - RNA, 63 nt, Human
gucucuucucuccagcguacacuuaaaauuggugccgagcagggauauaaccugcaguuaagu

SEQ ID NO: 250653 - RNA, 63 nt, Human
cacacacacacacacacacacacacacacacacgccgagcagcugucucggguccagagcgag

SEQ ID NO: 250654 - RNA, 64 nt, Human
ggagagccuggcccuguccuuugcuacccagggcugcccccaggcccaugaagccaauaggaga

SEQ ID NO: 250655 - RNA, 64 nt, Human
uucuguuaggacucaguugcaagaacagaaacccugcccccacuuaauaauaaaaaagaaaguu

SEQ ID NO: 250656 - RNA, 64 nt, Human
agccagccguaauggggacucuccaggcaccgccugcccccagcguggggguggccacuccugg

SEQ ID NO: 250657 - RNA, 64 nt, Human
ccgccaugcaugauggguaaagcaauacugccgcugcccccacccugcuucugcugccuguuug

SEQ ID NO: 250658 - RNA, 64 nt, Human
cguguuauuuauugcuacuuccugccuggucuccugcccccacaccuggcccuggggccuguac

SEQ ID NO: 250659 - RNA, 64 nt, Human
ucuaaauaccugcccugacaugcacaccucccccugcccccaccacggccacuggccaucucca

SEQ ID NO: 250660 - RNA, 64 nt, Human
gacagccgccugagccccucugccugguccccuuugcccccaggaugaauacgacgacauugug

SEQ ID NO: 250661 - RNA, 64 nt, Human
uccuggccguaccagcuagccucauccuuuggccugcccccaggugcauggcggccugcugcag

SEQ ID NO: 250662 - RNA, 64 nt, Human
uccccaacuccaugccugucuccaaucccaacccugcccccaaucuccccucaacuccaaucca

SEQ ID NO: 250663 - RNA, 64 nt, Human
cccucuucccugccucuucccucgcccaccugccugcccccauacucccccagcggagagcaug

SEQ ID NO: 250664 - RNA, 64 nt, Human
agaggagcgucccuggggauuguugggaccaugcugcccccacucccgcuuuuguuggggcucu

SEQ ID NO: 250665 - RNA, 64 nt, Human
ccuguacagcgacugucuccgaaccuucuggaccugcccccacuguggccugcaugcgccccuc

SEQ ID NO: 250666 - RNA, 64 nt, Human
cacgccccuggagcgcaucgcccaugagaacaccugcccccaggccccacaggaugggccccca

SEQ ID NO: 250667 - RNA, 64 nt, Human
ucuuuucuuuccuuccuuccuucuuuuuuguuuuugcccccaauucugcccauacccauuucuu

SEQ ID NO: 250668 - RNA, 64 nt, Human
uucuuucuuuccuuccuuccuucuuuuuuguuuuugcccccaguucuguccacaccccuucccu

SEQ ID NO: 250669 - RNA, 64 nt, Human
ggugguguauugcucuuuuucagcuuuauuuuuaagaguacagucaggaaaccaacaaggggcc

SEQ ID NO: 250670 - RNA, 64 nt, Human
cuugccuucccaggacugcacgguuuaacacagcagaguacagaagggugaagaagugagcaga

SEQ ID NO: 250671 - RNA, 64 nt, Human
agggcccugguaaaauaguggaucucaguuuuuaagaguacaagcucuuguuucuguuuagucc

SEQ ID NO: 250672 - RNA, 55 nt, Human
agaagcaggagcagcccugacccccugcccccaacuccauuauuuauuacggagc

SEQ ID NO: 250673 - RNA, 64 nt, Human
ccccugcccugcccugccccguguccaccucccuugcccccaagccuguccccagugccccucc

SEQ ID NO: 250674 - RNA, 64 nt, Human
gggagccuguggccagcagcccccacugcaccccugcccccaggugacacgcuucugagcaggg

SEQ ID NO: 250675 - RNA, 64 nt, Human
uguauaaaguugucuccguguccccuccucccucugcccccaguguuucuucugauuuuuuuuu

SEQ ID NO: 250676 - RNA, 64 nt, Human
caauguaguuuuccauccuucaaauaaacaugucugcccccaugguuucgguaaugggacucuu

SEQ ID NO: 250677 - RNA, 56 nt, Human
gccccaccaagagcuccugagcccccugcccccagagcaauaaagucagcuggcuu

SEQ ID NO: 250678 - RNA, 64 nt, Human
cccugacugaugucucuuacaugaaugugacuggugcccccaggaggcagucaccgugcugucu

SEQ ID NO: 250679 - RNA, 64 nt, Human
cacuucccggggccucggggcacacagcuggggcugcccccacccgaaagacccuccacgcucg

SEQ ID NO: 250680 - RNA, 64 nt, Human
gggaaaccucaaggccagcucaaugccugguaucugcccccaguccaggccaggcggaggggag

SEQ ID NO: 250681 - RNA, 64 nt, Human
uggcugcuggugcccggggaggagcagcuauccuugcccccagaggagcagucauugcccucug

SEQ ID NO: 250682 - RNA, 64 nt, Human
ccaaagccaugggagggguguccuccucagaccaugcccccagaugauuuuuuuaaauaaagaa

SEQ ID NO: 250683 - RNA, 64 nt, Human
cggucccccgcccugcucaccucuacuaugaaggugcccccaggucaccugugcugcccgccau

SEQ ID NO: 250684 - RNA, 64 nt, Human
cuccgccccugcccccucuccccccgcaugugggugcccccacucccccaucguggggucugug

SEQ ID NO: 250685 - RNA, 64 nt, Human
cuucugcugcagcagaggcucacccagcgugaacugcccccagggaacacugggcgaugccugg

SEQ ID NO: 250686 - RNA, 64 nt, Human
cucagaaagccaaguaccuuuucagcuuuuuaacugcccccaucccaacccagggaggccugug

SEQ ID NO: 250687 - RNA, 64 nt, Human
gaccucauuccccagaaaaggcuccucccacaccagaguacagccuggguagggggaaaaucag

SEQ ID NO: 250688 - RNA, 64 nt, Human
guguguggaggauuuacagcuaagcuguaguugcagaguacauguacaguaaugaaguucacug

SEQ ID NO: 250689 - RNA, 64 nt, Human
uuggcugucuggccuuggagcaggucgggagaguagaguacauaaucagugccacacagaggca

SEQ ID NO: 250690 - RNA, 64 nt, Human
uguuggccaucccuuccccagccacaggugucccugcccccaggacaguccagggccaggggcu

SEQ ID NO: 250691 - RNA, 64 nt, Human
aguacaccccaacagcacccucuccagaugggagugcccccaacagcacccucuccagaugaga

SEQ ID NO: 250692 - RNA, 64 nt, Human
ugccguggcgggacagcgugggcaggcucauuucugcccccaacccgggccccaggacagguca

SEQ ID NO: 250693 - RNA, 64 nt, Human
aacuccagaccucugggaacaagacugcgggcucugcccccagcucugccaggacggcugcaag

SEQ ID NO: 250694 - RNA, 64 nt, Human
ggagacagcaagaagcugcaaugugcaaucccccugcccccacagccaaggucaggaagaggcc

SEQ ID NO: 250695 - RNA, 64 nt, Human
gcaggaccugucgaccugaggugacccugggccuugcccccagccaacugggccaccagcuucc

SEQ ID NO: 250696 - RNA, 64 nt, Human
ucuuucucagguccugcaggcuggucucugagccugcccccacgaacuuucuggauuccaaggu

SEQ ID NO: 250697 - RNA, 64 nt, Human
guuucuuuuuucggcuaaaaagaaugcagagaugugcccccacccccacccucgaccacccccg

SEQ ID NO: 250698 - RNA, 64 nt, Human
ggggggugcccggggaucccccgccccauccuccugcccccaccccaggcugggcuguucacuc

SEQ ID NO: 250699 - RNA, 64 nt, Human
cccugccuaggugccugugcuggguguccaccugugcccccaccugggugcccuaugcugaccc

SEQ ID NO: 250700 - RNA, 62 nt, Human
ugugggccaccuauugucuaauaaagugggcaguugcccccaucugguggcuuuccuuaggg

SEQ ID NO: 250701 - RNA, 64 nt, Human
ggugucgcaucuucuccagcgcugggcccucccuugcccccaagcucaagaagggggcacugcc

SEQ ID NO: 250702 - RNA, 61 nt, Human
aggaguuuucugaguuuuaggggcaugccugugcccccauggguuuucuuuuuucuuuuuu

SEQ ID NO: 250703 - RNA, 64 nt, Human
uggcccagguggcuauuuugagaacuccagcuggugcccccagacagcugcucagagccaaggg

SEQ ID NO: 250704 - RNA, 64 nt, Human
uccaggcucuaggacugcgcgaugagccccagggugcccccaggcuccggccgguucccccggu

SEQ ID NO: 250705 - RNA, 64 nt, Human
gacaauauccacacuuuuccaacuucacacacggagaguacauggagaaugccuacaggcuaga

SEQ ID NO: 250706 - RNA, 64 nt, Human
caugaaacaaugccaacugucucuucccuaaggaagaguacaaguacccuaaaauugaaaggug

SEQ ID NO: 250707 - RNA, 64 nt, Human
uuuuagcaaaggcucgaaucuuacugcccaucaaagaguacauaauggagagaaacccaauagu

SEQ ID NO: 250708 - RNA, 64 nt, Human
cugcugcccucgcugccccugacccgcgcccccgugcccccaggcccagccgccgcccugcucc

SEQ ID NO: 250709 - RNA, 64 nt, Human
gcgggaaccccaacagggccccgggagggaacccugcccccaaccccccacagcaaggcuguac

SEQ ID NO: 250710 - RNA, 64 nt, Human
ccugggcuaaggaguaaccucccucaucucuaacugcccccacggggccagggcuaccccagaa

SEQ ID NO: 250711 - RNA, 64 nt, Human
ccccuccuacagcuguaacuccccuccuguccucugcccccaaggucuacucccuccucacccc

SEQ ID NO: 250712 - RNA, 64 nt, Human
ucuauuccauguuugcaccugugcauuuucuguuugcccccauucacuuugucaggaaaccuug

SEQ ID NO: 250713 - RNA, 64 nt, Human
cgaaugagaacggugucucugcccgcaggacgccugcccccagcccccgcagcccucuggcccc

SEQ ID NO: 250714 - RNA, 64 nt, Human
uaaggucucucuccuuggucacccagccuggcuuugcccccaaagucucccuuccccuagugac

SEQ ID NO: 250715 - RNA, 64 nt, Human
uucccagcccauaucuacaguacuuccagauggcugcccccaggaauggggaacucucccucug

SEQ ID NO: 250716 - RNA, 64 nt, Human
ccgcuccagaucugcacuggguguggccccgcagugcccccacccaguccgccaaacacuccac

SEQ ID NO: 250717 - RNA, 64 nt, Human
accauguucaaggguaccggaagagaagggugucugcccccaaccuccccugugggugucacug

SEQ ID NO: 250718 - RNA, 64 nt, Human
gaaggagacucaggacugcugaaggcacgggagcugcccccaguggacaccagugaaccccagu

SEQ ID NO: 250719 - RNA, 64 nt, Human
aaggagacucagagacuccagaaggcacaggagcugcccccaguggacaccaaugaaccccagc

SEQ ID NO: 250720 - RNA, 64 nt, Human
gaaggagacucaggacugcugaaggcacgggagcugcccccaguggacaccaaugaaccccagu

SEQ ID NO: 250721 - RNA, 64 nt, Human
guagaguugagaagguguggaagauagggacagcugcccccagaacucccuucaagggaggacu

SEQ ID NO: 250722 - RNA, 64 nt, Human
ccaggugaugcugcagcagggcgaggccaugcgcugcccccagugccagaucgugguacagaag

SEQ ID NO: 250723 - RNA, 64 nt, Human
gcagcuggagaaaauaagcuaaguuugcaauaacagaguacacaaguauaguggcccaggaugu

SEQ ID NO: 250724 - RNA, 64 nt, Human
acacaucuaaugugaacugcugccuaaccacucaagaguacacagcuggcaccagagcaucaca

SEQ ID NO: 250725 - RNA, 64 nt, Human
guaguaaucucacggcucuugaucuggaaacuucagaguacaaauugguggaugguggaaggca

SEQ ID NO: 250726 - RNA, 64 nt, Human
ucaggccucccgaaccgacuuccuccaggcgcugugcccccaggagcucgcuuugaccccuuug

SEQ ID NO: 250727 - RNA, 64 nt, Human
cccacagcuuacugaaaaagccagaggccaugacugcccccagaaacuugccccgaguuucucu

SEQ ID NO: 250728 - RNA, 64 nt, Human
uuaucaaaaaggacacugucaagaaggcgcccccugcccccacccccgugucacccuaggccug

SEQ ID NO: 250729 - RNA, 64 nt, Human
gugggccguugaguuaccucugugcuggaucccgugcccccacuugccuacccucuguccugcc

SEQ ID NO: 250730 - RNA, 64 nt, Human
uuauuuaaugucugcaguagacugaauguuugugugcccccagaauucuaauguugaaaucuca

SEQ ID NO: 250731 - RNA, 64 nt, Human
cgagacuccaucucaaaaaaaaggagacuucaugugcccccaauuuuucacuauuguuauuuga

SEQ ID NO: 250732 - RNA, 64 nt, Human
uccugcuggaugugcugugcagguugguaggacuugcccccacugucaaggccuggucucaucu

SEQ ID NO: 250733 - RNA, 64 nt, Human
gccaaacccugcucccaggcugaagccuggagucugcccccacuucccuuuucuauaauccacc

SEQ ID NO: 250734 - RNA, 64 nt, Human
acucucgccaaccuaucggggcauagcccagggaugcccccaggcggcccagguuagaugcguc

SEQ ID NO: 250735 - RNA, 64 nt, Human
agaccugagggacccuucgagaucaucacuuccuugcccccauuucacccauggggagacaguu

SEQ ID NO: 250736 - RNA, 64 nt, Human
ggcacuuggggcaccuugcuccuccuucugcugcugcccccaccucugcugccucccucugcug

SEQ ID NO: 250737 - RNA, 64 nt, Human
uuacuccuuuuucuacccagauaaggaggguuccugcccccaggugaacauuaacuuuccccag

SEQ ID NO: 250738 - RNA, 64 nt, Human
cacaaguuccagcuggucuuuugggaguggccccugcccccaaagguggucugcuuuugcuggg

SEQ ID NO: 250739 - RNA, 64 nt, Human
cugucggccaggugaggucagcagccugggagagugcccccaagagaugagggcaccccguguu

SEQ ID NO: 250740 - RNA, 64 nt, Human
gucaggccuauucgcugcacuuccugccaaacuuugcccccacaagccuggucaucagccaggc

SEQ ID NO: 250741 - RNA, 64 nt, Human
uauuuuuuuuuuauucauucuguuugcuuaauucagaguacaguuugugcuauuucauaucugu

SEQ ID NO: 250742 - RNA, 64 nt, Human
gguccugggaugaguugccccgggcugcaaauuaagaguacagcuaagugcggggguggcggug

SEQ ID NO: 250743 - RNA, 64 nt, Human
gucuuuuuuaacugagaaaggagauuuuuugaaaagaguacaauuaaaaggacauugucaagau

SEQ ID NO: 250744 - RNA, 64 nt, Human
ggcaaggagagggacagcacaggccacagagggcugcccccaccacacacacccccgcgucucg

SEQ ID NO: 250745 - RNA, 64 nt, Human
aggucccuggggaucugcauuucuaacaggcuccugcccccaagacugcucugguggaaaaucc

SEQ ID NO: 250746 - RNA, 64 nt, Human
uuggacaucaaagcugagucacuggaccuagcugugcccccaaccuagauuggcagcaccaccc

SEQ ID NO: 250747 - RNA, 64 nt, Human
caccauguccaaggucugacagcuccccacuggcugcccccacaggggcuuuaggcuggucugg

SEQ ID NO: 250748 - RNA, 64 nt, Human
uguuucuucaagcugugauccagaaagauuuuugugcccccagaugccucuugauaggagaggc

SEQ ID NO: 250749 - RNA, 64 nt, Human
aagcaacuguuuaaacccuuuguaaccggggccuugcccccaccuccugucuuuucuccuugcc

SEQ ID NO: 250750 - RNA, 64 nt, Human
cucugcucuccaucaaaucacuuccacuuuccugugcccccacccccgccuccaguuuuccgcu

SEQ ID NO: 250751 - RNA, 64 nt, Human
caaguagcaauaauuuggguccagggucaccuauugcccccagaggccucugaaccccaggcug

SEQ ID NO: 250752 - RNA, 64 nt, Human
cgccaagaccugcuguguaaagugguccaaucccugcccccaaguccagauuccagccccucug

SEQ ID NO: 250753 - RNA, 64 nt, Human
gcaacccagggucccagcuggcuggguccucuucugcccccagugcccuuccccuugggcugug

SEQ ID NO: 250754 - RNA, 64 nt, Human
gggggagaaugcuggagggagcacgccgcugagaugcccccaccccagguuucccccaucagag

SEQ ID NO: 250755 - RNA, 64 nt, Human
uggcagguggugaguucaggugggggcucccugcugcccccaggccugggagcuugaagcccuc

SEQ ID NO: 250756 - RNA, 64 nt, Human
ucagauaaggcagaacuaggagucuucacugcucugcccccaacucccggaggugucaccuucc

SEQ ID NO: 250757 - RNA, 64 nt, Human
ccuccugcucaagucuagaccccuacuucucugcugcccccacccugccagagcugauguuucc

SEQ ID NO: 250758 - RNA, 64 nt, Human
ggauaagugagagggauucggguugcguguucacugcccccaauuccuaaagcaaguuagaagu

SEQ ID NO: 250759 - RNA, 64 nt, Human
augggagugcccccaacagcacccucuccagaugagaguacaccccaacagcacccucuccaga

SEQ ID NO: 250760 - RNA, 64 nt, Human
ccuaagugucagccaacuugagaaauaaagggacagaguacaaaagagagaaauuuuaaagcug

SEQ ID NO: 250761 - RNA, 64 nt, Human
ucaccuugcaggagggccgugagccugacuacucagaguacaaggaguucaagcugacugugga

SEQ ID NO: 250762 - RNA, 64 nt, Human
uggcccuuucaccccucuucccaccaacucucucugcccccaaaagugucaaggggcccuagga

SEQ ID NO: 250763 - RNA, 64 nt, Human
caggaagccuccugcugagugguccacauucugcugcccccagaccccauccagccaggggugg

SEQ ID NO: 250764 - RNA, 64 nt, Human
cugagcucugaggggugggugcucagugcacgggugcccccaguguccucugauccuguccggu

SEQ ID NO: 250765 - RNA, 64 nt, Human
uagcucccugccagcuuccugucccugugcucacugcccccacgccuccugccaaggccgagcc

SEQ ID NO: 250766 - RNA, 64 nt, Human
gaaggugcucggucacugugggagcagggaaaggugcccccacuccccgagagccaggggaagg

SEQ ID NO: 250767 - RNA, 64 nt, Human
uuugaagagcaucaucaugggcuggggugguggcugcccccaggacaugcaggauuucugcagg

SEQ ID NO: 250768 - RNA, 64 nt, Human
ccaauucauuucaucuacuacagggugaggugcuugcccccauguggguguggcaguuacaggg

SEQ ID NO: 250769 - RNA, 64 nt, Human
ggcugugccugugccgggccgcagggaagcuggcugcccccauuccugcugcugcugcugcugc

SEQ ID NO: 250770 - RNA, 64 nt, Human
caguugguccugcagaacuggaugcucaaggcccugcccccagcccugcagguaggcuuagccc

SEQ ID NO: 250771 - RNA, 64 nt, Human
agcgggccaagcagaggagcccucgggucagcccugcccccagagcugccccccacgggcaucc

SEQ ID NO: 250772 - RNA, 64 nt, Human
aauauguuagcaagagagggcacucccaggccccugcccccaggcccuccccaggcgauggaca

SEQ ID NO: 250773 - RNA, 64 nt, Human
cagggccauugucucaccucccaaagggaccgccugcccccagcucaucccagagcgucccugc

SEQ ID NO: 250774 - RNA, 64 nt, Human
gggaccguccugcugagaaauugcacugaagagaugcccccaccucugguugggccugggggug

SEQ ID NO: 250775 - RNA, 64 nt, Human
ccucccgcucaggccacagccggagccuccgcauugcccccacccccauuuuccagggggguug

SEQ ID NO: 250776 - RNA, 64 nt, Human
ggucggcuccugggcuguggccguggagagacacugcccccaggaugacacaggcaagagcccc

SEQ ID NO: 250777 - RNA, 64 nt, Human
ugcagaacaaaugaagacaaaacauacauuuuguaccaaccauccaauuagcuuauguuaacug

SEQ ID NO: 250778 - RNA, 64 nt, Human
acaaaauuccuguuacccgcugaacuccaagcucaccaaccagauucaugagcuuucucacauu

SEQ ID NO: 250779 - RNA, 64 nt, Human
ggaagcugcaggugucaagagaaaugcucucaauaccaaccagggaggauugucuaaucaaaaa

SEQ ID NO: 250780 - RNA, 64 nt, Human
cagcugucugggacuucaguggacccccagccccugcccccacucaccaaggccucgcucgucc

SEQ ID NO: 250781 - RNA, 64 nt, Human
cacuuaauugguauuuuuuucugccuucuuccccugcccccacugacuccucuccucucccuuu

SEQ ID NO: 250782 - RNA, 64 nt, Human
gagccaggggucuguucuguagcagccaccccccugcccccacuccagggcagccaugaugugc

SEQ ID NO: 250783 - RNA, 64 nt, Human
gccgguccuucccucucaugacuugcagggccguugcccccagacuuccuccuuuccguguuuc

SEQ ID NO: 250784 - RNA, 64 nt, Human
ugaggugcagaggcccacccagcccccuaccuacugcccccauucauccuggcuuuccacagcc

SEQ ID NO: 250785 - RNA, 64 nt, Human
ggggcccugucgccaccaccccccgcccagccccugcccccagccugugugcccuguuccuugc

SEQ ID NO: 250786 - RNA, 64 nt, Human
aaacauuaaggguacccgggcacaaccguaccccugcccccagccccagccucccugagggccu

SEQ ID NO: 250787 - RNA, 64 nt, Human
gccagacgccagggccugcccggccuccuguuccugcccccacccaccaccugccuggagagga

SEQ ID NO: 250788 - RNA, 64 nt, Human
gcacugaggauucuugcccccuuguggugcccgcugcccccaaccuucaggcugccagaugcuc

SEQ ID NO: 250789 - RNA, 64 nt, Human
uaucugccagaucuucccaucuuguggcauguggugcccccaccaacaucccaaggggaccaau

SEQ ID NO: 250790 - RNA, 64 nt, Human
gcccgaagucauacucuugcucccaccccacccuugcccccagcccucucucccugugcuuugc

SEQ ID NO: 250791 - RNA, 64 nt, Human
ccugcaggguuauuuaauaugguauuugcuguauugcccccaugggguccuuggagugauaaua

SEQ ID NO: 250792 - RNA, 64 nt, Human
gaggggggggaacccaaggcacaggccccgccccugcccccaagcagcacugggcuacuggcuc

SEQ ID NO: 250793 - RNA, 64 nt, Human
uauauugguaagacuaguaccugccagggagaggugcccccaagugaagggguacaguggcacc

SEQ ID NO: 250794 - RNA, 64 nt, Human
ucucccucgcucucaaguaccugcccgagguguuugcccccaacgccccggaugugcugagcug

SEQ ID NO: 250795 - RNA, 64 nt, Human
uuugauggcaauaggccaaaauuauuguguccagagaguacacuuuuucaaaaugcucaccuac

SEQ ID NO: 250796 - RNA, 64 nt, Human
cuugaacccgggaaguggagguugcagugagccaagaguacaccacugcacuccagccugggca

SEQ ID NO: 250797 - RNA, 64 nt, Human
accuaguuuauagauaacugcuggucuuaauugcagaguacagagaacugaaccagcuccugau

SEQ ID NO: 250798 - RNA, 64 nt, Human
uggaguugcuggccaaagaauuccaggacaagacugcccccaggcugcagaaauaccuggugcu

SEQ ID NO: 250799 - RNA, 64 nt, Human
uugggcuucagguaccuaaaacagauccaggaccugcccccaacuggccucccugagaugaacc

SEQ ID NO: 250800 - RNA, 64 nt, Human
aucagcucagcacuuccaugggccauagccgguaugcccccagccugccauaagcgugcuuuca

SEQ ID NO: 250801 - RNA, 64 nt, Human
ggaaagucccugccaccuguaccaccaaugggccugcccccaccccaggaguuuggccggggga

SEQ ID NO: 250802 - RNA, 64 nt, Human
gagaaugacugccagggccucgccugccuccaccugcccccaccugcuccuaccugcucuacgu

SEQ ID NO: 250803 - RNA, 64 nt, Human
cgggcuaaaaaaggcuguuagaaccuuugggccgugcccccauuuuccguacauggugaagaac

SEQ ID NO: 250804 - RNA, 64 nt, Human
gauccaauaggagacaccaguucugacugaaccaugcccccaccuaagucacaaaaugagggaa

SEQ ID NO: 250805 - RNA, 64 nt, Human
aggggcaccucacuccaccucaaagucauuugacugcccccauccaccccaccacccuaaucuu

SEQ ID NO: 250806 - RNA, 64 nt, Human
acacucagaaaauucccuggggucaccuucuaguugcccccauucccagccugacuagaacucc

SEQ ID NO: 250807 - RNA, 64 nt, Human
acagcagucuccccagccugcccugcucaggccuugcccccaaaccuguacugucccggaggag

SEQ ID NO: 250808 - RNA, 64 nt, Human
uccuacuccaauuccacauccuucauccuggccaugcccccaccuucaagagcaugaagcacuc

SEQ ID NO: 250809 - RNA, 64 nt, Human
gaggccugaggaguggcaggaaagagggagcaggugcccccaggugagacagcggucccagggg

SEQ ID NO: 250810 - RNA, 64 nt, Human
ccauuuccuaucucuagcaaccuccugggccccaugcccccaccccuucuagaaccugcauucc

SEQ ID NO: 250811 - RNA, 64 nt, Human
ggagccuagagugagggccugaggucuggcugcuugcccccaugcuggcgccaacaacuucucc

SEQ ID NO: 250812 - RNA, 64 nt, Human
cuguuugggaagacguggaggaaaaggugacuucugcccccaccgcucuuacccccacuguagu

SEQ ID NO: 250813 - RNA, 64 nt, Human
gccuucucugcucccuugcagggguccccucucaagaguacagaagcuuuagcaagugugcacu

SEQ ID NO: 250814 - RNA, 64 nt, Human
aauguuacuaguuuucacauuuccuaagcagccuagaguacagggugagcauuuuuagaucucc

SEQ ID NO: 250815 - RNA, 64 nt, Human
cgaucaggagccuguuuacuaaaagucuucauacagaguacaagugcagccgccagaggagaaa

SEQ ID NO: 250816 - RNA, 64 nt, Human
ccgcucuuacccccacuguaguggccuuuggagaugcccccaccucccccccaccaacucucgc

SEQ ID NO: 250817 - RNA, 64 nt, Human
cucauacagugccuuugagcaaguuaggaaaagaugcccccacugggcagacacagcccuaugg

SEQ ID NO: 250818 - RNA, 64 nt, Human
ggggagagcauggauccuggggucaaagggccuuugcccccacccuuacuuggcccucuaccug

SEQ ID NO: 250819 - RNA, 64 nt, Human
ucugguccuggccaggccaugcuacacuaaccccugcccccacucuccuccccucuuuuccuuc

SEQ ID NO: 250820 - RNA, 64 nt, Human
cuuccuucguggauugucuccauuguccagacagugcccccaccucccaccgccuugccucacu

SEQ ID NO: 250821 - RNA, 64 nt, Human
gggcucggcuguaggggcuuccuuaggcugagagugcccccaggcugacaucuguguuggcuuu

SEQ ID NO: 250822 - RNA, 64 nt, Human
aaagagucaagugaccaucauuucaccugcugcuugcccccaauaguagucucugugaggccuu

SEQ ID NO: 250823 - RNA, 64 nt, Human
ucugcuccugcgaggcuaugagugggaugagugaugcccccacagcaccuccauguggacuuag

SEQ ID NO: 250824 - RNA, 64 nt, Human
caccucaccccacuguggcugauuuggaauuuugugcccccauguaagcaccccuucauuuggc

SEQ ID NO: 250825 - RNA, 64 nt, Human
uacuaucuuaucucagauauuugcacccccaaucugcccccaacucccaaaagcuagaacacug

SEQ ID NO: 250826 - RNA, 64 nt, Human
ccagcugggcuggaagguuccauaacuggccagcugcccccauaacuggcagcauucccagacc

SEQ ID NO: 250827 - RNA, 64 nt, Human
ugccuuagugugccucccaauacucccuucuuccugcccccacaccccauccccagcuagccca

SEQ ID NO: 250828 - RNA, 64 nt, Human
aauauuggaguuugggguauaaaacacuccucccugcccccauuaguauuuauauugaucuuuc

SEQ ID NO: 250829 - RNA, 64 nt, Human
uuuagcucaauuucugggccugaggugcucagacugcccccaagaucaaaucucuccuggcugu

SEQ ID NO: 250830 - RNA, 64 nt, Human
cuccagaacucuuccuccaaggacagaaggcuccugcccccauaguggccucgaacuccuggca

SEQ ID NO: 250831 - RNA, 64 nt, Human
ugaacaaguuuuuggcagagguauauuuacauucagaguacacuuuucuuuggaaaaaauuaca

SEQ ID NO: 250832 - RNA, 64 nt, Human
ugagacaggagaaucgcuuaaaccugggaggcggagaguacagugagccaagaucgcgccacug

SEQ ID NO: 250833 - RNA, 64 nt, Human
ugcucucuggagcuuacuaugugcugguacuuaaagaguacauucugccuugcuguagugaaga

SEQ ID NO: 250834 - RNA, 64 nt, Human
caucuucucuguguaccaccucugcugucucagaugcccccagcaaauaaacacucuucucguu

SEQ ID NO: 250835 - RNA, 64 nt, Human
ccucaggugaucugcccgccucggccucccaacgugcccccaguuuuauaaacagcagauagca

SEQ ID NO: 250836 - RNA, 64 nt, Human
uugaaaugaccuaaccaaaaacauucaaggguucugcccccagauuucgggagauccacguucc

SEQ ID NO: 250837 - RNA, 64 nt, Human
ugggaaaacugaggccuggagguaggaagggacuugcccccaaggccgcacacugaguuaacag

SEQ ID NO: 250838 - RNA, 64 nt, Human
gguggguagcuaauuaacuaucagguguugaggcugcccccaguggacaucaccuuuggcucug

SEQ ID NO: 250839 - RNA, 64 nt, Human
aucuugaggaagcccaagugcguaccuuuauuuuugcccccaccacccucuuucuguacuucaa

SEQ ID NO: 250840 - RNA, 64 nt, Human
uuauaaauauuguaaguuugugucgaugaguguaaguuggcagugcgcacgucucgguuuuuuu

SEQ ID NO: 250841 - RNA, 64 nt, Human
acucugaccgucucauaaaagaguucuacccagcaguuggcagauuaucagcuguggacuccag

SEQ ID NO: 250842 - RNA, 64 nt, Human
aggaagguggaugcuguugucauggagcugugggaguuggcacucugucugcugguggcccucu

SEQ ID NO: 250843 - RNA, 64 nt, Human
aguggagaaagugggaauagggugcauuggggcuaguuggcacugccauguaucucaggcuugg

SEQ ID NO: 250844 - RNA, 64 nt, Human
agaggggcugucaucuguagcugccaucacagugaguuggcagaagugacuugagcauuucucu

SEQ ID NO: 250845 - RNA, 64 nt, Human
auuugaauccucugaauaccugucaguauuuuaaaguuggcaauccaggacauuauaaguagga

SEQ ID NO: 250846 - RNA, 64 nt, Human
uaaauuuuauauagguaaaacauguuaauagggaagaguacaagcucucuuacauauaagaggg

SEQ ID NO: 250847 - RNA, 64 nt, Human
cugaauuuuguauaaaacuguaacauuacuguacagaguacaucaacuauuuucagcccaaaaa

SEQ ID NO: 250848 - RNA, 64 nt, Human
uuuggagagagggucucauucugucacccaggcuagaguacagugggaacagucauggcucacu

SEQ ID NO: 250849 - RNA, 64 nt, Human
guggggggaacuguacagaucagcagagcaggacaguuggcagcagugaccucaguagggaaca

SEQ ID NO: 250850 - RNA, 64 nt, Human
guuacauuacauugccagcgcauaucauuuagcaaguuggcauuaacauuuaugcuuuaauuaa

SEQ ID NO: 250851 - RNA, 64 nt, Human
ccgagucaagacuguuaauuucugacuccagaggaguuggcagcuguugauauuaucacugcaa

SEQ ID NO: 250852 - RNA, 64 nt, Human
acuuaugaaucacugagaaaaagugaaaaacuugaguuggcaaagaugcagagcagcagugcag

SEQ ID NO: 250853 - RNA, 64 nt, Human
ugccccagucgugacccccuaaaaguuaagggguaguuggcaccuccuuauuaauaugccagcc

SEQ ID NO: 250854 - RNA, 64 nt, Human
cagggcaugcuuauuagcagcuggguugguauggaguuggcagacaggauguucaacuuaauga

SEQ ID NO: 250855 - RNA, 64 nt, Human
aacuuuggaaaaaguaucccgguuuacuguguugaguuggcauuguacagaaauuaacagccau

SEQ ID NO: 250856 - RNA, 64 nt, Human
aagaaaaaggaaauaaaaaccaucucaauaauuaaguuggcagaugacuugaucuccgacauuu

SEQ ID NO: 250857 - RNA, 64 nt, Human
gcuuucuaucucuuuuaaaguaagucacuuuauaaguuggcagaagugaaugacacuuugagag

SEQ ID NO: 250858 - RNA, 64 nt, Human
gaguuucuucuuccccuugagcuucagagaggagaguuggcaugguuaaaucugaaugguuacc

SEQ ID NO: 250859 - RNA, 64 nt, Human
gaggugugaauggaucuccaaggauaaguguaacaguuggcaacaucccuaaaaacucagucuc

SEQ ID NO: 250860 - RNA, 64 nt, Human
uuccauuucugugauuuuucuauuauuugaggggaguuggcagaaguuccauguauaugggauc

SEQ ID NO: 250861 - RNA, 64 nt, Human
uuuuuaguuugguugugaaaaaacccugggcugaaguuggcauuucaguuaaaagaaaaaaaga

SEQ ID NO: 250862 - RNA, 64 nt, Human
ccaucucaggugccacucccugagcuuuggggacaguuggcagagaaggccucuugugcucacg

SEQ ID NO: 250863 - RNA, 64 nt, Human
acaucaguuuccacaucugaaaaauaagaagaugagaguacacgguuguuaugaacaaaugacu

SEQ ID NO: 250864 - RNA, 64 nt, Human
ccgauugcuuuauuaagcuaauaaugaauguuaaagaguacauauuuucaggaucguucaucua

SEQ ID NO: 250865 - RNA, 64 nt, Human
uaauguuuaggauauuaaaauuuuaggauaaugaagaguacauaauguccuacuuaauauuuau

SEQ ID NO: 250866 - RNA, 64 nt, Human
cccugaccucaggaagugucagagcauggccaguaguuggcagcccgaaagacacacagcaccc

SEQ ID NO: 250867 - RNA, 64 nt, Human
cagucuuuuugguguaauagugggaugucugcuuaguuggcagggguucaguccaaauggaaga

SEQ ID NO: 250868 - RNA, 64 nt, Human
ugaauguggggcucugguggcugucacgaagcagaguuggcacauaacauggaaccuggccagg

SEQ ID NO: 250869 - RNA, 64 nt, Human
uaauuaaucugcccaguaaauaccagcucguagcaguuggcaggugcaugucuagauaaaauuu

SEQ ID NO: 250870 - RNA, 64 nt, Human
gauuauuguaaauguuuaauuuugucucaaauauaguuggcauuggaaguuuagccuuuacuug

SEQ ID NO: 250871 - RNA, 64 nt, Human
cgugaaauggcaguauaguccaugauaucuaaggaguuggcaagcuuaacaaaacccauuuuuu

SEQ ID NO: 250872 - RNA, 64 nt, Human
uagauucuggauauuagaucuuuguuggaugcauaguuggcaaauauuuucuaccauucuguag

SEQ ID NO: 250873 - RNA, 64 nt, Human
augggagguugauuugcucucuaaacuucccucuaguuggcaagucucacauauucaucagcag

SEQ ID NO: 250874 - RNA, 64 nt, Human
uguccaucuacaguaaaccccaccauuaccuucuaguuggcauaaaaacaagaaccacaaaaac

SEQ ID NO: 250875 - RNA, 64 nt, Human
caacacccaccuuccacaacucagucugcaccucaguuggcaaaggagacuggauggccaucuu

SEQ ID NO: 250876 - RNA, 64 nt, Human
cucaagaccaggcugcagccuccacuucccucguaguuggcaggagcuccuggaagcacagcgc

SEQ ID NO: 250877 - RNA, 64 nt, Human
ucauugacuuaauaauaguaucagucggugcaacaguuggcaacaugugccuucacacuuuacc

SEQ ID NO: 250878 - RNA, 64 nt, Human
ugggcaaacugaauguauauaggcuuuugacaaaaguuggcacaaaaaguauaaaaggaggccu

SEQ ID NO: 250879 - RNA, 64 nt, Human
ugggggggguguauggugcugguuacuuuuccgcaguuggcauggguugcccuacaggcccaca

SEQ ID NO: 250880 - RNA, 64 nt, Human
uguugagauggagucucgcucuguugcccagcccagaguacaguggcacuaucucagcucacug

SEQ ID NO: 250881 - RNA, 64 nt, Human; identical to SEQ ID NO: 250094

SEQ ID NO: 250882 - RNA, 64 nt, Human
ggaaaguaguugauggaaaugagggaacacucaaagaguacauaugccacuuuccaugucuaau

SEQ ID NO: 250883 - RNA, 64 nt, Human
uggcugcgagaauggggggauguaucccucaugcaguuggcauccaggcagcccucugcagcag

SEQ ID NO: 250884 - RNA, 64 nt, Human
caauuuuuuuuuguaaaaguagcaguuugguaugaguuggcaugcauacaagauuuacuaagug

SEQ ID NO: 250885 - RNA, 64 nt, Human
cuaacagcagaggcaacuuaaauaacuccugagcaguuggcacuagaacagaauacuuggaaug

SEQ ID NO: 250886 - RNA, 64 nt, Human
aucagcgauuuuuguaaggcaaacagaauuuguaaguuggcagaucuuccuaaguugcaaaaug

SEQ ID NO: 250887 - RNA, 64 nt, Human
cuacuuuucccuuuuuuguauuaugugacuaauuaguuggcauauuguuaaaagucucucaaau

SEQ ID NO: 250888 - RNA, 64 nt, Human
uuugggugcccaccccaauuuuuaccuuuuaguaaguuggcaugaaauuuugguaaaaucugaa

SEQ ID NO: 250889 - RNA, 64 nt, Human
guggcggaucaaaaccuacaagauucaacugaaaaguuggcaguuaugguuuucuuucaucuga

SEQ ID NO: 250890 - RNA, 64 nt, Human
auuauuuccucugaauuucugggcuuggucuuccaguuggcauuugccugaaguuguauugaaa

SEQ ID NO: 250891 - RNA, 64 nt, Human
cuuuuuguuuggucaguacuguuagcucauuugaaguuggcaaaaacaaauacaaacaagcaaa

SEQ ID NO: 250892 - RNA, 64 nt, Human
ccaggaucagcuuccuccuucugucacuuguguaaguuggcacuaccuugugccucucagauug

SEQ ID NO: 250893 - RNA, 64 nt, Human
acauacccacuaauucaaguaugucagagcacaaaguuggcagcugguuauauuuaauucagcc

SEQ ID NO: 250894 - RNA, 64 nt, Human
uugugccucugcuuuuaaaggugcugugcuggacaguuggcaugccaggguucgagaagaguga

SEQ ID NO: 250895 - RNA, 64 nt, Human
ggacaagccagcgguggaagucauucugauauggaguuggcauuggaagcuuauucuuuuuguu

SEQ ID NO: 250896 - RNA, 64 nt, Human
uuggcucaagaauguuauaaugcuaagggacauaaguuggcaaccacuugguuuuuggaaggac

SEQ ID NO: 250897 - RNA, 64 nt, Human
auuuaguccuucauauuaaucucuauucucucucagaguacaagcucucaucauaugcaaauuc

SEQ ID NO: 250898 - RNA, 64 nt, Human
uccuuuccuuaaaaagaaaauaacuuuuauauuuagaguacauagggcaugauguggauuuauu

SEQ ID NO: 250899 - RNA, 64 nt, Human
cgagagaagcauuaagugacuuucaaagacuuucagaguacagccacuugguuccuuuuuguuu

SEQ ID NO: 250900 - RNA, 64 nt, Human
ugaaacaggagaaucgcuugaacccaggagauggaguuggcagugagccaagauuagccugggc

SEQ ID NO: 250901 - RNA, 64 nt, Human
uuacugaaguagucuguugguucagugcaugcuuaguuggcaguuaccacccugugcuagcaua

SEQ ID NO: 250902 - RNA, 64 nt, Human
cccaaagaauaacuuggagguugacuaauaagaaaguuggcauaaacuuucaaucaaaugaaga

SEQ ID NO: 250903 - RNA, 64 nt, Human
aaaguaucaauugcuuuaaaacuguuguaaguacaguuggcaagaucuccaagcugaaacuucc

SEQ ID NO: 250904 - RNA, 64 nt, Human
cuagcagcguuauugaugggcauuaaucuauguuaguuggcaccuuaagauacuagugcagcua

SEQ ID NO: 250905 - RNA, 64 nt, Human
cuuucugaggagauaguggggauaaucccugaagaguuggcagugugagugcaacucauuuauc

SEQ ID NO: 250906 - RNA, 64 nt, Human
cgcauaaagcacaaugcugucuucaucagaaaacaguuggcauaagaauuaaacauaugaacau

SEQ ID NO: 250907 - RNA, 64 nt, Human
ugacuuuccucauguguuuccuuaugacucaguaaguuggcaagguccugacuuuagucuuaau

SEQ ID NO: 250908 - RNA, 64 nt, Human
gccuugugguccaaauaggcaucaucaauaaaacaguuggcaugcaucccacugcugacuauaa

SEQ ID NO: 250909 - RNA, 64 nt, Human
gcccuaggaacaccagauuuccugguucuguucaaguuggcauuucuuguuuggaauaaacuau

SEQ ID NO: 250910 - RNA, 64 nt, Human
aaauuuucuauuaaaugcccugagugauaaaaccaguuggcaauaauauugccuuauuaaaucu

SEQ ID NO: 250911 - RNA, 64 nt, Human
uguagcucaaaaauucccaaaaguuuacuguuagaguuggcaauuuccuaucacuauuucagug

SEQ ID NO: 250912 - RNA, 64 nt, Human
auaauugguuugacuguaccaugguuugauauguaguuggcaccaugguaucauauauuaaaac

SEQ ID NO: 250913 - RNA, 64 nt, Human
auucuagcaucuucaggucuuuagaucuuggacaaguuggcaggguauuuuaaaagcuauaacu

SEQ ID NO: 250914 - RNA, 64 nt, Human
gauaaaccccagcagccgacucgaccccaggagcagaguacaggagacaccauggggagagacc

SEQ ID NO: 250915 - RNA, 64 nt, Human
aaagccugggugcccaagcagccaccgcagcagcagaguacaaccugcagagaagcugaucacc

SEQ ID NO: 250916 - RNA, 64 nt, Human
aagauaaaaagucagaaaucugaaaaguggaggaagaguacaaauagaccuaaauuaagcucau

SEQ ID NO: 250917 - RNA, 64 nt, Human
aauuuuauauaucaaacauacaggauggauacauaguuggcaacagucuaccuuauuuaaagcu

SEQ ID NO: 250918 - RNA, 64 nt, Human
acuuuguagaaaugagccagaagccaaggcccugaguuggcaguggcccauaaguguaaaauaa

SEQ ID NO: 250919 - RNA, 64 nt, Human
uuuuuguauguuggaacgugccccagaaugaggcaguuggcaaacuucucaggacaaugaaucc

SEQ ID NO: 250920 - RNA, 64 nt, Human
cugguuuugaaacauguuuguauauagauacaggaguuggcauaaauuuuguuaaauaaagcaa

SEQ ID NO: 250921 - RNA, 64 nt, Human
guggcuauuucuuauguaagaagcuuuuaacugaaguuggcauguuucguaaaacuugcguguc

SEQ ID NO: 250922 - RNA, 64 nt, Human
agaugcaguauugaguguucuaguuccuggaauuaguuggcagagaaaaugcugccuagugcua

SEQ ID NO: 250923 - RNA, 64 nt, Human
aaggcuaaaauucuguagugugcuaaaaugcucaaguuggcacauaaacccauuccaagauuuu

SEQ ID NO: 250924 - RNA, 64 nt, Human
uauuaacaaucuuuucugccuccaacuacuaugaaguuggcagcaacagaggggccuaugucaa

SEQ ID NO: 250925 - RNA, 64 nt, Human
uacuaauuugcugcuuguacagaaagugaaaauuaguuggcaaucauaagaaacaucugaauaa

SEQ ID NO: 250926 - RNA, 64 nt, Human
cuuacuguuaaaacuguaccuuuugcgauuucacaguuggcacuucugccaugagcagagaacu

SEQ ID NO: 250927 - RNA, 64 nt, Human
cugaccccuugcucccuucaaugcuagaaaaucgaguuggcaaaaugggguuugggccccucag

SEQ ID NO: 250928 - RNA, 64 nt, Human
gcagggaaaacucggggcuuugugccagucucuaaguuggcaacuuuggcugaacaaaugagua

SEQ ID NO: 250929 - RNA, 64 nt, Human
uuucaauauuuugaauacaucauuguuaauuuugaguuggcagagguaaacuaaccaacuacca

SEQ ID NO: 250930 - RNA, 64 nt, Human
ccacaguuccugaauggugcuaaggaucugcagcaguuggcaacgagcuggggcugggggcggc

SEQ ID NO: 250931 - RNA, 64 nt, Human
cuuuuuuccuccuuucucuguauauugggcucagagaguacacugugucucuaugugaauaugg

SEQ ID NO: 250932 - RNA, 64 nt, Human
aaaaaaagaggaacucuacaaaggccaagaucacagaguacagucuuggagggacagaauuguu

SEQ ID NO: 250933 - RNA, 64 nt, Human
uccaaauguauuuuucaaaacagaauggaauaucagaguacauuuucaugaaguuuaaaaauca

SEQ ID NO: 250934 - RNA, 64 nt, Human
cagguacugagggacaaguagaaagauuugaaacaguuggcauggaggcugcgacugaugaagg

SEQ ID NO: 250935 - RNA, 64 nt, Human
agagauuaauuccuaguguuuaccugauuauagcaguuggcaucauggggcauuuaauucugac

SEQ ID NO: 250936 - RNA, 64 nt, Human
uuuauuguccaguuaacuuuagugaccuuuuaaaaguuggcauuguaaauaaaacaacuugcaa

SEQ ID NO: 250937 - RNA, 64 nt, Human
ugaccuucuaaaauguuuuuauguuagcacugauaguuggcauuacuguuguuaagcacugugu

SEQ ID NO: 250938 - RNA, 64 nt, Human
uuuuugcuucuggaacuuugaaacacaaaacacaaguuggcacuuacaauuuuaaagaugcagc

SEQ ID NO: 250939 - RNA, 64 nt, Human
aaaaucaggauaaccacauuaagcccaauaugccaguuggcaccagaugcuguggacuuggaau

SEQ ID NO: 250940 - RNA, 64 nt, Human
aacaucagggugaccacauuaagcccaguauuccaguuggcaccagaagauauggacuuggaau

SEQ ID NO: 250941 - RNA, 64 nt, Human
gcacguggauguaguuuggcucaggugucccugcaguuggcaaggagucaguacucagucccug

SEQ ID NO: 250942 - RNA, 64 nt, Human
cuuccaccuccccacuguacacugugguacagauaguuggcacuauccuaguuauggcaucagg

SEQ ID NO: 250943 - RNA, 64 nt, Human
augcaaucaacagaaaagcuguaaauguguguacaguuggcaugguaguauacaaaaagauugu

SEQ ID NO: 250944 - RNA, 64 nt, Human
ucucaaacaaaaacaagaacaaaaacaaacauaaaguuggcacagaaaagggaccaaguuuaaa

SEQ ID NO: 250945 - RNA, 64 nt, Human
ugauaaacacaaaaugcagcuuccugaugcuuagaguuggcacaugcugcuguguuuauuuauu

SEQ ID NO: 250946 - RNA, 64 nt, Human
gauuuaagguccuaaauucuuaaccuggaacuggaguuggcaauaccuaguucugcuucugaaa

SEQ ID NO: 250947 - RNA, 64 nt, Human
aauacaaggggcacacagggaaggcagauccccuaguuggcaagacuauuuuaacuugauacac

SEQ ID NO: 250948 - RNA, 64 nt, Human
uuuacggggagaaacuugauucugggaagauagcagaguacaaaccagcugccucacuucuguu

SEQ ID NO: 250949 - RNA, 64 nt, Human
cccucccaagcaccaugucagugucguacaaucuaccaaccaaccagugcugaagagauuuuag

SEQ ID NO: 250950 - RNA, 64 nt, Human
ucaauuaugucuguuuuuuaugcuaaguaggaaaaccaaccacacacauuagcaaaccggccuc

SEQ ID NO: 250951 - RNA, 64 nt, Human
auaguauauuuugauauuaggugguucuacacauaguuggcaaaaugacuugguaaauuuguaa

SEQ ID NO: 250952 - RNA, 64 nt, Human
uugaugucugagaaucaguucaaggcauaugcagaguuggcagagaaacugagagaaaagggau

SEQ ID NO: 250953 - RNA, 64 nt, Human
ccggcagaccuagggaaggugaggcgagguggggaguuggcagaauccccauaccucgcagauu

SEQ ID NO: 250954 - RNA, 64 nt, Human
ccuuaaauuuaaaucaugugauuuauaguuuuuaaguuggcauaauucaacuuaugguauaacu

SEQ ID NO: 250955 - RNA, 64 nt, Human
uauuuuguaaaugcuaauuuuuuaggacucuacuaguuggcauacgaaaauauauaaggaugga

SEQ ID NO: 250956 - RNA, 64 nt, Human
auuuaaacuuuuauuuuuacuuaucuuggucauaaguuggcauucucucacauuccacaugaua

SEQ ID NO: 250957 - RNA, 64 nt, Human
ccucgccaaggaacucguggcagaagagggcagcaguuggcaguagcugccgaugucugucccc

SEQ ID NO: 250958 - RNA, 64 nt, Human
cucccaucuuccugcaagucaucugcucacacacaguuggcagcacauagcguuuccuucuuuc

SEQ ID NO: 250959 - RNA, 64 nt, Human
uugguuuuugaaucccagaaagggucugccauggaguuggcagucaucacgguagauggcguau

SEQ ID NO: 250960 - RNA, 64 nt, Human
uuuauaauuuuaccauaaguuuuaccuauucguaaguuggcaguuuuagauagauaacauucug

SEQ ID NO: 250961 - RNA, 64 nt, Human
auuuggcugggcuacaauuuguuaauuccuaugaaguuggcacauuucaugaggggaaagggag

SEQ ID NO: 250962 - RNA, 64 nt, Human
uugggcagugccuccuccugggccugggucuggaaguuggcaggaacagacacacuccauguuu

SEQ ID NO: 250963 - RNA, 64 nt, Human
aacuugauccauuguaucaguaccucacaaucagaguuggcaaaugauggaugagugauucaag

SEQ ID NO: 250964 - RNA, 64 nt, Human
ucaucccugcgcuguccuagcacccugucgcuggaguuggcaugcagagacuuugucaggaugg

SEQ ID NO: 250965 - RNA, 64 nt, Human
uguauacuuuaacaugccccauacuuuguauuggagaguacaauaauguaaauccuaaaagcac

SEQ ID NO: 250966 - RNA, 64 nt, Human
auauuaaaaugcauggugugucuucucuuacuacagaguacaguugugaauuuggcuccgcgaa

SEQ ID NO: 250967 - RNA, 64 nt, Human
gaucuuauauguguauaauguuuauuuuguaccuagaguacauuuaaaaggguggagacuaagc

SEQ ID NO: 250968 - RNA, 64 nt, Human
uggaaauaaaagauuuucuauuauggaaauaaagaguuggcaugaaaguggcuacugaaaagca

SEQ ID NO: 250969 - RNA, 64 nt, Human
gcuggguaguuuaccgucccuucuauaggcauggaguuggcacugacaucacagcuucauaacc

SEQ ID NO: 250970 - RNA, 64 nt, Human
ccgcuggauugcacuuugagcccguggggugaggaguuggcaauuuggagagacaggauuuggg

SEQ ID NO: 250971 - RNA, 64 nt, Human
uuuguucaucuccacuuugugcuaacccauucauaguuggcaguuaaacacauacuccaaaaga

SEQ ID NO: 250972 - RNA, 64 nt, Human
uaucaaaacaagacaaaugcuguucagggaaagaaguuggcaagcuuaagguuaaacaaaaaua

SEQ ID NO: 250973 - RNA, 64 nt, Human
guguucagaaauaccaaccauaaaaauguaaucuaguuggcaaaggugugcgcuaaaacacgga

SEQ ID NO: 250974 - RNA, 64 nt, Human
cagcccuccacugccaaaggccaaaagcucagacaguuggcagacguccaguuagcucaucuca

SEQ ID NO: 250975 - RNA, 64 nt, Human
gcucagggccgguggacauguucacugguggaccaguuggcauugaccuaaacggacagagaaa

SEQ ID NO: 250976 - RNA, 64 nt, Human
cuguaauuuccccccaaaaucauauugguauucuaguuggcaaugucuuacauuuauguuaagu

SEQ ID NO: 250977 - RNA, 64 nt, Human
acuacacaggccaggaguggcauuccaugccacuaguuggcauccuuuugaacuuuugucuccu

SEQ ID NO: 250978 - RNA, 64 nt, Human
aggaaaugaagacuggauacuucuguaucugugaaguuggcacagguaacauuuggacauguuc

SEQ ID NO: 250979 - RNA, 64 nt, Human
aggcaucaugucaauggguguuucccucaagcuuaguuggcagcacucuccacacuucuguggc

SEQ ID NO: 250980 - RNA, 64 nt, Human
ugugguuugcguaauaaaacauuuguauuuaaugaguuggcauuaauucuuugagcacaucucu

SEQ ID NO: 250981 - RNA, 64 nt, Human
ucucugagguuauaauuuucacuuaacauugucgaguuggcauuuugguuuuaguccaaugguu

SEQ ID NO: 250982 - RNA, 64 nt, Human
uuguacauuuaaagcagcuguuuuggggucugugagaguacauguauuauauacaagcacaaca

SEQ ID NO: 250983 - RNA, 64 nt, Human
ccuuuggguggcaauuccagcuuagcaacgcagaagaguacaaaguguggaagccagggcccag

SEQ ID NO: 250984 - RNA, 64 nt, Human
ucaguuauaagcagugagguccuaaaguguuacaagaguacagucuaccccauguuaggcauau

SEQ ID NO: 250985 - RNA, 64 nt, Human
ccugguggacauggaaaggcuucucagccucuguaguuggcagcugggcuggacuucuggagaa

SEQ ID NO: 250986 - RNA, 64 nt, Human
aaacagugugauguguguuauccuaggaaaugagaguuggcaaacaacuucucauuuugaauag

SEQ ID NO: 250987 - RNA, 64 nt, Human
acuaaguuuuuuuuauuuuucccauugaacuccuaguuggcaauuuugcacauucauacaaaaa

SEQ ID NO: 250988 - RNA, 64 nt, Human
uggucuccucccuugucucuagugucuuucagaaaguuggcaauaccuuaacaaaugcacucug

SEQ ID NO: 250989 - RNA, 64 nt, Human
acauuggacugaauuagauuuucccauuucuaauaguuggcaccauuauaagcuauaagguuca

SEQ ID NO: 250990 - RNA, 64 nt, Human
acugauagugccuguuagaucuccuguuuguuucaguuggcagaacauuuacuggccccaacug

SEQ ID NO: 250991 - RNA, 64 nt, Human
uccacgcaccacccguucagggcccugaauaaacaguuggcaacagcacauuguuguccagucu

SEQ ID NO: 250992 - RNA, 64 nt, Human
caaaaauauacuuugcuauuggguaagguauaguaguuggcagcagaauggacccauugaggau

SEQ ID NO: 250993 - RNA, 64 nt, Human
uuguuuuuaaugaugcaagaguggacguaaugcuaguuggcaguauuuuauuguaagaaaucaa

SEQ ID NO: 250994 - RNA, 64 nt, Human
gcccaggagucagguguuuggagcgaggcagggcaguuggcacuccacuccuauuuggagggac

SEQ ID NO: 250995 - RNA, 64 nt, Human
uucaagaagcaggaaaggcaucagaagaaguaacaguuggcagagggucucaggaaaaacaucu

SEQ ID NO: 250996 - RNA, 64 nt, Human
gacagugagggaggaauggaaacgagagaugugaaguuggcagccggggcauggcguucaagau

SEQ ID NO: 250997 - RNA, 64 nt, Human
ggguaaaaauaacucaaaguguuucuuaagggugaguuggcaugcaaaaaauuacauugauuac

SEQ ID NO: 250998 - RNA, 64 nt, Human
cucuuggucugacuccaagguggugucagugcugaguuggcagagaaacacagggccuaggagg

SEQ ID NO: 250999 - RNA, 64 nt, Human
caaaucaagcuaaaauuuauuuaaguugauucugagaguacaggucaguaagccucauuauuug

SEQ ID NO: 251000 - RNA, 64 nt, Human
guuaacauuaaaaccagaaggcaguaugugcugcagaguacauaagaagaggcuuuaaaauuua

SEQ ID NO: 251001 - RNA, 64 nt, Human
auucuacccucaccuccaauauaaacacauuaaaagaguacaauaaaaauguuuaaaaucaugu

SEQ ID NO: 251002 - RNA, 64 nt, Human
uauuuugaauugugagcaaaaugccgagaaacccaguuggcauuuauacaaaauguugaccuca

SEQ ID NO: 251003 - RNA, 64 nt, Human
acuacuacuuuuuguauucuagacaguuuucaaaaguuggcagauuuuuuuuuuuguuuuuaag

SEQ ID NO: 251004 - RNA, 64 nt, Human
gcagagggacucagggauggggacugccaggggcaguuggcaaaaguccaaguagagauuacac

SEQ ID NO: 251005 - RNA, 64 nt, Human
cugggggaucccccagcugaaggaggcuggcaggaguuggcaagagaacccccugcccugucca

SEQ ID NO: 251006 - RNA, 64 nt, Human
augcucaaccacuguggcguucugcugccccugcaguuggcagaaaggauguuuugucccauuu

SEQ ID NO: 251007 - RNA, 64 nt, Human
aucuuaccagcaguuuguaaaggucuggaaucacaguuggcauccuuuauucaggucucuucuc

SEQ ID NO: 251008 - RNA, 64 nt, Human
uauuuaacuuuguguucccagguccuagcucaggaguuggcaaauaagaauuaaaugucugcua

SEQ ID NO: 251009 - RNA, 64 nt, Human
cccuguccagauuauuggcugcuuugccucuaccaguuggcagacagccguuuguucuacaugg

SEQ ID NO: 251010 - RNA, 64 nt, Human
caugagacugaacagccaaauggaggcuauguggaguuggcauugcauuuaccggcagugcggg

SEQ ID NO: 251011 - RNA, 64 nt, Human
uugucaauguuaguaauugugcagugaagggaaaaguuggcauuuugaaguauuuacuauguaa

SEQ ID NO: 251012 - RNA, 64 nt, Human
aaaguuagcuggaucgcucaaggucacuuagguaaguuggcaaguccaugcuucccacucagcu

SEQ ID NO: 251013 - RNA, 64 nt, Human
gaauggaagcaguggugguagcuacacugggcagaguuggcagggugcugguucacucugccca

SEQ ID NO: 251014 - RNA, 64 nt, Human
ccaugaaaggaauaauucaaauacagauaaacagaguuggcaguauauuauagugauaauuuug

SEQ ID NO: 251015 - RNA, 64 nt, Human
aaacuacaaccaaaaggcacacaaaaccguuuccaguuggcagcagagaucagggguuaccucu

SEQ ID NO: 251016 - RNA, 64 nt, Human
uacaguugagauaguuaagauauaaccacaagucagaguacauugguuguauuuuguaaacuuu

SEQ ID NO: 251017 - RNA, 64 nt, Human
augggagucaaaauaccccauucccucagcagacagaguacagagaagggccucagaggacacc

SEQ ID NO: 251018 - RNA, 64 nt, Human
auccaguauaguuaggcuguucauuccucauaauagaguacauaacagaaaagugggacuuuca

SEQ ID NO: 251019 - RNA, 64 nt, Human
ggaaaaaucccugauccuucaaggucagucagacaguuggcaacauuauaauuaaaaauaagaa

SEQ ID NO: 251020 - RNA, 64 nt, Human
aaccauauagaauuaacuuauuuuguccaaguacaguuggcauuuuccagaauaauuuuaccac

SEQ ID NO: 251021 - RNA, 64 nt, Human
uacuauauaagcugaucuggcuuugaaagaugugaguuggcaaguuccucacauagagucauug

SEQ ID NO: 251022 - RNA, 64 nt, Human
ucacuguuauacugaaauaucaaaguaaaauccuaguuggcaggauuguaaguagaccgaauuc

SEQ ID NO: 251023 - RNA, 64 nt, Human
uggaguugcaacuuagguggggguuggagucgaaaguuggcaaauggggccaaggcugcacaaa

SEQ ID NO: 251024 - RNA, 64 nt, Human
uauagaguauaacucaucguuuacaguauguuuuaguuggcaguaucauaccuagauggugaau

SEQ ID NO: 251025 - RNA, 64 nt, Human
ggccaucagcucaugccaggcuaugggggcagccaguuggcauugcuccccagacugaacagaa

SEQ ID NO: 251026 - RNA, 64 nt, Human
gcucguccccagccaggccuccugaggucuucauaguuggcacaguccacaucucuucuagcuu

SEQ ID NO: 251027 - RNA, 64 nt, Human
cacaaacauuccaguuagaggcagaggcugcgugaguuggcaagguagggagaagucauuguua

SEQ ID NO: 251028 - RNA, 64 nt, Human
uacgggagugccaaaccagcccucggcugcuaugaguuggcaagauggccgagucuacuucuuc

SEQ ID NO: 251029 - RNA, 64 nt, Human
augucaauugaucagguuaaaauuuucaguguguaguuggcagauauuuucaaaauuacaaugc

SEQ ID NO: 251030 - RNA, 64 nt, Human
aguucgccagcaaagccaggcaggccaagacuugaguuggcaacucagcugcugcugcuuccau

SEQ ID NO: 251031 - RNA, 64 nt, Human
ggcaacugguacagaaccaaccuagaggcuuugcaguuggcaagcuaacucgcggccuuauuuc

SEQ ID NO: 251032 - RNA, 64 nt, Human
ggagauugcaaagucuuggggaacuccacguguuaguuggcaucccaguuucuuaaacaaauag

SEQ ID NO: 251033 - RNA, 64 nt, Human
gaguucuauauuacaauuuugugauuauuaguacagaguacagcuaugcugugacuguuuugga

SEQ ID NO: 251034 - RNA, 64 nt, Human
auguuuuguuauucuuaauaucaacuguuugguaagaguacaguuguuuuuauacacucuaaga

SEQ ID NO: 251035 - RNA, 64 nt, Human
ccgucagagauggcgcaucucgcugcaucccccgagaguacaccgguugcucuagccaccugcg

SEQ ID NO: 251036 - RNA, 64 nt, Human
aucauuuaaugugacaguguucaguaaacaaaucaguuggcaggcaccagaagaagaauggauu

SEQ ID NO: 251037 - RNA, 64 nt, Human
uugauuagaggaacuucugaacuuggaaaggggaaguuggcagcaacucuccugggccacguau

SEQ ID NO: 251038 - RNA, 64 nt, Human
augguacaccuauuuaggacauuuaccaugaacaaguuggcaggacuggaagcuggcucugggu

SEQ ID NO: 251039 - RNA, 64 nt, Human
agccaugaacccccuggcacuaguaccagcaccuaguuggcaaguagugggugcaucucucaag

SEQ ID NO: 251040 - RNA, 64 nt, Human
cguaacuauauuuaauuauuuguuuugguaggacaguuggcagaaaagaguuaaagugaaaauu

SEQ ID NO: 251041 - RNA, 64 nt, Human
aaguauuaaaacaaacaaaaaggaaaguuguuucaguuggcaacacugcccauucaauugaauc

SEQ ID NO: 251042 - RNA, 64 nt, Human
aggguaggugggaaagaacagacaagccaugggaaguuggcaguggggagauuuccacugugga

SEQ ID NO: 251043 - RNA, 64 nt, Human
aacacaaauguaacaauguauuuuugugaaugagaguuggcaugucaaaugcauccucuagaaa

SEQ ID NO: 251044 - RNA, 64 nt, Human
uguggggaaagaaaagcagaauacuugagaugaaaguuggcauacaaauaggauacuaucgcca

SEQ ID NO: 251045 - RNA, 64 nt, Human
ggucagauggucaacuuuuuucaguauuauuuauaguuggcacuugauugcaguucugugaggc

SEQ ID NO: 251046 - RNA, 64 nt, Human
aauuuuugagaaggugaguggcaauuuauaauuuaguuggcaauuuauaauagaacuuauagcu

SEQ ID NO: 251047 - RNA, 64 nt, Human
agcaaggagcucagccagccgugguggggugcagaguuggcaggagugggagaaggaggagaga

SEQ ID NO: 251048 - RNA, 64 nt, Human
ucucaagcucauucacguuucaugaccaacugguaguuggcacugaaaaaacuuuucagggcug

SEQ ID NO: 251049 - RNA, 64 nt, Human
caauaugauucuuauuguaguauuuauauuacaaaguuggcauacagggucaauaucuaauuua

SEQ ID NO: 251050 - RNA, 64 nt, Human
ucuggggaaguuaaaguccauauaaugacugauaagaguacaauacaggugccaugggaacacg

SEQ ID NO: 251051 - RNA, 64 nt, Human
auacauaaaagcaacccaugcuuaugguuaaaaaagaguacaggagucuggaguccguugaagg

SEQ ID NO: 251052 - RNA, 64 nt, Human
gggccggacggaguggaucgggggcggccugagcaccaaccaccuugccggguguccucagcca

SEQ ID NO: 251053 - RNA, 64 nt, Human
gagcuggaaggccuccggaugcgugccagcaaugaguuggcacuggcagagcuggaggaggagg

SEQ ID NO: 251054 - RNA, 64 nt, Human
gccccuucucuggcugugcuuugccugagggaagaguuggcaagaggccagaauucuaguuugg

SEQ ID NO: 251055 - RNA, 64 nt, Human
uguucugcugauuguagggaugugcagggcugggaguuggcacuccccccgaguggggagguga

SEQ ID NO: 251056 - RNA, 64 nt, Human
acggggagccccaaauguccacgcccagaacaacaguuggcaggacaggugugacacagccaca

SEQ ID NO: 251057 - RNA, 64 nt, Human
acaagaaugcaauuucguuaacggagaugacuuaaguuggcagcaguaaucuucuuuuaggagc

SEQ ID NO: 251058 - RNA, 64 nt, Human
ucgauuauguuuugcuuagaucaguguugaacuaaguuggcauagcacacacuaacaguuguag

SEQ ID NO: 251059 - RNA, 64 nt, Human
guuuugacaauugcgcuauccuacacucugagggaguuggcaacgcaugcgguauaguggagug

SEQ ID NO: 251060 - RNA, 64 nt, Human
ugauguagcagcacuugccauguuauauauauguaguuggcauuugguucccaaaaaguaggau

SEQ ID NO: 251061 - RNA, 64 nt, Human
guggccccaccggacuagcacaugaugaauguaaaguuggcacaaugaaaaugacaucgcuuua

SEQ ID NO: 251062 - RNA, 64 nt, Human
augagaaaauuuuguguugacauuccauaagaugaguuggcauuagaauuggaaguccaguuua

SEQ ID NO: 251063 - RNA, 64 nt, Human
ggagguaacuacugacauucaaguggagaggguuaguuggcaguuaguucuauggucaucucuu

SEQ ID NO: 251064 - RNA, 64 nt, Human
gaggcacaguguuuacaggcucugguggcagagcaguuggcacaccugugggugaaucugccug

SEQ ID NO: 251065 - RNA, 64 nt, Human
gugugcugcccaucuuuacauacacauugcuucuaguuggcagaaauaauugauuaaaagacca

SEQ ID NO: 251066 - RNA, 64 nt, Human
ccuugaaccagaaccaacugcucaggcucacaaaaguuggcaaaaugcgggcugggcaggcagc

SEQ ID NO: 251067 - RNA, 64 nt, Human
gguaaugugauuuggguauaagaauacuaaaaccagaguacagggugugaaucauguaccagga

SEQ ID NO: 251068 - RNA, 64 nt, Human
uccaaaugauaaaauuuaagauuuuucuaauaaaagaguacagauaaugggacaguugagagag

SEQ ID NO: 251069 - RNA, 64 nt, Human
ugaagguaacuaagaagugguguuccaugacuucagaguacauccaugcggaguccauuauuug

SEQ ID NO: 251070 - RNA, 64 nt, Human
aagcgcaacccccgcaaaacgcauuugccaucacaguuggcacaaacgcaggguaaacgggcug

SEQ ID NO: 251071 - RNA, 64 nt, Human
cgcuccuucauuucagguuacucguucuucagcaaguuggcaaaacagacaucaugcuggugag

SEQ ID NO: 251072 - RNA, 64 nt, Human
uggggaccuguacacuagcaggaugggucuugggaguuggcauggggagauuguaagggcugua

SEQ ID NO: 251073 - RNA, 64 nt, Human
uuccuccucacauggcaggugagcacagacuucuaguuggcaggagcugaggagggugaacaaa

SEQ ID NO: 251074 - RNA, 64 nt, Human
ugucucgguuaaaauuuaugggacuuugcuauguaguuggcauuuauaaaaucugaaguaucau

SEQ ID NO: 251075 - RNA, 64 nt, Human
caccaagucuaaaaagaccuggccuuucacuuuuaguuggcauuuguuauccucuuguauacuu

SEQ ID NO: 251076 - RNA, 64 nt, Human
ugugugcuccuggcucagcagaaacauccauuugaguuggcaucccuguagggaucccagagcg

SEQ ID NO: 251077 - RNA, 64 nt, Human
cucuacccaccuauugcuggacuucuguuguacaaguuggcaaacacuggcuggaacugggcug

SEQ ID NO: 251078 - RNA, 64 nt, Human
ucucuccagccucucuuaggagggguaaugguggaguuggcaucuuguaacucuccuuucuccu

SEQ ID NO: 251079 - RNA, 64 nt, Human
aaaaaaaaaagaaagcagauccucauggcuauagaguuggcauuuuagccccagcuucuguagc

SEQ ID NO: 251080 - RNA, 64 nt, Human
gacagagcagccaggccguccuggcucacuuugcaguuggcacuggguuggggaggaagagagc

SEQ ID NO: 251081 - RNA, 64 nt, Human
cugcccccaccucaccuucucuacuccuccaguaaguuggcaguuuuggugccaaaccccaaau

SEQ ID NO: 251082 - RNA, 64 nt, Human
agguucauaccagguggggauuucaguuucagcaaguuggcaucauuuuuauaggguaggacag

SEQ ID NO: 251083 - RNA, 64 nt, Human
ggcuucaaagcugcacagagucuacguuuuagagaguuggcaccuuugaugugguagugagcug

SEQ ID NO: 251084 - RNA, 64 nt, Human
cuuccauuacugcugaauaggacauugcaugggaagaguacagagguggcagaaugaagcuaga

SEQ ID NO: 251085 - RNA, 64 nt, Human
ucucucuucacuuccuucuaaagagacuaauuugagaguacaggugcauauuaauuuucuuggu

SEQ ID NO: 251086 - RNA, 64 nt, Human
ucaguaccuucuuacugugcuaugcauuuuauugagaguacagaaaggaagaggaaccuuuuuu

SEQ ID NO: 251087 - RNA, 64 nt, Human
cuuuuagcugacaacauugcuuaaacaggauaguaguuggcaagaugaaaugccagaauuaaaa

SEQ ID NO: 251088 - RNA, 64 nt, Human
uugucuaacuuuuuacuuguuuaagcuuugccucaguuggcaaacuucauuuuaugugccauuu

SEQ ID NO: 251089 - RNA, 64 nt, Human
agaaagugacguaaucacgugcucgaugaagaacaguuggcacuuugcagauggccagugucac

SEQ ID NO: 251090 - RNA, 64 nt, Human
uguucugaucagugggugggugagguaggguuugaguuggcaagagcagggaacgggcaugugc

SEQ ID NO: 251091 - RNA, 64 nt, Human
auauuuauucauuauuugucaaauuguccgggguaguuggcagaaauacagucuuccacaaaga

SEQ ID NO: 251092 - RNA, 64 nt, Human
cuuaauguggaaguuaacccuuaccaaaaaaggaaguuggcaaaaacagccuucuagcacacuu

SEQ ID NO: 251093 - RNA, 64 nt, Human
accauuuuuaaaaugugaagauggacuucaugcaaguuggcagugguucugguacuaaaaauug

SEQ ID NO: 251094 - RNA, 64 nt, Human
auaaacaaggaagucagcucuuucacuuuuuacaaguuggcaaaaacagacuuccggggaauuu

SEQ ID NO: 251095 - RNA, 64 nt, Human
cugcaacuguggggccugcacacagcccuuccacaguuggcacugcaggugcaggccaacccuu

SEQ ID NO: 251096 - RNA, 64 nt, Human
uuccucacacacuuugauuuggagaauuggugcuaguuggcaauagauaacucagcguagauag

SEQ ID NO: 251097 - RNA, 64 nt, Human
ugucucuacaagaaauuaaaaauuagccaggcauaguuggcacgugccuguagcaccagcuacu

SEQ ID NO: 251098 - RNA, 64 nt, Human
caacaagcaccccgcuuuugcagcagaggagcugaguuggcagaccgggccccccugaaccgca

SEQ ID NO: 251099 - RNA, 64 nt, Human
gaagccaaugguauagacugccucuggggaagcaaguuggcaguucuugaacagcaucagauau

SEQ ID NO: 251100 - RNA, 64 nt, Human
cuggagcuaccuugcuuguugggggacuggguacaguuggcaagcuguguuuccaucagcuccc

SEQ ID NO: 251101 - RNA, 64 nt, Human
aaaauucaaagggaucauugaauaaaacggguguagaguacaggaauggggcagacgcgauuca

SEQ ID NO: 251102 - RNA, 64 nt, Human
cauugacuugaagugagacaugguuauagauaagagaguacaaaaugacucuuuuuccugucaa

SEQ ID NO: 251103 - RNA, 64 nt, Human
ccaaauaccuuaauuggugaugccuucuuggcaaagaguacaccacuguaagauauucugaguu

SEQ ID NO: 251104 - RNA, 64 nt, Human
cccaaagaauauuuuuguggaauauaagauucagaguuggcaguuguuuucuuuuagacuucag

SEQ ID NO: 251105 - RNA, 64 nt, Human
uccauucugcaggacuaucccauguauuacaaacaguuggcaaccuugcccugcucaccaaaug

SEQ ID NO: 251106 - RNA, 64 nt, Human
cuggcacaucucgugaaguuucauagaaacaaggaguuggcaucuuggaucucagaauggccug

SEQ ID NO: 251107 - RNA, 64 nt, Human
guaauuuuaaauauucaaaccaaaucuucccaacaguuggcaaguuguuuauuuuauauuauuu

SEQ ID NO: 251108 - RNA, 64 nt, Human
uaucccugcugaaauauugguacuagcaacuuaaaguuggcaagucucaucuucaguaauacgg

SEQ ID NO: 251109 - RNA, 64 nt, Human
uacacauacaauccauauacauauggaguauguaaguuggcaauaacaguauacaucaaaaaau

SEQ ID NO: 251110 - RNA, 64 nt, Human
acacaccgugaauccauucccaucaguccauuccaguuggcaccagccugaaccauuugguacc

SEQ ID NO: 251111 - RNA, 64 nt, Human
acuuuagaaucaagggugggggagggagggagggaguuggcaguuucaaaucgcccaagugaug

SEQ ID NO: 251112 - RNA, 64 nt, Human
accucauuucguuuauuuuauuuuuguaauagucaguuggcaaagcaaacugauuuuuuagacu

SEQ ID NO: 251113 - RNA, 64 nt, Human
guuugcaaaaucacugcccagcauguuugaggucaguuggcaccuuaaaacaccuguucuccag

SEQ ID NO: 251114 - RNA, 64 nt, Human
ugcuuugugcaggguccuccggggcucagcccugaguuggcaucaccugcgcagggcccucugg

SEQ ID NO: 251115 - RNA, 64 nt, Human
ugucucaccauguauuucucaauaaaccugcauuaguuggcauugcaaauguaugucucagcag

SEQ ID NO: 251116 - RNA, 64 nt, Human
uguagagagcagcauucccagggaccuuggaaacaguuggcacuguaaggugcuugcuccccaa

SEQ ID NO: 251117 - RNA, 64 nt, Human
uacuccaaaaccaucaccauguaccauguguuagaguuggcaaaaugugauugacuagagaugg

SEQ ID NO: 251118 - RNA, 64 nt, Human
aucuuagugucgugggaaauuuacuggggggcaaagaguacaggcaaauguggaagauaaagau

SEQ ID NO: 251119 - RNA, 64 nt, Human
cugccgaaguuuaccuccacuaguucuuuguagcagaguacauaacuacauaaugccaacucug

SEQ ID NO: 251120 - RNA, 64 nt, Human
guaaaauaaaauuucacacaauaaaaaacaacauagaguacacauauuuauauguauuuuuaaa

SEQ ID NO: 251121 - RNA, 64 nt, Human
cagaagggaaacugaggcucggcaagcauaggcgaguuggcaguggaacacggaucuaaacuca

SEQ ID NO: 251122 - RNA, 64 nt, Human
ccaucccagcuugaauuggugccacaagcuuccaaguuggcauuuuuucuagaaccugaucguc

SEQ ID NO: 251123 - RNA, 64 nt, Human
uucaaugcccccucccuuucugaaggcaggaaggaguuggcacagaggcccccugauccaauuc

SEQ ID NO: 251124 - RNA, 64 nt, Human
ugucucuuggggaccugaguuugggugggguggcaguuggcacagcgcagaugcgguagagaug

SEQ ID NO: 251125 - RNA, 64 nt, Human
gcuaccaaaggaagcacuaacuuuggugcuuucaaguuggcaaggagugcauuuaauagucaau

SEQ ID NO: 251126 - RNA, 64 nt, Human
caaguaggaaaaaaaauguacauggcaguguuuuaguuggcaauauaaucuuugaauuucuuga

SEQ ID NO: 251127 - RNA, 64 nt, Human
cuucucaacagacaugauaaaauucaccugcaugaguuggcaggugggagaaccaaacuggauc

SEQ ID NO: 251128 - RNA, 64 nt, Human
aagaggcagaccccggggcccucaggaaggagggaguuggcagcgggggcugcagcaggaguag

SEQ ID NO: 251129 - RNA, 64 nt, Human
auuacaaauuuacuuugcuucauguaauuuuacgaguuggcaauauuuucuuaaauuggaauac

SEQ ID NO: 251130 - RNA, 64 nt, Human
uuuaaaaagaaucgugucagaacucuuuuggaagaguuggcacuucauugucucuucaaccucu

SEQ ID NO: 251131 - RNA, 64 nt, Human
uuuaaauaaaaucaugucagaacucuuuuggaaaaguuggcacuuacccaguugucucuucaac

SEQ ID NO: 251132 - RNA, 64 nt, Human
cuuaaauuuauuuuuuugaaacagcugcagcaagaguuggcacuuauucagauguaucuucaac

SEQ ID NO: 251133 - RNA, 64 nt, Human
auuugccucaaucuccuauugccugcaggggagcaguuggcauaagcaacauuuagaaguuccu

SEQ ID NO: 251134 - RNA, 64 nt, Human
aauuuuauuuugugaagugaaggauuuguguuuuaguuggcaguuguuaaguccuuggcuugcc

SEQ ID NO: 251135 - RNA, 64 nt, Human
ggcaacauuacaaacaaaggauuugaaaacaccaagaguacaggucuucuuuaaggaagaauaa

SEQ ID NO: 251136 - RNA, 64 nt, Human
uauaugauuuagcacugugccaaacacauuuucaagaguacauuuugauauaaaaagaaacuau

SEQ ID NO: 251137 - RNA, 64 nt, Human
uuuuaagacaggaucucauucuguugcccagacuagaguacaauauugcaaucacagcucacug

SEQ ID NO: 251138 - RNA, 64 nt, Human
gugguagguguuugaacagaggccacauuacuagaguuggcaugacucuugacucuugccugcc

SEQ ID NO: 251139 - RNA, 64 nt, Human
aaaugguauaggaacaacuguacuuuuuuugaucaguuggcaugaagccauagaauuaaauuuu

SEQ ID NO: 251140 - RNA, 64 nt, Human
uugugcaaauguauuuacuaugcguguuuccagcaguuggcauuaaagugccuuuuucuaauaa

SEQ ID NO: 251141 - RNA, 64 nt, Human
ggcuggucaugagagcaaaccguaguccccuggagacagcgacuccagagaaccucuugggaga

SEQ ID NO: 251142 - RNA, 64 nt, Human
cuuguguauugcauuccagcagaccacugaaccagacagcgaagccaagaucauuguucuacuu

SEQ ID NO: 251143 - RNA, 64 nt, Human
cccuuuccauuuccucucauuccauucauggguggacagcgaccacaaagacucauggggcuuc

SEQ ID NO: 251144 - RNA, 64 nt, Human
agcugagauugugccacugcacuccagccugggugacagcgagacccugucucaaaauauguau

SEQ ID NO: 251145 - RNA, 64 nt, Human
ccuccuggcuccaagcuaagucacucaacagaaugacagcgaaccuccuggacccucaccauau

SEQ ID NO: 251146 - RNA, 64 nt, Human
ggaggaagaggaggcgagggaaucagaaauugaggacagcgaugcgggcagcuggggggcugag

SEQ ID NO: 251147 - RNA, 64 nt, Human
ugaaauagcaaauagaaaugugcaggagcggagggacagcgacaccugguucuuaagcaaauuc

SEQ ID NO: 251148 - RNA, 64 nt, Human
agccacccccaggggccuccacaggccgcugcaugacagcgauacaguacuuaagugucugugu

SEQ ID NO: 251149 - RNA, 64 nt, Human
ucugaauguuugaacugccaagaaaaggcauggagacagcgaacuagaagaaagggcaagaagg

SEQ ID NO: 251150 - RNA, 64 nt, Human
gagcacccuccacauggacucccaccugcaaguggacagcgacauucaguccugcacugcucac

SEQ ID NO: 251151 - RNA, 56 nt, Human
ugccccucucacacaugugagggccggacagcgaacuggaggggggagaaauuuuc

SEQ ID NO: 251152 - RNA, 64 nt, Human
gugggcaaagcagccaccccacagccuuguggcuagaguacagugggguagacccuccagcccc

SEQ ID NO: 251153 - RNA, 64 nt, Human
aaaagaagauauuaagugcuuuuuaacaacuccuagaguacaaaaugaguacaucauaaugcug

SEQ ID NO: 251154 - RNA, 64 nt, Human
cugucuagucugcuuauaaaguaggaauugcaucagaguacauauauucuugcuguacaaugcc

SEQ ID NO: 251155 - RNA, 64 nt, Human
cucggcucgggguuuuacugcagcagccggaggugacagcgacgccucagccgccucuguugcu

SEQ ID NO: 251156 - RNA, 64 nt, Human
uuuccgaaaauggaggcauuccuuuccaaaucuggacagcgaucguuuuuaguguuucugucuc

SEQ ID NO: 251157 - RNA, 64 nt, Human
cauucacaaaaauuaauauaauuuuuaauguagugacagcgauuuaguguuuuguuugauaaag

SEQ ID NO: 251158 - RNA, 64 nt, Human
uguuuccuuauaccagauccucagucucacuaaagacagcgauaugggagacacccaggggccu

SEQ ID NO: 251159 - RNA, 64 nt, Human
ccgaggagcuccaugcggcacugagugaguggcugacagcgauccgggcuugguuuugugaggu

SEQ ID NO: 251160 - RNA, 64 nt, Human
cuggauuccauaaacaguuuucgugcuuccuccugacagcgacagaaaaccucaagggcuuucc

SEQ ID NO: 251161 - RNA, 64 nt, Human
uuccucaugugguguaauuacagcccuaucuggagacagcgaauacagcaaacagauuuuauua

SEQ ID NO: 251162 - RNA, 64 nt, Human
guuucugaucuuguuuucccuguggauauuggaggacagcgagguucuuucugauacuaaaaac

SEQ ID NO: 251163 - RNA, 64 nt, Human
uuaaagauuuuauuuuuacaaaucacagcugauagacagcgaagccuuccccauagagaccgug

SEQ ID NO: 251164 - RNA, 64 nt, Human
ggacaggugaggggcucggacggagccguggggggacagcgacugggggccuccaugccuucac

SEQ ID NO: 251165 - RNA, 64 nt, Human
uuaaaauuaauauaucauuaucuuugcuguuauugacagcgauauaauuuuauuacauaugauu

SEQ ID NO: 251166 - RNA, 64 nt, Human
uguagaguugugugaaaccccuagcauagagacagacagcgaagagauggugugaaaagcuugc

SEQ ID NO: 251167 - RNA, 64 nt, Human
ucuuugcaaccucccagcugcgcucauuccagcugacagcgagaugcaagcaaaugcucagcuc

SEQ ID NO: 251168 - RNA, 64 nt, Human
ucggagggagcagcggaaugcggcgaagacucuggacagcgagggcacagggucccaaaccgag

SEQ ID NO: 251169 - RNA, 64 nt, Human
aacaaacuuucuucacuuuguauuauagguacaagacagcgacuuacguaucuuuucuccuccu

SEQ ID NO: 251170 - RNA, 64 nt, Human
uugaggaagguauucugucccacagguuucuguggacagcgauacagcaggagucagugaaauc

SEQ ID NO: 251171 - RNA, 64 nt, Human
aaaaaaaaucuuaaagccuguaauuucugagaaaagaguacagcauuuacucuuaucaucuaga

SEQ ID NO: 251172 - RNA, 64 nt, Human
uuagcuuguguauauaauuguguuguauagucucagaguacauucuaacccuacauuucuaauc

SEQ ID NO: 251173 - RNA, 64 nt, Human
agaagaagaguuaucccacagaaaaguugggaaaagaguacaaugaccuuuuuguaugaaaauu

SEQ ID NO: 251174 - RNA, 64 nt, Human
uuguggucugguaagaggggugcuggaggacauggacagcgacaaaccugaggccgugucuagg

SEQ ID NO: 251175 - RNA, 64 nt, Human
cuucuacauuugagggcccagccaggagcagauggacagcgaugaggggacauuuucuggauuc

SEQ ID NO: 251176 - RNA, 64 nt, Human
gcuucauugaccucuacuugcugaaggagaaaaagacagcgauaagcuuucaauaguggcauac

SEQ ID NO: 251177 - RNA, 64 nt, Human
cauguguggcccugucugcuuauccuuggaaggugacagcgauucccuguguagcucucacaug

SEQ ID NO: 251178 - RNA, 64 nt, Human
gggucggcggcccucaggagagaccaggaggacugacagcgaagaucgagcucagguucgccac

SEQ ID NO: 251179 - RNA, 64 nt, Human
acaguaauaggcacuggguccagccuugaucagugacagcgaaggaaguuaucugcugggaaca

SEQ ID NO: 251180 - RNA, 64 nt, Human
ucagcagccccggaagccugccucacccgacgaggacagcgagcggcccggcuccuuucugucu

SEQ ID NO: 251181 - RNA, 64 nt, Human
cugggcuaggaguuggacggaauggaggauggaggacagcgagaagaaaggaagagaaaugcaa

SEQ ID NO: 251182 - RNA, 64 nt, Human
accacacguagcccccaggcugcuggacacgucggacagcgaaguauccccgacaggacgggcu

SEQ ID NO: 251183 - RNA, 64 nt, Human
caguuugugguuaugaaaccgucuguggccucaugacagcgagagaugggaauacacuagaagg

SEQ ID NO: 251184 - RNA, 64 nt, Human
agccaagaucacagcacugcacugcugccugggcgacagcgagacucuaucucaaaaaaaaaaa

SEQ ID NO: 251185 - RNA, 64 nt, Human
gcucugggagagccagcuuugcuauucccauugugacagcgauggcaggccugacccacggggc

SEQ ID NO: 251186 - RNA, 64 nt, Human
ggagggugagaucaacacguacuggggccugcuggacagcgaggacagcaggcaaguuccacag

SEQ ID NO: 251187 - RNA, 64 nt, Human
uaacaagccaaaugaacagacaaguaaaagacaugacagcgauacuuucccagagcugaaguua

SEQ ID NO: 251188 - RNA, 64 nt, Human
ggaccuaguacccacugagauuuccacgccgaaggacagcgaugggaaaaaugcccuuaaauca

SEQ ID NO: 251189 - RNA, 64 nt, Human
gcaccagcacggcuaugacagugaugaggagguggacagcgagcugggcaccugggagcaccag

SEQ ID NO: 251190 - RNA, 64 nt, Human
caaaaaagagaaggaaacuuuuuaaauucaauuuagaguacauaaaaaaagaaauccgcgaagc

SEQ ID NO: 251191 - RNA, 64 nt, Human
aguuugaggacuacaguucaucacaggguucagcagaguacaagaccacugucuaauuuugacu

SEQ ID NO: 251192 - RNA, 64 nt, Human
guucacacagccaauagauuuggaaucaggccuaagaguacacauggaggguaaauauuaaagu

SEQ ID NO: 251193 - RNA, 64 nt, Human
ccuguccuggcucucccggcccugcucugauuaggacagcgaccucggauagcacagccagcua

SEQ ID NO: 251194 - RNA, 64 nt, Human
cacaaagcaaacuacuaaccacuagcucuuacuggacagcgauuucuggcuuauaagaguucuc

SEQ ID NO: 251195 - RNA, 64 nt, Human
ggcgucacuguauguaguucauggcuacuguacugacagcgagagcauguccaucuguuggaca

SEQ ID NO: 251196 - RNA, 64 nt, Human
cuccuguguaccaagguauugcuuuuauuuacacgacagcgacucaaaaggcacucgauuaaug

SEQ ID NO: 251197 - RNA, 64 nt, Human
cuugcuuuuccugugcacacauguagcccaucaggacagcgagccgacgggucacgccaggggc

SEQ ID NO: 251198 - RNA, 64 nt, Human
gggccacccccaaguguugggccaucugccaagagacagcgacccaaagccgaaggacaggugg

SEQ ID NO: 251199 - RNA, 64 nt, Human
augggguaaggagaggccccagaaccccaaagcagacagcgagacccccagcggcagaggccuc

SEQ ID NO: 251200 - RNA, 64 nt, Human
guccuguaaacugugccaacuucaccuguccagggacagcgaagcuggggguggcggggggcau

SEQ ID NO: 251201 - RNA, 64 nt, Human
ggacgcuuagagucggcagagucugggguagggagacagcgacuuguccaaggucaagcacaga

SEQ ID NO: 251202 - RNA, 64 nt, Human
ugguccccaugaaggcauucagaguccaccugcagacagcgagagccccaggaagguuugcaca

SEQ ID NO: 251203 - RNA, 64 nt, Human
uucucuauuggcauuuuuccgauucuguucagaugacagcgaccgccuuuucauuccccccgcc

SEQ ID NO: 251204 - RNA, 64 nt, Human
ggccgggaucguacuacugcacuccagcauggaagacagcgagacuccgucuccaaaaaaaaaa

SEQ ID NO: 251205 - RNA, 64 nt, Human
uuggccucgguggcaggggagccccgcagagcuggacagcgacacgcagggggcucggaggacu

SEQ ID NO: 251206 - RNA, 64 nt, Human
guguuuaguuuacauauuguaauucauuuuuaagagaguacagacauacacuuuuugaguaggc

SEQ ID NO: 251207 - RNA, 64 nt, Human
uggaccacauauucuccauuuugcauugagcaguagaguacaguggaaagggaauaagaauacu

SEQ ID NO: 251208 - RNA, 64 nt, Human
uaacuacuacuuuuggaggaaacuuggaacaagaagaguacauaguuugauccauuccuacggu

SEQ ID NO: 251209 - RNA, 64 nt, Human
uggccaacaggguagauuucucuugggcaggcagagaguacagacugcagacauucucaaagcc

SEQ ID NO: 251210 - RNA, 57 nt, Human
aauaccauaaacccugcugaagacaggagaguacagaaugacaacauugagcccaca

SEQ ID NO: 251211 - RNA, 64 nt, Human
uuuugagacacggucugacucugucacccaggcuagaguacaguggugcaaucuuggcucacug

SEQ ID NO: 251212 - RNA, 64 nt, Human
cucccucaccuucuccaaaucuaggugaaaucacagaguacaaaacgugagaaugcugaaugug

SEQ ID NO: 251213 - RNA, 64 nt, Human
agaucuguaaacugggcucaaggacuguacaagcagaguacaacuacccgccuccccggugcca

SEQ ID NO: 251214 - RNA, 64 nt, Human
uuaucagucuguuuuccgaugauguguacaugaaagaguacaccaugugaagagaagagagaau

SEQ ID NO: 251215 - RNA, 64 nt, Human
cuauguauaugucuuaccucaucuccuaaaaggcagaguacaaaguaagccauguaucucagga

SEQ ID NO: 251216 - RNA, 64 nt, Human
uugagguuaucaucucaaugaggcuuaagcuccuagaguacaggaccauuuuguugauugucuu

SEQ ID NO: 251217 - RNA, 64 nt, Human
cugcugccggcucugggccugaggguccaccuggagaguacauuugcuuuaaugagugcaccug

SEQ ID NO: 251218 - RNA, 64 nt, Human
ccagauuucagauuuggccuccgucacuuaauccagaguacaggggcuggggucagggaaggaa

SEQ ID NO: 251219 - RNA, 64 nt, Human
gcgaaaaucaccaaggagacuuugcauuaaguucagaguacaauacaaacugggccuagcucug

SEQ ID NO: 251220 - RNA, 64 nt, Human
uuucucugaaaaaucaucgagacaaaagagccacagaguacaaguuuuuaugauuuuauaguca

SEQ ID NO: 251221 - RNA, 64 nt, Human
uaauuuaauauacuugauucagaaacaaaacaauagaguacaaaagugccaagcagaacauaaa

SEQ ID NO: 251222 - RNA, 64 nt, Human
ucagaacaaaacuucuauuauccagagucaugggagaguacacccuuuccaggaauaauguuuu

SEQ ID NO: 251223 - RNA, 64 nt, Human
gguauuuuuuacucuaucugugauacucuaagauagaguacaugcaacaaagaucuguucugcu

SEQ ID NO: 251224 - RNA, 64 nt, Human
aaguugaaguuuaauugugcaacaaauuuguauuagaguacaauuuaaaguguuuuucucuaua

SEQ ID NO: 251225 - RNA, 64 nt, Human
gagcuccaguuucucuuaagcugcccaauuucacagaguacaaaauaguuguaggggaaaucaa

SEQ ID NO: 251226 - RNA, 64 nt, Human
cccaaggucacauagcuaguuaugugagaaaguuagaguacagauccucugggguuucagcuua

SEQ ID NO: 251227 - RNA, 64 nt, Human
uuuuuauacuuaacucuucaguagagguuuacaaagaguacaaagguuaaauuacaaauucauu

SEQ ID NO: 251228 - RNA, 64 nt, Human
aaauuuuuguuuuugauuuauggauaauuucuuaagaguacacacuuuagauacacaaauaauc

SEQ ID NO: 251229 - RNA, 64 nt, Human
uucauucacuggaauuuacucacgcaaucucaguagaguacaacguagauacagaaccuaggag

SEQ ID NO: 251230 - RNA, 64 nt, Human
acugguuuaaggauagacauacggagcagaauaaagaguacagauaugaacacuuauacuuacg

SEQ ID NO: 251231 - RNA, 64 nt, Human
uuguugcaucacagaagggcguauuucgaaaaccagaguacagucuuaagugacagcacugaac

SEQ ID NO: 251232 - RNA, 64 nt, Human
acaauuaggacguggcaaugagaccuggcagggcagaguacaagcccagcacccagugucccag

SEQ ID NO: 251233 - RNA, 64 nt, Human
acaugcacagucauacaagucauggucacaguaaagaguacacucagccacugucacaggcaua

SEQ ID NO: 251234 - RNA, 64 nt, Human
aacauguuaaagggauuuuuaaauaaaguugcaaagaguacaaaugauaauuggccaugcaaau

SEQ ID NO: 251235 - RNA, 64 nt, Human
uuuaccagcccuuggacacuaugggaggagggcaagaguacaccaauuuguuaaaagcaagaaa

SEQ ID NO: 251236 - RNA, 59 nt, Human
gucaaucccaguugaauuaauuggcaugaagaguacagauguaaucacaaguaaugcaa

SEQ ID NO: 251237 - RNA, 64 nt, Human
uuucaugcauuaaaaauaguaugauaaagauuucagaguacaggucugguacaaucacaguuca

SEQ ID NO: 251238 - RNA, 64 nt, Human
uugaaagaacuuagggaggaccauuggcuugccaagaguacagaaauucauuaugcugcuaauu

SEQ ID NO: 251239 - RNA, 64 nt, Human; identical to SEQ ID NO: 28124

SEQ ID NO: 251240 - RNA, 64 nt, Human; identical to SEQ ID NO: 28125

SEQ ID NO: 251241 - RNA, 64 nt, Human; identical to SEQ ID NO: 28126

SEQ ID NO: 251242 - RNA, 64 nt, Human; identical to SEQ ID NO: 28127

SEQ ID NO: 251243 - RNA, 64 nt, Human; identical to SEQ ID NO: 28128

SEQ ID NO: 251244 - RNA, 64 nt, Human; identical to SEQ ID NO: 28129

SEQ ID NO: 251245 - RNA, 64 nt, Human; identical to SEQ ID NO: 28130

SEQ ID NO: 251246 - RNA, 64 nt, Human; identical to SEQ ID NO: 28131

SEQ ID NO: 251247 - RNA, 64 nt, Human; identical to SEQ ID NO: 28132

SEQ ID NO: 251248 - RNA, 64 nt, Human; identical to SEQ ID NO: 28133

SEQ ID NO: 251249 - RNA, 64 nt, Human; identical to SEQ ID NO: 28134

SEQ ID NO: 251250 - RNA, 64 nt, Human; identical to SEQ ID NO: 28135

SEQ ID NO: 251251 - RNA, 64 nt, Human; identical to SEQ ID NO: 28136

SEQ ID NO: 251252 - RNA, 64 nt, Human; identical to SEQ ID NO: 28137

SEQ ID NO: 251253 - RNA, 64 nt, Human; identical to SEQ ID NO: 28138

SEQ ID NO: 251254 - RNA, 64 nt, Human; identical to SEQ ID NO: 28139

SEQ ID NO: 251255 - RNA, 63 nt, Human
ccaccggcgucgcuggguucuucggugcuucuggccgagcaggcggccuacuugggcagggcu

SEQ ID NO: 251256 - RNA, 63 nt, Human
agccggagcccccgccgcuccacagucccuggggccgagcacgagugaguggacacugccccg

SEQ ID NO: 251257 - RNA, 63 nt, Human
aagagaaggaaaggaaagagacggggcucugaggccgagcacaguggcccaugccuauaaucc

SEQ ID NO: 251258 - RNA, 63 nt, Human
cgcgccccugcucccugcgucugggagagcgaggccgagcaaggaaagcauuucgaaccuucc

SEQ ID NO: 251259 - RNA, 64 nt, Human; identical to SEQ ID NO: 28140

SEQ ID NO: 251260 - RNA, 63 nt, Human
gcgaccccgaccgucccugcugcuccccuaggacgcggcuaaacucuuggccaaaaggcggua

SEQ ID NO: 251261 - RNA, 63 nt, Human
uccgaacauuuucugaauucccauuuucuuguucgcggcuaaaugacaguuucugucauuacu

SEQ ID NO: 251262 - RNA, 63 nt, Human
ccuuggcggacacugggggaggagaggaagaagcgcggcuaacuuauuccgagaaugccgagg

SEQ ID NO: 251263 - RNA, 63 nt, Human
cuaugcaauacaggguuccacuuuagaagugcgcgcggcuagggucaccgcccgcccuucccg

SEQ ID NO: 251264 - RNA, 63 nt, Human
gggcacgggcggccuccuauuggccgggcaccgcgcggcuagcggagguugcgucucauuggc

SEQ ID NO: 251265 - RNA, 63 nt, Human
cgcugguccccaguggugaccaagcuggugaaccgcggcuaccagccccaccuggaggacuuu

SEQ ID NO: 251266 - RNA, 64 nt, Human
aagaccguacucaguaacaggccggaaaauugugcucuagaagaauaaaacugaaaaacucuag

SEQ ID NO: 251267 - RNA, 64 nt, Human
ucauaagguaaacauucuauauauucuaugccugcucuagaauugaaagacuucagcaguauua

SEQ ID NO: 251268 - RNA, 64 nt, Human
acuccacaucugccuuaaaaccaaagagggcuuccucuagaagccaagggaaaggggugcuuuu

SEQ ID NO: 251269 - RNA, 64 nt, Human
aaggaacauuauggagagaaaggguacugaggcacucuagaaucugccacauucauuuucaaau

SEQ ID NO: 251270 - RNA, 64 nt, Human
uuuuuacacacuugacuuuuuaaaaauacaaccaaccaaccaccacaacuucuuauacauuugg

SEQ ID NO: 251271 - RNA, 64 nt, Human
auccuuuuacuuuguuuuagccaccuauaguguuaccaaccaucuuuauccuugucugcaggga

SEQ ID NO: 251272 - RNA, 64 nt, Human
gagccugaagggucaagugcugucuaccaucaacaccaaccagaugaacaacacacacgcugcu

SEQ ID NO: 251273 - RNA, 64 nt, Human
gaggcagcuggaauuggaacucagauuuguugaacucuagaacuaaagaucauaauguugucuu

SEQ ID NO: 251274 - RNA, 64 nt, Human
uuucagaguucaaggaagaagcaaaauaucacaucucuagaaguguugggaaaaauauaauuuc

SEQ ID NO: 251275 - RNA, 64 nt, Human
uacuccuaaguuauuucucauagaacccagccuacucuagaauuucagcagugacauuggagaa

SEQ ID NO: 251276 - RNA, 64 nt, Human
aaaauacaccagcucauuuggcugcucagucuaacucuagaauggaugcuuuugaauucauuuc

SEQ ID NO: 251277 - RNA, 64 nt, Human
uuagagaggaauuaacuuccuggucugugcccuucucuagaagaauauaagaugcuccuccucc

SEQ ID NO: 251278 - RNA, 64 nt, Human
ggcugggaggaaagugcugggcaucuuacaguaacucuagaaguuccuuugacuaggcugcaau

SEQ ID NO: 251279 - RNA, 64 nt, Human
ccugaagccauuggagagcugucuuccuguguaccucuagaaucccagcagcagagaaccauca

SEQ ID NO: 251280 - RNA, 58 nt, Human
gcccuuccuucgcccgcuaacaccacuccucuagaacucggugguaaugacugggagg

SEQ ID NO: 251281 - RNA, 64 nt, Human
gagaaguauguggacaucucuucuuuuccugucccucuagaagaacauucucccuugcuugaug

SEQ ID NO: 251282 - RNA, 64 nt, Human
cuuaagauccucacagcacgggagcagggagaggcucuagaacaagguuucacaaccgagaugc

SEQ ID NO: 251283 - RNA, 64 nt, Human
ucucauuacccuuuucuggguuugaagcugcugucucuagaagugccaucucaauugugcuuug

SEQ ID NO: 251284 - RNA, 64 nt, Human
guguccagaccauugucuuccaaccccagcuggccucuagaacacccacuggccaguccuagag

SEQ ID NO: 251285 - RNA, 64 nt, Human
guguuaucaaggaauuguacugugcuacaauuaucucuagaaucuccagaaagguggagggcug

SEQ ID NO: 251286 - RNA, 64 nt, Human
gaguccugauccuaacccugggcucccuggaggacucuagaagcucagguucccugccacacua

SEQ ID NO: 251287 - RNA, 64 nt, Human
cucuguuuugcccaggggcucccgcuuuuucuugcucuagaagagcaguauucaaccuuuuagc

SEQ ID NO: 251288 - RNA, 64 nt, Human
acugaucaucauaacucuguaucugagcagugauaccaaccacaucugaagucaacagaagauc

SEQ ID NO: 251289 - RNA, 64 nt, Human
auauccaacuaaaaauuacgcuaucuagaauuguaccaaccaaaaucucguauuggcagaucuu

SEQ ID NO: 251290 - RNA, 64 nt, Human
uuugcacuuuguguggauugagguguucagaaauaccaaccauaaaaauguaaucuaguuggca

SEQ ID NO: 251291 - RNA, 64 nt, Human
ccagacuauggauguguucucuaggccuucaggacucuagaauguccauauuuauuuuuauguu

SEQ ID NO: 251292 - RNA, 64 nt, Human
gcaguaacaaacuccagucuguugcaguaacaaacucuagaauauugacauucucuguggggga

SEQ ID NO: 251293 - RNA, 64 nt, Human
aucccucuuagcuguagucuauauuagggcaguucucuagaacgcccacauuuccaccaacuca

SEQ ID NO: 251294 - RNA, 64 nt, Human
gcuaguagguucugcuguuaugcagagccauuuccucuagaauuuggauaauaaagaugcuuau

SEQ ID NO: 251295 - RNA, 64 nt, Human
aaugacaauguagcuugaaagcgaugaagaaugucucuagaagagaaugaaggauugaagaauu

SEQ ID NO: 251296 - RNA, 64 nt, Human
uugaauauauugguugcucauuuuugaagagagucucuagaauauagauuuucacuucuuuuga

SEQ ID NO: 251297 - RNA, 64 nt, Human
uaugauaugauaauccuaccaauuuucaagaagucucuagaaagagauaacacauggaaagacg

SEQ ID NO: 251298 - RNA, 64 nt, Human
agccagccauauuacucuagucccuaccaaacugcucuagaaggucauuuccauuuuguuugug

SEQ ID NO: 251299 - RNA, 64 nt, Human
gauugaaaguaagaaaacggauuuaggaugaaaacucuagaacuacccuaugcuguuuauacug

SEQ ID NO: 251300 - RNA, 64 nt, Human
acuacagucagauuuauagccagccaucuaucaccucuagaagguuccagagacagugaaacug

SEQ ID NO: 251301 - RNA, 64 nt, Human
auccucuuuaaaaaaaaaaaaguuuuuguuauaucucuagaacauuucaagucuuuuccuuuuu

SEQ ID NO: 251302 - RNA, 64 nt, Human
ccacagaacguauagaguuaaccaaagugcucuucucuagaaucuuuacaccuccugugugguu

SEQ ID NO: 251303 - RNA, 64 nt, Human
uaguccccuaaauuucuguucuaguuuuaaauuucucuagaacuugcaauaguuggggguuuua

SEQ ID NO: 251304 - RNA, 64 nt, Human
agucucggccuccacauuaaccauaggauguugacucuagaaccuggacccacccagcgcgucc

SEQ ID NO: 251305 - RNA, 64 nt, Human
uuuuaauuuucuugugagauaauauucuaagaggcucuagaaacaugaaauacucaguagugau

SEQ ID NO: 251306 - RNA, 64 nt, Human
aguuuuuuugcuguuauccagauaauuaauaaaaaccaaccacgcaaaacugggucccacccuc

SEQ ID NO: 251307 - RNA, 64 nt, Human
uguagcagcagagacgccuuggaguuuaacccccaccaaccagagcgugggcugguaaagauga

SEQ ID NO: 251308 - RNA, 64 nt, Human
uuuuagacguuuggacuugaagccucaaagaucaaccaaccaguccccuuauuuaguaaauaag

SEQ ID NO: 251309 - RNA, 53 nt, Human
ucauaagcuccccuuccuaaucacucuagaagcugauuccccaaagguaagac

SEQ ID NO: 251310 - RNA, 64 nt, Human
gaggacaccauguacuauaaccaguuaaauggaacucuagaauaucaagggagcaagaggaagc

SEQ ID NO: 251311 - RNA, 64 nt, Human
uaaucaaaaacaaagaagcccuauaagaccauuucucuagaacagauguucuuaauauuuuucu

SEQ ID NO: 251312 - RNA, 64 nt, Human
uuggagcauguggucuuuuuaaaaaauuguaacccucuagaaaauaucaaagaaaugaaccaga

SEQ ID NO: 251313 - RNA, 64 nt, Human
caguuacugagaauuguugugcuuugacaguuaacucuagaaagaaagaacacuaccacugcaa

SEQ ID NO: 251314 - RNA, 64 nt, Human
aagaaaaaaguacugugaccugagagacacccuccucuagaauuuaguggcgggucugggcugg

SEQ ID NO: 251315 - RNA, 64 nt, Human
ucugaaacacauguguaacaaucaaaauggugggcucuagaaugguuuuggagcucgagaucuu

SEQ ID NO: 251316 - RNA, 64 nt, Human
uggucuccauucaggcaaguguguuucagcaaaucucuagaaauuuacauugauuaaaauguua

SEQ ID NO: 251317 - RNA, 64 nt, Human
cuuugauaauuguuauuuuuuuggcagauaauuccucuagaauguguaucuuuuuaugauuuag

SEQ ID NO: 251318 - RNA, 64 nt, Human
augacccaacauuucuuagcaugagcuaccucaucucuagaagcugggauggacuuacuauucu

SEQ ID NO: 251319 - RNA, 64 nt, Human
agaaacaccuuaaguguauacuguuguguaaugucucuagaaaggaauccugucuuaaaacugg

SEQ ID NO: 251320 - RNA, 64 nt, Human
ccugcuaccuaaaggauauaaagaaauacuauugcucuagaauguauuacuuuguucucccaug

SEQ ID NO: 251321 - RNA, 64 nt, Human
aggccuagaaccaguuuuaagauuaugccuacaucucuagaagacuaguacacuggcaucaucu

SEQ ID NO: 251322 - RNA, 64 nt, Human
ugccugggcccaaggggugaugaggcauccuuuccucuagaagaccugagucuuccugaccgac

SEQ ID NO: 251323 - RNA, 64 nt, Human
ucuagacaaaaaccauuguugaugaggcagaugccucuagaagagacguuuaaaagccaucaaa

SEQ ID NO: 251324 - RNA, 64 nt, Human
uucugaggaucauuugucuugguaguauaguaaaaccaaccagcugaaccuuucaggcuacaag

SEQ ID NO: 251325 - RNA, 64 nt, Human
aaaccuaaacaccgagccucauuaacccaagugaaccaaccaaagucaccaguucagaagugcu

SEQ ID NO: 251326 - RNA, 54 nt, Human
ggcccacccaccaggccugagggggccgagcagggccagcccagugacuggugu

SEQ ID NO: 251327 - RNA, 64 nt, Human
gaaguuccacaucaucuuaucgaucaagaagcuacucuagaagucggagcagaggaugguacag

SEQ ID NO: 251328 - RNA, 64 nt, Human
uuguccuguugccaaacaaaagccagucauguaacucuagaagcagugacugguggggcuuucu

SEQ ID NO: 251329 - RNA, 64 nt, Human
ugugaugcuucuggggcacguugaccauaugcaccucuagaaccuaaccagggcuuccuucuac

SEQ ID NO: 251330 - RNA, 64 nt, Human
ugagagcguuccuugaguccguacaccguccucccucuagaagcuggcaucacacucaugcugg

SEQ ID NO: 251331 - RNA, 64 nt, Human
auaugaaguuccccaaggaaacgaacaaaaugaacucuagaauaucuagcaaauaguuaaagaa

SEQ ID NO: 251332 - RNA, 64 nt, Human
uugcauggaagagaacaccucuuuauggcuuacccucuagaauuucuaauuuauguguucuguu

SEQ ID NO: 251333 - RNA, 64 nt, Human
uagcaccugggucccagcaucuagagcauggagccucuagaagccaugcucacccgcccacauu

SEQ ID NO: 251334 - RNA, 64 nt, Human
acaucaggaaagagagcaccacgugauggaguuucucuagaagcuccagugauaagagauguug

SEQ ID NO: 251335 - RNA, 64 nt, Human
gaagugugacucaaucuugccugccuucugggagcucuagaauuguucccaacccaguccaugg

SEQ ID NO: 251336 - RNA, 64 nt, Human
gucccuuccccagagaccuucagugccauccugacucuagaaggccccccacagcagggcguag

SEQ ID NO: 251337 - RNA, 64 nt, Human
gccuugaaagaaccgaagucuuucccauucacuucucuagaaagcugccaagacagaggcagaa

SEQ ID NO: 251338 - RNA, 64 nt, Human
uggcaggcuccaggcaggguccucugggaaguuacucuagaaaacgaagggaggaggagcacaa

SEQ ID NO: 251339 - RNA, 64 nt, Human
caaaacauaaccauauguguuuugcguuuacuuccucuagaaaagaauuugcaggcaaccaugu

SEQ ID NO: 251340 - RNA, 64 nt, Human
uggaagaaacaacuucuuuaaagagcuucuuuggcucuagaaaaauuucaaacaauuaaaauaa

SEQ ID NO: 251341 - RNA, 64 nt, Human
agaaauaauuuuuuucaaauaagaaaauuguguacucuagaaauggagaccgauuuacaauuua

SEQ ID NO: 251342 - RNA, 64 nt, Human
cuacuuucuuuuauauugccuauauaagcaaaaaaccaaccacuguauuaaagcaaacuaagcc

SEQ ID NO: 251343 - RNA, 64 nt, Human
cauuucuaaagauggacaggcccuuuggcgugguaccaaccagauaaugacugcaucaggauga

SEQ ID NO: 251344 - RNA, 64 nt, Human
aauuaaaugaaacaaaucuaaaagugaaacaaaaaccaaccaacaaauacaacacaaagcaauu

SEQ ID NO: 251345 - RNA, 64 nt, Human
uuacuccuccuccagauaccaacugcugauguugcucuagaaaaaccaccaaacaugacuguuc

SEQ ID NO: 251346 - RNA, 64 nt, Human
ugauuaggauuugauuucuugaaacccucuaggucucuagaacacugaggacaguuucuuuuga

SEQ ID NO: 251347 - RNA, 64 nt, Human
gggacuuuauuuucacauaagucaauagauguuucucuagaacaaaauauuuaguaaagcuuua

SEQ ID NO: 251348 - RNA, 64 nt, Human
cuuaaaaaauguccaugauggaauauuccccuaucucuagaauuuuaagugcuuuguaauggga

SEQ ID NO: 251349 - RNA, 64 nt, Human
gguaauuuuacacaugcuggaaugacuguaauuacucuagaauuccaaguagaauacaauaacu

SEQ ID NO: 251350 - RNA, 64 nt, Human
agauaacucuuaaaaaaccgucgagauuacaaugcucuagaaucagcauauaagaaaauaaaug

SEQ ID NO: 251351 - RNA, 64 nt, Human
uacaauauuacauuacagccuguauucauuuguucucuagaaguuuugucagaauuuugacuug

SEQ ID NO: 251352 - RNA, 64 nt, Human
uauuguaacuacacugggcaucagaauaaaaggccucuagaaauugcugaacaaugguuaauua

SEQ ID NO: 251353 - RNA, 64 nt, Human
cucucuccuucauuaauuuaaauauuuuuaucggcucuagaaaaugcauaagguuaguacaaga

SEQ ID NO: 251354 - RNA, 64 nt, Human
ucacucucugcacugacuuuuuaauuauuuaaaacucuagaaagaugaacaaagguuaauuuaa

SEQ ID NO: 251355 - RNA, 64 nt, Human
aacuauucuguugugacuaugagaacauuucugucucuagaagucaucugucuguauugaucuu

SEQ ID NO: 251356 - RNA, 64 nt, Human
cauucuccuauuuaccaguccuguccuauauacccucuagaaacagaaagcaauuuuuaggcag

SEQ ID NO: 251357 - RNA, 64 nt, Human
aagugucacauuucucuaagaugaaagauuuuuacucuagaaacugugcgagcacaacacacac

SEQ ID NO: 251358 - RNA, 64 nt, Human
gcagcuuugggaaagcugccucguuucccuuuuccucuagaagcagaaccagcucuacgagagu

SEQ ID NO: 251359 - RNA, 64 nt, Human
gaaugcccugacucuaccagcgcccauaaaugaucucuagaaggacuguuaguaccaaucuguu

SEQ ID NO: 251360 - RNA, 64 nt, Human
uagaugagaacucugggaaaacuugggaauggcaaccaaccaaaaucauuuuuaaucauuuauu

SEQ ID NO: 251361 - RNA, 64 nt, Human
caaauaaaguccaaaggcauuuucuccugugcugaccaaccaaauaauauguauagacacacac

SEQ ID NO: 251362 - RNA, 64 nt, Human
agauuaccuuccuguuuuagccuucugucuugucaccaaccauucuuacuugguggccauguac

SEQ ID NO: 251363 - RNA, 64 nt, Human
caaaauauaccauaggcuaaaacuaaggcuuucacucuagaaugcaaagcuguuuugcagcugu

SEQ ID NO: 251364 - RNA, 64 nt, Human
auucccaucugcugcucuuuguagaaaagguuuccucuagaacugaauuccucuggaauugagu

SEQ ID NO: 251365 - RNA, 64 nt, Human
guguaaacauugagcucaccuuuuauauauuaaccucuagaauuaaugggccuaugugguuuuu

SEQ ID NO: 251366 - RNA, 64 nt, Human
auaaaauauuuagcccuuccuugguagguagcuucucuagaauuuaauugugcuuuuuuuuuuu

SEQ ID NO: 251367 - RNA, 64 nt, Human
auacuuugccaaagcugucaucuuguaauauaugcucuagaaaugacauaaagguuuaugggga

SEQ ID NO: 251368 - RNA, 64 nt, Human
agaaccugaaauauuguuuucuuccuugaauuuucucuagaaaugcagaaauuaggaaggugau

SEQ ID NO: 251369 - RNA, 64 nt, Human
ggugaaucuuguuuuuuuuaucuuuaaaauauaucucuagaacuuaaagcugaaaucugcaaau

SEQ ID NO: 251370 - RNA, 64 nt, Human
aaaccucaagggauuuagugcccugucucccugucucuagaagccuuagccugggcaccuggcu

SEQ ID NO: 251371 - RNA, 64 nt, Human
augaaaugggaaucaguggucuuacuauauacuucucuagaagagauuacuuaagacuguguca

SEQ ID NO: 251372 - RNA, 64 nt, Human
ccauggugggaaacagccaccgagaagguucuagcucuagaaagggacuaaacuuauucucuca

SEQ ID NO: 251373 - RNA, 64 nt, Human
aguucuuacccaguuaacaugaagaaaccacugucucuagaagaaagcuuguuuugcaguauua

SEQ ID NO: 251374 - RNA, 64 nt, Human
ugaccaguugcacauguuuuccccuaaaagcuuacucuagaaaggauauuuuuuggagagggag

SEQ ID NO: 251375 - RNA, 64 nt, Human
uccuuaucucccucagacgcagaguuuuuaguuucucuagaaauuuuguuucauauuaggaaua

SEQ ID NO: 251376 - RNA, 64 nt, Human
ggaucauuaagaugaagagaguaauucacauuuacucuagaaccuuuaacaagcacugaaagga

SEQ ID NO: 251377 - RNA, 64 nt, Human
cugucacaggauuaauuaauugccgguuuucauacucuagaaggcugaaacugauguuuaucuu

SEQ ID NO: 251378 - RNA, 64 nt, Human
gcccucugugguuaguuccacaucuguggauucaaccaaccaaggacggaaaaugcuuaaaaaa

SEQ ID NO: 251379 - RNA, 64 nt, Human
gcuguguugaguucucuuuaaaaacaaggacaaaaccaaccagcguucaaaggaaccucccauc

SEQ ID NO: 251380 - RNA, 64 nt, Human
uugaguaguucauagagugcuaaggugacacuccaccaaccagagugagagggcagauaggcag

SEQ ID NO: 251381 - RNA, 64 nt, Human
auaauauauuucacaucuuuauuauugcaguuuucucuagaaagcucugagaagcuuucucugc

SEQ ID NO: 251382 - RNA, 64 nt, Human
ucauugaggaacuguugauuggcaggcacugauucucuagaacacugggcaugaggauguugca

SEQ ID NO: 251383 - RNA, 64 nt, Human
uuacuuuucagguaauuauggaaaauauuuuaaacucuagaagcuucaauaaugaugugugauu

SEQ ID NO: 251384 - RNA, 64 nt, Human
uucucugugugcuuugugguugcugucauauuugcucuagaagaaaaaaaaaaaaggaggggaa

SEQ ID NO: 251385 - RNA, 64 nt, Human
acacauuuuauacuuuucauaaaccacaaagucucucuagaauuuuuucugccuucacuaaaau

SEQ ID NO: 251386 - RNA, 64 nt, Human
agcuccugggcucaagugauccucuagacucagccucuagaauagcugggacuacaggcacaug

SEQ ID NO: 251387 - RNA, 64 nt, Human
ucagccuuuugggaauaauagcacaugauuugggcucuagaauuccaguccccuuucucggggu

SEQ ID NO: 251388 - RNA, 64 nt, Human
cuuguucuucaguauuuuguuuuucucaaaaaugcucuagaacuuuccuuggcacauauaaaag

SEQ ID NO: 251389 - RNA, 64 nt, Human
cuuccaauaauguuagaguucauguaaucacauucucuagaaccauuuaguuuguguuaacuau

SEQ ID NO: 251390 - RNA, 64 nt, Human
gaagaggucuugcagucuucagaugaaacuaaaucucuagaagaggcacaagaauggcuaaagc

SEQ ID NO: 251391 - RNA, 64 nt, Human
gaaaggauccacuacuucuuguucuuaugaaugacucuagaaaaaucagaaucaaguugugggu

SEQ ID NO: 251392 - RNA, 64 nt, Human
acuucacuaaugaucacauucuuuccaaaaggaacucuagaagaccaaaugccccgaguuaaga

SEQ ID NO: 251393 - RNA, 64 nt, Human
cacgugaaauauuuaaguauauaguauauuuauacucuagaacaugcacauuuauauauauaug

SEQ ID NO: 251394 - RNA, 64 nt, Human
aaaaaccuaaacucuucaggcuaccuuugugugucucuagaagagaaaagcaucuaucuggaga

SEQ ID NO: 251395 - RNA, 64 nt, Human
cugaauaaacaucagaguauuuuaaaaaacaguucucuagaaagaacuguuauaauuaaaauga

SEQ ID NO: 251396 - RNA, 64 nt, Human
uuuuauauccaaggguuucaaacccacagauuaaaccaaccacagaucaaaaauagaaaaaaaa

SEQ ID NO: 251397 - RNA, 64 nt, Human
caaaacacuacauccacauuauugacuuuuggaaaccaaccaaauuacuuaagaaauggaaaag

SEQ ID NO: 251398 - RNA, 64 nt, Human
ggaaacagugcagugacucacccccugcccccgcaccaaccacccauauucaggagaagaggac

SEQ ID NO: 251399 - RNA, 64 nt, Human
aaaacuccugugcuuuugagcaaggacuuuugcccucuagaaagcaacugaggccaggugcggu

SEQ ID NO: 251400 - RNA, 64 nt, Human
uacugugucaaaaugauaauuuuguuauguuagccucuagaaaauuuaaguucagaaaaaugca

SEQ ID NO: 251401 - RNA, 64 nt, Human
uugcuuauagaggcaaaccacaguaucauuuuaacucuagaauugggcuuguacagaaggauaa

SEQ ID NO: 251402 - RNA, 64 nt, Human
gauuuugagucauaggucuguaauuuauagagaucucuagaauucuuauuguaauuuuccuacu

SEQ ID NO: 251403 - RNA, 64 nt, Human
ccuuucaacucuguugacccucugucuggucuuccucuagaagguaccgcagaaauugaugugu

SEQ ID NO: 251404 - RNA, 64 nt, Human
ccacucagggcuucuccucugcuaggcuacccuccucuagaaggcugaguaccaugggcuacag

SEQ ID NO: 251405 - RNA, 64 nt, Human
agaagaccaaaccccacauccuccuuuccccucucucuagaaucaucucgcaccaccaguuaca

SEQ ID NO: 251406 - RNA, 64 nt, Human
uauugcauugcauucagaguaaccugugugcauacucuagaagaguagggaaaauaaugcuugu

SEQ ID NO: 251407 - RNA, 64 nt, Human
agggauuaaaaauaaggauaaacacuaauaagagcucuagaaaaaagggaacagaaagucugcc

SEQ ID NO: 251408 - RNA, 60 nt, Human
gggcacccaggagugucugagcugcauuaccucuagaaaccucaaacaaguagaaacuug

SEQ ID NO: 251409 - RNA, 64 nt, Human
caugagccaccgcaccuggccuucccugcuuccucucuagaauccaauuagggauguuuguuac

SEQ ID NO: 251410 - RNA, 64 nt, Human
ccguuuucauugucaagaauguuacuguaguauucucuagaacuucaaugucuuuguggacauu

SEQ ID NO: 251411 - RNA, 64 nt, Human
uuuaauuuuuaagcucuuugccaauauuccauuucucuagaauguuuauccuaagcacuuguuu

SEQ ID NO: 251412 - RNA, 64 nt, Human
cccagcuugcuaaauuaggcuauaccuagguaaucucuagaagacaacucugacagacucuuua

SEQ ID NO: 251413 - RNA, 64 nt, Human
auuuuucaucaugcacgaauuaauaaucaucauacucuagaaucuugucugucacucacuacau

SEQ ID NO: 251414 - RNA, 64 nt, Human
ucuguuggucugccuucugcugaaagacucgagaaccaaccagggaagcuguccuggagguccc

SEQ ID NO: 251415 - RNA, 64 nt, Human
agggacccugcccagucugugaaagcuacagagcaccaaccagcagaagccuguggacaccaag

SEQ ID NO: 251416 - RNA, 64 nt, Human
uaauaggcagagaugacuugcaucccagcuuuccaccaaccaaauucaaacauucacugcuuau

SEQ ID NO: 251417 - RNA, 64 nt, Human
auuucuagguuuguaagugcagcaguuuuauuuccucuagaacucauccuguuucaagggaagu

SEQ ID NO: 251418 - RNA, 64 nt, Human
ucuaagaauuuuccacuucuucaaaaugaacuuacucuagaaagcuuacccuuggauaaccagu

SEQ ID NO: 251419 - RNA, 64 nt, Human
gugcuggugaguauuaccuuucaucugugccaugcucuagaaccuugaccuugauaguucacca

SEQ ID NO: 251420 - RNA, 64 nt, Human
ugcuuaaugaucaaguguuacuuaucuaauaauccucuagaaagaacccuguuagaucuugguu

SEQ ID NO: 251421 - RNA, 64 nt, Human
caggggaaacucuggugccggggagggcacgaggcucuagaaaugcccuucacuuucuccuggu

SEQ ID NO: 251422 - RNA, 64 nt, Human
uucuccaccugcccaccgggacacucccccugcucucuagaaaggaacucucuuucuucucuug

SEQ ID NO: 251423 - RNA, 64 nt, Human
ucuucuaguuuugacauuuuaugauagauuugcucucuagaaggaaacgucuuuauuuaggagg

SEQ ID NO: 251424 - RNA, 64 nt, Human
aaugcagacucaaaccuucccaacaucuuuaugacucuagaauaaucauauugaugaaaucgua

SEQ ID NO: 251425 - RNA, 64 nt, Human
uuuuguuuuuugguuuuuuuuuuuacccagacaacucuagaaaugcggaccaaacuacuucauu

SEQ ID NO: 251426 - RNA, 64 nt, Human
cagugcgugaagaccaacaaagucacagucguaucucuagaaagcucuaaagaccauguuggaa

SEQ ID NO: 251427 - RNA, 64 nt, Human
gaauuccugcuuguuaauuacauaauaugugaugcucuagaaaauagucacaaguauuaauaau

SEQ ID NO: 251428 - RNA, 64 nt, Human
uuaagaccaaaaacuguaauauccuuuagaaaugcucuagaagaucuguauuguguagaaugau

SEQ ID NO: 251429 - RNA, 64 nt, Human
acaugauagccaauggugagggaaaaggagguuucucuagaagagucugaugaaaggccgggaa

SEQ ID NO: 251430 - RNA, 64 nt, Human
uaagcuuugucagguuaauguagcauguuaaggacucuagaaaaaaauaaacuaaggagacgag

SEQ ID NO: 251431 - RNA, 64 nt, Human
uauauucggggauaugaaggauucaaugaaugaucucuagaaagauuuaaagaagaauauucag

SEQ ID NO: 251432 - RNA, 64 nt, Human
cuuucucaccugaugcucuuaaaagaucuuagaaaccaaccauacagacgagccgaugcgguga

SEQ ID NO: 251433 - RNA, 64 nt, Human
uguagaaggagacaaaugcugauugggauggaagaccaaccaagagaucaagcuaucucugcga

SEQ ID NO: 251434 - RNA, 64 nt, Human
aaaaaaaacagaaacaagcgauuauuucaaaucaaccaaccaacucaguauccuguguuuugau

SEQ ID NO: 251435 - RNA, 64 nt, Human
ggguuccacccuaacuuggggaaacaaaagccuucucuagaaucugaaggccaggcuuaccucu

SEQ ID NO: 251436 - RNA, 64 nt, Human
auaggaaucaauaguuaguagugacauuggugcucucuagaaaucucagcaugagcugcuauag

SEQ ID NO: 251437 - RNA, 64 nt, Human
aacaggccugcuagcucagccgacgcucuggacacucuagaaaucacuccucagugugaccucc

SEQ ID NO: 251438 - RNA, 64 nt, Human
ccuaguccugaguauaaauccugugcauagauuccucuagaaaggcaucaaaaggcucaacaga

SEQ ID NO: 251439 - RNA, 64 nt, Human
aaaauggguucagggucuuguccuuagcuacuagcucuagaaaagucccaaaagcagcagaagg

SEQ ID NO: 251440 - RNA, 64 nt, Human
aacuggacuguuccugggaaaagggugaagccaccucuagaagggacuuuggccuccccccaag

SEQ ID NO: 251441 - RNA, 64 nt, Human
guuguguguaugguacuagcacaccacugcaugucucuagaaugcuguugccacuuacgggggc

SEQ ID NO: 251442 - RNA, 64 nt, Human
cgugucuucuaagagcuguucaauacaguauucacucuagaaacaauuaucuuuuucucuuaau

SEQ ID NO: 251443 - RNA, 64 nt, Human
uuaauaguaaagguaaaaucucucaguuuccuaccucuagaaagaggccaucucacuagaauag

SEQ ID NO: 251444 - RNA, 64 nt, Human
accccaaacuuucaccaaaagcaauaaagaggaacucuagaacuggagccaggacuaagugaga

SEQ ID NO: 251445 - RNA, 64 nt, Human
caauucaggagcuuugaaggaaguccaaggaaagcucuagaaaacaguauaaacuuucagaggc

SEQ ID NO: 251446 - RNA, 64 nt, Human
uaaucuucuagaagaaaaaucuccgaagagcucucucuagaaguccaaaauggcuagccauuau

SEQ ID NO: 251447 - RNA, 64 nt, Human
guagcugaugucagcuucauguggauuuuaagcacucuagaaacaaugaagcuucuuggcauau

SEQ ID NO: 251448 - RNA, 64 nt, Human
cuccugccacuagguuucaccucccaaacccagccucuagaacagccagacccugcagaucccc

SEQ ID NO: 251449 - RNA, 64 nt, Human
agacagugucuaaauauaagacaauauugaucagcucuagaauaacuuuaaagaaagacguguu

SEQ ID NO: 251450 - RNA, 64 nt, Human
ugggaugccacauaggcagaagccaggaaaaaugaccaaccacagaaccaagugguuccagugg

SEQ ID NO: 251451 - RNA, 64 nt, Human
ugagauggagagccaaucucacauucaaguguucaccaaccacugauguguuuuuauuuccuuc

SEQ ID NO: 251452 - RNA, 64 nt, Human
cugccuuuacuguagcucacccagcaucucuuuuaccaaccagagagugugaaacuaguuucau

SEQ ID NO: 251453 - RNA, 64 nt, Human
guucuuugcauuuggcucuacuuacuaacaaccccucuagaauacauuggugauuucauuuaaa

SEQ ID NO: 251454 - RNA, 64 nt, Human
uuuguaguacauguuuuuacuaauaauucuuguucucuagaaagcuuucuauuucuaaccuaug

SEQ ID NO: 251455 - RNA, 64 nt, Human
gugaaugguaguugaggucuucauacaguucagccucuagaaugguaacaaaucagccaauugg

SEQ ID NO: 251456 - RNA, 64 nt, Human
uaggaauugagcgguuccccaccuccuaccccuacucuagaaacacacuagacagaugucuccu

SEQ ID NO: 251457 - RNA, 64 nt, Human
agcaggguucaguuucauguaucuuugucuuuuccucuagaaccugccuuuuucaaauaucccu

SEQ ID NO: 251458 - RNA, 64 nt, Human
ccugccacugucccaacucuuucccucuacgucucucuagaaugacaucuuuaaaccccuuaca

SEQ ID NO: 251459 - RNA, 64 nt, Human
aggagauuuaguuuuacugcuuugacuggugggucucuagaagcaaaacugagugauaacucau

SEQ ID NO: 251460 - RNA, 64 nt, Human
uccauaguuuuguuuugguuuauuuuuaacaacgcucuagaaacaaagucaaauuaaucacaaa

SEQ ID NO: 251461 - RNA, 64 nt, Human
gucucuuuagaacuugauggcugggcacugccaucucuagaauugccacgagucucucucuucc

SEQ ID NO: 251462 - RNA, 64 nt, Human
gggguguacuaguuacacaucuucaacagacccccucuagaaauuuuucagaugcuucugggag

SEQ ID NO: 251463 - RNA, 64 nt, Human
cagcagcuguggucauuaaaccauuaguuuaccccucuagaacuggggucugcaaacucccacc

SEQ ID NO: 251464 - RNA, 64 nt, Human
gcuacagcacuaagagaagccccugagaaaaacccucuagaaaaacagcuguuccucugugugg

SEQ ID NO: 251465 - RNA, 64 nt, Human
uuucccucuguggccuccuggcuugcacugcucccucuagaaagauuccuucaggucuggaggc

SEQ ID NO: 251466 - RNA, 64 nt, Human
cucaguggacaguaugcacucagcugaccacucucucuagaaauagucaagauaugaacuaaga

SEQ ID NO: 251467 - RNA, 64 nt, Human
cgccuuguuaugcacaagagauucuauuaaaagccucuagaaguaacuccccuuaaaaugucua

SEQ ID NO: 251468 - RNA, 64 nt, Human
gagccuggagucugcaccuccuggaaauccugccaccaaccaggacacagcagccaccguauug

SEQ ID NO: 251469 - RNA, 64 nt, Human
cauguuuccucuuugacuaaauggcauuaccacuaccaaccauucauuuguccuuuuuaccaau

SEQ ID NO: 251470 - RNA, 64 nt, Human
guuugcugagguugggcuuauucauuuaacacauaccaaccauuauccagaggcaccauggaga

SEQ ID NO: 251471 - RNA, 64 nt, Human
cgccuugugcuagugcccucgagaagaguuauugcucuagaaaguugaguucucauuuuuuuaa

SEQ ID NO: 251472 - RNA, 64 nt, Human
gaucccggcggcaaggagaacagaacacugaagacucuagaaaagcaaagccggauuucuggaa

SEQ ID NO: 251473 - RNA, 64 nt, Human
acauacucugcuucucucugucagcguccugcugcucuagaagacuguccguggaugaguuuag

SEQ ID NO: 251474 - RNA, 64 nt, Human
uaagcugaagguguacuucaccagcaagagucaacucuagaauucaggauguuccuucuauugu

SEQ ID NO: 251475 - RNA, 64 nt, Human
uuuuuccuuuuuuucuugauuaggucuggaacagcucuagaaugaacacauaaaauuuagcaau

SEQ ID NO: 251476 - RNA, 64 nt, Human
aagugauuuugauguauucuaauuuugagaccaucucuagaaaagaauugcuaccucuuguaug

SEQ ID NO: 251477 - RNA, 64 nt, Human
uuucacuucaagacuuuccuucuuuucacuaaaacucuagaagguguuacaagggggagggaag

SEQ ID NO: 251478 - RNA, 64 nt, Human
guccuaggcccuagggauccaacuggcugucugccucuagaacucuccacccucaucucucugc

SEQ ID NO: 251479 - RNA, 64 nt, Human
agcugguaaaggggugcuggaggccauggaggagcucuagaaacauuagcaugggcugaucuga

SEQ ID NO: 251480 - RNA, 64 nt, Human
uuuauggcauaugucuccgauuuagaugguuauucucuagaaaauaguauuuaaagacauuuua

SEQ ID NO: 251481 - RNA, 64 nt, Human
ccucauccccaccccaccucaccccaacaaacuccucuagaagaagccaagaauuucucucuau

SEQ ID NO: 251482 - RNA, 64 nt, Human
ccugaugcuuggaccccuuuuauugaucagagugcucuagaauaauggauggucuuggaugaug

SEQ ID NO: 251483 - RNA, 64 nt, Human
gucauuauuuuaaugaaugugagcucuugacuuacucuagaauucuaauacagauacuuucugc

SEQ ID NO: 251484 - RNA, 64 nt, Human
ucuauuguuugaucuaguuauuuuaauaaaggaacucuagaaguuucaaguggccagugaagug

SEQ ID NO: 251485 - RNA, 64 nt, Human
gaaauaaguaggacugaguauuuaugugaaaacucucuagaagguaaaaauaaagauaauucuu

SEQ ID NO: 251486 - RNA, 64 nt, Human
aaacacuguuaagacuuaaaagccauauaauuccaccaaccaaaauuaaucccuuuugucauau

SEQ ID NO: 251487 - RNA, 64 nt, Human
gguggcugccccggccuccucggagagcagcagcaccaaccacagcaucgggagcacccagagc

SEQ ID NO: 251488 - RNA, 64 nt, Human
ggaaaugugucuugucuccauuuggauaaaaggaaccaaccaacaaacaaugccaucacuggaa

SEQ ID NO: 251489 - RNA, 64 nt, Human
gguuuucuguguaauuccagaugagucacuguaacucuagaagauuaaccuuccagccaaccua

SEQ ID NO: 251490 - RNA, 64 nt, Human
cuccucgcccuuucuuaaagugcaguucuuagcccucuagaaacgaguuggugucuuucgucuc

SEQ ID NO: 251491 - RNA, 64 nt, Human
agccccaaagcauauaaucucuacuccuuacagucucuagaauuaaauguacucauuuagacaa

SEQ ID NO: 251492 - RNA, 64 nt, Human
uacuaccuuacgugauagcauacaaagaagaaagcucuagaaagagaaauuauggagaaugauu

SEQ ID NO: 251493 - RNA, 64 nt, Human
cacuuaccccacagcugguuacugacaacacaagcucuagaauucauguuuguuuguuuguuuu

SEQ ID NO: 251494 - RNA, 64 nt, Human
uagaaaaauguggauaaacagucaaaccuuuauccucuagaauuuuggcaauguugacuaagaa

SEQ ID NO: 251495 - RNA, 64 nt, Human
acauccugaagaaaugguaaggguggagccaaaucucuagaaauaaguagugaggccguuaauu

SEQ ID NO: 251496 - RNA, 64 nt, Human
uaacccugacugugggcuugagaacaaagaugaacucuagaacucuagcagccuaacugcugcu

SEQ ID NO: 251497 - RNA, 64 nt, Human
cuaccauuugaauauuuucauuugguguuuuccccucuagaaaacagaguugcuguuguuuuuu

SEQ ID NO: 251498 - RNA, 64 nt, Human
uccccagaucucuucccccauuccuucuuuugggcucuagaaagucuugccucauugaguguuu

SEQ ID NO: 251499 - RNA, 64 nt, Human
cuuuuaucaagaugaagacauuuuacccuaccuacucuagaaauauacaacaauguuauauuuu

SEQ ID NO: 251500 - RNA, 64 nt, Human
agggcuaaugcugcauuuuucuacaacaucaugccucuagaagguuuaagcuagguaggcuuuc

SEQ ID NO: 251501 - RNA, 64 nt, Human
aaucuauuaucaacugcugcuucaccagacuuuucucuagaagcugucugcguuuacucuuguu

SEQ ID NO: 251502 - RNA, 64 nt, Human
gaggaacacugaacuaguuggaaauuacugcuuucucuagaaauauaaagcaaagcacuauucc

SEQ ID NO: 251503 - RNA, 64 nt, Human
uuuuuucagccacuaagaaccccucugcuuuuaacucuagaauuugggcuuggaccagaucuaa

SEQ ID NO: 251504 - RNA, 64 nt, Human
agcuuugcacuucaaaaaagcuuaauuaaguacaaccaaccaccuuuccagccauagagauuuu

SEQ ID NO: 251505 - RNA, 64 nt, Human
agcguuuuggaagaggaaaacaggaacccaccaaaccaaccaaucaaccaaacaaagaaaaaau

SEQ ID NO: 251506 - RNA, 64 nt, Human
auuucuggguccacuuucugagaugcuuucuaaaaccaaccaacugauaaaaaguagaugagac

SEQ ID NO: 251507 - RNA, 64 nt, Human
uuggguuuucccuugccuuaugggcugaaguguucucuagaauccagcaggucacacugggggc

SEQ ID NO: 251508 - RNA, 64 nt, Human
gagucugaggauguuaacuuuggaacucgcaguccucuagaacagcuucagauuauggcuuuuu

SEQ ID NO: 251509 - RNA, 64 nt, Human
ugcugcucuccaaugcuaacuuucugacacagugcucuagaacccugccugugguccugagcac

SEQ ID NO: 251510 - RNA, 64 nt, Human
aaguugaggaaaugguugggaaucgcuguuagaacucuagaaauucuaaucugacuuugccacu

SEQ ID NO: 251511 - RNA, 64 nt, Human
ggccuggacagccaggggcuccucgggcccugugcucuagaaggcccauucuaugucugcuucg

SEQ ID NO: 251512 - RNA, 64 nt, Human
agaaaagaaucugaacauuuaagugcgaaguuuucucuagaaauauauucaagauauguuuauu

SEQ ID NO: 251513 - RNA, 64 nt, Human
auuuauuuugcucgugcuuagcuaaauaugucaucucuagaaaagaugugguuuguuuuggcac

SEQ ID NO: 251514 - RNA, 64 nt, Human
accguucaaaugagcguagcccccugagucaucacucuagaagaaucuguacaucaucaggacu

SEQ ID NO: 251515 - RNA, 64 nt, Human
caugguguucacucuacauaucagguuauggugucucuagaaucuguuguuuguuuccuauaag

SEQ ID NO: 251516 - RNA, 64 nt, Human
aaaugaagaccuacuuucaacuccuuuuuccccccucuagaagaaucaaauugaaucuuuuacu

SEQ ID NO: 251517 - RNA, 64 nt, Human
gaaggugauugguuuucuuuacagacuccuuguucucuagaagggcuuuuuacuugaauaaaac

SEQ ID NO: 251518 - RNA, 64 nt, Human
uuuugugaaugagaguuggcaugucaaaugcauccucuagaaaaauaauuaguguuauagucuu

SEQ ID NO: 251519 - RNA, 64 nt, Human
ccacauagagccucucucuuuuccuguuucuuggcucuagaagaucagcacugcacuguuagcu

SEQ ID NO: 251520 - RNA, 64 nt, Human
cuggagaauuaucacaaccuaaugacauuaauaccucuagaaagggcugcugucauagugaaca

SEQ ID NO: 251521 - RNA, 64 nt, Human
gaacuugcagguccagguugguauacauuccacccucuagaaguauuuucuuacaguagauaag

SEQ ID NO: 251522 - RNA, 64 nt, Human
auguacagcuuucuacuucuuuguaagaacaccaaccaaccaagguuuaagugauuaauaggcu

SEQ ID NO: 251523 - RNA, 64 nt, Human
aaggaaagaaaacuaacaaccaaccaaccaaccaaccaaccacaaaccacccuaaaaugacagc

SEQ ID NO: 251524 - RNA, 64 nt, Human
uaaaaaggaaagaaaacuaacaaccaaccaaccaaccaaccaaccacaaaccacccuaaaauga

SEQ ID NO: 251525 - RNA, 64 nt, Human
aaauuggugauacuucuaaacuauaacuauaaaucucuagaauucugugaauuucaacauuauu

SEQ ID NO: 251526 - RNA, 63 nt, Human
acaaagucaauggaaauugaacucuagaauugucucuagaaaacauagcuucuuacugaacuu

SEQ ID NO: 251527 - RNA, 51 nt, Human
acaaagucaauggaaauugaacucuagaauugucucuagaaaacauagcuu

SEQ ID NO: 251528 - RNA, 64 nt, Human
cgauuuccuguagaaguagcuuuaaugguuuuugcucuagaauaccguaggucuauccuuagag

SEQ ID NO: 251529 - RNA, 64 nt, Human
uccugccuccugggguccagugacugggacccuacucuagaacuguguaccauccaauucgcca

SEQ ID NO: 251530 - RNA, 64 nt, Human
uucccuguaguugacaauucugcauguacuaguccucuagaaauagguuaaacugaagcaacuu

SEQ ID NO: 251531 - RNA, 64 nt, Human
ccacgcacaugcgaccccgaggaaacgaaacccacucuagaaaacgcgaccuuggccgcaccua

SEQ ID NO: 251532 - RNA, 64 nt, Human
uugucugcucccacagcaccaucuaagaccccuccucuagaaguggggaaggccagauguguag

SEQ ID NO: 251533 - RNA, 64 nt, Human
aacuauguauauuuaaauuuaguaauuuucuaaucucuagaaaucucugcuguucaaaaggugg

SEQ ID NO: 251534 - RNA, 64 nt, Human
cauuucuaaaucccaucuugauauacuaugaauacucuagaaugauguaaagcagauaggaaug

SEQ ID NO: 251535 - RNA, 64 nt, Human
ucaaucauguacuuuaguuuaauguauaaagauccucuagaaaaugauaauauuguguauuaag

SEQ ID NO: 251536 - RNA, 64 nt, Human
ucucugguggucucaagacaagaacaagagcugacucuagaaucuucugccuggcugaccucug

SEQ ID NO: 251537 - RNA, 64 nt, Human
gggucagugauggcaacaggauggccaaggauggcucuagaacacucuguccaugcgucacucc

SEQ ID NO: 251538 - RNA, 64 nt, Human
ccuguccuguccaaugcgggggcacugcagaacucucuagaaaugucaugauugagcuucagag

SEQ ID NO: 251539 - RNA, 64 nt, Human
gaacugaauaaucuuugccuggagugacacuacacucuagaauuuccacuuuggagaauacuca

SEQ ID NO: 251540 - RNA, 64 nt, Human
cuguuucaaguacucaagacugacuuacagaccaaccaaccaccuugcuggaacccuugcuagc

SEQ ID NO: 251541 - RNA, 64 nt, Human
auauauauaaauuaaaaaggaaagaaaacuaacaaccaaccaaccaaccaaccaaccacaaacc

SEQ ID NO: 251542 - RNA, 64 nt, Human
auucugacauuuggaggagucaguaaccaaucccaccaaccacuccagcaaccugacaagacua

SEQ ID NO: 251543 - RNA, 64 nt, Human
auuuuauuuuguuuucaaccaucaauaaaguuuucucuagaauauuguuuugaacauccuugua

SEQ ID NO: 251544 - RNA, 64 nt, Human
uguauggaaaugcacccucccuccugccgcuccucucuagaaccuucuagaaccugggcugugc

SEQ ID NO: 251545 - RNA, 64 nt, Human
uucuaagggugccaagagacugguuagucaaagccucuagaaggggauccucguugaaaggagc

SEQ ID NO: 251546 - RNA, 64 nt, Human
ccauaucuauaaaacaaacauaguaucugucaaucucuagaaaccacaagaugauggagagguc

SEQ ID NO: 251547 - RNA, 64 nt, Human
gguguagggacccugccaaguggcaccugauuuacucuagaaaauaaaaguagaaaauacugag

SEQ ID NO: 251548 - RNA, 64 nt, Human
ugucccugaaguauuuaauaagaagcauuuugcacucuagaaaguauguuuguguugguuuuuu

SEQ ID NO: 251549 - RNA, 64 nt, Human
ugguagauuacuuaucagaaaacauauaugucaucucuagaacgaagaaaaagcauaguaguuc

SEQ ID NO: 251550 - RNA, 64 nt, Human
ggguaggguauaguaucacuccugaguuccacugcucuagaaucuaaccagaaauagaaaccua

SEQ ID NO: 251551 - RNA, 64 nt, Human
ccccugcucaccauuggagaaucagcucacugcucucuagaaacguggcguuggugaacggacc

SEQ ID NO: 251552 - RNA, 64 nt, Human
cucaggacgugaugagguacucgugguucuggagcucuagaaacacuucugaugcaugaaaaau

SEQ ID NO: 251553 - RNA, 64 nt, Human
gaauguucagucggucguguuuuuaacacagagucucuagaagaggugcagacaucccgucuga

SEQ ID NO: 251554 - RNA, 64 nt, Human
cuggcaaguguccagaugccagaaccuucuuuuccucuagaagggauggugcuugguaaccuua

SEQ ID NO: 251555 - RNA, 64 nt, Human
cauguaugucgauugauaucgcugcuacaucagacucuagaaaaaagggcugagaggaagcaag

SEQ ID NO: 251556 - RNA, 64 nt, Human
cgauaauuccucaagcaugagaccuugcuaagcacucuagaauaaguuuuauguucugcucaca

SEQ ID NO: 251557 - RNA, 64 nt, Human
cuacaaaagugcaaauuucucauuuccugugggucucuagaaacucucucaauauuuaaagcca

SEQ ID NO: 251558 - RNA, 64 nt, Human
aaauuaaaaaggaaagaaaacuaacaaccaaccaaccaaccaaccaaccacaaaccacccuaaa

SEQ ID NO: 251559 - RNA, 64 nt, Human
uaaaauucuacauguuuaaauuuuuuguggaccuaccaaccaggaacauguugcuucucagguc

SEQ ID NO: 251560 - RNA, 64 nt, Human
gggucugucuccaaaaaugguugcugaugacaucaccaaccauugacuggaagagucugaggau

SEQ ID NO: 251561 - RNA, 64 nt, Human
cugggcuugguaagugaauuuaugagauuuacugcucuagaaaguauagauggccaaaggaccg

SEQ ID NO: 251562 - RNA, 64 nt, Human
uccaucugagaugggguccuguuguuuauuaucacucuagaaguuauacauugauauuuauucu

SEQ ID NO: 251563 - RNA, 64 nt, Human
gauuuuuguaacuuuacgcaggacacuuagagcucucuagaaucccacugacuuuagugggucu

SEQ ID NO: 251564 - RNA, 64 nt, Human
auaugcccauuugauccuaaccuuuuagccugcucucuagaacccuacuuacaguugaccaagc

SEQ ID NO: 251565 - RNA, 64 nt, Human
caguacggcccccucuuugcaggcuuuuccuccucucuagaaccuccuucuguuggaggcccuc

SEQ ID NO: 251566 - RNA, 64 nt, Human
ccucaggcccccagcccuguggcuuccaccucagcucuagaagccugcucccucugcagggggu

SEQ ID NO: 251567 - RNA, 64 nt, Human
agaaaaaaagaaaaagaacaaaaaauauauaucacucuagaaaauaaaucucuccugugucuua

SEQ ID NO: 251568 - RNA, 64 nt, Human
gcaaacacuaacugggggauuuuauuuauaagggcucuagaaaaaacgaguuauucacaccagc

SEQ ID NO: 251569 - RNA, 64 nt, Human
aaaaaaaaaaguuuguuaaaaggcuacacgagcucucuagaaacugcugcuacuagaaaugucu

SEQ ID NO: 251570 - RNA, 64 nt, Human
uuggggccauuagaaugaggcagacaccaggccacucuagaagccgagccgucacaccucaggc

SEQ ID NO: 251571 - RNA, 64 nt, Human
auuccccuggcaugaaacuuucagauuccccugccucuagaaauuguccugcccuccucaccac

SEQ ID NO: 251572 - RNA, 64 nt, Human
uaacccaugguucucagcuggggugacacugcuccucuagaagcagguuugaaauuauggguau

SEQ ID NO: 251573 - RNA, 64 nt, Human
uccuggcuuuuuguugauuauuaagcuguguucacucuagaagguguaaaggcccugucccaau

SEQ ID NO: 251574 - RNA, 64 nt, Human
cuacauucuccuugucugguauaacuuccauguucucuagaaaucaagguuuuguuuguuaauu

SEQ ID NO: 251575 - RNA, 64 nt, Human
uguuucuggugugugaacuuuaugguaacuucuacucuagaauacguacguaugcacccacaga

SEQ ID NO: 251576 - RNA, 64 nt, Human
uuuaauuaagacuuuuauaagacuagcuuaaaacaccaaccaacauuauuuuugcaaaagugag

SEQ ID NO: 251577 - RNA, 64 nt, Human
cuuuauggaauuuauauucaccaauuucaggaaaaccaaccauagaacuuuauaauaggacagu

SEQ ID NO: 251578 - RNA, 64 nt, Human
gaugauucuuccagauaauguccuugcuuuacaaaccaaccauuucuagagagucuccuuacuc

SEQ ID NO: 251579 - RNA, 64 nt, Human
ccagaacccagcccagaucggaggacaaguuccucucuagaacccaauccaauuuggagcccca

SEQ ID NO: 251580 - RNA, 64 nt, Human
uggagccccagcccaacuccagaacccaacccuucucuagaauccagcccagaucugaggccaa

SEQ ID NO: 251581 - RNA, 64 nt, Human
augugguccaaaugcggaucacuggucagauggacucuagaagcacugagcucccugucucugg

SEQ ID NO: 251582 - RNA, 64 nt, Human
uucaaaaagccucaugcauagcgggucauguagucucuagaaaauacauaaccugauggaaaug

SEQ ID NO: 251583 - RNA, 64 nt, Human
gguuauuuauauccuauuuuuucucaccccaucucucuagaaacaccuauaaaggcuauuauug

SEQ ID NO: 251584 - RNA, 64 nt, Human
cuuguauaagauccuagauccuaagggucgaaagcucuagaaucugcaauucaaaaguuccaag

SEQ ID NO: 251585 - RNA, 64 nt, Human
ggcugccgugauggauucuguuugacguauuguucucuagaaggccuggcucugauccagugac

SEQ ID NO: 251586 - RNA, 64 nt, Human
gguccccacccucugccccccagcccucuggcgucucuagaaacugcugcugauggagaccagg

SEQ ID NO: 251587 - RNA, 64 nt, Human
gcugacggaggaauuaacacaaaagcagacaacacucuagaacuggagagagguccagauugcg

SEQ ID NO: 251588 - RNA, 64 nt, Human
cccagccccuccccuacuuuuuggucagcuacgucucuagaauaagaugguaucugaaguccuu

SEQ ID NO: 251589 - RNA, 64 nt, Human
aguuguuucucucccugggccucaguuuccccaucucuagaaugaggauguuggggaaaauccc

SEQ ID NO: 251590 - RNA, 64 nt, Human
uugaaauucaguaauauuugacauuuuuauuuaucucuagaaguuucucuaaaauuguacucag

SEQ ID NO: 251591 - RNA, 64 nt, Human
aaaguacagugaugagcaugccuaaauccauguucucuagaauguaagcuuggugaaagaaggg

SEQ ID NO: 251592 - RNA, 64 nt, Human
cuagacuguucugggguagcagagucacagaucacucuagaaucuaauacuugguaauuauacu

SEQ ID NO: 251593 - RNA, 64 nt, Human
gcccccaggaauggggaacucucccucuggucuacucuagaagagggguuacuucuccccuggg

SEQ ID NO: 251594 - RNA, 64 nt, Human
gccaaaaacaacaacaaaaugaaacgcaaccaccaccaaccacugcgaccacaagaaggaugau

SEQ ID NO: 251595 - RNA, 64 nt, Human
gaguuauucaguuaaugacccuuuaauucucacaaccaaccagucauguugcuugaagccauuu

SEQ ID NO: 251596 - RNA, 64 nt, Human
auuaacaguuuuguacuuuacauuuuuuuauacaaccaaccaguuucuuuucuagccaaucauc

SEQ ID NO: 251597 - RNA, 64 nt, Human
cucccaucuccuuucagaaaaauucaagguccuccucuagaaguuucaaaucucucccaacucu

SEQ ID NO: 251598 - RNA, 64 nt, Human
uaaggcccuggguucaagagaguuggagaaaccccucuagaaacauauuggcugucaucaaagg

SEQ ID NO: 251599 - RNA, 64 nt, Human
ggaaauuccuuaacugagcuauacuugguacuugcucuagaacauuugggaaaugacaaacuca

SEQ ID NO: 251600 - RNA, 64 nt, Human
caucucuuccagcaccaucaggguuuuaauggcccucuagaauuaccacugagauacacuauuu

SEQ ID NO: 251601 - RNA, 64 nt, Human
gugaagaaucugggccaaccagggguccuugggccucuagaaggccacaguaggccucucuuug

SEQ ID NO: 251602 - RNA, 64 nt, Human
aaucugcuggugccuugaucuuggacuucccagccucuagaacuguaagaaauaaauauuugcu

SEQ ID NO: 251603 - RNA, 64 nt, Human
gcaagggcccaaggacagugccuuaguuuggauccucuagaaacuaacccugggaaaagggcau

SEQ ID NO: 251604 - RNA, 64 nt, Human
cuguauaacuuauuuucuuauuaucuucuucucccucuagaauauaaauuuaugaaaauacaaa

SEQ ID NO: 251605 - RNA, 64 nt, Human
uugcguggaaggagcaaugcagacacagugaaaucucuagaaucugcuuuguuuuguaagaacu

SEQ ID NO: 251606 - RNA, 64 nt, Human
uaguuaaaccaaacuacagucucagccugucauucucuagaacacauccaggugucggagcuaa

SEQ ID NO: 251607 - RNA, 64 nt, Human
cagucagggacccccauaaaggacacccccuucucucuagaaagagcugggcucucagcuauuu

SEQ ID NO: 251608 - RNA, 64 nt, Human
uaagacgggggcugcuucuccucuucaguauggacucuagaaagucuggcuacaugaauagauu

SEQ ID NO: 251609 - RNA, 64 nt, Human
cagugcuaacuugggccagcgggguuugggguaucucuagaaaacagcaacugaacagagcucc

SEQ ID NO: 251610 - RNA, 64 nt, Human
aggcgugacccaggccccuguagcccucagccuccucuagaagcuucuguacuccuuguaggau

SEQ ID NO: 251611 - RNA, 64 nt, Human
cugccguggccacccccgcugcccagugucugcccucuagaaguaggcuguguuuccagguguu

SEQ ID NO: 251612 - RNA, 54 nt, Human
accugcccucaccagacugagccaaccaaccacuguggggcaugugggagucac

SEQ ID NO: 251613 - RNA, 64 nt, Human
uucuaagccuuucugggaaaucauuucaguccacaccaaccauauuauucaggguuccugccau

SEQ ID NO: 251614 - RNA, 64 nt, Human
acacuucccauuaaaccuugcuuaugauauaggcaccaaccaaaccucuugcucugcuauaucu

SEQ ID NO: 251615 - RNA, 64 nt, Human
cuaaacaggaaagucgcauuauuuucccauucuacucuagaaagcauggaaauuaaguguuucg

SEQ ID NO: 251616 - RNA, 64 nt, Human
aucaacuauuuuguaaaugcaaguuuuuuaguagcucuagaaacauuuuuaagaaggagggaau

SEQ ID NO: 251617 - RNA, 64 nt, Human
gugaccagcucagaggauggggcuguccccugggcucuagaaagaacauucugugucaccagca

SEQ ID NO: 251618 - RNA, 64 nt, Human
ggaagaggcugggggacuagaaagaggcccugcccucuagaaagcucagaucuuggcuucuguu

SEQ ID NO: 251619 - RNA, 64 nt, Human
cucuuccaagaaugccucuguggugcuguuuggucucuagaaacagggucacuuuuuuaaugua

SEQ ID NO: 251620 - RNA, 64 nt, Human
ucgacugcugcuguuaaaaaacaugcauuagaaucucuagaacacgaggaaaaacagggucuug

SEQ ID NO: 251621 - RNA, 64 nt, Human
auugugcaaugauuguuaaauuauacugaaguagcucuagaaagacacauguauacaaggcacu

SEQ ID NO: 251622 - RNA, 64 nt, Human
agccguaguagauguucuacuuuguucugcuguucucuagaaagaauauuugguuuuccuguau

SEQ ID NO: 251623 - RNA, 64 nt, Human
guacacaucagcauaugagaaucucugagagguccucuagaaaggagagaaaaagcaccucuuu

SEQ ID NO: 251624 - RNA, 64 nt, Human
uggauucauauauuacaucaacuucccuuuuuaacucuagaaauucucaguaugggguuucccu

SEQ ID NO: 251625 - RNA, 64 nt, Human
cuggguuccuauggccuuguuggagggggccaggcucuagaacgucuaacacaguggagaaccg

SEQ ID NO: 251626 - RNA, 64 nt, Human
uuugaucacgaucauauuguagucucucaaagugcucuagaaauugucagugguuuacaugaag

SEQ ID NO: 251627 - RNA, 64 nt, Human
aaacuauagugauauaucaguguuugagagugaccucuagaaaaaagaaaaguguuuuuagaaa

SEQ ID NO: 251628 - RNA, 64 nt, Human
ugccacccaguagcccagagugagcuuuagcucucucuagaaugagcaagacugggccccacau

SEQ ID NO: 251629 - RNA, 64 nt, Human
caguugugcaggagguagccuggugguuuucaaccucuagaauuuuaagccuuuguugaacugu

SEQ ID NO: 251630 - RNA, 64 nt, Human
ggguuuuacaggaaguagauuaauugauccugucaccaaccauaugaaguaggcacuguuacca

SEQ ID NO: 251631 - RNA, 64 nt, Human
ggcaguguccacagccagaaaacuccugcugggcaccaaccacuacgagcauaccccaugccca

SEQ ID NO: 251632 - RNA, 64 nt, Human
aaugaaguguauuaaguaaauaaauaaguaaauaaccaaccaacccugaggaacaucuuguuuc

SEQ ID NO: 251633 - RNA, 64 nt, Human
uaguuuggaguaagggacuucauauaccugauuccucuagaaggcugucuaacauaccacauga

SEQ ID NO: 251634 - RNA, 64 nt, Human
augauauauuacuacuuauaauacuguggcuagucucuagaauggauguugaaaucuuugccuc

SEQ ID NO: 251635 - RNA, 64 nt, Human
gagugaacugaggaaggugcuuagauggugagggcucuagaaaccaagccccaugagcagcagu

SEQ ID NO: 251636 - RNA, 64 nt, Human
aaacuauagugauauaucaguguuugggagugaccucuagaaaaaagaaaacuguuuuuagaaa

SEQ ID NO: 251637 - RNA, 64 nt, Human
cagccgcauccugccuguagauggccggggaaggcucuagaaaaggggcgcauugcgauccaac

SEQ ID NO: 251638 - RNA, 64 nt, Human; identical to SEQ ID NO: 189246

SEQ ID NO: 251639 - RNA, 64 nt, Human; identical to SEQ ID NO: 189247

SEQ ID NO: 251640 - RNA, 64 nt, Human; identical to SEQ ID NO: 189248

SEQ ID NO: 251641 - RNA, 64 nt, Human; identical to SEQ ID NO: 189249

SEQ ID NO: 251642 - RNA, 64 nt, Human; identical to SEQ ID NO: 189250

SEQ ID NO: 251643 - RNA, 64 nt, Human; identical to SEQ ID NO: 189251

SEQ ID NO: 251644 - RNA, 64 nt, Human; identical to SEQ ID NO: 189252

SEQ ID NO: 251645 - RNA, 64 nt, Human; identical to SEQ ID NO: 189253

SEQ ID NO: 251646 - RNA, 64 nt, Human; identical to SEQ ID NO: 189254

SEQ ID NO: 251647 - RNA, 64 nt, Human
aacuacggaauacuaaauaaaaaguuuggccaaaaccaaccaugaagcugcaaaggugcuugcu

SEQ ID NO: 251648 - RNA, 63 nt, Human
auucugaaagugaauaaaagaaauuaacuuauccaccaaccacaaaaacuggccaugcuagug

SEQ ID NO: 251649 - RNA, 64 nt, Human
aggcucaguggugggagagaucccugcagaacccaccaaccagaacgugguuugccugaggcug

SEQ ID NO: 251650 - RNA, 64 nt, Human; identical to SEQ ID NO: 189255

SEQ ID NO: 251651 - RNA, 64 nt, Human; identical to SEQ ID NO: 189256

SEQ ID NO: 251652 - RNA, 64 nt, Human; identical to SEQ ID NO: 189257

SEQ ID NO: 251653 - RNA, 64 nt, Human; identical to SEQ ID NO: 189258

SEQ ID NO: 251654 - RNA, 64 nt, Human; identical to SEQ ID NO: 189262

SEQ ID NO: 251655 - RNA, 64 nt, Human; identical to SEQ ID NO: 189263

SEQ ID NO: 251656 - RNA, 64 nt, Human; identical to SEQ ID NO: 189264

SEQ ID NO: 251657 - RNA, 64 nt, Human; identical to SEQ ID NO: 189265

SEQ ID NO: 251658 - RNA, 64 nt, Human; identical to SEQ ID NO: 189266

SEQ ID NO: 251659 - RNA, 64 nt, Human; identical to SEQ ID NO: 189267

SEQ ID NO: 251660 - RNA, 64 nt, Human; identical to SEQ ID NO: 189268

SEQ ID NO: 251661 - RNA, 64 nt, Human; identical to SEQ ID NO: 189269

SEQ ID NO: 251662 - RNA, 59 nt, Human; identical to SEQ ID NO: 189270

SEQ ID NO: 251663 - RNA, 64 nt, Human; identical to SEQ ID NO: 189271

SEQ ID NO: 251664 - RNA, 64 nt, Human
ucucgccauagucgagcucucccgcugggggcacugcggggaggcgaggccucgggaagcugaa

SEQ ID NO: 251665 - RNA, 64 nt, Human
gagcagaggagcggggcaggcagccacagggcccugcggggagcacauccucgccuccguccgg

SEQ ID NO: 251666 - RNA, 64 nt, Human
gcaccuaugcaugccaaaacuguucuaggucgacugcggggacagaacaaaaaucaaaacaaag

SEQ ID NO: 251667 - RNA, 64 nt, Human; identical to SEQ ID NO: 189272

SEQ ID NO: 251668 - RNA, 64 nt, Human; identical to SEQ ID NO: 189273

SEQ ID NO: 251669 - RNA, 64 nt, Human; identical to SEQ ID NO: 189274

SEQ ID NO: 251670 - RNA, 64 nt, Human; identical to SEQ ID NO: 189275

SEQ ID NO: 251671 - RNA, 64 nt, Human; identical to SEQ ID NO: 189276

SEQ ID NO: 251672 - RNA, 64 nt, Human; identical to SEQ ID NO: 189280

SEQ ID NO: 251673 - RNA, 64 nt, Human; identical to SEQ ID NO: 189281

SEQ ID NO: 251674 - RNA, 64 nt, Human; identical to SEQ ID NO: 189282

SEQ ID NO: 251675 - RNA, 64 nt, Human; identical to SEQ ID NO: 189283

SEQ ID NO: 251676 - RNA, 64 nt, Human; identical to SEQ ID NO: 189284

SEQ ID NO: 251677 - RNA, 64 nt, Human; identical to SEQ ID NO: 189285

SEQ ID NO: 251678 - RNA, 64 nt, Human; identical to SEQ ID NO: 189286

SEQ ID NO: 251679 - RNA, 64 nt, Human; identical to SEQ ID NO: 189287

SEQ ID NO: 251680 - RNA, 64 nt, Human; identical to SEQ ID NO: 189288

SEQ ID NO: 251681 - RNA, 64 nt, Human
ucaagaggcgagaugagcccacagaggcauauccugcggggaugcugggcucccagugugguug

SEQ ID NO: 251682 - RNA, 64 nt, Human
gggcacugguuccggcugugucugguggucuggcugcggggaaggggcaagaaggcgggcaggc

SEQ ID NO: 251683 - RNA, 64 nt, Human
cacccaaacaucuuggcauccccaccccaggaagugcggggaggagguuaugaucccugggcgc

SEQ ID NO: 251684 - RNA, 64 nt, Human; identical to SEQ ID NO: 189289

SEQ ID NO: 251685 - RNA, 64 nt, Human; identical to SEQ ID NO: 189290

SEQ ID NO: 251686 - RNA, 64 nt, Human; identical to SEQ ID NO: 189291

SEQ ID NO: 251687 - RNA, 64 nt, Human; identical to SEQ ID NO: 189292

SEQ ID NO: 251688 - RNA, 64 nt, Human; identical to SEQ ID NO: 189293

SEQ ID NO: 251689 - RNA, 64 nt, Human; identical to SEQ ID NO: 189294

SEQ ID NO: 251690 - RNA, 64 nt, Human; identical to SEQ ID NO: 189298

SEQ ID NO: 251691 - RNA, 64 nt, Human; identical to SEQ ID NO: 189299

SEQ ID NO: 251692 - RNA, 64 nt, Human; identical to SEQ ID NO: 189300

SEQ ID NO: 251693 - RNA, 64 nt, Human; identical to SEQ ID NO: 189301

SEQ ID NO: 251694 - RNA, 64 nt, Human; identical to SEQ ID NO: 189302

SEQ ID NO: 251695 - RNA, 64 nt, Human; identical to SEQ ID NO: 189303

SEQ ID NO: 251696 - RNA, 64 nt, Human; identical to SEQ ID NO: 189304

SEQ ID NO: 251697 - RNA, 64 nt, Human; identical to SEQ ID NO: 189305

SEQ ID NO: 251698 - RNA, 64 nt, Human
gagaaaucuagcaccuugcaugcuggaucugggcugcggggaggcucuuuuucucccuggccuc

SEQ ID NO: 251699 - RNA, 64 nt, Human
ucccaucuguggacccaucguccaccagcccagcugcggggagcacagggcagguggcugggug

SEQ ID NO: 251700 - RNA, 64 nt, Human
cugcagggcuggggcugggugaggguggcgggccugcggggacauucuacugugcuaaaaagcc

SEQ ID NO: 251701 - RNA, 64 nt, Human; identical to SEQ ID NO: 189306

SEQ ID NO: 251702 - RNA, 64 nt, Human; identical to SEQ ID NO: 189307

SEQ ID NO: 251703 - RNA, 64 nt, Human; identical to SEQ ID NO: 189308

SEQ ID NO: 251704 - RNA, 64 nt, Human; identical to SEQ ID NO: 189309

SEQ ID NO: 251705 - RNA, 64 nt, Human; identical to SEQ ID NO: 189310

SEQ ID NO: 251706 - RNA, 53 nt, Human; identical to SEQ ID NO: 189311

SEQ ID NO: 251707 - RNA, 64 nt, Human; identical to SEQ ID NO: 189312

SEQ ID NO: 251708 - RNA, 64 nt, Human; identical to SEQ ID NO: 189317

SEQ ID NO: 251709 - RNA, 64 nt, Human; identical to SEQ ID NO: 189318

SEQ ID NO: 251710 - RNA, 64 nt, Human; identical to SEQ ID NO: 189319

SEQ ID NO: 251711 - RNA, 64 nt, Human; identical to SEQ ID NO: 189320

SEQ ID NO: 251712 - RNA, 64 nt, Human; identical to SEQ ID NO: 189321

SEQ ID NO: 251713 - RNA, 64 nt, Human; identical to SEQ ID NO: 189322

SEQ ID NO: 251714 - RNA, 64 nt, Human; identical to SEQ ID NO: 189323

SEQ ID NO: 251715 - RNA, 64 nt, Human
uucugcucucuggagcggugaaccggugguugucugcggggaagagaugauaaagagcacgggc

SEQ ID NO: 251716 - RNA, 64 nt, Human
aauuuuucugggaacacaccugccuuuuguguaaugcggggaagacuaaugcauggugacaccu

SEQ ID NO: 251717 - RNA, 64 nt, Human
cuccccgcugccgcccacccuggggagagacuuuugcggggagggaaggcggagcugaggacag

SEQ ID NO: 251718 - RNA, 64 nt, Human; identical to SEQ ID NO: 189324

SEQ ID NO: 251719 - RNA, 64 nt, Human; identical to SEQ ID NO: 189325

SEQ ID NO: 251720 - RNA, 64 nt, Human; identical to SEQ ID NO: 189326

SEQ ID NO: 251721 - RNA, 64 nt, Human; identical to SEQ ID NO: 189327

SEQ ID NO: 251722 - RNA, 64 nt, Human; identical to SEQ ID NO: 189328

SEQ ID NO: 251723 - RNA, 64 nt, Human; identical to SEQ ID NO: 189329

SEQ ID NO: 251724 - RNA, 64 nt, Human; identical to SEQ ID NO: 189330

SEQ ID NO: 251725 - RNA, 64 nt, Human; identical to SEQ ID NO: 189331

SEQ ID NO: 251726 - RNA, 64 nt, Human; identical to SEQ ID NO: 189336

SEQ ID NO: 251727 - RNA, 64 nt, Human; identical to SEQ ID NO: 189337

SEQ ID NO: 251728 - RNA, 64 nt, Human; identical to SEQ ID NO: 189338

SEQ ID NO: 251729 - RNA, 64 nt, Human; identical to SEQ ID NO: 189339

SEQ ID NO: 251730 - RNA, 64 nt, Human; identical to SEQ ID NO: 189340

SEQ ID NO: 251731 - RNA, 64 nt, Human; identical to SEQ ID NO: 189341

SEQ ID NO: 251732 - RNA, 64 nt, Human; identical to SEQ ID NO: 189342

SEQ ID NO: 251733 - RNA, 64 nt, Human; identical to SEQ ID NO: 189343

SEQ ID NO: 251734 - RNA, 64 nt, Human; identical to SEQ ID NO: 189344

SEQ ID NO: 251735 - RNA, 64 nt, Human; identical to SEQ ID NO: 189345

SEQ ID NO: 251736 - RNA, 64 nt, Human; identical to SEQ ID NO: 189346

SEQ ID NO: 251737 - RNA, 64 nt, Human; identical to SEQ ID NO: 189347

SEQ ID NO: 251738 - RNA, 64 nt, Human; identical to SEQ ID NO: 189348

SEQ ID NO: 251739 - RNA, 64 nt, Human; identical to SEQ ID NO: 189349

SEQ ID NO: 251740 - RNA, 64 nt, Human; identical to SEQ ID NO: 189350

SEQ ID NO: 251741 - RNA, 64 nt, Human; identical to SEQ ID NO: 189355

SEQ ID NO: 251742 - RNA, 64 nt, Human; identical to SEQ ID NO: 189356

SEQ ID NO: 251743 - RNA, 64 nt, Human; identical to SEQ ID NO: 189357

SEQ ID NO: 251744 - RNA, 64 nt, Human; identical to SEQ ID NO: 189358

SEQ ID NO: 251745 - RNA, 64 nt, Human; identical to SEQ ID NO: 189359

SEQ ID NO: 251746 - RNA, 64 nt, Human
gggaggaggcugcccguuccugccaguuccucacugcggggaccagcaaaggccuucucacugg

SEQ ID NO: 251747 - RNA, 64 nt, Human
cucauuuggaaacuaaaacuucaucuuccccaagugcggggaguacaaggcauggcguagaggg

SEQ ID NO: 251748 - RNA, 64 nt, Human
aggugccccacaccggcaaguaccagccagcaacaccaaccaaaugcuacucucuuuaaagucc

SEQ ID NO: 251749 - RNA, 64 nt, Human; identical to SEQ ID NO: 189360

SEQ ID NO: 251750 - RNA, 64 nt, Human; identical to SEQ ID NO: 189361

SEQ ID NO: 251751 - RNA, 64 nt, Human; identical to SEQ ID NO: 189362

SEQ ID NO: 251752 - RNA, 64 nt, Human; identical to SEQ ID NO: 189363

SEQ ID NO: 251753 - RNA, 64 nt, Human; identical to SEQ ID NO: 189364

SEQ ID NO: 251754 - RNA, 64 nt, Human; identical to SEQ ID NO: 189365

SEQ ID NO: 251755 - RNA, 64 nt, Human; identical to SEQ ID NO: 189366

SEQ ID NO: 251756 - RNA, 64 nt, Human; identical to SEQ ID NO: 189367

SEQ ID NO: 251757 - RNA, 64 nt, Human; identical to SEQ ID NO: 189368

SEQ ID NO: 251758 - RNA, 64 nt, Human; identical to SEQ ID NO: 189369

SEQ ID NO: 251759 - RNA, 64 nt, Human; identical to SEQ ID NO: 189374

SEQ ID NO: 251760 - RNA, 64 nt, Human; identical to SEQ ID NO: 189375

SEQ ID NO: 251761 - RNA, 64 nt, Human; identical to SEQ ID NO: 189376

SEQ ID NO: 251762 - RNA, 64 nt, Human; identical to SEQ ID NO: 189377

SEQ ID NO: 251763 - RNA, 64 nt, Human
uguuucaaguuaaaccuuuugugucaccgcccccaccaaccaccaccuccuaaauccugacagc

SEQ ID NO: 251764 - RNA, 64 nt, Human
ggugcgcccuaguacgacuccgcccaguguguggaccaaccaaauagcauucuuugcugucagg

SEQ ID NO: 251765 - RNA, 64 nt, Human
gguacggggagaggcgaugcuauuggccaucacuaccaaccaggguuucaaaaaguauuaccua

SEQ ID NO: 251766 - RNA, 64 nt, Human; identical to SEQ ID NO: 189378

SEQ ID NO: 251767 - RNA, 64 nt, Human; identical to SEQ ID NO: 189379

SEQ ID NO: 251768 - RNA, 64 nt, Human; identical to SEQ ID NO: 189380

SEQ ID NO: 251769 - RNA, 64 nt, Human; identical to SEQ ID NO: 189381

SEQ ID NO: 251770 - RNA, 64 nt, Human; identical to SEQ ID NO: 189382

SEQ ID NO: 251771 - RNA, 64 nt, Human; identical to SEQ ID NO: 189383

SEQ ID NO: 251772 - RNA, 64 nt, Human; identical to SEQ ID NO: 189384

SEQ ID NO: 251773 - RNA, 64 nt, Human; identical to SEQ ID NO: 189385

SEQ ID NO: 251774 - RNA, 64 nt, Human; identical to SEQ ID NO: 189386

SEQ ID NO: 251775 - RNA, 64 nt, Human; identical to SEQ ID NO: 189387

SEQ ID NO: 251776 - RNA, 64 nt, Human; identical to SEQ ID NO: 189388

SEQ ID NO: 251777 - RNA, 64 nt, Human; identical to SEQ ID NO: 188697

SEQ ID NO: 251778 - RNA, 64 nt, Human; identical to SEQ ID NO: 188698

SEQ ID NO: 251779 - RNA, 64 nt, Human; identical to SEQ ID NO: 188699

SEQ ID NO: 251780 - RNA, 64 nt, Human
agccccgggccggaccuccugcuggcucucgcccaccaaccaaguguuacaagccccagaaugc

SEQ ID NO: 251781 - RNA, 64 nt, Human
uuauugccgaaaccaggcaggcaaccccaagggcaccaaccagggccuccccaaagccugggcc

SEQ ID NO: 251782 - RNA, 64 nt, Human
cgaguggggcccaggacugguuccagugagagaaaccaaccacaggcacccaagcacuaccaga

SEQ ID NO: 251783 - RNA, 64 nt, Human; identical to SEQ ID NO: 188700

SEQ ID NO: 251784 - RNA, 64 nt, Human; identical to SEQ ID NO: 188701

SEQ ID NO: 251785 - RNA, 64 nt, Human; identical to SEQ ID NO: 188702

SEQ ID NO: 251786 - RNA, 64 nt, Human; identical to SEQ ID NO: 188703

SEQ ID NO: 251787 - RNA, 64 nt, Human; identical to SEQ ID NO: 188704

SEQ ID NO: 251788 - RNA, 64 nt, Human; identical to SEQ ID NO: 188705

SEQ ID NO: 251789 - RNA, 64 nt, Human; identical to SEQ ID NO: 188706

SEQ ID NO: 251790 - RNA, 64 nt, Human; identical to SEQ ID NO: 188707

SEQ ID NO: 251791 - RNA, 64 nt, Human; identical to SEQ ID NO: 188708

SEQ ID NO: 251792 - RNA, 64 nt, Human; identical to SEQ ID NO: 188709

SEQ ID NO: 251793 - RNA, 64 nt, Human; identical to SEQ ID NO: 188710

SEQ ID NO: 251794 - RNA, 64 nt, Human; identical to SEQ ID NO: 189392

SEQ ID NO: 251795 - RNA, 64 nt, Human; identical to SEQ ID NO: 189411

SEQ ID NO: 251796 - RNA, 64 nt, Human; identical to SEQ ID NO: 189412

SEQ ID NO: 251797 - RNA, 64 nt, Human
uuuaucucagccauccgcagacugcuuggccagaugcggggacaggcuggaaugagggaggcgu

SEQ ID NO: 251798 - RNA, 64 nt, Human
uaaaguauguuugauuuuauaagaagcucuuguaaccaaccauccagugagucuacuaaguguu

SEQ ID NO: 251799 - RNA, 64 nt, Human; identical to SEQ ID NO: 189413

SEQ ID NO: 251800 - RNA, 64 nt, Human; identical to SEQ ID NO: 189414

SEQ ID NO: 251801 - RNA, 64 nt, Human; identical to SEQ ID NO: 189415

SEQ ID NO: 251802 - RNA, 64 nt, Human; identical to SEQ ID NO: 189416

SEQ ID NO: 251803 - RNA, 64 nt, Human; identical to SEQ ID NO: 189417

SEQ ID NO: 251804 - RNA, 64 nt, Human; identical to SEQ ID NO: 189418

SEQ ID NO: 251805 - RNA, 64 nt, Human; identical to SEQ ID NO: 189419

SEQ ID NO: 251806 - RNA, 64 nt, Human; identical to SEQ ID NO: 189420

SEQ ID NO: 251807 - RNA, 64 nt, Human; identical to SEQ ID NO: 189421

SEQ ID NO: 251808 - RNA, 64 nt, Human; identical to SEQ ID NO: 189422

SEQ ID NO: 251809 - RNA, 64 nt, Human; identical to SEQ ID NO: 189423

SEQ ID NO: 251810 - RNA, 64 nt, Human; identical to SEQ ID NO: 189424

SEQ ID NO: 251811 - RNA, 64 nt, Human; identical to SEQ ID NO: 189425

SEQ ID NO: 251812 - RNA, 64 nt, Human; identical to SEQ ID NO: 189429

SEQ ID NO: 251813 - RNA, 64 nt, Human
ucagcaucagaaugagaaagccugagaagaaagaaccaaccacaagcacacaggaaggaaagcg

SEQ ID NO: 251814 - RNA, 64 nt, Human
gcuuggagcauggugaaccaucagagaaucuagaaccaaccaagcuaggaacaucagccuggug

SEQ ID NO: 251815 - RNA, 64 nt, Human
cuguuucuagaagaaaccucuuagagaauucaguaccaaccaagcuucagcccacuuucacacc

SEQ ID NO: 251816 - RNA, 64 nt, Human; identical to SEQ ID NO: 189430

SEQ ID NO: 251817 - RNA, 64 nt, Human; identical to SEQ ID NO: 189431

SEQ ID NO: 251818 - RNA, 64 nt, Human; identical to SEQ ID NO: 189432

SEQ ID NO: 251819 - RNA, 64 nt, Human; identical to SEQ ID NO: 189433

SEQ ID NO: 251820 - RNA, 64 nt, Human; identical to SEQ ID NO: 189434

SEQ ID NO: 251821 - RNA, 64 nt, Human; identical to SEQ ID NO: 189435

SEQ ID NO: 251822 - RNA, 64 nt, Human; identical to SEQ ID NO: 189436

SEQ ID NO: 251823 - RNA, 64 nt, Human; identical to SEQ ID NO: 189437

SEQ ID NO: 251824 - RNA, 64 nt, Human; identical to SEQ ID NO: 189438

SEQ ID NO: 251825 - RNA, 64 nt, Human; identical to SEQ ID NO: 189439

SEQ ID NO: 251826 - RNA, 64 nt, Human; identical to SEQ ID NO: 189440

SEQ ID NO: 251827 - RNA, 64 nt, Human; identical to SEQ ID NO: 189441

SEQ ID NO: 251828 - RNA, 64 nt, Human; identical to SEQ ID NO: 189442

SEQ ID NO: 251829 - RNA, 64 nt, Human; identical to SEQ ID NO: 189443

SEQ ID NO: 251830 - RNA, 64 nt, Human
gggccaccguaagcaagggaaaaagggcagaucaugcggggagaugaccuugaucuuugauugc

SEQ ID NO: 251831 - RNA, 64 nt, Human
auagaugugguccuuaggagacgcugcacuugacaccaaccagacagcacagggcagggguggu

SEQ ID NO: 251832 - RNA, 64 nt, Human
auugaaaccuaaaggcauuuugaaugacauuguuaccaaccauuaauuggcucaggaccuuugu

SEQ ID NO: 251833 - RNA, 64 nt, Human; identical to SEQ ID NO: 189447

SEQ ID NO: 251834 - RNA, 64 nt, Human; identical to SEQ ID NO: 189448

SEQ ID NO: 251835 - RNA, 64 nt, Human; identical to SEQ ID NO: 189449

SEQ ID NO: 251836 - RNA, 64 nt, Human; identical to SEQ ID NO: 189450

SEQ ID NO: 251837 - RNA, 64 nt, Human; identical to SEQ ID NO: 189451

SEQ ID NO: 251838 - RNA, 64 nt, Human; identical to SEQ ID NO: 189452

SEQ ID NO: 251839 - RNA, 64 nt, Human; identical to SEQ ID NO: 189453

SEQ ID NO: 251840 - RNA, 64 nt, Human; identical to SEQ ID NO: 189454

SEQ ID NO: 251841 - RNA, 64 nt, Human; identical to SEQ ID NO: 189455

SEQ ID NO: 251842 - RNA, 64 nt, Human; identical to SEQ ID NO: 189456

SEQ ID NO: 251843 - RNA, 64 nt, Human; identical to SEQ ID NO: 189457

SEQ ID NO: 251844 - RNA, 64 nt, Human; identical to SEQ ID NO: 189458

SEQ ID NO: 251845 - RNA, 64 nt, Human; identical to SEQ ID NO: 189459

SEQ ID NO: 251846 - RNA, 64 nt, Human; identical to SEQ ID NO: 189460

SEQ ID NO: 251847 - RNA, 64 nt, Human
cagggcucaguggcaggaaauccucaacagggucaccaaccagcccgcucaaugcagaaaaacu

SEQ ID NO: 251848 - RNA, 64 nt, Human
auuugagcaaguuggaaguuuaauuagcuuuccaaccaaccaaauuucugcauucgagucuuaa

SEQ ID NO: 251849 - RNA, 64 nt, Human
cuccaagaagcugggucuccagaucccauuuagaaccaaccaggugcugaaaacacauguagau

SEQ ID NO: 251850 - RNA, 64 nt, Human; identical to SEQ ID NO: 189461

SEQ ID NO: 251851 - RNA, 64 nt, Human; identical to SEQ ID NO: 189465

SEQ ID NO: 251852 - RNA, 64 nt, Human; identical to SEQ ID NO: 189466

SEQ ID NO: 251853 - RNA, 64 nt, Human; identical to SEQ ID NO: 189467

SEQ ID NO: 251854 - RNA, 64 nt, Human; identical to SEQ ID NO: 189468

SEQ ID NO: 251855 - RNA, 64 nt, Human; identical to SEQ ID NO: 189469

SEQ ID NO: 251856 - RNA, 64 nt, Human; identical to SEQ ID NO: 189470

SEQ ID NO: 251857 - RNA, 51 nt, Human; identical to SEQ ID NO: 189471

SEQ ID NO: 251858 - RNA, 64 nt, Human; identical to SEQ ID NO: 189472

SEQ ID NO: 251859 - RNA, 64 nt, Human; identical to SEQ ID NO: 189473

SEQ ID NO: 251860 - RNA, 64 nt, Human; identical to SEQ ID NO: 189474

SEQ ID NO: 251861 - RNA, 64 nt, Human; identical to SEQ ID NO: 189475

SEQ ID NO: 251862 - RNA, 64 nt, Human; identical to SEQ ID NO: 189476

SEQ ID NO: 251863 - RNA, 64 nt, Human; identical to SEQ ID NO: 189477

SEQ ID NO: 251864 - RNA, 64 nt, Human
ccuuuuggggcaggagggaggguuuuuuuaggguugcggggagggaacugcaagugccugagga

SEQ ID NO: 251865 - RNA, 64 nt, Human
gggacggccgcaccugccuccgccggcuccagugugcggggagccucugccugagugugcacca

SEQ ID NO: 251866 - RNA, 64 nt, Human; identical to SEQ ID NO: 189478

SEQ ID NO: 251867 - RNA, 64 nt, Human; identical to SEQ ID NO: 189479

SEQ ID NO: 251868 - RNA, 64 nt, Human; identical to SEQ ID NO: 189483

SEQ ID NO: 251869 - RNA, 64 nt, Human; identical to SEQ ID NO: 189484

SEQ ID NO: 251870 - RNA, 64 nt, Human; identical to SEQ ID NO: 189485

SEQ ID NO: 251871 - RNA, 64 nt, Human; identical to SEQ ID NO: 189486

SEQ ID NO: 251872 - RNA, 64 nt, Human; identical to SEQ ID NO: 189487

SEQ ID NO: 251873 - RNA, 64 nt, Human; identical to SEQ ID NO: 189488

SEQ ID NO: 251874 - RNA, 64 nt, Human; identical to SEQ ID NO: 189489

SEQ ID NO: 251875 - RNA, 64 nt, Human; identical to SEQ ID NO: 202886

SEQ ID NO: 251876 - RNA, 64 nt, Human; identical to SEQ ID NO: 202887

SEQ ID NO: 251877 - RNA, 64 nt, Human; identical to SEQ ID NO: 202888

SEQ ID NO: 251878 - RNA, 64 nt, Human
cagaucccgcaguccugaggagccagcggccaccugcggggagaccaccgccgcccagacuacu

SEQ ID NO: 251879 - RNA, 64 nt, Human
cauuaaauagaagguugauaguuuaucauaaaccugcggggaagaaacucagacuuucuauuuu

SEQ ID NO: 251880 - RNA, 53 nt, Human
ucgggauccacaaggacuagaccugcggggaaggucucuccuggacacgcccg

SEQ ID NO: 251881 - RNA, 55 nt, Human; identical to SEQ ID NO: 202889

SEQ ID NO: 251882 - RNA, 64 nt, Human; identical to SEQ ID NO: 202890

SEQ ID NO: 251883 - RNA, 64 nt, Human; identical to SEQ ID NO: 202891

SEQ ID NO: 251884 - RNA, 64 nt, Human; identical to SEQ ID NO: 202892

SEQ ID NO: 251885 - RNA, 64 nt, Human; identical to SEQ ID NO: 202893

SEQ ID NO: 251886 - RNA, 64 nt, Human; identical to SEQ ID NO: 202894

SEQ ID NO: 251887 - RNA, 64 nt, Human; identical to SEQ ID NO: 202895

SEQ ID NO: 251888 - RNA, 50 nt, Human; identical to SEQ ID NO: 202896

SEQ ID NO: 251889 - RNA, 64 nt, Human; identical to SEQ ID NO: 202897

SEQ ID NO: 251890 - RNA, 64 nt, Human; identical to SEQ ID NO: 202898

SEQ ID NO: 251891 - RNA, 64 nt, Human; identical to SEQ ID NO: 202899

SEQ ID NO: 251892 - RNA, 64 nt, Human; identical to SEQ ID NO: 202900

SEQ ID NO: 251893 - RNA, 64 nt, Human; identical to SEQ ID NO: 202901

SEQ ID NO: 251894 - RNA, 64 nt, Human; identical to SEQ ID NO: 202902

SEQ ID NO: 251895 - RNA, 64 nt, Human; identical to SEQ ID NO: 202903

SEQ ID NO: 251896 - RNA, 64 nt, Human
ccgacgucgccagccugggagcgaccacuuuggcugcggggaggcgcguggggagagaucucaa

SEQ ID NO: 251897 - RNA, 64 nt, Human
aaugccgucaucaucaggauuuuacaaaucucuuugcggggaacuguuucacucaugguaugga

SEQ ID NO: 251898 - RNA, 64 nt, Human
gugcccccagccucuccaacccccaaacugcugcugcggggaaccccccccaccccgccuucag

SEQ ID NO: 251899 - RNA, 64 nt, Human; identical to SEQ ID NO: 202904

SEQ ID NO: 251900 - RNA, 64 nt, Human; identical to SEQ ID NO: 202905

SEQ ID NO: 251901 - RNA, 64 nt, Human; identical to SEQ ID NO: 202906

SEQ ID NO: 251902 - RNA, 64 nt, Human; identical to SEQ ID NO: 202907

SEQ ID NO: 251903 - RNA, 64 nt, Human; identical to SEQ ID NO: 202908

SEQ ID NO: 251904 - RNA, 64 nt, Human; identical to SEQ ID NO: 202909

SEQ ID NO: 251905 - RNA, 64 nt, Human; identical to SEQ ID NO: 202910

SEQ ID NO: 251906 - RNA, 64 nt, Human; identical to SEQ ID NO: 202911

SEQ ID NO: 251907 - RNA, 50 nt, Human; identical to SEQ ID NO: 202912

SEQ ID NO: 251908 - RNA, 64 nt, Human; identical to SEQ ID NO: 202913

SEQ ID NO: 251909 - RNA, 64 nt, Human; identical to SEQ ID NO: 202914

SEQ ID NO: 251910 - RNA, 64 nt, Human; identical to SEQ ID NO: 202915

SEQ ID NO: 251911 - RNA, 64 nt, Human; identical to SEQ ID NO: 202916

SEQ ID NO: 251912 - RNA, 64 nt, Human; identical to SEQ ID NO: 202917

SEQ ID NO: 251913 - RNA, 64 nt, Human; identical to SEQ ID NO: 202918

SEQ ID NO: 251914 - RNA, 64 nt, Human
guaugaaccaugauccuccuaaaagcauuucuacugcggggaaggagagguaaauguuugaagc

SEQ ID NO: 251915 - RNA, 64 nt, Human
uucggagugagcugguggagccagacagagcaggugcggggaagggaagggcccaggccagacc

SEQ ID NO: 251916 - RNA, 64 nt, Human
uuauggcuagucuuaucuggccugguuauuuccuugcggggaggagaggguuugcuaaucugcu

SEQ ID NO: 251917 - RNA, 64 nt, Human; identical to SEQ ID NO: 202919

SEQ ID NO: 251918 - RNA, 64 nt, Human; identical to SEQ ID NO: 202920

SEQ ID NO: 251919 - RNA, 64 nt, Human; identical to SEQ ID NO: 202921

SEQ ID NO: 251920 - RNA, 64 nt, Human; identical to SEQ ID NO: 202922

SEQ ID NO: 251921 - RNA, 64 nt, Human; identical to SEQ ID NO: 202923

SEQ ID NO: 251922 - RNA, 64 nt, Human; identical to SEQ ID NO: 202924

SEQ ID NO: 251923 - RNA, 64 nt, Human; identical to SEQ ID NO: 202925

SEQ ID NO: 251924 - RNA, 54 nt, Human; identical to SEQ ID NO: 202926

SEQ ID NO: 251925 - RNA, 64 nt, Human; identical to SEQ ID NO: 202927

SEQ ID NO: 251926 - RNA, 64 nt, Human; identical to SEQ ID NO: 202928

SEQ ID NO: 251927 - RNA, 64 nt, Human; identical to SEQ ID NO: 202929

SEQ ID NO: 251928 - RNA, 64 nt, Human; identical to SEQ ID NO: 202930

SEQ ID NO: 251929 - RNA, 64 nt, Human; identical to SEQ ID NO: 202931

SEQ ID NO: 251930 - RNA, 64 nt, Human; identical to SEQ ID NO: 202932

SEQ ID NO: 251931 - RNA, 64 nt, Human; identical to SEQ ID NO: 202933

SEQ ID NO: 251932 - RNA, 64 nt, Human
ugggggagggcccagagaauggcacccaagagccugcggggaugcccaucccacacaccccacc

SEQ ID NO: 251933 - RNA, 64 nt, Human
caccaucccacgguggccuucccccugcacgcucugcggggagaaaaggaggggccugccuggc

SEQ ID NO: 251934 - RNA, 64 nt, Human
gacucagccgccccaucccgagucgcuaaggggcugcggggaggccgcagcaccuucuggaaga

SEQ ID NO: 251935 - RNA, 64 nt, Human; identical to SEQ ID NO: 202934

SEQ ID NO: 251936 - RNA, 64 nt, Human; identical to SEQ ID NO: 202935

SEQ ID NO: 251937 - RNA, 64 nt, Human; identical to SEQ ID NO: 202936

SEQ ID NO: 251938 - RNA, 64 nt, Human; identical to SEQ ID NO: 202937

SEQ ID NO: 251939 - RNA, 64 nt, Human; identical to SEQ ID NO: 202938

SEQ ID NO: 251940 - RNA, 64 nt, Human; identical to SEQ ID NO: 202939

SEQ ID NO: 251941 - RNA, 64 nt, Human; identical to SEQ ID NO: 202940

SEQ ID NO: 251942 - RNA, 64 nt, Human; identical to SEQ ID NO: 202941

SEQ ID NO: 251943 - RNA, 64 nt, Human; identical to SEQ ID NO: 202942

SEQ ID NO: 251944 - RNA, 64 nt, Human; identical to SEQ ID NO: 202943

SEQ ID NO: 251945 - RNA, 64 nt, Human; identical to SEQ ID NO: 202944

SEQ ID NO: 251946 - RNA, 64 nt, Human; identical to SEQ ID NO: 202945

SEQ ID NO: 251947 - RNA, 64 nt, Human; identical to SEQ ID NO: 202946

SEQ ID NO: 251948 - RNA, 64 nt, Human; identical to SEQ ID NO: 202947

SEQ ID NO: 251949 - RNA, 64 nt, Human; identical to SEQ ID NO: 202948

SEQ ID NO: 251950 - RNA, 64 nt, Human
cccgcuggagacaguguuugucgugggcguggucugcggggauccuguuacaaaggugaaaccc

SEQ ID NO: 251951 - RNA, 64 nt, Human
ggccagaccucuuuacacacacauucccguuccuaccaaccaccagaacuggaugguggcaccc

SEQ ID NO: 251952 - RNA, 64 nt, Human
gccauuuuuacacacuugacuuuuuaaaaauacaaccaaccaaccaccacaacuucuuauacau

SEQ ID NO: 251953 - RNA, 64 nt, Human; identical to SEQ ID NO: 202949

SEQ ID NO: 251954 - RNA, 64 nt, Human; identical to SEQ ID NO: 202950

SEQ ID NO: 251955 - RNA, 64 nt, Human; identical to SEQ ID NO: 202951

SEQ ID NO: 251956 - RNA, 64 nt, Human; identical to SEQ ID NO: 202952

SEQ ID NO: 251957 - RNA, 64 nt, Human; identical to SEQ ID NO: 202953

SEQ ID NO: 251958 - RNA, 56 nt, Human; identical to SEQ ID NO: 202954

SEQ ID NO: 251959 - RNA, 64 nt, Human
cguucacauguucuggcucuguacuccacgcuuaucgcgugaacccucacauguuggacuuuca

SEQ ID NO: 251960 - RNA, 64 nt, Human
gcgcugacccaccaucacccugcucugcccagccucgcgugaccucagagagguggggauaggg

SEQ ID NO: 251961 - RNA, 64 nt, Human
aucagucgccaaaagccacucagccccagccaccucgcgugagacccucacuguucauuguguu

SEQ ID NO: 251962 - RNA, 64 nt, Human
accagcaggauugcuccaggauuuuguguuuaccucgcgugaaguucagcacgugcugucgugu

SEQ ID NO: 251963 - RNA, 64 nt, Human
gguuaagguggguacgggaggguaaggcugugggucgcgugaugcgcaugucacggagggugac

SEQ ID NO: 251964 - RNA, 64 nt, Human
auggcgcugcgcuaaugacgucauaggcccggacucgcgugagugcgcgugcguuggggccuca

SEQ ID NO: 251965 - RNA, 64 nt, Human
ccacacaauggcuaugaaaaugcaaguaguuuccucgcgugaccucaccaugauucacauacgu

SEQ ID NO: 251966 - RNA, 64 nt, Human
auuacccucaggacaaugucugaacucuccagcuucgcgugagaaguccccuuccaucccagag

SEQ ID NO: 251967 - RNA, 64 nt, Human
uguacggauuugcucuccggaaggaauucugguuucgcgugauccugccugcguccgugucucu

SEQ ID NO: 251968 - RNA, 64 nt, Human
ucccccagcaauuugggaggcaaaggugggagaaucgcgugagcccaggaguuccagaccaggc

SEQ ID NO: 251969 - RNA, 64 nt, Human
cgccauucaccugccucagccucuggaguagcugagacuacaggcgcccaccaccaugcccggc

SEQ ID NO: 251970 - RNA, 64 nt, Human
acucgggcagcagaaucagauuggcagaaucuuuagacuacacaggcaauaaucaagucugcug

SEQ ID NO: 251971 - RNA, 64 nt, Human
ggucauccuccugccucggccucccaaagugcugagacuacaggugugagccaccgugcucagc

SEQ ID NO: 251972 - RNA, 64 nt, Human
ccaccagacuugcucauuuuucgaguuuuuaacuagacuacacucuauugaguuuaauuuuguc

SEQ ID NO: 251973 - RNA, 64 nt, Human
acgacccuaccccacccccuguuuucagggguuuagacuacauuugaaauccaaacuuggagua

SEQ ID NO: 251974 - RNA, 64 nt, Human
cuuccaaaaguagacccuguccccacacaggucaagacuacagagaaggcuuuguagaaaugug

SEQ ID NO: 251975 - RNA, 64 nt, Human
guaguuggaagaauuauucuucuggaggucuguuagacuacauccuacacugacuucagaaaac

SEQ ID NO: 251976 - RNA, 64 nt, Human
aacagauguuauccucagcacaaauucaguaaagagacuacaaaaggaugaucuucaagaaggg

SEQ ID NO: 251977 - RNA, 64 nt, Human
cugacugcggggcuuuuuaaaugcuucccuggacugcggggaggggcggggggagggagggauu

SEQ ID NO: 251978 - RNA, 64 nt, Human
ccgacuggaauccugaguccugggaagcuggcacugcggggaucuugcccgguguccugguccu

SEQ ID NO: 251979 - RNA, 64 nt, Human
ugggaucuccucuuccaccucuuccugguuccuuugcggggaaaauugcacuaaaacagaaccu

SEQ ID NO: 251980 - RNA, 64 nt, Human
cgccucccuccagcccuggagaggagggcagggcugcggggaggccaggccgagccccuggaac

SEQ ID NO: 251981 - RNA, 64 nt, Human
uaccaaucugugcggggcaguguccuaagcacuuagacuacaucagggaagaacacagaccaca

SEQ ID NO: 251982 - RNA, 64 nt, Human
auagugucagacauacugaccaaaaccacaaucuagacuacaaaguauauuguuuuagaguacu

SEQ ID NO: 251983 - RNA, 64 nt, Human
agaauuccuauuuaaaaaaauagaaaaauagugaagacuacacaagaggaaauagggcuuuuaa

SEQ ID NO: 251984 - RNA, 64 nt, Human
agguaauuuuugccauuuggccagagggaaucagagacuacaagcuggacagucacccaggccc

SEQ ID NO: 251985 - RNA, 64 nt, Human
uccucucaccucagccucucaaguaauauagcugagacuacaagugugugccaccaugccucac

SEQ ID NO: 251986 - RNA, 64 nt, Human
agagugaaacauucacaaagauuugcguuaaugaagacuacacagaaaaccuuucuagggauuu

SEQ ID NO: 251987 - RNA, 64 nt, Human
caugugcugugugcucuuugaaaggaaugacagcagacuacaaagcaaauaagauauacugagc

SEQ ID NO: 251988 - RNA, 64 nt, Human
uagugaagacaauguacaguuauccguuagaucaagacuacacggucuaugagcaauaauguga

SEQ ID NO: 251989 - RNA, 64 nt, Human
gagaauuaccuaaugauggauugaauaaaucuuuagacuacaaaagcccaacuuuucucuauuu

SEQ ID NO: 251990 - RNA, 64 nt, Human
gaagaggaagauuugugcagaccaagagcaccacagacuacaacugcccagcuucaucuaaaua

SEQ ID NO: 251991 - RNA, 64 nt, Human
uuccauaugucuauaacaaaagcaauauauacccagacuacacuaguccauaagcuuuacccac

SEQ ID NO: 251992 - RNA, 64 nt, Human
auuagagacaauauuggauguacaauuccucaggagacuacaguaguauauucuauuccuuacc

SEQ ID NO: 251993 - RNA, 64 nt, Human
uauuuuaguuaaacucugacagcucccaaacggaagacuacagcaugacguaguauuaugauug

SEQ ID NO: 251994 - RNA, 64 nt, Human
gaacaauagcggauagagcuacagguguucaguaagacuacaaaaacauuuugccuauuucgcu

SEQ ID NO: 251995 - RNA, 64 nt, Human
ccaacagacagggccuagcuuucauuugacacacagacuacagccagaagcccauggagcaggg

SEQ ID NO: 251996 - RNA, 64 nt, Human
aaacauuugacacauaaaaguaauuaauugcuggagacuacaauuccuggcaaacaccauuauu

SEQ ID NO: 251997 - RNA, 58 nt, Human
ccccgcgcuuccagcccugagcuuccgaugcggggagagcagagccucgggaggggca

SEQ ID NO: 251998 - RNA, 64 nt, Human
aucugucacacgcaugugggguggaguagggagaugcggggagcagggugggcaggaauacugu

SEQ ID NO: 251999 - RNA, 64 nt, Human
cugggggugcuggaggccaugcucccuccaggcuugcggggagaacuucccugccuccuccagu

SEQ ID NO: 252000 - RNA, 64 nt, Human
ucuaauggaaaaccuggagaagucgucaggaaccagacuacaguggacccuggagaaccuugaa

SEQ ID NO: 252001 - RNA, 64 nt, Human
agcaguccucccgucucagccuccugaguagcugagacuacaggugcacaccaccaagccuggc

SEQ ID NO: 252002 - RNA, 64 nt, Human
aaauuaucucccuaguucaaucuguagugaaauaagacuacagaaggcauuguuuuuuccuuuu

SEQ ID NO: 252003 - RNA, 64 nt, Human
auuuugaaguacauuuuuuccuguuuucacaauuagacuacauuuaauguguaggaauuguaug

SEQ ID NO: 252004 - RNA, 64 nt, Human
agcaguccucccaccucagucuccugaguagcugagacuacagcugugcgccaccacaucuggc

SEQ ID NO: 252005 - RNA, 64 nt, Human
agcgauccucccaccucagccucccaaguagcugagacuacagguguguguccaugcacagcua

SEQ ID NO: 252006 - RNA, 64 nt, Human
agcccucacggcugaucaauaauguugcaaagggagacuacagggaucucacgacgaauauucu

SEQ ID NO: 252007 - RNA, 64 nt, Human
agaaaaccugaaacgaugauugaaugggaaaaagagacuacaaaauuugucguaggauguauac

SEQ ID NO: 252008 - RNA, 64 nt, Human
ggacaauuaaagagacaaccaagggaacacauugagacuacaaaaauaugaauaaucucaauua

SEQ ID NO: 252009 - RNA, 64 nt, Human
gaaguuagcaccucuuggacugaaucguuugucuagacuacauguauuacaaagucucuuuggc

SEQ ID NO: 252010 - RNA, 64 nt, Human
agaccaccuacccacaaugcagccuauacucccaagacuacaaaguuaccaucgcaaaggaaag

SEQ ID NO: 252011 - RNA, 64 nt, Human
cagaucaguuaauuaacuccagaaagcaaauguuagacuacacauuuauuuuucuccuugauca

SEQ ID NO: 252012 - RNA, 64 nt, Human
aaauuuucuccccucccucuuaaugagguuuuagagacuacaccagaauaaaagacaguuuagg

SEQ ID NO: 252013 - RNA, 64 nt, Human
uuacacauauggccauuuauguaaagucccucuaagacuacauacuuuuuguuuaaaacaaaau

SEQ ID NO: 252014 - RNA, 64 nt, Human
aacaguccucccaccucagccuucugaguagcugagacuacagacaugcgccaccaugucuggc

SEQ ID NO: 252015 - RNA, 64 nt, Human
uauuuacuaauugcuaguguacucaguguggaaaagacuacagauuacacacucuuuucauuca

SEQ ID NO: 252016 - RNA, 64 nt, Human
gagggaccaagcauguggcccaggcucuaagcucugcggggauuggagagggauggggagggaa

SEQ ID NO: 252017 - RNA, 64 nt, Human
uauugcuguccuggaggggcuggggacuugugucugcggggaucagagcgcacagggagugcac

SEQ ID NO: 252018 - RNA, 64 nt, Human
ucuucacaguggagaacucuuggccaaagguuuuugcggggaggaggaggaaaccagcuuucug

SEQ ID NO: 252019 - RNA, 64 nt, Human
uguguguaaugauaaaaagucauuuucuucaaagagacuacagcuagcugcacauuguguagag

SEQ ID NO: 252020 - RNA, 64 nt, Human
ucccucaggaacuuaguagccugagucuuucaguagacuacacugcccagaacccuggccauuc

SEQ ID NO: 252021 - RNA, 64 nt, Human
uuuaagaaaucuuuuuaaaaaguaaaauucugucagacuacaaauguuuagcuguuacucauuu

SEQ ID NO: 252022 - RNA, 64 nt, Human
uaauccgggaaaagugaacauaugggcccuuuaaagacuacaagauuugcuagauaaacuggaa

SEQ ID NO: 252023 - RNA, 64 nt, Human
guugccuuuaugguuucccccuucuacauuucuuagacuacauuuagagaacuguggccguuau

SEQ ID NO: 252024 - RNA, 59 nt, Human
aguuuuugaguacuuugugaucuugcugaagacuacaggcagccaaaugguuccagaua

SEQ ID NO: 252025 - RNA, 64 nt, Human
augaguuaucaaaauauugacuccauuuaugacuagacuacauuucugaaagaucuuugguuua

SEQ ID NO: 252026 - RNA, 64 nt, Human
aacaaaaaguuacaaaaggcauaaucggaaauagagacuacauacuugaguuuaugggguuugu

SEQ ID NO: 252027 - RNA, 64 nt, Human
cuaaaguuguguacaugaacauacacccacauccagacuacagugauuuagaguuguuuugauu

SEQ ID NO: 252028 - RNA, 64 nt, Human
cacuuaucuauggauauuuuucucugugauugauagacuacacaagaagucauaugaagaaggg

SEQ ID NO: 252029 - RNA, 64 nt, Human
cugugaccagcguguguacacauaaaccuuaacaagacuacaaguauauuccagaaggaaauca

SEQ ID NO: 252030 - RNA, 64 nt, Human
ucucacagguagacaguauauaacuaacaaccaaagacuacauauugucacugacacacacguu

SEQ ID NO: 252031 - RNA, 64 nt, Human
auuauaacaacacaauaucaauccagcaaucuuuagacuacaauaauacuuuuauccaugugcu

SEQ ID NO: 252032 - RNA, 64 nt, Human
auaaaacaacuaccuaauacaaauauuucugauaagacuacaaauaucugacugagcuggggau

SEQ ID NO: 252033 - RNA, 55 nt, Human
agacuucucuucuucauuaaaaugaagacuacauuugugaacaaaaaauggagaa

SEQ ID NO: 252034 - RNA, 64 nt, Human
agaaaacuugauaaauacuugauuuuaaccaaugagacuacaggcagaugggacuaaguguuua

SEQ ID NO: 252035 - RNA, 64 nt, Human
cagcugacguccucucucgaucugcaagccuuucaccaaccaaauaguugccucucucgucacc

SEQ ID NO: 252036 - RNA, 64 nt, Human
auagugacguccugaagagccagucuguaaaauaaccaaccacuuacuuagcguuuggauagac

SEQ ID NO: 252037 - RNA, 64 nt, Human
gguagggcacagggaagagggagggugucucacaaccaaccaguucagaaugauacggaacagc

SEQ ID NO: 252038 - RNA, 64 nt, Human
auccaguucauuguuuuuuuuuugguaagaagugagacuacaguuccagcuaccuacaugucuu

SEQ ID NO: 252039 - RNA, 64 nt, Human
gaagcauccaaauaaagaauuucccucaugggccagacuacaacuuaacagaccuaggguuuug

SEQ ID NO: 252040 - RNA, 61 nt, Human
acaaugccacccgccucuaggcugugggcccagacuacagccuggaauggggaaggccugg

SEQ ID NO: 252041 - RNA, 64 nt, Human
gaaaauaaucucucugcuuaauuguuaacucagaagacuacauuagugagauguaagaauuauu

SEQ ID NO: 252042 - RNA, 64 nt, Human
agcaauccugcugucucagccucccaaguaacuaagacuacaggcaugcaccaccauacccaac

SEQ ID NO: 252043 - RNA, 64 nt, Human
cugacgcaacaggaugaaaauccaucagaaucucagacuacagcacuaaauaugcuuugaugcu

SEQ ID NO: 252044 - RNA, 64 nt, Human
gagugauccuccugucucaccucccaaguagcugagacuacaguacaggcacaugccaccacac

SEQ ID NO: 252045 - RNA, 64 nt, Human
uagagaauagcuucauauguuuacacguuugcauagacuacacacaugucaugcguuuauggca

SEQ ID NO: 252046 - RNA, 64 nt, Human
guucuauuggacagugcucuucuagaucaucauaagacuacagagcacuuuucaaagcucaugc

SEQ ID NO: 252047 - RNA, 64 nt, Human
ccagcagccccacaccagggccagccucuagagcagacuacagcuggggugcagggaugugggu

SEQ ID NO: 252048 - RNA, 64 nt, Human
aauacaagaaguucugggaggagacauugucuucagacuacaauguccaguuucuccccuagac

SEQ ID NO: 252049 - RNA, 64 nt, Human
agucccagccccugcuuacauuccagacagacacagacuacaccacaggagagaagauuuuaac

SEQ ID NO: 252050 - RNA, 64 nt, Human
gucgaugaaauaaacacaacucuuugaggauuugagacuacauucacccuuuauucacagucac

SEQ ID NO: 252051 - RNA, 64 nt, Human
agcaauucucuugcuucagccucccaaguagcugagacuacaagcacccaccaucacacccagc

SEQ ID NO: 252052 - RNA, 64 nt, Human
gauuuuaagcuuugcacauguccacccaaacuaaagacuacauuuuccauccacccuagaggcu

SEQ ID NO: 252053 - RNA, 64 nt, Human
aaaugaaauaguggcuaaagcccugaaagaggcaagacuacaaugggcugaaacaguugguaua

SEQ ID NO: 252054 - RNA, 64 nt, Human
gggcuggccaaggccggagccagcucccucagcuugcggggaggugcggagggagaggggcggg

SEQ ID NO: 252055 - RNA, 64 nt, Human
cuaggacggcccggugaccgcgcggauucaggauugcggggacgcagaaagguuaaggcacuuu

SEQ ID NO: 252056 - RNA, 64 nt, Human
gccagggcuucugccugaagauggagcugcagccugcggggaagcagcucagcucgaugguggg

SEQ ID NO: 252057 - RNA, 64 nt, Human
agcgauccuccugucucggccucacaaaguguugagacuacaggcaugagccacugugcccagc

SEQ ID NO: 252058 - RNA, 64 nt, Human
cugucuguggcucaauuucagucuucacagggauagacuacaacaccucuaggccccaaccacg

SEQ ID NO: 252059 - RNA, 64 nt, Human
uacauauaaauccuggaacagaaauuguuuauagagacuacacuaauuauuuuaacuguauaca

SEQ ID NO: 252060 - RNA, 64 nt, Human
uucaaccaguugaucaaauggcagaaaagcaguuagacuacaaucugugcagacagcauggaca

SEQ ID NO: 252061 - RNA, 64 nt, Human
gaucauagcgucaacauggucuggaguguguugcagacuacagaacauuguucucccuucaagc

SEQ ID NO: 252062 - RNA, 64 nt, Human
gaaaugcaucagguccuuuggggcauagaucagaagacuacaaaaaugaagcugcucugaaauc

SEQ ID NO: 252063 - RNA, 64 nt, Human
uugccucauuuaauaguauacaggcucagcccauagacuacaguucuucagaggccauaugucu

SEQ ID NO: 252064 - RNA, 64 nt, Human
uuauuuccugcuuuuuaucacaguugauuucugaagacuacauugccaagcagaaugaugaaau

SEQ ID NO: 252065 - RNA, 64 nt, Human
auuuuucauugugagacacuaaaaacuguuaaucagacuacagcuguuaucuuuccucuccuac

SEQ ID NO: 252066 - RNA, 64 nt, Human
uaauugacaugggcgaagcuaaaaguguccccaaagacuacacuguuguugagguggugguagu

SEQ ID NO: 252067 - RNA, 64 nt, Human
agcuuguuucugugacccaggagaacuuagugcaagacuacaggaguuaacagauggccagcuc

SEQ ID NO: 252068 - RNA, 55 nt, Human
caaggccacucuccccauaaacaucagacuacagauuuagguggaagagcagcca

SEQ ID NO: 252069 - RNA, 64 nt, Human
gagaccgcaaaaauucacuccuggagaucuccguagacuacaaucaaucaaaucaauagucagu

SEQ ID NO: 252070 - RNA, 64 nt, Human
ugaagaaaauaaaagaaauuauguuauauuaucuagacuacacaaaaguaagccacacuauauc

SEQ ID NO: 252071 - RNA, 64 nt, Human
ccuugugaugcuaugguuggggguaguuagggagagacuacaugaaauugugugccccuauuuu

SEQ ID NO: 252072 - RNA, 64 nt, Human
gcuuucuuguaauaaccuuuuauuacuguucuagagacuacacuaccgacagugugggccagcc

SEQ ID NO: 252073 - RNA, 64 nt, Human
ggacgggaacugcucuuuaauuauuagugauguuugcggggaugacgaugccaaguacaccugc

SEQ ID NO: 252074 - RNA, 64 nt, Human
ugcauugugaaaaauuuuauuuucggcguugcaaugcggggaggagaagucagauuauguacau

SEQ ID NO: 252075 - RNA, 64 nt, Human
ucuuggggccccgugauggggaggagagggcaggugcggggaggcucuggccuuccuuggugcc

SEQ ID NO: 252076 - RNA, 64 nt, Human
ccuggcuuugugagacacuguacaaggaguuacaagacuacagcuauaaccugcaguugagcag

SEQ ID NO: 252077 - RNA, 64 nt, Human
cuuguauaucugacauuuaauuuuuuaauuauggagacuacaugcuuuuguaguauaauauuaa

SEQ ID NO: 252078 - RNA, 64 nt, Human
auauguuuauauucuuucuuaaugaaccuuagaaagacuacauguuacuaagcaggccacuuuu

SEQ ID NO: 252079 - RNA, 64 nt, Human
acguuccuuaggcccugugcucagagaaaugauaagacuacaaaugcgggggccagggcucaag

SEQ ID NO: 252080 - RNA, 64 nt, Human
cagaaaggcuuuaauacuggaaaaaaagaauucaagacuacaggcagcuccccucuguacccca

SEQ ID NO: 252081 - RNA, 64 nt, Human
uuuucuagcuagacuguaaacuccuuaaggacagagacuacaccuuguacuuuuugugcaugac

SEQ ID NO: 252082 - RNA, 64 nt, Human
acacugaggagagauucccgcggguuccgcaggcagacuacacaggaugaggugguggagugga

SEQ ID NO: 252083 - RNA, 64 nt, Human
gaggaguccaaggcucuccuggaggaauacaacaagacuacaaugcuucucuccaagcaauucg

SEQ ID NO: 252084 - RNA, 64 nt, Human
acauuccucucacuuguaccccacuaaaaguauuagacuacacauuacauugaaguuaaacaca

SEQ ID NO: 252085 - RNA, 64 nt, Human
uggaauucaagaacagacucuggaguguccauuuagacuacacuaacuagacuuuuaaaagauu

SEQ ID NO: 252086 - RNA, 64 nt, Human
guuacuccaaaguaauaguaggggauaaacccauagacuacaacaauuauaggacagcuuuugu

SEQ ID NO: 252087 - RNA, 64 nt, Human
gugacuuuuuccucuuguuuuaucaacguuuuggagacuacacaaugaaaacacaucuguuggg

SEQ ID NO: 252088 - RNA, 64 nt, Human
ucucuuuugggggaaucaagcauuugcuuccucuagacuacagcagggaaagggaggagaaauc

SEQ ID NO: 252089 - RNA, 64 nt, Human
uauaaccugaaccuuuuuuuggagugggguggguagacuacaguagacacaagggcuggacaug

SEQ ID NO: 252090 - RNA, 64 nt, Human
guuacuccaaaguaacaguaggggauaaacccauagacuacaacaacuauaggauggcuuuugu

SEQ ID NO: 252091 - RNA, 64 nt, Human
ggaccucagccucuauucgcaacucauaauccguagacuacaagaugaaaucucaauaaauuau

SEQ ID NO: 252092 - RNA, 64 nt, Human
gguggugcacuggugacuucauggccacgccagcugcggggacgcacuugggacuccucgagag

SEQ ID NO: 252093 - RNA, 64 nt, Human
ugaggagguucacugagcuccccagaucucccacugcggggagacagaagccuggacucugccc

SEQ ID NO: 252094 - RNA, 64 nt, Human
gucaggaccagauuuucccagccauccagcaugcugcggggagaaggggcagaggcucaccucc

SEQ ID NO: 252095 - RNA, 64 nt, Human
aagaaggaaggaaggaaaaacuuguuacugaaagagacuacacuaucagguuucauuacauauu

SEQ ID NO: 252096 - RNA, 64 nt, Human
gguuuuggcaauuaaaccuccuuccuacugguuuagacuacacuuacaacaaggaaaaugcccc

SEQ ID NO: 252097 - RNA, 64 nt, Human
auguucaucuuucuguuaauuucccucugccuaaagacuacaugacagaaaugaccuaucacua

SEQ ID NO: 252098 - RNA, 64 nt, Human
uggcccaaagccauuucaaguacagaaauuauagagacuacagcuaaauaaauuugaacauuaa

SEQ ID NO: 252099 - RNA, 64 nt, Human
cuacagaugauuaugcagcauuugaauccaacaaagacuacauuuuggaauccaguggaaucuu

SEQ ID NO: 252100 - RNA, 64 nt, Human
agcgauucuccugccucagccucccgagcagcugagacuacaggcgccugccaccacgccuggc

SEQ ID NO: 252101 - RNA, 64 nt, Human
cucgguuccaucucauccauuuccuuuucaauggagacuacagcgucagccagcucagccuugg

SEQ ID NO: 252102 - RNA, 64 nt, Human
auucugcagacucuaaagacuucccuuuucugccagacuacauuuuguggggagccugaggacu

SEQ ID NO: 252103 - RNA, 64 nt, Human
aagccauuccagaaaugguaacuuaaaaaaaaaaagacuacaugucuaggaaacuguugagauu

SEQ ID NO: 252104 - RNA, 64 nt, Human
auaauacauacuaaugaaguauuacaugauuuaaagacuacaauaaaaccaaacaugcuuauaa

SEQ ID NO: 252105 - RNA, 64 nt, Human
cugcuaucuugugucauguacccacuuuuuggccagacuacacugggaagaagguaguccucua

SEQ ID NO: 252106 - RNA, 64 nt, Human
ggucguuagaaguugaaugggcacagcaacucuaagacuacagcacacgucauuucuuagcuaa

SEQ ID NO: 252107 - RNA, 64 nt, Human
aucucuugccaaauaaggguccccuccucacuggagacuacaaguggugggucaggugguccua

SEQ ID NO: 252108 - RNA, 64 nt, Human
agcuuuauguggcccuuuucugguccccuggcuuagacuacaguucuguguggauuugucugau

SEQ ID NO: 252109 - RNA, 64 nt, Human
agacuucaaucuacagcccagcucauccagaugcagacuacagucccugcaauugggucucugg

SEQ ID NO: 252110 - RNA, 64 nt, Human
uagagaggccuggggagagcagccgauggggcucagacuacauauggcaggccgaucagagcuc

SEQ ID NO: 252111 - RNA, 64 nt, Human
ucccgcggauggccaguagggggcgcuggaggacugcggggaucuagggccuggcugggaagag

SEQ ID NO: 252112 - RNA, 64 nt, Human
gaaguggaggucugccagcugccccggccaggcuugcggggaguucucuuccgccguguggcgg

SEQ ID NO: 252113 - RNA, 64 nt, Human
cgggaagggggcggggcuucccucccgggccgcaugcggggagaggcugcucccuccccuuuuu

SEQ ID NO: 252114 - RNA, 64 nt, Human
agcaauccuccugccucagccucccaaguagcugagacuacaggcacgagccaccacacccagc

SEQ ID NO: 252115 - RNA, 64 nt, Human
gugacuccauaguuuuuaaaguaauaagggucaaagacuacaucagagauucaaauagguuuuu

SEQ ID NO: 252116 - RNA, 64 nt, Human
aaaaauaaugacauuggguaucuauuucuuucuaagacuacauuaguaggaaaauaagucuuuu

SEQ ID NO: 252117 - RNA, 64 nt, Human
ccugggauuccagcacgaugccuccauaguugaaagacuacacaaaaagccacaaucauugccc

SEQ ID NO: 252118 - RNA, 64 nt, Human
agagaauaaccugguguguucagguuauucuuagagacuacacauuuggaauagcagagcaaaa

SEQ ID NO: 252119 - RNA, 64 nt, Human
ucagccaaaauuaccguuuuagaccagaaugaauagacuacacugauaaaauguacuggauaau

SEQ ID NO: 252120 - RNA, 64 nt, Human
ucuuucauaaagagaccucaguuuauagcguaacagacuacacaaugcacugauguuuucauaa

SEQ ID NO: 252121 - RNA, 64 nt, Human
caguaauucaguccauucuucuccccugaaaugaagacuacaucaccucucucccuuuggaaac

SEQ ID NO: 252122 - RNA, 64 nt, Human
gcccuuggcuaaaugaagcagagccaggaaaaacagacuacauauuuuucaugucuaaagaaau

SEQ ID NO: 252123 - RNA, 64 nt, Human
guuaaaugccgucuaucagguuuugugccuuaagagacuacagagucaaagcucauuuuuaaag

SEQ ID NO: 252124 - RNA, 64 nt, Human
acaaugaauguaaauaugacuuucuggaaaguuuagacuacauuuagaaucucuauucaaaauc

SEQ ID NO: 252125 - RNA, 64 nt, Human
gcagugccaguuggacccaagagaagacugcagcagacuacacaguacuucuugucaaaaugau

SEQ ID NO: 252126 - RNA, 64 nt, Human
gauaaccucagggaaccagcacuucccaaaccgcagacuacaucuuuagaggaagcacaacugu

SEQ ID NO: 252127 - RNA, 64 nt, Human
uuuggacauauuccaggcuaaaugcuuuuacucaagacuacagaaagguuugaaguagugugug

SEQ ID NO: 252128 - RNA, 64 nt, Human
accccaggagccaggcuuccccucagcugggugaagacuacagacucccugggguuggcagggg

SEQ ID NO: 252129 - RNA, 64 nt, Human
agugcuucuccagccucagccucccaaguagcugagacuacaggcacacaccaccacgccuggc

SEQ ID NO: 252130 - RNA, 64 nt, Human
gcgcagaacuuuggaagcugcuacuuacuuggaaugcggggagaccgacggugcgaaggcccuu

SEQ ID NO: 252131 - RNA, 64 nt, Human
ccugccaggaaauaaauucaaauacaguaugagcugcggggauauuuuugugucuacaccaggu

SEQ ID NO: 252132 - RNA, 64 nt, Human
gccccagcacuuuuggcucuguugcgcguggggaugcggggagauuugagaggggaaaaccccg

SEQ ID NO: 252133 - RNA, 64 nt, Human
uugauuuuucaaguggguaugccuccuagaauaaagacuacauuucccagucuccugugcaggu

SEQ ID NO: 252134 - RNA, 64 nt, Human
agggauauuagucauuauuuuauucaugacagguagacuacaauucgaacuuaggguuaccuca

SEQ ID NO: 252135 - RNA, 64 nt, Human
aagguacagccaugggaauacagaaugauagaagagacuacagauggauaauuggacuuaagcc

SEQ ID NO: 252136 - RNA, 64 nt, Human
aggagagagcuagucuagauaaaaaaagagauaaagacuacagaaggaaagagaucuugccuuu

SEQ ID NO: 252137 - RNA, 64 nt, Human
ugaucuccucccaccucagccucccaaguagcugagacuacagguucacaccccccacaccugg

SEQ ID NO: 252138 - RNA, 56 nt, Human
aguaugaaguuuccaucugaaccccaagacuacagcugcaggacccaggacgcccc

SEQ ID NO: 252139 - RNA, 64 nt, Human
gcuacagcuagugugcuuuuagacuuuccgccgcagacuacauuucuagaguuagagaaaccug

SEQ ID NO: 252140 - RNA, 64 nt, Human
cuguucugugcccaguaugugggcggaugacgcaagacuacaagauccuugcccucaagcugcu

SEQ ID NO: 252141 - RNA, 64 nt, Human
uauguacauacuggaagaaucuucauaauaaaugagacuacacaacaauauuguauguauccca

SEQ ID NO: 252142 - RNA, 64 nt, Human
agcaauccuccugugucagccaccagaguagcugagacuacagggguaugccaccaugcccagc

SEQ ID NO: 252143 - RNA, 64 nt, Human
auuagacuucuuaaggaaucaaauuuauuucaagagacuacacaugguuauuuaaucuccggua

SEQ ID NO: 252144 - RNA, 64 nt, Human
ucagauuuggggggguuuuauauuaaagaaauuaagacuacacuauuuaaauaaacguuuccug

SEQ ID NO: 252145 - RNA, 64 nt, Human
acuuuaugaacuuaaauggaaauuaauuuauuguagacuacaucucuauuuggaaugaugaggu

SEQ ID NO: 252146 - RNA, 64 nt, Human
aaaaugaauggaaguggcuggaugggacaucuccagacuacaaaaauuggaaagcuggacagcc

SEQ ID NO: 252147 - RNA, 64 nt, Human
ucccuucuccuuuccaggguagcaucacgcccacagacuacacccucuccaagugcuaccuccc

SEQ ID NO: 252148 - RNA, 64 nt, Human
auaaaaaguguuacuuaaccaacaaacaaauguaagacuacaaaaucguucaagagcaauucua

SEQ ID NO: 252149 - RNA, 64 nt, Human
caucgggcuuugucccucccccgcuuccucccucugcggggaggacccgggaccacagcugcug

SEQ ID NO: 252150 - RNA, 64 nt, Human
caggcaugggcgauggcucccucuucccagaaucugcggggaacuggggcaaggcccaucuguc

SEQ ID NO: 252151 - RNA, 64 nt, Human
uaaacaccucaauguagguacauuacacucuuguugcggggaggggauuuaccagaauacaguu

SEQ ID NO: 252152 - RNA, 64 nt, Human
gcucaggaugccccaggaaggaaagaagggcaacagacuacacgauuggacgugugugguugac

SEQ ID NO: 252153 - RNA, 64 nt, Human
aaaguauaaaaauuucuggaauacugacauguaaagacuacaguuaauucugacacuguaucuu

SEQ ID NO: 252154 - RNA, 64 nt, Human
uuucccugccucuacuugacuuggaauuggcugaagacuacacaggaaugcaucguucccacuc

SEQ ID NO: 252155 - RNA, 64 nt, Human
aaauaacuucugcacagcaaaagaagcuauuugcagacuacagaaugggagaaaauguuuacaa

SEQ ID NO: 252156 - RNA, 64 nt, Human
agcaguccuucugccuuagccuccuaaguagcugagacuacagacgugcgccaccacacccagu

SEQ ID NO: 252157 - RNA, 64 nt, Human
gggacugcuguacaaagaauauaggaaggccucuagacuacauccauuccuuccucaacaggag

SEQ ID NO: 252158 - RNA, 64 nt, Human
agcgauucuccugccucagccucccgaguagcugagacuacaggcgugugccacuacgcccggc

SEQ ID NO: 252159 - RNA, 64 nt, Human
cauacagggaagaguuguaugucuccuguggcauagacuacacuuggcaauugggguaauugau

SEQ ID NO: 252160 - RNA, 64 nt, Human
ggcgccuccuccucccccuccuccucaccuggagagacuacaggaacuucagggucacuccccg

SEQ ID NO: 252161 - RNA, 64 nt, Human
caaggggagaagagacgaagcagcuggacaucggagacuacaguugaacuucggagagaagcaa

SEQ ID NO: 252162 - RNA, 64 nt, Human
agauaucugcaaagaagaguaauuucaugaaugcagacuacaugguuguuuauuuagugaucag

SEQ ID NO: 252163 - RNA, 64 nt, Human
aguaaucagauugagaaaacccuaugaguauuccagacuacagaguuugcccaaaucaacugua

SEQ ID NO: 252164 - RNA, 64 nt, Human
uucuuaguuuccuuaucuguaaaacaguggaguuagacuacauaucuuuuggcacuaacaucuc

SEQ ID NO: 252165 - RNA, 64 nt, Human
gcucccuuuguuucaaaguguuugccaggcauccagacuacacguguggauuugcagggagcca

SEQ ID NO: 252166 - RNA, 64 nt, Human
ugggugaguggccugcuaaggccccuccuugcccagacuacagggcuuaggacuugguuuguua

SEQ ID NO: 252167 - RNA, 64 nt, Human
agcgauucuccugccucagccucccgaguagcugagacuacaggcaccugccaccauacccagc

SEQ ID NO: 252168 - RNA, 64 nt, Human
aguaaccaucacugguugcacuuaugauuucaugugcggggaucaucugccgugccuggauccu

SEQ ID NO: 252169 - RNA, 64 nt, Human
cccccgucacccucugacugcaggccugggcgacugcggggagcuugcucuucccucccccuca

SEQ ID NO: 252170 - RNA, 64 nt, Human
gcucaggcaauccgcaggccucagccucccuaagugcggggauuacaggcuugagccacugcac

SEQ ID NO: 252171 - RNA, 64 nt, Human
cuuucuaauuuuuacugaacugaaagcacaaagaagacuacacagaaaaucuggaaacaguugc

SEQ ID NO: 252172 - RNA, 64 nt, Human
uugggaaaucaucuuuacggaauguggugcugagagacuacauuuauaauuggagauccugaac

SEQ ID NO: 252173 - RNA, 64 nt, Human
aagcgaucccuccccucagccuccugaguagcugagacuacaggugagugccaccacacucagc

SEQ ID NO: 252174 - RNA, 64 nt, Human
acuggcuggagcugcccccuccaggccaguuugaagacuacaugaacacgucuuguuuggaggu

SEQ ID NO: 252175 - RNA, 64 nt, Human
uagaagacaagaauguaucaagacacacagguucagacuacacaauuauucaugaaauggcugu

SEQ ID NO: 252176 - RNA, 64 nt, Human
ugagggacauaucagugaccucgacguugccuuuagacuacaguuguguuagccucuugcguau

SEQ ID NO: 252177 - RNA, 64 nt, Human
cagacagcaucaaauauuugcccaauccaagauuagacuacacaaaagcuuccuuccaguauua

SEQ ID NO: 252178 - RNA, 64 nt, Human
acuuuaccaggcaugcagaagccuguaccaacacagacuacagcacccaggaggugcgagugug

SEQ ID NO: 252179 - RNA, 64 nt, Human
uaauuugccuugcuacacauuaagagggcuauuaagacuacauuuuuucuaaccucagauaagu

SEQ ID NO: 252180 - RNA, 64 nt, Human
uccuuccuugacaaaguacuauacagcugaagaacaucucgaauacaauuuuggugggaaagga

SEQ ID NO: 252181 - RNA, 64 nt, Human
uguguucucagagcccucaucacuucccaugccccaucucgacucccauccccaucuaucugug

SEQ ID NO: 252182 - RNA, 64 nt, Human
ucuguucguuuauccauugcgaucuggggagccccaucucgauauuuccaauccuggcuacuuu

SEQ ID NO: 252183 - RNA, 64 nt, Human
aaucuuuguauauauuuuuuuguguacaugcacacaucucgaaauccauuuccguguuuaaugu

SEQ ID NO: 252184 - RNA, 64 nt, Human
cccagugucucacugccaaaccucuugguuacgcugcggggaucuguuucuuugccugagaucc

SEQ ID NO: 252185 - RNA, 64 nt, Human
uagaaaggggacaaccaagugucucaguuugccuugcggggagggggcuccugggccaugggac

SEQ ID NO: 252186 - RNA, 64 nt, Human
aggaggccaggaacuucuuuggacuuggaaggugugcggggacuggccgaggccccugcacccu

SEQ ID NO: 252187 - RNA, 64 nt, Human
uucggcggcuaaugcuaccgcuuaaacgacucagcaucucgacuucccaaaucaaaggcccuuu

SEQ ID NO: 252188 - RNA, 64 nt, Human
guccccccacuucugugucucaguccucucaguccaucucgagccuccguucaaauugaucauc

SEQ ID NO: 252189 - RNA, 64 nt, Human
uugcacuccagcccgggcaacaagagcgaaaccccaucucgaaaaaaaacaaaacaaaacuaga

SEQ ID NO: 252190 - RNA, 64 nt, Human
uauacugucugucugaggcagaagauaacagcagcaucucgaccagccucugccuuaaaggaaa

SEQ ID NO: 252191 - RNA, 64 nt, Human
uguccauggcccuuaagucagcuuaaugcuuuuacaucucgaugugacuuuuguuaaaaucuac

SEQ ID NO: 252192 - RNA, 64 nt, Human
gaagauguuauuuuguuggguuuuguucccccuccaucucgauucucguacccaacuaaaaaaa

SEQ ID NO: 252193 - RNA, 64 nt, Human
aaagccagcgccguggaguucgugccaauccugacaucucgagguuuccucacuagacaacucu

SEQ ID NO: 252194 - RNA, 64 nt, Human
ucuucauuuauaguuuugugaguccaccaauuagcaucucgaagguuuaccuuuaucugucuuu

SEQ ID NO: 252195 - RNA, 64 nt, Human
ucuugaaguccagugugaauuuuauuaaugcuaucaucucgaccaagcucaaagccuacuuauu

SEQ ID NO: 252196 - RNA, 64 nt, Human
ccagagacugaaauuuucagccuugcuaagggaacaucucgauguuugaaccuuuguuguguuu

SEQ ID NO: 252197 - RNA, 64 nt, Human
gcgcagaaccuaccugaugcgguuccucuccacgcaucucgaggcggcguuaccuccagauucc

SEQ ID NO: 252198 - RNA, 64 nt, Human
acugcacuccagccugggcaacagagcaagacuccaucucgaaaaaaaggaauuccucuuggca

SEQ ID NO: 252199 - RNA, 64 nt, Human
ugccuccuggguucaagcgauucuccugccucagcaucucgaguagcugggauuacaggcaugc

SEQ ID NO: 252200 - RNA, 64 nt, Human
uaguuuuucuuuuuucucauuucuuuugaaauggcaucucgaacaaaguccaccaaucccuuua

SEQ ID NO: 252201 - RNA, 64 nt, Human
cugguaugguuugucuguguccucacccaaauuucaucucgaauuguaauccccauaaucccca

SEQ ID NO: 252202 - RNA, 64 nt, Human
caaagucccaagaauuuggaaugguaggaugcugugcggggagcucgaggcugaggcauaauca

SEQ ID NO: 252203 - RNA, 62 nt, Human
ggcaccugagcacgcugugagcccagcgggccugcggggacaggccaggccugaucccaccu

SEQ ID NO: 252204 - RNA, 64 nt, Human
gcgcguaccccaccaggugggcaaagcagaaaccugcggggagcggagacgccuuuuaucucug

SEQ ID NO: 252205 - RNA, 64 nt, Human
uuuaacaacuguaguacacuacccugagacacugcaucucgauuucuaucucuaguuagaguug

SEQ ID NO: 252206 - RNA, 64 nt, Human
cggggaguggguuuggauaggagagcugggacuccaucucgacccuggggcugaggccugaguc

SEQ ID NO: 252207 - RNA, 64 nt, Human
cgggccacgugggcaccguguaugcccuggcggucaucucgacgccagaccagaccaaagucuu

SEQ ID NO: 252208 - RNA, 64 nt, Human
guaguggaccgcacuccgcggcaccuucccuaaucaucucgaucugguugugacuguggccccu

SEQ ID NO: 252209 - RNA, 64 nt, Human
ccgugguuacuaugaauguauugcuguuggaggacaucucgauccaaagaacagccguuccugu

SEQ ID NO: 252210 - RNA, 64 nt, Human
acugcacuccagccuggucaacagagcaagacuccaucucgaagaaaaaaaaaaaaaauucccc

SEQ ID NO: 252211 - RNA, 64 nt, Human
gccggggccuggcucuuacccggggaguggugggcaucucgaugcuucuuugccuuaaugaugg

SEQ ID NO: 252212 - RNA, 64 nt, Human
ggccguguucuguccugcacaaauuugaacaacucaucucgauauauuugauauuucucugucu

SEQ ID NO: 252213 - RNA, 64 nt, Human
gccuuccuucaacaacaccgaugucuccaucggccaucucgacucagaaccuggucauguccuc

SEQ ID NO: 252214 - RNA, 64 nt, Human
ggcccagacaucccuacuggcuucgcugguggcucaucucgaacauccacgccagccuuucugg

SEQ ID NO: 252215 - RNA, 64 nt, Human
guucaagacuagccuggccaacauggugaaaccccaucucgacuaaaaauacaaaaauuagcca

SEQ ID NO: 252216 - RNA, 64 nt, Human
aucugggaucucgccuuauucucaaguagcaaggcaucucgacaagcauggucuaggucuggug

SEQ ID NO: 252217 - RNA, 64 nt, Human
gcauaccaggggaaguucuagaaaccgcagcugacaucucgacccaagagauuuaggauucucc

SEQ ID NO: 252218 - RNA, 64 nt, Human
aacaaaacaaaaaaaccacauaacauaaauuuaucaucucgaccacuuuucaguucaguggcau

SEQ ID NO: 252219 - RNA, 55 nt, Human
ccagcucgugccccaaaugaaaugccaucucgagccccuacagcucuacgggagg

SEQ ID NO: 252220 - RNA, 64 nt, Human
ccuguggccaagcccugaguggccacugccaagcugcggggaaggguccugagcaggggcaucu

SEQ ID NO: 252221 - RNA, 64 nt, Human
uuugggaaaucuuuuuguagcuuuuaaagagaugugcggggaagacauauggauguuagcagcc

SEQ ID NO: 252222 - RNA, 64 nt, Human
aggggacggcacggccgcucaccggaaggcugugugcggggacauccgagguggugguggacag

SEQ ID NO: 252223 - RNA, 64 nt, Human
ccauggugauaaagggcagcccggcgggucccagcaucucgagacccucugcagaaguauuauc

SEQ ID NO: 252224 - RNA, 64 nt, Human
aacagaaaaaaaaaaaaacccuuugauucugguucaucucgauacagagaaccaaaacagcuaa

SEQ ID NO: 252225 - RNA, 64 nt, Human
gaggaugcaguguacuguuaaaccaauaucaucacaucucgagucuuaucaaguuuucauucuc

SEQ ID NO: 252226 - RNA, 64 nt, Human
cucagugccacuugacauuccuugucaccagcaacaucucgagcccccuggauguccccugucc

SEQ ID NO: 252227 - RNA, 64 nt, Human
aaauuguucggcuggaacugacccaggcuggacuugcggggaggaaacuccagggcacugcauc

SEQ ID NO: 252228 - RNA, 64 nt, Human
aguccaccccaagucauacacuggacccagugccugcggggacaggacuguggguuucuugguc

SEQ ID NO: 252229 - RNA, 64 nt, Human
uuuggaggcacugcaguccaggccgaguccucagugcggggagcaggcugcugcugcugacucu

SEQ ID NO: 252230 - RNA, 64 nt, Human
ugccaggcugugcuagcaacacccaaagguggccugcggggagccaucaccuaggacugacucg

SEQ ID NO: 252231 - RNA, 64 nt, Human
uucuucccaggauaacugaagucuuuugacuuuuugcggggagggcgguucauccucuucugcu

SEQ ID NO: 252232 - RNA, 64 nt, Human
cagccaucguggccuucugagcccuuggccccccugcggggaggagguggagcagcgggcgucc

SEQ ID NO: 252233 - RNA, 64 nt, Human
cucugccacugugaaccggcucccacccucaaggugcggggagaagaagcggccaggcggggcg

SEQ ID NO: 252234 - RNA, 64 nt, Human
aagaacauguucagaagccauggggccaagcacaugcggggacggucucaaaugcgugaucaga

SEQ ID NO: 252235 - RNA, 64 nt, Human
aaagaccaucugcccggcacuggggacuuaggggugcggggaggggaaggacgccuccaagccc

SEQ ID NO: 252236 - RNA, 64 nt, Human
uacagggaggccagaagggcuccaugcacuggaaugcggggacucugcagguggauuacccagg

SEQ ID NO: 252237 - RNA, 64 nt, Human
cuagugauucauuuauacagauauaguaucucugugcggggauaugauauaauauuguauuucc

SEQ ID NO: 252238 - RNA, 64 nt, Human
gagggcgggaccugcaggacaguagccaaugaggugcggggagggggccgggcuggccaauggg

SEQ ID NO: 252239 - RNA, 57 nt, Human
gcucagaaguccugaugugaggagaggugcggggagacauuccaaaaaucaagccaa

SEQ ID NO: 252240 - RNA, 64 nt, Human
guaugaaaaggagaggacacagagacagaggagaugcggggaagacuauguaaagaugaaggca

SEQ ID NO: 252241 - RNA, 64 nt, Human
ugacggggcuguccugagcuguuaggagaguagaugcggggagggcuggugaccuccguggguu

SEQ ID NO: 252242 - RNA, 64 nt, Human
ggagguucaauagaagccgcugcaggagaguuuuaccaaccauuguguaugcccaauaauuugu

SEQ ID NO: 252243 - RNA, 64 nt, Human
uauaugacgcucuuaaaaaaacaucccaaccaaaaccaaccaaacaaaaacauccucacaacuc

SEQ ID NO: 252244 - RNA, 64 nt, Human
uagacagaggagugaaagaauuaaguggguagacaccaaccaaaaugacuuugaaagcagugag

SEQ ID NO: 252245 - RNA, 64 nt, Human
guccaggugacugcccuccuucuuucuuguaaauaccaaccaugcauuuguacagugggcccug

SEQ ID NO: 252246 - RNA, 64 nt, Human
cuaggugaccuuggacaaauucucgaacccauucaccaaccacacaaguuuguugugagucaua

SEQ ID NO: 252247 - RNA, 64 nt, Human
auuacacucaugucaaaaaucagagaggagagagaccaaccauauuugggaugaguguaaaagc

SEQ ID NO: 252248 - RNA, 64 nt, Human
auuuaacagucacaagaagucuuauuuacaugccaccaaccaaccucagaaacccauaauguca

SEQ ID NO: 252249 - RNA, 64 nt, Human
ggaccacugcucuagagagaggucaugauaucauaccaaccaaauggaaaugacaaauguuuua

SEQ ID NO: 252250 - RNA, 64 nt, Human
ucaaggugggcagaagagcagaggucuucucugcaccaaccacucucugcagauggcuggagaa

SEQ ID NO: 252251 - RNA, 64 nt, Human
uacauagccaggaguaccccuugaggcuaauucuaccaaccaagggauuugugcucuucaucug

SEQ ID NO: 252252 - RNA, 64 nt, Human
uuuuuguuguuguuguuguuguuuuacagcugaaaccaaccagcaagcccuugaugaccaagag

SEQ ID NO: 252253 - RNA, 64 nt, Human
ccugaacuuguucccagugaaggucaacagggccaccaaccaggguugaggaaccaucucagcc

SEQ ID NO: 252254 - RNA, 64 nt, Human
gagaaaugcacuuuugcacuaccaaccacuuuaaaccaaccacgagaacaaagaggagcgguug

SEQ ID NO: 252255 - RNA, 64 nt, Human
cccugacaccaguagagaaaugcacuuuugcacuaccaaccacuuuaaaccaaccacgagaaca

SEQ ID NO: 252256 - RNA, 64 nt, Human
aaccagugugccaucuccaauauuucuauaguauaccaaccaccccaggaaugcacuuuaacaa

SEQ ID NO: 252257 - RNA, 64 nt, Human
cugucacugcauuccaauggcagcuguacuaucuaccaaccaugcugaggacagcaccaaaggu

SEQ ID NO: 252258 - RNA, 64 nt, Human
cauauguauguauucacugaccaaaaauucacugaccaaccaaccaaacuccacacuucaucug

SEQ ID NO: 252259 - RNA, 64 nt, Human
uguauguauucacugaccaaaaauucacugaccaaccaaccaaacuccacacuucaucugaucc

SEQ ID NO: 252260 - RNA, 64 nt, Human
ccggacuggcagaagcauugccuggacugaccacaccaaccaggccuucauccuccuccccagc

SEQ ID NO: 252261 - RNA, 64 nt, Human
ggucaauaaggucaagggaaaaccccgucucuauaccaaccaaaccaauucaccaacacaguug

SEQ ID NO: 252262 - RNA, 64 nt, Human
cagcacuuuugauagauuacgucuaauccucccaaccaaccagcaggguagcuauuacugucca

SEQ ID NO: 252263 - RNA, 64 nt, Human
uggggaccaaggaacuauguacaaaaacaaaccuaccaaccaccaaaaacuagacaaauaaaga

SEQ ID NO: 252264 - RNA, 64 nt, Human
auuuaaggauaaagguaaaucauucaaggcaguuaccaaccacuaacuauuuguuuucauuuuu

SEQ ID NO: 252265 - RNA, 64 nt, Human
guaauuugcauguuuuguggagcauuuuuaugucaccaaccagacaguauuuccugcaugcuua

SEQ ID NO: 252266 - RNA, 64 nt, Human
acuagcuucuuuguucacaauucaguuccucccaaccaaccagucuucacuucaagagggccac

SEQ ID NO: 252267 - RNA, 64 nt, Human
ggagggaagcuucuggccaugcuugggcauucagaccaaccaucauuaauguuaauagaggaaa

SEQ ID NO: 252268 - RNA, 64 nt, Human
uaauauuuaaagauuauagcucccaaaagaauggaccaaccacuuucguaucauaauuucuuuu

SEQ ID NO: 252269 - RNA, 64 nt, Human
cauuuuggcaugugcucugagcuugaauuuugauaccaaccauucagugcaucauaccuagucu

SEQ ID NO: 252270 - RNA, 64 nt, Human
aggccagggacgaguguucagugggccacagugaaccaaccaaaccaaccccgaaucaucgcuc

SEQ ID NO: 252271 - RNA, 64 nt, Human
uugggugucugucuggcaucagauuggcagcugcaccaaccagaggaacagaagagaagagaga

SEQ ID NO: 252272 - RNA, 64 nt, Human
gcaacuaaaauauuacagauuaauaauaaauuaaaccaaccaaugauaaacacuacucagucca

SEQ ID NO: 252273 - RNA, 64 nt, Human
uuucuucaguaucgacaaagauuacauucugaguaccaaccaaacccuaaauugaaagacaaaa

SEQ ID NO: 252274 - RNA, 64 nt, Human
gauaaacuuuaauaccuccuccaaaucaucauucaccaaccauaccagagaaacauuuccaguu

SEQ ID NO: 252275 - RNA, 64 nt, Human
uccgcagaggcugggggccuccacccagcagcagaccaaccaggaagcagcuugaacuggaugg

SEQ ID NO: 252276 - RNA, 64 nt, Human
ugcuauuacaacuagcauugccucaaaaacugggaccaaccaaagugugucaacccuguuuccu

SEQ ID NO: 252277 - RNA, 64 nt, Human
gcuagauaagaucuuuuccaaaguuuuucuuagaaccaaccaaaaaacaauccgaguaggccca

SEQ ID NO: 252278 - RNA, 64 nt, Human
guccccauugucuacccacacaaauccucaggaaaccaaccaccgcccagguggcccugaggga

SEQ ID NO: 252279 - RNA, 64 nt, Human
aucaguccguuucgucucuuggaaacagcuccccaccaaccaagauuucuuuuucuaacuucug

SEQ ID NO: 252280 - RNA, 64 nt, Human
uccccccucuuuucccaccaacuccuauuucccuaccaaccaaggagccuccagaaggaaagga

SEQ ID NO: 252281 - RNA, 64 nt, Human
cauccuucucauuuuggaaacugcuagggagggaaccaaccacuuaaacaagcgugguuuucca

SEQ ID NO: 252282 - RNA, 64 nt, Human
caguuaucuuaguuuaccgguggaguauuucaacaccaaccacauuucccuuccucccucuaau

SEQ ID NO: 252283 - RNA, 64 nt, Human
ugaugagguuccuggacgugagacccucacaaagaccaaccauuccucuaauagccauuuaacg

SEQ ID NO: 252284 - RNA, 64 nt, Human
aggaggaaaaauuaaggggagagaggaaaacaaaaccaaccaaccccuaaaaucauuuucuuau

SEQ ID NO: 252285 - RNA, 64 nt, Human
agacccaagccauuguuagcagcuagccagccacaccaaccacgccagggggaggaaagggaag

SEQ ID NO: 252286 - RNA, 64 nt, Human
cucugcaaaugccaguuugacaagcacugcccagaccaaccauggguucaaacuccagcccugc

SEQ ID NO: 252287 - RNA, 64 nt, Human
aaggacuguucaaaucauaccagugacuguucaaaccaaccauacuuuuuauuagauuugcuuu

SEQ ID NO: 252288 - RNA, 64 nt, Human
cccuuagcuuucagccccccuucugaccucucauaccaaccacuccccucagucugccaaaaau

SEQ ID NO: 252289 - RNA, 64 nt, Human
gaauuagccagcuugccuccugcaccccacccccaccaaccaggggagccacuaagcugacuaa

SEQ ID NO: 252290 - RNA, 64 nt, Human
cugggggcucucagugguuaaacaaugcccaacaaccaaccagcuggcccuuggucuccucucu

SEQ ID NO: 252291 - RNA, 64 nt, Human
gagaugauccuaaaaauaaccgaagaaagagaggaccaaccagaauucccuuuggacauuugug

SEQ ID NO: 252292 - RNA, 64 nt, Human
ugcccuucauucuguacucuuggcagagucaguaaccaaccacuaauaaaaucaaaguuguagu

SEQ ID NO: 252293 - RNA, 64 nt, Human
uaugucccaauucucagaacucagauguggcuagaccaaccagugggaaacugccccagcuucu

SEQ ID NO: 252294 - RNA, 64 nt, Human
gcugggcacaccgaaacaguguaccaacgaauucaccaaccagggguuucuuucccuacccuuu

SEQ ID NO: 252295 - RNA, 64 nt, Human
ccuggcccgggaccuuggcauggcagugguggugaccaaccacauaacucgagacagggacagc

SEQ ID NO: 252296 - RNA, 61 nt, Human
uuguagugcaauccguuugauugauaugaauaccaaccaucgugggcuccagcuuaaagga

SEQ ID NO: 252297 - RNA, 64 nt, Human
ggaaaaaccaaauauacauacuuauuuucuauggaccaaccagauuaauuuaaaugccacagga

SEQ ID NO: 252298 - RNA, 64 nt, Human
cauuuuaaaaaccagacaagauggcuaggccaucaccaaccaacggacuuaccuuacaucuuug

SEQ ID NO: 252299 - RNA, 64 nt, Human
ggcgaguuaaauaggcaagguacccagugauaacaccaaccaaaccacuccuaucugcaugauu

SEQ ID NO: 252300 - RNA, 64 nt, Human
auugcagcacuguuuacaauagcaaagacuuggaaccaaccaaaauacccacaaaugauagacc

SEQ ID NO: 252301 - RNA, 64 nt, Human
ccauguagccagugaggggagggggagacacagaaccaaccacagccaggggcguccccauggc

SEQ ID NO: 252302 - RNA, 64 nt, Human
uaaugugugaccgugauauagugagaaagauucuaccaaccacuguuucacuacuuuuuaguua

SEQ ID NO: 252303 - RNA, 64 nt, Human
cuagaugguaaaaaaugugaaauugggauuagggaccaaccaaaauauuucauuaaugcuuuca

SEQ ID NO: 252304 - RNA, 64 nt, Human
ccucaggaaaugguccuuuuuuuuucuauaaaucaccaaccaacuaucuaaauggacauuuggg

SEQ ID NO: 252305 - RNA, 64 nt, Human
gagggucguccgguaucccccagugcccaccaccaccaaccagaaucacuucucagacugcaag

SEQ ID NO: 252306 - RNA, 64 nt, Human
gauucagccugauagcuaccaugcugcugucaaaaccaaccagaggggagcuuguucuucugcu

SEQ ID NO: 252307 - RNA, 64 nt, Human
cugggcagccaggaaggaaucugaauggagaaucaccaaccaccagagaaaaaagacugugggg

SEQ ID NO: 252308 - RNA, 64 nt, Human
cagccucugggguugaggugauaaucaauagcuuaccaaccaaaaagaguccaggaccagaugg

SEQ ID NO: 252309 - RNA, 64 nt, Human
cacaagucacaaauccaggcuucugaaacuucggaccaaccagcuucaaucaggguucccacua

SEQ ID NO: 252310 - RNA, 64 nt, Human
cguuuuaggaaaagaacaaaaaagacacaaacaaaccaaccagagggagaagagccccugccca

SEQ ID NO: 252311 - RNA, 64 nt, Human
uuacaaaaugaaaggaaggaaaaaaaaaaaggcaaccaaccacauuagaagucuuggcacuuug

SEQ ID NO: 252312 - RNA, 64 nt, Human
acagcauccacucuccugcgguuaccagcccugcaccaaccaccacagucagaauaaucucaaa

SEQ ID NO: 252313 - RNA, 64 nt, Human
cugcguggguagcccucggccggggagugaggccaccaaccaaagucaguuccuucccaccugu

SEQ ID NO: 252314 - RNA, 64 nt, Human
guuccuuuaagcagucuuuuuaccugcaggcuauaccaaccaggauccaaaugaagagaacucu

SEQ ID NO: 252315 - RNA, 64 nt, Human
gccacgcaacgucucugccuggcugagcacauccaccaaccaccugggcgagccacccuggguu

SEQ ID NO: 252316 - RNA, 64 nt, Human
agggccugggaccauuggcugggaccccucauuaaccaaccaagcacuuguaccucccuggcau

SEQ ID NO: 252317 - RNA, 64 nt, Human
caggagugacaagggaggaaagaccaaaaaaacaaccaaccaaaaaaaaaaaaaaaaaggaaag

SEQ ID NO: 252318 - RNA, 64 nt, Human
caccuuuggggaagcauuucugaauuuauccaucaccaaccauuucuucuuggauaccaucaag

SEQ ID NO: 252319 - RNA, 64 nt, Human
gaggaggaggcugugugugauggcucuggcucggaccaaccagaugagccuccugaagcccccu

SEQ ID NO: 252320 - RNA, 64 nt, Human
uuaccaaaaugccuuacacauuccuuacaaauaaaccaaccaaccuacacagcguuauccaggc

SEQ ID NO: 252321 - RNA, 64 nt, Human
auucuuuccccucuuuuaaaacaaaugguagcaaaccaaccacacacuguucuguaucuugcuc

SEQ ID NO: 252322 - RNA, 64 nt, Human
ccaccccugcucaacagcuuggcuuccaggcaagaccaaccacaucuggucucugccuucggug

SEQ ID NO: 252323 - RNA, 64 nt, Human
gucuucccaacccuauugcuucuaaguuguaacaaccaaccauugagugguacuuauaucugaa

SEQ ID NO: 252324 - RNA, 63 nt, Human
gucucaaaaaaauaaauacauaaauaaaaaauaaaccaaccauaauccccagugcagugguau

SEQ ID NO: 252325 - RNA, 64 nt, Human
auacuuuuugucuucaacgaauuaugaaaucuguaccaaccaacggcuggaaaugcaaaguaag

SEQ ID NO: 252326 - RNA, 64 nt, Human
cugagaacccaaacuucccagagaguaugugagaaccaaccaaugaaaacagucccaucgcucu

SEQ ID NO: 252327 - RNA, 64 nt, Human
acccacuucacacacacacaucccaaauaccaccaccaaccaccuucuuccucucaacucuguc

SEQ ID NO: 252328 - RNA, 64 nt, Human
ccuuugaggcucuaaaggaaaaucagcugccucuaccaaccacccucuaucagcaguggcccag

SEQ ID NO: 252329 - RNA, 64 nt, Human
gggcauucaaacggagggcaaaccgaugaucuaaaccaaccacuuggaaaaacccaauggggac

SEQ ID NO: 252330 - RNA, 64 nt, Human
cugagaauccaaacauccuggagaguaucugagaaccaaccaaguaaaagucucguugcucaua

SEQ ID NO: 252331 - RNA, 64 nt, Human
cugagaacccaaacuucccagagaguaucugagaaccaaccaaugaaaacagucccaucgcucu

SEQ ID NO: 252332 - RNA, 64 nt, Human
gcaaagaccagccaucccaguugagauacccuacaccaaccagauuuucaacugcuggacauau

SEQ ID NO: 252333 - RNA, 64 nt, Human
uauccaguguuguguaaagagacuggccaacaggaccaaccaagcaccuuaccucucccauaca

SEQ ID NO: 252334 - RNA, 64 nt, Human
aauaaauuaaucuauauugguugacaaacaagccaccaaccacugacugcaaaacugccugaug

SEQ ID NO: 252335 - RNA, 64 nt, Human
acaguucagucaacuuuguuuuuuuccuggagucaccaaccagcuuugggagacacagccgcca

SEQ ID NO: 252336 - RNA, 64 nt, Human
ucaucacaccaugcugccuuucccucauaugaucaccaaccaguagcugaguucaaaaacuaca

SEQ ID NO: 252337 - RNA, 64 nt, Human
gaaguuagauuguuaaagauagucucauucagcuaccaaccacuccuugauccuucccuucuua

SEQ ID NO: 252338 - RNA, 64 nt, Human
guccccaacccuuacagacaccacugccaccaccaccaaccacgaccaccaccaccaccaccac

SEQ ID NO: 252339 - RNA, 62 nt, Human
uuuaaaaaaaaagagcguaaauacaaacaggaguggugcaagccgccuugguguggguuugu

SEQ ID NO: 252340 - RNA, 62 nt, Human
guucaacuggaugucucucuucuccaaaugcuacaguacaaagcccuaagcaugaguggaaa

SEQ ID NO: 252341 - RNA, 62 nt, Human
ugaacguguccuuuugaggagggugggacacaacaguacagaaauaagugcuaauuucaaag

SEQ ID NO: 252342 - RNA, 62 nt, Human
ugcccuugcccagcacugcacucuggagguggguggugcaggcgguggagggacacaggcca

SEQ ID NO: 252343 - RNA, 62 nt, Human
gggucuuccucuguugcccaggcuggagugcaguggugcaaucuuggcucacuguaaccucc

SEQ ID NO: 252344 - RNA, 62 nt, Human
cgagaaaaggagagagcgcgugcagagacuugguggugcauaauggauauuuuuuaacuugg

SEQ ID NO: 252345 - RNA, 62 nt, Human
ucugcaaaaaauaacaaaauuagccgggcaugguggugcacaccuguagucccagcuauucu

SEQ ID NO: 252346 - RNA, 62 nt, Human
ucaacuaaaaauauaaaaauuagccaggcgugguggugcaugccuguagucccaguuacucg

SEQ ID NO: 252347 - RNA, 62 nt, Human
uuagacaucuucagaaugacuaauuucuccgaguggugcauaaucuuauuuuguuugggagu

SEQ ID NO: 252348 - RNA, 62 nt, Human
accccgaccuugagauuauuccuguuugaaagguggugcaugcagauggagaagugguguug

SEQ ID NO: 252349 - RNA, 62 nt, Human
gccaucaccuaggacugacucggcagugugcaguggugcaugcacugucucagccaacccgc

SEQ ID NO: 252350 - RNA, 62 nt, Human
ugguaccuacccggcagguagguuagauguggguggugcauguuaauuucccuuagaaguuc

SEQ ID NO: 252351 - RNA, 62 nt, Human
cggucugacucugucacccaggcuagaguacaguggugcaaucuuggcucacugcaaccucc

SEQ ID NO: 252352 - RNA, 62 nt, Human
uuagcaaccucauuucgacagugguuuguagcguggugcaccagggccuuguugaacagauc

SEQ ID NO: 252353 - RNA, 62 nt, Human
uacaaaaaaaauauaaaaauuagccaggugugguggugcacaccuguggucccagcuacuug

SEQ ID NO: 252354 - RNA, 62 nt, Human
ucuacuaaaaauacaaaaauuagcugggcgugguggugcaugccugaaaucccagcuacuug

SEQ ID NO: 252355 - RNA, 64 nt, Human
gcuauugcacgauuucauauuuugccucuaugaugaacggcaaccauuauuuguaacuguuuag

SEQ ID NO: 252356 - RNA, 62 nt, Human
auaaguucauuaaacagaagguaauaggaagaacaguacauuuuugucuuuaucucaaguau

SEQ ID NO: 252357 - RNA, 62 nt, Human
gugugauaucuuguaugaaugaucauuuaaauacaguacauuacuguagaagcuaaauugau

SEQ ID NO: 252358 - RNA, 62 nt, Human
gaaccuauucagcucacccugcucugcaucugacaguacaggugcauggccuguggacaauu

SEQ ID NO: 252359 - RNA, 62 nt, Human
gaggcaggggagucugcuugucuuagauguugguggugcagccccaggaccaagcuuaagga

SEQ ID NO: 252360 - RNA, 62 nt, Human
auucuccagaaacaguaaauaggugaguagggguggugcaagugaauucguuuucauuuaga

SEQ ID NO: 252361 - RNA, 62 nt, Human
uccuguuuucugugucugaaaguuuacagguuguggugcaucagcccaaacucacuggcguu

SEQ ID NO: 252362 - RNA, 62 nt, Human
uuuacaaaaaauacaaaaauuagccaggcaugguggugcaugccuguagucccagcuguuug

SEQ ID NO: 252363 - RNA, 62 nt, Human
cuguacuaaaaauacaagauuaccugggcaugguggugcaugccuauaaucccagcuacuca

SEQ ID NO: 252364 - RNA, 62 nt, Human
ccuucucaccagauuccccugaauccaaacucguggugcaaaccucuaccuuuuuuacaaaa

SEQ ID NO: 252365 - RNA, 62 nt, Human
uaaguucagacuaaagagaauggagaacuauuguggugcaaccuggcaaaucccucagagga

SEQ ID NO: 252366 - RNA, 62 nt, Human
cuuuacuccaguugcauuucucagacaauaaaguggugcauccaugcuaccuccuacuuugu

SEQ ID NO: 252367 - RNA, 62 nt, Human
cuacuaaaaauacaaaaaauuagccgagcacgguggugcaugccuguaaucccagcuacuug

SEQ ID NO: 252368 - RNA, 62 nt, Human
uacuaaaaauacaaaaaaauuagccaggcgugguggugcaccccuaaaaucccagcuacuug

SEQ ID NO: 252369 - RNA, 62 nt, Human
cccuacuaaaaauacaaaguuagccaggcauaguggugcaugccuguaaucccagcugcuca

SEQ ID NO: 252370 - RNA, 62 nt, Human
acggcccuggccuugggcccucugguuugccgguggugcagguagaccugucuccuggcggu

SEQ ID NO: 252371 - RNA, 62 nt, Human
cuacuaaagauacaaaaaauuagccgggcgugguggugcaugccuguaauccaagauacuca

SEQ ID NO: 252372 - RNA, 62 nt, Human
uagauauuuuuaagugcaacauuuacaugauaacaguacauuuuguuuucuucauagauuua

SEQ ID NO: 252373 - RNA, 62 nt, Human
uuuuaaugauuaauucguauuaaggcaacaagacaguacaacaaauaaucucuagagagguc

SEQ ID NO: 252374 - RNA, 62 nt, Human
gaucuuuggaaugcaugccaguaauguauuuuacaguacauguuuauuauguucaauauuug

SEQ ID NO: 252375 - RNA, 62 nt, Human
ucuucuuaaucauuaucaaucucgguuuuuuuguggugcaguggaaggagaaauaggucuag

SEQ ID NO: 252376 - RNA, 62 nt, Human
cucuagaaagagauaacacauggaaagacgguguggugcagcccagcccacgguggcuguuc

SEQ ID NO: 252377 - RNA, 62 nt, Human
gggucucacuuugucacccaggcuagagugcaguggugcaaucucagcucacugcagccucu

SEQ ID NO: 252378 - RNA, 62 nt, Human
aagggacggcugugggaccaggucuguggaaaguggugcauggucagaaugggugcaguuug

SEQ ID NO: 252379 - RNA, 62 nt, Human
cuacaaaagauuuuaauaauuaguugggcguaguggugcaugccuguaaucccagcuacucu

SEQ ID NO: 252380 - RNA, 62 nt, Human
gaguuuugcucuguugcccaggcuggagugcaguggugcaaucauagcucauugaagccucg

SEQ ID NO: 252381 - RNA, 62 nt, Human
gggucucgcucugucacccaggcuggaguguaguggugcagucuuggcucacugcaaccucc

SEQ ID NO: 252382 - RNA, 62 nt, Human
cucuucuaaaaauacaaaauuagcugggcaugguggugcaugccuguaauuccagcuacucg

SEQ ID NO: 252383 - RNA, 62 nt, Human
gugcccugagcccguuagguuuucuuuucuugguggugcaaagugguauaacugugugcaaa

SEQ ID NO: 252384 - RNA, 62 nt, Human
gcccuaagcccacauucuuucgauagcucacgguggugcaugaguguccaucaucugacucu

SEQ ID NO: 252385 - RNA, 62 nt, Human
ucuacuaaaaauaaaaaaauuagcugggugugguggugcacuccuguaaucccagcuacuca

SEQ ID NO: 252386 - RNA, 62 nt, Human
cagguuuuaguuuuuaaaauaucuuuugaccuguggugcaaaagcagaaaauacagcuggau

SEQ ID NO: 252387 - RNA, 62 nt, Human
acccuauguuauguaaauaguuauuuuauccuguggugcauguuugggcaaauauauauaua

SEQ ID NO: 252388 - RNA, 62 nt, Human
ccugaaccaccuucugcacuuaaagaagucuaacaguacaaauacacuaucuaucuuagaua

SEQ ID NO: 252389 - RNA, 62 nt, Human
guaaccgauuuuaaugacuagcuuuuaaaaauacaguacaaagacuuuguaaaugugauuca

SEQ ID NO: 252390 - RNA, 62 nt, Human
aaacauuucacuucuccaacaaguaccugugaacaguacaguauuuacaguauugagcuuug

SEQ ID NO: 252391 - RNA, 62 nt, Human
cucuacuaaaaauacaaaauuagccggucaugguggugcaugucugcaaacccagcuacucg

SEQ ID NO: 252392 - RNA, 62 nt, Human
cacccaccgagccaggcagaggccagcccuccguggugcacacagcacgcgccucaguccau

SEQ ID NO: 252393 - RNA, 62 nt, Human
cccugccccuaaauauauauuuuggugaagcuguggugcacuauuaauuuucuguuucaaaa

SEQ ID NO: 252394 - RNA, 62 nt, Human
ucaucauguuuugauuuaucugggagaaaacuguggugcacagcuugugaggagggcaaggu

SEQ ID NO: 252395 - RNA, 62 nt, Human
aaaccucauguaaugaauccaccaggcuggcaguggugcauauaaacuguggguguggcaag

SEQ ID NO: 252396 - RNA, 62 nt, Human
gccacaguugauggugaggaagcuccuuugacguggugcaauuuugaugagaugucucuggg

SEQ ID NO: 252397 - RNA, 62 nt, Human
cccacagaucacugagagggaccaucucccaaguggugcaguuuagaacuucucucccuuuu

SEQ ID NO: 252398 - RNA, 62 nt, Human
gaaucuugcucuguugcucaggcuggagugcaguggugcaaucuuggcucacugcaaccuac

SEQ ID NO: 252399 - RNA, 62 nt, Human
aucagcaccaguguccgucaggaaggcaggugguggugcagaaacaugaugccuggcugauu

SEQ ID NO: 252400 - RNA, 62 nt, Human
uuuucaccauuggcagaaacagugagagcuguguggugcagaaauccagaaaugagguguag

SEQ ID NO: 252401 - RNA, 62 nt, Human
uccuagaaauauaucuguaacaaugauuuaagguggugcagaugguguuuguucuauauuau

SEQ ID NO: 252402 - RNA, 62 nt, Human
gucucuacaaaaaauaaauuuagcugggcaugguggugcacaucuguaguccuaccaacuug

SEQ ID NO: 252403 - RNA, 62 nt, Human
gcugaccugggucagugcaugugcuuuaugguguggugcaucuuuggagaucaucaccauau

SEQ ID NO: 252404 - RNA, 62 nt, Human
ugccggcuaacauugugucauuccuggaguccacaguacacguccccugccucaacaggcac

SEQ ID NO: 252405 - RNA, 62 nt, Human
cuugaauuuaauaagcaguuuuuacggaguuuacaguacagaaauaggcuuuaauuuucaag

SEQ ID NO: 252406 - RNA, 62 nt, Human
aauugagacaaucuuguguuuccuaaacuguuacaguacauuucucagcauccuugugacag

SEQ ID NO: 252407 - RNA, 62 nt, Human
agugugucuucuccugcccauuucucucucccacaguacauccugcauugaaccacguguug

SEQ ID NO: 252408 - RNA, 62 nt, Human
augcaugucacaggcgggacuuucuucagagaguggugcagcgccagacauuuugcacauaa

SEQ ID NO: 252409 - RNA, 62 nt, Human
uuguauggaagccaccgggagauuucuggaugguggugcauccgugaaugcgcugaucguuu

SEQ ID NO: 252410 - RNA, 62 nt, Human
cugaaaggacguguggagacagcagcaguccuguggugcaguuacugccuguguggccagcu

SEQ ID NO: 252411 - RNA, 62 nt, Human
guuuugaagugccuaagaugaccuauuugucaguggugcaaaauuaauucucuucuuuuuug

SEQ ID NO: 252412 - RNA, 62 nt, Human
ucuacuaaaaauacaacaauuagccaggcaugguggugcaugccuguaaucccagcuacuca

SEQ ID NO: 252413 - RNA, 62 nt, Human
cccugagaagcugcuccaggccugcagcaggaguggugcagacagaagucuccucaauuuuu

SEQ ID NO: 252414 - RNA, 62 nt, Human
gagucucgcucugucgcccaagcuggaguacaguggugcaaucucacugcaagcucugccuc

SEQ ID NO: 252415 - RNA, 62 nt, Human
uuacccaggaagguugagcugcugagauuucaguggugcaaugucuuuaaaaaaacaggcuu

SEQ ID NO: 252416 - RNA, 62 nt, Human
cagugucucacuguugcccaggcuggagugcaguggugcaaucucaguucagugcaaucucc

SEQ ID NO: 252417 - RNA, 62 nt, Human
ggcccacuaaauauuuuuaucggcuaggcgugguggugcaugccuguaaucucggaaggcug

SEQ ID NO: 252418 - RNA, 62 nt, Human
gagucucacuccaucagccaggcuggagugcaguggugcaaucucggcucacugcaaccucu

SEQ ID NO: 252419 - RNA, 62 nt, Human
guggcucuaaguaaaacugggauuggacaguaguggugcaucugguccuugccgccugagag

SEQ ID NO: 252420 - RNA, 62 nt, Human
ccagccuggugccuggggugcugagcuagugaguggugcaguccaggacaccuuugcuuuau

SEQ ID NO: 252421 - RNA, 62 nt, Human
ccuauugaaacucuuaucauuuaaagugguguacaguacacucugcugugaugguauugcgg

SEQ ID NO: 252422 - RNA, 62 nt, Human
ucccacacuuugaagcaaauacaauucacagcacaguacacacaaaaaccuuggcauaagac

SEQ ID NO: 252423 - RNA, 62 nt, Human
acugacaucaauuugucuaaucuuguagcaguacaguacaguccugauuauugcaacuuuag

SEQ ID NO: 252424 - RNA, 62 nt, Human
cugucuagaguagcuuaccagaagcuuccauaguggugcagaggaaguggaaggcaucaguc

SEQ ID NO: 252425 - RNA, 62 nt, Human
cacuggcagccaaugaagacugugcucgcuggguggugcaggccuggcaccaggaggcuugc

SEQ ID NO: 252426 - RNA, 62 nt, Human
ucccccagacauacuuucagagcgcuagcuguguggugcacgggacuuuacaguuaggauuc

SEQ ID NO: 252427 - RNA, 62 nt, Human
ggugcugaauguaaggaggggagccuccaaguguggugcaagccgggggucuccacaucuuc

SEQ ID NO: 252428 - RNA, 62 nt, Human
cagagucucacuguugcccaggcuggagugcaguggugcaaucucggcucacugcaagcucu

SEQ ID NO: 252429 - RNA, 62 nt, Human
ugguuguggcuugcugaauuaaauauuuaugaguggugcauuuuuaaguauagugaacaaga

SEQ ID NO: 252430 - RNA, 62 nt, Human
uagacaaaagaaaauggcacaaggaaucacacguggugcagcuaaaacaaaacaaaacauga

SEQ ID NO: 252431 - RNA, 62 nt, Human
gaaaagaaaaagaaaaaaaucccuuguucucaguggugcaggauguuggcuuggggcaacag

SEQ ID NO: 252432 - RNA, 62 nt, Human
agcaacugacugcaggugcuggcaugauggagguggugcaccuuggacacguggacaaggcc

SEQ ID NO: 252433 - RNA, 62 nt, Human
agcauucugugcauaaaaguuaacauuaggcuguggugcaguaaccauuuaaugucgaggcu

SEQ ID NO: 252434 - RNA, 62 nt, Human
ucuauuaaaaauacaaaaauuagccaggcauaguggugcaugccuguagucccagcuacuug

SEQ ID NO: 252435 - RNA, 62 nt, Human
cucuacuaaaaauacaaaaguuaaccagguguguggugcacguuuguaaucccaguuacuca

SEQ ID NO: 252436 - RNA, 62 nt, Human
uguucuccaagaacuuacuguccaaucaugcuguggugcauuccuuugaagaucaugaagaa

SEQ ID NO: 252437 - RNA, 62 nt, Human
uacugcagcuuuacugccuuccuccuuauccuacaguacaaucagcagucuaguucuuuuca

SEQ ID NO: 252438 - RNA, 62 nt, Human
ucuuaaaauuuuuaaauuuuauauuuguaaauacaguacacauuuuauuucuuggauuuuga

SEQ ID NO: 252439 - RNA, 62 nt, Human
uuggcuuuucauauaaaugcuaaaggaaggcgacaguacagaguguuuugguugaacaacua

SEQ ID NO: 252440 - RNA, 62 nt, Human
agauacuccugacaucuugcuuuagcacauguacaguacaguuucuaugauaauguguuugc

SEQ ID NO: 252441 - RNA, 62 nt, Human
accuucuacuuucucugggaaagcauuauauaguggugcauuaguuuagaaagucagcuaug

SEQ ID NO: 252442 - RNA, 62 nt, Human
gcuacuaaaaauacaaaaaugagucggacaugguggugcaugccuguaaucccagcuacuug

SEQ ID NO: 252443 - RNA, 62 nt, Human
agaaucucacuuugucaccaggcuggagugcaguggugcaaucucaccucacugcaaccucc

SEQ ID NO: 252444 - RNA, 62 nt, Human
gucucugcccuuccucuagccucuugucacauguggugcacaaaccucaaccugacagcuuu

SEQ ID NO: 252445 - RNA, 62 nt, Human
gaacaagagaaccucugacgguggagaaccauguggugcaagaagagaucuuaggucucuuc

SEQ ID NO: 252446 - RNA, 62 nt, Human
cuacuaaaaauacaaaaaauuagcugggcaugguggugcaugccugugauuccagcuacuug

SEQ ID NO: 252447 - RNA, 62 nt, Human
ucuacuaaaaauacaaaaauuagcugggugugguggugcaugccuguagucccagcuacucg

SEQ ID NO: 252448 - RNA, 62 nt, Human
uacuaaaaauacaaaaauauuagccgggcgugguggugcaugccuguaaucccagcuacuag

SEQ ID NO: 252449 - RNA, 62 nt, Human
ugaagucucacaguuggugauuucuccgcucuguggugcaauaucccuauuuguaggugagu

SEQ ID NO: 252450 - RNA, 62 nt, Human; identical to SEQ ID NO: 252434

SEQ ID NO: 252451 - RNA, 62 nt, Human
acaaacauuucuaaucuacuggcuggagugcaguggugcagucuguagcucacugcagccuc

SEQ ID NO: 252452 - RNA, 62 nt, Human
gauggaguuucgcucuugucccccaggcuggaguggugcaguggcacgaucucaggucacug

SEQ ID NO: 252453 - RNA, 62 nt, Human
uuaccaaaaaauacaaaaauuagcugggugugguggugcacaccuguagucucaacuauugg

SEQ ID NO: 252454 - RNA, 62 nt, Human
uuuuaauggaucuacugacauuagcacuuuguacaguacaaaauaaagucuacauuuguuua

SEQ ID NO: 252455 - RNA, 62 nt, Human
uuauauaauaccucaaaaauaaaaauaugaaaacaguacacuguuguagguuggucaggaaa

SEQ ID NO: 252456 - RNA, 62 nt, Human
uuuuuaaagaauacgggucuguggugauaaauacaguacaauccuuuuucacuguuaugucu

SEQ ID NO: 252457 - RNA, 62 nt, Human
auggccauuuuuuuuuuagauggaguuuugcaguggugcaaucauagcucauugcagccuuc

SEQ ID NO: 252458 - RNA, 62 nt, Human
ccagcaggccagugguuauggccagcacggcuacaguacagguuaugacgaccugacccagg

SEQ ID NO: 252459 - RNA, 62 nt, Human
augacagaagcuaauuccuauugaacaacaauacaguacaacacagaauguuagagaaaaag

SEQ ID NO: 252460 - RNA, 62 nt, Human
ugguugcuauuuaggguaggcuaacagcugugacaguacacuccaaaauguauaauuacgua

SEQ ID NO: 252461 - RNA, 62 nt, Human
aaaugcuuggauuuuaugcaguaggcauuacuacaguacauggcuaaucuucccaaaaacua

SEQ ID NO: 252462 - RNA, 62 nt, Human
uuuuuagcuaaguaugcauuccucaauaguagacaguacaacauguuuauaacaagccaauu

SEQ ID NO: 252463 - RNA, 62 nt, Human
aaauaaagaaauagaacaaggcugaggauacgacaguacacugucagcagggacuguaaaca

SEQ ID NO: 252464 - RNA, 62 nt, Human
gggauguggugcaugccuuuguguacauggccacaguacagucugguccuuuuccuucccca

SEQ ID NO: 252465 - RNA, 62 nt, Human
guaacauuuuauucuuuggauuuuguauaauuacaguacaugauuguguauugugacaugaa

SEQ ID NO: 252466 - RNA, 62 nt, Human
uaggauggauucuuucuguauucugagaguguacaguacaggauuauuauaaugaaaguuua

SEQ ID NO: 252467 - RNA, 62 nt, Human
aacaucuuuuuccucccuuucccugagagcucacaguacaauguuucagaagccccauuugc

SEQ ID NO: 252468 - RNA, 62 nt, Human
aaacacaugaauaaauuugcaaaaccaagaucacaguacaccauaugcacucugguaccuua

SEQ ID NO: 252469 - RNA, 62 nt, Human
uugacauuuguuuuuaguuuuuguugguagaaacaguacacucaaaacauccuugacugucc

SEQ ID NO: 252470 - RNA, 62 nt, Human
gauuuuuacuaauauauauuuuaagguugcacacaguacacaccagaagaugugaaauucau

SEQ ID NO: 252471 - RNA, 62 nt, Human
cuaggacugagaauguauguaaaaguucugugacaguacagaaggaaaacaacuuuuuaugu

SEQ ID NO: 252472 - RNA, 62 nt, Human
uuugaaaguucucagaguuguacauauguuucacaguacaggaucuguacauaaaaguuucu

SEQ ID NO: 252473 - RNA, 62 nt, Human
ggaacaacauagauuccaugaucuuuuuaaugacaguacagacugagauuugaaggaaacau

SEQ ID NO: 252474 - RNA, 62 nt, Human
ucauaagcaaugauacaugaaaccaaugaaagacaguacauguaauaauauuuuccucagua

SEQ ID NO: 252475 - RNA, 62 nt, Human
acgaggagggaaggucuuuuauuggagaguauacaguacaagcagaucauucugccuuagag

SEQ ID NO: 252476 - RNA, 62 nt, Human
aaaaacacugagcucaguuacacuugaauuuuacaguacagaagcacugggauuuuaugugc

SEQ ID NO: 252477 - RNA, 62 nt, Human
acuaaaauuacaaaaaaaauuauccaggcgugguggugcacgccuguaaucccagcuacuca

SEQ ID NO: 252478 - RNA, 62 nt, Human
ggucuuugucacugcagagaaucugccucgcuguggugcacuggagaacuugguaaaugaug

SEQ ID NO: 252479 - RNA, 62 nt, Human
augccugagacugcuugaaagauauauuuuaaguggugcacuaauuagugaauauauaggaa

SEQ ID NO: 252480 - RNA, 62 nt, Human
gagucucacucugucgcccaggcuagacugcaguggugcaaucucagcucacugcaaccucc

SEQ ID NO: 252481 - RNA, 62 nt, Human
gcugaaaccaaaggcaguggggguccaaacucguggugcagcaagucacaccagacaggaaa

SEQ ID NO: 252482 - RNA, 62 nt, Human
gaagugauaggggucacaauggggaaauugaaguggugcauaacauugccaaaauagugugc

SEQ ID NO: 252483 - RNA, 62 nt, Human
ucuacuaaaaauacaaaaauaagccaggugugguggugcaugacuguaaucccaacuacuca

SEQ ID NO: 252484 - RNA, 62 nt, Human
uggggguggcuggagccagccugcugagaagcguggugcagcugggucugggacuucacuag

SEQ ID NO: 252485 - RNA, 62 nt, Human
cuauauaaauagcucuuucuugcuguuuuaauguggugcacacuauagccucacaaaccugu

SEQ ID NO: 252486 - RNA, 62 nt, Human
uuugaggcagagucuugcucugcuggagugcgguggugcaaucucggcucacugcaaccucc

SEQ ID NO: 252487 - RNA, 62 nt, Human
agcgcugggccugccagacagaggccccucuuguggugcaagcccagcucugucaccugaga

SEQ ID NO: 252488 - RNA, 62 nt, Human
uacuaaaaauacaaaaaaauuagcugcgcgugguggugcacgccuguagucccugcuacuug

SEQ ID NO: 252489 - RNA, 62 nt, Human
guuuacauuuacucagcuacuauauaugcaguguggugcacauuuucacagaauucuggcuu

SEQ ID NO: 252490 - RNA, 62 nt, Human
cucuaugauaaaucaguugcaucugugauaauacaguacauauguggacauaaacagggauc

SEQ ID NO: 252491 - RNA, 62 nt, Human
augggccaacuaaguguuauccaguagaaaagacaguacacugcuuuucuuuuaguguuugc

SEQ ID NO: 252492 - RNA, 62 nt, Human
aacaggucaaauuugucuuguuauuugugaguacaguacauuuaaaaaacauccuuaucggu

SEQ ID NO: 252493 - RNA, 62 nt, Human
cugucucuacaaaaaauaauuagccuggccugguggugcaugccuaguccuagcugaucugg

SEQ ID NO: 252494 - RNA, 62 nt, Human
acagcagauaauucugagaucaugggugagggguggugcauguugagauuuaaauuggcaua

SEQ ID NO: 252495 - RNA, 62 nt, Human
uuagauuaaaguacaacaauuagcagggcaugguggugcacgucuguagucccagcuacuca

SEQ ID NO: 252496 - RNA, 62 nt, Human
ucucuacaagaucaaaaacuuagccggguaugguggugcaugugugccuguaguccaagcua

SEQ ID NO: 252497 - RNA, 62 nt, Human
cucuacuaagaacacaaaauuagcugggcaugguggugcaugccuguaaucccagcuacuug

SEQ ID NO: 252498 - RNA, 62 nt, Human
gagucuuguucuguugcccaggagggagugcaguggugcaaccucggcucacugcaaccuuu

SEQ ID NO: 252499 - RNA, 62 nt, Human
uuggguaagaguaaacuagauaacugggcgucguggugcacaccuguagucccagccacucu

SEQ ID NO: 252500 - RNA, 62 nt, Human
gaguuucgcccuuuucgcccaggcugaguacaguggugcaaucucacugcaaccuccgccuu

SEQ ID NO: 252501 - RNA, 62 nt, Human
ucuacuaaaaauacaaaaauuagccaggcgugguggugcacaccuguagucccagcuacucg

SEQ ID NO: 252502 - RNA, 62 nt, Human
acuacaaaaauucaaaaaauuagccaggcaugguggugcacacuuguagucccagcuacuca

SEQ ID NO: 252503 - RNA, 62 nt, Human
ucuacuaaaaauacaaaaauuagccuggcgugguggugcacaccuguaaucccagcuacucu

SEQ ID NO: 252504 - RNA, 62 nt, Human
uguggggucggagaggcguuuggagaaggucuguggugcagugugugaaaauucaggugcua

SEQ ID NO: 252505 - RNA, 62 nt, Human
ucuacuaaaaauacaaaaaugagccgggcaugguggugcaugccuguaagcccagcuauucg

SEQ ID NO: 252506 - RNA, 62 nt, Human
uuaaagggguuguauguuuagugugaacaaagacaguacaaagcauauaaaauacaagguga

SEQ ID NO: 252507 - RNA, 62 nt, Human
agccuucaugcacaccccugaaccacgaggaaacaguacagucgcuagucaagugguuuuua

SEQ ID NO: 252508 - RNA, 62 nt, Human
caguauauguagggaccccaaaugaccacaacacaguacaauugcccuuuaccuagggcuac

SEQ ID NO: 252509 - RNA, 62 nt, Human
ucuuugaaaguuuaaagaaacuugaccaaaagacaguacaaaaaacacuggcacuugaaugu

SEQ ID NO: 252510 - RNA, 62 nt, Human
gucuguucauuggcuaugagguucaaauguguguggugcaguuucuguguuaauaaagcagg

SEQ ID NO: 252511 - RNA, 62 nt, Human
aauuuaaaagguuuuguugcugaaagcaguaaguggugcaguaaaauacuuaaguuauucaa

SEQ ID NO: 252512 - RNA, 62 nt, Human
guguguguguguguguauguauguguguguguguggugcacacauuguguucuuaaacugag

SEQ ID NO: 252513 - RNA, 62 nt, Human
ucuacaaaaaauauaaaagucagccaggcguuguggugcaugcuuguggucccagcuacuuu

SEQ ID NO: 252514 - RNA, 62 nt, Human
cucuacuaaaaaaacaaaacuagcugggggugguggugcaugccuguggucccagcuacuug

SEQ ID NO: 252515 - RNA, 62 nt, Human
gugugaccccacgugcacagaaagugcugcgaguggugcauggugagagguugaugcaggua

SEQ ID NO: 252516 - RNA, 62 nt, Human
auugcauggggguuauuuuaucuuucaugauuguggugcaccugaugcuggcgggguauuug

SEQ ID NO: 252517 - RNA, 62 nt, Human
cucuaugaaaaauacaaaauuugcugggagugguggugcaugccuguaaucccagcuacuug

SEQ ID NO: 252518 - RNA, 62 nt, Human
aaaaaacauuuagaggauuaugcuuguuuugaguggugcauaagggaaaaaacugacuuuuu

SEQ ID NO: 252519 - RNA, 62 nt, Human
gagucuugcucuaucacccaggcuggagugcaguggugcaaucucagcucacugcaaccucc

SEQ ID NO: 252520 - RNA, 62 nt, Human
ggggcugggggaugcuaggacugagacccuggguggugcagcgccuggugaucuugcugugu

SEQ ID NO: 252521 - RNA, 62 nt, Human
uauguauuaaacugguaucguggugauauaauguggugcaguuacuuauauauuaaauaucu

SEQ ID NO: 252522 - RNA, 62 nt, Human
uaaacucuggugauccaaacaaaauggcuucaguggugcagaugucaccuacauguuauucu

SEQ ID NO: 252523 - RNA, 64 nt, Human; identical to SEQ ID NO: 206280

SEQ ID NO: 252524 - RNA, 64 nt, Human; identical to SEQ ID NO: 206285

SEQ ID NO: 252525 - RNA, 64 nt, Human; identical to SEQ ID NO: 206289

SEQ ID NO: 252526 - RNA, 62 nt, Human
uuaugauuuacacagaagcaacugccaaaucuguggugcaaccacuaucuccagugaaauau

SEQ ID NO: 252527 - RNA, 62 nt, Human
gaaaauaugcuuccuguaucaaagguacguauguggugcaaacaaggcagaaacuuccuuuu

SEQ ID NO: 252528 - RNA, 62 nt, Human
ucuauuuaaaauacaaaaauuagcugggcaugguggugcaugccuguaaucccagcuacucg

SEQ ID NO: 252529 - RNA, 62 nt, Human
cucuauaaaaaaucaaaaauuagccaggcaugguggugcauaccuauaguccuggcuauuug

SEQ ID NO: 252530 - RNA, 62 nt, Human
ucuacuaaaaauacaaaaauuagcugggcgugguggugcaugccuguaaucccagcuacucg

SEQ ID NO: 252531 - RNA, 62 nt, Human
cugggugaggggaggccuuccugggaaggcguguggugcaggccugugcucacaguggcacc

SEQ ID NO: 252532 - RNA, 62 nt, Human
aggucucacuccgucauccaagcuggagugcaguggugcaauccucaacucacugcaaccuc

SEQ ID NO: 252533 - RNA, 62 nt, Human
gcugccucccucuucaugcaaucuggugagcaguggugcaggcggggagccagagaaacuug

SEQ ID NO: 252534 - RNA, 62 nt, Human
ucuacuaaaaauacaaaaauuagccaggugugguggugcacgccuguaauccccagauacuc

SEQ ID NO: 252535 - RNA, 62 nt, Human
gacaggacaucgugacugcugguaguaauaugguggugcauuguuuuuuccacccaaacuua

SEQ ID NO: 252536 - RNA, 62 nt, Human
gauucuuaaccaagaaacaaauaauagcaaugguggugcaccacuguaccccagguucuagu

SEQ ID NO: 252537 - RNA, 62 nt, Human
cuauaguccuauacaaaaauuagcugggcgugguggugcaugccuguaaucccagcuacuag

SEQ ID NO: 252538 - RNA, 62 nt, Human
aaucucauucaugauguugauuuuuuuucaauguggugcaauauauacaauaaaauuuguca

SEQ ID NO: 252539 - RNA, 64 nt, Human; identical to SEQ ID NO: 206295

SEQ ID NO: 252540 - RNA, 64 nt, Human; identical to SEQ ID NO: 206299

SEQ ID NO: 252541 - RNA, 57 nt, Human; identical to SEQ ID NO: 206303

SEQ ID NO: 252542 - RNA, 62 nt, Human
uauucuugaaaacugcuguagcaaauucaucuguggugcaauacacuuuuugauuaaagcuc

SEQ ID NO: 252543 - RNA, 62 nt, Human
gacuuccggucccugcaacgggugaccuaagcguggugcacccaucagucacgcaggaggac

SEQ ID NO: 252544 - RNA, 62 nt, Human
uggcacugggagucgggggagcacguccaggcguggugcauccuggggcagaacgccauggc

SEQ ID NO: 252545 - RNA, 62 nt, Human
ucuacuaaaaauacaaaaauuagccgggcaugguggugcacaucgguaguccuggcuacuag

SEQ ID NO: 252546 - RNA, 62 nt, Human
aggaaagaauaugcuuauuacaaagacaaaauguggugcagaaacuaucuugcaccugugug

SEQ ID NO: 252547 - RNA, 62 nt, Human
cuguaaucccuucccaagacuagcugcucaggguggugcagggacaggaccagacccugcgc

SEQ ID NO: 252548 - RNA, 62 nt, Human
gagcuguugcccaaaaaaauggaucuguugcaguggugcaaucugggcucacugaaaccacc

SEQ ID NO: 252549 - RNA, 62 nt, Human
agaagaggaccaagaagggagggggcugcccuguggugcacacaggccugccauggggcgug

SEQ ID NO: 252550 - RNA, 54 nt, Human
aaucucuuuacccuuguuaaaaacguggugcagcuauugcgguaauaaaaucuu

SEQ ID NO: 252551 - RNA, 62 nt, Human
cuacaaaaaaauacaaaaauuagcugggcauaguggugcaugccuguguuucuagcuacgca

SEQ ID NO: 252552 - RNA, 62 nt, Human
aaaaagguccuguaagaagcggcauagcacccguggugcaugguaugugggugacccuggac

SEQ ID NO: 252553 - RNA, 62 nt, Human
ugccuucucggagccuucugcaaccaggacuuguggugcagcugcagacacagagcacagcu

SEQ ID NO: 252554 - RNA, 62 nt, Human
aggaaagaccauuuuuccuccacugaacuaggguggugcauuuuuguaaguuagguaacugu

SEQ ID NO: 252555 - RNA, 64 nt, Human; identical to SEQ ID NO: 206311

SEQ ID NO: 252556 - RNA, 64 nt, Human; identical to SEQ ID NO: 206316

SEQ ID NO: 252557 - RNA, 64 nt, Human; identical to SEQ ID NO: 206321

SEQ ID NO: 252558 - RNA, 62 nt, Human
ggcccucggugaccucaggcauccuuucggcuguggugcaggugaauggcacgcccguaaug

SEQ ID NO: 252559 - RNA, 62 nt, Human
aagcugucugaggucugucccagguggcccagguggugcagguagaacagggugaggagagg

SEQ ID NO: 252560 - RNA, 62 nt, Human
ggagucuuguucuguugccaggcuggagugcgguggugcaaucucagcucacugcaaucucc

SEQ ID NO: 252561 - RNA, 62 nt, Human
cucuacuaaaaauacaaaauuaccugggcgugguggugcaugccuguaaucccaucaucuac

SEQ ID NO: 252562 - RNA, 62 nt, Human
acaaagaaauuuuaaaagauuauccaggcaugguggugcaugccuaugguuccagcuacucg

SEQ ID NO: 252563 - RNA, 62 nt, Human
gccccggacacauuucacaccucaggcucgugguggugcaggggacaagaggcugugggugc

SEQ ID NO: 252564 - RNA, 62 nt, Human
cucuucugauuuuuauugcaaucuuuuaccaaguggugcacaaacuugguauugaugucuuu

SEQ ID NO: 252565 - RNA, 62 nt, Human
uuguuuuaauuguuuaauaaagcugcugggcaguggugcagcauuccuaccuagugucauaa

SEQ ID NO: 252566 - RNA, 62 nt, Human
gagucucacucugucacccaggcuggagugcuguggugcaaucucggcucacugcaaccucu

SEQ ID NO: 252567 - RNA, 62 nt, Human
aaagaauggcucaacguggauuuuuauucauuguggugcacguuucaaauuuucuugcaaau

SEQ ID NO: 252568 - RNA, 62 nt, Human
gcagcagggggcagggugcaggguccacauagguggugcacacgcaagccccccggggugcu

SEQ ID NO: 252569 - RNA, 62 nt, Human
ugugggacagcccagggcagcagagcugggauguggugcaugccuuuguguacauggccaca

SEQ ID NO: 252570 - RNA, 62 nt, Human
ccuuuacucauagcacuucccccauuggacacguggugcauuuugcuuguuuauuauguuuu

SEQ ID NO: 252571 - RNA, 64 nt, Human; identical to SEQ ID NO: 206329

SEQ ID NO: 252572 - RNA, 64 nt, Human; identical to SEQ ID NO: 206334

SEQ ID NO: 252573 - RNA, 58 nt, Human; identical to SEQ ID NO: 206339

SEQ ID NO: 252574 - RNA, 62 nt, Human
aagcagcaggaaggggcucccaagagcuccugguggugcagccugugcuccccucagaagcu

SEQ ID NO: 252575 - RNA, 62 nt, Human
ggcuccgcccuggccaccuggggacuggcacuguggugcacaguggcccaauguggccaacg

SEQ ID NO: 252576 - RNA, 62 nt, Human
uuguuuguuugagaugcagagucuagagugcaguggugcaagcucagcuuacuguaaccucu

SEQ ID NO: 252577 - RNA, 62 nt, Human
caguuucacugugucgcccaggcuggcguucaguggugcaaucucagcucacugcaaacucu

SEQ ID NO: 252578 - RNA, 62 nt, Human
gauucucacucugucucccaggcuagagugcaguggugcaaucucagcucacugcagccuca

SEQ ID NO: 252579 - RNA, 62 nt, Human
uguauuuccuaucaagggugaaagugaugaugguggugcaggagggugacaauaaaauccua

SEQ ID NO: 252580 - RNA, 62 nt, Human
uaaaauucaaagaugggauauucuaacugguaguggugcaucauuuuuaacccaaauauugc

SEQ ID NO: 252581 - RNA, 62 nt, Human
agaggagccaaugacaggguagggagaugacaguggugcaugaugggagaaucaugaaaguc

SEQ ID NO: 252582 - RNA, 62 nt, Human
gaaguucagcguuguaugucucucucuacacuguggugcacuuaacuuguggaauuuuuaua

SEQ ID NO: 252583 - RNA, 62 nt, Human
agugcaaccccguuggugcucugcaggagcugguggugcagaaaggcuggcgguugccggag

SEQ ID NO: 252584 - RNA, 62 nt, Human
ucccaccagaacgcaccccacugggagagcugguggugcagccuuccccucccuguauaaga

SEQ ID NO: 252585 - RNA, 62 nt, Human
uuccuuuaaacaugcuacaaagcccaggcaugguggugcacaccuguacucccagcuacucg

SEQ ID NO: 252586 - RNA, 62 nt, Human
uggccaaauguaaacuaaaagccuuaauuaaaguggugcaauuuuguauaacuuagcaucag

SEQ ID NO: 252587 - RNA, 64 nt, Human; identical to SEQ ID NO: 206342

SEQ ID NO: 252588 - RNA, 64 nt, Human; identical to SEQ ID NO: 206349

SEQ ID NO: 252589 - RNA, 64 nt, Human; identical to SEQ ID NO: 206354

SEQ ID NO: 252590 - RNA, 62 nt, Human
uauaaaauguauggaaugguuagccuggugugguggugcacaccuguaaucccagcuacuug

SEQ ID NO: 252591 - RNA, 62 nt, Human
gagucucacuuugucacucaggcucaagugcaguggugcaaucucugcucacugcaacaucu

SEQ ID NO: 252592 - RNA, 62 nt, Human
ggaguuucucuugucaaccgggcuggagugcaguggugcaaucuuggcucacugcaaccucc

SEQ ID NO: 252593 - RNA, 62 nt, Human
gggucuggcuguguugcccugacuggaguucaguggugcaaacacagcucucuccacaaccu

SEQ ID NO: 252594 - RNA, 62 nt, Human
ucguggagugcgggcccugccagaagguauuuguggugcagcagauucccaacaguaaccuc

SEQ ID NO: 252595 - RNA, 62 nt, Human
ggaugguuguguauguguuuaaaauaaaaccuguggugcacauuucuacccagguuuugcua

SEQ ID NO: 252596 - RNA, 62 nt, Human
auucuugaagacuauuuuccagggaugccugaguggugcacugagcucuagacccuuacuca

SEQ ID NO: 252597 - RNA, 62 nt, Human
gcuaggaggacagaggcccccaagcugaucugguggugcauccacgcacccccacccuggga

SEQ ID NO: 252598 - RNA, 62 nt, Human
ucaguucagugggugugcuugcgugguaggauguggugcagcccucucuacgcucuucuauu

SEQ ID NO: 252599 - RNA, 62 nt, Human
acuaaaaaaaaaaaaaaaauuagucgggcgugguggugcaugccuguaaucccagcuacugg

SEQ ID NO: 252600 - RNA, 62 nt, Human
cuuauuuacuguuaguauccguugcaucuaguguggugcaccuggcacacaguaggcacuca

SEQ ID NO: 252601 - RNA, 62 nt, Human
cucuacaaaaaauacaaaauuagcagggugugguggugcacaccuguagucccuuacucccu

SEQ ID NO: 252602 - RNA, 62 nt, Human
cgcuguuguugagcugacucugugcccgaaugguggugcaggcgcccuguccugguuguguu

SEQ ID NO: 252603 - RNA, 64 nt, Human; identical to SEQ ID NO: 206358

SEQ ID NO: 252604 - RNA, 64 nt, Human; identical to SEQ ID NO: 206366

SEQ ID NO: 252605 - RNA, 64 nt, Human; identical to SEQ ID NO: 206371

SEQ ID NO: 252606 - RNA, 62 nt, Human
cucuacuaaaaauacaaaauuagccaggcgugguggugcaugccuguaauccagcuacuugg

SEQ ID NO: 252607 - RNA, 62 nt, Human
caucucuacugaaaauacaaaaauuaggcauaguggugcacgccugcagucccagcuacuca

SEQ ID NO: 252608 - RNA, 62 nt, Human
aagcuggcugucuugugugcagccugagugggguggugcaggccgguagucugcccgucacu

SEQ ID NO: 252609 - RNA, 62 nt, Human
uguuuuuaccguagcccucaucuaacuuacacguggugcauauuaaaauaagcagagaaaaa

SEQ ID NO: 252610 - RNA, 62 nt, Human
aacguggauuaucgcacagacugggagguuuaguggugcauuucuccucuguuuucuuuuua

SEQ ID NO: 252611 - RNA, 62 nt, Human
ugcgaggcuucguggacuguguccugguccauguggugcacgugucuccaccuccaaggaga

SEQ ID NO: 252612 - RNA, 62 nt, Human
ccuacuaaaaauacaaaaauuagcagggagugguggugcacaccuguaaucccagcuacucu

SEQ ID NO: 252613 - RNA, 62 nt, Human
cugcuauuaugccuucuuuagaucuuucuucuguggugcagacauuucuaguaaguguuuga

SEQ ID NO: 252614 - RNA, 62 nt, Human
cagccuggguggccaccccuccuuaucucuggguggugcacaugcccuucuuuccccacucc

SEQ ID NO: 252615 - RNA, 62 nt, Human
cugcugugcgggugcgcucggugacacuggugguggugcacgcucccgagcucccagaguua

SEQ ID NO: 252616 - RNA, 62 nt, Human
uccuaauuuuaaauguuggcucugauuuuaaaguggugcauuugauuccagccuugguaaug

SEQ ID NO: 252617 - RNA, 62 nt, Human
uucugccuccugccauaaaaccagcgagugucguggugcaggcaggcccuguggccugcugg

SEQ ID NO: 252618 - RNA, 62 nt, Human
cggagcauuucugcaagcguugccuggaugcgguggugcauugugggcccucugggcuccug

SEQ ID NO: 252619 - RNA, 64 nt, Human; identical to SEQ ID NO: 206376

SEQ ID NO: 252620 - RNA, 64 nt, Human; identical to SEQ ID NO: 206384

SEQ ID NO: 252621 - RNA, 64 nt, Human; identical to SEQ ID NO: 206388

SEQ ID NO: 252622 - RNA, 62 nt, Human
gggaccuugacagaagagagcccugggugcuuguggugcaaagaucuucaugcccaguucca

SEQ ID NO: 252623 - RNA, 62 nt, Human
gcuuaacagaaacagucuguaaaaaccuaacaguggugcaaucauguugucuguguuguguu

SEQ ID NO: 252624 - RNA, 62 nt, Human
uacuaaaaauacaaaauuagccgggcauugugguggugcaugccuguaaucccagcuacucg

SEQ ID NO: 252625 - RNA, 62 nt, Human
ucucuacuaaaaauaugaaauuagccagggugguggugcacaccuguaaucccagcuaccug

SEQ ID NO: 252626 - RNA, 62 nt, Human
gaaguuuaugcaacuuaaaauguuuacacacuguggugcaaucuacuguuugugaaugucug

SEQ ID NO: 252627 - RNA, 62 nt, Human
uccugccaggguccuuaggugggaaggcugggguggugcaggggccuugggcucccaggaca

SEQ ID NO: 252628 - RNA, 62 nt, Human
uaaaaauacaaaaaaauauuagcugggcguagguggugcacaccuguagucccagcuacugg

SEQ ID NO: 252629 - RNA, 62 nt, Human
guggggagagucuggggcgagcaaccgcccugguggugcaggcugugaagaaagaccaggag

SEQ ID NO: 252630 - RNA, 62 nt, Human
ucaccgaugaugcugagcgccuccuucagcgcguggugcaugugcagcaucucgucgugcug

SEQ ID NO: 252631 - RNA, 62 nt, Human
cucuguauuugcucccguggagcuucaucgggguggugcaggcucccaaacucaggcuuuca

SEQ ID NO: 252632 - RNA, 62 nt, Human
gagucuugcucugucacccaggcuggagugcuguggugcaaucucggcucacugcaaccucu

SEQ ID NO: 252633 - RNA, 62 nt, Human
ggccuucagggaagccuggguguggcccggugguggugcacuggugacuucauggccacgcc

SEQ ID NO: 252634 - RNA, 62 nt, Human
gagccuuguucugucaccuaggcuggaaugcaguggugcaaucauagcucacugcagccuug

SEQ ID NO: 252635 - RNA, 64 nt, Human; identical to SEQ ID NO: 206393

SEQ ID NO: 252636 - RNA, 64 nt, Human; identical to SEQ ID NO: 206397

SEQ ID NO: 252637 - RNA, 64 nt, Human; identical to SEQ ID NO: 206405

SEQ ID NO: 252638 - RNA, 62 nt, Human
aaaaaaaaacuucucuaaauuagccggaugugguggugcaugccuguagucccagcuacucg

SEQ ID NO: 252639 - RNA, 62 nt, Human
aucguaaauuuagauucuggaauugggguuugguggugcaauguguugcucacaaguggcca

SEQ ID NO: 252640 - RNA, 62 nt, Human
cguauaaaaaaauacaaaauuagccaggcaugguggugcaugccuguaacuccagauacuug

SEQ ID NO: 252641 - RNA, 62 nt, Human
caucuguacugaaaauacaaaaauuaggcaugguggugcaugccuguaguuccagcuacuug

SEQ ID NO: 252642 - RNA, 62 nt, Human
acaaaagaaaaaaaucaaaaugcagaaaauguguggugcacuaagaugaucacacagcauua

SEQ ID NO: 252643 - RNA, 62 nt, Human
uaccuaauuuuugccagucucauggguagauaguggugcagugcuuuaacauacauucaucu

SEQ ID NO: 252644 - RNA, 62 nt, Human
uaauaggucaguguaaagaaauaugauuugagguggugcaugcaaguaacuaggguuuauuc

SEQ ID NO: 252645 - RNA, 62 nt, Human
cuuugugcacaucuucccucuccccauucgguguggugcagugugaaaaguccuugauuguu

SEQ ID NO: 252646 - RNA, 62 nt, Human
cucuacuaaaaauacaaaauuagccaggugugguggugcaugccuguaaucccagcuacucg

SEQ ID NO: 252647 - RNA, 62 nt, Human
gggucucauucuaucggccaggcuggagugcaguggugcaaucacagcucacugcagccuug

SEQ ID NO: 252648 - RNA, 62 nt, Human
aaauucugcaucucaaggcagggcaagccgggguggugcaggucucagggcacgagucccuc

SEQ ID NO: 252649 - RNA, 62 nt, Human
aggaccugggcagagcaggcaugagcugggcuguggugcagagcaagcagacccagccacac

SEQ ID NO: 252650 - RNA, 62 nt, Human
ugggggggucgaccucuugcaggaggguggguguggugcagagagaggcaguccccaugaua

SEQ ID NO: 252651 - RNA, 64 nt, Human; identical to SEQ ID NO: 206410

SEQ ID NO: 252652 - RNA, 64 nt, Human; identical to SEQ ID NO: 206414

SEQ ID NO: 252653 - RNA, 64 nt, Human; identical to SEQ ID NO: 206231

SEQ ID NO: 252654 - RNA, 62 nt, Human
aguuuugcucuugucacccaggcuggagugcaguggugcaaucuuggcucgcaaccuccgcc

SEQ ID NO: 252655 - RNA, 62 nt, Human
agcaagaccccaucucuaaaaaauuaggcaugguggugcaugccuguauucccagcuacuca

SEQ ID NO: 252656 - RNA, 62 nt, Human
ugcccucuguggcuccagccuuuaccggaaguguggugcauguuuuuaacuucagggaagcg

SEQ ID NO: 252657 - RNA, 62 nt, Human
aaaauaaauuuaaaaaaaauuagcugagugugguggugcaugcauguaguuccagcuacuca

SEQ ID NO: 252658 - RNA, 62 nt, Human
gccccucccaaaggagcccuugagcuagggagguggugcagucagccucgcucucaacguga

SEQ ID NO: 252659 - RNA, 62 nt, Human
ucaaggagaauaugauaaaacacugcccucuuguggugcauugaaagaagagaugagaaaug

SEQ ID NO: 252660 - RNA, 62 nt, Human
ucaucuacuuccucuuccuccucuacuacaugguggugcagggcaagcgcaugaguaaagag

SEQ ID NO: 252661 - RNA, 62 nt, Human
ucuacaaaaaauacaaaaauuagccaggcaggguggugcaugccuguagucccagcuacuug

SEQ ID NO: 252662 - RNA, 62 nt, Human
cucuauuaaaaauacaaauuuagccgggcgugguggugcaggccuguaaucccagcuacucg

SEQ ID NO: 252663 - RNA, 62 nt, Human
gugccugacguguggggaacccucaguaaauaguggugcauuuguauugaggcucucugagg

SEQ ID NO: 252664 - RNA, 62 nt, Human
aauacaaaaaaaaaaaaaauuagccaggcgugguggugcacaccuguaguccuagcuacuug

SEQ ID NO: 252665 - RNA, 62 nt, Human
gcuguguccacucaggguuaaauggauuaaggguggugcaagaugugcuuuguuaaacagau

SEQ ID NO: 252666 - RNA, 62 nt, Human
gcuuuuuuaaaaaaaaaauuguagcacugggcguggugcaugccuguaaucccagccacuca

SEQ ID NO: 252667 - RNA, 64 nt, Human; identical to SEQ ID NO: 206234

SEQ ID NO: 252668 - RNA, 64 nt, Human
cuguuccuuuauguaaacauguaaagaaaauaagucagcgaaaaaaaugaaacccaaaacucuc

SEQ ID NO: 252669 - RNA, 64 nt, Human
gaaaaggaggcucagcacugucucaggcuggaggucagcgaaccucgugggcuguaggaaagca

SEQ ID NO: 252670 - RNA, 62 nt, Human
cagaggaggaggagaaggagccccucagcagaguggugcaguuucgcucagagcuugucucc

SEQ ID NO: 252671 - RNA, 62 nt, Human
uagaaaauucucacgcugaacugguguagcauguggugcagcauucagugaaacuggcugga

SEQ ID NO: 252672 - RNA, 62 nt, Human
ugcugaugcgaccucggcugacagcugggccuguggugcagacaggagcuguguggacaguc

SEQ ID NO: 252673 - RNA, 62 nt, Human
cugcuaaagauauaaaaaauuagcccggcgugguggugcacgccuguaaucccagcuacucg

SEQ ID NO: 252674 - RNA, 62 nt, Human
cucuaguaaaaauacaaaauuagccgggcaugguggugcacgccucuaaucccagcuacucg

SEQ ID NO: 252675 - RNA, 62 nt, Human
cugcuaaaaauacaaaaaauuagccagaugugguggugcacaccuguagucccaacuauucg

SEQ ID NO: 252676 - RNA, 62 nt, Human
cgcuucaggcagaagcucuccggaggauccagguggugcaugcauuugacaucuuccagaug

SEQ ID NO: 252677 - RNA, 62 nt, Human
gggucuaccucugucacccgagcuagagugcaguggugcagucuuggcucacuacagccucg

SEQ ID NO: 252678 - RNA, 62 nt, Human
caaucuccuauugcuugucagccugugugcguguggugcaggaaauaaaggaucuauacccu

SEQ ID NO: 252679 - RNA, 62 nt, Human
gaaggugcguauuuauucagggaggaggaaaaguggugcagggacagggagauggggcgcua

SEQ ID NO: 252680 - RNA, 62 nt, Human
uccuauauauagauaucuagaaaacuugguuuguggugcacaguuaaguguuggaucacuaa

SEQ ID NO: 252681 - RNA, 62 nt, Human
ucuacuaaagauauaaaaauuagcuggaugugguggugcacaccugugaucccagcuacuug

SEQ ID NO: 252682 - RNA, 62 nt, Human
ccugaaaaggaaauuggauuuuagaacuggauguggugcagugaaguauuuuaggcccaggu

SEQ ID NO: 252683 - RNA, 64 nt, Human
uacaagcugacauucaaccaagguggacagccuuucagcgaaguaggagaagugaaagacuucc

SEQ ID NO: 252684 - RNA, 64 nt, Human
ccucagccuuaaacuuuuguuccuacucccacccucagcgaacugggcagcacggggaggguuu

SEQ ID NO: 252685 - RNA, 64 nt, Human
guccaguucaggcuucuagacauuuuacucaugcucagcgaaggcugguuccugguccccuggg

SEQ ID NO: 252686 - RNA, 62 nt, Human
ucagccacaugccuagacuuauauacuaguuaguggugcagccagggagaggacucagauuu

SEQ ID NO: 252687 - RNA, 62 nt, Human
ugaucacuuuccuagcaaaggggagaccacauguggugcacagggaagaaacggcuuuagac

SEQ ID NO: 252688 - RNA, 62 nt, Human
acaagaaauuuuuuaaaaaugagccaagugugguggugcaugccuguaguuccagcuacuca

SEQ ID NO: 252689 - RNA, 62 nt, Human
aggagcugagccggacccuccaccuggaggagguggugcaggaggccgccggcgaguggcag

SEQ ID NO: 252690 - RNA, 62 nt, Human
cuguggaguuuccacggcgacacacagccucaguggugcaagauuuaaaauuaccuuccuuu

SEQ ID NO: 252691 - RNA, 62 nt, Human
ucuaauaaaaauacaaaaauuagccgggcaugguggugcaugccuguaaucccagcuacucg

SEQ ID NO: 252692 - RNA, 62 nt, Human
agcucucgcucugucacccaggcuggagugcaguggugcaaucaugguucacugcagucuug

SEQ ID NO: 252693 - RNA, 62 nt, Human
ucuaccaaaaauacaaaaauuagccagacgugguggugcacgccuuuaaucccagcuacucg

SEQ ID NO: 252694 - RNA, 62 nt, Human
cucuacuaaaaauacaaaauuagccaugcguaguggugcaugccuguaaucccagcuacucg

SEQ ID NO: 252695 - RNA, 62 nt, Human
auggagucucacugucaccaggcuggagugcaguggugcaaucucgguucacugcaaccucc

SEQ ID NO: 252696 - RNA, 62 nt, Human
gcgucucacucugucgcccaggcuggaguacgguggugcaaucucagcucacugcagccucu

SEQ ID NO: 252697 - RNA, 62 nt, Human
caaccacaaaaucuaaaaauuagcugggugugguggugcaugccugugauccuggcuacuuc

SEQ ID NO: 252698 - RNA, 62 nt, Human
gagucucacugugucacccaggcuggagugcaguggugcaaucucgccucacugcaaccuuc

SEQ ID NO: 252699 - RNA, 64 nt, Human
uacaacacccacguuguuuauuucaaagaacuuuucagcgaagggagaggagcuuucagaaaaa

SEQ ID NO: 252700 - RNA, 64 nt, Human
uuuugcuguuuuguaaaacagauugagaaaaauucgaucuuauuuagugaucuguugcaagaua

SEQ ID NO: 252701 - RNA, 63 nt, Human
ccauggggaggaacagacuggcaggaagcacaccgggguuaacacugguugacuugaauagga

SEQ ID NO: 252702 - RNA, 64 nt, Human; identical to SEQ ID NO: 138828

SEQ ID NO: 252703 - RNA, 62 nt, Human
cuauuaaaaauaaaaaugauuggccgagcaugguggugcacaccaguauucccagcuacucu

SEQ ID NO: 252704 - RNA, 62 nt, Human
aaauggcuccugugagggcugcaagcuggaggguggugcaggccuugggccacagggaggcg

SEQ ID NO: 252705 - RNA, 62 nt, Human
ucgacuaaaaauacaaaaauuagccaggcgugguggugcacaccuguaaucccagcuacucg

SEQ ID NO: 252706 - RNA, 62 nt, Human
cccugccugaaaagccugcuguguacaccaagguggugcauuaccggaaguggaucaaggac

SEQ ID NO: 252707 - RNA, 62 nt, Human
caccgucucuaaaauaaaauuagcugggugugguggugcaccgccuguggucccagcuccuc

SEQ ID NO: 252708 - RNA, 62 nt, Human
gacccuugcucugucaccuaggcugaagugcgguggugcaaucauggcucacugcagccuca

SEQ ID NO: 252709 - RNA, 62 nt, Human
ucuacuaaaaauacaaaaauuugccgggcgugguggugcaugccuguaaucccagcuacuug

SEQ ID NO: 252710 - RNA, 60 nt, Human
ucggggcuuucauggugugaaggaaggagcguggugcauuggacaugggucugacacgug

SEQ ID NO: 252711 - RNA, 62 nt, Human
cucuacuaaaaauauaaaauuagcugggcaugguggugcacaccugucgucucagcuacucg

SEQ ID NO: 252712 - RNA, 62 nt, Human
gagaugguauuugugguuaauuaugauauugaguggugcaugagguagguguuuagaguaau

SEQ ID NO: 252713 - RNA, 62 nt, Human
agucucacucuuguugcccaagcuggagugcaguggugcaaugugggcucacugcaaccucu

SEQ ID NO: 252714 - RNA, 62 nt, Human
cucuauuaaagauacaaaauuagccaggcaugguggugcaugccuguaaucccagcuacuug

SEQ ID NO: 252715 - RNA, 62 nt, Human
uuuuuuuugagacacacccaggcuggaguccaguggugcaaucuuggcucacugcaaccucc

SEQ ID NO: 252716 - RNA, 64 nt, Human; identical to SEQ ID NO: 138833

SEQ ID NO: 252717 - RNA, 64 nt, Human; identical to SEQ ID NO: 138838

SEQ ID NO: 252718 - RNA, 64 nt, Human; identical to SEQ ID NO: 138843

SEQ ID NO: 252719 - RNA, 62 nt, Human
ucuacuaaaaauacaaaaauuagccgggcaugguggugcacgccuauagucccagcuacucg

SEQ ID NO: 252720 - RNA, 62 nt, Human
gggucugacucuguccuccaggccagaguccaguggugcaaucucagcucacuguagccuca

SEQ ID NO: 252721 - RNA, 62 nt, Human
gagauuaagagaacuccaaauagcccaagaggguggugcacccccaacuucauagggguaga

SEQ ID NO: 252722 - RNA, 62 nt, Human
cucuacuaaaaauacaaacuuagcugggcuuaguggugcaugccuguagucucagcuacuug

SEQ ID NO: 252723 - RNA, 62 nt, Human
ucuacuaaaaauacaaaaauuagcugggugugguggugcacgccuguaaucccagcuacucg

SEQ ID NO: 252724 - RNA, 62 nt, Human
aaacaaaaaaacacaaaaauuagccaggugugguggugcaucccuauacucccagcaacuca

SEQ ID NO: 252725 - RNA, 62 nt, Human
gagucucauucugucacccaggcuggagugcaguggugcaaucuuggcucacugcaacuugg

SEQ ID NO: 252726 - RNA, 62 nt, Human
ggguuucacucugucacccaggcuggagugcaguggugcaaucacuguuuauugcagccgcg

SEQ ID NO: 252727 - RNA, 62 nt, Human
accaccuccuagaagacaggcgggacuucccaguggugcauccaaaggggagcuggaagccu

SEQ ID NO: 252728 - RNA, 62 nt, Human
uacuaaaaauacaaaaaaauuagcugggcaugguggugcaugccuguagucccagcuacuca

SEQ ID NO: 252729 - RNA, 62 nt, Human
uguacuaaaaauacaaaaauuugccuggugugguggugcaugccucuaguccuagcuacucg

SEQ ID NO: 252730 - RNA, 62 nt, Human
ucaucugaagaggacgaaugaggaggaccacuguggugcaugcuggugaggagccagucucu

SEQ ID NO: 252731 - RNA, 62 nt, Human
gcaggcgugugcguguguggggcaggcaggauguggugcaggcagguuccaucgcuuucgac

SEQ ID NO: 252732 - RNA, 64 nt, Human; identical to SEQ ID NO: 138848

SEQ ID NO: 252733 - RNA, 64 nt, Human; identical to SEQ ID NO: 138853

SEQ ID NO: 252734 - RNA, 64 nt, Human; identical to SEQ ID NO: 138859

SEQ ID NO: 252735 - RNA, 62 nt, Human
acaucaaaaaaaaaaaaaauuagucgggcaugguggugcacaccuguaaucccagcuuguca

SEQ ID NO: 252736 - RNA, 62 nt, Human
cccuacuaaaaauacaaaauuagccagguaugguggugcauaccuguaaucccagcuacucg

SEQ ID NO: 252737 - RNA, 62 nt, Human
ccuuggccgguggggacgcagagccccagcagguggugcacgacuguuggcggaaggaacgc

SEQ ID NO: 252738 - RNA, 62 nt, Human
cuguccccugcuccguggugggcaggagggaaguggugcagggcugcgugcauugccugcga

SEQ ID NO: 252739 - RNA, 62 nt, Human
ggguuggucucuguugcccaagcuugagggcaguggugcaaucauaacucauugcagccucg

SEQ ID NO: 252740 - RNA, 62 nt, Human
cucuacuaaaaauacaaaauuagucgggcguaguggugcaugccuguaaucccaguuacucg

SEQ ID NO: 252741 - RNA, 62 nt, Human
ucuacaaaauauuaaaacauuagcuaggcaugguggugcacaccuguaguccuagcuucuug

SEQ ID NO: 252742 - RNA, 62 nt, Human
uuuuaauauuugcaguacuugauuuaggaucuguggugcagggcaauguuucaaaguuuagu

SEQ ID NO: 252743 - RNA, 62 nt, Human
aacuccaccagcaacuccacccgaccccagcaguggugcaggacagcugccagcacccaccu

SEQ ID NO: 252744 - RNA, 62 nt, Human
guccuucauugcccacauggauagacggagcuguggugcagagaacuuuucccgcaacaggu

SEQ ID NO: 252745 - RNA, 62 nt, Human
auuucaaacagaucuuugaaaccucagauucuguggugcaauuuuaauguuuucuuguuucu

SEQ ID NO: 252746 - RNA, 62 nt, Human
gagugaaaagcaaaggucccacggugugugcuguggugcaccgccuggcuuugggggucccg

SEQ ID NO: 252747 - RNA, 62 nt, Human
caggucacugccuguggcugcagccguggcccguggugcagccguggcccauggcagccugu

SEQ ID NO: 252748 - RNA, 64 nt, Human; identical to SEQ ID NO: 138863

SEQ ID NO: 252749 - RNA, 64 nt, Human; identical to SEQ ID NO: 138868

SEQ ID NO: 252750 - RNA, 64 nt, Human; identical to SEQ ID NO: 138872

SEQ ID NO: 252751 - RNA, 62 nt, Human
uuuugagaugaagucgcccgggcugcaguucaguggugcaaucucagcucacugcaagcucu

SEQ ID NO: 252752 - RNA, 62 nt, Human
guaucauucagugcauuguuuacauauucaaaguggugcacuuugaaggaagcacaugugca

SEQ ID NO: 252753 - RNA, 62 nt, Human
cgucagguuccuuguggaagcuccccucauccguggugcagcaggcugagcacugcgcguuu

SEQ ID NO: 252754 - RNA, 62 nt, Human
uuaaauaauauguuguuauuugauacauuuuuguggugcaaguaauuaauguuauuauuuga

SEQ ID NO: 252755 - RNA, 62 nt, Human
cugcuaaaauuacaaaaaauuagcugggcgugguggugcacgccuguagucucagcuacuca

SEQ ID NO: 252756 - RNA, 62 nt, Human
agacauggcacagccaugaagagaccagugggguggugcaggguggacuuggggacccuacc

SEQ ID NO: 252757 - RNA, 62 nt, Human
guguguguguguguguguguguguguguguguguggugcaggagugccacccccagggcccu

SEQ ID NO: 252758 - RNA, 62 nt, Human
ucuacuaaaaauacaaaaauuaucugggcaugguggugcaugccuguaaucccagcuauucg

SEQ ID NO: 252759 - RNA, 62 nt, Human
gguggauauuaaaaaucuguaaaucaggacagguggugcaaauggcgcugggagguguacac

SEQ ID NO: 252760 - RNA, 62 nt, Human
gagucuugcucuguugcccaggcuagagugcaguggugcaaucucaguucacugcaaccucu

SEQ ID NO: 252761 - RNA, 62 nt, Human
cuucacuaaaaauacaaaacuuagcugguuagguggugcaugccuguagucccagcuacucg

SEQ ID NO: 252762 - RNA, 62 nt, Human
uaaaaaaaauaauaaaaacuuagcugggcaugguggugcaugccugugguccuggcuacuug

SEQ ID NO: 252763 - RNA, 62 nt, Human
uucugugugguauauuguuuaaucaguucuguguggugcauuccugaagucucuaaugugac

SEQ ID NO: 252764 - RNA, 64 nt, Human; identical to SEQ ID NO: 138877

SEQ ID NO: 252765 - RNA, 64 nt, Human; identical to SEQ ID NO: 138882

SEQ ID NO: 252766 - RNA, 64 nt, Human; identical to SEQ ID NO: 138887

SEQ ID NO: 252767 - RNA, 62 nt, Human
cguuuucuuucccuuuucucugguggccuguuguggugcaacgagcugauggcauuugaucu

SEQ ID NO: 252768 - RNA, 62 nt, Human
uaaggcuuuaaaagacagugaagcugggugcgguggugcacuccuguaacccugggacuuug

SEQ ID NO: 252769 - RNA, 62 nt, Human
gcuguguguguguguggugguggugggaggggguggugcaugugugugugugugugugcauc

SEQ ID NO: 252770 - RNA, 64 nt, Human
ccuuuaaaaaaaaagagcguaaauacaaacaggaguggugcaagccgccuugguguggguuugu

SEQ ID NO: 252771 - RNA, 64 nt, Human
gcugcccuugcccagcacugcacucuggagguggguggugcaggcgguggagggacacaggcca

SEQ ID NO: 252772 - RNA, 64 nt, Human
uggggucuuccucuguugcccaggcuggagugcaguggugcaaucuuggcucacuguaaccucc

SEQ ID NO: 252773 - RNA, 64 nt, Human
agcgagaaaaggagagagcgcgugcagagacuugguggugcauaauggauauuuuuuaacuugg

SEQ ID NO: 252774 - RNA, 64 nt, Human
ucucugcaaaaaauaacaaaauuagccgggcaugguggugcacaccuguagucccagcuauucu

SEQ ID NO: 252775 - RNA, 64 nt, Human
ucucaacuaaaaauauaaaaauuagccaggcgugguggugcaugccuguagucccaguuacucg

SEQ ID NO: 252776 - RNA, 64 nt, Human; identical to SEQ ID NO: 138893

SEQ ID NO: 252777 - RNA, 64 nt, Human; identical to SEQ ID NO: 138898

SEQ ID NO: 252778 - RNA, 64 nt, Human; identical to SEQ ID NO: 138902

SEQ ID NO: 252779 - RNA, 64 nt, Human
ucuuagacaucuucagaaugacuaauuucuccgaguggugcauaaucuuauuuuguuugggagu

SEQ ID NO: 252780 - RNA, 64 nt, Human
auaccccgaccuugagauuauuccuguuugaaagguggugcaugcagauggagaagugguguug

SEQ ID NO: 252781 - RNA, 64 nt, Human
gagccaucaccuaggacugacucggcagugugcaguggugcaugcacugucucagccaacccgc

SEQ ID NO: 252782 - RNA, 64 nt, Human
gaugguaccuacccggcagguagguuagauguggguggugcauguuaauuucccuuagaaguuc

SEQ ID NO: 252783 - RNA, 64 nt, Human
cacggucugacucugucacccaggcuagaguacaguggugcaaucuuggcucacugcaaccucc

SEQ ID NO: 252784 - RNA, 64 nt, Human
ucuuagcaaccucauuucgacagugguuuguagcguggugcaccagggccuuguugaacagauc

SEQ ID NO: 252785 - RNA, 64 nt, Human
ucuacaaaaaaaauauaaaaauuagccaggugugguggugcacaccuguggucccagcuacuug

SEQ ID NO: 252786 - RNA, 64 nt, Human
ucucuacuaaaaauacaaaaauuagcugggcgugguggugcaugccugaaaucccagcuacuug

SEQ ID NO: 252787 - RNA, 64 nt, Human
gugaggcaggggagucugcuugucuuagauguugguggugcagccccaggaccaagcuuaagga

SEQ ID NO: 252788 - RNA, 64 nt, Human
uuauucuccagaaacaguaaauaggugaguagggguggugcaagugaauucguuuucauuuaga

SEQ ID NO: 252789 - RNA, 64 nt, Human
uguccuguuuucugugucugaaaguuuacagguuguggugcaucagcccaaacucacuggcguu

SEQ ID NO: 252790 - RNA, 64 nt, Human
uguuuacaaaaaauacaaaaauuagccaggcaugguggugcaugccuguagucccagcuguuug

SEQ ID NO: 252791 - RNA, 64 nt, Human
aucuguacuaaaaauacaagauuaccugggcaugguggugcaugccuauaaucccagcuacuca

SEQ ID NO: 252792 - RNA, 60 nt, Human; identical to SEQ ID NO: 138906

SEQ ID NO: 252793 - RNA, 64 nt, Human; identical to SEQ ID NO: 138912

SEQ ID NO: 252794 - RNA, 62 nt, Human
ccaaacacccuauguaacuaucggaggcauauacgugguauaaaugacuguagcugugauac

SEQ ID NO: 252795 - RNA, 64 nt, Human
uaccuucucaccagauuccccugaauccaaacucguggugcaaaccucuaccuuuuuuacaaaa

SEQ ID NO: 252796 - RNA, 64 nt, Human
cauaaguucagacuaaagagaauggagaacuauuguggugcaaccuggcaaaucccucagagga

SEQ ID NO: 252797 - RNA, 64 nt, Human
uucuuuacuccaguugcauuucucagacaauaaaguggugcauccaugcuaccuccuacuuugu

SEQ ID NO: 252798 - RNA, 64 nt, Human
cucuacuaaaaauacaaaaaauuagccgagcacgguggugcaugccuguaaucccagcuacuug

SEQ ID NO: 252799 - RNA, 64 nt, Human
uuuacuaaaaauacaaaaaaauuagccaggcgugguggugcaccccuaaaaucccagcuacuug

SEQ ID NO: 252800 - RNA, 64 nt, Human
aacccuacuaaaaauacaaaguuagccaggcauaguggugcaugccuguaaucccagcugcuca

SEQ ID NO: 252801 - RNA, 64 nt, Human
uuacggcccuggccuugggcccucugguuugccgguggugcagguagaccugucuccuggcggu

SEQ ID NO: 252802 - RNA, 64 nt, Human
cucuacuaaagauacaaaaaauuagccgggcgugguggugcaugccuguaauccaagauacuca

SEQ ID NO: 252803 - RNA, 64 nt, Human
acucuucuuaaucauuaucaaucucgguuuuuuuguggugcaguggaaggagaaauaggucuag

SEQ ID NO: 252804 - RNA, 64 nt, Human
gucucuagaaagagauaacacauggaaagacgguguggugcagcccagcccacgguggcuguuc

SEQ ID NO: 252805 - RNA, 64 nt, Human
cagggucucacuuugucacccaggcuagagugcaguggugcaaucucagcucacugcagccucu

SEQ ID NO: 252806 - RNA, 64 nt, Human
ugaagggacggcugugggaccaggucuguggaaaguggugcauggucagaaugggugcaguuug

SEQ ID NO: 252807 - RNA, 64 nt, Human
cccuacaaaagauuuuaauaauuaguugggcguaguggugcaugccuguaaucccagcuacucu

SEQ ID NO: 252808 - RNA, 62 nt, Human
cuguccuggagacagugugccgggaaaagggaacgugguacucacuggaugcacccaggccg

SEQ ID NO: 252809 - RNA, 62 nt, Human
caaauaaauaaauaaaagcaaucugauuuccaacgugguacuaccuggugaguuugcauggc

SEQ ID NO: 252810 - RNA, 62 nt, Human
ggguuuugugggaggugcaggggccaagagagacgugguaggucuccaagagucccacccgg

SEQ ID NO: 252811 - RNA, 64 nt, Human
aggaguuuugcucuguugcccaggcuggagugcaguggugcaaucauagcucauugaagccucg

SEQ ID NO: 252812 - RNA, 64 nt, Human
cagggucucgcucugucacccaggcuggaguguaguggugcagucuuggcucacugcaaccucc

SEQ ID NO: 252813 - RNA, 64 nt, Human
gucucuucuaaaaauacaaaauuagcugggcaugguggugcaugccuguaauuccagcuacucg

SEQ ID NO: 252814 - RNA, 64 nt, Human
cggugcccugagcccguuagguuuucuuuucuugguggugcaaagugguauaacugugugcaaa

SEQ ID NO: 252815 - RNA, 64 nt, Human
aagcccuaagcccacauucuuucgauagcucacgguggugcaugaguguccaucaucugacucu

SEQ ID NO: 252816 - RNA, 64 nt, Human
ucucuacuaaaaauaaaaaaauuagcugggugugguggugcacuccuguaaucccagcuacuca

SEQ ID NO: 252817 - RNA, 64 nt, Human
uucagguuuuaguuuuuaaaauaucuuuugaccuguggugcaaaagcagaaaauacagcuggau

SEQ ID NO: 252818 - RNA, 64 nt, Human
auacccuauguuauguaaauaguuauuuuauccuguggugcauguuugggcaaauauauauaua

SEQ ID NO: 252819 - RNA, 64 nt, Human
gucucuacuaaaaauacaaaauuagccggucaugguggugcaugucugcaaacccagcuacucg

SEQ ID NO: 252820 - RNA, 64 nt, Human
ugcacccaccgagccaggcagaggccagcccuccguggugcacacagcacgcgccucaguccau

SEQ ID NO: 252821 - RNA, 64 nt, Human
cucccugccccuaaauauauauuuuggugaagcuguggugcacuauuaauuuucuguuucaaaa

SEQ ID NO: 252822 - RNA, 64 nt, Human
agucaucauguuuugauuuaucugggagaaaacuguggugcacagcuugugaggagggcaaggu

SEQ ID NO: 252823 - RNA, 64 nt, Human
agaaaccucauguaaugaauccaccaggcuggcaguggugcauauaaacuguggguguggcaag

SEQ ID NO: 252824 - RNA, 62 nt, Human
ggcuuggaccugccguggagggugcccagcagacgugguaugagagggauggcucacgaggc

SEQ ID NO: 252825 - RNA, 62 nt, Human
ugccuggaugucugcggccacaccggccggacacgugguagaugcccaccuccuccaugccu

SEQ ID NO: 252826 - RNA, 64 nt, Human; identical to SEQ ID NO: 141728

SEQ ID NO: 252827 - RNA, 64 nt, Human
cugccacaguugauggugaggaagcuccuuugacguggugcaauuuugaugagaugucucuggg

SEQ ID NO: 252828 - RNA, 64 nt, Human
ugcccacagaucacugagagggaccaucucccaaguggugcaguuuagaacuucucucccuuuu

SEQ ID NO: 252829 - RNA, 64 nt, Human
uggaaucuugcucuguugcucaggcuggagugcaguggugcaaucuuggcucacugcaaccuac

SEQ ID NO: 252830 - RNA, 64 nt, Human
ucaucagcaccaguguccgucaggaaggcaggugguggugcagaaacaugaugccuggcugauu

SEQ ID NO: 252831 - RNA, 64 nt, Human
ucuuuucaccauuggcagaaacagugagagcuguguggugcagaaauccagaaaugagguguag

SEQ ID NO: 252832 - RNA, 64 nt, Human
uuuccuagaaauauaucuguaacaaugauuuaagguggugcagaugguguuuguucuauauuau

SEQ ID NO: 252833 - RNA, 64 nt, Human
ccgucucuacaaaaaauaaauuuagcugggcaugguggugcacaucuguaguccuaccaacuug

SEQ ID NO: 252834 - RNA, 64 nt, Human
uugcugaccugggucagugcaugugcuuuaugguguggugcaucuuuggagaucaucaccauau

SEQ ID NO: 252835 - RNA, 64 nt, Human
gaaugcaugucacaggcgggacuuucuucagagaguggugcagcgccagacauuuugcacauaa

SEQ ID NO: 252836 - RNA, 64 nt, Human
uuuuguauggaagccaccgggagauuucuggaugguggugcauccgugaaugcgcugaucguuu

SEQ ID NO: 252837 - RNA, 64 nt, Human
cccugaaaggacguguggagacagcagcaguccuguggugcaguuacugccuguguggccagcu

SEQ ID NO: 252838 - RNA, 64 nt, Human
gaguuuugaagugccuaagaugaccuauuugucaguggugcaaaauuaauucucuucuuuuuug

SEQ ID NO: 252839 - RNA, 64 nt, Human
ucucuacuaaaaauacaacaauuagccaggcaugguggugcaugccuguaaucccagcuacuca

SEQ ID NO: 252840 - RNA, 64 nt, Human; identical to SEQ ID NO: 141733

SEQ ID NO: 252841 - RNA, 64 nt, Human; identical to SEQ ID NO: 141738

SEQ ID NO: 252842 - RNA, 60 nt, Human; identical to SEQ ID NO: 141741

SEQ ID NO: 252843 - RNA, 64 nt, Human
ugcccugagaagcugcuccaggccugcagcaggaguggugcagacagaagucuccucaauuuuu

SEQ ID NO: 252844 - RNA, 64 nt, Human
uggagucucgcucugucgcccaagcuggaguacaguggugcaaucucacugcaagcucugccuc

SEQ ID NO: 252845 - RNA, 64 nt, Human
gauuacccaggaagguugagcugcugagauuucaguggugcaaugucuuuaaaaaaacaggcuu

SEQ ID NO: 252846 - RNA, 64 nt, Human
gacagugucucacuguugcccaggcuggagugcaguggugcaaucucaguucagugcaaucucc

SEQ ID NO: 252847 - RNA, 64 nt, Human
ggggcccacuaaauauuuuuaucggcuaggcgugguggugcaugccuguaaucucggaaggcug

SEQ ID NO: 252848 - RNA, 64 nt, Human
cugagucucacuccaucagccaggcuggagugcaguggugcaaucucggcucacugcaaccucu

SEQ ID NO: 252849 - RNA, 64 nt, Human
agguggcucuaaguaaaacugggauuggacaguaguggugcaucugguccuugccgccugagag

SEQ ID NO: 252850 - RNA, 64 nt, Human
uuccagccuggugccuggggugcugagcuagugaguggugcaguccaggacaccuuugcuuuau

SEQ ID NO: 252851 - RNA, 64 nt, Human
agcugucuagaguagcuuaccagaagcuuccauaguggugcagaggaaguggaaggcaucaguc

SEQ ID NO: 252852 - RNA, 64 nt, Human
gacacuggcagccaaugaagacugugcucgcuggguggugcaggccuggcaccaggaggcuugc

SEQ ID NO: 252853 - RNA, 64 nt, Human
uuucccccagacauacuuucagagcgcuagcuguguggugcacgggacuuuacaguuaggauuc

SEQ ID NO: 252854 - RNA, 64 nt, Human
cgggugcugaauguaaggaggggagccuccaaguguggugcaagccgggggucuccacaucuuc

SEQ ID NO: 252855 - RNA, 64 nt, Human
gacagagucucacuguugcccaggcuggagugcaguggugcaaucucggcucacugcaagcucu

SEQ ID NO: 252856 - RNA, 64 nt, Human; identical to SEQ ID NO: 141744

SEQ ID NO: 252857 - RNA, 64 nt, Human; identical to SEQ ID NO: 141749

SEQ ID NO: 252858 - RNA, 64 nt, Human; identical to SEQ ID NO: 141752

SEQ ID NO: 252859 - RNA, 64 nt, Human
cuugguuguggcuugcugaauuaaauauuuaugaguggugcauuuuuaaguauagugaacaaga

SEQ ID NO: 252860 - RNA, 64 nt, Human
aauagacaaaagaaaauggcacaaggaaucacacguggugcagcuaaaacaaaacaaaacauga

SEQ ID NO: 252861 - RNA, 64 nt, Human
aagaaaagaaaaagaaaaaaaucccuuguucucaguggugcaggauguuggcuuggggcaacag

SEQ ID NO: 252862 - RNA, 64 nt, Human
acagcaacugacugcaggugcuggcaugauggagguggugcaccuuggacacguggacaaggcc

SEQ ID NO: 252863 - RNA, 64 nt, Human
caagcauucugugcauaaaaguuaacauuaggcuguggugcaguaaccauuuaaugucgaggcu

SEQ ID NO: 252864 - RNA, 64 nt, Human
ucucuauuaaaaauacaaaaauuagccaggcauaguggugcaugccuguagucccagcuacuug

SEQ ID NO: 252865 - RNA, 64 nt, Human
aucucuacuaaaaauacaaaaguuaaccagguguguggugcacguuuguaaucccaguuacuca

SEQ ID NO: 252866 - RNA, 64 nt, Human
cuuguucuccaagaacuuacuguccaaucaugcuguggugcauuccuuugaagaucaugaagaa

SEQ ID NO: 252867 - RNA, 64 nt, Human
gaaccuucuacuuucucugggaaagcauuauauaguggugcauuaguuuagaaagucagcuaug

SEQ ID NO: 252868 - RNA, 64 nt, Human
ucgcuacuaaaaauacaaaaaugagucggacaugguggugcaugccuguaaucccagcuacuug

SEQ ID NO: 252869 - RNA, 64 nt, Human
acagaaucucacuuugucaccaggcuggagugcaguggugcaaucucaccucacugcaaccucc

SEQ ID NO: 252870 - RNA, 64 nt, Human
augucucugcccuuccucuagccucuugucacauguggugcacaaaccucaaccugacagcuuu

SEQ ID NO: 252871 - RNA, 64 nt, Human
cagaacaagagaaccucugacgguggagaaccauguggugcaagaagagaucuuaggucucuuc

SEQ ID NO: 252872 - RNA, 64 nt, Human; identical to SEQ ID NO: 141756

SEQ ID NO: 252873 - RNA, 64 nt, Human; identical to SEQ ID NO: 141760

SEQ ID NO: 252874 - RNA, 64 nt, Human; identical to SEQ ID NO: 141763

SEQ ID NO: 252875 - RNA, 64 nt, Human
cucuacuaaaaauacaaaaaauuagcugggcaugguggugcaugccugugauuccagcuacuug

SEQ ID NO: 252876 - RNA, 64 nt, Human
ucucuacuaaaaauacaaaaauuagcugggugugguggugcaugccuguagucccagcuacucg

SEQ ID NO: 252877 - RNA, 64 nt, Human
ucuacuaaaaauacaaaaauauuagccgggcgugguggugcaugccuguaaucccagcuacuag

SEQ ID NO: 252878 - RNA, 64 nt, Human
gaugaagucucacaguuggugauuucuccgcucuguggugcaauaucccuauuuguaggugagu

SEQ ID NO: 252879 - RNA, 64 nt, Human; identical to SEQ ID NO: 252864

SEQ ID NO: 252880 - RNA, 64 nt, Human
ucacaaacauuucuaaucuacuggcuggagugcaguggugcagucuguagcucacugcagccuc

SEQ ID NO: 252881 - RNA, 64 nt, Human
cagauggaguuucgcucuugucccccaggcuggaguggugcaguggcacgaucucaggucacug

SEQ ID NO: 252882 - RNA, 64 nt, Human
cuuuaccaaaaaauacaaaaauuagcugggugugguggugcacaccuguagucucaacuauugg

SEQ ID NO: 252883 - RNA, 64 nt, Human
caauggccauuuuuuuuuuagauggaguuuugcaguggugcaaucauagcucauugcagccuuc

SEQ ID NO: 252884 - RNA, 64 nt, Human
cuacuaaaauuacaaaaaaaauuauccaggcgugguggugcacgccuguaaucccagcuacuca

SEQ ID NO: 252885 - RNA, 64 nt, Human
guggucuuugucacugcagagaaucugccucgcuguggugcacuggagaacuugguaaaugaug

SEQ ID NO: 252886 - RNA, 64 nt, Human
aaaugccugagacugcuugaaagauauauuuuaaguggugcacuaauuagugaauauauaggaa

SEQ ID NO: 252887 - RNA, 64 nt, Human
uggagucucacucugucgcccaggcuagacugcaguggugcaaucucagcucacugcaaccucc

SEQ ID NO: 252888 - RNA, 64 nt, Human; identical to SEQ ID NO: 141768

SEQ ID NO: 252889 - RNA, 64 nt, Human; identical to SEQ ID NO: 141773

SEQ ID NO: 252890 - RNA, 64 nt, Human; identical to SEQ ID NO: 141778

SEQ ID NO: 252891 - RNA, 64 nt, Human
gugcugaaaccaaaggcaguggggguccaaacucguggugcagcaagucacaccagacaggaaa

SEQ ID NO: 252892 - RNA, 64 nt, Human
augaagugauaggggucacaauggggaaauugaaguggugcauaacauugccaaaauagugugc

SEQ ID NO: 252893 - RNA, 64 nt, Human
uuucuacuaaaaauacaaaaauaagccaggugugguggugcaugacuguaaucccaacuacuca

SEQ ID NO: 252894 - RNA, 64 nt, Human
ccuggggguggcuggagccagccugcugagaagcguggugcagcugggucugggacuucacuag

SEQ ID NO: 252895 - RNA, 64 nt, Human
uucuauauaaauagcucuuucuugcuguuuuaauguggugcacacuauagccucacaaaccugu

SEQ ID NO: 252896 - RNA, 64 nt, Human
uuuuugaggcagagucuugcucugcuggagugcgguggugcaaucucggcucacugcaaccucc

SEQ ID NO: 252897 - RNA, 64 nt, Human
caagcgcugggccugccagacagaggccccucuuguggugcaagcccagcucugucaccugaga

SEQ ID NO: 252898 - RNA, 64 nt, Human
ucuacuaaaaauacaaaaaaauuagcugcgcgugguggugcacgccuguagucccugcuacuug

SEQ ID NO: 252899 - RNA, 64 nt, Human
ugguuuacauuuacucagcuacuauauaugcaguguggugcacauuuucacagaauucuggcuu

SEQ ID NO: 252900 - RNA, 64 nt, Human
cgcugucucuacaaaaaauaauuagccuggccugguggugcaugccuaguccuagcugaucugg

SEQ ID NO: 252901 - RNA, 64 nt, Human
ucacagcagauaauucugagaucaugggugagggguggugcauguugagauuuaaauuggcaua

SEQ ID NO: 252902 - RNA, 64 nt, Human
aauuagauuaaaguacaacaauuagcagggcaugguggugcacgucuguagucccagcuacuca

SEQ ID NO: 252903 - RNA, 64 nt, Human
ugucucuacaagaucaaaaacuuagccggguaugguggugcaugugugccuguaguccaagcua

SEQ ID NO: 252904 - RNA, 64 nt, Human; identical to SEQ ID NO: 141783

SEQ ID NO: 252905 - RNA, 64 nt, Human; identical to SEQ ID NO: 141787

SEQ ID NO: 252906 - RNA, 64 nt, Human; identical to SEQ ID NO: 141790

SEQ ID NO: 252907 - RNA, 64 nt, Human
gucucuacuaagaacacaaaauuagcugggcaugguggugcaugccuguaaucccagcuacuug

SEQ ID NO: 252908 - RNA, 64 nt, Human
uggagucuuguucuguugcccaggagggagugcaguggugcaaccucggcucacugcaaccuuu

SEQ ID NO: 252909 - RNA, 64 nt, Human
acuuggguaagaguaaacuagauaacugggcgucguggugcacaccuguagucccagccacucu

SEQ ID NO: 252910 - RNA, 64 nt, Human
cggaguuucgcccuuuucgcccaggcugaguacaguggugcaaucucacugcaaccuccgccuu

SEQ ID NO: 252911 - RNA, 64 nt, Human
ucucuacuaaaaauacaaaaauuagccaggcgugguggugcacaccuguagucccagcuacucg

SEQ ID NO: 252912 - RNA, 64 nt, Human
ucacuacaaaaauucaaaaaauuagccaggcaugguggugcacacuuguagucccagcuacuca

SEQ ID NO: 252913 - RNA, 64 nt, Human
ucucuacuaaaaauacaaaaauuagccuggcgugguggugcacaccuguaaucccagcuacucu

SEQ ID NO: 252914 - RNA, 64 nt, Human
gcuguggggucggagaggcguuuggagaaggucuguggugcagugugugaaaauucaggugcua

SEQ ID NO: 252915 - RNA, 64 nt, Human
ucucuacuaaaaauacaaaaaugagccgggcaugguggugcaugccuguaagcccagcuauucg

SEQ ID NO: 252916 - RNA, 64 nt, Human
gggucuguucauuggcuaugagguucaaauguguguggugcaguuucuguguuaauaaagcagg

SEQ ID NO: 252917 - RNA, 64 nt, Human
auaauuuaaaagguuuuguugcugaaagcaguaaguggugcaguaaaauacuuaaguuauucaa

SEQ ID NO: 252918 - RNA, 64 nt, Human
cuguguguguguguguguauguauguguguguguguggugcacacauuguguucuuaaacugag

SEQ ID NO: 252919 - RNA, 64 nt, Human
ucucuacaaaaaauauaaaagucagccaggcguuguggugcaugcuuguggucccagcuacuuu

SEQ ID NO: 252920 - RNA, 64 nt, Human; identical to SEQ ID NO: 141793

SEQ ID NO: 252921 - RNA, 64 nt, Human; identical to SEQ ID NO: 141799

SEQ ID NO: 252922 - RNA, 59 nt, Human; identical to SEQ ID NO: 141803

SEQ ID NO: 252923 - RNA, 64 nt, Human
aucucuacuaaaaaaacaaaacuagcugggggugguggugcaugccuguggucccagcuacuug

SEQ ID NO: 252924 - RNA, 64 nt, Human
cagugugaccccacgugcacagaaagugcugcgaguggugcauggugagagguugaugcaggua

SEQ ID NO: 252925 - RNA, 64 nt, Human
uaauugcauggggguuauuuuaucuuucaugauuguggugcaccugaugcuggcgggguauuug

SEQ ID NO: 252926 - RNA, 64 nt, Human
gucucuaugaaaaauacaaaauuugcugggagugguggugcaugccuguaaucccagcuacuug

SEQ ID NO: 252927 - RNA, 64 nt, Human
aaaaaaaacauuuagaggauuaugcuuguuuugaguggugcauaagggaaaaaacugacuuuuu

SEQ ID NO: 252928 - RNA, 64 nt, Human
cugagucuugcucuaucacccaggcuggagugcaguggugcaaucucagcucacugcaaccucc

SEQ ID NO: 252929 - RNA, 64 nt, Human
caggggcugggggaugcuaggacugagacccuggguggugcagcgccuggugaucuugcugugu

SEQ ID NO: 252930 - RNA, 64 nt, Human
aauauguauuaaacugguaucguggugauauaauguggugcaguuacuuauauauuaaauaucu

SEQ ID NO: 252931 - RNA, 64 nt, Human
ccuaaacucuggugauccaaacaaaauggcuucaguggugcagaugucaccuacauguuauucu

SEQ ID NO: 252932 - RNA, 64 nt, Human
aguuaugauuuacacagaagcaacugccaaaucuguggugcaaccacuaucuccagugaaauau

SEQ ID NO: 252933 - RNA, 64 nt, Human
uugaaaauaugcuuccuguaucaaagguacguauguggugcaaacaaggcagaaacuuccuuuu

SEQ ID NO: 252934 - RNA, 64 nt, Human
ucucuauuuaaaauacaaaaauuagcugggcaugguggugcaugccuguaaucccagcuacucg

SEQ ID NO: 252935 - RNA, 64 nt, Human
aucucuauaaaaaaucaaaaauuagccaggcaugguggugcauaccuauaguccuggcuauuug

SEQ ID NO: 252936 - RNA, 64 nt, Human; identical to SEQ ID NO: 141808

SEQ ID NO: 252937 - RNA, 64 nt, Human; identical to SEQ ID NO: 141812

SEQ ID NO: 252938 - RNA, 64 nt, Human; identical to SEQ ID NO: 141817

SEQ ID NO: 252939 - RNA, 64 nt, Human
ucucuacuaaaaauacaaaaauuagcugggcgugguggugcaugccuguaaucccagcuacucg

SEQ ID NO: 252940 - RNA, 64 nt, Human
ggcugggugaggggaggccuuccugggaaggcguguggugcaggccugugcucacaguggcacc

SEQ ID NO: 252941 - RNA, 64 nt, Human
agaggucucacuccgucauccaagcuggagugcaguggugcaauccucaacucacugcaaccuc

SEQ ID NO: 252942 - RNA, 64 nt, Human
cagcugccucccucuucaugcaaucuggugagcaguggugcaggcggggagccagagaaacuug

SEQ ID NO: 252943 - RNA, 64 nt, Human
ucucuacuaaaaauacaaaaauuagccaggugugguggugcacgccuguaauccccagauacuc

SEQ ID NO: 252944 - RNA, 64 nt, Human
gagacaggacaucgugacugcugguaguaauaugguggugcauuguuuuuuccacccaaacuua

SEQ ID NO: 252945 - RNA, 64 nt, Human
uggauucuuaaccaagaaacaaauaauagcaaugguggugcaccacuguaccccagguucuagu

SEQ ID NO: 252946 - RNA, 64 nt, Human
aacuauaguccuauacaaaaauuagcugggcgugguggugcaugccuguaaucccagcuacuag

SEQ ID NO: 252947 - RNA, 64 nt, Human
uuaaucucauucaugauguugauuuuuuuucaauguggugcaauauauacaauaaaauuuguca

SEQ ID NO: 252948 - RNA, 64 nt, Human
uguauucuugaaaacugcuguagcaaauucaucuguggugcaauacacuuuuugauuaaagcuc

SEQ ID NO: 252949 - RNA, 64 nt, Human
uggacuuccggucccugcaacgggugaccuaagcguggugcacccaucagucacgcaggaggac

SEQ ID NO: 252950 - RNA, 64 nt, Human
ccuggcacugggagucgggggagcacguccaggcguggugcauccuggggcagaacgccauggc

SEQ ID NO: 252951 - RNA, 64 nt, Human
ucucuacuaaaaauacaaaaauuagccgggcaugguggugcacaucgguaguccuggcuacuag

SEQ ID NO: 252952 - RNA, 64 nt, Human; identical to SEQ ID NO: 141822

SEQ ID NO: 252953 - RNA, 64 nt, Human; identical to SEQ ID NO: 141828

SEQ ID NO: 252954 - RNA, 56 nt, Human; identical to SEQ ID NO: 141833

SEQ ID NO: 252955 - RNA, 64 nt, Human
ugaggaaagaauaugcuuauuacaaagacaaaauguggugcagaaacuaucuugcaccugugug

SEQ ID NO: 252956 - RNA, 64 nt, Human
gccuguaaucccuucccaagacuagcugcucaggguggugcagggacaggaccagacccugcgc

SEQ ID NO: 252957 - RNA, 64 nt, Human
uggagcuguugcccaaaaaaauggaucuguugcaguggugcaaucugggcucacugaaaccacc

SEQ ID NO: 252958 - RNA, 64 nt, Human
acagaagaggaccaagaagggagggggcugcccuguggugcacacaggccugccauggggcgug

SEQ ID NO: 252959 - RNA, 54 nt, Human; identical to SEQ ID NO: 252550

SEQ ID NO: 252960 - RNA, 64 nt, Human
cucuacaaaaaaauacaaaaauuagcugggcauaguggugcaugccuguguuucuagcuacgca

SEQ ID NO: 252961 - RNA, 64 nt, Human
cuaaaaagguccuguaagaagcggcauagcacccguggugcaugguaugugggugacccuggac

SEQ ID NO: 252962 - RNA, 64 nt, Human
gcugccuucucggagccuucugcaaccaggacuuguggugcagcugcagacacagagcacagcu

SEQ ID NO: 252963 - RNA, 64 nt, Human
guaggaaagaccauuuuuccuccacugaacuaggguggugcauuuuuguaaguuagguaacugu

SEQ ID NO: 252964 - RNA, 64 nt, Human
cgggcccucggugaccucaggcauccuuucggcuguggugcaggugaauggcacgcccguaaug

SEQ ID NO: 252965 - RNA, 64 nt, Human
ccaagcugucugaggucugucccagguggcccagguggugcagguagaacagggugaggagagg

SEQ ID NO: 252966 - RNA, 64 nt, Human
acggagucuuguucuguugccaggcuggagugcgguggugcaaucucagcucacugcaaucucc

SEQ ID NO: 252967 - RNA, 64 nt, Human
aucucuacuaaaaauacaaaauuaccugggcgugguggugcaugccuguaaucccaucaucuac

SEQ ID NO: 252968 - RNA, 64 nt, Human; identical to SEQ ID NO: 141837

SEQ ID NO: 252969 - RNA, 64 nt, Human; identical to SEQ ID NO: 141842

SEQ ID NO: 252970 - RNA, 51 nt, Human; identical to SEQ ID NO: 141846

SEQ ID NO: 252971 - RNA, 64 nt, Human
cuacaaagaaauuuuaaaagauuauccaggcaugguggugcaugccuaugguuccagcuacucg

SEQ ID NO: 252972 - RNA, 64 nt, Human
gugccccggacacauuucacaccucaggcucgugguggugcaggggacaagaggcugugggugc

SEQ ID NO: 252973 - RNA, 64 nt, Human
uacucuucugauuuuuauugcaaucuuuuaccaaguggugcacaaacuugguauugaugucuuu

SEQ ID NO: 252974 - RNA, 64 nt, Human
uuuuguuuuaauuguuuaauaaagcugcugggcaguggugcagcauuccuaccuagugucauaa

SEQ ID NO: 252975 - RNA, 64 nt, Human
cggagucucacucugucacccaggcuggagugcuguggugcaaucucggcucacugcaaccucu

SEQ ID NO: 252976 - RNA, 64 nt, Human
ggaaagaauggcucaacguggauuuuuauucauuguggugcacguuucaaauuuucuugcaaau

SEQ ID NO: 252977 - RNA, 64 nt, Human
gggcagcagggggcagggugcaggguccacauagguggugcacacgcaagccccccggggugcu

SEQ ID NO: 252978 - RNA, 64 nt, Human
ccugugggacagcccagggcagcagagcugggauguggugcaugccuuuguguacauggccaca

SEQ ID NO: 252979 - RNA, 64 nt, Human
ccccuuuacucauagcacuucccccauuggacacguggugcauuuugcuuguuuauuauguuuu

SEQ ID NO: 252980 - RNA, 64 nt, Human
ugaagcagcaggaaggggcucccaagagcuccugguggugcagccugugcuccccucagaagcu

SEQ ID NO: 252981 - RNA, 64 nt, Human
cuggcuccgcccuggccaccuggggacuggcacuguggugcacaguggcccaauguggccaacg

SEQ ID NO: 252982 - RNA, 64 nt, Human
uuuuguuuguuugagaugcagagucuagagugcaguggugcaagcucagcuuacuguaaccucu

SEQ ID NO: 252983 - RNA, 64 nt, Human
gacaguuucacugugucgcccaggcuggcguucaguggugcaaucucagcucacugcaaacucu

SEQ ID NO: 252984 - RNA, 64 nt, Human; identical to SEQ ID NO: 141850

SEQ ID NO: 252985 - RNA, 64 nt, Human; identical to SEQ ID NO: 141855

SEQ ID NO: 252986 - RNA, 64 nt, Human; identical to SEQ ID NO: 141860

SEQ ID NO: 252987 - RNA, 64 nt, Human
cagauucucacucugucucccaggcuagagugcaguggugcaaucucagcucacugcagccuca

SEQ ID NO: 252988 - RNA, 64 nt, Human
ucuguauuuccuaucaagggugaaagugaugaugguggugcaggagggugacaauaaaauccua

SEQ ID NO: 252989 - RNA, 64 nt, Human
cuuaaaauucaaagaugggauauucuaacugguaguggugcaucauuuuuaacccaaauauugc

SEQ ID NO: 252990 - RNA, 64 nt, Human
gaagaggagccaaugacaggguagggagaugacaguggugcaugaugggagaaucaugaaaguc

SEQ ID NO: 252991 - RNA, 64 nt, Human
uggaaguucagcguuguaugucucucucuacacuguggugcacuuaacuuguggaauuuuuaua

SEQ ID NO: 252992 - RNA, 64 nt, Human
ugagugcaaccccguuggugcucugcaggagcugguggugcagaaaggcuggcgguugccggag

SEQ ID NO: 252993 - RNA, 64 nt, Human
ccucccaccagaacgcaccccacugggagagcugguggugcagccuuccccucccuguauaaga

SEQ ID NO: 252994 - RNA, 64 nt, Human
gguuccuuuaaacaugcuacaaagcccaggcaugguggugcacaccuguacucccagcuacucg

SEQ ID NO: 252995 - RNA, 64 nt, Human
gguggccaaauguaaacuaaaagccuuaauuaaaguggugcaauuuuguauaacuuagcaucag

SEQ ID NO: 252996 - RNA, 64 nt, Human
uguauaaaauguauggaaugguuagccuggugugguggugcacaccuguaaucccagcuacuug

SEQ ID NO: 252997 - RNA, 64 nt, Human
cggagucucacuuugucacucaggcucaagugcaguggugcaaucucugcucacugcaacaucu

SEQ ID NO: 252998 - RNA, 64 nt, Human
auggaguuucucuugucaaccgggcuggagugcaguggugcaaucuuggcucacugcaaccucc

SEQ ID NO: 252999 - RNA, 64 nt, Human
cggggucuggcuguguugcccugacuggaguucaguggugcaaacacagcucucuccacaaccu

SEQ ID NO: 253000 - RNA, 64 nt, Human; identical to SEQ ID NO: 141863

SEQ ID NO: 253001 - RNA, 64 nt, Human; identical to SEQ ID NO: 141866

SEQ ID NO: 253002 - RNA, 64 nt, Human; identical to SEQ ID NO: 141869

SEQ ID NO: 253003 - RNA, 64 nt, Human
gaucguggagugcgggcccugccagaagguauuuguggugcagcagauucccaacaguaaccuc

SEQ ID NO: 253004 - RNA, 64 nt, Human
aaggaugguuguguauguguuuaaaauaaaaccuguggugcacauuucuacccagguuuugcua

SEQ ID NO: 253005 - RNA, 64 nt, Human
gaauucuugaagacuauuuuccagggaugccugaguggugcacugagcucuagacccuuacuca

SEQ ID NO: 253006 - RNA, 64 nt, Human
gagcuaggaggacagaggcccccaagcugaucugguggugcauccacgcacccccacccuggga

SEQ ID NO: 253007 - RNA, 64 nt, Human
acucaguucagugggugugcuugcgugguaggauguggugcagcccucucuacgcucuucuauu

SEQ ID NO: 253008 - RNA, 64 nt, Human
cuacuaaaaaaaaaaaaaaaauuagucgggcgugguggugcaugccuguaaucccagcuacugg

SEQ ID NO: 253009 - RNA, 64 nt, Human
aucuuauuuacuguuaguauccguugcaucuaguguggugcaccuggcacacaguaggcacuca

SEQ ID NO: 253010 - RNA, 64 nt, Human
gucucuacaaaaaauacaaaauuagcagggugugguggugcacaccuguagucccuuacucccu

SEQ ID NO: 253011 - RNA, 64 nt, Human
cacgcuguuguugagcugacucugugcccgaaugguggugcaggcgcccuguccugguuguguu

SEQ ID NO: 253012 - RNA, 64 nt, Human
gucucuacuaaaaauacaaaauuagccaggcgugguggugcaugccuguaauccagcuacuugg

SEQ ID NO: 253013 - RNA, 64 nt, Human
cccaucucuacugaaaauacaaaaauuaggcauaguggugcacgccugcagucccagcuacuca

SEQ ID NO: 253014 - RNA, 64 nt, Human
cuaagcuggcugucuugugugcagccugagugggguggugcaggccgguagucugcccgucacu

SEQ ID NO: 253015 - RNA, 64 nt, Human
aauguuuuuaccguagcccucaucuaacuuacacguggugcauauuaaaauaagcagagaaaaa

SEQ ID NO: 253016 - RNA, 64 nt, Human; identical to SEQ ID NO: 141873

SEQ ID NO: 253017 - RNA, 64 nt, Human; identical to SEQ ID NO: 141879

SEQ ID NO: 253018 - RNA, 64 nt, Human; identical to SEQ ID NO: 141884

SEQ ID NO: 253019 - RNA, 64 nt, Human
caaacguggauuaucgcacagacugggagguuuaguggugcauuucuccucuguuuucuuuuua

SEQ ID NO: 253020 - RNA, 64 nt, Human
gaugcgaggcuucguggacuguguccugguccauguggugcacgugucuccaccuccaaggaga

SEQ ID NO: 253021 - RNA, 64 nt, Human
ucccuacuaaaaauacaaaaauuagcagggagugguggugcacaccuguaaucccagcuacucu

SEQ ID NO: 253022 - RNA, 64 nt, Human
aucugcuauuaugccuucuuuagaucuuucuucuguggugcagacauuucuaguaaguguuuga

SEQ ID NO: 253023 - RNA, 64 nt, Human
uccagccuggguggccaccccuccuuaucucuggguggugcacaugcccuucuuuccccacucc

SEQ ID NO: 253024 - RNA, 64 nt, Human
agcugcugugcgggugcgcucggugacacuggugguggugcacgcucccgagcucccagaguua

SEQ ID NO: 253025 - RNA, 64 nt, Human
ccuccuaauuuuaaauguuggcucugauuuuaaaguggugcauuugauuccagccuugguaaug

SEQ ID NO: 253026 - RNA, 64 nt, Human
gcuucugccuccugccauaaaaccagcgagugucguggugcaggcaggcccuguggccugcugg

SEQ ID NO: 253027 - RNA, 64 nt, Human
ugcggagcauuucugcaagcguugccuggaugcgguggugcauugugggcccucugggcuccug

SEQ ID NO: 253028 - RNA, 64 nt, Human
uagggaccuugacagaagagagcccugggugcuuguggugcaaagaucuucaugcccaguucca

SEQ ID NO: 253029 - RNA, 64 nt, Human
uggcuuaacagaaacagucuguaaaaaccuaacaguggugcaaucauguugucuguguuguguu

SEQ ID NO: 253030 - RNA, 64 nt, Human
ucuacuaaaaauacaaaauuagccgggcauugugguggugcaugccuguaaucccagcuacucg

SEQ ID NO: 253031 - RNA, 64 nt, Human
cgucucuacuaaaaauaugaaauuagccagggugguggugcacaccuguaaucccagcuaccug

SEQ ID NO: 253032 - RNA, 64 nt, Human; identical to SEQ ID NO: 141889

SEQ ID NO: 253033 - RNA, 64 nt, Human
ugucaggucucuccuguccuaaccauccagcuuggcucaacaccuuuugcccuccuccccugcc

SEQ ID NO: 253034 - RNA, 64 nt, Human
cugucccuccuccagguagagagaccacaagcaggcucaacauaacauaagcuagaaaaauuag

SEQ ID NO: 253035 - RNA, 64 nt, Human
gagaaguuuaugcaacuuaaaauguuuacacacuguggugcaaucuacuguuugugaaugucug

SEQ ID NO: 253036 - RNA, 64 nt, Human
gcuccugccaggguccuuaggugggaaggcugggguggugcaggggccuugggcucccaggaca

SEQ ID NO: 253037 - RNA, 64 nt, Human
acuaaaaauacaaaaaaauauuagcugggcguagguggugcacaccuguagucccagcuacugg

SEQ ID NO: 253038 - RNA, 64 nt, Human
caguggggagagucuggggcgagcaaccgcccugguggugcaggcugugaagaaagaccaggag

SEQ ID NO: 253039 - RNA, 64 nt, Human
ugucaccgaugaugcugagcgccuccuucagcgcguggugcaugugcagcaucucgucgugcug

SEQ ID NO: 253040 - RNA, 64 nt, Human
ggcucuguauuugcucccguggagcuucaucgggguggugcaggcucccaaacucaggcuuuca

SEQ ID NO: 253041 - RNA, 64 nt, Human
uggagucuugcucugucacccaggcuggagugcuguggugcaaucucggcucacugcaaccucu

SEQ ID NO: 253042 - RNA, 64 nt, Human
ggggccuucagggaagccuggguguggcccggugguggugcacuggugacuucauggccacgcc

SEQ ID NO: 253043 - RNA, 64 nt, Human
gagagccuuguucugucaccuaggcuggaaugcaguggugcaaucauagcucacugcagccuug

SEQ ID NO: 253044 - RNA, 64 nt, Human
acaaaaaaaaacuucucuaaauuagccggaugugguggugcaugccuguagucccagcuacucg

SEQ ID NO: 253045 - RNA, 64 nt, Human
cuaucguaaauuuagauucuggaauugggguuugguggugcaauguguugcucacaaguggcca

SEQ ID NO: 253046 - RNA, 64 nt, Human
uacguauaaaaaaauacaaaauuagccaggcaugguggugcaugccuguaacuccagauacuug

SEQ ID NO: 253047 - RNA, 64 nt, Human
cccaucuguacugaaaauacaaaaauuaggcaugguggugcaugccuguaguuccagcuacuug

SEQ ID NO: 253048 - RNA, 64 nt, Human
ugaccuugcacuccaacuauagugccuugcaagugcucaacaguacauauuggaaugaaguccc

SEQ ID NO: 253049 - RNA, 64 nt, Human
ggcugcagagcaauacccaagccucauuuggaaggcucaacauuuggaauugcacuuuaauuga

SEQ ID NO: 253050 - RNA, 64 nt, Human
uucauguauuuauugagcaccuacuuauuauggugcucaacacuuguuacugcaagcuaccuua

SEQ ID NO: 253051 - RNA, 64 nt, Human
ccacaaaagaaaaaaaucaaaaugcagaaaauguguggugcacuaagaugaucacacagcauua

SEQ ID NO: 253052 - RNA, 64 nt, Human
acuaccuaauuuuugccagucucauggguagauaguggugcagugcuuuaacauacauucaucu

SEQ ID NO: 253053 - RNA, 64 nt, Human
uauaauaggucaguguaaagaaauaugauuugagguggugcaugcaaguaacuaggguuuauuc

SEQ ID NO: 253054 - RNA, 64 nt, Human
cccuuugugcacaucuucccucuccccauucgguguggugcagugugaaaaguccuugauuguu

SEQ ID NO: 253055 - RNA, 64 nt, Human
aucucuacuaaaaauacaaaauuagccaggugugguggugcaugccuguaaucccagcuacucg

SEQ ID NO: 253056 - RNA, 64 nt, Human
cagggucucauucuaucggccaggcuggagugcaguggugcaaucacagcucacugcagccuug

SEQ ID NO: 253057 - RNA, 64 nt, Human
ucaaauucugcaucucaaggcagggcaagccgggguggugcaggucucagggcacgagucccuc

SEQ ID NO: 253058 - RNA, 64 nt, Human
ccaggaccugggcagagcaggcaugagcugggcuguggugcagagcaagcagacccagccacac

SEQ ID NO: 253059 - RNA, 64 nt, Human
gaugggggggucgaccucuugcaggaggguggguguggugcagagagaggcaguccccaugaua

SEQ ID NO: 253060 - RNA, 64 nt, Human
aaaguuuugcucuugucacccaggcuggagugcaguggugcaaucuuggcucgcaaccuccgcc

SEQ ID NO: 253061 - RNA, 64 nt, Human
auagcaagaccccaucucuaaaaaauuaggcaugguggugcaugccuguauucccagcuacuca

SEQ ID NO: 253062 - RNA, 64 nt, Human
ggugcccucuguggcuccagccuuuaccggaaguguggugcauguuuuuaacuucagggaagcg

SEQ ID NO: 253063 - RNA, 64 nt, Human
uaaaaauaaauuuaaaaaaaauuagcugagugugguggugcaugcauguaguuccagcuacuca

SEQ ID NO: 253064 - RNA, 64 nt, Human
aacaauggcugagggaaguagagguuaagauauagcucaacagugaaaguagcagggaaagagc

SEQ ID NO: 253065 - RNA, 64 nt, Human
auaguuaguacuccaaaaauauuauauuuaagaugcucaacaagaaaaaaaugcaaauguaaua

SEQ ID NO: 253066 - RNA, 64 nt, Human
uuuucuccucccccaucccuacccuuguccacaggcucaacauuucuacacguugcccaucauc

SEQ ID NO: 253067 - RNA, 64 nt, Human
cggccccucccaaaggagcccuugagcuagggagguggugcagucagccucgcucucaacguga

SEQ ID NO: 253068 - RNA, 64 nt, Human
auucaaggagaauaugauaaaacacugcccucuuguggugcauugaaagaagagaugagaaaug

SEQ ID NO: 253069 - RNA, 64 nt, Human
gcucaucuacuuccucuuccuccucuacuacaugguggugcagggcaagcgcaugaguaaagag

SEQ ID NO: 253070 - RNA, 64 nt, Human
ucucuacaaaaaauacaaaaauuagccaggcaggguggugcaugccuguagucccagcuacuug

SEQ ID NO: 253071 - RNA, 64 nt, Human
gucucuauuaaaaauacaaauuuagccgggcgugguggugcaggccuguaaucccagcuacucg

SEQ ID NO: 253072 - RNA, 64 nt, Human
gggugccugacguguggggaacccucaguaaauaguggugcauuuguauugaggcucucugagg

SEQ ID NO: 253073 - RNA, 64 nt, Human
aaaauacaaaaaaaaaaaaaauuagccaggcgugguggugcacaccuguaguccuagcuacuug

SEQ ID NO: 253074 - RNA, 64 nt, Human
gugcuguguccacucaggguuaaauggauuaaggguggugcaagaugugcuuuguuaaacagau

SEQ ID NO: 253075 - RNA, 64 nt, Human
gggcuuuuuuaaaaaaaaaauuguagcacugggcguggugcaugccuguaaucccagccacuca

SEQ ID NO: 253076 - RNA, 64 nt, Human
gucagaggaggaggagaaggagccccucagcagaguggugcaguuucgcucagagcuugucucc

SEQ ID NO: 253077 - RNA, 64 nt, Human
auuagaaaauucucacgcugaacugguguagcauguggugcagcauucagugaaacuggcugga

SEQ ID NO: 253078 - RNA, 64 nt, Human
caugcugaugcgaccucggcugacagcugggccuguggugcagacaggagcuguguggacaguc

SEQ ID NO: 253079 - RNA, 64 nt, Human
cucugcuaaagauauaaaaaauuagcccggcgugguggugcacgccuguaaucccagcuacucg

SEQ ID NO: 253080 - RNA, 64 nt, Human
cuguauuuuugaaauacucuacaagaaagcuguggcucaacacaugagaagaagcacgaagcag

SEQ ID NO: 253081 - RNA, 64 nt, Human
uucuggguggccaauucagaagaagaguguacaugcucaacaaauccuaggcccugcauuccug

SEQ ID NO: 253082 - RNA, 64 nt, Human
gaacuaucuguagauaguauacuaucuacacucugcucaacaagcucagaaauuaaauauuuuu

SEQ ID NO: 253083 - RNA, 64 nt, Human
gccucuaguaaaaauacaaaauuagccgggcaugguggugcacgccucuaaucccagcuacucg

SEQ ID NO: 253084 - RNA, 64 nt, Human
cucugcuaaaaauacaaaaaauuagccagaugugguggugcacaccuguagucccaacuauucg

SEQ ID NO: 253085 - RNA, 64 nt, Human
accgcuucaggcagaagcucuccggaggauccagguggugcaugcauuugacaucuuccagaug

SEQ ID NO: 253086 - RNA, 64 nt, Human
cagggucuaccucugucacccgagcuagagugcaguggugcagucuuggcucacuacagccucg

SEQ ID NO: 253087 - RNA, 64 nt, Human
cucaaucuccuauugcuugucagccugugugcguguggugcaggaaauaaaggaucuauacccu

SEQ ID NO: 253088 - RNA, 64 nt, Human
gggaaggugcguauuuauucagggaggaggaaaaguggugcagggacagggagauggggcgcua

SEQ ID NO: 253089 - RNA, 64 nt, Human
uauccuauauauagauaucuagaaaacuugguuuguggugcacaguuaaguguuggaucacuaa

SEQ ID NO: 253090 - RNA, 64 nt, Human
ucucuacuaaagauauaaaaauuagcuggaugugguggugcacaccugugaucccagcuacuug

SEQ ID NO: 253091 - RNA, 64 nt, Human
uaccugaaaaggaaauuggauuuuagaacuggauguggugcagugaaguauuuuaggcccaggu

SEQ ID NO: 253092 - RNA, 64 nt, Human
guucagccacaugccuagacuuauauacuaguuaguggugcagccagggagaggacucagauuu

SEQ ID NO: 253093 - RNA, 64 nt, Human
guugaucacuuuccuagcaaaggggagaccacauguggugcacagggaagaaacggcuuuagac

SEQ ID NO: 253094 - RNA, 64 nt, Human
cuacaagaaauuuuuuaaaaaugagccaagugugguggugcaugccuguaguuccagcuacuca

SEQ ID NO: 253095 - RNA, 64 nt, Human
ggaggagcugagccggacccuccaccuggaggagguggugcaggaggccgccggcgaguggcag

SEQ ID NO: 253096 - RNA, 64 nt, Human
ggguauaaaggagggggauucuacgggggcaguagcucaacaaggaauagagggaggaguguaa

SEQ ID NO: 253097 - RNA, 64 nt, Human
cugugcauagauuccucuagaaaggcaucaaaaggcucaacagacugaauggccucuuggucug

SEQ ID NO: 253098 - RNA, 64 nt, Human
aucaagccaauggccuuugucaggaagggaaggggcucaacacagugauggacugauccagaug

SEQ ID NO: 253099 - RNA, 64 nt, Human
ggcuguggaguuuccacggcgacacacagccucaguggugcaagauuuaaaauuaccuuccuuu

SEQ ID NO: 253100 - RNA, 64 nt, Human
ucucuaauaaaaauacaaaaauuagccgggcaugguggugcaugccuguaaucccagcuacucg

SEQ ID NO: 253101 - RNA, 64 nt, Human
caagcucucgcucugucacccaggcuggagugcaguggugcaaucaugguucacugcagucuug

SEQ ID NO: 253102 - RNA, 64 nt, Human
ucucuaccaaaaauacaaaaauuagccagacgugguggugcacgccuuuaaucccagcuacucg

SEQ ID NO: 253103 - RNA, 64 nt, Human
gucucuacuaaaaauacaaaauuagccaugcguaguggugcaugccuguaaucccagcuacucg

SEQ ID NO: 253104 - RNA, 64 nt, Human
agauggagucucacugucaccaggcuggagugcaguggugcaaucucgguucacugcaaccucc

SEQ ID NO: 253105 - RNA, 64 nt, Human
aagcgucucacucugucgcccaggcuggaguacgguggugcaaucucagcucacugcagccucu

SEQ ID NO: 253106 - RNA, 64 nt, Human
aacaaccacaaaaucuaaaaauuagcugggugugguggugcaugccugugauccuggcuacuuc

SEQ ID NO: 253107 - RNA, 64 nt, Human
uagagucucacugugucacccaggcuggagugcaguggugcaaucucgccucacugcaaccuuc

SEQ ID NO: 253108 - RNA, 64 nt, Human
cucuauuaaaaauaaaaaugauuggccgagcaugguggugcacaccaguauucccagcuacucu

SEQ ID NO: 253109 - RNA, 64 nt, Human
caaaauggcuccugugagggcugcaagcuggaggguggugcaggccuugggccacagggaggcg

SEQ ID NO: 253110 - RNA, 64 nt, Human
ucucgacuaaaaauacaaaaauuagccaggcgugguggugcacaccuguaaucccagcuacucg

SEQ ID NO: 253111 - RNA, 64 nt, Human
ugcccugccugaaaagccugcuguguacaccaagguggugcauuaccggaaguggaucaaggac

SEQ ID NO: 253112 - RNA, 64 nt, Human
ugaucagcauugaaugguuguuaggcagccaugugcucaacacugauuucaccucuugaguaua

SEQ ID NO: 253113 - RNA, 64 nt, Human
cacuuaacagaugaggaaacugaggccuagagaagcucaacaaguugccuaaguuccaaguuuc

SEQ ID NO: 253114 - RNA, 64 nt, Human
uccaaaaaauaggcuguuacauauccuaaagacugcucaacagcuucaaguugaaaguggccaa

SEQ ID NO: 253115 - RNA, 64 nt, Human
gacaccgucucuaaaauaaaauuagcugggugugguggugcaccgccuguggucccagcuccuc

SEQ ID NO: 253116 - RNA, 64 nt, Human
uagacccuugcucugucaccuaggcugaagugcgguggugcaaucauggcucacugcagccuca

SEQ ID NO: 253117 - RNA, 64 nt, Human
ucucuacuaaaaauacaaaaauuugccgggcgugguggugcaugccuguaaucccagcuacuug

SEQ ID NO: 253118 - RNA, 60 nt, Human; identical to SEQ ID NO: 252710

SEQ ID NO: 253119 - RNA, 64 nt, Human
gucucuacuaaaaauauaaaauuagcugggcaugguggugcacaccugucgucucagcuacucg

SEQ ID NO: 253120 - RNA, 64 nt, Human
uggagaugguauuugugguuaauuaugauauugaguggugcaugagguagguguuuagaguaau

SEQ ID NO: 253121 - RNA, 64 nt, Human
agagucucacucuuguugcccaagcuggagugcaguggugcaaugugggcucacugcaaccucu

SEQ ID NO: 253122 - RNA, 64 nt, Human
aucucuauuaaagauacaaaauuagccaggcaugguggugcaugccuguaaucccagcuacuug

SEQ ID NO: 253123 - RNA, 64 nt, Human
uuuuuuuuuugagacacacccaggcuggaguccaguggugcaaucuuggcucacugcaaccucc

SEQ ID NO: 253124 - RNA, 64 nt, Human
ucucuacuaaaaauacaaaaauuagccgggcaugguggugcacgccuauagucccagcuacucg

SEQ ID NO: 253125 - RNA, 64 nt, Human
cagggucugacucuguccuccaggccagaguccaguggugcaaucucagcucacuguagccuca

SEQ ID NO: 253126 - RNA, 64 nt, Human
augagauuaagagaacuccaaauagcccaagaggguggugcacccccaacuucauagggguaga

SEQ ID NO: 253127 - RNA, 64 nt, Human
aucucuacuaaaaauacaaacuuagcugggcuuaguggugcaugccuguagucucagcuacuug

SEQ ID NO: 253128 - RNA, 64 nt, Human
aaaggccagauuacucagcagaucucccauguuggcucaacaauucuuuguuuuuaauugcuug

SEQ ID NO: 253129 - RNA, 64 nt, Human
gucaaaauggggagggacuagggcaguuuggauagcucaacaagauacaaucucacucuguggu

SEQ ID NO: 253130 - RNA, 64 nt, Human
guagagcucuugcaugguaauauaccuuauuggugcucaacauuugugggaaauuagaggguug

SEQ ID NO: 253131 - RNA, 64 nt, Human
ucucuacuaaaaauacaaaaauuagcugggugugguggugcacgccuguaaucccagcuacucg

SEQ ID NO: 253132 - RNA, 64 nt, Human
caaaacaaaaaaacacaaaaauuagccaggugugguggugcaucccuauacucccagcaacuca

SEQ ID NO: 253133 - RNA, 64 nt, Human
cggagucucauucugucacccaggcuggagugcaguggugcaaucuuggcucacugcaacuugg

SEQ ID NO: 253134 - RNA, 64 nt, Human
caggguuucacucugucacccaggcuggagugcaguggugcaaucacuguuuauugcagccgcg

SEQ ID NO: 253135 - RNA, 64 nt, Human
ucaccaccuccuagaagacaggcgggacuucccaguggugcauccaaaggggagcuggaagccu

SEQ ID NO: 253136 - RNA, 64 nt, Human
ucuacuaaaaauacaaaaaaauuagcugggcaugguggugcaugccuguagucccagcuacuca

SEQ ID NO: 253137 - RNA, 64 nt, Human
ucuguacuaaaaauacaaaaauuugccuggugugguggugcaugccucuaguccuagcuacucg

SEQ ID NO: 253138 - RNA, 64 nt, Human
ccucaucugaagaggacgaaugaggaggaccacuguggugcaugcuggugaggagccagucucu

SEQ ID NO: 253139 - RNA, 64 nt, Human
gagcaggcgugugcguguguggggcaggcaggauguggugcaggcagguuccaucgcuuucgac

SEQ ID NO: 253140 - RNA, 64 nt, Human
aaacaucaaaaaaaaaaaaaauuagucgggcaugguggugcacaccuguaaucccagcuuguca

SEQ ID NO: 253141 - RNA, 64 nt, Human
gucccuacuaaaaauacaaaauuagccagguaugguggugcauaccuguaaucccagcuacucg

SEQ ID NO: 253142 - RNA, 64 nt, Human
gcccuuggccgguggggacgcagagccccagcagguggugcacgacuguuggcggaaggaacgc

SEQ ID NO: 253143 - RNA, 64 nt, Human
aacuguccccugcuccguggugggcaggagggaaguggugcagggcugcgugcauugccugcga

SEQ ID NO: 253144 - RNA, 64 nt, Human
aaguucaagcagcagaaggagcugcggaaucagggcucaacacagggugacccugagaggaacc

SEQ ID NO: 253145 - RNA, 64 nt, Human
cacugccccucagcaaggaugacucagcacugccgcucaacagggaugacucagggauggcuua

SEQ ID NO: 253146 - RNA, 64 nt, Human
uucuauauaguuuauuauacaugauacuuggguagcucaacauucuuaauaaacagccuuugua

SEQ ID NO: 253147 - RNA, 64 nt, Human
caggguuggucucuguugcccaagcuugagggcaguggugcaaucauaacucauugcagccucg

SEQ ID NO: 253148 - RNA, 64 nt, Human
gucucuacuaaaaauacaaaauuagucgggcguaguggugcaugccuguaaucccaguuacucg

SEQ ID NO: 253149 - RNA, 64 nt, Human
ucucuacaaaauauuaaaacauuagcuaggcaugguggugcacaccuguaguccuagcuucuug

SEQ ID NO: 253150 - RNA, 64 nt, Human
uuuuuuaauauuugcaguacuugauuuaggaucuguggugcagggcaauguuucaaaguuuagu

SEQ ID NO: 253151 - RNA, 64 nt, Human
agaacuccaccagcaacuccacccgaccccagcaguggugcaggacagcugccagcacccaccu

SEQ ID NO: 253152 - RNA, 64 nt, Human
cuguccuucauugcccacauggauagacggagcuguggugcagagaacuuuucccgcaacaggu

SEQ ID NO: 253153 - RNA, 64 nt, Human
auauuucaaacagaucuuugaaaccucagauucuguggugcaauuuuaauguuuucuuguuucu

SEQ ID NO: 253154 - RNA, 64 nt, Human
cugagugaaaagcaaaggucccacggugugugcuguggugcaccgccuggcuuugggggucccg

SEQ ID NO: 253155 - RNA, 64 nt, Human
gccaggucacugccuguggcugcagccguggcccguggugcagccguggcccauggcagccugu

SEQ ID NO: 253156 - RNA, 64 nt, Human
ucuuuugagaugaagucgcccgggcugcaguucaguggugcaaucucagcucacugcaagcucu

SEQ ID NO: 253157 - RNA, 64 nt, Human
uaguaucauucagugcauuguuuacauauucaaaguggugcacuuugaaggaagcacaugugca

SEQ ID NO: 253158 - RNA, 64 nt, Human
cccgucagguuccuuguggaagcuccccucauccguggugcagcaggcugagcacugcgcguuu

SEQ ID NO: 253159 - RNA, 64 nt, Human
gcuuaaauaauauguuguuauuugauacauuuuuguggugcaaguaauuaauguuauuauuuga

SEQ ID NO: 253160 - RNA, 64 nt, Human
uucuucuggagaauuggaacauguguggccccaagcucaacagaaaccaguuguucccaaucug

SEQ ID NO: 253161 - RNA, 64 nt, Human
aaagccucucaaugcguccucgaccuugaacugugcucaacagccuggcccuuucuggggccac

SEQ ID NO: 253162 - RNA, 64 nt, Human
gcauaaguuauugugaacguuuuugccaaucacugcucaacagcccugcuagauuuuguaugau

SEQ ID NO: 253163 - RNA, 64 nt, Human
gucugcuaaaauuacaaaaaauuagcugggcgugguggugcacgccuguagucucagcuacuca

SEQ ID NO: 253164 - RNA, 64 nt, Human
guagacauggcacagccaugaagagaccagugggguggugcaggguggacuuggggacccuacc

SEQ ID NO: 253165 - RNA, 64 nt, Human
guguguguguguguguguguguguguguguguguguggugcaggagugccacccccagggcccu

SEQ ID NO: 253166 - RNA, 64 nt, Human
ucucuacuaaaaauacaaaaauuaucugggcaugguggugcaugccuguaaucccagcuauucg

SEQ ID NO: 253167 - RNA, 64 nt, Human
aagguggauauuaaaaaucuguaaaucaggacagguggugcaaauggcgcugggagguguacac

SEQ ID NO: 253168 - RNA, 64 nt, Human
cagagucuugcucuguugcccaggcuagagugcaguggugcaaucucaguucacugcaaccucu

SEQ ID NO: 253169 - RNA, 64 nt, Human
aucuucacuaaaaauacaaaacuuagcugguuagguggugcaugccuguagucccagcuacucg

SEQ ID NO: 253170 - RNA, 64 nt, Human
ucuaaaaaaaauaauaaaaacuuagcugggcaugguggugcaugccugugguccuggcuacuug

SEQ ID NO: 253171 - RNA, 64 nt, Human
aauucugugugguauauuguuuaaucaguucuguguggugcauuccugaagucucuaaugugac

SEQ ID NO: 253172 - RNA, 64 nt, Human
aucguuuucuuucccuuuucucugguggccuguuguggugcaacgagcugauggcauuugaucu

SEQ ID NO: 253173 - RNA, 64 nt, Human
cuuaaggcuuuaaaagacagugaagcugggugcgguggugcacuccuguaacccugggacuuug

SEQ ID NO: 253174 - RNA, 64 nt, Human
uugcuguguguguguguggugguggugggaggggguggugcaugugugugugugugugugcauc

SEQ ID NO: 253175 - RNA, 64 nt, Human
gcagcgucuugaaagccuaauaugaccaucuguugcucaacaauacuguuuuuuuccuuuagua

SEQ ID NO: 253176 - RNA, 64 nt, Human
aagccagaccgcuuugaguugggagaauuuuguagcucaacauaucaaguccucgaugguaucu

SEQ ID NO: 253177 - RNA, 64 nt, Human
acccccagucaucuaaauuuuucagguaucaagugcucaacagacauaugauagucaaggcucu

SEQ ID NO: 253178 - RNA, 62 nt, Human; identical to SEQ ID NO: 252339

SEQ ID NO: 253179 - RNA, 62 nt, Human; identical to SEQ ID NO: 252342

SEQ ID NO: 253180 - RNA, 62 nt, Human; identical to SEQ ID NO: 252343

SEQ ID NO: 253181 - RNA, 62 nt, Human; identical to SEQ ID NO: 252344

SEQ ID NO: 253182 - RNA, 62 nt, Human; identical to SEQ ID NO: 252345

SEQ ID NO: 253183 - RNA, 62 nt, Human; identical to SEQ ID NO: 252346

SEQ ID NO: 253184 - RNA, 62 nt, Human; identical to SEQ ID NO: 252347

SEQ ID NO: 253185 - RNA, 62 nt, Human; identical to SEQ ID NO: 252348

SEQ ID NO: 253186 - RNA, 62 nt, Human; identical to SEQ ID NO: 252349

SEQ ID NO: 253187 - RNA, 62 nt, Human; identical to SEQ ID NO: 252350

SEQ ID NO: 253188 - RNA, 60 nt, Human
ucagaugucagugggagccuccaggugggaggagagcaugccuaaacccugguggccauu

SEQ ID NO: 253189 - RNA, 60 nt, Human
ccaugaacaugccaugucguuuuaaugccuggagagcagauugcguaaaacaucuguaua

SEQ ID NO: 253190 - RNA, 60 nt, Human
agcccugcugcuuugcuuggugguagggcaggagagcaaacaaacagucauggucuaaaa

SEQ ID NO: 253191 - RNA, 62 nt, Human; identical to SEQ ID NO: 252351

SEQ ID NO: 253192 - RNA, 62 nt, Human; identical to SEQ ID NO: 252352

SEQ ID NO: 253193 - RNA, 62 nt, Human; identical to SEQ ID NO: 252353

SEQ ID NO: 253194 - RNA, 62 nt, Human; identical to SEQ ID NO: 252354

SEQ ID NO: 253195 - RNA, 62 nt, Human; identical to SEQ ID NO: 252359

SEQ ID NO: 253196 - RNA, 62 nt, Human; identical to SEQ ID NO: 252360

SEQ ID NO: 253197 - RNA, 62 nt, Human; identical to SEQ ID NO: 252361

SEQ ID NO: 253198 - RNA, 62 nt, Human; identical to SEQ ID NO: 252362

SEQ ID NO: 253199 - RNA, 62 nt, Human; identical to SEQ ID NO: 252363

SEQ ID NO: 253200 - RNA, 62 nt, Human; identical to SEQ ID NO: 252364

SEQ ID NO: 253201 - RNA, 62 nt, Human; identical to SEQ ID NO: 252365

SEQ ID NO: 253202 - RNA, 62 nt, Human; identical to SEQ ID NO: 252366

SEQ ID NO: 253203 - RNA, 62 nt, Human; identical to SEQ ID NO: 252367

SEQ ID NO: 253204 - RNA, 60 nt, Human
gccugaucucuucuuuacugccagccuugaggagagcagaagccuccauuuuuaaagaca

SEQ ID NO: 253205 - RNA, 60 nt, Human
ccugcuuuacugaacuucauccuguuagauggagagcaugccuguuuaagggauuacugg

SEQ ID NO: 253206 - RNA, 60 nt, Human
cuguggcggacacucucgggguugucugcaggagagcaagccaggaggacaugggccugg

SEQ ID NO: 253207 - RNA, 60 nt, Human
gagcuggacugaggaggaggcugcacagcgggagagcagcugguccagaccagcccugca

SEQ ID NO: 253208 - RNA, 62 nt, Human; identical to SEQ ID NO: 252368

SEQ ID NO: 253209 - RNA, 62 nt, Human; identical to SEQ ID NO: 252369

SEQ ID NO: 253210 - RNA, 62 nt, Human; identical to SEQ ID NO: 252370

SEQ ID NO: 253211 - RNA, 62 nt, Human; identical to SEQ ID NO: 252371

SEQ ID NO: 253212 - RNA, 62 nt, Human; identical to SEQ ID NO: 252375

SEQ ID NO: 253213 - RNA, 62 nt, Human; identical to SEQ ID NO: 252376

SEQ ID NO: 253214 - RNA, 62 nt, Human; identical to SEQ ID NO: 252377

SEQ ID NO: 253215 - RNA, 62 nt, Human; identical to SEQ ID NO: 252378

SEQ ID NO: 253216 - RNA, 62 nt, Human; identical to SEQ ID NO: 252379

SEQ ID NO: 253217 - RNA, 62 nt, Human; identical to SEQ ID NO: 252380

SEQ ID NO: 253218 - RNA, 62 nt, Human; identical to SEQ ID NO: 252381

SEQ ID NO: 253219 - RNA, 62 nt, Human; identical to SEQ ID NO: 252382

SEQ ID NO: 253220 - RNA, 62 nt, Human; identical to SEQ ID NO: 252383

SEQ ID NO: 253221 - RNA, 60 nt, Human
gcccaucgauucccuacuaaugagaggcagggagagcaugggcaauggagacccaccaau

SEQ ID NO: 253222 - RNA, 60 nt, Human
guguccaggauggcauucccagaaugcaggggagagcaggaugccggguggaggagacag

SEQ ID NO: 253223 - RNA, 60 nt, Human
gcaaaauggcgccuugaagaaagaggccuaggagagcagcccuguaauguauccagucag

SEQ ID NO: 253224 - RNA, 60 nt, Human
uuaaaguggguuauucuggaguuuuuguuuggagagcacaccuaucuuagugguucccca

SEQ ID NO: 253225 - RNA, 62 nt, Human; identical to SEQ ID NO: 252384

SEQ ID NO: 253226 - RNA, 62 nt, Human; identical to SEQ ID NO: 252385

SEQ ID NO: 253227 - RNA, 62 nt, Human; identical to SEQ ID NO: 252386

SEQ ID NO: 253228 - RNA, 62 nt, Human; identical to SEQ ID NO: 252387

SEQ ID NO: 253229 - RNA, 62 nt, Human; identical to SEQ ID NO: 252391

SEQ ID NO: 253230 - RNA, 62 nt, Human; identical to SEQ ID NO: 252392

SEQ ID NO: 253231 - RNA, 62 nt, Human; identical to SEQ ID NO: 252393

SEQ ID NO: 253232 - RNA, 62 nt, Human; identical to SEQ ID NO: 252394

SEQ ID NO: 253233 - RNA, 62 nt, Human; identical to SEQ ID NO: 252395

SEQ ID NO: 253234 - RNA, 62 nt, Human; identical to SEQ ID NO: 252396

SEQ ID NO: 253235 - RNA, 62 nt, Human; identical to SEQ ID NO: 252397

SEQ ID NO: 253236 - RNA, 62 nt, Human; identical to SEQ ID NO: 252398

SEQ ID NO: 253237 - RNA, 62 nt, Human; identical to SEQ ID NO: 252399

SEQ ID NO: 253238 - RNA, 60 nt, Human
gggacacagugccugucucgccuccaucagggagagcagccaugccagggaugacuagcu

SEQ ID NO: 253239 - RNA, 60 nt, Human
uuuuuaucuuucuguuauuauuguuuuaaaggagagcauccuaaguuaauaggaaccaaa

SEQ ID NO: 253240 - RNA, 60 nt, Human
ucugguuuccacugauuccuucuuagccauggagagcauuugugauuaauuaauuuauau

SEQ ID NO: 253241 - RNA, 60 nt, Human
agcaagguaauuguaguuuaguuuuaauucggagagcaaugauaaucagugcacaggagu

SEQ ID NO: 253242 - RNA, 62 nt, Human; identical to SEQ ID NO: 252400

SEQ ID NO: 253243 - RNA, 62 nt, Human; identical to SEQ ID NO: 252401

SEQ ID NO: 253244 - RNA, 62 nt, Human; identical to SEQ ID NO: 252402

SEQ ID NO: 253245 - RNA, 62 nt, Human; identical to SEQ ID NO: 252403

SEQ ID NO: 253246 - RNA, 62 nt, Human; identical to SEQ ID NO: 252408

SEQ ID NO: 253247 - RNA, 62 nt, Human; identical to SEQ ID NO: 252409

SEQ ID NO: 253248 - RNA, 62 nt, Human; identical to SEQ ID NO: 252410

SEQ ID NO: 253249 - RNA, 62 nt, Human; identical to SEQ ID NO: 252411

SEQ ID NO: 253250 - RNA, 62 nt, Human; identical to SEQ ID NO: 252412

SEQ ID NO: 253251 - RNA, 62 nt, Human; identical to SEQ ID NO: 252413

SEQ ID NO: 253252 - RNA, 62 nt, Human; identical to SEQ ID NO: 252414

SEQ ID NO: 253253 - RNA, 62 nt, Human; identical to SEQ ID NO: 252415

SEQ ID NO: 253254 - RNA, 62 nt, Human; identical to SEQ ID NO: 252416

SEQ ID NO: 253255 - RNA, 60 nt, Human
uaugccgaaaauugacgucuuugaccucagggagagcaccuguccaggucugccuaaagg

SEQ ID NO: 253256 - RNA, 60 nt, Human
cuuuuuucaucuccaacaguuaaaugguaaggagagcaaaguuaauuauaaaaauuagac

SEQ ID NO: 253257 - RNA, 60 nt, Human
gacuaucauuacugaugcagaccuggcuguggagagcagcuaauguguggcccagagagc

SEQ ID NO: 253258 - RNA, 60 nt, Human
cccaccucaccgccccccaucccgguucugggagagcauuguuauuaaggaugcaugaca

SEQ ID NO: 253259 - RNA, 62 nt, Human; identical to SEQ ID NO: 252417

SEQ ID NO: 253260 - RNA, 62 nt, Human; identical to SEQ ID NO: 252418

SEQ ID NO: 253261 - RNA, 62 nt, Human; identical to SEQ ID NO: 252419

SEQ ID NO: 253262 - RNA, 62 nt, Human; identical to SEQ ID NO: 252420

SEQ ID NO: 253263 - RNA, 62 nt, Human; identical to SEQ ID NO: 252424

SEQ ID NO: 253264 - RNA, 62 nt, Human; identical to SEQ ID NO: 252425

SEQ ID NO: 253265 - RNA, 62 nt, Human; identical to SEQ ID NO: 252426

SEQ ID NO: 253266 - RNA, 62 nt, Human; identical to SEQ ID NO: 252427

SEQ ID NO: 253267 - RNA, 62 nt, Human; identical to SEQ ID NO: 252428

SEQ ID NO: 253268 - RNA, 62 nt, Human; identical to SEQ ID NO: 252429

SEQ ID NO: 253269 - RNA, 62 nt, Human; identical to SEQ ID NO: 252430

SEQ ID NO: 253270 - RNA, 62 nt, Human; identical to SEQ ID NO: 252431

SEQ ID NO: 253271 - RNA, 62 nt, Human; identical to SEQ ID NO: 252432

SEQ ID NO: 253272 - RNA, 60 nt, Human
uuuaucuauaccaugagguaacugaaguaaggagagcagugaaugucaaacuguguuucu

SEQ ID NO: 253273 - RNA, 60 nt, Human
ccccucucuccaucagaggacaccuguacuggagagcaacacaggauggucucugccaug

SEQ ID NO: 253274 - RNA, 60 nt, Human
ccuaacucuuguuccaguaugaaaguugggggagagcaccagccaccuaggaaaacugua

SEQ ID NO: 253275 - RNA, 60 nt, Human
uuucaauacugagagacagcuacaauaaaaggagagcaauugccucccuggggcuguuca

SEQ ID NO: 253276 - RNA, 62 nt, Human; identical to SEQ ID NO: 252433

SEQ ID NO: 253277 - RNA, 62 nt, Human; identical to SEQ ID NO: 252434

SEQ ID NO: 253278 - RNA, 62 nt, Human; identical to SEQ ID NO: 252435

SEQ ID NO: 253279 - RNA, 62 nt, Human; identical to SEQ ID NO: 252436

SEQ ID NO: 253280 - RNA, 62 nt, Human; identical to SEQ ID NO: 252441

SEQ ID NO: 253281 - RNA, 62 nt, Human; identical to SEQ ID NO: 252442

SEQ ID NO: 253282 - RNA, 62 nt, Human; identical to SEQ ID NO: 252443

SEQ ID NO: 253283 - RNA, 62 nt, Human; identical to SEQ ID NO: 252444

SEQ ID NO: 253284 - RNA, 62 nt, Human; identical to SEQ ID NO: 252445

SEQ ID NO: 253285 - RNA, 62 nt, Human; identical to SEQ ID NO: 252446

SEQ ID NO: 253286 - RNA, 62 nt, Human; identical to SEQ ID NO: 252447

SEQ ID NO: 253287 - RNA, 62 nt, Human; identical to SEQ ID NO: 252448

SEQ ID NO: 253288 - RNA, 62 nt, Human; identical to SEQ ID NO: 252449

SEQ ID NO: 253289 - RNA, 60 nt, Human
uaguacuggacacaguacuggugaaacugaggagagcauugcuuguaaaauccugaguuu

SEQ ID NO: 253290 - RNA, 60 nt, Human
uaaccaccagaucauuccuucuguagcucaggagagcaccccuccaccccauuugcucgc

SEQ ID NO: 253291 - RNA, 60 nt, Human
cccccgcaaggacccgcugacccgcuggauggagagcaaaggagaccccucccgagccgc

SEQ ID NO: 253292 - RNA, 60 nt, Human
cacagagaauccucgaggugcuuccuggcaggagagcagaugugauucugagcgacaugg

SEQ ID NO: 253293 - RNA, 62 nt, Human; identical to SEQ ID NO: 252434

SEQ ID NO: 253294 - RNA, 62 nt, Human; identical to SEQ ID NO: 252451

SEQ ID NO: 253295 - RNA, 62 nt, Human; identical to SEQ ID NO: 252452

SEQ ID NO: 253296 - RNA, 62 nt, Human; identical to SEQ ID NO: 252453

SEQ ID NO: 253297 - RNA, 62 nt, Human; identical to SEQ ID NO: 252457

SEQ ID NO: 253298 - RNA, 62 nt, Human; identical to SEQ ID NO: 252477

SEQ ID NO: 253299 - RNA, 62 nt, Human; identical to SEQ ID NO: 252478

SEQ ID NO: 253300 - RNA, 62 nt, Human; identical to SEQ ID NO: 252479

SEQ ID NO: 253301 - RNA, 62 nt, Human; identical to SEQ ID NO: 252480

SEQ ID NO: 253302 - RNA, 62 nt, Human; identical to SEQ ID NO: 252481

SEQ ID NO: 253303 - RNA, 62 nt, Human; identical to SEQ ID NO: 252482

SEQ ID NO: 253304 - RNA, 62 nt, Human; identical to SEQ ID NO: 252483

SEQ ID NO: 253305 - RNA, 62 nt, Human; identical to SEQ ID NO: 252484

SEQ ID NO: 253306 - RNA, 60 nt, Human
uucuaauaaaauauacaccuuauacccaagggagagcaaagacaaaauacaccaguaaca

SEQ ID NO: 253307 - RNA, 60 nt, Human
ugccaagagcgacucauaguaaccaggaugggagagcagcugccuuauucugaaucccaa

SEQ ID NO: 253308 - RNA, 60 nt, Human
ugggaaugcccagagccccagugugcuuguggagagcauggacagacuucgugguguuca

SEQ ID NO: 253309 - RNA, 60 nt, Human
uacuuucucugugggugccaguuaaauauuggagagcaaggaauguggacuuguauggcu

SEQ ID NO: 253310 - RNA, 62 nt, Human; identical to SEQ ID NO: 252485

SEQ ID NO: 253311 - RNA, 62 nt, Human; identical to SEQ ID NO: 252486

SEQ ID NO: 253312 - RNA, 62 nt, Human; identical to SEQ ID NO: 252487

SEQ ID NO: 253313 - RNA, 62 nt, Human; identical to SEQ ID NO: 252488

SEQ ID NO: 253314 - RNA, 62 nt, Human; identical to SEQ ID NO: 252489

SEQ ID NO: 253315 - RNA, 62 nt, Human; identical to SEQ ID NO: 252493

SEQ ID NO: 253316 - RNA, 62 nt, Human; identical to SEQ ID NO: 252494

SEQ ID NO: 253317 - RNA, 62 nt, Human; identical to SEQ ID NO: 252495

SEQ ID NO: 253318 - RNA, 62 nt, Human; identical to SEQ ID NO: 252496

SEQ ID NO: 253319 - RNA, 62 nt, Human; identical to SEQ ID NO: 252497

SEQ ID NO: 253320 - RNA, 62 nt, Human; identical to SEQ ID NO: 252498

SEQ ID NO: 253321 - RNA, 62 nt, Human; identical to SEQ ID NO: 252499

SEQ ID NO: 253322 - RNA, 62 nt, Human; identical to SEQ ID NO: 252500

SEQ ID NO: 253323 - RNA, 60 nt, Human
gacagaggaaggccuccugagggaggggcaggagagcagugaggagcugcugugugaccu

SEQ ID NO: 253324 - RNA, 60 nt, Human
cgugguggcgguggcugccccggccuccucggagagcagcagcaccaaccacagcaucgg

SEQ ID NO: 253325 - RNA, 60 nt, Human
ugugaguagaaggaagucaacaauauguggggagagcacucgguugucuuuacuuuuaaa

SEQ ID NO: 253326 - RNA, 60 nt, Human
ugggcuguaggaaagcaaauguagguaaggggagagcaaggaugcacagaaaacacacug

SEQ ID NO: 253327 - RNA, 62 nt, Human; identical to SEQ ID NO: 252501

SEQ ID NO: 253328 - RNA, 62 nt, Human; identical to SEQ ID NO: 252502

SEQ ID NO: 253329 - RNA, 62 nt, Human; identical to SEQ ID NO: 252503

SEQ ID NO: 253330 - RNA, 62 nt, Human; identical to SEQ ID NO: 252504

SEQ ID NO: 253331 - RNA, 62 nt, Human; identical to SEQ ID NO: 252505

SEQ ID NO: 253332 - RNA, 62 nt, Human; identical to SEQ ID NO: 252510

SEQ ID NO: 253333 - RNA, 62 nt, Human; identical to SEQ ID NO: 252511

SEQ ID NO: 253334 - RNA, 62 nt, Human; identical to SEQ ID NO: 252512

SEQ ID NO: 253335 - RNA, 62 nt, Human; identical to SEQ ID NO: 252513

SEQ ID NO: 253336 - RNA, 62 nt, Human; identical to SEQ ID NO: 252514

SEQ ID NO: 253337 - RNA, 62 nt, Human; identical to SEQ ID NO: 252515

SEQ ID NO: 253338 - RNA, 62 nt, Human; identical to SEQ ID NO: 252516

SEQ ID NO: 253339 - RNA, 62 nt, Human; identical to SEQ ID NO: 252517

SEQ ID NO: 253340 - RNA, 63 nt, Human
ggcccagcugaccgguucugaaguaugggccuccgggguuagcagaugccagcagugccugcc

SEQ ID NO: 253341 - RNA, 60 nt, Human
cugauaagauugggucaucgcugccaagguggagagcagugagcaaggggcuuggggcaa

SEQ ID NO: 253342 - RNA, 60 nt, Human
auaggaauuaacugaccccuuuuggaugggggagagcaucaggcuggggucagguaagug

SEQ ID NO: 253343 - RNA, 60 nt, Human
cuacccccucuucaaagcagagugggacuuggagagcaaaggcccaugcccccuucgcuc

SEQ ID NO: 253344 - RNA, 62 nt, Human; identical to SEQ ID NO: 252518

SEQ ID NO: 253345 - RNA, 62 nt, Human; identical to SEQ ID NO: 252519

SEQ ID NO: 253346 - RNA, 62 nt, Human; identical to SEQ ID NO: 252520

SEQ ID NO: 253347 - RNA, 62 nt, Human; identical to SEQ ID NO: 252521

SEQ ID NO: 253348 - RNA, 62 nt, Human; identical to SEQ ID NO: 252522

SEQ ID NO: 253349 - RNA, 62 nt, Human; identical to SEQ ID NO: 252526

SEQ ID NO: 253350 - RNA, 62 nt, Human; identical to SEQ ID NO: 252527

SEQ ID NO: 253351 - RNA, 62 nt, Human; identical to SEQ ID NO: 252528

SEQ ID NO: 253352 - RNA, 62 nt, Human; identical to SEQ ID NO: 252529

SEQ ID NO: 253353 - RNA, 62 nt, Human; identical to SEQ ID NO: 252530

SEQ ID NO: 253354 - RNA, 62 nt, Human; identical to SEQ ID NO: 252531

SEQ ID NO: 253355 - RNA, 62 nt, Human; identical to SEQ ID NO: 252532

SEQ ID NO: 253356 - RNA, 62 nt, Human; identical to SEQ ID NO: 252533

SEQ ID NO: 253357 - RNA, 60 nt, Human
gguucaaacaguguccuccuagaaagagugggagagcagcucacuucucuguguucugcc

SEQ ID NO: 253358 - RNA, 60 nt, Human
ggccacccacugggcucggcaggagauaggggagagcaauuacuuuguucacuguaugca

SEQ ID NO: 253359 - RNA, 60 nt, Human
gggauggggcgggggcggucuagggcaauaggagagcagagaaugggggaacuugagggu

SEQ ID NO: 253360 - RNA, 60 nt, Human
gacucuuccacccuuuuuuuuucugggaaaggagagcaagaggucccgaguccccuccua

SEQ ID NO: 253361 - RNA, 62 nt, Human; identical to SEQ ID NO: 252534

SEQ ID NO: 253362 - RNA, 62 nt, Human; identical to SEQ ID NO: 252535

SEQ ID NO: 253363 - RNA, 62 nt, Human; identical to SEQ ID NO: 252536

SEQ ID NO: 253364 - RNA, 62 nt, Human; identical to SEQ ID NO: 252537

SEQ ID NO: 253365 - RNA, 62 nt, Human; identical to SEQ ID NO: 252538

SEQ ID NO: 253366 - RNA, 62 nt, Human; identical to SEQ ID NO: 252542

SEQ ID NO: 253367 - RNA, 62 nt, Human; identical to SEQ ID NO: 252543

SEQ ID NO: 253368 - RNA, 62 nt, Human; identical to SEQ ID NO: 252544

SEQ ID NO: 253369 - RNA, 62 nt, Human; identical to SEQ ID NO: 252545

SEQ ID NO: 253370 - RNA, 62 nt, Human; identical to SEQ ID NO: 252546

SEQ ID NO: 253371 - RNA, 62 nt, Human; identical to SEQ ID NO: 252547

SEQ ID NO: 253372 - RNA, 62 nt, Human; identical to SEQ ID NO: 252548

SEQ ID NO: 253373 - RNA, 62 nt, Human; identical to SEQ ID NO: 252549

SEQ ID NO: 253374 - RNA, 64 nt, Human
ccacacacuugcacaccccagcucugagguggcuucagcgaaagucugcuaaccccuuacauuc

SEQ ID NO: 253375 - RNA, 60 nt, Human
cuccauaucacagacuuuaaucuacacugcggagagcaaaccagcuugggcuucuuuuug

SEQ ID NO: 253376 - RNA, 60 nt, Human
agagccugggcucagccccagggagggcagggagagcaaggggcaagguccccuuaccuu

SEQ ID NO: 253377 - RNA, 60 nt, Human
ucauaggaggaggagucugguacagcugcaggagagcagggccaucugaagcgguagcau

SEQ ID NO: 253378 - RNA, 54 nt, Human; identical to SEQ ID NO: 252550

SEQ ID NO: 253379 - RNA, 62 nt, Human; identical to SEQ ID NO: 252551

SEQ ID NO: 253380 - RNA, 62 nt, Human; identical to SEQ ID NO: 252552

SEQ ID NO: 253381 - RNA, 62 nt, Human; identical to SEQ ID NO: 252553

SEQ ID NO: 253382 - RNA, 62 nt, Human; identical to SEQ ID NO: 252554

SEQ ID NO: 253383 - RNA, 62 nt, Human; identical to SEQ ID NO: 252558

SEQ ID NO: 253384 - RNA, 62 nt, Human; identical to SEQ ID NO: 252559

SEQ ID NO: 253385 - RNA, 62 nt, Human; identical to SEQ ID NO: 252560

SEQ ID NO: 253386 - RNA, 62 nt, Human; identical to SEQ ID NO: 252561

SEQ ID NO: 253387 - RNA, 62 nt, Human; identical to SEQ ID NO: 252562

SEQ ID NO: 253388 - RNA, 62 nt, Human; identical to SEQ ID NO: 252563

SEQ ID NO: 253389 - RNA, 62 nt, Human; identical to SEQ ID NO: 252564

SEQ ID NO: 253390 - RNA, 62 nt, Human; identical to SEQ ID NO: 252565

SEQ ID NO: 253391 - RNA, 60 nt, Human
uaugaagggagauggggguuagguggaggaggagagcagcgugguuagcuaagguuauug

SEQ ID NO: 253392 - RNA, 60 nt, Human
cggugggggaaucccuugagcccaggaguuggagagcaacaucacaacaccccauuucua

SEQ ID NO: 253393 - RNA, 60 nt, Human
cgcgcuuccagcccugagcuuccgaugcggggagagcagagccucgggaggggcacacag

SEQ ID NO: 253394 - RNA, 60 nt, Human
guuuuaaacuucauauaacuuucagaaauuggagagcaaaaauuuugcuugucacugcac

SEQ ID NO: 253395 - RNA, 62 nt, Human; identical to SEQ ID NO: 252566

SEQ ID NO: 253396 - RNA, 62 nt, Human; identical to SEQ ID NO: 252567

SEQ ID NO: 253397 - RNA, 62 nt, Human; identical to SEQ ID NO: 252568

SEQ ID NO: 253398 - RNA, 62 nt, Human; identical to SEQ ID NO: 252569

SEQ ID NO: 253399 - RNA, 62 nt, Human; identical to SEQ ID NO: 252570

SEQ ID NO: 253400 - RNA, 62 nt, Human; identical to SEQ ID NO: 252574

SEQ ID NO: 253401 - RNA, 62 nt, Human; identical to SEQ ID NO: 252575

SEQ ID NO: 253402 - RNA, 62 nt, Human; identical to SEQ ID NO: 252576

SEQ ID NO: 253403 - RNA, 62 nt, Human; identical to SEQ ID NO: 252577

SEQ ID NO: 253404 - RNA, 62 nt, Human; identical to SEQ ID NO: 252578

SEQ ID NO: 253405 - RNA, 62 nt, Human; identical to SEQ ID NO: 252579

SEQ ID NO: 253406 - RNA, 62 nt, Human; identical to SEQ ID NO: 252580

SEQ ID NO: 253407 - RNA, 62 nt, Human; identical to SEQ ID NO: 252581

SEQ ID NO: 253408 - RNA, 60 nt, Human
uccugggaguggcuaccgcagguaguuucuggagagcacguuuucuucauugauaagugg

SEQ ID NO: 253409 - RNA, 60 nt, Human
ccccugcauccccauuuuuuacugagcucaggagagcaagaugaagguaacaaucaucua

SEQ ID NO: 253410 - RNA, 60 nt, Human
gcugcuuccugccgccucacucagccagguggagagcaccaaucugaaccagcaaugccu

SEQ ID NO: 253411 - RNA, 60 nt, Human
gagugugugauuuuuugcauuccugacaaaggagagcacacccagguuuggagguccuag

SEQ ID NO: 253412 - RNA, 62 nt, Human; identical to SEQ ID NO: 252582

SEQ ID NO: 253413 - RNA, 62 nt, Human; identical to SEQ ID NO: 252583

SEQ ID NO: 253414 - RNA, 62 nt, Human; identical to SEQ ID NO: 252584

SEQ ID NO: 253415 - RNA, 62 nt, Human; identical to SEQ ID NO: 252585

SEQ ID NO: 253416 - RNA, 62 nt, Human; identical to SEQ ID NO: 252586

SEQ ID NO: 253417 - RNA, 62 nt, Human; identical to SEQ ID NO: 252590

SEQ ID NO: 253418 - RNA, 62 nt, Human; identical to SEQ ID NO: 252591

SEQ ID NO: 253419 - RNA, 62 nt, Human; identical to SEQ ID NO: 252592

SEQ ID NO: 253420 - RNA, 62 nt, Human; identical to SEQ ID NO: 252593

SEQ ID NO: 253421 - RNA, 62 nt, Human; identical to SEQ ID NO: 252594

SEQ ID NO: 253422 - RNA, 62 nt, Human; identical to SEQ ID NO: 252595

SEQ ID NO: 253423 - RNA, 62 nt, Human; identical to SEQ ID NO: 252596

SEQ ID NO: 253424 - RNA, 62 nt, Human; identical to SEQ ID NO: 252597

SEQ ID NO: 253425 - RNA, 60 nt, Human
gcaccaggguuuggaggcugcgaccgccccggagagcagcuucacacuggcgccacagag

SEQ ID NO: 253426 - RNA, 60 nt, Human
augagcccuguuuaauaacgaaggggugggggagagcaguccgucuacaaccuggaauca

SEQ ID NO: 253427 - RNA, 60 nt, Human
gaaauugccacccucuuaauuucucacuggggagagcagggguggcagauccuggcuaga

SEQ ID NO: 253428 - RNA, 60 nt, Human
caucucacuggagcuguuccaggccccacuggagagcagaggaccugaucccccacuaga

SEQ ID NO: 253429 - RNA, 62 nt, Human; identical to SEQ ID NO: 252598

SEQ ID NO: 253430 - RNA, 62 nt, Human; identical to SEQ ID NO: 252599

SEQ ID NO: 253431 - RNA, 62 nt, Human; identical to SEQ ID NO: 252600

SEQ ID NO: 253432 - RNA, 62 nt, Human; identical to SEQ ID NO: 252601

SEQ ID NO: 253433 - RNA, 62 nt, Human; identical to SEQ ID NO: 252602

SEQ ID NO: 253434 - RNA, 62 nt, Human; identical to SEQ ID NO: 252606

SEQ ID NO: 253435 - RNA, 62 nt, Human; identical to SEQ ID NO: 252607

SEQ ID NO: 253436 - RNA, 62 nt, Human; identical to SEQ ID NO: 252608

SEQ ID NO: 253437 - RNA, 62 nt, Human; identical to SEQ ID NO: 252609

SEQ ID NO: 253438 - RNA, 62 nt, Human; identical to SEQ ID NO: 252610

SEQ ID NO: 253439 - RNA, 62 nt, Human; identical to SEQ ID NO: 252611

SEQ ID NO: 253440 - RNA, 62 nt, Human; identical to SEQ ID NO: 252612

SEQ ID NO: 253441 - RNA, 62 nt, Human; identical to SEQ ID NO: 252613

SEQ ID NO: 253442 - RNA, 64 nt, Human; identical to SEQ ID NO: 206235

SEQ ID NO: 253443 - RNA, 64 nt, Human; identical to SEQ ID NO: 206236

SEQ ID NO: 253444 - RNA, 64 nt, Human; identical to SEQ ID NO: 206237

SEQ ID NO: 253445 - RNA, 62 nt, Human; identical to SEQ ID NO: 252614

SEQ ID NO: 253446 - RNA, 62 nt, Human; identical to SEQ ID NO: 252615

SEQ ID NO: 253447 - RNA, 62 nt, Human; identical to SEQ ID NO: 252616

SEQ ID NO: 253448 - RNA, 62 nt, Human; identical to SEQ ID NO: 252617

SEQ ID NO: 253449 - RNA, 62 nt, Human; identical to SEQ ID NO: 252618

SEQ ID NO: 253450 - RNA, 62 nt, Human; identical to SEQ ID NO: 252622

SEQ ID NO: 253451 - RNA, 62 nt, Human; identical to SEQ ID NO: 252623

SEQ ID NO: 253452 - RNA, 62 nt, Human; identical to SEQ ID NO: 252624

SEQ ID NO: 253453 - RNA, 62 nt, Human; identical to SEQ ID NO: 252625

SEQ ID NO: 253454 - RNA, 62 nt, Human; identical to SEQ ID NO: 252626

SEQ ID NO: 253455 - RNA, 62 nt, Human; identical to SEQ ID NO: 252627

SEQ ID NO: 253456 - RNA, 62 nt, Human; identical to SEQ ID NO: 252628

SEQ ID NO: 253457 - RNA, 62 nt, Human; identical to SEQ ID NO: 252629

SEQ ID NO: 253458 - RNA, 64 nt, Human
agcauacccagcucggaccuccuaggacagagacucagcgaacccuugcugggaaccgcugagc

SEQ ID NO: 253459 - RNA, 64 nt, Human
ccacagaauauagcacguugugcaaacugucgauucagcgaaacuuaaaaaagacaagaaacua

SEQ ID NO: 253460 - RNA, 64 nt, Human
guaguggcuugaugcagggaacccugggggacuuucagcgaagagcugugcucuuuucugacua

SEQ ID NO: 253461 - RNA, 62 nt, Human; identical to SEQ ID NO: 252630

SEQ ID NO: 253462 - RNA, 62 nt, Human; identical to SEQ ID NO: 252631

SEQ ID NO: 253463 - RNA, 62 nt, Human; identical to SEQ ID NO: 252632

SEQ ID NO: 253464 - RNA, 62 nt, Human; identical to SEQ ID NO: 252633

SEQ ID NO: 253465 - RNA, 62 nt, Human; identical to SEQ ID NO: 252634

SEQ ID NO: 253466 - RNA, 62 nt, Human; identical to SEQ ID NO: 252638

SEQ ID NO: 253467 - RNA, 62 nt, Human; identical to SEQ ID NO: 252639

SEQ ID NO: 253468 - RNA, 62 nt, Human; identical to SEQ ID NO: 252640

SEQ ID NO: 253469 - RNA, 62 nt, Human; identical to SEQ ID NO: 252641

SEQ ID NO: 253470 - RNA, 62 nt, Human; identical to SEQ ID NO: 252642

SEQ ID NO: 253471 - RNA, 62 nt, Human; identical to SEQ ID NO: 252643

SEQ ID NO: 253472 - RNA, 62 nt, Human; identical to SEQ ID NO: 252644

SEQ ID NO: 253473 - RNA, 62 nt, Human; identical to SEQ ID NO: 252645

SEQ ID NO: 253474 - RNA, 64 nt, Human
acugaacgcaucugggcuucgugguuuccuguuuucagcgaaauuuacucugagcucccaguuc

SEQ ID NO: 253475 - RNA, 64 nt, Human
ggcaaguuuuuuucuucaccuucaauaugagaauucagcgaacuugaaagaaaaaucaucugug

SEQ ID NO: 253476 - RNA, 64 nt, Human
ugguuccugcuguuuauucucuggucaugccuuuucagcgaaagccugucuccucacccacccc

SEQ ID NO: 253477 - RNA, 62 nt, Human; identical to SEQ ID NO: 252646

SEQ ID NO: 253478 - RNA, 62 nt, Human; identical to SEQ ID NO: 252647

SEQ ID NO: 253479 - RNA, 62 nt, Human; identical to SEQ ID NO: 252648

SEQ ID NO: 253480 - RNA, 62 nt, Human; identical to SEQ ID NO: 252649

SEQ ID NO: 253481 - RNA, 62 nt, Human; identical to SEQ ID NO: 252650

SEQ ID NO: 253482 - RNA, 62 nt, Human; identical to SEQ ID NO: 252654

SEQ ID NO: 253483 - RNA, 62 nt, Human; identical to SEQ ID NO: 252655

SEQ ID NO: 253484 - RNA, 62 nt, Human; identical to SEQ ID NO: 252656

SEQ ID NO: 253485 - RNA, 62 nt, Human; identical to SEQ ID NO: 252657

SEQ ID NO: 253486 - RNA, 62 nt, Human; identical to SEQ ID NO: 252658

SEQ ID NO: 253487 - RNA, 62 nt, Human; identical to SEQ ID NO: 252659

SEQ ID NO: 253488 - RNA, 62 nt, Human; identical to SEQ ID NO: 252660

SEQ ID NO: 253489 - RNA, 62 nt, Human; identical to SEQ ID NO: 252661

SEQ ID NO: 253490 - RNA, 64 nt, Human
uuuauaauuuuaugaaaauuaaguacagaggcugcgaucuuagaaauaaugaaggugccauuug

SEQ ID NO: 253491 - RNA, 60 nt, Human
cccauccaagcauccuucgauuagggaaguggagagcacaucccuguaaggcccauaaga

SEQ ID NO: 253492 - RNA, 60 nt, Human
aacuaagaccccgaaaacuccagaccuucaggagagcagucagcagagccccucugugaa

SEQ ID NO: 253493 - RNA, 60 nt, Human
gagacggagucucgcacuguugcccaggcuggagagcaguggcgcgaucuuggcucacug

SEQ ID NO: 253494 - RNA, 62 nt, Human; identical to SEQ ID NO: 252662

SEQ ID NO: 253495 - RNA, 62 nt, Human; identical to SEQ ID NO: 252663

SEQ ID NO: 253496 - RNA, 62 nt, Human; identical to SEQ ID NO: 252664

SEQ ID NO: 253497 - RNA, 62 nt, Human; identical to SEQ ID NO: 252665

SEQ ID NO: 253498 - RNA, 62 nt, Human; identical to SEQ ID NO: 252666

SEQ ID NO: 253499 - RNA, 62 nt, Human; identical to SEQ ID NO: 252670

SEQ ID NO: 253500 - RNA, 62 nt, Human; identical to SEQ ID NO: 252671

SEQ ID NO: 253501 - RNA, 62 nt, Human; identical to SEQ ID NO: 252672

SEQ ID NO: 253502 - RNA, 62 nt, Human; identical to SEQ ID NO: 252673

SEQ ID NO: 253503 - RNA, 62 nt, Human; identical to SEQ ID NO: 252674

SEQ ID NO: 253504 - RNA, 62 nt, Human; identical to SEQ ID NO: 252675

SEQ ID NO: 253505 - RNA, 62 nt, Human; identical to SEQ ID NO: 252676

SEQ ID NO: 253506 - RNA, 62 nt, Human; identical to SEQ ID NO: 252677

SEQ ID NO: 253507 - RNA, 64 nt, Human; identical to SEQ ID NO: 206233

SEQ ID NO: 253508 - RNA, 64 nt, Human
ggggguggcugcucuuccuggcaggccugggccaucagcgaacugggccccgugaggagggcgg

SEQ ID NO: 253509 - RNA, 64 nt, Human
cagcugugccccucccccaggggcgugaggcugaucagcgaagacgggaggaaagauuucgauu

SEQ ID NO: 253510 - RNA, 62 nt, Human; identical to SEQ ID NO: 252678

SEQ ID NO: 253511 - RNA, 62 nt, Human; identical to SEQ ID NO: 252679

SEQ ID NO: 253512 - RNA, 62 nt, Human; identical to SEQ ID NO: 252680

SEQ ID NO: 253513 - RNA, 62 nt, Human; identical to SEQ ID NO: 252681

SEQ ID NO: 253514 - RNA, 62 nt, Human; identical to SEQ ID NO: 252682

SEQ ID NO: 253515 - RNA, 62 nt, Human; identical to SEQ ID NO: 252686

SEQ ID NO: 253516 - RNA, 62 nt, Human; identical to SEQ ID NO: 252687

SEQ ID NO: 253517 - RNA, 62 nt, Human; identical to SEQ ID NO: 252688

SEQ ID NO: 253518 - RNA, 62 nt, Human; identical to SEQ ID NO: 252689

SEQ ID NO: 253519 - RNA, 62 nt, Human; identical to SEQ ID NO: 252690

SEQ ID NO: 253520 - RNA, 62 nt, Human; identical to SEQ ID NO: 252691

SEQ ID NO: 253521 - RNA, 62 nt, Human; identical to SEQ ID NO: 252692

SEQ ID NO: 253522 - RNA, 62 nt, Human; identical to SEQ ID NO: 252693

SEQ ID NO: 253523 - RNA, 64 nt, Human; identical to SEQ ID NO: 206230

SEQ ID NO: 253524 - RNA, 64 nt, Human
agacacuuacuuauuauuaaaaccccaaaugcaaucagcgaaacauauuuuuacuauucuugga

SEQ ID NO: 253525 - RNA, 64 nt, Human
gguaagucuguuguucugauuaaucugcauucauucagcgaaugcucaagacaagccaggcaug

SEQ ID NO: 253526 - RNA, 62 nt, Human; identical to SEQ ID NO: 252694

SEQ ID NO: 253527 - RNA, 62 nt, Human; identical to SEQ ID NO: 252695

SEQ ID NO: 253528 - RNA, 62 nt, Human; identical to SEQ ID NO: 252696

SEQ ID NO: 253529 - RNA, 62 nt, Human; identical to SEQ ID NO: 252697

SEQ ID NO: 253530 - RNA, 62 nt, Human; identical to SEQ ID NO: 252698

SEQ ID NO: 253531 - RNA, 62 nt, Human; identical to SEQ ID NO: 252703

SEQ ID NO: 253532 - RNA, 62 nt, Human; identical to SEQ ID NO: 252704

SEQ ID NO: 253533 - RNA, 62 nt, Human; identical to SEQ ID NO: 252705

SEQ ID NO: 253534 - RNA, 62 nt, Human; identical to SEQ ID NO: 252706

SEQ ID NO: 253535 - RNA, 62 nt, Human; identical to SEQ ID NO: 252707

SEQ ID NO: 253536 - RNA, 62 nt, Human; identical to SEQ ID NO: 252708

SEQ ID NO: 253537 - RNA, 62 nt, Human; identical to SEQ ID NO: 252709

SEQ ID NO: 253538 - RNA, 60 nt, Human; identical to SEQ ID NO: 252710

SEQ ID NO: 253539 - RNA, 64 nt, Human; identical to SEQ ID NO: 206396

SEQ ID NO: 253540 - RNA, 64 nt, Human
gcugggaaggggugaaguguguggcugggcggauucagcgaagucucaugggaagcaggaccua

SEQ ID NO: 253541 - RNA, 64 nt, Human
ugccuuuuuguccuguccucagcucuccguguggucagcgaaaccauuguuuucuguuaggacu

SEQ ID NO: 253542 - RNA, 62 nt, Human; identical to SEQ ID NO: 252711

SEQ ID NO: 253543 - RNA, 62 nt, Human; identical to SEQ ID NO: 252712

SEQ ID NO: 253544 - RNA, 62 nt, Human; identical to SEQ ID NO: 252713

SEQ ID NO: 253545 - RNA, 62 nt, Human; identical to SEQ ID NO: 252714

SEQ ID NO: 253546 - RNA, 62 nt, Human; identical to SEQ ID NO: 252715

SEQ ID NO: 253547 - RNA, 62 nt, Human; identical to SEQ ID NO: 252719

SEQ ID NO: 253548 - RNA, 62 nt, Human; identical to SEQ ID NO: 252720

SEQ ID NO: 253549 - RNA, 62 nt, Human; identical to SEQ ID NO: 252721

SEQ ID NO: 253550 - RNA, 62 nt, Human; identical to SEQ ID NO: 252722

SEQ ID NO: 253551 - RNA, 62 nt, Human; identical to SEQ ID NO: 252723

SEQ ID NO: 253552 - RNA, 62 nt, Human; identical to SEQ ID NO: 252724

SEQ ID NO: 253553 - RNA, 62 nt, Human; identical to SEQ ID NO: 252725

SEQ ID NO: 253554 - RNA, 62 nt, Human; identical to SEQ ID NO: 252726

SEQ ID NO: 253555 - RNA, 64 nt, Human; identical to SEQ ID NO: 206413

SEQ ID NO: 253556 - RNA, 64 nt, Human
uuguaggugacacaugcucugcccucugaggcagucagcgaaggcaaauggucugacuucuuua

SEQ ID NO: 253557 - RNA, 60 nt, Human
aaggacaaaacuugcagaauugggugugugggagagcaaaaaaauacuguagaucuucaa

SEQ ID NO: 253558 - RNA, 62 nt, Human; identical to SEQ ID NO: 252727

SEQ ID NO: 253559 - RNA, 62 nt, Human; identical to SEQ ID NO: 252728

SEQ ID NO: 253560 - RNA, 62 nt, Human; identical to SEQ ID NO: 252729

SEQ ID NO: 253561 - RNA, 62 nt, Human; identical to SEQ ID NO: 252730

SEQ ID NO: 253562 - RNA, 62 nt, Human; identical to SEQ ID NO: 252731

SEQ ID NO: 253563 - RNA, 62 nt, Human; identical to SEQ ID NO: 252735

SEQ ID NO: 253564 - RNA, 62 nt, Human; identical to SEQ ID NO: 252736

SEQ ID NO: 253565 - RNA, 62 nt, Human; identical to SEQ ID NO: 252737

SEQ ID NO: 253566 - RNA, 62 nt, Human; identical to SEQ ID NO: 252738

SEQ ID NO: 253567 - RNA, 62 nt, Human; identical to SEQ ID NO: 252739

SEQ ID NO: 253568 - RNA, 62 nt, Human; identical to SEQ ID NO: 252740

SEQ ID NO: 253569 - RNA, 62 nt, Human; identical to SEQ ID NO: 252741

SEQ ID NO: 253570 - RNA, 62 nt, Human; identical to SEQ ID NO: 252742

SEQ ID NO: 253571 - RNA, 64 nt, Human
gaaggcuggcacaaggagaaaaaaaaagcaagcaucagcgaauaguauagugucucaggguccg

SEQ ID NO: 253572 - RNA, 64 nt, Human
uugugcuuuuauaggcaccguugacgaacugcagcgaucuuacuggccaagccagagcgccucc

SEQ ID NO: 253573 - RNA, 60 nt, Human
ugucuguacacguucuuaagcagcgugucaggagagcacccuguugucuucugguaaaug

SEQ ID NO: 253574 - RNA, 62 nt, Human; identical to SEQ ID NO: 252743

SEQ ID NO: 253575 - RNA, 62 nt, Human; identical to SEQ ID NO: 252744

SEQ ID NO: 253576 - RNA, 62 nt, Human; identical to SEQ ID NO: 252745

SEQ ID NO: 253577 - RNA, 62 nt, Human; identical to SEQ ID NO: 252746

SEQ ID NO: 253578 - RNA, 62 nt, Human; identical to SEQ ID NO: 252747

SEQ ID NO: 253579 - RNA, 62 nt, Human; identical to SEQ ID NO: 252751

SEQ ID NO: 253580 - RNA, 62 nt, Human; identical to SEQ ID NO: 252752

SEQ ID NO: 253581 - RNA, 62 nt, Human; identical to SEQ ID NO: 252753

SEQ ID NO: 253582 - RNA, 62 nt, Human; identical to SEQ ID NO: 252754

SEQ ID NO: 253583 - RNA, 62 nt, Human; identical to SEQ ID NO: 252755

SEQ ID NO: 253584 - RNA, 62 nt, Human; identical to SEQ ID NO: 252756

SEQ ID NO: 253585 - RNA, 62 nt, Human; identical to SEQ ID NO: 252757

SEQ ID NO: 253586 - RNA, 62 nt, Human; identical to SEQ ID NO: 252758

SEQ ID NO: 253587 - RNA, 60 nt, Human
cuugggauuguaaugggaaagagggugcugggagagcaaucaaaggcaaaaauaauacau

SEQ ID NO: 253588 - RNA, 60 nt, Human
gggagggagaguuuugcggggguuggcaguggagagcaggcuggagaggagauggcuaau

SEQ ID NO: 253589 - RNA, 60 nt, Human
aguuaugcuauuuguaaacaggauuauauaggagagcaaauaaacauaaguaugcauuuc

SEQ ID NO: 253590 - RNA, 60 nt, Human
ccucggaccucaccgcaggggcgcugggcuggagagcagguucgggcagccgucgggaau

SEQ ID NO: 253591 - RNA, 62 nt, Human; identical to SEQ ID NO: 252759

SEQ ID NO: 253592 - RNA, 62 nt, Human; identical to SEQ ID NO: 252760

SEQ ID NO: 253593 - RNA, 62 nt, Human; identical to SEQ ID NO: 252761

SEQ ID NO: 253594 - RNA, 62 nt, Human; identical to SEQ ID NO: 252762

SEQ ID NO: 253595 - RNA, 62 nt, Human; identical to SEQ ID NO: 252763

SEQ ID NO: 253596 - RNA, 62 nt, Human; identical to SEQ ID NO: 252767

SEQ ID NO: 253597 - RNA, 62 nt, Human; identical to SEQ ID NO: 252768

SEQ ID NO: 253598 - RNA, 62 nt, Human; identical to SEQ ID NO: 252769

SEQ ID NO: 253599 - RNA, 64 nt, Human; identical to SEQ ID NO: 252770

SEQ ID NO: 253600 - RNA, 64 nt, Human; identical to SEQ ID NO: 206409

SEQ ID NO: 253601 - RNA, 64 nt, Human
gcuggcuucuguagccaccugucccuucuauuuuucagcgaaggucaguguauuuaguguaauu

SEQ ID NO: 253602 - RNA, 60 nt, Human
cauggaugucuccccagcagcuugaacccuggagagcaagaauaaucugauuuuccuggg

SEQ ID NO: 253603 - RNA, 64 nt, Human; identical to SEQ ID NO: 252771

SEQ ID NO: 253604 - RNA, 64 nt, Human; identical to SEQ ID NO: 252772

SEQ ID NO: 253605 - RNA, 64 nt, Human; identical to SEQ ID NO: 252773

SEQ ID NO: 253606 - RNA, 64 nt, Human; identical to SEQ ID NO: 252774

SEQ ID NO: 253607 - RNA, 64 nt, Human; identical to SEQ ID NO: 252775

SEQ ID NO: 253608 - RNA, 64 nt, Human; identical to SEQ ID NO: 252779

SEQ ID NO: 253609 - RNA, 64 nt, Human; identical to SEQ ID NO: 252780

SEQ ID NO: 253610 - RNA, 64 nt, Human; identical to SEQ ID NO: 252781

SEQ ID NO: 253611 - RNA, 64 nt, Human; identical to SEQ ID NO: 252782

SEQ ID NO: 253612 - RNA, 64 nt, Human; identical to SEQ ID NO: 252783

SEQ ID NO: 253613 - RNA, 64 nt, Human; identical to SEQ ID NO: 252784

SEQ ID NO: 253614 - RNA, 64 nt, Human; identical to SEQ ID NO: 252785

SEQ ID NO: 253615 - RNA, 64 nt, Human; identical to SEQ ID NO: 252786

SEQ ID NO: 253616 - RNA, 60 nt, Human
ucacucagcccugggcguagccggacaggaggagagcagugaugcggauggguacccggg

SEQ ID NO: 253617 - RNA, 60 nt, Human
gguuggagaaaggcaucccaaagcuucgauggagagcagggaagggggacccaaggcagg

SEQ ID NO: 253618 - RNA, 60 nt, Human
ugcugcugggcacaucugugcucuuggugaggagagcaagaggaaccagaagaagucucu

SEQ ID NO: 253619 - RNA, 64 nt, Human; identical to SEQ ID NO: 252787

SEQ ID NO: 253620 - RNA, 64 nt, Human; identical to SEQ ID NO: 252788

SEQ ID NO: 253621 - RNA, 64 nt, Human; identical to SEQ ID NO: 252789

SEQ ID NO: 253622 - RNA, 64 nt, Human; identical to SEQ ID NO: 252790

SEQ ID NO: 253623 - RNA, 64 nt, Human; identical to SEQ ID NO: 252791

SEQ ID NO: 253624 - RNA, 64 nt, Human; identical to SEQ ID NO: 252795

SEQ ID NO: 253625 - RNA, 64 nt, Human; identical to SEQ ID NO: 252796

SEQ ID NO: 253626 - RNA, 64 nt, Human; identical to SEQ ID NO: 252797

SEQ ID NO: 253627 - RNA, 64 nt, Human; identical to SEQ ID NO: 252798

SEQ ID NO: 253628 - RNA, 64 nt, Human; identical to SEQ ID NO: 252799

SEQ ID NO: 253629 - RNA, 64 nt, Human; identical to SEQ ID NO: 252800

SEQ ID NO: 253630 - RNA, 64 nt, Human; identical to SEQ ID NO: 252801

SEQ ID NO: 253631 - RNA, 64 nt, Human; identical to SEQ ID NO: 252802

SEQ ID NO: 253632 - RNA, 64 nt, Human; identical to SEQ ID NO: 206367

SEQ ID NO: 253633 - RNA, 64 nt, Human; identical to SEQ ID NO: 206368

SEQ ID NO: 253634 - RNA, 64 nt, Human; identical to SEQ ID NO: 206369

SEQ ID NO: 253635 - RNA, 64 nt, Human; identical to SEQ ID NO: 252803

SEQ ID NO: 253636 - RNA, 64 nt, Human; identical to SEQ ID NO: 252804

SEQ ID NO: 253637 - RNA, 64 nt, Human; identical to SEQ ID NO: 252805

SEQ ID NO: 253638 - RNA, 64 nt, Human; identical to SEQ ID NO: 252806

SEQ ID NO: 253639 - RNA, 64 nt, Human; identical to SEQ ID NO: 252807

SEQ ID NO: 253640 - RNA, 64 nt, Human; identical to SEQ ID NO: 252811

SEQ ID NO: 253641 - RNA, 64 nt, Human; identical to SEQ ID NO: 252812

SEQ ID NO: 253642 - RNA, 64 nt, Human; identical to SEQ ID NO: 252813

SEQ ID NO: 253643 - RNA, 64 nt, Human; identical to SEQ ID NO: 252814

SEQ ID NO: 253644 - RNA, 64 nt, Human; identical to SEQ ID NO: 252815

SEQ ID NO: 253645 - RNA, 64 nt, Human; identical to SEQ ID NO: 252816

SEQ ID NO: 253646 - RNA, 64 nt, Human; identical to SEQ ID NO: 252817

SEQ ID NO: 253647 - RNA, 64 nt, Human; identical to SEQ ID NO: 252818

SEQ ID NO: 253648 - RNA, 64 nt, Human; identical to SEQ ID NO: 206372

SEQ ID NO: 253649 - RNA, 51 nt, Human; identical to SEQ ID NO: 206373

SEQ ID NO: 253650 - RNA, 64 nt, Human; identical to SEQ ID NO: 206374

SEQ ID NO: 253651 - RNA, 64 nt, Human; identical to SEQ ID NO: 252819

SEQ ID NO: 253652 - RNA, 64 nt, Human; identical to SEQ ID NO: 252820

SEQ ID NO: 253653 - RNA, 64 nt, Human; identical to SEQ ID NO: 252821

SEQ ID NO: 253654 - RNA, 64 nt, Human; identical to SEQ ID NO: 252822

SEQ ID NO: 253655 - RNA, 64 nt, Human; identical to SEQ ID NO: 252823

SEQ ID NO: 253656 - RNA, 64 nt, Human; identical to SEQ ID NO: 252827

SEQ ID NO: 253657 - RNA, 64 nt, Human; identical to SEQ ID NO: 252828

SEQ ID NO: 253658 - RNA, 64 nt, Human; identical to SEQ ID NO: 252829

SEQ ID NO: 253659 - RNA, 64 nt, Human; identical to SEQ ID NO: 252830

SEQ ID NO: 253660 - RNA, 64 nt, Human; identical to SEQ ID NO: 252831

SEQ ID NO: 253661 - RNA, 64 nt, Human; identical to SEQ ID NO: 252832

SEQ ID NO: 253662 - RNA, 64 nt, Human; identical to SEQ ID NO: 252833

SEQ ID NO: 253663 - RNA, 64 nt, Human; identical to SEQ ID NO: 252834

SEQ ID NO: 253664 - RNA, 60 nt, Human
guggguggcucuggcacgagucccccagggggagagcauggcuaccagggagcugcagcg

SEQ ID NO: 253665 - RNA, 60 nt, Human
ggggagggcacaggguggguuugagugaagggagagcacgguccuaaguccccagcaggu

SEQ ID NO: 253666 - RNA, 60 nt, Human
aacucauguuuucacaggaggguucaguguggagagcaaaaaagcugacuguggugauuu

SEQ ID NO: 253667 - RNA, 64 nt, Human; identical to SEQ ID NO: 252835

SEQ ID NO: 253668 - RNA, 64 nt, Human; identical to SEQ ID NO: 252836

SEQ ID NO: 253669 - RNA, 64 nt, Human; identical to SEQ ID NO: 252837

SEQ ID NO: 253670 - RNA, 64 nt, Human; identical to SEQ ID NO: 252838

SEQ ID NO: 253671 - RNA, 64 nt, Human; identical to SEQ ID NO: 252839

SEQ ID NO: 253672 - RNA, 64 nt, Human; identical to SEQ ID NO: 252843

SEQ ID NO: 253673 - RNA, 64 nt, Human; identical to SEQ ID NO: 252844

SEQ ID NO: 253674 - RNA, 64 nt, Human; identical to SEQ ID NO: 252845

SEQ ID NO: 253675 - RNA, 64 nt, Human; identical to SEQ ID NO: 252846

SEQ ID NO: 253676 - RNA, 64 nt, Human; identical to SEQ ID NO: 252847

SEQ ID NO: 253677 - RNA, 64 nt, Human; identical to SEQ ID NO: 252848

SEQ ID NO: 253678 - RNA, 64 nt, Human; identical to SEQ ID NO: 252849

SEQ ID NO: 253679 - RNA, 64 nt, Human; identical to SEQ ID NO: 252850

SEQ ID NO: 253680 - RNA, 64 nt, Human; identical to SEQ ID NO: 206377

SEQ ID NO: 253681 - RNA, 64 nt, Human; identical to SEQ ID NO: 206378

SEQ ID NO: 253682 - RNA, 50 nt, Human; identical to SEQ ID NO: 206379

SEQ ID NO: 253683 - RNA, 64 nt, Human; identical to SEQ ID NO: 252851

SEQ ID NO: 253684 - RNA, 64 nt, Human; identical to SEQ ID NO: 252852

SEQ ID NO: 253685 - RNA, 64 nt, Human; identical to SEQ ID NO: 252853

SEQ ID NO: 253686 - RNA, 64 nt, Human; identical to SEQ ID NO: 252854

SEQ ID NO: 253687 - RNA, 64 nt, Human; identical to SEQ ID NO: 252855

SEQ ID NO: 253688 - RNA, 64 nt, Human; identical to SEQ ID NO: 252859

SEQ ID NO: 253689 - RNA, 64 nt, Human; identical to SEQ ID NO: 252860

SEQ ID NO: 253690 - RNA, 64 nt, Human; identical to SEQ ID NO: 252861

SEQ ID NO: 253691 - RNA, 64 nt, Human; identical to SEQ ID NO: 252862

SEQ ID NO: 253692 - RNA, 64 nt, Human; identical to SEQ ID NO: 252863

SEQ ID NO: 253693 - RNA, 64 nt, Human; identical to SEQ ID NO: 252864

SEQ ID NO: 253694 - RNA, 64 nt, Human; identical to SEQ ID NO: 252865

SEQ ID NO: 253695 - RNA, 64 nt, Human; identical to SEQ ID NO: 252866

SEQ ID NO: 253696 - RNA, 64 nt, Human; identical to SEQ ID NO: 206383

SEQ ID NO: 253697 - RNA, 64 nt, Human; identical to SEQ ID NO: 206385

SEQ ID NO: 253698 - RNA, 64 nt, Human; identical to SEQ ID NO: 206386

SEQ ID NO: 253699 - RNA, 64 nt, Human; identical to SEQ ID NO: 252867

SEQ ID NO: 253700 - RNA, 64 nt, Human; identical to SEQ ID NO: 252868

SEQ ID NO: 253701 - RNA, 64 nt, Human; identical to SEQ ID NO: 252869

SEQ ID NO: 253702 - RNA, 64 nt, Human; identical to SEQ ID NO: 252870

SEQ ID NO: 253703 - RNA, 64 nt, Human; identical to SEQ ID NO: 252871

SEQ ID NO: 253704 - RNA, 64 nt, Human; identical to SEQ ID NO: 252875

SEQ ID NO: 253705 - RNA, 64 nt, Human; identical to SEQ ID NO: 252876

SEQ ID NO: 253706 - RNA, 64 nt, Human; identical to SEQ ID NO: 252877

SEQ ID NO: 253707 - RNA, 64 nt, Human; identical to SEQ ID NO: 252878

SEQ ID NO: 253708 - RNA, 64 nt, Human; identical to SEQ ID NO: 252864

SEQ ID NO: 253709 - RNA, 64 nt, Human; identical to SEQ ID NO: 252880

SEQ ID NO: 253710 - RNA, 64 nt, Human; identical to SEQ ID NO: 252881

SEQ ID NO: 253711 - RNA, 64 nt, Human; identical to SEQ ID NO: 252882

SEQ ID NO: 253712 - RNA, 64 nt, Human; identical to SEQ ID NO: 206389

SEQ ID NO: 253713 - RNA, 52 nt, Human; identical to SEQ ID NO: 206390

SEQ ID NO: 253714 - RNA, 64 nt, Human; identical to SEQ ID NO: 206391

SEQ ID NO: 253715 - RNA, 64 nt, Human; identical to SEQ ID NO: 252883

SEQ ID NO: 253716 - RNA, 64 nt, Human; identical to SEQ ID NO: 252884

SEQ ID NO: 253717 - RNA, 64 nt, Human; identical to SEQ ID NO: 252885

SEQ ID NO: 253718 - RNA, 64 nt, Human; identical to SEQ ID NO: 252886

SEQ ID NO: 253719 - RNA, 64 nt, Human; identical to SEQ ID NO: 252887

SEQ ID NO: 253720 - RNA, 64 nt, Human; identical to SEQ ID NO: 252891

SEQ ID NO: 253721 - RNA, 64 nt, Human; identical to SEQ ID NO: 252892

SEQ ID NO: 253722 - RNA, 64 nt, Human; identical to SEQ ID NO: 252893

SEQ ID NO: 253723 - RNA, 64 nt, Human; identical to SEQ ID NO: 252894

SEQ ID NO: 253724 - RNA, 64 nt, Human; identical to SEQ ID NO: 252895

SEQ ID NO: 253725 - RNA, 64 nt, Human; identical to SEQ ID NO: 252896

SEQ ID NO: 253726 - RNA, 64 nt, Human; identical to SEQ ID NO: 252897

SEQ ID NO: 253727 - RNA, 64 nt, Human; identical to SEQ ID NO: 252898

SEQ ID NO: 253728 - RNA, 64 nt, Human; identical to SEQ ID NO: 206392

SEQ ID NO: 253729 - RNA, 64 nt, Human
uuguggguggggagcaagggaagagagaaacucuucagcgaauccuucuaguacuaguugagag

SEQ ID NO: 253730 - RNA, 60 nt, Human
uguaggaaaugagacccucucugaagcugaggagagcacguugaucugaacuuuaaauca

SEQ ID NO: 253731 - RNA, 64 nt, Human; identical to SEQ ID NO: 252899

SEQ ID NO: 253732 - RNA, 64 nt, Human; identical to SEQ ID NO: 252900

SEQ ID NO: 253733 - RNA, 64 nt, Human; identical to SEQ ID NO: 252901

SEQ ID NO: 253734 - RNA, 64 nt, Human; identical to SEQ ID NO: 252902

SEQ ID NO: 253735 - RNA, 64 nt, Human; identical to SEQ ID NO: 252903

SEQ ID NO: 253736 - RNA, 64 nt, Human; identical to SEQ ID NO: 252907

SEQ ID NO: 253737 - RNA, 64 nt, Human; identical to SEQ ID NO: 252908

SEQ ID NO: 253738 - RNA, 64 nt, Human; identical to SEQ ID NO: 252909

SEQ ID NO: 253739 - RNA, 64 nt, Human; identical to SEQ ID NO: 252910

SEQ ID NO: 253740 - RNA, 64 nt, Human; identical to SEQ ID NO: 252911

SEQ ID NO: 253741 - RNA, 64 nt, Human; identical to SEQ ID NO: 252912

SEQ ID NO: 253742 - RNA, 64 nt, Human; identical to SEQ ID NO: 252913

SEQ ID NO: 253743 - RNA, 64 nt, Human; identical to SEQ ID NO: 252914

SEQ ID NO: 253744 - RNA, 64 nt, Human; identical to SEQ ID NO: 206341

SEQ ID NO: 253745 - RNA, 64 nt, Human; identical to SEQ ID NO: 206394

SEQ ID NO: 253746 - RNA, 64 nt, Human; identical to SEQ ID NO: 206395

SEQ ID NO: 253747 - RNA, 64 nt, Human; identical to SEQ ID NO: 252915

SEQ ID NO: 253748 - RNA, 64 nt, Human; identical to SEQ ID NO: 252916

SEQ ID NO: 253749 - RNA, 64 nt, Human; identical to SEQ ID NO: 252917

SEQ ID NO: 253750 - RNA, 64 nt, Human; identical to SEQ ID NO: 252918

SEQ ID NO: 253751 - RNA, 64 nt, Human; identical to SEQ ID NO: 252919

SEQ ID NO: 253752 - RNA, 64 nt, Human; identical to SEQ ID NO: 252923

SEQ ID NO: 253753 - RNA, 64 nt, Human; identical to SEQ ID NO: 252924

SEQ ID NO: 253754 - RNA, 64 nt, Human; identical to SEQ ID NO: 252925

SEQ ID NO: 253755 - RNA, 64 nt, Human; identical to SEQ ID NO: 252926

SEQ ID NO: 253756 - RNA, 64 nt, Human; identical to SEQ ID NO: 252927

SEQ ID NO: 253757 - RNA, 64 nt, Human; identical to SEQ ID NO: 252928

SEQ ID NO: 253758 - RNA, 64 nt, Human; identical to SEQ ID NO: 252929

SEQ ID NO: 253759 - RNA, 64 nt, Human; identical to SEQ ID NO: 252930

SEQ ID NO: 253760 - RNA, 64 nt, Human; identical to SEQ ID NO: 206401

SEQ ID NO: 253761 - RNA, 64 nt, Human; identical to SEQ ID NO: 206402

SEQ ID NO: 253762 - RNA, 64 nt, Human; identical to SEQ ID NO: 206403

SEQ ID NO: 253763 - RNA, 64 nt, Human; identical to SEQ ID NO: 252931

SEQ ID NO: 253764 - RNA, 64 nt, Human; identical to SEQ ID NO: 252932

SEQ ID NO: 253765 - RNA, 64 nt, Human; identical to SEQ ID NO: 252933

SEQ ID NO: 253766 - RNA, 64 nt, Human; identical to SEQ ID NO: 252934

SEQ ID NO: 253767 - RNA, 64 nt, Human; identical to SEQ ID NO: 252935

SEQ ID NO: 253768 - RNA, 64 nt, Human; identical to SEQ ID NO: 252939

SEQ ID NO: 253769 - RNA, 64 nt, Human; identical to SEQ ID NO: 252940

SEQ ID NO: 253770 - RNA, 64 nt, Human; identical to SEQ ID NO: 252941

SEQ ID NO: 253771 - RNA, 64 nt, Human; identical to SEQ ID NO: 252942

SEQ ID NO: 253772 - RNA, 64 nt, Human; identical to SEQ ID NO: 252943

SEQ ID NO: 253773 - RNA, 64 nt, Human; identical to SEQ ID NO: 252944

SEQ ID NO: 253774 - RNA, 64 nt, Human; identical to SEQ ID NO: 252945

SEQ ID NO: 253775 - RNA, 64 nt, Human; identical to SEQ ID NO: 252946

SEQ ID NO: 253776 - RNA, 64 nt, Human; identical to SEQ ID NO: 206365

SEQ ID NO: 253777 - RNA, 64 nt, Human; identical to SEQ ID NO: 206370

SEQ ID NO: 253778 - RNA, 64 nt, Human; identical to SEQ ID NO: 206387

SEQ ID NO: 253779 - RNA, 64 nt, Human; identical to SEQ ID NO: 252947

SEQ ID NO: 253780 - RNA, 64 nt, Human; identical to SEQ ID NO: 252948

SEQ ID NO: 253781 - RNA, 64 nt, Human; identical to SEQ ID NO: 252949

SEQ ID NO: 253782 - RNA, 64 nt, Human; identical to SEQ ID NO: 252950

SEQ ID NO: 253783 - RNA, 64 nt, Human; identical to SEQ ID NO: 252951

SEQ ID NO: 253784 - RNA, 64 nt, Human; identical to SEQ ID NO: 252955

SEQ ID NO: 253785 - RNA, 64 nt, Human; identical to SEQ ID NO: 252956

SEQ ID NO: 253786 - RNA, 64 nt, Human; identical to SEQ ID NO: 252957

SEQ ID NO: 253787 - RNA, 64 nt, Human; identical to SEQ ID NO: 252958

SEQ ID NO: 253788 - RNA, 54 nt, Human; identical to SEQ ID NO: 252550

SEQ ID NO: 253789 - RNA, 64 nt, Human; identical to SEQ ID NO: 252960

SEQ ID NO: 253790 - RNA, 64 nt, Human; identical to SEQ ID NO: 252961

SEQ ID NO: 253791 - RNA, 64 nt, Human; identical to SEQ ID NO: 252962

SEQ ID NO: 253792 - RNA, 64 nt, Human; identical to SEQ ID NO: 206325

SEQ ID NO: 253793 - RNA, 64 nt, Human; identical to SEQ ID NO: 206357

SEQ ID NO: 253794 - RNA, 64 nt, Human; identical to SEQ ID NO: 206375

SEQ ID NO: 253795 - RNA, 64 nt, Human; identical to SEQ ID NO: 252963

SEQ ID NO: 253796 - RNA, 64 nt, Human; identical to SEQ ID NO: 252964

SEQ ID NO: 253797 - RNA, 64 nt, Human; identical to SEQ ID NO: 252965

SEQ ID NO: 253798 - RNA, 64 nt, Human; identical to SEQ ID NO: 252966

SEQ ID NO: 253799 - RNA, 64 nt, Human; identical to SEQ ID NO: 252967

SEQ ID NO: 253800 - RNA, 64 nt, Human; identical to SEQ ID NO: 252971

SEQ ID NO: 253801 - RNA, 64 nt, Human; identical to SEQ ID NO: 252972

SEQ ID NO: 253802 - RNA, 64 nt, Human; identical to SEQ ID NO: 252973

SEQ ID NO: 253803 - RNA, 64 nt, Human; identical to SEQ ID NO: 252974

SEQ ID NO: 253804 - RNA, 64 nt, Human; identical to SEQ ID NO: 252975

SEQ ID NO: 253805 - RNA, 64 nt, Human; identical to SEQ ID NO: 252976

SEQ ID NO: 253806 - RNA, 64 nt, Human; identical to SEQ ID NO: 252977

SEQ ID NO: 253807 - RNA, 64 nt, Human; identical to SEQ ID NO: 252978

SEQ ID NO: 253808 - RNA, 64 nt, Human; identical to SEQ ID NO: 206406

SEQ ID NO: 253809 - RNA, 64 nt, Human; identical to SEQ ID NO: 206407

SEQ ID NO: 253810 - RNA, 64 nt, Human; identical to SEQ ID NO: 206408

SEQ ID NO: 253811 - RNA, 64 nt, Human; identical to SEQ ID NO: 252979

SEQ ID NO: 253812 - RNA, 64 nt, Human; identical to SEQ ID NO: 252980

SEQ ID NO: 253813 - RNA, 64 nt, Human; identical to SEQ ID NO: 252981

SEQ ID NO: 253814 - RNA, 64 nt, Human; identical to SEQ ID NO: 252982

SEQ ID NO: 253815 - RNA, 64 nt, Human; identical to SEQ ID NO: 252983

SEQ ID NO: 253816 - RNA, 64 nt, Human; identical to SEQ ID NO: 252987

SEQ ID NO: 253817 - RNA, 64 nt, Human; identical to SEQ ID NO: 252988

SEQ ID NO: 253818 - RNA, 64 nt, Human; identical to SEQ ID NO: 252989

SEQ ID NO: 253819 - RNA, 64 nt, Human; identical to SEQ ID NO: 252990

SEQ ID NO: 253820 - RNA, 64 nt, Human; identical to SEQ ID NO: 252991

SEQ ID NO: 253821 - RNA, 64 nt, Human; identical to SEQ ID NO: 252992

SEQ ID NO: 253822 - RNA, 64 nt, Human; identical to SEQ ID NO: 252993

SEQ ID NO: 253823 - RNA, 64 nt, Human; identical to SEQ ID NO: 252994

SEQ ID NO: 253824 - RNA, 64 nt, Human; identical to SEQ ID NO: 206304

SEQ ID NO: 253825 - RNA, 64 nt, Human; identical to SEQ ID NO: 206305

SEQ ID NO: 253826 - RNA, 64 nt, Human; identical to SEQ ID NO: 206306

SEQ ID NO: 253827 - RNA, 64 nt, Human; identical to SEQ ID NO: 252995

SEQ ID NO: 253828 - RNA, 64 nt, Human; identical to SEQ ID NO: 252996

SEQ ID NO: 253829 - RNA, 64 nt, Human; identical to SEQ ID NO: 252997

SEQ ID NO: 253830 - RNA, 64 nt, Human; identical to SEQ ID NO: 252998

SEQ ID NO: 253831 - RNA, 64 nt, Human; identical to SEQ ID NO: 252999

SEQ ID NO: 253832 - RNA, 64 nt, Human; identical to SEQ ID NO: 253003

SEQ ID NO: 253833 - RNA, 64 nt, Human; identical to SEQ ID NO: 253004

SEQ ID NO: 253834 - RNA, 64 nt, Human; identical to SEQ ID NO: 253005

SEQ ID NO: 253835 - RNA, 64 nt, Human; identical to SEQ ID NO: 253006

SEQ ID NO: 253836 - RNA, 64 nt, Human; identical to SEQ ID NO: 253007

SEQ ID NO: 253837 - RNA, 64 nt, Human; identical to SEQ ID NO: 253008

SEQ ID NO: 253838 - RNA, 64 nt, Human; identical to SEQ ID NO: 253009

SEQ ID NO: 253839 - RNA, 64 nt, Human; identical to SEQ ID NO: 253010

SEQ ID NO: 253840 - RNA, 64 nt, Human; identical to SEQ ID NO: 206404

SEQ ID NO: 253841 - RNA, 57 nt, Human
cccggcuacugcgugcagggcaccgucggccacaagauccucagcgggcagcggaag

SEQ ID NO: 253842 - RNA, 57 nt, Human
uucauccccgcauucccaauauacccaggccacaagaguggacgugaaccacagggu

SEQ ID NO: 253843 - RNA, 57 nt, Human
ggaauccuaaaagggagaguuauuacuggccacaagcccuguauucucaacagggau

SEQ ID NO: 253844 - RNA, 64 nt, Human; identical to SEQ ID NO: 253011

SEQ ID NO: 253845 - RNA, 64 nt, Human; identical to SEQ ID NO: 253012

SEQ ID NO: 253846 - RNA, 64 nt, Human; identical to SEQ ID NO: 253013

SEQ ID NO: 253847 - RNA, 64 nt, Human; identical to SEQ ID NO: 253014

SEQ ID NO: 253848 - RNA, 64 nt, Human; identical to SEQ ID NO: 253015

SEQ ID NO: 253849 - RNA, 64 nt, Human; identical to SEQ ID NO: 253019

SEQ ID NO: 253850 - RNA, 64 nt, Human; identical to SEQ ID NO: 253020

SEQ ID NO: 253851 - RNA, 64 nt, Human; identical to SEQ ID NO: 253021

SEQ ID NO: 253852 - RNA, 64 nt, Human; identical to SEQ ID NO: 253022

SEQ ID NO: 253853 - RNA, 64 nt, Human; identical to SEQ ID NO: 253023

SEQ ID NO: 253854 - RNA, 64 nt, Human; identical to SEQ ID NO: 253024

SEQ ID NO: 253855 - RNA, 64 nt, Human; identical to SEQ ID NO: 253025

SEQ ID NO: 253856 - RNA, 64 nt, Human; identical to SEQ ID NO: 253026

SEQ ID NO: 253857 - RNA, 64 nt, Human; identical to SEQ ID NO: 206312

SEQ ID NO: 253858 - RNA, 64 nt, Human; identical to SEQ ID NO: 206313

SEQ ID NO: 253859 - RNA, 64 nt, Human; identical to SEQ ID NO: 206314

SEQ ID NO: 253860 - RNA, 64 nt, Human; identical to SEQ ID NO: 253027

SEQ ID NO: 253861 - RNA, 64 nt, Human; identical to SEQ ID NO: 253028

SEQ ID NO: 253862 - RNA, 64 nt, Human; identical to SEQ ID NO: 253029

SEQ ID NO: 253863 - RNA, 64 nt, Human; identical to SEQ ID NO: 253030

SEQ ID NO: 253864 - RNA, 64 nt, Human; identical to SEQ ID NO: 253031

SEQ ID NO: 253865 - RNA, 64 nt, Human; identical to SEQ ID NO: 253035

SEQ ID NO: 253866 - RNA, 64 nt, Human; identical to SEQ ID NO: 253036

SEQ ID NO: 253867 - RNA, 64 nt, Human; identical to SEQ ID NO: 253037

SEQ ID NO: 253868 - RNA, 64 nt, Human; identical to SEQ ID NO: 253038

SEQ ID NO: 253869 - RNA, 64 nt, Human; identical to SEQ ID NO: 253039

SEQ ID NO: 253870 - RNA, 64 nt, Human; identical to SEQ ID NO: 253040

SEQ ID NO: 253871 - RNA, 64 nt, Human; identical to SEQ ID NO: 253041

SEQ ID NO: 253872 - RNA, 64 nt, Human; identical to SEQ ID NO: 253042

SEQ ID NO: 253873 - RNA, 64 nt, Human; identical to SEQ ID NO: 206317

SEQ ID NO: 253874 - RNA, 64 nt, Human; identical to SEQ ID NO: 206318

SEQ ID NO: 253875 - RNA, 64 nt, Human; identical to SEQ ID NO: 206319

SEQ ID NO: 253876 - RNA, 64 nt, Human; identical to SEQ ID NO: 253043

SEQ ID NO: 253877 - RNA, 64 nt, Human; identical to SEQ ID NO: 253044

SEQ ID NO: 253878 - RNA, 64 nt, Human; identical to SEQ ID NO: 253045

SEQ ID NO: 253879 - RNA, 64 nt, Human; identical to SEQ ID NO: 253046

SEQ ID NO: 253880 - RNA, 64 nt, Human; identical to SEQ ID NO: 253047

SEQ ID NO: 253881 - RNA, 64 nt, Human; identical to SEQ ID NO: 253051

SEQ ID NO: 253882 - RNA, 64 nt, Human; identical to SEQ ID NO: 253052

SEQ ID NO: 253883 - RNA, 64 nt, Human; identical to SEQ ID NO: 253053

SEQ ID NO: 253884 - RNA, 64 nt, Human; identical to SEQ ID NO: 253054

SEQ ID NO: 253885 - RNA, 64 nt, Human; identical to SEQ ID NO: 253055

SEQ ID NO: 253886 - RNA, 64 nt, Human; identical to SEQ ID NO: 253056

SEQ ID NO: 253887 - RNA, 64 nt, Human; identical to SEQ ID NO: 253057

SEQ ID NO: 253888 - RNA, 64 nt, Human; identical to SEQ ID NO: 253058

SEQ ID NO: 253889 - RNA, 64 nt, Human; identical to SEQ ID NO: 206322

SEQ ID NO: 253890 - RNA, 64 nt, Human; identical to SEQ ID NO: 206323

SEQ ID NO: 253891 - RNA, 64 nt, Human; identical to SEQ ID NO: 206324

SEQ ID NO: 253892 - RNA, 64 nt, Human; identical to SEQ ID NO: 253059

SEQ ID NO: 253893 - RNA, 64 nt, Human; identical to SEQ ID NO: 253060

SEQ ID NO: 253894 - RNA, 64 nt, Human; identical to SEQ ID NO: 253061

SEQ ID NO: 253895 - RNA, 64 nt, Human; identical to SEQ ID NO: 253062

SEQ ID NO: 253896 - RNA, 64 nt, Human; identical to SEQ ID NO: 253063

SEQ ID NO: 253897 - RNA, 64 nt, Human; identical to SEQ ID NO: 253067

SEQ ID NO: 253898 - RNA, 64 nt, Human; identical to SEQ ID NO: 253068

SEQ ID NO: 253899 - RNA, 64 nt, Human; identical to SEQ ID NO: 253069

SEQ ID NO: 253900 - RNA, 64 nt, Human; identical to SEQ ID NO: 253070

SEQ ID NO: 253901 - RNA, 64 nt, Human; identical to SEQ ID NO: 253071

SEQ ID NO: 253902 - RNA, 64 nt, Human; identical to SEQ ID NO: 253072

SEQ ID NO: 253903 - RNA, 64 nt, Human; identical to SEQ ID NO: 253073

SEQ ID NO: 253904 - RNA, 64 nt, Human; identical to SEQ ID NO: 253074

SEQ ID NO: 253905 - RNA, 50 nt, Human; identical to SEQ ID NO: 206353

SEQ ID NO: 253906 - RNA, 64 nt, Human; identical to SEQ ID NO: 206411

SEQ ID NO: 253907 - RNA, 64 nt, Human; identical to SEQ ID NO: 206412

SEQ ID NO: 253908 - RNA, 64 nt, Human; identical to SEQ ID NO: 253075

SEQ ID NO: 253909 - RNA, 64 nt, Human; identical to SEQ ID NO: 253076

SEQ ID NO: 253910 - RNA, 64 nt, Human; identical to SEQ ID NO: 253077

SEQ ID NO: 253911 - RNA, 64 nt, Human; identical to SEQ ID NO: 253078

SEQ ID NO: 253912 - RNA, 64 nt, Human; identical to SEQ ID NO: 253079

SEQ ID NO: 253913 - RNA, 64 nt, Human; identical to SEQ ID NO: 253083

SEQ ID NO: 253914 - RNA, 64 nt, Human; identical to SEQ ID NO: 253084

SEQ ID NO: 253915 - RNA, 64 nt, Human; identical to SEQ ID NO: 253085

SEQ ID NO: 253916 - RNA, 64 nt, Human; identical to SEQ ID NO: 253086

SEQ ID NO: 253917 - RNA, 64 nt, Human; identical to SEQ ID NO: 253087

SEQ ID NO: 253918 - RNA, 64 nt, Human; identical to SEQ ID NO: 253088

SEQ ID NO: 253919 - RNA, 64 nt, Human; identical to SEQ ID NO: 253089

SEQ ID NO: 253920 - RNA, 64 nt, Human; identical to SEQ ID NO: 253090

SEQ ID NO: 253921 - RNA, 64 nt, Human; identical to SEQ ID NO: 206330

SEQ ID NO: 253922 - RNA, 64 nt, Human; identical to SEQ ID NO: 206331

SEQ ID NO: 253923 - RNA, 64 nt, Human; identical to SEQ ID NO: 206332

SEQ ID NO: 253924 - RNA, 64 nt, Human; identical to SEQ ID NO: 253091

SEQ ID NO: 253925 - RNA, 64 nt, Human; identical to SEQ ID NO: 253092

SEQ ID NO: 253926 - RNA, 64 nt, Human; identical to SEQ ID NO: 253093

SEQ ID NO: 253927 - RNA, 64 nt, Human; identical to SEQ ID NO: 253094

SEQ ID NO: 253928 - RNA, 64 nt, Human; identical to SEQ ID NO: 253095

SEQ ID NO: 253929 - RNA, 64 nt, Human; identical to SEQ ID NO: 253099

SEQ ID NO: 253930 - RNA, 64 nt, Human; identical to SEQ ID NO: 253100

SEQ ID NO: 253931 - RNA, 64 nt, Human; identical to SEQ ID NO: 253101

SEQ ID NO: 253932 - RNA, 64 nt, Human; identical to SEQ ID NO: 253102

SEQ ID NO: 253933 - RNA, 64 nt, Human; identical to SEQ ID NO: 253103

SEQ ID NO: 253934 - RNA, 64 nt, Human; identical to SEQ ID NO: 253104

SEQ ID NO: 253935 - RNA, 64 nt, Human; identical to SEQ ID NO: 253105

SEQ ID NO: 253936 - RNA, 64 nt, Human; identical to SEQ ID NO: 253106

SEQ ID NO: 253937 - RNA, 64 nt, Human; identical to SEQ ID NO: 206335

SEQ ID NO: 253938 - RNA, 64 nt, Human; identical to SEQ ID NO: 206336

SEQ ID NO: 253939 - RNA, 64 nt, Human; identical to SEQ ID NO: 206337

SEQ ID NO: 253940 - RNA, 64 nt, Human; identical to SEQ ID NO: 253107

SEQ ID NO: 253941 - RNA, 64 nt, Human; identical to SEQ ID NO: 253108

SEQ ID NO: 253942 - RNA, 64 nt, Human; identical to SEQ ID NO: 253109

SEQ ID NO: 253943 - RNA, 64 nt, Human; identical to SEQ ID NO: 253110

SEQ ID NO: 253944 - RNA, 64 nt, Human; identical to SEQ ID NO: 253111

SEQ ID NO: 253945 - RNA, 64 nt, Human; identical to SEQ ID NO: 253115

SEQ ID NO: 253946 - RNA, 64 nt, Human; identical to SEQ ID NO: 253116

SEQ ID NO: 253947 - RNA, 64 nt, Human; identical to SEQ ID NO: 253117

SEQ ID NO: 253948 - RNA, 60 nt, Human; identical to SEQ ID NO: 252710

SEQ ID NO: 253949 - RNA, 64 nt, Human; identical to SEQ ID NO: 253119

SEQ ID NO: 253950 - RNA, 64 nt, Human; identical to SEQ ID NO: 253120

SEQ ID NO: 253951 - RNA, 64 nt, Human; identical to SEQ ID NO: 253121

SEQ ID NO: 253952 - RNA, 64 nt, Human; identical to SEQ ID NO: 253122

SEQ ID NO: 253953 - RNA, 64 nt, Human; identical to SEQ ID NO: 206302

SEQ ID NO: 253954 - RNA, 64 nt, Human; identical to SEQ ID NO: 206307

SEQ ID NO: 253955 - RNA, 64 nt, Human; identical to SEQ ID NO: 206333

SEQ ID NO: 253956 - RNA, 64 nt, Human; identical to SEQ ID NO: 253123

SEQ ID NO: 253957 - RNA, 64 nt, Human; identical to SEQ ID NO: 253124

SEQ ID NO: 253958 - RNA, 64 nt, Human; identical to SEQ ID NO: 253125

SEQ ID NO: 253959 - RNA, 64 nt, Human; identical to SEQ ID NO: 253126

SEQ ID NO: 253960 - RNA, 64 nt, Human; identical to SEQ ID NO: 253127

SEQ ID NO: 253961 - RNA, 64 nt, Human; identical to SEQ ID NO: 253131

SEQ ID NO: 253962 - RNA, 64 nt, Human; identical to SEQ ID NO: 253132

SEQ ID NO: 253963 - RNA, 64 nt, Human; identical to SEQ ID NO: 253133

SEQ ID NO: 253964 - RNA, 64 nt, Human; identical to SEQ ID NO: 253134

SEQ ID NO: 253965 - RNA, 64 nt, Human; identical to SEQ ID NO: 253135

SEQ ID NO: 253966 - RNA, 64 nt, Human; identical to SEQ ID NO: 253136

SEQ ID NO: 253967 - RNA, 64 nt, Human; identical to SEQ ID NO: 253137

SEQ ID NO: 253968 - RNA, 64 nt, Human; identical to SEQ ID NO: 253138

SEQ ID NO: 253969 - RNA, 64 nt, Human; identical to SEQ ID NO: 206298

SEQ ID NO: 253970 - RNA, 64 nt, Human; identical to SEQ ID NO: 206338

SEQ ID NO: 253971 - RNA, 51 nt, Human; identical to SEQ ID NO: 206340

SEQ ID NO: 253972 - RNA, 64 nt, Human; identical to SEQ ID NO: 253139

SEQ ID NO: 253973 - RNA, 64 nt, Human; identical to SEQ ID NO: 253140

SEQ ID NO: 253974 - RNA, 64 nt, Human; identical to SEQ ID NO: 253141

SEQ ID NO: 253975 - RNA, 64 nt, Human; identical to SEQ ID NO: 253142

SEQ ID NO: 253976 - RNA, 64 nt, Human; identical to SEQ ID NO: 253143

SEQ ID NO: 253977 - RNA, 64 nt, Human; identical to SEQ ID NO: 253147

SEQ ID NO: 253978 - RNA, 64 nt, Human; identical to SEQ ID NO: 253148

SEQ ID NO: 253979 - RNA, 64 nt, Human; identical to SEQ ID NO: 253149

SEQ ID NO: 253980 - RNA, 64 nt, Human; identical to SEQ ID NO: 253150

SEQ ID NO: 253981 - RNA, 64 nt, Human; identical to SEQ ID NO: 253151

SEQ ID NO: 253982 - RNA, 64 nt, Human; identical to SEQ ID NO: 253152

SEQ ID NO: 253983 - RNA, 64 nt, Human; identical to SEQ ID NO: 253153

SEQ ID NO: 253984 - RNA, 64 nt, Human; identical to SEQ ID NO: 253154

SEQ ID NO: 253985 - RNA, 62 nt, Human
aaccaaaacaucaauguuuauuaguucuguauacaguacaggaucuuuggucuacucuauca

SEQ ID NO: 253986 - RNA, 64 nt, Human; identical to SEQ ID NO: 206315

SEQ ID NO: 253987 - RNA, 64 nt, Human; identical to SEQ ID NO: 206415

SEQ ID NO: 253988 - RNA, 64 nt, Human; identical to SEQ ID NO: 253155

SEQ ID NO: 253989 - RNA, 64 nt, Human; identical to SEQ ID NO: 253156

SEQ ID NO: 253990 - RNA, 64 nt, Human; identical to SEQ ID NO: 253157

SEQ ID NO: 253991 - RNA, 64 nt, Human; identical to SEQ ID NO: 253158

SEQ ID NO: 253992 - RNA, 64 nt, Human; identical to SEQ ID NO: 253159

SEQ ID NO: 253993 - RNA, 64 nt, Human; identical to SEQ ID NO: 253163

SEQ ID NO: 253994 - RNA, 64 nt, Human; identical to SEQ ID NO: 253164

SEQ ID NO: 253995 - RNA, 64 nt, Human; identical to SEQ ID NO: 253165

SEQ ID NO: 253996 - RNA, 64 nt, Human; identical to SEQ ID NO: 253166

SEQ ID NO: 253997 - RNA, 64 nt, Human; identical to SEQ ID NO: 253167

SEQ ID NO: 253998 - RNA, 64 nt, Human; identical to SEQ ID NO: 253168

SEQ ID NO: 253999 - RNA, 64 nt, Human; identical to SEQ ID NO: 253169

SEQ ID NO: 254000 - RNA, 64 nt, Human; identical to SEQ ID NO: 253170

SEQ ID NO: 254001 - RNA, 64 nt, Human; identical to SEQ ID NO: 206294

SEQ ID NO: 254002 - RNA, 64 nt, Human; identical to SEQ ID NO: 206343

SEQ ID NO: 254003 - RNA, 64 nt, Human; identical to SEQ ID NO: 206347

SEQ ID NO: 254004 - RNA, 64 nt, Human; identical to SEQ ID NO: 253171

SEQ ID NO: 254005 - RNA, 64 nt, Human; identical to SEQ ID NO: 253172

SEQ ID NO: 254006 - RNA, 64 nt, Human; identical to SEQ ID NO: 253173

SEQ ID NO: 254007 - RNA, 64 nt, Human; identical to SEQ ID NO: 253174

SEQ ID NO: 254008 - RNA, 62 nt, Human; identical to SEQ ID NO: 252339

SEQ ID NO: 254009 - RNA, 62 nt, Human; identical to SEQ ID NO: 252342

SEQ ID NO: 254010 - RNA, 62 nt, Human; identical to SEQ ID NO: 252343

SEQ ID NO: 254011 - RNA, 62 nt, Human; identical to SEQ ID NO: 252344

SEQ ID NO: 254012 - RNA, 62 nt, Human; identical to SEQ ID NO: 252345

SEQ ID NO: 254013 - RNA, 50 nt, Human; identical to SEQ ID NO: 206350

SEQ ID NO: 254014 - RNA, 64 nt, Human; identical to SEQ ID NO: 206351

SEQ ID NO: 254015 - RNA, 64 nt, Human; identical to SEQ ID NO: 206352

SEQ ID NO: 254016 - RNA, 62 nt, Human; identical to SEQ ID NO: 252346

SEQ ID NO: 254017 - RNA, 62 nt, Human; identical to SEQ ID NO: 252347

SEQ ID NO: 254018 - RNA, 62 nt, Human; identical to SEQ ID NO: 252348

SEQ ID NO: 254019 - RNA, 62 nt, Human; identical to SEQ ID NO: 252349

SEQ ID NO: 254020 - RNA, 62 nt, Human; identical to SEQ ID NO: 252350

SEQ ID NO: 254021 - RNA, 62 nt, Human; identical to SEQ ID NO: 252351

SEQ ID NO: 254022 - RNA, 62 nt, Human; identical to SEQ ID NO: 252352

SEQ ID NO: 254023 - RNA, 62 nt, Human; identical to SEQ ID NO: 252353

SEQ ID NO: 254024 - RNA, 62 nt, Human; identical to SEQ ID NO: 252354

SEQ ID NO: 254025 - RNA, 62 nt, Human; identical to SEQ ID NO: 252359

SEQ ID NO: 254026 - RNA, 62 nt, Human; identical to SEQ ID NO: 252360

SEQ ID NO: 254027 - RNA, 62 nt, Human; identical to SEQ ID NO: 252361

SEQ ID NO: 254028 - RNA, 62 nt, Human; identical to SEQ ID NO: 252362

SEQ ID NO: 254029 - RNA, 62 nt, Human
ucuggguguggagcugggaucuucaacuggggacaguacaguaaagaacaucacagcaucuc

SEQ ID NO: 254030 - RNA, 62 nt, Human
agcauuucaccuuuaccacuuggcaggugcccacaguacaucauucgccuaacucaucauga

SEQ ID NO: 254031 - RNA, 62 nt, Human
ugaaagcaaaguaugauaguuuguuuugcuauacaguacaucuauauugauagagguucaug

SEQ ID NO: 254032 - RNA, 62 nt, Human; identical to SEQ ID NO: 252363

SEQ ID NO: 254033 - RNA, 62 nt, Human; identical to SEQ ID NO: 252364

SEQ ID NO: 254034 - RNA, 62 nt, Human; identical to SEQ ID NO: 252365

SEQ ID NO: 254035 - RNA, 62 nt, Human; identical to SEQ ID NO: 252366

SEQ ID NO: 254036 - RNA, 62 nt, Human; identical to SEQ ID NO: 252367

SEQ ID NO: 254037 - RNA, 62 nt, Human; identical to SEQ ID NO: 252368

SEQ ID NO: 254038 - RNA, 62 nt, Human; identical to SEQ ID NO: 252369

SEQ ID NO: 254039 - RNA, 62 nt, Human; identical to SEQ ID NO: 252370

SEQ ID NO: 254040 - RNA, 62 nt, Human; identical to SEQ ID NO: 252371

SEQ ID NO: 254041 - RNA, 62 nt, Human; identical to SEQ ID NO: 252375

SEQ ID NO: 254042 - RNA, 62 nt, Human; identical to SEQ ID NO: 252376

SEQ ID NO: 254043 - RNA, 62 nt, Human; identical to SEQ ID NO: 252377

SEQ ID NO: 254044 - RNA, 62 nt, Human; identical to SEQ ID NO: 252378

SEQ ID NO: 254045 - RNA, 62 nt, Human
cuccuaguuucuuguaaaggaagccagaguugacaguacaaagggucguggccagcccugca

SEQ ID NO: 254046 - RNA, 62 nt, Human
aacagcauggcuguaugugcgugguccauagcacaguacaugcagcaucuaauaagaguuuc

SEQ ID NO: 254047 - RNA, 62 nt, Human
ugcuuaggugguccccaacagugccuagggguacaguacagucccauuacacuagagcaggg

SEQ ID NO: 254048 - RNA, 62 nt, Human; identical to SEQ ID NO: 252379

SEQ ID NO: 254049 - RNA, 62 nt, Human; identical to SEQ ID NO: 252380

SEQ ID NO: 254050 - RNA, 62 nt, Human; identical to SEQ ID NO: 252381

SEQ ID NO: 254051 - RNA, 62 nt, Human; identical to SEQ ID NO: 252382

SEQ ID NO: 254052 - RNA, 62 nt, Human; identical to SEQ ID NO: 252383

SEQ ID NO: 254053 - RNA, 62 nt, Human; identical to SEQ ID NO: 252384

SEQ ID NO: 254054 - RNA, 62 nt, Human; identical to SEQ ID NO: 252385

SEQ ID NO: 254055 - RNA, 62 nt, Human; identical to SEQ ID NO: 252386

SEQ ID NO: 254056 - RNA, 62 nt, Human; identical to SEQ ID NO: 252387

SEQ ID NO: 254057 - RNA, 62 nt, Human; identical to SEQ ID NO: 252391

SEQ ID NO: 254058 - RNA, 62 nt, Human; identical to SEQ ID NO: 252392

SEQ ID NO: 254059 - RNA, 62 nt, Human; identical to SEQ ID NO: 252393

SEQ ID NO: 254060 - RNA, 62 nt, Human; identical to SEQ ID NO: 252394

SEQ ID NO: 254061 - RNA, 62 nt, Human
gguggugguggugguggugagugucagcaucuacaguacagccaggcaggcaggaccuugag

SEQ ID NO: 254062 - RNA, 62 nt, Human
aggcuuuuuaucacuacaaucuuagaggauugacaguacaggauuuuuguuuaagagaagga

SEQ ID NO: 254063 - RNA, 62 nt, Human
uacugguuuuauauuuuuuuuucuuugagacaacaguacauauaauagagguacaauucguu

SEQ ID NO: 254064 - RNA, 62 nt, Human; identical to SEQ ID NO: 252395

SEQ ID NO: 254065 - RNA, 62 nt, Human; identical to SEQ ID NO: 252396

SEQ ID NO: 254066 - RNA, 62 nt, Human; identical to SEQ ID NO: 252397

SEQ ID NO: 254067 - RNA, 62 nt, Human; identical to SEQ ID NO: 252398

SEQ ID NO: 254068 - RNA, 62 nt, Human; identical to SEQ ID NO: 252399

SEQ ID NO: 254069 - RNA, 62 nt, Human; identical to SEQ ID NO: 252400

SEQ ID NO: 254070 - RNA, 62 nt, Human; identical to SEQ ID NO: 252401

SEQ ID NO: 254071 - RNA, 62 nt, Human; identical to SEQ ID NO: 252402

SEQ ID NO: 254072 - RNA, 62 nt, Human; identical to SEQ ID NO: 252403

SEQ ID NO: 254073 - RNA, 62 nt, Human; identical to SEQ ID NO: 252408

SEQ ID NO: 254074 - RNA, 62 nt, Human; identical to SEQ ID NO: 252409

SEQ ID NO: 254075 - RNA, 62 nt, Human; identical to SEQ ID NO: 252410

SEQ ID NO: 254076 - RNA, 62 nt, Human; identical to SEQ ID NO: 252411

SEQ ID NO: 254077 - RNA, 64 nt, Human; identical to SEQ ID NO: 206320

SEQ ID NO: 254078 - RNA, 64 nt, Human; identical to SEQ ID NO: 206355

SEQ ID NO: 254079 - RNA, 64 nt, Human; identical to SEQ ID NO: 206356

SEQ ID NO: 254080 - RNA, 62 nt, Human; identical to SEQ ID NO: 252412

SEQ ID NO: 254081 - RNA, 62 nt, Human; identical to SEQ ID NO: 252413

SEQ ID NO: 254082 - RNA, 62 nt, Human; identical to SEQ ID NO: 252414

SEQ ID NO: 254083 - RNA, 62 nt, Human; identical to SEQ ID NO: 252415

SEQ ID NO: 254084 - RNA, 62 nt, Human; identical to SEQ ID NO: 252416

SEQ ID NO: 254085 - RNA, 62 nt, Human; identical to SEQ ID NO: 252417

SEQ ID NO: 254086 - RNA, 62 nt, Human; identical to SEQ ID NO: 252418

SEQ ID NO: 254087 - RNA, 62 nt, Human; identical to SEQ ID NO: 252419

SEQ ID NO: 254088 - RNA, 62 nt, Human; identical to SEQ ID NO: 252420

SEQ ID NO: 254089 - RNA, 62 nt, Human; identical to SEQ ID NO: 252424

SEQ ID NO: 254090 - RNA, 62 nt, Human; identical to SEQ ID NO: 252425

SEQ ID NO: 254091 - RNA, 62 nt, Human; identical to SEQ ID NO: 252426

SEQ ID NO: 254092 - RNA, 62 nt, Human; identical to SEQ ID NO: 252427

SEQ ID NO: 254093 - RNA, 62 nt, Human
cugccuuucacauaaaaucacaaaacuacaggacaguacaaacagauugccagagaaaucug

SEQ ID NO: 254094 - RNA, 62 nt, Human
cuguacggagucuucccagagggccggcuggaacaguacaucccaguacgggcccaguccua

SEQ ID NO: 254095 - RNA, 62 nt, Human
aucuuugaaagacuuccaaagaauguuagagcacaguacauaauacacuugcccugcucccu

SEQ ID NO: 254096 - RNA, 62 nt, Human
ucuuugaaaguuuaaagaaacuugaccaaaagacaguacaaaaacacuggcacuugaauguu

SEQ ID NO: 254097 - RNA, 62 nt, Human; identical to SEQ ID NO: 252428

SEQ ID NO: 254098 - RNA, 62 nt, Human; identical to SEQ ID NO: 252429

SEQ ID NO: 254099 - RNA, 62 nt, Human; identical to SEQ ID NO: 252430

SEQ ID NO: 254100 - RNA, 62 nt, Human; identical to SEQ ID NO: 252431

SEQ ID NO: 254101 - RNA, 62 nt, Human; identical to SEQ ID NO: 252432

SEQ ID NO: 254102 - RNA, 62 nt, Human; identical to SEQ ID NO: 252433

SEQ ID NO: 254103 - RNA, 62 nt, Human; identical to SEQ ID NO: 252434

SEQ ID NO: 254104 - RNA, 62 nt, Human; identical to SEQ ID NO: 252435

SEQ ID NO: 254105 - RNA, 62 nt, Human; identical to SEQ ID NO: 252436

SEQ ID NO: 254106 - RNA, 62 nt, Human; identical to SEQ ID NO: 252441

SEQ ID NO: 254107 - RNA, 62 nt, Human; identical to SEQ ID NO: 252442

SEQ ID NO: 254108 - RNA, 62 nt, Human; identical to SEQ ID NO: 252443

SEQ ID NO: 254109 - RNA, 62 nt, Human; identical to SEQ ID NO: 252444

SEQ ID NO: 254110 - RNA, 62 nt, Human
aagcauuucgaaccugcgcaacagaccaaagaacaguacaaagaacauccguguacccagua

SEQ ID NO: 254111 - RNA, 62 nt, Human
acaccgugaaucuaauaagguucacuguugacacaguacaaguuacauagcuaaaauacaua

SEQ ID NO: 254112 - RNA, 62 nt, Human
agucuucagguuaaagauacuucuaacagguuacaguacauuuccucuguauguaaauuaga

SEQ ID NO: 254113 - RNA, 62 nt, Human
ccgcuugcugugaaagcacagauucauugacuacaguacacuguuguucagaaaagaaggcu

SEQ ID NO: 254114 - RNA, 62 nt, Human; identical to SEQ ID NO: 252445

SEQ ID NO: 254115 - RNA, 62 nt, Human; identical to SEQ ID NO: 252446

SEQ ID NO: 254116 - RNA, 62 nt, Human; identical to SEQ ID NO: 252447

SEQ ID NO: 254117 - RNA, 62 nt, Human; identical to SEQ ID NO: 252448

SEQ ID NO: 254118 - RNA, 62 nt, Human; identical to SEQ ID NO: 252449

SEQ ID NO: 254119 - RNA, 62 nt, Human; identical to SEQ ID NO: 252434

SEQ ID NO: 254120 - RNA, 62 nt, Human; identical to SEQ ID NO: 252451

SEQ ID NO: 254121 - RNA, 62 nt, Human; identical to SEQ ID NO: 252452

SEQ ID NO: 254122 - RNA, 62 nt, Human; identical to SEQ ID NO: 252453

SEQ ID NO: 254123 - RNA, 62 nt, Human; identical to SEQ ID NO: 252457

SEQ ID NO: 254124 - RNA, 62 nt, Human; identical to SEQ ID NO: 252477

SEQ ID NO: 254125 - RNA, 62 nt, Human; identical to SEQ ID NO: 252478

SEQ ID NO: 254126 - RNA, 62 nt, Human; identical to SEQ ID NO: 252479

SEQ ID NO: 254127 - RNA, 62 nt, Human
guuguugaaucaacaguacucagcauauuaaaacaguacaucagaacucaugccaacagucu

SEQ ID NO: 254128 - RNA, 62 nt, Human
acauuuuguauguuuuuguaaacaguucauauacaguacauuucuguacugcuuucuuuaau

SEQ ID NO: 254129 - RNA, 62 nt, Human
uuuguauccuccauuguaucuucauacaaaggacaguacacacuuggguaauuaaaaauaaa

SEQ ID NO: 254130 - RNA, 62 nt, Human; identical to SEQ ID NO: 252480

SEQ ID NO: 254131 - RNA, 62 nt, Human; identical to SEQ ID NO: 252481

SEQ ID NO: 254132 - RNA, 62 nt, Human; identical to SEQ ID NO: 252482

SEQ ID NO: 254133 - RNA, 62 nt, Human; identical to SEQ ID NO: 252483

SEQ ID NO: 254134 - RNA, 62 nt, Human; identical to SEQ ID NO: 252484

SEQ ID NO: 254135 - RNA, 62 nt, Human; identical to SEQ ID NO: 252485

SEQ ID NO: 254136 - RNA, 62 nt, Human; identical to SEQ ID NO: 252486

SEQ ID NO: 254137 - RNA, 62 nt, Human; identical to SEQ ID NO: 252487

SEQ ID NO: 254138 - RNA, 62 nt, Human; identical to SEQ ID NO: 252488

SEQ ID NO: 254139 - RNA, 62 nt, Human; identical to SEQ ID NO: 252489

SEQ ID NO: 254140 - RNA, 62 nt, Human; identical to SEQ ID NO: 252493

SEQ ID NO: 254141 - RNA, 62 nt, Human; identical to SEQ ID NO: 252494

SEQ ID NO: 254142 - RNA, 62 nt, Human; identical to SEQ ID NO: 252495

SEQ ID NO: 254143 - RNA, 62 nt, Human
auuccuauuuaggagccaaggaguacuuuggaacaguacaaauauauugcuuuaaauuggaa

SEQ ID NO: 254144 - RNA, 62 nt, Human
aagcauuucacuucuccaagaaguaccugugaacaguacaauauuucaguauugagcuuugc

SEQ ID NO: 254145 - RNA, 62 nt, Human; identical to SEQ ID NO: 254144

SEQ ID NO: 254146 - RNA, 62 nt, Human; identical to SEQ ID NO: 252496

SEQ ID NO: 254147 - RNA, 62 nt, Human; identical to SEQ ID NO: 252497

SEQ ID NO: 254148 - RNA, 62 nt, Human; identical to SEQ ID NO: 252498

SEQ ID NO: 254149 - RNA, 62 nt, Human; identical to SEQ ID NO: 252499

SEQ ID NO: 254150 - RNA, 62 nt, Human; identical to SEQ ID NO: 252500

SEQ ID NO: 254151 - RNA, 62 nt, Human; identical to SEQ ID NO: 252501

SEQ ID NO: 254152 - RNA, 62 nt, Human; identical to SEQ ID NO: 252502

SEQ ID NO: 254153 - RNA, 62 nt, Human; identical to SEQ ID NO: 252503

SEQ ID NO: 254154 - RNA, 62 nt, Human; identical to SEQ ID NO: 252504

SEQ ID NO: 254155 - RNA, 62 nt, Human; identical to SEQ ID NO: 252505

SEQ ID NO: 254156 - RNA, 62 nt, Human; identical to SEQ ID NO: 252510

SEQ ID NO: 254157 - RNA, 62 nt, Human; identical to SEQ ID NO: 252511

SEQ ID NO: 254158 - RNA, 62 nt, Human; identical to SEQ ID NO: 252512

SEQ ID NO: 254159 - RNA, 62 nt, Human
augugcacugaccacaccuguauagaccaugcacaguacacauacgugcauacacaugccug

SEQ ID NO: 254160 - RNA, 62 nt, Human
ugcuggagaaaaauaucuguaagaguguuuauacaguacacuucaguuaucuugaucucccu

SEQ ID NO: 254161 - RNA, 64 nt, Human; identical to SEQ ID NO: 206284

SEQ ID NO: 254162 - RNA, 62 nt, Human; identical to SEQ ID NO: 252513

SEQ ID NO: 254163 - RNA, 62 nt, Human; identical to SEQ ID NO: 252514

SEQ ID NO: 254164 - RNA, 62 nt, Human; identical to SEQ ID NO: 252515

SEQ ID NO: 254165 - RNA, 62 nt, Human; identical to SEQ ID NO: 252516

SEQ ID NO: 254166 - RNA, 62 nt, Human; identical to SEQ ID NO: 252517

SEQ ID NO: 254167 - RNA, 62 nt, Human; identical to SEQ ID NO: 252518

SEQ ID NO: 254168 - RNA, 62 nt, Human; identical to SEQ ID NO: 252519

SEQ ID NO: 254169 - RNA, 62 nt, Human; identical to SEQ ID NO: 252520

SEQ ID NO: 254170 - RNA, 62 nt, Human; identical to SEQ ID NO: 252521

SEQ ID NO: 254171 - RNA, 62 nt, Human; identical to SEQ ID NO: 252522

SEQ ID NO: 254172 - RNA, 62 nt, Human; identical to SEQ ID NO: 252526

SEQ ID NO: 254173 - RNA, 62 nt, Human; identical to SEQ ID NO: 252527

SEQ ID NO: 254174 - RNA, 62 nt, Human; identical to SEQ ID NO: 252528

SEQ ID NO: 254175 - RNA, 62 nt, Human
ugcuguuauaaaguauuugucuauuuaugauaacaguacacguguucugcuugaauuuacua

SEQ ID NO: 254176 - RNA, 62 nt, Human
uaacaagggcugcaaugcccucauacccaugcacaguacaauaauguacucacauauaacau

SEQ ID NO: 254177 - RNA, 62 nt, Human
accucagguuccaaauucaguaaauuuuggaaacaguacagcuauuucucaucaauucucua

SEQ ID NO: 254178 - RNA, 62 nt, Human; identical to SEQ ID NO: 252529

SEQ ID NO: 254179 - RNA, 62 nt, Human; identical to SEQ ID NO: 252530

SEQ ID NO: 254180 - RNA, 62 nt, Human; identical to SEQ ID NO: 252531

SEQ ID NO: 254181 - RNA, 62 nt, Human; identical to SEQ ID NO: 252532

SEQ ID NO: 254182 - RNA, 62 nt, Human; identical to SEQ ID NO: 252533

SEQ ID NO: 254183 - RNA, 62 nt, Human; identical to SEQ ID NO: 252534

SEQ ID NO: 254184 - RNA, 62 nt, Human; identical to SEQ ID NO: 252535

SEQ ID NO: 254185 - RNA, 62 nt, Human; identical to SEQ ID NO: 252536

SEQ ID NO: 254186 - RNA, 62 nt, Human; identical to SEQ ID NO: 252537

SEQ ID NO: 254187 - RNA, 62 nt, Human; identical to SEQ ID NO: 252538

SEQ ID NO: 254188 - RNA, 62 nt, Human; identical to SEQ ID NO: 252542

SEQ ID NO: 254189 - RNA, 62 nt, Human; identical to SEQ ID NO: 252543

SEQ ID NO: 254190 - RNA, 62 nt, Human; identical to SEQ ID NO: 252544

SEQ ID NO: 254191 - RNA, 62 nt, Human
ccaccguaguauuuauaguuaaauuaagggugacaguacaauaaagugauggcgauguagac

SEQ ID NO: 254192 - RNA, 62 nt, Human
cuuaacagucacaaggugaaaagucaaaugaaacaguacaauucuugaugagugagguguca

SEQ ID NO: 254193 - RNA, 62 nt, Human
uucuaaauuuuaguaagagagaagcuuuuaaaacaguacauuccugaauaaaacaacaauau

SEQ ID NO: 254194 - RNA, 62 nt, Human
aaauaaaaccgaggguuguugauuuugcugugacaguacacuaaaucaauacuauaucuuau

SEQ ID NO: 254195 - RNA, 62 nt, Human; identical to SEQ ID NO: 252545

SEQ ID NO: 254196 - RNA, 62 nt, Human; identical to SEQ ID NO: 252546

SEQ ID NO: 254197 - RNA, 62 nt, Human; identical to SEQ ID NO: 252547

SEQ ID NO: 254198 - RNA, 62 nt, Human; identical to SEQ ID NO: 252548

SEQ ID NO: 254199 - RNA, 62 nt, Human; identical to SEQ ID NO: 252549

SEQ ID NO: 254200 - RNA, 54 nt, Human; identical to SEQ ID NO: 252550

SEQ ID NO: 254201 - RNA, 62 nt, Human; identical to SEQ ID NO: 252551

SEQ ID NO: 254202 - RNA, 62 nt, Human; identical to SEQ ID NO: 252552

SEQ ID NO: 254203 - RNA, 62 nt, Human; identical to SEQ ID NO: 252553

SEQ ID NO: 254204 - RNA, 62 nt, Human; identical to SEQ ID NO: 252554

SEQ ID NO: 254205 - RNA, 62 nt, Human; identical to SEQ ID NO: 252558

SEQ ID NO: 254206 - RNA, 62 nt, Human; identical to SEQ ID NO: 252559

SEQ ID NO: 254207 - RNA, 62 nt, Human; identical to SEQ ID NO: 252560

SEQ ID NO: 254208 - RNA, 62 nt, Human
acguauguaugcauugguuugcuuguuucuugacaguacauuuuuagaucuggccuuuucuu

SEQ ID NO: 254209 - RNA, 62 nt, Human
aaccacugccacugucuugugucagaacuuuuacaguacagaaaauaacagaauagccuucu

SEQ ID NO: 254210 - RNA, 62 nt, Human
cuugcucaguuuggagccacugcucaccucaaacaguacaaagaaagugguuccauauuuua

SEQ ID NO: 254211 - RNA, 62 nt, Human; identical to SEQ ID NO: 252561

SEQ ID NO: 254212 - RNA, 62 nt, Human; identical to SEQ ID NO: 252562

SEQ ID NO: 254213 - RNA, 62 nt, Human; identical to SEQ ID NO: 252563

SEQ ID NO: 254214 - RNA, 62 nt, Human; identical to SEQ ID NO: 252564

SEQ ID NO: 254215 - RNA, 62 nt, Human; identical to SEQ ID NO: 252565

SEQ ID NO: 254216 - RNA, 62 nt, Human; identical to SEQ ID NO: 252566

SEQ ID NO: 254217 - RNA, 62 nt, Human; identical to SEQ ID NO: 252567

SEQ ID NO: 254218 - RNA, 62 nt, Human; identical to SEQ ID NO: 252568

SEQ ID NO: 254219 - RNA, 62 nt, Human; identical to SEQ ID NO: 252569

SEQ ID NO: 254220 - RNA, 62 nt, Human; identical to SEQ ID NO: 252570

SEQ ID NO: 254221 - RNA, 62 nt, Human; identical to SEQ ID NO: 252574

SEQ ID NO: 254222 - RNA, 62 nt, Human; identical to SEQ ID NO: 252575

SEQ ID NO: 254223 - RNA, 62 nt, Human; identical to SEQ ID NO: 252576

SEQ ID NO: 254224 - RNA, 62 nt, Human
augacaucuucccuccacccugccccugaaaaacaguacacacacauccguucaacacaaga

SEQ ID NO: 254225 - RNA, 62 nt, Human
aaaaagaaguacaagaguauaauaccuucaugacaguacagcugacucaauccggaccacgu

SEQ ID NO: 254226 - RNA, 62 nt, Human
cugccacaaaccaccaggacugaaagaagaaaacaguacagaaggcaaaguuuacagauguu

SEQ ID NO: 254227 - RNA, 62 nt, Human; identical to SEQ ID NO: 252577

SEQ ID NO: 254228 - RNA, 62 nt, Human; identical to SEQ ID NO: 252578

SEQ ID NO: 254229 - RNA, 62 nt, Human; identical to SEQ ID NO: 252579

SEQ ID NO: 254230 - RNA, 62 nt, Human; identical to SEQ ID NO: 252580

SEQ ID NO: 254231 - RNA, 62 nt, Human; identical to SEQ ID NO: 252581

SEQ ID NO: 254232 - RNA, 62 nt, Human; identical to SEQ ID NO: 252582

SEQ ID NO: 254233 - RNA, 62 nt, Human; identical to SEQ ID NO: 252583

SEQ ID NO: 254234 - RNA, 62 nt, Human; identical to SEQ ID NO: 252584

SEQ ID NO: 254235 - RNA, 62 nt, Human; identical to SEQ ID NO: 252585

SEQ ID NO: 254236 - RNA, 62 nt, Human; identical to SEQ ID NO: 252586

SEQ ID NO: 254237 - RNA, 62 nt, Human; identical to SEQ ID NO: 252590

SEQ ID NO: 254238 - RNA, 62 nt, Human; identical to SEQ ID NO: 252591

SEQ ID NO: 254239 - RNA, 62 nt, Human; identical to SEQ ID NO: 252592

SEQ ID NO: 254240 - RNA, 64 nt, Human; identical to SEQ ID NO: 206281

SEQ ID NO: 254241 - RNA, 64 nt, Human; identical to SEQ ID NO: 206282

SEQ ID NO: 254242 - RNA, 64 nt, Human; identical to SEQ ID NO: 206283

SEQ ID NO: 254243 - RNA, 62 nt, Human; identical to SEQ ID NO: 252593

SEQ ID NO: 254244 - RNA, 62 nt, Human; identical to SEQ ID NO: 252594

SEQ ID NO: 254245 - RNA, 62 nt, Human; identical to SEQ ID NO: 252595

SEQ ID NO: 254246 - RNA, 62 nt, Human; identical to SEQ ID NO: 252596

SEQ ID NO: 254247 - RNA, 62 nt, Human; identical to SEQ ID NO: 252597

SEQ ID NO: 254248 - RNA, 62 nt, Human; identical to SEQ ID NO: 252598

SEQ ID NO: 254249 - RNA, 62 nt, Human; identical to SEQ ID NO: 252599

SEQ ID NO: 254250 - RNA, 62 nt, Human; identical to SEQ ID NO: 252600

SEQ ID NO: 254251 - RNA, 62 nt, Human; identical to SEQ ID NO: 252601

SEQ ID NO: 254252 - RNA, 62 nt, Human; identical to SEQ ID NO: 252602

SEQ ID NO: 254253 - RNA, 62 nt, Human; identical to SEQ ID NO: 252606

SEQ ID NO: 254254 - RNA, 62 nt, Human; identical to SEQ ID NO: 252607

SEQ ID NO: 254255 - RNA, 62 nt, Human; identical to SEQ ID NO: 252608

SEQ ID NO: 254256 - RNA, 62 nt, Human
uaccacucuuggucagcuuuuguuguuuauauacaguacacagauaccuugaaaggaagagc

SEQ ID NO: 254257 - RNA, 62 nt, Human
acauguuuuaaauuaaauucggguaauauuaaacaguacauguuuacaauaccaaaaaagaa

SEQ ID NO: 254258 - RNA, 59 nt, Human; identical to SEQ ID NO: 206348

SEQ ID NO: 254259 - RNA, 53 nt, Human; identical to SEQ ID NO: 206232

SEQ ID NO: 254260 - RNA, 62 nt, Human; identical to SEQ ID NO: 252609

SEQ ID NO: 254261 - RNA, 62 nt, Human; identical to SEQ ID NO: 252610

SEQ ID NO: 254262 - RNA, 62 nt, Human; identical to SEQ ID NO: 252611

SEQ ID NO: 254263 - RNA, 62 nt, Human; identical to SEQ ID NO: 252612

SEQ ID NO: 254264 - RNA, 62 nt, Human; identical to SEQ ID NO: 252613

SEQ ID NO: 254265 - RNA, 62 nt, Human; identical to SEQ ID NO: 252614

SEQ ID NO: 254266 - RNA, 62 nt, Human; identical to SEQ ID NO: 252615

SEQ ID NO: 254267 - RNA, 62 nt, Human; identical to SEQ ID NO: 252616

SEQ ID NO: 254268 - RNA, 62 nt, Human; identical to SEQ ID NO: 252617

SEQ ID NO: 254269 - RNA, 62 nt, Human; identical to SEQ ID NO: 252618

SEQ ID NO: 254270 - RNA, 62 nt, Human; identical to SEQ ID NO: 252622

SEQ ID NO: 254271 - RNA, 62 nt, Human; identical to SEQ ID NO: 252623

SEQ ID NO: 254272 - RNA, 62 nt, Human; identical to SEQ ID NO: 252624

SEQ ID NO: 254273 - RNA, 62 nt, Human
aaguaaagcaaagaagcuauaacauguuauguacaguacacucugaaaagaaaucugaaaca

SEQ ID NO: 254274 - RNA, 64 nt, Human; identical to SEQ ID NO: 206286

SEQ ID NO: 254275 - RNA, 64 nt, Human; identical to SEQ ID NO: 206287

SEQ ID NO: 254276 - RNA, 62 nt, Human; identical to SEQ ID NO: 252625

SEQ ID NO: 254277 - RNA, 62 nt, Human; identical to SEQ ID NO: 252626

SEQ ID NO: 254278 - RNA, 62 nt, Human; identical to SEQ ID NO: 252627

SEQ ID NO: 254279 - RNA, 62 nt, Human; identical to SEQ ID NO: 252628

SEQ ID NO: 254280 - RNA, 62 nt, Human; identical to SEQ ID NO: 252629

SEQ ID NO: 254281 - RNA, 62 nt, Human; identical to SEQ ID NO: 252630

SEQ ID NO: 254282 - RNA, 62 nt, Human; identical to SEQ ID NO: 252631

SEQ ID NO: 254283 - RNA, 62 nt, Human; identical to SEQ ID NO: 252632

SEQ ID NO: 254284 - RNA, 62 nt, Human; identical to SEQ ID NO: 252633

SEQ ID NO: 254285 - RNA, 62 nt, Human; identical to SEQ ID NO: 252634

SEQ ID NO: 254286 - RNA, 62 nt, Human; identical to SEQ ID NO: 252638

SEQ ID NO: 254287 - RNA, 62 nt, Human; identical to SEQ ID NO: 252639

SEQ ID NO: 254288 - RNA, 62 nt, Human; identical to SEQ ID NO: 252640

SEQ ID NO: 254289 - RNA, 62 nt, Human
uauaccauugaucuuuuuugcuauauuuguauacaguacaguaagcacaauuggcacuguac

SEQ ID NO: 254290 - RNA, 64 nt, Human; identical to SEQ ID NO: 206288

SEQ ID NO: 254291 - RNA, 64 nt, Human; identical to SEQ ID NO: 206293

SEQ ID NO: 254292 - RNA, 62 nt, Human; identical to SEQ ID NO: 252641

SEQ ID NO: 254293 - RNA, 62 nt, Human; identical to SEQ ID NO: 252642

SEQ ID NO: 254294 - RNA, 62 nt, Human; identical to SEQ ID NO: 252643

SEQ ID NO: 254295 - RNA, 62 nt, Human; identical to SEQ ID NO: 252644

SEQ ID NO: 254296 - RNA, 62 nt, Human; identical to SEQ ID NO: 252645

SEQ ID NO: 254297 - RNA, 62 nt, Human; identical to SEQ ID NO: 252646

SEQ ID NO: 254298 - RNA, 62 nt, Human; identical to SEQ ID NO: 252647

SEQ ID NO: 254299 - RNA, 62 nt, Human; identical to SEQ ID NO: 252648

SEQ ID NO: 254300 - RNA, 62 nt, Human; identical to SEQ ID NO: 252649

SEQ ID NO: 254301 - RNA, 62 nt, Human; identical to SEQ ID NO: 252650

SEQ ID NO: 254302 - RNA, 62 nt, Human; identical to SEQ ID NO: 252654

SEQ ID NO: 254303 - RNA, 62 nt, Human; identical to SEQ ID NO: 252655

SEQ ID NO: 254304 - RNA, 62 nt, Human; identical to SEQ ID NO: 252656

SEQ ID NO: 254305 - RNA, 64 nt, Human; identical to SEQ ID NO: 206359

SEQ ID NO: 254306 - RNA, 64 nt, Human; identical to SEQ ID NO: 206360

SEQ ID NO: 254307 - RNA, 64 nt, Human; identical to SEQ ID NO: 206361

SEQ ID NO: 254308 - RNA, 62 nt, Human; identical to SEQ ID NO: 252657

SEQ ID NO: 254309 - RNA, 62 nt, Human; identical to SEQ ID NO: 252658

SEQ ID NO: 254310 - RNA, 62 nt, Human; identical to SEQ ID NO: 252659

SEQ ID NO: 254311 - RNA, 62 nt, Human; identical to SEQ ID NO: 252660

SEQ ID NO: 254312 - RNA, 62 nt, Human; identical to SEQ ID NO: 252661

SEQ ID NO: 254313 - RNA, 62 nt, Human; identical to SEQ ID NO: 252662

SEQ ID NO: 254314 - RNA, 62 nt, Human; identical to SEQ ID NO: 252663

SEQ ID NO: 254315 - RNA, 62 nt, Human; identical to SEQ ID NO: 252664

SEQ ID NO: 254316 - RNA, 62 nt, Human; identical to SEQ ID NO: 252665

SEQ ID NO: 254317 - RNA, 62 nt, Human; identical to SEQ ID NO: 252666

SEQ ID NO: 254318 - RNA, 62 nt, Human; identical to SEQ ID NO: 252670

SEQ ID NO: 254319 - RNA, 62 nt, Human; identical to SEQ ID NO: 252671

SEQ ID NO: 254320 - RNA, 62 nt, Human; identical to SEQ ID NO: 252672

SEQ ID NO: 254321 - RNA, 62 nt, Human
ugcagaaaccuuuucaccuccacuagucugauacaguacaucuguacuuccauauaccuugc

SEQ ID NO: 254322 - RNA, 64 nt, Human; identical to SEQ ID NO: 206296

SEQ ID NO: 254323 - RNA, 64 nt, Human; identical to SEQ ID NO: 206297

SEQ ID NO: 254324 - RNA, 62 nt, Human; identical to SEQ ID NO: 252673

SEQ ID NO: 254325 - RNA, 62 nt, Human; identical to SEQ ID NO: 252674

SEQ ID NO: 254326 - RNA, 62 nt, Human; identical to SEQ ID NO: 252675

SEQ ID NO: 254327 - RNA, 62 nt, Human; identical to SEQ ID NO: 252676

SEQ ID NO: 254328 - RNA, 62 nt, Human; identical to SEQ ID NO: 252677

SEQ ID NO: 254329 - RNA, 62 nt, Human; identical to SEQ ID NO: 252678

SEQ ID NO: 254330 - RNA, 62 nt, Human; identical to SEQ ID NO: 252679

SEQ ID NO: 254331 - RNA, 62 nt, Human; identical to SEQ ID NO: 252680

SEQ ID NO: 254332 - RNA, 62 nt, Human; identical to SEQ ID NO: 252681

SEQ ID NO: 254333 - RNA, 62 nt, Human; identical to SEQ ID NO: 252682

SEQ ID NO: 254334 - RNA, 62 nt, Human; identical to SEQ ID NO: 252686

SEQ ID NO: 254335 - RNA, 62 nt, Human; identical to SEQ ID NO: 252687

SEQ ID NO: 254336 - RNA, 62 nt, Human; identical to SEQ ID NO: 252688

SEQ ID NO: 254337 - RNA, 62 nt, Human
ugugguagacaccugcacgcauaggauugaagacaguacaggcugcuguacagagaagcgcc

SEQ ID NO: 254338 - RNA, 62 nt, Human
ggaggcagacauacaccagaaaugggggagaaacaguacauaucuuucugucuuuaguuuau

SEQ ID NO: 254339 - RNA, 62 nt, Human
uauauauuauuuuuaaaaauuagcauugucauacaguacaauucuuagugaaguguauugug

SEQ ID NO: 254340 - RNA, 62 nt, Human
uagcuaugacuuuguuacaacuguucuuauccacaguacaaaaaugguuuguuuuuaauaug

SEQ ID NO: 254341 - RNA, 62 nt, Human; identical to SEQ ID NO: 252689

SEQ ID NO: 254342 - RNA, 62 nt, Human; identical to SEQ ID NO: 252690

SEQ ID NO: 254343 - RNA, 62 nt, Human; identical to SEQ ID NO: 252691

SEQ ID NO: 254344 - RNA, 62 nt, Human; identical to SEQ ID NO: 252692

SEQ ID NO: 254345 - RNA, 62 nt, Human; identical to SEQ ID NO: 252693

SEQ ID NO: 254346 - RNA, 62 nt, Human; identical to SEQ ID NO: 252694

SEQ ID NO: 254347 - RNA, 62 nt, Human; identical to SEQ ID NO: 252695

SEQ ID NO: 254348 - RNA, 62 nt, Human; identical to SEQ ID NO: 252696

SEQ ID NO: 254349 - RNA, 62 nt, Human; identical to SEQ ID NO: 252697

SEQ ID NO: 254350 - RNA, 62 nt, Human; identical to SEQ ID NO: 252698

SEQ ID NO: 254351 - RNA, 62 nt, Human; identical to SEQ ID NO: 252703

SEQ ID NO: 254352 - RNA, 62 nt, Human; identical to SEQ ID NO: 252704

SEQ ID NO: 254353 - RNA, 62 nt, Human; identical to SEQ ID NO: 252705

SEQ ID NO: 254354 - RNA, 62 nt, Human
cucugguuagaaaaaggacucugcuucaguccacaguacauaaaauguacucagguaggaca

SEQ ID NO: 254355 - RNA, 62 nt, Human
ccuggacuacagacucuguugccuugaauauaacaguacaauuugucaauuacucugcacca

SEQ ID NO: 254356 - RNA, 62 nt, Human
aguccuccagggggagcugggguugcagggcaacaguacagucgcgcuuacgaccuggcuag

SEQ ID NO: 254357 - RNA, 62 nt, Human; identical to SEQ ID NO: 252706

SEQ ID NO: 254358 - RNA, 62 nt, Human; identical to SEQ ID NO: 252707

SEQ ID NO: 254359 - RNA, 62 nt, Human; identical to SEQ ID NO: 252708

SEQ ID NO: 254360 - RNA, 62 nt, Human; identical to SEQ ID NO: 252709

SEQ ID NO: 254361 - RNA, 60 nt, Human; identical to SEQ ID NO: 252710

SEQ ID NO: 254362 - RNA, 62 nt, Human; identical to SEQ ID NO: 252711

SEQ ID NO: 254363 - RNA, 62 nt, Human; identical to SEQ ID NO: 252712

SEQ ID NO: 254364 - RNA, 62 nt, Human; identical to SEQ ID NO: 252713

SEQ ID NO: 254365 - RNA, 62 nt, Human; identical to SEQ ID NO: 252714

SEQ ID NO: 254366 - RNA, 62 nt, Human; identical to SEQ ID NO: 252715

SEQ ID NO: 254367 - RNA, 62 nt, Human; identical to SEQ ID NO: 252719

SEQ ID NO: 254368 - RNA, 62 nt, Human; identical to SEQ ID NO: 252720

SEQ ID NO: 254369 - RNA, 62 nt, Human; identical to SEQ ID NO: 252721

SEQ ID NO: 254370 - RNA, 62 nt, Human
auucugagaaaucuuuagagagaaaaaacucaacaguacaaauuaacuaauugggaaaguua

SEQ ID NO: 254371 - RNA, 62 nt, Human
uuaaaacuuauuuugcaauuaauacguauuuuacaguacacuaauaugcauauauguuguau

SEQ ID NO: 254372 - RNA, 62 nt, Human
acagaauccaaagguuuacucugguuauaaaaacaguacaauaaaauauuguuuauagccuu

SEQ ID NO: 254373 - RNA, 62 nt, Human; identical to SEQ ID NO: 252722

SEQ ID NO: 254374 - RNA, 62 nt, Human; identical to SEQ ID NO: 252723

SEQ ID NO: 254375 - RNA, 62 nt, Human; identical to SEQ ID NO: 252724

SEQ ID NO: 254376 - RNA, 62 nt, Human; identical to SEQ ID NO: 252725

SEQ ID NO: 254377 - RNA, 62 nt, Human; identical to SEQ ID NO: 252726

SEQ ID NO: 254378 - RNA, 62 nt, Human; identical to SEQ ID NO: 252727

SEQ ID NO: 254379 - RNA, 62 nt, Human; identical to SEQ ID NO: 252728

SEQ ID NO: 254380 - RNA, 62 nt, Human; identical to SEQ ID NO: 252729

SEQ ID NO: 254381 - RNA, 62 nt, Human; identical to SEQ ID NO: 252730

SEQ ID NO: 254382 - RNA, 62 nt, Human; identical to SEQ ID NO: 252731

SEQ ID NO: 254383 - RNA, 62 nt, Human; identical to SEQ ID NO: 252735

SEQ ID NO: 254384 - RNA, 62 nt, Human; identical to SEQ ID NO: 252736

SEQ ID NO: 254385 - RNA, 62 nt, Human; identical to SEQ ID NO: 252737

SEQ ID NO: 254386 - RNA, 64 nt, Human; identical to SEQ ID NO: 206279

SEQ ID NO: 254387 - RNA, 64 nt, Human; identical to SEQ ID NO: 206300

SEQ ID NO: 254388 - RNA, 64 nt, Human; identical to SEQ ID NO: 206301

SEQ ID NO: 254389 - RNA, 62 nt, Human; identical to SEQ ID NO: 252738

SEQ ID NO: 254390 - RNA, 62 nt, Human; identical to SEQ ID NO: 252739

SEQ ID NO: 254391 - RNA, 62 nt, Human; identical to SEQ ID NO: 252740

SEQ ID NO: 254392 - RNA, 62 nt, Human; identical to SEQ ID NO: 252741

SEQ ID NO: 254393 - RNA, 62 nt, Human; identical to SEQ ID NO: 252742

SEQ ID NO: 254394 - RNA, 62 nt, Human; identical to SEQ ID NO: 252743

SEQ ID NO: 254395 - RNA, 62 nt, Human; identical to SEQ ID NO: 252744

SEQ ID NO: 254396 - RNA, 62 nt, Human; identical to SEQ ID NO: 252745

SEQ ID NO: 254397 - RNA, 62 nt, Human; identical to SEQ ID NO: 252746

SEQ ID NO: 254398 - RNA, 62 nt, Human; identical to SEQ ID NO: 252747

SEQ ID NO: 254399 - RNA, 62 nt, Human; identical to SEQ ID NO: 252751

SEQ ID NO: 254400 - RNA, 62 nt, Human; identical to SEQ ID NO: 252752

SEQ ID NO: 254401 - RNA, 62 nt, Human; identical to SEQ ID NO: 252753

SEQ ID NO: 254402 - RNA, 62 nt, Human
ucaggggcuccagcauccgagcuggcgaggaaacaguacagggucugaguucugaauggaga

SEQ ID NO: 254403 - RNA, 62 nt, Human
uauaauucugggagaaagaaucuuuuauaagaacaguacagauuguucucaagagggccauc

SEQ ID NO: 254404 - RNA, 62 nt, Human
aaagaagagauaaacaaggaauauuuugucaaacaguacacaauaauuuaaagagaauguau

SEQ ID NO: 254405 - RNA, 62 nt, Human; identical to SEQ ID NO: 252754

SEQ ID NO: 254406 - RNA, 62 nt, Human; identical to SEQ ID NO: 252755

SEQ ID NO: 254407 - RNA, 62 nt, Human; identical to SEQ ID NO: 252756

SEQ ID NO: 254408 - RNA, 62 nt, Human; identical to SEQ ID NO: 252757

SEQ ID NO: 254409 - RNA, 62 nt, Human; identical to SEQ ID NO: 252758

SEQ ID NO: 254410 - RNA, 62 nt, Human; identical to SEQ ID NO: 252759

SEQ ID NO: 254411 - RNA, 62 nt, Human; identical to SEQ ID NO: 252760

SEQ ID NO: 254412 - RNA, 62 nt, Human; identical to SEQ ID NO: 252761

SEQ ID NO: 254413 - RNA, 62 nt, Human; identical to SEQ ID NO: 252762

SEQ ID NO: 254414 - RNA, 62 nt, Human; identical to SEQ ID NO: 252763

SEQ ID NO: 254415 - RNA, 62 nt, Human; identical to SEQ ID NO: 252767

SEQ ID NO: 254416 - RNA, 62 nt, Human; identical to SEQ ID NO: 252768

SEQ ID NO: 254417 - RNA, 62 nt, Human; identical to SEQ ID NO: 252769

SEQ ID NO: 254418 - RNA, 62 nt, Human
acaacuuguaaaaaugcaauuuaaauuuuaauacaguacauuuuucuucuaauaugauggag

SEQ ID NO: 254419 - RNA, 62 nt, Human
uauaaucacaauuuaauaauuuaucaaugcaaacaguacauuaaaaacuguagcacaaucua

SEQ ID NO: 254420 - RNA, 62 nt, Human
auuucuguggaggguugccaugguaaccagccacaguacauauguaauucuuuccaucaccc

SEQ ID NO: 254421 - RNA, 62 nt, Human
acuaugacagcaucaaauuucaggaccugcagacaguacaggcuagauaacccacccaauuu

SEQ ID NO: 254422 - RNA, 64 nt, Human; identical to SEQ ID NO: 252770

SEQ ID NO: 254423 - RNA, 64 nt, Human; identical to SEQ ID NO: 252771

SEQ ID NO: 254424 - RNA, 64 nt, Human; identical to SEQ ID NO: 252772

SEQ ID NO: 254425 - RNA, 64 nt, Human; identical to SEQ ID NO: 252773

SEQ ID NO: 254426 - RNA, 64 nt, Human; identical to SEQ ID NO: 252774

SEQ ID NO: 254427 - RNA, 64 nt, Human; identical to SEQ ID NO: 252775

SEQ ID NO: 254428 - RNA, 64 nt, Human; identical to SEQ ID NO: 252779

SEQ ID NO: 254429 - RNA, 64 nt, Human; identical to SEQ ID NO: 252780

SEQ ID NO: 254430 - RNA, 64 nt, Human; identical to SEQ ID NO: 252781

SEQ ID NO: 254431 - RNA, 62 nt, Human
agguuuuauuacuguuauauacuauacuuuuaacaguacagacccuaaauuuuauuauuugu

SEQ ID NO: 254432 - RNA, 62 nt, Human
auuaagauuacagaugcuuugggcccccucaaacaguacauugcuacaguucacuguagcaa

SEQ ID NO: 254433 - RNA, 62 nt, Human
aaaguuuaaaauauuuuguaaauauggacugcacaguacaggguagaaaacuacauauugug

SEQ ID NO: 254434 - RNA, 64 nt, Human; identical to SEQ ID NO: 252782

SEQ ID NO: 254435 - RNA, 64 nt, Human; identical to SEQ ID NO: 252783

SEQ ID NO: 254436 - RNA, 64 nt, Human; identical to SEQ ID NO: 252784

SEQ ID NO: 254437 - RNA, 64 nt, Human; identical to SEQ ID NO: 252785

SEQ ID NO: 254438 - RNA, 64 nt, Human; identical to SEQ ID NO: 252786

SEQ ID NO: 254439 - RNA, 64 nt, Human; identical to SEQ ID NO: 252787

SEQ ID NO: 254440 - RNA, 64 nt, Human; identical to SEQ ID NO: 252788

SEQ ID NO: 254441 - RNA, 64 nt, Human; identical to SEQ ID NO: 252789

SEQ ID NO: 254442 - RNA, 64 nt, Human; identical to SEQ ID NO: 252790

SEQ ID NO: 254443 - RNA, 64 nt, Human; identical to SEQ ID NO: 252791

SEQ ID NO: 254444 - RNA, 64 nt, Human; identical to SEQ ID NO: 252795

SEQ ID NO: 254445 - RNA, 64 nt, Human; identical to SEQ ID NO: 252796

SEQ ID NO: 254446 - RNA, 64 nt, Human; identical to SEQ ID NO: 252797

SEQ ID NO: 254447 - RNA, 62 nt, Human
cucagcugcuccgaagcaccugccagcaccgcacaguacaguuucagaggacagcagucucc

SEQ ID NO: 254448 - RNA, 62 nt, Human
ccaaauucuguggcugccaucagaaauuuucuacaguacaugacccggaugaacucaaugca

SEQ ID NO: 254449 - RNA, 62 nt, Human
aagguucuccacugcuuaccuuuuccagugggacaguacagugugagcccccgggaaguacu

SEQ ID NO: 254450 - RNA, 64 nt, Human; identical to SEQ ID NO: 252798

SEQ ID NO: 254451 - RNA, 64 nt, Human; identical to SEQ ID NO: 252799

SEQ ID NO: 254452 - RNA, 64 nt, Human; identical to SEQ ID NO: 252800

SEQ ID NO: 254453 - RNA, 64 nt, Human; identical to SEQ ID NO: 252801

SEQ ID NO: 254454 - RNA, 64 nt, Human; identical to SEQ ID NO: 252802

SEQ ID NO: 254455 - RNA, 64 nt, Human; identical to SEQ ID NO: 252803

SEQ ID NO: 254456 - RNA, 64 nt, Human; identical to SEQ ID NO: 252804

SEQ ID NO: 254457 - RNA, 64 nt, Human; identical to SEQ ID NO: 252805

SEQ ID NO: 254458 - RNA, 64 nt, Human; identical to SEQ ID NO: 252806

SEQ ID NO: 254459 - RNA, 64 nt, Human; identical to SEQ ID NO: 252807

SEQ ID NO: 254460 - RNA, 64 nt, Human; identical to SEQ ID NO: 252811

SEQ ID NO: 254461 - RNA, 64 nt, Human; identical to SEQ ID NO: 252812

SEQ ID NO: 254462 - RNA, 64 nt, Human; identical to SEQ ID NO: 252813

SEQ ID NO: 254463 - RNA, 62 nt, Human
aaaaacaucucaauuucuaauaccgguuguaaacaguacacaugucauuuugugauauagga

SEQ ID NO: 254464 - RNA, 62 nt, Human
uauucuagucuauuuguugaugcuugugucaaacaguacacuaucuuaauuauuguacauuu

SEQ ID NO: 254465 - RNA, 62 nt, Human
gcaugaaguagaaacacuuuuuuuuucuggguacaguacauggguaucggugcucuguauuu

SEQ ID NO: 254466 - RNA, 64 nt, Human; identical to SEQ ID NO: 252814

SEQ ID NO: 254467 - RNA, 64 nt, Human; identical to SEQ ID NO: 252815

SEQ ID NO: 254468 - RNA, 64 nt, Human; identical to SEQ ID NO: 252816

SEQ ID NO: 254469 - RNA, 64 nt, Human; identical to SEQ ID NO: 252817

SEQ ID NO: 254470 - RNA, 64 nt, Human; identical to SEQ ID NO: 252818

SEQ ID NO: 254471 - RNA, 64 nt, Human; identical to SEQ ID NO: 252819

SEQ ID NO: 254472 - RNA, 64 nt, Human; identical to SEQ ID NO: 252820

SEQ ID NO: 254473 - RNA, 64 nt, Human; identical to SEQ ID NO: 252821

SEQ ID NO: 254474 - RNA, 64 nt, Human; identical to SEQ ID NO: 252822

SEQ ID NO: 254475 - RNA, 64 nt, Human; identical to SEQ ID NO: 252823

SEQ ID NO: 254476 - RNA, 64 nt, Human; identical to SEQ ID NO: 252827

SEQ ID NO: 254477 - RNA, 64 nt, Human; identical to SEQ ID NO: 252828

SEQ ID NO: 254478 - RNA, 64 nt, Human; identical to SEQ ID NO: 252829

SEQ ID NO: 254479 - RNA, 62 nt, Human
gaaauaaaauauaugugcuuauuaaauaaugcacaguacacuagauuauagaguuuauuuuu

SEQ ID NO: 254480 - RNA, 62 nt, Human
acaggugcuuagucuuugccuuuguagcauuuacaguacagcuggagacccaugaugauuac

SEQ ID NO: 254481 - RNA, 62 nt, Human
ugagagaagugaagucacuuuuaugagguucaacaguacaggauggagccaggauuuuuauc

SEQ ID NO: 254482 - RNA, 64 nt, Human; identical to SEQ ID NO: 252830

SEQ ID NO: 254483 - RNA, 64 nt, Human; identical to SEQ ID NO: 252831

SEQ ID NO: 254484 - RNA, 64 nt, Human; identical to SEQ ID NO: 252832

SEQ ID NO: 254485 - RNA, 64 nt, Human; identical to SEQ ID NO: 252833

SEQ ID NO: 254486 - RNA, 64 nt, Human; identical to SEQ ID NO: 252834

SEQ ID NO: 254487 - RNA, 64 nt, Human; identical to SEQ ID NO: 252835

SEQ ID NO: 254488 - RNA, 64 nt, Human; identical to SEQ ID NO: 252836

SEQ ID NO: 254489 - RNA, 64 nt, Human; identical to SEQ ID NO: 252837

SEQ ID NO: 254490 - RNA, 64 nt, Human; identical to SEQ ID NO: 252838

SEQ ID NO: 254491 - RNA, 64 nt, Human; identical to SEQ ID NO: 252839

SEQ ID NO: 254492 - RNA, 64 nt, Human; identical to SEQ ID NO: 252843

SEQ ID NO: 254493 - RNA, 64 nt, Human; identical to SEQ ID NO: 252844

SEQ ID NO: 254494 - RNA, 64 nt, Human; identical to SEQ ID NO: 252845

SEQ ID NO: 254495 - RNA, 62 nt, Human
gccaagggcggccccugggaaaccgggcuucaacaguacaaggaaaagaaacuugcucuguu

SEQ ID NO: 254496 - RNA, 62 nt, Human
ugcaguuuucacccauggaaagcauuagucugacaguacaauguuuggauucuccuugauau

SEQ ID NO: 254497 - RNA, 62 nt, Human
uuaauaaaaaggcaccuauaaaacaggucaauacaguacaggcagcacagagacccccggaa

SEQ ID NO: 254498 - RNA, 64 nt, Human; identical to SEQ ID NO: 252846

SEQ ID NO: 254499 - RNA, 64 nt, Human; identical to SEQ ID NO: 252847

SEQ ID NO: 254500 - RNA, 64 nt, Human; identical to SEQ ID NO: 252848

SEQ ID NO: 254501 - RNA, 64 nt, Human; identical to SEQ ID NO: 252849

SEQ ID NO: 254502 - RNA, 64 nt, Human; identical to SEQ ID NO: 252850

SEQ ID NO: 254503 - RNA, 64 nt, Human; identical to SEQ ID NO: 252851

SEQ ID NO: 254504 - RNA, 64 nt, Human; identical to SEQ ID NO: 252852

SEQ ID NO: 254505 - RNA, 64 nt, Human; identical to SEQ ID NO: 252853

SEQ ID NO: 254506 - RNA, 64 nt, Human; identical to SEQ ID NO: 252854

SEQ ID NO: 254507 - RNA, 64 nt, Human; identical to SEQ ID NO: 252855

SEQ ID NO: 254508 - RNA, 64 nt, Human; identical to SEQ ID NO: 252859

SEQ ID NO: 254509 - RNA, 64 nt, Human; identical to SEQ ID NO: 252860

SEQ ID NO: 254510 - RNA, 64 nt, Human; identical to SEQ ID NO: 252861

SEQ ID NO: 254511 - RNA, 62 nt, Human
aaaagaaacucuaagguucccuccaguguuggacaguacaaaaacaaagcugcucuuguuag

SEQ ID NO: 254512 - RNA, 62 nt, Human
uauauaauguuucauguaccaagacccuuuucacaguacaauaaacagaucuauucauaaau

SEQ ID NO: 254513 - RNA, 62 nt, Human
uuuuaugaacugcauguauaaaugaaguuuauacaguacagugguucuacaaucuauuuauu

SEQ ID NO: 254514 - RNA, 64 nt, Human; identical to SEQ ID NO: 252862

SEQ ID NO: 254515 - RNA, 64 nt, Human; identical to SEQ ID NO: 252863

SEQ ID NO: 254516 - RNA, 64 nt, Human; identical to SEQ ID NO: 252864

SEQ ID NO: 254517 - RNA, 64 nt, Human; identical to SEQ ID NO: 252865

SEQ ID NO: 254518 - RNA, 64 nt, Human; identical to SEQ ID NO: 252866

SEQ ID NO: 254519 - RNA, 64 nt, Human; identical to SEQ ID NO: 252867

SEQ ID NO: 254520 - RNA, 64 nt, Human; identical to SEQ ID NO: 252868

SEQ ID NO: 254521 - RNA, 64 nt, Human; identical to SEQ ID NO: 252869

SEQ ID NO: 254522 - RNA, 64 nt, Human; identical to SEQ ID NO: 252870

SEQ ID NO: 254523 - RNA, 64 nt, Human; identical to SEQ ID NO: 252871

SEQ ID NO: 254524 - RNA, 64 nt, Human; identical to SEQ ID NO: 252875

SEQ ID NO: 254525 - RNA, 64 nt, Human; identical to SEQ ID NO: 252876

SEQ ID NO: 254526 - RNA, 64 nt, Human; identical to SEQ ID NO: 252877

SEQ ID NO: 254527 - RNA, 62 nt, Human
auugaccuugucucucauacuucaagaaaaggacaguacauugcuacauuacccuagaaagu

SEQ ID NO: 254528 - RNA, 62 nt, Human
ugggugucuaggaaucccaccagcuugucuuaacaguacaacagcuucuuugaggacccagu

SEQ ID NO: 254529 - RNA, 62 nt, Human
cugccccagccacggaagucagaguaggaugcacaguacaaaggaggggggaguggaggccu

SEQ ID NO: 254530 - RNA, 64 nt, Human; identical to SEQ ID NO: 252878

SEQ ID NO: 254531 - RNA, 64 nt, Human; identical to SEQ ID NO: 252864

SEQ ID NO: 254532 - RNA, 64 nt, Human; identical to SEQ ID NO: 252880

SEQ ID NO: 254533 - RNA, 64 nt, Human; identical to SEQ ID NO: 252881

SEQ ID NO: 254534 - RNA, 64 nt, Human; identical to SEQ ID NO: 252882

SEQ ID NO: 254535 - RNA, 64 nt, Human; identical to SEQ ID NO: 252883

SEQ ID NO: 254536 - RNA, 64 nt, Human; identical to SEQ ID NO: 252884

SEQ ID NO: 254537 - RNA, 64 nt, Human; identical to SEQ ID NO: 252885

SEQ ID NO: 254538 - RNA, 64 nt, Human; identical to SEQ ID NO: 252886

SEQ ID NO: 254539 - RNA, 64 nt, Human; identical to SEQ ID NO: 252887

SEQ ID NO: 254540 - RNA, 64 nt, Human; identical to SEQ ID NO: 252891

SEQ ID NO: 254541 - RNA, 64 nt, Human; identical to SEQ ID NO: 252892

SEQ ID NO: 254542 - RNA, 64 nt, Human; identical to SEQ ID NO: 252893

SEQ ID NO: 254543 - RNA, 63 nt, Human
uuguaucucaagcuaaugcucuacaaaggaaaggccgagcaggccguguugcaucuggggucu

SEQ ID NO: 254544 - RNA, 62 nt, Human
cuucuccaugaagccagggcacaaagaauuugacaguacaagucaaaucccccaccccacaa

SEQ ID NO: 254545 - RNA, 62 nt, Human
uuuuauauauuuuucuaaauauauguauauauacaguacauagaaaauagaacuuuuauuuu

SEQ ID NO: 254546 - RNA, 64 nt, Human; identical to SEQ ID NO: 252894

SEQ ID NO: 254547 - RNA, 64 nt, Human; identical to SEQ ID NO: 252895

SEQ ID NO: 254548 - RNA, 64 nt, Human; identical to SEQ ID NO: 252896

SEQ ID NO: 254549 - RNA, 64 nt, Human; identical to SEQ ID NO: 252897

SEQ ID NO: 254550 - RNA, 64 nt, Human; identical to SEQ ID NO: 252898

SEQ ID NO: 254551 - RNA, 64 nt, Human; identical to SEQ ID NO: 252899

SEQ ID NO: 254552 - RNA, 64 nt, Human; identical to SEQ ID NO: 252900

SEQ ID NO: 254553 - RNA, 64 nt, Human; identical to SEQ ID NO: 252901

SEQ ID NO: 254554 - RNA, 64 nt, Human; identical to SEQ ID NO: 252902

SEQ ID NO: 254555 - RNA, 64 nt, Human; identical to SEQ ID NO: 252903

SEQ ID NO: 254556 - RNA, 64 nt, Human; identical to SEQ ID NO: 252907

SEQ ID NO: 254557 - RNA, 64 nt, Human; identical to SEQ ID NO: 252908

SEQ ID NO: 254558 - RNA, 64 nt, Human; identical to SEQ ID NO: 252909

SEQ ID NO: 254559 - RNA, 62 nt, Human
guuuuucugauauaauuacuuuagcugcacuaacaguacaaugcuuguuaaugguuaauaua

SEQ ID NO: 254560 - RNA, 62 nt, Human
cagccgugacuuacaauuaaacccuuucaauuacaguacagauucugugugcuacuugauga

SEQ ID NO: 254561 - RNA, 62 nt, Human
caugugauuacuucuguuuuuuacacccacauacaguacaaaagauuauuaaaaauauuccc

SEQ ID NO: 254562 - RNA, 64 nt, Human; identical to SEQ ID NO: 252910

SEQ ID NO: 254563 - RNA, 64 nt, Human; identical to SEQ ID NO: 252911

SEQ ID NO: 254564 - RNA, 64 nt, Human; identical to SEQ ID NO: 252912

SEQ ID NO: 254565 - RNA, 64 nt, Human; identical to SEQ ID NO: 252913

SEQ ID NO: 254566 - RNA, 64 nt, Human; identical to SEQ ID NO: 252914

SEQ ID NO: 254567 - RNA, 64 nt, Human; identical to SEQ ID NO: 252915

SEQ ID NO: 254568 - RNA, 64 nt, Human; identical to SEQ ID NO: 252916

SEQ ID NO: 254569 - RNA, 64 nt, Human; identical to SEQ ID NO: 252917

SEQ ID NO: 254570 - RNA, 64 nt, Human; identical to SEQ ID NO: 252918

SEQ ID NO: 254571 - RNA, 64 nt, Human; identical to SEQ ID NO: 252919

SEQ ID NO: 254572 - RNA, 64 nt, Human; identical to SEQ ID NO: 252923

SEQ ID NO: 254573 - RNA, 64 nt, Human; identical to SEQ ID NO: 252924

SEQ ID NO: 254574 - RNA, 64 nt, Human; identical to SEQ ID NO: 252925

SEQ ID NO: 254575 - RNA, 62 nt, Human
uugagaauauuuucuaauuaccuguguaugcuacaguacagacauuaauucuauaaacaugu

SEQ ID NO: 254576 - RNA, 62 nt, Human
ggaacccugagugagaaugaguguggauguguacaguacacgcacuggacggcagcgggagg

SEQ ID NO: 254577 - RNA, 62 nt, Human
gaaacauauauuugugugcauuugcaugugcaacaguacacacaaacauacauaaagagagc

SEQ ID NO: 254578 - RNA, 64 nt, Human; identical to SEQ ID NO: 252926

SEQ ID NO: 254579 - RNA, 64 nt, Human; identical to SEQ ID NO: 252927

SEQ ID NO: 254580 - RNA, 64 nt, Human; identical to SEQ ID NO: 252928

SEQ ID NO: 254581 - RNA, 64 nt, Human; identical to SEQ ID NO: 252929

SEQ ID NO: 254582 - RNA, 64 nt, Human; identical to SEQ ID NO: 252930

SEQ ID NO: 254583 - RNA, 64 nt, Human; identical to SEQ ID NO: 252931

SEQ ID NO: 254584 - RNA, 64 nt, Human; identical to SEQ ID NO: 252932

SEQ ID NO: 254585 - RNA, 64 nt, Human; identical to SEQ ID NO: 252933

SEQ ID NO: 254586 - RNA, 64 nt, Human; identical to SEQ ID NO: 252934

SEQ ID NO: 254587 - RNA, 64 nt, Human; identical to SEQ ID NO: 252935

SEQ ID NO: 254588 - RNA, 64 nt, Human; identical to SEQ ID NO: 252939

SEQ ID NO: 254589 - RNA, 64 nt, Human; identical to SEQ ID NO: 252940

SEQ ID NO: 254590 - RNA, 64 nt, Human; identical to SEQ ID NO: 252941

SEQ ID NO: 254591 - RNA, 62 nt, Human
cgguaauccuaauaggacgucccgcacuugucacaguacagcuaauuuuuccuaguuaacau

SEQ ID NO: 254592 - RNA, 62 nt, Human
uaccucaaggauaucauuuuugauuuuguguuacaguacacuuguagccaaaacuggaagac

SEQ ID NO: 254593 - RNA, 62 nt, Human
aaguagugucuaaaaguaucuagucuuuauucacaguacauuauauugugugaugcacugga

SEQ ID NO: 254594 - RNA, 64 nt, Human; identical to SEQ ID NO: 252942

SEQ ID NO: 254595 - RNA, 64 nt, Human; identical to SEQ ID NO: 252943

SEQ ID NO: 254596 - RNA, 64 nt, Human; identical to SEQ ID NO: 252944

SEQ ID NO: 254597 - RNA, 64 nt, Human; identical to SEQ ID NO: 252945

SEQ ID NO: 254598 - RNA, 64 nt, Human; identical to SEQ ID NO: 252946

SEQ ID NO: 254599 - RNA, 64 nt, Human; identical to SEQ ID NO: 252947

SEQ ID NO: 254600 - RNA, 64 nt, Human; identical to SEQ ID NO: 252948

SEQ ID NO: 254601 - RNA, 64 nt, Human; identical to SEQ ID NO: 252949

SEQ ID NO: 254602 - RNA, 64 nt, Human; identical to SEQ ID NO: 252950

SEQ ID NO: 254603 - RNA, 64 nt, Human; identical to SEQ ID NO: 252951

SEQ ID NO: 254604 - RNA, 64 nt, Human; identical to SEQ ID NO: 252955

SEQ ID NO: 254605 - RNA, 64 nt, Human; identical to SEQ ID NO: 252956

SEQ ID NO: 254606 - RNA, 64 nt, Human; identical to SEQ ID NO: 252957

SEQ ID NO: 254607 - RNA, 62 nt, Human
ugaagggagaagacauugguuuguugacaauaacaguacaucuuuucaaguucucagcuauu

SEQ ID NO: 254608 - RNA, 62 nt, Human
auuuaaaaaaauaacuacaguauagcgcugguacaguacacuaaaagacuuugauaaaaaga

SEQ ID NO: 254609 - RNA, 62 nt, Human
ugcuggccaaaaccuggccgucucuucuauucacaguacacgucacaguauugaugugauuc

SEQ ID NO: 254610 - RNA, 64 nt, Human; identical to SEQ ID NO: 252958

SEQ ID NO: 254611 - RNA, 54 nt, Human; identical to SEQ ID NO: 252550

SEQ ID NO: 254612 - RNA, 64 nt, Human; identical to SEQ ID NO: 252960

SEQ ID NO: 254613 - RNA, 64 nt, Human; identical to SEQ ID NO: 252961

SEQ ID NO: 254614 - RNA, 64 nt, Human; identical to SEQ ID NO: 252962

SEQ ID NO: 254615 - RNA, 64 nt, Human; identical to SEQ ID NO: 252963

SEQ ID NO: 254616 - RNA, 64 nt, Human; identical to SEQ ID NO: 252964

SEQ ID NO: 254617 - RNA, 64 nt, Human; identical to SEQ ID NO: 252965

SEQ ID NO: 254618 - RNA, 64 nt, Human; identical to SEQ ID NO: 252966

SEQ ID NO: 254619 - RNA, 64 nt, Human; identical to SEQ ID NO: 252967

SEQ ID NO: 254620 - RNA, 64 nt, Human; identical to SEQ ID NO: 252971

SEQ ID NO: 254621 - RNA, 64 nt, Human; identical to SEQ ID NO: 252972

SEQ ID NO: 254622 - RNA, 64 nt, Human; identical to SEQ ID NO: 252973

SEQ ID NO: 254623 - RNA, 64 nt, Human
aggacuugguggcacaaaauacaucuccuuugaggaacggcaguggcauaacgacugcuuuaac

SEQ ID NO: 254624 - RNA, 64 nt, Human
cgagggcccugggcuugggguguucugguuuugagaacggcagacccaggucggagugaggaag

SEQ ID NO: 254625 - RNA, 64 nt, Human
ugaaacuuuuaaguauacuuuaggaaacaagcaugaacggcagucuagaauaccagaaacaucu

SEQ ID NO: 254626 - RNA, 64 nt, Human
uaaaggcuauuuaaaacauguaaaaggauuuggggaacggcagaaaacaugcaguuugggcauu

SEQ ID NO: 254627 - RNA, 64 nt, Human; identical to SEQ ID NO: 252974

SEQ ID NO: 254628 - RNA, 64 nt, Human; identical to SEQ ID NO: 252975

SEQ ID NO: 254629 - RNA, 64 nt, Human; identical to SEQ ID NO: 252976

SEQ ID NO: 254630 - RNA, 64 nt, Human; identical to SEQ ID NO: 252977

SEQ ID NO: 254631 - RNA, 64 nt, Human; identical to SEQ ID NO: 252978

SEQ ID NO: 254632 - RNA, 64 nt, Human; identical to SEQ ID NO: 252979

SEQ ID NO: 254633 - RNA, 64 nt, Human; identical to SEQ ID NO: 252980

SEQ ID NO: 254634 - RNA, 64 nt, Human; identical to SEQ ID NO: 252981

SEQ ID NO: 254635 - RNA, 64 nt, Human; identical to SEQ ID NO: 252982

SEQ ID NO: 254636 - RNA, 64 nt, Human; identical to SEQ ID NO: 252983

SEQ ID NO: 254637 - RNA, 64 nt, Human; identical to SEQ ID NO: 252987

SEQ ID NO: 254638 - RNA, 64 nt, Human; identical to SEQ ID NO: 252988

SEQ ID NO: 254639 - RNA, 64 nt, Human; identical to SEQ ID NO: 252989

SEQ ID NO: 254640 - RNA, 62 nt, Human
aaauucuaguguuuggauugggcccuucucuaacaguacauacucauucccaaagcaaucca

SEQ ID NO: 254641 - RNA, 62 nt, Human
ucaaacauacagaaacacacacagauauggacacaguacaauucuucuuuucaaaugaagac

SEQ ID NO: 254642 - RNA, 64 nt, Human; identical to SEQ ID NO: 252990

SEQ ID NO: 254643 - RNA, 64 nt, Human; identical to SEQ ID NO: 252991

SEQ ID NO: 254644 - RNA, 64 nt, Human; identical to SEQ ID NO: 252992

SEQ ID NO: 254645 - RNA, 64 nt, Human; identical to SEQ ID NO: 252993

SEQ ID NO: 254646 - RNA, 64 nt, Human; identical to SEQ ID NO: 252994

SEQ ID NO: 254647 - RNA, 64 nt, Human; identical to SEQ ID NO: 252995

SEQ ID NO: 254648 - RNA, 64 nt, Human; identical to SEQ ID NO: 252996

SEQ ID NO: 254649 - RNA, 64 nt, Human; identical to SEQ ID NO: 252997

SEQ ID NO: 254650 - RNA, 64 nt, Human; identical to SEQ ID NO: 252998

SEQ ID NO: 254651 - RNA, 64 nt, Human; identical to SEQ ID NO: 252999

SEQ ID NO: 254652 - RNA, 64 nt, Human; identical to SEQ ID NO: 253003

SEQ ID NO: 254653 - RNA, 64 nt, Human; identical to SEQ ID NO: 253004

SEQ ID NO: 254654 - RNA, 64 nt, Human; identical to SEQ ID NO: 253005

SEQ ID NO: 254655 - RNA, 64 nt, Human
ugaagcaggucuuucacucacaacacuuaacagggaacggcagggcucuuugcuggagcagagg

SEQ ID NO: 254656 - RNA, 64 nt, Human
uugaacuauacugcuuugagaucucauuucagaagaacggcaugaacagucuucagccacaguu

SEQ ID NO: 254657 - RNA, 64 nt, Human
acuucugccaguuguguuuuaugaauuaaacagggaacggcaugcugaacuugaaacuagauuu

SEQ ID NO: 254658 - RNA, 64 nt, Human
uuuucucagaaacugggcgaaucuacagaacaaagaacggcaugugaauucugugaagaaugaa

SEQ ID NO: 254659 - RNA, 64 nt, Human; identical to SEQ ID NO: 253006

SEQ ID NO: 254660 - RNA, 64 nt, Human; identical to SEQ ID NO: 253007

SEQ ID NO: 254661 - RNA, 64 nt, Human; identical to SEQ ID NO: 253008

SEQ ID NO: 254662 - RNA, 64 nt, Human; identical to SEQ ID NO: 253009

SEQ ID NO: 254663 - RNA, 64 nt, Human; identical to SEQ ID NO: 253010

SEQ ID NO: 254664 - RNA, 64 nt, Human; identical to SEQ ID NO: 253011

SEQ ID NO: 254665 - RNA, 64 nt, Human; identical to SEQ ID NO: 253012

SEQ ID NO: 254666 - RNA, 64 nt, Human; identical to SEQ ID NO: 253013

SEQ ID NO: 254667 - RNA, 64 nt, Human; identical to SEQ ID NO: 253014

SEQ ID NO: 254668 - RNA, 64 nt, Human; identical to SEQ ID NO: 253015

SEQ ID NO: 254669 - RNA, 64 nt, Human; identical to SEQ ID NO: 253019

SEQ ID NO: 254670 - RNA, 64 nt, Human; identical to SEQ ID NO: 253020

SEQ ID NO: 254671 - RNA, 64 nt, Human; identical to SEQ ID NO: 253021

SEQ ID NO: 254672 - RNA, 64 nt, Human
ccaagcccguucuuacgucgccauaaaggcccccgaacggcauucucgguacuucuguuuguuu

SEQ ID NO: 254673 - RNA, 62 nt, Human
ccuccugucucaccucccaaguagcugagacuacaguacaggcacaugccaccacaccuggc

SEQ ID NO: 254674 - RNA, 62 nt, Human
auuguuacagaauggugacuucauuugugcuaacaguacaacagcagauuugggucaggcuu

SEQ ID NO: 254675 - RNA, 64 nt, Human; identical to SEQ ID NO: 253022

SEQ ID NO: 254676 - RNA, 64 nt, Human; identical to SEQ ID NO: 253023

SEQ ID NO: 254677 - RNA, 64 nt, Human; identical to SEQ ID NO: 253024

SEQ ID NO: 254678 - RNA, 64 nt, Human; identical to SEQ ID NO: 253025

SEQ ID NO: 254679 - RNA, 64 nt, Human; identical to SEQ ID NO: 253026

SEQ ID NO: 254680 - RNA, 64 nt, Human; identical to SEQ ID NO: 253027

SEQ ID NO: 254681 - RNA, 64 nt, Human; identical to SEQ ID NO: 253028

SEQ ID NO: 254682 - RNA, 64 nt, Human; identical to SEQ ID NO: 253029

SEQ ID NO: 254683 - RNA, 64 nt, Human; identical to SEQ ID NO: 253030

SEQ ID NO: 254684 - RNA, 64 nt, Human; identical to SEQ ID NO: 253031

SEQ ID NO: 254685 - RNA, 64 nt, Human; identical to SEQ ID NO: 253035

SEQ ID NO: 254686 - RNA, 64 nt, Human; identical to SEQ ID NO: 253036

SEQ ID NO: 254687 - RNA, 64 nt, Human; identical to SEQ ID NO: 253037

SEQ ID NO: 254688 - RNA, 64 nt, Human
gcucaagaccgcacagcagcgaugcagaaggcaagaacggcagcuugaaaaauuaaaggagguu

SEQ ID NO: 254689 - RNA, 64 nt, Human
ugaccaugcccucagcaccacucuuguccccacugaacggcaacugagacuggguaccuggaga

SEQ ID NO: 254690 - RNA, 64 nt, Human
aaucccagaccgagucugcuuucugugccuaguugaacggcaagcucggcaucuguugguuaca

SEQ ID NO: 254691 - RNA, 64 nt, Human
acagcacaggauguggggcgagggcacagcuggggaacggcaagaaaggaauggacccugugug

SEQ ID NO: 254692 - RNA, 64 nt, Human; identical to SEQ ID NO: 253038

SEQ ID NO: 254693 - RNA, 64 nt, Human; identical to SEQ ID NO: 253039

SEQ ID NO: 254694 - RNA, 64 nt, Human; identical to SEQ ID NO: 253040

SEQ ID NO: 254695 - RNA, 64 nt, Human; identical to SEQ ID NO: 253041

SEQ ID NO: 254696 - RNA, 64 nt, Human; identical to SEQ ID NO: 253042

SEQ ID NO: 254697 - RNA, 64 nt, Human; identical to SEQ ID NO: 253043

SEQ ID NO: 254698 - RNA, 64 nt, Human; identical to SEQ ID NO: 253044

SEQ ID NO: 254699 - RNA, 64 nt, Human; identical to SEQ ID NO: 253045

SEQ ID NO: 254700 - RNA, 64 nt, Human; identical to SEQ ID NO: 253046

SEQ ID NO: 254701 - RNA, 64 nt, Human; identical to SEQ ID NO: 253047

SEQ ID NO: 254702 - RNA, 64 nt, Human; identical to SEQ ID NO: 253051

SEQ ID NO: 254703 - RNA, 64 nt, Human; identical to SEQ ID NO: 253052

SEQ ID NO: 254704 - RNA, 64 nt, Human; identical to SEQ ID NO: 253053

SEQ ID NO: 254705 - RNA, 64 nt, Human
auacagugccuuuccauuuauuuaacccccaccugaacggcauaaacugaguguucagcuggug

SEQ ID NO: 254706 - RNA, 64 nt, Human
auguucccaugcucuucuccguccccaggaaugcgaacggcaguuucccuuccccaguggacgu

SEQ ID NO: 254707 - RNA, 56 nt, Human
cgcaucaagcugaugagugagauccugaacggcaucaaggugcugaagcuguacgc

SEQ ID NO: 254708 - RNA, 64 nt, Human
gacuacuguucgaagauuuuuggaagaauacugagaacggcauaaagugaagaucgacauuuaa

SEQ ID NO: 254709 - RNA, 64 nt, Human; identical to SEQ ID NO: 253054

SEQ ID NO: 254710 - RNA, 64 nt, Human; identical to SEQ ID NO: 253055

SEQ ID NO: 254711 - RNA, 64 nt, Human; identical to SEQ ID NO: 253056

SEQ ID NO: 254712 - RNA, 64 nt, Human; identical to SEQ ID NO: 253057

SEQ ID NO: 254713 - RNA, 64 nt, Human; identical to SEQ ID NO: 253058

SEQ ID NO: 254714 - RNA, 64 nt, Human; identical to SEQ ID NO: 253059

SEQ ID NO: 254715 - RNA, 64 nt, Human; identical to SEQ ID NO: 253060

SEQ ID NO: 254716 - RNA, 64 nt, Human; identical to SEQ ID NO: 253061

SEQ ID NO: 254717 - RNA, 64 nt, Human; identical to SEQ ID NO: 253062

SEQ ID NO: 254718 - RNA, 64 nt, Human; identical to SEQ ID NO: 253063

SEQ ID NO: 254719 - RNA, 64 nt, Human; identical to SEQ ID NO: 253067

SEQ ID NO: 254720 - RNA, 64 nt, Human; identical to SEQ ID NO: 253068

SEQ ID NO: 254721 - RNA, 64 nt, Human; identical to SEQ ID NO: 253069

SEQ ID NO: 254722 - RNA, 64 nt, Human
uggagggcauggguauggcugaggagggugcugggaacggcaaggcggucugggggauggggag

SEQ ID NO: 254723 - RNA, 64 nt, Human
ucccuggggcaggaaguggguggacuuggaggaggaacggcaagggccgguccccacacucuug

SEQ ID NO: 254724 - RNA, 64 nt, Human
ugcucaaggauuaguuuuccaggacucugcggaggaacggcaggaagaaccucagagagggcag

SEQ ID NO: 254725 - RNA, 64 nt, Human
ucacggucucucuuccucacagaagcuggagcaagaacggcagaacguggaagggggaccugag

SEQ ID NO: 254726 - RNA, 64 nt, Human; identical to SEQ ID NO: 253070

SEQ ID NO: 254727 - RNA, 64 nt, Human; identical to SEQ ID NO: 253071

SEQ ID NO: 254728 - RNA, 64 nt, Human; identical to SEQ ID NO: 253072

SEQ ID NO: 254729 - RNA, 64 nt, Human; identical to SEQ ID NO: 253073

SEQ ID NO: 254730 - RNA, 64 nt, Human; identical to SEQ ID NO: 253074

SEQ ID NO: 254731 - RNA, 64 nt, Human; identical to SEQ ID NO: 253075

SEQ ID NO: 254732 - RNA, 64 nt, Human; identical to SEQ ID NO: 253076

SEQ ID NO: 254733 - RNA, 64 nt, Human; identical to SEQ ID NO: 253077

SEQ ID NO: 254734 - RNA, 64 nt, Human; identical to SEQ ID NO: 253078

SEQ ID NO: 254735 - RNA, 64 nt, Human; identical to SEQ ID NO: 253079

SEQ ID NO: 254736 - RNA, 64 nt, Human; identical to SEQ ID NO: 253083

SEQ ID NO: 254737 - RNA, 64 nt, Human; identical to SEQ ID NO: 253084

SEQ ID NO: 254738 - RNA, 64 nt, Human; identical to SEQ ID NO: 253085

SEQ ID NO: 254739 - RNA, 62 nt, Human
uacuggcucuaguccccgugagauguaaagaaacaguacagccccuuccacugcccauuuua

SEQ ID NO: 254740 - RNA, 62 nt, Human
gguuuaacaagcccgucaggugauucugauuuacaguacaguuugagacccacuggcuagaa

SEQ ID NO: 254741 - RNA, 62 nt, Human
auuuuaagaaucugcagauggcauccauagauacaguacaguauuuacugucaaugcaaaag

SEQ ID NO: 254742 - RNA, 64 nt, Human; identical to SEQ ID NO: 253086

SEQ ID NO: 254743 - RNA, 64 nt, Human; identical to SEQ ID NO: 253087

SEQ ID NO: 254744 - RNA, 64 nt, Human; identical to SEQ ID NO: 253088

SEQ ID NO: 254745 - RNA, 64 nt, Human; identical to SEQ ID NO: 253089

SEQ ID NO: 254746 - RNA, 64 nt, Human; identical to SEQ ID NO: 253090

SEQ ID NO: 254747 - RNA, 64 nt, Human; identical to SEQ ID NO: 253091

SEQ ID NO: 254748 - RNA, 64 nt, Human; identical to SEQ ID NO: 253092

SEQ ID NO: 254749 - RNA, 64 nt, Human; identical to SEQ ID NO: 253093

SEQ ID NO: 254750 - RNA, 64 nt, Human; identical to SEQ ID NO: 253094

SEQ ID NO: 254751 - RNA, 64 nt, Human; identical to SEQ ID NO: 253095

SEQ ID NO: 254752 - RNA, 64 nt, Human; identical to SEQ ID NO: 253099

SEQ ID NO: 254753 - RNA, 64 nt, Human; identical to SEQ ID NO: 253100

SEQ ID NO: 254754 - RNA, 64 nt, Human; identical to SEQ ID NO: 253101

SEQ ID NO: 254755 - RNA, 61 nt, Human
ucccuggcaugacuccaugaauuugucuccagaacggcagcaggaaagucuuuuuuguuuc

SEQ ID NO: 254756 - RNA, 62 nt, Human
uguaaaaugaucauauucauucaaaggccuacacaguacaaaugagcacgcugccauguacu

SEQ ID NO: 254757 - RNA, 64 nt, Human; identical to SEQ ID NO: 253102

SEQ ID NO: 254758 - RNA, 64 nt, Human; identical to SEQ ID NO: 253103

SEQ ID NO: 254759 - RNA, 64 nt, Human; identical to SEQ ID NO: 253104

SEQ ID NO: 254760 - RNA, 64 nt, Human; identical to SEQ ID NO: 253105

SEQ ID NO: 254761 - RNA, 64 nt, Human; identical to SEQ ID NO: 253106

SEQ ID NO: 254762 - RNA, 64 nt, Human; identical to SEQ ID NO: 253107

SEQ ID NO: 254763 - RNA, 64 nt, Human; identical to SEQ ID NO: 253108

SEQ ID NO: 254764 - RNA, 64 nt, Human; identical to SEQ ID NO: 253109

SEQ ID NO: 254765 - RNA, 64 nt, Human; identical to SEQ ID NO: 253110

SEQ ID NO: 254766 - RNA, 64 nt, Human; identical to SEQ ID NO: 253111

SEQ ID NO: 254767 - RNA, 64 nt, Human; identical to SEQ ID NO: 253115

SEQ ID NO: 254768 - RNA, 64 nt, Human; identical to SEQ ID NO: 253116

SEQ ID NO: 254769 - RNA, 64 nt, Human; identical to SEQ ID NO: 253117

SEQ ID NO: 254770 - RNA, 60 nt, Human
uuuauggcuucggcggcugagcuuaccucuacaguacacuaccgcaaaaccaacggcccu

SEQ ID NO: 254771 - RNA, 62 nt, Human
aaagugagugaacagcaaggaagaguguuugcacaguacaguaacauuugguuguucuuaag

SEQ ID NO: 254772 - RNA, 62 nt, Human
uugcuguuuuggaaguguaucauaaaccagaaacaguacagaacugauguugagggaggugu

SEQ ID NO: 254773 - RNA, 60 nt, Human; identical to SEQ ID NO: 252710

SEQ ID NO: 254774 - RNA, 64 nt, Human; identical to SEQ ID NO: 253119

SEQ ID NO: 254775 - RNA, 64 nt, Human; identical to SEQ ID NO: 253120

SEQ ID NO: 254776 - RNA, 64 nt, Human; identical to SEQ ID NO: 253121

SEQ ID NO: 254777 - RNA, 64 nt, Human; identical to SEQ ID NO: 253122

SEQ ID NO: 254778 - RNA, 64 nt, Human; identical to SEQ ID NO: 253123

SEQ ID NO: 254779 - RNA, 64 nt, Human; identical to SEQ ID NO: 253124

SEQ ID NO: 254780 - RNA, 64 nt, Human; identical to SEQ ID NO: 253125

SEQ ID NO: 254781 - RNA, 64 nt, Human; identical to SEQ ID NO: 253126

SEQ ID NO: 254782 - RNA, 64 nt, Human; identical to SEQ ID NO: 253127

SEQ ID NO: 254783 - RNA, 64 nt, Human; identical to SEQ ID NO: 253131

SEQ ID NO: 254784 - RNA, 64 nt, Human; identical to SEQ ID NO: 253132

SEQ ID NO: 254785 - RNA, 64 nt, Human; identical to SEQ ID NO: 253133

SEQ ID NO: 254786 - RNA, 62 nt, Human
auuuauagacuuucguaucuuagaaaaauucuacaguacauccacauagggugaaaguaccc

SEQ ID NO: 254787 - RNA, 62 nt, Human
gggaacuggugaauaauaauuaacuauugugaacaguacacuauaccauacuuccuuagcuu

SEQ ID NO: 254788 - RNA, 62 nt, Human
aagaacucuuccaggugacuucaaaacauaggacaguacaucucuaguagaauaugcccuga

SEQ ID NO: 254789 - RNA, 64 nt, Human; identical to SEQ ID NO: 253134

SEQ ID NO: 254790 - RNA, 64 nt, Human; identical to SEQ ID NO: 253135

SEQ ID NO: 254791 - RNA, 64 nt, Human; identical to SEQ ID NO: 253136

SEQ ID NO: 254792 - RNA, 64 nt, Human; identical to SEQ ID NO: 253137

SEQ ID NO: 254793 - RNA, 64 nt, Human; identical to SEQ ID NO: 253138

SEQ ID NO: 254794 - RNA, 64 nt, Human; identical to SEQ ID NO: 253139

SEQ ID NO: 254795 - RNA, 64 nt, Human; identical to SEQ ID NO: 253140

SEQ ID NO: 254796 - RNA, 64 nt, Human; identical to SEQ ID NO: 253141

SEQ ID NO: 254797 - RNA, 64 nt, Human; identical to SEQ ID NO: 253142

SEQ ID NO: 254798 - RNA, 64 nt, Human; identical to SEQ ID NO: 253143

SEQ ID NO: 254799 - RNA, 64 nt, Human; identical to SEQ ID NO: 253147

SEQ ID NO: 254800 - RNA, 64 nt, Human; identical to SEQ ID NO: 253148

SEQ ID NO: 254801 - RNA, 64 nt, Human; identical to SEQ ID NO: 253149

SEQ ID NO: 254802 - RNA, 64 nt, Human
gcucguucaguaagcauaaucugauuaacacagagaacggcaagcacauauaaaaugauuuuug

SEQ ID NO: 254803 - RNA, 62 nt, Human
ugcaaggaugaaugccuguauuuggucuaggaacaguacauuuuagucugauuuagaauuac

SEQ ID NO: 254804 - RNA, 62 nt, Human
gacuuauguuuggggagaggguuguuuuuauuacaguacauuacaggaauuguauguucacu

SEQ ID NO: 254805 - RNA, 64 nt, Human; identical to SEQ ID NO: 253150

SEQ ID NO: 254806 - RNA, 64 nt, Human; identical to SEQ ID NO: 253151

SEQ ID NO: 254807 - RNA, 64 nt, Human; identical to SEQ ID NO: 253152

SEQ ID NO: 254808 - RNA, 64 nt, Human; identical to SEQ ID NO: 253153

SEQ ID NO: 254809 - RNA, 64 nt, Human; identical to SEQ ID NO: 253154

SEQ ID NO: 254810 - RNA, 64 nt, Human; identical to SEQ ID NO: 253155

SEQ ID NO: 254811 - RNA, 64 nt, Human; identical to SEQ ID NO: 253156

SEQ ID NO: 254812 - RNA, 64 nt, Human; identical to SEQ ID NO: 253157

SEQ ID NO: 254813 - RNA, 64 nt, Human; identical to SEQ ID NO: 253158

SEQ ID NO: 254814 - RNA, 64 nt, Human; identical to SEQ ID NO: 253159

SEQ ID NO: 254815 - RNA, 64 nt, Human; identical to SEQ ID NO: 253163

SEQ ID NO: 254816 - RNA, 64 nt, Human; identical to SEQ ID NO: 253164

SEQ ID NO: 254817 - RNA, 64 nt, Human; identical to SEQ ID NO: 253165

SEQ ID NO: 254818 - RNA, 64 nt, Human
uccucagacuaaugauagugucugcuuucugcaugaacggcaauaugggacucccuccaagcua

SEQ ID NO: 254819 - RNA, 62 nt, Human
uuuaugaaguauauacccuuuacccaccagagacaguacagaaucccugcccuaaaauccca

SEQ ID NO: 254820 - RNA, 62 nt, Human
gugaccacagugaagucugagacccuuuugucacaguacagcucuugucuuuaccaacugcc

SEQ ID NO: 254821 - RNA, 64 nt, Human; identical to SEQ ID NO: 253166

SEQ ID NO: 254822 - RNA, 64 nt, Human; identical to SEQ ID NO: 253167

SEQ ID NO: 254823 - RNA, 64 nt, Human; identical to SEQ ID NO: 253168

SEQ ID NO: 254824 - RNA, 64 nt, Human; identical to SEQ ID NO: 253169

SEQ ID NO: 254825 - RNA, 64 nt, Human; identical to SEQ ID NO: 253170

SEQ ID NO: 254826 - RNA, 64 nt, Human; identical to SEQ ID NO: 253171

SEQ ID NO: 254827 - RNA, 64 nt, Human; identical to SEQ ID NO: 253172

SEQ ID NO: 254828 - RNA, 64 nt, Human; identical to SEQ ID NO: 253173

SEQ ID NO: 254829 - RNA, 64 nt, Human; identical to SEQ ID NO: 253174

SEQ ID NO: 254830 - RNA, 64 nt, Human
cgccagcuccucucugaagcgacucuccuguuuggaacggcaaaaaaaaauuuuuuuuucucuu

SEQ ID NO: 254831 - RNA, 64 nt, Human
uaugauaguuuuuaagguuucaauucaaucuucugaacggcauaaguccuauuuuagccuuacc

SEQ ID NO: 254832 - RNA, 64 nt, Human
aaacccacucauccucagcuugcacaaacugguugaacggcaggaaugaaaaauaaagagagau

SEQ ID NO: 254833 - RNA, 64 nt, Human
cuuggagucccgauuucagagcaagucuggcuaucugagauacagcugugagagccggauccgg

SEQ ID NO: 254834 - RNA, 64 nt, Human
gacgcauuggagaggaauuugccaaagaucuacccugagauaacgccuguccagugucuucacc

SEQ ID NO: 254835 - RNA, 64 nt, Human
uauguauauacaaaauuuaccuuuuuacuagcaucugagauagaguuacuuucugguacccagu

SEQ ID NO: 254836 - RNA, 64 nt, Human
ucaaggaaucugcccaucuucgccucccaaaguucugagauagcaggugugagucaucaugccc

SEQ ID NO: 254837 - RNA, 64 nt, Human
gcagcgcccuccuccccacugcccccugcagccccugagauauuuugcucacuaucccucccca

SEQ ID NO: 254838 - RNA, 64 nt, Human
gcugugugaguguugagaucucugccaucucuggcugagauacugcuguccugugaaguguuuc

SEQ ID NO: 254839 - RNA, 64 nt, Human
cagacaucaagaagcaggcaggaaaauggaaaaacugagauaauacacaggugauaaacaguuu

SEQ ID NO: 254840 - RNA, 64 nt, Human
uuguuucuccauggguuauuuguaaagcuguaaacugagauaucggugacuccguauuaugacu

SEQ ID NO: 254841 - RNA, 64 nt, Human
uguggcauacaguuccuaguuaagaucccaaauccugagauauugcugauuugcuauggcaggu

SEQ ID NO: 254842 - RNA, 64 nt, Human
gaaacgucacucccugcauccaacaucugaucugcugagauaugucugaucuaucucugcucgc

SEQ ID NO: 254843 - RNA, 64 nt, Human
uucuaagugguuuacaugcacugucucauuuaaucugagauaaaggauacuuaagcccaaacua

SEQ ID NO: 254844 - RNA, 64 nt, Human
acaggcauugcaaggacccucugaugggacgguacugagauaucucggcuuccgcucagcccgg

SEQ ID NO: 254845 - RNA, 64 nt, Human
gagcgcaaacucauccuuuauaaagacaccacuccugagauaacaauccaaucccaugauaaug

SEQ ID NO: 254846 - RNA, 64 nt, Human
agggcccuugguggaaaggggcaccagccuuggucugagauagucacaacccaggugacgaugc

SEQ ID NO: 254847 - RNA, 64 nt, Human
cacagaugcagaauaacuggaucuaacuggguaccugagauauuuuacagcuggaccuaguuuc

SEQ ID NO: 254848 - RNA, 64 nt, Human
cuuaaaagaaaauuuaucugcaaaugugcaaguucugagauauuagcuaaugaauuaguuguuu

SEQ ID NO: 254849 - RNA, 62 nt, Human
auuacaaagucauaaaugugccauauggauauacaguacauucuaguuggaaucguuuacuc

SEQ ID NO: 254850 - RNA, 62 nt, Human
auugauaaucagagaauguauuucagaauacuacaguacaauauauuaugaagcaugaccac

SEQ ID NO: 254851 - RNA, 62 nt, Human
uuuccuugaacaacuuuggaaaaauggauuugacaguacauaaucaguucuacuaaccaaag

SEQ ID NO: 254852 - RNA, 64 nt, Human
augucucaaaaauccuuaugcaugaaaugaaugucugagauacgucugugacuuaucuaccauu

SEQ ID NO: 254853 - RNA, 64 nt, Human
auuuauugaaccaacaaaaauaauuacuucugcccugagauaagcagauuaaguuuguucauuc

SEQ ID NO: 254854 - RNA, 64 nt, Human
aggagcucagcugaagcccuggaaacccucaggucugagauaggaguucucuaggaaccuggaa

SEQ ID NO: 254855 - RNA, 64 nt, Human
ggcaaagcaacacaugcucauccuccugccuaugcugagauacgcacucagcuccaugucuugu

SEQ ID NO: 254856 - RNA, 64 nt, Human
acccucaugacugggaaggaagccugugaugaggcugagauaaagcacagggugguuucacucu

SEQ ID NO: 254857 - RNA, 64 nt, Human
uuucuuacuagcuuuuaagaaauuaaauacuugccugagauagaaauacuuuauuuuuguaacu

SEQ ID NO: 254858 - RNA, 64 nt, Human
aguucucacgaaaguauuuacuuuuuaaaaauaacugagauauuauuuuaaauuucuuuuauua

SEQ ID NO: 254859 - RNA, 64 nt, Human
ggguagggugggggauccccaacaaucagguccccugagauagcuggucauugggcugaucauu

SEQ ID NO: 254860 - RNA, 64 nt, Human
uuuguauagcaagaauuugggaaacacagauggccugagauaagcaguacaaguagguuuuuga

SEQ ID NO: 254861 - RNA, 64 nt, Human
uuuaguucagaguuauauuacagagaauuauuuucugagauaaucuuaaacuagaauguucaaa

SEQ ID NO: 254862 - RNA, 64 nt, Human
guccauuuccuauauaaauaccagcaagaucacucugagauacauaaacucgcauuuccuucug

SEQ ID NO: 254863 - RNA, 64 nt, Human
auagauguccacguagcagagacugacuuaggaucugagauaaagcaucggauugcaggaauaa

SEQ ID NO: 254864 - RNA, 64 nt, Human
ccugaaaaagaaaccagaaaaaaauguacucuuacugagauacccucucaccccaaauguguaa

SEQ ID NO: 254865 - RNA, 64 nt, Human
uacauuuacuuuagcauugaagccacuuugaaaccugagauaaaugaaugugagguaucuuuuc

SEQ ID NO: 254866 - RNA, 64 nt, Human
gucucaccauagcugcuggaaucacaccugagaacugagauauaccaauauuuaacauuguuac

SEQ ID NO: 254867 - RNA, 64 nt, Human
aaauuguauggcuuauguguaaauuauuuuguaucugagauaccaguuccuuuucccaaauaua

SEQ ID NO: 254868 - RNA, 62 nt, Human
guauucuacaaauauuuuuauguucaaaacacacaguacagacagcauggauauuuccuguu

SEQ ID NO: 254869 - RNA, 62 nt, Human
gccagggcagagggcugcccagggccaggcucacaguacaggaggguggcgaggccccuccc

SEQ ID NO: 254870 - RNA, 62 nt, Human
aacugaauauaugggcuauagcaaguagcuuuacaguacagaucuuacaauuaaguuuugcu

SEQ ID NO: 254871 - RNA, 64 nt, Human
cuguugggcuguggagauagugccagggugcggccugagauauuuuucuacagcuucauagagc

SEQ ID NO: 254872 - RNA, 64 nt, Human
agaaugcuagcuagguauuccugggauuauuauacugagauauauauauauacacacacacaca

SEQ ID NO: 254873 - RNA, 64 nt, Human
uccaaacaacucuuaggauugacguaccgugcaucugagauaaaaauuugguucugggaaacug

SEQ ID NO: 254874 - RNA, 64 nt, Human
guaucucugagaauuuauuguauuaaaauuaauacugagauauuuuuaaaacauguuuauuuau

SEQ ID NO: 254875 - RNA, 64 nt, Human
agucaggguauugugcauaauagaaaguauuggacugagauauuugguuaccauggaggccaau

SEQ ID NO: 254876 - RNA, 64 nt, Human
aaacucuugugaaggggucaccccagcaugagugcugagauauggacucucuaaggaaggggcc

SEQ ID NO: 254877 - RNA, 64 nt, Human
uucacugcuuggcaguauugacauugaauauucucugagauacuuuuuuucuuuuggcuuuuca

SEQ ID NO: 254878 - RNA, 64 nt, Human
acuucauuauuaaaaauugauagaauuuuagcuccugagauauuuacaacugggagaaaugucu

SEQ ID NO: 254879 - RNA, 64 nt, Human
auuacuaguugcuagcauguuaugauuucauauccugagauagcucugcagauaagaaaauauu

SEQ ID NO: 254880 - RNA, 64 nt, Human
guccaaugagcaggaagauucugagacauuucgccugagauauaaguuguacugcguaugcagu

SEQ ID NO: 254881 - RNA, 64 nt, Human
uugugaaugcugcaagauuguugcauuguguauacugagauaaucugaggcauggagagcagau

SEQ ID NO: 254882 - RNA, 64 nt, Human
ugugucccugguuggggcuggggagagugagaagcugagauacugggcacaggguuguggccuc

SEQ ID NO: 254883 - RNA, 64 nt, Human
ggggacugucacuguggacgccaaaauggcauaacugagauaaggugaauaagugacaaauaaa

SEQ ID NO: 254884 - RNA, 64 nt, Human
ugcuuggagucauaaguguuauuuggacuauacccugagauaagcuuauagaucaaguuuggcu

SEQ ID NO: 254885 - RNA, 64 nt, Human
agggcuuuguuccuuuccauuuucuuuaacuucucugagauacugauuuguaaauuuugaaaau

SEQ ID NO: 254886 - RNA, 64 nt, Human
ugcuaaagccaagacacuaguugucaaagguguucugagauaagccaugaaguauuuuugaggu

SEQ ID NO: 254887 - RNA, 62 nt, Human
gcacuccaacuauagugccuugcaagugcucaacaguacauauuggaaugaagucccuauga

SEQ ID NO: 254888 - RNA, 62 nt, Human
caggagacuggaauccagggcaguuccaagugacaguacagagcacagcagcgaccuugggc

SEQ ID NO: 254889 - RNA, 62 nt, Human
uguuugacgggaaacaaaacuagguaaaaucuacaguacaccacaagggucacaauacuguu

SEQ ID NO: 254890 - RNA, 64 nt, Human
ucuggaggacagacagcaauucuaugagugcucacugagauacuugcuggagaccucagaaaac

SEQ ID NO: 254891 - RNA, 64 nt, Human
guguaaaaagcugaccauucccauucguucuauucugagauaggagaaaaccgcccuguggcug

SEQ ID NO: 254892 - RNA, 64 nt, Human
guauuguccaagguuucccccccacugagacagccugagauauggccucaugggaagggaaaga

SEQ ID NO: 254893 - RNA, 64 nt, Human
agagggaacaaaacuguucuuuugcauuuugccgcugagauauggcauugcacugcuuauaugc

SEQ ID NO: 254894 - RNA, 64 nt, Human
acggacaaaccuacugugggcuccagccuuuguccugagauagccaagcgggagaaugggcagu

SEQ ID NO: 254895 - RNA, 64 nt, Human
uaauuuacagacugagugacaguacucaguauaucugagauaaacucuauaauguuuuggauaa

SEQ ID NO: 254896 - RNA, 64 nt, Human
gaaagauguuguggaaguuagguacaaugcagcacugagauauauauauauauaugugugugug

SEQ ID NO: 254897 - RNA, 64 nt, Human
cacagccugcucacuucgugggaauaguucuccgcugagauagccccucucgccuaaguauuau

SEQ ID NO: 254898 - RNA, 64 nt, Human
uaaucuuaggggagagcuuucuguccuuuuggcacugagauauuuauuguuuauuuaucaguga

SEQ ID NO: 254899 - RNA, 64 nt, Human
auagaugcugauucaugcagauguaguacuaagucugagauauugaaauacugacuacuuugau

SEQ ID NO: 254900 - RNA, 64 nt, Human
gguauugcuagcaugugagcugcaguuguggggucugagauauuucuuugugguaguuucauac

SEQ ID NO: 254901 - RNA, 64 nt, Human
gcacugauuuugugaguuugacccauuauuaugucugagauauaaucauugauucuauuuguaa

SEQ ID NO: 254902 - RNA, 64 nt, Human
gaagcaagaaaggaucugcaugauaacuuugcagcugagauaguuccuaauucaucaacguaac

SEQ ID NO: 254903 - RNA, 64 nt, Human
gacacaacgugcaaggaaaugaagcggaaagcaucugagauaaaagaagcagaagccaaagcug

SEQ ID NO: 254904 - RNA, 64 nt, Human
ccaguuccugcuaugaucaguuuguauuccaucucugagauauguggucuugaccucccagcau

SEQ ID NO: 254905 - RNA, 64 nt, Human
ugauaggaugaaaggucaauacugcccucucacccugagauauuuagaacauuacacaccuucu

SEQ ID NO: 254906 - RNA, 62 nt, Human
gcuagaguuuccacuaucccaaucaaagaauuacaguacacauccccagaauccauaaaugu

SEQ ID NO: 254907 - RNA, 62 nt, Human
acaggcugccauucacaguauuuugcuuuuugacaguacaagaugcuguguaacuguuuuaa

SEQ ID NO: 254908 - RNA, 62 nt, Human
cuaagcaaaauuagguuuucaaaaaugugagaacaguacaaaguggcagaaccacauuuugu

SEQ ID NO: 254909 - RNA, 64 nt, Human
guuguuuucaagcuucucagugcuggaaaaaauacugagauagacauguuuaguugaaguuauu

SEQ ID NO: 254910 - RNA, 64 nt, Human
guccuugguggggguguaucauauuuuuaacuuacugagauaucauuuuaguucauugagguug

SEQ ID NO: 254911 - RNA, 64 nt, Human
ucacaccuaccaucgucccauggggauccaagaccugagauaaagcaacagccugcccagaucc

SEQ ID NO: 254912 - RNA, 64 nt, Human
uugauuuuuuuguuuuguuuuuauuugguuuuaucugagauaacuuauguucaaggugagaaua

SEQ ID NO: 254913 - RNA, 64 nt, Human
cugugccgacuccacaaaacgauuauguacucuucugagauagaagaugcuguucuucugagag

SEQ ID NO: 254914 - RNA, 64 nt, Human
uuuuguaguuacugguguugauccugaaagcagacugagauaacauuaaauugcugcaacugaa

SEQ ID NO: 254915 - RNA, 64 nt, Human
auagggagaauaauuuagauacacaugcucagagcugagauauuucucugauaaaucagguaac

SEQ ID NO: 254916 - RNA, 64 nt, Human
gagcagguucucauugauaacaagcuccauacugcugagauacagggaaauggaggggggaaag

SEQ ID NO: 254917 - RNA, 64 nt, Human
ccucagugauacaguauaaagauaaacagaaaugcugagauaagcuuagcacuugaguuguaca

SEQ ID NO: 254918 - RNA, 64 nt, Human
uuuucuuaauuuugguaauuauuaaagucuauuucugagauacgagaggguagucacauuaaua

SEQ ID NO: 254919 - RNA, 64 nt, Human
aaauucagauaaagggaaauuugacuaguguaaucugagauaugucauagggauuucuuucuga

SEQ ID NO: 254920 - RNA, 64 nt, Human
uuguuucaauauuuuuuuucucucuugaacaaaacugagauaauuuagaaaacaggugcuuaau

SEQ ID NO: 254921 - RNA, 64 nt, Human
ucugagucuuuuggaggacagggacgguuuguggcugagauaaguguuuccuggcaaaacauau

SEQ ID NO: 254922 - RNA, 64 nt, Human
ccugaguuguagccucuguaauugugaauauuaacugagauagugaaacaugguguccgguuuu

SEQ ID NO: 254923 - RNA, 64 nt, Human
auaccccaaaccagacauaugcuuaggauucaugcugagauaucaauugguuuccccuucuuuu

SEQ ID NO: 254924 - RNA, 64 nt, Human
ugugugcuuuuccuagaugucccaguuagcugugcugagauauaccuguacuauuuaugguuua

SEQ ID NO: 254925 - RNA, 62 nt, Human
ccauuuuuuuuuuguucuaccucaaagauaagacaguacaguauuuaagugcccauaaggca

SEQ ID NO: 254926 - RNA, 62 nt, Human
acuccgaguucugcuuuauucucuagcaauccacaguacaagaacaagcaaaugccacagcu

SEQ ID NO: 254927 - RNA, 62 nt, Human
uuucuuuguucugaaacaucauuaaaagaaugacaguacauugaauggguauaauuuacuuu

SEQ ID NO: 254928 - RNA, 64 nt, Human
aggagaauccuggaauuguuaucugucucuugcucugagauacagacuuguucauagguguggg

SEQ ID NO: 254929 - RNA, 64 nt, Human
aaguucuaucuugugauacggaaacaauaaauuccugagauacauucuuccaaucugugguaau

SEQ ID NO: 254930 - RNA, 64 nt, Human
gcaaaacccauuccccaaagcuacgcuuccccugcugagauagccccuacccccaccuccacag

SEQ ID NO: 254931 - RNA, 64 nt, Human
aagggcuuuaaguuauuuauguauuuaauaugcccugagauaacuuugggguauaagauuccau

SEQ ID NO: 254932 - RNA, 64 nt, Human
uauuaccacacaacaucaaguggccuugaagagacugagauaacgaauucuugaguuuguuuuc

SEQ ID NO: 254933 - RNA, 64 nt, Human
cuagaaagagagagagacagagagauggcaagcacugagauaaauaccuggcaaaacuaaauaa

SEQ ID NO: 254934 - RNA, 64 nt, Human
uuucucucugcacgaaaaacagguaguuugcagucugagauaugggagagcuuuuaggcuacac

SEQ ID NO: 254935 - RNA, 64 nt, Human
auggaaaccuauuacgaugcccuugagucaagcacugagauacguuacccaauuagggaaauaa

SEQ ID NO: 254936 - RNA, 64 nt, Human
uucuggauuagcuuuuccuauuuucgaugaaguucugagauacugaaaugugaaaagagcaauc

SEQ ID NO: 254937 - RNA, 64 nt, Human
auccuauucuguaaagccacuugucugugugacacugagauaaaauaggucuuuguuauuuuca

SEQ ID NO: 254938 - RNA, 64 nt, Human
caaaaccaaaccaaacagcaguucauauaccugccugagauaggcugguccucaccuccagagc

SEQ ID NO: 254939 - RNA, 64 nt, Human
gacauggcgcugaggguuuuucuaaguaagaacacugagauauugggacacacaucaaaaaccu

SEQ ID NO: 254940 - RNA, 64 nt, Human
ggggaaagauguacaggaugcuuugguuucacuccugagauacgagaacguccucugaacacac

SEQ ID NO: 254941 - RNA, 64 nt, Human
cucuccuuccuuccaccugucagcuucucugcuucugagauaagaaccauuuguguaacaccaa

SEQ ID NO: 254942 - RNA, 64 nt, Human
uugcuugaacccgggaggcagagguugcagugagcugagauagcgccauugcacuccagccugg

SEQ ID NO: 254943 - RNA, 64 nt, Human
uuauuugcauguggaucaaccaucgcuuuauuggcugagauaugaacauauuguugaaagguaa

SEQ ID NO: 254944 - RNA, 62 nt, Human
cauaugcaauuuccauuccuauuauaauugacacaguacauuaacaauccaugccaacggug

SEQ ID NO: 254945 - RNA, 62 nt, Human
auauuggaaagacuuguucuuccacggugacuacaguacaugcugaagcgugccguuucagc

SEQ ID NO: 254946 - RNA, 62 nt, Human
uccaguauuuguguguuugauuuuuuuugacaacaguacauauaucuauuucucuagggaua

SEQ ID NO: 254947 - RNA, 64 nt, Human
ucacagaucaguuucaacuguuaaaaacccaccucugagauacuggggggaggauccugaaaca

SEQ ID NO: 254948 - RNA, 64 nt, Human
ugguuugagacucacuuccucaucucccuguccucugagauaauaugagugagcacuuagguau

SEQ ID NO: 254949 - RNA, 64 nt, Human
ccuacuaugaaaugucucaucagaccugacaugucugagauaaccaaggugauucaggauuuga

SEQ ID NO: 254950 - RNA, 64 nt, Human
agggucacagggugaggaucaaagacacaaaugucugagauacacaauugcaggagauuuuauu

SEQ ID NO: 254951 - RNA, 64 nt, Human
agacagaaaauuguuucaugaguucacuuaacuacugagauauucagagcauuuuuaccucucu

SEQ ID NO: 254952 - RNA, 64 nt, Human
ucucuuaaaccaggaaggcagagauugcagugagcugagauaaucccacugcauuccagccugg

SEQ ID NO: 254953 - RNA, 64 nt, Human
uuuuguacaaagagaccugcuuaaacaaguacugcugagauaagugucugaucaagcuacagug

SEQ ID NO: 254954 - RNA, 64 nt, Human
gccagaagggauuucugguauaagguugaaauugcugagauaaaauaaacuaaaacaacaaaca

SEQ ID NO: 254955 - RNA, 64 nt, Human
uuguuuuaccauaaauucaccugacgagggcacucugagauagcacugcucuggggccaucuga

SEQ ID NO: 254956 - RNA, 64 nt, Human
gcaguaguggcugcugugauguaaacuuagggugcugagauaagcaauuagcucuagccuucug

SEQ ID NO: 254957 - RNA, 64 nt, Human
uaaauuccuguuauuugcccaguuuuuaauuacacugagauaauuuugaaaagaaauagaaauu

SEQ ID NO: 254958 - RNA, 64 nt, Human
gaugcuuagcucagagcaguggcugauggggacacugagauaagaucggaggggagcugucaau

SEQ ID NO: 254959 - RNA, 64 nt, Human
cuaauuuuacuuaccuauuagauuuugaaaguaucugagauauacaaaucucccuguaggaaau

SEQ ID NO: 254960 - RNA, 64 nt, Human
aagcaaaacaucucugcaguuuuucccaaguacccugagauacuucccaaagcccuuauguuua

SEQ ID NO: 254961 - RNA, 64 nt, Human
aaaaauuagcugggugugauggccacuugggaggcugagauaggagaaucgcuugaaccuggga

SEQ ID NO: 254962 - RNA, 64 nt, Human
ucuuauucugaagauuuuugcacacucaggcuaucugagauacugguaaucauccugugaaaaa

SEQ ID NO: 254963 - RNA, 62 nt, Human
uuuaccugaaaaugguaguaguuuacauuuauacaguacaguuuaugaagcacuuucauacg

SEQ ID NO: 254964 - RNA, 62 nt, Human
uuuuaaagacguuugcaauuauuaguugauucacaguacagaacaagguauaaaggaaaaaa

SEQ ID NO: 254965 - RNA, 62 nt, Human
uuuaagcccacacacucuguagcuuuucuaaaacaguacauuccauucaugcaguagauaug

SEQ ID NO: 254966 - RNA, 64 nt, Human
cugggagccucuuucacuccucuagacacacugccugagauagaaguuugcaucuuauuggcug

SEQ ID NO: 254967 - RNA, 64 nt, Human
uggcauauacuuguggucccagauacuugggaggcugagauaggaucacuugggcccaggaguu

SEQ ID NO: 254968 - RNA, 64 nt, Human
ggaaaugaaaagaccuggagucuaugcuaggaagcugagauauuuugguauugcauugguuuuu

SEQ ID NO: 254969 - RNA, 64 nt, Human
uuuucuuaugcgggucuuuuauauauuagggauccugagauacccgauucuauauguaaaagcu

SEQ ID NO: 254970 - RNA, 64 nt, Human
uuuggcacaggugcccacaaauacggaugcagugcugagauaguuuaugagacuuguaccauuu

SEQ ID NO: 254971 - RNA, 64 nt, Human
aaggcucugugccuuggucucuccuuccucuuggcugagauagcagaggggcuccccgggucuc

SEQ ID NO: 254972 - RNA, 64 nt, Human
cagcgucucuguaugacauugugugguugacccucugagauaacuguuuucaucuacagaauug

SEQ ID NO: 254973 - RNA, 64 nt, Human
gggccucaaaggccauuggaauuuuacuuuuauucugagauaggaaucuguuggaaggauuuga

SEQ ID NO: 254974 - RNA, 64 nt, Human
gucggaagacaaggggcuucugaaaugggaguuccugagauacaacaaaaugugugccuucaaa

SEQ ID NO: 254975 - RNA, 64 nt, Human
guauuuuuuuuaagauaauuuguauuuuugcacacugagauauaauaaaagguguuuaucauaa

SEQ ID NO: 254976 - RNA, 64 nt, Human
gcccagcaaccuucuaggccugcuuuccagacuucugagauagccugggaugagcaauccuguu

SEQ ID NO: 254977 - RNA, 64 nt, Human
gaccccucucuaccugugagcguucagggggucccugagauaguuuagaugcccccccaucuua

SEQ ID NO: 254978 - RNA, 64 nt, Human
agaagugaauaaucuuucuuugguagaaaauaggcugagauauaaggugauauugcuauugacc

SEQ ID NO: 254979 - RNA, 64 nt, Human
ugaacacucggucaucuaguaccucaaugcgauucugagauauuugaauuucauaaaauuguaa

SEQ ID NO: 254980 - RNA, 64 nt, Human
guccguuuucaaauucaucaacagccuagagugccugagauauaagaugaaacacaaauccaca

SEQ ID NO: 254981 - RNA, 64 nt, Human
uggcauugacgaaaaucauuugaaucucuucuggcugagauaauuugccaaugcaaaauacagu

SEQ ID NO: 254982 - RNA, 62 nt, Human
augaaugaauauaguguucuuugaauuaguaaacaguacaucugugacaaucauuuuuaaca

SEQ ID NO: 254983 - RNA, 62 nt, Human
agauguuguggccugggaaagcccucauugcuacaguacaaguaacacaagucguuguaccu

SEQ ID NO: 254984 - RNA, 62 nt, Human
acuacacauaagauaauucauacugaagagaaacaguacaaaugugaugaauguggcaaagc

SEQ ID NO: 254985 - RNA, 64 nt, Human
ugaaauucuuccuacuuauauaagaaaucucacacugagauagaauugugauuucauaauaaca

SEQ ID NO: 254986 - RNA, 64 nt, Human
uuugugcuguggugugucccccucuguccaggcacugagauaccagcgaggaggcuccagaggg

SEQ ID NO: 254987 - RNA, 64 nt, Human
gaauaucacacugaauagcaggugucaccaccuccugagauaagaaacauaguuuuauacauua

SEQ ID NO: 254988 - RNA, 64 nt, Human
uucagaagccagggucugguccuggcuccucuuacugagauacagggcagcacuggcagagagc

SEQ ID NO: 254989 - RNA, 64 nt, Human
ucguugacugaaaggaguuuuaaauucugagcuccugagauacugacuagcaaccauggaauga

SEQ ID NO: 254990 - RNA, 64 nt, Human
ggagucccaggccugggacccagagccaagaaagcugagauauccugugcaccauagggacuuc

SEQ ID NO: 254991 - RNA, 64 nt, Human
ugugaaaacagacaauauuaguuuaggucgggaacugagauauuguaaucaaauaguuaacauc

SEQ ID NO: 254992 - RNA, 64 nt, Human
uuaaaauguaaagccaugcuggaaaauaauacugcugagauacauacagaauuacuguaacuga

SEQ ID NO: 254993 - RNA, 64 nt, Human
aggagaaauggguuuuuuguggucuugagucacacugagauagucaguugugugugacucuaau

SEQ ID NO: 254994 - RNA, 64 nt, Human
cuuuauuuaaauauaagguagcuaguuuuuacaccugagauaaauaauaagcuuagaguguauu

SEQ ID NO: 254995 - RNA, 64 nt, Human
ccuguagcuguccaucacacugacaggcuucuuccugagauauccucagguuuucucagccaga

SEQ ID NO: 254996 - RNA, 64 nt, Human
agagaucaucuggccaccccuagaggcagaugggcugagauaaaagacuguuggggccaccuga

SEQ ID NO: 254997 - RNA, 64 nt, Human
accuccccaguguucagguguuucacaagaaagucugagauaugacuagcuacacguuuugcca

SEQ ID NO: 254998 - RNA, 64 nt, Human
ucaggagcccacuucugacauaacuaacccacaccugagauaacggcauuaauccauucaugag

SEQ ID NO: 254999 - RNA, 64 nt, Human
cuuugcaacagcacugaaauggcuguaaggacuccugagauauguguccagcaaggaguuuaca

SEQ ID NO: 255000 - RNA, 64 nt, Human
uggagaaugagaauuauccaaaugcucagucuaccugagauaguaaauucauggcuuaugcuuc

SEQ ID NO: 255001 - RNA, 62 nt, Human
ggcauccucaaucauuaaccuucugaaagcucacaguacacauuaguauguauaacuggcuu

SEQ ID NO: 255002 - RNA, 62 nt, Human
aauuuaggaaauaaauaugcuauaaacaagguacaguacagugagaguuaacaauccuagga

SEQ ID NO: 255003 - RNA, 62 nt, Human
uuuucagaauaggaccagaugcccauagaagcacaguacagacugaaguaaacccaaacuug

SEQ ID NO: 255004 - RNA, 64 nt, Human
gauacaaaguuagugaggucuauguccagagaagcugagauauggcauauaauaggcaucuaau

SEQ ID NO: 255005 - RNA, 64 nt, Human
auuuuguaacuuaaaagcagcuauugguaaauuucugagauauagcaggagaccaaaacauguu

SEQ ID NO: 255006 - RNA, 64 nt, Human
agaugucacacccaccagcaucaccaaagugacucugagauagaccggucccuucucagcguuc

SEQ ID NO: 255007 - RNA, 64 nt, Human
ucgcuugagcccgggaagcagagguugcagugaacugagauagugauagugccacugcaauuca

SEQ ID NO: 255008 - RNA, 64 nt, Human
ugaccuuagccaagauauuccucuguucccucugcugagauaaagaauucccuuaacaugauau

SEQ ID NO: 255009 - RNA, 64 nt, Human
uguuuugagccuggaggaaaaggaaccaaguuaacugagauacugcugcuggaaugggcgagac

SEQ ID NO: 255010 - RNA, 64 nt, Human
agucuagucuagucuagucaugugugacuguguacugagauaccacuagcccaguuugcugggu

SEQ ID NO: 255011 - RNA, 64 nt, Human
caaggaacuuuccccagaucaaauucuauuaacgcugagauacaagucauccaugcacagccac

SEQ ID NO: 255012 - RNA, 64 nt, Human
aauaagauguucuauuuuaaacuauguaaauugacugagauauaggagagcugauaauauauua

SEQ ID NO: 255013 - RNA, 64 nt, Human
ccucgaagcgcccgaggaaacgagggccugcuggcugagauauggggcugugggcagcagacga

SEQ ID NO: 255014 - RNA, 64 nt, Human
accugacaguagucuuuguauucuauaguauguucugagauauaauguuaacauuguucauaac

SEQ ID NO: 255015 - RNA, 64 nt, Human
auauccuucuucauaaaucauggaaaacucacugcugagauaguaaaccaugaaaucgccuuuu

SEQ ID NO: 255016 - RNA, 64 nt, Human
ucuuugaaaauuucuuuuuacacguguaagccaacugagauaccgugaugguguugauuucuuu

SEQ ID NO: 255017 - RNA, 64 nt, Human
accacucugcaggcugggcccaggaugugguguccugagauaguuuuguaucuuaaagacugag

SEQ ID NO: 255018 - RNA, 64 nt, Human
guguuucuucaugacagcugcucaaagcagguuucugagauagcugaccgagcucugguaaauc

SEQ ID NO: 255019 - RNA, 64 nt, Human
gaacauuaaaauuuacugaaucguauauauucaucugagauaaaaauauaaaaagaauuaugga

SEQ ID NO: 255020 - RNA, 63 nt, Human
uggggaaagcagccaugcuccccccgaccuccagccgagcauccuucaugagccugcagaacu

SEQ ID NO: 255021 - RNA, 62 nt, Human
aauauuaagacgaccaucucuucuauuaaauuacaguacauguucuagaccauugagaucaa

SEQ ID NO: 255022 - RNA, 62 nt, Human
acucuguuucugaagcaggaaagccaccacagacaguacauaaaggaauauguguagcuggg

SEQ ID NO: 255023 - RNA, 62 nt, Human
auaauugcuuuuggaaaauaccaaaugaacguacaguacaacauuucaaggaaaugaauaua

SEQ ID NO: 255024 - RNA, 64 nt, Human
cuuuaggauuaacuuguaaaaaacauauccugaacugagauaugcaaaauacucauuuucaagu

SEQ ID NO: 255025 - RNA, 64 nt, Human
aaugcagagcccugagcuagggcaucagcagaagcugagauagagauauuggucaugguugacu

SEQ ID NO: 255026 - RNA, 64 nt, Human
cacuuuuuuguaaaaugagaauaauguuuauuuccugagauacugcuguauuuuuuaauugcua

SEQ ID NO: 255027 - RNA, 64 nt, Human
uguuagaagugggacacuccaaccacauuccaagcugagauaaaaucaaaucacaaauguuuaa

SEQ ID NO: 255028 - RNA, 64 nt, Human
accuccuuuguuucacuuauguuuuuuccaguaucugagauaauauaaagcuggguaauuuuuu

SEQ ID NO: 255029 - RNA, 64 nt, Human
agauccuuuaggacaugagacugguagaagcuggcugagauaaaauaaguauuuauuuaaacua

SEQ ID NO: 255030 - RNA, 64 nt, Human
gaaauguucugaaacugaauuacuucuuguacagcugagauagcuucuucugaacuauuauuaa

SEQ ID NO: 255031 - RNA, 64 nt, Human
cuucgcuuuguuccucgugccucugaacagacugcugagauacccaaucaagagccaauccuug

SEQ ID NO: 255032 - RNA, 64 nt, Human
uacaauauaguauuauaguaacaguuaucauacacugagauauaguuucugugcuuguaaaaaa

SEQ ID NO: 255033 - RNA, 64 nt, Human
guaccgggcuacuucuuaaaugccgucacuccugcugagauaaaugcgucuuuaaaaauagucu

SEQ ID NO: 255034 - RNA, 64 nt, Human
cuggguugggucaucuuguuggauaguaguaccacugagauagggaauucaagguuuggggcaa

SEQ ID NO: 255035 - RNA, 64 nt, Human
ggguacuacgcagcaacacucacaacuguccaggcugagauaaaucccgggaccugaacuauua

SEQ ID NO: 255036 - RNA, 64 nt, Human
ccccuaaguagucaucaaugcaauaagauugcgccugagauacaaggcccagaagccugaucuu

SEQ ID NO: 255037 - RNA, 64 nt, Human
acaaaaacccauauuucugaaauaaugcugauuccugagauaagaaaguggauuugauccccag

SEQ ID NO: 255038 - RNA, 64 nt, Human
ccauauugguggacaugggaaugguugguguggccugagauacccauugcucaccaggccucac

SEQ ID NO: 255039 - RNA, 64 nt, Human
uugcacuguuauaugcaagaaguggugaaucacacugagauacgucgauuuggggagagacccc

SEQ ID NO: 255040 - RNA, 62 nt, Human
guauuuauuggccaugcaaguagaggaaaugcacaguacaaauguuuuucuuuagcacguaa

SEQ ID NO: 255041 - RNA, 62 nt, Human
ugguucucaagaauuauaagagaaaugaacucacaguacaaaaauuuuauaauuacuauacu

SEQ ID NO: 255042 - RNA, 62 nt, Human
ucacacacccugaggucagggagugcuggcucacaguacagcaugugccuuaaugcuucaua

SEQ ID NO: 255043 - RNA, 64 nt, Human
guuuuauuguacauagguuuguaaacauuauugccugagauauuuguauauaacuugggcuuug

SEQ ID NO: 255044 - RNA, 64 nt, Human
gauggagaagaugucucagaugaagggagugucccugagauaucauccuuuucuucugccucgc

SEQ ID NO: 255045 - RNA, 64 nt, Human
gauuagugcaauaaaacucccuuccuuaugcauacugagauagcuuagugucucguggaaggug

SEQ ID NO: 255046 - RNA, 64 nt, Human
cagucccuggaaaaacagucacugacucaagacacugagauauucagcccacugcccaaugccu

SEQ ID NO: 255047 - RNA, 64 nt, Human
cagacccacuuauuucugccacaucugagucggccugagauagacuuuucccucuaaacuggga

SEQ ID NO: 255048 - RNA, 64 nt, Human
uggcacaugccuguagucccaccuacucgagaagcugagauagggucaccugagccugguaggc

SEQ ID NO: 255049 - RNA, 64 nt, Human
uggugugagaaucaaccaggcuuuccugcuccaccugagauaaccaacucccucccguaaucag

SEQ ID NO: 255050 - RNA, 64 nt, Human
accccaauaccaagaccaacuggcauagagccaacugagauaaaugcuauuuaaauaaagugua

SEQ ID NO: 255051 - RNA, 64 nt, Human
uggucccggagaugugcuauaugaaacauucuuucugagauauaucaaccacacguggaaaagc

SEQ ID NO: 255052 - RNA, 64 nt, Human
auggcucaaucauucacaugaggugagcuucagccugagauagcaggcgacagacuucuugcgu

SEQ ID NO: 255053 - RNA, 64 nt, Human
gguugauuuucaugauucaugagcuggguacugacugagauaagaaaagccugaacuauuuauu

SEQ ID NO: 255054 - RNA, 64 nt, Human
aacaucacagcagauaaugaagcugauuuuuuagcugagauagaagcuuuggagaaaaugaaug

SEQ ID NO: 255055 - RNA, 64 nt, Human
uuuuuccacuacacaacugccuuccugacagguucugagauaaguguuauguuuguagauagag

SEQ ID NO: 255056 - RNA, 64 nt, Human
aaugaagacagcuccuucucaucuuuccauaagccugagauacaaguucagggacucagcaaug

SEQ ID NO: 255057 - RNA, 64 nt, Human
aaaucuuauaguauuuauccacccaaaccccagacugagauacugcucccaggggccuagguag

SEQ ID NO: 255058 - RNA, 64 nt, Human
uuuuuguaaguucuauuuaauacuugcgacaacccugagauaguaaguauuauuauuguucuca

SEQ ID NO: 255059 - RNA, 62 nt, Human
uaucugaauuuauucgagacauuaagaaaaagacaguacauggugggaaagcugcacauuuc

SEQ ID NO: 255060 - RNA, 62 nt, Human
ccagaggucaaugaauaaucaaaacauuuuuuacaguacaccuuuccuggaugauaugcaau

SEQ ID NO: 255061 - RNA, 62 nt, Human
aagaguguguuuacaacuguuuucucuuuuuuacaguacauguauuuaaaucauugcuauaa

SEQ ID NO: 255062 - RNA, 62 nt, Human
ccaugagaaauaucagaguaaaacuuucuagaacaguacaagguuaaagaggugaggugacg

SEQ ID NO: 255063 - RNA, 64 nt, Human
ccggcgcggccccgggacucucgcgauaacuguacugagauaaaguguggcaacucgagcuggc

SEQ ID NO: 255064 - RNA, 64 nt, Human
aggacauuuaggagacaucugccucucuggcccucugagauaucccgaugggcacaaauggaag

SEQ ID NO: 255065 - RNA, 64 nt, Human
ccccucuucucugcccuccacccccgucucugcacugagauacauaagaaacaaggguaguuua

SEQ ID NO: 255066 - RNA, 64 nt, Human
gggcaaugugaaaaucaugauugcuacagaagcacugagauaauggaguggggaugacuguggc

SEQ ID NO: 255067 - RNA, 64 nt, Human
aacuugcuuucccuguuuucuggcacauucuacccugagauauucagcggcauaugcacugaug

SEQ ID NO: 255068 - RNA, 64 nt, Human
agcagggaauuccucuacuacaggaagaagguggcugagauaagaaaggaagcacagaagucgc

SEQ ID NO: 255069 - RNA, 64 nt, Human
aaacuacaacuuagacaacaccagaggguucauacugagauauauuuuugcagaugcaguauau

SEQ ID NO: 255070 - RNA, 64 nt, Human
gcaucuccugacacccgaggagcccugagucacccugagauagagauucccaguaacacaucca

SEQ ID NO: 255071 - RNA, 64 nt, Human
aaaugaaaacaauuuccucccuucccucaaaucucugagauaaccaguauguguauuucuucuu

SEQ ID NO: 255072 - RNA, 64 nt, Human
ugcgugcgcauguguagaggagagagcagggucccugagauaaugguuuccaaacuguaucgua

SEQ ID NO: 255073 - RNA, 64 nt, Human
cucccagaaccacuacaucuggcuuugggcaggucugagauaaaacgaucuaaagguaggcaga

SEQ ID NO: 255074 - RNA, 63 nt, Human
gggaggggcgcucugagauuaaagaguuuuaccucugagauaaaugugaaguguguugugagu

SEQ ID NO: 255075 - RNA, 64 nt, Human
aacuauuuaaagacccuccaaauacaguaaccuucugagauauugagauuuaggacuuccaaca

SEQ ID NO: 255076 - RNA, 64 nt, Human
ccgaaaagcauacacugagagaacauguauaaggcugagauagccugauaaacucauccuauua

SEQ ID NO: 255077 - RNA, 64 nt, Human
ccaucaggguuuuaauggcccucuagaauuaccacugagauacacuauuugauccauggauaac

SEQ ID NO: 255078 - RNA, 64 nt, Human
guuugguuugaaguuuuucagugaaggaaaaggccugagauaggaagcagugcccucgcuucau

SEQ ID NO: 255079 - RNA, 62 nt, Human
agaagaccccucaugaagucucaguuuucaguacaguacaucauuccuccucacuaggagca

SEQ ID NO: 255080 - RNA, 62 nt, Human
ugggcagagcaaaagacaucaaauaagcauccacaguacaagccuugaacaucguccugcuu

SEQ ID NO: 255081 - RNA, 62 nt, Human
ugggaaugcucuuuggucagacauucccucacacaguacaguuuaauaaaugugcauuuuga

SEQ ID NO: 255082 - RNA, 64 nt, Human
ccaucaccuugaacaauagcuuuagcuugggaaucugagauaugaucccagaaaacaucugucu

SEQ ID NO: 255083 - RNA, 64 nt, Human
gaaggggcuuuucagacagacuguuugcuuucugcugagauaaggaaugcaucacucugccaga

SEQ ID NO: 255084 - RNA, 64 nt, Human
agaugugcucccaccaggcagcuccagcuguuaccugagauacugaagugcagcucaggagacg

SEQ ID NO: 255085 - RNA, 64 nt, Human
augcauggggaaggauguuuuuggacauuaucaacugagauaggugggaaaccuccucucauuu

SEQ ID NO: 255086 - RNA, 64 nt, Human
uaacugccuuuccuucuaaagggaauguuuuuuucugagauaaaauaaaaacgagccacaucgu

SEQ ID NO: 255087 - RNA, 64 nt, Human
uugcuugaaccugggaggcggagguugcagugagcugagauaacgccacugcacuccaguguag

SEQ ID NO: 255088 - RNA, 64 nt, Human
ccucccacucuauucaaaguuaucucucugcucacugagauagauacauaucugauugccuccu

SEQ ID NO: 255089 - RNA, 64 nt, Human
uagggcugacaaagacagggacagccuuuguuuucugagauaccaaagagagccaggggagggc

SEQ ID NO: 255090 - RNA, 64 nt, Human
aucuaaggcacagccauucuguucucacuugguucugagauaguggugagaacagaggaugagu

SEQ ID NO: 255091 - RNA, 64 nt, Human
uugaaaugugugacucugcugagugacguaggcucugagauagcuguccacgcccacguguuug

SEQ ID NO: 255092 - RNA, 64 nt, Human
agaagaacaaauggcuggcuuggcaaauccccaucugagauaaaguaaacaagugaccagcagc

SEQ ID NO: 255093 - RNA, 64 nt, Human
cguccuuccuggguugggcuggagucuggacuggcugagauaagagccuggcaaccagcaagag

SEQ ID NO: 255094 - RNA, 64 nt, Human
aaggccccaugagcuacagucguuugaaguuuuacugagauauaaauuagaauggcaugugcug

SEQ ID NO: 255095 - RNA, 64 nt, Human
aaagacaagugacaggggcaauggaucucaggcucugagauaaguauaucagaugacacuggug

SEQ ID NO: 255096 - RNA, 64 nt, Human
uuucuguggaaauaugaggaaaauccaugguuaucugagauaggagauacaaacuuuguaauuc

SEQ ID NO: 255097 - RNA, 64 nt, Human
gacgccccguaguaugaauguacaucuuguaaaacugagauauaaauaaacuuauaaauauuug

SEQ ID NO: 255098 - RNA, 63 nt, Human
uuuuccaauugcaaccaaacguauagcagucaagccgagcaaccuguauaagcagcccaacac

SEQ ID NO: 255099 - RNA, 63 nt, Human
caaaccugacaagagaaaaacaaaccugaagcugccgagcaggaguggaugcagccugaucag

SEQ ID NO: 255100 - RNA, 63 nt, Human
ggcauggucugcccucugcauccucuggagccagccgagcaggaggccuaggaggguccucug

SEQ ID NO: 255101 - RNA, 63 nt, Human
cagcagccagcccugccuggaggaccugagccugccgagcaaccguggcccuuccuggacagc

SEQ ID NO: 255102 - RNA, 64 nt, Human
uucuuaggcaaauucagagaaauaagugcuaguuaauacuaaucaccuccuccucugucucuca

SEQ ID NO: 255103 - RNA, 64 nt, Human
uauuucugaguguagucucagcuuaaaguuguguaauacuaaaaucacgagaacaccuaaacaa

SEQ ID NO: 255104 - RNA, 64 nt, Human
ugguauaaaccagguaauuuggaagugaauuacaaauacuaaggauccagauuugaaggcacuu

SEQ ID NO: 255105 - RNA, 64 nt, Human
uucaaauuaagugugcaugauuguauauggaacaaauacuaaggucccagggugggagggcuag

SEQ ID NO: 255106 - RNA, 64 nt, Human
auuaucugcauuuaucuuuuuuccuaguuuuucuaauacuaauguuauuucuuaaaauucagug

SEQ ID NO: 255107 - RNA, 64 nt, Human
aauuuuuaucuuacuuuuggauaauauccacugcaauacuaauugagaaacaugaauuauuucc

SEQ ID NO: 255108 - RNA, 64 nt, Human
guaggguaagcagacacucugaaacaaugagaaaaauacuaaaaauugacuugaguuauuucaa

SEQ ID NO: 255109 - RNA, 64 nt, Human
cauuguuucauuuaguauuugguacaaucuaauaaauacuaauccaguccaauacuaauccaau

SEQ ID NO: 255110 - RNA, 64 nt, Human
auuugguacaaucuaauaaauacuaauccaguccaauacuaauccaauccaauacuaauaauac

SEQ ID NO: 255111 - RNA, 64 nt, Human
uaaauacuaauccaguccaauacuaauccaauccaauacuaauaauacuauugguacaauccaa

SEQ ID NO: 255112 - RNA, 64 nt, Human
caauccaauacuaauaauacuauugguacaauccaauacuaauaauacuauugguacaauccaa

SEQ ID NO: 255113 - RNA, 64 nt, Human
caauccaauacuaauaauacuauugguacaauccaauacuaauaauacuaacaguaguauugau

SEQ ID NO: 255114 - RNA, 64 nt, Human
acuaauaauacuauugguacaauccaauacuaauaauacuaacaguaguauugauacaaucuaa

SEQ ID NO: 255115 - RNA, 64 nt, Human
ucacucauguacuuaauaacacuucaccuucuguaauacuaaguccucagagcuccaugcuguu

SEQ ID NO: 255116 - RNA, 64 nt, Human
augaacauggucagaaccuuuggacaagaggaaaaauacuaagagauuugcuuuuucugggugc

SEQ ID NO: 255117 - RNA, 63 nt, Human
aaacugaccgugguggugaacaacaucgcgguggccgagcagaucggggagcucuucauccac

SEQ ID NO: 255118 - RNA, 63 nt, Human
auauccuccccacaagggcaauccccgggaccugccgagcagccaaggcccuguccuuucuug

SEQ ID NO: 255119 - RNA, 63 nt, Human
uuaagccugcugcuuuggcagugccaugggugagccgagcagcugugagguggguggggcagg

SEQ ID NO: 255120 - RNA, 63 nt, Human
cauucccuuaacugacauuauuuagugucagaggccgagcacaguggcucccaccuauaaucc

SEQ ID NO: 255121 - RNA, 64 nt, Human
augaagcaaggaugaauaauaucaugucuugguaaauacuaacaaauuuguuagguuuggugac

SEQ ID NO: 255122 - RNA, 64 nt, Human
guauuaaagauuauuuguaagucauuguauuaauaauacuaauaaaauuuaucaagccuuuaua

SEQ ID NO: 255123 - RNA, 64 nt, Human
auaaauccucuaauguaagucuagcuaccuauccaauacuaaauaccccuuaaaguauuaaaug

SEQ ID NO: 255124 - RNA, 64 nt, Human
augugcuaugucagccagucaggaaguucugguuaauacuaagauuuguagguuauaaucuagu

SEQ ID NO: 255125 - RNA, 64 nt, Human
cauuuacuuuuaaauaauuauaaugaaguuuugaaauacuaaguuaauccagaccuuuaguugu

SEQ ID NO: 255126 - RNA, 64 nt, Human
ccuuggucauucauaaauaaauaucuaaauuaggaauacuaauuaauugaauuuucacucauga

SEQ ID NO: 255127 - RNA, 64 nt, Human
ugguauuauaucuguuuuuuaaauuguugaacaaaauacuaaacuuuuacacgucuucccuugg

SEQ ID NO: 255128 - RNA, 64 nt, Human
gggaggagagacaggauaaagggcagaugucagcaauacuaagggcuuccucaugggagggcau

SEQ ID NO: 255129 - RNA, 64 nt, Human
uaaacuuugauuugucaaauuuuaugcuguguggaauacuaacuauauguauuuuaacuuaguu

SEQ ID NO: 255130 - RNA, 64 nt, Human
gguauuucagcuuugaaaccaaaucuguguaucuaauacuaaccaaucuguuggauguggguuu

SEQ ID NO: 255131 - RNA, 64 nt, Human
auugaaccaaaaugaauucuuucuaaggcauuugaauacuaaaacguuuauuguuuauagauau

SEQ ID NO: 255132 - RNA, 64 nt, Human
uaagaccauuuaagugugugcuaaacaacuacggaauacuaaauaaaaaguuuggccaaaacca

SEQ ID NO: 255133 - RNA, 64 nt, Human
uuuuuuuuaagccacauuaaauuaucuguuuauaaauacuaaagcaggaaaauggggggaaagu

SEQ ID NO: 255134 - RNA, 64 nt, Human
aacgauaauugcuuuauuuggaaaagaauuuaggaauacuaaggacaauuauuuuuauagacaa

SEQ ID NO: 255135 - RNA, 64 nt, Human
aaccugcucauaaccucauaguaugcaaccaaagaauacuaauucauuuuaucacuuucauugg

SEQ ID NO: 255136 - RNA, 64 nt, Human
guagcacagcacuuuugcaguaagauuggugugaaauacuaaacacuauggauuuuguaggugu

SEQ ID NO: 255137 - RNA, 56 nt, Human
ucuuggagaaaggcuucugaggcccagccgagcagccugcuugucagcaugcccug

SEQ ID NO: 255138 - RNA, 62 nt, Human
cauguaguuuguaccaucacuaaaugcuuggaacaguacacaugcaccacaacaaaggcuca

SEQ ID NO: 255139 - RNA, 62 nt, Human
acacaguagcaguuguaaauaauuuaugaaugacaguacacauuaaaagguaugcauuagca

SEQ ID NO: 255140 - RNA, 62 nt, Human
gacagguagcagaggguuuuaauacuucacuaacaguacacccuccucccccuugggcuagc

SEQ ID NO: 255141 - RNA, 64 nt, Human
gacucaaauuaagaaaaaauaaaacuaccuacgaaauacuaagaaaaauuuguauacuaauauu

SEQ ID NO: 255142 - RNA, 64 nt, Human
uucauugcauuuauuaaacaaauguuguauaaccaauacuaaauguacuacugagcuucgcuga

SEQ ID NO: 255143 - RNA, 64 nt, Human
uauuaaaucgcccuuggugaaagaaaauucuuggaauacuaaaaaucaugagauccuuuaaauc

SEQ ID NO: 255144 - RNA, 64 nt, Human
guaaaauuuaaauggggaaagauauuuaauauuuaauacuaagcuuuaaaaagaaaccugcuau

SEQ ID NO: 255145 - RNA, 64 nt, Human
uucagggaauaguuuaagcuuuauucauucaugcaauacuaaagagaaauaagaauacugcaau

SEQ ID NO: 255146 - RNA, 64 nt, Human
gucacuauucuuuacagauuucauagaagucgugaauacuaaguaauguauacaaaagaaauau

SEQ ID NO: 255147 - RNA, 64 nt, Human
aucauuuaagaguuccuguaacaguuaugcagaaaauacuaaaacccaucaggcaagaucacca

SEQ ID NO: 255148 - RNA, 64 nt, Human
gugccucuguaccaaauauuuuauggaauaucuaaauacuaaaauaaacuaugaaugaaucuca

SEQ ID NO: 255149 - RNA, 64 nt, Human
aggggaacauuuuguacacauuuaaguauauaaaaauacuaaaauauguaauuuuauaacaaag

SEQ ID NO: 255150 - RNA, 64 nt, Human
cuuuuuguuuuuucaaucauggccauauuaugaaaauacuaacaggauauaggacaagguguaa

SEQ ID NO: 255151 - RNA, 64 nt, Human
aguaauacuguuauguauaugcuaaauguugguaaauacuaauuaauuuccaucauuuguagac

SEQ ID NO: 255152 - RNA, 64 nt, Human
guguuuauguacuccugacguauuaaaauggaauaauacuaaucuuguuaaaagcaauagaccu

SEQ ID NO: 255153 - RNA, 64 nt, Human
acuacugaaggucagaucaaaguugaaaugcaaaaauacuaauuagagaauaaugugaauaaaa

SEQ ID NO: 255154 - RNA, 64 nt, Human
uauagaaguaauuuuugaugaggagaaaugguacaauacuaauuaacaacuugguuuaacaugu

SEQ ID NO: 255155 - RNA, 64 nt, Human
ucauuccauuugcugauugucugaaauuuucuagaauacuaauaaaauacauacuauagauucu

SEQ ID NO: 255156 - RNA, 64 nt, Human
uggucaagagauuacugagaaacucuuuuucuauaauacuaaauugugauuauaagaaauaguc

SEQ ID NO: 255157 - RNA, 63 nt, Human
cuuauugguauuuggcaaaccugguauccugcagccgagcaugaacaugaaauacauuagaac

SEQ ID NO: 255158 - RNA, 63 nt, Human
gaaacccugucucuacuaaaaauacaaaaauuagccgagcaugguggccugugccuguaaacc

SEQ ID NO: 255159 - RNA, 63 nt, Human
ugggacccacccagagcaccugugcuggaggaugccgagcagggacucucgucugugggacgg

SEQ ID NO: 255160 - RNA, 63 nt, Human
gcucuucucccgcaccuccauggaugcacugcugccgagcagagcguccucugccaggccccg

SEQ ID NO: 255161 - RNA, 64 nt, Human
agucaugauugguggucaaguggauucaagcuaaaauacuaagaccagcauucuuaguggcgcu

SEQ ID NO: 255162 - RNA, 64 nt, Human
guuaauacauauuacacuacaguuuacuuuucagaauacuaaagacuuuauaacugcaugaacu

SEQ ID NO: 255163 - RNA, 64 nt, Human
uggaaaaccuuugguaaugugauuuggguauaagaauacuaaaaccagaguacagggugugaau

SEQ ID NO: 255164 - RNA, 64 nt, Human
aauaguuuuuaggcuccaugaauuggcuccuguaaauacuaacgacaugaaaaugcaaguguca

SEQ ID NO: 255165 - RNA, 64 nt, Human
uuuauagcuguagguuuucuguguuuagcuauuuaauacuaauuuuccauaagcuauuuugguu

SEQ ID NO: 255166 - RNA, 64 nt, Human
aaugacaacuaccaccuuuuuuuccuuuuuaauuaauacuaaauauugugauuucuuauuugag

SEQ ID NO: 255167 - RNA, 64 nt, Human
uugguaucaucuucagagaaaaaauaaagcaagaaauacuaacaucaaaaggacagguaugaug

SEQ ID NO: 255168 - RNA, 64 nt, Human
ccucagaaaauuucucaaucuaugugauuuguguaauacuaaugagcuuugggcaauaaauacg

SEQ ID NO: 255169 - RNA, 64 nt, Human
agcugugugaaugcauagauguaaucuugucucaaauacuaauacaguggagauuugguuuaug

SEQ ID NO: 255170 - RNA, 64 nt, Human
ucaggagaugaaacccuuguucuuaggaucacagaauacuaaagcaccucaaaaaaacagguau

SEQ ID NO: 255171 - RNA, 64 nt, Human
uguggugaaaucauuuugcauuaaaggaagguaaaauacuaauaaauugcauauuccuugacca

SEQ ID NO: 255172 - RNA, 64 nt, Human
uuuucagugaucucauuugaaugauuuauagguaaauacuaaucagacauuauuaaaagcaaaa

SEQ ID NO: 255173 - RNA, 64 nt, Human
acaugauaaucugaagcuaauaugacaauauuuaaauacuaagugguacuagggaacuacaaga

SEQ ID NO: 255174 - RNA, 64 nt, Human
gcaauguguauaaaaguuccuacacugauuuugaaauacuaagaucagacuuugaaaauuuuaa

SEQ ID NO: 255175 - RNA, 64 nt, Human
aauaguagcuuaacuauuucacucuuuaaauaaaaauacuaaagaaguucguauauccuggaau

SEQ ID NO: 255176 - RNA, 64 nt, Human
uugaacauaaaaagugaauacaaauaaauucaguaauacuaaaacauacagagauacugaacuu

SEQ ID NO: 255177 - RNA, 63 nt, Human
ccguucuuuagcaauauaaccuacccagugcgugccgagcaggcuugguggggaagggacuug

SEQ ID NO: 255178 - RNA, 63 nt, Human
agacuuugucucuauuaaaaauaaaaaugauuggccgagcaugguggugcacaccaguauucc

SEQ ID NO: 255179 - RNA, 63 nt, Human
uguucuguagccgggaugacagcucucgcccaagccgagcaugccccgggcccccgccuccuu

SEQ ID NO: 255180 - RNA, 63 nt, Human
gcugggagagcuaucuggggagggggagaggaggccgagcagaauacaccccagaguuagggu

SEQ ID NO: 255181 - RNA, 64 nt, Human
aaaauauuuguguauguguacaaaagcguugauaaauacuaaucuuuaaaguuuguggaguucc

SEQ ID NO: 255182 - RNA, 64 nt, Human
auccuggaguugauauucaccauuugugaggagaaauacuaacuggacugacccuauugcuagg

SEQ ID NO: 255183 - RNA, 64 nt, Human
guauuuuuuuuuuuaaccaagggaugucucuuguaauacuaaccgcgugauaauggguuuucag

SEQ ID NO: 255184 - RNA, 64 nt, Human
aaauaauugaccaaguaaguuugcauaaaaugugaauacuaaauguguccccaguugcuggcau

SEQ ID NO: 255185 - RNA, 64 nt, Human
aauuugaacaaaaagauaaaucuucacagauaugaauacuaaauuauaucuuaaugaaaauaga

SEQ ID NO: 255186 - RNA, 64 nt, Human
aacuguuuagcuaauauucuauguuuaauuaaugaauacuaacucuaagaaccccucacugauu

SEQ ID NO: 255187 - RNA, 64 nt, Human
uacauuuugucugugaaaauauaguaaauuuuaaaauacuaauauaaugugguauucuugauua

SEQ ID NO: 255188 - RNA, 64 nt, Human
ugauugaauuucaauaccuuaauucagugcacauaauacuaauguaacagcagaugaaaauuga

SEQ ID NO: 255189 - RNA, 64 nt, Human
ucaaauccaaauagcaugaaugcuucucuguaguaauacuaauuuugugccuuuugucugcuuu

SEQ ID NO: 255190 - RNA, 64 nt, Human
uucaaacccguaucuauuccuaacuacugccucuaauacuaauuacuaacuuguuacuaaugcu

SEQ ID NO: 255191 - RNA, 64 nt, Human
uaguuuggauuuaggguuuugauacuuauguugaaauacuaauguuucugaucaauaaaaucaa

SEQ ID NO: 255192 - RNA, 64 nt, Human
uuuugcagugacaggauuuuagucucuuacuaugaauacuaauuucgaaccauagcuuucauuu

SEQ ID NO: 255193 - RNA, 64 nt, Human
ucucgggaguuggaacauuguuauccuuguaagaaauacuaagcuuauguugauuuuuaaguaa

SEQ ID NO: 255194 - RNA, 64 nt, Human
aauuccuguauucuacagcagauacuuugucagcaauacuaagggaagaaacaaaguugaaccg

SEQ ID NO: 255195 - RNA, 64 nt, Human
ugguauauaagauuucaggaaauaaacuacucugaauacuaaacauugguaaacguacaaucuu

SEQ ID NO: 255196 - RNA, 64 nt, Human
acucaguguaagagaaggcacauacauaguuaagaauacuaaaguauuuuuaaaaaucaaggaa

SEQ ID NO: 255197 - RNA, 63 nt, Human
uaaaccucgguauuagccagccgcgcagaggaugccgagcacuuuccgggagcaaucggacuc

SEQ ID NO: 255198 - RNA, 63 nt, Human
ugaaauuuaaggaaagagccauuuuuuaaaaaugccgagcagggcaaugcaaguacagccaaa

SEQ ID NO: 255199 - RNA, 63 nt, Human
uuuucucuuugggccgggccgggccggggaagggccgagcaggcuccaggaggccuccagagu

SEQ ID NO: 255200 - RNA, 63 nt, Human
cggcgcauggagauggauaagaccagggaaugggccgagcagcugacaaagaugggccggggc

SEQ ID NO: 255201 - RNA, 64 nt, Human
uauucauaugacaagagauucaugcaacauuaaaaauacuaaaauacuugugugccaaagcauu

SEQ ID NO: 255202 - RNA, 64 nt, Human
caaaggagaaaaagaaccccacuuauucuuaguuaauacuaaaauauauagcaauaaauugcug

SEQ ID NO: 255203 - RNA, 64 nt, Human
aagguuagaaucuaaggacaaagaaugauccaaaaauacuaaggaaaaagaacaauuuucaauu

SEQ ID NO: 255204 - RNA, 64 nt, Human
uaggccuggcugaguugugccuaaggguggcugaaauacuaaaacacuuaucuuacagcaagug

SEQ ID NO: 255205 - RNA, 64 nt, Human
agaaaaugaaucuccaaaguaucuucaaagaauaaauacuaauggcagaucugcgauuucuggg

SEQ ID NO: 255206 - RNA, 64 nt, Human
uccuuuucugacauucaauuucaaucucagaucaaauacuaauaaacaauuagaaaucuuacuu

SEQ ID NO: 255207 - RNA, 64 nt, Human
ucugcaauaaagcauacauuuuuucaagaauuuaaauacuaaaaaucagauaaauguggauuuu

SEQ ID NO: 255208 - RNA, 64 nt, Human
aguucuuguuuuuugucacacuacuuuauauaacaauacuaagucaacuaagcuacuuuuagau

SEQ ID NO: 255209 - RNA, 64 nt, Human
ggaauugcugugauuaaagugaucaaaaugccaaaauacuaaaggaaaucaauuguucacaggu

SEQ ID NO: 255210 - RNA, 64 nt, Human
acauagcuuuagagaagccauaacguuagacugcaauacuaacgaccgacgccccuccgggcag

SEQ ID NO: 255211 - RNA, 64 nt, Human
gcuacaugacuaugucuaaaaacugaauacucagaauacuaaagguuuggugcuuaaauuuauu

SEQ ID NO: 255212 - RNA, 64 nt, Human
gagccucaauuauuaaggaaaagucuucaggaaaaauacuaaaauauuuucucuuccucauaag

SEQ ID NO: 255213 - RNA, 64 nt, Human
guuuauaucauuuuuuccagguacacgggaaggaaauacuaagaacccugcaagauguuuucug

SEQ ID NO: 255214 - RNA, 64 nt, Human
uaaaaauaugugagcaugaaacuaugcaccuauaaauacuaaauaugaaauuuuaccauuuugc

SEQ ID NO: 255215 - RNA, 64 nt, Human
ugguuuauuuagguuauuuguuaaaacuucaguaaauacuaaaguuacuuguauuagaacauaa

SEQ ID NO: 255216 - RNA, 64 nt, Human
augauacugguucuuacucccaccaguguuucauaauacuaacaagauggucucuccuagcaag

SEQ ID NO: 255217 - RNA, 63 nt, Human
gggauuacgggcuggagccaccgugcccggccggccgagcauaagaaguuuaaucaaaguaac

SEQ ID NO: 255218 - RNA, 63 nt, Human
aaauaagaucauguuuuaauugugagaaacagggccgagcacaguggcucacgccuguaauac

SEQ ID NO: 255219 - RNA, 63 nt, Human
uuguugugggggcugcccuguacggcaaagaaugccgagcagcacuuccagucuccacccaca

SEQ ID NO: 255220 - RNA, 63 nt, Human
ggacacuuacggacacagaaaugcacaggggaggccgagcauaaccaggggugaggggcaggc

SEQ ID NO: 255221 - RNA, 64 nt, Human
uuugcuuuuccuuuauaauggggucauuguuauuaauacuaauuguucuuucugguuuaguccu

SEQ ID NO: 255222 - RNA, 64 nt, Human
uaaauaagagcauuaaaagacuuuaaugauuuggaauacuaaauuuaauuguuuagaauauuaa

SEQ ID NO: 255223 - RNA, 64 nt, Human
agacucugguccaccaaccagacccuuggaaaggaauacuaaaaucauuacaagguauggauuu

SEQ ID NO: 255224 - RNA, 64 nt, Human
cuguucucuuucaaaaggaagagcaaccguguugaauacuaauaaugaugaauuaguauucagu

SEQ ID NO: 255225 - RNA, 64 nt, Human
cagaggggaaaaaggagcagcucuuaagaaacagaauacuaagggcccccauuacuguguggcc

SEQ ID NO: 255226 - RNA, 64 nt, Human
auauuugguuaaacauuucuaaaaauaaacuaccaauacuaaauaguaagaaaccuaacuuuag

SEQ ID NO: 255227 - RNA, 64 nt, Human
auuaauaaugguacuuaugauuaaaaacgcauuuaauacuaacugcaguaguucuuucaagaau

SEQ ID NO: 255228 - RNA, 64 nt, Human
uuggagauucagugcauaacuaaguauuuuccuuaauacuaaagauuuuaaauaauaaauagug

SEQ ID NO: 255229 - RNA, 64 nt, Human
auaaucuuccuuaaaagaaagaguguagccuauaaauacuaaauaugauaccuuuuccuucuag

SEQ ID NO: 255230 - RNA, 64 nt, Human
ucuaaauacuguuuuacccguuuucucuuguaggaauacuaacaugguauagauuaucugagug

SEQ ID NO: 255231 - RNA, 64 nt, Human
gccgagggcucucagagacccccuuaaccucccaaauacuaagaagcuaaaauauuuuaauauu

SEQ ID NO: 255232 - RNA, 64 nt, Human
aacauuuaugaugucaauuagugaaaguauugaaaauacuaaauuauaacuaaaagcaacuuuu

SEQ ID NO: 255233 - RNA, 64 nt, Human
ucuuuggcauacuuuguagacuuugaccacuuaaaauacuaaguggccaaaugauaaaaaaaac

SEQ ID NO: 255234 - RNA, 64 nt, Human
cuuuuuuuaacuuuauuugacuaauaugacugucaauacuaaaauuuaguuguugaaaguauuu

SEQ ID NO: 255235 - RNA, 64 nt, Human
gcuuauguaaucucaccucaccuggaugaucacuaauacuaauucauuuauuacuaaccuucug

SEQ ID NO: 255236 - RNA, 64 nt, Human
aagcauaaaauaaugauuuuucacucucuuuaaaaauacuaaaucauuuauguccauuucucaa

SEQ ID NO: 255237 - RNA, 62 nt, Human
cauauguuauuuggaaauauagguauuuuaguacaguacauacuugcauuacauagguacuu

SEQ ID NO: 255238 - RNA, 62 nt, Human
uguaugguauuuuuaugaaaaagaacugcacuacaguacaauuuacaacaaugcugcugaua

SEQ ID NO: 255239 - RNA, 64 nt, Human
aaacuaucuuauugacuuauuauuuaagccuuuuaauacuaaguaugaaacaaccuauggucug

SEQ ID NO: 255240 - RNA, 64 nt, Human
aaugucucaugauguaaaaaauauuaaagauaucaauacuaagugacaguaucacucuaauaua

SEQ ID NO: 255241 - RNA, 64 nt, Human
agccaguaagauuuaaucacaauuuuucuucuuuaauacuaagagauggguaccuuaguacccu

SEQ ID NO: 255242 - RNA, 64 nt, Human
agaaaaaaugugaagucuacuuuaguauuccuguaauacuaaaccguugaguuucuaaauauuu

SEQ ID NO: 255243 - RNA, 64 nt, Human
guaaugccguauuuauuguuuuuaaaaugaaaggaauacuaauaagucuuaaaaguuccuucau

SEQ ID NO: 255244 - RNA, 64 nt, Human
uuucacuugcaccuuuuuuauaagaauauauuguaauacuaaaaaauauuaaauucauaccauc

SEQ ID NO: 255245 - RNA, 64 nt, Human
aggaaaucauuagguaacaucaauccuaacuagaaauacuaaaaauggcuuuugagaaaaauac

SEQ ID NO: 255246 - RNA, 64 nt, Human
ucugauuucuggucccuccuuucucgacaacuauaauacuaacccuuuucucaggauaacuguc

SEQ ID NO: 255247 - RNA, 64 nt, Human
uucauguggacauucaggaagcuuauucucauauaauacuaaucuaaacaguacuagaaauuac

SEQ ID NO: 255248 - RNA, 64 nt, Human
gacaaaauuuguuagggucauucaugaaaacuuuaauacuaaaagcacuuuccauuauauacuu

SEQ ID NO: 255249 - RNA, 64 nt, Human
aauauaauuuauauuacaauguaaaagcuucuuuaauacuaaguauuuuucaggucuucaccaa

SEQ ID NO: 255250 - RNA, 64 nt, Human
acuugauuacauaugcacauguauguaaauguaaaauacuaauauucacuaauauauguacaua

SEQ ID NO: 255251 - RNA, 64 nt, Human
aaucauuguugaacuaccugaaacaagucuuuagaauacuaaauauaaugcuguugucucuucc

SEQ ID NO: 255252 - RNA, 64 nt, Human
aauagauaaccaccuuuaauauuacacugcuuauaauacuaauguuuacagauauguuucuguu

SEQ ID NO: 255253 - RNA, 64 nt, Human
cuaucaaaaucuccauaggucaaaauauuguuggaauacuaaaauuugcaaccuuguuuacuuu

SEQ ID NO: 255254 - RNA, 64 nt, Human
acugaacagcuuuuauguacagcucugauucuguaauacuaauauuuauuuacuuuguuucaua

SEQ ID NO: 255255 - RNA, 63 nt, Human
caaaugaaaaaaaaaaguaaucucagaauguuggccgagcaugguggcucacaccuguaaucc

SEQ ID NO: 255256 - RNA, 64 nt, Human
aaagggaacaaagcugccauaaaucgaaauguucaauacuaaaagcuaaaauauuucucaccau

SEQ ID NO: 255257 - RNA, 64 nt, Human
auuuuuauuucuuugggggcuuuuuuucuuggcaaauacuaaaaaucucgucaauguaauuucu

SEQ ID NO: 255258 - RNA, 64 nt, Human
auauguugaauuaugucagugugggcagcaguagaauacuaaaaggaaaaugucauguuaagca

SEQ ID NO: 255259 - RNA, 64 nt, Human
uuguauauauuggaaauguacauauccaauaugaaauacuaaaacaaacaaacaaacaaaaaac

SEQ ID NO: 255260 - RNA, 64 nt, Human
cuaaucauguuuuuaacauuuuaaaauaaaauuuaauacuaagaaauuauggcuuauaguaucu

SEQ ID NO: 255261 - RNA, 64 nt, Human
auccaaauauugccguuucauaaauguaauaaguaauacuaauucacagaguauuguaaauggu

SEQ ID NO: 255262 - RNA, 64 nt, Human
gaacaauaucugccaacugaaccuguugucuucaaauacuaaggaaggagaaugagggguacgg

SEQ ID NO: 255263 - RNA, 64 nt, Human
ggaauguggaagacauaauccuuuggaaacuguuaauacuaaaagauauguuucugauacaaua

SEQ ID NO: 255264 - RNA, 64 nt, Human
aaauuucaugaagaaaaccucuggcacauugacaaauacuaaaugugcaaguauauagauuuug

SEQ ID NO: 255265 - RNA, 64 nt, Human
aauuuaccuucaguuuaaucuguggauuuguucaaauacuaaagauccucagguccagaauucc

SEQ ID NO: 255266 - RNA, 64 nt, Human
ggaauaaucgaacaucuaaagccuugaauaagagaauacuaauuguuuugguaugaugauacuc

SEQ ID NO: 255267 - RNA, 64 nt, Human
aguacuaauuaaaugcuaacauaggaaguuagaaaauacuaauaacuuuuauuacucagcgauc

SEQ ID NO: 255268 - RNA, 64 nt, Human
auauauuauauauauauauauauuuuuaaggugaaauacuaaacacuacuuucugucuguggau

SEQ ID NO: 255269 - RNA, 64 nt, Human
gaaugauacugauuagacuuugagccaaggggaaaauacuaaauucuuuuaaaccuggagccuu

SEQ ID NO: 255270 - RNA, 64 nt, Human
aggcagugaauguuuuguguuuacuucuaagggaaauacuaacuuucuuucgcauuaguauuaa

SEQ ID NO: 255271 - RNA, 64 nt, Human
ccacauucuuuuugacugcuguaguccauaugugaauacuaaauguuaaacuucaucagcguca

SEQ ID NO: 255272 - RNA, 63 nt, Human
ugcugcccaccucucucgcaccccaguaugacugccgagcacugaggggucgccccgagagaa

SEQ ID NO: 255273 - RNA, 63 nt, Human
agauuuugcuuuuguuuguuaaucauaggcauggccgagcauuguggauuagccugaggcuua

SEQ ID NO: 255274 - RNA, 62 nt, Human
uaaaauaaguagauagcugcuguuaauauaauacaguacauuuuggggggcauauguguggu

SEQ ID NO: 255275 - RNA, 62 nt, Human
ucuuaaccccagcuaaaugacucugaggaccaacaguacauuucuuuuauguuuuucaaauc

SEQ ID NO: 255276 - RNA, 64 nt, Human
uuuuuuuaauuuguaaguauucuaagaguuuccuaauacuaagguuaaaauuuucauguugacc

SEQ ID NO: 255277 - RNA, 64 nt, Human
ucuguccuuacauacucaaugcauauaugaaaacaauacuaaauaaacaucugaucuguauaaa

SEQ ID NO: 255278 - RNA, 64 nt, Human
uuccuuaaacauaauacccuuugucuuggaguagaauacuaaguuagaguuaguggauuucuag

SEQ ID NO: 255279 - RNA, 64 nt, Human
gggucagggagagucuuuuuuuuuuuuuuuuuuaaauacuaaauuggaacauuuaauuccauau

SEQ ID NO: 255280 - RNA, 64 nt, Human
ccguggguugauagcuggaggaauuguuuuggacaauacuaacaugugaauuuaugucuuaguu

SEQ ID NO: 255281 - RNA, 64 nt, Human
aaugcaaggauucauuaacucuuugaauuuguuaaauacuaacaguuaaccauuagaagugguu

SEQ ID NO: 255282 - RNA, 64 nt, Human
ugguuauuaagccuggagaguguuugaauggcaaaauacuaauccuacuaauaauuguggauuu

SEQ ID NO: 255283 - RNA, 64 nt, Human
aacugucggacccgucuguaaaccaaggacuaugaauacuaaauguuaaguucuaggcaauuau

SEQ ID NO: 255284 - RNA, 64 nt, Human
acauugucuuuugaaaauaguuucuuuuuaaaggaauacuaauuaauuguaacuuguaaaacca

SEQ ID NO: 255285 - RNA, 64 nt, Human
cagaagugcuacacgggcuacagcugaagauuggaauacuaaagaauaaacaucauccugaccu

SEQ ID NO: 255286 - RNA, 64 nt, Human
guugugauauugaggucuuccuuccuaacaaauuaauacuaaaaugaaacagcuuuucuugugu

SEQ ID NO: 255287 - RNA, 64 nt, Human
uuuguuuuguuuugauuuuuggugguggauaaauaauacuaaaaggacucuaguggaaaggggg

SEQ ID NO: 255288 - RNA, 64 nt, Human
ugagcuguuucauuuccuugaugauguccuuugaaauacuaaagcuuuuaauuuugaugauguc

SEQ ID NO: 255289 - RNA, 64 nt, Human
ugaguguguaaacugcauacguuaaauaaauguaaauacuaauguacugcugccuucuggugug

SEQ ID NO: 255290 - RNA, 64 nt, Human
uagaaauuggucuuaauuuauauaaucaauauaaaauacuaaugcaauucuacagcauucaaau

SEQ ID NO: 255291 - RNA, 64 nt, Human
uuuguuuuuacaaauguuaaaauguguuguuccaaauacuaaugaaaacagaaugucucuuccu

SEQ ID NO: 255292 - RNA, 62 nt, Human
aacuuucuuauugccuuuggcuguugauuaguacaguacaagugcgauuucaaaaagaucuu

SEQ ID NO: 255293 - RNA, 62 nt, Human
aacuuuuaaaccagauuacugguuaaaauccaacaguacacaauuuauaaaguaaaaagauu

SEQ ID NO: 255294 - RNA, 62 nt, Human
uccuuaugaauuaaaacaaugcauauuuuacuacaguacagaguuuaaaugaauacauaaau

SEQ ID NO: 255295 - RNA, 64 nt, Human
uugaacaauaguaaugguugcaugauuugguaaaaauacuaaaaacuauggaauuguuuaauua

SEQ ID NO: 255296 - RNA, 64 nt, Human
gaacuggggcaaaugcuggcauccaggagccgccaauacuaacaggacagguuccauugccaug

SEQ ID NO: 255297 - RNA, 55 nt, Human
guuuuggauuucuuuacugauuucuaauacuaauaaagccuugggguuucuugau

SEQ ID NO: 255298 - RNA, 64 nt, Human
cugggcaacauggcaaaugccgucucugcaaaaaaauacuaaaauuagcuggucgcgguggcuu

SEQ ID NO: 255299 - RNA, 64 nt, Human
agauagagcaauguuucccaaauuguuuuucuagaauacuaauuuccagagagacauucacaag

SEQ ID NO: 255300 - RNA, 64 nt, Human
uauuaaagacagggagucguggcugucucuacauaauacuaacauuucagugaaaaaaguacaa

SEQ ID NO: 255301 - RNA, 64 nt, Human
gagggacuguauuucuguggaaaacaauuugcauaauacuaauuuauugccguccuggacucug

SEQ ID NO: 255302 - RNA, 64 nt, Human
agaauuuaucagauuagagcagcaggagaaaauuaauacuaaauuauaaucauuuuagugauau

SEQ ID NO: 255303 - RNA, 64 nt, Human
aagaggaacagaagcagggucgggguggagggagaauacuaaacuuagcuugagacauuuugca

SEQ ID NO: 255304 - RNA, 64 nt, Human
aagaaaaaacucuguuguaaaaacaguuuaacacaauacuaaacugcuaaacaacuagauguaa

SEQ ID NO: 255305 - RNA, 64 nt, Human
cuauuaucuggugucaccucauguaucguaaguuaauacuaaaagaagagaaagcacuuaaguu

SEQ ID NO: 255306 - RNA, 64 nt, Human
gaaaauaucuuccucucuuccccauucuauacaaaauacuaagugguuuucuugcucccacucc

SEQ ID NO: 255307 - RNA, 64 nt, Human
ugcuuguucagcuuuccuuuaacaccuguugguaaauacuaaugggaguagacagaguuguaug

SEQ ID NO: 255308 - RNA, 64 nt, Human
gcuuuuuaaaaguuaguuuugagaauugagacacaauacuaauacuguaggaauuggugaggcc

SEQ ID NO: 255309 - RNA, 64 nt, Human
augcauauugaaauaacacauauaguaacgugggaauacuaaaaaauaaccaagauuuuauauu

SEQ ID NO: 255310 - RNA, 64 nt, Human
auaacucgcguuuacauaugugauaguuaugcuuaauacuaauucacagaguuggcucgaucau

SEQ ID NO: 255311 - RNA, 62 nt, Human
uuuuuuuugaguuguuguuuguuuuuagauccacaguacaugagaauccuuuuuugacaagc

SEQ ID NO: 255312 - RNA, 62 nt, Human
gcagugcauuugucauuagucuucauguuaauacaguacauuuauucuuugguaccugccug

SEQ ID NO: 255313 - RNA, 62 nt, Human
gaggagagaggauguaccucucuggugcuguuacaguacauucuguaccugccauacaggcu

SEQ ID NO: 255314 - RNA, 62 nt, Human
uuguuaacuagguccgcuuucaugugcaucagacaguacaccuauagcaagcacacguagca

SEQ ID NO: 255315 - RNA, 64 nt, Human
auucuguaguucugugaaaaauuuuuuucuucagaauacuaauauuuugaugcauguguaucac

SEQ ID NO: 255316 - RNA, 64 nt, Human
gauauggccaaggaauagcaggauucacuauuauaauacuaauuguuaacucauuauuuaauug

SEQ ID NO: 255317 - RNA, 64 nt, Human
uaaauaugaaccauauucucauugugagaauuuuaauacuaauggaauguuucaaagguuuuau

SEQ ID NO: 255318 - RNA, 64 nt, Human
auuuuaggaaggauuaaugguuaaguguauauaaaauacuaauauuaaguaaacuucauauugg

SEQ ID NO: 255319 - RNA, 64 nt, Human
cauuugccuacaauaaauuauugcagcaguuugcaauacuaaaauauuuuuuauagacuuuaua

SEQ ID NO: 255320 - RNA, 64 nt, Human
caguguaacccaagcauuuguggacaaugaguggaauacuaaaguuaaaaagucaaacuuucac

SEQ ID NO: 255321 - RNA, 64 nt, Human
guuacuggauuuguuguucuuucagaaagcuuugaauacuaaauuauaguguagaaaagaacug

SEQ ID NO: 255322 - RNA, 64 nt, Human
agcucugguauugcucauaacuuaccaagaggcuaauacuaaacuuggaaaauuguuuaaguau

SEQ ID NO: 255323 - RNA, 64 nt, Human
uuaauaauaccaagacuaagcaccauaaccaagaaauacuaauguaaagauuguuucuuguuuc

SEQ ID NO: 255324 - RNA, 64 nt, Human
aucauugcauuuguuuugaaauguuaauauguuaaauacuaaacuaauauuucaaaaaugugua

SEQ ID NO: 255325 - RNA, 64 nt, Human
uuggaguuucagaaggaaauuauucugcaucacaaauacuaaauuuuauauuucuaaauuacua

SEQ ID NO: 255326 - RNA, 64 nt, Human
cauauuuuuaaaaguuacguguuccacagaauaaaauacuaauuguaaaugcugcaucuuuuaa

SEQ ID NO: 255327 - RNA, 64 nt, Human
uuuccugcuuugccccuuuucuuccugacuuacuaauacuaaagaaguugggggagcucgagag

SEQ ID NO: 255328 - RNA, 64 nt, Human
uuuagaagagauuauccuauauuccuaucaguauaauacuaaaauguaacuuuuuaaucaucug

SEQ ID NO: 255329 - RNA, 64 nt, Human
gauuuucccauuaacaauuuuuuuuuguuuuuuaaauacuaauauguuucacacuauaguuugu

SEQ ID NO: 255330 - RNA, 64 nt, Human
uaagaauaaaacauccaaauuuuaaguauuaugaaauacuaaaacuacauguuuuaaaacagag

SEQ ID NO: 255331 - RNA, 63 nt, Human
augaacucugaacuuuggagagugagcuacagagccgagcaauauuuauggaugcaacacgca

SEQ ID NO: 255332 - RNA, 63 nt, Human
uagcuugcgcucuacucuguaguuauguggauugccgagcaaugacccuuuucaauuucuuau

SEQ ID NO: 255333 - RNA, 63 nt, Human
ccagacgcccaccugugccucagggcaccgccugccgagcagagaaggcacagcagccgucag

SEQ ID NO: 255334 - RNA, 63 nt, Human
cccagcggcugcuucccugcaagccagcgacuugccgagcagaaugagcucugcuccugagcc

SEQ ID NO: 255335 - RNA, 64 nt, Human
gaaauauuaacuuuuuuaacccuuuaccauuuuaaauacuaacugggucuuucagauagcaaag

SEQ ID NO: 255336 - RNA, 64 nt, Human
aguguaguugcaauaaacuuagaacauaugcauuaauacuaaaccuaugcaguaauaccauaau

SEQ ID NO: 255337 - RNA, 64 nt, Human
caaguuuuaacaaaagagguauguagucacaguaaauacuaagauggcauuucuaucucagagg

SEQ ID NO: 255338 - RNA, 64 nt, Human
cuccaucccccugcauugcucuucugugaaagcaaauacuaaaggaugccauccucuggaaucc

SEQ ID NO: 255339 - RNA, 64 nt, Human
caagugaaugagaauuaaaaauuuucuaaauauuaauacuaacugggaaaaaaaaacuagugug

SEQ ID NO: 255340 - RNA, 64 nt, Human
cacacaccuaauacuacauucaaaguauuuuauaaauacuaacccuugaagaaagcaguuauau

SEQ ID NO: 255341 - RNA, 64 nt, Human
uuuauuaaacaaacaaacacagaguuugaacuauaauacuaaggccugaagucuagcuuggaua

SEQ ID NO: 255342 - RNA, 64 nt, Human
gggguguccacaaagucaaagcuauuuucauaauaauacuaacauguuauuugccuuuugaauu

SEQ ID NO: 255343 - RNA, 64 nt, Human
uauuuccauaccugacucuggguguggugguuaaaauacuaauuuuaaagucuuccagugacuu

SEQ ID NO: 255344 - RNA, 64 nt, Human
uccuuaauuaaaugaguaacuucuaaaauauaacaauacuaaauaucacacugcgauggagguc

SEQ ID NO: 255345 - RNA, 64 nt, Human
cucugaagaaauuuaggauuuuucucuuaaagcaaauacuaaagaggaaaaaaaauuaacuuua

SEQ ID NO: 255346 - RNA, 64 nt, Human
cccaucuccaaaaauauaauaauaauucucucaaaauacuaaacagaggugguuuuauugauaa

SEQ ID NO: 255347 - RNA, 64 nt, Human
cacagauagauaaagcaagucuaucaacauuaaaaauacuaaaaaauaaagacacacacagagc

SEQ ID NO: 255348 - RNA, 64 nt, Human
uguagcauuucagauugagcacuucacuaucaaaaauacuaacaucacauggcuugaagaguaa

SEQ ID NO: 255349 - RNA, 64 nt, Human
gcacuuuucaagaugugagaagguacuaaaacuuaauacuaaaacaugagagggaaaauaugug

SEQ ID NO: 255350 - RNA, 64 nt, Human
guacuagacaagguuaccaagugcggaauugguuaauacuaacagagagauuugcuccauucuc

SEQ ID NO: 255351 - RNA, 62 nt, Human
uugggaauuuuucucaaaaauauguggauaucacaguacaauuucuaauugauccuguucac

SEQ ID NO: 255352 - RNA, 62 nt, Human
ggccuugcauugccuugguaaaguaaaaggaaacaguacacuuggagcuaggaaaccaaagc

SEQ ID NO: 255353 - RNA, 62 nt, Human
uuacaggggggaaggguaaaccaguagggaauacaguacaaucccaacccuacugggagggg

SEQ ID NO: 255354 - RNA, 64 nt, Human
aauuuaccuuguuaaauauuguagauaaauugcuaauacuaauagccaaauagauaacacuaau

SEQ ID NO: 255355 - RNA, 64 nt, Human
uauuuuugaauaguaguugcagcuuguuuguauaaauacuaaaaaauaucuuaacagauuuuuu

SEQ ID NO: 255356 - RNA, 64 nt, Human
uguauugaaaguuucuaauuaugcuuuuuaaaaaaauacuaaaaauaaagguucaagcugccaa

SEQ ID NO: 255357 - RNA, 64 nt, Human
uugaagccccuuggcuuacagcauuugccugcugaauacuaaacacucacauggcaagaguugc

SEQ ID NO: 255358 - RNA, 64 nt, Human
cugcaacacgcguuuguuguugguauaccaaugcaauacuaaguugaugaagcacgcagcucaa

SEQ ID NO: 255359 - RNA, 64 nt, Human
auuagucaaaaauucuauagaaugacucacuucgaauacuaagacacaggagguuuagccugcu

SEQ ID NO: 255360 - RNA, 64 nt, Human
acuacguaaauucugaguuuaaaugucauacacaaauacuaagacacuuugcauuuuuaaaaau

SEQ ID NO: 255361 - RNA, 64 nt, Human
aacauauuugcaaaauuugcccagauccuauuacaauacuaaaaauagaaaauuucaccuccau

SEQ ID NO: 255362 - RNA, 64 nt, Human
uuuauggagauugguguuguaacauauuuugauaaauacuaacuuauuuuguugggguuuuggu

SEQ ID NO: 255363 - RNA, 64 nt, Human
accaaagucagccgugguggcugcacuggcacagaauacuaaacugagugugacuauuuucacu

SEQ ID NO: 255364 - RNA, 64 nt, Human
cgcuuaaaggaaaaaaaaaucuaaaacugcgaagaauacuaaauguaguugagaaauaauugau

SEQ ID NO: 255365 - RNA, 64 nt, Human
auucauuuucugacaugcauuguuggcuauuugaaauacuaaaagcaaaucuacagauccuuuu

SEQ ID NO: 255366 - RNA, 64 nt, Human
ccuuauuuuucacuguacagacacuaauucauuaaauacuaauugauuguuuaaaagaaauaua

SEQ ID NO: 255367 - RNA, 64 nt, Human
cuggcagacucauugcagcaggugguaaugauaaaauacuaaacuacauuuuauuuuuguaucu

SEQ ID NO: 255368 - RNA, 64 nt, Human
aggaaauuucugcaugauuuuuuaauauuuacaaaauacuaagguagagccauagcgccgccug

SEQ ID NO: 255369 - RNA, 64 nt, Human
acauggauuuauaacuuaauguuucuguuuauaaaauacuaaugauuugcaauguauuuuacug

SEQ ID NO: 255370 - RNA, 54 nt, Human
gcguccagcccuaccuauagaagggccgagcacagcaaugcaaguaagugggca

SEQ ID NO: 255371 - RNA, 59 nt, Human
augcugcaggguacccauagcaaguuauagccgagcaaaugaaccguccuccugccucu

SEQ ID NO: 255372 - RNA, 63 nt, Human
uauagggaccaacugggaccgagugcccagggggccgagcacggucaugcuggccggccugca

SEQ ID NO: 255373 - RNA, 63 nt, Human
gaugggggccagcagcugucauccuccugggaagccgagcagugucccugguggguaacaccc

SEQ ID NO: 255374 - RNA, 64 nt, Human
aaaaauaaguaauuuacaggaaaggcaaaaugcuaauacuaacauuuguagcacuugaugauuu

SEQ ID NO: 255375 - RNA, 64 nt, Human
aaacauucaaagugcuuccaucagaacggaguaaaauacuaaacaccucugaagacugcaaacu

SEQ ID NO: 255376 - RNA, 64 nt, Human
uuaaauauucuuuagugcuuguuuauuauuacuaaauacuaauuaaguacuaacaaguacuuaa

SEQ ID NO: 255377 - RNA, 64 nt, Human
uacuaaauacuaauuaaguacuaacaaguacuuaaauacuaauguauuaaguauuuaaguacuu

SEQ ID NO: 255378 - RNA, 64 nt, Human
cuuacuugaugucuuuuauaaaacuugggacuacaauacuaaccuuuuuuucugaaucugcugu

SEQ ID NO: 255379 - RNA, 64 nt, Human
cuucuuccuucuugucaccaguuaaaagcauuuuaauacuaagacccuaauucuuuuaucuuua

SEQ ID NO: 255380 - RNA, 64 nt, Human
auuccagaauuaugaggcauugaggggauagaugaauacuaaaugguugucugggucaauacug

SEQ ID NO: 255381 - RNA, 64 nt, Human
aauuuaguucagccauuuuacaaggaaauaauaaaauacuaaaaucugauuguuuuuugcuauu

SEQ ID NO: 255382 - RNA, 64 nt, Human
uagauuauauauuuauucucauaauacuuucacuaauacuaaauaaaauuuggggaacacuuuu

SEQ ID NO: 255383 - RNA, 64 nt, Human
uugccaggguauggcuuacagugacuacuauuauaauacuaaaacucagagaaucaaagaugga

SEQ ID NO: 255384 - RNA, 64 nt, Human
auauuuguaaccuuaagaagaguauuuuuuuguuaauacuaagauguucaaacuuagacaugau

SEQ ID NO: 255385 - RNA, 64 nt, Human
guuaggaauauaguuucauaauaauaguacauacaauacuaauuguauauaagguagcaaccaa

SEQ ID NO: 255386 - RNA, 64 nt, Human
uagugaaaaaucuaguauuuguauccuggcaaauaauacuaauuuauaauccacaguaaaguuc

SEQ ID NO: 255387 - RNA, 64 nt, Human
acuucuauuacuccugcauggagcaguuguuaugaauacuaauacaucacuuuuuaacuucugu

SEQ ID NO: 255388 - RNA, 64 nt, Human
auuuuaugauaaagggccuuuaaccucauggucaaauacuaauauuauauuugcugagacaaga

SEQ ID NO: 255389 - RNA, 64 nt, Human
uugugauaauccuucacagcaagaaaccgaauaaaauacuaacauuucuaacaacugcucugac

SEQ ID NO: 255390 - RNA, 63 nt, Human
uuuguccuguuucucaccauuggguuaaggggugccgagcacuagcuagacuuccacauaguc

SEQ ID NO: 255391 - RNA, 63 nt, Human
ccucugcccccacucuggccuccucuuggcaucgccgagcauccaugcaguucguggggaauu

SEQ ID NO: 255392 - RNA, 63 nt, Human
cgcccagugauguuuccacggugccuguacacagccgagcagcauuuccguugaaggacuugc

SEQ ID NO: 255393 - RNA, 63 nt, Human
gcugcggcugcuccugcucacaauaaagccggggccgagcagcuggcaggggaggccaauccc

SEQ ID NO: 255394 - RNA, 64 nt, Human
agccacagcugggagaccugcacugucccugcgaaauacuaagaacaccuagggugugcucacu

SEQ ID NO: 255395 - RNA, 64 nt, Human
ugauguaaagaggugcuaugauggucaugcaauuaauacuaaauauugaaucaaugcccagagc

SEQ ID NO: 255396 - RNA, 64 nt, Human
ugcuacccuuugaucauuuccuggccaccaucacaauacuaaggggcucagaugugucuugugc

SEQ ID NO: 255397 - RNA, 64 nt, Human
uagaagacuuugaccugugaagcugccaucuguuaauacuaaaauucccaaauaagguucuguu

SEQ ID NO: 255398 - RNA, 64 nt, Human
ugggaauugcuaucauguaaaauaucaaaguuaaaauacuaaggugcauuuucccugaagggaa

SEQ ID NO: 255399 - RNA, 64 nt, Human
auguaaggaaacuauaacuaauagucauuaccaaaauacuaaaacccaacaaaaugcaacugaa

SEQ ID NO: 255400 - RNA, 64 nt, Human
aucuuuugacuucuacauauaguggaaaucugccaauacuaauugguggagaugggaacuguaa

SEQ ID NO: 255401 - RNA, 64 nt, Human
aagcguuaacuuuggucuucuguauuuuggacuaaauacuaauugacuagagugcuguaaacuu

SEQ ID NO: 255402 - RNA, 64 nt, Human
aguacauuugcuccaaacuuuucaacuugagggcaauacuaaacuuaaaaauaagaguuuuuuu

SEQ ID NO: 255403 - RNA, 64 nt, Human
agaaaauugaagaucauuuuucaccuguacaaggaauacuaauggaucgucuuaaaauuggucu

SEQ ID NO: 255404 - RNA, 64 nt, Human
cucugacugaaaaucucuccuuggucuuaaggaaaauacuaacauugaacucacugacaugauc

SEQ ID NO: 255405 - RNA, 64 nt, Human
caaagcuagaaugugaauauaacuuuuguggaccaauacuaagaauaacaagaagcccaguggu

SEQ ID NO: 255406 - RNA, 64 nt, Human
caccaccccagggauaaauuggauauaaacacuaaauacuaaucaguugaacuuaacauuuaau

SEQ ID NO: 255407 - RNA, 64 nt, Human
aaucagaauaaugagacaacuuguuaaucucuuuaauacuaaaaauaaauuacucuucuauuuc

SEQ ID NO: 255408 - RNA, 64 nt, Human
accagacacacugauuggaacuguauuauauuaaaauacuaaaaauccuaagugucuuucgucu

SEQ ID NO: 255409 - RNA, 64 nt, Human
ccugaguuucuguauguguauuugcaagacaguuaauacuaauccaucaucccucacagagaug

SEQ ID NO: 255410 - RNA, 63 nt, Human
cuggagguuccagggacagggcagccucccagagccgagcaagagcucaagguacaaaugaga

SEQ ID NO: 255411 - RNA, 62 nt, Human
gacaagccgcugcccaccuccaagcccaggaaacaguacaagauggcuaaggagaacagggg

SEQ ID NO: 255412 - RNA, 62 nt, Human
ccuguucaggcauuaacaggcuuaauuaggccacaguacagugauccaaggcaggcaaggca

SEQ ID NO: 255413 - RNA, 62 nt, Human
ggagaccaacgguccugaugccaaucacgaguacaguacaagcagccagcauauggacuaca

SEQ ID NO: 255414 - RNA, 64 nt, Human
agcaaagcuaacaagcaaugaagacaugaagcaaaauacuaaucuaauuguguaaagaaaggau

SEQ ID NO: 255415 - RNA, 64 nt, Human
ggagugagucauuccaccugcaccuuucuguacaaauacuaauucaauuuuaagucuuaaguca

SEQ ID NO: 255416 - RNA, 64 nt, Human
auauauuaaguuguauaaacuaucaaggccacaaaauacuaaugucauuuggucauaaugacua

SEQ ID NO: 255417 - RNA, 64 nt, Human
ugaaauagauuuaagugugcuucuuauugcuaaaaauacuaaaugucaugggucauaguaucug

SEQ ID NO: 255418 - RNA, 64 nt, Human
caugguacauuaguaguucuuuguauauugaauaaauacuaaaucaccuaggugucuauguucu

SEQ ID NO: 255419 - RNA, 64 nt, Human
caguaugggacuuugaaauaaugauucauaauaaaauacuaaacgugugucuucaucucucuag

SEQ ID NO: 255420 - RNA, 64 nt, Human
aagcagcaucugcaacacuuaggaaggucuucgaaauacuaauuuguaagccccaccucaggcc

SEQ ID NO: 255421 - RNA, 64 nt, Human
ggaaaacauaaggucauuuucucccucuacucacaauacuaaagggaaaaaauggauucaaagc

SEQ ID NO: 255422 - RNA, 64 nt, Human
uuuauacaaauacauacauguacaccauguuucaaauacuaaauaaauagaguuuaaugccaua

SEQ ID NO: 255423 - RNA, 64 nt, Human
auuuacugaguagagguuucagcccauuccuuggaauacuaacagguauuucaucagucauugu

SEQ ID NO: 255424 - RNA, 64 nt, Human
uaagaagucacguggaacuuagugauuuuuaacaaauacuaaauucauccucacuuuauguuga

SEQ ID NO: 255425 - RNA, 64 nt, Human
uuggucuugacuguucucugggugcuuaauaaauaauacuaauuaugcaaguucuaguuuugau

SEQ ID NO: 255426 - RNA, 64 nt, Human
acaaguuaggucauuuaugaauggaauguaaaauaauacuaaaaaugcuucaauaacuuaucuu

SEQ ID NO: 255427 - RNA, 64 nt, Human
cauaguauuuguuuucugcuccgaacacuuaaaaaauacuaagacgugauagugaaaauagcuu

SEQ ID NO: 255428 - RNA, 64 nt, Human
ggaagucauguuauacuggauucauuuccaauuaaauacuaaacauuuuauagaaaauauuucu

SEQ ID NO: 255429 - RNA, 64 nt, Human
aucuaaaucacauucgguuauauaaucauugagcaauacuaauuuuuccaaucaguauggauug

SEQ ID NO: 255430 - RNA, 63 nt, Human
uuccgugaaagauuucuuaaaauauuacuuuuggccgagcaugguggcucaccccuguaauuc

SEQ ID NO: 255431 - RNA, 63 nt, Human
gguuauuucaaccuguuuuggucacaucacuaugccgagcaagaaaaguggaucucagggagg

SEQ ID NO: 255432 - RNA, 63 nt, Human
cccaggccccagagcagcccaggccaugacccugccgagcacggugugugaucuuugcuggcc

SEQ ID NO: 255433 - RNA, 63 nt, Human
gaaaguaagcugaagcagaucaccaccgagcuggccgagcaccgcucauauccccccgacaag

SEQ ID NO: 255434 - RNA, 64 nt, Human
ggucuccacaaguaccucucaucuugagagcccuaauacuaaaagaugggcacccacccccacc

SEQ ID NO: 255435 - RNA, 64 nt, Human
aaaagaaauuauauaaaaauacuuuauugcuaaaaauacuaauaaugaucuuagccuucaggga

SEQ ID NO: 255436 - RNA, 64 nt, Human
auuuggucucuauuucauuuuuugcaucaguauuaauacuaaaauaugucucgcuagugauguu

SEQ ID NO: 255437 - RNA, 64 nt, Human
aaggaacaaguccuaguuguuguuguuguuguugaauacuaaauuuaagauaugucagcuugcu

SEQ ID NO: 255438 - RNA, 64 nt, Human
cacuuauuuuauuugcuucuaaaaugcaaagaugaauacuaaagucagaagcaguguuucauuu

SEQ ID NO: 255439 - RNA, 64 nt, Human
ggauuggaaaggaauauuuuaagugccuuuuaaaaauacuaauaguccggccaggcgcuguggc

SEQ ID NO: 255440 - RNA, 62 nt, Human
aguaaaacuuaaguguuugucaucaauaaaugguaauacuaaauuuuuuuguuaauuuauuc

SEQ ID NO: 255441 - RNA, 64 nt, Human
uguguguguguguguguguguguaacacuuugacaauacuaaacucucauaagcauuuaacacu

SEQ ID NO: 255442 - RNA, 64 nt, Human
auuuggucagaaugcaguuguuguacaacucauaaauacuaacugcugauuuugacacaugugu

SEQ ID NO: 255443 - RNA, 64 nt, Human
uugaaucgguuuuguagguagaggaauaaaaugaaauacuaaaucuuucuguauauguuucccu

SEQ ID NO: 255444 - RNA, 64 nt, Human
ggcuggcucaauugaaagugggcaaaagcuuacaaauacuaaaaagaagugcugccgcgcagug

SEQ ID NO: 255445 - RNA, 64 nt, Human
aaaaauuccacucaaaauagggacuaucuaucuuaauacuaaggaaccaacaaucuuccuguuu

SEQ ID NO: 255446 - RNA, 64 nt, Human
aaauguuaaaauuaauuuaaauguaaaauuucugaauacuaaucuuagaaauguguaaaagaua

SEQ ID NO: 255447 - RNA, 64 nt, Human
ucaguuggaaucccuccaaauggauugcaagagaaauacuaaauugauucuaaaucuguuccau

SEQ ID NO: 255448 - RNA, 64 nt, Human
gcugcaaacuucuuuuuacucuaaucauuuuuaaaauacuaauggaagaacuuucuagcacuuu

SEQ ID NO: 255449 - RNA, 64 nt, Human
uucuuccuccacuauucuucucuaacagaugaccaauacuaauaaacuacugugaacacuuuca

SEQ ID NO: 255450 - RNA, 63 nt, Human
gccgcaacuuccugccgacccugaugcgggugggccgagcaguguggacaucagccacuuuuu

SEQ ID NO: 255451 - RNA, 63 nt, Human
ggaacccugucucuaccaaaauuacaaaaauuagccgagcaugguggcgcaugccuguagucg

SEQ ID NO: 255452 - RNA, 63 nt, Human
ccagccccgcaucucccacugccaacagcugaagccgagcacagaccucccuuugcacgcugg

SEQ ID NO: 255453 - RNA, 63 nt, Human
gggaggccaagccugggggcugggggcgggugggccgagcagcacgugguggguggggugcag

SEQ ID NO: 255454 - RNA, 64 nt, Human
guauuacuauaucacacuugugaguauguauucaaauacuaaguaucuuauaugcuacgugcau

SEQ ID NO: 255455 - RNA, 64 nt, Human
uaaaucagcaaggguuccuguauuaccaauauagaauacuaacaauuuuacuaacacguaagca

SEQ ID NO: 255456 - RNA, 64 nt, Human
aauuaacaaagugucacuccauaaaaagaaagcuaauacuaauagccuaaaagauuuugugaaa

SEQ ID NO: 255457 - RNA, 64 nt, Human
gaauuuugacucgugucuguaucauacaaguacaaauacuaauuuugcccuauguauccguaaa

SEQ ID NO: 255458 - RNA, 64 nt, Human
caaauauuuaaagacaaaaaaaucacgucaguaaaauacuaaaaggcucauuuuuauauuuguu

SEQ ID NO: 255459 - RNA, 64 nt, Human
cuaauaguuuuuugauuaaaaaugugaacaagaaaauacuaaaauaaaaauccuuucgauuuag

SEQ ID NO: 255460 - RNA, 64 nt, Human
uaaaguuuuauccaguauucuaggaauuuucagcaauacuaauauucucauuuuuaaacauuuu

SEQ ID NO: 255461 - RNA, 64 nt, Human
uaagaccauuuaaguguguguuaaacaacuacagaauacuaaauaaaaaguuuggccaaaacca

SEQ ID NO: 255462 - RNA, 64 nt, Human
gaaaauaagugugaaaagaaucagguguuaauauaauacuaaggauaaagcuuuagaagcuauu

SEQ ID NO: 255463 - RNA, 64 nt, Human; identical to SEQ ID NO: 255454

SEQ ID NO: 255464 - RNA, 64 nt, Human
gacuuuuuuauaaugguuucguaaugugaaaucaaauacuaauuuaaacucuggagcccauaau

SEQ ID NO: 255465 - RNA, 64 nt, Human
gaauguuguuuuuuuccagacguaacugccauuaaauacuaaggaguucuguaguuuuaaacac

SEQ ID NO: 255466 - RNA, 63 nt, Human
uaucugcuggcucuaaaccuucuacgccuuugggccgagcacugaaugucuuguacuuuaaaa

SEQ ID NO: 255467 - RNA, 63 nt, Human
aucugggccguggacuaucugaucuugguccuggccgagcaaacagcccggagguaagguuca

SEQ ID NO: 255468 - RNA, 63 nt, Human
caagaagugauuuugugaaugugaaguggagaggccgagcagcagccggccgggaugggggca

SEQ ID NO: 255469 - RNA, 63 nt, Human
aaaccccaucucuacuaaaaauacaaaaaauuagccgagcacgguggugcaugccuguaaucc

SEQ ID NO: 255470 - RNA, 63 nt, Human
uucuuuucuugccuuuuuuuuuuuuugaaauuugccgagcaguggagcccucugacaauuugc

SEQ ID NO: 255471 - RNA, 63 nt, Human
ggcauccgcgcucuagccugaacccuggccugggccgagcaguggcagcagagaguggccucg

SEQ ID NO: 255472 - RNA, 64 nt, Human
accgaccuaaaaacauuggcuacucuagcguggugcgcccuaguacgacuccgcccagugugug

SEQ ID NO: 255473 - RNA, 64 nt, Human
caacauuccaguguuugaacugucacugauucuugcgcccuagacaagcuaaccagguuuacca

SEQ ID NO: 255474 - RNA, 64 nt, Human
cgcccucagucuggcgcccaaccaccugcugcuggcgcccuagguggcugggggggaagacaac

SEQ ID NO: 255475 - RNA, 64 nt, Human
ccaggaggcuggcuccucaagcuacccaugcccagcgcccuaaagcagcaccagaugcuuugga

SEQ ID NO: 255476 - RNA, 64 nt, Human
aauaauucugccuauuuucauuugcuuuaaacaggcgcccuauuuucuuucuaguuguggcugc

SEQ ID NO: 255477 - RNA, 64 nt, Human
agagacagaagcugauuuaacagcauagagcacagcgcccuacuuccccacagacaggcugaau

SEQ ID NO: 255478 - RNA, 64 nt, Human
cacugccagggucccagucagauuccaggaauuugcgcccuaacuuugcuugcuaauccugguu

SEQ ID NO: 255479 - RNA, 64 nt, Human
cccuuacuccaggucagaugccagugggacucaugcgcccuaugagggcugcagggccagugcu

SEQ ID NO: 255480 - RNA, 64 nt, Human
cuuaacguagcauuucuaauacccuggugugaaggcgcccuagaccccuuuucucuggucacag

SEQ ID NO: 255481 - RNA, 64 nt, Human
gcagccaacagcccucuucccaccuggguaggcagcgcccuaauuggaauuggaaacagaaaau

SEQ ID NO: 255482 - RNA, 64 nt, Human
gccucagugcgcuuuccugcgcgcacugcggagggcgcccuaagcgucacccaagcacacucac

SEQ ID NO: 255483 - RNA, 64 nt, Human
acgaguucuuucguucugugcgcagcuaaaaggggcgcccuacaucuccgugccacucccgccc

SEQ ID NO: 255484 - RNA, 64 nt, Human
cccaccacgggcuguggcggagcucccgcccccugcgcccuaauggugcuaacccccucucacu

SEQ ID NO: 255485 - RNA, 64 nt, Human
gacgccccgcagaggcccgccugaagccagcccggcgcccuagcagaugcacgugucugucgaa

SEQ ID NO: 255486 - RNA, 64 nt, Human
aguagcuuuggcugaugcuaagcuuuccugguaugcgcccuauuuuuaagaaguaauugcuuuu

SEQ ID NO: 255487 - RNA, 64 nt, Human
cuuuucaaauacaugaaaguugcacagaggagaggcgcccuaagaauguaagcauugugggaaa

SEQ ID NO: 255488 - RNA, 62 nt, Human
cucauuaacauggaaacacacacacaggagcuacaguacauauuggcaggaaaagguaaacu

SEQ ID NO: 255489 - RNA, 62 nt, Human
auuaucuuaagcauguguaaugcuggauguguacaguacaguacugaacuuguaauuugaau

SEQ ID NO: 255490 - RNA, 62 nt, Human
aaaucacauccuaacaaagaagucugucuaagacaguacaucuccuguugaacuugcaucuu

SEQ ID NO: 255491 - RNA, 64 nt, Human
guguggaggagaggccggcuugggguggggccucgcgcccuagugccggccggccucagcccgg

SEQ ID NO: 255492 - RNA, 64 nt, Human
cagagggugagaacuucucugugccugcucagaggcgcccuagggaagggccauguuugaguuu

SEQ ID NO: 255493 - RNA, 64 nt, Human
cugggcugggauccggagcaagcgggcgagggcagcgcccuaagcagguacgggcggggcucaa

SEQ ID NO: 255494 - RNA, 64 nt, Human
guggagguggccugagcaggcagaaggacaccaagcgcccuauguugcuugucauucaugacgu

SEQ ID NO: 255495 - RNA, 62 nt, Human
uccagauucuuuguagccuuugaaagauuuuuacaguacauaugucuugacugagcuguccu

SEQ ID NO: 255496 - RNA, 62 nt, Human
acuauucuggcaauaaauuuugguagacuaauacaguacagcuagacccagaaauuuggaag

SEQ ID NO: 255497 - RNA, 62 nt, Human
ugggcuugugaacaccuccuagccacaucacuacaguacagugagugaccccagccuccugc

SEQ ID NO: 255498 - RNA, 62 nt, Human
uuugcaaucccaugacaacuggauuuaaaaguacaguacagauagucguacugaucaugaga

SEQ ID NO: 255499 - RNA, 62 nt, Human
cuuuuuauuuagaaacccacaaaaucagaaacacaguacaaauaaaacagaaaucaaacuau

SEQ ID NO: 255500 - RNA, 62 nt, Human
aaauaacuugaauuuauagacaaaugcuacucacaguacaaucaauuguauuauaccaugag

SEQ ID NO: 255501 - RNA, 62 nt, Human
ugugaaauaacuuccacauuucaacacacuucacaguacaggaaauaaaguaauaugaaaaa

SEQ ID NO: 255502 - RNA, 62 nt, Human
uaguacucaguaacagugaaguacucaguaauacaguacaguauucaguaaggcagugaagu

SEQ ID NO: 255503 - RNA, 62 nt, Human
guacucaguaacacagugcaguacucaguaauacaguacaguacucaguaaggcaguauggu

SEQ ID NO: 255504 - RNA, 62 nt, Human
cagauauaggacaugacacugaauagaguccaacaguacaaaaaaaauucaguauguucuag

SEQ ID NO: 255505 - RNA, 62 nt, Human
agauagaaugauacaaaagugaaguaguagccacaguacaacacugacugcucagacacauu

SEQ ID NO: 255506 - RNA, 62 nt, Human
uuuggcaacuaacuuaaccaugugcuucccacacaguacaucaggaaaacuuacagggcaau

SEQ ID NO: 255507 - RNA, 64 nt, Human
aaccguuuuucaagaaaacuggaaaucuggauuuucagcgaacaugccugauuuuaaaagguug

SEQ ID NO: 255508 - RNA, 64 nt, Human
ccccaguugaaaucuuugcaaaggucgguucuauucagcgaacagcacuauagcaaaagaagau

SEQ ID NO: 255509 - RNA, 64 nt, Human
caacugccuugggugaaaaucagaagcaagcaacucagcgaaaaacucagaagguuuggguaca

SEQ ID NO: 255510 - RNA, 64 nt, Human
ccuuuacaauuuccuaugggugucagaaguacucucagcgaaaacugauggcuaaaacaguauc

SEQ ID NO: 255511 - RNA, 64 nt, Human
gagcaagaggaggccguugauucacuucacgcuuucagcgaaugacaaaaucaucuuugugaag

SEQ ID NO: 255512 - RNA, 64 nt, Human
cccuuucuugccaguacauccaaguuuaaaauuaucagcgaaaugguccauguuuuuccaauua

SEQ ID NO: 255513 - RNA, 64 nt, Human
gcauuuaaagggacucaaggugccugccacuuccucagcgaagaagucuguguuccuccccguc

SEQ ID NO: 255514 - RNA, 64 nt, Human
gggccaagcaccuagccucgcucuuggcagguacucagcgaaugaaugcuguauauguugggug

SEQ ID NO: 255515 - RNA, 64 nt, Human
cuauacuaagacuuggaaauuauucucuccagugucagcgaauccagaaggguaucagauuaaa

SEQ ID NO: 255516 - RNA, 64 nt, Human
caggauaacagcuugcacccuccucagaauguuuucagcgaaagagugggguggcuguucucug

SEQ ID NO: 255517 - RNA, 64 nt, Human
aaaaagaacacacauuuagagucucucuuccuccucagcgaaccacuaggcccccuuuuuaaaa

SEQ ID NO: 255518 - RNA, 64 nt, Human
ucauaagcucuguuucccccucuccccaaagccuucagcgaacgugaaaugugcgcuaaacggg

SEQ ID NO: 255519 - RNA, 64 nt, Human
ccauuuccuaccccugccauuucccaccccugcuucagcgaaagggacucucuaacagggcagu

SEQ ID NO: 255520 - RNA, 64 nt, Human
guauauagagugguuucagauuguaaauagcgcgucagcgaacuugucuaaaucauauauuuuu

SEQ ID NO: 255521 - RNA, 64 nt, Human
caucugcagugcuuaaguacuuagcaaaaucuauucagcgaaaccacaccacuuaguuucuccc

SEQ ID NO: 255522 - RNA, 64 nt, Human
ucccgccuccccucccgcuugcuuuugccuuacucgaucuuaccaccaccccucccccggcccc

SEQ ID NO: 255523 - RNA, 64 nt, Human
uguguugagaguuuacagagcucuuugacauacgcgaucuuagucuuuacaaauaaggaaaaca

SEQ ID NO: 255524 - RNA, 64 nt, Human
gagaacucauuuuacagaacuugguuuccuuugccgaucuuauguacauacccauuuuagcuuu

SEQ ID NO: 255525 - RNA, 64 nt, Human
cugugguuuuucaguuguuuauuuuaaaugauaucgaucuuacacauucuguguauaaagaccu

SEQ ID NO: 255526 - RNA, 64 nt, Human
ggguuagaggaggggugaagauuggggccaguaucgaucuuaugaagcuggaggacuugugcag

SEQ ID NO: 255527 - RNA, 64 nt, Human
cucacucugucacccaggcuggagugcaguggcgcgaucuuagcucucugcaaccucugccucc

SEQ ID NO: 255528 - RNA, 64 nt, Human
ugcgcucuguugcccaggcuggagugcaguggugcgaucuuagcucacugcaaccuccaccucc

SEQ ID NO: 255529 - RNA, 64 nt, Human
uuuauaccaaacauuuuaaguaugcugggauggacgaucuuacacugguuuggaucacaguuuu

SEQ ID NO: 255530 - RNA, 64 nt, Human
gacacuugggaaagucuuuuuaauagaacaagaacgaucuuaauuuaagaauauuauccugguu

SEQ ID NO: 255531 - RNA, 64 nt, Human
gguuucuaugcagcccuucuuggcgaaauuccugcgaucuuauagauucuaaugagcucuugga

SEQ ID NO: 255532 - RNA, 64 nt, Human
ggaacaaggucaagguccuuuugaaacacugcagcgaucuuaauuuuguuagauuuggaguuca

SEQ ID NO: 255533 - RNA, 64 nt, Human
guugaagcaguaaauagcauguccuuccccuccccgaucuuaagguguguuuucuagaaaaguu

SEQ ID NO: 255534 - RNA, 64 nt, Human
gucucuguccguccucuucccugcacaagugugucgaucuuagauugccacugcuuucauugaa

SEQ ID NO: 255535 - RNA, 64 nt, Human
cacaacuagccuacccuuagauuuuuggaaggaucgaucuuauuuaacuauguguggaacaacc

SEQ ID NO: 255536 - RNA, 64 nt, Human
ugucaccuuaauagccaaguucuccugguuccuccgaucuuacaggcucauccagguuccaaag

SEQ ID NO: 255537 - RNA, 64 nt, Human
cuugcucugucgcccaggauggagugcaguggcgcgaucuuagcucacugcaagcuccgccucc

SEQ ID NO: 255538 - RNA, 64 nt, Human
aguucagaaucugcugcucuggaauauuucccuucgaucuuaucucagucacuucguuuuugag

SEQ ID NO: 255539 - RNA, 64 nt, Human
acacucuugggagaugcauuuuccgucuggcucacagggggagggugaggcuuuguaccccagc

SEQ ID NO: 255540 - RNA, 64 nt, Human
acacucuugggagaugcauuuuccgucuggcucacagggggagggugaggcuuugcaccccagc

SEQ ID NO: 255541 - RNA, 64 nt, Human
ccacccccacccuugcuggcaggggcagggaccccagggggauugacucugcaguuugggagcc

SEQ ID NO: 255542 - RNA, 64 nt, Human
ggugcuguacuuccuuuuuaaaguuggggagcggcagggggagggggaagugccacgcccuugu

SEQ ID NO: 255543 - RNA, 64 nt, Human
ggaaaugaaaaaaaaaugggaagauuaaaaagcacagggggaagaagaagagauuucggaggcc

SEQ ID NO: 255544 - RNA, 64 nt, Human
ggagauggcugugguacugcuggccaaccuggcucagggggacagccuggcagcucgugccauu

SEQ ID NO: 255545 - RNA, 64 nt, Human
uucggcuaccucucccaccaucccagacugugggcagggggauggggagggagugggccuggau

SEQ ID NO: 255546 - RNA, 64 nt, Human
gcggcuccagcagggacuaccuuucuuauaaacccagggggaccacacacacacacacacacac

SEQ ID NO: 255547 - RNA, 64 nt, Human
ggugggagguaugucuagggggcagugucucuuccagggggaauucucagcucuugggaacccc

SEQ ID NO: 255548 - RNA, 64 nt, Human
uggggggcaaaggcauuggucaccaagagucuugcagggggacccacagauaugccauguccuu

SEQ ID NO: 255549 - RNA, 64 nt, Human
aacuuuccucauuaccauccugaagucacuaccccagggggagcuauagcuucaugaccguaac

SEQ ID NO: 255550 - RNA, 64 nt, Human
ugcaucuacaccccagggcccugugguggggcugcagggggaagcugugcaccugagaugaggc

SEQ ID NO: 255551 - RNA, 64 nt, Human
cuuuaacaugguucaggcccuuggugugagagcccagggggaggacagcuugucugcugcucca

SEQ ID NO: 255552 - RNA, 64 nt, Human
gauauaguguuuacauucuuuagguccugaggggcagggggaucugugauauaacaaaauagca

SEQ ID NO: 255553 - RNA, 64 nt, Human
guggccgccggcagcauggacaaaggucuccaugcagggggaggaggccugcuucuuuccccac

SEQ ID NO: 255554 - RNA, 64 nt, Human
uguugcucuaacaguccagauguacacccagccucagggggaaggcagcucucuccagacagag

SEQ ID NO: 255555 - RNA, 57 nt, Human
augcugugcuaucugaaaagaacuuaaggccacaauucacgucucguccugggcauu

SEQ ID NO: 255556 - RNA, 57 nt, Human
ggagagugacacugucggggcagcuggggccacaagcaggagccggccucgggcaca

SEQ ID NO: 255557 - RNA, 57 nt, Human
caagauaaaagcagccugggucacccaggccacaaggccaugguuaauucuuaaggc

SEQ ID NO: 255558 - RNA, 64 nt, Human
uucccucagauuuccauuguguggccuggugggucagggggagucuuugcaccaaagauguccu

SEQ ID NO: 255559 - RNA, 64 nt, Human
agccagaaagggcccucugcuguggucugaaccccagggggaguggggcauugacuccaccccu

SEQ ID NO: 255560 - RNA, 64 nt, Human
gugguccaaggagggagacagagggucgucccaacagggggagguagggcuuugaaaacaccuu

SEQ ID NO: 255561 - RNA, 64 nt, Human
ugucaucacccccauugucccuagggugacaggccagggggaaaaauuauccccggacaacaug

SEQ ID NO: 255562 - RNA, 64 nt, Human
ucuugaaguccagguaccauccccccuuagcauacagggggaagggccugagaggaauguaagg

SEQ ID NO: 255563 - RNA, 64 nt, Human
cgagcgaauuaacggugucgaggugagccagggccagggggaccccgguaaaguuuaguugagg

SEQ ID NO: 255564 - RNA, 64 nt, Human
gugagaagcccgucuccucagugagccagcauuucagggggagcuggcggacucccacuccccg

SEQ ID NO: 255565 - RNA, 64 nt, Human
cacuugugucauuuccagguuuucugggggagugcagggggagaugggugaugagguaugaacg

SEQ ID NO: 255566 - RNA, 64 nt, Human
caucucauaccuuuaccucuggccaguuggccaccagggggagugggcugaagggagaguagau

SEQ ID NO: 255567 - RNA, 64 nt, Human
cccuuuccuucacugccccacuucuggcaugggacagggggaaguucagaagguguguccuuga

SEQ ID NO: 255568 - RNA, 64 nt, Human
gaucgccacccccccaccccaggcccugccagagcagggggaccuaggcuccucuuacccccgu

SEQ ID NO: 255569 - RNA, 64 nt, Human
gauaccgcagggcccuguagcaagaaaugggaagcagggggaggggcaggggcucagaacaaua

SEQ ID NO: 255570 - RNA, 64 nt, Human
aaccuuuguuguuuguugaaagaaaaugaaggaacagggggaaaaaaggugcaaaaugcuaaau

SEQ ID NO: 255571 - RNA, 64 nt, Human
agaucucuugacuagucaaggacugggaacgugccagggggaacaaaguaagcuugaugggcug

SEQ ID NO: 255572 - RNA, 64 nt, Human
gaagaagagccaugggacacagaguugacccagccagggggaaagcccagcucucuuuaaacca

SEQ ID NO: 255573 - RNA, 64 nt, Human
ccuucccugaggcugucuccugggaaugcuggaccagggggauuacuucccccacccacacccc

SEQ ID NO: 255574 - RNA, 57 nt, Human
uugacacaauguugcacugaaaacccaggccacaaaugugucccagugaacaguuug

SEQ ID NO: 255575 - RNA, 57 nt, Human
gcccccucaaaacugcacccagagcagggccacaagggugcuuuuuuucuuuaaaaa

SEQ ID NO: 255576 - RNA, 57 nt, Human
cacccaggagccauccucagugucuguggccacaauccuguacuguuccuuccaucc

SEQ ID NO: 255577 - RNA, 64 nt, Human
uccacguaauucaauuucucacaauagacagaaacagggggaaaauguuugcccuguucaaagu

SEQ ID NO: 255578 - RNA, 64 nt, Human
acaccuguaaucccagcacacugggaggccgaggcagggggacugcuugagcucaggaguucga

SEQ ID NO: 255579 - RNA, 64 nt, Human
ggucaggguuggaggccccuuacuggugguuuuacagggggauccuacuuuguuacacauguug

SEQ ID NO: 255580 - RNA, 64 nt, Human
uggaaaacccaaaguguuuuuuauucaggcuugucagggggauaacuaccagaaagguauaccu

SEQ ID NO: 255581 - RNA, 64 nt, Human
gacgaaccaaaaccagcugggcugagcucagauccagggggaaaugcuggaagucaauaaaacu

SEQ ID NO: 255582 - RNA, 64 nt, Human
ccuagcccaggagagagaaagccaggcagguagccagggggacuagccccuguggagacugggg

SEQ ID NO: 255583 - RNA, 64 nt, Human
gucccagccuccccuccccaccccaugcagcccccagggggauagcccaugggccccuguggac

SEQ ID NO: 255584 - RNA, 64 nt, Human
uccugccccucuccaggcccagcuccccucuuggcagggggagaggauggcccagcaggccugg

SEQ ID NO: 255585 - RNA, 64 nt, Human
ugcuggccaaggaggcuccugggguggggaucaccagggggauuuugacacagccuucggcugc

SEQ ID NO: 255586 - RNA, 64 nt, Human
gggagggguggugugguguugggaagggguccugcagggggaggaggacuuggagggucugggg

SEQ ID NO: 255587 - RNA, 64 nt, Human
guuguguguagaaauucaccagguggccugagcgcagggggaccuccagggcugcguugagcag

SEQ ID NO: 255588 - RNA, 64 nt, Human
uuuccuuuagccuuagcaguggguaugaggugugcagggggagcuggguggcuucacuccgccc

SEQ ID NO: 255589 - RNA, 64 nt, Human
gagaugcacuaacaacuggggauagggauggggucagggggagcccaagauggugaucugcccg

SEQ ID NO: 255590 - RNA, 64 nt, Human
gcugaagcugaagaggcggcuacgugcgguuugucagggggauuggguugaaaacuggccaguc

SEQ ID NO: 255591 - RNA, 64 nt, Human
gagcagggugaccccucaucugaaaggcccaaaccagggggaagcaccagccucagugcagccc

SEQ ID NO: 255592 - RNA, 64 nt, Human
gauugcaugggggauuuuuaacauauuugaaacucagggggaacaugauuaagaacacaaacug

SEQ ID NO: 255593 - RNA, 60 nt, Human
gggguccccugagcgucuuccaggguggcuggagagcacagacgcgccagggagcccccu

SEQ ID NO: 255594 - RNA, 60 nt, Human
ugcuucccaguggcuggauguggaggagguggagagcaguuaugagacugggaaagaacg

SEQ ID NO: 255595 - RNA, 60 nt, Human
gccugugggaacuucagggguucccaguggggagagcaguggcagugggaggcaucuggg

SEQ ID NO: 255596 - RNA, 64 nt, Human
cuucuaugagaaucuaaugcugcugcugaucugacagggggaggaacucaguaaugcuccauug

SEQ ID NO: 255597 - RNA, 64 nt, Human
cuuucacugaccuccuaauuuuagguggagggggcagggggagccauaaaaguugguauuaccc

SEQ ID NO: 255598 - RNA, 64 nt, Human
augacacuauugggguuucccaggauggauuggucagggggagaaaggaaaaggcaaaacacuc

SEQ ID NO: 255599 - RNA, 64 nt, Human
cuaauccagaguuuacuccaccugccgcacuuagcagggggacgggaccgaagcucccucaauc

SEQ ID NO: 255600 - RNA, 64 nt, Human
ggaagcacagaucaaaucaccuuggaguggucaccagggggacagggagccccccaccaaugua

SEQ ID NO: 255601 - RNA, 64 nt, Human
ugggcucacuaaguguucugcuguguuucaggaucagggggaccuuugcuuuuugaugaucucc

SEQ ID NO: 255602 - RNA, 64 nt, Human
cauucaaauggagacgcccucugcaaaggccuggcagggggaggcacguuucaucugucagcuc

SEQ ID NO: 255603 - RNA, 64 nt, Human
cuaugggugggggcagaaggcagagccugugucccagggggacccacacgaagucaccagccca

SEQ ID NO: 255604 - RNA, 64 nt, Human
auagcaggagagaggacccauuagcuggcagacccagggggaagaaaggagggcugugaggaga

SEQ ID NO: 255605 - RNA, 64 nt, Human
cugacaccauccuucagaucuauugccuuggcuucagggggauaaggagggaacauaucauaac

SEQ ID NO: 255606 - RNA, 64 nt, Human
cucugaggggcugaggggugaggccagggcccuccagggggagggguagccagcuugggcuguc

SEQ ID NO: 255607 - RNA, 64 nt, Human
aaagacuuaagagccaaaaagcuuuucaucucuccagggggaaaacugucuaguucccuucugu

SEQ ID NO: 255608 - RNA, 64 nt, Human
guugcagacagggccagggagaaauuagccagugcagggggaaaauugccucugaauaaugaau

SEQ ID NO: 255609 - RNA, 64 nt, Human
cccagccccuguaccaccccugcuguugccugggcagggggaagggggggcacggugccuguaa

SEQ ID NO: 255610 - RNA, 64 nt, Human
ugugggcaggugcuggccaaggacaucaucuaggcagggggagagccugggcugaacagcugug

SEQ ID NO: 255611 - RNA, 64 nt, Human
gauuggggaccauggucugggagcuguucuggggcagggggaauaugcaagcuaaagccccucu

SEQ ID NO: 255612 - RNA, 60 nt, Human
uggggaggugggcucugaagggcgaaggugggagagcagggccccugaggccuggguauc

SEQ ID NO: 255613 - RNA, 60 nt, Human
gauagaggcuaugggggccucaagauuuuuggagagcagagguggucucuggcaauucca

SEQ ID NO: 255614 - RNA, 60 nt, Human
cugcccuacgugcacuacaggaaggggugaggagagcagccagaggaaaaccagccccag

SEQ ID NO: 255615 - RNA, 64 nt, Human
gaggguccuaaugccuuauuucaaaacaauuccucagggggaacagcuuuggcuucaucuuucu

SEQ ID NO: 255616 - RNA, 64 nt, Human
gaucuguagcugggauuuucugacuuguaaugagcagggggauugcuuuuucacuuugugacac

SEQ ID NO: 255617 - RNA, 52 nt, Human
uaaaaccaccaacauuauaaaacagggggaaagcagacugacccucuuuuua

SEQ ID NO: 255618 - RNA, 64 nt, Human
uagagaugaggauaaaagaaaguuucagauucaacagggggaagaaaauggagauuuaauccua

SEQ ID NO: 255619 - RNA, 64 nt, Human
ggcucuucucuguccccugcccuuccccuccugccagggggaggcucagguugguccccgagug

SEQ ID NO: 255620 - RNA, 64 nt, Human
gcaggaagguaacuguuauaacccacaccaucagcagggggaaagccaagcugagaauaaaccc

SEQ ID NO: 255621 - RNA, 64 nt, Human
gcagguggcaugaacugcauggaggcauaacagucagggggaguggaagagguaccaggaguca

SEQ ID NO: 255622 - RNA, 64 nt, Human
acaagacuauaccuuauccauaggcgcaggugcacagggggaggccauaaagaucaaacaugca

SEQ ID NO: 255623 - RNA, 64 nt, Human
ucauagcauggagucggaggagagggccauuuagcagggggagcagaagaggcaauuccuccug

SEQ ID NO: 255624 - RNA, 64 nt, Human
ggaacugcuacagaaaaggaaguguuguucugagcagggggacaggauugaugaggcuugaaag

SEQ ID NO: 255625 - RNA, 64 nt, Human
gaauaaaaagggaucaccauucaauuugaguuuccagggggaagugcauguauaaugaaaugau

SEQ ID NO: 255626 - RNA, 64 nt, Human
gguauagagguggcucaaaggaaguguccgugggcagggggaggaaugaacaaaauggcgcugu

SEQ ID NO: 255627 - RNA, 64 nt, Human
uuguucuacuaguuggauacagaacacacaaauccagggggauuaaagcuggaaggggcuaaga

SEQ ID NO: 255628 - RNA, 64 nt, Human
gccgaaggacuuggugcaguucgugugaaucucacagggggaaugcaacugguuccugugaucu

SEQ ID NO: 255629 - RNA, 64 nt, Human
uuauaauugucccugcuccccuucuugaucucuucagggggaauacuaggcaguuuuguaucuu

SEQ ID NO: 255630 - RNA, 64 nt, Human
gcacgauuucacguuaucagugcaguucgguucucagggggaaagguaagcccauagcuaacuc

SEQ ID NO: 255631 - RNA, 60 nt, Human
ucacauuuuaucuuauauuuagggaaagccggagagcaacaacaaaaaauguuuaagccg

SEQ ID NO: 255632 - RNA, 60 nt, Human
cuguguuuccuuaggccugggguaggggauggagagcagcuccaaggcugagcuggggcu

SEQ ID NO: 255633 - RNA, 60 nt, Human
aggaagaagagguggaggugugguugugguggagagcaccagcuagccccuuccagaagg

SEQ ID NO: 255634 - RNA, 64 nt, Human
uaaaaauguaaaaaggccacucccagguaaaauccagggggaagagucaucuaaguuuaccaug

SEQ ID NO: 255635 - RNA, 64 nt, Human
ucugugaaauccaaaguuggugguguugggaaagcagggggacaugugucccucagcucagcag

SEQ ID NO: 255636 - RNA, 64 nt, Human
caccuggauacugcccauguugacgagacagcagcagggggagagggagggaaggaaggugcgg

SEQ ID NO: 255637 - RNA, 64 nt, Human
aggauacagaaguauugcagcccagauccccuaucagggggacagcuggugggcaaagcagcca

SEQ ID NO: 255638 - RNA, 64 nt, Human
aggguuguaacucagccuuccaaagggaagagugcagggggacggggccaugauauggggaaau

SEQ ID NO: 255639 - RNA, 53 nt, Human
ccaaugaugcguguacauaaucccagggggagggggucaggugucgaaccagc

SEQ ID NO: 255640 - RNA, 64 nt, Human
uguauuaacaugcaauaaaagguaccauucaaagcagggggaaagguaggaagaagagguaauu

SEQ ID NO: 255641 - RNA, 64 nt, Human
uuccagugcgcagccuucuggugccagccccaugcagggggacucucugaagcugugcaggcug

SEQ ID NO: 255642 - RNA, 64 nt, Human
augguaauaacauuuagccucuuaggaguuggagcagggggauggguaauuacagauuugcaga

SEQ ID NO: 255643 - RNA, 64 nt, Human
cuacagcuucaauaucaaacugguuaggaaagcccagggggaagggagggggcaggggaggagg

SEQ ID NO: 255644 - RNA, 64 nt, Human
gucuguuggacuucucuucaggaagaaaaagcaucagggggaaauggaaugccccugccccagg

SEQ ID NO: 255645 - RNA, 64 nt, Human
caggguaucuccacagcaugcaccauucuggguacagggggacauccucuguuacugaagaugu

SEQ ID NO: 255646 - RNA, 64 nt, Human
aucagaaaugagguuggaauuucgagguuuugagcagggggagcaucuuauauucacccuuaaa

SEQ ID NO: 255647 - RNA, 64 nt, Human
ugccccuuccuucucucuucuuggucucuacucccagggggaggggggaacuuacucuaggaaa

SEQ ID NO: 255648 - RNA, 64 nt, Human
ugaucccagagaugccguggauacgccagggucccagggggaaucuccccaagcucacacucuc

SEQ ID NO: 255649 - RNA, 64 nt, Human
cuggcucuugauaccccccucugucuugugaaggcagggggaaggugggguccuggagcagacc

SEQ ID NO: 255650 - RNA, 60 nt, Human
ugacagagauggaucugcuagaaggaaccuggagagcaggacccauggcugggcggcugg

SEQ ID NO: 255651 - RNA, 60 nt, Human
gcaggcagggggaccgaggggcagcagauaggagagcacugagcccggauaguucucagc

SEQ ID NO: 255652 - RNA, 60 nt, Human
cagagaccaagaaggcggagguuaguugagggagagcagugguucuuuguucuaguugaa

SEQ ID NO: 255653 - RNA, 64 nt, Human
ugguguguggcaggugggccaucccaugucccuccagggggaccccacagccuggcagaugagc

SEQ ID NO: 255654 - RNA, 64 nt, Human
ugccuugaccccugugaugaccugguagucuuagcagggggagcccucgacccugaaugugaac

SEQ ID NO: 255655 - RNA, 64 nt, Human
aaacugaggugccugcccuucuaggaaugggggacagggggaggggaggagcuagggaaagaaa

SEQ ID NO: 255656 - RNA, 64 nt, Human
gagcccaaggucagggaggggcaaccaacugccccagggggauauggguccucuggggccuucg

SEQ ID NO: 255657 - RNA, 64 nt, Human
gccagcugucucccacguguguauuaugguucaccagggggaacuggcaaaagugugugugggg

SEQ ID NO: 255658 - RNA, 64 nt, Human
uggaacugaccacggccuggaggacuggcccaggcagggggacagggaaaauggagcccaagua

SEQ ID NO: 255659 - RNA, 64 nt, Human
ccaucugcaguauuauaaaagucauuuagaaggucagggggauaaucuagaggcaggauuuugg

SEQ ID NO: 255660 - RNA, 64 nt, Human
ucauaggggaagagugucacacuccuggcuaucucagggggaauggggaaaagaaucuuucaag

SEQ ID NO: 255661 - RNA, 64 nt, Human
cgugcauugaggccgccucuuugacggguccauccagggggacccucuccuuucugugaaaggg

SEQ ID NO: 255662 - RNA, 64 nt, Human
gauccuaaggguguccuuccagagacgguguuuccagggggaggaccgcccccgcuuccagauc

SEQ ID NO: 255663 - RNA, 64 nt, Human
gcugggauuacaggcgugagccaccgcacccagccagggggaauguucuauaaccagcucugua

SEQ ID NO: 255664 - RNA, 64 nt, Human
aagaggccucucuuaacagcccaguccuugucugcagggggaggccugagcauuucccagcccc

SEQ ID NO: 255665 - RNA, 64 nt, Human
ggccuucagaaagacagaauuucaucacccaaugcagggggagcucuuccuggaccaagggagg

SEQ ID NO: 255666 - RNA, 64 nt, Human
ucaucuaggguggacccagcugcuggggaagagccagggggaccgcgaggagccgagcguccuc

SEQ ID NO: 255667 - RNA, 64 nt, Human
auauugugggguccguuuaacucgauagaaagcgcagggggauggcccccggcgcgggcucuug

SEQ ID NO: 255668 - RNA, 64 nt, Human
cuccuucccccacccagcuuucuuuuuauggccccagggggagggggagagagcaaggagaucg

SEQ ID NO: 255669 - RNA, 60 nt, Human
ggagaacggaugcuugucuggccaugaucuggagagcaucaggcccgcaggacugcacaa

SEQ ID NO: 255670 - RNA, 60 nt, Human
uacuccugguucagugccacgcagggcagaggagagcagcugucaagaagcagcccuggc

SEQ ID NO: 255671 - RNA, 60 nt, Human
cagcacucccgccugauguauuggaucauaggagagcacuugcucuccugccucugccag

SEQ ID NO: 255672 - RNA, 62 nt, Human
aggagugugggugcucauagaguugcccagcccagggggaaagggagcaagaguuguccaga

SEQ ID NO: 255673 - RNA, 64 nt, Human
gcugaucgcucucacuggccugcugcagaugagccagggggagccuaggcccagcuccuccgcg

SEQ ID NO: 255674 - RNA, 64 nt, Human
gggauuugcugcaaaaugacccagaggcaggggucagggggagagguagagaugagacaagagg

SEQ ID NO: 255675 - RNA, 64 nt, Human
gggcaggggcgggggggggggggggggcagagggcagggggacgggucgggacaccagugaaac

SEQ ID NO: 255676 - RNA, 64 nt, Human
cuccccugccuugcuguuggucaugugggucuuccagggggaaggccaaggggagucaccuucc

SEQ ID NO: 255677 - RNA, 64 nt, Human
gcacaggaugcuguguugucaacaaaccaagcaucagggggaagaagcagagagaugcggccaa

SEQ ID NO: 255678 - RNA, 64 nt, Human
uggccacuucagggacagccugggcccaggcacccagggggauggcggcagcuuccugcaccuu

SEQ ID NO: 255679 - RNA, 64 nt, Human
ccacgcuccccacaggacuuggacagagggcccacagggggaugggcuggcuguggccagguuu

SEQ ID NO: 255680 - RNA, 64 nt, Human
cacauuaggaagcagaauauccuccaguguagcacagggggagaagugagaaguguuaugacau

SEQ ID NO: 255681 - RNA, 64 nt, Human
cugcaaaaucagacagaaauggcuugagaagccgcagggggagcaugccugucucucagugaua

SEQ ID NO: 255682 - RNA, 64 nt, Human
accugagccucaccuuaugagauucugauucagccagggggaggacaggaaucuguauuuuuca

SEQ ID NO: 255683 - RNA, 64 nt, Human
agaugcugaggguguuucuuccugcacccacagccagggggaugccacuccucccuccggcuug

SEQ ID NO: 255684 - RNA, 64 nt, Human
accccgcagggagcaagcaguacaguggcauucccagggggaccagcagcuacccaaggagaac

SEQ ID NO: 255685 - RNA, 64 nt, Human
ggacgacuuagcuucuguauuauuguugcuuccucagggggagacagucaagaauaaaaaguau

SEQ ID NO: 255686 - RNA, 64 nt, Human
caugaucuccuagaacaaaaccgcccugacuuuacagggggaacacucaugcugagcugagaaa

SEQ ID NO: 255687 - RNA, 64 nt, Human
acaccugugaucccagcacuuugggaggccaaggcagggggauuacuucagcccaggaguucca

SEQ ID NO: 255688 - RNA, 60 nt, Human
ugcccggauugcaagaauaaaugcccuaaaggagagcacauaugcaaugccugauggguu

SEQ ID NO: 255689 - RNA, 60 nt, Human
uccauuaacuucuaccuaaaucaccuggaaggagagcauuacucaccaaaauugcaaaac

SEQ ID NO: 255690 - RNA, 60 nt, Human
gucaaaaaguuguaucagaucaacuaaaauggagagcaagacagagaaugaaaagaguug

SEQ ID NO: 255691 - RNA, 64 nt, Human
cauuggcugccauccaggaccccaauuugugcuucagggggauaaucuccuucucucggaucau

SEQ ID NO: 255692 - RNA, 64 nt, Human
uguccuuguguuccuaucggaugcucccaguaaccagggggaccacccgagcuaaucauggaau

SEQ ID NO: 255693 - RNA, 64 nt, Human
ccacucggauggcacucagguggacaggacggggcagggggagacuuggcaccugaccucgagc

SEQ ID NO: 255694 - RNA, 64 nt, Human
ucuucccuuugagucccaguuucccuuuugguuacagggggauaguagcccccagggaucaugu

SEQ ID NO: 255695 - RNA, 64 nt, Human
gccuaagaacuguggucugguguuccagcugaggcagggggauuugguaggaaggagccaguga

SEQ ID NO: 255696 - RNA, 64 nt, Human
gaucucacaguaacgcggcaugggaacagugagacagggggaggggaggcgcaguuacaaaggc

SEQ ID NO: 255697 - RNA, 64 nt, Human
aagaggcgggaggagucauggggauggggagcggcagggggagagaggggcccucgacaaaggc

SEQ ID NO: 255698 - RNA, 64 nt, Human
ggacucagccuugccugucuuuuccugcugcucccagggggaggugucagaccucgggaggcag

SEQ ID NO: 255699 - RNA, 64 nt, Human
caccaagagggcugagggugagguguggaagggacagggggaggagaugggcagcauuguugag

SEQ ID NO: 255700 - RNA, 64 nt, Human
ugcaagagucugggcuuggggucuuuaaaaccagcagggggaaaugauaaaaagagagcugcuu

SEQ ID NO: 255701 - RNA, 64 nt, Human
gaagaaaacugaugagcugucaacugucaaaaaucagggggaagggggaagcauuaguuuggau

SEQ ID NO: 255702 - RNA, 64 nt, Human
uuuucuucccagcugggccugguggagcccggggcagggggagaguagagacacucccuugugc

SEQ ID NO: 255703 - RNA, 64 nt, Human
guuguugggaugcaaggaggugaugaaaaggagacagggggaaaaauaauccauagucagcaga

SEQ ID NO: 255704 - RNA, 53 nt, Human
ccaggaagcuuguauuuuagagccagggggagcugggccuggucucacccugg

SEQ ID NO: 255705 - RNA, 64 nt, Human
ugucagguaaagaaccuucaauguagcuaucuuccagggggagggcccugcagccucgcuccuc

SEQ ID NO: 255706 - RNA, 64 nt, Human
cccuccugggcccaccuccgauucacagagguuucagggggacccaaaucacugcugguuuuca

SEQ ID NO: 255707 - RNA, 60 nt, Human
ccuccacccacccuccugccucaccccugcggagagcaccguggcggggcgacagcgcau

SEQ ID NO: 255708 - RNA, 57 nt, Human
uuagcccugacaucugucaagcuuuggggccacaaaauaauuuaauauaacccuaag

SEQ ID NO: 255709 - RNA, 57 nt, Human
cgcaguggcugcaggcugcccccugccggccacaagggagcagcguccgcgccgccg

SEQ ID NO: 255710 - RNA, 64 nt, Human
ccuugcugaguggcgcaaggccgagcguucccagcagggggagaaacccuucacaccccaggcc

SEQ ID NO: 255711 - RNA, 64 nt, Human
ucuuuguucaguccuugcuuuccaauaauaaacucagggggacaugcuguacugugugguuuag

SEQ ID NO: 255712 - RNA, 64 nt, Human
uccagcgccgcgauggugagaucacuguuccaagcagggggacggcucgcgauaggacaaagag

SEQ ID NO: 255713 - RNA, 64 nt, Human
accugagguccguagaagcuaagcuccugagacccagggggaccugccacugguaccgcggccc

SEQ ID NO: 255714 - RNA, 64 nt, Human
ucaccuugggggugagaauuccaaugugaauuugcagggggagugggggacacacacaaauuuc

SEQ ID NO: 255715 - RNA, 64 nt, Human
cgacgaacugagcuguaaccagacuggggaggggcagggggagaggcccccaucagggaccaga

SEQ ID NO: 255716 - RNA, 64 nt, Human
caggacacugccucuucugggcagaaggccccuccagggggacugcuccaacaggaaagagccc

SEQ ID NO: 255717 - RNA, 64 nt, Human
uguguacuuccuuguccccuuuuuauuuauugggcagggggagggggagggcacaggcaagaag

SEQ ID NO: 255718 - RNA, 64 nt, Human
uccugguucugcccugucccauuccaccccaccccagggggaacaguagcuucaccuuguuauu

SEQ ID NO: 255719 - RNA, 64 nt, Human
caagaagggccccucgcucuugcuggcagggcagcagggggacugaaggcuggagcggagggac

SEQ ID NO: 255720 - RNA, 64 nt, Human
uccuggcacugccaccagccucaccgccugcgggcagggggaggccagcaggcccgggcccagc

SEQ ID NO: 255721 - RNA, 64 nt, Human
cuucugaccuccuggcaagagaaauucagugcagcagggggacacagaccugcccaagccaccc

SEQ ID NO: 255722 - RNA, 64 nt, Human
gagggacggaaggcuggcaccucuuccaccaguucagggggacuuuccccucuccugucucagg

SEQ ID NO: 255723 - RNA, 64 nt, Human
uaguucgaggccuuggguccccauccucuggaaccagggggaggccuggaaggaguucacugua

SEQ ID NO: 255724 - RNA, 64 nt, Human
agacugugaaguauauauccuccagcauucaguccagggggagccacggaaaccauguucuugc

SEQ ID NO: 255725 - RNA, 64 nt, Human
aggggagcccccgacgccucugcaauaacuggaccagggggagcugcugucacucccccauccc

SEQ ID NO: 255726 - RNA, 57 nt, Human
gucaucuauucaagcacuuacagcucuggccacaacagggcauuuuacaggugcgaa

SEQ ID NO: 255727 - RNA, 57 nt, Human
ucuuguucagucaagaccccagacucuggccacaaaaaugccauaaugccuguuggu

SEQ ID NO: 255728 - RNA, 57 nt, Human
ggaacuaauuucuucuaaugucagcguggccacaacuuauagacaguaucccuuguc

SEQ ID NO: 255729 - RNA, 64 nt, Human
uccugccagaccggaggggcuggggggaucccagcagggggagggcaaucccuucaccccaguu

SEQ ID NO: 255730 - RNA, 64 nt, Human
auaugcacaggaccuugacccugcuguucacagccagggggacccucagagcagcuggcacugc

SEQ ID NO: 255731 - RNA, 64 nt, Human
acacaauggcaagcauagucgccugguuacggcccagggggaagaugccaagggcaccccuuaa

SEQ ID NO: 255732 - RNA, 64 nt, Human
ugggaagcaaagucaugucuuaugugguggcaggcagggggacuugugcacaggaacuccuauu

SEQ ID NO: 255733 - RNA, 64 nt, Human
cauguaaggaaagauaggaccaaauauguaagugcagggggaaacacauuucagaccaggaauc

SEQ ID NO: 255734 - RNA, 64 nt, Human
cuucucccccgccaaaccacagugggagcuggggcagggggagagccaggcaaucgggggccaa

SEQ ID NO: 255735 - RNA, 64 nt, Human
cccucccccaacccuaucccuccuaccucacccgcagggggaaggagggaggcugacaagccuu

SEQ ID NO: 255736 - RNA, 64 nt, Human
uguagaauacuuugacuuaauuuucuuccagauacagggggauaccugccuguuuuucaaagug

SEQ ID NO: 255737 - RNA, 60 nt, Human
augacuacuacccaagaugaugcguccacacagggggaggguagacugggaguccugacc

SEQ ID NO: 255738 - RNA, 64 nt, Human
aauacugaaauuaugccuugucuccuccccaccccagggggaugccguuuugcaguguggacac

SEQ ID NO: 255739 - RNA, 64 nt, Human
uaagaacuaauaacaucuugaguuauuuuuaauucagggggauguggaaagguuugcaauuguc

SEQ ID NO: 255740 - RNA, 64 nt, Human
gaaggagcuccuuagcccaccugguuugcaggugcagggggaccuuaggcacgccccaagcacc

SEQ ID NO: 255741 - RNA, 64 nt, Human
guccuuuucucuaaaugaaguggcaucaaggacucagggggaaagaaaucaggggacauguuau

SEQ ID NO: 255742 - RNA, 64 nt, Human
uuuaucuucucugcccaagcccugucuuaaggcccagggggagguuaggagacugauagcaugu

SEQ ID NO: 255743 - RNA, 64 nt, Human
gguggggguggggguaguuuaagccuauggggcccagggggaaaggccaaacagaaacccaacu

SEQ ID NO: 255744 - RNA, 64 nt, Human
agugccaaugaugugacccucaaucccacauacgcagggggaaggcuuggaguagacaaaagga

SEQ ID NO: 255745 - RNA, 60 nt, Human
cccagucgcacaacuucccacauacccagaggagagcauaugccugugggggcagugcug

SEQ ID NO: 255746 - RNA, 60 nt, Human
gccccacggggcccugcggagccugaagccggagagcaggcggcucuucuggaacgcagg

SEQ ID NO: 255747 - RNA, 60 nt, Human
uuuuugcauuuuccuucauuucuuuaacaaggagagcaaagcuguuuuagcagaggcugg

SEQ ID NO: 255748 - RNA, 64 nt, Human
guacuuguucccucuguugggaugccaguuguggcagggggaggggaaccuguccaguuuguac

SEQ ID NO: 255749 - RNA, 64 nt, Human
aaaaggacuccacgccucuguggaaucauguccacagggggaccugccucccgugaugucccac

SEQ ID NO: 255750 - RNA, 64 nt, Human
ucuaucagaaccaauucuaugcgccaaaauacaacagggggaugugucccaguacacuuacaaa

SEQ ID NO: 255751 - RNA, 64 nt, Human
gaagugagugggagcacagcugaaaagagagggucagggggaggcuggcugcuugcuuaggugg

SEQ ID NO: 255752 - RNA, 64 nt, Human
uagaguccuuaagacggaaguaaauuaugauguccagggggagaaggaagauaggacguauuua

SEQ ID NO: 255753 - RNA, 64 nt, Human
gaucuaccggacugagauggcacccggggccagccagggggaccagcagugacucuggggcuac

SEQ ID NO: 255754 - RNA, 64 nt, Human
aguacaaauagcuugauuuggcuaggcuuggcugcagggggacgugccuaaaagacauuccggg

SEQ ID NO: 255755 - RNA, 64 nt, Human
gcgccccagcucggccuugggagguggucguguccagggggaugauggagagcuguccaaccaa

SEQ ID NO: 255756 - RNA, 64 nt, Human
ucugggcucagagagaggcccuugagcugcagcucagggggaugcgaggcuucguggacugugu

SEQ ID NO: 255757 - RNA, 64 nt, Human
acucugaaggguauggaccuacgugaaugugugucagggggagacuugcugguggguuaguggu

SEQ ID NO: 255758 - RNA, 64 nt, Human
aacuaaaaagcuuuguguucuucaggguggguggcagggggauauagugaggguggaccaggga

SEQ ID NO: 255759 - RNA, 64 nt, Human
cuugguuuuagacucugaugaggaagaaaauggccagggggaaggaaaggugagugggaaggag

SEQ ID NO: 255760 - RNA, 64 nt, Human
uuuucccacaauccaagcugccauauuuugagggcagggggaguuuuauucuacacccuuuacc

SEQ ID NO: 255761 - RNA, 64 nt, Human
uuaaucuucauauauauuaucaucccuaauguagcagggggaaguauuuaauugcccaugauau

SEQ ID NO: 255762 - RNA, 64 nt, Human
uuauacacuuugcuuccuucuuauuggugaaaaccagggggaugaguggcuuccauggagagau

SEQ ID NO: 255763 - RNA, 63 nt, Human
ugauugaggaguccugcugagcccacuguguggcagggggauggcagguuggggguccugggg

SEQ ID NO: 255764 - RNA, 60 nt, Human
ucuucccccagcugcucccgaccaggagggggagagcagccuccacuuaccccaccccac

SEQ ID NO: 255765 - RNA, 60 nt, Human
gcgccgacguccugcccaccacgcacucccggagagcacggaaccgcacgcacgucaggc

SEQ ID NO: 255766 - RNA, 60 nt, Human
uuuuaaugaaugcucacaccuuauugcacaggagagcauuuauacuugaaaaaaauugua

SEQ ID NO: 255767 - RNA, 64 nt, Human
aagcauggagagagaggucagacuggcuaggcugcagggggaauuaccuuuggaaggagcuaua

SEQ ID NO: 255768 - RNA, 64 nt, Human
uugucaucucucuuccccccuuggaaguuguccucagggggauuuguuccuguccuggggauuu

SEQ ID NO: 255769 - RNA, 64 nt, Human
uauccacucacaugucuucccucaggcuaucgggcagggggacuucaccaggggguuuauggau

SEQ ID NO: 255770 - RNA, 64 nt, Human
gacagcuccagcuucgcagcccuucccggagcuacagggggauccucuagcaugggggguguga

SEQ ID NO: 255771 - RNA, 64 nt, Human
cuccacuggggguaccugagccuggauuagagggcagggggaggauauugccuagccaaagugg

SEQ ID NO: 255772 - RNA, 64 nt, Human
uagccucuggccucucuguggggaaaggggacugcagggggaagagccgggaagggacagucag

SEQ ID NO: 255773 - RNA, 64 nt, Human
cuaacccaggagcuuaguaaaaauugcauaagaccagggggaagagugucagcgugggguggga

SEQ ID NO: 255774 - RNA, 64 nt, Human
ucaggaagcugugcagccucugccauugccaucccagggggaucuggcauccuccuaaggaccg

SEQ ID NO: 255775 - RNA, 64 nt, Human
auuguuagcagcuagccagccacaccaaccacgccagggggaggaaagggaaggacugggagag

SEQ ID NO: 255776 - RNA, 64 nt, Human
cuuggggcugggucugccuggagaccagugggcccagggggaagggggaagcugagaaguucgu

SEQ ID NO: 255777 - RNA, 64 nt, Human
ccugcccaagccagacagacagcaccugcagacgcagggggacugcacaauuccaccugcccag

SEQ ID NO: 255778 - RNA, 64 nt, Human
ggaccgggacgggaaggaagaaggaggcuaggagcagggggaaaaggugcacuuggccaguggc

SEQ ID NO: 255779 - RNA, 64 nt, Human
cccggcccucugccagcauaaaccacucacaccccagggggaugagcucuccaagcccaggauu

SEQ ID NO: 255780 - RNA, 64 nt, Human
ucuggaagaaucccauacugauggcagggcuggccagggggaagaggguaguaucugugggucc

SEQ ID NO: 255781 - RNA, 64 nt, Human
uuuguuuuguuuuuuuaaagaugaaauaaagacccagggggagaauggguguuguauggggagg

SEQ ID NO: 255782 - RNA, 64 nt, Human
agacaauucaagauuucuauaugggguuguggcgcagggggagggagauuuaucuugaagcuga

SEQ ID NO: 255783 - RNA, 60 nt, Human
uaaagcggaaacucuaggacuguguucaugggagagcaguucaucuguucagaacaguga

SEQ ID NO: 255784 - RNA, 60 nt, Human
cccaccugccugcccccauacucccccagcggagagcaugauccgugcccuugcuucuga

SEQ ID NO: 255785 - RNA, 60 nt, Human
gggggaaacugaccaagaaagaaauucuaaggagagcaugagagaaggcuggcauuggca

SEQ ID NO: 255786 - RNA, 64 nt, Human
acuugagaucucuuuauuacauggacauuuacuucagggggaccacuguaagaaaagccaaacu

SEQ ID NO: 255787 - RNA, 64 nt, Human
ggaggcuggccucuugccuaccuccuugcauggacagggggaugaauauuuacuuucccaccuc

SEQ ID NO: 255788 - RNA, 64 nt, Human
agagcugaguagaguguugguuuuuccauaacuacagggggaaaaaaagucauuaggcuuuccc

SEQ ID NO: 255789 - RNA, 64 nt, Human
caguacagucuuccccugaaugccaccggggacccagggggacuccaccccccuaagcaagcac

SEQ ID NO: 255790 - RNA, 64 nt, Human
ggagcucuuugagccuuucugucucauuuggaaccagggggaaccaggaaggggcuccuggccu

SEQ ID NO: 255791 - RNA, 64 nt, Human
gcccacugacguuggagugcuaaaaaugccccuucagggggaaaacugcauuuucucuuccaaa

SEQ ID NO: 255792 - RNA, 64 nt, Human
cgugcagucuuaacagggagagggcuuucuggggcagggggagccccugucggcagcuuuccug

SEQ ID NO: 255793 - RNA, 64 nt, Human
uuugagggggucucuaccuccccaucaacagcugcagggggaccccagugccaacuuccucucc

SEQ ID NO: 255794 - RNA, 64 nt, Human
ccuuucuagaaggaagaucugaggcucuggugcucagggggauggcuugggccuuuucucucaa

SEQ ID NO: 255795 - RNA, 64 nt, Human
guuccagcccuuguuauucuuguccuuaguccuccagggggagcugggguugcagggcaacagu

SEQ ID NO: 255796 - RNA, 64 nt, Human
uggaggcaguaauucuaggagauccuaagggguucagggggacccuacccccaccucagguugg

SEQ ID NO: 255797 - RNA, 64 nt, Human
uuccuuucaagagguaacagcacugggauccaagcagggggaugaaaaacucagcagagaaauu

SEQ ID NO: 255798 - RNA, 64 nt, Human
ucuuagggccucuaugaagaaacuaacaagaaagcagggggaccugccacccccaggugggcuc

SEQ ID NO: 255799 - RNA, 64 nt, Human
aagaauguuuggggauauuucaguguugcugcugcagggggacuucaugaauuugcugauucuc

SEQ ID NO: 255800 - RNA, 64 nt, Human
aaaaagucaguugugcccagccuaccuucucucacagggggacccaauucucugaagucuacga

SEQ ID NO: 255801 - RNA, 64 nt, Human
ggccaagcugggugugguauuuagggcagcucagcagggggaacuuguccccauggucagagga

SEQ ID NO: 255802 - RNA, 60 nt, Human
ccaggggccucccuccuguugaagacugggggagagcaguggguucugggggggccuggg

SEQ ID NO: 255803 - RNA, 60 nt, Human
ccugucugcuccagucuugcccagcucgaaggagagcagaucugaccacuugccagcccc

SEQ ID NO: 255804 - RNA, 60 nt, Human
uuuuuauugguuuccaaggucuccuaggaaggagagcagagcugugugguccuaaucaug

SEQ ID NO: 255805 - RNA, 64 nt, Human
cugaugcagucccaccgaaagccuccaucugcuccagggggacagccccucguguccagaaccu

SEQ ID NO: 255806 - RNA, 64 nt, Human
auguucuguguugcagaccagagucuguuuaugucagggggauggggccauugcauccuuagcc

SEQ ID NO: 255807 - RNA, 64 nt, Human
ucgcacuuaacgacucgggccaccacugggggggcagggggagggguccaccaugauuucucca

SEQ ID NO: 255808 - RNA, 64 nt, Human
ucgcaaguaugaccagaagccaggacaaagcuggcagggggagaucccaagccuagccuugggu

SEQ ID NO: 255809 - RNA, 64 nt, Human
cccuggcugcaaugucucuaccacaucccagcaccagggggagcaaacccugccccugcccgcc

SEQ ID NO: 255810 - RNA, 64 nt, Human
gcagucagggaggggcggugagccagaguagucccagggggagacagauuccucccuccucccc

SEQ ID NO: 255811 - RNA, 64 nt, Human
caauaccuagaguuagaacacuauguacucugcacagggggagugaaguaauauuggcuuagaa

SEQ ID NO: 255812 - RNA, 64 nt, Human
cuugaaauacucaaccaaaagacagucgagaagccagggggagaaagaacucagggcacaaaau

SEQ ID NO: 255813 - RNA, 64 nt, Human
ccccaggaccuccggagcgcccugcagggccgggcagggggacagcagggaccgggcgcagccc

SEQ ID NO: 255814 - RNA, 64 nt, Human
guuccucccuagccuuccaucccucuguccaccccagggggagguaaccccgcacucacacucc

SEQ ID NO: 255815 - RNA, 64 nt, Human
aggaaagaaacuaaacccacccaagggaugaugucagggggagagguggagggcagauguccug

SEQ ID NO: 255816 - RNA, 64 nt, Human
ggggcagaguuugcacaaagucccccccauaauacagggggagccacuugggcaggaggcaggg

SEQ ID NO: 255817 - RNA, 64 nt, Human
accuacccacugcucccaggggucucuccaggggcagggggauuuuaggagauggggugggggc

SEQ ID NO: 255818 - RNA, 64 nt, Human
uguccuaagaggaccaccgccaucucugggucuccagggggagagccuggcccuguccuuugcu

SEQ ID NO: 255819 - RNA, 64 nt, Human
gcuaccccgagagguagccccacucuaaggggagcagggggaccugacagcacaccacugucuu

SEQ ID NO: 255820 - RNA, 64 nt, Human
uugacaaaacccacuguucuuguauuguauugcccagggggagcuaucacuguacuuguagagu

SEQ ID NO: 255821 - RNA, 57 nt, Human
gcagcucccuccuggcacaugggggcuggccacaauagcccagagggucagaacugg

SEQ ID NO: 255822 - RNA, 57 nt, Human
cagugcccuccagccccgcgaccauguggccacaauccacgcuucuccggaucgcgg

SEQ ID NO: 255823 - RNA, 57 nt, Human
gcuuugguagcucuguuggucagcaguggccacaaggcugcuuucugcacucucugu

SEQ ID NO: 255824 - RNA, 64 nt, Human
caaaugcaauuuccaacacaagggggaagggaugcagggggaggcagcgcugcaguugcucagg

SEQ ID NO: 255825 - RNA, 64 nt, Human
aaagacucagcagcacauggggcagguguccuggcagggggacaggagacuguaacaggcccag

SEQ ID NO: 255826 - RNA, 64 nt, Human
caucgggguggggugauaaaggauacaaccugcacagggggaaguuauuaaagaggcugcaaag

SEQ ID NO: 255827 - RNA, 64 nt, Human
uuccacgaugccgcugggcgacguggcgugggggcagggggacggugggggagcccucgccccc

SEQ ID NO: 255828 - RNA, 64 nt, Human
cuccauccccaaagagguagcacugcagcaacaucagggggaggacgugguggcugaacucuag

SEQ ID NO: 255829 - RNA, 64 nt, Human
cggugcugccccagccaggaucuggucgcugccccagggggacugaugggcagagucgccccug

SEQ ID NO: 255830 - RNA, 64 nt, Human
ccccucuuuuuacucaaaggcacugacuguaauccagggggacugggaccugccuccccccaac

SEQ ID NO: 255831 - RNA, 64 nt, Human
ccugaggcccaaggagguugucagggacacacagcagggggaggcagcccagaucccugcucau

SEQ ID NO: 255832 - RNA, 64 nt, Human
ucuuggauaccugggagggggccaaugggggccucagggggaggcccccucuggaaaugugguu

SEQ ID NO: 255833 - RNA, 64 nt, Human
ccugcucccuggagacugggaaaaggccgcagggcagggggacugggcggugguggcugguggu

SEQ ID NO: 255834 - RNA, 64 nt, Human
ggacggaucugcucagaaaggaagaggcaggcgccagggggaacccccuucguguuuugugacc

SEQ ID NO: 255835 - RNA, 64 nt, Human
uaaucccuaaucccagcacuuugggaggcugaggcagggggaucacgaggucaagagauaaaga

SEQ ID NO: 255836 - RNA, 64 nt, Human
agcuccucaauucucccccacccugaacaucccgcagggggagggggagagggggaagccgaga

SEQ ID NO: 255837 - RNA, 64 nt, Human
cuuacuuaaccuuaauggaaacgcuggaaaucugcagggggagggagaggggaacuguuaucuc

SEQ ID NO: 255838 - RNA, 64 nt, Human
caacuucacauccguccuccugucucagggcuggcagggggagccuggaauuacccccuaguga

SEQ ID NO: 255839 - RNA, 64 nt, Human
ggccgcugcaugucguuaugcagaucagacucaucagggggagcccucaccucugccucaagcc

SEQ ID NO: 255840 - RNA, 60 nt, Human
cccgcgugugcgccaggcuugggguccccgggagagcagagcuugcgccucgggcauagg

SEQ ID NO: 255841 - RNA, 60 nt, Human
ccaugcccgcugucccagcuccuugagacuggagagcagccagcaggugcccggcagcuc

SEQ ID NO: 255842 - RNA, 60 nt, Human
ccaucugcccacguggcuugcagugacucaggagagcaggcccacagcguuugccaucuu

SEQ ID NO: 255843 - RNA, 64 nt, Human
ucuugugcuccccaucccgccuccugccggguuucagggggacaguggaggauccaggucuugg

SEQ ID NO: 255844 - RNA, 64 nt, Human
uuuuugcugcccccuccccgcccacugucuggggcagggggagaagguauuuucgagauaaagc

SEQ ID NO: 255845 - RNA, 64 nt, Human
cgaggccaggauggaggugggaggccgagccaagcagggggacguugccagaggggaccagggc

SEQ ID NO: 255846 - RNA, 64 nt, Human
acucaguucucacucauugcagaaggauucauaccagggggaaauguggaaggcauuccaucaa

SEQ ID NO: 255847 - RNA, 64 nt, Human
uacugggaucaaacuggaauaaauugaagacagccagggggauggugcagcugugaagcucggg

SEQ ID NO: 255848 - RNA, 64 nt, Human
aaauuauuuuuucaaccuagagaaucuccucuuacagggggaugcauauaacagaucauguaug

SEQ ID NO: 255849 - RNA, 64 nt, Human
gcuucuuccucccgugcccucuccccgugugccccagggggaucagggauccucacccuccuga

SEQ ID NO: 255850 - RNA, 64 nt, Human
aagggcuggcuucuagguccccgagauaagugugcagggggaugggccagggccaggcuaaggg

SEQ ID NO: 255851 - RNA, 64 nt, Human
caccggggcccugcaugucagauggcguggucugcagggggagcucugugccuuaguggcucuu

SEQ ID NO: 255852 - RNA, 64 nt, Human
cuagaccuuguggguggcgcccugcauaggggagcagggggaacgggucugaugucccugugcu

SEQ ID NO: 255853 - RNA, 64 nt, Human
caccuguaaguccuuugugaagaugugggugacacagggggacaggaaaacccauuucucaacc

SEQ ID NO: 255854 - RNA, 64 nt, Human
uucccagagucccuccuucucccagguuuggucucagggggaccccagggaugccccagaucag

SEQ ID NO: 255855 - RNA, 64 nt, Human
uuucaaaaacagggcagagccuggcugucccaaccagggggagcaggggcuuggcccugacagc

SEQ ID NO: 255856 - RNA, 64 nt, Human
ggccucgcccggaccauuaggcggacugcggcgucagggggauagcggguggugagggaagggg

SEQ ID NO: 255857 - RNA, 64 nt, Human
agaaauacugugucucaugaaggaucacagaguucagggggaaaaugugacagcacacgcacaa

SEQ ID NO: 255858 - RNA, 58 nt, Human
cagcuagcaaacagucuuaggaaucgugcagggggagaaauccuugagccagggcugc

SEQ ID NO: 255859 - RNA, 60 nt, Human
gagcaugagagaaggcuggcauuggcaggaggagagcaccaggacgaggaugggaagcga

SEQ ID NO: 255860 - RNA, 57 nt, Human
ugaucuggcaaugacuuuuugugugugggccacaauauugauuuucccauuaacaau

SEQ ID NO: 255861 - RNA, 57 nt, Human
cacuucugugauccauuuuaauuuccaggccacaagacaguagugaugcucugaaau

SEQ ID NO: 255862 - RNA, 64 nt, Human
ccagcaggcgaggcuacaguaccugcugucuuuccagggggaaggggcuccccaugagggaggg

SEQ ID NO: 255863 - RNA, 64 nt, Human
ccgagcaagguggguggcucuggcacgagucccccagggggagagcauggcuaccagggagcug

SEQ ID NO: 255864 - RNA, 64 nt, Human
aaaaugccugcugcucacagcacagaaaauggggcagggggagccucaagcacaaucuagcugu

SEQ ID NO: 255865 - RNA, 64 nt, Human
uggccugggauuuggugacggagaggagggcucccagggggacaugcggugggacaggagcgug

SEQ ID NO: 255866 - RNA, 64 nt, Human
gggcaccaggcaugggacugagcccaugucuccucagggggauggggugggguacaaccaccau

SEQ ID NO: 255867 - RNA, 64 nt, Human
uaacauuguccagguugguuuuaaaauucccaggcagggggagaguggcauggggagugacuuc

SEQ ID NO: 255868 - RNA, 64 nt, Human
gguauuaaugcaauguguggugguuguauuggagcagggggaauugauaaaggagagugguugc

SEQ ID NO: 255869 - RNA, 64 nt, Human
cguguaccuuucccauuguggucaugccauuuggcagggggagaaugggaggcuuggccuucuu

SEQ ID NO: 255870 - RNA, 64 nt, Human
uccucacugcugcccugaguccagccaugguuuucagggggacaguggacagggacucagaaau

SEQ ID NO: 255871 - RNA, 64 nt, Human
ggccacagaaggggcaggccagguggaaaggagccagggggaaguggucuaagagaccuggaac

SEQ ID NO: 255872 - RNA, 64 nt, Human
gggcagaaacugggcagcccugacuugauagcagcagggggagcucccaagcugccaagccccu

SEQ ID NO: 255873 - RNA, 64 nt, Human
cauucacuccugccccugcccacacggcagguagcagggggagugcuggucacaccccugugug

SEQ ID NO: 255874 - RNA, 64 nt, Human
agggaugucccugugcccagcacagggugccuggcagggggagaccacagguaugcaggugggg

SEQ ID NO: 255875 - RNA, 64 nt, Human
gcccccucgccccagccccaccccacauggagcucagggggaagcagggagggguucccaaaag

SEQ ID NO: 255876 - RNA, 64 nt, Human
acauuuaguaacuugucucagggcagagggcaggcagggggaccgaggggcagcagauaggaga

SEQ ID NO: 255877 - RNA, 64 nt, Human
ugggcagggcugcuccaggcaggucagagcagugcagggggaggagaggagaaagggaggaagc

SEQ ID NO: 255878 - RNA, 60 nt, Human
gagcgggucauggggcaacacgguuagcggggagagcacgggguagccggagaagggccu

SEQ ID NO: 255879 - RNA, 60 nt, Human
acgucccaccccucagauauuucuuugaagggagagcaaacccacccuguccucugacgu

SEQ ID NO: 255880 - RNA, 60 nt, Human
cugcagggaugguugugagccgcuagugauggagagcagagggagagggccaggcuccag

SEQ ID NO: 255881 - RNA, 64 nt, Human
uccccugcccaccugccccucaacccuguagcugcagggggaggggacuucauucauggguugg

SEQ ID NO: 255882 - RNA, 64 nt, Human
uccuggacucagagagcccagggcaacugccaagcagggggacaaguauucuggcggggggugg

SEQ ID NO: 255883 - RNA, 64 nt, Human
ccuaaaccguccccuccuucccucacccccagcacagggggauucugagcagugccucuugucu

SEQ ID NO: 255884 - RNA, 64 nt, Human
auguccuccuucugaaggaccucauccuuccucacagggggaugaccaagaaaucauuuugugg

SEQ ID NO: 255885 - RNA, 64 nt, Human
ugucugccaggaggccacguguguccugcccacccagggggagcuguauuuuggcagcacccca

SEQ ID NO: 255886 - RNA, 64 nt, Human
ucgccuuccuacccccgcccgccauccccaguugcagggggaucuggggacuaccagagacucu

SEQ ID NO: 255887 - RNA, 64 nt, Human
accugaucacucaacugcuucuuaacaccuccaccagggggaaggcuggcacaaggagaaaaaa

SEQ ID NO: 255888 - RNA, 64 nt, Human
ucccaaacucccccagcccugagcugggagaugacagggggaaagaggcccucucaagggugcc

SEQ ID NO: 255889 - RNA, 64 nt, Human
ccauguucccagcucagugccaaagaggggucaccagggggagcugucugcggagccagcgccu

SEQ ID NO: 255890 - RNA, 64 nt, Human
ggcccccuucauuagugccuugcuuugggcccugcagggggaggggugacagggcgagccccca

SEQ ID NO: 255891 - RNA, 64 nt, Human
gggaggaggaaggccuguugcugcaaucauuguacagggggaaauggguaugagagacugaggc

SEQ ID NO: 255892 - RNA, 64 nt, Human
accccugaucuccagucccuagcugggggcuggacagggggaagggagagaggauuucuauuca

SEQ ID NO: 255893 - RNA, 64 nt, Human
aaaaggugacggcaaggacaugcauugcaauuugcagggggaauugucaagugaggacuucauc

SEQ ID NO: 255894 - RNA, 64 nt, Human
aaccuccauuuggauaccaagugagccucccucucagggggacucugacagacucgugugcggg

SEQ ID NO: 255895 - RNA, 64 nt, Human
gggagaggcaggaaggauccuccccuagagccuccagggggaacuggaggaugcguaagagacc

SEQ ID NO: 255896 - RNA, 60 nt, Human
aaccgccucuaguuguaccccagccucguuggagagcagcaggugcugugcgccuuguag

SEQ ID NO: 255897 - RNA, 60 nt, Human
gagggaugaugaagagagagagggccugcuggagagcauagggucuggaacaccaggcug

SEQ ID NO: 255898 - RNA, 60 nt, Human
auggacguacugguuuaaccuccuauccuuggagagcagcuggcucuccaccuuguuaca

SEQ ID NO: 255899 - RNA, 64 nt, Human
gccggcccugugcacaaggaugcacuccucucggccccuguagacuuucucuaaagccgcccgc

SEQ ID NO: 255900 - RNA, 64 nt, Human
agcgagggagaggucgugaggccagcucccggggccccuguaacccuacucuccucucucccug

SEQ ID NO: 255901 - RNA, 64 nt, Human
cuagaguugcuaaggauaaguuuaaagaccaauaccccuguacuuaauccugugcugucgaggg

SEQ ID NO: 255902 - RNA, 64 nt, Human
guaggcccuggugaacugaauccagcacaggccuccccuguaacacaacaggacugagcagaac

SEQ ID NO: 255903 - RNA, 64 nt, Human
uaacagcccccucuaaaagcgcaagccagucauaccccuguauaucuuagcagcacugagucca

SEQ ID NO: 255904 - RNA, 64 nt, Human
uuaauugcugugcuccacagaucuugucuauuggccccuguagaaaguuaaccuuuguuguuuu

SEQ ID NO: 255905 - RNA, 64 nt, Human
gaaggagaggagaggggcacagggucucuaccauccccuguagagugggagcugagugggggau

SEQ ID NO: 255906 - RNA, 60 nt, Human
uccccgagggccagcagggcugggggcuccggagagcagcaggaagcacucccagccacc

SEQ ID NO: 255907 - RNA, 60 nt, Human
gacaaacagcagacccuacagagauguguuggagagcacgucgugaccuugggggcaagg

SEQ ID NO: 255908 - RNA, 60 nt, Human
ugaugugugaagcugggcagucugugguguggagagcagccaucugucuggccauucaga

SEQ ID NO: 255909 - RNA, 64 nt, Human
ccgccccucccgcuugcuccccagcccacccaccccccuguacagaaugucugcuuugggugcg

SEQ ID NO: 255910 - RNA, 64 nt, Human
ccugcccuguaccucucucugcuccucacccccaccccuguacccagccaccuuccugacuggg

SEQ ID NO: 255911 - RNA, 64 nt, Human
aucaaauuaugugugaaauguaggaaaaugcuugccccuguaaacuagugaguugauggagcau

SEQ ID NO: 255912 - RNA, 64 nt, Human
aaaaauacaaaaauuagccaggcgugguggugugccccuguaaucccagcuacucaggaggcug

SEQ ID NO: 255913 - RNA, 64 nt, Human
cccugggcacgcaaggaugaguaugggccaugggccccuguagagcugcuuaccuggugaugac

SEQ ID NO: 255914 - RNA, 64 nt, Human
ggaaauucagcccaccagccaccucauccccaacccccuguaagguuccauccaccccugcguc

SEQ ID NO: 255915 - RNA, 64 nt, Human
ugccugcaaagcuagugcuguugagaaggggguuccccuguaccaccacaucgccgacuugucu

SEQ ID NO: 255916 - RNA, 64 nt, Human
uucuccggggucugugcugugccugcuagagcaaccccuguacccagcuccuuuuguccccagg

SEQ ID NO: 255917 - RNA, 64 nt, Human
ucucuguccucgggaaggcccccacaagcuuaagccccuguauacgugugacaugcuggccuca

SEQ ID NO: 255918 - RNA, 64 nt, Human
accuagauucuaauccugacgcaaccacauacuaccccuguagcugugaaccuccgggcucauc

SEQ ID NO: 255919 - RNA, 64 nt, Human
guguggggaggggugccugcuggccccauguccuccccuguacauagucuucgugucuuucugg

SEQ ID NO: 255920 - RNA, 64 nt, Human
uugcuagguaucauaguuuaggcccauuuaccuuccccuguacuggcaguucagccgcuuacau

SEQ ID NO: 255921 - RNA, 64 nt, Human
uuguuuuauguacaggaugucauaugucccccuaccccuguaccugccaaggauuggcagugcu

SEQ ID NO: 255922 - RNA, 64 nt, Human
cugucugauguccaggaugucacauguucccuuaccccuguaccugugaaggauuggcagugcu

SEQ ID NO: 255923 - RNA, 64 nt, Human
gacucgaggcugagcguggaucugaacaccacagccccuguacuuggguugccucuugucccug

SEQ ID NO: 255924 - RNA, 60 nt, Human
ugacgaacugccccccccccccccccagcaggagagcagcaaaauuuaugcaaaucuuug

SEQ ID NO: 255925 - RNA, 60 nt, Human
gaugcugaugaagaguucacaggugguaugggagagcaaaaggcaagcuaaugcuguuua

SEQ ID NO: 255926 - RNA, 60 nt, Human
caggcugccccucuccuuccccggcucgcaggagagcagagcagagaacuguggggaacg

SEQ ID NO: 255927 - RNA, 64 nt, Human
caggagauggaaguugcagugagcugauaucaugccccuguacuccagccugggugacagagca

SEQ ID NO: 255928 - RNA, 64 nt, Human
ucugcccccaggucgucuugcacaccuuggcagcccccuguaguugacagguaagcuguaggca

SEQ ID NO: 255929 - RNA, 64 nt, Human
ugaugaaaacgccuccuuuucugaccuucaaaguccccuguagagaccaugcaugcucuaagcc

SEQ ID NO: 255930 - RNA, 64 nt, Human
uucuaagacgccagcucuuugagauuugcucauuccccuguauuucccacauauauauuacaua

SEQ ID NO: 255931 - RNA, 64 nt, Human
uauuucaguagaugggauuucagccaaguagguuccccuguaaccuccuacaaagcaauauucc

SEQ ID NO: 255932 - RNA, 64 nt, Human
uuuucucugcaccucuguacagagaauacaccugccccuguauauccuuuuuuccccuccccuc

SEQ ID NO: 255933 - RNA, 64 nt, Human
auuuuaucaaauccucucuugcccucccucaauuccccuguaacauuccugaagcuguucccac

SEQ ID NO: 255934 - RNA, 64 nt, Human
gugaagcuuuuaaaaaauguuagugcccacucuuccccuguacccccggacaguuaaaucagaa

SEQ ID NO: 255935 - RNA, 64 nt, Human
acgacaaaaaaaauuagccaagcauaguggcacaccccuguagucccagcuacuugggaggcug

SEQ ID NO: 255936 - RNA, 64 nt, Human
uaagacaaacccuucucccaucugccuucccuauccccuguaccugacaaucuaugaguuugcu

SEQ ID NO: 255937 - RNA, 64 nt, Human
ugagagagaaaaauaugugcaguaucucauccucccccuguaccaggccauagcuuugaagugu

SEQ ID NO: 255938 - RNA, 64 nt, Human
gccuucggcugccccccacuaagcuaauuccacaccccuguacccccccagggggcccucugcc

SEQ ID NO: 255939 - RNA, 64 nt, Human
aaaauaacaaaaauggaagcaaacaacaucagaaccccuguaaguuuggugugaccuuacagac

SEQ ID NO: 255940 - RNA, 64 nt, Human
gacugacucuccaccauaaaacuggaagcugcuuccccuguaguccccauuucaguaccaguuc

SEQ ID NO: 255941 - RNA, 64 nt, Human
aucaguggcuucucaagggaagagccuugcugugccccuguagccucagcacccagcacaggcc

SEQ ID NO: 255942 - RNA, 60 nt, Human
acuguuuucacuaaacagcuuuuucuaaggggagagcaagggggagagaucuagauuggg

SEQ ID NO: 255943 - RNA, 60 nt, Human
caaagugcguuccuuaaagacagacauugaggagagcaaauaccgacagcgccaccugaa

SEQ ID NO: 255944 - RNA, 60 nt, Human
gaagucagcauaggcugcccaccuaaugguggagagcaugaaacugggagcauccugugg

SEQ ID NO: 255945 - RNA, 64 nt, Human
gauggagcagaggagcgccacacauggaggaaagccccuguaacguuaccuaccuuaaacucca

SEQ ID NO: 255946 - RNA, 64 nt, Human
aauugcacugaagaaaggccgggcgcgguggcucccccuguaaucccagcgcuuugggaggccg

SEQ ID NO: 255947 - RNA, 64 nt, Human
ucuggaggacagaccugcucauuaggugugcuguccccuguagccucgugagucagcccagagg

SEQ ID NO: 255948 - RNA, 64 nt, Human
auagaagggaagggugaugagagaacagaacuggccccuguacaggugucauuaaucugguugu

SEQ ID NO: 255949 - RNA, 64 nt, Human
gugagauaaaguacuuagauuuauaaggcagcuuccccuguagugauaaauuacaagcagacaa

SEQ ID NO: 255950 - RNA, 64 nt, Human
cugccguccucgcugcugggggcauaugccccagccccuguaccaccccugcuguugccugggc

SEQ ID NO: 255951 - RNA, 64 nt, Human
ggaugcuucuuaacccucaggcaaaccuguguucccccuguauucaggcucugcuuuaaagcaa

SEQ ID NO: 255952 - RNA, 64 nt, Human
aaguggcuguguucuucuacagccuguggaagaaccccuguagcagagccucccguccacccuc

SEQ ID NO: 255953 - RNA, 64 nt, Human
ugccucugggcugagcacagcuugaccccucuagccccuguaaauacuggaucaaugaaugaau

SEQ ID NO: 255954 - RNA, 64 nt, Human
cuggcaugaaaauucuugaccccucacacuuuacccccuguacagcacaggcauaccauggaga

SEQ ID NO: 255955 - RNA, 64 nt, Human
gcuggauaguggucaggcauucucuauucuuuucccccuguagacccauucuaaaugugggccu

SEQ ID NO: 255956 - RNA, 64 nt, Human
gacaccugguucuagaacuagcucugcccuuagcccccuguaugacccuaugcaaguccuccuc

SEQ ID NO: 255957 - RNA, 64 nt, Human
uggacugccagaaugagccaacagcacuugcuucccccuguagagagccuaugaauggacgugc

SEQ ID NO: 255958 - RNA, 64 nt, Human
cuuaaaagcggagagaacacagaguggaaucagcccccuguaaguaaaaggguagagaaagaga

SEQ ID NO: 255959 - RNA, 64 nt, Human
gucagcccaggggagaaagauaacugcuaaaauuccccuguaccccauccuuucuuguccuuuc

SEQ ID NO: 255960 - RNA, 60 nt, Human
gacugcgugggaguuugugaccuuguggugggagagcagagguggacgcggccgagagcc

SEQ ID NO: 255961 - RNA, 60 nt, Human
cauagcuuacaaaugcaucaguguguaucuggagagcauccuaacugcauuucaacucau

SEQ ID NO: 255962 - RNA, 60 nt, Human
ccaagcaucacauggaguguagggucacugggagagcagaggucacagccucuagagaag

SEQ ID NO: 255963 - RNA, 64 nt, Human
ucuauaacuuuuucuccgccuuugucccauucugccccuguacauguuuccuaccaagcauguu

SEQ ID NO: 255964 - RNA, 64 nt, Human
uuuuuacuaaauaacuauagauauguaucguuuuccccuguaaaauuggaauaguaugauugga

SEQ ID NO: 255965 - RNA, 64 nt, Human
gugccuaugcccuggcguugccaggcuuaaccuuccccuguaucuuacucaucccagaauuauu

SEQ ID NO: 255966 - RNA, 64 nt, Human
ccguccugacguuuugaggcaauagagaugccuuccccuguagcagucuucagccuccucuacc

SEQ ID NO: 255967 - RNA, 64 nt, Human
cugcgcuguuguuguccguauuuaaacaacagcuccccuguauucccccaucuagccauuucgg

SEQ ID NO: 255968 - RNA, 64 nt, Human
aaaccaggcccgcuucacgaguuagaguugagcuccccuguagccaggacuaugcuguagauau

SEQ ID NO: 255969 - RNA, 64 nt, Human
uuugcucauggugucgcauaaccacuucuucuauccccuguacuuucaaggauaauuuaggcua

SEQ ID NO: 255970 - RNA, 64 nt, Human
ucuaacacugagcaacacucucccaguggcagauccccuguaucauuccaagaggagcauucau

SEQ ID NO: 255971 - RNA, 64 nt, Human
caaacaaggugcaggacccagcuuuggccccaugccccuguaggucccucugggacagucaccg

SEQ ID NO: 255972 - RNA, 64 nt, Human
augucucacgcaacuugguccaccaaacgccuguccccuguaacuccuaggggugcgccuagac

SEQ ID NO: 255973 - RNA, 64 nt, Human
ggccggucacagccucagugugacuccacaguggccccuguagccgggcaagcaggagcagguc

SEQ ID NO: 255974 - RNA, 64 nt, Human
ugaaauuuucuagacuuucuguugguguauccccccccuguauaguuaggauagcauuuuugau

SEQ ID NO: 255975 - RNA, 64 nt, Human
uguauggagccucuugccuuccccuggggaggcaccccuguaccccagcuuccuuccccuggcc

SEQ ID NO: 255976 - RNA, 64 nt, Human
ggaagagggagggagcaaagagauugggguauguccccuguaguacacucuuaccucuuacuuc

SEQ ID NO: 255977 - RNA, 64 nt, Human
ccauccuaaaaaugugagugucaauuuccaaccuccccuguacuuaccuguuuucuccuccccc

SEQ ID NO: 255978 - RNA, 60 nt, Human
uuggccauacacuccaugccuagaugccucggagagcaucauucucugccuaggcaaggc

SEQ ID NO: 255979 - RNA, 60 nt, Human
augauguuugacaguagagcugugugagagggagagcagcuccccucgccccgccccugc

SEQ ID NO: 255980 - RNA, 60 nt, Human
cccaagagcaccauaacauagcuccgaaagggagagcagagauggcagcugaaacucacu

SEQ ID NO: 255981 - RNA, 64 nt, Human
uccuuuauugcucccguacgaaccccuccccuccccccuguaaacacagugcugcgagaucgcu

SEQ ID NO: 255982 - RNA, 64 nt, Human
ccgucucaguguugagccuuuucccucuuuggcuccccuguaccuuuugaggagccccagcuac

SEQ ID NO: 255983 - RNA, 64 nt, Human
ucaguccuccccaacaggguacuaggacugcagcccccuguagcuccucucugcuuaccccucc

SEQ ID NO: 255984 - RNA, 64 nt, Human
uuuccugcucccauacacccaaggcuuguuucuuccccuguaaaaaccacugccucaaucucug

SEQ ID NO: 255985 - RNA, 64 nt, Human
aggaagccaggcaccgauagagcacccagccccaccccuguaaauggaauuuaccagaugaagg

SEQ ID NO: 255986 - RNA, 64 nt, Human
caaagauauuccucaauagauuucaaacaccacuccccuguagaacucucccagccucguuggg

SEQ ID NO: 255987 - RNA, 64 nt, Human
aaaaauacaaaaauuagcugggcguggugguguaccccuguaaucccagcuacucgggaggcug

SEQ ID NO: 255988 - RNA, 64 nt, Human
cuggagccccauugccugcucauucguguuuuucccccuguaaauuauuuugcuuuugaccagg

SEQ ID NO: 255989 - RNA, 64 nt, Human
aauuuuacaaaaauuagcugcgugugguggcaggccccuguaaucccagcuaauugggaggcug

SEQ ID NO: 255990 - RNA, 64 nt, Human
aaguggaggcagguccagcagccccucuucagagccccuguaaaugcuaucgcagccugagucc

SEQ ID NO: 255991 - RNA, 64 nt, Human
aucucauuauuucugggccgggcaugguggcucaccccuguaaucccagcacuuugggaggcca

SEQ ID NO: 255992 - RNA, 64 nt, Human
gaaagcuuggcccaaauugauuuucuucuuuuucccccuguaggacugacuguuggcuaauuuu

SEQ ID NO: 255993 - RNA, 64 nt, Human
uuuuuuaauagauauggccgagcgugauggcucaccccuguaaucccagcacuuugugaggcca

SEQ ID NO: 255994 - RNA, 64 nt, Human
gcuagccgugguccuuuuggcuaugguugcgguuccccuguaaagcaaauguacuuaagucauc

SEQ ID NO: 255995 - RNA, 64 nt, Human
uuagcugggcccaucugcugggccuccucugccuccccuguaaaaugggaccuccgaaccaacc

SEQ ID NO: 255996 - RNA, 60 nt, Human
cuguacacagaaacuacaggcucugucucaggagagcauaggcacauuuuaaaagguuau

SEQ ID NO: 255997 - RNA, 60 nt, Human
cucaacucugccccaccccagccucuuccaggagagcacccuuacuuggcccggcuucca

SEQ ID NO: 255998 - RNA, 60 nt, Human
aucugugacccagagggcaaugaaagccaaggagagcagaggggucucuaacuuaaagcc

SEQ ID NO: 255999 - RNA, 64 nt, Human
uaaaauauuacuuuuggccgagcaugguggcucaccccuguaauuccagcacuuugggaggcug

SEQ ID NO: 256000 - RNA, 64 nt, Human
ccuguuuuggaagaaagcuuggggccauuucagcccccuguauucucaugauuuucucucagga

SEQ ID NO: 256001 - RNA, 64 nt, Human
cucggacccucugcugccccgggggcagcguguuccccuguaccuguccaaggccccccagcag

SEQ ID NO: 256002 - RNA, 64 nt, Human
caauccauuaaagcagccaggaaggacaggcuuuccccuguauaucauaggaaacucagggaca

SEQ ID NO: 256003 - RNA, 64 nt, Human
accccagguucagugcggccccucggcuguuccuccccuguaggguuuggacagacccaccccc

SEQ ID NO: 256004 - RNA, 64 nt, Human
cuggacaaguucuuccauauugaugguggagcaaccccuguaaucuacuccuuggaaggauuuu

SEQ ID NO: 256005 - RNA, 64 nt, Human
uaaauccccucuccuggccgggcgcgguagcucuccccuguaaucucagcauuuugggaggcag

SEQ ID NO: 256006 - RNA, 64 nt, Human
ugugagccaccgcugccagcacagagcguccuucccccuguagacuagugccguagggaguacc

SEQ ID NO: 256007 - RNA, 64 nt, Human
ggaggagacauacaaugggggaagaagaagaaguccccuguaagaugucacugucuggguucca

SEQ ID NO: 256008 - RNA, 64 nt, Human
ugguuacauuugggaacuuguguagggaucauggccccuguagccaggguuaaaaacuggacuu

SEQ ID NO: 256009 - RNA, 64 nt, Human
ugggaaugaggagucgugacgugcuccuucagugccccuguacugcccugccaucucaggccaa

SEQ ID NO: 256010 - RNA, 64 nt, Human
ucucuuuagggagacacagauggcugggaucccuccccuguacccuucucacugccaggagaac

SEQ ID NO: 256011 - RNA, 64 nt, Human
aauaagggcaggugguucagcgagccacggcagcccccuguaucuggauuguaaugugaaucuu

SEQ ID NO: 256012 - RNA, 64 nt, Human
aaaggucucacagcaaaggagcaggacucccaggccccuguacccugccuggccugauucaggg

SEQ ID NO: 256013 - RNA, 64 nt, Human
uucuuccccaagcccagagaagagcagcccugagccccuguauucugcuggccagacacacaug

SEQ ID NO: 256014 - RNA, 60 nt, Human
aagcaggaggaucacuggaggccaagaguuggagagcagacugggcaacauagcgagacc

SEQ ID NO: 256015 - RNA, 60 nt, Human
gcugcugagucgcucucaugaagcccuuagggagagcaccuguugugugccugacaccac

SEQ ID NO: 256016 - RNA, 60 nt, Human
ccccgagccgccugccgacugccugcacagggagagcaguugaggcccgggcagggcccc

SEQ ID NO: 256017 - RNA, 64 nt, Human
ccgggagccagauucuaucauaugcauguguaauccccuguaauacacucaggugcucacaaau

SEQ ID NO: 256018 - RNA, 64 nt, Human
accacucuguccauccagccaauggaugucccuuccccuguaccccaauuucaagcuuauuuua

SEQ ID NO: 256019 - RNA, 64 nt, Human
uguaacauuuuguauauuccagggguagggccgcccccuguaucauaccuagcagagguuggag

SEQ ID NO: 256020 - RNA, 64 nt, Human
aagcgcugcaugcucucagaggagcgugccguuuccccuguagauggauacuuuuguuuuguug

SEQ ID NO: 256021 - RNA, 64 nt, Human
gagguucaggaccaaggggcuucugguccuccagccccuguacucggccaugcccuguggucac

SEQ ID NO: 256022 - RNA, 64 nt, Human
ccuccacccaccccucucccaaccucucuccccgccccuguauccugcauuccuccacccaccc

SEQ ID NO: 256023 - RNA, 64 nt, Human
acucccaccccucccacaaccccuguaccucccaccccuguauccccaccccuccacccacccc

SEQ ID NO: 256024 - RNA, 64 nt, Human
guauccccaccccguacucccaccccucccacaaccccuguaccucccaccccuguauccccac

SEQ ID NO: 256025 - RNA, 64 nt, Human
gccgacgggggcagcugccccaucccucccccaaccccuguauccccaccccguacucccaccc

SEQ ID NO: 256026 - RNA, 64 nt, Human
uggcuugccagcugccaagauggagaagcaugugccccuguagagcgucuccccagaaccagac

SEQ ID NO: 256027 - RNA, 64 nt, Human
gcggacugaggaagcgauggccccagagaaagggccccuguagccuggcucucacacaguauuu

SEQ ID NO: 256028 - RNA, 64 nt, Human
ugacuauaacucugaccacacagaaccagggcugccccuguaauccccacaguaagaaaguugu

SEQ ID NO: 256029 - RNA, 64 nt, Human
aucaauauuuguaggccaggcgugguggcucaccccccuguauucucagcacuuugggaggccg

SEQ ID NO: 256030 - RNA, 64 nt, Human
guguacauuuuuuuguaaaaaguuuagaggcuuaccccuguaagaacagauauaaguauucuau

SEQ ID NO: 256031 - RNA, 64 nt, Human
agcauggggacaggugagguggggcugggcagacccccuguagcguuuagcaggaugggggccc

SEQ ID NO: 256032 - RNA, 60 nt, Human
ccacaaccagccaggcagguccacagagagggagagcagagaaagaaguccuuucucuuu

SEQ ID NO: 256033 - RNA, 60 nt, Human
gugggaagccaggagugagaaggaauucagggagagcaaaggagccagugcugagaugcu

SEQ ID NO: 256034 - RNA, 60 nt, Human
uugggaggagaaggcagggugagggaucugggagagcaggacguugagauauccugaccc

SEQ ID NO: 256035 - RNA, 64 nt, Human
uaggcuaagcuauuugggaaaguucuccccaccgccccuguacgcgucauccuagccccccuua

SEQ ID NO: 256036 - RNA, 64 nt, Human
uuuggugcucagccuccccaaggacaagcuccucccccuguaauaccuccuccuaaccaagccg

SEQ ID NO: 256037 - RNA, 64 nt, Human
ggaggccucuuugccccgacuccgcuuccccugcccccuguacauuugugcuccauuuuuucuu

SEQ ID NO: 256038 - RNA, 64 nt, Human
cugaccucggccgggccacucuggcuucucugugccccuguaaauaguuuuaaauaugaacaaa

SEQ ID NO: 256039 - RNA, 64 nt, Human
cccugccugguagccagacuagcccacuaaagcuccccuguaaaugggggcuccauuaguucug

SEQ ID NO: 256040 - RNA, 64 nt, Human
gcgagcuccuuggguccugcaaucuccagggcugccccuguagguugcuuaaaagggacaguau

SEQ ID NO: 256041 - RNA, 64 nt, Human
ugagaaggcugugcccauguggggccgcaggaauccccuguauguucagggcugugagcugcca

SEQ ID NO: 256042 - RNA, 64 nt, Human
ugaagugaucguagucaugccucagaagcaguccccccuguaaauaguccuuggauauuaccgu

SEQ ID NO: 256043 - RNA, 64 nt, Human
cccugcauggggggagccugggccuaauaggcacccccuguaccucaggcuguggcgggagcag

SEQ ID NO: 256044 - RNA, 64 nt, Human
ugagaugggauuucacauuuuccucucaucaacuccccuguaauagcuagcgucuuucuaguga

SEQ ID NO: 256045 - RNA, 64 nt, Human
uaucuccugcccaagcauauaucgucucuuuacuccccuguauaaugaguaagaagcuucuuca

SEQ ID NO: 256046 - RNA, 64 nt, Human
uuuuuuucuggaggcuggcaccugauuuuguaucccccuguagcagcauuacagaaauacauag

SEQ ID NO: 256047 - RNA, 64 nt, Human
ugucuucuguccccaucuuccugccgauagcuauccccuguaugauguuggaugcuccucacau

SEQ ID NO: 256048 - RNA, 64 nt, Human
ucgucccuacuuccuccucccugcuuccucuccuccccuguacgugccccagcauucugggguu

SEQ ID NO: 256049 - RNA, 64 nt, Human
ugguuguaguucauaaacacagagcuguuuguguccccuguaucuggaaugccauuaugaccca

SEQ ID NO: 256050 - RNA, 60 nt, Human
aaaaggagaggacgacgcugucggaggcagggagagcaaauuaccacagcuucuuggccc

SEQ ID NO: 256051 - RNA, 60 nt, Human
caggguauagcuuagaugguggaaagcaaaggagagcaggaaguuguaaaucacuggcua

SEQ ID NO: 256052 - RNA, 60 nt, Human
ucaagcugcuaggaacuuacgguuuuauuaggagagcaguacaaggguaucuaucccagu

SEQ ID NO: 256053 - RNA, 64 nt, Human
cacaucaccacccauugucaggugcucucccucaccccuguaagccagacaguuuguucaaaac

SEQ ID NO: 256054 - RNA, 64 nt, Human
caaagauucugaccuuaaaugcaaccauuugaaaccccuguaggccucaggugaaacuccagau

SEQ ID NO: 256055 - RNA, 64 nt, Human
aguuuuuuuuuucuugucuauaaagcauuuaaccccccuguacacaacucacuccuuuuaaaga

SEQ ID NO: 256056 - RNA, 64 nt, Human
ggauuuuugcugcuuuuggggugcauggggaucuccccuguaaacuuuccuuugcccaauuaua

SEQ ID NO: 256057 - RNA, 64 nt, Human
agaaguuaaauaacuugccgggugcgguggcucaccccuguaaucccagcacuuugggaggcca

SEQ ID NO: 256058 - RNA, 64 nt, Human
uuuccuaagaaaucagcaaagagggaaggcagggccccuguagauucaccaguauaaacuucag

SEQ ID NO: 256059 - RNA, 64 nt, Human
gaaggaucgaauacuugaugguaaaggccaagucccccuguauugggaagugugugauuucggc

SEQ ID NO: 256060 - RNA, 64 nt, Human
acaguggccuugaguuccaagggcagcucuggugccccuguauauguggaucucgccuacaucc

SEQ ID NO: 256061 - RNA, 64 nt, Human
uaaguucugaagcugauuugguuauggggucuuuccccuguauacuaccaguugugucuuuaga

SEQ ID NO: 256062 - RNA, 64 nt, Human
gccagugcacccccacucccacccucaaccgcggccccuguaggccaaggcgccaggcaggacg

SEQ ID NO: 256063 - RNA, 64 nt, Human
aagguaggacucaaccaacugaaaccugacuuucccccuguaccuucagccccugugcagguag

SEQ ID NO: 256064 - RNA, 64 nt, Human
gguccuugauuugguuuuuucauuguuuccuuggccccuguauccagauauuggacuuacugcu

SEQ ID NO: 256065 - RNA, 64 nt, Human
aggcccauuacuguaucgggaauuucuaguguuuccccuguaauaaacagauauuucaaguuac

SEQ ID NO: 256066 - RNA, 64 nt, Human
uaacuuacuguauagaaaguuuaacuuuuccucaccccuguauagaaaaugccuugccucucaa

SEQ ID NO: 256067 - RNA, 64 nt, Human
uuguuucucauuucuuuuuucuucuucuuuaacuccccuguaauaggaaauaaaguauuuuugu

SEQ ID NO: 256068 - RNA, 60 nt, Human
ccacagauguugggggcuggagaaggggcaggagagcaucacacucagccccagccuccu

SEQ ID NO: 256069 - RNA, 60 nt, Human
auauuuguaaauuuaugugauggcaaagaaggagagcauaggaaaccacacagacuuggg

SEQ ID NO: 256070 - RNA, 60 nt, Human
augcgagagcugccugauggccucuugucaggagagcaguggcacgggggcgugaggaag

SEQ ID NO: 256071 - RNA, 64 nt, Human
ucauguuauucagaauuguuuuggugauaccucaccccuguaaucccagcacuuugggugggug

SEQ ID NO: 256072 - RNA, 64 nt, Human
cgggggccauggggccuccugagguacaccuuugccccuguaagggccucuaggcccugggccu

SEQ ID NO: 256073 - RNA, 64 nt, Human
agggaagcagcagcgggccaggugugguggcuuaccccuguaaucccagcacuuugggaggcca

SEQ ID NO: 256074 - RNA, 64 nt, Human
uucggugacauucuucuaccuaguaggagucaugccccuguagugcccaaccuagccagguagc

SEQ ID NO: 256075 - RNA, 64 nt, Human
uucagacuuuguucugcggugcccacaggacuuaccccuguauguacaggauuuuuguaugaaa

SEQ ID NO: 256076 - RNA, 64 nt, Human
acuccucccgauaaacaggccacugaagcucucgccccuguaacuuauaccccacccagcucag

SEQ ID NO: 256077 - RNA, 64 nt, Human
gucucaaccaccaccaccaccaccaccccuacuaccccuguauucaagguaaaaauugaaguuu

SEQ ID NO: 256078 - RNA, 64 nt, Human
cuugucugaccuuaaugcaagcagucuguuugaaccccuguaggcugcauucaggagacagaag

SEQ ID NO: 256079 - RNA, 64 nt, Human
uagcauuaguagcuucuguggggggaucccagagccccuguauuuauuuucccuguguuugucu

SEQ ID NO: 256080 - RNA, 64 nt, Human
gagggacagcagauuccacaggacacgaaggcugccccuguaagguuucaaugcauacaauaaa

SEQ ID NO: 256081 - RNA, 64 nt, Human
guuuaaaauggaaaaagggguucucuguguucugccccuguaauucuaggucuggaaccuuuau

SEQ ID NO: 256082 - RNA, 64 nt, Human
ccuccacagccuaagggguguccuaaagugccucccccuguauucccccucccagggcagcccc

SEQ ID NO: 256083 - RNA, 64 nt, Human
ucagagaaaucacugaaccucucaggaucaaugaccccuguaaggggccagagccuuggaggac

SEQ ID NO: 256084 - RNA, 64 nt, Human
uuucacaggaaccgucaugcuuguuccucccucuccccuguaaccucacuucuuauugauuccu

SEQ ID NO: 256085 - RNA, 64 nt, Human
gggaagaacagagccagggaaagaaugguggggaccccuguacuugggggagacacaccugcau

SEQ ID NO: 256086 - RNA, 60 nt, Human
cuuugcuguacuucuugaaauguuucuaggggagagcauuggaaaauccccuucccccau

SEQ ID NO: 256087 - RNA, 60 nt, Human
uugucuugcuucauuaaaauguaaggcuaaggagagcauggaauuugucaguuuuguuca

SEQ ID NO: 256088 - RNA, 60 nt, Human
ggcaugugagcguaaauagaggugaccagaggagagcaugagggguggggcuuugggacc

SEQ ID NO: 256089 - RNA, 64 nt, Human
gugacagagggggugggacaggggcgggggguucccccuguacauacccugccauaccaacccc

SEQ ID NO: 256090 - RNA, 64 nt, Human
aaaucccccaccccuggcugggcucaguggcucaccccuguaaucccagcacuuugggaggcca

SEQ ID NO: 256091 - RNA, 64 nt, Human
aaaguguuugccccacuucccaccccgucuccagccccuguacuuuggcuugaccucguggaaa

SEQ ID NO: 256092 - RNA, 64 nt, Human
ccccuuuccaaaauucccucuucugccaguacucccccuguaccacccauugcugauggcacac

SEQ ID NO: 256093 - RNA, 64 nt, Human
cugugcuucucccugaugacguuuuauuuuuuuuccccuguaagcaaccgagguagaaaaauaa

SEQ ID NO: 256094 - RNA, 64 nt, Human
aaauuagcugggcaugguggcacacaccuguaguccccuguagucccagcuacucgggaggcug

SEQ ID NO: 256095 - RNA, 64 nt, Human
guguccaucccuguucccccaggggcucuaucagccccuguaccccacacugcccucugaagac

SEQ ID NO: 256096 - RNA, 64 nt, Human
aaaaauaggaaaaucagccaggcgugguggcagaccccuguaaucccagcuacucaagaggcug

SEQ ID NO: 256097 - RNA, 64 nt, Human
gagaacaagugcccuuggggacagccggcaggcgccccuguacgucugcucaugcaccaggcag

SEQ ID NO: 256098 - RNA, 64 nt, Human
caacuccagagaggcugugggaaucuucagaaccccccuguaagagacagacaugagagacaag

SEQ ID NO: 256099 - RNA, 64 nt, Human
uggauccguguguguguguguccgugugugugucccccuguaaauagccagcuguuauuuauac

SEQ ID NO: 256100 - RNA, 64 nt, Human
ggguguccccugcugagaaauggagagcucuuuuccccuguacuucucugggguuugccuugug

SEQ ID NO: 256101 - RNA, 64 nt, Human
accugcugcgagggccccucccagaggagccccgccccuguaagauuuccuuccugguuuucug

SEQ ID NO: 256102 - RNA, 64 nt, Human
ggagggaggauccuguuucccaccuccuucuccuccccuguacuccccagugccuuccuuguuc

SEQ ID NO: 256103 - RNA, 64 nt, Human
ucgugcuccauccuucccugccggggccugcuggccccuguaaggucccgcccccaaagacccu

SEQ ID NO: 256104 - RNA, 60 nt, Human
guccacacagcaaaaaugcaucugagaauuggagagcaguaaaagacugaagauaauguu

SEQ ID NO: 256105 - RNA, 60 nt, Human
guguguguauacacgagcauguauguauuuggagagcauccaucuucugacauacaacug

SEQ ID NO: 256106 - RNA, 60 nt, Human
caaaucauaacuuccugcaaaucaacgccaggagagcaacuuaccuucauuucuuugucu

SEQ ID NO: 256107 - RNA, 64 nt, Human
ggcgaccauugaguccuagucucccuuguuugugccccuguaggagguagguccuuuucuccuc

SEQ ID NO: 256108 - RNA, 64 nt, Human
cuccccaaguacuuaaauguucucaucugucgcaccccuguauuugccucaccccugcaugguc

SEQ ID NO: 256109 - RNA, 64 nt, Human
agccgacccccucucccugcauggcauccuccagccccuguagaacucaaccucuacaggguua

SEQ ID NO: 256110 - RNA, 64 nt, Human
accccaccccacagcagggcuccuggcccccaccccccuguacauaauuuuuaaaaccuuuuuu

SEQ ID NO: 256111 - RNA, 64 nt, Human
ccaaagacaggguugugccuuaccccaggagccaccccuguaccccccuugcccugccauucac

SEQ ID NO: 256112 - RNA, 64 nt, Human
gauauugauucucccaauucaugaauauaguauaccccuguauuuauuuguuuucuugaauuuc

SEQ ID NO: 256113 - RNA, 64 nt, Human
uacagauuacggggggaccgggugagccagugacccccuguagcccccagcuucaggccucagu

SEQ ID NO: 256114 - RNA, 64 nt, Human
gcucccucgcccccagccccggggccugagccguccccuguaagaugcgggaagugucagcucc

SEQ ID NO: 256115 - RNA, 64 nt, Human
accaggcccugcacacacccacuccguaaccucuccccuguaccugugccaagccuagcacuug

SEQ ID NO: 256116 - RNA, 64 nt, Human
ugaggggcugcaggggcagucucccuccuccaagccccuguacauaaccuggagcgugugaccu

SEQ ID NO: 256117 - RNA, 64 nt, Human
cuccuuccugaccacuuccugccuuuauucucugccccuguaucacucuccaggggacucuuga

SEQ ID NO: 256118 - RNA, 64 nt, Human
cgauccccacccuucagccacuagaucccagaucccccuguaaccauaacuguggaucccuuac

SEQ ID NO: 256119 - RNA, 64 nt, Human
aaaaaauagaaaaaguagcagguguggugguaugccccuguagucccagcuacuugggaggcug

SEQ ID NO: 256120 - RNA, 64 nt, Human
aagucucucacccucaucacuaggagauuccuuuccccuguagggguagagggguggggacaga

SEQ ID NO: 256121 - RNA, 64 nt, Human
uaagagaaccuccaagucagggcgcaguggcucaccccuguaaucucagcacuuuggguggcca

SEQ ID NO: 256122 - RNA, 60 nt, Human
augaguccaggcaguccuagcaaguacucaggagagcaggggugggugugacagaggcug

SEQ ID NO: 256123 - RNA, 60 nt, Human
cuacccauugccaagagaggaugcaucuggggagagcaaagcacuaaggaauucagcauc

SEQ ID NO: 256124 - RNA, 60 nt, Human
ugcggcugccagccucgggccaucagccuaggagagcagaugcagcuccaggggcucgac

SEQ ID NO: 256125 - RNA, 64 nt, Human
auuuuucuugcuaucagaguagcaagaaacagcaccccuguaggugacaggugggcagccuggu

SEQ ID NO: 256126 - RNA, 64 nt, Human
cugacguauucacugugccucugggccacuucuuccccuguagaugugggcuuguugccuucag

SEQ ID NO: 256127 - RNA, 64 nt, Human
uuuugaccuugugguucuaaaauuccuugucugaccccuguagaucuuuuccuugccaugucac

SEQ ID NO: 256128 - RNA, 64 nt, Human
uuguaacuaaguuauuuacuccuccugcuccucaccccuguagggaaaccuuggagaggagagu

SEQ ID NO: 256129 - RNA, 64 nt, Human
ccugugccuaucaccucuuaugcacaccucccacccccuguauucccaccccuggacugguggc

SEQ ID NO: 256130 - RNA, 64 nt, Human
caggccauucgcaccagccaccacccacucccacccccuguagugcucccaccccuggacuggu

SEQ ID NO: 256131 - RNA, 64 nt, Human
aaggccugucacacugaccaccuccuacucccacccccuguagugcucccaccccuggacuggu

SEQ ID NO: 256132 - RNA, 64 nt, Human
uugagcaguuuguuuugcugccaaccugucuccaccccuguauuucaagaucauugauaagccc

SEQ ID NO: 256133 - RNA, 64 nt, Human
agugacuguguguccugcagaggcgugacccaggccccuguagcccucagccuccucuagaagc

SEQ ID NO: 256134 - RNA, 64 nt, Human
cagggugcaugcccaucuccagcccagggcagcuccccuguaagcugggugagcuacugaagcc

SEQ ID NO: 256135 - RNA, 64 nt, Human
cuggaggcugugguguguucucuccuucugccucccccuguaaccugugugaacccagcaccca

SEQ ID NO: 256136 - RNA, 64 nt, Human
cagggggcuccuccagggcugaacuuugggagggccccuguacuaccuccugggccaagaaacu

SEQ ID NO: 256137 - RNA, 64 nt, Human
cagaccgagguggccauggagacuccaccuggauccccuguaggaggccagggaggggaacuca

SEQ ID NO: 256138 - RNA, 64 nt, Human
gccucuugagaacggcggucuuuuaugcuaccuaccccuguacaaguuaugcgaaggaaaccaa

SEQ ID NO: 256139 - RNA, 56 nt, Human
cgucggcugcugaugucuagaugaguccccuguagggucagagacaaugucaaacu

SEQ ID NO: 256140 - RNA, 60 nt, Human
uaaucccucuggacuggaugguucuucauaggagagcaacuguaggugaucauuauccug

SEQ ID NO: 256141 - RNA, 60 nt, Human
aauaccaaccaucgugggcuccagcuuaaaggagagcagagguaugggggacagaagugg

SEQ ID NO: 256142 - RNA, 60 nt, Human
agggggcagcagcaggcugggaguuaggagggagagcagggugccggcccugccaccaag

SEQ ID NO: 256143 - RNA, 64 nt, Human
ugcaugauuuuguuuucaucccauuucccccaagccccuguaaaucagggaaaaugcgcaacug

SEQ ID NO: 256144 - RNA, 64 nt, Human
uuuccuguucagcauguacuccccucauccgauuccccuguaucagucacugacaguuaauaaa

SEQ ID NO: 256145 - RNA, 64 nt, Human
uuuccuggucagcauguacuccccucauccgauuccccuguagcagucacugacaguuaauaaa

SEQ ID NO: 256146 - RNA, 64 nt, Human
ccuguuccaggaagcucauccucaccuguguaggccccuguagugacccacgcguccagcagac

SEQ ID NO: 256147 - RNA, 64 nt, Human
uuuccuggucagcauguacuccccucauccgauuccccuguagcagucacugacaguaaauaaa

SEQ ID NO: 256148 - RNA, 64 nt, Human
auccugggggaagaggagaugugaucaggccccaccccuguaaucaggcaaggaggaggaguca

SEQ ID NO: 256149 - RNA, 64 nt, Human
ccgccacccccugcaccagcccacauccccacugccccuguacaguccugccccccagcacccu

SEQ ID NO: 256150 - RNA, 64 nt, Human
auaauuuuucccuaaugauaccacuuuucuuuucccccuguaccuaugggacuuccagaaagaa

SEQ ID NO: 256151 - RNA, 64 nt, Human
augucuuugauguuuucaguuguuugauauaucuccccuguagggcauguugaggaaggaggag

SEQ ID NO: 256152 - RNA, 64 nt, Human
cagcugcuucaaaauuaggaaauacuacaggacaccccuguaauggauugguggcaacugggug

SEQ ID NO: 256153 - RNA, 64 nt, Human
uauaggccuucugacuccuaguucaguauucuuaccccuguaccacauugagucaugggacuuu

SEQ ID NO: 256154 - RNA, 64 nt, Human
ccgggaccgcacugacaggaaaccuuccgucgugagggagcacuucccaggggccgcagggacg

SEQ ID NO: 256155 - RNA, 64 nt, Human
cgugccugaauaagaaggccucuuagggagccagagggagcagaguggucguguccugcgugcu

SEQ ID NO: 256156 - RNA, 64 nt, Human
cgaggggacacaggauggaaaccccaggaugagaagggagcagggagaguuccagaaaggggga

SEQ ID NO: 256157 - RNA, 60 nt, Human
gaccagcaaccaaguaaaaucaguaauugaggagagcagggcacaaaggggcugcaguuu

SEQ ID NO: 256158 - RNA, 60 nt, Human
uggaucagugaccauuugcuggcagacaggggagagcagcuuccagccugggucagaagg

SEQ ID NO: 256159 - RNA, 60 nt, Human
uuuggugcuagggguuugggacugaggcguggagagcagaugugauggcaggaagacucu

SEQ ID NO: 256160 - RNA, 64 nt, Human
ggaaacuaaaaccuaggucuuagguacauccuaaagggagcacagaacccaucauuucacacau

SEQ ID NO: 256161 - RNA, 64 nt, Human
ggugcuagcuugacacagucagcaugcuucccagagggagcaggccggaaccacagggccagag

SEQ ID NO: 256162 - RNA, 64 nt, Human
cugugcucuugaccugcuccgcccccuucccuggagggagcacccucuggacagacagaaccau

SEQ ID NO: 256163 - RNA, 64 nt, Human
caggucagcguggccugauugucccaggaccugaagggagcaaggauggccucagggccuggug

SEQ ID NO: 256164 - RNA, 64 nt, Human
guccagucauucaccagcauuugcaaauguccauagggagcagguggcagccucuacucccagc

SEQ ID NO: 256165 - RNA, 64 nt, Human
gcaugugagguguuugagggcauauguuugaaagagggagcaucaccacaggaauccuuucugu

SEQ ID NO: 256166 - RNA, 64 nt, Human
ggguuuuauauuuuuauagacaaauaauaagcaaagggagcacuggguugacuuucagguacua

SEQ ID NO: 256167 - RNA, 64 nt, Human
guccucuguccagauuggggugggagcaagggacagggagcagggcaggggcugaaaggggcac

SEQ ID NO: 256168 - RNA, 64 nt, Human
acccagggcucuaaccuuguaugcgggcaggcccagggagcaggcagcaguguucuuccccuca

SEQ ID NO: 256169 - RNA, 64 nt, Human
gagcagauugcuuaugccaugcagaugucccugcagggagcagaguuuggccaggcggaaucag

SEQ ID NO: 256170 - RNA, 64 nt, Human
cagcuguaggcccuuccaccagcuggggagcuagagggagcaggcccaagggcagagcagaggc

SEQ ID NO: 256171 - RNA, 64 nt, Human
gagacguuuggcuagcaccccaggaagaugugagagggagcaagcaagguuagcaacugugaac

SEQ ID NO: 256172 - RNA, 64 nt, Human
uuuaaaauaaagugccgucauguagcccuguggaagggagcacauaaccagcuguuuggcauga

SEQ ID NO: 256173 - RNA, 64 nt, Human
ucccuuuagaaacucucucccugcuguauauuaaagggagcagguggagagucauuuuccuucg

SEQ ID NO: 256174 - RNA, 64 nt, Human
ccaaacugccucaauccuagguaacgagggcaacagggagcaccugucuggauuguuuuuaaac

SEQ ID NO: 256175 - RNA, 64 nt, Human
cacuggcccguggggucugaguucagggguguggagggagcagacuccaccggcccaggcccag

SEQ ID NO: 256176 - RNA, 60 nt, Human
gucuuugguuaccccccagccccaguaggaggagagcaggcagagcuugucauccccagc

SEQ ID NO: 256177 - RNA, 60 nt, Human
caucagucuucuggagcccuccuuggagcuggagagcaccucagagaccagugacaugcc

SEQ ID NO: 256178 - RNA, 60 nt, Human
auuuaaacuguucugugugggucuggggagggagagcaccuuaauauuauugggguuggu

SEQ ID NO: 256179 - RNA, 64 nt, Human
cggacacaaaguccauccaggacccaggccgcagagggagcaggaagagaugcugauaguuuga

SEQ ID NO: 256180 - RNA, 64 nt, Human
auaaaaaguuauauauaauuaucccuuuaauuaaagggagcaaaggggcguuccacauggacag

SEQ ID NO: 256181 - RNA, 64 nt, Human
ggggaaacggagccagcgugucacauggugagagagggagcaagagacagacaggggaggaaau

SEQ ID NO: 256182 - RNA, 64 nt, Human
accuguuuuauaguucuaugugauguaaaggucuagggagcaauaaccagcccuuuuuuuucug

SEQ ID NO: 256183 - RNA, 64 nt, Human
uuugucuguugccgucagccgaacuuuguuauggagggagcagccucacacaagcagaaacacu

SEQ ID NO: 256184 - RNA, 64 nt, Human
uacagggcaauauuuuuaacuuggggcaggaagaagggagcagcagagaauugacuagauauag

SEQ ID NO: 256185 - RNA, 64 nt, Human
auugggcaccgcugacuccagcauggaggacaccagggagcagggccugggccuguuuccccag

SEQ ID NO: 256186 - RNA, 64 nt, Human
guuucacccggcaggaugacacagaccacuucccagggagcacgggcaugccuuggaauauugc

SEQ ID NO: 256187 - RNA, 64 nt, Human
ugcuuugugucucccucugucuagcuuccagggcagggagcaggccccaccuagggcugcaggc

SEQ ID NO: 256188 - RNA, 64 nt, Human
guucaguugauccaacacuuuccuuuaaaaguugagggagcagaggcccaugggauuaaauggc

SEQ ID NO: 256189 - RNA, 64 nt, Human
ccauggagcagucucuuccauggaguaagaaggaagggagcauguacgcuugguccaagauugg

SEQ ID NO: 256190 - RNA, 64 nt, Human
guguguuuugugcaccuccacuuuagguaaucauagggagcacauuuacaggauggucuaauaa

SEQ ID NO: 256191 - RNA, 64 nt, Human
gguugcagcaaaguuuuaaguuuaccuugugucaagggagcaaugcuugguuuggggagugugu

SEQ ID NO: 256192 - RNA, 64 nt, Human
agaggggcaguuagagggagaacaggggugggaaagggagcaaggggcagauagcucagcaagg

SEQ ID NO: 256193 - RNA, 64 nt, Human
ggguuggcuuggggugaaaaguucugcccuccgcagggagcagcuccagcugccuggcagugcu

SEQ ID NO: 256194 - RNA, 64 nt, Human
gucagggagagaaacccaaccccacugucaacauagggagcaucaccaacuccagacuggcucc

SEQ ID NO: 256195 - RNA, 60 nt, Human
cccacacagugggggccagccucgcuggagggagagcaacccuuugccgaugaccacgcu

SEQ ID NO: 256196 - RNA, 60 nt, Human
cugagguccccgcugccagucccgggcccuggagagcagaugcugucuuguuauguacag

SEQ ID NO: 256197 - RNA, 60 nt, Human
ccugcuacuucuuguagauauuucauuucaggagagcagcaguuaaacccguggauuuug

SEQ ID NO: 256198 - RNA, 60 nt, Human
cucacucaucuucuuucucuuucugaagcuggagagcagaagcccccaucuuugaaaagc

SEQ ID NO: 256199 - RNA, 64 nt, Human
caccccggggcugacauuucuaagcaagauaggaagggagcacuuucuaggcuaggaguugggu

SEQ ID NO: 256200 - RNA, 64 nt, Human
aaaugugggcuuuugugaagaccacuuucaaacaagggagcacugaaaccugaauuggauacug

SEQ ID NO: 256201 - RNA, 64 nt, Human
cccuuuucucucguggaagauaaaaccuggacucagggagcaaccacaggcucuccacuuugaa

SEQ ID NO: 256202 - RNA, 64 nt, Human
gguguuucugcacauaccucugcaguaccucaccagggagcauuccaguaucaugcaggguccu

SEQ ID NO: 256203 - RNA, 64 nt, Human
aauuucuaauggaaguuuguugugaauguaaaggagggagcauucuuugcuuuuuaauauacaa

SEQ ID NO: 256204 - RNA, 64 nt, Human
agaugcccagggagacccaagaaagagucagguuagggagcagugaaagugaggagggaagaca

SEQ ID NO: 256205 - RNA, 64 nt, Human
ucuugagaaauuccuaaccagccuccugugacccagggagcagggucgcuaagguccugcccac

SEQ ID NO: 256206 - RNA, 64 nt, Human
ccaaaaccuuucaaaggauaugcagaaagaugguagggagcauuuggguuugaaucugaaugcu

SEQ ID NO: 256207 - RNA, 64 nt, Human
cuuggcccucuccacagggaacucuagaauaucaagggagcaagaggaagccaagaaaacuugg

SEQ ID NO: 256208 - RNA, 64 nt, Human
gguugcccaccaguugcgaaagcccccuuuccucagggagcacgcgggaccucgguggagaucu

SEQ ID NO: 256209 - RNA, 64 nt, Human
cucauuccauaaaugucggugcauaccuuauguaagggagcaguucaauaauccaugaaagaac

SEQ ID NO: 256210 - RNA, 64 nt, Human
gcagcggggcccuucuucccuccgcauccccuucagggagcaggagcccagggcgcccugggag

SEQ ID NO: 256211 - RNA, 64 nt, Human
ugccccucagacuggggaagaguccaaggaagggagggagcagccacuccucaaugcucaaugg

SEQ ID NO: 256212 - RNA, 64 nt, Human
aucucacaaugcgucguagaugucgcguguuggaagggagcaggaggaaggacugauacuggca

SEQ ID NO: 256213 - RNA, 64 nt, Human
gccgagguaaaagagacaucugcagugugacagaagggagcaugagaagcauggcucaccagcc

SEQ ID NO: 256214 - RNA, 64 nt, Human
cagggggcccggccuccgcugccgcgacacugcgagggagcagccagccaagagccgggcguua

SEQ ID NO: 256215 - RNA, 60 nt, Human
uuggguggggagcagggacgggcggagggaggagagcagguuucagauccuuacuugccg

SEQ ID NO: 256216 - RNA, 60 nt, Human
guuauuauuaacaaucuuggguggguaguaggagagcaaaaaguaugaaugggauggagc

SEQ ID NO: 256217 - RNA, 60 nt, Human
ccgcccccuccagccccaucucugucucaaggagagcaggguaggugaaagucuagagaa

SEQ ID NO: 256218 - RNA, 60 nt, Human
aagcagcugcauuugcucuuggaggcuuugggagagcaggaaugaaaacauucagaggaa

SEQ ID NO: 256219 - RNA, 64 nt, Human
uagacagaaggcacuaaaaaagaagaaugaauuaagggagcaauuuuuauuacuuccagagauc

SEQ ID NO: 256220 - RNA, 64 nt, Human
cuggagaaugagagacugcgcucucuuggggcugagggagcaccaugcagcuucaccccucaca

SEQ ID NO: 256221 - RNA, 64 nt, Human
gcugccuuugccgcugggcuuuccgggacuguggagggagcacaggcggggaagcuccacuuca

SEQ ID NO: 256222 - RNA, 64 nt, Human
cuugccaaucuguuuuuuaaaggaucaggcucguagggagcaggaucaugccagaaauagggau

SEQ ID NO: 256223 - RNA, 64 nt, Human
caauuuuuccuguaaacaauaccaauuuuuaauuagggagcauuuuccuucuagucuauuucag

SEQ ID NO: 256224 - RNA, 64 nt, Human
ugacuaggguccucaggcaguggcccagggaaucagggagcacuggaggccucugcaagauucu

SEQ ID NO: 256225 - RNA, 64 nt, Human
aggggcagggccguagacucacggcugcaccugcagggagcagcacgccaaccccagcaguccu

SEQ ID NO: 256226 - RNA, 64 nt, Human
ccacacuuggaggaaaguugcagguggguugggcagggagcaggcaugguucugcuuugcuguu

SEQ ID NO: 256227 - RNA, 64 nt, Human
acuacauuacuucaaacugagauccuuccuuuugagggagcaaguccuucccuuucauuuuuuc

SEQ ID NO: 256228 - RNA, 64 nt, Human
aggggaggagagugagggccaagaacgagccuuaagggagcagucccaagcuggagccacccag

SEQ ID NO: 256229 - RNA, 64 nt, Human
cuguuuuaaguuucagaguuguuaaggguuguuaagggagcaaaaaccguaaaaauccuuccua

SEQ ID NO: 256230 - RNA, 64 nt, Human
agagcaacgggaaggacaaagaaagagguggggcagggagcacaccccaggacccucacuuuuc

SEQ ID NO: 256231 - RNA, 50 nt, Human
cguccacgagguuaaucuaaagggagcauguuucacaguggcuggacuac

SEQ ID NO: 256232 - RNA, 64 nt, Human
uggaccuucuucucuucagaagauaauuuucaaaagggagcaaugcugugaaugcagcuugcuu

SEQ ID NO: 256233 - RNA, 64 nt, Human
cccgcguagccaggugggcccaagggugccuggcagggagcacuaccccuggaccccuccugcu

SEQ ID NO: 256234 - RNA, 64 nt, Human
uggggaggugcaguggcacccccagagccaacagagggagcaggcagagggugggggaccuggc

SEQ ID NO: 256235 - RNA, 60 nt, Human
uuuuuuuucuuucguuccuuuuuugaaacaggagagcaaagcaguuagaguucagaggcc

SEQ ID NO: 256236 - RNA, 60 nt, Human
ccuaacccccuaagcuccaggugcccugugggagagcaacuggacuauagcagggcuggg

SEQ ID NO: 256237 - RNA, 60 nt, Human
guuggggccagcacaccgggauggauggagggagagcagaggccuuugcuucucugccua

SEQ ID NO: 256238 - RNA, 60 nt, Human
gaauaaaccccugauguuagagaggccuggggagagcagccgauggggcucagacuacau

SEQ ID NO: 256239 - RNA, 64 nt, Human
uuccuggucuuggcagauggcucugggaacagcgagggagcacagaagucguggccugaggcug

SEQ ID NO: 256240 - RNA, 64 nt, Human
ggacagccuccgccaagaucuacaggacaaagggagggagcaagcccuacucggauggggcacg

SEQ ID NO: 256241 - RNA, 64 nt, Human
gguaugaagcugcgcuccuccaucggguuuggggagggagcacucugggacugugagacaagga

SEQ ID NO: 256242 - RNA, 64 nt, Human
gccaagcaaagagaagucucaguggagcaugaggagggagcaguccagaugccaacaaggaaau

SEQ ID NO: 256243 - RNA, 64 nt, Human
uugauaggcccagaagcccaucuuaguuaggggaagggagcaggaagaggguuguucaaaugcc

SEQ ID NO: 256244 - RNA, 64 nt, Human
gacuugguacaggaagggagaagggcaggugggcagggagcagacagggucuggcuuugcccag

SEQ ID NO: 256245 - RNA, 64 nt, Human
gcccccucaguugccugagcagcugguggcuuccagggagcaucucugcucuaccccugcccca

SEQ ID NO: 256246 - RNA, 64 nt, Human
gauccagagcuggagaaagaagccgaaggcucuuagggagcagccagagggccaagugaccaag

SEQ ID NO: 256247 - RNA, 64 nt, Human
gucugaaggacuggacuugacaccccacaguggaagggagcaucaggagaggaacaaaaaaagg

SEQ ID NO: 256248 - RNA, 64 nt, Human
aaggcacucggccaauccgcaucucagcccucucagggagcagucuuccaucaugcugaauuuu

SEQ ID NO: 256249 - RNA, 64 nt, Human
accauccagugccuguccucgccacagggccuccagggagcauucgggucaaauccauggacac

SEQ ID NO: 256250 - RNA, 64 nt, Human
uugauuccgaaggguagggugggaaggugagcaaagggagcagaaacaagggaauucaagaccc

SEQ ID NO: 256251 - RNA, 64 nt, Human
ggggcccuaccuccucagcucugugcuuggauacagggagcagccaggagacucccuagugccc

SEQ ID NO: 256252 - RNA, 64 nt, Human
uucccuccacuuccagguggugcugggcucaccgagggagcacuggugggugcucugaaaaccc

SEQ ID NO: 256253 - RNA, 64 nt, Human
uuuaaagcagagacuauuuugguggauaggugggagggagcaaggggaguuugagggaaucaga

SEQ ID NO: 256254 - RNA, 64 nt, Human
gugaccaagugcaauaugggcgggcagucgcugcagggagcaccacggccagaaguaacuuauu

SEQ ID NO: 256255 - RNA, 60 nt, Human
guuuagcaggaugggggccccagguacuguggagagcauaguccagccugggcauuuguc

SEQ ID NO: 256256 - RNA, 60 nt, Human
guuccagaaccgacgcaugaaguggaaaaaggagagcaaacugcucagcgcgucucagcu

SEQ ID NO: 256257 - RNA, 60 nt, Human
acggaaguaagcagagcugccaggcucccaggagagcauggggacuaggaggaagggugu

SEQ ID NO: 256258 - RNA, 60 nt, Human
gaaccucaaaugaaagacugucuccucgugggagagcaccuggggccaucagaaaugucu

SEQ ID NO: 256259 - RNA, 64 nt, Human
uguccuugcagagccccucuguuuuugggggaacagggagcauucacagggucuugggaacaaa

SEQ ID NO: 256260 - RNA, 64 nt, Human
gggcuucugauacccucaaacauggagaacaguaagggagcagagugguuaaggacuuucagga

SEQ ID NO: 256261 - RNA, 55 nt, Human
aaacuguucagcaaagguagucauuagggagcaggcacuaccacuaagauauccc

SEQ ID NO: 256262 - RNA, 64 nt, Human
ggcuggccaaagagacugugggcuguuuucagucagggagcaugugcauuguuugugcucaauu

SEQ ID NO: 256263 - RNA, 64 nt, Human
auaggaaggaaacuggaauucuuuguacuaauacagggagcacacuccuucaguucagcaagac

SEQ ID NO: 256264 - RNA, 64 nt, Human
uaugacucucugcuaucccacuguauagauccacagggagcaaacacuuagaaaugauagagaa

SEQ ID NO: 256265 - RNA, 64 nt, Human
uaggacuccaacagccacucugagggaggggagaagggagcagaggccacgcagaaugaaccga

SEQ ID NO: 256266 - RNA, 64 nt, Human
ccuguuagagauggcguagaagugaaagucuuaaagggagcauuagagauccuuuuaauacacg

SEQ ID NO: 256267 - RNA, 64 nt, Human
uuguaaaauuggaaccaucagcugauaaccucguagggagcaaccccaggauagcuaaguguua

SEQ ID NO: 256268 - RNA, 64 nt, Human
gcucccagcacaccacagcccgcgaccucagggcagggagcagagcagcugccggcugugugcc

SEQ ID NO: 256269 - RNA, 64 nt, Human
cccaaagauuagcuucauguccauuauagcauugagggagcagagauacccauacacagaagca

SEQ ID NO: 256270 - RNA, 64 nt, Human
gcuguauuaaauagccaugagcuucacugcuuagagggagcagaaaggucaacaucuaaaagca

SEQ ID NO: 256271 - RNA, 64 nt, Human
ggaccaaggacgggccugaaggcacaugggggaaagggagcacacggggaggacguuggggacc

SEQ ID NO: 256272 - RNA, 64 nt, Human
ugcagagcugccagcagggagcucacagaaggggagggagcaccaggccagcugagcugcaccc

SEQ ID NO: 256273 - RNA, 64 nt, Human
uagggugaagagcauaucccacaagaggccccacagggagcagagacugcuuuaaucccugcug

SEQ ID NO: 256274 - RNA, 64 nt, Human
guuuuacagaguaugcugcuaccucucuccuugaagggagcauggcgagacccauuggauggau

SEQ ID NO: 256275 - RNA, 60 nt, Human
cugauguguuuacaugguacuguauguaugggagagcagacugcacccuccagcaacaac

SEQ ID NO: 256276 - RNA, 60 nt, Human
caggccccgggcccggccgcgccuccgcggggagagcaccccggcuucccgcgcgcccuc

SEQ ID NO: 256277 - RNA, 60 nt, Human
ccaccugccugcccccgggcagcacgggagggagagcagggugagcacgcuuguugguuu

SEQ ID NO: 256278 - RNA, 60 nt, Human
ccuuauuuugaacugccucaggaccccacuggagagcacagcaugccuuacuacuggguc

SEQ ID NO: 256279 - RNA, 64 nt, Human
ccaggccagcgcuuugcucuccugcuccgucugaagggagcaggugcaccagccaaaaugucag

SEQ ID NO: 256280 - RNA, 64 nt, Human
gccuccgcccggcccgggcaccacccgaccucgcagggagcaggcccugucaccgacgggucac

SEQ ID NO: 256281 - RNA, 50 nt, Human
gccacuggcucaagguguagagggagcagagacgaagaccccaggaaguc

SEQ ID NO: 256282 - RNA, 64 nt, Human
cagaccuggucagacccagcgccccuccucccugagggagcauggcacagccucacacuugaaa

SEQ ID NO: 256283 - RNA, 64 nt, Human
cgccuuauucccccaaacuuuuuguucauguggcagggagcaguacacaacuauggaauagauu

SEQ ID NO: 256284 - RNA, 64 nt, Human
cuuuugagacagaagcucuuaaguacuucuugccagggagcagcacugcaugugugaugguugu

SEQ ID NO: 256285 - RNA, 64 nt, Human
uuauuggagugaaucacauuucuuacgcaaaugaagggagcagacagugauuaaugguucuguu

SEQ ID NO: 256286 - RNA, 64 nt, Human
ugacaggaagcuguaacugagcacaaaguacuuuagggagcagccacacauacaggaagcucuu

SEQ ID NO: 256287 - RNA, 64 nt, Human
cugucugacuacaacaugcaucaugcucauggggagggagcaggggaagguuguaugugucauu

SEQ ID NO: 256288 - RNA, 64 nt, Human
aguuucuuugcuuacuuuuacugucuauauauauagggagcacuuuaaacuuaaugcagugggc

SEQ ID NO: 256289 - RNA, 64 nt, Human
uuuccuccacagcccuucugcccaucugagauugagggagcaucguccacuugagaucagggau

SEQ ID NO: 256290 - RNA, 64 nt, Human
gugguguggcacugggagcugcuccuaaggaagcagggagcaaaucccaccuuuaccccaccuu

SEQ ID NO: 256291 - RNA, 64 nt, Human
cucugcaaugacugggcuccuucccuugacuuccagggagcacccccucgauuugggcagaugg

SEQ ID NO: 256292 - RNA, 64 nt, Human
gggaacugggaaagccaaagucagucuugagcagagggagcacauuuuguggaccugguuccac

SEQ ID NO: 256293 - RNA, 64 nt, Human
cuuagggagcccagcuauuuacaaaguacacacgagggagcaggcuggucauugacuucgggcu

SEQ ID NO: 256294 - RNA, 64 nt, Human
agcucugugaucgcugugauguggacccagcuccagggagcagagugucgaggauggaggggcc

SEQ ID NO: 256295 - RNA, 60 nt, Human
uuuucacuuaugaaugauuugcauaugaaaggagagcaucggccuagggcccccacaguu

SEQ ID NO: 256296 - RNA, 60 nt, Human
cucauccagagacggccggugggcaggcggggagagcagcuuuccuucccuggagagaac

SEQ ID NO: 256297 - RNA, 60 nt, Human
auugcaggccccaucuccaggcuaaggggaggagagcaucaucacuuuccauuagcugua

SEQ ID NO: 256298 - RNA, 60 nt, Human
ugaagagcccucugagcucgguugcuagcaggagagcaugcccauauuggcuuacuuugu

SEQ ID NO: 256299 - RNA, 64 nt, Human
ugugugaguggcauuuccuuaagcuggcaggaacagggagcagcccugugucgggggcuggaau

SEQ ID NO: 256300 - RNA, 64 nt, Human
gggaccugggucucugggagaggaaggaagagggagggagcaaagagauugggguauguccccu

SEQ ID NO: 256301 - RNA, 64 nt, Human
uucuguggaguaaauauugggauuggggggaaagagggagcaacggcccauagccuugggguug

SEQ ID NO: 256302 - RNA, 64 nt, Human
uuccugcaccacccaggauucaaaggaaagacgaagggagcagaacuuguggcagcaacaggua

SEQ ID NO: 256303 - RNA, 64 nt, Human
cuaaugggaguucccgagaugcucggguuugagcagggagcaggcagagcugcagucagagaca

SEQ ID NO: 256304 - RNA, 64 nt, Human
gagaauggugauccacccaguuacaggggcauuuagggagcagaugacugagaacauuaaaaaa

SEQ ID NO: 256305 - RNA, 64 nt, Human
gagaaguuacauuucuggaggugaugaagcaaggagggagcacuaggaagagaaaagcuacaau

SEQ ID NO: 256306 - RNA, 64 nt, Human
auaucaacacgcuuggaggaaagggacucagggaagggagcagggagugugggguggggaugga

SEQ ID NO: 256307 - RNA, 64 nt, Human
cagcuuggauggccgucaccucagacaucacuccagggagcacccgcaggagcugggcccccuc

SEQ ID NO: 256308 - RNA, 64 nt, Human
cgcaguggcugcaggcugcccccugccggccacaagggagcagcguccgcgccgccgcccaccg

SEQ ID NO: 256309 - RNA, 64 nt, Human
uaggggagcaccuguuucagacugggcaugaagaagggagcacagcagcuacuagaccccauua

SEQ ID NO: 256310 - RNA, 64 nt, Human
aaggaggaggggcuuauagagcugggauugguggagggagcaggugccaguccccucacucucu

SEQ ID NO: 256311 - RNA, 64 nt, Human
uccuccagcaagcagggcugcagugggagcugggagggagcagugcaccugccagcguggccga

SEQ ID NO: 256312 - RNA, 64 nt, Human
auuaaagucaagaggggcagcucaggaugcuaccagggagcacaucguuucuggugccucaucu

SEQ ID NO: 256313 - RNA, 64 nt, Human
caaucuuuguaucuauuauuacacgugcugcugaagggagcaugguuuuuaucuaugauacuua

SEQ ID NO: 256314 - RNA, 64 nt, Human
agagguguccacuccauccuucccuccguggcguagggagcacuguuucuuuccagcaagccug

SEQ ID NO: 256315 - RNA, 60 nt, Human
uacugggaauagcuacucagccuuggaaauggagagcacugcagugaauucuuuagggca

SEQ ID NO: 256316 - RNA, 60 nt, Human
ggcuaugccauggcagcugcagaggcccagggagagcagcaggaagauagccuggagaag

SEQ ID NO: 256317 - RNA, 60 nt, Human
ggggccccgccagcccgauggggaugaggaggagagcacagcccucagcaucaacgagga

SEQ ID NO: 256318 - RNA, 64 nt, Human
uagaauucaggugcaggucuuugccgguuaaguaagggagcaacacguaaaaugggagaggagu

SEQ ID NO: 256319 - RNA, 64 nt, Human
gccccagccgcagugucugaaggccaccucccaaagggagcacguugccuuuucaaacucccgu

SEQ ID NO: 256320 - RNA, 64 nt, Human
cacguggcuccagcaagagccccaggcaggacaaagggagcaggcagcagcugcagaaacagcc

SEQ ID NO: 256321 - RNA, 64 nt, Human
ugggugcucauagaguugcccagcccagggggaaagggagcaagaguuguccagagaagacagu

SEQ ID NO: 256322 - RNA, 64 nt, Human
cuggccauuuucuugccugaggcucaagaggcccagggagcaaugggagggggcuccauggagg

SEQ ID NO: 256323 - RNA, 64 nt, Human
cccuuuccugcucauccccagugagcuaguggagagggagcaagggaggccgcagagggaaaaa

SEQ ID NO: 256324 - RNA, 64 nt, Human
cucgguuuuucauccacugcaggaauguggccacagggagcagagguuuguacuuuccccaaga

SEQ ID NO: 256325 - RNA, 64 nt, Human
aaguaaaacuaaggcuucagccauaauauggaggagggagcagauguaagcucccaagagccug

SEQ ID NO: 256326 - RNA, 64 nt, Human
cacccccagccuugcccagcuuucaaaggacaaaagggagcaucccccaccuacucucagguuu

SEQ ID NO: 256327 - RNA, 64 nt, Human
aaaagccaucggccuccaauacccaugaugacagagggagcacuugagccuugccuucccuccu

SEQ ID NO: 256328 - RNA, 64 nt, Human
ucuaaaguguuuaccagaugcugaaggcaaggggagggagcagaagcacuuauguuuacggaua

SEQ ID NO: 256329 - RNA, 64 nt, Human
aagaaccugaccccagugaaugaagcugaugcacagggagcaccaaaggaccuucguuaaguga

SEQ ID NO: 256330 - RNA, 50 nt, Human
aguuccaaguucgaaccugaagggagcauuugcugagggaauagucuugc

SEQ ID NO: 256331 - RNA, 64 nt, Human
cacuucggugagggugacaggguggccuaucucaagggagcagggccaccuuccugcaaguuua

SEQ ID NO: 256332 - RNA, 64 nt, Human
ugacuguggcccccuccgugauccauccaucuccagggagcaagacagagacgcaggaauggaa

SEQ ID NO: 256333 - RNA, 64 nt, Human
gcugcuccaagccuguugcccaauucacgguacaagggagcaccccuucccuuuccucugaagg

SEQ ID NO: 256334 - RNA, 60 nt, Human
ggagugaccgggacuggagccagggucuggggagagcaacagcaccaggcuuuuccuggu

SEQ ID NO: 256335 - RNA, 57 nt, Human
agugggccuugauggccgggccucgaaggccacaaacaaggcgucgaggaauuggaa

SEQ ID NO: 256336 - RNA, 57 nt, Human
auugauugauuguaaauaaaggaugauggccacaacaugaaaacuccauauuuauuu

SEQ ID NO: 256337 - RNA, 57 nt, Human
uucuucagagacuccugcaggcagccaggccacaagacccuuguggucccaccccac

SEQ ID NO: 256338 - RNA, 64 nt, Human
ggugucucuaugaaaagcacaaggggccaaggucagggagcaagaggugugcacaccaaagcua

SEQ ID NO: 256339 - RNA, 64 nt, Human
caaaacuaucgguucaaguugaugugacaagggaagggagcaccagaugacacauaaaucuguc

SEQ ID NO: 256340 - RNA, 64 nt, Human
gccggcuguggacgggggaggaggaaggggacagagggagcagguaggaaacacuuuaguuggg

SEQ ID NO: 256341 - RNA, 64 nt, Human
gggugggggcccccaaaccaaaguccucugggguagggagcagggcugggcaggcauucugggg

SEQ ID NO: 256342 - RNA, 64 nt, Human
caagcccugaagccuggggccagcugggacuugaagggagcacgaguccaggauggacucagug

SEQ ID NO: 256343 - RNA, 64 nt, Human
acugaaaauggacccaugagaguauauuuuuaugagggagcaaaaguuagacugagaacaaacg

SEQ ID NO: 256344 - RNA, 64 nt, Human
ggacaaccagguagucacccaguccucucuaagcagggagcacuuguccuucucuccucugcug

SEQ ID NO: 256345 - RNA, 64 nt, Human
ccaugcacaggcccgucccacccugcaugugggaagggagcaggagggccuggcugggugaggg

SEQ ID NO: 256346 - RNA, 64 nt, Human
aaaugagcgacuucugugcuuccagaggaagacgagggagcaggagcuuggcugacugcucaga

SEQ ID NO: 256347 - RNA, 64 nt, Human
accacugcugaguggccuugaggacgaaccccgcagggagcaagcaguacaguggcauucccag

SEQ ID NO: 256348 - RNA, 64 nt, Human
cuucggccccaaggcugucgccugcaccuucgccagggagcaccuggugagucugccggcggug

SEQ ID NO: 256349 - RNA, 64 nt, Human
gcagcuugguucuccccucuggccccuggagagaagggagcauuccuagaccccugggugcuug

SEQ ID NO: 256350 - RNA, 64 nt, Human
guuuccuuacuggggauuucagggcuggggguucagggagcauuuccuuuuccugggaguuaug

SEQ ID NO: 256351 - RNA, 64 nt, Human
cagguccagagagaccgaggagggagagucucccagggagcaugagaggaggcagcaggacugu

SEQ ID NO: 256352 - RNA, 64 nt, Human
gccuagcuccagugcuucuaguaggagggcugaaagggagcaacuuuuccuccaauccuggaaa

SEQ ID NO: 256353 - RNA, 64 nt, Human
gugcccgcacagaggcuccgugugacuuccguccagggagcaugugggccugcaacuuucucca

SEQ ID NO: 256354 - RNA, 60 nt, Human
auguugaagugcgcuguucacacccgcuccggagagcaccccagcagcauccagaagcag

SEQ ID NO: 256355 - RNA, 60 nt, Human
acacacaaaacgcucacggaccuugaacgaggagagcacugcugaucagacuaggcccca

SEQ ID NO: 256356 - RNA, 60 nt, Human
cccagagaccaggccaggaaggcccgagauggagagcacuaaauucacggcuuucauguu

SEQ ID NO: 256357 - RNA, 60 nt, Human
uaauuuauguaucugguuaaugacauacuuggagagcaaauuauggaaauguguauuuua

SEQ ID NO: 256358 - RNA, 64 nt, Human
cucacccaggagcuggcugggccaggaccgggagagggagcacugcugcccuccuggcccugcu

SEQ ID NO: 256359 - RNA, 64 nt, Human
cggggcggcauuuuacugcucagaauuuggagggagggagcaguaccuucccggaguccacgca

SEQ ID NO: 256360 - RNA, 64 nt, Human
gacauggagcacaaagaacugaaaauauguuuugagggagcaugacauccuugaccucauuuga

SEQ ID NO: 256361 - RNA, 64 nt, Human
gccuguguguaggucccacggccucugccuccccagggagcagagccugggccuccccuaagag

SEQ ID NO: 256362 - RNA, 64 nt, Human
cucaggugcugaacauuucucagcccuggcuaaaagggagcagcacagggagagaaacaggaua

SEQ ID NO: 256363 - RNA, 64 nt, Human
gggugugagcagcacccauccaccguccccucccagggagcaagggcagggacagggccggucg

SEQ ID NO: 256364 - RNA, 64 nt, Human
ccugagggcuugagggaggcuggggaaaaccagcagggagcacuuggcuccuggcagagggaga

SEQ ID NO: 256365 - RNA, 64 nt, Human
uuccccugcaaggugcccaccugcccggagacagagggagcagcugaggccucucuccacuggc

SEQ ID NO: 256366 - RNA, 64 nt, Human
auuuuuuccaagcacgaagccaccagucucccccagggagcaucaggaagggacauggaugugc

SEQ ID NO: 256367 - RNA, 64 nt, Human
aauaugcuggcuggagugaggaaaaaaaucguccagggagcauuuuccuccaucgcaguguuca

SEQ ID NO: 256368 - RNA, 64 nt, Human
gcugaggucacugccacuucucacaugcugcuuaagggagcacaaauaaagguauucgauuuuu

SEQ ID NO: 256369 - RNA, 64 nt, Human
ucagggcacuacgcgccaccaguucccgguacccagggagcaggcagccacacacgggccuugc

SEQ ID NO: 256370 - RNA, 64 nt, Human
ucgaucaauaauucugcucuggaagagaaggaacagggagcagagagacccaacugggagccag

SEQ ID NO: 256371 - RNA, 64 nt, Human
ccccagggguaugagggcaccagcuggguucuccagggagcaggaguuggaccuccauggagcc

SEQ ID NO: 256372 - RNA, 64 nt, Human
ggccccgguucccacaggacacgcuaagaagcacagggagcauuuaacaggcucacccucccuu

SEQ ID NO: 256373 - RNA, 64 nt, Human
auacacguucaccgagaaagggagagggaaucggagggagcagcggaaugcggcgaagacucug

SEQ ID NO: 256374 - RNA, 52 nt, Human
uuggagccuucuuacuauaggaggagagcaaauaucauuauaugaaaguccu

SEQ ID NO: 256375 - RNA, 60 nt, Human
uggccaauaccagagcauaucagcagaguaggagagcaaggauuugguuucccauguucu

SEQ ID NO: 256376 - RNA, 60 nt, Human
accaucacccugcccugcccucguggcuucggagagcagaggggucaggcccaggggaac

SEQ ID NO: 256377 - RNA, 60 nt, Human
ggaccaguuucucugccaaggggaggaguuggagagcacaguugccccguugugugaggg

SEQ ID NO: 256378 - RNA, 64 nt, Human
ucucacggacugccgggucggcgccuccugcgcgagggagcagguucuccgcauucccaugggc

SEQ ID NO: 256379 - RNA, 64 nt, Human
auaauaaaacacaggguuuggaagguuuuguuacagggagcauggucuguugaagauuuuuaaa

SEQ ID NO: 256380 - RNA, 64 nt, Human
gaaauauuauguaucuuacuguugaugugugagcagggagcagagcuaucugcauuuguauuua

SEQ ID NO: 256381 - RNA, 64 nt, Human
uuggacuuauuuauuuaaaauuuagauuuauuagagggagcauggccauaaaauaaaauaaaau

SEQ ID NO: 256382 - RNA, 64 nt, Human
uaaggaacaauggaaagagcugaaggccaccuacagggagcacguagaggccaucaaaauuggc

SEQ ID NO: 256383 - RNA, 64 nt, Human
acuguagcaaaagccacuuccacauggcccuggcagggagcacugcugcuccaugcuccauucu

SEQ ID NO: 256384 - RNA, 64 nt, Human
cuauggucuguuaaacagggcuggcaucagguagagggagcagaguggugaccugauagcuccu

SEQ ID NO: 256385 - RNA, 64 nt, Human
ugcucugccuaccugccccaccccucacagccccagggagcagaagacagaaugaagagacuga

SEQ ID NO: 256386 - RNA, 64 nt, Human
gucuguucauaauugguaggugccuuuugugagcagggagcauaauuauugguuuauuauggua

SEQ ID NO: 256387 - RNA, 64 nt, Human
cuguaggaaauacaugacagagaaaguuacacucagggagcagcagcaccuccagacuggaaaa

SEQ ID NO: 256388 - RNA, 64 nt, Human
auccucucguauuucugaguuuuuguccuucccgagggagcacccuagugagaguugaaccccu

SEQ ID NO: 256389 - RNA, 64 nt, Human
ccaccuccagcugccaaacagcagccugccgggcagggagcagccccaggccagagaggccucc

SEQ ID NO: 256390 - RNA, 64 nt, Human
cugaagaaggcuuucccaggaugcacguccucagagggagcagccuaucucccccaagcuggag

SEQ ID NO: 256391 - RNA, 64 nt, Human
aaacaggaaacaagacugcgaauggcgcucaggcagggagcagggaguggcguuuggcuugcac

SEQ ID NO: 256392 - RNA, 64 nt, Human
ccaguccaaggagucaggaaagagcucucugaggagggagcaucugagccagauguugagggcu

SEQ ID NO: 256393 - RNA, 64 nt, Human
gaguuaucaguccuuugacaaggacagguggggcagggagcaagacagguaggcuggaagaaca

SEQ ID NO: 256394 - RNA, 60 nt, Human
uuaaucauggcuguucuaagaaguacuuauggagagcaagaacguuuuuguucauuucuu

SEQ ID NO: 256395 - RNA, 60 nt, Human
ucauuuguuuggggagauauaaaaggcucaggagagcaggcuuuugcuuuugcuuuuguu

SEQ ID NO: 256396 - RNA, 60 nt, Human
ccagguggggcuagguguggcugggggccaggagagcaggaacagaacagagaaaugccc

SEQ ID NO: 256397 - RNA, 64 nt, Human
cuccugaguccuccacccuggccugggauuggccagggagcagggcgggcauugggaccagugu

SEQ ID NO: 256398 - RNA, 64 nt, Human
uaagauccugagacacuugacuucacaauccacaagggagcacucauugucuacacacccuaac

SEQ ID NO: 256399 - RNA, 64 nt, Human
ucacuuuaugaaugaggaaacugaaauggccuuaagggagcaaguuauuucuuuuuuuuugaca

SEQ ID NO: 256400 - RNA, 64 nt, Human
aacaagagacgucauuguucaguagcaggcaaagagggagcacacagcauuauucugauggaaa

SEQ ID NO: 256401 - RNA, 64 nt, Human
ucgggccacucuucugaaggccaacguggaggaaagggagcagccagccauuugggagaagauc

SEQ ID NO: 256402 - RNA, 64 nt, Human
caugugucugucucaguugguuccaaaugaaaccagggagcaggggaguuaggaaucgaacacc

SEQ ID NO: 256403 - RNA, 64 nt, Human
cccagugcccagaagagggaaggggaguggcuggagggagcagggggugggacaguguaucaaa

SEQ ID NO: 256404 - RNA, 64 nt, Human
uucuagauuugaacucugcugugaagugacuggaagggagcagaggccagcugggggccagugg

SEQ ID NO: 256405 - RNA, 64 nt, Human
cuguggcacccgcugggcgcgggcagcagggaagagggagcaaggcauuguccacagacugcug

SEQ ID NO: 256406 - RNA, 64 nt, Human
ugcugacugucugcuguccgcuccuguagaagguagggagcacaauaccuagggacuaagggau

SEQ ID NO: 256407 - RNA, 64 nt, Human
guggugaaacauuguucuguuuucacaagagaugagggagcaggcuuuccaauaugcuggaagu

SEQ ID NO: 256408 - RNA, 64 nt, Human
aggacugaggaggaguggagggaagcagggagggagggagcaagugugaagggcacagcugcug

SEQ ID NO: 256409 - RNA, 64 nt, Human
gcauaauuuucagauuuuuuuccccuagauuuugagggagcagagaaacuggaaaaaacuuuag

SEQ ID NO: 256410 - RNA, 64 nt, Human
aacaaaauuagagcaaagcugaccuggagcccucagggagcaaaacaucaucuccaccugacuc

SEQ ID NO: 256411 - RNA, 64 nt, Human
aauccccuucccccaucuagaucgaaggaagaugagggagcagcuuggauucuucucaguuguc

SEQ ID NO: 256412 - RNA, 64 nt, Human
gagcaaaccuagauaaggaccuguuuggggcagcagggagcaaaaucuccuuuaacaaccaagc

SEQ ID NO: 256413 - RNA, 60 nt, Human
uucaaaaauacggagcagugccuaguaucuggagagcagcacuaccauuuauucuuucau

SEQ ID NO: 256414 - RNA, 60 nt, Human
guggcggcggcuccucuucugccuguguauggagagcaaauccuaugccgaaaggcuacg

SEQ ID NO: 256415 - RNA, 60 nt, Human
cagaaguguauguaaauacagcagcuagugggagagcaccaguugggccuaauccugccu

SEQ ID NO: 256416 - RNA, 60 nt, Human
ggguccaaacauguugcuccgaucaucacaggagagcaaaaggcccuagauacccccuuu

SEQ ID NO: 256417 - RNA, 64 nt, Human
cugguggggugggaggagcaccacucacuucugcagggagcaaggguccagagcagauauggac

SEQ ID NO: 256418 - RNA, 64 nt, Human
gggguaccuagucaccaggaucuccaggacucccagggagcagagucuucucaucuuuucacug

SEQ ID NO: 256419 - RNA, 64 nt, Human
ccagagaacguaacuccugcucccuguggcacucagggagcauuuaauggcagcuagugccuuu

SEQ ID NO: 256420 - RNA, 64 nt, Human
cuugauuaauccaugcacaugauuuuuuuugaguagggagcauuaguaccuggugcuagagaau

SEQ ID NO: 256421 - RNA, 64 nt, Human
agcuugugugcaaaagcagugggcuccuggcagaagggagcagcacacgcguuauaguaacucc

SEQ ID NO: 256422 - RNA, 64 nt, Human
guuacuccugaauauucugauuucauacguacccagggagcaugcuguuuugucaaucaauaua

SEQ ID NO: 256423 - RNA, 64 nt, Human
ugagguugugcuguggggguuuggguuugagggaagggagcaggguggcgguugaggaacgcuu

SEQ ID NO: 256424 - RNA, 64 nt, Human
aucaucgagcgcacggccagcuucgugugcaggcagggagcacaguuugagaucaugcugaagg

SEQ ID NO: 256425 - RNA, 64 nt, Human
aggccgcaccgccgccagccuccuccggcccuggagggagcaucucgggcugggggcccacccc

SEQ ID NO: 256426 - RNA, 64 nt, Human
ggcccuucuguggaugugggagcccaggccaggcagggagcagaugcagggacucugccacguu

SEQ ID NO: 256427 - RNA, 64 nt, Human
auagguuuuuagucuaauugaaucccuuaaacucagggagcauuuauaaauggacaaaugcuua

SEQ ID NO: 256428 - RNA, 64 nt, Human
caauacccugcucuuuacucaaugguacccagggagggagcaugggaagagggugagcugaggg

SEQ ID NO: 256429 - RNA, 64 nt, Human
gugaucuuugucucuguucuaaaauggaggcaguagggagcaaaacuauucuucucaagcaucc

SEQ ID NO: 256430 - RNA, 64 nt, Human
uggugcuuuuccucaggcucuucauugguuuccaagggagcaaauccucaguggggauacaaga

SEQ ID NO: 256431 - RNA, 64 nt, Human
gcacagucaugugccuacguccugccucgcaaugagggagcauguaccccagguacauccauga

SEQ ID NO: 256432 - RNA, 64 nt, Human
agcuuuuuucccuccuaccacauacaccauucuuagggagcaaugagguaacaggucuguguug

SEQ ID NO: 256433 - RNA, 60 nt, Human
ccucugggagcugaagcacacggccauguuggagagcaaaacuuaauaauaauucuuuuu

SEQ ID NO: 256434 - RNA, 60 nt, Human
gggaccgcggcgagcagcacggagcggaagggagagcaggggagagaaggccucaucucu

SEQ ID NO: 256435 - RNA, 60 nt, Human
cccacacacggcgcaggcugcccgccuccuggagagcacacuucagcugaaacaguaaag

SEQ ID NO: 256436 - RNA, 60 nt, Human
aggugcccauuccauacccugggagacugaggagagcauuggcugaagcccaguuccuuu

SEQ ID NO: 256437 - RNA, 64 nt, Human
cgcaccugcucuguagcagacacggaagaguccaagggagcagccacguuaggaagagagacuu

SEQ ID NO: 256438 - RNA, 64 nt, Human
aucggcacucagggggucuggaaagaaggucauaagggagcaugauaggauuuggggcagaggg

SEQ ID NO: 256439 - RNA, 64 nt, Human
agggcaaguuuaucaaaaacauuguuucaggagaagggagcauaaguuuacagccuacaggacg

SEQ ID NO: 256440 - RNA, 64 nt, Human
agcugugcagugccggccccagauccucacacccagggagcagcugcacaucgugaaagacuga

SEQ ID NO: 256441 - RNA, 64 nt, Human
agcuccggcuucucguccuccggucuccacccugagggagcaccgacccggugccgccggagcu

SEQ ID NO: 256442 - RNA, 64 nt, Human
uauuaacaaguagcuuauacugaggugugcuucaagggagcauuauagggcagaaaacaaauua

SEQ ID NO: 256443 - RNA, 64 nt, Human
aauguaguaguguguuauuuuauuacacgaaaugagggagcaauaacuucaaccaauguaauca

SEQ ID NO: 256444 - RNA, 64 nt, Human
ugguuuuguauuacauacgguaguccucugcgucagggagcacuuuuuuguuugccucgagacu

SEQ ID NO: 256445 - RNA, 64 nt, Human
gaagcuuauaauaauauacaguauauguauauguagggagcaauuggucaaaaguggcuuuuug

SEQ ID NO: 256446 - RNA, 64 nt, Human
gagcuuuauucugaucucauuuugaauguuccagagggagcaucauaagagcccagagcuccga

SEQ ID NO: 256447 - RNA, 64 nt, Human
gggcuucagaaaaggaguggccacagcaccccgaagggagcaucuguuuaccuggcaguggcuc

SEQ ID NO: 256448 - RNA, 64 nt, Human
uauauguacaguuccuauuuuagcuugcuuacaaagggagcauuauuuuuauuuaaaguauugc

SEQ ID NO: 256449 - RNA, 64 nt, Human
auaguuauguaaguaaaauuuuuaaaaaucauaaagggagcaccauuguacagucuagcauaaa

SEQ ID NO: 256450 - RNA, 64 nt, Human
aagauccuuggguugugaagagaguagaaacccuagggagcagugcuuuuggguccuagaaccu

SEQ ID NO: 256451 - RNA, 64 nt, Human
gguaccggggacuugggagagugagacccaguggagggagcaagaggagagggaugucgggggg

SEQ ID NO: 256452 - RNA, 64 nt, Human
ucuuuggagcaauuaagauggaauuacaauuucuagggagcauuuuaaggaaaauguuuuggcu

SEQ ID NO: 256453 - RNA, 60 nt, Human
ggguggggaggguuggagacugggcugggaggagagcaagcaggaacagggauggaggca

SEQ ID NO: 256454 - RNA, 60 nt, Human
ggaaggcgggcugaggagacaaccagaucaggagagcaaggucaugaaggaggggaccuc

SEQ ID NO: 256455 - RNA, 60 nt, Human
cuggauuagaggugauggccacagcaaaugggagagcaaaauguuggccuacagagaaug

SEQ ID NO: 256456 - RNA, 60 nt, Human
uuuugagucaccuugggagauucaggauggggagagcaaauuugaacaaaagguuuuucu

SEQ ID NO: 256457 - RNA, 64 nt, Human
uuaaggaaggacuaagugacuuaugaccagaacaagggagcagccugagucagucuccccaaug

SEQ ID NO: 256458 - RNA, 64 nt, Human
guucacacaaauuuuuaauaagaaacauuuaccaagggagcaucuuuggacucucuguuuuuaa

SEQ ID NO: 256459 - RNA, 64 nt, Human
accggagacuaauuccugcccugcccaauuuugcagggagcauggcugugaggauggggugaac

SEQ ID NO: 256460 - RNA, 64 nt, Human
agggccaggcaacaggcuagcaaggcccacagggagggagcagaauggagagggcaucucagau

SEQ ID NO: 256461 - RNA, 64 nt, Human
ucacaaucccaaaacuagaguuggggggaacuggagggagcaaaacacugauuugauacuaguc

SEQ ID NO: 256462 - RNA, 64 nt, Human
aucauuauggcuauguaucuuguccauaccagacagggagcaggggguagcggucaaaggagca

SEQ ID NO: 256463 - RNA, 64 nt, Human
ccgcagccuggauacuuaccuggcccuccucccuagggagcaagugccuuccacuuacuuccca

SEQ ID NO: 256464 - RNA, 64 nt, Human
aaucauucccaaugguguacaauguaaggguuuuagggagcaacaguauuuaacuggaagaaag

SEQ ID NO: 256465 - RNA, 64 nt, Human
caccccgccuucaggagcccucuccuacggcgcuagggagcacuggaagcagagaugccagccc

SEQ ID NO: 256466 - RNA, 64 nt, Human
accaaaaccugcggggcugcuuggaguggaaagcagggagcaguguucagaggcaaagcagccu

SEQ ID NO: 256467 - RNA, 64 nt, Human
gcuucaccacccuggcuuauguggaacaccuaucagggagcagaaaaggggugcaguacacuaa

SEQ ID NO: 256468 - RNA, 64 nt, Human
ugggggccaggccacauggcuggagaggaauuucagggagcauagcaucgggaggaugcuacau

SEQ ID NO: 256469 - RNA, 64 nt, Human
ggaagacauaguucccuucuuuuuuggguaaugaagggagcagucuaaagaauuguaugcaugu

SEQ ID NO: 256470 - RNA, 64 nt, Human
uauaaauacugauauucuccaaaccuagugguguagggagcaagagaaugcagcuggaaggcac

SEQ ID NO: 256471 - RNA, 64 nt, Human
gagcauuaguagaacagcagugaugaggacacagagggagcagacaguggguaccacgaucucc

SEQ ID NO: 256472 - RNA, 64 nt, Human
ugagugaaaggccaucaccccaggaagccaaaugagggagcagcaacauguauaugagcuuccu

SEQ ID NO: 256473 - RNA, 60 nt, Human
gcaacacagcgugugcauggggcugcuggaggagagcauuccagagcaguacaucugcua

SEQ ID NO: 256474 - RNA, 60 nt, Human
agguaggagagauucccaucccuuggugugggagagcaaguugccuauguccauguucug

SEQ ID NO: 256475 - RNA, 60 nt, Human
agaugcaggaggcucaggugaucuguuugaggagagcacccuaggcagccugcagggaau

SEQ ID NO: 256476 - RNA, 64 nt, Human
gaggaagcagcuccuuccucccacaggagccccaagggagcacucacccuccucccaauuggau

SEQ ID NO: 256477 - RNA, 64 nt, Human
gguuauagguuuuauguuuuguuuugugggucauagggagcacauuucaccugugcaggaaaag

SEQ ID NO: 256478 - RNA, 64 nt, Human
aguuuagaggauugggggaagggagaacgaacccagggagcauauugcuguaaacgcuucaaug

SEQ ID NO: 256479 - RNA, 64 nt, Human
acacagagagaagacuuucagagcucacaggagcagggagcaggagcacucuaagggaauucca

SEQ ID NO: 256480 - RNA, 64 nt, Human
guuuccuugguacuaauuuuaauuuuuauuuggaagggagcaguauaaagcuuauuuguauuua

SEQ ID NO: 256481 - RNA, 64 nt, Human
aaauaaggcauauauaaugacacuguguucugugagggagcaggcccugugagaaucaauucag

SEQ ID NO: 256482 - RNA, 64 nt, Human
uacucagcacuagagggagggagggggagggaggagggagcaggcaggucccaaaugcaaaagc

SEQ ID NO: 256483 - RNA, 64 nt, Human
uuaagaagcccaagccuuguuccugcccuggccuagggagcacucaggaggguuccuugguccu

SEQ ID NO: 256484 - RNA, 64 nt, Human
aagugccuaggguugcccgcuguggccugcuuccagggagcaacagagaggccaccaagcagag

SEQ ID NO: 256485 - RNA, 64 nt, Human
uauugaguuauuucuuaacaaguuucgagagagaagggagcaagacaagagcaagcaacggcua

SEQ ID NO: 256486 - RNA, 64 nt, Human
ggggugagcugggccgcaccuacccuggggccccagggagcaggacgcuccggggcccagcacg

SEQ ID NO: 256487 - RNA, 64 nt, Human
accaaaacagcagcagcucguuggcuccaaaaccagggagcagaccaugcccucccaacccugg

SEQ ID NO: 256488 - RNA, 64 nt, Human
gaggugaaugcacagugaagggugauuuguggggagggagcauuuuugguggucuugggggagg

SEQ ID NO: 256489 - RNA, 64 nt, Human
aaugcacuuuguggcugagugcuccaggacuccuagggagcaagguccucccucuaagguguuu

SEQ ID NO: 256490 - RNA, 64 nt, Human
ggaacaccauaggucaccuuuauucuggcagaggagggagcaucagugcccuccaggauagacu

SEQ ID NO: 256491 - RNA, 64 nt, Human
gcucaggcccccaucucugggguguuugggggucagggagcagggagcacuggccguggucuac

SEQ ID NO: 256492 - RNA, 60 nt, Human
ccuaaacuaccuuagcugcauaguggaagaggagagcaugaagcaaagaauuccaggaaa

SEQ ID NO: 256493 - RNA, 60 nt, Human
ucugcccagggaacugcuccauggggucugggagagcagccauccccugcuggcaccaua

SEQ ID NO: 256494 - RNA, 60 nt, Human
aggaaacaguacagggucugaguucugaauggagagcauggauugugaugaggaaacaag

SEQ ID NO: 256495 - RNA, 60 nt, Human
cauacugggcgugugcaucugaaucccgcuggagagcaaacacgaacuucuguucgcugc

SEQ ID NO: 256496 - RNA, 64 nt, Human
cccccaucucugggguguuugggggucagggagcagggagcacuggccguggucuacagcgugu

SEQ ID NO: 256497 - RNA, 64 nt, Human
uuaauauuggggaaacuuaaugaguauaaauagcagggagcacauuguaacagcacaguguuuu

SEQ ID NO: 256498 - RNA, 64 nt, Human
aacaggcccuugggcagaugcaggcauuaccagcagggagcagacuuaccuccgaagauggaga

SEQ ID NO: 256499 - RNA, 64 nt, Human
uggcaaaaugcgggcugggcaggcagcucggggcagggagcagcagugcaggccuggccugugu

SEQ ID NO: 256500 - RNA, 64 nt, Human
gccucagggggcugucggccaagagccuggagaaagggagcaagcugcccccuccuugccccca

SEQ ID NO: 256501 - RNA, 64 nt, Human
augaggcucaugaagcagaggguaucccagucauagggagcagaaagagcaaguggguuaagga

SEQ ID NO: 256502 - RNA, 64 nt, Human
cuggcccagggccggcuuugccuggugaggcuggagggagcaccaggaccugcugucugcuguc

SEQ ID NO: 256503 - RNA, 64 nt, Human
cauuaagucuaagagagaggagccuggaagcagcagggagcagccugggucucugucccagacu

SEQ ID NO: 256504 - RNA, 64 nt, Human
ucggaucagggccgggaugggaggggucagccucagggagcagcugccuugggggacacaccua

SEQ ID NO: 256505 - RNA, 64 nt, Human
ccucuucuagcccaugcccuuccccgguggagggagggagcagggagcccucacucuccacgcc

SEQ ID NO: 256506 - RNA, 64 nt, Human
uggguggagcagucauccucccccuuccccgugcagggagcaggaaaucagugcuggggguggu

SEQ ID NO: 256507 - RNA, 64 nt, Human
uccaaggagcauggcuggcccguggggcagguggagggagcagucuucguucuuccuccccuca

SEQ ID NO: 256508 - RNA, 64 nt, Human
agccugcaucugugccucccagcccccugcacugagggagcaaguugcccacaugcccgccagc

SEQ ID NO: 256509 - RNA, 64 nt, Human
aauucucccgcauugguggcuugggacuugggagagggagcaagccuuccuccauggcccauca

SEQ ID NO: 256510 - RNA, 64 nt, Human
aaggccaaguccgcagaagcccugauguguccucagggagcagggaaggccugacuucugcugg

SEQ ID NO: 256511 - RNA, 64 nt, Human
auuugccuugcuggacggggacuggggaugugggagggagcagacaggaggaaucaugucaggc

SEQ ID NO: 256512 - RNA, 60 nt, Human
aauguugacuguuuuagauuguaagcuccuggagagcaguauugcuguaguaggaauguu

SEQ ID NO: 256513 - RNA, 60 nt, Human
agagcauacaacagagggggcacccggggaggagagcacauacuguguuccaauuucacg

SEQ ID NO: 256514 - RNA, 60 nt, Human
cucacgucccccagggcaagugcuuguggaggagagcaagucucaagagcgcaguauuug

SEQ ID NO: 256515 - RNA, 60 nt, Human
gccgggcugggcucugcggugcgguccacgggagagcaggccuccagcuggaaaggccag

SEQ ID NO: 256516 - RNA, 64 nt, Human
gugugugugugugugugugugugugucuucuuuuagggagcaggagugcaucugguaauugagg

SEQ ID NO: 256517 - RNA, 64 nt, Human
gcauccgugagcagugugucuccugcaugcagaaagggagcagagaaggccaggggcuuuugcu

SEQ ID NO: 256518 - RNA, 64 nt, Human
guaucaaacagcucaggcuguuuuugggugcaagagggagcacgugacuguauuauacaugggu

SEQ ID NO: 256519 - RNA, 64 nt, Human
ccccuaccaauuguuuuacuuccucuuccugcucagggagcagaugggccucacugguugagau

SEQ ID NO: 256520 - RNA, 64 nt, Human
guccaauuuucacacacgugagaaucccuggcaaagggagcagaacugaaccggcuuuaccaaa

SEQ ID NO: 256521 - RNA, 64 nt, Human
ggagaaggaggggaaccagauguuagaucaggggagggagcaggagugucccucccgucagugc

SEQ ID NO: 256522 - RNA, 64 nt, Human
ccugccagacagcacacuuuggaggaaggucugcagggagcagcugagccauuuguucuugaac

SEQ ID NO: 256523 - RNA, 64 nt, Human
ugcggauccgggaggaggagcgcuacccaccuccagggagcacccugcccaccaagaagcacug

SEQ ID NO: 256524 - RNA, 64 nt, Human
ucacuggauugacuuugcugucaaaacuacugacagggagcagcccccgggccgcuggcuggug

SEQ ID NO: 256525 - RNA, 64 nt, Human
cuucccaggucugacuuugucacccugccguuucagggagcagaaguccuucuggacaguguga

SEQ ID NO: 256526 - RNA, 64 nt, Human
ugagaggguuucuuuuacuucaaaaucuuucuucagggagcaagacaugaacugacuaauuggu

SEQ ID NO: 256527 - RNA, 64 nt, Human
aacuugcucucucugccccuauuuccuuguaaagagggagcacauugacuugggaauuuccucc

SEQ ID NO: 256528 - RNA, 64 nt, Human
cuccagccuucccuggcccccgccggaggccgggagggagcagggucucccucagggcugcagg

SEQ ID NO: 256529 - RNA, 64 nt, Human
ccugcagggcucgacccuguggguuucuguccccagggagcagacugugcggcacccaggccca

SEQ ID NO: 256530 - RNA, 64 nt, Human
uggggccuccuuguuggugcuguaggcacccgccagggagcagggacccgacuugcagacgcau

SEQ ID NO: 256531 - RNA, 64 nt, Human
ugcaaucucccaccuccugcccaucccucucuugagggagcagcaggggccaggagcuacccca

SEQ ID NO: 256532 - RNA, 60 nt, Human
gcgcuucugccugcguuccaugcugucuggggagagcagcacacuggccgcccagcacug

SEQ ID NO: 256533 - RNA, 60 nt, Human
caugauacuuuuauaaauacgacauuaacaggagagcagcaguacgauuuugccgaugga

SEQ ID NO: 256534 - RNA, 60 nt, Human
gcucacugaggaucugaggggacccuguuaggagagcauagcaucaugauguauuagcug

SEQ ID NO: 256535 - RNA, 60 nt, Human
uggaggauggucggugguggugauggagguggagagcauuaaacugucugcacugcacug

SEQ ID NO: 256536 - RNA, 64 nt, Human
cacugagcccccugaggcccacagccacccaggcagggagcaaguggccuggucacuucugguu

SEQ ID NO: 256537 - RNA, 64 nt, Human
cagccuaggauccaggggcugccucuggccucuuagggagcagagagcagaacuccgcagccca

SEQ ID NO: 256538 - RNA, 64 nt, Human
auacccucuggguguugagagguuuagccacaugagggagcagaggacaaucucugcagggcug

SEQ ID NO: 256539 - RNA, 64 nt, Human
auuucucaacauagcacacuugugcacugagaggagggagcauuaugggaaagucccugccuuc

SEQ ID NO: 256540 - RNA, 64 nt, Human
gccccuuggggccugcgcccgugaaacuggugccagggagcacugccagcuugccaguuucugc

SEQ ID NO: 256541 - RNA, 64 nt, Human
gugcccagcacucggauucuccuggacaccaucgagggagcaggagcaucaggcggccggcgca

SEQ ID NO: 256542 - RNA, 64 nt, Human
gacaggagacccagagagcuagggcuggagggacagggagcagggcagaaaacacagccugugu

SEQ ID NO: 256543 - RNA, 64 nt, Human
cccucaggcagccaaagcacuuuaaccccugcauagggagcagagggcgguacggcuucuggau

SEQ ID NO: 256544 - RNA, 64 nt, Human
gagggaccucucccagggucccugggguggggauagggagcagaugcaaugacucaggacaucc

SEQ ID NO: 256545 - RNA, 64 nt, Human
gggcggguauagauuggccugggaguguuacaguagggagcaggcuucucccuucuuucuggga

SEQ ID NO: 256546 - RNA, 64 nt, Human
ugaaagguucaaggacacuggccuugcaggcccgagggagcagccaucacaaacucacagacca

SEQ ID NO: 256547 - RNA, 64 nt, Human
gaggagggaggaggaauaaggggaaggaagagagagggagcaggcggagcgagagagggagaaa

SEQ ID NO: 256548 - RNA, 64 nt, Human
gcgccuggccagagccgggguuccaggacagggaagggagcaggagccugcagucacuggcuug

SEQ ID NO: 256549 - RNA, 64 nt, Human
caggaagccuggagccaagaaccuucuggcucugagggagcaagagcuggcaggcggcagggcu

SEQ ID NO: 256550 - RNA, 64 nt, Human
ugggugaccggggagaaacagggcagacuggguaagggagcagggcuuacugagcaguggguug

SEQ ID NO: 256551 - RNA, 64 nt, Human
cagcuguggcgggaggugcagagcagagggcuuuagggagcagugacugcggucaccccuuuag

SEQ ID NO: 256552 - RNA, 60 nt, Human
auuuuuguuauugguuaaggagacaauuuuggagagcaagcaaaucuuuuuaaaaaauag

SEQ ID NO: 256553 - RNA, 60 nt, Human
gggaaguuucguaugcacucccuugaggauggagagcagccagcacccaccugguacuga

SEQ ID NO: 256554 - RNA, 60 nt, Human
gacaguaccucugugucuaugagaaagcggggagagcaacaccccagcuucuagcagcuc

SEQ ID NO: 256555 - RNA, 60 nt, Human
cgugguuucaaacaucaacuuggaauucuuggagagcauuccuuguaguuaagcagggac

SEQ ID NO: 256556 - RNA, 64 nt, Human
ggaccagaugucccuccccucaugagcgugcaacagggagcagccccagccagccccaccgccg

SEQ ID NO: 256557 - RNA, 64 nt, Human
cccagccugcucccccauccacacuuggaaauugagggagcaugaccgcucucugacuucacau

SEQ ID NO: 256558 - RNA, 64 nt, Human
uucugcaccaccucacaauuuuccugaaccccaaagggagcagagagauaagaggacagaagaa

SEQ ID NO: 256559 - RNA, 64 nt, Human
uggagcugcauugaugaauuggcucaguauuuaaagggagcaaacuuuuugauaauaaaucuuu

SEQ ID NO: 256560 - RNA, 64 nt, Human
gagccagcgggacgccgcacgcggccccagacucagggagcagggccaggcgggcucgggggcc

SEQ ID NO: 256561 - RNA, 64 nt, Human
gccuucugggcccaugaguaauaaugagcacacuagggagcaucucuguaaacacaguggcugg

SEQ ID NO: 256562 - RNA, 64 nt, Human
uuugauuauaugugauugacaauguguauuuuugagggagcaaagauuucuguacauauuucuu

SEQ ID NO: 256563 - RNA, 64 nt, Human
uggacggcugggcacacgccucccacugggguccagggagcaggcggugggcacccacccuggg

SEQ ID NO: 256564 - RNA, 64 nt, Human
aguuguaccugacucauuuuucucaggugucuccagggagcaggacccauggagggaccccugg

SEQ ID NO: 256565 - RNA, 64 nt, Human
aggggcccaggcucugagcuccacaggucugagcagggagcaacucaggcccccacccaagccu

SEQ ID NO: 256566 - RNA, 64 nt, Human
guuuuaggcacagcaaauggcacauacaagggccagggagcaagagagaggacagguccucaac

SEQ ID NO: 256567 - RNA, 64 nt, Human
uccuuccucauuugcaaggugaacacuuccuucuagggagcacccucccaccccccaccccccc

SEQ ID NO: 256568 - RNA, 64 nt, Human
ggagccauccgccccccucagccccuuccuccccagggagcaaagccauaaggggcaggggcca

SEQ ID NO: 256569 - RNA, 64 nt, Human
aggccuggagggucagaugggagaccaggucccaagggagcaagaccucgcgaagcgcagcagc

SEQ ID NO: 256570 - RNA, 55 nt, Human
ggcccaagaacagcuccugagcaccagggagcaggcaggggccucaggcuccucu

SEQ ID NO: 256571 - RNA, 64 nt, Human
uguuuaccaacuggggcggggguggggggggcccagggagcagggcuuaggggcuagcagccca

SEQ ID NO: 256572 - RNA, 60 nt, Human
ggagccccuuccacccaaucccaucucgcaggagagcagggucugggcuccugccucacc

SEQ ID NO: 256573 - RNA, 60 nt, Human
agcacaggccccucuguugggggauggggaggagagcagucugcccuugggagcguaggc

SEQ ID NO: 256574 - RNA, 60 nt, Human
cucugaucuaaacgguaaaacaagcugccuggagagcagcuguaccuaacaauacuguaa

SEQ ID NO: 256575 - RNA, 60 nt, Human
cggauggaaugugcugggccacuguuggguggagagcagcacauucuuacagaggagaug

SEQ ID NO: 256576 - RNA, 64 nt, Human
cuccgcagccagaaaugcugccggcugcacccagagggagcagugaggcaggacagauggacag

SEQ ID NO: 256577 - RNA, 64 nt, Human
ggagcggugagugcgagccgcccgccaaggcugcagggagcaccaccaggagcccagugucuga

SEQ ID NO: 256578 - RNA, 64 nt, Human
uugagggucgagcagcaggggcccauucagucccagggagcagagacccccccaaccccuucac

SEQ ID NO: 256579 - RNA, 64 nt, Human
uugccggcauguuuuggggguaaugaucgugggcagggagcagagguccgcugaggcagucugu

SEQ ID NO: 256580 - RNA, 64 nt, Human
auaagagagggcuuauaaaucccucugccgacgcagggagcagagacuugccggcauguuuugg

SEQ ID NO: 256581 - RNA, 64 nt, Human
uccccaccgugaccugccuggccuccccugucucagggagcaggucacaggucaccauggggaa

SEQ ID NO: 256582 - RNA, 64 nt, Human
gacggugggagcaugggcuuaggaugugaaugccagggagcaauaaagguauccgugguaucgg

SEQ ID NO: 256583 - RNA, 64 nt, Human
auaaauuccuugagggcauugacuuuuacaaaagagggagcagcaauggccuagagucucagga

SEQ ID NO: 256584 - RNA, 64 nt, Human
aucauuccuaacgaccuugaucuggagaauguggagggagcaugucccugaauuuuccuagauc

SEQ ID NO: 256585 - RNA, 64 nt, Human
cagcccagaggaaugcugagaaaucaccuggaggagggagcagaaagagaagguuuuuaaggag

SEQ ID NO: 256586 - RNA, 64 nt, Human
ggggccuucgaugggcuuuucuucuugucaguggagggagcagcuccccacucagcccugggac

SEQ ID NO: 256587 - RNA, 64 nt, Human
ggaagagcagcuggaggguggauggggaggccagagggagcaaugagggguggucccagcucug

SEQ ID NO: 256588 - RNA, 64 nt, Human
ugcugaauccuuucuggggacuuucucaucgggcagggagcagagggcuucucguucaugcacc

SEQ ID NO: 256589 - RNA, 64 nt, Human
gaacuuuauugacauuuugcaaaugaaguuacuuagggagcagauaauuuaauucaugauggaa

SEQ ID NO: 256590 - RNA, 64 nt, Human
uaagaccucucugaagagcugucaugaaggagggagggagcacauuccuggcagagaaaacagc

SEQ ID NO: 256591 - RNA, 64 nt, Human
agaugcggacaggacagacacguugagaagcugcagggagcagggcaccaagggagugugcacu

SEQ ID NO: 256592 - RNA, 60 nt, Human
ccacuucuaugggucugagcuguggaaaagggagagcagagaggaacugagaugagcagg

SEQ ID NO: 256593 - RNA, 60 nt, Human
acugaagucuaaggggcugagaccaagaagggagagcacaagacuaacuuuggucucuug

SEQ ID NO: 256594 - RNA, 60 nt, Human
auauuuuggacugcuguuuuccauuaaugaggagagcaacaggccccugauuauacaguu

SEQ ID NO: 256595 - RNA, 64 nt, Human
uccgcucaguguggcuccucagcccacagaggggagggagcauggggccaggugccagucaucu

SEQ ID NO: 256596 - RNA, 64 nt, Human
ggcggcacgccaacagccccccccuugaaucugcagggagcaacucuccacuccauauuuauuu

SEQ ID NO: 256597 - RNA, 64 nt, Human
gggggcagcuugcugacccucaacugggggggugagggagcaucaggagguccaggcguggggc

SEQ ID NO: 256598 - RNA, 64 nt, Human
uagguugaaggaaagauuucuccucucaagugccagggagcagccacacgucugucuguguuua

SEQ ID NO: 256599 - RNA, 64 nt, Human
guacaauguucccuuguggccaaauuucccucccagggagcaauuucagugcuaggaucauugg

SEQ ID NO: 256600 - RNA, 64 nt, Human
accuuucuucguugugguggggauggaagagcagagggagcauggcccagggguguugaggcca

SEQ ID NO: 256601 - RNA, 64 nt, Human
uuucuguaugacauuuuuuuuuuuuucagagggcagggagcaauuuuucuauggcaugugacag

SEQ ID NO: 256602 - RNA, 64 nt, Human
ggucacucaauccuggccugggggagaaugcuggagggagcacgccgcugagaugcccccaccc

SEQ ID NO: 256603 - RNA, 53 nt, Human
gcuaccgcauccgcccaugacacagggagcagauggauccacgugcucgccuc

SEQ ID NO: 256604 - RNA, 64 nt, Human
ugugaauggccggugauguaugucaggaggccacagggagcagaggagcggggcaggcagccac

SEQ ID NO: 256605 - RNA, 64 nt, Human
ccccuccaggccaggguccuggggcaggcaucucagggagcagccagcccaggccuccugccgu

SEQ ID NO: 256606 - RNA, 64 nt, Human
aaugcacuuaggauguuucugcaucaugucuaccagggagcaggguuccccacaguuucagagg

SEQ ID NO: 256607 - RNA, 64 nt, Human
ugagaaaucaauuauucccacaggauuuuaggucagggagcaaaaaucucagaacuugaccaug

SEQ ID NO: 256608 - RNA, 64 nt, Human
uuggauccuccagauagccacugccuuuuccucaagggagcaacguuagcuuuccugaaugaug

SEQ ID NO: 256609 - RNA, 64 nt, Human
cagccgggggccguggccacauuaccucagcgggagggagcagagcugggacaggcagcuaaaa

SEQ ID NO: 256610 - RNA, 64 nt, Human
ucacggcauuccugcugagcaccguggggcacccagggagcaggggcgucagggauccugcugc

SEQ ID NO: 256611 - RNA, 60 nt, Human
uggggugcaggaaaagccagagaagccgguggagagcagcaccuuuaagagcccucucuc

SEQ ID NO: 256612 - RNA, 60 nt, Human
guaauacuggaggcagaguagggggugguuggagagcaguuaguacaaagaggcagaaca

SEQ ID NO: 256613 - RNA, 60 nt, Human
ugcuuuccagcaggcguaguauauuuagucggagagcacaucuguaugcgacaacuugau

SEQ ID NO: 256614 - RNA, 60 nt, Human
auauuuucaacuugggggacagagagaaauggagagcaggaauuacaguuccaacaaaca

SEQ ID NO: 256615 - RNA, 64 nt, Human
ggggugaggccugggcagccggagggcagggcucagggagcaggaggcugcauccguccacccc

SEQ ID NO: 256616 - RNA, 64 nt, Human
agaaucagccuuuagaguuacaagccccuggaaaagggagcaggucccauacaaucagccuuuc

SEQ ID NO: 256617 - RNA, 64 nt, Human
uuucagaaccuuuggccagcaggagagaggugguagggagcagccagccggcaaaggaaggagg

SEQ ID NO: 256618 - RNA, 64 nt, Human
cccuguccacccaguguccacuggccuguccuucagggagcagagcagagcaggugguggacgg

SEQ ID NO: 256619 - RNA, 64 nt, Human
aagagcugagcucagaggcagagaagcuccuugcagggagcacugggagauggccuggcccguc

SEQ ID NO: 256620 - RNA, 64 nt, Human
ggcuuucucugggggacagcagucucugagcaccagggagcaguugcccucaggccugugccca

SEQ ID NO: 256621 - RNA, 64 nt, Human
gccaugucuucacugaaauugcaaaaguacuuuuagggagcaggaguuuauuugacaucuaguu

SEQ ID NO: 256622 - RNA, 64 nt, Human
cccgcagaagcuacagcugccaggucaugcacgaagggagcaccguggagaagacgguggcccc

SEQ ID NO: 256623 - RNA, 64 nt, Human
gccucugccccacauggggcccuaccccacuuccagggagcacagcagccucugacccuagccc

SEQ ID NO: 256624 - RNA, 64 nt, Human
uuuguagggcugccaggcugcagccugcugcuccagggagcaccagcugcagcugauccaauac

SEQ ID NO: 256625 - RNA, 64 nt, Human
ugcaggguguguacugcacaaggacauuguaugcagggagcacuguucacaucauagauaaagc

SEQ ID NO: 256626 - RNA, 64 nt, Human
cucuaggaggccaggcaagcauggacaggagccaagggagcagggucauuaacuuuuucuucuu

SEQ ID NO: 256627 - RNA, 64 nt, Human
cugccagaaaacaugccuacuacuaccagcagaaagggagcagagcccagagcaucaccaggag

SEQ ID NO: 256628 - RNA, 64 nt, Human
uuauuuuccugccuuggcagaggaggaggagucaagggagcagggcagcucuaccaggcaaggu

SEQ ID NO: 256629 - RNA, 64 nt, Human
aaagcagcgaagagccgcgcgcccucuggccucaagggagcauuggcagaaccauaagguacug

SEQ ID NO: 256630 - RNA, 64 nt, Human
cuggccagcugcccaccccagugccaggugggagagggagcagaacagccagccccuuccaggu

SEQ ID NO: 256631 - RNA, 60 nt, Human
cucucugggccgguucccugcagacccgcaggagagcacaugugccuugcaugaagugug

SEQ ID NO: 256632 - RNA, 60 nt, Human
ccuuccuugugaguagcucucaacuguccuggagagcagaggcuauuuggggucggagga

SEQ ID NO: 256633 - RNA, 60 nt, Human
aagaugaaugcuggguggguguguccaggaggagagcaggggagagagugagcgugagcu

SEQ ID NO: 256634 - RNA, 60 nt, Human
uuuugucuucagcaagcagggcaagcaccuggagagcaugcggcugccccugguuucaga

SEQ ID NO: 256635 - RNA, 64 nt, Human
ucuuggguaggguaguggcugggguggagugggaagggagcauugcagccuaagaagaaggcca

SEQ ID NO: 256636 - RNA, 64 nt, Human
uucaucaauucuuaaauuucuuaaccuaggcuucagggagcauaugaaaccaaaauuauaugga

SEQ ID NO: 256637 - RNA, 64 nt, Human
caucuuuauuuuagaguuuuaaugaauucaaggaagggagcauagcauaucuguggcaaacuau

SEQ ID NO: 256638 - RNA, 64 nt, Human
ggcugcagcagaggccugaggaguggcaggaaagagggagcaggugcccccaggugagacagcg

SEQ ID NO: 256639 - RNA, 64 nt, Human
cuucagauguucucucccaggggcuggcuucaggagggagcauagaaggcaggugagcaaccag

SEQ ID NO: 256640 - RNA, 64 nt, Human
auacaguuuccuaaagccuggcuuugaaugcagaagggagcagcuccuccuaguuaaguuucca

SEQ ID NO: 256641 - RNA, 64 nt, Human
ggcugucucagauaaauuaugguaaaauuuuguaagggagcagacuuuuaaagacuugcacaaa

SEQ ID NO: 256642 - RNA, 64 nt, Human
ggagagcuggggaccagcagucugccuggaggccagggagcaguggcugaguagcucugccuuu

SEQ ID NO: 256643 - RNA, 64 nt, Human
acagguguauuucuugcuaugcucagugggaaccagggagcagaaaagauuguggaaaguggga

SEQ ID NO: 256644 - RNA, 64 nt, Human
aguauaaggaaauguuucuuuauggccauuuuggagggagcaggggaugaggcuuggcauaguc

SEQ ID NO: 256645 - RNA, 64 nt, Human
aaagcuaaggcuggguaagaauaguugugcagggagggagcacgagaugggcagagcugguucc

SEQ ID NO: 256646 - RNA, 64 nt, Human
ggaggagcugagugugaugaagguguauguugggagggagcacagugucuguggggagcccagg

SEQ ID NO: 256647 - RNA, 64 nt, Human
uccaggcccgaagcaugaacagugcaccugggacagggagcagccccaaauugucaccugcuuc

SEQ ID NO: 256648 - RNA, 64 nt, Human
uccaggcuugcacugaagacgugccacggggaggcuccugcaggaggcucaacccgacggauca

SEQ ID NO: 256649 - RNA, 64 nt, Human
gcaggccccacagaggcagaggcugcuggcugaccuccugcacaacgucagccagaacaucgcg

SEQ ID NO: 256650 - RNA, 64 nt, Human
uggccacagugcccagacccauguaacccacuggcuccugcauuaacccagaaauaccucgcuu

SEQ ID NO: 256651 - RNA, 60 nt, Human
uacaagacugcaggaauucuccuuaagggaggagagcaagcagguguggccccagcuucu

SEQ ID NO: 256652 - RNA, 60 nt, Human
gcccuguccacaccaugccucuccugcacuggagagcagugcuggcccagccccugcggc

SEQ ID NO: 256653 - RNA, 60 nt, Human
ugccccaaggcccagagcuccccccagacuggagagcaagcccagcccagccucggcaua

SEQ ID NO: 256654 - RNA, 60 nt, Human
aggcggccagggcaguuguugggugaauguggagagcacauggccaugucuugcccccgg

SEQ ID NO: 256655 - RNA, 64 nt, Human
gcaaccaguagcugcugggcccguggccugaacccuccugcacuccuccagcuggagucucacc

SEQ ID NO: 256656 - RNA, 64 nt, Human
ucccgcggggacaccagcacugagcccccucucccuccugcaauaauucggggagucucagccc

SEQ ID NO: 256657 - RNA, 64 nt, Human
uucccuccucccaagacccuugucugcaguggugcuccugcaggcugcccguuaagaugguggc

SEQ ID NO: 256658 - RNA, 64 nt, Human
gucguagugccuucaggguccgaggagcaucaggcuccugcagagccccauccccccgccacac

SEQ ID NO: 256659 - RNA, 64 nt, Human
cuucagaauggagaucuccucucaucagucucaccuccugcagcaacugaacgagcagcgcagg

SEQ ID NO: 256660 - RNA, 64 nt, Human
aauccucccugcucucugagcugcugccuuuugccuccugcaacucaacauccucuucacccug

SEQ ID NO: 256661 - RNA, 64 nt, Human
cuuccuccccagaggacccggccgaccucagcgccuccugcaggcuaggacacuggugcacuac

SEQ ID NO: 256662 - RNA, 64 nt, Human
uuggucuuccccaggcacgagaggucgugcgcuccuccugcaucaaccuguaugggaagguggu

SEQ ID NO: 256663 - RNA, 64 nt, Human
cgggcuuagaucaaucucaauuccuuuucaugcccuccugcauugcugcugcguggguauuugu

SEQ ID NO: 256664 - RNA, 64 nt, Human
uugcuuuaacacuggaagauuuaaagaauaaaaacuccugcauaaacgauuucaggaauuugua

SEQ ID NO: 256665 - RNA, 64 nt, Human
uugcaugacagcauugacugguuuacaggcccugcuccugcagcauggccccugccuuaggccu

SEQ ID NO: 256666 - RNA, 64 nt, Human
ugaaggagcagcauugacugguuuacaggcccugcuccugcagcauggucccugccuuaggccu

SEQ ID NO: 256667 - RNA, 64 nt, Human; identical to SEQ ID NO: 256666

SEQ ID NO: 256668 - RNA, 64 nt, Human
uguccuuggcccugccugggguguguggugugugcuccugcaucuugucugggagugcagugac

SEQ ID NO: 256669 - RNA, 64 nt, Human
ccuucaagcugugaaauuguccuuguacucucagcuccugcauggaucugggucaaguagaagg

SEQ ID NO: 256670 - RNA, 64 nt, Human
cuucugaacggcauaaguccuauuuuagccuuaccuccugcauuugcaauacguaauacugauc

SEQ ID NO: 256671 - RNA, 60 nt, Human
ucuuuuagcccacugaugcuuacuuaggccggagagcaggggacacggugcuagguuccc

SEQ ID NO: 256672 - RNA, 60 nt, Human
ggcauuugaacuuguccuucuauuuacucaggagagcaggagcuaccuguaagcccuggu

SEQ ID NO: 256673 - RNA, 60 nt, Human
ccagggcgccucucugugccagggaggcugggagagcagcaagggggaccaggugcgcca

SEQ ID NO: 256674 - RNA, 60 nt, Human
gccugcuggcugcucucccaggggccagguggagagcagugccccccgacacauguauuc

SEQ ID NO: 256675 - RNA, 64 nt, Human
uacuugcuccaucugcagccuacgcugcccuggccuccugcagacagauagugggguuaccugg

SEQ ID NO: 256676 - RNA, 64 nt, Human
uagacauccucaccaucuccauccgcucucacgccuccugcaggaucugggagugaggguggag

SEQ ID NO: 256677 - RNA, 64 nt, Human
aggauuuauuuaaauaaaauaugcuuauuaaacacuccugcaaagaugguuuuauuaguacccu

SEQ ID NO: 256678 - RNA, 64 nt, Human
caaugcagggcugguucuuuuaccccuugguuuacuccugcacuugucuuacucauucugaauc

SEQ ID NO: 256679 - RNA, 64 nt, Human
ggcggaugccccuuccccuuagcacuacccuggccuccugcauccccucgccucauguuccucc

SEQ ID NO: 256680 - RNA, 64 nt, Human
ccagucucagacacuaaaugcagacaacaccuuccuccugcagacaccuggacugagccaagga

SEQ ID NO: 256681 - RNA, 64 nt, Human
ggcuuauggccaggggacacuguaugacucuccucuccugcaggugucuauccaccugggguau

SEQ ID NO: 256682 - RNA, 64 nt, Human
ggagcgugaggcaggaagacacuaggugcugaaucuccugcaaaacuggcugccuggaggcccu

SEQ ID NO: 256683 - RNA, 64 nt, Human
agccacagcugccaggccugacauggccuugccucuccugcagucuuggugacugagacccuug

SEQ ID NO: 256684 - RNA, 64 nt, Human
caguaggaggguccgggaggcccugccguccugucuccugcaccauuggguggagucuggugau

SEQ ID NO: 256685 - RNA, 64 nt, Human
cgcagggcugcucccugaggccaagaagccucggcuccugcacggcacccugaucaugaaggac

SEQ ID NO: 256686 - RNA, 64 nt, Human
ggaagacccccucgggcucucggcugacccccaccuccugcacagcugugcccaggcccccagg

SEQ ID NO: 256687 - RNA, 64 nt, Human
gaaguuuucguaucacaguguuaaccuguacucucuccugcaaaccuacacaccaaagcuuuau

SEQ ID NO: 256688 - RNA, 64 nt, Human
cgugguacccagcagguggcacugcagcuccccgcuccugcagguccagcguccucacaggaac

SEQ ID NO: 256689 - RNA, 64 nt, Human
ucugagcgaggccucuuccugcugggcucccagacuccugcauccaggcccccaccuucucggc

SEQ ID NO: 256690 - RNA, 64 nt, Human
uugguauuggguaaaggagggggcaccugcaugucuccugcaaugagcaaggaauuaugucuca

SEQ ID NO: 256691 - RNA, 60 nt, Human
auucagaaacuaguagcuaacauugcuucuggagagcagaaauaagcaugucuucuggcu

SEQ ID NO: 256692 - RNA, 60 nt, Human
ugagugugcacccagcugaagagaagaaauggagagcagcaauuggagcuucaggaccgg

SEQ ID NO: 256693 - RNA, 60 nt, Human
ucaggaauugcaaaggcucugcugucacaaggagagcaggcugaguuuggagcagggucc

SEQ ID NO: 256694 - RNA, 60 nt, Human
guggggaguguuuuaacggaucgugucgcaggagagcacagcccagcguuggggccggga

SEQ ID NO: 256695 - RNA, 64 nt, Human
gucucuaacccuaaucucugggcuugcccuuugccuccugcagaacuuugaaaagcuggguuga

SEQ ID NO: 256696 - RNA, 64 nt, Human
acaaucugcuugugucucccucgcuggccugcuccuccugcagggccugugagcugcucacaac

SEQ ID NO: 256697 - RNA, 64 nt, Human
cgacugugucuuugggccacugcucaacuucccccuccugcaggggauccggguccaugggaug

SEQ ID NO: 256698 - RNA, 64 nt, Human
cugauggaaggaacaacagguggcccaggacaugcuccugcauacuccugggugucccagggac

SEQ ID NO: 256699 - RNA, 64 nt, Human
gccugccuccccuccgcagcagggaagcucuuuucuccugcagaaagggccacccaugauacuc

SEQ ID NO: 256700 - RNA, 64 nt, Human
gcuuaacaaaacccauuuuuuauaaauguccauccuccugcauuuguugauaccacuaacaaaa

SEQ ID NO: 256701 - RNA, 64 nt, Human
cuugacaggcugguaaugugcuggccaccuccagcuccugcaucgagucuguaaaccagagcug

SEQ ID NO: 256702 - RNA, 64 nt, Human
accgaccauagagcaagaaucaagauucugcuaacuccugcacagccccguccucuuccuuucu

SEQ ID NO: 256703 - RNA, 64 nt, Human
guuucuuuggaaaauggacauacuguauuguguucuccugcauauaucauuccuggagagagaa

SEQ ID NO: 256704 - RNA, 64 nt, Human
aaggguaaacugagcuagccccuggggcugaguacuccugcagggcuggaggaacagguucuua

SEQ ID NO: 256705 - RNA, 64 nt, Human
cuugaaccagaaccuagucccgagcagcaccgcucuccugcaccucccgccugcguugugccuc

SEQ ID NO: 256706 - RNA, 64 nt, Human
cuggguggggacagcacguccagccuucccaccucuccugcaggcuucuagacggaguuucaaa

SEQ ID NO: 256707 - RNA, 64 nt, Human
gugcugugacggcggggccucugggugcgaguuccuccugcauaugaaccgaggggaggaggag

SEQ ID NO: 256708 - RNA, 64 nt, Human
cacccacccuccucccaauuguuuccccuucacacuccugcacugguccuaucccccaggacug

SEQ ID NO: 256709 - RNA, 64 nt, Human
gccuccuggguuuucccugggggccgcaaucuggcuccugcaggccuuucuguggucuuccuuu

SEQ ID NO: 256710 - RNA, 64 nt, Human
agagaccuggaaagagaacucucccagggcccaucuccugcaucccaugaauacucuguacaca

SEQ ID NO: 256711 - RNA, 64 nt, Human; identical to SEQ ID NO: 141874

SEQ ID NO: 256712 - RNA, 64 nt, Human; identical to SEQ ID NO: 141875

SEQ ID NO: 256713 - RNA, 64 nt, Human; identical to SEQ ID NO: 141876

SEQ ID NO: 256714 - RNA, 64 nt, Human; identical to SEQ ID NO: 141877

SEQ ID NO: 256715 - RNA, 64 nt, Human
auuuagcaaauaugcagccuccgcaagaugagcucuccugcagacaagcauggucugaaacauu

SEQ ID NO: 256716 - RNA, 64 nt, Human
ggacucaugagcugucucuucaucucuccucucucuccugcaucucuccccuuacucuucaauu

SEQ ID NO: 256717 - RNA, 64 nt, Human
ucuacuaaugcucuucuggcuuuucuacaaaauacuccugcaauuccagcugccauuugcaaaa

SEQ ID NO: 256718 - RNA, 64 nt, Human
ccauucagagguguggcuuuuuccacgucuuuuucuccugcaaugaacugcucccacguccugc

SEQ ID NO: 256719 - RNA, 64 nt, Human
guggguggguggguuugauugagaacacuuugggcuccugcagugauggugggaaagaaaaauu

SEQ ID NO: 256720 - RNA, 64 nt, Human
uucuggguagaggaugcugaacugacucagcacccuccugcaggacgggguuagggaauuuggu

SEQ ID NO: 256721 - RNA, 64 nt, Human
uuugcacagugcacuuaugucuauuuuaacaauccuccugcaucuguauuuuauagucagccuu

SEQ ID NO: 256722 - RNA, 51 nt, Human
uugaggagggacucggcugagcuccugcacccaguguuucugucagucuuu

SEQ ID NO: 256723 - RNA, 64 nt, Human
ggacacagauccugaucccucuugcuucuuuucccuccugcaccgcagcuugccaucccugccc

SEQ ID NO: 256724 - RNA, 55 nt, Human
ccucccgaacugggaaguaaagagacuccugcauuccuccuccccuccugaggga

SEQ ID NO: 256725 - RNA, 64 nt, Human
cccagggauaaaaacagagaucauugucuuggaccuccugcaucagccuauucaaaauuaucuc

SEQ ID NO: 256726 - RNA, 64 nt, Human
cucagggagauguuggacugugccuggauccuuacuccugcauuguucuuugccagagaccuau

SEQ ID NO: 256727 - RNA, 53 nt, Human
ucaucaacaagguggugugauggcuccugcacaggcccugcacauaggaugag

SEQ ID NO: 256728 - RNA, 64 nt, Human
acaaucggaacgucaugcagaaggaauggccugacuccugcagugcagauuggaggccccagaa

SEQ ID NO: 256729 - RNA, 64 nt, Human
cuggggcagggcuucugauggccauuugcuuggccuccugcauuuuaguccaacucacagucca

SEQ ID NO: 256730 - RNA, 64 nt, Human
auggagaaacucucuaggccauccccucuucuaccuccugcaacccacccauccuauuagccuc

SEQ ID NO: 256731 - RNA, 64 nt, Human
gccauucaagacaaggaagagacacaugugugcacuccugcauguucaguucuguacuuccagu

SEQ ID NO: 256732 - RNA, 64 nt, Human; identical to SEQ ID NO: 141880

SEQ ID NO: 256733 - RNA, 64 nt, Human; identical to SEQ ID NO: 141881

SEQ ID NO: 256734 - RNA, 64 nt, Human; identical to SEQ ID NO: 141882

SEQ ID NO: 256735 - RNA, 64 nt, Human
aucacagaagguauauugcuaguuacacuuugcccuccugcaguuucuucucugcucccaaccc

SEQ ID NO: 256736 - RNA, 64 nt, Human
guuuauuuccuaugcugauucuggaggaguuaaccuccugcaaaaaaggcaucuugucccuaca

SEQ ID NO: 256737 - RNA, 64 nt, Human
uugccugacuguaccccguagaccccuguuucuccuccugcaccuguguccccaucugcccuuc

SEQ ID NO: 256738 - RNA, 64 nt, Human
uguuugccauuuucucacuggaugcccuggguagcuccugcagggucugccuguucccagggcu

SEQ ID NO: 256739 - RNA, 64 nt, Human
gaccccagugcccuccucagaagaagcacaugggcuccugcagcccuguccuggcaggugaugu

SEQ ID NO: 256740 - RNA, 64 nt, Human
ccggcugcagaggccagaggcccccagcccagggcuccugcacuuacuugcuuauuugacaacg

SEQ ID NO: 256741 - RNA, 64 nt, Human
ggacuguagggagggcggcaggggccuggagauccuccugcagaccacgcccguccugccugug

SEQ ID NO: 256742 - RNA, 64 nt, Human
uucccccucaccugguguucagacaccccaugcucuccugcagcucagggcaggugaccccauc

SEQ ID NO: 256743 - RNA, 64 nt, Human
uccagugaagagcagcaggcuguguuuguaaaaccuccugcaggaguaacuaagauuauaauuu

SEQ ID NO: 256744 - RNA, 64 nt, Human
guuccagugugguuaaccuuugccuuuggaauuacuccugcagaagguugccugccaccaccag

SEQ ID NO: 256745 - RNA, 64 nt, Human
uauguaaaaacccuuccaaugccuaagugucuuucuccugcaacuccaaacccagacucgccac

SEQ ID NO: 256746 - RNA, 64 nt, Human
cugcugcugugaagguauagcaccaccccagguccuccugcagugcggcauccccuuggcagcu

SEQ ID NO: 256747 - RNA, 64 nt, Human
ccguacccuuggucugucacuccugcuuuccuaacuccugcaguccaaggcagccaugaaucua

SEQ ID NO: 256748 - RNA, 64 nt, Human
acuugcagaauaugaacaucgacauuucugccuucuccugcauugcugcccuggcuauggucac

SEQ ID NO: 256749 - RNA, 64 nt, Human
uucccuccucccggcccgcugccgccacccaccucuccugcaggcugcgaccugcaguggcccg

SEQ ID NO: 256750 - RNA, 64 nt, Human
uagcuaaugauguacuucacaauccaccuuggaucuccugcauguccaaaucucaguaguuaau

SEQ ID NO: 256751 - RNA, 64 nt, Human; identical to SEQ ID NO: 141885

SEQ ID NO: 256752 - RNA, 64 nt, Human; identical to SEQ ID NO: 141886

SEQ ID NO: 256753 - RNA, 64 nt, Human; identical to SEQ ID NO: 141887

SEQ ID NO: 256754 - RNA, 64 nt, Human
ugggacccucaagaggaauaccacuuauguuacacuccugcacuaaaggcacguacugcagugu

SEQ ID NO: 256755 - RNA, 64 nt, Human
cucagacaucagaacaucacauuggaacggauuacuccugcauaacaagaucccauuucuuucc

SEQ ID NO: 256756 - RNA, 64 nt, Human
caguugucggaaagacaaaagcgauuucuucccacuccugcagggccagaaguucaggcugccc

SEQ ID NO: 256757 - RNA, 64 nt, Human
gccaccaggcccgggcccagcgcggccagugcuccuccugcacgcggcggacucggaggcgcag

SEQ ID NO: 256758 - RNA, 64 nt, Human
ccaggggcgucagucgauauucccagggccgcuucuccugcagucuguggagcguccuuguccc

SEQ ID NO: 256759 - RNA, 64 nt, Human
uaagccagugcggagcuguuagggacgggcccagcuccugcaccacggacacagaaugucugga

SEQ ID NO: 256760 - RNA, 64 nt, Human
acacugggccagagaggccugccuucugccugcucuccugcacugacccuuuggagggggucuc

SEQ ID NO: 256761 - RNA, 64 nt, Human
caaaagccucuauagaaaguccucugugaucugacuccugcagacucuuccagauuuuucugcc

SEQ ID NO: 256762 - RNA, 64 nt, Human
gugucuggaugaagcuggggcugcaagacugccucuccugcaaggcagcucauacuuguacugu

SEQ ID NO: 256763 - RNA, 64 nt, Human
ccuuucuuuccuuuaugcaguagaugcuuucuuccuccugcaguucuggaccauguggagcuac

SEQ ID NO: 256764 - RNA, 64 nt, Human
ugagaagggcaaggaguaacccauggccugcacccuccugcagugcaguugcugaggaacugag

SEQ ID NO: 256765 - RNA, 64 nt, Human
ugguucuuccaguuccucacggguuagguaggggcuccugcaucaccuucagaauccaguucca

SEQ ID NO: 256766 - RNA, 64 nt, Human
gagcugguugaagauguuuguaaucguuuucagucuccugcagguuucugugccccuguggugg

SEQ ID NO: 256767 - RNA, 64 nt, Human
uaagucacuuuuccccaggaaagaauauuucccucuccugcaucaagucugcguggccauccuc

SEQ ID NO: 256768 - RNA, 64 nt, Human
gagacggggucucacuuuccaggcuggccucaaacuccugcacucaagcaauucuucuacccug

SEQ ID NO: 256769 - RNA, 64 nt, Human
gucucccaggcucgagcaauccucccacuucacccuccugcauagcuaggacuacaggcaugug

SEQ ID NO: 256770 - RNA, 64 nt, Human; identical to SEQ ID NO: 141888

SEQ ID NO: 256771 - RNA, 60 nt, Human
ccacccuucacuucccgagggcgggugaguggagagcagagccaggagcucuggcagcug

SEQ ID NO: 256772 - RNA, 60 nt, Human
guacugcaagaaaagaagucaaucagcagaggagagcauuugauaacuaagaggaagacu

SEQ ID NO: 256773 - RNA, 60 nt, Human
agauacaguucacucugaaagcugguugaaggagagcagcaaaaauguaucagggguuuu

SEQ ID NO: 256774 - RNA, 64 nt, Human
uagucuccuaugcccuccaaaagucggguccuugcuccugcaugccaucagccccacucagccc

SEQ ID NO: 256775 - RNA, 64 nt, Human
cacugcagaccagcacggcaccuguggggaugggcuccugcagccuggggaggagugugacgac

SEQ ID NO: 256776 - RNA, 64 nt, Human
uccucuggccagaaauggccuccgaacugugcagcuccugcagcaccauuuguaucauagcaua

SEQ ID NO: 256777 - RNA, 64 nt, Human
gcgagcaggccacagccuggccucgggaagguggcuccugcaguucagcgucccugggcccauu

SEQ ID NO: 256778 - RNA, 64 nt, Human
uggagucgugggaaggaggggagccuuaccaagacuccugcaaaaacccuuggaccucuccacg

SEQ ID NO: 256779 - RNA, 64 nt, Human
aucacaggaagacuuuguaaggacaguuuaaguucuccugcaagguuuaauuuguuaucaugua

SEQ ID NO: 256780 - RNA, 64 nt, Human
aaccaacagucugucaguguacagcagcaguacucuccugcacagucucaagcaaccauauauu

SEQ ID NO: 256781 - RNA, 64 nt, Human
ggcauauucuuggcagcacuccacucaccuucagcuccugcaccgacaucaggaacccacggcc

SEQ ID NO: 256782 - RNA, 64 nt, Human
gguccuccagcgaggcccugucagcggucuuaggcuccugcacaugaaggugugugccuguggu

SEQ ID NO: 256783 - RNA, 64 nt, Human
gaaagugugcuguguugucauucaaggacuuccucuccugcaggccaacugaaauaccagaaaa

SEQ ID NO: 256784 - RNA, 64 nt, Human
gagggagcuguauuccuuuauacaaaucugauggcuccugcagcacuuuuuccuucugaaaaua

SEQ ID NO: 256785 - RNA, 64 nt, Human
ugaaaaaagcaagauugaaauuugaacuaugagucuccugcauggcaacaaaaugugugucacc

SEQ ID NO: 256786 - RNA, 64 nt, Human
gcagcuaugguucuguugguuuaacuugccggagcuccugcauauagaucacuuguaucaagug

SEQ ID NO: 256787 - RNA, 64 nt, Human
ucuguaccagcgcuuuauguuaauuaccaaaacucuccugcaucagagcaugauaucuauaaua

SEQ ID NO: 256788 - RNA, 64 nt, Human
cugaguaaggggacagcuccaggccggggccugucuccugcacagaguaagccgguaaauguuu

SEQ ID NO: 256789 - RNA, 64 nt, Human
cugcgggaggcugggagcccugcccugcccaucccuccugcaccagcgcugucccugcacacuu

SEQ ID NO: 256790 - RNA, 64 nt, Human; identical to SEQ ID NO: 141890

SEQ ID NO: 256791 - RNA, 64 nt, Human; identical to SEQ ID NO: 141891

SEQ ID NO: 256792 - RNA, 60 nt, Human
agccgagauugcaccacugcacuccagccuggagagcagagcaagacucugucucaaaaa

SEQ ID NO: 256793 - RNA, 60 nt, Human
acaaacaagacuccagugggguggucaguaggagagcacguucagagggaagagccaucu

SEQ ID NO: 256794 - RNA, 64 nt, Human
uauaaaucaaugucacuuaaaggcugugguaguacuccugcaaaauuuuauagcucaguuuauc

SEQ ID NO: 256795 - RNA, 64 nt, Human
ucauucccugcauuagcgagcaguuauuggguaccuccugcaugccuggucccauuccagacag

SEQ ID NO: 256796 - RNA, 64 nt, Human
gcagcugcucuugcaucugggccagaaguccucccuccugcaggcuggcuguuggccccucugc

SEQ ID NO: 256797 - RNA, 64 nt, Human
agaauugacaguugaacagagcuagaggccaugucuccugcauagcuuuucccuguccugacac

SEQ ID NO: 256798 - RNA, 64 nt, Human
uucagaugagaguugggucgcugagcauugguuacuccugcagaguguaaucagcaccccaucc

SEQ ID NO: 256799 - RNA, 64 nt, Human
gaagcccugggucugggugugaauuccaccuucccuccugcagugcugagaggcagcgaggacg

SEQ ID NO: 256800 - RNA, 64 nt, Human
uuuucagcaaauuccagauuuguuuccuuuuggccuccugcaaagucuccagaagaaaauuugc

SEQ ID NO: 256801 - RNA, 64 nt, Human
ccuguaaauucuccaacugauccuacccucccuacuccugcaccccaaauaugaacaacugcag

SEQ ID NO: 256802 - RNA, 64 nt, Human
ugcccuuuuauuguaccccaggccuccuagaggacuccugcagauucuauuguugggugggaaa

SEQ ID NO: 256803 - RNA, 64 nt, Human
aauguuuuaugcaaggcacaauaggaagucaguucuccugcacuuccuccucauguagucugga

SEQ ID NO: 256804 - RNA, 64 nt, Human
aaaucaaacaguuggauucagaaccaagaccuaacuccugcagagacagacucugaaugcauga

SEQ ID NO: 256805 - RNA, 64 nt, Human
ugucagggaaauuccauaaugaaguagaaugcugcuccugcauuaagauuucauugagggcaag

SEQ ID NO: 256806 - RNA, 64 nt, Human
gggcaggaaccuggcgccgccaccgagacugagccuccugcagacgggcgaagccgccugcugc

SEQ ID NO: 256807 - RNA, 64 nt, Human
cuucucuucgacuuccugaaagcgaaagcuuuaccuccugcaaaugucagcacauguaguagga

SEQ ID NO: 256808 - RNA, 64 nt, Human
cucugggcuucauccauuaagauucauccuuaugcuccugcaaguuucuuauauuuauguauuu

SEQ ID NO: 256809 - RNA, 64 nt, Human
uguccucuguccgucuguccugcgccugcgccuccuccugcaugucggggccccugcguguguu

SEQ ID NO: 256810 - RNA, 64 nt, Human; identical to SEQ ID NO: 141872

SEQ ID NO: 256811 - RNA, 60 nt, Human
gagaccaagagagugcgguggggaugggggggagagcacggguccccgucugacaguggc

SEQ ID NO: 256812 - RNA, 60 nt, Human
cucaggcuuuucucagacaugcgggagccaggagagcacccuucuccacucagcuccaaa

SEQ ID NO: 256813 - RNA, 60 nt, Human
ccuaaccucuccuggccaaucccccccgccggagagcaggacacuagggaggacccccag

SEQ ID NO: 256814 - RNA, 64 nt, Human
cgggcggggcgagggcggcggggccugggucccccuccugcacgcggacuccgggguucggauc

SEQ ID NO: 256815 - RNA, 64 nt, Human
caguccuaucccucgucagcguguggagacccagcuccugcagcccuccugcucccacgccccc

SEQ ID NO: 256816 - RNA, 64 nt, Human
gggcccccgugucccgucugcucucagccuccuccuccugcaggauaaagucauccccaaggcu

SEQ ID NO: 256817 - RNA, 64 nt, Human
guuacucaggaugaacucucugagcagggaccugcuccugcagcaaccaaacuuggagugguua

SEQ ID NO: 256818 - RNA, 64 nt, Human
guggcuuuaucaccaccgagugaugugcugaggccuccugcagugaaugcuccuuccauuccug

SEQ ID NO: 256819 - RNA, 64 nt, Human
uuccucauggaauugaaccugacauuuucuggaucuccugcaugucaggagcaucagugaggcu

SEQ ID NO: 256820 - RNA, 64 nt, Human
cacugcacccuccgccucucggguucaagcaauucuccugcaucagccucccgaguagcuggca

SEQ ID NO: 256821 - RNA, 64 nt, Human
ugagccacuggccacuccuggcuucuccuugucccuccugcagccucugcucagaacgcccuuc

SEQ ID NO: 256822 - RNA, 64 nt, Human
uaccacaagacauuucuuucuguuuuguuuuuuucuccugcaaauuuaguuuguuaaagccugu

SEQ ID NO: 256823 - RNA, 64 nt, Human
uuuagaauuauugugaaguuuaaaaauagccuuucuccugcaaauuuuccuagucuuuaguaac

SEQ ID NO: 256824 - RNA, 64 nt, Human
uguucugaguggagcuacuaggaugucuuccagccuccugcagucaaggaguaccacuguauug

SEQ ID NO: 256825 - RNA, 64 nt, Human
gggcaaaagggacaaagagggcaaaugagaucaccuccugcagcccaccacuccagcaccugug

SEQ ID NO: 256826 - RNA, 64 nt, Human
gucccuucccccugaagcaauagccccuccccaccuccugcaauacgccuuuccaaucuuuauu

SEQ ID NO: 256827 - RNA, 64 nt, Human
cucugccaugggaacgaguguaaaccguggcugucuccugcagugagccaccgcggcaggcacg

SEQ ID NO: 256828 - RNA, 64 nt, Human
uccugaauccuguucucugacauccguggagccccuccugcauccaccuaugccuccuauaagu

SEQ ID NO: 256829 - RNA, 64 nt, Human
agugcugguucuccucgcggugcugccugugcuccuccugcagaucacuguuggccucaucuuc

SEQ ID NO: 256830 - RNA, 64 nt, Human; identical to SEQ ID NO: 141868

SEQ ID NO: 256831 - RNA, 64 nt, Human; identical to SEQ ID NO: 141878

SEQ ID NO: 256832 - RNA, 60 nt, Human
ccggcagguccuguguccccugcaccuggaggagagcaggcuagaggcacagcggccaca

SEQ ID NO: 256833 - RNA, 60 nt, Human
uuuugcuaauuuuuagcuaauaucuagccaggagagcaagcacauaggacagacugaaag

SEQ ID NO: 256834 - RNA, 64 nt, Human
agccacugcaccucgccagauguccaaugucugacuccugcauaccaagguguucuguaucaag

SEQ ID NO: 256835 - RNA, 64 nt, Human
cuucuaggccucuggaccgcagaugcccuccucccuccugcacaccuggccuccugggccucca

SEQ ID NO: 256836 - RNA, 64 nt, Human
uacccacuaaagcuugagguggauguuggcuucacuccugcagcacaaugcuggcccuagaaag

SEQ ID NO: 256837 - RNA, 64 nt, Human
aggaauggauguggggacucuuccuggguucuggcuccugcauagcucaccccaccucaucaug

SEQ ID NO: 256838 - RNA, 64 nt, Human
uuguauuaucugugcauuaaugguccucaucugacuccugcauugugucuuauuuuucugcaug

SEQ ID NO: 256839 - RNA, 64 nt, Human
cagauguauggcuaaccggaaacaggugggucaccuccugcaagaaguggggccucgagcuguc

SEQ ID NO: 256840 - RNA, 64 nt, Human
uucugccacuuucugucggugcuaauggauggaacuccugcacaaguuuuaacugaacaagaaa

SEQ ID NO: 256841 - RNA, 64 nt, Human
acccucaucaugcaccacuuuagccaaauucugucuccugcauacacuccggcaugcauccaac

SEQ ID NO: 256842 - RNA, 64 nt, Human
cacugcaaccuccgccucccagguucaagcgauucuccugcagccucccgaguagcugggauua

SEQ ID NO: 256843 - RNA, 64 nt, Human
cuacaguuguccagaucacugaauuggaacuuuucuccugcauguguauauaugucaaauuguc

SEQ ID NO: 256844 - RNA, 64 nt, Human
cuguuuucugauugcgcucuucacaauuaaaggccuccugcaaaccuuucccagucuccugcau

SEQ ID NO: 256845 - RNA, 64 nt, Human
gcccuuugccuguggaauguauuucacucauucucuccugcacgcuguuaggcaguucuuucac

SEQ ID NO: 256846 - RNA, 64 nt, Human
guaucacugacagagagcagugcuuccagaguuccuccugcaccugugcuggggaguaggaggc

SEQ ID NO: 256847 - RNA, 64 nt, Human
ccuuuuccuguuccuccaauccccagauccaccacuccugcacaugccauacacauuuagaagc

SEQ ID NO: 256848 - RNA, 64 nt, Human
uaacacuguguacauauugucaguaguuuaugagcuccugcauaguaugcagaguguguggccu

SEQ ID NO: 256849 - RNA, 64 nt, Human
ucaccugaguuuuaauguuuuuaaacaaaguuuucuccugcagugcuuuucuauaugaaauagu

SEQ ID NO: 256850 - RNA, 64 nt, Human; identical to SEQ ID NO: 141854

SEQ ID NO: 256851 - RNA, 60 nt, Human
cugugucacacagguauuucuugguccucuggagagcagaggacucacucagcucuuugc

SEQ ID NO: 256852 - RNA, 60 nt, Human
ccacacucguuccccauuggcaagauacauggagagcacccugaggaccuuuaaaaggca

SEQ ID NO: 256853 - RNA, 60 nt, Human
ucagcucccaacgagccuccucaggggguaggagagcacugccucuaugcccugcagagc

SEQ ID NO: 256854 - RNA, 64 nt, Human
uucguuagaaagcggacgcuguucuaaaaaaggucuccugcagaucugucugggcugugaugac

SEQ ID NO: 256855 - RNA, 64 nt, Human
ggcgauggcccagguggguggccgcgacgguggccuccugcagagcugggacccgguccuacau

SEQ ID NO: 256856 - RNA, 64 nt, Human
agggucuccccagggcuccucccccugcacaacacuccugcacacgugcaaaccugcuguccuc

SEQ ID NO: 256857 - RNA, 64 nt, Human
ggccaggaccgagcucuuccugcuguuugccggccuccugcagagguaccgccugcugcccccg

SEQ ID NO: 256858 - RNA, 64 nt, Human
agcgugcgagcccugcaccccccagguccugggacuccugcagaccccacuccauucccgcucc

SEQ ID NO: 256859 - RNA, 64 nt, Human
gugaaggccuagcccuguggcuuccaccagucuccuccugcagugccacgugguggcauuucuc

SEQ ID NO: 256860 - RNA, 64 nt, Human
ccuugcuugaccccaucucugguuccugcccuggcuccugcaccagccccagcuccugccuaca

SEQ ID NO: 256861 - RNA, 64 nt, Human
acacugucacuggaugucauggggccaauaaaaucuccugcaauuguguaucucagacauuugu

SEQ ID NO: 256862 - RNA, 64 nt, Human
gccuccagucaccucaccuagcucacugcucucucuccugcaaagucucuccugcuucccuccc

SEQ ID NO: 256863 - RNA, 64 nt, Human
gcgcugggagugagugcauggugcuuugucccagcuccugcacccacaggcccccucagggcuc

SEQ ID NO: 256864 - RNA, 64 nt, Human
aacucucuuucgcaggcuccuuugaacaacucagcuccugcaaaagcuuccgucccugaggcaa

SEQ ID NO: 256865 - RNA, 64 nt, Human
ugcccuguccugagccuggaaaaugugaaacugucuccugcaaccugcugggcaugugggccug

SEQ ID NO: 256866 - RNA, 64 nt, Human
gaagaaaagguauuaguguuaaacucuuaaucgacuccugcaaaucuauaccagugagaaaucu

SEQ ID NO: 256867 - RNA, 64 nt, Human
ucuugguggcccagcuuggccagcacacacuuuccuccugcagcacccccugcugaaggggucc

SEQ ID NO: 256868 - RNA, 64 nt, Human
ugcccauaugagcacggcuccccauggccacauacuccugcaaagcuuuuaugcugcuucgcuu

SEQ ID NO: 256869 - RNA, 64 nt, Human
auuuugcacaguuaccugcacaccgagucacggacuccugcaucguggcacuccucucgcaugg

SEQ ID NO: 256870 - RNA, 64 nt, Human; identical to SEQ ID NO: 141845

SEQ ID NO: 256871 - RNA, 64 nt, Human; identical to SEQ ID NO: 141865

SEQ ID NO: 256872 - RNA, 64 nt, Human; identical to SEQ ID NO: 141883

SEQ ID NO: 256873 - RNA, 64 nt, Human
uccagcuguggcuccaucugcccagcuugccugccuccugcacccacugcccugaccuuccugc

SEQ ID NO: 256874 - RNA, 64 nt, Human
ggcccgcagccucacccggcucccucuccucacccuccugcaccuaacucccuccuccuucucc

SEQ ID NO: 256875 - RNA, 64 nt, Human
uaaguaaguuagagagaaaacauuguaugaucagcuccugcacuugaucuaucuaucuuuggcu

SEQ ID NO: 256876 - RNA, 64 nt, Human
agugucucauuaguugcacugcaguuaacuguggcuccugcagggcacccugcccagaaugccc

SEQ ID NO: 256877 - RNA, 64 nt, Human
gcuaagagggccuauugucaggggaagguccccgcuccugcacacucucuauggauacuugggu

SEQ ID NO: 256878 - RNA, 64 nt, Human
uuuuuaagucuuaaccaaucucuaagguuuguuucuccugcaagggaugguucauggccucucu

SEQ ID NO: 256879 - RNA, 64 nt, Human
aucuuuaaaaguaucgguuugccuguugagcacacuccugcaagccaaacacgugaacuuuggu

SEQ ID NO: 256880 - RNA, 64 nt, Human
auccauccucgguguuagcagcagcguucccugccuccugcaggaugacuuagaaaucuaguga

SEQ ID NO: 256881 - RNA, 64 nt, Human
gugaguaauuuuuggauaagguaugcugaagaaucuccugcagaagucugauacaugauuuuca

SEQ ID NO: 256882 - RNA, 64 nt, Human
gccaccagaccaaaagcauccagcuucugugcaccuccugcaaagcuggcagaggcccuggaau

SEQ ID NO: 256883 - RNA, 64 nt, Human
aaaaauucgcugggaggccaauaggcugaaauggcuccugcacuuuggguuccuaagucagcaa

SEQ ID NO: 256884 - RNA, 64 nt, Human
caguauaacugauaugauaugaagggggacuuaucuccugcagagauuggagaagguagaggag

SEQ ID NO: 256885 - RNA, 64 nt, Human
augaagagaucucuaggcaggaaauccacagcuccuccugcacccagaaugggaaggaaagaag

SEQ ID NO: 256886 - RNA, 56 nt, Human
ucaccagguuguuucgauagcucacacuccugcacugugccugucacccaggugag

SEQ ID NO: 256887 - RNA, 64 nt, Human
ggaagaagcugauggaauucauauaucugucucucuccugcaagaaucuaccugagaccaugcc

SEQ ID NO: 256888 - RNA, 64 nt, Human
cugcccccugggagcccucgcuggaucgucucgucuccugcagcagcacuggcaggcgagggcu

SEQ ID NO: 256889 - RNA, 60 nt, Human
ccuggccaagcgagagcagcuggauuuuauggagagcaugcuaucccacgggaaaggagc

SEQ ID NO: 256890 - RNA, 60 nt, Human
agcagcagagagcccugggugacuucagguggagagcacuagaagugguuuccugauaac

SEQ ID NO: 256891 - RNA, 60 nt, Human
agugccaaaguacaaacgcugcuuggauaaggagagcaaagcuucuggaacuuuauuuac

SEQ ID NO: 256892 - RNA, 60 nt, Human
aaaggaggaggagccggggacucccaggcuggagagcacugccaggacccaccacuggaa

SEQ ID NO: 256893 - RNA, 64 nt, Human
cgaacgcccagggcacugcgccccgcaacugacgcuccugcaaggaaaagcucugggugcguau

SEQ ID NO: 256894 - RNA, 64 nt, Human
gaccagccgcucaggacaggacccuggggcuacacuccugcauugcugcaauacugcuccccca

SEQ ID NO: 256895 - RNA, 64 nt, Human
ucaucucagggaaacuuaauuccugcccguccugcuccugcaccuccuuuauauaguucccuca

SEQ ID NO: 256896 - RNA, 64 nt, Human
aggucacauauuuucuuuuguauccuggcaaauacuccugcaggccaggaaguauaauagcaaa

SEQ ID NO: 256897 - RNA, 64 nt, Human
uuuccaguguuacuucccaauuuaugcaggaaaccuccugcaaagcugaaacugauuagaaaau

SEQ ID NO: 256898 - RNA, 64 nt, Human
ugauagaaccaaguugccaagggagauaucaucucuccugcaggaaggaaguccugccucccac

SEQ ID NO: 256899 - RNA, 64 nt, Human
cugccccagccccuuccccagaccccucuccagucuccugcaccccuuagcccucccugcuuug

SEQ ID NO: 256900 - RNA, 64 nt, Human
cuggccuaugcccccgcgcccgcugcccccgcggcuccugcagccggcccugcagcgcuacuuu

SEQ ID NO: 256901 - RNA, 64 nt, Human
gggacuaggaagggcuauuccaggcucagcccugcuccugcagcuuugccgcugaguguaggaa

SEQ ID NO: 256902 - RNA, 64 nt, Human
cuccaggccuggaucccuuccuucuauaaauagucuccugcaccaccgugacucccuggcugcu

SEQ ID NO: 256903 - RNA, 64 nt, Human
cucgacucugcugcucaugggaagaacagaauugcuccugcaugcaacuaauucaauaaaacug

SEQ ID NO: 256904 - RNA, 64 nt, Human
cugcugguuugaauuggacacacugcugcggcuccuccugcaggccugagggggcuucccucug

SEQ ID NO: 256905 - RNA, 64 nt, Human
caguacaugugcacaaagcagaaucucagagggucuccugcagcccucugcuccucccggccgc

SEQ ID NO: 256906 - RNA, 64 nt, Human
guucacugcauucaccuuagugcaacuuagaucucuccugcaaaaguaaauguugacaggcaaa

SEQ ID NO: 256907 - RNA, 64 nt, Human
ucuauagucauuagaagccagagaacugcuaagucuccugcaauguuuuucuugcuuuuugccu

SEQ ID NO: 256908 - RNA, 64 nt, Human
ucuuagccuucaauugggagauaccuuuggucugcuccugcaccaaagccauauggguggaagu

SEQ ID NO: 256909 - RNA, 64 nt, Human
uuccuuggcaaaagcaaaaauucucccugugagagcucaacaucucaaauacaaccacaggaaa

SEQ ID NO: 256910 - RNA, 60 nt, Human
ucaagugggucccccacgaagauacugcacggagagcagugccaagccuguggaucagga

SEQ ID NO: 256911 - RNA, 60 nt, Human
gagcucgcucuugggagucaggaccuccggggagagcagaggguuccgacggauuccuuu

SEQ ID NO: 256912 - RNA, 60 nt, Human
ccaagugcuccccaaggagaucggucaccaggagagcagccacaaaggucaagaaagaca

SEQ ID NO: 256913 - RNA, 64 nt, Human
gcuuugcccaccaggacuuuugagcuggggcugacuccugcaggggaagcccugguccagcugg

SEQ ID NO: 256914 - RNA, 64 nt, Human
gggaucccagcaucucagaguccagucaaguucccuccugcagccugaccccuaggcagcucga

SEQ ID NO: 256915 - RNA, 64 nt, Human
gggaucccagcaucucagaguccagucaaguucccuccugcagccugaccccaggcagcucgag

SEQ ID NO: 256916 - RNA, 64 nt, Human
cacagcuuccugagucaccccucuguccagccagcuccugcacaaauggaacuccccagggccu

SEQ ID NO: 256917 - RNA, 64 nt, Human
ugugucccuuccccugaggacugcggcucccucccuccugcaugagggucuccuacugcuccuu

SEQ ID NO: 256918 - RNA, 64 nt, Human
uuucuaacaaugacugacuaaauaaagcugucugcuccugcauugauaaugaaggugcguugua

SEQ ID NO: 256919 - RNA, 64 nt, Human
uggccuucuucuccgcguacugcugcagccgcuccuccugcagcugugccgccuucuuguccuc

SEQ ID NO: 256920 - RNA, 64 nt, Human
ggggcagcagugcgggaggggcuuugcacagcagcuccugcaacugacccaguccgcaaauauu

SEQ ID NO: 256921 - RNA, 64 nt, Human
gagcuggggucccagccaggugcccccgcaugcccuccugcaguugcuggauggauagggacac

SEQ ID NO: 256922 - RNA, 64 nt, Human
auguccccugcccagcccccucgccgcccuugaccuccugcaggccauguguguauuacuuguc

SEQ ID NO: 256923 - RNA, 64 nt, Human
aaggcucugaagucccgggcugcucucagcacuucuccugcagacugaagacucuggacucauu

SEQ ID NO: 256924 - RNA, 64 nt, Human
ugucuacaccgaaggcuaaaagcucucuuggccacuccugcacacccaggaccuugauguugcu

SEQ ID NO: 256925 - RNA, 64 nt, Human
cccucccgucugugagcucccugcccagcaccaccuccugcacugcacuucugccguccacauc

SEQ ID NO: 256926 - RNA, 64 nt, Human
uacagaacuccacauauacaacuuccgucauuaccuccugcagucugacaagcucaucacugaa

SEQ ID NO: 256927 - RNA, 64 nt, Human
cuccagccuggccuuuccuccuuccccucugaaccuccugcaacccugagccaucaggacaauc

SEQ ID NO: 256928 - RNA, 64 nt, Human
cccauacucguuucugauucagaaucagugugggcuccugcagugggcgcgggucacggcugac

SEQ ID NO: 256929 - RNA, 61 nt, Human; identical to SEQ ID NO: 141862

SEQ ID NO: 256930 - RNA, 60 nt, Human
gaagaccaguauuucagaacuuugagaauuggagagcaggcacaucaacugaucucauuu

SEQ ID NO: 256931 - RNA, 60 nt, Human
ccaguuaauucaugccucccauggaccuauggagagcagcaaguugaucuuaguuaaguc

SEQ ID NO: 256932 - RNA, 60 nt, Human
ucuguauguauaaagucaugcucgauuucaggagagcagcugaucacaauuugcuucaug

SEQ ID NO: 256933 - RNA, 64 nt, Human
gagggcuuaaguuggggauguuugaccaggccaccuccugcaacugcuguuucuccugucccuc

SEQ ID NO: 256934 - RNA, 64 nt, Human
gugggaccagcuggaccugaggcugcagucuucucuccugcaggcugcuugccuugucucucau

SEQ ID NO: 256935 - RNA, 64 nt, Human
ccaucuuugguuacuugauauugguguugucaagcuccugcaaauaauaguaaaugugcaagga

SEQ ID NO: 256936 - RNA, 64 nt, Human
cugagggcauugagcugaggcuccacccugagcucuccugcaggguggagggcauuguuuccca

SEQ ID NO: 256937 - RNA, 64 nt, Human
gagaauugagugcuugcagucaagcagaauguaccuccugcagagacaaaucuucugcaugaga

SEQ ID NO: 256938 - RNA, 64 nt, Human
ucagguuaucaaaggcaaguagaguaauaaaucucuccugcaugguaaaucuagacuuuuuuuc

SEQ ID NO: 256939 - RNA, 64 nt, Human
cucacuuuagggaggcuucacugacuaggcuuuccuccugcauguugaauuuccuucagcuuua

SEQ ID NO: 256940 - RNA, 64 nt, Human
ggcguggcgcagccggcgggaccgcgaggagauccuccugcaggagcuggagccggucaucucc

SEQ ID NO: 256941 - RNA, 64 nt, Human
uuuugcuuugagaagaggcuccucuggcccugcucuccugcagggagguggcuguccugcggga

SEQ ID NO: 256942 - RNA, 64 nt, Human
ugucuggcaaacuggagggaccucagaaacuggacuccugcauguccuugggggcgcagcccug

SEQ ID NO: 256943 - RNA, 64 nt, Human
gacgcaaguuggcugggugguccgcacccuggcucuccugcagguccacacaccuuccaggccu

SEQ ID NO: 256944 - RNA, 64 nt, Human
ccagcgaggguagaauucagaauagagaguuauacuccugcauacaugcucucccucucauuga

SEQ ID NO: 256945 - RNA, 64 nt, Human
gaucuguguggccagcccuguccacaccaugccucuccugcacuggagagcagugcuggcccag

SEQ ID NO: 256946 - RNA, 52 nt, Human
aguucgagauggacaucugacucuccugcaaggauuagaagaaaagcagcaa

SEQ ID NO: 256947 - RNA, 64 nt, Human
ucaaguuucucugcuuucacugcucgcucgcucucuccugcaaugauugaugaucacuccgugg

SEQ ID NO: 256948 - RNA, 64 nt, Human
ucgagaugcucccugcagcccaggccccgggcaccuccugcaaccaucucugggcucagcaccu

SEQ ID NO: 256949 - RNA, 64 nt, Human; identical to SEQ ID NO: 141823

SEQ ID NO: 256950 - RNA, 64 nt, Human; identical to SEQ ID NO: 141824

SEQ ID NO: 256951 - RNA, 64 nt, Human; identical to SEQ ID NO: 141825

SEQ ID NO: 256952 - RNA, 64 nt, Human; identical to SEQ ID NO: 141826

SEQ ID NO: 256953 - RNA, 64 nt, Human
aauuccagaccugagguugggaaaagagguuuuucuccugcaggguacugggccaggcccucag

SEQ ID NO: 256954 - RNA, 64 nt, Human
agaggcagugaugacuugcuguccaggcagcucccuccugcacacagaaugcucagggucacug

SEQ ID NO: 256955 - RNA, 64 nt, Human
gggucaggcugucacuuccggcucucagcccuaucuccugcaaccucagugccucagccugaga

SEQ ID NO: 256956 - RNA, 64 nt, Human
cacuugguuccuuuuuguuuguuuuccuucuccucuccugcauuuuccuccaucuccagguaca

SEQ ID NO: 256957 - RNA, 64 nt, Human
ggcuaagauggagaaacagguacuggacuuuucccuccugcaugaaacaagcaaacaauggaca

SEQ ID NO: 256958 - RNA, 64 nt, Human
cacuauugggaaggagauguggacggccugucuccuccugcagggcccacccuaagaauguauu

SEQ ID NO: 256959 - RNA, 64 nt, Human
gcagacagaaccucugggacacacaccaagggcacuccugcagguggcccggccugagguuccc

SEQ ID NO: 256960 - RNA, 64 nt, Human
cucauaagaugguccacucuguacacaggcauuccuccugcaauaauguuguaucuuugagacc

SEQ ID NO: 256961 - RNA, 64 nt, Human
ccaugcuuuuucuaucccauccucucucugugcccuccugcaauggcagccuuggcacaaugcc

SEQ ID NO: 256962 - RNA, 64 nt, Human
uguauuaaauggcaaacucccaaaacacugcagccuccugcaucuggcccagggccuggcauuu

SEQ ID NO: 256963 - RNA, 64 nt, Human
caaagaucauaauuuucaaugauuagccguguaacuccugcaaugaauguuuaugugauugaag

SEQ ID NO: 256964 - RNA, 64 nt, Human
ccaggccacagggaggaggcuucuuugugggucucuccugcagagggugggggucucagggucu

SEQ ID NO: 256965 - RNA, 64 nt, Human
auuucuucaccuacaacccuuugucuugacuuaucuccugcaacugacucaucugcaacauuca

SEQ ID NO: 256966 - RNA, 64 nt, Human
uugaagagcagcuggcaugaugacugcuguuugacuccugcauaccaagauauucugcagcaau

SEQ ID NO: 256967 - RNA, 64 nt, Human
gagaggccugcuuuguuacaaagcucgggucucccuccugcagcucgguuaaguacccgaggcc

SEQ ID NO: 256968 - RNA, 64 nt, Human
cuaacagggagugggccauucccugggacucucgcuccugcacugccagccccuucuccucucc

SEQ ID NO: 256969 - RNA, 64 nt, Human; identical to SEQ ID NO: 141829

SEQ ID NO: 256970 - RNA, 64 nt, Human; identical to SEQ ID NO: 141830

SEQ ID NO: 256971 - RNA, 64 nt, Human; identical to SEQ ID NO: 141831

SEQ ID NO: 256972 - RNA, 64 nt, Human
caggauugccucccagcugccuggccagcccacccuccugcaaccucucacccgaacaccagug

SEQ ID NO: 256973 - RNA, 64 nt, Human
caaaagggccucaggcucaaggggugggaugcggcuccugcaggagagagguugagaccugguc

SEQ ID NO: 256974 - RNA, 64 nt, Human
gaagaggcagaucgcagcccagaccaaccucacccuccugcaaguaaacaacuggugaguuugc

SEQ ID NO: 256975 - RNA, 64 nt, Human
cacacgugugcaaagagacggugguguguguucucuccugcaucugcgugugcacacaugugcu

SEQ ID NO: 256976 - RNA, 64 nt, Human
agacgcagcccgcaggcagccccacacccgccgccuccugcaccgagagagauggaauaaagcc

SEQ ID NO: 256977 - RNA, 64 nt, Human
augugguucccaggaucuggaaccucucccaccccuccugcaguuggacugaauucuucccuuu

SEQ ID NO: 256978 - RNA, 64 nt, Human
gcagccaugcacucccccggggugucgcucuccccuccugcaggucagcagcugauccugaucc

SEQ ID NO: 256979 - RNA, 59 nt, Human
cucccucccgccaaugcugauaguccccucuccugcaucccuccaccccaguccccggg

SEQ ID NO: 256980 - RNA, 64 nt, Human
uuggaacgcucaucccccgcuauaccuccccuuccuccugcaucuccccuucuuuccuuccccc

SEQ ID NO: 256981 - RNA, 64 nt, Human
agcagcuggcacugcacccaggauucucgucuuccuccugcagacaggcggacccacaggcccc

SEQ ID NO: 256982 - RNA, 64 nt, Human
uauuugcagaagcuuugagaaccaugcguauagccuccugcauucuccccucuccuaggagcuc

SEQ ID NO: 256983 - RNA, 64 nt, Human
ucagaggacaccugaugcucaccugccccucuuucuccugcacuuggcuugcagugagaugcuc

SEQ ID NO: 256984 - RNA, 64 nt, Human
acagaguccggggggaaauguacuguagggaucccuccugcacaucagugggugcaugugggaa

SEQ ID NO: 256985 - RNA, 64 nt, Human
gaaucaaacucaaccaggaggcaugauuccuucucuccugcaauugcacaaaaacaaguggugg

SEQ ID NO: 256986 - RNA, 64 nt, Human
ucucacacaugaucuucagagugcuggaaacacacuccugcagaagcuguaggacucuugaauu

SEQ ID NO: 256987 - RNA, 64 nt, Human
uugucuccuaaugcuuuauccaucaccaccugggcuccugcauccucacuguggaaucaggcac

SEQ ID NO: 256988 - RNA, 64 nt, Human; identical to SEQ ID NO: 141832

SEQ ID NO: 256989 - RNA, 64 nt, Human; identical to SEQ ID NO: 141834

SEQ ID NO: 256990 - RNA, 64 nt, Human; identical to SEQ ID NO: 141835

SEQ ID NO: 256991 - RNA, 64 nt, Human
ugcaggacagggaggccaccaaaggggcugcugucuccugcacauccagccuccugcgacuccc

SEQ ID NO: 256992 - RNA, 64 nt, Human
ucgcucccaugcacaacucuccaaaacacuuauccuccugcaagagugggcuuuccagggucuu

SEQ ID NO: 256993 - RNA, 64 nt, Human
gagaaagaaucaaaggcagagaagaccagccgugcuccugcauuccgucacuccaugacuucau

SEQ ID NO: 256994 - RNA, 64 nt, Human
auuuaugccggaaacucuccuucugugaguauaacuccugcaguuccuauagcagauaagauau

SEQ ID NO: 256995 - RNA, 64 nt, Human
ccagccgggcucucuaguggugauccggcucauucuccugcaaguuggaagcacaauuuucccc

SEQ ID NO: 256996 - RNA, 64 nt, Human
ugggcaaggcgguggguggugggcaaggugggaccuccugcagccuggaaagaggagggaggcc

SEQ ID NO: 256997 - RNA, 64 nt, Human
aggcugccugccuugccagcacccguguccugagcuccugcagcccaguggcugcugaaguugu

SEQ ID NO: 256998 - RNA, 64 nt, Human
cuguuauuccagugcccuguaacaaucacugguccuccugcagaugacccuugguagagucuuu

SEQ ID NO: 256999 - RNA, 64 nt, Human
uguugucacuuacucccuugugauugaauuuuuucuccugcauccauggcaggauccccagcca

SEQ ID NO: 257000 - RNA, 64 nt, Human
aaaaugaacaagugggacuacauuaaacccaaaacuccugcacaacaaaggaaacgaucaccaa

SEQ ID NO: 257001 - RNA, 64 nt, Human
accccuuccuccccaaccugcaauaaauccgcuucuccugcaguggaugagugugggugccagu

SEQ ID NO: 257002 - RNA, 64 nt, Human
uuuuuucuuuuuuuuuuuuuuaauguaaacuaaccuccugcaugacagagguuaaaauuuuguc

SEQ ID NO: 257003 - RNA, 57 nt, Human
agugcaagucugaagaaugacugugcccuccugcaaggcuagagcugauggcacugu

SEQ ID NO: 257004 - RNA, 64 nt, Human
guguugacagccacccacccucucccaccucaugcuccugcaccugcaccaccaagguugaugc

SEQ ID NO: 257005 - RNA, 64 nt, Human
cacugaugugccucgaaagauccgguguuuguggcuccugcacccugcucagcagcucuguccc

SEQ ID NO: 257006 - RNA, 64 nt, Human
ugguccugcuugaagguuuguccaggcagagcagcuccugcagcgccucggucugugacagucc

SEQ ID NO: 257007 - RNA, 60 nt, Human
gggguuagaguggucucagcggcagguggaggagagcaggaugcugggcucaagcgcuug

SEQ ID NO: 257008 - RNA, 60 nt, Human
uugacugaaaaaaaaaaagaagaagaagaaggagagcaagaaggaaagauuugugaacug

SEQ ID NO: 257009 - RNA, 60 nt, Human
cccuccacagaagcucugcagcaggggcugggagagcagaagggcaggcccugcaacuca

SEQ ID NO: 257010 - RNA, 60 nt, Human
aggcucacuuccugcacagcugucucugucggagagcaagucuguuuugggaacuagaac

SEQ ID NO: 257011 - RNA, 64 nt, Human
cggacccccaccccuccgcacugugaaagacuaacuccugcaacuggaaagcgggggcgcccgc

SEQ ID NO: 257012 - RNA, 64 nt, Human
gucgaggccuuguguuugucagacacccaguguccuccugcaaggacgcaacugugagcugagg

SEQ ID NO: 257013 - RNA, 64 nt, Human
uauccucuagcucacacuuuccuaauggccccaucuccugcagaagccaggugagcccagcacu

SEQ ID NO: 257014 - RNA, 64 nt, Human
cacccccgacacuccugcuguccacuggccuuagcuccugcaaguuccccaguguccgcaccug

SEQ ID NO: 257015 - RNA, 64 nt, Human
aguccaggcgccuggagcaagugcucagcuacuucuccugcacuuugaaagaccccucccacuc

SEQ ID NO: 257016 - RNA, 64 nt, Human
uauguacaagaccggauucgggcccuacgcgcagcuccugcagguggcuuccagaacaucgccu

SEQ ID NO: 257017 - RNA, 64 nt, Human
cacugaagagcaaaaggggcugggacacucugaacuccugcacucuccagaagugacuggucau

SEQ ID NO: 257018 - RNA, 64 nt, Human
cguaguccccggcaccugucguuauuccuauauccuccugcaacugugguuugaaacugcgcau

SEQ ID NO: 257019 - RNA, 64 nt, Human
acauauguacauguacccaccacaaacgugcaagcuccugcacacaugcaugcacacaaacgug

SEQ ID NO: 257020 - RNA, 64 nt, Human
acacgcacacguacauucacuacaaacgugcagccuccugcacacgugcacauucauguguaca

SEQ ID NO: 257021 - RNA, 64 nt, Human
augcacauguacgcaccacaaacacaugcgcaggcuccugcaggcgugaauacacacaugcaca

SEQ ID NO: 257022 - RNA, 64 nt, Human
accuaccccagccaccaaggcccugacgcacugccuccugcaccuucagcacaucccugugcac

SEQ ID NO: 257023 - RNA, 64 nt, Human
uggccauguaagucccaucaggacguagucaugccuccugcauuucgcuacccgaguuuaguaa

SEQ ID NO: 257024 - RNA, 64 nt, Human
accacuaucucuagucucccuagcuuggugccuucuccugcaggagucagagcagccacauugc

SEQ ID NO: 257025 - RNA, 64 nt, Human
cacugaaaccucugccucccggguucaagcgauucuccugcaucagccucccgaguagcuagga

SEQ ID NO: 257026 - RNA, 64 nt, Human
acuuugucauuuccuguugucucacuccugagggcuccugcaguaacucuguacuucucuaucu

SEQ ID NO: 257027 - RNA, 64 nt, Human; identical to SEQ ID NO: 141838

SEQ ID NO: 257028 - RNA, 64 nt, Human; identical to SEQ ID NO: 141839

SEQ ID NO: 257029 - RNA, 64 nt, Human; identical to SEQ ID NO: 141840

SEQ ID NO: 257030 - RNA, 64 nt, Human
uucuccucuccccuccuucccccaccacaggucucuccugcauaggcagccacuguccguucuu

SEQ ID NO: 257031 - RNA, 64 nt, Human
ugccaaccacggagaugugccaagcaucucaucucuccugcacacuuuagucagaaggacuucu

SEQ ID NO: 257032 - RNA, 64 nt, Human
ugacaggccuagccgcccgugacucucacacugucuccugcaugacggguggcgccucccgcag

SEQ ID NO: 257033 - RNA, 64 nt, Human
uccucuagucugccuggcuaccaugcuucucacucuccugcaucugcagacccugcguugccau

SEQ ID NO: 257034 - RNA, 64 nt, Human
gccaaggagaagacagccccccuccuauuucagccuccugcacccaaggcagugccugagaagc

SEQ ID NO: 257035 - RNA, 64 nt, Human
gguucagauugcagaaacccagcccugccccugccuccugcauccagcccccaacauggugcca

SEQ ID NO: 257036 - RNA, 64 nt, Human
aucauggaauuugcuagaacuguggaagcuucuacuccugcaguaagcacagaucgcacugccu

SEQ ID NO: 257037 - RNA, 64 nt, Human
acccgaguucccccagcccuucaucaccaacccgcuccugcaggagugagucuuaccuccccug

SEQ ID NO: 257038 - RNA, 64 nt, Human
aggcggaauugcuuucuucugagccgggugggcucuccugcagggagaaugcaggggucugugc

SEQ ID NO: 257039 - RNA, 64 nt, Human
uagcccguaugaucacguagacccacccaacacacuccugcacacuggccccggcccacggcac

SEQ ID NO: 257040 - RNA, 64 nt, Human
aaucuguucucguuccuuguaccggauuauucuacuccugcaaugaacccuguugacaccggau

SEQ ID NO: 257041 - RNA, 64 nt, Human
cucagccuugggaccgugcccacgagggucuccccuccugcacacagggcaguccuuacucccc

SEQ ID NO: 257042 - RNA, 64 nt, Human
cggagcugggcacuccagcggcccuggcgcguggcuccugcauagcuagcccaagccaauaaag

SEQ ID NO: 257043 - RNA, 64 nt, Human
caggcuggucuugaacuccugaccucaggugauccuccugcauuggccucccaaagugcuggaa

SEQ ID NO: 257044 - RNA, 64 nt, Human
uaauggaaaccauuuaucagauuaaucucuugcucuccugcauuuuagaggacaccaauuaauu

SEQ ID NO: 257045 - RNA, 64 nt, Human
guagccuaggcagugaguaaauaccucagauguccuccugcagcaagugucuauauguuguggu

SEQ ID NO: 257046 - RNA, 64 nt, Human; identical to SEQ ID NO: 141836

SEQ ID NO: 257047 - RNA, 64 nt, Human; identical to SEQ ID NO: 141843

SEQ ID NO: 257048 - RNA, 64 nt, Human; identical to SEQ ID NO: 141844

SEQ ID NO: 257049 - RNA, 64 nt, Human
cucacugguacugccugcuguuuucuaagcauugcuccugcacagacauggagucccagcccca

SEQ ID NO: 257050 - RNA, 64 nt, Human
aaucugagugaggacaugcaggccaacuuuuacccuccugcauuugccuggcccugaucucgcc

SEQ ID NO: 257051 - RNA, 64 nt, Human
uagaaggauguuuuggggaaggaacuggauaucucuccugcagcccagcaccgagauacccagg

SEQ ID NO: 257052 - RNA, 64 nt, Human
auaugggacugaugauguguguugggguagacugcuccugcagaguuuggaagaagucaccagc

SEQ ID NO: 257053 - RNA, 64 nt, Human
ucuggugagggaaguccccaggccagacgcuggacuccugcaaugaggguggaggacucagccu

SEQ ID NO: 257054 - RNA, 64 nt, Human
uuuuuacuucaugcauggcuucuccuccaacuuccuccugcacuuaaaaagggccagguuccaa

SEQ ID NO: 257055 - RNA, 64 nt, Human
aaaauagaguugggcuuaauguugacuucuauuacuccugcauggagcaguuguuaugaauacu

SEQ ID NO: 257056 - RNA, 64 nt, Human
ucagagugccauggccacuaccccacuguuugcucuccugcaaaucaacugcuuuuaauuuaca

SEQ ID NO: 257057 - RNA, 64 nt, Human
uauggcuaagacuguaugugcugaauuccugggccuccugcagaagcagaaagccugcugggga

SEQ ID NO: 257058 - RNA, 64 nt, Human
acagauggacaaguuggauccccuggcccauccucuccugcagugguauggauagaauggcuca

SEQ ID NO: 257059 - RNA, 64 nt, Human
acagagaagagauccuugacuucuguuccucucucuccugcagaugcaagagcuccugggcagg

SEQ ID NO: 257060 - RNA, 64 nt, Human
gguugaugggggaugaugugcucccggggccugccuccugcacggggcuccacggagcccagcu

SEQ ID NO: 257061 - RNA, 64 nt, Human
acuucaccgaguuugugugaggccggggcccucccuccugcacuggccuuggacgguauugccu

SEQ ID NO: 257062 - RNA, 64 nt, Human
ccccugggcuuuccugcuggccacggagacucugcuccugcauggaaagggagccugggagcca

SEQ ID NO: 257063 - RNA, 64 nt, Human
aacccuggcaucagcagacccagggugcuucugucuccugcagaccacgccagggagugcagac

SEQ ID NO: 257064 - RNA, 64 nt, Human
ccaagcaggggcggccgcagcucucacccacuuucuccugcagacggcgaggggaccgaccugu

SEQ ID NO: 257065 - RNA, 64 nt, Human; identical to SEQ ID NO: 138907

SEQ ID NO: 257066 - RNA, 64 nt, Human; identical to SEQ ID NO: 138908

SEQ ID NO: 257067 - RNA, 64 nt, Human; identical to SEQ ID NO: 138909

SEQ ID NO: 257068 - RNA, 64 nt, Human; identical to SEQ ID NO: 138910

SEQ ID NO: 257069 - RNA, 64 nt, Human
gcugcccacguguggccuccgcuggcucugccugcuccugcaacagugcggucccugcccggag

SEQ ID NO: 257070 - RNA, 64 nt, Human
cacacaugcugucacgcauacacacacgcacauacuccugcacauguucccaugcaugugugug

SEQ ID NO: 257071 - RNA, 64 nt, Human
cguugagcuucugccggguuucuucuugaagcagcuccugcaaaagggaugcaaagagguccca

SEQ ID NO: 257072 - RNA, 64 nt, Human
auccugaagugacuccguuugugccuugggcuugcuccugcaaccaguaucuccuuggaauuca

SEQ ID NO: 257073 - RNA, 64 nt, Human
auuccccgucucugguuccuccccuccuccuggacuccugcacacgcuccuuccucugaggcug

SEQ ID NO: 257074 - RNA, 64 nt, Human
aggagcagccacauuccugaugcuucuucagagacuccugcaggcagccaggccacaagacccu

SEQ ID NO: 257075 - RNA, 64 nt, Human
ccagccugacuggcuuccugggcgagccuaguagcuccugcaggcaggggcaguuuguugcguu

SEQ ID NO: 257076 - RNA, 64 nt, Human
ugcccagcgggcucccggagcagcauuccagagccuccugcagagccagcgaaggaaagcucua

SEQ ID NO: 257077 - RNA, 64 nt, Human
uuucugggguaguaccuguggagccgggaagggucuccugcagugccauucugccuucucaaug

SEQ ID NO: 257078 - RNA, 64 nt, Human
ccucgcucugaugccaacugcagauaauacacaccuccugcagcguccagccacggcuccaggg

SEQ ID NO: 257079 - RNA, 64 nt, Human
ugaccagaaagcuucauccacagccuugcagcggcuccugcaaaaggaggugaaaucccugccu

SEQ ID NO: 257080 - RNA, 64 nt, Human
ugcuuuccccucgcccuagggcucccuugccgcccuccugcaguauuuauggccucguccuccc

SEQ ID NO: 257081 - RNA, 64 nt, Human
cagcgacucccgcaaagggacaagguuccucccucuccugcagaguaggcaucugggcaccaag

SEQ ID NO: 257082 - RNA, 64 nt, Human
cuuuguccaggcccacagcuuagccauggcuucccuccugcaucccugccguggguugcuggcc

SEQ ID NO: 257083 - RNA, 64 nt, Human
aauauugggagaaaugacuugugcccuaaacaaccuccugcacagucugcagcuuccugagucc

SEQ ID NO: 257084 - RNA, 64 nt, Human
accccacugugcccuggccuugggucugccgagccuccugcagcaggggacgggugcuuuggcc

SEQ ID NO: 257085 - RNA, 64 nt, Human; identical to SEQ ID NO: 138913

SEQ ID NO: 257086 - RNA, 64 nt, Human; identical to SEQ ID NO: 138914

SEQ ID NO: 257087 - RNA, 64 nt, Human; identical to SEQ ID NO: 141847

SEQ ID NO: 257088 - RNA, 64 nt, Human; identical to SEQ ID NO: 141848

SEQ ID NO: 257089 - RNA, 64 nt, Human
aauauugggagaaaugacuugugcccuaaacaaccuccugcacagucugcaacuuccugaggcc

SEQ ID NO: 257090 - RNA, 64 nt, Human
guggcugcugcauaaguaucuguagccugucuaccuccugcaguggggccgcucgccucuuccc

SEQ ID NO: 257091 - RNA, 64 nt, Human
uccaaagccggcuugauuuccgugaacucuggugcuccugcaucucaugagugugccccauggg

SEQ ID NO: 257092 - RNA, 64 nt, Human
ccuggcuauuccucuuuccucucugcugcugcuucuccugcaucuuguuccugcuuauuuaaau

SEQ ID NO: 257093 - RNA, 64 nt, Human
ggccaccagcucucccgccuccagugugggccggcuccugcaggguccgagggcugcaucucua

SEQ ID NO: 257094 - RNA, 64 nt, Human
uaaaugguugacugagucaagaacaggauaauaucuccugcauaguuuucaguaauguaagugu

SEQ ID NO: 257095 - RNA, 64 nt, Human
gaacaaaaagagcccaaucucugauguuauugagcuccugcaugaacucuggaccugccugccu

SEQ ID NO: 257096 - RNA, 64 nt, Human
ugcaagguccugccugccaucagauccgaggugccuccugcagugaccccuuuuccuggcauuu

SEQ ID NO: 257097 - RNA, 64 nt, Human
uguguggccacacgaagaagccaaacgccguggccuccugcagagcuggggcuucuguggagaa

SEQ ID NO: 257098 - RNA, 64 nt, Human
aauaagucauucucccuagcagagccacuugggucuccugcauggaagccaucacacuugggca

SEQ ID NO: 257099 - RNA, 64 nt, Human
cagcucugcuucaggagcuaugagagucgggacucuccugcaccugacuggagcucagaugugg

SEQ ID NO: 257100 - RNA, 64 nt, Human
ugggaggguaacaaagagggccugccccuuuagucuccugcaccccugcccccugguucaccag

SEQ ID NO: 257101 - RNA, 64 nt, Human
gcaaaagccucccucccagaauuagccagcuugccuccugcaccccacccccaccaaccagggg

SEQ ID NO: 257102 - RNA, 64 nt, Human
auggugcaugccgcugcauccgugagcagugugucuccugcaugcagaaagggagcagagaagg

SEQ ID NO: 257103 - RNA, 64 nt, Human
cccaagaggagaucagcgcaauugucagcuaaaccuccugcaaaaguggaagcgaagccgaaaa

SEQ ID NO: 257104 - RNA, 64 nt, Human
cccucccuggcguccucagacuuagucccacggucuccugcaucagcuggugaugaagaggagc

SEQ ID NO: 257105 - RNA, 62 nt, Human
gaugugauuuuuguugcuuuucagaaaaaggaacgugguagggaguguuuuuucccacgcuu

SEQ ID NO: 257106 - RNA, 60 nt, Human
ccagcgcaguccugcucuccugugaccuguggagagcacuaaugaucacguguguugaug

SEQ ID NO: 257107 - RNA, 60 nt, Human; identical to SEQ ID NO: 256533

SEQ ID NO: 257108 - RNA, 60 nt, Human
caugauccuuuuauaaaugugagauuaacaggagagcagcaauacgauuuugccaaugga

SEQ ID NO: 257109 - RNA, 64 nt, Human
cugccauaggaggagaacacagcccaccucaggccuccugcaaaaauacauagaauaaacaaca

SEQ ID NO: 257110 - RNA, 64 nt, Human
uaagcugagcuccuuagccuuugucccagaaugccuccugcagggauucuuccugcuuagcuug

SEQ ID NO: 257111 - RNA, 64 nt, Human
gggguggggggaagguguuagaggacuccaggagcuccugcaccccuccccaaauguccaucuu

SEQ ID NO: 257112 - RNA, 64 nt, Human
aacacugccggagucgcgucaugccaugcccccucuccugcaccucccuggcccugccggccac

SEQ ID NO: 257113 - RNA, 64 nt, Human
caggggcugccgagaugcgggagcaguucuaccacuccugcaagcaguauggcaucacggugag

SEQ ID NO: 257114 - RNA, 64 nt, Human
uacugucaaaccagcaugguuaauugugagcauccuccugcagcaugccccuuaagauuuucua

SEQ ID NO: 257115 - RNA, 64 nt, Human
aggacucuggcuggccaugugcuugugguugccucuccugcauuugccacuggauuugcacugc

SEQ ID NO: 257116 - RNA, 64 nt, Human
uucuuaccucuuggcaucucagaugcacuggccucuccugcauucuguuugcaggcaaaugcuu

SEQ ID NO: 257117 - RNA, 64 nt, Human
ccccugcuccugcuccuccccuucgggcccccuccuccugcaaaacccgcucccgaagcggcgc

SEQ ID NO: 257118 - RNA, 64 nt, Human
acaggugggccuggcggccuguggguuugggugccuccugcaguuugggagacauggaccagca

SEQ ID NO: 257119 - RNA, 64 nt, Human
aguacaccaguuguuccucccccaccucagcccucuccugcauccuccuguacccgcagcgaag

SEQ ID NO: 257120 - RNA, 64 nt, Human
aauacagugggacaguuaggaaugcacccggggccuccugcagauuucggaaauuggcaagcua

SEQ ID NO: 257121 - RNA, 64 nt, Human
acccucacuggcucuccuggcccugggagaaucgcuccugcagccccagcccagccccacuccu

SEQ ID NO: 257122 - RNA, 52 nt, Human
ccacuggugugcaggugugaggcuccugcaggcccacucucuucagcagcca

SEQ ID NO: 257123 - RNA, 64 nt, Human
gccuggugcugcucccaucugccgccccccuucucuccugcaauugguuuguacucacugggcu

SEQ ID NO: 257124 - RNA, 64 nt, Human
agaucuugcccugaauguacccugccucugcuuucuccugcaucccaugcuaagcagggucaug

SEQ ID NO: 257125 - RNA, 64 nt, Human; identical to SEQ ID NO: 141849

SEQ ID NO: 257126 - RNA, 64 nt, Human; identical to SEQ ID NO: 141851

SEQ ID NO: 257127 - RNA, 64 nt, Human; identical to SEQ ID NO: 141852

SEQ ID NO: 257128 - RNA, 64 nt, Human; identical to SEQ ID NO: 141853

SEQ ID NO: 257129 - RNA, 64 nt, Human
gugcauguucccugucuggugccccuuugcccgccuccugcaaaccucacaggguccccacaca

SEQ ID NO: 257130 - RNA, 64 nt, Human
uuguuccucaauagcugggggcugggacugaggccuccugcagguaccugccccccuucacaca

SEQ ID NO: 257131 - RNA, 64 nt, Human
acaguccccugggugucagaaggugggcuagggccuccugcaggguugugggguggaacagggu

SEQ ID NO: 257132 - RNA, 64 nt, Human
uuggcuuucgugcucacaccacugcugcucgagucuccugcacugugucucccacacugagaaa

SEQ ID NO: 257133 - RNA, 64 nt, Human
uagcccaaaacaguugccaaacuuugccauugugcuccugcauuuguguuugagcugcuauaua

SEQ ID NO: 257134 - RNA, 64 nt, Human
aggcuuuaaauuauucuacuuuccaaacugaauucuccugcagugccaaguaucaaaggugucc

SEQ ID NO: 257135 - RNA, 64 nt, Human
agaggacuuugaucccucggugaaguggaaacuccuccugcaggaagagccuuaaagcuccaaa

SEQ ID NO: 257136 - RNA, 64 nt, Human
aggcucugugcucccaccacuguaccccgaaucccuccugcaggcucauugccacuuuuguaga

SEQ ID NO: 257137 - RNA, 64 nt, Human
cuuugugguuuuauggagaccucuccuuccuacccuccugcacuguuuaaguacuguuuaccau

SEQ ID NO: 257138 - RNA, 64 nt, Human
cgugugcaugugucagagccauuugguccaucaucuccugcaauaaacccaucgcaagaaugac

SEQ ID NO: 257139 - RNA, 64 nt, Human
ggcucuuuaucuaccuuugcgggagauuuucacucuccugcaaaugaucguucucacacucaua

SEQ ID NO: 257140 - RNA, 64 nt, Human
uuugaucugcccaggaaagggaugcauugacacucuccugcaugcaccuggcgagaagccaccu

SEQ ID NO: 257141 - RNA, 64 nt, Human
ggucacaccagagagaggcagggggccuggccggcuccugcaggaucaugcagcuggggcgcgg

SEQ ID NO: 257142 - RNA, 64 nt, Human
caagcaacaaagucccgagcaaugaagucauccacuccugcaucugguuggucuuuauugagca

SEQ ID NO: 257143 - RNA, 64 nt, Human
ugagggauguggauuugggacugucugggggccccuccugcagcgaggaugggagggggugcug

SEQ ID NO: 257144 - RNA, 64 nt, Human
acggugcagggcugccugcccaucuagguccccucuccugcaucugucucccuucauugcugug

SEQ ID NO: 257145 - RNA, 62 nt, Human; identical to SEQ ID NO: 141792

SEQ ID NO: 257146 - RNA, 64 nt, Human; identical to SEQ ID NO: 141802

SEQ ID NO: 257147 - RNA, 64 nt, Human; identical to SEQ ID NO: 141821

SEQ ID NO: 257148 - RNA, 64 nt, Human; identical to SEQ ID NO: 141827

SEQ ID NO: 257149 - RNA, 64 nt, Human
accaaugggagccuuccccucacuucuuagaauccuccugcaagagggcaacuccagccagugu

SEQ ID NO: 257150 - RNA, 64 nt, Human
cuuccuguuccuccccagccuuaaccccaaagcccuccugcaccccaaagaagccacugaggcu

SEQ ID NO: 257151 - RNA, 64 nt, Human
agcaaaugugggaaagacuauaggcaauaggaaucuccugcaaacuccuacaggagaaaaguug

SEQ ID NO: 257152 - RNA, 64 nt, Human
agaccaagcccccugccagcucaccgugcccagccuccugcauccccucgaagagccuggccag

SEQ ID NO: 257153 - RNA, 52 nt, Human
acaugccaggcaggggcugacccuccugcagcuuggaccuuugacuucugac

SEQ ID NO: 257154 - RNA, 64 nt, Human
uuccuucccuggcccuuggcugugacacaagauccuccugcagggcuaggcggauuguucugga

SEQ ID NO: 257155 - RNA, 64 nt, Human
cgugacauggugggcaccggaaaggaggggacuucuccugcaccccaagaagugguggggagau

SEQ ID NO: 257156 - RNA, 64 nt, Human
ggauccuccguguuccucggcggacucugcugaccuccugcagacccaaaccacagccacaucc

SEQ ID NO: 257157 - RNA, 64 nt, Human
aggggcuggacucagguuaguuugggggugggggcuccugcacuuugccacaggcacggggagg

SEQ ID NO: 257158 - RNA, 64 nt, Human
cagccccaaggagguggccacccugagcaaggaacuccugcaauucacggcauccaagguaccc

SEQ ID NO: 257159 - RNA, 64 nt, Human
cugucccuggcugggcuaggugguccuguccaggcuccugcagcgccccccucacuuugacacu

SEQ ID NO: 257160 - RNA, 64 nt, Human
gauuaccuggggacaaaauuaacuguacaccaaacuccugcaacaugcaguugacccauguaca

SEQ ID NO: 257161 - RNA, 64 nt, Human
cuugucaauacuuuaccugauguucucauagugacuccugcauauuuugauuaauguuugcaug

SEQ ID NO: 257162 - RNA, 64 nt, Human
gccuaggggcugagucccacaccagcugugaauucuccugcagacaggagggcccuggcugugc

SEQ ID NO: 257163 - RNA, 64 nt, Human
cugcgaggauggagaucuuggucaucucugacaucuccugcaucgcagaggccacugccagccc

SEQ ID NO: 257164 - RNA, 64 nt, Human
acgccacgccacccgcuguucacgucccgucggccuccugcacagcccacacgcugcgcccgga

SEQ ID NO: 257165 - RNA, 64 nt, Human; identical to SEQ ID NO: 141856

SEQ ID NO: 257166 - RNA, 64 nt, Human; identical to SEQ ID NO: 141857

SEQ ID NO: 257167 - RNA, 64 nt, Human; identical to SEQ ID NO: 141858

SEQ ID NO: 257168 - RNA, 64 nt, Human
cagcugggaucugccugaggacagagaacauggucuccugcagggcccugccucccaagccccg

SEQ ID NO: 257169 - RNA, 64 nt, Human
cuccguccacacuggccggcacccccugcugggucuccugcauuccacggagccccugcugcca

SEQ ID NO: 257170 - RNA, 64 nt, Human
ucccagucccacucucggaggguuaagagaaggccuccugcagcugugccguccacaccucuag

SEQ ID NO: 257171 - RNA, 64 nt, Human
guacuccaggcuugcuucggagucauagucaucccuccugcacugcuccuuuccaaacacugua

SEQ ID NO: 257172 - RNA, 64 nt, Human
caaaccuaccaucuguucaacuuccaccuaccaccuccugcaccccuuugaucggggacuuacu

SEQ ID NO: 257173 - RNA, 64 nt, Human
agcucuucuggccacguggaaccucgaacccgagcuccugcagaaguggcccuggagauugagg

SEQ ID NO: 257174 - RNA, 64 nt, Human
ucucacuccuuuugguguguuggacagagaagggcuccugcaggccacagccaccuaaacgguu

SEQ ID NO: 257175 - RNA, 64 nt, Human
aagggggccuggaagaccaccugccccggccccucuccugcaggggccccacacaggcaugagg

SEQ ID NO: 257176 - RNA, 64 nt, Human
ggcaaucccuucccuccugucaacugcuccccgacuccugcauggcucauuccuucacaauguc

SEQ ID NO: 257177 - RNA, 64 nt, Human
auaaaaggacauuugcauguaaccuauccacauccuccugcaucccauaaaucaugccuagauu

SEQ ID NO: 257178 - RNA, 64 nt, Human
caggagcccagugucugacggccuccacuuguuucuccugcaccccagccugucacgcuaucag

SEQ ID NO: 257179 - RNA, 64 nt, Human
uagucuuuuucauccucuucucuuuccaccaacccuccugcauccuugccuugcagcgugaccg

SEQ ID NO: 257180 - RNA, 64 nt, Human
gaucagcggccaggggaugccucagggccuggcccuccugcaugcuaugcccggggcaggccug

SEQ ID NO: 257181 - RNA, 64 nt, Human
ccugggccaggugcaagaggaacaaagaaagggacuccugcagcguccggcugaccuggcccuu

SEQ ID NO: 257182 - RNA, 64 nt, Human
guguuuugugccuggacucgggacgcccgacagccuccugcaucucacacucuucuccccccac

SEQ ID NO: 257183 - RNA, 64 nt, Human
gagacauuuaguucauuugccugcaaauuuucuucuccugcaaggaucucgguggacucaguca

SEQ ID NO: 257184 - RNA, 64 nt, Human; identical to SEQ ID NO: 141816

SEQ ID NO: 257185 - RNA, 64 nt, Human; identical to SEQ ID NO: 141841

SEQ ID NO: 257186 - RNA, 64 nt, Human; identical to SEQ ID NO: 141861

SEQ ID NO: 257187 - RNA, 64 nt, Human
ggucuucacaggccugauggucucccuccucugccuccugcacuuuagcaucguguccguggcc

SEQ ID NO: 257188 - RNA, 64 nt, Human
auuuuaugccugccucauuuuauuauaugauuagcuccugcauuucuuugguucuaaguuugug

SEQ ID NO: 257189 - RNA, 64 nt, Human
ugggaaggagaguugacucuugaggacccccacccuccugcauccucucucuggaaggcugcau

SEQ ID NO: 257190 - RNA, 64 nt, Human
agauuuuccuguuugaauguaugucugcauuauacuccugcaauaaugcugaggacucguugca

SEQ ID NO: 257191 - RNA, 64 nt, Human
uccccgacacccaagccccuccccacgucgcccccuccugcacagccaccagcagccagccccc

SEQ ID NO: 257192 - RNA, 64 nt, Human
cgguugauauccaaagccuguucucccagccguccuccugcagcuggagccuucaggccguauu

SEQ ID NO: 257193 - RNA, 64 nt, Human
ccauugggcugcccaaggccagccagccugagcucuccugcaagacagagccugauguggcacg

SEQ ID NO: 257194 - RNA, 64 nt, Human
ucugcgaauccagggugcacguggucaauauccccuccugcauucaggagagccaugguagggc

SEQ ID NO: 257195 - RNA, 64 nt, Human
gggggucugugaaucugagagucauucaggugaccuccugcagggagccuucugccaccagccc

SEQ ID NO: 257196 - RNA, 64 nt, Human
gcuuacagaacaguuucucauuagaugaguguuucuccugcagcacuccaaaacccacucugca

SEQ ID NO: 257197 - RNA, 64 nt, Human
ggucaucugccucugagggaccguccucaccgagcuccugcaucccuugaguguugaucaggag

SEQ ID NO: 257198 - RNA, 64 nt, Human
ugcagggcagggcaggcagggggggcuucccgcccuccugcagcaaagggcaaccacccucgga

SEQ ID NO: 257199 - RNA, 64 nt, Human
ccagcugaacccccagggagacccggagcacagccuccugcagguguccuccacaggcagggcc

SEQ ID NO: 257200 - RNA, 64 nt, Human
acacagggacuaggacaucgaccacccucugccccuccugcagucagaacccgaguagugcaag

SEQ ID NO: 257201 - RNA, 64 nt, Human
cucuugccuugggacacucuugaggcuggcagcccuccugcaaugaguugcucucaguuccuuc

SEQ ID NO: 257202 - RNA, 64 nt, Human
ucauagccccggugugcggugcauacacccccaccuccugcaauaaaauaguagcaucggcucc

SEQ ID NO: 257203 - RNA, 64 nt, Human; identical to SEQ ID NO: 141774

SEQ ID NO: 257204 - RNA, 64 nt, Human; identical to SEQ ID NO: 141775

SEQ ID NO: 257205 - RNA, 64 nt, Human; identical to SEQ ID NO: 141776

SEQ ID NO: 257206 - RNA, 64 nt, Human
uaauagaccugguacaugguacacacacccccaccuccugcaauuaaacaguagcaucgccucc

SEQ ID NO: 257207 - RNA, 64 nt, Human
uaauagcccugguacaugguacacacccccccaccuccugcaauuaaacaguagcaucgccucc

SEQ ID NO: 257208 - RNA, 64 nt, Human
ucauagcccugguacaugguacacacacccccaccuccugcaauuaaacaguagcaucaccucc

SEQ ID NO: 257209 - RNA, 64 nt, Human
ucauagccccagugugcagugcacacucucccaccuccugcaauuaaacaguagcauugccucc

SEQ ID NO: 257210 - RNA, 64 nt, Human
auuuuaaaaagugucuaccuugguacgcagccaccuccugcaugcugugcauguuauugggacu

SEQ ID NO: 257211 - RNA, 64 nt, Human
gugaaggccucccccagcccagacccuguggucccuccugcagugucugaagcgccugccuccc

SEQ ID NO: 257212 - RNA, 64 nt, Human
ccgcggccgccuacacccggaccugcaguccaaccuccugcagguggacagugagugcagagca

SEQ ID NO: 257213 - RNA, 64 nt, Human
ugaaugucuguagucaguuguuuacaaacucccucuccugcacaauucauuuagaggcuucaau

SEQ ID NO: 257214 - RNA, 64 nt, Human
acccaacuuuucuagugugccacggccccaccaccuccugcaguacccacaccaucaccacugc

SEQ ID NO: 257215 - RNA, 64 nt, Human
gugcaccgucccuccgaggggauuucugagaauucuccugcauuuuuacauaaacuaaauguga

SEQ ID NO: 257216 - RNA, 64 nt, Human
gcugggacacgcugggggagggcuccucccaugccuccugcacacagccgucugagcagggcag

SEQ ID NO: 257217 - RNA, 64 nt, Human
aucacauugguaaucucauuuaaucuuuacuacacuccugcaacauagacaguauuauuacauu

SEQ ID NO: 257218 - RNA, 64 nt, Human
gagccuugggcaccucacccaugucacauccugucuccugcaauuggaauuccaccuuguccag

SEQ ID NO: 257219 - RNA, 64 nt, Human
agcuuaaucucuauguuucucuccauuuucauuccuccugcaacuauuuuccuugauguuguaa

SEQ ID NO: 257220 - RNA, 64 nt, Human
ggucugggucaaauucuucuuuuguauguccagucuccugcacagcaccugcagcauuguaacu

SEQ ID NO: 257221 - RNA, 64 nt, Human
gcaugcgcuccccuggcugagcaccccagagauucuccugcaccuuccucaugccgcacgcugc

SEQ ID NO: 257222 - RNA, 64 nt, Human; identical to SEQ ID NO: 141779

SEQ ID NO: 257223 - RNA, 64 nt, Human; identical to SEQ ID NO: 141780

SEQ ID NO: 257224 - RNA, 64 nt, Human; identical to SEQ ID NO: 141781

SEQ ID NO: 257225 - RNA, 64 nt, Human
cccaccugaaagcugauagucgcguccugaauugcuccugcacuuugaccauuuccuggugucu

SEQ ID NO: 257226 - RNA, 64 nt, Human
agaggcuauaccucaaaguagcugcggauuuugucuccugcacugccaauaugcaacugauccc

SEQ ID NO: 257227 - RNA, 64 nt, Human
aacagguaacugacuguucccaccugcuccuuuucuccugcagcauggagcaaucagucaugug

SEQ ID NO: 257228 - RNA, 64 nt, Human
guucaugucccugcggcuggccucucgccagccacuccugcagugugcguccggccgccugagc

SEQ ID NO: 257229 - RNA, 64 nt, Human
gggcucugggcuggggucggcccugggcaggcuucuccugcaccuuuugucugcugggcugagg

SEQ ID NO: 257230 - RNA, 64 nt, Human
gccaagucuagcauguuccugucuccaacaccgccuccugcacaugcagagcagacagaaauac

SEQ ID NO: 257231 - RNA, 64 nt, Human
cucugcuuccugccagggcccugguccucacucccuccugcauuccucauuuaaggaguguuua

SEQ ID NO: 257232 - RNA, 64 nt, Human
ggggauggggacauggagaggaaggggccgccuacuccugcaaaugcuugugacagaugccagg

SEQ ID NO: 257233 - RNA, 64 nt, Human
cccuugcucccaaagcuuuccuuggagaagggcccuccugcagcuggacccugcaggguggcuc

SEQ ID NO: 257234 - RNA, 64 nt, Human
uagcccuccacuucuccagccucucagcccugugcuccugcauccagaguggaacccaggcugg

SEQ ID NO: 257235 - RNA, 64 nt, Human
cgguggccaggaaggcugaagcccgcuucccaugcuccugcaucaggugcccagccgugggugg

SEQ ID NO: 257236 - RNA, 64 nt, Human
caucucccacccuugaucucaucacccugccggccuccugcaagauccucauugagccacucca

SEQ ID NO: 257237 - RNA, 64 nt, Human
cgaaggguuuaucugcguucgucucggugggcuucuccugcaugggaguuguguuccugugcaa

SEQ ID NO: 257238 - RNA, 64 nt, Human
ccuggcuaugggugccacuggagcuagaacagcccuccugcacccaggcuggcgacagcccagc

SEQ ID NO: 257239 - RNA, 64 nt, Human
gauuucauguugacccuggggaugcugugaauuucuccugcaggagagacaucauugaauuuuu

SEQ ID NO: 257240 - RNA, 57 nt, Human
aggccaaaccugccgaauaagccucuucuccugcagccugagauggauggacagaca

SEQ ID NO: 257241 - RNA, 64 nt, Human; identical to SEQ ID NO: 138876

SEQ ID NO: 257242 - RNA, 64 nt, Human; identical to SEQ ID NO: 138886

SEQ ID NO: 257243 - RNA, 52 nt, Human; identical to SEQ ID NO: 141772

SEQ ID NO: 257244 - RNA, 64 nt, Human; identical to SEQ ID NO: 141777

SEQ ID NO: 257245 - RNA, 64 nt, Human
cccugaacacccaaucucggccccucucgccacccuccugcauuucuguucaguucguuuaugu

SEQ ID NO: 257246 - RNA, 64 nt, Human
cagagucccgugcccauuaggucuggcaugcccccuccugcaaggggcucaacccccuaccccg

SEQ ID NO: 257247 - RNA, 64 nt, Human; identical to SEQ ID NO: 256730

SEQ ID NO: 257248 - RNA, 64 nt, Human
ggaaauggacaagguggggggccccacucuuucucuccugcagucccguagcuggggccuccuu

SEQ ID NO: 257249 - RNA, 64 nt, Human
gggcuccagagagacccuagguacugccuucuaacuccugcauccucagaaggggaaaagggac

SEQ ID NO: 257250 - RNA, 64 nt, Human
gcacacugggacuggccccacucucccagcuggacuccugcaugcuccuccccuugggcucuca

SEQ ID NO: 257251 - RNA, 64 nt, Human
ugaguuuaguuuucucuuuuauaaacccagugaacuccugcacuggcauuuggauguguguuaa

SEQ ID NO: 257252 - RNA, 64 nt, Human
uuccgcggccaccgugcuccgggcaccccgggagcuccugcaagaggccugaggagggaggcuc

SEQ ID NO: 257253 - RNA, 64 nt, Human
gguuggaauucuucuuucagaggagcgccuggggcuccugcaagucagcuacucuccgugccca

SEQ ID NO: 257254 - RNA, 64 nt, Human; identical to SEQ ID NO: 185764

SEQ ID NO: 257255 - RNA, 64 nt, Human; identical to SEQ ID NO: 141767

SEQ ID NO: 257256 - RNA, 64 nt, Human; identical to SEQ ID NO: 141782

SEQ ID NO: 257257 - RNA, 60 nt, Human
ugcacugugcaaagcaugcccuucugcacaggagagcaaggcacuugcaguagugaucua

SEQ ID NO: 257258 - RNA, 64 nt, Human; identical to SEQ ID NO: 185765

SEQ ID NO: 257259 - RNA, 64 nt, Human; identical to SEQ ID NO: 185766

SEQ ID NO: 257260 - RNA, 64 nt, Human; identical to SEQ ID NO: 185767

SEQ ID NO: 257261 - RNA, 64 nt, Human; identical to SEQ ID NO: 185768

SEQ ID NO: 257262 - RNA, 64 nt, Human; identical to SEQ ID NO: 185769

SEQ ID NO: 257263 - RNA, 64 nt, Human; identical to SEQ ID NO: 185770

SEQ ID NO: 257264 - RNA, 64 nt, Human; identical to SEQ ID NO: 185771

SEQ ID NO: 257265 - RNA, 64 nt, Human; identical to SEQ ID NO: 185772

SEQ ID NO: 257266 - RNA, 64 nt, Human; identical to SEQ ID NO: 185773

SEQ ID NO: 257267 - RNA, 64 nt, Human; identical to SEQ ID NO: 185774

SEQ ID NO: 257268 - RNA, 64 nt, Human; identical to SEQ ID NO: 185778

SEQ ID NO: 257269 - RNA, 64 nt, Human; identical to SEQ ID NO: 185779

SEQ ID NO: 257270 - RNA, 64 nt, Human; identical to SEQ ID NO: 185780

SEQ ID NO: 257271 - RNA, 64 nt, Human; identical to SEQ ID NO: 185781

SEQ ID NO: 257272 - RNA, 64 nt, Human; identical to SEQ ID NO: 185782

SEQ ID NO: 257273 - RNA, 64 nt, Human; identical to SEQ ID NO: 138858

SEQ ID NO: 257274 - RNA, 64 nt, Human; identical to SEQ ID NO: 141784

SEQ ID NO: 257275 - RNA, 64 nt, Human; identical to SEQ ID NO: 141785

SEQ ID NO: 257276 - RNA, 64 nt, Human; identical to SEQ ID NO: 185783

SEQ ID NO: 257277 - RNA, 64 nt, Human; identical to SEQ ID NO: 185784

SEQ ID NO: 257278 - RNA, 64 nt, Human; identical to SEQ ID NO: 185785

SEQ ID NO: 257279 - RNA, 64 nt, Human; identical to SEQ ID NO: 185786

SEQ ID NO: 257280 - RNA, 64 nt, Human; identical to SEQ ID NO: 185787

SEQ ID NO: 257281 - RNA, 64 nt, Human; identical to SEQ ID NO: 185788

SEQ ID NO: 257282 - RNA, 64 nt, Human; identical to SEQ ID NO: 185789

SEQ ID NO: 257283 - RNA, 64 nt, Human; identical to SEQ ID NO: 185790

SEQ ID NO: 257284 - RNA, 64 nt, Human; identical to SEQ ID NO: 185791

SEQ ID NO: 257285 - RNA, 64 nt, Human; identical to SEQ ID NO: 185792

SEQ ID NO: 257286 - RNA, 64 nt, Human; identical to SEQ ID NO: 185793

SEQ ID NO: 257287 - RNA, 64 nt, Human; identical to SEQ ID NO: 185797

SEQ ID NO: 257288 - RNA, 64 nt, Human; identical to SEQ ID NO: 185798

SEQ ID NO: 257289 - RNA, 64 nt, Human; identical to SEQ ID NO: 185799

SEQ ID NO: 257290 - RNA, 64 nt, Human; identical to SEQ ID NO: 185800

SEQ ID NO: 257291 - RNA, 64 nt, Human; identical to SEQ ID NO: 138849

SEQ ID NO: 257292 - RNA, 64 nt, Human; identical to SEQ ID NO: 138850

SEQ ID NO: 257293 - RNA, 64 nt, Human; identical to SEQ ID NO: 138851

SEQ ID NO: 257294 - RNA, 64 nt, Human; identical to SEQ ID NO: 185801

SEQ ID NO: 257295 - RNA, 64 nt, Human; identical to SEQ ID NO: 185802

SEQ ID NO: 257296 - RNA, 64 nt, Human; identical to SEQ ID NO: 185803

SEQ ID NO: 257297 - RNA, 64 nt, Human; identical to SEQ ID NO: 185804

SEQ ID NO: 257298 - RNA, 64 nt, Human; identical to SEQ ID NO: 185805

SEQ ID NO: 257299 - RNA, 64 nt, Human; identical to SEQ ID NO: 185806

SEQ ID NO: 257300 - RNA, 64 nt, Human; identical to SEQ ID NO: 185807

SEQ ID NO: 257301 - RNA, 64 nt, Human; identical to SEQ ID NO: 185808

SEQ ID NO: 257302 - RNA, 64 nt, Human; identical to SEQ ID NO: 185809

SEQ ID NO: 257303 - RNA, 64 nt, Human; identical to SEQ ID NO: 185810

SEQ ID NO: 257304 - RNA, 64 nt, Human; identical to SEQ ID NO: 185811

SEQ ID NO: 257305 - RNA, 64 nt, Human; identical to SEQ ID NO: 185812

SEQ ID NO: 257306 - RNA, 64 nt, Human; identical to SEQ ID NO: 185816

SEQ ID NO: 257307 - RNA, 64 nt, Human; identical to SEQ ID NO: 185817

SEQ ID NO: 257308 - RNA, 64 nt, Human; identical to SEQ ID NO: 185818

SEQ ID NO: 257309 - RNA, 61 nt, Human; identical to SEQ ID NO: 138854

SEQ ID NO: 257310 - RNA, 64 nt, Human; identical to SEQ ID NO: 138855

SEQ ID NO: 257311 - RNA, 64 nt, Human; identical to SEQ ID NO: 138856

SEQ ID NO: 257312 - RNA, 64 nt, Human; identical to SEQ ID NO: 138857

SEQ ID NO: 257313 - RNA, 64 nt, Human; identical to SEQ ID NO: 185819

SEQ ID NO: 257314 - RNA, 64 nt, Human; identical to SEQ ID NO: 185820

SEQ ID NO: 257315 - RNA, 64 nt, Human; identical to SEQ ID NO: 185821

SEQ ID NO: 257316 - RNA, 64 nt, Human; identical to SEQ ID NO: 185822

SEQ ID NO: 257317 - RNA, 64 nt, Human; identical to SEQ ID NO: 185823

SEQ ID NO: 257318 - RNA, 64 nt, Human; identical to SEQ ID NO: 185824

SEQ ID NO: 257319 - RNA, 64 nt, Human; identical to SEQ ID NO: 185825

SEQ ID NO: 257320 - RNA, 64 nt, Human; identical to SEQ ID NO: 185826

SEQ ID NO: 257321 - RNA, 64 nt, Human; identical to SEQ ID NO: 185827

SEQ ID NO: 257322 - RNA, 64 nt, Human; identical to SEQ ID NO: 185828

SEQ ID NO: 257323 - RNA, 64 nt, Human; identical to SEQ ID NO: 185829

SEQ ID NO: 257324 - RNA, 64 nt, Human; identical to SEQ ID NO: 185830

SEQ ID NO: 257325 - RNA, 64 nt, Human; identical to SEQ ID NO: 185831

SEQ ID NO: 257326 - RNA, 64 nt, Human; identical to SEQ ID NO: 185835

SEQ ID NO: 257327 - RNA, 64 nt, Human; identical to SEQ ID NO: 185836

SEQ ID NO: 257328 - RNA, 64 nt, Human; identical to SEQ ID NO: 138842

SEQ ID NO: 257329 - RNA, 64 nt, Human; identical to SEQ ID NO: 138860

SEQ ID NO: 257330 - RNA, 64 nt, Human; identical to SEQ ID NO: 138861

SEQ ID NO: 257331 - RNA, 64 nt, Human; identical to SEQ ID NO: 185837

SEQ ID NO: 257332 - RNA, 64 nt, Human; identical to SEQ ID NO: 185838

SEQ ID NO: 257333 - RNA, 64 nt, Human; identical to SEQ ID NO: 185839

SEQ ID NO: 257334 - RNA, 64 nt, Human; identical to SEQ ID NO: 185840

SEQ ID NO: 257335 - RNA, 64 nt, Human; identical to SEQ ID NO: 185841

SEQ ID NO: 257336 - RNA, 64 nt, Human; identical to SEQ ID NO: 185842

SEQ ID NO: 257337 - RNA, 64 nt, Human; identical to SEQ ID NO: 185843

SEQ ID NO: 257338 - RNA, 64 nt, Human; identical to SEQ ID NO: 185844

SEQ ID NO: 257339 - RNA, 64 nt, Human; identical to SEQ ID NO: 185845

SEQ ID NO: 257340 - RNA, 64 nt, Human; identical to SEQ ID NO: 185846

SEQ ID NO: 257341 - RNA, 64 nt, Human; identical to SEQ ID NO: 185847

SEQ ID NO: 257342 - RNA, 64 nt, Human; identical to SEQ ID NO: 185848

SEQ ID NO: 257343 - RNA, 64 nt, Human; identical to SEQ ID NO: 185849

SEQ ID NO: 257344 - RNA, 64 nt, Human; identical to SEQ ID NO: 185850

SEQ ID NO: 257345 - RNA, 64 nt, Human; identical to SEQ ID NO: 185854

SEQ ID NO: 257346 - RNA, 64 nt, Human; identical to SEQ ID NO: 138862

SEQ ID NO: 257347 - RNA, 64 nt, Human; identical to SEQ ID NO: 138905

SEQ ID NO: 257348 - RNA, 64 nt, Human; identical to SEQ ID NO: 141788

SEQ ID NO: 257349 - RNA, 64 nt, Human; identical to SEQ ID NO: 185855

SEQ ID NO: 257350 - RNA, 64 nt, Human; identical to SEQ ID NO: 185856

SEQ ID NO: 257351 - RNA, 64 nt, Human; identical to SEQ ID NO: 185857

SEQ ID NO: 257352 - RNA, 64 nt, Human; identical to SEQ ID NO: 185858

SEQ ID NO: 257353 - RNA, 64 nt, Human; identical to SEQ ID NO: 185859

SEQ ID NO: 257354 - RNA, 64 nt, Human; identical to SEQ ID NO: 185860

SEQ ID NO: 257355 - RNA, 64 nt, Human; identical to SEQ ID NO: 185861

SEQ ID NO: 257356 - RNA, 64 nt, Human; identical to SEQ ID NO: 185862

SEQ ID NO: 257357 - RNA, 64 nt, Human; identical to SEQ ID NO: 185863

SEQ ID NO: 257358 - RNA, 64 nt, Human; identical to SEQ ID NO: 185864

SEQ ID NO: 257359 - RNA, 64 nt, Human; identical to SEQ ID NO: 185865

SEQ ID NO: 257360 - RNA, 64 nt, Human; identical to SEQ ID NO: 185866

SEQ ID NO: 257361 - RNA, 64 nt, Human; identical to SEQ ID NO: 185867

SEQ ID NO: 257362 - RNA, 64 nt, Human; identical to SEQ ID NO: 185868

SEQ ID NO: 257363 - RNA, 64 nt, Human; identical to SEQ ID NO: 185869

SEQ ID NO: 257364 - RNA, 64 nt, Human; identical to SEQ ID NO: 138864

SEQ ID NO: 257365 - RNA, 64 nt, Human; identical to SEQ ID NO: 138865

SEQ ID NO: 257366 - RNA, 64 nt, Human; identical to SEQ ID NO: 138866

SEQ ID NO: 257367 - RNA, 64 nt, Human; identical to SEQ ID NO: 185873

SEQ ID NO: 257368 - RNA, 64 nt, Human; identical to SEQ ID NO: 185874

SEQ ID NO: 257369 - RNA, 64 nt, Human; identical to SEQ ID NO: 185875

SEQ ID NO: 257370 - RNA, 64 nt, Human; identical to SEQ ID NO: 185876

SEQ ID NO: 257371 - RNA, 64 nt, Human; identical to SEQ ID NO: 185877

SEQ ID NO: 257372 - RNA, 64 nt, Human; identical to SEQ ID NO: 185878

SEQ ID NO: 257373 - RNA, 64 nt, Human; identical to SEQ ID NO: 185879

SEQ ID NO: 257374 - RNA, 64 nt, Human; identical to SEQ ID NO: 185880

SEQ ID NO: 257375 - RNA, 64 nt, Human; identical to SEQ ID NO: 185881

SEQ ID NO: 257376 - RNA, 64 nt, Human; identical to SEQ ID NO: 185882

SEQ ID NO: 257377 - RNA, 64 nt, Human; identical to SEQ ID NO: 185883

SEQ ID NO: 257378 - RNA, 64 nt, Human; identical to SEQ ID NO: 185884

SEQ ID NO: 257379 - RNA, 64 nt, Human; identical to SEQ ID NO: 185885

SEQ ID NO: 257380 - RNA, 64 nt, Human; identical to SEQ ID NO: 185886

SEQ ID NO: 257381 - RNA, 64 nt, Human; identical to SEQ ID NO: 185887

SEQ ID NO: 257382 - RNA, 64 nt, Human; identical to SEQ ID NO: 138837

SEQ ID NO: 257383 - RNA, 64 nt, Human; identical to SEQ ID NO: 138869

SEQ ID NO: 257384 - RNA, 64 nt, Human; identical to SEQ ID NO: 138870

SEQ ID NO: 257385 - RNA, 64 nt, Human; identical to SEQ ID NO: 185888

SEQ ID NO: 257386 - RNA, 64 nt, Human; identical to SEQ ID NO: 185892

SEQ ID NO: 257387 - RNA, 64 nt, Human; identical to SEQ ID NO: 185893

SEQ ID NO: 257388 - RNA, 64 nt, Human; identical to SEQ ID NO: 185894

SEQ ID NO: 257389 - RNA, 64 nt, Human; identical to SEQ ID NO: 185895

SEQ ID NO: 257390 - RNA, 64 nt, Human; identical to SEQ ID NO: 185896

SEQ ID NO: 257391 - RNA, 64 nt, Human; identical to SEQ ID NO: 185897

SEQ ID NO: 257392 - RNA, 64 nt, Human; identical to SEQ ID NO: 185898

SEQ ID NO: 257393 - RNA, 64 nt, Human; identical to SEQ ID NO: 185899

SEQ ID NO: 257394 - RNA, 64 nt, Human; identical to SEQ ID NO: 185900

SEQ ID NO: 257395 - RNA, 64 nt, Human; identical to SEQ ID NO: 185901

SEQ ID NO: 257396 - RNA, 64 nt, Human; identical to SEQ ID NO: 185902

SEQ ID NO: 257397 - RNA, 64 nt, Human; identical to SEQ ID NO: 185903

SEQ ID NO: 257398 - RNA, 64 nt, Human; identical to SEQ ID NO: 185904

SEQ ID NO: 257399 - RNA, 64 nt, Human; identical to SEQ ID NO: 185905

SEQ ID NO: 257400 - RNA, 64 nt, Human; identical to SEQ ID NO: 138873

SEQ ID NO: 257401 - RNA, 64 nt, Human; identical to SEQ ID NO: 138874

SEQ ID NO: 257402 - RNA, 64 nt, Human; identical to SEQ ID NO: 138875

SEQ ID NO: 257403 - RNA, 64 nt, Human; identical to SEQ ID NO: 185906

SEQ ID NO: 257404 - RNA, 64 nt, Human; identical to SEQ ID NO: 185907

SEQ ID NO: 257405 - RNA, 64 nt, Human; identical to SEQ ID NO: 185911

SEQ ID NO: 257406 - RNA, 64 nt, Human; identical to SEQ ID NO: 185912

SEQ ID NO: 257407 - RNA, 64 nt, Human; identical to SEQ ID NO: 185913

SEQ ID NO: 257408 - RNA, 64 nt, Human; identical to SEQ ID NO: 185914

SEQ ID NO: 257409 - RNA, 64 nt, Human; identical to SEQ ID NO: 185915

SEQ ID NO: 257410 - RNA, 64 nt, Human; identical to SEQ ID NO: 185916

SEQ ID NO: 257411 - RNA, 64 nt, Human; identical to SEQ ID NO: 185917

SEQ ID NO: 257412 - RNA, 64 nt, Human; identical to SEQ ID NO: 185918

SEQ ID NO: 257413 - RNA, 64 nt, Human; identical to SEQ ID NO: 185919

SEQ ID NO: 257414 - RNA, 64 nt, Human; identical to SEQ ID NO: 185920

SEQ ID NO: 257415 - RNA, 64 nt, Human; identical to SEQ ID NO: 185921

SEQ ID NO: 257416 - RNA, 64 nt, Human; identical to SEQ ID NO: 185922

SEQ ID NO: 257417 - RNA, 64 nt, Human; identical to SEQ ID NO: 185923

SEQ ID NO: 257418 - RNA, 64 nt, Human; identical to SEQ ID NO: 138867

SEQ ID NO: 257419 - RNA, 64 nt, Human; identical to SEQ ID NO: 138901

SEQ ID NO: 257420 - RNA, 64 nt, Human; identical to SEQ ID NO: 138911

SEQ ID NO: 257421 - RNA, 64 nt, Human; identical to SEQ ID NO: 185924

SEQ ID NO: 257422 - RNA, 64 nt, Human; identical to SEQ ID NO: 185925

SEQ ID NO: 257423 - RNA, 64 nt, Human; identical to SEQ ID NO: 185926

SEQ ID NO: 257424 - RNA, 64 nt, Human; identical to SEQ ID NO: 185930

SEQ ID NO: 257425 - RNA, 64 nt, Human; identical to SEQ ID NO: 185931

SEQ ID NO: 257426 - RNA, 64 nt, Human; identical to SEQ ID NO: 185932

SEQ ID NO: 257427 - RNA, 64 nt, Human; identical to SEQ ID NO: 185933

SEQ ID NO: 257428 - RNA, 64 nt, Human; identical to SEQ ID NO: 185934

SEQ ID NO: 257429 - RNA, 64 nt, Human; identical to SEQ ID NO: 185935

SEQ ID NO: 257430 - RNA, 64 nt, Human; identical to SEQ ID NO: 185936

SEQ ID NO: 257431 - RNA, 64 nt, Human; identical to SEQ ID NO: 185937

SEQ ID NO: 257432 - RNA, 64 nt, Human; identical to SEQ ID NO: 185938

SEQ ID NO: 257433 - RNA, 64 nt, Human; identical to SEQ ID NO: 185939

SEQ ID NO: 257434 - RNA, 64 nt, Human; identical to SEQ ID NO: 185940

SEQ ID NO: 257435 - RNA, 64 nt, Human; identical to SEQ ID NO: 185941

SEQ ID NO: 257436 - RNA, 64 nt, Human; identical to SEQ ID NO: 138878

SEQ ID NO: 257437 - RNA, 64 nt, Human; identical to SEQ ID NO: 138879

SEQ ID NO: 257438 - RNA, 64 nt, Human; identical to SEQ ID NO: 138880

SEQ ID NO: 257439 - RNA, 64 nt, Human; identical to SEQ ID NO: 185942

SEQ ID NO: 257440 - RNA, 64 nt, Human; identical to SEQ ID NO: 185943

SEQ ID NO: 257441 - RNA, 64 nt, Human; identical to SEQ ID NO: 185944

SEQ ID NO: 257442 - RNA, 51 nt, Human; identical to SEQ ID NO: 185945

SEQ ID NO: 257443 - RNA, 64 nt, Human; identical to SEQ ID NO: 185949

SEQ ID NO: 257444 - RNA, 64 nt, Human; identical to SEQ ID NO: 185950

SEQ ID NO: 257445 - RNA, 64 nt, Human; identical to SEQ ID NO: 185951

SEQ ID NO: 257446 - RNA, 64 nt, Human; identical to SEQ ID NO: 185952

SEQ ID NO: 257447 - RNA, 64 nt, Human; identical to SEQ ID NO: 185953

SEQ ID NO: 257448 - RNA, 64 nt, Human; identical to SEQ ID NO: 185954

SEQ ID NO: 257449 - RNA, 64 nt, Human; identical to SEQ ID NO: 185955

SEQ ID NO: 257450 - RNA, 64 nt, Human; identical to SEQ ID NO: 185956

SEQ ID NO: 257451 - RNA, 64 nt, Human; identical to SEQ ID NO: 185957

SEQ ID NO: 257452 - RNA, 64 nt, Human; identical to SEQ ID NO: 185958

SEQ ID NO: 257453 - RNA, 64 nt, Human; identical to SEQ ID NO: 185959

SEQ ID NO: 257454 - RNA, 64 nt, Human; identical to SEQ ID NO: 138832

SEQ ID NO: 257455 - RNA, 64 nt, Human; identical to SEQ ID NO: 138883

SEQ ID NO: 257456 - RNA, 64 nt, Human; identical to SEQ ID NO: 138884

SEQ ID NO: 257457 - RNA, 64 nt, Human; identical to SEQ ID NO: 138885

SEQ ID NO: 257458 - RNA, 64 nt, Human; identical to SEQ ID NO: 185960

SEQ ID NO: 257459 - RNA, 64 nt, Human; identical to SEQ ID NO: 185961

SEQ ID NO: 257460 - RNA, 64 nt, Human; identical to SEQ ID NO: 185962

SEQ ID NO: 257461 - RNA, 64 nt, Human; identical to SEQ ID NO: 185963

SEQ ID NO: 257462 - RNA, 64 nt, Human; identical to SEQ ID NO: 185964

SEQ ID NO: 257463 - RNA, 64 nt, Human; identical to SEQ ID NO: 185968

SEQ ID NO: 257464 - RNA, 64 nt, Human; identical to SEQ ID NO: 185969

SEQ ID NO: 257465 - RNA, 64 nt, Human; identical to SEQ ID NO: 185970

SEQ ID NO: 257466 - RNA, 64 nt, Human; identical to SEQ ID NO: 185971

SEQ ID NO: 257467 - RNA, 64 nt, Human; identical to SEQ ID NO: 185972

SEQ ID NO: 257468 - RNA, 53 nt, Human; identical to SEQ ID NO: 185973

SEQ ID NO: 257469 - RNA, 64 nt, Human; identical to SEQ ID NO: 185974

SEQ ID NO: 257470 - RNA, 64 nt, Human; identical to SEQ ID NO: 185975

SEQ ID NO: 257471 - RNA, 64 nt, Human; identical to SEQ ID NO: 185976

SEQ ID NO: 257472 - RNA, 64 nt, Human; identical to SEQ ID NO: 185977

SEQ ID NO: 257473 - RNA, 64 nt, Human; identical to SEQ ID NO: 138888

SEQ ID NO: 257474 - RNA, 64 nt, Human; identical to SEQ ID NO: 138889

SEQ ID NO: 257475 - RNA, 57 nt, Human; identical to SEQ ID NO: 138890

SEQ ID NO: 257476 - RNA, 64 nt, Human; identical to SEQ ID NO: 138891

SEQ ID NO: 257477 - RNA, 64 nt, Human; identical to SEQ ID NO: 185978

SEQ ID NO: 257478 - RNA, 64 nt, Human; identical to SEQ ID NO: 185979

SEQ ID NO: 257479 - RNA, 64 nt, Human; identical to SEQ ID NO: 185980

SEQ ID NO: 257480 - RNA, 64 nt, Human; identical to SEQ ID NO: 185981

SEQ ID NO: 257481 - RNA, 64 nt, Human; identical to SEQ ID NO: 185982

SEQ ID NO: 257482 - RNA, 64 nt, Human; identical to SEQ ID NO: 185983

SEQ ID NO: 257483 - RNA, 64 nt, Human; identical to SEQ ID NO: 185987

SEQ ID NO: 257484 - RNA, 64 nt, Human; identical to SEQ ID NO: 185988

SEQ ID NO: 257485 - RNA, 64 nt, Human; identical to SEQ ID NO: 185989

SEQ ID NO: 257486 - RNA, 64 nt, Human; identical to SEQ ID NO: 185990

SEQ ID NO: 257487 - RNA, 64 nt, Human; identical to SEQ ID NO: 185991

SEQ ID NO: 257488 - RNA, 64 nt, Human; identical to SEQ ID NO: 185992

SEQ ID NO: 257489 - RNA, 64 nt, Human; identical to SEQ ID NO: 185993

SEQ ID NO: 257490 - RNA, 64 nt, Human; identical to SEQ ID NO: 185994

SEQ ID NO: 257491 - RNA, 64 nt, Human; identical to SEQ ID NO: 185995

SEQ ID NO: 257492 - RNA, 64 nt, Human; identical to SEQ ID NO: 138881

SEQ ID NO: 257493 - RNA, 64 nt, Human; identical to SEQ ID NO: 141762

SEQ ID NO: 257494 - RNA, 64 nt, Human; identical to SEQ ID NO: 141791

SEQ ID NO: 257495 - RNA, 64 nt, Human; identical to SEQ ID NO: 185996

SEQ ID NO: 257496 - RNA, 64 nt, Human; identical to SEQ ID NO: 185997

SEQ ID NO: 257497 - RNA, 64 nt, Human; identical to SEQ ID NO: 185998

SEQ ID NO: 257498 - RNA, 64 nt, Human; identical to SEQ ID NO: 185999

SEQ ID NO: 257499 - RNA, 64 nt, Human; identical to SEQ ID NO: 186000

SEQ ID NO: 257500 - RNA, 64 nt, Human; identical to SEQ ID NO: 186001

SEQ ID NO: 257501 - RNA, 64 nt, Human; identical to SEQ ID NO: 186002

SEQ ID NO: 257502 - RNA, 64 nt, Human; identical to SEQ ID NO: 186006

SEQ ID NO: 257503 - RNA, 64 nt, Human; identical to SEQ ID NO: 186007

SEQ ID NO: 257504 - RNA, 64 nt, Human; identical to SEQ ID NO: 186008

SEQ ID NO: 257505 - RNA, 64 nt, Human; identical to SEQ ID NO: 186009

SEQ ID NO: 257506 - RNA, 64 nt, Human; identical to SEQ ID NO: 186010

SEQ ID NO: 257507 - RNA, 64 nt, Human; identical to SEQ ID NO: 186011

SEQ ID NO: 257508 - RNA, 64 nt, Human; identical to SEQ ID NO: 186012

SEQ ID NO: 257509 - RNA, 64 nt, Human; identical to SEQ ID NO: 186013

SEQ ID NO: 257510 - RNA, 64 nt, Human; identical to SEQ ID NO: 138871

SEQ ID NO: 257511 - RNA, 64 nt, Human; identical to SEQ ID NO: 138894

SEQ ID NO: 257512 - RNA, 57 nt, Human; identical to SEQ ID NO: 138895

SEQ ID NO: 257513 - RNA, 64 nt, Human; identical to SEQ ID NO: 138896

SEQ ID NO: 257514 - RNA, 64 nt, Human; identical to SEQ ID NO: 186014

SEQ ID NO: 257515 - RNA, 64 nt, Human; identical to SEQ ID NO: 186015

SEQ ID NO: 257516 - RNA, 64 nt, Human; identical to SEQ ID NO: 186016

SEQ ID NO: 257517 - RNA, 64 nt, Human; identical to SEQ ID NO: 186017

SEQ ID NO: 257518 - RNA, 64 nt, Human; identical to SEQ ID NO: 186018

SEQ ID NO: 257519 - RNA, 64 nt, Human; identical to SEQ ID NO: 186019

SEQ ID NO: 257520 - RNA, 64 nt, Human; identical to SEQ ID NO: 186020

SEQ ID NO: 257521 - RNA, 64 nt, Human; identical to SEQ ID NO: 186021

SEQ ID NO: 257522 - RNA, 64 nt, Human; identical to SEQ ID NO: 186025

SEQ ID NO: 257523 - RNA, 64 nt, Human; identical to SEQ ID NO: 186026

SEQ ID NO: 257524 - RNA, 64 nt, Human; identical to SEQ ID NO: 186027

SEQ ID NO: 257525 - RNA, 64 nt, Human; identical to SEQ ID NO: 186028

SEQ ID NO: 257526 - RNA, 64 nt, Human; identical to SEQ ID NO: 186029

SEQ ID NO: 257527 - RNA, 64 nt, Human; identical to SEQ ID NO: 186015

SEQ ID NO: 257528 - RNA, 64 nt, Human; identical to SEQ ID NO: 186031

SEQ ID NO: 257529 - RNA, 64 nt, Human; identical to SEQ ID NO: 138897

SEQ ID NO: 257530 - RNA, 64 nt, Human; identical to SEQ ID NO: 138899

SEQ ID NO: 257531 - RNA, 64 nt, Human; identical to SEQ ID NO: 138900

SEQ ID NO: 257532 - RNA, 64 nt, Human; identical to SEQ ID NO: 186032

SEQ ID NO: 257533 - RNA, 64 nt, Human; identical to SEQ ID NO: 186033

SEQ ID NO: 257534 - RNA, 64 nt, Human; identical to SEQ ID NO: 186034

SEQ ID NO: 257535 - RNA, 64 nt, Human; identical to SEQ ID NO: 186035

SEQ ID NO: 257536 - RNA, 64 nt, Human; identical to SEQ ID NO: 186036

SEQ ID NO: 257537 - RNA, 64 nt, Human; identical to SEQ ID NO: 186037

SEQ ID NO: 257538 - RNA, 64 nt, Human; identical to SEQ ID NO: 186038

SEQ ID NO: 257539 - RNA, 64 nt, Human; identical to SEQ ID NO: 186039

SEQ ID NO: 257540 - RNA, 64 nt, Human; identical to SEQ ID NO: 186040

SEQ ID NO: 257541 - RNA, 64 nt, Human; identical to SEQ ID NO: 186044

SEQ ID NO: 257542 - RNA, 64 nt, Human; identical to SEQ ID NO: 186045

SEQ ID NO: 257543 - RNA, 64 nt, Human; identical to SEQ ID NO: 186046

SEQ ID NO: 257544 - RNA, 64 nt, Human; identical to SEQ ID NO: 186047

SEQ ID NO: 257545 - RNA, 64 nt, Human; identical to SEQ ID NO: 186048

SEQ ID NO: 257546 - RNA, 64 nt, Human; identical to SEQ ID NO: 186049

SEQ ID NO: 257547 - RNA, 63 nt, Human
uguuuguauugcaauaaacacugggaccaguuccgggguuaagaauuaauuuuuguuuuuaau

SEQ ID NO: 257548 - RNA, 63 nt, Human
uacuuauauuuuguuuugcuauuaaccuacuuacgggguuagggauuugcggggggggcuugu

SEQ ID NO: 257549 - RNA, 64 nt, Human; identical to SEQ ID NO: 186050

SEQ ID NO: 257550 - RNA, 64 nt, Human; identical to SEQ ID NO: 186051

SEQ ID NO: 257551 - RNA, 64 nt, Human; identical to SEQ ID NO: 186052

SEQ ID NO: 257552 - RNA, 64 nt, Human; identical to SEQ ID NO: 186053

SEQ ID NO: 257553 - RNA, 64 nt, Human; identical to SEQ ID NO: 186054

SEQ ID NO: 257554 - RNA, 64 nt, Human; identical to SEQ ID NO: 186055

SEQ ID NO: 257555 - RNA, 64 nt, Human; identical to SEQ ID NO: 186056

SEQ ID NO: 257556 - RNA, 57 nt, Human; identical to SEQ ID NO: 186057

SEQ ID NO: 257557 - RNA, 64 nt, Human; identical to SEQ ID NO: 186058

SEQ ID NO: 257558 - RNA, 64 nt, Human; identical to SEQ ID NO: 186059

SEQ ID NO: 257559 - RNA, 64 nt, Human; identical to SEQ ID NO: 186063

SEQ ID NO: 257560 - RNA, 64 nt, Human; identical to SEQ ID NO: 186064

SEQ ID NO: 257561 - RNA, 64 nt, Human; identical to SEQ ID NO: 186065

SEQ ID NO: 257562 - RNA, 64 nt, Human; identical to SEQ ID NO: 186066

SEQ ID NO: 257563 - RNA, 64 nt, Human; identical to SEQ ID NO: 186067

SEQ ID NO: 257564 - RNA, 64 nt, Human; identical to SEQ ID NO: 138829

SEQ ID NO: 257565 - RNA, 64 nt, Human; identical to SEQ ID NO: 138830

SEQ ID NO: 257566 - RNA, 64 nt, Human; identical to SEQ ID NO: 138831

SEQ ID NO: 257567 - RNA, 64 nt, Human; identical to SEQ ID NO: 186068

SEQ ID NO: 257568 - RNA, 64 nt, Human; identical to SEQ ID NO: 186069

SEQ ID NO: 257569 - RNA, 64 nt, Human; identical to SEQ ID NO: 186070

SEQ ID NO: 257570 - RNA, 64 nt, Human; identical to SEQ ID NO: 186071

SEQ ID NO: 257571 - RNA, 64 nt, Human; identical to SEQ ID NO: 186072

SEQ ID NO: 257572 - RNA, 64 nt, Human; identical to SEQ ID NO: 186073

SEQ ID NO: 257573 - RNA, 64 nt, Human; identical to SEQ ID NO: 186074

SEQ ID NO: 257574 - RNA, 64 nt, Human; identical to SEQ ID NO: 186075

SEQ ID NO: 257575 - RNA, 64 nt, Human; identical to SEQ ID NO: 186076

SEQ ID NO: 257576 - RNA, 64 nt, Human; identical to SEQ ID NO: 186077

SEQ ID NO: 257577 - RNA, 64 nt, Human; identical to SEQ ID NO: 186078

SEQ ID NO: 257578 - RNA, 64 nt, Human; identical to SEQ ID NO: 186082

SEQ ID NO: 257579 - RNA, 64 nt, Human; identical to SEQ ID NO: 186083

SEQ ID NO: 257580 - RNA, 64 nt, Human; identical to SEQ ID NO: 186084

SEQ ID NO: 257581 - RNA, 64 nt, Human; identical to SEQ ID NO: 186085

SEQ ID NO: 257582 - RNA, 64 nt, Human; identical to SEQ ID NO: 138827

SEQ ID NO: 257583 - RNA, 64 nt, Human; identical to SEQ ID NO: 138903

SEQ ID NO: 257584 - RNA, 64 nt, Human; identical to SEQ ID NO: 138904

SEQ ID NO: 257585 - RNA, 64 nt, Human; identical to SEQ ID NO: 186086

SEQ ID NO: 257586 - RNA, 64 nt, Human; identical to SEQ ID NO: 186087

SEQ ID NO: 257587 - RNA, 64 nt, Human; identical to SEQ ID NO: 186088

SEQ ID NO: 257588 - RNA, 64 nt, Human; identical to SEQ ID NO: 186089

SEQ ID NO: 257589 - RNA, 64 nt, Human; identical to SEQ ID NO: 186090

SEQ ID NO: 257590 - RNA, 64 nt, Human; identical to SEQ ID NO: 186091

SEQ ID NO: 257591 - RNA, 64 nt, Human; identical to SEQ ID NO: 186092

SEQ ID NO: 257592 - RNA, 64 nt, Human; identical to SEQ ID NO: 186093

SEQ ID NO: 257593 - RNA, 64 nt, Human; identical to SEQ ID NO: 186094

SEQ ID NO: 257594 - RNA, 64 nt, Human; identical to SEQ ID NO: 186095

SEQ ID NO: 257595 - RNA, 64 nt, Human; identical to SEQ ID NO: 186096

SEQ ID NO: 257596 - RNA, 64 nt, Human; identical to SEQ ID NO: 186097

SEQ ID NO: 257597 - RNA, 64 nt, Human; identical to SEQ ID NO: 186101

SEQ ID NO: 257598 - RNA, 64 nt, Human; identical to SEQ ID NO: 186102

SEQ ID NO: 257599 - RNA, 64 nt, Human; identical to SEQ ID NO: 186103

SEQ ID NO: 257600 - RNA, 64 nt, Human; identical to SEQ ID NO: 138834

SEQ ID NO: 257601 - RNA, 64 nt, Human; identical to SEQ ID NO: 138835

SEQ ID NO: 257602 - RNA, 64 nt, Human; identical to SEQ ID NO: 138836

SEQ ID NO: 257603 - RNA, 64 nt, Human; identical to SEQ ID NO: 186104

SEQ ID NO: 257604 - RNA, 64 nt, Human; identical to SEQ ID NO: 186105

SEQ ID NO: 257605 - RNA, 64 nt, Human; identical to SEQ ID NO: 186106

SEQ ID NO: 257606 - RNA, 64 nt, Human; identical to SEQ ID NO: 186107

SEQ ID NO: 257607 - RNA, 64 nt, Human; identical to SEQ ID NO: 186108

SEQ ID NO: 257608 - RNA, 64 nt, Human; identical to SEQ ID NO: 186109

SEQ ID NO: 257609 - RNA, 64 nt, Human; identical to SEQ ID NO: 186110

SEQ ID NO: 257610 - RNA, 64 nt, Human; identical to SEQ ID NO: 186111

SEQ ID NO: 257611 - RNA, 64 nt, Human; identical to SEQ ID NO: 186112

SEQ ID NO: 257612 - RNA, 64 nt, Human; identical to SEQ ID NO: 186113

SEQ ID NO: 257613 - RNA, 64 nt, Human; identical to SEQ ID NO: 186114

SEQ ID NO: 257614 - RNA, 64 nt, Human; identical to SEQ ID NO: 186115

SEQ ID NO: 257615 - RNA, 64 nt, Human; identical to SEQ ID NO: 186116

SEQ ID NO: 257616 - RNA, 64 nt, Human; identical to SEQ ID NO: 186120

SEQ ID NO: 257617 - RNA, 64 nt, Human; identical to SEQ ID NO: 186121

SEQ ID NO: 257618 - RNA, 64 nt, Human; identical to SEQ ID NO: 138839

SEQ ID NO: 257619 - RNA, 64 nt, Human; identical to SEQ ID NO: 138840

SEQ ID NO: 257620 - RNA, 64 nt, Human; identical to SEQ ID NO: 138841

SEQ ID NO: 257621 - RNA, 64 nt, Human; identical to SEQ ID NO: 186122

SEQ ID NO: 257622 - RNA, 64 nt, Human; identical to SEQ ID NO: 186123

SEQ ID NO: 257623 - RNA, 64 nt, Human; identical to SEQ ID NO: 186124

SEQ ID NO: 257624 - RNA, 64 nt, Human; identical to SEQ ID NO: 186125

SEQ ID NO: 257625 - RNA, 64 nt, Human; identical to SEQ ID NO: 186126

SEQ ID NO: 257626 - RNA, 64 nt, Human; identical to SEQ ID NO: 186127

SEQ ID NO: 257627 - RNA, 64 nt, Human; identical to SEQ ID NO: 186128

SEQ ID NO: 257628 - RNA, 64 nt, Human; identical to SEQ ID NO: 186129

SEQ ID NO: 257629 - RNA, 64 nt, Human; identical to SEQ ID NO: 186130

SEQ ID NO: 257630 - RNA, 64 nt, Human; identical to SEQ ID NO: 186131

SEQ ID NO: 257631 - RNA, 64 nt, Human; identical to SEQ ID NO: 186132

SEQ ID NO: 257632 - RNA, 64 nt, Human; identical to SEQ ID NO: 186133

SEQ ID NO: 257633 - RNA, 64 nt, Human; identical to SEQ ID NO: 186134

SEQ ID NO: 257634 - RNA, 64 nt, Human; identical to SEQ ID NO: 186135

SEQ ID NO: 257635 - RNA, 64 nt, Human; identical to SEQ ID NO: 186139

SEQ ID NO: 257636 - RNA, 64 nt, Human; identical to SEQ ID NO: 138844

SEQ ID NO: 257637 - RNA, 64 nt, Human; identical to SEQ ID NO: 138845

SEQ ID NO: 257638 - RNA, 64 nt, Human; identical to SEQ ID NO: 138846

SEQ ID NO: 257639 - RNA, 64 nt, Human; identical to SEQ ID NO: 186140

SEQ ID NO: 257640 - RNA, 64 nt, Human; identical to SEQ ID NO: 186141

SEQ ID NO: 257641 - RNA, 64 nt, Human; identical to SEQ ID NO: 186142

SEQ ID NO: 257642 - RNA, 64 nt, Human; identical to SEQ ID NO: 186143

SEQ ID NO: 257643 - RNA, 64 nt, Human; identical to SEQ ID NO: 186144

SEQ ID NO: 257644 - RNA, 64 nt, Human; identical to SEQ ID NO: 186145

SEQ ID NO: 257645 - RNA, 64 nt, Human; identical to SEQ ID NO: 186146

SEQ ID NO: 257646 - RNA, 64 nt, Human; identical to SEQ ID NO: 186147

SEQ ID NO: 257647 - RNA, 52 nt, Human; identical to SEQ ID NO: 186148

SEQ ID NO: 257648 - RNA, 64 nt, Human; identical to SEQ ID NO: 186149

SEQ ID NO: 257649 - RNA, 64 nt, Human; identical to SEQ ID NO: 186150

SEQ ID NO: 257650 - RNA, 64 nt, Human; identical to SEQ ID NO: 186151

SEQ ID NO: 257651 - RNA, 64 nt, Human; identical to SEQ ID NO: 186152

SEQ ID NO: 257652 - RNA, 64 nt, Human; identical to SEQ ID NO: 186153

SEQ ID NO: 257653 - RNA, 64 nt, Human; identical to SEQ ID NO: 186154

SEQ ID NO: 257654 - RNA, 64 nt, Human; identical to SEQ ID NO: 138847

SEQ ID NO: 257655 - RNA, 64 nt, Human; identical to SEQ ID NO: 138852

SEQ ID NO: 257656 - RNA, 64 nt, Human; identical to SEQ ID NO: 138892

SEQ ID NO: 257657 - RNA, 64 nt, Human; identical to SEQ ID NO: 186158

SEQ ID NO: 257658 - RNA, 64 nt, Human; identical to SEQ ID NO: 186159

SEQ ID NO: 257659 - RNA, 64 nt, Human; identical to SEQ ID NO: 186160

SEQ ID NO: 257660 - RNA, 63 nt, Human
augcugcccgguugccauggagaucugaaggggcgggguuagagccaagcugcacaauuuaau

SEQ ID NO: 257661 - RNA, 63 nt, Human
agcggccuccccaaagcgacagguaacgcagugcgggguuagggauuccccgggagagaggac

SEQ ID NO: 257662 - RNA, 63 nt, Human
gaugcugaacugacucagcacccuccugcaggacgggguuagggaauuuggugcucaauugcu

SEQ ID NO: 257663 - RNA, 63 nt, Human
uucuggggcaucacaaagaggaagggggucccccgggguuaugcaauguggcugcuuugacug

SEQ ID NO: 257664 - RNA, 63 nt, Human
gauuuacaagcaucauggaucaaccaaguuacacgggguuacacuguuaaucauggguuccuc

SEQ ID NO: 257665 - RNA, 63 nt, Human
aagcuggaaagauaacagauggguuucugagcacgggguuaaccuccagcuaaacucaacuuc

SEQ ID NO: 257666 - RNA, 63 nt, Human
auuugcagauaauucuggaccagagacuuggugcgggguuaacaccuucauccagauugggug

SEQ ID NO: 257667 - RNA, 63 nt, Human
cucggacgccuuuccagccagugucucugacgucgggguuagugccuuagaggguacuggggu

SEQ ID NO: 257668 - RNA, 63 nt, Human
ucuuuaaauaugcuuaaguguuauagggaaagacgggguuaccaguaaacauguaacuagaaa

SEQ ID NO: 257669 - RNA, 63 nt, Human
cgcccagcuaauauuuuguauuuucaguagggacgggguuacaccauguuggccaggcugguc

SEQ ID NO: 257670 - RNA, 63 nt, Human
agaauacaaucaaacuuuaccacuuggaggacacgggguuaguccaggaccaaagaggccaau

SEQ ID NO: 257671 - RNA, 63 nt, Human
ugcaaauauuuuauugauuacaagggcuguauacgggguuacaaaaagacaugagcuggauug

SEQ ID NO: 257672 - RNA, 63 nt, Human
uuucuauacauuuucugagggaaagcagaacaccgggguuauagcuauaccuucaggucuuuu

SEQ ID NO: 257673 - RNA, 63 nt, Human
auauugaggcauucauacagagcugcaguuagacgggguuacgggggcuaaaagcagaaaaaa

SEQ ID NO: 257674 - RNA, 63 nt, Human
uuuuuguaacaauugcuuuuuucaugggggaggcgggguuaguauuuauaguccuaacaaguc

SEQ ID NO: 257675 - RNA, 63 nt, Human
agcaugcuggggaggugaaugccacauccuuggcgggguuauggaccucuugcaugucauagc

SEQ ID NO: 257676 - RNA, 63 nt, Human
ccuuugcaggguuggggguggucagcgguaccccgggguuaggcauccuagacagcagccuga

SEQ ID NO: 257677 - RNA, 64 nt, Human
ggcaguguuguggggacugcaaaagagaaaacguccaggcgagcccaguuguccucgcccacag

SEQ ID NO: 257678 - RNA, 64 nt, Human
caccagccccaggaccuggggcgacuggaggaagccaggcgaguggggcccaggacugguucca

SEQ ID NO: 257679 - RNA, 60 nt, Human
uccucucuauuucagccuaguaucagaaggccaggcgagacugcaacacugcucaucacc

SEQ ID NO: 257680 - RNA, 64 nt, Human
ucccucuccucccaaucuccauaggcugggccucccaggcgaucugcauacuuuaaggaccaga

SEQ ID NO: 257681 - RNA, 64 nt, Human
gggugcuuugugucagugcugcagcacuggggagccaggcgaggggggcuugggggcauggggc

SEQ ID NO: 257682 - RNA, 64 nt, Human
ggagaguugugagggaugggacggaggcuggcgaccaggcgaggccuaggccaggcucgggaga

SEQ ID NO: 257683 - RNA, 64 nt, Human
acuuggggccgaaaaacuguggccugcagaagucccaggcgacccccaucccuaucuagacuua

SEQ ID NO: 257684 - RNA, 55 nt, Human
ugagggaaaacucuucuugaaauaaccaggcgauacuuuguuuuguauauauuug

SEQ ID NO: 257685 - RNA, 64 nt, Human
ccucaggagcuuugcagagaggaggacguguacuccaggcgaggccucuggaccuguguuccug

SEQ ID NO: 257686 - RNA, 64 nt, Human; identical to SEQ ID NO: 141751

SEQ ID NO: 257687 - RNA, 54 nt, Human; identical to SEQ ID NO: 141786

SEQ ID NO: 257688 - RNA, 64 nt, Human; identical to SEQ ID NO: 141859

SEQ ID NO: 257689 - RNA, 64 nt, Human; identical to SEQ ID NO: 141864

SEQ ID NO: 257690 - RNA, 64 nt, Human
caagguaugguuaauaaguuucacugacuuagaaccaggcgagagacuuguggccugggagagc

SEQ ID NO: 257691 - RNA, 64 nt, Human
acaggagcuggggaagggggccucuggggccugaccaggcgacagguaggggcggaggggagcu

SEQ ID NO: 257692 - RNA, 64 nt, Human
gggcccagugcugccccugcugcugcaggagcccccaggcgagguucggccuuccucucgcccc

SEQ ID NO: 257693 - RNA, 64 nt, Human
cugcggaaagcccccucccugagucgucgccacaccaggcgacaggcaccacccccucugauaa

SEQ ID NO: 257694 - RNA, 64 nt, Human
uggcgcgaucucggcucaccgcaaaguccgccucccaggcgauucuccugccucagccuccuga

SEQ ID NO: 257695 - RNA, 64 nt, Human
guccagccucguggcuccauuucaacaucuccccccaggcgauguucucccccaagacgaccag

SEQ ID NO: 257696 - RNA, 64 nt, Human
aaagaugauuuuuacuuaaagauauuaggucuggccaggcgaagugacucacaccugcaauccc

SEQ ID NO: 257697 - RNA, 64 nt, Human
uccggcucuacaaaaaagaguuuuucaaaauuagccaggcgaaguggcacacaucugugguccc

SEQ ID NO: 257698 - RNA, 64 nt, Human
cuuaggcggauucuccuuccuccugcuacugauaccaggcgagggggccaaggguggaucccuc

SEQ ID NO: 257699 - RNA, 50 nt, Human
aagccucacagaugucuugaccaggcgagaagcuguaauaccaauauuaa

SEQ ID NO: 257700 - RNA, 64 nt, Human
cuggucugucuccaggcuggggagagaagggugaccaggcgaggagggagccgagacgucaacu

SEQ ID NO: 257701 - RNA, 64 nt, Human
gcugagauggacuccagaagaagaaacuguuucuccaggcgacuuugaacccauuuuuuggcag

SEQ ID NO: 257702 - RNA, 57 nt, Human
ccaacuuuaauuuuuccugaugaaucuccaggcgacgcgguuuuuucacuucccgag

SEQ ID NO: 257703 - RNA, 64 nt, Human
ggacauguuuuuggaggcauauggagaagggggcccaggcgagguggcucacaccuguaauccc

SEQ ID NO: 257704 - RNA, 64 nt, Human
ucacgugugaucuguguugccccucucgguggucccaggcgauccagccaugcccccugccccu

SEQ ID NO: 257705 - RNA, 64 nt, Human
caccacacuccccgccguacaguucuccagaaucccaggcgaugacaagucugaacccacgaaa

SEQ ID NO: 257706 - RNA, 64 nt, Human; identical to SEQ ID NO: 141794

SEQ ID NO: 257707 - RNA, 64 nt, Human; identical to SEQ ID NO: 141795

SEQ ID NO: 257708 - RNA, 64 nt, Human; identical to SEQ ID NO: 141796

SEQ ID NO: 257709 - RNA, 64 nt, Human; identical to SEQ ID NO: 141797

SEQ ID NO: 257710 - RNA, 64 nt, Human
uugaacauucugauguugucacuaaaguugauuuccaggcgaugcucgugugccccuggcgugg

SEQ ID NO: 257711 - RNA, 64 nt, Human
caacauugaccauuggaggagugguuuaagagugccaggcgaagggcaaacuguagaucgaucu

SEQ ID NO: 257712 - RNA, 50 nt, Human; identical to SEQ ID NO: 257699

SEQ ID NO: 257713 - RNA, 64 nt, Human
cuccuugccuuuucugucgcacagccccuucuuuccaggcgagauuccucagcuucugaguagg

SEQ ID NO: 257714 - RNA, 64 nt, Human
gcagcugaggcaggacaguggggcuaacuguagaccaggcgagggcacgggcugcugggguggc

SEQ ID NO: 257715 - RNA, 64 nt, Human
gaaaucuugcauuuucaaaaauucagugcaagcgccaggcgauuugugucuaaggauacgauuu

SEQ ID NO: 257716 - RNA, 64 nt, Human
cugccucuccucaaaugcugugugcugcaauuguccaggcgaugacaauggugauggcuccaga

SEQ ID NO: 257717 - RNA, 64 nt, Human
agccccauccucucccaggaccaggaguuuaugaccaggcgagcacaaauggcuaaaagccaag

SEQ ID NO: 257718 - RNA, 64 nt, Human
gauuauaggcgugagccaccgcccccagcugauuccaggcgaauucuucucugaugggcgggcg

SEQ ID NO: 257719 - RNA, 64 nt, Human
gagauggaucaaucaaacccggcgguccccuccgccaggcgagauggggugggguggagaacuc

SEQ ID NO: 257720 - RNA, 64 nt, Human
cuuuccucacuguuccuguggaggaugucuacgcccaggcgagcuccucgaccucugagggacc

SEQ ID NO: 257721 - RNA, 64 nt, Human
gcaucauuguuuuaagcuugccuguucaaggcagccaggcgaggggugauggcaacgguggccu

SEQ ID NO: 257722 - RNA, 53 nt, Human
agcuguggaggagugugugaggaccaggcgaaggaagguaucagcugugcugg

SEQ ID NO: 257723 - RNA, 64 nt, Human
aauugguggccugagccgauggggccccccaggcccaggcgaaagggcagcagcauguggccca

SEQ ID NO: 257724 - RNA, 64 nt, Human
uucccagcugcagccuaggcaggggaugcacagcccaggcgaggaagccuggcuucucugugag

SEQ ID NO: 257725 - RNA, 64 nt, Human
ccucuuuuucugagaaacauggagcagcgcacgcccaggcgaugccagucugugugccgugaug

SEQ ID NO: 257726 - RNA, 64 nt, Human
ugaggggcuagggcuggaagccaguucuaggcuuccaggcgaaagcugagggaaggaagaaacu

SEQ ID NO: 257727 - RNA, 64 nt, Human; identical to SEQ ID NO: 141743

SEQ ID NO: 257728 - RNA, 64 nt, Human; identical to SEQ ID NO: 141800

SEQ ID NO: 257729 - RNA, 52 nt, Human; identical to SEQ ID NO: 141801

SEQ ID NO: 257730 - RNA, 64 nt, Human
gguuucucuaacaaauaaacagaacccgcacugcccaggcgagcguugccacuuucaaaguggu

SEQ ID NO: 257731 - RNA, 64 nt, Human
accgcugaacuguggguggguggccgcgggauccccaggcgaccuuccccguguuugaguaaag

SEQ ID NO: 257732 - RNA, 64 nt, Human
aguugguuuccuuccugugucccuuugcaagcuuccaggcgaucuaaggugucauuucucccuc

SEQ ID NO: 257733 - RNA, 64 nt, Human
aagauuguguuuugagguuuccuucagacagauuccaggcgaugugcaaguguaugcacgugug

SEQ ID NO: 257734 - RNA, 64 nt, Human
gagggcccaccgaugagagagaugguggcagccgccaggcgagcaggcugcuuucccugcccag

SEQ ID NO: 257735 - RNA, 64 nt, Human
gguggacugauaggcuggugggcuggccgcugugccaggcgaggcccuuggcgggcacgggugu

SEQ ID NO: 257736 - RNA, 54 nt, Human
cacaggaaacuucgcagugaugcaccaggcgaggaaacgagaccucuuucguuc

SEQ ID NO: 257737 - RNA, 64 nt, Human
agaucuucuaaauggaaugcuuguugcacuguucccaggcgaguggcugccaugagaccugagg

SEQ ID NO: 257738 - RNA, 64 nt, Human
cacugggacgcccaccgccccuuucccuccgcugccaggcgagcauguugugguaauucuggaa

SEQ ID NO: 257739 - RNA, 64 nt, Human
augcagaaaugaucuuaauauucaugaccacuggccaggcgagguggcucacaccuguaauccc

SEQ ID NO: 257740 - RNA, 64 nt, Human
ucgcuggaaccugcaccaugccaggaucaugggaccaggcgagagggcacccucccuuccuccc

SEQ ID NO: 257741 - RNA, 64 nt, Human
ccuugcugacucucugagcuggggaggugggaggccaggcgagccugacucuguugaucuaccc

SEQ ID NO: 257742 - RNA, 64 nt, Human
acugcauuuucucuuccaaaaaggaaagguucuuccaggcgagaaaccuguggucuagaaccac

SEQ ID NO: 257743 - RNA, 64 nt, Human
cagggcccgggcucuggaccugggugccccccugccaggcgaggcugacuccgcgugagauggu

SEQ ID NO: 257744 - RNA, 64 nt, Human
cuggcgaaggaaauggucacaccccccgcccaccccaggcgaggauccuggugacaugcuccuc

SEQ ID NO: 257745 - RNA, 64 nt, Human
gaggccuccugacaccagcagaggaauuuuguacccaggcgaggacuucuugaacuucugcgua

SEQ ID NO: 257746 - RNA, 64 nt, Human; identical to SEQ ID NO: 141759

SEQ ID NO: 257747 - RNA, 64 nt, Human; identical to SEQ ID NO: 141804

SEQ ID NO: 257748 - RNA, 64 nt, Human; identical to SEQ ID NO: 141805

SEQ ID NO: 257749 - RNA, 54 nt, Human; identical to SEQ ID NO: 141806

SEQ ID NO: 257750 - RNA, 64 nt, Human
uaccaagcaagcaccacaagaaagggaggguacgccaggcgagcccagggcacagaugcugaga

SEQ ID NO: 257751 - RNA, 64 nt, Human
aggcuugggugugccuggccugggacugagggguccaggcgaccagagcuggcuguacaggaau

SEQ ID NO: 257752 - RNA, 64 nt, Human
cucugcggccaggaagccugacacuaggcaccccccaggcgagagcuaguggggugcagagggc

SEQ ID NO: 257753 - RNA, 64 nt, Human
cagccccuccccgcagggggccaggccggggcucccaggcgagggggacuuggggcuuccacgu

SEQ ID NO: 257754 - RNA, 64 nt, Human
gcuagggagggcagaguccccaucacguggcaagccaggcgaggcgggugcugaggucucaggg

SEQ ID NO: 257755 - RNA, 64 nt, Human
caggaauggggauagaugggagguucuugaagccccaggcgaagcugguaccucuggcuacagc

SEQ ID NO: 257756 - RNA, 64 nt, Human
ucgccuuaguccagaaccugacaggccucuggagccaggcgacuucuugggaaacugucaucuc

SEQ ID NO: 257757 - RNA, 64 nt, Human
uuuugaagcucaggugucucacgucugggcugcaccaggcgaagagagaaauuaaagauuugag

SEQ ID NO: 257758 - RNA, 64 nt, Human
gagggccgagggucacccgucggccgccgccaccccaggcgaggccggaggaaggaucaucuga

SEQ ID NO: 257759 - RNA, 64 nt, Human
agggcacucccaggccccugcccccaggcccuccccaggcgauggacaauuaugauagcuuaug

SEQ ID NO: 257760 - RNA, 64 nt, Human
ggcagggaacccgaucucuuccuuugugcuggggccaggcgaguggagaaacgcccuccagucu

SEQ ID NO: 257761 - RNA, 64 nt, Human
gacagccagagcguuagaggggccagcggcccucccaggcgaucuugugucuacucuaggacug

SEQ ID NO: 257762 - RNA, 64 nt, Human
caugggccuugcgaaccuggguuagaaacccuggccaggcgaacguggggugauucacagcaca

SEQ ID NO: 257763 - RNA, 64 nt, Human
ggucugcgauggcacgccagugcuggagccgcagccaggcgaggccacucgacucccggggccg

SEQ ID NO: 257764 - RNA, 64 nt, Human; identical to SEQ ID NO: 141798

SEQ ID NO: 257765 - RNA, 64 nt, Human; identical to SEQ ID NO: 141811

SEQ ID NO: 257766 - RNA, 56 nt, Human; identical to SEQ ID NO: 141867

SEQ ID NO: 257767 - RNA, 62 nt, Human
cgacagagcgagacuccaucuaccagauccuuaugacgcagcugaugccugccuugguuccu

SEQ ID NO: 257768 - RNA, 62 nt, Human
auucaauuauauauaaagagugaaacauuaaaaugacgcauggauuuauauuuauuauaauu

SEQ ID NO: 257769 - RNA, 62 nt, Human
accuucaggucgcgcaccuucgcugaaggaagaugacgcagagcuuuaucugaaaucagagg

SEQ ID NO: 257770 - RNA, 62 nt, Human
gugcccccugcauccauucucucuuucucuugaugacgcagcugucauuuggcugugcgugc

SEQ ID NO: 257771 - RNA, 62 nt, Human
caagagcuuauaaccaguaucagaacuggauaaugacgcaguuuuucacucugaccuccauc

SEQ ID NO: 257772 - RNA, 62 nt, Human
gucucccacaggccugugaguugccucggcauaugacgcagaaccccaacuguuacaacuua

SEQ ID NO: 257773 - RNA, 62 nt, Human
caguugacccaaugcaagaaucucagacacacaugacgcaccaguuacagggguuguuuuua

SEQ ID NO: 257774 - RNA, 62 nt, Human
uuuuuccauauacuuuaaauaaugguaaaaccaugacgcaaagagagauuuuuuuuuaaaga

SEQ ID NO: 257775 - RNA, 62 nt, Human
caacacaagcacaacuaaguauguauauacacaugacgcacacgaugccagggccuagaccu

SEQ ID NO: 257776 - RNA, 62 nt, Human
ugaacuguuucgcuucugacuguuaaacaccgaugacgcaugcacugcacuucuucguuuuc

SEQ ID NO: 257777 - RNA, 62 nt, Human
aaauaaggucagaggaucuaacauagaagcugaugacgcauuaauguaaaaauggaacuuau

SEQ ID NO: 257778 - RNA, 62 nt, Human
acugugaaagucagaaucgccucagcauuuccaugacgcacauuaugcaaaucucuuuagca

SEQ ID NO: 257779 - RNA, 62 nt, Human
ggagcuggcagccugggcaggggggcugaggcacgugguagcccucuuucugugaauggggu

SEQ ID NO: 257780 - RNA, 62 nt, Human
cuugccacccccuccucucccuucacccagacacgugguagggauggaaaaggauucuucac

SEQ ID NO: 257781 - RNA, 62 nt, Human
aagagaaucuaaaaaauaaacaaaucccuaacacgugguaugggugaaccguaugauaugcu

SEQ ID NO: 257782 - RNA, 62 nt, Human
auuuguugaaaacuagcacucuacccacagugacgugguaucugaugaagaccugaucgagu

SEQ ID NO: 257783 - RNA, 62 nt, Human
ugcugcaagugagcugggagugaccagaagaaaugacgcagaagugaaaugaacuuuuuaua

SEQ ID NO: 257784 - RNA, 62 nt, Human
acauacuguagagagaggcaauuuaauguuaaaugacgcaccauccucccucccacccuucu

SEQ ID NO: 257785 - RNA, 62 nt, Human
gaguguugcucugucacccaggcuggagugcaaugacgcaaucucggcucacugcaaccucc

SEQ ID NO: 257786 - RNA, 62 nt, Human
ugcaaaagacuugcacuuuccucagaaccaacaugacgcagcucaauaagggugagggucac

SEQ ID NO: 257787 - RNA, 62 nt, Human
gccaccagggcugaagaugcgagcccguccucaugacgcaggcgccacccugcugccggagc

SEQ ID NO: 257788 - RNA, 62 nt, Human
ucacccuacuuuucagcagcaaaacugcccugaugacgcagcacgaagggccuggcaggcug

SEQ ID NO: 257789 - RNA, 62 nt, Human
caagaagucguuuccuguggccaauaaugaagaugacgcacucggaagcuugugggcucuga

SEQ ID NO: 257790 - RNA, 62 nt, Human
gggucgccuauuuuuaaaaaguaccacauuccaugacgcaggagcuguggaaauggugagcg

SEQ ID NO: 257791 - RNA, 62 nt, Human
aaaagguauauaugcauauaucuauauauaauaugacgcagaaauaaaucuaugagaaaucu

SEQ ID NO: 257792 - RNA, 62 nt, Human
cucucaaaagagauuaacugggauuaagugagaugacgcauguaaagaugcuguguaaacug

SEQ ID NO: 257793 - RNA, 62 nt, Human
agaaguguggccugaguugaauuucugggaggaugacgcagaugucugcugcagagcugggc

SEQ ID NO: 257794 - RNA, 62 nt, Human
agaaagagccaggguucaaagcuggcgaauggaugacgcacccuagccacuggccccucucu

SEQ ID NO: 257795 - RNA, 62 nt, Human
aguggacguaguaguuuguaaaaacguuuucuaugacgcauaagcuagcaugccuaugauuu

SEQ ID NO: 257796 - RNA, 62 nt, Human
guguccuuucucucugucuguacauguuuaacaugacgcaauaauuugagggcaaacuuagu

SEQ ID NO: 257797 - RNA, 62 nt, Human
acaacauuuuugucuauggugaacugcuguaaaugacgcagagaaaugccuaaaaaggacag

SEQ ID NO: 257798 - RNA, 64 nt, Human; identical to SEQ ID NO: 141729

SEQ ID NO: 257799 - RNA, 64 nt, Human; identical to SEQ ID NO: 141730

SEQ ID NO: 257800 - RNA, 64 nt, Human; identical to SEQ ID NO: 141731

SEQ ID NO: 257801 - RNA, 62 nt, Human
ggaggaguuccaccaugagcucacccgugucuaugacgcaaagaucaccagccaugugccuu

SEQ ID NO: 257802 - RNA, 62 nt, Human
cugagccagggucacccuuguggggccuggacaugacgcacgcuggcugcgacuaggagcag

SEQ ID NO: 257803 - RNA, 62 nt, Human
ggcagagcuggcuggcucagcuaaguggcacgaugacgcaugaaggagauuauguugugcuc

SEQ ID NO: 257804 - RNA, 62 nt, Human
cagcuguauauaaguccaguguguucaucuagaugacgcaaagaaucuccugguagagaagc

SEQ ID NO: 257805 - RNA, 62 nt, Human
cgcuugcuguucugugcccaguaugugggcggaugacgcaagacuacaagauccuugcccuc

SEQ ID NO: 257806 - RNA, 62 nt, Human
gcuccaacuccuugucucucaacguauuggcuaugacgcagcaagcagaaugaauuuggacu

SEQ ID NO: 257807 - RNA, 62 nt, Human
cuacagcaaguuugacacaaacucacacaaccaugacgcacugcucaagaacuacgggcugc

SEQ ID NO: 257808 - RNA, 62 nt, Human
cuacagcaaguuugacacaaaaucgcacaacgaugacgcacugcucaagaacuacgggcugc

SEQ ID NO: 257809 - RNA, 62 nt, Human
cuacagcaaguuugacacaaacucgcacaaccaugacgcacugcucaagaacuacgggcugc

SEQ ID NO: 257810 - RNA, 62 nt, Human
uucucugucaugcuucuccacuguuuuccccaaugacgcacuauuuugacacacuggccuug

SEQ ID NO: 257811 - RNA, 62 nt, Human
cagcuaaaucaugacaccuucaauuugccaucaugacgcagaccuguauacauuagguuaaa

SEQ ID NO: 257812 - RNA, 62 nt, Human
agggggugugggguauguaugacuauaaagggaugacgcaaggaguuccuuugugcugaugg

SEQ ID NO: 257813 - RNA, 62 nt, Human
accaucucccagaaaccugaaagcaccugccaaugacgcagauaacccuggcccuacagccu

SEQ ID NO: 257814 - RNA, 62 nt, Human
gaaugcuuuuuaaagcacaugucucauuuuaaaugacgcacaaacugaagauguuaauaaaa

SEQ ID NO: 257815 - RNA, 64 nt, Human; identical to SEQ ID NO: 141789

SEQ ID NO: 257816 - RNA, 55 nt, Human; identical to SEQ ID NO: 141809

SEQ ID NO: 257817 - RNA, 64 nt, Human; identical to SEQ ID NO: 141810

SEQ ID NO: 257818 - RNA, 64 nt, Human
ugaaggcagcaguggucucaggaggaagaaacgggggcgggagagaguggugaucuguggucag

SEQ ID NO: 257819 - RNA, 64 nt, Human
acacccugagggucucggggcucuggagagaguggggcgggaggaagaauuggcaccuuccuag

SEQ ID NO: 257820 - RNA, 64 nt, Human
gggaaugggaaaaaagaaaacagauccugggagggggcgggaaauacaaggaauauuuuuuaaa

SEQ ID NO: 257821 - RNA, 64 nt, Human
aaaccaaagcuuuguguaaaaucuugaauuuauggggcgggaggguaggaaagccuguaccugu

SEQ ID NO: 257822 - RNA, 64 nt, Human
agauggcuuagguggcaccauggcucagcaggaggggcgggaggcaccaggguucuuguuugga

SEQ ID NO: 257823 - RNA, 64 nt, Human
ucuggucugggugccccguccacggcucuagguggggcgggaaagccagugacuccaggagagg

SEQ ID NO: 257824 - RNA, 64 nt, Human
gcaccaccagccagcggaagagcagcccucuggugggcgggaaaccaguguccccaccaucagc

SEQ ID NO: 257825 - RNA, 64 nt, Human
ucauuuguugguguguggggugggggcagggguagggcgggagagcgaugcuuggauuuuuguu

SEQ ID NO: 257826 - RNA, 64 nt, Human
ggaagcgguccacaaccucaaggcugucuucaaggggcgggaccagaagcugauggacagugcg

SEQ ID NO: 257827 - RNA, 64 nt, Human
accugucuccagagagaggagccugaaguucguggggcgggacagcgucggccugauuucccgu

SEQ ID NO: 257828 - RNA, 64 nt, Human
aaaggcuaugguuuauugcaggggauugggaggggggcgggaaaacauggagaauuaagucaga

SEQ ID NO: 257829 - RNA, 64 nt, Human
agaauuugguguuuggaauguuuucugacucuuggggcgggauuccucgccuuaucauccucac

SEQ ID NO: 257830 - RNA, 64 nt, Human
ggcucccccggcugggggcugugcaguccggucagggcgggaggggaaaugcaccgcugcaugu

SEQ ID NO: 257831 - RNA, 64 nt, Human
gagggagagcuugguccaucuggucaccaaggcugggcgggacagagcagucaagaaccacggu

SEQ ID NO: 257832 - RNA, 64 nt, Human
acucccaccuaaacggggcaguacuccucccugggggcgggacuccucccuggggguggggcuc

SEQ ID NO: 257833 - RNA, 64 nt, Human; identical to SEQ ID NO: 141734

SEQ ID NO: 257834 - RNA, 64 nt, Human; identical to SEQ ID NO: 141735

SEQ ID NO: 257835 - RNA, 64 nt, Human; identical to SEQ ID NO: 141736

SEQ ID NO: 257836 - RNA, 64 nt, Human
aagcaacugaacggaugcgugcgagcugaggacagggcgggaggagggggcacacaugccccag

SEQ ID NO: 257837 - RNA, 64 nt, Human
caaacaauaccugcucauuuacacugaggauucagggcgggagacaggagccuugggguccugu

SEQ ID NO: 257838 - RNA, 64 nt, Human
cucacucauaaugaggcugucucugaaccccggagggcgggaccuacaaguccuuccucuuggc

SEQ ID NO: 257839 - RNA, 64 nt, Human
aaagguacuggauaaaaguaaacuucaaaccuuagggcgggagcacuaaaaccaaaauacaugu

SEQ ID NO: 257840 - RNA, 64 nt, Human
uucaagaccagugaugggccggcuccgaggcuccgggcgggaaugggaccugcgcuccagggug

SEQ ID NO: 257841 - RNA, 64 nt, Human
gugggagggaaguccuuguuggcagagggauguggggcgggaaugaggaaaggggagggcauga

SEQ ID NO: 257842 - RNA, 64 nt, Human
ggagccgaauucuacaaucccgcuggggcggccggggcgggagagaaagguggugcugcagugg

SEQ ID NO: 257843 - RNA, 64 nt, Human
cguuacgcccucgcuggaaccugaggcgccgagagggcgggaccugcaggacaguagccaauga

SEQ ID NO: 257844 - RNA, 64 nt, Human
cccccucccuagagcgggauggggaugggagggggggcgggauucucucucuaaguauauuaua

SEQ ID NO: 257845 - RNA, 64 nt, Human
cccaaggguggguggggugagggcuugaggacuugggcgggacacaggcuccaaacuggagcuu

SEQ ID NO: 257846 - RNA, 64 nt, Human
ggcugggccgggaacuguccgaggugcugagcuggggcgggaccggaauccucccgguagggua

SEQ ID NO: 257847 - RNA, 64 nt, Human
ggcugugagaucuucuggggaggcuagccggguggggcgggagccucucagcuguccagauuca

SEQ ID NO: 257848 - RNA, 64 nt, Human
cuaauuacgauaaggaagaaacagaagagagaaggggcgggaauauuguuucuuuaucaccugg

SEQ ID NO: 257849 - RNA, 64 nt, Human
ucgccccccacuucccagcagcucugugguaguggggcgggagcagcagggacguaccuuaaga

SEQ ID NO: 257850 - RNA, 64 nt, Human
ccaguauuggggauuacauuucaacuugagguuugggcgggaacaaauagucaaauuauauuac

SEQ ID NO: 257851 - RNA, 62 nt, Human
gaaauaaagggaccagcccuucauggguggugacgugguagucacuuguaaggggaacagaa

SEQ ID NO: 257852 - RNA, 62 nt, Human
gggagguuuuacugucaaguccaauuagcaaaacgugguaauaauuuuuuugucaguauuuu

SEQ ID NO: 257853 - RNA, 64 nt, Human; identical to SEQ ID NO: 141739

SEQ ID NO: 257854 - RNA, 64 nt, Human
augcuguuugaacucuuuuucacuucaaggcaaggggcgggaucuccacugggggcuuacggga

SEQ ID NO: 257855 - RNA, 64 nt, Human
caaacaaacggccuuuucgugugaaacaucuucagggcgggaaaggggccacuucuggcuuugu

SEQ ID NO: 257856 - RNA, 64 nt, Human
cuaugccucagcaauacauagaacugaaaaaacagggcgggagugguauguggcccugaauaaa

SEQ ID NO: 257857 - RNA, 64 nt, Human
cacaggaggaggcaugcccgaggcagccaggacugggcgggaaggugcucccuggauauacucu

SEQ ID NO: 257858 - RNA, 64 nt, Human
cauaggcuccuggcguggacaaggggucugugaagggcgggaacugggugagcaccuggggcag

SEQ ID NO: 257859 - RNA, 64 nt, Human
acaccuugcucuggcuucucuguguccauggggugggcgggagggggucccccagcaggugcgg

SEQ ID NO: 257860 - RNA, 64 nt, Human
guccuccagcauccccugcagcgguucccuggacgggcgggagcucucccggcaggugcggagc

SEQ ID NO: 257861 - RNA, 64 nt, Human
agggaauacaguacaaucccaacccuacugggaggggcgggagggagguguugccgucacugua

SEQ ID NO: 257862 - RNA, 61 nt, Human
uaaggaaguaucaucuauaagggagggcugggggcgggaaaagaaaaaaaaaagucauuuu

SEQ ID NO: 257863 - RNA, 64 nt, Human
ccugagagcgcgggacuuggacacggaccucggcgggcgggacugggcggggcggggcaucaga

SEQ ID NO: 257864 - RNA, 64 nt, Human
cccagagggcagggcuaggcgagagccugggguggggcgggagggggaacaguauggaaaagac

SEQ ID NO: 257865 - RNA, 64 nt, Human
caccuagagcagccccagagucacggggcugagggggcgggagcugccccugucauagggaggg

SEQ ID NO: 257866 - RNA, 64 nt, Human
cauaugcuuuuuccacgagugucugucagugagcgggcgggaggaagggcacagcaggagcggu

SEQ ID NO: 257867 - RNA, 64 nt, Human
cccugcuaaccccuucuccgccaggugggcuccagggcgggaggcaagcccccuugccuuucaa

SEQ ID NO: 257868 - RNA, 64 nt, Human
ggucaggcaagugagcaccggggacugaggaucagggcgggaccccgugaggcucauuagggga

SEQ ID NO: 257869 - RNA, 62 nt, Human
uuuaugccccagcacuagguacggggcccaacacgugguaggcacuccaucaguguuugcug

SEQ ID NO: 257870 - RNA, 55 nt, Human; identical to SEQ ID NO: 141732

SEQ ID NO: 257871 - RNA, 64 nt, Human; identical to SEQ ID NO: 141742

SEQ ID NO: 257872 - RNA, 64 nt, Human
auacaaaaagguuuucauguauuuguggcugagagggcgggaaauaauuguguacauaaaauua

SEQ ID NO: 257873 - RNA, 64 nt, Human
ugcucuucacagcuguggaggugagggugggcgugggcgggaugcuguucagcugcagacuuuc

SEQ ID NO: 257874 - RNA, 64 nt, Human
uagcagggggccuuuagcuaguuucucccgagaggggcgggaaguacagcugguggagacagug

SEQ ID NO: 257875 - RNA, 64 nt, Human
ucagagcugauucacaggaggaggggagguuggggggcgggagacaaaaaccacaccucuuuuu

SEQ ID NO: 257876 - RNA, 64 nt, Human
agaaguggucaggaacaaucaucagcccuccucugggcgggaaucagagcagucaguccagcag

SEQ ID NO: 257877 - RNA, 64 nt, Human
gcagccacgcccccaggcccaccgugcauggugugggcgggacagccggaagcuuccggggugg

SEQ ID NO: 257878 - RNA, 60 nt, Human
ggacagcagacugccgguaacgcgcggccggggcgggagagacucagcaacgacccauac

SEQ ID NO: 257879 - RNA, 64 nt, Human
cuuaggaugagucuucuuuaaucaaucauauauugggcgggaaaaacaccagcuuugacccgaa

SEQ ID NO: 257880 - RNA, 64 nt, Human
ccggguucguacuccagcacagcgcccuucuaacgggcgggaggaaggccgcugcucgcagggc

SEQ ID NO: 257881 - RNA, 64 nt, Human
uaggaugguggaauauugguguuaccagugaagggggcgggauguuugaaaaugcuauguuuac

SEQ ID NO: 257882 - RNA, 64 nt, Human
ccuggccuaguugcugagaggggcuggggagauggggcgggagggccagacucagugcugcugu

SEQ ID NO: 257883 - RNA, 64 nt, Human
aggaagcccucagccucugcccuccccccacacagggcgggagcccaggccuguuccuggcagc

SEQ ID NO: 257884 - RNA, 64 nt, Human
uuguuuguauucacuguccccugcaagggggacggggcgggagcacuggucaccgcgggggccg

SEQ ID NO: 257885 - RNA, 64 nt, Human
auuuggaccaagugggaaacaagaacacucggaggggcgggaaucagaagagccuggaaaaaga

SEQ ID NO: 257886 - RNA, 53 nt, Human
aggaagaaguagacaacugaaaagggcgggagacuguggcaccuuggaaggua

SEQ ID NO: 257887 - RNA, 64 nt, Human; identical to SEQ ID NO: 141813

SEQ ID NO: 257888 - RNA, 64 nt, Human; identical to SEQ ID NO: 141814

SEQ ID NO: 257889 - RNA, 61 nt, Human; identical to SEQ ID NO: 141815

SEQ ID NO: 257890 - RNA, 64 nt, Human
cuugagccugggccgggggcggggccgggacugggggcgggacugggggcggggccugggcggg

SEQ ID NO: 257891 - RNA, 64 nt, Human
ggagccaugaggcuggccagcccucagcggggccgggcgggagcuggagccugccagccgcuuc

SEQ ID NO: 257892 - RNA, 64 nt, Human
aggccagggugugagggaggugcagaggcauccggggcgggagcaagccccagguugugacagg

SEQ ID NO: 257893 - RNA, 64 nt, Human
ccccucgaaggucggacaggacggguggagccgugggcgggacccucaggcccgggcccgccgc

SEQ ID NO: 257894 - RNA, 64 nt, Human
gacgucugucugggcgaaggguagggguggguaggggcgggaagccugagugcaaaugucauuu

SEQ ID NO: 257895 - RNA, 64 nt, Human
ggagagcugggugcgagaacauggcgccuccagggggcgggaggagcacuaggggcuggggcag

SEQ ID NO: 257896 - RNA, 64 nt, Human
ccuccggcagcuccagguucuggacaaccgacuggggcgggagacggggcgguucugaucuggc

SEQ ID NO: 257897 - RNA, 64 nt, Human
uaauguuuugcacuuuuucguacagggugggcgggggcgggaggggcuagcgccccugaacuuu

SEQ ID NO: 257898 - RNA, 64 nt, Human
cauuucaucgcggacugugcggccuggggguggggggcgggacucucacggugacauguuuaca

SEQ ID NO: 257899 - RNA, 64 nt, Human
caggucacugaguugccugccauccaaaggggaugggcgggauuggaagaagcuguggcagcuc

SEQ ID NO: 257900 - RNA, 64 nt, Human
ccgccccuucucgugacccgggcggugcgggugggggcgggaggcgcaaggugucgguuuugau

SEQ ID NO: 257901 - RNA, 64 nt, Human
auccggacuccugccgcagugaucaaaguccgaggggcgggacccaggcaccugcauuuuaaag

SEQ ID NO: 257902 - RNA, 64 nt, Human
uccucccuuuggguuuccagagucggugggagaagggcgggagggugggcccgaguggcccagu

SEQ ID NO: 257903 - RNA, 64 nt, Human
gggaagaaucuggagauggagccgcggugagggugggcgggaggccucagaggauacuguuaau

SEQ ID NO: 257904 - RNA, 64 nt, Human
aggaguagcuugaaguggccagaagggucauucggggcgggagacccugagccugcugagaaau

SEQ ID NO: 257905 - RNA, 64 nt, Human; identical to SEQ ID NO: 141745

SEQ ID NO: 257906 - RNA, 64 nt, Human; identical to SEQ ID NO: 141746

SEQ ID NO: 257907 - RNA, 64 nt, Human; identical to SEQ ID NO: 141747

SEQ ID NO: 257908 - RNA, 64 nt, Human
gggagagauccaggacugagccagccucaggccagggcgggaaagcaggcuguccaggcugggc

SEQ ID NO: 257909 - RNA, 64 nt, Human
cagugggcgcccacacuggcccugcagugaugcagggcgggagggagauaagaagaccccgcag

SEQ ID NO: 257910 - RNA, 64 nt, Human
agccugacagauaggcuagugguauuguguauaugggcgggacgugugugucauuauuauuuga

SEQ ID NO: 257911 - RNA, 64 nt, Human
cccuuguuucccacauucccuucguccugcccaagggcgggacugaagagcuggaagaaagcag

SEQ ID NO: 257912 - RNA, 64 nt, Human
uccaucugccacauggaaguucauagccaggauagggcgggagaggcaccagaacauuucucuc

SEQ ID NO: 257913 - RNA, 64 nt, Human
gaagacccgguccugcccgagcucaacaaucccagggcgggagcccauacccaggcuggcuccu

SEQ ID NO: 257914 - RNA, 64 nt, Human
aaaccucagccgcagccuccgggggacaggcccagggcgggaaauggagccggagaagcuugag

SEQ ID NO: 257915 - RNA, 64 nt, Human
cagcugacugaggaccacgagugagccagcgagggggcgggagaccucagccgcagccgccgcc

SEQ ID NO: 257916 - RNA, 64 nt, Human
ucucugccacuuacugagggggcugggaggugucgggcgggacagaauggggagcugaggaggc

SEQ ID NO: 257917 - RNA, 64 nt, Human
uuccggugaggggagggugaggagcuggagggaggggcgggagagaggcaagggguggacggag

SEQ ID NO: 257918 - RNA, 64 nt, Human
auccaucucccagcauccaucugcauucagcuaagggcgggaaacugaccuagugccuguguug

SEQ ID NO: 257919 - RNA, 64 nt, Human
caagccugagggaaauggggcccuaggagggugggggcgggaaggaggggcaaggucuuucagg

SEQ ID NO: 257920 - RNA, 64 nt, Human
augacaggcacaggccaccgcaugaggagauggagggcgggacugggccgcccagccccuugac

SEQ ID NO: 257921 - RNA, 64 nt, Human
ucagcaggcugugagcaucgccaggcugcugugggggcgggagcagccucagugucaagggccc

SEQ ID NO: 257922 - RNA, 64 nt, Human
gggcagccuugucccggcccagugugugugaccagggcgggaggggccccaguggcugagcucc

SEQ ID NO: 257923 - RNA, 62 nt, Human
gccaguaggcuucuagcucaauucccugaagcacgugguacucugaagcacuugaaaauggg

SEQ ID NO: 257924 - RNA, 64 nt, Human; identical to SEQ ID NO: 141737

SEQ ID NO: 257925 - RNA, 64 nt, Human; identical to SEQ ID NO: 141750

SEQ ID NO: 257926 - RNA, 64 nt, Human
aggacagggaggugaccccagguuucuauguguagggcgggaggauguucugggacacaguuca

SEQ ID NO: 257927 - RNA, 64 nt, Human
gcagaccuuagccccugacuaaggccucagacuagggcgggaggggucuccuccucucugcugc

SEQ ID NO: 257928 - RNA, 64 nt, Human
auccauagcugcucugcagggcggaagacaccuggggcgggaaagcaccccugaguuccaucuu

SEQ ID NO: 257929 - RNA, 64 nt, Human
gccugggccaucagcgaacugggccccgugaggagggcgggaguguggaggagggugggccucu

SEQ ID NO: 257930 - RNA, 64 nt, Human
ugggaggcucugggcugcccugucggcuccuugagggcgggaugaacugcuuugugacuuggaa

SEQ ID NO: 257931 - RNA, 64 nt, Human
ggcauccuugucccccucacccacccagagcuaggggcgggaacagcccaccuuuugguuggca

SEQ ID NO: 257932 - RNA, 64 nt, Human
gggagguggaugguucuuauucuguggagaagaagggcgggaagaacuuccuuucaggaggaag

SEQ ID NO: 257933 - RNA, 64 nt, Human
augcucaguuagggguugcgggauccccgagugugggcgggacugggacacccuuuggccucug

SEQ ID NO: 257934 - RNA, 64 nt, Human
ggcggggccguacugcggggcuggggcggggagcgggcgggaaauggaacugugacggucccgg

SEQ ID NO: 257935 - RNA, 64 nt, Human
ucccaggaccccauccucucagaagguaggggaagggcgggaggauugagaagggacaagccac

SEQ ID NO: 257936 - RNA, 64 nt, Human
ucaaccuugugugagugugacggggguugggguggggcgggaggccacgggggaggccgaggca

SEQ ID NO: 257937 - RNA, 64 nt, Human
aacaagaauagagccaggcgcgugggcagggccagggcgggaggagcuggggagcuggggcccu

SEQ ID NO: 257938 - RNA, 64 nt, Human
cacgacaggagccuccaaguaugugggaggggacgggcgggacgagcuuggcuguucugcugca

SEQ ID NO: 257939 - RNA, 64 nt, Human
gugcccacaugaagcugcuuuuuccggggccaccgggcgggaguggggaagggugggcgcacgg

SEQ ID NO: 257940 - RNA, 64 nt, Human
aacuccggaccccgccuucuugggcugggcccgggggcgggacuggggagggaacuccgccccu

SEQ ID NO: 257941 - RNA, 64 nt, Human; identical to SEQ ID NO: 141748

SEQ ID NO: 257942 - RNA, 64 nt, Human; identical to SEQ ID NO: 141753

SEQ ID NO: 257943 - RNA, 64 nt, Human; identical to SEQ ID NO: 141754

SEQ ID NO: 257944 - RNA, 64 nt, Human
cugccauucuuaaccaaggcugccucuuccaacagggcgggaaucagaccuacuccccuagguc

SEQ ID NO: 257945 - RNA, 64 nt, Human
gggaacgcgugucaaucccuugugccgcagggcugggcgggagagacuguucuguuccuugugu

SEQ ID NO: 257946 - RNA, 64 nt, Human
gcaggagagagggagcuggcggugcccagcgcaagggcgggaaggaggggcccaggcugcggag

SEQ ID NO: 257947 - RNA, 64 nt, Human
ucucgcugcccgcauguguuuggcgcugugcuaggggcgggaguucuuccagacucuuggacca

SEQ ID NO: 257948 - RNA, 64 nt, Human
gcuuccgagaaccucggccgugacauucggggccgggcgggacccgccccacagacuccaacuu

SEQ ID NO: 257949 - RNA, 64 nt, Human
gaguccuggggacgcagugccccagcugggaagagggcgggaucgggcacugguuccuccuugu

SEQ ID NO: 257950 - RNA, 64 nt, Human
cacugugggcacaaagacacuuuuucuuccgcaggggcgggagccccuaguuccaacacugagg

SEQ ID NO: 257951 - RNA, 51 nt, Human
aguuggaaaguuacugcuagggggcgggauccccgugucuguucaguuagc

SEQ ID NO: 257952 - RNA, 64 nt, Human
ggccuggugaccuugcaagcaucccauggggcgggggcgggaccagggagaauuaauaaaguuc

SEQ ID NO: 257953 - RNA, 64 nt, Human
auauauauauauuuggaggucaguaauuuccaaugggcgggaggcuuuaagcaccgacccuggg

SEQ ID NO: 257954 - RNA, 64 nt, Human
agagagagagaagucuccucugcauuuuggguuugggcgggagugggcuggggggagaggcugg

SEQ ID NO: 257955 - RNA, 64 nt, Human
uguuguuuuuaaguagagguaaaauugagauggggggcgggaggugacaucaugaaguuuuuug

SEQ ID NO: 257956 - RNA, 64 nt, Human
ggccgcaggacgcugagacgguuugggggugggugggcgggaggacuuugcuauggauuugagg

SEQ ID NO: 257957 - RNA, 64 nt, Human
gcccggcuggcccccacccccgacucugaaucccgggcgggaggaggacccccgcaccgccccc

SEQ ID NO: 257958 - RNA, 64 nt, Human
cccugcagcgggccggccagagggggccccgggggggcgggaacugggagggaagggugagacg

SEQ ID NO: 257959 - RNA, 64 nt, Human; identical to SEQ ID NO: 141818

SEQ ID NO: 257960 - RNA, 64 nt, Human; identical to SEQ ID NO: 141819

SEQ ID NO: 257961 - RNA, 64 nt, Human; identical to SEQ ID NO: 141820

SEQ ID NO: 257962 - RNA, 64 nt, Human
aggcgccucugguucuccgaauucaaauaaaaaggggcgggagcgcuguugguugugcgcaugc

SEQ ID NO: 257963 - RNA, 64 nt, Human
cugcucuucccucucccagauugguggggagggagggcgggagguagauauaggccuguucuuu

SEQ ID NO: 257964 - RNA, 64 nt, Human
gugcugguacccacugcccacccuggcugccgcugggcgggaaccccaacagggccccgggagg

SEQ ID NO: 257965 - RNA, 64 nt, Human
acccagaguaugucuauagcagaggggguuaugggggcgggaggguagacugacauacagaagu

SEQ ID NO: 257966 - RNA, 64 nt, Human
ggugugccgagcuggcuccccagcucgcuguagggggcgggacuggauucuguauccaugggau

SEQ ID NO: 257967 - RNA, 64 nt, Human
auggaggcggggcucggccccgggccacuucacggggcgggaaggggaggggaagaagagucuc

SEQ ID NO: 257968 - RNA, 64 nt, Human
ggcacaguguuccuggauccuggggcugcguggggggcgggagggccuguagauaaucuugcgu

SEQ ID NO: 257969 - RNA, 64 nt, Human
agcgcugcugaaaagaaaucauuuggguuggguggggcgggaugggggaaaaguauauaaugcu

SEQ ID NO: 257970 - RNA, 64 nt, Human
cguggggauaguuuuugcuagauuuuggaagagggggcgggacagaggaugcuguucuucagug

SEQ ID NO: 257971 - RNA, 64 nt, Human
gcggcugcccggcagcaacugggguggccagguggggcgggaccccagcaccucccccaacuga

SEQ ID NO: 257972 - RNA, 64 nt, Human
cccucucugaccuugggggaucaggagcgaaguugggcgggacuucagagauccgccucccuug

SEQ ID NO: 257973 - RNA, 64 nt, Human
uuuccuauuuaagacuuuaaggguuuguggggcggggcgggauuaacacaacauuuggcuuugu

SEQ ID NO: 257974 - RNA, 64 nt, Human
ccaggaauuccguugacuuguuggcugccaguaggggcgggaggaaaggcggaggcgagcccug

SEQ ID NO: 257975 - RNA, 64 nt, Human
gcaggccgcuccuacgguccuuuggccugaggcagggcgggaggcaugcaagccagugggggaa

SEQ ID NO: 257976 - RNA, 64 nt, Human
cccucacugucagggucccuggggucgcuugugcgggcgggagggcaaugguggcagagacaug

SEQ ID NO: 257977 - RNA, 64 nt, Human; identical to SEQ ID NO: 141755

SEQ ID NO: 257978 - RNA, 64 nt, Human; identical to SEQ ID NO: 141757

SEQ ID NO: 257979 - RNA, 64 nt, Human; identical to SEQ ID NO: 141758

SEQ ID NO: 257980 - RNA, 64 nt, Human
caggcaaggcuugugggcaccggagcuugagagagggcgggagugggaaggcuaagaaucugcu

SEQ ID NO: 257981 - RNA, 64 nt, Human
ggcuguggaggcugguuuugaccaaaagugaguggggcgggaggaaggggcaggaggaaggguu

SEQ ID NO: 257982 - RNA, 64 nt, Human
gcacagcggcccgcccucuguucucagaggugaggggcgggagaagguugucuccucuggggcc

SEQ ID NO: 257983 - RNA, 64 nt, Human
cucucgggagccacagacgcccgagacccacgccgggcgggaccggccagggaucacccccgcc

SEQ ID NO: 257984 - RNA, 64 nt, Human
gcugcgccgcguccgaacgucgagaccccaccgagggcgggagggggacucucgggagccacag

SEQ ID NO: 257985 - RNA, 64 nt, Human
uuccucaaagcuuuuuuuuuuuuuccuggcuggggggcgggaagggcagacugcaaacuggggg

SEQ ID NO: 257986 - RNA, 62 nt, Human
acacuguauuaggaucugcauuucuaaaacugacgugguaucaggaaggcauuuucaaucau

SEQ ID NO: 257987 - RNA, 64 nt, Human; identical to SEQ ID NO: 141740

SEQ ID NO: 257988 - RNA, 64 nt, Human; identical to SEQ ID NO: 141761

SEQ ID NO: 257989 - RNA, 64 nt, Human
cugccggcuuugugcaggcagccccgacgguuuccacagcgagcgccagcuccggccagccugg

SEQ ID NO: 257990 - RNA, 64 nt, Human
uggaugguuaagcaggauccuaggagccucuuugcacagcgauccuuccauguguagagugcuu

SEQ ID NO: 257991 - RNA, 64 nt, Human
uauuugcaacuguaaugagaauuuuucacacuaacacagcgagggacucaacacgcugauucuc

SEQ ID NO: 257992 - RNA, 64 nt, Human
uuuauuccugggcuaauccugucccucccuaagucacagcgaggugucugucccagggcuggag

SEQ ID NO: 257993 - RNA, 64 nt, Human
cagagacaccgaaggaaaugggguggugaaaccccacagcgaaaagccacaccguugcucugug

SEQ ID NO: 257994 - RNA, 64 nt, Human
cuccucuacucuugggucgagaucccuuuggagccacagcgaggaacccugugguccucaggca

SEQ ID NO: 257995 - RNA, 64 nt, Human
uacagaggaggccucaaagcaacccgcuggagcccacagcgagccugugccuuccuccccgccu

SEQ ID NO: 257996 - RNA, 64 nt, Human
gguaguuacaagcaaagggagacaaggaaacgggcacagcgaaauccuggugaagagcaaagca

SEQ ID NO: 257997 - RNA, 64 nt, Human
agagaggaaggaaggauuggaaaaguccccgcagcacagcgacggugggaagaugccuuacguc

SEQ ID NO: 257998 - RNA, 64 nt, Human
acugagaauuggagaggacaggcuaggucccaggcacagcgagggcccugggcuugggguguuc

SEQ ID NO: 257999 - RNA, 64 nt, Human
cuugagcccaggaguucaagaccagccugggcaacacagcgagaccccaucucuuaaaaaauaa

SEQ ID NO: 258000 - RNA, 64 nt, Human
gagugaggugcccuggagaagcaggcuuugaaggcacagcgaagcuguaacugaggacccugcu

SEQ ID NO: 258001 - RNA, 60 nt, Human
auguuucuggacaaaguuagugaagcucaucacagcgaaccaggucucucaaaagaaagg

SEQ ID NO: 258002 - RNA, 64 nt, Human
ggccugagaagggcaggaucagaagggaccuuggcacagcgaccucaucccccaaguggacacg

SEQ ID NO: 258003 - RNA, 64 nt, Human; identical to SEQ ID NO: 141764

SEQ ID NO: 258004 - RNA, 64 nt, Human; identical to SEQ ID NO: 141765

SEQ ID NO: 258005 - RNA, 64 nt, Human; identical to SEQ ID NO: 141766

SEQ ID NO: 258006 - RNA, 64 nt, Human
cugggaggagaggcugccgcauucugcugcuccucacagcgagcaaagcugcacccacuuacau

SEQ ID NO: 258007 - RNA, 64 nt, Human
cauagugcucaggaggcagcaucuggaguuggggcacagcgagguacugcagcuuccuccacag

SEQ ID NO: 258008 - RNA, 64 nt, Human
gcuuguuuucucugaacagcaacagaacaguguucacagcgauucaaaggguggcauuggguug

SEQ ID NO: 258009 - RNA, 64 nt, Human
agggugcaggucacugagugacuuccccagggugcacagcgaguaacagaucaggacccaaacu

SEQ ID NO: 258010 - RNA, 64 nt, Human
cuugaggcaaggaguuugagaccagacuggccaacacagcgagacccccaucucuaaaaaaaaa

SEQ ID NO: 258011 - RNA, 64 nt, Human
ggccaggccugguuugaagaccaucugagggaggcacagcgacagcagcugcaucuaggggccc

SEQ ID NO: 258012 - RNA, 64 nt, Human
auggcguagaaugaaaugccucucacccuuuccccacagcgacuacuucccacucagaggcaac

SEQ ID NO: 258013 - RNA, 64 nt, Human
acccuucaacaagccugaaucagucacuuuucaacacagcgauguuuuaacaagccagcugcua

SEQ ID NO: 258014 - RNA, 64 nt, Human
aggaaggaugcagugacucuugcugcccagaaugcacagcgaugguaagagacaccguggauau

SEQ ID NO: 258015 - RNA, 64 nt, Human
caugggcagcaggagugagcggaggggugugucccacagcgacuuucccagccaaugccacggu

SEQ ID NO: 258016 - RNA, 64 nt, Human
cuccuugcauggcuugugugguccucagacuccgcacagcgagcguaggucucuggguuucaga

SEQ ID NO: 258017 - RNA, 64 nt, Human
acuuuucuaagacccacauuugguuauugaaggccacagcgaaucuuaaccuaacagccuugac

SEQ ID NO: 258018 - RNA, 64 nt, Human
uaagaaugccaaagggaccgacgagacuccccaucacagcgagcucuguccuuacauguauuug

SEQ ID NO: 258019 - RNA, 64 nt, Human
agaaaacaaguauggugaggucacuuuaauguuucacagcgaucucagaucuaggccucaggua

SEQ ID NO: 258020 - RNA, 64 nt, Human
gagggaggcagccagcggggcgugaugcagugugcacagcgaggagcagacccaggcagggccg

SEQ ID NO: 258021 - RNA, 64 nt, Human
gaaauugugccacugcacuuuucagccugggugccacagcgagacccuaguuaagagaaaaaaa

SEQ ID NO: 258022 - RNA, 62 nt, Human
agugcaugcaguaauuccaaugugacugcaugacgugguacagacauuacagguguuguaga

SEQ ID NO: 258023 - RNA, 62 nt, Human
aguguccaucaacagaugaauggauaaagaaaacgugguacauauacacaauggaguacucu

SEQ ID NO: 258024 - RNA, 62 nt, Human
gguagaauuaauuuaugacauggaaaugccuuacgugguaucacacuuagucuugaaaaaaa

SEQ ID NO: 258025 - RNA, 64 nt, Human
cuugaacucaggaguuugagagcagccagggcaacacagcgagacccugucucaaaaaaaaaaa

SEQ ID NO: 258026 - RNA, 64 nt, Human
aucccgggccagcugccugcggaccgcuuccuuccacagcgagaacugcacuaccuucuguugu

SEQ ID NO: 258027 - RNA, 64 nt, Human
auaaccuuucuggagugaaccagaccgucgcacccacagcgaaggcacaugccccgaugucgac

SEQ ID NO: 258028 - RNA, 64 nt, Human
ugagaagccuucagcuccagggaauccaagccuccacagcgagggcagcugcuauuuauuuucc

SEQ ID NO: 258029 - RNA, 64 nt, Human
ccgagaccgugccacugcacuccagccugggcaacacagcgagacuccgucucgaggaaaaaaa

SEQ ID NO: 258030 - RNA, 64 nt, Human
acuugagcccaggaguucaagaccagccugggaacacagcgagacccucucauuaaaaacaaca

SEQ ID NO: 258031 - RNA, 64 nt, Human
cugagauugugccacugcacuccagacugggugacacagcgagacuucaucucaaaaaaaaaaa

SEQ ID NO: 258032 - RNA, 64 nt, Human
cccacuucaacuuccccucgaagacguugugccucacagcgaggccuacaagggaugggaacuu

SEQ ID NO: 258033 - RNA, 64 nt, Human
uggggaaaaccguuuuuuaaaggacacacacacacacagcgaugcaucucucucuaaagcucag

SEQ ID NO: 258034 - RNA, 64 nt, Human
auucgguaauacuaucaagagaagagccuaggagcacagcgagggaaugaaccuuacuugcacu

SEQ ID NO: 258035 - RNA, 62 nt, Human
aaccagacuguccuggcuaguccucuuagucacacagcgaguaggccucuuccaccagaagc

SEQ ID NO: 258036 - RNA, 64 nt, Human
aacguguccccauuuuaccagaaccaaaccucaacacagcgaagcuguacugucuuuguguggc

SEQ ID NO: 258037 - RNA, 64 nt, Human
aaauuacugaagaucucaucaugcaugugucagccacagcgaaucccaugucuugguuauaggu

SEQ ID NO: 258038 - RNA, 64 nt, Human
ccgagaucacgccacugcacuugagccugggcgacacagcgagacuccaucucaaaacaaaaca

SEQ ID NO: 258039 - RNA, 64 nt, Human
cuugagcccaggaguuugagaccagccugggcaacacagcgagaccuugucucuuaaaaaaaaa

SEQ ID NO: 258040 - RNA, 64 nt, Human
ccaagauugcgccauugcacuccagccugggcaacacagcgagacuccgucucaaggaaaaaau

SEQ ID NO: 258041 - RNA, 64 nt, Human; identical to SEQ ID NO: 141807

SEQ ID NO: 258042 - RNA, 64 nt, Human; identical to SEQ ID NO: 141870

SEQ ID NO: 258043 - RNA, 64 nt, Human; identical to SEQ ID NO: 141871

SEQ ID NO: 258044 - RNA, 64 nt, Human
uagggaaacagaaucagauguguaauauacuuggcacagcgaaaaaauggauuuaaaagacaaa

SEQ ID NO: 258045 - RNA, 64 nt, Human
agacgugcgggcuccggggaaaaggaccuggagucacagcgaauccccgccccgccccgggaag

SEQ ID NO: 258046 - RNA, 64 nt, Human
aucugacaagaaagccuggagcgaggaaggaaagcacagcgaacccaauggguaacgugguuua

SEQ ID NO: 258047 - RNA, 64 nt, Human
gcaggaggaagcaagcgugucuuccccugcagcacacagcgacuugcguugacaaaggaggagg

SEQ ID NO: 258048 - RNA, 64 nt, Human
ucuagccguuccuaguggggcuugcucaagguugcacagcgagucaguagaagcccuggcuggc

SEQ ID NO: 258049 - RNA, 64 nt, Human
gcuggcacugagcaguaccagugugcuugcccaccacagcgauccacggagcugaagcugggag

SEQ ID NO: 258050 - RNA, 64 nt, Human
gggugguggucucuucucaccucaguuuuucugacacagcgaaucgagggcuuuggccaaggcc

SEQ ID NO: 258051 - RNA, 64 nt, Human
cuguacaauuaguugcuuauuacguaugauuacucacagcgaucuauuguuccauauaaccaaa

SEQ ID NO: 258052 - RNA, 64 nt, Human
aaaccacagucuaaggaagugacugcagaaagcucacagcgacccuggccuccccuguggccuc

SEQ ID NO: 258053 - RNA, 64 nt, Human
cuugagcccaggaguucgagaccagccugggcaacacagcgagaucucuuggggguaaaacaaa

SEQ ID NO: 258054 - RNA, 64 nt, Human
acucucccccuuuccuagccccuagaggcggacacacagcgacccccaucccugcaggacaaac

SEQ ID NO: 258055 - RNA, 64 nt, Human
cgaauucucagacgacaccuggagacugucccgacacagcgacgcuccccugagagguuucugg

SEQ ID NO: 258056 - RNA, 64 nt, Human
cuaugaucacaccauugcacuucagccugggcgacacagcgagacccugucucaagaaagaaaa

SEQ ID NO: 258057 - RNA, 64 nt, Human
acaccacggggacacacggacagacgcagacggacacagcgacaugccccagacacguuaaggg

SEQ ID NO: 258058 - RNA, 64 nt, Human
ccaagaucaugccacugcacuccagccugggcaacacagcgagacuccgucucaaaaagaaaaa

SEQ ID NO: 258059 - RNA, 64 nt, Human
guguagagguguguggcuggacauuuuucguggccacagcgaguugaguuguguugaauuguac

SEQ ID NO: 258060 - RNA, 62 nt, Human
guucacagcaaauucacugccuccucccaugcacgugguagagaguaccaguaucaacaugg

SEQ ID NO: 258061 - RNA, 62 nt, Human
uucuuagacagcugucuuccugcaguguccucacgugguagaagaggaaggcagcucuccgg

SEQ ID NO: 258062 - RNA, 62 nt, Human
caccaguuuuacaaugaguuaucccaggccagacgugguagcucacaccuguaaucccagaa

SEQ ID NO: 258063 - RNA, 64 nt, Human
augaaaaugauguagacauuuuaagcauuuucuacacagcgagaaaacuucguaagaacauguu

SEQ ID NO: 258064 - RNA, 64 nt, Human
aucccaccaccaggaggaaugccaaggcugggcccacagcgagaaaccgcuaugccagccagug

SEQ ID NO: 258065 - RNA, 64 nt, Human
cagaggcugagcaggaaaugcagcgcaucaaggccacagcgauucgcacggaggaggagaagcg

SEQ ID NO: 258066 - RNA, 64 nt, Human
uuggggcgccugccucccugcuccucuguccucgcacagcgaaccugggcuccugcccaggaca

SEQ ID NO: 258067 - RNA, 64 nt, Human
ggauugcagcaaagguggucagggugaugggccgcacagcgaggcagucaaggccagcucccug

SEQ ID NO: 258068 - RNA, 64 nt, Human
cccccacaccagguggugguaggcggugugacugcacagcgaggugccggaucugugagcaggc

SEQ ID NO: 258069 - RNA, 64 nt, Human
uuuuuugaaagucagcugaaggaugguuagacagcacagcgaagacugcuaaaugcacugaccc

SEQ ID NO: 258070 - RNA, 64 nt, Human
acuccauaagucaucagggaaugcaaauugaaaccacagcgaggcuaugacuuacuuaucucaa

SEQ ID NO: 258071 - RNA, 64 nt, Human
cugugcuucagcucuucuugacaucaaggcucuuccguuccacauccacacagccaauccaauu

SEQ ID NO: 258072 - RNA, 64 nt, Human
gccauacaagguuggcuacgcccucaaucccugaccguuccaggcacugagcugggcacccacg

SEQ ID NO: 258073 - RNA, 64 nt, Human
cuuccagagaagcuauuccaggucucaacauacgccguuccaccaauuuuuuuuuuagccccac

SEQ ID NO: 258074 - RNA, 64 nt, Human
uuccaggagggucuguccccagaugcucugccucccguuccaaaacccacucauccucagcuug

SEQ ID NO: 258075 - RNA, 64 nt, Human
cuuacaaauccuaagcucagagaaaguuccauuuccguuccagagggaagggaaccucccuagg

SEQ ID NO: 258076 - RNA, 64 nt, Human
cucccuauggccugcuggcccaccucccuggaccccguuccacccucacccuuuuccuuuccca

SEQ ID NO: 258077 - RNA, 62 nt, Human
uuuuacauaaauaauaaugcuuugccagcaguacgugguagccacaauugcacaauauauuu

SEQ ID NO: 258078 - RNA, 62 nt, Human
agcaggacuccgucccuguccccgacugugccacgugguaggacacauaggacacaggaauu

SEQ ID NO: 258079 - RNA, 62 nt, Human
uuuacuguccucaaauggacuuggccuuagagacgugguaaagcacuuuggcaggguuuaaa

SEQ ID NO: 258080 - RNA, 64 nt, Human
gucaagggaggggcaagaggaggaggagagccugccguuccaacuugcccaucagagacccgga

SEQ ID NO: 258081 - RNA, 64 nt, Human
ucuguaacagagguaauauaugagacaaucaacaccguuccaaaggccugaaaauaauuuucag

SEQ ID NO: 258082 - RNA, 64 nt, Human
uccgccucggcgggaacgcuguacauagucagguccguuccagggaccacuuaaacuuuuuagu

SEQ ID NO: 258083 - RNA, 64 nt, Human
cccaggaaaugacugccuuccuugggaccaaggaccguuccaacagcauucacugccaguucua

SEQ ID NO: 258084 - RNA, 64 nt, Human
uuugcuuuuaauccuuccaaaaaaugaugaaccaccguuccauucaguaguuugacaagcuguu

SEQ ID NO: 258085 - RNA, 64 nt, Human
cugauggaaaauucccaugagagagugcuccaaaccguuccaagguggggccaguugcgauucu

SEQ ID NO: 258086 - RNA, 64 nt, Human
guggcccuaggcaccugggcugcaggaagugacuccguuccacuccuccuuuauucccuuaaaa

SEQ ID NO: 258087 - RNA, 64 nt, Human
ggugaagcucacggggccaggcugaccgucuugaccguuccacuugagauagguuggucaucgu

SEQ ID NO: 258088 - RNA, 64 nt, Human
aaacauaacuguuagacccaaagcauuuuaugcuccguuccaucuuaaggagccauccuuaagu

SEQ ID NO: 258089 - RNA, 64 nt, Human
gccugguuacuggguaccuccugaguggcuguccccguuccagaacuugcauacacugagcggg

SEQ ID NO: 258090 - RNA, 64 nt, Human
cuguuagugacagagcccagcaucccuucugcccccguuccagcugacaucuugcacggugacc

SEQ ID NO: 258091 - RNA, 64 nt, Human
ucuuggggcucuucuucagggaagaguagggacgccguuccagccccccuuccuaucguguccu

SEQ ID NO: 258092 - RNA, 64 nt, Human
uauccacuacuccgugaaggcuucucuguucuacccguuccaaaagccaauggcugcaguccgu

SEQ ID NO: 258093 - RNA, 64 nt, Human
ugcauuauuuuuuuuagugaauuuuaugaaauccccguuccauucaacaggcacauguuuaaaa

SEQ ID NO: 258094 - RNA, 64 nt, Human
cauuucaucuauuucugagaagguccuuaaugauccguuccauugcaagcuucuuuuaguugua

SEQ ID NO: 258095 - RNA, 64 nt, Human
cacucaacuuugugaaccccugaagauuuuuugaccguuccaagucuuaaugccacaccacuau

SEQ ID NO: 258096 - RNA, 62 nt, Human
gcuguggacuucugggauuugcagauuuugcaacgugguacuacuuuuuuuuucuuuuuguc

SEQ ID NO: 258097 - RNA, 62 nt, Human
aggagaaauuauuaccacaguauuuaaaguauacgugguaaagaauagagucugugaaugau

SEQ ID NO: 258098 - RNA, 62 nt, Human
cauuuuaauggagucaguuugcaguaugcuccacgugguaagauccuccaagcugcuuuaga

SEQ ID NO: 258099 - RNA, 64 nt, Human
cgcacugugugccucugcccagaagggggccucgccguuccaccagaagcucagcuccaggccc

SEQ ID NO: 258100 - RNA, 64 nt, Human
cucggggaagaagcuuccucuggccuggcgcaggccguuccaucugccucccaggucugcgucc

SEQ ID NO: 258101 - RNA, 64 nt, Human
uguuuauacaaggagacaucugugguuuccccaaccguuccaaaaggcuauuucaaaggaacca

SEQ ID NO: 258102 - RNA, 64 nt, Human
ccucugcauuuccagccccagcaucuugcuggagccguuccaucccggagcuuggaggggcagc

SEQ ID NO: 258103 - RNA, 64 nt, Human
gggagcauaccccacacccucccugccaccguugccguuccagaaccucggucaguguuucccu

SEQ ID NO: 258104 - RNA, 64 nt, Human
acuuacucagcugaugucacagugcagacauccaccguuccaccacagaaccaguggcugagcg

SEQ ID NO: 258105 - RNA, 64 nt, Human
agacugcaccucuucuauugcucuccucuguccaccguuccaggcagcagcacucccaccuggc

SEQ ID NO: 258106 - RNA, 64 nt, Human
accuugacuucugcccaaauccccucccugugacccguuccauaucccuuucucucuuguccaa

SEQ ID NO: 258107 - RNA, 64 nt, Human
caguuacucaccuguggcuucuucccccaguguaccguuccacuguggcccacauucuugugca

SEQ ID NO: 258108 - RNA, 64 nt, Human
gcuuggggagcaggucucuggcagagaaggauguccguuccaggagcacacggcccugccccau

SEQ ID NO: 258109 - RNA, 61 nt, Human
cuccacagcagaagauuuagcaccacuaucuccguuccaucugggcuuauauguacuuuua

SEQ ID NO: 258110 - RNA, 64 nt, Human
uaaaaaaccaaacagcugcccucauuagcggauuccguuccauuaucaaacccgaguggauccg

SEQ ID NO: 258111 - RNA, 64 nt, Human
caaaacccggcaaccagaaggggacagauaaggaccguuccagaaaucccaacucucacaccca

SEQ ID NO: 258112 - RNA, 64 nt, Human
uggggugcuuccugugguagugucuuucagguauccguuccacuagcuacaggugagcauuuua

SEQ ID NO: 258113 - RNA, 64 nt, Human
gccccagcuggaaccuggcagaggccuuaggaccccguuccaagugcacugcccggccaagccc

SEQ ID NO: 258114 - RNA, 64 nt, Human
aagaggcaccagaacugagcacugcccgugugacccguuccagguccccugggcucccucaaau

SEQ ID NO: 258115 - RNA, 64 nt, Human; identical to SEQ ID NO: 141769

SEQ ID NO: 258116 - RNA, 64 nt, Human; identical to SEQ ID NO: 141770

SEQ ID NO: 258117 - RNA, 64 nt, Human; identical to SEQ ID NO: 141771

SEQ ID NO: 258118 - RNA, 64 nt, Human
caccuccaccccauccauauccucuuuauuuccuccguuccaaugagaggccuauggcugcucu

SEQ ID NO: 258119 - RNA, 64 nt, Human
uccccgccuggccaggagcaggcacgggugguccccguuccaccccaagagaacucgcgcucag

SEQ ID NO: 258120 - RNA, 64 nt, Human
gucguuagcaagaucaucauaggcaaacauauauccguuccaaggcuaaaagugaccuuaacug

SEQ ID NO: 258121 - RNA, 64 nt, Human
cuggaaccauacuaucaaauggcgacagacuguuccguuccacccccgugaaguaaucaugcac

SEQ ID NO: 258122 - RNA, 64 nt, Human
gaaaucagcaagccugcuuaccuccagagacacaccguuccacuuacaguaucuagcuuccucg

SEQ ID NO: 258123 - RNA, 64 nt, Human
aagcugcaaauugcucaacuggcauugcuguaacccguuccauuuaauugguuuuuauuucuuu

SEQ ID NO: 258124 - RNA, 64 nt, Human
ggagcgccacagccgcauacauacaggggagcggccguuccauugcacgcuuugugagaaagcc

SEQ ID NO: 258125 - RNA, 64 nt, Human
ccuucccaggggccggggccggaacaugugccucccguuccagcaucuggcugcccgggggagg

SEQ ID NO: 258126 - RNA, 64 nt, Human
accccccugccgugccucccgcagcccucccaugccguuccacuccucccugccucugagccga

SEQ ID NO: 258127 - RNA, 64 nt, Human
accaccaucucaggaaaggcuguugugcuggugcccguuccagcugcaggggugacacugggag

SEQ ID NO: 258128 - RNA, 64 nt, Human
ugccugcugauguggcccugacaggcagccguuaccguuccauugcgguugaacguggccuuuu

SEQ ID NO: 258129 - RNA, 64 nt, Human
auuggaaggggacaagcuucguuucaggggucugccguuccauccugguucagagaaggccgag

SEQ ID NO: 258130 - RNA, 64 nt, Human
gcccccuaggagccagugaugcucggccuugcgcccguuccaccucccaggccacccuuccugg

SEQ ID NO: 258131 - RNA, 64 nt, Human
gaccaaauuuaaugaaccugcccaaaguuagcuaccguuccaugguucuuugcucuccccgggu

SEQ ID NO: 258132 - RNA, 64 nt, Human
uagaauaaucucaccacagaaucagaauuuucuaccguuccacacccaaccccuucaaauacac

SEQ ID NO: 258133 - RNA, 62 nt, Human
ccuuucccuacccaguaaccaugugacuacuaacgugguauauugauuuauuuuguuugcug

SEQ ID NO: 258134 - RNA, 62 nt, Human
gcuuuuuacuuuuucuuuugcuuuuucucggcacgugguaucuccaccauuucuucugcaca

SEQ ID NO: 258135 - RNA, 62 nt, Human
gagcgugaaccaugagggcccucaggaggggaacgugguaaaacccaagacauuaaaucugc

SEQ ID NO: 258136 - RNA, 62 nt, Human
agcuguuauucagugaugcauuuuguauacucacgugguauuuaguaauaaaaaucuaucua

SEQ ID NO: 258137 - RNA, 62 nt, Human
uuggaaaauccgugucuuuaucuuuuuuucccacgugguagauaugaucccauuggagguaa

SEQ ID NO: 258138 - RNA, 62 nt, Human
ccgggcugccccucacaaaagcuucugcauccacgugguaagcucccauggaugacaggguu

SEQ ID NO: 258139 - RNA, 62 nt, Human
auuaauauaugggggaaaauuauuuugacaugacgugguaaaaugugaaaaacuaauguguc

SEQ ID NO: 258140 - RNA, 62 nt, Human
gccaugcuaugagcaggccuauaaagagacuuacgugguaaaaaaugaagucuccugcccac

SEQ ID NO: 258141 - RNA, 62 nt, Human
aacagaagaaaauaauaugauuuauuagcacaacgugguacuauuugccauuuaaaacuaga

SEQ ID NO: 258142 - RNA, 62 nt, Human
auagcucaugcucccugccgagaaaguggaggacgugguacaggguugcagauguuuaguuu

SEQ ID NO: 258143 - RNA, 62 nt, Human
cugcuccuuuuuucuagaggaaauguuugucuacgugguaagauaugaccuagcccuuuuag

SEQ ID NO: 258144 - RNA, 62 nt, Human
gugacggaaauguucuguauuugcguuguccaacgugguaaaccagacacaugugauucuug

SEQ ID NO: 258145 - RNA, 62 nt, Human
agggagaacuuuaagcuuuuuugcucacagggacgugguaugggcccugggugcaggugccc

SEQ ID NO: 258146 - RNA, 62 nt, Human
acugaaaauuagacauuuauuaaccaaauuuaacgugguauuuaaagguaauauuuuuaaua

SEQ ID NO: 258147 - RNA, 62 nt, Human
auguuugcucagcuucuccaacaauaagaagcacgugguaaaacacuugcggauauucugga

SEQ ID NO: 258148 - RNA, 62 nt, Human
uaucauuaaacaaauugucuauuaaaugcaagacgugguaauauacagaauuuaucaggcau

SEQ ID NO: 258149 - RNA, 62 nt, Human
ucuggaagcaaagaauggggauggggagagcuacgugguaguauguuuuuauuaggagaaua

SEQ ID NO: 258150 - RNA, 62 nt, Human
ugaaaguguacaugcauaugcaagugugaauuacgugguauggauguuugcuuguuuauuaa

SEQ ID NO: 258151 - RNA, 62 nt, Human
gccaggucccgcgcaccaucccugcccugcccacgugguauugcugggcuccuggcuagaug

SEQ ID NO: 258152 - RNA, 62 nt, Human
aggcuauugcuuccacaccccuggccgugagaacgugguauguaggagaguuggcuguagcu

SEQ ID NO: 258153 - RNA, 62 nt, Human
cauauuuauuuauuuaaacaccccagggaguuacgugguaacaagguuguccauaaagaggu

SEQ ID NO: 258154 - RNA, 62 nt, Human
cacagcaggcuauuuucuaguuugugcuggucacgugguagaugaagccucuuacugcccca

SEQ ID NO: 258155 - RNA, 64 nt, Human
caggucagguccgcaaaggcuucugaagaagaggaagggcgaguaggggcaccuggacgcugau

SEQ ID NO: 258156 - RNA, 64 nt, Human
ggcgggaagccaggcggguggagcccaugggagcaagggcgaguggccgguccccgcugugcca

SEQ ID NO: 258157 - RNA, 64 nt, Human
ggugcuuucugcuuacugacuuaggcaauacaccaagggcgagauuuuauaugcacauuucugg

SEQ ID NO: 258158 - RNA, 64 nt, Human
caauuugagcuaccugaggaggaggcagggcagaaagggcgagggccugccucugaccugccgu

SEQ ID NO: 258159 - RNA, 64 nt, Human
cgaauuucucuuacguacaacugacagcaaaaggaagggcgaacuuucuagugacaaggaaucu

SEQ ID NO: 258160 - RNA, 64 nt, Human
aacagaccuaauucaucuccugugaggauggagcaagggcgaauauaggcauagacauaucugg

SEQ ID NO: 258161 - RNA, 60 nt, Human
aaaaguuaagcugcugacccugaaggcaagggagagcaggcugcacagcuguguguggaa

SEQ ID NO: 258162 - RNA, 60 nt, Human
uccuggcacuccagaccugggugaugugcaggagagcacacugauagaaauccuuguguc

SEQ ID NO: 258163 - RNA, 60 nt, Human
cuuaauggaucucucccaccuuaauaaaugggagagcaucccuaacacugagaaauccua

SEQ ID NO: 258164 - RNA, 55 nt, Human
aguuuagcaaaugcuggugaaaagaaagggcgagaucaccaagguucuuccaggu

SEQ ID NO: 258165 - RNA, 64 nt, Human
cuagaacaagaaccaccaaagccuguucgcacagaagggcgaccuugcagggacucgccgccgc

SEQ ID NO: 258166 - RNA, 64 nt, Human
uugauuucaguuacaauuuaaucuuuacaauuaaaagggcgaaagauguagaauuuuaguuuuu

SEQ ID NO: 258167 - RNA, 64 nt, Human
aaggacucaagaaaaauaauaaaagaccauaaauaagggcgaaaacauuaccaugugaaaagaa

SEQ ID NO: 258168 - RNA, 64 nt, Human
uggcccgcaucucgcugugcccugaagggggaugaagggcgaugccucgcccgaggcuuugggc

SEQ ID NO: 258169 - RNA, 64 nt, Human
gcugcugcucgcuuacuucagucgccucugcgccaagggcgacauccccccgccgcugcgcgcc

SEQ ID NO: 258170 - RNA, 64 nt, Human
ccccggcgccugcccaggcggaggcccuuucagaaagggcgaagcucacgccugacucugcggg

SEQ ID NO: 258171 - RNA, 64 nt, Human
cguggcugaguguggaugacuuuuauuuuaggagaagggcgauuaacacuuuugacaguauuuu

SEQ ID NO: 258172 - RNA, 64 nt, Human
caaagcuauuuuaaagaagaugcuauguugggagaagggcgaaguuguacuauaugacauaauc

SEQ ID NO: 258173 - RNA, 64 nt, Human
gauccgcgucgggacaggguuuuaagugacaaagaagggcgaguggcuucucugggccggguuc

SEQ ID NO: 258174 - RNA, 64 nt, Human
accucauuguaaauacgauuauucuaaaaacucaaagggcgagaacaacuggaauuucccaccu

SEQ ID NO: 258175 - RNA, 64 nt, Human
cugccugggaguuuuggcauuaagccccgccuugaagggcgagcuuuaaguuuuucccaguucu

SEQ ID NO: 258176 - RNA, 64 nt, Human
uggucacugugaaggagaaagagugagggcaaugaagggcgaugguggggagacucggugggug

SEQ ID NO: 258177 - RNA, 64 nt, Human
uuaauuguagauguuacaaguacguuacuuauuaaagggcgacucuguguaaguaaccuaagaa

SEQ ID NO: 258178 - RNA, 64 nt, Human
agaccaugggaguucccgaggggccccagcuuucaagggcgacgggagagacacaggauaaaag

SEQ ID NO: 258179 - RNA, 64 nt, Human
cagggaagcuaccggaccugccugggagccagugaagggcgagucagggcacgcguccuggagg

SEQ ID NO: 258180 - RNA, 60 nt, Human
gucgcccugaccgcuuguggauggagaaggggagagcaucuaggcaggcaaacagaaggg

SEQ ID NO: 258181 - RNA, 60 nt, Human
ugaccauuggcuucccucaucugaggcgugggagagcagacuggauagaugagaauuguu

SEQ ID NO: 258182 - RNA, 60 nt, Human
aacagaaagaauagagaacaggaacgagguggagagcaagacugacagagaaagugugag

SEQ ID NO: 258183 - RNA, 64 nt, Human
ccuagaaucacugaggcaccaauggcugagcaggaagggcgaggagacaccuugaucagcgucc

SEQ ID NO: 258184 - RNA, 64 nt, Human
ugcugcacuuccuguucauguacgacccuaagaaaagggcgacggccggggacugccuggagag

SEQ ID NO: 258185 - RNA, 64 nt, Human
ucugaggaggaaggccuccuggaaacugggagcuaagggcgaggcccuucccuucagaggcucc

SEQ ID NO: 258186 - RNA, 64 nt, Human
cacagcucacucgaccuugaggaggccucccacgaagggcgaagauggccgagaugauccuaaa

SEQ ID NO: 258187 - RNA, 55 nt, Human
ccaaauuaacacaccugugaugggaaagggcgaacgaggauuaggggauggggag

SEQ ID NO: 258188 - RNA, 64 nt, Human
cagggccacgcgccugcucccgaugcacggggagaagggcgacuuucaggccugaggagaggcc

SEQ ID NO: 258189 - RNA, 64 nt, Human
acccucagcagcaggggcucugucucccuucccaaagggcgagaaccacauuggacggucccgg

SEQ ID NO: 258190 - RNA, 64 nt, Human
ggugaagguagaauguaagaagaggccaggggccaagggcgaugcaggaccccccggagcuccu

SEQ ID NO: 258191 - RNA, 55 nt, Human
gaaccaacgcggaggacuagggcgcaagggcgagcccccgccgcgcuucugcgcu

SEQ ID NO: 258192 - RNA, 64 nt, Human
uaaagaucguguagauugggguuggggagggaugaagggcgagugaaucuaaggauaaugaaau

SEQ ID NO: 258193 - RNA, 64 nt, Human
gcgagcgagagagauuuccuuggaaauuucucccaagggcgaaagucauuggaauuuuuaaauc

SEQ ID NO: 258194 - RNA, 64 nt, Human
cuccagagccauguccauggggaggugggcucugaagggcgaaggugggagagcagggccccug

SEQ ID NO: 258195 - RNA, 64 nt, Human
acacuuauaaggcuuucuguaaaagguacuauagaagggcgaagaaucguucaacugucaauca

SEQ ID NO: 258196 - RNA, 64 nt, Human
uucucggcaacaucuggagaagcauaagcuaauuaagggcgaugauuauuauuacaagaagaaa

SEQ ID NO: 258197 - RNA, 64 nt, Human
gagucgagccucacagaagccagcgcgggucucugcucagcaccccagccggggcucuggaccc

SEQ ID NO: 258198 - RNA, 64 nt, Human
gcaucaguccuggcucugcugguccagaucuugcgcucagcacacucuagggaauaauuccacu

SEQ ID NO: 258199 - RNA, 60 nt, Human
cucugucccugggcuagggcaggggaggagggagagcaggguugggggagaggcugagga

SEQ ID NO: 258200 - RNA, 60 nt, Human
ugguggagcugacaaccuuugaggcugggaggagagcagccucugggcaucguucccagu

SEQ ID NO: 258201 - RNA, 60 nt, Human
gaugcagcccuucccccgagugcauggcuuggagagcagaaugugggcugcauauaagca

SEQ ID NO: 258202 - RNA, 64 nt, Human
ucagcugggcuuggcugccuggccagggccgggggcucagcagccuccucuagccucugaugcc

SEQ ID NO: 258203 - RNA, 64 nt, Human
ucagucagagguauuuauuaaguaccuacugugugcucagcacuaaagguuuguugauaaaaug

SEQ ID NO: 258204 - RNA, 64 nt, Human
uugagccuuucuagauggcuuagguggcaccauggcucagcaggaggggcgggaggcaccaggg

SEQ ID NO: 258205 - RNA, 64 nt, Human
gagagaggaguuggccuagagcaggccacugugagcucagcacagaguaggaagaacagugaca

SEQ ID NO: 258206 - RNA, 64 nt, Human
uugcucacugcuaaguccccagcucaccuuaggggcucagcaggucccuguugaagggaggaag

SEQ ID NO: 258207 - RNA, 64 nt, Human
gcaaggccuugguggagcagccagagcugugccugcucagcagccagucucagagaccagcacu

SEQ ID NO: 258208 - RNA, 64 nt, Human
gauccgucucuguccuguccuggcacuggcacaagcucagcacaugcccaguaaugcguguugu

SEQ ID NO: 258209 - RNA, 64 nt, Human
cuuuguuguggggcugucugguguaugguagggugcucagcagcaucccuggccucugcccacu

SEQ ID NO: 258210 - RNA, 64 nt, Human
aaaaguguguuccuguucauagccaggaaacccagcucagcaaacucccuuucaaagcugugug

SEQ ID NO: 258211 - RNA, 64 nt, Human
aaucacagucaagacggaucaauaauaugguuuggcucagcaaagccagcugugcucuuuuagg

SEQ ID NO: 258212 - RNA, 64 nt, Human
agcaucagucuuuccggggcauuucaguuaagcugcucagcagauauggauggaucugcaauca

SEQ ID NO: 258213 - RNA, 64 nt, Human
guggcauggggcucuggggagcaagcccuuacuugcucagcacugguuauguagcacaaauagc

SEQ ID NO: 258214 - RNA, 64 nt, Human
cccuacugucuacacgggcuugcacacagcaggugcucagcaaaugucuauugauuugauuguc

SEQ ID NO: 258215 - RNA, 64 nt, Human
ucagguucagcgcccuuggggcuaugaaugggaggcucagcagugcccugaggaugggcuuccu

SEQ ID NO: 258216 - RNA, 64 nt, Human
agccuggacccuguggaugauaaaacacaaacgggcucagcaaaagaugcuucucacugccaug

SEQ ID NO: 258217 - RNA, 64 nt, Human
auuguugcacggcaaccacuccucccauggcauugcucagcaacuacuucucccuucccggcca

SEQ ID NO: 258218 - RNA, 60 nt, Human
uggcaacaaugccccgagugguggcagccaggagagcagcgcagaacagcccagaaaagg

SEQ ID NO: 258219 - RNA, 60 nt, Human
uaaaaccuaauugcuaaugcuucacaacuaggagagcaugccgucuugauguuuaaaaaa

SEQ ID NO: 258220 - RNA, 60 nt, Human
guuggucuauaugacagggaggagaguaaaggagagcaggagcaauuggcugccugcaaa

SEQ ID NO: 258221 - RNA, 64 nt, Human
gcuccacccucaccaggaugaaggcgugcaaggggcucagcaaggugugaaugaccuuaguccg

SEQ ID NO: 258222 - RNA, 64 nt, Human
gucauacugaggaggaccccagcuuuucuugccagcucagcaguucacuuccuagagcaucugu

SEQ ID NO: 258223 - RNA, 64 nt, Human
agugggccaggugguugaagaaagccaugugggagcucagcaaaucccaagggcuuauuaugac

SEQ ID NO: 258224 - RNA, 64 nt, Human
auucgcuggacugcaaaaaggagcaccagggaaagcucagcaaaggcucaggaggccucccggg

SEQ ID NO: 258225 - RNA, 64 nt, Human
uacugggccuuguauugcuuuuaaaguuuccucugcucagcaucauuucaugccaaagugcugc

SEQ ID NO: 258226 - RNA, 64 nt, Human
auuuuccauggagcccaugucagaguccacuccagcucagcaggaaaguggaauugcccaguac

SEQ ID NO: 258227 - RNA, 64 nt, Human
ggccagagagcaggcucagagcagcuaguguggagcucagcauccccaccccaccccuccuccc

SEQ ID NO: 258228 - RNA, 64 nt, Human
gggugccuaucuaaguggaacuaauugcccgagggcucagcaaggccaagaggagacagccgug

SEQ ID NO: 258229 - RNA, 64 nt, Human
ucaggggagcugccuucaggcuugugccccgugugcucagcagcugccucugucccccucuacu

SEQ ID NO: 258230 - RNA, 64 nt, Human
gcugaccuaccuacagucccuggcugccaaaacugcucagcaguugggccacuccacuauucca

SEQ ID NO: 258231 - RNA, 64 nt, Human
gaagacaccuucccugcccugguuuggcugacgugcucagcaaaaccccaugugcccugcuccu

SEQ ID NO: 258232 - RNA, 64 nt, Human
gucuagagcccacccccuccucaggaacucaagagcucagcauuuauaaugagcaguugguaau

SEQ ID NO: 258233 - RNA, 64 nt, Human
ugaaauaaagacuuuuuguauuucuggggcugaggcucagcaacagccccucaggcuuccagug

SEQ ID NO: 258234 - RNA, 64 nt, Human
aaggggaagaagaucaaaacccaccaugccccaggcucagcagcgugcugauggaaguggaagu

SEQ ID NO: 258235 - RNA, 64 nt, Human
aagaggaagaagaccaaggcccaccgugccccaggcucagcagggagcugcuggagguaguaga

SEQ ID NO: 258236 - RNA, 64 nt, Human
aaguggaagaagaccaagacccaucaugccccaggcucagcagggagcugcuggcugagaaaga

SEQ ID NO: 258237 - RNA, 60 nt, Human
ugucacucugccucuaaggccaaggccucaggagagcaucaccaccacaccccugccggc

SEQ ID NO: 258238 - RNA, 60 nt, Human
uucuaacucaaggaggagagcuauguacagggagagcauuuuagauugaagguuggaaug

SEQ ID NO: 258239 - RNA, 60 nt, Human
cauacugggcgugugcaucugaauccugcuggagagcaaacacgaacuucuguucccugc

SEQ ID NO: 258240 - RNA, 64 nt, Human
gagcuuuacauuuucugccucugccuuccucccagcucagcaaggaaguauuugggcacccuac

SEQ ID NO: 258241 - RNA, 64 nt, Human
ugcugggucucuccaacccucaccagccaagguggcucagcaccuugugucccccuccccugcc

SEQ ID NO: 258242 - RNA, 64 nt, Human
gggaggaggcgggaucugcucugaggcccucgaggcucagcagagcgugcaccaaugagaccac

SEQ ID NO: 258243 - RNA, 64 nt, Human
acagcaccaauuguacauucccugcauccaaucugcucagcaggcccuaagaugccuugagucu

SEQ ID NO: 258244 - RNA, 64 nt, Human
ucuggcuccguuucuggugcuucuggaagucucugcucagcacagggaagaacuaacacgacua

SEQ ID NO: 258245 - RNA, 64 nt, Human
uguuggggaugcuguuguauaaugauaugguguagcucagcauuuccaaagacugaauacauua

SEQ ID NO: 258246 - RNA, 64 nt, Human
ucaaagaagucuggcagcacuuggguuauagagggcucagcaugaccaaaguccuaaagauuuu

SEQ ID NO: 258247 - RNA, 64 nt, Human
ggagagcagcgcagaacagcccagaaaaggcggugcucagcacggggugucauccugugaaggg

SEQ ID NO: 258248 - RNA, 64 nt, Human
aaucagcuuguuguagugaugcuggccaaauggugcucagcaggugagaacaaaaaaaccccag

SEQ ID NO: 258249 - RNA, 64 nt, Human
gaacaggggugggaaagggagcaaggggcagauagcucagcaaggaaagaaugggcucagaaaa

SEQ ID NO: 258250 - RNA, 64 nt, Human
gggaagggucccccuggccuccagcaggagcacagcucagcagggucccugcugcccaccccuc

SEQ ID NO: 258251 - RNA, 64 nt, Human
gaaaacauugagcagagaacugcagccaggaugcgcucagcagacauucacucuggcugcuggg

SEQ ID NO: 258252 - RNA, 64 nt, Human
uuucuccuuucuuuucuccauugaggacaguucugcucagcaaaauuguugaguaccuguucug

SEQ ID NO: 258253 - RNA, 64 nt, Human
uagggaacugcaaauguaugaugauuuugaaaaggcucagcaggauuuguucuuaaaccgacuc

SEQ ID NO: 258254 - RNA, 64 nt, Human
ugugguggcucacacccauaaucccaacacuuuggcucagcagauugcuugaacccaggaauuc

SEQ ID NO: 258255 - RNA, 64 nt, Human
ccuccuucccgcuacagaaucgcucaucggcgaggcucagcagaaagacccugaaggcaggcug

SEQ ID NO: 258256 - RNA, 60 nt, Human
aguggugucauguauuguaauugcucgcagggagagcagucuuuuugguguaauaguggg

SEQ ID NO: 258257 - RNA, 60 nt, Human
uccuuuucuugaaucagacuugugauuuggggagagcaacuucagggcuucuccauagac

SEQ ID NO: 258258 - RNA, 60 nt, Human
gcgcucauuaagcagaggagcccacuuugaggagagcaaagcacaagcuugccugaagaa

SEQ ID NO: 258259 - RNA, 64 nt, Human
gugagaagccauaagagagagaccgaauucuguggcucagcacacaggacugacccacagccca

SEQ ID NO: 258260 - RNA, 64 nt, Human
ugacaccaaacacaucgcugaaaaaauuaagucagcucagcacgaguugaaauugacuacauua

SEQ ID NO: 258261 - RNA, 51 nt, Human
ucaugcauuauucugaguaaagcucagcagggcugugcuugccucacagga

SEQ ID NO: 258262 - RNA, 64 nt, Human
ggaagaugcuuuggaugaguuaauuaaggauugugcucagcagcuguuugaguuaacagaugac

SEQ ID NO: 258263 - RNA, 64 nt, Human
gaugaaaaggggccacugaaaagugaauuugauagcucagcauuuaagcaugauuacauauuca

SEQ ID NO: 258264 - RNA, 64 nt, Human
cgaaauuuguuuuaugcaugaguuaauaccacuggcucagcaaauacaaguuaguuugcuuuaa

SEQ ID NO: 258265 - RNA, 64 nt, Human
agaguugcuauggccaggcauaugggauuuggaagcucagcagaagugacuucugcucuguggu

SEQ ID NO: 258266 - RNA, 64 nt, Human
gcccagcacccacccggccaugaggaccugcucugcucagcacgggcacugccacuuggugugg

SEQ ID NO: 258267 - RNA, 64 nt, Human
uuccuccccuguuucaaccccacauguauuccaugcucagcagcagcagcagaaauaguaggau

SEQ ID NO: 258268 - RNA, 64 nt, Human
uguugagcucggggugucuuccccaaggcauguggcucagcagcaagaaaggcaaguugcuccu

SEQ ID NO: 258269 - RNA, 64 nt, Human
uccuuacccugcagaaauaucacaguuagcuggggcucagcaguccucccucuggggacucccu

SEQ ID NO: 258270 - RNA, 64 nt, Human
agcugaguaaaggcaagcaggugugaagagcagggcucagcagcaagucacauuuuucuacuau

SEQ ID NO: 258271 - RNA, 57 nt, Human
cuuacuauccacagcaguaauaugucugcucagcagcucagcugauucagaucagag

SEQ ID NO: 258272 - RNA, 64 nt, Human
cagcauggagcagggaugggcugucugugcccaugcucagcaugccuugaggggaggagguggu

SEQ ID NO: 258273 - RNA, 64 nt, Human
acugaugguuugguuuccucucugcucugccccugcucagcacagggagaauguugacuuagaa

SEQ ID NO: 258274 - RNA, 64 nt, Human
cccugggggcccacgacucaccuggugggccugggcucagcaaacagcccucccucccaguauu

SEQ ID NO: 258275 - RNA, 60 nt, Human
gugucuguggaaaaugggagcucuuguuguggagagcauaguaaauuuucagagaacuug

SEQ ID NO: 258276 - RNA, 60 nt, Human
caugagcuccaugcucaccagccucgccgaggagagcaaguuccugaacaugaugaccua

SEQ ID NO: 258277 - RNA, 60 nt, Human
guugucugagccggagccggcagcuccacuggagagcagugcaggcagaguggagccucc

SEQ ID NO: 258278 - RNA, 64 nt, Human
gaggcaaaguccuaagcaagguugugcuaucaaggcucagcauaccuucgugggccuuugauuu

SEQ ID NO: 258279 - RNA, 64 nt, Human
cuggauaaagcccauaagcugggucucaggcugggcucagcaaaggacucgccuugcaaccgac

SEQ ID NO: 258280 - RNA, 64 nt, Human
gaauuuugccacuuuuaaauaaugugcugaauaagcucagcaacuaaaaaccauuacccaagaa

SEQ ID NO: 258281 - RNA, 64 nt, Human
aggauuauaugauguacaucaguucuauaaaugugcucagcaguuuaacaugugaauccuguuu

SEQ ID NO: 258282 - RNA, 64 nt, Human
uucccaguuguugacugugacaggcucagcaugggcucagcagaugcugucuuaauuuguggau

SEQ ID NO: 258283 - RNA, 64 nt, Human
gaggccccgguuucccaguuguugacugugacaggcucagcaugggcucagcagaugcugucuu

SEQ ID NO: 258284 - RNA, 64 nt, Human
gccccucagaggcggugucuggggaggacuuugugcucagcacucugcaccggccacucuuagc

SEQ ID NO: 258285 - RNA, 64 nt, Human
guccgugggacccauguuagagcagaaaauuugggcucagcacauuuuacuguuaguagagagc

SEQ ID NO: 258286 - RNA, 64 nt, Human
caccgcgcccgcccugccccuuuccaagagauaugcucagcauaaugagagaucaaccguggug

SEQ ID NO: 258287 - RNA, 64 nt, Human
cuugccuuauaguugagcuauuugguuugacaaagcucagcagaaacuugaugugaaaaaucua

SEQ ID NO: 258288 - RNA, 64 nt, Human
cuguggugugaggguggcuuugucuaagaugccugcucagcaugaucaccagagggugugggca

SEQ ID NO: 258289 - RNA, 64 nt, Human
ggccuccggcucucagagcauaauccuuggcagggcucagcaggcgcacguugguuucuugguc

SEQ ID NO: 258290 - RNA, 64 nt, Human
ggggccccagacgccacgucgggauuucugacaugcucagcagguagaccagaggccgugugac

SEQ ID NO: 258291 - RNA, 64 nt, Human
uuauuggggccauuucauagaaaggcagauugaagcucagcagggaagaggcuuuugaggguga

SEQ ID NO: 258292 - RNA, 64 nt, Human
cagccccguguagccccgggcugacccagugugugcucagcagccccaccccacccugccccuu

SEQ ID NO: 258293 - RNA, 64 nt, Human
caucuagguggucaugauuaccugcaugcuuugagcucagcagcagucuucauaaacacauuua

SEQ ID NO: 258294 - RNA, 60 nt, Human
cagguuucauguugcgucuuguugagggagggagagcagguuacuuggcaaccauauugu

SEQ ID NO: 258295 - RNA, 60 nt, Human
gggagagagugaugaccucguggccuguguggagagcaugcaucaggugaucccggggug

SEQ ID NO: 258296 - RNA, 60 nt, Human
cugaaccaauuguuuuugacugaguaucuaggagagcaguaaguggaacuucagacaagc

SEQ ID NO: 258297 - RNA, 64 nt, Human
agcacuggauggggguagugagcaaaucugcccugcucagcagucaccauagcagcugacugaa

SEQ ID NO: 258298 - RNA, 64 nt, Human
ggggugucagaucugucugaggagccccagucaugcucagcacgcuacagauguguuguuuguc

SEQ ID NO: 258299 - RNA, 64 nt, Human
cacgcguugaauaguuccacauacuuucagaagagcucagcagggcccugccuggucucccgag

SEQ ID NO: 258300 - RNA, 64 nt, Human
gugauccauaguauuuagugcccugauacuauaagcucagcaaguaaccugguacauuugaaau

SEQ ID NO: 258301 - RNA, 64 nt, Human
ccauggcggaugcugaggccacagcuggugaacagcucagcagacaacaugcuggaguacaagu

SEQ ID NO: 258302 - RNA, 64 nt, Human
ccauuuucaguucugcugucacuuggaaguucaggcucagcaugaauuuuuggcagguagcucu

SEQ ID NO: 258303 - RNA, 64 nt, Human
uucaucgugugaaauugcauuccaagugagcugugcucagcagugcuuggacacagagcugcaa

SEQ ID NO: 258304 - RNA, 64 nt, Human
gugggaaucuaugauggagguuacuggggaaacagcucagcagauuuuuggagaccaaaccaaa

SEQ ID NO: 258305 - RNA, 64 nt, Human
gguguugggaaagcagggggacaugugucccucagcucagcagaggcugugguacaacaugguc

SEQ ID NO: 258306 - RNA, 64 nt, Human
ggccgaggcacccgguggcagcuggcaggguuuugcucagcacgugccggccuuccucgaagcu

SEQ ID NO: 258307 - RNA, 64 nt, Human
gcugcccagagcgugucccagacaucacagcggggcucagcaguucccacagccucugccugcc

SEQ ID NO: 258308 - RNA, 64 nt, Human
cgucaccuagggcucuccuguucagccuuaacaggcucagcaaaucagggcguggcuggacgau

SEQ ID NO: 258309 - RNA, 64 nt, Human
uaaaagcuacagagauaacuccaaguuuaauccagcucagcaugaaacugcaaaaacacugaac

SEQ ID NO: 258310 - RNA, 64 nt, Human
uuaguuuuaaaaggaugaaaagcuuaugcaacaugcucagcaggagcuucaucaacgauauaug

SEQ ID NO: 258311 - RNA, 64 nt, Human
auggcccaugccuguagucccagcuacucaggaggcucagcagcaggacgacuugagcccaaga

SEQ ID NO: 258312 - RNA, 64 nt, Human
cccacaacagcguguaaacacauguucugugccugcucagcagagccucguuucugcuuucagc

SEQ ID NO: 258313 - RNA, 60 nt, Human
cuuggucuguuuuucuugugggagccuaguggagagcagacguggcuuuuuaugugucuu

SEQ ID NO: 258314 - RNA, 60 nt, Human
cuuauacauguugggguuugcucuuaaagaggagagcaggaagaaagguugguuucagaa

SEQ ID NO: 258315 - RNA, 60 nt, Human
cauuguguauacugagauaaucugaggcauggagagcagauucagggugugugugugugu

SEQ ID NO: 258316 - RNA, 64 nt, Human
gucgaaccagcaggcaaggcgaggugcccgcucagcucagcaagguucucaacugccucgagua

SEQ ID NO: 258317 - RNA, 64 nt, Human
ccugguccagcccugguuggggagggugggcccagcucagcagggacaguuuggggagaguccg

SEQ ID NO: 258318 - RNA, 64 nt, Human
ggauauaugguaaaguuguuuuggacuuguuuuugcucagcaugaaguuuuauaugcugcauuu

SEQ ID NO: 258319 - RNA, 64 nt, Human
uacucccggucacacugggcgaccacgggggccugcucagcacccucaccucccacccccugag

SEQ ID NO: 258320 - RNA, 64 nt, Human
ugaggggcacagcaccccuccccggcaucugccagcucagcacagaagacaccgaaugugcauc

SEQ ID NO: 258321 - RNA, 64 nt, Human
aaaggauggggaccacaaggaagagccaggugcugcucagcagaggauaugggugggagcgaaa

SEQ ID NO: 258322 - RNA, 64 nt, Human
ucaguuucauccccauccccaggucuuccuagacgcucagcacccccuucuccccugugccgua

SEQ ID NO: 258323 - RNA, 64 nt, Human
auuaccccuugauuucucaggagcgucugggggggcucagcacgcacaaacuccuucuccuucu

SEQ ID NO: 258324 - RNA, 64 nt, Human
gggguggggguuucugcauccgggucaaugcccagcucagcaucuucagcugugcccaggcucc

SEQ ID NO: 258325 - RNA, 64 nt, Human
gguaacguguauauuuugguggagauuuuuaaaagcucagcaugagcaaucauuccauucgguu

SEQ ID NO: 258326 - RNA, 64 nt, Human
uccccuuccccuucccuucugaccagccuuggaggcucagcaucugugccucucacuccgugga

SEQ ID NO: 258327 - RNA, 64 nt, Human
ccacccaagccugauacgcaucugggcccgccgggcucagcaggggaggcugcuacggcugccc

SEQ ID NO: 258328 - RNA, 64 nt, Human
aaugacaauaaaaaacugguccaacgaagacacugcucagcacuucagccaucaggacuaaucc

SEQ ID NO: 258329 - RNA, 64 nt, Human
ucacaugcuccuugccucugcucugugcacucacgcucagcacacaugcauccuccccucuccu

SEQ ID NO: 258330 - RNA, 64 nt, Human
aagaggccuagccugagccaaagagagaguacgggcucagcagccagaggaggccggugaagug

SEQ ID NO: 258331 - RNA, 64 nt, Human
ccguaggccaugugaugggccugaaguggaggcugcucagcacagagcccuuucuggugccucu

SEQ ID NO: 258332 - RNA, 60 nt, Human
cuggcaucugaauguccauucgccaggcauggagagcaagagaagguauguacugccuga

SEQ ID NO: 258333 - RNA, 60 nt, Human
gugaccaaagcaguuggcucuuaaaaggugggagagcagcccaaccaauccccaauccuu

SEQ ID NO: 258334 - RNA, 60 nt, Human
ugggaucuuuuagggcccugagcccugccuggagagcagcacagcucaucaguccccaaa

SEQ ID NO: 258335 - RNA, 64 nt, Human
ugccugcuaggagccccccagggucugggaccccgcucagcauggcugcagguaccuugauagc

SEQ ID NO: 258336 - RNA, 64 nt, Human
acaguccaccuuucggccggccagccugaucugggcucagcauguuuggggucagucaguguug

SEQ ID NO: 258337 - RNA, 64 nt, Human
gugaaggcucugccagacaccuccaagcuugagagcucagcaccaugcaccaagagcaggagaa

SEQ ID NO: 258338 - RNA, 64 nt, Human
aaggaaggcugugcaccacugggacccagcagcagcucagcagcagcagugagagggccuuggg

SEQ ID NO: 258339 - RNA, 64 nt, Human
aaaaugcuaucucaaaguuuaacacaauuuaagggcucagcauaaguaaacaacauauuugggg

SEQ ID NO: 258340 - RNA, 64 nt, Human
gcaucuaaaaaagcauagaauuccuacucacacagcucagcaacaaccauuuugaugguaacag

SEQ ID NO: 258341 - RNA, 64 nt, Human
cugccucgcuccugacucagcacuuuguucacuggcucagcaguuauguuuacacaucauuuuu

SEQ ID NO: 258342 - RNA, 64 nt, Human
uucccuuugccuccccaggacagggugagucagagcucagcauuuaaucuccucuccaaaguag

SEQ ID NO: 258343 - RNA, 64 nt, Human
ggcaaaauaacaaauugugaaaauagaagccauugcucagcaccguuucuccaucaaugccgug

SEQ ID NO: 258344 - RNA, 64 nt, Human
augugguaaagccuucagucauagcucagccauugcucagcaucagauaauucacaccagagag

SEQ ID NO: 258345 - RNA, 64 nt, Human
gggagucggccuuuccucuaguaaccaccacauggcucagcaucugugccaaacauaggcgcuc

SEQ ID NO: 258346 - RNA, 64 nt, Human
gagucuccagucacugguggccuuccccaagugagcucagcagcaugugcuaauaggugccaau

SEQ ID NO: 258347 - RNA, 64 nt, Human
ugaacaccgcagccccuccuucgcuccuuccagagcucagcaugucacggcaaggacugccgca

SEQ ID NO: 258348 - RNA, 64 nt, Human
gugcccucaggaggagaccacagcauguccaucagcucagcagagcucgacagccacaaguccu

SEQ ID NO: 258349 - RNA, 64 nt, Human
gaguccaggagggauggaaaacuccuggauuuaagcucagcaucccccacaugggcuuuucgau

SEQ ID NO: 258350 - RNA, 64 nt, Human
gagcuugguacuuucccuccaggcagaggcucuagcucagcacggccuguagcgcacagucagu

SEQ ID NO: 258351 - RNA, 60 nt, Human
ccuugaagccuccagcaacgucuaucuccaggagagcagggcagccuaugcaaguguucc

SEQ ID NO: 258352 - RNA, 60 nt, Human
ccuggcaggggucuggccccccagguaggcggagagcagucccucccucaggaacuggag

SEQ ID NO: 258353 - RNA, 60 nt, Human
gcuuaaugaaggucauaaguuucugagaugggagagcaacaaguagagaugaaguuaaag

SEQ ID NO: 258354 - RNA, 64 nt, Human
uugggucugggaagagguaagaggaacacuagaagcucagcaugacuuaaacagguuguagcaa

SEQ ID NO: 258355 - RNA, 64 nt, Human
gccuaggccacaguggugacggcaggauggcccugcucagcaccgcaagagccauggcuguccc

SEQ ID NO: 258356 - RNA, 64 nt, Human
aaaacuguuucaagcccuccuccccagagcuggcgcucagcagcccuagcggcugcuccuucag

SEQ ID NO: 258357 - RNA, 64 nt, Human
acggggugaaaccucccauuggccaaaggacacggcucagcaagggggacauugcccaagcccg

SEQ ID NO: 258358 - RNA, 64 nt, Human
ggucucaaagauguagaacgcagcgugugcccacgcucagcaggugugccauccuuccaccugc

SEQ ID NO: 258359 - RNA, 64 nt, Human
ucugccuccaagguaggagaugucugugggugaggcucagcaacugagcaaauaugugccugug

SEQ ID NO: 258360 - RNA, 64 nt, Human
uucuaaaauuccacaccuggagugaccucuagucgcucagcauccacuuugugucuccaaauug

SEQ ID NO: 258361 - RNA, 64 nt, Human
uuauuuacacuguuuuguauuguacaauauauaugcucagcacugcccccuucucugauugcuu

SEQ ID NO: 258362 - RNA, 64 nt, Human
cugcaacccaaacucgacucuucuacuuacacuugcucagcauuuuugucaucccugcccuugg

SEQ ID NO: 258363 - RNA, 64 nt, Human
aagccuggagggguggcagggcagagcagcccaggcucagcauggagcccacuuaccguguggc

SEQ ID NO: 258364 - RNA, 64 nt, Human
cuuccuccuucugcuggcugaagugaugacuggagcucagcaaccacuuugcaccaugaggcag

SEQ ID NO: 258365 - RNA, 64 nt, Human
cagagcauuuuccaaguucccgauggcgaacggggcucagcaccagagaccagggaguauucac

SEQ ID NO: 258366 - RNA, 57 nt, Human
cgugcugccugcucaugugaggcuguugcucagcaugcaggggcccugucgcgggca

SEQ ID NO: 258367 - RNA, 64 nt, Human
cgaguuugcaaugucacaaccucucugaucuugugcucagcaugauucuuuaauagaaguuuua

SEQ ID NO: 258368 - RNA, 64 nt, Human
acugggaggcagggcucucccgugcauccccccugcucagcaauucagaccccuuugagagacg

SEQ ID NO: 258369 - RNA, 64 nt, Human
ggcaaauagagagucuccaagagaacgcccucaugcucagcacauauuugcaugggagggggag

SEQ ID NO: 258370 - RNA, 64 nt, Human
agccaacagccuccggccagcagcccuacccggggcucaacacacaggcuguggcucuggacau

SEQ ID NO: 258371 - RNA, 60 nt, Human
gagcagacccuuuagaaaucagcccaagggggagagcaagagaaaacacucuagggagua

SEQ ID NO: 258372 - RNA, 60 nt, Human
aauuuguuaauuguuuaaaccacuucuuuuggagagcaaggggaaggucaagaaggcagu

SEQ ID NO: 258373 - RNA, 64 nt, Human
uauuuguaaaagcuguugauuucgaguuguaagagcucagcaucccaggggcaucuucuugacu

SEQ ID NO: 258374 - RNA, 64 nt, Human
cuucccucuuuucuuaaacuucuggcauuucagagcucagcaggcuaccccugguuucuggaga

SEQ ID NO: 258375 - RNA, 64 nt, Human
auuggaaaaccugcugaacauuuuacauuggucugcucagcacauggcuggaugcggauauuuc

SEQ ID NO: 258376 - RNA, 64 nt, Human
cuccccugaaccugggagacagaugaggagacuggcucagcaaggccccuggaggucaagcuug

SEQ ID NO: 258377 - RNA, 64 nt, Human
gagugaagacugugaugugugguccccauauguggcucagcaaagacucgagagaucaucccuu

SEQ ID NO: 258378 - RNA, 64 nt, Human
gugccuguguggucuguuuacagugcagaaggcggcucagcagugcaaugggcugacagccuug

SEQ ID NO: 258379 - RNA, 64 nt, Human
caaagugaccuugguuacuuuuuuacccugaggggcucagcacucauuaggacuuggugccuaa

SEQ ID NO: 258380 - RNA, 64 nt, Human
caggcaccacucagaacguggugaguacagcucagcucagcacucagucagugguaacuugugc

SEQ ID NO: 258381 - RNA, 64 nt, Human
cgcgcggugcuggacaacccgcaccgugagucuggcucagcagcccccucccgggcagcuucac

SEQ ID NO: 258382 - RNA, 64 nt, Human
aagggcagggcuggagccggguccucagcugucugcucagcagcccuggacccgcgugcguuac

SEQ ID NO: 258383 - RNA, 64 nt, Human
acugcccaucuucggugacacccuggggugaggugcucagcaccuuccucucgaggagccacau

SEQ ID NO: 258384 - RNA, 64 nt, Human
ccuggaagcuucuuggccucagcuccccuuccccgcucagcacccuguuaggaucagugugugu

SEQ ID NO: 258385 - RNA, 64 nt, Human
uggaggggaagaggggccccgaggaugggccugggcucagcauucgagaucuugagaaugauuu

SEQ ID NO: 258386 - RNA, 64 nt, Human
agagcaggacugcacagcguccuguccacacccagcucagcauuuccacaccaagcagcaacag

SEQ ID NO: 258387 - RNA, 64 nt, Human
ccaggccccgggcaccuccugcaaccaucucugggcucagcaccugaggcggguuuccuggguc

SEQ ID NO: 258388 - RNA, 64 nt, Human
cgccugcagcugagagcaggagcaggaaaaggaggcucagcacugucucaggcuggaggucagc

SEQ ID NO: 258389 - RNA, 64 nt, Human
uuuguggaacacucugggauaauuggggacuucugcucaacauggcaguggcauguuaggcaug

SEQ ID NO: 258390 - RNA, 60 nt, Human
caucccaguggggcauaacuaggggucacgggagagcagucucgucuccuguguguaugu

SEQ ID NO: 258391 - RNA, 60 nt, Human
agccucugccggagccccagucuccgcaguggagagcagagcgggcgguaaagcugcuga

SEQ ID NO: 258392 - RNA, 64 nt, Human
ccugccccauaacguccuccgcauccacuuuccagcucagcagccgcacccgaggcucagccug

SEQ ID NO: 258393 - RNA, 64 nt, Human
acuucaccacaccccuugccuggccuggccugaggcucagcagugcaugacuucucguagauaa

SEQ ID NO: 258394 - RNA, 64 nt, Human
uuagcauaaagucguggggggcauuuucuggaaugcucagcaguucugauuaacugccaagccc

SEQ ID NO: 258395 - RNA, 64 nt, Human
acuugacaacuuuuaagggcauguuauuugaagugcucagcaguugaaagcaaaauaauaacug

SEQ ID NO: 258396 - RNA, 64 nt, Human
ccauuuggaggguuuugcugacacagcggggacugcucagcacucccuaaaaacacaccaugga

SEQ ID NO: 258397 - RNA, 64 nt, Human
ggugcagguagaacagggugaggagagggggucggcucagcaggaggaggcuguggcugcagag

SEQ ID NO: 258398 - RNA, 64 nt, Human
acagaaggucaugaguucagggucagacgcagccgcucagcacaggagggguggaggggaaaug

SEQ ID NO: 258399 - RNA, 64 nt, Human
aaagugggagggagucagaaacagaguuggugcugcucagcaggacggugaaacaaugauacuu

SEQ ID NO: 258400 - RNA, 64 nt, Human
ugggcuagaaugccugcacauuuaguuaaacugggcucagcaugcuuguccucaaaauguccau

SEQ ID NO: 258401 - RNA, 64 nt, Human
ccaaacuugauuggagaauuugcaaacuaccgucgcucagcaacaccaaaaagagaaagucugg

SEQ ID NO: 258402 - RNA, 64 nt, Human
aaccauuuuggaauuuccuucgugauguucgagagcucagcaauggaccccucacagagcuccu

SEQ ID NO: 258403 - RNA, 64 nt, Human
ucccagucccgccagccuggggcauccuccaugggcucagcacugagaggucuugggucugcca

SEQ ID NO: 258404 - RNA, 64 nt, Human
ggaccaugcugucuggcacagccugcacuugggggcucagcaaggccaccucuuccuggccggu

SEQ ID NO: 258405 - RNA, 64 nt, Human
ggcugucuugguggaugggcccugcaagacacaggcucagcaugcagaagugcaugaacagggu

SEQ ID NO: 258406 - RNA, 64 nt, Human
guguauguaacggcuucugauuucugugaaagcugcucagcaacaaacguacuuccaccagaug

SEQ ID NO: 258407 - RNA, 64 nt, Human
ggccuuuuuaauugccaaacugcucucuucaucagcucagcacaugcuuuaagaaagcaaaacc

SEQ ID NO: 258408 - RNA, 59 nt, Human
uccuuaaaguugccauauagaugugaacugcucaacacacagaucuccuacuccaucca

SEQ ID NO: 258409 - RNA, 64 nt, Human
agcuggagccccugcugcccagcucagacucuaagcucaacaagcccuugagcccccagaagga

SEQ ID NO: 258410 - RNA, 64 nt, Human
agaaggagcugacgcugcgcagccaagcccuggagcucaacaagcggaaggugaggcugggcca

SEQ ID NO: 258411 - RNA, 64 nt, Human
uccaccuuggccuguuuuguuuuucuuuccuugggcucagcaauucaaauucuaguuguuauuu

SEQ ID NO: 258412 - RNA, 64 nt, Human
cagguggggggguacccgcaccgggaaugagcaggcucagcaggggggcagccccaccccuagu

SEQ ID NO: 258413 - RNA, 64 nt, Human
gcggcugccaggcccagcccugacuuccacucuggcucagcaaccugguuauuuauguggggcc

SEQ ID NO: 258414 - RNA, 64 nt, Human
aggacaugauuuucaccuacuaacaccuccacgugcucagcaauuuugcaugucccuuuucauc

SEQ ID NO: 258415 - RNA, 64 nt, Human
agcagccuuuguaaguggaaggauuguacugaaggcucagcagcaauagaggugagugcaugua

SEQ ID NO: 258416 - RNA, 64 nt, Human
cgauucucauucucuggcaacacccuugucuccagcucagcagacccugaaggacacuuugaga

SEQ ID NO: 258417 - RNA, 64 nt, Human
cucccgcgccccaccggcuccgacgcgcaaccccgcucagcagucacagaagcagggcccagcc

SEQ ID NO: 258418 - RNA, 64 nt, Human
gaaaaauaauauuugccaauaugacguguauauugcucagcacacucuguaucuccuguccuua

SEQ ID NO: 258419 - RNA, 64 nt, Human
aaggccacuaaaagaggagaugguggagacggaggcucagcaguggucuugagggguaaaggac

SEQ ID NO: 258420 - RNA, 64 nt, Human
uggagcauggcccucccuggcucccugucccugggcucagcacgaccacacaggacacccagcc

SEQ ID NO: 258421 - RNA, 64 nt, Human
uaagcuagccagaguuuucucaagagccagcuuugcucagcacacucuccugggccccaaggag

SEQ ID NO: 258422 - RNA, 64 nt, Human
ccgcugccaugcucucucccuuguuuccuuaagagcucagcaucugucccuguucauuacaugu

SEQ ID NO: 258423 - RNA, 64 nt, Human
ccugcagcugaaauggacuguucuuuacugaccugcucagcaguuucuucucucauauauuccc

SEQ ID NO: 258424 - RNA, 64 nt, Human
ucgaaagauccgguguuuguggcuccugcacccugcucagcagcucugucccgggacagucagg

SEQ ID NO: 258425 - RNA, 64 nt, Human
cuagaugcucugagggccauucacaauucucagggcucagcagugaugggagaacagaggacag

SEQ ID NO: 258426 - RNA, 64 nt, Human
uuaagucaccacgucuagaagucacaugaacucugcucagcaauaaucuguucucagaacagac

SEQ ID NO: 258427 - RNA, 64 nt, Human
cacugccccucagcaaggaugacucagcacugccgcucaacagacaugacucagggauggcuua

SEQ ID NO: 258428 - RNA, 64 nt, Human
cacugccccucaccaaggaugacucagcacugccgcucaacagacaugacucagggauggcuua

SEQ ID NO: 258429 - RNA, 56 nt, Human
ugagccagcacgcacagugagggaucgcucaacaggacaccucuccgcagaaggcu

SEQ ID NO: 258430 - RNA, 64 nt, Human
gggaucacagaauuucugccccuccagcugccuggcucagcaggcgugggugccaccacccucu

SEQ ID NO: 258431 - RNA, 64 nt, Human
ccgcaucgacaucaccgccaagcucugcgauguggcucagcagcgcaacugcgaggacaugauc

SEQ ID NO: 258432 - RNA, 64 nt, Human
auuccauuuacauaaggauacacuuauuugucaagcucagcacaaucuguaaauuuuuaaccua

SEQ ID NO: 258433 - RNA, 64 nt, Human
uaggccaagauugaaaaauguggaucggaguagugcucagcauuuggaaguuacuguuggagau

SEQ ID NO: 258434 - RNA, 64 nt, Human
uauagccaugggcacuuggcccccugcuuuuccugcucagcagagccccucccuucagagauua

SEQ ID NO: 258435 - RNA, 64 nt, Human
auaauaaugaaaucaguugccucaaugguagagagcucagcaucacuggagguggucacacaga

SEQ ID NO: 258436 - RNA, 64 nt, Human
guuuuacucugcuacaggguggauuccaaaacuggcucagcacauugcauguaguugagccaca

SEQ ID NO: 258437 - RNA, 64 nt, Human
ugagacgcaccaugugggcacggagggggacggggcucagcaaugccauuucaguggcuuccca

SEQ ID NO: 258438 - RNA, 64 nt, Human
ugucacaugucagagaguaucauuaaaagaagacgcucagcacuguuucagcccgaagcugcuu

SEQ ID NO: 258439 - RNA, 64 nt, Human
guuuuuuuguuuguuuuuuuuucuuuuguacugagcucagcauagacuaauacuaccuuaaugu

SEQ ID NO: 258440 - RNA, 64 nt, Human
agguagugggcaucucucuccuaaugacgaagcugcucagcaacuccaccugcccgccgcagga

SEQ ID NO: 258441 - RNA, 64 nt, Human
ucugcuucuugggagcauggugagcagcccuggugcucagcagccauaccuaugggacacacac

SEQ ID NO: 258442 - RNA, 64 nt, Human
uuauaauacucuguuguacuauggaaaaucagcugcucagcaaccuuucaccuuuguguauuuu

SEQ ID NO: 258443 - RNA, 64 nt, Human
gaaaagagaugaacuuggaagcaagagauacgcagcucagcaugacagagacuccauuccaggu

SEQ ID NO: 258444 - RNA, 64 nt, Human
uguuuggacuauguuuucuuuucuucucccacuugcucagcagcuugggcuuccauucuaguuc

SEQ ID NO: 258445 - RNA, 64 nt, Human
agaagccagcccugcuauuuccagccuccugaaggcucagcacggugaggccugacauccuggg

SEQ ID NO: 258446 - RNA, 64 nt, Human
uacaaaaguuuugcagcauugccuaaauuauagugcucaacacaagaacuguuuuuggggccag

SEQ ID NO: 258447 - RNA, 64 nt, Human
ugaucacccucucggccuccucccacaagcaccugcucaacauaggccugcucagccucuagca

SEQ ID NO: 258448 - RNA, 64 nt, Human
ccggcccuccccggcuaugacgcccccggcccgugcucaacaccgccugggccacagcuaggcc

SEQ ID NO: 258449 - RNA, 64 nt, Human
accgccagccaggaucccccaaagugugcagagggcucagcagagaacaguaugggacccccuc

SEQ ID NO: 258450 - RNA, 64 nt, Human
uuuggcauuuccuuuccuuuccuuuauaaaacaugcucagcaaacugcaccaguuaacuacagu

SEQ ID NO: 258451 - RNA, 55 nt, Human
uucaucuagguaugaguuaaggauggcucagcacuugcucaucuuggauggcuuc

SEQ ID NO: 258452 - RNA, 64 nt, Human
agacauagguuauaaacuaguuaucuuuuaaaaggcucagcaacacaacucuugaaaugcuuau

SEQ ID NO: 258453 - RNA, 64 nt, Human
ucuugagccagcugugcuuugcccguggccagaagcucagcagcggcuccugggaaaggccugg

SEQ ID NO: 258454 - RNA, 64 nt, Human
uuaggcuagcuguuaaauaugugacccagcauuagcucagcaucugucagagcaagagaccagg

SEQ ID NO: 258455 - RNA, 64 nt, Human
caucuccauuuucugaccucuggacuaacugguugcucagcaagguucugaaggagaguuucuu

SEQ ID NO: 258456 - RNA, 64 nt, Human
uguagagagccaaaauguguggcccuguccccaagcucagcaccaccggccaugaccagagguu

SEQ ID NO: 258457 - RNA, 64 nt, Human
guaacagguggucugguggauagcggggagcauggcucagcaccagagcagaggcccagccagc

SEQ ID NO: 258458 - RNA, 64 nt, Human
gcuuuucuauuaaguacaugacuucacaaggaccgcucagcauggcucacuggagaguuccaug

SEQ ID NO: 258459 - RNA, 64 nt, Human
ugcaagacaguggcauuucuccucuccucuugcugcucagcacagcccuggauugcagccccga

SEQ ID NO: 258460 - RNA, 64 nt, Human
gcggggcucccuucugugcagacuuuuggacccagcucagcaccagcacccgggcguccugagc

SEQ ID NO: 258461 - RNA, 64 nt, Human
ucugucccaaguccugcuccuuucugcccagccugcucagcagguugaauggguucucaguggu

SEQ ID NO: 258462 - RNA, 64 nt, Human
caagaauguauuaguuuguggugacacuggguuagcucagcauggauuucccuuauccgaugau

SEQ ID NO: 258463 - RNA, 64 nt, Human
uuccagaguugaucauuuccucucaugguacucugcucagcauggccacguagguuuuuuguuu

SEQ ID NO: 258464 - RNA, 64 nt, Human
ggggguuuguacuucucugcgaauggguugcagugcucagcauugcgggucucuguagaagucc

SEQ ID NO: 258465 - RNA, 60 nt, Human
uucuguauggacaaaggugggguaccuacaggagagcaaagguuaauuuugugcuuuuag

SEQ ID NO: 258466 - RNA, 60 nt, Human
ccagcgaggucagccgagaugacgcugccgggagagcagucuucucuguaguccccggag

SEQ ID NO: 258467 - RNA, 60 nt, Human
ggcuuaguugaagaggaaaggguugugcaaggagagcaggaggcuguuuccaaaaaccag

SEQ ID NO: 258468 - RNA, 64 nt, Human
uucuccuuuccccgacgcacagaauaaacaugaagcucagcaguagaagcguaaugauuucccu

SEQ ID NO: 258469 - RNA, 64 nt, Human
uggugguucgacuucucccucugucugggggcaggcucagcaucugcccacuggucucacuaag

SEQ ID NO: 258470 - RNA, 64 nt, Human
agaagaaagcuggaaggauguguacuaaagucuagcucagcaguccccaaccuuuuuggcauca

SEQ ID NO: 258471 - RNA, 64 nt, Human
agcauucuauaugcaaccagaguagaggggaccugcucagcaggugugaccaggguucucugaa

SEQ ID NO: 258472 - RNA, 64 nt, Human
ugucuaugauuguucaaaaauauguuaaauuuaggcucagcacaguagcucacaccugaaaucu

SEQ ID NO: 258473 - RNA, 64 nt, Human
ugucaucguagagguagaaagcaaacaaucuggggcucagcacaccugggggugcucccacuca

SEQ ID NO: 258474 - RNA, 64 nt, Human
cugccugagcccagccuaccaggcuugccccucagcucagcacuguugaccacgcugcguauga

SEQ ID NO: 258475 - RNA, 64 nt, Human
gucagugccugcagucaagugccucccagccucggcucagcacaucccuugccacaaaucagug

SEQ ID NO: 258476 - RNA, 64 nt, Human
ucaguuucucaguugcgcuaaucacauuucaagugcucagcagccacccgugucuacuacuaca

SEQ ID NO: 258477 - RNA, 64 nt, Human
ggaaaaguaguuugacccucacaguucacauucagcucagcagagcaagaccccagagaugcuu

SEQ ID NO: 258478 - RNA, 64 nt, Human
ugaaagcauuucugaagccccuuucuaagacaaggcucagcaucuugauauuuuugacagauuc

SEQ ID NO: 258479 - RNA, 64 nt, Human
ucaucuccagccucaguaguuggggguagaaggagcucagcaccucuuccagcccuuaaagcug

SEQ ID NO: 258480 - RNA, 64 nt, Human
agagaugacucagcacugccccucagcagggauggcucagcagggaugacucagcauugccccu

SEQ ID NO: 258481 - RNA, 64 nt, Human
cgguagcugggaagcuuuauguguguguaugucagcucagcaucuuuuaaucgugucugauuuu

SEQ ID NO: 258482 - RNA, 64 nt, Human
gaaauggagagguauagagagagcagguuccauagcucagcacuuuuaaguggaagaucauuug

SEQ ID NO: 258483 - RNA, 64 nt, Human
cuuuaaaaagucucaauucaagcuggauuagccagcucagcauaaucaacuagacagugguuug

SEQ ID NO: 258484 - RNA, 64 nt, Human
uggguugacuuaugcucacaaauauguuucguuugcucaacaugguuuacuacuaacauuuuaa

SEQ ID NO: 258485 - RNA, 64 nt, Human
aauuagagcuugcuacguguuuauggaacugaaagcucaacaggggagcaauaaaccgagaaau

SEQ ID NO: 258486 - RNA, 64 nt, Human
gaaaacauuuaaaauaaauaguuuuuaauuguaggcucaacaucuguuaccccauagcuuuuuc

SEQ ID NO: 258487 - RNA, 64 nt, Human
ccagccagggccccgagcgcagaggcggagcugugcucagcacaggccugggaccucccccggc

SEQ ID NO: 258488 - RNA, 64 nt, Human
ggaaaagugucgggcaaagggggaucuggggggagcucagcagugacuggggagcuggucugcc

SEQ ID NO: 258489 - RNA, 64 nt, Human
uuuuuuuuuugucagcuccaugacaacaugaccagcucagcaaaggcugagacugcccaugacc

SEQ ID NO: 258490 - RNA, 64 nt, Human
ggaaucuguuucucugcugucaacuucccaucuggcucagcauagggucacuuugccauuaugc

SEQ ID NO: 258491 - RNA, 64 nt, Human
uuuuuccuuuaucacauaacuguaauauuugguugcucagcauaagugauggaagcaaacacua

SEQ ID NO: 258492 - RNA, 64 nt, Human
uguaucaaaugacaaaucuuuauugaaugguuuugcucagcaccaccuuuuaauauauuggcag

SEQ ID NO: 258493 - RNA, 64 nt, Human
gcagccagaccuauuccuccugggccccucaucugcucagcagcuauuugaaugagaugauuca

SEQ ID NO: 258494 - RNA, 64 nt, Human
ccugccgagucagcuggcugagauuggggcagcggcucagcagucccugggggaagccauugac

SEQ ID NO: 258495 - RNA, 64 nt, Human
cauuauguccaggugcacauaggugguauugaaugcucagcaggguaggggcugaccacugucc

SEQ ID NO: 258496 - RNA, 64 nt, Human
uaggcuaggucuuagggcaacuccuugcccuccugcucagcaccuccauuuccccauccuuggu

SEQ ID NO: 258497 - RNA, 64 nt, Human
gccagaucugcaccaccuucgagcacuauguggagcucagcaacaaggcugcacagcucaacgg

SEQ ID NO: 258498 - RNA, 64 nt, Human
cugcagcaaucucugaggguaaagccggugggaggcucagcaggccaggaggcccaaggacagg

SEQ ID NO: 258499 - RNA, 64 nt, Human
uaauuuuuuugugccaaaaacuguggacaugcuggcucagcauccucaggaccaaguuguugcu

SEQ ID NO: 258500 - RNA, 64 nt, Human
caccccucacaccuggcuucuagaauagaggauugcucagcaugaguccaauucagagaacggu

SEQ ID NO: 258501 - RNA, 64 nt, Human
aggaccucucuggacuaauuucucuuccuagacagcucagcacagcuauugauauguuagaggc

SEQ ID NO: 258502 - RNA, 64 nt, Human
ggcgugggcuuugcuggcccagugugugcuccuggcucagcagaaacauccauuugaguuggca

SEQ ID NO: 258503 - RNA, 64 nt, Human
ggcuguggggugggcuggaguccucuccagagaggcucaacaaggaaaaaugccacucccuacc

SEQ ID NO: 258504 - RNA, 64 nt, Human
cuugcaggccacccauuccaacugaguguagucggcucaacacccuccaccuuccccuccaugc

SEQ ID NO: 258505 - RNA, 64 nt, Human
uccuggcaucgaguggguggagaccagagaagccgcucaacauccugcaaugcaugggacaggc

SEQ ID NO: 258506 - RNA, 64 nt, Human
uuugaauuuagcuuuuacuaauucgcaucuggaagcucagcaagugcacaagccuuacuuuggu

SEQ ID NO: 258507 - RNA, 64 nt, Human
gcaucuguccauccucccuauggcccuggccagagcucagcaugggcagggguucuggguagga

SEQ ID NO: 258508 - RNA, 64 nt, Human
agcuggccuagggaggccugggguaaccuggggggcucagcaauggugcugcacggcgaggugg

SEQ ID NO: 258509 - RNA, 64 nt, Human
gauccaagaucuuaaauguuauauugauaaccaugcucagcaaugagcuauuagauucauuuug

SEQ ID NO: 258510 - RNA, 64 nt, Human
gcugcaggccaagcugggugugguauuuagggcagcucagcagggggaacuuguccccaugguc

SEQ ID NO: 258511 - RNA, 64 nt, Human
aucaguguccagcgugcugguuccccagagcacagcucagcaucacacugacacucacccugcc

SEQ ID NO: 258512 - RNA, 64 nt, Human
ggcucagccguucccagggaucugccagcccccggcucagcagugggaccagggccucgcagca

SEQ ID NO: 258513 - RNA, 64 nt, Human
caaaagucacccagggacacuccaacucuacacagcucagcagacauccacacacaguaauggg

SEQ ID NO: 258514 - RNA, 64 nt, Human
ggauugugaccugauauuuggagauguaaauauugcucagcauauuaaucccgauggaauauag

SEQ ID NO: 258515 - RNA, 64 nt, Human
uacugucuuucuguggaguuugguuugaagacuggcucagcaaguggagguuucaauguauuuu

SEQ ID NO: 258516 - RNA, 64 nt, Human
cuuuaauuauuucaagagucaagaccaaaaguuugcucagcaucacacuacaucucaaaauuaa

SEQ ID NO: 258517 - RNA, 64 nt, Human
ccaugcagagauccugaggcuuuucccccaggcugcucagcaggaaagguagacacagguguuu

SEQ ID NO: 258518 - RNA, 64 nt, Human
gauccucagccaaaggaaccugugcaagacacuggcucagcaguuccccaggccacaguaucag

SEQ ID NO: 258519 - RNA, 64 nt, Human
acacgggggaagcuugcggagcccaggugaacaagcucagcaaucggacaucucuggggaaagg

SEQ ID NO: 258520 - RNA, 64 nt, Human
caccuggcagugagggacagagcuaguggggugggcucagcagaagugggugcauuucugcaaa

SEQ ID NO: 258521 - RNA, 64 nt, Human
gugcagaccuccccugccucccauggugaugggggcucagcagcgacaucucuacucccgccuc

SEQ ID NO: 258522 - RNA, 64 nt, Human
ucugucugugaccuucuccugccccauuucacuugcucaacaccagacuuuaaucugacuguag

SEQ ID NO: 258523 - RNA, 64 nt, Human
augaguugcucucaguuccuucuguuuggauuuugcucaacaucuccaguuucucugcucugaa

SEQ ID NO: 258524 - RNA, 64 nt, Human
aauucaguucagucaaacuagccauauuucaagugcucaacagccacugguggcuauugguuac

SEQ ID NO: 258525 - RNA, 64 nt, Human
cugagagcaaaggucaaggacccccucugugaaggcucagcagaggugggaucccacgcccccu

SEQ ID NO: 258526 - RNA, 64 nt, Human
uuguaacccaugugccagauguguggaauuuuuagcucagcauugagagaauaaaaugucacua

SEQ ID NO: 258527 - RNA, 64 nt, Human
ugaauugaugaggacuguccccaugcccacggaugcucagcagcccgccgcacuggggcagaug

SEQ ID NO: 258528 - RNA, 64 nt, Human
agguguuaaaggcccaggugugcugugccaaagagcucagcagaggcucacguggcccaggcug

SEQ ID NO: 258529 - RNA, 64 nt, Human
gugacaucagguuuuucccggacuuagaaaaccagcucagcacugccugcucccauccugugug

SEQ ID NO: 258530 - RNA, 64 nt, Human
uccaggguaggaagcagcagcucugcuggacugggcucagcagucccauuugggauguaagccu

SEQ ID NO: 258531 - RNA, 64 nt, Human
acucggggcggccaguaccaccgccugaggcggggcucagcagcguugcauguacgggccucgu

SEQ ID NO: 258532 - RNA, 64 nt, Human
ccaacuugacccucaccagcauuaucaggagcgcgcucagcaaguugguaguuuccuccccccu

SEQ ID NO: 258533 - RNA, 64 nt, Human
gcauuuuagcugaggcuuuggaguacgaauaggagcucagcaggcagacgaaugaggaauaaag

SEQ ID NO: 258534 - RNA, 64 nt, Human
ggagccucucccugcuacaggggguggggguccugcucagcaggguagguggugguuuuagguc

SEQ ID NO: 258535 - RNA, 64 nt, Human
uugaggacaguuugaaguuaguguuucagccauagcucagcauaccccaguggucgugggacug

SEQ ID NO: 258536 - RNA, 64 nt, Human
gcaaagauuguccccucugcuguucucuggggccgcucagcacagaagaaggaugagggggcuc

SEQ ID NO: 258537 - RNA, 64 nt, Human
uaggauuacaggcgugagccaccacaccuggccagcucagcauauucuuaaguaggauucacau

SEQ ID NO: 258538 - RNA, 64 nt, Human
cucccagcugccaggaauuucugcgccuguccaggcucagcaagggguccaaagacauuguucu

SEQ ID NO: 258539 - RNA, 64 nt, Human
aguuaauagaagaaugaaauaaugcauguaaauugcucagcagcgugccuagcauaaaguaauu

SEQ ID NO: 258540 - RNA, 64 nt, Human
auggggaaguuccagcugagcagagcccuccacagcucagcaaagccucuguagccagacugcc

SEQ ID NO: 258541 - RNA, 64 nt, Human
agcaaauuucaaaagacauguuguaaauuaggaggcucaacaauaaaacauuaugcuccagaaa

SEQ ID NO: 258542 - RNA, 60 nt, Human
gcauccaugugggcaacccuuuuuugugcgggagagcagguguugcucuucaguauguag

SEQ ID NO: 258543 - RNA, 60 nt, Human
cuguccuggugucacuuacuguuucugucaggagagcagcggggcgaagcccaggccccu

SEQ ID NO: 258544 - RNA, 64 nt, Human
auaguuucuuuaaauugguuaaugugugagaugugcucagcacagugccugguccauaguaagu

SEQ ID NO: 258545 - RNA, 64 nt, Human
uccuggccuggaguggguggaggccagagacacugcucagcagcacccugcagugcccaggacg

SEQ ID NO: 258546 - RNA, 64 nt, Human
ugacgucaggacccgagccuccagccugagccuagcucagcagcccaaggacgauggugagggg

SEQ ID NO: 258547 - RNA, 64 nt, Human
cgucccgccacccaccaccccucacaggacguccgcucagcacacgccuuguuacgagcaagug

SEQ ID NO: 258548 - RNA, 64 nt, Human
cuugcuuuucgaccacuuggagacgggggagcuggcucagcaccucaccuaccuggaguuccgg

SEQ ID NO: 258549 - RNA, 64 nt, Human
cgccgcucuucuugaaucaugcugggcugccccugcucagcaccccgccuggugugggccuggu

SEQ ID NO: 258550 - RNA, 64 nt, Human
caaugcaugggacaggcccugccuagaaacaccagcucagcauggcagcagugcggaggccagg

SEQ ID NO: 258551 - RNA, 64 nt, Human
uggcucugagcaggacagagagcaugcagcaggugcucagcaauauggaaaugggaccaaacag

SEQ ID NO: 258552 - RNA, 64 nt, Human
ggcuuucuagugucucauauucuguuggcaagaagcucagcacugcauuccugaccgaggucag

SEQ ID NO: 258553 - RNA, 64 nt, Human
cauuccuggagguccuacaggugaaacugcaggagcucagcauagacccagcucucugggggau

SEQ ID NO: 258554 - RNA, 64 nt, Human
ugagaauuugggagagaacagugcaucaggccaggcucagcaauauguuugcucacauucuuuc

SEQ ID NO: 258555 - RNA, 64 nt, Human
cucugagccccggacucugcuuacccugauggcugcucagcaccacagagugcuugggcugagg

SEQ ID NO: 258556 - RNA, 64 nt, Human
gccaucagccagacaugucuagggugagaccagugcucagcaccacccgccaaggaacacugau

SEQ ID NO: 258557 - RNA, 64 nt, Human
cuuuaggucaacacuugcaagagccccuuccaaagcucagcacaguuuccuccugggaugagga

SEQ ID NO: 258558 - RNA, 64 nt, Human
ugugguuccuaagccuguugcugaagucauugucgcucagcaauagggugcaguuuuccaggaa

SEQ ID NO: 258559 - RNA, 64 nt, Human
ggucuccgccaugcacgcguggacucucggaugagcucagcagaaccgcacagccagagcccca

SEQ ID NO: 258560 - RNA, 64 nt, Human
ccuuggaccucccagcccacccagccucagcacagcucaacacagaaggagcagccccagccac

SEQ ID NO: 258561 - RNA, 64 nt, Human
aaaaauuggguggaggggauaacuuucauaucuggcucaacaucucaggaaaaucugugauuau

SEQ ID NO: 258562 - RNA, 64 nt, Human
cuccaaggaucagaaguauggaauuuucugccaggcucaacaagggucucauaucuaacuuccu

SEQ ID NO: 258563 - RNA, 64 nt, Human
ucauccucuuauaugugccccuuccccaugcucagcucagcauuguguacaaaauauccaagcc

SEQ ID NO: 258564 - RNA, 64 nt, Human
ggcugaccugagagguuccuggcgcccugagguggcucagcaccugcccaggguaggccuggca

SEQ ID NO: 258565 - RNA, 64 nt, Human
gcacucuauucccccagccucuuucugcuuucaugcucagcacaucaucuuccuaggcagucuc

SEQ ID NO: 258566 - RNA, 64 nt, Human
agacagacagagaaggcagcaggcggccuuuguugcucagcaaggggcucugcccucccuccuu

SEQ ID NO: 258567 - RNA, 64 nt, Human
agacagacagagaaggcugcaggaguccuuuguugcucagcagggcgcucugcccucccuccuu

SEQ ID NO: 258568 - RNA, 64 nt, Human; identical to SEQ ID NO: 258567

SEQ ID NO: 258569 - RNA, 64 nt, Human
gagaagacagagaaggcugcaggaggccuuuguugcucagcaggggacucugcccucccuccuu

SEQ ID NO: 258570 - RNA, 64 nt, Human
agacagacacagaagguggcaggaggccuuuguugcucagcaggaggcucugcccuugcuccuu

SEQ ID NO: 258571 - RNA, 64 nt, Human
ccuucagccuagccugucccccaaggauggugaagcucagcaggggucugaggguagccggcca

SEQ ID NO: 258572 - RNA, 64 nt, Human
ggcccaugcccuccguccuggcagggcaggcagagcucagcacagccucaccccugcaggcggu

SEQ ID NO: 258573 - RNA, 64 nt, Human
acagcaccagcucugacaaguccuaucauccucugcucagcagugaccucccuggccccacuuu

SEQ ID NO: 258574 - RNA, 64 nt, Human
acggccgggucccgucccccgggagcaucgcucggcucagcaccuuggcucccagugggggccc

SEQ ID NO: 258575 - RNA, 64 nt, Human
auuaaaacuucagauuguucaacaugagagaaaggcucagcaacgugaaauaacgcaaauggcu

SEQ ID NO: 258576 - RNA, 64 nt, Human
agaguccaggaaggggcggggagaagccuggguggcucagcauccuccacgggcugcgccgucu

SEQ ID NO: 258577 - RNA, 64 nt, Human
cuggaagagggcuugcuuagggcagcuucuugcugcucagcagaccaugaccuguagguucacc

SEQ ID NO: 258578 - RNA, 64 nt, Human
ccuuggaccucccagcccacccagccucagcacagcucagcacagaaggagcagccccagccac

SEQ ID NO: 258579 - RNA, 64 nt, Human
guggugcuggcccaccucugaaagcagaacacuugcucaacaaccuugcuguuggcccaagucu

SEQ ID NO: 258580 - RNA, 64 nt, Human
cuagccaaggcugugagggccagaauaaacaacugcucaacaaaggguguuucugugaugagag

SEQ ID NO: 258581 - RNA, 64 nt, Human
ggauccccaccgauggggaccugugcuggccugugcucaacacgggccccuccccacagaaagc

SEQ ID NO: 258582 - RNA, 64 nt, Human
uggccucgcacaggcgcgcacacaccgccaagcagcucagcauucucccccggcacacuuagug

SEQ ID NO: 258583 - RNA, 64 nt, Human
ucugugcaccuucccugcuggccugcacacagcugcucagcaccacuuucauucuggaccuggg

SEQ ID NO: 258584 - RNA, 64 nt, Human
cccuggcugugcugcaagcugacuccagccuugggcucagcagcacccggugaacagcagcagg

SEQ ID NO: 258585 - RNA, 64 nt, Human
ccacccccuccccagggagcccaaggcaggggaggcucagcauggaaugaaacaggggagugag

SEQ ID NO: 258586 - RNA, 64 nt, Human
ccccagcugugccaucccaaauacuugggcagcagcucagcaugggcagacaugggggcugugg

SEQ ID NO: 258587 - RNA, 64 nt, Human
cucggguugggcuuggcccucucugccugagagagcucagcacacacacagcucagacccacgg

SEQ ID NO: 258588 - RNA, 64 nt, Human
uuagcgaucacaggccuucagaaguacaacaucagcucagcaggaacgccggcuccccgaggac

SEQ ID NO: 258589 - RNA, 64 nt, Human
cagucaggaccugacccgucucugucugaggccggcucagcagugcagccuggucccugggggc

SEQ ID NO: 258590 - RNA, 64 nt, Human
gggcccugcugacccccagcggacacaagagcgugcucagcagccagguguguguacauacggg

SEQ ID NO: 258591 - RNA, 64 nt, Human
ucaugguaacacuggguauuucagcugaucagaagcucagcauggccauuaugccuaguuuuga

SEQ ID NO: 258592 - RNA, 64 nt, Human
agccacgcagccccuggucuggaaugcaguucaggcucagcaaacugucagggugcuggccccu

SEQ ID NO: 258593 - RNA, 64 nt, Human
ccuaccugccugaguccuggagacagaaugaagcgcucagcaucccgggaauacuucucuugcu

SEQ ID NO: 258594 - RNA, 64 nt, Human
gagcgcaacauuucuccacugcacugugcuagcagcucagcagggccucuaaccugugauguca

SEQ ID NO: 258595 - RNA, 64 nt, Human
cccuuccuccacugcugccuaaugcaaggcaguggcucagcagcaagaaugcugguucuacauc

SEQ ID NO: 258596 - RNA, 64 nt, Human
uuauugcuuuugcccaugcauucaauauugaucagcucagcacuuccaugggccauagccggua

SEQ ID NO: 258597 - RNA, 64 nt, Human
gcccuuucccagcucuuccccuucaucccacccugcucagcauuuacauuuuugccaccagcac

SEQ ID NO: 258598 - RNA, 64 nt, Human
uugccguuugaaguaaaaaauuuccaaaauguaugcucaacaauaaucauuaaaauguuugcag

SEQ ID NO: 258599 - RNA, 64 nt, Human; identical to SEQ ID NO: 258427

SEQ ID NO: 258600 - RNA, 64 nt, Human
uuggcuagcucuuugagcuagagagcuguaggaagcucaacauuucuuuguagagaacguugcu

SEQ ID NO: 258601 - RNA, 64 nt, Human
cccauuucaacaaaauugaacacaggacucuucugcucagcagcaucucuuuucucagaugugg

SEQ ID NO: 258602 - RNA, 64 nt, Human
ggccaagcuuaagccaugaagucauggauuuguggcucagcaccagguccugaggggagcguau

SEQ ID NO: 258603 - RNA, 64 nt, Human
gcccuauuucccuuccuaucccucugcccuacccgcucagcaacauagaagagggaaggaaaga

SEQ ID NO: 258604 - RNA, 64 nt, Human
ugguguuugaaggguaauagucacaggagcugcagcucagcagagagacccugaacucugcuaa

SEQ ID NO: 258605 - RNA, 64 nt, Human
gugcugccccaugaagccacagcccaggccuccagcucagcagugacuguggccauggucccca

SEQ ID NO: 258606 - RNA, 64 nt, Human
gaagaugugauuucaagaaaugaaauucagggccgcucagcagaggaggcuuacaaacagcaaa

SEQ ID NO: 258607 - RNA, 64 nt, Human
auuuguauauauaccugcgcuuguuuuaaagugggcucagcacauaggguucccacgaagcucc

SEQ ID NO: 258608 - RNA, 64 nt, Human
ucccuauuuccccuccuaucccucugccccuacugcucagcaauguaaaagagacaaauaagga

SEQ ID NO: 258609 - RNA, 64 nt, Human; identical to SEQ ID NO: 257818

SEQ ID NO: 258610 - RNA, 64 nt, Human; identical to SEQ ID NO: 257819

SEQ ID NO: 258611 - RNA, 64 nt, Human; identical to SEQ ID NO: 257820

SEQ ID NO: 258612 - RNA, 64 nt, Human; identical to SEQ ID NO: 257821

SEQ ID NO: 258613 - RNA, 64 nt, Human; identical to SEQ ID NO: 257822

SEQ ID NO: 258614 - RNA, 64 nt, Human; identical to SEQ ID NO: 257823

SEQ ID NO: 258615 - RNA, 64 nt, Human; identical to SEQ ID NO: 257824

SEQ ID NO: 258616 - RNA, 64 nt, Human; identical to SEQ ID NO: 257825

SEQ ID NO: 258617 - RNA, 64 nt, Human
uccaccuuguccuugugcaggaagggcugacggagcucaacagcacagccaucaagccacaggu

SEQ ID NO: 258618 - RNA, 60 nt, Human
uuuaugucucucugaccuaugggcuacuugggagagcacuggacuccauucaugcaugag

SEQ ID NO: 258619 - RNA, 60 nt, Human
gccgaguuccggguguaagggggccauuagggagagcagagcgaggcagcugaucuuccg

SEQ ID NO: 258620 - RNA, 64 nt, Human; identical to SEQ ID NO: 257826

SEQ ID NO: 258621 - RNA, 64 nt, Human; identical to SEQ ID NO: 257827

SEQ ID NO: 258622 - RNA, 64 nt, Human; identical to SEQ ID NO: 257828

SEQ ID NO: 258623 - RNA, 64 nt, Human; identical to SEQ ID NO: 257829

SEQ ID NO: 258624 - RNA, 64 nt, Human; identical to SEQ ID NO: 257830

SEQ ID NO: 258625 - RNA, 64 nt, Human; identical to SEQ ID NO: 257831

SEQ ID NO: 258626 - RNA, 64 nt, Human; identical to SEQ ID NO: 257832

SEQ ID NO: 258627 - RNA, 64 nt, Human; identical to SEQ ID NO: 257836

SEQ ID NO: 258628 - RNA, 64 nt, Human; identical to SEQ ID NO: 257837

SEQ ID NO: 258629 - RNA, 64 nt, Human; identical to SEQ ID NO: 257838

SEQ ID NO: 258630 - RNA, 64 nt, Human; identical to SEQ ID NO: 257839

SEQ ID NO: 258631 - RNA, 64 nt, Human; identical to SEQ ID NO: 257840

SEQ ID NO: 258632 - RNA, 64 nt, Human; identical to SEQ ID NO: 257841

SEQ ID NO: 258633 - RNA, 64 nt, Human; identical to SEQ ID NO: 257842

SEQ ID NO: 258634 - RNA, 64 nt, Human; identical to SEQ ID NO: 257843

SEQ ID NO: 258635 - RNA, 64 nt, Human; identical to SEQ ID NO: 257844

SEQ ID NO: 258636 - RNA, 64 nt, Human
auccaaacuaauccaucaccggggugguuuaguggcucaacauuguguucccauuucagcugau

SEQ ID NO: 258637 - RNA, 64 nt, Human
gccucugccuuaucucauuucucaacaguucauugcucaacaagaacgauucaccuggguuugc

SEQ ID NO: 258638 - RNA, 64 nt, Human
aggucuaccuggacacucauccacuguuggagaugcucaacagcuagacacagaugcucacagc

SEQ ID NO: 258639 - RNA, 64 nt, Human; identical to SEQ ID NO: 257845

SEQ ID NO: 258640 - RNA, 64 nt, Human; identical to SEQ ID NO: 257846

SEQ ID NO: 258641 - RNA, 64 nt, Human; identical to SEQ ID NO: 257847

SEQ ID NO: 258642 - RNA, 64 nt, Human; identical to SEQ ID NO: 257848

SEQ ID NO: 258643 - RNA, 64 nt, Human; identical to SEQ ID NO: 257849

SEQ ID NO: 258644 - RNA, 64 nt, Human; identical to SEQ ID NO: 257850

SEQ ID NO: 258645 - RNA, 64 nt, Human; identical to SEQ ID NO: 257854

SEQ ID NO: 258646 - RNA, 64 nt, Human; identical to SEQ ID NO: 257855

SEQ ID NO: 258647 - RNA, 64 nt, Human; identical to SEQ ID NO: 257856

SEQ ID NO: 258648 - RNA, 64 nt, Human; identical to SEQ ID NO: 257857

SEQ ID NO: 258649 - RNA, 64 nt, Human; identical to SEQ ID NO: 257858

SEQ ID NO: 258650 - RNA, 64 nt, Human; identical to SEQ ID NO: 257859

SEQ ID NO: 258651 - RNA, 64 nt, Human; identical to SEQ ID NO: 257860

SEQ ID NO: 258652 - RNA, 64 nt, Human; identical to SEQ ID NO: 257861

SEQ ID NO: 258653 - RNA, 61 nt, Human; identical to SEQ ID NO: 257862

SEQ ID NO: 258654 - RNA, 64 nt, Human; identical to SEQ ID NO: 257863

SEQ ID NO: 258655 - RNA, 64 nt, Human
uaaugcuguacaggggcucuugggguucggcucagcucaacauggcuugacauggugggcacac

SEQ ID NO: 258656 - RNA, 64 nt, Human
cugggaaagacugacugagacacucccccuguuagcucaacagaucugcauuuggcugcuucuc

SEQ ID NO: 258657 - RNA, 64 nt, Human
uucgccaccaccuucucuugugauuuacuguacugcucaacacagagggugugauugacacagc

SEQ ID NO: 258658 - RNA, 64 nt, Human; identical to SEQ ID NO: 257864

SEQ ID NO: 258659 - RNA, 64 nt, Human; identical to SEQ ID NO: 257865

SEQ ID NO: 258660 - RNA, 64 nt, Human; identical to SEQ ID NO: 257866

SEQ ID NO: 258661 - RNA, 64 nt, Human; identical to SEQ ID NO: 257867

SEQ ID NO: 258662 - RNA, 64 nt, Human; identical to SEQ ID NO: 257868

SEQ ID NO: 258663 - RNA, 64 nt, Human; identical to SEQ ID NO: 257872

SEQ ID NO: 258664 - RNA, 64 nt, Human; identical to SEQ ID NO: 257873

SEQ ID NO: 258665 - RNA, 64 nt, Human; identical to SEQ ID NO: 257874

SEQ ID NO: 258666 - RNA, 64 nt, Human; identical to SEQ ID NO: 257875

SEQ ID NO: 258667 - RNA, 64 nt, Human; identical to SEQ ID NO: 257876

SEQ ID NO: 258668 - RNA, 64 nt, Human; identical to SEQ ID NO: 257877

SEQ ID NO: 258669 - RNA, 60 nt, Human; identical to SEQ ID NO: 257878

SEQ ID NO: 258670 - RNA, 64 nt, Human; identical to SEQ ID NO: 257879

SEQ ID NO: 258671 - RNA, 64 nt, Human; identical to SEQ ID NO: 257880

SEQ ID NO: 258672 - RNA, 64 nt, Human; identical to SEQ ID NO: 257881

SEQ ID NO: 258673 - RNA, 64 nt, Human; identical to SEQ ID NO: 257882

SEQ ID NO: 258674 - RNA, 64 nt, Human
cuugagcugucucuuuucauguauuaccuuucuugcucaacagcuauuccuguuuucuguaaga

SEQ ID NO: 258675 - RNA, 64 nt, Human
gguauagccaugauuucagucauagcaagcuuuugcucaacagcauaugggugggauuuugcaa

SEQ ID NO: 258676 - RNA, 64 nt, Human
uuaugugcaauguucaauaccucauauaauacuugcucaacaguauagugguaccaauggcauu

SEQ ID NO: 258677 - RNA, 64 nt, Human; identical to SEQ ID NO: 257883

SEQ ID NO: 258678 - RNA, 64 nt, Human; identical to SEQ ID NO: 257884

SEQ ID NO: 258679 - RNA, 64 nt, Human; identical to SEQ ID NO: 257885

SEQ ID NO: 258680 - RNA, 53 nt, Human; identical to SEQ ID NO: 257886

SEQ ID NO: 258681 - RNA, 64 nt, Human; identical to SEQ ID NO: 257890

SEQ ID NO: 258682 - RNA, 64 nt, Human; identical to SEQ ID NO: 257891

SEQ ID NO: 258683 - RNA, 64 nt, Human; identical to SEQ ID NO: 257892

SEQ ID NO: 258684 - RNA, 64 nt, Human; identical to SEQ ID NO: 257893

SEQ ID NO: 258685 - RNA, 64 nt, Human; identical to SEQ ID NO: 257894

SEQ ID NO: 258686 - RNA, 64 nt, Human; identical to SEQ ID NO: 257895

SEQ ID NO: 258687 - RNA, 64 nt, Human; identical to SEQ ID NO: 257896

SEQ ID NO: 258688 - RNA, 64 nt, Human; identical to SEQ ID NO: 257897

SEQ ID NO: 258689 - RNA, 64 nt, Human; identical to SEQ ID NO: 257898

SEQ ID NO: 258690 - RNA, 64 nt, Human; identical to SEQ ID NO: 257899

SEQ ID NO: 258691 - RNA, 64 nt, Human; identical to SEQ ID NO: 257900

SEQ ID NO: 258692 - RNA, 64 nt, Human; identical to SEQ ID NO: 257901

SEQ ID NO: 258693 - RNA, 64 nt, Human
ccuguuuguuuuauaaggggcuuuucccccuuuugcucaacacuucuuccugccaucaugugaa

SEQ ID NO: 258694 - RNA, 64 nt, Human
uuugagacuaguacccaagugcaguuuuaguauggcucaacaugggucagauuuagugauaaag

SEQ ID NO: 258695 - RNA, 64 nt, Human
aaaagucgacugcuaugcucaaaaaguaaaaaaagcucaacaguuaaaaucuaauguuuguuuu

SEQ ID NO: 258696 - RNA, 64 nt, Human; identical to SEQ ID NO: 257902

SEQ ID NO: 258697 - RNA, 64 nt, Human; identical to SEQ ID NO: 257903

SEQ ID NO: 258698 - RNA, 64 nt, Human; identical to SEQ ID NO: 257904

SEQ ID NO: 258699 - RNA, 64 nt, Human; identical to SEQ ID NO: 257908

SEQ ID NO: 258700 - RNA, 64 nt, Human; identical to SEQ ID NO: 257909

SEQ ID NO: 258701 - RNA, 64 nt, Human; identical to SEQ ID NO: 257910

SEQ ID NO: 258702 - RNA, 64 nt, Human; identical to SEQ ID NO: 257911

SEQ ID NO: 258703 - RNA, 64 nt, Human; identical to SEQ ID NO: 257912

SEQ ID NO: 258704 - RNA, 64 nt, Human; identical to SEQ ID NO: 257913

SEQ ID NO: 258705 - RNA, 64 nt, Human; identical to SEQ ID NO: 257914

SEQ ID NO: 258706 - RNA, 64 nt, Human; identical to SEQ ID NO: 257915

SEQ ID NO: 258707 - RNA, 64 nt, Human; identical to SEQ ID NO: 257916

SEQ ID NO: 258708 - RNA, 64 nt, Human; identical to SEQ ID NO: 257917

SEQ ID NO: 258709 - RNA, 64 nt, Human; identical to SEQ ID NO: 257918

SEQ ID NO: 258710 - RNA, 64 nt, Human; identical to SEQ ID NO: 257919

SEQ ID NO: 258711 - RNA, 64 nt, Human; identical to SEQ ID NO: 257920

SEQ ID NO: 258712 - RNA, 64 nt, Human
uuguauauguaugccauuuucucccugcaaagcagcucaacaagagaaaaagcucuaguuauag

SEQ ID NO: 258713 - RNA, 64 nt, Human
ggugcuugugccuuuucugagaagcguugugacugcucaacauccccaucaagguuugagucca

SEQ ID NO: 258714 - RNA, 64 nt, Human
gcaucggagauaucaccuccugcucggugcuguggcucaacaaugccuuccaggugcgugcggg

SEQ ID NO: 258715 - RNA, 64 nt, Human; identical to SEQ ID NO: 257921

SEQ ID NO: 258716 - RNA, 64 nt, Human; identical to SEQ ID NO: 257922

SEQ ID NO: 258717 - RNA, 64 nt, Human; identical to SEQ ID NO: 257926

SEQ ID NO: 258718 - RNA, 64 nt, Human; identical to SEQ ID NO: 257927

SEQ ID NO: 258719 - RNA, 64 nt, Human; identical to SEQ ID NO: 257928

SEQ ID NO: 258720 - RNA, 64 nt, Human; identical to SEQ ID NO: 257929

SEQ ID NO: 258721 - RNA, 64 nt, Human; identical to SEQ ID NO: 257930

SEQ ID NO: 258722 - RNA, 64 nt, Human; identical to SEQ ID NO: 257931

SEQ ID NO: 258723 - RNA, 64 nt, Human; identical to SEQ ID NO: 257932

SEQ ID NO: 258724 - RNA, 64 nt, Human; identical to SEQ ID NO: 257933

SEQ ID NO: 258725 - RNA, 64 nt, Human; identical to SEQ ID NO: 257934

SEQ ID NO: 258726 - RNA, 64 nt, Human; identical to SEQ ID NO: 257935

SEQ ID NO: 258727 - RNA, 64 nt, Human; identical to SEQ ID NO: 257936

SEQ ID NO: 258728 - RNA, 64 nt, Human; identical to SEQ ID NO: 257937

SEQ ID NO: 258729 - RNA, 64 nt, Human; identical to SEQ ID NO: 257938

SEQ ID NO: 258730 - RNA, 64 nt, Human; identical to SEQ ID NO: 257939

SEQ ID NO: 258731 - RNA, 64 nt, Human
acacacacacacacacacacacacacacaccccugcucaacagagguuuaguuuacagucucug

SEQ ID NO: 258732 - RNA, 64 nt, Human
ucucagccaacugcccuugagcaguguacagccugcucaacaaccgcccugggcaggccgcucc

SEQ ID NO: 258733 - RNA, 64 nt, Human
cuggcccauaaugugaacauaaguaaucacuaaugcucaacaauuuauccauucaaucauuuau

SEQ ID NO: 258734 - RNA, 64 nt, Human; identical to SEQ ID NO: 257940

SEQ ID NO: 258735 - RNA, 64 nt, Human; identical to SEQ ID NO: 257944

SEQ ID NO: 258736 - RNA, 64 nt, Human; identical to SEQ ID NO: 257945

SEQ ID NO: 258737 - RNA, 64 nt, Human; identical to SEQ ID NO: 257946

SEQ ID NO: 258738 - RNA, 64 nt, Human; identical to SEQ ID NO: 257947

SEQ ID NO: 258739 - RNA, 64 nt, Human; identical to SEQ ID NO: 257948

SEQ ID NO: 258740 - RNA, 64 nt, Human; identical to SEQ ID NO: 257949

SEQ ID NO: 258741 - RNA, 64 nt, Human; identical to SEQ ID NO: 257950

SEQ ID NO: 258742 - RNA, 51 nt, Human; identical to SEQ ID NO: 257951

SEQ ID NO: 258743 - RNA, 64 nt, Human; identical to SEQ ID NO: 257952

SEQ ID NO: 258744 - RNA, 64 nt, Human; identical to SEQ ID NO: 257953

SEQ ID NO: 258745 - RNA, 64 nt, Human; identical to SEQ ID NO: 257954

SEQ ID NO: 258746 - RNA, 64 nt, Human; identical to SEQ ID NO: 257955

SEQ ID NO: 258747 - RNA, 64 nt, Human; identical to SEQ ID NO: 257956

SEQ ID NO: 258748 - RNA, 64 nt, Human; identical to SEQ ID NO: 257957

SEQ ID NO: 258749 - RNA, 64 nt, Human; identical to SEQ ID NO: 257958

SEQ ID NO: 258750 - RNA, 64 nt, Human
ugccuguugaugguuuuugcaagagaauucagcagcucaacaguaaugaaagugaagaacagag

SEQ ID NO: 258751 - RNA, 60 nt, Human
cuagggcauuguuucccuggggaagcagugggagagcagacucaucucagaacacagcac

SEQ ID NO: 258752 - RNA, 60 nt, Human
ggugcagccccaggaccaagcuuaaggagaggagagcaucugcucugagacggauggaag

SEQ ID NO: 258753 - RNA, 64 nt, Human; identical to SEQ ID NO: 257962

SEQ ID NO: 258754 - RNA, 64 nt, Human; identical to SEQ ID NO: 257963

SEQ ID NO: 258755 - RNA, 64 nt, Human; identical to SEQ ID NO: 257964

SEQ ID NO: 258756 - RNA, 64 nt, Human; identical to SEQ ID NO: 257965

SEQ ID NO: 258757 - RNA, 64 nt, Human; identical to SEQ ID NO: 257966

SEQ ID NO: 258758 - RNA, 64 nt, Human; identical to SEQ ID NO: 257967

SEQ ID NO: 258759 - RNA, 64 nt, Human; identical to SEQ ID NO: 257968

SEQ ID NO: 258760 - RNA, 64 nt, Human; identical to SEQ ID NO: 257969

SEQ ID NO: 258761 - RNA, 64 nt, Human; identical to SEQ ID NO: 257970

SEQ ID NO: 258762 - RNA, 64 nt, Human; identical to SEQ ID NO: 257971

SEQ ID NO: 258763 - RNA, 64 nt, Human; identical to SEQ ID NO: 257972

SEQ ID NO: 258764 - RNA, 64 nt, Human; identical to SEQ ID NO: 257973

SEQ ID NO: 258765 - RNA, 64 nt, Human; identical to SEQ ID NO: 257974

SEQ ID NO: 258766 - RNA, 64 nt, Human; identical to SEQ ID NO: 257975

SEQ ID NO: 258767 - RNA, 64 nt, Human; identical to SEQ ID NO: 257976

SEQ ID NO: 258768 - RNA, 64 nt, Human; identical to SEQ ID NO: 257980

SEQ ID NO: 258769 - RNA, 64 nt, Human
ucugugccucuauggagacuaucuuccaguugcugcucaacagaguuguuggcugagaccugcu

SEQ ID NO: 258770 - RNA, 64 nt, Human
gagcaaggguugccuuuguccuaucccugagcuugcucaacaagagaaacaagguuucuuaagu

SEQ ID NO: 258771 - RNA, 64 nt, Human
uuguuaagacaacucuuguguacgcuauguugaagcucaacaaaaaagucaugggaccacuucu

SEQ ID NO: 258772 - RNA, 64 nt, Human; identical to SEQ ID NO: 257981

SEQ ID NO: 258773 - RNA, 64 nt, Human; identical to SEQ ID NO: 257982

SEQ ID NO: 258774 - RNA, 64 nt, Human; identical to SEQ ID NO: 257983

SEQ ID NO: 258775 - RNA, 64 nt, Human; identical to SEQ ID NO: 257984

SEQ ID NO: 258776 - RNA, 64 nt, Human; identical to SEQ ID NO: 257985

SEQ ID NO: 258777 - RNA, 64 nt, Human; identical to SEQ ID NO: 122387

SEQ ID NO: 258778 - RNA, 64 nt, Human
uuuacccauauaaguuauuuaauauaauaaugaagcucaacacugugguaggaaaauagccacu

SEQ ID NO: 258779 - RNA, 64 nt, Human
ugucaugugaggaaauaaugcacaugcucuaacugcucaacaggaaaugaaccuagaaacagaa

SEQ ID NO: 258780 - RNA, 64 nt, Human
acagcgggggccagggcagcggcgucgcuccucugcucaacaggaccacaaccccugccagcag

SEQ ID NO: 258781 - RNA, 64 nt, Human; identical to SEQ ID NO: 122388

SEQ ID NO: 258782 - RNA, 64 nt, Human; identical to SEQ ID NO: 122389

SEQ ID NO: 258783 - RNA, 64 nt, Human; identical to SEQ ID NO: 122390

SEQ ID NO: 258784 - RNA, 64 nt, Human; identical to SEQ ID NO: 122391

SEQ ID NO: 258785 - RNA, 64 nt, Human; identical to SEQ ID NO: 122392

SEQ ID NO: 258786 - RNA, 64 nt, Human; identical to SEQ ID NO: 122393

SEQ ID NO: 258787 - RNA, 64 nt, Human; identical to SEQ ID NO: 122394

SEQ ID NO: 258788 - RNA, 64 nt, Human; identical to SEQ ID NO: 122395

SEQ ID NO: 258789 - RNA, 64 nt, Human; identical to SEQ ID NO: 122396

SEQ ID NO: 258790 - RNA, 64 nt, Human; identical to SEQ ID NO: 122397

SEQ ID NO: 258791 - RNA, 64 nt, Human; identical to SEQ ID NO: 122398

SEQ ID NO: 258792 - RNA, 64 nt, Human; identical to SEQ ID NO: 122399

SEQ ID NO: 258793 - RNA, 64 nt, Human; identical to SEQ ID NO: 122400

SEQ ID NO: 258794 - RNA, 64 nt, Human; identical to SEQ ID NO: 122401

SEQ ID NO: 258795 - RNA, 64 nt, Human; identical to SEQ ID NO: 122402

SEQ ID NO: 258796 - RNA, 64 nt, Human; identical to SEQ ID NO: 122403

SEQ ID NO: 258797 - RNA, 64 nt, Human
cuugagauguaggaaucugugcauucuaugcuuugcucaacaggaaagagaggaaaucaaauac

SEQ ID NO: 258798 - RNA, 64 nt, Human
gacauaaaaacagccaacagguauaugaaaaagugcucaacaucacugaucagcagggaaaugc

SEQ ID NO: 258799 - RNA, 64 nt, Human
gcuuccugggggaaggaugcagaaggagucugaugcucaacaucccuuaccuccuuucguugau

SEQ ID NO: 258800 - RNA, 64 nt, Human; identical to SEQ ID NO: 122404

SEQ ID NO: 258801 - RNA, 64 nt, Human; identical to SEQ ID NO: 122405

SEQ ID NO: 258802 - RNA, 64 nt, Human; identical to SEQ ID NO: 122406

SEQ ID NO: 258803 - RNA, 64 nt, Human; identical to SEQ ID NO: 122407

SEQ ID NO: 258804 - RNA, 64 nt, Human; identical to SEQ ID NO: 122408

SEQ ID NO: 258805 - RNA, 64 nt, Human; identical to SEQ ID NO: 122409

SEQ ID NO: 258806 - RNA, 64 nt, Human; identical to SEQ ID NO: 122410

SEQ ID NO: 258807 - RNA, 64 nt, Human; identical to SEQ ID NO: 122411

SEQ ID NO: 258808 - RNA, 64 nt, Human; identical to SEQ ID NO: 122412

SEQ ID NO: 258809 - RNA, 64 nt, Human; identical to SEQ ID NO: 122413

SEQ ID NO: 258810 - RNA, 64 nt, Human; identical to SEQ ID NO: 122414

SEQ ID NO: 258811 - RNA, 54 nt, Human; identical to SEQ ID NO: 122415

SEQ ID NO: 258812 - RNA, 64 nt, Human; identical to SEQ ID NO: 122416

SEQ ID NO: 258813 - RNA, 64 nt, Human; identical to SEQ ID NO: 122417

SEQ ID NO: 258814 - RNA, 64 nt, Human; identical to SEQ ID NO: 122418

SEQ ID NO: 258815 - RNA, 64 nt, Human; identical to SEQ ID NO: 122419

SEQ ID NO: 258816 - RNA, 64 nt, Human
ucuaggaugcccccucaggggcuggccaggcccugcucaacaucuggagauacaggcccacccc

SEQ ID NO: 258817 - RNA, 64 nt, Human
uggugagcauccucuguagagggacuccaccccugcucaacagcuuggcuuccaggcaagacca

SEQ ID NO: 258818 - RNA, 60 nt, Human
aagaggacuucuuggggccagaacuguggaggagagcacauuugauuaucauauugaccu

SEQ ID NO: 258819 - RNA, 64 nt, Human; identical to SEQ ID NO: 122420

SEQ ID NO: 258820 - RNA, 64 nt, Human; identical to SEQ ID NO: 122421

SEQ ID NO: 258821 - RNA, 64 nt, Human; identical to SEQ ID NO: 122422

SEQ ID NO: 258822 - RNA, 64 nt, Human; identical to SEQ ID NO: 122423

SEQ ID NO: 258823 - RNA, 64 nt, Human; identical to SEQ ID NO: 122424

SEQ ID NO: 258824 - RNA, 64 nt, Human; identical to SEQ ID NO: 122425

SEQ ID NO: 258825 - RNA, 64 nt, Human; identical to SEQ ID NO: 122426

SEQ ID NO: 258826 - RNA, 64 nt, Human; identical to SEQ ID NO: 122427

SEQ ID NO: 258827 - RNA, 64 nt, Human; identical to SEQ ID NO: 122429

SEQ ID NO: 258828 - RNA, 64 nt, Human; identical to SEQ ID NO: 122430

SEQ ID NO: 258829 - RNA, 64 nt, Human; identical to SEQ ID NO: 122431

SEQ ID NO: 258830 - RNA, 64 nt, Human; identical to SEQ ID NO: 122432

SEQ ID NO: 258831 - RNA, 64 nt, Human; identical to SEQ ID NO: 122433

SEQ ID NO: 258832 - RNA, 64 nt, Human; identical to SEQ ID NO: 122434

SEQ ID NO: 258833 - RNA, 64 nt, Human; identical to SEQ ID NO: 122435

SEQ ID NO: 258834 - RNA, 64 nt, Human; identical to SEQ ID NO: 122436

SEQ ID NO: 258835 - RNA, 64 nt, Human
uacugaggauuaaaauaaaaaaccguaggaaugggcucaacagugaacaaagcacaccagacaa

SEQ ID NO: 258836 - RNA, 60 nt, Human
ugccucauugcacuccccaaaagagagucaggagagcagcaggagaggcgcacagaaggc

SEQ ID NO: 258837 - RNA, 60 nt, Human
caguugguuugguaaugaucugcaagucccggagagcaacagcacagcucugccugacgc

SEQ ID NO: 258838 - RNA, 64 nt, Human; identical to SEQ ID NO: 122437

SEQ ID NO: 258839 - RNA, 64 nt, Human; identical to SEQ ID NO: 122438

SEQ ID NO: 258840 - RNA, 64 nt, Human; identical to SEQ ID NO: 122439

SEQ ID NO: 258841 - RNA, 64 nt, Human; identical to SEQ ID NO: 122440

SEQ ID NO: 258842 - RNA, 64 nt, Human; identical to SEQ ID NO: 122441

SEQ ID NO: 258843 - RNA, 64 nt, Human; identical to SEQ ID NO: 122442

SEQ ID NO: 258844 - RNA, 64 nt, Human; identical to SEQ ID NO: 122443

SEQ ID NO: 258845 - RNA, 64 nt, Human; identical to SEQ ID NO: 122444

SEQ ID NO: 258846 - RNA, 64 nt, Human; identical to SEQ ID NO: 122446

SEQ ID NO: 258847 - RNA, 64 nt, Human; identical to SEQ ID NO: 122447

SEQ ID NO: 258848 - RNA, 64 nt, Human; identical to SEQ ID NO: 122448

SEQ ID NO: 258849 - RNA, 64 nt, Human; identical to SEQ ID NO: 122449

SEQ ID NO: 258850 - RNA, 64 nt, Human; identical to SEQ ID NO: 122450

SEQ ID NO: 258851 - RNA, 64 nt, Human; identical to SEQ ID NO: 122451

SEQ ID NO: 258852 - RNA, 64 nt, Human; identical to SEQ ID NO: 122452

SEQ ID NO: 258853 - RNA, 64 nt, Human; identical to SEQ ID NO: 122453

SEQ ID NO: 258854 - RNA, 64 nt, Human
aggccccagccggcaacuucuaccgagagccauggcucaacaccaaacuggacaguagacauca

SEQ ID NO: 258855 - RNA, 64 nt, Human
aucuuaauuucuggcucuaucagaguuguuucaugcucaacaaugccauugaagugcacggugu

SEQ ID NO: 258856 - RNA, 64 nt, Human
acagacauccuagcauuugugucgggcucauuuugcucaacaugguauuugugguuuucagccu

SEQ ID NO: 258857 - RNA, 64 nt, Human; identical to SEQ ID NO: 122454

SEQ ID NO: 258858 - RNA, 64 nt, Human; identical to SEQ ID NO: 122455

SEQ ID NO: 258859 - RNA, 64 nt, Human; identical to SEQ ID NO: 122456

SEQ ID NO: 258860 - RNA, 64 nt, Human; identical to SEQ ID NO: 122457

SEQ ID NO: 258861 - RNA, 64 nt, Human; identical to SEQ ID NO: 122458

SEQ ID NO: 258862 - RNA, 64 nt, Human; identical to SEQ ID NO: 122459

SEQ ID NO: 258863 - RNA, 64 nt, Human; identical to SEQ ID NO: 122460

SEQ ID NO: 258864 - RNA, 64 nt, Human; identical to SEQ ID NO: 122461

SEQ ID NO: 258865 - RNA, 64 nt, Human; identical to SEQ ID NO: 122463

SEQ ID NO: 258866 - RNA, 64 nt, Human; identical to SEQ ID NO: 122464

SEQ ID NO: 258867 - RNA, 64 nt, Human; identical to SEQ ID NO: 122465

SEQ ID NO: 258868 - RNA, 64 nt, Human; identical to SEQ ID NO: 122466

SEQ ID NO: 258869 - RNA, 50 nt, Human; identical to SEQ ID NO: 122467

SEQ ID NO: 258870 - RNA, 64 nt, Human; identical to SEQ ID NO: 122468

SEQ ID NO: 258871 - RNA, 64 nt, Human; identical to SEQ ID NO: 122469

SEQ ID NO: 258872 - RNA, 64 nt, Human; identical to SEQ ID NO: 122470

SEQ ID NO: 258873 - RNA, 51 nt, Human
cugugaagacaaacauucgaagcucaacaagagacuggaaggaccauaaau

SEQ ID NO: 258874 - RNA, 64 nt, Human
ucacauugccuuaccuaaaucuguuugacagucugcucaacacgacugcaagcuccaugagggc

SEQ ID NO: 258875 - RNA, 64 nt, Human
acugagcagccucuggagaggggccauuaauaaagcucaacaucauuggcuguggcugaguguc

SEQ ID NO: 258876 - RNA, 64 nt, Human; identical to SEQ ID NO: 122471

SEQ ID NO: 258877 - RNA, 64 nt, Human; identical to SEQ ID NO: 122472

SEQ ID NO: 258878 - RNA, 64 nt, Human; identical to SEQ ID NO: 122473

SEQ ID NO: 258879 - RNA, 64 nt, Human; identical to SEQ ID NO: 122474

SEQ ID NO: 258880 - RNA, 64 nt, Human; identical to SEQ ID NO: 122475

SEQ ID NO: 258881 - RNA, 64 nt, Human; identical to SEQ ID NO: 122476

SEQ ID NO: 258882 - RNA, 64 nt, Human; identical to SEQ ID NO: 122477

SEQ ID NO: 258883 - RNA, 64 nt, Human; identical to SEQ ID NO: 122478

SEQ ID NO: 258884 - RNA, 64 nt, Human; identical to SEQ ID NO: 122480

SEQ ID NO: 258885 - RNA, 64 nt, Human; identical to SEQ ID NO: 122481

SEQ ID NO: 258886 - RNA, 64 nt, Human; identical to SEQ ID NO: 122482

SEQ ID NO: 258887 - RNA, 64 nt, Human; identical to SEQ ID NO: 122483

SEQ ID NO: 258888 - RNA, 64 nt, Human; identical to SEQ ID NO: 122484

SEQ ID NO: 258889 - RNA, 64 nt, Human; identical to SEQ ID NO: 122485

SEQ ID NO: 258890 - RNA, 64 nt, Human; identical to SEQ ID NO: 122486

SEQ ID NO: 258891 - RNA, 64 nt, Human; identical to SEQ ID NO: 122487

SEQ ID NO: 258892 - RNA, 64 nt, Human
cuuuuuuucuucauccucaaaaggagacucuuuugcucaacauuaaauugugcuuccuaacccu

SEQ ID NO: 258893 - RNA, 64 nt, Human
ucucuuuuaaauagaauccucuuccaccaucaaggcucaacauuuuguaagcauccaaaaaauu

SEQ ID NO: 258894 - RNA, 64 nt, Human
aaguuuccaguacuagucccagaauuuagaauaugcucaacacaaaguaaacagcauuauauaa

SEQ ID NO: 258895 - RNA, 64 nt, Human; identical to SEQ ID NO: 122488

SEQ ID NO: 258896 - RNA, 64 nt, Human; identical to SEQ ID NO: 122489

SEQ ID NO: 258897 - RNA, 64 nt, Human; identical to SEQ ID NO: 122490

SEQ ID NO: 258898 - RNA, 64 nt, Human; identical to SEQ ID NO: 122491

SEQ ID NO: 258899 - RNA, 64 nt, Human; identical to SEQ ID NO: 122492

SEQ ID NO: 258900 - RNA, 64 nt, Human; identical to SEQ ID NO: 122493

SEQ ID NO: 258901 - RNA, 64 nt, Human; identical to SEQ ID NO: 122494

SEQ ID NO: 258902 - RNA, 64 nt, Human; identical to SEQ ID NO: 122495

SEQ ID NO: 258903 - RNA, 64 nt, Human; identical to SEQ ID NO: 122497

SEQ ID NO: 258904 - RNA, 64 nt, Human; identical to SEQ ID NO: 122498

SEQ ID NO: 258905 - RNA, 64 nt, Human; identical to SEQ ID NO: 122499

SEQ ID NO: 258906 - RNA, 64 nt, Human; identical to SEQ ID NO: 122500

SEQ ID NO: 258907 - RNA, 64 nt, Human; identical to SEQ ID NO: 122501

SEQ ID NO: 258908 - RNA, 64 nt, Human; identical to SEQ ID NO: 122502

SEQ ID NO: 258909 - RNA, 64 nt, Human; identical to SEQ ID NO: 122503

SEQ ID NO: 258910 - RNA, 64 nt, Human; identical to SEQ ID NO: 122504

SEQ ID NO: 258911 - RNA, 64 nt, Human; identical to SEQ ID NO: 258856

SEQ ID NO: 258912 - RNA, 64 nt, Human
ccuaggggcggaaagaagacccgguccugcccgagcucaacaaucccagggcgggagcccauac

SEQ ID NO: 258913 - RNA, 64 nt, Human
accucccucuccccaacgaggcauggagaccccagcucaacacgcccccucuccauuguuucca

SEQ ID NO: 258914 - RNA, 64 nt, Human; identical to SEQ ID NO: 122505

SEQ ID NO: 258915 - RNA, 64 nt, Human; identical to SEQ ID NO: 122506

SEQ ID NO: 258916 - RNA, 64 nt, Human; identical to SEQ ID NO: 122507

SEQ ID NO: 258917 - RNA, 64 nt, Human; identical to SEQ ID NO: 122508

SEQ ID NO: 258918 - RNA, 64 nt, Human; identical to SEQ ID NO: 122509

SEQ ID NO: 258919 - RNA, 64 nt, Human; identical to SEQ ID NO: 122510

SEQ ID NO: 258920 - RNA, 64 nt, Human; identical to SEQ ID NO: 122511

SEQ ID NO: 258921 - RNA, 64 nt, Human; identical to SEQ ID NO: 122512

SEQ ID NO: 258922 - RNA, 64 nt, Human; identical to SEQ ID NO: 122514

SEQ ID NO: 258923 - RNA, 64 nt, Human; identical to SEQ ID NO: 122515

SEQ ID NO: 258924 - RNA, 64 nt, Human; identical to SEQ ID NO: 122516

SEQ ID NO: 258925 - RNA, 64 nt, Human; identical to SEQ ID NO: 122517

SEQ ID NO: 258926 - RNA, 64 nt, Human; identical to SEQ ID NO: 122518

SEQ ID NO: 258927 - RNA, 64 nt, Human; identical to SEQ ID NO: 122519

SEQ ID NO: 258928 - RNA, 64 nt, Human; identical to SEQ ID NO: 122520

SEQ ID NO: 258929 - RNA, 64 nt, Human; identical to SEQ ID NO: 122521

SEQ ID NO: 258930 - RNA, 64 nt, Human
gguaggagaaaguuucuuauggaacgaauacccugcucaacauuuaaucaaucuuugugccuca

SEQ ID NO: 258931 - RNA, 54 nt, Human
agaccagcgauagugauugauacugcucaacacagcccaaccuauagugcccug

SEQ ID NO: 258932 - RNA, 64 nt, Human
uugacccaguuuggaauguaucugcaauuguguggcucaacacuuuaggaaacaauagauuauu

SEQ ID NO: 258933 - RNA, 64 nt, Human; identical to SEQ ID NO: 122522

SEQ ID NO: 258934 - RNA, 64 nt, Human; identical to SEQ ID NO: 122523

SEQ ID NO: 258935 - RNA, 64 nt, Human; identical to SEQ ID NO: 122524

SEQ ID NO: 258936 - RNA, 64 nt, Human; identical to SEQ ID NO: 122525

SEQ ID NO: 258937 - RNA, 64 nt, Human; identical to SEQ ID NO: 122526

SEQ ID NO: 258938 - RNA, 64 nt, Human; identical to SEQ ID NO: 122527

SEQ ID NO: 258939 - RNA, 64 nt, Human; identical to SEQ ID NO: 122528

SEQ ID NO: 258940 - RNA, 64 nt, Human; identical to SEQ ID NO: 122529

SEQ ID NO: 258941 - RNA, 64 nt, Human; identical to SEQ ID NO: 122530

SEQ ID NO: 258942 - RNA, 64 nt, Human; identical to SEQ ID NO: 122531

SEQ ID NO: 258943 - RNA, 64 nt, Human; identical to SEQ ID NO: 122532

SEQ ID NO: 258944 - RNA, 64 nt, Human; identical to SEQ ID NO: 122533

SEQ ID NO: 258945 - RNA, 64 nt, Human; identical to SEQ ID NO: 122534

SEQ ID NO: 258946 - RNA, 64 nt, Human; identical to SEQ ID NO: 122535

SEQ ID NO: 258947 - RNA, 64 nt, Human; identical to SEQ ID NO: 122536

SEQ ID NO: 258948 - RNA, 64 nt, Human; identical to SEQ ID NO: 122537

SEQ ID NO: 258949 - RNA, 64 nt, Human
ucaucauguuacuuucaggagccucaacacgagagcucaacacugccuccgaccagucccucug

SEQ ID NO: 258950 - RNA, 64 nt, Human
augucuuggaccuggaaaguuggacauguguguggcucaacaguuuucucgggggaguucagug

SEQ ID NO: 258951 - RNA, 64 nt, Human
auugaaugaucagcauguugacaucauugucugggcucaacaggaugucaaauaauauuucuca

SEQ ID NO: 258952 - RNA, 64 nt, Human; identical to SEQ ID NO: 122538

SEQ ID NO: 258953 - RNA, 64 nt, Human; identical to SEQ ID NO: 122539

SEQ ID NO: 258954 - RNA, 64 nt, Human; identical to SEQ ID NO: 122540

SEQ ID NO: 258955 - RNA, 64 nt, Human; identical to SEQ ID NO: 122541

SEQ ID NO: 258956 - RNA, 64 nt, Human; identical to SEQ ID NO: 122542

SEQ ID NO: 258957 - RNA, 64 nt, Human; identical to SEQ ID NO: 122543

SEQ ID NO: 258958 - RNA, 64 nt, Human; identical to SEQ ID NO: 122544

SEQ ID NO: 258959 - RNA, 64 nt, Human; identical to SEQ ID NO: 122545

SEQ ID NO: 258960 - RNA, 64 nt, Human; identical to SEQ ID NO: 122546

SEQ ID NO: 258961 - RNA, 64 nt, Human; identical to SEQ ID NO: 122547

SEQ ID NO: 258962 - RNA, 64 nt, Human; identical to SEQ ID NO: 122548

SEQ ID NO: 258963 - RNA, 64 nt, Human; identical to SEQ ID NO: 122549

SEQ ID NO: 258964 - RNA, 64 nt, Human; identical to SEQ ID NO: 122550

SEQ ID NO: 258965 - RNA, 64 nt, Human; identical to SEQ ID NO: 122551

SEQ ID NO: 258966 - RNA, 64 nt, Human; identical to SEQ ID NO: 122552

SEQ ID NO: 258967 - RNA, 64 nt, Human; identical to SEQ ID NO: 122553

SEQ ID NO: 258968 - RNA, 64 nt, Human
gaacaaauucuggaaauggauagcgaugaugguugcucaacauuuugaauguuaaugccacuaa

SEQ ID NO: 258969 - RNA, 64 nt, Human
aacagagccauucccuuggaaugcauaucgcugggcucaacauagaguuugucuuccucuuguu

SEQ ID NO: 258970 - RNA, 64 nt, Human
cguggcugcagcagcugagcccacacuuguugcugcucaacaggacugcacucgucucugcccu

SEQ ID NO: 258971 - RNA, 64 nt, Human; identical to SEQ ID NO: 122554

SEQ ID NO: 258972 - RNA, 64 nt, Human; identical to SEQ ID NO: 122555

SEQ ID NO: 258973 - RNA, 64 nt, Human; identical to SEQ ID NO: 122556

SEQ ID NO: 258974 - RNA, 64 nt, Human; identical to SEQ ID NO: 122557

SEQ ID NO: 258975 - RNA, 64 nt, Human; identical to SEQ ID NO: 122558

SEQ ID NO: 258976 - RNA, 64 nt, Human; identical to SEQ ID NO: 122559

SEQ ID NO: 258977 - RNA, 64 nt, Human; identical to SEQ ID NO: 122560

SEQ ID NO: 258978 - RNA, 64 nt, Human; identical to SEQ ID NO: 122561

SEQ ID NO: 258979 - RNA, 64 nt, Human; identical to SEQ ID NO: 122563

SEQ ID NO: 258980 - RNA, 64 nt, Human; identical to SEQ ID NO: 122564

SEQ ID NO: 258981 - RNA, 64 nt, Human; identical to SEQ ID NO: 122565

SEQ ID NO: 258982 - RNA, 64 nt, Human; identical to SEQ ID NO: 122566

SEQ ID NO: 258983 - RNA, 64 nt, Human; identical to SEQ ID NO: 122567

SEQ ID NO: 258984 - RNA, 64 nt, Human; identical to SEQ ID NO: 122568

SEQ ID NO: 258985 - RNA, 64 nt, Human; identical to SEQ ID NO: 122569

SEQ ID NO: 258986 - RNA, 64 nt, Human; identical to SEQ ID NO: 122570

SEQ ID NO: 258987 - RNA, 64 nt, Human
uauaauuuguuacauagcgacagauaacuauacagcucaacaacuagaaaaauaaacuguuuac

SEQ ID NO: 258988 - RNA, 64 nt, Human
uuguauauuacaacauuuaugugagguaauuauugcucaacagacaauuagaaaaaaguccaca

SEQ ID NO: 258989 - RNA, 64 nt, Human
cuaucuagauuaggaaaaugaucagaauauuccagcucaacaagucuggguauauucacuauug

SEQ ID NO: 258990 - RNA, 64 nt, Human; identical to SEQ ID NO: 122571

SEQ ID NO: 258991 - RNA, 64 nt, Human; identical to SEQ ID NO: 122572

SEQ ID NO: 258992 - RNA, 64 nt, Human; identical to SEQ ID NO: 122573

SEQ ID NO: 258993 - RNA, 64 nt, Human; identical to SEQ ID NO: 122574

SEQ ID NO: 258994 - RNA, 64 nt, Human; identical to SEQ ID NO: 122575

SEQ ID NO: 258995 - RNA, 64 nt, Human; identical to SEQ ID NO: 122576

SEQ ID NO: 258996 - RNA, 64 nt, Human; identical to SEQ ID NO: 122577

SEQ ID NO: 258997 - RNA, 64 nt, Human; identical to SEQ ID NO: 122578

SEQ ID NO: 258998 - RNA, 64 nt, Human; identical to SEQ ID NO: 122580

SEQ ID NO: 258999 - RNA, 64 nt, Human; identical to SEQ ID NO: 122581

SEQ ID NO: 259000 - RNA, 64 nt, Human; identical to SEQ ID NO: 122582

SEQ ID NO: 259001 - RNA, 64 nt, Human; identical to SEQ ID NO: 122583

SEQ ID NO: 259002 - RNA, 64 nt, Human; identical to SEQ ID NO: 122584

SEQ ID NO: 259003 - RNA, 64 nt, Human; identical to SEQ ID NO: 122585

SEQ ID NO: 259004 - RNA, 64 nt, Human; identical to SEQ ID NO: 122586

SEQ ID NO: 259005 - RNA, 64 nt, Human; identical to SEQ ID NO: 122587

SEQ ID NO: 259006 - RNA, 64 nt, Human
uaagaaacugaagaucagagaaguuaagaaacuugcucaacaucauauaguaaguagcagaguu

SEQ ID NO: 259007 - RNA, 64 nt, Human
acauauacauggucaauaaguauauuuuuaaaaugcucaacauuaacuauucauacagaaaugc

SEQ ID NO: 259008 - RNA, 64 nt, Human
uaccugccccucuucaguacagggauggcuggcugcucaacacacuccuccuccccuuuuuucc

SEQ ID NO: 259009 - RNA, 64 nt, Human; identical to SEQ ID NO: 122588

SEQ ID NO: 259010 - RNA, 64 nt, Human; identical to SEQ ID NO: 122589

SEQ ID NO: 259011 - RNA, 64 nt, Human; identical to SEQ ID NO: 122590

SEQ ID NO: 259012 - RNA, 64 nt, Human; identical to SEQ ID NO: 122591

SEQ ID NO: 259013 - RNA, 64 nt, Human; identical to SEQ ID NO: 122592

SEQ ID NO: 259014 - RNA, 64 nt, Human; identical to SEQ ID NO: 122593

SEQ ID NO: 259015 - RNA, 64 nt, Human; identical to SEQ ID NO: 122594

SEQ ID NO: 259016 - RNA, 64 nt, Human; identical to SEQ ID NO: 122595

SEQ ID NO: 259017 - RNA, 64 nt, Human; identical to SEQ ID NO: 122597

SEQ ID NO: 259018 - RNA, 64 nt, Human; identical to SEQ ID NO: 122598

SEQ ID NO: 259019 - RNA, 64 nt, Human; identical to SEQ ID NO: 122599

SEQ ID NO: 259020 - RNA, 64 nt, Human; identical to SEQ ID NO: 122600

SEQ ID NO: 259021 - RNA, 64 nt, Human; identical to SEQ ID NO: 122601

SEQ ID NO: 259022 - RNA, 64 nt, Human; identical to SEQ ID NO: 122602

SEQ ID NO: 259023 - RNA, 64 nt, Human; identical to SEQ ID NO: 122603

SEQ ID NO: 259024 - RNA, 64 nt, Human; identical to SEQ ID NO: 122604

SEQ ID NO: 259025 - RNA, 64 nt, Human
aauccuggacaccaguaccccugcagcauggcuugcucaacaacagucuuugaguggcauagaa

SEQ ID NO: 259026 - RNA, 64 nt, Human
aaugucucuaauacaauacggugauugcuugugugcucaacauaccugcaguugaaacguauug

SEQ ID NO: 259027 - RNA, 64 nt, Human
gucucaacguucaggcuuacucagagauuugauugcucaacaugcauaacuugaauucaauaga

SEQ ID NO: 259028 - RNA, 64 nt, Human; identical to SEQ ID NO: 122605

SEQ ID NO: 259029 - RNA, 64 nt, Human; identical to SEQ ID NO: 122606

SEQ ID NO: 259030 - RNA, 64 nt, Human; identical to SEQ ID NO: 122607

SEQ ID NO: 259031 - RNA, 64 nt, Human; identical to SEQ ID NO: 122608

SEQ ID NO: 259032 - RNA, 64 nt, Human; identical to SEQ ID NO: 122609

SEQ ID NO: 259033 - RNA, 64 nt, Human; identical to SEQ ID NO: 122610

SEQ ID NO: 259034 - RNA, 64 nt, Human; identical to SEQ ID NO: 122611

SEQ ID NO: 259035 - RNA, 64 nt, Human; identical to SEQ ID NO: 122612

SEQ ID NO: 259036 - RNA, 64 nt, Human; identical to SEQ ID NO: 122613

SEQ ID NO: 259037 - RNA, 64 nt, Human; identical to SEQ ID NO: 122614

SEQ ID NO: 259038 - RNA, 64 nt, Human; identical to SEQ ID NO: 122615

SEQ ID NO: 259039 - RNA, 64 nt, Human; identical to SEQ ID NO: 122616

SEQ ID NO: 259040 - RNA, 64 nt, Human; identical to SEQ ID NO: 122617

SEQ ID NO: 259041 - RNA, 64 nt, Human; identical to SEQ ID NO: 122618

SEQ ID NO: 259042 - RNA, 64 nt, Human; identical to SEQ ID NO: 122619

SEQ ID NO: 259043 - RNA, 64 nt, Human; identical to SEQ ID NO: 122620

SEQ ID NO: 259044 - RNA, 64 nt, Human
ugagggaauccagacucccuucucucaaggggaggcucaacagaacauugaccugggggcaaac

SEQ ID NO: 259045 - RNA, 64 nt, Human
uuguauuucuccagaagcugcagcaagagguacagcucaacaaaggaaaaccacaggacuggau

SEQ ID NO: 259046 - RNA, 64 nt, Human
cagaggcccccagcagacgaugaggacauugucggcucaacaucucaggccacucauuaccuuc

SEQ ID NO: 259047 - RNA, 64 nt, Human; identical to SEQ ID NO: 122621

SEQ ID NO: 259048 - RNA, 64 nt, Human; identical to SEQ ID NO: 122622

SEQ ID NO: 259049 - RNA, 64 nt, Human; identical to SEQ ID NO: 122623

SEQ ID NO: 259050 - RNA, 64 nt, Human; identical to SEQ ID NO: 122624

SEQ ID NO: 259051 - RNA, 64 nt, Human; identical to SEQ ID NO: 122625

SEQ ID NO: 259052 - RNA, 64 nt, Human; identical to SEQ ID NO: 122626

SEQ ID NO: 259053 - RNA, 64 nt, Human; identical to SEQ ID NO: 122627

SEQ ID NO: 259054 - RNA, 64 nt, Human; identical to SEQ ID NO: 122628

SEQ ID NO: 259055 - RNA, 64 nt, Human; identical to SEQ ID NO: 122630

SEQ ID NO: 259056 - RNA, 64 nt, Human; identical to SEQ ID NO: 122631

SEQ ID NO: 259057 - RNA, 64 nt, Human; identical to SEQ ID NO: 122632

SEQ ID NO: 259058 - RNA, 64 nt, Human; identical to SEQ ID NO: 122633

SEQ ID NO: 259059 - RNA, 64 nt, Human; identical to SEQ ID NO: 122634

SEQ ID NO: 259060 - RNA, 64 nt, Human; identical to SEQ ID NO: 122635

SEQ ID NO: 259061 - RNA, 64 nt, Human; identical to SEQ ID NO: 122636

SEQ ID NO: 259062 - RNA, 64 nt, Human; identical to SEQ ID NO: 122637

SEQ ID NO: 259063 - RNA, 64 nt, Human
agcggccugggcugguccagugcuaugccuggaggcucaacacaaaacuucccauccaaacauu

SEQ ID NO: 259064 - RNA, 64 nt, Human
agaaccaagaugggaccugaggacacaaagaugagcucaacagucucagcccuagaggaauaga

SEQ ID NO: 259065 - RNA, 64 nt, Human
cgcgaccacagugugaaugaccuuugacuugcaugcucaacagggaguggaggagaggagacaa

SEQ ID NO: 259066 - RNA, 64 nt, Human; identical to SEQ ID NO: 122638

SEQ ID NO: 259067 - RNA, 64 nt, Human; identical to SEQ ID NO: 122639

SEQ ID NO: 259068 - RNA, 64 nt, Human; identical to SEQ ID NO: 122640

SEQ ID NO: 259069 - RNA, 62 nt, Human; identical to SEQ ID NO: 122641

SEQ ID NO: 259070 - RNA, 64 nt, Human; identical to SEQ ID NO: 122642

SEQ ID NO: 259071 - RNA, 64 nt, Human; identical to SEQ ID NO: 122643

SEQ ID NO: 259072 - RNA, 64 nt, Human; identical to SEQ ID NO: 122644

SEQ ID NO: 259073 - RNA, 64 nt, Human; identical to SEQ ID NO: 122645

SEQ ID NO: 259074 - RNA, 64 nt, Human; identical to SEQ ID NO: 122647

SEQ ID NO: 259075 - RNA, 64 nt, Human; identical to SEQ ID NO: 122648

SEQ ID NO: 259076 - RNA, 64 nt, Human; identical to SEQ ID NO: 122649

SEQ ID NO: 259077 - RNA, 64 nt, Human; identical to SEQ ID NO: 122650

SEQ ID NO: 259078 - RNA, 64 nt, Human; identical to SEQ ID NO: 122651

SEQ ID NO: 259079 - RNA, 64 nt, Human; identical to SEQ ID NO: 122652

SEQ ID NO: 259080 - RNA, 64 nt, Human; identical to SEQ ID NO: 122653

SEQ ID NO: 259081 - RNA, 64 nt, Human; identical to SEQ ID NO: 122654

SEQ ID NO: 259082 - RNA, 64 nt, Human
caucaaacuguaaaagauuaaacugcgaagucaagcucaacagauuauuuuggaaaguuuuugu

SEQ ID NO: 259083 - RNA, 64 nt, Human
uucuccauuuuaucaccugaaggcuugggccagagcucaacagcuacucaacuggaggggugag

SEQ ID NO: 259084 - RNA, 60 nt, Human
gagacggagucuugcucugucacccaggcuggagagcaguggcgugaucucggcucacug

SEQ ID NO: 259085 - RNA, 64 nt, Human; identical to SEQ ID NO: 122655

SEQ ID NO: 259086 - RNA, 64 nt, Human; identical to SEQ ID NO: 122656

SEQ ID NO: 259087 - RNA, 64 nt, Human; identical to SEQ ID NO: 122657

SEQ ID NO: 259088 - RNA, 64 nt, Human; identical to SEQ ID NO: 122658

SEQ ID NO: 259089 - RNA, 64 nt, Human; identical to SEQ ID NO: 122659

SEQ ID NO: 259090 - RNA, 64 nt, Human; identical to SEQ ID NO: 122660

SEQ ID NO: 259091 - RNA, 64 nt, Human; identical to SEQ ID NO: 122661

SEQ ID NO: 259092 - RNA, 64 nt, Human; identical to SEQ ID NO: 122662

SEQ ID NO: 259093 - RNA, 64 nt, Human; identical to SEQ ID NO: 122663

SEQ ID NO: 259094 - RNA, 64 nt, Human; identical to SEQ ID NO: 122664

SEQ ID NO: 259095 - RNA, 64 nt, Human; identical to SEQ ID NO: 122665

SEQ ID NO: 259096 - RNA, 64 nt, Human; identical to SEQ ID NO: 122666

SEQ ID NO: 259097 - RNA, 64 nt, Human; identical to SEQ ID NO: 122667

SEQ ID NO: 259098 - RNA, 64 nt, Human; identical to SEQ ID NO: 122668

SEQ ID NO: 259099 - RNA, 64 nt, Human; identical to SEQ ID NO: 122669

SEQ ID NO: 259100 - RNA, 64 nt, Human; identical to SEQ ID NO: 122670

SEQ ID NO: 259101 - RNA, 64 nt, Human
cccacuccauagccauguggauuuuuauccaaaggcucaacaaccagagggaauggugagaccu

SEQ ID NO: 259102 - RNA, 53 nt, Human
cggaaggugaggaaaauuaaauggcucaacaagcacaauaccuagguuaccac

SEQ ID NO: 259103 - RNA, 64 nt, Human
uuuauuaaauauucuuauccucuuaaauaaaacugcucaacaguuaaucagcagugaaucaucu

SEQ ID NO: 259104 - RNA, 64 nt, Human; identical to SEQ ID NO: 122671

SEQ ID NO: 259105 - RNA, 64 nt, Human; identical to SEQ ID NO: 122672

SEQ ID NO: 259106 - RNA, 64 nt, Human; identical to SEQ ID NO: 122673

SEQ ID NO: 259107 - RNA, 64 nt, Human; identical to SEQ ID NO: 122674

SEQ ID NO: 259108 - RNA, 64 nt, Human; identical to SEQ ID NO: 122675

SEQ ID NO: 259109 - RNA, 64 nt, Human; identical to SEQ ID NO: 122676

SEQ ID NO: 259110 - RNA, 64 nt, Human; identical to SEQ ID NO: 122677

SEQ ID NO: 259111 - RNA, 64 nt, Human; identical to SEQ ID NO: 122678

SEQ ID NO: 259112 - RNA, 63 nt, Human; identical to SEQ ID NO: 122680

SEQ ID NO: 259113 - RNA, 64 nt, Human; identical to SEQ ID NO: 122681

SEQ ID NO: 259114 - RNA, 64 nt, Human; identical to SEQ ID NO: 122682

SEQ ID NO: 259115 - RNA, 58 nt, Human; identical to SEQ ID NO: 122683

SEQ ID NO: 259116 - RNA, 64 nt, Human
uuauugcaauaaccgcuugguuugcaaccucuuugcucaacagaacauauguugcaagacccuc

SEQ ID NO: 259117 - RNA, 64 nt, Human
cuacaugaaguuuacagauugguaaauaucaccugcucaacauguaauuauuuaauaaaacuuu

SEQ ID NO: 259118 - RNA, 64 nt, Human
uauguuggguacauuauuuaauggggucaguauugcucaacacucucauugagucacugugagg

SEQ ID NO: 259119 - RNA, 64 nt, Human
uagagugucacugcuggugaacuguggcacgguugcucaacacaucaccucggacaaauucagg

SEQ ID NO: 259120 - RNA, 64 nt, Human
gaaagagauguaagguguauucauagggaugguggcucaacaaaucaagcaaacuggaaucaag

SEQ ID NO: 259121 - RNA, 60 nt, Human
caaggacccaggucuuccugcugcugccagggagagcagggacagugccgcgugcgagau

SEQ ID NO: 259122 - RNA, 60 nt, Human
gcuauauucacugugcuguccuagggggagggagagcagagcucgccccugcacugcagc

SEQ ID NO: 259123 - RNA, 60 nt, Human
aagacacuccaucaaccccuacaguaacagggagagcaggauccucuucagcaccuggaa

SEQ ID NO: 259124 - RNA, 60 nt, Human
cccaaauccaggcccggcccccucuggcuuggagagcauuccaagcccccaccccacccc

SEQ ID NO: 259125 - RNA, 60 nt, Human
ucuuuuccacugccuagcuaagcagucuggggagagcauggggaucauuucuaugugugu

SEQ ID NO: 259126 - RNA, 60 nt, Human
cagugauuuuuccccccaccccccagcacaggagagcacccacagccgcagaaggggaau

SEQ ID NO: 259127 - RNA, 60 nt, Human
ggaauuacuuuuuguuguuuuugccaccguggagagcaacuauuuggagugcacagccua

SEQ ID NO: 259128 - RNA, 60 nt, Human
uaaaccuaggucuggucaccaauaggguuuggagagcaaagggccacaacucaucagcug

SEQ ID NO: 259129 - RNA, 60 nt, Human
cccucuaccaaucccuggcacaggguuccuggagagcaggugcuguacauuuuacagcuu

SEQ ID NO: 259130 - RNA, 60 nt, Human
ggauggagcuaagaguucagaggccaucaaggagagcagcaaguuuccauuuggcauuag

SEQ ID NO: 259131 - RNA, 60 nt, Human
cuccgugaccuuucucuagccagggagaagggagagcaggaguauuggggcugggcccug

SEQ ID NO: 259132 - RNA, 60 nt, Human
aguuaucuuuaacugacuucuguccacucuggagagcagugaggaauuaaucuugcuuuu

SEQ ID NO: 259133 - RNA, 60 nt, Human
auggagagaauuugaauaaaaggugggaaaggagagcacuguucuuugauuguuuaucca

SEQ ID NO: 259134 - RNA, 60 nt, Human
gccaagauccuugaaggacccuggaaggagggagagcaggcagcccuucacaggauagga

SEQ ID NO: 259135 - RNA, 60 nt, Human
agagcucucuuuggugagacuucccuggauggagagcagcagcaggggaagaggugcucu

SEQ ID NO: 259136 - RNA, 60 nt, Human
caacugauucccaguuuaagauaggaggaaggagagcaauuucuaaguuucaauccugcg

SEQ ID NO: 259137 - RNA, 60 nt, Human
uuacgcucaagggucccugguccccugcauggagagcauaaugacagaagaucgucugaa

SEQ ID NO: 259138 - RNA, 60 nt, Human
aucuaucugaguagucaaaauacaaguaaaggagagcaaauaaacaacauuuggaaaaaa

SEQ ID NO: 259139 - RNA, 60 nt, Human
uggucaguauuucuuuuuuggggggaacuaggagagcaggaguagaagugagauguuaag

SEQ ID NO: 259140 - RNA, 60 nt, Human
uacagguuuucccuacuaaacaaagguguuggagagcagcuuuggguucugugcugguug

SEQ ID NO: 259141 - RNA, 60 nt, Human
uaacacgggggaggggcaggagagggauauggagagcaggugguggaaucagaggacgag

SEQ ID NO: 259142 - RNA, 60 nt, Human
agguacuugugaggcaguguacuggagaggggagagcauggauccuggggucaaagggcc

SEQ ID NO: 259143 - RNA, 60 nt, Human
gggauuucaaggcagcagaggguagugaggggagagcaggagaagccucuguccuguaua

SEQ ID NO: 259144 - RNA, 60 nt, Human
uccgaaaaccaccuggggacucacguagcuggagagcauuacagccucauccacuuaccu

SEQ ID NO: 259145 - RNA, 56 nt, Human
aacggaagcaggaugaauaaagaaagggagagcacaugaagcuuugcuaauuauaa

SEQ ID NO: 259146 - RNA, 60 nt, Human
uuguuuaaauaaacuaaauuaauuuuuaggggagagcaguaggaaaaagagcuaaugcau

SEQ ID NO: 259147 - RNA, 60 nt, Human
ggcacagccuuggcuuccacgccugagcguggagagcacgaguuaguuguaguccggcuu

SEQ ID NO: 259148 - RNA, 60 nt, Human
guaugaugauuuuugcagccacuuggcuauggagagcagccgacacccccucuuacagcc

SEQ ID NO: 259149 - RNA, 62 nt, Human
uugugaagaaauaauguuaauauaaguaucuggugaaggaccaaaaccgugugauaagguug

SEQ ID NO: 259150 - RNA, 62 nt, Human
aaaggauaggccuuugaguguuagagaaaggagugaaggaggcaggugggaaaugguauuuc

SEQ ID NO: 259151 - RNA, 62 nt, Human
ucuucuagcuugguaaugaaguauauuuauuggugaaggaaacagcugcugcugcuucuccu

SEQ ID NO: 259152 - RNA, 62 nt, Human
cauuacagguuaugcuuugagaucucuuuggggugaaggauugaaauuaaacccugagccac

SEQ ID NO: 259153 - RNA, 62 nt, Human
uugauuuugauuuucacugccaagccaaucaugugaaggacagaagcuuuugccaugggccc

SEQ ID NO: 259154 - RNA, 62 nt, Human
uuccucaguuugcuaacuccccaugcaucuuugugaaggacaguaucuaguuuaucuguagg

SEQ ID NO: 259155 - RNA, 62 nt, Human
uacagugaaaugagccagggcgaggagggagggugaaggaacggagggcgggcggcuccgag

SEQ ID NO: 259156 - RNA, 62 nt, Human
aaguacauguauuuuuaauauaugcaucccuggugaaggaucuugccugcaugaaacauguu

SEQ ID NO: 259157 - RNA, 62 nt, Human
aacugucuaaugacacgguaggccaagcugaagugaaggagaaaggagccggaccaagaugg

SEQ ID NO: 259158 - RNA, 62 nt, Human
gauugaggauuaucuucucucagaaaggcauugugaaggaauugagccagaucucucucccu

SEQ ID NO: 259159 - RNA, 62 nt, Human
aagaagucuggcuccugcuuuucuacaugccugugaaggagacuuuucaugaaacugaauaa

SEQ ID NO: 259160 - RNA, 62 nt, Human
agauaagaaaaaggcuauuaauaucauacuaagugaaggacaggaaaggguuuuauucauaa

SEQ ID NO: 259161 - RNA, 62 nt, Human
caccaggaugcagagaaucagacuggccugaggugaaggagcacacagcccugagggcuugg

SEQ ID NO: 259162 - RNA, 62 nt, Human
aguccuagcguagcgaacguuccuggaguggggugaaggauaucaauauacuaaguuuuaac

SEQ ID NO: 259163 - RNA, 62 nt, Human
uuaucugaacuggagaagcaauaaaaauuaaagugaaggaaaauacugaacucugucugagu

SEQ ID NO: 259164 - RNA, 62 nt, Human
aagaaaagagaaagagaaaaggaauuaauucagugaaggaugauuuugcuccuaguuuugga

SEQ ID NO: 259165 - RNA, 62 nt, Human
ucuuccagcaacaacccucacauaugcacugagugaaggaugaauguauggacacaucuggg

SEQ ID NO: 259166 - RNA, 62 nt, Human
ucgguccaacaacaggaaaccugacuggggcagugaaggaagggauggcauagcguuaugug

SEQ ID NO: 259167 - RNA, 62 nt, Human
gucuuuuauucugccacauuuauugauaaacagugaaggaauuuuuaaaaaauuuuuaagaa

SEQ ID NO: 259168 - RNA, 62 nt, Human
uauacccaagaacaagagauaccuuuaagccagugaaggauacuugcgauagaaucauccgc

SEQ ID NO: 259169 - RNA, 62 nt, Human
aggaugucacauguucccuuaccccuguaccugugaaggauuggcagugcuugugccugacc

SEQ ID NO: 259170 - RNA, 62 nt, Human
uucuccuggauccugcccugcucucagccauagugaaggaccagcccuaggagucugcgaga

SEQ ID NO: 259171 - RNA, 62 nt, Human
gaggcugggaagaggugggaggaggggcagaagugaaggaagaauaggaaggauauuaccuc

SEQ ID NO: 259172 - RNA, 62 nt, Human
cugccacuaucaaaguuccagcuaccugcaaggugaaggaaggcaucccuuuuggggcaugc

SEQ ID NO: 259173 - RNA, 62 nt, Human
uauucuauuuaugguucccgggaaguuguuuggugaaggaagccccucccugggcauuuucu

SEQ ID NO: 259174 - RNA, 62 nt, Human
ugccucaggaggagaacccuccccaguguacugugaaggaugacacagcacuucuuccuaau

SEQ ID NO: 259175 - RNA, 62 nt, Human
uguggcauuaucaaaaugaagaggagcaaggagugaaggagugggguuaugaaucugccaaa

SEQ ID NO: 259176 - RNA, 62 nt, Human
gggguggacagggcauggauucuucauugcaagugaaggagccucccagcucagccacgugg

SEQ ID NO: 259177 - RNA, 62 nt, Human
uagcaauguguuuugcaacauauuaagaguaugugaaggaagcagggaugucgcaggaaucc

SEQ ID NO: 259178 - RNA, 62 nt, Human
caucaauccaagaaagaguugcuuuguggaaggugaaggaagacccacagagugcucaggau

SEQ ID NO: 259179 - RNA, 62 nt, Human
aauccucaugucuuugagggaucccaccacaggugaaggaaguaaagaccacuucuccccca

SEQ ID NO: 259180 - RNA, 62 nt, Human
caggggagagagggaaaugccaaaaacuuggagugaaggaugaugcuauuuuuuauuuuuaa

SEQ ID NO: 259181 - RNA, 62 nt, Human
uggagcuugcgaggcagcguggacuggugacugugaaggaaggcccccgugguagaaugagc

SEQ ID NO: 259182 - RNA, 62 nt, Human
ccgcccugcuccacgcagucugcuucagugcagugaaggaaccguggagcaugcaacacauc

SEQ ID NO: 259183 - RNA, 62 nt, Human
gacucaguggcagaacaugcagcagaaaagcugugaaggaaggaaauuuacgugauuguaau

SEQ ID NO: 259184 - RNA, 62 nt, Human
cugcacuccagcucgccccuuucccgcgcgaagugaaggaugcgucacuuuucugagcggcc

SEQ ID NO: 259185 - RNA, 62 nt, Human
gggggaaaaugcaauaauuuuugaugagaugggugaaggacaagaagugaguugugucaauu

SEQ ID NO: 259186 - RNA, 62 nt, Human
gaaucacugccuccugugauuugaaggccauugugaaggaaaacaaugcagugaaagaaagu

SEQ ID NO: 259187 - RNA, 62 nt, Human
cgcgcggugccggcugggucuguaccaaaggugugaaggaaagaagacaccgaccacggcga

SEQ ID NO: 259188 - RNA, 62 nt, Human
cuugucuagacaugguuuuaagaauagcugacgugaaggaagaggauuuauugcugcaguac

SEQ ID NO: 259189 - RNA, 62 nt, Human
aaaaguaucgagaacagcuuucuuucccaggggugaaggauggcgcucgggggugacuccua

SEQ ID NO: 259190 - RNA, 62 nt, Human
uaggauuucaugauuuuuuuuuuucaguccccgugaaggagagcccuucauuuggagauuau

SEQ ID NO: 259191 - RNA, 62 nt, Human
gggagacuuacugcauugccgacagcacagaugugaaggacaugagacuaagagaaaccuug

SEQ ID NO: 259192 - RNA, 62 nt, Human
ccucacuccuuuuacucacugggcucaugacagugaaggagaugcuccaucugcuucucccc

SEQ ID NO: 259193 - RNA, 62 nt, Human
acgcaacauaauucacauaauuuguaugcagugugaaggagcagaaggcaucuucucacugu

SEQ ID NO: 259194 - RNA, 62 nt, Human
agaaaaaaacaaacaaccccaucaaaaagugggugaaggacaugaacagacacuucucaaaa

SEQ ID NO: 259195 - RNA, 62 nt, Human
acaacaacaaaccacaaaauuauuugaguacugugaaggauuauuugucuaacaguucauuc

SEQ ID NO: 259196 - RNA, 62 nt, Human
aaagggaggcaucaggaauagaaugaaacugugugaaggauaagauuguucgcaucaagauc

SEQ ID NO: 259197 - RNA, 62 nt, Human
gcugaaaucaagcacauauuuugaaauggacugugaaggaaaaggggacaggaacaaaggac

SEQ ID NO: 259198 - RNA, 62 nt, Human
gaggcagcuuuaaccagcccccagggaugauugugaaggaggccccuccccuugugaggagg

SEQ ID NO: 259199 - RNA, 62 nt, Human
agagggcugugccccguagggacagugcccaggugaaggaugccccugguccuccagggcac

SEQ ID NO: 259200 - RNA, 62 nt, Human
acggugggcucuuccccuugguuuguaacgaagugaaggaggagaacuugggagccagguuc

SEQ ID NO: 259201 - RNA, 62 nt, Human
cugacauuuccuaggaagcuaggaaaaggaaagugaaggaauggucuaaagaaaugaccauu

SEQ ID NO: 259202 - RNA, 62 nt, Human
gguagaaaaucagggcaggagagaauauaauugugaaggagucagggcuaacaccuggaucu

SEQ ID NO: 259203 - RNA, 62 nt, Human
uguuuucugucauuugccuacuggggaagaaagugaaggaggggaaacuguuuaauaucaca

SEQ ID NO: 259204 - RNA, 62 nt, Human
aagaaaaggcugccgcaacaucucagcgaggagugaaggacccaugucccaggaaccgcgcu

SEQ ID NO: 259205 - RNA, 62 nt, Human
uuaagauaccgaagucuuaaagugaccuggacgugaaggaaaaaguaagaugagaaauaaag

SEQ ID NO: 259206 - RNA, 62 nt, Human
acaauuuuaggccucaauuuuuuuuuuuuucugugaaggaacuugaagugaugcauguguga

SEQ ID NO: 259207 - RNA, 62 nt, Human
guaguuacuguuuucaccagaaaagguaaugagugaaggaaagaauaguagcagaaagcaca

SEQ ID NO: 259208 - RNA, 62 nt, Human
uuuagucagucccccaaacagucaugccaacugugaaggaaugucccacaaaacauuuccau

SEQ ID NO: 259209 - RNA, 62 nt, Human
uaaaugcacacuucugacuauaauuuugagcagugaaggaaggaugacugccuguuacacag

SEQ ID NO: 259210 - RNA, 62 nt, Human
gauuagagguuugggcauauaaccagauuaaagugaaggaacuuucuguuguuuuuguagca

SEQ ID NO: 259211 - RNA, 62 nt, Human
gugugcauucugagaccucuuguauucaaucugugaaggauauguguauuaauccguacacc

SEQ ID NO: 259212 - RNA, 62 nt, Human
cagaguacaaaauaguuguaggggaaaucaaggugaaggaucuguccgacagucaagacgga

SEQ ID NO: 259213 - RNA, 62 nt, Human
cuugaagccuuuacuuuuuuuuuuuuuuggaagugaaggaaaaagaaacuauuuacagcacu

SEQ ID NO: 259214 - RNA, 62 nt, Human
ucccacccuuucugccagggauggcaguggcugugaaggaguaaugggauaugggguuacuu

SEQ ID NO: 259215 - RNA, 62 nt, Human
uggugcuuagagacuaucaacucccuccuuuagugaaggagccguguuagagcuuccgagaa

SEQ ID NO: 259216 - RNA, 62 nt, Human
gcaacuggaugacacaagauuuuacuugaacagugaaggacaaaaaucaugauuguggaaga

SEQ ID NO: 259217 - RNA, 62 nt, Human
cacccucugcccgccuuggggucugcugggcugugaaggagaauaaagaguuaaacugucag

SEQ ID NO: 259218 - RNA, 62 nt, Human
gcguaagaaacagaguagauagacuaaauucagugaaggaaaggaauugagagauuuuucuu

SEQ ID NO: 259219 - RNA, 62 nt, Human
auuguccugucuaugugcaggcccaggguguggugaaggaccuggagccggaacugcugcgg

SEQ ID NO: 259220 - RNA, 62 nt, Human
cagagacagagcgugcacacguagaguggcuagugaaggacgccuuuuugacucuucuuggu

SEQ ID NO: 259221 - RNA, 62 nt, Human
gugaaagcccaaguccuuggaagcuuuccccagugaaggacugacugggggccucacgcuua

SEQ ID NO: 259222 - RNA, 62 nt, Human
aaaaaaauuuuuuaaauaaguuuaauuauaaagugaaggaccaguuggaccacggaccccua

SEQ ID NO: 259223 - RNA, 62 nt, Human
cucaacugagaaggugaaaugugagcaaagacgugaaggaagccagggagguagcagguagc

SEQ ID NO: 259224 - RNA, 62 nt, Human
uuguuugaaggagguggugaugguggauagaggugaaggagguagggagugcccuccaagug

SEQ ID NO: 259225 - RNA, 62 nt, Human
caccuguaaagggucggugcugaggaggaauagugaaggagggaggccucuuugcaguugag

SEQ ID NO: 259226 - RNA, 62 nt, Human
auuauuuuucuuauaggcuuuuuguuaaaauagugaaggaacaaauguuaaaggguaagaua

SEQ ID NO: 259227 - RNA, 62 nt, Human
uuuagcuguagccuggaauccauauauauaaagugaaggagggcagaccacacgcccucuca

SEQ ID NO: 259228 - RNA, 62 nt, Human
acauuuuauaauuuggaagacacaaaucaaaugugaaggauuugauuuucuacauuuaaaau

SEQ ID NO: 259229 - RNA, 62 nt, Human
ugacugccccgccauuucauccuaggcauucugugaaggagauugguuaguccaaacuugcu

SEQ ID NO: 259230 - RNA, 62 nt, Human
agggaacaaauaauguuucauccuauggaaaugugaaggaugaauugagcuccuggcccuuc

SEQ ID NO: 259231 - RNA, 62 nt, Human
uaugggaguauuaaaauagcuuaaaauuucucgugaaggacauguggcuaaagggucaaaaa

SEQ ID NO: 259232 - RNA, 62 nt, Human
cauuuaaaagcagauuuuuucaaaaucgauaugugaaggacuacagaaucaccuccucuuga

SEQ ID NO: 259233 - RNA, 62 nt, Human
guguaguaaagggacucaaguaauguuugacagugaaggauacaacuucauuccuugccugc

SEQ ID NO: 259234 - RNA, 62 nt, Human
gaaucaaccaaaggugauucuccuaaagagcagugaaggaaaugucagguuagcaggaccca

SEQ ID NO: 259235 - RNA, 62 nt, Human
uguacccgaucauaauaaaaauggauaauaaugugaaggaagaaaagagccgcuugaaucgc

SEQ ID NO: 259236 - RNA, 62 nt, Human
gcuugaaggagccaaccauggauuugaggcgugugaaggaauauuucuccuggcucuacuau

SEQ ID NO: 259237 - RNA, 62 nt, Human
gagaggagaacuaacccacacaggaucauuucgugaaggagcaaggcugaagaaccagaccu

SEQ ID NO: 259238 - RNA, 62 nt, Human
gaucgccaccagaaccauuugugaacugauuugugaaggaaaagucagucuuacuccaaaga

SEQ ID NO: 259239 - RNA, 62 nt, Human
uacauuaagaaugacuacacuguuccucguaugugaaggaggcagugcugacuccgugagug

SEQ ID NO: 259240 - RNA, 62 nt, Human
caaagagagggcuuuaauuuuuuuaaccaaaggugaaggaauauauggcagaguuguaaaua

SEQ ID NO: 259241 - RNA, 62 nt, Human
gcuggucaccuggauguacagaagucuaacuggugaaggaauaucauuuacagacauuaaac

SEQ ID NO: 259242 - RNA, 62 nt, Human
aaaaaucaguauuguuauuuuuuuccaagagugugaaggaaaauggggcauuccuuuccacu

SEQ ID NO: 259243 - RNA, 62 nt, Human
ugaguaaagccaucacacagaagagggcuguggugaaggaccagcauggaaaacgcauugac

SEQ ID NO: 259244 - RNA, 62 nt, Human
aauaggucuuuuuauuaggcagccagaauguagugaaggacaauuuauuauacuuuaugacc

SEQ ID NO: 259245 - RNA, 62 nt, Human
ccuugcccaucuucacucuagccuucguauuugugaaggacucagccaccuuccuucuucac

SEQ ID NO: 259246 - RNA, 62 nt, Human
uuugacuacauagacuaaaauauuccaugguggugaaggauguacaagcuugugaauaugua

SEQ ID NO: 259247 - RNA, 62 nt, Human
cuuaucaaccuugaaugacuacagauuauuuugugaaggaggaugaaguaauguguguucuu

SEQ ID NO: 259248 - RNA, 62 nt, Human
ggggagcccagcccggcagggaagaggccagcgugaaggaccugggcucuuggccguggcau

SEQ ID NO: 259249 - RNA, 62 nt, Human
aggcagcaccaggccagggguugauuugaaacgugaaggauuggguuuucaggcccucugcu

SEQ ID NO: 259250 - RNA, 62 nt, Human
ccauaaacuagcagaggacauugcauucuuuagugaaggacauuuauuuagagucugacaac

SEQ ID NO: 259251 - RNA, 62 nt, Human
ccagcacugcagaaaccacuccaggcaaaguagugaaggaaaaaagccugcucuccaguagc

SEQ ID NO: 259252 - RNA, 62 nt, Human
gguuuugugacuuucaacuuuuguacaguuaugugaaggaugaaaggugggugaaaggacca

SEQ ID NO: 259253 - RNA, 62 nt, Human
ggcuggcagggaaggaaagaacuugcauguuggugaaggaagaagugggguggaagaagugg

SEQ ID NO: 259254 - RNA, 62 nt, Human
uuugcuuuuguuuuuuuccucauguaacauuggugaaggauccaggaauaugacacaaaggu

SEQ ID NO: 259255 - RNA, 62 nt, Human
auuuugaugucuuuucuuuuggucggaagugagugaaggagccaggucgcccugaagguuuu

SEQ ID NO: 259256 - RNA, 62 nt, Human
guguguuugaacauuaugccaaauaucaagaugugaaggacuaauucaggaugcaaaaacgu

SEQ ID NO: 259257 - RNA, 62 nt, Human
cuaaugaaagggaaagucagcuuucagagccagugaaggagccacgugaauggcccuagaac

SEQ ID NO: 259258 - RNA, 62 nt, Human
gccuuccuuucuaaugacaaugacagguauuggugaaggagcuaauguuuaauauuugaccu

SEQ ID NO: 259259 - RNA, 62 nt, Human
gguaaaggaaauccucugauggacaggucagagugaaggaagguugugcugguaagacaucu

SEQ ID NO: 259260 - RNA, 62 nt, Human
ggacauuugaagaacugguaugcuacucacuggugaaggacagucaggugaaggacuguaag

SEQ ID NO: 259261 - RNA, 62 nt, Human
ugguaugcuacucacuggugaaggacagucaggugaaggacuguaagcccacacaagcucuu

SEQ ID NO: 259262 - RNA, 62 nt, Human
gccacggcuucagucagggccaggaggaacacgugaaggagaaagagaaaugcaggagccgc

SEQ ID NO: 259263 - RNA, 62 nt, Human
cguuuuugcuuagauuuuguucuaaucaccacgugaaggaaugagauuagcaccacaaguuu

SEQ ID NO: 259264 - RNA, 62 nt, Human
uaugccucucgccuuuugauaauaguuguucagugaaggaagucagcugccagaauauuaag

SEQ ID NO: 259265 - RNA, 62 nt, Human
uuuuuguuuacaagaauaauuagcaauacugagugaaggauguuggccaaaagcugcuuucc

SEQ ID NO: 259266 - RNA, 62 nt, Human
aacgugagacugcagaguuuguuuuucuauaugugaaggauuacaacacaaaaaguuauccu

SEQ ID NO: 259267 - RNA, 62 nt, Human
cagacuguacggcaaggcggcuacaugccucagugaaggacuaguaguuccugcuacaacuu

SEQ ID NO: 259268 - RNA, 62 nt, Human
augguucuguuggccaaggcuucucccugucggugaaggaucauguucaggcacuccaagug

SEQ ID NO: 259269 - RNA, 62 nt, Human
agcccuggggacuguuccaaagccagugaaaugugaaggaaagugggguccuucggggcgau

SEQ ID NO: 259270 - RNA, 62 nt, Human
caggucuucaugggcagggguuguggguccuggugaaggaagugcauccucaggccugggcu

SEQ ID NO: 259271 - RNA, 62 nt, Human
gagcugcaguucuuguggaagacacuugcugagugaaggaaaugaaucuuugacugaagccg

SEQ ID NO: 259272 - RNA, 62 nt, Human
gcaacucuacagucccucccuccuuucggaaggugaaggauacuggguuuuuagaugccuug

SEQ ID NO: 259273 - RNA, 62 nt, Human
gaaauaggaaggugggauuucuggggaggcuggugaaggagggcaggguucuuuucucuacg

SEQ ID NO: 259274 - RNA, 62 nt, Human
uggcagagaaggcuuccuccagcggcuggguggugaaggacccuggcucuucucucggggcg

SEQ ID NO: 259275 - RNA, 62 nt, Human
aggggcagacccugucgcugcguuucugaacugugaaggagcccauucgggugggagacuuc

SEQ ID NO: 259276 - RNA, 62 nt, Human
agcugagaggcacuauggauuagucuucugaagugaaggaaauauagaugucaccuaaguga

SEQ ID NO: 259277 - RNA, 62 nt, Human
gaggcagaagugggaguccagagccaggaacagugaaggaugguuccuggccccucugagug

SEQ ID NO: 259278 - RNA, 62 nt, Human
aucgacugacugcuugauucaggcuguucaaggugaaggauucaugagucuauauaaaggcu

SEQ ID NO: 259279 - RNA, 62 nt, Human
ccucccugaggauugacuucugcacuaauccagugaaggaggcugugucaaaagaagggcuc

SEQ ID NO: 259280 - RNA, 62 nt, Human
acuuuaauaauguugcgauggauugccacagugugaaggaaaugcaguguggggauaggacu

SEQ ID NO: 259281 - RNA, 62 nt, Human
auagaaaguacuuugugggaaccuuuauuacugugaaggagaaaaauagcuauuucuugaca

SEQ ID NO: 259282 - RNA, 62 nt, Human
agcuggagacuacuuuugugcuuuacaaaacugugaaggauuguggucaccuggaacagguc

SEQ ID NO: 259283 - RNA, 62 nt, Human
cgaguauugugauuuugcugaaaagacaaggugugaaggagcaacuucaguugacacaaaau

SEQ ID NO: 259284 - RNA, 62 nt, Human
auuugaauguguguguuuccguuuaacuuguggugaaggaagugugugacucagcuuggcug

SEQ ID NO: 259285 - RNA, 62 nt, Human
aaaagggaagaguuuuugugaugggggagagggugaaggaggucaggccccacuccuuccug

SEQ ID NO: 259286 - RNA, 62 nt, Human
cacucccugcucccaccuggaaccuugccagcgugaaggaggcuuccagguacuucacccug

SEQ ID NO: 259287 - RNA, 62 nt, Human
ucuguccuucaggagaggacaccagggugggggugaaggagacacuacugcccccaccccug

SEQ ID NO: 259288 - RNA, 62 nt, Human
ccugcaaggucuccagaaccccuuuggaaauggugaaggaaccagcccaauagaaguacaga

SEQ ID NO: 259289 - RNA, 62 nt, Human
uaguugaaaguucccuucuccacccaggggcagugaaggaggaggggcuuauagagcuggga

SEQ ID NO: 259290 - RNA, 62 nt, Human
ccugucuucugagcccgagccccucauuaccagugaaggacaugcuugagggguucgggaag

SEQ ID NO: 259291 - RNA, 62 nt, Human
ucccuuugugugggugggguuuguggguaguggugaaggaccgauaucagaaaaaugccuuc

SEQ ID NO: 259292 - RNA, 62 nt, Human
ugcugcauggcugucugcaugaaccacgccuggugaaggagccugggugagaaacaccaucc

SEQ ID NO: 259293 - RNA, 62 nt, Human
ggggauaaucuagaggcaggauuuuggacauugugaaggaaaugugcuccuucucagcucac

SEQ ID NO: 259294 - RNA, 62 nt, Human
aaugaaaggacucuuuacccuagaaggaagaggugaaggaucuggcuuguuuuuaaagcuuu

SEQ ID NO: 259295 - RNA, 62 nt, Human
uuuugacccugguuuuuggauuaaauuaguuugugaaggauuauggaaaaauaaaacuguca

SEQ ID NO: 259296 - RNA, 62 nt, Human
uauuuuggugacaaccuacuuugcuuggcugagugaaggaaugauauucauauauucauuua

SEQ ID NO: 259297 - RNA, 62 nt, Human
gccugcuauugcagaaugaagccauuuagagggugaaggagaaauacccauguuacuucucu

SEQ ID NO: 259298 - RNA, 62 nt, Human
cagauggccccgggcggcccagguccucuacugugaaggagcagggagcugccgagggacac

SEQ ID NO: 259299 - RNA, 62 nt, Human
gaauaaacaaaauugcugcaccaaugcacugagugaaggaagagagacagaggaucaagggc

SEQ ID NO: 259300 - RNA, 62 nt, Human
cacacugcuuccuuccuccagaaggucuuacugugaaggaaaaaaugucaguugaacuaaau

SEQ ID NO: 259301 - RNA, 62 nt, Human
aagagugggccgcuguguuuggagacggccaagugaaggagccagugcccacuauggcccug

SEQ ID NO: 259302 - RNA, 62 nt, Human
guuaaguuuauugaaguuuauucccuuaaucagugaaggacaacccuuauuuauuaccuaga

SEQ ID NO: 259303 - RNA, 62 nt, Human
uguugauugaauaaauguuagcucuucucauugugaaggacucacuuuuacugggauaaaca

SEQ ID NO: 259304 - RNA, 62 nt, Human
cugggccagugguacugagucuaagcacugcagugaaggaguuaguagaaaacagucuggau

SEQ ID NO: 259305 - RNA, 62 nt, Human
ugacaggaggagaauaaggcugaaagccucaagugaaggaucuugcagcuuguaaaagcaau

SEQ ID NO: 259306 - RNA, 62 nt, Human
ucucgcacuacaucugauaucaggaaauaucugugaaggacuuggugauuaccugaaagccc

SEQ ID NO: 259307 - RNA, 62 nt, Human
aggagagaguaggugguggugacgugagggcugugaaggauccagagacaagacuuagaugu

SEQ ID NO: 259308 - RNA, 62 nt, Human
aguuucccauuucccuuucuuagauugcaccagugaaggagauguuuugcaaagauucagag

SEQ ID NO: 259309 - RNA, 62 nt, Human
ucuguuccagcucuguaaaggucacaggaaucgugaaggagcugagaaaucuuccucuccgg

SEQ ID NO: 259310 - RNA, 62 nt, Human
uauccaaacagacguucacugccacuuguaaagugaaggauguaaacgaggauauauaacug

SEQ ID NO: 259311 - RNA, 62 nt, Human
aaccuauuaucuuuuauuuuuguuuguuuuuggugaaggauaagagugguguuucuuuugcc

SEQ ID NO: 259312 - RNA, 62 nt, Human
auguugaaagcuccuuuguugacugggucaaagugaaggaauuucaaucuccaucaguguac

SEQ ID NO: 259313 - RNA, 62 nt, Human
gucugaaugauuggggugaagacaucccuggagugaaggacuccucagcauggggggcagug

SEQ ID NO: 259314 - RNA, 62 nt, Human
caguagggugaguuaaguaugugcccucaggugugaaggagcacaggugagggggugccugc

SEQ ID NO: 259315 - RNA, 62 nt, Human
cugaugggcccucccaggcccgucaagcccuggugaaggagcuuagcuugucuucuuggcaa

SEQ ID NO: 259316 - RNA, 62 nt, Human
augcauagugggaggagaucagaccuuuacaagugaaggaaagcaacuucagaaaugaauua

SEQ ID NO: 259317 - RNA, 62 nt, Human
agagaugaaaaccagggcgguagaacuucagggugaaggacagaguccuggguggggcagcg

SEQ ID NO: 259318 - RNA, 62 nt, Human
ggccuggggugugacagcccugggagagccaugugaaggaggcagcuggcgccaucgcuccg

SEQ ID NO: 259319 - RNA, 62 nt, Human
cuugcuggguuuuaaugaggaaacaggaaagggugaaggaaauccuugucuaaggacugcac

SEQ ID NO: 259320 - RNA, 62 nt, Human
uccaugcgccugggagcacaaaggccccgguagugaaggaaccccccgucuccugagagugg

SEQ ID NO: 259321 - RNA, 62 nt, Human
ugaacacagacacgcagggagaaggcagccgugugaaggagucggagaucagagugagggac

SEQ ID NO: 259322 - RNA, 62 nt, Human
acugcuggcauuuaaugugcaguagugaaugagugaaggacuguaaucauaauaugcucacu

SEQ ID NO: 259323 - RNA, 62 nt, Human
uuuauuuuaguguuaaauguuuacaaaagacagugaaggauucuuaucacauaaugugcagg

SEQ ID NO: 259324 - RNA, 62 nt, Human
cggcgcccuggacuugguacaguugcaggagcgugaaggacuuagccgacugcgcugcuuuu

SEQ ID NO: 259325 - RNA, 62 nt, Human
auaaagaagaguaaacuuauuuuuuauagagggugaaggaugcuggaaggguaaggauuuag

SEQ ID NO: 259326 - RNA, 62 nt, Human
ccuauugcaauuugguccaacuauaucuucuggugaaggaaauuaaugauguaagaaaaugc

SEQ ID NO: 259327 - RNA, 62 nt, Human
uucaugaguuucuacuugagugagaaaacugggugaaggaauagaauuuuaaauaguaauaa

SEQ ID NO: 259328 - RNA, 62 nt, Human
auucuuagacuggcugccaaaggaugaagcuagugaaggagaaaaagcuuaaauuccaucuu

SEQ ID NO: 259329 - RNA, 62 nt, Human
gcugcccuaccugggaaggcaccccagcaccugugaaggacauuuacugcucauccucaccu

SEQ ID NO: 259330 - RNA, 62 nt, Human
ucccaaccuacagcauugacgccaacuuggcugugaaggaagaggaaaggaucuggccuugu

SEQ ID NO: 259331 - RNA, 62 nt, Human
cugggcucugaguguaaacuacaugguagguugugaaggaugcaaauaucgaaucaaucauu

SEQ ID NO: 259332 - RNA, 62 nt, Human
aauuuccaggacaaacaucuuuggaauugugagugaaggauauaguggcaggcuugucccuc

SEQ ID NO: 259333 - RNA, 62 nt, Human
uuaacagccaccuauagaagaguccaucugcugugaaggagagacagagaacucuggguucc

SEQ ID NO: 259334 - RNA, 62 nt, Human
acaguuuuagcugacaaagaagaaauuucagagugaaggaauuuuaaaaaucuggcugacgg

SEQ ID NO: 259335 - RNA, 62 nt, Human
guuuggaagccacaggcgauucuauggucaaugugaaggacuagaaauaaaaacccacaugu

SEQ ID NO: 259336 - RNA, 62 nt, Human
uccagucaacagugcuucccaaaguggguggugugaaggaagaggagguacauuaagagcua

SEQ ID NO: 259337 - RNA, 62 nt, Human
gauuguggauguguuuagaagguagauucgaugugaaggaugaaucuggcuugaccuucugg

SEQ ID NO: 259338 - RNA, 62 nt, Human
uuagagaaagcacagaaucccagauccagcuggugaaggagggaaggcuucaggccuuuaag

SEQ ID NO: 259339 - RNA, 62 nt, Human
agagacguaucagauuauguaaaauuaaauuugugaaggauguauagagucucaaacacuga

SEQ ID NO: 259340 - RNA, 62 nt, Human
acgugcaggucugcggaggggaaguguccugagugaaggaggggacccccauccugggggau

SEQ ID NO: 259341 - RNA, 62 nt, Human
agcacuuugaccacuauauccgcuucuguuuugugaaggaugaagccacgcuccaggccaug

SEQ ID NO: 259342 - RNA, 62 nt, Human
gcggaugcugccaggggcagugaaguguuuaggugaaggacaaguagguaagaggacgccuu

SEQ ID NO: 259343 - RNA, 62 nt, Human
gggugaccucaggccuagucccuuucccuugcgugaaggacacgccccacagaaggcuacgg

SEQ ID NO: 259344 - RNA, 62 nt, Human
gcugggcugcucccgccccagcccggcccagggugaaggaagaggcacgugcuccucagagc

SEQ ID NO: 259345 - RNA, 62 nt, Human
agcaagaugcccacacaacaggcuuauuuucugugaaggaaccaacugaucucccccacccu

SEQ ID NO: 259346 - RNA, 62 nt, Human
acaacgguuugcaagccaccaaauaccagggagugaaggauagugauucuugagagggcaaa

SEQ ID NO: 259347 - RNA, 62 nt, Human
agaaccagagaaacgaaagccauucccacaaagugaaggaacaguuuccaaaaccccugcga

SEQ ID NO: 259348 - RNA, 62 nt, Human
aacucggggaaaccagcccagcuaaguccggagugaaggagccucucugcuuuagcuaaaga

SEQ ID NO: 259349 - RNA, 62 nt, Human
ucuguuagcauaucauaaaguaagccuuucuggugaaggaagguugcuaugaaacuuuuuuu

SEQ ID NO: 259350 - RNA, 62 nt, Human
cuugacuacugagcaguuacaccaaggagagcgugaaggagaugauugagccagagaagaaa

SEQ ID NO: 259351 - RNA, 62 nt, Human
caaggugauauuuguauuguaaaacaauaauggugaaggaaauaaaaaggcuuuuaaaauuu

SEQ ID NO: 259352 - RNA, 62 nt, Human
gugucuucccucuugccaaaaggccuggggaggugaaggaagagagacuuuaggcaagcagc

SEQ ID NO: 259353 - RNA, 62 nt, Human
ccggccccagaaggaucuuccuggaugccaacgugaaggaaagcuacugcccccuagugccc

SEQ ID NO: 259354 - RNA, 62 nt, Human
ugaguccagaaccccugucacacagggaauaggugaaggaacuagggauauuuaacuggagc

SEQ ID NO: 259355 - RNA, 62 nt, Human
auguuuggaaccuuuagcacagauuugcuuuggugaaggacacgugucuucuaguucugccu

SEQ ID NO: 259356 - RNA, 62 nt, Human
uggacugagaauaguugaacaccgggggcuuugugaaggagucugggccaagguuugcccuc

SEQ ID NO: 259357 - RNA, 62 nt, Human
gcuggucuagguauuaaccccaggacucagaagugaaggagaaauggguuuuuuguggucuu

SEQ ID NO: 259358 - RNA, 62 nt, Human
aaguuguauuuuaaacguguuaggcuuuauaggugaaggacuuguuuugacuuaaguagaag

SEQ ID NO: 259359 - RNA, 62 nt, Human
cuacuguugggucccugauuccaggcuggccugugaaggauugccccagguguccccuuuca

SEQ ID NO: 259360 - RNA, 62 nt, Human
uugcuuuaucaguucauuccagcucccuguuagugaaggacacugcuguuagugaaggaaca

SEQ ID NO: 259361 - RNA, 62 nt, Human
cagcucccuguuagugaaggacacugcuguuagugaaggaacaaagucuaugaguccuaaaa

SEQ ID NO: 259362 - RNA, 62 nt, Human
uccuacauuaccacuacuacaugcuggcaaaggugaaggaucagaggacugaaaaaugauuc

SEQ ID NO: 259363 - RNA, 62 nt, Human
aggcccccugggccagcuccgagaaggcgccagugaaggaccagggaccaggccagggugcg

SEQ ID NO: 259364 - RNA, 62 nt, Human
ccuuugcugcugaugggcaucauuguuuaggggugaaggaggggguucuuccucaccuugua

SEQ ID NO: 259365 - RNA, 62 nt, Human
aaaagcuuccuugaugugagcucugggggagugugaaggaugcaucucuagcccccgaguaa

SEQ ID NO: 259366 - RNA, 62 nt, Human
uagagcccucaggcagacugaauucuaaaucugugaaggaucuaaggagacacaugcaccgg

SEQ ID NO: 259367 - RNA, 62 nt, Human
uuagucucagcacaggaauugaggugggucaggugaaggaagaguguauguuccuauuuuua

SEQ ID NO: 259368 - RNA, 62 nt, Human
ucaagaucccggagugguagcgcugucuccuggugaaggaguauuugucacacuggaaugug

SEQ ID NO: 259369 - RNA, 62 nt, Human
cgauccucuuaaggcauuaucagugagcaaaugugaaggaaauggugucuggaagaaaguuc

SEQ ID NO: 259370 - RNA, 62 nt, Human
gcaauccuugggggugcaggguggagcagaaagugaaggagggacacgugcaagaguggugu

SEQ ID NO: 259371 - RNA, 62 nt, Human
gcuacacuuuaaggaaagauugaaucuaagcugugaaggacaguauagaagacugcaccaag

SEQ ID NO: 259372 - RNA, 62 nt, Human
aacugcacacaacaggccugggagcgaacugugugaaggaccuuaauucaaaucagagaaaa

SEQ ID NO: 259373 - RNA, 62 nt, Human
ccuguuguuccugcaccacaucagauaagcaugugaaggagggccaacuggcagcugcggga

SEQ ID NO: 259374 - RNA, 62 nt, Human
uggcugaagcuuuugcaaguaggcuuugaggggugaaggagauugguggaggagaguaaaua

SEQ ID NO: 259375 - RNA, 62 nt, Human
auagaaagcugcuauuauguauauugucauuugugaaggaaguuggagagucacagcuuuac

SEQ ID NO: 259376 - RNA, 62 nt, Human
cagugcauauuaguggacagcacuuaguagcugugaaggaaggugcagagucagaagaugaa

SEQ ID NO: 259377 - RNA, 62 nt, Human
uaaaacagcuggagcauuuccuucccuuuccagugaaggagcagcauagugaaauccuggca

SEQ ID NO: 259378 - RNA, 62 nt, Human
ugggccuucuccgggaugaggcccuggcagaggugaaggacauggagcagcugcuggcccuu

SEQ ID NO: 259379 - RNA, 62 nt, Human
uccugaauccagcugugcacuuugcccaaguggugaaggaaugccgggcaguggucauugcg

SEQ ID NO: 259380 - RNA, 62 nt, Human
ccagcugagguagaggccagacuccuccaacagugaaggaaaaggcacaggugagaguauag

SEQ ID NO: 259381 - RNA, 57 nt, Human; identical to SEQ ID NO: 67230

SEQ ID NO: 259382 - RNA, 62 nt, Human
aguuauuauuaauauuuugaacacagguggaugugaaggauuuucauuuaaaaaccaagugg

SEQ ID NO: 259383 - RNA, 62 nt, Human
ugccuucaggaaguugugccagacccuagauugugaaggacccacuguucuucuguuguacg

SEQ ID NO: 259384 - RNA, 62 nt, Human
aauggaaaguaauuguugaccuccugcuuugggugaaggagacuguaagcugguacuugaga

SEQ ID NO: 259385 - RNA, 62 nt, Human
aaccaaaccagguguguucuacaccugcaugagugaaggauuuccacguagacaccuaggaa

SEQ ID NO: 259386 - RNA, 62 nt, Human
auuaugcuacuugugaggcagaagaguuuucugugaaggaaaaaagcccauuagaguucuuc

SEQ ID NO: 259387 - RNA, 62 nt, Human
ugaugucacugaaccagaaggguuuauacugagugaaggaaagguaaaaaguaguauuuugu

SEQ ID NO: 259388 - RNA, 62 nt, Human
agccaaguucgugccaucggacuccagccugggugaaggagugagacccugucuccaaaaac

SEQ ID NO: 259389 - RNA, 62 nt, Human
uucuaaagguaggaccaacacccaggggaucagugaaggaagagaaggccagcagaucacug

SEQ ID NO: 259390 - RNA, 62 nt, Human
guaggguagggccucugaggaggagggaaaaagugaaggagaggcuuuggaccuggugacag

SEQ ID NO: 259391 - RNA, 62 nt, Human
gaggagcuggggaucccucccccccaugcacugugaaggacccuuguuuacacauacccucu

SEQ ID NO: 259392 - RNA, 62 nt, Human
cccaacugaaaugaggagcuuccucucuuccugugaaggauaugacaguccagcaucgaugc

SEQ ID NO: 259393 - RNA, 62 nt, Human
auaccuaaggacuaauuuaaacacauaucaaugugaaggacuaauuuaaauuacuaucauuu

SEQ ID NO: 259394 - RNA, 62 nt, Human
uuaacccuggagaucugcaaauggagggaggggugaaggaggaaucuuaagaccgagggaga

SEQ ID NO: 259395 - RNA, 62 nt, Human
aaagagcuauuagccaaacugauucuaugcaggugaaggaugcacuaaaguucucacuuuag

SEQ ID NO: 259396 - RNA, 62 nt, Human
gaacauuuuauaaaacauacgaaaaagugauugugaaggauuuuuauuugcaugauuauagu

SEQ ID NO: 259397 - RNA, 62 nt, Human
auccacucaauugccuuauuccugaggauguagugaaggaagaaaaaguuuucuggaauucc

SEQ ID NO: 259398 - RNA, 62 nt, Human
uuccaaguuuguuuucacuuuuuugugugugcgugaaggagucugugucacccaggcugugu

SEQ ID NO: 259399 - RNA, 62 nt, Human
ucuuuguuaucuaaauguuucagaauucaaucgugaaggaacaggcauuuuacacuaugaag

SEQ ID NO: 259400 - RNA, 62 nt, Human
uucaacaaauauuuaccaaguuccuaauauaagugaaggaccacuucucauauuagauuacu

SEQ ID NO: 259401 - RNA, 62 nt, Human
gcugccuuaguugcuaguuuaguagccuuacugugaaggaauaauuaagauuguuucagacu

SEQ ID NO: 259402 - RNA, 62 nt, Human
accuuaccuucaaggagcaagugaagaacucugugaaggauggaacuuucagauaucaacua

SEQ ID NO: 259403 - RNA, 62 nt, Human
acagaguuuccuuacgaggagacuuggucacugugaaggagaaagagugagggcaaugaagg

SEQ ID NO: 259404 - RNA, 62 nt, Human
gguuuaccucaggaugacgugcagaaaaaugggugaaggauaaaccguugagacguggcccc

SEQ ID NO: 259405 - RNA, 62 nt, Human
uaucauggcaugacuuaagggaacauugguuugugaaggaaaaacagauuaucuaaagccau

SEQ ID NO: 259406 - RNA, 62 nt, Human
uauuuugugauuuaugugauuucuuuugcugagugaaggaaaggagaaauuguugcuauugu

SEQ ID NO: 259407 - RNA, 62 nt, Human
ccaccaaaaauaaaaucaaacaaaacuaaguugugaaggaagggagggaaggucauagccuu

SEQ ID NO: 259408 - RNA, 62 nt, Human
cugaaggggaugcuaaaggagauaaagccaaggugaaggaugaaucacagagaagaucugcg

SEQ ID NO: 259409 - RNA, 62 nt, Human
aauuuugucaauuaaaaaagcgugggagcagugugaaggagaagaggcaagaacgaccccug

SEQ ID NO: 259410 - RNA, 62 nt, Human
caacuaagaaccaaaauccagggcacucauaugugaaggauaagaaccucacuuccuuacuc

SEQ ID NO: 259411 - RNA, 62 nt, Human
aggagggaggaaagaugaaaaaccacuuaaaugugaaggaacaacagcaacaagaccaguau

SEQ ID NO: 259412 - RNA, 62 nt, Human
ccccagagaguuuggaguguaggauucccucugugaaggaaucaucucuacuucucugagga

SEQ ID NO: 259413 - RNA, 62 nt, Human
gaggaaguuuuaaaagaccuuaagcuggcauugugaaggaacaccaugguagacucuuuuug

SEQ ID NO: 259414 - RNA, 52 nt, Human; identical to SEQ ID NO: 67263

SEQ ID NO: 259415 - RNA, 62 nt, Human
cuuauugggugaggggacgagaugggguucaugugaaggaggaagcgaugccgagguaggaa

SEQ ID NO: 259416 - RNA, 62 nt, Human
cgcauacaggcucuagucaagaaugaauuagagugaaggaaagcugugugacaccuggcauu

SEQ ID NO: 259417 - RNA, 62 nt, Human
gcuucugagaauuguguuauuucacuugccaagugaaggacccccuccccaacaugccccag

SEQ ID NO: 259418 - RNA, 62 nt, Human
aggacguuuuggcuaugaucaucugauggcaagugaaggagaaaugagugauagggcuuugc

SEQ ID NO: 259419 - RNA, 62 nt, Human
auuaaaccgagguuauagaaggucaggggagagugaaggagucagugaccuaugucugccau

SEQ ID NO: 259420 - RNA, 62 nt, Human
aagugagaaugagaacugcugugauagggagagugaaggagggauaugugguagagcacuug

SEQ ID NO: 259421 - RNA, 62 nt, Human
ccagcuucccacuugccacucuccugucgagagugaaggaaguugaugcacagaauuuaccu

SEQ ID NO: 259422 - RNA, 62 nt, Human
uuugggaugagaacagcucugacggccgguaugugaaggagaacugcaaaccucugaagguc

SEQ ID NO: 259423 - RNA, 62 nt, Human
ccaggccagagccacccaaugaacagugcaaugugaaggaaggcaggagccugcaggggagc

SEQ ID NO: 259424 - RNA, 62 nt, Human
caucuuuguaggaaggucuggccuggggucgggugaaggagggcccaggucaguucuggggu

SEQ ID NO: 259425 - RNA, 62 nt, Human
cuuugccaccaaaaggcuuuucccugagaacagugaaggauguaugucauuuuguggugguu

SEQ ID NO: 259426 - RNA, 62 nt, Human
ggcauacaggcucuagucaagaaugaauuagagugaaggaaagcugugugacaccuggcauu

SEQ ID NO: 259427 - RNA, 62 nt, Human; identical to SEQ ID NO: 259426

SEQ ID NO: 259428 - RNA, 62 nt, Human
cagcggauggacagcuuggcucucccagagaggugaaggagcaccuggccuuaggaauccug

SEQ ID NO: 259429 - RNA, 62 nt, Human
gaucuguguugacucuggcauuuaguggcuuugugaaggaaagaaaccauuaaaugaccuga

SEQ ID NO: 259430 - RNA, 62 nt, Human
gcccugccugacgauguaucgaaaagaugagagugaaggagacuuugugcagcaggaaacgg

SEQ ID NO: 259431 - RNA, 62 nt, Human
acauuuggaaaauaguaacauugauauuucuugugaaggagaaguagaaaguaacagugacu

SEQ ID NO: 259432 - RNA, 62 nt, Human
gcccaauccuuccagacccaccagcuggaaaagugaaggaagcauguccacugacaaacggg

SEQ ID NO: 259433 - RNA, 62 nt, Human
gcuagagugccuugaaaaaauguguuggcuaugugaaggaauauuucaacuaaaauggaaug

SEQ ID NO: 259434 - RNA, 62 nt, Human
ccccccaugguguuuucauaugagguacuacugugaaggaucugguuccucauucacuguuu

SEQ ID NO: 259435 - RNA, 62 nt, Human
aaagcugccuuuaaauaucccuaggagacagggugaaggagacccuugacagccccagccua

SEQ ID NO: 259436 - RNA, 62 nt, Human
ucccagucagcccgcucgauccugaagaucgugugaaggaagcguucuuggugcuacacaca

SEQ ID NO: 259437 - RNA, 62 nt, Human
cuuucaccucuggcccaggagacugacccaaagugaaggacauugccgggagaggccugcag

SEQ ID NO: 259438 - RNA, 62 nt, Human
ugagcaaggcacgacccucagaucucagucuagugaaggagagaaaacuguaauaacacuac

SEQ ID NO: 259439 - RNA, 62 nt, Human
cccugggaaggggacccaaggaugaauuggcugugaaggauccucccugagacuggcaaggg

SEQ ID NO: 259440 - RNA, 62 nt, Human
guggcaggaggcaaagaguaggguguaauugagugaaggaauccuggguagagaccauucuc

SEQ ID NO: 259441 - RNA, 62 nt, Human
cuacugacaaguugcucuaguaacccaaagaagugaaggagaaagcagcugccucaccgccc

SEQ ID NO: 259442 - RNA, 62 nt, Human
uuucaauauaaaaggcacagcuguuggccaaagugaaggaaucuuuuuucaguuuuauugga

SEQ ID NO: 259443 - RNA, 62 nt, Human
aauaugcaaaugugaaauaaccgaucuauaacgugaaggaggcagacaugagcuguacuacu

SEQ ID NO: 259444 - RNA, 62 nt, Human
cccguggaggagcccaccagccccuucuucuugugaaggaaaucccguuuuuuucuagacag

SEQ ID NO: 259445 - RNA, 62 nt, Human
uccuccacaagaagguguuucccuguuguuaagugaaggaggccgccccugcccccaccuga

SEQ ID NO: 259446 - RNA, 62 nt, Human
gagagcaucaaaaggagcccacaccuucagcagugaaggauucuaacacagggaaucugcag

SEQ ID NO: 259447 - RNA, 62 nt, Human
caacaccauggccugcaaccccagggucaagggugaaggaaagcaagcucaccgccugaaca

SEQ ID NO: 259448 - RNA, 62 nt, Human
uauucuuaaagccaugguaaaaauagggaucugugaaggaaauuucuaaaauuggauguauu

SEQ ID NO: 259449 - RNA, 62 nt, Human
aaaaaaaaacacuuggcauacaaaauauuuaagugaaggagaagucuaacgcugaacugaca

SEQ ID NO: 259450 - RNA, 62 nt, Human
acuaaaacugaugaaaugcuaagacaugucuugugaaggaagguuucuuggagaccacuuuu

SEQ ID NO: 259451 - RNA, 62 nt, Human
uuugauauucagguuuccucaauuuagccuuagugaaggagggguuguacacacugccauuu

SEQ ID NO: 259452 - RNA, 62 nt, Human
agguggguggcauauuggggaccugggaaugugugaaggaggagaucaaauuucaguggcuu

SEQ ID NO: 259453 - RNA, 62 nt, Human
gagcugauggccuugguugagcugauggacaagugaaggaggccauggggcugugcuguccu

SEQ ID NO: 259454 - RNA, 62 nt, Human
agaagagcuugaaugggacgugcagcgagaaugugaaggauggagcagguagcucaucuggc

SEQ ID NO: 259455 - RNA, 62 nt, Human
auuguauuuaccuucuaccucuuggcugccuugugaaggaauuauucccaugaguuggcugg

SEQ ID NO: 259456 - RNA, 62 nt, Human
gcgaaaauguccgaggagaacugcuggcccuggugaaggaccugccgagucagcuggcugag

SEQ ID NO: 259457 - RNA, 62 nt, Human
uucucuggucuucuauuuuugguguuguucaagugaaggaagagauguucccucuaauuucu

SEQ ID NO: 259458 - RNA, 62 nt, Human
uaagccccuuuacccugguccuguacugaucagugaaggaaaccgugguuacugaggcccug

SEQ ID NO: 259459 - RNA, 62 nt, Human
ggaagaaggagacgccccuccaacuggcgggugugaaggaagccgcccagggguccgggcug

SEQ ID NO: 259460 - RNA, 62 nt, Human
ccguguucgucgggaaucaggauuauugagaggugaaggagccagguggcuucauucuggcg

SEQ ID NO: 259461 - RNA, 62 nt, Human
cugcauggcuuucgcaaagucacuagcuuuuggugaaggaucugccaggguguccugggcag

SEQ ID NO: 259462 - RNA, 62 nt, Human
ggggucguugauuucaacuggauugagagacugugaaggaacucgguuacaaauccauaaca

SEQ ID NO: 259463 - RNA, 62 nt, Human
uggugaacucuuaaggacuuuucccuucaagugugaaggaaggugugaugaaugcuguggag

SEQ ID NO: 259464 - RNA, 62 nt, Human
ugaauucaugguaggaucacucgcaaggccuugugaaggagucuuaccuaaaacgaaagaaa

SEQ ID NO: 259465 - RNA, 62 nt, Human
ggccucuguccccagcggugagguugcagugagugaaggagaggaggugaucuguucucccu

SEQ ID NO: 259466 - RNA, 62 nt, Human
aaaucacugugaaauuucaugauuggcuuaaagugaaggaaauaaagguaaaaucacuucag

SEQ ID NO: 259467 - RNA, 62 nt, Human
ucaaaacugccaugccccccugugaugcucccgugaaggaaugcacuuugccuuguaaguuc

SEQ ID NO: 259468 - RNA, 62 nt, Human
cacagugcauccagagcaugacccgccugguggugaaggaacggaaucgcaaguaugaccag

SEQ ID NO: 259469 - RNA, 62 nt, Human
aacuuggcaaggauuacauucuagagcuaaaagugaaggaaacgucucaagugacuuugguc

SEQ ID NO: 259470 - RNA, 62 nt, Human
uaauauccccaaauuagggcaauuggaacaaagugaaggacauagagguauauuggaagagg

SEQ ID NO: 259471 - RNA, 62 nt, Human
uacuugucacauauuugaagaaauuccauacagugaaggaaauuugagucuguauugcugcu

SEQ ID NO: 259472 - RNA, 62 nt, Human
cccucucugcugccuugggguuggcagaacacgugaaggauccgaggagcgagaggaauguc

SEQ ID NO: 259473 - RNA, 62 nt, Human
gaaauaagcccugcugcuuucuagaaauaagugugaaggauaaauuuucuuuguugaccuau

SEQ ID NO: 259474 - RNA, 62 nt, Human
aucccugaaaauggugaggaggguggggggaagugaaggaaagacaagcagggcuaauucca

SEQ ID NO: 259475 - RNA, 62 nt, Human
caauauguagcagucucucuggauggcggagagugaaggagacggagaaacgcgccccaucc

SEQ ID NO: 259476 - RNA, 62 nt, Human
aggcucgcucuugcgcggugccugagaagagggugaaggagcuggggcaggccccauccugg

SEQ ID NO: 259477 - RNA, 62 nt, Human
uuggguugggauuuugguuucuuccuuuccucgugaaggauaagagaaacaggcccgggggg

SEQ ID NO: 259478 - RNA, 62 nt, Human
ggccauauguucaccugcuuuccuguccguuggugaaggaauuucagaauucauuuuauauc

SEQ ID NO: 259479 - RNA, 62 nt, Human
aauuucauauccagccaaacuaagcuucauaagugaaggagaaauaaaauacuuuacagaca

SEQ ID NO: 259480 - RNA, 62 nt, Human
aaaagaucuuucagaaaauauuauccuuuaaagugaaggagaguauuuauauuaaagaugaa

SEQ ID NO: 259481 - RNA, 62 nt, Human
gagcuagcugaguaugcugaaauccgggucaagugaaggagcugggggcagccugcguggcu

SEQ ID NO: 259482 - RNA, 62 nt, Human
ccaggcccaguacggaggacgcuggggaaauggugaaggaaacagaaaaaaggucccugccc

SEQ ID NO: 259483 - RNA, 62 nt, Human
ugcuuuuuuuuguacggaauagauaauuaagagugaaggaguugaaacuuuucuuguuagug

SEQ ID NO: 259484 - RNA, 62 nt, Human
uucugggacauuguuggucucauguuaugccugugaaggauuuguccagccuucauguuacu

SEQ ID NO: 259485 - RNA, 62 nt, Human
uguugggggggaaaguacugugaauaaugugugugaaggacuuuauuccgacuaauacucuu

SEQ ID NO: 259486 - RNA, 62 nt, Human
agaaaucacugaaauuucaugauuggcuuaaagugaaggaaguaaagguaaaaucacuucag

SEQ ID NO: 259487 - RNA, 62 nt, Human
ggaucauugauugggugaagaucauugauuaggugaaggauuauuucuauccaauuugugaa

SEQ ID NO: 259488 - RNA, 62 nt, Human
uuucuucaguguuauggcuauagagagccuuugugaaggagccgucugccuaaaguuaaacc

SEQ ID NO: 259489 - RNA, 62 nt, Human
uagagaugaggaggaguaaaagugaaauuuuugugaaggacuuaaauuauccaguguuucuu

SEQ ID NO: 259490 - RNA, 62 nt, Human
gugauggugguuucugaagccccaugucccuggugaaggaggacugaaccaaggacucugug

SEQ ID NO: 259491 - RNA, 62 nt, Human
cccgggaggggcuuauguuacaaggugaucaagugaaggaaaaaccugagccuaucuggcug

SEQ ID NO: 259492 - RNA, 62 nt, Human
ugacuccucuugguuugguuugaaguuuuucagugaaggaaaaggccugagauaggaagcag

SEQ ID NO: 259493 - RNA, 62 nt, Human
ggccuugaaaauccuugcccuuaucauuuggggugaaggagacauuucuguccuuggcuucc

SEQ ID NO: 259494 - RNA, 62 nt, Human
cucagaaacagacugaauuugaucugauuaaugugaaggacuggccagucugggaaaccgcc

SEQ ID NO: 259495 - RNA, 62 nt, Human
ugggguuggcgggaccugcuggugacgugcaggugaaggacaggaaggggcaugugagcgua

SEQ ID NO: 259496 - RNA, 62 nt, Human
caauacggaacacugucaauggacugcaccuugugaaggaaaaacaugcuuaagggggugua

SEQ ID NO: 259497 - RNA, 62 nt, Human
cacccagcuggucucauacauagacagcacuugugaaggauugaaugcagguuccaggugga

SEQ ID NO: 259498 - RNA, 62 nt, Human
ugugccgcuggcaugagggccguguccccacugugaaggaugaagagcaaggcccucaggac

SEQ ID NO: 259499 - RNA, 62 nt, Human
uuuaaagaguaaauuauuuguggcuuugcugagugaaggaaggggagcaagggguggugccc

SEQ ID NO: 259500 - RNA, 62 nt, Human
ccuccccucccucuucagucauugcugugcgugugaaggaagagcaucuagacguggccucg

SEQ ID NO: 259501 - RNA, 62 nt, Human
ugccgcccgcccacuccguuucccugugguccgugaaggacggccucaggccuuggcauccu

SEQ ID NO: 259502 - RNA, 62 nt, Human
acggcaugaggacagagggaggggcacggggagugaaggagggggcccuggggcaaggcucg

SEQ ID NO: 259503 - RNA, 62 nt, Human
uuuaaaccuuucccuggccuuucccauagcuggugaaggacaccuccauccauuccacgcag

SEQ ID NO: 259504 - RNA, 62 nt, Human
cagagaaugaucacccugaauucauugucucagugaaggaagaaccuguagaagaugaccuc

SEQ ID NO: 259505 - RNA, 62 nt, Human
ugccccgguagccucgagagcaccccuugccggugaaggaugcggcaggugcucuguggaug

SEQ ID NO: 259506 - RNA, 62 nt, Human
cccaugacuuacagccgguucuuaccucuuaggugaaggagaugacauguuuuuagaauugc

SEQ ID NO: 259507 - RNA, 62 nt, Human
uccgaccccuuucccagcccacagggcuugaagugaaggaacagaggcagggggugggccag

SEQ ID NO: 259508 - RNA, 62 nt, Human
ccggggagcagggucaugaacuuuuuucuuuagugaaggaggaauacaaucaaggguuuugu

SEQ ID NO: 259509 - RNA, 62 nt, Human
cccucuuccuaaggacagggguaacagucaaagugaaggaaugauggguucuugccugucuu

SEQ ID NO: 259510 - RNA, 62 nt, Human
aaagggacaggcaguaguguucaacagugcaugugaaggaaaguucuguuuuccaugguuuu

SEQ ID NO: 259511 - RNA, 62 nt, Human; identical to SEQ ID NO: 259253

SEQ ID NO: 259512 - RNA, 62 nt, Human
gugguuaaagagggcagucacuguuccaaggagugaaggacuggguguuacuggagggaaca

SEQ ID NO: 259513 - RNA, 62 nt, Human
ggaaaaugcucugauucucuguuuaggcauuugugaaggauuccagagccuuucccaaagug

SEQ ID NO: 259514 - RNA, 62 nt, Human
acauuuguauauuacauauauggacauaacuugugaaggaugaaagaaaguacagccucucg

SEQ ID NO: 259515 - RNA, 62 nt, Human
uacugugugcuaaaacaagcacuaaacaaagagugaaggauuuauguuuaauucugaaagca

SEQ ID NO: 259516 - RNA, 62 nt, Human
aaaugacuugucugagauuaguuuucaggcaugugaaggacuuauacucacaugcuagcccu

SEQ ID NO: 259517 - RNA, 62 nt, Human
ugugguguuacuguaggaauuuucuugaaacugugaaggaacucugcaguuaaauaguggaa

SEQ ID NO: 259518 - RNA, 62 nt, Human
uuuuuuaagugaaauuuauugaggaaaaauaugugaaggaccuucacucuaagauguuauau

SEQ ID NO: 259519 - RNA, 62 nt, Human
uggacacuaacacacaggcacucaaugaaugagugaaggaaauaaaagucaccccguuggug

SEQ ID NO: 259520 - RNA, 62 nt, Human
gagaaaaacggugguagccauggaaaucgggagugaaggagcacugcuucauuguggcucag

SEQ ID NO: 259521 - RNA, 62 nt, Human
uauuuuaugugagccuucaguaaaaucuuugugugaaggauuggaaaaggcuauuuuccaac

SEQ ID NO: 259522 - RNA, 62 nt, Human
aaagcccuuuaagagucaugguaaggagaugggugaaggaaaauuuagcaacagguaauuga

SEQ ID NO: 259523 - RNA, 62 nt, Human
ccaucccugugaaggaguaggccacucuuuaagugaaggauuggaugauuguucauaauaca

SEQ ID NO: 259524 - RNA, 62 nt, Human
gcuggagggcuauggauucccagcccaucccugugaaggaguaggccacucuuuaagugaag

SEQ ID NO: 259525 - RNA, 62 nt, Human
gagcccaaguugaagagaagagacgcccauccgugaaggagcagaccauccauccgauccuc

SEQ ID NO: 259526 - RNA, 62 nt, Human
uugcauuuuaaaguauuucggguaaaggugaagugaaggauuuucgucuuuauaauuucugu

SEQ ID NO: 259527 - RNA, 62 nt, Human
uuuaagaugaucaucuaauuuuauuuugugaagugaaggauuuguguuuuaguuggcaguug

SEQ ID NO: 259528 - RNA, 62 nt, Human
uggugguggauacuaauacaguucuguacgaugugaaggaugugucuuugcuauuucuuguc

SEQ ID NO: 259529 - RNA, 62 nt, Human
agcaacaagcauguccuuguaguacagguacagugaaggauagaacacacuuucguugauac

SEQ ID NO: 259530 - RNA, 62 nt, Human
uucaacugaguuucguuuuguuaaacaguucagugaaggagaaagcaccugugauauauggc

SEQ ID NO: 259531 - RNA, 62 nt, Human
ccgaguccuugcagcuggucuuuggcauugacgugaaggaagcggaccccaccagcaacacc

SEQ ID NO: 259532 - RNA, 62 nt, Human
cauagauuucauaguauuuuucugagaauccugugaaggaacgcugucucuuugcaaaguaa

SEQ ID NO: 259533 - RNA, 62 nt, Human
aagggaaaggcuaccgcgaagaggucuugaccgugaaggaaauuaccugagacccagagggu

SEQ ID NO: 259534 - RNA, 64 nt, Human
ucuaagauggauuaaacaaguauaaaauaaaauacauuuauaaaauaaaaaggaaaacagacuu

SEQ ID NO: 259535 - RNA, 57 nt, Human
aguucuucuaauugagacugacuccaaggccacaaacuguucaacacacacaaagug

SEQ ID NO: 259536 - RNA, 57 nt, Human
acuagaggacuugaaagagaacugaggggccacaaaauaaacuucaccuuccauuaa

SEQ ID NO: 259537 - RNA, 64 nt, Human
gcuccucccugugucuuugcuguucuucagacuccauuuauagagaaugagggcugauaacagg

SEQ ID NO: 259538 - RNA, 64 nt, Human
cguacauagggcauuuugcaaggccuugcaaaugcauuuauaccuguaaguguacagugggcuu

SEQ ID NO: 259539 - RNA, 64 nt, Human
gucuucuccuuuuccaaacaccacacguugaaagcauuuauaaauccaagucugaaacucugcg

SEQ ID NO: 259540 - RNA, 64 nt, Human
ugaaaugggggcaggaaagccacaucuugcucugcauuuauaaagaccguacaaacucagaucc

SEQ ID NO: 259541 - RNA, 64 nt, Human
ucucacaaaaauucacauuauuaagaccuaaguucauuuauacuuacaaguuauaguuuaaaau

SEQ ID NO: 259542 - RNA, 64 nt, Human
cuuauaccuuuagauaaucaguaugaaaaguucccauuuauaauggaaaugaaaauucuuaacu

SEQ ID NO: 259543 - RNA, 64 nt, Human
ccuguagggggcgauauacuaaauguauauaguacauuuauacuaaauguauuccuguaggggg

SEQ ID NO: 259544 - RNA, 64 nt, Human
gggagggcaugagggaacacuucuuaugagaaaacauuuauaaacaaaagaaacauuuauaaac

SEQ ID NO: 259545 - RNA, 64 nt, Human
cuucuuaugagaaaacauuuauaaacaaaagaaacauuuauaaacuaaagaaaaacuaaaagaa

SEQ ID NO: 259546 - RNA, 64 nt, Human
guuaaauuauaauauucaaauaucuauuuaaagacauuuauauuaauuugaaauaauaacauau

SEQ ID NO: 259547 - RNA, 64 nt, Human
gaauucuuucauugcuauauaauauucaguggcucauuuauaccuaauaaaauaaugguauuuu

SEQ ID NO: 259548 - RNA, 64 nt, Human
augucuauucccagcccugggaggaagggggagucauuuauauucugcaggaggaaggggcccc

SEQ ID NO: 259549 - RNA, 64 nt, Human
gaagagacuuguuucaucuccggaaaugcaaaaccauuuauagcaugaagcccuacaugaucac

SEQ ID NO: 259550 - RNA, 64 nt, Human
cuauugcccagggaugucauuguaaauauaugugcauuuauaaauaauuuuuguauucauugac

SEQ ID NO: 259551 - RNA, 64 nt, Human
uagccuuguuuuuugcaucuuucucacucccauacauuuauauuauauccccacuaaauuucuu

SEQ ID NO: 259552 - RNA, 64 nt, Human
uguagaccuuaauacucagguuaaauauucauugcauuuauaagaucuucugcaaaaagcccag

SEQ ID NO: 259553 - RNA, 57 nt, Human
uuucacaccauuaauggggaaaagcguggccacaaaaacagaugcuaggaagcuugg

SEQ ID NO: 259554 - RNA, 57 nt, Human
cugugccuuauggagggguccggcagcggccacaauugucuuguccccucacccccc

SEQ ID NO: 259555 - RNA, 57 nt, Human
ugaaaacauuaaugauacaugaaucuuggccacaaugagaaaaauaaaaaugaaaaa

SEQ ID NO: 259556 - RNA, 57 nt, Human
gccguggacauagcuuccaaggagugcggccacaagccggugccagcaugagagcag

SEQ ID NO: 259557 - RNA, 64 nt, Human
ucucuguggggcucuucaccaauuuuuccagccucauuuauaguaaacaaauuguucuaaucca

SEQ ID NO: 259558 - RNA, 64 nt, Human
gagucaggcccggccuauugcuugggucucucuccauuuauauaucuaaguucacaguguuucu

SEQ ID NO: 259559 - RNA, 64 nt, Human
uugguuuuauuuuaaauuaaauauuaaaauuacacauuuauauugaaauccuugguuugucuuc

SEQ ID NO: 259560 - RNA, 64 nt, Human
uguauugaacuuauucuaaaggcuuaugcuaacccauuuauaauugguaaaaaucagaaaauac

SEQ ID NO: 259561 - RNA, 64 nt, Human
caguuuguauauuuguagguaacuccagcuguugcauuuauacugggaaucuucauaagaagcu

SEQ ID NO: 259562 - RNA, 64 nt, Human
uuaauuaaugcuuuuuaguuuaaauaaauugaaucauuuauaauaaucaguguuaacaauuuag

SEQ ID NO: 259563 - RNA, 64 nt, Human
uauauucuguaaaaccuucuauuugaugucauuccauuuauaaucagaaaaaaaacuuauuucu

SEQ ID NO: 259564 - RNA, 64 nt, Human
ccugaauucuggauuuuguccuacaagucugugccauuuauaagcuaaguugaggguucagagg

SEQ ID NO: 259565 - RNA, 64 nt, Human
guaauacaaaaguuuugagcucuuccaaguauaccauuuauauacaaacaaauagguuuauuca

SEQ ID NO: 259566 - RNA, 64 nt, Human
aacuauugaauuuguaagcugcuaugcaaaugggcauuuauauaaacuugugauguuucuuguc

SEQ ID NO: 259567 - RNA, 64 nt, Human
aaguauguguaaaaaugugaugcucagauaaguacauuuauaucaguucaguguuaaaaugcag

SEQ ID NO: 259568 - RNA, 64 nt, Human
aauuuuuuuaauuuuacaaguacauuuaacagaucauuuauaaagcaggaguccauuuuaacac

SEQ ID NO: 259569 - RNA, 64 nt, Human
uugaagugagaagaugauccacaacuugagaagacauuuauaauacaaauaacugaugaaggau

SEQ ID NO: 259570 - RNA, 64 nt, Human
uacaaacagcuuaaagauuugcaugugcagugugcauuuauaacaaacuucuaauugcacaaaa

SEQ ID NO: 259571 - RNA, 64 nt, Human
augccuacaugugauauaaauuaauauuuauauucauuuauauuuauauuuuugaacuuauuua

SEQ ID NO: 259572 - RNA, 64 nt, Human
cccccuggugggggauuggggaucuguguuuagccauuuauaucuacuuuagcuguuaaagagg

SEQ ID NO: 259573 - RNA, 57 nt, Human
agaaauccuggccucugcucaugcgcaggccacaaccgggcuggaagugcgguugag

SEQ ID NO: 259574 - RNA, 57 nt, Human
caaaaauaacuauuugacuauaauauaggccacaaaaaaucuugauauaacuccuag

SEQ ID NO: 259575 - RNA, 57 nt, Human
aauuuauaauuccauauuuauaauguuggccacaacauuaugauuauuccuugucug

SEQ ID NO: 259576 - RNA, 57 nt, Human
aacccugagaggcaggugguaggccauggccacaauccccagcugaggagcaggugu

SEQ ID NO: 259577 - RNA, 64 nt, Human
ggcucuggcacaaaaccuccuccucccaggcacucauuuauauugcucugaaagagcuuuccaa

SEQ ID NO: 259578 - RNA, 64 nt, Human
guaccugacuaaaaaugaaguaauacccuuaaaccauuuauaauuucuaguauuucucugaaag

SEQ ID NO: 259579 - RNA, 64 nt, Human
gcaaaggccucccugcauuugaagagcagguuuucauuuauauguauuuuugggauaaaaaaau

SEQ ID NO: 259580 - RNA, 64 nt, Human
agcccacccccuccucaggaacucaagagcucagcauuuauaaugagcaguugguaaugaguug

SEQ ID NO: 259581 - RNA, 64 nt, Human
aguuuggauuguaucaaguggcaugugcugugaccauuuauaauguuaguagaaauuuuacaau

SEQ ID NO: 259582 - RNA, 64 nt, Human
ucuacugucucguccgaauuagccuugggaaaaucauuuauaugcuaaauaauuuaccuuuuua

SEQ ID NO: 259583 - RNA, 64 nt, Human
ucacuuuaaguucguauuuuuuaauuuauauuaccauuuauagauucauuuuggaaccauuuua

SEQ ID NO: 259584 - RNA, 64 nt, Human
cauuuguuuuuuaacaguaacguggcuaggcuuccauuuauaagucuuagcauuauuuccuuug

SEQ ID NO: 259585 - RNA, 64 nt, Human
aggaguccauccuugagagaguggguguaguuaucauuuauacaguaaucauugcauuuuaaaa

SEQ ID NO: 259586 - RNA, 64 nt, Human
ucugaguauccauguguucucuuuguuuggcccccauuuauaagugagaacaugugguauuugg

SEQ ID NO: 259587 - RNA, 64 nt, Human
caaugcucacuacacaguuuagaauagacguucucauuuauauuaucuuccaaauuugaucagu

SEQ ID NO: 259588 - RNA, 64 nt, Human
caucaugaaugaacuauaauuuuuaaguuaugcccauuuauaacguuguuuaugacuacauugu

SEQ ID NO: 259589 - RNA, 64 nt, Human
auuugagagaagguauaggugaucggaucuguuucauuuauaaaagguccaguuuuuaggacua

SEQ ID NO: 259590 - RNA, 64 nt, Human
aucccauuuauuucuuuaaaaaauguaaggauuucauuuauauugaaaaauaauauuaaucauu

SEQ ID NO: 259591 - RNA, 64 nt, Human
ugguguuugugaaacauuuuuaaaaauguaguuucauuuauauuaguuauguuugauaaauguc

SEQ ID NO: 259592 - RNA, 64 nt, Human
ccuggaauuuuuccccuuugauucacaguggucccauuuauaucugcuucuagcuuagugcuau

SEQ ID NO: 259593 - RNA, 57 nt, Human
ugccuagcccaggaugaagggcuggguggccacaacugggaugccaccuggagcccc

SEQ ID NO: 259594 - RNA, 57 nt, Human
uauuuugauucucauugccauucuuauggccacaagcaaaguaaugguucucauagu

SEQ ID NO: 259595 - RNA, 64 nt, Human
ucaccucucacccucuccuucccgggaggcccugggaggugaucauugacacccagccaagcag

SEQ ID NO: 259596 - RNA, 64 nt, Human
gaggccccuccugccuggcccugcuccccaguggggaggugacuguguuucccagagugugagc

SEQ ID NO: 259597 - RNA, 64 nt, Human
ugauggccaaauuuuaaaauguuauuuuucauaucauuuauaaucuugucacaauccacuuaaa

SEQ ID NO: 259598 - RNA, 64 nt, Human
gcuguuccccugcucuguugccucucuaagguaacauuuauagaagaaauggaaugaaucucca

SEQ ID NO: 259599 - RNA, 64 nt, Human
uuaguuggaguugucuuuuugagagcucaucauucauuuauagauggugccaaagcuaaccuua

SEQ ID NO: 259600 - RNA, 64 nt, Human
uuauucuugagcacaaaaugauaaucaauuauuacauuuauacaucaccuuuuugacuuuucca

SEQ ID NO: 259601 - RNA, 64 nt, Human
gagcuaucuguuccucauagugccaguguguuuacauuuauaggaccacauaucccugguuucu

SEQ ID NO: 259602 - RNA, 64 nt, Human
augaaugggagggagagauuugaguccaagcauacauuuauauucaguguugugccauugaguu

SEQ ID NO: 259603 - RNA, 64 nt, Human
uuugaaauaagaaauaacucuuuuacuagugauucauuuauacagauauaguaucucugugcgg

SEQ ID NO: 259604 - RNA, 64 nt, Human
ccuaacuauuuaacaucagcuggaaagaagggaacauuuauauugcccaucuccugugucuuca

SEQ ID NO: 259605 - RNA, 64 nt, Human
guaggacucaauaguaaaugcugucugucuuacacauuuauaaggacccugcaagacgacgaca

SEQ ID NO: 259606 - RNA, 64 nt, Human
aggcaauuuuucuauuuuauauuaagacuucauacauuuauauauguaaauauggcuuauuaau

SEQ ID NO: 259607 - RNA, 64 nt, Human
uuuguuugguguaaguagguugugugaguuaauucauuuauauuuacuaugucuguuaaaucag

SEQ ID NO: 259608 - RNA, 64 nt, Human
gccucagaaugcauucuuacacaucuauccuagacauuuauaagcacucuaauggauaacaauc

SEQ ID NO: 259609 - RNA, 64 nt, Human
ugacuugggaugacauauuacaugcuguaguuaacauuuauaauucuuuuuccuuguuugagua

SEQ ID NO: 259610 - RNA, 64 nt, Human
ucaguacuuuuuucucauguaucuuucucuagaccauuuauauacgggugaaaugaaagcuuuu

SEQ ID NO: 259611 - RNA, 64 nt, Human
gaaaacuccagugaacucccaaggacauuuacaacauuuauauucacacgcuguauggaagggu

SEQ ID NO: 259612 - RNA, 64 nt, Human
cuacaacguugcuaauuuauuuccuuuugauaugcauuuauauaggcaacucgauauaggaugg

SEQ ID NO: 259613 - RNA, 64 nt, Human
cgcacaaaaaauaaaguuaagucugagacucuaaggaggugaaaugaaucccaaaugcauuuuu

SEQ ID NO: 259614 - RNA, 64 nt, Human
ccccauuuucauacucuucccagggauuagugauggaggugaggucucccuaaucaugguaaag

SEQ ID NO: 259615 - RNA, 64 nt, Human
gugugaauguugacguucguuucauggagaaaggggaggugaaagauugaagagcagguuccug

SEQ ID NO: 259616 - RNA, 64 nt, Human
gagagcagacguggcuuuuuaugugucuuguuggggaggugacuugcaugguggggacaaggcu

SEQ ID NO: 259617 - RNA, 64 nt, Human
ucuaagaggauauauuuugagaccaauuuaauuucauuuauaagaacauaguaauuaagugaac

SEQ ID NO: 259618 - RNA, 64 nt, Human
cucguuuaaguaugguucuuaauuacauuucauucauuuauauuagaguaaauggcuucauaac

SEQ ID NO: 259619 - RNA, 64 nt, Human
aaugauucuguuccuugugugcuuacuuccuuaacauuuauacauuguuuuaagaaaaaacuuu

SEQ ID NO: 259620 - RNA, 64 nt, Human
uagagaugaauuaggggacacugucuuauggauucauuuauaagaagagaaccagccauauaca

SEQ ID NO: 259621 - RNA, 64 nt, Human
uaauuuuugauauucauauaauuaauagaaguugcauuuauauuuuuuauggggcauaguuccu

SEQ ID NO: 259622 - RNA, 64 nt, Human
auguuaacaguauaccaguaacagcacuuuaucucauuuauaugaacaccuuugaggugcuacu

SEQ ID NO: 259623 - RNA, 64 nt, Human
cuauaaauacuugauuguaaacuaaauucaagaucauuuauaggaaaaucuaguuucacagcua

SEQ ID NO: 259624 - RNA, 64 nt, Human
aacuuuaauuuuuccccauaacuuuuauaagucccauuuauaaacccacuuuuaaaaauaacag

SEQ ID NO: 259625 - RNA, 64 nt, Human
uaaccaccaaauguuauuagaauuuuucuucuagcauuuauaauuuuuucaacuccuauugugu

SEQ ID NO: 259626 - RNA, 64 nt, Human
guauaauagcauagauuuuccuucaaaaaaugaacauuuauauaucuacaaaaauauggagaag

SEQ ID NO: 259627 - RNA, 64 nt, Human
aauuuucaauuuauggugaugaucugcugauaugcauuuauaaaguaagcucuguuguacaguc

SEQ ID NO: 259628 - RNA, 64 nt, Human
gcauacaugcaaaaagaaaugacuaauuaggguacauuuauaauugcaucuagguaauuuuuac

SEQ ID NO: 259629 - RNA, 64 nt, Human
auagggagauccaaaguccugugguuaacgccuucauuuauagaugaggcagcugaggccuggg

SEQ ID NO: 259630 - RNA, 64 nt, Human
aggaaugaagaacaacaacucucaguggugccugcauuuauaauuauuuaugugaaagucaaau

SEQ ID NO: 259631 - RNA, 64 nt, Human
gaaaauuaguuggcuggacauugauaaaauaaugcauuuauaacaauuacauguguuucuggga

SEQ ID NO: 259632 - RNA, 64 nt, Human
aaaucacccaaucuuuuuuguguuucucuaaagucauuuauacauuaaauguaauuauagcaac

SEQ ID NO: 259633 - RNA, 64 nt, Human
ggggagcaccucugcccggccgcgaccccauuugggaggugaggagcaacucugcccagccgcc

SEQ ID NO: 259634 - RNA, 64 nt, Human
uuuucauuucucaggaugcuucuuaccugucagaggaggugacaaggcagucucuugcucucuu

SEQ ID NO: 259635 - RNA, 64 nt, Human
aaguaucucagccugcagucaguuauuauguauaggaggugagcuaguuaacaaacuuguacca

SEQ ID NO: 259636 - RNA, 64 nt, Human
uuaaaacagacauuccacagggccugggccccugggaggugagguguggugugcggcuucaccc

SEQ ID NO: 259637 - RNA, 64 nt, Human
auuaaauauuaaaauaucuauuuauuauuaaaaccauuuauaaggcuuuuucauaaauguauag

SEQ ID NO: 259638 - RNA, 64 nt, Human
auugacauuauacacugaagucuuaacauuuuaacauuuauagugcuuauuugcaaaauuguau

SEQ ID NO: 259639 - RNA, 64 nt, Human
aucuuaaguguaggaaugggcuccagagagaagacauuuauauuaugaaauauguaccuuuguu

SEQ ID NO: 259640 - RNA, 64 nt, Human
uuucugaaagaaaaauauauaaacagaucuucuacauuuauauuuuuaaucuucuguuaaauac

SEQ ID NO: 259641 - RNA, 64 nt, Human
acaaaaagguggaagcuuuuuaauaaagaaauugcauuuauaaaugaucuguauuagaauauaa

SEQ ID NO: 259642 - RNA, 64 nt, Human
uuuacuacuaggaaaccuuccucauaugaauaaccauuuauauguguuuugcuuaaaguauucc

SEQ ID NO: 259643 - RNA, 64 nt, Human
aauuucuauuuuaaaauucacuuuauucaugugacauuuauaguaccagagugauuauuucaua

SEQ ID NO: 259644 - RNA, 64 nt, Human
auaguuguagacaaaguacauucuggggaaacaacauuuauauguagccuuuacuguuugauau

SEQ ID NO: 259645 - RNA, 64 nt, Human
acaacugugugauuaaaagguauacuuuaguagacauuuauaacucaaggauaccuucuuauuu

SEQ ID NO: 259646 - RNA, 64 nt, Human
auaaguuacuaugaucugcauuuugccagaaacucauuuauaauuaaggcuaucauuuauuaau

SEQ ID NO: 259647 - RNA, 64 nt, Human
uaaugcuucugcuaaguguuagccaaaaucuagccauuuauauuuaguuguguaaaccuaaauu

SEQ ID NO: 259648 - RNA, 64 nt, Human
auaaaucaagaaauauuuauuauuaaaaguaagucauuuauacaucuuagaaaaaauuacauag

SEQ ID NO: 259649 - RNA, 64 nt, Human
ggucauuugcauuaagaugaagaauuuuuuaaaacauuuauaauaaauaguagcaauuucugag

SEQ ID NO: 259650 - RNA, 64 nt, Human
cauuuuggacucaauuucacaucaccaaauuccucauuuauacuuggggaaaaaacaaggccau

SEQ ID NO: 259651 - RNA, 64 nt, Human
uuacaaguacuguucuaaauguuaacaccuguugcauuuauauucuuuccauuugcuaucaugu

SEQ ID NO: 259652 - RNA, 64 nt, Human
ccaacauucacucaucugggacauucuuaagauacauuuauaaaucauuucagcaguaguacuu

SEQ ID NO: 259653 - RNA, 64 nt, Human
ugacccauuugggaaaauagagcaucucagagaaggaggugaguucuuccugccugugauuucu

SEQ ID NO: 259654 - RNA, 64 nt, Human
ugggaacacucaguagggagacacuuuggagacaggaggugaugaaccuuuuuaugugcagcug

SEQ ID NO: 259655 - RNA, 64 nt, Human
caugccuguaaucccggcacuuugggaggccaagggaggugaucacuugagcccaggaguaaag

SEQ ID NO: 259656 - RNA, 64 nt, Human
ugugcagcugcugagcaaaaggguuagaggguggggaggugagagcaaaggcccagcugcagcc

SEQ ID NO: 259657 - RNA, 64 nt, Human
gcauuuucacaauaacugcaaugguuugacauaacauuuauaggcagaaaguuaauaaacuggc

SEQ ID NO: 259658 - RNA, 64 nt, Human
uacagaacccauuaauaucguggcuaucugauuacauuuauauuccaagaugaaccuuuuuuau

SEQ ID NO: 259659 - RNA, 64 nt, Human
gugugguucagagacuaauuccuguguuuaauagcauuuauacuuuaagcacaacuagaaaauu

SEQ ID NO: 259660 - RNA, 64 nt, Human
accaaaaagaaacuuuacuguagaguuacaaguacauuuauauauauauguugcugcaucacuu

SEQ ID NO: 259661 - RNA, 64 nt, Human
uccccuauacaagauguaucucauucuccucaagcauuuauaaauuuuuccuucaaugacauga

SEQ ID NO: 259662 - RNA, 64 nt, Human
gaaaaauacauuucuauuuauagaauaaauguuucauuuauauaaaagcaaaagaacuuagagu

SEQ ID NO: 259663 - RNA, 64 nt, Human
uucagauaugggacaaaauuuaaaaauucaguaacauuuauaaacagaauugaaugaaaagagu

SEQ ID NO: 259664 - RNA, 64 nt, Human
ucuaucaauauuguauaaaaagacugaaacaaugcauuuauauaauauguauacaauauuguuu

SEQ ID NO: 259665 - RNA, 64 nt, Human
aaguaugggacuacauggagagggaagacaguuucauuuauagcuacuggggcuaccaggaccc

SEQ ID NO: 259666 - RNA, 64 nt, Human
gcuuauccuaagcugugguugcagaaaccguggccauuuauauaagcuauaacaucaaaucagg

SEQ ID NO: 259667 - RNA, 64 nt, Human
ugcuaccuguacagcagacaugccgcuccagugacauuuauaaugacagaagcaggguaauggu

SEQ ID NO: 259668 - RNA, 64 nt, Human
auucuuaugaaaucuugauaaaauauuuauaaugcauuuauagaaaaaguauauauauauauau

SEQ ID NO: 259669 - RNA, 64 nt, Human
uucucugauuuuaccugaaaaugguaguaguuuacauuuauacaguacaguuuaugaagcacuu

SEQ ID NO: 259670 - RNA, 64 nt, Human
cauccuagcaacguuauuugacgaggggcaugaacauuuauaguugaaacuguagaaaggguca

SEQ ID NO: 259671 - RNA, 64 nt, Human
ucuucucuauucuauucuacuuccuccauuucaccauuuauacaaagucauucaaaaaggcuga

SEQ ID NO: 259672 - RNA, 64 nt, Human
uauccaccucaacacacauccaucucaagaggaacauuuauaccaggcagucagagcuggaagu

SEQ ID NO: 259673 - RNA, 64 nt, Human
agggaucacaauucacugaaauacagcaguguguggaggugauggccaguuaaucugcugaacu

SEQ ID NO: 259674 - RNA, 64 nt, Human
gauccccuccaagccuaaaagguuguuaauaguuggaggugauuccagugaagauauuuuauuu

SEQ ID NO: 259675 - RNA, 64 nt, Human
caggcccuaaguugaugaagaaaaagucaaggaaggaggugauacaauuggaaauauucccauc

SEQ ID NO: 259676 - RNA, 64 nt, Human
uccaaaguuugccuucaucucuccucuacaguuuggaggugauggugcagcaguggaacaucuc

SEQ ID NO: 259677 - RNA, 64 nt, Human
gcguuuguaaaagaaggaccaccaacuauacugacauuuauaaaugaaccuuuauuaaagacac

SEQ ID NO: 259678 - RNA, 64 nt, Human
aauaccugggaugagaagaauccugagacugccuggaggugagguagaaaauuagaaauacuuc

SEQ ID NO: 259679 - RNA, 64 nt, Human
gagaaggccgcgaagccaugggcagacaggaaguggaggugaaugucucugccuccuguaggcc

SEQ ID NO: 259680 - RNA, 64 nt, Human
caguugcuggugaguggagaugauugaagggcuaggaggugagggccuucauuaauugagauca

SEQ ID NO: 259681 - RNA, 64 nt, Human
auuaacagugugaugugcugguggaagaguuugaggaggugaucgaggacugguacaggaacca

SEQ ID NO: 259682 - RNA, 64 nt, Human
aguugacacaaaauuugaaaugcucacagaucagggaggugauuucccaaaguaauugcccaag

SEQ ID NO: 259683 - RNA, 64 nt, Human
accucugggcaggaccaccugcgucuggcacccaggaggugaggcagacaccaugguuagguga

SEQ ID NO: 259684 - RNA, 64 nt, Human
uuuaccaauucacccacucccuugaaguuguggaggaggugaaagaaagggacccaccugcuag

SEQ ID NO: 259685 - RNA, 64 nt, Human
ucuggaaaagaggaguuucgagguagaguuugaaggaggugagggaugugaauugccugcagag

SEQ ID NO: 259686 - RNA, 64 nt, Human
ccucucuguccaaugcugccuggacauuuacuggggaggugaguagcaggcccagcuccaggau

SEQ ID NO: 259687 - RNA, 64 nt, Human
acccccacaggggcugccugcucuucacagcuguggaggugagggugggcgugggcgggaugcu

SEQ ID NO: 259688 - RNA, 64 nt, Human
gcugacagcagcagccggcuguuugggggaugauggaggugacaucaggcagaggagagugcag

SEQ ID NO: 259689 - RNA, 64 nt, Human
caccggcaugugaagcugccggaaaguggacaggccagaccagggagauguguaccugaggggc

SEQ ID NO: 259690 - RNA, 64 nt, Human
gccaaggcagguagaucacuugaugccaggaguuccagaccaggcuggccgacauggugaaacc

SEQ ID NO: 259691 - RNA, 64 nt, Human
gaaccugguucacccuucauaccagcuccaagccccagaccaugggagcugucugggauguuga

SEQ ID NO: 259692 - RNA, 64 nt, Human
aaggccaaggaagugaccugccugcuggcauuggccagaccacagcagcaccuccuccaugcag

SEQ ID NO: 259693 - RNA, 64 nt, Human
aguagcaggccggcccgggccgccaccgcccaucccagaccauggagcgcgcugggaaggacgc

SEQ ID NO: 259694 - RNA, 64 nt, Human
ggcgcggggcggggagcgagccccaggcggguccgggucgcaggaccaucccggccggcgcgcu

SEQ ID NO: 259695 - RNA, 64 nt, Human
cacaggauggugacuggaacuaaggcuacacagagggucgcacuuggacucugaggguugggug

SEQ ID NO: 259696 - RNA, 64 nt, Human
uccgccgcccccuucccacucagcuucugccagcgggucgcaccgggcuagcuggcugcccaga

SEQ ID NO: 259697 - RNA, 64 nt, Human
ccucuuacuaauguaaaaugauuuguaguggaaacauuuauauuuuuauaauaaacauaaugaa

SEQ ID NO: 259698 - RNA, 64 nt, Human
cuccuacuuuucauccuagucuagcauucugcaacauuuauauagacuguugaaaggagaauuu

SEQ ID NO: 259699 - RNA, 64 nt, Human
aaaacagauuauuaaagagguucauguuaaaaggcauuuauaauuauuuuuaauuaucuaaguu

SEQ ID NO: 259700 - RNA, 64 nt, Human
uuuagucauucuaaaaaacaccuaauuauuaaaacauuuauagagugccuacuguaugcaugag

SEQ ID NO: 259701 - RNA, 64 nt, Human
gaaauacaucauuguauucacaaccaugugucuucauuuauaacuuuuuguuuaaaaaauuuuu

SEQ ID NO: 259702 - RNA, 64 nt, Human
ccuuuccaaauguuuguauauguaaucagauguacauuuauauugaaaaacaaaugagauggac

SEQ ID NO: 259703 - RNA, 64 nt, Human
auuguguauuugcucaguaucugaacuauaagcccauuuauacuguuccauacaaaagcuauuu

SEQ ID NO: 259704 - RNA, 64 nt, Human
caacaaacaauaugaaaacgaaguuaaauaauuccauuuauaauaccaucagaaagaauaaaau

SEQ ID NO: 259705 - RNA, 64 nt, Human
auucauccugggcccuggccgaugugcauaucaacauuuauacauggaacuggagaacauugug

SEQ ID NO: 259706 - RNA, 64 nt, Human
aaguaaacauuuaaauuguagaacugauauuuuucauuuauaugaaguauaagccucuacuggg

SEQ ID NO: 259707 - RNA, 64 nt, Human
acguuuaaauaaauaaaaauugaauuuuauuguucauuuauauaaaaucugauaccuugaugua

SEQ ID NO: 259708 - RNA, 64 nt, Human
aauugcaggugauuugauaauuaagcacccauaccauuuauaacuucugaauuuaaaaaguuau

SEQ ID NO: 259709 - RNA, 64 nt, Human
uagcugaucucauuuccuuccaugguuuccuuaccauuuauaugcaaaugacugucagauucau

SEQ ID NO: 259710 - RNA, 64 nt, Human
uggucaaaagacauuuacccuuaauaucagacaacauuuauauuuuagugaagaaacaaguucu

SEQ ID NO: 259711 - RNA, 64 nt, Human
uaaacuuguauaaaaguguguaaaaauguauagccauuuauauccuauguauaaauuaaaugag

SEQ ID NO: 259712 - RNA, 64 nt, Human
acccaugcuuaguacauaugaccuuuaacccuuacauuuauaugauucugggguugcuucagaa

SEQ ID NO: 259713 - RNA, 64 nt, Human
acaggagaaguuuuccaagagguucaugggaggcggaggugacuggcuggcugucuugcaucag

SEQ ID NO: 259714 - RNA, 64 nt, Human
aagaauauuuguaguuaucuuagaagauagcaugggaggugaggauuccaaaaacauuuuauuu

SEQ ID NO: 259715 - RNA, 64 nt, Human
auccgcaauguggagcagcagccacugcacaggaggaggugacaaaccauuuccaacagcaaca

SEQ ID NO: 259716 - RNA, 64 nt, Human
aaugcacuauuucacuguucgccucccauucuaaggaggugaggugguuggaauaaaaacaguu

SEQ ID NO: 259717 - RNA, 64 nt, Human
cagaugugagccaccgcauccagccccacacccucauuuauaccaauuaccugcccaguaacug

SEQ ID NO: 259718 - RNA, 64 nt, Human
agaaaagaaaaagauaaagggauugugaaaagagcauuuauauuggacuaaucagaugagagug

SEQ ID NO: 259719 - RNA, 64 nt, Human
accucugugcaguuuguaugaaugaauugcuauacauuuauaaggagccagggucuggaggguu

SEQ ID NO: 259720 - RNA, 64 nt, Human
ccuuaaaacuguucccaguguacuugaacaguugcauuuauaaggggggaaaugugguuuaaug

SEQ ID NO: 259721 - RNA, 64 nt, Human
aacaaauggcauugaagugucuuuaauaaagguucauuuauaaaugucaguauaguuggugguc

SEQ ID NO: 259722 - RNA, 64 nt, Human
uuucugcaccaaguuaauuaucccuguccuuucacauuuauagggggaaaauaaauacuuuaau

SEQ ID NO: 259723 - RNA, 64 nt, Human
guauuccauuguuuuauaugauuuuccuaacaaucauuuauaauuggaugugcuccugaaucua

SEQ ID NO: 259724 - RNA, 64 nt, Human
cuuugguccauaauuugauuugauaugauuguuucauuuauaauuugcccaaauacauggagca

SEQ ID NO: 259725 - RNA, 64 nt, Human
uucaaauauuuuccuuggcuguaauuuauguauucauuuauauccuauccgucuuuugagcuuc

SEQ ID NO: 259726 - RNA, 64 nt, Human
aguuguaugcauaaacauaagauuuguaauguuucauuuauaaacugccuucuucaacacaugu

SEQ ID NO: 259727 - RNA, 64 nt, Human
cuuggaguuaucuuugacuuuuaccacaaaucuucauuuauaaaagaaaaagccaaagugaaaa

SEQ ID NO: 259728 - RNA, 64 nt, Human
gauggcagauugucagagucaauugauuaaaccucauuuauacuucuagugucauuuuauauga

SEQ ID NO: 259729 - RNA, 64 nt, Human
agguuuucuauuuuuuuuuuuuuuuuuuuuacuacauuuauaugucugauacauauacggcuuu

SEQ ID NO: 259730 - RNA, 64 nt, Human
auguauaucuggggaaaaaagguccgaauuuucacauuuauauuuaaacuucaauuuuuuauau

SEQ ID NO: 259731 - RNA, 64 nt, Human
gugcccucauuuuucacuuauuuuuuugguuauucauuuauaauaaaagguuggcauugauaug

SEQ ID NO: 259732 - RNA, 64 nt, Human
auccaccucuguuggaacucucuuuuaaaaaguacauuuauagauugaucagaauuauaaccau

SEQ ID NO: 259733 - RNA, 64 nt, Human
gggcucucccucccccagccuggagcacgggaggggaggugacggcuggugacugauggauggg

SEQ ID NO: 259734 - RNA, 64 nt, Human
ugcugcagcucucggcuuccgcccaacagccucuggaggugaggcgggagcaugcccucagcga

SEQ ID NO: 259735 - RNA, 64 nt, Human
ggagugacggugaugacccagcagcaacugaaagggaggugaggggcuuccuuucugcagcuga

SEQ ID NO: 259736 - RNA, 64 nt, Human
augugaugugaaaugaagacuauauauauggaauggaggugacagaaagaaagaaauucuuugu

SEQ ID NO: 259737 - RNA, 64 nt, Human
auuagugaacuaaguuauuguuaauuauguacaacauuuauauauugucuguaaaaaauguaug

SEQ ID NO: 259738 - RNA, 64 nt, Human
cauuggugucauuauaugaagcuugcauuuaauacauuuauacauaauacauuuguacauuuaa

SEQ ID NO: 259739 - RNA, 64 nt, Human
cuuuuuuaaaacuuuuguauuagaaaugcgcauacauuuauaugaauauauuuugauaacguag

SEQ ID NO: 259740 - RNA, 64 nt, Human
cauuguauucagcuagccccuuaaagguaaugaccauuuauaaauuauuccuucaguuggcuau

SEQ ID NO: 259741 - RNA, 64 nt, Human
acaaaauaguguuugucaucagguugguacuaaacauuuauaauuacuguguaauuauaaacaa

SEQ ID NO: 259742 - RNA, 64 nt, Human
uuugggcuugucuucuagucugggccgcucuaaacauuuauaauuccaacauuguggauuucau

SEQ ID NO: 259743 - RNA, 64 nt, Human
gcuccugugggaacuaccuagaugaagagaguaucauuuauaccuucuaggagcuccuauuggg

SEQ ID NO: 259744 - RNA, 64 nt, Human
cccugaauuccaaaauauuauggauaaacauuaccauuuauaugcuacaaauuagucugauucc

SEQ ID NO: 259745 - RNA, 64 nt, Human
cuccagguccucuacuuaaugagauaguagcauacauuuauaauguuugcuauugacaagucau

SEQ ID NO: 259746 - RNA, 64 nt, Human
aauccacacuuuuuguuaagaaggaaacauuuagcauuuauauauuuguguauggaaaacacuu

SEQ ID NO: 259747 - RNA, 64 nt, Human
aauuaaaggggagcauggcagauaaccauaaagucauuuauauuugauuuugaaauguauuuuu

SEQ ID NO: 259748 - RNA, 64 nt, Human
gcaugugcauuguuugugcucaauuucagacacucauuuauaaacaaauucaaccaagggauau

SEQ ID NO: 259749 - RNA, 64 nt, Human
guuuuggaaagcuacaguaauuucuguauuacaucauuuauaugugaaaaguuggacauuucug

SEQ ID NO: 259750 - RNA, 64 nt, Human
cauauguaggauagccacuuuuuagguauauguacauuuauauuucuaucaauuccuuagaaag

SEQ ID NO: 259751 - RNA, 64 nt, Human
caguaccauaauguuuauuuacuggaagauaaugcauuuauaagcauuuuaaaauucuguaaag

SEQ ID NO: 259752 - RNA, 64 nt, Human
uuacuaaguaggugaugaguuugacaguuuuugacauuuauauuaaauaacauguuucucuaua

SEQ ID NO: 259753 - RNA, 64 nt, Human
uaguucccagaccuuuuuuccuuguggucauccaggaggugaucaauuacaugugcacagugcu

SEQ ID NO: 259754 - RNA, 64 nt, Human
aacaggaaagccugggaggguuguugggaugcaaggaggugaugaaaaggagacagggggaaaa

SEQ ID NO: 259755 - RNA, 64 nt, Human
acuuuuccuuuacauaccucuauacuuuccagauggaggugauucagaaccuuuuaaagugauu

SEQ ID NO: 259756 - RNA, 64 nt, Human
cuuccaaagccuuacuuccccaagcugccagccaggaggugauaaccacccucccagaguuucu

SEQ ID NO: 259757 - RNA, 64 nt, Human
auugccaucuagaagaacuaugaugagaaagauacauuuauauauuauguaaaauguuaacuau

SEQ ID NO: 259758 - RNA, 64 nt, Human
uauacuuugucaaauauauggauguguauguguacauuuauaagaaccaguauggauacaucca

SEQ ID NO: 259759 - RNA, 64 nt, Human
aaagaaauuguagaaaaaacccaugcagacauaacauuuauaccaaugaggcaaaaauaaagaa

SEQ ID NO: 259760 - RNA, 64 nt, Human
uuacuggguuugguauaauuuaauuuaaaauucucauuuauagaguauuuuauuuaaucuagua

SEQ ID NO: 259761 - RNA, 64 nt, Human
uccuugcuuaugggaaaauagcaaaacaacauuucauuuauacuuuuguuuaccccucucugag

SEQ ID NO: 259762 - RNA, 64 nt, Human
ucauagaauugcagucauuuggugcucugcuaaccauuuauauaaaacuuaaaaacaagagaaa

SEQ ID NO: 259763 - RNA, 64 nt, Human
uuuaaaaaaaagacuaaauauauuuaaaaggccacauuuauauuuuuuucacaagaaccacaua

SEQ ID NO: 259764 - RNA, 64 nt, Human
caacaacaaaagcgauuauuauuuuagagcaucucauuuauaauguagcagcucauaaaugaaa

SEQ ID NO: 259765 - RNA, 64 nt, Human
ucuauguugaauaaaagugguucugugugauugucauuuauaucugauccccaaauagcucaua

SEQ ID NO: 259766 - RNA, 64 nt, Human
cugaauuuccucccuuggggaagaagggaaccaacauuuauaccugaccagauggcuaaagugc

SEQ ID NO: 259767 - RNA, 64 nt, Human
acauuuacauuaugaugaccaugggguuuaugaacauuuauaacuuuuuauaauuuccauauua

SEQ ID NO: 259768 - RNA, 64 nt, Human
ggggaaacacuagauuuuuaccucgguuuuugaucauuuauaauggagagaggaaguugccuau

SEQ ID NO: 259769 - RNA, 64 nt, Human
caguuacaaaguaauuucuuugaucuggacagaacauuuauaucaguuucaugaaaugauugga

SEQ ID NO: 259770 - RNA, 64 nt, Human
gaagaaaauuucacuauuugcauugaugugcuggcauuuauauguaauucauaauuuugauucc

SEQ ID NO: 259771 - RNA, 64 nt, Human
cacaaaaauagcugaaagccagguacaacuacugcauuuauauauguaaguuuuguauaucaaa

SEQ ID NO: 259772 - RNA, 64 nt, Human
uuuguuuaaaauaaacugaauguauuuaaugguccauuuauauguucuuuuauguaacauguag

SEQ ID NO: 259773 - RNA, 64 nt, Human
cacccugcgucccugugugcauuaaguucauucugggucgcagccaugaagugucaccaguauc

SEQ ID NO: 259774 - RNA, 64 nt, Human
gcacugcagcucccagcuccuuuggaaagggacagggucgcagggcagaugcugcucgguccuu

SEQ ID NO: 259775 - RNA, 64 nt, Human
gaagggcgccgagugcccucuccuggacgaucgcgggucgcagaagcccaggccagcgagcccu

SEQ ID NO: 259776 - RNA, 64 nt, Human
ugcaaccugugaagccaagagugaacugauguuucauuuauauuuucauccaaaugacauuauc

SEQ ID NO: 259777 - RNA, 64 nt, Human
aaccauuuuaacuuucaucucuagggauguuuaacauuuauaauugcaaaauaaaccaacuaua

SEQ ID NO: 259778 - RNA, 64 nt, Human
uuagagcaaugacuguauuuuguuguccuuauaacauuuauauuauuucaguuuuaagucaaaa

SEQ ID NO: 259779 - RNA, 64 nt, Human
cuauuuuguuaaggugucaucagccuucaaccuccauuuauauauuuuuauaauguuaagccac

SEQ ID NO: 259780 - RNA, 64 nt, Human
uucauguuugaaugcuguaauuccauuuaaauuccauuuauauacuuuaaggaaacaagauuac

SEQ ID NO: 259781 - RNA, 64 nt, Human
agguaaaaauauauaccuucgggucgcaguucaccauuuauaugugguauuaaaaauuaaugaa

SEQ ID NO: 259782 - RNA, 64 nt, Human
guaaaaucuaaccauuuuauucucugcuucauagcauuuauaauguaugaugagguuaacacug

SEQ ID NO: 259783 - RNA, 64 nt, Human
aacaagucucuuaaccucucuaagacugauuccucauuuauaacagggaggagguggauuaugu

SEQ ID NO: 259784 - RNA, 64 nt, Human
gaaauguaccuugccuuguuuagaggcaauuucacauuuauaaauauuuuuuuuuccuccauga

SEQ ID NO: 259785 - RNA, 64 nt, Human
uuacucuuugaugaaugcauaaguucuguacuugcauuuauacgaacauauaugagacuugaau

SEQ ID NO: 259786 - RNA, 64 nt, Human
uaacuacacauacagcacucuauaggagauauuccauuuauaaaaacuuuagguucuaaaaacc

SEQ ID NO: 259787 - RNA, 64 nt, Human
uuuauaucacaacucaaaggacugugauauaauccauuuauaucacagcucacaguuucugaaa

SEQ ID NO: 259788 - RNA, 64 nt, Human
uuuacaucacagcucaaaggacugugauauaauccauuuauaucacaacucaaaggacugugau

SEQ ID NO: 259789 - RNA, 64 nt, Human
acauggagaaagauuuucccauaauaauaacuaacauuuauauuagguuggugcaaaacuaguu

SEQ ID NO: 259790 - RNA, 64 nt, Human
aggcuagagugcuuuuagccuuuuuuaaaaacuccauuuauauuacauuuguaaccaugauacu

SEQ ID NO: 259791 - RNA, 64 nt, Human
uuaauguuacuaaguuuaaugccuggccauuuuccauuuauauauauuuuuuaagaggcuagag

SEQ ID NO: 259792 - RNA, 55 nt, Human
cuaugaaaggaauugauuaaauucacauuuauauguuuagaaacauguagacuaa

SEQ ID NO: 259793 - RNA, 64 nt, Human
uaaacagggaugauucuucaagagacccuucaaacuuggguagaguuuacagcucugacuuuac

SEQ ID NO: 259794 - RNA, 64 nt, Human
uuaacugagcucuaauuuagcugaucagauuuugcuuggguaaaguuccuuuuuaauguucuaa

SEQ ID NO: 259795 - RNA, 64 nt, Human
ccugggcgccccucggugcugcaggcuggggggccuuggguaccugcagagccuuuucucugaa

SEQ ID NO: 259796 - RNA, 64 nt, Human
ucucauauuuuugcuuuuauuuuuaguauaagaacauuuauaaaaucauauuuuuguuacugca

SEQ ID NO: 259797 - RNA, 64 nt, Human
aguuuugaaggauguuugagcuuuuguauaaugccauuuauaccugcaguuuuacagauaaugu

SEQ ID NO: 259798 - RNA, 64 nt, Human
aguaagucauuuuaaccgaauguucauucauauucauuuauaaaaaguaccuguaucaaaggaa

SEQ ID NO: 259799 - RNA, 64 nt, Human
uuguaacacaagaaauaacuccuuuuuacaugaucauuuauaucuauauacauauauauacuug

SEQ ID NO: 259800 - RNA, 64 nt, Human
uuugaauuucuuauuguaaaaaucuguuuaaauccauuuauauuauuuuacagucuuuuaugua

SEQ ID NO: 259801 - RNA, 64 nt, Human
uuuagacuuaguuaaagaccugugugcucugcugcauuuauaggguuuugggcugcugagaaua

SEQ ID NO: 259802 - RNA, 64 nt, Human
aacaaacagcauuuguaaauggucuauuagccuucauuuauacugccuaacaauuauuugaagg

SEQ ID NO: 259803 - RNA, 64 nt, Human
uauguauuuaaaaaaaucaaaacaaaaaaaaacucauuuauaccuguguauuuuuuaaagcuac

SEQ ID NO: 259804 - RNA, 64 nt, Human
uauaugugacugaaauuuuuaauuuuuuuguuuccauuuauaguggaucaaaauauuuaaacau

SEQ ID NO: 259805 - RNA, 64 nt, Human
cggauaagguuucauaauuuacaaaugggaauuucauuuauaauaauaaauaugaguguccuuu

SEQ ID NO: 259806 - RNA, 64 nt, Human
gcagaaauauauccaaaguuauguacuuaauguucauuuauaccguucagaucuauagacccag

SEQ ID NO: 259807 - RNA, 64 nt, Human
uuuauaccguucagaucuauagacccaguaaugucauuuauagcuauaauauccagugcauaua

SEQ ID NO: 259808 - RNA, 64 nt, Human
gugaagaaucuguugcuauguacuguauauucagcauuuauauuugguuuguuucauagcuaau

SEQ ID NO: 259809 - RNA, 64 nt, Human
aguauuuucuguuccauuccuuuucauucuauuucauuuauaaaacaugcuaguugagacuuuu

SEQ ID NO: 259810 - RNA, 64 nt, Human
gguguuuaaggaugaacuaaauauuuuaauugagcauuuauauggauaaucauacauuauguaa

SEQ ID NO: 259811 - RNA, 64 nt, Human
auauugcaaaaguuaaacaaggguaccacaauaucauuuauaauugaugucaauauuaguaguc

SEQ ID NO: 259812 - RNA, 64 nt, Human
caccaaaauagcuguuuugaaacuguuuuaauugcuuggguagcaaugugcacuuuaaacaauu

SEQ ID NO: 259813 - RNA, 64 nt, Human
agguaaugugauuauugcagggguguuuuuaaaucuuggguauaaauucuaggguaaauuccag

SEQ ID NO: 259814 - RNA, 64 nt, Human
uaccaaaaaaggaagguuguuuuuucuacaugugcuuggguaucuaacaucuaccauuaaaaca

SEQ ID NO: 259815 - RNA, 64 nt, Human
augauaaacuuucaucguucuuagccuacauugucauuuauaucaccaaaugaguuuauagauu

SEQ ID NO: 259816 - RNA, 64 nt, Human
aucacgucauucuuuaaacaaaaauacucaagaucauuuauauuuauuuggagagaaaacuguc

SEQ ID NO: 259817 - RNA, 64 nt, Human
aagcuuuauaugaaauuauuaaugugaaguuuuucauuuauaauucaaggaaggauuuccugaa

SEQ ID NO: 259818 - RNA, 64 nt, Human
auucuaauauuuauuuaagguaauaaaaucuugacauuuauaaucuuucaacucaugggaguuu

SEQ ID NO: 259819 - RNA, 64 nt, Human
uuagugguggauuuucucccacuucugaaauguucauuuauacugguugcauuuuaagaucaug

SEQ ID NO: 259820 - RNA, 64 nt, Human
aaagaaugaaaaauaaaaccuguguuuaugaauacauuuauaauuaggaacuuaucgugaggug

SEQ ID NO: 259821 - RNA, 64 nt, Human
cuuuauggguuuguugugaacacagugcagggcacauuuauaauaagagcucagucaaugguag

SEQ ID NO: 259822 - RNA, 64 nt, Human
auucucacaaccaaccagucauguugcuugaagccauuuauagacgagcuucaaagcaacuuua

SEQ ID NO: 259823 - RNA, 64 nt, Human
cagaaaauagcuuuuauugaguaauauuacauuucauuuauacuguagcaauauauuuguaggu

SEQ ID NO: 259824 - RNA, 64 nt, Human
guaguggaggagguggcuucauguggcacuugggcauuuauauuccacuugggagggucaggcu

SEQ ID NO: 259825 - RNA, 64 nt, Human
uuucuuuugaaacaauagauuauuaaaaucugggcauuuauaugcaauuuagagccauuuuuac

SEQ ID NO: 259826 - RNA, 64 nt, Human
aauuuuagauguagauauuugaaauagauuuuuucauuuauaccaguuuucuuuaugaugauac

SEQ ID NO: 259827 - RNA, 64 nt, Human
gauaaaauugguaucguguaugauaauauuguaucauuuauauuugccuuauguuaacuuuaag

SEQ ID NO: 259828 - RNA, 64 nt, Human
caugcugugacauuuuaauaaaaagcaaaaggagcauuuauaauuaucucauuuguuaaggcug

SEQ ID NO: 259829 - RNA, 64 nt, Human
ucaaacguuuaagaagaauuacaacucugaaaagcauuuauauguggaacuucucaaggagccu

SEQ ID NO: 259830 - RNA, 64 nt, Human
uucugaauauguuacugagcuugcuugugguaaccauuuauaauaucagaaaguauauguacac

SEQ ID NO: 259831 - RNA, 62 nt, Human
ccaaacagggaauagacugaguugggcaaaagcuuggguaggacaagaacuuccauacaaau

SEQ ID NO: 259832 - RNA, 64 nt, Human
agcuaaaaggccaccccuuuaucgcauugcuguccuuggguagaauauaaaauaaagggacuuu

SEQ ID NO: 259833 - RNA, 64 nt, Human
aggagcauuaacuccagaugaaagauugaccccucuuggguaucauuuggccucucugcccgug

SEQ ID NO: 259834 - RNA, 64 nt, Human
uggucaauucaggguugaggagacuguuggggggcauuuauaauguaugaaaguuaaggaaggg

SEQ ID NO: 259835 - RNA, 64 nt, Human
ucguauauuuuuauuauggcauuuauauauaguucauuuauauuuaaauuuuaauuccaugaac

SEQ ID NO: 259836 - RNA, 64 nt, Human
acuuccaaagcacuuucguauauuuuuauuauggcauuuauauauaguucauuuauauuuaaau

SEQ ID NO: 259837 - RNA, 64 nt, Human
acaaaagugccuggcauccacuacugcugccuuucauuuauaauaauagcccuuccaucuggca

SEQ ID NO: 259838 - RNA, 64 nt, Human
gagccacuggacaaagcuucugucucuguguguacauuuauaauguucuaaccaagucucaaac

SEQ ID NO: 259839 - RNA, 64 nt, Human
cuggagauuuuauaaaagcaagcauuuuuauuuccauuuauaauuucuauucaauauugcuaga

SEQ ID NO: 259840 - RNA, 64 nt, Human
aaugccuuuuuauuucugauauguaguuauuagacauuuauauauuaaggauaacuuccuuagu

SEQ ID NO: 259841 - RNA, 64 nt, Human
gugauauguguucuuugaagguuuuuuaauuuaacauuuauagucacuuuuuagugcacacauu

SEQ ID NO: 259842 - RNA, 64 nt, Human
aacuaauuuagauaacuauaagauacuuauuguccauuuauacccuguaaagccguuuuagaau

SEQ ID NO: 259843 - RNA, 64 nt, Human
ucauggggagggagcaggggaagguuguaugugucauuuauaacuucuguacaguaagaccacc

SEQ ID NO: 259844 - RNA, 64 nt, Human
cuaugcauuuuuguuucaguuuguaaauguguaacauuuauaguuaaauaggacaaagcaggcc

SEQ ID NO: 259845 - RNA, 64 nt, Human
gagucccaaucacauaacugugguguuacucugucauuuauauggugucaaaagcacuugauga

SEQ ID NO: 259846 - RNA, 64 nt, Human
cuacuuuuagguuuucccaggacaggacaguccccauuuauacuuauuaucccaguuuaauuau

SEQ ID NO: 259847 - RNA, 64 nt, Human
guuuacaaauauuuuuaggacucacguuaacucacauuuauacagcagaaaugcuauuuuguau

SEQ ID NO: 259848 - RNA, 64 nt, Human
gaagagaggcugagugucaccaagguccaaacuccauuuauaaaaauacugcaaaaccaggagu

SEQ ID NO: 259849 - RNA, 64 nt, Human
uagucaguugggagugguugcuauaccuugacuucauuuauaugaauuuccacuuuauuaaaua

SEQ ID NO: 259850 - RNA, 64 nt, Human
gccagcacugcacagacagcugcgaccagagacuggaggugacccuugcccuuuuccacccuuc

SEQ ID NO: 259851 - RNA, 64 nt, Human
uggagugcccacccugggagacagaccccaccuccuuggguagugagcagugagcagaaagcug

SEQ ID NO: 259852 - RNA, 64 nt, Human
ugcagguggcaggccagggauuuguaccaugggacuuggguaaauaaaggggacugaacucugu

SEQ ID NO: 259853 - RNA, 64 nt, Human
gacucagccauagaagaugccgccccaccuucuacuuggguagcugggcugggacgcugggaca

SEQ ID NO: 259854 - RNA, 64 nt, Human
gaaggcaauuucauacuaaacugauuaaauaauacauuuauaaucuacaacuguuugcacuuac

SEQ ID NO: 259855 - RNA, 64 nt, Human
guuggauuggaugcuuacaggguuuuucuuguaacauuuauaagugcugcuuacaucacugaac

SEQ ID NO: 259856 - RNA, 64 nt, Human
agauaauugaauaguuugccaucgagauuauuuucauuuauacuauaaaacaaaagcaaacuag

SEQ ID NO: 259857 - RNA, 64 nt, Human
acacguagcccacugccucauuauagguaaaaggcauuuauaacugcucaggggauuacgagaa

SEQ ID NO: 259858 - RNA, 64 nt, Human
aaacauucuacauacguauucucuuuugucucuucauuuauaacugcugugaauuguacauuuc

SEQ ID NO: 259859 - RNA, 64 nt, Human
augaaguuauuaaauaauacuuuuaaaaaucagacauuuauauagaguuucaaagacuauugua

SEQ ID NO: 259860 - RNA, 64 nt, Human
aaaauaauaauagcuuucauuuacauagugcuuacauuuauauagcacuuacuaugugcgaugu

SEQ ID NO: 259861 - RNA, 64 nt, Human
auaaaugaaugaauaacuaagauauagaaacucucauuuauauugcagauugaauauauaugau

SEQ ID NO: 259862 - RNA, 64 nt, Human
cuguuuuuagcaguugccaaaucuaggaaacuaacauuuauauugcuguaucuauaaguauuug

SEQ ID NO: 259863 - RNA, 64 nt, Human
ucuguaaauauguuaaugaggccaauuuuuccagcauuuauaauuauuuuuuucacuuguuagg

SEQ ID NO: 259864 - RNA, 64 nt, Human
ugcauauuugcuauuuuaacauuauuggacccugcauuuauaguccuuugauuucuucccucuc

SEQ ID NO: 259865 - RNA, 64 nt, Human
aauuauaucuaauuuguacccuuguugaaauugucauuuauacaauaaagcgaauucuuuaucu

SEQ ID NO: 259866 - RNA, 64 nt, Human
gcucaaaauauggugcugcuuuauauaaaccuuacauuuauauagugcaccuaugagcaguugc

SEQ ID NO: 259867 - RNA, 64 nt, Human
cgagaaagaggccuugccaucaauggaauacugccauuuauauugcuuagcagggcauuugacu

SEQ ID NO: 259868 - RNA, 64 nt, Human
uugaauguuuauugaacaauaguacuugaaugaacauuuauaaauguaauuauugcgaucacug

SEQ ID NO: 259869 - RNA, 64 nt, Human
uuuuguguauuuuucgcugauaaaaauuauuuaacauuuauauuuuuacuugauuacauaugca

SEQ ID NO: 259870 - RNA, 64 nt, Human
uugauccaugucuguuuguaggacggagaaaccgcuuggguaacuuguucaagauaugaugcau

SEQ ID NO: 259871 - RNA, 64 nt, Human
ccaaugggaggagaagcccauaauguuacuguaacuuggguauuauguuaaaugucuguuuuaa

SEQ ID NO: 259872 - RNA, 64 nt, Human
ucuuugucuuacuaguuaaauccucaccuaaucucuuggguaugaauauaaaugugugucaucg

SEQ ID NO: 259873 - RNA, 64 nt, Human
aucaaaugcaaucaucuaaaauauaaaggucaaucauuuauaauagaaacaccuugaccacaag

SEQ ID NO: 259874 - RNA, 64 nt, Human
ggcaaaggauauuucccaucuaauaccaguuucucauuuauauuuaacguauuggaccugauau

SEQ ID NO: 259875 - RNA, 64 nt, Human
gugcuuagccuuauaaaaaagguuguaaaauguacauuuauauuuuaucuuuuuuuuuuuuuuu

SEQ ID NO: 259876 - RNA, 64 nt, Human
ucuucagauucauugagagaguuuuccauaaagacauuuauauaugugagcaagauuuuuuuua

SEQ ID NO: 259877 - RNA, 64 nt, Human
uaacaguauuaauagcgacauugguaacagcuaccauuuauagaguuuuaaugggaguaggagc

SEQ ID NO: 259878 - RNA, 64 nt, Human
auugccuuaaaccuccuuguuuuagacacacuaacauuuauaccaaauugcagauuauucugca

SEQ ID NO: 259879 - RNA, 64 nt, Human
auccagcugguguguucuuuugcauguaaacugccauuuauauuuuagaaaacuauuguauaga

SEQ ID NO: 259880 - RNA, 64 nt, Human
cauuuugcguuuuuuagaaacccauuuucuuggucauuuauaaagcugcuuuauagauaucuuu

SEQ ID NO: 259881 - RNA, 64 nt, Human
uaaguguaagaucuccuauggaguacuuuaaauucauuuauacaaaugaauaaguguaucuuug

SEQ ID NO: 259882 - RNA, 64 nt, Human
cucagauuuuacucacauuacccuuguauuaugccauuuauaaacugcucugaaaccugaagcu

SEQ ID NO: 259883 - RNA, 64 nt, Human
uuguuaaguuuuugcccacauugcauaugccuuucauuuauaauuuauuuacccugcuugacuu

SEQ ID NO: 259884 - RNA, 64 nt, Human
uacuaugccaauauuuccuuauaucuauccauaacauuuauacuacauuuguaagagaauaugc

SEQ ID NO: 259885 - RNA, 64 nt, Human
auagaacauccagaguaagugaugagggccucugcauuuauaugcgcuuaaauuaagauuaugu

SEQ ID NO: 259886 - RNA, 64 nt, Human
aucaacacugcuccauggugagagcacagcaacucauuuauauauauauauauaggcuuuguug

SEQ ID NO: 259887 - RNA, 64 nt, Human
ggacauuuucuucagagagcuaaauuacaauugucauuuauaaaaccaucaaaaauauuccauc

SEQ ID NO: 259888 - RNA, 64 nt, Human
uauauauauauagauauauucaaaaacauugcaucauuuauaugaacuauagggggauuauuau

SEQ ID NO: 259889 - RNA, 57 nt, Human
ugaggugacacucuggagugguugaagggccacaaggugcaggguuaauacucuugc

SEQ ID NO: 259890 - RNA, 57 nt, Human
caauccugugucccagaggucccucugggccacaacccaacccuucucacucuccuc

SEQ ID NO: 259891 - RNA, 57 nt, Human
cacaacaaaauggcuuguugccaauauggccacaacauugccagcaaauacugccuu

SEQ ID NO: 259892 - RNA, 57 nt, Human
accagugugaccuuacgauguucccuaggccacaagagaggccccccauccucacac

SEQ ID NO: 259893 - RNA, 64 nt, Human
uucuaaucaucuauguguguaugauggaugugaccauuuauaugucauguguugaaauuaaagg

SEQ ID NO: 259894 - RNA, 64 nt, Human
uuacacuuuaugguaaguagcagggggggaaaugcauuuauagaucauuucuaggcaaaauugu

SEQ ID NO: 259895 - RNA, 64 nt, Human
uucuucucugaauuauuaaaguucuuuaugaccucauuuauaaacacuaaauucugucaccucc

SEQ ID NO: 259896 - RNA, 64 nt, Human
uuuuaucuaugauacuuaguuaacauauauauuacauuuauagcuauguaguaguuccccuaaa

SEQ ID NO: 259897 - RNA, 64 nt, Human
aaguauauaguauauuuauacucuagaacaugcacauuuauauauauauguauauguauauaua

SEQ ID NO: 259898 - RNA, 64 nt, Human
uuaauaaaugcucaccccuuauugcacaggaaagcauuuauacuucagaaagauuguacaaaua

SEQ ID NO: 259899 - RNA, 64 nt, Human
ccagaaguggaguuuuccuuauugcacaggaaagcauuuauacuugagaaaaauuguauaaaga

SEQ ID NO: 259900 - RNA, 64 nt, Human
acugcagauaaguuaaauauucccauagguuuuacauuuauauuuuuucuuauuuaaauuuauu

SEQ ID NO: 259901 - RNA, 64 nt, Human
uuaaccaauccucacaccuuauugcacaggaaagcauuuauacuugagaaaaauuguauaaaga

SEQ ID NO: 259902 - RNA, 64 nt, Human
cuugagaaaaauuguauaaagaauauggaaaagccauuuauaucugcucacauguaaaaacauc

SEQ ID NO: 259903 - RNA, 64 nt, Human
acugcauuucaugugcaccaaauauuuugaaagacauuuauaaauaauuggcuuaugacucaua

SEQ ID NO: 259904 - RNA, 64 nt, Human
gcaaaugugguuuuuuuacuuggaaauaacugcacauuuauauauaggauauuggacucugcuu

SEQ ID NO: 259905 - RNA, 64 nt, Human
uuaugcaguuacuaucauucaguuuuacuaucuucauuuauaguuuugugaguccaccaauuag

SEQ ID NO: 259906 - RNA, 64 nt, Human
aaaaggaaaauuauacuugugauucucguagugacauuuauauuacauguuccauuugugauau

SEQ ID NO: 259907 - RNA, 64 nt, Human
acacagcuuauuuuauugcauuggaucaaaaugccauuuauaaagaauuaugccuuuuccauca

SEQ ID NO: 259908 - RNA, 64 nt, Human
acucuuaucaaggccaucuuuuagaccugauuuucauuuauaugaaaacagaccuguccauguc

SEQ ID NO: 259909 - RNA, 57 nt, Human
aggcggaggcgagcccuggaggagggaggccacaacuccgagcugcccaccuggugc

SEQ ID NO: 259910 - RNA, 57 nt, Human
accggccacaccgcugaaggccaaagaggccacaaagaagaaaaagaaacaguuugg

SEQ ID NO: 259911 - RNA, 57 nt, Human
agcccuggagcagcucagggcucagggggccacaaggaggcaggucgggaggaagaa

SEQ ID NO: 259912 - RNA, 57 nt, Human
ugucauucagacauucagagaaugguuggccacaaacaaugaccaaguauugcuugg

SEQ ID NO: 259913 - RNA, 64 nt, Human
auuuaaauaucacaacaauuugacacccuucauucauuuauaaaaauaaaugagcuaguucuuu

SEQ ID NO: 259914 - RNA, 64 nt, Human
cugaaucuauauuauguuuaacuucagaaggcaucauuuauaagacaguauggcaguuaauuau

SEQ ID NO: 259915 - RNA, 64 nt, Human
aaagcucaauagaugauuucuugcuuuuuucagucauuuauaaauauagguguaauuuuucaug

SEQ ID NO: 259916 - RNA, 64 nt, Human
augaaaaauuuguaugcuuugaaggcugccaaagcauuuauacucuggacauaguuuuaacugc

SEQ ID NO: 259917 - RNA, 64 nt, Human
aagaaaauaaagguagugaaauauggacaaaggacauuuauauauuaacuaaaguuguuuaugu

SEQ ID NO: 259918 - RNA, 64 nt, Human
auuugauuuuuuaaaaauauacacauaggugcugcauuuauaucugcugguuuaaauucuguca

SEQ ID NO: 259919 - RNA, 64 nt, Human
aguaucuggagagcagcacuaccauuuauucuuucauuuauaguugggaaaguuuuugacggua

SEQ ID NO: 259920 - RNA, 64 nt, Human
acaguugacugacuagucucagauuguuucauaucauuuauacuuggguaagaguaaacuagau

SEQ ID NO: 259921 - RNA, 64 nt, Human
uuguuagcccuguguauguacaguucaaaaaguucauuuauaaaaguaguuuccuguuccuagu

SEQ ID NO: 259922 - RNA, 64 nt, Human
gcuuuuccaaacauucuccaguaagcagguacuacauuuauaauggaaggaauuuuuuaaaaaa

SEQ ID NO: 259923 - RNA, 64 nt, Human
uucagauacagggugcuccuugucaauacugagccauuuauaccuuugaaauauuaaaaucacu

SEQ ID NO: 259924 - RNA, 64 nt, Human
auauuguuaaauauucuguauuuuggaauuuauccauuuauaggcuucaaaaguaaauuuuuaa

SEQ ID NO: 259925 - RNA, 64 nt, Human
aaaauaggaauuauuuugauggcucuaacagugacauuuauaucauguguuauaucuguaguau

SEQ ID NO: 259926 - RNA, 64 nt, Human
aaaauaagaauuauuuugauggcucuaacaaugacauuuauaucacauguuuucucuggaguau

SEQ ID NO: 259927 - RNA, 64 nt, Human
agcauuauagacuuuuugguugcgguggcuuuugcauuuauauuaucaaugccuugcaggaacg

SEQ ID NO: 259928 - RNA, 64 nt, Human
guuuuuguugauuugguauaaaguuuuuccaauucauuuauauuuuacaaaugcuagauauugg

SEQ ID NO: 259929 - RNA, 57 nt, Human
caacaggcccaguggcuuccccuucagggccacaacaggcuguagaaggggaugacg

SEQ ID NO: 259930 - RNA, 57 nt, Human
cugugcuuuggaacaaucacagggaauggccacaaaccugcccgccuaagacccuga

SEQ ID NO: 259931 - RNA, 57 nt, Human
acuaguaaaggaggaauagugcuugcuggccacaaggaaaaggaggaggugucuggg

SEQ ID NO: 259932 - RNA, 57 nt, Human
gccuuuaaggcugugucaccaagguauggccacaaggaagaauaguguacagagauu

SEQ ID NO: 259933 - RNA, 64 nt, Human
aauuuaaaaucaugaauauucaauuuuauacaaacauuuauauauauauauauagauuugugua

SEQ ID NO: 259934 - RNA, 64 nt, Human
ucguccaacuaaaacaacuguaauguacuugauacauuuauaucaaguucuaaaguauuuagac

SEQ ID NO: 259935 - RNA, 64 nt, Human
caguaugcauauuuuuuucuccucuagauucauacauuuauauagcauugaaacacuuucaaac

SEQ ID NO: 259936 - RNA, 64 nt, Human
aaggacaucagcaaacaggaucaguuaacuauugcauuuauauguaccguaggcuuuguauuca

SEQ ID NO: 259937 - RNA, 64 nt, Human
ggcaagccacuucauuuuucagaacuuguuuacucauuuauaauaugggaauaaaaauuugugc

SEQ ID NO: 259938 - RNA, 64 nt, Human
ucuuucuuagugguugcuuuagaguuggaguuuucauuuauaacuaauccacguuugcuuucag

SEQ ID NO: 259939 - RNA, 64 nt, Human
uuguacauauuggaaaggucauuguggcuaucugcauuuauaaauguguggugcuaacuguaug

SEQ ID NO: 259940 - RNA, 64 nt, Human
aaaagcaacucaaaacaacuucaacguggaggugcauuuauaauucagucugcauuuauucugu

SEQ ID NO: 259941 - RNA, 64 nt, Human
guuauagacuguauacucagugcaaauauagcugcauuuauaccucagaggggccaaguguuaa

SEQ ID NO: 259942 - RNA, 62 nt, Human
ccaaagccaaaaccacgugauuucccuuucagcauuuauacccaggacugaacaugcagaac

SEQ ID NO: 259943 - RNA, 64 nt, Human
uuucugcccaguggcguugggggaauucagccuucauuuauaaucagugagauuccccuguuga

SEQ ID NO: 259944 - RNA, 64 nt, Human
uauauaaggugcuauauaagugugaaauaucauucauuuauaaaugaaaugccuucuaacuuuc

SEQ ID NO: 259945 - RNA, 64 nt, Human
ugcaaugaauccccaauaauugcagaacuaaacucauuuauaaagcuaaaauaaccggauauau

SEQ ID NO: 259946 - RNA, 64 nt, Human
aaagaccuagugauggauauuucuuugaggcuuucauuuauauaauuuuauuuuguacaauguu

SEQ ID NO: 259947 - RNA, 64 nt, Human
auauaaaacuugaugcguuuugcacuacucuuuccauuuauaugcugcaaacaacuacagucuu

SEQ ID NO: 259948 - RNA, 64 nt, Human
aaaccaaccacuguauuaaagcaaacuaagccugcauuuauaucugaauuauuaccuccauauu

SEQ ID NO: 259949 - RNA, 64 nt, Human
gguucgacgaggagacccagaggacguuccucaaggaggugaaggucaugcgaugccuggaaca

SEQ ID NO: 259950 - RNA, 64 nt, Human
cuauaauuuagaauuuucuuaugaauccacucuacuuggguagaaaauauuuuaucucuaguga

SEQ ID NO: 259951 - RNA, 64 nt, Human
uccccguaagggcuggacccagcuccuuucugggcuuggguagucaaaugucugagcuacccca

SEQ ID NO: 259952 - RNA, 64 nt, Human
gugccacacgagaaccugaaggggaaggaaauagcuuggguagcgcacucuucauggugacacu

SEQ ID NO: 259953 - RNA, 64 nt, Human
cacaaaagcccuguucacaggggaaugguguaaacauuuauacuguuuuguucacuguauuuag

SEQ ID NO: 259954 - RNA, 64 nt, Human
auacaaagaugacuggucccucauagcccucagacauuuauauauuggaagcugcugaggcccc

SEQ ID NO: 259955 - RNA, 64 nt, Human
aauccuuaugauaaaagucugucagucaaaaauacauuuauaaauuauuuaaugccaguccuca

SEQ ID NO: 259956 - RNA, 64 nt, Human
uuauuggggcuuacccccaccuuaauuagagaaacauuuauauugcuuacuacuguaggcugua

SEQ ID NO: 259957 - RNA, 64 nt, Human
uuaaagaccugacagcuugagaaggucacuacugcauuuauaggaccuucuggugguucugcug

SEQ ID NO: 259958 - RNA, 64 nt, Human
uugguuuauguuugguuauggcaagauguuacagcauuuauaguuaauacuacuacuaauaugu

SEQ ID NO: 259959 - RNA, 64 nt, Human
uuuuuuaaucagcauuaacaugggcaggcacccucauuuauagaugucaggaaacauucaguga

SEQ ID NO: 259960 - RNA, 64 nt, Human
ugaggcauuuuccugcagaaugggcaauuuuaugcauuuauauucaucagugcugcccucacuu

SEQ ID NO: 259961 - RNA, 64 nt, Human
aauuccaccuaucuuaaugugaauuaaaaaccaccauuuauaauaauaauagcgccauauucua

SEQ ID NO: 259962 - RNA, 64 nt, Human
agaggauauguuuauaaagugagcauguuggucccauuuauaaauauauguaugauuuauaagc

SEQ ID NO: 259963 - RNA, 64 nt, Human
aaggaugcuaaaccuuaguacugaguuacauugucauuuauauagauuauaacuugucuaaaua

SEQ ID NO: 259964 - RNA, 64 nt, Human
gaaggugaugcuguucuuauuguaaaaggaaagucauuuauauuaaagaauuuggaaggcaaag

SEQ ID NO: 259965 - RNA, 64 nt, Human
auuagccauccauuauuuaucuucuguggcaaugcauuuauaugguugauuggguggggaauuu

SEQ ID NO: 259966 - RNA, 64 nt, Human
cauuaaaaagaaacucauuuuuacgcugaaugaacauuuauaugauugcauugggaccagucau

SEQ ID NO: 259967 - RNA, 64 nt, Human
ucagaacaaagauuggaaaaagcuggccgagaaccauuuauacauagaggaagggcuuauggac

SEQ ID NO: 259968 - RNA, 64 nt, Human
aaaaggaaauccaaaaccuauucuaaacaauuugcauuuauauaauuuuccuguuuaacaacaa

SEQ ID NO: 259969 - RNA, 57 nt, Human
ugaggccucaucucaaaaaaaaaaaaaggccacaaaacucaacaauaaaaacaaaca

SEQ ID NO: 259970 - RNA, 57 nt, Human
ucauggcuaccucagaaagauuugaugggccacaacugucuuagacugcuagcuuuc

SEQ ID NO: 259971 - RNA, 57 nt, Human
gagcuccgagccaggucaggcuucggaggccacaagcucagccucaggcccaggcac

SEQ ID NO: 259972 - RNA, 57 nt, Human
gggagcagccucuacccucagcauccuggccacaaguucuuccuuccauugucccuu

SEQ ID NO: 259973 - RNA, 64 nt, Human
agacauaucacugcugcugggacuugaacaaagacauuuauauggguuuauuuucauucugcca

SEQ ID NO: 259974 - RNA, 64 nt, Human
ugggaacaucaauuuuguacuguuaugcaguaaacauuuauaauaauauaauuucagucauuuc

SEQ ID NO: 259975 - RNA, 64 nt, Human
uguuuuauuauuacuguuacauuaauuuaacaugcauuuauagaagaauacauucaaagcacug

SEQ ID NO: 259976 - RNA, 64 nt, Human
ugauguccucagauaaucuuaaugacuauuuuggcauuuauaaauagaaaugauuauggacuuu

SEQ ID NO: 259977 - RNA, 64 nt, Human
cagauaauugaauaaguaccuuuguguccuuguucauuuauaucgcuggccagcauuauaagca

SEQ ID NO: 259978 - RNA, 64 nt, Human
aauaugcuccugaagaaggcaacagauaugauggcauuuauaaggugcucuaucuggcaugaca

SEQ ID NO: 259979 - RNA, 64 nt, Human
aauguuacuauuuuaucagcaagguauuaaaaugcauuuauaaauucuucuuggcuucauucau

SEQ ID NO: 259980 - RNA, 64 nt, Human
cagaaagccugggugacauuugggagacaugugacauuuauauauugaauuaauaucccuacau

SEQ ID NO: 259981 - RNA, 64 nt, Human
agagagauguacaaggcuacagacuguaugauuccauuuauaugaaauauacauacuaggcaaa

SEQ ID NO: 259982 - RNA, 64 nt, Human
cuguuuuuaauaccauauacuuuauauuucuauacauuuauauuucuaauaauacaguuaucac

SEQ ID NO: 259983 - RNA, 64 nt, Human
uuuaggaauuucuuucuauagaguucuucauuaacauuuauacgaguuuuuugcugagucagau

SEQ ID NO: 259984 - RNA, 64 nt, Human
uuuuuaaaguuuccuuuacccugcccuuguugaacauuuauauaaucuaaccuggacaucaagc

SEQ ID NO: 259985 - RNA, 64 nt, Human
gaaaagacuuguugguuuauaugcugaaauuguucauuuauaauuaauuuuacuaauuucuacu

SEQ ID NO: 259986 - RNA, 64 nt, Human
cuaugcuguggauauaauaccaaccagaaauuggcauuuauaaaccuguuaagagacuuuaagc

SEQ ID NO: 259987 - RNA, 64 nt, Human
auccucuauguuucuuccucacaaaaccauaucucauuuauauccagaccauuacuucacuaua

SEQ ID NO: 259988 - RNA, 64 nt, Human
uagauauaugccuucccccacuaccguaaauguccauuuauaucauuuuuuauauauucuuaua

SEQ ID NO: 259989 - RNA, 57 nt, Human
aaggcggccuacagaaaaaggaaaaaaggccacaaaaguucccucucacuuucagua

SEQ ID NO: 259990 - RNA, 57 nt, Human
cagggucgucccuggcccaaggccaggggccacaaguuaguuggaagccggcguucg

SEQ ID NO: 259991 - RNA, 64 nt, Human
gacuauauuaacagcugcugaacaaaucagcucuggaggugauuccacauccccuggcauuaug

SEQ ID NO: 259992 - RNA, 64 nt, Human
acgcacaaagccuaaugagcucuuguccucaguccauuuauauaugaaaacuauacaacaaagg

SEQ ID NO: 259993 - RNA, 64 nt, Human
uauuaaaacaauauaagauaauuucuugauuugucauuuauaaauccuaaaguauauuuguuua

SEQ ID NO: 259994 - RNA, 64 nt, Human
auucauuauuaagcucugaaauucaggacacauacauuuauagagugugaggcugugcauacgu

SEQ ID NO: 259995 - RNA, 64 nt, Human
cagaauaaauucuggcuaguugaauccacaacuucauuuauauacaggcuucccuuuuuuauuu

SEQ ID NO: 259996 - RNA, 64 nt, Human
ccuucuguauuuuaaaauguaauauacuuuguaccauuuauaaaaauugugugaugaaugaauc

SEQ ID NO: 259997 - RNA, 64 nt, Human
aaauuaugugaauuuugccauauuaaaucuuccucauuuauacuauuauuuguuacguucaauc

SEQ ID NO: 259998 - RNA, 64 nt, Human
uuguaugauauuuauugguugugucuacugccaacauuuauauccaauucuaagauuucugaaa

SEQ ID NO: 259999 - RNA, 64 nt, Human
agauguaaacaaacaaauacacuauuucugggaacauuuauauugagauucuuuguggcuauug

SEQ ID NO: 260000 - RNA, 64 nt, Human
gugaaaaacauauuucuuuggaggaaaauguaugcauuuauaaguguuccauggaaucaguuuu

SEQ ID NO: 260001 - RNA, 64 nt, Human
aauauauuacauaauauaguuuaaugaaucauuacauuuauaauaacaaaggccacaauuuaau

SEQ ID NO: 260002 - RNA, 64 nt, Human
uauaagugaggaucuucaacaucuuucaaaaaugcauuuauauagucuuacuuuguuucuuuca

SEQ ID NO: 260003 - RNA, 64 nt, Human
aagcuucauuuaaauuauuucaucugaucauuaucauuuauaacuuuauuguuacuucuucauc

SEQ ID NO: 260004 - RNA, 64 nt, Human
cagaaaggaaugggggccucuucaaauuagaagacauuuauacucuuuuuucauggacacuuug

SEQ ID NO: 260005 - RNA, 64 nt, Human
aaugaugauuagagacaucaccgcuaaaaaacuacauuuauaagcuaggauuuguuauaugcaa

SEQ ID NO: 260006 - RNA, 64 nt, Human
cagacaaugaauuuaaucgggcccuugguggaaacauuuauauauuuaaugcagaugcauagug

SEQ ID NO: 260007 - RNA, 64 nt, Human
gaaauuugguuauucacugacauaauuauugggucauuuauaguuacauuuuauaauuuucuuc

SEQ ID NO: 260008 - RNA, 57 nt, Human
uggaaaugagugacuggaaaucccauaggccacaagaaugacuuucacaagggcagg

SEQ ID NO: 260009 - RNA, 57 nt, Human
gucccaaggcaagcgccccaaaccucgggccacaagacaccacuuccccuuuacccu

SEQ ID NO: 260010 - RNA, 64 nt, Human
accccucagugccugcucucauccaaauaaccugggaggugacaaucaggauaucucaggaggu

SEQ ID NO: 260011 - RNA, 64 nt, Human
uucggggcugcgccgccggcuuccuggaggggucggaggugaggcugcagccccugcgggcggg

SEQ ID NO: 260012 - RNA, 64 nt, Human
uuucucaagcagaggcaggaagagcuagucuuagcauuuauauuuuaauaggaaguugacuccc

SEQ ID NO: 260013 - RNA, 64 nt, Human
uuugcuuuuaugugauuuaucuguauacuuuguucauuuauauaaauaaaugucuuaaugguuu

SEQ ID NO: 260014 - RNA, 64 nt, Human
ccuauugugauauuaaguguuuauuucauaaugccauuuauacauagcugaauuugaugaggau

SEQ ID NO: 260015 - RNA, 64 nt, Human
ugaauuguacuucugagcugccuuaaugcaaggucauuuauauuuguuaagaggaaauaaucaa

SEQ ID NO: 260016 - RNA, 64 nt, Human
uggaaacauuaaugagguuuacauauuucucugacauuuauauaguucuuauguccauuucagu

SEQ ID NO: 260017 - RNA, 64 nt, Human
auuacaguuucaacuaucauauuuucuuugauuacauuuauaauuugaucuugcucugauuaua

SEQ ID NO: 260018 - RNA, 64 nt, Human
uucaccaucugggcaaucauuuauuuuccuugagcauuuauaaaccagggcgaggguuguucca

SEQ ID NO: 260019 - RNA, 64 nt, Human
aauauaggacagguacaauuuuggauaaauagcacauuuauaagaaccgcaaugaaaacugacu

SEQ ID NO: 260020 - RNA, 64 nt, Human
auuucucauuuguaccaaggcaucuccuacucuccauuuauauucuauggacccaagucuaugc

SEQ ID NO: 260021 - RNA, 64 nt, Human
uuucaaaugucagucaaguuuugcauuagggacacauuuauauauagcaaaagccugagcuguu

SEQ ID NO: 260022 - RNA, 64 nt, Human
aaauauaaauauauguauacacuacuaaauuuugcauuuauagcuaaauugaaucagaagacug

SEQ ID NO: 260023 - RNA, 64 nt, Human
uugugucaaacaguacacuaucuuaauuauuguacauuuauaguuguaacuauaguccagcuuu

SEQ ID NO: 260024 - RNA, 64 nt, Human
auuauugaauaguaauuaaacuuuaacugaugaccauuuauauucuaguagccaucuucacugu

SEQ ID NO: 260025 - RNA, 64 nt, Human
gccuuucauuauuuucagauagcggggucuuuuccauuuauagagaaugauguaacugccagga

SEQ ID NO: 260026 - RNA, 64 nt, Human
gaauugugagcaaaaugccgagaaacccaguuggcauuuauacaaaauguugaccucaggucua

SEQ ID NO: 260027 - RNA, 64 nt, Human
uugcuuccauguauuuuggaaaagaaaaugauuucauuuauaaaugaacauacuaaaauaguca

SEQ ID NO: 260028 - RNA, 64 nt, Human
auagcaggaaaacaaacaaaaguauuggacugucggaggugagccugugcgucuguaacccuuu

SEQ ID NO: 260029 - RNA, 64 nt, Human
aacuuugaaugaauuauaccuaaaucugggacagggaggugacaguggaacaggcuaccaauca

SEQ ID NO: 260030 - RNA, 64 nt, Human
uguucucuccagcccagcauacaggaggaucaaaggaggugacggagcaucguggcacggcagu

SEQ ID NO: 260031 - RNA, 64 nt, Human
ccaguuugaaugcagucuguccaggcucgucauuggaggugaacaagcaaacccagacggcucc

SEQ ID NO: 260032 - RNA, 64 nt, Human
acugcaacaugaugagguaguaccuuuuauaucccauuuauagaugggggaaagcaaagcacag

SEQ ID NO: 260033 - RNA, 64 nt, Human
aaaaaacuaguauuuuuauaucauaaaacaaugucauuuauagcuuaucauucauguauugucc

SEQ ID NO: 260034 - RNA, 64 nt, Human
guuugaagaaagaucuaggguccugggucucuugcauuuauaugucagaaaaggggcgauaugc

SEQ ID NO: 260035 - RNA, 64 nt, Human
cacuuucagauguuagagcagcguauuuuacaggcauuuauauccauugcuuuccucagcaagg

SEQ ID NO: 260036 - RNA, 64 nt, Human
gcauagaaaaagaauugcaauuuuaauuuaaaaacauuuauagaaaauucauuuaauuuuagug

SEQ ID NO: 260037 - RNA, 64 nt, Human
uauuaauaaauugguaauauacaaaacaauuaaucauuuauaguuuuuuuuguaauuuaagugg

SEQ ID NO: 260038 - RNA, 64 nt, Human
uuuccccuuuuuuucauaaaaaucuggucagggucauuuauauauuagaacaguuagacacauu

SEQ ID NO: 260039 - RNA, 64 nt, Human
uaggcuggagagacguccauagccuuagguauaucauuuauaccagacauuaugaaguuauuaa

SEQ ID NO: 260040 - RNA, 64 nt, Human
uaaccuuaacugaauucuccguuucuccuggaggcauuuauauucagugauaauuccuucccuu

SEQ ID NO: 260041 - RNA, 64 nt, Human
uuuacgguuuuauaaaauuaucuuccaguuuguacauuuauauggaauuguucuuuaucaaggg

SEQ ID NO: 260042 - RNA, 64 nt, Human
auguuucuuauauuuauguaaacuuaugacucuucauuuauauaguuacuuacuuuuucaugua

SEQ ID NO: 260043 - RNA, 64 nt, Human
uuucuccacacuuguaugccaauguagagaagaucauuuauauuugcagugccauccuuaaguc

SEQ ID NO: 260044 - RNA, 64 nt, Human
uauguacuucuucaauuuggaaacuuuucucucucauuuauagugaaaauacuuggaaguuacu

SEQ ID NO: 260045 - RNA, 64 nt, Human
ucucuuuuauauacauacacacacccaaacauaacauuuauaauagugugguaguggaauguau

SEQ ID NO: 260046 - RNA, 64 nt, Human
guuaugccaagcauaguaaauaaaggucaaguagcauuuauaauagaggaaguauuguuauccc

SEQ ID NO: 260047 - RNA, 64 nt, Human
ugaguuagcuucauguguauuauugcagcuugaucauuuauauaaauauuugucuaguacaaug

SEQ ID NO: 260048 - RNA, 57 nt, Human
uugaugaagcagaugaguuuguagcagggccacaaaacaaagugaaacguccagggg

SEQ ID NO: 260049 - RNA, 64 nt, Human
cccucaugggugcugccauccuuccuggagagagggaggugaaagcuggugugagcccaguggg

SEQ ID NO: 260050 - RNA, 64 nt, Human
acccagccaugaaggcugugaacgagcagggcaaggaggugaccgaguucggcaauaaguacug

SEQ ID NO: 260051 - RNA, 64 nt, Human
uugaccugcugguguucgaccucaagaccaugcgggaggugaggcgggcucugcgugcgcaccg

SEQ ID NO: 260052 - RNA, 64 nt, Human
uagaucuuuugguuuuauccccuggccucagagccauuuauauucccagaguaggcaguacagg

SEQ ID NO: 260053 - RNA, 64 nt, Human
uuuuuauuuucuuggguuauuuacaugucagagacauuuauaaaaagugaaaggauaaaaaaaa

SEQ ID NO: 260054 - RNA, 64 nt, Human
acuaacacaccguaauuuggcauuuguuuaaccucauuuauaaaagcuucaaaaaaacccaaac

SEQ ID NO: 260055 - RNA, 64 nt, Human
guacacuggucccaagguguaaagcuuuaagagucauuuauauaaaauguuuaaucucugcuga

SEQ ID NO: 260056 - RNA, 64 nt, Human
cacuuuuacuuaaacauaauauauaauggauauucauuuauacugauuuaugaaaguaaguuuu

SEQ ID NO: 260057 - RNA, 64 nt, Human
gccuggacccaaaggcaauacuguaauguaaagacauuuauaguacuaggcaaacagcacccca

SEQ ID NO: 260058 - RNA, 64 nt, Human
ccucacaugccauacccucaguuaagcauguuaacauuuauaggaggaaaaaaaucacuuuggg

SEQ ID NO: 260059 - RNA, 64 nt, Human
caggcgugagccaccccgcccggcccuuuuuuuucauuuauacuuuuucauuuagauuguaaug

SEQ ID NO: 260060 - RNA, 64 nt, Human
cuugaguuuuuauaauguucuucugaaagccuuacauuuauaacaucauaguguguaaauuuaa

SEQ ID NO: 260061 - RNA, 64 nt, Human
uuuuguaaaccauuuauugaauguucugaucuuucauuuauaacuuaagauuuuuuacagaacu

SEQ ID NO: 260062 - RNA, 64 nt, Human
cuuggggaugagauccaagucuaaacacaaaauucauuuauauuuuauauauaccuuguucaca

SEQ ID NO: 260063 - RNA, 64 nt, Human
auccauuuuacauguucacauguaucuauaacaacauuuauauuucuaaaacaaacuuuucaug

SEQ ID NO: 260064 - RNA, 64 nt, Human
ucuccacaaggcuacuguauuagaacgugcaaugcauuuauaugaaacugguguauggaagaca

SEQ ID NO: 260065 - RNA, 64 nt, Human
aucucuaaccauauuguaucucucccacuguauucauuuauacaccaucagcagacauuggcau

SEQ ID NO: 260066 - RNA, 64 nt, Human
cucuaugacaauaauacaaaccaauuuaagugaacauuuauauccgauaaggggugggagugug

SEQ ID NO: 260067 - RNA, 64 nt, Human
uuaauuugaauagaaaauaaucacauuuucaacccauuuauacaaauuguuaauguuucuuuag

SEQ ID NO: 260068 - RNA, 57 nt, Human
ggaggagggugaggggugccgcccaugggccacaaaucucuacaagugccugcuauc

SEQ ID NO: 260069 - RNA, 64 nt, Human
guggggggugcaggugggcacuggagcaugcagaggaggugagagugggagggagguaacgggu

SEQ ID NO: 260070 - RNA, 64 nt, Human
gcaccgaggccagcgaagccaucgcgcuccuugcggaggugaagaggacccugaguccccaccu

SEQ ID NO: 260071 - RNA, 64 nt, Human
auuuccaaacauccaaaaaaagggaaggauuuaaggaggugaagucgggucaaaaauaaaauau

SEQ ID NO: 260072 - RNA, 64 nt, Human
gaaggccacgauugcuggcuccacaauuuaguaacauuuauauuaagauauauauauagugguc

SEQ ID NO: 260073 - RNA, 64 nt, Human
uaauaucaaaugugaguuugggacugccuggcaacauuuauauuucuuauucagaacccuugau

SEQ ID NO: 260074 - RNA, 64 nt, Human
aaauugucuuuuuucccccagcgugaaauguauccauuuauaacugccuauugccuguucuauu

SEQ ID NO: 260075 - RNA, 64 nt, Human
uuauucccucauccuuucagguuuucagguugcccauuuauauucauuuacaugucauuugacu

SEQ ID NO: 260076 - RNA, 64 nt, Human
caacaaagagggaagauacagguugccaguuauacauuuauagaaagauaauccccuggcuuua

SEQ ID NO: 260077 - RNA, 64 nt, Human
uuuucccaggggacaggacccacugggagacaagcauuuauacuuucuuucuucuuuuuuauuu

SEQ ID NO: 260078 - RNA, 64 nt, Human
aucccccauugcaugggggaagggcauaaagaaucauuuauaugcacguggagacuccuuucuc

SEQ ID NO: 260079 - RNA, 64 nt, Human
uuggcugcugugaagauguaauuuuaucuuuuaacauuuauaauuauaugaggaaauuugaccu

SEQ ID NO: 260080 - RNA, 64 nt, Human
uaguuuagcuuccugauuuauauaaaugaaaucucauuuauaaaguauaauaaagaugacugua

SEQ ID NO: 260081 - RNA, 64 nt, Human
aauaugcauguagaaaagaccuacuuaaagucuucauuuauauucuuucaaaucaaaucuuuau

SEQ ID NO: 260082 - RNA, 64 nt, Human
aaguuagucugguuaagaguuuugguuuagacuucauuuauauuuuccuuacuaauaucuaaua

SEQ ID NO: 260083 - RNA, 64 nt, Human
gacagcuagaaagaugcugacuuugucaaacuugcauuuauaugaaaaccuucugucucuaaua

SEQ ID NO: 260084 - RNA, 64 nt, Human
uguaaaagaguuaaaaauuguuacuucauguauucauuuauauuuuauauuauuuugcgucuaa

SEQ ID NO: 260085 - RNA, 64 nt, Human
uuuuagucuaauugaaucccuuaaacucagggagcauuuauaaauggacaaaugcuuaugaaac

SEQ ID NO: 260086 - RNA, 64 nt, Human
uguugcauuacugggauuuuaaaaguuugauuuacauuuauauuccuuuucugguucccauguu

SEQ ID NO: 260087 - RNA, 64 nt, Human
cagugacuucagugguauccuuuuuuccuaagaccauuuauaauuauuaguggcaacagaguca

SEQ ID NO: 260088 - RNA, 64 nt, Human
ucuggcaggggcagaauccucacaggaucgccugggaggugaggugugugugacccacuggaug

SEQ ID NO: 260089 - RNA, 64 nt, Human
cacccccaaucccuugcagccaggccacaaugggggaggugaguccagccccuuggaacaggcu

SEQ ID NO: 260090 - RNA, 64 nt, Human
cuuuuuaaaaaggagaaacaggaagguuucuuuuggaggugaaaucuaauuauuggugagaguc

SEQ ID NO: 260091 - RNA, 64 nt, Human
agcggcggggcucauggcucccaucuuggccccuggaggugagcucauucacagaagugguccc

SEQ ID NO: 260092 - RNA, 64 nt, Human
auuaauugcauacaguaaaagucugugauuaaaacauuuauauaccucauucuuuaguguuguu

SEQ ID NO: 260093 - RNA, 64 nt, Human
uuuguaaacagaugaaaauuuuauuuucuuauuucauuuauaagauggcucaauguauugggag

SEQ ID NO: 260094 - RNA, 64 nt, Human
uuacauguguaguuuucuuucuucacagucaaagcauuuauauuauugggggugggggcaggga

SEQ ID NO: 260095 - RNA, 64 nt, Human
aggugucuuaagcuguaggcuuuucuuuguacugcauuuauagagauuuagcuuuaauauuuuu

SEQ ID NO: 260096 - RNA, 64 nt, Human
aaguugaauaucagucuauagcuaaugcuacuuucauuuauauuuuuaaauguucuuaguuuua

SEQ ID NO: 260097 - RNA, 64 nt, Human
uguuaaaagaaacauuaauuacauuggcaguuuucauuuauacauuguugacauaauuuuacuc

SEQ ID NO: 260098 - RNA, 64 nt, Human
guauuuuccccauauuauuuuaaauguccauuuucauuuauaggccaaauccugccaggaaagu

SEQ ID NO: 260099 - RNA, 64 nt, Human
caagaaaccuagauguuuuuuggugccaucucuccauuuauaaauguuggcaaccaauuugaac

SEQ ID NO: 260100 - RNA, 64 nt, Human
uuuuucucuucuccaguaauaaacaauuaccuuucauuuauacuuugauaaccuguauuuaauu

SEQ ID NO: 260101 - RNA, 64 nt, Human
aguugcauccagaaggguuuuguuagaaugaauacauuuauauuaggacugacaacuucagcuc

SEQ ID NO: 260102 - RNA, 64 nt, Human
auauuucaaugcaucaugcuuguaacaggcauuucauuuauaauaagaaugaguuauucauuug

SEQ ID NO: 260103 - RNA, 64 nt, Human
uguaacauggcuauuuccuaguuguaaaguucugcauuuauaagugccauuguuguaagguggu

SEQ ID NO: 260104 - RNA, 64 nt, Human
uuuaagagucaguguauagcaaaccaaaagaucacauuuauacccaaagcuuucuaguaaucag

SEQ ID NO: 260105 - RNA, 64 nt, Human
caguuuauuuacaggauuuguaaaauguuuucuacauuuauauagaacaugaaaagcauuuagu

SEQ ID NO: 260106 - RNA, 64 nt, Human
uauacauuuuugccaaauggcgcaaauauaccuccauuuauauuuuguaucuuaaaauguaguu

SEQ ID NO: 260107 - RNA, 64 nt, Human
auuuuauuaaaugccaauagauacaguauuuaagcauuuauaaacugaaaccuuuucaugugaa

SEQ ID NO: 260108 - RNA, 57 nt, Human
aaacucucagaaauccugaugacgucuggccacaauuaaggacucauuaacugauga

SEQ ID NO: 260109 - RNA, 57 nt, Human
ggggcggagucggggauggagggagcuggccacaacccacugcucugaugggugguu

SEQ ID NO: 260110 - RNA, 57 nt, Human
gaugcacaaaaaaccacccuguacgaaggccacaaagaacagcucagaugcacaaag

SEQ ID NO: 260111 - RNA, 57 nt, Human
cucaucaagaacaauaucgacuuccccggccacaacuacaccacguaagugcccagg

SEQ ID NO: 260112 - RNA, 64 nt, Human
ccauauguguauuagggugacugaguggugacuucauuuauaauaauacagagaauagcuauaa

SEQ ID NO: 260113 - RNA, 64 nt, Human
uuccuuaaucaaaccagcucugggaaauuuaauacauuuauauuaauugagauuauuaaaacau

SEQ ID NO: 260114 - RNA, 64 nt, Human
uguucaacaagcaacauuaaaaauagauuugaaacauuuauauauagagagguacacauuuauu

SEQ ID NO: 260115 - RNA, 64 nt, Human
auguagccaugauguuguucuaaagaugucuuaacauuuauagugaggauugacagaaauuaag

SEQ ID NO: 260116 - RNA, 64 nt, Human
ucugcacuuuggaaucaguucauuagaaugauaacauuuauauggauaaagaugcaguauuccu

SEQ ID NO: 260117 - RNA, 64 nt, Human
ggccauuaccgucauuggccugugaagcauuggacauuuauagauaauugauauaaaagaaucg

SEQ ID NO: 260118 - RNA, 54 nt, Human
uagaacccuuuccgguauaaucaccauuuauauagucgagacaguugucaaaga

SEQ ID NO: 260119 - RNA, 64 nt, Human
guuuuuauugcccccaaaauuacauguuaauuuccauuuauaucagggauucuauuuacuugaa

SEQ ID NO: 260120 - RNA, 64 nt, Human
cuugaugcuuuauaauccugacucucgacguguucauuuauacaaaaucaggaauaacuuuguu

SEQ ID NO: 260121 - RNA, 64 nt, Human
aaugauuaaaugucaguuccccuaaaccaauaaacauuuauacuagauuuuuuauuuccacuua

SEQ ID NO: 260122 - RNA, 64 nt, Human
caauuaguagcuuaccacagauacuguuuccuaccauuuauaaaauuuacuuuuuauugaaaaa

SEQ ID NO: 260123 - RNA, 51 nt, Human
uuuucuggcagcccaguuaaccauuuauaagauuuggaccuuggagcugaa

SEQ ID NO: 260124 - RNA, 64 nt, Human
cuuuuccacuguauaugccagucacaaucuugaucauuuauaugaaugaaacucccuuuuaaac

SEQ ID NO: 260125 - RNA, 64 nt, Human
cuuuggguugaagcuacuuuguuaggcuugaauucauuuauaugucuuuugauucuuaaaaaaa

SEQ ID NO: 260126 - RNA, 64 nt, Human
auccacaauuuaugauaucacuuuguaacccauacauuuauacaauuauaaauugucaauuuac

SEQ ID NO: 260127 - RNA, 64 nt, Human
aauuguuuaaauaucuggaaauacuuuuagcuaucauuuauaaagauaguuuuguucucaguuu

SEQ ID NO: 260128 - RNA, 57 nt, Human
aauauauuaaguuguauaaacuaucaaggccacaaaauacuaaugucauuuggucau

SEQ ID NO: 260129 - RNA, 64 nt, Human
caacuccugagugucccgcucuccugcuuaccuaggaggugagugccaggaaaauacaccaaau

SEQ ID NO: 260130 - RNA, 64 nt, Human
ugggagucugaggcaggagaauugcuugaacucaggaggugaagguugcaguaagcugagauug

SEQ ID NO: 260131 - RNA, 59 nt, Human
cgaccucucccagcugcugaaaggccacgggaggugaggcucuucacaucccauuggga

SEQ ID NO: 260132 - RNA, 64 nt, Human
ugacacccagaaggggcagaagaaccacauuuuucauuuauagauguuugcauccuuuguauua

SEQ ID NO: 260133 - RNA, 64 nt, Human
uuuugaaaaacuagugguggacacauuuggaucacauuuauacaguuauaaaaauaaagguuug

SEQ ID NO: 260134 - RNA, 64 nt, Human
uaugacaauuugcacagcccaguggcuuaaacaccauuuauaccacagguccagaugaauccug

SEQ ID NO: 260135 - RNA, 64 nt, Human
uagugaaauguagaggaaggcucaaaggagucaacauuuauaucuggaagggacaagucaugcc

SEQ ID NO: 260136 - RNA, 64 nt, Human
uuuggcauuugaaaugaucauuuuauuuuacaaucauuuauaaugaaucaauguuccaguuagc

SEQ ID NO: 260137 - RNA, 64 nt, Human
cucuauagaaguacccacagaaaguaaaguaucacauuuauaaauaccaaagauguaacaauuu

SEQ ID NO: 260138 - RNA, 64 nt, Human
uaauuuugggagguuuucauuaguggaagcucuucauuuauaaagcuauuugaagggguuuagg

SEQ ID NO: 260139 - RNA, 64 nt, Human
auuuacaaaucccgugcucuaaaauguucucaaacauuuauauagauuucccuuucaucuuacu

SEQ ID NO: 260140 - RNA, 64 nt, Human
gaaauugucagcuauacauuuaucuuuaugaacucauuuauauuccuuuuuaaugacucguugu

SEQ ID NO: 260141 - RNA, 64 nt, Human
cccaguauaaacauuagccugcuuaauauuuagacauuuauagguagaauucugagcacucaac

SEQ ID NO: 260142 - RNA, 64 nt, Human
aguggguuguguuugugcuucucccaccuuucagcauuuauagaacaugcugccccacauacaa

SEQ ID NO: 260143 - RNA, 64 nt, Human
uucacauugggucucugguccugugucuucaccucauuuauagcacgucuccuugauuuuuggu

SEQ ID NO: 260144 - RNA, 64 nt, Human
caugauucugaacuugaugcuucguggaaugcugcauuuauauguaagugacauuugaauacug

SEQ ID NO: 260145 - RNA, 64 nt, Human
uaaaacucuauuuuuauuuggggcagaguaauuucauuuauagugccaguagguguaccuugug

SEQ ID NO: 260146 - RNA, 64 nt, Human
gagaaaaucuaaaaugaaaaguggauaaacagaacauuuauaagugaucaguuaaugccuaaga

SEQ ID NO: 260147 - RNA, 64 nt, Human
acuaucugucuguaaaauacuuuuuuuaagaaagcauuuauauuuauaugacagcuugaacuga

SEQ ID NO: 260148 - RNA, 57 nt, Human
acuacccaccuggggaugaagcucacuggccacaauacccaccucuguggaugaugu

SEQ ID NO: 260149 - RNA, 57 nt, Human
gaccauucagaaauaaagcaaaaagcaggccacaaccuuaaccaacaccaaagaaac

SEQ ID NO: 260150 - RNA, 57 nt, Human
cuucagcccgccgcagacuucacagcuggccacaacgagccuguagccaacggcagu

SEQ ID NO: 260151 - RNA, 57 nt, Human
uauacaaggaauaugacauacagugcuggccacaaccuucugaaggcccaugcccug

SEQ ID NO: 260152 - RNA, 64 nt, Human
uauauuucuguucaguauccauucacuaguucuucauuuauaaauaucaucuuccccauucugc

SEQ ID NO: 260153 - RNA, 64 nt, Human
caucuccuuuucucccugauacauagcccugagacauuuauagcguucaggagucuucuauugc

SEQ ID NO: 260154 - RNA, 64 nt, Human
ggguaaugugacaccugcagaaacuauagagcgucauuuauacguaguuuggcagaaaccacuu

SEQ ID NO: 260155 - RNA, 64 nt, Human
gaaguagcaauaggcuguaaucaagaaaauaugccauuuauagagauaagauaaaugaaauaau

SEQ ID NO: 260156 - RNA, 64 nt, Human
gcaucugaaauuuuguuuguacauguaucuugaucauuuauaaagccacugugaucuauaaauc

SEQ ID NO: 260157 - RNA, 64 nt, Human
ucaagucccuuuacauaaauaguauuugguaauacauuuauagaugagaguuauaugaaaaggc

SEQ ID NO: 260158 - RNA, 64 nt, Human
uaagucaagauacuguuuuaggaguuuacccucucauuuauaaccaaaguugcucuaaaacacu

SEQ ID NO: 260159 - RNA, 64 nt, Human
uguguuuuugcuuauuuuucuaugcauaguuaugcauuuauauucucaaaaaugaaaucauaau

SEQ ID NO: 260160 - RNA, 64 nt, Human
ugaucucacucaaauugacauuugcauaauuugacauuuauauucauucaguuaugacuacuug

SEQ ID NO: 260161 - RNA, 64 nt, Human
auuucuuucauucuugcugguuuauaccuauguucauuuauaugcuguaaaaaaguaguagcuu

SEQ ID NO: 260162 - RNA, 64 nt, Human
acuguggauguggaaaaccuuuucuagcuuagagcauuuauaucuacaauacauuuuaaaguca

SEQ ID NO: 260163 - RNA, 64 nt, Human
agauuagacucuaaaauuguggccauuggaaucucauuuauaaauggaccuuuuaaguauauua

SEQ ID NO: 260164 - RNA, 64 nt, Human
gacuaaaggaagauacuuacucucugccccucuccauuuauaccaaagaaaucauaggugaaac

SEQ ID NO: 260165 - RNA, 64 nt, Human
cccauggaagaaaacacagaguagauauugcugucauuuauacaacuacagaaauuuaucuaug

SEQ ID NO: 260166 - RNA, 64 nt, Human
guugcugcccguauuaggccacacaguggaaccccauuuauaucauagcagaagaaauaggauu

SEQ ID NO: 260167 - RNA, 64 nt, Human
aggaaccaagaaagcaauacuguacauaaaaugucauuuauauuuuccaaccuggcaugggugu

SEQ ID NO: 260168 - RNA, 57 nt, Human
uccaauggccacuggagauguguguagggccacaagaaugagaaagggggcaaugga

SEQ ID NO: 260169 - RNA, 57 nt, Human
agguuguuaccucaguaaaaaccuucaggccacaaagcaaaaaguugcauagccaca

SEQ ID NO: 260170 - RNA, 57 nt, Human
auacaaucuagugucaaaaacauaaauggccacaaaaaaguaguuugaguguuauga

SEQ ID NO: 260171 - RNA, 57 nt, Human
cccugcgucggcccugggguaccauguggccacaacugcuguggcccccugucccca

SEQ ID NO: 260172 - RNA, 64 nt, Human
auaaaauguggaagugaauuaaacaaguuuuagucauuuauacaaagucacaaauauaaaguuc

SEQ ID NO: 260173 - RNA, 64 nt, Human
ggagcuucuagaauuacgaaggccauaccugccacauuuauaaaauaaugguuuuaucccugcc

SEQ ID NO: 260174 - RNA, 64 nt, Human
aguccucugcuguuuacuucugcaggagcugauccauuuauaaaugcaguuuuaauaaaccaug

SEQ ID NO: 260175 - RNA, 64 nt, Human
uauacuguaaucgugcuauuuuuuaucauugaaacauuuauaaacuagaauaauaaugcccuua

SEQ ID NO: 260176 - RNA, 64 nt, Human
cuagauuuuauggcuuuaguucacugugauuguacauuuauacuuggccuaugugcuggccgca

SEQ ID NO: 260177 - RNA, 64 nt, Human
uacuuaaaaagaaaccucugugcuagcaauaaagcauuuauauuguguacuccuugggauuguu

SEQ ID NO: 260178 - RNA, 64 nt, Human
acuuacuacaagaaggaucuuuuuucaagcuguacauuuauaaaaacagaucauauacuguaua

SEQ ID NO: 260179 - RNA, 64 nt, Human
aggccuaauaaaaugcccaagaaaauauucagugcauuuauagagaaggauauuuuguaguagu

SEQ ID NO: 260180 - RNA, 64 nt, Human
gaaaggaaacaguuuaaugguggaaaugaacuaccauuuauaacuucuguuuuuuuauugagaa

SEQ ID NO: 260181 - RNA, 64 nt, Human
uggagaauuuagguuuuuauuaguaccauaguaccauuuauacaaauuagaaaauguuauuuaa

SEQ ID NO: 260182 - RNA, 64 nt, Human
uuuuauaugaagauaaguguauuuuucaauaaagcauuuauaaauuagccuuuguuugguuaua

SEQ ID NO: 260183 - RNA, 64 nt, Human
gaauggaaguuaugaccaagggaauuaugcuguucauuuauaauaguggacauuauggagagcu

SEQ ID NO: 260184 - RNA, 64 nt, Human
gagcugugcauguacauauauacauauauagauacauuuauaauauauacacacagucuauaua

SEQ ID NO: 260185 - RNA, 64 nt, Human
uuuagcaacugacauuauuuuguauaucagugcccauuuauauaaugguuauaaaauuuacagu

SEQ ID NO: 260186 - RNA, 64 nt, Human
aguggaaacaauaaucaucucuauugcuuggugucauuuauaggaagcacugccaguuaaagag

SEQ ID NO: 260187 - RNA, 64 nt, Human
ugguuauuguguucacaucauaguauucaagcaucauuuauaguuugguuuugagaacuuuucu

SEQ ID NO: 260188 - RNA, 57 nt, Human
aaauacuguguauuacuuuauuuuacaggccacaauugauuaugaagucacccugug

SEQ ID NO: 260189 - RNA, 57 nt, Human
uguugcccaggcuggucucgaacuccuggccacaagugugccucccgccuuggccuc

SEQ ID NO: 260190 - RNA, 57 nt, Human
cucaacagcuaccccagccaacaccaaggccacaaggggaccccggccuaggaggca

SEQ ID NO: 260191 - RNA, 57 nt, Human
ggaaggagccggccugcugggcagcguggccacaaggggcggcacuccucaggccgg

SEQ ID NO: 260192 - RNA, 64 nt, Human
auauauauuaucuuuucauacauuuucuaagaaacauuuauauugauaagaucuuuuauuuugc

SEQ ID NO: 260193 - RNA, 64 nt, Human
aaacacagcaguguuuugagggagaaaggaccaucauuuauaaugcucuguacauacuaccaga

SEQ ID NO: 260194 - RNA, 64 nt, Human
gguuaaaauuuaugggacuuugcuauguaguuggcauuuauaaaaucugaaguaucauaaauaa

SEQ ID NO: 260195 - RNA, 64 nt, Human
uugauuuuuuuaauaagaauuuucauuuuaagcacauuuauacugaaggaauuugugcugugua

SEQ ID NO: 260196 - RNA, 64 nt, Human
uaaguuuucuuauugcuaacaaugucacagugaacauuuauauauucauuaaauccuuuuccuc

SEQ ID NO: 260197 - RNA, 64 nt, Human
augucaaugucaacacugagucuaauuuugaccacauuuauagugguauagugucaauacugca

SEQ ID NO: 260198 - RNA, 64 nt, Human
gccaguguugcgcauuacuuacaauaaaagggaucauuuauaucagagggguccuguggcagug

SEQ ID NO: 260199 - RNA, 64 nt, Human
gcuauagaggcuccaagugcaauuaauaauaacucauuuauaccuuccacagaauuuaauaaag

SEQ ID NO: 260200 - RNA, 64 nt, Human
ccauguaugucaaauacagguuaaaauaucagggcauuuauauaaagaguuguagucuucugau

SEQ ID NO: 260201 - RNA, 64 nt, Human
augagccagucaccaucccaugauaugaaagugucauuuauaucaacuuguccauguguuaaau

SEQ ID NO: 260202 - RNA, 64 nt, Human
gauauauauauauuguuucuacgacaugguauugcauuuauaucuuuuuacuacagugaucugu

SEQ ID NO: 260203 - RNA, 64 nt, Human
guuugcaggacugacuaucaaacuggaugauuuccauuuauacccuacugugucaguucaagca

SEQ ID NO: 260204 - RNA, 64 nt, Human
ugcacuuguucucauaguaguaaaaugcuaugcgcauuuauaccuugcauaaguccucauucua

SEQ ID NO: 260205 - RNA, 64 nt, Human
aaguaaaccuggcagcuauagaauacacuaugugcauuuauaauagcuauuuuauauauuguag

SEQ ID NO: 260206 - RNA, 64 nt, Human
acaaaaaaaauuucaacagauugugugguuugugcauuuauauccuguuaagcauuaauagcua

SEQ ID NO: 260207 - RNA, 64 nt, Human
uuugaauuuauaaaauuaauguuuuucuuuguaacauuuauauauauuuuuuaacauuuuaagu

SEQ ID NO: 260208 - RNA, 57 nt, Human
ggagacagaggcagacuggagugaugcggccacaagcccagggacaccuggagcccc

SEQ ID NO: 260209 - RNA, 64 nt, Human
auucucacuggggugauuaguggaggaagucuggggaggugagcuacuggaagagacagggcaa

SEQ ID NO: 260210 - RNA, 64 nt, Human
ucacugguacaaacagcuguugaagcucagagcuggaggugagcuucugaggccuuugccauua

SEQ ID NO: 260211 - RNA, 64 nt, Human
uguguuccaggaccauguaccgcguuauguggcgggaggugaggcgggagguucagcagaccca

SEQ ID NO: 260212 - RNA, 64 nt, Human
aaaaaagaagcuuaauuucaugcuucauaaguagcauuuauauuuauagcaccaauguacauuu

SEQ ID NO: 260213 - RNA, 64 nt, Human
gccuggcuucuuucacguagcauuuugagaaaagcauuuauacuauuuacagauuguugacaaa

SEQ ID NO: 260214 - RNA, 64 nt, Human
uuuaagagcuuucagaauuguacugggugaaucucauuuauaaaacuuccuaagagacuaucug

SEQ ID NO: 260215 - RNA, 64 nt, Human
ccuuuguuucaacuuucuuaucuggaaauaauaucauuuauaaagggacacuuuuauguuuuuc

SEQ ID NO: 260216 - RNA, 64 nt, Human
uccaguuuuguggauuaaaccuuuuuauaaagaucauuuauaauacuguuuuaaaaugugaggc

SEQ ID NO: 260217 - RNA, 64 nt, Human
accaaguccuggacguaaaaucgaauaaaagacacauuuauauccaauagagaccacaccugua

SEQ ID NO: 260218 - RNA, 64 nt, Human
uagcaagugucacugcucaucaguuacuuccuuccauuuauaucacaaauacccaaguuucaau

SEQ ID NO: 260219 - RNA, 64 nt, Human
gccugauuuuuuuuuuguuuucugccccuccccccauuuauaggugugguuuucauuuuucuaa

SEQ ID NO: 260220 - RNA, 64 nt, Human
cucacuuaccucucuguguucagauguggccuuccauuuauaugugaucuuuguuuuauuagua

SEQ ID NO: 260221 - RNA, 64 nt, Human
uacaauuuuuaugaaugguggucuuugcaaagagcauuuauauuuucuuuuuuuuuuacuaaaa

SEQ ID NO: 260222 - RNA, 64 nt, Human
uuuauauaauguguuuugcuugaauaaaauguuacauuuauacuuugagaacucugaccaaauc

SEQ ID NO: 260223 - RNA, 64 nt, Human
uauuuccaguugaccaaauauucuaaucuuuuuucauuuauaugcaaaagaaauaguuuuaagu

SEQ ID NO: 260224 - RNA, 64 nt, Human
uagaucaagcaaauguguuuaaaaaccaucuacacauuuauaaauguugaucugugaucuagca

SEQ ID NO: 260225 - RNA, 64 nt, Human
uuaaugaaugcucacaccuuauugcacaggagagcauuuauacuugaaaaaaauuguacaaaua

SEQ ID NO: 260226 - RNA, 64 nt, Human
aaaacuuaaugcucacacuuuauugcuaggaaagcauuuauacuugagauaaauuauacaaaua

SEQ ID NO: 260227 - RNA, 64 nt, Human
guuuuuaacuaauacaccuuauugcacagaaaaucauuuauauuugagaaaaauuguagaaaua

SEQ ID NO: 260228 - RNA, 57 nt, Human
guacuggucaagaugggucaagcaagcggccacaagggacugaggcaagcacaaugg

SEQ ID NO: 260229 - RNA, 57 nt, Human
cugauccaccuccuccucccaccaguuggccacaauugaucucuugugagaggggug

SEQ ID NO: 260230 - RNA, 57 nt, Human
gcuggacugucagccagucgcagggccggccacaagacccaugucuccaucugguca

SEQ ID NO: 260231 - RNA, 57 nt, Human
aaauaguugguuccuaagaaugugaugggccacaaggaaagagagaccccagucaag

SEQ ID NO: 260232 - RNA, 64 nt, Human
uucgacaaugcucacacccuauugcacaggaaagcauuuauacuugagaagaaauguacaaaua

SEQ ID NO: 260233 - RNA, 64 nt, Human
ccaccuuucagugaagagauaguuaagccaauuccauuuauagaccaccuccagccagugacgc

SEQ ID NO: 260234 - RNA, 64 nt, Human
cuuuccagacuuuguaccacugcuucuguuuauucauuuauaugcuuuugugucccauaaauua

SEQ ID NO: 260235 - RNA, 64 nt, Human
auauaacucagaaaacauaagaauauuccuuugucauuuauagguuuguaauaccaauauuuau

SEQ ID NO: 260236 - RNA, 64 nt, Human
uguguaauaauauuuauguaaauuggaaugaaaucauuuauaaagaacaacuguuucuauuauu

SEQ ID NO: 260237 - RNA, 64 nt, Human
uggagauaauauccaguaaaauagauuaaacuuccauuuauaaagucagaaccuaucucugaaa

SEQ ID NO: 260238 - RNA, 64 nt, Human
agauagcuggcagagggcagggcaagggauuggccauuuauacugggcucgagcucagaagccc

SEQ ID NO: 260239 - RNA, 64 nt, Human
acuuggauuugaaguuagaagaaauguuggaagucauuuauauaugaagaaauguuggaaggac

SEQ ID NO: 260240 - RNA, 64 nt, Human
aauucuugcagaccaugaacauaagcuaccuucccauuuauaugcgucuuguucaauuucauuc

SEQ ID NO: 260241 - RNA, 64 nt, Human
aaaacuuugcaagauuugacuuguuuaaaaaucacauuuauaagugaaccguauuaaaacuuuu

SEQ ID NO: 260242 - RNA, 64 nt, Human
cugucuaugcaugcacacccacaagccuauacaccauuuauauaccuacacgcacgcaagagac

SEQ ID NO: 260243 - RNA, 64 nt, Human
uuuaaugaauacucacaccuuauugccaggaaagcauuuauacuugagaaaaauuguaccaaua

SEQ ID NO: 260244 - RNA, 64 nt, Human
gaguaauauucugcauuaugagaaaacuuaauuucauuuauaaguaaauuaaaauuaguauauu

SEQ ID NO: 260245 - RNA, 64 nt, Human
acuuuuaacuaaugcucacaccuucacaggaaagcauuuauacuugagaaauauuguacaaaua

SEQ ID NO: 260246 - RNA, 64 nt, Human
acauuguaaauuauacagaagauaccacagauagcauuuauaaaguauacagaaacauuaucug

SEQ ID NO: 260247 - RNA, 64 nt, Human
aaaaugugauugugguuaaaugaccuuuuucuugcauuuauagcaacaguguuuuaugcaccug

SEQ ID NO: 260248 - RNA, 57 nt, Human
guuacuuggagugggggguggggguggggccacaaaaggaaaaccggaggagcaauu

SEQ ID NO: 260249 - RNA, 57 nt, Human
agcaacucauauaucagucucucacauggccacaauucuagacaaaaaccaaagacc

SEQ ID NO: 260250 - RNA, 57 nt, Human
agggggcccagaggagcaauagcccugggccacaagcguggguaggccuuucacgua

SEQ ID NO: 260251 - RNA, 57 nt, Human
agaugcaggccuucaagggcaaggagaggccacaaggaauaugggugggaguaaaag

SEQ ID NO: 260252 - RNA, 64 nt, Human
caagcugcaugcauuaacagacaguuuaauuaagcauuuauaacggaaucaggcacaccuuuuc

SEQ ID NO: 260253 - RNA, 64 nt, Human
guucuuuaguagcaacuaaaaugugucuugcugucauuuauauuccuuuucccaggaaagaagc

SEQ ID NO: 260254 - RNA, 64 nt, Human
aaauacuuaacacaugugcacauguacacauguacauuuauaugcagugaauuguuacucgugg

SEQ ID NO: 260255 - RNA, 64 nt, Human
gggugccccagggacgugauaaugcagauaaauacauuuauauuuuuaagaaaaagcgagccuc

SEQ ID NO: 260256 - RNA, 64 nt, Human
cauucaucaacaucagagaauccauacuaaagagcauuuauaauaauuauaugugauagagauu

SEQ ID NO: 260257 - RNA, 64 nt, Human
auaacugauagauaacucauuggaaacgugcauacauuuauauucagaugaaauuaugguuugc

SEQ ID NO: 260258 - RNA, 64 nt, Human
cagcuuuaccgaaaacgcaagggaaguuucauuccauuuauacuucuccagacccccugccauc

SEQ ID NO: 260259 - RNA, 64 nt, Human
aucaugucuuacugaucuaacccuaaauccaacucauuuauacuuuuauuuuuaguucaguuua

SEQ ID NO: 260260 - RNA, 64 nt, Human
agagucugggccucugacucugaguccacugcuccauuuauaaccccagccugaccugagacug

SEQ ID NO: 260261 - RNA, 64 nt, Human
ugcaguauccuuuaaaagcaaaaaaaaaaaaaugcauuuauauuacaguuuuccucuaugaaag

SEQ ID NO: 260262 - RNA, 64 nt, Human
gccaguuauuuccuuuuuaagccuauuuccuauccauuuauagcuacuacugaaaaugacuacu

SEQ ID NO: 260263 - RNA, 64 nt, Human
uuuuaucuuuaguucaacaccaucaugguggauucauuuauaccaucuaauauaugacacacug

SEQ ID NO: 260264 - RNA, 62 nt, Human
cucuuuuugcuacuacauaaaagaaagauacucauuuauaguuacguucauuucagguuaaa

SEQ ID NO: 260265 - RNA, 64 nt, Human
cagcaaaaccauugcuucacuacccaucgguguccauuuauagaauaaugugggaagaaacaaa

SEQ ID NO: 260266 - RNA, 64 nt, Human
cuaaugugccauauuuugcugugagugaccuuaacauuuauauuuuuauaugaauuguuucaug

SEQ ID NO: 260267 - RNA, 64 nt, Human
cuagcuuaaaugaauguguucuauuugcuuuauacauuuauauuaauaaauuguacauuuuucu

SEQ ID NO: 260268 - RNA, 57 nt, Human
agccagcaagucuggacacauuacaaaggccacaagggguuuuauccuggaccccgg

SEQ ID NO: 260269 - RNA, 57 nt, Human
aaccgcacacccauacacaacuacaagggccacaaagcaacugcuggguuagcuuuc

SEQ ID NO: 260270 - RNA, 57 nt, Human
aacgcagggggccucuguaaggcacauggaggugaugguguuucuuagagagaagau

SEQ ID NO: 260271 - RNA, 64 nt, Human
gucauuguuaaagcguacauacuguaaauuaaagggaggugaauggaaauuaaugaauaaacau

SEQ ID NO: 260272 - RNA, 64 nt, Human
auuguuuaaaaacagcuuagggauuaauguccuccauuuauaaugaagauuaaaaugaaggcuu

SEQ ID NO: 260273 - RNA, 64 nt, Human
cacgacauagcauuauguacauagaugaguguaacauuuauaucucacauagagacaugcuuau

SEQ ID NO: 260274 - RNA, 64 nt, Human
aaucaucuuuacggaauguggugcugagagacuacauuuauaauuggagauccugaacaccaaa

SEQ ID NO: 260275 - RNA, 64 nt, Human
ucccccuuuuuauauaauaauuauauaacuuaugcauuuauacacuacgaguugaucucggcca

SEQ ID NO: 260276 - RNA, 64 nt, Human
uguagaauauucaccuuuaaaacuaguuaguaugcauuuauaauuuuaccagaauauacaacua

SEQ ID NO: 260277 - RNA, 64 nt, Human
auauaagauuucaaauaaaauuuugaaccaaaaacauuuauaaugccguucugguuuuucuauu

SEQ ID NO: 260278 - RNA, 64 nt, Human
gagaguugcacucccagaaaccuuuuaagagauacauuuauagcccuaggggugguaugaccca

SEQ ID NO: 260279 - RNA, 64 nt, Human
ggauaguauaggaagacauuaauccuagcauugucauuuauauacauuaaugaaauccugauga

SEQ ID NO: 260280 - RNA, 64 nt, Human
guuucugugagggaggcugcuuucugugaaauuucauuuauauuuuucuauuuuuaguacugua

SEQ ID NO: 260281 - RNA, 64 nt, Human
uggaggaauauauuuacucaauaauggcaccuuacauuuauaaauuguaacaguugucuaauaa

SEQ ID NO: 260282 - RNA, 64 nt, Human
acaugccuauauauuuuauacacugaggguagcccauuuauaaauuaagagcacauuauauuca

SEQ ID NO: 260283 - RNA, 64 nt, Human
aauuauuuuuuucaaugagugcugaaugggaaaacauuuauaucuuacuauaaaagguucuguu

SEQ ID NO: 260284 - RNA, 64 nt, Human
gcugguuuguccgacacccaaagcccacuucacacauuuauaaggacagagauuugguaacuca

SEQ ID NO: 260285 - RNA, 64 nt, Human
uuuuagugugcuuuaaaguagauaguauacuuuacauuuauaaaaaaaaaucaaauuuuguucu

SEQ ID NO: 260286 - RNA, 64 nt, Human
uaacuccccucccgccuacccccaucccaaacugcauuuauaauuuugugacugaggaucauuu

SEQ ID NO: 260287 - RNA, 64 nt, Human
acauucaaaacugucuucaagaagucacguuuuucauuuauaacaauuuucuuauaaaaacaug

SEQ ID NO: 260288 - RNA, 57 nt, Human
ccucccaggcccgucugccagggcgccggccacaauccugcagggccaaggacugga

SEQ ID NO: 260289 - RNA, 50 nt, Human
acuacuacaauuccgccuagggccacaaggccuucccuguuuucccccca

SEQ ID NO: 260290 - RNA, 57 nt, Human
cccacucccccagacaccuggacacguggccacaaaucugggacaaggggcccccgc

SEQ ID NO: 260291 - RNA, 57 nt, Human
uucgcccucugaagcuguuccucuacuggccacaaacucugggccuggugggagagg

SEQ ID NO: 260292 - RNA, 64 nt, Human
auguaaugcuaaccuucugaauauauuuugaauacauuuauauauucacuguugccuuauaaaa

SEQ ID NO: 260293 - RNA, 64 nt, Human
aaagaaaacagguuggaacauacauauagccuagcauuuauaacagaauuguugaacgucugua

SEQ ID NO: 260294 - RNA, 64 nt, Human
gagauacagaauuuuaugcggcauuuucuucucacauuuauauuuuugugauuuugugauugau

SEQ ID NO: 260295 - RNA, 64 nt, Human
guugcaaucauaauaugaguugcauccucccucucauuuauaucaaauauacuugacuagauuu

SEQ ID NO: 260296 - RNA, 64 nt, Human
uaguucaauucauaauuaucgcaauuauccauaacauuuauauagcgguguaauaacugcagca

SEQ ID NO: 260297 - RNA, 64 nt, Human
agcucuggaucaccacuugauuauguaguagacucauuuauaaagcagcuuaggaacuaauuaa

SEQ ID NO: 260298 - RNA, 64 nt, Human
uuuuauauaguuuaggaguaagagucuugcuuuucauuuauacugggaaacccauguuauuucu

SEQ ID NO: 260299 - RNA, 64 nt, Human
aaccagucucaaauggucacauacuguaugaucgcauuuauauaacauucuugaggugacaaaa

SEQ ID NO: 260300 - RNA, 64 nt, Human
cuuuucugauguugaugcaugucuuugggaaacacauuuauaaacauggauaccugauaauaga

SEQ ID NO: 260301 - RNA, 64 nt, Human
cauacagauuuuuguuagucaucauguaauaagccauuuauaucagaaaccuuuuuuccugcca

SEQ ID NO: 260302 - RNA, 64 nt, Human
ugccugagacucuagcagaaauggccuguuuguacauuuauaucucuuccuucuaguuggcugu

SEQ ID NO: 260303 - RNA, 64 nt, Human
gucccuagagacuaccuaguuguagugugaccuacauuuauaauuauugucauguccgaauaga

SEQ ID NO: 260304 - RNA, 64 nt, Human
acuguaauguugcugaacaccuuucccuguuuuccauuuauacacauauuaaagucauauuggg

SEQ ID NO: 260305 - RNA, 64 nt, Human
gugauccaaauucuacugucuuccaagaaagcuacauuuauacauccaaacaaauucuuuucca

SEQ ID NO: 260306 - RNA, 64 nt, Human
caaauaagacuuuaccuuuaaaugaauuucucagcauuuauacuaaaaauuauguaaagugcuc

SEQ ID NO: 260307 - RNA, 64 nt, Human
ugauauucuucgacacacguggguaaguugaugccauuuauaaauguuuuauugaaauuugaua

SEQ ID NO: 260308 - RNA, 57 nt, Human
ggguuacaggugugagccacugcacccggccacaagauguaauuuuuacuuuaucuc

SEQ ID NO: 260309 - RNA, 57 nt, Human
ugccucagccugaacucuucacugaguggccacaauuuucacugggaacaaaaagua

SEQ ID NO: 260310 - RNA, 57 nt, Human
guuggcugaacgcugacugcagcuccuggccacaauagccucaucaacauggcugcu

SEQ ID NO: 260311 - RNA, 57 nt, Human
ccuuccccaaccccagacacagggguuggccacaaucccacugaaugcccuugguuc

SEQ ID NO: 260312 - RNA, 64 nt, Human
ucuuccccuccugcuuuagugccaccccaaacugcauuuauaauuuugugacugaggaucguuu

SEQ ID NO: 260313 - RNA, 64 nt, Human
uaucaguaaacagguuuuuaaaaaucuuuuaugucauuuauaggauaaaacauaugcuugucug

SEQ ID NO: 260314 - RNA, 64 nt, Human
aauggugccauauauaagguuaggcuucuuggaacauuuauaaacccaaaccaauaccuguaac

SEQ ID NO: 260315 - RNA, 64 nt, Human
agaagcaaaaacaaaaguaaacuccuuucccuggcccuccaaacauauauucugugagauaacu

SEQ ID NO: 260316 - RNA, 64 nt, Human
uuuuccuccucuaagcccaaagauuaacuagagucccuccaaccuuauagauuguuggcuuuca

SEQ ID NO: 260317 - RNA, 64 nt, Human
acccucaaacacccagcucagccacacacaacuacccuccaaaccaccacagucucugucacac

SEQ ID NO: 260318 - RNA, 64 nt, Human
cacacacacacaugcacaagucaugugcgaacagcccuccaaagccuaugccacagacagcucu

SEQ ID NO: 260319 - RNA, 64 nt, Human
cucuguuuccuaauucaggaccccacucaucuagcccuccaagagccuccgccaaauuguagcc

SEQ ID NO: 260320 - RNA, 64 nt, Human
ggaccaaaccugaacacacagauaccucacucaucccuccaauucaagccucucaacucaaaag

SEQ ID NO: 260321 - RNA, 64 nt, Human
ugccugacccugaaccagaacccagcugaacugccccuccaagggacaggaaggcugggggagg

SEQ ID NO: 260322 - RNA, 64 nt, Human
cacauuucuaauaccaccaccccugugcuucaggcccuccaaaccccuguguuccccaaauguu

SEQ ID NO: 260323 - RNA, 64 nt, Human
ucuucuaugauccugcccuucagagaugaacuuucccuccaaagcuagaacuuucuucccagga

SEQ ID NO: 260324 - RNA, 64 nt, Human
aacccagcuacuuugcauuccagaaguuuccauucccuccaauuccaccuaauuuuucaucugu

SEQ ID NO: 260325 - RNA, 64 nt, Human
cugcccuggcgggggccaugggggugaugaaugacccuccaacagccccacauggguuguuucu

SEQ ID NO: 260326 - RNA, 64 nt, Human
uuuaagugugcacguucguuuauuucugcaucuucccuccaaacuugccuuugcaucuuaaaua

SEQ ID NO: 260327 - RNA, 64 nt, Human
ugacuaaagggcuugucuugguggggucucccaccccuccaagacccauucugcacagucccuc

SEQ ID NO: 260328 - RNA, 57 nt, Human
uugggucuauaaaugugcauuuguaagggccacaaaagugaacgugugguacuguag

SEQ ID NO: 260329 - RNA, 57 nt, Human
uuagcauuuccaucugcgaugaauguaggccacaaaccacaguaguauuagcagugc

SEQ ID NO: 260330 - RNA, 57 nt, Human
aaggcacgggacaggcaugugacacuaggccacaagcgauaagcacaggcaccugac

SEQ ID NO: 260331 - RNA, 57 nt, Human
aagcucacccccaaucccuugcagccaggccacaaugggggaggugaguccagcccc

SEQ ID NO: 260332 - RNA, 64 nt, Human
cuucucccugccucaaucuaaaagcagugccacacccuccaaaguggaauagaaagaaguucau

SEQ ID NO: 260333 - RNA, 64 nt, Human
ugcccaugcugggagcccacgcucacccccucaccccuccaagcucacuccccaacccccaacu

SEQ ID NO: 260334 - RNA, 64 nt, Human
ucaagccccuauccaggcccgaauccuuccgcugcccuccaagcgcccucuggggacagaccaa

SEQ ID NO: 260335 - RNA, 64 nt, Human
agcucuguagagacaaucaacuguguccugcccacccuccaaggugcauugucuuccaguaucu

SEQ ID NO: 260336 - RNA, 64 nt, Human
uuguuggaaucccacccacucccccggacccugccccuccaaguuggggacggagauggggagc

SEQ ID NO: 260337 - RNA, 64 nt, Human
cccccaccugcuggcccccuuguccuuccucacccccuccaauauagucucggagcuacaaccg

SEQ ID NO: 260338 - RNA, 64 nt, Human
aguccucuccccaaaucagggcucuagacccgagcccuccaaaccuggacucugggacuuaggc

SEQ ID NO: 260339 - RNA, 64 nt, Human
uugaaaagcaguuugugcuauacuuuucccccaacccuccaauaaaucuuaaauuuaaaaccua

SEQ ID NO: 260340 - RNA, 64 nt, Human
gccugcacucccagcaugccaugcagucaucuuccccuccaagggggcagaaauuccaccagaa

SEQ ID NO: 260341 - RNA, 64 nt, Human
aaaaccuuacuuagugacuggaaugguauaugcucccuccaaaaguuuaucuuuguuuauugau

SEQ ID NO: 260342 - RNA, 64 nt, Human
ucucucuggcccuaagagguuuuuccucuuugcucccuccaaucuugagauuggguuuugcuuu

SEQ ID NO: 260343 - RNA, 64 nt, Human
agaaugaauagauuugucuuuuccucaccaccuucccuccaaaacaugacauaaacaauauuuu

SEQ ID NO: 260344 - RNA, 59 nt, Human
ccaccagcccccagaucuaaaucuacucucccuccaaggcagcaaagcagaaucgggag

SEQ ID NO: 260345 - RNA, 64 nt, Human
cgucucuuuuuuuucaucacugauugccuugugucccuccaagucuacuuguuacuauccaucu

SEQ ID NO: 260346 - RNA, 64 nt, Human
gggaacgugcugagccagcacccucagaugauuucccuccaaacugcugacuaggucauccucu

SEQ ID NO: 260347 - RNA, 64 nt, Human
ugugaucugcccuagcgcucucuuccagaagaugcccuccaauccuuuccacccuauucccuaa

SEQ ID NO: 260348 - RNA, 57 nt, Human
ggauguccuuggggaggggucagcucuggccacaauccuccccaccagucucaccca

SEQ ID NO: 260349 - RNA, 57 nt, Human
uaggaggaagggacccagcugggucugggccacaagggaggagacugcaccccacug

SEQ ID NO: 260350 - RNA, 57 nt, Human
guuuaaccccuaagauguguccauugaggccacaaaucacccuccacuggaaucacc

SEQ ID NO: 260351 - RNA, 57 nt, Human
ggguuggcgcauacccacccccgccacggccacaagcccuggcauccccugcaaaua

SEQ ID NO: 260352 - RNA, 64 nt, Human
ccuuccuccccagucuacguucuccagcccacaccccuccaaagccccaccuuuaaguccucuc

SEQ ID NO: 260353 - RNA, 64 nt, Human
gagucuaggcagcucugcugcugugaucugcacacccuccaaccugggcagggacuggggggau

SEQ ID NO: 260354 - RNA, 64 nt, Human
cagguuucagugucuuuucccucccuuagcccaacccuccaaggccucaugucuccuaagcaug

SEQ ID NO: 260355 - RNA, 64 nt, Human
acagggccaggccuacccuccuuccccacaagcccccuccaacccccacccccaugcucuggac

SEQ ID NO: 260356 - RNA, 64 nt, Human
ggguuuucccuuguuuuccucucauugcauguuucccuccaauauugguucauugucaucaauc

SEQ ID NO: 260357 - RNA, 64 nt, Human
ucauucauaauuucgcaacuguccuuuuggguugcccuccaacacauuacuuccauuucagaaa

SEQ ID NO: 260358 - RNA, 64 nt, Human
cucucucucuucuuucucucugagggagagggagcccuccaaacuucagauccuguggguuuag

SEQ ID NO: 260359 - RNA, 64 nt, Human
caccuuuuccuagggggcuggucccggcuccacccccuccaagcucaguggacacugggucuga

SEQ ID NO: 260360 - RNA, 64 nt, Human
agacagaggguuaaaugaaccagugggggcaggucccuccaaccaccagcacugacuccugggc

SEQ ID NO: 260361 - RNA, 64 nt, Human
guggggcuguacacacccuccagcacagacuguucccuccaagguccucuuaggucccgggagg

SEQ ID NO: 260362 - RNA, 64 nt, Human
agguugcauggugaguucacagucggauuguccucccuccaaacugaaacuaauuugauuuuga

SEQ ID NO: 260363 - RNA, 64 nt, Human
augggagcuaaccuuuaucccaccuuugacacuacccuccaaucuugcaacacuauccuguuuc

SEQ ID NO: 260364 - RNA, 64 nt, Human
aagccugcccucgggcucugcucaccucuggugacccuccaagaugccccugcccucaguuucc

SEQ ID NO: 260365 - RNA, 64 nt, Human
caucucaguccugcaucuuuucuucugcuuucuucccuccaagagcaaaaccugggcaagggga

SEQ ID NO: 260366 - RNA, 64 nt, Human
cucgucccugccagugucugggccugaaggggcucccuccaagcggugccuuccugcggcuuag

SEQ ID NO: 260367 - RNA, 64 nt, Human
caaacuuucccacauuuuccuguuuucuucugagcccuccaaacuguuccagccucugccuguu

SEQ ID NO: 260368 - RNA, 57 nt, Human
uucugauucaugcugccccuccuugguggccacaauuuagccaugucaucugguggu

SEQ ID NO: 260369 - RNA, 57 nt, Human
guguagaauauuugucuuaaaauucaaggccacaaaaacaauguuugggggaaaaaa

SEQ ID NO: 260370 - RNA, 57 nt, Human
aaucaaaagacuuucucaaucuauuuuggccacaaacaaacauauucaacugaagcu

SEQ ID NO: 260371 - RNA, 57 nt, Human
caucucaucucccagugauucuccgugggccacaaugccucuagcuauggugcacuc

SEQ ID NO: 260372 - RNA, 64 nt, Human
ggacauagccaaaccauaucauucuaccccuggccccuccaaaucucauguccucacuauucaa

SEQ ID NO: 260373 - RNA, 64 nt, Human
ugcccugcugcucaaagugacuagccaaauugaccccuccaacagaaaguaaucuuuguuccca

SEQ ID NO: 260374 - RNA, 64 nt, Human
uugcaaguguauacaaaaacuaaauagacuucugcccuccaacaucuuuuuauugcauuacuuc

SEQ ID NO: 260375 - RNA, 64 nt, Human
aauuauuugccuuuuaaauucuuuucccccaucccccuccaaagucuugauagcaagcguuauu

SEQ ID NO: 260376 - RNA, 64 nt, Human
ucugcuuuuucucuuuugucgguguauuugguaccccuccaaugcuggucuuuuuguagaaacu

SEQ ID NO: 260377 - RNA, 64 nt, Human
uugaucucuaucagacuuccuuucaacuguccuccccuccaagcagaccaccuguccccuucua

SEQ ID NO: 260378 - RNA, 64 nt, Human
uaguaaagaaaugacacuuuucaugugugauuuccccuccaagguaugguuaauaaguuucacu

SEQ ID NO: 260379 - RNA, 64 nt, Human
ucuugccuccuacuauucacaucuuuaugugguccccuccaaugcugaauacagaugauuugug

SEQ ID NO: 260380 - RNA, 64 nt, Human
ggagaaguguguaccauauguuuugagcagaggacccuccaacuuauggcaucaggggcaaaaa

SEQ ID NO: 260381 - RNA, 60 nt, Human
gcuaucugaaugcuuccuaaaaagcgaggucccuccaaaccguugucauuuuuauaaaac

SEQ ID NO: 260382 - RNA, 64 nt, Human
guaguuucagaccagaccugaauagucuccuaugcccuccaaaagucggguccuugcuccugca

SEQ ID NO: 260383 - RNA, 64 nt, Human
acuuccucuuaccuaugucccuucucaugccuuucccuccaacggggaaagccaacuccaucuc

SEQ ID NO: 260384 - RNA, 64 nt, Human
agacaaaugugauaaugacaugauuucccaccugcccuccaagaaaauggugacucacucucaa

SEQ ID NO: 260385 - RNA, 64 nt, Human
ugaugguggauagaggugaaggagguagggagugcccuccaagugcaaaaauaacaaauaugau

SEQ ID NO: 260386 - RNA, 64 nt, Human
cacaaaaguggccaugucgacauuuguccacccacccuccaauaagcuggagcgacaaagggac

SEQ ID NO: 260387 - RNA, 64 nt, Human
ucuaaucuccauggcuuugcaccaaauccuccaccccuccaauugggaggggacuguucaccac

SEQ ID NO: 260388 - RNA, 57 nt, Human
gaguaggaggcccacucacaagcccuuggccacaacuauacuccugucccaccccac

SEQ ID NO: 260389 - RNA, 57 nt, Human
ucucaggcccaucccagagcacugagaggccacaaucguucagcccugugcccugaa

SEQ ID NO: 260390 - RNA, 57 nt, Human
acaaugcaaaaaaaaaaaaaaaaaaauggccacaacaguugcacagugcccacccua

SEQ ID NO: 260391 - RNA, 57 nt, Human
ccuuaauucaaagaucauauuuuagcuggccacaaaaccaagaacauaucuagcaag

SEQ ID NO: 260392 - RNA, 64 nt, Human
caaaauggaagugcugaagccauggucuuucugccccuccaagcugaugaagggaagccuuugc

SEQ ID NO: 260393 - RNA, 64 nt, Human
uauguuaaauugugucaaauauauaugucaaauucccuccaacauuguuuaaaugugccuuucc

SEQ ID NO: 260394 - RNA, 64 nt, Human
uguaauuuaauaaaaaaaacuaaggacgaaaaaacccuccaauuuucccaaaugcaaucagugu

SEQ ID NO: 260395 - RNA, 64 nt, Human
cucugacaagucagaauagggacacugcuucuaucccuccaauggagagauucuggcaaccuuu

SEQ ID NO: 260396 - RNA, 64 nt, Human
uccacacccaaaagauauauagagugaaaagucucccuccaauccuuauucuccaccugcucag

SEQ ID NO: 260397 - RNA, 64 nt, Human
aaauguaaaugauauuaaaucugugauuccuuuucccuccaaaggcuuuuguguacauggcgcu

SEQ ID NO: 260398 - RNA, 64 nt, Human
agacuaaggagaaacguauaucccuacaaaccuccccuccaaacaccuucucacauucuuuucc

SEQ ID NO: 260399 - RNA, 64 nt, Human
agacuuuaugcccuccagagcuccaagauauaagcccuccaagggaucagaagcuccaaguucc

SEQ ID NO: 260400 - RNA, 64 nt, Human
uccacugcguuccugggaagggcugcgaggccugcccuccaaaccugacuggggaugggcggca

SEQ ID NO: 260401 - RNA, 64 nt, Human
auguacguccagccugccccggagcuggaggauccccuccaagccuaaaagguuguuaauaguu

SEQ ID NO: 260402 - RNA, 64 nt, Human
gugugcuccucggcagaugcuguuguuguuacuucccuccaagaggcuggaaaagggcucagag

SEQ ID NO: 260403 - RNA, 64 nt, Human
gaggucagcgauagcccaaaggcucugcaguauucccuccaauggccaaggauuccguguguca

SEQ ID NO: 260404 - RNA, 64 nt, Human
auuggaggguuaucuguauauaaaagguuuucuccccuccaaagaaagacuccaguacaagaua

SEQ ID NO: 260405 - RNA, 64 nt, Human
ucaguagcgugguugaugcuauuguuuagccuuccccuccaaauuguauacauuggcuuggaau

SEQ ID NO: 260406 - RNA, 64 nt, Human
acagucuuuggcugaaauucugaacucagaaguccccuccaaggcauccagucuuuggugguug

SEQ ID NO: 260407 - RNA, 64 nt, Human
uugacccccuuugaggcaucugcuccccgucucccccuccaaaaaaaaaguggauauuugaaga

SEQ ID NO: 260408 - RNA, 57 nt, Human
caagccaucuacugagggaggcagaaaggccacaacccacccuagguugauguaugg

SEQ ID NO: 260409 - RNA, 64 nt, Human
guaaguaaaaacacacagaauuguguugacugggggaggugaaucacaaaaaaguuacgaggag

SEQ ID NO: 260410 - RNA, 64 nt, Human
gaaucauggucauuccauggagaccuccccuugaggaggugaauucaggccaaaagggcuguug

SEQ ID NO: 260411 - RNA, 64 nt, Human
cugggaugaagucugguggugggucguaaguuuaggaggugacugcauccuccagcaucucaac

SEQ ID NO: 260412 - RNA, 64 nt, Human
aaguggguuauaagacauugcuuuagaaucuugccccuccaaaucuucccucaaagaucuuaau

SEQ ID NO: 260413 - RNA, 64 nt, Human
gcuggugcccuguauauauguaacaauauaggaccccuccaaauagguuuugcuucuggugaau

SEQ ID NO: 260414 - RNA, 64 nt, Human
agaaagaaaagaacacuugcccagggcagcuuugcccuccaagaggcucccuccugucucuaag

SEQ ID NO: 260415 - RNA, 64 nt, Human
gaagugacugaggcuggggugccucucccuggcccccuccaacugccaaauucugcuucccucu

SEQ ID NO: 260416 - RNA, 64 nt, Human
uuugaacugcucacccaacuucugcuaucuugcucccuccaaacucacagauucuccuacaguc

SEQ ID NO: 260417 - RNA, 64 nt, Human
gcucuggcacagaccacugugguugauggcauggcccuccaacuuggaauaggauuuuccuuuu

SEQ ID NO: 260418 - RNA, 64 nt, Human
ugacaggucaggaucuccaaacauggacguccuccccuccaaauccagaagcucccagaaggug

SEQ ID NO: 260419 - RNA, 64 nt, Human
ccccaagauuagaugccacuaaucuccaaagauucccuccaauuaugaaauauuuuaaugucua

SEQ ID NO: 260420 - RNA, 64 nt, Human
agucauuuuuaauuuauaucagauuuauaucagacccuccaaaaaguauuugaaauauauuaca

SEQ ID NO: 260421 - RNA, 64 nt, Human
augcgacagccugagaacgcugggcagcaccacacccuccaauucacacugccuucuaguugug

SEQ ID NO: 260422 - RNA, 64 nt, Human
ugguuuuguguuugcuuuuccggaccccacucugcccuccaaaaagacaaaaaaaaaaaaaaaa

SEQ ID NO: 260423 - RNA, 64 nt, Human
acaaacugagucaauuuaacaauccugacaugcucccuccaauuuaaaagcgcacacacacaca

SEQ ID NO: 260424 - RNA, 64 nt, Human
uagugaacagacauugcccagugucucuucuagccccuccaacaguucuucauguagcacugcu

SEQ ID NO: 260425 - RNA, 64 nt, Human
gaggugucagcaguauuaucuccacuuucaaucucccuccaagcucuacucuggaggagucugu

SEQ ID NO: 260426 - RNA, 64 nt, Human
gagggagcugagguccuggugccaggggcccaggcccuccaaccauaaacaguccaggauggaa

SEQ ID NO: 260427 - RNA, 64 nt, Human
ccagacacagcuguuguucggggcuguggaacugcccuccaagcugcuggucuacuugucggug

SEQ ID NO: 260428 - RNA, 57 nt, Human
ugaaaccccuuagagagaagcauauauggccacaaagcacagaggcuuagguuugcc

SEQ ID NO: 260429 - RNA, 57 nt, Human
uuuaaugauaugagaaaaauuuuguuaggccacaaaaacacugcacugugaacauuu

SEQ ID NO: 260430 - RNA, 57 nt, Human
auuugacauuuaguagaauuccucuuuggccacaagaauaagcagcaaauaaacaac

SEQ ID NO: 260431 - RNA, 57 nt, Human
aaaaagaauaagucacauugguuccauggccacaaaccauucagaucagccacuugc

SEQ ID NO: 260432 - RNA, 64 nt, Human
auuuuauaaaggagauggcuuauucaaccauagccccuccaacauaucuacuggaaauucugcu

SEQ ID NO: 260433 - RNA, 64 nt, Human
aagggugacaggaaggcuuuaccaaccugucucucccuccaaaagagcagaauccucccaccgc

SEQ ID NO: 260434 - RNA, 64 nt, Human
aauaucugcauguaccaagagucccuaagccacccccuccaaagauggaguguagaaaugauga

SEQ ID NO: 260435 - RNA, 64 nt, Human
ugcgagcaagcucggaauccaguuccucaggaaccccuccaaaacccacacccccagggacgcc

SEQ ID NO: 260436 - RNA, 64 nt, Human
ggugagaaguacagggcagaaccaagaacauaaacccuccaagggaucugcuugauaucccaag

SEQ ID NO: 260437 - RNA, 64 nt, Human
ucccuaaaauaauacccuaucaucugcuccuaaucccuccaaucucucuccacugaguggcugg

SEQ ID NO: 260438 - RNA, 64 nt, Human
ucuguggaucgugaaggcgaucucaagaguguuucccuccaaaccugauagcugccuauuccug

SEQ ID NO: 260439 - RNA, 64 nt, Human
auacuccugucccaccccaccacgauggccuggucccuccaacaugcauggacaggggacagug

SEQ ID NO: 260440 - RNA, 64 nt, Human
aagcugcggaaggauugaagucaaagaauugaaacccuccaaaccacgucaucugauuguaagc

SEQ ID NO: 260441 - RNA, 64 nt, Human
guucuuaaggcucuuuucuuacaaaaauaagagacccuccaaccacgggcuguuuaggaggaug

SEQ ID NO: 260442 - RNA, 64 nt, Human
uaggugccuacagagacuauagagcuagacaaagcccuccaaacuggccccuccugcucacugc

SEQ ID NO: 260443 - RNA, 64 nt, Human
uuacaggcagacauuauugguaaacaagaucuugcccuccaaugaaaugacuuacauguuuuaa

SEQ ID NO: 260444 - RNA, 64 nt, Human
aaaugaauucuaaaccaaucaaaugucugggaagcccuccaagaaaaaaaauagaaaagcacuu

SEQ ID NO: 260445 - RNA, 64 nt, Human
gaagaggcccccagggaguugugagcagauuagacccuccaagaccgccccagggguuggccca

SEQ ID NO: 260446 - RNA, 64 nt, Human
gucaacaaagccaucauaauguugguguuuguuucccuccaauguauguauguuuaguuuuuau

SEQ ID NO: 260447 - RNA, 64 nt, Human
uacagugucuggccuugggaagaagugauucugucccuccaaagaaauagggcauggcuugccc

SEQ ID NO: 260448 - RNA, 57 nt, Human
cucccagcccccauggggcagcagcugggccacaauugccccuuuccguuuucuaac

SEQ ID NO: 260449 - RNA, 57 nt, Human
cagaggaccuuccagccacccgcgacaggccacaagcguuccacgagcgaaggcgcc

SEQ ID NO: 260450 - RNA, 57 nt, Human
uguguacacugguuagauaaaacuuaaggccacaaggagggcccagguaggcgaugu

SEQ ID NO: 260451 - RNA, 57 nt, Human
aacugucauguuuuguuguucaucuguggccacaauaaaguuuacuuguaaaauuuu

SEQ ID NO: 260452 - RNA, 64 nt, Human
aacugcggauggagccccucugagaaacacaugccccuccaaguggggucuggggccuggagag

SEQ ID NO: 260453 - RNA, 64 nt, Human
aauuugucucuauagcuaauuagcuuaucaacuccccuccaaacaaacaauuaaaaaaaaaaca

SEQ ID NO: 260454 - RNA, 64 nt, Human
uaauuuguaugcuaaaugaggagguacauugaaacccuccaaaucuccagucucaucuauguca

SEQ ID NO: 260455 - RNA, 64 nt, Human
gaaacgaaaaaucaacaaacacucuguccucuaucccuccaaagaaugaaaaucagaaaaagcc

SEQ ID NO: 260456 - RNA, 64 nt, Human
cuggccacgcggcucguucccccgcuccucggggcccuccaaggugucuccguagucagcaggu

SEQ ID NO: 260457 - RNA, 64 nt, Human
ugucugcuuucugcaugaacggcaauaugggacucccuccaagcuaggguuuggcaagucugcc

SEQ ID NO: 260458 - RNA, 64 nt, Human
uuuaauaaagauacuaauucucaugacugaaucacccuccaaaggccccaccuccuaauaccau

SEQ ID NO: 260459 - RNA, 64 nt, Human
cggcucuauugacacagauccgccugcagauggccccuccaacccucucugcugcuguuuccau

SEQ ID NO: 260460 - RNA, 64 nt, Human
gcuaguuuuuugcuucucuuucccccacccuacucccuccaauucccccuuaaacuuccaaagc

SEQ ID NO: 260461 - RNA, 64 nt, Human
gaacuuuauuucuucauacgacauaacagaauugcccuccaagucacacaagcuccaagacuaa

SEQ ID NO: 260462 - RNA, 64 nt, Human
acaauuuauauuauuugguaagguuuuuuuuuuucccuccaaagaugucaucuucucaucugaa

SEQ ID NO: 260463 - RNA, 64 nt, Human
agccccucugcagaucuccucuggccacugcagccccuccaaugggcuuuuucucucaugcauu

SEQ ID NO: 260464 - RNA, 64 nt, Human
agacauuccaggagcuagcaauuuuaagaggugucccuccaaagugaccugauggaaguccuga

SEQ ID NO: 260465 - RNA, 64 nt, Human
uuggaucaggacagagacuugggggccauccugccccuccaacccgacauguguaccucagcuu

SEQ ID NO: 260466 - RNA, 64 nt, Human; identical to SEQ ID NO: 260465

SEQ ID NO: 260467 - RNA, 64 nt, Human
gaugaagaaauaagcaguuaaaaaaauaagucgccccuccaaaacacgcccccaucccacagcg

SEQ ID NO: 260468 - RNA, 57 nt, Human
agcgucccaugagccuugguaucaagaggccacaagagugggaccccaggggcuccc

SEQ ID NO: 260469 - RNA, 57 nt, Human
gauuccuuaagauguuaccacccagggggccacaagccagccugcugucucaggaag

SEQ ID NO: 260470 - RNA, 57 nt, Human
gaucaucagucaccgaagguccuacagggccacaacugcccccgccacaacccaccc

SEQ ID NO: 260471 - RNA, 57 nt, Human
uuucacaaauuuauucuauuauugaguggccacaauguagaguggcucaaaguacuu

SEQ ID NO: 260472 - RNA, 64 nt, Human
ugggaaaacucuuagauaguacagugaguugugacccuccaaaggaucacaaguacauaaacag

SEQ ID NO: 260473 - RNA, 64 nt, Human
caaagacccccucacccuggccccuugggcuggacccuccaaugccagcgacucccaggagccc

SEQ ID NO: 260474 - RNA, 64 nt, Human
guccaccuguuccucugccaccugccuggcuucacccuccaaggccuccccauggccacagugg

SEQ ID NO: 260475 - RNA, 64 nt, Human
agagagccaaaaauacagaagaggcggagagcgccccuccaaccaggcuguuauuccccuggac

SEQ ID NO: 260476 - RNA, 64 nt, Human
gaagaaagcgccucucuaccauacaguauuucaucccuccaaacacuugggcaaaaagaaaacu

SEQ ID NO: 260477 - RNA, 64 nt, Human
aggaagcucagccuucuccucccaagguuugagucccuccaaagggcaguggguggaggaccgg

SEQ ID NO: 260478 - RNA, 64 nt, Human
agacagagccggaagcgcagucggccucugcagccccuccaagcaagugcuccagggacuaucc

SEQ ID NO: 260479 - RNA, 64 nt, Human
gucagauauuguucuuuugauaugcaguuuccagcccuccaaugaguccccagcacagaucuca

SEQ ID NO: 260480 - RNA, 64 nt, Human
gagcaagggcagggacagggccggucgggggggacccuccaaggccaggccuuggggacaaccu

SEQ ID NO: 260481 - RNA, 64 nt, Human
aguguugaacuucaaccugagggggccgacagugcccuccaagacagagacgacugaacuuuug

SEQ ID NO: 260482 - RNA, 64 nt, Human
uuuguaagugcaggaaaccgaguagaaaaugugacccuccaaauggagaagcugcaggcuuugc

SEQ ID NO: 260483 - RNA, 64 nt, Human
agacauuugcuuccugguggcaaguaacugugcacccuccaacaucccaaccccagaggaacca

SEQ ID NO: 260484 - RNA, 64 nt, Human
ugugccuggacugaagcugucccgcagguccccacccuccaacacgugcucaccugucccccuc

SEQ ID NO: 260485 - RNA, 64 nt, Human
aaaaauaaauaaauaagggaaauuccuaacuuugcccuccaaagucuaacuuugguuuucuugu

SEQ ID NO: 260486 - RNA, 64 nt, Human
ccccccauggaugcccuucagauagcagaggacacccuccaaacacugguuccccacugcccug

SEQ ID NO: 260487 - RNA, 64 nt, Human
uucucagguggugauaugguuuggauguuuuguccccuccaaaucucauguucaaagugugaca

SEQ ID NO: 260488 - RNA, 57 nt, Human
augccucacucaggccccgggcucccuggccacaagcuuuuucuauccuguuuucau

SEQ ID NO: 260489 - RNA, 57 nt, Human
gggagaaaaauaaauauaugcuguaguggccacaaauaggccuaugauuuagcuggc

SEQ ID NO: 260490 - RNA, 57 nt, Human
ugaucccuuacccccaggcugggaugcggccacaaagcacgucuauuuuuuuaugaa

SEQ ID NO: 260491 - RNA, 57 nt, Human
ucucagaccccuggauucagaacccaaggccacaaaucauaggcaugaagcacuuuc

SEQ ID NO: 260492 - RNA, 64 nt, Human
gugaccaugaucuguugauaucuuugaaucucuucccuccaaaccccaaguaaguuguccuuca

SEQ ID NO: 260493 - RNA, 64 nt, Human
gccaagaauaaaauugcugcaccagaaggagggucccuccaaaguugaacacuuggugaaagga

SEQ ID NO: 260494 - RNA, 64 nt, Human
cccacaccucggccguacaucucugugagagacccccuccaacgauuagcuuuugcaacauggu

SEQ ID NO: 260495 - RNA, 64 nt, Human
aagagaucucauaggacggagggggaaaugguuucccuccaagcuugggucaguguguuaacug

SEQ ID NO: 260496 - RNA, 64 nt, Human
ccagaaucugcucagcuuucugcccccaccaacacccuccaaccaggccuugccuucugagagc

SEQ ID NO: 260497 - RNA, 64 nt, Human
ucccaggaagucagugauugucuuuuugggcuuccccuccaaaggaccuucugcaguggaagug

SEQ ID NO: 260498 - RNA, 64 nt, Human
cgguucuggccuccagaccaggguaagggcaggccccuccaacaggugcucacagccaccgagg

SEQ ID NO: 260499 - RNA, 64 nt, Human
aagaaaagauccaugaucggcuuucuccuggggccccuccaauuguuuacuguuagaaaguggg

SEQ ID NO: 260500 - RNA, 64 nt, Human
agaaugggauggaauccaccaggcuccagcucaucccuccaaggcccugucucugcgcacagca

SEQ ID NO: 260501 - RNA, 64 nt, Human
cuuuauuuauuggggguagggggauggaggaggucccuccaacauguuuggacccagcuccuuu

SEQ ID NO: 260502 - RNA, 64 nt, Human
ccucggagaccuguuuaacaagcaaaaaucaaaacccuccaagauugucucauauucuaccugg

SEQ ID NO: 260503 - RNA, 64 nt, Human
gucagcagcugauccugauccaccuccgcccaggcccuccaagcucuacucaccccuagggccu

SEQ ID NO: 260504 - RNA, 64 nt, Human
ugccuccagggucuggcugagugggaucagguggcccuccaacucagcacaggaaauaaguaga

SEQ ID NO: 260505 - RNA, 64 nt, Human
cuagggcuuaucaucagcccucacacccgcuucccccuccaacccacagccuuugcuuccaggu

SEQ ID NO: 260506 - RNA, 64 nt, Human
cuucugucccuccugccuuccuucucuucccaagcccuccaauccccaucccaggcuugcugug

SEQ ID NO: 260507 - RNA, 64 nt, Human
ucuucccccaccccuuuccaggagaaggggcugccccuccaagcccuacuuguaugugcggagu

SEQ ID NO: 260508 - RNA, 57 nt, Human
acgucggggacccagcgguugggcucaggccacaacggccugagauugccccggggc

SEQ ID NO: 260509 - RNA, 57 nt, Human
gggccagggugauuggacugagaauuuggccacaaccaaauugaugcuggcuggaac

SEQ ID NO: 260510 - RNA, 57 nt, Human
augaaucauuacauuuauaauaacaaaggccacaauuuaauuaauugguaagauaua

SEQ ID NO: 260511 - RNA, 57 nt, Human
ccaacacagaggugagaccaggaauaaggccacaaguaucucacuuucucugcagaa

SEQ ID NO: 260512 - RNA, 64 nt, Human
ccagagcccaggucaccuccgggcuuccgcagcccccuccaaggcggaguggagccuugggaac

SEQ ID NO: 260513 - RNA, 64 nt, Human
ucuggggguuggcacagcauucugauuuaccaaacccuccaagugauuuugauguauucuaauu

SEQ ID NO: 260514 - RNA, 64 nt, Human
agacuuucaguauaaggaaaagggguaguuuauucccuccaaauuugacuacagcucgaaauug

SEQ ID NO: 260515 - RNA, 64 nt, Human
cccugcuucucccccuccuaccugagaggcugcacccuccaaccucccauuggcucgcuccccc

SEQ ID NO: 260516 - RNA, 64 nt, Human
cuccagagcuagauccugaugggucucuaagguucccuccaagaagacaaggacaggagacuug

SEQ ID NO: 260517 - RNA, 64 nt, Human
cuuggccuuccauccucuccccacggcugauggucccuccaaggccgacuccuaaggaaucacc

SEQ ID NO: 260518 - RNA, 64 nt, Human
ggccaggagugggauucagcugcagcagggcgcccccuccaaacugcagcuggucuggcuuacu

SEQ ID NO: 260519 - RNA, 64 nt, Human
uggcuguugucauucuuucugcaucccacuguuccccuccaauuuauguuauuuucuacccugu

SEQ ID NO: 260520 - RNA, 64 nt, Human
gggcucggacccugaacucagacucuacagauugcccuccaagugaggacuuggcucccccacu

SEQ ID NO: 260521 - RNA, 64 nt, Human
acaaagcaauaagcaucaugcauccuccccuuaccccuccaacaccccucugccucuggcucag

SEQ ID NO: 260522 - RNA, 64 nt, Human
gagaggagucagagccauaacucaaucacucagccccuccaaagauaguugaugugugauaauc

SEQ ID NO: 260523 - RNA, 64 nt, Human
uaccuggaacccaccuucccucugcugcuggggacccuccaacaccugugcaggccccauggca

SEQ ID NO: 260524 - RNA, 64 nt, Human
ucacacaagauuugacuguaauauuuaaauauuacccuccaagucuguaccucaaaugaauucu

SEQ ID NO: 260525 - RNA, 64 nt, Human
guagagagccccuaaguccuucaucauaccacugcccuccaaaucuacucuucuuuuaagcaau

SEQ ID NO: 260526 - RNA, 64 nt, Human
ugcugaguaugacaaauagugucuacuaucucaacccuccaaaauuugcagaguguugggacug

SEQ ID NO: 260527 - RNA, 64 nt, Human
cccuggguuguuuaaacuuguguucaaauauucccccuccaagugaaagccugucgggaauucc

SEQ ID NO: 260528 - RNA, 57 nt, Human
uccuuuuagaaaaaaaugcaauuuucuggccacaagggcauagugcaguucacuuac

SEQ ID NO: 260529 - RNA, 57 nt, Human
uugugauucauaauuuucauuugugaaggccacaacacuccccuugaaauacagggc

SEQ ID NO: 260530 - RNA, 57 nt, Human
cuugaccccacuucuggcuguccugcgggccacaagcucuucaggccaagucagagc

SEQ ID NO: 260531 - RNA, 57 nt, Human
ccucuccgcguggguacuuggggguggggccacaaaucuggcgaaaaacuucaugcu

SEQ ID NO: 260532 - RNA, 64 nt, Human
aaccacaagcagauggaaguggucugaccacugccccuccaacucccagggacucauuacagcc

SEQ ID NO: 260533 - RNA, 64 nt, Human
uaguaaauccuucagcaacaaggcuggcuuggugcccuccaagcaucuaauggcuuauuaaauu

SEQ ID NO: 260534 - RNA, 64 nt, Human
caaaaguugccugggguucuguauuucuucucugcccuccaauccccgacugcuaugauguuua

SEQ ID NO: 260535 - RNA, 64 nt, Human
acccgucaaccagagcgugccuccgggccagcuucccuccaaggaaugaguggauuucauacag

SEQ ID NO: 260536 - RNA, 64 nt, Human
caaaacagagacaugguucuauaaugcuucaugucccuccaagauuugagaucaauuuagggau

SEQ ID NO: 260537 - RNA, 64 nt, Human
aaguugucuccuuccauucagauguuaauggggacccuccaaaggaagggguuuucccaugacu

SEQ ID NO: 260538 - RNA, 64 nt, Human
aggaggacccagggccaaaggaauccucaaacuucccuccaagggagauauuguaaggggaaaa

SEQ ID NO: 260539 - RNA, 64 nt, Human
aggcggcugggaucucaggcagggugugcgucagcccuccaacccccagaggggcgccuguggg

SEQ ID NO: 260540 - RNA, 64 nt, Human
aggguaugguggugugccgauaccuccucgccugcccuccaagccccagcugccuuccuuuugg

SEQ ID NO: 260541 - RNA, 64 nt, Human
caagguucuauuaaccacuucuaaggguacaccucccuccaaacuacugcauuuucuauggauu

SEQ ID NO: 260542 - RNA, 64 nt, Human
gaguucaucacuacguaaggaaagcuccuuccgccccuccaaagcccucaccaugccuaacaga

SEQ ID NO: 260543 - RNA, 64 nt, Human
gauuucagcaaaccaccaccucccacucaguguccccuccaaacuucacacuucccugccugca

SEQ ID NO: 260544 - RNA, 64 nt, Human
gggucccuccuuuuugggggaaggucagcccagccccuccaaaggucugaugucuccacuuuca

SEQ ID NO: 260545 - RNA, 64 nt, Human
cugucccguucagccguugggcccaggcuuccuccccuccaaggugaaacacugcagucccggu

SEQ ID NO: 260546 - RNA, 64 nt, Human
caagcagccucccccagcacuugcggccgcucagcccuccaaccaagaccuaagucacacauca

SEQ ID NO: 260547 - RNA, 64 nt, Human
ucaguccagugaccauauuuaugaaaagcuguagcccuccaaggucugggaauuuaucgagaag

SEQ ID NO: 260548 - RNA, 57 nt, Human
aucagggggccaggccagcagcucgggggccacaaggagauggauaaugugccuguu

SEQ ID NO: 260549 - RNA, 57 nt, Human
ccuucacauuuccuccccagcuuuugcggccacaacacaucagugucauuugggugu

SEQ ID NO: 260550 - RNA, 57 nt, Human
ggagauaauaguuuugacucugaacuuggccacaaccccugaacugaucccaaaauc

SEQ ID NO: 260551 - RNA, 57 nt, Human
gggaguccaggcgcaggagggacccggggccacaaggcgcugcgggcccaggugugc

SEQ ID NO: 260552 - RNA, 64 nt, Human
guggagccaugguggugcguccuuuacucaacaacccuccaauccggaugcugugggaagggcc

SEQ ID NO: 260553 - RNA, 64 nt, Human
caaugauuuuauaauauuuaacccaccaaaaagucccuccaacagcaauaucuuaugaaagucu

SEQ ID NO: 260554 - RNA, 64 nt, Human
gucugccaggucucaaaaauucaucaagcaauuucccuccaacaagggcugcaguucuagugau

SEQ ID NO: 260555 - RNA, 64 nt, Human
aauaguggagguauuguggguucauuugaguaagcccuccaaagauaccauucaaauaaccugg

SEQ ID NO: 260556 - RNA, 64 nt, Human
caggggauagggagaugugccagaguccuuccuccccuccaaggacagguaguaggugccagcc

SEQ ID NO: 260557 - RNA, 64 nt, Human
cccaauucccaggucucacaucccaccccuccugcccuccaacccuucugccuugaaagcuggc

SEQ ID NO: 260558 - RNA, 64 nt, Human
agccuuggggcauuauggguucuucccccacuuccccuccaagacccuguguucauuugguguu

SEQ ID NO: 260559 - RNA, 64 nt, Human
gggagguuucccccaaucuccuccaaguucuucucccuccaaccagaguugugucuaacuuuag

SEQ ID NO: 260560 - RNA, 64 nt, Human
guauuuuuacuauuauaauauaauauggaaccuucccuccaaauucuucaauaaaaguugcuuu

SEQ ID NO: 260561 - RNA, 64 nt, Human
gggucccgcugccugccgucgacucauccaaggacccuccaaggcuggcagugugguguugcua

SEQ ID NO: 260562 - RNA, 64 nt, Human
uuaccacacuugggguuuaaauauccaggugugccccuccaagucacaaagagauguccuugua

SEQ ID NO: 260563 - RNA, 64 nt, Human
uuggaccugagcccgcacauuccacucccauucucccuccaagaggggcccagcauuguauuuc

SEQ ID NO: 260564 - RNA, 64 nt, Human
gcacuaguuugauauaaaauuaaaaugaccaaaacccuccaacuuugaagcuaaagaagguaaa

SEQ ID NO: 260565 - RNA, 64 nt, Human
uugacuguuuuuacccauauccccucuccccccccccuccaauccugcccccugaaacuuauuu

SEQ ID NO: 260566 - RNA, 64 nt, Human
ugugacaggaaugggaaaaggacagcacaggaugcccuccaaggaugagcugguccagagauac

SEQ ID NO: 260567 - RNA, 64 nt, Human
ggggguguaccaagggcaaggacccucuggcuuacccuccaagcgacucuguaguuuucccaga

SEQ ID NO: 260568 - RNA, 57 nt, Human
ggaccgggugggccuggccugagcuggggccacaaaucaaagcaagggcuccagcau

SEQ ID NO: 260569 - RNA, 57 nt, Human
ugggcccuguagugcuggacucucccgggccacaauagggacagggcagggacaggg

SEQ ID NO: 260570 - RNA, 57 nt, Human
cugaauuuagaucuccagacccugccuggccacaauucaaauuaaggcaacaaacau

SEQ ID NO: 260571 - RNA, 57 nt, Human
uuaccugaugcuaaaauaaugugccucggccacaaaaaagcaugcaaagucauuguu

SEQ ID NO: 260572 - RNA, 64 nt, Human
agcacugggggcuucuccccaggagaccacgcugcccuccaagaccaggagcagcugugagcug

SEQ ID NO: 260573 - RNA, 64 nt, Human
uuucccccauccaccacuggcaggguugccccuucccuccaaucaucacugugcuccuuuuuuc

SEQ ID NO: 260574 - RNA, 64 nt, Human
uggccaggaggcugcagaacgugugucucccccucccuccaagagguccugcucccucugccag

SEQ ID NO: 260575 - RNA, 64 nt, Human
cgccguggcgcuccaacuuccuucccugccuuuucccuccaagcuccuauuuuacugugucagc

SEQ ID NO: 260576 - RNA, 64 nt, Human
agauccacuggaaacuaggccgggaagcagcagccccuccaagggccagggcaccugggagacg

SEQ ID NO: 260577 - RNA, 64 nt, Human
cagccaggugcuuucaucacagcuaaaccugguucccuccaaaccucccagccacucgggcuug

SEQ ID NO: 260578 - RNA, 64 nt, Human
gcaacuuaaaauagcaaaacccaacucucccugucccuccaaucccucuccuaaaaaguucagu

SEQ ID NO: 260579 - RNA, 64 nt, Human
cuuccgugagauuugcucccagacccucugaucucccuccaacaaacccuggcuccagcccccu

SEQ ID NO: 260580 - RNA, 64 nt, Human
aauggacucagcccucucccacauuuuccccucacccuccaaguccuaaccccuccauccucuc

SEQ ID NO: 260581 - RNA, 64 nt, Human
cuuggguucuaaugcuccugcucucuucucuuuccccuccaaccaguucaaucucaucccuccc

SEQ ID NO: 260582 - RNA, 64 nt, Human
cauucacuacagccuggaugacaagcaagacccucccuccaaagaaaauaaagcucaaaauaaa

SEQ ID NO: 260583 - RNA, 64 nt, Human
cgacuacuuccugugaccccgcccggccccugcccccuccaacccuucuggcccucgcaccacu

SEQ ID NO: 260584 - RNA, 64 nt, Human
gaugcugacuguacuccucccaggcgccccuucccccuccaaucccaccaacccucagagccac

SEQ ID NO: 260585 - RNA, 64 nt, Human
agucccaccaccugcacauguguagccccaccagcccuccaaggcauugcucgcccaagcagcu

SEQ ID NO: 260586 - RNA, 64 nt, Human
caccucucucacuccuugaaaacacuguucucugcccuccaagaccuucuccuucaccuuuguc

SEQ ID NO: 260587 - RNA, 64 nt, Human
ugacuaagccuuugacuuaaggguugcuugcuugcccuccaaauguccuuucucagaggggcca

SEQ ID NO: 260588 - RNA, 57 nt, Human
uacacugauguucuucacuaaauggauggccacaagaaaaauaaaguaaaugucuua

SEQ ID NO: 260589 - RNA, 57 nt, Human
acucuuuggugcacaaguaacacauuuggccacaaaacaccaaagaauuguaggcag

SEQ ID NO: 260590 - RNA, 55 nt, Human
uacugggccagagaaaaugaaggaaggccacaagcucagagcccacaucaacacu

SEQ ID NO: 260591 - RNA, 57 nt, Human
ggcuggagaauguggagaacuaaagguggccacaaauucuuugacacucaagucccc

SEQ ID NO: 260592 - RNA, 64 nt, Human
cuccucugcucuuccaaacacguagcauuugcaccccuccaaagccaucuuuguaaaggaaaac

SEQ ID NO: 260593 - RNA, 64 nt, Human
uuggaugaugcucuagccucugucagggacuguccccuccaaacuugcuuccguggucugccuc

SEQ ID NO: 260594 - RNA, 64 nt, Human
acgcaagugccagggcugggccccuuccaaaugucccuccaacacagauccgcaagaguaaagg

SEQ ID NO: 260595 - RNA, 64 nt, Human
guggucuacccgugucuagaggcagguagggggucccuccaagugguccacaagcuucuguccu

SEQ ID NO: 260596 - RNA, 64 nt, Human
auucucgcccucccuuuuccucucuccuccugcccccuccaagaaguacugacuggucuccucu

SEQ ID NO: 260597 - RNA, 64 nt, Human
ccaguacagacuccagacagaggggcccuuggggcccuccaaccucaggugaugagcugagaaa

SEQ ID NO: 260598 - RNA, 64 nt, Human
uacauacacuaagcugucgacaccccgcccucaccccuccaauccccccucugacccccucuuc

SEQ ID NO: 260599 - RNA, 64 nt, Human
gguaaauuauccaucacuuuuguuuuaaaguggucccuccaagaauaauguggcauacacagug

SEQ ID NO: 260600 - RNA, 64 nt, Human
aggagcacuggggaaagccucagcccaauucgggcccuccaauuacugaggcauacguaacaga

SEQ ID NO: 260601 - RNA, 64 nt, Human
gucccccaucucccuuccugcacccugcugugcucccuccaaacccaccuugcucuguguucuc

SEQ ID NO: 260602 - RNA, 64 nt, Human
gcgagcauccugcugggcucucugcccggcccaccccuccaaggggcuggccugugagccuuga

SEQ ID NO: 260603 - RNA, 64 nt, Human
ccugccuggucuagcuccucuccaaacagccaugcccuccaaaugcuagagaccugggcccuga

SEQ ID NO: 260604 - RNA, 64 nt, Human
cccuccuccacuggguucagaggguaagaaagcacccuccaauaaacccaggcuccaggccgug

SEQ ID NO: 260605 - RNA, 64 nt, Human
auuuggauuuucaguuugcuuuuuucuuuuuuuccccuccaaacuccuuuuccuuggccaagcc

SEQ ID NO: 260606 - RNA, 64 nt, Human
cacaagcccagcagguccugagugaagccgugggcccuccaaaugcucguuuuauagcaaccuc

SEQ ID NO: 260607 - RNA, 64 nt, Human
uccagguccggaggggccuaagugccacccuccucccuccaagccuggcacccaccgucucggc

SEQ ID NO: 260608 - RNA, 57 nt, Human
uguuacucugucccacguccaaucaugggccacaaggcacagucuucugagcgagug

SEQ ID NO: 260609 - RNA, 57 nt, Human
ggccuggugggaccagggcuccacagaggccacaaaauguugcaagucaugauggau

SEQ ID NO: 260610 - RNA, 57 nt, Human
gggauaccuggauucugguucugacagggccacaagcuaggaucucuaacaaacgca

SEQ ID NO: 260611 - RNA, 57 nt, Human
caaguacaaugcugccauuuuuuaaagggccacaacuauagaauuaccacuguugga

SEQ ID NO: 260612 - RNA, 64 nt, Human
cccaaaugcugcuugcagcacccacccuaaagcccccuccaaauagccauacuuagccucagca

SEQ ID NO: 260613 - RNA, 64 nt, Human
auggggcgcuggacaccuacagcagcacgcaugucccuccaaggcugucuucucccagagcaca

SEQ ID NO: 260614 - RNA, 64 nt, Human
cccacuacccuccucugcccuauucugucccugccccuccaagcugaagaagguccuugugggg

SEQ ID NO: 260615 - RNA, 64 nt, Human
augacugacuaaagaugcuaggcgugacaccguucccuccaaaagcagaccucggaaucacugc

SEQ ID NO: 260616 - RNA, 59 nt, Human
cacgaaaggaaacaggcuaagguggugaacccuccaauucaggaagugggaaaaggagc

SEQ ID NO: 260617 - RNA, 64 nt, Human
cagccugggcgcugguccuuucuuccggccccuccccuccaaaaugugccuauugcuagagcuc

SEQ ID NO: 260618 - RNA, 64 nt, Human
ugaaaggaagucacuggagugcugccaggggccgcccuccaagguuaaugagaggcccacaucc

SEQ ID NO: 260619 - RNA, 64 nt, Human
uugggggucccgggggagagguggacagacaccucccuccaacuggcauuuggcaacaggagcc

SEQ ID NO: 260620 - RNA, 64 nt, Human
agcagcugcuucggaacaccgucccuccuaugcacccuccaagacgugcagcagaugcaaaggg

SEQ ID NO: 260621 - RNA, 64 nt, Human
uccagcagccgggacccucuggagagcuuguuuucccuccaagaagagguuugagacaggcggc

SEQ ID NO: 260622 - RNA, 64 nt, Human
gugguggauuuguuccaaagccucaaucccuacccccuccaaggggcagguuuccaguccagcc

SEQ ID NO: 260623 - RNA, 64 nt, Human
uucgggaaaccaagagagaggaagaaggagacgccccuccaacuggcgggugugaaggaagccg

SEQ ID NO: 260624 - RNA, 64 nt, Human
cuucucuccuggggagcugucugcauccgccacccccuccaaccacugcccucagcccccgacc

SEQ ID NO: 260625 - RNA, 64 nt, Human
uccuccaguucugaugaggcacgccugccuucuccccuccaagugaaugaguuuccagcuaagc

SEQ ID NO: 260626 - RNA, 64 nt, Human
uugccugcugacaccccucgagucacccagcacucccuccaaacagaccuugaggcccaagacc

SEQ ID NO: 260627 - RNA, 64 nt, Human
ccauuuugaaugaauagauugguuuccuguggcucccuccaaaccuggccaagcccagcuuccg

SEQ ID NO: 260628 - RNA, 57 nt, Human
gucuucucggaaaaaaccauccuuggaggccacaagugaugagaaggauucuuuuuc

SEQ ID NO: 260629 - RNA, 57 nt, Human
gcuguccucucaagcuggugcuguguaggccacaaggcaucugcaugagugacuuua

SEQ ID NO: 260630 - RNA, 57 nt, Human
gcaccauccccuaucgcaggacuccugggccacaagcagucggucagugcagacuuc

SEQ ID NO: 260631 - RNA, 57 nt, Human
uuuuguuugaaugugcaauaguuuauaggccacaaauaagcuuucuuguaagcucuc

SEQ ID NO: 260632 - RNA, 64 nt, Human
uccuuuucuccuugccuucgcauggcuggccuuccccuccaaaaccuccauuccccugcugcca

SEQ ID NO: 260633 - RNA, 64 nt, Human
cucaaguacccauucuguuuucccccagcaacgccccuccaaaccuccagccucccugucucca

SEQ ID NO: 260634 - RNA, 64 nt, Human
cggcccaagagcccgugccacccccagcccuggccccuccaauccuccccgcucugccgccgcc

SEQ ID NO: 260635 - RNA, 64 nt, Human
ggaacuaaaugaacagaacuucaaauacuuccuacccuccaauucagacucagcugacuguuga

SEQ ID NO: 260636 - RNA, 64 nt, Human
uucacuaacagaggaauuaugcuuugcacuacgucccuccaagugaagacagacuguuuuagac

SEQ ID NO: 260637 - RNA, 64 nt, Human
ccaugugauuucaguauauacaacuccaccagaccccuccaacccauauaacaccccaccccug

SEQ ID NO: 260638 - RNA, 64 nt, Human
uggucccgagaggagguggggccuggcccuggcucccuccaaccagcugcuccugggacacagg

SEQ ID NO: 260639 - RNA, 64 nt, Human
ucaagccccaugccgugcucauccuacccccaaucccuccaauaaaccugauucugcugcccag

SEQ ID NO: 260640 - RNA, 64 nt, Human
aggauuuucacacccccuccucaagcugggccugcccuccaagugcuuguuauauaccuccacg

SEQ ID NO: 260641 - RNA, 64 nt, Human
ugaagcacucuucuaccaauguuugggugaccaccccuccaauaucccagaaugaauaagaaca

SEQ ID NO: 260642 - RNA, 64 nt, Human
ugguuuaugccacugacuugguuaaguuuccacccccuccaauuugugaaaaacagagcaguga

SEQ ID NO: 260643 - RNA, 64 nt, Human
ccccagugagguugaaggcaccaauuccaagaaucccuccaaccucccugccagcacucccccu

SEQ ID NO: 260644 - RNA, 64 nt, Human
uuuaaggguuuuuuuuuuuuuuaguguguguuuucccuccaagugugauauuuccugcugaauu

SEQ ID NO: 260645 - RNA, 64 nt, Human
ugucccugggagggacaugcuuagcaguccccuucccuccaagaaggauuugguccgucauaac

SEQ ID NO: 260646 - RNA, 64 nt, Human
uuggccgaaauuucuacaccugugucuaguccuccccuccaagagcauuaacuauuuaaaacaa

SEQ ID NO: 260647 - RNA, 64 nt, Human
gggugccccuccagucccagacggcaauguuccucccuccaacugucccuggagccagaacacu

SEQ ID NO: 260648 - RNA, 57 nt, Human
cugcacaaccagauugcuugugcagagggccacaauaaguguauguuuuauauuuua

SEQ ID NO: 260649 - RNA, 57 nt, Human
agccuacagcaguguggucucuuacauggccacaaagggacacacagugacaaaagg

SEQ ID NO: 260650 - RNA, 57 nt, Human
uuuuuuuuaaaccaacaaaccaaaaaaggccacaaaauuaauuagaggcuucucauc

SEQ ID NO: 260651 - RNA, 57 nt, Human
aaaucccuuaggaagacuaugagaguaggccacaaggacaugggcccacacaucugc

SEQ ID NO: 260652 - RNA, 64 nt, Human
ccaccccgggccaugccagugugucccucugggucccuccaaaacucuggucaguucaaggaug

SEQ ID NO: 260653 - RNA, 64 nt, Human
ccccugcccgggaagggaccuugcagggaccucucccuccaaaaaaagaaaaaaagaaaaagaa

SEQ ID NO: 260654 - RNA, 64 nt, Human
cuugccucuguccccuucucucaucucuuagcuccccuccaaccuggggggcagugguguggag

SEQ ID NO: 260655 - RNA, 64 nt, Human
gccgggcgggacccgccccacagacuccaacuuccccuccaaaccccgaagugaaacccgccac

SEQ ID NO: 260656 - RNA, 64 nt, Human
aaaugugaggaauguggcaaagccuuuagccugucccuccaauuuacugcacauaagauaauuu

SEQ ID NO: 260657 - RNA, 64 nt, Human
ccucuccugagggggaauccuggugcucaaauuacccuccaaaagcaaguagccaaagccguug

SEQ ID NO: 260658 - RNA, 64 nt, Human
ugcaugcugugccugccgcgugcccuucccccaucccuccaaucugugccccgucugcagggca

SEQ ID NO: 260659 - RNA, 64 nt, Human
ccagaguuggacccgaccccaauggaugaagacccccuccaaagagaccagccucccucccugu

SEQ ID NO: 260660 - RNA, 64 nt, Human
gaggugacgggcggggcggccugcaucccagggccccuccaaucccaccggacccaggcccugg

SEQ ID NO: 260661 - RNA, 64 nt, Human
uggaagaggagcaaacacuggccucugguguccacccuccaacccccacaagucccucuuuggg

SEQ ID NO: 260662 - RNA, 64 nt, Human
ggagggguggcuggggcccccacccauucccccucccuccaaacucccaacccccagucagugu

SEQ ID NO: 260663 - RNA, 64 nt, Human
cgcgggagcugaggaagcgccgcuccaccgucugcccuccaaggacccgcauggaggcaguggg

SEQ ID NO: 260664 - RNA, 64 nt, Human
ccugcucucucuccacccuccuguucugucuguacccuccaaaaccaagagccggagguggccc

SEQ ID NO: 260665 - RNA, 64 nt, Human
ggaggggagagaagacuuuguuuccgacucaucacccuccaagagggcagcgcucccaguggug

SEQ ID NO: 260666 - RNA, 64 nt, Human
cuucccuucccacccccccuuaagccugucagcccccuccaaaugucucaggauccccccucuc

SEQ ID NO: 260667 - RNA, 64 nt, Human
ggccccccaucucugaacccuagagccccgcuuucccuccaaggcugacuccccgcugacccua

SEQ ID NO: 260668 - RNA, 57 nt, Human
ugccuucugaaucaaggauuuaauuaaggccacaauaccuuuuuaauacucaguguu

SEQ ID NO: 260669 - RNA, 53 nt, Human
cccaagaugcagccgucugaugaggccacaaccccuaggccccucaggagcuu

SEQ ID NO: 260670 - RNA, 57 nt, Human
uggccaaguauggggucauggauuccaggccacaaauuccaggccuaguucagucug

SEQ ID NO: 260671 - RNA, 57 nt, Human
uaacacuuguuagagacaccucagucgggccacaacugucucuguuucaacuuuaag

SEQ ID NO: 260672 - RNA, 64 nt, Human
uggugcggggcagggccuaacaaggaaaccugggcccuccaagccagguugaggucugguaaca

SEQ ID NO: 260673 - RNA, 64 nt, Human
gaaggagguggaugguuaggucugcugggaugggcccuccaagcccaagccuccugcuccgggg

SEQ ID NO: 260674 - RNA, 64 nt, Human
ugcccuaugcugacccaggaaaggccagaccugccccuccaaacuccacaguaugggacccugg

SEQ ID NO: 260675 - RNA, 64 nt, Human
agaaggggagucauuacuccccauuaccuagggccccuccaaaagaguccuuuuaaauaaauga

SEQ ID NO: 260676 - RNA, 64 nt, Human
ggccacgcuccccguccuuggccgccccuccacccccuccaacucugcuccucuagggccgccg

SEQ ID NO: 260677 - RNA, 64 nt, Human
aacaaccucuaccugcggcugcaggagcugguggcccuccaagggcagcauccacccugcagcg

SEQ ID NO: 260678 - RNA, 64 nt, Human
gcguucacugccaaugcuguacucaccuccaucacccuccaacuuuggggcccaugucuuccuu

SEQ ID NO: 260679 - RNA, 64 nt, Human
ugggcacaagcaaaucccaaauucuccuccugaacccuccaaauuugucuaagaacuucgaaaa

SEQ ID NO: 260680 - RNA, 64 nt, Human
gugaggugagggcuagagacagcccacgggcccucccuccaagugugggagggagagaugcucu

SEQ ID NO: 260681 - RNA, 64 nt, Human
augaccuaauuuaaauaaauuaacuauuuaaagacccuccaaauacaguaaccuucugagauau

SEQ ID NO: 260682 - RNA, 64 nt, Human
ccuuccaccgugaccccaaccucuccuguccccucccuccaacucugucucuaaguuauuuaaa

SEQ ID NO: 260683 - RNA, 64 nt, Human
uguggagggagcaugucccugaauuuuccuagaucccuccaaaugccacccaccagagucacug

SEQ ID NO: 260684 - RNA, 64 nt, Human
ccaggggaccucgggacugcgcgugaggccccggcccuccaaauccaaauccagacgcaggccc

SEQ ID NO: 260685 - RNA, 64 nt, Human
aggacuggagacaaaacccucugcuuccuugggucccuccaagacucccuggggcccaacugug

SEQ ID NO: 260686 - RNA, 64 nt, Human
uaauuuaauuuuuaaccuguuaaauaaaccuugucccuccaaggaguucauuuuugggaaacaa

SEQ ID NO: 260687 - RNA, 64 nt, Human
aagugugaagaugcuuaaugguguuuugaggcaucccuccaaccucugugacuacuuuauccau

SEQ ID NO: 260688 - RNA, 57 nt, Human
auauagacaugucacagguggaaaaagggccacaagccguuuugcacaaaugccugc

SEQ ID NO: 260689 - RNA, 57 nt, Human
ucagcauccuuggugaacaagaggaguggccacaaggccaguggcaccugccagagg

SEQ ID NO: 260690 - RNA, 57 nt, Human
aaagucccaaaccaagaauagguccuuggccacaagcagggucugaucccccaucag

SEQ ID NO: 260691 - RNA, 54 nt, Human
aagaggagggaucaaguuaaugaaggccacaaggcacugggcaccaguccuuuu

SEQ ID NO: 260692 - RNA, 64 nt, Human
uguggguugcuuuuucuucagugcuaagaaaguucccuccaacaggaacucucugaccuguuua

SEQ ID NO: 260693 - RNA, 64 nt, Human
ccuagggucuucggcaccuccaagagcugaaucucccuccaacccuucuugccuacuccucacu

SEQ ID NO: 260694 - RNA, 64 nt, Human
agugaccccagagcccugggcuauagucucugaccccuccaaggaaagaccaccuucuggggac

SEQ ID NO: 260695 - RNA, 64 nt, Human
cucccugccuguccccaaguccucaccucaaacucccuccaagucccauguauauagguccuga

SEQ ID NO: 260696 - RNA, 64 nt, Human
acugugcaggagaacagacagaggaaaugugucucccuccaaggccccaaagccucagagaaag

SEQ ID NO: 260697 - RNA, 64 nt, Human
ccagcaaccccccagggucauggaggacccaggacccuccaaccuugacaccuguaaggacagg

SEQ ID NO: 260698 - RNA, 64 nt, Human
ucugaagcgccugccuccccacugcucugccccacccuccaaucugcacuuugauuugcuuccu

SEQ ID NO: 260699 - RNA, 64 nt, Human
caucucagacuuccucgucuauaacaagagccgucccuccaauuaaugcagcccugaggugucu

SEQ ID NO: 260700 - RNA, 64 nt, Human
ccuccaggagaauggagagaaagggcuuccaggccccuccaagccuggggaaggacguggcauc

SEQ ID NO: 260701 - RNA, 64 nt, Human
aaggcugaugcauucccggugcagaacaggggcacccuccaaacacugggcucugaggagugga

SEQ ID NO: 260702 - RNA, 64 nt, Human
ugggcucucacaucuaucugguuguucuucaccacccuccaaguccucugaccuaauuuucugc

SEQ ID NO: 260703 - RNA, 64 nt, Human
gagucaccugagcccucguccccauucccagggccccuccaagcccagcuggcaccaaagagcu

SEQ ID NO: 260704 - RNA, 64 nt, Human
ggcuaguggccuggccauugguauuuugaaaaaucccuccaagugauucuuuuacaucccagau

SEQ ID NO: 260705 - RNA, 64 nt, Human
ucaucuuggaaacugcucuuauugugccaauaugcccuccaaacccucccaggauucaaagcua

SEQ ID NO: 260706 - RNA, 64 nt, Human
acccugacuucagggaaggugaaacagggcuugucccuccaacugcaggaaaacccuuaauaaa

SEQ ID NO: 260707 - RNA, 64 nt, Human
cgaaggccgcccuaacaacuucccauccgcugaccccuccaacgccaucaaucuccagcugugg

SEQ ID NO: 260708 - RNA, 57 nt, Human
cuguuaagguggaaaauggacuggcuuggccacaaccugaaagacaaaauaaacauu

SEQ ID NO: 260709 - RNA, 57 nt, Human
caccaccaacaaagaggacuuuuguggggccacaaguaagaggucauuucuggaaug

SEQ ID NO: 260710 - RNA, 57 nt, Human
aauucaacccugcagaugucaacugaaggccacaaaaaugaacuccaucuacaagug

SEQ ID NO: 260711 - RNA, 57 nt, Human
uggcuuccauugaggagcccaggcuggggccacaacccugaauaaacucuguuggcc

SEQ ID NO: 260712 - RNA, 64 nt, Human
cugacauugccucaggagggggaagcucaucccucccuccaagcccccgaugcggagcuagggc

SEQ ID NO: 260713 - RNA, 64 nt, Human
ggcagagcgggugucagacugaggauuucgcuuccccuccaagacgcugggggucuuggcugcu

SEQ ID NO: 260714 - RNA, 64 nt, Human
uacccccaucacccagggcguggagaugaccacgcccuccaaacagagcaacaacaaguacgcg

SEQ ID NO: 260715 - RNA, 64 nt, Human
ucagcccuuccaauuccccucuuuuucugcccuccccuccaacucagccaacccaggugugggc

SEQ ID NO: 260716 - RNA, 64 nt, Human
cuauauccccaccucugcuugcuuucuuucccuccccuccaaugauaaagaaaaugauaaauuu

SEQ ID NO: 260717 - RNA, 64 nt, Human
uagagccaggaccaggugggggugcggcccugugcccuccaaauucacaggggguaccuaggag

SEQ ID NO: 260718 - RNA, 64 nt, Human
gagaggaugaggcauaugcguugucaguuggaaucccuccaaauggauugcaagagaaauacua

SEQ ID NO: 260719 - RNA, 64 nt, Human
gacaggaacccuugcauccauuguugugucugugcccuccaaagagccuucagaaugcuccuga

SEQ ID NO: 260720 - RNA, 64 nt, Human
cuuugauuuuauuuauaagccacuugcugcaugacccuccaaguagaccuguggcuuaaaauaa

SEQ ID NO: 260721 - RNA, 64 nt, Human
uuccauugaauuaucaacugugauuuuuauauugcccuccaagugguagaagaagauugcaaag

SEQ ID NO: 260722 - RNA, 64 nt, Human
caggcccccaaccccccauuucuuccccaccaaccccuccaaugcuguuaucccugccuggucc

SEQ ID NO: 260723 - RNA, 64 nt, Human
cucucaggugaccaaaauccccuucucaucacuccccuccaaagaggugacugggcccugccuc

SEQ ID NO: 260724 - RNA, 64 nt, Human
uaggaucuccacuggacccuugauucauucugaacccuccaaaggaacucuagagggcgaggga

SEQ ID NO: 260725 - RNA, 56 nt, Human
cauccccugaaaaacucugaagaauccccuccaaccauucucuugugaacagaaga

SEQ ID NO: 260726 - RNA, 64 nt, Human
cuuauauuuuuauuagaacucauuauucuggguacccuccaaugagaauuagagagguuaaaua

SEQ ID NO: 260727 - RNA, 64 nt, Human
uugugggcauugcucuaaccuacuucucaagcuucccuccaaagaaacugauuggcccuggaac

SEQ ID NO: 260728 - RNA, 64 nt, Human
aaauaaggcuugcuguuuguucuccuggggcgcucccuccaacuuuugcagauucuugcaaccu

SEQ ID NO: 260729 - RNA, 57 nt, Human
gggccauuuaagaagcuaggggaauuaggccacaacacccccugggacauccgaaag

SEQ ID NO: 260730 - RNA, 57 nt, Human
gaagacagggaaaggaaggcagcaggaggccacaagcccaccaggucuucaugucaa

SEQ ID NO: 260731 - RNA, 57 nt, Human
gggacagucaccaggguuggggggaagggccacaaaaugaaaccauuaaagacccuu

SEQ ID NO: 260732 - RNA, 64 nt, Human; identical to SEQ ID NO: 158815

SEQ ID NO: 260733 - RNA, 64 nt, Human; identical to SEQ ID NO: 158816

SEQ ID NO: 260734 - RNA, 64 nt, Human; identical to SEQ ID NO: 158817

SEQ ID NO: 260735 - RNA, 64 nt, Human; identical to SEQ ID NO: 158818

SEQ ID NO: 260736 - RNA, 64 nt, Human; identical to SEQ ID NO: 158819

SEQ ID NO: 260737 - RNA, 64 nt, Human; identical to SEQ ID NO: 158820

SEQ ID NO: 260738 - RNA, 64 nt, Human; identical to SEQ ID NO: 158821

SEQ ID NO: 260739 - RNA, 64 nt, Human; identical to SEQ ID NO: 158822

SEQ ID NO: 260740 - RNA, 64 nt, Human; identical to SEQ ID NO: 158823

SEQ ID NO: 260741 - RNA, 64 nt, Human; identical to SEQ ID NO: 158824

SEQ ID NO: 260742 - RNA, 64 nt, Human; identical to SEQ ID NO: 158825

SEQ ID NO: 260743 - RNA, 64 nt, Human; identical to SEQ ID NO: 158826

SEQ ID NO: 260744 - RNA, 57 nt, Human
gggucccagcacagcccagaaaccuuuggccacaagaaguggggucagucagggcug

SEQ ID NO: 260745 - RNA, 57 nt, Human
aguccgagcuuaucuaaauaugaauguggccacaaagcuguggaaggugacaaagcu

SEQ ID NO: 260746 - RNA, 57 nt, Human
uugauaccacgggaguccaguaauauuggccacaaaagccagagaaaguaccaagcc

SEQ ID NO: 260747 - RNA, 64 nt, Human; identical to SEQ ID NO: 158827

SEQ ID NO: 260748 - RNA, 64 nt, Human; identical to SEQ ID NO: 158828

SEQ ID NO: 260749 - RNA, 64 nt, Human; identical to SEQ ID NO: 158829

SEQ ID NO: 260750 - RNA, 64 nt, Human; identical to SEQ ID NO: 158830

SEQ ID NO: 260751 - RNA, 64 nt, Human; identical to SEQ ID NO: 158831

SEQ ID NO: 260752 - RNA, 64 nt, Human; identical to SEQ ID NO: 158832

SEQ ID NO: 260753 - RNA, 64 nt, Human; identical to SEQ ID NO: 158833

SEQ ID NO: 260754 - RNA, 64 nt, Human; identical to SEQ ID NO: 158834

SEQ ID NO: 260755 - RNA, 64 nt, Human; identical to SEQ ID NO: 158835

SEQ ID NO: 260756 - RNA, 64 nt, Human; identical to SEQ ID NO: 158836

SEQ ID NO: 260757 - RNA, 64 nt, Human; identical to SEQ ID NO: 158837

SEQ ID NO: 260758 - RNA, 64 nt, Human; identical to SEQ ID NO: 158838

SEQ ID NO: 260759 - RNA, 64 nt, Human; identical to SEQ ID NO: 158839

SEQ ID NO: 260760 - RNA, 64 nt, Human; identical to SEQ ID NO: 158840

SEQ ID NO: 260761 - RNA, 64 nt, Human; identical to SEQ ID NO: 158841

SEQ ID NO: 260762 - RNA, 64 nt, Human; identical to SEQ ID NO: 158842

SEQ ID NO: 260763 - RNA, 57 nt, Human
aucucaaacuccuggucuugaacuccuggccacaagugaucugcccgccuuggccuc

SEQ ID NO: 260764 - RNA, 57 nt, Human
gucucuagacgaggggaaugggggaagggccacaaccucuguuucugugacccagca

SEQ ID NO: 260765 - RNA, 57 nt, Human
ggaaaauacugagugcuaauguuacagggccacaaucucauauccacaauuccaaaa

SEQ ID NO: 260766 - RNA, 64 nt, Human; identical to SEQ ID NO: 158843

SEQ ID NO: 260767 - RNA, 64 nt, Human; identical to SEQ ID NO: 158844

SEQ ID NO: 260768 - RNA, 64 nt, Human; identical to SEQ ID NO: 158845

SEQ ID NO: 260769 - RNA, 64 nt, Human; identical to SEQ ID NO: 158846

SEQ ID NO: 260770 - RNA, 64 nt, Human; identical to SEQ ID NO: 158847

SEQ ID NO: 260771 - RNA, 64 nt, Human; identical to SEQ ID NO: 158848

SEQ ID NO: 260772 - RNA, 64 nt, Human; identical to SEQ ID NO: 158849

SEQ ID NO: 260773 - RNA, 64 nt, Human; identical to SEQ ID NO: 158850

SEQ ID NO: 260774 - RNA, 64 nt, Human; identical to SEQ ID NO: 158851

SEQ ID NO: 260775 - RNA, 64 nt, Human; identical to SEQ ID NO: 158852

SEQ ID NO: 260776 - RNA, 57 nt, Human
caggugcuagaaacuuuaugucaaaguggccacaagauuguuuaauaggagacgaac

SEQ ID NO: 260777 - RNA, 57 nt, Human
gucaccaauaggguuuggagagcaaagggccacaacucaucagcugccugucucuua

SEQ ID NO: 260778 - RNA, 57 nt, Human
ggcaacuguuucaucuuaauaugcaagggccacaauuugcacuguguucauauuaau

SEQ ID NO: 260779 - RNA, 57 nt, Human
cagugcacuggcgggucucuccaugcaggccacaacacagggucaguguucaccugg

SEQ ID NO: 260780 - RNA, 57 nt, Human
agagcuccaugcuguucugaaagggauggccacaaguucuuucccagccucuuccau

SEQ ID NO: 260781 - RNA, 57 nt, Human
gggugaaguucacuccagcaagucucaggccacaauggggugguuugguuugguuuc

SEQ ID NO: 260782 - RNA, 57 nt, Human
cagguaccuacugcuggccucuucaguggccacaauccucaguccucaccugcuggu

SEQ ID NO: 260783 - RNA, 57 nt, Human
cccccaggaggagaugaccagugccuuggccacaaugcgcguugacuacgagcagau

SEQ ID NO: 260784 - RNA, 57 nt, Human
uugcagcugugagaagucacucacacuggccacaaggacgcuggcuacugucuauua

SEQ ID NO: 260785 - RNA, 57 nt, Human
augaguuccugggagcggaggcuggaaggccacaaggugcuugcuaaggaacagaau

SEQ ID NO: 260786 - RNA, 64 nt, Human
gaggagggaggagggaaccuggcgggggugucugaggccgcacugucagcuggccgguccaagc

SEQ ID NO: 260787 - RNA, 50 nt, Human
gggacaucgcuaaguacuagaggccgcagacuccuguccgcagccucgca

SEQ ID NO: 260788 - RNA, 64 nt, Human
ccccccaacccgggaaccccugcccuccuccagcaggccgcaccgccccuggggcccccugcca

SEQ ID NO: 260789 - RNA, 64 nt, Human
ucuggggccccuuuccaccgcucacugcuuagaaaggccgcauccuccccgagcccuuauaccu

SEQ ID NO: 260790 - RNA, 64 nt, Human
ccgaccgcagccagccccuccccaggagcuccccaggccgcaggggcucugcguucugcucugg

SEQ ID NO: 260791 - RNA, 64 nt, Human
agauggauaaacugccaagaaccagauuuuuaaaaggccgcaaaaaaucuuuuccugggagucu

SEQ ID NO: 260792 - RNA, 64 nt, Human
cugggucggcggacacaaaguccauccaggacccaggccgcagagggagcaggaagagaugcug

SEQ ID NO: 260793 - RNA, 64 nt, Human
gguacgaguccacuguugcuuugguagagaugagaggccgcauuuugcugcuaaagcaagagaa

SEQ ID NO: 260794 - RNA, 64 nt, Human
agaagagaaaauguaaaggagggagaucuuucccaggccgcaccauuucugucacucacaugga

SEQ ID NO: 260795 - RNA, 64 nt, Human
agggggucaguggagccaugucaggagccuggccaggccgcaccccuugcugucucagcagaug

SEQ ID NO: 260796 - RNA, 64 nt, Human
ugauuggggccucacccagaaggaacccggucccaggccgcauggccccuccaggaacauuccc

SEQ ID NO: 260797 - RNA, 64 nt, Human
ccaucugcuccccaauggccaaaaucacaucaccaggccgcagaccagcccuauagagaaaaau

SEQ ID NO: 260798 - RNA, 64 nt, Human
aaggcuacuaagaaauucaucauuugaaacguagaggccgcagcagucagcgauguuucugaaa

SEQ ID NO: 260799 - RNA, 64 nt, Human
aaccggacagcagcuuggcaaaggccucccuaaaaggccgcauuucugaccugagccccggguc

SEQ ID NO: 260800 - RNA, 64 nt, Human
uugcugaauguuuccaauagacuaaauacuguuuaggccgcaggagaguuuggaauccggaaua

SEQ ID NO: 260801 - RNA, 64 nt, Human
cagacaucccugaaaggaagccccuuuggggcagggaggugaggacuucaucucaacaucggcu

SEQ ID NO: 260802 - RNA, 64 nt, Human
cauuuuucuguguagagacucgguggcccaggcaggaggugaaagcagccauccggaaggcccu

SEQ ID NO: 260803 - RNA, 64 nt, Human
uccacauggccggggaggccucagaaucauggcgggaggugaaaagcacuucguacaugguggu

SEQ ID NO: 260804 - RNA, 64 nt, Human
ggaauggguugcaaaauagaaaugagcuuaauccaggccgcagagccagggaaggugaguaacu

SEQ ID NO: 260805 - RNA, 64 nt, Human
uagggacaggcagggcagggacagccaccuuggaaggccgcagugaggagcugucuggaccagu

SEQ ID NO: 260806 - RNA, 64 nt, Human
ggaggugucacacaacuuggagguaaaugcccccaggccgcauguggcuucauuauacugagcc

SEQ ID NO: 260807 - RNA, 64 nt, Human
ggguuggggcgcugagcucccagacccccugaucaggccgcacugucugaagcaaucgguuccc

SEQ ID NO: 260808 - RNA, 64 nt, Human
auaugccucagugaugcauuuaucuuuguauaucaggccgcaugauucccaacuuucugccaca

SEQ ID NO: 260809 - RNA, 64 nt, Human
cggaagcucccggggacgacgcugacugcccuggaggccgcagccaacccggcacugcccucag

SEQ ID NO: 260810 - RNA, 64 nt, Human
guccucuucucuggccugccuggggagcccgugaaggccgcacgggugccuccagccugagaca

SEQ ID NO: 260811 - RNA, 64 nt, Human
ucaccggaggagggcggggccugcacuugaagucaggccgcaccugucuguuuuuggaagggua

SEQ ID NO: 260812 - RNA, 64 nt, Human
cauccccagugagcuaguggagagggagcaagggaggccgcagagggaaaaaacaaaacguaac

SEQ ID NO: 260813 - RNA, 64 nt, Human
gaguuggcaugcagagacuuugucaggaugggagaggccgcagguguuguguucugaucacugg

SEQ ID NO: 260814 - RNA, 64 nt, Human
gcacuggcaggcgagggcucucguucauauucucaggccgcaagugcaaugccugaggggauca

SEQ ID NO: 260815 - RNA, 64 nt, Human
accauucuuacuugguggccauguacuuggaaaaaggccgcaugaucuuucuggcuccacucag

SEQ ID NO: 260816 - RNA, 64 nt, Human
ugggacucaguucuuggccugcuagcggcugaacaggccgcacaucucacuucaguuguggccu

SEQ ID NO: 260817 - RNA, 64 nt, Human
uuuggcaaugcugcuuauaacacaucccaagugcaggccgcagugguccacgucauccagcccc

SEQ ID NO: 260818 - RNA, 64 nt, Human
gccccagccuucugaaagccggcgcugcagccagaggccgcacgcugcacugucgcgacgcaga

SEQ ID NO: 260819 - RNA, 64 nt, Human
aacauuucuaaacacuuguucugccaucuacaugggaggugaugaaacucagugguaacucaug

SEQ ID NO: 260820 - RNA, 64 nt, Human
ggcauucuuggagggauccugugaaguauuguuaggaggugaacuucacuacauguuaaguuac

SEQ ID NO: 260821 - RNA, 64 nt, Human
cugggguaggaaugguuguuggggcagagccaguggaggugagugacccugagacuaaugaaca

SEQ ID NO: 260822 - RNA, 53 nt, Human
ccucugggcccuggcuguagccgaggccgcagccggugagaggcggagccucg

SEQ ID NO: 260823 - RNA, 64 nt, Human
ggaaugagcaggucagauucaaggcagugaggucaggccgcaugaaccuggaggggaaucgggg

SEQ ID NO: 260824 - RNA, 64 nt, Human
ggcaaaucaccgggcagagggaggggaggagaggaggccgcacucucccugucucucccgucuc

SEQ ID NO: 260825 - RNA, 64 nt, Human
auuugugccugccucugugcugccgcaggagggcaggccgcaagugggguuggugggggucgag

SEQ ID NO: 260826 - RNA, 64 nt, Human
uacuuaccaagcugagcaaccucuucagcugggaaggccgcaagaggcauagagggagaggaag

SEQ ID NO: 260827 - RNA, 64 nt, Human
cccgaggggaaggggcggugcccacaccggggacaggccgcagcuccauuuucuuauugcgcug

SEQ ID NO: 260828 - RNA, 50 nt, Human
cagagauccagaugguuugaaggccgcagagccagaccauuucuucccca

SEQ ID NO: 260829 - RNA, 64 nt, Human
uuagcuaggcauaguaccugaggccaggagguccaggccgcaaugagauguguuugugccauug

SEQ ID NO: 260830 - RNA, 64 nt, Human
ucuaucugggggacgcugcucgagagaggccaagaggccgcagaacaugccagguguccucacu

SEQ ID NO: 260831 - RNA, 64 nt, Human
cggaaugcacaggcgagucccugcccucccucccaggccgcacagguccugccaagccucacgg

SEQ ID NO: 260832 - RNA, 64 nt, Human
ccgccccaucccgagucgcuaaggggcugcggggaggccgcagcaccuucuggaagacuuggcc

SEQ ID NO: 260833 - RNA, 64 nt, Human
ccgagggguggccgcuccagaagggugcccagucaggccgcaccgccgccagccuccuccggcc

SEQ ID NO: 260834 - RNA, 64 nt, Human
uuuucuaagcuggaaacuuagugugccuuggaaaaggccgcaaguugcuuacuccgaguagcug

SEQ ID NO: 260835 - RNA, 64 nt, Human
uaaacuauuucuagguuugugaaugugaagccccaggccgcagggggcaaggggccaggugccc

SEQ ID NO: 260836 - RNA, 64 nt, Human
cauagcuggagugaaggcggagggagccugcuacaggccgcagcccaaccccuguuuuuuauuc

SEQ ID NO: 260837 - RNA, 64 nt, Human
cuauucugagauaggagaaaaccgcccuguggcuggaggugagauaugcuggcagcaauacugc

SEQ ID NO: 260838 - RNA, 64 nt, Human
caggugucaugccagguuauguauacauuuauguggaggugauuaauuuuguaguaacuuuuga

SEQ ID NO: 260839 - RNA, 55 nt, Human
auugcuguucaaggaaguaagaggaggaggugauguagcacuuccaagauggcac

SEQ ID NO: 260840 - RNA, 64 nt, Human
ggccugcccacugugccuuucgagauggugguggaggccgcacagaaggccaaugcccacggcu

SEQ ID NO: 260841 - RNA, 64 nt, Human
gcccaggcccaguccuuggugucagggagcccccaggccgcagguggagggugauaaaauaugu

SEQ ID NO: 260842 - RNA, 64 nt, Human
aggggcagcccuugcuuguugggauuccugacccaggccgcagcucuugcccuucccugucccu

SEQ ID NO: 260843 - RNA, 64 nt, Human
acugaacagccauggcaaggcagaccuacaggcgaggccgcagcagaggguggggcagagcagc

SEQ ID NO: 260844 - RNA, 64 nt, Human
cugccgugucuccucgucaggggagacuuuuaggaggccgcagccuuccaucaccggaucaguu

SEQ ID NO: 260845 - RNA, 64 nt, Human
gaggggggccugccaggacuccugucucugggugaggccgcauccuucaaggcccaugugggcu

SEQ ID NO: 260846 - RNA, 64 nt, Human
aguaugaggccagcaggggacauuugggaugcccaggccgcagaggaagcugggcacugggugc

SEQ ID NO: 260847 - RNA, 64 nt, Human
ggggcgaggcgccucccgcccucggcuggagacgaggccgcagaccccuucucaccucuugagg

SEQ ID NO: 260848 - RNA, 64 nt, Human
gcuuguuccugccccaggaauaggccaggagggaaggccgcagcaggacugccguggggagcac

SEQ ID NO: 260849 - RNA, 64 nt, Human
ugcuuuugugucugagaugggccccucuuuucagaggccgcagggugggugauggagaaggcug

SEQ ID NO: 260850 - RNA, 64 nt, Human
gucuguccucccaucuuggaacaaccuuaucaacaggccgcacugcagaaaugauguuuuauga

SEQ ID NO: 260851 - RNA, 64 nt, Human
gcucgccacaguccuucuuugacaccacaccaucaggccgcauccugaacugcuucuccaagga

SEQ ID NO: 260852 - RNA, 64 nt, Human
caugaacccgggagguggagguugcagggagccgaggccgcaccacugcacuccagccugggug

SEQ ID NO: 260853 - RNA, 64 nt, Human
uggacuuguagccugcaguugucuuuugacuugcaggccgcaggugucuuucuguuaugugaau

SEQ ID NO: 260854 - RNA, 64 nt, Human
ggcauggacuaccagaugaccacaaguugcguugaggccgcaucuuucuucagcagcgugcaau

SEQ ID NO: 260855 - RNA, 64 nt, Human
uccagaagacacacauuugcuauggaaugauuguggaggugagaguauagugcauauuaauuca

SEQ ID NO: 260856 - RNA, 64 nt, Human
cuauuucagggaguauaucuucugugguuuugaaggaggugaguucuguaugugccuugcagua

SEQ ID NO: 260857 - RNA, 64 nt, Human
uggagucagugggugucggccgcucuguugugggggaggugaaccagggaggggcagggcaagg

SEQ ID NO: 260858 - RNA, 64 nt, Human
ggagaauugccugcgccacgcagcggggccggacaggccgcacagaccuacuguggcgggaggg

SEQ ID NO: 260859 - RNA, 64 nt, Human
ucguugcugcuucugccugugcugugggggagagaggccgcagccaggccucugcugcccuuuc

SEQ ID NO: 260860 - RNA, 64 nt, Human
uugcugaaaguuccagagccauugagaauaacugaggccgcagaugcaugaaauuugggccugg

SEQ ID NO: 260861 - RNA, 64 nt, Human
uaaagacgcaacguuuccaacucucgggacgccaaggccgcaggacuggagggccaggccccgc

SEQ ID NO: 260862 - RNA, 64 nt, Human
ccugcauuucacagauggggagcucagcccucgaaggccgcagagacgccucccaggcccgucu

SEQ ID NO: 260863 - RNA, 64 nt, Human
agucaggagcgggggagacagggcuccagggaugaggccgcauucugcucccacagcgccuuuu

SEQ ID NO: 260864 - RNA, 64 nt, Human
agccacugacccuggucaccagaggcugcaauucaggccgcaagcagcugccuggggggugucc

SEQ ID NO: 260865 - RNA, 64 nt, Human
uuuucugauuugacuuuucucgccggccggucucaggccgcacagacguuccagaggaggaggg

SEQ ID NO: 260866 - RNA, 64 nt, Human
cgcuguaauucccugcucccuggagacugggaaaaggccgcagggcagggggacugggcggugg

SEQ ID NO: 260867 - RNA, 64 nt, Human
cggcggggaggagcgggugggugugcgcgcaaggaggccgcacaccguuccuuccaaucccucc

SEQ ID NO: 260868 - RNA, 64 nt, Human
cugucucucagccgcggcagcagggagcgggcagaggccgcagggcuggcucgggcaggugggu

SEQ ID NO: 260869 - RNA, 64 nt, Human
aucaccgaggaggaggcaaaacuucuggcccagaaggccgcagaggcugagcaggaaaugcagc

SEQ ID NO: 260870 - RNA, 64 nt, Human
caucucagacuccuuggcaaaaaacggaguccgcaggccgcagguguugugaagaccacucguu

SEQ ID NO: 260871 - RNA, 64 nt, Human
cccacgagggucgccaugaucaccccaacucuagaggccgcagcagagcucaggacauuccccc

SEQ ID NO: 260872 - RNA, 58 nt, Human
aaguguggaagacggacuaagccuagagaggccgcaaggggaccgccccaggcaccgc

SEQ ID NO: 260873 - RNA, 64 nt, Human
auucuugucacccuuugggagaaguuacauuucuggaggugaugaagcaaggagggagcacuag

SEQ ID NO: 260874 - RNA, 64 nt, Human
gaaguaggaccagagaaguggaaggaagcaaaauggaggugaugagaaagguggugggagaaag

SEQ ID NO: 260875 - RNA, 64 nt, Human
agggucaugcguugagcuacugacaaacucaggcggaggugaccaugcccuucaccaaagcugc

SEQ ID NO: 260876 - RNA, 64 nt, Human
ugggugucccccaccccaucagcugggaaagcccaggccgcaggagugggaugcccguuggacu

SEQ ID NO: 260877 - RNA, 64 nt, Human
cauccagcccuccuccucuaucuuuaucugccauaggccgcagcccuggcccccuguggauuga

SEQ ID NO: 260878 - RNA, 64 nt, Human
gacaggagcacguggcucagacaccgacgccgggaggccgcagaccccggacgugucaggcauc

SEQ ID NO: 260879 - RNA, 64 nt, Human
gagaugagaggaucacuugagccuggggagguccaggccgcagugauccgagaucacaccacug

SEQ ID NO: 260880 - RNA, 64 nt, Human
cuggacagcgacacgcagggggcucggaggacucaggccgcagcccccgcgacggagggcaggg

SEQ ID NO: 260881 - RNA, 64 nt, Human
gauuauagauuauaaaguauuaagacaacaccacaggccgcaugcucuaaucggucucuuuaua

SEQ ID NO: 260882 - RNA, 64 nt, Human
gcggccugggcagcgccugugcagaccucccugcaggccgcacugccaacugcugcauuuguug

SEQ ID NO: 260883 - RNA, 64 nt, Human
cugaggccuggagguaggaagggacuugcccccaaggccgcacacugaguuaacagcagaauug

SEQ ID NO: 260884 - RNA, 64 nt, Human
guggaauuaauugcaguagggauaaaguagaagaaaccacaaauuaucuugugccugaaaucca

SEQ ID NO: 260885 - RNA, 64 nt, Human
agaauggcccaguccucucccaaguccacacaggggaggugauagcauugcuuucguguaaauu

SEQ ID NO: 260886 - RNA, 64 nt, Human
cagaugggcuuagcauugggaagacagagggcaaggaggugauagauggauauagaagcauuuc

SEQ ID NO: 260887 - RNA, 64 nt, Human
caugguggcucaugccuguaaucccagcacuuugggaggugagguggguggaucaucugagguc

SEQ ID NO: 260888 - RNA, 64 nt, Human
gucaauguaaguauuugucauaucugagguccaaaaccacaaugaaagugcucugaagauuuaa

SEQ ID NO: 260889 - RNA, 64 nt, Human
caucguguuugcaaagguuaaaacaaaaacaaaaaaccacaaaaauaaaaaacaaaaaaaacaa

SEQ ID NO: 260890 - RNA, 64 nt, Human
uauucaacagaaggacuguggucauguaacagguaaccacaauuuucagguuucuuaaaaacag

SEQ ID NO: 260891 - RNA, 64 nt, Human
aaguagaguuucuuaauagucacaacuuaauuugaaccacaaguauccagcuuaaucacguauc

SEQ ID NO: 260892 - RNA, 64 nt, Human
uuccauuugaaaaaaaucucaaaacacagauuaaaaccacaauaggcuguaguauuuuuuauuu

SEQ ID NO: 260893 - RNA, 64 nt, Human
gugcaugugugugugugugagugucuuaaagcauaaccacaaacugcaaaaagcuagguaagcu

SEQ ID NO: 260894 - RNA, 64 nt, Human
ucaacaagacggcugccaaccugagaagucaccaaaccacaaaaauaaccuuacagccuucagg

SEQ ID NO: 260895 - RNA, 64 nt, Human
ggcaacacaagcucgcaacucuaagauuuuuuuaaaccacaaaaacccugguuagccaucucau

SEQ ID NO: 260896 - RNA, 64 nt, Human
aagcaauuuaaucaauugcaaagcaauuauauaaaaccacaaagaauguacugaaccuacuaac

SEQ ID NO: 260897 - RNA, 64 nt, Human
uguaaaucuucauagugucagacauacugaccaaaaccacaaucuagacuacaaaguauauugu

SEQ ID NO: 260898 - RNA, 64 nt, Human
gguaaauacaccauaccauaauaucugcuuggagaaccacaaugcacauuagcauauuagucug

SEQ ID NO: 260899 - RNA, 64 nt, Human
auuuugaaguauuugggcaggugagucauguuuuaaccacaagccauaacucaucuguugucuu

SEQ ID NO: 260900 - RNA, 64 nt, Human
acaaaauacccaagauuuaagaccggggggaaaaaaccacaaauugguaaauaaagguuugcua

SEQ ID NO: 260901 - RNA, 64 nt, Human
uugcugcccuggaagccaggagccugcucacuccaaccacaagucgcccuugacugcggcggcc

SEQ ID NO: 260902 - RNA, 64 nt, Human
acggcuuuuugcauauuugugucaguuugauguuaaccacaagugccagacugauuuuucagac

SEQ ID NO: 260903 - RNA, 64 nt, Human
gggaagaggaacugagaucacagggaaggagauuggaggugauaccagcacagacagacucuca

SEQ ID NO: 260904 - RNA, 64 nt, Human
agcagcguacggcagacgaaggcagucgagguguggaggugaucacgaagauacauguguuuga

SEQ ID NO: 260905 - RNA, 64 nt, Human
ugucuguguagaguguuauacuugggaauauaaaggaggugaccaaaucagugugaggagguag

SEQ ID NO: 260906 - RNA, 64 nt, Human
ugauuuuuuuuuuaaauuuauguugcggaaagguaaccacaaaguuaugaugaacugcaaacau

SEQ ID NO: 260907 - RNA, 64 nt, Human
agcugcuuaaucauauugauaucuaauuucuuuuaaccacaaugaauuguccuuaauuaccaac

SEQ ID NO: 260908 - RNA, 64 nt, Human
uaggucauuuaguauaauucuucauuaguuuacgaaccacaaaauugcaaauaaauaagcuaug

SEQ ID NO: 260909 - RNA, 64 nt, Human
ggaggaaaauaugguguuuggaauguuagauauuaaccacaauaaggcaugaucuggauuaaau

SEQ ID NO: 260910 - RNA, 64 nt, Human
aucugguacaugggcaaguaaguuauuuaguucuaaccacaaauaacaaguaguuuccaaggaa

SEQ ID NO: 260911 - RNA, 64 nt, Human
uuucuccuagggggcaaaaucgccuccauuugagaaccacaacucuaaagucaagauauuuuuc

SEQ ID NO: 260912 - RNA, 64 nt, Human
cccaccauuaccuucuaguuggcauaaaaacaagaaccacaaaaacuugaaaaaucugaaacag

SEQ ID NO: 260913 - RNA, 64 nt, Human
gcaucagaaugagaaagccugagaagaaagaaccaaccacaagcacacaggaaggaaagcgcag

SEQ ID NO: 260914 - RNA, 64 nt, Human
ugagaaacuuuuuuccuacaaagaccuugcuugaaaccacaaaaguuuugcuggcacgaaagaa

SEQ ID NO: 260915 - RNA, 64 nt, Human
cacauaaucagaccauauagacgaggcacuuuggaaccacaagcuuggcucacaaaaagagcuu

SEQ ID NO: 260916 - RNA, 64 nt, Human
uuguguagguaaauaaaggcagacaugguuugcaaaccacaagaaucauuaguuguagagaagc

SEQ ID NO: 260917 - RNA, 64 nt, Human
uuuuaguaaacuggacauguuauuccacuacaaaaaccacaaguuaucuggccuuuuagaucuu

SEQ ID NO: 260918 - RNA, 64 nt, Human
uuggaaacaguuccugucugaaaacucuucugagaaccacaaaccuuguguauggauucggcau

SEQ ID NO: 260919 - RNA, 64 nt, Human
caucaaaugaaaugagaaguguguaugcugaccaaaccacaagaaacuuucuuuaaguuguguu

SEQ ID NO: 260920 - RNA, 57 nt, Human
augucaccuccaaugacuagggugggcaaccacaaacccacgagggcagagugcugc

SEQ ID NO: 260921 - RNA, 64 nt, Human
ggucagucccccguccggccagccgccccguccgggaggugaggggcgccucugcccagcugcc

SEQ ID NO: 260922 - RNA, 64 nt, Human
ugagcuuuggguucucaguagugaauugagacuuggaggugacuuuucauguuuggaguaucau

SEQ ID NO: 260923 - RNA, 64 nt, Human
ugguggugugagagccugugaguccuagcuaccuggaggugaggugggaacaucacuugagccc

SEQ ID NO: 260924 - RNA, 57 nt, Human
cuaaucccaaggcagugugacucagcuaaccacaaaugucuccuccaggcuaugaaa

SEQ ID NO: 260925 - RNA, 64 nt, Human
caaggcuuuacugcugauagugcuaauuggcauuaaccacaaaaugagaauuauauuugucaac

SEQ ID NO: 260926 - RNA, 64 nt, Human
uugcacuacuuacaaguuucauagauuugagccuaaccacaagaggcuggugcuuaguacuguu

SEQ ID NO: 260927 - RNA, 64 nt, Human
gcaaggcuuuuaucccugaaaaucauuuacagauaaccacaauuugcugugguauauaaacuaa

SEQ ID NO: 260928 - RNA, 64 nt, Human
ucaaacaacaacaacaacaacaacaacaacaacaaaccacaaaauuauuugaguacugugaagg

SEQ ID NO: 260929 - RNA, 64 nt, Human
aaauaaauaagaauaacucagaaacucaaaaggaaaccacaaauucagcuaauaauagcauuuc

SEQ ID NO: 260930 - RNA, 64 nt, Human
uucagaagugucuggucaagauaacaugcuggccaaccacaauuccuagaguuaagagaaccuu

SEQ ID NO: 260931 - RNA, 64 nt, Human
cauucugaaaugaaagaaacuccuuuauauauccaaccacaaucaaacauauaaauaagccugg

SEQ ID NO: 260932 - RNA, 64 nt, Human
cugguauggcuauucuugaaggccagguuuuaauaaccacaaacaaaaaggcaugaaccugggu

SEQ ID NO: 260933 - RNA, 64 nt, Human
guuguuaaucuucaagcuagguuuugcaguucccaaccacaacauucuucuauuuugccaggcu

SEQ ID NO: 260934 - RNA, 64 nt, Human
gaacuucauccuaauaaggauaaaacuuaaggaaaaccacaauaaaccaugaagguguacacau

SEQ ID NO: 260935 - RNA, 64 nt, Human
cuuaagugagcaugcuacuaagucuucuguccugaaccacaauaauaucuuuuaguucucuuua

SEQ ID NO: 260936 - RNA, 64 nt, Human
ggccaggucuccaagccccaaaugaguccuugugaaccacaacugauccccccaggugggugcu

SEQ ID NO: 260937 - RNA, 64 nt, Human
acacaaaggaaucuuuauuuauuacaugaaaaauaaccacaaguccagcauugcggcacacucc

SEQ ID NO: 260938 - RNA, 64 nt, Human
caaaaauaacacaaauaauaauauccuucguuauaaccacaaugagauaaguauuggcauuagu

SEQ ID NO: 260939 - RNA, 64 nt, Human
cgcugcugagcugcgugccacaucgcuacgcccaggaggugagccggcucugccuccugccugc

SEQ ID NO: 260940 - RNA, 64 nt, Human
uguaauccccaugugucaagggagggaccugaugggaggugaugggaucaugggggugguuucc

SEQ ID NO: 260941 - RNA, 64 nt, Human
cucuuggcagauucucaaacagucgcagcucuuuggaggugacucguguuccagguggaucccu

SEQ ID NO: 260942 - RNA, 64 nt, Human
cuuguuuauaaaauaaucauuugcccagggaaaaaaccacaacgcuguuucaagcuuuagucuu

SEQ ID NO: 260943 - RNA, 64 nt, Human
uuagagggaaagacugaaagagaaagauaggaggaaccacaauguuucuucauuucucugcaug

SEQ ID NO: 260944 - RNA, 64 nt, Human
uugaaaguuuugugacaauuauuuugcuguguuuaaccacaaucauucaccuuauggcaugcuu

SEQ ID NO: 260945 - RNA, 64 nt, Human
gcuuugcaaaucuggauuccaauggaccuuucaaaaccacaacaaaaccucaguuuuagaugag

SEQ ID NO: 260946 - RNA, 64 nt, Human
cugguugugauuuauauuuuaaagcuuggugcuaaaccacaauauguauagcauauggagugcc

SEQ ID NO: 260947 - RNA, 64 nt, Human
augggaguagggggguggacaggggagaaacgaaaaccacaaaaagaaaacccaacuccucucc

SEQ ID NO: 260948 - RNA, 64 nt, Human
uacuaaaugggcuccuucauggugacgccccgucaaccacaaucaagaacugaggccugaggcu

SEQ ID NO: 260949 - RNA, 64 nt, Human
uauuuaaaauguacauuccacauuuuaauaaauuaaccacaagaaaauaaucccacauauacaa

SEQ ID NO: 260950 - RNA, 64 nt, Human
gaaguuaagguguugaccacugugccugaaaugaaaccacaaggcuugagaauagaaauuaaaa

SEQ ID NO: 260951 - RNA, 64 nt, Human
uguguacugacuccaucugccccgucaaauaaaaaaccacaagguucgagccgccgggcccgac

SEQ ID NO: 260952 - RNA, 64 nt, Human
ugauuuguaauuuaaacuaauuguauucugagguaaccacaaaauaaauucaaccaaacugggg

SEQ ID NO: 260953 - RNA, 64 nt, Human
cuuuuguuugcauuuucugcaaaaaggaaaaagaaaccacaaauuggggaaaaaaaaagaagaa

SEQ ID NO: 260954 - RNA, 64 nt, Human
ccccuccccaccuaacugcacugaaaccauuucuaaccacaacccuuggcccaaggacuuggua

SEQ ID NO: 260955 - RNA, 64 nt, Human
ggagggaucugacagagaugaaugugccaagcaaaaccacaacuguguauauuuuaaagcacau

SEQ ID NO: 260956 - RNA, 64 nt, Human
uuuuuuagccuuauuaauauuuuucccuauuagaaaccacaauuacucccucuauuaacccuuc

SEQ ID NO: 260957 - RNA, 64 nt, Human
ugcagagcucuuugcuccaggagugaggagacugggaggugaaauggggaaauggaaggguuug

SEQ ID NO: 260958 - RNA, 64 nt, Human
uccacauggcuggggaggccucagaaucauggcgggaggugaaaggcacuucuuacauggcagc

SEQ ID NO: 260959 - RNA, 64 nt, Human
cagcucagggguggggaagaggcgaaagcgugggggaggugagcgcagcggcaguucugccucg

SEQ ID NO: 260960 - RNA, 64 nt, Human
gggcagcccgcugucgggucucucuaggccuaugaaccacaaagcagggaagugggcacguucu

SEQ ID NO: 260961 - RNA, 64 nt, Human
gaagagucaaaguaguuaguuuugguuauuucuaaaccacaaaaguuguuuaauaaguauaucu

SEQ ID NO: 260962 - RNA, 64 nt, Human
cuuuuuuccuuaauaucagaaagcaaaaaaauaaaaccacaauugagauuugccuuucaaaccc

SEQ ID NO: 260963 - RNA, 64 nt, Human
agucuacuugcagguucugaccaagaacaaagacaaccacaaccuaugacuggagcagaauaag

SEQ ID NO: 260964 - RNA, 64 nt, Human
cucucugcuucgugauuuuauuucauugaauuauaaccacaagccaccacccauuugacauccu

SEQ ID NO: 260965 - RNA, 64 nt, Human
ugaccccaguggaaaacaaagccaaacaaaacugaaccacaaaaaaaaaggcugguguucacca

SEQ ID NO: 260966 - RNA, 64 nt, Human
uugcuggaagaaacuaaaaauauagcaaaugcagaaccacaaacaauucgaaugggguagaaac

SEQ ID NO: 260967 - RNA, 64 nt, Human
cugaagccacguagaagcaccuugaaaucuguaaaaccacaagaaaguacuuuauaaaagguau

SEQ ID NO: 260968 - RNA, 64 nt, Human
gaaguaaguuauagcauacuuuuuuaaaaguaggaaccacaaucuuuauauggagcagcuuguu

SEQ ID NO: 260969 - RNA, 64 nt, Human
uauaaaauggagaagagcuugauauucagguacuaaccacaacuagucugacauuguuggcagu

SEQ ID NO: 260970 - RNA, 64 nt, Human
ggauacuuggaaccuuguauuuaaaagugaauuuaaccacaacugagaccuaagaaauugaccu

SEQ ID NO: 260971 - RNA, 64 nt, Human
uuuaucaaaacaagaugaaacacagaaaaguugaaaccacaacaaaaugaauucuauuaaagaa

SEQ ID NO: 260972 - RNA, 64 nt, Human
acuggaaauggagaaguuauugcagacagucaugaaccacaaaucacugugauuaaaauuuucu

SEQ ID NO: 260973 - RNA, 64 nt, Human
uaccagaaaaguacaguugagauaguuaagauauaaccacaagucagaguacauugguuguauu

SEQ ID NO: 260974 - RNA, 64 nt, Human
aaugaguugcaguaauuuguuugcuuguuuguuuaaccacaaccacuauuuuaaugauauacua

SEQ ID NO: 260975 - RNA, 64 nt, Human
ggggcuugugucgagcccuuggguggggccaggaggaggugauggcgucagaggaggugugguc

SEQ ID NO: 260976 - RNA, 64 nt, Human
gaggccguguguuggagagugcccugaugcagauggaggugaugggaguucccuucccacuugc

SEQ ID NO: 260977 - RNA, 64 nt, Human
gcccaacugggaccaggguuuucuguuuuuugauggaggugaaaucucuuuguaauccacuagg

SEQ ID NO: 260978 - RNA, 64 nt, Human
aaacaguuaauaccauuuuuuaaggaaacaauauaaccacaaagcacaguuugaacaaaaucuc

SEQ ID NO: 260979 - RNA, 64 nt, Human
uuuaaauguuaaaauuauaauuucagauucauauaaccacaacugugauauauccuaacuauaa

SEQ ID NO: 260980 - RNA, 64 nt, Human
ggcuaugcauauucaauguauugagaaccaaagcaaccacaaaugcauaaaugcauaauuuaug

SEQ ID NO: 260981 - RNA, 64 nt, Human
auauaugaucucuggguaggugaguuguugugacaaccacaagcacuuuuuuuuuuuuuaaaga

SEQ ID NO: 260982 - RNA, 64 nt, Human
guaauucuaaucucuucuguguuuuccuugccuuaaccacaaauuguggugcuuuuuguauauu

SEQ ID NO: 260983 - RNA, 64 nt, Human
agcgaaacucugucucaaaaaacaaaccaacaaaaaccacaauugauuugaugaaaauuaguuu

SEQ ID NO: 260984 - RNA, 64 nt, Human
gauaaaaacuuuuccaugcaaauaucuauuucuaaaccacaaugaucugauuuucuuucuucuu

SEQ ID NO: 260985 - RNA, 64 nt, Human
gaaagaaaacuaacaaccaaccaaccaaccaaccaaccacaaaccacccuaaaaugacagccgc

SEQ ID NO: 260986 - RNA, 64 nt, Human
gcauacucuuguaagaaaaacacugaauacuuugaaccacaaauaaguguuuauggacaaaaau

SEQ ID NO: 260987 - RNA, 64 nt, Human
caacauuaacuauucauacagaaaugcaaaucaaaaccacaaugagauaucaucucauccuaau

SEQ ID NO: 260988 - RNA, 64 nt, Human
aaggcacaaggaugccaaaaaaacaaaggugagaaaccacaacacaggucuaaacucagcaugc

SEQ ID NO: 260989 - RNA, 64 nt, Human
agaaaugaaagauccaguuugggauuaugaaauaaaccacaaauuaaaauuuuuguuuaaacug

SEQ ID NO: 260990 - RNA, 64 nt, Human
uuauuuuccauaugguucauguucaaauguucacaaccacaaugcaucugacugcaauaaugug

SEQ ID NO: 260991 - RNA, 64 nt, Human
ggauuauugucugucuuuauagcaaguuccaguaaaccacaaguauggcaaagcuuauccaauu

SEQ ID NO: 260992 - RNA, 64 nt, Human
aaguuuguuuugcuuuuaauuuaaaggaagcaguaaccacaaagcuuccgcucaggguuuuuuc

SEQ ID NO: 260993 - RNA, 64 nt, Human
aguaguaacuggccgauugcuaaagaguucauaaggaggugagaaguaauuuuuuuaaaggaga

SEQ ID NO: 260994 - RNA, 64 nt, Human
cucacauuucuauaaacagaggcccccaugaugaggaggugaagauuuagguugcagaaucgac

SEQ ID NO: 260995 - RNA, 64 nt, Human
cucccacaaccuugcccagaguccuuuccacuaaggaggugaagagaacagagaaagagauuuc

SEQ ID NO: 260996 - RNA, 64 nt, Human
aaacuagccacuguucaaaucugauacacuauucaaccacaaaguguaaaggcacugcuuagau

SEQ ID NO: 260997 - RNA, 64 nt, Human
cucaaucacugccuuucucagaacucgguuguccaaccacaauucccuuucccuuaggauaggg

SEQ ID NO: 260998 - RNA, 64 nt, Human
aauagaagcaaauuaaacgguaacauccaaaagcaaccacaaaccuaguacgacuucauuccuu

SEQ ID NO: 260999 - RNA, 64 nt, Human
auugaguguggauuuugcauacauucaaaacauuaaccacaaaauacagcaagugcaccuauau

SEQ ID NO: 261000 - RNA, 63 nt, Human
cuucaucagagaguagcuagaagagaauaaguuaaccacaaaauaagacuuuuugccaucaua

SEQ ID NO: 261001 - RNA, 64 nt, Human
ugauuaaaauuggucguuacuaaaauaguauaguaaccacaagugauuggcuuauaaaugaagu

SEQ ID NO: 261002 - RNA, 64 nt, Human
gagccuguugucuguuagggaccacuaaaucaacaaccacaaauggauuuuuuuuuuaagagga

SEQ ID NO: 261003 - RNA, 64 nt, Human
cuugguuuagcugugcagaaggugaaauggaggaaaccacaaauucaugcaaaguccuuucccg

SEQ ID NO: 261004 - RNA, 64 nt, Human
agaagagcuaaguaacauugucagaaauaaauaaaaccacaagucucaagaauuugccacguau

SEQ ID NO: 261005 - RNA, 64 nt, Human
uacuggguuucaagaaaaucuuuguugaaguuugaaccacaacuuugucgugguucuuaaaugu

SEQ ID NO: 261006 - RNA, 64 nt, Human
gaaggacagcagaggaguauuuuccaucauuucaaaccacaaacaaaauuaagauuuaaacugu

SEQ ID NO: 261007 - RNA, 64 nt, Human
gucauauauacauucagaacuuuuauuuuaaaacaaccacaauaacauuaauaauagaaaauuc

SEQ ID NO: 261008 - RNA, 64 nt, Human
auuuccguguagauggagaucacuguguguaauaaaccacaagugcgugucugggugugccugu

SEQ ID NO: 261009 - RNA, 64 nt, Human
gcuguugcuccuggccucaucagccuccaaacucaaccacaaccagcugccucugcaguuggac

SEQ ID NO: 261010 - RNA, 64 nt, Human
caaguuccuucuggugucugcuuucuccauuguaaaccacaaggcuguugcaugggcuaaugaa

SEQ ID NO: 261011 - RNA, 64 nt, Human
gacugucuuucccccuguccucgacagaagagugggaggugagaagcccgucuccucagugagc

SEQ ID NO: 261012 - RNA, 64 nt, Human
cuuuuaguuaauugccauugagcaccuguucugaggaggugagauguggacuugugcuuauaaa

SEQ ID NO: 261013 - RNA, 64 nt, Human
ugacauaccuguugagggacuaggggagugguggggaggugaguggaccaaaggauauaggccc

SEQ ID NO: 261014 - RNA, 64 nt, Human
aauaucccuuaggaaaaaaaaaaaacacacaaaaaaccacaagagccccagccaguuuacucca

SEQ ID NO: 261015 - RNA, 64 nt, Human
accaacagaguauuugagaaaauugaaaacauguaaccacaagaaguugucauuuucaaaaacu

SEQ ID NO: 261016 - RNA, 64 nt, Human
aagaaagcuuuaaaaguuuuauauccagauauacaaccacaauaaagcaaaauaaccuacuauc

SEQ ID NO: 261017 - RNA, 64 nt, Human
acuucagacuucucaguguguugggaaaaccaaaaaccacaacuacagaaauucaucuaaaaau

SEQ ID NO: 261018 - RNA, 64 nt, Human
ugcuuaaucaucuuuaaacacuuuuuaaauuucuaaccacaagaccucucuauaaugguaaaug

SEQ ID NO: 261019 - RNA, 64 nt, Human
cuuuacacaagcuacacauuuuauacuuuucauaaaccacaaagucucucuagaauuuuuucug

SEQ ID NO: 261020 - RNA, 64 nt, Human
cauugcaguucauacuuauugacucagaguuuaaaaccacaaucuguaggcuuuaagaauugcu

SEQ ID NO: 261021 - RNA, 57 nt, Human
cgaaauuuucaaccuuuuaagaacuugaaccacaacaaucacaaacuaaugagaaga

SEQ ID NO: 261022 - RNA, 64 nt, Human
gugacuccccgcacuccccaaaaagaauccgaaaaaccacaaagaaacaccaggcguaccuggu

SEQ ID NO: 261023 - RNA, 64 nt, Human
acccugcucccugaucugucagagcuuaccuuccaaccacaaggcaacuuccuggcuuuuuaca

SEQ ID NO: 261024 - RNA, 64 nt, Human
aagcuggugacuuuauuugcaaagcugugaauaaaaccacaaacucuaaaguagcacaagccuc

SEQ ID NO: 261025 - RNA, 64 nt, Human
auaaaguuccauguguaagcuucucuaaauaggaaaccacaauuugucaaauauguuugccaua

SEQ ID NO: 261026 - RNA, 64 nt, Human
cggggcauagaaugcucguauacaucucuuuaacaaccacaaaccuuaagccauguagaugaag

SEQ ID NO: 261027 - RNA, 64 nt, Human
uggaaaaaugccaucaaaugaauaaugccuuuguaaccacaacuuucacuauaaugugaaaugu

SEQ ID NO: 261028 - RNA, 64 nt, Human
acuaaucaccaugaauauuucucaccauaggaauaaccacaacccaccaaguacccauguuggc

SEQ ID NO: 261029 - RNA, 64 nt, Human
gugagcauguggggggugccuuuccuuuaaccagggaggugaacacuaccugccuccugcgugu

SEQ ID NO: 261030 - RNA, 64 nt, Human
uccauaucaaagacccuaagaaucagguggggaaggaggugaucugccaggugcugcaccuggg

SEQ ID NO: 261031 - RNA, 64 nt, Human
gccucacccggucgggucccggcucuuccuguguggaggugaugguaccugccacaccacagcu

SEQ ID NO: 261032 - RNA, 64 nt, Human
gcuuuaauccauguggauuuuuuuuuucuuagagaaccacaaaacauaaaaggagcaagucgga

SEQ ID NO: 261033 - RNA, 64 nt, Human
guugaauucugaaucaucuugaaaauaagauuccaaccacaaaaaaaauuuagccauuucuuua

SEQ ID NO: 261034 - RNA, 64 nt, Human
gcugccaaagcuaugcacccaguuggccuuagaaaaccacaauguuuacagcccugucuuaggg

SEQ ID NO: 261035 - RNA, 64 nt, Human
gcugggcaauggagucagauucucuuucuuaaaaaaccacaaaaaaacuggauuuccaguucuc

SEQ ID NO: 261036 - RNA, 64 nt, Human
gaggauaccuuuaaggcacucuuggacucucggcaaccacaacauaauaguugaaagaucaaga

SEQ ID NO: 261037 - RNA, 64 nt, Human
aaaauauaaggaaaucuuuauacuauuuuacaguaaccacaaucuaaauauuuacauauaccca

SEQ ID NO: 261038 - RNA, 64 nt, Human
ucucauuuccaagcaaguauuagaauaccacaggaaccacaagacugcacaucaaaauaugccc

SEQ ID NO: 261039 - RNA, 64 nt, Human
agggacacuguguuaucaaccauuaagaagaaagaaccacaagccucccaaguauuuggguucu

SEQ ID NO: 261040 - RNA, 64 nt, Human
cuuugcugagaaguuaggucugugguagaccagaaaccacaaauugacuuuuuuucuuagaaaa

SEQ ID NO: 261041 - RNA, 64 nt, Human
uccuucguauugcuggauucuguuuucuagauuaaaccacaaggaccuuguuagugagguuuac

SEQ ID NO: 261042 - RNA, 64 nt, Human
aaaaaaaaaaaaaaaaaaacaagaugacgacgacaaccacaaaaaaaauugacaucagaugaaa

SEQ ID NO: 261043 - RNA, 64 nt, Human
ugacagcuccucccacccccccaaaaaauaaaaaaaccacaaaaaacaaaaaaacaaaacuaag

SEQ ID NO: 261044 - RNA, 64 nt, Human
auucaguaaaagccugcucaauuuggagaaauagaaccacaaacacagaucacaggggccuuac

SEQ ID NO: 261045 - RNA, 64 nt, Human
ucugauaacauaauuaacauuucucaauaauuucaaccacaaucauuaauaaaaauaggaauua

SEQ ID NO: 261046 - RNA, 64 nt, Human
uggaggaguuauaaaaagaaaugucacagaagaaaaccacaaacuuguuuuacuggacuuguga

SEQ ID NO: 261047 - RNA, 64 nt, Human
uuuguugugugcaguuugauggcagcugcaaacuggaggugaggcggaggaaaggcagguagga

SEQ ID NO: 261048 - RNA, 64 nt, Human
auguguagaaaauauguaaugcagggcuuguccuggaggugauguuagguaauggugaggugga

SEQ ID NO: 261049 - RNA, 64 nt, Human
cuggggcuggcugcagacggugugguugggggugggaggugagcuagacccaacccuuagcuuu

SEQ ID NO: 261050 - RNA, 64 nt, Human
acugugguuuccccaagcugcacaggaggccagaaaccacaaguaugaugacuaggaagccuac

SEQ ID NO: 261051 - RNA, 64 nt, Human
cgccaccucaagugaacugcaggaauccuccaacaaccacaaacacaugcuucgcuguuagugu

SEQ ID NO: 261052 - RNA, 64 nt, Human
uagcgcccccacccccacgcccagucacggugacaaccacaaacccuaucagaucuauucaccu

SEQ ID NO: 261053 - RNA, 64 nt, Human
aacagaugcccccgugaaugcuuaccugugagauaaccacaaccaggaagaacaaaucugggca

SEQ ID NO: 261054 - RNA, 64 nt, Human
ucauauauaauuaaacagcuuuuuaaagaaacauaaccacaaaccuuuucaaauaauaauaaua

SEQ ID NO: 261055 - RNA, 64 nt, Human
acugccaaaacuccagaggcaaaguggaccuggcaaccacaagacccuccccauaagcagggga

SEQ ID NO: 261056 - RNA, 64 nt, Human
cauguaauaagauaaacaucauacauuauaagguaaccacaauuacaaaauggcaaaacauuuu

SEQ ID NO: 261057 - RNA, 64 nt, Human
acaaucaggacaaccaaagucaaggacccagaugaaccacaaggcagcuagucagcuacuuaga

SEQ ID NO: 261058 - RNA, 64 nt, Human
auaagcaaauauugucuucaaaagaaugcacaagaaccacaauuaagaugucauauuauuuuga

SEQ ID NO: 261059 - RNA, 64 nt, Human
uuaagcauuucauauuuuaauuuaaauuggauucaaccacaauaaagaaaaugagaaaagcuuu

SEQ ID NO: 261060 - RNA, 64 nt, Human
cuuuuaauaucacuaauuucuucuuuagaugccaaaccacaagacucuuuggguccauucagau

SEQ ID NO: 261061 - RNA, 64 nt, Human
cuugaagugcgauagugacauuauggaagagucaaaccacaaccauucuuucuugucauaguuc

SEQ ID NO: 261062 - RNA, 64 nt, Human
uguuaggcaucuccuguauguaagacacaaggccaaccacaacacagaacgauguugaccuguu

SEQ ID NO: 261063 - RNA, 64 nt, Human
uaguccaaauggaaccccuugaaggauaaugagaaaccacaaggccugccucugacuggggcug

SEQ ID NO: 261064 - RNA, 64 nt, Human
accacgguccccaccacgacacaaucacguucacaaccacaaccacgcagccacagcuauaacc

SEQ ID NO: 261065 - RNA, 64 nt, Human
guuuaaucugaccaagaaauuggaauugaaaacaggaggugacuagggagggauuaggaaauua

SEQ ID NO: 261066 - RNA, 64 nt, Human
auggcacagaucugcugcuucuaacagauggccaggaggugacaccgauuucagccauugccaa

SEQ ID NO: 261067 - RNA, 64 nt, Human
cccugagcuuuguccugaaggaaaaugacucuggggaggugaacgugaguacauaguucuuagu

SEQ ID NO: 261068 - RNA, 64 nt, Human
ccuugaugucugugaucaaaccaugacaggaugcaaccacaacacacggcuaugaucaugacaa

SEQ ID NO: 261069 - RNA, 64 nt, Human
cacaagaauccauucucacagaaacugcauguggaaccacaagcagccuucagcccaagagaag

SEQ ID NO: 261070 - RNA, 64 nt, Human
ucuguugaagcaagcaagcaaacaaauccauaacaaccacaacaagcaacaagaacaagaacaa

SEQ ID NO: 261071 - RNA, 64 nt, Human
auuugcaacucugcccaacaaaaacaagcaagcaaaccacaaugguaaagugguuaauucagga

SEQ ID NO: 261072 - RNA, 64 nt, Human
agccuaaaggacagucaaagaagcagcccaguggaaccacaaaaaggccaauuucagaugguag

SEQ ID NO: 261073 - RNA, 64 nt, Human
gccuguggcauucauauuucauauucauauuucaaaccacaauauccagcaaaaugucuccuga

SEQ ID NO: 261074 - RNA, 64 nt, Human
aacaauaaaaucuaaauaaauuggaaggaauaacaaccacaaaggaaagaauagaguuggucug

SEQ ID NO: 261075 - RNA, 64 nt, Human
cccugugagccugagacagagagggccaggcaccaaccacaaggcgggaaaguccauggguaga

SEQ ID NO: 261076 - RNA, 64 nt, Human
auguucugugggggucaucagggaggguuaggaaaaccacaaacggagccccugaaagccucac

SEQ ID NO: 261077 - RNA, 64 nt, Human
caggagccuucauuaaaacagaaauuuuagggaaaaccacaaaaaccuucguaaagugaauugc

SEQ ID NO: 261078 - RNA, 64 nt, Human
acaccacucggcuccauggggagguuuagaaccaaaccacaaguccccucaaggacaaccacua

SEQ ID NO: 261079 - RNA, 64 nt, Human
accauauacuuuuguauuuaauagauuacuuagaaaccacaaaaauaggaauccuuaccccuuc

SEQ ID NO: 261080 - RNA, 64 nt, Human
cuugaacaacuuugcaggaauaaagcaacccccuaaccacaaaauaucccucuaaauuaguucc

SEQ ID NO: 261081 - RNA, 64 nt, Human
uccggagcagcucagucagcccucggggacgagaaaccacaagcgcagagacgcugaggcccag

SEQ ID NO: 261082 - RNA, 64 nt, Human
caaaaauaaugcauccagcaguacaauaaaaguaaaccacaaaaaaauaccucaggaaagaaua

SEQ ID NO: 261083 - RNA, 64 nt, Human
uucccuaucagcacagggaucucagcucuggccuggaggugaagagaccugccuuguagguggc

SEQ ID NO: 261084 - RNA, 64 nt, Human
ggcccaggguggcugcugcuuccugcuaagugggggaggugagacagaucuggaaagccgucuc

SEQ ID NO: 261085 - RNA, 64 nt, Human
gcccuucuuuacuccacagggagaaaaaaccaaaggaggugaugggaggcuuuucaagacgcug

SEQ ID NO: 261086 - RNA, 64 nt, Human
gaaauagaaaacacaauccuaaaauuuauaugggaaccacaaaagacuuagaauagucagcuau

SEQ ID NO: 261087 - RNA, 64 nt, Human
uugguugaaaucauaauuaaugcguuacuguaugaaccacaaaacagcacuauuuauuuagccu

SEQ ID NO: 261088 - RNA, 64 nt, Human
guugagguccguggauggcagauuuaaagggaagaaccacaaaggcuugcaaagauaggagagg

SEQ ID NO: 261089 - RNA, 64 nt, Human
cccuccuugcuguccauauggguucaaugugaguaaccacaauuguagaguguggccaucuucu

SEQ ID NO: 261090 - RNA, 64 nt, Human
gcuaguaaggcucaaagaagaagaaaaacaccaaaaccacaagggaaaagaaaaacccaguuuc

SEQ ID NO: 261091 - RNA, 64 nt, Human
gcucuguccaaaugaaaaagguauuucuaacaacaaccacaauaacaauaacaacuuagugcuu

SEQ ID NO: 261092 - RNA, 64 nt, Human
cucccagccuccuccuccggcaggaacugaacagaaccacaaaaagucuacauuuauuuaauau

SEQ ID NO: 261093 - RNA, 64 nt, Human
cuuccucaugauuuccaaccuuaauacuauuaguaaccacaaguucaagggucaaagggacccu

SEQ ID NO: 261094 - RNA, 62 nt, Human
aagaagauaaaauaaauuauauacccgagccauuaaccacaauuuagugaucacuagugguu

SEQ ID NO: 261095 - RNA, 64 nt, Human
uaauacuaauggaauguuucaaagguuuuauucaaaccacaaauuauagaauccacccaagaaa

SEQ ID NO: 261096 - RNA, 64 nt, Human
cugugcugggggcuggguuaacguuuucucagggaaccacaaugcacgaaagaggaacuggggu

SEQ ID NO: 261097 - RNA, 64 nt, Human
aaggacuugcccgcauggagcuauuuuuauuucuaaccacaauuuuacagaacuuuaaccugaa

SEQ ID NO: 261098 - RNA, 64 nt, Human
gacaacuccccaugauccugucacacagcauuauaaccacaaauccaaaccuuagccugcugcu

SEQ ID NO: 261099 - RNA, 64 nt, Human
cuuucagcucuggccaagagugggacaggguuuuaaccacaaauaggagcagcaugcaauuccu

SEQ ID NO: 261100 - RNA, 64 nt, Human
acaugcacugacccuuccagacauacgaaacacaaaccacaacugacacaggaaaccaacaccc

SEQ ID NO: 261101 - RNA, 64 nt, Human
uucauguuuaugaguauuagccuuuuaaguuaugggaggugauauacuuaguccauugauguug

SEQ ID NO: 261102 - RNA, 64 nt, Human
caguguuauuaaugacaaaggcacugaggcccagggaggugacccgaauuauaaaggccagcgc

SEQ ID NO: 261103 - RNA, 64 nt, Human
ccccgccucggcucgggguuuuacugcagcagccggaggugacagcgacgccucagccgccucu

SEQ ID NO: 261104 - RNA, 64 nt, Human
ugggacagggugaauaaagcagggaauauuuuagaaccacaagagaucagcaguggcaggaccc

SEQ ID NO: 261105 - RNA, 63 nt, Human
gcaaaccacauaaucucucuagguccauuuuccuaaccacaagauaaagauguuacauuguca

SEQ ID NO: 261106 - RNA, 64 nt, Human
gcuuccucuccugucaauuccaggcucuuuccauaaccacaagccugaggcugcagccuuuuau

SEQ ID NO: 261107 - RNA, 64 nt, Human
cuaacuuugucgcuaguccuaaggagaaaccuuuaaccacaaaguuuuuaucauugaagacaau

SEQ ID NO: 261108 - RNA, 64 nt, Human
gaguccacgcccaccagccuugcucucuucaauaaaccacaagcaucucacuuuugugcccccu

SEQ ID NO: 261109 - RNA, 64 nt, Human
gggucuggugggggacacccaagaauaaaagaauaaccacaaagugugcaagggaccaacagcu

SEQ ID NO: 261110 - RNA, 64 nt, Human
cccugccuccaucuuuccaagcaccggggcgaaaaaccacaaaggaaaggaagaaaauuuauau

SEQ ID NO: 261111 - RNA, 64 nt, Human
aagaguaaggggaugauuauuauauugaggcuaaaaccacaaaguggcucaggcuuuaaaaaaa

SEQ ID NO: 261112 - RNA, 64 nt, Human
gccuccauucugacaucugggcuggggccucaggaaccacaagagauagcaauguguuuuaagu

SEQ ID NO: 261113 - RNA, 64 nt, Human
cagguuugaaucagucaccuagggguaagagaaaaaccacaacauaagaccugaaaaacagaag

SEQ ID NO: 261114 - RNA, 56 nt, Human
guaccuucauacccaucugaugggacaaccacaaggucuggaaacuagguuuaaaa

SEQ ID NO: 261115 - RNA, 64 nt, Human
augguuugccuugccuuuccacccccuaauugucaaccacaaaaaugagaaauuccucuucuag

SEQ ID NO: 261116 - RNA, 64 nt, Human
cugaggcaagcaccucuucucuguagcugggaucaaccacaauuaauaggaauccucaacauac

SEQ ID NO: 261117 - RNA, 64 nt, Human
gaagaauuuuccucaagauggacccgguaaauauaaccacaaggaagcgaaacugggugcguuc

SEQ ID NO: 261118 - RNA, 64 nt, Human
aacugcauggagacgcauuucgguugagaauggaaaccacaacuuuuaaccaaacaauuauuua

SEQ ID NO: 261119 - RNA, 64 nt, Human
acuaaugacaaaccucuuuuuaagaugguagaauggaggugauagucacaaaaguaaauguucc

SEQ ID NO: 261120 - RNA, 64 nt, Human
gcccccguagcagguggugugggugcucgggaguggaggugacgucagcagcgcucucugaccg

SEQ ID NO: 261121 - RNA, 64 nt, Human
guagguaucuguguauugcaaucauucucaaccaggaggugauuuugcccccugacuccacccc

SEQ ID NO: 261122 - RNA, 64 nt, Human
ccuuucuuaaagauacuccaagccacaugccacuaaccacaagcaagcuggcugcaagacuaaa

SEQ ID NO: 261123 - RNA, 64 nt, Human
ccaaggcaaacucuaauacccauccauugugcaaaaccacaagcacgcaaguauuaaauaagag

SEQ ID NO: 261124 - RNA, 64 nt, Human
cacuacgggaacaguuugccucccucccagccucaaccacaauucuuccaugcuggggcugaug

SEQ ID NO: 261125 - RNA, 64 nt, Human
uaauugugguuuuugccauugaaaguaauggcaaaaccacaauuacuuuuuuaccaaccuaaua

SEQ ID NO: 261126 - RNA, 64 nt, Human
auauauuuauagauuguguucacagcaaucauuuaaccacaaauaaaauaucccuugaugauac

SEQ ID NO: 261127 - RNA, 64 nt, Human
gcaagcaggaaaaaaaaauugggaccucaguugcaaccacaaggaacugaauucugccaaaaau

SEQ ID NO: 261128 - RNA, 64 nt, Human
gcuaagauucaucagagcccacccuauucuaaggaaccacaauaacuuacucuggccccagugu

SEQ ID NO: 261129 - RNA, 64 nt, Human
gacuguuccaccguugugcauauuguugcuucugaaccacaaacuguauaaauggaugguuuuu

SEQ ID NO: 261130 - RNA, 64 nt, Human
gaaagaauguguuaccaaugugagagugaagaugaaccacaagcagauggaaguggucugacca

SEQ ID NO: 261131 - RNA, 64 nt, Human
ugaaccaggcuguccaggaauggcagcuguauccaaccacaaacaacaaaggcuacccuuugac

SEQ ID NO: 261132 - RNA, 64 nt, Human
aaaacuggagucgagaccuagguuagauuccugcaaccacaaacauccaucagggauggccagc

SEQ ID NO: 261133 - RNA, 64 nt, Human
gcaaaaugucuccugaaauaagggaaaaaaaaaaaaccacaacuuugaaaaucuuaauguugaa

SEQ ID NO: 261134 - RNA, 64 nt, Human
cagaacaggacuccacacagcguuugccaccagaaaccacaagcaaaaucuggaucuugggacc

SEQ ID NO: 261135 - RNA, 64 nt, Human
ggggaacaaaaaaaaaaauaucugaauuuugaaaaaccacaaagcuacaaacugacccucuuuu

SEQ ID NO: 261136 - RNA, 64 nt, Human
uguggcagggggcacugagccuccagacccugcuaaccacaaaagggaacaucccagcaggcug

SEQ ID NO: 261137 - RNA, 64 nt, Human
agccugcacggggcgccccgccaaggaggcaccuggaggugaaacccagcuccagcucccguua

SEQ ID NO: 261138 - RNA, 64 nt, Human
uauuucauagauaauuuugaguuuuaaaguccauggaggugauugguucucuuuacacauuaac

SEQ ID NO: 261139 - RNA, 64 nt, Human
agugcuacagauguacauuaaauaccagccagcaggaggugaucauaggggcauagccaguucu

SEQ ID NO: 261140 - RNA, 64 nt, Human
cuccucucuucuuaguaacuucuuucuguggcaaaaccacaauucuuuaagauuccuauuguuc

SEQ ID NO: 261141 - RNA, 64 nt, Human
caugccuucucagaaauuaaaucuuuugacuuugaaccacaaguuagcauuuauuuguugaaga

SEQ ID NO: 261142 - RNA, 64 nt, Human
caacaggccacucacucuuaagggugagaagaauaaccacaauuguaugugccuguuuuuuacu

SEQ ID NO: 261143 - RNA, 64 nt, Human
aagaauauaggauguuuacagugaauaauuuuaaaaccacaaacauagcagaaauguacuuuau

SEQ ID NO: 261144 - RNA, 64 nt, Human
aggucgcuggaugcugaucuaaucaguagcuugaaaccacaauuuuaaaaaugugacuuucuug

SEQ ID NO: 261145 - RNA, 64 nt, Human
uaauuauauuuacuuuuuggaaugguguaagccuaaccacaaguaaaagaucuuugccuaaguu

SEQ ID NO: 261146 - RNA, 64 nt, Human
guguaaaaacaacaaaaacaaacaaaagcaagaaaaccacaacuaaaacuggaaauguauauuu

SEQ ID NO: 261147 - RNA, 64 nt, Human
gugaaacuccauuuacagcaaccccauaguauaaaaccacaaugccucauuguaaugggauauu

SEQ ID NO: 261148 - RNA, 64 nt, Human
uugucauuugggcuuucuguugaaugaaucaacaaaccacaauacuuccugggaccuuuuguac

SEQ ID NO: 261149 - RNA, 64 nt, Human
cauuugaggauacagugagaagccuucaucuaugaaccacaaaguagcccucaucagacacuga

SEQ ID NO: 261150 - RNA, 64 nt, Human
aacuugcccugggggccuuuuuuuaaaaaacaaaaaccacaaaaauucccaaaccauacuugcu

SEQ ID NO: 261151 - RNA, 64 nt, Human
aaaccagacaguaggggaguucaacucgugauggaaccacaaaaggucacacaagccaaccaug

SEQ ID NO: 261152 - RNA, 64 nt, Human
gugucucuucuuauucaacauuaauccuuacuagaaccacaagaaagugaaugaaaucuuuagu

SEQ ID NO: 261153 - RNA, 64 nt, Human
acaaccuggccgcguuuagaccaaggaacaaaaaaaccacaaaggccaaacugcuggacgucuu

SEQ ID NO: 261154 - RNA, 64 nt, Human
gccuacugugacuucaugcccuuuugggauaagaaaccacaaaacgcauggaacaacuauccau

SEQ ID NO: 261155 - RNA, 64 nt, Human
caucagaccucuuccauuuugcacagggagugcaggaggugaauguucacuuucuguucuccag

SEQ ID NO: 261156 - RNA, 64 nt, Human
uggugaggauuggggcuucuagauugucuaggcaggaggugaaacuuaggccagagucagauuu

SEQ ID NO: 261157 - RNA, 64 nt, Human
gugggaggggucggggccccuggaggggcaauggggaggugaugucuucucucugcucagagag

SEQ ID NO: 261158 - RNA, 64 nt, Human
cuugcuuuuaggcaaaacaaaccaauuaacaaacaaccacaagaaagggagaagaggugccugu

SEQ ID NO: 261159 - RNA, 64 nt, Human
ugugaugaacuacauuuauccccuuuccugccccaaccacaaacucuuuccuucaaagagggcc

SEQ ID NO: 261160 - RNA, 56 nt, Human
gcacuuguaccaaagcaugaaggaagaaccacaaacuaaaaccucgguggaaaagc

SEQ ID NO: 261161 - RNA, 64 nt, Human
uaauccuuuugguagaaaucagguuacaaagcaaaaccacaauaucagcaacacuuccuaauca

SEQ ID NO: 261162 - RNA, 64 nt, Human
cuaacuaccauaaugaaugcugcauauuaagagaaaccacaagaagguuauauguuugguuguc

SEQ ID NO: 261163 - RNA, 64 nt, Human
aacuggaaucauuacuuaauuuuaacuaaccaacaaccacaaaagcagcagcuacugcuaaaua

SEQ ID NO: 261164 - RNA, 64 nt, Human
ugccucccagacgcggcgggagccaagcuccuccaaccacaagggggguggggggcggugaauc

SEQ ID NO: 261165 - RNA, 64 nt, Human
uauaaaacaaacauaguaucugucaaucucuagaaaccacaagaugauggagaggucauaaaaa

SEQ ID NO: 261166 - RNA, 64 nt, Human
acacaugcuuuaaaauauguauucaaauguuauuaaccacaaugacgaccugcuuugauuuaac

SEQ ID NO: 261167 - RNA, 64 nt, Human
auaaucucaaaaagauguacaaguuauaccuguaaaccacaaaagugaagccugaggcuucugu

SEQ ID NO: 261168 - RNA, 64 nt, Human
uguucagauguuucaaugccucaugauacaauaaaaccacaaaaauuuucuuaacaguuuaaau

SEQ ID NO: 261169 - RNA, 64 nt, Human
ccugccgagaugucggugauggccuggaugcuguaaccacaaccuguggcuaaaaauuuuauuu

SEQ ID NO: 261170 - RNA, 64 nt, Human
ggguagaaaaaagggacauuaaaauuaaaagcaaaaccacaagaagggaaagaccgcaacucgg

SEQ ID NO: 261171 - RNA, 64 nt, Human
acacuucuuccccaucaagcccauuuccuuccccaaccacaaagguguuugugauuccucaccc

SEQ ID NO: 261172 - RNA, 64 nt, Human
agaucugggcuccaagccaggaaaggugaacagaaaccacaaguguccagcccucggugcugga

SEQ ID NO: 261173 - RNA, 64 nt, Human
gaggaagcaucccuugugcaagaucacauagucaggaggugacacagggcuaagacuugaacca

SEQ ID NO: 261174 - RNA, 64 nt, Human
augugccccaucucauucuauacucacaucccauggaggugaggauuuucacuucuuuucucua

SEQ ID NO: 261175 - RNA, 64 nt, Human
uccauugggcauaggggaguuggcuuuugccccaggaggugagguuaaggaguugggggccugg

SEQ ID NO: 261176 - RNA, 64 nt, Human
ggaauguuuggagaauguuaauuuccaaaucaggaaccacaaacugcccucuaauaagacaucg

SEQ ID NO: 261177 - RNA, 64 nt, Human
ugguauaguaucuacagaguguauaauuuaaacuaaccacaaagcuuuacaucuucauuuugac

SEQ ID NO: 261178 - RNA, 64 nt, Human
ucuccaggugggcauaaggaguaacagauggcaaaaccacaaacuauuuugauggacugugcug

SEQ ID NO: 261179 - RNA, 64 nt, Human
auccgaaucagggcuucuaccacugcugaugcaaaaccacaaagggaccuaccugagccaccgu

SEQ ID NO: 261180 - RNA, 64 nt, Human
uucuggccuguuaugauucugaacauuugacuugaaccacaagugaaucuuucuccuggugacu

SEQ ID NO: 261181 - RNA, 64 nt, Human
guucauuuauugaugcauugguuggacacaauaaaaccacaauuguuaucaaaaaguuucccuc

SEQ ID NO: 261182 - RNA, 64 nt, Human
uuagaggacuucauacaaagcugggcauuaagaaaaccacaaugcauggccgggcgugguggcu

SEQ ID NO: 261183 - RNA, 64 nt, Human
agggcguguaugagcaguuuugcaaacagaacacaaccacaaugaugguauuuugaaaaguguu

SEQ ID NO: 261184 - RNA, 64 nt, Human
cugggaagaggaauauuaagacaucuuaacaacaaaccacaacauugccugcaugucuaaaaga

SEQ ID NO: 261185 - RNA, 64 nt, Human
acacaaauuauauaucuaucuaucuauacagcggaaccacaagagagacugaggaaggccugga

SEQ ID NO: 261186 - RNA, 64 nt, Human
auuuccuaauuuguugauggccuuuuguguugugaaccacaacaaagagaggccucuuuugugg

SEQ ID NO: 261187 - RNA, 64 nt, Human
cauccuuucuucucagucccuaccuacuguuuguaaccacaagugucucugugugugggugggu

SEQ ID NO: 261188 - RNA, 64 nt, Human
gcguucuaucuucucucuccuccuuguuccugcaaaccacaagauaaagguaguggugugucuc

SEQ ID NO: 261189 - RNA, 64 nt, Human
gcuguugcugagaccccccccccaagucaaucagaaccacaacagguuggucaucaggauggcc

SEQ ID NO: 261190 - RNA, 64 nt, Human
uuuuuacccuccugugacagcuguuacaaccuguaaccacaaucccucaccucucagagggaac

SEQ ID NO: 261191 - RNA, 64 nt, Human
ugccuuggaagaccuaaaucucccauccaguucaggaggugacaacauccuuauuuuaaacuuc

SEQ ID NO: 261192 - RNA, 64 nt, Human
uuucuuuuuaguaaugggaaaaugcaauuaauauggaggugauagucacuaagaacuguugaau

SEQ ID NO: 261193 - RNA, 64 nt, Human
gcaggccagaagacuuccagggaaacucauucaaggaggugaaaaugauggaugacuccuccaa

SEQ ID NO: 261194 - RNA, 64 nt, Human
guucugugcugucucauugaaaaccgagccagucaaccacaaggcuggcagggugugauccuug

SEQ ID NO: 261195 - RNA, 64 nt, Human
ccggaggagccagcuguccuggugggacgauagcaaccacaaguggauucuccuucaauuccuc

SEQ ID NO: 261196 - RNA, 64 nt, Human
aacaguaaagacuuuauuuauggauuguaauaacaaccacaagaaaagccauacaucuuaauga

SEQ ID NO: 261197 - RNA, 64 nt, Human
cuaugacccagccgagcuguuuaacaaauaaacuaaccacaaaagacugaguugcaagagucuc

SEQ ID NO: 261198 - RNA, 64 nt, Human
cauuuuauauuaaauuucuguguauauaauguaaaaccacaauuuuugaauaaaauuuaguucc

SEQ ID NO: 261199 - RNA, 64 nt, Human
gaauagaauacaauaaaacaaaacaaugacacaaaaccacaaucaucaucauaaucguauccaa

SEQ ID NO: 261200 - RNA, 64 nt, Human
cuuaacauguaguucuuugggugcauuuugucugaaccacaauugugaaggcagcucagcuuag

SEQ ID NO: 261201 - RNA, 64 nt, Human
ucgacauauauuaggugcguguacuguuucuaaaaaccacaaacuaagaaugauaaauuaucaa

SEQ ID NO: 261202 - RNA, 64 nt, Human
ccccgccggcggcagcggcuuuggacgagggcagaaccacaacgugcaaggguuccaccccuac

SEQ ID NO: 261203 - RNA, 64 nt, Human
ucagcacucacuccccacucccccagccccuggcaaccacaaaucuuuccaacucuacggauuu

SEQ ID NO: 261204 - RNA, 64 nt, Human
ccuaggcaacacagugaggccuuaucucaacaacaaccacaaaaucuaaaaauuagcugggugu

SEQ ID NO: 261205 - RNA, 64 nt, Human
gagugugagagugugagcagggcuugcuccugccaaccacaauucaaugaauccccgacccccc

SEQ ID NO: 261206 - RNA, 64 nt, Human
caaugucauugcuccucaaggaacuguagaguaaaaccacaaugugcugucacucuagacaguc

SEQ ID NO: 261207 - RNA, 64 nt, Human
uccacauaggagagaaacuuugcugaugacuuuuaaccacaaguaaaaaaugugguaaguccac

SEQ ID NO: 261208 - RNA, 64 nt, Human
ccagcgcgaggaggaagaaacagcaguuccugggaaccacaauuauggggggugggggguguga

SEQ ID NO: 261209 - RNA, 64 nt, Human
gcauuucacccaggaauauugagaaugagggccuggaggugaaaugugcaaaacccaccccuca

SEQ ID NO: 261210 - RNA, 64 nt, Human
gucugucuggcaugcaugcacucacuuuggggcuggaggugacaguaggugagggcagaggagg

SEQ ID NO: 261211 - RNA, 64 nt, Human
caaaagccaaagaauuagcauacacugugugccaggaggugaagaaauugguggguuuucuaua

SEQ ID NO: 261212 - RNA, 64 nt, Human
uggaugucaacaaaccucaccacuggauccugacaaccacaaugccuggauccuggggccccca

SEQ ID NO: 261213 - RNA, 64 nt, Human
aucccuuacuucagcaacucaagucugcuacccuaaccacaagauucaagauuauccacacccc

SEQ ID NO: 261214 - RNA, 64 nt, Human
uguuuuccucuuggacauuguuguauuucaaauaaaccacaaaucaucauuuuccaccgagcca

SEQ ID NO: 261215 - RNA, 64 nt, Human
cugauuuugucugcccaauccauccugcucaggaaaccacaaccuugcaguauuuuuaaauaug

SEQ ID NO: 261216 - RNA, 64 nt, Human
acccagggcggaaaaccgcuuaaagggguuccugaaccacaaaccauagcauaagugaucugug

SEQ ID NO: 261217 - RNA, 64 nt, Human
uuggagacagaacaacagagucucagggaaagagaaccacaauagaaaaaggcagaaaaggccg

SEQ ID NO: 261218 - RNA, 64 nt, Human
gaaaaagcaaaacaaaacaaacaaacaagcaaaaaaccacaauuagacugacagcugacuuuuu

SEQ ID NO: 261219 - RNA, 64 nt, Human
agugauuucaauugcaccaugacuucuucacuaaaaccacaaaguccugcuuaaaacuauggaa

SEQ ID NO: 261220 - RNA, 64 nt, Human
cccucucucccuguccucagacccuggaaaagugaaccacaagacucccuccagugaggagcug

SEQ ID NO: 261221 - RNA, 64 nt, Human
cgcaccgugcccagguacacuuucaagacacuguaaccacaagauguuauuuauugagcuggcg

SEQ ID NO: 261222 - RNA, 64 nt, Human
uucuacaucauuaaccaguaaggacuuuuuaauuaaccacaauaccacuaucacaccuaauaau

SEQ ID NO: 261223 - RNA, 64 nt, Human
auauucucagaucagccaucuugaaccaaagcaaaaccacaaguuacacuuucuuaaaauuuga

SEQ ID NO: 261224 - RNA, 64 nt, Human
aaaaaauaugaacagacucagcuuugggacguccaaccacaaaagaaauuauauauaaauauau

SEQ ID NO: 261225 - RNA, 64 nt, Human
acagagggauggaggaagaacugaaaggcuuuucaaccacaaaacucaucuggaguucucaaag

SEQ ID NO: 261226 - RNA, 64 nt, Human
uugcaaugcuuuuauauggcccagccuuguaaauaaccacaagguccacucccugcuccacgaa

SEQ ID NO: 261227 - RNA, 64 nt, Human
ucuuguacaguuaacucucccagguggauuuuguggaggugagaaaaggggcauugagacuaua

SEQ ID NO: 261228 - RNA, 64 nt, Human
cacgcccuccugggccgucuggccuguggcuaauggaggugacggcacucccaugugcugacuc

SEQ ID NO: 261229 - RNA, 64 nt, Human
gaaccaaccacaagcacacaggaaggaaagcgcaggaggugaaaaugcuuucuuggccagggua

SEQ ID NO: 261230 - RNA, 64 nt, Human
gcaggugguggacaggcgcaucccacucuaugcgaaccacaagacccuccuccagaaggcagcc

SEQ ID NO: 261231 - RNA, 64 nt, Human
gagagcuacacuugagaaggggacuugugaacucaaccacaaucuccucgagacauucauccag

SEQ ID NO: 261232 - RNA, 64 nt, Human
cuuuguccucucguggaaacagcacacagcaagcaaccacaaaaccagagcggaaggagggacu

SEQ ID NO: 261233 - RNA, 64 nt, Human
agugaaaccuuucccuuuucccaucugccggacgaaccacaacagcguuccccaugaucaagca

SEQ ID NO: 261234 - RNA, 64 nt, Human
ggcccuuggguccuugucaaccagaggucuagggaaccacaacccuuauuguccuggguggacc

SEQ ID NO: 261235 - RNA, 64 nt, Human
uuuauucuguaggcuuuuuacucaauuauguacaaaccacaaaucagguacuguauuuuaguga

SEQ ID NO: 261236 - RNA, 64 nt, Human
ucucccaaggacccaccaugcagaagugucaauaaaccacaaguucugaacucugucgcccgag

SEQ ID NO: 261237 - RNA, 64 nt, Human
uugaccugcagaagaagaccugaugugcuaaugaaaccacaacguguaagccugucuuccuuuu

SEQ ID NO: 261238 - RNA, 64 nt, Human
gaauugcugaguuuuguguauccuuuaaauuaaaaaccacaaguguuuauuguagugguuaaac

SEQ ID NO: 261239 - RNA, 64 nt, Human
ucacucuagggcaccugaccuggccucuugccuaaaccacaaggcuaagggcuauagacaaugg

SEQ ID NO: 261240 - RNA, 64 nt, Human
auaauuagggaaaauugauaaauaucugucaccaaaccacaagaaauccaaaaucauuuuaggu

SEQ ID NO: 261241 - RNA, 64 nt, Human
gaagcccacuggcuugacuuguaaguucaaccuaaaccacaauccuagaccaucauggauuuag

SEQ ID NO: 261242 - RNA, 64 nt, Human
aguuuauaaguuugaacuggacuuguucgauuauaaccacaaauugugugugugugugugugug

SEQ ID NO: 261243 - RNA, 64 nt, Human
cauuucugcaagcaauguaugaccccaccugagcaaccacaaauaggcucucugugaaacuaca

SEQ ID NO: 261244 - RNA, 64 nt, Human
aagaaaaauguauauagcugugaguuuaaacaaaaaccacaaacagacaaacaagaaaaaaagc

SEQ ID NO: 261245 - RNA, 64 nt, Human
uggguggguggugugggcuugcaaauacaagcuuggaggugagacauggccagacaugacuccu

SEQ ID NO: 261246 - RNA, 64 nt, Human
cucucugcaucugaccacgugcuacccccaugcuggaggugacaucucuuacgcccaacccuuc

SEQ ID NO: 261247 - RNA, 64 nt, Human
uuacgugauuguaauggaggcuagggguggauugggaggugaguggaggagagucucugaccag

SEQ ID NO: 261248 - RNA, 62 nt, Human
aagaaacaagguuuauauuaaauggaaauccauaaaccacaauuaauccuauuuugucaugu

SEQ ID NO: 261249 - RNA, 64 nt, Human
cucauucaaagaggaauuauucaaaaguaaucaaaaccacaaaugcauuugguuuuugggccag

SEQ ID NO: 261250 - RNA, 64 nt, Human
aauaguaugugcucauuguaguacauuuuuuaaaaaccacaaaugagcaaagauuuuuuuaaaa

SEQ ID NO: 261251 - RNA, 64 nt, Human
gaacacuguaaaaugccagaagcaggugaagagcaaccacaaguuuaaaugaagacaagcugaa

SEQ ID NO: 261252 - RNA, 64 nt, Human
cucgaacuacaggcccuaaagagaaauugccucaaaccacaagugcuguaacuuccuccccuuu

SEQ ID NO: 261253 - RNA, 64 nt, Human
gcaucuuuguugcuuauuacauauuuacacacacaaccacaaauuuuaaacuuaugaugaaaau

SEQ ID NO: 261254 - RNA, 64 nt, Human
acuuuauaaguuugaacuggacuuauuugauuauaaccacaaauugugugugugugugugugug

SEQ ID NO: 261255 - RNA, 64 nt, Human
aauuucugcaagcaauguaugaccccaccugagcaaccacaaauaggcucuccaugaaacugca

SEQ ID NO: 261256 - RNA, 64 nt, Human
uaaaucuuccuuagacauuagugagaaagaaaaagaucgcuauuucagucucucagauaaagau

SEQ ID NO: 261257 - RNA, 64 nt, Human
cauucuccaaugaaauaauagggcauuuaacaaagaucgcuaugugcaauacuguauuuagugu

SEQ ID NO: 261258 - RNA, 64 nt, Human
ggcagaaugcagauuuuuuuaauuuacaaagcgugaucgcuagcaaaagcauuagugcuuuuua

SEQ ID NO: 261259 - RNA, 64 nt, Human
uaaugccacaaaacugacaguaaaucucacaaaugaucgcuaucuagcaacccuaacaguaaga

SEQ ID NO: 261260 - RNA, 64 nt, Human
gugucacucuccaagugccagagaaguggaggcagaucgcuaccccaggcugagauggccccca

SEQ ID NO: 261261 - RNA, 64 nt, Human
gagaaaaccacuuuacauuuguuguuaaacuccugaucgcuacucuuaagaauauacauguaug

SEQ ID NO: 261262 - RNA, 64 nt, Human
gagcaggagcaauuggcugccugcaaagccagcuggaggugaagugcaggaaaggaaaggucac

SEQ ID NO: 261263 - RNA, 64 nt, Human
aaagguucucccucggcgggagggcaucuguguuggaggugauuugucuggguucuuccuuuug

SEQ ID NO: 261264 - RNA, 64 nt, Human
aacaugccguugguuuuauuggcagugggcacaaggaggugagaaguggugguaaaaggagcgg

SEQ ID NO: 261265 - RNA, 64 nt, Human
cagccccagucccuggccacgcccaagggaagagggaggugaggacuugacuuuccucccagag

SEQ ID NO: 261266 - RNA, 64 nt, Human
guuuauccauuuccugaacugugugcacuccuuagaucgcuauugauggcuugaucaucccuca

SEQ ID NO: 261267 - RNA, 64 nt, Human
cauaccacauucacuucugaaacacucuuguugcgaucgcuaaccucacugggacagagaaccg

SEQ ID NO: 261268 - RNA, 64 nt, Human
uacucuucagggucuaaagaucaagugggccuuggaucgcuaagcuggcucuguuugaugcuau

SEQ ID NO: 261269 - RNA, 64 nt, Human
ccuuuuucauuucccaacauuuuuuggcuauuaugaucgcuauguguuccuucaaauaauuucc

SEQ ID NO: 261270 - RNA, 64 nt, Human
gcaguuuauuuaagaacauacugauuaaaugcaggaucgcuacuaaaaauuguuuuguauccuu

SEQ ID NO: 261271 - RNA, 64 nt, Human
acagcugugagagccggauccggaguuaccugagggaggugagcuccuaccccuccacgguggg

SEQ ID NO: 261272 - RNA, 64 nt, Human
gugggcugagguuaaucagggaagguuuccugggggaggugauccuugaacuggcucccgggga

SEQ ID NO: 261273 - RNA, 64 nt, Human
caagcuugcagcugcccugauggugcaggugcagggaggugaccauguaacucugaccaaucug

SEQ ID NO: 261274 - RNA, 64 nt, Human
cucagggcccugggccaucacugcaguggcccugggaggugaggaagaagcuggcuagaggagg

SEQ ID NO: 261275 - RNA, 64 nt, Human
ugggaggcugaggcuggagaaucgcuugaacccaggaggugaagguugcagugaccagagauga

SEQ ID NO: 261276 - RNA, 64 nt, Human
aaggaguccaggcuagagccacagagacuguuguggaggugaguucggcuguaguuagagugau

SEQ ID NO: 261277 - RNA, 64 nt, Human
ucuguuggcuucucagucugcaucuuggaggcagggaggugagggcaggugccccucagacacu

SEQ ID NO: 261278 - RNA, 64 nt, Human
guguuccugauccuaauuccuaucugucuaacguggaggugaucaaguguggcuguaggccuuu

SEQ ID NO: 261279 - RNA, 64 nt, Human
gcccugccuggaccccauggaggccgaauagggaggaggugagaggcuggggugccccaagcuu

SEQ ID NO: 261280 - RNA, 64 nt, Human
uuuuuguuaauuuugcucuauguuugccucugaaggaggugagauuugugcuacuuugggagau

SEQ ID NO: 261281 - RNA, 64 nt, Human
cacuuggucacuccagaguuuuuaauagcucccaggaggugauauuauuuucagugcucagcug

SEQ ID NO: 261282 - RNA, 64 nt, Human
gggccaccuaucccggggguggaugcugaguccaggaggugaugagcaaguguacaaaagaaaa

SEQ ID NO: 261283 - RNA, 64 nt, Human
uuaaaccuccauacucaagcugucucuucggcagggaggugaauacucuugaaaggccaacagc

SEQ ID NO: 261284 - RNA, 64 nt, Human
uuagaguaggagaggacuaauucucagcagcaguggaggugaguucuuucuuuugcggaagcuu

SEQ ID NO: 261285 - RNA, 64 nt, Human
gcuuauuuuguaucuuuucacuuaggaagauuuuggaggugauuuuuuuccauaggaggauacc

SEQ ID NO: 261286 - RNA, 64 nt, Human
auggcagugucuucccucuugccaaaaggccuggggaggugaaggaagagagacuuuaggcaag

SEQ ID NO: 261287 - RNA, 64 nt, Human
acuagauggguauguguguuuauguguuggguagggaggugacgauugccacucauaaaauaaa

SEQ ID NO: 261288 - RNA, 64 nt, Human
cccuuuguuuuggguuaaaugaaguuugccagguggaggugauuagggggaggaugcuaaguga

SEQ ID NO: 261289 - RNA, 64 nt, Human
aacuaaaaaaauuaagaaauucacuuccccucuaggaggugaugauaggguuucuaaugguuau

SEQ ID NO: 261290 - RNA, 64 nt, Human
cagaaaacggaggauggggguggggcgccuuccuggaggugacacuugauggggguguguucug

SEQ ID NO: 261291 - RNA, 64 nt, Human
ggaggucaagggcauggguugggguaguggguggggaggugaauguuuucuagagauucaaacu

SEQ ID NO: 261292 - RNA, 64 nt, Human
aagugccuuuugcugcgcaccaaugcccagcaggggaggugaggggggcuggcggggcgaaguu

SEQ ID NO: 261293 - RNA, 64 nt, Human
uucguuuugucgaugagaaaguugaggccagaggggaggugacauguuuagagucacccagcug

SEQ ID NO: 261294 - RNA, 64 nt, Human
cuccucacauaagcauccauauggcuucgucaagggaggugaacauuguugcugaguuaaauuc

SEQ ID NO: 261295 - RNA, 64 nt, Human
ccaaggacuuuccagugaggaaauggcaacacguggaggugaagucccuguucucagcuccguc

SEQ ID NO: 261296 - RNA, 64 nt, Human
aaacagggaccccauuugucuucccauaucugguggaggugagggggcuccucaaaagggaacu

SEQ ID NO: 261297 - RNA, 64 nt, Human
aaugauuuccuggcuggccaacugguggccagugggaggugaugguggaccuagacugugcuuu

SEQ ID NO: 261298 - RNA, 64 nt, Human
aauacugaaggggaaaaggacaguuugauuggcaggaggugacccagugcaccaucacccugcc

SEQ ID NO: 261299 - RNA, 64 nt, Human
ucaccaaugaagcgggugagggaagaugagagggggaggugagagcuucugggaaggggcauuu

SEQ ID NO: 261300 - RNA, 64 nt, Human
uccugagacacaugggugcuauugggguugggggggaggugagguaccagccuuggauacucca

SEQ ID NO: 261301 - RNA, 64 nt, Human
uucacugcuccccucgcuccucuuaacagcuuggggaggugaccagugguucaggagggacuag

SEQ ID NO: 261302 - RNA, 64 nt, Human
cguuuuguuguuauucacauuuuauuguaacuuaggaggugaacgaccuaagauuacguuauug

SEQ ID NO: 261303 - RNA, 63 nt, Human
ucuucucagauaaaaguuagagccgcauguccuggaggugacugcagguuguuggauuuggag

SEQ ID NO: 261304 - RNA, 64 nt, Human
aaggagauggcagacccugggcuaggaaccauauggaggugacuuugaggccacagcugucccu

SEQ ID NO: 261305 - RNA, 64 nt, Human
ggacucaagugcaguccacggugugaaacaugagggaggugagguguccguccacuucccccau

SEQ ID NO: 261306 - RNA, 64 nt, Human
cucucugagccucgguuacccugucuguaaaaagggaggugagaauaccuaccucacggaacug

SEQ ID NO: 261307 - RNA, 64 nt, Human
guucggggacagccaccgccuugagucuggccaaggaggugauuaaacagcucagcuucucuca

SEQ ID NO: 261308 - RNA, 64 nt, Human
uuuauugugaucacuaaaaugaggccaagguuuaggaggugagaaaaaguaucccuuuuacgga

SEQ ID NO: 261309 - RNA, 64 nt, Human
cacuugacaucagggacccugaacccuuccccugggaggugagggccugaucaaggcaccuccu

SEQ ID NO: 261310 - RNA, 64 nt, Human
uguauuaugucaggcaauaauccuacuaaaagguggaggugaccgcugucaauaaaaagccgga

SEQ ID NO: 261311 - RNA, 64 nt, Human
uccccugcucccagcccagagcagccaucaggcuggaggugacgaugaguuccugaaacuugga

SEQ ID NO: 261312 - RNA, 64 nt, Human
augugaggagaucugcuuucagcccucaccuaagggaggugaggaagaggaaaagcccucuugu

SEQ ID NO: 261313 - RNA, 64 nt, Human
ggggccuggccucccugcccugauuggggacucaggaggugaggccuggggggcuuccugcccc

SEQ ID NO: 261314 - RNA, 64 nt, Human
aauaggucagauaaguaugggaugauaguugaagggaggugaagaggcugcuucucuacagagg

SEQ ID NO: 261315 - RNA, 64 nt, Human
acucccuuuugcaaaaaagaaaccugggugucagggaggugaagugacuugcccuaggagcaga

SEQ ID NO: 261316 - RNA, 64 nt, Human
gagaccccuuguugcacugcccccugcuuggccaggaggugagagaaggauggguccccuccgc

SEQ ID NO: 261317 - RNA, 64 nt, Human
aguugaucccuccacuguccaggcugucucaggaggaggugaaucagagcuagucugucaccuu

SEQ ID NO: 261318 - RNA, 64 nt, Human
caacaacaaccagcuccaacugacucuggucuugggaggugaggcuucccaaccacggaagacu

SEQ ID NO: 261319 - RNA, 64 nt, Human
guuuuagcugaaaugaggagucacaauuaaggauggaggugauauuuuccucaauggcaaauuu

SEQ ID NO: 261320 - RNA, 64 nt, Human
acaauguaaaaaccagccaagcaaggccauaaagggaggugacuuaaaaaagaaaauggauuag

SEQ ID NO: 261321 - RNA, 64 nt, Human
uuaauagcauugcuuccccuucaguuucuauuuaggaggugaagaaucuuuuaauaagguagaa

SEQ ID NO: 261322 - RNA, 64 nt, Human
ugaacccugccccuuucuauccaugcuguguccaggaggugaccuugagauccugauaccaccu

SEQ ID NO: 261323 - RNA, 64 nt, Human
ucugucaguaacgaggcuuuugauguguugagcuggaggugaguggaccgggggcuguguuuua

SEQ ID NO: 261324 - RNA, 64 nt, Human
acaggcugauuaucuggguaaucuuuuacgggugggaggugagauugauagugcaauaaucagu

SEQ ID NO: 261325 - RNA, 64 nt, Human
cagcugcuucauccacagaaggcgcuaagaacggggaggugaggaauaagauccuuaaaauaaa

SEQ ID NO: 261326 - RNA, 64 nt, Human
accaagacuucaucccccccaaaaaaaaaagauuggaggugauuuacagugaaagacacaaaua

SEQ ID NO: 261327 - RNA, 64 nt, Human
gagaggaccaacucuuuaauuuuuaguaaaaccuggaggugaugggccgggcgcaguggcucac

SEQ ID NO: 261328 - RNA, 64 nt, Human
uacaucuaguuauuggucuggaaauuggagaaauggaggugagcaaauuaacgguagugugacu

SEQ ID NO: 261329 - RNA, 64 nt, Human
gaugaacuuugccauauggguagagguuacagagggaggugauauuuucagcuaaaaaaaaaaa

SEQ ID NO: 261330 - RNA, 64 nt, Human
cuaugccuggcuuaggggcaaccucguacugagaggaggugauaccggguccuagguagguagg

SEQ ID NO: 261331 - RNA, 64 nt, Human
cccucccgggucaugacagagcucuuuuggggcaggaggugagggcagggggccccgcuccuug

SEQ ID NO: 261332 - RNA, 64 nt, Human
ucuguagaggcuucugggaaaugagcugucugcaggaggugaagcaguguuuuccuuggaaugu

SEQ ID NO: 261333 - RNA, 64 nt, Human
gggccagcucuuaaaauaagaaagcugagacugaggaggugaaacugaaaauaaaaagagaaag

SEQ ID NO: 261334 - RNA, 64 nt, Human
aagcauccagaggcccugagcagcuuucagcacuggaggugaagagagcguguuuuuaaaauac

SEQ ID NO: 261335 - RNA, 64 nt, Human
uucagaguuguugacucauaguacaguaaaggguggaggugauauggcauucugaaaguaggga

SEQ ID NO: 261336 - RNA, 64 nt, Human
uacacagauggagggcaugggauaggacaggagaggaggugauguacacuuagagguaacuaag

SEQ ID NO: 261337 - RNA, 64 nt, Human
cuugccauuuaggaggauaauuuugugguaguguggaggugaaauaaagagaaaagggaaccuu

SEQ ID NO: 261338 - RNA, 64 nt, Human
gguaucaugcugucuguacaguuccauacaacaaggaggugaaaucagagauaccagcuccucu

SEQ ID NO: 261339 - RNA, 64 nt, Human
ggcuguccuauagcugagaugcgugggucgcaggggaggugauuucuaggcauauugcuguccc

SEQ ID NO: 261340 - RNA, 64 nt, Human
ugaggaggggucucuccaggcauuguuccagcacggaggugaugugucacgggcccugacugag

SEQ ID NO: 261341 - RNA, 64 nt, Human
aggccucuaaggcuucucucccuggagugaggguggaggugagggagagcuggcacaagcccuc

SEQ ID NO: 261342 - RNA, 64 nt, Human
gcugcugagcuaaaggaccagggacguggaaacaggaggugaacuaaggcaccccgccacccac

SEQ ID NO: 261343 - RNA, 64 nt, Human
gcgcaucucuacauguauuccuagaguccagaggggaggugagguuaaaaccugaguaauggaa

SEQ ID NO: 261344 - RNA, 64 nt, Human
guccagaagccagaucagcaaauggaggaaccucggaggugaccagaaagaucuccaucgguug

SEQ ID NO: 261345 - RNA, 64 nt, Human
ucucagcuuucugaguacgucucuuggggucgcuggaggugauccuaggaucugucucugagac

SEQ ID NO: 261346 - RNA, 64 nt, Human
gggcaggggagauguggggaaguccaggacuccaggaggugaaaaggaaaaaaaaaaaaaaaug

SEQ ID NO: 261347 - RNA, 64 nt, Human
acugaguacugaucuaaaaagauuaccuuuggcuggaggugagcugcacugaaacuuuacgaca

SEQ ID NO: 261348 - RNA, 64 nt, Human
cauaauccccaugugucuagggagagaccuggugggaggugauuggaucaugggggugguuucc

SEQ ID NO: 261349 - RNA, 64 nt, Human
ugcagggcugggaguuggcacuccccccgaguggggaggugacagcuugucacaguagccaggc

SEQ ID NO: 261350 - RNA, 64 nt, Human
cacacgcuuguguuugcaacacuaggucuggaugggaggugaggggugugcguauggcugccau

SEQ ID NO: 261351 - RNA, 64 nt, Human
uuguuuuugggacaacgcugcuuagauauggaguggaggugauuuacugcugaauuaaaacuca

SEQ ID NO: 261352 - RNA, 64 nt, Human
accacugggugcgucucuugcugggguuugcccuggaggugaggugagugcucgagggagggga

SEQ ID NO: 261353 - RNA, 64 nt, Human
agcuccuggaggaggacgaugacccugaugacucggaggugauuugcagcuuccugguggcccu

SEQ ID NO: 261354 - RNA, 64 nt, Human
ccuucuaggugacucugaucccuacucaugacacggaggugacucgugagugguaccaacaaac

SEQ ID NO: 261355 - RNA, 64 nt, Human
aggugcuguuaggguagaugggaaauggggcuagggaggugaaagugcguggucacaaaauauc

SEQ ID NO: 261356 - RNA, 64 nt, Human
uggauccaaaaugaugaugaagcaucucccauggggaggugaugguggggagaugaugggcuaa

SEQ ID NO: 261357 - RNA, 64 nt, Human
guuguauuuauuguauuuuaucugugugugcucaggaggugagccuaguggguccuuaaguuug

SEQ ID NO: 261358 - RNA, 64 nt, Human
gaggucuuucccaccaaacaucuuucagcugcugggaggugaccauagggcucugcuuuuaaag

SEQ ID NO: 261359 - RNA, 64 nt, Human
cugccaaaugaacuagugauugucagacugguauggaggugacugcuuuguaagguuuugucgu

SEQ ID NO: 261360 - RNA, 64 nt, Human
guggaaugguuuauuuuauggaagagaauucauuggaggugagauugaaguauauugugaagug

SEQ ID NO: 261361 - RNA, 64 nt, Human
uggggaggagacagucccugcuugugacaaguguggaggugaaaagguacaauagugcuugucu

SEQ ID NO: 261362 - RNA, 64 nt, Human
gggcugguaggagggagggugggcccacugcuuuggaggugaugggacuaucaauaagaacucu

SEQ ID NO: 261363 - RNA, 64 nt, Human
uuuuugcaguacaugggugacuaucuccccuguuggaggugaguggccuguaaguccaagcugu

SEQ ID NO: 261364 - RNA, 64 nt, Human
aaggggcuguggcugaggcuguagcaucucugcuggaggugagacacucugggaacugauuuga

SEQ ID NO: 261365 - RNA, 64 nt, Human
cucugccugaagucacacagugagucgaggacagggaggugaccccagguuucuauguguaggg

SEQ ID NO: 261366 - RNA, 64 nt, Human
gacagcuccacucaaaaacuaaggcugaugugagggaggugagaggucacugcacuugguacuu

SEQ ID NO: 261367 - RNA, 64 nt, Human
aaagggguucccggcaccucgguuuguguugguuggaggugaucgcacacuuggcccuugguua

SEQ ID NO: 261368 - RNA, 64 nt, Human
gugagcacauguguacaucucagccuuaucucaaggaggugacaccuucucuccuuguccccau

SEQ ID NO: 261369 - RNA, 64 nt, Human
cucugguuccuccagccaccucagucccucuuugggaggugauguucccauuguuuuucaaagg

SEQ ID NO: 261370 - RNA, 64 nt, Human
aggcagccauuaauauacgaacugagcaugcuggggaggugaaugccacauccuuggcgggguu

SEQ ID NO: 261371 - RNA, 64 nt, Human
gcagugcuuuacuuuaaacuaaggggaacuuugcggaggugaaaaccuuugcuggguuuucugu

SEQ ID NO: 261372 - RNA, 64 nt, Human
cuggccccugcugcuguccuguggccguccuggaggaggugaugcuggucccuggccaccucua

SEQ ID NO: 261373 - RNA, 64 nt, Human
cugccaggccauuaaaaucagcacccagcaugcuggaggugacguggccuucucccuccagcca

SEQ ID NO: 261374 - RNA, 64 nt, Human
uacacugccaucugaugccgugauccugagccaaggaggugaggagcagagcaggcaauuucac

SEQ ID NO: 261375 - RNA, 64 nt, Human
ugccugacccuugagcuccaggcuccugccagcuggaggugaaacugugcuuguauccccagcc

SEQ ID NO: 261376 - RNA, 64 nt, Human
cuucauccacagccuugcagcggcuccugcaaaaggaggugaaaucccugccucaggccaaggg

SEQ ID NO: 261377 - RNA, 64 nt, Human
ugacuuagcccccugcucacucuaggugccuccaggaggugagcccugggugcagcuggucucu

SEQ ID NO: 261378 - RNA, 64 nt, Human
uauacauaaagacaggcuuucuccccuauaguuaggaggugaacucacacauguguaccugaac

SEQ ID NO: 261379 - RNA, 64 nt, Human
gccuccaucccuuccagacugguccagacgucggggaggugaaacacgucucuucucuaccagc

SEQ ID NO: 261380 - RNA, 64 nt, Human
ggaagccaguuagcugcugcuuuggcacuggcauggaggugagcagucaaggaugcuggugagg

SEQ ID NO: 261381 - RNA, 64 nt, Human
guaacucagccauggagaugccaagcacuagccaggaggugaguuccucuuuagggcuuugguu

SEQ ID NO: 261382 - RNA, 64 nt, Human
gaggagcuccucugcccggccgcgaccccgucugggaggugaggagcgucucugucuggccacc

SEQ ID NO: 261383 - RNA, 64 nt, Human
uguccuuccugaagcuucucgacugcccagauagggaggugaguccucucuaucuccucuggcu

SEQ ID NO: 261384 - RNA, 64 nt, Human
gaacgcucuaggcagaagaagcugggagggagggggaggugaaaagggcagaggcaaggauggu

SEQ ID NO: 261385 - RNA, 64 nt, Human
acugcucuaagcacacggagacgugaugaagggaggaggugaacuguuuccacauucaagauua

SEQ ID NO: 261386 - RNA, 64 nt, Human
cucccucuccacaaccccugucacauaccuuucaggaggugacaguugucuuaguugucaucua

SEQ ID NO: 261387 - RNA, 64 nt, Human
aggaagcaugcuuuugcaguuaaauggcgaugguggaggugauagggacuucaagaguaaaaug

SEQ ID NO: 261388 - RNA, 64 nt, Human
gaugacggccaggcucccugaccacccugccuguggaggugaccuguuaggucucaugcccacu

SEQ ID NO: 261389 - RNA, 64 nt, Human
gggcaucuucccggaaucagauucaaaggauccuggaggugaugggauagacuggggagacgau

SEQ ID NO: 261390 - RNA, 64 nt, Human
aagaguguccuggcaguuaucuugagguggggaaggaggugaugaaacauuaguuugugaaauc

SEQ ID NO: 261391 - RNA, 64 nt, Human
aucacugccaagggcaagaucauggcuuuuggagggaggugaguuuagggagggccaggaccau

SEQ ID NO: 261392 - RNA, 64 nt, Human
agcuggccuauuuuggacgugugaggauguggauggaggugaugaaaaccacccuaucaucagu

SEQ ID NO: 261393 - RNA, 64 nt, Human
uggaggaugaguugggacagucuuccuuuuguugggaggugagcacauuuacagauauuuugcu

SEQ ID NO: 261394 - RNA, 64 nt, Human
uccccagcggugagguugcagugagugaaggagaggaggugaucuguucucccuccccuucugc

SEQ ID NO: 261395 - RNA, 64 nt, Human
gccccuccuuccucugguguuuuacaacuauaaaggaggugaagggggaagaaaugacugagau

SEQ ID NO: 261396 - RNA, 64 nt, Human
ccccugcuccaucugagccuugguaggguuaaagggaggugacagggugaagagggauccugug

SEQ ID NO: 261397 - RNA, 64 nt, Human
uacugaggggcacugucagcgagauguugggucuggaggugaugagaucgggccacacuugagc

SEQ ID NO: 261398 - RNA, 64 nt, Human
ggggaggcugaggcagaagaaucgcuugaacccaggaggugagguugcagugagcugagauugc

SEQ ID NO: 261399 - RNA, 64 nt, Human
ucucuguuaacucagaaagagaugggagguugggggaggugagcauaaacgcagaguucacugu

SEQ ID NO: 261400 - RNA, 64 nt, Human
ggaaucugugcccaccaccagcuccugguccguaggaggugagacaugggguucugucaugccc

SEQ ID NO: 261401 - RNA, 64 nt, Human
ucucugcagaugcuucccagaagaaaggaaagaaggaggugaggagaggacgagcaaggacggg

SEQ ID NO: 261402 - RNA, 64 nt, Human
gauggggucuuauccuggccucugaggguucagcggaggugaggaaggcagcagagcuccagca

SEQ ID NO: 261403 - RNA, 64 nt, Human
gaagccccuccuccuucccccacagauggggacaggaggugauggggugcucagaacccugcag

SEQ ID NO: 261404 - RNA, 64 nt, Human
gacucagaaccuggucauguccucgucgggcgugggaggugacgcuagugucacgcugacgcug

SEQ ID NO: 261405 - RNA, 64 nt, Human
ucuucaggaaagaaaccucauucuuuggcaagcaggaggugacacuagauggcugugaauguga

SEQ ID NO: 261406 - RNA, 64 nt, Human
guaggaaauggaagaaaaagauucagccaaguggggaggugacagaugcacaauuaugaaaccu

SEQ ID NO: 261407 - RNA, 64 nt, Human
uucugggauuauuguucaagaccagccucuaaugggaggugaaacgguacgauggucucaacac

SEQ ID NO: 261408 - RNA, 64 nt, Human
gucuggguccgcugcuucgcagggacagcgcuggggaggugacggcgcccgccgcagguggggc

SEQ ID NO: 261409 - RNA, 64 nt, Human
aguauccucaaaacgacuugacuuuaauuuucucggaggugauaggcuuccacacaggucucca

SEQ ID NO: 261410 - RNA, 64 nt, Human
ccacugugugccaggccccagcggggcccaugggggaggugaccugggugaggaaggucauuug

SEQ ID NO: 261411 - RNA, 64 nt, Human
gacgcaaucuuaagccacccuggccuugcuccugggaggugagcgugcacaggugugugcaggu

SEQ ID NO: 261412 - RNA, 64 nt, Human
agugauggcccaaaauggucaggacuuuaauggaggaggugagguguugaaagcacaggcagag

SEQ ID NO: 261413 - RNA, 64 nt, Human
aaacccagagauggaggcugucuugcuauggcagggaggugacagccugcuggcacuguauauu

SEQ ID NO: 261414 - RNA, 64 nt, Human
agggggccuaggguggucugggaggcgucuccaaggaggugacacuuaagccauccccgaaaga

SEQ ID NO: 261415 - RNA, 64 nt, Human
caccauucucucuggcauggguuggguaggggauggaggugagaauacuccuugguuuucucug

SEQ ID NO: 261416 - RNA, 60 nt, Human
acagccagagaagccucugagaugcagccgggaggugaacagcagagagaagaauguacc

SEQ ID NO: 261417 - RNA, 64 nt, Human
ugcacgaacaccaagugucugcaaguaaacaccuggaggugaaggcagagaggagccaggacug

SEQ ID NO: 261418 - RNA, 64 nt, Human
gucaucaaaacucugcaugucaccuuguccaucuggaggugaugucaauggcuggccaugcagg

SEQ ID NO: 261419 - RNA, 64 nt, Human
agacuggugccauuuguugucagacuauagguguggaggugaaauuacagguucaacaguaauu

SEQ ID NO: 261420 - RNA, 64 nt, Human
uuccaugaucuuggagugacucugaaggacucugggaggugagacguugucccggagaucaaaa

SEQ ID NO: 261421 - RNA, 64 nt, Human
uuuuuaaguagagguaaaauugagauggggggcgggaggugacaucaugaaguuuuuuggaaau

SEQ ID NO: 261422 - RNA, 64 nt, Human
cguuucaauuguggaccggcgccgagggggaaagggaggugacuucgcccgguggcaauaguuc

SEQ ID NO: 261423 - RNA, 64 nt, Human
ucggaagguuucaaaucacgacagaguccauguuggaggugauaaaaaacuguaaaaaaaaaaa

SEQ ID NO: 261424 - RNA, 64 nt, Human
uggggcuccuggggacuggugggaucuaagaaagggaggugaguggguggaggcagggugacgu

SEQ ID NO: 261425 - RNA, 64 nt, Human
cccagccacuuccucacccccagugccuggacccggaggugagaacaggaagccauucaccucc

SEQ ID NO: 261426 - RNA, 64 nt, Human
ugcuucuuuugcugccuuaagcccccuaugcccuggaggugagggcagcucucuugucucuucc

SEQ ID NO: 261427 - RNA, 64 nt, Human
uauaauccccauguguugggggagggaccuggugggaggugauaggaucaugggggugguuccc

SEQ ID NO: 261428 - RNA, 64 nt, Human
gugcugccuguugacagaugugugucuguccucaggaggugaaauaauuugcccuagagaucaa

SEQ ID NO: 261429 - RNA, 64 nt, Human
uuguaaucuccaguauuggagguggggcccauugggaggugauugaaucauggaaguggauuuc

SEQ ID NO: 261430 - RNA, 64 nt, Human
ggacugggcugugguugggccugaggccuguggaggaggugaguguagccagcagcggccgucu

SEQ ID NO: 261431 - RNA, 64 nt, Human
uugggaaaaaggccucugucccggaagagucaugggaggugaaaggggcacguuugaagaugcg

SEQ ID NO: 261432 - RNA, 64 nt, Human
augcaauucaucccagaggaaccugaggccugaaggaggugagagaagaccucugugaggaaag

SEQ ID NO: 261433 - RNA, 64 nt, Human
uguaaucugcauguguugugggaugggccugguaggaggugacugaaucaugggggcggacuuc

SEQ ID NO: 261434 - RNA, 64 nt, Human
ccaacaugaaauguagacagcgugaauacggacaggaggugaugccauauucacagugggggau

SEQ ID NO: 261435 - RNA, 64 nt, Human
agcagacuuguguuuuggguuuuuuaaaccuaagggaggugaugguaggaacccuguucuacug

SEQ ID NO: 261436 - RNA, 64 nt, Human
acuccaugaacggggaggaucugcuucugacaggggaggugagcuggcgcccucuaguggagaa

SEQ ID NO: 261437 - RNA, 64 nt, Human
ucccuugggcuggaagaauuggggauucucuauuggaggugagaucacagccuccagggccccc

SEQ ID NO: 261438 - RNA, 64 nt, Human
uuguaagggugggggcugacggccgacccugggaggaggugacaucgccgggggagguuguggg

SEQ ID NO: 261439 - RNA, 64 nt, Human
guuaacaaaacuccaaagcaaaaacccuuuuaauggaggugagaaauaaauuuaauguaacaac

SEQ ID NO: 261440 - RNA, 64 nt, Human
gugagcacgggccuggcuggcacccgguuuacagggaggugauugaggacgucguuaugauuug

SEQ ID NO: 261441 - RNA, 64 nt, Human
cacggacacugacucuuacagcaauaacuucagaggaggugaagacaucuggccucaaagccaa

SEQ ID NO: 261442 - RNA, 64 nt, Human
auucaaagccuuucaauuugaagugaccuaggugggaggugauaaaauuuguucccuuuauagu

SEQ ID NO: 261443 - RNA, 64 nt, Human
acgccaucaaucuccagcugugguuguugaacucggaggugagcuccucucaccacucucuuga

SEQ ID NO: 261444 - RNA, 62 nt, Human
agggcugggcuuuggagugagggcagugcgguggaggugagggggugagccuggaccugugg

SEQ ID NO: 261445 - RNA, 64 nt, Human
ucaccuuuuuucaccccacacuugcagagcugcuggaggugaggucaggugccucccagcccug

SEQ ID NO: 261446 - RNA, 64 nt, Human
aguuauuuaaaauaaaucuuccuugagagccuugggaggugaugucaggguuauaaauggcaca

SEQ ID NO: 261447 - RNA, 64 nt, Human
aagcacggggugaacuugcucugaacugcacccaggaggugacugggaaggagaaaaccagcaa

SEQ ID NO: 261448 - RNA, 64 nt, Human
uacccacugaccccagaccagugcagccagcaggggaggugagccauacacaggccacgacaaa

SEQ ID NO: 261449 - RNA, 64 nt, Human
gccaccugggcccucacagcccagacccucacugggaggugagcucagcugcccuuuggaauaa

SEQ ID NO: 261450 - RNA, 64 nt, Human
uggcaauuggcacugaaggcaccccaggccccugggaggugaguuagacagcccaggggaccag

SEQ ID NO: 261451 - RNA, 64 nt, Human
cacuacaaccuccaugaccuugagacgcaucccaggaggugacgaggcaggggcuccaggaaag

SEQ ID NO: 261452 - RNA, 64 nt, Human
uggaggacuugggagaaggauggggucuuaggaaggaggugacagcacuugcauggucacuuga

SEQ ID NO: 261453 - RNA, 64 nt, Human
cccaaauaagggcugguauuucuccucuguccuuggaggugauuucccccugacccccuccccc

SEQ ID NO: 261454 - RNA, 64 nt, Human
aggcuggauuugaaugaacuccgggccuguuuggggaggugaagcugccaggugugcacagggg

SEQ ID NO: 261455 - RNA, 64 nt, Human
cgaauugcagcuguuuaacuugaaagacacugucggaggugagcaucugggcgccgggacgcug

SEQ ID NO: 261456 - RNA, 64 nt, Human
cugcugcaggcagaugaccucaugggggguggagggaggugaggugcccagguggcuauuugcc

SEQ ID NO: 261457 - RNA, 64 nt, Human
guaugcaaaguuuuuguugaaagcugugcucagaggaggugagaggagaggaaggagaaaacug

SEQ ID NO: 261458 - RNA, 64 nt, Human
aaggagcuuuggggacuuaaguccugaggauccaggaggugaggugacuuguccaagauuccac

SEQ ID NO: 261459 - RNA, 64 nt, Human
ccuguuauuuuaguugccuuaucuggagagacguggaggugauuuucuuuuuuuuaaauuauua

SEQ ID NO: 261460 - RNA, 64 nt, Human
cugugcagccgcagaauaugcauaucaaugaguuggaggugauuauucucuguaacucccuaau

SEQ ID NO: 261461 - RNA, 64 nt, Human
gagcuggcccuugacccccacccacccccacccuugcuggcaggggcagggaccccagggggau

SEQ ID NO: 261462 - RNA, 55 nt, Human
ccggccccccagagaaaugagcuccugcuggcaucuggagaacaccccugugccu

SEQ ID NO: 261463 - RNA, 64 nt, Human
gggccucaagcuggggugggaugaggaggcgcucugcuggcagugcugaggacggguacuccag

SEQ ID NO: 261464 - RNA, 64 nt, Human
uucuuuuaucuuuggaacaucagcaccaguauauugcuggcagcuauuguauuaaaaaauaaag

SEQ ID NO: 261465 - RNA, 64 nt, Human
aucuuguauccucauacccacuuuugggauagggugcuggcagcugucccaagcaauggguaau

SEQ ID NO: 261466 - RNA, 64 nt, Human
caagccaggucccggcauggguggguuaugcucaugcuggcaauacuugaaacggguuuauuaa

SEQ ID NO: 261467 - RNA, 64 nt, Human
gcaucuguccaggccuggaaccgucucaagacagugcuggcaaagcugcaguauugagaugcua

SEQ ID NO: 261468 - RNA, 64 nt, Human
guagagagggccagagaugcccgcgugguagggcugcuggcaggcacacuggguguagcccaac

SEQ ID NO: 261469 - RNA, 64 nt, Human
aggcacuggcccacuugcggaaccugacucaggcugcuggcaagcguagcuauguguuggcccu

SEQ ID NO: 261470 - RNA, 64 nt, Human
cuuccccuuccccacccgaauucuuuucugaaguugcuggcauuugggucaagguuuuauuaaa

SEQ ID NO: 261471 - RNA, 64 nt, Human
cgcagcccagguccaggaccacauccuggccagcugcuggcagaacuccuggcugccgcacggg

SEQ ID NO: 261472 - RNA, 64 nt, Human
cugugcagagauuucucuguaagggcaacgaacgugcuggcaucaaagaauaucaguuuacaua

SEQ ID NO: 261473 - RNA, 64 nt, Human
ggagggcagccccaaaggccacaguccccuccugugcuggcagcuuugcccacacauacccagc

SEQ ID NO: 261474 - RNA, 64 nt, Human
gcuauagcuucaugaccguaacaugugaccugugugcuggcaggacgacucacugcggcugcgc

SEQ ID NO: 261475 - RNA, 64 nt, Human
gcccacuuuucuuucuuuccuucuuauuuuguuaugcuggcagccauuugccccugcaugguau

SEQ ID NO: 261476 - RNA, 64 nt, Human
gacagacacagcaggggucuggggcacggagccuugcuggcaucagcaucagcccuuccuccca

SEQ ID NO: 261477 - RNA, 64 nt, Human
gagggagagggaggucacuggaaaggggagagccugcuggcacccaccguggaggaggaaggca

SEQ ID NO: 261478 - RNA, 64 nt, Human
ggggcgggaaaacauggagaauuaagucagauaaugcuggcagccaaaggggcaaaauggccug

SEQ ID NO: 261479 - RNA, 64 nt, Human
uugaaccauggcugagcagugccggcauacgcuuugcuggcaugcuuggaugcccagcuguguc

SEQ ID NO: 261480 - RNA, 50 nt, Human
aguacugcuguuucguaugaugcuggcaagacacccagaaaggcuauuuu

SEQ ID NO: 261481 - RNA, 64 nt, Human
cucaagucuaaguccgaggccagccuccuccagcugcuggcaggggcuggcacccaugggacac

SEQ ID NO: 261482 - RNA, 64 nt, Human
gggccugcagugucuccauuccccaagcugcuccugcuggcacuucgcuucuguggccuuggca

SEQ ID NO: 261483 - RNA, 55 nt, Human
ggagcugugggagcugcuaggguggugcuggcauccugaguccuggcccuccugg

SEQ ID NO: 261484 - RNA, 64 nt, Human
caguaggccccuguccccagccacacaccuuagaugcuggcaugccuuacuccaggugccugug

SEQ ID NO: 261485 - RNA, 64 nt, Human
gggcagagccguccagaccugggaucagggaagcugcuggcaucguccccacccccagccuggg

SEQ ID NO: 261486 - RNA, 64 nt, Human
cucaugcaucuccuuuccugagcaccaguaaugcugcuggcaucgccugcuuucucuccagugg

SEQ ID NO: 261487 - RNA, 64 nt, Human
ccucauuguacagauggggcaggacccagcacgcugcuggcagagaugguuugagaacacaucc

SEQ ID NO: 261488 - RNA, 64 nt, Human
gagagagagaagcugggcccagccgggccgugccugcuggcacagacgccuuaacgcugugugu

SEQ ID NO: 261489 - RNA, 64 nt, Human
cauggucuagcaugcaucuuguagaaacaaggcaugcuggcagauugcaggguugagauguguu

SEQ ID NO: 261490 - RNA, 64 nt, Human
gagauccacauaccauucucaaucccacugaaauugcuggcauucucaaaggcagggcagaggg

SEQ ID NO: 261491 - RNA, 64 nt, Human
aaucagcucuguccuuggcgggacaguccuucccugcuggcagucucuucucguuggcucccuc

SEQ ID NO: 261492 - RNA, 64 nt, Human
gacuguuuuguuuucuuguuggccauuucuguauugcuggcaucugugcuaagcuuuacagugg

SEQ ID NO: 261493 - RNA, 64 nt, Human
ccucugaugccccacugaggugcuguugguuuauugcuggcaacgugaauucucucaggggucu

SEQ ID NO: 261494 - RNA, 64 nt, Human
auccuggggugaguggagucaccccacucccaguugcuggcagagacugagacuaaagcaucac

SEQ ID NO: 261495 - RNA, 64 nt, Human
aaacugaaaaauggcucuucuugggucuugagcuugcuggcauauggacugaaagaaacuaugc

SEQ ID NO: 261496 - RNA, 64 nt, Human
gggguucagccuguccugucaccucugaggugccugcuggcauccucucccccaugcuuacuaa

SEQ ID NO: 261497 - RNA, 64 nt, Human
ccuacaaagaccuugcuugaaaccacaaaaguuuugcuggcacgaaagaaacuagauggaaaua

SEQ ID NO: 261498 - RNA, 64 nt, Human
agguguauaagaugaguugcaaauuagccgggcaugcuggcacgcaccaguaaucccagcuacu

SEQ ID NO: 261499 - RNA, 64 nt, Human
aauguuaugguaccauauacugauguaaaaaucaugcuggcauccaugaacacaccgguaaaua

SEQ ID NO: 261500 - RNA, 64 nt, Human
uaaugcagcucagaugcugagcucuaguaggaaaugcuggcaugcugauuacaagauacagcug

SEQ ID NO: 261501 - RNA, 64 nt, Human
uuuccaacagcugggacauuuuucugaugaucauugcuggcaugaagcuguugcggacaucauu

SEQ ID NO: 261502 - RNA, 64 nt, Human
cgggaaggaugugugcucugacagacgugucagaugcuggcagaagggauugguuuucuccugu

SEQ ID NO: 261503 - RNA, 64 nt, Human
cgcuggaaguguggauuuauagcuaugaaaccacugcuggcagugggugggccacugggacuga

SEQ ID NO: 261504 - RNA, 64 nt, Human
aacauucgugaaaugauuuuuuuuagcugaaaaaugcuggcaagaagaauuuuaaagcuuaaaa

SEQ ID NO: 261505 - RNA, 64 nt, Human
cuacuaauacgcaggaagcguuccagcuauuuaaugcuggcaacuacuguuuaauggucaguua

SEQ ID NO: 261506 - RNA, 64 nt, Human
guagagacauugagcccaucacaacuguuuugacugcuggcagucuaaaacaguccacccaccc

SEQ ID NO: 261507 - RNA, 64 nt, Human
cuauuuguuugcuuuuaauuugccaaccuaucgcugcuggcagcacuuuuugagcaagccgaga

SEQ ID NO: 261508 - RNA, 64 nt, Human
cccugggccagggaauggcuccuuauaccaaagaugcuggcacauagcagaacccagugcacgu

SEQ ID NO: 261509 - RNA, 64 nt, Human
ugggauuacuagaaaaccugacuaauggugucacugcuggcaauggugauaauggauuaauucc

SEQ ID NO: 261510 - RNA, 64 nt, Human
ucggauucccagaaaaccugacuaauggugccacugcuggcaauggugaugauggauuaauucc

SEQ ID NO: 261511 - RNA, 64 nt, Human
ggaaagauucugaauggggugagacuuaaaguuaugcuggcagauucgccaagagaagaaucua

SEQ ID NO: 261512 - RNA, 64 nt, Human
ugucgccugcugcugggcgugaugucgcuggaggugcuggcagggacucugauuuggugguccg

SEQ ID NO: 261513 - RNA, 64 nt, Human
uuuagauuuuuuccaauagugugaguauauccauugcuggcaguggagggcuugccaugaaaau

SEQ ID NO: 261514 - RNA, 64 nt, Human
gaaccuggugcguaguagaugcucaauaaauuuuugcuggcacgauuucuguuguuacuguugu

SEQ ID NO: 261515 - RNA, 64 nt, Human
auucagcccugaguggagaccuaucagauuggauugcuggcaaagcacagaaugccuguauaug

SEQ ID NO: 261516 - RNA, 64 nt, Human
cacaaccaagccacccuucacagauaaaauaugaugcuggcauggcaaucagaccaaagcacug

SEQ ID NO: 261517 - RNA, 64 nt, Human
auauucuuggguguggcuauauuacaaaaugggaugcuggcaaugaaacaauacauuuaacacu

SEQ ID NO: 261518 - RNA, 64 nt, Human
aaaacauucuucacgcaggggcuugggauauggcugcuggcaacacauuuuguugugggcuccu

SEQ ID NO: 261519 - RNA, 64 nt, Human
aacccccuagaauuuccaugucucugcuuagcugugcuggcagcuagcagcuggcuguguuugc

SEQ ID NO: 261520 - RNA, 64 nt, Human
gcugcgcugugcuggucucuaggccugaacuaggugcuggcaugucugggucgucuuuugaaaa

SEQ ID NO: 261521 - RNA, 60 nt, Human
ggcuccagucaccagugugagagagaaaggugcuggcauaggaucugcccagaagagaaa

SEQ ID NO: 261522 - RNA, 64 nt, Human
auauagaaaaagauuauagaggaggagaaucuacugcuggcaauugggaaccgcaagguauacu

SEQ ID NO: 261523 - RNA, 64 nt, Human
ugagguggugccccucugccugccugccccacugugcuggcaggagcugacuguggacuggugg

SEQ ID NO: 261524 - RNA, 64 nt, Human
ucauggcuucucuuuauucuuggccuggguugucugcuggcacuaauacaucuauuauuaacgu

SEQ ID NO: 261525 - RNA, 64 nt, Human
ucaguaauacuaaaacauacagagauacugaacuugcuggcacauuuacuucugguaagcauaa

SEQ ID NO: 261526 - RNA, 64 nt, Human
aaugugcauuuuuggaagccucccucacucuccaugcuggcagagcaggagggagacugaagua

SEQ ID NO: 261527 - RNA, 64 nt, Human
gggacaguuuccuguggccagccgagccuggcagugcuggcaccgcgagcuggccugacgccuc

SEQ ID NO: 261528 - RNA, 64 nt, Human
guuaauuuugcauggcuucuuaaggccagcaaaaugcuggcaguuuucuuuaucuuugugaaga

SEQ ID NO: 261529 - RNA, 64 nt, Human
ugcauaaaaugugaauacuaaauguguccccaguugcuggcauucauauguacaggauuuguuc

SEQ ID NO: 261530 - RNA, 64 nt, Human
agcuuuauacuucagaaccuaagucucuucacuuugcuggcaccugcuauacuggaguauugcu

SEQ ID NO: 261531 - RNA, 64 nt, Human
ccgugugcuggcccugccccagccuagcugagugugcuggcaaaguuccccacaggacucagcc

SEQ ID NO: 261532 - RNA, 64 nt, Human
aaagaguguagaucagagcagcagugaaaacaagugcuggcaccaccaggcaccucacagaaau

SEQ ID NO: 261533 - RNA, 64 nt, Human
uuaaaugagaaggaauuugaguuggaucaucuauugcuggcaaagacagaagccucacugcaag

SEQ ID NO: 261534 - RNA, 64 nt, Human
cuggccauucagguauaaggcagggugguguaccugcuggcacuauccagauggaggcaccaaa

SEQ ID NO: 261535 - RNA, 64 nt, Human
caaccucuuuacucuuagucaaguggaaugugcaugcuggcaucugaauguccauucgccaggc

SEQ ID NO: 261536 - RNA, 64 nt, Human
cugugcucucccugccuccccuagcccauaccucugcuggcaccuucuguaccaugccuucaga

SEQ ID NO: 261537 - RNA, 64 nt, Human
caacaguuucccauuaacucuuucugaccaauagugcuggcaccguugcuuccucuuugggaag

SEQ ID NO: 261538 - RNA, 64 nt, Human
agcagaucauguauuucccggagacgugggaccuugcuggcaugucuccuucacaaucaggcgu

SEQ ID NO: 261539 - RNA, 64 nt, Human
cacagcccggcagaggggcacacucuggagaccuugcuggcagugcuagccaggaaacagagug

SEQ ID NO: 261540 - RNA, 64 nt, Human
ugaacauuaauguuaaagacuuaagacuuuaaccugcuggcagucccaaaugaaauuaugcaac

SEQ ID NO: 261541 - RNA, 64 nt, Human
ccucagguauuguaaccacugggccuuccaacuuugcuggcaagcucugguaaccucccugacu

SEQ ID NO: 261542 - RNA, 64 nt, Human
agcuucccuuuccacccuaccuagguucccuccuugcuggcauaaaggccaagcagugaaauga

SEQ ID NO: 261543 - RNA, 64 nt, Human
ucuuggaaaaccucaaugcaagauaguguuucagugcuggcauauuuuggaauucugcacauuc

SEQ ID NO: 261544 - RNA, 64 nt, Human
uauuuaaaguuaggaagaucugggagauagggguugcuggcaugaaaauguauaacuuacaaca

SEQ ID NO: 261545 - RNA, 64 nt, Human
caugugucccagcauaaggcaucagguuguuagaugcuggcaucucugcagcucaaagaugugg

SEQ ID NO: 261546 - RNA, 64 nt, Human
uugcgacuucuucgauaguuaccugcacguccauugcuggcaacugacuugucauuaaaaccug

SEQ ID NO: 261547 - RNA, 64 nt, Human
ccagggccagggcugcagccugaggcucaggcugugcuggcauaagugcucugcuccuagguga

SEQ ID NO: 261548 - RNA, 64 nt, Human
aggagaaaaccgcccuguggcuggaggugagauaugcuggcagcaauacugcucuguuacuccu

SEQ ID NO: 261549 - RNA, 64 nt, Human
ugagaccuaacgagaaauagaaauggggaacuacugcuggcaguggaacuaagaaagcccuuag

SEQ ID NO: 261550 - RNA, 64 nt, Human
cuggaagcccugggcauuaggagaagggagugggugcuggcauggacaugacuggauagaauuu

SEQ ID NO: 261551 - RNA, 64 nt, Human
ccccuuuaucuguacauagugacugaguggggggugcuggcaaguguggcagcugccucugggc

SEQ ID NO: 261552 - RNA, 64 nt, Human
cucuuagacccagcuggagccagcacccucuggcugcuggcagccccaagggaucugccauuug

SEQ ID NO: 261553 - RNA, 64 nt, Human
gaauaucaagucguugaaauuuauuugaaauacuugcuggcacugcaccuggauuuguacugca

SEQ ID NO: 261554 - RNA, 64 nt, Human
gaggaagggcagggcagacugcagauggccuuguugcuggcaucccggccaggugggcggggac

SEQ ID NO: 261555 - RNA, 64 nt, Human
ugauggcagaaucacugaugggaauccagcuuuuugcuggcauuuaaauagugaaaagagugua

SEQ ID NO: 261556 - RNA, 64 nt, Human
uuuuuaaauaaguauuuuguugagguugaagaauugcuggcaauuaaaagaauagagcuaauua

SEQ ID NO: 261557 - RNA, 50 nt, Human
ucuuuucauccccuagaugaugcuggcacagaaggcauuguucccuaccc

SEQ ID NO: 261558 - RNA, 64 nt, Human
uuacuguagcccuuugauuccagagagggagcuuugcuggcaaaagcaguuuuugcacuagaaa

SEQ ID NO: 261559 - RNA, 64 nt, Human
acugcgugccacguguuuucauagacucaucccaugcuggcaacagcccugcaaggggcuuggc

SEQ ID NO: 261560 - RNA, 64 nt, Human
aggccacgcagaaugaaccgaugggguauucaguugcuggcagcuacauuguguggcauucuag

SEQ ID NO: 261561 - RNA, 64 nt, Human
cuucaaaugagaaaaaagaacaguuucuuccaugugcuggcacguggaugauuagaaaaaaaga

SEQ ID NO: 261562 - RNA, 64 nt, Human
uacuuggaagaaaauuucacuauuugcauugaugugcuggcauuuauauguaauucauaauuuu

SEQ ID NO: 261563 - RNA, 64 nt, Human
ugaaugucguggcuguuggcugccgagccucagcugcuggcauuuccuucugcuguuugcugcu

SEQ ID NO: 261564 - RNA, 64 nt, Human
ucccuggauauacucugugaaccuucuggaaggcugcuggcaguuuuuccuuuuuguccaccac

SEQ ID NO: 261565 - RNA, 64 nt, Human
gcuucagaguuucaccugcccacacaggguccguugcuggcaacuggacuuccccauaagccuu

SEQ ID NO: 261566 - RNA, 64 nt, Human
gaccucgugaucugccugccucggccucccaaagugcuggcauuacaggcaugagccaccaugc

SEQ ID NO: 261567 - RNA, 64 nt, Human
ucaacucuugccccaugucuccuuggcagcaggaugcuggcaucuguguaguccucauacuguu

SEQ ID NO: 261568 - RNA, 64 nt, Human
ccaccuccgacagcaaacagcaacugacugcaggugcuggcaugauggagguggugcaccuugg

SEQ ID NO: 261569 - RNA, 64 nt, Human
cugggaucagccaugcccagaggucugguccugaugcuggcaggggggcccccuccuccauccc

SEQ ID NO: 261570 - RNA, 57 nt, Human
gcucacauuccuuaaauuaaggagaaaugcuggcauagagcagcacuaaaugacacc

SEQ ID NO: 261571 - RNA, 57 nt, Human; identical to SEQ ID NO: 261570

SEQ ID NO: 261572 - RNA, 64 nt, Human
agauuuucucagccagugauaguacauucugaaaugcuggcaccaggagacggccacagacaca

SEQ ID NO: 261573 - RNA, 64 nt, Human
caucggcacuagcggguuggggguggugguggggugcuggcagccucaggagcgaucgcucccc

SEQ ID NO: 261574 - RNA, 64 nt, Human
gguccagccaagagccaucucgugccaagacuucugcuggcaagggaauggauaaagcuguuuu

SEQ ID NO: 261575 - RNA, 64 nt, Human
gucugggaacagagccacgaaucugccuuugagaugcuggcagaucucaaggccaucaauuauu

SEQ ID NO: 261576 - RNA, 64 nt, Human
uuuucaccauucaugaauaauaauaaauauguacugcuggcauguaaugcuuaguuuucuugua

SEQ ID NO: 261577 - RNA, 64 nt, Human
caguugagguccaucgggcuggccccagcccaucugcuggcaucaguaccugguguugggacag

SEQ ID NO: 261578 - RNA, 64 nt, Human
gugguccugucgucccucgugccccucggccaccugcuggcagccgaugggggcacucggacau

SEQ ID NO: 261579 - RNA, 64 nt, Human
cuauagcaagucucagguguuugcaguaagaagcugcuggcaugcacgggaacagugaaugcca

SEQ ID NO: 261580 - RNA, 64 nt, Human
uuguucccuugagaccaaaauuuaaguuaacuguugcuggcagucuaaguguaaauguuaacag

SEQ ID NO: 261581 - RNA, 64 nt, Human
uaagucaacagacagaccuggguuugaauccaagugcuggcaccuacuugcucagugaucauga

SEQ ID NO: 261582 - RNA, 64 nt, Human
auugaaaguuuguggcaaugcuguugagcaaaucugcuggcaucuuucuucccaaaggcaugug

SEQ ID NO: 261583 - RNA, 64 nt, Human
ucccuccugugcacccucaggucccuccuuuuccugcuggcacugagugccagggguccgcucc

SEQ ID NO: 261584 - RNA, 64 nt, Human
ugggauucaggaauguguggccugcacagugaagugcuggcaaccacuaagaauucaaacuggg

SEQ ID NO: 261585 - RNA, 64 nt, Human
cuuguccccacggcccccagaacaacauucucccugcuggcagcccuuccaugucuccaaaccu

SEQ ID NO: 261586 - RNA, 64 nt, Human
ugcagccucccuuccaugccccaggaucacucucugcuggcaggauucuucccgcuccccaccu

SEQ ID NO: 261587 - RNA, 64 nt, Human
cccugcuccccauccccuaccaugggcacccaugugcuggcacagaacaguuccagaucuagac

SEQ ID NO: 261588 - RNA, 64 nt, Human
ugcagcacaaauaggccccccagucccagccgugugcuggcagauaggguuguauuauuucuuc

SEQ ID NO: 261589 - RNA, 64 nt, Human
cugagcagcaccuucuggacagggggcgugaugcugcuggcacugguuggguaccugauacggg

SEQ ID NO: 261590 - RNA, 56 nt, Human
cccaaaggccaaggaagugaccugccugcuggcauuggccagaccacagcagcacc

SEQ ID NO: 261591 - RNA, 64 nt, Human
aagagaaguguacauugauuuccaauuaaaaauuugcuggcauuaaaaauaagcacacuuacau

SEQ ID NO: 261592 - RNA, 64 nt, Human
agccagcacgggguagagccaugguccucauacuugcuggcaucccucaucugguggucuguua

SEQ ID NO: 261593 - RNA, 64 nt, Human
caguaaaaacacugcacaugcguccccucccaagugcuggcaggccacugugcaugcagacagc

SEQ ID NO: 261594 - RNA, 64 nt, Human
aucagauggcaagcucagugcccgggauacccacugcuggcaggagaaggcccauuuucacagu

SEQ ID NO: 261595 - RNA, 64 nt, Human
uccugaggcaugaagccuccucagcucuuggaauugcuggcaaggggugacugccucugaguca

SEQ ID NO: 261596 - RNA, 64 nt, Human
aagccagggugauagcccagacucugcccuguugugcuggcagaaacggggagaaggguugagu

SEQ ID NO: 261597 - RNA, 64 nt, Human
uggugcugaggauagcagagcccccagccaucacugcuggcagccugggcaaaccgggugagca

SEQ ID NO: 261598 - RNA, 64 nt, Human
cuaggagaugaacuagaaauaaggggucagauaaugcuggcaaauccuccuacccaaaaagggg

SEQ ID NO: 261599 - RNA, 64 nt, Human
cugaccacaacauccuuccugugguugcuggagcugcuggcagggccaggcaaggccagagugc

SEQ ID NO: 261600 - RNA, 64 nt, Human
ccucaggugauccacccgcuucagcuucccaaagugcuggcauuacaggcgugagccaccacgc

SEQ ID NO: 261601 - RNA, 64 nt, Human
cuuuaguuucugcuauuuuucuguggaaaaccacugcuggcacaagcagugacuguuuggcagc

SEQ ID NO: 261602 - RNA, 64 nt, Human
gaacuacccuguuuuccuuguauauaaugacuuuugcuggcagaacugaaauauaaacuguaag

SEQ ID NO: 261603 - RNA, 64 nt, Human
gguggucuuguggugguacauuugguuaacccauugcuggcagugggagcugauuuaggcaggg

SEQ ID NO: 261604 - RNA, 64 nt, Human
aaccgagaucugcagucugaucuguggacuucucugcuggcauaucuuuuaugauuuaaccucu

SEQ ID NO: 261605 - RNA, 64 nt, Human
ggguuaacaggacaacgaagugcauguggcagugugcuggcaguggccuugaggcuuuggacca

SEQ ID NO: 261606 - RNA, 64 nt, Human
cccacacaacuaugucuggucaccagcucccuccugcuggcacccagagacccggacccgcagg

SEQ ID NO: 261607 - RNA, 64 nt, Human
cucaaaaaguggccaaggauguggagugggcaugugcuggcaggugggauauguccucagccuu

SEQ ID NO: 261608 - RNA, 64 nt, Human
auuuaauuuaauggagcauguacuuauuugcauuugcuggcaguucaggcauaguuaaagugag

SEQ ID NO: 261609 - RNA, 64 nt, Human
gggcuuuuaauuuuaauccuggagucucacugucugcuggcaaagauagagaaugcccucagcu

SEQ ID NO: 261610 - RNA, 64 nt, Human
uucucuaacuugcgguggcaugacugucaggaggugcuggcauuuucagcagauccucaugugu

SEQ ID NO: 261611 - RNA, 64 nt, Human
cagcagucucugcuccagaaucucuggacggagcugcuggcagcuucugcgagaagagagagau

SEQ ID NO: 261612 - RNA, 64 nt, Human
auagcugccauccgaggcuuccuggucuaagaguugcuggcaagaagauggccgggcguggugg

SEQ ID NO: 261613 - RNA, 64 nt, Human
guuggccacagcaugggaggaaagacagccaugcugcuggcacuacagagggugagccgcccau

SEQ ID NO: 261614 - RNA, 64 nt, Human
ucuccauuagaguccccagaaaggaaugcagccuugcuggcaccuuuuuagcccagugagauca

SEQ ID NO: 261615 - RNA, 64 nt, Human
gagaagaggaaugacugcaugaaucuaccugaguugcuggcauugggaggccaguuacuggaaa

SEQ ID NO: 261616 - RNA, 64 nt, Human
gugggcaguuacugagcuuuccuccucagagccaugcuggcagcccugggacagagaacggugu

SEQ ID NO: 261617 - RNA, 64 nt, Human
uacauaaaauuucauuauuuccugcuaucuuguuugcuggcagaagugaauguuuggugagguu

SEQ ID NO: 261618 - RNA, 64 nt, Human
ugauugacucaggauuguuuuucccauauugauaugcuggcaauauaggaugguauguaaugga

SEQ ID NO: 261619 - RNA, 64 nt, Human
cggugcccaggauagauguaauauuucuuacagaugcuggcacagaggaaauaauauaccagcu

SEQ ID NO: 261620 - RNA, 64 nt, Human
cucuugucuuuaccaacugccugaagaggccauaugcuggcauuuugcacaacuuuuugguugu

SEQ ID NO: 261621 - RNA, 64 nt, Human
cacucuuuagccccggagcuccaggcccagcggaugcuggcacccaagcgcagcugggggaccc

SEQ ID NO: 261622 - RNA, 64 nt, Human
gagaagaugaagcagcucacagaggagacggaggugcuggcacaugagaucgagcggcugcaga

SEQ ID NO: 261623 - RNA, 64 nt, Human
gggcccaccaccuguccgucccuguccccuuuccugcuggcaggagccggcugccuaccagggg

SEQ ID NO: 261624 - RNA, 64 nt, Human
acaguccugccgcagguacaugaugaugcgggacugcuggcaugcagugcccucacagagaccc

SEQ ID NO: 261625 - RNA, 64 nt, Human
uauuugaaagagguuucuuugauguuuuaacuuuugcuggcaaaaaaaaauucacgcuuggugu

SEQ ID NO: 261626 - RNA, 64 nt, Human
ucauguuuuaaagguguuuauacugauuugauugugcuggcaaauauacuguauuguuaauauu

SEQ ID NO: 261627 - RNA, 64 nt, Human
uuuugcauauugcuguuaauaagcauuguaaucaugcuggcauuuugcaaucccagucgguaug

SEQ ID NO: 261628 - RNA, 64 nt, Human
uaguggcaauagugaugaaaggaccgccuuaucaugcuggcaauguuaauuacccagguguagg

SEQ ID NO: 261629 - RNA, 64 nt, Human
agagaguugaggaaaccagaaggccaaguggaucugcuggcaaacccugaaccugucuccugcg

SEQ ID NO: 261630 - RNA, 64 nt, Human
ccgucugaauaauggguuuuagcggguccuagucugcuggcauugagcuggggcugggucacca

SEQ ID NO: 261631 - RNA, 64 nt, Human
ugcagagggccagaagaaugagagagaggaagacugcuggcagggaaaucgaggaggcgagacu

SEQ ID NO: 261632 - RNA, 64 nt, Human
aauagcaaggccagggcacagcuggagacgaucuugcuggcagggccuggccuuguccccagcu

SEQ ID NO: 261633 - RNA, 64 nt, Human
ucuaggggagacucugucuccugcuccuucaggcugcuggcagaauccacauccuuucgguggc

SEQ ID NO: 261634 - RNA, 64 nt, Human
cugcuccauggggucugggagagcagccauccccugcuggcaccauagacccacacaaggagcc

SEQ ID NO: 261635 - RNA, 64 nt, Human
ugaagggacauccuuggggcugugccgugaguuuugcuggcauaggugacagggugugucucug

SEQ ID NO: 261636 - RNA, 64 nt, Human
cagaccucuuaaugggccagugaauaacacucacugcuggcauuuaaugugcaguagugaauga

SEQ ID NO: 261637 - RNA, 64 nt, Human
agaguagacugagagcuggggccacguaucccugugcuggcaccugcucccugugcucaguauu

SEQ ID NO: 261638 - RNA, 64 nt, Human
uauguagacuggagucuucgugaacuggggcaaaugcuggcauccaggagccgccaauacuaac

SEQ ID NO: 261639 - RNA, 64 nt, Human
accugugcucugcaggggaaaccagaaggcaaaaugcuggcagcaugaaacccuuuugugguuc

SEQ ID NO: 261640 - RNA, 64 nt, Human
cugggccgguggguggcucucagaaaauacuugcugcuggcaaaaggccuguacucaggcauuu

SEQ ID NO: 261641 - RNA, 64 nt, Human
cccccacagcacuucccacuacugcuucugucccugcuggcagccucugucccuccagaacggc

SEQ ID NO: 261642 - RNA, 64 nt, Human
uggugcucuaaugccaaguuauacacgggacaguugcuggcaugucuucauuggcuauauaaaa

SEQ ID NO: 261643 - RNA, 64 nt, Human
ccugguuccagggggcuguuuuguaaugagaugcugcuggcaggccacucagaggcucccagcu

SEQ ID NO: 261644 - RNA, 64 nt, Human
ggauuauaggugugagccaccgcgccgggccgguugcuggcaucuuaauguucuguagguggaa

SEQ ID NO: 261645 - RNA, 64 nt, Human
aacagauggauggugggcacagauggguccuccaugcuggcaaugcguuacagguuuuaugaua

SEQ ID NO: 261646 - RNA, 64 nt, Human
uuuuuacuaccuguuagauauagugcuaaagaggugcuggcaugcuuuacagcacagaucugau

SEQ ID NO: 261647 - RNA, 64 nt, Human
agcugcugcugugguguggcccacuggagcaaacugcuggcaccuauucuggguugcuugugaa

SEQ ID NO: 261648 - RNA, 64 nt, Human
cccccugccccagcaagacucgcagugggauggcugcuggcaugcccacccugcaugcgcuuug

SEQ ID NO: 261649 - RNA, 64 nt, Human
uuuaaggagacacacucauucauccccuacuaugugcuggcagcuuuaccuuugucauuucauc

SEQ ID NO: 261650 - RNA, 64 nt, Human
ugggacugggacagucuuuagauauuauuugaaaugcuggcacugucuaucuggaucccagggc

SEQ ID NO: 261651 - RNA, 64 nt, Human
gcccaggagacugguuucccggugacacauccauugcuggcaaugagugugccagaguuauuag

SEQ ID NO: 261652 - RNA, 64 nt, Human
ccaccaguuuugcagguggcaucagaggcuggcaugcuggcaggaacauccccucuuagcccca

SEQ ID NO: 261653 - RNA, 64 nt, Human
gcaguucacaaguaguacuggcuccaccccuuggugcuggcaguguuuggggacauuaugcugg

SEQ ID NO: 261654 - RNA, 64 nt, Human
cuuauuuguguaauaaaguuaaugcaaguagaagugcuggcacugaaauccagaacaugauggg

SEQ ID NO: 261655 - RNA, 64 nt, Human
gucagccguggccccaccuaccagaacugugcucugcuggcagcugugcuuuugccaaacccag

SEQ ID NO: 261656 - RNA, 64 nt, Human
aucaaccgcuucugcuuccaagucacacggcugcugcuggcacacggggccgaccccagcgagu

SEQ ID NO: 261657 - RNA, 64 nt, Human
aauggcagagcagucuaaacagaguccgggagaaugcuggcaaaggcuggcuguguauacccac

SEQ ID NO: 261658 - RNA, 64 nt, Human
ccucgugggaugagaggaguuguggcuuugugucugcuggcaccaagagggcugagggugaggu

SEQ ID NO: 261659 - RNA, 64 nt, Human
gcuugagcugaaagaugccagagccggagaugucugcuggcagcaggcaggguucauucuggug

SEQ ID NO: 261660 - RNA, 64 nt, Human
cccuguauccacuugggagagagccucuacaacaugcuggcaacuucccccucacugauucaaa

SEQ ID NO: 261661 - RNA, 64 nt, Human
uuaauguucccgacucgggugauuccagcuguguugcuggcaguguugucucaacccucucccu

SEQ ID NO: 261662 - RNA, 64 nt, Human
cuucuucugccacuccucccugcuugcaucucguugcuggcagaguccucuuguacuucaagaa

SEQ ID NO: 261663 - RNA, 64 nt, Human
cugacuuuuucuaaccucuuauagacaugccaaaugcuggcaaaaagaagugcuuuuuggauau

SEQ ID NO: 261664 - RNA, 64 nt, Human
gcuuugccaugccuguuuuccuaaauaaaacaguugcuggcauuugcacauccacaacguguug

SEQ ID NO: 261665 - RNA, 63 nt, Human
acuguggccaguugagcuaaucuguggccagggugcuggcaugguggcagcugcaaaugucca

SEQ ID NO: 261666 - RNA, 64 nt, Human
ucaggacguucauguggaugguuucaugucaucgugcuggcaacuuguccucccugccuuagag

SEQ ID NO: 261667 - RNA, 64 nt, Human
gauacauuaaauauauuuaugcgaguugcaacuaugcuggcaacuggaggcaacagaaagaaau

SEQ ID NO: 261668 - RNA, 64 nt, Human
cgccugugcugacgaggcccggagcugcuccugcugcuggcaacaaaggauucgggaggcugau

SEQ ID NO: 261669 - RNA, 64 nt, Human
gaugagcgacgaguuugguuuuagcuggggauugugcuggcauccugcgaagcuccucccagcc

SEQ ID NO: 261670 - RNA, 64 nt, Human
aaaaugcuguaaagaaaauagaaaugcgauagagugcuggcaggcuaguguagauaaguggucu

SEQ ID NO: 261671 - RNA, 64 nt, Human
gagagcuguggcaaggucaccccacugaggaugcugcuggcagccuggggaaggagccaguuuu

SEQ ID NO: 261672 - RNA, 64 nt, Human
agccaggaagacggcccucaccagacaccaugucugcuggcaccuugaucuuggaccucccagc

SEQ ID NO: 261673 - RNA, 64 nt, Human
uccugaugagugagcugacgcuggugcuggaaccugcuggcaccucacuggccacaucuuugga

SEQ ID NO: 261674 - RNA, 64 nt, Human
uggauucuuuuuggaaacugagcgaaauccaagaugcuggcaccaagcguauuccguguggccc

SEQ ID NO: 261675 - RNA, 64 nt, Human
cuauucauguucuuuagcuagagccuguacuuuuugcuggcauuugaauaacccaguuuaaaaa

SEQ ID NO: 261676 - RNA, 64 nt, Human
aucucucucaguuguguauuuguucaucuucauaugcuggcaggaacaacuauuaauacagaua

SEQ ID NO: 261677 - RNA, 64 nt, Human
cuugcauggcgccugcuggaggaggagagagcucugcuggcaugagccacaguuucuugacugg

SEQ ID NO: 261678 - RNA, 64 nt, Human
gcccugcaugccuuccugcucgugcacuccaagcugcuggcauucuacucuaggugagcucaag

SEQ ID NO: 261679 - RNA, 64 nt, Human
ccaggcagaucgauuuuuagaucaauuuuuacagugcuggcaacuugguggugugggaugcucc

SEQ ID NO: 261680 - RNA, 64 nt, Human
cuggagccaacaccgccagccacccccucuggccugcuggcaaugccacaggugcccaagaaga

SEQ ID NO: 261681 - RNA, 64 nt, Human
ccaguguccugccccugcuuggcccaguuuugauugcuggcaucuugccaccccagguaucccu

SEQ ID NO: 261682 - RNA, 64 nt, Human
ugaguuuuguggugcuguagguaacguguggcacugcuggcaaaugaaggucaugagaugaguu

SEQ ID NO: 261683 - RNA, 64 nt, Human
augccacuaagaacaaaagcucugaaguucuuccugcuggcaccaaauauuaggauuacaagcu

SEQ ID NO: 261684 - RNA, 64 nt, Human
cugagggggugugggcccaggcagggcuggggugugcuggcaucgacagcccccacucugggca

SEQ ID NO: 261685 - RNA, 57 nt, Human
agaaaaagaccacggagugacugagcuugcuggcagucacgucaguuauguagauac

SEQ ID NO: 261686 - RNA, 64 nt, Human
gacaggccuuaauacugugagaggauccuugcucugcuggcaguuucccacuccuaugcacuuu

SEQ ID NO: 261687 - RNA, 64 nt, Human
gaucugcauccuuaggaaucugggauuugccaguugcuggcaauguagagcaggcauggaauuu

SEQ ID NO: 261688 - RNA, 64 nt, Human
cuucacugucucuuccuacauuaccacuacuacaugcuggcaaaggugaaggaucagaggacug

SEQ ID NO: 261689 - RNA, 64 nt, Human
gcgagacugcagcgauggauuggugugucuccccugcuggcacuucuccccucccuggcccuuc

SEQ ID NO: 261690 - RNA, 64 nt, Human
ggggcggagcuggggucugggcagugccacagccugcuggcagggccagggcaaugccaucagc

SEQ ID NO: 261691 - RNA, 64 nt, Human
aggcuucagagcgagcacgacagggcucagaugcugcuggcagaguugucucgggagcggggug

SEQ ID NO: 261692 - RNA, 64 nt, Human
caugggucuuggagaucuucuguucaaaguacagugcuggcacuggggcacagagugcccacgu

SEQ ID NO: 261693 - RNA, 64 nt, Human
agaaauccugacaccaagaagggccccucgcucuugcuggcagggcagcagggggacugaaggc

SEQ ID NO: 261694 - RNA, 64 nt, Human
ugaaauuuaaacugcaaugccaguccugcaggagugcuggcauuacccucugcagaacagugaa

SEQ ID NO: 261695 - RNA, 64 nt, Human
cuuucagucuauccaaaguagcaacuuaacuaguugcuggcaacugaauacccagaguagugga

SEQ ID NO: 261696 - RNA, 64 nt, Human
ggcgugugaagacugaaguguucuucaguaauugugcuggcacuuaggagagagaggaggggga

SEQ ID NO: 261697 - RNA, 64 nt, Human
ccacugccacccacggcccuccuuuugugcuccaugcuggcaucuucacuccccuaccccuucc

SEQ ID NO: 261698 - RNA, 64 nt, Human
acuugaagugugugguggccgugggggagggacaugcuggcagcaggcgccuucuucagcugug

SEQ ID NO: 261699 - RNA, 64 nt, Human
uucuacacauuaacuugagcugcuggagggacacugcuggcaaacggagaccuauuuuuguaca

SEQ ID NO: 261700 - RNA, 64 nt, Human
gcaucuuauagcagugccuuugucucagggccucugcuggcagucuagaccuuuugggcagaaa

SEQ ID NO: 261701 - RNA, 64 nt, Human
uugggggguaguuggaucugggugucugguccauugcuggcaguggacauuauucuugcccuaa

SEQ ID NO: 261702 - RNA, 64 nt, Human
ccagguuacuugcuucuaggacucuuggccaugcugcuggcaguggagaccuucucugagcugc

SEQ ID NO: 261703 - RNA, 64 nt, Human
cucacagcugucaucacugaguuugcccugcagcugcuggcaccugguaccuaccagccccgcc

SEQ ID NO: 261704 - RNA, 64 nt, Human
guuuguagcgucaccucaggucuggggaagucugugcuggcaucuccucauugugccuucauca

SEQ ID NO: 261705 - RNA, 64 nt, Human
ugggccucugggaugcccgccccauugcugccaaugcuggcagccccuccccuggcauggcagg

SEQ ID NO: 261706 - RNA, 64 nt, Human
cagggagggagggagcaagugugaagggcacagcugcuggcaaaugccccauucccugccccag

SEQ ID NO: 261707 - RNA, 64 nt, Human
caagaauuguuaccugucauuuugcacuguaaauugcuggcagaugcuuuacagucaauagugu

SEQ ID NO: 261708 - RNA, 64 nt, Human
uuguguagggaguggcauuuguggaaaccagaugugcuggcagcuuagggggaaguggcagugu

SEQ ID NO: 261709 - RNA, 64 nt, Human
cuggauuucugcccaagaccagaggagugugcugugcuggcaaguguaagucccccaguugcuc

SEQ ID NO: 261710 - RNA, 64 nt, Human
cuagggaggugggguagagcacucuccguccugcugcuggcaaggaaugggaacaguggcuguc

SEQ ID NO: 261711 - RNA, 64 nt, Human
uaagaccaaauuauggaaaauaagaaaaagcuguugcuggcaagaccaucaagacuguucugac

SEQ ID NO: 261712 - RNA, 64 nt, Human
gcggaguuuuuuguuuguuuauuuuaguagcugaugcuggcacaucauuuugcuggagaguuuu

SEQ ID NO: 261713 - RNA, 64 nt, Human
guugguuuuuucuuucucccuuccucccgcucucugcuggcacgcgaggcuuccccuuccaccc

SEQ ID NO: 261714 - RNA, 64 nt, Human
gcccacuggccugaaucuacacuggaagccaacuugcuggcacccccgcuccccaacccuucuu

SEQ ID NO: 261715 - RNA, 64 nt, Human
gaaccuaagagcgcacaccagguggagcaggugcugcuggcauauuccaggugcauccaggugc

SEQ ID NO: 261716 - RNA, 64 nt, Human
cccccaggcugcccuggcacccaaauugcugccaugcuggcaucuguagcucgguggcuugaca

SEQ ID NO: 261717 - RNA, 64 nt, Human
gggugugggggcccugggugaaugcugcugccccugcuggcagccaccuugagaccucaccggg

SEQ ID NO: 261718 - RNA, 64 nt, Human
agauuuuauuggucuacccuuuucucacuguagcugcuggcagcccugugccauaucuggacuc

SEQ ID NO: 261719 - RNA, 64 nt, Human
uuucgcagcccccuucucaucuccacccaagaagugcuggcaccgauguuuaacucaggccacc

SEQ ID NO: 261720 - RNA, 64 nt, Human
uggacaguccugugucuggaugaggaggacucagugcuggcagauggcaguggaagcugcccug

SEQ ID NO: 261721 - RNA, 64 nt, Human
agucggggaagcugcggcuacacauuccacaaagugcuggcacuuacacccacaacccggaagg

SEQ ID NO: 261722 - RNA, 64 nt, Human
gucacuaaauuccugggauggaaguaaaagacaaugcuggcaacugggcucuaaucuccuaaag

SEQ ID NO: 261723 - RNA, 64 nt, Human
uuuccugccaugcuuucggccuuugguguggaggugcuggcauucagucugcuagaggcagagg

SEQ ID NO: 261724 - RNA, 64 nt, Human
gcucgggacagcuggucuuuccggccaucuuucuugcuggcaagucagcaaacauuaccuucuu

SEQ ID NO: 261725 - RNA, 64 nt, Human
caucccaaauuuccccugccaugugugcugauccugcuggcaggaccacauuucuuugccacug

SEQ ID NO: 261726 - RNA, 64 nt, Human
guggggugaagagaucuugugauuuuuaagaaccugcuggcaagaguuuaacuugucuucagca

SEQ ID NO: 261727 - RNA, 64 nt, Human
auuggcauuugaacaaaagacuuacuuacaaaguugcuggcagauguauuugaugguuacucuu

SEQ ID NO: 261728 - RNA, 64 nt, Human
ucugacaucaugguguuuucuuaaugccucacauugcuggcacggggaugugcccugccugcca

SEQ ID NO: 261729 - RNA, 64 nt, Human
uuucauagauaccauuuugaaauauucacaagguugcuggcauuugcugcauuucaaguuaauu

SEQ ID NO: 261730 - RNA, 64 nt, Human
gaaagacagaccuaaugacuggcauuugagaugcugcuggcauuuugaauucaacaucugcuga

SEQ ID NO: 261731 - RNA, 64 nt, Human
guggggcacgggguaggggaaauggggugaacggugcuggcaguucggcuagauuucugucuug

SEQ ID NO: 261732 - RNA, 64 nt, Human
ccuuauuccccagguuaggcgagccagaggauugugcuggcaucgugucuuuccugugcucuga

SEQ ID NO: 261733 - RNA, 64 nt, Human
gccaaagaauagacuuaaugaagaagugcccacaugcuggcaggggccggcccacucuggccag

SEQ ID NO: 261734 - RNA, 64 nt, Human
agaagguacccaaagggaaaaagagaaaagcugaugcuggcaaggagcgggaaggugcuggaga

SEQ ID NO: 261735 - RNA, 64 nt, Human
ccucaggugguccacccgccucggccucccaaagugcuggcauuacaggcgugaaccaccgugc

SEQ ID NO: 261736 - RNA, 64 nt, Human
ccaucggagaacuuaccaucccccaaauauauccugcuggcacuacaccuucguaacugcuguu

SEQ ID NO: 261737 - RNA, 64 nt, Human
gcuggcucccuuggcugugggcagguagcacgccugcuggcagagguaccugguggcugcccug

SEQ ID NO: 261738 - RNA, 64 nt, Human
ggcggugaguguaaggaugcagugggagcauggaugcuggcaucuuagaacccucccuacuccc

SEQ ID NO: 261739 - RNA, 64 nt, Human
ugacucuuaggaagagcacacaugagggcaaggcugcuggcagacgucuccauuguccuuaugu

SEQ ID NO: 261740 - RNA, 64 nt, Human
ucaagugaucugcccgccucgaccucucucaaagugcuggcauuacaggugugagccacggugc

SEQ ID NO: 261741 - RNA, 64 nt, Human
ggccagaaagagggcugucaacaggaacugcgucugcuggcaccuugaucuugaacuucccagc

SEQ ID NO: 261742 - RNA, 64 nt, Human
cacggaugagccgaauagccagucagcauguugcugcuggcagccugugccuuugucagcucuu

SEQ ID NO: 261743 - RNA, 64 nt, Human
cauuugauuaugguauauaaaccuuuuuguuuauugcuggcacauuucuuuuucuuuuucuuuc

SEQ ID NO: 261744 - RNA, 64 nt, Human
gccuucucuucugugcaccuaaguugcccagcccugcuggcaaucucuccaucagaauccaccu

SEQ ID NO: 261745 - RNA, 64 nt, Human
uccgccacagggcucugagcugcacuggccccggugcuggcaucugguggagcggacccacucc

SEQ ID NO: 261746 - RNA, 64 nt, Human
ggauuggggaugacaggaaucucacccucuggggugcuggcaaggaggucuuugcacaggaaaa

SEQ ID NO: 261747 - RNA, 64 nt, Human
cuguaccagcacagccugggggagcuacugcuguugcuggcaggcgggagcugcuucacacuga

SEQ ID NO: 261748 - RNA, 64 nt, Human
ccaacaggaggugguggggucugacguguccaagugcuggcagacacccuggucacccaggaca

SEQ ID NO: 261749 - RNA, 64 nt, Human
ccucaagugaucuacccgccuuggccucccaaagugcuggcauuacaggugugagccaccgugc

SEQ ID NO: 261750 - RNA, 64 nt, Human
ccgggaccugccugucagaucugaggugucuccuugcuggcagagugcgcucacgcgagggcug

SEQ ID NO: 261751 - RNA, 64 nt, Human
ucugauuuauggugauuuucuuaagaaccagaacugcuggcagaaagggggcacccacacgcuu

SEQ ID NO: 261752 - RNA, 64 nt, Human
guagugggaaccaacagcugggcuggagaguuggugcuggcaaaacaguccuugcccuggggcc

SEQ ID NO: 261753 - RNA, 64 nt, Human
gaugcgcugcugucugagaggaagggcugacacuugcuggcauggccucugcgggcuucgucau

SEQ ID NO: 261754 - RNA, 64 nt, Human
aaccucuucuuccccucuuccagagcuuccacggugcuggcaaaguccugcagcuucuucuucg

SEQ ID NO: 261755 - RNA, 64 nt, Human
aucucuacaaagauguaaaaaaauuagccacaugugcuggcacuuaccuguagucccagcuacu

SEQ ID NO: 261756 - RNA, 64 nt, Human
ugcacacuccccugcacuggaguccagucucuucugcuggcagaaagcaaaugugaccuguguc

SEQ ID NO: 261757 - RNA, 64 nt, Human
gaacaugauagcuuguauccagcagaguggcacgugcuggcacaccucacagaagcacccuggc

SEQ ID NO: 261758 - RNA, 64 nt, Human
caccuucuggucucagcaagggaggagagucuguugcuggcauagcccuggaaggagcccccag

SEQ ID NO: 261759 - RNA, 64 nt, Human
cccacccuccuggaagagacccccguguucagagugcuggcagcccugcacguguccagggaca

SEQ ID NO: 261760 - RNA, 64 nt, Human
ccaggaauauaugucagugaugacuauucucaaaugcuggcaaauccaggcugguguucugucu

SEQ ID NO: 261761 - RNA, 64 nt, Human
agagguuuucagauggaagugagaggugacagugugcuggcagcccucacagcccucgcuugcu

SEQ ID NO: 261762 - RNA, 64 nt, Human
ucauuuagcaccaugcugcuucugucugucuuaaugcuggcauuaagaucaugagcccuuuuuc

SEQ ID NO: 261763 - RNA, 64 nt, Human
caccgcacaguucuggccacagcucccgcuccugugcuggcacuucugugcucgcagagcaggg

SEQ ID NO: 261764 - RNA, 64 nt, Human
uguggcccugugugggaccacacugucaucucgcugcuggcagaaaagccugaucccaggaggc

SEQ ID NO: 261765 - RNA, 64 nt, Human
aaguagcauggaaccuacgucuuucccuacugcuugcuggcauauaucaguugguaugaacauu

SEQ ID NO: 261766 - RNA, 64 nt, Human
uuguggaguuacagccucaagguuguagcaugugugcuggcaaucagggccgcaguguguucug

SEQ ID NO: 261767 - RNA, 64 nt, Human
cccuuggcccuagcccuugcugcgcagaacagcuugcuggcagcuggcaucgugucgcuuuauc

SEQ ID NO: 261768 - RNA, 64 nt, Human
cacuguugucccaccgaauggacagcuuugcaggugcuggcacuaacuucauugacaccugagu

SEQ ID NO: 261769 - RNA, 64 nt, Human
cugucggcccgagacauuuggaaguccugggggaugcuggcaaaucucagcuguugcugaggag

SEQ ID NO: 261770 - RNA, 64 nt, Human
gugagcaccaaccugcugcagucucuugggccccugcuggcagcucugccacgucaccgccugc

SEQ ID NO: 261771 - RNA, 64 nt, Human
auaaaugggccuggcagccucggcucuuugcggcugcuggcaggacugagcuguccggguucuc

SEQ ID NO: 261772 - RNA, 64 nt, Human
gggagggaagggcugggaugcugggaccuguuguugcuggcaaagccagaggucacaguggccu

SEQ ID NO: 261773 - RNA, 64 nt, Human
ccaggccagguagcaagagagcagcgcccaggccugcuggcaucaggucugggcaaguagcagg

SEQ ID NO: 261774 - RNA, 64 nt, Human
gaggguccaucagcugccuccagcauccaguggcugcuggcauacagccucauccccacguccc

SEQ ID NO: 261775 - RNA, 64 nt, Human
aguaauuugagaacuuuaagguugucuuuuuaacugcuggcaaaauguugauuuuuuaauauua

SEQ ID NO: 261776 - RNA, 64 nt, Human
ucaaucaaaggaacucugggaaggagguugugauugcuggcaagucccccccaacuguaccacg

SEQ ID NO: 261777 - RNA, 64 nt, Human
gugaccagaaacacagaaggugagaucacagcucugcuggcagagauuacuagcccuuggcucu

SEQ ID NO: 261778 - RNA, 64 nt, Human
aagggacacaguggacgaggggagaguccucaucugcuggcauuuugugggguguuagugccaa

SEQ ID NO: 261779 - RNA, 64 nt, Human
gaggacaaggugguucuguggccuuuucccucuuugcuggcacguucugcuucucacccucugg

SEQ ID NO: 261780 - RNA, 64 nt, Human
gggaaagacugaagaaacacaucucgugcagaucugcuggcagaggacaaucaaaaacgacaac

SEQ ID NO: 261781 - RNA, 59 nt, Human
uggcagcaauauuggugugauugagguuaugcuggcaccacucgcacacaggcgcacaa

SEQ ID NO: 261782 - RNA, 64 nt, Human
ucuacugacccucccagggcauuccagcucaagcugcuggcaggaacugaccaguucuguccuu

SEQ ID NO: 261783 - RNA, 64 nt, Human
gauaaucggugcagcgguggaaggagccugcggcugcuggcacagacuucacacagcaccuccu

SEQ ID NO: 261784 - RNA, 64 nt, Human
cugucucuaagcccccuucccuuccacuaugagcugcuggcaguggguuuguauucgguuccca

SEQ ID NO: 261785 - RNA, 64 nt, Human
auguguccucagggagcagggaaggccugacuucugcuggcaucaagaggugggagggcccucc

SEQ ID NO: 261786 - RNA, 64 nt, Human
agaauaaauaucugcugcucugcucaccaauugcugcuggcagccucucccguccucacuggcu

SEQ ID NO: 261787 - RNA, 64 nt, Human
cacaucuuugaccacgucaucgggccagaaggcgugcuggcaggcaaggugaggccugccagag

SEQ ID NO: 261788 - RNA, 64 nt, Human
gcugcuuuaggaauucugcaaggguucuuggugaugcuggcagccauggccauggcagcgggug

SEQ ID NO: 261789 - RNA, 64 nt, Human
cucgccucccugccugugcuggccuggccuugccugcuggcaccauuggaguaggagggggugg

SEQ ID NO: 261790 - RNA, 64 nt, Human
cuuacccugguuaggucacuacuuuugcagauuuugcuggcacugaucuggagaucugcagauc

SEQ ID NO: 261791 - RNA, 64 nt, Human
ccacagacugccccggagaccuggaggacagcagugcuggcacuuggguguccaugggcccguc

SEQ ID NO: 261792 - RNA, 64 nt, Human
uccugggcccccaccauucacuuuuuguccuugcugcuggcaaacaguaaagaaacucacuuuc

SEQ ID NO: 261793 - RNA, 64 nt, Human
caggagagcucgggcccugugaccacgaucuacaugcuggcagggaagccccgcggauccgaag

SEQ ID NO: 261794 - RNA, 64 nt, Human
auuuucucuaacuucaaggcccauaucugugaaaugcuggcauuugcaccuaccucacagagug

SEQ ID NO: 261795 - RNA, 64 nt, Human
uccagagcuggcccaagacccuuagaacccugagugcuggcaaaucucacugcuccugacccag

SEQ ID NO: 261796 - RNA, 64 nt, Human
uuguccacugcaguaggcaccggccacaugugacugcuggcaugaaauagaagugcaguuccuc

SEQ ID NO: 261797 - RNA, 64 nt, Human
gggccgcugggccaccgagcugcccuggaugggcugcuggcaugccaacucggggagcgcccug

SEQ ID NO: 261798 - RNA, 64 nt, Human
ccgugccauaucccaggaggaccagcuggcccccugcuggcaggcugaacacccugcggagcgg

SEQ ID NO: 261799 - RNA, 64 nt, Human
ucccgguuucuucuuucaaaauuuccucuccaucugcuggcaccugaggagagugagcagccug

SEQ ID NO: 261800 - RNA, 56 nt, Human
gccagucucuaugcugcuagcccaucugcuggcaaaccaccugcuacaggaccacc

SEQ ID NO: 261801 - RNA, 63 nt, Human
aucuucuuugugagccucuuaauaaauuugagcaugcuggcauaaccuaauuaguucucuugc

SEQ ID NO: 261802 - RNA, 64 nt, Human
uccccaccuuacucggauggccucccugccccucugcuggcacagccugggcaaggggagaagg

SEQ ID NO: 261803 - RNA, 64 nt, Human
ggcccgagcagaagcaggauaguugcuccgccucugcuggcacauuuccccagaccugagcucc

SEQ ID NO: 261804 - RNA, 64 nt, Human
gaguuggccugacccgcuuggaucagugaccauuugcuggcagacaggggagagcagcuuccag

SEQ ID NO: 261805 - RNA, 64 nt, Human
ggccuucacagagacccugugggcccuggcccugugcuggcacugugccagucaugaggcagcu

SEQ ID NO: 261806 - RNA, 64 nt, Human
gcccuaacgggccauaacacuugaccaauucagcugcuggcagagggaggaaacaaguguuuuc

SEQ ID NO: 261807 - RNA, 64 nt, Human
cucuugccucccugaaggaccuguauacuguguaugcuggcauucacacucuacucacuggcug

SEQ ID NO: 261808 - RNA, 64 nt, Human
cugugccuucucauguuucauagacaguggucugugcuggcagaggcugcugccccugguuggg

SEQ ID NO: 261809 - RNA, 64 nt, Human
uguccugucggucucaguacguucacuuuauagcugcuggcaauaucgaagguuccuuuuuugu

SEQ ID NO: 261810 - RNA, 64 nt, Human
gcaaagaugaggagcccguguucccaucgggcccugcuggcagggacuugcaguggauucuugg

SEQ ID NO: 261811 - RNA, 64 nt, Human
ugugaccuuacccgcuaggugguuaauuuauccaugcuggcagaggcacucagguacuugguaa

SEQ ID NO: 261812 - RNA, 64 nt, Human
uuaauguugaugucauggagugacagaauggcuuugcuggcacucagagcuccucacuuagcua

SEQ ID NO: 261813 - RNA, 64 nt, Human
acuaggcuuccugcguguguaaaagucgagguauugcuggcauucagggugacaugaugguacu

SEQ ID NO: 261814 - RNA, 64 nt, Human
augacaucaucaccaguaauaguugcauugauacugcuggcaccaguuaauucugggauacagu

SEQ ID NO: 261815 - RNA, 64 nt, Human
cuauaacuucauccucaguauguucccaaaucugugcuggcauugaaaggacaaaacauuauac

SEQ ID NO: 261816 - RNA, 64 nt, Human
auacaaauguuugcccugguaauuagcaaugaacugcuggcaguuucuucagcuguguauauac

SEQ ID NO: 261817 - RNA, 64 nt, Human
aaauguucaccuagagguguucugguaaacugauugcuggcaacaacagauucucuuggcucau

SEQ ID NO: 261818 - RNA, 64 nt, Human
aaauguucaccugcagauguucugguaaacugauugcuggcaacaacagauucucuuggcucau

SEQ ID NO: 261819 - RNA, 64 nt, Human
ggccauaucccaauacguguagggcgagggucccugcuggcacauucaggcugugcugggaaga

SEQ ID NO: 261820 - RNA, 64 nt, Human
cagaucccggggggauucagcccuucucccacugugcuggcagaggcacuccugugacgcugaa

SEQ ID NO: 261821 - RNA, 64 nt, Human
uggggaacacacgauaccuguuuuucuuuuccguugcuggcaguacuguugcgccgcaguuugg

SEQ ID NO: 261822 - RNA, 64 nt, Human
cuucagcguucaccuuccuugucuccaguuccgaugcuggcagugguuccuaccucuguugggu

SEQ ID NO: 261823 - RNA, 64 nt, Human
agugcaaaagagggccuucaccagaacccaagcaugcuggcaccuugaccuuggacuuucagcc

SEQ ID NO: 261824 - RNA, 64 nt, Human
gcaggacuugggguugaggugagucauggccucuugcuggcaauggggugggaggaguaccccc

SEQ ID NO: 261825 - RNA, 64 nt, Human
gaggcugucuugcuauggcagggaggugacagccugcuggcacuguauauuuagugucuuacuu

SEQ ID NO: 261826 - RNA, 64 nt, Human
uguaaacccugaaucucaucuggggugggggcccugcuggcaacccugagcccuguccaagguu

SEQ ID NO: 261827 - RNA, 64 nt, Human
ggccaccugggccagccccuuguccucugccuucugcuggcagaggagcagcuggacuggggcc

SEQ ID NO: 261828 - RNA, 64 nt, Human
aagcaaugaaguaagaacuucauucaauaaguggugcuggcauaacuggcuagccauaugcagg

SEQ ID NO: 261829 - RNA, 64 nt, Human
cuucaaauuacccaccugccucagccucccaaagugcuggcauuacaggcgcucgaggcuuucu

SEQ ID NO: 261830 - RNA, 64 nt, Human
acucgggacugaggcauccucuguucacaggacaugcuggcaucuacugggucagggcucugcu

SEQ ID NO: 261831 - RNA, 64 nt, Human
ccccaguguuggccccaggaccugaucugaguucugcuggcagcuuccagaggauugccuuuuu

SEQ ID NO: 261832 - RNA, 64 nt, Human
ucucggggguguggggcccugugccuuccugaagugcuggcagcccaguggcaccuccuucagg

SEQ ID NO: 261833 - RNA, 64 nt, Human
gaccuuggccucaguucacagccuggugcucaucugcuggcaccgggcauccacccaucagccc

SEQ ID NO: 261834 - RNA, 64 nt, Human
auacuaggguccagaggccgacuggagcaagguuugcuggcagaugaggccucaguggaaguga

SEQ ID NO: 261835 - RNA, 64 nt, Human
gaaucaggcacaccuuuuccacgagacucgagugugcuggcauuucucacccuuucaucuuuag

SEQ ID NO: 261836 - RNA, 64 nt, Human
caucuccgugcugugcaucugaaggccagugcugugcuggcaggaaaauagggacugagaaaaa

SEQ ID NO: 261837 - RNA, 64 nt, Human
aagaccaucugaggccuaugccaucuggacugucugcuggcaauuucuuuuuuucuuucuuuuc

SEQ ID NO: 261838 - RNA, 64 nt, Human
uggaauagaaaagcccugcugcaucgagacacaaugcuggcagcugcggcaguguacagaggua

SEQ ID NO: 261839 - RNA, 64 nt, Human
gugacuucauccugaggagccacagcacaggccgugcuggcacuuucugcacacuggcucuggg

SEQ ID NO: 261840 - RNA, 64 nt, Human
agugagucuccaggucugccacacuggugcaccuugcuggcacggugccucaggaagguggcga

SEQ ID NO: 261841 - RNA, 64 nt, Human
uucugacacagugagcaacaagccuggguuucccugcuggcagacggcagaucccucaggaaac

SEQ ID NO: 261842 - RNA, 64 nt, Human
uuuauucgccaucugauccccaugccuagcagagugcuggcacuuaguagguccucaauaaaua

SEQ ID NO: 261843 - RNA, 64 nt, Human
uuuuuuuuuuuuuuuuuaguauuucagcaggaucugcuggcaggguuuuuuuguuuuauuuguu

SEQ ID NO: 261844 - RNA, 64 nt, Human
uggaugcuuugucauccaugcgugcacauaugggugcuggcagagcccccaaggacucuggccu

SEQ ID NO: 261845 - RNA, 64 nt, Human
cugcagaggagccccagggcaaggacagcucagcugcuggcagccugccuggcccauagacauc

SEQ ID NO: 261846 - RNA, 64 nt, Human
aucacuccagaagauccuuucaugugaaguuuuuugcuggcauuucaaccuuugggacaucuuc

SEQ ID NO: 261847 - RNA, 64 nt, Human
guaacaccccagcugcuugagagaacaguguugcugcuggcagagaugcauuccagagaugcac

SEQ ID NO: 261848 - RNA, 64 nt, Human
acccaccauuguagccaccugugcgccaugaccaugcuggcagagucuuuccuguuccccauau

SEQ ID NO: 261849 - RNA, 64 nt, Human
accgcuggucacccagauccucauucaaacccacugcuggcacaucccuuuccuuacuuugccc

SEQ ID NO: 261850 - RNA, 64 nt, Human
aaccuucuccacauuccgcccaaucuguaccggaugcuggcagggagguggcagagagcucacu

SEQ ID NO: 261851 - RNA, 64 nt, Human
cugagaaaccacccagugccucaccuccagauccugcuggcaucaccuccagagcccugcaugc

SEQ ID NO: 261852 - RNA, 64 nt, Human
accaguccccuccccaguggggccccacugcaccugcuggcaggaaauaaaugaauguuuacug

SEQ ID NO: 261853 - RNA, 64 nt, Human
agcacguugaucugaacuuuaaaucaaucagugcugcuggcacaaugaaagguggaacugcacu

SEQ ID NO: 261854 - RNA, 64 nt, Human
uuuuguauguguuuuaucagaauuugcuggacuaugcuggcaaggacuuuguuuacgaucaaau

SEQ ID NO: 261855 - RNA, 64 nt, Human
uagacaggacagaggggugccugcccccugccccugcuggcacauuuaacccuuguccccugac

SEQ ID NO: 261856 - RNA, 64 nt, Human
gagccccguggagggaugacaguucaggcccuacugcuggcacgucagagcacugggaaguuuu

SEQ ID NO: 261857 - RNA, 64 nt, Human
cgccugauggagcagaaggugcuggaagccgaggugcuggcacugaagauggcugaggagucag

SEQ ID NO: 261858 - RNA, 64 nt, Human
acuugcugccgaauucccagaagugccucugcugugcuggcauaaaauaaccugaaaagauucu

SEQ ID NO: 261859 - RNA, 64 nt, Human
ggggcccagggcaucgcuaaacccaaaugggggcugcuggcagaccccgagggugccuggccag

SEQ ID NO: 261860 - RNA, 64 nt, Human
agaucuagguuguggcugcugguaugcuucagcuugcuggcaaugaugugccuugacaaccgug

SEQ ID NO: 261861 - RNA, 64 nt, Human
gucgggagugacaagcucagagagcaugaacugaugcuggcaugaaggauuccaggaagaucau

SEQ ID NO: 261862 - RNA, 64 nt, Human
ucacacccaggagcugccccugcugugccugguaugcuggcaguggugauggugacaacacaau

SEQ ID NO: 261863 - RNA, 64 nt, Human
ccuuacuuuguuuccugaagugauagccuacuaaugcuggcaagcagaugcuuaauaguaaauu

SEQ ID NO: 261864 - RNA, 64 nt, Human
guaccuaucgcucacugcaugcucgccucccucuugcuggcaucccggccuguuucaaugacua

SEQ ID NO: 261865 - RNA, 64 nt, Human
ccagcauuugcacaccacuacucacccucucugcugcuggcauguugguagagucaucccugua

SEQ ID NO: 261866 - RNA, 64 nt, Human
aaacugaaauuuagccuuacucccaaguuauaaaugcuggcaacaaaucacaguaguaaaagca

SEQ ID NO: 261867 - RNA, 64 nt, Human
cggucucccacuuccggccuagucugccagcuuuugcuggcacguaggcuaccacucuccgggc

SEQ ID NO: 261868 - RNA, 64 nt, Human
gucuaauaggagguuugagcucaaaugcuuaaacugcuggcaacauauaauaaaugcaugcuau

SEQ ID NO: 261869 - RNA, 64 nt, Human
ggagaggaggauggaagggagggguccggcacgcugcuggcauuuugcuguguccugcagcccc

SEQ ID NO: 261870 - RNA, 50 nt, Human
cuaccaagaacaaagcauaaugcuggcaauuaaaaaugugguuuaguuuu

SEQ ID NO: 261871 - RNA, 64 nt, Human
acugcauggugccagugcuaaugcuucauccuguugcuggcagugggauguggacuuagaaaau

SEQ ID NO: 261872 - RNA, 64 nt, Human
agcucaguucaccaugauucucuucugucaccucugcuggcacaccaguggcaaggcccagaau

SEQ ID NO: 261873 - RNA, 64 nt, Human
ccugccccccccgccccgccaaaagccgagggggugcuggcaggcgggccucaggggcugucuu

SEQ ID NO: 261874 - RNA, 64 nt, Human
aaguucaguaauugcuuauuguauuaguuuuagaugcuggcacugcaugugcucuguuuauucu

SEQ ID NO: 261875 - RNA, 60 nt, Human
cggggccggugugcuguugagccaggacugugcuggcaccccacagggagccuuggagcc

SEQ ID NO: 261876 - RNA, 64 nt, Human
ugccccacgguguccccgccgggaagcagccccggcuccugaaucacccucgcuccgucaggcg

SEQ ID NO: 261877 - RNA, 64 nt, Human
ggauagaugcagaaacaaggaagaaauggagucugcuccugagaagcuucaaauucaggccagg

SEQ ID NO: 261878 - RNA, 64 nt, Human
gccuuccucgugccugggaggucguucuagggaugcuccugaccuccgucucuuggaccuaaga

SEQ ID NO: 261879 - RNA, 64 nt, Human
ccuggcuuugggaccuugugcugagggaugauuugcuccugaccuugauuaacuuaacaguucc

SEQ ID NO: 261880 - RNA, 64 nt, Human
augcccucugggguugucugguucccagugagaggcuccugagaaaaauaaagcugguucccag

SEQ ID NO: 261881 - RNA, 64 nt, Human
ucuaguacuucccaggcaaauaggccccuuugaggcuccugagugcccucagauggucaaaacc

SEQ ID NO: 261882 - RNA, 64 nt, Human
agaucccacugagaaaauccacccuggcaucugggcuccugaucagcugauggagcuccugauu

SEQ ID NO: 261883 - RNA, 64 nt, Human
acccuggcaucugggcuccugaucagcugauggagcuccugauuugacaaaggagcuugccucc

SEQ ID NO: 261884 - RNA, 64 nt, Human
cccuggaccccaggcucuuagagacuaaggggcagcuccugaccaaagacgauacagcuuggca

SEQ ID NO: 261885 - RNA, 64 nt, Human
gaccuccugaccucugacccuggccagcacucuagcuccugaccuuugacccgagggccaccuc

SEQ ID NO: 261886 - RNA, 64 nt, Human
cuggccauagauaccuuugggcugccugggacaggcuccugaggaggauugagggugaaagucu

SEQ ID NO: 261887 - RNA, 64 nt, Human
uagaguuggagggggaggccccugaggcagcccagcuccugaauaaagauucuacaacacacga

SEQ ID NO: 261888 - RNA, 64 nt, Human
ggguacggcugaccaggaaugaagguugaacucugcuccugagcacggugcgugcaaagcauau

SEQ ID NO: 261889 - RNA, 64 nt, Human
cacuucuuggagauuucagacaggcagcaccagggcuccugacugaaaggggaguuggugggcc

SEQ ID NO: 261890 - RNA, 64 nt, Human
guguggaauguggugaccuagucaccuggaaccagcuccugacagaccccggcaacuucuagau

SEQ ID NO: 261891 - RNA, 64 nt, Human
agcuuggguucuaaagugauuuaaucaaauucaugcuccugaucuuuuuuuucccccuuccuuu

SEQ ID NO: 261892 - RNA, 64 nt, Human
ucuaaaaagaugucccuuacccucauucuggagggcuccugagccucugcguaaggcugaacgu

SEQ ID NO: 261893 - RNA, 64 nt, Human
uauguucccccacaugcaggugguuuuucaguaggcuccugaagagugaucucaacuuuccagg

SEQ ID NO: 261894 - RNA, 64 nt, Human
ggucuagccaucaugacaccucuggaggugucaagcuccugaaacaagcucauuucaguuucug

SEQ ID NO: 261895 - RNA, 64 nt, Human
ugcgcggcccagccauuuccacccucgggaggcggcuccugagaaacagggaggaaggggcgga

SEQ ID NO: 261896 - RNA, 64 nt, Human
cuggagcuagugucuccucucugguggcugggcugcuccugaaugaggcggagcuccaggaugg

SEQ ID NO: 261897 - RNA, 64 nt, Human
acccggccuggucugucuccaccauccugacugggcuccugagcuucaugguggagaagggccc

SEQ ID NO: 261898 - RNA, 64 nt, Human
caccaccaucugcccuggcagccuggcugcuccagcuccugacagcaccugugucugagcagcc

SEQ ID NO: 261899 - RNA, 64 nt, Human
uguuucuuugugcggucaggaauuauuuccaaaugcuccugaagccuaguguuuuagugaacau

SEQ ID NO: 261900 - RNA, 64 nt, Human
gggcguccaggacccugagggccauggccaaaaggcuccugagugugccugguggucuggcugg

SEQ ID NO: 261901 - RNA, 64 nt, Human
cccuuucucggggcuuggggcucgggccguaggggcuccugagugucaugaagugcacaggagc

SEQ ID NO: 261902 - RNA, 64 nt, Human
uaggggccugggagcccuguggcuggaucugagugcuccugagcuggcuucagcugcagaacuc

SEQ ID NO: 261903 - RNA, 64 nt, Human
cugguuuaaaauaugaaguugguuuuguuggauggcuccugagcugacugacugaugucugaag

SEQ ID NO: 261904 - RNA, 64 nt, Human
uguauuuccucuccccauuuucaggcccuguggggcuccugagguucaguagcugggauguucc

SEQ ID NO: 261905 - RNA, 64 nt, Human
gcagugguauagucauagcucacugcaaccuccagcuccugagcucaagugguccuccugcuuc

SEQ ID NO: 261906 - RNA, 64 nt, Human
aaauuaauaaauaaaaagucucaggugaccaaaggcuccugaagcuagaaccagguuuggauaa

SEQ ID NO: 261907 - RNA, 64 nt, Human
uuugacacacuccaacaauccgaaggggcauguugcuccugagcagcaugaagaacugaccaaa

SEQ ID NO: 261908 - RNA, 64 nt, Human
aagauacuuagggaaaacaggagccuaccacaaggcuccugaucauucuggagucacuguuucu

SEQ ID NO: 261909 - RNA, 64 nt, Human
ccccucucccuagcuucuccuguuagcuccuucugcuccugaccccaccuccuugcucuuggcg

SEQ ID NO: 261910 - RNA, 64 nt, Human
cuuagggaaggguuaaugaugucgccacaggucagcuccugauccuugccgacuugauguugcu

SEQ ID NO: 261911 - RNA, 64 nt, Human
caguucgcugggaccagugcuaauggcagcuucugcuccugacccccaucaggucucuuuccuc

SEQ ID NO: 261912 - RNA, 64 nt, Human
cucaaaucuucauuuaucucuggccuuaacccuggcuccugaggcugcggccagcagagcccag

SEQ ID NO: 261913 - RNA, 64 nt, Human
uccaggucuagaaggccaggccucuacuaggucugcuccugaaccaguccugcugccuggaguc

SEQ ID NO: 261914 - RNA, 64 nt, Human
gaaguccuggccuaaggauuuuauuacacugucugcuccugaugacccucugcgguugucaggc

SEQ ID NO: 261915 - RNA, 64 nt, Human
uugugccuguagcucauuuuauuaugaccuauaugcuccugauuuaaagagaucuguguacugu

SEQ ID NO: 261916 - RNA, 64 nt, Human
gcagcagugacagcuucaagaacuuaacagccuugcuccugaagaacuggcugcccaggaagcc

SEQ ID NO: 261917 - RNA, 64 nt, Human
gggugcugcugccacccgccccagccagccaccugcuccugacagccagcagcuguguauuuga

SEQ ID NO: 261918 - RNA, 64 nt, Human
ggcccuccuuccuaaauuuuccuguccucuuucagcuccugaccaguugcagucacucuaguca

SEQ ID NO: 261919 - RNA, 64 nt, Human
cagggaaaugaccgguggugcgguaaccugcguggcuccugauagcguuuggaagaacgcgggg

SEQ ID NO: 261920 - RNA, 64 nt, Human
gcaccugauguaucaucucaaacacaauaaacaugcuccugaaggcauaguuuccugucguaau

SEQ ID NO: 261921 - RNA, 64 nt, Human
cccagccgggcuacuaggacaggccagggcacuugcuccugagcccccaugguauuggggcugg

SEQ ID NO: 261922 - RNA, 64 nt, Human
aacugcccagccacggguuuuuaacccaccuguugcuccugaggucgucacuauaucaacaguc

SEQ ID NO: 261923 - RNA, 64 nt, Human
uguuuaaagaaauggugcuuugcucuguguuugugcuccugauuucccuggagguucuggauga

SEQ ID NO: 261924 - RNA, 64 nt, Human
guuuucaugaaaaaugggaagaucagacaacauugcuccugaauucccacagagcagcaagcua

SEQ ID NO: 261925 - RNA, 64 nt, Human
gccguggcauuccuacagaacagagugaggacaggcuccugauuccucuuccuucuuuagagga

SEQ ID NO: 261926 - RNA, 64 nt, Human
uaaucaaaaucauguauaccaucuucuauuuccagcuccugauuccccauagguaacaucccuu

SEQ ID NO: 261927 - RNA, 64 nt, Human
uuugagcuugcuuuuuuauguuuguguauugguugcuccugacacuauacauuucaaaauuuuu

SEQ ID NO: 261928 - RNA, 64 nt, Human
cucaaggcucccucgcuugacauucaaacuucaugcuccugaaaaccauucucugcagcagaau

SEQ ID NO: 261929 - RNA, 64 nt, Human
uggaagcagccuuuguuccuuucuggcugagcaagcuccugaggcugggagagacuaggaaggc

SEQ ID NO: 261930 - RNA, 64 nt, Human
gacuacuucauuauuaaaaauugauagaauuuuagcuccugagauauuuacaacugggagaaau

SEQ ID NO: 261931 - RNA, 64 nt, Human
ccgguguguuucugacccuuucagccccauuaaagcuccugagcucuccgcugccuccucucuc

SEQ ID NO: 261932 - RNA, 64 nt, Human
uaggcucugggcacauuuccuguucuugaauucugcuccugaagagggugaacaaauggggcau

SEQ ID NO: 261933 - RNA, 64 nt, Human
cucuuccugcucucccaggaagccagcucccugagcuccugagccagccggaaacucuuccucc

SEQ ID NO: 261934 - RNA, 64 nt, Human
ugcucugacaaccuguggcaugcugcagggucaggcuccugauaggaggauuucaugacuaugu

SEQ ID NO: 261935 - RNA, 64 nt, Human
cggacgaacaucugaccaaagagguguggucgaggcuccugaaagagaaagggccugcuggucu

SEQ ID NO: 261936 - RNA, 64 nt, Human
gaaagccaggcccaccugcccuauccccucccuugcuccugaggccaaagccagagacucgaac

SEQ ID NO: 261937 - RNA, 64 nt, Human
aagcuuucagaagcauccagaaugccuaccaucagcuccugaaucagggauuuucagcacuacc

SEQ ID NO: 261938 - RNA, 64 nt, Human
aaaacagccuuuuuguaauuuauuuuuuaagugggcuccugacaauacuguaucagaugugaag

SEQ ID NO: 261939 - RNA, 64 nt, Human
acuccuguagggaaguuucuucaaacaaaacccagcuccugagucuccagauguuguucuguca

SEQ ID NO: 261940 - RNA, 64 nt, Human
agugguuuuucuuuuuaaguauauuaacaggguagcuccugagccuuucccuuuauuggaaacu

SEQ ID NO: 261941 - RNA, 64 nt, Human
gggaggagacccuuggaaaaguccucucuucccagcuccugauucuggaucugagauucucaga

SEQ ID NO: 261942 - RNA, 64 nt, Human
cugcccaugcccugaggccaguuggcgagggguggcuccugaggguuuuuauacccuuuguuug

SEQ ID NO: 261943 - RNA, 64 nt, Human
aacugagggcucaaaacuccuggacaaguugcuggcuccugagaccaguauuuccuggagcugu

SEQ ID NO: 261944 - RNA, 64 nt, Human
ucuuuguugacagucggcgacaagguugugcguggcuccugaccugcugcuaagagucacuuga

SEQ ID NO: 261945 - RNA, 64 nt, Human
uuugggcagccugagucucuugguuucugagcuggcuccugaauauauguucaagugggugugc

SEQ ID NO: 261946 - RNA, 64 nt, Human
aaguaggguuaaacuccccaguuuccugagggaggcuccugacaggugcccuuugucagacccu

SEQ ID NO: 261947 - RNA, 64 nt, Human
ccugugugcguguguauaagucaagcuccaagaggcuccugaaugugacuggcgugcugagaau

SEQ ID NO: 261948 - RNA, 64 nt, Human
augauuuuccuaacaaucauuuauaauuggaugugcuccugaaucuacuuuuuauaaaaaaaaa

SEQ ID NO: 261949 - RNA, 64 nt, Human
ucugaagguccucuuuggcaccccagaauuuguggcuccugaagugaucaacuaugagcccauc

SEQ ID NO: 261950 - RNA, 64 nt, Human
caagugucaaacuugcuauagcauaaaagccggggcuccugauuuccagguuucuaaaaaggaa

SEQ ID NO: 261951 - RNA, 64 nt, Human
ggaacuuugaugcagacaaaaugcugcugcugcugcuccugaaauacccaccccuuuccacuac

SEQ ID NO: 261952 - RNA, 64 nt, Human
ccugaaacuauugcuguggaauaaaagaugaaaugcuccugauuauuguaaauacaaaauugca

SEQ ID NO: 261953 - RNA, 64 nt, Human
uccccucaaaugaaaguucuccccuugauuuucugcuccugaaggcagggugaguucucuccuc

SEQ ID NO: 261954 - RNA, 64 nt, Human
guggauguauauaaaauuaagaugauaagaaagugcuccugagaaggcucuugccagaagccug

SEQ ID NO: 261955 - RNA, 64 nt, Human
aggaggaacugugauuggcacgugcagauacaaugcuccugagaagacagcauuuuccacagga

SEQ ID NO: 261956 - RNA, 64 nt, Human
uugagaauguaaagcagguuaagacuuguuucuugcuccugaggagcguauagaaggacccaca

SEQ ID NO: 261957 - RNA, 64 nt, Human
gcaagccagcgacuugccgagcagaaugagcucugcuccugagccccgguagcugcuuccucau

SEQ ID NO: 261958 - RNA, 64 nt, Human
uggaacuggaaggaccuuagaacuuaucuguuaugcuccugauagccaauagcagauagaagcu

SEQ ID NO: 261959 - RNA, 64 nt, Human
ugcaggcggccgagggcacaggggguuucgcgcugcuccugaccgcggugaggccgcgccgacc

SEQ ID NO: 261960 - RNA, 64 nt, Human
auagagagcagacagaagcagaacagagcccggggcuccugagccucugcgugugcccucccag

SEQ ID NO: 261961 - RNA, 64 nt, Human
gcacaauucuugaacugaugucagcacccgaguggcuccugaauuuaagucugggacgacaucu

SEQ ID NO: 261962 - RNA, 64 nt, Human
acuuugucuuaccucaauugaguaacagaauauagcuccugaaggaaacacugauuugcuuucu

SEQ ID NO: 261963 - RNA, 64 nt, Human
caggauuucacuauguuggccagguuggucucaagcuccugaccucagaugaucuaccagccuc

SEQ ID NO: 261964 - RNA, 64 nt, Human
agucugcccaggccggccgcccccaccccucggggcuccugaauaucagucacuguucgucacu

SEQ ID NO: 261965 - RNA, 60 nt, Human
gggagggcaccgaggucuagguacagaacagcuccugagccagguggacaugccagagag

SEQ ID NO: 261966 - RNA, 64 nt, Human
acauuuguccaaacuccccaaccgaguucuagaagcuccugacaaggaggcagcauccagccuu

SEQ ID NO: 261967 - RNA, 64 nt, Human
cugggccugcgagacccaaggcucacugcagcgcgcuccugaccccucccugcaggggcuacgu

SEQ ID NO: 261968 - RNA, 64 nt, Human
agaaguuacaguagacugugaggcaccccaccuugcuccugaugcaguuucugugccauugcug

SEQ ID NO: 261969 - RNA, 64 nt, Human
uacauucaggagcugugaauauagcucuaggugugcuccugaaucaguucaugguagauuaugc

SEQ ID NO: 261970 - RNA, 64 nt, Human
gcccuuaucagcuguccccuucuggaagcuuucugcuccugacguguugugccccaaacccugg

SEQ ID NO: 261971 - RNA, 64 nt, Human
acccucaccucccacccccugagagcuggggcaggcuccugagaugucuagacuggugcguugu

SEQ ID NO: 261972 - RNA, 64 nt, Human
acacuggagggucccccggaccacacuggggugggcuccugaggacguggggaagugauuuugu

SEQ ID NO: 261973 - RNA, 64 nt, Human
ggacuccuuucuccuuuucuuuccucucuaggcugcuccugaauccuguucucugacauccgug

SEQ ID NO: 261974 - RNA, 64 nt, Human
agccagcucuaaacaacacacagagcacaaauaugcuccugacggacucaggaaaaugccaaca

SEQ ID NO: 261975 - RNA, 64 nt, Human
gagaugccugguccgucuugggucugcccuccgugcuccugaccccugcugcccaagagagccu

SEQ ID NO: 261976 - RNA, 64 nt, Human
gcaagaccuacuagauugaauuuauuuagugaaugcuccugaauaaaugugcauuccucuuuua

SEQ ID NO: 261977 - RNA, 64 nt, Human
uccccccaagucuguuccgucagagcuucuggcugcuccugaaugguggaaugcuguguccucu

SEQ ID NO: 261978 - RNA, 64 nt, Human
uuacuacuugucuccuuaaagaaaaaguuugccagcuccugaucuagaccaagagggagauauu

SEQ ID NO: 261979 - RNA, 64 nt, Human
auuagcuugacugucuuugaaaguaucugauggagcuccugaugaccuaauguauccuuuagaa

SEQ ID NO: 261980 - RNA, 64 nt, Human
aaguucagacauguugguguaaaguuucuccucugcuccugaaaacuucaucuucuuggugucu

SEQ ID NO: 261981 - RNA, 61 nt, Human
ccaagggccugauguugugaguccuguuagugcuccugaucugcaggugccacaggugagg

SEQ ID NO: 261982 - RNA, 64 nt, Human
cuucuuccucacacugcuguccucucccccuucagcuccugaguagcugggccugugcacuggg

SEQ ID NO: 261983 - RNA, 64 nt, Human
aaagucucacugaguuaguucuuacagaaaaucagcuccugacccugccuaaaagcauuggaaa

SEQ ID NO: 261984 - RNA, 64 nt, Human
agcuuacaauugaccuauacauugcauucagcaagcuccugaauuuagaacugccgucagugua

SEQ ID NO: 261985 - RNA, 64 nt, Human
gcagguagagucccauuucuuaugggaccugugugcuccugagaacucuuacuugagacaucaa

SEQ ID NO: 261986 - RNA, 64 nt, Human
cguugagggaaaugaaauugcuggacuauuuguggcuccugaguugagugauuuuggugaaaga

SEQ ID NO: 261987 - RNA, 64 nt, Human
caggguuucaccauguuggucaggcugaucucgagcuccugaccucaggugaucuacccaccuc

SEQ ID NO: 261988 - RNA, 64 nt, Human
guguuucuuaggaaauagaauguuaugcuuuggggcuccugaaacaccucguuuugaaggugaa

SEQ ID NO: 261989 - RNA, 64 nt, Human
ccaugaaaaacagcagaguaaaauuacagaagaagcuccugaaucccuuucaguuuguccacac

SEQ ID NO: 261990 - RNA, 64 nt, Human
cugugucguucuacugagcacgcuucucugccucgcuccugacucagcacuuuguucacuggcu

SEQ ID NO: 261991 - RNA, 64 nt, Human
accaggauggagcaagcucuucccuugcucaugagcuccugaucagaggcauuugagcagcuga

SEQ ID NO: 261992 - RNA, 64 nt, Human
ucaucuuuaaauuuguuucuguauuauuauaugugcuccugaagcgagcacucuuuuuaucuau

SEQ ID NO: 261993 - RNA, 64 nt, Human
auguuuauguggaaucuccaggcugccaucgagggcuccugagcucauccugaggacccagggu

SEQ ID NO: 261994 - RNA, 64 nt, Human
augccuggagagucuguuugcugcagacacccuugcuccugagucauuauuuucuuucauguua

SEQ ID NO: 261995 - RNA, 64 nt, Human
cuuucgagagagaaguuuaagcuucaccaaugcugcuccugaccaauggaaauauguacaacuu

SEQ ID NO: 261996 - RNA, 64 nt, Human
aaaguguggaggagaaacucuuggccuaucaagugcuccugagagaaaccaugcaauuuaacac

SEQ ID NO: 261997 - RNA, 64 nt, Human
caaugugaguggcgcuaugggacgggccagcccugcuccugagccagccccgcccucugccccc

SEQ ID NO: 261998 - RNA, 64 nt, Human
cauuagcuccuuuuaagcuagaaacguagccugagcuccugaagaguuccugggagauuugagc

SEQ ID NO: 261999 - RNA, 64 nt, Human
acugcugcuaauacguuauuauaaaacuuaccuagcuccugaauucuuccuaucuuauagcuua

SEQ ID NO: 262000 - RNA, 64 nt, Human
cccucuccaguccuggcuccuuccuacauccugggcuccugaagaagcugucuucccauuuucc

SEQ ID NO: 262001 - RNA, 64 nt, Human
cauguuucucggugcagaucugaaaucacauccagcuccugauguuuucuucucccucugacug

SEQ ID NO: 262002 - RNA, 64 nt, Human
gggccgcugccccucagccauguggcacuucugagcuccugaccuaggccaaggggaggucucu

SEQ ID NO: 262003 - RNA, 64 nt, Human
uugucauugucauuaucuucuuaaacaugaagcugcuccugaucauaggugguacacguuaaua

SEQ ID NO: 262004 - RNA, 64 nt, Human
ucaggccaccagccucugccggccucccagccgggcuccugaagcccgcugaaaggucagcgac

SEQ ID NO: 262005 - RNA, 64 nt, Human
ugaaaagaacucccaagaaaccaggcaggcagaagcuccugaaugcuggacuagacaaacuaca

SEQ ID NO: 262006 - RNA, 64 nt, Human
guguaacagugguggauacuguugcauaagaugagcuccugaagagugaagcuaauucuuuggu

SEQ ID NO: 262007 - RNA, 64 nt, Human
cugccccagucagccuggcugggcucuggugggggcuccugauccgcauccaagcuuaaccaag

SEQ ID NO: 262008 - RNA, 64 nt, Human
acauuuagcaguacguacagagccugacagcgcagcuccugaggacuucugcggcugcaggaga

SEQ ID NO: 262009 - RNA, 64 nt, Human
cauagaaucaaaguugcucucugaaggagcuuuggcuccugauauuuuaucaugcuccuauauu

SEQ ID NO: 262010 - RNA, 64 nt, Human
uuuuaaagacucaccuuuuuaaaugguacuuggagcuccugauucaaauuaccuagacccccua

SEQ ID NO: 262011 - RNA, 64 nt, Human
uugagugucccaaaacacugaugccaugaugugggcuccugacuggccuccuuuuccuuugacu

SEQ ID NO: 262012 - RNA, 64 nt, Human
uaagggacccugagccacagugaguuggucaaaugcuccugacaguguggagaaaccaacaggc

SEQ ID NO: 262013 - RNA, 64 nt, Human
aaaaccgcucaacugcauggaaacaggacaagcugcuccugaaugaguacuggguacauaacga

SEQ ID NO: 262014 - RNA, 64 nt, Human
uggauacaggcucccucuuuccucccaauccuaagcuccugacaaguggccagguggcucuggg

SEQ ID NO: 262015 - RNA, 64 nt, Human
acgcaguuuuaaagggaggaagaucagcaaauaugcuccugaagaaggcaacagauaugauggc

SEQ ID NO: 262016 - RNA, 64 nt, Human
cagcaggcaucugggcaggccaguccucaaagcagcuccugaaggucuguguugcacugucacc

SEQ ID NO: 262017 - RNA, 64 nt, Human
uucuuugaagagcucagaggcuuccaagugaucugcuccugaacaaguuugaagaccuauuguu

SEQ ID NO: 262018 - RNA, 64 nt, Human
uuaaauucuacuugaugacugcagucgucaaggggcuccugaugcaagaugccccuuccauuuu

SEQ ID NO: 262019 - RNA, 50 nt, Human
acguccagggcuuggccugagcuccugagccagcggggccuggccuaccu

SEQ ID NO: 262020 - RNA, 64 nt, Human
cuuauuccagaugcugagagugaccaggacagcagcuccugaggcccaguggucuucuuuccaa

SEQ ID NO: 262021 - RNA, 64 nt, Human
gggguggggagguucuuaguugcgaaggagccaagcuccugauggacuugcguugggauguggg

SEQ ID NO: 262022 - RNA, 64 nt, Human
gcuggucaccucccggcuuugccguucagauggggcuccugaggcucaggagugaagaugccac

SEQ ID NO: 262023 - RNA, 64 nt, Human
uaugaaaaauauuuuaagugggaaaaagauuggugcuccugauaaagcaaagggcugggaauac

SEQ ID NO: 262024 - RNA, 64 nt, Human
uagugaccugccucaccuaauccucacccuugcugcuccugaugcaaagccaggcacaacaagg

SEQ ID NO: 262025 - RNA, 64 nt, Human
ucccagggucucuguugccaccaucagauuauaagcuccugaugcugggggggcccagccaucc

SEQ ID NO: 262026 - RNA, 64 nt, Human
accuccaggaacagacauggaccuucucuccagagcuccugaguggaaucaaguucuugucuuu

SEQ ID NO: 262027 - RNA, 64 nt, Human
aguucauuuggccuccuccugacuuguugcuccagcuccugaacagaaacuagcuucagggcuc

SEQ ID NO: 262028 - RNA, 60 nt, Human
uuguggagaccagcacuuagggugggcggggcuccugagggagcuccaacucagaaggga

SEQ ID NO: 262029 - RNA, 64 nt, Human
uggccuuggagcucaaaucuuuccuuugauuuuugcuccugaucaucaaggccccaguggcaac

SEQ ID NO: 262030 - RNA, 64 nt, Human
agguccucagugguugccuggggagccggacggggcuccugagggguacagguugggugggccc

SEQ ID NO: 262031 - RNA, 64 nt, Human
auuggcaguggcagagaauccaaacucaacaagugcuccugaaagaaacgcuagaagccuaaga

SEQ ID NO: 262032 - RNA, 64 nt, Human
ggcuugagggacccagaccaggugucugcagucagcuccugagacacagcuggccggcacaaca

SEQ ID NO: 262033 - RNA, 64 nt, Human
aaacagggcaagaccacggaggcacagggguccugcuccugauggggccucaggaggggcggag

SEQ ID NO: 262034 - RNA, 64 nt, Human
cuggacccggccgcgcagcugguggacuguaggggcuccugacugggcacaggagcucccagcu

SEQ ID NO: 262035 - RNA, 64 nt, Human
gaugccaguuacuugcuuuaccuuuucagggcuggcuccugauccacuuugggggaggagaaca

SEQ ID NO: 262036 - RNA, 64 nt, Human
augugcuuuccaaccagcacagcuggcgcucuuagcuccugauugguuguguguuuuauuaagg

SEQ ID NO: 262037 - RNA, 64 nt, Human
guacagccugcucaacaaccgcccugggcaggccgcuccugagcugcugucucccucucugacc

SEQ ID NO: 262038 - RNA, 64 nt, Human
acaucagaccaugaaguucaaccccuccagggaagcuccugauuuccccugcauaauugaaaau

SEQ ID NO: 262039 - RNA, 64 nt, Human
ccgugugucucgucuccugacaugucucacagacgcuccugaaguuaggucauuacuaaccaua

SEQ ID NO: 262040 - RNA, 64 nt, Human
ucuaguuuaauaaugggggaaaaaagauuagguugcuccugaaacugacuguagagcauguaaa

SEQ ID NO: 262041 - RNA, 64 nt, Human
uccuucguugacugaaaggaguuuuaaauucugagcuccugagauacugacuagcaaccaugga

SEQ ID NO: 262042 - RNA, 64 nt, Human
guuacaagucuuugaaaugggucuggugucuucagcuccugaaaugcuaauuuaccccuuaccu

SEQ ID NO: 262043 - RNA, 64 nt, Human
cugacagagcuuugggggccgugaugugauugcagcuccugagguggccugcuuaccccagguc

SEQ ID NO: 262044 - RNA, 64 nt, Human
acugccugccccuguggcagggcaucaaccuggugcuccugaccaggguaggagagccccucac

SEQ ID NO: 262045 - RNA, 64 nt, Human
ugauggccugaggccugggguugaccacuaacuggcuccugacagggaagagcgcuggcagagg

SEQ ID NO: 262046 - RNA, 64 nt, Human
ucaaacauggggaaacaggccagagcauugcccggcuccugaauuaaacucuguucuggugccu

SEQ ID NO: 262047 - RNA, 64 nt, Human
cagagauacuuaucucuauacuaauucacagacagcuccugauguaaggauuuagagggccuuc

SEQ ID NO: 262048 - RNA, 64 nt, Human
aaugcugacccaugggcaggagacuguggagacugcuccugagcccccagcuuccagcaggagg

SEQ ID NO: 262049 - RNA, 64 nt, Human
aacugccuaguccccaugacugugugcccaccgagcuccugaguguucucauuccuuuacccac

SEQ ID NO: 262050 - RNA, 64 nt, Human
agugccgaauucaaacccuucauuuuauguuuaagcuccugaaucugcauuccacuuggguugu

SEQ ID NO: 262051 - RNA, 64 nt, Human
cuucucagaccacaaagcagaaagaagaagaaaagcuccugacuaaaucagggcugggcuuaga

SEQ ID NO: 262052 - RNA, 64 nt, Human
cccauaaaugacaccugagguccguagaagcuaagcuccugagacccagggggaccugccacug

SEQ ID NO: 262053 - RNA, 64 nt, Human
auggcgggagggcugugcccuggcugucucucuggcuccugaccuggccuuuggcuaccauacc

SEQ ID NO: 262054 - RNA, 64 nt, Human
ccccacuagagcuccuaaagaucacacagcagcugcuccugacagggaugcucaugcccagaaa

SEQ ID NO: 262055 - RNA, 64 nt, Human
cuugggucccggagugcccgugaagcguguuuuugcuccugaggugcauuuucucaucauccuu

SEQ ID NO: 262056 - RNA, 64 nt, Human
agccuugccuuugcuuguguauucagaggccugagcuccugaacccacuugaaguccugucuuu

SEQ ID NO: 262057 - RNA, 64 nt, Human
caagaucugaggcucuagugggaaaccucagguagcuccugaagaucugugcuuuccaacaagu

SEQ ID NO: 262058 - RNA, 64 nt, Human
uguagauguugggcuauauguuggggugaugguagcuccugauguaauuuucuuaguugcaucu

SEQ ID NO: 262059 - RNA, 64 nt, Human
agggugcacacaggauggcaggaggcauccaaaggcuccugagacacaugggugcuauuggggu

SEQ ID NO: 262060 - RNA, 64 nt, Human
ugggacuuuguuguuuggauuccucacagccuuggcuccugagaaaggugaggagggcagucca

SEQ ID NO: 262061 - RNA, 64 nt, Human
agaccuuugucuuuaguacacccaaggaucaacugcuccugaagcaaagaggucaggauggagu

SEQ ID NO: 262062 - RNA, 64 nt, Human
agccucgccuuugcucaucuuuucagaggccugagcuccugaacccacuugcaguccugucuuu

SEQ ID NO: 262063 - RNA, 64 nt, Human
auccccggauggggacccuucccacccucugcaagcuccugagauuuguuuuagcaaacagaug

SEQ ID NO: 262064 - RNA, 64 nt, Human
ggaugucaugacauuuugagaaaaacuaaaucaugcuccugaaccuucugaacgcauuuguuau

SEQ ID NO: 262065 - RNA, 64 nt, Human
gaagcuggagagcagaagcccccaucuuugaaaagcuccugagugcaacuuaauuaccaccaug

SEQ ID NO: 262066 - RNA, 64 nt, Human
ccuccaccuccuaggggaggugggcugggcccucgcuccugacuguugcugcuccccagcccau

SEQ ID NO: 262067 - RNA, 64 nt, Human
uccugaguggguguugcacagacugguccacagggcuccugaaggaagccccuggaucuuuggg

SEQ ID NO: 262068 - RNA, 64 nt, Human
cccagccgcacuccaggcaagggccagugcgccugcuccugaccacugcaaucccagcgcccaa

SEQ ID NO: 262069 - RNA, 64 nt, Human
uggcucccgcucucugaccuucugacuccugugggcuccugagcuuacaaagcauggcaggcca

SEQ ID NO: 262070 - RNA, 64 nt, Human
aaauauguauuauacaucuguauuuuuaaauucugcuccugaaaaaugacugucccauucucca

SEQ ID NO: 262071 - RNA, 64 nt, Human
gaaugcuguuuuaaaaacaaagaaauaaaauccugcuccugacucggucaaaauauuuuuuaaa

SEQ ID NO: 262072 - RNA, 64 nt, Human
caggcagccucagucagagcacccugaaguuuuugcuccugaauccagcugugcacuuugccca

SEQ ID NO: 262073 - RNA, 64 nt, Human
gagagaaggauggguccccuccgccauggggucggcuccugauggugucauucugccugcucca

SEQ ID NO: 262074 - RNA, 64 nt, Human
cagggcagggagccuggaagcaaaggaggaccuggcuccugacucucagagaggauaggcugga

SEQ ID NO: 262075 - RNA, 64 nt, Human
ucgguuucuugaugucuuuugguucuccuugccugcuccugaugcuuggaccccuuuuauugau

SEQ ID NO: 262076 - RNA, 64 nt, Human
uauuaaaauagaaacagggauugauuaaugucccgcuccugaauacauguaaaauuuguacaaa

SEQ ID NO: 262077 - RNA, 64 nt, Human
gcaguucgacucugugcuggccagcgagcgcccagcuccugacacugcuggagaggccccagcc

SEQ ID NO: 262078 - RNA, 64 nt, Human
ggggaagcugguauuugacauaguguguuaaacagcuccugagaaccuuugggacacucugcca

SEQ ID NO: 262079 - RNA, 64 nt, Human
uuccacuuuuuccacucuuauuagcacugcaaaagcuccugagaauuuaaaaacacaguaauuc

SEQ ID NO: 262080 - RNA, 64 nt, Human
ccaggauuucauguuuguaucuucauaaggccaugcuccugacaggucuaggcaaccuggggga

SEQ ID NO: 262081 - RNA, 64 nt, Human
ccucaggcuugaggggugcuuggggccaggcuacgcuccugaccucuucccaggcagugccuag

SEQ ID NO: 262082 - RNA, 64 nt, Human
auucauagcauagcuagagauuggugaauugaaugcuccugacaucucaguucuugucagugaa

SEQ ID NO: 262083 - RNA, 64 nt, Human
ggcaagggcaagaaaugagcucuccacccagcccgcuccugacccuuaucuucccagagaccag

SEQ ID NO: 262084 - RNA, 64 nt, Human
agcuuaacuaaauuacaggggacucagaggccgugcuccugaccgauccagacacuauuacugg

SEQ ID NO: 262085 - RNA, 64 nt, Human
cuuuaccaaggaugaaagaggagccaggccuugggcuccugaugaggagaaaggggccccaccg

SEQ ID NO: 262086 - RNA, 64 nt, Human
caggguuuugccauguuggccaggcuggucucgagcuccugaccucaggugauccgccugccuu

SEQ ID NO: 262087 - RNA, 64 nt, Human
auugggauaggcugucaguauguuaaggauaguugcuccugagucaauucuucacuuacucccu

SEQ ID NO: 262088 - RNA, 64 nt, Human
ccagugaaguuuaaucuagcuaaacacugguccugcuccugagaugggauccuauguguuugga

SEQ ID NO: 262089 - RNA, 64 nt, Human
uacauuccagucuacacuuuguuuuuguauuguugcuccugaacaaccuguuucaaauugguuu

SEQ ID NO: 262090 - RNA, 64 nt, Human
gcugauccccgacagaaacgcagcagaugcagacgcuccugaugaaaucaucccuguggggagu

SEQ ID NO: 262091 - RNA, 64 nt, Human
acugcccuugaccggcaaaugcccugcaacgguggcuccugacaccaggggauagggagaugug

SEQ ID NO: 262092 - RNA, 64 nt, Human
uugccccaguuucuccacugaguauuuacucagugcuccugagccgaugccuuccccucugccu

SEQ ID NO: 262093 - RNA, 64 nt, Human
cuugagacuccauccagccccaggcacgccaccugcuccugagccuccacuaucucccugugac

SEQ ID NO: 262094 - RNA, 64 nt, Human
ucacauccauggauugggcccacuacucauagcagcuccugaggcagguaaauggggcaaggac

SEQ ID NO: 262095 - RNA, 64 nt, Human
aacuugccaugcccugucccuuaguagaugaguugcuccugauuggucauuggguuugggugag

SEQ ID NO: 262096 - RNA, 63 nt, Human
cuucccuucuguacuguuaacuuaaaaauaaauagcuccugauucaaaguauuaccucuacuu

SEQ ID NO: 262097 - RNA, 64 nt, Human
gucuuccccaaggcugagugucccaguuuuaucugcuccugagacugagcccagauccccaaau

SEQ ID NO: 262098 - RNA, 64 nt, Human
cugccucacuucucucuugagaacuuggcucagggcuccugaggaccuuucccagcauuaccuu

SEQ ID NO: 262099 - RNA, 64 nt, Human
gccagagaccucaggcucucagcacauuccacaggcuccugaguccccgaggccugggccagcu

SEQ ID NO: 262100 - RNA, 64 nt, Human
aacaccacccccaccgcccccaccaccacccccagcuccugaggugcuggccagugcaccccca

SEQ ID NO: 262101 - RNA, 64 nt, Human
ucccuugccucaggccgggcugagugugacugcagcuccugaggaugggccugcccugucuggg

SEQ ID NO: 262102 - RNA, 64 nt, Human
uucuuccccagaagaguuaacaguugaguguucagcuccugacuuaccuuuaauuuagaggcaa

SEQ ID NO: 262103 - RNA, 64 nt, Human
guauuuucuuucuuugcuuccugucaccccaggggcuccugaguauaggcuuuucagucccugg

SEQ ID NO: 262104 - RNA, 64 nt, Human
ccacccgaugcaggacucaccucugugccuugcugcuccugaggcccaagggcagccauggugc

SEQ ID NO: 262105 - RNA, 64 nt, Human
aaguacgcuggugccgugucacccauguugagccgcuccugauggcugacgggcucccagaccc

SEQ ID NO: 262106 - RNA, 64 nt, Human
gcgcauguccugugcuuuguggacgcugcugugugcuccugaacacggcaggcccugcuaucac

SEQ ID NO: 262107 - RNA, 64 nt, Human
cacaggcgcgggcccuccuugcgcugcagugggggcuccugagugcagccccacacgacugagc

SEQ ID NO: 262108 - RNA, 64 nt, Human
aggcgggaucgcugguuucucucgaccucgcagagcuccugacaaaggcggcuucugcgucguc

SEQ ID NO: 262109 - RNA, 64 nt, Human
cgccucccggguucaagugaucguccugccuuaggcuccugaguagcuggggauuacaggugcc

SEQ ID NO: 262110 - RNA, 64 nt, Human
gcacauacaccugugggaaaacggaccgcucuuggcuccugacucccaggguacagcgcccagu

SEQ ID NO: 262111 - RNA, 64 nt, Human
cauccucuggguucaagcaauucuccugccucaggcuccugaguagcugggauuacaggcacgu

SEQ ID NO: 262112 - RNA, 64 nt, Human
ggccugucaagagggaggaaggggccccauggcagcuccugaccuuggguccugaagugaccuc

SEQ ID NO: 262113 - RNA, 64 nt, Human
cccagugcuggauccacugggugaagccagcugggcuccugagucugguggggacuuggagaac

SEQ ID NO: 262114 - RNA, 64 nt, Human
ucuggugcuguccucacucgccccuggcccagaggcuccugaagaugcugggcgguccuggcac

SEQ ID NO: 262115 - RNA, 64 nt, Human
cauaauccgccccugguggguggcacucucaggugcuccugaacagaagauuuggcccucauuu

SEQ ID NO: 262116 - RNA, 64 nt, Human
ccagaagccgacacucaagguguucguggggcuggcuccugaagggccugggaggguccaucag

SEQ ID NO: 262117 - RNA, 64 nt, Human
uugcccacucuuggcuuucaacccguaggcuccggcuccugacgccacacccugauaucaagac

SEQ ID NO: 262118 - RNA, 64 nt, Human
acaucuucauguggacauugagauucacaugcuggcuccugaagggugcucagucuccuuggug

SEQ ID NO: 262119 - RNA, 64 nt, Human
gcaugcagggcuggggguggaauggggcuaaccagcuccugauggccugagccaggcaucuuga

SEQ ID NO: 262120 - RNA, 64 nt, Human
cucuggacgaggccuccuuccucagguuccuccugcuccugaccucccagugugauguccgggu

SEQ ID NO: 262121 - RNA, 64 nt, Human
cagugaacuauuccucagugggaucgguucuucagcuccugaugggggcuguguaaugggggca

SEQ ID NO: 262122 - RNA, 64 nt, Human
auucugcugacugugguguguguguggugauugugcuccugacccacaaaugacugagugcucc

SEQ ID NO: 262123 - RNA, 64 nt, Human
ggacagagcagggcaggcaguucuaugccuuggagcuccugacugcagggacucuguccccaca

SEQ ID NO: 262124 - RNA, 64 nt, Human
agauggugcaauaucuuuguuuuuuuuuuaugaggcuccugagaaucaacccaacugaagcauu

SEQ ID NO: 262125 - RNA, 64 nt, Human
gacuuccauuuccaucguccuuucugaaggaacagcuccugaaaccagucucccugggcugaga

SEQ ID NO: 262126 - RNA, 64 nt, Human
gaaugagucagaagggcuucugggaccaauuccagcuccugacauucccccaguccugccucuc

SEQ ID NO: 262127 - RNA, 64 nt, Human
acgguucacaccuugucaccaucaggccuuucuggcuccugauaggguggagcaaaaguggaaa

SEQ ID NO: 262128 - RNA, 64 nt, Human
ggagagcagggcacaaaggggcugcaguuugggagcuccugaagaaauggcucagauauugagu

SEQ ID NO: 262129 - RNA, 64 nt, Human
gccuuggcuccagguugguagaagcagccgaagggcuccugacaguggccagggaccccugggu

SEQ ID NO: 262130 - RNA, 64 nt, Human
uaagaagugccguccucgaacuuucugacucuaagcuccugagcgggagucagacuuagcccug

SEQ ID NO: 262131 - RNA, 64 nt, Human
cuccucugcauguauccccgcaccccagaacugggcuccugaacgccaggaaccuggggucugg

SEQ ID NO: 262132 - RNA, 64 nt, Human
agcaacuuugcucucccugccgugccucgguggugcuccugaauguggcugaccugggcugcug

SEQ ID NO: 262133 - RNA, 64 nt, Human
acccuuagaacccugagugcuggcaaaucucacugcuccugacccagccuguguauucaaaacg

SEQ ID NO: 262134 - RNA, 64 nt, Human
ccaguccugaagccccugcaguggcgggacucaagcuccugaccuuugcccggccuggcugggc

SEQ ID NO: 262135 - RNA, 64 nt, Human
ugccucccacguucaagcgauccuccugccucaggcuccugaguagcugggauuacaggcgucg

SEQ ID NO: 262136 - RNA, 64 nt, Human
uggugcaagagccucuagcggcuuccaguuccccgcuccugacuccugaccuccaggaugucuc

SEQ ID NO: 262137 - RNA, 64 nt, Human
gggggucucccuauguugcccaggcuggucucgagcuccugaccucaagugauccuccugcccc

SEQ ID NO: 262138 - RNA, 64 nt, Human
ccugccuccuuggucacugccucuugcugcacgggcuccugagcccacccccuuggggcacaac

SEQ ID NO: 262139 - RNA, 51 nt, Human
aaaaagaugacaagaacuaacgcuccugaguaccagccccugucacaucug

SEQ ID NO: 262140 - RNA, 64 nt, Human
uuuuuauuguguauccguuccccuccuacggugugcuccugaaugaagguuucuauguaagcag

SEQ ID NO: 262141 - RNA, 64 nt, Human
acaguggcacaaucauggcucacugcagccucgagcuccugagcucaaaggauccucccaccuc

SEQ ID NO: 262142 - RNA, 64 nt, Human
gaagucagaucuacagccacccagaggaaagucagcuccugaaacgcugcaguggaacgcgcag

SEQ ID NO: 262143 - RNA, 64 nt, Human
ggcugcuggugaacuucuguggccaccaccuccugcuccugaccucccugggagggugcuauca

SEQ ID NO: 262144 - RNA, 64 nt, Human
gccucaccgaagagaggaaccaccacacccagcagcuccugacagacccccaccccuaaagaug

SEQ ID NO: 262145 - RNA, 64 nt, Human
uuguauguuguauugucgucccaacggaaggagagcuccugacuccaggaugggcugcagguug

SEQ ID NO: 262146 - RNA, 64 nt, Human
cccagugugcccccugggaaagggcacggccugugcuccugacacgggcugugcuuggccacag

SEQ ID NO: 262147 - RNA, 64 nt, Human
ccgccgcagaccagcuggcggguguggagaccaggcuccugaccccgccaugcaugcagcgcca

SEQ ID NO: 262148 - RNA, 64 nt, Human
cucaaccccccuaugagggccacguccugggguagcuccugaccuccgaccuuauguccaaauu

SEQ ID NO: 262149 - RNA, 64 nt, Human
acuccagccgcugaauacaguguuaggacugggggcuccugagaugagaguuugagauucaggg

SEQ ID NO: 262150 - RNA, 64 nt, Human
augcggcacagcaggcacgugccuggagagaacagcuccugagcacagcacccuuggagcccuc

SEQ ID NO: 262151 - RNA, 64 nt, Human
auguguuucuagaaguuuccuguggaaccuggaggcuccugaugccuuugacuccaggcugggc

SEQ ID NO: 262152 - RNA, 64 nt, Human
gagauuuugucaccaccaggccugcccuaaaagagcuccugaaggaagcacuaaacauggaaag

SEQ ID NO: 262153 - RNA, 64 nt, Human
aaaaccgcucaacuacuuggaaacugaacaaccugcuccugaaugacuacuggguacauaacga

SEQ ID NO: 262154 - RNA, 64 nt, Human
aaaucccuuaggggaugaggggugaaauuuaaaagcuccugaaaaugaguacugcuguguugag

SEQ ID NO: 262155 - RNA, 64 nt, Human
agcuccaguccucugucuggccuccacuccucuugcuccugagggcaguuuguuucuuuugugg

SEQ ID NO: 262156 - RNA, 64 nt, Human
aucccauggaaccacuaaaaacaaggucugcucugcuccugaagcccuauaugcuggagaugga

SEQ ID NO: 262157 - RNA, 64 nt, Human
aggaaaagcccagccucuguaaaucaucacuucagcuccugauuggucccaggccaagcugaau

SEQ ID NO: 262158 - RNA, 64 nt, Human
gcuaggagguuacagauugcuuuuccugggcugggcuccugaguguugguucuuccagcugugc

SEQ ID NO: 262159 - RNA, 64 nt, Human
uagaggcuggugcugugucgggaggaaggucagggcuccugagcagcaauaaaggaccaggaag

SEQ ID NO: 262160 - RNA, 64 nt, Human
gaagcgccuucaacucaagaucuaucaucauuuagcuccugaaaguccacacuuaaguagagcc

SEQ ID NO: 262161 - RNA, 64 nt, Human
gacugaugcgaggucccccaggccucagccuggagcuccugagccgugacaguuuucaggggcc

SEQ ID NO: 262162 - RNA, 64 nt, Human
ccuuuucagaaaacagauagaugccaucucgcccgcuccugacuuccucuacuugcgcugcucg

SEQ ID NO: 262163 - RNA, 64 nt, Human
ugaggcuucccagagacccugggucuagaaagcggcuccugaaggucccuuauuguggcugaua

SEQ ID NO: 262164 - RNA, 64 nt, Human
gggucuugguuuccucuccuacucccuuccuuaggcuccugaacucguuugcuccuaaaucuug

SEQ ID NO: 262165 - RNA, 64 nt, Human
aguggccugaggcccagagggucuggucuggugagcuccugaggccacacagcaccauaaaguc

SEQ ID NO: 262166 - RNA, 64 nt, Human
cccggccccuaccagccacgggcacaagaccccugcuccugacuuagcccgucacccuuauuua

SEQ ID NO: 262167 - RNA, 64 nt, Human
ccugaggaccucaggaggccagcagaacccgcaggcuccugaagacuggccacgccuccugaga

SEQ ID NO: 262168 - RNA, 64 nt, Human
ggugcccaagggaccugaagugaagcuccccaaggcuccugaggucaagcuuccaaaagugccc

SEQ ID NO: 262169 - RNA, 64 nt, Human
cuuugggcuuucccucuuggagccccggcccgcugcuccugaaguuguagagagcaagcugaag

SEQ ID NO: 262170 - RNA, 64 nt, Human
caccccacccuggagggccaggggaguggagagagcuccugaugucuuaguuuccacaguaagg

SEQ ID NO: 262171 - RNA, 64 nt, Human
uggaaaggucucuuacaaggacucuugaauacaagcuccugauaacuucaagaucauaccacug

SEQ ID NO: 262172 - RNA, 64 nt, Human
aggguggugcacccccaacuucauagggguagaggcuccugagauuaggagaacccuuuuuagg

SEQ ID NO: 262173 - RNA, 64 nt, Human
cucacuucauuaggugaggauuauuucucuccaagcuccugaagaaaaaagacucugccuuuua

SEQ ID NO: 262174 - RNA, 64 nt, Human
ucucguguccucaaaguggauggguucugggguggcuccugagguagaggaguggagaacuggc

SEQ ID NO: 262175 - RNA, 64 nt, Human
gcucgggcaagcugcuggagagggagaucaaggcgcuccugaccccugaggauuaccagcgauu

SEQ ID NO: 262176 - RNA, 64 nt, Human
cuucucaggcaccuuccguuuauuaauugccauugcuccugacaucacuaagauggguccccuu

SEQ ID NO: 262177 - RNA, 64 nt, Human
uggucuuaauugcagaguacagagaacugaaccagcuccugauauuguaguuagcagucuuccu

SEQ ID NO: 262178 - RNA, 64 nt, Human
caggauacuguaauuugacuccauaauugcuuuugcuccugaaaccugggaaucaauggaaagg

SEQ ID NO: 262179 - RNA, 64 nt, Human
gagaaacagacauguuuaccacgcguuuuccaaagcuccugaucuuucccaagauuguaacuga

SEQ ID NO: 262180 - RNA, 64 nt, Human
gccgccuugagaagcacaguuuaacucacugcgggcuccugagccugcuucugccugcuuucca

SEQ ID NO: 262181 - RNA, 64 nt, Human
ccuggcuauggagauugaccaagcaagaucaggagcuccugauagcaggcgucuuugagccuag

SEQ ID NO: 262182 - RNA, 64 nt, Human
ugcccugguccagggaagcuggccgaggguccuggcuccugaggggcaucugccccucccccaa

SEQ ID NO: 262183 - RNA, 64 nt, Human
uguuucugcuuuugcugcucuugaucccaccuuugcuccugacaacccucauucaauaaagacc

SEQ ID NO: 262184 - RNA, 64 nt, Human
aagaagaccaugaucucaauagucaguuacugaugcuccugaacccuauguguccauuucugca

SEQ ID NO: 262185 - RNA, 64 nt, Human
cccagagaagccaugggccaccugcucugugcccgcuccugaaacccagcaugccccaagugag

SEQ ID NO: 262186 - RNA, 64 nt, Human
gagacugugcaaagccucuuugcuguuucucugggcuccugagcauaccaggggaaguucuaga

SEQ ID NO: 262187 - RNA, 64 nt, Human
uaguugucacguuaucuuugaaaacucuuggacugcuccugaggaggcccucuuuuccaguagg

SEQ ID NO: 262188 - RNA, 64 nt, Human
gagagcuggagaaggugcagauucaaagugagcggcuccugaggagagccgccaaggcugcucg

SEQ ID NO: 262189 - RNA, 64 nt, Human
caucuuccugcuuuguccagaacacauugaccaagcuccugaaagauguaaguuuacuacgcau

SEQ ID NO: 262190 - RNA, 64 nt, Human
guggccuauuucagcugcuuugacaaaaugacuggcuccugacuuaacguucuauaaaugaaug

SEQ ID NO: 262191 - RNA, 64 nt, Human
aaggagguauaucaacuguuguauccucggacgggcuccugacacggcuuuaaucaggaguuuc

SEQ ID NO: 262192 - RNA, 64 nt, Human
gugcacacugugugugaugaaucucgccagaaaggcuccugaggucccagguuggcacuucucc

SEQ ID NO: 262193 - RNA, 64 nt, Human
agccccugacccagcucgggcccccgacccuccagcuccugacucugccuauuguuccuccagu

SEQ ID NO: 262194 - RNA, 64 nt, Human
cccccaggugggggugcccgcagggauggaggcagcuccugaacugguggccagcccacggggu

SEQ ID NO: 262195 - RNA, 64 nt, Human
cuccagcugcucacagacaccagcaaagcaaugugcuccugaucaaguagauuuuuuaaaaauc

SEQ ID NO: 262196 - RNA, 64 nt, Human
agagauggagggcgagauuuggaugggacccagggcuccugacucugcccuggaagguucaugg

SEQ ID NO: 262197 - RNA, 64 nt, Human
ugagcuggggcucuggccccaggugagguccccagcuccugagcacuucugaggggguggguuc

SEQ ID NO: 262198 - RNA, 64 nt, Human
gauggccugagugugcacuuuggcucugcuaccugcuccugaagccccgcuaaaaauaauucau

SEQ ID NO: 262199 - RNA, 64 nt, Human
gaggccggguuccccucgcugcgggccaggcuuggcuccugauucccucucuggucccuguauu

SEQ ID NO: 262200 - RNA, 64 nt, Human
gggcugugggggcagcugggguuggaggaugagagcuccugaggggcagaggagcagagaugca

SEQ ID NO: 262201 - RNA, 64 nt, Human
ggacacagccaucagcagcuugcgcccucccucugcuccugagaugcugacccagcauggagcc

SEQ ID NO: 262202 - RNA, 64 nt, Human
gcugcccucuagagagcaaauccaguuuccuggagcuccugaaugaauaucuguacuggcucgc

SEQ ID NO: 262203 - RNA, 64 nt, Human
uugugaggggcccgccaggucaccuccccaaccugcuccugauggggcacugggccgcccuucc

SEQ ID NO: 262204 - RNA, 64 nt, Human
caacacugagggccuggagaccucggcuccuccugcuccugaaccaggaggcuucauguggggg

SEQ ID NO: 262205 - RNA, 64 nt, Human
gcgcuugacccaugcuggaagcuaauggccuguugcuccugacagagccccaaacuccucggcc

SEQ ID NO: 262206 - RNA, 64 nt, Human
ccccuuccucuucagaggucccguggacuacacagcuccugagcuugaucuuuuucugccauga

SEQ ID NO: 262207 - RNA, 64 nt, Human
ccuuguguacauccugucccugccacauccauaagcuccugagagaaaggucugacuuguugau

SEQ ID NO: 262208 - RNA, 64 nt, Human
aaauuuagaucaaauuaguaauuuuguuuaugcugcuccugauauaacacuuuccagccuauag

SEQ ID NO: 262209 - RNA, 64 nt, Human
guugugucugugcccuccaaagagccuucagaaugcuccugagugguguaggugggggugggga

SEQ ID NO: 262210 - RNA, 64 nt, Human
acuccagagccccuccccaagcuccccuccccaagcuccugaagacccgguuucugagggaggg

SEQ ID NO: 262211 - RNA, 64 nt, Human
gaagccccagcccgucacagaaguguggaggggggcuccugacuagacaauuucccuagcccuu

SEQ ID NO: 262212 - RNA, 64 nt, Human
aacaaagaaugggaagcacuugugauaaagacaggcuccugagaaaugcaacaaguggucuuac

SEQ ID NO: 262213 - RNA, 59 nt, Human
cuuuggggcaugaagugugacaagugugggcuccugaaaggaauguuccagagaaacca

SEQ ID NO: 262214 - RNA, 64 nt, Human
ccacccucugccuugcaauacgcaaacugcgccugcuccugaaaagcucucugggaaggaaugg

SEQ ID NO: 262215 - RNA, 64 nt, Human
ucuuuuaaauuuucaggcccugaacaggaaaguugcuccugaaguuauguuuccaggcuuagaa

SEQ ID NO: 262216 - RNA, 64 nt, Human
gaucaaggccaagcuggucuagccugacauccuagcuccugacugaacacuauagacuucccag

SEQ ID NO: 262217 - RNA, 64 nt, Human
ccuuuucccacuaaguaguauugccuuccauuaggcuccugagaguuauuucucagggucaugu

SEQ ID NO: 262218 - RNA, 59 nt, Human; identical to SEQ ID NO: 262213

SEQ ID NO: 262219 - RNA, 64 nt, Human
aauucagccaguaagguucagucuucuugcucaggcuccugaaggguugauucuccugauagau

SEQ ID NO: 262220 - RNA, 64 nt, Human
cgguacuaaauugaauaacgaguaaauaaucuuacuuggguagagauggccuuugccaacaaag

SEQ ID NO: 262221 - RNA, 64 nt, Human
gccaucaagaugaccuggagcagagagcaugggccuuggguaaagcaggcccaggucaaggucu

SEQ ID NO: 262222 - RNA, 64 nt, Human
ucagugugccuaacuuauuggagcacaucaguuucuuggguaauggaaaacauuaccuagaguu

SEQ ID NO: 262223 - RNA, 64 nt, Human
ccugcgccagccccaggcugcugaggagcagaggccagaccagggccgaucuggguguccugac

SEQ ID NO: 262224 - RNA, 64 nt, Human
ggcagcagcaggcuccccagcggcccagggugggccagaccagcagcccaggaagcagcacacg

SEQ ID NO: 262225 - RNA, 64 nt, Human
auugcuuccucucugcagaggaacaacccuaaaaccagaccacuccacgcaggacaggcaggag

SEQ ID NO: 262226 - RNA, 64 nt, Human
uccucugcuccuaggccuccccagcgagcuccucccagaccaagacuuuuguucuguuuuucua

SEQ ID NO: 262227 - RNA, 64 nt, Human
uuucaaaccagagugucucacuccccucugaccuccagaccagauggggcaugagccagccagc

SEQ ID NO: 262228 - RNA, 64 nt, Human
uuaacauguugcaggaaaacacucuccccuuaugccagaccagcaguaucucauuuggauggga

SEQ ID NO: 262229 - RNA, 64 nt, Human
gagcaauccuugguuuuguugcuacauuauuuuuccagaccaacacaucuaccaaguaaauuuu

SEQ ID NO: 262230 - RNA, 64 nt, Human
agaugggacaagaagccgccucuggacuaucuccccagaccagcagccugacuugacuuuugag

SEQ ID NO: 262231 - RNA, 64 nt, Human
aacagaagcagauggauaugaagaggagaggggaccagaccaucuccgcaaccacagcccagag

SEQ ID NO: 262232 - RNA, 64 nt, Human
uaaaucagccguguaaccauggacccaauauuuaccagaccacaaaacuuuucuaauacucuac

SEQ ID NO: 262233 - RNA, 59 nt, Human
ggcuggaaucccgccccuagugguacccuccagaccagcgccaccgccuccgacagugu

SEQ ID NO: 262234 - RNA, 64 nt, Human
ugagccucuccggcugccagccagggggccugggccagaccagggcucuguccuuccgugacuu

SEQ ID NO: 262235 - RNA, 64 nt, Human
cugggugccugaguuuugacuccaaucagugauaccagaccacauugacagggaggaucaaauu

SEQ ID NO: 262236 - RNA, 64 nt, Human
ggugcuacugcuguggccagcuggggggcuuccuccagaccaccggccucggccccggcauccc

SEQ ID NO: 262237 - RNA, 64 nt, Human
uuucuuggugccagaguuuauacccugggugcuggggucgcacuguguuauauauauauauaua

SEQ ID NO: 262238 - RNA, 64 nt, Human
cuugcacccuggcugcuuugcuuggacaguuugucuuggguauagggaagccuuccuugucagg

SEQ ID NO: 262239 - RNA, 64 nt, Human
ccaaauucaauguagaaagaaugugacaacacaccuuggguaguucugcuuguguuuuugcaua

SEQ ID NO: 262240 - RNA, 64 nt, Human
accuuguacauaacccugggugacgugcacauugcuuggguauggaacgguagaaauuugggug

SEQ ID NO: 262241 - RNA, 64 nt, Human
gaagcacugggaaguaaugggguguggggugccaccagaccaacacccccagacuuccccaccu

SEQ ID NO: 262242 - RNA, 64 nt, Human
gccaaggcaguaggacugauugaagacaggaguuccagaccagucugggaaacaaagcgagacc

SEQ ID NO: 262243 - RNA, 64 nt, Human
agaccucagcuuuuaucucagaaccccauggguuccagaccaagaguacaggaaaucaaauugu

SEQ ID NO: 262244 - RNA, 64 nt, Human
agauguuuguggauguagcacugaguggugauacccagaccagcagucaccccaggaagugggg

SEQ ID NO: 262245 - RNA, 64 nt, Human
guuguucauuuggggcuccaguuuuugugcauuuccagaccagggucccugucugggagcucag

SEQ ID NO: 262246 - RNA, 64 nt, Human
uauuauguucagaagccaacaaaacaguuuguugccagaccaauguuugaugggaaaacguggc

SEQ ID NO: 262247 - RNA, 64 nt, Human
ccuuggucugccuaugcccuuguuuuauacauuuccagaccauucaucaaggaaaggaccugaa

SEQ ID NO: 262248 - RNA, 64 nt, Human
gaagcagcauugaagugggaagauuuaggcugccccagaccauaucuacuggccuuuguuucac

SEQ ID NO: 262249 - RNA, 64 nt, Human
auuuuaaauaugucaccuccuaagagaaaccuucccagaccacucuuucuaaaaugaaucuucu

SEQ ID NO: 262250 - RNA, 55 nt, Human
cacagccugccacccagugaaguguccagaccauugucuuccaaccccagcuggc

SEQ ID NO: 262251 - RNA, 64 nt, Human
agcaagcgcuucaggaggacugugcugguuguucccagaccaaagagagucacuuuugacucca

SEQ ID NO: 262252 - RNA, 64 nt, Human
aagugauccuuaacccccaaguaaucauuaacccccagaccagccucagaacugaaggagauug

SEQ ID NO: 262253 - RNA, 64 nt, Human
aaauagaauuaaauaauuuaacuugauuaaucaaccagaccaauuuugacgucuggagaacuua

SEQ ID NO: 262254 - RNA, 64 nt, Human
gcucuuacacauagcaggggcaccuuccgacaucccagaccagccaaggguccucaccccucgc

SEQ ID NO: 262255 - RNA, 64 nt, Human
ccggccgcgggucucccggcccaaccccaccgacccagaccaagaccgcgccgagccgccggga

SEQ ID NO: 262256 - RNA, 64 nt, Human
aagguugaacacuuuuuuauaugcuuauugggcacuuggguaucuucuuuugugaaguacccgu

SEQ ID NO: 262257 - RNA, 64 nt, Human
ggcccugggguagggagggagacucaggcccacacuuggguauuuucuaauuucagacaaacac

SEQ ID NO: 262258 - RNA, 64 nt, Human
ucuuggcaguugaagcuggggcaagaacucugggcuuggguaaugagcaggaagaaaauuuucu

SEQ ID NO: 262259 - RNA, 64 nt, Human
auggaaaucugaaaggagugugcucaugccauuuccagaccaagaaaauacauuuauuauuugc

SEQ ID NO: 262260 - RNA, 64 nt, Human
ccacaugucccugcaggguuggcagggacagagcccagaccauggugccagccagggagcuguc

SEQ ID NO: 262261 - RNA, 64 nt, Human
gaggaggaggcugcacagcgggagagcagcugguccagaccagcccugcagcccccacucagcc

SEQ ID NO: 262262 - RNA, 64 nt, Human
cugaagcccaugcuuucccaccagcaugucacucccagaccaccucccugcccuguccuccagc

SEQ ID NO: 262263 - RNA, 64 nt, Human
ccugucauacuuuuugcauugaucguuaugaauaccagaccauuuguaagugugguugaagagc

SEQ ID NO: 262264 - RNA, 64 nt, Human
uucuuacuuaauccuccuugccaccccaccaucaccagaccacugaucugcuuucuuuaugauc

SEQ ID NO: 262265 - RNA, 64 nt, Human
ggaaacaggcagaccagggccccgugggggcagcccagaccaguacccuuaccgaacccaggau

SEQ ID NO: 262266 - RNA, 64 nt, Human
cuacuugggcagcucccugcugagugaacauaucccagaccauugccagcuccacucucugguu

SEQ ID NO: 262267 - RNA, 64 nt, Human
gcccuucaggugccuucuacucccagugccaaagccagaccacugggguuuccugcugcaggaa

SEQ ID NO: 262268 - RNA, 64 nt, Human
gagagagcacuuucuucccagagccccaugcucuccagaccaaugucugggcuucccuuucuug

SEQ ID NO: 262269 - RNA, 64 nt, Human
gcaaaggugggaggaucauuugagcucaggaguuccagaccagccugggcaacauagcaaaauc

SEQ ID NO: 262270 - RNA, 64 nt, Human
ggaggauuuucuguuuuggaaaacaccauuagaaccagaccagcuuuguuuuggguuagagaga

SEQ ID NO: 262271 - RNA, 64 nt, Human
aguggauguggaggagugaccagaccagaccagaccagaccagagggaucggaggcucaggccc

SEQ ID NO: 262272 - RNA, 64 nt, Human
guggaaguggauguggaggagugaccagaccagaccagaccagaccagagggaucggaggcuca

SEQ ID NO: 262273 - RNA, 64 nt, Human
aagggguggaaguggauguggaggagugaccagaccagaccagaccagaccagagggaucggag

SEQ ID NO: 262274 - RNA, 64 nt, Human
uuucuuaauauuuggacaugcaguugucgccaaacuuggguauucauggaauuucuaguaaaug

SEQ ID NO: 262275 - RNA, 64 nt, Human
gaggcugcuagaguguagugguuaagaacaggaacuuggguaccaggcgccugaauuuuaauca

SEQ ID NO: 262276 - RNA, 64 nt, Human
cuaggcuggaguugcuuccuugaagaugggacuccuuggguaucaagaccuaugccacaucaca

SEQ ID NO: 262277 - RNA, 64 nt, Human
caaugaagggguggaaguggauguggaggagugaccagaccagaccagaccagaccagagggau

SEQ ID NO: 262278 - RNA, 64 nt, Human
ccaucuuccagcugaccagacuaaacucccaaccccagaccagggcaggggacaggucucaagu

SEQ ID NO: 262279 - RNA, 64 nt, Human
ggccucaucuugaaccagaccuuaacgaccaaacccagaccaugccaaaguccagucugaaaug

SEQ ID NO: 262280 - RNA, 64 nt, Human
auuaucuuccuaaaucaaggaaaggaaaucauccccagaccauuuaugcugagcuuuggaauac

SEQ ID NO: 262281 - RNA, 64 nt, Human
uguuuacucagaaccugcuccuggaguacaccaaccagaccacucaggcacgccccaggcccac

SEQ ID NO: 262282 - RNA, 64 nt, Human
aagcaaacagccaggcucccugagggccaggcccccagaccaucuuggguuggaauugaguggc

SEQ ID NO: 262283 - RNA, 64 nt, Human
acuugggccauuguuggugggggcuccuuuccggccagaccacaaggccagaagcaauaauggc

SEQ ID NO: 262284 - RNA, 64 nt, Human
gggcagguuuuuaaaaauuagcuaggcaucaaggccagaccagggcuggggguugggcuguagg

SEQ ID NO: 262285 - RNA, 64 nt, Human
cugugucucugaauuccugucuuccaaauugaagccagaccaugcugaugaccucaaguagcac

SEQ ID NO: 262286 - RNA, 64 nt, Human
auaucaaaauaggauuucuuaaauuuuucaacccccagaccauacugacucaacauggagucuc

SEQ ID NO: 262287 - RNA, 64 nt, Human
gagcagcauucugagagacgcacaggagaccaagccagaccaauaaacagaacacuuuuccuuc

SEQ ID NO: 262288 - RNA, 64 nt, Human
aauucuaggcccuucagcagagacccauuugugcccagaccacaauauuucuucuuccucaggg

SEQ ID NO: 262289 - RNA, 64 nt, Human
auguuuguguuuuugguuaugcccaucuccauagccagaccaagcacucuggaagccaggguug

SEQ ID NO: 262290 - RNA, 64 nt, Human
uagcgugucucucaacacuggggcugcugcaacaccagaccagugaucuuuccuaagcaucguu

SEQ ID NO: 262291 - RNA, 64 nt, Human
ucuuaaaaggauuuggaaauggaacaaguagcuuccagaccagauacuaccuguggcaagaaug

SEQ ID NO: 262292 - RNA, 64 nt, Human
uauuucaacugcuguaaaauuauaaacuuuuauacuuggguaagucccccaggggcgaguuccu

SEQ ID NO: 262293 - RNA, 64 nt, Human
uuuguggggaaaguagcauuccuccaccucaggccuuggguagauuuggcaaaagaacaggagc

SEQ ID NO: 262294 - RNA, 64 nt, Human
caggaagaauucaaugacuaugaggccaacgacccuuggguacaacaguucauccuuaaccugg

SEQ ID NO: 262295 - RNA, 64 nt, Human
agaugggugcugguccuguugaucccagucucugccagaccaaggcgaguuuccccacuaauaa

SEQ ID NO: 262296 - RNA, 64 nt, Human
acggugugccccuacgcagguacagccgccgcuuccagaccauugacaucgagccugacaucga

SEQ ID NO: 262297 - RNA, 52 nt, Human
cagcucccccgacgcuguaacuccagaccaccuugaguguggcaccuccccu

SEQ ID NO: 262298 - RNA, 64 nt, Human
cacaccugggcagccacuucauauaaagguuacuccagaccauguacaaaacacagccacucuu

SEQ ID NO: 262299 - RNA, 64 nt, Human
gacugaggucuuagcacauguacugguggaguuuccagaccaccaguaugaauaaaagcuuguu

SEQ ID NO: 262300 - RNA, 64 nt, Human
acaggcauaccauggagauauuacaggaucaguuccagaccaccauaauaaaguggauaucgca

SEQ ID NO: 262301 - RNA, 64 nt, Human
ucagucauguucccaggucugaggggagcaauggccagaccaguuucaguaucucuggcaacag

SEQ ID NO: 262302 - RNA, 64 nt, Human
aaaaguuuucuuuacuguugguuaaaaaaaaaagccagaccauaguuugacugguggcauggaa

SEQ ID NO: 262303 - RNA, 64 nt, Human
agccugagguggcucaggaagcggagaaagggugccagaccauucucuggcggggaccagggcc

SEQ ID NO: 262304 - RNA, 64 nt, Human
cucccugauagaugcugagagcauccagaaacuuccagaccagcccucucaccacacccagaag

SEQ ID NO: 262305 - RNA, 64 nt, Human
ccagaagaggccuuucccaucuggagagaagcuuccagaccagcccuucacacaccacagccag

SEQ ID NO: 262306 - RNA, 64 nt, Human
ccaggaggggccuuucccaccuggagagaaacuuccagaccagccccucauaccacagccaaga

SEQ ID NO: 262307 - RNA, 64 nt, Human
ccaagaggggccuuucucaccuggagagaaauuuccagaccauccccucucaccacagccagga

SEQ ID NO: 262308 - RNA, 64 nt, Human
ccaggagaggccuuucccaccgguagagaaacuuccagaccagccccucacaccacagccaaga

SEQ ID NO: 262309 - RNA, 64 nt, Human
ccaagagaagccuuuccagccuggagagaaacuuccagaccagcccucucacuacagccaggag

SEQ ID NO: 262310 - RNA, 64 nt, Human
gauucacugccuaugaacagaccaucccccacuccuuggguauccccaaccccagacccccauc

SEQ ID NO: 262311 - RNA, 64 nt, Human
ugaccuuaauguuuuuccaaucuucuucccccuacuuggguaauugauuaaaauaccuccauuu

SEQ ID NO: 262312 - RNA, 64 nt, Human
gggaagggguguucugguggagugggaagggaggcuuggguaggauugugggauaagaucgccc

SEQ ID NO: 262313 - RNA, 64 nt, Human
ccaggagaggccuuucccaccuggacagaaacuuccagaccagccccucucaccacagccagga

SEQ ID NO: 262314 - RNA, 64 nt, Human
ccaggagaggccuuuaccaccuggagagaagcuuccagaccagccccucacaccacagccagga

SEQ ID NO: 262315 - RNA, 64 nt, Human
ccaggagaggccuuucccaccuggagagaaacuuccagaccagccccucauaccacagccaaga

SEQ ID NO: 262316 - RNA, 64 nt, Human
ccaagaggggccuuucucaccuggagagaaacuuccagaccagccccucacaccaccgccagga

SEQ ID NO: 262317 - RNA, 64 nt, Human
ccaggagaggccuuucccaccgggagagaaacuuccagaccagccccucacaccacagccagga

SEQ ID NO: 262318 - RNA, 64 nt, Human
ccaggagaggccuuucccaccgggagagaaacuuccagaccagcccucucacuacagccagaag

SEQ ID NO: 262319 - RNA, 64 nt, Human
ccagaagaggccuuucccaccgggagaggaacuuccagaccagccccucacaccacagccagga

SEQ ID NO: 262320 - RNA, 64 nt, Human
ccaggagaggccguuccugccuggagagaagcuuccagaccagcccuucacaccacagccagga

SEQ ID NO: 262321 - RNA, 64 nt, Human
ccaggagaggccuuucccaccuggagagaaacuuccagaccagccccucucaccacagccagga

SEQ ID NO: 262322 - RNA, 64 nt, Human
gcagcugaagugggccagccuugcaccagccaggccagaccaccauggugaaggcuucuuuccc

SEQ ID NO: 262323 - RNA, 64 nt, Human
cgacugagugccagcuuauuugugaugccccuucccagaccagguuaggauuccugggaaggcc

SEQ ID NO: 262324 - RNA, 64 nt, Human
gccaaagcaggaggauagcuugaggccaggaguuccagaccagccugggcaacauagugagauc

SEQ ID NO: 262325 - RNA, 64 nt, Human
uuuuuaauugauguuguuaugggcaggauggcaaccagaccauugucucagagcaggugcuggc

SEQ ID NO: 262326 - RNA, 64 nt, Human
gaauaacacuuguauugaccaauuuagacagauaccagaccaauuuugcauuuaagaaauuguu

SEQ ID NO: 262327 - RNA, 64 nt, Human
uaccuuaauuucgacacacuucuguugaaucucaccagaccaugugggaggauuuaggugaauc

SEQ ID NO: 262328 - RNA, 64 nt, Human
uauuguuuaaagcugcauucaacgucaaaauuaccuuggguaacuuuugauaacuuacaugugu

SEQ ID NO: 262329 - RNA, 64 nt, Human
gcaggcgaacagagcucucucuggaucagcuuuacuuggguagauuaaguuaaauaagcaaaag

SEQ ID NO: 262330 - RNA, 64 nt, Human
uaaaguagaaguuacauaauucuauauuuuaagucuuggguaaaaaaguaguuuuacauuuuau

SEQ ID NO: 262331 - RNA, 64 nt, Human
agacccugccuuguccuggcaagcauagguuuucccagaccacaaugcugauauaucuuauuua

SEQ ID NO: 262332 - RNA, 64 nt, Human
uauuugaugauagagguuuauuaauuuuguuuauccagaccauuaauuuuauuuguuuuuguuc

SEQ ID NO: 262333 - RNA, 64 nt, Human
cggccgaagucuggucacgcucagacagagcugaccagaccagaccguuugccuuuucaaguuu

SEQ ID NO: 262334 - RNA, 50 nt, Human
ucugggacaugcucaccugaccagaccagcccagccguccuguccugcca

SEQ ID NO: 262335 - RNA, 64 nt, Human
gggccuaaccacagauccuggaguucugcaaccuccagaccagagcggucucaugaaccaccuc

SEQ ID NO: 262336 - RNA, 64 nt, Human
cagaaaucuaaacacacauccgucccaacauuccccagaccauucagaaucacacagcguauua

SEQ ID NO: 262337 - RNA, 64 nt, Human
gagaaugccuucuagaugcaaaaucaccuccaaaccagaccacuuuucuugacuugccuguuuu

SEQ ID NO: 262338 - RNA, 64 nt, Human
augguuguccauucuggggcuuaaagaacugggaccagaccaaguagaggccuuggugcugguu

SEQ ID NO: 262339 - RNA, 64 nt, Human
ugcucuaagugaaagaacugucaucugcuggugaccagaccagacuuuucagauugcuuccugg

SEQ ID NO: 262340 - RNA, 64 nt, Human
cgggacacccgagagcuccaggagccccgugaacccagaccacccagugccauggccacuuagg

SEQ ID NO: 262341 - RNA, 64 nt, Human
ggcucagcagcaggacgacuugagcccaagaguuccagaccagccuggccaccuuagugagauc

SEQ ID NO: 262342 - RNA, 64 nt, Human
ggaagugcagaggauuuagaaaaguacaugauccccagaccacaacaaaccaaaacauaaacuc

SEQ ID NO: 262343 - RNA, 64 nt, Human
gcucagcaagguucucaacugccucgaguacccaccagaccaagaaggccugcggcagagccga

SEQ ID NO: 262344 - RNA, 64 nt, Human
ucugagccuaaaggaggaaaagucccaccaacuaccagaccagaacacgagccccucugggcag

SEQ ID NO: 262345 - RNA, 64 nt, Human
aagcucugccugagcuuuccacuaggcacgccagccagaccaauaaaaagcgucugucccacuc

SEQ ID NO: 262346 - RNA, 64 nt, Human
ugggaacucuggacuugaguguguuugccucuuccuuggguaugaaugugugaguucacccaga

SEQ ID NO: 262347 - RNA, 64 nt, Human
uaacugcuagcuauagaaauccaauuaagacucacuuggguaaaaaaaaauaaaaaaauaaaca

SEQ ID NO: 262348 - RNA, 64 nt, Human
agagcaguuaacaaacaaaggcaguagcucaucacuuggguagcagguacccauuuuaggaccc

SEQ ID NO: 262349 - RNA, 64 nt, Human
cauccaccugagaacuccacuacccuuuucccucccagaccacgaauuagaagauauguggaag

SEQ ID NO: 262350 - RNA, 64 nt, Human
cguugaucauucucagaucauugauuggccuccacuuggguaugugaauuauucaugucccaga

SEQ ID NO: 262351 - RNA, 64 nt, Human
auuuaaauguguuuuuccugagagacaaggaagacuuggguauuucccaaaacagguaaaaauc

SEQ ID NO: 262352 - RNA, 64 nt, Human
aaaaaacucgcugacauaaucucccuagugaaaacuuggguaauauauguaagaaauggcaaau

SEQ ID NO: 262353 - RNA, 64 nt, Human; identical to SEQ ID NO: 185729

SEQ ID NO: 262354 - RNA, 64 nt, Human; identical to SEQ ID NO: 185730

SEQ ID NO: 262355 - RNA, 64 nt, Human; identical to SEQ ID NO: 185731

SEQ ID NO: 262356 - RNA, 64 nt, Human; identical to SEQ ID NO: 185732

SEQ ID NO: 262357 - RNA, 64 nt, Human; identical to SEQ ID NO: 185733

SEQ ID NO: 262358 - RNA, 64 nt, Human; identical to SEQ ID NO: 185734

SEQ ID NO: 262359 - RNA, 64 nt, Human; identical to SEQ ID NO: 185735

SEQ ID NO: 262360 - RNA, 64 nt, Human; identical to SEQ ID NO: 185736

SEQ ID NO: 262361 - RNA, 64 nt, Human; identical to SEQ ID NO: 185737

SEQ ID NO: 262362 - RNA, 64 nt, Human; identical to SEQ ID NO: 185738

SEQ ID NO: 262363 - RNA, 64 nt, Human; identical to SEQ ID NO: 185739

SEQ ID NO: 262364 - RNA, 64 nt, Human; identical to SEQ ID NO: 129961

SEQ ID NO: 262365 - RNA, 64 nt, Human
auuuccugugccagaaucacugcucuauuccauaccgugccauggaggcuguuuuagaaguggu

SEQ ID NO: 262366 - RNA, 64 nt, Human
uaaccuguguugcagguacaaccggaugccagccccgugccaggagccuggagggaaguugggg

SEQ ID NO: 262367 - RNA, 59 nt, Human
accgcguuguggugcccugagucuggggcccgugccagccggcagcccccaagccugcc

SEQ ID NO: 262368 - RNA, 55 nt, Human
cugucucucccccagacugauucuuccagaccagaguuugaugccagcagcuucg

SEQ ID NO: 262369 - RNA, 64 nt, Human
cuucuucacacaccccacaucucugggcuuugugccagaccaucucuaacuuaauccucucauc

SEQ ID NO: 262370 - RNA, 64 nt, Human
gugcacacaugggccauagcccuaaggacuccugccagaccacacagcccacaccuggcccugu

SEQ ID NO: 262371 - RNA, 64 nt, Human
aggccgaggcaggcggaucacgaggucaagagauccagaccauccuggcuaacacggugaaacc

SEQ ID NO: 262372 - RNA, 64 nt, Human
agaaugauuuugcugacuucccaagcccuggugaccagaccaaggcagggcccagcauaauucc

SEQ ID NO: 262373 - RNA, 64 nt, Human
ucccuauguauucucuguuuccaucuuuaaguucccagaccaauauacauuaagaguuuugcau

SEQ ID NO: 262374 - RNA, 64 nt, Human
uuuuaauaaagcagcuauggaggccaagaacaugccagaccaauauucuacaguuugcaacaau

SEQ ID NO: 262375 - RNA, 64 nt, Human
aaacauuuuuuuuaaaaauuagccuugauauucuccagaccaaagcaaucauuaagugacuuug

SEQ ID NO: 262376 - RNA, 64 nt, Human
aacagucuuucuuccuuugucguguuucuugcucccagaccaaggcacugacgacaguacugau

SEQ ID NO: 262377 - RNA, 64 nt, Human
ugacacaggccacgguggcuccagccaggaccagccagaccagcagagcagggagccacuugcc

SEQ ID NO: 262378 - RNA, 64 nt, Human
accgccgcggacaaucccccaccccgaucccucgccagaccaggacgcuuccucaagcccagcc

SEQ ID NO: 262379 - RNA, 64 nt, Human
guaaauuaaggaucuggcaucauacaaaaugaagccagaccacuaaugcauuacaguaguucuu

SEQ ID NO: 262380 - RNA, 64 nt, Human
caaagucucaagaccaaggugacucaagauaacaccagaccacgcaugaucaccaaaaccuucc

SEQ ID NO: 262381 - RNA, 64 nt, Human
cuuccaugaaaauaaaugcugccuggacccccacccagaccacacacugacggccggcuccggc

SEQ ID NO: 262382 - RNA, 64 nt, Human
gaugcaaucucuugucucacaugcuagcaacauaccagaccacucugcuucauuuuugggagaa

SEQ ID NO: 262383 - RNA, 64 nt, Human; identical to SEQ ID NO: 107765

SEQ ID NO: 262384 - RNA, 64 nt, Human; identical to SEQ ID NO: 107771

SEQ ID NO: 262385 - RNA, 64 nt, Human; identical to SEQ ID NO: 107777

SEQ ID NO: 262386 - RNA, 64 nt, Human; identical to SEQ ID NO: 107783

SEQ ID NO: 262387 - RNA, 64 nt, Human
gucuuuauugccaccuacugacacucgauuuaggccagaccagagguaaggauuuuuuaaagau

SEQ ID NO: 262388 - RNA, 64 nt, Human
gccagcagccccagacugcccaaaaacuugcccaccagaccaagggcagugccccaaggccccu

SEQ ID NO: 262389 - RNA, 64 nt, Human
ugaaucaaaagccacuuuguuaggcgaggauuucccagaccacucaucacauuaaaaaauauuu

SEQ ID NO: 262390 - RNA, 64 nt, Human
ugcacauccagggcaagaaacauguccaaguuacccagaccauugauaacaguugcauuuaggu

SEQ ID NO: 262391 - RNA, 64 nt, Human
ucugcaaaacuuccuggaguucagcccagcaaggccagaccaaggaggcagcaaccugccuuuc

SEQ ID NO: 262392 - RNA, 64 nt, Human
gcaaccaaaggcaacagagucuagcucauggccaccagaccaaaagcauccagcuucugugcac

SEQ ID NO: 262393 - RNA, 64 nt, Human
cugcccucucaccucugacacccagccccaggagccagaccacuccugccuccaccucugacuc

SEQ ID NO: 262394 - RNA, 64 nt, Human
gugaugaugguguccuuuagggcucuuggagcagccagaccauguuuccaagagaaaccuggug

SEQ ID NO: 262395 - RNA, 64 nt, Human
cuguccuccuuuacucuagauucauucagcuuuuccagaccaggcaucaccgagcggagagagg

SEQ ID NO: 262396 - RNA, 64 nt, Human
ggagccuaggcccagcuccuccgcgguuggccccccagaccauaccucugacccacccagcccc

SEQ ID NO: 262397 - RNA, 64 nt, Human
ggggaaaaucaccccccagccaccucggggaacuccagaccaagggugagggcgccuuucccuc

SEQ ID NO: 262398 - RNA, 64 nt, Human
caugacaggcuguucagccgggaggguggugggcccagaccacugucuccacccaccuugacgu

SEQ ID NO: 262399 - RNA, 64 nt, Human
gucugccgguggccuccagcagcaccacagagcuccagaccaaccaccccaagugccguuugga

SEQ ID NO: 262400 - RNA, 64 nt, Human
uaaaaagugacuuaaaauaagccaacagacucucccagaccacacaacuaguggaaugauuccu

SEQ ID NO: 262401 - RNA, 64 nt, Human
ccuggcucggaccacugcaagggccgaggcagggccagaccagagcauccuggguacaggccug

SEQ ID NO: 262402 - RNA, 61 nt, Human; identical to SEQ ID NO: 107789

SEQ ID NO: 262403 - RNA, 64 nt, Human; identical to SEQ ID NO: 107795

SEQ ID NO: 262404 - RNA, 64 nt, Human; identical to SEQ ID NO: 107801

SEQ ID NO: 262405 - RNA, 64 nt, Human; identical to SEQ ID NO: 107806

SEQ ID NO: 262406 - RNA, 64 nt, Human
agcauuacuagagauguuucaaauguagauuuuaccagaccauuuuaaucaacuuuauugagau

SEQ ID NO: 262407 - RNA, 64 nt, Human
gacugugaaauacuuagccaugcagaauaugugaccagaccagagcauguguaggaagacuuua

SEQ ID NO: 262408 - RNA, 64 nt, Human
uuuccaucaaaugaccaacagcuucucaauaaaaccagaccauuucucaccugcaucaugucug

SEQ ID NO: 262409 - RNA, 64 nt, Human
ugcugggauuacaggcgugagccacugcgccuggccagaccauuuuagaauugggaaauuuuag

SEQ ID NO: 262410 - RNA, 64 nt, Human
auuaaggauuuacugaauaagguguugaccaaauccagaccauuuuauuuuauuuuuuuauuua

SEQ ID NO: 262411 - RNA, 64 nt, Human
gaggaguuucuuaaugagauauuuguauuuauuuccagaccaauaaauuuguaacuuugcagcg

SEQ ID NO: 262412 - RNA, 64 nt, Human
aagguucccuggugcugccucacacuccugagauccagaccacgagaagugaccuucaggguca

SEQ ID NO: 262413 - RNA, 64 nt, Human
aggcugaggugaguggauuacaaggucaggaguuccagaccagccuggcuaauauggugaaacc

SEQ ID NO: 262414 - RNA, 64 nt, Human
aucuuguccaaauuuagugaaauguggaagucaaccagaccaaugauggaauuaaauguaaauu

SEQ ID NO: 262415 - RNA, 64 nt, Human
gccgaguugggagguuugcuugagcccaggaguuccagaccagccugggcaacauggcgaaacc

SEQ ID NO: 262416 - RNA, 64 nt, Human
guuucuuccucacaaaaccauaucucauuuauauccagaccauuacuucacuauaauuacaagg

SEQ ID NO: 262417 - RNA, 64 nt, Human
cccagguuccgccccagagcgguccuggacaaggccagaccaaagcaagcagggccuggcaccu

SEQ ID NO: 262418 - RNA, 64 nt, Human
cauggaacagcccugcacgcccaggaugaaggggccagaccacgccccugccugagaccacggu

SEQ ID NO: 262419 - RNA, 50 nt, Human
gcggcggcagggacagcugaccagaccacgggcagggccugccuccgugu

SEQ ID NO: 262420 - RNA, 64 nt, Human
cuggggugguugaggagcgaguucucucuuccucccagaccaaguuccucccucggguuugccu

SEQ ID NO: 262421 - RNA, 64 nt, Human; identical to SEQ ID NO: 107811

SEQ ID NO: 262422 - RNA, 64 nt, Human; identical to SEQ ID NO: 107816

SEQ ID NO: 262423 - RNA, 64 nt, Human; identical to SEQ ID NO: 107821

SEQ ID NO: 262424 - RNA, 64 nt, Human; identical to SEQ ID NO: 107827

SEQ ID NO: 262425 - RNA, 64 nt, Human
aacagccagcuuuggcgcuguuggggagacuccuccagaccaggaaccccagaaggagacagag

SEQ ID NO: 262426 - RNA, 64 nt, Human
gcuccguuguucccuugcccugguggugggggggccagaccaccuccggaauccugccaccugu

SEQ ID NO: 262427 - RNA, 64 nt, Human
cagccuuugacccacaacggccacacagccgccuccagaccagcacucggacugcccugcagug

SEQ ID NO: 262428 - RNA, 64 nt, Human
caccugugaccagcagcugaugccuccuuggccaccagaccaugggccaagagccgccguggcu

SEQ ID NO: 262429 - RNA, 64 nt, Human
ucaccgggcaaauggggucggggggacuggggcaccagaccaggcaccaccuggacacuuucuu

SEQ ID NO: 262430 - RNA, 64 nt, Human
ggggacauaacaagcucugcugggcuugagggacccagaccaggugucugcagucagcuccuga

SEQ ID NO: 262431 - RNA, 64 nt, Human
accuguguccuccgggagaggcccccuccucuccccagaccacagggggccucucugccuccag

SEQ ID NO: 262432 - RNA, 51 nt, Human
gcgugcagccggcccaguagcccagaccacggcagggcaugaccuggggag

SEQ ID NO: 262433 - RNA, 64 nt, Human
cagcgcugaccuaagagcucccugugccgucuauccagaccagacuucgguagaugccuuuguu

SEQ ID NO: 262434 - RNA, 64 nt, Human
gaugccuuucagaaauuuguauauuuugcaguugccagaccaauaaaauaccugguugaaauac

SEQ ID NO: 262435 - RNA, 64 nt, Human
gcugaggugggcaaaucaccugaggucaggaguuccagaccagccuggccaacaugaugaaacc

SEQ ID NO: 262436 - RNA, 64 nt, Human
cagaguugccucuccuccuccucuuccccaacccccagaccaugaccagccuuagaaaauccau

SEQ ID NO: 262437 - RNA, 64 nt, Human
cagccuccacaccagaucuccacauugucuugauccagaccagcucugugaucagaaggaaauu

SEQ ID NO: 262438 - RNA, 64 nt, Human
aagcagagacaacugccacccagccugggccuucccagaccagcauuugcacaauaucaccagg

SEQ ID NO: 262439 - RNA, 64 nt, Human
aaagacaaauaauccaacgcugcuagucuuaaccccagaccagagagaacugcagaucugacug

SEQ ID NO: 262440 - RNA, 64 nt, Human; identical to SEQ ID NO: 107832

SEQ ID NO: 262441 - RNA, 64 nt, Human; identical to SEQ ID NO: 107837

SEQ ID NO: 262442 - RNA, 64 nt, Human; identical to SEQ ID NO: 107842

SEQ ID NO: 262443 - RNA, 64 nt, Human; identical to SEQ ID NO: 107848

SEQ ID NO: 262444 - RNA, 64 nt, Human
uucuuauugguugauauuaccacaugaaauauugccagaccaagauaccuaaacucaugauguc

SEQ ID NO: 262445 - RNA, 64 nt, Human
uccaccccugccuccccuccaccugccccagugcccagaccaaccaaggcccugacagcccugc

SEQ ID NO: 262446 - RNA, 64 nt, Human
gcaccauuugcuguccagcugccugucguuuggcccagaccacccucagaaaaaaaccagcugc

SEQ ID NO: 262447 - RNA, 64 nt, Human
gccgaggcaggcggaucaccugaaaucaggaguuccagaccagccugggcaacauggugaaacc

SEQ ID NO: 262448 - RNA, 64 nt, Human
uguauguggaauccaagaauaaccauaggcucuaccagaccagaaggguaaggauggacacuaa

SEQ ID NO: 262449 - RNA, 64 nt, Human
accuccucccugacccuuaacacuccuguccugcccagaccaacagagagagcugucccugaga

SEQ ID NO: 262450 - RNA, 64 nt, Human
gcacaaacucucccuuccaccuuuacgacccucuccagaccagaccuggaguccucuucaagca

SEQ ID NO: 262451 - RNA, 64 nt, Human
gaccuuggaccugcuugguuaaggagggagugggccagaccagagugccaggagcuaauggagc

SEQ ID NO: 262452 - RNA, 64 nt, Human
uggcccagugagcccagacgcuccuccaccccuuccagaccaagcucaacgccuccaagaccag

SEQ ID NO: 262453 - RNA, 63 nt, Human
aagaagauuacgacuccuagcgccuucugccccccagaccauagccccuuuuaguugguuuua

SEQ ID NO: 262454 - RNA, 64 nt, Human
gaggggcagggagcccuuuccucgguucuggccuccagaccaggguaagggcaggccccuccaa

SEQ ID NO: 262455 - RNA, 61 nt, Human
cagagauccagaugguuugaaggccgcagagccagaccauuucuuccccagguccugaagu

SEQ ID NO: 262456 - RNA, 64 nt, Human
ccugagguggugaaggcaggaugcucucucuaagccagaccagagggacucagacaccaccgau

SEQ ID NO: 262457 - RNA, 64 nt, Human
cccgcucuaaggggugcaagaggaaggagugugcccagaccagcugggggagcauugaaaggac

SEQ ID NO: 262458 - RNA, 64 nt, Human
accccacggaggaugagaagaggcagaucgcagcccagaccaaccucacccuccugcaaguaaa

SEQ ID NO: 262459 - RNA, 64 nt, Human; identical to SEQ ID NO: 107854

SEQ ID NO: 262460 - RNA, 64 nt, Human; identical to SEQ ID NO: 107860

SEQ ID NO: 262461 - RNA, 64 nt, Human; identical to SEQ ID NO: 107866

SEQ ID NO: 262462 - RNA, 64 nt, Human; identical to SEQ ID NO: 107872

SEQ ID NO: 262463 - RNA, 64 nt, Human
acaaagggagaguggcaucccugcugcugcugugccagaccagaguuuccugaggggcccugac

SEQ ID NO: 262464 - RNA, 64 nt, Human
acccugcuucuuucucccccagaaucgacauaguccagaccacccagguaugggcagcucccag

SEQ ID NO: 262465 - RNA, 54 nt, Human
ccccggaugaggccaucugagccuccagaccagaccccaaaccagcccuugagu

SEQ ID NO: 262466 - RNA, 64 nt, Human
acccaagcuccuccucggaaccgcucaccuagagccagaccaacguuacucagggcuccuccca

SEQ ID NO: 262467 - RNA, 64 nt, Human
gagaaaauacugaaagcacaggggcagggacagaccagaccagacccaggagucuccaaagcac

SEQ ID NO: 262468 - RNA, 64 nt, Human
aguguuccuccucaccccacguccuggggucaggccagaccauguuucgucagccuuggggacu

SEQ ID NO: 262469 - RNA, 64 nt, Human
gcagaccggcccagacagccaggcuguggcugguccagaccaacugcuaugguggaaaaugcag

SEQ ID NO: 262470 - RNA, 64 nt, Human
uccccuuucagcucccaugagcaugcauaguucaccagaccaauggccuagccauucucuaagu

SEQ ID NO: 262471 - RNA, 64 nt, Human
uaaauuaaacauuugguagagucaucauaaaacaccagaccacuuagacucaggcugaaccaua

SEQ ID NO: 262472 - RNA, 64 nt, Human
ucugcgccugccccacacccucccuuacccuccuccagaccauucaggacacagggaaaucagg

SEQ ID NO: 262473 - RNA, 64 nt, Human
acucccuggacuagugcaguccuugcccucagccccagaccagagaugggugguauaugccaug

SEQ ID NO: 262474 - RNA, 64 nt, Human
ugugcaaagaaagaauguguagcaaaugaaaauaccagaccaagaaaugagugagcugggaagu

SEQ ID NO: 262475 - RNA, 64 nt, Human
ugccacacuaaugcuuguuggauucaugagguggccagaccaauguguuguuuuguuguuguuu

SEQ ID NO: 262476 - RNA, 64 nt, Human
gcuaaggaggggagagggggcauccugucucucuccagaccaucacugcacuuuaaccaggguc

SEQ ID NO: 262477 - RNA, 64 nt, Human
ggaaccacacccaaaauggacccccacuaccuucccagaccauauaucuccccuugaucauagu

SEQ ID NO: 262478 - RNA, 64 nt, Human; identical to SEQ ID NO: 107878

SEQ ID NO: 262479 - RNA, 64 nt, Human; identical to SEQ ID NO: 107884

SEQ ID NO: 262480 - RNA, 64 nt, Human; identical to SEQ ID NO: 107889

SEQ ID NO: 262481 - RNA, 64 nt, Human; identical to SEQ ID NO: 107895

SEQ ID NO: 262482 - RNA, 64 nt, Human
uuuccugcaggugauuacuuugaaaaagguugguccagaccauuuugaucaagaaccuguauau

SEQ ID NO: 262483 - RNA, 64 nt, Human
auggugccgcggcacguccccccugugacgcguuccagaccaacaugaccucucccugcuuucu

SEQ ID NO: 262484 - RNA, 64 nt, Human
aggcaggcagcaccagcagggguccaccaagagcccagaccagccccucugcccuccuacccgg

SEQ ID NO: 262485 - RNA, 64 nt, Human
aagaucacauuucugggaagaugagaacuuguuuccagaccagcauccaguggccaucaggucu

SEQ ID NO: 262486 - RNA, 64 nt, Human
cuuuaggacagcuuagaugccgagugggcgaaugccagaccaaugauacccagagcuaccugcc

SEQ ID NO: 262487 - RNA, 64 nt, Human
cuaaugccuugaaagaaugaacaaauaaaaauucccagaccacagaauuuccacagcaagaaua

SEQ ID NO: 262488 - RNA, 64 nt, Human
aggccaaggcagguggaucacgaggucaggagauccagaccauccuggcuaacauggugaaacc

SEQ ID NO: 262489 - RNA, 64 nt, Human
ugaugccaaggccacauccccgugcuuccagugaccagaccacugaccacccugacuguccaaa

SEQ ID NO: 262490 - RNA, 64 nt, Human
gcuuaggcagaaggaucaccugagaucaggaguuccagaccagccuggccaacauggcgaaacc

SEQ ID NO: 262491 - RNA, 64 nt, Human
ggcauuugaagccuuucagccaguugcuucugagccagaccagcuguaagcugaaaccucaaug

SEQ ID NO: 262492 - RNA, 64 nt, Human
cuguguugcagaauggaguuuccauggauuucuaccagaccacugaaggaguuccuggaagccc

SEQ ID NO: 262493 - RNA, 64 nt, Human
uucgucggcugucggaaaguucugagcaguggcuccagaccaccuugucuugcuacuuggaacu

SEQ ID NO: 262494 - RNA, 64 nt, Human
aaacuucaucacacacugagaggccgucacagccccagaccacccgcuuggcccacgcagcagc

SEQ ID NO: 262495 - RNA, 64 nt, Human
cccagguggccugcgucuuuuuucucuucccuucccagaccaggaaaggcuuggcugguguaug

SEQ ID NO: 262496 - RNA, 64 nt, Human
gaaagguguuuggagaauucgagugccuaggaugccagaccagaguugagacaaaaagaaauaa

SEQ ID NO: 262497 - RNA, 64 nt, Human; identical to SEQ ID NO: 107898

SEQ ID NO: 262498 - RNA, 64 nt, Human; identical to SEQ ID NO: 107903

SEQ ID NO: 262499 - RNA, 64 nt, Human; identical to SEQ ID NO: 107907

SEQ ID NO: 262500 - RNA, 64 nt, Human; identical to SEQ ID NO: 107912

SEQ ID NO: 262501 - RNA, 64 nt, Human
aaagaaccagaguuggaaggcacuugacuggccaccagaccaacucugcuguuacugacaugcu

SEQ ID NO: 262502 - RNA, 64 nt, Human
cuugcuacuaccguuauacacauauaguguacagccagaccagauuaaacuucauauguaaucu

SEQ ID NO: 262503 - RNA, 64 nt, Human
ucaguuuuaaaguuaaauucuuuugauauuaauaccagaccaaagacauuuucuguuuccugga

SEQ ID NO: 262504 - RNA, 64 nt, Human
cugccugauugccaagggugcccagcacguggccccagaccaaucugagugacuuaguguuggc

SEQ ID NO: 262505 - RNA, 64 nt, Human
uggagugacaggugaccugcucaggugccccuccccagaccaaaugucccaggcacacagccca

SEQ ID NO: 262506 - RNA, 64 nt, Human
auucucuacccucaccccacagagccaucucucuccagaccaaaagcuggaaggagaguugcuu

SEQ ID NO: 262507 - RNA, 64 nt, Human
uuuaucauuuuaucaugaaaacuucuuugccuuaccagaccaguuaauaugugcacuaaacaag

SEQ ID NO: 262508 - RNA, 64 nt, Human
ccccccccaccccugccccuuggaagaguuguugccagaccaggguuuugggggaaaccugucu

SEQ ID NO: 262509 - RNA, 64 nt, Human
auaaagugauucuacucuucuaagcuuacagagaccagaccaggugaauguaacuggggaaaau

SEQ ID NO: 262510 - RNA, 64 nt, Human
gaguggagaugaccagaauauaagggugcaauucccagaccaucccugcgcaucugacugacuc

SEQ ID NO: 262511 - RNA, 64 nt, Human
gacuugggggugaaacuuuccaguuuacugaacuccagaccaugcauguaguccacuccagaaa

SEQ ID NO: 262512 - RNA, 64 nt, Human
gagcauuugguacacacuugaccuucugucguccccagaccaguagugaccaaucgggaguagc

SEQ ID NO: 262513 - RNA, 64 nt, Human
gcuuuucaugcuguucuucagagcugcaguuaugccagaccaucagccugccucccaguagagg

SEQ ID NO: 262514 - RNA, 64 nt, Human
caaccucgagccugggcucugguccacuacugccccagaccacccucaaagcuggucuucagaa

SEQ ID NO: 262515 - RNA, 64 nt, Human
agaagacuaaggcagaugggcuuccaggacuggcccagaccagccagggcuccuuguagaaaag

SEQ ID NO: 262516 - RNA, 64 nt, Human
acuucaggagcugacagagccagaggcaccuaaacuuggguacaucuuguaagacacauaauga

SEQ ID NO: 262517 - RNA, 64 nt, Human; identical to SEQ ID NO: 107918

SEQ ID NO: 262518 - RNA, 64 nt, Human; identical to SEQ ID NO: 107922

SEQ ID NO: 262519 - RNA, 64 nt, Human; identical to SEQ ID NO: 107926

SEQ ID NO: 262520 - RNA, 64 nt, Human
gaagagccaagaggcuccgagucugcagcagcagccagaccaguagcuggagccccagucccac

SEQ ID NO: 262521 - RNA, 64 nt, Human
uugugcuucuaauauuuauugcuuuauaaauaaaccagaccaggacuugcaaccuauaaaagcc

SEQ ID NO: 262522 - RNA, 64 nt, Human
cuaacaaccucaguaguaauuugcugagcaucauccagaccauuaauagaaucagcaaagcacu

SEQ ID NO: 262523 - RNA, 64 nt, Human
gccuagacucugucuaccuggucugguugggcagccagaccagcaggcuggccuauguggucua

SEQ ID NO: 262524 - RNA, 64 nt, Human
cugcagcaguggcuuagaaaguccaauuccaaagccagaccagaagauucuaucccccgcagcg

SEQ ID NO: 262525 - RNA, 64 nt, Human
cuucuacuaagagaagccacugcuccacccggagccagaccagaaacucaagagauaggguagc

SEQ ID NO: 262526 - RNA, 64 nt, Human
aggccgaggcgggcggcucacgacgucaggagauccagaccaucuuggcuaacagggugaaacc

SEQ ID NO: 262527 - RNA, 64 nt, Human
gggcaccguguaugcccuggcggucaucucgacgccagaccagaccaaagucuucagugcaucc

SEQ ID NO: 262528 - RNA, 64 nt, Human
ccguguaugcccuggcggucaucucgacgccagaccagaccaaagucuucagugcauccuacga

SEQ ID NO: 262529 - RNA, 64 nt, Human
ccccagcgcggcuuggccgccauccgggacgcuuccagaccaccugccagccaucacaagggga

SEQ ID NO: 262530 - RNA, 64 nt, Human
cagagcugccucucgguggccagcaggacucugcccagaccacacguagcccccaggcugcugg

SEQ ID NO: 262531 - RNA, 64 nt, Human
ggaauuggaucacaaucauguagcagaauggcacccagaccacugcccaccagugacggacaug

SEQ ID NO: 262532 - RNA, 62 nt, Human
gcuuguucacuggacucugauaguuggagcucccagaccaggcagugcugggagcaaccacc

SEQ ID NO: 262533 - RNA, 64 nt, Human
gcccccgaaugccccacacacacugcagcauugaccagaccauccgaaaccugcgucccuggug

SEQ ID NO: 262534 - RNA, 64 nt, Human
ggcugccaucacucuauaaaagugcuucaugagcccagaccaaaagcccacagugaaaugaagu

SEQ ID NO: 262535 - RNA, 64 nt, Human; identical to SEQ ID NO: 107932

SEQ ID NO: 262536 - RNA, 64 nt, Human; identical to SEQ ID NO: 107938

SEQ ID NO: 262537 - RNA, 64 nt, Human; identical to SEQ ID NO: 107944

SEQ ID NO: 262538 - RNA, 64 nt, Human; identical to SEQ ID NO: 107949

SEQ ID NO: 262539 - RNA, 64 nt, Human
agggcucugcaaaugccaguuugacaagcacugcccagaccaaccauggguucaaacuccagcc

SEQ ID NO: 262540 - RNA, 64 nt, Human
gccccuccccugccacacacacagacacguaauaccagaccaaccucaauccccgcaaacuaaa

SEQ ID NO: 262541 - RNA, 64 nt, Human
ggggcacggcgcugagacagagcuggagaugaggccagaccauggacacuacacccagcaauag

SEQ ID NO: 262542 - RNA, 64 nt, Human
uccuccugcgaagugaucugcaguggcuguuugaccagaccacaaaguucacaucuccugagcu

SEQ ID NO: 262543 - RNA, 64 nt, Human
aacuuacagaauuaaagauggcccauaaggaauuccagaccaauauuucuuccugcgguuuauu

SEQ ID NO: 262544 - RNA, 64 nt, Human
ugagaugggggucagcucuuuauauaaagggaaaccagaccaggccuaaagcccaccccuaccc

SEQ ID NO: 262545 - RNA, 64 nt, Human
cugcuggggcagaguugauugccuuccccaggagccagaccacugggggugcaucauuggggau

SEQ ID NO: 262546 - RNA, 64 nt, Human
auuuauaaaccagauacauguucuuagucuggucccagaccaaggagcuggucagacggcccuu

SEQ ID NO: 262547 - RNA, 64 nt, Human
cgggugucagaggacgaccaaucuuagggaauuuccagaccaaugagcaaaaugauugugcaca

SEQ ID NO: 262548 - RNA, 64 nt, Human
ccugcccccgggcacugcacagccugucugggggccagaccaccccauuguccauccuuguugu

SEQ ID NO: 262549 - RNA, 64 nt, Human
aguuguccccagagcacccugggccugggcugagccagaccagacccuugggagguggcccuau

SEQ ID NO: 262550 - RNA, 64 nt, Human
aagugguguguucacauacagugacccuuggccaccagaccacagaggauggagccugggaagc

SEQ ID NO: 262551 - RNA, 64 nt, Human
gugcuugacuccuggaaccugccugcucccucucccagaccagcuaguuuggggcuggggagcu

SEQ ID NO: 262552 - RNA, 64 nt, Human
agagaaggccaggggcuuuugcuaaaaauaguggccagaccagagcucuggagccaccuguccc

SEQ ID NO: 262553 - RNA, 64 nt, Human
gccaguuccagcuggcuccagccauccugcagggccagaccaaagagaagaugguuaccauggu

SEQ ID NO: 262554 - RNA, 64 nt, Human
aagacaagaaucuguguuuuggaaugagucuauucuuggguauugaacuuuuaguuuuguuugc

SEQ ID NO: 262555 - RNA, 64 nt, Human
aauugccuggccuuauauuuuucaguagauuagaccgugccaaucacaauccuggguggauuug

SEQ ID NO: 262556 - RNA, 64 nt, Human; identical to SEQ ID NO: 107955

SEQ ID NO: 262557 - RNA, 64 nt, Human; identical to SEQ ID NO: 107961

SEQ ID NO: 262558 - RNA, 64 nt, Human
cuggcucagcuccacucggguggaguggaaguggccagaccauuuagacggacaggguccucac

SEQ ID NO: 262559 - RNA, 64 nt, Human
uccuacuuguggaggaucaguagcuguuaugaugccagaccauuuggagaaguaucagaggccu

SEQ ID NO: 262560 - RNA, 64 nt, Human
aaaacaaucuaaaacaauucccuucuuuuucaucccagaccaauggcauuauuaggucuuaaag

SEQ ID NO: 262561 - RNA, 64 nt, Human
gagcugugcucccuugagugcacuugagcacuccccagaccagaucacuuuuuggacacaccca

SEQ ID NO: 262562 - RNA, 64 nt, Human
ccacugggcuccccccgggguugaaacggguuucccagaccagggguucagaggagacuauuua

SEQ ID NO: 262563 - RNA, 58 nt, Human
ccgcgcuuugggaguacugaggccgcgcccagaccagccugucgcgcauuaaaaccgu

SEQ ID NO: 262564 - RNA, 64 nt, Human
aggccgaggcaggcagaucacgaggucaggagauccagaccauccuggcuaacacggugaaacc

SEQ ID NO: 262565 - RNA, 64 nt, Human
aacccagcggcuuagccaagcccuaagccuguccccagaccaacccugggaccuauacagaaca

SEQ ID NO: 262566 - RNA, 64 nt, Human
gccgaggcggguggaucaccugaggucaggaguuccagaccagccuggccaacauggugaaacc

SEQ ID NO: 262567 - RNA, 64 nt, Human
agcacauuccauucuuuguggcccagggccuggaccagaccauugugauaccugaccccgccca

SEQ ID NO: 262568 - RNA, 64 nt, Human
gugugccagcccucagcaugacucugccaagcauccagaccacaaaugcaggaauuuggcugag

SEQ ID NO: 262569 - RNA, 64 nt, Human
gagcuugaccccuggacauuugcacugacuuuauccagaccaaagagcugccucuugguggcag

SEQ ID NO: 262570 - RNA, 64 nt, Human
cccuggugccccgcccagaccccugggcugacguccagaccaaucucaccccagaggcaacugg

SEQ ID NO: 262571 - RNA, 64 nt, Human
gcugcaucuccaguugcugccgccccaacugcugccagaccaugugcugccgcccaaccugcuc

SEQ ID NO: 262572 - RNA, 61 nt, Human
gaggcaggaagauuccuugagcacaggaguuccagaccagccugggcaauguagcaagacg

SEQ ID NO: 262573 - RNA, 64 nt, Human
uaggcuguuaggggcaguggagguagaaugacuccuuggguauuagaguuucaaccaugaaguc

SEQ ID NO: 262574 - RNA, 64 nt, Human; identical to SEQ ID NO: 107966

SEQ ID NO: 262575 - RNA, 64 nt, Human
ggcacggccgcucaccggaaggcugugugcggggacauccgagguggugguggacaggaaggac

SEQ ID NO: 262576 - RNA, 64 nt, Human
cuauuggagggaggugguguguucacgugagccuacauccgagggugcucuucguaagggguag

SEQ ID NO: 262577 - RNA, 64 nt, Human
gugcuucagagacuagauguaucugagagggucuccagaccagguuacugcaaaaaugagguuu

SEQ ID NO: 262578 - RNA, 64 nt, Human
uggggcugacacccaggcccgagcgccugcguucccagaccaugggaaaugggaauugcgcuca

SEQ ID NO: 262579 - RNA, 64 nt, Human
cucuuccuccacagauaaccgggggcuccucuccccagaccaaaaugaauugcaaguugccaca

SEQ ID NO: 262580 - RNA, 64 nt, Human
gcucccuccccuaaccuuggugccugauccauccccagaccaggacagcagccacucaguucuu

SEQ ID NO: 262581 - RNA, 64 nt, Human
cccugggguucaauacuggaagugccuuauuuaaccagaccaucagggcaucauagaauugagc

SEQ ID NO: 262582 - RNA, 64 nt, Human
cuuguuauuuuauuaauuugccugaaugaugagaccagaccagugucuacagauuuucauuguc

SEQ ID NO: 262583 - RNA, 64 nt, Human
aggcugguuuuuaauaacgaaugcagccacagcaccagaccaggggcuauuuuugugacccaca

SEQ ID NO: 262584 - RNA, 64 nt, Human
gcgggcccaggcgggccgggggcggggccgucauccagaccaaagccaugccauugcgcugccc

SEQ ID NO: 262585 - RNA, 64 nt, Human
ucuuggguuggagcaggagacccucauuugccacccagaccaaugugagccugcccccagcccc

SEQ ID NO: 262586 - RNA, 64 nt, Human
ccccaccaugucaaacccaagaccagccccaaggccagaccaaggcauguaggccugggcaggu

SEQ ID NO: 262587 - RNA, 64 nt, Human
gcgcuggccacagggcucccugcagggucagggaccagaccacgcccagaggaggggaggcacu

SEQ ID NO: 262588 - RNA, 64 nt, Human
caugcuuccugucccccgcuuacacgacaacgggccagaccacaggaaggacgguguuuguguc

SEQ ID NO: 262589 - RNA, 64 nt, Human
cugcgccggaggcugcggcggcgggagccacggaccagaccagccacauccagggguccucauu

SEQ ID NO: 262590 - RNA, 64 nt, Human
aaacucagugccuggguccagggccccagugcuuccagaccaagacuugggccaccacuugucc

SEQ ID NO: 262591 - RNA, 64 nt, Human
cacuucgguuccugauuggucccgggccaaggucccagaccaagcugaaucacgcuuucuccaa

SEQ ID NO: 262592 - RNA, 64 nt, Human; identical to SEQ ID NO: 107965

SEQ ID NO: 262593 - RNA, 64 nt, Human; identical to SEQ ID NO: 107967

SEQ ID NO: 262594 - RNA, 64 nt, Human; identical to SEQ ID NO: 107968

SEQ ID NO: 262595 - RNA, 64 nt, Human; identical to SEQ ID NO: 107969

SEQ ID NO: 262596 - RNA, 64 nt, Human
gcuaagguggguggaucaccugaggucaagaguuccagaccaggcuggccagcauggugaaacc

SEQ ID NO: 262597 - RNA, 64 nt, Human
cagggcuagaaguccagaacauguaugugggaccccagaccaucccagccaccccccaucuucc

SEQ ID NO: 262598 - RNA, 64 nt, Human
gucgaggugggcagauuaccugaggucaggaguuccagaccagccuggccaacauggugaaacc

SEQ ID NO: 262599 - RNA, 64 nt, Human
ggucaccugggggcagcuggugccgggucuucacccagaccacgcuggguccccucuguugggg

SEQ ID NO: 262600 - RNA, 64 nt, Human
acagugguccuuccugccugagcccugcacugucccagaccacacagaagucuggucaccucug

SEQ ID NO: 262601 - RNA, 64 nt, Human
guccccaggucccugcgcagccaccagggccccaccagaccauggguuccuuauucuggacaaa

SEQ ID NO: 262602 - RNA, 64 nt, Human
gccccagguugagagaacagaggccuagggaccuccagaccauuggaaucacuguuugccagcu

SEQ ID NO: 262603 - RNA, 64 nt, Human
uggugggucagauuugacucacugcccauaguuuccagaccaugauguucagguucauggaagc

SEQ ID NO: 262604 - RNA, 64 nt, Human
gauuaccuccugggaugggugcucacuaucuaccccagaccaaugccaccugcagccuguggag

SEQ ID NO: 262605 - RNA, 64 nt, Human
acaaacugucccuguccccaggcccacuccaguuccagaccacccuccaugcuccacccccagg

SEQ ID NO: 262606 - RNA, 64 nt, Human
ccccaaacguccuggacugcacagaccucccacuccagaccauccaggccugguucccaagacc

SEQ ID NO: 262607 - RNA, 64 nt, Human
gucacuggccucaaaggaccccacagcaccugggccagaccaacagcucgagggagaaccugaa

SEQ ID NO: 262608 - RNA, 64 nt, Human
agauaccagacauuugagugaaauuuuggauccaccagaccagccaccagcuaaaugccaguga

SEQ ID NO: 262609 - RNA, 64 nt, Human
gccgaggcgggcggaucacuugaggucaggaguuccagaccagccuggccaacauggugaaacu

SEQ ID NO: 262610 - RNA, 64 nt, Human
cccucgacucaagcccuuguccucauuauccggcccagaccaaagauucccucaucccuggggg

SEQ ID NO: 262611 - RNA, 64 nt, Human
cuggaaacaagugaccccagggccugucucccuucuuggguagggcagacaugccuuggugccg

SEQ ID NO: 262612 - RNA, 64 nt, Human
acugccuacagacaucaucacagcagccuccucacuuggguacuacaguguggaagcugagugc

SEQ ID NO: 262613 - RNA, 64 nt, Human
aagacccuucaguuuugaugcauuuugcugaacacuuggguagugagugggauccuauccaguu

SEQ ID NO: 262614 - RNA, 64 nt, Human
gucugcccucugaauucagacacacuauauuagaccagaccaccaugugucauugugugugugu

SEQ ID NO: 262615 - RNA, 64 nt, Human
aggccgaggugggcaaauuacgaggucaggagauccagaccauccuggcuaacacggugaaacc

SEQ ID NO: 262616 - RNA, 64 nt, Human
uggacccauugggaccagcccacccggaccuaacccagaccaucuccccccgccgggcuacgau

SEQ ID NO: 262617 - RNA, 64 nt, Human
uuguaaaagugacaugaaaauuacaacagauauuccagaccaaaauaauacaacaaucccagca

SEQ ID NO: 262618 - RNA, 64 nt, Human
gcucuggccaacccucagaaacccucacaauaaaccagaccagaaggaugucccaucugaaugc

SEQ ID NO: 262619 - RNA, 64 nt, Human
ucaccccuuucccccgccaaauaagaaacgcaagccagaccacgaugauuguagaagucccucc

SEQ ID NO: 262620 - RNA, 64 nt, Human
agccaaaugaagcaguuauguguuguccaguuuuccagaccaggacugaaauccagagaggguc

SEQ ID NO: 262621 - RNA, 64 nt, Human
gcagcagcuacaacauggucauccgggaggacaaccagaccaaccgccugcaggaggcucugaa

SEQ ID NO: 262622 - RNA, 64 nt, Human
gcaggcccugccgcccugagaccacaguccaaccccagaccaucccucuggccucugcugaauc

SEQ ID NO: 262623 - RNA, 64 nt, Human
cccuccaucucucuuccccauagaccccauaaccccagaccaaagagguucucuaagcagcugu

SEQ ID NO: 262624 - RNA, 64 nt, Human
agccagccugggaccucccaaaguggguggcuuaccagaccacccuuaaaugacuuucaucugg

SEQ ID NO: 262625 - RNA, 64 nt, Human
uacacccacaagcaaggccuuggauuucuggcucccagaccaccugcuuuuguucugaguuugu

SEQ ID NO: 262626 - RNA, 64 nt, Human
gggugccugugcccccuuucugguugaagggaagccagaccaguggaguggaagcucuugaagc

SEQ ID NO: 262627 - RNA, 64 nt, Human
cgcucauaaagaaguuuuugggaugggagagaauccagaccaucuuggggcagccaggcccuug

SEQ ID NO: 262628 - RNA, 64 nt, Human
gaggcucagacagcaggcuccggggccacgcagcccagaccacaccugccacggucuuccagga

SEQ ID NO: 262629 - RNA, 64 nt, Human
agaguuuugccugcugcuuuccucguggccucuucuuggguagugaaauuaagugacauuugga

SEQ ID NO: 262630 - RNA, 64 nt, Human
cugggagaaaccaagcugcuggccauaggguguccuuggguacauccaggagucuucauugcuu

SEQ ID NO: 262631 - RNA, 64 nt, Human
agucauggcaauaaugguguaaagaaaauaguuucuuggguauuuguaacguacaaacuaucau

SEQ ID NO: 262632 - RNA, 64 nt, Human
ugcccaaucucucagacccaccccaccugcaggcccagaccacgugggacagaacuccugccca

SEQ ID NO: 262633 - RNA, 64 nt, Human
aggaaagcacccugguccucccuggcuccuagauccagaccaccuuccuccaggugugggagcc

SEQ ID NO: 262634 - RNA, 64 nt, Human
cagagcucagagcacccaguguagggaaacacagccagaccacuguggugacagacuuucuuua

SEQ ID NO: 262635 - RNA, 64 nt, Human
cuggaggacccagccucacaguguguccuuugugccagaccaagcggcccgugggggguggggg

SEQ ID NO: 262636 - RNA, 64 nt, Human
acugccacagggucaaaggagguuuucgaucagcccagaccagaggcucugagcccugaaccaa

SEQ ID NO: 262637 - RNA, 64 nt, Human
gcaaaggugggagaaucgcgugagcccaggaguuccagaccaggcugggucacaugacaaagcc

SEQ ID NO: 262638 - RNA, 64 nt, Human
agccacccuccccaggcccaacucugcuagcuucccagaccacccccaucgagugcggagagag

SEQ ID NO: 262639 - RNA, 64 nt, Human
cugugcugaggcagugcugucucgcucagucuuuccagaccagcggggcagcaccugggaggcc

SEQ ID NO: 262640 - RNA, 64 nt, Human
caucccuuccuggggaccacacugcucugcuccaccagaccacacuaugaaauaggaauaagug

SEQ ID NO: 262641 - RNA, 52 nt, Human
auccaugccauacccacugaccccagaccagugcagccagcaggggagguga

SEQ ID NO: 262642 - RNA, 64 nt, Human
agcgggucccugagacgggggguggcugcccuccccagaccaccccggcagccugagcagcucc

SEQ ID NO: 262643 - RNA, 64 nt, Human
guccuauggccccaccccaccauucccucuaggcccagaccaucaucauggcccuggccauuga

SEQ ID NO: 262644 - RNA, 64 nt, Human
cauggacacagaaaagcuacgccggcuggccucuccagaccaguucccaggcugggucugccgc

SEQ ID NO: 262645 - RNA, 64 nt, Human
ggccagcucagggcuuccugcgggugacugucgcccagaccaggugccauucaugacuaaucag

SEQ ID NO: 262646 - RNA, 64 nt, Human
agucaaaggacugggcaccugccucugacagacaccagaccagguccagggccuccuccacagc

SEQ ID NO: 262647 - RNA, 64 nt, Human
cucuuaucuaggggggagggggguggcacagcagcuuggguaccccccaaccuccaggagcuag

SEQ ID NO: 262648 - RNA, 64 nt, Human
aaagagagccuucccucucccccaccccuguguucuuggguaggaaugggaaaaggggcaaccu

SEQ ID NO: 262649 - RNA, 64 nt, Human
cugccacaauccuuagcccccauaucuggcuguccuuggguaacagcucccagcaggcccuaag

SEQ ID NO: 262650 - RNA, 64 nt, Human
aggcacugguuugcccagagaauuuuuauuuuucccagaccacacuugccuuuaggccuguagg

SEQ ID NO: 262651 - RNA, 64 nt, Human
ccugcuuccccaaaggccaacagcauuggccuggccagaccaggugaccuuagauuuggugaac

SEQ ID NO: 262652 - RNA, 64 nt, Human
uccgaggcgggcggaucacucgaggucaggaguuccagaccagccugaccaaaauggugaaacc

SEQ ID NO: 262653 - RNA, 64 nt, Human
gaagacauuggcuucuccacugcgagagauugauccagaccaacccaaaagacugcauacuuuu

SEQ ID NO: 262654 - RNA, 64 nt, Human
ugcaaaugacuucugagacuuuaugucuuuucuuccagaccaagaccguagaaggagucacauc

SEQ ID NO: 262655 - RNA, 64 nt, Human
cagaugaguugaguggggcagagggacagggcagccagaccaaggccaagccuucucacccuug

SEQ ID NO: 262656 - RNA, 64 nt, Human
gccaagaugggaggagugcuugagguuaggcguuccagaccagccugggcaacauagugagacu

SEQ ID NO: 262657 - RNA, 64 nt, Human
aagagagaaggaaagagagagagaaagaaagucuccagaccaggaauguuuuugucccacugac

SEQ ID NO: 262658 - RNA, 64 nt, Human
caugcacacacgugugagaauggaagagcccccuccagaccacucuacagcugcucuagccuua

SEQ ID NO: 262659 - RNA, 64 nt, Human
caagugucugacgauuaucacugggcucccuaucccagaccauuuggacugcacagagcagcug

SEQ ID NO: 262660 - RNA, 64 nt, Human
auaucucuucuauuauuagucuguuuguuaaaugccagaccacguuucuaugaucuguugaaug

SEQ ID NO: 262661 - RNA, 64 nt, Human
aaaaaaauccauuuuacacagcaccacagugaauccagaccaaccuuccauucacaccagcuaa

SEQ ID NO: 262662 - RNA, 64 nt, Human
auaauuaauugauuuacagccuuguugccgcuggccagaccaccagguggcccauuacucgaga

SEQ ID NO: 262663 - RNA, 64 nt, Human
uauaccuuggccacagagagggaugaacugucauccagaccaugugucaggaaaauugugaacg

SEQ ID NO: 262664 - RNA, 64 nt, Human
uagcuagcauguuuacugcucuaugccuccugauccagaccaggcauugcccagccugggaauc

SEQ ID NO: 262665 - RNA, 64 nt, Human
uggucagcaggcugggggcauggagcagagagggcuuggguacaagcuggagaggaaggagauu

SEQ ID NO: 262666 - RNA, 64 nt, Human; identical to SEQ ID NO: 107960

SEQ ID NO: 262667 - RNA, 64 nt, Human
ugcuuuugauaaaauguauuuucagcauuaauacacauccgauuaugccuuauuuauauaugaa

SEQ ID NO: 262668 - RNA, 64 nt, Human
ugcucccugaacccuuccauccgagacugugcccacauccgaagcacaaggacaucaaaucauc

SEQ ID NO: 262669 - RNA, 64 nt, Human
ucuaguagaagauuuccacagugaaaucagugagccagaccaacucuacaucuccugccuaacc

SEQ ID NO: 262670 - RNA, 64 nt, Human
cuacuuauugguagcuucuuaauuucauacuuguccagaccauuagacauuauuacaugcucug

SEQ ID NO: 262671 - RNA, 64 nt, Human
agcacggccagugccaggaccgggccgagggaggccagaccaagggaggcacgcgcgcugccgg

SEQ ID NO: 262672 - RNA, 64 nt, Human
ccacgcgugcagcugucccauccagaccccgacuggccaagaccuccacguccccagaguccag

SEQ ID NO: 262673 - RNA, 64 nt, Human
gcccuccacagccgcagccucccucugaccugcaggccaagagcagaggcagcgaguuguggaa

SEQ ID NO: 262674 - RNA, 64 nt, Human
aaagugcugggauuacaggugugccaccgcgcccggccaagaugggaguauuuuuauggccauu

SEQ ID NO: 262675 - RNA, 64 nt, Human
uugggggccuuccauguagaaaguggggucaggaggccaagaaagggaauaugaauguauaucc

SEQ ID NO: 262676 - RNA, 64 nt, Human
cuccauccagagaaaaggaagaaggugcagggugggccaagaggcaagugaagguuggccugag

SEQ ID NO: 262677 - RNA, 64 nt, Human
ucugcuccugccccuggccauuggugacuaguggggccaagagaagcuggagcagagagcuggc

SEQ ID NO: 262678 - RNA, 64 nt, Human
aaucgcuugaacccaggagauggagauugcaguaggccaagaugaugccacugcacuccagccu

SEQ ID NO: 262679 - RNA, 64 nt, Human
ccucacccagaagucugagcccagccucaggaggggccaagaaccagggggccaucaaaagcau

SEQ ID NO: 262680 - RNA, 64 nt, Human
ggcgacaggcccggggcuacgcgaagaagucgcaggccaagauucuuuacaguuugagaaauaa

SEQ ID NO: 262681 - RNA, 64 nt, Human
ugccagcuaugugguagggccagcccaccaugggggccaagaccugcacaggacaagggccacc

SEQ ID NO: 262682 - RNA, 64 nt, Human
acagcccugagcauggggcuuaaugggacaauggggccaagagugaagcgggcagggccccugg

SEQ ID NO: 262683 - RNA, 64 nt, Human
cagcaaacaagcuaccccugccaguccuagacaacuuggguacaucuggggaccuagcaguuag

SEQ ID NO: 262684 - RNA, 64 nt, Human
guagguccuuuucuccuccggccuaguaggggaccuuggguaacaucccauuuuucggccaagg

SEQ ID NO: 262685 - RNA, 64 nt, Human
aaguagccauaguacacacacaacacgcuaucagcuuggguaaggacagugggauuuaugugaa

SEQ ID NO: 262686 - RNA, 64 nt, Human
cccugccaaccaacugccucucugaggaggagguggccaagaagcggaaaaaccuggccacuua

SEQ ID NO: 262687 - RNA, 64 nt, Human
cuuguaaauuguauauguugucaugcaggguuugggccaagaaagcaugcagaaaaaaaugcca

SEQ ID NO: 262688 - RNA, 50 nt, Human
ucgaacuggacuugcucuaaggccaagacuucucucucccaucaccuugc

SEQ ID NO: 262689 - RNA, 64 nt, Human
gaccugggcuacagaagagcucuugggacugaauggccaagaaccugcuacggccugauggaua

SEQ ID NO: 262690 - RNA, 59 nt, Human
ucggggagggcacccccuaagaccacaguggccaagaucacaguggccacggccacggc

SEQ ID NO: 262691 - RNA, 64 nt, Human
cagaggaagauauuuuacaaaccaggucaguguaggccaagacuuauggucuacagauuuuggc

SEQ ID NO: 262692 - RNA, 64 nt, Human
gacuggggcccuguucaccuugaacaugccccugggccaagauggggcuucaccccuccccaga

SEQ ID NO: 262693 - RNA, 64 nt, Human
gugaacagcuuggccuuuuuugggugucuugacaggccaagaagaacaaaugacucagaaugga

SEQ ID NO: 262694 - RNA, 64 nt, Human
gugggacacaacacagauaauuuuuucuuaagucggccaagauguacuucucugugugcacacc

SEQ ID NO: 262695 - RNA, 64 nt, Human
ugccccgcccgcagcucccucccacaccccgccuggccaagaugacugcuucagggggcuuugg

SEQ ID NO: 262696 - RNA, 64 nt, Human
gggcccucagguggagagagcugcgauccauccaggccaagaccacagcucugugauccuuccg

SEQ ID NO: 262697 - RNA, 64 nt, Human
ugaagcgggagauggcgcaggggcugcucccugaggccaagaagccucggcuccugcacggcac

SEQ ID NO: 262698 - RNA, 64 nt, Human
cagagccggagagcgugcugcuggugcauggcgaggccaagaagauggaguuccugaagcagaa

SEQ ID NO: 262699 - RNA, 64 nt, Human
gcaaagcccuuggaacacccuggaugcuguugagggccaagagaucuguguggcuccugggccg

SEQ ID NO: 262700 - RNA, 64 nt, Human
cgaggcaccggcgcugcagguacuuccuccugauggccaagagcaucgugacccuucagggcca

SEQ ID NO: 262701 - RNA, 64 nt, Human
aaaagauuuauuuagaaucgugaauugacauaaucuuggguaauggaacggagaucugcaacau

SEQ ID NO: 262702 - RNA, 64 nt, Human
aaugccaucagcagcgguagguaaauuuuuucuccuuggguauuacaaguuuuugucuggagcc

SEQ ID NO: 262703 - RNA, 64 nt, Human
ugcuggccugagccccaggccuuggccuccugugcuuggguaaccauggccacugggaaaagca

SEQ ID NO: 262704 - RNA, 64 nt, Human
ucuaaguggaacuaauugcccgagggcucagcaaggccaagaggagacagccgugacgguaaac

SEQ ID NO: 262705 - RNA, 64 nt, Human
ccaucugagccucgacagggccuggagccccaucggccaagaauacuugaagaaacagaguggc

SEQ ID NO: 262706 - RNA, 64 nt, Human
gcuuaaccccugccaucccaugcugggcccuccaggccaagagucucagcuggccgagagucca

SEQ ID NO: 262707 - RNA, 64 nt, Human
ccugggaggcuuuuggugguccccacagccucugggccaagacuccugucccuucuugggauga

SEQ ID NO: 262708 - RNA, 64 nt, Human
gguacauguggaagauguggcuucugaugacaauggccaagacuugaggugauaaacauaauga

SEQ ID NO: 262709 - RNA, 64 nt, Human
cgggcccugcaaccgccggcgcgcaccggcgcgcggccaagaccaugguccugggguuccugcu

SEQ ID NO: 262710 - RNA, 64 nt, Human
gccagaacugcugucgaagaaaaucaggccggaaggccaagaaggcgcuaagggggaugggagg

SEQ ID NO: 262711 - RNA, 64 nt, Human
cuggauagacugccugcguccuuaccacugaucuggccaagaaugaggcccucccaacacuuuc

SEQ ID NO: 262712 - RNA, 64 nt, Human
auucuggaaauuauuauucauugaagaaugcaguggccaagaaaauaucaaauguagauuguua

SEQ ID NO: 262713 - RNA, 64 nt, Human
agguaaaugccguauaugaucaauuaccuuaauuggccaagaaaaugcuucaggugucuagggg

SEQ ID NO: 262714 - RNA, 64 nt, Human
accuaaagggguuccucauuuuaaagauuuguuaggccaagaagcaagagaguauuccuaguau

SEQ ID NO: 262715 - RNA, 64 nt, Human
gggacuacagaguuaaucuccuuuuuacaaaugaggccaagagaagccucauugguucacaguc

SEQ ID NO: 262716 - RNA, 64 nt, Human
augggauuugggugugggacuaggguacaaugaaggccaagagcaucucagacauagaguuaaa

SEQ ID NO: 262717 - RNA, 64 nt, Human
caagcgaucuuuggaggaaacaagaaucccaagaggccaagaacagccccaucugacgcaugcc

SEQ ID NO: 262718 - RNA, 64 nt, Human
caaaaacuugaaaaaucugaaacagagaacagaaggccaagagccagcuucugcguucucaacu

SEQ ID NO: 262719 - RNA, 64 nt, Human
cccucugguuggugauucaacuugggcuccaagacuuggguaagcucugggccuucacagaaug

SEQ ID NO: 262720 - RNA, 64 nt, Human
aucuuucauauuuuuuaaguguuuugcccaugugcuuggguagccuugaagucaccagaauaac

SEQ ID NO: 262721 - RNA, 64 nt, Human
accuguuuccuccaccuccacccccaccccuuaacuuggguaccccucuggcccucagagcacc

SEQ ID NO: 262722 - RNA, 64 nt, Human
ugcuacuucagaagccuuauaggauuuucuuucuggccaagauuuccuucuguaucacuccaag

SEQ ID NO: 262723 - RNA, 64 nt, Human
gagaguccucuggauggcaccagaggcugcagaaggccaagaaucaagcuagaaggccacaugu

SEQ ID NO: 262724 - RNA, 64 nt, Human
agaagcucagguucccugccacacuauuugaguuggccaagaaauaaauucacauccucagaaa

SEQ ID NO: 262725 - RNA, 64 nt, Human
acacauggauguaccuaucuuggugaugggugggggccaagaauugagcaugacaucuucccca

SEQ ID NO: 262726 - RNA, 64 nt, Human
gacauggacccacgugcuugaggccuggcagcugggccaagacagauggggcuuuguggcccug

SEQ ID NO: 262727 - RNA, 64 nt, Human
aacaagucuucuuagaguuaaaggagggggugcuggccaagagccaacacauucuuggcccagg

SEQ ID NO: 262728 - RNA, 64 nt, Human
uaacuucuuguuaggauucagggaaggaacaguuggccaagaauuuuuuuucuuuuaaacaagc

SEQ ID NO: 262729 - RNA, 64 nt, Human
caaaugcuucaguccgccgagagcaguaccguguggccaagagguggacucagagccuuccuug

SEQ ID NO: 262730 - RNA, 64 nt, Human
gccucugcagcugcagcccucguucucuuggcugggccaagagggccuuccuggauuucuuugu

SEQ ID NO: 262731 - RNA, 64 nt, Human
ccccaauucucucuguugcagaguuggaaguauuggccaagaagagcccacggcggcugcucaa

SEQ ID NO: 262732 - RNA, 64 nt, Human
cauuuuguuucuuuggauuugggguggggguccuggccaagaacucagucauuuuucuguguac

SEQ ID NO: 262733 - RNA, 64 nt, Human
gguggcucaggccuguaaucccagcacuuugggaggccaagaugggcggaucaugaagucagga

SEQ ID NO: 262734 - RNA, 64 nt, Human
gaaugggcaguuaguccagugcccucauuuaagaggccaagauccugauucagaggaggcaucc

SEQ ID NO: 262735 - RNA, 64 nt, Human
guggaucaugaggucagacguucaacaccagccuggccaagauggugaaaccccgucucuauua

SEQ ID NO: 262736 - RNA, 64 nt, Human
auguuugucuucuuggcagcgccaucagggcaguggccaagaacaccacccccggggcagcccu

SEQ ID NO: 262737 - RNA, 64 nt, Human
ugagggcgauuugucugagagcuggggcuggaugcuuggguaacuggggcagggcagguggagg

SEQ ID NO: 262738 - RNA, 64 nt, Human; identical to SEQ ID NO: 107970

SEQ ID NO: 262739 - RNA, 64 nt, Human; identical to SEQ ID NO: 107971

SEQ ID NO: 262740 - RNA, 64 nt, Human; identical to SEQ ID NO: 107972

SEQ ID NO: 262741 - RNA, 64 nt, Human
gguggcuuacgccuguaauccuagcacuuugggaggccaagacgggcggaucaccugaggugag

SEQ ID NO: 262742 - RNA, 64 nt, Human
ccagagcaaaccuggagaagauucacaauagacaggccaagaaacccggugcuuccuccagagc

SEQ ID NO: 262743 - RNA, 64 nt, Human
acaucacuguuuguaccaaagccaaacucuggcuggccaagaggcaaaauccauguuuggugac

SEQ ID NO: 262744 - RNA, 64 nt, Human
uccagaugagggccaggaaggggaggagagugagggccaagaacgagccuuaagggagcagucc

SEQ ID NO: 262745 - RNA, 64 nt, Human
uuuaauuuucaauauuugguuucauuuuucaacaggccaagaggccucugguaaugaagugcua

SEQ ID NO: 262746 - RNA, 64 nt, Human
ccugugugacuguggcagugccggaggccaagggggccaagaggaaaagcaucuguggucugcu

SEQ ID NO: 262747 - RNA, 64 nt, Human
guauagcuagagaaugcgaaauucaccaacacguggccaagagaaacuuccuagggggcuaaga

SEQ ID NO: 262748 - RNA, 64 nt, Human
uacauguaaaugaagcaauagaauucuaacauaaggccaagaaaugagacgaauguuugggguu

SEQ ID NO: 262749 - RNA, 56 nt, Human
caucaucugaugaugucugaggaagcggccaagaaugucauucucaaugcccagau

SEQ ID NO: 262750 - RNA, 64 nt, Human
augggugguugaaugauuucccacucagggcuggggccaagaggaaaaacagggaaaaaaagaa

SEQ ID NO: 262751 - RNA, 64 nt, Human
auaggugguuugugaaacucacaggugguccccaggccaagaugggcaggugucacaaagaaga

SEQ ID NO: 262752 - RNA, 64 nt, Human
cgucucuguguucgugauucccuugcacagucagggccaagagagcagugaccacugaggauuc

SEQ ID NO: 262753 - RNA, 56 nt, Human
aaaaagaguauuucauuuaagaugcaggccaagauucugaguuuuacuaccaggcu

SEQ ID NO: 262754 - RNA, 64 nt, Human
gccagacccagagcccucugagccgccacucccgggccaagacagauggacacugccaagagcc

SEQ ID NO: 262755 - RNA, 64 nt, Human
cuaugcaaagggaaaagcauguugcauucaccuaggccaagaaacaguguuguagguuaagggc

SEQ ID NO: 262756 - RNA, 64 nt, Human
ucagcacuguugaccacgcugcguaugagggcaucuuggguaucccacuccuucuccccauuuc

SEQ ID NO: 262757 - RNA, 64 nt, Human
gugguguaaaaugucuugaugauaauuuuuaaaacuuggguaacacuuccaaauaugggaggaa

SEQ ID NO: 262758 - RNA, 64 nt, Human
ccucagcagaugacacugauuggccucacggggacuuggguaagcaacaggcggcauucaggac

SEQ ID NO: 262759 - RNA, 64 nt, Human
uuguuucuauaguaacuggucugugaucuuuuguggccaagagaauagcaggcaagaauuaggg

SEQ ID NO: 262760 - RNA, 64 nt, Human
aaguguugggauuauaggagugagccaccacaccggccaagaugcuuuucaaacugauacagau

SEQ ID NO: 262761 - RNA, 64 nt, Human
cccagaccauacugacucaacauggagucucacuggccaagaaaauugccuuuaaaacucgaaa

SEQ ID NO: 262762 - RNA, 64 nt, Human
agucucuccuuagcuauuugaugcuuuucauauaggccaagaacucauugcaaaacauuuuugc

SEQ ID NO: 262763 - RNA, 64 nt, Human
aagugcgcaugauucuacauaugagaauucuuuaggccaagaaacuguccuuggcucagaggug

SEQ ID NO: 262764 - RNA, 64 nt, Human
uucacuuggaacaugaugagagauuucuuauugaggccaagagauguuuccugucccagaggaa

SEQ ID NO: 262765 - RNA, 64 nt, Human
agccacagcagccacuuugcuaccaugacaaaaaggccaagagaaucacagagucauugacccu

SEQ ID NO: 262766 - RNA, 64 nt, Human
aaguaggauuaguuaggggcagaucuugaauucuggccaagaaacugauauuuaacccauaaag

SEQ ID NO: 262767 - RNA, 64 nt, Human
aguggagccaguuugguuuucucccucugcacuaggccaagaacuugcugccuugccugugggg

SEQ ID NO: 262768 - RNA, 64 nt, Human
auccauggcuaaugaaagauaccaagaacauggaggccaagaaacucuccaaggaccggaugaa

SEQ ID NO: 262769 - RNA, 64 nt, Human
gugauucacaaggucaggaguucaagaccagccuggccaagauggugaaauccugucucuaaua

SEQ ID NO: 262770 - RNA, 64 nt, Human
guggaucacaaggucaggaguuugagaccagccuggccaagaugguaaaaccccgucucuacua

SEQ ID NO: 262771 - RNA, 64 nt, Human
caaccgagaagguuuaucccgccgauagagggacggccaagaauguacguccagccugccccgg

SEQ ID NO: 262772 - RNA, 64 nt, Human
ugauuccugguuccagaaagggcuggagcagaagggccaagagggccuguggaacugcuacaga

SEQ ID NO: 262773 - RNA, 64 nt, Human
gggagaauauacaaauagcaaaauugaggccaagggccaagagaauauccgaacuuuaauuuca

SEQ ID NO: 262774 - RNA, 64 nt, Human
ucucucccucugucucccuccuggccauucugggcuuggguaucuccuugcaugccuccucagc

SEQ ID NO: 262775 - RNA, 64 nt, Human
accaccaccaucaccaccaccauggacaacaagccuuggguaaccggaccaggccaagggucua

SEQ ID NO: 262776 - RNA, 64 nt, Human
gagguaugucagaaaaaauauguugguauucucccuuggguagggggaaaugaccuuuuuacaa

SEQ ID NO: 262777 - RNA, 64 nt, Human
gguggcucacgccugugaucccagcacuuugggaggccaagacgggcggaucaugaggucaaga

SEQ ID NO: 262778 - RNA, 64 nt, Human
ggcggcucaugccuguaaucccaggacuuugguaggccaagacaagcagaucacuugaggucag

SEQ ID NO: 262779 - RNA, 64 nt, Human
agugcuggaauuacaggcgugagccacugcgccuggccaagaauggacauuuuuuaaaaaaaca

SEQ ID NO: 262780 - RNA, 64 nt, Human
caacagugaaaguagcagggaaagagcugggcaaggccaagaccaucuuuuguaccguugguac

SEQ ID NO: 262781 - RNA, 64 nt, Human
uuugguauauagucucgcauauuauauuauagcaggccaagauaaaauuuugacagcucuuuaa

SEQ ID NO: 262782 - RNA, 64 nt, Human
agucggaaaacuucgaagcagcuguuggcaaguuggccaagacuccccuuauugcugauguuua

SEQ ID NO: 262783 - RNA, 64 nt, Human
gaaagauacuacaaagccaaucuuuauagaauugggccaagauaaaucuauguuguuuugcaug

SEQ ID NO: 262784 - RNA, 64 nt, Human
aggcaugacuuuccuuaauguuuaaaguuuuccgggccaagaauuuuuauccaugaagacuuuc

SEQ ID NO: 262785 - RNA, 64 nt, Human
uacuuacuaaaguauuaacuagcuaacagugaugggccaagacgcuccgagaacucuaccggga

SEQ ID NO: 262786 - RNA, 64 nt, Human
aacuaugguugauugaaaagugucucaaaaucugggccaagaaugauugcuagguccauaagcu

SEQ ID NO: 262787 - RNA, 64 nt, Human
aaauaaaagauacuaucuuuaccguaguaguucaggccaagauuaugcuuaguuuuaguucucc

SEQ ID NO: 262788 - RNA, 64 nt, Human
aguggcgcacaccugcaaucccaacacuuugggaggccaagagaggaagauugcuugagcccag

SEQ ID NO: 262789 - RNA, 61 nt, Human
gcaagaaggagaagaaguaacauggaggccaggccaagagccacagggcggccucucccca

SEQ ID NO: 262790 - RNA, 64 nt, Human
uaaacuuaccuggagcucauguggaggaacagaaggccaagauccuugcuuugggggugccuca

SEQ ID NO: 262791 - RNA, 64 nt, Human
ccuccuuugccuuucaagagcagggccugggcaaggccaagaaccaugcagaagccuuccuggu

SEQ ID NO: 262792 - RNA, 64 nt, Human
ccaaacugggaccgaaugacccugggaaggggaacuuggguagguuggggauggggcagagguc

SEQ ID NO: 262793 - RNA, 64 nt, Human
ucuccucagugacccccauaccucaucaugaacccuuggguagcuugauucugccuaccaucca

SEQ ID NO: 262794 - RNA, 64 nt, Human
uugaugcuauugcugccaggucuugcugugugaccuuggguagguugcuucuacucucugggcc

SEQ ID NO: 262795 - RNA, 64 nt, Human
gcuucucuucuuucugaagaucaauuucucccaaggccaagauuguccuuuucucccauuucuu

SEQ ID NO: 262796 - RNA, 64 nt, Human
ggguuuaacacaggauccacaugaaucuucugugggccaagagauguuccuuaauccuuguaga

SEQ ID NO: 262797 - RNA, 64 nt, Human
auuuaaaaguggaccaacuugcucuuaaucacagggccaagaagguugacgggccaucuugguu

SEQ ID NO: 262798 - RNA, 64 nt, Human
gaggagaaggacauuuuacugcagugagaaugagggccaagaaagagucaggccuuaauuuuca

SEQ ID NO: 262799 - RNA, 64 nt, Human
uguuuuaaauacgcacuacaugugguuuauagagggccaagacuuggcaacagaagcaguugag

SEQ ID NO: 262800 - RNA, 64 nt, Human
caccguguuuucuguaaaaguauuguuaguaaguggccaagagacuugaggaaaauacagauuu

SEQ ID NO: 262801 - RNA, 64 nt, Human
aaguugugcacggcuccaguguugagauggguagggccaagaugaccagugugaaaacucucag

SEQ ID NO: 262802 - RNA, 64 nt, Human
aaggaggagauggcucagcggggcugcaccaaggggccaagaggcccuacccgugucuaaaccc

SEQ ID NO: 262803 - RNA, 64 nt, Human
agugcugagauuacaggcaugagccauugcaccuggccaagaagagacaucuugacuugagccu

SEQ ID NO: 262804 - RNA, 64 nt, Human
gccccuuccagcuggagccgcccgugccuccaggggccaagaggaugaugucguggccuccauu

SEQ ID NO: 262805 - RNA, 64 nt, Human
guguagauuaccugccacuuccaggagcccagagggccaagagagacauugccuccaccucucc

SEQ ID NO: 262806 - RNA, 64 nt, Human
uuguuuuaaaccaaaguuuacagugucuguugguggccaagaccuucucucuccaccccuccuc

SEQ ID NO: 262807 - RNA, 64 nt, Human
guugaugcuuccccagggucccccuggcuggggaggccaagaauagggaagggacuuguagccc

SEQ ID NO: 262808 - RNA, 64 nt, Human
aguuuguccaauuaaagcuucagagguaacacuuggccaagauaugagaucugaauuaccuuuc

SEQ ID NO: 262809 - RNA, 64 nt, Human
ccagccuggguaacagacgcugucucaaaaaaaaggccaagagaaaguaagggagacagauuuu

SEQ ID NO: 262810 - RNA, 64 nt, Human
aagagugcauuacacuauucuuauucuuuaguaacuuggguaguacuguaauauuuuuaaucau

SEQ ID NO: 262811 - RNA, 64 nt, Human
cucuugggcucuuuuacacauuggauaucucuuccuuggguagaggguucugaccuaaaauucc

SEQ ID NO: 262812 - RNA, 64 nt, Human
uggguuggugcuauaggccaagggucauuuuauacuuggguauaaaucaaucccaguuugggaa

SEQ ID NO: 262813 - RNA, 64 nt, Human
gguggcucacgccuguaauuccagugcuuugggaggccaagaugggaggaucauuugagcccag

SEQ ID NO: 262814 - RNA, 64 nt, Human
ccacagagccauccugcccugacagcuagcaagaggccaagacccacagaacaaccacuacagc

SEQ ID NO: 262815 - RNA, 64 nt, Human
uuaagguagcccugccacguggcucuccaggcagggccaagaagacagcacaaaguauggguuu

SEQ ID NO: 262816 - RNA, 64 nt, Human
cacuuugggaggccaaggggacaggacugcuugaggccaagagguggaaaccaucuugggcuac

SEQ ID NO: 262817 - RNA, 64 nt, Human
guugggaaagcucuguagagcaugguuccagugaggccaagauugaaauuugauacuaaaaagg

SEQ ID NO: 262818 - RNA, 64 nt, Human
ugugcauugaacccugggucagggacguuccaauggccaagagagugacacagccaggacccug

SEQ ID NO: 262819 - RNA, 64 nt, Human
ccuugaugccugucggcacuucugaaaggcacaaggccaagaacuccuggccaggacugcaagg

SEQ ID NO: 262820 - RNA, 64 nt, Human
aaucgcuugaaccugggagguggagguugcagugggccaagaucgcaccacugcacuccagccu

SEQ ID NO: 262821 - RNA, 64 nt, Human
gaagauuuucagguuuuaauaacgcagucauggaggccaagaacuugcaauaccaauguucuaa

SEQ ID NO: 262822 - RNA, 64 nt, Human
gaagauuuucagguuuuaauaaagcagcuauggaggccaagaacaugccagaccaauauucuac

SEQ ID NO: 262823 - RNA, 64 nt, Human
caagcccauagugugugcccaaaagcugucaaguggccaagacagcucguuucuggagaguaug

SEQ ID NO: 262824 - RNA, 64 nt, Human
aagaagaaaggaaaccucauuacucaauccuucuggccaagagugucuugcuuguggcgccuuc

SEQ ID NO: 262825 - RNA, 64 nt, Human
cauuccugauagaguagccgagggagagucuuggggccaagaagggcccagggugggucaggcg

SEQ ID NO: 262826 - RNA, 64 nt, Human
gaaauagguacugugccuaauuuuucauuggcuuggccaagauucuguuaccuguaauuauguc

SEQ ID NO: 262827 - RNA, 64 nt, Human
gguccuaccucuggguuuccuggaaguggauuugggccaagaaggagagggagaaaggcccgag

SEQ ID NO: 262828 - RNA, 64 nt, Human
uggcaguggagaccuucucugagcugccgcagguccgugccauggggaaguucuucagacccag

SEQ ID NO: 262829 - RNA, 64 nt, Human
cccugucccaccaacucugcacuccauggccaccccgugccacccguaggcagccucucugcua

SEQ ID NO: 262830 - RNA, 64 nt, Human; identical to SEQ ID NO: 107954

SEQ ID NO: 262831 - RNA, 64 nt, Human; identical to SEQ ID NO: 107973

SEQ ID NO: 262832 - RNA, 64 nt, Human
ccauggcccgcagaggcacugccacagcugugagggccaagaugcuguccccccauccaaaacc

SEQ ID NO: 262833 - RNA, 64 nt, Human
cuggguuucuuuuuucuuucuuccuuucuuccuuggccaagagaagggcuuacaggcauggaca

SEQ ID NO: 262834 - RNA, 64 nt, Human
auaucacaggaggccagagagaggcaaaggcucaggccaagagccaacgcugugggaggccggu

SEQ ID NO: 262835 - RNA, 64 nt, Human
ugcgugccucuccgccggaggucuagcugugggcggccaagaagggucacccuugaggacaaac

SEQ ID NO: 262836 - RNA, 64 nt, Human
aguggcgcaugccuguaaucccagaacuuugggaggccaagacgggaugauugcuugagcucag

SEQ ID NO: 262837 - RNA, 64 nt, Human
gacggugcacaccucuagucccagcuacucgggaggccaagacagaaggaucaccuugaggcca

SEQ ID NO: 262838 - RNA, 64 nt, Human
ggguaaugccaauuuaagaucucucuuaacuuguggccaagaaauucuagauuuuccagcugac

SEQ ID NO: 262839 - RNA, 64 nt, Human
ggccaugcuggcugcugucacugagcgggacucaggccaagaggcgugaccucgggccagccug

SEQ ID NO: 262840 - RNA, 53 nt, Human
aaugcugcaaaaagccaugaggaggccaagaagcugcuguggcugaugcggau

SEQ ID NO: 262841 - RNA, 64 nt, Human
aagauccagucugagagaagucuccuuugagaagggccaagaggcucuuuccugaguguuugcu

SEQ ID NO: 262842 - RNA, 64 nt, Human
aaccaagcaucagggggaagaagcagagagaugcggccaagauaggaccuugggccaaauccgc

SEQ ID NO: 262843 - RNA, 64 nt, Human
ggaucacuugaggucaggaguucaaaaccagccuggccaagauggugaaaccccaucucuacua

SEQ ID NO: 262844 - RNA, 64 nt, Human
ugaagguugcugucugucaugagugcaugaaggaggccaagaguuuaugcuaugggaggaaaca

SEQ ID NO: 262845 - RNA, 64 nt, Human
ggaaagaaugaggcucagggaaguuaaaugacuuggccaagaucugcucaucgucacugucugu

SEQ ID NO: 262846 - RNA, 64 nt, Human
cccagccccguuuuaaggacauuaaaagcuaucaggccaagaccccagcuucauuaugcagcug

SEQ ID NO: 262847 - RNA, 64 nt, Human
aaaguguuugaggaccuaugcagagccuguaacacuuggguaguaccugcuaggacaauuucuu

SEQ ID NO: 262848 - RNA, 64 nt, Human
ggagccacuucagccuuuccccuccccuccacuucuuggguaaucugaccugaagcauagucca

SEQ ID NO: 262849 - RNA, 64 nt, Human
ccuggcaugcaauggacauggaagcugaaaauuacuuggguauucucugauuucuagcuaauau

SEQ ID NO: 262850 - RNA, 64 nt, Human
aauguuaaaaaaaauaaagcacuuuauccaauuaggccaagauuuaacauuguugacaguccug

SEQ ID NO: 262851 - RNA, 64 nt, Human
ggaggaaagggaggcagcgccggacggcgcagcuggccaagaggcgggcggggccagaaauacc

SEQ ID NO: 262852 - RNA, 64 nt, Human
uugcuggcaugucuucauuggcuauauaaaauguggccaagaagauaggcucucaguaagaagu

SEQ ID NO: 262853 - RNA, 64 nt, Human
cccacgccgacuugggaggaugguggccugcagcggccaagaagccaaaaaaaauuuuuuuuuu

SEQ ID NO: 262854 - RNA, 64 nt, Human
agugcugggauuacaggcauggagcaccgugccuggccaagauucuuuacaauaggauuuaugu

SEQ ID NO: 262855 - RNA, 64 nt, Human
ccucacccagcacccugccccgcuucccagggcuggccaagagagaagacuggacggcagggag

SEQ ID NO: 262856 - RNA, 64 nt, Human
gaggguagggagugggugggggggagggggguaaggccaagacugggguagaauuuuaaagauu

SEQ ID NO: 262857 - RNA, 64 nt, Human
ucagcaugccagcaugggucaggccucuucacagggccaagaaacucauagcaucucccacauu

SEQ ID NO: 262858 - RNA, 50 nt, Human
aggaaguggcagcauucugaggccaagagacacucacuggacaauaucaa

SEQ ID NO: 262859 - RNA, 64 nt, Human
guggcuaacaccuauaauucccagcacuuugggaggccaagaugggcaaaucacuugagucuag

SEQ ID NO: 262860 - RNA, 64 nt, Human
cagcagcugaugccuccuuggccaccagaccaugggccaagagccgccguggcuauaccugggg

SEQ ID NO: 262861 - RNA, 64 nt, Human
aaucagaucccagggugagaguaacaggccauuuggccaagaaagaaaccuguuuguuuuucuu

SEQ ID NO: 262862 - RNA, 64 nt, Human
ccuuccauuuccagccaggccucaucugggguagggccaagaggaaaguacagagugcccgugg

SEQ ID NO: 262863 - RNA, 64 nt, Human
uggacaguagacuuuaucccuccuucuuacucugggccaagaccucccacuccgcccucugagg

SEQ ID NO: 262864 - RNA, 64 nt, Human
ccagggcccuggguggggagguguggguucccugggccaagaccagccuuuuuccucaguuuaa

SEQ ID NO: 262865 - RNA, 64 nt, Human
gaucccccaaagucagacacagagcaagaguccccuuggguacaccccucugcccacagccuca

SEQ ID NO: 262866 - RNA, 64 nt, Human
acugaagaagcccccuuaucauuuuagauuuauacuuggguacucaaggagaaggaaugcauac

SEQ ID NO: 262867 - RNA, 64 nt, Human
auuaaacuauaugggagguuaugaauuacuuuuucuuggguagacccuaaaaugucaguagcau

SEQ ID NO: 262868 - RNA, 64 nt, Human
ugcgcuaccagcugcagcggggagugguggugcuggccaagagcuucucucaggagagaaucaa

SEQ ID NO: 262869 - RNA, 64 nt, Human
uuaaaaauaaauaaaaacauaaaaaauuaagaggggccaagaggaagacauucuuucugcaagg

SEQ ID NO: 262870 - RNA, 64 nt, Human
uugcaggaagcaaaccuccuuguuuacaucuucaggccaagaugacugauuugggggcuacucg

SEQ ID NO: 262871 - RNA, 64 nt, Human
ugugguggcauugggagaguucccccaugaugagggccaagauagaaucuguaccacucagugc

SEQ ID NO: 262872 - RNA, 64 nt, Human
guggggccccaggauaaaacagacacagugacagggccaagagccagcacugcuggccuuggug

SEQ ID NO: 262873 - RNA, 64 nt, Human
ggacacaacuccgggaagccuuugagcagcuccaggccaagaaacaaauggccauggagaaacg

SEQ ID NO: 262874 - RNA, 64 nt, Human
gggaggcucagaaggaggugguguggggaccccuggccaagagggcugaggucugacccugcuu

SEQ ID NO: 262875 - RNA, 64 nt, Human
acagaucacagcuucagccaggagcugggcagaaggccaagaggcuguucccaccaggcugcuc

SEQ ID NO: 262876 - RNA, 64 nt, Human
ccugauaccaggaagaaccaugugggaauaggugggccaagagcccuccccuuucuccaucccu

SEQ ID NO: 262877 - RNA, 64 nt, Human
auacacaugaggccccuacuucucaagcugggaaggccaagagccuuccuucagccuuucuggu

SEQ ID NO: 262878 - RNA, 64 nt, Human
acagccaccuccuuguauguuaccuuucagcucuggccaagagugggacaggguuuuaaccaca

SEQ ID NO: 262879 - RNA, 64 nt, Human
cagaucugcugaagcaaacacaggagcgcuacuuggccaagaagaaaaccaaaaucuccucggu

SEQ ID NO: 262880 - RNA, 64 nt, Human
auggggcugggggaugggccugagugagaggggaggccaagaguggccccaccuggcccucucu

SEQ ID NO: 262881 - RNA, 64 nt, Human
acuggaggauggacuguuccccccuucaggccggggccaagagugagcugcuaacacggcaucc

SEQ ID NO: 262882 - RNA, 64 nt, Human
cucccacccccaauguccuguugguaggagguggggccaagagugggguauggugggccuuggc

SEQ ID NO: 262883 - RNA, 64 nt, Human
caaggcucuggagacaggaagggccuuuggccgccuuggguaguugaccugccuuuucugacuc

SEQ ID NO: 262884 - RNA, 64 nt, Human
agguggaaugcagauaacucacauguaaaaggaacuuggguagguaaauaaaagcuauacaugu

SEQ ID NO: 262885 - RNA, 64 nt, Human
ugaauuuucauucugccauugacuuggcauuuaccuuggguaagccauaagcgaaucuuaauuu

SEQ ID NO: 262886 - RNA, 64 nt, Human
cucugucacccagucuguugcugcuccaugguggggccaagagucacuucuaauaaacagacug

SEQ ID NO: 262887 - RNA, 64 nt, Human
agucguacucuuccagguuuggaagacccagagaggccaagaucccauccuuagccauagcgag

SEQ ID NO: 262888 - RNA, 64 nt, Human
auucccgagugugagcugucuuggggccccaccuggccaagaguagcagccacagcaguaccuc

SEQ ID NO: 262889 - RNA, 64 nt, Human
uauggcccucccaacuuuaaagucauaccagaguggccaagaguguuuaucccaacccuuccau

SEQ ID NO: 262890 - RNA, 64 nt, Human
accuuuccucauagagcuauccugguuaauaacaggccaagauucucccauuauccccuguugu

SEQ ID NO: 262891 - RNA, 64 nt, Human
accccugcccccacuaucuggaguuuuccaugcuggccaagaucuggacacgagcagucccuga

SEQ ID NO: 262892 - RNA, 64 nt, Human
ccccuaauuccaaaaaaaagaggaacucuacaaaggccaagaucacagaguacagucuuggagg

SEQ ID NO: 262893 - RNA, 64 nt, Human
cgaugccacugcagcccgcaccuugucacugcugggccaagaagccuucacuaggagugggauc

SEQ ID NO: 262894 - RNA, 64 nt, Human
cccaggguccugcccucagcacuagauuuaauggggccaagaggguccaaaccccuugcuaaca

SEQ ID NO: 262895 - RNA, 64 nt, Human
cuucaggacucgugccuucugcuguucucauuguggccaagaaaugucccagcugagggccuuu

SEQ ID NO: 262896 - RNA, 64 nt, Human
ucuugcuucuaucugggggacgcugcucgagagaggccaagaggccgcagaacaugccaggugu

SEQ ID NO: 262897 - RNA, 64 nt, Human
guagaagccacagucauugaaaagacagaaucauggccaagaaucauuaugagauucaggaaaa

SEQ ID NO: 262898 - RNA, 64 nt, Human
uguguuuuuaguagagacgggguuucaccauguuggccaagauggucucaaucucuugaccuug

SEQ ID NO: 262899 - RNA, 64 nt, Human
ucuacuauuaaguuugaaaauaguuaccuucaaaggccaagagaauucuauuugaagcaugcuc

SEQ ID NO: 262900 - RNA, 64 nt, Human
aggaagccugcuaucuugggauucacuaauaauaggccaagaacaaaggcaagcauccauuccu

SEQ ID NO: 262901 - RNA, 64 nt, Human
aaguggugagcggcgucuuuugggggugagggagcuuggguagaugaggcuccuggcugagccc

SEQ ID NO: 262902 - RNA, 64 nt, Human
uaacuccuugugagcugcuucucuuuauagagcucuuggguauguagaacuguaugggaagaag

SEQ ID NO: 262903 - RNA, 64 nt, Human
ggacaucugaccccaagggggcugcugcuccucucuuggguaggguaguggcugggguggagug

SEQ ID NO: 262904 - RNA, 64 nt, Human
gucucaccucuaggcccucugcuggugcuguggaggccaagaccccauuaagccuaaaggugau

SEQ ID NO: 262905 - RNA, 64 nt, Human
uuaccuuauaguaaguuucuauuuuaugacuuugggccaagaauuaaguauuuuccuaagcaca

SEQ ID NO: 262906 - RNA, 64 nt, Human
gacuuguucuacaggaaaggguccaugcuccuuuggccaagaucaucagaaccucucaacccaa

SEQ ID NO: 262907 - RNA, 64 nt, Human
ggaucaccugagaucaggaguucgaggccagccuggccaagauggcaaaaaccccgacucuacu

SEQ ID NO: 262908 - RNA, 64 nt, Human
uugguuagaggacugccugugauccuggccacuaggccaagaggcccuaugaagguggcgggaa

SEQ ID NO: 262909 - RNA, 64 nt, Human
aagagaaaccauccucucccuucuuacaccgugaggccaagauccccucagaaggcaggagugc

SEQ ID NO: 262910 - RNA, 64 nt, Human
gaauuuucauuuucauuuacguucuuccccuucuggccaagauuugccagaggcaacaucaaaa

SEQ ID NO: 262911 - RNA, 64 nt, Human
ugcaguacguggagcgauacgggaagcguuugaaggccaagaaccugauguaccugaagcagau

SEQ ID NO: 262912 - RNA, 64 nt, Human
cugaugcacggcgagugaacaccguuggcgccgaggccaagacuuugauuuaaaagaaaacaca

SEQ ID NO: 262913 - RNA, 64 nt, Human
caaggauggcacucagaucuccauggcccagcaaggccaagauaaaucuaccaccccaggcacc

SEQ ID NO: 262914 - RNA, 64 nt, Human
auuuacaaguacuuaaaagcgugguccccagugaggccaagaaaguuuccgguuaaguucuuua

SEQ ID NO: 262915 - RNA, 64 nt, Human
gcagcuacuagggagaagucugcaagaugucaagggccaagaagucccaguaaguuaaaucauu

SEQ ID NO: 262916 - RNA, 64 nt, Human
caggcaaagcgccagcagcccugcacuccacgcuggccaagaaggccuuccacgcagaaugaca

SEQ ID NO: 262917 - RNA, 64 nt, Human
ugaugacagugaugaugaugaagaaagcaaagaaggccaagaaaguucuaguagugcugcaaac

SEQ ID NO: 262918 - RNA, 64 nt, Human
cccugccugccccaccacagcuggaguuggccacggccaagaacgacaugaaccggcaccugca

SEQ ID NO: 262919 - RNA, 64 nt, Human
auuggccuguuccccaaauggccauuuuaaaaugcuuggguacacuucucuuaaguggucuagu

SEQ ID NO: 262920 - RNA, 64 nt, Human
auuuguccuuaagcugucuuucaauucagauugucuuggguauuugcacaaaaaagaaagcaug

SEQ ID NO: 262921 - RNA, 64 nt, Human
gcgucuuacucgggauuucugcuguuguuguggccuuggguaaaggccuccccugagaacacag

SEQ ID NO: 262922 - RNA, 64 nt, Human
acaacuagcaaaaagaauagccauaagaaaaccaggccaagauugaaaaauguggaucggagua

SEQ ID NO: 262923 - RNA, 64 nt, Human
aggcacuugcagccgggaaagccagggugugccgggccaagauacucacaggcuggccacagcu

SEQ ID NO: 262924 - RNA, 64 nt, Human
ggcagagccauggguucugugcuggagggugcacggccaagaucuccagacugcugguucccag

SEQ ID NO: 262925 - RNA, 62 nt, Human
gaauaaagucuaugacuuuuaaauaaaucaccagggccaagauugagugaaucuugggucca

SEQ ID NO: 262926 - RNA, 64 nt, Human
uuugucugguuaaaaaauaggugguagauauugaggccaagaauauugcaaaauacaugaagcu

SEQ ID NO: 262927 - RNA, 64 nt, Human
agggugugcaggaguucgccagcaaagccaggcaggccaagacuugaguuggcaacucagcugc

SEQ ID NO: 262928 - RNA, 64 nt, Human
guaauaacaugaaaugaaacccagcauaggagcuggccaagagcuuuuaauuuuauugauacuc

SEQ ID NO: 262929 - RNA, 64 nt, Human
gggagagagggacucaagggaaaggcaagcuugaggccaagauggcugcugccugcucauggcc

SEQ ID NO: 262930 - RNA, 64 nt, Human
ugcuauuuugagagagucaagacucuuucuuaagggccaagaaagcaacuugagccuugggcua

SEQ ID NO: 262931 - RNA, 64 nt, Human
cacuuugggaggcugagaugggaggaucacuugaggccaagaguuugagaccaaccuggguaac

SEQ ID NO: 262932 - RNA, 64 nt, Human
ucuagagccauauaguuccuugggauuagcucuuggccaagaaggcugaguaugguucccaauu

SEQ ID NO: 262933 - RNA, 64 nt, Human
agugcugggauuacaggcaugagccacugugcccggccaagaucuaacucacgcuuacuuuuca

SEQ ID NO: 262934 - RNA, 64 nt, Human
agaugauuagucaagagucaagguugcgaguacaggccaagaccaugggaaaaaaagccaugcu

SEQ ID NO: 262935 - RNA, 64 nt, Human
agcuucuggaaccacguaguuucuacacguggcaggccaagaaugggaggcugacucaaaacua

SEQ ID NO: 262936 - RNA, 64 nt, Human
uagccaccuuucuggccucccacuugcccugaaaggccaagaucaagaugucccccaggcaucu

SEQ ID NO: 262937 - RNA, 64 nt, Human
ccaggcuccacaucacgggaagugagauggauuucuuggguaacaacucauuauaaggaauacu

SEQ ID NO: 262938 - RNA, 64 nt, Human
cccugaccccuccugcugccuucccacccccguucuuggguauguucaauaaaaggauuguuuu

SEQ ID NO: 262939 - RNA, 64 nt, Human
ggugacagacauaacagcucugguuuuauaauaucuuggguaucucuaaggccaauaaggauaa

SEQ ID NO: 262940 - RNA, 64 nt, Human
acucuaaaccugauuuuugccauggauuccuucuggccaagaaauuaaagcacaugugaucaau

SEQ ID NO: 262941 - RNA, 64 nt, Human
agucgcucaugccucuaaucccagcacgaugggaggccaagacaggcagaucacuugagcccag

SEQ ID NO: 262942 - RNA, 64 nt, Human
gguggcucaugccuguaaucccagcacuuugggaggccaagauggguggaucaccugaagucag

SEQ ID NO: 262943 - RNA, 64 nt, Human
ccacugugaguacugacauuuagaguuguuuaaaggccaagaacuggaaacagccuuuucccua

SEQ ID NO: 262944 - RNA, 64 nt, Human
ggaucacuugaggucaggaguucgagaccagccuggccaagauggcgaaacccugugucuacua

SEQ ID NO: 262945 - RNA, 64 nt, Human
ugcaggccauuggagagaaggucuccuuggcccaggccaagauugagaagaucaagggcagcaa

SEQ ID NO: 262946 - RNA, 64 nt, Human
cauuuggggaggcaaagguggaaguaucccucgaggccaagaguucaugaccagccuggucuuu

SEQ ID NO: 262947 - RNA, 64 nt, Human
caccagagaaccaggcuacaagagaaaaagcagaggccaagaguuugagggagaaauagucggu

SEQ ID NO: 262948 - RNA, 53 nt, Human
ucccccagaagaacuccuaagaaggccaagaaggaggaugaagcccagccugc

SEQ ID NO: 262949 - RNA, 64 nt, Human
ugucugcagaaggagaucaagaggcuggggguaaggccaagaagguaggaggaaaauggcagac

SEQ ID NO: 262950 - RNA, 64 nt, Human
cuguguucagaaagacuaugagaccugaacauauggccaagaggaaagaagagugacguugucu

SEQ ID NO: 262951 - RNA, 64 nt, Human
ggcguaaauggaugugcuuguaguucagggguuuggccaagaaucaucacgaaagggucggugg

SEQ ID NO: 262952 - RNA, 64 nt, Human
agcauuuaacaaccugugaugugggcagagaugaggccaagaacggagaagggaggagcaugaa

SEQ ID NO: 262953 - RNA, 64 nt, Human
agcucuguccgcaaaaccaaaucugggugucagaggccaagacccuggggugggaucagggacc

SEQ ID NO: 262954 - RNA, 64 nt, Human
cggacagaguagguggccgcuuugcgccauccggggccaagaggggguggacccgcgugucugg

SEQ ID NO: 262955 - RNA, 64 nt, Human
aaaaguauguauuugcacauguguuuuuauuucucuuggguaaguaccuaggacuuuaauugcu

SEQ ID NO: 262956 - RNA, 64 nt, Human
gcgucuuacucgggauuccugcuguuguuguggccuuggguaaaggccuccccugagaacacag

SEQ ID NO: 262957 - RNA, 64 nt, Human
caugggucaugacucuggguccugggucugugaccuuggguaagucgcgccugacccaggcugc

SEQ ID NO: 262958 - RNA, 64 nt, Human
gugguucuggccaggaaggcacaagguagcugugggccaagacaccagcccuguccuagcccuu

SEQ ID NO: 262959 - RNA, 64 nt, Human
ccaggaugcaaggcuccugguccuguuugcagccggccaagaggcgcugggaggggcaaaacca

SEQ ID NO: 262960 - RNA, 64 nt, Human
caaguuggaaaauagaguccaaauguaacuuuguggccaagaguauuuucaaaaaagucuaaag

SEQ ID NO: 262961 - RNA, 64 nt, Human
aauaaacuguauuuucguuucuaacucuauuuagggccaagagaagaaagcuggaaggaugugu

SEQ ID NO: 262962 - RNA, 64 nt, Human
auugggguaauauuuccuccuuuuccaagaccaaggccaagaggcugggccaggcuucaguuca

SEQ ID NO: 262963 - RNA, 64 nt, Human
cagcacagaaccugaaugccaggaaaaauuccugggccaagaagcuaaagcuaaagaaaccuuc

SEQ ID NO: 262964 - RNA, 64 nt, Human
ugcuaaggcagcugauccaggcaaucguucugcuggccaagaaguuaaacuauuuugagcauua

SEQ ID NO: 262965 - RNA, 64 nt, Human
uuuuugcuuuucuucaacaggcugcauguuaaauggccaagaggugaggcuuacuauucacuau

SEQ ID NO: 262966 - RNA, 64 nt, Human
cacuuugggaggccaaggugggaagaucgcuugaggccaagaguucaagaccagccugggcaac

SEQ ID NO: 262967 - RNA, 64 nt, Human
gucauugugcuggaccucugaaaagaucugcaggggccaagauguugcagccaccggaggcugc

SEQ ID NO: 262968 - RNA, 64 nt, Human
cagcucccguccuggccacccuggaagcucaucaggccaagacccggacagagcuucagaggag

SEQ ID NO: 262969 - RNA, 64 nt, Human
acccccauagccugcauguccacucccagacgauggccaagagcagaaacacaagcuggagcca

SEQ ID NO: 262970 - RNA, 64 nt, Human
caccugccuauaccccacaucccuucugccucgaggccaagaugccuaaaaaagcuaaaggcca

SEQ ID NO: 262971 - RNA, 64 nt, Human
ugagcggguuuaggggcucgcccacaugcaugcaggccaagacagcaaaugccagccgggcacg

SEQ ID NO: 262972 - RNA, 64 nt, Human
gccacuggucugugcacauccacggugggugaguggccaagacaagcagugugauagaguccuu

SEQ ID NO: 262973 - RNA, 64 nt, Human
caguacuuuguauugggauauuaaagagauuuaacuuggguaacauggccuugggccuuuggga

SEQ ID NO: 262974 - RNA, 64 nt, Human
acccccgccaucacugcuggacaggagccacccccuuggguaccagagggagcugugcauugug

SEQ ID NO: 262975 - RNA, 64 nt, Human
cauccccaugacccacagcccccccacacccguccuuggguaggguacgguggggugggguguu

SEQ ID NO: 262976 - RNA, 64 nt, Human
acaucaguaucuagagggacaagaagaagaagguggccaagacccagggauaacuguggugccu

SEQ ID NO: 262977 - RNA, 64 nt, Human
ugcaguguaccguggacagccucagggggcugucggccaagagccuggagaaagggagcaagcu

SEQ ID NO: 262978 - RNA, 64 nt, Human
ugcuuugggaagccgaagcaggaggaucacuggaggccaagaguuggagagcagacugggcaac

SEQ ID NO: 262979 - RNA, 64 nt, Human
ggugauuucugugacucugggcccacagcggggaggccaagaggggcccuguggacuuucaccc

SEQ ID NO: 262980 - RNA, 64 nt, Human
accaggcccugcucuccuguguaggccucagagaggccaagaagggaagcuuugggcuucggug

SEQ ID NO: 262981 - RNA, 64 nt, Human
aggaggcauggaugggaaccugaguagguaguguggccaagagaucagcacaaccuuugcaggc

SEQ ID NO: 262982 - RNA, 64 nt, Human
uggucaucuuggugacucggucacagcagcuacuggccaagaucagacgucgcugaggggcugu

SEQ ID NO: 262983 - RNA, 64 nt, Human
ccuuggcuucugaaggcugaagcuccuuuggcugggccaagaaggaucuagucugcccacuaca

SEQ ID NO: 262984 - RNA, 64 nt, Human
agcaauaagucucacccuucuccccuacaggucaggccaagaagggugaaggccucuugcacuc

SEQ ID NO: 262985 - RNA, 64 nt, Human
agucagccagauccucccccuacuucuccccaagggccaagaacugcucagggacauuaaaggu

SEQ ID NO: 262986 - RNA, 64 nt, Human
ggugcugggauuacaggugugagccaccacaccuggccaagaauaccacuuuugaaguuaaucc

SEQ ID NO: 262987 - RNA, 64 nt, Human
cuuucuuacucagaauuuugauagaaaaccauggggccaagagcucuggaagccuggccggaaa

SEQ ID NO: 262988 - RNA, 64 nt, Human
cuccuacgggucccuggggcagcuguccccaucaggccaagagcgagcgagaggcgcugcccca

SEQ ID NO: 262989 - RNA, 64 nt, Human
cggcucuccugcgguguggcugguggccugccguggccaagagcaucuucuggguggauggaac

SEQ ID NO: 262990 - RNA, 64 nt, Human
cuuucaagcagugcuuguugugaggucccaucucggccaagaacuuaccuucagaacauacucu

SEQ ID NO: 262991 - RNA, 64 nt, Human
aauaugaaggucuuuuuguuuacuucuaaacccacuuggguaguuacuauccccaaaucuguuc

SEQ ID NO: 262992 - RNA, 64 nt, Human
gcaugcaccccuggggagcacagggaggcagaggcuuggguaaacucauuccacaacccuaugg

SEQ ID NO: 262993 - RNA, 64 nt, Human
cucuggguuuagggcuagcccugccuccaucucccuuggguaaaaugaagggugugggguaaaa

SEQ ID NO: 262994 - RNA, 64 nt, Human
aaauggcagccuuuuccccagcuacuguuuuuggggccaagauggcugcccuagcagcaaucac

SEQ ID NO: 262995 - RNA, 64 nt, Human
cgcgcgcacacacacacacacacauccaccccagggccaagagaaaggccugcacacaagccca

SEQ ID NO: 262996 - RNA, 64 nt, Human
gggacggucaucugcuccggaaggaaagagaacgggccaagacugggacuauuccccacccccg

SEQ ID NO: 262997 - RNA, 64 nt, Human
ggcccuaggccuagccccaucccuccccaugaggggccaagacacugccuaaggugugggaggg

SEQ ID NO: 262998 - RNA, 64 nt, Human
ccauuccuguugaggugcccauaagaaaaucauaggccaagauagggaggggcauuccagcaaa

SEQ ID NO: 262999 - RNA, 64 nt, Human
gcgggaggggaaguggauugagaggaaagagagaggccaagacaauuuguaacuagaauccguu

SEQ ID NO: 263000 - RNA, 64 nt, Human
gggagaaaugcaggcaacacugagacaugggagaggccaagauaugcuugacagaaagggugau

SEQ ID NO: 263001 - RNA, 64 nt, Human
cccauacacauuuggcucaggguuaccgaagaggggccaagaaauuagaguccucagaagagaa

SEQ ID NO: 263002 - RNA, 64 nt, Human
uccggcuggauuuggguuuugugggaggugcaggggccaagagagacgugguaggucuccaaga

SEQ ID NO: 263003 - RNA, 64 nt, Human
guccacauuaaugguuggcaugauugugcuugcaggccaagaaaugaucauaccccuugccaaa

SEQ ID NO: 263004 - RNA, 64 nt, Human
ccacggcucacaccuauaaucgagcacuuugggaggccaagacaggaggaucacuugaggccag

SEQ ID NO: 263005 - RNA, 64 nt, Human
ugauaccuuuacuugccaagauuuauuuaaaguuggccaagauaccaagaagguggcuugcagg

SEQ ID NO: 263006 - RNA, 64 nt, Human
ugaccuuagcccagcaagccaggcccuucaugaaggccaagaaggcugccaccauucccugcca

SEQ ID NO: 263007 - RNA, 64 nt, Human
acugggcagcuacccaccuggggaugggacgugaggccaagaccccagcagagaugccagaaug

SEQ ID NO: 263008 - RNA, 64 nt, Human
uucaacaguucccgcacggccugaacgcuucuuaggccaagagacaccaugcagagccuagucu

SEQ ID NO: 263009 - RNA, 64 nt, Human
uuaagccccaacauguucagaaaagaagugaagucuuggguauuuuaaccuguauacucuugaa

SEQ ID NO: 263010 - RNA, 64 nt, Human
ggagccccacgugcacuccccggccugcauccggcuuggguacacaggcccagaggacuggggu

SEQ ID NO: 263011 - RNA, 64 nt, Human
acauuuugaacuuuggggggauauuuguucaucacuuggguagaagaggagcaaaaauaccucu

SEQ ID NO: 263012 - RNA, 64 nt, Human
cgggaacaagcacguuguacccuuggcuggacauggccaagacacaaggcauuccacggcggca

SEQ ID NO: 263013 - RNA, 64 nt, Human
aguggcucacgccuauaaucucagcacucugggaggccaagauggaggauugcuugaagccagg

SEQ ID NO: 263014 - RNA, 64 nt, Human
gguggcucaugccuguaaucccagcacuuugggaggccaagacgggcggaucuuuugaggucgg

SEQ ID NO: 263015 - RNA, 64 nt, Human
ccgaaaccacuggcuggucccuucccugagcccuggccaagauucaggcugcaggggaagaaag

SEQ ID NO: 263016 - RNA, 64 nt, Human
uuugggaaaauacguugagggagagaagaccuugggccaagaugcuaaaugggaaugcaaagcu

SEQ ID NO: 263017 - RNA, 64 nt, Human
cucauggauggcacugcuuuucugaggacucaagggccaagauggaggggcugacucaguccag

SEQ ID NO: 263018 - RNA, 64 nt, Human
aggucacuugaggucaagaguuugaaacaagcauggccaagagaugugagccaguuuucccagc

SEQ ID NO: 263019 - RNA, 64 nt, Human
agguaggugugauaaacagaguagaaaagauuguggccaagaagagugaaugugucccauccaa

SEQ ID NO: 263020 - RNA, 64 nt, Human
agugcugggauuacaggcgugagccacugugcccggccaagaauuuuuuuaucgauaacauagu

SEQ ID NO: 263021 - RNA, 64 nt, Human
uuggggcagcggggaagggguucugaagaacucuggccaagaggacgaggaucugggggugggg

SEQ ID NO: 263022 - RNA, 64 nt, Human
cacuuugggaggcugagguaggaggauugauugaggccaagaguuaaagaccagccuggucaau

SEQ ID NO: 263023 - RNA, 64 nt, Human
aguggacgccugugcccacccgagccuggagcauggccaagagccagcuugcaccacccaccug

SEQ ID NO: 263024 - RNA, 64 nt, Human
aguggcucacaccuguaaucccagcacuuugggaggccaagaugggcggaucacgaggucagga

SEQ ID NO: 263025 - RNA, 64 nt, Human
uuguauuuuaguagauauggaguuucaccacguuggccaagacagucucgauuuccugaccuug

SEQ ID NO: 263026 - RNA, 64 nt, Human
gcaggucuggugggcggggccagggaaagggcagggccaagaccgggcuugggagaggggcgca

SEQ ID NO: 263027 - RNA, 64 nt, Human
gacuagaaucaagcaguagauaauugaauccaaucuuggguauuauuagauaauguauaacuug

SEQ ID NO: 263028 - RNA, 64 nt, Human
auaugagaacauuacacugcauaaagauauccagcuuggguacccuacuaaaacaacaucacca

SEQ ID NO: 263029 - RNA, 64 nt, Human
ccaaugggaggagaagcccauaauguuacuguaacuuggguauuauguuaacugucuguuuuaa

SEQ ID NO: 263030 - RNA, 64 nt, Human
gaggcaggagaauugcuugaacuugggagguggaggccaagauuguaccacuguauuccagccc

SEQ ID NO: 263031 - RNA, 64 nt, Human
gugcacugacggagaugcggacuccugggucccuggccaagaagccaggagagggacggcugau

SEQ ID NO: 263032 - RNA, 64 nt, Human
ucaguugugggguuugguuucauguguuagauaaggccaagacuuagagaaucagugggaaaaa

SEQ ID NO: 263033 - RNA, 64 nt, Human
uguggcucacgccugcaaugccagcacuuugagaggccaagacugguaggucacuggagguuaa

SEQ ID NO: 263034 - RNA, 64 nt, Human
ggugucucacaccuguaaucccagcacuuugagaggccaagacagguaggucacuugaggucau

SEQ ID NO: 263035 - RNA, 64 nt, Human
gaaauggucuaucaacugaacaugaaauggagcaggccaagaccuuaggacauugggauuuuug

SEQ ID NO: 263036 - RNA, 64 nt, Human
guggaucacgaggucaggaguuugagauuagccuggccaagauggugaaacccugucucuacua

SEQ ID NO: 263037 - RNA, 64 nt, Human
guguagacagagccaggccucaccuguuuguuuaggccaagaugccauggacaugcagcguuag

SEQ ID NO: 263038 - RNA, 64 nt, Human
ccuaaagggcucuugagccucugggaaugggaggggccaagagaaggaaaacccugucuuuagc

SEQ ID NO: 263039 - RNA, 64 nt, Human
guagcuuaggacgugaguuauuuuuccgcagacuggccaagagccagguucuaagcuuggaccu

SEQ ID NO: 263040 - RNA, 64 nt, Human
ccccauacccggaaggaggaacgcugcacagagaggccaagaagcaucuggacagacaggccuu

SEQ ID NO: 263041 - RNA, 64 nt, Human
gugcccaccccucucccauuauccuuuagcuuuaggccaagagcguugcucagggcagcuucug

SEQ ID NO: 263042 - RNA, 64 nt, Human
cacauucaccaaaguuuguuuucaugauccugauggccaagaacaccgugugggauuuuuuuuu

SEQ ID NO: 263043 - RNA, 64 nt, Human
uggggcuacaguaguggguaaacaaaugcccaccggccaagaggccauuaacaaaucguccuug

SEQ ID NO: 263044 - RNA, 64 nt, Human
gaggaaaauaccgacuggucuuaugagaagcaguggccaagacuaccuugagugcuggugauua

SEQ ID NO: 263045 - RNA, 64 nt, Human
aggacaggaauagcagaccagccaacgggauggccuuggguacaucacucagccuuucuggacc

SEQ ID NO: 263046 - RNA, 64 nt, Human
ccuggggacggguuuggguccccaggaggagagccuuggguauaaucuauuuuucuaggagccu

SEQ ID NO: 263047 - RNA, 58 nt, Human
aggaggugugcugucauugaaccucugccuuggguaacauccagacucaucugaaggc

SEQ ID NO: 263048 - RNA, 64 nt, Human
uugccucuaguucauggagaugugucucuguucaggccaagauacagccagccaggccugucgu

SEQ ID NO: 263049 - RNA, 64 nt, Human
uggagcuuuagagagaugcacucagcuucguguuggccaagacuccuucugggccaauggggcu

SEQ ID NO: 263050 - RNA, 64 nt, Human
cauuguggagcccauuauacuuugauuuaaaauaggccaagagaaucaggccuggagaucuagg

SEQ ID NO: 263051 - RNA, 64 nt, Human
ggggucuccaggggaugacuguuuucaaucucugggccaagaucacaugcaggauaccauggga

SEQ ID NO: 263052 - RNA, 64 nt, Human
cugggcaucuggggacaggaacaccucucaggguggccaagaggggcuuccuugggaccagugc

SEQ ID NO: 263053 - RNA, 64 nt, Human
cggaggcugugggcuccucaaagcuggagaaagaggccaagauuuuucugcacacggagugugg

SEQ ID NO: 263054 - RNA, 64 nt, Human
auuuauuaugggaauuggcucucgcaauuauggaggccaagaagucccacagucuugcauuugc

SEQ ID NO: 263055 - RNA, 64 nt, Human
ucugccucagugagggaucagggcagcaaacaagggccaagaccaucugagccagccccacauc

SEQ ID NO: 263056 - RNA, 64 nt, Human
guggcucaugccuauaaucucagcacuuuugggaggccaagacaggaggaucacuucaggccag

SEQ ID NO: 263057 - RNA, 64 nt, Human
caggaaaggcaggauugaaaauguccaggaaaguggccaagaagcaguggccuuauugcauccc

SEQ ID NO: 263058 - RNA, 64 nt, Human
ugaggaagaugcuaacgcaguaaggucugugcugggccaagagcagcuuugaagcuccagagaa

SEQ ID NO: 263059 - RNA, 64 nt, Human
agcucuucaucaagagggugguccugaagacuccggccaagaggcacaagcagcucaguaugcc

SEQ ID NO: 263060 - RNA, 64 nt, Human
agcccugaugggagcagcuuggcugugagcaccaggccaagacuccugagaacaggcagcccag

SEQ ID NO: 263061 - RNA, 64 nt, Human
cugaacuuugggagggccccuguacuaccuccugggccaagaaacuggcacagccccacacugu

SEQ ID NO: 263062 - RNA, 64 nt, Human
guguggcuguugcugucaccuggaguccuuuuggggccaagaugugugugcacccggggucgug

SEQ ID NO: 263063 - RNA, 64 nt, Human
gcuaagcugcuugugaaucucuuucuggauugcucuuggguacaagagagacugucggucucug

SEQ ID NO: 263064 - RNA, 64 nt, Human
ggcagagccaauuaccacccucugcugcuuagugcuuggguaccucuugcaauaaccagcucuu

SEQ ID NO: 263065 - RNA, 64 nt, Human
uuuccuauuucuauauaguuuauuauacaugauacuuggguagcucaacauucuuaauaaacag

SEQ ID NO: 263066 - RNA, 64 nt, Human
uggagucucccgaggcccccaugugcugcugaguggccaagaugaugccaggcugcccuauaca

SEQ ID NO: 263067 - RNA, 64 nt, Human
gguggcucacgccuguaaucccagcacuuugggaggccaagauggguggaucaccugaggucag

SEQ ID NO: 263068 - RNA, 64 nt, Human
gccaaauugcuucucaacccuagacaaagccuuuggccaagagggaggugcuguuaguugggca

SEQ ID NO: 263069 - RNA, 64 nt, Human
cccccaucacacucggccacuagugggguccugaggccaagaaagaaaccagacccuguaugac

SEQ ID NO: 263070 - RNA, 64 nt, Human
aucuggggcagccaccuugcuaccaugaaggaaaggccaagacaaucauccacagcuauucccu

SEQ ID NO: 263071 - RNA, 64 nt, Human
ggguaauacccacaacaacuguaguuucuuacuuggccaagagaaugcuuauuuaaguguuaga

SEQ ID NO: 263072 - RNA, 64 nt, Human
guucaagagagagucucuaaaucacuguuaguguggccaagagcaggguuuucuuuuuguucuu

SEQ ID NO: 263073 - RNA, 64 nt, Human
uucugaaggcugagucagccccacuccacaguuaggccaagaauuagauuuuaaaacuucaucu

SEQ ID NO: 263074 - RNA, 64 nt, Human
aggaaagggcccauguggcagaaggcaaaguacaggccaagaauugggggugggggagauggcu

SEQ ID NO: 263075 - RNA, 57 nt, Human
guggcugcucuguggccugaaggucuuggccaagaaauguagaccuuuccccaggcc

SEQ ID NO: 263076 - RNA, 64 nt, Human
gcacguggucaacaggacuccccaagcggaaugaggccaagacuggcgcugacaccacagcagc

SEQ ID NO: 263077 - RNA, 64 nt, Human
guggaucacgaggucaagaguucaagagcagccuggccaagauggugaaaccccgucucuacug

SEQ ID NO: 263078 - RNA, 64 nt, Human
uagcuaaaaccuuccaugucaagauucagcuaguggccaagagaugcagugccaggaacccuua

SEQ ID NO: 263079 - RNA, 64 nt, Human
gcuuccaaucccuaguacauauauaauagaaaagggccaagaaaaauaugcaucuugauuugga

SEQ ID NO: 263080 - RNA, 64 nt, Human
ucagcugagcacagguccgagggggcgggggcagggccaagaguucaaaagaagccaauggagg

SEQ ID NO: 263081 - RNA, 64 nt, Human
ccacggaguaucacaggcaggaaaggguggccuucuuggguagcaggagucagggggcuguacc

SEQ ID NO: 263082 - RNA, 64 nt, Human
gacagcgcuuccgcgagcacccugggaacugggucuuggguagcaaagcccucccagagaaaag

SEQ ID NO: 263083 - RNA, 64 nt, Human
gcaauccaucccgguucucucugagggccacgggcuuggguaguggaaaggguguuugggaaau

SEQ ID NO: 263084 - RNA, 64 nt, Human
gguagcucaugcuuguaaucucaccacuuugggaggccaagaugggaggagugcuugagguuag

SEQ ID NO: 263085 - RNA, 64 nt, Human
cuuugauucccugggauaguggcuucugagcaaaggccaagaaauuauugugccugaaauuucc

SEQ ID NO: 263086 - RNA, 64 nt, Human
auuacaucaaugugcagaaagccagaggacuagaggccaagacuuguuucagaaagauggaaga

SEQ ID NO: 263087 - RNA, 64 nt, Human
ccugccuccagcuuuacugagcacaggaugcgggggccaagaugaugcugaggccugaugacau

SEQ ID NO: 263088 - RNA, 64 nt, Human
cugacccaggcacuaggccuuggugacuuccuggggccaagaaacuaaggaaacucggcuuugc

SEQ ID NO: 263089 - RNA, 64 nt, Human
aauaaaauaacaaugucuucuugaaauuugugauggccaagaaagaaaaugaugaugacauuag

SEQ ID NO: 263090 - RNA, 58 nt, Human
uucugcaucucuacucuuaagagacucaggccaagaaacgucuucuaaacuuccccau

SEQ ID NO: 263091 - RNA, 64 nt, Human
cagcuagccccagggguggaacaacucugggagucuuggguacucgcaccucuuggcuuuguug

SEQ ID NO: 263092 - RNA, 64 nt, Human
ucugugagcuggaaacagaaggaaaaaacauacccuuggguacccauagccaauaacuggaaga

SEQ ID NO: 263093 - RNA, 64 nt, Human
cacuaauaauuuguauagauuauauauauuagaucuuggguaugguuuuuaccuucucccaugg

SEQ ID NO: 263094 - RNA, 64 nt, Human
cagcguaacuggcaaguuaccaagguuguuccugaaacagcagugaucaugacuucuccuuucc

SEQ ID NO: 263095 - RNA, 64 nt, Human
uaucaauacuuaggaagaccacagcuagacggacaaacagcauugggaggccuuaguccugcuc

SEQ ID NO: 263096 - RNA, 64 nt, Human
aguguuggagggccagagacuaguccugagauggaaacagcaacuuguacaguggcugagaaaa

SEQ ID NO: 263097 - RNA, 64 nt, Human
ggagaaaaaccgauucaaaucaacuuguacauggaaacagcaagcauuauggucaaacagcaaa

SEQ ID NO: 263098 - RNA, 64 nt, Human
caacuuguacauggaaacagcaagcauuauggucaaacagcaaaggccauaaccuuuugggauu

SEQ ID NO: 263099 - RNA, 64 nt, Human
ggaacaugcuucauggucacacauacaggcacaaaaacagcauuauguggacgccucauguauu

SEQ ID NO: 263100 - RNA, 64 nt, Human
cuuuagaacuuuuuuuuuuuuuuuuuuuuugguuaaacagcagcacuuuuuaguucccuaaacu

SEQ ID NO: 263101 - RNA, 64 nt, Human
uguucucaguuucccugccaacauugaaaaauaaaaacagcagcuuuucuccuuuaccaccacc

SEQ ID NO: 263102 - RNA, 64 nt, Human
guuauuucguuuuuucccucccagugcauuuuaaaaacagcacuggcuggggcauucucauucu

SEQ ID NO: 263103 - RNA, 64 nt, Human
cacccauaacuacggcauucucugugacuuccuuaaacagcagugaugggaagggauccaauag

SEQ ID NO: 263104 - RNA, 64 nt, Human
auuugugcaaauucuagucaauacuacuuuauguaaacagcaguguaaaauccaaaaacuucca

SEQ ID NO: 263105 - RNA, 64 nt, Human
cuucugagagggcuucucagccuggaaacuauggaaacagcaucaaagagaaaggaaugugggg

SEQ ID NO: 263106 - RNA, 64 nt, Human
guuaacaaaaagaauaaagcuaaucauguauuacaaacagcagugugcccagacuuguggaaau

SEQ ID NO: 263107 - RNA, 64 nt, Human
ugaaauuuugauucagacauccauuuccaguggcaaacagcaaagccugaacccauaaacccaa

SEQ ID NO: 263108 - RNA, 64 nt, Human
accuguauuuguuugaaugccuauuuugcauucucuuggguauauaucuaggaguggaacugcu

SEQ ID NO: 263109 - RNA, 64 nt, Human
cagacuggagugguccguucucaccacccuucagcuuggguacacacacagaggagaccucagc

SEQ ID NO: 263110 - RNA, 64 nt, Human
uacaucugcuacuuugggaggcccuuuacauagaaaacagcauucuuuuugccaaauaugacca

SEQ ID NO: 263111 - RNA, 64 nt, Human
aaaacuaugggggaaauaucacuggucugucaagaaacagcaguaauuauuacugaguuaaauu

SEQ ID NO: 263112 - RNA, 64 nt, Human
cuaaagggugauggaaagaagcagaggaaagcagaaacagcaagagugacugagaccugcuguc

SEQ ID NO: 263113 - RNA, 64 nt, Human
agccacuccaggauccugauuggggugccaagagaaacagcaggauguugaauugaucaucaga

SEQ ID NO: 263114 - RNA, 64 nt, Human
aggggcagcuuaucacagugcaaggggacaggguaaacagcaggggguggggugugagcuugga

SEQ ID NO: 263115 - RNA, 64 nt, Human
uuguaaaaguuuaugguauuauaccgauagaccaaaacagcauguguaagaggcaguaucugca

SEQ ID NO: 263116 - RNA, 64 nt, Human
ggaaaauagguacugucagaacaaagcuaccuggaaacagcauagagugaagccuuucgugagg

SEQ ID NO: 263117 - RNA, 64 nt, Human
gugugauacucauacuugcuguccagagggaguaaaacagcagagaacaguuugugugccauua

SEQ ID NO: 263118 - RNA, 64 nt, Human
ugugaagucgggauaaucaguagaauucucacccaaacagcaacauuucuaaggaacuuggauu

SEQ ID NO: 263119 - RNA, 64 nt, Human
uugauugugaugguuguacaacucugaauacaugaaacagcauuaaacaucacuuuaaguaagu

SEQ ID NO: 263120 - RNA, 64 nt, Human
aacaauagauuccauuaauauagacucaagaucaaaacagcauaccugcuaagcuaagauagau

SEQ ID NO: 263121 - RNA, 64 nt, Human
aaaaaaaaaaaaaaaacaaaaaacaacaccaaaaaaacagcagugauauauauauauauauaua

SEQ ID NO: 263122 - RNA, 64 nt, Human
uguuuagaaauauauggccaaaucuguaacccggaaacagcaaaaaacuucuuagcaaaggauc

SEQ ID NO: 263123 - RNA, 64 nt, Human
cuuuacaauaaugcuuagaugcagagagaggaaaaaacagcaacaaagucacauaaaucuuucc

SEQ ID NO: 263124 - RNA, 64 nt, Human
cucagaaaaggcuaacaauuuuauauagaggacaaaacagcauuaaacucaucaguugcaaaga

SEQ ID NO: 263125 - RNA, 64 nt, Human
cucuugggcccuggcauccugggugaccgguguucuuggguauuggggacaggacagagagcuc

SEQ ID NO: 263126 - RNA, 64 nt, Human
cuccauuguaucuucauacaaaggacaguacacacuuggguaauuaaaaauaaaaguugauuga

SEQ ID NO: 263127 - RNA, 64 nt, Human
augugguuuuaaagucucacguucucuauaauagaaacagcaggucuugucagcuccuugugug

SEQ ID NO: 263128 - RNA, 64 nt, Human
uuccuacaccccuuuccuggacugcucucuccagaaacagcacagcucauggagggugagauca

SEQ ID NO: 263129 - RNA, 64 nt, Human
auuagcagacucuuuguggacgagugaauuucacaaacagcacaauuucagaagaaaucgaggg

SEQ ID NO: 263130 - RNA, 64 nt, Human
aagcaaguacauauaguagugacuauauuuaaaaaaacagcauaaaaugcuuaaaaauguaaua

SEQ ID NO: 263131 - RNA, 64 nt, Human
uugagacguacuuuuaaaaucuaaagugugaaagaaacagcagaguaaaagccagacucauugc

SEQ ID NO: 263132 - RNA, 64 nt, Human
uuccacaucagauuuaaagcaucaaaugccugugaaacagcaaagaugguugaagauugugcuc

SEQ ID NO: 263133 - RNA, 64 nt, Human
cuguugagaauucuuugccacuuuucccaccccaaaacagcauggggccugacaucuucugccc

SEQ ID NO: 263134 - RNA, 64 nt, Human
cuuuaauuuuucccacaaguuuugaucagcaaauaaacagcauucuuguuuuggaaacaaacca

SEQ ID NO: 263135 - RNA, 64 nt, Human
ugucaguacuuaggaagaccacagcuagauggacaaacagcauugggaggccuuagcccugcuc

SEQ ID NO: 263136 - RNA, 64 nt, Human
uguccucccuuccgucuucucccucauccuuuccaaacagcagggugacuuuagaggcaugggc

SEQ ID NO: 263137 - RNA, 64 nt, Human
ugaguuauuggauuagaccaauuacugcacucuuaaacagcaccaccauuuaauuucauguaua

SEQ ID NO: 263138 - RNA, 64 nt, Human
uaaaacuggugggucuuuaauaaaacaacaacaaaaacagcaguuugugauauagcagagguuu

SEQ ID NO: 263139 - RNA, 64 nt, Human
uaguuccauucuugcccagcacuuucugcauuccaaacagcauccuaccuggguuuuuauccac

SEQ ID NO: 263140 - RNA, 64 nt, Human
ggaaagagcagacagcguaacagcagccuaugccaaacagcacuaaggaugucaguguacgaga

SEQ ID NO: 263141 - RNA, 64 nt, Human
auccaauuuugucaguauuuucuuagucugaaaaaaacagcaguaguaaucuggugaauguuau

SEQ ID NO: 263142 - RNA, 64 nt, Human
gaacucauuuaccucauuucuugccaauuacucacuuggguauuuacugcguaaucuggaacau

SEQ ID NO: 263143 - RNA, 64 nt, Human
uacccacauuucaauucuuuccauuauuugaacacuuggguagaacucuugcuuuguauuaaac

SEQ ID NO: 263144 - RNA, 64 nt, Human
uuuacuucauuggcuuauaaccuuguuguuauugaaacagcacuucuguuuuugaguuuguuuu

SEQ ID NO: 263145 - RNA, 64 nt, Human
acauugcaccuaccccggaaggcuggaaauacagaaacagcauggaauugcaaguccucugaag

SEQ ID NO: 263146 - RNA, 64 nt, Human
auaaaugcaauaauaugcauguuaacaacauuaaaaacagcaaacagcaaucuaaguacagaaa

SEQ ID NO: 263147 - RNA, 64 nt, Human
caauaauaugcauguuaacaacauuaaaaacagcaaacagcaaucuaaguacagaaaagcuuuu

SEQ ID NO: 263148 - RNA, 64 nt, Human
uaccuaaguggugugauguaaauacuggaaacaaaaacagcaguugcauugauuuugaaaacaa

SEQ ID NO: 263149 - RNA, 64 nt, Human
aauuugauuguuacucauuuugcucucauguucuaaacagcaacaguguaacuagucuuuuguu

SEQ ID NO: 263150 - RNA, 64 nt, Human
agccacuaauuaacuacugugucuucugugucacaaacagcacuccaggccagcucaagaagca

SEQ ID NO: 263151 - RNA, 64 nt, Human
acucuccgaucagaaucaucugggaagcauuuucaaacagcaaaguacuuugaaaaccauuauu

SEQ ID NO: 263152 - RNA, 64 nt, Human
uagcuggacugcaauaucaacaacaaguuguuucaaacagcaucaaaauacaacuucauugcua

SEQ ID NO: 263153 - RNA, 64 nt, Human
ugugaagauugaaaaugaacaaaguuagaaaaaaaaacagcaaaaucagugauuuagucagaug

SEQ ID NO: 263154 - RNA, 64 nt, Human
acaaagaaaagcagaugccaaaauacucuucugaaaacagcaacccagguaagacuugugauag

SEQ ID NO: 263155 - RNA, 64 nt, Human
gugacuuuuuaaaauggugacaguguuggcaaggaaacagcaacacaggcugcgcuguugguag

SEQ ID NO: 263156 - RNA, 64 nt, Human
gagauggagguagaaggaauugccuuucuuuuuuaaacagcaucaucuugauucuuagcuugga

SEQ ID NO: 263157 - RNA, 64 nt, Human
uuaaacuacguauaguguugcugaaauagaaagaaaacagcauuggaauuggauucauguaucg

SEQ ID NO: 263158 - RNA, 64 nt, Human
uauucugccauuuuuuaaaggaaagggaaaaugaaaacagcaugucuuuuuaaacauugaaaag

SEQ ID NO: 263159 - RNA, 64 nt, Human
acacaauuuugucaguuuacuuacagugcauacucuuggguaguacuugugcugaccaaguauc

SEQ ID NO: 263160 - RNA, 64 nt, Human
caggacacucauccauuaucuuggcugugagcuccuuggguacggguaccuuguauguuuacuu

SEQ ID NO: 263161 - RNA, 64 nt, Human
aagauuaguuaccauugaaauugguucugucauaaaacagcaugagucugguuuuaaauuaucu

SEQ ID NO: 263162 - RNA, 64 nt, Human
agucccagaauuuagaauaugcucaacacaaaguaaacagcauuauauaaguuuauauuuuugu

SEQ ID NO: 263163 - RNA, 64 nt, Human
cccauggacuguguuacaguuugucucuaacaugaaacagcaagagguagcccccucucccguc

SEQ ID NO: 263164 - RNA, 64 nt, Human
ugcuuuguucacacacauuugauuaaaaauaaacaaacagcaucuccccaccugcauucuccuc

SEQ ID NO: 263165 - RNA, 64 nt, Human
ccauggaaacuuggcagaagauucaaagcagcuuaaacagcacuuuuaaauuaacuccuaagcg

SEQ ID NO: 263166 - RNA, 64 nt, Human
aacauagccauaguccuuugaaguaaguggcuagaaacagcacucugguuauaauugccccagg

SEQ ID NO: 263167 - RNA, 64 nt, Human
uuguuguguguauucaaugugugauuuuaaaaauaaacagcaacaacaauaaaaacccugacug

SEQ ID NO: 263168 - RNA, 64 nt, Human
cuguuuuuuuucucugcaacucguuagcagaggaaaacagcauguggguauuugucgaccaaaa

SEQ ID NO: 263169 - RNA, 64 nt, Human
aggcugggcuucaaaaucaaaacaaaaaccccaaaaacagcaggcaaaugcuuuuuaacucuga

SEQ ID NO: 263170 - RNA, 64 nt, Human
gucuucugaagaugaaguucagccauuuuguaucaaacagcacaagcagugucugucacuuucc

SEQ ID NO: 263171 - RNA, 64 nt, Human
agcuuucaaagcaggcuuugugaaaauguaauacaaacagcagugaaugggacucaaauguugu

SEQ ID NO: 263172 - RNA, 64 nt, Human
cauaauucucuucaaagacuucagcagcaaaccaaaacagcagguuaaaaaaaaagaugcuuuu

SEQ ID NO: 263173 - RNA, 64 nt, Human
accuucuguuccccuccuggccugugcagaauguaaacagcagacucauacucaaugggcacua

SEQ ID NO: 263174 - RNA, 64 nt, Human
uuuccugauguacagggguuaaguccuauggaagaaacagcagaauuauucaaaauuauuuaca

SEQ ID NO: 263175 - RNA, 64 nt, Human
ccuagcuucacaucuuguguuuuccagaaaauaaaaacagcagacuguccuuucuccuaugguu

SEQ ID NO: 263176 - RNA, 64 nt, Human
cuugcuguuagggcaggaaggggcaaaaggaagacuuggguaguaaucuggggguucagauggg

SEQ ID NO: 263177 - RNA, 64 nt, Human
caugaacggcagucuagaauaccagaaacaucuacuuggguagcuuggugccauuauccugugg

SEQ ID NO: 263178 - RNA, 64 nt, Human
aguguuaacaaccaaacccuacagacgguaucagaaacagcaaauagauauuccucuacccuuu

SEQ ID NO: 263179 - RNA, 64 nt, Human
uuugaccaaaugagcuggucuauuaugccuuguaaaacagcagcauagggcuuuuaaaagguag

SEQ ID NO: 263180 - RNA, 64 nt, Human
gaugcuuguacaaacacgcacacacaaauggauaaaacagcaccucuggcuguuacauuaccau

SEQ ID NO: 263181 - RNA, 64 nt, Human
ugugugacuuucaaauccccuuucgcagugaaagaaacagcaaacacuuaagauucagcaucug

SEQ ID NO: 263182 - RNA, 64 nt, Human
ucuguugccugaaacagcccaguccucuuaacugaaacagcauucuacuucuuguuccaagaug

SEQ ID NO: 263183 - RNA, 64 nt, Human
aauucugaccagcaccucaguuucccucagagggaaacagcaggaggagggaucccugacugcu

SEQ ID NO: 263184 - RNA, 64 nt, Human
cugaagucugaggaacaaugccuuaagaaaaaacaaacagcaggaaucggugggacaguuuccu

SEQ ID NO: 263185 - RNA, 64 nt, Human
aauccguccucuacgcuugggcuuuucuguuaccaaacagcacuaucccaggaacuauugucug

SEQ ID NO: 263186 - RNA, 64 nt, Human
gcuuuccuuuugaggccaccaaaguaauuuagggaaacagcagaggguaauccaggucuuuuuu

SEQ ID NO: 263187 - RNA, 64 nt, Human
uauauuuuaaaaaccuagcuccuuucauuauuuaaaacagcaaaauuauuuuuguagcucaguu

SEQ ID NO: 263188 - RNA, 64 nt, Human
cucacuaacauugcuuccuuuuuugaccagcaggaaacagcaggucuggccagauucucacuug

SEQ ID NO: 263189 - RNA, 64 nt, Human
ggugccucgcaagagagcaagcacguucauaacaaaacagcaacacaaagacauguuaagcaug

SEQ ID NO: 263190 - RNA, 64 nt, Human
ggcagaguaccaugcgcucggccccagcugcaggaaacagcaggccccgcccucucacagagga

SEQ ID NO: 263191 - RNA, 64 nt, Human
caaacagaaccauuuucuuccucuuuaccucuuaaaacagcagaaguacaagaauacagcugua

SEQ ID NO: 263192 - RNA, 64 nt, Human
auacacccacaugcacacaccauaguuuuuauacaaacagcaauaacaaaaccaaaaagaugcc

SEQ ID NO: 263193 - RNA, 64 nt, Human
aaaugaaaaaaccaugacuaucaucaccaacauccuuggguauuaagugcagucacucuccuag

SEQ ID NO: 263194 - RNA, 64 nt, Human
cugacuagucucagauuguuucauaucauuuauacuuggguaagaguaaacuagauaacugggc

SEQ ID NO: 263195 - RNA, 64 nt, Human
uucugcaauucaacacauccacagguucgagcccaaacagcagaacuuuuugccaaaaugacag

SEQ ID NO: 263196 - RNA, 64 nt, Human
gaucagaaacaugauuuguucauuucugagucacaaacagcaggauaccucacagguaagccau

SEQ ID NO: 263197 - RNA, 64 nt, Human
cuuaaccaaaaaugauucaauacuguuaucacuaaaacagcaccaagaccugaagccaucuucc

SEQ ID NO: 263198 - RNA, 64 nt, Human
cuuucacaaaauuuaaaucauaaacaggcaaaccaaacagcacacuguagcuauaguuguuaug

SEQ ID NO: 263199 - RNA, 64 nt, Human
uugaauuuuuuuuuuaaaucuauuaggaacuggaaaacagcaaguaugguugauucucauuauu

SEQ ID NO: 263200 - RNA, 64 nt, Human
gagcuggaccacccaugccaaggagcgagccuuuaaacagcaguuuguaaacuaugcaacugaa

SEQ ID NO: 263201 - RNA, 64 nt, Human
gggaaaugggaggggugcaaaagaggagaguaagaaacagcauggagaaaacccgguacgcuca

SEQ ID NO: 263202 - RNA, 64 nt, Human
gcuggccucuaaaucaccuggagagccucgaaaaaaacagcaguggccaguccaccggguaugu

SEQ ID NO: 263203 - RNA, 64 nt, Human
uggcguggcauuucuuuggugucugcucagaaagaaacagcaugggaccgugugauugggucca

SEQ ID NO: 263204 - RNA, 64 nt, Human
aguaguauuaagccacaacaauaaugccacauugaaacagcauuuaauaaaaugcauaaagcua

SEQ ID NO: 263205 - RNA, 64 nt, Human
gugacagagugagacccugucucaaaagcaaaacaaacagcaauaacaauauuauuauuguuau

SEQ ID NO: 263206 - RNA, 64 nt, Human
uacaucgcacauacagccaggacuguagcuuuaaaaacagcauguaccauguuggagauuacgu

SEQ ID NO: 263207 - RNA, 64 nt, Human
uuuaaggaugccaagaaugcauuauuccacaaaaaaacagcagaccaacauauagaguguuuaa

SEQ ID NO: 263208 - RNA, 64 nt, Human
uauguguaaaaucagaugcuugcaggaggacgguaaacagcaaaggcuuuacuucuuuuucucu

SEQ ID NO: 263209 - RNA, 64 nt, Human
aauuacacugacuuggcuguuacuugaucuuaggaaacagcacaguuuaagauauugugaauuc

SEQ ID NO: 263210 - RNA, 64 nt, Human
gguccguugcuggcaacuggacuuccccauaagccuuggguauccugugaugggcugugucucc

SEQ ID NO: 263211 - RNA, 64 nt, Human
gcagauucauuuuucuuucugaugucaaaaaugucuuggguaggcgggaaggaggguuagggag

SEQ ID NO: 263212 - RNA, 64 nt, Human
cagaccggcagucaucauggcaguuucagcguucaaacagcaauagcucaagugugauaacuac

SEQ ID NO: 263213 - RNA, 64 nt, Human
uaaccguaaccucacacauuaacuuuauucaaacaaacagcacuuacaggaaauguaaaguaga

SEQ ID NO: 263214 - RNA, 64 nt, Human
uccauaacuuugcuauuacgaauagugcugcgauaaacagcacuauuaugaauagugcugcgau

SEQ ID NO: 263215 - RNA, 64 nt, Human
uaucgguuaggucauuuguggguugauucuucagaaacagcaguugauaccuagcagcguuauu

SEQ ID NO: 263216 - RNA, 64 nt, Human
aaauuguguucuguuaaagagguuaguaggaugaaaacagcaaaacaauaauuuuuucaacaaa

SEQ ID NO: 263217 - RNA, 64 nt, Human
ucuucaagaugcaauacuuuucuuaguaaaggaaaaacagcauaaaaagauaccuggucugccu

SEQ ID NO: 263218 - RNA, 64 nt, Human
uuucagaauaugaacugaggagucaaacaguuggaaacagcacauugcugauuuacacuggauc

SEQ ID NO: 263219 - RNA, 64 nt, Human
gccgcagggagauacacccaacugggagaugaggaaacagcaacccagagaggagaacuaaccc

SEQ ID NO: 263220 - RNA, 64 nt, Human
gaaggaaucuuaacaggaacaugaagccuugauaaaacagcaguuuuacuuuucucacaaaaac

SEQ ID NO: 263221 - RNA, 64 nt, Human
ugauuucagcauucguugcuuugcuauuuuuacaaaacagcauugauugaagcaagucuugguu

SEQ ID NO: 263222 - RNA, 64 nt, Human
caauuuggacuacauuuggcagaaaugauggaguaaacagcaaggcuuuaaauuaaauuaauag

SEQ ID NO: 263223 - RNA, 64 nt, Human
uugaacagcuuaucuuccacuugcagguuuauggaaacagcaguauuugaaaauaaauaaaaag

SEQ ID NO: 263224 - RNA, 64 nt, Human
guucagucacuuguuuguguuugaauugauuuuuaaacagcagguugugugugugugcagugau

SEQ ID NO: 263225 - RNA, 64 nt, Human
gacacaaucaagacaauagugcaccguuccuuaaaaacagcaucugaggaaucccccuuuuguu

SEQ ID NO: 263226 - RNA, 64 nt, Human
uccaaaggcuuuuauuuagagaaacggguaauuaaaacagcagcuuuagaauagcuucuuacug

SEQ ID NO: 263227 - RNA, 64 nt, Human
uugccuuucgcucuucuaucacagccaccuugaccuuggguaaaacccaaggucuuuccuucug

SEQ ID NO: 263228 - RNA, 64 nt, Human
guuuuccuuguuuaagugguaguugaacauagaacuuggguauuauagaucacuuuucacuuuu

SEQ ID NO: 263229 - RNA, 64 nt, Human
ucuucucauacuauuuaagagaacaagcaaauauaaacagcaacuuguguuccuaacaggaauu

SEQ ID NO: 263230 - RNA, 64 nt, Human
gaaacagcuaauuuccauuuugaaaauuaaaagaaaacagcacagagaaguuaaaugcggugua

SEQ ID NO: 263231 - RNA, 64 nt, Human
cgggcgugcucucucagacacacaacucugcuauaaacagcagaaacucuggacacaaacuuuu

SEQ ID NO: 263232 - RNA, 64 nt, Human
cacaggaguaauggacuguuuaacaaguuucccaaaacagcauuuuccugcuccuucguaugua

SEQ ID NO: 263233 - RNA, 64 nt, Human
auuauaaaguacugaagucacauagccaccuauaaaacagcauagaaaugucugccuguuuaaa

SEQ ID NO: 263234 - RNA, 64 nt, Human
cauauuguaaaaaaagaaucuuaucuccuauagaaaacagcaacauauaaauucaauaaauaag

SEQ ID NO: 263235 - RNA, 64 nt, Human
gucgcuucuucaagugaaugauucugcacuuuguaaacagcacugagauuuauuuuaacaaaaa

SEQ ID NO: 263236 - RNA, 64 nt, Human
acacacacacaaaugcagacacacaacaucaagaaaacagcaagggagagaauccaagccuaaa

SEQ ID NO: 263237 - RNA, 64 nt, Human
ucugcccuucagggggcacuaaaauguauuauugaaacagcauucugggcuuaaauagguguau

SEQ ID NO: 263238 - RNA, 64 nt, Human
gaaaaagcaaaagaaaagcaaaaaaaagaagaagaaacagcagaaagcagucucagguucaacu

SEQ ID NO: 263239 - RNA, 64 nt, Human
cucuuugugugucuccagguaacuuugcuugauuaaacagcaaagccauauucuaaauucacug

SEQ ID NO: 263240 - RNA, 64 nt, Human
auagaguauacaaguuuuuuagacccaaagaaaaaaacagcagagucucagcaugaucaguccu

SEQ ID NO: 263241 - RNA, 64 nt, Human
gggagcccagcccccaccccccaccuccgacagcaaacagcaacugacugcaggugcuggcaug

SEQ ID NO: 263242 - RNA, 64 nt, Human
augggcaacagaggccaaagaaacgaagcaagacaaacagcaaacaggcauuuuggucagguca

SEQ ID NO: 263243 - RNA, 64 nt, Human
guaugaagacacugucaaugagguuaugagaaaaaaacagcaggggcauuaguuucaggcaagg

SEQ ID NO: 263244 - RNA, 64 nt, Human
ugucuuuacuuaucaaaaccaucaaguccuuuuucuuggguauauauuuaaucaguaaguuaau

SEQ ID NO: 263245 - RNA, 64 nt, Human
aacuauaagaaaauucaaguccuuuauuuugugucuuggguauaugucauuauuuuaaauucca

SEQ ID NO: 263246 - RNA, 64 nt, Human
uuuauuuauuccuuauuucucuuucaucaaaacaaaacagcagcugugggaggagaaaugagag

SEQ ID NO: 263247 - RNA, 64 nt, Human
ggggaaaacuguucucuuuaaaauauuugucuuuaaacagcaacuacagaaguggaagugcuug

SEQ ID NO: 263248 - RNA, 64 nt, Human
acacaggcagcuccagggggcucugguugccaacaaacagcauuuguaaauggucuauuagccu

SEQ ID NO: 263249 - RNA, 64 nt, Human
uuugaaauuguuacagagcuuuccucuuuacuucaaacagcaaaaaaguggggggcauauugua

SEQ ID NO: 263250 - RNA, 64 nt, Human
ugggccuucucaccacagagccucgggacaucaaaaacagcagaacuucugaaaccucuggguc

SEQ ID NO: 263251 - RNA, 64 nt, Human
gggaauaauaaaauugcaaccaguuugguaaugcaaacagcagaauagaaugaaaucucaguaa

SEQ ID NO: 263252 - RNA, 64 nt, Human
augcugugacaauaaguuugaaccuuuuuuuuugaaacagcagucccaguauucucagagcaug

SEQ ID NO: 263253 - RNA, 64 nt, Human
gcuggaguaggagucugggaguggagaccccaggaaacagcaugaggugagggugugagggaag

SEQ ID NO: 263254 - RNA, 64 nt, Human
cucuuuuaaugcuaauggcuaguacguuuaaacaaaacagcaguucucugcugcaauauuccca

SEQ ID NO: 263255 - RNA, 64 nt, Human
gaugcgccuccacugucaccuguaccaagugccaaaacagcagaggggccaguuagagcaagag

SEQ ID NO: 263256 - RNA, 64 nt, Human
uccaaaggggaacuccagagacauuucauaaugcaaacagcacuguugcuuuaagaacaaggcc

SEQ ID NO: 263257 - RNA, 64 nt, Human
gcauuggauauagcaggaaagaaagcacauuuccaaacagcagggaguaagcuuacauuucugu

SEQ ID NO: 263258 - RNA, 64 nt, Human
gagauguauacuuagcaaaauuauuuuuaaauugaaacagcacaguaaauacuuaauauaaaau

SEQ ID NO: 263259 - RNA, 64 nt, Human
uguguagagcagagcuggaaaauaaggguucuugaaacagcaacagucaaaugcccaaccaacu

SEQ ID NO: 263260 - RNA, 64 nt, Human
aagaaccaacuccuacaaaugagaauucuugcacaaacagcagacuggcaugcucaaaguuacu

SEQ ID NO: 263261 - RNA, 64 nt, Human
gagugaaaauuccuuaggugauuccuaagauuuccuuggguaucugguuuuuguuuucauauuu

SEQ ID NO: 263262 - RNA, 64 nt, Human
aaaaacaaacuuggcuugauaaucauuugggcagcuuggguaaguacgcaacuuacuuuuccac

SEQ ID NO: 263263 - RNA, 64 nt, Human
uucaucagucaaugaggaagauuuuguuagacuuaaacagcagauuucagaucauauuucacaa

SEQ ID NO: 263264 - RNA, 64 nt, Human
aaauggcuauuuuguaagguuaauacuuucaguuaaacagcauguuugacuugauuccaucaug

SEQ ID NO: 263265 - RNA, 64 nt, Human
uggcugaaugaauuuuuaaaaucucaaagcaguuaaacagcaggaaagcccauuaacuucguac

SEQ ID NO: 263266 - RNA, 64 nt, Human
ggauauauuuaaccauaacauacugugauucaucaaacagcacaaacuuucauuucauggaguu

SEQ ID NO: 263267 - RNA, 64 nt, Human
cuugagauuuaagucuuuggguuuuguuuuaauaaaacagcauguuuucagguagagcuuaaac

SEQ ID NO: 263268 - RNA, 64 nt, Human
ucacgcuguaaguguaguucaguguaggugaagaaaacagcaccacugagaugaaucucauggc

SEQ ID NO: 263269 - RNA, 64 nt, Human
auguugcuuccacauuaacaaaacaaucacugaaaaacagcagauguuuaaauagauuauuuua

SEQ ID NO: 263270 - RNA, 64 nt, Human
ugaggguggagggaagcugaggauagagcuccagaaacagcacuagggucccaggagaggggca

SEQ ID NO: 263271 - RNA, 64 nt, Human
uuuauauugcuuugcacuuugguuugauauuaagaaacagcauucuucuucagugaaauuuugg

SEQ ID NO: 263272 - RNA, 64 nt, Human
gguugucaaaauuggauguuaaggauucuuagaaaaacagcaaccaccagaauagcauauaucu

SEQ ID NO: 263273 - RNA, 64 nt, Human
uguagaauggggucuggccaccuggccugcugggaaacagcaaucuuccuuaauagcauuucaa

SEQ ID NO: 263274 - RNA, 64 nt, Human
uagacaugacuaguuaacaacacagcugggaucuaaacagcaauaacuaacauuaauggagaac

SEQ ID NO: 263275 - RNA, 64 nt, Human
uagacaugacaagugaacagcagagcugggaucuaaacagcaauaacuaacauuaacagagaau

SEQ ID NO: 263276 - RNA, 64 nt, Human
aguguccacccucucugaaaaucuuucuuguucaaaacagcaacgacauaucuuguuaacuuuu

SEQ ID NO: 263277 - RNA, 64 nt, Human
cuuguagaacaucagagaaggcacauugacuagcaaacagcacuuuaggaaaagucaccguagc

SEQ ID NO: 263278 - RNA, 64 nt, Human
acccucuucccucuccuuucauaccagucacuaucuuggguaacaaauuuauacaggacagugg

SEQ ID NO: 263279 - RNA, 64 nt, Human
gcagagauuacuagcccuuggcucucucguuuggcuuggguauuuuauauuauuucugucauaa

SEQ ID NO: 263280 - RNA, 64 nt, Human
auuucacuguagaugauaugcuaggaucaaaguuaaacagcauucuucacugcaggacaucuca

SEQ ID NO: 263281 - RNA, 64 nt, Human
ccccuacaucccuggcacugguuguuuucugugaaaacagcagugaacagguucaguuuugaac

SEQ ID NO: 263282 - RNA, 64 nt, Human
accaacucaacauuccauuggaggcuauaugaucaaacagcaaauuguuuaucaugaaugcagg

SEQ ID NO: 263283 - RNA, 64 nt, Human
cccagugaaugccccauguaaaaacaugaugauaaaacagcaaagcacuguugugugcuugagu

SEQ ID NO: 263284 - RNA, 64 nt, Human
caggagaucaugcugcugugauacugaguuuucuaaacagcauaaggaagacuugcuccccugu

SEQ ID NO: 263285 - RNA, 64 nt, Human
ugcucuaacgaauuaccacaaaccugguggauugaaacagcagaacuugauucccuuacaguuc

SEQ ID NO: 263286 - RNA, 64 nt, Human
uuauguuaaguuggguauuuuuuuaaaaaaagaaaaacagcaacauuaauaaaagaaguggugu

SEQ ID NO: 263287 - RNA, 64 nt, Human
uacuaaauguuaaacuauuaccacacagcccauaaaacagcauuugcguuuauugagagagagg

SEQ ID NO: 263288 - RNA, 64 nt, Human
acuaaaagaacauaagucaagggaggaugaauaaaaacagcaaaaccaaauaaaguggagauga

SEQ ID NO: 263289 - RNA, 64 nt, Human
gaaaccaauuucuacuucauacugauguuuuuggaaacagcaauuaaaguuuuucuuccaugag

SEQ ID NO: 263290 - RNA, 64 nt, Human
uuugcagauucucugggauuuuaaggaacugagaaaacagcaaaguugacuaaauuuuauauuu

SEQ ID NO: 263291 - RNA, 64 nt, Human
ccugcucaggucuuugugcucuguuccuuaucaaaaacagcacaacccccucaaucugcccauu

SEQ ID NO: 263292 - RNA, 64 nt, Human
guuacaguuauggaaguaugagaaguuaugagugaaacagcaauuuucuauauaaauugccuau

SEQ ID NO: 263293 - RNA, 64 nt, Human
gggaaaagaggggaagaagcaucuuaagaagaggaaacagcagagaacuggcuggaugaccugu

SEQ ID NO: 263294 - RNA, 64 nt, Human
cgcuugaggccagaagugcaagaccagccugcgcaaacagcaagacccugucuacaaaaaaaaa

SEQ ID NO: 263295 - RNA, 64 nt, Human
gaccuucauuuaacuuggcucacuucucuucagacuuggguagaagugcagagccacagaauug

SEQ ID NO: 263296 - RNA, 64 nt, Human
uggacuggacugacggcgagugaauucucuagaccuuggguacuuucaguacacaacaccccua

SEQ ID NO: 263297 - RNA, 64 nt, Human
uuuucagccauucacaagcauucaaaaccaaaccaaacagcaguucauauaccugccugagaua

SEQ ID NO: 263298 - RNA, 64 nt, Human
cucaaagacaauucauagccuguggucuccacauaaacagcaacaagacaaguaauaguccuuu

SEQ ID NO: 263299 - RNA, 64 nt, Human
aauacaaacgauguuguguuccuucucucgaacaaaacagcaaagggaaugccagcuaacuucu

SEQ ID NO: 263300 - RNA, 64 nt, Human
uuuuuggacacuuggaucuaaaugauguaaagcaaaacagcaucaauauauaugugagguugca

SEQ ID NO: 263301 - RNA, 64 nt, Human
gaaacuccuggaucccuuucacuauguccaugaaaaacagcagaguaaaauuacagaagaagcu

SEQ ID NO: 263302 - RNA, 64 nt, Human
aaaaaaacuacucuuauguccacuuuacaaaagaaaacagcauugugauuacucccagggaccg

SEQ ID NO: 263303 - RNA, 64 nt, Human
ugaugugucaucucugaccuuguuucagcaaaguaaacagcacuccccaccccacccuccuuuu

SEQ ID NO: 263304 - RNA, 64 nt, Human
uaauagcacuuguaugaaauucaguuuuggaacuaaacagcaaauuucuagaauuuugcugaaa

SEQ ID NO: 263305 - RNA, 64 nt, Human
uucccaagcaacauagauuucccuaucuuucaggaaacagcaucaaggaacucugaaaaauaua

SEQ ID NO: 263306 - RNA, 64 nt, Human
ggcauguucugauauguuuauaggcaaacaaauaaaacagcaaacuuuuuugccacauguuugc

SEQ ID NO: 263307 - RNA, 64 nt, Human
ccuuauuuuguaauucauauaguaagaguauucuaaacagcacuacauuaauaucauuugauag

SEQ ID NO: 263308 - RNA, 64 nt, Human
uugcauuucuccccacucccugcccugcuuuaauaaacagcaaaccaauaucuaggaagaauga

SEQ ID NO: 263309 - RNA, 64 nt, Human
guuccaaggaacugacagcaaccugcaaagaggaaaacagcaucuccucaccugcguaaaauug

SEQ ID NO: 263310 - RNA, 64 nt, Human
cccuaggguccccaugggaaagggacaugcaaggaaacagcacagaacacgaggugguccccau

SEQ ID NO: 263311 - RNA, 64 nt, Human
agacuuuauuccuuuggaaaauucacuguuccacaaacagcaggcugaauggccucgccucuag

SEQ ID NO: 263312 - RNA, 64 nt, Human
caccauaguagaacaugguugcuuucuauuuuuucuuggguauggagguuucuugaagaccuag

SEQ ID NO: 263313 - RNA, 64 nt, Human
agucugcugagcagucaugaauuuuauuguauuucuuggguaaggacaggccagaaugaguguc

SEQ ID NO: 263314 - RNA, 64 nt, Human
aagucauuuugaguguugguguuaagcaugaaacaaacagcagcuguuguccuuaaaaaugaau

SEQ ID NO: 263315 - RNA, 64 nt, Human
auguugcaccuaaacauuccaacccuuaaagcuaaaacagcacaaaaaaauuucacuuuugaaa

SEQ ID NO: 263316 - RNA, 64 nt, Human
ucucuggcucaagggcugaguuaagugaaaggaaaaacagcacaauggugaccacugauaaagg

SEQ ID NO: 263317 - RNA, 64 nt, Human
guggcuugauuuccaauagcugaacuugggcagaaaacagcaggccaauguuccuaugugguuu

SEQ ID NO: 263318 - RNA, 64 nt, Human
ugugggagugcuacagcagggaaccaugaaacagaaacagcaagauggaggcagccagacacca

SEQ ID NO: 263319 - RNA, 64 nt, Human
acccuggaguauuuggaagcaacguguuaauuauaaacagcaggguuugagcacaaucuguucu

SEQ ID NO: 263320 - RNA, 64 nt, Human
uaauagaaagcacccuaauugacuuggaaaaaaaaaacagcaaaagcaaaaguagcaacauaug

SEQ ID NO: 263321 - RNA, 64 nt, Human
uacgcuugcuugacgucacucucucucgaccuccaaacagcaggacucuuucucugggaaacca

SEQ ID NO: 263322 - RNA, 64 nt, Human
agcuucaaacuauacuacaaggcuacaguaaccaaaacagcauaguacuggcacaaaaacacac

SEQ ID NO: 263323 - RNA, 64 nt, Human
uuuauccaaagcuuuuucucuguguccacucuccaaacagcauucuagagcagucaaggagaca

SEQ ID NO: 263324 - RNA, 64 nt, Human
uauucucauuuaaaggaguuuagcuuucagagagaaacagcaggauugcuuuugaccuuuuaga

SEQ ID NO: 263325 - RNA, 64 nt, Human
auuucugucuccccaggcguccaggugaucccccaaacagcaugugcucagccccagaccugcc

SEQ ID NO: 263326 - RNA, 64 nt, Human
guuaauguacuugcaaaucuccugcuggcucaugaaacagcagaauuccagccaaggcaaauuc

SEQ ID NO: 263327 - RNA, 64 nt, Human
uuaacuuauuuauuucuucuaggaaacaauagauaaacagcaugaaaauguaaaucaucuggca

SEQ ID NO: 263328 - RNA, 64 nt, Human
auuaaaggacuuuguuacuuuagccacaaagcuaaaacagcauuaccucagcucuaaacuagcc

SEQ ID NO: 263329 - RNA, 64 nt, Human
cccgguccucugcccugaucuguguaacucuuaucuuggguacuugagcagacgguauauucca

SEQ ID NO: 263330 - RNA, 64 nt, Human
agcccugcccccaauacucugucuggguuaggaucuuggguaugucuuggaauuaacuuguccu

SEQ ID NO: 263331 - RNA, 64 nt, Human
gauuuuugcuacaguuuagacacugugguuuacaaaacagcaugcacucaacuugggacuuuau

SEQ ID NO: 263332 - RNA, 64 nt, Human
gucucagauguucuaauucucuuuguaugcuuggaaacagcauagauauguugcugugguuuuc

SEQ ID NO: 263333 - RNA, 64 nt, Human
uuugaccuaaaauauuuucucaaacuaauucaugaaacagcaacuuuuaccaauaccuuuguau

SEQ ID NO: 263334 - RNA, 64 nt, Human
gcugcugaggcccccaaguuuuuuaauuaagcagaaacagcauauuagcagggauucucucauc

SEQ ID NO: 263335 - RNA, 64 nt, Human
uaugaauacgucuguauaaucggcuucuggagugaaacagcaaaccccaaaucuucaaaguugg

SEQ ID NO: 263336 - RNA, 64 nt, Human
gggaaaauaaaaggauccucuucacuucuuucuuaaacagcaaauccagccagguucagauuac

SEQ ID NO: 263337 - RNA, 64 nt, Human
aguugagaaggggaccuuaaguuugguuugcggcaaacagcacuugcaagaaauauaacccucc

SEQ ID NO: 263338 - RNA, 64 nt, Human
ucauauuguaaugccaauauaauauaguuaaugaaaacagcauuuuuaaaaaccgaaauauuga

SEQ ID NO: 263339 - RNA, 64 nt, Human
ugauuuguccugcagugcucauucaucacuccaaaaacagcaggccaucuuuuuaugcaaaagu

SEQ ID NO: 263340 - RNA, 64 nt, Human
ccuucucaggcuggugggggcagccuugcaagagaaacagcagccuuugucucuucccucuugu

SEQ ID NO: 263341 - RNA, 64 nt, Human
uauuuuaucuucauccuaaauuuucucccuaucaaaacagcaggaaauuuuuaaacuuuuauau

SEQ ID NO: 263342 - RNA, 64 nt, Human
uaaacuagaugaccucauuaaccgaugcuuuaccaaacagcaaaccaagagauugcuaauugcu

SEQ ID NO: 263343 - RNA, 64 nt, Human
uacauuuaauuauuuccuauguuagcuguuaaagaaacagcaggacuuguuuacaaagaugucu

SEQ ID NO: 263344 - RNA, 64 nt, Human
cauucucccaacugaguguaguauguggagcauaaaacagcauauuucuuaguauuucaugaau

SEQ ID NO: 263345 - RNA, 64 nt, Human
gauuagauggguuguguuuguguucugauggagaaaacagcaccccaaggacucagaagaugau

SEQ ID NO: 263346 - RNA, 64 nt, Human
cccuggugucaggcagguuugccagugaagacuucuuggguaguuuagaucccaugucaccuca

SEQ ID NO: 263347 - RNA, 64 nt, Human
caagcagcuaggacuacaggcacaugccaccacacuuggguaauuaaaaaauaaauaaauacuu

SEQ ID NO: 263348 - RNA, 64 nt, Human
ccuuaaacccucgcuuuguuguaaaagcuaaaauaaacagcaugcuauauuguaauuguauuuc

SEQ ID NO: 263349 - RNA, 64 nt, Human
caaagaucaguugacaucuccuagggaaugaugaaaacagcaggcuauuagaaaauuauuucau

SEQ ID NO: 263350 - RNA, 63 nt, Human
uacuuaaaagucaucuuugaaaugauaaucaagaaacagcagcuaugaagccuugaauuuuga

SEQ ID NO: 263351 - RNA, 64 nt, Human
cauacgucuuaaaucucaucaaugaaauccagugaaacagcaccauuucuuaguaucauuaaau

SEQ ID NO: 263352 - RNA, 64 nt, Human
gagguggacacauuuucauguucauuacuaaaacaaacagcaaaacuauugguuuguuauucug

SEQ ID NO: 263353 - RNA, 64 nt, Human
caucagccaucaaaucuuguugaguuuaaaaaauaaacagcaaaaaaaaacaaaacaaaacaaa

SEQ ID NO: 263354 - RNA, 64 nt, Human
guagcuguuccuaguguauuuucgucuuucuggaaaacagcauugagugguuguuuucugugua

SEQ ID NO: 263355 - RNA, 64 nt, Human
gaggaguaucuuauuugcuuucuaucaucaguaaaaacagcauuuaacuugcuaaauaaacaug

SEQ ID NO: 263356 - RNA, 64 nt, Human
auuaugcugcaauguauaaucugguguguuauuuaaacagcacuaguacuguacacugguuuuu

SEQ ID NO: 263357 - RNA, 64 nt, Human
ggaagggcgugcaaaaacuaacauugaaauuuugaaacagcagcagagugaguggauuuuauuu

SEQ ID NO: 263358 - RNA, 64 nt, Human
ucuacguucgaaacaaaguaauaugaaaauauuuaaacagcauuacaaaauccuaguuuauacu

SEQ ID NO: 263359 - RNA, 64 nt, Human
aaccacuucccauauaagaugcuuaaggcucucaaaacagcagaacaaugaaacauacucuccc

SEQ ID NO: 263360 - RNA, 64 nt, Human
cuacacccaccuguuuuccaguguucuucucucuaaacagcaaagccaaagcacucugcacacc

SEQ ID NO: 263361 - RNA, 64 nt, Human
uuuuuaaauuguuguacaggaagagaugugucuaaaacagcaucuuaaagcugaguguauuucu

SEQ ID NO: 263362 - RNA, 64 nt, Human
uuguauuaguguuagaaaacacagcugcguaaauaaacagcacgggugacccgcauucccgcuc

SEQ ID NO: 263363 - RNA, 64 nt, Human
ucaccccugcggcuguccuauagcugagaugcgugggucgcaggggaggugauuucuaggcaua

SEQ ID NO: 263364 - RNA, 64 nt, Human
uccuauggcgccagucaccagcuccuagacagcacuuggguaccccauuggggucuuggagagg

SEQ ID NO: 263365 - RNA, 64 nt, Human
uccagcccuauucugccacuccugacagggugaccuuggguauuugcaauauuccuuugggccu

SEQ ID NO: 263366 - RNA, 64 nt, Human
accaccucagauggaucugacguggcuaagggacaaacagcaaauauuucagucauuuugauuu

SEQ ID NO: 263367 - RNA, 64 nt, Human
cggggacucuggccacagaggucaggccuccugaaaacagcacugccuuccgcgcugccccagc

SEQ ID NO: 263368 - RNA, 64 nt, Human
aacuaaaucucuauuuguucagaugaugcuucuaaaacagcauugauagguuaaagaagcuugg

SEQ ID NO: 263369 - RNA, 53 nt, Human
ggaagucugagugggugugaaaaaaacagcaccuggcggugccccggggcuca

SEQ ID NO: 263370 - RNA, 64 nt, Human
gacuuccaauuauucaacagagcuacaguaaccaaaacagcaugauacuggcauaacaacagac

SEQ ID NO: 263371 - RNA, 64 nt, Human
aaaucauaauuaaugcguuacuguaugaaccacaaaacagcacuauuuauuuagccuuacuucu

SEQ ID NO: 263372 - RNA, 64 nt, Human
uuuucaaaagaguaacugaaauuguugcaggccaaaacagcaauaugauaucucagauuuaguu

SEQ ID NO: 263373 - RNA, 64 nt, Human
aacuucuaacuuugcuccaagccacucucuuuuuaaacagcaacaauuuaaagcuaugaaguca

SEQ ID NO: 263374 - RNA, 64 nt, Human
uuaagcgcuccccuggcaaacaaauugaagugccaaacagcacucgcugcaggguauuuuuaga

SEQ ID NO: 263375 - RNA, 64 nt, Human
cccugggacauuucacuguaccaguauuaacugcaaacagcaauaauugucauuacagcaaggg

SEQ ID NO: 263376 - RNA, 64 nt, Human
aagucuugaaguuggguguuuccagaauugguaaaaacagcagcucauagaauuuugaguauuc

SEQ ID NO: 263377 - RNA, 64 nt, Human
uuuucuuuguuuguuuguuuuuuucucuaaaaacaaacagcaaaagacagcugaaaacaagaac

SEQ ID NO: 263378 - RNA, 64 nt, Human
gaaauugacuuacauagaugauaaaagagaagccaaacagcaagaagcuguuaccacacccagg

SEQ ID NO: 263379 - RNA, 56 nt, Human
uuggagguaaacccuuaugagacaggaaacagcaaaggcuagcuuuaggagagaaa

SEQ ID NO: 263380 - RNA, 61 nt, Human
aggaugaugaagaugaaugaaaaaaaaaaucaaacagcagaagaccaaggcaucagaucug

SEQ ID NO: 263381 - RNA, 64 nt, Human
acaugaaugaggagcagcaagucauaaccacucccuuggguauacaauuugcuguguagugaag

SEQ ID NO: 263382 - RNA, 64 nt, Human
auauuguuuaccuaucuucuacacaaggcguguccuuggguaaguuauuuaacuucaauuuacc

SEQ ID NO: 263383 - RNA, 64 nt, Human
agaggccgagccugggccacagcucagccacugacuuggguaucaguuuccccuucugagaagu

SEQ ID NO: 263384 - RNA, 64 nt, Human
ucagcuauugaacaguuacuaauuuaugggguggaaacagcauuaagaauacugaaucaaaugg

SEQ ID NO: 263385 - RNA, 64 nt, Human
ccacagaaaaacccaugagguuuuuuaacauuaaaaacagcagcuuuaugauagagaaaaaaac

SEQ ID NO: 263386 - RNA, 64 nt, Human
uggcucuuacccagcucucagugacucccccacaaaacagcaacagccuccaccgccaacucaa

SEQ ID NO: 263387 - RNA, 64 nt, Human
guuuaugcuuuuccuuucugguaccggaaguagaaaacagcacauguugauuacgaauguuuuu

SEQ ID NO: 263388 - RNA, 64 nt, Human
ccuucagcggacggauaccgggagcgcuugggcgaaacagcagagaaagaaagacuguggucgg

SEQ ID NO: 263389 - RNA, 64 nt, Human
agguaccaggaagaaggaaugaccucugggcugaaaacagcagcauuuucaguaauuccuacaa

SEQ ID NO: 263390 - RNA, 64 nt, Human
auggugcucugugguggcgcaugauucacugagcaaacagcacuuuacagaagaaaaucuuuau

SEQ ID NO: 263391 - RNA, 64 nt, Human
gucauuucacuucgaaauaaaacacagcuccuucaaacagcacuuuuuccacauaaaucuaguu

SEQ ID NO: 263392 - RNA, 64 nt, Human
cccuacugagacugguccccucaaaagguagacaaaacagcagcucccuguggagcugaagggc

SEQ ID NO: 263393 - RNA, 64 nt, Human
ucuuacccucacauugaaaugaggauuuugcuuaaaacagcacuugccgccagugggaggaggg

SEQ ID NO: 263394 - RNA, 64 nt, Human
gcaggcucugcuguuucuagugacccugagauguaaacagcaagugggggcugaggcagaggca

SEQ ID NO: 263395 - RNA, 64 nt, Human
acccccucucagccacugucuucagucuccacagaaacagcaucaagugugcggagacaggcgg

SEQ ID NO: 263396 - RNA, 64 nt, Human
uaucagugaccugccugcaagcauccccagaagcaaacagcagagguagaagauaucacugcag

SEQ ID NO: 263397 - RNA, 64 nt, Human
acuuaaagaugcaguauauacuuuucucauuuuuaaacagcacauauuuauuaagagaaaaaaa

SEQ ID NO: 263398 - RNA, 64 nt, Human
cagagguuugcuuugcuuuuuuuucagaaguuccaaacagcaacuuugagagcaguggggugcu

SEQ ID NO: 263399 - RNA, 64 nt, Human
ucgccuggacaagaaggaaaaugcugauuuccuccuuggguagaaagagggagcgagggcaaau

SEQ ID NO: 263400 - RNA, 64 nt, Human
uauguuuucuuccuucugcagcagcuuucugcuucuuggguacuacuagcuauuguucaauuca

SEQ ID NO: 263401 - RNA, 64 nt, Human
uauuaccaggcccaacucagucuucagugauuuuaaacagcauugacaucaucuguaaaaccau

SEQ ID NO: 263402 - RNA, 64 nt, Human
agggaacagggcagcucuguuugaauggggugaaaaacagcaaaauuaauucuuagcaagcucc

SEQ ID NO: 263403 - RNA, 64 nt, Human
ugguguucuauaccuaaaggaugaccugcuccagaaacagcaccagcacagcauguauuuucuu

SEQ ID NO: 263404 - RNA, 64 nt, Human
ggucccuaacaugaggauguggcuggcucgugggaaacagcaaaacacuaagccugaccucucc

SEQ ID NO: 263405 - RNA, 64 nt, Human
aaaaaaaagagaacccacaugaagcucugaaaccaaacagcauccugccaugagcuucccagag

SEQ ID NO: 263406 - RNA, 64 nt, Human
uuguauaccugggacagggcuguuuuauaccaauaaacagcaaaauauuguccuuacucauuca

SEQ ID NO: 263407 - RNA, 64 nt, Human
uguuuuguucuuuaaagucagguccaauuuguaaaaacagcauugcuuucugaaauuagggccc

SEQ ID NO: 263408 - RNA, 64 nt, Human
gcagcaccagcagcucuugccaccuccagcugccaaacagcagccugccgggcagggagcagcc

SEQ ID NO: 263409 - RNA, 64 nt, Human
gcacuuuagggccccuuagcagggugagcuguuaaaacagcacacaucucucauccccucuucc

SEQ ID NO: 263410 - RNA, 64 nt, Human
gcagguucuuugucucacugaauucuuaucauggaaacagcagcagcagccgcuaggaaaucuu

SEQ ID NO: 263411 - RNA, 64 nt, Human
ucugaggguuaaaugaaaauaaaaagaaaaugugaaacagcaccacagguacuugacaaugaug

SEQ ID NO: 263412 - RNA, 64 nt, Human
caacuccaccuaaggcaugaauaugcggcagagaaaacagcaauagugaaugaaugcaaaaggu

SEQ ID NO: 263413 - RNA, 64 nt, Human
cucuaaauagccaacacccaucuguuuuuuguaaaaacagcauagcuuauacauggacaugucu

SEQ ID NO: 263414 - RNA, 64 nt, Human
uuccaaucugcugaaucuuuugacugcaccuuacaaacagcagucugcucccaugacccucugc

SEQ ID NO: 263415 - RNA, 64 nt, Human
uagaaggggacagaggugucccugauuaagcaggaaacagcacccuuggcguccccagcaggcu

SEQ ID NO: 263416 - RNA, 64 nt, Human
gaaugaggugcuccugccguguccgccuuguuccgggucgcacuggaacaggcagcaauuccua

SEQ ID NO: 263417 - RNA, 64 nt, Human
augucaccuucacagaacaggacaggguacccuugggucgcacgggccuggcuggcauguaaac

SEQ ID NO: 263418 - RNA, 64 nt, Human
gcaucuccaugaugguggaucccaaaaccccucugggucgcacccugccagagccuuccuuggu

SEQ ID NO: 263419 - RNA, 64 nt, Human
aaaaaauuucuccuuaagaaaacagaauauucaaaaacagcacuuuuccaggaaguuagugagg

SEQ ID NO: 263420 - RNA, 64 nt, Human
gagcacuuugcccguacuuaggcuguggacccuaaaacagcaguguuucaacaagauguugcug

SEQ ID NO: 263421 - RNA, 64 nt, Human
auuagugacuugaaucuucauaaguuaaaguaaaaaacagcaaaaaaccuagaucuuugucuuu

SEQ ID NO: 263422 - RNA, 64 nt, Human
cucauaauaauugacucuaaggcuuuuauuaagaaaacagcagaaagauuaaaucuugaauuaa

SEQ ID NO: 263423 - RNA, 64 nt, Human
acuacugcccugauuacuccuuaggauguggucaaaacagcaucaaauguuucuucucuuccuu

SEQ ID NO: 263424 - RNA, 64 nt, Human
ccucguccacacccggggggcccccgggugcagaaaacagcaccucccaccaaccagccacucc

SEQ ID NO: 263425 - RNA, 64 nt, Human
gacccaagaaaugcuguuugcucaugguaaacagaaacagcaucuucgcuacaaccacugacac

SEQ ID NO: 263426 - RNA, 64 nt, Human
uacuucuguauagaacuaacagcaaaaaggcguuaaacagcaagugucaucuacauccuagccu

SEQ ID NO: 263427 - RNA, 64 nt, Human
auacuguaauguaaagacauuuauaguacuaggcaaacagcaccccagguacuccaggcccucc

SEQ ID NO: 263428 - RNA, 64 nt, Human
caggucuuccucuuuccugagacuggaucuguucaaacagcaaacgcccacagauggcccagag

SEQ ID NO: 263429 - RNA, 64 nt, Human
uauuugggggcuaagguuuccagucagaugaggcaaacagcaagaguaagcaguguuacuugca

SEQ ID NO: 263430 - RNA, 64 nt, Human
cagucgucacgaccccgcagacuguccuccggauaaacagcauugagauugcuccguguuuguu

SEQ ID NO: 263431 - RNA, 64 nt, Human
guuuuaauuucaggaacaggugauccacucuguaaaacagcagguaaauuucacucaaccccau

SEQ ID NO: 263432 - RNA, 64 nt, Human
ucucaguucucgauaggucagagcagagguggaaaaacagcauguacggauuuucaguuacuua

SEQ ID NO: 263433 - RNA, 64 nt, Human
aagagauucuagaaucugugcccugggaagggagaaacagcagggaagaggggcaauacaacag

SEQ ID NO: 263434 - RNA, 64 nt, Human
aagagaaaugaaaacauaucuccccacaaaaaaacuuggguaugagauuucacauuaucauugc

SEQ ID NO: 263435 - RNA, 64 nt, Human
agcacuuauguuacugguguccagcugaguuucucuuggguauaaaggcuaaaagggaaaaagg

SEQ ID NO: 263436 - RNA, 64 nt, Human
uggaaucauuaaguaauuuaauaaaaaaauugugaaacagcauauuacaaguuugaaaauucag

SEQ ID NO: 263437 - RNA, 64 nt, Human
cuccagucuccacucccugaggauggaaucggggaaacagcauccugccgccuccucucugccu

SEQ ID NO: 263438 - RNA, 64 nt, Human
guagcgguaguugaugggagcuguugaaacagguaaacagcauucuagcaauccuucgacuuuu

SEQ ID NO: 263439 - RNA, 64 nt, Human
ucagccuuccagaguuacugucugcuuaaggcagaaacagcaguaaauaaugaggaaaaugaau

SEQ ID NO: 263440 - RNA, 64 nt, Human
ggagaaaaaaagccacuucugcuucuguguuuccaaacagcauugcauugauucaguaagaugu

SEQ ID NO: 263441 - RNA, 64 nt, Human
aaacaagagcauuuguaauaggaaguguuuauacaaacagcacauuugugauauguugaaaagc

SEQ ID NO: 263442 - RNA, 64 nt, Human
ucgcuuuuuaucuggaaccucucagauaccucuaaaacagcaaacugugauucucaagauuaga

SEQ ID NO: 263443 - RNA, 64 nt, Human
aaacagaaauagacacacacaccagcagagacagaaacagcaauagccaggacuccuggcuaaa

SEQ ID NO: 263444 - RNA, 64 nt, Human
guccugcagucguauaguauagcagugcaggaacaaacagcacuugccagcaaagucugugugu

SEQ ID NO: 263445 - RNA, 64 nt, Human
uuguuguugcuguuagaaaauuuguggcuggugaaaacagcacuccuuuggcuggagcacaugu

SEQ ID NO: 263446 - RNA, 64 nt, Human
auguuacaucugucuuucaucucccagauccuggaaacagcaguguauauuuuuggugguggug

SEQ ID NO: 263447 - RNA, 64 nt, Human
uccccaccuccccacccuggaaccccugagggccaaacagcagaguggagcugagcuguggacc

SEQ ID NO: 263448 - RNA, 64 nt, Human
cugcccgugaggcccggugcaggaccgauguacaaaacagcagcaagugccucucuucucagag

SEQ ID NO: 263449 - RNA, 64 nt, Human
uucuuguuaaaaauguuuauaugauaaugucuguaaacagcaucacuuugauuacaauagaugu

SEQ ID NO: 263450 - RNA, 64 nt, Human
uacauacauucgauacauucagcagggacucgugaaacagcaggauggugaguguucuugauuc

SEQ ID NO: 263451 - RNA, 64 nt, Human
ugcacaagaugcuggaggcuugguaaguuccucugggucgcagaucgguuucucgggucgggau

SEQ ID NO: 263452 - RNA, 64 nt, Human
aaccacauuccugcugcugcgggcgugggcucccgggucgcaagccgggagggucgagccgaag

SEQ ID NO: 263453 - RNA, 64 nt, Human
cuccccagacaccucuccacgucuccuacccagggggucgcaucccuagcccuucacugacccc

SEQ ID NO: 263454 - RNA, 64 nt, Human
uguauuuugugguaguugaaauuguaucacuucuaaacagcaaacuguuuuuguuuuuaauuag

SEQ ID NO: 263455 - RNA, 64 nt, Human
guuuccaggaauuuauuugauauuaaugggcguaaaacagcaucauuguacuuaagcuauggau

SEQ ID NO: 263456 - RNA, 64 nt, Human
ccuuuuuguccuguuuacagucuuaaaagagguaaaacagcaaauauuuuuuuaagggaacuau

SEQ ID NO: 263457 - RNA, 64 nt, Human
acaaaggcuguccugagguaggaaaaaaaaaaagaaacagcauuucuagaaaccuagucacuuc

SEQ ID NO: 263458 - RNA, 64 nt, Human
aauauuaaaacauacuaugaagccucugauacuuaaacagcauggcgcugguacguaaauagac

SEQ ID NO: 263459 - RNA, 64 nt, Human
agccauugccuuacucuugauuuucaacaguucuaaacagcaacagcauccaccuaauauaccu

SEQ ID NO: 263460 - RNA, 64 nt, Human
auauauaaaaaucuauaaaggcauauuuuuagaaaaacagcacaccacugcuucuuuugaaaau

SEQ ID NO: 263461 - RNA, 64 nt, Human
uaugguuucuaaaaucucagcugagaacuucagaaaacagcagcaguauuuuccuuuuccuagu

SEQ ID NO: 263462 - RNA, 64 nt, Human
cacuaaagauucauuuuuguugaguccuuaugagaaacagcaguaugaaucuugacgguuucug

SEQ ID NO: 263463 - RNA, 64 nt, Human
guacagaagaaaaggauauuuauauauuuucuuaaaacagcagauuugcugcuugugccauaaa

SEQ ID NO: 263464 - RNA, 64 nt, Human
gaagauucuuagagccagcuuuauuuuuauguugaaacagcaauuucccuuaauucaucgaagu

SEQ ID NO: 263465 - RNA, 64 nt, Human
ugcugaaggacuugcuuuuccaugaagaagacgaaaacagcaaacaagggcaagaaggucugag

SEQ ID NO: 263466 - RNA, 64 nt, Human
auuucaguguuagauucauagugauaagaacugcaaacagcaauuugauucuguacuuuuaauu

SEQ ID NO: 263467 - RNA, 64 nt, Human
guucauauuuaacuuuguguguggucugcaaaauaaacagcaggacagaaauuguguuguuuug

SEQ ID NO: 263468 - RNA, 64 nt, Human
ggaagggacuggaccucuuuccccucaucaaaggaaacagcagucuuugccucuuucuguuggu

SEQ ID NO: 263469 - RNA, 64 nt, Human
ugcgcggaggcggcaguguugauauggugaaaccgggucgcauuugcuuccgguuuacuggcug

SEQ ID NO: 263470 - RNA, 64 nt, Human
agaaaagagagcugccucagaugauggacgaggugggucgcauucucuguaaccugugcggugu

SEQ ID NO: 263471 - RNA, 64 nt, Human
uauuggucuguuccuuuggcuuucucuuggaggugggucgcagcaccagauggggagcuuuaug

SEQ ID NO: 263472 - RNA, 64 nt, Human
cugccagacgugccacugccccaccaccagcugaaaacagcagcacaucgcuggcuuuuccccu

SEQ ID NO: 263473 - RNA, 64 nt, Human
auucuuaauggccuuccucuguugcaaccucaauaaacagcacaaucucauggcuuggucucug

SEQ ID NO: 263474 - RNA, 64 nt, Human
cgacucuaaugggggaagcaggguggauaaguccaaacagcagaucucucuuuggagggcacug

SEQ ID NO: 263475 - RNA, 64 nt, Human
ccuggguccuguucuuccuacauaaaaugcaagaaaacagcauggccaguaaacugagcaaggg

SEQ ID NO: 263476 - RNA, 64 nt, Human
agugugagucugugugagcuaguuucugaugucuaaacagcaauuaccuauggagaauacauca

SEQ ID NO: 263477 - RNA, 64 nt, Human
cuaaagaauucuuguuauuuaauaucaaauaaugaaacagcagucacuucuaguucauuaccau

SEQ ID NO: 263478 - RNA, 64 nt, Human
gauauuuugacuauuuacaucuuuucacaguuauaaacagcacuucacugaaucccauguacau

SEQ ID NO: 263479 - RNA, 64 nt, Human
gaaacaucuuuucaggggagcggggggucuauaaaaacagcaauagaaauuaagcauaaagcau

SEQ ID NO: 263480 - RNA, 64 nt, Human
aaaugauguauuugugacacccuaucuugucaauaaacagcauucugauuaguuugucuuauuu

SEQ ID NO: 263481 - RNA, 64 nt, Human
acuaaaaaggaacguugcagaagcaaucgggauaaaacagcauuagauagucaugcugcuagau

SEQ ID NO: 263482 - RNA, 64 nt, Human
gaggaaauaggcugucacuaucacauuguccugaaaacagcaucugcuuuccucuuggccauga

SEQ ID NO: 263483 - RNA, 64 nt, Human
uucauaaacagguguauaaggaacaaugucuuauaaacagcaugggggcaaucugagaauauuc

SEQ ID NO: 263484 - RNA, 64 nt, Human
ucucuguggagcucugacugguguagcuggaaacaaacagcaacuugcaaacggacgaagagcc

SEQ ID NO: 263485 - RNA, 64 nt, Human
cuguggaguuuguucagugguacgguguccaagcaaacagcagaaugcaacuuucuaaacagcc

SEQ ID NO: 263486 - RNA, 64 nt, Human
acagcagaaugcaacuuucuaaacagccccaagcaaacagcagaauucaacuuuuuaaacaaua

SEQ ID NO: 263487 - RNA, 64 nt, Human
agccaugugaaacuucccuucuggaugugauucugggucgcaaguccuuauuuauaugugaggc

SEQ ID NO: 263488 - RNA, 64 nt, Human
caaacgucccacuucauuuguuccauuccugauucuuggguaauaaagacaaacuuuguaccuc

SEQ ID NO: 263489 - RNA, 61 nt, Human
ugcagccaaaagcagacuaaaauaguccagccuuggguauacuugcauuuaccuacaauua

SEQ ID NO: 263490 - RNA, 64 nt, Human
aauacauuauguaauuuaaaaaauauuccuuuuuaaacagcaacagaaaugcacuauaaaauau

SEQ ID NO: 263491 - RNA, 64 nt, Human
aaucuuuauuguuuuccaaacagcuaguuuaacaaaacagcaucauacauagugaaugauguuc

SEQ ID NO: 263492 - RNA, 64 nt, Human
gcaugagacaucuuucugaaaaugguaacuucugaaacagcaaagcuuccuguguuucacucug

SEQ ID NO: 263493 - RNA, 64 nt, Human
auuaccaaaugccuuucuagcaauugcuucucuaaaacagcacuaucgagguauuugguaacuu

SEQ ID NO: 263494 - RNA, 64 nt, Human
aaguugaaagcaagagucccugaguauaaaggaaaaacagcaaaacaaaaagcaaacaaaaaaa

SEQ ID NO: 263495 - RNA, 64 nt, Human
aaauuguaugaucguaacauuauuuauuaccacaaaacagcaaaaucuucaaugucuaagaaaa

SEQ ID NO: 263496 - RNA, 64 nt, Human
aucauaaagggagcaccauuguacagucuagcauaaacagcaaauuuuaaagaggacauauuua

SEQ ID NO: 263497 - RNA, 64 nt, Human
acucuggccucaaucauauuccucugggauuucuaaacagcaguuaagcuacaaaaagcaaaca

SEQ ID NO: 263498 - RNA, 64 nt, Human
acgugauuuuuccaugcagcaucuggugugaauaaaacagcaguugacugauguuuaccgcugu

SEQ ID NO: 263499 - RNA, 64 nt, Human
uuuguugcuguuuucccagaugcuuauccccaagaaacagcaagcucaggucuguggguucccu

SEQ ID NO: 263500 - RNA, 64 nt, Human
gacacugccauucaugcauugucagauauuuauuaaacagcagcaaagugccagccaauuuguc

SEQ ID NO: 263501 - RNA, 64 nt, Human
uucaaugaaguacaauaaugugaacugcauguguaaacagcaucacauuauuaccaccucucua

SEQ ID NO: 263502 - RNA, 64 nt, Human
aguuaggacgcccaugaagauuuaggggugaaaaaaacagcagaguauuuauuaaacuacagca

SEQ ID NO: 263503 - RNA, 64 nt, Human
guguaacagauaccagugguguguugcaugcucaaaacagcagcgucgucauugaagucugcuu

SEQ ID NO: 263504 - RNA, 64 nt, Human
agccaagcacuuugugaauucugguuuguuuguaaaacagcauuauuauaauguagguaugguc

SEQ ID NO: 263505 - RNA, 64 nt, Human
gcugcuuugccguccguccacugggaaccgaguagggucgcaagauguauccuuggaguccucu

SEQ ID NO: 263506 - RNA, 64 nt, Human
cugcugucugcucuggagggcggcgcucaccucugggucgcaguccccacgaucagccagcagc

SEQ ID NO: 263507 - RNA, 64 nt, Human
uagugccguugguuucacaugauugcacuuuugugggucgcaaggugauacauacguguauuac

SEQ ID NO: 263508 - RNA, 64 nt, Human
augcuacaguacuauguaaauuuaaagaagucauaaacagcauuuauuaccuugguauaucaua

SEQ ID NO: 263509 - RNA, 64 nt, Human
gcugccaaagacaaaucagacugucagucauuaaaaacagcauuagcaggaugaggauagcaau

SEQ ID NO: 263510 - RNA, 64 nt, Human
ccaaagauuauauaauguucauaauccaccaugaaaacagcauuggccaaagguacugaggcug

SEQ ID NO: 263511 - RNA, 63 nt, Human
gauguauuucuccauugaaaacacaauaaaaaaaaaacagcacaaucucacaguugccugauu

SEQ ID NO: 263512 - RNA, 64 nt, Human
cuucuguccucaagaacaaguccuaggucaagggaaacagcacagccuguuuauaauuaggaaa

SEQ ID NO: 263513 - RNA, 64 nt, Human
ucccaacaggcccuggcagcgucuggacuuguguaaacagcagcagucacguuccucggccgcc

SEQ ID NO: 263514 - RNA, 64 nt, Human
acaaagaaaaacagauacuaaaagucucuucugaaaacagcaauccagguaagacuuauaacag

SEQ ID NO: 263515 - RNA, 64 nt, Human
ccucacaccacuguuacuugguguacaugagcaaaaacagcaaguggugaaauucuuaaucaag

SEQ ID NO: 263516 - RNA, 64 nt, Human
ucauuuggacuuggugguucguccugucucagugaaacagcagccuuucuuguuuacccauacc

SEQ ID NO: 263517 - RNA, 64 nt, Human
cuacauuguggaaaacaauugaauuuauugggaaaaacagcagucuuagauuuugcuccuugca

SEQ ID NO: 263518 - RNA, 64 nt, Human
acagccaacauuuugugaaacaaugacuggaacaaaacagcagccauacuuaccuuugagguuu

SEQ ID NO: 263519 - RNA, 64 nt, Human
uucaagccacuggagggagaaauggaaaacaugaaaacagcaaucuucuuaugcuucugaauaa

SEQ ID NO: 263520 - RNA, 64 nt, Human
aucaaaccuuuccuccugacuuaccaaaccaggaaaacagcaggagaggguggcucaggacuua

SEQ ID NO: 263521 - RNA, 64 nt, Human
gagagugaaugcugccaagaguuccucagauuacaaacagcaguggugccauuuccuuccccau

SEQ ID NO: 263522 - RNA, 64 nt, Human
ugaaguucagagucacccguggcuccuaaggaaaaaacagcaucaugaaaggcaaaaaguauuu

SEQ ID NO: 263523 - RNA, 64 nt, Human
cagccugccuggcuggcccccuucccucugucuggggucgcauuccgcacaagccuuucaucaa

SEQ ID NO: 263524 - RNA, 64 nt, Human
cggcacagucagagucgggggccugcccuggccggggucgcagucggcagcagcgugcaguccg

SEQ ID NO: 263525 - RNA, 64 nt, Human
gggccggggaggaggauuaggcuggacugaucgcgggucgcaggugaccccgggaccagauguc

SEQ ID NO: 263526 - RNA, 64 nt, Human
cagucuguucuuuuguaaacauuuuuaguuggaaaaacagcaucugcauuuuccccauccucua

SEQ ID NO: 263527 - RNA, 64 nt, Human
cagugacucagggaacuuaugccccuucuguaggaaacagcagagaccagguggaaaccuuuuc

SEQ ID NO: 263528 - RNA, 64 nt, Human
cucuccagcccaucaucuucguuucggacagagcaaacagcaacaaggagcuggguguggacca

SEQ ID NO: 263529 - RNA, 64 nt, Human
ccugaaagccagggucgguucaugaaaagcuaugaaacagcaugcuaaaugugaaaugucaacc

SEQ ID NO: 263530 - RNA, 64 nt, Human
aaagagaaaaaaagguaauuauuguagaaccugaaaacagcaauguauggaaacccucaaagca

SEQ ID NO: 263531 - RNA, 64 nt, Human
caaaggccagccagcuugggagcagcagagaaauaaacagcauuucugaugccccuccgugucu

SEQ ID NO: 263532 - RNA, 64 nt, Human
cacuucugccuccucccguuuccccuccacauccaaacagcacccugguccucucuaucccccc

SEQ ID NO: 263533 - RNA, 64 nt, Human
uccgaaugccuuuuauuugggggaacacaaaaccaaacagcagauguuuuggacuugaucugug

SEQ ID NO: 263534 - RNA, 64 nt, Human
uguuuuaaguggggaaaaagguggauuauuuaauaaacagcacuuuuagacaacuagcuaucaa

SEQ ID NO: 263535 - RNA, 64 nt, Human
gugaggucugcucagaccuuguaggcuucuaucaaaacagcacccugcuugcucaccaggccua

SEQ ID NO: 263536 - RNA, 64 nt, Human
ggcccaggccccaaggucuccuucuuggggucacaaacagcaguaaggaagaggaauauauagc

SEQ ID NO: 263537 - RNA, 64 nt, Human
ccucucagccgucucaggacuacuguuggauugcaaacagcaucucugacccagucuucggacu

SEQ ID NO: 263538 - RNA, 64 nt, Human
caguugcuguaacgugauguaaaaacguuacuguaaacagcaugaggauaugaaguccuuccac

SEQ ID NO: 263539 - RNA, 64 nt, Human
gaagaagacucuguggacaagauaccaguccccaaaacagcauuuucaguuccuucuucaauua

SEQ ID NO: 263540 - RNA, 64 nt, Human
cauggccuuacccagucuaagcuggcaggaucuaaaacagcagcgaccucggccccuauccaga

SEQ ID NO: 263541 - RNA, 64 nt, Human
uguucccuuugccugguccacccuugcccucccugggucgcagacgaggucggccucgucauuc

SEQ ID NO: 263542 - RNA, 64 nt, Human
gcgaggucagaaaucacaagccugggcauggccugggucgcacccccuccccacggccccaccc

SEQ ID NO: 263543 - RNA, 50 nt, Human
ccagcaagaggaagagaugagggucgcaggggcccccggccgcccaccgc

SEQ ID NO: 263544 - RNA, 64 nt, Human
ugcucccggcccacccucuaggaggcucuggcucaaacagcaauagggucuuccucacugaccu

SEQ ID NO: 263545 - RNA, 64 nt, Human
gcccuccccugccccaggaacccuggccucaccaaaacagcagcagcucguuggcuccaaaacc

SEQ ID NO: 263546 - RNA, 64 nt, Human
guuugucuaagcugccuggguauccacgggacaaaaacagcaaacucccucagacuuuguccau

SEQ ID NO: 263547 - RNA, 64 nt, Human
aggucugggcaaggcgcugccgucggcugucaauaaacagcaggaaacagaggugccuggcuca

SEQ ID NO: 263548 - RNA, 64 nt, Human
gaagcuuuaacugaagugucagguuccucgugagaaacagcacacguuagaggcuuugagagaa

SEQ ID NO: 263549 - RNA, 64 nt, Human
ccacagaccccuaugccuuguuccgagcacgaagaaacagcagcagggaugucuaccagccacc

SEQ ID NO: 263550 - RNA, 64 nt, Human
cucugugcuuggcccugggccccuggccauccacaaacagcagaggccuucccuggaggaggcu

SEQ ID NO: 263551 - RNA, 64 nt, Human
caagaaaaaguggaaccagcugucccuccagcaaaaacagcagcccuaauagcagcccacggac

SEQ ID NO: 263552 - RNA, 64 nt, Human
uuacuucuagagggagaagacugugcggcacaggaaacagcaaacaguggggugaucugcagcc

SEQ ID NO: 263553 - RNA, 64 nt, Human
ugcucuaacauggcaugcccuuucucagcccaggaaacagcaugugguucagagaaaagagcga

SEQ ID NO: 263554 - RNA, 64 nt, Human
uauucagaauuacauuuuaucguuuucacauugaaaacagcaaauguugacuuaguaauuuuua

SEQ ID NO: 263555 - RNA, 64 nt, Human
guuuagcauuugugccgccuccuuuugcuacucaaaacagcaaugcuuggcggcagccuuccau

SEQ ID NO: 263556 - RNA, 64 nt, Human
gggggaaaugggagaaaauaaugugacauuucaaaaacagcaccaaagcagucagcauuggaag

SEQ ID NO: 263557 - RNA, 64 nt, Human
aggcauuuuauguuagucacagucuugaauguauaaacagcacuaagacucucaggucagguac

SEQ ID NO: 263558 - RNA, 64 nt, Human
gaaacuaaaaaauucagaguuaauucacuauuaaaaacagcaaggcccugcuauuucccaagaa

SEQ ID NO: 263559 - RNA, 64 nt, Human
ucagggaugcuugcucuccacuuuucaagugggucuuggguacgagaauucccucaucuuucuc

SEQ ID NO: 263560 - RNA, 64 nt, Human
cuugcacaccaccccugaagcacauggcaguaggaaacagcauaggauuguaugugggaggugg

SEQ ID NO: 263561 - RNA, 64 nt, Human
accauauuuuauuauaaaauaguuucagucaucuaaacagcagugaugcuuaauuauuuuuuuu

SEQ ID NO: 263562 - RNA, 64 nt, Human
cacgugggagacaagaaaucccuguuuaauauuuaaacagcaguguuccccaucuggguccuug

SEQ ID NO: 263563 - RNA, 64 nt, Human
ggcugccucuaagacuaggaauaggaauaucugaaaacagcauuucuaagggugguaaccacag

SEQ ID NO: 263564 - RNA, 64 nt, Human
auaaauauacaauaaaaguaaacacauacacacaaaacagcaaacuucagguaacuauuuugga

SEQ ID NO: 263565 - RNA, 64 nt, Human
uccccuggagggggaauggcagcagggguuggggaaacagcaucuccaagcagcuuagaguugg

SEQ ID NO: 263566 - RNA, 64 nt, Human
auugcuauguuuuuaacaaauuguggcaaauucuaaacagcaauucuuuuguacguaauaggac

SEQ ID NO: 263567 - RNA, 64 nt, Human
augagcuucauugggaguuccuagcaaguugacuaaacagcaaaaguucuuucucguggguaaa

SEQ ID NO: 263568 - RNA, 64 nt, Human
gggauuccaugcucaauggaugaauguagacacaaaacagcaacacuuguaugaagauguaaag

SEQ ID NO: 263569 - RNA, 64 nt, Human
uucccuugguuggauucuucaacacagccaaugaaaacagcacuauauuucugaucugucacug

SEQ ID NO: 263570 - RNA, 64 nt, Human
cuggaccaccucccgcugcguuuccuacucagagaaacagcaagggcggggucaagacacggga

SEQ ID NO: 263571 - RNA, 64 nt, Human
augcaaggguucucuucugugucuuguaaccaugaaacagcagaagaacuaacauaacuaacuc

SEQ ID NO: 263572 - RNA, 64 nt, Human
ggggaagagacugcauuguggccccagacuuuuaaaacagcacuaaauaacuugggggaaacgg

SEQ ID NO: 263573 - RNA, 64 nt, Human
accaaucauaaguagaacccacuucaaaauaaaaaaacagcauuacuauuucuaaucccaagga

SEQ ID NO: 263574 - RNA, 64 nt, Human
cuuucuuacugcuacuuucauguugcuuucuagaaaacagcauuucauuccaaaauaacuagga

SEQ ID NO: 263575 - RNA, 64 nt, Human
uauuucacuaucuuuauacuauauaauaugguaacuuggguaccgggggaacuuuaaaauuuca

SEQ ID NO: 263576 - RNA, 64 nt, Human
aagagggcuuucacaguccacaggguucaaaugacuuggguaacagaaguuauucuuagcuuac

SEQ ID NO: 263577 - RNA, 64 nt, Human
gauugcguagauguugccuggugcaaagugccccaaacagcaauagaaaggcauauguauaacc

SEQ ID NO: 263578 - RNA, 64 nt, Human
guuaaauuguaaauguguuuucuuuauguuaccaaaacagcaauuugaaauuagaacuaguggu

SEQ ID NO: 263579 - RNA, 64 nt, Human
ccacccagagccuugugggagacccaguagaaagaaacagcauccugggaaauccagcuaccau

SEQ ID NO: 263580 - RNA, 64 nt, Human
uuacauguguggacaaagcuaauagugguuuuuuaaacagcaccuugccugaacaugacuuuaa

SEQ ID NO: 263581 - RNA, 64 nt, Human
uacuuuaaaaaaauucaaaugaagagaaaaagaaaaacagcauucuagaaauggcauuucuccu

SEQ ID NO: 263582 - RNA, 64 nt, Human
agacgcuucggaccccgggaaaggccauacgaagaaacagcagugguuggcuucuaugggacaa

SEQ ID NO: 263583 - RNA, 64 nt, Human
uuucgacugguccagcucugacaucccuuccuggaaacagcaugaauaaaacacucaucccaug

SEQ ID NO: 263584 - RNA, 64 nt, Human
aaggccuggccagcagguagccuguguguuugacaaacagcagcuggcagcgcugccuccugcc

SEQ ID NO: 263585 - RNA, 64 nt, Human
agucauguaauuagucaucuggaacaaagacuaaaaacagcagagaauugcggguucuacccag

SEQ ID NO: 263586 - RNA, 64 nt, Human
cuuuccugaguuugaucauccauuuagccuugacaaacagcagacccuacagagauguguugga

SEQ ID NO: 263587 - RNA, 64 nt, Human
uuuccgggaacuuugcagcauaccaauuacccauaaacagcacaccuguguccaagaacucuaa

SEQ ID NO: 263588 - RNA, 64 nt, Human
aauaaauuaacuuuguacacauuuuuauauaaaaaaacagcaagugauuucagaauguuguagg

SEQ ID NO: 263589 - RNA, 64 nt, Human
uucacaaauauuuggguuuuccuuuuucacucacaaacagcagggaggucauguacuuuuugua

SEQ ID NO: 263590 - RNA, 64 nt, Human
cuuuuuuccauucccauuuuuguccucauaaucaaaacagcauaacaugacaucaucaccagua

SEQ ID NO: 263591 - RNA, 64 nt, Human
auggacuguuuacuauccaaaaguucaagagagaaaacagcacuugaggucucaucaauuaaag

SEQ ID NO: 263592 - RNA, 64 nt, Human
aacgguaggggagcaugauggggccuuugaggcagggucgcagggacaagcucagcuuuaggca

SEQ ID NO: 263593 - RNA, 64 nt, Human
uuaugacccauucacuagccccagggauugaagucuuggguacucaaagugucuuucuaccagg

SEQ ID NO: 263594 - RNA, 64 nt, Human
uuaagauuuauuuuuuaaaaauuauuuuuguggacuuggguaucaaugauggcaccuacuuuug

SEQ ID NO: 263595 - RNA, 64 nt, Human
aaaugauagaaucuuuacucagggaugggcaauaaaacagcaaagagcuuugugauuggguuug

SEQ ID NO: 263596 - RNA, 64 nt, Human
augaugcauaaagcgcuaggcccuagaacuccagaaacagcacagcuggggcggggacccagcc

SEQ ID NO: 263597 - RNA, 64 nt, Human
cgggagcagguucuuggccagcguagacagcagcaaacagcagcagggaagccauucucacugc

SEQ ID NO: 263598 - RNA, 64 nt, Human
cuauauucagagauauucaagucccugauauuaaaaacagcauauuugcauauaaucuaggcac

SEQ ID NO: 263599 - RNA, 64 nt, Human
cccugcucacauuuuccccuacacuuugucauuaaaacagcacgaaaacucacaugauuugguu

SEQ ID NO: 263600 - RNA, 64 nt, Human
cccuccucaccccuuccccuacacuugaucauuaaaacagcaccaaacuucacaugauugguuc

SEQ ID NO: 263601 - RNA, 64 nt, Human
cauccagccaucacaugcagauaauuccuuucaaaaacagcagaaagaggcucguucuugucuu

SEQ ID NO: 263602 - RNA, 64 nt, Human
aacuuuaaaccauacuacaaggcuacagcaacuaaaacagcaugguacugguauaaaaaaagac

SEQ ID NO: 263603 - RNA, 64 nt, Human
cuucagugauugugggaggggcaagaaggaaaagaaacagcagcagguuugauauucagaaaga

SEQ ID NO: 263604 - RNA, 64 nt, Human
gggugcugcugcugugacagccugcaguguuuugaaacagcauggauugggugucuuguuugca

SEQ ID NO: 263605 - RNA, 64 nt, Human
accaacucaguauaccacuggaggcucugugagcaaacagcaaacuguucucaugaaagcagga

SEQ ID NO: 263606 - RNA, 64 nt, Human
auucaaacgagauucacccagcgcgaggaggaagaaacagcaguuccugggaaccacaauuaug

SEQ ID NO: 263607 - RNA, 64 nt, Human
ccucauguccagacgcugcccaguccuguccugaaaacagcacgccccaggcccacagaacccc

SEQ ID NO: 263608 - RNA, 64 nt, Human
caacuucagaaagcagccaucccgcgugucguccaaacagcagugccugcgucccgcuccacgg

SEQ ID NO: 263609 - RNA, 64 nt, Human
acuguucgucugcugucugugucuucuauuuggcaaacagcaaugaucuuccaauaaaagauuu

SEQ ID NO: 263610 - RNA, 64 nt, Human
gugauaacuguuuuuaaacuugccuaauaccuuucuuggguauuguuuguaaugugacuuauuu

SEQ ID NO: 263611 - RNA, 64 nt, Human
ugcagugagcuaugaugaugccacuguacugcagcuuggguaacagauugagaaccugucucau

SEQ ID NO: 263612 - RNA, 64 nt, Human
cauaugagaaccuuuguauaaaauauuggcauguaaacagcacagacaccguaacacacucugu

SEQ ID NO: 263613 - RNA, 64 nt, Human
caguucucacucauguccccaacucaaggcuagaaaacagcaagauggagaaauaauguucugc

SEQ ID NO: 263614 - RNA, 64 nt, Human
ugucucaaaaaagaaagaaugauguccugacaugaaacagcaggcuacaaaaccacugcaugcu

SEQ ID NO: 263615 - RNA, 64 nt, Human
ccuuuguuauuuuucuugcuaucagaguagcaagaaacagcaccccuguaggugacaggugggc

SEQ ID NO: 263616 - RNA, 64 nt, Human
cagagcucagaggucacacuguaucaaagaucucaaacagcaaagucagcauuugcuguauaga

SEQ ID NO: 263617 - RNA, 64 nt, Human
augaaggagggagggagcacauuccuggcagagaaaacagcacgugcaaaggccccgagacugg

SEQ ID NO: 263618 - RNA, 64 nt, Human
caaaguaaagccagcuucuccucucccagggcggaaacagcauuugccuucugagagaagagac

SEQ ID NO: 263619 - RNA, 64 nt, Human
uuuuuaaacuaucaauggcauuucaagucuucugaaacagcauggcuguaugugcgugguccau

SEQ ID NO: 263620 - RNA, 64 nt, Human
aaaaguucccucucacuuucaguaaaaauaaauaaaacagcagcagcaaacaaauaaaaugaaa

SEQ ID NO: 263621 - RNA, 64 nt, Human
ccuccauaaauaugaucuaugauuuugcuucauaaaacagcaaaucaauguuuuauguaaaaua

SEQ ID NO: 263622 - RNA, 64 nt, Human
gcuccauggggcccaggugcaaaggguuucugaaaaacagcaggauuaaguacugaaagagccc

SEQ ID NO: 263623 - RNA, 64 nt, Human
uugguuacuuguauucacgguuaauuuacaacccaaacagcaaaacacaguugguggacaaguu

SEQ ID NO: 263624 - RNA, 64 nt, Human
ucaccaugaagccugggauugggccacgaggaacaaacagcagaugcccuugccuuccagucca

SEQ ID NO: 263625 - RNA, 64 nt, Human
aacuugggccagcgggguuugggguaucucuagaaaacagcaacugaacagagcuccacacauc

SEQ ID NO: 263626 - RNA, 64 nt, Human
guuugguuacaggacuucugugcauuguaaacauaaacagcauggaaaagguuaaauaccugug

SEQ ID NO: 263627 - RNA, 64 nt, Human
auaucggaagcaguacagcgcgcggcucuacacgcuuggguagcgggauaagucacuguuuucu

SEQ ID NO: 263628 - RNA, 64 nt, Human
ggccuggggagcugagugacaucccaagcuugggcuuggguagugagugacaugugcacacguc

SEQ ID NO: 263629 - RNA, 64 nt, Human
aaugugcucuaccccauuggcucagagcuagggcaaacagcagauauucagacuuuauuacuua

SEQ ID NO: 263630 - RNA, 64 nt, Human
gucgcccaugagagcgcagcccgcggcaaucaauaaacagcaggugauacaagcaacccgccgu

SEQ ID NO: 263631 - RNA, 64 nt, Human
uuggagguucuaaucauuucagcaguagcgucuuaaacagcaguauuacuauaagcaguugcuu

SEQ ID NO: 263632 - RNA, 64 nt, Human
ccacaggaagccgccuagugcagagagguugugaaaacagcagcaaugcaauguggaaauugua

SEQ ID NO: 263633 - RNA, 64 nt, Human
cuuugggggugaguuccccuuuguccucucguggaaacagcacacagcaagcaaccacaaaacc

SEQ ID NO: 263634 - RNA, 64 nt, Human
auacguagagucugaacaggugcucugcugcuagaaacagcaaaccaucuagauuaaacuccua

SEQ ID NO: 263635 - RNA, 64 nt, Human
aaaccagaguuagaacuguuggauacaggagaagaaacagcagcuccacuaccgaccccccccc

SEQ ID NO: 263636 - RNA, 64 nt, Human
uagcuuccuguugugugcggggugugguggaauuaaacagcauucauugugugucccugugccu

SEQ ID NO: 263637 - RNA, 64 nt, Human
ugaaacuucagcgauuccauugugauaagcgcacaaacagcacugucugucgguaaucgguacu

SEQ ID NO: 263638 - RNA, 64 nt, Human
ccugcuuccccacccaagccagucuacauugcccaaacagcaaggguuggagaguggcuuaagu

SEQ ID NO: 263639 - RNA, 64 nt, Human
cgcagaugaguccucgguaaaccgaggacccaugaaacagcagcugaagccagcucccugaauc

SEQ ID NO: 263640 - RNA, 64 nt, Human
cauucugaucuucuucugauucuuuuguuucaauaaacagcaaugagcaugaacacugcauuug

SEQ ID NO: 263641 - RNA, 64 nt, Human
gcugcugcaaugaggaaaugggcaucuggaagacaaacagcaacucucagcuugcuucaagaac

SEQ ID NO: 263642 - RNA, 64 nt, Human
uuaagaugcuucuugacaugcugcauaacuacauaaacagcagagguguuuaagagcccagaaa

SEQ ID NO: 263643 - RNA, 64 nt, Human
gacaaggccauuaugcacagguugaauucugaguaaacagcagauaacuugccaaguucaguuu

SEQ ID NO: 263644 - RNA, 64 nt, Human
gccuggggcuggaggccugggaucccuccuuugugggucgcacacauguuuccugcugugagcu

SEQ ID NO: 263645 - RNA, 64 nt, Human
gugaucaugaaccaaaggaauuuauguuuuguaacuuggguacuuuauuuugcauuuuguuaua

SEQ ID NO: 263646 - RNA, 64 nt, Human
uaagcacggcugcucacuggcccccacuuuguuucuuggguaauucacaggggaauucccagua

SEQ ID NO: 263647 - RNA, 64 nt, Human
gauuauuaaagccagccaugcagguccaugauagaaacagcaggugaugacucugcacucucau

SEQ ID NO: 263648 - RNA, 64 nt, Human
uaguagaaacuuuaguuuugaugaugcacaaaauaaacagcagugguucucaacuagggccauu

SEQ ID NO: 263649 - RNA, 64 nt, Human
uuggaaacaguaugcaugaagacaugaaggcaagaaacagcaaaacaaauacugaagcaugaag

SEQ ID NO: 263650 - RNA, 64 nt, Human
cuugauaaaaacauuuucaacauacauugagccuaaacagcaguuaaguugucucuaaaugaac

SEQ ID NO: 263651 - RNA, 64 nt, Human
uugagcaagcaaugguagauucaggcuccuacagaaacagcauugaucauacugugguucuucg

SEQ ID NO: 263652 - RNA, 64 nt, Human
ugaaauucagggccgcucagcagaggaggcuuacaaacagcaaaucaaagaagauaauauugga

SEQ ID NO: 263653 - RNA, 64 nt, Human
ccgccucggccucccaacgugcccccaguuuuauaaacagcagauagcaacuugucgucacagc

SEQ ID NO: 263654 - RNA, 64 nt, Human
agcucaaagucacaagaagaaaaaugaaaggaaaaaacagcagcccuauucagaaauugguuug

SEQ ID NO: 263655 - RNA, 64 nt, Human
aggccacagugcucaacccggacacccucacgaagggucgcaagucacucuuguggcucagauu

SEQ ID NO: 263656 - RNA, 64 nt, Human
aacaccauucguugcugguauuuaguuuucugaagggucgcaguugccuugagcacuugguauu

SEQ ID NO: 263657 - RNA, 64 nt, Human
gacuucccuucuaaguagacagcaaaaauggcgggggucgcaggaaucugcacucaacugccca

SEQ ID NO: 263658 - RNA, 64 nt, Human
gggagggucuggaggucuuugcugcacaguuccugggucgcacauccacguucauuuaacugaa

SEQ ID NO: 263659 - RNA, 64 nt, Human
cugugccucugggagccacugggccaggggccccgggucgcagagagcacguucccguuauuua

SEQ ID NO: 263660 - RNA, 64 nt, Human
ugaguguaugauguagguaaaaauauauaccuucgggucgcaguucaccauuuauaugugguau

SEQ ID NO: 263661 - RNA, 64 nt, Human
ggccgugugucacccugaccacgucuaucucugggggucgcacguugcgggcagagcgcaaggc

SEQ ID NO: 263662 - RNA, 64 nt, Human; identical to SEQ ID NO: 185722

SEQ ID NO: 263663 - RNA, 64 nt, Human
auucuugaagccacacauggcuggcggaacccagagcccccaccccagcccaccuggcucuuug

SEQ ID NO: 263664 - RNA, 64 nt, Human
ucuuaagggcuccuugauggaugccaucucuccuagcccccagcccuggugccacuggugggca

SEQ ID NO: 263665 - RNA, 64 nt, Human
aggggguggacaaacuggagucuggagugggcagagcccccaggaagcccaggagggcauccau

SEQ ID NO: 263666 - RNA, 64 nt, Human
agcuuaaauccuagcaggagagaggcucuggggcagcccccaugggcuccugccccuuucaggc

SEQ ID NO: 263667 - RNA, 64 nt, Human
gagguguagauaaucuagaggcauagacugcuagagcccccagggaucugggguggucagggcu

SEQ ID NO: 263668 - RNA, 64 nt, Human
gggguggucaggaugggcuggggggcccacuagcagcccccagcaucucccacccacccagcua

SEQ ID NO: 263669 - RNA, 64 nt, Human
acuuucugcuuuagcguaauugcucagaguagagagcccccacaaaguuauuuaaaagaugccc

SEQ ID NO: 263670 - RNA, 64 nt, Human
accaaggucugugggcucuaggcagcccggcagcagcccccagaggaacugcucccaccucucc

SEQ ID NO: 263671 - RNA, 64 nt, Human
augagcuacaagagucaaauaguccucugaauggagcccccaucacaaaacagugcccaggagg

SEQ ID NO: 263672 - RNA, 64 nt, Human
caugaaaaagaagaaaaacaauaaaguaaaccugagcccccacgucccaauuuuuuuaauagau

SEQ ID NO: 263673 - RNA, 64 nt, Human
ggcaaagugaagaugacaguccuugcucucagggagcccccacuuuaaugggagacugauaaac

SEQ ID NO: 263674 - RNA, 64 nt, Human
ggugucuacauguuugcuuagaggcggcuccaagagcccccagagcugccugcauagcacaccu

SEQ ID NO: 263675 - RNA, 64 nt, Human
uccuagcuuuuagcuauaaaccacucaaagauucagcccccagaucccacagucagaacugaau

SEQ ID NO: 263676 - RNA, 64 nt, Human
augcgauggcuacaagggcuacgaccuggucuacagcccccagagcggcuucaccugcgugucc

SEQ ID NO: 263677 - RNA, 63 nt, Human
uaaguguggcacauaaggaucugcagaauuuuccguagacaaagaaaggaucuuguguauuuu

SEQ ID NO: 263678 - RNA, 63 nt, Human
ccaucuaacuauucaggaauuguagucugagggcguagacaauuucauauaauaaauauccuu

SEQ ID NO: 263679 - RNA, 63 nt, Human
uauuuacauuaagaagaguuaaauuuauuuuaacguagacacuaaaaguaugugcaauauaca

SEQ ID NO: 263680 - RNA, 63 nt, Human
ucaaugaagguauuggcauuguuaaggacguagcguagacaacagcagucauaaauaauuagg

SEQ ID NO: 263681 - RNA, 64 nt, Human; identical to SEQ ID NO: 185723

SEQ ID NO: 263682 - RNA, 64 nt, Human; identical to SEQ ID NO: 185724

SEQ ID NO: 263683 - RNA, 64 nt, Human; identical to SEQ ID NO: 37374

SEQ ID NO: 263684 - RNA, 64 nt, Human; identical to SEQ ID NO: 102614

SEQ ID NO: 263685 - RNA, 64 nt, Human; identical to SEQ ID NO: 129994

SEQ ID NO: 263686 - RNA, 64 nt, Human; identical to SEQ ID NO: 179425

SEQ ID NO: 263687 - RNA, 64 nt, Human; identical to SEQ ID NO: 37392

SEQ ID NO: 263688 - RNA, 64 nt, Human; identical to SEQ ID NO: 102718

SEQ ID NO: 263689 - RNA, 64 nt, Human; identical to SEQ ID NO: 130011

SEQ ID NO: 263690 - RNA, 64 nt, Human; identical to SEQ ID NO: 179461

SEQ ID NO: 263691 - RNA, 64 nt, Human; identical to SEQ ID NO: 37427

SEQ ID NO: 263692 - RNA, 64 nt, Human; identical to SEQ ID NO: 102771

SEQ ID NO: 263693 - RNA, 64 nt, Human; identical to SEQ ID NO: 131732

SEQ ID NO: 263694 - RNA, 64 nt, Human; identical to SEQ ID NO: 179515

SEQ ID NO: 263695 - RNA, 64 nt, Human; identical to SEQ ID NO: 38526

SEQ ID NO: 263696 - RNA, 64 nt, Human
ggccccaccugucucacaagaacuucacucaaccccgugccaggacucagcaguggccuggaca

SEQ ID NO: 263697 - RNA, 64 nt, Human
aguucugugauccuggacaaguaacugaaucucuccgugccacaguuucuucuuguagaaaacg

SEQ ID NO: 263698 - RNA, 64 nt, Human
cccugggagggggcaaacuggggguugccacaggccgugccauucugccucuuaccuggaagau

SEQ ID NO: 263699 - RNA, 64 nt, Human; identical to SEQ ID NO: 102860

SEQ ID NO: 263700 - RNA, 64 nt, Human; identical to SEQ ID NO: 132317

SEQ ID NO: 263701 - RNA, 64 nt, Human; identical to SEQ ID NO: 179676

SEQ ID NO: 263702 - RNA, 64 nt, Human; identical to SEQ ID NO: 38543

SEQ ID NO: 263703 - RNA, 64 nt, Human; identical to SEQ ID NO: 102949

SEQ ID NO: 263704 - RNA, 64 nt, Human; identical to SEQ ID NO: 132351

SEQ ID NO: 263705 - RNA, 64 nt, Human; identical to SEQ ID NO: 179892

SEQ ID NO: 263706 - RNA, 64 nt, Human; identical to SEQ ID NO: 38560

SEQ ID NO: 263707 - RNA, 64 nt, Human; identical to SEQ ID NO: 103144

SEQ ID NO: 263708 - RNA, 64 nt, Human; identical to SEQ ID NO: 132368

SEQ ID NO: 263709 - RNA, 62 nt, Human; identical to SEQ ID NO: 185402

SEQ ID NO: 263710 - RNA, 64 nt, Human; identical to SEQ ID NO: 185403

SEQ ID NO: 263711 - RNA, 64 nt, Human; identical to SEQ ID NO: 185404

SEQ ID NO: 263712 - RNA, 64 nt, Human; identical to SEQ ID NO: 38577

SEQ ID NO: 263713 - RNA, 64 nt, Human; identical to SEQ ID NO: 102399

SEQ ID NO: 263714 - RNA, 64 nt, Human; identical to SEQ ID NO: 107937

SEQ ID NO: 263715 - RNA, 64 nt, Human; identical to SEQ ID NO: 107974

SEQ ID NO: 263716 - RNA, 64 nt, Human; identical to SEQ ID NO: 107975

SEQ ID NO: 263717 - RNA, 64 nt, Human; identical to SEQ ID NO: 107976

SEQ ID NO: 263718 - RNA, 64 nt, Human; identical to SEQ ID NO: 132453

SEQ ID NO: 263719 - RNA, 64 nt, Human; identical to SEQ ID NO: 185649

SEQ ID NO: 263720 - RNA, 64 nt, Human; identical to SEQ ID NO: 185650

SEQ ID NO: 263721 - RNA, 64 nt, Human; identical to SEQ ID NO: 185651

SEQ ID NO: 263722 - RNA, 64 nt, Human; identical to SEQ ID NO: 38594

SEQ ID NO: 263723 - RNA, 64 nt, Human; identical to SEQ ID NO: 102435

SEQ ID NO: 263724 - RNA, 64 nt, Human; identical to SEQ ID NO: 132555

SEQ ID NO: 263725 - RNA, 64 nt, Human; identical to SEQ ID NO: 185703

SEQ ID NO: 263726 - RNA, 64 nt, Human; identical to SEQ ID NO: 185704

SEQ ID NO: 263727 - RNA, 64 nt, Human; identical to SEQ ID NO: 185705

SEQ ID NO: 263728 - RNA, 64 nt, Human; identical to SEQ ID NO: 38627

SEQ ID NO: 263729 - RNA, 64 nt, Human; identical to SEQ ID NO: 102471

SEQ ID NO: 263730 - RNA, 64 nt, Human; identical to SEQ ID NO: 132572

SEQ ID NO: 263731 - RNA, 64 nt, Human; identical to SEQ ID NO: 179239

SEQ ID NO: 263732 - RNA, 64 nt, Human; identical to SEQ ID NO: 38660

SEQ ID NO: 263733 - RNA, 64 nt, Human; identical to SEQ ID NO: 107977

SEQ ID NO: 263734 - RNA, 64 nt, Human; identical to SEQ ID NO: 107978

SEQ ID NO: 263735 - RNA, 64 nt, Human; identical to SEQ ID NO: 107979

SEQ ID NO: 263736 - RNA, 64 nt, Human; identical to SEQ ID NO: 107980

SEQ ID NO: 263737 - RNA, 64 nt, Human; identical to SEQ ID NO: 102507

SEQ ID NO: 263738 - RNA, 64 nt, Human; identical to SEQ ID NO: 132589

SEQ ID NO: 263739 - RNA, 64 nt, Human; identical to SEQ ID NO: 179299

SEQ ID NO: 263740 - RNA, 64 nt, Human; identical to SEQ ID NO: 38677

SEQ ID NO: 263741 - RNA, 64 nt, Human; identical to SEQ ID NO: 102561

SEQ ID NO: 263742 - RNA, 64 nt, Human; identical to SEQ ID NO: 132606

SEQ ID NO: 263743 - RNA, 64 nt, Human; identical to SEQ ID NO: 179335

SEQ ID NO: 263744 - RNA, 64 nt, Human; identical to SEQ ID NO: 38694

SEQ ID NO: 263745 - RNA, 64 nt, Human; identical to SEQ ID NO: 102700

SEQ ID NO: 263746 - RNA, 64 nt, Human; identical to SEQ ID NO: 132623

SEQ ID NO: 263747 - RNA, 64 nt, Human; identical to SEQ ID NO: 179389

SEQ ID NO: 263748 - RNA, 64 nt, Human; identical to SEQ ID NO: 38711

SEQ ID NO: 263749 - RNA, 64 nt, Human; identical to SEQ ID NO: 102807

SEQ ID NO: 263750 - RNA, 64 nt, Human; identical to SEQ ID NO: 132759

SEQ ID NO: 263751 - RNA, 64 nt, Human; identical to SEQ ID NO: 179443

SEQ ID NO: 263752 - RNA, 64 nt, Human; identical to SEQ ID NO: 107981

SEQ ID NO: 263753 - RNA, 64 nt, Human; identical to SEQ ID NO: 107982

SEQ ID NO: 263754 - RNA, 64 nt, Human; identical to SEQ ID NO: 107983

SEQ ID NO: 263755 - RNA, 64 nt, Human; identical to SEQ ID NO: 107984

SEQ ID NO: 263756 - RNA, 64 nt, Human; identical to SEQ ID NO: 38728

SEQ ID NO: 263757 - RNA, 64 nt, Human; identical to SEQ ID NO: 103038

SEQ ID NO: 263758 - RNA, 64 nt, Human; identical to SEQ ID NO: 132793

SEQ ID NO: 263759 - RNA, 64 nt, Human; identical to SEQ ID NO: 179605

SEQ ID NO: 263760 - RNA, 64 nt, Human; identical to SEQ ID NO: 38745

SEQ ID NO: 263761 - RNA, 64 nt, Human; identical to SEQ ID NO: 102238

SEQ ID NO: 263762 - RNA, 64 nt, Human; identical to SEQ ID NO: 132827

SEQ ID NO: 263763 - RNA, 64 nt, Human; identical to SEQ ID NO: 185326

SEQ ID NO: 263764 - RNA, 64 nt, Human; identical to SEQ ID NO: 185327

SEQ ID NO: 263765 - RNA, 64 nt, Human; identical to SEQ ID NO: 185328

SEQ ID NO: 263766 - RNA, 64 nt, Human; identical to SEQ ID NO: 38762

SEQ ID NO: 263767 - RNA, 64 nt, Human; identical to SEQ ID NO: 102274

SEQ ID NO: 263768 - RNA, 64 nt, Human; identical to SEQ ID NO: 132844

SEQ ID NO: 263769 - RNA, 64 nt, Human; identical to SEQ ID NO: 185684

SEQ ID NO: 263770 - RNA, 64 nt, Human; identical to SEQ ID NO: 185685

SEQ ID NO: 263771 - RNA, 64 nt, Human; identical to SEQ ID NO: 107948

SEQ ID NO: 263772 - RNA, 64 nt, Human; identical to SEQ ID NO: 107985

SEQ ID NO: 263773 - RNA, 64 nt, Human; identical to SEQ ID NO: 107986

SEQ ID NO: 263774 - RNA, 64 nt, Human; identical to SEQ ID NO: 107987

SEQ ID NO: 263775 - RNA, 64 nt, Human; identical to SEQ ID NO: 185686

SEQ ID NO: 263776 - RNA, 64 nt, Human; identical to SEQ ID NO: 185687

SEQ ID NO: 263777 - RNA, 64 nt, Human; identical to SEQ ID NO: 38779

SEQ ID NO: 263778 - RNA, 64 nt, Human; identical to SEQ ID NO: 102310

SEQ ID NO: 263779 - RNA, 64 nt, Human; identical to SEQ ID NO: 132878

SEQ ID NO: 263780 - RNA, 64 nt, Human; identical to SEQ ID NO: 178833

SEQ ID NO: 263781 - RNA, 64 nt, Human; identical to SEQ ID NO: 41306

SEQ ID NO: 263782 - RNA, 64 nt, Human; identical to SEQ ID NO: 102363

SEQ ID NO: 263783 - RNA, 64 nt, Human; identical to SEQ ID NO: 132929

SEQ ID NO: 263784 - RNA, 64 nt, Human; identical to SEQ ID NO: 178901

SEQ ID NO: 263785 - RNA, 64 nt, Human; identical to SEQ ID NO: 41355

SEQ ID NO: 263786 - RNA, 64 nt, Human; identical to SEQ ID NO: 102417

SEQ ID NO: 263787 - RNA, 64 nt, Human; identical to SEQ ID NO: 132946

SEQ ID NO: 263788 - RNA, 64 nt, Human; identical to SEQ ID NO: 179096

SEQ ID NO: 263789 - RNA, 64 nt, Human; identical to SEQ ID NO: 41372

SEQ ID NO: 263790 - RNA, 63 nt, Human
gaauaagcagaaaauauaacugcagcuguaugucguagacacaagaauugaaacugugcaguc

SEQ ID NO: 263791 - RNA, 63 nt, Human
agcccaggcagacgggagcagguucuuggccagcguagacagcagcaaacagcagcagggaag

SEQ ID NO: 263792 - RNA, 64 nt, Human
cauguggacacacaaaggcaaacagaucugccaucgaucgcagauuucuguagaaacacggaug

SEQ ID NO: 263793 - RNA, 64 nt, Human
ucucguuuucacaggcggcaugcguuccugcggacgaucgcaucuugugucgcugaagcgccuc

SEQ ID NO: 263794 - RNA, 64 nt, Human; identical to SEQ ID NO: 102489

SEQ ID NO: 263795 - RNA, 64 nt, Human; identical to SEQ ID NO: 132980

SEQ ID NO: 263796 - RNA, 64 nt, Human; identical to SEQ ID NO: 179168

SEQ ID NO: 263797 - RNA, 56 nt, Human; identical to SEQ ID NO: 41389

SEQ ID NO: 263798 - RNA, 64 nt, Human; identical to SEQ ID NO: 102596

SEQ ID NO: 263799 - RNA, 64 nt, Human; identical to SEQ ID NO: 132997

SEQ ID NO: 263800 - RNA, 64 nt, Human; identical to SEQ ID NO: 179281

SEQ ID NO: 263801 - RNA, 64 nt, Human; identical to SEQ ID NO: 41422

SEQ ID NO: 263802 - RNA, 64 nt, Human; identical to SEQ ID NO: 102913

SEQ ID NO: 263803 - RNA, 64 nt, Human; identical to SEQ ID NO: 133978

SEQ ID NO: 263804 - RNA, 54 nt, Human; identical to SEQ ID NO: 179353

SEQ ID NO: 263805 - RNA, 64 nt, Human; identical to SEQ ID NO: 41439

SEQ ID NO: 263806 - RNA, 64 nt, Human; identical to SEQ ID NO: 98035

SEQ ID NO: 263807 - RNA, 64 nt, Human; identical to SEQ ID NO: 137119

SEQ ID NO: 263808 - RNA, 64 nt, Human; identical to SEQ ID NO: 179479

SEQ ID NO: 263809 - RNA, 62 nt, Human
gggguucaugggaucccgaaggagcaagcagucggcagcacccaggccacaggagacuccgc

SEQ ID NO: 263810 - RNA, 62 nt, Human
cgccaucucacacgccucccuccuguggccgccggcagcauggacaaaggucuccaugcagg

SEQ ID NO: 263811 - RNA, 62 nt, Human
accgucuaaacaguguugugcagucgcaguggcggcagcagcggcagccguccgucacucca

SEQ ID NO: 263812 - RNA, 64 nt, Human; identical to SEQ ID NO: 41456

SEQ ID NO: 263813 - RNA, 64 nt, Human; identical to SEQ ID NO: 102081

SEQ ID NO: 263814 - RNA, 64 nt, Human; identical to SEQ ID NO: 137619

SEQ ID NO: 263815 - RNA, 64 nt, Human; identical to SEQ ID NO: 185497

SEQ ID NO: 263816 - RNA, 64 nt, Human; identical to SEQ ID NO: 185498

SEQ ID NO: 263817 - RNA, 64 nt, Human; identical to SEQ ID NO: 185499

SEQ ID NO: 263818 - RNA, 64 nt, Human; identical to SEQ ID NO: 41473

SEQ ID NO: 263819 - RNA, 64 nt, Human; identical to SEQ ID NO: 102132

SEQ ID NO: 263820 - RNA, 64 nt, Human; identical to SEQ ID NO: 140165

SEQ ID NO: 263821 - RNA, 64 nt, Human; identical to SEQ ID NO: 173594

SEQ ID NO: 263822 - RNA, 64 nt, Human; identical to SEQ ID NO: 41490

SEQ ID NO: 263823 - RNA, 64 nt, Human; identical to SEQ ID NO: 102168

SEQ ID NO: 263824 - RNA, 64 nt, Human; identical to SEQ ID NO: 140818

SEQ ID NO: 263825 - RNA, 64 nt, Human; identical to SEQ ID NO: 173630

SEQ ID NO: 263826 - RNA, 64 nt, Human; identical to SEQ ID NO: 41507

SEQ ID NO: 263827 - RNA, 64 nt, Human; identical to SEQ ID NO: 107913

SEQ ID NO: 263828 - RNA, 64 nt, Human; identical to SEQ ID NO: 107914

SEQ ID NO: 263829 - RNA, 64 nt, Human; identical to SEQ ID NO: 107915

SEQ ID NO: 263830 - RNA, 64 nt, Human; identical to SEQ ID NO: 107916

SEQ ID NO: 263831 - RNA, 64 nt, Human; identical to SEQ ID NO: 102256

SEQ ID NO: 263832 - RNA, 64 nt, Human; identical to SEQ ID NO: 140825

SEQ ID NO: 263833 - RNA, 64 nt, Human; identical to SEQ ID NO: 178681

SEQ ID NO: 263834 - RNA, 64 nt, Human; identical to SEQ ID NO: 41524

SEQ ID NO: 263835 - RNA, 64 nt, Human; identical to SEQ ID NO: 102328

SEQ ID NO: 263836 - RNA, 64 nt, Human; identical to SEQ ID NO: 141696

SEQ ID NO: 263837 - RNA, 64 nt, Human; identical to SEQ ID NO: 178766

SEQ ID NO: 263838 - RNA, 64 nt, Human; identical to SEQ ID NO: 41541

SEQ ID NO: 263839 - RNA, 64 nt, Human; identical to SEQ ID NO: 102453

SEQ ID NO: 263840 - RNA, 64 nt, Human; identical to SEQ ID NO: 141715

SEQ ID NO: 263841 - RNA, 64 nt, Human; identical to SEQ ID NO: 178850

SEQ ID NO: 263842 - RNA, 64 nt, Human; identical to SEQ ID NO: 41569

SEQ ID NO: 263843 - RNA, 64 nt, Human; identical to SEQ ID NO: 102736

SEQ ID NO: 263844 - RNA, 64 nt, Human; identical to SEQ ID NO: 143002

SEQ ID NO: 263845 - RNA, 64 nt, Human; identical to SEQ ID NO: 179132

SEQ ID NO: 263846 - RNA, 64 nt, Human
uucugugcgcagcuaaaaggggcgcccuacaucuccgugccacucccgccccagccuagcccca

SEQ ID NO: 263847 - RNA, 62 nt, Human
gcuucucgugguuggcgugcugcagcgacaggcggcagcacagcaccugcacgaacacccgc

SEQ ID NO: 263848 - RNA, 62 nt, Human
uggcccggcuagccgccuggacugcaggggggcggcagcagcggcgguggcagugggugccu

SEQ ID NO: 263849 - RNA, 62 nt, Human
cugagaccaaggucugugggcucuaggcagcccggcagcagcccccagaggaacugcuccca

SEQ ID NO: 263850 - RNA, 64 nt, Human; identical to SEQ ID NO: 41586

SEQ ID NO: 263851 - RNA, 64 nt, Human; identical to SEQ ID NO: 97891

SEQ ID NO: 263852 - RNA, 64 nt, Human; identical to SEQ ID NO: 143019

SEQ ID NO: 263853 - RNA, 64 nt, Human; identical to SEQ ID NO: 179317

SEQ ID NO: 263854 - RNA, 64 nt, Human; identical to SEQ ID NO: 41620

SEQ ID NO: 263855 - RNA, 64 nt, Human
aaaaauacaaaaauuagccaggcaugguggcacacgccuauagucccagcuacucaggaggcug

SEQ ID NO: 263856 - RNA, 64 nt, Human
aaauacaaaaaaauuagccaggcauaguggcgcgcgccuauaaucccagcuacugggaggcuga

SEQ ID NO: 263857 - RNA, 64 nt, Human
aggcaccaggcaguaacuuccaugaugacacugacgccuauaccugagcucuaggcugccugga

SEQ ID NO: 263858 - RNA, 64 nt, Human
aaaauacaaaaaauuagccuggcguaauggcaggcgccuauaaucccagcuacucaggaggcug

SEQ ID NO: 263859 - RNA, 64 nt, Human
aaaaauauaaaaauuagccuggcaugguagcaugcgccuauagucccagcugcucaggaggcug

SEQ ID NO: 263860 - RNA, 64 nt, Human
gaaaagaaaacuggaggcugggcgcaguggcucacgccuauaaucccagaggcugaggcaggcg

SEQ ID NO: 263861 - RNA, 64 nt, Human
uuuaaaaaggcaguaggcccggugugguggcucacgccuauaaucccagcacuuugggaggcug

SEQ ID NO: 263862 - RNA, 64 nt, Human
aaauguuaagaaauaggccaagugcgguggcucacgccuauaauccuaucacuuugggaggccu

SEQ ID NO: 263863 - RNA, 64 nt, Human
cuaaaguugauuuaaggccaggcauggugguuuacgccuauaaucccagcauuuugggaguccg

SEQ ID NO: 263864 - RNA, 64 nt, Human
gcuaagugcuuacuucgggauagcaggggccggacgccuauacaccugucugcugccuguggac

SEQ ID NO: 263865 - RNA, 64 nt, Human
aagagaagacaagagggccgggcgcggugacucacgccuauaaucccagcacuuugggaggccg

SEQ ID NO: 263866 - RNA, 64 nt, Human
cugauggccaucccuggugcaaguguucauccagccgugccagggcaacagcccacccccuagu

SEQ ID NO: 263867 - RNA, 64 nt, Human; identical to SEQ ID NO: 107919

SEQ ID NO: 263868 - RNA, 64 nt, Human; identical to SEQ ID NO: 107920

SEQ ID NO: 263869 - RNA, 64 nt, Human
agaagaagcuugccaggccgggcacgguggcucacgccuauaaucccagcacuuugggaggccg

SEQ ID NO: 263870 - RNA, 64 nt, Human
gcuaaagaaugccauggccgggugcaguggcucacgccuauaaucccagcacuuugggaggccg

SEQ ID NO: 263871 - RNA, 64 nt, Human
aaaaauacaaaaauuagccgggcaugguggcaggcgccuauaaucccagcuacuggggaggcug

SEQ ID NO: 263872 - RNA, 64 nt, Human
aaaaauacaaaaauuagcugggugugguggcgggcgccuauaauccuagcuacuagggaggcca

SEQ ID NO: 263873 - RNA, 64 nt, Human
aaaguuaaccaagcaggccaggcacgguggcucacgccuauaaucccagcacuuagggaggcca

SEQ ID NO: 263874 - RNA, 64 nt, Human
aucuguucuuuuuuuaaaaaaacuuccuucaccgcgccuauaauccuagcacuuugggaggccg

SEQ ID NO: 263875 - RNA, 64 nt, Human
cuguuaaaauuuaaaaaggugcuuuaaaauaaaacgccuauaaagauugugcaguaagaauuuu

SEQ ID NO: 263876 - RNA, 64 nt, Human
gucguuccagggcugggggaggugggagggaucacgccuauaggugugggcacaugaaacgacc

SEQ ID NO: 263877 - RNA, 64 nt, Human
guagccaauguuuuuuuugucuugucaucacaggcgccuauacagcuucugucucaauaggguc

SEQ ID NO: 263878 - RNA, 64 nt, Human
gaaaauagaaaaauuagcugggcaugguggugggcgccuauaaucccagcuauucuggaggcug

SEQ ID NO: 263879 - RNA, 64 nt, Human
gagaacccacccagagacugggagugguggcucacgccuauaaucccugcgcuuuggcaguccg

SEQ ID NO: 263880 - RNA, 64 nt, Human
uaacaaguaguuauuggcugugcacaguggcucacgccuauaaucccagcauuuugggaggcug

SEQ ID NO: 263881 - RNA, 64 nt, Human
aucaaucacuguccuggccaguugcaguggcucacgccuauaaucccaacacuucgggaggcca

SEQ ID NO: 263882 - RNA, 64 nt, Human
uuacaaguaacucuaggcugggugugguggcucacgccuauaaucccagcacuuugggaggcug

SEQ ID NO: 263883 - RNA, 64 nt, Human
gcugaagcggccgggggcucccacucgccugcugcgccuauagccacugcgcccugggggccug

SEQ ID NO: 263884 - RNA, 64 nt, Human
aaauacaaaaaaacuagcugggcgugguggcgggcgccuauaaucccagcuacuugggaggcug

SEQ ID NO: 263885 - RNA, 64 nt, Human; identical to SEQ ID NO: 107764

SEQ ID NO: 263886 - RNA, 64 nt, Human; identical to SEQ ID NO: 107921

SEQ ID NO: 263887 - RNA, 64 nt, Human; identical to SEQ ID NO: 107923

SEQ ID NO: 263888 - RNA, 64 nt, Human; identical to SEQ ID NO: 107924

SEQ ID NO: 263889 - RNA, 64 nt, Human
gaagaaaacagcuguggucgggcacgguggcucacgccuauaaucccagcacuuugggaggccg

SEQ ID NO: 263890 - RNA, 64 nt, Human
ugccaucucugcaguggccgucgccuugauguaucgccuauacauggcagaggacugaacaccu

SEQ ID NO: 263891 - RNA, 64 nt, Human
aagacuuggccuuagggccgagugcgguggcucacgccuauaaucccagcacuuugggaggccg

SEQ ID NO: 263892 - RNA, 64 nt, Human
aagacgaaaagugacggccaggugcaguggcucacgccuauaaucucagcacucugggaggcca

SEQ ID NO: 263893 - RNA, 64 nt, Human
aaaaauuuuuuaaugaaccaggcauuguggcaugcgccuauagucccagccacucaagaggcac

SEQ ID NO: 263894 - RNA, 64 nt, Human
uucaaaaggauuucaggcugagugugguggcucacgccuauacacccagcacuuuggaaggcug

SEQ ID NO: 263895 - RNA, 64 nt, Human
aaaauacaaaaaauuagccaggcguggcagcaugcgccuauagucccagccacuugggaggcug

SEQ ID NO: 263896 - RNA, 64 nt, Human
uaaaccucugcuccuggccaggcacaguggcucacgccuauaaucccagcacuuugggaggcug

SEQ ID NO: 263897 - RNA, 64 nt, Human
ucaaaaaugaaaugcugccgggugcggugacucacgccuauaaucccagcacuuugggaggcug

SEQ ID NO: 263898 - RNA, 64 nt, Human
aaaaauacaaaaauuagccgggcaugguggugcacgccuauagucccagcuacucgggaggcug

SEQ ID NO: 263899 - RNA, 64 nt, Human
gcgagggcgacaugaagaugcacugcugcguggccgccuauaucuccgacuaugccuucuuggg

SEQ ID NO: 263900 - RNA, 64 nt, Human
aaaaagauaaaaauaagcugggcgugguggcaggcgccuauaaucccagcuacucgggaggcug

SEQ ID NO: 263901 - RNA, 64 nt, Human
ggaaaauuggaaauggacugggcgugguggcucacgccuauaaucccagcaguuugggaggcug

SEQ ID NO: 263902 - RNA, 64 nt, Human
cgcagauaacccuggcccuacagccugcuugcuccgccuauaccacagagcacagccuggacau

SEQ ID NO: 263903 - RNA, 64 nt, Human; identical to SEQ ID NO: 263855

SEQ ID NO: 263904 - RNA, 64 nt, Human; identical to SEQ ID NO: 107927

SEQ ID NO: 263905 - RNA, 64 nt, Human; identical to SEQ ID NO: 107928

SEQ ID NO: 263906 - RNA, 64 nt, Human; identical to SEQ ID NO: 107929

SEQ ID NO: 263907 - RNA, 64 nt, Human; identical to SEQ ID NO: 107930

SEQ ID NO: 263908 - RNA, 64 nt, Human; identical to SEQ ID NO: 263856

SEQ ID NO: 263909 - RNA, 64 nt, Human; identical to SEQ ID NO: 263857

SEQ ID NO: 263910 - RNA, 64 nt, Human; identical to SEQ ID NO: 263858

SEQ ID NO: 263911 - RNA, 64 nt, Human; identical to SEQ ID NO: 263859

SEQ ID NO: 263912 - RNA, 64 nt, Human; identical to SEQ ID NO: 263860

SEQ ID NO: 263913 - RNA, 64 nt, Human; identical to SEQ ID NO: 263861

SEQ ID NO: 263914 - RNA, 64 nt, Human; identical to SEQ ID NO: 263862

SEQ ID NO: 263915 - RNA, 64 nt, Human; identical to SEQ ID NO: 263863

SEQ ID NO: 263916 - RNA, 64 nt, Human; identical to SEQ ID NO: 263864

SEQ ID NO: 263917 - RNA, 64 nt, Human; identical to SEQ ID NO: 263865

SEQ ID NO: 263918 - RNA, 64 nt, Human; identical to SEQ ID NO: 263869

SEQ ID NO: 263919 - RNA, 64 nt, Human; identical to SEQ ID NO: 263870

SEQ ID NO: 263920 - RNA, 64 nt, Human; identical to SEQ ID NO: 263871

SEQ ID NO: 263921 - RNA, 64 nt, Human; identical to SEQ ID NO: 263872

SEQ ID NO: 263922 - RNA, 64 nt, Human; identical to SEQ ID NO: 263873

SEQ ID NO: 263923 - RNA, 64 nt, Human; identical to SEQ ID NO: 263874

SEQ ID NO: 263924 - RNA, 64 nt, Human; identical to SEQ ID NO: 107931

SEQ ID NO: 263925 - RNA, 62 nt, Human
gcugaaccagcagaccuaccugcagugggaaccggcagcaucccagccaggguuugcuguuu

SEQ ID NO: 263926 - RNA, 62 nt, Human
acagugccaaugcuugucagacacaugcccuucggcagcauuccagaacaggagggaagaga

SEQ ID NO: 263927 - RNA, 62 nt, Human
guccaagucucccucaggaaggccuuuucuaucggcagcaauuccaucaagccaagccuccu

SEQ ID NO: 263928 - RNA, 64 nt, Human; identical to SEQ ID NO: 263875

SEQ ID NO: 263929 - RNA, 64 nt, Human; identical to SEQ ID NO: 263876

SEQ ID NO: 263930 - RNA, 64 nt, Human; identical to SEQ ID NO: 263877

SEQ ID NO: 263931 - RNA, 64 nt, Human; identical to SEQ ID NO: 263878

SEQ ID NO: 263932 - RNA, 64 nt, Human; identical to SEQ ID NO: 263879

SEQ ID NO: 263933 - RNA, 64 nt, Human; identical to SEQ ID NO: 263880

SEQ ID NO: 263934 - RNA, 64 nt, Human; identical to SEQ ID NO: 263881

SEQ ID NO: 263935 - RNA, 64 nt, Human; identical to SEQ ID NO: 263882

SEQ ID NO: 263936 - RNA, 64 nt, Human; identical to SEQ ID NO: 263883

SEQ ID NO: 263937 - RNA, 64 nt, Human; identical to SEQ ID NO: 263884

SEQ ID NO: 263938 - RNA, 64 nt, Human; identical to SEQ ID NO: 263889

SEQ ID NO: 263939 - RNA, 64 nt, Human; identical to SEQ ID NO: 263890

SEQ ID NO: 263940 - RNA, 64 nt, Human; identical to SEQ ID NO: 263891

SEQ ID NO: 263941 - RNA, 64 nt, Human; identical to SEQ ID NO: 263892

SEQ ID NO: 263942 - RNA, 64 nt, Human; identical to SEQ ID NO: 263893

SEQ ID NO: 263943 - RNA, 64 nt, Human; identical to SEQ ID NO: 263894

SEQ ID NO: 263944 - RNA, 64 nt, Human; identical to SEQ ID NO: 107933

SEQ ID NO: 263945 - RNA, 64 nt, Human; identical to SEQ ID NO: 107934

SEQ ID NO: 263946 - RNA, 64 nt, Human; identical to SEQ ID NO: 107935

SEQ ID NO: 263947 - RNA, 64 nt, Human; identical to SEQ ID NO: 107936

SEQ ID NO: 263948 - RNA, 64 nt, Human; identical to SEQ ID NO: 263895

SEQ ID NO: 263949 - RNA, 64 nt, Human; identical to SEQ ID NO: 263896

SEQ ID NO: 263950 - RNA, 64 nt, Human; identical to SEQ ID NO: 263897

SEQ ID NO: 263951 - RNA, 64 nt, Human; identical to SEQ ID NO: 263898

SEQ ID NO: 263952 - RNA, 64 nt, Human; identical to SEQ ID NO: 263899

SEQ ID NO: 263953 - RNA, 64 nt, Human; identical to SEQ ID NO: 263900

SEQ ID NO: 263954 - RNA, 64 nt, Human; identical to SEQ ID NO: 263901

SEQ ID NO: 263955 - RNA, 64 nt, Human; identical to SEQ ID NO: 263902

SEQ ID NO: 263956 - RNA, 64 nt, Human
ccgugggcagaaugacuuuuauugagcucuuguuccgugccaggcauucaauccucaggucucc

SEQ ID NO: 263957 - RNA, 64 nt, Human
gcugacugcagaacuaggcucccucugccacgguccgugccagccaauagauguccugaggccu

SEQ ID NO: 263958 - RNA, 64 nt, Human
accggccccauggucuggcuccugucaccuggguccgugccagcacaaucugccaaaguucuag

SEQ ID NO: 263959 - RNA, 64 nt, Human
uccccucccugagccagcaucuccauccaccaccccgugccagcucccgugccagccuucauuc

SEQ ID NO: 263960 - RNA, 64 nt, Human
gccagcaucuccauccaccaccccgugccagcucccgugccagccuucauuccucccagugucc

SEQ ID NO: 263961 - RNA, 61 nt, Human
aggugcaccagaccuccugagcuuagagccaccgugccauccugugcugugcucaagcggg

SEQ ID NO: 263962 - RNA, 64 nt, Human
guuauguauaaugcuuuguuaaagaacccccuuuccgugccacuggugaauagggauugaugaa

SEQ ID NO: 263963 - RNA, 64 nt, Human
agacugugcccuugggaauuuccacucuggcuuuccgugccacucuucuuccuuuccaucccaa

SEQ ID NO: 263964 - RNA, 64 nt, Human
uggaggccucaccguggacucaacucugcauucuccgugccacauuccuccaguucccacacgu

SEQ ID NO: 263965 - RNA, 64 nt, Human
uuugguaacugugcacuguguccuuuagccagggccgugccaacuuaugaagacacugcagcuu

SEQ ID NO: 263966 - RNA, 64 nt, Human
ggccccagguccauguugggcacuagggcagguuccgugccagagucgggggccacacgagggc

SEQ ID NO: 263967 - RNA, 64 nt, Human
uuuuuaaaauuuuacgcgcaaaacuccguggaccccgugccagugucuuggaagugucaacgug

SEQ ID NO: 263968 - RNA, 64 nt, Human
gcagccacccaccccacgugccaacuuccccuccccgugccagcacugccgcuuccaccugggc

SEQ ID NO: 263969 - RNA, 64 nt, Human
cuuccaccugggccacccaccggacccucgcacgccgugccaggccugccccagacgcgucugc

SEQ ID NO: 263970 - RNA, 64 nt, Human
agcacugggggucuucagaccagccagcaaggggccgugccagugcccagagagcaggucagac

SEQ ID NO: 263971 - RNA, 64 nt, Human
cgaggacccuuucuugcccacaguuucgagaggcccgugccaugagaccgccuggggugagcaa

SEQ ID NO: 263972 - RNA, 64 nt, Human
cccgugcccaccucugcgcggacgaccccgacuuccgugccaucccagacgggccgcgaaggcg

SEQ ID NO: 263973 - RNA, 64 nt, Human
auucaauucauagaauaacaacugcugggaauauccgugccaggaaaagaaaaauuucuggcaa

SEQ ID NO: 263974 - RNA, 64 nt, Human
cccgcccccgccaaggggcaccaaggccacguuuccgugccaccuccugucuacucauuguugc

SEQ ID NO: 263975 - RNA, 64 nt, Human
ccaguggguaauacuugcuuccacuugcagagcaccgugccaagcacuucccacacacuuaccc

SEQ ID NO: 263976 - RNA, 64 nt, Human
uugccaucccaagcccagugaccuuacucguauaccgugccacuuuccaccaacuuuuuccaag

SEQ ID NO: 263977 - RNA, 64 nt, Human
acaguggggccucuccguauuugugcauugggcuccgugccacaaccaagcuucauuagucuua

SEQ ID NO: 263978 - RNA, 64 nt, Human
ccacggcggaagcucccuuggaggcagcccugccccgugccaccugcagcuuuaauauuuauga

SEQ ID NO: 263979 - RNA, 64 nt, Human
cgccaggcgcugcccugcaggugcucucguccucccgugccagcccccgcccgcccguguccca

SEQ ID NO: 263980 - RNA, 64 nt, Human
auggaggggcacugcuugcuuggcccgguccccuccgugccaguucccaggcgcacucuacucc

SEQ ID NO: 263981 - RNA, 64 nt, Human
gcggcuccucacccucacaauuuauuuccuccucccgugccagcccuucuuuugugucugaaac

SEQ ID NO: 263982 - RNA, 64 nt, Human
ggggagacugaggaagggcagagccagaagcaagccgugccaggccaucugccugcucaugggg

SEQ ID NO: 263983 - RNA, 64 nt, Human
ccucagcacagacccuccagacugggucucagagccgugccacccacccucccacacagccggc

SEQ ID NO: 263984 - RNA, 64 nt, Human
ccaccuugggcucgagcagcgacccgaaccagccccgugccagcccgguccccagacccaagcc

SEQ ID NO: 263985 - RNA, 64 nt, Human
uuuguccccaugucaggcggaggcggaaggcccaccgugccagaggcugggcaccagccuuaac

SEQ ID NO: 263986 - RNA, 64 nt, Human
aauauuauguaccuaccacuaagaaauacaugaaccgugccaugaggacaguaaguguucauaa

SEQ ID NO: 263987 - RNA, 64 nt, Human
ccucccaaagugcugggauuacaggcuugagccaccgugccaggccuguuuuguuuguuuuugu

SEQ ID NO: 263988 - RNA, 64 nt, Human
agcaacaacagaugaaagccagugagccuacuaaccgugccaucuugcaaacuacacuuuaaaa

SEQ ID NO: 263989 - RNA, 64 nt, Human
gaauccaggagguggagcuugcagugagccgagaccgugccacugcacuccagccugggcaaca

SEQ ID NO: 263990 - RNA, 60 nt, Human
ugcaccaggauggugguuagcaacaguggcccgugccaaagcacuuaccaaagugaugau

SEQ ID NO: 263991 - RNA, 64 nt, Human
gguggucuguuuugcaagcuugauaacagaauguccgugccauuguaaauguuguagagaugug

SEQ ID NO: 263992 - RNA, 64 nt, Human
uggaaagcgggggcgcccgccgacgaggaggccaccgugccaagccggcagaggucaugccagg

SEQ ID NO: 263993 - RNA, 64 nt, Human
gaagucguccuuacuccugugggagccucgcaacccgugccaaguccagguccugguggggcag

SEQ ID NO: 263994 - RNA, 64 nt, Human
gcaugguucucuggaaacgcgccaggaaaagcuuccgugccagugauucguugccucagaaacu

SEQ ID NO: 263995 - RNA, 64 nt, Human
cucuuaccaggagcaaggcccucugaagcaugggccgugccagcugugcccuagugauaagggu

SEQ ID NO: 263996 - RNA, 64 nt, Human
acagcggcacguucuagcugcgucugcggccagcccgugccaguggagugggcuccgcguugcu

SEQ ID NO: 263997 - RNA, 64 nt, Human
ugagagcucgaucccguaugaagggugcugccgcccgugccaucuggcccgggggugacuuuuu

SEQ ID NO: 263998 - RNA, 64 nt, Human
auuagccagccccgggccccgggugccucugcguccgugccaggccuccugaugccaaggccac

SEQ ID NO: 263999 - RNA, 64 nt, Human
aaacuucauguaacuauagacuggaaaaaaugagccgugccaaagucucccuucuguuucuuca

SEQ ID NO: 264000 - RNA, 64 nt, Human
gaaguauggaaacuuccaggcucaaacaugucccccgugccacaaggcaaacugcgaugagcuc

SEQ ID NO: 264001 - RNA, 64 nt, Human
cuaauuucuauuacuacguacugucacuuuccucccgugccauuacugcaucauaauacaagga

SEQ ID NO: 264002 - RNA, 64 nt, Human
cuucugcugaugcccuagcucagggcucugcauuccgugccagggacgccucagccccuuaaca

SEQ ID NO: 264003 - RNA, 64 nt, Human
uggccuaggaaggagcaccggccacagcugcuccccgugccacucaggguggacccagcaucuc

SEQ ID NO: 264004 - RNA, 64 nt, Human
gagugacgaggaggagcuccgagcugcgccugagccgugccagccggcggaccucaggcggugg

SEQ ID NO: 264005 - RNA, 52 nt, Human
caucucgagguggagcuuagccccgugccaggagcaaugggacuggagucag

SEQ ID NO: 264006 - RNA, 64 nt, Human
uuuauuuaaauuuauaauccuuuauuuuuuaauaccgugccauuuuccacaaaggauuuguggu

SEQ ID NO: 264007 - RNA, 64 nt, Human
cugccucuccccuuccggugcucacacgcccacgccgugccacccgaugcaggacucaccucug

SEQ ID NO: 264008 - RNA, 64 nt, Human
cgucacccaaggcugguggucagugugaagggcuccgugccaacuggucagcuguccuucacgc

SEQ ID NO: 264009 - RNA, 64 nt, Human
aaaaagaaacuggguuccagucuuaauucauuuuccgugccagguuuuauuucgugugugugug

SEQ ID NO: 264010 - RNA, 64 nt, Human
cagagcgagacucugucucgaaaaaaaaaaagguccgugccaagcugcucccugcccuugcccu

SEQ ID NO: 264011 - RNA, 64 nt, Human
cggugccagcccggcucugaagccaagggccgucccgugccacggugcugugaguauuccuccg

SEQ ID NO: 264012 - RNA, 64 nt, Human
gaccccacuggccccuggccugccggacacagcaccgugccaaccccacccagcuccaggccca

SEQ ID NO: 264013 - RNA, 64 nt, Human
uccuggacuccagccagccuucacagaggacgucccgugccagauucucucacagcagaucggg

SEQ ID NO: 264014 - RNA, 64 nt, Human
cagccuuuuccccaggccucagagcauugcucauccgugccaaacuggguagguggauuugagc

SEQ ID NO: 264015 - RNA, 64 nt, Human
aaaaccagaagacaucguaugcuugggaugggggccgugccacccgugggaaugcugcccgcuc

SEQ ID NO: 264016 - RNA, 64 nt, Human
uaaggacgcuggagccaagaggauuguucccgugccgugccaugguuucacccuaugugugcca

SEQ ID NO: 264017 - RNA, 64 nt, Human
ggcguaccagacugcaagaccccccaguaccucaccgugccaaauaggaagagguggccuuggu

SEQ ID NO: 264018 - RNA, 64 nt, Human
acauagaggcuuuuucagcauuacugugucgucuccgugccagauguggcaagaucaccauuag

SEQ ID NO: 264019 - RNA, 64 nt, Human
aguaccccacgcacccccaggaccuucgccgucuccgugccagcguucacgcucccucccgggg

SEQ ID NO: 264020 - RNA, 64 nt, Human
gcauuguucugagcagugugauggagagucucugccgugccaucugggaugcaaaccgucccug

SEQ ID NO: 264021 - RNA, 64 nt, Human
cacacaucuacacccccaagcacacacacaugguccgugccaugucaccuccauagggaaaggc

SEQ ID NO: 264022 - RNA, 64 nt, Human
aaaguaguuuucuccucuaccccucucauuccuuccgugccaugguuuuaauugacccuguuuu

SEQ ID NO: 264023 - RNA, 64 nt, Human
uugauaucuauccuuauauuuuucucccuuuuucccgugccacuuuuucuuaaauuauuuccca

SEQ ID NO: 264024 - RNA, 64 nt, Human
ugggaucaugcuagucacuuccugcccccaggcaccgugccaaagacuggaugcccccuacucc

SEQ ID NO: 264025 - RNA, 64 nt, Human; identical to SEQ ID NO: 107897

SEQ ID NO: 264026 - RNA, 64 nt, Human; identical to SEQ ID NO: 107925

SEQ ID NO: 264027 - RNA, 64 nt, Human
uccgccauuaugauuucagacagagcugcuggguccgugccauaucccaggaggaccagcuggc

SEQ ID NO: 264028 - RNA, 64 nt, Human
aaguuucuaucauccaaaguaugggcuacagaaaccgugccaaaagacuucuacagagugaacc

SEQ ID NO: 264029 - RNA, 64 nt, Human
cucgcugcagagccgggcccagcgcgcccuguccccgugccagggaaccgggguugaccgcccc

SEQ ID NO: 264030 - RNA, 64 nt, Human
gagcccgcccagaggagcccagcggcccaagagcccgugccacccccagcccuggccccuccaa

SEQ ID NO: 264031 - RNA, 64 nt, Human
ugaaccugggaaguggagguugagugagccgggaccgugccauuguacuccagccugggugaca

SEQ ID NO: 264032 - RNA, 64 nt, Human
cccagccagcagccuccuuccuacgggggucccuccgugccagggucggggggcccccccgccg

SEQ ID NO: 264033 - RNA, 64 nt, Human
ucgagcuuuccuggacucggucauuggggccaccccgugccagcggugcccuucugcggccgcc

SEQ ID NO: 264034 - RNA, 64 nt, Human
cuucaccaggauccgguaaaccugccgggcaggaccgugccacaccagcuguccagagucggag

SEQ ID NO: 264035 - RNA, 64 nt, Human
cucucauuucuuccagcaugaucgcgcccugcucccgugccaccguagucccuggcagacaggc

SEQ ID NO: 264036 - RNA, 64 nt, Human
uucacgguugcuacccaggcggccaagcuccagaccgugccagacccaggugccccagugccuu

SEQ ID NO: 264037 - RNA, 64 nt, Human
guguucauccccgcugcaggucgggcgucuccccccgugccacuccugagacucccaccguuac

SEQ ID NO: 264038 - RNA, 64 nt, Human
cucgcggcggacguccccaggggucacccugcaaccgugccacguggaggagcugggggucgcc

SEQ ID NO: 264039 - RNA, 64 nt, Human
gugacauuggaacguggccuuccugucacccccuccgugccacgcacugaaggccacccccacc

SEQ ID NO: 264040 - RNA, 64 nt, Human
ccgggcaggggccgcuucgccaugugcugugcacccgugccacgcgcucugcaugcuccucugc

SEQ ID NO: 264041 - RNA, 64 nt, Human
uuuugugccaggagugggugggacacagagacccccgugccaaauccugggcauccccagcccc

SEQ ID NO: 264042 - RNA, 64 nt, Human
ggccagccccagggccaggguccccuuggugaagccgugccagggggcucagcugcuucaggga

SEQ ID NO: 264043 - RNA, 64 nt, Human
ucuguuucccucugcugccugggagcugaggcacccgugccaguggcagaggccacagccccag

SEQ ID NO: 264044 - RNA, 64 nt, Human
ucucugucuugguaguugccgguggacagcauggccgugccagccucccacacugaggccaggu

SEQ ID NO: 264045 - RNA, 64 nt, Human
uaguggugauuguuuaaacucucacagucuuaaaccgugccaaaguccuguuaugucuugaacu

SEQ ID NO: 264046 - RNA, 64 nt, Human
cuauucguagccaucuccguggccaaugugacuaccgugccagcagcgggggcggcccagccuc

SEQ ID NO: 264047 - RNA, 64 nt, Human
cacgcguuuccacaacauccccugggucagacccaccagguaccccguaggaauuuccaguuuc

SEQ ID NO: 264048 - RNA, 64 nt, Human
uugguguguacccagggaaguuaucuugguauaaaccagguaauuuggaagugaauuacaaaua

SEQ ID NO: 264049 - RNA, 64 nt, Human
gcaguggcuuuaugcagacuccaagaacaaaaccaccagguauuuuuuuuuaaguaaaaauuua

SEQ ID NO: 264050 - RNA, 64 nt, Human
gugaacuaaauauucggucugcccgucuucgaauaccagguauugcagagguaggucuauuauu

SEQ ID NO: 264051 - RNA, 64 nt, Human
gcugaaaccugccuuuccuaaugcucacacaagcaccagguacccugagcuuauacugagucca

SEQ ID NO: 264052 - RNA, 64 nt, Human
ugaaauugcuuuggacaaguuuucuaggcuaucuaccagguagcucauuaaacguaauucuuca

SEQ ID NO: 264053 - RNA, 64 nt, Human
guaugaccuggaauucaaguuucucgacgaccccaccagguacaucucaccugacugucuggcu

SEQ ID NO: 264054 - RNA, 64 nt, Human
accaggcccagccugagugguauuuucuuuagggaccagguagacuuuaaaacgaggguaagag

SEQ ID NO: 264055 - RNA, 64 nt, Human
ugaccugaauguguuccugccccccaggagugugaccagguacauguggaagauguggcuucug

SEQ ID NO: 264056 - RNA, 64 nt, Human
aauccaugaccacuguuuuuuuccuauuuauaucaccagguagcccacugaguuaauauuuaag

SEQ ID NO: 264057 - RNA, 64 nt, Human
gagaggccacacacuugcccccccauccccacaaaccagguaaugccaguuugccagcagcuau

SEQ ID NO: 264058 - RNA, 64 nt, Human
gccauuggcuugucugcauuucaaaaucauuaaaaccagguauggaagccuacgugcucacagu

SEQ ID NO: 264059 - RNA, 64 nt, Human
aucaaaagagcacaagaguaugcguacauaguuuaccagguaguagaaguguguuaaaauguuc

SEQ ID NO: 264060 - RNA, 64 nt, Human
acccccagccuggguagagccaccagguacgacgaccagguaccagaaaccaccaggcacacgg

SEQ ID NO: 264061 - RNA, 64 nt, Human
gccccuccccucgacccccagccuggguagagccaccagguacgacgaccagguaccagaaacc

SEQ ID NO: 264062 - RNA, 64 nt, Human; identical to SEQ ID NO: 107939

SEQ ID NO: 264063 - RNA, 64 nt, Human; identical to SEQ ID NO: 107940

SEQ ID NO: 264064 - RNA, 64 nt, Human; identical to SEQ ID NO: 107941

SEQ ID NO: 264065 - RNA, 64 nt, Human; identical to SEQ ID NO: 107942

SEQ ID NO: 264066 - RNA, 64 nt, Human
gaagauugaguuuauccugauuuuugaaaaauuaaccagguaucuuuaucacuguguauuuuuc

SEQ ID NO: 264067 - RNA, 64 nt, Human
ugcucuuauuggccagauaaauguguuauauuaaaccagguaaguauuuuaaacagagaacauu

SEQ ID NO: 264068 - RNA, 64 nt, Human
cuugccaguuguauaacugaaaaaggacuuuucuaccagguaugaccuuuuaagugaaaaucug

SEQ ID NO: 264069 - RNA, 64 nt, Human
uuaaaacuguaacacaucacauaaaagauacuuuaccagguauguauugcauuauaucauugca

SEQ ID NO: 264070 - RNA, 64 nt, Human
aucccuacccauauucuuuucauaaaacccacucaccagguacaauagaaacuucccuccuugu

SEQ ID NO: 264071 - RNA, 64 nt, Human
aaggauuauuugucuaacaguucauuccaaucagaccagguaggagcuuuccuguuucauaugu

SEQ ID NO: 264072 - RNA, 64 nt, Human
ggaaguuuuguggaggagcucaggacacuaauacaccagguagaacacaaggucauuugcuaac

SEQ ID NO: 264073 - RNA, 64 nt, Human
gaagucuuuaaaaagccugcauuguguauuaaacaccagguaauaugugcaaaaccgagggcuc

SEQ ID NO: 264074 - RNA, 64 nt, Human
gcgguguccaggggcgccccgccccugcggccccaccagguacugaaagacccgcaggcugagc

SEQ ID NO: 264075 - RNA, 64 nt, Human
acauuuuucucugauagcuggaaguugaaccucaaccagguauaaaagaugcauaacaaccuuu

SEQ ID NO: 264076 - RNA, 64 nt, Human
uuaggugaauuaauuaaacauugugaucauuaguaccagguauuauuaucuuuaagagucuucc

SEQ ID NO: 264077 - RNA, 64 nt, Human
auucuagaaaucacuggaaagaggagaggaaagaaccagguaggcaaauggucugugaaacccu

SEQ ID NO: 264078 - RNA, 64 nt, Human
guacaacauuucaaggaaaugaauauauuguuagaccagguaagcaaguuuauuuuuguuaaag

SEQ ID NO: 264079 - RNA, 64 nt, Human
ggcuggguaugagggguacagacuuggcccucacaccagguagguucugagacacuugaagaag

SEQ ID NO: 264080 - RNA, 64 nt, Human
ugcucaaauuagaauguuuagcaugaguugagguaccagguaguguuaaguagguucaucacgc

SEQ ID NO: 264081 - RNA, 64 nt, Human; identical to SEQ ID NO: 107943

SEQ ID NO: 264082 - RNA, 64 nt, Human; identical to SEQ ID NO: 107945

SEQ ID NO: 264083 - RNA, 64 nt, Human; identical to SEQ ID NO: 107946

SEQ ID NO: 264084 - RNA, 64 nt, Human; identical to SEQ ID NO: 107947

SEQ ID NO: 264085 - RNA, 64 nt, Human
aucagucaucagucagggugcguaagccuugaauaccagguagccucaggagugaaaagauaaa

SEQ ID NO: 264086 - RNA, 64 nt, Human
uggaaggcaggugaggaugucaggaugagaugggaccagguagccgaggacagugaggcauguc

SEQ ID NO: 264087 - RNA, 64 nt, Human
aaucauuauucuucaauaguggaccauauccuucaccagguauccuauuucuguuaucuagagg

SEQ ID NO: 264088 - RNA, 64 nt, Human
aagaagaacuccaaguuacuggacaccaggacaaaccagguagaucacugcauccgguuccucc

SEQ ID NO: 264089 - RNA, 64 nt, Human
ugcuuuaugggacagcugacaccuuuuagacccuaccagguauugcuagcaugugagcugcagu

SEQ ID NO: 264090 - RNA, 64 nt, Human
uauuuaugagucuuugagacuaaauucaaucaccaccagguaucaaaucaacuuuuaugcagca

SEQ ID NO: 264091 - RNA, 64 nt, Human
aaugguuuccacauucuuaucacaucugagccuuaccagguagagaagguacuaaauacacuuu

SEQ ID NO: 264092 - RNA, 64 nt, Human
acaaugagaguaauugcuugacaacaaccuaugcaccagguauuuaacauuaacuuuggaaaca

SEQ ID NO: 264093 - RNA, 64 nt, Human
gaguagagauaaagacacaaaccgaaugugaaauaccagguaauaauuauuuugcauuaaacuc

SEQ ID NO: 264094 - RNA, 64 nt, Human
auucaucuuuccuuugcucuggauacaccgaaugaccagguaacaucaucaggccgggugcagu

SEQ ID NO: 264095 - RNA, 64 nt, Human
cagccuggggaagcucugcacagagugaccugagaccagguacaggaaaccuguagcucaauca

SEQ ID NO: 264096 - RNA, 64 nt, Human
ugguucugcugugcucuggaaaguaacugcagccaccagguaugaaaaggagccugguggggag

SEQ ID NO: 264097 - RNA, 64 nt, Human
agcgcguauggaguggaaacgcuuguaggguuucaccagguaagcgguguugaacuuucugcuu

SEQ ID NO: 264098 - RNA, 64 nt, Human
cacagaugccaccaaaaccugcuaucucuucaucaccagguacgauucucuuuccacaguggac

SEQ ID NO: 264099 - RNA, 64 nt, Human
uauacauaaaaauauauuauauauguauaugaaaaccagguaguuauuuguguuuaguaaggaa

SEQ ID NO: 264100 - RNA, 64 nt, Human; identical to SEQ ID NO: 107950

SEQ ID NO: 264101 - RNA, 64 nt, Human; identical to SEQ ID NO: 107951

SEQ ID NO: 264102 - RNA, 64 nt, Human; identical to SEQ ID NO: 107952

SEQ ID NO: 264103 - RNA, 64 nt, Human; identical to SEQ ID NO: 107953

SEQ ID NO: 264104 - RNA, 64 nt, Human
uauaugaauucuuaugaaagugcuugagcuuuuaaccagguacugucuaacaacagucaucuuu

SEQ ID NO: 264105 - RNA, 64 nt, Human
accaacaaaguaggcucuuuacagggguguucucaccagguagaaaugcgauuugcucacugag

SEQ ID NO: 264106 - RNA, 64 nt, Human
ggguggugggugagggugugagacaggcagggagaccagguaaugaguggcugcaaggagucau

SEQ ID NO: 264107 - RNA, 64 nt, Human
uuagguuugcuuuuugaccaaaaagauaacaaauaccagguauggcaaguugugaagacagcac

SEQ ID NO: 264108 - RNA, 64 nt, Human
aauuguaguuuucauuaugaaguuuucccaauaaaccagguauucuaaacuuguuuccaguuug

SEQ ID NO: 264109 - RNA, 64 nt, Human
acauuuugcaugaugaaugaccugacuuuuagccaccagguacucuuuaaacaguuuuccuuau

SEQ ID NO: 264110 - RNA, 64 nt, Human
cccagcuaccaagucagacaccaagguuuaugccaccagguaacacgggaaucacagguacaug

SEQ ID NO: 264111 - RNA, 64 nt, Human
guugucauggccgcaguucagugugagauuuuuuaccagguauugcgcuuaagggacaugauuu

SEQ ID NO: 264112 - RNA, 64 nt, Human
auuccuuuuuuaaaaaauaauauaagcuacagaaaccagguaagcccuuuauuuccuuaaaugu

SEQ ID NO: 264113 - RNA, 64 nt, Human
cauuacauaguuacucaguaaacaaaagagaaauaccagguaggaaagaagaguuacuauuccu

SEQ ID NO: 264114 - RNA, 64 nt, Human
aucuuaaucaucccaguuccuaggcaacuuguucaccagguacgcaagggccgaauaguugaga

SEQ ID NO: 264115 - RNA, 64 nt, Human
gaggcaagauuccucuuaauugauaaccaggacaaccagguagucacccaguccucucuaagca

SEQ ID NO: 264116 - RNA, 64 nt, Human
ggggaaaggauauguuuauugacacauaaucuguaccagguaugcauuaaaauauauuuguuaa

SEQ ID NO: 264117 - RNA, 64 nt, Human
cgaaguucagauaacuggguuggcucucaauuagaccagguaguuuguugcauugcagguaagu

SEQ ID NO: 264118 - RNA, 64 nt, Human
aucagcugaaaguuuuugaaacaaauauuugaaaaccagguauccacacauagcacuuuuauuc

SEQ ID NO: 264119 - RNA, 62 nt, Human
caagugugugcucagagcaucuuuguucuucacggcagcagcuaccuucccucacugucuca

SEQ ID NO: 264120 - RNA, 62 nt, Human
auggugggaggcaaaaagcacuucuuacauggcggcagcaagagaaaaugagaaagaagcaa

SEQ ID NO: 264121 - RNA, 62 nt, Human
gugaccagacacugcccacugcagugccaagacggcagcaggacuggggcugauagcccacc

SEQ ID NO: 264122 - RNA, 62 nt, Human
ccucugcucuguacccuuuuuccuuuuguccccggcagcagggaagaagcuggaggccgugg

SEQ ID NO: 264123 - RNA, 64 nt, Human
ugaaccuacuacccagguuaagaaaauaaaugucaccagguacuugagaaaccccucgauuguc

SEQ ID NO: 264124 - RNA, 64 nt, Human
agcagguagaauacagcuccuuaucguucuauguaccagguauuuuauuacugaacuagcaacu

SEQ ID NO: 264125 - RNA, 64 nt, Human
guguaaggguuagcuaccacccuauaaccucccuaccagguaauaaggagaccaagucuuugau

SEQ ID NO: 264126 - RNA, 64 nt, Human
caggcccccaagaagcugauccgauacaucgacaaccagguagugagcaccaaaggggagcgau

SEQ ID NO: 264127 - RNA, 64 nt, Human
ugcaaagcaguuaagcaacugguccaagaucuagaccagguacucaaccaccccacuccacaug

SEQ ID NO: 264128 - RNA, 64 nt, Human
guccgggcugugauggcaccaaggcagguggagcaccagguaccacacagcugggcuucccacc

SEQ ID NO: 264129 - RNA, 64 nt, Human
guauauagaucaaauguuuuuuuugguauauauaaccagguacaccagagcuuacauauguuug

SEQ ID NO: 264130 - RNA, 64 nt, Human
aaagaagcuuuugggaagugaugagucauuuugcaccagguaauaggggaaaauugugugaccu

SEQ ID NO: 264131 - RNA, 64 nt, Human
cuacauacaucucucagguggugccaagaggcacaccagguagagcaaacuuagcagcucugac

SEQ ID NO: 264132 - RNA, 64 nt, Human
acccuaaaaacacccacauaugcuuuucgauggaaccagguaaguugacgcuaaaguucuuaug

SEQ ID NO: 264133 - RNA, 64 nt, Human
uuuuuuuuuuucuggcuaaaauaguuugcaaaggaccagguaauuggggaggggagagaggugg

SEQ ID NO: 264134 - RNA, 64 nt, Human
caaaacacaaucaugauauucuaacuguggucaaaccagguacccaagccaccucccugcccaa

SEQ ID NO: 264135 - RNA, 64 nt, Human
agcacuguguuccuguugucgugguucaagacccaccagguauuuucagauuauaaaacuuuuc

SEQ ID NO: 264136 - RNA, 64 nt, Human
cauaauuugcuaguagugcuaacuaaaauuuuacaccagguaaaaucaggucaccuuuuuuaug

SEQ ID NO: 264137 - RNA, 64 nt, Human
acuugcuggcgugacaagugcccacaaguaacacaccagguacccagagcaggguggacaggag

SEQ ID NO: 264138 - RNA, 64 nt, Human; identical to SEQ ID NO: 107956

SEQ ID NO: 264139 - RNA, 64 nt, Human; identical to SEQ ID NO: 107957

SEQ ID NO: 264140 - RNA, 64 nt, Human; identical to SEQ ID NO: 107958

SEQ ID NO: 264141 - RNA, 64 nt, Human; identical to SEQ ID NO: 107959

SEQ ID NO: 264142 - RNA, 64 nt, Human
gguuuuugugacuuuauuuuuuuaauucacaaggaccagguacaguagcugaaacccaauucag

SEQ ID NO: 264143 - RNA, 64 nt, Human
uuuuugggauggguugcccugaauaacauuacggaccagguaaauaauuucauagaaguucagu

SEQ ID NO: 264144 - RNA, 64 nt, Human
ugcugaaggcaugauguaugcggcuccacuugagaccagguaucaggauguucagagggagcca

SEQ ID NO: 264145 - RNA, 64 nt, Human
aaagucaucugaauccuugguucucuuuauacucaccagguacaaauuacugguauguuuuaua

SEQ ID NO: 264146 - RNA, 64 nt, Human
cauaaaccugcagagagaagucucgaaaggcuccaccagguaccaagggcagcugcuuuuccug

SEQ ID NO: 264147 - RNA, 64 nt, Human
ccgugcacuucuccucucugggccuuggcuugggaccagguacgaaggauccccaagcccuuca

SEQ ID NO: 264148 - RNA, 64 nt, Human
aacccuacaauuacuucagguagcuacacaauauaccagguaagaaucaaugcacaguauaaag

SEQ ID NO: 264149 - RNA, 64 nt, Human
aguuuuguuuacuggggugaacaucuuuccaguaaccagguaguccugguacuccuuuaguuuu

SEQ ID NO: 264150 - RNA, 64 nt, Human
auaaagaagagauuaacuuuccauauaaauaaauaccagguaugaaauuacugauuuuagugca

SEQ ID NO: 264151 - RNA, 64 nt, Human
ugacauuuucuauuuugacuguuuucauacuauaaccagguaaagggacuucuuucagagagcu

SEQ ID NO: 264152 - RNA, 64 nt, Human
ccuguaaaauauaacaaagggcaucauuaaguagaccagguaauuacugcuugucucucaaggc

SEQ ID NO: 264153 - RNA, 64 nt, Human
cccagcauuagcucagcaucugucagagcaagagaccagguaauuucuaagaacaggguucuag

SEQ ID NO: 264154 - RNA, 64 nt, Human
uucaauuucuucaccucuaaaaugggggacuuggaccagguagauugcugagcucacuaccagg

SEQ ID NO: 264155 - RNA, 64 nt, Human
gaaagacuuagaacauacacagauccuaaguagaaccagguaauugucucuuuuucuaauaagg

SEQ ID NO: 264156 - RNA, 64 nt, Human
cuucaccauugucaaccagcagucaaggaugagcaccagguauaguccugguuugauaucucac

SEQ ID NO: 264157 - RNA, 64 nt, Human; identical to SEQ ID NO: 107855

SEQ ID NO: 264158 - RNA, 64 nt, Human; identical to SEQ ID NO: 107856

SEQ ID NO: 264159 - RNA, 64 nt, Human; identical to SEQ ID NO: 107857

SEQ ID NO: 264160 - RNA, 64 nt, Human; identical to SEQ ID NO: 107858

SEQ ID NO: 264161 - RNA, 64 nt, Human
ugcauaaugacaaauauuuaagauugcagacgggaccagguauucuuaauugggaaaacaguca

SEQ ID NO: 264162 - RNA, 64 nt, Human
ucauucauaagguagguuuucuuacaaaacucacaccagguacuuaaagaugugcucugcuuuu

SEQ ID NO: 264163 - RNA, 64 nt, Human
uucaauaauugaacugaguuaacauucuugguaaaccagguaauugaaugaagaaaggucacua

SEQ ID NO: 264164 - RNA, 64 nt, Human
cacacaccagaaaaacaaaagacagcagaaaauaaccagguauucuuagagcuauagauuuuug

SEQ ID NO: 264165 - RNA, 64 nt, Human
auagaggggcugcuuuaugggaaguuuuucucugaccagguacaacaccugacuuuaaaggccu

SEQ ID NO: 264166 - RNA, 64 nt, Human
ugggaaccacggcccuucucuucugugggucuguaccagguacuccaggccagcccaugggccc

SEQ ID NO: 264167 - RNA, 64 nt, Human
auguuucgcagaaaaguguccccaaggaagugccaccagguacuaaguccucuccagguugguc

SEQ ID NO: 264168 - RNA, 64 nt, Human
ucucucuccucccacccccauaggaucaguguguaccagguacacauuguuccuguuaacagca

SEQ ID NO: 264169 - RNA, 64 nt, Human
uuaccucccucccuccuucccaaggcuggcacuaaccagguaccacauucauuguuaaggaaug

SEQ ID NO: 264170 - RNA, 64 nt, Human
ucuuugggucuuacuauuuuuacccauaaaagugaccagguagacccuuuuuaauuacauucac

SEQ ID NO: 264171 - RNA, 64 nt, Human
ucugugaccagccccggauucaggcuguacuaauaccagguauauuguggaauuuaguauaaag

SEQ ID NO: 264172 - RNA, 64 nt, Human
agucuugaguuucuaagaggguucuuuauguuauaccagguaaguguauaaaagagauuaagug

SEQ ID NO: 264173 - RNA, 64 nt, Human
aaguguaacacauucuuacugguuaaagacgacuaccagguaucuaacuuguuuaacauugagu

SEQ ID NO: 264174 - RNA, 64 nt, Human
uuaucauugaagaauagcuuaaaugacugcaguaaccagguaauauuggcaaaggcaucucagg

SEQ ID NO: 264175 - RNA, 64 nt, Human
ccagaagcagcagccacuguugcugccacugaccaccagguagacagcgcaaucuguggagcuu

SEQ ID NO: 264176 - RNA, 64 nt, Human; identical to SEQ ID NO: 107861

SEQ ID NO: 264177 - RNA, 64 nt, Human; identical to SEQ ID NO: 107862

SEQ ID NO: 264178 - RNA, 64 nt, Human; identical to SEQ ID NO: 107863

SEQ ID NO: 264179 - RNA, 64 nt, Human; identical to SEQ ID NO: 107864

SEQ ID NO: 264180 - RNA, 64 nt, Human
gcacacaugcucugcaggauguggccauccugucaccagguaguuuuucccugccagagauggc

SEQ ID NO: 264181 - RNA, 64 nt, Human
cagucagcgucugcugcuugugaagaaauagccuaccagguagcuggcgucucugggaaccugg

SEQ ID NO: 264182 - RNA, 64 nt, Human
cacggagcucccaguccuaaucacauucaaggucaccagguacaguuguacagguuguacacug

SEQ ID NO: 264183 - RNA, 64 nt, Human
gaccaacguggaaaagucugaagggccuugggagaccagguagcaccuggccccaucaugaugc

SEQ ID NO: 264184 - RNA, 64 nt, Human
gcggaacccccacgaggugaagccagccuaugccaccagguacgccaucacugucugguauuuu

SEQ ID NO: 264185 - RNA, 64 nt, Human
cacaaaaaguauaaaauaccuaggaauacagccaaccagguaagugaaagauuucuacaaugag

SEQ ID NO: 264186 - RNA, 64 nt, Human
guccggggaagggcagaggucaccaggcuggucuaccagguaguuggggaggguccccagccaa

SEQ ID NO: 264187 - RNA, 64 nt, Human
gccuucuguaggucggaggaauggaggcuuacuaaccagguaagccuucuaugcauccacacca

SEQ ID NO: 264188 - RNA, 64 nt, Human
cuaccaaaugguggggacccugagcccagcucugaccagguagagccugugcagccugggcugc

SEQ ID NO: 264189 - RNA, 64 nt, Human
aaggucuagggguagaaaggggagggguggggcuaccagguagcaguugacaacccaaggucag

SEQ ID NO: 264190 - RNA, 64 nt, Human
gacucuagaggaugaauuagcaagaggguauuuuaccagguaugaucugacuucaguugugccc

SEQ ID NO: 264191 - RNA, 64 nt, Human
caucuugagaucaccaggcaagagaguugccugcaccagguaagaggccaaagccccuggggua

SEQ ID NO: 264192 - RNA, 64 nt, Human
ccuuccccacccacugccugagccuucugagcagaccagguaccuuggcugcaccggugugugg

SEQ ID NO: 264193 - RNA, 64 nt, Human
cagcugcuggugauccucagccggagggcaggguaccagguaagcuuaacuccaucuugggugu

SEQ ID NO: 264194 - RNA, 64 nt, Human
gguaagggccugccucagcgugguugggagucugaccagguaggacuugaaugauucggcuacc

SEQ ID NO: 264195 - RNA, 64 nt, Human; identical to SEQ ID NO: 107867

SEQ ID NO: 264196 - RNA, 64 nt, Human; identical to SEQ ID NO: 107868

SEQ ID NO: 264197 - RNA, 64 nt, Human; identical to SEQ ID NO: 107869

SEQ ID NO: 264198 - RNA, 64 nt, Human; identical to SEQ ID NO: 107870

SEQ ID NO: 264199 - RNA, 64 nt, Human
cuucauucaaugggcacaauaugcuguguaucucaccagguagcugucaggggccaccgagagu

SEQ ID NO: 264200 - RNA, 64 nt, Human
guaauaguaaacacagggaagagcuccccuacggaccagguauagagaaaggucuaugcagaaa

SEQ ID NO: 264201 - RNA, 64 nt, Human
ugcagugacucaaguugucucuuuaucaugguuuaccagguagagugccuggcuauuacuauau

SEQ ID NO: 264202 - RNA, 64 nt, Human
uaaaagagggggugagaauaaugagauaucugaaaccagguagaaggaagccuagauuguaaga

SEQ ID NO: 264203 - RNA, 64 nt, Human
gguuagaucaaucagcagauauuggguccgguauaccagguauuauuuugggguaagcuaacaa

SEQ ID NO: 264204 - RNA, 64 nt, Human
cccuuugcccuauuuucuguucaguuuuuuaaaaguguuguaagagacuccugaggaagacaca

SEQ ID NO: 264205 - RNA, 64 nt, Human
uggaaauuccuuaauguuuauuagcuucuaacuaguguuguaaguccgaugccagaauuuggag

SEQ ID NO: 264206 - RNA, 64 nt, Human
caugacccaggaaggccgggguggaucccucuuuguguuguaguccaugcuauuaaaagugugg

SEQ ID NO: 264207 - RNA, 64 nt, Human
uuagcaugcaauugguauuugacuuggaaguguuguguuguauuuuuugaaccccuaggcuuca

SEQ ID NO: 264208 - RNA, 64 nt, Human
uuaacaacauucuauuugcucuuuguauauuuaaguguuguaaggaaacguguuucaaucaaaa

SEQ ID NO: 264209 - RNA, 64 nt, Human
uaucucauguguaauugugggccuuuauaaaauuguguuguaagauaucaagcaacuuuuguaa

SEQ ID NO: 264210 - RNA, 64 nt, Human
guaucauuuaguauuuguaucacuguaccauuuaguguuguauaucacucagucauuuaauauu

SEQ ID NO: 264211 - RNA, 64 nt, Human
gaauaguuucaaaauaauuuucagugauaaaagaguguuguaauuaaucauauuacacuaaaau

SEQ ID NO: 264212 - RNA, 64 nt, Human
uuucccucucagacauagcucuuuggagaacuagguguuguaauucaguuaugaagcuauuuuc

SEQ ID NO: 264213 - RNA, 64 nt, Human
auguaaacuugcuguuuuuguuuuuuccugccggguguuguauguguggugacuugcggauuua

SEQ ID NO: 264214 - RNA, 64 nt, Human; identical to SEQ ID NO: 107873

SEQ ID NO: 264215 - RNA, 64 nt, Human; identical to SEQ ID NO: 107874

SEQ ID NO: 264216 - RNA, 64 nt, Human; identical to SEQ ID NO: 107875

SEQ ID NO: 264217 - RNA, 64 nt, Human; identical to SEQ ID NO: 107876

SEQ ID NO: 264218 - RNA, 64 nt, Human
uuuacuagcuaaaacauaaucacaaagcuuuaucguguuguauaaaaaaauuaacaauauaaug

SEQ ID NO: 264219 - RNA, 64 nt, Human
ucaaguauuaacauucucuauuaaauaagaggagguguuguaaagagcugcuaguagguucgcu

SEQ ID NO: 264220 - RNA, 64 nt, Human
cuucucuauuucuggaugaaugcccagugagacuguguuguacagcuagaaaaggccuucuucc

SEQ ID NO: 264221 - RNA, 64 nt, Human
uccaaguaaacuuuccaaggacuucuuccuguugguguuguaagaaaaggcccaugcuuguccg

SEQ ID NO: 264222 - RNA, 64 nt, Human
cccaggcccagccaggacuuugccuaccccagcuguguuguaaaccaggucccccuccugaccu

SEQ ID NO: 264223 - RNA, 64 nt, Human
uguauauucucaccuuuuauggucguagcauauaguguuguauauuguaaauuguaauuucaac

SEQ ID NO: 264224 - RNA, 64 nt, Human
uuacacuacaugcagauccauaguauccuuuguaguguuguaaauacuuuugcuuugaaaacuu

SEQ ID NO: 264225 - RNA, 64 nt, Human
gcaaauguuaaauguguuaagccuuguaguacuaguguuguaacuuuccaaguaaagguguccc

SEQ ID NO: 264226 - RNA, 64 nt, Human
uaauacagauauuauuaaaguuucugguuuugagguguuguagauaaauguauuuaugugccua

SEQ ID NO: 264227 - RNA, 64 nt, Human
aucacaaaauaaaaaagguuugccaagcucagugguguuguauuuuuuauuuuccaauacugca

SEQ ID NO: 264228 - RNA, 64 nt, Human
uggugcccuccccucaccccacuguagcugugacguguuguaguuuuuagauguuuguaaaaug

SEQ ID NO: 264229 - RNA, 64 nt, Human
ggggagucuguacugagauggaacugucagugcuguguuguauguacuugcuguuguaaaaguu

SEQ ID NO: 264230 - RNA, 64 nt, Human
acagagcguuacuugauaacagcguuccaucuuuguguuguagcagaugaaauggacaguaaug

SEQ ID NO: 264231 - RNA, 64 nt, Human
aaaaaccagucaagagcaaucaaagcagcacaugguguuguauacuucauuagcaagugaguuu

SEQ ID NO: 264232 - RNA, 64 nt, Human
ggaauacaguguuauuuucuuugaaauuguuuaaguguuguaaauauuuauguaaacugcauua

SEQ ID NO: 264233 - RNA, 64 nt, Human; identical to SEQ ID NO: 107894

SEQ ID NO: 264234 - RNA, 64 nt, Human; identical to SEQ ID NO: 107962

SEQ ID NO: 264235 - RNA, 64 nt, Human; identical to SEQ ID NO: 107963

SEQ ID NO: 264236 - RNA, 64 nt, Human; identical to SEQ ID NO: 107964

SEQ ID NO: 264237 - RNA, 64 nt, Human
cuuuucugcauugaaugcuuugugccuuuucgauguguuguaguugcuuagaguugauucugcu

SEQ ID NO: 264238 - RNA, 64 nt, Human
ccucugaucccuuccaucugaaagguuacaaggaguguuguagcuucugaaggugcagaaaaca

SEQ ID NO: 264239 - RNA, 64 nt, Human
ucaauuaguaugggaacuugacuaaagacccccaguguuguaacguaccuuuguacccagacaa

SEQ ID NO: 264240 - RNA, 64 nt, Human
gaugcaaugauaaaaaucacuguaauacuucauuguguuguacuggaugcaaagcuagaaaaua

SEQ ID NO: 264241 - RNA, 64 nt, Human
agauugugaccuuuuagauucgguguugagcucuguguuguauuacuuccuaaaagauaaugcu

SEQ ID NO: 264242 - RNA, 64 nt, Human
uugaacuguuuuuuuuuuuauuaaagccaaauuuguguuguauauauucguauuccauguguua

SEQ ID NO: 264243 - RNA, 64 nt, Human
uaauuuguaauuuucguuucagaagcaaauauucguguuguacaaauuucugauugcccuaaau

SEQ ID NO: 264244 - RNA, 64 nt, Human
cacauggagcaggaacuggaguaaaugcaauacuguguuguaauaucccaacaaaaaucagaca

SEQ ID NO: 264245 - RNA, 64 nt, Human
aaagguuuauuugucuuaauaaauugaauacuagguguuguaaggaagugagaccagaaggaca

SEQ ID NO: 264246 - RNA, 64 nt, Human
gguuaauuuauuuucauguuaugccaguaauauaguguuguaugccuauugagugauuguggca

SEQ ID NO: 264247 - RNA, 64 nt, Human
uguuugggaggcauagugcugacauauauucagaguguuguaguuuuaagguuagcgugacuuc

SEQ ID NO: 264248 - RNA, 64 nt, Human
uuuacgucccugcccucuuugaccuggcaauauaguguuguauaauguaaauuuauuucuccaa

SEQ ID NO: 264249 - RNA, 64 nt, Human
caugcuuugugacuaaugcaagaaagcaaguccuguguuguauuuguucuagucauuuuuauuc

SEQ ID NO: 264250 - RNA, 64 nt, Human
cugaagaaagcucuggcuggcugacaggaucccuguguuguaauuggucccuccuuucagcucu

SEQ ID NO: 264251 - RNA, 64 nt, Human
ccaaaguccauaguuuacaugaagauucacucugguguuguacauuguaugggcuuagacaaau

SEQ ID NO: 264252 - RNA, 64 nt, Human; identical to SEQ ID NO: 107879

SEQ ID NO: 264253 - RNA, 64 nt, Human; identical to SEQ ID NO: 107880

SEQ ID NO: 264254 - RNA, 64 nt, Human; identical to SEQ ID NO: 107881

SEQ ID NO: 264255 - RNA, 64 nt, Human; identical to SEQ ID NO: 107882

SEQ ID NO: 264256 - RNA, 64 nt, Human
cucagauggccgccuuugagaguuuuacgugaauguguuguauacaacacuggcaaagaaauga

SEQ ID NO: 264257 - RNA, 64 nt, Human
guuuguaacaccguccaacauuccuuguuuguaaguguuguauguaccguugauguugauaaaa

SEQ ID NO: 264258 - RNA, 64 nt, Human
ccaauuuaacucauguuaucaucauuagugaucuguguuguagaacaugaggguguaagccuuc

SEQ ID NO: 264259 - RNA, 64 nt, Human
cuaucuuuguguugcagccucaaccaacaacaauguguuguaaaaaugucuuucauguaaaaag

SEQ ID NO: 264260 - RNA, 64 nt, Human
ccauccaaaccuaccuuauagagcacaauauuaaguguuguacaauuacugugagaacugugaa

SEQ ID NO: 264261 - RNA, 64 nt, Human
uuuguuacaauuaaacuggauacuuauuugcaaaguguuguagcuuauaaugaacucuuaagua

SEQ ID NO: 264262 - RNA, 64 nt, Human
uggaguuggaaggguacuacucugugauucagguguguuguacccauauuuauaauuaggcuuu

SEQ ID NO: 264263 - RNA, 64 nt, Human
gauguguucuucuuucucuguauuccgauacaaaguguuguaucaaagugugauauacaaagug

SEQ ID NO: 264264 - RNA, 64 nt, Human
gaacagcccggagccugaugugaaaggaccacggguguuguaagcugggacacggaagccaaac

SEQ ID NO: 264265 - RNA, 64 nt, Human
agaaucaggacagaaaaugguuccauuuugcccaguguuguaccacaagaacacaacaccuugc

SEQ ID NO: 264266 - RNA, 64 nt, Human
cuauuuugaaaauaguguugugugaaugcuguaaguguuguacaugucucugguuucagaauua

SEQ ID NO: 264267 - RNA, 64 nt, Human
aaaagcauguugcauucaccuaggccaagaaacaguguuguagguuaagggcauggacugcuug

SEQ ID NO: 264268 - RNA, 64 nt, Human
ggcccucucagaggugcagcuuccaugucaguugguguuguaaccauggaaaagucccuuucca

SEQ ID NO: 264269 - RNA, 64 nt, Human
auagaaaugauuuggguauaauuuaagaguccuuguguuguacagauauggugacugauguagu

SEQ ID NO: 264270 - RNA, 64 nt, Human
uguguaagcuggaaucuguggcaacuauuacccuguguuguauuucccaagugucuggauggau

SEQ ID NO: 264271 - RNA, 64 nt, Human; identical to SEQ ID NO: 107883

SEQ ID NO: 264272 - RNA, 64 nt, Human; identical to SEQ ID NO: 107885

SEQ ID NO: 264273 - RNA, 64 nt, Human; identical to SEQ ID NO: 107886

SEQ ID NO: 264274 - RNA, 64 nt, Human; identical to SEQ ID NO: 107887

SEQ ID NO: 264275 - RNA, 64 nt, Human
ucuaugccaaaacauaccuucaggauauuguuauguguuguauagauguuaaguguuucaugug

SEQ ID NO: 264276 - RNA, 64 nt, Human
acuugggauuuuccucucuuaaccgucaacaucaguguuguaaauuugcuaaacugauucacuu

SEQ ID NO: 264277 - RNA, 64 nt, Human
ggguugcaaaaucauuuuuucccuuaauaccuggguguuguauuagaucucauaauuugacaag

SEQ ID NO: 264278 - RNA, 64 nt, Human
uguccaauugaguagcugcaugcuguucccccagguguuguaacacaacuuuauugauugaauu

SEQ ID NO: 264279 - RNA, 64 nt, Human
cucacaaagcucuucaagcauggaagugggaguuguguuguacuucauggcacucugaugccug

SEQ ID NO: 264280 - RNA, 64 nt, Human
aguagaaaacaaacauuggguccgacuucaaaauguguuguauuguccuacagugucauaaaga

SEQ ID NO: 264281 - RNA, 64 nt, Human
auaggcugugcaucagacaaaagcuugaauauuuguguuguaugcuuguuccaaccaccgcuug

SEQ ID NO: 264282 - RNA, 64 nt, Human
gaagaggaaaaauaacacagaggaguuaugaccaguguuguaaggaucuggccuagaaauggca

SEQ ID NO: 264283 - RNA, 64 nt, Human
uacuucuuuaauugaucuaauuuacauauucugcguguuguauucagcacuaaaaaaugguggg

SEQ ID NO: 264284 - RNA, 64 nt, Human
ggguagugucuggggcagugcugguagccugcauguguuguaaaucauccugccauaacaaagg

SEQ ID NO: 264285 - RNA, 64 nt, Human
uguuccauugcuagcuguccugcuguuuaacacaguguuguauuuuuuuucuaaauguacauaa

SEQ ID NO: 264286 - RNA, 64 nt, Human
ccgcuuaaccaagcuguugugguuuuucagcauaguguuguauguuccauugcuagcuguccug

SEQ ID NO: 264287 - RNA, 64 nt, Human
aaauauugaaguaugaugguuugacuguauggcaguguuguagcagccucuuguuuuuuucccc

SEQ ID NO: 264288 - RNA, 64 nt, Human
ugacugcagacuuuguuuccccuuaguaugugcuguguuguaaauuuuucuccucccuccuccu

SEQ ID NO: 264289 - RNA, 64 nt, Human
cuguaugguuguuugauucuaucaacaauugaaaguguuguauaugacccacauuuaccuaguu

SEQ ID NO: 264290 - RNA, 64 nt, Human; identical to SEQ ID NO: 107890

SEQ ID NO: 264291 - RNA, 64 nt, Human; identical to SEQ ID NO: 107891

SEQ ID NO: 264292 - RNA, 64 nt, Human; identical to SEQ ID NO: 107892

SEQ ID NO: 264293 - RNA, 64 nt, Human; identical to SEQ ID NO: 107893

SEQ ID NO: 264294 - RNA, 64 nt, Human
ugcuguauuuugauaaaauucacuuauuguauguguguuguaaucuaaaaaaaaaaagaaugac

SEQ ID NO: 264295 - RNA, 64 nt, Human
cuuuauugucucccgcuucucagauaguuuugauguguuguacaguggaauaucuuagauacuu

SEQ ID NO: 264296 - RNA, 64 nt, Human
auaauuauugguaauuuuaugagcugugagaaggguguuguaguuuauaaaagacugucuuaau

SEQ ID NO: 264297 - RNA, 64 nt, Human; identical to SEQ ID NO: 264296

SEQ ID NO: 264298 - RNA, 64 nt, Human
uuuguauucauguucaugugauuaacucuuagaaguguuguaaaagaugcagaguaaguauuau

SEQ ID NO: 264299 - RNA, 64 nt, Human
cugugcacauguuuaccugauacagcagugcugcguguuguacauacuuggaacaacaaacuag

SEQ ID NO: 264300 - RNA, 64 nt, Human
cuuuggcucacucucacuugaagaggggaucuugguguuguaguacuuggacuguacaaauguu

SEQ ID NO: 264301 - RNA, 64 nt, Human
uuauucggaccaagcagagcucacagcuggacagguguuguauauagaguggaaucucuuggau

SEQ ID NO: 264302 - RNA, 64 nt, Human
auccuuucuucuucugagaaugugacuuuuucugguguuguaaaaaagaaaaaaaaaagaaugc

SEQ ID NO: 264303 - RNA, 64 nt, Human
uugcuauauuugcuaauaccaacuauuucaauaaguguuguaccauauguagcauuaaauauaa

SEQ ID NO: 264304 - RNA, 64 nt, Human
ggcaguuagugaauguaagaaguacaguguuaaaguguuguaaacaguuacucagugcaaugua

SEQ ID NO: 264305 - RNA, 64 nt, Human
uuuuucuuccaguuuguugguuuuuaaugguaccguguuguaaagauacccacuaauggacaau

SEQ ID NO: 264306 - RNA, 64 nt, Human
ugacugauuucaauaacugugaaaaauaaaaaagguguuguauugcuugugagaacuugaacug

SEQ ID NO: 264307 - RNA, 64 nt, Human
uuuccuugugucuucaguguggcuuucuuccucaguguuguagguugagcgaaugcuaccagag

SEQ ID NO: 264308 - RNA, 64 nt, Human
uuggaaacauuuuugagauauuaaagauuggaauguguuguaaguuucuuugcuuacuuuuacu

SEQ ID NO: 264309 - RNA, 64 nt, Human; identical to SEQ ID NO: 107831

SEQ ID NO: 264310 - RNA, 64 nt, Human; identical to SEQ ID NO: 107853

SEQ ID NO: 264311 - RNA, 64 nt, Human; identical to SEQ ID NO: 107859

SEQ ID NO: 264312 - RNA, 64 nt, Human; identical to SEQ ID NO: 107896

SEQ ID NO: 264313 - RNA, 64 nt, Human
uggaaggcaugggguugccaguaccacaaaaacuguguuguauauaauguaaagauuaaaaugg

SEQ ID NO: 264314 - RNA, 64 nt, Human
uggaauacuuuuuuuaaagaaauucuuaucauggguguuguaauaaugaagacgaauuugacuu

SEQ ID NO: 264315 - RNA, 64 nt, Human
ggagggaggugggugggucaggugaguggaagggguguuguauauuguguugaugacguacguu

SEQ ID NO: 264316 - RNA, 64 nt, Human
aaauguuuacuguuagaauucuauuaaauuuuaaguguuguauucuuuuucauugggugauguc

SEQ ID NO: 264317 - RNA, 64 nt, Human
uaacuacuuaccggaucccuccauauuaucauggguguuguauuuuuccaaaaugacuucuuaa

SEQ ID NO: 264318 - RNA, 64 nt, Human
ugggaguaggcaaacuacuaaucaguuuagcuuuguguuguaugcuaguuuaaaaaagaaaaua

SEQ ID NO: 264319 - RNA, 64 nt, Human
ggguuauuuacuacgguagugcaaauaacuuuugguguuguagcuaaauaaggaauacucaugc

SEQ ID NO: 264320 - RNA, 64 nt, Human
ucagcuguggacucugugaccuuugucuaaaccuguguuguaagaucuugggacuuccucucuu

SEQ ID NO: 264321 - RNA, 64 nt, Human
aggcaugcauaaccuuccucuuagaaaauggcagguguuguaauuucaaauuuuugugcaauua

SEQ ID NO: 264322 - RNA, 64 nt, Human
uuaaucacaaaacuaagaauacauccaaagaauaguguuguaacuaugaaaaagaauacuuuga

SEQ ID NO: 264323 - RNA, 64 nt, Human
gagagaugaccagguguacaguucugaccauccuguguuguaaguacccguggaauggauuugu

SEQ ID NO: 264324 - RNA, 64 nt, Human
ucagguauucaccaauuuccccauguaagguacuguguuguaccuuuauuucuguauuucuaaa

SEQ ID NO: 264325 - RNA, 64 nt, Human
aauaaaucagguaaacauuuuaaccugucguuaaguguuguaacuucaaaaaaccaaaaugcuu

SEQ ID NO: 264326 - RNA, 64 nt, Human
ggcaaagccaugguguguguucagcucuuggccuguguuguaaacuuaguugcacuucaguucc

SEQ ID NO: 264327 - RNA, 61 nt, Human
cuguuagacgcaggaaauaaaggucacauugguguuguacucaauuuuaacaacagcuggu

SEQ ID NO: 264328 - RNA, 64 nt, Human; identical to SEQ ID NO: 107820

SEQ ID NO: 264329 - RNA, 64 nt, Human; identical to SEQ ID NO: 107865

SEQ ID NO: 264330 - RNA, 64 nt, Human; identical to SEQ ID NO: 107911

SEQ ID NO: 264331 - RNA, 64 nt, Human; identical to SEQ ID NO: 107917

SEQ ID NO: 264332 - RNA, 64 nt, Human
gggaggauggaggcagcugaccucuccaguugcuguguuguauuccuacccaauuuccugggca

SEQ ID NO: 264333 - RNA, 64 nt, Human
gcagauuauucugcagagagggaauugcauguuuguguuguauauuuaguaugaacuuuuuuca

SEQ ID NO: 264334 - RNA, 64 nt, Human
aacaaaguucauuguuuuaggguuuuuaaaaaacguguuguaccuaaggccauacuuacucuuc

SEQ ID NO: 264335 - RNA, 64 nt, Human
acaaauccuuccagagggaaaguucuuuguuuaaguguuguacuugaaaaggucaaucuucagg

SEQ ID NO: 264336 - RNA, 64 nt, Human
auaauuuacacccuugaaggugaucucuuguuuuguguuguaaauauauuguuuguauguuucc

SEQ ID NO: 264337 - RNA, 64 nt, Human
auguugugugugaacuguuguuucuuugccacauguguuguauuugaaaguuuuacaguaaguu

SEQ ID NO: 264338 - RNA, 64 nt, Human
caauaaaugcccaauaaauauuuguugaccauauguguuguacacuguggugcccuguccaguc

SEQ ID NO: 264339 - RNA, 64 nt, Human
auaagaguaguugaacugagcaauaccuccuccuguguuguauuacacauauuagccacgaguu

SEQ ID NO: 264340 - RNA, 64 nt, Human
cauuuagaauucuaguguuucaaaacacuuuuguguguuguauggucaauaacauuuuucauua

SEQ ID NO: 264341 - RNA, 64 nt, Human
ccauuacucuauugauacaauauugugcaugcuaguguuguauuucuauacaguagcuugaaau

SEQ ID NO: 264342 - RNA, 64 nt, Human
aaacaaacaaacaaacaaaaaagauauugcaguuguguuguaagcguccuuaucuuucagagcu

SEQ ID NO: 264343 - RNA, 64 nt, Human
ccuuugcaauaacuagauugugaaaagcuaacaaguguuguaacaauaauccauuguuugaggu

SEQ ID NO: 264344 - RNA, 64 nt, Human
caagguggggacguguguccuuugguacuaugguguguuguaucuuuguaagagcaaaagccuc

SEQ ID NO: 264345 - RNA, 64 nt, Human
aagaaagaaauaaaaacccugaaacaugacgagaguguuguaaaguguggaaaugccuucuuaa

SEQ ID NO: 264346 - RNA, 64 nt, Human
uaaacacauacacaccuccaguuuuugcucuuuuguguuguacugaacacaauauuuguguuuu

SEQ ID NO: 264347 - RNA, 64 nt, Human; identical to SEQ ID NO: 107847

SEQ ID NO: 264348 - RNA, 64 nt, Human; identical to SEQ ID NO: 107899

SEQ ID NO: 264349 - RNA, 64 nt, Human; identical to SEQ ID NO: 107900

SEQ ID NO: 264350 - RNA, 64 nt, Human; identical to SEQ ID NO: 107901

SEQ ID NO: 264351 - RNA, 64 nt, Human
gguuauuguacuuccauucauacucugggcacuuguguuguauuguucuguuacauacuuuuuu

SEQ ID NO: 264352 - RNA, 64 nt, Human
uuccccuuccuucuagagcagaaaagggagagagguguuguauuccuguuugguaaccucaguc

SEQ ID NO: 264353 - RNA, 64 nt, Human
uauuacuuuucuguuuaguuuuacacuaggaaacguguuguaucuacaguaaugaaauguuuac

SEQ ID NO: 264354 - RNA, 64 nt, Human
uucucuuggguaaguaccuaggacuuuaauugcuguguuguaagugucuuaguucauucaggcu

SEQ ID NO: 264355 - RNA, 64 nt, Human
augauucuguuuguuaauauuuugacagauuaagguguuguauaaauaauauucuuuugggggg

SEQ ID NO: 264356 - RNA, 64 nt, Human
acuacuagacuuauuguagguucguuugagcuuuguguuguaaaauuaaaaaugcuucuguaaa

SEQ ID NO: 264357 - RNA, 64 nt, Human
aaugugacugcaugacgugguacagacauuacagguguuguagacagaggcacuugucucgugc

SEQ ID NO: 264358 - RNA, 64 nt, Human
auggaagggccaccucaggagggggauauaauguguguuguaaauauccugugguuuucugccu

SEQ ID NO: 264359 - RNA, 64 nt, Human
cucugggcaucugcaaaaggcccugcucucuggaguguuguauauaguguagcaaaagaguauu

SEQ ID NO: 264360 - RNA, 64 nt, Human
ggauacuaagaugcaucguuugaaaucaucuaguguguuguaugcaguuauccucaaaaacauc

SEQ ID NO: 264361 - RNA, 64 nt, Human
cugccuugaaccugugaguaaauauugaggcuuuguguuguaauucuucaguugguugugucuu

SEQ ID NO: 264362 - RNA, 64 nt, Human
auucuuugcuuagguucauuuacaagauguaucaguguuguaaguccaauaauuuaaguccagu

SEQ ID NO: 264363 - RNA, 64 nt, Human
auacacacccacucgcacaagcuuccauccacauguguuguacuuucagcucuaggcaugcaga

SEQ ID NO: 264364 - RNA, 64 nt, Human
ucuccugccucagccuccugaguagcugggcacgguguuguaccucuagucccagcuacuuggg

SEQ ID NO: 264365 - RNA, 64 nt, Human
uuacugaauuuaguucugugcucuuccuuauuuaguguuguaucauaaauacuuugauguuuca

SEQ ID NO: 264366 - RNA, 64 nt, Human; identical to SEQ ID NO: 107800

SEQ ID NO: 264367 - RNA, 64 nt, Human; identical to SEQ ID NO: 107871

SEQ ID NO: 264368 - RNA, 64 nt, Human; identical to SEQ ID NO: 107904

SEQ ID NO: 264369 - RNA, 64 nt, Human; identical to SEQ ID NO: 107905

SEQ ID NO: 264370 - RNA, 64 nt, Human
acuagaugagcaauuuaaaaagguguagcuauuaguguuguauuuuuucauuuacauuaaugua

SEQ ID NO: 264371 - RNA, 64 nt, Human
gcagcuuugcucuuaggagaaaagcauuucauuaguguuguauuacuugagucuaaggguagau

SEQ ID NO: 264372 - RNA, 64 nt, Human
gccugucacuucgccaccgugcuagaauacuguuguguuguaagaugacuaauuuuaaaagaac

SEQ ID NO: 264373 - RNA, 64 nt, Human
cagccuuugugauguacuguguuuaccuccuuuuguguuguaucugguaauuaaauaggccuca

SEQ ID NO: 264374 - RNA, 64 nt, Human
caucuccagaugagaauuugaaacaagaaacagaguguuguaaaaggacaccuucacugaagca

SEQ ID NO: 264375 - RNA, 64 nt, Human
guaaauguguuauuuugucauuuuuccaaagagaguguuguagguuuucccuguaguucuuccu

SEQ ID NO: 264376 - RNA, 64 nt, Human
ucagaaaucugaccuuugccgaugcugcaauaaaguguuguaauuuagauuuggcgugguguug

SEQ ID NO: 264377 - RNA, 64 nt, Human
aagacuuaauguccuuuagcuuguguauauaauuguguuguauagucucagaguacauucuaac

SEQ ID NO: 264378 - RNA, 64 nt, Human
agcaauacuguccaguuuucuugcuguuuuuccgguguuguacuaaaccucgugcuugugaacu

SEQ ID NO: 264379 - RNA, 64 nt, Human
uugcacugagguuaucuaggcuucacuauccauuguguuguaaauguuugucagaaaugcagcc

SEQ ID NO: 264380 - RNA, 64 nt, Human
agaauacuuggugcuuuccaacacacuuucacauguguuguaacuuguuugauccacccccuuc

SEQ ID NO: 264381 - RNA, 64 nt, Human
uguaaauggucguuuuucuguuaaugaugcuaauguguuguaaacaagauucuaaauuuaaaaa

SEQ ID NO: 264382 - RNA, 64 nt, Human
gaaacagaaaauaaauauugugcuuuaugugguaguguuguacccauucuuaaaaauaaaucac

SEQ ID NO: 264383 - RNA, 64 nt, Human
aauauaaauaauuuuaauauacuagucaugauguguguuguauuuuaaaaauuaucugcaaccu

SEQ ID NO: 264384 - RNA, 64 nt, Human
gaucaacacacacucccacccuugggguaguaguguguuguagucguacuuaccaagcugagca

SEQ ID NO: 264385 - RNA, 64 nt, Human; identical to SEQ ID NO: 107790

SEQ ID NO: 264386 - RNA, 64 nt, Human; identical to SEQ ID NO: 107791

SEQ ID NO: 264387 - RNA, 64 nt, Human; identical to SEQ ID NO: 107792

SEQ ID NO: 264388 - RNA, 64 nt, Human; identical to SEQ ID NO: 107793

SEQ ID NO: 264389 - RNA, 64 nt, Human
acuuuccaaaaccuaaagaggaaaagugcaaugcguguuguacauacagagguaacuaucaaua

SEQ ID NO: 264390 - RNA, 64 nt, Human
cauuuaagucaaugguuguuaaaagaaguuucccguguuguaaaucauguuucccuuaucagau

SEQ ID NO: 264391 - RNA, 64 nt, Human
uguucagcuuggggggcaacuuugauuuuucucuguguuguagucucucauauuuacucaagga

SEQ ID NO: 264392 - RNA, 64 nt, Human
gccuucagggccuggacugcacucacagaggcaaguguuguagacuaacaaagauacuccaaaa

SEQ ID NO: 264393 - RNA, 64 nt, Human
aaguacuuucagugcucaaaaaaaugcaaucacuguguuguauauaauaguucauagguugauc

SEQ ID NO: 264394 - RNA, 64 nt, Human
accccucaacuuuaauuugcccaguuauaccucaguguuguagcaguacugugauaccuggcac

SEQ ID NO: 264395 - RNA, 64 nt, Human
cugaugcagagcgugaccccuccugcugggaccuguguuguaagcuccuauuugcuuaucuugu

SEQ ID NO: 264396 - RNA, 64 nt, Human
aaaagauuuaacaaauacauucauaaggaaauguguguuguaacaaauauauugcaaaaacaua

SEQ ID NO: 264397 - RNA, 64 nt, Human
uuuguauaaaaugugggaaggauuuauuuacaguguguuguaauuuuguaaggccaacuauuua

SEQ ID NO: 264398 - RNA, 64 nt, Human
ugccccccagccccacccacucaugacucuaaguguguuguauuaauauuuauuuauuuggaga

SEQ ID NO: 264399 - RNA, 64 nt, Human
ggguggcaagugccaccuucgcugugcuagaguuguguuguaggaauuagucagggaguuguug

SEQ ID NO: 264400 - RNA, 64 nt, Human
aaucccaguaggcuuuuaccauuagcauaauuuuguguuguacaauuaaguuacaauuacaucu

SEQ ID NO: 264401 - RNA, 64 nt, Human
aagcuccucacugguauacuaucauccuggagggguguuguauggcugagcaagagagagagag

SEQ ID NO: 264402 - RNA, 64 nt, Human
gacaggaucaggagcgauagagagcaggcccucaguguuguacuauuugucucgguccuugugu

SEQ ID NO: 264403 - RNA, 64 nt, Human
uguaaacagcaucacuuugauuacaauagauguaguguuguaauaaacuguuuaauggggcuga

SEQ ID NO: 264404 - RNA, 64 nt, Human; identical to SEQ ID NO: 107796

SEQ ID NO: 264405 - RNA, 64 nt, Human; identical to SEQ ID NO: 107797

SEQ ID NO: 264406 - RNA, 64 nt, Human; identical to SEQ ID NO: 107798

SEQ ID NO: 264407 - RNA, 64 nt, Human; identical to SEQ ID NO: 107799

SEQ ID NO: 264408 - RNA, 64 nt, Human
acaaggcaaaaacuauugaacaguugguuuuaguguguuguauaacuuugcuguauaucaaacu

SEQ ID NO: 264409 - RNA, 64 nt, Human
uuuuccccuuucaagaauuuuuuuuuuuuuugguguguuguacagcaguauaauuuuucacuua

SEQ ID NO: 264410 - RNA, 64 nt, Human
uaaaacaggguuuauucaguugcaucugucuccaguguuguauugacagcucugggucuuuuuu

SEQ ID NO: 264411 - RNA, 64 nt, Human
cccuuugcacuagugucucugcagguugcugguuguguuguaugugcuguuccaugguguugac

SEQ ID NO: 264412 - RNA, 64 nt, Human
gaagacuccauugccaaaccauggccuuuccucaguguuguaaggccuaugccaaggauaaagg

SEQ ID NO: 264413 - RNA, 64 nt, Human
aaugacuuggggaaggcacaaaacaugagagaaaguguuguacagaauuuaucauggauuauug

SEQ ID NO: 264414 - RNA, 64 nt, Human
auaauuggaucagguuuucuuuguguguguguguguguuguaucaugaguguuugggggauaag

SEQ ID NO: 264415 - RNA, 64 nt, Human
uagucccugccucucaagagccacaaaugcauggguguuguauagauccaguugcacuaaauuc

SEQ ID NO: 264416 - RNA, 64 nt, Human
gacaccaguaauuuuaagaaccugcuuagcuucuguguuguauuuaaguuaucucuaaauagau

SEQ ID NO: 264417 - RNA, 64 nt, Human
uacauucuauuccuguaauuauugugcccuuuaaguguuguaaaaucguuuuggaauuugugcc

SEQ ID NO: 264418 - RNA, 64 nt, Human
uauagggaaaagaaaucaccuacucccugacacuguguuguacccuucauccaaaagucagcuu

SEQ ID NO: 264419 - RNA, 64 nt, Human
uuuuguaaauaucagaucagugauacugguguuaguguuguaaucagguuaaacccacuuccau

SEQ ID NO: 264420 - RNA, 64 nt, Human
uaauaacauaaaacuaguauuuguagaagauuauguguuguauauaacaaauuaguauuuauag

SEQ ID NO: 264421 - RNA, 64 nt, Human
gaggugguugcugcucauguagaucuauaaauauguguuguaugucuuuuuugcuuuuuuuuua

SEQ ID NO: 264422 - RNA, 64 nt, Human
agauauuuaacgaaaaaaaagguagaucuugaauguguuguagcacgaauaaauugcuguacuu

SEQ ID NO: 264423 - RNA, 64 nt, Human; identical to SEQ ID NO: 107782

SEQ ID NO: 264424 - RNA, 64 nt, Human; identical to SEQ ID NO: 107802

SEQ ID NO: 264425 - RNA, 64 nt, Human; identical to SEQ ID NO: 107803

SEQ ID NO: 264426 - RNA, 64 nt, Human; identical to SEQ ID NO: 107804

SEQ ID NO: 264427 - RNA, 64 nt, Human
uuccaaagagugauauugacauuuauggagauugguguuguaacauauuuugauaaauacuaac

SEQ ID NO: 264428 - RNA, 64 nt, Human
cuccgagaagccccuaaguuauugaccgguuucaguguuguauauauaaauaugcaagaugugc

SEQ ID NO: 264429 - RNA, 64 nt, Human
uaagaaaauauauagagcauuuuauuuuuuuuuaguguuguaaaauauuaaccucugugagauc

SEQ ID NO: 264430 - RNA, 64 nt, Human
ccagagaucugaucuucaagcaagaaaauaagcaguguuguacuugugaauuuugugauauuuu

SEQ ID NO: 264431 - RNA, 64 nt, Human
uaaucuaugcagcauuucaagaaacaaccauaugguguuguauauuauaaacuggugacauucu

SEQ ID NO: 264432 - RNA, 64 nt, Human
gggccaugaguaaaauagauuuuauaagaugacuguguuguaccaaaauucaucugucuauauu

SEQ ID NO: 264433 - RNA, 64 nt, Human
acauacugggauucuguaaaggacauuaucugggguguuguauguauuuuuguguguucugcuu

SEQ ID NO: 264434 - RNA, 64 nt, Human
ucaacagaagcauuuguauuuugugugaccaacuguguuguauuaacaaaaguucccugaaaca

SEQ ID NO: 264435 - RNA, 64 nt, Human
auuauuugaaguaguucuucaguuauauuuacauguguuguaaauauguaaauauacuuuuagc

SEQ ID NO: 264436 - RNA, 64 nt, Human
ggugcauuuguuccucaaucaagcaagagcaccuguguuguacugcuuuauaucucauguauau

SEQ ID NO: 264437 - RNA, 64 nt, Human
uuaaacuaaacacugugcuucauauuuguacacuguguuguacuacagugaggaauuuccuccu

SEQ ID NO: 264438 - RNA, 64 nt, Human
caaacuuaaagcuacuguaguaccuaaaaagucaguguuguacauagcauaaaaacucugcaga

SEQ ID NO: 264439 - RNA, 64 nt, Human
uacugacuaaacuggaauggaaaucuuauaauuaguguuguauuuuucugcaaaauagugaauu

SEQ ID NO: 264440 - RNA, 64 nt, Human
gcuggcagacgucuccauuguccuuauguugucuguguuguauuuuuuuuuuuuuauugaccau

SEQ ID NO: 264441 - RNA, 64 nt, Human
cagaaccuugagacauaauacaguugugaggaauguguuguaacuuggcuggccaaguuacaug

SEQ ID NO: 264442 - RNA, 64 nt, Human; identical to SEQ ID NO: 107805

SEQ ID NO: 264443 - RNA, 64 nt, Human; identical to SEQ ID NO: 107807

SEQ ID NO: 264444 - RNA, 64 nt, Human; identical to SEQ ID NO: 107808

SEQ ID NO: 264445 - RNA, 64 nt, Human; identical to SEQ ID NO: 107809

SEQ ID NO: 264446 - RNA, 64 nt, Human
agguaacaggcagauacaggaaaagcugcugacaguguuguaugagguuugaggauuuugaucc

SEQ ID NO: 264447 - RNA, 64 nt, Human
uugguucuauucagaaaccugugucguuuuuuugguguuguaguuuauuuugugauuuuuugga

SEQ ID NO: 264448 - RNA, 64 nt, Human
ggagguaaaaaucaauaaaauggcccauucauuuguguuguagcucaucauagauguauuucuu

SEQ ID NO: 264449 - RNA, 64 nt, Human
uuauuuaguuuggggaggggaagcauuuuuaaguguguuguaaaaucaaauuuuauauuucauu

SEQ ID NO: 264450 - RNA, 64 nt, Human
gggucaaagggcaaccagcuugggugcuaccucaguguuguaguuucugauacuuuaugucuuu

SEQ ID NO: 264451 - RNA, 64 nt, Human
cuauaaguacuaugaaugaauuugguugguuuugguguuguacagcucacauguuuacacacuc

SEQ ID NO: 264452 - RNA, 64 nt, Human
augcuagacuaguugcaucugacgggagaaguuuguguuguaccagcgcaugccuuggaaagac

SEQ ID NO: 264453 - RNA, 64 nt, Human
ucagacuuuguccauguauaaacuugaagugguuguguuguaggguugcagguuuuuuguuacg

SEQ ID NO: 264454 - RNA, 64 nt, Human
guguuuuuacguagugucauguucugugcauauaguguuguauucuccuuugcacuguuuaugu

SEQ ID NO: 264455 - RNA, 64 nt, Human
uggcaaugggguggucacuaccucacaaggcaaaguguuguaugauuagaaauuacgucuccag

SEQ ID NO: 264456 - RNA, 64 nt, Human; identical to SEQ ID NO: 264448

SEQ ID NO: 264457 - RNA, 64 nt, Human
cccacuuccuggccagggcucucauucuggaccuguguuguaauuguguacagaggauggcguu

SEQ ID NO: 264458 - RNA, 64 nt, Human
ggauuuugaauguuuugcaaauguauuggucccuguguuguauuuuguagccuuuuccugggcu

SEQ ID NO: 264459 - RNA, 64 nt, Human
cacuguguuccuauaaaggcccuuuucuuucuuaguguuguaaguuacauuuucauuaugcccc

SEQ ID NO: 264460 - RNA, 64 nt, Human
cauuccguuugaauuccuucuaacuggaacauuuguguuguaucuguaacacuggcacugaaau

SEQ ID NO: 264461 - RNA, 64 nt, Human; identical to SEQ ID NO: 107906

SEQ ID NO: 264462 - RNA, 64 nt, Human; identical to SEQ ID NO: 107908

SEQ ID NO: 264463 - RNA, 64 nt, Human; identical to SEQ ID NO: 107909

SEQ ID NO: 264464 - RNA, 64 nt, Human; identical to SEQ ID NO: 107910

SEQ ID NO: 264465 - RNA, 64 nt, Human
auaagcuaauuuuuaaaaagaaaugccauuaacuguguuguaucgugguuuaaaauuacuaaca

SEQ ID NO: 264466 - RNA, 64 nt, Human
uuaaagaugaaauaaagacccagggggagaauggguguuguauggggaggcaaguguggggggu

SEQ ID NO: 264467 - RNA, 64 nt, Human
uaauuauagcccauaguucacauuaagauucauuguguuguaagguuauguggguuuugacaaa

SEQ ID NO: 264468 - RNA, 64 nt, Human
aggccuuggggagucucugcuccuaccugacucuguguuguaauuucaggggagcaucagugga

SEQ ID NO: 264469 - RNA, 64 nt, Human
acuggggacugggguuuucgccccaugcugcaucguguuguauugggauggggcugaggaacau

SEQ ID NO: 264470 - RNA, 64 nt, Human
cauccacucaguuuugugauuccuggauauuuguguguuguaaaguguuuuguuaggugguaug

SEQ ID NO: 264471 - RNA, 64 nt, Human
cuugaccaugaaaggaaagucucauccuuaaaauguguuguacuucacaauccuggacuguugc

SEQ ID NO: 264472 - RNA, 64 nt, Human
uuguccuugucuuuaagcuauuugacaacucuacguguuguagaaaacugauaauaauacaaau

SEQ ID NO: 264473 - RNA, 64 nt, Human
aaugauaaggagaaucucuuguuuccucccaccuguguuguaaagauaaacugacgauauacag

SEQ ID NO: 264474 - RNA, 64 nt, Human
cagcugauugagaauuuccauuguaaauagcucaguguuguauagugaggcuuacgauguuuug

SEQ ID NO: 264475 - RNA, 64 nt, Human
gagauacagucgguuuaccucaggagucaauucaguguuguacuggugaccugggaugcaguag

SEQ ID NO: 264476 - RNA, 64 nt, Human
ccuaucuauggauguguuuugugugacccauacaguguuguaaaaaacacuuagaaccauuauu

SEQ ID NO: 264477 - RNA, 64 nt, Human
aaaacagacuuccggggaauuucgauguuuucccguguuguagagcuuccaggguuuaauaaaa

SEQ ID NO: 264478 - RNA, 64 nt, Human
ugagguucccagaacuguaguuuuuuuuaccaggguguuguauuuggagggggaggaggacucg

SEQ ID NO: 264479 - RNA, 64 nt, Human
ggucuaaguuguucuaaacccaggguucucaaauguguuguacaaaaaguuucauguaauaaaa

SEQ ID NO: 264480 - RNA, 64 nt, Human; identical to SEQ ID NO: 107776

SEQ ID NO: 264481 - RNA, 64 nt, Human; identical to SEQ ID NO: 107812

SEQ ID NO: 264482 - RNA, 64 nt, Human; identical to SEQ ID NO: 107813

SEQ ID NO: 264483 - RNA, 64 nt, Human; identical to SEQ ID NO: 107814

SEQ ID NO: 264484 - RNA, 50 nt, Human
uauuuuuaaaugacacguaaguguuguacauauuuaugggguacagugug

SEQ ID NO: 264485 - RNA, 64 nt, Human
uuuuuaguuagagguggaacauuccuuggaccagguguuguauugcaggaccccuucccccagc

SEQ ID NO: 264486 - RNA, 64 nt, Human
cacacccgacaugacauaaauaaaaaaauaaauaguguuguaucuuuccccucauccccucccu

SEQ ID NO: 264487 - RNA, 64 nt, Human
aaaucuguauauacagucuauguguuuagaauuuguguuguaaguaaacuacagcuuugaguug

SEQ ID NO: 264488 - RNA, 64 nt, Human
ggcuuuuguugaacuagaacccucagcacauacuguguuguacuuuuguaaaugauuuuuuaaa

SEQ ID NO: 264489 - RNA, 64 nt, Human
aacagacguuaggucucauuuuccuccucaugcaguguuguaguguggguugucaacuuuucuu

SEQ ID NO: 264490 - RNA, 64 nt, Human
uuuauaugaacaaaguacugcagaaguuaaaccuguguuguauuuuuucugagauguuuugcuu

SEQ ID NO: 264491 - RNA, 64 nt, Human
gaaccaccaccccguacuuuguuuugccuguagaguguuguaaaauauuuuggaugugaauguc

SEQ ID NO: 264492 - RNA, 64 nt, Human
cccucccuaauggccgcuggggggugagggcgguguguuguaugucuuuggguguuuguuuuuu

SEQ ID NO: 264493 - RNA, 64 nt, Human
uuuagucuuccaagggagggccucgcgcccauucguguuguauccuccacucacuauggcccga

SEQ ID NO: 264494 - RNA, 64 nt, Human
uuuuacaggugugaaagucacagcuuguaaauaaguguuguauguauuaaaccuuuuccaguuc

SEQ ID NO: 264495 - RNA, 64 nt, Human
ugauacugauuuuuauuccuugcguuaucacauaguguuguauuugaaacauaguucaugguuu

SEQ ID NO: 264496 - RNA, 64 nt, Human
ccaacuccuggagauuucaguuacuuaccugcauguguuguacaauaccagaucacucaaaaag

SEQ ID NO: 264497 - RNA, 64 nt, Human
uaaggugcuugcuccccaagacacauccuaaaagguguuguaauggugaaaacgucuuccuucu

SEQ ID NO: 264498 - RNA, 64 nt, Human
agccaugccauuuuuaccuuaugucugcuagaaaguguuguaguugauugaccaaaccaguuca

SEQ ID NO: 264499 - RNA, 64 nt, Human; identical to SEQ ID NO: 107810

SEQ ID NO: 264500 - RNA, 64 nt, Human; identical to SEQ ID NO: 107817

SEQ ID NO: 264501 - RNA, 64 nt, Human; identical to SEQ ID NO: 107818

SEQ ID NO: 264502 - RNA, 64 nt, Human; identical to SEQ ID NO: 107819

SEQ ID NO: 264503 - RNA, 64 nt, Human
gcuugcagccuaguaggagcugagcuuuccagccguguuguagcuaauuaggaagcuugauuug

SEQ ID NO: 264504 - RNA, 64 nt, Human
ugaguggcaguccugcgccagccucgcgggacacguguuguacauaagccucugcaguguccuc

SEQ ID NO: 264505 - RNA, 64 nt, Human
ucaaacugguccuguaauuguugcuagacuuuauguguuguacaacuaaacauugcuguuugaa

SEQ ID NO: 264506 - RNA, 64 nt, Human
guaacaacacuguucucuguugagucugcccuccguguuguagccagaccuuguggagauggcu

SEQ ID NO: 264507 - RNA, 64 nt, Human
cuugcccgaaggaccucugaaguacgcuggagcuguguuguacaggugcugugagaccuacccu

SEQ ID NO: 264508 - RNA, 64 nt, Human
cgcucuuugaagaaaaaaaaaaaaaucaccuuguguguuguagcucauuuguuucaagagagaa

SEQ ID NO: 264509 - RNA, 64 nt, Human
auuaacauguguagggguuacggugaggaucacuguguuguauucagaaaaacggggagaggga

SEQ ID NO: 264510 - RNA, 64 nt, Human
acuuaaccgaaauggaaccaacugacauucuaucguguuguacauagaaugaugaaggguucca

SEQ ID NO: 264511 - RNA, 64 nt, Human
cuguccuccaucccaccccucuuacuccagccucguguuguaaauaaaguuucgguggucaugc

SEQ ID NO: 264512 - RNA, 64 nt, Human
cuucccauuguggcuccuaucuguguuuugaaugguguuguaugccuuuaaaucugugaugauc

SEQ ID NO: 264513 - RNA, 64 nt, Human
uuacauaauacagauacuugagaaaguuguugugguguuguaugccaagaaaauucuuuuuauu

SEQ ID NO: 264514 - RNA, 64 nt, Human
gcuuuuagcuuugauaaauugaaaauauuuuaauguguuguauuuuugaaauugaaaacacugu

SEQ ID NO: 264515 - RNA, 64 nt, Human
ugguccugcuaguuucuggauuguacaaauaaauguguuguagaugacugguuaguguuugagg

SEQ ID NO: 264516 - RNA, 64 nt, Human
aauggauucacaaacgaugugaaaacauuauugaguguuguagccacuagaauuuuaaaaucaa

SEQ ID NO: 264517 - RNA, 64 nt, Human
gacgagcaagaguccaggucacugugccuuugcuguguuguauggaaaggauggcagggaacau

SEQ ID NO: 264518 - RNA, 64 nt, Human; identical to SEQ ID NO: 107822

SEQ ID NO: 264519 - RNA, 64 nt, Human; identical to SEQ ID NO: 107823

SEQ ID NO: 264520 - RNA, 64 nt, Human; identical to SEQ ID NO: 107824

SEQ ID NO: 264521 - RNA, 64 nt, Human; identical to SEQ ID NO: 107825

SEQ ID NO: 264522 - RNA, 64 nt, Human
uggccugucccuucagugagccaugcccacccuuguguuguagugagaagcuguugucacgacu

SEQ ID NO: 264523 - RNA, 64 nt, Human
gguuaauacuuugagacuuuguuuacguguggcaguguuguaaaaagaaacuaaagaucacauu

SEQ ID NO: 264524 - RNA, 64 nt, Human
caggauguaacaaauauauucaguaccauuucuuguguuguauuguguugugcuguguuagguu

SEQ ID NO: 264525 - RNA, 64 nt, Human
caagcaaauguuaaauguguuaagacuuguacuaguguuguaacuuuccaaguaaaaguauccc

SEQ ID NO: 264526 - RNA, 64 nt, Human; identical to SEQ ID NO: 264515

SEQ ID NO: 264527 - RNA, 64 nt, Human
uaacaaaaagcaaacagaaaaaaaaguguggaauguguuguauuuucgacagguugcugccaga

SEQ ID NO: 264528 - RNA, 64 nt, Human
gaaagucagaaaggccagcggggagaggcuggggcgaggggaggagggggaucagcuucugcua

SEQ ID NO: 264529 - RNA, 64 nt, Human
uaaagccacaggcaggcaucguagcuccacagcccgaggggacacaggauggaaaccccaggau

SEQ ID NO: 264530 - RNA, 64 nt, Human
cacagagugggacccaaggggcuaauuggaggcacgaggggaccccuccccagggccuuuuccu

SEQ ID NO: 264531 - RNA, 64 nt, Human
acuugucccucucucagcccuccauggccuggcacgaggggauggggaugcuuccgccuuuccg

SEQ ID NO: 264532 - RNA, 64 nt, Human
cugcagagcagugagccuacaucugccacucagccgaggggacccugcucacagccuucuacau

SEQ ID NO: 264533 - RNA, 64 nt, Human
ggccucugggugcgaguuccuccugcauaugaaccgaggggaggaggagaagcugagcacgugu

SEQ ID NO: 264534 - RNA, 64 nt, Human
ccggucaggcucucagaugcagcugguugcaccccgaggggagaugccuucucccccaccuccc

SEQ ID NO: 264535 - RNA, 64 nt, Human
gaugguuguguaaaugugggcugugugcuguucccgaggggagcuugggauuggguccugcuga

SEQ ID NO: 264536 - RNA, 64 nt, Human; identical to SEQ ID NO: 107828

SEQ ID NO: 264537 - RNA, 64 nt, Human; identical to SEQ ID NO: 107829

SEQ ID NO: 264538 - RNA, 64 nt, Human; identical to SEQ ID NO: 107830

SEQ ID NO: 264539 - RNA, 64 nt, Human
ugugcugugcauucccaggcccgcagcucccggucgaggggacuccgaugugaauuuguuguga

SEQ ID NO: 264540 - RNA, 64 nt, Human
ggcacucggacuugaaaagcuuggcccaagggugcgaggggaacuccgaguucuuucugagccu

SEQ ID NO: 264541 - RNA, 64 nt, Human
cuaaagaaauaaaaauaaugguguaaagccaacucgaggggaaucugaauaagcuuccaaaauu

SEQ ID NO: 264542 - RNA, 64 nt, Human
auuucgggcuguuugacuuucugugagcccccagcgaggggaggcccagccuccgaggagacca

SEQ ID NO: 264543 - RNA, 64 nt, Human
ccccugggagacauacgcaucaacuguggagguccgaggggaugagaagggauacccaccaucu

SEQ ID NO: 264544 - RNA, 64 nt, Human
ccaggaacaugggagggccgugcuugucucuagacgaggggaaugggggaagggccacaaccuc

SEQ ID NO: 264545 - RNA, 64 nt, Human
uuuuuccuggaaagcccgcuagaagguuugggaacgaggggaaaguucucagaacuguuggcug

SEQ ID NO: 264546 - RNA, 64 nt, Human
uugugaagaucaaauguguguuaagaaaaggugucgaggggagggacaaaaccagaaacggugg

SEQ ID NO: 264547 - RNA, 64 nt, Human
ugcggacuucugcgggcggcugacaacgcgagggcgaggggagaaagccaucagguccuagacg

SEQ ID NO: 264548 - RNA, 64 nt, Human
ccauuucuacuaaaaauacaaaaauuagcuggggcgaggggauaggccgaguuccggguguaag

SEQ ID NO: 264549 - RNA, 64 nt, Human
gaacccagaugucuguuaggcuggcuggcugcugcgaggggagggggguggccuuucauuuggg

SEQ ID NO: 264550 - RNA, 64 nt, Human
gaaggugagggagugggaagggggauggagagcucgaggggacaguguguuugagcuggagugc

SEQ ID NO: 264551 - RNA, 64 nt, Human
uuugcugcacacugguucaucaaaagaagguuaccgaggggaaggaacuaaagguguuugcacu

SEQ ID NO: 264552 - RNA, 64 nt, Human
gggaggaguccgaggugggguugguuaccugucccgaggggacccuguccggguccuugcucgg

SEQ ID NO: 264553 - RNA, 64 nt, Human; identical to SEQ ID NO: 107770

SEQ ID NO: 264554 - RNA, 64 nt, Human; identical to SEQ ID NO: 107841

SEQ ID NO: 264555 - RNA, 64 nt, Human; identical to SEQ ID NO: 107888

SEQ ID NO: 264556 - RNA, 64 nt, Human; identical to SEQ ID NO: 107902

SEQ ID NO: 264557 - RNA, 64 nt, Human
cuucugcaggggauguccacagagagggaagggccgaggggagagggugaccauggggaaugug

SEQ ID NO: 264558 - RNA, 64 nt, Human
aaacauuugcccccagaugcgcaggcugaucacccgaggggaauggcagucggaggcgcaggac

SEQ ID NO: 264559 - RNA, 64 nt, Human
auguuaugaagugcaggaacagcacagacccagacgaggggaugcagcccggagccaguaaccc

SEQ ID NO: 264560 - RNA, 64 nt, Human
guggcugaggcucaucuuugaggagcauggaacucgaggggagaagucgcgcccccagggaagc

SEQ ID NO: 264561 - RNA, 64 nt, Human
uggcuguuugauucccagguucuucaccuaccaacgaggggagagagcugugguucuccaucau

SEQ ID NO: 264562 - RNA, 64 nt, Human
gagucuccauuguuguacaggaucuucaguuauucgaggggaaugaggcaggucaagccgaugc

SEQ ID NO: 264563 - RNA, 64 nt, Human
auacgggcagcuaggaacaggggacaaaauggaccgaggggaacccacacaggugagacuauuu

SEQ ID NO: 264564 - RNA, 64 nt, Human
ccgggcccuggggagcccugggcacagcagcggccgaggggauguccugcuccaauacccgcac

SEQ ID NO: 264565 - RNA, 64 nt, Human
gccgccaccgagggacagccgagggaccgauggacgaggggacaggcuggugggaugggguucc

SEQ ID NO: 264566 - RNA, 64 nt, Human
uuucaaugugaauuuguucuuacauuauggcucccgaggggaagcgauuacuuuuuuuaauuuu

SEQ ID NO: 264567 - RNA, 64 nt, Human
aagcuccugugguuuugcucagccaaaaccaaaacgaggggaagaggaugauuccuaacucuuc

SEQ ID NO: 264568 - RNA, 64 nt, Human
auauuuguuuucugccuaaauguuuauacuaagccgaggggagagagguaccuagaccauguca

SEQ ID NO: 264569 - RNA, 64 nt, Human
gacgccacucccugggacacagacccaggacccccgaggggagggcaggauggccuuuccuucc

SEQ ID NO: 264570 - RNA, 64 nt, Human
aagugauuguaccuaggauuguaacuuaaauuaacgaggggaaacgacaugcugggacccuuga

SEQ ID NO: 264571 - RNA, 64 nt, Human; identical to SEQ ID NO: 107826

SEQ ID NO: 264572 - RNA, 64 nt, Human; identical to SEQ ID NO: 107833

SEQ ID NO: 264573 - RNA, 64 nt, Human; identical to SEQ ID NO: 107834

SEQ ID NO: 264574 - RNA, 64 nt, Human; identical to SEQ ID NO: 107835

SEQ ID NO: 264575 - RNA, 64 nt, Human
ggggccuugccggccccuucaagcaauagggucccgaggggagacccaccccgagcccccuccc

SEQ ID NO: 264576 - RNA, 64 nt, Human
gaaccccuuucuuuuaaaagaagucugucuauuucgaggggaguuacaggcaaguuugguaaaa

SEQ ID NO: 264577 - RNA, 64 nt, Human
cagaacacagugcagacggugggcggggagagcucgaggggaggcccagcccugcaggugggac

SEQ ID NO: 264578 - RNA, 64 nt, Human
caacuugagggcguguaguaaguuguagaaggcucgaggggacguggacuuauuugccuugguu

SEQ ID NO: 264579 - RNA, 64 nt, Human
gcucgaaagcccaacgccucccggaccggaccgccgaggggagcugggaccuccucugccaacu

SEQ ID NO: 264580 - RNA, 64 nt, Human
ugaagcuucaaagugacacuguggaaaucugaaacgaggggaugucaugaaggcagcuuuucuu

SEQ ID NO: 264581 - RNA, 64 nt, Human
ggacaggcgggaggaggugugaggaggaggcucccgaggggaaggggcggugcccacaccgggg

SEQ ID NO: 264582 - RNA, 64 nt, Human
gugugaguguggcagugagaagaagcaucgagggcgaggggaauaugaaaguuggucuucaccu

SEQ ID NO: 264583 - RNA, 64 nt, Human
aacccaaucuaguaggauguucucauuuuaaaaacgaggggaaaagaccagaguuuuucaggag

SEQ ID NO: 264584 - RNA, 64 nt, Human
gcugcgccgcuucccgccgcagcgcccgcgccuccgaggggacagcgcccucuggagcucgcug

SEQ ID NO: 264585 - RNA, 64 nt, Human
ggggcugggaagcccgggcgcggcgcgcuggggacgaggggaggucccgggggggcgcuggugu

SEQ ID NO: 264586 - RNA, 64 nt, Human
uccuccugugugcuuucuuccccagcaagccacccgaggggacugccuggccuuccagaugcga

SEQ ID NO: 264587 - RNA, 64 nt, Human
ugugcuuccguccccaggagccugaucagguguacgaggggaucaccuucgaggacuuccugaa

SEQ ID NO: 264588 - RNA, 64 nt, Human
accuacggaggaagcggaaagcguuuucuuugcucgaggggacaaaaaagucaaaacgaggcga

SEQ ID NO: 264589 - RNA, 64 nt, Human; identical to SEQ ID NO: 107815

SEQ ID NO: 264590 - RNA, 64 nt, Human; identical to SEQ ID NO: 107838

SEQ ID NO: 264591 - RNA, 64 nt, Human; identical to SEQ ID NO: 107839

SEQ ID NO: 264592 - RNA, 64 nt, Human; identical to SEQ ID NO: 107840

SEQ ID NO: 264593 - RNA, 64 nt, Human
uccuagaucugcaggcugcaccucuggcuagagccgaggggagagagggacucaagggaaaggc

SEQ ID NO: 264594 - RNA, 64 nt, Human
gcuuuuaaauuguaguuauaucaguguauauacacgaggggaacuguauaaagacauacuaaag

SEQ ID NO: 264595 - RNA, 64 nt, Human
aaaugaacuuagagaaucagacaggcgagaaguacgaggggagcgagacgaaaggagaacggug

SEQ ID NO: 264596 - RNA, 64 nt, Human
ugugggcgggcgcaugugcaccacagagugcacucgaggggacuuucagucacaggauuucaua

SEQ ID NO: 264597 - RNA, 64 nt, Human
cagcugggaggaggaggggaggggaacuuccacccgaggggaagaugcucucgggacaguuucc

SEQ ID NO: 264598 - RNA, 64 nt, Human
cccugccccaacugugugcugguccugcuguggccgaggggaccggguguguuuggcucuuuau

SEQ ID NO: 264599 - RNA, 64 nt, Human
gccgcagcucucacccacuuucuccugcagacggcgaggggaccgaccuguuugccguggcugu

SEQ ID NO: 264600 - RNA, 64 nt, Human
cuuucguuugaguccugcuguuggugucggagcacgaggggaggcacggugcggagagcgucgc

SEQ ID NO: 264601 - RNA, 64 nt, Human
aggcugauggggcacacccuuggccucucguccacgaggggagaaaccuaaacccuguuucaca

SEQ ID NO: 264602 - RNA, 64 nt, Human
gcugguguuugaggcauuuccacugugaucuccacgaggggauguuuuccgggacacaucucug

SEQ ID NO: 264603 - RNA, 64 nt, Human
augaugucuggaagggcuuaagggacacaguggacgaggggagaguccucaucugcuggcauuu

SEQ ID NO: 264604 - RNA, 64 nt, Human
cccggaagauccucagcugagugcaggugggguucgaggggaaaggacgauggggcaugaccuc

SEQ ID NO: 264605 - RNA, 64 nt, Human
ucucuaaaugaggggccucagguuugccugagggcgaggggaggguggcaggugaccuucuggg

SEQ ID NO: 264606 - RNA, 64 nt, Human
guucguguccugaccaggugcuccuccuuugauccgaggggaaagggacugguuuauagaaaga

SEQ ID NO: 264607 - RNA, 64 nt, Human; identical to SEQ ID NO: 107843

SEQ ID NO: 264608 - RNA, 64 nt, Human; identical to SEQ ID NO: 107844

SEQ ID NO: 264609 - RNA, 64 nt, Human; identical to SEQ ID NO: 107845

SEQ ID NO: 264610 - RNA, 64 nt, Human; identical to SEQ ID NO: 107846

SEQ ID NO: 264611 - RNA, 64 nt, Human
gcagcacggcccggccccucacccucuguccccacgaggggacccaugggggcugucuuugcag

SEQ ID NO: 264612 - RNA, 64 nt, Human
cauaggaacgcguugcggaguccgccccgucccccgaggggaggggucuuguacauacuguaac

SEQ ID NO: 264613 - RNA, 64 nt, Human
gccgagugaaggugcuggaaagggagggaggacgcgaggggaaaggccuguggggagccgaggg

SEQ ID NO: 264614 - RNA, 64 nt, Human
auucacguuucucucugaguccuguaacuguccccgaggggauugagcagaagcucggguauga

SEQ ID NO: 264615 - RNA, 64 nt, Human
gggcuacagcaagccaacaggucacagaagccaacgaggggacuguuucucuuccacuccuauc

SEQ ID NO: 264616 - RNA, 64 nt, Human
cagcuugucucccucgauccaaaggccguuuucucgaggggagggcaggcccggccuggagggg

SEQ ID NO: 264617 - RNA, 64 nt, Human
ggucuccuaagaccucauccugcuggggaccccacgaggggacauccacccucugggguguggc

SEQ ID NO: 264618 - RNA, 64 nt, Human
uccaguuguaaaugccacuucaugaggggaggggcgaggggaagcccaccccugcaugcuucug

SEQ ID NO: 264619 - RNA, 64 nt, Human
uguaggggguggcacuccccagagacugcccucacgaggggacuggguucgcucucagcucugc

SEQ ID NO: 264620 - RNA, 64 nt, Human
cucaaccacccugggcccagaaacagaggccugccgaggggaggagccuggccucuguccaccc

SEQ ID NO: 264621 - RNA, 64 nt, Human
uugggcuuggagggaggagggccggcgaggcuagcgaggggacaggagacggcccugcugcgga

SEQ ID NO: 264622 - RNA, 64 nt, Human
ggaaccagcacccgggccucagcugucugugcugcgaggggagucugcccuggugcccacuggg

SEQ ID NO: 264623 - RNA, 64 nt, Human
aaacuucugacaaucagugaauguacaacccagccgaggggacggugcauaacucuccaucaga

SEQ ID NO: 264624 - RNA, 64 nt, Human
caguuuagagccuuacacuguaccugagaauaaucgaggggagagaccuggugguuaacaugca

SEQ ID NO: 264625 - RNA, 64 nt, Human; identical to SEQ ID NO: 107849

SEQ ID NO: 264626 - RNA, 64 nt, Human; identical to SEQ ID NO: 107850

SEQ ID NO: 264627 - RNA, 64 nt, Human; identical to SEQ ID NO: 107851

SEQ ID NO: 264628 - RNA, 64 nt, Human; identical to SEQ ID NO: 107852

SEQ ID NO: 264629 - RNA, 64 nt, Human
ucuugggaggacacucauucuccaggcucggagacgaggggagaaguuugggguuucaguccca

SEQ ID NO: 264630 - RNA, 64 nt, Human
auugcacccgcccguccuaagccuccccacaaggcgaggggaguuaccccuaaaacaaagcuau

SEQ ID NO: 264631 - RNA, 64 nt, Human
cagacagacuaaagcugcccuccuggugcagggccgaggggacacaaggaccuaccuggaagca

SEQ ID NO: 264632 - RNA, 64 nt, Human
gccgagaccccagcaacaaucugagccaugagaacgaggggaucugggcaccccaggaaccgcc

SEQ ID NO: 264633 - RNA, 64 nt, Human
ccaguccaguuagcuucccuucuggaccaauagacgaggggagaccccauggauccucuggcug

SEQ ID NO: 264634 - RNA, 64 nt, Human
cccauucguguuguauccuccacucacuauggcccgaggggagaggagaguuuggggcagggag

SEQ ID NO: 264635 - RNA, 64 nt, Human
gacgucgcuuucauccccaagugcaccgucccuccgaggggauuucugagaauucuccugcauu

SEQ ID NO: 264636 - RNA, 64 nt, Human
ggagugcgggccgcgcacggugccaggauuccgccgaggggaagccgcucacauugcagucauc

SEQ ID NO: 264637 - RNA, 64 nt, Human
gguuuucccuuugagccuuuggccacauccaccucgaggggacccuggcaccccgggcacacaa

SEQ ID NO: 264638 - RNA, 64 nt, Human
ccgccucuccuccaucuucuggcaaggacagaggcgaggggacagcccagcgccauccugagga

SEQ ID NO: 264639 - RNA, 64 nt, Human
gcccccagggaggguuucccaccucagaguacaccgaggggaccugcagagggggcugucggga

SEQ ID NO: 264640 - RNA, 64 nt, Human
cagcccaugccuggcuguggcgauucagaagcaacgaggggagcuauccagagggucagugcug

SEQ ID NO: 264641 - RNA, 64 nt, Human
aggaugguuacuaguggcugggaaaaggggugugcgaggggaacuggggaugcuuaauguguac

SEQ ID NO: 264642 - RNA, 64 nt, Human; identical to SEQ ID NO: 107766

SEQ ID NO: 264643 - RNA, 64 nt, Human; identical to SEQ ID NO: 107767

SEQ ID NO: 264644 - RNA, 64 nt, Human; identical to SEQ ID NO: 107768

SEQ ID NO: 264645 - RNA, 64 nt, Human; identical to SEQ ID NO: 107769

SEQ ID NO: 264646 - RNA, 64 nt, Human
acacccucugcauggcccugccuggaccccauggaggccgaauagggaggaggugagaggcugg

SEQ ID NO: 264647 - RNA, 64 nt, Human
cgggcugugccgcgggcacauuugccuuuugugaaggccgaacucgagcuguauccucauagga

SEQ ID NO: 264648 - RNA, 64 nt, Human
cugaccccuuucccgcgcacugaaagggcagaguaggccgaaggguccaagggccagacugccu

SEQ ID NO: 264649 - RNA, 64 nt, Human
ccuauuuauugacuguccugagggccuugaaaacaggccgaaccuggagggccuggauuucuuu

SEQ ID NO: 264650 - RNA, 64 nt, Human
uaaggagaacaggggggaugauggggccaccgagaggccgaagaaggccaaggaggagcggcgc

SEQ ID NO: 264651 - RNA, 64 nt, Human
acucuagaagucggagcagaggaugguacagcagaggccgaaccagaagccggagcaguuccua

SEQ ID NO: 264652 - RNA, 64 nt, Human
ugguggcucaugccuguaaucccagcacuuugagaggccgaagcgaguggaucaccugagguca

SEQ ID NO: 264653 - RNA, 64 nt, Human
aagcacagcuggcuuuuaugacauaaagaacuaaaggccgaaagaaucucuugcugcugcaaag

SEQ ID NO: 264654 - RNA, 64 nt, Human
uaccacccaauuaucuauggcagcaugcauguauaggccgaacuauuaucagcucugauguuuc

SEQ ID NO: 264655 - RNA, 64 nt, Human
ugguggcucacaccuguaaucccagcacuuugggaggccgaaguggguggaucaccugaggucc

SEQ ID NO: 264656 - RNA, 64 nt, Human
caucuugagggguuuucuaacccccaggucucccaggccgaaggucagccuugagucccguuua

SEQ ID NO: 264657 - RNA, 64 nt, Human
gggaaacgucucccagaucgcucccuuggcuuugaggccgaagcugcugugacuguguccccuu

SEQ ID NO: 264658 - RNA, 64 nt, Human; identical to SEQ ID NO: 107772

SEQ ID NO: 264659 - RNA, 64 nt, Human; identical to SEQ ID NO: 107773

SEQ ID NO: 264660 - RNA, 64 nt, Human; identical to SEQ ID NO: 107774

SEQ ID NO: 264661 - RNA, 64 nt, Human; identical to SEQ ID NO: 107775

SEQ ID NO: 264662 - RNA, 64 nt, Human
cgguggcucacgccuguaaucccagcacuuugggaggccgaagcaggcggaucacgaggucagg

SEQ ID NO: 264663 - RNA, 64 nt, Human
uuaaagagauggagcaagagaguggucagaacacaggccgaauccaggcucuaucacuuacuag

SEQ ID NO: 264664 - RNA, 64 nt, Human
ugacggcucacgccuguaaucccagcacuuugggaggccgaaacaggcgaaucacuugagccca

SEQ ID NO: 264665 - RNA, 64 nt, Human
cauauuuuaauacgaagaggacacucccgugugcaggccgaaucagacccggcgugggcgaauu

SEQ ID NO: 264666 - RNA, 64 nt, Human
caauggcucacaccuguaaugccagcccuuugggaggccgaaugggcagaucacuugaggucag

SEQ ID NO: 264667 - RNA, 64 nt, Human
acgugacggcaacccggcaaaaggguagggagccaggccgaaggggccucacugaccaauugug

SEQ ID NO: 264668 - RNA, 64 nt, Human
gugugcuucugacuuuacccuguccccuaagucaaggccgaacuccagccugguggcuuugcca

SEQ ID NO: 264669 - RNA, 64 nt, Human
gaguuguuugguugagaggaacauccccaucucaaggccgaaccugugugaaccucaugccaag

SEQ ID NO: 264670 - RNA, 64 nt, Human
ggaggcggcccggccagcgggcacagggcaccagaggccgaaggugccucagacuccgcccucc

SEQ ID NO: 264671 - RNA, 64 nt, Human
aaaugcgggcucaucagcccccccagagagggucaggccgaaccccauuucuccuccucuuagg

SEQ ID NO: 264672 - RNA, 64 nt, Human
cggggacaggagggauguccugccgcccccagccaggccgaacuccgcacucgcucucccggca

SEQ ID NO: 264673 - RNA, 64 nt, Human
ugugucauuggucaugauauuugaaaaggggaggaggccgaaguuguucccauuuauccaguau

SEQ ID NO: 264674 - RNA, 64 nt, Human
gacaaacaaagaaacaaaauuaaaauggaauuggaggccgaacgcugcacagcugcccucucuc

SEQ ID NO: 264675 - RNA, 64 nt, Human
aaucugggggagaaggacacugcaucccagaucgaggccgaaaagucuuccucaaugucaucac

SEQ ID NO: 264676 - RNA, 64 nt, Human; identical to SEQ ID NO: 107778

SEQ ID NO: 264677 - RNA, 64 nt, Human; identical to SEQ ID NO: 107779

SEQ ID NO: 264678 - RNA, 64 nt, Human; identical to SEQ ID NO: 107780

SEQ ID NO: 264679 - RNA, 64 nt, Human; identical to SEQ ID NO: 107781

SEQ ID NO: 264680 - RNA, 64 nt, Human
gggaaaagggaacaggaaaagaaaccccaaacucaggccgaaugaucaaggggacccauaggaa

SEQ ID NO: 264681 - RNA, 64 nt, Human
ggggucaguucccacccccacccgucccaggcccaggccgaagccagcgcccagcuuuccucac

SEQ ID NO: 264682 - RNA, 64 nt, Human
ccagagccuggggcucuaacgccugagcccagggaggccgaagcuaacagggaaggcaggcagg

SEQ ID NO: 264683 - RNA, 64 nt, Human
gaggaggagccuuccaaacagagagaaaaaaaugaggccgaaaauuuagaggaaaaugaagagc

SEQ ID NO: 264684 - RNA, 64 nt, Human
uggcauugacgagaacucagguggaggcuugagaaggccgaaagggccccugaccugccuggcu

SEQ ID NO: 264685 - RNA, 64 nt, Human
cacuguccagcccccaccccucaacacgcgggggaggccgaaagguagggcggggacuggagau

SEQ ID NO: 264686 - RNA, 64 nt, Human
agaaaccgggcucagucaaucaaugcuuuauuucaggccgaaugaggcucuuuagauugggauc

SEQ ID NO: 264687 - RNA, 64 nt, Human
aauccaaguuucauguaguaggacagagaacagaaggccgaauccaaguuucaugugguaggac

SEQ ID NO: 264688 - RNA, 64 nt, Human
uccaccaccacuggccaccaggcuggcgcagccaaggccgaagcucuggcugaacccugugcug

SEQ ID NO: 264689 - RNA, 64 nt, Human
gugugaguggccuggggagggggccguggcacugaggccgaaagugccugccagacggcacggu

SEQ ID NO: 264690 - RNA, 64 nt, Human
caguagcaggcuuaccaauuuccauagucucaugaggccgaaaugaauuacaauguaaaguguu

SEQ ID NO: 264691 - RNA, 64 nt, Human
cugcucgugagauugggcuggguagggacagaggaggccgaaaucccucccccaugcuuccuga

SEQ ID NO: 264692 - RNA, 64 nt, Human
aagggauaucccaggugacgguuucccuugcacuaggccgaaccuauaguauagaaauauuauc

SEQ ID NO: 264693 - RNA, 64 nt, Human
uccugcuggcuugggcccggcucuggggcccccaaggccgaagggugacaaaauacaggccccc

SEQ ID NO: 264694 - RNA, 64 nt, Human; identical to SEQ ID NO: 107784

SEQ ID NO: 264695 - RNA, 64 nt, Human; identical to SEQ ID NO: 107785

SEQ ID NO: 264696 - RNA, 64 nt, Human; identical to SEQ ID NO: 107786

SEQ ID NO: 264697 - RNA, 64 nt, Human; identical to SEQ ID NO: 107787

SEQ ID NO: 264698 - RNA, 64 nt, Human
gucaucuguaccucugccuccuuuccccucccucaggccgaaggaggagucagggagagcugaa

SEQ ID NO: 264699 - RNA, 64 nt, Human
ggccagcccugucaccaccuccacugccaugaccaggccgaaggcagggaacgcccuccccagu

SEQ ID NO: 264700 - RNA, 64 nt, Human
ugaccguuucccugccuccugcuucagccucccgaggccgaagccucagccccuccagacaggc

SEQ ID NO: 264701 - RNA, 64 nt, Human
cccgugcagcuucuguccugcgucgaagcuuugaaggccgaaggcagugcaagagacucuggcc

SEQ ID NO: 264702 - RNA, 64 nt, Human
uaaaucuaugagguuuaggguucaaaaugauggaaggccgaagagcaaggcuuauaugguggua

SEQ ID NO: 264703 - RNA, 64 nt, Human
auugcucauguucuucaucuucucaaaucaucagaggccgaagaaaaacacuuuggcugugucu

SEQ ID NO: 264704 - RNA, 64 nt, Human
gagggcccacuucaggguucuccucuccccucuaaggccgaagaaggguccuucccucucccca

SEQ ID NO: 264705 - RNA, 64 nt, Human
ucaauuaaugcaaaaacaaaaggggagauguuggaggccgaaggaaugagggucgugaccaacu

SEQ ID NO: 264706 - RNA, 64 nt, Human
cucaggccacccucccugccacguggagacgcagaggccgaacccaaacuggggccaccucugu

SEQ ID NO: 264707 - RNA, 64 nt, Human
aggcucagagcagcagguguuacccaaggucacaaggccgaacauuuucagaaaucuuucagaa

SEQ ID NO: 264708 - RNA, 64 nt, Human
cgcgcgccacgggggcaccuuggaagaccaagagaggccgaagggcacgggguaggggguucuc

SEQ ID NO: 264709 - RNA, 64 nt, Human
uggugguucacgccuguaaucccagcacuuugggaggccgaagcgggcggaucaccugaggucg

SEQ ID NO: 264710 - RNA, 64 nt, Human
uggcggcucacgccuguaaucccagcacuuugggaggccgaaguggguggaucacuugaggcca

SEQ ID NO: 264711 - RNA, 64 nt, Human; identical to SEQ ID NO: 107788

SEQ ID NO: 264712 - RNA, 64 nt, Human; identical to SEQ ID NO: 107794

SEQ ID NO: 264713 - RNA, 64 nt, Human; identical to SEQ ID NO: 107836

SEQ ID NO: 264714 - RNA, 64 nt, Human; identical to SEQ ID NO: 107877

SEQ ID NO: 264715 - RNA, 64 nt, Human; identical to SEQ ID NO: 107743

SEQ ID NO: 264716 - RNA, 64 nt, Human; identical to SEQ ID NO: 107744

SEQ ID NO: 264717 - RNA, 64 nt, Human; identical to SEQ ID NO: 107745

SEQ ID NO: 264718 - RNA, 64 nt, Human; identical to SEQ ID NO: 107746

SEQ ID NO: 264719 - RNA, 64 nt, Human; identical to SEQ ID NO: 107747

SEQ ID NO: 264720 - RNA, 64 nt, Human; identical to SEQ ID NO: 107748

SEQ ID NO: 264721 - RNA, 64 nt, Human; identical to SEQ ID NO: 107749

SEQ ID NO: 264722 - RNA, 64 nt, Human; identical to SEQ ID NO: 107750

SEQ ID NO: 264723 - RNA, 64 nt, Human; identical to SEQ ID NO: 107751

SEQ ID NO: 264724 - RNA, 64 nt, Human; identical to SEQ ID NO: 107752

SEQ ID NO: 264725 - RNA, 64 nt, Human; identical to SEQ ID NO: 107753

SEQ ID NO: 264726 - RNA, 64 nt, Human; identical to SEQ ID NO: 107754

SEQ ID NO: 264727 - RNA, 64 nt, Human; identical to SEQ ID NO: 107755

SEQ ID NO: 264728 - RNA, 64 nt, Human; identical to SEQ ID NO: 107756

SEQ ID NO: 264729 - RNA, 64 nt, Human; identical to SEQ ID NO: 107757

SEQ ID NO: 264730 - RNA, 64 nt, Human; identical to SEQ ID NO: 107758

SEQ ID NO: 264731 - RNA, 64 nt, Human; identical to SEQ ID NO: 107759

SEQ ID NO: 264732 - RNA, 51 nt, Human; identical to SEQ ID NO: 107760

SEQ ID NO: 264733 - RNA, 64 nt, Human; identical to SEQ ID NO: 107761

SEQ ID NO: 264734 - RNA, 64 nt, Human; identical to SEQ ID NO: 107762

SEQ ID NO: 264735 - RNA, 64 nt, Human; identical to SEQ ID NO: 107763

SEQ ID NO: 264736 - RNA, 64 nt, Human; identical to SEQ ID NO: 107988

SEQ ID NO: 264737 - RNA, 64 nt, Human; identical to SEQ ID NO: 107989

SEQ ID NO: 264738 - RNA, 64 nt, Human; identical to SEQ ID NO: 107990

SEQ ID NO: 264739 - RNA, 64 nt, Human; identical to SEQ ID NO: 107991

SEQ ID NO: 264740 - RNA, 64 nt, Human; identical to SEQ ID NO: 107992

SEQ ID NO: 264741 - RNA, 64 nt, Human; identical to SEQ ID NO: 107993

SEQ ID NO: 264742 - RNA, 64 nt, Human; identical to SEQ ID NO: 107994

SEQ ID NO: 264743 - RNA, 64 nt, Human; identical to SEQ ID NO: 107995

SEQ ID NO: 264744 - RNA, 64 nt, Human; identical to SEQ ID NO: 107996

SEQ ID NO: 264745 - RNA, 64 nt, Human; identical to SEQ ID NO: 107997

SEQ ID NO: 264746 - RNA, 64 nt, Human; identical to SEQ ID NO: 107998

SEQ ID NO: 264747 - RNA, 64 nt, Human; identical to SEQ ID NO: 107999

SEQ ID NO: 264748 - RNA, 64 nt, Human; identical to SEQ ID NO: 108000

SEQ ID NO: 264749 - RNA, 64 nt, Human; identical to SEQ ID NO: 108001

SEQ ID NO: 264750 - RNA, 64 nt, Human; identical to SEQ ID NO: 108002

SEQ ID NO: 264751 - RNA, 64 nt, Human; identical to SEQ ID NO: 108003

SEQ ID NO: 264752 - RNA, 64 nt, Human; identical to SEQ ID NO: 108004

SEQ ID NO: 264753 - RNA, 64 nt, Human; identical to SEQ ID NO: 108005

SEQ ID NO: 264754 - RNA, 64 nt, Human; identical to SEQ ID NO: 108006

SEQ ID NO: 264755 - RNA, 64 nt, Human; identical to SEQ ID NO: 108007

SEQ ID NO: 264756 - RNA, 64 nt, Human; identical to SEQ ID NO: 108008

SEQ ID NO: 264757 - RNA, 64 nt, Human; identical to SEQ ID NO: 108009

SEQ ID NO: 264758 - RNA, 64 nt, Human; identical to SEQ ID NO: 108010

SEQ ID NO: 264759 - RNA, 64 nt, Human; identical to SEQ ID NO: 108011

SEQ ID NO: 264760 - RNA, 64 nt, Human; identical to SEQ ID NO: 108012

SEQ ID NO: 264761 - RNA, 64 nt, Human; identical to SEQ ID NO: 108013

SEQ ID NO: 264762 - RNA, 64 nt, Human; identical to SEQ ID NO: 108014

SEQ ID NO: 264763 - RNA, 64 nt, Human; identical to SEQ ID NO: 107991

SEQ ID NO: 264764 - RNA, 64 nt, Human; identical to SEQ ID NO: 108016

SEQ ID NO: 264765 - RNA, 64 nt, Human; identical to SEQ ID NO: 108017

SEQ ID NO: 264766 - RNA, 64 nt, Human; identical to SEQ ID NO: 108018

SEQ ID NO: 264767 - RNA, 64 nt, Human; identical to SEQ ID NO: 108019

SEQ ID NO: 264768 - RNA, 64 nt, Human; identical to SEQ ID NO: 108020

SEQ ID NO: 264769 - RNA, 64 nt, Human; identical to SEQ ID NO: 108021

SEQ ID NO: 264770 - RNA, 64 nt, Human; identical to SEQ ID NO: 108022

SEQ ID NO: 264771 - RNA, 64 nt, Human; identical to SEQ ID NO: 108023

SEQ ID NO: 264772 - RNA, 59 nt, Human; identical to SEQ ID NO: 108024

SEQ ID NO: 264773 - RNA, 64 nt, Human; identical to SEQ ID NO: 108025

SEQ ID NO: 264774 - RNA, 64 nt, Human; identical to SEQ ID NO: 108026

SEQ ID NO: 264775 - RNA, 64 nt, Human; identical to SEQ ID NO: 108027

SEQ ID NO: 264776 - RNA, 64 nt, Human; identical to SEQ ID NO: 108028

SEQ ID NO: 264777 - RNA, 64 nt, Human; identical to SEQ ID NO: 108029

SEQ ID NO: 264778 - RNA, 64 nt, Human; identical to SEQ ID NO: 108030

SEQ ID NO: 264779 - RNA, 64 nt, Human; identical to SEQ ID NO: 108031

SEQ ID NO: 264780 - RNA, 64 nt, Human; identical to SEQ ID NO: 108032

SEQ ID NO: 264781 - RNA, 64 nt, Human; identical to SEQ ID NO: 108033

SEQ ID NO: 264782 - RNA, 64 nt, Human; identical to SEQ ID NO: 108034

SEQ ID NO: 264783 - RNA, 64 nt, Human; identical to SEQ ID NO: 108035

SEQ ID NO: 264784 - RNA, 64 nt, Human; identical to SEQ ID NO: 108036

SEQ ID NO: 264785 - RNA, 64 nt, Human; identical to SEQ ID NO: 108037

SEQ ID NO: 264786 - RNA, 64 nt, Human; identical to SEQ ID NO: 108038

SEQ ID NO: 264787 - RNA, 64 nt, Human; identical to SEQ ID NO: 108039

SEQ ID NO: 264788 - RNA, 64 nt, Human; identical to SEQ ID NO: 108040

SEQ ID NO: 264789 - RNA, 64 nt, Human; identical to SEQ ID NO: 108041

SEQ ID NO: 264790 - RNA, 64 nt, Human; identical to SEQ ID NO: 108042

SEQ ID NO: 264791 - RNA, 64 nt, Human; identical to SEQ ID NO: 108043

SEQ ID NO: 264792 - RNA, 64 nt, Human; identical to SEQ ID NO: 108044

SEQ ID NO: 264793 - RNA, 64 nt, Human; identical to SEQ ID NO: 108045

SEQ ID NO: 264794 - RNA, 64 nt, Human; identical to SEQ ID NO: 108046

SEQ ID NO: 264795 - RNA, 64 nt, Human; identical to SEQ ID NO: 108047

SEQ ID NO: 264796 - RNA, 64 nt, Human; identical to SEQ ID NO: 108048

SEQ ID NO: 264797 - RNA, 64 nt, Human; identical to SEQ ID NO: 108049

SEQ ID NO: 264798 - RNA, 64 nt, Human; identical to SEQ ID NO: 108050

SEQ ID NO: 264799 - RNA, 64 nt, Human; identical to SEQ ID NO: 108051

SEQ ID NO: 264800 - RNA, 64 nt, Human; identical to SEQ ID NO: 108052

SEQ ID NO: 264801 - RNA, 64 nt, Human; identical to SEQ ID NO: 108053

SEQ ID NO: 264802 - RNA, 64 nt, Human; identical to SEQ ID NO: 108054

SEQ ID NO: 264803 - RNA, 64 nt, Human; identical to SEQ ID NO: 108055

SEQ ID NO: 264804 - RNA, 64 nt, Human; identical to SEQ ID NO: 108056

SEQ ID NO: 264805 - RNA, 64 nt, Human; identical to SEQ ID NO: 108057

SEQ ID NO: 264806 - RNA, 64 nt, Human; identical to SEQ ID NO: 108058

SEQ ID NO: 264807 - RNA, 64 nt, Human; identical to SEQ ID NO: 108059

SEQ ID NO: 264808 - RNA, 64 nt, Human; identical to SEQ ID NO: 108060

SEQ ID NO: 264809 - RNA, 64 nt, Human; identical to SEQ ID NO: 108061

SEQ ID NO: 264810 - RNA, 64 nt, Human; identical to SEQ ID NO: 108062

SEQ ID NO: 264811 - RNA, 64 nt, Human; identical to SEQ ID NO: 108063

SEQ ID NO: 264812 - RNA, 64 nt, Human; identical to SEQ ID NO: 108064

SEQ ID NO: 264813 - RNA, 64 nt, Human; identical to SEQ ID NO: 108065

SEQ ID NO: 264814 - RNA, 64 nt, Human; identical to SEQ ID NO: 108066

SEQ ID NO: 264815 - RNA, 64 nt, Human; identical to SEQ ID NO: 108067

SEQ ID NO: 264816 - RNA, 64 nt, Human; identical to SEQ ID NO: 108068

SEQ ID NO: 264817 - RNA, 64 nt, Human; identical to SEQ ID NO: 108069

SEQ ID NO: 264818 - RNA, 64 nt, Human; identical to SEQ ID NO: 108070

SEQ ID NO: 264819 - RNA, 64 nt, Human; identical to SEQ ID NO: 108071

SEQ ID NO: 264820 - RNA, 64 nt, Human; identical to SEQ ID NO: 108072

SEQ ID NO: 264821 - RNA, 64 nt, Human; identical to SEQ ID NO: 108073

SEQ ID NO: 264822 - RNA, 64 nt, Human; identical to SEQ ID NO: 108074

SEQ ID NO: 264823 - RNA, 64 nt, Human; identical to SEQ ID NO: 108075

SEQ ID NO: 264824 - RNA, 64 nt, Human; identical to SEQ ID NO: 108076

SEQ ID NO: 264825 - RNA, 64 nt, Human; identical to SEQ ID NO: 108077

SEQ ID NO: 264826 - RNA, 64 nt, Human; identical to SEQ ID NO: 108078

SEQ ID NO: 264827 - RNA, 64 nt, Human; identical to SEQ ID NO: 108079

SEQ ID NO: 264828 - RNA, 64 nt, Human; identical to SEQ ID NO: 108080

SEQ ID NO: 264829 - RNA, 64 nt, Human; identical to SEQ ID NO: 108081

SEQ ID NO: 264830 - RNA, 64 nt, Human; identical to SEQ ID NO: 108082

SEQ ID NO: 264831 - RNA, 64 nt, Human; identical to SEQ ID NO: 108083

SEQ ID NO: 264832 - RNA, 64 nt, Human; identical to SEQ ID NO: 108084

SEQ ID NO: 264833 - RNA, 64 nt, Human; identical to SEQ ID NO: 108085

SEQ ID NO: 264834 - RNA, 64 nt, Human; identical to SEQ ID NO: 108086

SEQ ID NO: 264835 - RNA, 64 nt, Human; identical to SEQ ID NO: 108087

SEQ ID NO: 264836 - RNA, 64 nt, Human; identical to SEQ ID NO: 108088

SEQ ID NO: 264837 - RNA, 64 nt, Human; identical to SEQ ID NO: 108089

SEQ ID NO: 264838 - RNA, 64 nt, Human; identical to SEQ ID NO: 108090

SEQ ID NO: 264839 - RNA, 64 nt, Human; identical to SEQ ID NO: 108091

SEQ ID NO: 264840 - RNA, 64 nt, Human; identical to SEQ ID NO: 108092

SEQ ID NO: 264841 - RNA, 64 nt, Human; identical to SEQ ID NO: 108093

SEQ ID NO: 264842 - RNA, 64 nt, Human; identical to SEQ ID NO: 108094

SEQ ID NO: 264843 - RNA, 64 nt, Human; identical to SEQ ID NO: 108095

SEQ ID NO: 264844 - RNA, 64 nt, Human; identical to SEQ ID NO: 108096

SEQ ID NO: 264845 - RNA, 64 nt, Human; identical to SEQ ID NO: 108097

SEQ ID NO: 264846 - RNA, 64 nt, Human; identical to SEQ ID NO: 108098

SEQ ID NO: 264847 - RNA, 64 nt, Human; identical to SEQ ID NO: 108099

SEQ ID NO: 264848 - RNA, 64 nt, Human; identical to SEQ ID NO: 108100

SEQ ID NO: 264849 - RNA, 64 nt, Human; identical to SEQ ID NO: 108101

SEQ ID NO: 264850 - RNA, 64 nt, Human; identical to SEQ ID NO: 108102

SEQ ID NO: 264851 - RNA, 64 nt, Human; identical to SEQ ID NO: 108103

SEQ ID NO: 264852 - RNA, 64 nt, Human; identical to SEQ ID NO: 108104

SEQ ID NO: 264853 - RNA, 64 nt, Human; identical to SEQ ID NO: 108105

SEQ ID NO: 264854 - RNA, 64 nt, Human; identical to SEQ ID NO: 108106

SEQ ID NO: 264855 - RNA, 64 nt, Human; identical to SEQ ID NO: 108107

SEQ ID NO: 264856 - RNA, 64 nt, Human; identical to SEQ ID NO: 108108

SEQ ID NO: 264857 - RNA, 64 nt, Human; identical to SEQ ID NO: 108109

SEQ ID NO: 264858 - RNA, 64 nt, Human; identical to SEQ ID NO: 108110

SEQ ID NO: 264859 - RNA, 64 nt, Human; identical to SEQ ID NO: 108111

SEQ ID NO: 264860 - RNA, 64 nt, Human; identical to SEQ ID NO: 108112

SEQ ID NO: 264861 - RNA, 64 nt, Human; identical to SEQ ID NO: 108113

SEQ ID NO: 264862 - RNA, 64 nt, Human; identical to SEQ ID NO: 108114

SEQ ID NO: 264863 - RNA, 64 nt, Human; identical to SEQ ID NO: 108115

SEQ ID NO: 264864 - RNA, 64 nt, Human; identical to SEQ ID NO: 108116

SEQ ID NO: 264865 - RNA, 64 nt, Human; identical to SEQ ID NO: 108117

SEQ ID NO: 264866 - RNA, 64 nt, Human; identical to SEQ ID NO: 108118

SEQ ID NO: 264867 - RNA, 64 nt, Human; identical to SEQ ID NO: 108119

SEQ ID NO: 264868 - RNA, 64 nt, Human; identical to SEQ ID NO: 108120

SEQ ID NO: 264869 - RNA, 64 nt, Human; identical to SEQ ID NO: 108121

SEQ ID NO: 264870 - RNA, 64 nt, Human; identical to SEQ ID NO: 108122

SEQ ID NO: 264871 - RNA, 64 nt, Human; identical to SEQ ID NO: 108123

SEQ ID NO: 264872 - RNA, 64 nt, Human; identical to SEQ ID NO: 108124

SEQ ID NO: 264873 - RNA, 64 nt, Human; identical to SEQ ID NO: 108125

SEQ ID NO: 264874 - RNA, 64 nt, Human; identical to SEQ ID NO: 108126

SEQ ID NO: 264875 - RNA, 64 nt, Human; identical to SEQ ID NO: 108127

SEQ ID NO: 264876 - RNA, 64 nt, Human; identical to SEQ ID NO: 108128

SEQ ID NO: 264877 - RNA, 64 nt, Human; identical to SEQ ID NO: 108129

SEQ ID NO: 264878 - RNA, 64 nt, Human; identical to SEQ ID NO: 108130

SEQ ID NO: 264879 - RNA, 64 nt, Human; identical to SEQ ID NO: 108131

SEQ ID NO: 264880 - RNA, 64 nt, Human; identical to SEQ ID NO: 108132

SEQ ID NO: 264881 - RNA, 64 nt, Human; identical to SEQ ID NO: 108133

SEQ ID NO: 264882 - RNA, 64 nt, Human; identical to SEQ ID NO: 108134

SEQ ID NO: 264883 - RNA, 64 nt, Human; identical to SEQ ID NO: 108135

SEQ ID NO: 264884 - RNA, 64 nt, Human; identical to SEQ ID NO: 108136

SEQ ID NO: 264885 - RNA, 64 nt, Human; identical to SEQ ID NO: 108137

SEQ ID NO: 264886 - RNA, 64 nt, Human; identical to SEQ ID NO: 108138

SEQ ID NO: 264887 - RNA, 64 nt, Human; identical to SEQ ID NO: 108139

SEQ ID NO: 264888 - RNA, 64 nt, Human; identical to SEQ ID NO: 108140

SEQ ID NO: 264889 - RNA, 64 nt, Human; identical to SEQ ID NO: 108141

SEQ ID NO: 264890 - RNA, 64 nt, Human; identical to SEQ ID NO: 108142

SEQ ID NO: 264891 - RNA, 64 nt, Human; identical to SEQ ID NO: 108143

SEQ ID NO: 264892 - RNA, 64 nt, Human; identical to SEQ ID NO: 108144

SEQ ID NO: 264893 - RNA, 64 nt, Human; identical to SEQ ID NO: 108145

SEQ ID NO: 264894 - RNA, 64 nt, Human; identical to SEQ ID NO: 108146

SEQ ID NO: 264895 - RNA, 64 nt, Human; identical to SEQ ID NO: 108147

SEQ ID NO: 264896 - RNA, 64 nt, Human; identical to SEQ ID NO: 108148

SEQ ID NO: 264897 - RNA, 64 nt, Human; identical to SEQ ID NO: 108149

SEQ ID NO: 264898 - RNA, 64 nt, Human; identical to SEQ ID NO: 108150

SEQ ID NO: 264899 - RNA, 64 nt, Human; identical to SEQ ID NO: 108151

SEQ ID NO: 264900 - RNA, 64 nt, Human; identical to SEQ ID NO: 108152

SEQ ID NO: 264901 - RNA, 64 nt, Human; identical to SEQ ID NO: 108153

SEQ ID NO: 264902 - RNA, 64 nt, Human; identical to SEQ ID NO: 108154

SEQ ID NO: 264903 - RNA, 64 nt, Human; identical to SEQ ID NO: 108155

SEQ ID NO: 264904 - RNA, 64 nt, Human; identical to SEQ ID NO: 108156

SEQ ID NO: 264905 - RNA, 64 nt, Human; identical to SEQ ID NO: 108157

SEQ ID NO: 264906 - RNA, 64 nt, Human; identical to SEQ ID NO: 108158

SEQ ID NO: 264907 - RNA, 64 nt, Human; identical to SEQ ID NO: 108159

SEQ ID NO: 264908 - RNA, 64 nt, Human; identical to SEQ ID NO: 108160

SEQ ID NO: 264909 - RNA, 64 nt, Human; identical to SEQ ID NO: 108161

SEQ ID NO: 264910 - RNA, 64 nt, Human; identical to SEQ ID NO: 108162

SEQ ID NO: 264911 - RNA, 64 nt, Human; identical to SEQ ID NO: 108163

SEQ ID NO: 264912 - RNA, 64 nt, Human; identical to SEQ ID NO: 108164

SEQ ID NO: 264913 - RNA, 64 nt, Human; identical to SEQ ID NO: 108165

SEQ ID NO: 264914 - RNA, 64 nt, Human; identical to SEQ ID NO: 108166

SEQ ID NO: 264915 - RNA, 64 nt, Human; identical to SEQ ID NO: 108167

SEQ ID NO: 264916 - RNA, 64 nt, Human; identical to SEQ ID NO: 108168

SEQ ID NO: 264917 - RNA, 64 nt, Human; identical to SEQ ID NO: 108169

SEQ ID NO: 264918 - RNA, 64 nt, Human; identical to SEQ ID NO: 108170

SEQ ID NO: 264919 - RNA, 64 nt, Human; identical to SEQ ID NO: 108171

SEQ ID NO: 264920 - RNA, 64 nt, Human; identical to SEQ ID NO: 108172

SEQ ID NO: 264921 - RNA, 64 nt, Human; identical to SEQ ID NO: 108173

SEQ ID NO: 264922 - RNA, 64 nt, Human; identical to SEQ ID NO: 108174

SEQ ID NO: 264923 - RNA, 64 nt, Human; identical to SEQ ID NO: 108175

SEQ ID NO: 264924 - RNA, 64 nt, Human; identical to SEQ ID NO: 108176

SEQ ID NO: 264925 - RNA, 64 nt, Human; identical to SEQ ID NO: 108177

SEQ ID NO: 264926 - RNA, 64 nt, Human; identical to SEQ ID NO: 108178

SEQ ID NO: 264927 - RNA, 64 nt, Human; identical to SEQ ID NO: 108179

SEQ ID NO: 264928 - RNA, 64 nt, Human; identical to SEQ ID NO: 108180

SEQ ID NO: 264929 - RNA, 64 nt, Human; identical to SEQ ID NO: 108181

SEQ ID NO: 264930 - RNA, 64 nt, Human; identical to SEQ ID NO: 108182

SEQ ID NO: 264931 - RNA, 64 nt, Human; identical to SEQ ID NO: 108183

SEQ ID NO: 264932 - RNA, 64 nt, Human; identical to SEQ ID NO: 108184

SEQ ID NO: 264933 - RNA, 64 nt, Human; identical to SEQ ID NO: 108185

SEQ ID NO: 264934 - RNA, 64 nt, Human; identical to SEQ ID NO: 108186

SEQ ID NO: 264935 - RNA, 64 nt, Human; identical to SEQ ID NO: 108187

SEQ ID NO: 264936 - RNA, 64 nt, Human; identical to SEQ ID NO: 108188

SEQ ID NO: 264937 - RNA, 50 nt, Human; identical to SEQ ID NO: 108189

SEQ ID NO: 264938 - RNA, 64 nt, Human; identical to SEQ ID NO: 108190

SEQ ID NO: 264939 - RNA, 64 nt, Human; identical to SEQ ID NO: 108191

SEQ ID NO: 264940 - RNA, 64 nt, Human; identical to SEQ ID NO: 108192

SEQ ID NO: 264941 - RNA, 64 nt, Human; identical to SEQ ID NO: 108193

SEQ ID NO: 264942 - RNA, 64 nt, Human; identical to SEQ ID NO: 108194

SEQ ID NO: 264943 - RNA, 64 nt, Human; identical to SEQ ID NO: 108195

SEQ ID NO: 264944 - RNA, 64 nt, Human; identical to SEQ ID NO: 108196

SEQ ID NO: 264945 - RNA, 64 nt, Human; identical to SEQ ID NO: 108197

SEQ ID NO: 264946 - RNA, 64 nt, Human; identical to SEQ ID NO: 108198

SEQ ID NO: 264947 - RNA, 64 nt, Human; identical to SEQ ID NO: 108199

SEQ ID NO: 264948 - RNA, 64 nt, Human; identical to SEQ ID NO: 108200

SEQ ID NO: 264949 - RNA, 64 nt, Human; identical to SEQ ID NO: 108201

SEQ ID NO: 264950 - RNA, 64 nt, Human; identical to SEQ ID NO: 108202

SEQ ID NO: 264951 - RNA, 64 nt, Human; identical to SEQ ID NO: 108203

SEQ ID NO: 264952 - RNA, 64 nt, Human; identical to SEQ ID NO: 108204

SEQ ID NO: 264953 - RNA, 64 nt, Human; identical to SEQ ID NO: 108205

SEQ ID NO: 264954 - RNA, 64 nt, Human; identical to SEQ ID NO: 108206

SEQ ID NO: 264955 - RNA, 64 nt, Human; identical to SEQ ID NO: 108207

SEQ ID NO: 264956 - RNA, 64 nt, Human; identical to SEQ ID NO: 108208

SEQ ID NO: 264957 - RNA, 64 nt, Human; identical to SEQ ID NO: 108209

SEQ ID NO: 264958 - RNA, 64 nt, Human; identical to SEQ ID NO: 108210

SEQ ID NO: 264959 - RNA, 64 nt, Human; identical to SEQ ID NO: 108211

SEQ ID NO: 264960 - RNA, 64 nt, Human; identical to SEQ ID NO: 108212

SEQ ID NO: 264961 - RNA, 64 nt, Human; identical to SEQ ID NO: 108213

SEQ ID NO: 264962 - RNA, 64 nt, Human; identical to SEQ ID NO: 108214

SEQ ID NO: 264963 - RNA, 64 nt, Human; identical to SEQ ID NO: 108215

SEQ ID NO: 264964 - RNA, 64 nt, Human; identical to SEQ ID NO: 108216

SEQ ID NO: 264965 - RNA, 64 nt, Human; identical to SEQ ID NO: 108217

SEQ ID NO: 264966 - RNA, 64 nt, Human; identical to SEQ ID NO: 108218

SEQ ID NO: 264967 - RNA, 64 nt, Human; identical to SEQ ID NO: 108219

SEQ ID NO: 264968 - RNA, 64 nt, Human; identical to SEQ ID NO: 108220

SEQ ID NO: 264969 - RNA, 64 nt, Human; identical to SEQ ID NO: 108221

SEQ ID NO: 264970 - RNA, 64 nt, Human; identical to SEQ ID NO: 108222

SEQ ID NO: 264971 - RNA, 64 nt, Human; identical to SEQ ID NO: 108223

SEQ ID NO: 264972 - RNA, 64 nt, Human; identical to SEQ ID NO: 108224

SEQ ID NO: 264973 - RNA, 64 nt, Human; identical to SEQ ID NO: 108225

SEQ ID NO: 264974 - RNA, 64 nt, Human; identical to SEQ ID NO: 108226

SEQ ID NO: 264975 - RNA, 64 nt, Human; identical to SEQ ID NO: 108227

SEQ ID NO: 264976 - RNA, 64 nt, Human; identical to SEQ ID NO: 108228

SEQ ID NO: 264977 - RNA, 64 nt, Human; identical to SEQ ID NO: 108229

SEQ ID NO: 264978 - RNA, 64 nt, Human; identical to SEQ ID NO: 108230

SEQ ID NO: 264979 - RNA, 64 nt, Human; identical to SEQ ID NO: 108231

SEQ ID NO: 264980 - RNA, 64 nt, Human; identical to SEQ ID NO: 108232

SEQ ID NO: 264981 - RNA, 64 nt, Human; identical to SEQ ID NO: 108233

SEQ ID NO: 264982 - RNA, 64 nt, Human; identical to SEQ ID NO: 108234

SEQ ID NO: 264983 - RNA, 64 nt, Human; identical to SEQ ID NO: 108235

SEQ ID NO: 264984 - RNA, 64 nt, Human; identical to SEQ ID NO: 108236

SEQ ID NO: 264985 - RNA, 64 nt, Human; identical to SEQ ID NO: 108237

SEQ ID NO: 264986 - RNA, 64 nt, Human; identical to SEQ ID NO: 108238

SEQ ID NO: 264987 - RNA, 64 nt, Human; identical to SEQ ID NO: 108239

SEQ ID NO: 264988 - RNA, 64 nt, Human; identical to SEQ ID NO: 108240

SEQ ID NO: 264989 - RNA, 64 nt, Human; identical to SEQ ID NO: 108241

SEQ ID NO: 264990 - RNA, 64 nt, Human; identical to SEQ ID NO: 108242

SEQ ID NO: 264991 - RNA, 64 nt, Human; identical to SEQ ID NO: 108243

SEQ ID NO: 264992 - RNA, 64 nt, Human; identical to SEQ ID NO: 108244

SEQ ID NO: 264993 - RNA, 64 nt, Human; identical to SEQ ID NO: 108245

SEQ ID NO: 264994 - RNA, 64 nt, Human; identical to SEQ ID NO: 108246

SEQ ID NO: 264995 - RNA, 64 nt, Human; identical to SEQ ID NO: 108247

SEQ ID NO: 264996 - RNA, 64 nt, Human; identical to SEQ ID NO: 108248

SEQ ID NO: 264997 - RNA, 64 nt, Human; identical to SEQ ID NO: 108249

SEQ ID NO: 264998 - RNA, 64 nt, Human; identical to SEQ ID NO: 108250

SEQ ID NO: 264999 - RNA, 64 nt, Human; identical to SEQ ID NO: 108251

SEQ ID NO: 265000 - RNA, 64 nt, Human; identical to SEQ ID NO: 108252

SEQ ID NO: 265001 - RNA, 64 nt, Human; identical to SEQ ID NO: 108253

SEQ ID NO: 265002 - RNA, 64 nt, Human; identical to SEQ ID NO: 108254

SEQ ID NO: 265003 - RNA, 64 nt, Human; identical to SEQ ID NO: 108255

SEQ ID NO: 265004 - RNA, 64 nt, Human; identical to SEQ ID NO: 108256

SEQ ID NO: 265005 - RNA, 64 nt, Human; identical to SEQ ID NO: 108257

SEQ ID NO: 265006 - RNA, 64 nt, Human; identical to SEQ ID NO: 108258

SEQ ID NO: 265007 - RNA, 64 nt, Human; identical to SEQ ID NO: 108259

SEQ ID NO: 265008 - RNA, 64 nt, Human; identical to SEQ ID NO: 108260

SEQ ID NO: 265009 - RNA, 64 nt, Human; identical to SEQ ID NO: 108261

SEQ ID NO: 265010 - RNA, 64 nt, Human; identical to SEQ ID NO: 108262

SEQ ID NO: 265011 - RNA, 64 nt, Human; identical to SEQ ID NO: 108263

SEQ ID NO: 265012 - RNA, 64 nt, Human; identical to SEQ ID NO: 108264

SEQ ID NO: 265013 - RNA, 64 nt, Human; identical to SEQ ID NO: 108265

SEQ ID NO: 265014 - RNA, 64 nt, Human; identical to SEQ ID NO: 108266

SEQ ID NO: 265015 - RNA, 64 nt, Human; identical to SEQ ID NO: 108267

SEQ ID NO: 265016 - RNA, 64 nt, Human; identical to SEQ ID NO: 108268

SEQ ID NO: 265017 - RNA, 64 nt, Human; identical to SEQ ID NO: 108269

SEQ ID NO: 265018 - RNA, 64 nt, Human; identical to SEQ ID NO: 108270

SEQ ID NO: 265019 - RNA, 64 nt, Human; identical to SEQ ID NO: 108271

SEQ ID NO: 265020 - RNA, 64 nt, Human; identical to SEQ ID NO: 108272

SEQ ID NO: 265021 - RNA, 64 nt, Human; identical to SEQ ID NO: 108273

SEQ ID NO: 265022 - RNA, 64 nt, Human; identical to SEQ ID NO: 108274

SEQ ID NO: 265023 - RNA, 64 nt, Human; identical to SEQ ID NO: 108275

SEQ ID NO: 265024 - RNA, 64 nt, Human; identical to SEQ ID NO: 108276

SEQ ID NO: 265025 - RNA, 64 nt, Human; identical to SEQ ID NO: 108277

SEQ ID NO: 265026 - RNA, 64 nt, Human; identical to SEQ ID NO: 108278

SEQ ID NO: 265027 - RNA, 64 nt, Human; identical to SEQ ID NO: 108279

SEQ ID NO: 265028 - RNA, 64 nt, Human; identical to SEQ ID NO: 108280

SEQ ID NO: 265029 - RNA, 64 nt, Human; identical to SEQ ID NO: 108281

SEQ ID NO: 265030 - RNA, 64 nt, Human; identical to SEQ ID NO: 108282

SEQ ID NO: 265031 - RNA, 64 nt, Human; identical to SEQ ID NO: 108283

SEQ ID NO: 265032 - RNA, 64 nt, Human; identical to SEQ ID NO: 108284

SEQ ID NO: 265033 - RNA, 64 nt, Human; identical to SEQ ID NO: 108285

SEQ ID NO: 265034 - RNA, 64 nt, Human; identical to SEQ ID NO: 108286

SEQ ID NO: 265035 - RNA, 64 nt, Human; identical to SEQ ID NO: 108287

SEQ ID NO: 265036 - RNA, 64 nt, Human; identical to SEQ ID NO: 108288

SEQ ID NO: 265037 - RNA, 64 nt, Human; identical to SEQ ID NO: 108289

SEQ ID NO: 265038 - RNA, 64 nt, Human; identical to SEQ ID NO: 108290

SEQ ID NO: 265039 - RNA, 64 nt, Human; identical to SEQ ID NO: 108291

SEQ ID NO: 265040 - RNA, 64 nt, Human; identical to SEQ ID NO: 108292

SEQ ID NO: 265041 - RNA, 64 nt, Human; identical to SEQ ID NO: 108293

SEQ ID NO: 265042 - RNA, 64 nt, Human; identical to SEQ ID NO: 108294

SEQ ID NO: 265043 - RNA, 64 nt, Human; identical to SEQ ID NO: 108295

SEQ ID NO: 265044 - RNA, 64 nt, Human; identical to SEQ ID NO: 108296

SEQ ID NO: 265045 - RNA, 64 nt, Human; identical to SEQ ID NO: 108297

SEQ ID NO: 265046 - RNA, 64 nt, Human; identical to SEQ ID NO: 108298

SEQ ID NO: 265047 - RNA, 64 nt, Human; identical to SEQ ID NO: 108299

SEQ ID NO: 265048 - RNA, 64 nt, Human; identical to SEQ ID NO: 108300

SEQ ID NO: 265049 - RNA, 64 nt, Human; identical to SEQ ID NO: 108301

SEQ ID NO: 265050 - RNA, 64 nt, Human; identical to SEQ ID NO: 108302

SEQ ID NO: 265051 - RNA, 64 nt, Human; identical to SEQ ID NO: 108303

SEQ ID NO: 265052 - RNA, 64 nt, Human; identical to SEQ ID NO: 108304

SEQ ID NO: 265053 - RNA, 64 nt, Human; identical to SEQ ID NO: 108305

SEQ ID NO: 265054 - RNA, 64 nt, Human; identical to SEQ ID NO: 108306

SEQ ID NO: 265055 - RNA, 64 nt, Human; identical to SEQ ID NO: 108307

SEQ ID NO: 265056 - RNA, 64 nt, Human; identical to SEQ ID NO: 108308

SEQ ID NO: 265057 - RNA, 64 nt, Human; identical to SEQ ID NO: 108309

SEQ ID NO: 265058 - RNA, 64 nt, Human; identical to SEQ ID NO: 108310

SEQ ID NO: 265059 - RNA, 64 nt, Human; identical to SEQ ID NO: 108311

SEQ ID NO: 265060 - RNA, 64 nt, Human; identical to SEQ ID NO: 108312

SEQ ID NO: 265061 - RNA, 64 nt, Human; identical to SEQ ID NO: 108313

SEQ ID NO: 265062 - RNA, 64 nt, Human; identical to SEQ ID NO: 108314

SEQ ID NO: 265063 - RNA, 64 nt, Human; identical to SEQ ID NO: 108315

SEQ ID NO: 265064 - RNA, 64 nt, Human; identical to SEQ ID NO: 108316

SEQ ID NO: 265065 - RNA, 64 nt, Human; identical to SEQ ID NO: 108317

SEQ ID NO: 265066 - RNA, 64 nt, Human; identical to SEQ ID NO: 108318

SEQ ID NO: 265067 - RNA, 64 nt, Human; identical to SEQ ID NO: 108319

SEQ ID NO: 265068 - RNA, 64 nt, Human; identical to SEQ ID NO: 108320

SEQ ID NO: 265069 - RNA, 64 nt, Human; identical to SEQ ID NO: 108321

SEQ ID NO: 265070 - RNA, 64 nt, Human; identical to SEQ ID NO: 108322

SEQ ID NO: 265071 - RNA, 64 nt, Human; identical to SEQ ID NO: 108323

SEQ ID NO: 265072 - RNA, 64 nt, Human; identical to SEQ ID NO: 108324

SEQ ID NO: 265073 - RNA, 64 nt, Human; identical to SEQ ID NO: 108325

SEQ ID NO: 265074 - RNA, 64 nt, Human; identical to SEQ ID NO: 108326

SEQ ID NO: 265075 - RNA, 64 nt, Human; identical to SEQ ID NO: 108327

SEQ ID NO: 265076 - RNA, 64 nt, Human; identical to SEQ ID NO: 108328

SEQ ID NO: 265077 - RNA, 64 nt, Human; identical to SEQ ID NO: 108329

SEQ ID NO: 265078 - RNA, 64 nt, Human; identical to SEQ ID NO: 108330

SEQ ID NO: 265079 - RNA, 64 nt, Human; identical to SEQ ID NO: 108331

SEQ ID NO: 265080 - RNA, 64 nt, Human; identical to SEQ ID NO: 108332

SEQ ID NO: 265081 - RNA, 64 nt, Human; identical to SEQ ID NO: 108333

SEQ ID NO: 265082 - RNA, 64 nt, Human; identical to SEQ ID NO: 108334

SEQ ID NO: 265083 - RNA, 64 nt, Human; identical to SEQ ID NO: 108335

SEQ ID NO: 265084 - RNA, 64 nt, Human; identical to SEQ ID NO: 108336

SEQ ID NO: 265085 - RNA, 64 nt, Human; identical to SEQ ID NO: 108337

SEQ ID NO: 265086 - RNA, 64 nt, Human; identical to SEQ ID NO: 108338

SEQ ID NO: 265087 - RNA, 64 nt, Human; identical to SEQ ID NO: 108339

SEQ ID NO: 265088 - RNA, 64 nt, Human; identical to SEQ ID NO: 108340

SEQ ID NO: 265089 - RNA, 64 nt, Human; identical to SEQ ID NO: 108341

SEQ ID NO: 265090 - RNA, 64 nt, Human; identical to SEQ ID NO: 108342

SEQ ID NO: 265091 - RNA, 64 nt, Human; identical to SEQ ID NO: 108343

SEQ ID NO: 265092 - RNA, 64 nt, Human; identical to SEQ ID NO: 108344

SEQ ID NO: 265093 - RNA, 64 nt, Human; identical to SEQ ID NO: 108345

SEQ ID NO: 265094 - RNA, 64 nt, Human; identical to SEQ ID NO: 108346

SEQ ID NO: 265095 - RNA, 64 nt, Human; identical to SEQ ID NO: 108347

SEQ ID NO: 265096 - RNA, 64 nt, Human; identical to SEQ ID NO: 108348

SEQ ID NO: 265097 - RNA, 64 nt, Human; identical to SEQ ID NO: 108349

SEQ ID NO: 265098 - RNA, 64 nt, Human; identical to SEQ ID NO: 108350

SEQ ID NO: 265099 - RNA, 64 nt, Human; identical to SEQ ID NO: 108351

SEQ ID NO: 265100 - RNA, 64 nt, Human; identical to SEQ ID NO: 108352

SEQ ID NO: 265101 - RNA, 64 nt, Human; identical to SEQ ID NO: 108353

SEQ ID NO: 265102 - RNA, 64 nt, Human; identical to SEQ ID NO: 108354

SEQ ID NO: 265103 - RNA, 64 nt, Human; identical to SEQ ID NO: 108355

SEQ ID NO: 265104 - RNA, 64 nt, Human; identical to SEQ ID NO: 108356

SEQ ID NO: 265105 - RNA, 64 nt, Human; identical to SEQ ID NO: 108357

SEQ ID NO: 265106 - RNA, 64 nt, Human; identical to SEQ ID NO: 108358

SEQ ID NO: 265107 - RNA, 64 nt, Human; identical to SEQ ID NO: 108359

SEQ ID NO: 265108 - RNA, 64 nt, Human; identical to SEQ ID NO: 108360

SEQ ID NO: 265109 - RNA, 64 nt, Human; identical to SEQ ID NO: 108361

SEQ ID NO: 265110 - RNA, 64 nt, Human; identical to SEQ ID NO: 108362

SEQ ID NO: 265111 - RNA, 64 nt, Human; identical to SEQ ID NO: 108363

SEQ ID NO: 265112 - RNA, 64 nt, Human; identical to SEQ ID NO: 108364

SEQ ID NO: 265113 - RNA, 64 nt, Human; identical to SEQ ID NO: 108365

SEQ ID NO: 265114 - RNA, 64 nt, Human; identical to SEQ ID NO: 108366

SEQ ID NO: 265115 - RNA, 64 nt, Human; identical to SEQ ID NO: 108367

SEQ ID NO: 265116 - RNA, 64 nt, Human; identical to SEQ ID NO: 108368

SEQ ID NO: 265117 - RNA, 64 nt, Human; identical to SEQ ID NO: 108369

SEQ ID NO: 265118 - RNA, 64 nt, Human; identical to SEQ ID NO: 108370

SEQ ID NO: 265119 - RNA, 64 nt, Human; identical to SEQ ID NO: 108371

SEQ ID NO: 265120 - RNA, 64 nt, Human; identical to SEQ ID NO: 108372

SEQ ID NO: 265121 - RNA, 58 nt, Human; identical to SEQ ID NO: 108373

SEQ ID NO: 265122 - RNA, 64 nt, Human; identical to SEQ ID NO: 108374

SEQ ID NO: 265123 - RNA, 64 nt, Human; identical to SEQ ID NO: 108375

SEQ ID NO: 265124 - RNA, 64 nt, Human; identical to SEQ ID NO: 108376

SEQ ID NO: 265125 - RNA, 64 nt, Human; identical to SEQ ID NO: 108377

SEQ ID NO: 265126 - RNA, 64 nt, Human; identical to SEQ ID NO: 108378

SEQ ID NO: 265127 - RNA, 64 nt, Human; identical to SEQ ID NO: 108379

SEQ ID NO: 265128 - RNA, 64 nt, Human; identical to SEQ ID NO: 108380

SEQ ID NO: 265129 - RNA, 64 nt, Human; identical to SEQ ID NO: 108381

SEQ ID NO: 265130 - RNA, 64 nt, Human; identical to SEQ ID NO: 108382

SEQ ID NO: 265131 - RNA, 64 nt, Human; identical to SEQ ID NO: 108383

SEQ ID NO: 265132 - RNA, 64 nt, Human; identical to SEQ ID NO: 108384

SEQ ID NO: 265133 - RNA, 64 nt, Human; identical to SEQ ID NO: 108385

SEQ ID NO: 265134 - RNA, 64 nt, Human; identical to SEQ ID NO: 108386

SEQ ID NO: 265135 - RNA, 60 nt, Human; identical to SEQ ID NO: 108387

SEQ ID NO: 265136 - RNA, 64 nt, Human; identical to SEQ ID NO: 108388

SEQ ID NO: 265137 - RNA, 64 nt, Human; identical to SEQ ID NO: 108389

SEQ ID NO: 265138 - RNA, 64 nt, Human; identical to SEQ ID NO: 108390

SEQ ID NO: 265139 - RNA, 64 nt, Human; identical to SEQ ID NO: 108391

SEQ ID NO: 265140 - RNA, 64 nt, Human; identical to SEQ ID NO: 108392

SEQ ID NO: 265141 - RNA, 64 nt, Human; identical to SEQ ID NO: 108393

SEQ ID NO: 265142 - RNA, 64 nt, Human; identical to SEQ ID NO: 108394

SEQ ID NO: 265143 - RNA, 64 nt, Human; identical to SEQ ID NO: 108395

SEQ ID NO: 265144 - RNA, 64 nt, Human; identical to SEQ ID NO: 108396

SEQ ID NO: 265145 - RNA, 64 nt, Human; identical to SEQ ID NO: 108397

SEQ ID NO: 265146 - RNA, 64 nt, Human; identical to SEQ ID NO: 108398

SEQ ID NO: 265147 - RNA, 64 nt, Human; identical to SEQ ID NO: 108399

SEQ ID NO: 265148 - RNA, 64 nt, Human; identical to SEQ ID NO: 108400

SEQ ID NO: 265149 - RNA, 64 nt, Human; identical to SEQ ID NO: 108401

SEQ ID NO: 265150 - RNA, 64 nt, Human; identical to SEQ ID NO: 108402

SEQ ID NO: 265151 - RNA, 64 nt, Human; identical to SEQ ID NO: 108403

SEQ ID NO: 265152 - RNA, 64 nt, Human; identical to SEQ ID NO: 108404

SEQ ID NO: 265153 - RNA, 64 nt, Human; identical to SEQ ID NO: 108405

SEQ ID NO: 265154 - RNA, 64 nt, Human; identical to SEQ ID NO: 108406

SEQ ID NO: 265155 - RNA, 64 nt, Human; identical to SEQ ID NO: 108407

SEQ ID NO: 265156 - RNA, 64 nt, Human; identical to SEQ ID NO: 108408

SEQ ID NO: 265157 - RNA, 64 nt, Human; identical to SEQ ID NO: 108409

SEQ ID NO: 265158 - RNA, 64 nt, Human; identical to SEQ ID NO: 108410

SEQ ID NO: 265159 - RNA, 64 nt, Human; identical to SEQ ID NO: 108411

SEQ ID NO: 265160 - RNA, 64 nt, Human; identical to SEQ ID NO: 108412

SEQ ID NO: 265161 - RNA, 64 nt, Human; identical to SEQ ID NO: 108413

SEQ ID NO: 265162 - RNA, 64 nt, Human; identical to SEQ ID NO: 108414

SEQ ID NO: 265163 - RNA, 64 nt, Human; identical to SEQ ID NO: 108415

SEQ ID NO: 265164 - RNA, 64 nt, Human; identical to SEQ ID NO: 108416

SEQ ID NO: 265165 - RNA, 64 nt, Human; identical to SEQ ID NO: 108417

SEQ ID NO: 265166 - RNA, 64 nt, Human; identical to SEQ ID NO: 108418

SEQ ID NO: 265167 - RNA, 64 nt, Human; identical to SEQ ID NO: 108419

SEQ ID NO: 265168 - RNA, 64 nt, Human; identical to SEQ ID NO: 108420

SEQ ID NO: 265169 - RNA, 64 nt, Human; identical to SEQ ID NO: 108421

SEQ ID NO: 265170 - RNA, 64 nt, Human; identical to SEQ ID NO: 108422

SEQ ID NO: 265171 - RNA, 64 nt, Human; identical to SEQ ID NO: 108423

SEQ ID NO: 265172 - RNA, 64 nt, Human; identical to SEQ ID NO: 108424

SEQ ID NO: 265173 - RNA, 64 nt, Human; identical to SEQ ID NO: 108425

SEQ ID NO: 265174 - RNA, 64 nt, Human; identical to SEQ ID NO: 108426

SEQ ID NO: 265175 - RNA, 64 nt, Human; identical to SEQ ID NO: 108427

SEQ ID NO: 265176 - RNA, 64 nt, Human; identical to SEQ ID NO: 108428

SEQ ID NO: 265177 - RNA, 64 nt, Human; identical to SEQ ID NO: 108429

SEQ ID NO: 265178 - RNA, 64 nt, Human; identical to SEQ ID NO: 108430

SEQ ID NO: 265179 - RNA, 64 nt, Human; identical to SEQ ID NO: 108431

SEQ ID NO: 265180 - RNA, 64 nt, Human; identical to SEQ ID NO: 108432

SEQ ID NO: 265181 - RNA, 64 nt, Human; identical to SEQ ID NO: 108433

SEQ ID NO: 265182 - RNA, 64 nt, Human; identical to SEQ ID NO: 108434

SEQ ID NO: 265183 - RNA, 64 nt, Human; identical to SEQ ID NO: 108435

SEQ ID NO: 265184 - RNA, 64 nt, Human; identical to SEQ ID NO: 108436

SEQ ID NO: 265185 - RNA, 64 nt, Human; identical to SEQ ID NO: 108437

SEQ ID NO: 265186 - RNA, 64 nt, Human; identical to SEQ ID NO: 108438

SEQ ID NO: 265187 - RNA, 64 nt, Human; identical to SEQ ID NO: 108439

SEQ ID NO: 265188 - RNA, 64 nt, Human; identical to SEQ ID NO: 108440

SEQ ID NO: 265189 - RNA, 64 nt, Human; identical to SEQ ID NO: 108441

SEQ ID NO: 265190 - RNA, 64 nt, Human; identical to SEQ ID NO: 108442

SEQ ID NO: 265191 - RNA, 64 nt, Human; identical to SEQ ID NO: 108443

SEQ ID NO: 265192 - RNA, 64 nt, Human; identical to SEQ ID NO: 108444

SEQ ID NO: 265193 - RNA, 64 nt, Human; identical to SEQ ID NO: 108445

SEQ ID NO: 265194 - RNA, 64 nt, Human; identical to SEQ ID NO: 108446

SEQ ID NO: 265195 - RNA, 64 nt, Human; identical to SEQ ID NO: 108447

SEQ ID NO: 265196 - RNA, 64 nt, Human; identical to SEQ ID NO: 108448

SEQ ID NO: 265197 - RNA, 64 nt, Human; identical to SEQ ID NO: 108449

SEQ ID NO: 265198 - RNA, 64 nt, Human; identical to SEQ ID NO: 108450

SEQ ID NO: 265199 - RNA, 64 nt, Human; identical to SEQ ID NO: 108451

SEQ ID NO: 265200 - RNA, 64 nt, Human; identical to SEQ ID NO: 108452

SEQ ID NO: 265201 - RNA, 64 nt, Human; identical to SEQ ID NO: 108453

SEQ ID NO: 265202 - RNA, 64 nt, Human; identical to SEQ ID NO: 108454

SEQ ID NO: 265203 - RNA, 64 nt, Human; identical to SEQ ID NO: 108455

SEQ ID NO: 265204 - RNA, 64 nt, Human; identical to SEQ ID NO: 108456

SEQ ID NO: 265205 - RNA, 64 nt, Human; identical to SEQ ID NO: 108457

SEQ ID NO: 265206 - RNA, 64 nt, Human; identical to SEQ ID NO: 108458

SEQ ID NO: 265207 - RNA, 64 nt, Human; identical to SEQ ID NO: 108459

SEQ ID NO: 265208 - RNA, 64 nt, Human; identical to SEQ ID NO: 108460

SEQ ID NO: 265209 - RNA, 64 nt, Human; identical to SEQ ID NO: 108461

SEQ ID NO: 265210 - RNA, 64 nt, Human; identical to SEQ ID NO: 108462

SEQ ID NO: 265211 - RNA, 64 nt, Human; identical to SEQ ID NO: 108463

SEQ ID NO: 265212 - RNA, 64 nt, Human; identical to SEQ ID NO: 108464

SEQ ID NO: 265213 - RNA, 64 nt, Human; identical to SEQ ID NO: 108465

SEQ ID NO: 265214 - RNA, 64 nt, Human; identical to SEQ ID NO: 108466

SEQ ID NO: 265215 - RNA, 64 nt, Human; identical to SEQ ID NO: 108467

SEQ ID NO: 265216 - RNA, 64 nt, Human; identical to SEQ ID NO: 108468

SEQ ID NO: 265217 - RNA, 64 nt, Human; identical to SEQ ID NO: 108469

SEQ ID NO: 265218 - RNA, 64 nt, Human; identical to SEQ ID NO: 108470

SEQ ID NO: 265219 - RNA, 64 nt, Human; identical to SEQ ID NO: 108471

SEQ ID NO: 265220 - RNA, 64 nt, Human; identical to SEQ ID NO: 108472

SEQ ID NO: 265221 - RNA, 64 nt, Human; identical to SEQ ID NO: 108473

SEQ ID NO: 265222 - RNA, 64 nt, Human; identical to SEQ ID NO: 108474

SEQ ID NO: 265223 - RNA, 64 nt, Human; identical to SEQ ID NO: 108475

SEQ ID NO: 265224 - RNA, 64 nt, Human; identical to SEQ ID NO: 108476

SEQ ID NO: 265225 - RNA, 64 nt, Human; identical to SEQ ID NO: 108477

SEQ ID NO: 265226 - RNA, 64 nt, Human; identical to SEQ ID NO: 108478

SEQ ID NO: 265227 - RNA, 64 nt, Human; identical to SEQ ID NO: 108479

SEQ ID NO: 265228 - RNA, 64 nt, Human; identical to SEQ ID NO: 108480

SEQ ID NO: 265229 - RNA, 64 nt, Human; identical to SEQ ID NO: 108481

SEQ ID NO: 265230 - RNA, 64 nt, Human; identical to SEQ ID NO: 108482

SEQ ID NO: 265231 - RNA, 64 nt, Human; identical to SEQ ID NO: 108483

SEQ ID NO: 265232 - RNA, 64 nt, Human; identical to SEQ ID NO: 108484

SEQ ID NO: 265233 - RNA, 64 nt, Human; identical to SEQ ID NO: 108485

SEQ ID NO: 265234 - RNA, 64 nt, Human; identical to SEQ ID NO: 108486

SEQ ID NO: 265235 - RNA, 64 nt, Human; identical to SEQ ID NO: 108487

SEQ ID NO: 265236 - RNA, 64 nt, Human; identical to SEQ ID NO: 108488

SEQ ID NO: 265237 - RNA, 64 nt, Human; identical to SEQ ID NO: 108489

SEQ ID NO: 265238 - RNA, 64 nt, Human; identical to SEQ ID NO: 108490

SEQ ID NO: 265239 - RNA, 64 nt, Human; identical to SEQ ID NO: 108491

SEQ ID NO: 265240 - RNA, 64 nt, Human; identical to SEQ ID NO: 108492

SEQ ID NO: 265241 - RNA, 64 nt, Human; identical to SEQ ID NO: 108493

SEQ ID NO: 265242 - RNA, 64 nt, Human; identical to SEQ ID NO: 108494

SEQ ID NO: 265243 - RNA, 64 nt, Human; identical to SEQ ID NO: 108495

SEQ ID NO: 265244 - RNA, 64 nt, Human; identical to SEQ ID NO: 108496

SEQ ID NO: 265245 - RNA, 64 nt, Human; identical to SEQ ID NO: 108497

SEQ ID NO: 265246 - RNA, 64 nt, Human; identical to SEQ ID NO: 108498

SEQ ID NO: 265247 - RNA, 64 nt, Human; identical to SEQ ID NO: 108499

SEQ ID NO: 265248 - RNA, 64 nt, Human; identical to SEQ ID NO: 108500

SEQ ID NO: 265249 - RNA, 64 nt, Human; identical to SEQ ID NO: 108501

SEQ ID NO: 265250 - RNA, 62 nt, Human; identical to SEQ ID NO: 108502

SEQ ID NO: 265251 - RNA, 64 nt, Human; identical to SEQ ID NO: 108503

SEQ ID NO: 265252 - RNA, 64 nt, Human; identical to SEQ ID NO: 108504

SEQ ID NO: 265253 - RNA, 64 nt, Human; identical to SEQ ID NO: 108505

SEQ ID NO: 265254 - RNA, 64 nt, Human; identical to SEQ ID NO: 108506

SEQ ID NO: 265255 - RNA, 64 nt, Human; identical to SEQ ID NO: 108507

SEQ ID NO: 265256 - RNA, 64 nt, Human; identical to SEQ ID NO: 108508

SEQ ID NO: 265257 - RNA, 64 nt, Human; identical to SEQ ID NO: 108509

SEQ ID NO: 265258 - RNA, 61 nt, Human; identical to SEQ ID NO: 108510

SEQ ID NO: 265259 - RNA, 64 nt, Human; identical to SEQ ID NO: 108511

SEQ ID NO: 265260 - RNA, 64 nt, Human; identical to SEQ ID NO: 108512

SEQ ID NO: 265261 - RNA, 64 nt, Human; identical to SEQ ID NO: 108513

SEQ ID NO: 265262 - RNA, 64 nt, Human; identical to SEQ ID NO: 108514

SEQ ID NO: 265263 - RNA, 63 nt, Human; identical to SEQ ID NO: 108515

SEQ ID NO: 265264 - RNA, 64 nt, Human; identical to SEQ ID NO: 108516

SEQ ID NO: 265265 - RNA, 64 nt, Human; identical to SEQ ID NO: 108517

SEQ ID NO: 265266 - RNA, 64 nt, Human; identical to SEQ ID NO: 108518

SEQ ID NO: 265267 - RNA, 64 nt, Human; identical to SEQ ID NO: 108519

SEQ ID NO: 265268 - RNA, 64 nt, Human; identical to SEQ ID NO: 108520

SEQ ID NO: 265269 - RNA, 64 nt, Human; identical to SEQ ID NO: 108521

SEQ ID NO: 265270 - RNA, 64 nt, Human; identical to SEQ ID NO: 108522

SEQ ID NO: 265271 - RNA, 64 nt, Human; identical to SEQ ID NO: 108523

SEQ ID NO: 265272 - RNA, 64 nt, Human; identical to SEQ ID NO: 108524

SEQ ID NO: 265273 - RNA, 64 nt, Human; identical to SEQ ID NO: 108525

SEQ ID NO: 265274 - RNA, 64 nt, Human; identical to SEQ ID NO: 108526

SEQ ID NO: 265275 - RNA, 64 nt, Human; identical to SEQ ID NO: 108527

SEQ ID NO: 265276 - RNA, 64 nt, Human; identical to SEQ ID NO: 108528

SEQ ID NO: 265277 - RNA, 64 nt, Human; identical to SEQ ID NO: 108529

SEQ ID NO: 265278 - RNA, 64 nt, Human; identical to SEQ ID NO: 108530

SEQ ID NO: 265279 - RNA, 64 nt, Human; identical to SEQ ID NO: 108531

SEQ ID NO: 265280 - RNA, 64 nt, Human; identical to SEQ ID NO: 108532

SEQ ID NO: 265281 - RNA, 64 nt, Human; identical to SEQ ID NO: 108533

SEQ ID NO: 265282 - RNA, 64 nt, Human; identical to SEQ ID NO: 108534

SEQ ID NO: 265283 - RNA, 64 nt, Human; identical to SEQ ID NO: 108535

SEQ ID NO: 265284 - RNA, 64 nt, Human; identical to SEQ ID NO: 108536

SEQ ID NO: 265285 - RNA, 64 nt, Human; identical to SEQ ID NO: 108537

SEQ ID NO: 265286 - RNA, 50 nt, Human; identical to SEQ ID NO: 108538

SEQ ID NO: 265287 - RNA, 64 nt, Human; identical to SEQ ID NO: 108539

SEQ ID NO: 265288 - RNA, 64 nt, Human; identical to SEQ ID NO: 108540

SEQ ID NO: 265289 - RNA, 64 nt, Human; identical to SEQ ID NO: 108541

SEQ ID NO: 265290 - RNA, 64 nt, Human; identical to SEQ ID NO: 108542

SEQ ID NO: 265291 - RNA, 64 nt, Human; identical to SEQ ID NO: 108543

SEQ ID NO: 265292 - RNA, 64 nt, Human; identical to SEQ ID NO: 108544

SEQ ID NO: 265293 - RNA, 64 nt, Human; identical to SEQ ID NO: 108545

SEQ ID NO: 265294 - RNA, 64 nt, Human; identical to SEQ ID NO: 108546

SEQ ID NO: 265295 - RNA, 64 nt, Human; identical to SEQ ID NO: 108547

SEQ ID NO: 265296 - RNA, 64 nt, Human; identical to SEQ ID NO: 108548

SEQ ID NO: 265297 - RNA, 64 nt, Human; identical to SEQ ID NO: 108549

SEQ ID NO: 265298 - RNA, 64 nt, Human; identical to SEQ ID NO: 108550

SEQ ID NO: 265299 - RNA, 64 nt, Human; identical to SEQ ID NO: 108551

SEQ ID NO: 265300 - RNA, 64 nt, Human; identical to SEQ ID NO: 107914

SEQ ID NO: 265301 - RNA, 64 nt, Human; identical to SEQ ID NO: 108553

SEQ ID NO: 265302 - RNA, 64 nt, Human; identical to SEQ ID NO: 108554

SEQ ID NO: 265303 - RNA, 64 nt, Human; identical to SEQ ID NO: 108555

SEQ ID NO: 265304 - RNA, 64 nt, Human; identical to SEQ ID NO: 108556

SEQ ID NO: 265305 - RNA, 64 nt, Human; identical to SEQ ID NO: 108557

SEQ ID NO: 265306 - RNA, 64 nt, Human; identical to SEQ ID NO: 108558

SEQ ID NO: 265307 - RNA, 64 nt, Human; identical to SEQ ID NO: 108559

SEQ ID NO: 265308 - RNA, 64 nt, Human; identical to SEQ ID NO: 108560

SEQ ID NO: 265309 - RNA, 64 nt, Human; identical to SEQ ID NO: 108561

SEQ ID NO: 265310 - RNA, 64 nt, Human; identical to SEQ ID NO: 108562

SEQ ID NO: 265311 - RNA, 64 nt, Human; identical to SEQ ID NO: 108563

SEQ ID NO: 265312 - RNA, 64 nt, Human; identical to SEQ ID NO: 108564

SEQ ID NO: 265313 - RNA, 64 nt, Human; identical to SEQ ID NO: 108565

SEQ ID NO: 265314 - RNA, 64 nt, Human; identical to SEQ ID NO: 108566

SEQ ID NO: 265315 - RNA, 64 nt, Human; identical to SEQ ID NO: 108567

SEQ ID NO: 265316 - RNA, 64 nt, Human; identical to SEQ ID NO: 108568

SEQ ID NO: 265317 - RNA, 64 nt, Human; identical to SEQ ID NO: 108569

SEQ ID NO: 265318 - RNA, 64 nt, Human; identical to SEQ ID NO: 108570

SEQ ID NO: 265319 - RNA, 64 nt, Human; identical to SEQ ID NO: 108571

SEQ ID NO: 265320 - RNA, 64 nt, Human; identical to SEQ ID NO: 108572

SEQ ID NO: 265321 - RNA, 64 nt, Human; identical to SEQ ID NO: 108573

SEQ ID NO: 265322 - RNA, 64 nt, Human; identical to SEQ ID NO: 108574

SEQ ID NO: 265323 - RNA, 64 nt, Human; identical to SEQ ID NO: 108575

SEQ ID NO: 265324 - RNA, 64 nt, Human; identical to SEQ ID NO: 108576

SEQ ID NO: 265325 - RNA, 64 nt, Human; identical to SEQ ID NO: 108577

SEQ ID NO: 265326 - RNA, 64 nt, Human; identical to SEQ ID NO: 108578

SEQ ID NO: 265327 - RNA, 64 nt, Human; identical to SEQ ID NO: 108579

SEQ ID NO: 265328 - RNA, 64 nt, Human; identical to SEQ ID NO: 108580

SEQ ID NO: 265329 - RNA, 64 nt, Human; identical to SEQ ID NO: 108581

SEQ ID NO: 265330 - RNA, 64 nt, Human; identical to SEQ ID NO: 108582

SEQ ID NO: 265331 - RNA, 64 nt, Human; identical to SEQ ID NO: 108583

SEQ ID NO: 265332 - RNA, 64 nt, Human; identical to SEQ ID NO: 108584

SEQ ID NO: 265333 - RNA, 64 nt, Human; identical to SEQ ID NO: 108585

SEQ ID NO: 265334 - RNA, 64 nt, Human; identical to SEQ ID NO: 108586

SEQ ID NO: 265335 - RNA, 64 nt, Human; identical to SEQ ID NO: 108587

SEQ ID NO: 265336 - RNA, 64 nt, Human; identical to SEQ ID NO: 108588

SEQ ID NO: 265337 - RNA, 64 nt, Human; identical to SEQ ID NO: 108589

SEQ ID NO: 265338 - RNA, 64 nt, Human; identical to SEQ ID NO: 108590

SEQ ID NO: 265339 - RNA, 64 nt, Human; identical to SEQ ID NO: 108591

SEQ ID NO: 265340 - RNA, 64 nt, Human; identical to SEQ ID NO: 108592

SEQ ID NO: 265341 - RNA, 64 nt, Human; identical to SEQ ID NO: 108593

SEQ ID NO: 265342 - RNA, 64 nt, Human; identical to SEQ ID NO: 108594

SEQ ID NO: 265343 - RNA, 64 nt, Human; identical to SEQ ID NO: 108595

SEQ ID NO: 265344 - RNA, 64 nt, Human; identical to SEQ ID NO: 108596

SEQ ID NO: 265345 - RNA, 64 nt, Human; identical to SEQ ID NO: 108597

SEQ ID NO: 265346 - RNA, 64 nt, Human; identical to SEQ ID NO: 108598

SEQ ID NO: 265347 - RNA, 64 nt, Human; identical to SEQ ID NO: 108599

SEQ ID NO: 265348 - RNA, 64 nt, Human; identical to SEQ ID NO: 108600

SEQ ID NO: 265349 - RNA, 64 nt, Human; identical to SEQ ID NO: 108601

SEQ ID NO: 265350 - RNA, 64 nt, Human; identical to SEQ ID NO: 108602

SEQ ID NO: 265351 - RNA, 64 nt, Human; identical to SEQ ID NO: 108603

SEQ ID NO: 265352 - RNA, 64 nt, Human; identical to SEQ ID NO: 108604

SEQ ID NO: 265353 - RNA, 64 nt, Human; identical to SEQ ID NO: 108605

SEQ ID NO: 265354 - RNA, 64 nt, Human; identical to SEQ ID NO: 108606

SEQ ID NO: 265355 - RNA, 64 nt, Human; identical to SEQ ID NO: 108607

SEQ ID NO: 265356 - RNA, 64 nt, Human; identical to SEQ ID NO: 108608

SEQ ID NO: 265357 - RNA, 64 nt, Human; identical to SEQ ID NO: 108609

SEQ ID NO: 265358 - RNA, 64 nt, Human; identical to SEQ ID NO: 108610

SEQ ID NO: 265359 - RNA, 64 nt, Human; identical to SEQ ID NO: 108611

SEQ ID NO: 265360 - RNA, 64 nt, Human; identical to SEQ ID NO: 108612

SEQ ID NO: 265361 - RNA, 64 nt, Human; identical to SEQ ID NO: 108613

SEQ ID NO: 265362 - RNA, 64 nt, Human; identical to SEQ ID NO: 108614

SEQ ID NO: 265363 - RNA, 64 nt, Human; identical to SEQ ID NO: 108615

SEQ ID NO: 265364 - RNA, 64 nt, Human; identical to SEQ ID NO: 108616

SEQ ID NO: 265365 - RNA, 64 nt, Human; identical to SEQ ID NO: 108617

SEQ ID NO: 265366 - RNA, 64 nt, Human; identical to SEQ ID NO: 108618

SEQ ID NO: 265367 - RNA, 50 nt, Human; identical to SEQ ID NO: 108619

SEQ ID NO: 265368 - RNA, 54 nt, Human; identical to SEQ ID NO: 108620

SEQ ID NO: 265369 - RNA, 64 nt, Human; identical to SEQ ID NO: 108621

SEQ ID NO: 265370 - RNA, 64 nt, Human; identical to SEQ ID NO: 108622

SEQ ID NO: 265371 - RNA, 64 nt, Human; identical to SEQ ID NO: 108623

SEQ ID NO: 265372 - RNA, 64 nt, Human; identical to SEQ ID NO: 108624

SEQ ID NO: 265373 - RNA, 64 nt, Human; identical to SEQ ID NO: 108625

SEQ ID NO: 265374 - RNA, 64 nt, Human; identical to SEQ ID NO: 108626

SEQ ID NO: 265375 - RNA, 64 nt, Human; identical to SEQ ID NO: 108627

SEQ ID NO: 265376 - RNA, 64 nt, Human; identical to SEQ ID NO: 108628

SEQ ID NO: 265377 - RNA, 64 nt, Human; identical to SEQ ID NO: 108629

SEQ ID NO: 265378 - RNA, 64 nt, Human; identical to SEQ ID NO: 108630

SEQ ID NO: 265379 - RNA, 64 nt, Human; identical to SEQ ID NO: 108631

SEQ ID NO: 265380 - RNA, 64 nt, Human; identical to SEQ ID NO: 108632

SEQ ID NO: 265381 - RNA, 64 nt, Human; identical to SEQ ID NO: 108633

SEQ ID NO: 265382 - RNA, 64 nt, Human; identical to SEQ ID NO: 108634

SEQ ID NO: 265383 - RNA, 64 nt, Human; identical to SEQ ID NO: 108635

SEQ ID NO: 265384 - RNA, 64 nt, Human; identical to SEQ ID NO: 108636

SEQ ID NO: 265385 - RNA, 64 nt, Human; identical to SEQ ID NO: 108637

SEQ ID NO: 265386 - RNA, 64 nt, Human; identical to SEQ ID NO: 108638

SEQ ID NO: 265387 - RNA, 64 nt, Human; identical to SEQ ID NO: 108639

SEQ ID NO: 265388 - RNA, 64 nt, Human; identical to SEQ ID NO: 108640

SEQ ID NO: 265389 - RNA, 64 nt, Human; identical to SEQ ID NO: 108641

SEQ ID NO: 265390 - RNA, 64 nt, Human; identical to SEQ ID NO: 108642

SEQ ID NO: 265391 - RNA, 64 nt, Human; identical to SEQ ID NO: 108643

SEQ ID NO: 265392 - RNA, 64 nt, Human; identical to SEQ ID NO: 108644

SEQ ID NO: 265393 - RNA, 64 nt, Human; identical to SEQ ID NO: 108645

SEQ ID NO: 265394 - RNA, 64 nt, Human; identical to SEQ ID NO: 108646

SEQ ID NO: 265395 - RNA, 64 nt, Human; identical to SEQ ID NO: 108647

SEQ ID NO: 265396 - RNA, 64 nt, Human; identical to SEQ ID NO: 108648

SEQ ID NO: 265397 - RNA, 64 nt, Human; identical to SEQ ID NO: 108649

SEQ ID NO: 265398 - RNA, 64 nt, Human; identical to SEQ ID NO: 108650

SEQ ID NO: 265399 - RNA, 64 nt, Human; identical to SEQ ID NO: 108651

SEQ ID NO: 265400 - RNA, 64 nt, Human; identical to SEQ ID NO: 108652

SEQ ID NO: 265401 - RNA, 64 nt, Human; identical to SEQ ID NO: 108653

SEQ ID NO: 265402 - RNA, 64 nt, Human; identical to SEQ ID NO: 108654

SEQ ID NO: 265403 - RNA, 64 nt, Human; identical to SEQ ID NO: 108655

SEQ ID NO: 265404 - RNA, 64 nt, Human; identical to SEQ ID NO: 108656

SEQ ID NO: 265405 - RNA, 64 nt, Human; identical to SEQ ID NO: 108657

SEQ ID NO: 265406 - RNA, 64 nt, Human; identical to SEQ ID NO: 108658

SEQ ID NO: 265407 - RNA, 64 nt, Human; identical to SEQ ID NO: 108659

SEQ ID NO: 265408 - RNA, 64 nt, Human; identical to SEQ ID NO: 108660

SEQ ID NO: 265409 - RNA, 64 nt, Human; identical to SEQ ID NO: 108661

SEQ ID NO: 265410 - RNA, 64 nt, Human; identical to SEQ ID NO: 108662

SEQ ID NO: 265411 - RNA, 64 nt, Human; identical to SEQ ID NO: 108663

SEQ ID NO: 265412 - RNA, 64 nt, Human; identical to SEQ ID NO: 108664

SEQ ID NO: 265413 - RNA, 64 nt, Human; identical to SEQ ID NO: 108665

SEQ ID NO: 265414 - RNA, 64 nt, Human; identical to SEQ ID NO: 108666

SEQ ID NO: 265415 - RNA, 64 nt, Human; identical to SEQ ID NO: 108667

SEQ ID NO: 265416 - RNA, 64 nt, Human; identical to SEQ ID NO: 108668

SEQ ID NO: 265417 - RNA, 64 nt, Human; identical to SEQ ID NO: 108669

SEQ ID NO: 265418 - RNA, 64 nt, Human; identical to SEQ ID NO: 108670

SEQ ID NO: 265419 - RNA, 64 nt, Human; identical to SEQ ID NO: 108671

SEQ ID NO: 265420 - RNA, 64 nt, Human; identical to SEQ ID NO: 108672

SEQ ID NO: 265421 - RNA, 64 nt, Human; identical to SEQ ID NO: 108673

SEQ ID NO: 265422 - RNA, 64 nt, Human; identical to SEQ ID NO: 108674

SEQ ID NO: 265423 - RNA, 64 nt, Human; identical to SEQ ID NO: 108675

SEQ ID NO: 265424 - RNA, 64 nt, Human; identical to SEQ ID NO: 108676

SEQ ID NO: 265425 - RNA, 64 nt, Human; identical to SEQ ID NO: 108677

SEQ ID NO: 265426 - RNA, 53 nt, Human; identical to SEQ ID NO: 108678

SEQ ID NO: 265427 - RNA, 64 nt, Human; identical to SEQ ID NO: 108679

SEQ ID NO: 265428 - RNA, 64 nt, Human; identical to SEQ ID NO: 108680

SEQ ID NO: 265429 - RNA, 64 nt, Human; identical to SEQ ID NO: 108681

SEQ ID NO: 265430 - RNA, 64 nt, Human; identical to SEQ ID NO: 108682

SEQ ID NO: 265431 - RNA, 64 nt, Human; identical to SEQ ID NO: 108683

SEQ ID NO: 265432 - RNA, 64 nt, Human; identical to SEQ ID NO: 108684

SEQ ID NO: 265433 - RNA, 64 nt, Human; identical to SEQ ID NO: 108685

SEQ ID NO: 265434 - RNA, 64 nt, Human; identical to SEQ ID NO: 108686

SEQ ID NO: 265435 - RNA, 64 nt, Human; identical to SEQ ID NO: 108687

SEQ ID NO: 265436 - RNA, 64 nt, Human; identical to SEQ ID NO: 108688

SEQ ID NO: 265437 - RNA, 64 nt, Human; identical to SEQ ID NO: 108689

SEQ ID NO: 265438 - RNA, 64 nt, Human; identical to SEQ ID NO: 108690

SEQ ID NO: 265439 - RNA, 64 nt, Human; identical to SEQ ID NO: 108691

SEQ ID NO: 265440 - RNA, 64 nt, Human; identical to SEQ ID NO: 108692

SEQ ID NO: 265441 - RNA, 60 nt, Human; identical to SEQ ID NO: 108693

SEQ ID NO: 265442 - RNA, 64 nt, Human; identical to SEQ ID NO: 108694

SEQ ID NO: 265443 - RNA, 64 nt, Human; identical to SEQ ID NO: 108695

SEQ ID NO: 265444 - RNA, 64 nt, Human; identical to SEQ ID NO: 108696

SEQ ID NO: 265445 - RNA, 64 nt, Human; identical to SEQ ID NO: 108697

SEQ ID NO: 265446 - RNA, 64 nt, Human; identical to SEQ ID NO: 108698

SEQ ID NO: 265447 - RNA, 64 nt, Human; identical to SEQ ID NO: 108699

SEQ ID NO: 265448 - RNA, 64 nt, Human; identical to SEQ ID NO: 108700

SEQ ID NO: 265449 - RNA, 64 nt, Human; identical to SEQ ID NO: 108701

SEQ ID NO: 265450 - RNA, 64 nt, Human; identical to SEQ ID NO: 108702

SEQ ID NO: 265451 - RNA, 64 nt, Human; identical to SEQ ID NO: 108703

SEQ ID NO: 265452 - RNA, 64 nt, Human; identical to SEQ ID NO: 108704

SEQ ID NO: 265453 - RNA, 64 nt, Human; identical to SEQ ID NO: 108705

SEQ ID NO: 265454 - RNA, 64 nt, Human; identical to SEQ ID NO: 108706

SEQ ID NO: 265455 - RNA, 64 nt, Human; identical to SEQ ID NO: 108707

SEQ ID NO: 265456 - RNA, 64 nt, Human; identical to SEQ ID NO: 108708

SEQ ID NO: 265457 - RNA, 64 nt, Human; identical to SEQ ID NO: 108709

SEQ ID NO: 265458 - RNA, 64 nt, Human; identical to SEQ ID NO: 108710

SEQ ID NO: 265459 - RNA, 64 nt, Human; identical to SEQ ID NO: 108711

SEQ ID NO: 265460 - RNA, 64 nt, Human; identical to SEQ ID NO: 108712

SEQ ID NO: 265461 - RNA, 64 nt, Human; identical to SEQ ID NO: 108713

SEQ ID NO: 265462 - RNA, 64 nt, Human; identical to SEQ ID NO: 108714

SEQ ID NO: 265463 - RNA, 64 nt, Human; identical to SEQ ID NO: 108715

SEQ ID NO: 265464 - RNA, 64 nt, Human; identical to SEQ ID NO: 108716

SEQ ID NO: 265465 - RNA, 64 nt, Human; identical to SEQ ID NO: 108717

SEQ ID NO: 265466 - RNA, 64 nt, Human; identical to SEQ ID NO: 108718

SEQ ID NO: 265467 - RNA, 64 nt, Human; identical to SEQ ID NO: 108719

SEQ ID NO: 265468 - RNA, 64 nt, Human; identical to SEQ ID NO: 108720

SEQ ID NO: 265469 - RNA, 64 nt, Human; identical to SEQ ID NO: 108721

SEQ ID NO: 265470 - RNA, 64 nt, Human; identical to SEQ ID NO: 108722

SEQ ID NO: 265471 - RNA, 64 nt, Human; identical to SEQ ID NO: 108723

SEQ ID NO: 265472 - RNA, 64 nt, Human; identical to SEQ ID NO: 108724

SEQ ID NO: 265473 - RNA, 64 nt, Human; identical to SEQ ID NO: 108725

SEQ ID NO: 265474 - RNA, 64 nt, Human; identical to SEQ ID NO: 108726

SEQ ID NO: 265475 - RNA, 64 nt, Human; identical to SEQ ID NO: 108727

SEQ ID NO: 265476 - RNA, 64 nt, Human; identical to SEQ ID NO: 108728

SEQ ID NO: 265477 - RNA, 64 nt, Human; identical to SEQ ID NO: 108729

SEQ ID NO: 265478 - RNA, 64 nt, Human; identical to SEQ ID NO: 108730

SEQ ID NO: 265479 - RNA, 64 nt, Human; identical to SEQ ID NO: 108731

SEQ ID NO: 265480 - RNA, 64 nt, Human; identical to SEQ ID NO: 108732

SEQ ID NO: 265481 - RNA, 64 nt, Human; identical to SEQ ID NO: 108733

SEQ ID NO: 265482 - RNA, 64 nt, Human; identical to SEQ ID NO: 108734

SEQ ID NO: 265483 - RNA, 64 nt, Human; identical to SEQ ID NO: 108735

SEQ ID NO: 265484 - RNA, 64 nt, Human; identical to SEQ ID NO: 108736

SEQ ID NO: 265485 - RNA, 64 nt, Human; identical to SEQ ID NO: 108737

SEQ ID NO: 265486 - RNA, 64 nt, Human; identical to SEQ ID NO: 108738

SEQ ID NO: 265487 - RNA, 64 nt, Human; identical to SEQ ID NO: 108739

SEQ ID NO: 265488 - RNA, 64 nt, Human; identical to SEQ ID NO: 108740

SEQ ID NO: 265489 - RNA, 64 nt, Human; identical to SEQ ID NO: 108741

SEQ ID NO: 265490 - RNA, 64 nt, Human; identical to SEQ ID NO: 108742

SEQ ID NO: 265491 - RNA, 64 nt, Human; identical to SEQ ID NO: 108743

SEQ ID NO: 265492 - RNA, 64 nt, Human; identical to SEQ ID NO: 108744

SEQ ID NO: 265493 - RNA, 64 nt, Human; identical to SEQ ID NO: 108745

SEQ ID NO: 265494 - RNA, 64 nt, Human; identical to SEQ ID NO: 108746

SEQ ID NO: 265495 - RNA, 64 nt, Human; identical to SEQ ID NO: 108747

SEQ ID NO: 265496 - RNA, 64 nt, Human; identical to SEQ ID NO: 108748

SEQ ID NO: 265497 - RNA, 64 nt, Human; identical to SEQ ID NO: 108749

SEQ ID NO: 265498 - RNA, 64 nt, Human; identical to SEQ ID NO: 108750

SEQ ID NO: 265499 - RNA, 64 nt, Human; identical to SEQ ID NO: 108751

SEQ ID NO: 265500 - RNA, 64 nt, Human; identical to SEQ ID NO: 108752

SEQ ID NO: 265501 - RNA, 64 nt, Human; identical to SEQ ID NO: 108753

SEQ ID NO: 265502 - RNA, 64 nt, Human; identical to SEQ ID NO: 108754

SEQ ID NO: 265503 - RNA, 64 nt, Human; identical to SEQ ID NO: 108755

SEQ ID NO: 265504 - RNA, 64 nt, Human; identical to SEQ ID NO: 108756

SEQ ID NO: 265505 - RNA, 50 nt, Human; identical to SEQ ID NO: 108757

SEQ ID NO: 265506 - RNA, 64 nt, Human; identical to SEQ ID NO: 108758

SEQ ID NO: 265507 - RNA, 64 nt, Human; identical to SEQ ID NO: 108759

SEQ ID NO: 265508 - RNA, 64 nt, Human; identical to SEQ ID NO: 108760

SEQ ID NO: 265509 - RNA, 64 nt, Human; identical to SEQ ID NO: 108761

SEQ ID NO: 265510 - RNA, 64 nt, Human; identical to SEQ ID NO: 108762

SEQ ID NO: 265511 - RNA, 64 nt, Human; identical to SEQ ID NO: 108763

SEQ ID NO: 265512 - RNA, 64 nt, Human; identical to SEQ ID NO: 108764

SEQ ID NO: 265513 - RNA, 64 nt, Human; identical to SEQ ID NO: 108765

SEQ ID NO: 265514 - RNA, 64 nt, Human; identical to SEQ ID NO: 108766

SEQ ID NO: 265515 - RNA, 64 nt, Human; identical to SEQ ID NO: 108767

SEQ ID NO: 265516 - RNA, 64 nt, Human; identical to SEQ ID NO: 108768

SEQ ID NO: 265517 - RNA, 64 nt, Human; identical to SEQ ID NO: 108769

SEQ ID NO: 265518 - RNA, 64 nt, Human; identical to SEQ ID NO: 108770

SEQ ID NO: 265519 - RNA, 64 nt, Human; identical to SEQ ID NO: 108771

SEQ ID NO: 265520 - RNA, 64 nt, Human; identical to SEQ ID NO: 108772

SEQ ID NO: 265521 - RNA, 64 nt, Human; identical to SEQ ID NO: 108773

SEQ ID NO: 265522 - RNA, 64 nt, Human; identical to SEQ ID NO: 108774

SEQ ID NO: 265523 - RNA, 64 nt, Human; identical to SEQ ID NO: 108775

SEQ ID NO: 265524 - RNA, 64 nt, Human; identical to SEQ ID NO: 108776

SEQ ID NO: 265525 - RNA, 64 nt, Human; identical to SEQ ID NO: 108777

SEQ ID NO: 265526 - RNA, 64 nt, Human; identical to SEQ ID NO: 108778

SEQ ID NO: 265527 - RNA, 64 nt, Human; identical to SEQ ID NO: 108779

SEQ ID NO: 265528 - RNA, 64 nt, Human; identical to SEQ ID NO: 108780

SEQ ID NO: 265529 - RNA, 64 nt, Human; identical to SEQ ID NO: 108781

SEQ ID NO: 265530 - RNA, 64 nt, Human; identical to SEQ ID NO: 108782

SEQ ID NO: 265531 - RNA, 64 nt, Human; identical to SEQ ID NO: 108783

SEQ ID NO: 265532 - RNA, 64 nt, Human; identical to SEQ ID NO: 108784

SEQ ID NO: 265533 - RNA, 64 nt, Human; identical to SEQ ID NO: 108785

SEQ ID NO: 265534 - RNA, 64 nt, Human; identical to SEQ ID NO: 108786

SEQ ID NO: 265535 - RNA, 64 nt, Human; identical to SEQ ID NO: 108787

SEQ ID NO: 265536 - RNA, 64 nt, Human; identical to SEQ ID NO: 108788

SEQ ID NO: 265537 - RNA, 64 nt, Human; identical to SEQ ID NO: 108789

SEQ ID NO: 265538 - RNA, 64 nt, Human; identical to SEQ ID NO: 108790

SEQ ID NO: 265539 - RNA, 64 nt, Human; identical to SEQ ID NO: 108791

SEQ ID NO: 265540 - RNA, 64 nt, Human; identical to SEQ ID NO: 108792

SEQ ID NO: 265541 - RNA, 64 nt, Human; identical to SEQ ID NO: 108793

SEQ ID NO: 265542 - RNA, 64 nt, Human; identical to SEQ ID NO: 108794

SEQ ID NO: 265543 - RNA, 64 nt, Human
cccuuccuccgggugaccccacagggccuuuccaagcccccauuugagcugcuccuuccugugu

SEQ ID NO: 265544 - RNA, 64 nt, Human
ccucgcaccugcccuccgcugcuccucagaccccagcccccagcgagccgacguccccacccgu

SEQ ID NO: 265545 - RNA, 64 nt, Human
agaagccaugggccagcaauaccugcuuuucugaagcccccaaggagggcucugacauucuuuu

SEQ ID NO: 265546 - RNA, 59 nt, Human; identical to SEQ ID NO: 207819

SEQ ID NO: 265547 - RNA, 62 nt, Human
ccugacacccacuggggugcacuuuaauguuccggcagcaagacuggggaacuucaggcucc

SEQ ID NO: 265548 - RNA, 62 nt, Human
cuacaucagaaccaaacuacuucuccaacacccggcagcacuuggcccugcaagcuuaggau

SEQ ID NO: 265549 - RNA, 62 nt, Human
gaaucugcuuuuccaagccgccaggguccugacggcagcaggacgaagccuguuguggcguc

SEQ ID NO: 265550 - RNA, 64 nt, Human
aggcccggcccccucuggcuuggagagcauuccaagcccccaccccaccccuagaacugccauu

SEQ ID NO: 265551 - RNA, 64 nt, Human
ccagcucagggauugccugaaccaagaggccaggagcccccaugggccgcccaguaccaugcac

SEQ ID NO: 265552 - RNA, 64 nt, Human
uggccucguucugcgaggggcucaugggucugagagcccccacccacuaggcuugauugcaucc

SEQ ID NO: 265553 - RNA, 64 nt, Human
caccucauucuucccuggccucuuucccacccacagcccccagaggcucuagaucaacaauguu

SEQ ID NO: 265554 - RNA, 64 nt, Human
ugauauuccaaaagggacuuuacauuaaaggagaagcccccaagauguggccacccuuaaccau

SEQ ID NO: 265555 - RNA, 64 nt, Human
cauuaaggucuugaagucaggcugcccccuccccagcccccaguucucuccccacccccucacc

SEQ ID NO: 265556 - RNA, 64 nt, Human
cgauugagaagccaaucagugaacccuuuggcaaagcccccauccacaccuggcacuccccucu

SEQ ID NO: 265557 - RNA, 64 nt, Human
gggaccaauuuaguguccuuccaccugugagccaagcccccauuugaggacaucuaucguauuc

SEQ ID NO: 265558 - RNA, 64 nt, Human
ggacucugccacucuacccccagcccuacccaccagcccccaggugaggcuuccagcugggacc

SEQ ID NO: 265559 - RNA, 64 nt, Human
accugcccccuccccacaccaaucagccaggcugagcccccaccccugccccagcuccaggacc

SEQ ID NO: 265560 - RNA, 64 nt, Human
ccgccugggagccgcgggcaggcgagacuggcggagcccccagaccucccaguggggacggggc

SEQ ID NO: 265561 - RNA, 64 nt, Human
ggggaggcaggucccaggagcagacccugcccccagcccccacagacacaccccaaucugaaag

SEQ ID NO: 265562 - RNA, 64 nt, Human
agagagggaaggagggaggaggcaucuucccugaagcccccaaucuggccccccccuccccaga

SEQ ID NO: 265563 - RNA, 64 nt, Human
ugguuguccccgccaggccggggaagguuggagcagcccccagggaggggggcacuagguguca

SEQ ID NO: 265564 - RNA, 64 nt, Human
uugggggaguaguggggcacggcuccuaagauccagcccccauacugacagacggacagacaga

SEQ ID NO: 265565 - RNA, 64 nt, Human
caguuggguuucucauaaguauccuaguucauguacauccgaaugcuaaauaauacuguguuuu

SEQ ID NO: 265566 - RNA, 62 nt, Human
ccucugagugagccccacgggguccaggcgggcggcagcagcccaggggccccaggccuccu

SEQ ID NO: 265567 - RNA, 62 nt, Human
cgcuggagggacacucaccccaucugcucccacggcagcaccaucaacucaacaagucagaa

SEQ ID NO: 265568 - RNA, 62 nt, Human
gggcgacacaggcagcuucuucggcagccucacggcagcaaccccagccuucccaaagcagc

SEQ ID NO: 265569 - RNA, 64 nt, Human
ccccucuuaccacacuuuaccaguuaaccacugaagcccccaauucccacagcuuuuccauuaa

SEQ ID NO: 265570 - RNA, 64 nt, Human
cacaugggagaccccaacccagcugacaauguggagcccccagaacuucagaacuguguggagg

SEQ ID NO: 265571 - RNA, 64 nt, Human
ccucuccccaccagcaccauggcuggcaucgcucagcccccagcccaauugccaucaagacucc

SEQ ID NO: 265572 - RNA, 64 nt, Human
aggcacuccaaaccugucuuggggccacuuucagagcccccagcccugggaaccacucccacca

SEQ ID NO: 265573 - RNA, 64 nt, Human
cauaaguggacugugccaguacaauacaugccucagcccccaagccuagaaggaccucuagucu

SEQ ID NO: 265574 - RNA, 64 nt, Human
auguacaaagcucaccaagccccugcccauguacagcccccagacccucugcaauaucacuuuu

SEQ ID NO: 265575 - RNA, 64 nt, Human
gcacuuuaccucucugaaagccccagaggaccagagcccccagccuuaccucucaaccuguccc

SEQ ID NO: 265576 - RNA, 64 nt, Human
uucugauacuaauggagcuucaugacccacggucagcccccaaaccaaaguugucccaacagag

SEQ ID NO: 265577 - RNA, 64 nt, Human
ugggcauccaaagcggccacgcccacaauccgacagcccccaggagcagguccagggaugaugc

SEQ ID NO: 265578 - RNA, 64 nt, Human
auaaacagggcuauuagggguaucagccacgucgagcccccagacucugugcacuucagaccag

SEQ ID NO: 265579 - RNA, 64 nt, Human
gagggaccaggugucuagaggcaacaguguucugagcccccaccugccugaccaucccaugagc

SEQ ID NO: 265580 - RNA, 64 nt, Human
ucugugucugcccccgucuucucuccauccucaaagcccccacuucucuccaggcuguuucuuu

SEQ ID NO: 265581 - RNA, 64 nt, Human
gcacuggcacugcgaucaggaagacuggacccccagcccccagggccccccuccccccacuuag

SEQ ID NO: 265582 - RNA, 64 nt, Human
gggcccuaccuggggaaagccugaagggccucccagcccccaaccccaagaccaagcuuagucc

SEQ ID NO: 265583 - RNA, 64 nt, Human
ggcuguggagugcaggccagagcagggugugcguagcccccagcacccagguucuucugucaga

SEQ ID NO: 265584 - RNA, 62 nt, Human
gggguccagcucagaaccacgggggucugugccggcagcaccggugccaucuuggcuuccac

SEQ ID NO: 265585 - RNA, 62 nt, Human
ucuggagugccaugcuggcgaggauccggaugcggcagcacccucuuucgggcugcauccac

SEQ ID NO: 265586 - RNA, 62 nt, Human
agagugugcgcauuucagagcaugggauugaucggcagcaagaguaaagacacagcuccaga

SEQ ID NO: 265587 - RNA, 62 nt, Human
cugcccauuaagggagaaggagaggauccggucggcagcagcccugagcagaaagcuggagg

SEQ ID NO: 265588 - RNA, 64 nt, Human
ugucuuccacaggauuugagaauaguuucaucucagcccccauuagagagaaguuggggugaau

SEQ ID NO: 265589 - RNA, 64 nt, Human
ccacaccccucucccaggggcuugguggcagcauagcccccaccccugcggccuuugcucacgg

SEQ ID NO: 265590 - RNA, 64 nt, Human
cugcccucgggggccucucccaggguccagccugagcccccaccaggggucucugcccagcaca

SEQ ID NO: 265591 - RNA, 64 nt, Human
cugcagaaccagcugcaacagcugcgugcacaggagcccccaggcagucagcagccccugcaga

SEQ ID NO: 265592 - RNA, 64 nt, Human
ucacagcugcagcugggccccaugcucugccccaagcccccaaccccgcggugcucuggcggcu

SEQ ID NO: 265593 - RNA, 64 nt, Human
uuccagcugggggaugggggggagucauaggaaaagcccccaucucccaucugggauagggacc

SEQ ID NO: 265594 - RNA, 64 nt, Human
uacaacagcuccaggacaucucagcccagguucuagcccccacgcaccccagaccccaggugga

SEQ ID NO: 265595 - RNA, 64 nt, Human
uccccuaccuuggaccaucccgcguagggguggcagcccccagcuccccucagugcugcuguca

SEQ ID NO: 265596 - RNA, 64 nt, Human
caggccaaggcagacauuggcccucccuucucccagcccccagaggccuggccuuggguucguc

SEQ ID NO: 265597 - RNA, 64 nt, Human
gaacugcccccacugucccccuacccaccgauggagcccccagauagagcuggguggccuguuu

SEQ ID NO: 265598 - RNA, 64 nt, Human
ucugugguucccacaggaacaggguugucuuuugagcccccagugucugguuucauucaucuca

SEQ ID NO: 265599 - RNA, 64 nt, Human
gccccucccccuaccgcauggcagcugggcccacagcccccaccccagcacagcuccuccccug

SEQ ID NO: 265600 - RNA, 64 nt, Human
caguccuugccaauccccagagcuguucuuccaaagcccccaggcuggcuuagaaccccauaga

SEQ ID NO: 265601 - RNA, 64 nt, Human
gagguggcgaguguggacacccugccaggacugcagcccccauggugaugcuguggcaucagac

SEQ ID NO: 265602 - RNA, 64 nt, Human
cagacaggagccaggguugagcaauggagagcccagcccccacgucuuacagucgccauccucc

SEQ ID NO: 265603 - RNA, 62 nt, Human
ccugagccucccccaccaggacugggccuccccggcagcaagaccccggcacuccccgccag

SEQ ID NO: 265604 - RNA, 62 nt, Human
ugauuggucuauucaccaucccccugcuguaccggcagcaccaggugagugugacacccuca

SEQ ID NO: 265605 - RNA, 62 nt, Human
ugggacggacagggcuggcugucucucagccgcggcagcagggagcgggcagaggccgcagg

SEQ ID NO: 265606 - RNA, 62 nt, Human
cccccugggggacagcugccagacacagcuggcggcagcaccagaugcuaagcgcuucagag

SEQ ID NO: 265607 - RNA, 64 nt, Human
ugcaggcauuaggacuguccugagcaaggucugcagcccccagcucugcucaccccgaauccug

SEQ ID NO: 265608 - RNA, 60 nt, Human; identical to SEQ ID NO: 207877

SEQ ID NO: 265609 - RNA, 53 nt, Human; identical to SEQ ID NO: 207824

SEQ ID NO: 265610 - RNA, 64 nt, Human
gguucuggaggcugcgagagcagcuggcacugucagcccccagcagggaacacguuacaggguc

SEQ ID NO: 265611 - RNA, 64 nt, Human
ggaagccauucccaguuugagucuucauccuguaagcccccaggggcagucccugcuuuacuga

SEQ ID NO: 265612 - RNA, 64 nt, Human
ugccuggugagccuuccccuggugucugccuggcagcccccaccucccaccuaucaccccucac

SEQ ID NO: 265613 - RNA, 64 nt, Human
uccacucagguucuucagggccaguccuccugggagcccccaccacaaacuucugcuggggauu

SEQ ID NO: 265614 - RNA, 64 nt, Human
cuagaaaaagaucaguaagccccaguguccccccagcccccaugcuuaugugaacaugcgcugu

SEQ ID NO: 265615 - RNA, 64 nt, Human
auccagccacaggcaccagcugguugggaccagcagcccccagcauccucuugcacuggcuggc

SEQ ID NO: 265616 - RNA, 64 nt, Human
uuuucaguggaacccuugcccccaaaugucgaccagcccccaaaugucgaagaauuuucuucuu

SEQ ID NO: 265617 - RNA, 64 nt, Human
acgucuuuguucagaagggaucagguuggggggcagcccccagucccuuucugucccagcucag

SEQ ID NO: 265618 - RNA, 64 nt, Human
ccucacagccuguagccaccaauguuucaagaggagcccccacccuguuccugcugcugucugg

SEQ ID NO: 265619 - RNA, 64 nt, Human
acacugggcuuaugccuuacucucagggacaagcagcccccauugcugccuguagaugugagcu

SEQ ID NO: 265620 - RNA, 64 nt, Human
augcuuucuucccauuccccugcugucuauucuaagcccccagacucaagccucuagacucuug

SEQ ID NO: 265621 - RNA, 64 nt, Human
ggguaggucaugaacagucacccgugcuggcuguagcccccacagaggcaaucaugcccaauag

SEQ ID NO: 265622 - RNA, 64 nt, Human
acaaagugcgguuucccaagccuuuguccaucucagcccccagaguauaucugugcuuggggaa

SEQ ID NO: 265623 - RNA, 62 nt, Human
uggaggagaaagacaacacuuggucuaagacacggcagcaagacaucccugcauauuguucc

SEQ ID NO: 265624 - RNA, 64 nt, Human
ccccagccucccgcucugggcgagccuccuccccagcccccaccccugggaugcgaagccagca

SEQ ID NO: 265625 - RNA, 64 nt, Human
guuuugucugccauucuugaaagugcaucuugagagcccccauuuguuguguagagauauagca

SEQ ID NO: 265626 - RNA, 64 nt, Human
cagcgggagagcagcugguccagaccagcccugcagcccccacucagccggcagccagauggcc

SEQ ID NO: 265627 - RNA, 64 nt, Human
uuuggcuaggugucucucacggcugcuccauccuagcccccacaagcuggggcuuccuccugua

SEQ ID NO: 265628 - RNA, 64 nt, Human
uggaagguuuuacaagaagacugauagucuuucaagcccccacaucacaggcuuagggacggca

SEQ ID NO: 265629 - RNA, 64 nt, Human
ucagagaggaggcgcaggcaggccccugcccggcagcccccaucuucaagggcugcuucuacac

SEQ ID NO: 265630 - RNA, 64 nt, Human
acuuccccugugaagaaacagguguucucggcugagcccccaacccucugcagaaccagguuga

SEQ ID NO: 265631 - RNA, 64 nt, Human
auagaccagugcagccagagagaccaccaaacagagcccccaaaagacagacaucucugcuagc

SEQ ID NO: 265632 - RNA, 64 nt, Human
acacggacgccuauccagaagccagccggcuggcagcccccaucugcucaauaucacugcucug

SEQ ID NO: 265633 - RNA, 64 nt, Human
guccacugguucuucuuggucucagugucaaugcagcccccauuguggucacaggaaguagagg

SEQ ID NO: 265634 - RNA, 64 nt, Human
ggacccgucccagccuccccuccccaccccaugcagcccccagggggauagcccaugggccccu

SEQ ID NO: 265635 - RNA, 64 nt, Human
ucaggcugguuauaagccggaggcagcuuuaaccagcccccagggaugauugugaaggaggccc

SEQ ID NO: 265636 - RNA, 64 nt, Human
gcugggccuccucaccaacggcagugccaaaaucagcccccacaucaaggugguguucucugug

SEQ ID NO: 265637 - RNA, 64 nt, Human
ucuggaaccugacuuuagauguuuugggaucaggagcccccaacacaggcaaguccaccccaua

SEQ ID NO: 265638 - RNA, 64 nt, Human
cccucgagugccaucccugccaaacaacucucccagcccccacuaccucucuguguacugccgc

SEQ ID NO: 265639 - RNA, 64 nt, Human; identical to SEQ ID NO: 28125

SEQ ID NO: 265640 - RNA, 64 nt, Human; identical to SEQ ID NO: 28130

SEQ ID NO: 265641 - RNA, 64 nt, Human; identical to SEQ ID NO: 28135

SEQ ID NO: 265642 - RNA, 64 nt, Human
aucgcuguuuccaauggcucaggagacaaugaaaagcccccauuuaaaaaaauaacaaacauuu

SEQ ID NO: 265643 - RNA, 64 nt, Human
gugagugaagaggaaggggucucuggucaaacccagcccccagggccuaggguugaaagccuuc

SEQ ID NO: 265644 - RNA, 64 nt, Human
gugccgcucugcccgaugcacagccaccucagccagcccccagguagaaacguggguuaagcuc

SEQ ID NO: 265645 - RNA, 56 nt, Human; identical to SEQ ID NO: 207825

SEQ ID NO: 265646 - RNA, 64 nt, Human
ugcucuccuaggccacagggccuuuggcaggugcagcccccacugccuuugaccugccucccuu

SEQ ID NO: 265647 - RNA, 64 nt, Human
uaaaaauauucuucugaacucaucaaaguagaagagcccccaaccuuuucucucugccuucaag

SEQ ID NO: 265648 - RNA, 64 nt, Human
ucuggcagggcugcuaccuccucagaguuucagaagcccccacaugggggcucuaggaaugccg

SEQ ID NO: 265649 - RNA, 64 nt, Human
caugcugaaaaagacaaaauugaagaagaaauguagcccccagccgguacccaccaaaggagag

SEQ ID NO: 265650 - RNA, 64 nt, Human
cccaccccaucugaggcagagaagacucgaguccagcccccaggaagccugcuccccucucugg

SEQ ID NO: 265651 - RNA, 64 nt, Human
cuucuggcugcccccaaugccccgaggccuggggagcccccagcucacccaucuguagcucccu

SEQ ID NO: 265652 - RNA, 64 nt, Human
cgcuucuuuccuuccugcaguucccagcccucggagcccccaucccuuaucuuacccccaccgc

SEQ ID NO: 265653 - RNA, 56 nt, Human; identical to SEQ ID NO: 207826

SEQ ID NO: 265654 - RNA, 64 nt, Human
ccuccucccaugagguggggagaggcaacagggcagcccccagaggaguguccuggccgcuguc

SEQ ID NO: 265655 - RNA, 64 nt, Human
guguuauuacugguggaugcaccguguccacagcagcccccaaucccagcgaugcgucagaucu

SEQ ID NO: 265656 - RNA, 64 nt, Human
ucucugugcaaagcaucagaaagaccugcuucccagcccccagcauuccagugcucuccaggcu

SEQ ID NO: 265657 - RNA, 64 nt, Human
gacccguuucucccucaaguuugaguauuucgggagcccccaaaacagccugagcaaaaagacc

SEQ ID NO: 265658 - RNA, 64 nt, Human; identical to SEQ ID NO: 28126

SEQ ID NO: 265659 - RNA, 64 nt, Human; identical to SEQ ID NO: 28132

SEQ ID NO: 265660 - RNA, 64 nt, Human; identical to SEQ ID NO: 28138

SEQ ID NO: 265661 - RNA, 64 nt, Human
accaccuccugagcucaagugauccucccaucuaagcccccaaguagcuaggacuacaggagca

SEQ ID NO: 265662 - RNA, 64 nt, Human
gccaagaucaacagcuccuucuccaaacaacucaagcccccaauucccaucgcauuccauuugg

SEQ ID NO: 265663 - RNA, 64 nt, Human
ccgcgggaggccgggaggaggguggggaccuugcagcccccauccucuccgugcgcuuggagcc

SEQ ID NO: 265664 - RNA, 64 nt, Human
ggcgccagguuuccuggagcucuuggcuucagccagcccccagccagaguccuggcuaggacag

SEQ ID NO: 265665 - RNA, 64 nt, Human
agggccagaggagccagggacuauuuucugcaccagcccccagggcugccaccccuguuguguc

SEQ ID NO: 265666 - RNA, 64 nt, Human
accuaaauaucacuugcucugccacugcccgcccagcccccauggucuucuggaaggucccucg

SEQ ID NO: 265667 - RNA, 64 nt, Human
uugagaggugagaccuuuaaggguuacuaggcagagcccccaugaauggauuaaugccauuauu

SEQ ID NO: 265668 - RNA, 64 nt, Human
uugggaugagcccccuccccccaaugcacaagccagcccccaagacccuggggguggacaccac

SEQ ID NO: 265669 - RNA, 64 nt, Human
cucucccagucucucccugcaguccugcagcagcagcccccacccccaagcuuggugcugagcc

SEQ ID NO: 265670 - RNA, 64 nt, Human
ucuccuccagccccugcacacucccacccaggacagcccccagcccaacuaggaaagggccaug

SEQ ID NO: 265671 - RNA, 64 nt, Human
gcccagccucuuggcaccuccuguuuacuccccgagcccccagauucucaccuuugcccagagc

SEQ ID NO: 265672 - RNA, 64 nt, Human
cagccaagaauuucgggcuguuugacuuucugugagcccccagcgaggggaggcccagccuccg

SEQ ID NO: 265673 - RNA, 64 nt, Human
uucagcagccccucagggcuucccaaggauguccagcccccacacccacacguuaacauaauga

SEQ ID NO: 265674 - RNA, 64 nt, Human
gccucugcuuugggggugccccugccuccagcagagcccccaccauucacugugacaucuuucc

SEQ ID NO: 265675 - RNA, 64 nt, Human
acuccaauggcaguguccuguuugagcacccugcagcccccacccaagauggccuggugagaug

SEQ ID NO: 265676 - RNA, 64 nt, Human
ccuuccugggccaacuaaccagacaacugggaagagcccccaacuccaacaggauuauuuuccc

SEQ ID NO: 265677 - RNA, 64 nt, Human
caauauaagugugauugcaagaaugguagaggaccgagcacagaaaucuuagagauuucuuguc

SEQ ID NO: 265678 - RNA, 64 nt, Human
accagcuggcccggccacucugaauugcgccuuccgagcacacauaaaagcacaaagacagaga

SEQ ID NO: 265679 - RNA, 64 nt, Human
cacacgggcccagugcugccccugcugcugcaggagcccccaggcgagguucggccuuccucuc

SEQ ID NO: 265680 - RNA, 64 nt, Human
augacuuccugcucacagcccuggaguccuguuacgagcacauccagaaagaagacaugaggcu

SEQ ID NO: 265681 - RNA, 64 nt, Human
ucaucuucucauccaccaccuucuccugcuucuccugucacauagggccucaugaaggucuuua

SEQ ID NO: 265682 - RNA, 64 nt, Human
cccuccuggggaggcugacggguguggccacccgcugucacaauggcacacugccacugucccu

SEQ ID NO: 265683 - RNA, 64 nt, Human
ccguguucucccacggggcccugguuucgagucucugucacagccucuuccggcggcagcgugc

SEQ ID NO: 265684 - RNA, 64 nt, Human
ucuuuuuuuuuuuuuuuugagauggagucucacucugucacacaggcuggaaugcagugaugcc

SEQ ID NO: 265685 - RNA, 64 nt, Human
ucucacugugggaaaauuugaugaaauauuugaacugucacauauauuaagaauacuuuaugau

SEQ ID NO: 265686 - RNA, 64 nt, Human
acguuauuuccauggaagauagccgcuguggcagcugucacaucaccacagcucccuagggucu

SEQ ID NO: 265687 - RNA, 64 nt, Human
ccccaccccuccagccgcaguuuuuggcuacaaacugucacaguauacauugguaauaaaauau

SEQ ID NO: 265688 - RNA, 64 nt, Human
uggagagguggcugcgcccccagcuucucucucccugucacacacuggaccccacuggcugaga

SEQ ID NO: 265689 - RNA, 64 nt, Human
guacccucuggagggguguggcuccuucccaucgcugucacaggcgguuaugaaauucaccccc

SEQ ID NO: 265690 - RNA, 64 nt, Human
agcagggucccucugaguggggccaggcccaggacugucacacaaggcuugagaagcccccucu

SEQ ID NO: 265691 - RNA, 64 nt, Human
cagccuccuugcugaccccaggucagcccugugucugucacaggcugggucaaaagagcccugg

SEQ ID NO: 265692 - RNA, 64 nt, Human
uuuaaagucaaaauucugaaguacaguuuauauucugucacaggauuaauuaauugccgguuuu

SEQ ID NO: 265693 - RNA, 64 nt, Human
augcccuuuuucaagcagauuuaugagcagauuucugucacauaagucgucuucugcuugagua

SEQ ID NO: 265694 - RNA, 64 nt, Human
ggaauucagggcgacggucuaggugucgagggcuguggcgcagccucuucagcugcggcgagaa

SEQ ID NO: 265695 - RNA, 64 nt, Human
ugcuucugugguuguaaaaaugcuguugcuaaagguggcgcagaaacaaauaucaguguuaguc

SEQ ID NO: 265696 - RNA, 64 nt, Human
guugggauaagagaaauagagcuauuagagacaaguggcgcauauuuuuucauugauauuugaa

SEQ ID NO: 265697 - RNA, 64 nt, Human
gacguggggccaugacucucugggaccuugccacagcccccauuccccugcuugcagucugcaa

SEQ ID NO: 265698 - RNA, 64 nt, Human
ugagggucaaauucaacauuauccugaucuagacagcccccauucucaauccacccuuuuccaa

SEQ ID NO: 265699 - RNA, 64 nt, Human
gcaauaaaugggggaauagguaguuuccugguuuagcccccaucuagucaggaauuaauauacu

SEQ ID NO: 265700 - RNA, 64 nt, Human
aaaggaaacaaagcaauagguuugggggacgcccagcccccacccccgucaccccgcucuuccc

SEQ ID NO: 265701 - RNA, 64 nt, Human
cuccgcggaggccccugagggacgagcagagcgcagcccccacgccgauauaagccauagcccc

SEQ ID NO: 265702 - RNA, 64 nt, Human
ggcgggaggugggggaacaaggggucuuccgagcagcccccagcccuccccucccaucugugcc

SEQ ID NO: 265703 - RNA, 64 nt, Human
acccagcccuggacugaggauggaugguuccaugagcccccagaugaaaaccuggauucgacag

SEQ ID NO: 265704 - RNA, 64 nt, Human
uuuuccauuccugaguuacuucccuuaggauaacagcccccaguuccguccaaguugcugcaaa

SEQ ID NO: 265705 - RNA, 64 nt, Human
gagcagcugccggcugugugcccauggggagcccagcccccaccccccaccuccgacagcaaac

SEQ ID NO: 265706 - RNA, 64 nt, Human
ucccuacuucuuauaaugcagaguuaaggagcugagcccccaugauuuuguagcuguacuuuug

SEQ ID NO: 265707 - RNA, 64 nt, Human
uucuacuuuuugcaccuuauuuucucuguuccugagcccccacauucucuaggagaaacuuaga

SEQ ID NO: 265708 - RNA, 64 nt, Human
acacccccgccaggcugcccaucagggcccagggagcccccagaggacuuuauucggaccaagc

SEQ ID NO: 265709 - RNA, 64 nt, Human
uaaaggagccagccagguguaauacagucaaggcagcccccagccuagagacaaucugugaaau

SEQ ID NO: 265710 - RNA, 64 nt, Human
agggggacaaugaugagaagaccugaggauuugcagcccccagcccuggguucaagucccagcu

SEQ ID NO: 265711 - RNA, 64 nt, Human
uggugacacccagcccaggggcacccccuuccccagcccccaccuggagagacauggccccugc

SEQ ID NO: 265712 - RNA, 64 nt, Human
caggaugcacagaaugggcaugaccuucagcucacgagcacaccuggagaaauucagaaccagg

SEQ ID NO: 265713 - RNA, 64 nt, Human
ccugcaagcgucaggcacacagggacagacauggcgagcacagugcaggcccggggcccacggg

SEQ ID NO: 265714 - RNA, 64 nt, Human
accacagugagagcuuuuucccuuugcuaaccaacgagcacacagaagaucuccagucacccca

SEQ ID NO: 265715 - RNA, 64 nt, Human
uucuuuuuuauuacacuucgaauuuuaggguacacgagcacaacgugcagguuaguuacauaug

SEQ ID NO: 265716 - RNA, 64 nt, Human
cccugccugggcacucccuccucccugcgcccacagcccccaugccaaucuccgucagcucuuu

SEQ ID NO: 265717 - RNA, 64 nt, Human
gcaccacacaccccgccccugaaaggagaucaucagcccccacaauuugucagagcugaagcca

SEQ ID NO: 265718 - RNA, 64 nt, Human
cuccgccucccaguucaagugauucuccugccucagcccccaaguagcugggauuacaagugug

SEQ ID NO: 265719 - RNA, 64 nt, Human
ggguccagguccucuccccucauuuccaucucccagcccccaggggccccuuccccuuuauggg

SEQ ID NO: 265720 - RNA, 64 nt, Human
gccuugacuuagagugacagccgguguccuggaaagcccccagcagcugccccagggacauggg

SEQ ID NO: 265721 - RNA, 64 nt, Human
agccccacacagcuacagcuuucuugcucccuucagcccccagccccucccccaucucccaccc

SEQ ID NO: 265722 - RNA, 64 nt, Human
uauccccuuaaaagaaugccuuccacuucccaacagcccccaucaagggaccccaagaggccac

SEQ ID NO: 265723 - RNA, 61 nt, Human; identical to SEQ ID NO: 207126

SEQ ID NO: 265724 - RNA, 64 nt, Human
caugaggagcugaaacugaccaguguccaguguuagcccccacauggggcugcucuugcuucua

SEQ ID NO: 265725 - RNA, 55 nt, Human; identical to SEQ ID NO: 207961

SEQ ID NO: 265726 - RNA, 64 nt, Human
agcagugccaagccuguggaucaggaauaucaacagcccccagagaguggugcuggcugagggu

SEQ ID NO: 265727 - RNA, 64 nt, Human
guggacgggcgcaccugcauggagggguccccagagcccccaaccagugccagcauacucagcg

SEQ ID NO: 265728 - RNA, 64 nt, Human
ccagccccauuggggagugaucucuuggacacagagcccccauucaaaauggggcagggcaagg

SEQ ID NO: 265729 - RNA, 64 nt, Human
auaguaacccuaggcucagagacccaauuuuuuaagcccccagacuccuuagcccucagagccg

SEQ ID NO: 265730 - RNA, 64 nt, Human
uccucaggggccuguggcugaagaaaaggugcccagcccccaccacuccucagcugccccccaa

SEQ ID NO: 265731 - RNA, 64 nt, Human
auuugcuggcauuaaaaauaagcacacuuacauaagcccccauacauagagugggacucuugga

SEQ ID NO: 265732 - RNA, 64 nt, Human
aaccuagguaaaaaauguugcgaaaacauggguaguggcgcauacauuuuguuauccuugaaau

SEQ ID NO: 265733 - RNA, 64 nt, Human
cagagucucauucugucacccaggcuggagugcaguggcgcaaucuuggcucacugcaaccucc

SEQ ID NO: 265734 - RNA, 64 nt, Human
gcccucucaagacugaauggugaggccagguacaguggcgcacaccuguaaucccagcuacucu

SEQ ID NO: 265735 - RNA, 64 nt, Human
ucucugacccauuaggcuaaagagagacaagagaagcccccaaccugauucucaugacagcucc

SEQ ID NO: 265736 - RNA, 64 nt, Human
auuaagcagauacucuccauuccuuccuuccuccagcccccagcaaccaccaaucugcuuucug

SEQ ID NO: 265737 - RNA, 64 nt, Human
gaagucagaaggcuggggcagaucacuucaagcaagcccccaugaugguucucaguccugcuuc

SEQ ID NO: 265738 - RNA, 64 nt, Human
gggugaaggagacacuacugcccccaccccugacagcccccaccccauggcuuccaucuuuugc

SEQ ID NO: 265739 - RNA, 64 nt, Human
acccacggacguggcuuggugcugaggauagcagagcccccagccaucacugcuggcagccugg

SEQ ID NO: 265740 - RNA, 64 nt, Human
ugggaucuagaucuuuccuccuugacaucaccugagcccccaccuagccauccaugggagagag

SEQ ID NO: 265741 - RNA, 64 nt, Human
gggacuccugagaacacgguucucuccuagccucagcccccagcugggucucagaggagcuggg

SEQ ID NO: 265742 - RNA, 64 nt, Human
auuguggauuauuacagugaagugccuggcccggagcccccagugaugaagcaggaacuugagu

SEQ ID NO: 265743 - RNA, 64 nt, Human
cugugugcggugcccaggcccuaggagcucccccagcccccagguccuccugaccacuccccuc

SEQ ID NO: 265744 - RNA, 64 nt, Human
ccccucugaugcugucugcagcucagucccugccagcccccaggagcgccuccagggccccgcc

SEQ ID NO: 265745 - RNA, 64 nt, Human
uccucagccaccaaaugucccugacacccuccccagcccccacagauaacaucagcugagguuu

SEQ ID NO: 265746 - RNA, 64 nt, Human
cagcagccaccgcccaguuccaguggccccacgaagcccccaguggcuggcuguccagcugggc

SEQ ID NO: 265747 - RNA, 64 nt, Human
cuggggcaucuggcuggugccugcugccauggccagcccccacucucacccugcacaggggguc

SEQ ID NO: 265748 - RNA, 64 nt, Human
agcccccacucucacccugcacagggggucuugcagcccccaggcccacagccucguugggagg

SEQ ID NO: 265749 - RNA, 64 nt, Human
uucuugauugagguagcaugaaggaugaggcuucagcccccauugucuuauguagaauguggca

SEQ ID NO: 265750 - RNA, 64 nt, Human
accccaauggcuacucugcucacaugcacugcguguggcgcaucucugucacacccggggagaa

SEQ ID NO: 265751 - RNA, 64 nt, Human
ucucuacuaaaauacaaaaaauuagcugggugugguggcgcaaaccuguagucguagcuacuug

SEQ ID NO: 265752 - RNA, 64 nt, Human
gcuuuucagggccaagcacuauaaggguuuagcuguggcgcagugaugcauggccuguugacac

SEQ ID NO: 265753 - RNA, 64 nt, Human
guggcaagcagaucaaccagguggcauuggaggcguggcgcagccggcgggaccgcgaggagau

SEQ ID NO: 265754 - RNA, 64 nt, Human
acguggggcccugacaccacguuaucaaacaugcagcccccacaccccucgucugcccgccccc

SEQ ID NO: 265755 - RNA, 64 nt, Human
aaagacuccucugggccuggggugcauccuccucagcccccaggccaggugagguccaccggcc

SEQ ID NO: 265756 - RNA, 64 nt, Human
uaucugccuaguggaaaugagccacccccacugcagcccccaccuuuguguccuagagcucagc

SEQ ID NO: 265757 - RNA, 64 nt, Human
acccagagcaccucccagccaccguccccucaagagcccccagaacgagacccuguacucuguc

SEQ ID NO: 265758 - RNA, 64 nt, Human
ucggucacaucaggcccgcuagguccagagagcgagcccccaaugcccggccaggcuaagccgc

SEQ ID NO: 265759 - RNA, 64 nt, Human
augcccggccaggcuaagccgcagagacccucucagcccccaccucagguuagggcucugcccg

SEQ ID NO: 265760 - RNA, 64 nt, Human
gucccuugaaucccaaaagugccuccccagccucagcccccaccuccagccacacacacauuac

SEQ ID NO: 265761 - RNA, 50 nt, Human; identical to SEQ ID NO: 208033

SEQ ID NO: 265762 - RNA, 64 nt, Human
gcugggagccucgcccuuugucccaacuggguagagcccccaggugcuguuugcucaggaggcu

SEQ ID NO: 265763 - RNA, 52 nt, Human; identical to SEQ ID NO: 208035

SEQ ID NO: 265764 - RNA, 64 nt, Human
uggggcucagccugggggagccuacuggggacugagcccccaggagggccagcauguggagagu

SEQ ID NO: 265765 - RNA, 64 nt, Human
gcuucacgccucgguagauuugcauucugaugcaagcccccaaccucacggaccaagaggaucc

SEQ ID NO: 265766 - RNA, 64 nt, Human
uccagggcccagucuggcucccgagcucagacacagcccccaggagccgcccaccacggcugug

SEQ ID NO: 265767 - RNA, 64 nt, Human
agcgaggaagccccgggguuugucgucguugagcagcccccacggcugucggucagacucuugg

SEQ ID NO: 265768 - RNA, 64 nt, Human
uacgagagcuauucauucauaagauggggcaaacagcccccaggcacuugcucccugcuccaua

SEQ ID NO: 265769 - RNA, 64 nt, Human
aagccaccguguccagccaguuucuguuguuugaagcccccaacuucuagauugggaaacgaag

SEQ ID NO: 265770 - RNA, 64 nt, Human
accccuguauaucuuagcagcacugaguccagugcgagcacacacccacuauacaagaguggcu

SEQ ID NO: 265771 - RNA, 64 nt, Human
cggagucuugcucuguugcccaggcaggagugcaguggcgcaucucggcucacugcaaccucug

SEQ ID NO: 265772 - RNA, 64 nt, Human
ucucuacuaaaaauacaaaaauuagccuggcgugguggcgcaugccuguaaucccagcuacuca

SEQ ID NO: 265773 - RNA, 52 nt, Human; identical to SEQ ID NO: 208046

SEQ ID NO: 265774 - RNA, 64 nt, Human
ugggauggacccucgcagcaggugcaagagacagagcccccaagccucugccccaaggggccca

SEQ ID NO: 265775 - RNA, 64 nt, Human
ucuucucuauaguucccgaguuggcccccauugcagcccccacccuguggguagucuuccagaa

SEQ ID NO: 265776 - RNA, 64 nt, Human
acagauuguacugugggcucagaaaccgugagagagcccccaccguggacaccggcucuagggc

SEQ ID NO: 265777 - RNA, 64 nt, Human
agaagcugcgccccaccuuuccagauacccacaaagcccccagacagaaucuagcaucgggacu

SEQ ID NO: 265778 - RNA, 60 nt, Human; identical to SEQ ID NO: 208051

SEQ ID NO: 265779 - RNA, 62 nt, Human; identical to SEQ ID NO: 208052

SEQ ID NO: 265780 - RNA, 55 nt, Human; identical to SEQ ID NO: 208053

SEQ ID NO: 265781 - RNA, 64 nt, Human
aagccuucagcucuccccugaacuccaucuuaacagcccccaugguuuguucaacaucuccacc

SEQ ID NO: 265782 - RNA, 64 nt, Human
ggcugcagccucagucccugccccuccagcccacagcccccaucccguagcccuuccuggaucu

SEQ ID NO: 265783 - RNA, 64 nt, Human
gcugcccaccaagcccugcccccagcccaagaggagcccccacugccugcggggcagugauguc

SEQ ID NO: 265784 - RNA, 64 nt, Human
caguguguccaaccagcuguucucuccucaaagcagcccccaagcaagucccuucucuagggug

SEQ ID NO: 265785 - RNA, 64 nt, Human
uauaucauccuaaaaguggggguugccucaagacagcccccaggaacugauaagaagggaugaa

SEQ ID NO: 265786 - RNA, 64 nt, Human
agaggccacccacguggcagccccaccucuugagagcccccagugccggagcagaaaggacccu

SEQ ID NO: 265787 - RNA, 64 nt, Human
ggaccgcugcgggugguaaccaguggaagaccccagcccccagggagaggaacccguucuaucc

SEQ ID NO: 265788 - RNA, 64 nt, Human
ccccagugagcggcagccucaggggccucaggggagcccccaccccacggauguugucaggaau

SEQ ID NO: 265789 - RNA, 64 nt, Human
cacguaaagccucaaaacacagcacacacacacacgagcacacacacacacacacacacgaaca

SEQ ID NO: 265790 - RNA, 64 nt, Human
ccugcguuugccgagcgcuaugccccggacaaaacgagcacagugcugacccggcacagccagc

SEQ ID NO: 265791 - RNA, 64 nt, Human
uaaagcuuggucggugaccuuugcauaccaucaacgagcacagcuaagaacagagugagagagg

SEQ ID NO: 265792 - RNA, 64 nt, Human
uccugaguggaaguuucauucaucagugaugaauagcccccaaacagugggaguguguauguau

SEQ ID NO: 265793 - RNA, 64 nt, Human
ccgagggaggacccugagggccgcgaagcauccgagcccccagcugggaaggggcaggccggug

SEQ ID NO: 265794 - RNA, 64 nt, Human
aaucugcuucucggaucucccucagucugcccccagcccccaaacuccuccuggcuagacugua

SEQ ID NO: 265795 - RNA, 64 nt, Human
gcuggaggaaugugggggauugaaacuagcucccagcccccauggggcagcagcugggccacaa

SEQ ID NO: 265796 - RNA, 64 nt, Human
gaaccacacccaacacuuagacaugcgaacaagcagcccccagcgagggucuccuucgccuuca

SEQ ID NO: 265797 - RNA, 64 nt, Human
guuucugagguugucgugugaguucuguacaaaaagcccccacaagucguccaguagaaaugca

SEQ ID NO: 265798 - RNA, 64 nt, Human
ucgauuuccugggcucaagcaauccucccaccucagcccccaaguagcugggccuacaggugcg

SEQ ID NO: 265799 - RNA, 64 nt, Human
gauucauauguccccacuggcauuacucagcaggagcccccagcugccaaagguuggcagugau

SEQ ID NO: 265800 - RNA, 64 nt, Human
auaaaauuugauaaacauuccuguugaugggaaaagcccccaguuaauacuccagagacaggga

SEQ ID NO: 265801 - RNA, 64 nt, Human
caggacagcaggguggaccccaguuuggaagcugagcccccagccacgaacauggaucugagga

SEQ ID NO: 265802 - RNA, 64 nt, Human
caggagaccaggcucuagcucugggcccuccuucagcccccaucaugggaauaaauuaauuuuc

SEQ ID NO: 265803 - RNA, 64 nt, Human
caguugaggcuggggcuaguggucccagcagcccagcccccacccuccuggcagcagcgccagg

SEQ ID NO: 265804 - RNA, 64 nt, Human
guggccuuugugcugcgccugcaggcagagcuggagcccccagcagaggcaggcugggacggac

SEQ ID NO: 265805 - RNA, 64 nt, Human
uggucccuaccugggcagucucauuugcacccauagcccccaucuauggacaggcugggacaga

SEQ ID NO: 265806 - RNA, 64 nt, Human
cucagacucccaaagcgguggaauuagaggcgugagcccccaugcuuggccuuaccuuucuacu

SEQ ID NO: 265807 - RNA, 64 nt, Human
cccagcuuuccgccugcacccgcgaggacgcgcgcgagcacacgcggcgccccgccaggccuua

SEQ ID NO: 265808 - RNA, 64 nt, Human
cuuucuguuucuuaagggcacacacacgugcgugcgagcacacacacacauacgugcacagggu

SEQ ID NO: 265809 - RNA, 64 nt, Human
uauccagaccugccuucuggaagcucaauuaucacgagcacaugguggaaaacgugggccggug

SEQ ID NO: 265810 - RNA, 64 nt, Human
gcuacuugggcacacgccuguaguccaggccacucgagcacacaccuguaguaccagcuacucu

SEQ ID NO: 265811 - RNA, 64 nt, Human
uuggugagcucagacuuggugcuucccuauccacagcccccaccccuuguuuuucaagauacua

SEQ ID NO: 265812 - RNA, 64 nt, Human
guggggcaggagauuguuucuucauucuucugacagcccccaucugacgcguaacugcccauuu

SEQ ID NO: 265813 - RNA, 62 nt, Human; identical to SEQ ID NO: 208087

SEQ ID NO: 265814 - RNA, 64 nt, Human
cccuccuccaggcccccggacgcucagcccccacagcccccacagccuggcgccagggcucaca

SEQ ID NO: 265815 - RNA, 64 nt, Human
ugacggcugcccuccuccaggcccccggacgcucagcccccacagcccccacagccuggcgcca

SEQ ID NO: 265816 - RNA, 64 nt, Human
cccacagaggaugaagccaccccacagaggaugcagcccccagcugcauggaagguggaggaca

SEQ ID NO: 265817 - RNA, 64 nt, Human
uguccccgacugccauuggcaacaguggcccugcagcccccagcccuccccacccagguuuucg

SEQ ID NO: 265818 - RNA, 64 nt, Human
cccuuccccaugggaagacgaggcccucgggcccagcccccacagugcugucugaucugugcuu

SEQ ID NO: 265819 - RNA, 64 nt, Human
caagggucuuucuaaguuaauacugugagcauugagcccccauuaaaacucuuuuuuacuucag

SEQ ID NO: 265820 - RNA, 64 nt, Human
gcggcuuguccgugagcuccgugcacuucaccaaagcccccaucccagcacacaggacccgugu

SEQ ID NO: 265821 - RNA, 64 nt, Human
uccuuucucuguccucuccugagguucugccugcagcccccaggaggugggccugccccauccu

SEQ ID NO: 265822 - RNA, 64 nt, Human
agcaccucagccuggcacccccacuccccugcgcagcccccaggccucaggaccccaccccucu

SEQ ID NO: 265823 - RNA, 64 nt, Human
agaaguugaaucugguuauuauuuaaaaacuagaagcccccaaaccagcagaucuuacugaaga

SEQ ID NO: 265824 - RNA, 64 nt, Human
uguuaaaacacuaauugcugggccucaacccaaaagcccccaaaguggcacuucugaguuccug

SEQ ID NO: 265825 - RNA, 64 nt, Human
gcauagacccucaguagaauuggauuuccaugucagcccccacuccaggaaggcagcccaaucc

SEQ ID NO: 265826 - RNA, 64 nt, Human
augucuucccucccccgaccccagccugucaguccgagcacagugcagguuuggcucugacuug

SEQ ID NO: 265827 - RNA, 64 nt, Human
uucuugucgcuuccuaucaaaauauucagagacucgagcacagcacccagacuucaugcgcccg

SEQ ID NO: 265828 - RNA, 64 nt, Human
gcugaugggacuggagggagcccacccuucagcacgagcacacugcaucucuccugugaguugg

SEQ ID NO: 265829 - RNA, 64 nt, Human
augccacguccauccaccccaccccuuuucgucacgagcacaauggucuuacauuggauuuuug

SEQ ID NO: 265830 - RNA, 64 nt, Human
gccucccugcccccugugacggagggggcaagcaagcccccagaggcugugucucuggacagac

SEQ ID NO: 265831 - RNA, 64 nt, Human
uagacccaagaccaaacgcaucuaaaggauccccagcccccaagaccuagccuuugucugcgau

SEQ ID NO: 265832 - RNA, 64 nt, Human
aaaguuaagugaaaauuagucaacugcacguggaagcccccaccacuuuggggaucucuuuauu

SEQ ID NO: 265833 - RNA, 64 nt, Human
gcccagccaggccugacucaucauggucacauccagcccccacccccggccaacuaaccacugc

SEQ ID NO: 265834 - RNA, 64 nt, Human
ugagggcggcugcaggagaggaaggggcucccacagcccccacugaugccgcugcaggccccug

SEQ ID NO: 265835 - RNA, 64 nt, Human
uaaggaugaaagcaaaggagggccuugaggaagcagcccccaggccuggcagccacgcagcggc

SEQ ID NO: 265836 - RNA, 64 nt, Human
cccccugcccugggccccuuccccacugcccaggagcccccauccuaagcuccaagcaugucug

SEQ ID NO: 265837 - RNA, 64 nt, Human
aguucagcaguucaucuucaugggaaauuugcugagcccccaccagggaaccggaugaugaaac

SEQ ID NO: 265838 - RNA, 64 nt, Human
gggccaagggggcuugcccacccaccccgaccccagcccccagccucagccccgguccgggggc

SEQ ID NO: 265839 - RNA, 64 nt, Human
uguguuuguggcucccacuccccagccccccagcagcccccagccgaggggcccagggcccaca

SEQ ID NO: 265840 - RNA, 64 nt, Human
uguguggcuuggggcuuguugccuccccucucugagcccccauuuccuccuucauccuguggag

SEQ ID NO: 265841 - RNA, 64 nt, Human
cccaggcuggacugagccccucacgccgcccugcagcccccaugccccugcccaacaugcuggg

SEQ ID NO: 265842 - RNA, 64 nt, Human
agucacccuacaacuacuacuucuugggaccucaagcccccaacaucccaguccucaguccuca

SEQ ID NO: 265843 - RNA, 64 nt, Human
ugggagucucaagucugcuaagauucacauccauagcccccauggcuuugaggagaauccucuc

SEQ ID NO: 265844 - RNA, 50 nt, Human; identical to SEQ ID NO: 208118

SEQ ID NO: 265845 - RNA, 64 nt, Human; identical to SEQ ID NO: 28140

SEQ ID NO: 265846 - RNA, 64 nt, Human
ccagccagcugguccucugggaacagccagcucccgagcacagccgcacuccuguugacccugg

SEQ ID NO: 265847 - RNA, 64 nt, Human
cucugcccgacaggcugaagugguaccuccuuagcgagcacaguggcuccguggaagaugacau

SEQ ID NO: 265848 - RNA, 64 nt, Human
cagccccgcaucucccacugccaacagcugaagccgagcacagaccucccuuugcacgcuggaa

SEQ ID NO: 265849 - RNA, 64 nt, Human
cccuccuuauuucuuuuuucuaucuguuccucuuagcccccaaacucccagguucucacuuccu

SEQ ID NO: 265850 - RNA, 64 nt, Human
cauugcacagccaggcugggagcagccuagggagagcccccaucaugcccaccacccacucugg

SEQ ID NO: 265851 - RNA, 64 nt, Human
uuaaagaugaggcgccauaggcauccgucuccagagcccccaggaggcaggaaccaggauaagg

SEQ ID NO: 265852 - RNA, 64 nt, Human
gucccaguuucccuuuugguuacagggggauaguagcccccagggaucaugugaaagugagaaa

SEQ ID NO: 265853 - RNA, 64 nt, Human
cgaguguugagcccaaggggggauuuguagaacaagcccccaugagaaacagcuguuacucuac

SEQ ID NO: 265854 - RNA, 64 nt, Human
cagcucagcuuccccaacacgcaggagcacacccagcccccacauccugugccuccaucagcua

SEQ ID NO: 265855 - RNA, 64 nt, Human
aaaauggaaacccccaucugaguauuuugggaggagcccccagcccucauccagcucuggcacg

SEQ ID NO: 265856 - RNA, 64 nt, Human
cccugaaacgagaagugcccuuaaggaucaccccagcccccacagcccuggaauaaauuucgca

SEQ ID NO: 265857 - RNA, 64 nt, Human
aauuaucucagaacagaagucaucagaucaucagagcccccagauggcuacagaccagagauuc

SEQ ID NO: 265858 - RNA, 64 nt, Human
ugccuggggucaggcccucacugacccucaggggagcccccaaggugcugucugucuagacagg

SEQ ID NO: 265859 - RNA, 64 nt, Human
guccacaccucgcucccuguuagugccguaugacagcccccaucaaaugaccuuggccaaguca

SEQ ID NO: 265860 - RNA, 64 nt, Human
ccuaccuguuugggucagagagauguguuuuaaaagcccccaaggaaggaggcugggacugugc

SEQ ID NO: 265861 - RNA, 64 nt, Human
ucagucaaagaaaguccauuguacauaacaaaacagcccccaaacagcccagugccgacaccau

SEQ ID NO: 265862 - RNA, 64 nt, Human
aaugcuuagaaagcugucuuuucagugguguugcagcccccagauguguggccaaccucugcug

SEQ ID NO: 265863 - RNA, 64 nt, Human
ucagcuaacagaauaaacgacucugaagaggagaagcccccaguuaggagaagacagaguggca

SEQ ID NO: 265864 - RNA, 64 nt, Human
accagagccguuacuacacacaaaggcuauugaccgagcacauaccaugugccacacaccuuga

SEQ ID NO: 265865 - RNA, 64 nt, Human
cauccucucccaggaccaggaguuuaugaccaggcgagcacaaauggcuaaaagccaagcuguc

SEQ ID NO: 265866 - RNA, 64 nt, Human
agagauuaaaccaauuauaacuuauuagcagucgcgagcacauguucauauagucaauguaaaa

SEQ ID NO: 265867 - RNA, 64 nt, Human
gcagaugcccacacagccagcacugacuuguguucgagcacagaacggauauaaucagucuggc

SEQ ID NO: 265868 - RNA, 64 nt, Human
uuaaccuggcagcccguuuuggggugcuuucuugagcccccaguucucuguccccuagcacuag

SEQ ID NO: 265869 - RNA, 64 nt, Human
aggauugcagggguccagccuugccuguuuccgaagcccccacacugccuuucgcccuacugag

SEQ ID NO: 265870 - RNA, 64 nt, Human
ccacccacaggccauguccagccccacuucccucagcccccagggcuuccuucuggccccucug

SEQ ID NO: 265871 - RNA, 64 nt, Human
uggcuccaauuuggagagggaaugcugagcagauagcccccauuguuaauccaguauccuuaug

SEQ ID NO: 265872 - RNA, 64 nt, Human
uagaguggccuggccccucccccucuaccucaguagcccccaggccugagauggcugagaaggg

SEQ ID NO: 265873 - RNA, 64 nt, Human
ucugcgccaucuaccggcugaacuuucugaccacagcccccagcaggggaggcccacaccugcc

SEQ ID NO: 265874 - RNA, 64 nt, Human
cuauaggaccucaagauuccuggaaagaagccccagcccccaggggaaaccuccagaggaacaa

SEQ ID NO: 265875 - RNA, 64 nt, Human
cuuacccucccaguuggccagaaucugaggggagagcccccagagagcccccuuccccaucaga

SEQ ID NO: 265876 - RNA, 64 nt, Human
augagguccaugcagcucuuugacaaugucaucuagcccccaggagagggggucaguguuuccu

SEQ ID NO: 265877 - RNA, 64 nt, Human
agaaagaauuuagcugcaaguggacaaaggaacaagcccccagaaaagaaagggaagaacugcc

SEQ ID NO: 265878 - RNA, 64 nt, Human
ugguauguagaagggucugucagcacacauggaaagcccccauuugcacagauguagaacuuua

SEQ ID NO: 265879 - RNA, 64 nt, Human
uuaauauaaagauuuuaaaacugcauuaugaccuagcccccauaauugggauuuaucauuuugg

SEQ ID NO: 265880 - RNA, 64 nt, Human
guggacggugccagcugaggcugaggcaugcagcagcccccagcuaccuuugcuuagggcuggg

SEQ ID NO: 265881 - RNA, 64 nt, Human
cuucuuaaaaaucagcuuuaaggagcuggcagaaagcccccagccccacagcccugagagaugg

SEQ ID NO: 265882 - RNA, 64 nt, Human
ggcccaggcagggcuggggugugcuggcaucgacagcccccacucugggcacuaggugggcccu

SEQ ID NO: 265883 - RNA, 64 nt, Human
gccccugcuuccccacccccuccucaggcuccugcgagcacacccccacccccaaaucccuccc

SEQ ID NO: 265884 - RNA, 64 nt, Human
uuacauuuuauaugugagcgagcaagccggcaagcgagcacaguauuauuucuccauccccucc

SEQ ID NO: 265885 - RNA, 64 nt, Human
ucuuuccagguuuugaggacuugaggaagugggacgagcacauuucuauugucuucacuuggau

SEQ ID NO: 265886 - RNA, 64 nt, Human
caggaugcuuuccaaagccaaucacuggggagaccgagcacagggaggaccaaggggaagggga

SEQ ID NO: 265887 - RNA, 64 nt, Human
acaccagggccgcucgugggacuccacauccuccagcccccacaauccugucaggggcucccug

SEQ ID NO: 265888 - RNA, 64 nt, Human
acccaugggcaggagacuguggagacugcuccugagcccccagcuuccagcaggagggacaguc

SEQ ID NO: 265889 - RNA, 64 nt, Human
cccccacaucacccugaagaugacuuccugagccagcccccagccacagccuuagagcugcggg

SEQ ID NO: 265890 - RNA, 64 nt, Human
cucaauggcugcuuugaacuuacucaggaaagccagcccccauaauauuguauuaccaaacagu

SEQ ID NO: 265891 - RNA, 64 nt, Human
gguguugcacccggggcugcaaacgucuccgugcagcccccagagagaggcccaugggcucaga

SEQ ID NO: 265892 - RNA, 64 nt, Human
uuuucuuccccgcccccugcacauucggggucucagcccccaggcugugagcuccuugggggca

SEQ ID NO: 265893 - RNA, 64 nt, Human
ggggaacaaagaggagccugguaaaaaacagccaagcccccaagaccucagcccaggcagaagc

SEQ ID NO: 265894 - RNA, 64 nt, Human
uacggccccuugaccugagcuuaugccgugaaacagcccccagcccccgucugucccccaaccc

SEQ ID NO: 265895 - RNA, 64 nt, Human
ccaggagccuccaggauggagauggagacccagcagcccccagacuacuucuaucccugaaaac

SEQ ID NO: 265896 - RNA, 64 nt, Human
uugccccagccuguaccccagcccugcagcaggaagcccccagucccagcccuuugggacuguu

SEQ ID NO: 265897 - RNA, 64 nt, Human
uuuucagagaacaguuaaucaaggcaaaucagcaagcccccaaagugcuguaauuuaacaucau

SEQ ID NO: 265898 - RNA, 64 nt, Human
guucuuagguuacacaugaaauccuaccgucacuagcccccauacaccaguguugcuggcugaa

SEQ ID NO: 265899 - RNA, 64 nt, Human
aggcuggcccagauauuccccaguggaugggcagagcccccaccuucaagucucuccagugugu

SEQ ID NO: 265900 - RNA, 64 nt, Human
ugugccuaggccuuacgcauuugcugacugacucagcccccaugcuucuggggaccuuuccuac

SEQ ID NO: 265901 - RNA, 64 nt, Human
aauaugauagcuucgcaugguggugugcaccuauagcccccacugccuggaaagcugagguggg

SEQ ID NO: 265902 - RNA, 64 nt, Human; identical to SEQ ID NO: 28134

SEQ ID NO: 265903 - RNA, 64 nt, Human
acaaaaaaaaaaaaaaaaaaaauagccgggcaugguggcgcaagccuguaaucccagcuacuca

SEQ ID NO: 265904 - RNA, 64 nt, Human
gauacggggaagacccacccagggagcgguuucaguggcgcaacaaagcaccacuuuuacuguu

SEQ ID NO: 265905 - RNA, 64 nt, Human
cuccugugugggaggaucucuaaccccucugaucguggcgcauggcuuggggauuaaacuaccc

SEQ ID NO: 265906 - RNA, 53 nt, Human; identical to SEQ ID NO: 208175

SEQ ID NO: 265907 - RNA, 64 nt, Human
aggauuacuggauagaauucaggcuuuccccuccagcccccaaucauagcucacaaaccuuccu

SEQ ID NO: 265908 - RNA, 64 nt, Human
gguauggguauauuuuucuuguguccuugcaguuagcccccaugucuuauguguguccugaaaa

SEQ ID NO: 265909 - RNA, 64 nt, Human
cauuucagaagguggcacucaggucacccugaaaagcccccaggggcuugcaauucuggaaaau

SEQ ID NO: 265910 - RNA, 64 nt, Human
caucuucuuucucuuucugaagcuggagagcagaagcccccaucuuugaaaagcuccugagugc

SEQ ID NO: 265911 - RNA, 64 nt, Human
gccugaguucagccccacggacaaagggacacacagcccccaauggagaccauuguaaguggug

SEQ ID NO: 265912 - RNA, 64 nt, Human
guccucacucaggagugggggguguaggcuggccagcccccagggcuuguccaccagucuucuc

SEQ ID NO: 265913 - RNA, 64 nt, Human
ccaucuuccccugccgcaccggcagucucagcccagcccccaccuuuggguuguagguugggcu

SEQ ID NO: 265914 - RNA, 64 nt, Human
cccgccugccccgcggaagaccgcccagugagccagcccccaccuuccaggcgccuucgcccug

SEQ ID NO: 265915 - RNA, 64 nt, Human
gcgccaggcccccacagucuguggccguggucuuagcccccaguuccacucuggaugggccugu

SEQ ID NO: 265916 - RNA, 64 nt, Human
ucagccucaccaaaguguugggauuacuggugugagcccccacaccuggccgagccagcgcuuc

SEQ ID NO: 265917 - RNA, 64 nt, Human
cagaacugcucacccugccuuuuucugggggcugagcccccacaaccugucuuuuccaagugga

SEQ ID NO: 265918 - RNA, 64 nt, Human
ccacugggcagcuccuggacagccucuuggcuccagcccccacccgaaaguggacacuggcucc

SEQ ID NO: 265919 - RNA, 64 nt, Human
auauucccugacgacacugaagaaucaagagggcagcccccacuuuccuacaaaauggagggag

SEQ ID NO: 265920 - RNA, 64 nt, Human
caguauauuccgugucguguguguguguggccaaagcccccaaggguggcaagugccaccuucg

SEQ ID NO: 265921 - RNA, 64 nt, Human
cagagucucucucuguugcccaggcuggagugcaguggcgcaaucucagcucacugcaaccucc

SEQ ID NO: 265922 - RNA, 64 nt, Human
cgcuacuaaaaauauaaaaaauuagcugggcaugguggcgcacgccuguaguuccagcuacuca

SEQ ID NO: 265923 - RNA, 64 nt, Human
gucucuacuaaaaauucaaaauuagccuggugugguggcgcaugccuauaaucccagcuauucg

SEQ ID NO: 265924 - RNA, 64 nt, Human
ucucuacuaauaauacaaaaauuagcugggcaugguggcgcaugccuguaaucccagcuacugg

SEQ ID NO: 265925 - RNA, 64 nt, Human
gacacuucucaggaaauggcuuuucccaacccccagcccccacccggugguucuuccuguucug

SEQ ID NO: 265926 - RNA, 64 nt, Human
caacugccccagguuuaagcaauccucccaccucagcccccagguaacugggacuacaggcaug

SEQ ID NO: 265927 - RNA, 64 nt, Human
cuggccccagagccuuugccacagugcucccaccagcccccaccucauccgucuguuugcagag

SEQ ID NO: 265928 - RNA, 64 nt, Human
ugagacuacuagaaagaaacgacacccuuccccaagcccccacagcuacuccaacccaaacaac

SEQ ID NO: 265929 - RNA, 64 nt, Human
ggcguuagacuggcaucaggcuggcacuaggcucagcccccaaaacccccugcccagccccagc

SEQ ID NO: 265930 - RNA, 64 nt, Human
guggcauccccagggaagggguugcuguagagauagcccccacccaggggauggaggucuaccc

SEQ ID NO: 265931 - RNA, 62 nt, Human; identical to SEQ ID NO: 208204

SEQ ID NO: 265932 - RNA, 64 nt, Human
gugguagcaagaggaguacccaguuagggguuggagcccccauauaacaucuuccugucagaag

SEQ ID NO: 265933 - RNA, 64 nt, Human
ccucuagaaacgaguuggugucuuucgucucaguagcccccaccccaauaagcuguagacauug

SEQ ID NO: 265934 - RNA, 64 nt, Human
guuucagcugcauccuggugucccacccaggucgagcccccaggcuucuggaaaagagugugug

SEQ ID NO: 265935 - RNA, 64 nt, Human
uuuggcugccauucucacugacaaaauguauaucagcccccaccuccaccccccaauauuccuu

SEQ ID NO: 265936 - RNA, 64 nt, Human
cucacaggagcuuaaacagcuggucagcccccuaagcccccacuacaagugauccucaggcagg

SEQ ID NO: 265937 - RNA, 64 nt, Human
cacugauugggcaauugugggcccaugggguggaagcccccagaugacugagcaguucuacaaa

SEQ ID NO: 265938 - RNA, 64 nt, Human
acccaggugugcaggggagcacacagggcccggcagcccccaggaaucaaggauagggcuaagg

SEQ ID NO: 265939 - RNA, 64 nt, Human
gugcucguuccaaagggaaaaacucggaugaagaagcccccaagacugcccagaagaaguuaaa

SEQ ID NO: 265940 - RNA, 64 nt, Human
agcuacccuggaucuuugcccaccucuuccucagagcccccacugaggggccguagcccuaucu

SEQ ID NO: 265941 - RNA, 64 nt, Human; identical to SEQ ID NO: 28126

SEQ ID NO: 265942 - RNA, 64 nt, Human; identical to SEQ ID NO: 28127

SEQ ID NO: 265943 - RNA, 64 nt, Human; identical to SEQ ID NO: 28128

SEQ ID NO: 265944 - RNA, 64 nt, Human
ccucuaaccugcugugucacccgcuuucccucccagcccccacauccuuaccauuuucccuccc

SEQ ID NO: 265945 - RNA, 64 nt, Human
uccucaccccuccccguguuaaucuguaacuugcagcccccaggccaaaguccuuucucacacu

SEQ ID NO: 265946 - RNA, 64 nt, Human
cuugggaccugguucucuucuaaccccuggcaauagcccccauuccugggucuuuagagauccu

SEQ ID NO: 265947 - RNA, 64 nt, Human
gaguccuggcugauugguguucgcuguucaucugagcccccaaaagcauuauuacugauacuug

SEQ ID NO: 265948 - RNA, 64 nt, Human
cucuuugucuaggacccagaucauccccagagagagcccccacaagcuccucaggaaacaggau

SEQ ID NO: 265949 - RNA, 55 nt, Human; identical to SEQ ID NO: 208219

SEQ ID NO: 265950 - RNA, 64 nt, Human
gaucuguccucagccuugccagagauccaaaagaagcccccagcuaagaaccuggaacuugggg

SEQ ID NO: 265951 - RNA, 64 nt, Human
cuuucucccugccuucuugcccugcccucucuguagcccccacccuccugccaagcugccucug

SEQ ID NO: 265952 - RNA, 64 nt, Human
uugggugagggggaagaauacggggguucccagaagcccccaugugauccaaggguuuguauuu

SEQ ID NO: 265953 - RNA, 64 nt, Human
uaaaaugucuauaaauuaucagucugggugggaaagcccccaccuccauccauuuuccugcuua

SEQ ID NO: 265954 - RNA, 64 nt, Human
caucacugcccuacaugugacuauguccaaguuaagcccccaacacgagaggaaagcugcugac

SEQ ID NO: 265955 - RNA, 64 nt, Human
cccacgggagcacuuccuacccccacgagggcacagcccccacgccuuccagaagacacaaacu

SEQ ID NO: 265956 - RNA, 64 nt, Human
gcucuuuuaagucugauaacaugguuucaagcccagcccccagccuuucuuaccaaucaaggac

SEQ ID NO: 265957 - RNA, 64 nt, Human
caggugagcuguguccucuaggcugccagcucacagcccccaccccagggcccuguaagcugug

SEQ ID NO: 265958 - RNA, 64 nt, Human
auggggagcccaccgccuacacaguaggggcaguagcccccagcuccacgccuguugccaugug

SEQ ID NO: 265959 - RNA, 64 nt, Human
acgaagucacaucccagccccagagucacuguccagcccccaccccucaacacgcgggggaggc

SEQ ID NO: 265960 - RNA, 64 nt, Human; identical to SEQ ID NO: 28131

SEQ ID NO: 265961 - RNA, 64 nt, Human; identical to SEQ ID NO: 28132

SEQ ID NO: 265962 - RNA, 64 nt, Human; identical to SEQ ID NO: 28133

SEQ ID NO: 265963 - RNA, 64 nt, Human
aaucuaugacucaccuugcucugccaucccuggcagcccccaccgguguccuguuccugccaca

SEQ ID NO: 265964 - RNA, 64 nt, Human
gggggguuccugggggcuuccagcccaggcuagaagcccccauggcuucuggcagcuggacauc

SEQ ID NO: 265965 - RNA, 64 nt, Human
ccucugcuccccugugaacccacugaaccuucugagcccccacugcuucuauggggcucucucu

SEQ ID NO: 265966 - RNA, 64 nt, Human
acccaucugaccaucuccuuaagguuucacccaaagcccccagugucagagacuugggauggga

SEQ ID NO: 265967 - RNA, 64 nt, Human
uuauaaaaucaugaagcagguaaagggaggggcaagcccccaaacugcuguggggacauuuuau

SEQ ID NO: 265968 - RNA, 64 nt, Human
uagcgcucuggacagauggacgcaggcccuguccagcccccagugcgcucguuccgguccccac

SEQ ID NO: 265969 - RNA, 64 nt, Human
gggaugcugcugagcaucccgcaguguacaggacagcccccaaacaaggaauuauccagcccca

SEQ ID NO: 265970 - RNA, 64 nt, Human
acacucgcggccuggaaggagaagguguccacggagcccccacccauccucggcgguucccauc

SEQ ID NO: 265971 - RNA, 64 nt, Human
uuccuccugagucuggguaauuauaccucucccaagcccccauuguguguugaaauccugucau

SEQ ID NO: 265972 - RNA, 64 nt, Human
ugccauuacugcaucauaauacaaggaaccucagagcccccauuuguucauuaaagaggcaacu

SEQ ID NO: 265973 - RNA, 64 nt, Human
aagcaccggaaugccaauuaacuagagacccuccagcccccaaggggaggauuugggcagaacc

SEQ ID NO: 265974 - RNA, 64 nt, Human
aguggagcccagacacgucuccuugggauucacuagcccccagcccgccaaaccccaccccagc

SEQ ID NO: 265975 - RNA, 64 nt, Human
acauugaacgcugcacuccugggcuccuguccccagcccccauucagacacgcugacucaggag

SEQ ID NO: 265976 - RNA, 64 nt, Human
cugaaucagccagugccuugcucuuggacuucccagcccccagaacugugagaaauaaauuucu

SEQ ID NO: 265977 - RNA, 64 nt, Human
ccagcccaggagguggcuggauugcagggcuggcagcccccacgugguggcauccugacaggca

SEQ ID NO: 265978 - RNA, 64 nt, Human; identical to SEQ ID NO: 28136

SEQ ID NO: 265979 - RNA, 64 nt, Human; identical to SEQ ID NO: 28137

SEQ ID NO: 265980 - RNA, 64 nt, Human; identical to SEQ ID NO: 28138

SEQ ID NO: 265981 - RNA, 64 nt, Human; identical to SEQ ID NO: 28139

SEQ ID NO: 265982 - RNA, 64 nt, Human
gccccuggcccaggcccaguccuuggugucagggagcccccaggccgcagguggagggugauaa

SEQ ID NO: 265983 - RNA, 64 nt, Human
ccagucgaacugggggcuagccaccuccucguccagcccccaaaccuccccuuccuuucccccu

SEQ ID NO: 265984 - RNA, 64 nt, Human
cagaaacccagcccugccccugccuccugcauccagcccccaacauggugccaaagcuuccaga

SEQ ID NO: 265985 - RNA, 64 nt, Human
accgcacccuacccagugucgauauccacaacccagcccccaggccugcacuuuggagauuucu

SEQ ID NO: 265986 - RNA, 64 nt, Human
uguagacccagccucuagucuccugagccuguagagcccccaggagacugggacccaaagaacu

SEQ ID NO: 265987 - RNA, 64 nt, Human
ccuggaacucuuccagccuuucuacuugaucuccagcccccaggucuuugccagaugaugggaa

SEQ ID NO: 265988 - RNA, 64 nt, Human
uucaucacugcugucugcuagagcccuuccucucagcccccauguugggagaggggaguggauu

SEQ ID NO: 265989 - RNA, 64 nt, Human
cugggauggcgaguaagaggcgaccccgcccggcagcccccauccaucugugucugucuguugg

SEQ ID NO: 265990 - RNA, 64 nt, Human
caagagccaccaaaaguuaggggacuucaguccuagcccccagauggccgcccugaagcucucu

SEQ ID NO: 265991 - RNA, 64 nt, Human
ccuggaagauguggggugcugggugagaggcaucagcccccacaaguauguuuuugugucuuaa

SEQ ID NO: 265992 - RNA, 64 nt, Human
uuuuccuccuacuggucuccaccaaggcuuuguuagcccccacccugccuggugugcagcuaac

SEQ ID NO: 265993 - RNA, 64 nt, Human
cgcacagcccagcagcccgaggccgcccgcgacuagcccccaccguaguauuuauaguuaaauu

SEQ ID NO: 265994 - RNA, 64 nt, Human
acuuagauucugguggagagaagugagaauaggcagcccccaaauaaaaaauauucauggauuu

SEQ ID NO: 265995 - RNA, 64 nt, Human
auuccuaagcagcuggccugaccucuuccugcccagcccccaacccagucucuggccucugccc

SEQ ID NO: 265996 - RNA, 64 nt, Human
agacagagccaggagaagcucagcugcauuccgcagcccccacccccaagguucuccaacauca

SEQ ID NO: 265997 - RNA, 64 nt, Human; identical to SEQ ID NO: 28140

SEQ ID NO: 265998 - RNA, 64 nt, Human; identical to SEQ ID NO: 28124

SEQ ID NO: 265999 - RNA, 64 nt, Human
gaaaagguuaaugaacuucaggucccugcaacucagcccccaccacaaacacagcccuggaaac

SEQ ID NO: 266000 - RNA, 64 nt, Human
ggagcagaggugagcagcaaugcacugguucgggagcccccaucagccuccuugugcaaacugg

SEQ ID NO: 266001 - RNA, 64 nt, Human
gccggccucgagaggggccgaugcccagagacacagcccccacggacaaaaccccccagauauc

SEQ ID NO: 266002 - RNA, 64 nt, Human
auauccuccuauaccgcacauaaauagauuucagagcccccauacaaugggcagugucugcuau

SEQ ID NO: 266003 - RNA, 64 nt, Human
ccugcuccccgggcagccucccgccgaggggcccagcccccaacccacaggcacggaggggcau

SEQ ID NO: 266004 - RNA, 64 nt, Human
gcccagcucagacucuaagcucaacaagcccuugagcccccagaaggagaccgcuaacucucag

SEQ ID NO: 266005 - RNA, 64 nt, Human
uauauauauauauauauguauaugucuguaccccagcccccaccuuucagauucugcucuuggc

SEQ ID NO: 266006 - RNA, 64 nt, Human
cuuguggugcuagauguguguuuagagcuaaaccagcccccacccccacccuccaccugccccu

SEQ ID NO: 266007 - RNA, 64 nt, Human
uauuucagcaguuugccacugugacugucuggcaagcccccagauggcguuauauuaauuggau

SEQ ID NO: 266008 - RNA, 64 nt, Human
cccaaagccuucauuuuaacagauggggaaagugagcccccaagaugggaaagaaccacacagc

SEQ ID NO: 266009 - RNA, 64 nt, Human
acacgcacuuggagggcccaggugucucuccaccagcccccaugcaguagggacuggaagauau

SEQ ID NO: 266010 - RNA, 64 nt, Human
uaaguuuugggggaaagauggaguuccuauccagagcccccagauuuccagaaucgagugagcu

SEQ ID NO: 266011 - RNA, 64 nt, Human
cuugaaaacagugugaugcaauuacugcuguucuagcccccaaagaguuuucugugcaaaaucu

SEQ ID NO: 266012 - RNA, 64 nt, Human
gguggaaaaagaucaccucccagugaccucccucagcccccaggggaguaggucuguguccaaa

SEQ ID NO: 266013 - RNA, 64 nt, Human
cccaaauuuccacuccacaaagaaaacagcugcaagcccccagggacuuaccuggggcuggcau

SEQ ID NO: 266014 - RNA, 64 nt, Human
gcaugcguacacaauucccuggccaagccuggcucgagcacaggaagcucaucugcguuuuggc

SEQ ID NO: 266015 - RNA, 64 nt, Human
ucuaagaugaaagauuuuuacucuagaaacugugcgagcacaacacacacaauccuuucuaacu

SEQ ID NO: 266016 - RNA, 56 nt, Human
gcguccagcccuaccuauagaagggccgagcacagcaaugcaaguaagugggcacc

SEQ ID NO: 266017 - RNA, 64 nt, Human
gauacuagcaucugguauuuuauuuauuuugcagcgagcacaugaggaagcugagucuuucacc

SEQ ID NO: 266018 - RNA, 64 nt, Human
ggggguuuauggauaggcuucaagagggucugugagcccccagaaauugugugugagacugagu

SEQ ID NO: 266019 - RNA, 64 nt, Human
ccgcuuccuuucucagcugaaccccuacucccggagcccccagcagggcccuccgagguggagc

SEQ ID NO: 266020 - RNA, 64 nt, Human
ggccgcuuccuuucucagcugaaccccuacccggagcccccagcagggcccuccgagguggaac

SEQ ID NO: 266021 - RNA, 64 nt, Human
cacaggaagucacaguggugcccagggaugugucagcccccagccacggggacgcgggauucaa

SEQ ID NO: 266022 - RNA, 64 nt, Human
aaauagaaaaaucuaauucaauaaacucuguaucagcccccaacauauuauuuuucauuauuug

SEQ ID NO: 266023 - RNA, 64 nt, Human
uuuauaagggcacuaaccccauucaugagagcagagcccccauggccuaaucaccuuuccaagg

SEQ ID NO: 266024 - RNA, 64 nt, Human
cagugaauuuuuuuauauuaaaagguugagccaaagcccccaguguuuguauuuugaagccaag

SEQ ID NO: 266025 - RNA, 64 nt, Human
cccugauccucugcuuccuccucacaaccccaagagcccccagcccgguccauccacgucugga

SEQ ID NO: 266026 - RNA, 64 nt, Human
gaguaagggaaccccaggcaggcggcccugccacagcccccaaagacacuggccuccugcucca

SEQ ID NO: 266027 - RNA, 64 nt, Human
cugcaaggccuucacgccugccagggucagcugcagcccccacucugccaagguggggaguggu

SEQ ID NO: 266028 - RNA, 64 nt, Human
gaggagugggcccuggaguccugucccucccagaagcccccagggugggauuucucaggcugcc

SEQ ID NO: 266029 - RNA, 64 nt, Human
uugaccugcugggccaggcugcccugggacucucagcccccaguugcuuauccagaugugacag

SEQ ID NO: 266030 - RNA, 64 nt, Human
aguuuggccacgcccugggccugggccacuccucagcccccaacuccauuaugaggcccuucua

SEQ ID NO: 266031 - RNA, 64 nt, Human
cccuccuguagggcacaaggccaggcugccucccagcccccaggcccucucccaccuacagaga

SEQ ID NO: 266032 - RNA, 64 nt, Human
accaacccugcaaucaccuugaucuugggcuuucagcccccaaaggugugagaaaauaaacuuc

SEQ ID NO: 266033 - RNA, 64 nt, Human; identical to SEQ ID NO: 28127

SEQ ID NO: 266034 - RNA, 64 nt, Human; identical to SEQ ID NO: 28128

SEQ ID NO: 266035 - RNA, 64 nt, Human; identical to SEQ ID NO: 28129

SEQ ID NO: 266036 - RNA, 64 nt, Human; identical to SEQ ID NO: 28130

SEQ ID NO: 266037 - RNA, 64 nt, Human
uccugcaaccaguaucuccuuggaauucauccaaagcccccauggacgcauggacgcagggcga

SEQ ID NO: 266038 - RNA, 64 nt, Human
cgguggccagcaggacucugcccagaccacacguagcccccaggcugcuggacacgucggacag

SEQ ID NO: 266039 - RNA, 64 nt, Human
uagggccugacacucuccuaagagguucucuccaagcccccaaauagcuccaggcgcccucggc

SEQ ID NO: 266040 - RNA, 64 nt, Human
gaggagagucuguugcuggcauagcccuggaaggagcccccagccucuccccuccuccuccuug

SEQ ID NO: 266041 - RNA, 64 nt, Human
caggggcgcucggcagcccacagggccuggccucagcccccacuccuguuccuugugcacccac

SEQ ID NO: 266042 - RNA, 64 nt, Human
cuugugccagagaacccagcccacccccggcagcagcccccagcucccaccuccccuugggccc

SEQ ID NO: 266043 - RNA, 64 nt, Human
caccuucucccugccuucucucuucucucgucugagcccccaggccuuuuccacuuugagggag

SEQ ID NO: 266044 - RNA, 64 nt, Human
uggcuuccuggcgcccccuaucgggggugagcgaagcccccacuacuaaauggccucucuccac

SEQ ID NO: 266045 - RNA, 64 nt, Human
acuucugugcucgcagagcaggggaacaggacucagcccccaucaccguggagccaaaguguuu

SEQ ID NO: 266046 - RNA, 64 nt, Human
cagcuagaagggccggugggcaccggggccgggaagcccccaccucaccaccugagggccccug

SEQ ID NO: 266047 - RNA, 64 nt, Human
cucggcacuagaauucgccacucucccaccccccagcccccaccucugccuccaggucucaucu

SEQ ID NO: 266048 - RNA, 64 nt, Human
gaggccauagcaauuccccuacaucaaaugcucaagcccccagcuggaaguuaagagaaaguca

SEQ ID NO: 266049 - RNA, 64 nt, Human
guuauuuagcauuucgaacaucucggccauucaaagcccccauguucucugcacuguuuggcca

SEQ ID NO: 266050 - RNA, 64 nt, Human
ccccgagcccugacuccuggacuccggaggacugagcccccaccggaacugggcuggcgcuugg

SEQ ID NO: 266051 - RNA, 64 nt, Human
guccccgaucugccuccagccccaagaugccuacagcccccaggccccuucggcagcacugccu

SEQ ID NO: 266052 - RNA, 64 nt, Human; identical to SEQ ID NO: 28133

SEQ ID NO: 266053 - RNA, 64 nt, Human; identical to SEQ ID NO: 28134

SEQ ID NO: 266054 - RNA, 64 nt, Human; identical to SEQ ID NO: 28135

SEQ ID NO: 266055 - RNA, 64 nt, Human; identical to SEQ ID NO: 28136

SEQ ID NO: 266056 - RNA, 64 nt, Human
ccaugagaggcagcgcccgccacccuguguccacagcccccaccuucccgcuucccuuagaacc

SEQ ID NO: 266057 - RNA, 64 nt, Human
gucucuucucuaccagcugccgcggcgggggcaaagcccccagagccucacuggccccggcggg

SEQ ID NO: 266058 - RNA, 64 nt, Human
cucacugcguuugguuuucuuuucagaacuugggagcccccagggaggggcuaguguugguagg

SEQ ID NO: 266059 - RNA, 64 nt, Human
gacucaaagggaaaccccccagucacccacugucagcccccaucugacaagaaagccuggagcg

SEQ ID NO: 266060 - RNA, 64 nt, Human
uaucuguuuagcuuuuaugaagagucaccguagcagcccccacggcuggaaagaggccuguacg

SEQ ID NO: 266061 - RNA, 64 nt, Human
agguggagggaaggauaaagccacuucuggcuucagcccccaccaggggaaggaaggagggcac

SEQ ID NO: 266062 - RNA, 64 nt, Human
gagcagcagcgucaguggacccagugcugagaaaagcccccacaucccggaaaacccacuuucc

SEQ ID NO: 266063 - RNA, 64 nt, Human
augcagaaguacccauucaucacaccugccccauagcccccacucugcuguacugauaggauuu

SEQ ID NO: 266064 - RNA, 64 nt, Human
cucagcucuguccacgcuucgauaggccugacgcagcccccagcccagggccgcccuagcaacu

SEQ ID NO: 266065 - RNA, 53 nt, Human; identical to SEQ ID NO: 208338

SEQ ID NO: 266066 - RNA, 64 nt, Human
ccagggcuacccacugcuuacucagggaccaggcagcccccauggcaguaaaagcagccuagac

SEQ ID NO: 266067 - RNA, 64 nt, Human
cucuccggcuuccagggagaccuccccgcccagcagcccccagagacacaacaaccuaccuucc

SEQ ID NO: 266068 - RNA, 64 nt, Human
gugccucaggaccuuuuggucuucagccucccucagcccccaggaucuggguuagguggccgcu

SEQ ID NO: 266069 - RNA, 64 nt, Human
uccucugcuucuuugccucccucagauagaaaacagcccccacuccaguccacuccugaccccu

SEQ ID NO: 266070 - RNA, 64 nt, Human
cccucaacucacccccuacacacacaugagagagagcccccacccaguuccuuggccuaggucu

SEQ ID NO: 266071 - RNA, 64 nt, Human
ccucccgucagggcccacaucaucuaggcuccccagcccccacugugaaggggcuggccagggg

SEQ ID NO: 266072 - RNA, 64 nt, Human; identical to SEQ ID NO: 28125

SEQ ID NO: 266073 - RNA, 64 nt, Human; identical to SEQ ID NO: 28137

SEQ ID NO: 266074 - RNA, 64 nt, Human; identical to SEQ ID NO: 28139

SEQ ID NO: 266075 - RNA, 64 nt, Human
agauaaguugguccucccucugccuuuccucucaagcccccaaagagcaaaggcaacagcaaga

SEQ ID NO: 266076 - RNA, 64 nt, Human
guccacagcagucugagcuggcaggucauggagcagcccccaaagagcuguggcuggggggaug

SEQ ID NO: 266077 - RNA, 64 nt, Human
cgugcugcuuacacuccagguguggaccggccgcagcccccacugaccugcccauguccagagg

SEQ ID NO: 266078 - RNA, 64 nt, Human
uuuggauaccaaagguuucucauguuaauuucucagcccccaaagaagcaucuuacuccugaac

SEQ ID NO: 266079 - RNA, 64 nt, Human
gccuuaucauuuucucccuaggacauucccuuguagcccccagaauugucuggcccaaauugaa

SEQ ID NO: 266080 - RNA, 64 nt, Human
aaggcaucccaguucuaaggcugcugcuaauuacagcccccaaccuccaacccaccagcugacc

SEQ ID NO: 266081 - RNA, 64 nt, Human
ccuccacaagccuaguccauccugccugagcuccagcccccagcccccacugugcccagacaug

SEQ ID NO: 266082 - RNA, 64 nt, Human
aagccuaguccauccugccugagcuccagcccccagcccccacugugcccagacaugugugcuc

SEQ ID NO: 266083 - RNA, 64 nt, Human
gccggggugggguggcugcagccucaggacugggagcccccagccugucagauccaggagcucc

SEQ ID NO: 266084 - RNA, 64 nt, Human
uaugaaacucaccagcgagaacaaacaccuccccagcccccagcccuccccgcagugggaagug

SEQ ID NO: 266085 - RNA, 64 nt, Human
ggccuuaagcuuuccaggggccggggcaguggggagcccccaucccuucacaccgccaccaacu

SEQ ID NO: 266086 - RNA, 64 nt, Human
cccacaggccaacccuggcacaggucaugucugcagcccccagaauguucuggacaugcaccac

SEQ ID NO: 266087 - RNA, 64 nt, Human
ccgcugcccagaagagaccagcaagccaaacuggagcccccauugcaggcugucgccaugugga

SEQ ID NO: 266088 - RNA, 64 nt, Human
ucgcucacuucgcucgcuccgcgucccccaugccagcccccaacgcagggcgcccggcgaagcc

SEQ ID NO: 266089 - RNA, 64 nt, Human
ccggaggaaauccugaagcugacccucaccuccgagcccccacucccaccccagccgcacaguu

SEQ ID NO: 266090 - RNA, 62 nt, Human
ugcccacugugcgcaucuccccaccgaggccccggcagcagucuuguucacagaccuuaggc

SEQ ID NO: 266091 - RNA, 64 nt, Human
cacuugauccacgcagcguggcacugggacguaaguggcgcagucugaauggcggcacgcugaa

SEQ ID NO: 266092 - RNA, 64 nt, Human
gcagccagccgugagugcagaccccuuggccagcguggcgcaguggcccugagcaguaguggca

SEQ ID NO: 266093 - RNA, 64 nt, Human
accuuucugacucugucguccaggcuggagugcaguggcgcaaucucacugcaagcuccacuuc

SEQ ID NO: 266094 - RNA, 64 nt, Human
ggccauggggagggaaggacuuucucccaggggaagcccccagcccugugggucauggucugug

SEQ ID NO: 266095 - RNA, 64 nt, Human
guggcugggcaagugggaaccacuaucucuugggagcccccaaaagcugggaaaugcuggagga

SEQ ID NO: 266096 - RNA, 64 nt, Human
ggccaucuaagcgucgccacccuuugguuauuucagcccccaucacccaagccacaagcugacc

SEQ ID NO: 266097 - RNA, 64 nt, Human
cugagcaauauacuuaaccugaaucucuacucacagcccccaccagcucugaaugucuaaccug

SEQ ID NO: 266098 - RNA, 64 nt, Human
ucagccguuccuccaccucucagccauaucuuucagcccccacuccccuggauccgugugugug

SEQ ID NO: 266099 - RNA, 64 nt, Human
ucccagacacaacaccauguggucuggaggucccagcccccacccuaaaaagguuaucccugag

SEQ ID NO: 266100 - RNA, 64 nt, Human
cagacaaguguguguguggaccauccgcaccuccagcccccaccccacccucuuugucucagcg

SEQ ID NO: 266101 - RNA, 64 nt, Human
uuuuucuuuugccuuugcccgccccccuguccccagcccccagagcgcagggacacccccaucc

SEQ ID NO: 266102 - RNA, 64 nt, Human
uuuucucacugaacuccaccgaccaacugcccuaagcccccagggccuccagggcccagguucg

SEQ ID NO: 266103 - RNA, 64 nt, Human
ggcccaggccucugcccucugcccacccagcgucagcccccagaaaaaaggcaauaaagacgag

SEQ ID NO: 266104 - RNA, 64 nt, Human
acuccccuaggucacaacucugggaaggauacagagcccccacccuucacugaguucucuggau

SEQ ID NO: 266105 - RNA, 64 nt, Human
cccuccugaccugugacccccugccacaauccuuagcccccauaucuggcuguccuuggguaac

SEQ ID NO: 266106 - RNA, 64 nt, Human
cucccugcggguaucccggggggcacuggaugcgagcccccaggucugacguccuugggggugg

SEQ ID NO: 266107 - RNA, 64 nt, Human
aggagccugcagucacuggcuuggcuuuacuuugagcccccaaccccccucucccagcccuggu

SEQ ID NO: 266108 - RNA, 64 nt, Human
aggccaagggccauggggaagauggagcaaaccuagcccccaagccggugggcuagaaaguaca

SEQ ID NO: 266109 - RNA, 64 nt, Human
gaaaggguuuuaaagcccaugccccaacucugccagcccccaccugccaggacguucuagcagg

SEQ ID NO: 266110 - RNA, 62 nt, Human
cucauccuccuccuccuccacuugcagcgagacggcagcacagaccccuggagguccagggg

SEQ ID NO: 266111 - RNA, 64 nt, Human
cuugggaagcagcuccugcugggagcauggccucagcccccagcaucuccuggggcccccaugg

SEQ ID NO: 266112 - RNA, 64 nt, Human
ugcaaggugcuagaccaaugggcugcaguauuauagcccccaggccuggcaggcaugcgcuggg

SEQ ID NO: 266113 - RNA, 64 nt, Human
accuguuaagacuccugacccccaaguggcaugcagcccccaugcccaccgggaccuggucagc

SEQ ID NO: 266114 - RNA, 64 nt, Human
aguggggagaaacaggcccuccuuguccuugugcagcccccacuuuuguccuggcugugggugg

SEQ ID NO: 266115 - RNA, 64 nt, Human
guccuggcccuuucaguuuuauaaguugguuuccagcccccaguguccugacuucugucugcca

SEQ ID NO: 266116 - RNA, 64 nt, Human
ucccuaaggcguccucgagaugaagacgggggggagcccccagccagguggagaccccgcaggg

SEQ ID NO: 266117 - RNA, 64 nt, Human
ugguguggagggaaaugcccuggucuggccuccgagcccccagguccaccgucuccccuccccu

SEQ ID NO: 266118 - RNA, 64 nt, Human
gaccucagcgguuagccugacucuucuuccccccagcccccacccacugcuguguugugugugc

SEQ ID NO: 266119 - RNA, 64 nt, Human
cucggccucccaaaguacugggauuacaggcgugagcccccacgcuggccugcuuuacguauuu

SEQ ID NO: 266120 - RNA, 64 nt, Human
uggggagcuugggcauccuccuccagccuccuccagcccccaggcagugccuuaccuguggugc

SEQ ID NO: 266121 - RNA, 64 nt, Human
gccaccgugcccagccccucaguagguuuuaaggagcccccagcccuccucccuucugggcccg

SEQ ID NO: 266122 - RNA, 64 nt, Human
ucaacucagggccgcugugagcaaagcugaccccagcccccacccccaguuaacacugcugcuu

SEQ ID NO: 266123 - RNA, 64 nt, Human
cccccagcaaguccucuggcaagccggaggacgcagcccccaagaccagcggacagcgccagaa

SEQ ID NO: 266124 - RNA, 64 nt, Human
ccccgcgccucugccggacacggaccggccccucagcccccaccgaggacgcagccacuggggg

SEQ ID NO: 266125 - RNA, 64 nt, Human
ugcccccuacccaauucugagcacacgguacuguagcccccaguuccucccuagccuuccaucc

SEQ ID NO: 266126 - RNA, 64 nt, Human
agggaagggcucuggcccugacuccgcugugucccgagcacacgugcugaccgcagcccgccgc

SEQ ID NO: 266127 - RNA, 64 nt, Human
cccgcacgcugggcaccaacagagccacggagcgcgagcacaugcccgcccggggagcacaaug

SEQ ID NO: 266128 - RNA, 64 nt, Human
agggauuaagcuaagaacuuacagaaugcaaacacgagcacacucucuucgaacccaauugugg

SEQ ID NO: 266129 - RNA, 64 nt, Human
acccagcugccauaaccaccuuagaacuaccagacgagcacaucagaacccuuugacagccauc

SEQ ID NO: 266130 - RNA, 64 nt, Human
uggguacccccaggaccagaagcucccccagcaaagcccccagagcccaggcucggccugcccc

SEQ ID NO: 266131 - RNA, 64 nt, Human
gaugacgagugaugccaggaagccaggccaccgaagcccccacccuacccuuauuccaugaaag

SEQ ID NO: 266132 - RNA, 64 nt, Human
gccuccacuuaccccaccccacccuugggcuaaaagcccccaggcgggcagggggugaccccug

SEQ ID NO: 266133 - RNA, 64 nt, Human
uggcacugucuuccuggccggggccugaaaccuuagcccccagccggccugagugggggauauu

SEQ ID NO: 266134 - RNA, 64 nt, Human
cgugaagugccaacgcccuccccacccugggccgagcccccaccccucccugggcccccaagug

SEQ ID NO: 266135 - RNA, 64 nt, Human
gcggcuccgcaggugaggagcccauggggcgggcagcccccagaaagcgggcagcaggccccga

SEQ ID NO: 266136 - RNA, 64 nt, Human
uccaccccuagcucagccagauccuuacacguggagcccccagcaugggaaugaggggcucugc

SEQ ID NO: 266137 - RNA, 64 nt, Human
uucuccugacuuuacguuggccccuccucugccaagcccccaggggagcccucccuggcguccg

SEQ ID NO: 266138 - RNA, 64 nt, Human
gagaggccggcuggagccaggcccccucgcacgcagcccccaaaucauggacgcaccugugggg

SEQ ID NO: 266139 - RNA, 64 nt, Human
gugagagcucagaguuucugggguccucauuaggagcccccaucccuguguuccccaagaauuc

SEQ ID NO: 266140 - RNA, 64 nt, Human
uacggggggaccgggugagccagugacccccuguagcccccagcuucaggccucagugucugcc

SEQ ID NO: 266141 - RNA, 64 nt, Human
agccuuguagggaggccucuacacagaagaaagcagcccccaugucccagccacuucugggucc

SEQ ID NO: 266142 - RNA, 64 nt, Human
ggaucugagaggaggcugcugggccuucggggugagcccccagagcuggaccugagcuauucuc

SEQ ID NO: 266143 - RNA, 64 nt, Human
ggcuaggcugaccccauccuccucucccuccaggagcccccagcauguccugaccugugcacgg

SEQ ID NO: 266144 - RNA, 64 nt, Human
ggccccgggacccagcagagcugggggagggaucagcccccaaagaaaugggggugcaugcugg

SEQ ID NO: 266145 - RNA, 64 nt, Human; identical to SEQ ID NO: 28124

SEQ ID NO: 266146 - RNA, 64 nt, Human
acacuuaagacucccacccugugacacugagucccgagcacagcaccuucccagucuccugugc

SEQ ID NO: 266147 - RNA, 64 nt, Human
gauccauguguucagguuuagaucauaugacacucgagcacagaagaauaauuucaaggagguc

SEQ ID NO: 266148 - RNA, 64 nt, Human
ccucagguuacucaggaaaaugcuccagcaugugcgagcacaugaccugagguugcaucauagc

SEQ ID NO: 266149 - RNA, 64 nt, Human
cuugaugggggugggcagggggccaguugagccaagcccccagccccgaucugcagauccugcc

SEQ ID NO: 266150 - RNA, 64 nt, Human
gagcugcuccuguggguugauggagcgucccugaagcccccagcccuggggauggggaaggaca

SEQ ID NO: 266151 - RNA, 64 nt, Human
ccuuagaaugccacagucccccaacccuccacagagcccccagacccaccagaacuuccacaga

SEQ ID NO: 266152 - RNA, 64 nt, Human
uuucuggccuccuaaggcuccccaccccgaaaucagcccccagccuuguuucugaugacagugu

SEQ ID NO: 266153 - RNA, 64 nt, Human
caggcagggacuguggcagcuuauguccaaagggagcccccaugcacaggaagccacaggguuc

SEQ ID NO: 266154 - RNA, 64 nt, Human
ggccccuccgcagccccuucccuugcucggggaaagcccccaauucugcccacacccauuuauu

SEQ ID NO: 266155 - RNA, 64 nt, Human
ccagacugagcccugcuggcggacuucaaggagaagcccccacaggggauuuugcuccuagagu

SEQ ID NO: 266156 - RNA, 64 nt, Human
cuguagggguggggaccggggagcaccugccuguagcccccaucagacccugccccaagcacca

SEQ ID NO: 266157 - RNA, 64 nt, Human
auguggggucagugcuugggagccuguggccagcagcccccacugcaccccugcccccagguga

SEQ ID NO: 266158 - RNA, 64 nt, Human
gcacccagcgaggaggggcgggggcaggggcugcagcccccagcgcugccuuugcggauucugu

SEQ ID NO: 266159 - RNA, 64 nt, Human
ccucacuccgcuggugacuucguaccugcucaggagcccccacugucccagucccacucaggcc

SEQ ID NO: 266160 - RNA, 56 nt, Human; identical to SEQ ID NO: 208436

SEQ ID NO: 266161 - RNA, 64 nt, Human
uccuacggguggguucauuggccugggcccagcgagcccccaccugcauugaccuuaggcccau

SEQ ID NO: 266162 - RNA, 64 nt, Human
ggcuccuggaacuucugccuccaccucgcuggggagcccccagggcugcuguggccacagcccu

SEQ ID NO: 266163 - RNA, 64 nt, Human
ugggcaggaccugugagagccaccucacaggcagagcccccaccaggcagggcaaggagacucc

SEQ ID NO: 266164 - RNA, 64 nt, Human
ccugccugaguugugugcauccaggggccuggugagcccccaggcugguggcauggccccccug

SEQ ID NO: 266165 - RNA, 62 nt, Human
gccccaagaugccuacagcccccaggccccuucggcagcacugccucugcccaccugccuuu

SEQ ID NO: 266166 - RNA, 62 nt, Human
gaaaagccaguggagaaagcgcccuuccagggcggcagcagcgggagccacgcagaccccga

SEQ ID NO: 266167 - RNA, 62 nt, Human
cugucauaaagacauauauacacaaauguucacggcagcacuauacacaaucgcaaagucag

SEQ ID NO: 266168 - RNA, 64 nt, Human
cgggcuggucaggcggaugaggucccuacucccgagcccccagccucacccacugcagggccag

SEQ ID NO: 266169 - RNA, 64 nt, Human
aagcugagcacagaccagcagcgaccucccuuccagcccccagaaagcucggucacuugagugu

SEQ ID NO: 266170 - RNA, 64 nt, Human
gcccuccuccacucccuuuuuguaacucccuuacagcccccagacccuucuugaaacgagagcc

SEQ ID NO: 266171 - RNA, 64 nt, Human
ggugcucuuagaaacacuaauguuccucuggggcagcccccaccuccguccugacccgacgggg

SEQ ID NO: 266172 - RNA, 64 nt, Human
agccguggagcuguggaauugggccccguggcagagcccccaucccuugggggcuguggggaug

SEQ ID NO: 266173 - RNA, 64 nt, Human
uccacaccucuaggucgccagagcccuggcccccagcccccagcaagccugagcccgggaagaa

SEQ ID NO: 266174 - RNA, 64 nt, Human
cggggccaggacugcgcucaggaucccgccccggagcccccagcccgggggagagggggaggga

SEQ ID NO: 266175 - RNA, 64 nt, Human
uuuucuaaguuuuauuuuucaaaccaccccggacagcccccagcucugauuccuucaaggcccg

SEQ ID NO: 266176 - RNA, 64 nt, Human
agugaccuuguauuuaugaggccucugugaggccagcccccaccuuccucuuucccaccugucc

SEQ ID NO: 266177 - RNA, 64 nt, Human
caggguauggaaagaggggcucacgcuuaacuccagcccccacccacacccccaucccacccaa

SEQ ID NO: 266178 - RNA, 64 nt, Human
aguccucaguaagguuuuccauuuaaugaaaagcagcccccaaaaucauuuucuuuucuaacaa

SEQ ID NO: 266179 - RNA, 64 nt, Human
ucacugcgaugggggucaccaggugaccagugggagcccccaccccgagucacaccagaaagcu

SEQ ID NO: 266180 - RNA, 64 nt, Human
accuuaggggugaccugggcccaagucucucaucagcccccaauccccuggguaccaggcuucu

SEQ ID NO: 266181 - RNA, 64 nt, Human
ugccaggggcggaggugggugucccccaggucucagcccccaaggcugcccccucagcagaggc

SEQ ID NO: 266182 - RNA, 64 nt, Human
acagggcuccuguggggaggccuuggccugugacagcccccaggccugggggcacagauccccc

SEQ ID NO: 266183 - RNA, 62 nt, Human
aaaaggucuuucccucguggccuuugcacuugcggcagcaacguguacuacacugcagaagg

SEQ ID NO: 266184 - RNA, 62 nt, Human
agagguccccaaagauggacacacaaccccagcggcagcaggaaaaacauaugggaauuuuc

SEQ ID NO: 266185 - RNA, 62 nt, Human
cuugaaagcucugaagaggcccuggguugccgcggcagcaguggucuguuugaugcugccgu

SEQ ID NO: 266186 - RNA, 62 nt, Human
auccugagccccugcaugcacccagggccacccggcagcacacucaucccgcgccuccagag

SEQ ID NO: 266187 - RNA, 54 nt, Human; identical to SEQ ID NO: 208464

SEQ ID NO: 266188 - RNA, 64 nt, Human
uaagcggaacacccugccccagggccggacuuccagcccccagagcccucucccugucacuccc

SEQ ID NO: 266189 - RNA, 64 nt, Human
agggagcaggucacaggucaccauggggaauucuagcccccacuggggggauguuacaacacca

SEQ ID NO: 266190 - RNA, 64 nt, Human
ucgcuacaucccuugcccccuguccauuuauuuaagcccccauaggugcccuucacccccaaaa

SEQ ID NO: 266191 - RNA, 64 nt, Human
ucucccaccccaaacuccaaccuguaucagaugcagcccccaagcccuuagacucuaagcccag

SEQ ID NO: 266192 - RNA, 64 nt, Human
cccccugccugcucucuuucccuacaacuaggucagcccccagccccgcuacggcggccgcacc

SEQ ID NO: 266193 - RNA, 64 nt, Human
ucuagccuaucuccugugccccugacugagcagaagcccccacagcuggccagcagccccgccu

SEQ ID NO: 266194 - RNA, 64 nt, Human
cagagcaguugcuucaggcguuuucuccccaccaagcccccacccuugcugugucaccaucacu

SEQ ID NO: 266195 - RNA, 64 nt, Human
uggcuugucuagccccccugcugggugcuuguucagcccccacucugggcuguggagugggugg

SEQ ID NO: 266196 - RNA, 64 nt, Human
uugcccaggucaggaguguuuucuuggugguuccagcccccaucaauugaacuguuucugggcu

SEQ ID NO: 266197 - RNA, 64 nt, Human
gacucuugcaauccacaaucugacauucucaggaagcccccaaguugauauuucuauuuccugg

SEQ ID NO: 266198 - RNA, 64 nt, Human
agugcuucuggauucaugggugaguucccugggcagcccccaggaaggccuuccagaucuggcu

SEQ ID NO: 266199 - RNA, 64 nt, Human
ugucauccaugcgugcacauaugggugcuggcagagcccccaaggacucuggccucucgaguuc

SEQ ID NO: 266200 - RNA, 64 nt, Human
cuggccauggguccuugcccccgacagacagagcagcccccacccgggagccuugauggggguc

SEQ ID NO: 266201 - RNA, 64 nt, Human
agucccucccaccacccucgccgcaggcagcugcagcccccagaggggaccacaagcccaaaaa

SEQ ID NO: 266202 - RNA, 64 nt, Human
agggccagcacagaggggccuuccucccccacagagcccccaugacauagucugcucugggcgg

SEQ ID NO: 266203 - RNA, 62 nt, Human
ggcagaagaggcgucgagggcgccagaaguggcggcagcagcagccgcagcagccaaagaga

SEQ ID NO: 266204 - RNA, 62 nt, Human
agucgggggccugcccuggccggggucgcagucggcagcagcgugcaguccggcaucucccg

SEQ ID NO: 266205 - RNA, 62 nt, Human
agucccucuacuacaggcaguggaccuuggcccggcagcaccacgcugacuauagcaaccag

SEQ ID NO: 266206 - RNA, 64 nt, Human
cucagcugaaucucucugaccauuccucuacuggagcccccaaugaaagccgcaaaccuauacc

SEQ ID NO: 266207 - RNA, 64 nt, Human
uucccacccugucuucuccccuaggugguuccugagcccccacccccaaucccagugcuacacc

SEQ ID NO: 266208 - RNA, 64 nt, Human
agaagguccagccuaggcccccugcaaggcuggcagcccccacccccaccccccaggccgccuu

SEQ ID NO: 266209 - RNA, 64 nt, Human
cccugagguuggcgucuuccuacgucccagaagcagcccccaccccacacaugacccacaccgc

SEQ ID NO: 266210 - RNA, 64 nt, Human
agaggaacauuuccucaguguagccuaacaaugcagcccccaaucuguuccuuuuuuuuuuuga

SEQ ID NO: 266211 - RNA, 64 nt, Human
gaaucggcggauugucugaaugacacauauacagagcccccacggauuucugcacacucugggu

SEQ ID NO: 266212 - RNA, 64 nt, Human
ccgccuaagggaccccugcucccagccugcugagagcccccaccuugaucccaauccuuauccc

SEQ ID NO: 266213 - RNA, 64 nt, Human
cuuucccuccuugucuggccccaguggucuggggagcccccaggcacaccuaagcgucguggag

SEQ ID NO: 266214 - RNA, 64 nt, Human
cuccgagccugcuaccugguugccaaccuucccuagcccccaaaccgaagccaucugccaaauu

SEQ ID NO: 266215 - RNA, 64 nt, Human
uuuggacaacuggccuggccgcucccauccuguaagcccccaccacggggagacccucaucccu

SEQ ID NO: 266216 - RNA, 64 nt, Human
cagcagcgagcuggucuggcgagggcaccucggcagcccccacggguuggcuccuacguuugcg

SEQ ID NO: 266217 - RNA, 64 nt, Human
aauuuucaggaagaaagggaaauugcagccccucagcccccaggauugaccucuggggagugau

SEQ ID NO: 266218 - RNA, 64 nt, Human
gcuucugaggccagccaugcccacgccccuccccagcccccacccaugccagcgcagcgccagg

SEQ ID NO: 266219 - RNA, 64 nt, Human
gcggauggccggagaggaccggcggcucggaggaagcccccaccgugggcagggagcggccggc

SEQ ID NO: 266220 - RNA, 64 nt, Human
agcaugggcacuacucuucaugugcggugacaccagcccccagaugccuugaauuaaguguccu

SEQ ID NO: 266221 - RNA, 62 nt, Human
agaccgacguccuuuagcccucccaggccccacggcagcacuuaugguagcggcacugucuu

SEQ ID NO: 266222 - RNA, 62 nt, Human
ccccaggucauccuauccccaagagugaugcccggcagcauucccagcucagggcuaauggu

SEQ ID NO: 266223 - RNA, 62 nt, Human
cagaggagugacagccgcagacacacgacagccggcagcaacuggaauggcagcaauuaagg

SEQ ID NO: 266224 - RNA, 62 nt, Human
agacacgaggagggccugcccggaagucacaucggcagcagcugucuaaagggcuugggggc

SEQ ID NO: 266225 - RNA, 64 nt, Human
aaaaagcaacgggaaaugugguccuauuuaagccagcccccaccuagggucuauuuguguggca

SEQ ID NO: 266226 - RNA, 64 nt, Human
auggacucccagacugcaggggagcacuuggggcagcccccagaaggaccacugcuggauccca

SEQ ID NO: 266227 - RNA, 64 nt, Human
uuguucuggucucagccgcucccuuggcagcugcagcccccaugcagaagaggcucccaggccc

SEQ ID NO: 266228 - RNA, 64 nt, Human
ccggacuguucccgacccggagacgcggggccacagcccccagcugacccuaauuuauucucag

SEQ ID NO: 266229 - RNA, 64 nt, Human
gccaucacccagcaccccagaucaccgccaggccagcccccaaugguccccuuacggacagguc

SEQ ID NO: 266230 - RNA, 64 nt, Human
agcuggcaccaaagagcuugggcccgugcugaccagcccccaaggcccucuggccggaccaugc

SEQ ID NO: 266231 - RNA, 64 nt, Human
gaccagaggcccacauggaugccacuccccacacagcccccaggccugcccagcccaccuccuc

SEQ ID NO: 266232 - RNA, 64 nt, Human
caccgggggcuucuugccucaguucuucccucugagcccccaggcccucccgcaucucagguug

SEQ ID NO: 266233 - RNA, 64 nt, Human
uuggaaggaggaagggcugaccuggguucucuccagcccccaggugcgccgggucacccgugcc

SEQ ID NO: 266234 - RNA, 64 nt, Human
cggcuggcccgggccaugggcugcgcaaaucaccagcccccaacccagggaggaacuggccccu

SEQ ID NO: 266235 - RNA, 64 nt, Human
aggccagggggguggggggccgcccucaucaggcagcccccagcccccugaggcccuguccauc

SEQ ID NO: 266236 - RNA, 64 nt, Human
gggaucuggggcuuccuggccuggccagagcuggagcccccacaggguaaggaagagagagugg

SEQ ID NO: 266237 - RNA, 64 nt, Human
ggggucagcagagcuucagagguggccccaccugagcccccacccgggagcaguguccugugcu

SEQ ID NO: 266238 - RNA, 64 nt, Human; identical to SEQ ID NO: 266227

SEQ ID NO: 266239 - RNA, 64 nt, Human
ugguucgauucugccucuguagcucaaggggggcagcccccagaguccugugcauucugccaag

SEQ ID NO: 266240 - RNA, 64 nt, Human; identical to SEQ ID NO: 28129

SEQ ID NO: 266241 - RNA, 64 nt, Human
gcccccaccacaaacacagcccuggaaacauacaguggcgcaagguccucuugaaauguuaaug

SEQ ID NO: 266242 - RNA, 64 nt, Human
guauuuccaguaacacagcaucaucgcacugacuguggcgcacuggggaauaacagucugagcu

SEQ ID NO: 266243 - RNA, 64 nt, Human
gccaugcagagcccuggccgcuggagacucuuaaagcccccacagcccuccagguccuccagcu

SEQ ID NO: 266244 - RNA, 64 nt, Human
agcagcucgaagaccauccuggccauagcagccaagcccccauucccagagcagacccucuccc

SEQ ID NO: 266245 - RNA, 64 nt, Human
cagggugagacagcagggcccaggggaguggaccagcccccagcaaauuaucaccaucugugcc

SEQ ID NO: 266246 - RNA, 64 nt, Human
ccugucccaguuuaucaggaacgcaggccuggggagcccccaguggcggggacagggccagauu

SEQ ID NO: 266247 - RNA, 64 nt, Human
accuguuccagaggugcagacaagagguggcgagagcccccaucaugccccucaaccuaucccg

SEQ ID NO: 266248 - RNA, 64 nt, Human
cugugccaauaaccucauucuuugucugagaaacagcccccaguccuccuccacuacaaccucc

SEQ ID NO: 266249 - RNA, 64 nt, Human
ccucccugagggccugccgggcugccucugccccagcccccagcaagggcacucccaggcuucc

SEQ ID NO: 266250 - RNA, 54 nt, Human; identical to SEQ ID NO: 208529

SEQ ID NO: 266251 - RNA, 64 nt, Human
gaccacugcaucucacugggccagcagcccccccagcccccagccuugguggggaccaagcagc

SEQ ID NO: 266252 - RNA, 64 nt, Human
agaaagcauuugcccaucugccuuucuuucccccagcccccacccgcuuugaauguagagaccc

SEQ ID NO: 266253 - RNA, 64 nt, Human
ugcagaagcacagacacuacagaccacagcauucagcccccauggaguuuggugugcuugccuu

SEQ ID NO: 266254 - RNA, 64 nt, Human
uacagccccggcccucgacaguauugaggccccgagcccccagcacuuguguguacagcccccg

SEQ ID NO: 266255 - RNA, 64 nt, Human
gaacaacgagcagaaggcccuggcgacugggcugagcccccaagugaaacugagguucaggaga

SEQ ID NO: 266256 - RNA, 64 nt, Human
agcggcuggagggaugccacaccccucacagggcagcccccaacuacaucuucccugcuuacuc

SEQ ID NO: 266257 - RNA, 64 nt, Human
ccacacugaggccaggucuaccccccaucauaccagcccccaggaccacuaccccacggccagc

SEQ ID NO: 266258 - RNA, 64 nt, Human
uuuaauguagccaugggaccaaaccuagccccuuagcccccacccacuucccugggcaaaugaa

SEQ ID NO: 266259 - RNA, 62 nt, Human
ccacccugucccccagcucuggugagucuuggcggcagcagccaucauaggaagggaccaag

SEQ ID NO: 266260 - RNA, 57 nt, Human
ugagcccagaggugcggugaccgcacgcggcagcaccucugagccggagggcaccag

SEQ ID NO: 266261 - RNA, 62 nt, Human
uuaugugacucuucauauaacccuuuuuucuacggcagcauuaaaauugucuuuuugcuaua

SEQ ID NO: 266262 - RNA, 64 nt, Human
cugagcaccucgcucuggugcccgucugugugggagcccccacuguaacacucuaauaaaucag

SEQ ID NO: 266263 - RNA, 64 nt, Human
ccagggaggccaucuggggcuccuucuccaccccagcccccaaagcagcccuucccccagugcc

SEQ ID NO: 266264 - RNA, 64 nt, Human
gcuuuuggucccagagcugggguauguuggccccagcccccagccuguggcucccaaaaggccu

SEQ ID NO: 266265 - RNA, 64 nt, Human
cuuugggcccugcagggggaggggugacagggcgagcccccaccccagcagcagcaauaccccc

SEQ ID NO: 266266 - RNA, 64 nt, Human
acgccagccccaaacuaagauaucccucacacccagcccccauuaccuagggacaagagucuuc

SEQ ID NO: 266267 - RNA, 64 nt, Human
caaggcugcucagaggggccccgguccuggccccagcccccaccuccgccccagacacaccccc

SEQ ID NO: 266268 - RNA, 64 nt, Human
ccccagcagcccucucuucccccaccuccccagcagcccccacccuugccccagcugggcucca

SEQ ID NO: 266269 - RNA, 64 nt, Human
gagacaagaccuagaggguuugggacaaacugggagcccccaccccacacucuaguugcccaug

SEQ ID NO: 266270 - RNA, 64 nt, Human
guguacuauucauugauucagugaugugaaauugagcccccaaaagguuguuucugaagcucga

SEQ ID NO: 266271 - RNA, 64 nt, Human
caucaugaaugauaagcuguuucugagggaugccagcccccaagagacucagagugccuucucc

SEQ ID NO: 266272 - RNA, 64 nt, Human
ucagauguggaggcccagggaauagacccucaagagcccccaagagacaggagagacuccgaac

SEQ ID NO: 266273 - RNA, 64 nt, Human
augaagugcccuccagccucagagcuagccacaaagcccccagagcugaauucauugaguauuu

SEQ ID NO: 266274 - RNA, 64 nt, Human
cugggaaucgcuguguuauuugcaaagaaaaaacagcccccacuccuccuccugaguuccaggg

SEQ ID NO: 266275 - RNA, 64 nt, Human
acuccaguuucuuaaggaaaccacuggaaucugcagcccccacaugcaucugucuaacgcaugc

SEQ ID NO: 266276 - RNA, 64 nt, Human
cagccuccuguagcccgccucaugcacugaccacagcccccaggggaggaugguacuggaucug

SEQ ID NO: 266277 - RNA, 62 nt, Human
ggguuagggcaccaggaggggccagguggcgucggcagcaucuguccccagaaucaggcaga

SEQ ID NO: 266278 - RNA, 62 nt, Human
ggcauagccccgguccucuccaucucucuccucggcagcagcgggaggcagaggaaggcggc

SEQ ID NO: 266279 - RNA, 62 nt, Human
gaauguucugagccgucugagggccuucaugccggcagcagcuagcaaagccagaaagcaag

SEQ ID NO: 266280 - RNA, 62 nt, Human
guucauccucagugaucugcccuccagcaucucggcagcaucucauccuccaucgucagcug

SEQ ID NO: 266281 - RNA, 64 nt, Human
uggugcccugagucuggggcccgugccagccggcagcccccaagccugccccgcuacccaagca

SEQ ID NO: 266282 - RNA, 64 nt, Human
ccugaggccucugggucaagcuuucaucagccccagcccccacacuccaccaaaguucucaugc

SEQ ID NO: 266283 - RNA, 64 nt, Human
ggagugaugcggccacaagcccagggacaccuggagcccccaggagcugggagaggcaggaagg

SEQ ID NO: 266284 - RNA, 62 nt, Human
ucuuagucccagcgauucugcagagcggccaucggcagcaugucaaccauuugcauggcugg

SEQ ID NO: 266285 - RNA, 62 nt, Human
gcggcugaggacacgcugaggccgcggcugcccggcagcaacugggguggccagguggggcg

SEQ ID NO: 266286 - RNA, 62 nt, Human
cuugaaauggauuucuaggucacuggggacuccggcagcacauucggcuucagaauaaaggg

SEQ ID NO: 266287 - RNA, 64 nt, Human; identical to SEQ ID NO: 99919

SEQ ID NO: 266288 - RNA, 64 nt, Human; identical to SEQ ID NO: 99920

SEQ ID NO: 266289 - RNA, 64 nt, Human; identical to SEQ ID NO: 99921

SEQ ID NO: 266290 - RNA, 64 nt, Human; identical to SEQ ID NO: 99922

SEQ ID NO: 266291 - RNA, 64 nt, Human; identical to SEQ ID NO: 99923

SEQ ID NO: 266292 - RNA, 64 nt, Human; identical to SEQ ID NO: 99924

SEQ ID NO: 266293 - RNA, 64 nt, Human; identical to SEQ ID NO: 99925

SEQ ID NO: 266294 - RNA, 64 nt, Human; identical to SEQ ID NO: 99926

SEQ ID NO: 266295 - RNA, 64 nt, Human; identical to SEQ ID NO: 99927

SEQ ID NO: 266296 - RNA, 64 nt, Human; identical to SEQ ID NO: 99928

SEQ ID NO: 266297 - RNA, 64 nt, Human; identical to SEQ ID NO: 99929

SEQ ID NO: 266298 - RNA, 64 nt, Human; identical to SEQ ID NO: 99930

SEQ ID NO: 266299 - RNA, 64 nt, Human; identical to SEQ ID NO: 99931

SEQ ID NO: 266300 - RNA, 62 nt, Human
gugagcaguucagccugcagcagaggagggcacggcagcagagacacgcacaugcacguaag

SEQ ID NO: 266301 - RNA, 62 nt, Human
gcugggagguccggaucguuccugcagggaagcggcagcacacggagaccacuugguugaau

SEQ ID NO: 266302 - RNA, 62 nt, Human
ggcagguggcacguggcaucgcauggugggcucggcagcaccuugccuguguuucugugagg

SEQ ID NO: 266303 - RNA, 64 nt, Human; identical to SEQ ID NO: 99932

SEQ ID NO: 266304 - RNA, 64 nt, Human; identical to SEQ ID NO: 99933

SEQ ID NO: 266305 - RNA, 64 nt, Human; identical to SEQ ID NO: 99934

SEQ ID NO: 266306 - RNA, 64 nt, Human; identical to SEQ ID NO: 99935

SEQ ID NO: 266307 - RNA, 64 nt, Human; identical to SEQ ID NO: 99936

SEQ ID NO: 266308 - RNA, 64 nt, Human; identical to SEQ ID NO: 99937

SEQ ID NO: 266309 - RNA, 64 nt, Human; identical to SEQ ID NO: 99938

SEQ ID NO: 266310 - RNA, 64 nt, Human; identical to SEQ ID NO: 99939

SEQ ID NO: 266311 - RNA, 64 nt, Human; identical to SEQ ID NO: 99940

SEQ ID NO: 266312 - RNA, 64 nt, Human; identical to SEQ ID NO: 99941

SEQ ID NO: 266313 - RNA, 64 nt, Human; identical to SEQ ID NO: 99942

SEQ ID NO: 266314 - RNA, 61 nt, Human; identical to SEQ ID NO: 99943

SEQ ID NO: 266315 - RNA, 64 nt, Human; identical to SEQ ID NO: 99944

SEQ ID NO: 266316 - RNA, 64 nt, Human; identical to SEQ ID NO: 99945

SEQ ID NO: 266317 - RNA, 62 nt, Human
ucuuuuuugaagaguuuuucuugugcuugcuucggcagcauauauacugaaauuagaaaaag

SEQ ID NO: 266318 - RNA, 62 nt, Human
cucagacaccuagacucuaaaacuaucagcagcggcagcagcagcagcagcagcaguuugug

SEQ ID NO: 266319 - RNA, 64 nt, Human; identical to SEQ ID NO: 28131

SEQ ID NO: 266320 - RNA, 64 nt, Human; identical to SEQ ID NO: 99946

SEQ ID NO: 266321 - RNA, 64 nt, Human; identical to SEQ ID NO: 99947

SEQ ID NO: 266322 - RNA, 64 nt, Human; identical to SEQ ID NO: 99948

SEQ ID NO: 266323 - RNA, 64 nt, Human; identical to SEQ ID NO: 99949

SEQ ID NO: 266324 - RNA, 64 nt, Human; identical to SEQ ID NO: 99950

SEQ ID NO: 266325 - RNA, 64 nt, Human; identical to SEQ ID NO: 99951

SEQ ID NO: 266326 - RNA, 64 nt, Human; identical to SEQ ID NO: 99952

SEQ ID NO: 266327 - RNA, 64 nt, Human; identical to SEQ ID NO: 99953

SEQ ID NO: 266328 - RNA, 64 nt, Human; identical to SEQ ID NO: 99954

SEQ ID NO: 266329 - RNA, 64 nt, Human; identical to SEQ ID NO: 99955

SEQ ID NO: 266330 - RNA, 64 nt, Human; identical to SEQ ID NO: 99956

SEQ ID NO: 266331 - RNA, 64 nt, Human; identical to SEQ ID NO: 99957

SEQ ID NO: 266332 - RNA, 64 nt, Human; identical to SEQ ID NO: 99958

SEQ ID NO: 266333 - RNA, 64 nt, Human; identical to SEQ ID NO: 99959

SEQ ID NO: 266334 - RNA, 62 nt, Human
ggacccccagugggcagggcaggagguggcagcggcagcagcuguguuucugcaccauuucc

SEQ ID NO: 266335 - RNA, 62 nt, Human
ugaaugugaaaaggugaaacuggugcugacuucggcagcagguauacuaaaauuggaaugac

SEQ ID NO: 266336 - RNA, 62 nt, Human
ugaaugugaaaaggugaaacuguugcugacuucggcagcagguauacuaaaauuggaaugac

SEQ ID NO: 266337 - RNA, 64 nt, Human; identical to SEQ ID NO: 99960

SEQ ID NO: 266338 - RNA, 64 nt, Human; identical to SEQ ID NO: 99961

SEQ ID NO: 266339 - RNA, 64 nt, Human; identical to SEQ ID NO: 99962

SEQ ID NO: 266340 - RNA, 64 nt, Human; identical to SEQ ID NO: 99963

SEQ ID NO: 266341 - RNA, 64 nt, Human; identical to SEQ ID NO: 99964

SEQ ID NO: 266342 - RNA, 64 nt, Human; identical to SEQ ID NO: 99965

SEQ ID NO: 266343 - RNA, 64 nt, Human; identical to SEQ ID NO: 99966

SEQ ID NO: 266344 - RNA, 64 nt, Human; identical to SEQ ID NO: 99967

SEQ ID NO: 266345 - RNA, 64 nt, Human; identical to SEQ ID NO: 99968

SEQ ID NO: 266346 - RNA, 64 nt, Human; identical to SEQ ID NO: 99969

SEQ ID NO: 266347 - RNA, 64 nt, Human; identical to SEQ ID NO: 99970

SEQ ID NO: 266348 - RNA, 64 nt, Human; identical to SEQ ID NO: 99971

SEQ ID NO: 266349 - RNA, 64 nt, Human; identical to SEQ ID NO: 99972

SEQ ID NO: 266350 - RNA, 64 nt, Human; identical to SEQ ID NO: 99973

SEQ ID NO: 266351 - RNA, 62 nt, Human
agguguuacuguaauuccucaacguauuguuucggcagcacuuauuuaaugccgauauacuc

SEQ ID NO: 266352 - RNA, 64 nt, Human; identical to SEQ ID NO: 99974

SEQ ID NO: 266353 - RNA, 64 nt, Human; identical to SEQ ID NO: 99975

SEQ ID NO: 266354 - RNA, 64 nt, Human; identical to SEQ ID NO: 99976

SEQ ID NO: 266355 - RNA, 60 nt, Human; identical to SEQ ID NO: 99977

SEQ ID NO: 266356 - RNA, 64 nt, Human; identical to SEQ ID NO: 99978

SEQ ID NO: 266357 - RNA, 64 nt, Human; identical to SEQ ID NO: 99979

SEQ ID NO: 266358 - RNA, 64 nt, Human; identical to SEQ ID NO: 99980

SEQ ID NO: 266359 - RNA, 64 nt, Human; identical to SEQ ID NO: 99981

SEQ ID NO: 266360 - RNA, 64 nt, Human; identical to SEQ ID NO: 99982

SEQ ID NO: 266361 - RNA, 64 nt, Human; identical to SEQ ID NO: 99983

SEQ ID NO: 266362 - RNA, 64 nt, Human; identical to SEQ ID NO: 99984

SEQ ID NO: 266363 - RNA, 64 nt, Human; identical to SEQ ID NO: 99985

SEQ ID NO: 266364 - RNA, 64 nt, Human; identical to SEQ ID NO: 99986

SEQ ID NO: 266365 - RNA, 64 nt, Human; identical to SEQ ID NO: 99987

SEQ ID NO: 266366 - RNA, 62 nt, Human
gaugaagagcauccucuuuauucaguauaagccggcagcaagcaguucuaccuaacguccca

SEQ ID NO: 266367 - RNA, 62 nt, Human
cauccaacucugacuucggaggcauucccagccggcagcaguguguccagccugccucuucc

SEQ ID NO: 266368 - RNA, 62 nt, Human
ggucccugucccucuggugguuggggauggagcggcagcaagggguguaauggggcuggguu

SEQ ID NO: 266369 - RNA, 64 nt, Human; identical to SEQ ID NO: 99988

SEQ ID NO: 266370 - RNA, 64 nt, Human; identical to SEQ ID NO: 99989

SEQ ID NO: 266371 - RNA, 64 nt, Human; identical to SEQ ID NO: 99990

SEQ ID NO: 266372 - RNA, 61 nt, Human; identical to SEQ ID NO: 99991

SEQ ID NO: 266373 - RNA, 64 nt, Human; identical to SEQ ID NO: 99992

SEQ ID NO: 266374 - RNA, 64 nt, Human; identical to SEQ ID NO: 99993

SEQ ID NO: 266375 - RNA, 64 nt, Human; identical to SEQ ID NO: 99994

SEQ ID NO: 266376 - RNA, 64 nt, Human; identical to SEQ ID NO: 99995

SEQ ID NO: 266377 - RNA, 64 nt, Human; identical to SEQ ID NO: 99996

SEQ ID NO: 266378 - RNA, 64 nt, Human; identical to SEQ ID NO: 99997

SEQ ID NO: 266379 - RNA, 64 nt, Human; identical to SEQ ID NO: 99998

SEQ ID NO: 266380 - RNA, 64 nt, Human; identical to SEQ ID NO: 99999

SEQ ID NO: 266381 - RNA, 64 nt, Human; identical to SEQ ID NO: 100000

SEQ ID NO: 266382 - RNA, 64 nt, Human; identical to SEQ ID NO: 100001

SEQ ID NO: 266383 - RNA, 62 nt, Human
guuugagguuuaaaacaauucaauuacaaaagcggcagcagccaaugcacgccccugcaugc

SEQ ID NO: 266384 - RNA, 62 nt, Human
uaguaaaaaugcauaugcacgugcaauuugcacggcagcauuucaccgauuguggacuguau

SEQ ID NO: 266385 - RNA, 62 nt, Human
cugagcugcuuugugaugcugaaggauacugccggcagcaggcagaggagggagggggccua

SEQ ID NO: 266386 - RNA, 64 nt, Human; identical to SEQ ID NO: 100002

SEQ ID NO: 266387 - RNA, 64 nt, Human; identical to SEQ ID NO: 100003

SEQ ID NO: 266388 - RNA, 64 nt, Human; identical to SEQ ID NO: 100004

SEQ ID NO: 266389 - RNA, 64 nt, Human; identical to SEQ ID NO: 100005

SEQ ID NO: 266390 - RNA, 64 nt, Human; identical to SEQ ID NO: 100006

SEQ ID NO: 266391 - RNA, 64 nt, Human; identical to SEQ ID NO: 100007

SEQ ID NO: 266392 - RNA, 64 nt, Human; identical to SEQ ID NO: 100008

SEQ ID NO: 266393 - RNA, 64 nt, Human; identical to SEQ ID NO: 100009

SEQ ID NO: 266394 - RNA, 64 nt, Human; identical to SEQ ID NO: 100010

SEQ ID NO: 266395 - RNA, 64 nt, Human; identical to SEQ ID NO: 100011

SEQ ID NO: 266396 - RNA, 64 nt, Human; identical to SEQ ID NO: 100012

SEQ ID NO: 266397 - RNA, 64 nt, Human; identical to SEQ ID NO: 100013

SEQ ID NO: 266398 - RNA, 64 nt, Human; identical to SEQ ID NO: 100014

SEQ ID NO: 266399 - RNA, 64 nt, Human; identical to SEQ ID NO: 100015

SEQ ID NO: 266400 - RNA, 62 nt, Human
aggaugccuucuacacguuggugcgugagauccggcagcacaagcugcggaagcugaacccu

SEQ ID NO: 266401 - RNA, 62 nt, Human
uccagcccccuugcuucacucuaccggacagacggcagcagucccagcucugguuuccuucu

SEQ ID NO: 266402 - RNA, 62 nt, Human
agagcccucgugcauugacuugacagccucuccggcagcacaggccuagcugguucuggguu

SEQ ID NO: 266403 - RNA, 64 nt, Human; identical to SEQ ID NO: 100016

SEQ ID NO: 266404 - RNA, 64 nt, Human; identical to SEQ ID NO: 100017

SEQ ID NO: 266405 - RNA, 64 nt, Human; identical to SEQ ID NO: 100018

SEQ ID NO: 266406 - RNA, 64 nt, Human; identical to SEQ ID NO: 100019

SEQ ID NO: 266407 - RNA, 64 nt, Human; identical to SEQ ID NO: 100020

SEQ ID NO: 266408 - RNA, 61 nt, Human; identical to SEQ ID NO: 100021

SEQ ID NO: 266409 - RNA, 64 nt, Human; identical to SEQ ID NO: 100022

SEQ ID NO: 266410 - RNA, 64 nt, Human; identical to SEQ ID NO: 100023

SEQ ID NO: 266411 - RNA, 64 nt, Human; identical to SEQ ID NO: 100024

SEQ ID NO: 266412 - RNA, 64 nt, Human; identical to SEQ ID NO: 100025

SEQ ID NO: 266413 - RNA, 64 nt, Human; identical to SEQ ID NO: 100026

SEQ ID NO: 266414 - RNA, 64 nt, Human; identical to SEQ ID NO: 100027

SEQ ID NO: 266415 - RNA, 64 nt, Human; identical to SEQ ID NO: 100028

SEQ ID NO: 266416 - RNA, 64 nt, Human; identical to SEQ ID NO: 100029

SEQ ID NO: 266417 - RNA, 62 nt, Human
gcacacuuuggugaccccaacgagaacccucucggcagcagccaggagcuguucaccuucca

SEQ ID NO: 266418 - RNA, 62 nt, Human
gcugaugcaugcuuuaauauuugccuauagcccggcagcaaggaagucggggcggggggacu

SEQ ID NO: 266419 - RNA, 62 nt, Human
ucuuaagaaaaccugaauggauuucaucaaggcggcagcauaauuugaagggcaauugcgug

SEQ ID NO: 266420 - RNA, 64 nt, Human; identical to SEQ ID NO: 100030

SEQ ID NO: 266421 - RNA, 64 nt, Human; identical to SEQ ID NO: 100031

SEQ ID NO: 266422 - RNA, 64 nt, Human; identical to SEQ ID NO: 100032

SEQ ID NO: 266423 - RNA, 64 nt, Human; identical to SEQ ID NO: 100033

SEQ ID NO: 266424 - RNA, 64 nt, Human; identical to SEQ ID NO: 100034

SEQ ID NO: 266425 - RNA, 64 nt, Human; identical to SEQ ID NO: 100035

SEQ ID NO: 266426 - RNA, 64 nt, Human; identical to SEQ ID NO: 100036

SEQ ID NO: 266427 - RNA, 64 nt, Human; identical to SEQ ID NO: 100037

SEQ ID NO: 266428 - RNA, 64 nt, Human; identical to SEQ ID NO: 100038

SEQ ID NO: 266429 - RNA, 64 nt, Human; identical to SEQ ID NO: 100039

SEQ ID NO: 266430 - RNA, 64 nt, Human; identical to SEQ ID NO: 100040

SEQ ID NO: 266431 - RNA, 64 nt, Human; identical to SEQ ID NO: 100041

SEQ ID NO: 266432 - RNA, 64 nt, Human; identical to SEQ ID NO: 100042

SEQ ID NO: 266433 - RNA, 64 nt, Human; identical to SEQ ID NO: 100043

SEQ ID NO: 266434 - RNA, 62 nt, Human
uuucccaggaggaggaggccccugaaggggugcggcagcaggggggugggaagggaggguaa

SEQ ID NO: 266435 - RNA, 62 nt, Human
gucucgugcccagaugaaaccauuuggaaacucggcagcagaguuuguccaaaugacccuuu

SEQ ID NO: 266436 - RNA, 62 nt, Human
gugcacaggugcccaggcuccaaggacagcuccggcagcagguccucgcugggcagaugcug

SEQ ID NO: 266437 - RNA, 64 nt, Human; identical to SEQ ID NO: 100044

SEQ ID NO: 266438 - RNA, 64 nt, Human; identical to SEQ ID NO: 100045

SEQ ID NO: 266439 - RNA, 64 nt, Human; identical to SEQ ID NO: 100046

SEQ ID NO: 266440 - RNA, 64 nt, Human; identical to SEQ ID NO: 100047

SEQ ID NO: 266441 - RNA, 64 nt, Human; identical to SEQ ID NO: 100048

SEQ ID NO: 266442 - RNA, 64 nt, Human; identical to SEQ ID NO: 100049

SEQ ID NO: 266443 - RNA, 64 nt, Human; identical to SEQ ID NO: 100050

SEQ ID NO: 266444 - RNA, 64 nt, Human; identical to SEQ ID NO: 100051

SEQ ID NO: 266445 - RNA, 64 nt, Human; identical to SEQ ID NO: 100052

SEQ ID NO: 266446 - RNA, 64 nt, Human; identical to SEQ ID NO: 100053

SEQ ID NO: 266447 - RNA, 64 nt, Human; identical to SEQ ID NO: 100054

SEQ ID NO: 266448 - RNA, 64 nt, Human; identical to SEQ ID NO: 100055

SEQ ID NO: 266449 - RNA, 64 nt, Human; identical to SEQ ID NO: 100056

SEQ ID NO: 266450 - RNA, 64 nt, Human; identical to SEQ ID NO: 100057

SEQ ID NO: 266451 - RNA, 62 nt, Human
uuagcugcaguaucaauguggcauaaauacugcggcagcauucuucgaaaaccgcauuuuca

SEQ ID NO: 266452 - RNA, 62 nt, Human
ugaggaacgcuucagccuuagcugcuaccuuucggcagcagugaaauacaagcugcagccuc

SEQ ID NO: 266453 - RNA, 62 nt, Human
gcaguucuuuguucaagcguuccucuggggaccggcagcagaggcaccguguucucucagcc

SEQ ID NO: 266454 - RNA, 64 nt, Human; identical to SEQ ID NO: 100058

SEQ ID NO: 266455 - RNA, 64 nt, Human; identical to SEQ ID NO: 100059

SEQ ID NO: 266456 - RNA, 64 nt, Human; identical to SEQ ID NO: 100060

SEQ ID NO: 266457 - RNA, 64 nt, Human; identical to SEQ ID NO: 100061

SEQ ID NO: 266458 - RNA, 64 nt, Human; identical to SEQ ID NO: 100062

SEQ ID NO: 266459 - RNA, 64 nt, Human; identical to SEQ ID NO: 100063

SEQ ID NO: 266460 - RNA, 64 nt, Human; identical to SEQ ID NO: 100064

SEQ ID NO: 266461 - RNA, 64 nt, Human; identical to SEQ ID NO: 100065

SEQ ID NO: 266462 - RNA, 64 nt, Human; identical to SEQ ID NO: 100066

SEQ ID NO: 266463 - RNA, 64 nt, Human; identical to SEQ ID NO: 100067

SEQ ID NO: 266464 - RNA, 64 nt, Human; identical to SEQ ID NO: 100068

SEQ ID NO: 266465 - RNA, 64 nt, Human; identical to SEQ ID NO: 100069

SEQ ID NO: 266466 - RNA, 64 nt, Human; identical to SEQ ID NO: 100070

SEQ ID NO: 266467 - RNA, 64 nt, Human; identical to SEQ ID NO: 100071

SEQ ID NO: 266468 - RNA, 62 nt, Human
ucuugcaccauuaaauaguguguuaagugcuacggcagcaaauugcuacaugugcuggauau

SEQ ID NO: 266469 - RNA, 62 nt, Human
gugucucugaacugcgccaucaacuccagucucggcagcagcuccgcucccggcgccaccca

SEQ ID NO: 266470 - RNA, 62 nt, Human
guuucuagagucuuccagcugcaucuucaugccggcagcauuuuggauuuugugcaaucaug

SEQ ID NO: 266471 - RNA, 64 nt, Human; identical to SEQ ID NO: 100072

SEQ ID NO: 266472 - RNA, 64 nt, Human; identical to SEQ ID NO: 100073

SEQ ID NO: 266473 - RNA, 64 nt, Human; identical to SEQ ID NO: 100074

SEQ ID NO: 266474 - RNA, 64 nt, Human; identical to SEQ ID NO: 100075

SEQ ID NO: 266475 - RNA, 64 nt, Human; identical to SEQ ID NO: 100076

SEQ ID NO: 266476 - RNA, 64 nt, Human; identical to SEQ ID NO: 100077

SEQ ID NO: 266477 - RNA, 58 nt, Human; identical to SEQ ID NO: 100078

SEQ ID NO: 266478 - RNA, 64 nt, Human; identical to SEQ ID NO: 100079

SEQ ID NO: 266479 - RNA, 64 nt, Human; identical to SEQ ID NO: 100080

SEQ ID NO: 266480 - RNA, 64 nt, Human; identical to SEQ ID NO: 100081

SEQ ID NO: 266481 - RNA, 64 nt, Human; identical to SEQ ID NO: 100082

SEQ ID NO: 266482 - RNA, 64 nt, Human; identical to SEQ ID NO: 100083

SEQ ID NO: 266483 - RNA, 64 nt, Human; identical to SEQ ID NO: 100084

SEQ ID NO: 266484 - RNA, 64 nt, Human; identical to SEQ ID NO: 100085

SEQ ID NO: 266485 - RNA, 62 nt, Human
ggagcauguaccccagguacauccaugaacugcggcagcaguuugacuuauugcuguuucag

SEQ ID NO: 266486 - RNA, 62 nt, Human
gugauguggaugagugaagggagccagguacacggcagcagggcagaggagacuauggggag

SEQ ID NO: 266487 - RNA, 62 nt, Human
gaguccauguggagagagcacugugugcgcagcggcagcagcacagacguccaugaggaaaa

SEQ ID NO: 266488 - RNA, 64 nt, Human; identical to SEQ ID NO: 100086

SEQ ID NO: 266489 - RNA, 64 nt, Human; identical to SEQ ID NO: 100087

SEQ ID NO: 266490 - RNA, 64 nt, Human; identical to SEQ ID NO: 100088

SEQ ID NO: 266491 - RNA, 64 nt, Human; identical to SEQ ID NO: 100089

SEQ ID NO: 266492 - RNA, 64 nt, Human; identical to SEQ ID NO: 100090

SEQ ID NO: 266493 - RNA, 64 nt, Human; identical to SEQ ID NO: 100091

SEQ ID NO: 266494 - RNA, 64 nt, Human; identical to SEQ ID NO: 100092

SEQ ID NO: 266495 - RNA, 64 nt, Human; identical to SEQ ID NO: 100093

SEQ ID NO: 266496 - RNA, 64 nt, Human; identical to SEQ ID NO: 100094

SEQ ID NO: 266497 - RNA, 64 nt, Human; identical to SEQ ID NO: 100095

SEQ ID NO: 266498 - RNA, 64 nt, Human; identical to SEQ ID NO: 100096

SEQ ID NO: 266499 - RNA, 64 nt, Human; identical to SEQ ID NO: 100097

SEQ ID NO: 266500 - RNA, 64 nt, Human; identical to SEQ ID NO: 100098

SEQ ID NO: 266501 - RNA, 64 nt, Human; identical to SEQ ID NO: 100099

SEQ ID NO: 266502 - RNA, 62 nt, Human
cugucuauauccuuguuacucagagcauggcccggcagcaguguugucacagggcagcuugu

SEQ ID NO: 266503 - RNA, 62 nt, Human
aggaggguguaauggagcaucaagccacucggcggcagcauggagcuauaacuaagcauccu

SEQ ID NO: 266504 - RNA, 62 nt, Human
cggcagccaacucgaaagcaggcgguugugugcggcagcaguuggcguuugcuuugcacuuc

SEQ ID NO: 266505 - RNA, 64 nt, Human; identical to SEQ ID NO: 100100

SEQ ID NO: 266506 - RNA, 64 nt, Human; identical to SEQ ID NO: 100101

SEQ ID NO: 266507 - RNA, 64 nt, Human; identical to SEQ ID NO: 100102

SEQ ID NO: 266508 - RNA, 64 nt, Human; identical to SEQ ID NO: 100103

SEQ ID NO: 266509 - RNA, 64 nt, Human; identical to SEQ ID NO: 100104

SEQ ID NO: 266510 - RNA, 61 nt, Human; identical to SEQ ID NO: 100105

SEQ ID NO: 266511 - RNA, 64 nt, Human; identical to SEQ ID NO: 100106

SEQ ID NO: 266512 - RNA, 64 nt, Human; identical to SEQ ID NO: 100107

SEQ ID NO: 266513 - RNA, 64 nt, Human; identical to SEQ ID NO: 100108

SEQ ID NO: 266514 - RNA, 64 nt, Human; identical to SEQ ID NO: 100109

SEQ ID NO: 266515 - RNA, 64 nt, Human; identical to SEQ ID NO: 100110

SEQ ID NO: 266516 - RNA, 64 nt, Human; identical to SEQ ID NO: 100111

SEQ ID NO: 266517 - RNA, 64 nt, Human; identical to SEQ ID NO: 100112

SEQ ID NO: 266518 - RNA, 64 nt, Human; identical to SEQ ID NO: 100113

SEQ ID NO: 266519 - RNA, 62 nt, Human
ggagcuccguggaacuggagcuagagcggugccggcagcaagcaggccuccuggugaccgga

SEQ ID NO: 266520 - RNA, 62 nt, Human
gcuguggccuuggucuacaggugucugacuuccggcagcagcugcuggccugugccggggug

SEQ ID NO: 266521 - RNA, 64 nt, Human; identical to SEQ ID NO: 100114

SEQ ID NO: 266522 - RNA, 64 nt, Human; identical to SEQ ID NO: 100115

SEQ ID NO: 266523 - RNA, 64 nt, Human; identical to SEQ ID NO: 100116

SEQ ID NO: 266524 - RNA, 64 nt, Human; identical to SEQ ID NO: 100117

SEQ ID NO: 266525 - RNA, 64 nt, Human; identical to SEQ ID NO: 100118

SEQ ID NO: 266526 - RNA, 64 nt, Human; identical to SEQ ID NO: 100119

SEQ ID NO: 266527 - RNA, 64 nt, Human; identical to SEQ ID NO: 100120

SEQ ID NO: 266528 - RNA, 64 nt, Human; identical to SEQ ID NO: 100121

SEQ ID NO: 266529 - RNA, 64 nt, Human; identical to SEQ ID NO: 100122

SEQ ID NO: 266530 - RNA, 64 nt, Human; identical to SEQ ID NO: 100123

SEQ ID NO: 266531 - RNA, 64 nt, Human; identical to SEQ ID NO: 100124

SEQ ID NO: 266532 - RNA, 64 nt, Human; identical to SEQ ID NO: 100125

SEQ ID NO: 266533 - RNA, 64 nt, Human; identical to SEQ ID NO: 100126

SEQ ID NO: 266534 - RNA, 64 nt, Human; identical to SEQ ID NO: 100127

SEQ ID NO: 266535 - RNA, 62 nt, Human
accacuacuaucauucacuagcucauaucugccggcagcaauugaagagauccaauauuuga

SEQ ID NO: 266536 - RNA, 62 nt, Human
acugaagaggucuguacagugacaacccgggccggcagcaaggacacagaugcagccacagu

SEQ ID NO: 266537 - RNA, 62 nt, Human
ucccagggaaugaaugguggucuccccacucccggcagcacuuuaggcagcccauaagcuau

SEQ ID NO: 266538 - RNA, 64 nt, Human; identical to SEQ ID NO: 100128

SEQ ID NO: 266539 - RNA, 51 nt, Human; identical to SEQ ID NO: 100129

SEQ ID NO: 266540 - RNA, 64 nt, Human; identical to SEQ ID NO: 100130

SEQ ID NO: 266541 - RNA, 64 nt, Human; identical to SEQ ID NO: 100131

SEQ ID NO: 266542 - RNA, 64 nt, Human; identical to SEQ ID NO: 100132

SEQ ID NO: 266543 - RNA, 64 nt, Human; identical to SEQ ID NO: 100133

SEQ ID NO: 266544 - RNA, 64 nt, Human; identical to SEQ ID NO: 100134

SEQ ID NO: 266545 - RNA, 64 nt, Human; identical to SEQ ID NO: 100135

SEQ ID NO: 266546 - RNA, 64 nt, Human; identical to SEQ ID NO: 100136

SEQ ID NO: 266547 - RNA, 64 nt, Human; identical to SEQ ID NO: 100137

SEQ ID NO: 266548 - RNA, 64 nt, Human; identical to SEQ ID NO: 100138

SEQ ID NO: 266549 - RNA, 64 nt, Human; identical to SEQ ID NO: 100139

SEQ ID NO: 266550 - RNA, 64 nt, Human; identical to SEQ ID NO: 100140

SEQ ID NO: 266551 - RNA, 64 nt, Human; identical to SEQ ID NO: 100141

SEQ ID NO: 266552 - RNA, 64 nt, Human
ugauuuuagguuccaggaacuuccugagaacacccgaucgcagaggguaauuuucuggaguuug

SEQ ID NO: 266553 - RNA, 64 nt, Human
gcaauaaguuaucaugaaaaguuuuuagauuacacgaucgcauaugcugcauuucacguuuuau

SEQ ID NO: 266554 - RNA, 64 nt, Human
gugaaugucuguauuaucaggaaacaugucuauacgaucgcagaguuguauuuccucacaaacu

SEQ ID NO: 266555 - RNA, 64 nt, Human; identical to SEQ ID NO: 100142

SEQ ID NO: 266556 - RNA, 64 nt, Human; identical to SEQ ID NO: 100143

SEQ ID NO: 266557 - RNA, 64 nt, Human; identical to SEQ ID NO: 100144

SEQ ID NO: 266558 - RNA, 64 nt, Human; identical to SEQ ID NO: 100145

SEQ ID NO: 266559 - RNA, 64 nt, Human; identical to SEQ ID NO: 100146

SEQ ID NO: 266560 - RNA, 64 nt, Human; identical to SEQ ID NO: 100147

SEQ ID NO: 266561 - RNA, 64 nt, Human; identical to SEQ ID NO: 100148

SEQ ID NO: 266562 - RNA, 64 nt, Human; identical to SEQ ID NO: 100149

SEQ ID NO: 266563 - RNA, 64 nt, Human; identical to SEQ ID NO: 100150

SEQ ID NO: 266564 - RNA, 64 nt, Human; identical to SEQ ID NO: 100151

SEQ ID NO: 266565 - RNA, 64 nt, Human; identical to SEQ ID NO: 100152

SEQ ID NO: 266566 - RNA, 64 nt, Human; identical to SEQ ID NO: 100153

SEQ ID NO: 266567 - RNA, 64 nt, Human; identical to SEQ ID NO: 100154

SEQ ID NO: 266568 - RNA, 64 nt, Human; identical to SEQ ID NO: 100155

SEQ ID NO: 266569 - RNA, 64 nt, Human
gccaguucuacugaaaaccacaugcaucuugaugcgaucgcacuuucugaagaaggaaggaucc

SEQ ID NO: 266570 - RNA, 64 nt, Human; identical to SEQ ID NO: 100156

SEQ ID NO: 266571 - RNA, 64 nt, Human; identical to SEQ ID NO: 100157

SEQ ID NO: 266572 - RNA, 64 nt, Human; identical to SEQ ID NO: 100158

SEQ ID NO: 266573 - RNA, 64 nt, Human; identical to SEQ ID NO: 100159

SEQ ID NO: 266574 - RNA, 64 nt, Human; identical to SEQ ID NO: 100160

SEQ ID NO: 266575 - RNA, 64 nt, Human; identical to SEQ ID NO: 100161

SEQ ID NO: 266576 - RNA, 64 nt, Human; identical to SEQ ID NO: 100162

SEQ ID NO: 266577 - RNA, 64 nt, Human; identical to SEQ ID NO: 100163

SEQ ID NO: 266578 - RNA, 64 nt, Human; identical to SEQ ID NO: 100164

SEQ ID NO: 266579 - RNA, 64 nt, Human; identical to SEQ ID NO: 100165

SEQ ID NO: 266580 - RNA, 64 nt, Human; identical to SEQ ID NO: 100166

SEQ ID NO: 266581 - RNA, 64 nt, Human; identical to SEQ ID NO: 100167

SEQ ID NO: 266582 - RNA, 64 nt, Human; identical to SEQ ID NO: 100168

SEQ ID NO: 266583 - RNA, 64 nt, Human; identical to SEQ ID NO: 100169

SEQ ID NO: 266584 - RNA, 62 nt, Human
aggacgcagcguccagggccagcgagcucccccggcagcagguccccaagccaugucaggca

SEQ ID NO: 266585 - RNA, 62 nt, Human
caccuucgcuuugcaucucgguagaggagaaacggcagcacagcccaaggaccaaaggaggg

SEQ ID NO: 266586 - RNA, 62 nt, Human
gcaucuguuaacagaggagaacgucuggguggcggcagcagcuuugcucugagugccuacaa

SEQ ID NO: 266587 - RNA, 64 nt, Human; identical to SEQ ID NO: 100170

SEQ ID NO: 266588 - RNA, 64 nt, Human; identical to SEQ ID NO: 100171

SEQ ID NO: 266589 - RNA, 64 nt, Human; identical to SEQ ID NO: 100172

SEQ ID NO: 266590 - RNA, 64 nt, Human; identical to SEQ ID NO: 100173

SEQ ID NO: 266591 - RNA, 64 nt, Human; identical to SEQ ID NO: 100174

SEQ ID NO: 266592 - RNA, 64 nt, Human; identical to SEQ ID NO: 100175

SEQ ID NO: 266593 - RNA, 64 nt, Human; identical to SEQ ID NO: 100176

SEQ ID NO: 266594 - RNA, 64 nt, Human; identical to SEQ ID NO: 100177

SEQ ID NO: 266595 - RNA, 64 nt, Human; identical to SEQ ID NO: 100178

SEQ ID NO: 266596 - RNA, 64 nt, Human; identical to SEQ ID NO: 100179

SEQ ID NO: 266597 - RNA, 64 nt, Human; identical to SEQ ID NO: 100180

SEQ ID NO: 266598 - RNA, 64 nt, Human; identical to SEQ ID NO: 100181

SEQ ID NO: 266599 - RNA, 64 nt, Human; identical to SEQ ID NO: 100182

SEQ ID NO: 266600 - RNA, 64 nt, Human; identical to SEQ ID NO: 100183

SEQ ID NO: 266601 - RNA, 63 nt, Human
ugcugcacucaccggcuucuucucacucucugucguagacacaccgauaggaccaauggccaa

SEQ ID NO: 266602 - RNA, 64 nt, Human
uugacaaauaugcaugccuaggugacuaccacuccgaucgcaauagauaacauugccaucgccc

SEQ ID NO: 266603 - RNA, 62 nt, Human
gacggacguguagcccuggcgaggccagccggcggcagcacagccugucuccaaucagcaag

SEQ ID NO: 266604 - RNA, 64 nt, Human; identical to SEQ ID NO: 100184

SEQ ID NO: 266605 - RNA, 64 nt, Human; identical to SEQ ID NO: 100185

SEQ ID NO: 266606 - RNA, 64 nt, Human; identical to SEQ ID NO: 100186

SEQ ID NO: 266607 - RNA, 64 nt, Human; identical to SEQ ID NO: 100187

SEQ ID NO: 266608 - RNA, 64 nt, Human; identical to SEQ ID NO: 100188

SEQ ID NO: 266609 - RNA, 64 nt, Human; identical to SEQ ID NO: 100189

SEQ ID NO: 266610 - RNA, 64 nt, Human; identical to SEQ ID NO: 100190

SEQ ID NO: 266611 - RNA, 64 nt, Human; identical to SEQ ID NO: 100191

SEQ ID NO: 266612 - RNA, 64 nt, Human; identical to SEQ ID NO: 100192

SEQ ID NO: 266613 - RNA, 59 nt, Human; identical to SEQ ID NO: 100193

SEQ ID NO: 266614 - RNA, 64 nt, Human; identical to SEQ ID NO: 100194

SEQ ID NO: 266615 - RNA, 64 nt, Human; identical to SEQ ID NO: 100195

SEQ ID NO: 266616 - RNA, 64 nt, Human; identical to SEQ ID NO: 100196

SEQ ID NO: 266617 - RNA, 60 nt, Human; identical to SEQ ID NO: 100197

SEQ ID NO: 266618 - RNA, 63 nt, Human
cccguacuccuugccaccggcuuccuagagcagcguagacagcugguaaacugaagagcacaa

SEQ ID NO: 266619 - RNA, 62 nt, Human
cucaggcagcaagacaaucuuucacucacugacggcagcagccaugucucucaaagugguga

SEQ ID NO: 266620 - RNA, 64 nt, Human; identical to SEQ ID NO: 100198

SEQ ID NO: 266621 - RNA, 64 nt, Human; identical to SEQ ID NO: 100199

SEQ ID NO: 266622 - RNA, 64 nt, Human; identical to SEQ ID NO: 100200

SEQ ID NO: 266623 - RNA, 64 nt, Human; identical to SEQ ID NO: 100201

SEQ ID NO: 266624 - RNA, 64 nt, Human; identical to SEQ ID NO: 100202

SEQ ID NO: 266625 - RNA, 64 nt, Human; identical to SEQ ID NO: 100203

SEQ ID NO: 266626 - RNA, 64 nt, Human; identical to SEQ ID NO: 100204

SEQ ID NO: 266627 - RNA, 64 nt, Human; identical to SEQ ID NO: 100205

SEQ ID NO: 266628 - RNA, 64 nt, Human; identical to SEQ ID NO: 100206

SEQ ID NO: 266629 - RNA, 64 nt, Human; identical to SEQ ID NO: 100207

SEQ ID NO: 266630 - RNA, 64 nt, Human; identical to SEQ ID NO: 100208

SEQ ID NO: 266631 - RNA, 64 nt, Human; identical to SEQ ID NO: 100209

SEQ ID NO: 266632 - RNA, 64 nt, Human; identical to SEQ ID NO: 100210

SEQ ID NO: 266633 - RNA, 64 nt, Human; identical to SEQ ID NO: 100211

SEQ ID NO: 266634 - RNA, 62 nt, Human
uggggaaggggguuaguagacuauguggauugcggcagcagaggcugcagccuaacgugugg

SEQ ID NO: 266635 - RNA, 62 nt, Human
auuuacucagaaaaaaugucccuuacaggaaccggcagcagcuaggcagucaccggcccgcc

SEQ ID NO: 266636 - RNA, 62 nt, Human
gcugucugcugaugaacggcccaucugcacagcggcagcaaggauuaccccaagggcaggaa

SEQ ID NO: 266637 - RNA, 64 nt, Human; identical to SEQ ID NO: 100212

SEQ ID NO: 266638 - RNA, 64 nt, Human; identical to SEQ ID NO: 100213

SEQ ID NO: 266639 - RNA, 64 nt, Human; identical to SEQ ID NO: 100214

SEQ ID NO: 266640 - RNA, 64 nt, Human; identical to SEQ ID NO: 100215

SEQ ID NO: 266641 - RNA, 64 nt, Human; identical to SEQ ID NO: 100216

SEQ ID NO: 266642 - RNA, 64 nt, Human; identical to SEQ ID NO: 100217

SEQ ID NO: 266643 - RNA, 64 nt, Human; identical to SEQ ID NO: 100218

SEQ ID NO: 266644 - RNA, 64 nt, Human; identical to SEQ ID NO: 100219

SEQ ID NO: 266645 - RNA, 64 nt, Human; identical to SEQ ID NO: 100220

SEQ ID NO: 266646 - RNA, 64 nt, Human; identical to SEQ ID NO: 100221

SEQ ID NO: 266647 - RNA, 64 nt, Human; identical to SEQ ID NO: 100222

SEQ ID NO: 266648 - RNA, 64 nt, Human; identical to SEQ ID NO: 100223

SEQ ID NO: 266649 - RNA, 64 nt, Human; identical to SEQ ID NO: 100224

SEQ ID NO: 266650 - RNA, 64 nt, Human; identical to SEQ ID NO: 100225

SEQ ID NO: 266651 - RNA, 63 nt, Human
uuguauaauaaagcuuucagguguuacagaaaucguagacaagcaagugcacaugauaaacau

SEQ ID NO: 266652 - RNA, 62 nt, Human
gaggguccccuccuccuucccuacuccugggacggcagcaaggacaugggggcugcuguuag

SEQ ID NO: 266653 - RNA, 62 nt, Human
aagcaggggacggaaagagagagacacucaggcggcagcauucccucccagccacugagcug

SEQ ID NO: 266654 - RNA, 64 nt, Human; identical to SEQ ID NO: 100226

SEQ ID NO: 266655 - RNA, 64 nt, Human; identical to SEQ ID NO: 100227

SEQ ID NO: 266656 - RNA, 64 nt, Human; identical to SEQ ID NO: 100228

SEQ ID NO: 266657 - RNA, 64 nt, Human; identical to SEQ ID NO: 100229

SEQ ID NO: 266658 - RNA, 64 nt, Human; identical to SEQ ID NO: 100230

SEQ ID NO: 266659 - RNA, 64 nt, Human; identical to SEQ ID NO: 100231

SEQ ID NO: 266660 - RNA, 64 nt, Human; identical to SEQ ID NO: 100232

SEQ ID NO: 266661 - RNA, 64 nt, Human; identical to SEQ ID NO: 100233

SEQ ID NO: 266662 - RNA, 64 nt, Human; identical to SEQ ID NO: 100234

SEQ ID NO: 266663 - RNA, 64 nt, Human; identical to SEQ ID NO: 100235

SEQ ID NO: 266664 - RNA, 64 nt, Human; identical to SEQ ID NO: 100236

SEQ ID NO: 266665 - RNA, 64 nt, Human; identical to SEQ ID NO: 100237

SEQ ID NO: 266666 - RNA, 64 nt, Human; identical to SEQ ID NO: 100238

SEQ ID NO: 266667 - RNA, 64 nt, Human; identical to SEQ ID NO: 100239

SEQ ID NO: 266668 - RNA, 63 nt, Human
agcaacugccuggauguguuugauuuuuuaaagcguagacauauauuuaugaaugugcauuuc

SEQ ID NO: 266669 - RNA, 62 nt, Human
ugcugaggagaaaggaggggcaguggcuuccccggcagcagccccaugauggcugaauccga

SEQ ID NO: 266670 - RNA, 62 nt, Human
ggcuccuugugccagagaacccagcccacccccggcagcagcccccagcucccaccuccccu

SEQ ID NO: 266671 - RNA, 64 nt, Human; identical to SEQ ID NO: 100240

SEQ ID NO: 266672 - RNA, 64 nt, Human; identical to SEQ ID NO: 100241

SEQ ID NO: 266673 - RNA, 64 nt, Human; identical to SEQ ID NO: 100242

SEQ ID NO: 266674 - RNA, 64 nt, Human; identical to SEQ ID NO: 100243

SEQ ID NO: 266675 - RNA, 64 nt, Human; identical to SEQ ID NO: 100244

SEQ ID NO: 266676 - RNA, 64 nt, Human; identical to SEQ ID NO: 100245

SEQ ID NO: 266677 - RNA, 64 nt, Human; identical to SEQ ID NO: 100246

SEQ ID NO: 266678 - RNA, 64 nt, Human; identical to SEQ ID NO: 100247

SEQ ID NO: 266679 - RNA, 64 nt, Human; identical to SEQ ID NO: 100248

SEQ ID NO: 266680 - RNA, 64 nt, Human; identical to SEQ ID NO: 100249

SEQ ID NO: 266681 - RNA, 64 nt, Human; identical to SEQ ID NO: 100250

SEQ ID NO: 266682 - RNA, 61 nt, Human; identical to SEQ ID NO: 100251

SEQ ID NO: 266683 - RNA, 64 nt, Human; identical to SEQ ID NO: 100252

SEQ ID NO: 266684 - RNA, 64 nt, Human; identical to SEQ ID NO: 100253

SEQ ID NO: 266685 - RNA, 62 nt, Human
ccugcccaguguuucugggccucacggugcuccggcagcagagcgcauggugcuagccaugg

SEQ ID NO: 266686 - RNA, 62 nt, Human
guccagaccccacaacuucaggagcucuuucccggcagcagagaucugcaggcugccucuuc

SEQ ID NO: 266687 - RNA, 62 nt, Human
uacuaaaauguaaaaaauuaaugugcucaccucggcagcacauauacuaaaaauuaauaaga

SEQ ID NO: 266688 - RNA, 64 nt, Human; identical to SEQ ID NO: 100254

SEQ ID NO: 266689 - RNA, 64 nt, Human; identical to SEQ ID NO: 100255

SEQ ID NO: 266690 - RNA, 64 nt, Human; identical to SEQ ID NO: 100256

SEQ ID NO: 266691 - RNA, 64 nt, Human; identical to SEQ ID NO: 100257

SEQ ID NO: 266692 - RNA, 64 nt, Human; identical to SEQ ID NO: 100258

SEQ ID NO: 266693 - RNA, 64 nt, Human; identical to SEQ ID NO: 100259

SEQ ID NO: 266694 - RNA, 64 nt, Human; identical to SEQ ID NO: 100260

SEQ ID NO: 266695 - RNA, 64 nt, Human; identical to SEQ ID NO: 100261

SEQ ID NO: 266696 - RNA, 64 nt, Human; identical to SEQ ID NO: 100262

SEQ ID NO: 266697 - RNA, 64 nt, Human; identical to SEQ ID NO: 100263

SEQ ID NO: 266698 - RNA, 64 nt, Human; identical to SEQ ID NO: 100264

SEQ ID NO: 266699 - RNA, 64 nt, Human; identical to SEQ ID NO: 100265

SEQ ID NO: 266700 - RNA, 64 nt, Human; identical to SEQ ID NO: 100266

SEQ ID NO: 266701 - RNA, 64 nt, Human; identical to SEQ ID NO: 100267

SEQ ID NO: 266702 - RNA, 64 nt, Human
cugcuucccaacuccucuauccaagacugugcccacauccgaagcacaaggaccucaagucacc

SEQ ID NO: 266703 - RNA, 62 nt, Human
caucuugguucugccauccucuugccuuccuacggcagcagcuguucauggcacugaagaug

SEQ ID NO: 266704 - RNA, 62 nt, Human
ccuggcaugacuccaugaauuugucuccagaacggcagcaggaaagucuuuuuuguuucccc

SEQ ID NO: 266705 - RNA, 64 nt, Human; identical to SEQ ID NO: 100268

SEQ ID NO: 266706 - RNA, 64 nt, Human; identical to SEQ ID NO: 100269

SEQ ID NO: 266707 - RNA, 64 nt, Human; identical to SEQ ID NO: 100270

SEQ ID NO: 266708 - RNA, 64 nt, Human; identical to SEQ ID NO: 100271

SEQ ID NO: 266709 - RNA, 64 nt, Human; identical to SEQ ID NO: 100272

SEQ ID NO: 266710 - RNA, 59 nt, Human; identical to SEQ ID NO: 100273

SEQ ID NO: 266711 - RNA, 64 nt, Human; identical to SEQ ID NO: 100274

SEQ ID NO: 266712 - RNA, 64 nt, Human; identical to SEQ ID NO: 100275

SEQ ID NO: 266713 - RNA, 64 nt, Human; identical to SEQ ID NO: 100276

SEQ ID NO: 266714 - RNA, 64 nt, Human; identical to SEQ ID NO: 100277

SEQ ID NO: 266715 - RNA, 64 nt, Human; identical to SEQ ID NO: 100278

SEQ ID NO: 266716 - RNA, 64 nt, Human; identical to SEQ ID NO: 100279

SEQ ID NO: 266717 - RNA, 64 nt, Human; identical to SEQ ID NO: 100280

SEQ ID NO: 266718 - RNA, 64 nt, Human; identical to SEQ ID NO: 100281

SEQ ID NO: 266719 - RNA, 63 nt, Human
uucaaaauuuugauucggaagacuaagucuggacguagacauuauaaugcuaucaaagaaguu

SEQ ID NO: 266720 - RNA, 62 nt, Human
caucagcugcauacuuacuaccagcuaggucgcggcagcagugauggauuuauaguuccucc

SEQ ID NO: 266721 - RNA, 62 nt, Human
gugcccucugggugggguggccuccccgcacucggcagcauggccaggcuggccagggcgug

SEQ ID NO: 266722 - RNA, 64 nt, Human; identical to SEQ ID NO: 100282

SEQ ID NO: 266723 - RNA, 64 nt, Human; identical to SEQ ID NO: 100283

SEQ ID NO: 266724 - RNA, 64 nt, Human; identical to SEQ ID NO: 100284

SEQ ID NO: 266725 - RNA, 64 nt, Human; identical to SEQ ID NO: 100285

SEQ ID NO: 266726 - RNA, 55 nt, Human; identical to SEQ ID NO: 100286

SEQ ID NO: 266727 - RNA, 64 nt, Human; identical to SEQ ID NO: 100287

SEQ ID NO: 266728 - RNA, 64 nt, Human; identical to SEQ ID NO: 100288

SEQ ID NO: 266729 - RNA, 64 nt, Human; identical to SEQ ID NO: 100289

SEQ ID NO: 266730 - RNA, 64 nt, Human; identical to SEQ ID NO: 100290

SEQ ID NO: 266731 - RNA, 64 nt, Human; identical to SEQ ID NO: 100291

SEQ ID NO: 266732 - RNA, 64 nt, Human; identical to SEQ ID NO: 100292

SEQ ID NO: 266733 - RNA, 64 nt, Human; identical to SEQ ID NO: 100293

SEQ ID NO: 266734 - RNA, 64 nt, Human; identical to SEQ ID NO: 100294

SEQ ID NO: 266735 - RNA, 64 nt, Human; identical to SEQ ID NO: 100295

SEQ ID NO: 266736 - RNA, 64 nt, Human
caggagcccuugggggacgugaggggagccucucacauccgauuucuccuccugccccagccuc

SEQ ID NO: 266737 - RNA, 64 nt, Human
ggcuguucuagccacagugguagauuuaugauucacauccgaaagugugccuuaguuaucaauu

SEQ ID NO: 266738 - RNA, 64 nt, Human
gaccucagugucuacuuucugccuguugcucgauacauccgagcugcccucaguguuccccaag

SEQ ID NO: 266739 - RNA, 64 nt, Human; identical to SEQ ID NO: 100296

SEQ ID NO: 266740 - RNA, 64 nt, Human; identical to SEQ ID NO: 100297

SEQ ID NO: 266741 - RNA, 64 nt, Human; identical to SEQ ID NO: 100298

SEQ ID NO: 266742 - RNA, 64 nt, Human; identical to SEQ ID NO: 100299

SEQ ID NO: 266743 - RNA, 64 nt, Human; identical to SEQ ID NO: 100300

SEQ ID NO: 266744 - RNA, 64 nt, Human; identical to SEQ ID NO: 100301

SEQ ID NO: 266745 - RNA, 64 nt, Human; identical to SEQ ID NO: 100302

SEQ ID NO: 266746 - RNA, 64 nt, Human; identical to SEQ ID NO: 100303

SEQ ID NO: 266747 - RNA, 64 nt, Human; identical to SEQ ID NO: 100304

SEQ ID NO: 266748 - RNA, 64 nt, Human; identical to SEQ ID NO: 100305

SEQ ID NO: 266749 - RNA, 64 nt, Human; identical to SEQ ID NO: 100306

SEQ ID NO: 266750 - RNA, 64 nt, Human; identical to SEQ ID NO: 100307

SEQ ID NO: 266751 - RNA, 64 nt, Human; identical to SEQ ID NO: 100308

SEQ ID NO: 266752 - RNA, 64 nt, Human; identical to SEQ ID NO: 100309

SEQ ID NO: 266753 - RNA, 62 nt, Human
ugucagcaugcagagggauccaggaauccccccggcagcacggcccgcuuuccuucuccucc

SEQ ID NO: 266754 - RNA, 62 nt, Human
gagaaagccagccccgccugcuuagucagccccggcagcagggcagccaugggaacucagga

SEQ ID NO: 266755 - RNA, 62 nt, Human
aaaggggcacugcacgagcaccugccagccaucggcagcaagcgacacacacucaccuuccu

SEQ ID NO: 266756 - RNA, 64 nt, Human; identical to SEQ ID NO: 100310

SEQ ID NO: 266757 - RNA, 64 nt, Human; identical to SEQ ID NO: 100311

SEQ ID NO: 266758 - RNA, 64 nt, Human; identical to SEQ ID NO: 100312

SEQ ID NO: 266759 - RNA, 64 nt, Human; identical to SEQ ID NO: 100313

SEQ ID NO: 266760 - RNA, 64 nt, Human; identical to SEQ ID NO: 100314

SEQ ID NO: 266761 - RNA, 64 nt, Human; identical to SEQ ID NO: 100315

SEQ ID NO: 266762 - RNA, 64 nt, Human; identical to SEQ ID NO: 100316

SEQ ID NO: 266763 - RNA, 64 nt, Human; identical to SEQ ID NO: 100317

SEQ ID NO: 266764 - RNA, 64 nt, Human; identical to SEQ ID NO: 100318

SEQ ID NO: 266765 - RNA, 64 nt, Human; identical to SEQ ID NO: 100319

SEQ ID NO: 266766 - RNA, 64 nt, Human; identical to SEQ ID NO: 100320

SEQ ID NO: 266767 - RNA, 64 nt, Human; identical to SEQ ID NO: 100321

SEQ ID NO: 266768 - RNA, 64 nt, Human; identical to SEQ ID NO: 100322

SEQ ID NO: 266769 - RNA, 64 nt, Human; identical to SEQ ID NO: 100323

SEQ ID NO: 266770 - RNA, 64 nt, Human
uacagcggcuccuaccagacaaucaagaucugggacauccgaacccuugacugcauccacgucc

SEQ ID NO: 266771 - RNA, 64 nt, Human
cugccauuuguucacuuuuuaaacuaaaauaggaacauccgacacacaccguuugcaucgucuu

SEQ ID NO: 266772 - RNA, 64 nt, Human
aagcugacucaucggagagggaaauaccaaauaaacauccgagguugcauuuauuuauuuauuu

SEQ ID NO: 266773 - RNA, 54 nt, Human; identical to SEQ ID NO: 100324

SEQ ID NO: 266774 - RNA, 50 nt, Human; identical to SEQ ID NO: 100325

SEQ ID NO: 266775 - RNA, 64 nt, Human; identical to SEQ ID NO: 100326

SEQ ID NO: 266776 - RNA, 64 nt, Human; identical to SEQ ID NO: 100327

SEQ ID NO: 266777 - RNA, 64 nt, Human; identical to SEQ ID NO: 100328

SEQ ID NO: 266778 - RNA, 64 nt, Human; identical to SEQ ID NO: 100329

SEQ ID NO: 266779 - RNA, 64 nt, Human; identical to SEQ ID NO: 100330

SEQ ID NO: 266780 - RNA, 64 nt, Human; identical to SEQ ID NO: 100331

SEQ ID NO: 266781 - RNA, 64 nt, Human; identical to SEQ ID NO: 100332

SEQ ID NO: 266782 - RNA, 64 nt, Human; identical to SEQ ID NO: 100333

SEQ ID NO: 266783 - RNA, 64 nt, Human; identical to SEQ ID NO: 100334

SEQ ID NO: 266784 - RNA, 64 nt, Human; identical to SEQ ID NO: 100335

SEQ ID NO: 266785 - RNA, 64 nt, Human; identical to SEQ ID NO: 100336

SEQ ID NO: 266786 - RNA, 64 nt, Human; identical to SEQ ID NO: 100337

SEQ ID NO: 266787 - RNA, 62 nt, Human
cccgagccgucccagaaaccaaagggcaggcacggcagcaaacgccugagguaauuuucauc

SEQ ID NO: 266788 - RNA, 52 nt, Human
auaacuacaagccauacugaggcggcagcaggagcgaccaacugaucgcaca

SEQ ID NO: 266789 - RNA, 62 nt, Human
cuccuggauuauagccugcacaaggagaggaccggcagcaaucgauuugccaagguuggauu

SEQ ID NO: 266790 - RNA, 64 nt, Human; identical to SEQ ID NO: 100338

SEQ ID NO: 266791 - RNA, 64 nt, Human; identical to SEQ ID NO: 100339

SEQ ID NO: 266792 - RNA, 64 nt, Human; identical to SEQ ID NO: 100340

SEQ ID NO: 266793 - RNA, 64 nt, Human; identical to SEQ ID NO: 100341

SEQ ID NO: 266794 - RNA, 64 nt, Human; identical to SEQ ID NO: 100342

SEQ ID NO: 266795 - RNA, 64 nt, Human; identical to SEQ ID NO: 100343

SEQ ID NO: 266796 - RNA, 64 nt, Human; identical to SEQ ID NO: 100344

SEQ ID NO: 266797 - RNA, 64 nt, Human; identical to SEQ ID NO: 100345

SEQ ID NO: 266798 - RNA, 64 nt, Human; identical to SEQ ID NO: 100346

SEQ ID NO: 266799 - RNA, 64 nt, Human; identical to SEQ ID NO: 100347

SEQ ID NO: 266800 - RNA, 64 nt, Human; identical to SEQ ID NO: 100348

SEQ ID NO: 266801 - RNA, 64 nt, Human; identical to SEQ ID NO: 100349

SEQ ID NO: 266802 - RNA, 64 nt, Human; identical to SEQ ID NO: 100350

SEQ ID NO: 266803 - RNA, 64 nt, Human
cucuguauaaagaguauguagcaacaacuguuuaacauccgagaugaaguggaccugaugcugu

SEQ ID NO: 266804 - RNA, 64 nt, Human
guguuaauuuaacucuauguuguccgccguguagacauccgaggucauuuguugcguugaauua

SEQ ID NO: 266805 - RNA, 64 nt, Human
aaucgaaauugacaucacucagcuguuacauuucacauccgauucagcccccuuuuauuuccau

SEQ ID NO: 266806 - RNA, 60 nt, Human
gccugggaaacugugaaagucagaaaggccagcggggagaggcuggggcgaggggaggag

SEQ ID NO: 266807 - RNA, 60 nt, Human
guguuccugugaggacgcuggaccugcaggagcggggagcugcagugccaccugcugggu

SEQ ID NO: 266808 - RNA, 60 nt, Human
uuaaaucacccacugaggugacagcucauuagcggggagagagauggagcaucgagugac

SEQ ID NO: 266809 - RNA, 60 nt, Human
aggcuccacgggagcggggcugcuggagagagcggggaacucccaccacaguggggcauc

SEQ ID NO: 266810 - RNA, 60 nt, Human
gccugaaaaccauccaucuguggaaaugacagcggggaagguuuuuaugugccuuuuugu

SEQ ID NO: 266811 - RNA, 60 nt, Human
cuuaguccgcaaguucagggaagcaggcagagcggggaggugccugagcuggggccugga

SEQ ID NO: 266812 - RNA, 60 nt, Human
gaaggucagggugccgcugggggagcagggagcggggagggaggaagaggggaaugcaca

SEQ ID NO: 266813 - RNA, 60 nt, Human
auuuagcacuuuuuucuauuuaaaggaacaagcggggaagggugcuaaaagauaauacgu

SEQ ID NO: 266814 - RNA, 60 nt, Human
ccugaugcugcugccaugguggcuuggggcagcggggagaaaggaguguccuugaggccu

SEQ ID NO: 266815 - RNA, 60 nt, Human
uuuuuuauaaaugaucuuggucuauuggggagcggggauaguuaauauuccaguacacug

SEQ ID NO: 266816 - RNA, 60 nt, Human
agcccaacuccaaguuccuuucccccagaaagcggggagaagccagaguucuuggcucag

SEQ ID NO: 266817 - RNA, 64 nt, Human
gagaaucccugaccccugcccugggccuuaacacacauccgacgaaugaaugaaggguugccuc

SEQ ID NO: 266818 - RNA, 64 nt, Human
cagcaaaucucagucccugacuaacagccucagcacauccgacaccucccagcgugggacccca

SEQ ID NO: 266819 - RNA, 63 nt, Human
ucagcuucuuccugggagagagccccccuuucacguagacacaccuggcugccuucuucacgc

SEQ ID NO: 266820 - RNA, 60 nt, Human
gcucucaugauccaccugccccgggagggcagcggggaagacagagaaaagcaaacgcau

SEQ ID NO: 266821 - RNA, 60 nt, Human
gggacucagcgccuucggguggcggcgguaagcggggaggaaacauggcgccgcccaaau

SEQ ID NO: 266822 - RNA, 60 nt, Human
uucaaaaaacccuugcuuuuaggggagggaagcggggaaggaaaggaaugagggaggaaa

SEQ ID NO: 266823 - RNA, 60 nt, Human
cucuggaccuguguagggccucacugcuggagcggggaaaccgcagcucagcccaggccc

SEQ ID NO: 266824 - RNA, 60 nt, Human
gccuucggacauagggacccaguucccaggagcggggagguaggguuggggcuggggcau

SEQ ID NO: 266825 - RNA, 60 nt, Human
ccagggagaggggagccagagccggugggaagcggggaggggcugcguggcacagcuagu

SEQ ID NO: 266826 - RNA, 60 nt, Human
uccugauuccucuuccuucuuuagaggagaagcggggaguggguuaacuaacagcuuuau

SEQ ID NO: 266827 - RNA, 60 nt, Human
agugaaagaaugagcuagcaaaugaguuuuagcggggacaaaaaaucaaacaaaaaagug

SEQ ID NO: 266828 - RNA, 60 nt, Human
ggcuaaacaaaagcuugaacuugccacuucagcggggagaugagaggcaggugcacugag

SEQ ID NO: 266829 - RNA, 60 nt, Human
aaauuuuaagccaaaaacaaacgaaaggaaagcggggaggggaaaacagacccucccacu

SEQ ID NO: 266830 - RNA, 60 nt, Human
gcucccucucaccacccucuucugccuaugagcggggaacaaaaaggccagaugacaggu

SEQ ID NO: 266831 - RNA, 60 nt, Human
cuccccauugucaggcucuccauguccacgagcggggagggguggguucuggggcauugu

SEQ ID NO: 266832 - RNA, 60 nt, Human
ggacugauguuuccuucuccgaggggcuggagcggggaucugaugaaaaggucagacuga

SEQ ID NO: 266833 - RNA, 60 nt, Human
aguaaagcuuuauaaauuauauuaaaaggaagcggggaacauguauuuuuuaacauagaa

SEQ ID NO: 266834 - RNA, 60 nt, Human
uggguuagaggauugcagaagacgagcgggagcggggagggcagggaagaugccugucgg

SEQ ID NO: 266835 - RNA, 60 nt, Human
aguuuccucauaagcacuguggacaaaaaaagcggggaagacagcaagauuuauuggaag

SEQ ID NO: 266836 - RNA, 62 nt, Human
gacugcuccuggugagccugugcauagggaagcggcagcaucggaugucagcccccugcggc

SEQ ID NO: 266837 - RNA, 62 nt, Human
gucuguccuauggggagcaguuugggggcggccggcagcaggagccugggaaagaggcccuc

SEQ ID NO: 266838 - RNA, 62 nt, Human
aacgacagugccuuggaaaggcaggcuccaugcggcagcaacaggauugucuucgguaccuu

SEQ ID NO: 266839 - RNA, 62 nt, Human
caacugcugcacccccacaggacauggccgugcggcagcaccugcucacuaaccugguagag

SEQ ID NO: 266840 - RNA, 60 nt, Human
aaaacaaauacgucaacaccuaugaaaagaagcggggaaaacaacaacaaggacaacaac

SEQ ID NO: 266841 - RNA, 60 nt, Human
gugcagagcggaucggacgggacaggguggagcggggaggccugugcaaagugggaaaga

SEQ ID NO: 266842 - RNA, 60 nt, Human
cgggaggugcucgugcuggcccugggugggagcggggaguccuggugagaccccggugag

SEQ ID NO: 266843 - RNA, 60 nt, Human
ccccgccgcaccacgcgggccggcggccggagcggggaagggcgcgggcgcgggcgcgga

SEQ ID NO: 266844 - RNA, 60 nt, Human
ugccccaguuguggggaggucucugugcacagcggggaaaaugcuugugucgccuuuggu

SEQ ID NO: 266845 - RNA, 60 nt, Human
auauguugccuucauccuagcugcuggggaagcggggagaggggucagggaggcuaaugg

SEQ ID NO: 266846 - RNA, 60 nt, Human
gcuuuccgccggcucacagcaguuggggccagcggggagaagagaggcggaacugcugug

SEQ ID NO: 266847 - RNA, 60 nt, Human
caccaacgccauuuacccuaauuuaagaacagcggggacugacccuccgugccgagggcu

SEQ ID NO: 266848 - RNA, 60 nt, Human
uucauuaauaaugugugcaaguuuccuauuagcggggaagguguggggcucugcugggcu

SEQ ID NO: 266849 - RNA, 60 nt, Human
agccuagguucugggcucagguccagaugcagcggggauucuguucucugacuguggcga

SEQ ID NO: 266850 - RNA, 60 nt, Human
auggaagauguugggagagagcuggggcagagcggggagcugcagcacagcaacagugau

SEQ ID NO: 266851 - RNA, 60 nt, Human
caccgcagaacaccgaaguaauuccagcauagcggggaagauguugaccaagguggagaa

SEQ ID NO: 266852 - RNA, 60 nt, Human
aucuucaaccuugucuacuggcauaagugcagcggggaucucuacucaaaugugucaggg

SEQ ID NO: 266853 - RNA, 60 nt, Human
ugucggaaccaggacacaaaagcagcaagaagcggggagagagagggauagaaaacaagc

SEQ ID NO: 266854 - RNA, 60 nt, Human
guucacuuacucuuacacccgacgcuuaccagcggggacaccaauggcugcaucaaaugc

SEQ ID NO: 266855 - RNA, 60 nt, Human
caggguuauuuccccccagggaguggggcaagcggggaaguugggaugagugcguguggg

SEQ ID NO: 266856 - RNA, 64 nt, Human
cuuucaggcccuugagggaaagcuacuugaucaaacauccgauagucacaaauuugaaaccgug

SEQ ID NO: 266857 - RNA, 63 nt, Human
guuuauuuuucccugcugugcccagaacauuggcguagacacaguaagaaccuaguaaauauu

SEQ ID NO: 266858 - RNA, 63 nt, Human
auaggcaaaaaggauugaauccauaccagaacacguagacaggcuguaauauucaaaccaccu

SEQ ID NO: 266859 - RNA, 63 nt, Human
gugccuucccuucucuggucuccuugagaugaucguagacacagggaugauucccacccaaac

SEQ ID NO: 266860 - RNA, 60 nt, Human
acuaccugcguccguggaagccucugccucagcggggacggccuccugcugcagguccug

SEQ ID NO: 266861 - RNA, 60 nt, Human
caccggacgggugguccggagggaggcuggagcggggaggcgaggagggggcugugaguc

SEQ ID NO: 266862 - RNA, 60 nt, Human
aggcagacaguaccucugugucuaugagaaagcggggagagcaacaccccagcuucuagc

SEQ ID NO: 266863 - RNA, 60 nt, Human
aggauaguggugggaacagacaaauaaggaagcggggaggacuggauaauugguuuuccc

SEQ ID NO: 266864 - RNA, 60 nt, Human
caaaugaaaagucuugauggcauggacuggagcggggacaguggggauggagaaagggga

SEQ ID NO: 266865 - RNA, 60 nt, Human
agagauggaggccugcccagacuaggaggcagcggggauagacagggaauggggagaaga

SEQ ID NO: 266866 - RNA, 60 nt, Human
gcacugagccauguuccuaugucagguggcagcggggaagcgaggguccaauccugcccu

SEQ ID NO: 266867 - RNA, 60 nt, Human
aauuccuuuaaaaaggugcacuacaguuuuagcggggagggggauaggaagacgcagagc

SEQ ID NO: 266868 - RNA, 60 nt, Human
aucuauugcaaaaccugaaggacuguaguuagcggggaugauguuaaguguggccaagcg

SEQ ID NO: 266869 - RNA, 60 nt, Human
acuguuaagccauguguuccaaggcauuuuagcggggaggggguuaucaaaaaaaaaaaa

SEQ ID NO: 266870 - RNA, 60 nt, Human
cuccacuguccgggacagcguucgcccuuuagcggggaggucauuacagccucauggccu

SEQ ID NO: 266871 - RNA, 60 nt, Human
caggccaggucgcccugcgcuaccagcugcagcggggagugguggugcuggccaagagcu

SEQ ID NO: 266872 - RNA, 60 nt, Human
aaagcaccauuuggaggguuuugcugacacagcggggacugcucagcacucccuaaaaac

SEQ ID NO: 266873 - RNA, 60 nt, Human
acgucauccaggcugucaacaccagccccgagcggggaggcgaggaggcccugcaugccu

SEQ ID NO: 266874 - RNA, 60 nt, Human
ggcugugaggcccucagggcagggauacaaagcggggagaggguacacaauggguaucua

SEQ ID NO: 266875 - RNA, 60 nt, Human
ugugugggggccccaggaauccuuagcugaagcggggagacucacucuccaucucaggaa

SEQ ID NO: 266876 - RNA, 63 nt, Human
aaaaaaaaauuccuaaaacuguggaauggaucacguagacauguaacccagcagcaguuugcu

SEQ ID NO: 266877 - RNA, 63 nt, Human
uccacacuuguccuaagccaagguagauuuguacguagacagacuggugagcaagcauuauau

SEQ ID NO: 266878 - RNA, 63 nt, Human
gugaucucugggaguuauaggucaugggaagagcguagacagguguuacuuacagucccagau

SEQ ID NO: 266879 - RNA, 63 nt, Human
gcgugcccucugcccagguggcacugccaggugcguagacagacggugucacgagccauuucc

SEQ ID NO: 266880 - RNA, 60 nt, Human
ugugaagggaggcccgcggcgguggagccgagcggggagccaggaaagaagaguuggagu

SEQ ID NO: 266881 - RNA, 60 nt, Human
ccacccccuucaagaggcgccauagacccuagcggggagggcaggggagggacggaaggc

SEQ ID NO: 266882 - RNA, 60 nt, Human
uuuucgguguuagauucaacacugcgcuaaagcggggauguuccauugaauaaaagagca

SEQ ID NO: 266883 - RNA, 60 nt, Human
gugguucuggcuaggcucucauguccagacagcggggaccaggggaaaacccagccccuu

SEQ ID NO: 266884 - RNA, 60 nt, Human
ccagcauguuccuugaagcccaucgccucuagcggggacccuccuuuccuccccauccca

SEQ ID NO: 266885 - RNA, 60 nt, Human
aucagagggcuggcaguagggaguuccaggagcggggacuucucgggaaaauccuauaac

SEQ ID NO: 266886 - RNA, 60 nt, Human
agcagcuccagguagggggccauguuucccagcggggacccaccaacagaggccaguuuc

SEQ ID NO: 266887 - RNA, 60 nt, Human
cucuugauggaucacguaaaacugaaaggcagcggggagcagacaaagaugaggucuaca

SEQ ID NO: 266888 - RNA, 60 nt, Human
acacaugaagcuggcuggguguaaggcaguagcggggagcggcaugcugucuaacagcug

SEQ ID NO: 266889 - RNA, 60 nt, Human
agguuugcuugugaaaugaggcugggugggagcggggagggacuagaucagaagagauca

SEQ ID NO: 266890 - RNA, 60 nt, Human
aaaaauaaauaaauacauaaaaagcaaacaagcggggacaccugcagucuuagucacuga

SEQ ID NO: 266891 - RNA, 60 nt, Human
auucucuucauggccagguggcugccagggagcggggagcuuccuggaggcuucccaggg

SEQ ID NO: 266892 - RNA, 60 nt, Human
gagcaguucuacaaaagaauggccagcacgagcggggacuagaggguccugauuuugugu

SEQ ID NO: 266893 - RNA, 60 nt, Human
uagagagauauauuugugggggccggggggagcggggaggggguggagugaagcucaggg

SEQ ID NO: 266894 - RNA, 60 nt, Human
ggccuggccugucgcucucacuugucuuccagcggggagcuucacguugccgaguggaag

SEQ ID NO: 266895 - RNA, 60 nt, Human
auacacauuggaaggcucccuaacacacacagcggggaagcugggccgaguaccuuaauc

SEQ ID NO: 266896 - RNA, 63 nt, Human
ugaaauuggcugaauaauuacuccucugccuggcguagacaugcgcuuugggaaaaaaacgag

SEQ ID NO: 266897 - RNA, 63 nt, Human
ugugguugcauucagaauauuugaaguuucuuacguagacagaaauaauaaaaauauuaacua

SEQ ID NO: 266898 - RNA, 63 nt, Human
gugaauuggaggcacucugcuaaaagacauccccguagacauaggggagagaguugcuggcug

SEQ ID NO: 266899 - RNA, 63 nt, Human
acuauaccucuaaaaccaauuguaccgacaucacguagacaaaaacuccagauaaauccauug

SEQ ID NO: 266900 - RNA, 60 nt, Human
caggcacaaaccauggguccagggagucucagcggggaacuucuaucaguaucaauaacc

SEQ ID NO: 266901 - RNA, 60 nt, Human
guccaggacagcaggugcuggccgguggggagcggggaggggcacugagaugggcagggc

SEQ ID NO: 266902 - RNA, 60 nt, Human
gcgcucccuggcggcuucgcccgggcuccuagcggggaaaaggaaggggauaacucagag

SEQ ID NO: 266903 - RNA, 60 nt, Human
gaaguugauauagaacagugcuugccacagagcggggacucgguaagcacuuaaugaaug

SEQ ID NO: 266904 - RNA, 60 nt, Human
gacuggauaguaacagguggucugguggauagcggggagcauggcucagcaccagagcag

SEQ ID NO: 266905 - RNA, 60 nt, Human
guguauguauuucugcugagugauaaagccagcggggagggacugauuuuuauaggaaag

SEQ ID NO: 266906 - RNA, 60 nt, Human
agauuuuaguuccucauuuugcagaugaaaagcggggaaaaaaaaaaaaaaaaaaaaaac

SEQ ID NO: 266907 - RNA, 60 nt, Human
acacgagagcacacucgaucccccuaggccagcggggacaccccagccacacagggaggc

SEQ ID NO: 266908 - RNA, 60 nt, Human
uggcucuugcuguauccucacuuccuguggagcggggauuggcucugagaaggaguguuc

SEQ ID NO: 266909 - RNA, 60 nt, Human
ccuaagauacagacccccccaacuccccaaagcggggaggagauauuuauuuuggggaga

SEQ ID NO: 266910 - RNA, 60 nt, Human
gcucacauaucugucauuugagcagggcucagcggggacagcuccuucuguccuacucug

SEQ ID NO: 266911 - RNA, 55 nt, Human
cuucccacuucuauuccugaggugcagcggggaggagcagaugagcugggcaggg

SEQ ID NO: 266912 - RNA, 60 nt, Human
ccugugagcacaucgcccccugcuggcgacagcggggaaaugagggcugaaaauauccuc

SEQ ID NO: 266913 - RNA, 60 nt, Human
ucaucugaacuucagauauuucacaugugaagcggggacaaaaccaugcagcucagaggu

SEQ ID NO: 266914 - RNA, 60 nt, Human
auggaccgcgccaucccagggcuggggaggagcggggagggcggaucucccuggccagca

SEQ ID NO: 266915 - RNA, 60 nt, Human
aucagugccuggaaggcaggugugcccgucagcggggaguggaacucaucaggcuugcca

SEQ ID NO: 266916 - RNA, 64 nt, Human
agggaggggauaaagaggaagcaauaaaaaaaaaacauccgacagagcagcucuggcuuugcag

SEQ ID NO: 266917 - RNA, 63 nt, Human
cuuaacacaauaacuucuagaaaaugugugugccguagacacaaagaagggaacaauagacac

SEQ ID NO: 266918 - RNA, 63 nt, Human
guguucuacaccugcaugagugaaggauuuccacguagacaccuaggaagagcccgcaugccc

SEQ ID NO: 266919 - RNA, 63 nt, Human
uacuaaagauauaaguuguuccauggguguacacguagacagacacacauacacccaaauuau

SEQ ID NO: 266920 - RNA, 60 nt, Human
ugggggugauuucugugacucugggcccacagcggggaggccaagaggggcccuguggac

SEQ ID NO: 266921 - RNA, 60 nt, Human
cguggggccccaucuuuuguguuuuccucaagcggggaaagaauggacuguuugcaugcu

SEQ ID NO: 266922 - RNA, 60 nt, Human
gccugggaccagaccuggccaaggucagccagcggggagggccgaggucugagcucucgu

SEQ ID NO: 266923 - RNA, 60 nt, Human
gccccaggaugauugaccaugguguucaggagcggggagcacugaugaggugcuggggau

SEQ ID NO: 266924 - RNA, 60 nt, Human
agguguugccaaugcugcgguucgugcagaagcggggaaacucaacgguguacgagugga

SEQ ID NO: 266925 - RNA, 60 nt, Human
ggcuggaccuggaccuggaccuggaccuacagcggggacuuaaaugccuucuuauccaau

SEQ ID NO: 266926 - RNA, 60 nt, Human
aucuucgcaauuuugagugcuccuguggggagcggggaugagcuaaagauacaauguuuc

SEQ ID NO: 266927 - RNA, 60 nt, Human
accaagcacugcccugggcccaugggauagagcggggaaggugauggcucuuccagagga

SEQ ID NO: 266928 - RNA, 60 nt, Human
ccugcccaccggcccccggcagugcaguccagcggggaggaggcugcccguuccugccag

SEQ ID NO: 266929 - RNA, 60 nt, Human
uucugcugaccucagauaccagccuuccccagcggggacgggugcuucuggagcuggucc

SEQ ID NO: 266930 - RNA, 60 nt, Human
uguguguuaagcucugcuauuaggccagcaagcggggaugucccugggagggacaugcuu

SEQ ID NO: 266931 - RNA, 60 nt, Human
ggggguggggcugggacgcuguuugugcucagcggggacagccaggguugaucuggcccc

SEQ ID NO: 266932 - RNA, 60 nt, Human
cccggugggaauccgagcggcucccucgggagcggggacugcuggaacagcggcuauucu

SEQ ID NO: 266933 - RNA, 60 nt, Human
gaagagggggucauggauggcugagcagagagcggggaaaaugcaggcugaguggggcga

SEQ ID NO: 266934 - RNA, 60 nt, Human
ccguggauuucagggacacauaccgccuccagcggggagcacgggugcugccuuccgugc

SEQ ID NO: 266935 - RNA, 60 nt, Human
ccccuucucuccugggcagccacaccacagagcggggaggggcaggugggggaauggagg

SEQ ID NO: 266936 - RNA, 62 nt, Human
aggccauagcugcuccagccggggcuccggggcggcagcagagcuggcacaccgauucuggg

SEQ ID NO: 266937 - RNA, 62 nt, Human
aagaaagaacggagugaagccauuuaugccuacggcagcagaaagagaugaaaucuugagag

SEQ ID NO: 266938 - RNA, 62 nt, Human
uuauaacaaucauaacuaacauuuacugugcccggcagcaaauuaaguauuugacaaacauu

SEQ ID NO: 266939 - RNA, 62 nt, Human
cggcccagacguccagggagccggccccuccccggcagcaggccggggcggagcaggagcgg

SEQ ID NO: 266940 - RNA, 60 nt, Human
gcggcccacacacuggacugaccugcccugagcggggaugcaguguugcacugaugacuu

SEQ ID NO: 266941 - RNA, 60 nt, Human
guucaguggaggccaccaggagcauccaugagcggggaagggguccacacccuuacaugg

SEQ ID NO: 266942 - RNA, 60 nt, Human
augucccgcgucucugcaccuucgggugggagcggggacugaucuacuuucacauucuca

SEQ ID NO: 266943 - RNA, 60 nt, Human
gugacugcccggucagaucagcuggaucucagcggggagccacgucucuugcacuguggu

SEQ ID NO: 266944 - RNA, 60 nt, Human
uccgccagagcuuuuccacugauuguacucagcggggaggcaggggaggcagaggggcag

SEQ ID NO: 266945 - RNA, 60 nt, Human
accacaugaacuggacugagagggggaagaagcggggaggaagaaaucccgccccaaacg

SEQ ID NO: 266946 - RNA, 60 nt, Human
aagugauccuccugccucagcuucccaaguagcggggaucacaggcaugagccgccacac

SEQ ID NO: 266947 - RNA, 60 nt, Human
uucuggagagaaaaccaucugucguggcugagcggggagcuugaacacccaggccaggga

SEQ ID NO: 266948 - RNA, 60 nt, Human
aguuugaaccccccccacucugcagagggaagcggggacaaugccgggguuucaggcagg

SEQ ID NO: 266949 - RNA, 60 nt, Human
gaugccucgucuugcauagggucuuggggcagcggggaagggguucugaagaacucuggc

SEQ ID NO: 266950 - RNA, 60 nt, Human
gccagucguguccgaacucuccaaugacuaagcggggagaugcggacauccuagcuccuu

SEQ ID NO: 266951 - RNA, 60 nt, Human
guucugagcgggucauggggcaacacgguuagcggggagagcacgggguagccggagaag

SEQ ID NO: 266952 - RNA, 60 nt, Human
uccugcuggccuggucugcccacgagcuagagcggggaaauguugagcucaaauggguaa

SEQ ID NO: 266953 - RNA, 60 nt, Human
aucuccccccuccuuccucugccccaccccagcggggagcagacugcuccuccaggcugu

SEQ ID NO: 266954 - RNA, 60 nt, Human
ccccauuucacccauggggagacaguugagagcggggaugugacaugcccaaggccacgg

SEQ ID NO: 266955 - RNA, 60 nt, Human
uguacuacacggugccauggagccggggagagcggggaagucucugcauccaugccaccc

SEQ ID NO: 266956 - RNA, 63 nt, Human
cuguaccccugggcagugcuaccugggcacacacguagacaagggcagcuauuccuuagacca

SEQ ID NO: 266957 - RNA, 63 nt, Human
gcuguuccgcuccuccuccagcuggcgcagcuucguagacacguugagcuucugccggguuuc

SEQ ID NO: 266958 - RNA, 63 nt, Human
gcugaagaccgcgguggaggagauccacaaugccguagacaggcugcucucgcugacccuucu

SEQ ID NO: 266959 - RNA, 56 nt, Human
cuggguuuuucgagugcugaccccagcguagacaguucagaccgcuaacuuacagg

SEQ ID NO: 266960 - RNA, 60 nt, Human
cccucaggcucucaggugaacguggccgucagcggggaaacgugugugucaguuggacca

SEQ ID NO: 266961 - RNA, 60 nt, Human
acauguguugaagacauugaugucauagggagcggggagcugcauucccuucugggcugu

SEQ ID NO: 266962 - RNA, 60 nt, Human
uccuggggcccuagaagccggggcggccccagcggggaggaggagcaaggacauguacca

SEQ ID NO: 266963 - RNA, 60 nt, Human
agcuugcuugugggcacuggcuuggacuuuagcggggagggaagccaggggauuuugaag

SEQ ID NO: 266964 - RNA, 60 nt, Human
uucuuggacacagacuauucugaggcacagagcggggacuuaagaugggaaagagaaagc

SEQ ID NO: 266965 - RNA, 60 nt, Human
cccugccagugcucgcccaucugagugucaagcggggauuucgcugucaaggaaccguuu

SEQ ID NO: 266966 - RNA, 60 nt, Human
aguauggugacuacgaccccaguguucacaagcggggauuuuuggcccaagaggaauugc

SEQ ID NO: 266967 - RNA, 60 nt, Human
gauggguucagcccuagagagagagagagaagcggggagaauaagagugcacuacagccc

SEQ ID NO: 266968 - RNA, 60 nt, Human
uucccggugggagcccucugucccacagggagcggggagccagcuuugcuggggcccuac

SEQ ID NO: 266969 - RNA, 60 nt, Human
cccaccauaggccucugcuaccugccagucagcggggaaguucaccagauuucggcugcu

SEQ ID NO: 266970 - RNA, 60 nt, Human
cugccagcagcagacauagacgggugcagaagcggggagcuccaggugcaggagggcacc

SEQ ID NO: 266971 - RNA, 60 nt, Human
uccacuuguguccacacaggcccugggaggagcggggacacugaggaccucucuccaaau

SEQ ID NO: 266972 - RNA, 60 nt, Human
ccgccccgcaggcagguacuucccggagcgagcggggaacgcgacguaccccagugcgcc

SEQ ID NO: 266973 - RNA, 60 nt, Human
gcuguguggaguggacacccugacccccgaagcggggagggccgcuguggccuucgucac

SEQ ID NO: 266974 - RNA, 60 nt, Human
gguuauguggaaguguguguggcagcaggcagcggggaggggaggaacagggaaggggga

SEQ ID NO: 266975 - RNA, 60 nt, Human
uccacccagccuuuucauuuucgauugcacagcggggaggaggaauggcuuuguggucgu

SEQ ID NO: 266976 - RNA, 63 nt, Human
ccauguccccauuacaccagagggccaucgugacguagacaggaugccaggggccuggccagc

SEQ ID NO: 266977 - RNA, 63 nt, Human
acuuuauuaaaaaccuaagguuuuuuuuuuuuccguagacaugaccacuuuauuaacuggugg

SEQ ID NO: 266978 - RNA, 63 nt, Human
cgcauugcagagcgggaggccaggaggacucgucguagacaagccagagaacaaaccgguaag

SEQ ID NO: 266979 - RNA, 63 nt, Human
ucauccugacugucucguuauugugaagucuuucguagacaccccagagcacacacauccccu

SEQ ID NO: 266980 - RNA, 64 nt, Human
cugaacuaagccauauuuaucacccguggacagcacauccgagucaagacuguuaauuucugac

SEQ ID NO: 266981 - RNA, 64 nt, Human
agacaugugagacuucccugccccaccccacaugacauccgaggaucugagauuuccguguuug

SEQ ID NO: 266982 - RNA, 64 nt, Human
aagcuaggggaauuaggccacaacacccccugggacauccgaaagcuacaccacagaugccagu

SEQ ID NO: 266983 - RNA, 64 nt, Human
gaugaccugaaauuuuacauccgaacaaaauuuuacauccgaaaagcaaccaacuucuucaugg

SEQ ID NO: 266984 - RNA, 64 nt, Human
uuuuggcauaauuuuuaugaugaccugaaauuuuacauccgaacaaaauuuuacauccgaaaag

SEQ ID NO: 266985 - RNA, 64 nt, Human
cuaucagaagccuuuacaauuacuuuuagcuguaacauccgauucuguauaagccacauagaaa

SEQ ID NO: 266986 - RNA, 64 nt, Human
ccauccauccucugacaaggaagaaggugaggccacauccgauucugaaucagagguuagugaa

SEQ ID NO: 266987 - RNA, 64 nt, Human
ggggugcagugggagauugggcuuuggaacagacacauccgacauaaaauuccugcucugccac

SEQ ID NO: 266988 - RNA, 58 nt, Human
accuuaacccaccuaaguaaauguggaaacauccgauauaaaucucauaguuaauggc

SEQ ID NO: 266989 - RNA, 64 nt, Human
ggagagaaagaacagaccagcgcccuucccgacuacauccgaaacuucacacaggguguuucug

SEQ ID NO: 266990 - RNA, 64 nt, Human
agcauucaaucaguguaacuugcaaaaugcauaaacauccgacaguuugaauuuauaguguuga

SEQ ID NO: 266991 - RNA, 64 nt, Human
ugaccaugugcagcuuucuuuuuuguuagaugccacauccgaagacucaucgcaguguguuaua

SEQ ID NO: 266992 - RNA, 64 nt, Human
ccccucguaccugucacugggaugcagacucucgacauccgaguccaagcgcaggccccucggg

SEQ ID NO: 266993 - RNA, 64 nt, Human
gacuccccucuuccucaaggguagaugagaggaacgagcacagagguuggcuguggguccuggg

SEQ ID NO: 266994 - RNA, 64 nt, Human
aggucugcagaaccauagcuuccacgcaccugaacgagcacagaaugaacugacgguggaagac

SEQ ID NO: 266995 - RNA, 64 nt, Human
uggugccaggaaagccacuggaauugucacacggcgagcacagagggccggccaccaguccucg

SEQ ID NO: 266996 - RNA, 64 nt, Human
aaaagcuggauuugauuuuuuuuuucuggucacucgagcacaucuaagaucacccauuagguuu

SEQ ID NO: 266997 - RNA, 64 nt, Human
acccgcuucccaccugcugcggucaccaugguggcgagcacagcaaccccagguguccagagca

SEQ ID NO: 266998 - RNA, 64 nt, Human
ucaggaugaaccuggaggcccaccucaaggagugcgagcacaucaaaugcccccacuccaagua

SEQ ID NO: 266999 - RNA, 64 nt, Human
gcuaaggccucgcugccagccuucugacggcgggcgagcacacggucucuuccccugccccaac

SEQ ID NO: 267000 - RNA, 64 nt, Human
gcggaaacgccgugcaucucuugucuguuggcagcgagcacaucgugcuggagacacgaguuuc

SEQ ID NO: 267001 - RNA, 64 nt, Human
auucccuuaacugacauuauuuagugucagaggccgagcacaguggcucccaccuauaauccua

SEQ ID NO: 267002 - RNA, 64 nt, Human
uguucugggaauguuucagcagccaauaagugcccgagcacacugcccccgguugccugccugg

SEQ ID NO: 267003 - RNA, 64 nt, Human
aaaugggagacuguuucucuggccucagaagaagcgagcacaggcugggguggaugacuuaugc

SEQ ID NO: 267004 - RNA, 64 nt, Human
cacuggcuuuugccuguaagaaaaaaaauguacccgagcacauagagcuuuuuaauagcacuaa

SEQ ID NO: 267005 - RNA, 64 nt, Human
caggcgaccagagcuggcuguacaggaauguccacgagcacagcaggugaucuugaggccuugc

SEQ ID NO: 267006 - RNA, 64 nt, Human
gccgggaccgggaucgugaccgugaccgugaccgcgagcacaaacggggggagcggggcaguga

SEQ ID NO: 267007 - RNA, 64 nt, Human
augugggaaacccuucauuuaccgccauucugcucgagcacaugaaaggaaucacacuguacag

SEQ ID NO: 267008 - RNA, 64 nt, Human
agagaaggaaaggaaagagacggggcucugaggccgagcacaguggcccaugccuauaauccca

SEQ ID NO: 267009 - RNA, 64 nt, Human
aauaagaucauguuuuaauugugagaaacagggccgagcacaguggcucacgccuguaauacca

SEQ ID NO: 267010 - RNA, 64 nt, Human
aguggaccaagcaccaguggcuucagcgguggaccgagcacaggagcuggcuucggcgguggac

SEQ ID NO: 267011 - RNA, 64 nt, Human
cugaagaaagaacuugaaccuauguuauaugauacgagcacaacuugagcuacaguaaacuaca

SEQ ID NO: 267012 - RNA, 64 nt, Human
gugccauaauuuggcaaaugcuggccuuuauggacgagcacaauucgggggucagaccugguuc

SEQ ID NO: 267013 - RNA, 64 nt, Human; identical to SEQ ID NO: 265770

SEQ ID NO: 267014 - RNA, 64 nt, Human; identical to SEQ ID NO: 265677

SEQ ID NO: 267015 - RNA, 64 nt, Human; identical to SEQ ID NO: 266126

SEQ ID NO: 267016 - RNA, 64 nt, Human; identical to SEQ ID NO: 266127

SEQ ID NO: 267017 - RNA, 64 nt, Human; identical to SEQ ID NO: 266128

SEQ ID NO: 267018 - RNA, 64 nt, Human; identical to SEQ ID NO: 266129

SEQ ID NO: 267019 - RNA, 64 nt, Human; identical to SEQ ID NO: 266146

SEQ ID NO: 267020 - RNA, 64 nt, Human; identical to SEQ ID NO: 265678

SEQ ID NO: 267021 - RNA, 64 nt, Human; identical to SEQ ID NO: 266147

SEQ ID NO: 267022 - RNA, 64 nt, Human; identical to SEQ ID NO: 266148

SEQ ID NO: 267023 - RNA, 64 nt, Human; identical to SEQ ID NO: 266014

SEQ ID NO: 267024 - RNA, 64 nt, Human; identical to SEQ ID NO: 265680

SEQ ID NO: 267025 - RNA, 64 nt, Human; identical to SEQ ID NO: 265712

SEQ ID NO: 267026 - RNA, 64 nt, Human; identical to SEQ ID NO: 265713

SEQ ID NO: 267027 - RNA, 64 nt, Human; identical to SEQ ID NO: 265714

SEQ ID NO: 267028 - RNA, 64 nt, Human; identical to SEQ ID NO: 265715

SEQ ID NO: 267029 - RNA, 64 nt, Human; identical to SEQ ID NO: 266015

SEQ ID NO: 267030 - RNA, 56 nt, Human; identical to SEQ ID NO: 266016

SEQ ID NO: 267031 - RNA, 64 nt, Human; identical to SEQ ID NO: 266017

SEQ ID NO: 267032 - RNA, 64 nt, Human; identical to SEQ ID NO: 265789

SEQ ID NO: 267033 - RNA, 64 nt, Human; identical to SEQ ID NO: 265790

SEQ ID NO: 267034 - RNA, 64 nt, Human; identical to SEQ ID NO: 265791

SEQ ID NO: 267035 - RNA, 64 nt, Human; identical to SEQ ID NO: 265807

SEQ ID NO: 267036 - RNA, 64 nt, Human; identical to SEQ ID NO: 265808

SEQ ID NO: 267037 - RNA, 64 nt, Human; identical to SEQ ID NO: 265809

SEQ ID NO: 267038 - RNA, 64 nt, Human; identical to SEQ ID NO: 265810

SEQ ID NO: 267039 - RNA, 64 nt, Human; identical to SEQ ID NO: 265826

SEQ ID NO: 267040 - RNA, 64 nt, Human; identical to SEQ ID NO: 265827

SEQ ID NO: 267041 - RNA, 64 nt, Human; identical to SEQ ID NO: 265828

SEQ ID NO: 267042 - RNA, 64 nt, Human; identical to SEQ ID NO: 265829

SEQ ID NO: 267043 - RNA, 64 nt, Human; identical to SEQ ID NO: 265846

SEQ ID NO: 267044 - RNA, 64 nt, Human; identical to SEQ ID NO: 265847

SEQ ID NO: 267045 - RNA, 64 nt, Human; identical to SEQ ID NO: 265848

SEQ ID NO: 267046 - RNA, 64 nt, Human; identical to SEQ ID NO: 265864

SEQ ID NO: 267047 - RNA, 64 nt, Human; identical to SEQ ID NO: 265865

SEQ ID NO: 267048 - RNA, 64 nt, Human; identical to SEQ ID NO: 265866

SEQ ID NO: 267049 - RNA, 64 nt, Human; identical to SEQ ID NO: 265867

SEQ ID NO: 267050 - RNA, 64 nt, Human; identical to SEQ ID NO: 265883

SEQ ID NO: 267051 - RNA, 64 nt, Human; identical to SEQ ID NO: 265884

SEQ ID NO: 267052 - RNA, 64 nt, Human; identical to SEQ ID NO: 265885

SEQ ID NO: 267053 - RNA, 64 nt, Human; identical to SEQ ID NO: 265886

SEQ ID NO: 267054 - RNA, 64 nt, Human; identical to SEQ ID NO: 266993

SEQ ID NO: 267055 - RNA, 64 nt, Human; identical to SEQ ID NO: 266994

SEQ ID NO: 267056 - RNA, 64 nt, Human; identical to SEQ ID NO: 266995

SEQ ID NO: 267057 - RNA, 64 nt, Human; identical to SEQ ID NO: 266996

SEQ ID NO: 267058 - RNA, 64 nt, Human; identical to SEQ ID NO: 266997

SEQ ID NO: 267059 - RNA, 64 nt, Human; identical to SEQ ID NO: 266998

SEQ ID NO: 267060 - RNA, 64 nt, Human; identical to SEQ ID NO: 266999

SEQ ID NO: 267061 - RNA, 64 nt, Human; identical to SEQ ID NO: 267000

SEQ ID NO: 267062 - RNA, 64 nt, Human; identical to SEQ ID NO: 267001

SEQ ID NO: 267063 - RNA, 64 nt, Human; identical to SEQ ID NO: 267002

SEQ ID NO: 267064 - RNA, 64 nt, Human; identical to SEQ ID NO: 267003

SEQ ID NO: 267065 - RNA, 64 nt, Human; identical to SEQ ID NO: 267004

SEQ ID NO: 267066 - RNA, 64 nt, Human; identical to SEQ ID NO: 267005

SEQ ID NO: 267067 - RNA, 64 nt, Human; identical to SEQ ID NO: 267006

SEQ ID NO: 267068 - RNA, 64 nt, Human; identical to SEQ ID NO: 267007

SEQ ID NO: 267069 - RNA, 64 nt, Human; identical to SEQ ID NO: 267008

SEQ ID NO: 267070 - RNA, 64 nt, Human; identical to SEQ ID NO: 267009

SEQ ID NO: 267071 - RNA, 64 nt, Human; identical to SEQ ID NO: 267010

SEQ ID NO: 267072 - RNA, 64 nt, Human; identical to SEQ ID NO: 267011

SEQ ID NO: 267073 - RNA, 64 nt, Human; identical to SEQ ID NO: 267012

SEQ ID NO: 267074 - RNA, 64 nt, Human
ugccucacagcuggccgucacuuguggggguccacgggacgauggcuuugccagcuuaaaguaa

SEQ ID NO: 267075 - RNA, 64 nt, Human
gcggaggaggaaagcgaggggguggggggcuucccgggacgauaaccuggcaguggaaggaaag

SEQ ID NO: 267076 - RNA, 64 nt, Human
uacagacuucuccagacccaccacaccgcagaagcgggacgagacccuacaggagagggaagag

SEQ ID NO: 267077 - RNA, 64 nt, Human
gcgacugaugaggucacgguucuuaaggcacauccgggacgaucgauauagcacuuaggcuaug

SEQ ID NO: 267078 - RNA, 64 nt, Human
gacucagggcuauccuguccugucuuggaucuugcgggacgaguuagucaccgcuguguguguu

SEQ ID NO: 267079 - RNA, 64 nt, Human
ggaauagucgcgcaagcaucccgcuggugccucccgggacgaaggacuucccgagcgguguggg

SEQ ID NO: 267080 - RNA, 64 nt, Human
ccgccuuggguaguugaccugccuuuucugacuccgggacgagccaguccuaggcugccuccgg

SEQ ID NO: 267081 - RNA, 64 nt, Human
cccuccaucuucauucauaggucugcgcuggggccgggacgaagcacuugguaacaggcacauc

SEQ ID NO: 267082 - RNA, 64 nt, Human
aaggcagacaguggcuggcaggggggcccaggcccgggacgaggccuccccuucagcucaggca

SEQ ID NO: 267083 - RNA, 64 nt, Human
gacaggagccuccaaguaugugggaggggacgggcgggacgagcuuggcuguucugcugcaccu

SEQ ID NO: 267084 - RNA, 64 nt, Human
cggaacacgauugucucagaugcagggcgcugugcgggacgaagccgcaaggacucucguaucg

SEQ ID NO: 267085 - RNA, 64 nt, Human
cugacguuguagaagcgaguggccucgaaggcuacgggacgaggguggcgggugaccaagugca

SEQ ID NO: 267086 - RNA, 64 nt, Human
aggcagggagggaggccaggccucgcuugcaccgcgggacgaggcugaccgggcuguucuguag

SEQ ID NO: 267087 - RNA, 64 nt, Human
cucuggacugucauaagcuagcacccgugguaagcgggacgagacaagcucccgaagcccgcca

SEQ ID NO: 267088 - RNA, 64 nt, Human
auuccuccaguagacaccccugcugugugcccagcgggacgacagccacagggccuguuucaag

SEQ ID NO: 267089 - RNA, 64 nt, Human; identical to SEQ ID NO: 267074

SEQ ID NO: 267090 - RNA, 64 nt, Human; identical to SEQ ID NO: 267075

SEQ ID NO: 267091 - RNA, 64 nt, Human; identical to SEQ ID NO: 267076

SEQ ID NO: 267092 - RNA, 64 nt, Human; identical to SEQ ID NO: 267077

SEQ ID NO: 267093 - RNA, 64 nt, Human; identical to SEQ ID NO: 267078

SEQ ID NO: 267094 - RNA, 64 nt, Human; identical to SEQ ID NO: 267079

SEQ ID NO: 267095 - RNA, 64 nt, Human; identical to SEQ ID NO: 267080

SEQ ID NO: 267096 - RNA, 64 nt, Human; identical to SEQ ID NO: 267081

SEQ ID NO: 267097 - RNA, 64 nt, Human; identical to SEQ ID NO: 267082

SEQ ID NO: 267098 - RNA, 64 nt, Human; identical to SEQ ID NO: 267083

SEQ ID NO: 267099 - RNA, 64 nt, Human; identical to SEQ ID NO: 267084

SEQ ID NO: 267100 - RNA, 64 nt, Human; identical to SEQ ID NO: 267085

SEQ ID NO: 267101 - RNA, 64 nt, Human; identical to SEQ ID NO: 267086

SEQ ID NO: 267102 - RNA, 64 nt, Human; identical to SEQ ID NO: 267087

SEQ ID NO: 267103 - RNA, 64 nt, Human; identical to SEQ ID NO: 267088

SEQ ID NO: 267104 - RNA, 64 nt, Human
ugugugauugucuucuguuaucauuugucuuacaggcggcuauugcagacggcuaauuuaugcu

SEQ ID NO: 267105 - RNA, 64 nt, Human
ugaagaaaccaacaaugacuaugaaacagcugacggcggcuacaugacucugaaccccagggca

SEQ ID NO: 267106 - RNA, 64 nt, Human
aaccccagagaccacuccuguggagagcugagggggcggcuaccguccccucugcaggcucauu

SEQ ID NO: 267107 - RNA, 64 nt, Human
cuaccaggugacugcugcugggugacuccccugaggcggcuauacccuuaagccagccccacua

SEQ ID NO: 267108 - RNA, 64 nt, Human
gcugcgggaaggcugccgcagcugaagcugaagaggcggcuacgugcgguuugucagggggauu

SEQ ID NO: 267109 - RNA, 64 nt, Human
cccgccuccauccccgccucuguccccuggccuuggcggcuauuuuugccaccugccuugggug

SEQ ID NO: 267110 - RNA, 64 nt, Human
gccuaaaaguuacuuaccacagacuguacggcaaggcggcuacaugccucagugaaggacuagu

SEQ ID NO: 267111 - RNA, 64 nt, Human
uuaaaauguuuacugauagauaauggauuuaaagggcggcuaauugauugucugccauuguuga

SEQ ID NO: 267112 - RNA, 64 nt, Human
acuguuggugaauuuagaguguccuuuuagguggggcggcuauucuaaaagugucuuucuauca

SEQ ID NO: 267113 - RNA, 64 nt, Human
gaggcugggagucccuaccugcuucacguuggccggcggcuacucuggaauguuuuucccuccc

SEQ ID NO: 267114 - RNA, 64 nt, Human
uaccagacacugcugcugccccgucggcaugugcggcggcuaccugagcugaccccugcugagc

SEQ ID NO: 267115 - RNA, 64 nt, Human
caccuuccgggagaccugaggaguguaacguggaggcggcuaccuccgugggugggagcccagg

SEQ ID NO: 267116 - RNA, 64 nt, Human
ugcuccuccagggccacgugccaggcccggggcuggcggcuacucagcagcccuccucaccccg

SEQ ID NO: 267117 - RNA, 64 nt, Human
uuuaucaacuauguuuuuucagucugacaaccaaggcggcuacuaagugacuaaggggcaggua

SEQ ID NO: 267118 - RNA, 64 nt, Human
ugaucgucgugguggcagaggaggcuaugaucgaggcggcuaccggggccgcggcggggaccgu

SEQ ID NO: 267119 - RNA, 64 nt, Human
ugggccuuuagcccuagaaccugcagguggugggggcggcuaccaagaaggaacagaggucucu

SEQ ID NO: 267120 - RNA, 64 nt, Human
ccgcacggcuggcagagggcaggcugcaugcaguggcggcuacugggcccugcccagccccgga

SEQ ID NO: 267121 - RNA, 64 nt, Human
uggggagcccaggccuggccucggggcagggcagggcggcuaggccggccagcucccccuugcc

SEQ ID NO: 267122 - RNA, 64 nt, Human
gagaggggccgaaccgugaagggcuggaggccccggcggcuaggaggaggccucggugguacca

SEQ ID NO: 267123 - RNA, 64 nt, Human
gagcugggcuccugggccuugguccccagaagauggcggcuagggccucgccgccaggacagag

SEQ ID NO: 267124 - RNA, 64 nt, Human
ggagggacccagugggagguaauuuaauccucggggcggcuaccuccgugcuguucucgugaua

SEQ ID NO: 267125 - RNA, 64 nt, Human
uccgcugaccggggagauggccuguguguacaagggcggcuacugggaggccaaggagaagcaa

SEQ ID NO: 267126 - RNA, 64 nt, Human
cacugaggugccgcugcuggagaugcgugcccccggcggcuacccgcuggaccggccacucucc

SEQ ID NO: 267127 - RNA, 64 nt, Human
cgcauccagaaagacgcacuccuggaccacaaccggcggcuaccucagccccacggcucugcag

SEQ ID NO: 267128 - RNA, 60 nt, Human
cuugugugucuggucacacuuuuuaggcgucacgccaaaggccagccuccuggccccaau

SEQ ID NO: 267129 - RNA, 60 nt, Human
ggagcaaugacugacuggcugcagccuucccacgccaagaggcuggaacauagugucugc

SEQ ID NO: 267130 - RNA, 60 nt, Human
cgaguagcugggauuacaggugcgcacuaccacgccaagcuaauuuuuguauuuuuuagu

SEQ ID NO: 267131 - RNA, 60 nt, Human
cgaguagcugggauuacaggcaugugccaccacgccaagcuaauuuuuguauuuuuagua

SEQ ID NO: 267132 - RNA, 60 nt, Human
ugggagaaggggcuccugggugucuguauacacgccaaaggcagauacaaauaaaauaca

SEQ ID NO: 267133 - RNA, 60 nt, Human
uagacucacggcugcaccugcagggagcagcacgccaaccccagcaguccugggcccccu

SEQ ID NO: 267134 - RNA, 60 nt, Human
uguucaucauaacuuuccacagcuuuaauccacgccaaguuuguauauaacugaaauuca

SEQ ID NO: 267135 - RNA, 60 nt, Human
ggcaugacuuuauauuguauacagauuuugcacgccaaacucggcagcuuuggggaagaa

SEQ ID NO: 267136 - RNA, 60 nt, Human
agccugauugggggccucccggcccuggcucacgccaagucccuggugcuggguuugcuc

SEQ ID NO: 267137 - RNA, 60 nt, Human
cacgaguacugcagugauaccgaacuguggcacgccaaagcaaaggauaaccauccucca

SEQ ID NO: 267138 - RNA, 60 nt, Human
cuuccacugucguccuuccucagagggccucacgccaaacaaacggccuuuucgugugaa

SEQ ID NO: 267139 - RNA, 60 nt, Human
ggccuuacuccguuuccuuagcgcccaugacacgccaagucccguuucgcacucggcuuc

SEQ ID NO: 267140 - RNA, 60 nt, Human
uaauguuaaaugacgaguuacuggaugcagcacgccaacauggcacauguauacauaugu

SEQ ID NO: 267141 - RNA, 60 nt, Human
aucucccccgacuucuaccagggaugccuucacgccaaggcuguucucaccagcugccuc

SEQ ID NO: 267142 - RNA, 64 nt, Human; identical to SEQ ID NO: 11119

SEQ ID NO: 267143 - RNA, 64 nt, Human; identical to SEQ ID NO: 11120

SEQ ID NO: 267144 - RNA, 64 nt, Human; identical to SEQ ID NO: 11121

SEQ ID NO: 267145 - RNA, 53 nt, Human; identical to SEQ ID NO: 137634

SEQ ID NO: 267146 - RNA, 60 nt, Human
cagccccaaggaaacacugaaaacacauaucacgccaaugccgugugguuuuguuugaau

SEQ ID NO: 267147 - RNA, 60 nt, Human
cuacuagcccgcggcgccgcccgggugggacacgccaagcucuucagugaagacacgaug

SEQ ID NO: 267148 - RNA, 60 nt, Human
ccucccacaugaugucaccuccccaucauccacgccaaguggaagccacuggaccacagg

SEQ ID NO: 267149 - RNA, 60 nt, Human
agaagagccaggcacagagcugcaguugggcacgccaaggauuccaaagguggaaugaga

SEQ ID NO: 267150 - RNA, 60 nt, Human
gaggaggugguggcuggcccggcccccgcccacgccaaggagggcuugcggcacuuucug

SEQ ID NO: 267151 - RNA, 60 nt, Human
ccucacaggagugauaagaaacaucugcuccacgccaacucccagagcugaugcuauugu

SEQ ID NO: 267152 - RNA, 60 nt, Human
caggcucaugucuuuacaccuucacucagccacgccaaccagagacuggguuccaaucuc

SEQ ID NO: 267153 - RNA, 60 nt, Human
guguguccugaguguuucuuugguucuuugcacgccaagucucuugguuguaccauguga

SEQ ID NO: 267154 - RNA, 60 nt, Human
ccucuggccucaggauuggccccacaucaccacgccaacaggaccacagcgcacuggcuc

SEQ ID NO: 267155 - RNA, 60 nt, Human
auuuuuuggacucaagcugucaucuucaagcacgccaacuucaggcaguguuuucuacug

SEQ ID NO: 267156 - RNA, 60 nt, Human
ggcaugaacacacauggaugcacacacacacacgccaaugcacacacacagagauaugca

SEQ ID NO: 267157 - RNA, 60 nt, Human
cagccagucaaaaaguaaaaugaagagaggcacgccaaccacuccaaaauuuugagucuu

SEQ ID NO: 267158 - RNA, 60 nt, Human
uuugcaccugauuuuauuuaucauuagugccacgccaagaucauuuagacgaugcuuauc

SEQ ID NO: 267159 - RNA, 60 nt, Human
cuccugaggcagguaaauggggcaaggacucacgccaaauaccacacgcguaugucaaac

SEQ ID NO: 267160 - RNA, 60 nt, Human
agagcaguuucuugccgcuugggucuucagcacgccaagccccccaccaacccuccaccc

SEQ ID NO: 267161 - RNA, 64 nt, Human; identical to SEQ ID NO: 11122

SEQ ID NO: 267162 - RNA, 64 nt, Human; identical to SEQ ID NO: 11123

SEQ ID NO: 267163 - RNA, 64 nt, Human; identical to SEQ ID NO: 11124

SEQ ID NO: 267164 - RNA, 60 nt, Human
gaagcaagcccaggagaagacucuccgccccacgccaaucccaaaggcaugcagauggcu

SEQ ID NO: 267165 - RNA, 60 nt, Human
uuuagguauacaaaacaguugauuauucaccacgccaauaucugggucucuguaucucau

SEQ ID NO: 267166 - RNA, 60 nt, Human
cgucgcuguugaaaugugaaucccggcggacacgccaaauugcgaggcgacggaaacgga

SEQ ID NO: 267167 - RNA, 60 nt, Human
acuucuacccauagcacaucccaacaccgucacgccaaaggaagagaaagaucaacucac

SEQ ID NO: 267168 - RNA, 60 nt, Human
cugcucccccaacccagcgucaggcugggacacgccaacgcuguuccggguuggaacagc

SEQ ID NO: 267169 - RNA, 60 nt, Human
gcucccuccuggagcaucccaggcgggcggcacgccaacagccccccccuugaaucugca

SEQ ID NO: 267170 - RNA, 60 nt, Human
cuguggucagaggaggagccggcgccuggccacgccaaccuuagaaucaugaacuguagu

SEQ ID NO: 267171 - RNA, 60 nt, Human
gaacacgccaagauggaagagcaacugaggcacgccaaguucaccaucacggagugcuuc

SEQ ID NO: 267172 - RNA, 60 nt, Human
acuuacgaagaacuggccagggccuacgaacacgccaagauggaagagcaacugaggcac

SEQ ID NO: 267173 - RNA, 60 nt, Human
gucuuuuguaaccuccugucccuccuaaaacacgccaaccccugcagucaaaucacauua

SEQ ID NO: 267174 - RNA, 60 nt, Human
guugcagaggucagucucuggcgugggccgcacgccaaccgcucauuucuguguugccuu

SEQ ID NO: 267175 - RNA, 60 nt, Human
gucuuggagcuucugacuaguucagacugccacgccaaccccagaaaauaccccacaugc

SEQ ID NO: 267176 - RNA, 60 nt, Human
caagccaccagggagccaaucucagcccuccacgccaaggagccuugcccaccagccaau

SEQ ID NO: 267177 - RNA, 60 nt, Human
ugcucauuccuacuaugaauccagaauaaacacgccaagauaacagcuaaaucagcaagg

SEQ ID NO: 267178 - RNA, 64 nt, Human; identical to SEQ ID NO: 11125

SEQ ID NO: 267179 - RNA, 64 nt, Human; identical to SEQ ID NO: 11126

SEQ ID NO: 267180 - RNA, 64 nt, Human; identical to SEQ ID NO: 11127

SEQ ID NO: 267181 - RNA, 64 nt, Human; identical to SEQ ID NO: 11128

SEQ ID NO: 267182 - RNA, 64 nt, Human; identical to SEQ ID NO: 11129

SEQ ID NO: 267183 - RNA, 64 nt, Human; identical to SEQ ID NO: 11130

SEQ ID NO: 267184 - RNA, 64 nt, Human; identical to SEQ ID NO: 11131

SEQ ID NO: 267185 - RNA, 64 nt, Human; identical to SEQ ID NO: 11132

SEQ ID NO: 267186 - RNA, 64 nt, Human; identical to SEQ ID NO: 11133

SEQ ID NO: 267187 - RNA, 64 nt, Human; identical to SEQ ID NO: 11134

SEQ ID NO: 267188 - RNA, 64 nt, Human; identical to SEQ ID NO: 11135

SEQ ID NO: 267189 - RNA, 64 nt, Human; identical to SEQ ID NO: 11136

SEQ ID NO: 267190 - RNA, 64 nt, Human; identical to SEQ ID NO: 11137

SEQ ID NO: 267191 - RNA, 64 nt, Human; identical to SEQ ID NO: 11138

SEQ ID NO: 267192 - RNA, 64 nt, Human; identical to SEQ ID NO: 11139

SEQ ID NO: 267193 - RNA, 64 nt, Human; identical to SEQ ID NO: 11140

SEQ ID NO: 267194 - RNA, 64 nt, Human; identical to SEQ ID NO: 11141

SEQ ID NO: 267195 - RNA, 64 nt, Human; identical to SEQ ID NO: 11142

SEQ ID NO: 267196 - RNA, 64 nt, Human; identical to SEQ ID NO: 11143

SEQ ID NO: 267197 - RNA, 64 nt, Human; identical to SEQ ID NO: 11144

SEQ ID NO: 267198 - RNA, 64 nt, Human; identical to SEQ ID NO: 11145

SEQ ID NO: 267199 - RNA, 64 nt, Human; identical to SEQ ID NO: 11146

SEQ ID NO: 267200 - RNA, 64 nt, Human; identical to SEQ ID NO: 11147

SEQ ID NO: 267201 - RNA, 64 nt, Human; identical to SEQ ID NO: 11148

SEQ ID NO: 267202 - RNA, 64 nt, Human; identical to SEQ ID NO: 11149

SEQ ID NO: 267203 - RNA, 64 nt, Human; identical to SEQ ID NO: 11150

SEQ ID NO: 267204 - RNA, 64 nt, Human; identical to SEQ ID NO: 11151

SEQ ID NO: 267205 - RNA, 52 nt, Human; identical to SEQ ID NO: 11152

SEQ ID NO: 267206 - RNA, 64 nt, Human; identical to SEQ ID NO: 11153

SEQ ID NO: 267207 - RNA, 64 nt, Human; identical to SEQ ID NO: 11154

SEQ ID NO: 267208 - RNA, 64 nt, Human; identical to SEQ ID NO: 11155

SEQ ID NO: 267209 - RNA, 64 nt, Human; identical to SEQ ID NO: 11156

SEQ ID NO: 267210 - RNA, 64 nt, Human
ggggguggcagagggcacccgggcgguaguccgggacgcgcaaggcagagcccugacgcuccgg

SEQ ID NO: 267211 - RNA, 64 nt, Human
uagaaggucauuuccauuuuguuugugauauuuagacgcgcagacuucaggaaguucaccuuua

SEQ ID NO: 267212 - RNA, 64 nt, Human
gcagccucacagggaacacgggacagacgccggcgacgcgcagacacacggacacgcggaagcc

SEQ ID NO: 267213 - RNA, 64 nt, Human
guggucucaggucccauuugcagucugcaacagugacgcgcagcccgguccggagcguggugag

SEQ ID NO: 267214 - RNA, 64 nt, Human
gcaagugcacggggcacagcggagucuguccugugacgcgcaagucugagggucugggcggcgg

SEQ ID NO: 267215 - RNA, 64 nt, Human
gcccugcccuuuccucccgcgccccaccggcuccgacgcgcaaccccgcucagcagucacagaa

SEQ ID NO: 267216 - RNA, 64 nt, Human
ggcacgccccaagcaccaggcaccagggcccaaggacgcgcagguguuggggcacaguccccaa

SEQ ID NO: 267217 - RNA, 64 nt, Human
ccgugccagugauucguugccucagaaacugcaugacgcgcaggagucagacuuccgcugggac

SEQ ID NO: 267218 - RNA, 64 nt, Human
uggggggucagguggacgccgcccuccggggcuggacgcgcaucccucagucccucggccaccc

SEQ ID NO: 267219 - RNA, 58 nt, Human
cugcugacgucagggucagcucccccgcggagcugacuucagcagcccacagcugugg

SEQ ID NO: 267220 - RNA, 58 nt, Human
aagugcagagccgcacaggagcugccccggagcugaggggacggucuucggcuccucu

SEQ ID NO: 267221 - RNA, 58 nt, Human
cugggucagccagagguuccuccaggcaggagcugagcauggggugggcagugagguc

SEQ ID NO: 267222 - RNA, 64 nt, Human
gcccgaaagcugagacccucgccacggggagggggacgcgcacacacaccggucaccgagacgg

SEQ ID NO: 267223 - RNA, 64 nt, Human; identical to SEQ ID NO: 267210

SEQ ID NO: 267224 - RNA, 64 nt, Human; identical to SEQ ID NO: 267211

SEQ ID NO: 267225 - RNA, 64 nt, Human; identical to SEQ ID NO: 267212

SEQ ID NO: 267226 - RNA, 58 nt, Human
ucuaaaaugauacccuggguggagugggggagcugagcaggaggccagguggcaacca

SEQ ID NO: 267227 - RNA, 58 nt, Human
ggccucugcccuccucucaggugcuggaggagcugaaggcuucgccacaggaccugga

SEQ ID NO: 267228 - RNA, 58 nt, Human
aggggucucuccccauagccacaguggaggagcugacagacaccuucuauuaucgucu

SEQ ID NO: 267229 - RNA, 64 nt, Human; identical to SEQ ID NO: 267213

SEQ ID NO: 267230 - RNA, 64 nt, Human; identical to SEQ ID NO: 267214

SEQ ID NO: 267231 - RNA, 64 nt, Human; identical to SEQ ID NO: 267215

SEQ ID NO: 267232 - RNA, 64 nt, Human; identical to SEQ ID NO: 267216

SEQ ID NO: 267233 - RNA, 64 nt, Human; identical to SEQ ID NO: 267217

SEQ ID NO: 267234 - RNA, 64 nt, Human; identical to SEQ ID NO: 267218

SEQ ID NO: 267235 - RNA, 64 nt, Human; identical to SEQ ID NO: 267222

SEQ ID NO: 267236 - RNA, 58 nt, Human
guagaggaaguugguguagaccagcuguggagcugaaggcacagucugccccaccccc

SEQ ID NO: 267237 - RNA, 58 nt, Human
guguggcuucccacuuuuccugcauuguggagcugacugaguacaccggugaggcugg

SEQ ID NO: 267238 - RNA, 58 nt, Human
uccagcaauaagaaaugaacaaaagauuggagcugaagaccuaaagugcuugcuuuuu

SEQ ID NO: 267239 - RNA, 58 nt, Human
uggcaaagcugcaguauugagaugcuaaggagcugaugccaccucuuugucuuccccu

SEQ ID NO: 267240 - RNA, 58 nt, Human
gccauuggaggcccacuguaggugggagggagcugauuuugggguggggggugggacu

SEQ ID NO: 267241 - RNA, 58 nt, Human
ccagcgcugucugugggucccuugccccggagcugacucgccuccagugaguccauac

SEQ ID NO: 267242 - RNA, 58 nt, Human
ugaagccuaaaccagugucuacgcaggcggagcugaacggagaggugaagcagggggu

SEQ ID NO: 267243 - RNA, 58 nt, Human
uguuguccccuucaaugguguuaccuuaggagcugaacauucaauucaguuacaccac

SEQ ID NO: 267244 - RNA, 58 nt, Human
uuccugccuguuccccacuccacaggagggagcugacguuggcuugaaaggaguaaag

SEQ ID NO: 267245 - RNA, 58 nt, Human
cggucacuauuuuguaauaaauguggcuggagcugauccagcugucucugaccuacag

SEQ ID NO: 267246 - RNA, 58 nt, Human
ugcagugaccagugcucuguggggcagaggagcugaccagggagggagguacccauga

SEQ ID NO: 267247 - RNA, 58 nt, Human
cagggucucuaccauccccuguagagugggagcugagugggggaucacagccucugaa

SEQ ID NO: 267248 - RNA, 58 nt, Human
ugcaggcauggucccuuaaggcacagugggagcugagcuggaaggggccacguggaug

SEQ ID NO: 267249 - RNA, 58 nt, Human
gccaucagaccaaaaaaaaguagagaaaggagcugaacuccacucucgaugcuacuua

SEQ ID NO: 267250 - RNA, 58 nt, Human
agaaaggaccugcauuuuccuacauugaggagcugacauagggguaagguaugggaga

SEQ ID NO: 267251 - RNA, 58 nt, Human
cuccagucuuuguuguauaaagguugggggagcugauaagguuuuuguacaguauuuu

SEQ ID NO: 267252 - RNA, 58 nt, Human
auccacacugcugaucacaccaacgacaggagcugauaagcaagaaagcgucacagcc

SEQ ID NO: 267253 - RNA, 58 nt, Human
ugccaaaugaggccugcucagaggaguaggagcugaaagauggugccuuccacccucu

SEQ ID NO: 267254 - RNA, 58 nt, Human
uaccuugguuugcaggaaagcagaugguggagcugaauaugccacuuaccagacuaaa

SEQ ID NO: 267255 - RNA, 58 nt, Human
ucccccgggugcuccccugccgaggucaggagcugaccaagccuuggcccggugacac

SEQ ID NO: 267256 - RNA, 58 nt, Human
gucccgggccgagugaggucgggccuggggagcugagugacaucccaagcuugggcuu

SEQ ID NO: 267257 - RNA, 58 nt, Human
ugccuggucgcgcucuucagucccacgaggagcugacacguccucucuggccgccauc

SEQ ID NO: 267258 - RNA, 58 nt, Human
ggucaauacacauaagaccgugucccaaggagcugauuuccaggccccugaggacugg

SEQ ID NO: 267259 - RNA, 58 nt, Human
gagcugggacuugagcucacaaaacuggggagcugagacauuuguucucuuggaucuc

SEQ ID NO: 267260 - RNA, 58 nt, Human
guuagcaaaccacuccuuuuguugcaaaggagcugaggucaaggguggcaaaggcacu

SEQ ID NO: 267261 - RNA, 58 nt, Human
ucagcuguggucccacccaggaagggagggagcugaggccucccuugaguaggcccug

SEQ ID NO: 267262 - RNA, 58 nt, Human
ugcuucccugugugucgggguccuccagggagcugacccagagguggaggccacggag

SEQ ID NO: 267263 - RNA, 58 nt, Human
ugaguccuggccucugcugggcccugaaggagcugagagggagcucaacuccccaccc

SEQ ID NO: 267264 - RNA, 58 nt, Human
ggggcauauaagcuacugaguggaacauggagcugaucaagaggccguaauggucaug

SEQ ID NO: 267265 - RNA, 58 nt, Human
gcgucauguaagggaagcuggaauuaagggagcugagccagucaugguuguggcgugu

SEQ ID NO: 267266 - RNA, 58 nt, Human
ugaugccccagcggauguuggccacggaggagcugaggcucucccuuucucugugauu

SEQ ID NO: 267267 - RNA, 58 nt, Human
ggaagugugucacagugaacaaauccagggagcugauaauuggcaaaagaccacuuuu

SEQ ID NO: 267268 - RNA, 58 nt, Human
auucagcuguuuuuggcuaagggcuuuuggagcugauggcagggguuugaugaaucca

SEQ ID NO: 267269 - RNA, 58 nt, Human
accagaugaacaggagcuggaaaggcaaggagcugaagccucugggagucugggaagu

SEQ ID NO: 267270 - RNA, 58 nt, Human
cauuuugcugcuaaagcaagagaaacuuggagcugaagcacacaccuggucugccccu

SEQ ID NO: 267271 - RNA, 58 nt, Human
gaggacuacugaggcucugcgaccuucaggagcugagccugccucucuccuuuagaug

SEQ ID NO: 267272 - RNA, 58 nt, Human
gcaugaggagagaagacccugcucugguggagcugacaaccuuugaggcugggaggag

SEQ ID NO: 267273 - RNA, 58 nt, Human
cugggaugcccuggcccugcuacuugagggagcugacuuagcucccgucccuaagguc

SEQ ID NO: 267274 - RNA, 58 nt, Human
cccuguagaaaaccagugaagcagguacggagcugaggacugggccccaggagguggg

SEQ ID NO: 267275 - RNA, 58 nt, Human
acauuuuggcuaucuuuacuuuguucugggagcugaucaugauaaccugcagaccuga

SEQ ID NO: 267276 - RNA, 58 nt, Human
ggcacuuccauugguucuuccuuucccuggagcugagguuuagaugugcaaccugugg

SEQ ID NO: 267277 - RNA, 58 nt, Human
aauuggaaaagggaaagacaaaguagugggagcugaucaaacguugaguuccuugggu

SEQ ID NO: 267278 - RNA, 58 nt, Human
aaagacaauggcauacuuggggugagagggagcugaggaugucugaggagggaauagu

SEQ ID NO: 267279 - RNA, 58 nt, Human
gaaggcauggacguguggaggaggcgcuggagcugaaggaauggacgagcccugggag

SEQ ID NO: 267280 - RNA, 58 nt, Human
gaccuccccaaguccagaaggaaggaauggagcugagcaacugacgucaaauccccaa

SEQ ID NO: 267281 - RNA, 58 nt, Human
uugagacacaccuagagaaggguuuuugggagcugaauaaacucagucaccugguuuc

SEQ ID NO: 267282 - RNA, 58 nt, Human
agccuucuggacaaggccugggcuaagaggagcugauucguuaucucuucacccacug

SEQ ID NO: 267283 - RNA, 58 nt, Human
aguaggcaggaccaugggaccaggucuuggagcugagccucucaccuguacucuuccg

SEQ ID NO: 267284 - RNA, 58 nt, Human
ccaccaugcuggccugcggcaugugcagggagcugaggcuguuuccaggugaugcugc

SEQ ID NO: 267285 - RNA, 58 nt, Human
gaucuucagauuaaacccuuuggugcuaggagcugacaauuuccaaagcagccuguga

SEQ ID NO: 267286 - RNA, 58 nt, Human
agauuuucaguuuuuugcagggaaucauggagcugagaauuucacagauacuuuauaa

SEQ ID NO: 267287 - RNA, 58 nt, Human
ucuugguucagagcaggaaaaccuucaaggagcugacugaccacguagcaugggggca

SEQ ID NO: 267288 - RNA, 58 nt, Human
aauauaaagauguauuauuuuaagccaaggagcugaaauauaucucaguuuauaaauu

SEQ ID NO: 267289 - RNA, 58 nt, Human
guuaagaaaaacuuggucuuagcccuugggagcugacagcccaugggcauuaaggcaa

SEQ ID NO: 267290 - RNA, 58 nt, Human
guaucccccuaaacuuaggggagauacuggagcugaccauccugaccuccuauuaaag

SEQ ID NO: 267291 - RNA, 58 nt, Human
aacaccucccaggggcuccaccuguucaggagcugaagcccaugcuuucccaccagca

SEQ ID NO: 267292 - RNA, 58 nt, Human
acuggugaucuacgugugcuuuuucaagggagcugauaaagaacuucuucccaaaaug

SEQ ID NO: 267293 - RNA, 58 nt, Human
uaauguguuuagauugcuagauugcuaaggagcugauacuuugacaguguuuuuagac

SEQ ID NO: 267294 - RNA, 58 nt, Human
aaaucaucccacaguguugcuuuucuauggagcugauuuaaaguauuccauuuagauu

SEQ ID NO: 267295 - RNA, 58 nt, Human
gucugugacagucagggaaggaugccucggagcugagguggggugagacagaguggga

SEQ ID NO: 267296 - RNA, 58 nt, Human
ucagggagcaggagcccagggcgcccugggagcugagccugggacuuccaggaccucc

SEQ ID NO: 267297 - RNA, 58 nt, Human
cuggagugagacaagggcucggccuuaaggagcugaagagucuggguagcuuguuuag

SEQ ID NO: 267298 - RNA, 58 nt, Human
gagaagauaaucauugcuuaugucaaauggagcugaauuugauaaaaacccaaaauac

SEQ ID NO: 267299 - RNA, 58 nt, Human
ucugcccugcgugcccugcugucaccgcggagcugaagagggaggaaggggcggcugc

SEQ ID NO: 267300 - RNA, 58 nt, Human
guguccgugaagugagucccgucugccaggagcugacgaaccacgaaugcuucugccu

SEQ ID NO: 267301 - RNA, 58 nt, Human
gaucccacagaggacugugguggccacaggagcugaaagcagaagagugggauuugau

SEQ ID NO: 267302 - RNA, 58 nt, Human
agcauccuuucaagaauauuagauaauuggagcugaguacucaggaacuugacuguag

SEQ ID NO: 267303 - RNA, 58 nt, Human
gcccuuaaugggaagggggcaggggugaggagcugagccugcucaaggagugggaagu

SEQ ID NO: 267304 - RNA, 58 nt, Human
gaggugagcgcagcggcaguucugccucggagcugauugcagggcccuguguggucuc

SEQ ID NO: 267305 - RNA, 58 nt, Human
gccuggggacggagcacugugcagccggggagcugaggggcagggccguagacucacg

SEQ ID NO: 267306 - RNA, 58 nt, Human
gggcuucuggcuagaacccgaaacaaaaggagcugaaggcagguggccugagagccau

SEQ ID NO: 267307 - RNA, 58 nt, Human
ccuuccuaucuguguuuucucaaagucaggagcugaccaggagcacacuaaggugugg

SEQ ID NO: 267308 - RNA, 58 nt, Human
ucugccugccugccccacugugcuggcaggagcugacuguggacuggugggcuccccu

SEQ ID NO: 267309 - RNA, 58 nt, Human
gaagaaaaagaucuagaaacugaguuguggagcugacucuaaucaaaugugaugauug

SEQ ID NO: 267310 - RNA, 58 nt, Human
uuguuauuuucagugauaacuccuaagaggagcugaguuguuguggguucuauguuua

SEQ ID NO: 267311 - RNA, 58 nt, Human
ggcuguagaagaguuguuggggaaggagggagcugaggagggggcaucucccaacuuc

SEQ ID NO: 267312 - RNA, 58 nt, Human
aggggaccugccuguccucagcucccugggagcugaaagugaggauacuccgugcucc

SEQ ID NO: 267313 - RNA, 58 nt, Human
uucucaaguccccuggugauuuccaaguggagcugagcaguuuuagggaaauugagug

SEQ ID NO: 267314 - RNA, 58 nt, Human
uucagcauccuggcuccccaggguggcaggagcugagggagggccacacacuggcaag

SEQ ID NO: 267315 - RNA, 58 nt, Human
guggccguggguuccugaugucggugcaggagcugaaggugaguggagugcugccaag

SEQ ID NO: 267316 - RNA, 58 nt, Human
cccccaggauguguacccgguuguaguaggagcugaaauccaugcugagcuguaccag

SEQ ID NO: 267317 - RNA, 58 nt, Human
cauuuuguaucagguguguugcuggccaggagcugauggcucacugggcucuuggagg

SEQ ID NO: 267318 - RNA, 58 nt, Human
acuugcaggcagaaugggaggaggacauggagcugauggaguccaggcugugcaagcc

SEQ ID NO: 267319 - RNA, 58 nt, Human
ggaacaaaauuugcuauccuuuagauuaggagcugaagauucauuucccugggaaugu

SEQ ID NO: 267320 - RNA, 58 nt, Human
ccccaagcuuggugcugagcccuggugaggagcugagggggauggguugcuggggcca

SEQ ID NO: 267321 - RNA, 58 nt, Human
agaauguguuuuauuguacuccuuccuuggagcugaaugcaaggaaugugaauucuga

SEQ ID NO: 267322 - RNA, 58 nt, Human
cagaaaccuaacaccauguaccagcaguggagcugaucccuacguccgugucuacuug

SEQ ID NO: 267323 - RNA, 58 nt, Human
auaaaagagaacgaacagguaguuugguggagcugagcuaguguacaauacacuaguu

SEQ ID NO: 267324 - RNA, 58 nt, Human
aguuuagaagcugagacacaaaggguugggagcugaugaaacucacaaaugaugguag

SEQ ID NO: 267325 - RNA, 58 nt, Human
caauccagcgaacugcuguauguauagaggagcugaggugcugucuaaugggaaaugu

SEQ ID NO: 267326 - RNA, 58 nt, Human
gacagcugacucacgguguuaugaauaaggagcugaaguacuguaagaauccugagga

SEQ ID NO: 267327 - RNA, 58 nt, Human
acugugcauauuuucaaccagaucaccaggagcugagaucuucuucagucccuagcca

SEQ ID NO: 267328 - RNA, 58 nt, Human
cccucacccugccccacuccuacgacugggagcugacaugaccagcccacugauccug

SEQ ID NO: 267329 - RNA, 58 nt, Human
ggggccuggcaugaaccuggccucccggggagcugagacuagggucccagcacagccc

SEQ ID NO: 267330 - RNA, 58 nt, Human
cucaucucccugguugcauggcccacuuggagcugaggucucauacaaggauauuugg

SEQ ID NO: 267331 - RNA, 58 nt, Human
agauuuuugccuagcacucgguuuugguggagcugacgauuuugagggcugaggcugg

SEQ ID NO: 267332 - RNA, 58 nt, Human
agacccucucuccugacccggcacaucuggagcugaagcguuacuacagcaucugcca

SEQ ID NO: 267333 - RNA, 58 nt, Human
cagcuuugcuuguggcaggggugagaguggagcugaguggggucugggcucugccccu

SEQ ID NO: 267334 - RNA, 58 nt, Human
cugguucugcaggggaggaaggcugccaggagcugaggggcuagcaccugcauugagg

SEQ ID NO: 267335 - RNA, 58 nt, Human
uggccagagugggucgucaaccucguguggagcugagaccaaggucugugggcucuag

SEQ ID NO: 267336 - RNA, 58 nt, Human
acugggguagcaacugacagcucagaaaggagcugagcucccucugcccugccaguug

SEQ ID NO: 267337 - RNA, 58 nt, Human
cugaccaggcgacagguaggggcggaggggagcugagucuccgaagccuuggcuuuuc

SEQ ID NO: 267338 - RNA, 58 nt, Human
acuuguaugcugcccacauacgugagggggagcugaaagggagccccuccucugagca

SEQ ID NO: 267339 - RNA, 58 nt, Human
ucggagccaaugaacagcuccuccucuuggagcugagaugagccccacguggagcucg

SEQ ID NO: 267340 - RNA, 58 nt, Human
aggcacugagugaaugcccccuggcugcggagcugagccccgcccugccaugagguuu

SEQ ID NO: 267341 - RNA, 58 nt, Human
aaaguuuauuuuauguugaauuauuuuuggagcugaaaucuuuguaauauuaaagcaa

SEQ ID NO: 267342 - RNA, 58 nt, Human
ucucagcaauaggaguagcgacccagguggagcugagauuaggccucuggggaucacc

SEQ ID NO: 267343 - RNA, 58 nt, Human
cacuucuuagcauuuccauucagugaauggagcugauguuugccugucauuuuaagau

SEQ ID NO: 267344 - RNA, 58 nt, Human
caggaaauuucuuuugaaauaaagugcuggagcugaauucugcauuauuuaucguugc

SEQ ID NO: 267345 - RNA, 58 nt, Human
ccugcaggcuguagggggcauggugccuggagcugaggggcauccgaacgcguugcgg

SEQ ID NO: 267346 - RNA, 58 nt, Human
cacuccagugcguccuguugcagggaccggagcugaugggagcugcuucucccccaug

SEQ ID NO: 267347 - RNA, 58 nt, Human
aggaggggcuaggggagaagcugcagcuggagcugaaggcucgaucuugugaaccccu

SEQ ID NO: 267348 - RNA, 58 nt, Human
ccauccucaaagaaguagcaguaccuggggagcugacacuucuguaaaacuagaagau

SEQ ID NO: 267349 - RNA, 58 nt, Human
cacggagcgggcaaccaacagugaauguggagcugagagacaguaaaauaauaacuga

SEQ ID NO: 267350 - RNA, 58 nt, Human
ggagacugcgucaagcaaucgagauuugggagcugaaccaaagccucuucaaaaagca

SEQ ID NO: 267351 - RNA, 58 nt, Human
uucagugucacuccauucauguugauuuggagcugacaguuauuuuguguaagcagag

SEQ ID NO: 267352 - RNA, 58 nt, Human
aucccuacuucuuauaaugcagaguuaaggagcugagcccccaugauuuuguagcugu

SEQ ID NO: 267353 - RNA, 58 nt, Human
ggauagguaacuugggugggcaacuuggggagcugaccauucucuuuugguaaauguu

SEQ ID NO: 267354 - RNA, 58 nt, Human
cuguagccuggaggggcuugaguggaugggagcugaugcugugauuuugagcuguggu

SEQ ID NO: 267355 - RNA, 58 nt, Human
acuucucagauuuguaauucuucuuuugggagcugagcuagugcuuuuaggagaacag

SEQ ID NO: 267356 - RNA, 58 nt, Human
gaccacacugauccuggagaaaagggauggagcugaaaaagauggaaugcuugcagag

SEQ ID NO: 267357 - RNA, 58 nt, Human
ccuguaugcaggacuccugaaggaggugggagcugagggcccuggaggauggggaagg

SEQ ID NO: 267358 - RNA, 58 nt, Human
cacagcuggagggucagccaccaagcugggagcugagccagaacaggagugaugucuc

SEQ ID NO: 267359 - RNA, 58 nt, Human
gagagucacgccccccacucuccuuuagggagcugagguucuucugcccugagcccug

SEQ ID NO: 267360 - RNA, 58 nt, Human
cgaacaugacuccagaggaccucgcccuggagcugagccuggcgccgggucaggacgg

SEQ ID NO: 267361 - RNA, 58 nt, Human
cauccagaacauucuuggaagagcacccggagcugaagcugucccugaugaugaaggu

SEQ ID NO: 267362 - RNA, 58 nt, Human
cuucugaaugaccaggacugcuuucuuuggagcugaugaaaauguacucuuuuagcgu

SEQ ID NO: 267363 - RNA, 58 nt, Human
ccaucuuugcucauggcaacaguuagcuggagcugaguagcagcugccugauuagaug

SEQ ID NO: 267364 - RNA, 58 nt, Human
gcagagcagaggagaauuguacauuuggggagcugaucucucggaaggguuuuaacug

SEQ ID NO: 267365 - RNA, 58 nt, Human
uuuugguaucaacccucaugaacccauaggagcugaauauuuguuucacugcuuaaua

SEQ ID NO: 267366 - RNA, 58 nt, Human
aaaaggcugagaaggaacagggaacauuggagcugacuguucuugguaacugauuacc

SEQ ID NO: 267367 - RNA, 58 nt, Human
cccuuuuacucuucccaacugggaacuuggagcugaaaaacauuggcacugaggccag

SEQ ID NO: 267368 - RNA, 58 nt, Human
gccacaaggauacccucacuuugcaugaggagcugaaacugaccaguguccaguguua

SEQ ID NO: 267369 - RNA, 58 nt, Human
ugccaggacccaccacuggaagcaggauggagcugacuacggaacugcacacucagug

SEQ ID NO: 267370 - RNA, 58 nt, Human
uuuuuaaauauuaugcugcuuuaacaguggagcugaauuuucuggaaaaugcuucuug

SEQ ID NO: 267371 - RNA, 58 nt, Human
agaggaaaggcaaauucuucucuccucuggagcugagacacucuucuucuucugcccu

SEQ ID NO: 267372 - RNA, 58 nt, Human
agacugcaggugggcugggcccacccagggagcugaugccccuucuccccuuccugga

SEQ ID NO: 267373 - RNA, 58 nt, Human
uuggcucagacauguuuuccgugaaaacggagcugaacaauaggcuguucccauguag

SEQ ID NO: 267374 - RNA, 58 nt, Human
ucaucuaaguccccagauggguacaaugggagcugaguuguuggagggagaagcugga

SEQ ID NO: 267375 - RNA, 58 nt, Human
aaaagucucuuggggaccucuggggcaaggagcugagaaguccugcagcaccagguga

SEQ ID NO: 267376 - RNA, 58 nt, Human
gacaaauggccauggggcagaggacaggggagcugagguugguucagaggccagccug

SEQ ID NO: 267377 - RNA, 58 nt, Human
cuggaaucaggggagugcaucauccucgggagcugacaacagccaggcuacaccaggg

SEQ ID NO: 267378 - RNA, 58 nt, Human
ugggugaucccagcucuuacuaggagagggagcugagguccuggugccaggggcccag

SEQ ID NO: 267379 - RNA, 58 nt, Human
cgaguguccuaaccccacgccaugugauggagcugaucaaggucauguuucucacugu

SEQ ID NO: 267380 - RNA, 58 nt, Human
ccucugcuugagccuugagccuugacugggagcugaaaggaguugcagcuguuggcau

SEQ ID NO: 267381 - RNA, 58 nt, Human
caacccagcccagacugggcuuuucuggggagcugaggaguuuaucaguauucaucuu

SEQ ID NO: 267382 - RNA, 58 nt, Human
cugaucaaggcaccacacaacccagaaaggagcugauggggcagaacgaacuuuaagu

SEQ ID NO: 267383 - RNA, 58 nt, Human
cagcugacccuugaacauggggguuaggggagcugacaauucguggguccgcaaaauc

SEQ ID NO: 267384 - RNA, 58 nt, Human
gaaaugagcaacuccauucaguaacgugggagcugaucccacgggcaggcucucccug

SEQ ID NO: 267385 - RNA, 58 nt, Human
uccaauuuacccuggaaucaguuuugagggagcugauaaagacuuuagcugacucguu

SEQ ID NO: 267386 - RNA, 58 nt, Human
cucacauucucucaagacaguugcucuaggagcugaguugcugguuuggaagugugga

SEQ ID NO: 267387 - RNA, 58 nt, Human
ccugguguugcauuuagcccuggggcauggagcugaacaguacuugugcaggauuguu

SEQ ID NO: 267388 - RNA, 58 nt, Human
gacaaagacagaaagaaggagcuauccaggagcugauccuccuugcaaagcugugccu

SEQ ID NO: 267389 - RNA, 58 nt, Human
guuaugcacaaaugugaacaccugagauggagcugaacauuucuucacuuuguucuuu

SEQ ID NO: 267390 - RNA, 58 nt, Human
aauagccuuuugcgcugccuguccugugggagcugauaaaccaagucacauuugcauu

SEQ ID NO: 267391 - RNA, 58 nt, Human
auguguacuguaaaacuugaaauacucaggagcugagugaauauguuuguugcuacuu

SEQ ID NO: 267392 - RNA, 58 nt, Human
caccaaccaugcaaucuagcgaguccauggagcugagcagcaggaggaggagccguga

SEQ ID NO: 267393 - RNA, 58 nt, Human
aaccuggcaacccuguggccugucugccggagcugacuggauccacucaucaauucuu

SEQ ID NO: 267394 - RNA, 58 nt, Human
gcgccguccugggcagggcacacggucuggagcugagaggguggagcaagagugcacu

SEQ ID NO: 267395 - RNA, 58 nt, Human
ccagggcuuccaaagaccccacugccccggagcugaagccgacucugcucccaucuca

SEQ ID NO: 267396 - RNA, 58 nt, Human
gcacucacaucaacggagccucagaaagggagcugaggccaugcacggcccugcaguu

SEQ ID NO: 267397 - RNA, 58 nt, Human
aguguaaacccaguggcuucucugaccuggagcugaugggccgugaagggggccuauu

SEQ ID NO: 267398 - RNA, 58 nt, Human
ucguaaucgggcuugagccagaggcuggggagcugagucccagccaaaccucacuggc

SEQ ID NO: 267399 - RNA, 58 nt, Human
uaauuucuaauaaccaacuccagaacuaggagcugaucaacucuuuguuuuccucucc

SEQ ID NO: 267400 - RNA, 58 nt, Human
aucuagaagaaccuggaccauucuugauggagcugaauacagugaucacguuguccuc

SEQ ID NO: 267401 - RNA, 58 nt, Human
aagccgggugucgcucacacaaccagaaggagcugaguuuggcaacaacccaagugag

SEQ ID NO: 267402 - RNA, 58 nt, Human
uuucuggccccuccugagaugaccugauggagcugaugcuuucucuccuaaucccugg

SEQ ID NO: 267403 - RNA, 58 nt, Human
gugagacaggugaggugauggugaugaaggagcugauccgguucgacgaggagaccca

SEQ ID NO: 267404 - RNA, 58 nt, Human
cagagguccaucuagcagggugccgggaggagcugagcccccggaggugggcuccugg

SEQ ID NO: 267405 - RNA, 58 nt, Human
acauuugguuaacccauugcuggcagugggagcugauuuaggcaggguaaacaggaaa

SEQ ID NO: 267406 - RNA, 58 nt, Human
uuucaaacauaaaauaauaagauaauugggagcugagcauaaaacauuauuuggaaaa

SEQ ID NO: 267407 - RNA, 58 nt, Human
agguaaugacgacaucauuuuaaggcauggagcugagaagucugggagugaggagauc

SEQ ID NO: 267408 - RNA, 58 nt, Human
cucagucacgcuggcuggugaaaaguggggagcugacagccuuggaguucagugcuuc

SEQ ID NO: 267409 - RNA, 58 nt, Human
caacuugguuaagggaggcugaauucuuggagcugaagggaaaacuucauuccaacgg

SEQ ID NO: 267410 - RNA, 58 nt, Human
cuaccaggguuacugguuuauuuuccagggagcugauaaagcaggagaacuguugcug

SEQ ID NO: 267411 - RNA, 58 nt, Human
agcccuccugagguuguugggccucucuggagcugagcacauuguggagcacaggcuu

SEQ ID NO: 267412 - RNA, 58 nt, Human
gaacaaauuccuaaauaguuuuaguaaaggagcugagaagcuagcauuagguuugcag

SEQ ID NO: 267413 - RNA, 58 nt, Human
auccuagaucacuuugcuuuuucuuuaaggagcugauguugcaccuaaacauuccaac

SEQ ID NO: 267414 - RNA, 58 nt, Human
cccugacucuuauuuucccagaggccauggagcugagauugagacuagccuugugguu

SEQ ID NO: 267415 - RNA, 58 nt, Human
ccaguagcugcccuuccugccugaugugggagcugaaccacagaaaucacagucaaug

SEQ ID NO: 267416 - RNA, 58 nt, Human
gccccuccacugccuggcucagcgggccggagcugaucgcucucacuggccugcugca

SEQ ID NO: 267417 - RNA, 58 nt, Human
gguagaaguaaaaggaugaucaugggagggagcugagggguuaauauauauacauaca

SEQ ID NO: 267418 - RNA, 58 nt, Human
cucaaccgcacaugugccacuguucagcggagcugacugguuucuccugguagagggg

SEQ ID NO: 267419 - RNA, 58 nt, Human
uuaccagccaccguggcucagccagagaggagcugagcccuguggagcagaacgggaa

SEQ ID NO: 267420 - RNA, 58 nt, Human
gcucuguaaaggucacaggaaucgugaaggagcugagaaaucuuccucuccggcccac

SEQ ID NO: 267421 - RNA, 58 nt, Human
acaggcugcagcuccagcgaguggcaguggagcugauucugagccagcucgccauauc

SEQ ID NO: 267422 - RNA, 58 nt, Human
acgugucugccuaagccuucaagugggcggagcugagggcagcagcuugacuuugcag

SEQ ID NO: 267423 - RNA, 58 nt, Human
uucucuguuaagaugcagccauccauggggagcugagaaaucagacucaaaguuccac

SEQ ID NO: 267424 - RNA, 58 nt, Human
agccccuguuuacugguucuugcaaaugggagcugagcagccucuggacagccaguga

SEQ ID NO: 267425 - RNA, 58 nt, Human
gcccucagagagguuccagucuagaugaggagcugaucuagacagguaaaaggcuaac

SEQ ID NO: 267426 - RNA, 58 nt, Human
acaucccucugcucuuuaaaaggacgcuggagcugagguuuccuaccugaaaaaugau

SEQ ID NO: 267427 - RNA, 58 nt, Human
gagugcuuuguggcuuugggguccucugggagcugaagcacacggccauguuggagag

SEQ ID NO: 267428 - RNA, 58 nt, Human
guagauacugaacuaagggcuaaugucaggagcugauuuuuaaugauaaagcugcaga

SEQ ID NO: 267429 - RNA, 58 nt, Human
agcacgaaagcugcuugucugcuuuggcggagcugagcuguguaugggauccaggagg

SEQ ID NO: 267430 - RNA, 58 nt, Human
cagcggccaccacccgucaacccugccaggagcugagggcaccacccagcaaccuggg

SEQ ID NO: 267431 - RNA, 58 nt, Human
gagcaccaggccgggcgccugcccagcaggagcugaugccggaggcagugggugcccu

SEQ ID NO: 267432 - RNA, 58 nt, Human
agugauguagcguaacaaacaaaaucauggagcugaggaggugccuuguaaacaugaa

SEQ ID NO: 267433 - RNA, 58 nt, Human
cagucuucuuuucagcuggucucuggggggagcugagaacucgcuugcuaccucacau

SEQ ID NO: 267434 - RNA, 58 nt, Human
ggaggaggcugcagccgugguccaaccaggagcugauggcagcuggggcuaggggaag

SEQ ID NO: 267435 - RNA, 58 nt, Human
aaggcagccggcagcucugccaggguggggagcugagcugaggcucccucuccaccca

SEQ ID NO: 267436 - RNA, 58 nt, Human
caaccagccuuuggguccugggcaggugggagcugaaaaggaucgaggcauggggcau

SEQ ID NO: 267437 - RNA, 58 nt, Human
gcuccaagggucgcugccgcucccugguggagcugacccccauagcagcagugcaugg

SEQ ID NO: 267438 - RNA, 58 nt, Human
acagagggaaggagccgcgcccccaccuggagcugaaucacaugaccuagcugcaccc

SEQ ID NO: 267439 - RNA, 58 nt, Human
uaaucuacgccagaaggccgggugcccaggagcugaaggugggggugacacugggagg

SEQ ID NO: 267440 - RNA, 58 nt, Human
ugucagaauuuguugcuaauuugccacaggagcugaaguuaacccugucugagaugca

SEQ ID NO: 267441 - RNA, 58 nt, Human
aaaccaaaacugggucucucuccacccgggagcugaggaggggugggggccguuuguu

SEQ ID NO: 267442 - RNA, 58 nt, Human
cagagcaccugcagaggagcaggaggccggagcugagccugcagaccccgguuucuau

SEQ ID NO: 267443 - RNA, 58 nt, Human
caggugcaagaguuauguagaaggaaagggagcugaaauaggaacagaaaaaucaacc

SEQ ID NO: 267444 - RNA, 58 nt, Human
cugugauugccuucuuacaacagagaugggagcugagugcuagaguaggugcagaagu

SEQ ID NO: 267445 - RNA, 58 nt, Human
caggggccaacuagggccagguggaaggggagcugagaagccaaccccuagcccaggg

SEQ ID NO: 267446 - RNA, 58 nt, Human
gccacugggccccucccacaccaccuggggagcugagaagaggaggcuggaguaaggg

SEQ ID NO: 267447 - RNA, 58 nt, Human
uuccaacuuucaggggcugacucuccagggagcugaugucaucacacucuccauguua

SEQ ID NO: 267448 - RNA, 58 nt, Human
gcggucaugaggguggggaauggcacuaggagcugauguuugccucauuuaaaguagg

SEQ ID NO: 267449 - RNA, 58 nt, Human
ucuguauuuucuaacgggaagauucaaaggagcugaauguguuaugcuuccaaacaac

SEQ ID NO: 267450 - RNA, 58 nt, Human
gcuggggacuggugcuugcugaaacccaggagcugaacagugaggaggcuguccaccu

SEQ ID NO: 267451 - RNA, 58 nt, Human
ugaacuuuugggguggagacuagaggcaggagcugagggacugauuccugugguugga

SEQ ID NO: 267452 - RNA, 58 nt, Human
gagucccaggagcugcccagaguugcugggagcugaaaaaucacauccuggccuggca

SEQ ID NO: 267453 - RNA, 58 nt, Human
ugguuucuggaagaggggucugugacuuggagcugaucuuuacugagcucgccguggc

SEQ ID NO: 267454 - RNA, 53 nt, Human
gcccacuaggcuacugcugaaagggagcugaaauuccuccaccaaguugguau

SEQ ID NO: 267455 - RNA, 58 nt, Human
uguaaaacgcaggcgcugggccgcgggcggagcugaggacaggccuuggcugguccca

SEQ ID NO: 267456 - RNA, 58 nt, Human
uuagcucaucuguggugucagaauccuuggagcugaagagagaaaucaaaagagcaug

SEQ ID NO: 267457 - RNA, 58 nt, Human
cucucuaggcugcgggcuccuggcugcuggagcugagcgggacgcuggagggauggga

SEQ ID NO: 267458 - RNA, 58 nt, Human
uucagauaagaauguacauaauguuaccggagcugauuuguuuggucauuagcucuua

SEQ ID NO: 267459 - RNA, 58 nt, Human
ggggugacugaacugggaguccagggagggagcugaggagcccuuacccucccaccac

SEQ ID NO: 267460 - RNA, 58 nt, Human
aaagguagacaaaacagcagcucccuguggagcugaagggcggccucaaaguggcuuu

SEQ ID NO: 267461 - RNA, 58 nt, Human
uggagcucccacagccagcaguaaucagggagcugagagccugguucugugaucaugg

SEQ ID NO: 267462 - RNA, 58 nt, Human
gcuuggggauucaguaguccagaucucuggagcugaaggggccagagagugggcagag

SEQ ID NO: 267463 - RNA, 58 nt, Human
guggaaggagaaacagcugcaggaggggggagcugaaaggaaucugaugcucaggccu

SEQ ID NO: 267464 - RNA, 58 nt, Human
ugcaaaccgccaccucccuauacugcuuggagcugagcaaaucaccacaaacuguaau

SEQ ID NO: 267465 - RNA, 58 nt, Human
aagauggugacuucuccuuggggaucugggagcugagcacuugucuauacuuguuccu

SEQ ID NO: 267466 - RNA, 58 nt, Human
uucccacccucccagcucaccuccccauggagcugagaggccucccuuggagagaugg

SEQ ID NO: 267467 - RNA, 58 nt, Human
ggaggggguaccucaugaggaccaggguggagcugagaagaggaggaggugggggcug

SEQ ID NO: 267468 - RNA, 58 nt, Human
cccccgcagaggcagaaugaacccauagggagcugaucguaauguuuaucauguuacu

SEQ ID NO: 267469 - RNA, 58 nt, Human
ggaagugacgcaguuuuaaggaauuccaggagcugacugccgaucaaugagccagaug

SEQ ID NO: 267470 - RNA, 58 nt, Human
cccuggggaucagaaaggugggcuugcuggagcugagcuguuucacugccucucgcag

SEQ ID NO: 267471 - RNA, 58 nt, Human
guccugggcaugcaucugggacccccguggagcugacaaguuuuccuugcuuuccuga

SEQ ID NO: 267472 - RNA, 58 nt, Human
cucuagggguuuggcuacuguuggccugggagcugagagaaggcacugagagggacag

SEQ ID NO: 267473 - RNA, 58 nt, Human
ggcuuaccaagaucacauaccagagucuggagcugagcuaccuggggugggggccaag

SEQ ID NO: 267474 - RNA, 58 nt, Human
gcucacaccuguaaucccagcacuuuggggagcugaggcgggcggaucacgaggucaa

SEQ ID NO: 267475 - RNA, 58 nt, Human
augucauagccuugguuuaguuuuggguggagcugaauaaacccaaaucucagggccu

SEQ ID NO: 267476 - RNA, 58 nt, Human
guaugaaauucuguaauaccaagaagagggagcugaaaaggaaaauuuucagauuaau

SEQ ID NO: 267477 - RNA, 58 nt, Human
agggccagagcccguccagaggccaccaggagcugagacagugccaccaccagcaccu

SEQ ID NO: 267478 - RNA, 58 nt, Human
ucccugcccugcaccagcacccugagauggagcugagacuuuauuuauuggggguagg

SEQ ID NO: 267479 - RNA, 58 nt, Human
agauagaaaaagaagcauggauccuugaggagcugacaacaaguuaucccagggccug

SEQ ID NO: 267480 - RNA, 58 nt, Human
gaguggcggcccacgcagcuucugcugaggagcugaccgcucugagcuguucuguuuc

SEQ ID NO: 267481 - RNA, 58 nt, Human
ucuucaggggccagcugggaaaugcuaaggagcugagggugcccaccaagcccaccuu

SEQ ID NO: 267482 - RNA, 58 nt, Human
cguuacucagggcuccucccagcuuguaggagcugagguuucacccuuaacccaagga

SEQ ID NO: 267483 - RNA, 58 nt, Human
uccucgaggccugcacagcuguggccguggagcugaccugaccaggcaaggcugcugu

SEQ ID NO: 267484 - RNA, 58 nt, Human
uggcagccucuucucgacgucuccuuccggagcugagauccagcccagggcgaauggc

SEQ ID NO: 267485 - RNA, 58 nt, Human
cugcuucugugaccgcugcuauaggcguggagcugaggcucggcuuuuccuuuuguuc

SEQ ID NO: 267486 - RNA, 58 nt, Human
acucagccccuuuuucugccuaggauaaggagcugaaagauuaacuuggaucuucuaa

SEQ ID NO: 267487 - RNA, 58 nt, Human
caugguggauucaagaacucccuagugaggagcugaacuugcucaaucuaaggcugau

SEQ ID NO: 267488 - RNA, 58 nt, Human
uuuuacuuguuuaauucuaaaagagaagggagcugaggccauucccuguaggaguaaa

SEQ ID NO: 267489 - RNA, 53 nt, Human
ccgagccggagcagcucugaccuggagcugaggcagccagcagaucucagcag

SEQ ID NO: 267490 - RNA, 58 nt, Human
gacuaugguucaaggacacuggaauugaggagcugaucaaggcucucuucagccuugc

SEQ ID NO: 267491 - RNA, 58 nt, Human
gccugugccacccucagagaagaagaaaggagcugaggaggagaagccaaagaggagg

SEQ ID NO: 267492 - RNA, 58 nt, Human
auacacagagucugucacagacagggacggagcugaagaccaucaacgacuuucucuu

SEQ ID NO: 267493 - RNA, 58 nt, Human
uuuauuagaauaguaugaaaguacuggaggagcugaaagaaaaacacccaaggcuggg

SEQ ID NO: 267494 - RNA, 58 nt, Human
ccuuucacgucagcuaccuggauauugaggagcugagccugaguggacucugccagug

SEQ ID NO: 267495 - RNA, 58 nt, Human
cacauacaugauaaugauucccagcccaggagcugaggggugagggcuggggaccaug

SEQ ID NO: 267496 - RNA, 50 nt, Human
ccccaccaaagcccauguaaggagcugaguucuuaaagacugaagacagg

SEQ ID NO: 267497 - RNA, 58 nt, Human
ggaaccccugagggccaaacagcagaguggagcugagcuguggaccucucgggcaacu

SEQ ID NO: 267498 - RNA, 58 nt, Human
uauugugcaagaacccaacuuuuacucaggagcugagaaggaagaagccucaaaccac

SEQ ID NO: 267499 - RNA, 58 nt, Human
gaggaaggauugauuugcaaccagaaagggagcugaaaaccacggagcuccauggcuc

SEQ ID NO: 267500 - RNA, 58 nt, Human
aauuaauaauaauaauaauaauaauaaaggagcugacguucuuagccuugugugguuc

SEQ ID NO: 267501 - RNA, 58 nt, Human
guaucugauuccucugcugucccugccaggagcugaagggugggaacaacaaaggcaa

SEQ ID NO: 267502 - RNA, 58 nt, Human
ucugacaugacaguauuuuuucugaccaggagcugaaagacccugacauucaugaucc

SEQ ID NO: 267503 - RNA, 58 nt, Human
ucuucgcaggggcugaugcacuggguguggagcugagcagagaggccuaaccaggauc

SEQ ID NO: 267504 - RNA, 58 nt, Human
agguacuccccaacccugagucccagaaggagcugaguucucuagaccagaagaggau

SEQ ID NO: 267505 - RNA, 58 nt, Human
guccugggucuucccaguugagacugcuggagcugagacacaguacucucuuaaagaa

SEQ ID NO: 267506 - RNA, 58 nt, Human
uguggucagcucucagacggcagggagcggagcugacguuggcugugcuuggucaccg

SEQ ID NO: 267507 - RNA, 58 nt, Human
gucgucacccuuggauuuuauggaucacggagcugaccaucuuuaccugguccuggaa

SEQ ID NO: 267508 - RNA, 58 nt, Human
ggcacauaccuguaauccaagcugcccaggagcugaggccggagaaucgcuugaaccu

SEQ ID NO: 267509 - RNA, 58 nt, Human
gaggacucucuacccuugccguaucuaaggagcugagguaauacagauccaaggagaa

SEQ ID NO: 267510 - RNA, 58 nt, Human
aacggauugaucugaucaaucccuucaaggagcugaaggcaaaauguguaaaaccccu

SEQ ID NO: 267511 - RNA, 58 nt, Human
aaucaaaucauccugucacaaggcaggaggagcugauaaugaacuuuauuggagcauu

SEQ ID NO: 267512 - RNA, 58 nt, Human
uccuuguccucauuuaugcauguuuggaggagcugauuccugaacucauauuuaaucu

SEQ ID NO: 267513 - RNA, 58 nt, Human
cugggaggugucgggcgggacagaauggggagcugaggaggcauuuuuggggggcuuu

SEQ ID NO: 267514 - RNA, 58 nt, Human
gaugggcagagaaaggguagugugugagggagcugaguaggccagguaggcgauugga

SEQ ID NO: 267515 - RNA, 58 nt, Human
ggaguccuuggggagaugaaggggguggggagcugagcaggcugggcaauuugcccuc

SEQ ID NO: 267516 - RNA, 58 nt, Human
acaugugggguucuuggugugggucuggggagcugaaggauuuuauggagcuggugcu

SEQ ID NO: 267517 - RNA, 58 nt, Human
aagaaccagauggcuucagcucucuagaggagcugagccuauucacagugccuaaccu

SEQ ID NO: 267518 - RNA, 58 nt, Human
cacccaagcccuccuuuggagcaaagaaggagcugagaacaagccgaaugaggaguuu

SEQ ID NO: 267519 - RNA, 58 nt, Human
uucaggagugcaagcagcacucaaaccuggagcugaggaaucuaauucagacagagac

SEQ ID NO: 267520 - RNA, 58 nt, Human
aguuaaccauuuauaagauuuggaccuuggagcugaaccagggagcuagcaaaaguaa

SEQ ID NO: 267521 - RNA, 58 nt, Human
cagcuagagagcaggacuucacccuccaggagcugacuggguguugcugaagcaaaug

SEQ ID NO: 267522 - RNA, 58 nt, Human
gacgauuagcgcugagucgcggccccugggagcugaucuggacacccugugacacugg

SEQ ID NO: 267523 - RNA, 58 nt, Human
cggcacaggagggugcauggggcgugggggagcugagcaagggucgcucacuuagaaa

SEQ ID NO: 267524 - RNA, 58 nt, Human
uucugaaacucuguggaggaggaagaugggagcugaugagaaucaaaguggaaugaag

SEQ ID NO: 267525 - RNA, 58 nt, Human
cugggugcucugagcccacgguucccacggagcugacuucuccggggugccugugccc

SEQ ID NO: 267526 - RNA, 58 nt, Human
ggagcccugaaguuguguccacgaagagggagcugaaacaaauucggggcuaugaagu

SEQ ID NO: 267527 - RNA, 58 nt, Human
agcccugcagguguccggcgcagccgugggagcugaggaucuggcacuugagaggcag

SEQ ID NO: 267528 - RNA, 58 nt, Human
ccaguaaagaaggcuguacucaagaggaggagcugacacauuucacuuggcugcgucu

SEQ ID NO: 267529 - RNA, 58 nt, Human
ugucauuuccaccagcaguucccuuaggggagcugaaauaaauucacauuuucucaaa

SEQ ID NO: 267530 - RNA, 58 nt, Human
cugaacccaguugggcuaguccccaagaggagcugagagccauguacucuaaugccuc

SEQ ID NO: 267531 - RNA, 58 nt, Human
agcgggccgagccacgcagcggcuucgaggagcugaacaacgagaacaagagcacacu

SEQ ID NO: 267532 - RNA, 58 nt, Human
gcacacugcaguuggagcagcaaguaaaggagcugaagaagucgggugagcugaaaga

SEQ ID NO: 267533 - RNA, 58 nt, Human
gcaaguaaaggagcugaagaagucggguggagcugaagagccaagaggcuccgagucu

SEQ ID NO: 267534 - RNA, 58 nt, Human
ccacaccuacuccaaagaacagcuggacggagcugagaggagacccuagcaucuccau

SEQ ID NO: 267535 - RNA, 58 nt, Human
aguuaguccucugcuguuuacuucugcaggagcugauccauuuauaaaugcaguuuua

SEQ ID NO: 267536 - RNA, 58 nt, Human
accacguaguuaucuuuucacuucagguggagcugaaauucugcuggcuccagaguuu

SEQ ID NO: 267537 - RNA, 58 nt, Human
uaccucacugccaccacuccugcuguuaggagcugagugugucucccuaaaauuucua

SEQ ID NO: 267538 - RNA, 58 nt, Human
cagucuucggacucauucuguaaauggaggagcugaggucagaggggggcugugaacu

SEQ ID NO: 267539 - RNA, 58 nt, Human
ccccagcaggauggguggggccugcucuggagcugagcccguggccgcucacaggugu

SEQ ID NO: 267540 - RNA, 58 nt, Human
uucccagccccaccagagccccgugccgggagcugacagcuuucacgcuuaaggcacg

SEQ ID NO: 267541 - RNA, 58 nt, Human
cacaucugcugguuuggggcuucaguggggagcugacagcugugagcacaccacuguc

SEQ ID NO: 267542 - RNA, 58 nt, Human
ugggcuggaggccuguccacuggcuucuggagcugaaggucugcgucacggugaaaau

SEQ ID NO: 267543 - RNA, 58 nt, Human
cagccucagugacccccuagugcuuccuggagcugaggcugugggcggcugucccagc

SEQ ID NO: 267544 - RNA, 58 nt, Human
ugcagggcagccucggggguguggagaaggagcugacgcugcgcagccaagcccugga

SEQ ID NO: 267545 - RNA, 58 nt, Human
caugcuggauaggaccugggaugcugcuggagcugaaucggaugccaccaaggcucgg

SEQ ID NO: 267546 - RNA, 58 nt, Human
uuccuccccagggaguggggccuccccgggagcugacgccaccacccugcuuagcccu

SEQ ID NO: 267547 - RNA, 58 nt, Human
aaaaaugggcuuugcacacaauggguuuggagcugacugggaacaauggaaaaaauua

SEQ ID NO: 267548 - RNA, 58 nt, Human
gucucuuuggggagagcuggcagugugcggagcugauaacauuuucccaauauugagc

SEQ ID NO: 267549 - RNA, 58 nt, Human
acuaauugugggggugccugagucaggcggagcugacccaggggugggaacgauggca

SEQ ID NO: 267550 - RNA, 58 nt, Human
ggccuguucccuaaggggccccagccaaggagcugagcgaggcugucuggcuuggggg

SEQ ID NO: 267551 - RNA, 58 nt, Human
ugcagcuggguggucugcaguuugacaaggagcugaggucgcucauugccuaccuuac

SEQ ID NO: 267552 - RNA, 58 nt, Human
gucccccccaacuguaccacgggcaugaggagcugaagagaacugcugaggaggauuu

SEQ ID NO: 267553 - RNA, 58 nt, Human
cuagagagaccagcugccuuugagaccaggagcugagcaccgagaaccaucugugagc

SEQ ID NO: 267554 - RNA, 58 nt, Human
uaagcaugggggcguggggaagagggcaggagcugaaguuccaggggagcccaggacc

SEQ ID NO: 267555 - RNA, 58 nt, Human
gcaggugagcacagacuucuaguuggcaggagcugaggagggugaacaaaccccgagg

SEQ ID NO: 267556 - RNA, 58 nt, Human
uuuucuucaggcagcugaggguccugggggagcugaggcucugugcugcacccccagc

SEQ ID NO: 267557 - RNA, 58 nt, Human
gguuuggcuuguuuuucuugcaugguuuggagcugaucgcuucucccccacccccuag

SEQ ID NO: 267558 - RNA, 58 nt, Human
ccuggccggguuucuaccucucgucaccggagcugaucacugucaguuuuguaccgau

SEQ ID NO: 267559 - RNA, 58 nt, Human
aacaaggcaaacccguagcagccucucaggagcugacagguccucuuucggggcucag

SEQ ID NO: 267560 - RNA, 58 nt, Human
aguucucaguggggccagacuggcuccuggagcugacaagcgaccccguggugaggag

SEQ ID NO: 267561 - RNA, 58 nt, Human
ucuuccugcuuagcuugagggugacuauggagcugagcagguguucuucauuaccuca

SEQ ID NO: 267562 - RNA, 58 nt, Human
aaccuauauuucucugucuaaaaauaugggagcugagauuccguucguggaaaaaaga

SEQ ID NO: 267563 - RNA, 58 nt, Human
uugcccuucccagagggaugguuugaggggagcugaugagaagagagguaucuguuaa

SEQ ID NO: 267564 - RNA, 58 nt, Human
gccaauguccauuugccuuaugcuuuguggagcugauuaggcugggauuugaggugau

SEQ ID NO: 267565 - RNA, 58 nt, Human
uagaguuccuggccuucucuuugcaaggggagcugagaaucugguuuugguagcagga

SEQ ID NO: 267566 - RNA, 58 nt, Human
acagaggggagaucucagcacuuuguccggagcugaggaagugguuucuguguuuuac

SEQ ID NO: 267567 - RNA, 58 nt, Human
cuuuggugcccggugagcgcagccagcaggagcugagcagcgggggagaugaaucacc

SEQ ID NO: 267568 - RNA, 58 nt, Human
aaaggucuaagcaagugagucugguggaggagcugagggagggagccauggaaggugc

SEQ ID NO: 267569 - RNA, 58 nt, Human
ccuugggaagccucuccaaagagcuuucggagcugacacugacagcuucaguuucccc

SEQ ID NO: 267570 - RNA, 58 nt, Human
cagccacucugagccggggcuccuuccaggagcugaaauccaccugucuccaucuucc

SEQ ID NO: 267571 - RNA, 58 nt, Human
aaugacagcauccuggcgacuccacaguggagcugagcgccacucccuguagccgauc

SEQ ID NO: 267572 - RNA, 58 nt, Human
gccacaacggugaccagccggagcagccggagcugaagcggaucaagacagaagacgg

SEQ ID NO: 267573 - RNA, 58 nt, Human
ccccugccggcgggcuccguggggcccuggagcugaugacgggggaggcccguccgcc

SEQ ID NO: 267574 - RNA, 58 nt, Human
ggacaccgaggauuggaaauaagggccuggagcugaguaguagccagucugcugugac

SEQ ID NO: 267575 - RNA, 58 nt, Human
gggcugcacucagcaggcugcuugagugggagcugacuccaacaugcccugcccuggc

SEQ ID NO: 267576 - RNA, 58 nt, Human
gcaaucauguaaacuucugacaccaccaggagcugacucacaccugaacugaacacca

SEQ ID NO: 267577 - RNA, 58 nt, Human
cgggguccccgacucagcugguggcuguggagcugaguccccuccccguaaccucugc

SEQ ID NO: 267578 - RNA, 58 nt, Human
agugugcuugcccaccacagcgauccacggagcugaagcugggagcuacagggggcgu

SEQ ID NO: 267579 - RNA, 58 nt, Human
ucgagagugggcagccccucuaccuccuggagcugaacugggguggaacugagugugc

SEQ ID NO: 267580 - RNA, 58 nt, Human
aacucugauuguagcaaaaguucugagaggagcugagcccuguuguggcccauuaaag

SEQ ID NO: 267581 - RNA, 58 nt, Human
cucggagugcgcuaccucccccaugugaggagcugagaacggaagcugcagaaagaua

SEQ ID NO: 267582 - RNA, 58 nt, Human
gaugcugaguuguugggcugaacaacuaggagcugaaaacaacguagaggcuggaaag

SEQ ID NO: 267583 - RNA, 58 nt, Human
ccuauucccaugccucccucucauuggaggagcugaccaaagcagcccuaacgggcca

SEQ ID NO: 267584 - RNA, 58 nt, Human
cuagcggaacuuuuuuuuucauuuaaauggagcugaauaauggagauuuugugucugc

SEQ ID NO: 267585 - RNA, 58 nt, Human
gcagaagagagaugcugcucuggcccugggagcugaauuccaagcccaggguuuggcu

SEQ ID NO: 267586 - RNA, 58 nt, Human
cuccugcccuggaaaucuggagccccuuggagcugagcuggacggggggccagcugcg

SEQ ID NO: 267587 - RNA, 58 nt, Human
gggaagcgccauucccgcgggggggcggggagcugagcaccuggggccucggggcggg

SEQ ID NO: 267588 - RNA, 58 nt, Human
cuggccauuuauggugaaccugugucuuggagcugacuuacuaaguggaaugagccga

SEQ ID NO: 267589 - RNA, 58 nt, Human
cccggguggggagguggccaaggaugcuggagcugaaucagacgcugacaguucuuca

SEQ ID NO: 267590 - RNA, 58 nt, Human
uuucacaagcuauucccucaaaucugagggagcugaguaacaccaucgaucaugaugu

SEQ ID NO: 267591 - RNA, 58 nt, Human
ggggucuaggagagggagagcuggaaaaggagcugauggggucuuauccuggccucug

SEQ ID NO: 267592 - RNA, 58 nt, Human
ugagccucagugagaaguccuuccgacaggagcugacucaugucaggauggcaggccu

SEQ ID NO: 267593 - RNA, 58 nt, Human
guccgaauaaccuaguuuuacaguugagggagcugagcucagauucaguucuuugccg

SEQ ID NO: 267594 - RNA, 58 nt, Human
cugcaggucacccggagcaggacggggaggagcugagccggacccuccaccuggagga

SEQ ID NO: 267595 - RNA, 58 nt, Human
cucagaaccuccaacugacugaaugccaggagcugaacauuaauaugugcaaagauug

SEQ ID NO: 267596 - RNA, 58 nt, Human
auguccuccuagaguuuagaggcuagagggagcugaggggaggaucuuacugaaagca

SEQ ID NO: 267597 - RNA, 58 nt, Human
ugucuacugggagccggguuucccacagggagcugagucuacagacuccagggcaauc

SEQ ID NO: 267598 - RNA, 58 nt, Human
cggccggcccaccuguccccucgggaggggagcugagcccgacuucuaccgggguccc

SEQ ID NO: 267599 - RNA, 58 nt, Human
ccccccaaugcuccagggccaguccuaaggagcugagggucugaggacgcagggaggg

SEQ ID NO: 267600 - RNA, 58 nt, Human
gcagugaggaacggugccggcucugcacggagcugaggacaggacagaccuugcuuug

SEQ ID NO: 267601 - RNA, 58 nt, Human
acacuuacugagcaccugcugugugcagggagcugagcuaugggaugggaaugggagu

SEQ ID NO: 267602 - RNA, 58 nt, Human
ccaucugcccaguccuugacucguccauggagcugagggucggaggaaccuuccuugg

SEQ ID NO: 267603 - RNA, 58 nt, Human
gcggugaagaucuguggagauggagcugggagcugaggcuccuguugcaccagccacc

SEQ ID NO: 267604 - RNA, 58 nt, Human
aucguugcaggugaguccaucagaaacaggagcugacaaccugcugggcacccgaaga

SEQ ID NO: 267605 - RNA, 58 nt, Human
ccaacaagcaccccgcuuuugcagcagaggagcugaguuggcagaccgggccccccug

SEQ ID NO: 267606 - RNA, 58 nt, Human
guaucuugugcccaaggccuguauuuguggagcugauguucuagugagagacaguaaa

SEQ ID NO: 267607 - RNA, 58 nt, Human
uaaugagcccuuaaucgcugccucuaggggagcugauuguagcagccucguuaguguc

SEQ ID NO: 267608 - RNA, 58 nt, Human
auuccaagggcuuagagaugaaugcccaggagcugaggauaaagggcccgaucuuucu

SEQ ID NO: 267609 - RNA, 58 nt, Human
cgucucuagggcugcauggggagcccggggagcugaguaguggggauccagagaggac

SEQ ID NO: 267610 - RNA, 58 nt, Human
cuccuuguuuccuuccagccuucguccaggagcugaggaagcgggguucucccugacc

SEQ ID NO: 267611 - RNA, 58 nt, Human
cugccgggagggagggaggcacacagguggagcugacccucgucuuuguggcagcaaa

SEQ ID NO: 267612 - RNA, 58 nt, Human
agccccuggcccgccuggcccuagccauggagcugagccggcgcguggccgggcuggg

SEQ ID NO: 267613 - RNA, 58 nt, Human
agacuguguccuuuacagcaacauagauggagcugaggcucuuauccuaagugaauua

SEQ ID NO: 267614 - RNA, 58 nt, Human
ccagaaggagcccuuggaccucugggagggagcugacccuugacuccagcauagcucu

SEQ ID NO: 267615 - RNA, 58 nt, Human
ugaguaaucuucagguccuccguguucuggagcugagaugggaaugagccccuacaca

SEQ ID NO: 267616 - RNA, 58 nt, Human
guuuagagaagaacauaaaugaccugauggagcugaaaaacacagcaugagaacuucg

SEQ ID NO: 267617 - RNA, 58 nt, Human
cacuguuagugucgccaccgcccauaaaggagcugagcccagcaggggcacugccugg

SEQ ID NO: 267618 - RNA, 58 nt, Human
ggggcccuguagccaaaaggcuacagcaggagcugaugacccucaugaugccugguga

SEQ ID NO: 267619 - RNA, 58 nt, Human
ucggccacccggcccugagucccuggggggagcugaugggccccagaagaugggggac

SEQ ID NO: 267620 - RNA, 58 nt, Human
cuguggacaugacccaccucuggccggaggagcugagcugguaucugcugggggcuuc

SEQ ID NO: 267621 - RNA, 58 nt, Human
ugaccaucccugauggggccugaccgcgggagcugaggaagcgccgcuccaccgucug

SEQ ID NO: 267622 - RNA, 58 nt, Human
cccguacacaccagggguuccgggguugggagcugaaccauccccaccucaggguuau

SEQ ID NO: 267623 - RNA, 58 nt, Human
cugggggcugcucaccucccuggcuccuggagcugauugccaaagaguuuuuucuucc

SEQ ID NO: 267624 - RNA, 58 nt, Human
gacggagggggagaaugggaggagacaaggagcugaaggaguaguucccgaaggaccu

SEQ ID NO: 267625 - RNA, 58 nt, Human
acaugacuaguuugguuuucaccgguucggagcugaagaagaauuuugccucagcaug

SEQ ID NO: 267626 - RNA, 58 nt, Human
cggcggcggcagccccggagggcggcugggagcugagcguggcgcaagcgggccaggg

SEQ ID NO: 267627 - RNA, 58 nt, Human
gcaggcccguggcaggaggagggcucagggagcugagaucccgacaagcccgccagcc

SEQ ID NO: 267628 - RNA, 58 nt, Human
cccccaggagaggauccuucagcagagaggagcugacaggguaccugcuccgggccag

SEQ ID NO: 267629 - RNA, 58 nt, Human
cuccgcugggcaucucccugccacagguggagcugaccggcuuuggggaggcagguac

SEQ ID NO: 267630 - RNA, 58 nt, Human
uuggagagguaggggugcggggugggggggagcugaaucuucaaucggaauaaaagca

SEQ ID NO: 267631 - RNA, 58 nt, Human
uucuguuuuguuuugaaguccucaaaugggagcugaaauuuuccagucacuagaguuc

SEQ ID NO: 267632 - RNA, 58 nt, Human
auagcgucauucagaagaaggcguccaaggagcugaagguggugaaauuuguccugca

SEQ ID NO: 267633 - RNA, 58 nt, Human
gaaggaggaagaauagggcccaugggagggagcugagaagacucaaguccccgucugc

SEQ ID NO: 267634 - RNA, 58 nt, Human
uuaaaccagagcaacuccaucuggaauaggagcugaauaaaaugaggcugagaccuac

SEQ ID NO: 267635 - RNA, 58 nt, Human
gaguucagggcccagacuuugggguccgggagcugauggccccucucucccggcuccg

SEQ ID NO: 267636 - RNA, 58 nt, Human
aagugauucuccuaccucagccucccaaggagcugagauuacgaguacaccacaccau

SEQ ID NO: 267637 - RNA, 58 nt, Human
ugccacggaguauaaggagggagagaaaggagcugaaagucuagguuuggccagcuag

SEQ ID NO: 267638 - RNA, 58 nt, Human
cuuccuacaggggaagaggccccucuggggagcugacucagccaggcucccugaacuu

SEQ ID NO: 267639 - RNA, 58 nt, Human
ggggggucucccuccggaccuaccucagggagcugagcgugcaggcgcuccagggcag

SEQ ID NO: 267640 - RNA, 58 nt, Human
auccagccagcccagcccugugaaagauggagcugacuugcugcaggggaccugauuu

SEQ ID NO: 267641 - RNA, 58 nt, Human
cguggccaggcaggaggggccggguucaggagcugagcaggggaugccugugcguggu

SEQ ID NO: 267642 - RNA, 58 nt, Human
uggcuucccccucagcaccaggguaccaggagcugaggagugugagcgugccgucauc

SEQ ID NO: 267643 - RNA, 58 nt, Human
cuccacuggaggagacccauugcugggaggagcugagggggaacaggagcagggccac

SEQ ID NO: 267644 - RNA, 58 nt, Human
cugugccgucauccccauuucaaagcagggagcugagguccugggaggggaaagugcu

SEQ ID NO: 267645 - RNA, 58 nt, Human
uuauuuucaaggaacuccaagggccacaggagcugacagguuuuucaauuaauauucc

SEQ ID NO: 267646 - RNA, 58 nt, Human
ggugaugggacaauucuucucgacuucaggagcugacagagccagaggcaccuaaacu

SEQ ID NO: 267647 - RNA, 58 nt, Human
gaaagaaccaacaaagaccuauccugguggagcugaccuccugggaaaagagucaaua

SEQ ID NO: 267648 - RNA, 58 nt, Human
gcuucaccucacccuaaucccccgggagggagcugacugaugcaaaaagcugaggggg

SEQ ID NO: 267649 - RNA, 58 nt, Human
uuguuuagauacucaucaggaccucacaggagcugagacuuaucagccagaauguguu

SEQ ID NO: 267650 - RNA, 58 nt, Human
agguccgguggggccaugaggaagaagaggagcugaagguaagaaacucauaaacaag

SEQ ID NO: 267651 - RNA, 58 nt, Human
gcguccacuuccaggaccagaaugacguggagcugaacaggcugaacucuguaugugc

SEQ ID NO: 267652 - RNA, 58 nt, Human
cugaaggcgcugauaaguccugugcugaggagcugacuugcccuuguuuacuuacaaa

SEQ ID NO: 267653 - RNA, 58 nt, Human
ccuuguugccuccgcucaggaugaaagaggagcugagagaagugcucugccugccagu

SEQ ID NO: 267654 - RNA, 58 nt, Human
guuagcagacaggccccgugaggcaaugggagcugaggccacacucagcacaaggcca

SEQ ID NO: 267655 - RNA, 58 nt, Human
gcagacagcaagggcuugcagccuaguaggagcugagcuuuccagccguguuguagcu

SEQ ID NO: 267656 - RNA, 58 nt, Human
ccaccccaccacaacugcccagguagcuggagcugaucauaaacaagaaggcucuggg

SEQ ID NO: 267657 - RNA, 58 nt, Human
cagccgaggggcuggguagugccgugcgggagcugaugguacagggcacucgcugucc

SEQ ID NO: 267658 - RNA, 58 nt, Human
ugcccugggcaucaucucccuccugcgaggagcugagccaguccccucacagauggau

SEQ ID NO: 267659 - RNA, 58 nt, Human
ccuaggcccaggacccauuauggggacaggagcugaagggcucccagggccccagggg

SEQ ID NO: 267660 - RNA, 58 nt, Human
aaggagaacaggcugaggggagcugagaggagcugaggugcuacccggagccccauuc

SEQ ID NO: 267661 - RNA, 58 nt, Human
cugggucuggaaggagaacaggcugaggggagcugagaggagcugaggugcuacccgg

SEQ ID NO: 267662 - RNA, 58 nt, Human
ccaagcuagcugaguggcguaugcagguggagcugaauauuggcucuggccucuuuag

SEQ ID NO: 267663 - RNA, 58 nt, Human
cugcuuuguuuaguagaggugggcaggaggagcugaggggcuggggcugggguguuga

SEQ ID NO: 267664 - RNA, 58 nt, Human
gggauaaagagggcaagguaaaguuuauggagcugaguguuagugacuuuggcauuuc

SEQ ID NO: 267665 - RNA, 58 nt, Human
gaugcaaauugcuucuuagugcuuauuaggagcugaagaaauggaaaagcagucucca

SEQ ID NO: 267666 - RNA, 58 nt, Human
cuuggcuggggucaggggcuggugccugggagcugaugaagcaggugccagggcugug

SEQ ID NO: 267667 - RNA, 58 nt, Human
ggcagcuucuguuucccucugcugccugggagcugaggcacccgugccaguggcagag

SEQ ID NO: 267668 - RNA, 58 nt, Human
cuggcuggccacuugacacccucccccuggagcugaugucugugacuacagggagauu

SEQ ID NO: 267669 - RNA, 58 nt, Human
ggucaguccucuuuccuugucccaggauggagcugauccaguaaccucggagacggga

SEQ ID NO: 267670 - RNA, 58 nt, Human
caguccagaugugccuagacacgaaauuggagcugaggacucucacgauaugcaaguu

SEQ ID NO: 267671 - RNA, 58 nt, Human
aaggggggcagcucaguggccccaagagggagcugauaucaugaggauaacauuggcg

SEQ ID NO: 267672 - RNA, 58 nt, Human
gcuaccaugacaacccugugguuuccaaggagcugagaauagaaggaaacuagcuuac

SEQ ID NO: 267673 - RNA, 58 nt, Human
ugaacagugucaccuugcaggcugugguggagcugacgcugggagucuucauaauaca

SEQ ID NO: 267674 - RNA, 58 nt, Human
acaggguccacacggcaaucagaagaaaggagcugagaugagguuuuggaaaacccug

SEQ ID NO: 267675 - RNA, 58 nt, Human
uuuaucaagggucagcccuuuucuauuuggagcugaaucuuuucuuucauguagaaau

SEQ ID NO: 267676 - RNA, 58 nt, Human
ccucccaccccagacauuuuuccuggugggagcugaagcacugggcuuccacaggccc

SEQ ID NO: 267677 - RNA, 58 nt, Human
guuuuuuauuuuaaaggaauuuggcuggggagcugaacagggcucccugugaucugaa

SEQ ID NO: 267678 - RNA, 58 nt, Human
cucuauuucuuuguuagaaguuuucuguggagcugaaacccagccucuguuugacugg

SEQ ID NO: 267679 - RNA, 58 nt, Human
aaugcgucccugaggagaaaaucugggaggagcugagugugaugaagguguauguugg

SEQ ID NO: 267680 - RNA, 58 nt, Human
gggagagacuuuugcggggagggaaggcggagcugaggacagccagcuccgcccuccc

SEQ ID NO: 267681 - RNA, 58 nt, Human
uggccccuccagacccugccugagcccaggagcugagucaccuccuccacucacucca

SEQ ID NO: 267682 - RNA, 58 nt, Human
ccugcggggugggggcaucgcugccuggggagcugaggcguuaccgcuguguuggggg

SEQ ID NO: 267683 - RNA, 64 nt, Human
guuuuuguacaauuuuuuuucauuuaauuggaaugaucuucagguuucuacaaauaggguaauu

SEQ ID NO: 267684 - RNA, 64 nt, Human
ccccgguucaacccuaccagcuugugguaacuuacugucacauagcucugacguuuuguuguaa

SEQ ID NO: 267685 - RNA, 64 nt, Human
ccaauuguccaagucaggagaauggugugaucaccugucacagacacuuuguccccucuccccg

SEQ ID NO: 267686 - RNA, 64 nt, Human
caggggccacuucacagcaugucagggaaaaucacugucacacaauuccaauggauuuugugcu

SEQ ID NO: 267687 - RNA, 64 nt, Human
uccugcccagauguugacccucacccagcgugagcugucacauaguaggagcuucuagaugcau

SEQ ID NO: 267688 - RNA, 64 nt, Human
aucgggcccugcagaggcagaaaacccuuaaaugcugucacagcucaagcaggagugucagggg

SEQ ID NO: 267689 - RNA, 64 nt, Human
ugaggaauuuguuuucgccuuacuuuuuuuucuucugucacaaugcuaagugguauccgagguu

SEQ ID NO: 267690 - RNA, 64 nt, Human
uucccacuccugcucccauagccuugaccugcuucugucacagcacugaucacacugagaugga

SEQ ID NO: 267691 - RNA, 64 nt, Human
ccacacacaacuacccuccaaaccaccacagucucugucacacccccacuaccgcugccacgcc

SEQ ID NO: 267692 - RNA, 64 nt, Human
guaaauauuuuaggcuuugcagcccauacggucucugucacagcuagucaacccugccauuuua

SEQ ID NO: 267693 - RNA, 64 nt, Human
gaauaggacaccccgcagcuucucuguaguggcucugucacagucaaaaaaugaaaagguuuuu

SEQ ID NO: 267694 - RNA, 64 nt, Human
uauguagauaaauauauauaguggccuuucaggacugucacaguaacacuuuauuuacagagcu

SEQ ID NO: 267695 - RNA, 64 nt, Human
aaguuaaagauauuuguugucuuugaaugauuugcugucacagacuauuugguagaagaaauau

SEQ ID NO: 267696 - RNA, 64 nt, Human
uuaagucauuccucauauggcaugcuuuucuuaccugucacaucuuggccauccuccucuagac

SEQ ID NO: 267697 - RNA, 64 nt, Human
uucugucuuuaauuaaccaagguguuaggugugacugucacaacuguuauguuuuccaguaaac

SEQ ID NO: 267698 - RNA, 64 nt, Human
ccuggcgacagggcagaccaaugaugccaggcagcugucacacgcuaguauuggcuucauugug

SEQ ID NO: 267699 - RNA, 64 nt, Human
ucucuacuaaaagugcaaaaauuagccgggcgugguggcgcaugccuguaauccuagcuacuca

SEQ ID NO: 267700 - RNA, 64 nt, Human
ucagcccccugugacaguagguuuugaugcuagugaucuucagaucuuucucucuggaaaugug

SEQ ID NO: 267701 - RNA, 64 nt, Human
aguaagccaauaagaaccuuuuaaacaaaucguccugucacaaaaugcuuucauauggcuuaau

SEQ ID NO: 267702 - RNA, 64 nt, Human
gcagguuacuuggcaaccauauugucaccuguaccugucacacaucuugaaaaauaaaacgaua

SEQ ID NO: 267703 - RNA, 64 nt, Human
gguugucucugugagagcacuguccccacccaaccugucacaacggccagaaccauacaccaga

SEQ ID NO: 267704 - RNA, 64 nt, Human
gggauuaugcuuuauaggauguggucccacaggccugucacagggccaaauugggucuguccau

SEQ ID NO: 267705 - RNA, 64 nt, Human
cacuuugucuccucagguagugaugaauuaguugcugucacaaaaggagggaaguagcacccaa

SEQ ID NO: 267706 - RNA, 64 nt, Human
caagucauuguccucugagcugcaguuuccucaucugucacaucgcuacagacaagaccucccu

SEQ ID NO: 267707 - RNA, 64 nt, Human
gaaaaugaauaaugguguaaugguucuccuggggcugucacauuuuauaggucagagugugacu

SEQ ID NO: 267708 - RNA, 64 nt, Human
auuuccuccaugauaaaaggauccaagugaggcccugucacagccuguggguaggggaugcggc

SEQ ID NO: 267709 - RNA, 64 nt, Human
cucuggaaagcgucccagaauauuagccaguuuucugucacaugcugguuuguuugcuugcuug

SEQ ID NO: 267710 - RNA, 64 nt, Human
aaucauauuuauuuggcuuuuuauuuaaaggauucugucacaagucuuauugaaaaguagauuu

SEQ ID NO: 267711 - RNA, 64 nt, Human
ucagagucuuguucaagagaaagugaucaccgagcugucacaucagcaaauauguagucaaggc

SEQ ID NO: 267712 - RNA, 64 nt, Human
agaacgaaaguaaagauguuugaauacuuaaacacugucacaagauggcaaaaugcugaaaguu

SEQ ID NO: 267713 - RNA, 64 nt, Human
uucacggucccaggagcuguccuugcugcaugcccugucacaguucccucgacucuuucaaagc

SEQ ID NO: 267714 - RNA, 64 nt, Human
cccuuccguggucugcuuucauuccgugugcuuccugucacagguaauggaaaacauaaguaga

SEQ ID NO: 267715 - RNA, 64 nt, Human
gccucgcauuccugggaagagggaccuguccaagcugucacacugggagucucagauggaagga

SEQ ID NO: 267716 - RNA, 64 nt, Human
agcaacucagcuuaaagguaauguauuugcuaaugaucuucagauuuuaucuuugucuacagaa

SEQ ID NO: 267717 - RNA, 64 nt, Human
ucuucuuucugugauaauucagaagauaguuauggaucuucaaugccucugagucauuguuaua

SEQ ID NO: 267718 - RNA, 64 nt, Human
uagcaugccuuaccuacagcacuaugugcauuugcugucacaauaaaguauauuuugucuugca

SEQ ID NO: 267719 - RNA, 64 nt, Human
cuuaccuuuauaagagccacuugauggaguagaucugucacauuacuaagauacgauauuucuu

SEQ ID NO: 267720 - RNA, 64 nt, Human
gucugcccacuaagcuccccccgaccccugcaggcugucacaugacucauugaguaguaaugau

SEQ ID NO: 267721 - RNA, 64 nt, Human
gggugacagggaaagcaugggcauuuuuguauugcugucacaugcuaacagagguuuguaauua

SEQ ID NO: 267722 - RNA, 64 nt, Human
auggggcugucauagacagacccaccaguaggaacugucacagaauggccugcugaacugggau

SEQ ID NO: 267723 - RNA, 64 nt, Human
uuuaauauuuuaauuauccuuguuuguauauguccugucacagaguguccucuugguguauucu

SEQ ID NO: 267724 - RNA, 64 nt, Human
cauuccuuuuuaaggaaaagugaagagcagugugcugucacacaccguuaagccagagguucug

SEQ ID NO: 267725 - RNA, 64 nt, Human
agcaaaggaguagaaagacagagcugggauguuucugucacaucagcuccacuuucagugaaag

SEQ ID NO: 267726 - RNA, 64 nt, Human
caugaaugacaagaaaacaagggaaagaguuaaccugucacauagcagguuaacuuuuucaggg

SEQ ID NO: 267727 - RNA, 64 nt, Human
uuccagaguccuccuuugccugauccuccaacagcugucacaacuuguguugagcaagcaguag

SEQ ID NO: 267728 - RNA, 64 nt, Human
augaauuguuguagccggugaauugagucguauucugucacauaauauuuugaagaaaacuugg

SEQ ID NO: 267729 - RNA, 64 nt, Human
gguuuuguaauguuuuuauguccugacucacauucugucacauacgcuuuccccuaauagucgg

SEQ ID NO: 267730 - RNA, 64 nt, Human
cuguauaugauguaacuguaucaaaaauaaaaagcugucacauauuuuguaaauuuuuaccuug

SEQ ID NO: 267731 - RNA, 64 nt, Human
gaagauauuaacaucuauugcuuuuucccuucaucugucacaggaaacagaagcccaggcacaa

SEQ ID NO: 267732 - RNA, 64 nt, Human
ccuuguucugagagguucuugccugcaggagaagcugucacaucucaagcaugugaggcaccgu

SEQ ID NO: 267733 - RNA, 64 nt, Human
auauacacuaagaacaaacuaaauugugauuuaugaucuucauuuauuuuaaugauaaugguuu

SEQ ID NO: 267734 - RNA, 64 nt, Human
gagguacaccagguggugcuuggaagagaugaaagaucuucauggcuguuuccacugaaaugga

SEQ ID NO: 267735 - RNA, 64 nt, Human
uuguaacucuuuagcacauuucucuaaacccuuucugucacagucuuuuuuuuaauuuauuuau

SEQ ID NO: 267736 - RNA, 64 nt, Human
ggccugcgcagcugcaggggacagacgccaaucacugucacagcagagucaccuuagaaauugg

SEQ ID NO: 267737 - RNA, 64 nt, Human
gcugaaggcagguggccugagagccaucugugaccugucacacucaccuggcuccagccucccc

SEQ ID NO: 267738 - RNA, 64 nt, Human
uuauauauauauauggaauauuucaaaauucaaacugucacauuaagaaacaugauaaccuaaa

SEQ ID NO: 267739 - RNA, 64 nt, Human
agcuaugugcuguuguuuuccaggaacaagugcucugucacauuuggggacuggagaugagucc

SEQ ID NO: 267740 - RNA, 64 nt, Human
guugucaaaggucaucaagcaguguucauuuauccugucacauguuucuguuucuauaguaauu

SEQ ID NO: 267741 - RNA, 64 nt, Human
gugacuucaaggucacgagguuccccucccaccucugucacaggcuucuugacuacguaguugg

SEQ ID NO: 267742 - RNA, 64 nt, Human
acacgcauccuguaucuacacguguauuuuguagcugucacacuaaccuuaauaagaauucuac

SEQ ID NO: 267743 - RNA, 64 nt, Human
gcaagcuaugcuucaguaugugguugauauuuuucugucacaaugauuucuuuaugcaugcaga

SEQ ID NO: 267744 - RNA, 64 nt, Human
uaaauugggguuucacaauucuuacauuauuugucugucacagaagagagcugcuuaugauuuu

SEQ ID NO: 267745 - RNA, 64 nt, Human
cacuuccacuaaacagugccaguguuuuaagguucugucacacucaguaacccacuucugguuc

SEQ ID NO: 267746 - RNA, 64 nt, Human
ccaagucucaguggcuucaucugucaagugggaucugucacaccagccauacuuaucucucugu

SEQ ID NO: 267747 - RNA, 64 nt, Human
cacuaccccuaaccugccaggaugcucaaguccacugucacaaucccuuucagaaaacauuagu

SEQ ID NO: 267748 - RNA, 64 nt, Human
gcugaccuuccaaagcacuuuuuauuuucauuuucugucacagacacucagggauagcaguacc

SEQ ID NO: 267749 - RNA, 64 nt, Human
cccugucccccgggguccugcaaggcuggacugugaucuucaaucauccugcccaucucuggua

SEQ ID NO: 267750 - RNA, 64 nt, Human
auuauuguugauagcuucugacuagguguuaagggaucuucauuaugaacaagaugaauuuuuu

SEQ ID NO: 267751 - RNA, 64 nt, Human
uugaacucccaucaacucuuauaaaauucaugcugaucuucauuaccguugcaugauuggaaau

SEQ ID NO: 267752 - RNA, 64 nt, Human
guuuuacuuuucacuggagaagacaaaacagggugaucuucauguuauuguuuuauacaaguga

SEQ ID NO: 267753 - RNA, 64 nt, Human
aaagaaaguauggcaucuuguaccacugcccugacugucacaacuccuaaccuugccauugccu

SEQ ID NO: 267754 - RNA, 64 nt, Human
augguucaaguauuaagcaguucauucuaccaagcugucacagguuuucagagaauuaucucaa

SEQ ID NO: 267755 - RNA, 64 nt, Human
uuuggagauuaugucuuuuucuuaaacaccauggcugucacacuucaguucaauuaaaucagaa

SEQ ID NO: 267756 - RNA, 64 nt, Human
guacagugagaguuaacaauccuaggaauccugccugucacaagcucccaguucccugucauuu

SEQ ID NO: 267757 - RNA, 64 nt, Human
ucucugggcaacguccauucagggugcggcauggcugucacaaagcuuuauuugagcaaauuau

SEQ ID NO: 267758 - RNA, 64 nt, Human
ucugguugaauggcuuuucuuagugugguauuugcugucacauaguuuuuccugggugagucug

SEQ ID NO: 267759 - RNA, 64 nt, Human
uuuacaugucaagaggaaaagcuguaagaaaaugcugucacagacccaucccuguggcaucguc

SEQ ID NO: 267760 - RNA, 64 nt, Human
aagaaaaaagcaacccucuuucaaacuguuaauucugucacagccuguauauuuuagucauuug

SEQ ID NO: 267761 - RNA, 64 nt, Human
aacuucauaaccagaauugucuguuggcuagcagcugucacagauaggcagggcacuugggaua

SEQ ID NO: 267762 - RNA, 64 nt, Human
cacuucauccacaggaaacacugcucuuccucaccugucacauaaagcauuuuuuuaaaaaguc

SEQ ID NO: 267763 - RNA, 64 nt, Human
uaaaaucaguuuuuuguuuaaaaaccuuguuucacugucacauaugaaaaaaauacugcauuga

SEQ ID NO: 267764 - RNA, 64 nt, Human
ccuugccuccgugcccagguugcugugggugcagcugucacagcccugagagucaggguggaga

SEQ ID NO: 267765 - RNA, 64 nt, Human
uucuccagcuuacccuagggugaccaaguagggccugucacaccaggguggcgcagcuuucugu

SEQ ID NO: 267766 - RNA, 64 nt, Human
gagaccaugaugcuugggcuuaggaucuugaggccugucacaugggcagcaugugcacagggga

SEQ ID NO: 267767 - RNA, 64 nt, Human
aagucauggucacaguaaagaguacacucagccacugucacaggcauauucccugcacacacau

SEQ ID NO: 267768 - RNA, 64 nt, Human
cucuugguaaagcucaaagccaggcuagccugagguggcgcagggcucuccuuccugucccuuc

SEQ ID NO: 267769 - RNA, 64 nt, Human
gcuucaaaauguauuuuuauauauuaccuuauuugaucuucacaacuguuguaaaauuugucaa

SEQ ID NO: 267770 - RNA, 64 nt, Human
agaugcagauuuguguuuuguuuucuuguuaucacugucacacagcuuauaacauguaugcuuu

SEQ ID NO: 267771 - RNA, 64 nt, Human
gguauaugaccugcguuuucugcagaugcugcugcugucacaacaugaacugcugacacagucc

SEQ ID NO: 267772 - RNA, 64 nt, Human
caacagaggcagucucucauagaguauaaagcagcugucacacuucaaagagcagugagucuaa

SEQ ID NO: 267773 - RNA, 64 nt, Human
cauugucaccuuguuacagcuaugugaagcagagcugucacaacuuuuccugucuacaggcagg

SEQ ID NO: 267774 - RNA, 64 nt, Human
ucaccucaaacccaaucacccccuccucuguaugcugucacaccuauauuauuaaacuuaucac

SEQ ID NO: 267775 - RNA, 64 nt, Human
uggacuucauuaugcuuuugaaaugcuuaucugccugucacauaaguuaaacuauuuaauuugu

SEQ ID NO: 267776 - RNA, 64 nt, Human
gaauauaaugauaagcuugauucuaguucagcugcugucacagucucauuuguucuuccaacug

SEQ ID NO: 267777 - RNA, 64 nt, Human
gcaugccaagcagcaugcucagugggguuuuaggcugucacaugcagcugagaaaagguauguu

SEQ ID NO: 267778 - RNA, 64 nt, Human
ggugugugugaggcugccagaacaagugcugggucugucacagagaaguuuaaaaaagaaaacu

SEQ ID NO: 267779 - RNA, 64 nt, Human
uuguagaaauguuacauugggauggauaguggugcugucacagaaggacaaaauauuccuagac

SEQ ID NO: 267780 - RNA, 64 nt, Human
uugcuggcuaaugugcauugucauauaauguacacugucacaucuuuacagucuuguauguuau

SEQ ID NO: 267781 - RNA, 64 nt, Human
ugguguuuguaagaaaaugcuagaagaaaacaaacugucacaaguuguuauguccaaaacuccc

SEQ ID NO: 267782 - RNA, 64 nt, Human
aagagaagaaacuuguauuugcagcuagagguuacugucacaucauagauuuaacauuuaccau

SEQ ID NO: 267783 - RNA, 64 nt, Human
uaucaaguguucuaaaaugaaauaugagaagauccugucacaauucuuagaucugguguccagc

SEQ ID NO: 267784 - RNA, 64 nt, Human
cucauaaauugguagcguauauaaagagaaguuccugucacauuauauucccacuagaauuauu

SEQ ID NO: 267785 - RNA, 64 nt, Human
aucacaaaguuuuucauucuuccuuguccaccaugaucuucaucacagucuuugauaugucugc

SEQ ID NO: 267786 - RNA, 64 nt, Human
guacaaacucaccugaaugggacuuuuuuagacagaucuucaugaccuguucccaccccaguuc

SEQ ID NO: 267787 - RNA, 64 nt, Human
gcgugaguuaguuucacugucuucuuggcuggaccugucacaagcaaccuuuaaguccuacagc

SEQ ID NO: 267788 - RNA, 64 nt, Human
auugugugaaggguuuauggauaaagcuguacuucugucacaauguggcaguacuuucugcuuu

SEQ ID NO: 267789 - RNA, 64 nt, Human
guucacaugaaugcaaaccugaaggcuaugaauucugucacaaccgcaaggugggugcucccuc

SEQ ID NO: 267790 - RNA, 64 nt, Human
ugcaguuaaauguuuaagguaaaaugauuggucucugucacagcuaaaagauuucaguagccuu

SEQ ID NO: 267791 - RNA, 64 nt, Human
augagugaaguguauauacuuuaauguguguauacugucacauuuugacuauuuuggaagacuu

SEQ ID NO: 267792 - RNA, 64 nt, Human
ugaauaggaguaguaaagccucaaggacaucugccugucacaauauauucucaaagugaucuga

SEQ ID NO: 267793 - RNA, 64 nt, Human
cccaugaugacccucaggaauugcaaaggcucugcugucacaaggagagcaggcugaguuugga

SEQ ID NO: 267794 - RNA, 64 nt, Human
uuuuucuggggauugaaaucuuuaguccuuggagcugucacauagcaggggcaaccucacacug

SEQ ID NO: 267795 - RNA, 64 nt, Human
uguuuagaacacugguuuaaagggauaaucaucucugucacauuagacuauccaucaugaccag

SEQ ID NO: 267796 - RNA, 64 nt, Human
gaaaauguaauauuuugauaauacuguaauauaccugucacacaaaugcuuuucuaauguuuua

SEQ ID NO: 267797 - RNA, 64 nt, Human
guauaauaaacgauacccagccagagucuacucacugucacaagcacaacgaguuuauaugaga

SEQ ID NO: 267798 - RNA, 64 nt, Human
gggaacauugcaguuacugcacagcuucuguucucugucacaaccccaggugauuugguccggu

SEQ ID NO: 267799 - RNA, 64 nt, Human
uuaagucuguguuccauugugccauucagguuugcugucacauaugcaucaucugaaaucauuu

SEQ ID NO: 267800 - RNA, 64 nt, Human
cucagcacgugccggccuuccucgaagcucgguacugucacaguggagccucucaacaacgcug

SEQ ID NO: 267801 - RNA, 64 nt, Human
caggaucucauucuguugccuaggcuggagugcaguggcgcaaucucggcucacugcaaccucu

SEQ ID NO: 267802 - RNA, 64 nt, Human
ccuagggugaccaaguagggccugucacaccaggguggcgcagcuuucugugugaugcagaugu

SEQ ID NO: 267803 - RNA, 64 nt, Human
gacagagcuguaucugcauagagcuggucucacuguggcgcaggccccggggggagugccugug

SEQ ID NO: 267804 - RNA, 64 nt, Human
uacuaaaaauacaaaaaaaaauuagcuggaccugguggcgcaugccuguaauccuagcuacuca

SEQ ID NO: 267805 - RNA, 64 nt, Human
uauaagaaauugaaagagcagaagaauuacagcccugucacaugugcccagcacuccgccccau

SEQ ID NO: 267806 - RNA, 64 nt, Human
cccauauuacuaaagcaaaauuuccagggguagggacugggacuccagaaccauuaauaaaaca

SEQ ID NO: 267807 - RNA, 64 nt, Human
gucaguuacaauaugagaaagauuuggaaaacgagacugggacuauggcuuauucagugaugac

SEQ ID NO: 267808 - RNA, 64 nt, Human
uuggcacauagcccacuaggaaaccaagaaguuugacugggagcguguguuucauugcacuggg

SEQ ID NO: 267809 - RNA, 64 nt, Human
uguuuuucaaaagaagaauguacauauuccacuugacugggaagcuguguggcccaaaucacug

SEQ ID NO: 267810 - RNA, 64 nt, Human
uuguugacaucaacauggcaauugcacucauguggacugggaccgugcgagcugccgugugggu

SEQ ID NO: 267811 - RNA, 64 nt, Human
ggcugguccugccccuuugagggggugcaaacaugacugggaccuaagagccagaggcugugua

SEQ ID NO: 267812 - RNA, 64 nt, Human
cgugaugcucccggauggaguggagaaacuaggagacugggacaagcaaaaggcugcaaacaac

SEQ ID NO: 267813 - RNA, 64 nt, Human
acugcacugugaacauuuuagaaaagguaugucagacugggauuaaugacagcaugauuuucaa

SEQ ID NO: 267814 - RNA, 64 nt, Human
uggauauaucacuauguauuuuaugaacagaauugacugggacuaauaucacaggaucaaucau

SEQ ID NO: 267815 - RNA, 64 nt, Human
cgauuccuuugaagugucucccacaggguggcaggacugggagaaucucugaggcgugucuucc

SEQ ID NO: 267816 - RNA, 64 nt, Human
uggggcaggggugaggcagguugaggggggaggggacugggacuggcggugagguuuugauacc

SEQ ID NO: 267817 - RNA, 64 nt, Human
cugaguacuaagcagcaguuuugcaaggaugggagacugggauagcuucccaucacagaacugu

SEQ ID NO: 267818 - RNA, 64 nt, Human
gggggacagacaggagguggauuuggagaccgaagacugggaugccugucuugaguagacuugg

SEQ ID NO: 267819 - RNA, 64 nt, Human
acugccuguuauugguauagcagugguauuugcagacugggaucauaaggagcccuuaaauacu

SEQ ID NO: 267820 - RNA, 64 nt, Human
uguuuuugaaaggacagcacaggaggagaaaagugacugggacgaugcuuccucucauccaaaa

SEQ ID NO: 267821 - RNA, 64 nt, Human
uccuaagucuuugcuuucccugauuucuugauuugaucuucaaaggugggcaaaguucccucug

SEQ ID NO: 267822 - RNA, 64 nt, Human
uguaucuuuccagagguauacagaauuaaaauuugaucuucaagcuuuaaugauccaguuuuaa

SEQ ID NO: 267823 - RNA, 64 nt, Human
gauaaauguuccgagagucuccauuguuguacaggaucuucaguuauucgaggggaaugaggca

SEQ ID NO: 267824 - RNA, 64 nt, Human
ugacuucaauuccugugcauuagugugaugauuucugucacauagcagcauuccgauucuaugu

SEQ ID NO: 267825 - RNA, 64 nt, Human
cacuugaccaucacauuucaguauucauagaugacugucacauuuuaaaauguucccacuugag

SEQ ID NO: 267826 - RNA, 64 nt, Human
uuucgcaguaauucucauguccccauaagcagagcugucacagugugcacuaccuuagauuguu

SEQ ID NO: 267827 - RNA, 64 nt, Human
ugaaggaucuugcucaguagcuggaacaaugcugcugucacacagucucuucucugaaacuuca

SEQ ID NO: 267828 - RNA, 64 nt, Human
ccuuugaaaauucauuuuggucuuuuuaccacaucugucacaaaaagccaggucuuagcgggcu

SEQ ID NO: 267829 - RNA, 64 nt, Human
ccaggcacaaggcaucuuguugccuugccacguccugucacagcuggguauccuuaccauguuc

SEQ ID NO: 267830 - RNA, 64 nt, Human
uaaauacaucaaaaauggguaauuuucuuugacucugucacacuaaacuucuuaacgaaauuuc

SEQ ID NO: 267831 - RNA, 64 nt, Human
ugugggaucuuuuucaccuaagaguuuccuagcucugucacaugaauucuuuuuuauccuaaug

SEQ ID NO: 267832 - RNA, 64 nt, Human
auacagcuuguacauggacauucugcaaacccagcugucacauuuuucuugcaacuccuuuugc

SEQ ID NO: 267833 - RNA, 64 nt, Human
aauggacagaguuaucaaggcacauucuccaccacugucacaggaaggacaugucaaucuuggu

SEQ ID NO: 267834 - RNA, 64 nt, Human
aauggacagaguuaucgaggcacauacuucaccacugucacaggaagaaccugccaagcuuggu

SEQ ID NO: 267835 - RNA, 64 nt, Human
uguauccuaacgucuaaugaggcagggaaugucacugucacacucugcagacgaggaagccaug

SEQ ID NO: 267836 - RNA, 64 nt, Human
uuaaauuagaaaauauucucuauuugaauuauuucugucacaguaaaaauaaaauacuuugagu

SEQ ID NO: 267837 - RNA, 64 nt, Human
gccugcagagcaccuguccuaaggagggaaaauccugucacacugccucuccccauucgugugu

SEQ ID NO: 267838 - RNA, 64 nt, Human
agugugaggcuccacuucuguugaauaugagcggcugucacacccaugagcaaguuuccuugau

SEQ ID NO: 267839 - RNA, 64 nt, Human
ucucuacuaaaaguacaaaaauuagccaggcgugguggcgcauaccuguaauuccagcuacuca

SEQ ID NO: 267840 - RNA, 64 nt, Human
uggagucuugcucugucacccaggcuggagugcgguggcgcaaucucggcucacugcauccucu

SEQ ID NO: 267841 - RNA, 64 nt, Human
uccaugccccaguucuaagcccuguggccaggugcugucacacagcaaaggggacuuugcaggu

SEQ ID NO: 267842 - RNA, 64 nt, Human
guguccaaacugagacauucuggagcuggaaagccugucacacuagagugugugugacaugucc

SEQ ID NO: 267843 - RNA, 64 nt, Human
uaugaccuuuaauuucuuuuuuauuuuaaauauacugucacacugaagcacugguugggcauuu

SEQ ID NO: 267844 - RNA, 64 nt, Human
gccuugacgggacuucaucuuauagacuguuaaacugucacacacaaacaggcuuuccaccccu

SEQ ID NO: 267845 - RNA, 64 nt, Human
ugcagguaaccacccugcacuucagguaauguuccugucacagcugucgacuaccccacgcugc

SEQ ID NO: 267846 - RNA, 64 nt, Human
agguuccgucucacggcguuuuaauuuauuuucacugucacacgcauagauccacgaggcacca

SEQ ID NO: 267847 - RNA, 64 nt, Human
uuacaggaccauauuuuagggucuguccucauaccugucacauuggugaucucacagaggaggg

SEQ ID NO: 267848 - RNA, 64 nt, Human
ugcagaggaaguguuccuaccugcaggaaggcaccugucacacagggcguucacucagaccauc

SEQ ID NO: 267849 - RNA, 64 nt, Human
uauuggucugggaggcaacauuaaugguaccagccugucacaacugagcaguucuaauaaugca

SEQ ID NO: 267850 - RNA, 64 nt, Human
uacucugcucacaugcacugcguguggcgcaucucugucacacccggggagaagguacgugugg

SEQ ID NO: 267851 - RNA, 64 nt, Human
agagcuucuacugaggagggcuguggcagagccacugucacacagaaugccggaggggcgcaga

SEQ ID NO: 267852 - RNA, 64 nt, Human
gcaggggaccagcauacccgggagcugucccugucugucacagcacaguggggccacgaggcug

SEQ ID NO: 267853 - RNA, 64 nt, Human
ugugaccuaaauuuaguccuauuguaauaugugccugucacaacacaaauaccccucuugaaag

SEQ ID NO: 267854 - RNA, 64 nt, Human
aggcuuugaucucuugggaaguucuucauagaugcugucacauuucuuaaagcaaccuuuuaau

SEQ ID NO: 267855 - RNA, 64 nt, Human
accugcagguguaagcauagaugaaauaacuguccugucacaugugcagcaggccauggagugu

SEQ ID NO: 267856 - RNA, 64 nt, Human
cucuacuaaaaauauaaaaaauuagccaggcauaguggcgcaugccuguuguagccccagcuac

SEQ ID NO: 267857 - RNA, 64 nt, Human
cgacagucuugcucugucaucaggcuggagugcaguggcgcaauuucggcucacugcaaccucc

SEQ ID NO: 267858 - RNA, 64 nt, Human
gguaaauauuuaugcuucacgguccauacagucucugucacaacuauucaguucugcuaguaua

SEQ ID NO: 267859 - RNA, 64 nt, Human
ggcugagaaucagacugacaguuuacagacgcugcugucacaaccaagaauguuaugugcaagu

SEQ ID NO: 267860 - RNA, 64 nt, Human
ucccgggccuccuuguguuuuugccucauuccuacugucacacaggucacgaggguggacuccc

SEQ ID NO: 267861 - RNA, 64 nt, Human
gguucucuacaugcauaacaaacccugcuccaaucugucacauaaaagucugugacuugaaguu

SEQ ID NO: 267862 - RNA, 64 nt, Human
gcuacucuugacuuagaccuauacugaaagaucucugucacauccaacuggaaauuccaggaac

SEQ ID NO: 267863 - RNA, 64 nt, Human
aauagcuuuagugaugccuccccucuuuaaauaccugucacaccguaugaauauggugagauca

SEQ ID NO: 267864 - RNA, 64 nt, Human
agcugauuugucuguucguaggaugaugugcagccugucacaguggcagccacaggcauucagu

SEQ ID NO: 267865 - RNA, 64 nt, Human
uauugaagguuuuagacccauagcagcuuugucucugucacaucagcaauuucagaaccaaaag

SEQ ID NO: 267866 - RNA, 64 nt, Human
aaagguagaaaauaucccuacugacaguaacuaccugucacauauuucucuuaggacuuuuaaa

SEQ ID NO: 267867 - RNA, 64 nt, Human
guagauagaaauacgaagauuaugauaagaaagucugucacagugcuauuuggaaaacggaaaa

SEQ ID NO: 267868 - RNA, 64 nt, Human
cugaaagcagacuguuaggagcaguauugaguggcugucacacuuugaggcaacuaaaaaggcu

SEQ ID NO: 267869 - RNA, 64 nt, Human
cauuuauaauaauauaauuucagucauuucuuaacugucacaucuauugaaaauggauauagau

SEQ ID NO: 267870 - RNA, 64 nt, Human
gauguaaacuaauguaccucaguaauuaaauaugcugucacaacauuuaggaauuaagacagua

SEQ ID NO: 267871 - RNA, 64 nt, Human
gagaugacgcagugaagggcugaggauggacgcacugucacaccucugcauuuccagccccagc

SEQ ID NO: 267872 - RNA, 64 nt, Human
ucuacuaaaaauacgaaaaaauuagcugggcaugguggcgcacaccuguagucccagcuacucc

SEQ ID NO: 267873 - RNA, 64 nt, Human
gucucuacuaaaaauacaaaauuagccagaugugguggcgcacaccuguaaucccagcuacuca

SEQ ID NO: 267874 - RNA, 64 nt, Human
cacaugcauuaaaaaauuuuucaagcugggccuaguggcgcacaccugcaaucccaacacuuug

SEQ ID NO: 267875 - RNA, 64 nt, Human
ucucuauuaaaaauacaaaaauuagcugggcgugguggcgcaugccuguagucccaacuacuag

SEQ ID NO: 267876 - RNA, 64 nt, Human
cuggcuuccagggaccuaugucuuuuaauacucacugucacauugggcaaaguugcuucuaauc

SEQ ID NO: 267877 - RNA, 64 nt, Human
uggcuuucugggucuuuuauuuguacccaugugucugucacaccaugaauguaccuggggaaau

SEQ ID NO: 267878 - RNA, 64 nt, Human
accauaagacagauaauuugggguugcuauaaugcugucacacaucucaaaguacauucaaauc

SEQ ID NO: 267879 - RNA, 64 nt, Human
uagugcccuugucaguuucuguaagaugccacuacugucacaagguguuucagacucuugauaa

SEQ ID NO: 267880 - RNA, 64 nt, Human
gauuccaaagguggaaugagagaguagggucaaacugucacaguaucugcuccauagguuucug

SEQ ID NO: 267881 - RNA, 64 nt, Human
caguauuuaugacucuguuaagcauaccguuugucugucacauuaguagauucugagauuaaaa

SEQ ID NO: 267882 - RNA, 64 nt, Human
ccuguccagccggguggcaccagcacucaggcuacugucacaucuugaucacagagcagaaagg

SEQ ID NO: 267883 - RNA, 64 nt, Human
guuugaauauggacaagagguacaggguuuuuaccugucacauugcauucuauugccuucuuug

SEQ ID NO: 267884 - RNA, 64 nt, Human
ccaccccaguugaggcucccacccacagggcugucugucacaaacccaccucuguugggagcua

SEQ ID NO: 267885 - RNA, 64 nt, Human
agaguagcugccaggaggacuuggccacccggcccugucacacugcagccccuuccccuucccu

SEQ ID NO: 267886 - RNA, 64 nt, Human
cccaacacccccaaauucaagaguggauguggcccugucacagguagaaaaaccuauuuaguua

SEQ ID NO: 267887 - RNA, 64 nt, Human
acauaagagacuucccuaauaaauuaccagggcccugucacaacaaaauggauaucauuucuag

SEQ ID NO: 267888 - RNA, 64 nt, Human
gauggccaggccaugcaggaaaggccaggggccucugucacaggaacccagagcaccaagugag

SEQ ID NO: 267889 - RNA, 64 nt, Human
cccuggguucugccgucuugccucacuuccccuccugucacaugcugacguuggacuuagcagg

SEQ ID NO: 267890 - RNA, 64 nt, Human
ucucuacaaaaaacacaaaaauuagcugggcauuguggcgcacaccuguauucccaucuaguca

SEQ ID NO: 267891 - RNA, 64 nt, Human
ucuacuaaaaauacaaaaaaauuagcugggcgugguggcgcaugccuguaauccuagcuacuug

SEQ ID NO: 267892 - RNA, 64 nt, Human
acagccgcaaaccaucuucaccugggggcauugaguggcgcagagccggguuucaucuggaauu

SEQ ID NO: 267893 - RNA, 64 nt, Human
cucuacaaaaaaauuuaaaacuuagcuggcauugguggcgcaugccuauagucccagcuacuug

SEQ ID NO: 267894 - RNA, 64 nt, Human
gagaaaaaaaggcaacagcugauucuuucaacaacugucacagaauggcugggcugagaacgcu

SEQ ID NO: 267895 - RNA, 64 nt, Human
gccacuuggugucugcaguccucauauuaacagucugucacagaaugcaguuaaaguauugauu

SEQ ID NO: 267896 - RNA, 64 nt, Human
uaagaguauuuuuuagguuuucacucaaucuuuccugucacaguaacgugaaaacugauuauuc

SEQ ID NO: 267897 - RNA, 64 nt, Human
auugcuuccagauucugaugugugagggaaaauacugucacaaugaaaaucuugacaauuuacu

SEQ ID NO: 267898 - RNA, 64 nt, Human
aaagagaagaccagaugugcauagaagccagucucugucacauacaccgcagguggucaccgag

SEQ ID NO: 267899 - RNA, 64 nt, Human
uccagacaguaaaucuuuuucgcuguuuucagcucugucacaugcucaguuugugacccaggga

SEQ ID NO: 267900 - RNA, 64 nt, Human
caaggugccugaaacgauacgugugcccacuccacugucacagugugccugaggaaggcugcua

SEQ ID NO: 267901 - RNA, 64 nt, Human
ugcuauucuccauacucuguaacaguugcauugacugucacauaaugcucauacuuaucuaaug

SEQ ID NO: 267902 - RNA, 64 nt, Human
cucaaugcauuggguuuggaugcucuccuguugucugucacacuuaacucuugcaucuccuugu

SEQ ID NO: 267903 - RNA, 64 nt, Human
uggggggaacauuacuugaauggggauauuuacccugucacaagagccacugguauuuuaguac

SEQ ID NO: 267904 - RNA, 64 nt, Human
uucaucugugaaauggggauaaaaauacuuguugcugucacaauuauuaccaucucuccagcua

SEQ ID NO: 267905 - RNA, 64 nt, Human
gcaaaauuuguuuucaaugccugugccucagcugcugucacaaauacccaucuuaggaucccau

SEQ ID NO: 267906 - RNA, 64 nt, Human
caggagaaauguuuccagacaacuccccaugauccugucacacagcauuauaaccacaaaucca

SEQ ID NO: 267907 - RNA, 64 nt, Human
agaagaagagaucagaaugaugaguccagaaccccugucacacagggaauaggugaaggaacua

SEQ ID NO: 267908 - RNA, 64 nt, Human
uggugucucccaacaugggagggaucagccccgccugucacaauaaaguuuauuaugaaaacag

SEQ ID NO: 267909 - RNA, 64 nt, Human
ggggagaagagaggcggaacugcuguguccucauguggcgcagccucaaacuggcauccaggca

SEQ ID NO: 267910 - RNA, 64 nt, Human
gucucuacuaaaaauacaaaauuagccggacaagguggcgcaugccuauaaucccagguacuca

SEQ ID NO: 267911 - RNA, 64 nt, Human
ugguuguaaaugguccuauuucacccccuucuuccugucacaugacccccccccauguuuuauu

SEQ ID NO: 267912 - RNA, 64 nt, Human
gggcugucugauugccccugcccugcucaccacccugucacagccacucccaagcccacaccca

SEQ ID NO: 267913 - RNA, 64 nt, Human
augguggagggcacuucagguccgugggccguaucugucacaauaaauggccagugcugcuucu

SEQ ID NO: 267914 - RNA, 64 nt, Human
uuuaagcaauauguuuuggucuugugaucacugucugucacaaguagagugaaagggguaaggg

SEQ ID NO: 267915 - RNA, 64 nt, Human
ggguccugccccaggcccagccagggcugaggagcugucacagagagggccucagcucugaccu

SEQ ID NO: 267916 - RNA, 64 nt, Human
aauuuuuuuauguugaggcuuuuucgacgugaaacugucacagauggcaaaauaaaugucacgg

SEQ ID NO: 267917 - RNA, 64 nt, Human
ccuuaccccaccccuacugauuaugaugucacugcugucacauauugucauacguggggggcug

SEQ ID NO: 267918 - RNA, 64 nt, Human
ucuuuuuucuuucuuuuuuuuuuauuaugguuagcugucacauacaacuuuuuuuuuuuuugag

SEQ ID NO: 267919 - RNA, 64 nt, Human
uguuuugguuuuuuguuuuuugaggaguuucccucugucacacaagcuggagggcaauggcgcc

SEQ ID NO: 267920 - RNA, 64 nt, Human
gccuccagaccagaccccaaaccagcccuugagucugucacacucucuugggccagccccagca

SEQ ID NO: 267921 - RNA, 64 nt, Human
ccgcacuguagaggccggucuuggugucccaucccugucacagccgcucacuccccgugccucu

SEQ ID NO: 267922 - RNA, 64 nt, Human
gaccgcagguucccccagccucagguugcuggagcugucacaugacugcauccugccugccagg

SEQ ID NO: 267923 - RNA, 64 nt, Human
gcaccauccaagaaacuacuaccuaucaagaaugcugucacaccuuugaagccuggcaagcaug

SEQ ID NO: 267924 - RNA, 64 nt, Human
uguugccaagucugugguccaugggcuuucauuucugucacauuucauuucuuggaaaaggccu

SEQ ID NO: 267925 - RNA, 64 nt, Human
ugaaaaaaaaaaacacaaaaauuagccaggcaugguggcgcaugccuguaaucccagcuacuag

SEQ ID NO: 267926 - RNA, 64 nt, Human
auaauaauaacaauauaagaacuagcugggcaugguggcgcaugcauguagucccagcuacucc

SEQ ID NO: 267927 - RNA, 64 nt, Human
gucucaacuaauaauacaaaauuagccaggcgugguggcgcaugccuguaaucccagcuacucg

SEQ ID NO: 267928 - RNA, 64 nt, Human
gacagucucgcucugucgcccaggcuggagugcaguggcgcaaucucggcucacugcaaccucc

SEQ ID NO: 267929 - RNA, 64 nt, Human
auguaaguuuguuuuuauuugccggcugaggauucugucacaaugaaagaaaacuguuuauaua

SEQ ID NO: 267930 - RNA, 64 nt, Human
caugcacuuugggauacagcguauaggugcagcccugucacaacaccaacagaaguagcagccu

SEQ ID NO: 267931 - RNA, 64 nt, Human
gccaggagucacuggacauguucauccuagaauccugucacacuacagucauuucuuuuccucu

SEQ ID NO: 267932 - RNA, 64 nt, Human
agguagacacacgggcauagccagcccacuccuacugucacaggcgccccaccauucaaccuuc

SEQ ID NO: 267933 - RNA, 64 nt, Human
agggaacauuaagcaaaaucccaauacacagagucugucacagacagguaagagaguugcccuc

SEQ ID NO: 267934 - RNA, 64 nt, Human
guagaauuuaacaugacuucugccccagcuuuaucugucacacaaggcugggcaccucuagugc

SEQ ID NO: 267935 - RNA, 64 nt, Human
aaugccuuucccccauaggccccaagaagagcggcugucacacucauugaaaugaaauggaccu

SEQ ID NO: 267936 - RNA, 64 nt, Human
ucuggaaacucuagauuuucugucauacccacaucugucacaguaccugcauugucuuggaaug

SEQ ID NO: 267937 - RNA, 64 nt, Human
agaugccugaucagaugagaagcccgccaugauacugucacagugccuagaaugggcucuuuau

SEQ ID NO: 267938 - RNA, 64 nt, Human
cuccucaaagacgcaaaacauuuuccaacaagagcugucacaguggcagcaaagcaggggccac

SEQ ID NO: 267939 - RNA, 64 nt, Human
ccugugagccucugcacaaagcagaggcugugggcugucacagaugcugugucaaccagggccc

SEQ ID NO: 267940 - RNA, 64 nt, Human
uuuugauauuacagagaguuauaaaaucaggaugcugucacaacuguugcgaaguauacacuga

SEQ ID NO: 267941 - RNA, 64 nt, Human
uggcaguggaaacuuguucucuuuuucacugacacugucacagcggaugacagacuuucuacgg

SEQ ID NO: 267942 - RNA, 64 nt, Human
aucuuaacugaggcucaggccacauaauuggacucugucacaaagggacuuuggaaaacuacuu

SEQ ID NO: 267943 - RNA, 64 nt, Human
ccuacugugacugcaaaacugguuuuacccaccacugucacacaccaaucagaacuugccagcu

SEQ ID NO: 267944 - RNA, 64 nt, Human
cagagucuugcucugucacccaggcuggagugcaguggcgcaaucucgggucacugcaagcucu

SEQ ID NO: 267945 - RNA, 64 nt, Human
gaaagucucgcugugucacccaggcuggagugcaguggcgcaaucucacugcauccuccgccuc

SEQ ID NO: 267946 - RNA, 64 nt, Human
cagaguuucucucuguugcccaggcuggagugcaguggcgcaauuucagcucacugcaaccucu

SEQ ID NO: 267947 - RNA, 64 nt, Human
ugaaaagagaaaugauaaugcuuccaaacuguagcugucacagggcaauuucuuuauuuauaac

SEQ ID NO: 267948 - RNA, 64 nt, Human
gccagcucccaauaaauggaggaggggaaagggacugucacagaaggagcaagggcagggugga

SEQ ID NO: 267949 - RNA, 64 nt, Human
augaagagggaaugcguaugaauuaaggcuacuacugucacagaagaucauagucuuugaugcu

SEQ ID NO: 267950 - RNA, 64 nt, Human
aucacucuuugcacacucuuguguuuuuugcucacugucacauucccagcaccuaguaugcuca

SEQ ID NO: 267951 - RNA, 64 nt, Human
ucuuggcuggauccuaacgcugauuuccacucugcugucacaaacauuuuuccccccguaaaau

SEQ ID NO: 267952 - RNA, 64 nt, Human
guuuucaaagggacuuuuguaaaaucaaaucauccugucacaaggcaggaggagcugauaauga

SEQ ID NO: 267953 - RNA, 64 nt, Human
gaagaaaacggccccuugaagagcuccccggccccugucacagucagucgucucauuuguccag

SEQ ID NO: 267954 - RNA, 64 nt, Human
uggauuuaaaaauuuuuaaacuaaauaauuugugcugucacagaaaugguauuguugcucuugu

SEQ ID NO: 267955 - RNA, 64 nt, Human
cugucuuguacauaggcaucuuauucacugcacccugucacacccagcaccccccgccccgcac

SEQ ID NO: 267956 - RNA, 64 nt, Human
guuuuccugucuguuucagagacgaguuguacugcugucacaggaaauggacgcuggauuacaa

SEQ ID NO: 267957 - RNA, 64 nt, Human
ccugcugaaacuuguuccaccucaguccccucaucugucacacgcaugugggguggaguaggga

SEQ ID NO: 267958 - RNA, 64 nt, Human
ucaugcaucagggcauuuagaaagagcuauguuucugucacagagacagcccuuuucucagaac

SEQ ID NO: 267959 - RNA, 64 nt, Human
uucuaguuuuuauaagucuuuuuauauauuuagccugucacaacagugcucaagauuguauuga

SEQ ID NO: 267960 - RNA, 64 nt, Human
ucaugugaccaccaucacaagagacagaacaguucugucacauggaucccuugcacugcccuuu

SEQ ID NO: 267961 - RNA, 64 nt, Human
aguucugaaguagauauauauauauauauaucuacugucacauuccauauauuuugaauauuua

SEQ ID NO: 267962 - RNA, 64 nt, Human
uuaagagucccggauuacuuucuuggcagcuuaaguggcgcagccaggccaagcuguguaaguu

SEQ ID NO: 267963 - RNA, 64 nt, Human
ucucuacugaaaauacaaaaauuagccaggugugguggcgcauaccuguagucccagcuacuug

SEQ ID NO: 267964 - RNA, 64 nt, Human
acaccuaaggucacgcagcuggguagauauacagcugucacaagagucuagaucaguuagcaca

SEQ ID NO: 267965 - RNA, 64 nt, Human
gaaggcuugugcaucaccuggcuugaguuccuugcugucacagaugauagguucauguacacaa

SEQ ID NO: 267966 - RNA, 64 nt, Human
agaugugauugagggguguucugcccugccuccacugucacagccuuuaauaaagaugugaauc

SEQ ID NO: 267967 - RNA, 64 nt, Human
agucugugaaaaagaaaccaucucucuggauaggcugucacacugacugaccuaaggguucaug

SEQ ID NO: 267968 - RNA, 64 nt, Human
gcacucgcaagagaagguaauuccuguggaaugacugucacacaucagagcuggcuggcccggg

SEQ ID NO: 267969 - RNA, 64 nt, Human
uugugccaggacugccgugcuccacugagcuccucugucacaccccauucuugccccucacugg

SEQ ID NO: 267970 - RNA, 64 nt, Human
cuacaccaauaacugcugcaggugugauuuuggucugucacacuguacaucuaucauaaugugc

SEQ ID NO: 267971 - RNA, 64 nt, Human
gaguaguauugcagagaaugugaugaguuauucacugucacaacuuuuucuauagaaaacaggg

SEQ ID NO: 267972 - RNA, 64 nt, Human
caaaaccaacuaaaaagugauucuugcacaugaacugucacauguuuaaaaauguguuuuuuag

SEQ ID NO: 267973 - RNA, 64 nt, Human
guaugagcaacaaaaaaucagaaaagagccuugacugucacaagaaauauuuccaccucaaaaa

SEQ ID NO: 267974 - RNA, 64 nt, Human
gcugggccauuugaucuccuuucaccuugcauugcugucacagcaccuuguaugauggcaggac

SEQ ID NO: 267975 - RNA, 64 nt, Human
cagugcacuccagcuugggcgacagaucaagacucugucacacacaaaacaaacaaacaaauuu

SEQ ID NO: 267976 - RNA, 64 nt, Human
cuuuuaaaaaauauuuuuggauaucauugaugugcugucacacuauauauugagugacuuucug

SEQ ID NO: 267977 - RNA, 64 nt, Human
cacacgauccggagagccgaaggccgcgugcuuccugucacaugggcuguaaucauuuguaguu

SEQ ID NO: 267978 - RNA, 64 nt, Human
ggaggggcugguccuuccccucggugcuggcucucugucacaaugccucaaaagacauggaacc

SEQ ID NO: 267979 - RNA, 64 nt, Human
gagcagcuagacaaaauaaucugcaaauuuaaauguggcgcauuugacucauucuugagaaauu

SEQ ID NO: 267980 - RNA, 64 nt, Human
cccggcggaagcuacagucucuacccugagcuccguggcgcagagcgcuccacgcguauucacg

SEQ ID NO: 267981 - RNA, 64 nt, Human
uagguccgugcagcccaagggucagcccucuugacugucacaugcugcccccacccagccuaaa

SEQ ID NO: 267982 - RNA, 64 nt, Human
cuguuccccucuccagcugcgggucuguaggcagcugucacaucugaaggguuucugcaaccug

SEQ ID NO: 267983 - RNA, 64 nt, Human
ccaugcuguccucacauacgguaaagccaaagagcugucacaugggccagaaacaugagccacg

SEQ ID NO: 267984 - RNA, 64 nt, Human
uauuuuauuuuaaauugguagaauucuuugcgaacugucacagagaaauuccuuuucaugacuu

SEQ ID NO: 267985 - RNA, 64 nt, Human
gugggccauggcagaaguaggggguugguuggaccugucacaugaaauggaucagcacuugaau

SEQ ID NO: 267986 - RNA, 64 nt, Human
ccguuuucuuacacacccccagagagaggagggacugucacacuggugcugagugaccgggggc

SEQ ID NO: 267987 - RNA, 64 nt, Human
ccucuucaccccccacucaccaguguccccuccacugucacauuguaacugaacuucaggauaa

SEQ ID NO: 267988 - RNA, 64 nt, Human
ccauuagcuaacauacccucccucuccacaaccccugucacauaccuuucaggaggugacaguu

SEQ ID NO: 267989 - RNA, 64 nt, Human
acagugaaugugucuggaccucauguuguugaggcugucacaguccugaguguggacuuggcag

SEQ ID NO: 267990 - RNA, 64 nt, Human
ggugccuguugaaucugagcugcagguuccuuaucugucacaccugugccuccucagaggacag

SEQ ID NO: 267991 - RNA, 64 nt, Human
acuuugugguccuugccgaguuuuguaggggucacugucacaugcuugugcccuggaagcccca

SEQ ID NO: 267992 - RNA, 64 nt, Human
agggggccuuguggcucucagccaugccacaucccugucacacacccagggcauccauuccuaa

SEQ ID NO: 267993 - RNA, 64 nt, Human
uucugcaaauacaugcccuaaaguuucucagagccugucacaaaggccggcugcccccaaaggu

SEQ ID NO: 267994 - RNA, 64 nt, Human
gaugacaagaacuaacgcuccugaguaccagccccugucacaucugacuguggguuucaagugg

SEQ ID NO: 267995 - RNA, 64 nt, Human
cccaccgcgggcugucugcucucccuccuagcagcugucacacugaaguuuuguccucugcugu

SEQ ID NO: 267996 - RNA, 64 nt, Human
gaucaaauuaagauucucugcccagccgggcacaguggcgcaugccuguaaucccagaacuuug

SEQ ID NO: 267997 - RNA, 64 nt, Human
gucucuacuaaaaauauaaaaucagccaggcaugguggcgcacaccuauaaucucagcuacuca

SEQ ID NO: 267998 - RNA, 64 nt, Human
cuguaaaggugucuucucuucucagacucuuccucugucacacgucugacuccuucacgucagg

SEQ ID NO: 267999 - RNA, 64 nt, Human
aauggugucagugagguggggaaaggaagucuuccugucacauaugcagguucguuuucauucu

SEQ ID NO: 268000 - RNA, 64 nt, Human
aucgaccuggagcggccccagagcaacagcagcgcugucacagggaccucgggucaguacuuuc

SEQ ID NO: 268001 - RNA, 64 nt, Human
gcaaggaacagccccuuuaaggagcaaaucacuucugucacaguuauuaugguaauaugaggca

SEQ ID NO: 268002 - RNA, 64 nt, Human
aacuuaaaacuaaguuuguuaccugcuuuuuauacugucacaaagguuuuugaaaaagcugggg

SEQ ID NO: 268003 - RNA, 64 nt, Human
cacuccaacuccuuccuuuaggcugugcucuugccugucacaaagaggcaacguagccacugcc

SEQ ID NO: 268004 - RNA, 64 nt, Human
aaauaucagugaguuuuaaaucagaacaaguuaccugucacauugaagaaaaggguaggcacua

SEQ ID NO: 268005 - RNA, 64 nt, Human
caugugcagcugaaauagugaucugcuucugucacugucacauagacagcccugcaugcccccu

SEQ ID NO: 268006 - RNA, 64 nt, Human
gauacucaggguaugcuaucuggaggccuggacacugucacacucaacaucaccucucaggcaa

SEQ ID NO: 268007 - RNA, 64 nt, Human
cacauaagaaccauggccuuggauuauucacugccugucacaagccucaguguggccugagaaa

SEQ ID NO: 268008 - RNA, 64 nt, Human
ccugcugcccccuccacccccaacccaguccuaccugucacaccggacggacccgcugugccuu

SEQ ID NO: 268009 - RNA, 64 nt, Human
ugucggguucgaccacuuggccgaugggaauggucugucacagucugcuccuuuuuuuuguccg

SEQ ID NO: 268010 - RNA, 64 nt, Human
aaggguguaggaaagguuuugucaucacacaacccugucacacaugaauguguaguggagagaa

SEQ ID NO: 268011 - RNA, 64 nt, Human
ggcuaggccaauugccuuuugcacuuccccguuccugucacauuuccccagccccaccuucccc

SEQ ID NO: 268012 - RNA, 64 nt, Human
cagagucucgcucugucaccuaggcuggagugcaguggcgcaaucucaccucacugcaagcucu

SEQ ID NO: 268013 - RNA, 64 nt, Human
ucucuaccaaaauuacaaaaauuagccgagcaugguggcgcaugccuguagucgcagcuacucg

SEQ ID NO: 268014 - RNA, 64 nt, Human
gucucuauuaaaaauacaaaaguagccaggcaugguggcgcaugcguguaaucccagcuacuug

SEQ ID NO: 268015 - RNA, 64 nt, Human
ugcucuugagcagguggagccauggugcucugugguggcgcaugauucacugagcaaacagcac

SEQ ID NO: 268016 - RNA, 64 nt, Human
ggcucucagggacccccugggucggcuucugucccugucacacccccaaccccagggaggggcu

SEQ ID NO: 268017 - RNA, 64 nt, Human
uauaaaagauuuuaauuuuaugagggcaauacaacugucacaucagaaacaagaaaacaaauga

SEQ ID NO: 268018 - RNA, 64 nt, Human
cagcaccucucuuugccuccuacuugcucagucucugucacaagaacuggaucuccauccccuu

SEQ ID NO: 268019 - RNA, 64 nt, Human
ucacacacacccucaugugugaagggcagagacacugucacaaacaggcaugccccuuagaaga

SEQ ID NO: 268020 - RNA, 64 nt, Human
acgcuuaagacaccucugcaugcagucaaagccacugucacaagccggcaggcacuggugagga

SEQ ID NO: 268021 - RNA, 64 nt, Human
agggaagaauaucagaauugguagacauuucaaacugucacauuagggauacaaaaaugaacag

SEQ ID NO: 268022 - RNA, 64 nt, Human
ggaaggaagaaugaggacagucccgucguaagaccugucacaacaauaagcagggaggggagau

SEQ ID NO: 268023 - RNA, 64 nt, Human
cacuccagccugggcagcaagagcaaaacaaccucugucacacacacaaaaaaaaaaaaaaagg

SEQ ID NO: 268024 - RNA, 64 nt, Human
gaaaugugaagaaugugacaaagccuuuaaauggcugucacacuugauuguagguaagauaaua

SEQ ID NO: 268025 - RNA, 64 nt, Human
acaucccuuuuuguugagaaccucccuugaaugucugucacacucacaccugacgggaugguua

SEQ ID NO: 268026 - RNA, 64 nt, Human
ucuucuucacuuacccacagcagcaacaccaggccugucacacagaugaauguguugagggaau

SEQ ID NO: 268027 - RNA, 64 nt, Human
ugcacauuguaucucugaucuugggcugucugcacugucacaggugcacacacucgcucaugcu

SEQ ID NO: 268028 - RNA, 64 nt, Human
uuuuuccuauagaugucucagauguucaguuuuccugucacaaggcuuccagucuguauuaguu

SEQ ID NO: 268029 - RNA, 64 nt, Human
cacugucguuccccguguguccccagcccggucccugucacauuuguuaaaugaaagaacaaug

SEQ ID NO: 268030 - RNA, 64 nt, Human
aagaagccuuggcaaaaugauggaugagagcuuucugucacaauucuaaccuuaacagauaaua

SEQ ID NO: 268031 - RNA, 64 nt, Human
guggucagaugcagguuggaaggggccuugcugaguggcgcaaggccgagcguucccagcaggg

SEQ ID NO: 268032 - RNA, 64 nt, Human
uugagucuugcucugucacugaggcuggagugcaguggcgcaauuucagcucacugcaaccucu

SEQ ID NO: 268033 - RNA, 64 nt, Human
uauaaaacaguaucagugugucaaagcauuauggcugucacaagcuugugaaaggaaaauaaaa

SEQ ID NO: 268034 - RNA, 64 nt, Human
gaaggccuuccagaucuggcuccagggucaccaccugucacagcaauaccugggaccaugcucu

SEQ ID NO: 268035 - RNA, 64 nt, Human
ggcuguggcccagcugggucugacaaggacccagcugucacaucgugaauauuuaaauguccug

SEQ ID NO: 268036 - RNA, 64 nt, Human
cuugguaacuuagauuaaacugagcauuguuuuucugucacaaauguuuuccuuaugacacugg

SEQ ID NO: 268037 - RNA, 64 nt, Human
uuacuuuuacaaagaucaagaauacugcccauuacugucacaauuuuccagauauuauauaaug

SEQ ID NO: 268038 - RNA, 64 nt, Human
caagugccggaaagucuaggggucugugcaaggccugucacacugaccaccuccuacucccacc

SEQ ID NO: 268039 - RNA, 64 nt, Human
gggaugugggauggcagcagccagguauguagcccugucacaggacagcucacugugguuuugc

SEQ ID NO: 268040 - RNA, 64 nt, Human
uugguauuggagaagggauggucaguuagccugucugucacacgacggaauggauacugggccc

SEQ ID NO: 268041 - RNA, 64 nt, Human
ugcuuuaaagcuacuuuuguccacaaaugaaauacugucacaguagacgcuuaaaugccacguu

SEQ ID NO: 268042 - RNA, 64 nt, Human
cuccccagcauuggcccuaaucauccugaucaugcugucacaaacuuaagaggaaauaaggaaa

SEQ ID NO: 268043 - RNA, 64 nt, Human
uauaaacucuuuuuaguucuuaacccuugccuuccugucacaggguuugcuuguugcugcuaua

SEQ ID NO: 268044 - RNA, 64 nt, Human
auugaaaguguauuuuugguaugaagcugguuuucugucacaauuguaauuucccaaauuuuaa

SEQ ID NO: 268045 - RNA, 64 nt, Human
aggacugcacauauuucauuuccucugauuuaugcugucacaaauugaaaaucugaguguaguu

SEQ ID NO: 268046 - RNA, 64 nt, Human
ccagcaaagucccccgugucccuugcugaguauucugucacagacaagccuccauuaaagccac

SEQ ID NO: 268047 - RNA, 64 nt, Human
cuaaaaugucgaggucucuugaagacuugagaagcugucacaaggucacuacaagcccaaccug

SEQ ID NO: 268048 - RNA, 64 nt, Human
uggagucucacucuguggcccaggcuggagugcaguggcgcaaucuuggcucacugcaaccucc

SEQ ID NO: 268049 - RNA, 64 nt, Human
ucuauacuaaaaauacaaaaaauagccaggcaugguggcgcacgccuguggucccagcuacuug

SEQ ID NO: 268050 - RNA, 64 nt, Human
cucugcccggggagccucaggcaguccucuccugcugucacagcugccauccacuucucagucc

SEQ ID NO: 268051 - RNA, 64 nt, Human
gcagguguccacucacagguggcgcucaccuaggcugucacaggacccaccuccaugccaggca

SEQ ID NO: 268052 - RNA, 64 nt, Human
ccacggcccucaguugccagggauggggccaccacugucacacuguggaauacaagacagugaa

SEQ ID NO: 268053 - RNA, 64 nt, Human
augccuacaaagcucugaauucaggucccaguugcugucacaaaggagugagugaaacucccac

SEQ ID NO: 268054 - RNA, 64 nt, Human
aucccgaggcagccaggguuuguuuugcgcucuccugucacaaaugcugcacuauugguucuua

SEQ ID NO: 268055 - RNA, 64 nt, Human
uguguccugccaccaugugggucagauguacucucugucacaugaggagagugcuaguucaugu

SEQ ID NO: 268056 - RNA, 64 nt, Human
gagcuuuccugugauuucuguuucacguuccuuccugucacacccuccuuuggcgucucugugu

SEQ ID NO: 268057 - RNA, 64 nt, Human
gaacugcucugucuuuguaacuacucaaggccaacugucacaugaaggaaugaauaaagaguuu

SEQ ID NO: 268058 - RNA, 64 nt, Human
cccagcacuggagaagcagcgcugugggggcaaucugucacacucucagagucugggacuugac

SEQ ID NO: 268059 - RNA, 64 nt, Human
gcucccacaguuuggagggacaaagcuaauugaucugucacacucaggcucaugggcaggcaca

SEQ ID NO: 268060 - RNA, 64 nt, Human
ggaaauauuuugggcuuugcaggccaugcggccucugucacaucuacucaacucugcuguugac

SEQ ID NO: 268061 - RNA, 64 nt, Human
uaacauuucuugaggcucuaccacauagcaggcacugucacagaguaauggcauuaauccccau

SEQ ID NO: 268062 - RNA, 64 nt, Human
uauguuuguuccaaaaccaucauuuaaaucucuacugucacauuuuguuucuuaaaagcaaagc

SEQ ID NO: 268063 - RNA, 64 nt, Human
uauguaauaaaaaaaguuggauuuuuguguaugucugucacauuauuuagagagaaguaaucuu

SEQ ID NO: 268064 - RNA, 64 nt, Human
guucauguugguucugaaugguucacugcagcuccugucacaagcugggauggauuuaucacau

SEQ ID NO: 268065 - RNA, 64 nt, Human
cccugugaggugccagcacgggccaccugcggguguggcgcagcccagggcucacacugcgugg

SEQ ID NO: 268066 - RNA, 64 nt, Human
ucucuacuaaaaauacaaaaauuagcugggcaugguggcgcauaccuguaaucccagcuacuug

SEQ ID NO: 268067 - RNA, 64 nt, Human
cuuuugucuccggggcugaguaaauaaacauguucugucacaaauagcagcaccacuuuggauu

SEQ ID NO: 268068 - RNA, 64 nt, Human
agcacuacagcauaccccucuacaacauacagcccugucacauugagaucauaaucccuccugu

SEQ ID NO: 268069 - RNA, 64 nt, Human
aaauuggaauuugaacaacaauguaaaaccuguucugucacaaauguuccugaaagcaccacag

SEQ ID NO: 268070 - RNA, 64 nt, Human
ugcaaacucugccucccagguuuaagcgauucuccugucacagcuucccaaguagcugggauuu

SEQ ID NO: 268071 - RNA, 64 nt, Human
cccuuaucugaccucuuuggaaacuauaacauagcugucacaguauagucacaauccacaaaug

SEQ ID NO: 268072 - RNA, 64 nt, Human
uggagucucgcucugucgcccaggcuggagugcaguggcgcaaucucagcucacugcaagcucu

SEQ ID NO: 268073 - RNA, 64 nt, Human
ccgcccugcuccggccccaguguggugggcgaggguggcgcaugggaggccgagccugaauccu

SEQ ID NO: 268074 - RNA, 64 nt, Human
ggaauuucacucuugucgcccaggcuggaguguaguggcgcagucucagcucacugcaaccucc

SEQ ID NO: 268075 - RNA, 64 nt, Human
cagcaguagacacagugcacaggggagaagagggguggcgcagaaggguugggggccuguaugc

SEQ ID NO: 268076 - RNA, 64 nt, Human
gcccagcuguuccccucgggaacaugagguggugguggcgcagcagacugcgaucaauucugca

SEQ ID NO: 268077 - RNA, 53 nt, Human
ucuucguggacaucaugugacucguggcgcaugccccagcccugccugaggug

SEQ ID NO: 268078 - RNA, 64 nt, Human
gacagucuugcucuaucgcccaggcuggagugcaguggcgcauucuaggcucacugcaacuucu

SEQ ID NO: 268079 - RNA, 64 nt, Human
cggagucucgcucuuucgcccaggcuggagugcaguggcgcaaucucggcucacuguaaucucc

SEQ ID NO: 268080 - RNA, 64 nt, Human
ggagacugggagccuucacuucggccuccgauugguggcgcauaggguguaaccaauaggaaac

SEQ ID NO: 268081 - RNA, 64 nt, Human
cggagucucucacugucgcccaggcuggagugcaguggcgcaaucucggcucacugcaaccucc

SEQ ID NO: 268082 - RNA, 64 nt, Human
ucacacagaaagcaacuguacacaguagaauucuguggcgcagaccaugcuguauuaacacauc

SEQ ID NO: 268083 - RNA, 64 nt, Human
ucucuacugaauacacaaaaauuggcuggacaugguggcgcaugucuguaaucccagcuacugu

SEQ ID NO: 268084 - RNA, 64 nt, Human
acggagucucgcucugucgccaggcuggagugcaguggcgcagucucggcucgcugcaaccucu

SEQ ID NO: 268085 - RNA, 64 nt, Human
aagggucucccucuguugccaaggcuggagugcaguggcgcaaucuuaacucauugcaaccucc

SEQ ID NO: 268086 - RNA, 64 nt, Human
ucucuacugaaaacacaaaaauuagacgggcaugguggcgcacaccuguaaucccagcuacuug

SEQ ID NO: 268087 - RNA, 64 nt, Human
agucucgcucuguugcccaggcugcuggagugccguggcgcaaucucggcucacugcaaccucc

SEQ ID NO: 268088 - RNA, 64 nt, Human
agacguccagccgcaggcggcugcugggccccagguggcgcacggauggugaggggcugagaau

SEQ ID NO: 268089 - RNA, 64 nt, Human
cggagucucacucuguuacccaggcuggaaugcaguggcgcaaucuuggcucacuuuaaccucc

SEQ ID NO: 268090 - RNA, 64 nt, Human
gucucuacuaaaaguacagaauuagccgggcgugguggcgcaugcccauaaucccagcuacuga

SEQ ID NO: 268091 - RNA, 64 nt, Human
uagagacccaggagugccugauugucccacagggguggcgcacagcucugggaccacucagaag

SEQ ID NO: 268092 - RNA, 64 nt, Human
ucucuacuaaaauacaaaaaauuagcugggcaugguggcgcacaccuguagucccagcuacucu

SEQ ID NO: 268093 - RNA, 64 nt, Human
ucucuacuaaaaauacaaaaauuagcugggugcaguggcgcaugcuuguaaucccagcuacuca

SEQ ID NO: 268094 - RNA, 64 nt, Human
cugcccaccuggccucugcacuccccugcuggguguggcgcagcauauucaggaagcucagggc

SEQ ID NO: 268095 - RNA, 64 nt, Human
cuaccaaaaauagaaaaaaauauagccgggccugguggcgcacgccuguagucccagcuacucg

SEQ ID NO: 268096 - RNA, 64 nt, Human
aucccagcugacuccggucggccucaacccagggguggcgcaggcaccuugcaagccucgagcu

SEQ ID NO: 268097 - RNA, 64 nt, Human
cugaacauccaccugucuggacguugcauggaggguggcgcaggccucuccaaucccuggcgua

SEQ ID NO: 268098 - RNA, 64 nt, Human
uucuacaaaaaauuuguaaaauuagccaggcaugguggcgcacgccuguagucccagcugcuug

SEQ ID NO: 268099 - RNA, 64 nt, Human
auuguaagugcaguggggguaagcaguccugugaguggcgcaugaacgcuggagcuuauuccgc

SEQ ID NO: 268100 - RNA, 64 nt, Human
ucucuacuaaaaaugcaaaaacuagccgggcaugguggcgcacaccuguaauccuagcuacucg

SEQ ID NO: 268101 - RNA, 64 nt, Human
uuuccaguggucaugcucagccuugcugcucugcguggcgcaggugccaugccugcucccuguc

SEQ ID NO: 268102 - RNA, 64 nt, Human
aucuccacuaaaaauacaaaauuagcugggugugguggcgcaugccuguaaucccagcuacuug

SEQ ID NO: 268103 - RNA, 64 nt, Human
ccccagagacaauucaagauuucuauaugggguuguggcgcagggggagggagauuuaucuuga

SEQ ID NO: 268104 - RNA, 64 nt, Human
accccgucucuacuaaaaauacaagccgggcgugguggcgcaugccuguaaucccagcuacuca

SEQ ID NO: 268105 - RNA, 64 nt, Human
ccccccucuucccccaccccaugcccccaauucuguggcgcauccagauugugaaaauguacaa

SEQ ID NO: 268106 - RNA, 64 nt, Human
ggagucuugcucuugucgcccaggcuggagugcaguggcgcaaucucagcucacugcaaccucc

SEQ ID NO: 268107 - RNA, 64 nt, Human
uggagucucgcucugucgcccaggcuggagugcaguggcgcaaucucagcucacugcaagcucc

SEQ ID NO: 268108 - RNA, 64 nt, Human
cuauacuaaaaaauucaaaaauuacccggacgugguggcgcaugccuguaaucccagcuacuug

SEQ ID NO: 268109 - RNA, 64 nt, Human
gaggggcgcgcaugguccgccagggcugugggccguggcgcauuuuccgacuguuuguccagcu

SEQ ID NO: 268110 - RNA, 64 nt, Human
ucucauucaauugcaagaauagaggccagacacgguggcgcaugccuguagucccagcuaacug

SEQ ID NO: 268111 - RNA, 64 nt, Human
ucucuacuaaaaauacaaaaauuagcugggcgugguggcgcaugccuauaaucccagcuacuug

SEQ ID NO: 268112 - RNA, 64 nt, Human
uggagucucgcucugucgcccagguuggagugcaguggcgcaaucucggcucacugcaagcucc

SEQ ID NO: 268113 - RNA, 64 nt, Human
ucuuuacaaaaaauacaaaaauuagccuagcaugguggcgcauaccuguaguccuagcuacuca

SEQ ID NO: 268114 - RNA, 64 nt, Human
ggagucuuacucuguugccuaggcuggagugaaaguggcgcaaccucugccucccaggucaaag

SEQ ID NO: 268115 - RNA, 64 nt, Human
ggcggcagccccggagggcggcugggagcugagcguggcgcaagcgggccagggcgcgggcgcg

SEQ ID NO: 268116 - RNA, 64 nt, Human
uucuacuaaaaauauaaaaaauuagccaggaguaguggcgcaugccuguagucccagcuacuug

SEQ ID NO: 268117 - RNA, 64 nt, Human
agaguuuugcucuuguugccuaggcuggagugcaguggcgcagucuuggcucaccucaaccucu

SEQ ID NO: 268118 - RNA, 64 nt, Human
auggagucuugcucugucaccaggcuggaaugcaguggcgcaaucugggcucacugcaaccucc

SEQ ID NO: 268119 - RNA, 64 nt, Human
gaggggaacgagaacuuguccaugugccaagaggguggcgcacccccacuccauggggacagaa

SEQ ID NO: 268120 - RNA, 64 nt, Human
gcagcauccugagauuuuaaauccugaaguguggguggcgcacacaccaaguagggagcuaguc

SEQ ID NO: 268121 - RNA, 64 nt, Human
aucucuacuaaaaauacaaaauuagccgggugugguggcgcaugccuguaaucccagcuacuug

SEQ ID NO: 268122 - RNA, 64 nt, Human
uaaaaagaaaaaaaacaauucucggcugggcgcgguggcgcaugccuguaaucccagcacuuug

SEQ ID NO: 268123 - RNA, 64 nt, Human
cggugucucgcugcaucacccaggcuggagugcaguggcgcaaucucgccuuccugcagucucc

SEQ ID NO: 268124 - RNA, 64 nt, Human
ccugucuacugaccaauaccccgacucaccuuguguggcgcacuucagaaucagauauaccuag

SEQ ID NO: 268125 - RNA, 64 nt, Human
agaaccugguagcgccuccuggggcagcacguggguggcgcagccuugguaacgccauggacug

SEQ ID NO: 268126 - RNA, 64 nt, Human
agagccugguagcgccuccuggggcagcacguggguggcgcaggcuuaguaacgccguggacug

SEQ ID NO: 268127 - RNA, 64 nt, Human
aucgucucaaaaaaaaaaaaaaaagcuggguaugguggcgcaugccuuuaaucccagcuacucg

SEQ ID NO: 268128 - RNA, 64 nt, Human
guguccugucaguccccugaguauguguguggguguggcgcaugugcaggucugugccuccugu

SEQ ID NO: 268129 - RNA, 64 nt, Human
uuucauuucagacgcaccaggauguugccgguuaguggcgcauuccacacccgccucauggagc

SEQ ID NO: 268130 - RNA, 64 nt, Human; identical to SEQ ID NO: 268084

SEQ ID NO: 268131 - RNA, 64 nt, Human
auguuucauagguuauguuguguucauuuaguagguggcgcauaaucugugguuuucucucuuu

SEQ ID NO: 268132 - RNA, 64 nt, Human
agaacugaacauggugguuugcacuuggguucugguggcgcaggcgcaggagcagccagcugug

SEQ ID NO: 268133 - RNA, 64 nt, Human
acagagucucacucuguugccaggcuggagugcaguggcgcaaucuuggcucacugcaaccucc

SEQ ID NO: 268134 - RNA, 64 nt, Human
ggcuggccucugcuggauuuugagauuugaggguguggcgcauggcgcugggguuggaaugggg

SEQ ID NO: 268135 - RNA, 64 nt, Human
cagagacuugcuuugucgcccaggcuggagugcaguggcgcaaugucagcucacugccaccucc

SEQ ID NO: 268136 - RNA, 64 nt, Human
gcagaaggcuguggauuaauuguagcauuucacugaucuucacuccagucacuagggacaauag

SEQ ID NO: 268137 - RNA, 64 nt, Human
ggucuguuuugcugugaauauuggaaaugcuuaggaucuucagacccaauagcucuaauuuuaa

SEQ ID NO: 268138 - RNA, 64 nt, Human
uguuccaagugcuacucucacucagccuguugcggaucuucauggccucaggagacuuguuucu

SEQ ID NO: 268139 - RNA, 64 nt, Human
cuccccagaaggccaagggaugugggggcugggggacugggaggccuggcagucuucaugcugc

SEQ ID NO: 268140 - RNA, 64 nt, Human
ggaagcaauuaaggaacaagauggaagagaaguggacugggaguauuuuuauggccugcuuuuu

SEQ ID NO: 268141 - RNA, 64 nt, Human
uccccaaagucuuaaguacuaguagccuguuauugacugggagccugacugauguauuauauau

SEQ ID NO: 268142 - RNA, 64 nt, Human
gcugcucugagggucucagcccaucccccaggaggacugggauuugguaugaucaaauccucaa

SEQ ID NO: 268143 - RNA, 64 nt, Human
ccucacccccaccccuguacccagccaccuuccugacugggaaggacauaaaagguuuaauguc

SEQ ID NO: 268144 - RNA, 64 nt, Human
uguaugcugccuccucugugcccucccagacgcugacugggaaacacaagaaguacaaccaaca

SEQ ID NO: 268145 - RNA, 64 nt, Human
gggcaucaggaacagugcuacuuacugauggguagacugggagaggugguguaacuuaguucuu

SEQ ID NO: 268146 - RNA, 64 nt, Human
agggacgaugagcaagucugccacaccaccuggugacugggaagggcugcuucucucguaaggg

SEQ ID NO: 268147 - RNA, 64 nt, Human
ucagcccuccccuucccagccccaaacugagacagacugggagcugggagccugggguggacag

SEQ ID NO: 268148 - RNA, 64 nt, Human
cuggugugugagggcugggugggguggguguggggacugggauuggggucagccuucugcagcu

SEQ ID NO: 268149 - RNA, 64 nt, Human
cacauacuggaaaugaugaguuagaaucugauuugacugggauguuuuaugagaauguaagugu

SEQ ID NO: 268150 - RNA, 64 nt, Human
cgcuaacaccacuccucuagaacucggugguaaugacugggaggucuauuccugccgggaggaa

SEQ ID NO: 268151 - RNA, 64 nt, Human
aggacacuuucuacccucugucaguccugggggugacugggaaccagagagguugagcagaauu

SEQ ID NO: 268152 - RNA, 64 nt, Human
gagguucuugaaagaggggacacgaaggaggagugacugggaagccucccaugccaaggaggug

SEQ ID NO: 268153 - RNA, 64 nt, Human
uugagagagagaaaguagaugaguacuugccuaggacugggaggaggauugcgaggaaauggag

SEQ ID NO: 268154 - RNA, 64 nt, Human
uuugaucuuagauuugaucuuaaaaucacuuugggacugggaucccuugcugauugacaaacag

SEQ ID NO: 268155 - RNA, 64 nt, Human
uugcaguuguguggaaaacuguuuuguaaugaaagaucuucauugggggauugagcagcauuua

SEQ ID NO: 268156 - RNA, 64 nt, Human
uuuggaggagacguaauccagcauuggaacuucugaucuucaagcagggauucucaaccugugg

SEQ ID NO: 268157 - RNA, 64 nt, Human
gcagcagccuaggcugggucaggggcuucccuaagaucuucaccucucugccucccuacugccc

SEQ ID NO: 268158 - RNA, 64 nt, Human
uccaaagauuguccuuuccauucucaaauccugugacugggaucacucaacagcacugugaugu

SEQ ID NO: 268159 - RNA, 64 nt, Human
gaggcggcggcugugugcgcagggcccggcaccggacugggacccuggcgucccuccaggccuu

SEQ ID NO: 268160 - RNA, 64 nt, Human
caguuggaucucacagcacagcuauccacagggagacugggauguucacgcagcacuccauuac

SEQ ID NO: 268161 - RNA, 64 nt, Human
gaauccagugaccuaaggauuuucugcaaaauuugacugggaguugugauaggugguauuuuug

SEQ ID NO: 268162 - RNA, 64 nt, Human
gagauaauuuauuuaauauacuuuaaauaaaggugacugggaauuguuacuguuguacuuauuc

SEQ ID NO: 268163 - RNA, 64 nt, Human
ccauccaugcuuuuauuuuuguuaagucuuuugugacugggacaguuaauuuuaguagcugaag

SEQ ID NO: 268164 - RNA, 64 nt, Human
uacugugcgggucacaguuucucccaaugauuaugacugggacauucuuugguagauaccauuu

SEQ ID NO: 268165 - RNA, 64 nt, Human
caugauccgucacucuuccuugugguaaucccuagacugggagcucagguacucuuuuagucau

SEQ ID NO: 268166 - RNA, 64 nt, Human
ggaaggccugagguccagguaagaagggaaaauagacugggagugggacaagggacuugacucu

SEQ ID NO: 268167 - RNA, 64 nt, Human
ugggaacucuuuuaaccugcagcugucugucugggacugggauuuacguuauagcaaugcacag

SEQ ID NO: 268168 - RNA, 64 nt, Human
cuggggucucuugcugcuugccucugcugcucuggacugggagagcuucuguccugugcugcau

SEQ ID NO: 268169 - RNA, 55 nt, Human
augccuuccgggccccgugaccccugacugggaugcccuggcccugcuacuugag

SEQ ID NO: 268170 - RNA, 64 nt, Human
ggauuucuuugagcuaggagaauaagagucuggagacugggagccuucacuucggccuccgauu

SEQ ID NO: 268171 - RNA, 64 nt, Human
ccaagugcagagcucuuugcuccaggagugaggagacugggaggugaaauggggaaauggaagg

SEQ ID NO: 268172 - RNA, 64 nt, Human
uuccacugcacauggcccuccuccccacccucaugacugggaaggaagccugugaugaggcuga

SEQ ID NO: 268173 - RNA, 64 nt, Human
uuggguuuugagauccuuccuuauuuuaagccaggacugggauuaaaucucccucugucagauc

SEQ ID NO: 268174 - RNA, 55 nt, Human
agcaaaauauuaaaauauaagugaggaucuucaacaucuuucaaaaaugcauuua

SEQ ID NO: 268175 - RNA, 64 nt, Human
uuccagacucuuuggcguuggagacgccuguuaggaucuucaagucccaucauagaaaauugaa

SEQ ID NO: 268176 - RNA, 64 nt, Human
agaacuguaccauaauuauguugaagguagaagugaucuucaaagagauggccauuaacuuagc

SEQ ID NO: 268177 - RNA, 64 nt, Human
gugguggcuugccacucagcaguccuagcuuggugacugggaacugccacauacagggccaggc

SEQ ID NO: 268178 - RNA, 64 nt, Human
uugagucuuuguggaauggauagccucccacuaggacugggaggagaauaacccaggucuuaag

SEQ ID NO: 268179 - RNA, 64 nt, Human
uacccucuccuccaaccauuuugggaaaauuauggacugggacucuucagaaauucugucuuuu

SEQ ID NO: 268180 - RNA, 64 nt, Human
cuacucuggagacugaggugggagaaucgcuugagacugggaggcagagguugcagugaaccga

SEQ ID NO: 268181 - RNA, 64 nt, Human
gauacugaccugugauaauauaauucccagggaggacugggaaccuuaucucuugagauauuug

SEQ ID NO: 268182 - RNA, 64 nt, Human
uccuugauggccuuagaucucuugacuagucaaggacugggaacgugccagggggaacaaagua

SEQ ID NO: 268183 - RNA, 64 nt, Human
aagggauuucugcucacuggcaggagacugcgaugacugggagaaaaccugcacucgguggcac

SEQ ID NO: 268184 - RNA, 64 nt, Human
uggacuuuccuucaguguaucuuucagagugcaagacugggaauggaaagaacuacagagggac

SEQ ID NO: 268185 - RNA, 64 nt, Human
uggaucuauaagcagcaggaagauuuuuuccaaggacugggagcaaacuugcaggcucugccau

SEQ ID NO: 268186 - RNA, 64 nt, Human
agggggcaccgcguuccagggcccagugcuggaggacugggaaagcggaaacaaaaccuucacc

SEQ ID NO: 268187 - RNA, 64 nt, Human
ugugguuuaucuaaaccguuuuaauaagcaagaugacugggaaaucucugccccuuuucugagc

SEQ ID NO: 268188 - RNA, 64 nt, Human
accuacaaaucaaucacagcuuguauuuugugaagacugggaagugacuuagcagaugcugguc

SEQ ID NO: 268189 - RNA, 64 nt, Human
cacugauggcgagcagccccugagcacuuucugggacugggagacugcuugguguucccugagg

SEQ ID NO: 268190 - RNA, 64 nt, Human
ugugugcagaauucuaggcagcaccuuagggagggacugggaugagagaaagugggaccuggug

SEQ ID NO: 268191 - RNA, 64 nt, Human
cagcaagcagccugcaaccaccucagacauccuggacugggagguggaggcagagccccccagg

SEQ ID NO: 268192 - RNA, 64 nt, Human
uccguuuucacgcugcugauaaagacauacccgagacugggaagaaaaagugguuuaauuggac

SEQ ID NO: 268193 - RNA, 64 nt, Human
uuccucucuuaaaaaauguacuugcacaaggaaggaucuucagauauucaugcacugaaaaaug

SEQ ID NO: 268194 - RNA, 64 nt, Human
uguguacuuuuuauuuauuuuggagguuuuauaugaucuucaauugaguauuaaauaauuugcc

SEQ ID NO: 268195 - RNA, 64 nt, Human
acacuagaauuaauuuuacacucuaaugguaguugaucuucauagucaagaggcacuguucaag

SEQ ID NO: 268196 - RNA, 64 nt, Human
ucuguauuaaugcugcugauaaagacguacccgagacugggaagaaaaagagguuuacuuggac

SEQ ID NO: 268197 - RNA, 64 nt, Human
ggucauccugggcauguccccaguguggacucuggacugggaagggggcaggccccuuuggacc

SEQ ID NO: 268198 - RNA, 64 nt, Human
guaaacccuggaaccugagucccaagaaaugguagacugggaauggaaagaaugggguaaacca

SEQ ID NO: 268199 - RNA, 64 nt, Human
auccucuccuauuuaucucugaggaucgaccggggacugggauagaggaagggugagcuccuca

SEQ ID NO: 268200 - RNA, 64 nt, Human
auaauguacauauugaaaggacugaaggcucucagacugggaaagaaacuuacccauuuuaaaa

SEQ ID NO: 268201 - RNA, 64 nt, Human
gccugaguugggcucuagugacucgagacucaaugacugggacuuagacuggggcucggccucg

SEQ ID NO: 268202 - RNA, 64 nt, Human
ggacuauagcaaauguguuugauggguaauucuagacugggacuaugguacccuuuuccagagu

SEQ ID NO: 268203 - RNA, 64 nt, Human
cuguauaggaagaggguauggucugagaugugcagacugggaccagcgcuagccugaggagcuc

SEQ ID NO: 268204 - RNA, 64 nt, Human
auuugauuuauucuuggacuguacucuucgcauggacugggaaguucuuuuaaaucauuaaaua

SEQ ID NO: 268205 - RNA, 64 nt, Human
aaggcuguuuccaacucuccccauuuuccuguucgacugggagguucuggaaagaaagagagag

SEQ ID NO: 268206 - RNA, 64 nt, Human
ugugcagugggcauucaguaaauguguguugaaggacugggacguacguggaggcugcuggacc

SEQ ID NO: 268207 - RNA, 64 nt, Human
ccauggcugucaccuccugccgaguccaaucccagacugggaaccaccaucugagacaggaccu

SEQ ID NO: 268208 - RNA, 64 nt, Human
cugucuuuuaucccaggaggcaggacaacacugagacugggauauguccaauaaaaacuaugac

SEQ ID NO: 268209 - RNA, 64 nt, Human
ugacaguuucucuagcgaggaugacuacgaaucugacugggaguagaggggcagguagaguucc

SEQ ID NO: 268210 - RNA, 56 nt, Human
ccaaaaugaagaauauguagauaauggacugggauauauuguauuucucauguuaa

SEQ ID NO: 268211 - RNA, 64 nt, Human
ccaucuucuccuccauuaucaucuagcagggucagacugggaaaccugguuggccacgccacac

SEQ ID NO: 268212 - RNA, 64 nt, Human
uuuaaccccgucaacaaaucuaggaaaauauuuugaucuucaacaaauugcccuuuagucuccc

SEQ ID NO: 268213 - RNA, 64 nt, Human
cucucgguuucaguugacaccauucccucuccaugaucuucagacuuaacuacuacugggugcu

SEQ ID NO: 268214 - RNA, 64 nt, Human
uucuugcugcagugcaacaggaggcuuuuucagugaucuucacuguauauguaaauuacaaaug

SEQ ID NO: 268215 - RNA, 64 nt, Human
acgccuuuuugacucuucuuggucucagcauguugacugggauuggaaauaaugagacugagcc

SEQ ID NO: 268216 - RNA, 64 nt, Human
cauuccgacagcaggacauacauguuggugugaagacugggacgacacuggguagaaucuaguu

SEQ ID NO: 268217 - RNA, 64 nt, Human
ccugcagguugcauuuauuguaaugaaaaagaaagacugggauuaaucucuaaucaggugagua

SEQ ID NO: 268218 - RNA, 64 nt, Human
aagaagaugaaugagcaaaaccaaauauuccagagacugggacuaaguguaccagagaagggcu

SEQ ID NO: 268219 - RNA, 64 nt, Human
uuuguuuugcacaggaagaugcugcugcugcccugacugggaugagggugaggggugacgggug

SEQ ID NO: 268220 - RNA, 64 nt, Human
ugcucuuccugcccucacccugccccacuccuacgacugggagcugacaugaccagcccacuga

SEQ ID NO: 268221 - RNA, 64 nt, Human
gagggcaaggggauauagugauggggcucagauggacugggaggagggggagggugaugcauua

SEQ ID NO: 268222 - RNA, 64 nt, Human
ucucugagaaaguggccccagggagagaauggaggacugggaggagaagcauuaacugagcucc

SEQ ID NO: 268223 - RNA, 64 nt, Human
ucaacuugaucuucuaccccgugccugugacucagacugggaaauacugagcagagacggcugg

SEQ ID NO: 268224 - RNA, 64 nt, Human
ucucacuugcugugggugaggggccauuuaaguggacugggagacagugcgcaguuuguauaua

SEQ ID NO: 268225 - RNA, 64 nt, Human
cuuccccuguucaauaguaugggaaaaauaagaugacugggaaaaagacacacccacaccguag

SEQ ID NO: 268226 - RNA, 64 nt, Human
gagccggagccgcuccaacccggcgggggccgcagacugggagcucccgguccgccucccagca

SEQ ID NO: 268227 - RNA, 64 nt, Human
ggggguuggggguggugggggucggggccugggggacugggagccgcagcagcucccccucccc

SEQ ID NO: 268228 - RNA, 64 nt, Human
ggaguaguacccccaggcccugcccugggugacagacugggaggaaaccaggcuggaccugggc

SEQ ID NO: 268229 - RNA, 64 nt, Human
ugcagugggcacgggggggccggccagacaggcagacugggaggauggaggacggagcugcaga

SEQ ID NO: 268230 - RNA, 64 nt, Human
guuguacauguuccuguuuaugcauucacaaggugacugggauguagagaggcguuagugggca

SEQ ID NO: 268231 - RNA, 64 nt, Human
ucuguauaauuaacauagguugucucauggcuuugaucuucaaaaggaagagccuuuuaaaaac

SEQ ID NO: 268232 - RNA, 64 nt, Human
gcaaaguguuggugauuuuacugaaaacuuuugagaucuucauuuuacaggcagaccugucuaa

SEQ ID NO: 268233 - RNA, 64 nt, Human
uuuuaauguuguuuacuuuuuuaaauacuugguugaucuucaagguaauagcgauacaauuaaa

SEQ ID NO: 268234 - RNA, 64 nt, Human
ugaccuauucagagccuuuuuguccuugucaacagacugggacagugucugauucccccuucac

SEQ ID NO: 268235 - RNA, 64 nt, Human
ucucuuuccucauggaugaucuucagcaagaguggacugggaagcugcaccuggcucccacuuu

SEQ ID NO: 268236 - RNA, 64 nt, Human
agccuguggcucuugaggccgugguucccacguggacugggaggcagucucagccacccggggu

SEQ ID NO: 268237 - RNA, 64 nt, Human
gaccuugccggauggggcaacuccgcccuugaaagacugggaauuaugcuagaaggucgugggc

SEQ ID NO: 268238 - RNA, 64 nt, Human
uuuauuaugauggugcuagguaaaaaauuguaaagacugggaugguuguguggaaaacuuuucu

SEQ ID NO: 268239 - RNA, 64 nt, Human
ccacacuuugaagguaauaaauacacagcaugcagacugggaguugcuagcaaacaaauggcuu

SEQ ID NO: 268240 - RNA, 64 nt, Human
uccucuagaagcagaaccagcucuacgagagugagacugggaacuugauggcucagagagcauc

SEQ ID NO: 268241 - RNA, 64 nt, Human
cuugcccaagggacaacaacaaacagugcagccugacugggaacaggauccugugaaagcugau

SEQ ID NO: 268242 - RNA, 64 nt, Human
aucacaggcucugcauacacaugcacucaguguggacugggaagcauuacuuuguagauguauu

SEQ ID NO: 268243 - RNA, 64 nt, Human
ugcuuagaugagggugacugucaaguacaagcaagacugggaccuuagaaaucauuguagaaac

SEQ ID NO: 268244 - RNA, 64 nt, Human
augcagauuccucagauucaauaaugagagcucagacugggaacagggcccaggaaucugugug

SEQ ID NO: 268245 - RNA, 64 nt, Human
guaagucaaagacuuguuacauagagggaaaauggacugggauagaggacagacugauaguuuc

SEQ ID NO: 268246 - RNA, 64 nt, Human
caccaggccagcugagcugcacccacagucccgagacugggaucccccaccccaacagugauuu

SEQ ID NO: 268247 - RNA, 64 nt, Human
aggcagggagggugaugaaggacugacccacauggacugggaugugugucgguuaugggcauga

SEQ ID NO: 268248 - RNA, 64 nt, Human
caacuuacuucuugcuugugucuuuccauuugaugacugggaauuacuuuucuagauaacuuuu

SEQ ID NO: 268249 - RNA, 64 nt, Human
cauuuucucuggguuugggaguggaguauuaugugacugggacuccacaaaauauuuauauuau

SEQ ID NO: 268250 - RNA, 64 nt, Human; identical to SEQ ID NO: 143115

SEQ ID NO: 268251 - RNA, 64 nt, Human; identical to SEQ ID NO: 143125

SEQ ID NO: 268252 - RNA, 64 nt, Human; identical to SEQ ID NO: 143135

SEQ ID NO: 268253 - RNA, 64 nt, Human
aaugacucccaagggccaaaagaguuaaaggcacgacugggauuucuucugagacuguggugaa

SEQ ID NO: 268254 - RNA, 64 nt, Human
gaaggagcugagaugaggccccacaccaggacuggacugggaugccgcuagugaggcugagggg

SEQ ID NO: 268255 - RNA, 64 nt, Human
ucuauuuauugcccaauuuauuguuuauacggaugacugggaggcacugcaccacaacguagga

SEQ ID NO: 268256 - RNA, 64 nt, Human
cccagaaggcuuucauuuguacucugcugggagugacugggaaaaacuccuucccugcugcuga

SEQ ID NO: 268257 - RNA, 64 nt, Human
ucaggagcccagcucuccagggggcuucugcccugacugggaagggugccuggcucccuaaaac

SEQ ID NO: 268258 - RNA, 64 nt, Human
aacaagcucacccguagcuuacgcuuggaagcaggacugggaacauccacgcuauuuauuaucg

SEQ ID NO: 268259 - RNA, 58 nt, Human
gcccucagagugcucuguaggagcuguagacugggaagagaggccaggcgugguggcu

SEQ ID NO: 268260 - RNA, 64 nt, Human
gacagcuagacccugucucaaaaaaaaaaaaaaagacugggaagagagcuagagggacuaggag

SEQ ID NO: 268261 - RNA, 64 nt, Human
gccccaacaggggaugcucaucacuggagacugcgacugggaagaacacugcccccucccucgg

SEQ ID NO: 268262 - RNA, 64 nt, Human
uagguacagucauuuuccaacuaacaucuagugagacugggauucaccacucagaauggggguc

SEQ ID NO: 268263 - RNA, 64 nt, Human
cuauccccuccccucugcuugagccuugagccuugacugggagcugaaaggaguugcagcuguu

SEQ ID NO: 268264 - RNA, 64 nt, Human
aaaccuacaguccuggaaggucucugcuggaagagacugggagaguggggaggggccagggacc

SEQ ID NO: 268265 - RNA, 64 nt, Human
ggggcucccugaggacggggcugugucugccucagacugggaaucccugaagauggggccgugu

SEQ ID NO: 268266 - RNA, 64 nt, Human
gaaaaauuuaugacccaaauacaaaucucaauuugacugggacagaaugaggaauggagauuuu

SEQ ID NO: 268267 - RNA, 64 nt, Human
cuuuccuaguguaccagccuucacaggauaagaggacugggaauaaagucagauguaaugugac

SEQ ID NO: 268268 - RNA, 64 nt, Human
aaaaggaaauuggcaugcaauucuaaacugcagugacugggaugggaggggaggggagcagugu

SEQ ID NO: 268269 - RNA, 64 nt, Human; identical to SEQ ID NO: 143144

SEQ ID NO: 268270 - RNA, 64 nt, Human; identical to SEQ ID NO: 143153

SEQ ID NO: 268271 - RNA, 64 nt, Human; identical to SEQ ID NO: 143163

SEQ ID NO: 268272 - RNA, 64 nt, Human
uacagugcugauguuuagaaauaaauagcagugugacugggaaagaggaauugcaguugugggg

SEQ ID NO: 268273 - RNA, 64 nt, Human
cccguccauuccagucaaaucugggcucacucaccccagcgagcucucaaaucccucuccaacu

SEQ ID NO: 268274 - RNA, 64 nt, Human
uuccagaaaaggcuucacucgcugggaacgucaacccagcgagaaaggaggggaagccccuucu

SEQ ID NO: 268275 - RNA, 64 nt, Human
cgcaggcccuccgcgggggacaggaacacccagccccagcgagucuggagaccaggacucugcc

SEQ ID NO: 268276 - RNA, 64 nt, Human
agccggagccccuugggcaggucacacaaccugucccagcgagggacaccgaguggcccuucau

SEQ ID NO: 268277 - RNA, 64 nt, Human
accauuugaagcuuucuggaccuguggucuuagucccagcgauucugcagagcggccaucggca

SEQ ID NO: 268278 - RNA, 64 nt, Human
uugggagcccuccuuugccugcucccgcgggucacccagcgagugcugagaccccauuuucugu

SEQ ID NO: 268279 - RNA, 64 nt, Human
auggcccacaucagcagucaacccugcacucuuucccagcgaucuuggauguguccccaggauc

SEQ ID NO: 268280 - RNA, 64 nt, Human
gaguuuaugggagaagggacugggccggcugccucccagcgaugcacuugaccugacacucccc

SEQ ID NO: 268281 - RNA, 64 nt, Human
aggggcuggagcccaaugccaagccuguguuguccccagcgacccugcagcugcucgcucugau

SEQ ID NO: 268282 - RNA, 64 nt, Human
gcuggggcugggguguugaaguuggcuuugcaugcccagcgaugcgccucccugugggauguca

SEQ ID NO: 268283 - RNA, 64 nt, Human
gggggagggaaggacauacggguaacuagaacuacccagcgagucguccagaggagaggaucag

SEQ ID NO: 268284 - RNA, 64 nt, Human
agccgcgaguaugagcagcucaagagcgagugggcccagcgagcgaacccugaggaccuggaau

SEQ ID NO: 268285 - RNA, 64 nt, Human
uuuaaauagcauuuuggcgcucgaaguugaucuccccagcgagggccccagcgugaagccaggg

SEQ ID NO: 268286 - RNA, 63 nt, Human
gauccggaacgucagccagcucccagccacauggcgcaugaaggagagcccagucucccucca

SEQ ID NO: 268287 - RNA, 63 nt, Human
cucuucuaacauuuaaggaauagagccuaauuagcgcaugaauacguguugaacugugaauga

SEQ ID NO: 268288 - RNA, 64 nt, Human
ggugagaaaacucaaccagagucacccaguuggugacugggaaaguuaggauucagaucgaaau

SEQ ID NO: 268289 - RNA, 64 nt, Human
cacacacagccccuauagcacugagcucacaugggacugggauaugggggcaucucuuccccag

SEQ ID NO: 268290 - RNA, 64 nt, Human
ggagaggacauuggaggggagaaaugcaguugcugacugggaauuuaagaaugugaacuucuca

SEQ ID NO: 268291 - RNA, 64 nt, Human
uguggccucccacuaacuagcauuccuuuaaagagacugggaaauguuuuaagcaaaucuaguu

SEQ ID NO: 268292 - RNA, 64 nt, Human
uguacuuuucuccaugguugaaauaaaacagggugacugggaguuacuuagaauucaugaagau

SEQ ID NO: 268293 - RNA, 64 nt, Human
agguaaugccaggggcccuucacuccgcccccaugacugggaagaggccuguggcagcgccgcu

SEQ ID NO: 268294 - RNA, 64 nt, Human
auaaacaugaagaaaauaagcaaagaaaaauggagacugggaaagcaaagcuguuuucauccua

SEQ ID NO: 268295 - RNA, 64 nt, Human
uuggcagagccuuugcaacaccuuaaguggacaggacugggaggucuuggugguuggagccaac

SEQ ID NO: 268296 - RNA, 64 nt, Human
aguaugugugugcgugugcaugggagugugcguggacugggauaucaucucuacagccugcaaa

SEQ ID NO: 268297 - RNA, 64 nt, Human
uaguucuauaaagagaacugcuuuuaacauuagggacugggagcaguccaugggauaaaaagga

SEQ ID NO: 268298 - RNA, 64 nt, Human
uuuuuaauagaauauacugucuugucucacuuuggacugggacaguggaugcccaucuaaaagu

SEQ ID NO: 268299 - RNA, 64 nt, Human
gauguuaaggcuguuuugcuuggagaagacuugggacugggacagucuuuagauauuauuugaa

SEQ ID NO: 268300 - RNA, 64 nt, Human
uuccccugguucccacucuucccaagccucccgggacugggacauguuugcaauaaaggaaagg

SEQ ID NO: 268301 - RNA, 64 nt, Human
ugcaguagagucaucuccaucagcuguaagaagagacugggaagauaggcucugcacagaugga

SEQ ID NO: 268302 - RNA, 64 nt, Human
aaguguguuaguaggauggagaaacugugauggggacugggaaccuggauuugucugauuuuag

SEQ ID NO: 268303 - RNA, 64 nt, Human
gcugguccuacauguauuagguucuuucaaguuugacugggaggucaccuuuuucugauuuaca

SEQ ID NO: 268304 - RNA, 63 nt, Human
cuuccuccucuacuacaugguggugcagggcaagcgcaugaguaaagagacguggggcuauuu

SEQ ID NO: 268305 - RNA, 64 nt, Human
ugcccccgcccugucccaaggcccaggcuguugggacugggacccucccuacccugccccagcu

SEQ ID NO: 268306 - RNA, 64 nt, Human
cccucggugccacagcugugcugaggaggccggggacugggaaucggagugggcaccucugugu

SEQ ID NO: 268307 - RNA, 64 nt, Human
aucgucugacugguguuaucaccgugggcucccugacugggaguugaucgccuuucccaggugc

SEQ ID NO: 268308 - RNA, 64 nt, Human
gcaguuuuaguggagucugaugagcaaguuucuggacugggagguaaauagacuuguuuuuucu

SEQ ID NO: 268309 - RNA, 64 nt, Human
aaugcagucagaaggacccugcuccaccuggggggacugggagugugagugugcauggcaugug

SEQ ID NO: 268310 - RNA, 64 nt, Human
gguacagugugcacagacagguacugagcugacagacugggauuuucuguacuaaaauguuacu

SEQ ID NO: 268311 - RNA, 64 nt, Human
uuuuaaaacacagagguguucugaccugcaacuugacugggaagccccuggguaacacaggucc

SEQ ID NO: 268312 - RNA, 64 nt, Human
uggacccagggacaagagacccugagagcccugggacugggagugucugcuccucugaggccag

SEQ ID NO: 268313 - RNA, 64 nt, Human
acaugaagagaacaucccuugagacgaauuuggagacugggauuagagccuuuggaggucaaag

SEQ ID NO: 268314 - RNA, 64 nt, Human
cuccacuaucgaugccuccugacugcacacugaggacugggacugggguugaguucugucuggu

SEQ ID NO: 268315 - RNA, 64 nt, Human
gguguuggcgcugauguagcucauggaaggaucagacugggaaccacagaggaaggaugaggug

SEQ ID NO: 268316 - RNA, 64 nt, Human
ucuccagauagcugaaugagucugcuuucacugugacugggaccugaaugaccugcagucaggg

SEQ ID NO: 268317 - RNA, 64 nt, Human
ugaucugugauuaaagcaguaauauuuuaagauggacugggaaaaacaucaacuccugaaguua

SEQ ID NO: 268318 - RNA, 64 nt, Human
uggagcaggggugcugggaccuggggcacugugggacugggacacuuuuauguuaaugcucugg

SEQ ID NO: 268319 - RNA, 64 nt, Human
ggccaucaucaaacaggacagaguuggaagaggagacugggaggcagcaagaggggucacauac

SEQ ID NO: 268320 - RNA, 64 nt, Human
ccaacaguguuaggccuggcacagugucugggcugacugggaccgucucaggcccacagaacac

SEQ ID NO: 268321 - RNA, 61 nt, Human
cuugcaucuauuuuaauaaauuaauucuuugcucuaguaauagauuuuauauaaugaaaua

SEQ ID NO: 268322 - RNA, 61 nt, Human
aaaguaguagaaguauuuuguagcuuaaagucucuaguauguaauaugcauaaaguaaauc

SEQ ID NO: 268323 - RNA, 61 nt, Human
cugggcagcagggccagugucaccugcugaccucuaguauuuccuuugcccuagagcuaga

SEQ ID NO: 268324 - RNA, 64 nt, Human
gucuuuuccuauugaagaauuuuucaucagaaacgacugggaaaguuugggaaagucagcaaaa

SEQ ID NO: 268325 - RNA, 64 nt, Human
acuuccuugucaucauggagaagugccagcaggggacugggaaaagcacucuacccagaccuca

SEQ ID NO: 268326 - RNA, 64 nt, Human
ucucuccucuaugcgugcccauugcagagaaggggacugggaccaaagggguggggauaauggg

SEQ ID NO: 268327 - RNA, 64 nt, Human
agagagcuggggaaaguagcagcaacuagauuaagacugggaggauuuugaccaaacuaaaggc

SEQ ID NO: 268328 - RNA, 64 nt, Human
ucgaaccgccaagcagaaaccggaccucacagcugacugggaacuggacauguggaagagcugc

SEQ ID NO: 268329 - RNA, 64 nt, Human
agauuagacacauuuuauaaugggggagauguaugacugggaacugcauuuacuugugguauac

SEQ ID NO: 268330 - RNA, 64 nt, Human
guguguuuuuuuaugaauggguggaaaggugugagacugggaaggcuugggauuugcuguguaa

SEQ ID NO: 268331 - RNA, 64 nt, Human
cuucauucccacugcacuuggugcugcuuuggcugacugggaacaccccauaacuacagagucu

SEQ ID NO: 268332 - RNA, 64 nt, Human
ugauggggcuggguacacuggggaauguuagcaagacugggaaggaggccacauuccugucugc

SEQ ID NO: 268333 - RNA, 64 nt, Human
gccuugauuuuccuccaggcuucucuucacaagagacugggaggauccguaagggauguccuaa

SEQ ID NO: 268334 - RNA, 64 nt, Human
aaagaugcuuuauggaauguaagaagaugaaggugacugggauucagcgagagagaggucccuc

SEQ ID NO: 268335 - RNA, 64 nt, Human
uuuuagcccuuauuuauugucggucugcccaugggacugggagccgcccacuuuuguccucaau

SEQ ID NO: 268336 - RNA, 64 nt, Human
ugcccuucaccccauuccacccuuguuccagcaagacugggauggguacaacugaacugggguc

SEQ ID NO: 268337 - RNA, 64 nt, Human
ugccccccacaccacaccuguaggggaccugucugacugggaagggaguuccgagagggagggg

SEQ ID NO: 268338 - RNA, 64 nt, Human
acccaagaugaugcguccacacagggggaggguagacugggaguccugaccacgcaggcccugg

SEQ ID NO: 268339 - RNA, 64 nt, Human
aauuuuuaucaccugaagguuggaaccagugagggacugggagagagugauuuauaagcaccaa

SEQ ID NO: 268340 - RNA, 61 nt, Human
gaccagccuggccaacauggugaaacccugucucuaguaaaaauccaaaaaaaaaaaaaaa

SEQ ID NO: 268341 - RNA, 61 nt, Human
guacuuaugcuuuaguaguuuguuugguccccucuaguaugugucacugagaaauuuuuua

SEQ ID NO: 268342 - RNA, 61 nt, Human
uucuuuuuauacuauagaauaauauuuuguucucuaguauaucaaaauaccaaaauauuau

SEQ ID NO: 268343 - RNA, 64 nt, Human
guggccacucauguggucagcaggucggcggagagacugggauggcugggcuucucucucugcc

SEQ ID NO: 268344 - RNA, 64 nt, Human
caacuacacaggggaacggagcagauagagcugcgacugggaagcgucaccuucccguccagag

SEQ ID NO: 268345 - RNA, 64 nt, Human
guugagccugacuguaaaccuagaacugcggaaggacugggacuuuuguacaaauuucacauuu

SEQ ID NO: 268346 - RNA, 64 nt, Human
gagaggcugcucaaucgacaccccgaguucucaugacugggaagauaguuuucuucagguguca

SEQ ID NO: 268347 - RNA, 64 nt, Human
cuacaaaaaugugacugggaagggggcuuugagagacugggacugcucuggguuagguuuucug

SEQ ID NO: 268348 - RNA, 64 nt, Human
guaggaauccauucugaacaaacuacaaaaaugugacugggaagggggcuuugagagacuggga

SEQ ID NO: 268349 - RNA, 64 nt, Human
cucaagccuugccuugucucugccucggaacugggacugggacuggcucauccaccuaugugcg

SEQ ID NO: 268350 - RNA, 64 nt, Human
cugcaaagaagaugcaaugagcauccuuggaacagacugggagccugaucccaagaggcugcug

SEQ ID NO: 268351 - RNA, 64 nt, Human
uuccacugcucuucucugguucauguccaccacugacugggacccugaagaggcauuucagagu

SEQ ID NO: 268352 - RNA, 64 nt, Human
auuaguucucagaagaagggagaaaugaucauaggacugggaauuguuuugcaaacguucuagg

SEQ ID NO: 268353 - RNA, 64 nt, Human
cucuguacccauguguacagccuacccaugcagggacugggauucgaggacuuccaggcgcaua

SEQ ID NO: 268354 - RNA, 64 nt, Human
ggaaaacugagcauguguccuguuuuaagugguggacugggagggaagugucaacuucugaggu

SEQ ID NO: 268355 - RNA, 64 nt, Human
guuccugauuuauuuucagccaguaaucaaaacagacugggaaugaauaaagcacuuacagaag

SEQ ID NO: 268356 - RNA, 64 nt, Human
cugugggaacaggaauaaaggagaaaccacuauugacugggaagacacacaaagaacuuuguca

SEQ ID NO: 268357 - RNA, 64 nt, Human
aaucccuacuagaguccugugggcugaaauaucagacugggaaaaaaugcaaagcacauuggau

SEQ ID NO: 268358 - RNA, 64 nt, Human
cauauaucguugugcacaggaucaacaugauggugacugggaaaaaauuacuucaaguaacaug

SEQ ID NO: 268359 - RNA, 64 nt, Human
ucuuuguggacccaucuuccuccucugccaccccgaucuucacucggauaccucuugauuucug

SEQ ID NO: 268360 - RNA, 64 nt, Human
aaaacccccagccagacuauucauggcccauucagaucuucauguucaucccacaagugcaaga

SEQ ID NO: 268361 - RNA, 61 nt, Human
caguggagagagggaaagaauguugcaccugcucuaguaccauaggucaagaggcuucugg

SEQ ID NO: 268362 - RNA, 64 nt, Human
aaaugccauuucuaugcacccaccuggccugugugacugggagaaucucucuuuuuauuaaaug

SEQ ID NO: 268363 - RNA, 64 nt, Human
ggcaucccagaaacguguaaaugaccccgagugugacugggaaggagaacuuauuccuuaccag

SEQ ID NO: 268364 - RNA, 64 nt, Human
cacacgccuaugcacaaacguggauuaucgcacagacugggagguuuaguggugcauuucuccu

SEQ ID NO: 268365 - RNA, 64 nt, Human
acccagcaccccccgccccgcacauuauuugaaagacugggaauuuaaugguuagggacaguaa

SEQ ID NO: 268366 - RNA, 64 nt, Human
cuggggaaggcaugagggggcucagaggcuccuugacugggaccaggauugggggccagggcuu

SEQ ID NO: 268367 - RNA, 64 nt, Human
caauaagguggagcaacagaacaaugggaaagaggacugggagaggaaucuaagaaccagaugg

SEQ ID NO: 268368 - RNA, 64 nt, Human
ugaaaggacccgaaaaugcagggguuggcuuucugacugggaacuuaaaaaucacucuucaugc

SEQ ID NO: 268369 - RNA, 64 nt, Human
aauagaagcuacagaguucuuuucuugggaccuagacugggaggugcaaugucaggaccuccag

SEQ ID NO: 268370 - RNA, 64 nt, Human
uacaagagccuugacaaggcacuguuuuuugugggacugggaguucacacugaugaagcaaacc

SEQ ID NO: 268371 - RNA, 64 nt, Human
cuauagacugauaggcccuauccacaagggccaugacugggaaaagguaugggagcagaaggag

SEQ ID NO: 268372 - RNA, 64 nt, Human
gacguucagucucauuuauuaaaauaauaacugagacugggagagguggcucaugccuguaaau

SEQ ID NO: 268373 - RNA, 64 nt, Human
ucagcccugcuccuccugccuccugggguccagugacugggacccuacucuagaacuguguacc

SEQ ID NO: 268374 - RNA, 64 nt, Human
ccucuagucuccugagccuguagagcccccaggagacugggacccaaagaacuucacagcacac

SEQ ID NO: 268375 - RNA, 64 nt, Human
uaauggcagggugcgguccuuaggccccggccuggacugggaaauggggguagggcaccaggag

SEQ ID NO: 268376 - RNA, 64 nt, Human
cuggaaugaggaaagauucuccauucgagagaaugacugggagggaagaagucggggcccuccu

SEQ ID NO: 268377 - RNA, 64 nt, Human
ugguagucaugugggcuugccuucucugccaaacgacugggaaaccaaaaugagcccaccuugu

SEQ ID NO: 268378 - RNA, 61 nt, Human
aucucuggggcuggaaaccauccaucaaggucucuaguaguucuggcccaccucuuucccc

SEQ ID NO: 268379 - RNA, 61 nt, Human
uugaccagcacauuaacuucuggacugccggcucuaguaccuuuucaguaaagugguucuc

SEQ ID NO: 268380 - RNA, 61 nt, Human
aaguuuaauggugccuucauuugggaugcuacucuaguauuccagaccugaagaaucacaa

SEQ ID NO: 268381 - RNA, 64 nt, Human
uauauuuucuuuaaaaauccugggcuggcacauugacugggaaaccugagugagacccagcaac

SEQ ID NO: 268382 - RNA, 64 nt, Human
agaaaauaggggugauggagggggagaagcccaggacugggagaaucgcacaugccccaggggu

SEQ ID NO: 268383 - RNA, 64 nt, Human
accgcagcagccacaggcagaggaggacgaggacgacugggaauccuagggggcuccaugacac

SEQ ID NO: 268384 - RNA, 64 nt, Human
gaaccauucacuggcaaauggaggggaacgugcugacugggacucccagcuggagcugggagga

SEQ ID NO: 268385 - RNA, 64 nt, Human
aggaagguguccaguucaagagaacccacccagagacugggagugguggcucacgccuauaauc

SEQ ID NO: 268386 - RNA, 64 nt, Human
guucaccuggaacuaaagaagagcguccaggugggacugggauaauuguucaaggaauuguguu

SEQ ID NO: 268387 - RNA, 64 nt, Human
caagcugguuuuaaguggaacugcccuacugggagacugggacaccuuuaacacagaccccuag

SEQ ID NO: 268388 - RNA, 64 nt, Human
auauuuuguuagauauuuaaaauuacugcaaaaggacugggauaauuuuuucaccauuugcaau

SEQ ID NO: 268389 - RNA, 64 nt, Human
acgggcuguccgggauccggggugucuguccgcagacugggaugagucuacucgagcaucuccg

SEQ ID NO: 268390 - RNA, 64 nt, Human
gauggagaaggcugagugcagcaagguggggggugacugggacccagccuuugggccuccccag

SEQ ID NO: 268391 - RNA, 64 nt, Human
gccugagcugguggcacccuccccugggccggaagacugggaauuccugcuaaguguggcuucu

SEQ ID NO: 268392 - RNA, 64 nt, Human
aucccgggaccugaacuauuagcacgucacuagagacugggagccgaggcaguggugcuggccc

SEQ ID NO: 268393 - RNA, 64 nt, Human
agagaccauucucaggugguugggccaggcuaaagacugggauuugggucuaucuaugccuuuc

SEQ ID NO: 268394 - RNA, 64 nt, Human
gucauuacuguuuuaauugucuggcuucucucuggacugggagcucagugaggauucugaccag

SEQ ID NO: 268395 - RNA, 64 nt, Human
ggacuucuguuuucucccuguggagaucagugaagacugggaggaaagcugcuucaaccugagu

SEQ ID NO: 268396 - RNA, 64 nt, Human
uuucuugacgaccaccucauguggccaauaaauggacugggagcguuuuagcugccauuaacuu

SEQ ID NO: 268397 - RNA, 64 nt, Human
agaucuuaauaaaagcaagcuuaauguaguuaaggaucuucauauuagaauugugucauuuauc

SEQ ID NO: 268398 - RNA, 64 nt, Human
cugaggcagggaaagagagccuauucucacacaugaucuucagagugcuggaaacacacuccug

SEQ ID NO: 268399 - RNA, 64 nt, Human
uggggcugagagagggucuggguuaucuccuucugaucuucaaaacaagagagagaccuugaau

SEQ ID NO: 268400 - RNA, 64 nt, Human
ccacaccaaccacgccagggggaggaaagggaaggacugggagagacacaaagaccagagccag

SEQ ID NO: 268401 - RNA, 64 nt, Human
guuaaugacgucucucccucuaaaccccauuaaggacugggagaggcagagcaagccucagagc

SEQ ID NO: 268402 - RNA, 64 nt, Human
cugcucuggacaagaauugagcaacuugucugaugacugggaaaggaggaccugcaaccaucug

SEQ ID NO: 268403 - RNA, 64 nt, Human
aaaaaugggcuuugcacacaauggguuuggagcugacugggaacaauggaaaaaauuacauuag

SEQ ID NO: 268404 - RNA, 64 nt, Human
ggggagaaggccagcuuuaagacguaggccuggggacugggagggcagagggugagucacagcc

SEQ ID NO: 268405 - RNA, 64 nt, Human
agcugcccugcccuccauaggcaacuggugcagggacugggaaaccauagacagaguccacucc

SEQ ID NO: 268406 - RNA, 64 nt, Human
gcccaccccuccaaggggcuggccugugagccuugacugggauucaugauguggaggcccccaa

SEQ ID NO: 268407 - RNA, 64 nt, Human
gacaagaucguuagggagagaggcccaggguggggacugggaauuuaaggagagcugggaacgg

SEQ ID NO: 268408 - RNA, 64 nt, Human
ccuggaagacugagucuggacggcagaguggagggacugggaggcuguggcugccucccucccu

SEQ ID NO: 268409 - RNA, 64 nt, Human
aguuagggguugcgggauccccgagugugggcgggacugggacacccuuuggccucuguuuguc

SEQ ID NO: 268410 - RNA, 64 nt, Human
ccagcagcuucuguugucuaacguauggcaggcagacugggagcaggaaaacagagggccccaa

SEQ ID NO: 268411 - RNA, 64 nt, Human
cagugagaaaaagcuccuguccucccauccccuggacugggagguagauagguaaauaccaagu

SEQ ID NO: 268412 - RNA, 64 nt, Human
agcccagagcgguggccuugcucuuccggcuggagacugggacaucccugauagguucacaucc

SEQ ID NO: 268413 - RNA, 64 nt, Human
ucagcuggugaugaagaggagcaugcuggggugagacugggauucuggcuucucuuugaaccac

SEQ ID NO: 268414 - RNA, 64 nt, Human
gggaggagaggagaggagagggaggauccuggaggacugggaagaucuagccuaaagaggcuuc

SEQ ID NO: 268415 - RNA, 64 nt, Human
ugguggcaaggaggggcaggggauauggggacgugacugggacagguuccugccuuaucauuuu

SEQ ID NO: 268416 - RNA, 64 nt, Human
gacuuuguuggauagcugccacuaggguugcuucgaucuucagccacaugcuguccuugaagca

SEQ ID NO: 268417 - RNA, 64 nt, Human
uaucauggagugacggucccacacuggugacugcgaucuucagagcagggguccuuggugugac

SEQ ID NO: 268418 - RNA, 64 nt, Human
gccacuggaccacaggaggugugauagagccuuugaucuucaggaugcacgguuucuguucugc

SEQ ID NO: 268419 - RNA, 64 nt, Human
gcucagagccggggugggguggcugcagccucaggacugggagcccccagccugucagauccag

SEQ ID NO: 268420 - RNA, 64 nt, Human
ugcccagugggaggcgccacuuuguauauuucaggacugggaccuacuccccagaugccaccug

SEQ ID NO: 268421 - RNA, 64 nt, Human
uuccuugccugccuggguacucaugccaagcagagacugggauuagggguucugugcucuugcc

SEQ ID NO: 268422 - RNA, 64 nt, Human
gaaacgccaaggcccucgucaaacccugagucaugacugggaggagaaggagcaggaucagacg

SEQ ID NO: 268423 - RNA, 64 nt, Human
aguccagggauagcaaugguacugaccagcuauggacugggagaacauugaguccuguuuucca

SEQ ID NO: 268424 - RNA, 64 nt, Human
cuuaacuucguguucacacuccauggaaaccccagacugggacacaggcggaagccuaggagag

SEQ ID NO: 268425 - RNA, 64 nt, Human
uagcagauauccacaaacauagcuaugaaguucugacugggauaaccuugcuguuugucuauuu

SEQ ID NO: 268426 - RNA, 64 nt, Human
gucaucugcuccggaaggaaagagaacgggccaagacugggacuauuccccacccccggucccc

SEQ ID NO: 268427 - RNA, 64 nt, Human
uuuguuuacuucauuuuuuccucuaaauauucaagacugggacaaaaguauaaauauuauuuau

SEQ ID NO: 268428 - RNA, 64 nt, Human
ugagcagacuggugggaucugugcccagagaugggacugggagggcccacuucaggguucuccu

SEQ ID NO: 268429 - RNA, 64 nt, Human
uuagagaaacaaucaguucaacuauuguuguacugacugggacuucauauucuaauggaugugg

SEQ ID NO: 268430 - RNA, 64 nt, Human
agcacagaucuugaugacuucccuuucuagggcagacugggaggguauccaggaaucggccccu

SEQ ID NO: 268431 - RNA, 64 nt, Human
cgccucauggcuaguguggcguugaaagaguagcgacugggaagauacaacuuacacagugggg

SEQ ID NO: 268432 - RNA, 64 nt, Human
gugcaaaagagcuaucaaagacaagaggauaaaagacugggauagucuuuuccaaggacccucu

SEQ ID NO: 268433 - RNA, 64 nt, Human
ucacagaacaaccgagggacaaaggagauuggaugacugggaagcgcuggcccggaacagcccc

SEQ ID NO: 268434 - RNA, 64 nt, Human
cugaggaguuuugcuuuaguuucuuaucgccauggacugggaauuaacauguauuuaacacauu

SEQ ID NO: 268435 - RNA, 64 nt, Human
gugcugacaaagaugaccugcugcuguugagugagaucuucaaugcuuccuccuuggaagaggg

SEQ ID NO: 268436 - RNA, 64 nt, Human
aucagaaaaucagggcaaucaucuagaucucacagaucuucaacauaggacucuagguuaugag

SEQ ID NO: 268437 - RNA, 64 nt, Human
uugucuuuucugggcuguauuacagcccucuguggaucuucaacucugcugccuccacugugau

SEQ ID NO: 268438 - RNA, 64 nt, Human
acaacccacaguggccuucagaggcuccuccugggacugggaaccgccgcagggccaggcggac

SEQ ID NO: 268439 - RNA, 64 nt, Human
acccacaccuggcccaguccacguugagguccaggacugggaaggaccgggugagugcaccggg

SEQ ID NO: 268440 - RNA, 64 nt, Human
gggcaacagacuacacgauuggacgugugugguugacugggaugaaguuggagggaggggcagg

SEQ ID NO: 268441 - RNA, 64 nt, Human
cuccccagcccagccugcucagagaagcuggcaggacugggaggcgacagaugggccccucuug

SEQ ID NO: 268442 - RNA, 64 nt, Human
gcagagaccugcgcccacaggugcugucuuaguggacugggacgugaaccuuucgcucuccuuc

SEQ ID NO: 268443 - RNA, 64 nt, Human
uggacugggacgugaaccuuucgcucuccuucuggacugggagaagggaggcuuggguguugug

SEQ ID NO: 268444 - RNA, 64 nt, Human
uguuuugacagcucugcugucccauagggacugcgacugggaccaggucaaccacgccaggggg

SEQ ID NO: 268445 - RNA, 64 nt, Human
cacuucugggccugggucugaggacaucuuuuuugacugggagccuucuuacuguugagguuca

SEQ ID NO: 268446 - RNA, 64 nt, Human
gagcugcugagccuaaagacuggagaaucugggggacugggagugggggucagagaggcagauu

SEQ ID NO: 268447 - RNA, 64 nt, Human
uguuguacacaggguauuucuagaagcagaaauagacugggaagaugcacaaccaagggguuac

SEQ ID NO: 268448 - RNA, 64 nt, Human
cugggcucugacucgaacaccugcaaaggacagggacugggaccguuacuuacaugacacugca

SEQ ID NO: 268449 - RNA, 64 nt, Human
uuuuuacucaaaggcacugacuguaauccagggggacugggaccugccuccccccaaccucugg

SEQ ID NO: 268450 - RNA, 64 nt, Human
aacgggcagggcugccacugaccugaagacuccggacugggaccccacuccgagggcagcuccc

SEQ ID NO: 268451 - RNA, 64 nt, Human
aauaggcagggccagaucacccaaaacuccucaggacugggaucuggcguuuauaaauaacuag

SEQ ID NO: 268452 - RNA, 64 nt, Human
cccccaccgaggccuaggccccugccacccccaagacugggaggggacuucuuuuucuaaaaca

SEQ ID NO: 268453 - RNA, 64 nt, Human
guuccuccugcgcuguaauucccugcucccuggagacugggaaaaggccgcagggcagggggac

SEQ ID NO: 268454 - RNA, 64 nt, Human
gaaacaaaauucuaaucaacauauaauucagaaggaucuucaucugacuaugacauaaaaacaa

SEQ ID NO: 268455 - RNA, 64 nt, Human
ucauaggaaauuccuucauaaaacauguaacacugaucuucagauagaaaaagcaaucuguuua

SEQ ID NO: 268456 - RNA, 64 nt, Human
caccuuugucaucagcuuuuccucuuugccacuggaucuucauggagacaugggcaagcauuag

SEQ ID NO: 268457 - RNA, 64 nt, Human
caagcuggauucuguguaccuaguacacaggcaugacugggaucccguguaccgaguacacgac

SEQ ID NO: 268458 - RNA, 57 nt, Human
aaaccguccaggccaguuaacucuggggacugggaacccaugaaauugacccccaaa

SEQ ID NO: 268459 - RNA, 64 nt, Human
agucaaguuccaaugagggucucuuaggcuuuaggacugggacuucggcuagggaggaagguag

SEQ ID NO: 268460 - RNA, 64 nt, Human
ucagcccaagauucuucagucuggacuauauugggacugggacuucugggucuccagggagggu

SEQ ID NO: 268461 - RNA, 64 nt, Human
ucucagagaagccauagccccccugggaccuccggacugggaggggagcagaguccccaggagc

SEQ ID NO: 268462 - RNA, 64 nt, Human
cauucagguggaggucccgagugggcggggcagcgacugggagaugggucggucacccagacag

SEQ ID NO: 268463 - RNA, 64 nt, Human
uacguaaacaguauuuauuauaaauuacuaccgugacugggaugcaagagaauuaggacuauaa

SEQ ID NO: 268464 - RNA, 64 nt, Human
aaaugucaagacagaauuggacaugcaaaagauugacugggagaacacaccucugauggacaaa

SEQ ID NO: 268465 - RNA, 64 nt, Human
acgucccagcugcgacguacugucacugaugagagacugggaagggaaaagcauauauauauag

SEQ ID NO: 268466 - RNA, 64 nt, Human
aggaaccaacaauucgucggaggcaucauggaaagacugggacagcccaggaaacaaggggucu

SEQ ID NO: 268467 - RNA, 64 nt, Human
ccggagacguuucaacccugcagcgggaaaggcugacugggaaauccauuuugggugggcaauu

SEQ ID NO: 268468 - RNA, 64 nt, Human
cccccagucauucugggaacauguuguaagcacugacugggaccaggcaccaggcagggucuag

SEQ ID NO: 268469 - RNA, 64 nt, Human
gaugaagauuuaggaauaaauaugccugggaagagacugggaagguucuagggugaggcaccuc

SEQ ID NO: 268470 - RNA, 64 nt, Human
gaacaggacugcaaaaauccuucuccaccgcacagacugggaaccccuccuggccugggggaag

SEQ ID NO: 268471 - RNA, 64 nt, Human
agugccagcauccagcaugagcagaugucggggagacugggaagucuccagcguuacugcucuc

SEQ ID NO: 268472 - RNA, 64 nt, Human
agugccagcauccagcgugagcagacgucggggagacugggaagucuccgauguuacugccugc

SEQ ID NO: 268473 - RNA, 64 nt, Human
uaggagaagcauuuuguggaggauuugaaguugagaucuucauccaagaaguagcuuuucaauu

SEQ ID NO: 268474 - RNA, 64 nt, Human
uuuaucuauauccauauggauggauagguagguagaucuucauagauuuuuuuuucuuuuguua

SEQ ID NO: 268475 - RNA, 64 nt, Human
accacucucccuuccacucuggcuuuacugcagcgaucuucaaccuugucuacuggcauaagug

SEQ ID NO: 268476 - RNA, 64 nt, Human
gccucacccagggaccgucuggcuuccccagcuggacugggaggucaggaagccaggcaaggag

SEQ ID NO: 268477 - RNA, 64 nt, Human
gcgcuggggagacugauaacuuggggaggcaagagacugggagccacuucuccccagaaagugu

SEQ ID NO: 268478 - RNA, 64 nt, Human
cagccaagacaaggagguagagaggggacugggggacugggagucagagcccuggcuggguuca

SEQ ID NO: 268479 - RNA, 64 nt, Human
gcagugaugauggccuguuuuggagugugucugagacugggauugcauuugggguuucccgugu

SEQ ID NO: 268480 - RNA, 64 nt, Human
aaaaauggauucaacuuggccuuucugaaggcaagacugggauuggaucacuucuuaaacuucc

SEQ ID NO: 268481 - RNA, 64 nt, Human
cugcaccuaccccucccauugcaaagccaacuuggacugggaagggcccuucaggucaccaaac

SEQ ID NO: 268482 - RNA, 64 nt, Human
uccugaagagcccucuccaccugcaaggugccaggacugggagggaaaguccagggccccccca

SEQ ID NO: 268483 - RNA, 64 nt, Human
cuuggacaucuguuuauaauauaaacagacaugugacugggaacaucuugcugccaaaagaauc

SEQ ID NO: 268484 - RNA, 64 nt, Human
ggcuggauguggaggagguggagagcaguuaugagacugggaaagaacggggcacucaaagagc

SEQ ID NO: 268485 - RNA, 64 nt, Human
auucagcagcauuuuaaucacauguccuccagcugacugggacucaggcugcgugccuccgucu

SEQ ID NO: 268486 - RNA, 64 nt, Human
uguuuugagacggcgacagaaccugacccguggagacugggagagcccagcaggcaccuguauu

SEQ ID NO: 268487 - RNA, 64 nt, Human
gugaaaguaggugauuccuuugcagaacuucagggacugggagcagaggccccucacucaacga

SEQ ID NO: 268488 - RNA, 64 nt, Human
aacucaaaugcuggggguagguggcuaaucucaggacugggaagauuacggcgaauuaugcuca

SEQ ID NO: 268489 - RNA, 64 nt, Human
aacaagaugcuuccaguuacagcggcaggagcgggacugggagcacgggcugacggcugcuggu

SEQ ID NO: 268490 - RNA, 64 nt, Human
gugcgggacaggguggcuggcacgagaugugugggacugggacgcuuccuuuggggaccagagg

SEQ ID NO: 268491 - RNA, 64 nt, Human
uagggaggcccaugaucgacuaaugcaguuggccgacugggacuuuucaacauuggauucaaug

SEQ ID NO: 268492 - RNA, 64 nt, Human
uuugcagguggucuuucggggugcuccugugggagaucuucacucugggcggcuccccauaccc

SEQ ID NO: 268493 - RNA, 64 nt, Human
cuguaccuuauccaaauuuacaccuagcuauuaggaucuucaacccagguaacaggaauaauuc

SEQ ID NO: 268494 - RNA, 64 nt, Human
gauuuuacuuuuuauuguaauuaauaaacauugagaucuucauuuuauaccuuauuaucugauu

SEQ ID NO: 268495 - RNA, 64 nt, Human
ggggugaacuugcucugaacugcacccaggaggugacugggaaggagaaaaccagcaaaggaag

SEQ ID NO: 268496 - RNA, 64 nt, Human
gaucggacagugccauccaugggccccaccuugugacugggacaaucagggaccuggauuggac

SEQ ID NO: 268497 - RNA, 64 nt, Human
cugggaguguguauauauguagcauaucaugggggacugggaaguugggagagguaggaccuga

SEQ ID NO: 268498 - RNA, 64 nt, Human
ugucaugcugucaguucccaauugacaagucacagacugggagaaaauauuugcaaaucgugua

SEQ ID NO: 268499 - RNA, 64 nt, Human
ccaacaccucccaaggauggaggacugggcgagggacugggaaagaggcauauuuaguuuugug

SEQ ID NO: 268500 - RNA, 64 nt, Human
cuucuaacuccugcauccucagaaggggaaaagggacugggaaguaaagggaaaccauauggcc

SEQ ID NO: 268501 - RNA, 64 nt, Human
ugaaggccuggaauuagcuuggggccagggaagggacugggaggggagagaagagaaggaggga

SEQ ID NO: 268502 - RNA, 64 nt, Human
cuagaaccgguaagauggugacauuguugaucaagacugggaauauaagagagaagcagguuug

SEQ ID NO: 268503 - RNA, 61 nt, Human
cugaguuggaaauaagcugaaaugaauacaugacugggaauaauggggacugccugugagg

SEQ ID NO: 268504 - RNA, 64 nt, Human
gccuccaaaucuggaaggugcugaaugcccugcugacugggaaaguuucagggcacugaugggg

SEQ ID NO: 268505 - RNA, 64 nt, Human
gugaagagcaagccacuguagugaggaauguggagacugggagucuguccuaaaccccauggga

SEQ ID NO: 268506 - RNA, 64 nt, Human
gguggagcccugggagagaggguacugaucagcagacugggagguggggagaaguccgcuggug

SEQ ID NO: 268507 - RNA, 64 nt, Human
uuucuuccaagccccucccugccugacuuacccagacugggauuaccagauaccaggugauuua

SEQ ID NO: 268508 - RNA, 64 nt, Human
ccgcaaccuggaccccagugagaggcggugggcugacugggaaggagaggcccccaaccuccuc

SEQ ID NO: 268509 - RNA, 64 nt, Human
ccucccccagccacuccccagccagccuggcugggacugggaacagaacucgguguccccacca

SEQ ID NO: 268510 - RNA, 64 nt, Human
cgacacuuccaacuucgaaacuuacccugagcaugacugggacacagccgcgcccgugccgcag

SEQ ID NO: 268511 - RNA, 64 nt, Human
uuuguguaaaccauaauccacaugugccguaaaugaucuucacuccuuauccgagggcaaauuc

SEQ ID NO: 268512 - RNA, 64 nt, Human
uucuucuucacuucuuccuuguaauuauacuuaagaucuucaauuucuucaaaaaaugaaggau

SEQ ID NO: 268513 - RNA, 64 nt, Human
gguuuuuuguguagguuuguuuuuuauuuuugaugaucuucagauggaaggagaaaacaggguu

SEQ ID NO: 268514 - RNA, 62 nt, Human
uuuugccagcugcagugagauucugcagcauaggccacgauaaaggaaggagagaaggggcu

SEQ ID NO: 268515 - RNA, 62 nt, Human
acuuggccuagcaucccuccuggccccccucuggccacgacuuggccugugccugguucucu

SEQ ID NO: 268516 - RNA, 62 nt, Human
agcuucccccagccccugccaccccagagggcggccacgacagggagagguguagaugccac

SEQ ID NO: 268517 - RNA, 62 nt, Human
ugagcugcuuuuaucauacucuccuaguugugggccacgauuuaaaccaucagagaugacaa

SEQ ID NO: 268518 - RNA, 62 nt, Human
gcccaccugcacacagucuguuggauagguagggccacgaggaguagccagguaggcgagac

SEQ ID NO: 268519 - RNA, 62 nt, Human
gccuccagcguggggagcgcccgaguccucucggccacgagcuggacgcucuucaggacguu

SEQ ID NO: 268520 - RNA, 62 nt, Human
caccugcgcuguagcuuaucugacaacgcugaggccacgagcuccuggguagcugugaucag

SEQ ID NO: 268521 - RNA, 62 nt, Human
gcuucuggggcguugggaaacccaggcccgccggccacgacucugcccucagcuucacaguc

SEQ ID NO: 268522 - RNA, 62 nt, Human
gucaaaaacccugaucagguagauuuggaggcggccacgauuuccuguuuggccccuguuca

SEQ ID NO: 268523 - RNA, 62 nt, Human
guuaucaucggagccuucuuguguccucaaagggccacgaggccugaaaggaggaucagaau

SEQ ID NO: 268524 - RNA, 62 nt, Human
augcugaucuauuggggaacagagaagagacaggccacgaaggucaggcucuuuauauuaag

SEQ ID NO: 268525 - RNA, 62 nt, Human
gagggauaccauccuagggucugggaauccaaggccacgagacuccuugguuugugguccga

SEQ ID NO: 268526 - RNA, 62 nt, Human
guuugcugaaaaguuagucuuaauuaucuauuggccacgaugaaacagauuucaacugauaa

SEQ ID NO: 268527 - RNA, 62 nt, Human
gccuucccuucaggaguugcgucuccucugcaggccacgauggucugcucuggagcauuggg

SEQ ID NO: 268528 - RNA, 64 nt, Human
acuguggcauuuccuguccaccgccgguuuauaugaucuucauaccuuucccuggaccacaggc

SEQ ID NO: 268529 - RNA, 64 nt, Human
uuugugaugcugagaagugaaguucauuuuaugugaucuucaugcgucguaaucuacuuuuggu

SEQ ID NO: 268530 - RNA, 64 nt, Human
uggcuccuuuuccaucacuacaucuuuucuuccggaucuucaucauggaaguuucauuuguugc

SEQ ID NO: 268531 - RNA, 62 nt, Human
aaaaucuaaaagcuguagcuggagaagcccauggccacgaggaagcagcaauuaauuagauc

SEQ ID NO: 268532 - RNA, 62 nt, Human
auucugauauccggaggugaaaugaaaggccuggccacgaaaucuuuccuccacgccgucca

SEQ ID NO: 268533 - RNA, 62 nt, Human
accccuucuaccaagcucccucguggccacgaggccacgaacccggccagcccugacgcccc

SEQ ID NO: 268534 - RNA, 62 nt, Human
acagaagaaccccuucuaccaagcucccucguggccacgaggccacgaacccggccagcccu

SEQ ID NO: 268535 - RNA, 62 nt, Human
ugauguggcaaaaggcccucuggagggcugguggccacgagguuaaagaagcugcauguuaa

SEQ ID NO: 268536 - RNA, 62 nt, Human
agaacacagccuggcuccucggaggaggcagaggccacgaaggcacaccacgcccuggagca

SEQ ID NO: 268537 - RNA, 62 nt, Human
acuuggcccuggccaggaaccccuggaacugaggccacgauccccucucaaaggcugugcac

SEQ ID NO: 268538 - RNA, 62 nt, Human
uacacacgauccuggcccuccaccugccuccaggccacgaaaugggaauuccagcacuaagc

SEQ ID NO: 268539 - RNA, 62 nt, Human
gggagcugucccugucugucacagcacaguggggccacgaggcugacauucucuggccuugc

SEQ ID NO: 268540 - RNA, 62 nt, Human
cgggcccuggagacgacacacggcagcccacaggccacgacagacgcuggaugcccuccuac

SEQ ID NO: 268541 - RNA, 62 nt, Human
accgcugcccgagagguuaagguggcuucuguggccacgaagcgcuuccgagcugugcccag

SEQ ID NO: 268542 - RNA, 62 nt, Human
agcuuuuccuuucuuuuuuuucuugguguuugggccacgauuuuaaaaugacuuuuauuaug

SEQ ID NO: 268543 - RNA, 62 nt, Human
uuuccaagucaacuugguguagccgguuccccggccacgacucugggcacuuccccugaagc

SEQ ID NO: 268544 - RNA, 62 nt, Human
uucgauguaacaugagaggaagucggcguccuggccacgaaaugcaguucacuuuuuuuuag

SEQ ID NO: 268545 - RNA, 62 nt, Human
ggcugcugacacccgcgcguggggaggacucgggccacgaaaggaaagaaauguauaccgua

SEQ ID NO: 268546 - RNA, 50 nt, Human
agguugugcucuggcaguagggccacgaccugccugccugggcuggagcu

SEQ ID NO: 268547 - RNA, 64 nt, Human
auaauggcaaauccuucaagcagggauaaaagucgaucuucaaacauuaacuuaagcagaccaa

SEQ ID NO: 268548 - RNA, 64 nt, Human
cuggguucugguuguagcucuggccccucccugugaucuucaacaagccacuugcuuucucucg

SEQ ID NO: 268549 - RNA, 64 nt, Human
cacaccuuguuguacaugagaaacuuugaaaauggaucuucauauagaaucaguggauggaaac

SEQ ID NO: 268550 - RNA, 62 nt, Human
cuuugggaggucgaggugggaggaucacuugaggccacgaguucaagaccagccuggccaac

SEQ ID NO: 268551 - RNA, 62 nt, Human
gugcucucugggccuggcucccagucagugguggccacgaugcgguacagggcaucccuccu

SEQ ID NO: 268552 - RNA, 62 nt, Human
agagcugccucccugcugccgagcccuggucuggccacgagccaccacugccucccgcugcu

SEQ ID NO: 268553 - RNA, 62 nt, Human
acacccaugcacgcacacacauacacacugaaggccacgauugcuggcuccacaauuuagua

SEQ ID NO: 268554 - RNA, 62 nt, Human
aaccuguguuuccuggcgcaggagauggacagggccacgacagggcucugagaggcucaucc

SEQ ID NO: 268555 - RNA, 62 nt, Human
ccccgaugcuccuuagugaugcucugaggcguggccacgaucucccucccaggugguaucgc

SEQ ID NO: 268556 - RNA, 62 nt, Human
caaauucaguggggacucagugcccaggcccuggccacgagcuuuggccuuggucuaccugc

SEQ ID NO: 268557 - RNA, 62 nt, Human
ugcuaggcccuggcacaguguuauguggacugggccacgauaggguggagugagcuagugaa

SEQ ID NO: 268558 - RNA, 62 nt, Human
agguaagucagagcagcuuuaccacagcuucaggccacgagagccccuucacccgcccugcu

SEQ ID NO: 268559 - RNA, 62 nt, Human
aagauucucaaauuagcacacccuucucagauggccacgauguaggcuccacuuugccaacu

SEQ ID NO: 268560 - RNA, 62 nt, Human
ugggugccccugaccccuuggcaccggauacaggccacgauaaacauccuuucguguguucc

SEQ ID NO: 268561 - RNA, 62 nt, Human
auuugggagguugagcugguaggaucacaauaggccacgaauuugagaccagccugguaaaa

SEQ ID NO: 268562 - RNA, 62 nt, Human
uugacuggauuggacuaaaagcacugaucagaggccacgacauaaaaauucagucccuuugu

SEQ ID NO: 268563 - RNA, 62 nt, Human
uuccuaaacagccagugcagacguucucucugggccacgaagccccucggguccuccccguc

SEQ ID NO: 268564 - RNA, 62 nt, Human
cacaaggcgaacacaaauggacacacauaccuggccacgaacccacaccuccucagacacuc

SEQ ID NO: 268565 - RNA, 62 nt, Human
ucagggcaaagaaguggccuccuggggggccaggccacgagggccagggcuucugccugaag

SEQ ID NO: 268566 - RNA, 64 nt, Human
uguccuggcccagcuacuccuuuaccugugagaagaucuucaccauuaggaagaucucuagacc

SEQ ID NO: 268567 - RNA, 64 nt, Human
cacuccaugagcaccccaaggcugcaguuuguuggaucuucaauggcuuuuuaaauuuuauuuc

SEQ ID NO: 268568 - RNA, 64 nt, Human
cacuccaugagcaccccaaggcugcgguuuguuggaucuucaauggcuuuuuaaauuuuauuuc

SEQ ID NO: 268569 - RNA, 52 nt, Human
acagugaggcccaggccuagggggccacgagcuucucaacaaccauguuacu

SEQ ID NO: 268570 - RNA, 62 nt, Human
caaagagucccaagcccagcaccugcuccuggggccacgaccucccuggccguggccacccg

SEQ ID NO: 268571 - RNA, 62 nt, Human
ccccucacuggguucggaggagagucaggaagggccacgacaaagcagaaacaucggauuug

SEQ ID NO: 268572 - RNA, 62 nt, Human
aacugggggggccucagggacaggccuggaaaggccacgauggcugcugaauucaaacaagg

SEQ ID NO: 268573 - RNA, 62 nt, Human
cccagcaaauaagaagcauaucuguagcuuaaggccacgaauccguaaaaaccccaugacuu

SEQ ID NO: 268574 - RNA, 62 nt, Human
ccacccuccuccggaaucucccuucccuuccuggccacgaauggcagcguccuccccgaccc

SEQ ID NO: 268575 - RNA, 62 nt, Human
cugaugauccaaccacaggaucccuacucuuuggccacgagaucccaguacccagauccugg

SEQ ID NO: 268576 - RNA, 62 nt, Human
agaagccaaccaaaucccaccaaaaccaaguuggccacgagagugaccucuggucguccuca

SEQ ID NO: 268577 - RNA, 62 nt, Human
ugucgguuaucuggcaaaagccauuuuaugucggccacgaggcagguguucacugugcauca

SEQ ID NO: 268578 - RNA, 62 nt, Human
ccgagccucucccugcccauccucaccacugaggccacgacaaagcacagcuccagcucgga

SEQ ID NO: 268579 - RNA, 62 nt, Human
cuagaauaggcugcaugguguaugucagugagggccacgaggcgucggcuuuagacacagau

SEQ ID NO: 268580 - RNA, 62 nt, Human
caaaggcuguguccauuuggcaaaacuuccuuggccacgagacucuaggugaugugugaagc

SEQ ID NO: 268581 - RNA, 62 nt, Human
caaggacagacuguagaggauccacaucagguggccacgaggacuugcaggcuauaguuaug

SEQ ID NO: 268582 - RNA, 62 nt, Human
ugcccacuccaucaccaugaagccugggauugggccacgaggaacaaacagcagaugcccuu

SEQ ID NO: 268583 - RNA, 62 nt, Human
gaagggcagacccgugucuuuccaugcccgagggccacgacgucacuaugcagggcacacgu

SEQ ID NO: 268584 - RNA, 62 nt, Human
uuggaugcccucaggggugcugaccccugccaggccacgaauaucaggcuagagacccaugg

SEQ ID NO: 268585 - RNA, 64 nt, Human
cacaaugggcucccccgccaacggggacgacagggaucuucaggaacuucugaccucaccaagu

SEQ ID NO: 268586 - RNA, 64 nt, Human
uccuccgaggccaguaccuuuccauuuauucuuugaucuucagggaacugcauagauugaucaa

SEQ ID NO: 268587 - RNA, 64 nt, Human
uucaaaagaacuucaacaaaucaucacguaacaggaucuucagaaaaacuacccugugacuaug

SEQ ID NO: 268588 - RNA, 62 nt, Human
uguugguggcagugaucuggagaggcugcaggggccacgaguuugcagaugcuguacuucag

SEQ ID NO: 268589 - RNA, 62 nt, Human
gugcagccagcaggggaggugagccauacacaggccacgacaaaaugcaggcauuuuauuag

SEQ ID NO: 268590 - RNA, 62 nt, Human
uugcacugaacacgcgugugugcaucgcacgcggccacgaccacagacacgcaugcacacac

SEQ ID NO: 268591 - RNA, 62 nt, Human
ccuggauuggguaucguggggcaggucacccuggccacgaugcccccggcacacccaggccc

SEQ ID NO: 268592 - RNA, 62 nt, Human
aauugcacagauguguaagcuuguugaacuucggccacgagacaugcacacuuccagaggca

SEQ ID NO: 268593 - RNA, 64 nt, Human
ccgcugcuccucuguccugcuagccuuccuccaggaagcacacugggugcagauaaucaggaca

SEQ ID NO: 268594 - RNA, 64 nt, Human
auucauaaaacaggaaaaaguaaacuaucauucggaagcacagcccauuccucccauuuuuugc

SEQ ID NO: 268595 - RNA, 64 nt, Human
ccgccccucuugccccucagaccuugcauccacagaagcacaacccagccaaacaccacagccu

SEQ ID NO: 268596 - RNA, 64 nt, Human
ccuccacuugaccaagaaaaaagugauucucccagaagcacaaagcauacucuugccccucagg

SEQ ID NO: 268597 - RNA, 64 nt, Human
ccuuuuugcucuuaaaacugcuucucugcucugagaagcacagcuaccugccuucacugaaaua

SEQ ID NO: 268598 - RNA, 64 nt, Human
acagacggacagacagacaugcaaacaccagacugaagcacauguaauauagaccguguauguu

SEQ ID NO: 268599 - RNA, 64 nt, Human
ucucaaaauggauuucauauaauuucggagcacggaagcacacacaagcucuuuaugaauucug

SEQ ID NO: 268600 - RNA, 64 nt, Human
gccuaaagagcucugacaccacuuuucauguuaagaucuucauuuagcuccuuuacugggauuu

SEQ ID NO: 268601 - RNA, 64 nt, Human
uucugaauggauugcugucauggacacggacacggaucuucaucugguucauuguauuuauaug

SEQ ID NO: 268602 - RNA, 64 nt, Human
ccaguuuagcccuucccugccuuuaaggagaagagaucuucauggugacauuugagaugaugga

SEQ ID NO: 268603 - RNA, 64 nt, Human
gcuccaaaccuauagaacaaaaugugcaaucacagaagcacaugggauguaaucaugagcucug

SEQ ID NO: 268604 - RNA, 64 nt, Human
ggcuccucagcaaggaagcaaacgccuuggaggagaagcacaugguugcccuuuuguccuugcu

SEQ ID NO: 268605 - RNA, 64 nt, Human
cuagcacaaauuagaugguuuggagcacaauggugaagcacacuccccucccuccucaccuggg

SEQ ID NO: 268606 - RNA, 64 nt, Human
aaaggcagucuauaauuaacugacagaccuaacugaagcacagagaauacaucagacuuaugca

SEQ ID NO: 268607 - RNA, 64 nt, Human
ugaggaaaauggaagaccuaaggcagacaggaaggaagcacaaaagacaagcauugggucagac

SEQ ID NO: 268608 - RNA, 64 nt, Human
guucaguagguagagaccaagcaucuaucugauagaagcacauggagugcaauaggacauugug

SEQ ID NO: 268609 - RNA, 64 nt, Human
aauuuguuggaaaaacaugaauucauaaauucaggaagcacaauauauaccaaacauauauuua

SEQ ID NO: 268610 - RNA, 64 nt, Human
ucccgcuuuggggagcgccucgcuucacggacaggaagcacagcagguuuauccagaugaacug

SEQ ID NO: 268611 - RNA, 64 nt, Human
ccucugaaggugaaacugagcagaugaggccacagaagcacaaggggaaggugccgugucaagc

SEQ ID NO: 268612 - RNA, 64 nt, Human
uuuugagggguaauuaggacccucgacguaccaagaagcacauaaugccuuuguauuuauuuca

SEQ ID NO: 268613 - RNA, 64 nt, Human
agaguaugaaguggaaugaaugcuccuguucugagaagcacacuuguaacugcaucuuuuggaa

SEQ ID NO: 268614 - RNA, 64 nt, Human
cuaaagcugccagccgagauagccaaggccaaaggaagcacaugccucucucaggccaaacuca

SEQ ID NO: 268615 - RNA, 64 nt, Human
auucaaauuaaggcaacaaacauauaccuuccaugaagcacacacagacuuuugaaagcaagga

SEQ ID NO: 268616 - RNA, 64 nt, Human
aucugaacacaugaaucuuuuuuggucaguguaggaagcacagccagauccuauaggaaugaau

SEQ ID NO: 268617 - RNA, 64 nt, Human
cauuuugcugcuaaagcaagagaaacuuggagcugaagcacacaccuggucugccccuagauuu

SEQ ID NO: 268618 - RNA, 64 nt, Human
uaaacugauucauaauaaauaucuguacuucuucgaucuucaccuuuugugcugugauucuuca

SEQ ID NO: 268619 - RNA, 64 nt, Human
aaugcuaguuuccaccaucuuucaaugauacccugaucuucacugcagaauguaaagguuucaa

SEQ ID NO: 268620 - RNA, 64 nt, Human
cauccugguuuccacugucuuucaaugacacccugaucuucacugcagaauguaaagguuucaa

SEQ ID NO: 268621 - RNA, 64 nt, Human
cuggagacagggguuugaggugggggccucucuggaagcacauuuggagggaaagacaagagag

SEQ ID NO: 268622 - RNA, 64 nt, Human
ggauaaagagagagaaggacuguuaugaaaaacagaagcacaaauuuuggugaauugggauuug

SEQ ID NO: 268623 - RNA, 64 nt, Human
ucuuugccuacugacacccuuguccccacaagcagaagcacagaggggucacuagcaccuugug

SEQ ID NO: 268624 - RNA, 64 nt, Human
cccagagcugugccuaguucauagaaacugacuggaagcacauugcugagggagguuuguugaa

SEQ ID NO: 268625 - RNA, 64 nt, Human
ccuccacuucccucguaguuggcaggagcuccuggaagcacagcgcugagcauggggcgcuccc

SEQ ID NO: 268626 - RNA, 64 nt, Human
gaaugauauaagguuuuuuuuucucacagaagaugaagcacacaggaaccuaaugggccaacug

SEQ ID NO: 268627 - RNA, 64 nt, Human
aauucuuucuugcuugaauaacuauuuguccaaagaagcacaguugaaguccuagaauaaugga

SEQ ID NO: 268628 - RNA, 64 nt, Human
aguucagcuaccugauuacugccccauucuuuuagaagcacaugucugccaaggagugguuugu

SEQ ID NO: 268629 - RNA, 64 nt, Human
cuccacaacccuguuuggagcuacugcaggaccagaagcacaaagugcgguuucccaagccuuu

SEQ ID NO: 268630 - RNA, 64 nt, Human
auuggccuuuuaauucuaaguaguauuacccuaugaagcacagugugcaaagguaugcuacaag

SEQ ID NO: 268631 - RNA, 64 nt, Human
uaccuuuccaaguucucacugcuggaaagagcuagaagcacaguucaaaguucuggcuucugga

SEQ ID NO: 268632 - RNA, 64 nt, Human
gcauugauguggacuucauagacacaaaggcuucgaagcacaagccaaauaugucaauauuugu

SEQ ID NO: 268633 - RNA, 64 nt, Human
auuugagacaauuaaaauccuucugggggcacuggaagcacaauacggugaccaaucuugcuuu

SEQ ID NO: 268634 - RNA, 64 nt, Human
uccccucugagcccucucaccuuguccuguggaagaagcacaggcuccuguccucagaucccgg

SEQ ID NO: 268635 - RNA, 64 nt, Human
ggauuucaguuuuaacaaaugcuauuaaaguggagaagcacacucuggucuuggaauuccauuu

SEQ ID NO: 268636 - RNA, 64 nt, Human
gugaccuccaaggggauuggugaauacucauaaggaucuucaggcugaacagacuaugucuggg

SEQ ID NO: 268637 - RNA, 64 nt, Human
ucaguguucgaccaccuaagaaaaguuggaaaaagaucuucaaccuuucgggaggagagaaaac

SEQ ID NO: 268638 - RNA, 64 nt, Human
cccuuuguauaaguuuuaaaaagagauggagggagaucuucauuucuuugaggagaucaguauu

SEQ ID NO: 268639 - RNA, 64 nt, Human
cacccuuugucuccaccacacauaguguacuuuggaagcacaacguccaggcugguaccgcagc

SEQ ID NO: 268640 - RNA, 64 nt, Human
uuuaguggucauuuuuuaagugcacaauuaauaagaagcacaacuuguucacaaacucauucag

SEQ ID NO: 268641 - RNA, 64 nt, Human
auguuucuagucuuucaagcuuagugauaagguggaagcacaagaaaaauuucaguagaauaca

SEQ ID NO: 268642 - RNA, 64 nt, Human
cagggcugggaggaccccagugcccuccucagaagaagcacaugggcuccugcagcccuguccu

SEQ ID NO: 268643 - RNA, 64 nt, Human
cccuuggugcuuuagugcaagaagccuaggcucagaagcacagcagcgccaucuuuccguuuca

SEQ ID NO: 268644 - RNA, 64 nt, Human
agccagccuugcaguaggcaguagacuauaagcagaagcacauaugaacuggaccugcaccaaa

SEQ ID NO: 268645 - RNA, 64 nt, Human
gacauaauauaaacuuauuuacuuuccuuuuuaugaagcacauacaaaagaagacagggaaugc

SEQ ID NO: 268646 - RNA, 64 nt, Human
uuuguaugcauuuguuaccuuuaaacauuuggaagaagcacaaaaaaauagauuuaguuaaccc

SEQ ID NO: 268647 - RNA, 64 nt, Human
gcaauguugaaugacaaaaauaaacaguucaagugaagcacaaggauuaaguuggaaaagcugu

SEQ ID NO: 268648 - RNA, 64 nt, Human
gcaucauuuagggaugccugagauggcaguucaugaagcacagaagauaaagaagaagucuuuc

SEQ ID NO: 268649 - RNA, 64 nt, Human
ugugugauuuaucagcuaauuuagguagaacagggaagcacacccaaagaauuuucaaaggaaa

SEQ ID NO: 268650 - RNA, 64 nt, Human
gcauauggcucagagcagagccggaucucccaaggaagcacaaauaguuuuugucgcuaacuua

SEQ ID NO: 268651 - RNA, 64 nt, Human
uaggagcuuaagaaagaacauuuugccugauugagaagcacaacugaaaccaguagccgcuggg

SEQ ID NO: 268652 - RNA, 64 nt, Human
accccgacagaaggugggggggggggggcucugggaagcacaggccagcaccuccccagguggc

SEQ ID NO: 268653 - RNA, 64 nt, Human
aauaauagcccguuucgucucugacccaacagaggaagcacagaucaaaucaccuuggaguggu

SEQ ID NO: 268654 - RNA, 64 nt, Human
uuuuuacuuuuauuauaugagauagagcugugcagaucuucacucaaguuaguucugucacgcu

SEQ ID NO: 268655 - RNA, 64 nt, Human
gccaaaaguugucugaaucuccuuauucuucucugaucuucauuuaugcagccaaugucuagcu

SEQ ID NO: 268656 - RNA, 64 nt, Human
aguuaaaauuuaaauggcuuuugccacauacauagaucuucaugaugugugaguguaauuccau

SEQ ID NO: 268657 - RNA, 64 nt, Human
guucccuucccacuugcucuccgugggaccgggugaagcacagaccuugccaagcuucagguuc

SEQ ID NO: 268658 - RNA, 64 nt, Human
agggaagccagaaagaaaagacggcccagccacagaagcacaauggcccuucgcucucccccag

SEQ ID NO: 268659 - RNA, 64 nt, Human
uguggcccaaguccaucucuuggucuucuccuuugaagcacagccuauuucugagccaaggguu

SEQ ID NO: 268660 - RNA, 64 nt, Human
aaggacccaauguaccaguauuuauaccucuaaugaagcacagagagaggaagagagcugcuua

SEQ ID NO: 268661 - RNA, 64 nt, Human
uaaaacuguaagacaagccuccuguaugaagccagaagcacaagugccuucagagggcaguuga

SEQ ID NO: 268662 - RNA, 64 nt, Human
ccacagccaggcuucugucauacagguagaucccgaagcacagagacauaaaaaaggucuccca

SEQ ID NO: 268663 - RNA, 64 nt, Human
agaacuuccuucugcuucuaccagauggcccaaggaagcacaucguccuguuuuauugcuuucu

SEQ ID NO: 268664 - RNA, 64 nt, Human
cuaguucuuguuaauuuuuauuuguuauacaauggaagcacaauguuauaaggaaagguaauuu

SEQ ID NO: 268665 - RNA, 64 nt, Human
cuuauuuguguuuuucaugguuaaaaaaauaaaagaagcacaaugaccaguacaugaaaucagc

SEQ ID NO: 268666 - RNA, 64 nt, Human
agcucaacuaguauaagcaaaaauauaacaucuagaagcacaguuuuagccaggauguuuaaaa

SEQ ID NO: 268667 - RNA, 64 nt, Human
guuuccccacaaagggaauuucucacucugguuggaagcacaaacacugaaaugucuacguuuc

SEQ ID NO: 268668 - RNA, 64 nt, Human
auucuaguuuucagaauaggaccagaugcccauagaagcacaguacagacugaaguaaacccaa

SEQ ID NO: 268669 - RNA, 64 nt, Human
cccaauucauucuuaucugccaaagaauuaucuagaagcacaucaaauaccagcaccccaccug

SEQ ID NO: 268670 - RNA, 64 nt, Human
acugagaaggacaaccaaagugagcuggaucuuugaagcacaaaugcagcaaauccuucacccu

SEQ ID NO: 268671 - RNA, 64 nt, Human
uguggaguaucagucgcucacaggacuuggaucugaagcacaguaaacgcaagaggggauuugu

SEQ ID NO: 268672 - RNA, 64 nt, Human
ucuaacucauggauuuuucucuuuccucauggaugaucuucagcaagaguggacugggaagcug

SEQ ID NO: 268673 - RNA, 64 nt, Human
agccauguguguugaucagauacaguuuuucugagaucuucaauuaaucucacuuuaaaaauga

SEQ ID NO: 268674 - RNA, 64 nt, Human
aucuugaaauguugaaauguaaggugugcacagugaucuucaacuuaacaaacacuuacguucu

SEQ ID NO: 268675 - RNA, 64 nt, Human
auaaaugcaugccuagaguagugcucucguugaugaagcacauguaugaggagaccagcagcaa

SEQ ID NO: 268676 - RNA, 64 nt, Human
cagccaaggccaagcaggcccaucucacaacccugaagcacauacaagcacccugguggaagaa

SEQ ID NO: 268677 - RNA, 64 nt, Human
uugaauuucucuucaaucaaagugccccaaaacagaagcacaaguaaauaaaagaaauuuaagu

SEQ ID NO: 268678 - RNA, 64 nt, Human
ucagggaugcuuuguaucuaacacaacgccaacagaagcacauuugucuuccagaacaccgugc

SEQ ID NO: 268679 - RNA, 64 nt, Human
cugagugacacuauuuguaaauauaacuaguugugaagcacacauaccuuuauuuugggaauuu

SEQ ID NO: 268680 - RNA, 64 nt, Human
ugacacuaggaauauaauaaagguaacacagcaagaagcacagaacuacucccucuucaucucc

SEQ ID NO: 268681 - RNA, 64 nt, Human
gaggugauuuugaaucuuguccauauaggaaaaugaagcacagaauuacucagucuuccauauu

SEQ ID NO: 268682 - RNA, 64 nt, Human
auaaaaaccauuugccaaagcaacacucuacuuagaagcacauguacauacauggaccucauuc

SEQ ID NO: 268683 - RNA, 64 nt, Human
aauuggaaaaauagcuccauuuuuuggugcuugggaagcacagugaccaaaaaaguuguauggc

SEQ ID NO: 268684 - RNA, 64 nt, Human
ggaguuguaccacaaacaguacuacaaugauucugaagcacaguguauucagacagauacagug

SEQ ID NO: 268685 - RNA, 64 nt, Human
aauugucuuuaaaacaacaacacauaaggaaucugaagcacaggagaacacagagccaacaaac

SEQ ID NO: 268686 - RNA, 64 nt, Human
cuggccuugaggacgauguuuggaaauaugguuggaagcacaauucauucgcuacuaguuauuc

SEQ ID NO: 268687 - RNA, 64 nt, Human
uaucacauuccagcuacaauacuuccauuuauuagaagcacauuaaccauuucuauagcaugau

SEQ ID NO: 268688 - RNA, 64 nt, Human
uuaggaagccuuuuauucgugggaacucgaacuugaagcacaaguuccugguuugaauccuggc

SEQ ID NO: 268689 - RNA, 64 nt, Human
gugccuugauuaaggcuacugacccuaaauuucugaagcacagccaagaaaaauuacauuccuu

SEQ ID NO: 268690 - RNA, 64 nt, Human
aaaggauuccaccuccaucgucuuuccuaacuuagaucuucauugagaaauugggcaagguuaa

SEQ ID NO: 268691 - RNA, 64 nt, Human
ucuguuuccuuggccuggccagagcagcagugcugaucuucauuugggaaaggauguuccuggg

SEQ ID NO: 268692 - RNA, 64 nt, Human
caucugauuucuaaaacauauuacauuuuaugcugaucuucaguucauaauucuuccaggaaaa

SEQ ID NO: 268693 - RNA, 64 nt, Human
cucuauguuguaaaugaucaacuacaauauucaggaagcacauuuauucagauucucaguaaaa

SEQ ID NO: 268694 - RNA, 64 nt, Human
uccaaaguucauugguucaguggugugaagaaaggaagcacaauuggcagguuaucacuuucca

SEQ ID NO: 268695 - RNA, 64 nt, Human
cuuuuauaccuuucuugguuugacgugcaauaaagaagcacauuauuuuagcuucuggcuacug

SEQ ID NO: 268696 - RNA, 64 nt, Human
aaucuuuaccuguauacagugcagagccuucucagaagcacagaauauuuuuauauuuccuuua

SEQ ID NO: 268697 - RNA, 64 nt, Human
gguacacuuuuuuugaaugguuuucuaacaacuugaagcacaggaucaaggaauuagggugguc

SEQ ID NO: 268698 - RNA, 54 nt, Human
guggcaagcagcuugagugaggaugaagcacaucuuaaaggaaugaaguguaau

SEQ ID NO: 268699 - RNA, 64 nt, Human
ugccuaugccuuaagucaaugcacucagcaaggagaagcacaucuuauuuaucuuguuaccuau

SEQ ID NO: 268700 - RNA, 64 nt, Human
ucccauuuacuuuagguuucaagaggauucaccggaagcacaugccccggucuagucccauuug

SEQ ID NO: 268701 - RNA, 64 nt, Human
cuuugucauuucauauuggauuuucuauagagaagaagcacaauggggaagauaggagcaaggu

SEQ ID NO: 268702 - RNA, 64 nt, Human
ugauuuuuuucucuccacaucaggauaguuuacugaagcacaaucucuuauacuagugggacaa

SEQ ID NO: 268703 - RNA, 64 nt, Human
guacugggagaaaccaaggcugaagagucagguugaagcacaggcuuuuguuuuuuguuguuuu

SEQ ID NO: 268704 - RNA, 64 nt, Human
uucauaucaccagacacaccaggcaacagaaguugaagcacaaccacuguagcaaaauaccuug

SEQ ID NO: 268705 - RNA, 64 nt, Human
gggaccuuggcauguggcuggccacaccaagcaggaagcacaaacucccccaagcugacucauc

SEQ ID NO: 268706 - RNA, 64 nt, Human
aaacagccuccuauaaaguaaaccucuucccguggaagcacacucuacuacuaaagggaaggcc

SEQ ID NO: 268707 - RNA, 64 nt, Human
ggaaauggaaugccccugccccaggaacauggcagaagcacagguucuguaccucagauggacu

SEQ ID NO: 268708 - RNA, 64 nt, Human
ucaaauuaaguagaacugcccuugccggaauagugaucuucaaaaaacccuugcuuuuagggga

SEQ ID NO: 268709 - RNA, 64 nt, Human
aguguuaaaaauacccucauacguuauugcauuugaucuucacagaaagugcauuuuaaccagu

SEQ ID NO: 268710 - RNA, 52 nt, Human
ccaaucgaaucagaguauagaagaucuucauuugaaaaccaucuaccucagc

SEQ ID NO: 268711 - RNA, 64 nt, Human
gcucugggcuuccucggagaccccuggggauggggaucuucagggaaggaacucuggccaccca

SEQ ID NO: 268712 - RNA, 64 nt, Human
gauuccuagauuacaucugccuuaaaaaaacacggaagcacaguuggaggugggacgaugagac

SEQ ID NO: 268713 - RNA, 64 nt, Human
agaggugccagugauggacuggaucagcuugaaagaagcacaaagacuccgugaucacaauagu

SEQ ID NO: 268714 - RNA, 64 nt, Human
gggcuaccugcccccagguggccaccaaguuguggaagcacauuucuaaauaaaaacugcucuu

SEQ ID NO: 268715 - RNA, 64 nt, Human
cacggggccuaugugucucugucgcgucugcugugaagcacaugaugcucuauuuauuguagag

SEQ ID NO: 268716 - RNA, 64 nt, Human
cagagauggacuguggccaggcuuccacauuccugaagcacacagaucucaggaaagguuauuu

SEQ ID NO: 268717 - RNA, 64 nt, Human
aaaaaaccuccauuuugaaaaucuacguuguacagaagcacaugucuuuaaugucuucagacaa

SEQ ID NO: 268718 - RNA, 64 nt, Human
uucauaugguuuaguuuucaaaaaacuucaccaugaagcacaauguauauauuuaugcaguuuu

SEQ ID NO: 268719 - RNA, 64 nt, Human
gugacuauuguauaaaaacaaaucuugauauccagaagcacaugaaguuugcaacuuuccaccc

SEQ ID NO: 268720 - RNA, 64 nt, Human
uaauucuuuuuuuaaaaaaacccaaccuccuagagaagcacaacugucaagagucuuguacaca

SEQ ID NO: 268721 - RNA, 64 nt, Human
cauggguaaauguauucacauauuaccaagagaagaagcacauuaucuaugaucuuuuggccca

SEQ ID NO: 268722 - RNA, 64 nt, Human
uuccugauaugaccaagaaagcuucuuaucaaaagaagcacaauugccuucgguuaccucauua

SEQ ID NO: 268723 - RNA, 64 nt, Human
cgcaggcuuccagaggacaaaccccaauacaggagaagcacaagacagagaagggccaaugggg

SEQ ID NO: 268724 - RNA, 64 nt, Human
gaaauauccauccaugaauuaugccagcaagaaugaagcacagaugaaggcagcgccccucacu

SEQ ID NO: 268725 - RNA, 64 nt, Human
aaaaaaggucaagcaguuuucacuugucacgccagaagcacacuugaggcugcagucgcagaaa

SEQ ID NO: 268726 - RNA, 64 nt, Human
gucgaccccauacagagaacucagcuugaagcuggaagcacacaguggguagcaggagaaggac

SEQ ID NO: 268727 - RNA, 64 nt, Human
ucggauugacgaaaaucaaccauaauuuucaagggaucuucauggguugugacuggaagcugac

SEQ ID NO: 268728 - RNA, 64 nt, Human
uguugucucacuuucugccuaccuuuuagguauugaucuucacuauauuuuuuucucucucucu

SEQ ID NO: 268729 - RNA, 64 nt, Human
uuuuggaaaaggaauuaagccucacggaacaauggaucuucagcaaaccuuaacuucauugucu

SEQ ID NO: 268730 - RNA, 64 nt, Human
uccuuuggggcaugauguuuuaaccuuugcuuuagaagcacaagcuguaaaucuaaaaggcacu

SEQ ID NO: 268731 - RNA, 64 nt, Human
cgugggugcccgccaaacgcccugcgaccgcucagaagcacaaaugcuguccauggccgugagg

SEQ ID NO: 268732 - RNA, 64 nt, Human
caguggcagcccuggggcccuuucccuucuggaggaagcacaagccucagggaaggggaagcag

SEQ ID NO: 268733 - RNA, 64 nt, Human
gaaucaugagaauuauggguuaaaaagccacaaagaagcacauauuggugaccaucauuaauga

SEQ ID NO: 268734 - RNA, 64 nt, Human
cuagucuccaccugagacccugggagagaaguuugaagcacaacucccuuaaggucuccaaacc

SEQ ID NO: 268735 - RNA, 64 nt, Human
ggagcuagaauuugauaugugaacaguuguguuugaagcacagugaucaaguuauuuuuaauuu

SEQ ID NO: 268736 - RNA, 64 nt, Human
ccacacacgcaggaacucccagcaacacaagcuggaagcacauguuuauuuauucugcauuuua

SEQ ID NO: 268737 - RNA, 64 nt, Human
uucagcccccuguauucucaugauuuucucucaggaagcacacacugugaauggcagacuuuuc

SEQ ID NO: 268738 - RNA, 64 nt, Human
ccaaaaguacuuacccuaaaacauguguugccuggaagcacauguguguaucgcugccuugcca

SEQ ID NO: 268739 - RNA, 64 nt, Human
cucacagcagaggaaccuuuccaagguggggauggaagcacagucgggacagaauucgauggau

SEQ ID NO: 268740 - RNA, 64 nt, Human
guuucuuauucuuacaacaugauuguuuauaugugaagcacaucuugcuguugccuuauuuuug

SEQ ID NO: 268741 - RNA, 64 nt, Human
cauaagcauaaaaagaaaaucuuuguugccaacugaagcacaugaugauuuugugguccuuuau

SEQ ID NO: 268742 - RNA, 64 nt, Human
guguguggaugcauagagauggaggugcuguagagaagcacaggcucacccgcuccguccagug

SEQ ID NO: 268743 - RNA, 64 nt, Human
gccaucuucuaagagacuuuguagcugccuccuagaagcacauucugagcacauuugagaccuc

SEQ ID NO: 268744 - RNA, 64 nt, Human
gcuucuucagacucagcccaaauuaggaagugcagaagcacaugauggugaaaaaccuaggauu

SEQ ID NO: 268745 - RNA, 64 nt, Human
aaugacuugggaaaaacacccucccucacuacaggaucuucauguuguuaauaauauaaacaaa

SEQ ID NO: 268746 - RNA, 64 nt, Human
uagggcagaagugaaugccugucacggagggauugaucuucagggcuguuuuuguuccugccuu

SEQ ID NO: 268747 - RNA, 64 nt, Human
auauucugaaacaauauaguaauaauggaauugugaucuucaguugcaccucaaccauuuuuuu

SEQ ID NO: 268748 - RNA, 64 nt, Human
ucauucuuugucaauucauuuuuucccaugagaugaagcacaugugacgaauacggacuagaua

SEQ ID NO: 268749 - RNA, 62 nt, Human
cuaccagagggaaaauguaaccugucacucaagaagcacaccuacagagcaccuguagcugc

SEQ ID NO: 268750 - RNA, 64 nt, Human
ggccccggagccacagcacaaucaucucaguggcgaagcacaccacuugauucuauuuuuuuuu

SEQ ID NO: 268751 - RNA, 64 nt, Human
ugaaguuuuccuaaggcaagcaagaagaggaguggaagcacaguugccuggauuuggaggcaga

SEQ ID NO: 268752 - RNA, 64 nt, Human
ggagaauaacauaggugccuuugcuacgcgaagugaagcacacaguuuuagauuuuugcaggac

SEQ ID NO: 268753 - RNA, 64 nt, Human
agaagcgugaagaucguaggauugagaacuuagggaagcacauuagcuugcuugaagugcugau

SEQ ID NO: 268754 - RNA, 64 nt, Human
gucccuauuugaaauguguuauaauacaaacaaggaagcacauuguguacaaaauacuuaugua

SEQ ID NO: 268755 - RNA, 64 nt, Human
ucaagauacuauuauuauauuuucacagacuuuugaagcacaaauuuauuggcauuuaauauug

SEQ ID NO: 268756 - RNA, 64 nt, Human
uggauacagguggcugggcuauuccauccaucuggaagcacauuugagccuccaggcuucuccu

SEQ ID NO: 268757 - RNA, 64 nt, Human
ugggugacagacuucuaagcaggaagauagacgugaagcacaugguuacauuugggaacuugug

SEQ ID NO: 268758 - RNA, 64 nt, Human
ccugcaggguaguaacccagugauguuucuuacagaagcacaauauguugaaaauccugggugu

SEQ ID NO: 268759 - RNA, 64 nt, Human
gagugcuuuguggcuuugggguccucugggagcugaagcacacggccauguuggagagcaaaac

SEQ ID NO: 268760 - RNA, 64 nt, Human
gcauguuuuguguguuugccacaaaacauugcuugaagcacauacuuagauagaaauuggucuu

SEQ ID NO: 268761 - RNA, 64 nt, Human
aucuuggcaaugagugagagauguuaauuucacagaagcacaacucccaacccaacccuuagga

SEQ ID NO: 268762 - RNA, 64 nt, Human
guggcacagcucacucauggggucugaggggagagaagcacaccaggggcgcccucugccuucc

SEQ ID NO: 268763 - RNA, 64 nt, Human
gacauaaaguaaaauaguuuaucauuuacugugugaucuucaguaagucucucaggcucucuga

SEQ ID NO: 268764 - RNA, 59 nt, Human
ggcuugcgccacggcagugaaucuucauggaucuucaugcagccauacaaacccugguu

SEQ ID NO: 268765 - RNA, 64 nt, Human
caaagaguagcuuuuuguacuuuuauuacugagagaucuucauauacuucauuuuuuaauauaa

SEQ ID NO: 268766 - RNA, 64 nt, Human
uaugguuguuggaugugccacuuccaauccaaaagaagcacacuugguaagucaguuuuguuuu

SEQ ID NO: 268767 - RNA, 64 nt, Human
uaaaauuaucagaaucucaguguuugaaaguacugaagcacaaacauauaucaucucuguacca

SEQ ID NO: 268768 - RNA, 64 nt, Human
ccccuuucuuuguggaguuuccuaaccugcugcugaagcacaauguuuuggugcuuucuuuucu

SEQ ID NO: 268769 - RNA, 64 nt, Human
gguccacacacccuucaggaagggggagcacugagaagcacagcacaggggcucagccugggau

SEQ ID NO: 268770 - RNA, 64 nt, Human
gggccugugucagccgccggcccuccgcacccuggaagcacacggccucugggaaggacagccc

SEQ ID NO: 268771 - RNA, 64 nt, Human
cugcaaucacagccguccgcuggaaaaacguuucgaagcacaguggccagcgagcgagcacgug

SEQ ID NO: 268772 - RNA, 64 nt, Human
ggaacaaagauaauggaaccuccauuuucaaacugaagcacagggacagaaaauauauuucuag

SEQ ID NO: 268773 - RNA, 64 nt, Human
gugauguuguuuccuuacuacugccucaccucaggaagcacauaaugucuacuugucucuuuuc

SEQ ID NO: 268774 - RNA, 64 nt, Human
aucacagccuagaguuaaguaaagucaauucacagaagcacaauuuugcccuuugcgagacauu

SEQ ID NO: 268775 - RNA, 59 nt, Human
ugcaucgggauucagaaugaccaaccuaagaagcacaaauuuaguuuggguguuccuca

SEQ ID NO: 268776 - RNA, 64 nt, Human
uggguagcagccagcaaaggccaucagacaaccagaagcacauccauuuuuguagugucacaaa

SEQ ID NO: 268777 - RNA, 64 nt, Human
agauaagggacgcuaccuugcuuuucuggcacaggaagcacaugauaaagcaugcucagaugag

SEQ ID NO: 268778 - RNA, 64 nt, Human
cuuucagcccaucaaccagcauuggucccauagggaagcacaggggacucacccucuuucauau

SEQ ID NO: 268779 - RNA, 64 nt, Human
ccuggggguuuggggccggcuucuccccucuugugaagcacaaaguccccuccccaccuacccu

SEQ ID NO: 268780 - RNA, 64 nt, Human
uagcuaaacauuucauuguccccagucugcaaaagaagcacaauucuauugcuuugucuugcuu

SEQ ID NO: 268781 - RNA, 64 nt, Human
uacugcauaccuguaaaucgaaggccaauggucagaucuucaaaauaaaaagucaucuuaaaaa

SEQ ID NO: 268782 - RNA, 64 nt, Human
aagggguuuaaaccucuuucuucugcuuuuuccugaucuucaaaccucaaagagccaaguuaaa

SEQ ID NO: 268783 - RNA, 64 nt, Human
gaacucagcacucagaauuuuaaauuaaaucaaugaucuucaaguauuugccacuuucgaguac

SEQ ID NO: 268784 - RNA, 64 nt, Human
guugccgccaaacaaggcaaaaaaauuuaaacaugaagcacacacacaaaaaaggcaguaggaa

SEQ ID NO: 268785 - RNA, 64 nt, Human
ugccacccugcucagagcuuuccacccacagggagaagcacaaucaggaacagugagugcuccu

SEQ ID NO: 268786 - RNA, 64 nt, Human
acuauuaaggauguagcuuuucaccuuuacuuuagaagcacaguaaauaucccaaacugugaug

SEQ ID NO: 268787 - RNA, 64 nt, Human
gaaaaggcaguuaugaagccaauucauuuugaaggaagcacaauuuccaccuuauuuuuugaac

SEQ ID NO: 268788 - RNA, 64 nt, Human
cacucccggccccgguucccacaggacacgcuaagaagcacagggagcauuuaacaggcucacc

SEQ ID NO: 268789 - RNA, 64 nt, Human
ugacugcuguccgcugcggaaucuguucuugguggaagcacagguccgugucgcugcugugguu

SEQ ID NO: 268790 - RNA, 64 nt, Human
cuuucuaaaguuugauguguucucaagccugacagaagcacaaggaacaguuugauacacuuuu

SEQ ID NO: 268791 - RNA, 64 nt, Human
cuuaccacacacauggguguuucuauuauccuuggaagcacagaccucgggcauccccuuauug

SEQ ID NO: 268792 - RNA, 64 nt, Human
agcugggaaggccgcaagaggcauagagggagaggaagcacacugcagggcugcuguggcccag

SEQ ID NO: 268793 - RNA, 64 nt, Human
ugagacggagaccccgguggcaguggaaaaaucagaagcacaaaggaaaacucuuggccucugc

SEQ ID NO: 268794 - RNA, 64 nt, Human
aaugugccuuaaaaaucaagacacuaguucagaggaagcacauaauguccagaucuauggcgaa

SEQ ID NO: 268795 - RNA, 64 nt, Human
cucaaugugucuguagacuuagauacauccucuugaagcacauccauuucuuuagcgucucuca

SEQ ID NO: 268796 - RNA, 64 nt, Human
uccuggagacuuaccauugagccaugcaaucugggaagcacaggaauaaguagacacuuugaaa

SEQ ID NO: 268797 - RNA, 64 nt, Human
uucucacucccuugaucucaagggcguaacucuggaagcacagcuugacuacacgucauuuuua

SEQ ID NO: 268798 - RNA, 64 nt, Human
uagauggugccuucucgcuguauccucaaugguagaagcacaaacaagcaagcuccuuccugcc

SEQ ID NO: 268799 - RNA, 64 nt, Human
uuucugagggauuacagccugggaggauuccaccgaucuucacuucuagcagguuuuuuaaacg

SEQ ID NO: 268800 - RNA, 64 nt, Human
auucaaaaguuuuguaggguggugggaaaugggggaucuucaauguuuauuuuaaaauaaaaua

SEQ ID NO: 268801 - RNA, 64 nt, Human
caaccugguuuccaaagucuuucaacgacacccugaucuucacuaaaaauuguaaagguuucaa

SEQ ID NO: 268802 - RNA, 64 nt, Human
aacagguacuuugaaggcaagacauaggguugaagaagcacagccagccucugaaaucauagcu

SEQ ID NO: 268803 - RNA, 64 nt, Human
ucccuaacccuugccugaccaugugagguuaucugaagcacaaggcccacccucaccuaucugu

SEQ ID NO: 268804 - RNA, 64 nt, Human
aaaagucuuccucaaugucaucacucaauauugcgaagcacaugccccaucgagccuacugggc

SEQ ID NO: 268805 - RNA, 64 nt, Human
gaagaucugugcuuuccaacaagugacuacccuugaagcacauccccuucuggaucugaaaaga

SEQ ID NO: 268806 - RNA, 64 nt, Human
cuugugcccucuuuuggggcagccuguugaaacugaagcacagucugaccacucacgauaaagc

SEQ ID NO: 268807 - RNA, 64 nt, Human
gccauggggccgguuggaaggauacuuggaacgggaagcacaugagaggugggcacccggugcc

SEQ ID NO: 268808 - RNA, 64 nt, Human
ggcuacucuccucggcccccuccaucgggcugaggaagcacagcagcaucuucaaacauguaca

SEQ ID NO: 268809 - RNA, 64 nt, Human
aggagaggaggaagauggugacaugauuugguuagaagcacaagcaaacugaucagccucccag

SEQ ID NO: 268810 - RNA, 64 nt, Human
cuaguggugauccggcucauucuccugcaaguuggaagcacaauuuuccccccaaguggaggaa

SEQ ID NO: 268811 - RNA, 64 nt, Human
ugguggguacucaauguguacuuuuggguucacagaagcacagcacccaugggaaggguccauc

SEQ ID NO: 268812 - RNA, 64 nt, Human
guuuuggaagacgagagaaaguugagaagaacacgaagcacagacccugaugugauaaaacauu

SEQ ID NO: 268813 - RNA, 64 nt, Human
cuggugucuguacuguguacacacaucccucugagaagcacaaggagacgacacgcgcauugua

SEQ ID NO: 268814 - RNA, 64 nt, Human
cuuguauguucuugggugguuccuaagggaaagggaagcacaugaucaugggaaugauagccca

SEQ ID NO: 268815 - RNA, 64 nt, Human
gcgacaaugcugagauugaucuggaagauuuaaagaagcacacagucuacuacggugguuucca

SEQ ID NO: 268816 - RNA, 64 nt, Human
auccauccuauguuugucccacuauuguauuuuggaagcacauaacuuguuugguuucacaggu

SEQ ID NO: 268817 - RNA, 64 nt, Human
gccaggacuaacauuucuggauuugugaagaagggaucuucaaagccauugaacccacagagcu

SEQ ID NO: 268818 - RNA, 64 nt, Human
ugcuucaaauaaauagaaaaauaguuauaauauugaucuucaacuuugccauucaugcuucuau

SEQ ID NO: 268819 - RNA, 64 nt, Human
uagcaagacccugcugugauuacuauguuguacagaucuucaaaguauauugccuaauaugagu

SEQ ID NO: 268820 - RNA, 64 nt, Human
uuuggacuauuguauauaauguauuguaauauuugaagcacaaauguaauacaguuuuauugug

SEQ ID NO: 268821 - RNA, 64 nt, Human
agcugucacagggcaauuucuuuauuuauaacaugaagcacaauggauuuacagcucuaggaac

SEQ ID NO: 268822 - RNA, 64 nt, Human
cuuggaaucaagagauaguuuauuacaugcguaagaagcacauucuaacgcuacuaaauguuca

SEQ ID NO: 268823 - RNA, 64 nt, Human
uuuggccuccucaaaagcagcagcaagucgucaagaagcacaccaauucuaacccacaagauuc

SEQ ID NO: 268824 - RNA, 64 nt, Human
cagggaagggaccaauuaauuuuaaaacucacuugaagcacagcuggucauggggcuugguaua

SEQ ID NO: 268825 - RNA, 64 nt, Human
auucccuccucccuucuacugcuucuaccaacuggaagcacagaaaacuagaauuucauuuauu

SEQ ID NO: 268826 - RNA, 64 nt, Human
aagcaaccuguggccugcacuuguggccucgaaggaagcacaaacccuccauccacuucccauu

SEQ ID NO: 268827 - RNA, 64 nt, Human
cgcagauccagcaggccauccauggcaaccugcagaagcacacgguacucaucaucgcgcaccg

SEQ ID NO: 268828 - RNA, 64 nt, Human
gagugcugaccuuguaauguaugaguucacggaagaagcacaaccgaacgucuuguucagugac

SEQ ID NO: 268829 - RNA, 64 nt, Human
ucacucccgugaggagggccuucacccuguucuagaagcacaugguuguccuccuguuguuggc

SEQ ID NO: 268830 - RNA, 64 nt, Human
auggguaagucccuaaauuacaaaugagaaaauugaagcacaaggaaaaaaauaacuaguuuga

SEQ ID NO: 268831 - RNA, 64 nt, Human
uuugaagcugaacaguagcaaaucagauuuuccagaagcacaaacuuuguagaauacaguuuag

SEQ ID NO: 268832 - RNA, 64 nt, Human
cuaacgacgcuacuggaagccccagagcagaaaagaagcacauccuaagauucagggaaagacu

SEQ ID NO: 268833 - RNA, 64 nt, Human
cucucucuuugccucauagauuuagcuauguugggaagcacaugcuugcucuaggaauaucucc

SEQ ID NO: 268834 - RNA, 64 nt, Human
cuucaugaaacacuagaauguacccucagagcaggaagcacaccugugccauuucugggacucu

SEQ ID NO: 268835 - RNA, 64 nt, Human
caaaaggacuauggaagcuguucaagauacauuugaucuucagaaaagcagaauuugguucaac

SEQ ID NO: 268836 - RNA, 64 nt, Human
auucuaucucggcucagacuuuugguuggaaaaagaucuucauggccccaaauccccugagaca

SEQ ID NO: 268837 - RNA, 64 nt, Human
uaaccucuucuuuaggcaucuggugaguauugcagaucuucaggcugucccuaaaaggagguag

SEQ ID NO: 268838 - RNA, 64 nt, Human
cccaucuagaguuugacacgaagccuuauuucuagaagcacauguguauuuauacccccaggaa

SEQ ID NO: 268839 - RNA, 64 nt, Human
uauuuuacauugcuagauguacaaacuuuauacagaagcacaaccuuaucauuuuuaaauaaaa

SEQ ID NO: 268840 - RNA, 64 nt, Human
accccguaugguauuuuguuagauuguucaacaggaagcacaugauugagaacaucuugggaca

SEQ ID NO: 268841 - RNA, 64 nt, Human
ggaggcugcagcgcccggugcucugugucaaggugaagcacauacggcagaccucuuagagucc

SEQ ID NO: 268842 - RNA, 64 nt, Human
aggguuugagagcccgcgugcuggagaauugacugaagcacagcaccgggggagagggacacuc

SEQ ID NO: 268843 - RNA, 64 nt, Human
gcuuccgccagcacuucaccaucgccuugaaggagaagcacaucacagacauggugugcccugc

SEQ ID NO: 268844 - RNA, 64 nt, Human
cucauuuucuuuccccgaacgccaugacuguucagaagcacaauacuaucuccugaaagagaua

SEQ ID NO: 268845 - RNA, 64 nt, Human
auuuuuaugacuauuuauuccaauguuuuaacaagaagcacagagauuuauaguauucuuaaua

SEQ ID NO: 268846 - RNA, 64 nt, Human
cucaccccguaaacugacaagcaugaugaaaaaagaagcacauccaaguuucugccucuuuuaa

SEQ ID NO: 268847 - RNA, 64 nt, Human
auugacuucaagaugccucuucuaccucuuccaggaagcacaggccaggggaucugggugugug

SEQ ID NO: 268848 - RNA, 64 nt, Human
uacagaaugaagaggagacuugaguguugcugcugaagcacauccuugcaaugugggagugcac

SEQ ID NO: 268849 - RNA, 64 nt, Human
uaggagggauguuccaguggaugagggccaccaggaagcacagguccaaggcuggucccacacu

SEQ ID NO: 268850 - RNA, 64 nt, Human
augaaucuaucacugagaaguuuuacuacucauugaagcacaaaaauauccgcuacacagguuc

SEQ ID NO: 268851 - RNA, 64 nt, Human
aaugguauaguugugaggugaucuuagauuugaugaagcacaguaugcagguaggccuaauggg

SEQ ID NO: 268852 - RNA, 64 nt, Human
cuccagauuuguauuugacagcuuggugggaagggaagcacacucugcuguucuggaaucuuau

SEQ ID NO: 268853 - RNA, 64 nt, Human
ggacauugugggguguauuucuggauacccucaagaucuucauuuaaauuuugauacuuucuau

SEQ ID NO: 268854 - RNA, 64 nt, Human
accuucaaacuuuagguuuuuuuaaugauauacugaucuucauuaccaauaggcaaauuaauca

SEQ ID NO: 268855 - RNA, 64 nt, Human
uucaacauggucuagagcuuaccagugaucuucugaucuucaagaagacuaaguuugagacuug

SEQ ID NO: 268856 - RNA, 64 nt, Human
cagucugaauggcggcacgcugaaggaaacgugcgaagcacaggcugaagagggguuucuaacc

SEQ ID NO: 268857 - RNA, 64 nt, Human
aguaaagggauaggcucauggcccuucacaagaggaagcacacuggguaacaaugaacagugac

SEQ ID NO: 268858 - RNA, 64 nt, Human
gggcaaguggggcucgggguagggggcacugcuugaagcacagcacuugguuagggggccacag

SEQ ID NO: 268859 - RNA, 64 nt, Human
aaugcugguuccugcacacaauucucuaucuacugaagcacaucuguuuucuuuguuuguuuug

SEQ ID NO: 268860 - RNA, 64 nt, Human
ggaacuaucagcccacuugaccacccaguuuguggaagcacaggcaagaguguucuuuucuggu

SEQ ID NO: 268861 - RNA, 64 nt, Human
agcacuucccaaaccgcagacuacaucuuuagaggaagcacaacugugccuuuuucugaaaauc

SEQ ID NO: 268862 - RNA, 64 nt, Human
gcgguucugggcacuugaacucagggcccaagcagaagcacaggcccaguccuggcugcaagca

SEQ ID NO: 268863 - RNA, 64 nt, Human
agugcacagcccucguucugccagcuggagccaagaagcacagagacacagaggcgccugcccc

SEQ ID NO: 268864 - RNA, 64 nt, Human
cagaagaggaacacaaaggaagccacccaggaaggaagcacagagcugggggcucuggaaacgc

SEQ ID NO: 268865 - RNA, 64 nt, Human
uggaccggcaagcuggcuguguacaggaaaauuggaagcacacaguggacugugccucuuaaag

SEQ ID NO: 268866 - RNA, 64 nt, Human
ucacauacuuaaaaaguagauaaugugccaaccagaagcacaagaguuccuacacaaaacucug

SEQ ID NO: 268867 - RNA, 64 nt, Human
caugcuuugaaaucucuggaugaaaggugcuuuggaagcacaaaccauuaucacuugucucaua

SEQ ID NO: 268868 - RNA, 64 nt, Human
ggcagcccagcccccgcacccacccccaaccagagaagcacagaucuuggggagcugccccaca

SEQ ID NO: 268869 - RNA, 64 nt, Human
guguccacagggacacacgugagccacagggcuagaagcacaggcccgucaccccaggaggaaa

SEQ ID NO: 268870 - RNA, 64 nt, Human
gacacuaauggggcggugagaggggaacagacuggaagcacagcuucauuuccugugucuuuuu

SEQ ID NO: 268871 - RNA, 64 nt, Human
uuuccuuggucuccaguggaagggaaaagcccaugaucuucaagcagggaagccccagugagua

SEQ ID NO: 268872 - RNA, 62 nt, Human
ucaugaaauaccguacuugauuugaugacagagaucuucauuaaacaagaucugggacagua

SEQ ID NO: 268873 - RNA, 64 nt, Human
ucccauuaccagaaagaccaaaauuaaacuccuggaucuucaccccauccagugggaaacacag

SEQ ID NO: 268874 - RNA, 64 nt, Human
ugcuggugccagcaggggacacagacugcaaagagaagcacaaaguuugagccuugauuccugg

SEQ ID NO: 268875 - RNA, 64 nt, Human
cacgaagcagcguugugcugugugucccucgcaagaagcacaggaaagagaaguuucuuuagua

SEQ ID NO: 268876 - RNA, 64 nt, Human
aguacagccuccggaagcagcccuacaacaaccugaagcacaaguucccauggcugucggaggc

SEQ ID NO: 268877 - RNA, 64 nt, Human
gggcgcggcgcgagcggccgggcagggcccugcagaagcacaacuccggccccuggacccgggc

SEQ ID NO: 268878 - RNA, 64 nt, Human
caauugcugucugaaaaugagagagaagacuucggaagcacauuguguucauaauguacuccac

SEQ ID NO: 268879 - RNA, 64 nt, Human
aaauggggacaauggggauaaugauccccaccucgaagcacaguugugaguguuaaacaagcca

SEQ ID NO: 268880 - RNA, 64 nt, Human
agcuggugggcaggauggcuggguggcccccagagaagcacagaccugagauggggucuccaug

SEQ ID NO: 268881 - RNA, 64 nt, Human
cccagugcaaaccacuucuccaugcugcaaaggagaagcacagcuccugccagggugagcaggg

SEQ ID NO: 268882 - RNA, 64 nt, Human
guugguuuuguuuugcguuuuacagccguggggggaagcacauaaucccgccccagggcccacu

SEQ ID NO: 268883 - RNA, 64 nt, Human
uauggugaauuguuguucuuauagucuguuucaugaagcacaaguggaauuuaauacauaaaag

SEQ ID NO: 268884 - RNA, 64 nt, Human
gagggaggaaauaugucccuugcacaccaccccugaagcacauggcaguaggaaacagcauagg

SEQ ID NO: 268885 - RNA, 64 nt, Human
acuuugguuccccacgcagcccuggggcuuggaagaagcacaugaccguacucugcguggggcu

SEQ ID NO: 268886 - RNA, 64 nt, Human
cacgcagaccugcagcgggcaaagagcucccgaggaagcacagcuugggucagguucuugccuu

SEQ ID NO: 268887 - RNA, 64 nt, Human
aagcaagaaagagggucccagggcugcaaaacuggaagcacagccucggggauggggagggaaa

SEQ ID NO: 268888 - RNA, 64 nt, Human
cuuaugaagauauucagauacucuucuaugccaggaagcacaaagacuuuguugagauuugccu

SEQ ID NO: 268889 - RNA, 64 nt, Human
guuuagaaguacacuuaccucagaaaccugauuugaucuucaugucuugggcaggaguuguuga

SEQ ID NO: 268890 - RNA, 64 nt, Human
guagaugaaaauguggugauagaaaugggugcaugaucuucacgugugacagccaggccuuugc

SEQ ID NO: 268891 - RNA, 64 nt, Human
cuuguauaaauuauuuuauuuauuauuguaauuagaucuucacaaaguugucuuuucacugugu

SEQ ID NO: 268892 - RNA, 64 nt, Human
cugugggagagcgaagggggucaaaggaagacuugaagcacagagggcuagggaggugggguac

SEQ ID NO: 268893 - RNA, 64 nt, Human
ggaggccgaggcaggggcugggcagaggggagaggaagcacaagaagugggagugggagaggaa

SEQ ID NO: 268894 - RNA, 64 nt, Human
gauuugcaaauuuggauuuacacccauuguuuuggaagcacaucagcugaauaaaguugagguu

SEQ ID NO: 268895 - RNA, 64 nt, Human
gcgcuggcucugggcagggagugugccuuaaugggaagcacacgggcuuuggagucaggcacag

SEQ ID NO: 268896 - RNA, 64 nt, Human
gccagaauggcauuauauuuaaauaguucauaaagaagcacaaaagaauauuauuucauaacau

SEQ ID NO: 268897 - RNA, 64 nt, Human
ucucuccaguuuuauccccugccuaaugcugcgagaagcacagaauaaacuuuuugucacucuc

SEQ ID NO: 268898 - RNA, 64 nt, Human
gaccuggcuagaacacaaggucagaugauaaacagaagcacaggaacucagcccauggccgcaa

SEQ ID NO: 268899 - RNA, 64 nt, Human
uguuugucuuacucucauuuccguaauagaagaggaagcacauguuaacuugucccguuuauaa

SEQ ID NO: 268900 - RNA, 64 nt, Human
auauuuaaaacaucauuacugccaucuuuaucaugaagcacaucaauuacaagcuguagaccac

SEQ ID NO: 268901 - RNA, 64 nt, Human
ggagauggggcuucaaccagggacauccaaaccggaagcacaaauccaggaggcucucauaucc

SEQ ID NO: 268902 - RNA, 64 nt, Human
guuuuuaauuguuaaaaaaaaaaaguuuuaaacagaagcacaugacauaugaaagccugcagga

SEQ ID NO: 268903 - RNA, 64 nt, Human
caagcuaaauguaguuauuuuauccuguggcccugaagcacaaaauaaaaauucuaauuaaaau

SEQ ID NO: 268904 - RNA, 53 nt, Human
gcaaaacgaagcagucaugaugagaagcacaccucagaaaucaggacaucccc

SEQ ID NO: 268905 - RNA, 64 nt, Human
agcuacccacuaaugagcccaugguuuuauuucagaagcacaugagggugugaaaccacucugu

SEQ ID NO: 268906 - RNA, 64 nt, Human
cuccuuagugccugcaccucaccacgauauugaggaagcacaggacauccaaggguacucucca

SEQ ID NO: 268907 - RNA, 64 nt, Human
uaugcaaaccucaucuuucuccuucauuaaugaugaucuucagauuaaacccuuuggugcuagg

SEQ ID NO: 268908 - RNA, 64 nt, Human
cugcagaacauuuuacuuaaaagaggaaacacaagaucuucaaugaacgucaucggcuacagaa

SEQ ID NO: 268909 - RNA, 64 nt, Human
aaagagaagcagaguuaguuccagcucuaauagggaucuucaaaguuauuuugucuugauguau

SEQ ID NO: 268910 - RNA, 64 nt, Human
uguguauuccuguccucuauguuagagugcaucagaagcacauuuacugugcuaucuauaucgc

SEQ ID NO: 268911 - RNA, 64 nt, Human
cccaccuuuuaucuuaguaggcucaaauguucaggaagcacagggauggaaaccucuuccugga

SEQ ID NO: 268912 - RNA, 64 nt, Human
uagccauuccguccugcuccccagcucacucucugaagcacacaucauuggcuuuccuauuuuu

SEQ ID NO: 268913 - RNA, 64 nt, Human
guuccugggaacgcucuuguugcuuggugcaacagaagcacaaaaaucaauaaacacugugauu

SEQ ID NO: 268914 - RNA, 64 nt, Human
ucaaccagaagagugcgcugcaggugcacaugaagaagcacacgggggagcggcccuacaagug

SEQ ID NO: 268915 - RNA, 64 nt, Human
aaucuguguucagguccaggguuacauaauugcagaagcacaagccauacaucgcagguaggaa

SEQ ID NO: 268916 - RNA, 64 nt, Human
gauuucuaaaauucugugauucagauuugucagggaagcacagugaagcuugcuuaaaggcacu

SEQ ID NO: 268917 - RNA, 64 nt, Human
uguaauuaauucaaguccuuauuauagacuauuugaagcacaaccuaauggaaaauuguagaga

SEQ ID NO: 268918 - RNA, 64 nt, Human
uguggugcccagaacguugaucuaacaccaucuugaagcacacaugcugaucuccaggugcacc

SEQ ID NO: 268919 - RNA, 64 nt, Human
cuggcugaacucugggagugugucccagcugagggaagcacaaguagcaaagcucauuggucug

SEQ ID NO: 268920 - RNA, 64 nt, Human
agggucauuagcuuugggaauagaaggcuacacagaagcacacuguuuuugaacuugacaacag

SEQ ID NO: 268921 - RNA, 64 nt, Human
uuggagggaagaaguaauggcgcuagugugggacgaagcacagaucccagcacuuuucccagcu

SEQ ID NO: 268922 - RNA, 64 nt, Human
ugugugacucccauggggaggaacagacuggcaggaagcacaccgggguuaacacugguugacu

SEQ ID NO: 268923 - RNA, 64 nt, Human
ccccccccccaucuucgggaccaggauuugcacagaagcacaugcaccuacccauacacccccu

SEQ ID NO: 268924 - RNA, 64 nt, Human
ggagaguaggcccaggccccaugaggcaccaguggaagcacagcuccaaguucagacaggugcc

SEQ ID NO: 268925 - RNA, 64 nt, Human
gaaagguguugacagggagacuugucuaugacucgaucuucaauuuauuuuuuacauauauaug

SEQ ID NO: 268926 - RNA, 64 nt, Human
ggaaaauuguuuuaucuuugugcgucuguuugcugaucuucagcgugggaauaauaacaguacc

SEQ ID NO: 268927 - RNA, 64 nt, Human
uagggucuccuugauguagcuaagcugcuucagugaucuucacauuugcacuccaguuuuuuuu

SEQ ID NO: 268928 - RNA, 64 nt, Human
cucugccucccucaagaugagugcccgggcaugagaagcacaugguuccaugagcaggacccau

SEQ ID NO: 268929 - RNA, 64 nt, Human
aaggaggaggagucauagggaagagaaagaaauggaagcacagcuucuuucagacuucccugac

SEQ ID NO: 268930 - RNA, 64 nt, Human
cacccgcggaguggggggcccccuccgccacaaggaagcacaaccagcucgcccucccccuacc

SEQ ID NO: 268931 - RNA, 64 nt, Human
cccaaugacccccucccuuggggcgacuccugaugaagcacaacuccccgcagggcccccagcc

SEQ ID NO: 268932 - RNA, 64 nt, Human
gacggccagcuguggcccauaucuuggucacucugaagcacaauauuuaugaagcuauagaacg

SEQ ID NO: 268933 - RNA, 64 nt, Human
cucuaggggcugucuccuccaggaagcccuccgggaagcacagcaaagucccucauucugcaca

SEQ ID NO: 268934 - RNA, 64 nt, Human
cuacuacaggaagaagguggcugagauaagaaaggaagcacagaagucgcaggcagccucucag

SEQ ID NO: 268935 - RNA, 64 nt, Human
agaccgcuccccaauacucuccuaaaauaaacaugaagcacaaaaacauuaugccagauccuug

SEQ ID NO: 268936 - RNA, 64 nt, Human
aguuugggguuucagucccagggcuuagccggaggaagcacauuuugaaccugcaacuucagac

SEQ ID NO: 268937 - RNA, 64 nt, Human
acauauucuuuaguagaacucacauuaucugcuugaagcacauuuugcuaauguuuuauucaga

SEQ ID NO: 268938 - RNA, 64 nt, Human
ucuuuagaaaucccauccugccuugugauauuuagaagcacaaguacguuaaacaagugcuaaa

SEQ ID NO: 268939 - RNA, 64 nt, Human
uucugggaauuggcucaucauaaauuauccaagagaagcacaaaguuaugggcacaaagguuuu

SEQ ID NO: 268940 - RNA, 64 nt, Human
aaaauuagcugggcaucccagcuaugcagaagcugaagcacaagaauugcuugaacccuggagg

SEQ ID NO: 268941 - RNA, 64 nt, Human
ugcuuggguuugguuguaagauaaaccuggaggagaagcacaguugucccauugaauuauuuga

SEQ ID NO: 268942 - RNA, 64 nt, Human
cccaacuccucuauccaagacugugcccacauccgaagcacaaggaccucaagucaccagcaua

SEQ ID NO: 268943 - RNA, 64 nt, Human
auagcaauuauaucuacaaauaaucuauuaacaugaucuucagaaucucuaguuuuuguucuau

SEQ ID NO: 268944 - RNA, 64 nt, Human
caucacccagugguauccuacauacuucuuucaagaucuucaaccaugagguaaaagagccaag

SEQ ID NO: 268945 - RNA, 64 nt, Human
auuauugacuauacaaccuaccagcugaaagaaagaucuucaucaacaucuguaucuuuccaga

SEQ ID NO: 268946 - RNA, 64 nt, Human
uugacccugaagucagagcaggccagccaagcaggaagcacacuguuuacuuuuugcaugaaaa

SEQ ID NO: 268947 - RNA, 64 nt, Human
cuccauuugggagccugccuacauucuuguucuagaagcacaaaaaauccucagaugaauuaga

SEQ ID NO: 268948 - RNA, 64 nt, Human
uaggacggaggacuauuuuccuguggacgccggggaagcacagcaccacccccgcaccugcccu

SEQ ID NO: 268949 - RNA, 64 nt, Human
auucaacgugaggaagcaagugacaaggacgcccgaagcacaguggacggucaugaaggagcgg

SEQ ID NO: 268950 - RNA, 64 nt, Human
caauuugacauauucuuaaaacuagagggugugagaagcacagcaauaggaagucucuccacaa

SEQ ID NO: 268951 - RNA, 64 nt, Human
cuccgcugcgcuuuugcaugcccgggcgaggaccgaagcacacaccuccacgcgcacgggcccu

SEQ ID NO: 268952 - RNA, 64 nt, Human
gcagcccccacccccaccccccaggccgccuugagaagcacaguuuaacucacugcgggcuccu

SEQ ID NO: 268953 - RNA, 64 nt, Human
uguuuuuuuaaaugugucuuugaugcauacuuuagaagcacacuggcucgcgguuuccaucccu

SEQ ID NO: 268954 - RNA, 64 nt, Human
ugauuaaaaauaucaaauuaauugugugaacuuggaagcacaccaaucuuacuuuguaaauucu

SEQ ID NO: 268955 - RNA, 64 nt, Human
gagacaggagucuuccggagucaggcaggaaggagaagcacagcaauauacauucauaauauac

SEQ ID NO: 268956 - RNA, 64 nt, Human
uucuggcuccucacguguccuucaggacagaacagaagcacaaagacucagccaagaguucucu

SEQ ID NO: 268957 - RNA, 64 nt, Human
ugcaagggaggauggaggcuggccccucuuuauagaagcacauuucugccaccuccccugggag

SEQ ID NO: 268958 - RNA, 64 nt, Human
cugaacccuuccauccgagacugugcccacauccgaagcacaaggacaucaaaucaucagcaca

SEQ ID NO: 268959 - RNA, 64 nt, Human
gguggugugauuuuugacgugccuggcccugagcgaagcacauuacauauaucaucaaauuuau

SEQ ID NO: 268960 - RNA, 64 nt, Human
gaagcaauaauuuuuaaauuguguaugugcauaugaagcacagacaugcauguguguguguguc

SEQ ID NO: 268961 - RNA, 64 nt, Human
guccuugaaucaccugugggacuugaggacucgggaucuucaggacgccuggagaagggugguu

SEQ ID NO: 268962 - RNA, 64 nt, Human
cagaccaucuccucccuaaugaguuugcaucgcugaucuucaguaccuucaccugucucagucu

SEQ ID NO: 268963 - RNA, 64 nt, Human
aaauggugggcucuagaaugguuuuggagcucgagaucuucauggguuagacuugcuggucaga

SEQ ID NO: 268964 - RNA, 64 nt, Human
auuguuuacauauucaaaguggugcacuuugaaggaagcacaugugcaccuuuccuuuacacua

SEQ ID NO: 268965 - RNA, 64 nt, Human
ggggcgguaggggucuugaugaaaccucuugaacgaagcacaguuugucccaucuuuguucacu

SEQ ID NO: 268966 - RNA, 64 nt, Human
cuguuaucauccccauuucacaggugaagaaacagaagcacagagauguugauacagacucaag

SEQ ID NO: 268967 - RNA, 64 nt, Human
agccaggaaggcuccucucccacagguuucagaggaagcacagcccugcuugaauucaaacuuu

SEQ ID NO: 268968 - RNA, 64 nt, Human
aguucuuuuggaucauaaacuggaaauacugauggaagcacacaaguggagagaaguugacaug

SEQ ID NO: 268969 - RNA, 64 nt, Human
agugaguuaugcaguucccaguguccaguuaaaggaagcacacaugcuagucaugugagacaac

SEQ ID NO: 268970 - RNA, 64 nt, Human
gaagauuagcaugaaagcaguuuagcauugggaggaagcacagaucucuagagcuguccugucg

SEQ ID NO: 268971 - RNA, 64 nt, Human
caugcccucuuucugggaccaggcuaacucugcagaagcacagacacuacagaccacagcauuc

SEQ ID NO: 268972 - RNA, 64 nt, Human
uuaaggcauguuggucucaaggggauuugggauugaagcacagcuuucuguugaggaaaccuag

SEQ ID NO: 268973 - RNA, 64 nt, Human
gggugcagucagcuuaaaguguccaggcaucacagaagcacaggaggccaguucugaaaggcga

SEQ ID NO: 268974 - RNA, 64 nt, Human
cugcuccugauauaacacuuuccagccuauagcagaagcacauuuucagacugcaauauagaga

SEQ ID NO: 268975 - RNA, 64 nt, Human
ccgccauucaaggacuccucucuuucuucaccaagaagcacagaauucugcugggccuuugcuu

SEQ ID NO: 268976 - RNA, 64 nt, Human
ucaaguaugugaauggauggaugaauggaauugugaagcacagaugagcucuuucacacuccaa

SEQ ID NO: 268977 - RNA, 64 nt, Human
aacaguaacaucuggagccuggagauauccucaggaagcacaucuguagugcacucccagcagg

SEQ ID NO: 268978 - RNA, 64 nt, Human
uaccaaugugucugaaggccaaaauauauauccagaagcacaaugcaucauuccuuuguuguug

SEQ ID NO: 268979 - RNA, 64 nt, Human
ccaccuccaacuuucccuccaccagugugcuugggaucuucaaugaacugugcuuuucgcuuuc

SEQ ID NO: 268980 - RNA, 64 nt, Human
auuauguauauucaaacuugauuauuuuaaauucgaucuucagcuguacuguaaauaggguacu

SEQ ID NO: 268981 - RNA, 64 nt, Human
cagucugugcuuaguuaacaugugucauggcuccgaucuucaucuugaagaagagugacauugg

SEQ ID NO: 268982 - RNA, 64 nt, Human
cugugucuuugguuugugcuaggcccccgggugugaagcacagaccccuuccagggguuuacag

SEQ ID NO: 268983 - RNA, 64 nt, Human
ucuagguagugauauuuucuuccacuuaccugcugaagcacauuuaugcauuucuuuauggcaa

SEQ ID NO: 268984 - RNA, 64 nt, Human
ccugcccccuaucuguuugcugugauagugcaaagaagcacaggaaaauguuuaauuauccauu

SEQ ID NO: 268985 - RNA, 64 nt, Human
aggacccuagaggagacucucauucgauuuuaaagaagcacaacgggucauuuuccuuuguaug

SEQ ID NO: 268986 - RNA, 64 nt, Human
gcaguagguugaaaaacacugaagugcuuuucaugaagcacagcugcagcaaagccuugcaauc

SEQ ID NO: 268987 - RNA, 64 nt, Human
gacaagcucaaagugacagaauauguuauagguugaagcacacauauuugcaguuuacugaaaa

SEQ ID NO: 268988 - RNA, 64 nt, Human
cccaaccccacgaagucuccuauuuaaugugauggaagcacaaccccucucucacuuugcuccu

SEQ ID NO: 268989 - RNA, 64 nt, Human
uuccccacaauugucugauguaugaguccucucagaagcacaagugcauacuaggaaggcuuug

SEQ ID NO: 268990 - RNA, 64 nt, Human
gagucaaaacaaagcagcuuuaaaaaaauaauuggaagcacaagugcauggcacugacugaaug

SEQ ID NO: 268991 - RNA, 64 nt, Human
gacugagaaauauuuaaagcucaagaagaacacagaagcacacaucccucagcuaugagagaga

SEQ ID NO: 268992 - RNA, 64 nt, Human
ucauuccaaccucuauuuuacagaugagaaaacugaagcacagagaaguuaagugacuugccaa

SEQ ID NO: 268993 - RNA, 64 nt, Human
ucaguuagauggggaacauuuugcuagcccauuagaagcacacagaauuauccuuguccuccua

SEQ ID NO: 268994 - RNA, 64 nt, Human
gucaaaagagcagugguuccauuucuagauuguggaucuucagauaaauucugccauuuucauu

SEQ ID NO: 268995 - RNA, 55 nt, Human
uuaaagauaugagcuugugauaauggaucuucauuuaauguuuacuguuaugagg

SEQ ID NO: 268996 - RNA, 64 nt, Human
guaaaucaucuuauccccaaccucaguaccaccggaucuucacuucucagugggauuuuguccu

SEQ ID NO: 268997 - RNA, 64 nt, Human
uagggaaaaaccaucaagcucauuauuauuuuuugaucuucaguuguauuuuugugaauauuuu

SEQ ID NO: 268998 - RNA, 54 nt, Human
aagacgauaauuacaaguagguuggaucuucaaaagugguuuguauaacuuugu

SEQ ID NO: 268999 - RNA, 64 nt, Human
uauguaagcauccaccugugacgccguggagcaggaucuucauucaucucaccagagcaacagc

SEQ ID NO: 269000 - RNA, 64 nt, Human
cagcacaaauucaguaaagagacuacaaaaggaugaucuucaagaagggaaaugauucuaaaag

SEQ ID NO: 269001 - RNA, 64 nt, Human
cguuucuauaguccuuuauuuucaaaugcacauugaucuucacuugcugcauuuuuacucuuca

SEQ ID NO: 269002 - RNA, 64 nt, Human
ggaauaacacagagaaauguuuuaacugacuuuggaucuucaucaccuaaaaaagaguguguug

SEQ ID NO: 269003 - RNA, 64 nt, Human
uggugaauguugauauuaaauaaaccagagaucugaucuucaagcaagaaaauaagcaguguug

SEQ ID NO: 269004 - RNA, 64 nt, Human
aaacuugugaacaagcuuucauuuugaucaaacugaucuucauuuuuguaauaaaacggaagac

SEQ ID NO: 269005 - RNA, 64 nt, Human
cuggccuggugucuccucaugcccccucagugaggaucuucauguaccugcucuucuguuugca

SEQ ID NO: 269006 - RNA, 64 nt, Human
gucccacuugacuguuccaaagagcagcuucucagaucuucaguguucacugguaaauuucuaa

SEQ ID NO: 269007 - RNA, 64 nt, Human
gugguacuucauguuuucuugccaagacuguguugaucuucagauacucucuuugccagaugaa

SEQ ID NO: 269008 - RNA, 64 nt, Human
aauccauagaauauauucuuuuauguuaaauuaugaucuucauauuaaucuuaaaauuuuguga

SEQ ID NO: 269009 - RNA, 64 nt, Human
cguugugcugaaauccuaucaucaugguggauuugaucuucaguggccaaacacgaauuaaagu

SEQ ID NO: 269010 - RNA, 64 nt, Human
gacagaagagagcccugggugcuuguggugcaaagaucuucaugcccaguuccaaagugagguc

SEQ ID NO: 269011 - RNA, 64 nt, Human
ugacuggauaguuaguguaaaagcuucauguugagaucuucacguaucauucugcuaaaccaga

SEQ ID NO: 269012 - RNA, 64 nt, Human
acuguuuauauauuugaaugcugcuacaacagaugaucuucaucccugaaguuuucagcuaaac

SEQ ID NO: 269013 - RNA, 64 nt, Human
ucaaaagagcagugguuccuguuucuagguuguggaucuucagauaaauucugucauuuuccuu

SEQ ID NO: 269014 - RNA, 64 nt, Human
cuggaaaagucaaucuuuuaggaauuguuuuucagaucuucaauaaauuuuuucuuuaaauuuc

SEQ ID NO: 269015 - RNA, 64 nt, Human
aacaauccauucacaagccuccuguaccucaguggaucuucagaacugcccuugcugcccgcgg

SEQ ID NO: 269016 - RNA, 64 nt, Human
auagcaguagucauagacuuaagacuauucuagagaucuucaucuccauaagacuuuuacauuu

SEQ ID NO: 269017 - RNA, 64 nt, Human
aaaucaucuucaaucuuaaauuagaaaccagaaugaucuucaggauaaaaagaacuucugaauc

SEQ ID NO: 269018 - RNA, 64 nt, Human
cugcucccaucucugcagccuacgacccucagcagaucuucaagugcaaagggaccuuuguggg

SEQ ID NO: 269019 - RNA, 64 nt, Human
uuaagcugugcuguggugugagaaugucauucuugaucuucagccuucguuugcaaggagaguu

SEQ ID NO: 269020 - RNA, 64 nt, Human
agaaaauuucacuaggucaguaauuuaaaccuuggaucuucaaaaaauaaaauaaugugaagca

SEQ ID NO: 269021 - RNA, 64 nt, Human
agggcaugaagcugaccucagaggaguuuaacgcgaucuucacauuuuacgacaagguaagaga

SEQ ID NO: 269022 - RNA, 64 nt, Human
ucacugcccugucuccccuuguuucucugugccagaucuucagugccccuuuccauacagggau

SEQ ID NO: 269023 - RNA, 64 nt, Human
uuaagcugugcuguggugugagaaugucauucuugaucuucagccuucguuugcaagaagaguu

SEQ ID NO: 269024 - RNA, 64 nt, Human
uucuuugugcuucucugagcuaugaggcugagaagaucuucaaguggauuuuuagcaaauuuag

SEQ ID NO: 269025 - RNA, 64 nt, Human; identical to SEQ ID NO: 269024

SEQ ID NO: 269026 - RNA, 64 nt, Human
cccuugaguacaggggcugcuuucuuccugccuagaucuucaccaucucugcacagcucugaga

SEQ ID NO: 269027 - RNA, 64 nt, Human
aaacuuuggaagcacuuuuucugcauacuuagaugaucuucaugggcccacaggguaccaggau

SEQ ID NO: 269028 - RNA, 64 nt, Human
gguggugggcggacaauaggaucacugccugccagaucuucaaacuuuuauauauauauauaua

SEQ ID NO: 269029 - RNA, 64 nt, Human
ccugaaagaaaaaccaaauucugcuauaagucuugaucuucaaugaacuuuuaaauaaugcauu

SEQ ID NO: 269030 - RNA, 64 nt, Human
agauucuuccacuggcuccacauccaccccacuggaucuucagaaggcuagagggcgacucugg

SEQ ID NO: 269031 - RNA, 64 nt, Human
accaagggaagugaccaaggugaagauggccuaggaucuucacugucuuacucaagauacugga

SEQ ID NO: 269032 - RNA, 64 nt, Human
gaaauuuauauaggugagacaauagaaauaaaaagaucuucagccaggccuuucugaaggaguu

SEQ ID NO: 269033 - RNA, 64 nt, Human
uuuugcacauuccaaaauucauuucauaagacaagaucuucauaggaccuccuuggcauccugg

SEQ ID NO: 269034 - RNA, 64 nt, Human
cguucaugggggacacaaggcuuuuaugcuccuagaucuucaacgcagcagaggaaccauaagu

SEQ ID NO: 269035 - RNA, 64 nt, Human
acuguuuuaaaggaaaaaaaaaaaaaaaaguacugaucuucaauaugaagacaugagcuuuucu

SEQ ID NO: 269036 - RNA, 64 nt, Human
aauugggugugugggagagcaaaaaaauacuguagaucuucaaagagcaucuccacaacccaca

SEQ ID NO: 269037 - RNA, 64 nt, Human
guuucuuuuaacaaccuggaaguaccuuucuugugaucuucacugaggaauuagaacuaugaua

SEQ ID NO: 269038 - RNA, 64 nt, Human
guguggucuauguagccucuggguguggagcugggaucuucaacuggggacaguacaguaaaga

SEQ ID NO: 269039 - RNA, 64 nt, Human
uagaccuuaauggaauaauggguccagaaaacaugaucuucaauggguacuacaacuaauaggu

SEQ ID NO: 269040 - RNA, 64 nt, Human
accacaugggagggggcucaggccucagccucaagaucuucagcuguggccucucgggcucggc

SEQ ID NO: 269041 - RNA, 64 nt, Human
uaggguagccauucacaucauuuuuuauaggguagaucuucauauugcugugauuaaugcaucc

SEQ ID NO: 269042 - RNA, 64 nt, Human
uucaucuggagacaguucaacguucugcaaaccagaucuucaggaauuuuacugggauaauuau

SEQ ID NO: 269043 - RNA, 64 nt, Human
aaaaacaaaugaggcagaauugcuaugugugguugaucuucagauaaauugacugaucacaguu

SEQ ID NO: 269044 - RNA, 64 nt, Human
caucugauuuuuugggaaagaaguccaguuuuaugaucuucacaggcuauugcauuuuuacuga

SEQ ID NO: 269045 - RNA, 64 nt, Human
augggccaccacgccuagccucacgcuccuuucugaucuucacuaagaacaaaagaagcagcaa

SEQ ID NO: 269046 - RNA, 64 nt, Human
ugcuucuacauugguugcuuuguuaacucuaccugaucuucacuugucaguaauuugagaccac

SEQ ID NO: 269047 - RNA, 64 nt, Human
uaguucccuacuccauccuucccuggugauucuugaucuucaaagccucggggaucccagguuu

SEQ ID NO: 269048 - RNA, 64 nt, Human
gcccucuugccugaccccugaagcccagaacucugaucuucacagcccuagguauggccccagc

SEQ ID NO: 269049 - RNA, 64 nt, Human
auuugcacaaagagacuguggcucucuguugugagaucuucagcuaccucauggugcaauaaca

SEQ ID NO: 269050 - RNA, 64 nt, Human
ucugugggcuuuuguuuuuguuuuuguuuugguagaucuucaauuuggauauuuggaggaguga

SEQ ID NO: 269051 - RNA, 64 nt, Human
ugugaagggggaacaagucaaaauauuuuuaaaagaucuucaaaaguaaugccucugucuagca

SEQ ID NO: 269052 - RNA, 64 nt, Human
gaggaggaggacgaaggccuagacucagcugaaggaucuucaaagcaggaugaagaccuagacu

SEQ ID NO: 269053 - RNA, 64 nt, Human
cuagacuuaccugaaggccuagacucagcugaaggaucuucaaagcaggaugaagaccuagacu

SEQ ID NO: 269054 - RNA, 64 nt, Human
ucaaagcaggaugaagaccuagacuuaccugaaggaucuucaaagcagaaugaagaccuaggcu

SEQ ID NO: 269055 - RNA, 64 nt, Human
ucaaagcagaaugaagaccuaggcuuaccugaaggaucuucaaagcaggaugaagaccuagacu

SEQ ID NO: 269056 - RNA, 64 nt, Human
ucaaagcaggaugaagaccuagacuuaccugaaggaucuucacaggaggauaaagacguagaau

SEQ ID NO: 269057 - RNA, 64 nt, Human
ucacaggaggauaaagacguagaauuaccugaaggaucuucacaggaggaugaagaccuagaga

SEQ ID NO: 269058 - RNA, 64 nt, Human
aaaaaaaaaaauccuguccuaggcuuuuacucuugaucuucaaaggcacgcaggguuuaauggu

SEQ ID NO: 269059 - RNA, 64 nt, Human
ucacaggaggaugaagaccuaggguuaucugaaggaucuucacaagaggaugaagaccuagacu

SEQ ID NO: 269060 - RNA, 64 nt, Human
ucaaagcaggaugaagaccuacaauuaccugaaggaucuucacaggaggaugaagaccuagggu

SEQ ID NO: 269061 - RNA, 64 nt, Human
gaacugagacccuccaucagccagagucuuaugggaucuucacuucacauguuugucuuagguu

SEQ ID NO: 269062 - RNA, 64 nt, Human
aaaucuggccauuugugaauccuguaaaccuugugaucuucaauuacuuugauguuaaauuaaa

SEQ ID NO: 269063 - RNA, 64 nt, Human
caguacuaccaccaccaccaacaacaucaacacagaucuucacaucugcccauucugugguuag

SEQ ID NO: 269064 - RNA, 64 nt, Human
aaaaguguuuaagacuuagcuagguuuccauuuagaucuucauaucuguugcauggaagaaagu

SEQ ID NO: 269065 - RNA, 64 nt, Human
caauagauacgcuucaccaaaaugaaacuuuccagaucuucaacuuaugaaaacagguauuuau

SEQ ID NO: 269066 - RNA, 50 nt, Human; identical to SEQ ID NO: 58964

SEQ ID NO: 269067 - RNA, 64 nt, Human; identical to SEQ ID NO: 58965

SEQ ID NO: 269068 - RNA, 64 nt, Human; identical to SEQ ID NO: 58966

SEQ ID NO: 269069 - RNA, 64 nt, Human; identical to SEQ ID NO: 58967

SEQ ID NO: 269070 - RNA, 64 nt, Human; identical to SEQ ID NO: 58968

SEQ ID NO: 269071 - RNA, 64 nt, Human; identical to SEQ ID NO: 58969

SEQ ID NO: 269072 - RNA, 64 nt, Human; identical to SEQ ID NO: 58970

SEQ ID NO: 269073 - RNA, 64 nt, Human; identical to SEQ ID NO: 58971

SEQ ID NO: 269074 - RNA, 64 nt, Human; identical to SEQ ID NO: 58972

SEQ ID NO: 269075 - RNA, 64 nt, Human; identical to SEQ ID NO: 58973

SEQ ID NO: 269076 - RNA, 64 nt, Human; identical to SEQ ID NO: 58974

SEQ ID NO: 269077 - RNA, 64 nt, Human; identical to SEQ ID NO: 58975

SEQ ID NO: 269078 - RNA, 64 nt, Human; identical to SEQ ID NO: 58976

SEQ ID NO: 269079 - RNA, 64 nt, Human; identical to SEQ ID NO: 58977

SEQ ID NO: 269080 - RNA, 64 nt, Human; identical to SEQ ID NO: 58978

SEQ ID NO: 269081 - RNA, 64 nt, Human; identical to SEQ ID NO: 58979

SEQ ID NO: 269082 - RNA, 64 nt, Human; identical to SEQ ID NO: 58980

SEQ ID NO: 269083 - RNA, 64 nt, Human; identical to SEQ ID NO: 58981

SEQ ID NO: 269084 - RNA, 64 nt, Human; identical to SEQ ID NO: 58982

SEQ ID NO: 269085 - RNA, 64 nt, Human; identical to SEQ ID NO: 58983

SEQ ID NO: 269086 - RNA, 64 nt, Human; identical to SEQ ID NO: 58984

SEQ ID NO: 269087 - RNA, 64 nt, Human; identical to SEQ ID NO: 58985

SEQ ID NO: 269088 - RNA, 64 nt, Human; identical to SEQ ID NO: 58986

SEQ ID NO: 269089 - RNA, 59 nt, Human; identical to SEQ ID NO: 58987

SEQ ID NO: 269090 - RNA, 64 nt, Human; identical to SEQ ID NO: 58988

SEQ ID NO: 269091 - RNA, 64 nt, Human; identical to SEQ ID NO: 58989

SEQ ID NO: 269092 - RNA, 64 nt, Human; identical to SEQ ID NO: 58990

SEQ ID NO: 269093 - RNA, 64 nt, Human; identical to SEQ ID NO: 58991

SEQ ID NO: 269094 - RNA, 64 nt, Human; identical to SEQ ID NO: 58992

SEQ ID NO: 269095 - RNA, 64 nt, Human; identical to SEQ ID NO: 58993

SEQ ID NO: 269096 - RNA, 64 nt, Human; identical to SEQ ID NO: 58994

SEQ ID NO: 269097 - RNA, 64 nt, Human; identical to SEQ ID NO: 58995

SEQ ID NO: 269098 - RNA, 64 nt, Human; identical to SEQ ID NO: 58996

SEQ ID NO: 269099 - RNA, 64 nt, Human; identical to SEQ ID NO: 58997

SEQ ID NO: 269100 - RNA, 64 nt, Human; identical to SEQ ID NO: 58998

SEQ ID NO: 269101 - RNA, 64 nt, Human; identical to SEQ ID NO: 58999

SEQ ID NO: 269102 - RNA, 64 nt, Human; identical to SEQ ID NO: 59000

SEQ ID NO: 269103 - RNA, 64 nt, Human; identical to SEQ ID NO: 59001

SEQ ID NO: 269104 - RNA, 64 nt, Human; identical to SEQ ID NO: 59002

SEQ ID NO: 269105 - RNA, 64 nt, Human; identical to SEQ ID NO: 59003

SEQ ID NO: 269106 - RNA, 64 nt, Human; identical to SEQ ID NO: 59004

SEQ ID NO: 269107 - RNA, 64 nt, Human; identical to SEQ ID NO: 59005

SEQ ID NO: 269108 - RNA, 64 nt, Human; identical to SEQ ID NO: 59006

SEQ ID NO: 269109 - RNA, 64 nt, Human; identical to SEQ ID NO: 59007

SEQ ID NO: 269110 - RNA, 64 nt, Human; identical to SEQ ID NO: 59008

SEQ ID NO: 269111 - RNA, 64 nt, Human; identical to SEQ ID NO: 59009

SEQ ID NO: 269112 - RNA, 64 nt, Human; identical to SEQ ID NO: 59010

SEQ ID NO: 269113 - RNA, 64 nt, Human; identical to SEQ ID NO: 59011

SEQ ID NO: 269114 - RNA, 64 nt, Human; identical to SEQ ID NO: 59012

SEQ ID NO: 269115 - RNA, 64 nt, Human; identical to SEQ ID NO: 59013

SEQ ID NO: 269116 - RNA, 64 nt, Human; identical to SEQ ID NO: 59014

SEQ ID NO: 269117 - RNA, 64 nt, Human; identical to SEQ ID NO: 59015

SEQ ID NO: 269118 - RNA, 64 nt, Human; identical to SEQ ID NO: 59016

SEQ ID NO: 269119 - RNA, 64 nt, Human; identical to SEQ ID NO: 59017

SEQ ID NO: 269120 - RNA, 64 nt, Human; identical to SEQ ID NO: 59018

SEQ ID NO: 269121 - RNA, 64 nt, Human; identical to SEQ ID NO: 59019

SEQ ID NO: 269122 - RNA, 64 nt, Human; identical to SEQ ID NO: 59020

SEQ ID NO: 269123 - RNA, 64 nt, Human; identical to SEQ ID NO: 59021

SEQ ID NO: 269124 - RNA, 64 nt, Human; identical to SEQ ID NO: 59022

SEQ ID NO: 269125 - RNA, 64 nt, Human; identical to SEQ ID NO: 59023

SEQ ID NO: 269126 - RNA, 64 nt, Human; identical to SEQ ID NO: 59024

SEQ ID NO: 269127 - RNA, 64 nt, Human; identical to SEQ ID NO: 59025

SEQ ID NO: 269128 - RNA, 64 nt, Human; identical to SEQ ID NO: 59026

SEQ ID NO: 269129 - RNA, 64 nt, Human; identical to SEQ ID NO: 59027

SEQ ID NO: 269130 - RNA, 64 nt, Human; identical to SEQ ID NO: 59028

SEQ ID NO: 269131 - RNA, 64 nt, Human; identical to SEQ ID NO: 59029

SEQ ID NO: 269132 - RNA, 61 nt, Human
ucguuguucucauagaaccaacagcaucugagcccucaacaccaacagcaccauccucugu

SEQ ID NO: 269133 - RNA, 61 nt, Human
cuauucucugguguauccuucacaucuaggugcccucaagcagcugugugaguguugagau

SEQ ID NO: 269134 - RNA, 61 nt, Human
cggguauagguaacccacaggcccagugccagcccucaaaggacauagacuuugaaacaag

SEQ ID NO: 269135 - RNA, 61 nt, Human
caagcccagagauguccaccugggcuggacugcccucaagcuuauacuagagaagagcaac

SEQ ID NO: 269136 - RNA, 61 nt, Human
uauuuagaagacacuuucucugccucauccugcccucaagcuuuagucaagaaguuauggc

SEQ ID NO: 269137 - RNA, 61 nt, Human
ccuuggcaaauguuaucugugggggaaaauugcccucaauugagaaccacuggucuagcua

SEQ ID NO: 269138 - RNA, 61 nt, Human
guggugaggcuucaagccuuaaagucagugugcccucaaccagcacagccugccccaauuc

SEQ ID NO: 269139 - RNA, 61 nt, Human
cagccauaguuuggguauuuuugguuuauaugcccucaaguaaaagaaaagccgaaagggu

SEQ ID NO: 269140 - RNA, 61 nt, Human
uaucuaucugucuacuccauuucucucaaaagcccucaagucacaaaguaaaugguucaag

SEQ ID NO: 269141 - RNA, 61 nt, Human
cuaaggacuuucagguaaucagaguucaugggcccucaaagguaaauugcaguuguagaca

SEQ ID NO: 269142 - RNA, 61 nt, Human
cuggagccucagucucuccugcuuggucuuggcccucaacuggggcaagugaagccagagg

SEQ ID NO: 269143 - RNA, 61 nt, Human
acagaacuuccggcugguguccucagagcaagcccucaaagagcugggucuggcugagcac

SEQ ID NO: 269144 - RNA, 61 nt, Human
gggcuggguuuggccauacaagguuggcuacgcccucaaucccugaccguuccaggcacug

SEQ ID NO: 269145 - RNA, 59 nt, Human
aaauaaauaaauaaaaauaaagcgagauguugcccucaaacuucaccuggccccggucc

SEQ ID NO: 269146 - RNA, 61 nt, Human
uauuuuaaagauugagagggcuaagaaaguagcccucaaauaaacuguuauugcauuauag

SEQ ID NO: 269147 - RNA, 61 nt, Human
aagguaucauccguguggguucuucccuccugcccucaauuguuuuucugggccuuguuuu

SEQ ID NO: 269148 - RNA, 61 nt, Human
gaagauacaauuuuauuugauaucaaugaacgcccucaagacugagcugcuuuuaucauac

SEQ ID NO: 269149 - RNA, 61 nt, Human
agcagugggcuacauacaaugagagcccugagcccucaagaacucaugccagcucagcccu

SEQ ID NO: 269150 - RNA, 61 nt, Human
cuuuugauuuuuguauuguuugcauccccuugcccucaauaaauaaaguucuuuuuuaguu

SEQ ID NO: 269151 - RNA, 61 nt, Human
caagucccccagcagaaccagccucaaaaacgcccucaagaacaugaugggccugaacucg

SEQ ID NO: 269152 - RNA, 61 nt, Human
aagugguucuuagauggugaucugggauuaggcccucaagacccuuuuggguuucugcccu

SEQ ID NO: 269153 - RNA, 61 nt, Human
auggugguuucccucaaguuuauguucucaugcccucaaucuguaaauuuuugucuccaga

SEQ ID NO: 269154 - RNA, 61 nt, Human
uuuauuauuaacaaaacaguccuaaauagcagcccucaauugugaaaaaauuuacuuuaaa

SEQ ID NO: 269155 - RNA, 61 nt, Human
aggaggccacuccaucucaccucggggggcugcccucaaugugggagugaccccagccaga

SEQ ID NO: 269156 - RNA, 61 nt, Human
uuagugccuucgguguaagaucuucucaucagcccucaauuugugauccggaauuuuauga

SEQ ID NO: 269157 - RNA, 61 nt, Human
auuaaugaaaaugugacuuagaguagggguagcccucaaaaauagauuuaucauuuacuca

SEQ ID NO: 269158 - RNA, 61 nt, Human
cauuuuaccaagacuuuagaugcuuucuugugcccucaauuuucuuuuuaaaaauacuucu

SEQ ID NO: 269159 - RNA, 61 nt, Human
agacucagugcagcacuuccacaccaagaaggcccucaauaaaggcuuccugaggaacgca

SEQ ID NO: 269160 - RNA, 61 nt, Human
cuuugccuuaucuugugcugguggugaagaggcccucaaagccaggccucucuauuccuuu

SEQ ID NO: 269161 - RNA, 61 nt, Human
agggcccacugccugcccggcccugggccaggcccucaacagaagccaucucauuuaagcc

SEQ ID NO: 269162 - RNA, 61 nt, Human
uucuuccuacuagugacaaucaucuggucuugcccucaagcaacaauugcuagaguaacau

SEQ ID NO: 269163 - RNA, 61 nt, Human
gucuauagaccauuugucagaaaucagaucagcccucaaagaauggggucugugggcuagu

SEQ ID NO: 269164 - RNA, 61 nt, Human
cucucuugaucuccucaaucuggaguccccugcccucaaaacacagugauguucagaacag

SEQ ID NO: 269165 - RNA, 61 nt, Human
cacccuggcaugacauuccuucucuuuccuggcccucaaccacuuccuuccuuuggcucuu

SEQ ID NO: 269166 - RNA, 61 nt, Human
ucguaaaggguauaagcauaggacagauuuugcccucaaucacaauauuuguauucacuug

SEQ ID NO: 269167 - RNA, 61 nt, Human
ucauguuggccaggauggucucuuaacuccugcccucaagugauccaccagagaggagauc

SEQ ID NO: 269168 - RNA, 52 nt, Human
gagguaguaugagaaacuaaaagcccucaaggaggaagaauagucuuagcca

SEQ ID NO: 269169 - RNA, 61 nt, Human
uuuuguacuugcuugguauccguacaagggggcccucaaacaugauagcaggaacuacgcg

SEQ ID NO: 269170 - RNA, 61 nt, Human
ggcauccgugggggaaaaaaaaucucucagagcccucaacuauucuguuccacacccaaug

SEQ ID NO: 269171 - RNA, 61 nt, Human
guggguaaugccagggguggggugggcacaggcccucaagagccccuuuugccuuguaguc

SEQ ID NO: 269172 - RNA, 61 nt, Human
cauauuguggcacaagcaaaagggugucugagcccucaaagugaggggaaaccagggccug

SEQ ID NO: 269173 - RNA, 61 nt, Human
cccagcaccauuucugugggccuagaauauggcccucaacccuuagaguggggcagugagg

SEQ ID NO: 269174 - RNA, 61 nt, Human
ugccacgacauggcugggcuacgugaauagcgcccucaacccugugaucuauaccaccuuc

SEQ ID NO: 269175 - RNA, 61 nt, Human
uuuaaucugggcugguacaggccucagccuugcccucaaugcacgaaagguggcccaggag

SEQ ID NO: 269176 - RNA, 61 nt, Human
cacugcagggcccugagguggucgugucccugcccucaauucuugaagcaccagcucccug

SEQ ID NO: 269177 - RNA, 61 nt, Human
ucccuggucuuuuagucuaguccuuuggcaagcccucaaccucagauuaauccuauuuauu

SEQ ID NO: 269178 - RNA, 61 nt, Human
acuacaagugucucacuucagccuuagaaaagcccucaauguaaaccuuauguuuguuacu

SEQ ID NO: 269179 - RNA, 61 nt, Human
agcaaaagucagucuuauagcaagacuguuagcccucaaacuugacucuacugaucugacc

SEQ ID NO: 269180 - RNA, 61 nt, Human
gaguguacagaguggaauaagacagagaccugcccucaagagcaaaguagaucaugcauag

SEQ ID NO: 269181 - RNA, 61 nt, Human
aaacccugaaauaaucgaacaggaaaaaguugcccucaagccugaccuggaaccguuccuc

SEQ ID NO: 269182 - RNA, 61 nt, Human
agaagggccccaugauuucauuuugugcugagcccucaaaauuaugucuguuucguggugg

SEQ ID NO: 269183 - RNA, 61 nt, Human
gaggguauaaagacaucuccaccaagucugagcccucaaaauguccugauuacaaugcugu

SEQ ID NO: 269184 - RNA, 61 nt, Human
ugaugugggacuacuuggucgaauuuuuuuagcccucaacuugguaauuggguguuucugu

SEQ ID NO: 269185 - RNA, 61 nt, Human
ucggcgcccaccacccccucaagccccagcagcccucaacaggcccagggagggaagugug

SEQ ID NO: 269186 - RNA, 61 nt, Human
cugugcacagccacaccacccucucccgacagcccucaaagacguagcaacucuuucucuc

SEQ ID NO: 269187 - RNA, 61 nt, Human
caguuuggcuccacaaguccuccaggacagagcccucaaagcaacucccaacgaguucuca

SEQ ID NO: 269188 - RNA, 61 nt, Human
uugugcaucuguccaccuguuccccaguauugcccucaauuccugagagcccuggagcggu

SEQ ID NO: 269189 - RNA, 61 nt, Human
uacuacucugagauggauccauucagcucaugcccucaauguuuauauuguguuaucuguu

SEQ ID NO: 269190 - RNA, 61 nt, Human
agagcaagaguguugaacugaagaccaaaaugcccucaagguguaaaauaauccgaggggg

SEQ ID NO: 269191 - RNA, 61 nt, Human
acuggucucaaagcugggcagcccauugcaugcccucaacucuugcuuggcagggguacca

SEQ ID NO: 269192 - RNA, 61 nt, Human
aucauaaaugcagcuugggguuggagcaggggcccucaaaggcccagcuccugcucaaaaa

SEQ ID NO: 269193 - RNA, 61 nt, Human
ugcgacuagcaaggcucgcagcaagagcacagcccucaacuacuugugccagaguuucucu

SEQ ID NO: 269194 - RNA, 61 nt, Human
ugcacuucaggaauggucacaacaggggguagcccucaaaagcacuccuuuuucuauaccu

SEQ ID NO: 269195 - RNA, 61 nt, Human
cacauguguauaguauuuaagugaaacucaagcccucaaggcccaacuucucugucuauau

SEQ ID NO: 269196 - RNA, 61 nt, Human
ugggaacaaagccuuuuuaacacacguaagggcccucaaaccgugggaccucuaaggagac

SEQ ID NO: 269197 - RNA, 61 nt, Human
uuaaccuuaaaauugugcaugcaucauuguagcccucaauauuugguaaugcuauuuaaag

SEQ ID NO: 269198 - RNA, 61 nt, Human
cauuugucauuuuuaaggaaguuuucuaagagcccucaauugccugccuguauuaauuuua

SEQ ID NO: 269199 - RNA, 61 nt, Human
ccacagccuguuucugcugaguuucuuaucagcccucaagcuaugcuaggaaaaguuauaa

SEQ ID NO: 269200 - RNA, 61 nt, Human
cugaaaugauaaaauguagcccuagcccccugcccucaauuguaaagugagcaaccauugc

SEQ ID NO: 269201 - RNA, 61 nt, Human
aguacuucagaaagccuagagagaagagagggcccucaaaucccauuccagccccuaaaug

SEQ ID NO: 269202 - RNA, 61 nt, Human
ugugggcccugaaggaagaccugggcccagugcccucaauaaagagaggcccagagguggc

SEQ ID NO: 269203 - RNA, 61 nt, Human
aaacuccagacccugccaaaacaugagcccugcccucaauuacaguaacguagggucagcu

SEQ ID NO: 269204 - RNA, 61 nt, Human
gaauggaaaacuuauacagcuucauucuguugcccucaaaugggcauagcccuauguacua

SEQ ID NO: 269205 - RNA, 61 nt, Human
aacaucuuuugcaccccuagaaugucauuuugcccucaaccuugguauuucuccuggggcc

SEQ ID NO: 269206 - RNA, 61 nt, Human
aauaaugcagagauaauuagacaugguucccgcccucaagaagcucacaaaaguauucagg

SEQ ID NO: 269207 - RNA, 61 nt, Human
aggaguggcauuggcauccugacccagcucugcccucaagguggggauggaugggcaaagg

SEQ ID NO: 269208 - RNA, 61 nt, Human
ccagugucugcuugccauccugccagaacaggcccucaagcccaagagccaucccaggccu

SEQ ID NO: 269209 - RNA, 61 nt, Human
ccucccugcuugaccuaugcuccaggacccugcccucaacccuugucagcucccuaagucu

SEQ ID NO: 269210 - RNA, 61 nt, Human
cacagccgggugugugucugcagcaccgugggcccucaagcuuuccugcugucuucucccu

SEQ ID NO: 269211 - RNA, 61 nt, Human
agcacguugcaugacaucuggaacacagaaagcccucaauacauugaagcucuuaggauuu

SEQ ID NO: 269212 - RNA, 61 nt, Human
caaggaaauuuucacacaaagcuuggccuuugcccucaauauagguguuuuaggaugguga

SEQ ID NO: 269213 - RNA, 61 nt, Human
ggggccacagggacacugcucugccugccuggcccucaaccuuccaugaccagcgugugcg

SEQ ID NO: 269214 - RNA, 61 nt, Human
guguucuuugaacaucauuugugcagauucugcccucaaugaggaccaaauaaagaugauu

SEQ ID NO: 269215 - RNA, 61 nt, Human
gucaccugguuggagggcauggauugaagcugcccucaaguccaggccuugaggcccaccu

SEQ ID NO: 269216 - RNA, 61 nt, Human
ggacuggcacagggacccucgauggagcgaagcccucaaacgggaugcuuucugguauucu

SEQ ID NO: 269217 - RNA, 61 nt, Human
ccuugcagacauguugcccagcacacaguaggcccucaauaaaagccauuugcacuuuaaa

SEQ ID NO: 269218 - RNA, 61 nt, Human
cuaaauugggaagcaaguagcuaguauaaaggcccucaauuguaguuguuuccagcugaau

SEQ ID NO: 269219 - RNA, 61 nt, Human
cagaacgaagcaaaguugcuggcuuaguagagcccucaauucauagagguuacuguaauug

SEQ ID NO: 269220 - RNA, 61 nt, Human
ucugucuccaaagaugaaaaaggacuucucugcccucaagggaaccccacaguaucuuaga

SEQ ID NO: 269221 - RNA, 61 nt, Human
acaacuaaaugacuccucugucaucaucagcgcccucaagaccuaccuggugucgggguaa

SEQ ID NO: 269222 - RNA, 61 nt, Human
uggggccaggggcuugcuuccucgcuccauagcccucaacugcccaggcgcucccaccagc

SEQ ID NO: 269223 - RNA, 61 nt, Human
cauaguggcacaaccaggccuagcacccaaggcccucaaaugaauuccucacuauuaaucu

SEQ ID NO: 269224 - RNA, 61 nt, Human
accucauacuaaacauugacccuuucacuaugcccucaaccugggagcaucuggcaggcag

SEQ ID NO: 269225 - RNA, 61 nt, Human
ugaucuccgcagaggcugccugcugcgcucggcccucaagugcccgggccggccuucgugc

SEQ ID NO: 269226 - RNA, 61 nt, Human
auguuaugcauugauucuaacaaacuguaaugcccucaacagaacuaauuuuacuaauaca

SEQ ID NO: 269227 - RNA, 61 nt, Human
cucuugccugguaggaacaggcgaagugucagcccucaauguuggguacuuagacccaaac

SEQ ID NO: 269228 - RNA, 61 nt, Human
cgggagccguagaggguggccgacggcggcggcccucaaaagcacuuguuccuucugcuuc

SEQ ID NO: 269229 - RNA, 61 nt, Human
cccaaagcccugaugaccugguucuucugaggcccucaaccuggcaucuuaggguaugguc

SEQ ID NO: 269230 - RNA, 61 nt, Human
cuagcacagauggccagccccuuagacagaggcccucaagucuuucucuuucccugguccc

SEQ ID NO: 269231 - RNA, 61 nt, Human
gagcagacugaaggggccgcugcagccccuggcccucaauacccagcugcuucuggcuaag

SEQ ID NO: 269232 - RNA, 61 nt, Human
auaugucgugggacuggggugugggugaccugcccucaaaccuugccugccaccuccccau

SEQ ID NO: 269233 - RNA, 61 nt, Human
gagucccaccaggagccacgugcccggccuugcccucaagguuuuuugcuuuucuccugug

SEQ ID NO: 269234 - RNA, 61 nt, Human
ucccuggcgcaggugggcuggacuucuaccugcccucaaggguguguauauuguauagggg

SEQ ID NO: 269235 - RNA, 61 nt, Human
agugugauaccuuccuugguuuuuuuuugcagcccucaaauccuaucuuccugccccacaa

SEQ ID NO: 269236 - RNA, 61 nt, Human
agcccccaggcugugagcuccuugggggcaggcccucaauaaaugugaacugcugcugccg

SEQ ID NO: 269237 - RNA, 61 nt, Human
gccccagagggcuuuguggaggacaggccuugcccucaagaacgucguaccugacgcugag

SEQ ID NO: 269238 - RNA, 61 nt, Human
uuggcgagaggaggggcccguugucucccuggcccucaaggccucccacagugacucgggc

SEQ ID NO: 269239 - RNA, 61 nt, Human
aaaacacuggacagaauuucccacagucuuugcccucaaggaguucaccaguuuauggggc

SEQ ID NO: 269240 - RNA, 61 nt, Human
gcaaauuaugccagaauccgaaggcagcagggcccucaagccacagacauuguggugucac

SEQ ID NO: 269241 - RNA, 61 nt, Human
gcgguaucacaugaggccugucccuaacagugcccucaaagugaagguccucaaggaggau

SEQ ID NO: 269242 - RNA, 61 nt, Human
cugggaaugcugggaaaugagauacauucccgcccucaagaaucucccagucugguaggag

SEQ ID NO: 269243 - RNA, 61 nt, Human
uacaaaaaauuagcugaguguagugacgcaugcccucaaucccagcuacucaagaggcuga

SEQ ID NO: 269244 - RNA, 61 nt, Human
ucauguggguaucccuaggauggccuucagagcccucaaacuuacaagcaccugguaguug

SEQ ID NO: 269245 - RNA, 61 nt, Human
ugccucacaggauugugacuccccagccccugcccucaaagcuucagaccccucagguagc

SEQ ID NO: 269246 - RNA, 61 nt, Human
cguguggggagaacaucucccuuccggggcugcccucaagagcuucugaaaaacuaaugac

SEQ ID NO: 269247 - RNA, 61 nt, Human
uggagcugucaucacucaacaaaaaaccgaggcccucaauccaccuucaggccccgcccca

SEQ ID NO: 269248 - RNA, 61 nt, Human
gaggaucuaguucaagaggcaagaagaucuggcccucaauuagcuagauguagaugcugcc

SEQ ID NO: 269249 - RNA, 61 nt, Human
auuaaaagacagaacaaaacuguggaucauugcccucaacaugaagacugccauauuccaa

SEQ ID NO: 269250 - RNA, 61 nt, Human
gccccacuuucccuucuucaaaggacaaagugcccucaaagggaauugaauuuuuuuuuua

SEQ ID NO: 269251 - RNA, 61 nt, Human
uggacauuuuaggaaucaccaauggcuccuugcccucaagcaauauaggccagacuugguc

SEQ ID NO: 269252 - RNA, 61 nt, Human
uuuucggcuccucucccuccuccuaccuuccgcccucaaguagacuccagugucuguuauu

SEQ ID NO: 269253 - RNA, 61 nt, Human
ccagcaggcugugcuuggaucaugcucgucugcccucaagcuggaaaacaaggggcuaccu

SEQ ID NO: 269254 - RNA, 61 nt, Human
agucacuuuggagcuuuagcuucucugccaagcccucaauaagccagcaaaccaggacucu

SEQ ID NO: 269255 - RNA, 61 nt, Human
auauagcccccuacccuuuucccaauccuuugcccucaaaucagugacccaagggaggggg

SEQ ID NO: 269256 - RNA, 61 nt, Human
acggaaaacauuggcugcaaagccccucaaagcccucaagugccuucugugaguuuaaaug

SEQ ID NO: 269257 - RNA, 61 nt, Human
acaguccgugcugugcugcgcuaaggagcuggcccucaacucuccuuggugcaggguuccc

SEQ ID NO: 269258 - RNA, 61 nt, Human
cugcacgugcauccaaacgcugugcucugucgcccucaaccuuugcaggguccuuccuacc

SEQ ID NO: 269259 - RNA, 61 nt, Human
uuguucucugccugauguguaugcagaggcagcccucaauaugcagugguugaauaaauga

SEQ ID NO: 269260 - RNA, 61 nt, Human
gggguggggagcugagcaggcugggcaauuugcccucaaacagaacagcuccccuuguagc

SEQ ID NO: 269261 - RNA, 61 nt, Human
cagcuccuggccaggcugcugccaaggucaagcccucaagggcauuaccccgccuccucuu

SEQ ID NO: 269262 - RNA, 61 nt, Human
gauggcccugggaaucaauuccucaggaauugcccucaagaacucugcuucuugcuuugca

SEQ ID NO: 269263 - RNA, 61 nt, Human
cacacuggggcuagggaaguaggugaugccagcccucaagucugucuucagccagggacuu

SEQ ID NO: 269264 - RNA, 61 nt, Human
acauggcaaaaaauaaaauaacuccuauacugcccucaaaauggaguuugcaauuaauauc

SEQ ID NO: 269265 - RNA, 61 nt, Human
aagauagagauuuccuuucuccccugacaaagcccucaacagccucccaggcuaucaguau

SEQ ID NO: 269266 - RNA, 61 nt, Human
acccaacaggcccuucuguagccucccccuugcccucaaagggggagugggggccagcuuu

SEQ ID NO: 269267 - RNA, 61 nt, Human
gguuaccagugugucaggcaaucuggacuuugcccucaaaagagcagugguuccuguuucu

SEQ ID NO: 269268 - RNA, 61 nt, Human
uaaauauauuuuauuugaaaggcugaguguugcccucaaacacuugcuaaaacugccuagg

SEQ ID NO: 269269 - RNA, 61 nt, Human
gugagcucuucauuagcucaauaugugguuugcccucaauugagcacuguuuauuacuuug

SEQ ID NO: 269270 - RNA, 61 nt, Human
ccuggccacaccguuggagugaacccucacugcccucaaggacaacagcagggugucaccc

SEQ ID NO: 269271 - RNA, 61 nt, Human
gugagcucuucuauagcucaauaugcgguuugcccucaagugugcacuguuuauuacuuug

SEQ ID NO: 269272 - RNA, 61 nt, Human
aggugguucucugcagugaucguuuaguguggcccucaaacauuaaauaucccgaggucuc

SEQ ID NO: 269273 - RNA, 61 nt, Human
aauucaaauuauuauuuugguccuggucagggcccucaaggugauuugacuguugcaagcu

SEQ ID NO: 269274 - RNA, 61 nt, Human
agagcagcucccuugcugccguccaucaagagcccucaacacaagaguuuguuauaaauag

SEQ ID NO: 269275 - RNA, 61 nt, Human
uccucuucccccacauguguggcacgcugcagcccucaaggccagcccuggccccuccacu

SEQ ID NO: 269276 - RNA, 61 nt, Human
aggacgaaucugccuacugcccaugaacggggcccucaagcguccugggaucuccuucucc

SEQ ID NO: 269277 - RNA, 61 nt, Human
ugucagcagggcaguuaacucuggacucagagcccucaagggcauguggcagaaccucaug

SEQ ID NO: 269278 - RNA, 61 nt, Human
uuuuucaucuuuacccugccagaaaugacccgcccucaaugcuggcugcugcuaacauuaa

SEQ ID NO: 269279 - RNA, 59 nt, Human
acaagaaaaaggccaccuaggcaauggaagcccucaaagaagucggaaugucauagucu

SEQ ID NO: 269280 - RNA, 61 nt, Human
agaaccccagggcaaggcuaagaggcacugagcccucaacccaagccaggcugaccucauc

SEQ ID NO: 269281 - RNA, 61 nt, Human
uuguccccgacagcaggcaaagccucacauugcccucaauuuucccccuuucauuugaagg

SEQ ID NO: 269282 - RNA, 61 nt, Human
gccagcuuucugcauggauggucagucucuugcccucaaacacuacagcaaacaagcuacc

SEQ ID NO: 269283 - RNA, 61 nt, Human
cgaaugggcuucugaggacacaaggugggcugcccucaagccccagagagccccucauccu

SEQ ID NO: 269284 - RNA, 61 nt, Human
ugggcggaugacgcaagacuacaagauccuugcccucaagcugcuaggaacuuacgguuuu

SEQ ID NO: 269285 - RNA, 61 nt, Human
guuaucuucacagcugacuucacacucacuggcccucaauagcuuagagugggacuccuga

SEQ ID NO: 269286 - RNA, 61 nt, Human
ggggaaggaggaaugugggcugggggaagaugcccucaacucacccccuacacacacauga

SEQ ID NO: 269287 - RNA, 61 nt, Human
cagacaaaccacccccacuccuacccagccagcccucaaaacacaaaggaacaaagacagu

SEQ ID NO: 269288 - RNA, 61 nt, Human
ggaauguggugacauaaacuagacauggggugcccucaaguuuccaaggggaccaaugugc

SEQ ID NO: 269289 - RNA, 61 nt, Human
gguuggugcagauggaaguuucugucugcuggcccucaagagaguguuuugccagggacac

SEQ ID NO: 269290 - RNA, 61 nt, Human
cucacucuccccgucaugcucccucugccccgcccucaaaaaaaaaaaaaaaaaaaaaaaa

SEQ ID NO: 269291 - RNA, 61 nt, Human
guauauaccaccuaggaggagaugccaccaagcccucaagaaguugugcccuuccccgccu

SEQ ID NO: 269292 - RNA, 61 nt, Human
agauggcucuuuucuuuggaucuuguuucuagcccucaacugcugaaagccucagaauuua

SEQ ID NO: 269293 - RNA, 61 nt, Human
ugcaguucaguuuugggccaccugggguacugcccucaagagaacgugcuguggcccaugc

SEQ ID NO: 269294 - RNA, 61 nt, Human
gggcccccauggcuggggcaggggaaagagagcccucaaaggccucuuucuggucugucug

SEQ ID NO: 269295 - RNA, 61 nt, Human
guccugaggcugcuguccggggccgguggcugcccucaaggucccuucccuagcugcugcg

SEQ ID NO: 269296 - RNA, 61 nt, Human
uucggccccgccccccgcacugaacacacccgcccucaaccccgcacccuccgcacucacc

SEQ ID NO: 269297 - RNA, 61 nt, Human
accauguuggccaggcuggucuccaacuccugcccucaagugauccgccucggucccauuu

SEQ ID NO: 269298 - RNA, 61 nt, Human
agugugaaaaacauggcaaagccuuuaagaagcccucaauucuuaacagacauaagauaau

SEQ ID NO: 269299 - RNA, 61 nt, Human
cgcuucugcagccucggccuaggucacguuggcccucaaagcgagccguugaauuggaaac

SEQ ID NO: 269300 - RNA, 61 nt, Human
aagucagaggcugauucuuguagaauuaacagcccucaacgugaugagcuaugauaacacu

SEQ ID NO: 269301 - RNA, 61 nt, Human
gagucugaggcugauuccaguagaauuagcagcccucaaugcugugcaacaagacaucaga

SEQ ID NO: 269302 - RNA, 61 nt, Human
aagauggagaaugauuucugauucucacaaagcccucaaugguagugauucuucuguguuc

SEQ ID NO: 269303 - RNA, 61 nt, Human
ggagccccccggagagggaccucccagccgagcccucaaagaacuccaugaaaucaggaac

SEQ ID NO: 269304 - RNA, 61 nt, Human
ccuagaguacacacgucccaaacuccccugugcccucaaguccuacagccccuagaagacc

SEQ ID NO: 269305 - RNA, 61 nt, Human
ucuaacugucccuaacacagcaugugggaaugcccucaauacgguggaugcuguuaacuuu

SEQ ID NO: 269306 - RNA, 61 nt, Human
gccauucugccaucucccucuauauccccaagcccucaacugugagccacuccaauacccu

SEQ ID NO: 269307 - RNA, 61 nt, Human
ccacagggacuuccuuggucccuucagggaagcccucaacucaucucugaacuuagaaucu

SEQ ID NO: 269308 - RNA, 61 nt, Human
uuggcugcuuuucaaggugucccccaauguggcccucaagagccauccccacugccuggcc

SEQ ID NO: 269309 - RNA, 61 nt, Human
guggccugaggcaacuccuuuccccgcuucagcccucaacugccucgaguccugugauggu

SEQ ID NO: 269310 - RNA, 61 nt, Human
gccuccagcugggccugacccuccauguccugcccucaaaaaacuggguggagaaauaauu

SEQ ID NO: 269311 - RNA, 61 nt, Human
gccccaccgcaacugcacggcccugggccuggcccucaaugugccaggcucuuccucccau

SEQ ID NO: 269312 - RNA, 61 nt, Human
ucucuggagacccuagaaggcggcauguccugcccucaaccugccugccuggauugcaccu

SEQ ID NO: 269313 - RNA, 61 nt, Human
caugaaggcaucaucuuggaaacagacaugagcccucaacagacaacugcaccuacugaug

SEQ ID NO: 269314 - RNA, 61 nt, Human
ggggcagagaauucaagaagguacagcuuuggcccucaagagcccacuguaugcuggggaa

SEQ ID NO: 269315 - RNA, 61 nt, Human
ggggaaaaaaagauagccagagagagaccuggcccucaaaaaggugugaacaagacugaaa

SEQ ID NO: 269316 - RNA, 61 nt, Human
uucuuaaacuuccaguuaagaaucuagguccgcccucaagcccauacugaccaugccucau

SEQ ID NO: 269317 - RNA, 50 nt, Human
cguccacagcagcugucugagcccucaauccccaagcuggcagcugucau

SEQ ID NO: 269318 - RNA, 61 nt, Human
uuugugccucuuuguuuuuccccaaaccaaagcccucaaauuguagucucugucggcuucu

SEQ ID NO: 269319 - RNA, 61 nt, Human
gcuacugaaguuuauuuuaccauugacugcugcccucaaucuagaacgcuacacaagaaau

SEQ ID NO: 269320 - RNA, 61 nt, Human
uuguggagcguccccuuccaucaagcagccugcccucaagccaaggaucauccccuggaac

SEQ ID NO: 269321 - RNA, 61 nt, Human
cggcugaguucucuuaggacccagagccagggcccucaacuuccauccugcgggaggccuu

SEQ ID NO: 269322 - RNA, 61 nt, Human
gaaaaucuugcuuuuauggucuuccccccucgcccucaagaacaagggccuugugcguggg

SEQ ID NO: 269323 - RNA, 61 nt, Human
cacucucucuuuaccuucuuguucuauccaggcccucaacaaauuggaugaggcacuaugc

SEQ ID NO: 269324 - RNA, 61 nt, Human
cuuuugguaauuugaccccacgugcucucuggcccucaagcauguaaccucggggucugag

SEQ ID NO: 269325 - RNA, 61 nt, Human
caccaauuaaccagaaauccaguuauuuuccgcccucaaaaugacagccauggccggccgg

SEQ ID NO: 269326 - RNA, 61 nt, Human
ggagacuggagcccaagcucugcagcgugucgcccucaagcuguaggcccauguuccaguc

SEQ ID NO: 269327 - RNA, 61 nt, Human
agcccaaggcagaagaccuaucugcauuugagcccucaaacucaccuugcagagcgccaag

SEQ ID NO: 269328 - RNA, 61 nt, Human
ggccugcccuccuguccucccacuucucuacgcccucaagguuggagaccccgcucccaug

SEQ ID NO: 269329 - RNA, 61 nt, Human
ugaaggcgcucucugcacuuagaugcugucagcccucaacguaggaggggccguggggucc

SEQ ID NO: 269330 - RNA, 61 nt, Human
gaggggaccuucgagggccucugccccaugugcccucaaagcugucccacaaucauggagc

SEQ ID NO: 269331 - RNA, 61 nt, Human
ggagaagugacaggucccagagccaaagccggcccucaagcaucaucagggagugguguag

SEQ ID NO: 269332 - RNA, 61 nt, Human
acguguacaaaucaugcuauuuuagagaucagcccucaauuuguaaggcaugugaacaggg

SEQ ID NO: 269333 - RNA, 61 nt, Human
uguuuggcagagcuuuuaccuguuauucuuugcccucaaauacaguauuguggucauuuug

SEQ ID NO: 269334 - RNA, 61 nt, Human
gucuguuggaaucuugauagcugauuaauuugcccucaauucugcucccugaacuucacac

SEQ ID NO: 269335 - RNA, 61 nt, Human
gcguucuguuucaccaguuuccaaguuuauugcccucaaaaucuuuagaauaguuaaauug

SEQ ID NO: 269336 - RNA, 61 nt, Human
caaacuaccccacagcagucccucaaagacagcccucaauccauguagggacaucugagua

SEQ ID NO: 269337 - RNA, 64 nt, Human
aaacacggccccgacacuuaguguggccccaggccccagcgagccucgcccucccaguuuugcu

SEQ ID NO: 269338 - RNA, 64 nt, Human
gcaccugcccuccgcugcuccucagaccccagcccccagcgagccgacguccccacccguuccu

SEQ ID NO: 269339 - RNA, 64 nt, Human
aaagaaaggaaccagaggcagagagacgaggauacccagcgaaagggacgggaggaagcauccg

SEQ ID NO: 269340 - RNA, 64 nt, Human
uacugacccgaaaggcucggccgcagagccggggcccagcgaaucacgcagagaaaucuuacag

SEQ ID NO: 269341 - RNA, 64 nt, Human
caaagugcugagauuacaggcgugagccaccgcgcccagcgauuguuucuugaggcuuccccag

SEQ ID NO: 269342 - RNA, 64 nt, Human
ccugggcaucagaccuuaaccaccaggcccacagcccagcgagggagaggucgugaggccagcu

SEQ ID NO: 269343 - RNA, 55 nt, Human
ccaacauccucugcuccuaggccuccccagcgagcuccucccagaccaagacuuu

SEQ ID NO: 269344 - RNA, 64 nt, Human
uuaccgaacaguuggaaaguaaaacuuugaauaucccagcgaagaaauggauaaaugguacagu

SEQ ID NO: 269345 - RNA, 64 nt, Human
cuuucacuucugccggcuccgcaacugagugacacccagcgacaaccgacuggggagugguaga

SEQ ID NO: 269346 - RNA, 64 nt, Human
augcuucugcugggugagcaggacagcuccuguccccagcgaagaauccggcugccccugggcc

SEQ ID NO: 269347 - RNA, 61 nt, Human
aaaagaaagauugguccggguuaauauuauccucuaguauaagugaauuacuaguuucucu

SEQ ID NO: 269348 - RNA, 61 nt, Human
cuggggccgcuauuguaaaagccugggcucccucuaguagcuugcgccacccccccucgcu

SEQ ID NO: 269349 - RNA, 61 nt, Human
cucaaguagaaaaauggauagaaacaaaauucucuaguacucauccaggaaaccauucuuc

SEQ ID NO: 269350 - RNA, 64 nt, Human
cugagcacugugaggccuggaugugaagacucagcccagcgaagcucauucccuuacccccggc

SEQ ID NO: 269351 - RNA, 64 nt, Human
ggagaaagggcccgacugcccgccggacccugcacccagcgacugggccccgcgcgcgcccucc

SEQ ID NO: 269352 - RNA, 64 nt, Human
ggcgccgucgcucggguggcggaggcugcgguggcccagcgagacggccgccucgagagacggc

SEQ ID NO: 269353 - RNA, 64 nt, Human
ggcccagagaugugagggcuccuuccucaggaugcccagcgaaugagggguagagccacucugg

SEQ ID NO: 269354 - RNA, 64 nt, Human
aauuaaccaggugugguggcacgugccugggagucccagcgacuugggaggcugaggugggagg

SEQ ID NO: 269355 - RNA, 64 nt, Human
uucacgauuccuucccacggucaacucgggaccucccagcgaccacugcagccugcggacgagg

SEQ ID NO: 269356 - RNA, 64 nt, Human
gggcacuggugggugacagucauacuucguggagcccagcgagcaucccgggcaagcacuacca

SEQ ID NO: 269357 - RNA, 60 nt, Human
aggugcuuguuggguccuaagacccagggacccagcgacuaugcccacccagaccccaga

SEQ ID NO: 269358 - RNA, 64 nt, Human
agacaaggguggguggaccuaaccaacuaucauccccagcgauguucaaacauaaaaucuuauc

SEQ ID NO: 269359 - RNA, 64 nt, Human
ugguggaugcaccguguccacagcagcccccaaucccagcgaugcgucagaucuuacguggcuu

SEQ ID NO: 269360 - RNA, 64 nt, Human
gggugaugagacaggacuagaaaguagugggggacccagcgaguggacgcccugcuccgggauu

SEQ ID NO: 269361 - RNA, 52 nt, Human
uaugcaucaccaccuuguagcccccagcgaggggcagacuggcucuggccuc

SEQ ID NO: 269362 - RNA, 64 nt, Human
caagaauuucgggcuguuugacuuucugugagcccccagcgaggggaggcccagccuccgagga

SEQ ID NO: 269363 - RNA, 64 nt, Human
ccuuugaguccagugugggacacgguuuaacugucccagcgacauuucuccaaguggaaauccu

SEQ ID NO: 269364 - RNA, 64 nt, Human
ccaugcuuaguacuggaauagagguggccaggcccccagcgacucuucuuggccugauguuugu

SEQ ID NO: 269365 - RNA, 64 nt, Human; identical to SEQ ID NO: 143114

SEQ ID NO: 269366 - RNA, 61 nt, Human
aaagccccaaauucccugggaacuguuuuuucucuaguagcugaauauaaggaaauauguc

SEQ ID NO: 269367 - RNA, 61 nt, Human
uuuauaauguuucuaauaugaaaucacuaaacucuaguacauuauagcaggugcuuuguaa

SEQ ID NO: 269368 - RNA, 64 nt, Human
cagugagacaagggauguucuaccugggcauguccccagcgaggggguugggggauggaguuca

SEQ ID NO: 269369 - RNA, 64 nt, Human
ucucuucgccuuccugcgggaggcccugccagcucccagcgacgacgccaccgcgcuuaugacc

SEQ ID NO: 269370 - RNA, 64 nt, Human
aagauguaacauggcuuagaggaaagaguguagacccagcgacagaucaucagucacucaaauc

SEQ ID NO: 269371 - RNA, 64 nt, Human
gugucacccaaaccggcaggugcgauuuuguuaacccagcgacgaacuuuccgaaaaauaaaga

SEQ ID NO: 269372 - RNA, 64 nt, Human
cccuccgggcagagaccaccgcgccccucugcgccccagcgacgcggcccgcggggacgucgcu

SEQ ID NO: 269373 - RNA, 64 nt, Human
uugguaugugacucugaugccccagcacaguuaccccagcgagcagaaugaagaagauguuugu

SEQ ID NO: 269374 - RNA, 64 nt, Human
ggcccaguaucacagccaagacgagaagucauuucccagcgaugucugcuaucuaaucuguauu

SEQ ID NO: 269375 - RNA, 64 nt, Human
ccuugguauaccagcucggcagaacaguuccccacccagcgauuagggagcugggcuggccagu

SEQ ID NO: 269376 - RNA, 64 nt, Human
ucaaagcgguacccauccucccccagaagcuguccccagcgagccucccuucuuuguuugaauu

SEQ ID NO: 269377 - RNA, 64 nt, Human
cugccugcauuuccagagcuggugccagggucagcccagcgaggagucccugcaauaagccccu

SEQ ID NO: 269378 - RNA, 64 nt, Human
uggcauagcuaccgugaguucucagcaggaacuucccagcgaugauaauguacaugaaauuagc

SEQ ID NO: 269379 - RNA, 64 nt, Human
caguaguacaagcuccccucagccagccugccugcccagcgaggcccccagguucaagguguug

SEQ ID NO: 269380 - RNA, 64 nt, Human
gacuucuggugacagccagaucaucccucgaguccccagcgagaaagaaagcauuuagccauuc

SEQ ID NO: 269381 - RNA, 63 nt, Human
ugugguucuccuccaguugauagagaaaaacaacccagcgaaggcgccuucucugaaaacaau

SEQ ID NO: 269382 - RNA, 64 nt, Human
aggggaaaaggaaggccagggguucacauagggccccagcgaguuucccaggaguuagagggau

SEQ ID NO: 269383 - RNA, 61 nt, Human
agccaccaugccugggcuaaacucuuuaagucucuaguaaaugcagcuagauucaaauggg

SEQ ID NO: 269384 - RNA, 61 nt, Human
cucuuuuuuggcccguuguuauuaguaauaccucuaguaguugauacuucaggaagucuga

SEQ ID NO: 269385 - RNA, 61 nt, Human
uuauguugguuuuuugcugugaagugcugcgcucuaguaacugccuuagcaacuguagaug

SEQ ID NO: 269386 - RNA, 64 nt, Human
gccaccaucgaggccacacucagcacuccaggaucccagcgaugucagacacucuugaguuguc

SEQ ID NO: 269387 - RNA, 64 nt, Human
cacacccaacacuuagacaugcgaacaagcagcccccagcgagggucuccuucgccuucaaccu

SEQ ID NO: 269388 - RNA, 64 nt, Human
auuugugugccugauuugaaaggaagcuggggcacccagcgaguuuagccuuuaaguuucugug

SEQ ID NO: 269389 - RNA, 64 nt, Human
ucuagccagaggucccagaugccugggcugagaacccagcgauaagggggcguucccaaagcag

SEQ ID NO: 269390 - RNA, 64 nt, Human
agggcuucaccagugugggauccaccugucaguccccagcgacucucaugacacucauucugca

SEQ ID NO: 269391 - RNA, 64 nt, Human
gucccuucccccuccagcucgcccucuucuaccucccagcgagaccuggcccagaaagggugcc

SEQ ID NO: 269392 - RNA, 64 nt, Human
gcccuucacugcagugucaggccuuuagaugggacccagcgaaaauguggcccuucugagucac

SEQ ID NO: 269393 - RNA, 64 nt, Human
uggggggaucacaaagccaggggcuuggccccaccccagcgaagccaugaacucccaagccccg

SEQ ID NO: 269394 - RNA, 64 nt, Human
cguguagcuuuagacucggagaugagugcuuugacccagcgaggagcucagcuaaguguaucca

SEQ ID NO: 269395 - RNA, 64 nt, Human
acaccucucugcccucccucccuuugucccaucucccagcgacuuccaauauucauguuucuga

SEQ ID NO: 269396 - RNA, 64 nt, Human
agucacacggcugcugcuggcacacggggccgaccccagcgagugcccagcccacgagucccuc

SEQ ID NO: 269397 - RNA, 64 nt, Human
auggguuagagcccugcucgaugcucacagggcccccagcgagagucccugcagucccuuucga

SEQ ID NO: 269398 - RNA, 64 nt, Human
cacccuaucuaaaguguuccuuaccuuucaugggcccagcgaggguagaauucagaauagagag

SEQ ID NO: 269399 - RNA, 64 nt, Human
gcacuucucucuucaagcggcgacccccuacccucccagcgaguugcgcugggagacgcuggcg

SEQ ID NO: 269400 - RNA, 64 nt, Human
uaugacaucuauggcauagggcuacuggucucaucccagcgaucgggacagaaauugcuaauag

SEQ ID NO: 269401 - RNA, 61 nt, Human
aaagugugccuuaguuaucaauuuaacauuucucuaguauucauaucccuuuucuuaccau

SEQ ID NO: 269402 - RNA, 61 nt, Human
aggauuuacaucuuaggaaauaacauguauacucuaguaaauaagcgauuuagguguucca

SEQ ID NO: 269403 - RNA, 61 nt, Human
gaaauaaaagauguuucuccuaucuccuuuucucuaguauuugacuguuacuguccuuggc

SEQ ID NO: 269404 - RNA, 64 nt, Human
uggacuugccccuccgguagccuuccuuggcccucccagcgaggggcacccuuccucugugccc

SEQ ID NO: 269405 - RNA, 64 nt, Human
aacaggaacagaagcgugguccugcggcugcguccccagcgaguuucacuuuccccuugcucgu

SEQ ID NO: 269406 - RNA, 64 nt, Human
ugaguucaaccaaccgcagccaccuacguuugaccccagcgagaucaaaguuguauaucugagg

SEQ ID NO: 269407 - RNA, 64 nt, Human
acagggaccugggaaaggugggagagaugcugagcccagcgaauccucuccauugaaggauuca

SEQ ID NO: 269408 - RNA, 64 nt, Human
gcuugcccucauccuccugguucaggaccucuaccccagcgagagcacagcagaggacgacauu

SEQ ID NO: 269409 - RNA, 64 nt, Human
gcuuuugcguggugaccugagcggcucggggcgucccagcgacgcgggaaggggcagggcgcug

SEQ ID NO: 269410 - RNA, 64 nt, Human
uccccaaaaccggggcccuccacagaggccccuucccagcgacacuaccuggggcucaggccug

SEQ ID NO: 269411 - RNA, 64 nt, Human
ggagcccgccagguggaccggcccgcgcuccgcccccagcgagccggggacccacccaccaccc

SEQ ID NO: 269412 - RNA, 64 nt, Human
cuagcacuaggaauaaaccuuucauaaaagcaggcccagcgaggucaauuugucggggacucua

SEQ ID NO: 269413 - RNA, 64 nt, Human
uaaggaaugaaaagcaagggccaggugggaguagcccagcgaaggcacuugggcugccaggaac

SEQ ID NO: 269414 - RNA, 64 nt, Human
guuccuucgagccccuuccacucagagggccacacccagcgaugccagugaagguggcacagcc

SEQ ID NO: 269415 - RNA, 64 nt, Human
uacacccagacagacccagaaaucuuuugauuuccccagcgagauacuuaccacucucucuucu

SEQ ID NO: 269416 - RNA, 64 nt, Human
uggggguggacuugggaacaggcuguguguuugucccagcgauggugccugcuuagcuucccgu

SEQ ID NO: 269417 - RNA, 64 nt, Human
guguugagauauugguguuuuagaguuaguucuacccagcgaggaggaggcggggagagaaacu

SEQ ID NO: 269418 - RNA, 64 nt, Human
uacuucaaggaacuagacuaauuagcuauauaggcccagcgaugcuucuuauugaucuuaauag

SEQ ID NO: 269419 - RNA, 61 nt, Human
aguuuguaacaagaaaacagucucucccauucucuaguacugcuccccuacccagcaguca

SEQ ID NO: 269420 - RNA, 61 nt, Human
aggacuaacuggaaaaauacuuugaccauagcucuaguacuuccaaauaaauucauaucua

SEQ ID NO: 269421 - RNA, 61 nt, Human
agaagugccuuuaauuugcuacugucauuuccucuaguaucacuuuugcugugaugaugug

SEQ ID NO: 269422 - RNA, 64 nt, Human
gggaaggcaggcagggcucuccuggcuucccauccccagcgauucccucucccaggccccauga

SEQ ID NO: 269423 - RNA, 64 nt, Human
gguacaucagcaauuaauucuagagcaacuuugccccagcgauuccucuugggugcgaacagaa

SEQ ID NO: 269424 - RNA, 64 nt, Human
ugcacuguggacgugggucugggggucucacccgcccagcgagagcagaaccaauccagucagg

SEQ ID NO: 269425 - RNA, 64 nt, Human
ccaaggguacacgcaggcaugcacggguuuccugcccagcgacggcuuaagccagcccccgacu

SEQ ID NO: 269426 - RNA, 64 nt, Human
gugggggcaaagggcgugggaagagcagggcuugcccagcgacacugcuggacaggaauuaacu

SEQ ID NO: 269427 - RNA, 64 nt, Human
ucagaacagggcgggggggggggcggugucaggucccagcgagccacaggaacggcccugcagg

SEQ ID NO: 269428 - RNA, 64 nt, Human
ccaugccaggggagaaggcacccagccauccugacccagcgaggagccaacuaucccaaauaua

SEQ ID NO: 269429 - RNA, 64 nt, Human
cagagcuggaggaggaggagggcaaacccgagggcccagcgaacucuucgaaaaccugcuggug

SEQ ID NO: 269430 - RNA, 64 nt, Human
caugcgggaggugucccagcgcuuccgccugccucccagcgaguacgucaucgugcccuccacc

SEQ ID NO: 269431 - RNA, 64 nt, Human
ucccugguugccucucuugccccuuguccugaagcccagcgacacagaaggggguggggcgggu

SEQ ID NO: 269432 - RNA, 64 nt, Human
gccugucucagaagaaggggcccuuggccagccccccagcgacacuaugcaaauccuggagugc

SEQ ID NO: 269433 - RNA, 64 nt, Human
cggggaggaugacggcccaggcccugguucucugcccagcgaagcaggaguagcugccgggccc

SEQ ID NO: 269434 - RNA, 64 nt, Human
gaguccgaaagggacuuggaagcuccgcuuucuacccagcgagcugccggcacgacuguugcuu

SEQ ID NO: 269435 - RNA, 64 nt, Human
uuuugagucaggcacaguggcucaugucugcaaucccagcgauuugggagguugagcugguagg

SEQ ID NO: 269436 - RNA, 64 nt, Human
cacuuccugcuggacucaggccuccagcucccugcccagcgagcggccucagccaccgccuccc

SEQ ID NO: 269437 - RNA, 61 nt, Human
agcugagcacuuuugaaaagcuuguccaucacucuaguagggagaggcucuggacagauga

SEQ ID NO: 269438 - RNA, 61 nt, Human
auuguauuauaaucuucuccaugugugccuucucuaguagaaugugagcucuuugaggcca

SEQ ID NO: 269439 - RNA, 61 nt, Human
cuccugcaacugugguuugaaacugcgcauucucuaguaguauauaucgugccugucuuca

SEQ ID NO: 269440 - RNA, 64 nt, Human
uuccaggcucuaggggcuggugcucauccccacccccagcgacuuccguccuaccuggcaugcu

SEQ ID NO: 269441 - RNA, 64 nt, Human
aaccacaagaagggaaagaccgcaacucggacagcccagcgacuuccaaguccucucacagaag

SEQ ID NO: 269442 - RNA, 64 nt, Human
ccuucccucugucuucuguguuuggcagaccagccccagcgaggacuuguugguugugguuuuu

SEQ ID NO: 269443 - RNA, 64 nt, Human
agcccacagccagcuccgugcccgagugggcguccccagcgagccuucccucucugccgcuugu

SEQ ID NO: 269444 - RNA, 64 nt, Human
ccucuggccucgugcccugcuggggaaggccucacccagcgaaggccggagaagcgguugggcc

SEQ ID NO: 269445 - RNA, 64 nt, Human
caaagugcugggauuacaggcaugagccaccacacccagcgagacgggguuucauuauguuggc

SEQ ID NO: 269446 - RNA, 64 nt, Human
aaagcagaaguggaccaccaucagcucccacccacccagcgauuuuuccuuggaggucagcccg

SEQ ID NO: 269447 - RNA, 64 nt, Human
ucaucaaaacauggacagcaggguguucucagcucccagcgaagccuccacaacagaauggggc

SEQ ID NO: 269448 - RNA, 64 nt, Human
agccgcgcuucagcgaugacuccagucugggugucccagcgagccccugcagggacaguauggc

SEQ ID NO: 269449 - RNA, 64 nt, Human
cucugaggcagucugcgcuguggcccugccucugcccagcgagaggccgugggcucuggacaag

SEQ ID NO: 269450 - RNA, 64 nt, Human
agcugagugccugagggguccagaagcuucgaggcccagcgaccucggugggcccaguggggag

SEQ ID NO: 269451 - RNA, 64 nt, Human
agcugagugccugagggguccagaagcuucgaggcccagcgaccucagugggcccaguggggag

SEQ ID NO: 269452 - RNA, 64 nt, Human
aguuacagguuggacaugaugcacacuauggggccccagcgacgugucugguugagcucaggga

SEQ ID NO: 269453 - RNA, 64 nt, Human
cuggauuuccuuucuuugucccccacucccgauacccagcgaaagcacccucugacugccagau

SEQ ID NO: 269454 - RNA, 64 nt, Human
agaugcucaggggccagucccugugucucuggugcccagcgagcugagcaccagugggugaccg

SEQ ID NO: 269455 - RNA, 61 nt, Human
ggagagccuggggguggggggacugccuugucucuaguaguguggccugugccagcaccac

SEQ ID NO: 269456 - RNA, 61 nt, Human
ggauuuuuuuuuaaugcagaaguaauguauacucuaguauucugguguuuuuauauuuaug

SEQ ID NO: 269457 - RNA, 61 nt, Human
cuguagucgcauuuuuauauuuuuaguaucacucuaguaaaaaaaccaaauaauuuguuua

SEQ ID NO: 269458 - RNA, 64 nt, Human
aaauguuaacaccgggagcucuccaggccacucacccagcgacgcucgugggggaaacauacua

SEQ ID NO: 269459 - RNA, 64 nt, Human
cucugaagcgguggccacuucuuggacaucuugacccagcgaguggucuccuacacgucaccug

SEQ ID NO: 269460 - RNA, 64 nt, Human
acuugagcaugugaauauucucacggagagaagccccagcgagauuuuccggugaauacgggau

SEQ ID NO: 269461 - RNA, 64 nt, Human
agaccgagggugaggcuggaggguccaaagcuggcccagcgagcaccagggucccaggugucau

SEQ ID NO: 269462 - RNA, 64 nt, Human
uguccagaauggggacguggggcagccaccccugcccagcgagagcgcagacaccgugugaggg

SEQ ID NO: 269463 - RNA, 62 nt, Human
ucacucucaagcacgacuaagagccuucugagcccagcgacuucugaagggccccuugcaaa

SEQ ID NO: 269464 - RNA, 64 nt, Human
agccccaguccagguccaggaggcucccucccugcccagcgagucuuccagaaggggugaaagg

SEQ ID NO: 269465 - RNA, 53 nt, Human
cgcagcugucagccuucugagcacccagcgaggaggggcgggggcaggggcug

SEQ ID NO: 269466 - RNA, 64 nt, Human
ugagggcuccuacggguggguucauuggccugggcccagcgagcccccaccugcauugaccuua

SEQ ID NO: 269467 - RNA, 64 nt, Human
uacggccacuucccguucggaauaacugaaaucccccagcgaugggguaacaauuuuuuaaaac

SEQ ID NO: 269468 - RNA, 64 nt, Human
cugcuguggagaagccggacccauccccgagguccccagcgaggacacacacuccacgagagca

SEQ ID NO: 269469 - RNA, 64 nt, Human
cagccccucgagcccccccaccggccccggccgccccagcgaccucccuggcaccggccgccgc

SEQ ID NO: 269470 - RNA, 64 nt, Human
accucccucugaacuaaucccggagcaccccacccccagcgagucccaccuggaccucuucaaa

SEQ ID NO: 269471 - RNA, 64 nt, Human
gugucccagcacgccgggaggggcaaccaggccucccagcgaguccugcagggcccaucuagag

SEQ ID NO: 269472 - RNA, 62 nt, Human
ucacucucaagcacgucuaagagccuuaugagcccagcgacuucugaagggccccuugcaaa

SEQ ID NO: 269473 - RNA, 64 nt, Human; identical to SEQ ID NO: 143126

SEQ ID NO: 269474 - RNA, 64 nt, Human; identical to SEQ ID NO: 143127

SEQ ID NO: 269475 - RNA, 64 nt, Human; identical to SEQ ID NO: 143128

SEQ ID NO: 269476 - RNA, 61 nt, Human
ucuuuaagaugugcauuccuuucugcuugcucucuaguaaauguuuuacuaccgggaccug

SEQ ID NO: 269477 - RNA, 61 nt, Human
uaagauguguguucacaauagaccauaacuccucuaguaucaaaauuggggcucuucaguu

SEQ ID NO: 269478 - RNA, 61 nt, Human
augugaugauagaauuucuccauugaugaaucucuaguauguguguauacuuuauuuaccc

SEQ ID NO: 269479 - RNA, 61 nt, Human
uccaacuuguacauccagaacaaaagggccccucuaguagcugugugcuggauuauucagg

SEQ ID NO: 269480 - RNA, 64 nt, Human
aaggaauguugcugcagagacugaaugacaugcaacaggugaagguuuauacguuauacacaag

SEQ ID NO: 269481 - RNA, 64 nt, Human
gugcuugcuuagagugcccagcagagguuugcugacaggugaugcucuggcuugccccaggacu

SEQ ID NO: 269482 - RNA, 64 nt, Human
gcuaugcauuuauuaggaaaaacugaauuucccaacaggugaacugaaaaguuauuuuaacuau

SEQ ID NO: 269483 - RNA, 64 nt, Human
gcuccauccgugccucuuuuuaaaguucaaacucacaggugacucuaagguuaucuacuuuuac

SEQ ID NO: 269484 - RNA, 64 nt, Human
uccuucugccucagccucccgaguagcugggauuacaggugagcaccacuguaccuggcuagcu

SEQ ID NO: 269485 - RNA, 64 nt, Human
ucucuuggcgacaguaccaagcacgguucucuacacaggugacugaaguugccucuguguuggc

SEQ ID NO: 269486 - RNA, 64 nt, Human
caaacacagcacuucggcuccucuaaccugugccacaggugaccaccaauaaaauccucugcug

SEQ ID NO: 269487 - RNA, 64 nt, Human
auuaaaaaaaaauaauuaaaagugaugucuuugcacaggugagacuuugcacugagggaaggga

SEQ ID NO: 269488 - RNA, 64 nt, Human
guguauguaugugaauauacacacacacacacacacaggugagugugaauacuuccuuguuggc

SEQ ID NO: 269489 - RNA, 64 nt, Human
ugcacaucacaaauuacacuauccuggguauuuuacaggugacauguuacuucguucuugaauu

SEQ ID NO: 269490 - RNA, 64 nt, Human
agcuacaaagucauuuguggcuagauagguuaagacaggugauuuuuuaaaguagacugucuuu

SEQ ID NO: 269491 - RNA, 64 nt, Human
guggucuccuugguaauguauaauuugguauugcacaggugauuagucaaggaagucuggaaaa

SEQ ID NO: 269492 - RNA, 64 nt, Human
auuaaccaugaggaagagcauuuuucuaaggagaacaggugacaauauacacaugugcgcuaau

SEQ ID NO: 269493 - RNA, 64 nt, Human
uaugucaagaauuuuagauaggccuuucaguaacacaggugaagaaauuuuuaaaaauacauug

SEQ ID NO: 269494 - RNA, 64 nt, Human
cucugugucccacacgcaggugacacaccgugagacaggugaggugauggugaugaaggagcug

SEQ ID NO: 269495 - RNA, 64 nt, Human
gaugguggaggugcuaaugcuuugcuuggggccuacaggugaaagguggcugcccucagauucc

SEQ ID NO: 269496 - RNA, 64 nt, Human; identical to SEQ ID NO: 195435

SEQ ID NO: 269497 - RNA, 64 nt, Human; identical to SEQ ID NO: 195436

SEQ ID NO: 269498 - RNA, 64 nt, Human; identical to SEQ ID NO: 195437

SEQ ID NO: 269499 - RNA, 64 nt, Human; identical to SEQ ID NO: 195438

SEQ ID NO: 269500 - RNA, 64 nt, Human; identical to SEQ ID NO: 195439

SEQ ID NO: 269501 - RNA, 64 nt, Human; identical to SEQ ID NO: 195440

SEQ ID NO: 269502 - RNA, 64 nt, Human; identical to SEQ ID NO: 195441

SEQ ID NO: 269503 - RNA, 64 nt, Human; identical to SEQ ID NO: 195442

SEQ ID NO: 269504 - RNA, 64 nt, Human; identical to SEQ ID NO: 195447

SEQ ID NO: 269505 - RNA, 64 nt, Human; identical to SEQ ID NO: 195448

SEQ ID NO: 269506 - RNA, 64 nt, Human; identical to SEQ ID NO: 143136

SEQ ID NO: 269507 - RNA, 64 nt, Human; identical to SEQ ID NO: 143137

SEQ ID NO: 269508 - RNA, 64 nt, Human; identical to SEQ ID NO: 143138

SEQ ID NO: 269509 - RNA, 64 nt, Human; identical to SEQ ID NO: 195449

SEQ ID NO: 269510 - RNA, 64 nt, Human; identical to SEQ ID NO: 195450

SEQ ID NO: 269511 - RNA, 64 nt, Human; identical to SEQ ID NO: 195451

SEQ ID NO: 269512 - RNA, 64 nt, Human; identical to SEQ ID NO: 195452

SEQ ID NO: 269513 - RNA, 64 nt, Human; identical to SEQ ID NO: 195453

SEQ ID NO: 269514 - RNA, 64 nt, Human; identical to SEQ ID NO: 195454

SEQ ID NO: 269515 - RNA, 64 nt, Human; identical to SEQ ID NO: 195455

SEQ ID NO: 269516 - RNA, 64 nt, Human; identical to SEQ ID NO: 195456

SEQ ID NO: 269517 - RNA, 64 nt, Human; identical to SEQ ID NO: 195457

SEQ ID NO: 269518 - RNA, 64 nt, Human; identical to SEQ ID NO: 195458

SEQ ID NO: 269519 - RNA, 64 nt, Human; identical to SEQ ID NO: 195459

SEQ ID NO: 269520 - RNA, 64 nt, Human; identical to SEQ ID NO: 195460

SEQ ID NO: 269521 - RNA, 64 nt, Human; identical to SEQ ID NO: 195461

SEQ ID NO: 269522 - RNA, 64 nt, Human; identical to SEQ ID NO: 195466

SEQ ID NO: 269523 - RNA, 64 nt, Human; identical to SEQ ID NO: 195467

SEQ ID NO: 269524 - RNA, 61 nt, Human
gaccaaccugaccuacauggagaaacuccgccucuaguaaaaauacaaaauuagccgggca

SEQ ID NO: 269525 - RNA, 61 nt, Human
agaaauccauaggccucucuuggugacacaucucuaguacuuuuugucauaaacaaacagg

SEQ ID NO: 269526 - RNA, 61 nt, Human
cagcauucuuaggcgauaaagagagcagcaccucuaguaccuuuaggcagauuacuuuuuc

SEQ ID NO: 269527 - RNA, 64 nt, Human; identical to SEQ ID NO: 195468

SEQ ID NO: 269528 - RNA, 64 nt, Human; identical to SEQ ID NO: 195469

SEQ ID NO: 269529 - RNA, 64 nt, Human; identical to SEQ ID NO: 195470

SEQ ID NO: 269530 - RNA, 64 nt, Human; identical to SEQ ID NO: 195471

SEQ ID NO: 269531 - RNA, 64 nt, Human; identical to SEQ ID NO: 195472

SEQ ID NO: 269532 - RNA, 64 nt, Human; identical to SEQ ID NO: 195473

SEQ ID NO: 269533 - RNA, 64 nt, Human; identical to SEQ ID NO: 195474

SEQ ID NO: 269534 - RNA, 64 nt, Human; identical to SEQ ID NO: 195475

SEQ ID NO: 269535 - RNA, 64 nt, Human; identical to SEQ ID NO: 195476

SEQ ID NO: 269536 - RNA, 64 nt, Human; identical to SEQ ID NO: 195477

SEQ ID NO: 269537 - RNA, 64 nt, Human; identical to SEQ ID NO: 195478

SEQ ID NO: 269538 - RNA, 64 nt, Human; identical to SEQ ID NO: 195479

SEQ ID NO: 269539 - RNA, 64 nt, Human; identical to SEQ ID NO: 195480

SEQ ID NO: 269540 - RNA, 64 nt, Human; identical to SEQ ID NO: 195485

SEQ ID NO: 269541 - RNA, 64 nt, Human; identical to SEQ ID NO: 195486

SEQ ID NO: 269542 - RNA, 64 nt, Human; identical to SEQ ID NO: 143145

SEQ ID NO: 269543 - RNA, 64 nt, Human; identical to SEQ ID NO: 143146

SEQ ID NO: 269544 - RNA, 64 nt, Human; identical to SEQ ID NO: 143147

SEQ ID NO: 269545 - RNA, 64 nt, Human; identical to SEQ ID NO: 195487

SEQ ID NO: 269546 - RNA, 64 nt, Human; identical to SEQ ID NO: 195488

SEQ ID NO: 269547 - RNA, 64 nt, Human; identical to SEQ ID NO: 195489

SEQ ID NO: 269548 - RNA, 64 nt, Human; identical to SEQ ID NO: 195490

SEQ ID NO: 269549 - RNA, 64 nt, Human; identical to SEQ ID NO: 195491

SEQ ID NO: 269550 - RNA, 64 nt, Human; identical to SEQ ID NO: 195492

SEQ ID NO: 269551 - RNA, 64 nt, Human; identical to SEQ ID NO: 195493

SEQ ID NO: 269552 - RNA, 64 nt, Human; identical to SEQ ID NO: 195494

SEQ ID NO: 269553 - RNA, 64 nt, Human; identical to SEQ ID NO: 195495

SEQ ID NO: 269554 - RNA, 64 nt, Human; identical to SEQ ID NO: 195496

SEQ ID NO: 269555 - RNA, 64 nt, Human; identical to SEQ ID NO: 195497

SEQ ID NO: 269556 - RNA, 64 nt, Human; identical to SEQ ID NO: 195498

SEQ ID NO: 269557 - RNA, 64 nt, Human; identical to SEQ ID NO: 195499

SEQ ID NO: 269558 - RNA, 64 nt, Human; identical to SEQ ID NO: 195504

SEQ ID NO: 269559 - RNA, 64 nt, Human; identical to SEQ ID NO: 195505

SEQ ID NO: 269560 - RNA, 64 nt, Human; identical to SEQ ID NO: 143154

SEQ ID NO: 269561 - RNA, 64 nt, Human; identical to SEQ ID NO: 143155

SEQ ID NO: 269562 - RNA, 64 nt, Human; identical to SEQ ID NO: 143156

SEQ ID NO: 269563 - RNA, 64 nt, Human; identical to SEQ ID NO: 195506

SEQ ID NO: 269564 - RNA, 64 nt, Human; identical to SEQ ID NO: 195507

SEQ ID NO: 269565 - RNA, 64 nt, Human; identical to SEQ ID NO: 195508

SEQ ID NO: 269566 - RNA, 64 nt, Human; identical to SEQ ID NO: 195509

SEQ ID NO: 269567 - RNA, 64 nt, Human; identical to SEQ ID NO: 195510

SEQ ID NO: 269568 - RNA, 64 nt, Human; identical to SEQ ID NO: 195511

SEQ ID NO: 269569 - RNA, 52 nt, Human; identical to SEQ ID NO: 195512

SEQ ID NO: 269570 - RNA, 64 nt, Human; identical to SEQ ID NO: 195513

SEQ ID NO: 269571 - RNA, 64 nt, Human; identical to SEQ ID NO: 195514

SEQ ID NO: 269572 - RNA, 64 nt, Human; identical to SEQ ID NO: 195515

SEQ ID NO: 269573 - RNA, 64 nt, Human; identical to SEQ ID NO: 195516

SEQ ID NO: 269574 - RNA, 64 nt, Human; identical to SEQ ID NO: 195517

SEQ ID NO: 269575 - RNA, 64 nt, Human; identical to SEQ ID NO: 195518

SEQ ID NO: 269576 - RNA, 64 nt, Human; identical to SEQ ID NO: 195523

SEQ ID NO: 269577 - RNA, 54 nt, Human; identical to SEQ ID NO: 195524

SEQ ID NO: 269578 - RNA, 64 nt, Human; identical to SEQ ID NO: 143164

SEQ ID NO: 269579 - RNA, 64 nt, Human; identical to SEQ ID NO: 143165

SEQ ID NO: 269580 - RNA, 64 nt, Human; identical to SEQ ID NO: 143166

SEQ ID NO: 269581 - RNA, 64 nt, Human; identical to SEQ ID NO: 195525

SEQ ID NO: 269582 - RNA, 64 nt, Human; identical to SEQ ID NO: 195526

SEQ ID NO: 269583 - RNA, 64 nt, Human; identical to SEQ ID NO: 195527

SEQ ID NO: 269584 - RNA, 64 nt, Human; identical to SEQ ID NO: 195528

SEQ ID NO: 269585 - RNA, 64 nt, Human; identical to SEQ ID NO: 195529

SEQ ID NO: 269586 - RNA, 64 nt, Human; identical to SEQ ID NO: 195530

SEQ ID NO: 269587 - RNA, 64 nt, Human; identical to SEQ ID NO: 195531

SEQ ID NO: 269588 - RNA, 64 nt, Human; identical to SEQ ID NO: 195532

SEQ ID NO: 269589 - RNA, 64 nt, Human; identical to SEQ ID NO: 195533

SEQ ID NO: 269590 - RNA, 64 nt, Human; identical to SEQ ID NO: 195534

SEQ ID NO: 269591 - RNA, 64 nt, Human; identical to SEQ ID NO: 195535

SEQ ID NO: 269592 - RNA, 64 nt, Human; identical to SEQ ID NO: 195536

SEQ ID NO: 269593 - RNA, 64 nt, Human; identical to SEQ ID NO: 195537

SEQ ID NO: 269594 - RNA, 64 nt, Human; identical to SEQ ID NO: 195542

SEQ ID NO: 269595 - RNA, 64 nt, Human; identical to SEQ ID NO: 195543

SEQ ID NO: 269596 - RNA, 64 nt, Human
gcgccccccgccagcccgcccccgguuguccaccucccgcgaagcccaaucgcgaggccgcgag

SEQ ID NO: 269597 - RNA, 61 nt, Human
caaccccugagugccccugucccaccccuaccucuaguaaauuuaaguccaccucacguuc

SEQ ID NO: 269598 - RNA, 61 nt, Human
gaccagccuggucaacauggugaaaucuugucucuaguaaaaauacaaaaauauaugaaau

SEQ ID NO: 269599 - RNA, 64 nt, Human; identical to SEQ ID NO: 195544

SEQ ID NO: 269600 - RNA, 64 nt, Human; identical to SEQ ID NO: 195545

SEQ ID NO: 269601 - RNA, 64 nt, Human; identical to SEQ ID NO: 195546

SEQ ID NO: 269602 - RNA, 64 nt, Human; identical to SEQ ID NO: 195547

SEQ ID NO: 269603 - RNA, 64 nt, Human; identical to SEQ ID NO: 195548

SEQ ID NO: 269604 - RNA, 64 nt, Human; identical to SEQ ID NO: 195549

SEQ ID NO: 269605 - RNA, 64 nt, Human; identical to SEQ ID NO: 195550

SEQ ID NO: 269606 - RNA, 64 nt, Human; identical to SEQ ID NO: 195551

SEQ ID NO: 269607 - RNA, 64 nt, Human; identical to SEQ ID NO: 195552

SEQ ID NO: 269608 - RNA, 64 nt, Human; identical to SEQ ID NO: 195553

SEQ ID NO: 269609 - RNA, 64 nt, Human; identical to SEQ ID NO: 195554

SEQ ID NO: 269610 - RNA, 64 nt, Human; identical to SEQ ID NO: 195555

SEQ ID NO: 269611 - RNA, 64 nt, Human; identical to SEQ ID NO: 195556

SEQ ID NO: 269612 - RNA, 64 nt, Human; identical to SEQ ID NO: 195561

SEQ ID NO: 269613 - RNA, 64 nt, Human; identical to SEQ ID NO: 195562

SEQ ID NO: 269614 - RNA, 64 nt, Human; identical to SEQ ID NO: 195563

SEQ ID NO: 269615 - RNA, 64 nt, Human; identical to SEQ ID NO: 195564

SEQ ID NO: 269616 - RNA, 64 nt, Human; identical to SEQ ID NO: 195565

SEQ ID NO: 269617 - RNA, 64 nt, Human; identical to SEQ ID NO: 195566

SEQ ID NO: 269618 - RNA, 64 nt, Human; identical to SEQ ID NO: 195567

SEQ ID NO: 269619 - RNA, 64 nt, Human; identical to SEQ ID NO: 195568

SEQ ID NO: 269620 - RNA, 64 nt, Human; identical to SEQ ID NO: 195569

SEQ ID NO: 269621 - RNA, 64 nt, Human; identical to SEQ ID NO: 195570

SEQ ID NO: 269622 - RNA, 64 nt, Human; identical to SEQ ID NO: 195571

SEQ ID NO: 269623 - RNA, 64 nt, Human; identical to SEQ ID NO: 195572

SEQ ID NO: 269624 - RNA, 61 nt, Human; identical to SEQ ID NO: 195573

SEQ ID NO: 269625 - RNA, 64 nt, Human; identical to SEQ ID NO: 195574

SEQ ID NO: 269626 - RNA, 64 nt, Human; identical to SEQ ID NO: 195575

SEQ ID NO: 269627 - RNA, 64 nt, Human; identical to SEQ ID NO: 195580

SEQ ID NO: 269628 - RNA, 64 nt, Human; identical to SEQ ID NO: 195581

SEQ ID NO: 269629 - RNA, 63 nt, Human
cuuugugggcuccaggccuguacucaucggcaggcgcaugaguaucugugggaguccucuaga

SEQ ID NO: 269630 - RNA, 63 nt, Human
auuaaagcgagcaaagucugcauuuuaccuggugcgcaugaguggggucuuuaagaguuuugg

SEQ ID NO: 269631 - RNA, 63 nt, Human
augaaauuuuaaaggaguuucaguuuuaaaagugcgcaugauucuacauaugagaauucuuua

SEQ ID NO: 269632 - RNA, 64 nt, Human; identical to SEQ ID NO: 195582

SEQ ID NO: 269633 - RNA, 64 nt, Human; identical to SEQ ID NO: 195583

SEQ ID NO: 269634 - RNA, 64 nt, Human; identical to SEQ ID NO: 195584

SEQ ID NO: 269635 - RNA, 64 nt, Human; identical to SEQ ID NO: 195585

SEQ ID NO: 269636 - RNA, 64 nt, Human; identical to SEQ ID NO: 195586

SEQ ID NO: 269637 - RNA, 64 nt, Human; identical to SEQ ID NO: 195587

SEQ ID NO: 269638 - RNA, 64 nt, Human; identical to SEQ ID NO: 195588

SEQ ID NO: 269639 - RNA, 64 nt, Human; identical to SEQ ID NO: 195589

SEQ ID NO: 269640 - RNA, 64 nt, Human; identical to SEQ ID NO: 195590

SEQ ID NO: 269641 - RNA, 64 nt, Human; identical to SEQ ID NO: 195591

SEQ ID NO: 269642 - RNA, 64 nt, Human; identical to SEQ ID NO: 195592

SEQ ID NO: 269643 - RNA, 64 nt, Human; identical to SEQ ID NO: 195593

SEQ ID NO: 269644 - RNA, 64 nt, Human; identical to SEQ ID NO: 195594

SEQ ID NO: 269645 - RNA, 64 nt, Human; identical to SEQ ID NO: 195599

SEQ ID NO: 269646 - RNA, 64 nt, Human; identical to SEQ ID NO: 195600

SEQ ID NO: 269647 - RNA, 63 nt, Human
guuuguugcuuacaguuugacaacuuaaaugcugcgcaugaaaccucuaaguuggaaauugaa

SEQ ID NO: 269648 - RNA, 63 nt, Human
cugcuaggacuuaccccagccacugaguggcaggcgcaugagauuuguggcuguuccugaugc

SEQ ID NO: 269649 - RNA, 63 nt, Human
cagaaagaaacaacagaaaccaaaacucacaaggcgcaugauuacuuguuuuauauuucaugu

SEQ ID NO: 269650 - RNA, 64 nt, Human; identical to SEQ ID NO: 195601

SEQ ID NO: 269651 - RNA, 64 nt, Human; identical to SEQ ID NO: 195602

SEQ ID NO: 269652 - RNA, 64 nt, Human; identical to SEQ ID NO: 195603

SEQ ID NO: 269653 - RNA, 64 nt, Human; identical to SEQ ID NO: 195604

SEQ ID NO: 269654 - RNA, 64 nt, Human; identical to SEQ ID NO: 195605

SEQ ID NO: 269655 - RNA, 64 nt, Human; identical to SEQ ID NO: 195606

SEQ ID NO: 269656 - RNA, 64 nt, Human; identical to SEQ ID NO: 195607

SEQ ID NO: 269657 - RNA, 64 nt, Human; identical to SEQ ID NO: 195608

SEQ ID NO: 269658 - RNA, 64 nt, Human; identical to SEQ ID NO: 195609

SEQ ID NO: 269659 - RNA, 64 nt, Human; identical to SEQ ID NO: 195610

SEQ ID NO: 269660 - RNA, 64 nt, Human; identical to SEQ ID NO: 195611

SEQ ID NO: 269661 - RNA, 64 nt, Human; identical to SEQ ID NO: 195612

SEQ ID NO: 269662 - RNA, 64 nt, Human; identical to SEQ ID NO: 195613

SEQ ID NO: 269663 - RNA, 64 nt, Human; identical to SEQ ID NO: 195618

SEQ ID NO: 269664 - RNA, 64 nt, Human; identical to SEQ ID NO: 195619

SEQ ID NO: 269665 - RNA, 61 nt, Human
uauuuuuaaagaucacauuuuccaugaacgccucuaguagcaaaccauucuuuugcacacc

SEQ ID NO: 269666 - RNA, 61 nt, Human
ucuuuaacucaugcauggccacugaaccucucucuaguagccuggauuuaucauucucucu

SEQ ID NO: 269667 - RNA, 61 nt, Human
gcaccuugacacaaggacuccacacugugcucucuaguagcacaaggaggaaguuggacag

SEQ ID NO: 269668 - RNA, 64 nt, Human; identical to SEQ ID NO: 195620

SEQ ID NO: 269669 - RNA, 64 nt, Human; identical to SEQ ID NO: 195621

SEQ ID NO: 269670 - RNA, 64 nt, Human; identical to SEQ ID NO: 195622

SEQ ID NO: 269671 - RNA, 64 nt, Human; identical to SEQ ID NO: 195623

SEQ ID NO: 269672 - RNA, 64 nt, Human; identical to SEQ ID NO: 195624

SEQ ID NO: 269673 - RNA, 64 nt, Human; identical to SEQ ID NO: 195625

SEQ ID NO: 269674 - RNA, 64 nt, Human; identical to SEQ ID NO: 195626

SEQ ID NO: 269675 - RNA, 64 nt, Human; identical to SEQ ID NO: 195627

SEQ ID NO: 269676 - RNA, 64 nt, Human; identical to SEQ ID NO: 195628

SEQ ID NO: 269677 - RNA, 64 nt, Human; identical to SEQ ID NO: 195629

SEQ ID NO: 269678 - RNA, 64 nt, Human; identical to SEQ ID NO: 195630

SEQ ID NO: 269679 - RNA, 64 nt, Human; identical to SEQ ID NO: 195631

SEQ ID NO: 269680 - RNA, 64 nt, Human; identical to SEQ ID NO: 195632

SEQ ID NO: 269681 - RNA, 64 nt, Human; identical to SEQ ID NO: 195637

SEQ ID NO: 269682 - RNA, 64 nt, Human; identical to SEQ ID NO: 195638

SEQ ID NO: 269683 - RNA, 63 nt, Human
uccccaggaccccauccuguucucggggacccugcgcaugaaccuggaccccuucggcagcua

SEQ ID NO: 269684 - RNA, 63 nt, Human
gacaagcuggacccccugcucccgggggggcgagcgcaugacccccccgcccucgcgcugccu

SEQ ID NO: 269685 - RNA, 63 nt, Human
uuagucugacuugacuauuguuuuuccuuucuggcgcaugaauccauacaucauuccuggaag

SEQ ID NO: 269686 - RNA, 64 nt, Human; identical to SEQ ID NO: 195639

SEQ ID NO: 269687 - RNA, 64 nt, Human; identical to SEQ ID NO: 195640

SEQ ID NO: 269688 - RNA, 64 nt, Human; identical to SEQ ID NO: 195641

SEQ ID NO: 269689 - RNA, 64 nt, Human; identical to SEQ ID NO: 195642

SEQ ID NO: 269690 - RNA, 64 nt, Human; identical to SEQ ID NO: 195643

SEQ ID NO: 269691 - RNA, 64 nt, Human; identical to SEQ ID NO: 195644

SEQ ID NO: 269692 - RNA, 64 nt, Human; identical to SEQ ID NO: 195645

SEQ ID NO: 269693 - RNA, 64 nt, Human; identical to SEQ ID NO: 195646

SEQ ID NO: 269694 - RNA, 64 nt, Human; identical to SEQ ID NO: 195647

SEQ ID NO: 269695 - RNA, 64 nt, Human; identical to SEQ ID NO: 195648

SEQ ID NO: 269696 - RNA, 64 nt, Human; identical to SEQ ID NO: 195649

SEQ ID NO: 269697 - RNA, 64 nt, Human; identical to SEQ ID NO: 195650

SEQ ID NO: 269698 - RNA, 64 nt, Human; identical to SEQ ID NO: 195651

SEQ ID NO: 269699 - RNA, 64 nt, Human; identical to SEQ ID NO: 195656

SEQ ID NO: 269700 - RNA, 64 nt, Human; identical to SEQ ID NO: 195657

SEQ ID NO: 269701 - RNA, 64 nt, Human
guauaagugcgcuucgguacagcacggguccugcucccgcgauguggaagugucacacggcacc

SEQ ID NO: 269702 - RNA, 64 nt, Human
uguagagccccaacuuagauugccuucugggaaaucccgcgauacuaaaauccagugagcuuug

SEQ ID NO: 269703 - RNA, 64 nt, Human
cagugccacaccucgaacugguuguagugggaagucccgcgaaacccggugcaucuggcacgug

SEQ ID NO: 269704 - RNA, 64 nt, Human; identical to SEQ ID NO: 195658

SEQ ID NO: 269705 - RNA, 64 nt, Human; identical to SEQ ID NO: 195659

SEQ ID NO: 269706 - RNA, 64 nt, Human; identical to SEQ ID NO: 195660

SEQ ID NO: 269707 - RNA, 64 nt, Human; identical to SEQ ID NO: 195661

SEQ ID NO: 269708 - RNA, 64 nt, Human; identical to SEQ ID NO: 195662

SEQ ID NO: 269709 - RNA, 64 nt, Human; identical to SEQ ID NO: 195663

SEQ ID NO: 269710 - RNA, 64 nt, Human; identical to SEQ ID NO: 195664

SEQ ID NO: 269711 - RNA, 64 nt, Human; identical to SEQ ID NO: 195665

SEQ ID NO: 269712 - RNA, 64 nt, Human; identical to SEQ ID NO: 195666

SEQ ID NO: 269713 - RNA, 64 nt, Human; identical to SEQ ID NO: 195667

SEQ ID NO: 269714 - RNA, 64 nt, Human; identical to SEQ ID NO: 195668

SEQ ID NO: 269715 - RNA, 64 nt, Human; identical to SEQ ID NO: 195669

SEQ ID NO: 269716 - RNA, 64 nt, Human; identical to SEQ ID NO: 195670

SEQ ID NO: 269717 - RNA, 64 nt, Human; identical to SEQ ID NO: 195675

SEQ ID NO: 269718 - RNA, 64 nt, Human; identical to SEQ ID NO: 195676

SEQ ID NO: 269719 - RNA, 61 nt, Human
ucccaucccacaaaacagaaucuguccguuucucuaguaagggagacuuguuggagaggcg

SEQ ID NO: 269720 - RNA, 64 nt, Human
aaggauaguuucuuccucugacauggggaccauaacaggugaucacugauaccuggcaaagacu

SEQ ID NO: 269721 - RNA, 64 nt, Human; identical to SEQ ID NO: 195677

SEQ ID NO: 269722 - RNA, 64 nt, Human; identical to SEQ ID NO: 195678

SEQ ID NO: 269723 - RNA, 64 nt, Human; identical to SEQ ID NO: 195679

SEQ ID NO: 269724 - RNA, 64 nt, Human; identical to SEQ ID NO: 195680

SEQ ID NO: 269725 - RNA, 64 nt, Human; identical to SEQ ID NO: 195681

SEQ ID NO: 269726 - RNA, 64 nt, Human; identical to SEQ ID NO: 195682

SEQ ID NO: 269727 - RNA, 58 nt, Human; identical to SEQ ID NO: 195683

SEQ ID NO: 269728 - RNA, 64 nt, Human; identical to SEQ ID NO: 195684

SEQ ID NO: 269729 - RNA, 64 nt, Human; identical to SEQ ID NO: 195685

SEQ ID NO: 269730 - RNA, 64 nt, Human; identical to SEQ ID NO: 195686

SEQ ID NO: 269731 - RNA, 64 nt, Human; identical to SEQ ID NO: 195687

SEQ ID NO: 269732 - RNA, 64 nt, Human; identical to SEQ ID NO: 195688

SEQ ID NO: 269733 - RNA, 64 nt, Human; identical to SEQ ID NO: 195689

SEQ ID NO: 269734 - RNA, 64 nt, Human; identical to SEQ ID NO: 195694

SEQ ID NO: 269735 - RNA, 64 nt, Human; identical to SEQ ID NO: 195695

SEQ ID NO: 269736 - RNA, 64 nt, Human; identical to SEQ ID NO: 143116

SEQ ID NO: 269737 - RNA, 64 nt, Human; identical to SEQ ID NO: 143117

SEQ ID NO: 269738 - RNA, 64 nt, Human; identical to SEQ ID NO: 143118

SEQ ID NO: 269739 - RNA, 64 nt, Human; identical to SEQ ID NO: 195696

SEQ ID NO: 269740 - RNA, 64 nt, Human; identical to SEQ ID NO: 195697

SEQ ID NO: 269741 - RNA, 64 nt, Human; identical to SEQ ID NO: 195698

SEQ ID NO: 269742 - RNA, 64 nt, Human; identical to SEQ ID NO: 195699

SEQ ID NO: 269743 - RNA, 64 nt, Human; identical to SEQ ID NO: 195700

SEQ ID NO: 269744 - RNA, 64 nt, Human; identical to SEQ ID NO: 195701

SEQ ID NO: 269745 - RNA, 64 nt, Human; identical to SEQ ID NO: 195702

SEQ ID NO: 269746 - RNA, 64 nt, Human; identical to SEQ ID NO: 195703

SEQ ID NO: 269747 - RNA, 64 nt, Human; identical to SEQ ID NO: 195704

SEQ ID NO: 269748 - RNA, 64 nt, Human; identical to SEQ ID NO: 195705

SEQ ID NO: 269749 - RNA, 64 nt, Human; identical to SEQ ID NO: 195706

SEQ ID NO: 269750 - RNA, 64 nt, Human; identical to SEQ ID NO: 195707

SEQ ID NO: 269751 - RNA, 64 nt, Human; identical to SEQ ID NO: 195708

SEQ ID NO: 269752 - RNA, 64 nt, Human; identical to SEQ ID NO: 195712

SEQ ID NO: 269753 - RNA, 64 nt, Human; identical to SEQ ID NO: 195713

SEQ ID NO: 269754 - RNA, 64 nt, Human; identical to SEQ ID NO: 195714

SEQ ID NO: 269755 - RNA, 64 nt, Human; identical to SEQ ID NO: 195715

SEQ ID NO: 269756 - RNA, 64 nt, Human; identical to SEQ ID NO: 195716

SEQ ID NO: 269757 - RNA, 64 nt, Human; identical to SEQ ID NO: 195717

SEQ ID NO: 269758 - RNA, 64 nt, Human; identical to SEQ ID NO: 195718

SEQ ID NO: 269759 - RNA, 64 nt, Human; identical to SEQ ID NO: 195719

SEQ ID NO: 269760 - RNA, 64 nt, Human; identical to SEQ ID NO: 195720

SEQ ID NO: 269761 - RNA, 64 nt, Human; identical to SEQ ID NO: 195721

SEQ ID NO: 269762 - RNA, 64 nt, Human; identical to SEQ ID NO: 195722

SEQ ID NO: 269763 - RNA, 64 nt, Human; identical to SEQ ID NO: 195723

SEQ ID NO: 269764 - RNA, 64 nt, Human; identical to SEQ ID NO: 195724

SEQ ID NO: 269765 - RNA, 64 nt, Human; identical to SEQ ID NO: 195725

SEQ ID NO: 269766 - RNA, 64 nt, Human; identical to SEQ ID NO: 195726

SEQ ID NO: 269767 - RNA, 64 nt, Human; identical to SEQ ID NO: 195731

SEQ ID NO: 269768 - RNA, 64 nt, Human; identical to SEQ ID NO: 195732

SEQ ID NO: 269769 - RNA, 64 nt, Human; identical to SEQ ID NO: 195733

SEQ ID NO: 269770 - RNA, 64 nt, Human; identical to SEQ ID NO: 195734

SEQ ID NO: 269771 - RNA, 64 nt, Human; identical to SEQ ID NO: 195735

SEQ ID NO: 269772 - RNA, 64 nt, Human; identical to SEQ ID NO: 195736

SEQ ID NO: 269773 - RNA, 64 nt, Human; identical to SEQ ID NO: 195737

SEQ ID NO: 269774 - RNA, 55 nt, Human; identical to SEQ ID NO: 195738

SEQ ID NO: 269775 - RNA, 64 nt, Human; identical to SEQ ID NO: 195739

SEQ ID NO: 269776 - RNA, 64 nt, Human; identical to SEQ ID NO: 195740

SEQ ID NO: 269777 - RNA, 64 nt, Human; identical to SEQ ID NO: 195741

SEQ ID NO: 269778 - RNA, 64 nt, Human; identical to SEQ ID NO: 195742

SEQ ID NO: 269779 - RNA, 64 nt, Human; identical to SEQ ID NO: 195743

SEQ ID NO: 269780 - RNA, 64 nt, Human; identical to SEQ ID NO: 195744

SEQ ID NO: 269781 - RNA, 64 nt, Human; identical to SEQ ID NO: 195745

SEQ ID NO: 269782 - RNA, 64 nt, Human; identical to SEQ ID NO: 195750

SEQ ID NO: 269783 - RNA, 64 nt, Human; identical to SEQ ID NO: 195751

SEQ ID NO: 269784 - RNA, 64 nt, Human; identical to SEQ ID NO: 195752

SEQ ID NO: 269785 - RNA, 64 nt, Human; identical to SEQ ID NO: 195753

SEQ ID NO: 269786 - RNA, 64 nt, Human; identical to SEQ ID NO: 195754

SEQ ID NO: 269787 - RNA, 64 nt, Human; identical to SEQ ID NO: 195755

SEQ ID NO: 269788 - RNA, 64 nt, Human; identical to SEQ ID NO: 195756

SEQ ID NO: 269789 - RNA, 64 nt, Human; identical to SEQ ID NO: 195757

SEQ ID NO: 269790 - RNA, 64 nt, Human; identical to SEQ ID NO: 195758

SEQ ID NO: 269791 - RNA, 64 nt, Human; identical to SEQ ID NO: 195759

SEQ ID NO: 269792 - RNA, 64 nt, Human; identical to SEQ ID NO: 195760

SEQ ID NO: 269793 - RNA, 64 nt, Human; identical to SEQ ID NO: 195761

SEQ ID NO: 269794 - RNA, 64 nt, Human; identical to SEQ ID NO: 195762

SEQ ID NO: 269795 - RNA, 64 nt, Human; identical to SEQ ID NO: 195763

SEQ ID NO: 269796 - RNA, 64 nt, Human; identical to SEQ ID NO: 195764

SEQ ID NO: 269797 - RNA, 64 nt, Human; identical to SEQ ID NO: 195769

SEQ ID NO: 269798 - RNA, 64 nt, Human; identical to SEQ ID NO: 195770

SEQ ID NO: 269799 - RNA, 64 nt, Human; identical to SEQ ID NO: 195771

SEQ ID NO: 269800 - RNA, 64 nt, Human; identical to SEQ ID NO: 195772

SEQ ID NO: 269801 - RNA, 64 nt, Human; identical to SEQ ID NO: 195773

SEQ ID NO: 269802 - RNA, 64 nt, Human; identical to SEQ ID NO: 195774

SEQ ID NO: 269803 - RNA, 64 nt, Human; identical to SEQ ID NO: 195775

SEQ ID NO: 269804 - RNA, 64 nt, Human; identical to SEQ ID NO: 195776

SEQ ID NO: 269805 - RNA, 64 nt, Human; identical to SEQ ID NO: 195777

SEQ ID NO: 269806 - RNA, 64 nt, Human; identical to SEQ ID NO: 195778

SEQ ID NO: 269807 - RNA, 64 nt, Human; identical to SEQ ID NO: 195779

SEQ ID NO: 269808 - RNA, 64 nt, Human; identical to SEQ ID NO: 195780

SEQ ID NO: 269809 - RNA, 64 nt, Human; identical to SEQ ID NO: 195781

SEQ ID NO: 269810 - RNA, 64 nt, Human; identical to SEQ ID NO: 195782

SEQ ID NO: 269811 - RNA, 64 nt, Human; identical to SEQ ID NO: 195783

SEQ ID NO: 269812 - RNA, 64 nt, Human; identical to SEQ ID NO: 195788

SEQ ID NO: 269813 - RNA, 64 nt, Human; identical to SEQ ID NO: 195789

SEQ ID NO: 269814 - RNA, 64 nt, Human; identical to SEQ ID NO: 195790

SEQ ID NO: 269815 - RNA, 64 nt, Human; identical to SEQ ID NO: 195791

SEQ ID NO: 269816 - RNA, 64 nt, Human; identical to SEQ ID NO: 195792

SEQ ID NO: 269817 - RNA, 64 nt, Human; identical to SEQ ID NO: 195793

SEQ ID NO: 269818 - RNA, 64 nt, Human; identical to SEQ ID NO: 195794

SEQ ID NO: 269819 - RNA, 64 nt, Human; identical to SEQ ID NO: 195795

SEQ ID NO: 269820 - RNA, 64 nt, Human; identical to SEQ ID NO: 195796

SEQ ID NO: 269821 - RNA, 64 nt, Human; identical to SEQ ID NO: 195797

SEQ ID NO: 269822 - RNA, 64 nt, Human; identical to SEQ ID NO: 195798

SEQ ID NO: 269823 - RNA, 64 nt, Human; identical to SEQ ID NO: 195799

SEQ ID NO: 269824 - RNA, 64 nt, Human; identical to SEQ ID NO: 195800

SEQ ID NO: 269825 - RNA, 64 nt, Human; identical to SEQ ID NO: 195801

SEQ ID NO: 269826 - RNA, 64 nt, Human; identical to SEQ ID NO: 195802

SEQ ID NO: 269827 - RNA, 64 nt, Human; identical to SEQ ID NO: 195807

SEQ ID NO: 269828 - RNA, 64 nt, Human; identical to SEQ ID NO: 195808

SEQ ID NO: 269829 - RNA, 64 nt, Human; identical to SEQ ID NO: 195809

SEQ ID NO: 269830 - RNA, 64 nt, Human; identical to SEQ ID NO: 195810

SEQ ID NO: 269831 - RNA, 64 nt, Human; identical to SEQ ID NO: 195811

SEQ ID NO: 269832 - RNA, 64 nt, Human; identical to SEQ ID NO: 195812

SEQ ID NO: 269833 - RNA, 58 nt, Human; identical to SEQ ID NO: 195813

SEQ ID NO: 269834 - RNA, 64 nt, Human; identical to SEQ ID NO: 195814

SEQ ID NO: 269835 - RNA, 64 nt, Human; identical to SEQ ID NO: 195815

SEQ ID NO: 269836 - RNA, 64 nt, Human; identical to SEQ ID NO: 195816

SEQ ID NO: 269837 - RNA, 64 nt, Human; identical to SEQ ID NO: 195817

SEQ ID NO: 269838 - RNA, 64 nt, Human; identical to SEQ ID NO: 195818

SEQ ID NO: 269839 - RNA, 64 nt, Human; identical to SEQ ID NO: 195819

SEQ ID NO: 269840 - RNA, 64 nt, Human; identical to SEQ ID NO: 195820

SEQ ID NO: 269841 - RNA, 64 nt, Human; identical to SEQ ID NO: 195821

SEQ ID NO: 269842 - RNA, 64 nt, Human; identical to SEQ ID NO: 195822

SEQ ID NO: 269843 - RNA, 64 nt, Human; identical to SEQ ID NO: 195823

SEQ ID NO: 269844 - RNA, 64 nt, Human; identical to SEQ ID NO: 195824

SEQ ID NO: 269845 - RNA, 64 nt, Human; identical to SEQ ID NO: 195825

SEQ ID NO: 269846 - RNA, 64 nt, Human; identical to SEQ ID NO: 195826

SEQ ID NO: 269847 - RNA, 64 nt, Human; identical to SEQ ID NO: 195827

SEQ ID NO: 269848 - RNA, 64 nt, Human; identical to SEQ ID NO: 195828

SEQ ID NO: 269849 - RNA, 64 nt, Human; identical to SEQ ID NO: 195829

SEQ ID NO: 269850 - RNA, 64 nt, Human; identical to SEQ ID NO: 195830

SEQ ID NO: 269851 - RNA, 64 nt, Human; identical to SEQ ID NO: 195831

SEQ ID NO: 269852 - RNA, 64 nt, Human; identical to SEQ ID NO: 195832

SEQ ID NO: 269853 - RNA, 64 nt, Human; identical to SEQ ID NO: 195833

SEQ ID NO: 269854 - RNA, 64 nt, Human; identical to SEQ ID NO: 195834

SEQ ID NO: 269855 - RNA, 64 nt, Human; identical to SEQ ID NO: 195835

SEQ ID NO: 269856 - RNA, 64 nt, Human; identical to SEQ ID NO: 195836

SEQ ID NO: 269857 - RNA, 64 nt, Human; identical to SEQ ID NO: 195838

SEQ ID NO: 269858 - RNA, 64 nt, Human; identical to SEQ ID NO: 195839

SEQ ID NO: 269859 - RNA, 64 nt, Human; identical to SEQ ID NO: 143119

SEQ ID NO: 269860 - RNA, 64 nt, Human; identical to SEQ ID NO: 143129

SEQ ID NO: 269861 - RNA, 64 nt, Human; identical to SEQ ID NO: 143139

SEQ ID NO: 269862 - RNA, 64 nt, Human; identical to SEQ ID NO: 195840

SEQ ID NO: 269863 - RNA, 64 nt, Human; identical to SEQ ID NO: 195841

SEQ ID NO: 269864 - RNA, 64 nt, Human; identical to SEQ ID NO: 195842

SEQ ID NO: 269865 - RNA, 64 nt, Human; identical to SEQ ID NO: 195843

SEQ ID NO: 269866 - RNA, 64 nt, Human; identical to SEQ ID NO: 195844

SEQ ID NO: 269867 - RNA, 50 nt, Human; identical to SEQ ID NO: 195845

SEQ ID NO: 269868 - RNA, 64 nt, Human; identical to SEQ ID NO: 195846

SEQ ID NO: 269869 - RNA, 64 nt, Human; identical to SEQ ID NO: 195847

SEQ ID NO: 269870 - RNA, 64 nt, Human; identical to SEQ ID NO: 195848

SEQ ID NO: 269871 - RNA, 64 nt, Human; identical to SEQ ID NO: 195849

SEQ ID NO: 269872 - RNA, 64 nt, Human; identical to SEQ ID NO: 195850

SEQ ID NO: 269873 - RNA, 64 nt, Human; identical to SEQ ID NO: 195851

SEQ ID NO: 269874 - RNA, 64 nt, Human; identical to SEQ ID NO: 195852

SEQ ID NO: 269875 - RNA, 64 nt, Human; identical to SEQ ID NO: 195857

SEQ ID NO: 269876 - RNA, 64 nt, Human; identical to SEQ ID NO: 195858

SEQ ID NO: 269877 - RNA, 64 nt, Human; identical to SEQ ID NO: 143148

SEQ ID NO: 269878 - RNA, 64 nt, Human; identical to SEQ ID NO: 143157

SEQ ID NO: 269879 - RNA, 64 nt, Human; identical to SEQ ID NO: 143167

SEQ ID NO: 269880 - RNA, 64 nt, Human; identical to SEQ ID NO: 195859

SEQ ID NO: 269881 - RNA, 64 nt, Human; identical to SEQ ID NO: 195860

SEQ ID NO: 269882 - RNA, 61 nt, Human; identical to SEQ ID NO: 195861

SEQ ID NO: 269883 - RNA, 64 nt, Human; identical to SEQ ID NO: 195862

SEQ ID NO: 269884 - RNA, 64 nt, Human; identical to SEQ ID NO: 195863

SEQ ID NO: 269885 - RNA, 64 nt, Human; identical to SEQ ID NO: 195864

SEQ ID NO: 269886 - RNA, 64 nt, Human; identical to SEQ ID NO: 195865

SEQ ID NO: 269887 - RNA, 64 nt, Human; identical to SEQ ID NO: 195866

SEQ ID NO: 269888 - RNA, 64 nt, Human; identical to SEQ ID NO: 195867

SEQ ID NO: 269889 - RNA, 64 nt, Human; identical to SEQ ID NO: 195868

SEQ ID NO: 269890 - RNA, 64 nt, Human; identical to SEQ ID NO: 195869

SEQ ID NO: 269891 - RNA, 64 nt, Human; identical to SEQ ID NO: 195870

SEQ ID NO: 269892 - RNA, 64 nt, Human; identical to SEQ ID NO: 195871

SEQ ID NO: 269893 - RNA, 64 nt, Human; identical to SEQ ID NO: 195876

SEQ ID NO: 269894 - RNA, 64 nt, Human; identical to SEQ ID NO: 195877

SEQ ID NO: 269895 - RNA, 63 nt, Human
ggaagagaccauaaaggcuucaaaacuagaagugcgcaugaaggaugcuucaugcccuguucc

SEQ ID NO: 269896 - RNA, 64 nt, Human; identical to SEQ ID NO: 195878

SEQ ID NO: 269897 - RNA, 64 nt, Human; identical to SEQ ID NO: 195879

SEQ ID NO: 269898 - RNA, 64 nt, Human; identical to SEQ ID NO: 195880

SEQ ID NO: 269899 - RNA, 64 nt, Human; identical to SEQ ID NO: 195881

SEQ ID NO: 269900 - RNA, 64 nt, Human; identical to SEQ ID NO: 195882

SEQ ID NO: 269901 - RNA, 64 nt, Human; identical to SEQ ID NO: 195883

SEQ ID NO: 269902 - RNA, 64 nt, Human; identical to SEQ ID NO: 195884

SEQ ID NO: 269903 - RNA, 64 nt, Human; identical to SEQ ID NO: 195885

SEQ ID NO: 269904 - RNA, 64 nt, Human; identical to SEQ ID NO: 195886

SEQ ID NO: 269905 - RNA, 64 nt, Human; identical to SEQ ID NO: 195887

SEQ ID NO: 269906 - RNA, 64 nt, Human; identical to SEQ ID NO: 195888

SEQ ID NO: 269907 - RNA, 64 nt, Human; identical to SEQ ID NO: 195889

SEQ ID NO: 269908 - RNA, 64 nt, Human; identical to SEQ ID NO: 195890

SEQ ID NO: 269909 - RNA, 64 nt, Human; identical to SEQ ID NO: 195895

SEQ ID NO: 269910 - RNA, 64 nt, Human; identical to SEQ ID NO: 195896

SEQ ID NO: 269911 - RNA, 63 nt, Human
ugggcacgccagucugcaccaugugucccugcggcgcaugagugacuggcguauuuagcccgu

SEQ ID NO: 269912 - RNA, 63 nt, Human
guguuuggugaugguuauugacgacaauguguagcgcaugauuguuuuuauaccaagaacauu

SEQ ID NO: 269913 - RNA, 64 nt, Human; identical to SEQ ID NO: 195897

SEQ ID NO: 269914 - RNA, 64 nt, Human; identical to SEQ ID NO: 195898

SEQ ID NO: 269915 - RNA, 64 nt, Human; identical to SEQ ID NO: 195899

SEQ ID NO: 269916 - RNA, 64 nt, Human; identical to SEQ ID NO: 195900

SEQ ID NO: 269917 - RNA, 64 nt, Human; identical to SEQ ID NO: 195901

SEQ ID NO: 269918 - RNA, 64 nt, Human; identical to SEQ ID NO: 195902

SEQ ID NO: 269919 - RNA, 64 nt, Human; identical to SEQ ID NO: 195903

SEQ ID NO: 269920 - RNA, 64 nt, Human; identical to SEQ ID NO: 195904

SEQ ID NO: 269921 - RNA, 64 nt, Human; identical to SEQ ID NO: 195905

SEQ ID NO: 269922 - RNA, 64 nt, Human; identical to SEQ ID NO: 195906

SEQ ID NO: 269923 - RNA, 64 nt, Human; identical to SEQ ID NO: 195907

SEQ ID NO: 269924 - RNA, 53 nt, Human; identical to SEQ ID NO: 195908

SEQ ID NO: 269925 - RNA, 64 nt, Human; identical to SEQ ID NO: 195909

SEQ ID NO: 269926 - RNA, 64 nt, Human; identical to SEQ ID NO: 195914

SEQ ID NO: 269927 - RNA, 64 nt, Human; identical to SEQ ID NO: 195915

SEQ ID NO: 269928 - RNA, 63 nt, Human
cuugagcagguggagccauggugcucugugguggcgcaugauucacugagcaaacagcacuuu

SEQ ID NO: 269929 - RNA, 63 nt, Human
ccuggucuuguuaccugugugugugcuggugcugcgcaugaggacugucugccuuugagggcu

SEQ ID NO: 269930 - RNA, 63 nt, Human
uaacucagaggaacagacacucaaacucccaaagcgcaugauugcugggaaacaguagaaacc

SEQ ID NO: 269931 - RNA, 64 nt, Human; identical to SEQ ID NO: 195916

SEQ ID NO: 269932 - RNA, 51 nt, Human; identical to SEQ ID NO: 195917

SEQ ID NO: 269933 - RNA, 64 nt, Human; identical to SEQ ID NO: 195918

SEQ ID NO: 269934 - RNA, 64 nt, Human; identical to SEQ ID NO: 195919

SEQ ID NO: 269935 - RNA, 64 nt, Human; identical to SEQ ID NO: 195920

SEQ ID NO: 269936 - RNA, 64 nt, Human; identical to SEQ ID NO: 195921

SEQ ID NO: 269937 - RNA, 64 nt, Human; identical to SEQ ID NO: 195922

SEQ ID NO: 269938 - RNA, 64 nt, Human; identical to SEQ ID NO: 195923

SEQ ID NO: 269939 - RNA, 64 nt, Human; identical to SEQ ID NO: 195924

SEQ ID NO: 269940 - RNA, 64 nt, Human; identical to SEQ ID NO: 195925

SEQ ID NO: 269941 - RNA, 64 nt, Human; identical to SEQ ID NO: 195926

SEQ ID NO: 269942 - RNA, 64 nt, Human; identical to SEQ ID NO: 195927

SEQ ID NO: 269943 - RNA, 64 nt, Human; identical to SEQ ID NO: 195928

SEQ ID NO: 269944 - RNA, 64 nt, Human; identical to SEQ ID NO: 195933

SEQ ID NO: 269945 - RNA, 64 nt, Human; identical to SEQ ID NO: 195934

SEQ ID NO: 269946 - RNA, 63 nt, Human
ggucagucaggguucgggggcugcagcagccaagcgcaugagagguguuuccuuggccuucca

SEQ ID NO: 269947 - RNA, 63 nt, Human
ugugugcucacaaccacucucaccuguucgugagcgcaugaggcgaaguuaucuuauauuucc

SEQ ID NO: 269948 - RNA, 64 nt, Human; identical to SEQ ID NO: 195935

SEQ ID NO: 269949 - RNA, 64 nt, Human; identical to SEQ ID NO: 195936

SEQ ID NO: 269950 - RNA, 64 nt, Human; identical to SEQ ID NO: 195937

SEQ ID NO: 269951 - RNA, 64 nt, Human; identical to SEQ ID NO: 195938

SEQ ID NO: 269952 - RNA, 64 nt, Human; identical to SEQ ID NO: 195939

SEQ ID NO: 269953 - RNA, 61 nt, Human; identical to SEQ ID NO: 195940

SEQ ID NO: 269954 - RNA, 64 nt, Human; identical to SEQ ID NO: 195941

SEQ ID NO: 269955 - RNA, 64 nt, Human; identical to SEQ ID NO: 195942

SEQ ID NO: 269956 - RNA, 64 nt, Human; identical to SEQ ID NO: 195943

SEQ ID NO: 269957 - RNA, 64 nt, Human; identical to SEQ ID NO: 195944

SEQ ID NO: 269958 - RNA, 64 nt, Human; identical to SEQ ID NO: 195945

SEQ ID NO: 269959 - RNA, 64 nt, Human; identical to SEQ ID NO: 195946

SEQ ID NO: 269960 - RNA, 64 nt, Human; identical to SEQ ID NO: 195947

SEQ ID NO: 269961 - RNA, 64 nt, Human; identical to SEQ ID NO: 195952

SEQ ID NO: 269962 - RNA, 64 nt, Human; identical to SEQ ID NO: 195953

SEQ ID NO: 269963 - RNA, 64 nt, Human
ccauccccccaagcccuagagcucccuccacucuucccgcgaacaucacaccguuccccgacca

SEQ ID NO: 269964 - RNA, 64 nt, Human
auagguacgagcgcugcggccuccccgugcgcccucccgcgaccgggggcccgguuuguaugua

SEQ ID NO: 269965 - RNA, 64 nt, Human
ggcugagcuucuaccuacgagugaaacucuguccucccgcgaggaccaggcaucgcugugugag

SEQ ID NO: 269966 - RNA, 64 nt, Human; identical to SEQ ID NO: 195954

SEQ ID NO: 269967 - RNA, 64 nt, Human; identical to SEQ ID NO: 195955

SEQ ID NO: 269968 - RNA, 64 nt, Human; identical to SEQ ID NO: 195956

SEQ ID NO: 269969 - RNA, 64 nt, Human; identical to SEQ ID NO: 195957

SEQ ID NO: 269970 - RNA, 64 nt, Human; identical to SEQ ID NO: 195958

SEQ ID NO: 269971 - RNA, 64 nt, Human; identical to SEQ ID NO: 195959

SEQ ID NO: 269972 - RNA, 64 nt, Human; identical to SEQ ID NO: 195960

SEQ ID NO: 269973 - RNA, 64 nt, Human; identical to SEQ ID NO: 195961

SEQ ID NO: 269974 - RNA, 64 nt, Human; identical to SEQ ID NO: 195962

SEQ ID NO: 269975 - RNA, 64 nt, Human; identical to SEQ ID NO: 195963

SEQ ID NO: 269976 - RNA, 64 nt, Human; identical to SEQ ID NO: 195964

SEQ ID NO: 269977 - RNA, 64 nt, Human; identical to SEQ ID NO: 195965

SEQ ID NO: 269978 - RNA, 64 nt, Human; identical to SEQ ID NO: 195966

SEQ ID NO: 269979 - RNA, 64 nt, Human; identical to SEQ ID NO: 195971

SEQ ID NO: 269980 - RNA, 52 nt, Human; identical to SEQ ID NO: 195972

SEQ ID NO: 269981 - RNA, 61 nt, Human
ugugguugaagagcaaaaugcuaauugacaucucuaguaaauacuguuacaggauucauga

SEQ ID NO: 269982 - RNA, 61 nt, Human
aggaacgaugacaggucgcaugaagaucagccucuaguacugaugaucuuuacuuaugcau

SEQ ID NO: 269983 - RNA, 61 nt, Human
uaaaagcauuuuuaaaaaaacuucuacaaaacucuaguaugggcuucugacuuuuuccagg

SEQ ID NO: 269984 - RNA, 64 nt, Human; identical to SEQ ID NO: 195973

SEQ ID NO: 269985 - RNA, 64 nt, Human; identical to SEQ ID NO: 195974

SEQ ID NO: 269986 - RNA, 64 nt, Human; identical to SEQ ID NO: 195975

SEQ ID NO: 269987 - RNA, 64 nt, Human; identical to SEQ ID NO: 195976

SEQ ID NO: 269988 - RNA, 64 nt, Human; identical to SEQ ID NO: 195977

SEQ ID NO: 269989 - RNA, 64 nt, Human; identical to SEQ ID NO: 195978

SEQ ID NO: 269990 - RNA, 55 nt, Human; identical to SEQ ID NO: 195979

SEQ ID NO: 269991 - RNA, 64 nt, Human; identical to SEQ ID NO: 195980

SEQ ID NO: 269992 - RNA, 64 nt, Human; identical to SEQ ID NO: 195981

SEQ ID NO: 269993 - RNA, 64 nt, Human; identical to SEQ ID NO: 195982

SEQ ID NO: 269994 - RNA, 64 nt, Human; identical to SEQ ID NO: 195983

SEQ ID NO: 269995 - RNA, 64 nt, Human; identical to SEQ ID NO: 195984

SEQ ID NO: 269996 - RNA, 64 nt, Human; identical to SEQ ID NO: 195985

SEQ ID NO: 269997 - RNA, 64 nt, Human; identical to SEQ ID NO: 195989

SEQ ID NO: 269998 - RNA, 64 nt, Human; identical to SEQ ID NO: 195990

SEQ ID NO: 269999 - RNA, 61 nt, Human
ucccugggucuggcuuccucccgcaaccucacucuaguagagccugugccugccuacuagc

SEQ ID NO: 270000 - RNA, 61 nt, Human
guugaguuugcgaaaucuuuuugucuuugaacucuaguacuguuuauaguucaugacuaug

SEQ ID NO: 270001 - RNA, 61 nt, Human
ccaggugacuucaaaacauaggacaguacaucucuaguagaauaugcccugagaaugaaaa

SEQ ID NO: 270002 - RNA, 64 nt, Human; identical to SEQ ID NO: 195991

SEQ ID NO: 270003 - RNA, 64 nt, Human; identical to SEQ ID NO: 19544

SEQ ID NO: 270004 - RNA, 64 nt, Human; identical to SEQ ID NO: 19545

SEQ ID NO: 270005 - RNA, 64 nt, Human; identical to SEQ ID NO: 19546

SEQ ID NO: 270006 - RNA, 57 nt, Human; identical to SEQ ID NO: 19547

SEQ ID NO: 270007 - RNA, 64 nt, Human; identical to SEQ ID NO: 19548

SEQ ID NO: 270008 - RNA, 64 nt, Human; identical to SEQ ID NO: 19549

SEQ ID NO: 270009 - RNA, 64 nt, Human; identical to SEQ ID NO: 19550

SEQ ID NO: 270010 - RNA, 64 nt, Human; identical to SEQ ID NO: 19551

SEQ ID NO: 270011 - RNA, 64 nt, Human; identical to SEQ ID NO: 19552

SEQ ID NO: 270012 - RNA, 64 nt, Human; identical to SEQ ID NO: 19553

SEQ ID NO: 270013 - RNA, 61 nt, Human
uuuuuguuucaauucuaagaaacacuugcagcucuaguauucacuugagucuuccuguuuu

SEQ ID NO: 270014 - RNA, 61 nt, Human
accacgucuauuucaucagaacagcuguugacucuaguacugugaauccagugaaaauaag

SEQ ID NO: 270015 - RNA, 61 nt, Human
auaaagcuacuacauauauaugccaguauuucucuaguaagauuauguuucucuuacuaga

SEQ ID NO: 270016 - RNA, 64 nt, Human; identical to SEQ ID NO: 19554

SEQ ID NO: 270017 - RNA, 64 nt, Human; identical to SEQ ID NO: 19555

SEQ ID NO: 270018 - RNA, 64 nt, Human; identical to SEQ ID NO: 19556

SEQ ID NO: 270019 - RNA, 64 nt, Human; identical to SEQ ID NO: 19557

SEQ ID NO: 270020 - RNA, 64 nt, Human; identical to SEQ ID NO: 19558

SEQ ID NO: 270021 - RNA, 58 nt, Human; identical to SEQ ID NO: 19559

SEQ ID NO: 270022 - RNA, 64 nt, Human; identical to SEQ ID NO: 19560

SEQ ID NO: 270023 - RNA, 64 nt, Human; identical to SEQ ID NO: 19561

SEQ ID NO: 270024 - RNA, 64 nt, Human; identical to SEQ ID NO: 19562

SEQ ID NO: 270025 - RNA, 64 nt, Human; identical to SEQ ID NO: 19563

SEQ ID NO: 270026 - RNA, 64 nt, Human; identical to SEQ ID NO: 19564

SEQ ID NO: 270027 - RNA, 64 nt, Human; identical to SEQ ID NO: 19565

SEQ ID NO: 270028 - RNA, 61 nt, Human
ugccguaauaguauauugccuguauuucuaccucuaguaaugggcuuuaugugcuagauuu

SEQ ID NO: 270029 - RNA, 61 nt, Human
aagaaauaaaugaaacuuggccaguuuguuccucuaguaguauauuuaauuuugacauaag

SEQ ID NO: 270030 - RNA, 64 nt, Human
accccucuuugaaaaaagacacagagaauaaacuccuacgaaagcccuacauugagcuccaauc

SEQ ID NO: 270031 - RNA, 64 nt, Human
augaguggggaaaagauuauacucuuaagaaauuccuacgaaagcuauccaaaagccuuuucuu

SEQ ID NO: 270032 - RNA, 64 nt, Human
cauugacauuuaagacaccaaaaaauaaaagacuccuacgaagaacuguuuuuguuuuccucuu

SEQ ID NO: 270033 - RNA, 64 nt, Human
ggauccugacucaaauuaagaaaaaauaaaacuaccuacgaaauacuaagaaaaauuuguauac

SEQ ID NO: 270034 - RNA, 64 nt, Human
caggaguucagggucauagcaugcugugauugugccuacgaauagccacugcauaccaaccugg

SEQ ID NO: 270035 - RNA, 64 nt, Human
uuuccagagcuggaggucacguuucuaaaacucaccuacgaaagauagcauuaaaggaacaggg

SEQ ID NO: 270036 - RNA, 64 nt, Human
gcugaauauaaugugacacuauggucgaauacuaccuacgaauuauaacauuagaagccuagug

SEQ ID NO: 270037 - RNA, 64 nt, Human
uuaugaaauauuucuuuuaaaagccccagucucaccuacgaaauaugaagagcaaaagcugauu

SEQ ID NO: 270038 - RNA, 64 nt, Human
cuagaaaaaugacaaauaguaaaaugaacaaaacccuacgaaagaauggcaacagccagggugg

SEQ ID NO: 270039 - RNA, 64 nt, Human
gagacaugcacaaacuauucuagagaggcuugugccuacgaagauuacuuaagaauguguugac

SEQ ID NO: 270040 - RNA, 64 nt, Human
aaugggaagcuugugaguggcccaucuuuguuggccuacgaacuuugguuugaugccagucagg

SEQ ID NO: 270041 - RNA, 64 nt, Human
ugugccugaauuauuagaccuuuuuauuagucaaccuacgaagacuaaaauagaauauauuagu

SEQ ID NO: 270042 - RNA, 64 nt, Human
ugauaggcagcuuuccuucuuuucaacagugauaccuacgaaaaucaaaauaaaugcaagcuga

SEQ ID NO: 270043 - RNA, 64 nt, Human
auuuaaagaucuuuuagaagugagagaaaaagguccuacgaaaacggaauaauaaaaagcauuu

SEQ ID NO: 270044 - RNA, 64 nt, Human
cucagguucacagugcaccaugucacugugcuauccuacgaaaucauuuguuucuaaguugugu

SEQ ID NO: 270045 - RNA, 64 nt, Human; identical to SEQ ID NO: 143143

SEQ ID NO: 270046 - RNA, 64 nt, Human; identical to SEQ ID NO: 143152

SEQ ID NO: 270047 - RNA, 63 nt, Human
gauaauaugguguuaugggaaaacacauuuugugcgcaugaugaagagagcaccgugaaucua

SEQ ID NO: 270048 - RNA, 64 nt, Human
cagcaucuugagagcacaagggaaaaaauaagaaccuacgaauauuuuugaggcagauaaugau

SEQ ID NO: 270049 - RNA, 64 nt, Human
cugcuggagaaggcuuaugcuaagcuccaugguuccuacgaagcucugaaaggugggaacacca

SEQ ID NO: 270050 - RNA, 64 nt, Human
uguguacaaauugcuucucaccauccccauuagaccuacgaauaaagcauccgguucuaaaauu

SEQ ID NO: 270051 - RNA, 54 nt, Human
uggccguggagagucaguaacucuccuacgaaccuccuaccuguuggccagccu

SEQ ID NO: 270052 - RNA, 64 nt, Human
ugucauguggccuaaaagccuccaugucauuugaccuacgaauucuaucuuugggaauuuaucc

SEQ ID NO: 270053 - RNA, 64 nt, Human
aauaugcauuugagaaaucacauuagauugaaacccuacgaaugcaguauaugugggaaagccu

SEQ ID NO: 270054 - RNA, 64 nt, Human
auugaacaucagaggacauauccuggagaaaagcccuacgaaugcauugauugugggaaagccu

SEQ ID NO: 270055 - RNA, 64 nt, Human
cacaguuguucaaagcugagugagggaaacaggaccuacgaaaacgugucagcguuuucuuuuu

SEQ ID NO: 270056 - RNA, 64 nt, Human
agugccuccuccacuuacgaagaacuggccagggccuacgaacacgccaagauggaagagcaac

SEQ ID NO: 270057 - RNA, 64 nt, Human; identical to SEQ ID NO: 246646

SEQ ID NO: 270058 - RNA, 64 nt, Human; identical to SEQ ID NO: 246647

SEQ ID NO: 270059 - RNA, 64 nt, Human; identical to SEQ ID NO: 246648

SEQ ID NO: 270060 - RNA, 64 nt, Human; identical to SEQ ID NO: 246649

SEQ ID NO: 270061 - RNA, 64 nt, Human; identical to SEQ ID NO: 246653

SEQ ID NO: 270062 - RNA, 64 nt, Human; identical to SEQ ID NO: 246654

SEQ ID NO: 270063 - RNA, 64 nt, Human; identical to SEQ ID NO: 246655

SEQ ID NO: 270064 - RNA, 61 nt, Human
aagcugacaagaguucuagaggauucugcuucucuaguaacuagacaggugauacgcauuu

SEQ ID NO: 270065 - RNA, 59 nt, Human
aaacucuauacuucuaaggugccaccaccuucucuaguaacuuacuguguagucuuggg

SEQ ID NO: 270066 - RNA, 61 nt, Human
aucacaucaggguaaaugagguauccaucaccucuaguauuuauccuuuguauuacaagca

SEQ ID NO: 270067 - RNA, 64 nt, Human; identical to SEQ ID NO: 246656

SEQ ID NO: 270068 - RNA, 64 nt, Human; identical to SEQ ID NO: 246657

SEQ ID NO: 270069 - RNA, 64 nt, Human; identical to SEQ ID NO: 246658

SEQ ID NO: 270070 - RNA, 64 nt, Human; identical to SEQ ID NO: 246659

SEQ ID NO: 270071 - RNA, 64 nt, Human; identical to SEQ ID NO: 246660

SEQ ID NO: 270072 - RNA, 64 nt, Human; identical to SEQ ID NO: 246661

SEQ ID NO: 270073 - RNA, 64 nt, Human; identical to SEQ ID NO: 246662

SEQ ID NO: 270074 - RNA, 64 nt, Human; identical to SEQ ID NO: 246663

SEQ ID NO: 270075 - RNA, 64 nt, Human; identical to SEQ ID NO: 246664

SEQ ID NO: 270076 - RNA, 64 nt, Human; identical to SEQ ID NO: 246665

SEQ ID NO: 270077 - RNA, 64 nt, Human; identical to SEQ ID NO: 246666

SEQ ID NO: 270078 - RNA, 64 nt, Human; identical to SEQ ID NO: 246667

SEQ ID NO: 270079 - RNA, 64 nt, Human; identical to SEQ ID NO: 246668

SEQ ID NO: 270080 - RNA, 64 nt, Human; identical to SEQ ID NO: 246673

SEQ ID NO: 270081 - RNA, 64 nt, Human; identical to SEQ ID NO: 246674

SEQ ID NO: 270082 - RNA, 64 nt, Human; identical to SEQ ID NO: 246675

SEQ ID NO: 270083 - RNA, 64 nt, Human; identical to SEQ ID NO: 143162

SEQ ID NO: 270084 - RNA, 63 nt, Human
uaagugcaguggggguaagcaguccugugaguggcgcaugaacgcuggagcuuauuccgccgc

SEQ ID NO: 270085 - RNA, 61 nt, Human
aaggaauuauauuuugagauaagaaguuaagcucuaguauaacaaugauaugggucaaaga

SEQ ID NO: 270086 - RNA, 64 nt, Human
agcaggcaggaaaauggaaaaacugagauaauacacaggugauaaacaguuucgagaaaauaaa

SEQ ID NO: 270087 - RNA, 64 nt, Human; identical to SEQ ID NO: 246676

SEQ ID NO: 270088 - RNA, 64 nt, Human; identical to SEQ ID NO: 246675

SEQ ID NO: 270089 - RNA, 64 nt, Human; identical to SEQ ID NO: 246678

SEQ ID NO: 270090 - RNA, 64 nt, Human; identical to SEQ ID NO: 246679

SEQ ID NO: 270091 - RNA, 64 nt, Human; identical to SEQ ID NO: 246680

SEQ ID NO: 270092 - RNA, 64 nt, Human; identical to SEQ ID NO: 246681

SEQ ID NO: 270093 - RNA, 64 nt, Human; identical to SEQ ID NO: 246682

SEQ ID NO: 270094 - RNA, 64 nt, Human; identical to SEQ ID NO: 246683

SEQ ID NO: 270095 - RNA, 64 nt, Human; identical to SEQ ID NO: 246684

SEQ ID NO: 270096 - RNA, 64 nt, Human; identical to SEQ ID NO: 246685

SEQ ID NO: 270097 - RNA, 64 nt, Human; identical to SEQ ID NO: 246686

SEQ ID NO: 270098 - RNA, 64 nt, Human; identical to SEQ ID NO: 246687

SEQ ID NO: 270099 - RNA, 64 nt, Human; identical to SEQ ID NO: 246688

SEQ ID NO: 270100 - RNA, 64 nt, Human; identical to SEQ ID NO: 246693

SEQ ID NO: 270101 - RNA, 64 nt, Human; identical to SEQ ID NO: 246694

SEQ ID NO: 270102 - RNA, 64 nt, Human; identical to SEQ ID NO: 246695

SEQ ID NO: 270103 - RNA, 63 nt, Human
uuuaauucauguugccuugcauaauggucagaggcgcaugaauuugugaagguggaaauaaac

SEQ ID NO: 270104 - RNA, 64 nt, Human
gccagggggaaaaauuauccccggacaacaugaaacaggugaggucaggucacugcggacauca

SEQ ID NO: 270105 - RNA, 64 nt, Human
aucucucccaaggcuaccuacugcaggagggccaacaggugagaugggaagaauggaaacaggg

SEQ ID NO: 270106 - RNA, 64 nt, Human
cucccauuuuacagaugagaauacugaggccuggacaggugaagugaccagagagcaaaaggca

SEQ ID NO: 270107 - RNA, 64 nt, Human; identical to SEQ ID NO: 246696

SEQ ID NO: 270108 - RNA, 64 nt, Human; identical to SEQ ID NO: 246697

SEQ ID NO: 270109 - RNA, 53 nt, Human; identical to SEQ ID NO: 246698

SEQ ID NO: 270110 - RNA, 64 nt, Human; identical to SEQ ID NO: 246699

SEQ ID NO: 270111 - RNA, 64 nt, Human; identical to SEQ ID NO: 246700

SEQ ID NO: 270112 - RNA, 64 nt, Human; identical to SEQ ID NO: 246701

SEQ ID NO: 270113 - RNA, 64 nt, Human; identical to SEQ ID NO: 246702

SEQ ID NO: 270114 - RNA, 64 nt, Human; identical to SEQ ID NO: 246703

SEQ ID NO: 270115 - RNA, 64 nt, Human; identical to SEQ ID NO: 246704

SEQ ID NO: 270116 - RNA, 64 nt, Human; identical to SEQ ID NO: 246705

SEQ ID NO: 270117 - RNA, 64 nt, Human; identical to SEQ ID NO: 246706

SEQ ID NO: 270118 - RNA, 64 nt, Human; identical to SEQ ID NO: 246707

SEQ ID NO: 270119 - RNA, 64 nt, Human; identical to SEQ ID NO: 246708

SEQ ID NO: 270120 - RNA, 64 nt, Human; identical to SEQ ID NO: 246713

SEQ ID NO: 270121 - RNA, 64 nt, Human; identical to SEQ ID NO: 246714

SEQ ID NO: 270122 - RNA, 64 nt, Human; identical to SEQ ID NO: 246715

SEQ ID NO: 270123 - RNA, 64 nt, Human; identical to SEQ ID NO: 143120

SEQ ID NO: 270124 - RNA, 64 nt, Human; identical to SEQ ID NO: 143121

SEQ ID NO: 270125 - RNA, 64 nt, Human; identical to SEQ ID NO: 143122

SEQ ID NO: 270126 - RNA, 64 nt, Human; identical to SEQ ID NO: 143123

SEQ ID NO: 270127 - RNA, 64 nt, Human; identical to SEQ ID NO: 246716

SEQ ID NO: 270128 - RNA, 64 nt, Human; identical to SEQ ID NO: 246717

SEQ ID NO: 270129 - RNA, 64 nt, Human; identical to SEQ ID NO: 246718

SEQ ID NO: 270130 - RNA, 64 nt, Human; identical to SEQ ID NO: 246719

SEQ ID NO: 270131 - RNA, 64 nt, Human; identical to SEQ ID NO: 246720

SEQ ID NO: 270132 - RNA, 64 nt, Human; identical to SEQ ID NO: 246721

SEQ ID NO: 270133 - RNA, 64 nt, Human; identical to SEQ ID NO: 246722

SEQ ID NO: 270134 - RNA, 64 nt, Human; identical to SEQ ID NO: 246723

SEQ ID NO: 270135 - RNA, 64 nt, Human; identical to SEQ ID NO: 246724

SEQ ID NO: 270136 - RNA, 64 nt, Human; identical to SEQ ID NO: 246725

SEQ ID NO: 270137 - RNA, 64 nt, Human; identical to SEQ ID NO: 246726

SEQ ID NO: 270138 - RNA, 64 nt, Human; identical to SEQ ID NO: 246727

SEQ ID NO: 270139 - RNA, 64 nt, Human; identical to SEQ ID NO: 246728

SEQ ID NO: 270140 - RNA, 64 nt, Human; identical to SEQ ID NO: 246733

SEQ ID NO: 270141 - RNA, 64 nt, Human; identical to SEQ ID NO: 246734

SEQ ID NO: 270142 - RNA, 64 nt, Human; identical to SEQ ID NO: 246735

SEQ ID NO: 270143 - RNA, 64 nt, Human; identical to SEQ ID NO: 143130

SEQ ID NO: 270144 - RNA, 64 nt, Human; identical to SEQ ID NO: 143131

SEQ ID NO: 270145 - RNA, 64 nt, Human; identical to SEQ ID NO: 143132

SEQ ID NO: 270146 - RNA, 64 nt, Human; identical to SEQ ID NO: 143133

SEQ ID NO: 270147 - RNA, 64 nt, Human; identical to SEQ ID NO: 246736

SEQ ID NO: 270148 - RNA, 64 nt, Human; identical to SEQ ID NO: 246737

SEQ ID NO: 270149 - RNA, 64 nt, Human; identical to SEQ ID NO: 246738

SEQ ID NO: 270150 - RNA, 64 nt, Human; identical to SEQ ID NO: 246739

SEQ ID NO: 270151 - RNA, 64 nt, Human; identical to SEQ ID NO: 246740

SEQ ID NO: 270152 - RNA, 64 nt, Human; identical to SEQ ID NO: 246741

SEQ ID NO: 270153 - RNA, 64 nt, Human; identical to SEQ ID NO: 246742

SEQ ID NO: 270154 - RNA, 64 nt, Human; identical to SEQ ID NO: 246743

SEQ ID NO: 270155 - RNA, 64 nt, Human; identical to SEQ ID NO: 246744

SEQ ID NO: 270156 - RNA, 64 nt, Human; identical to SEQ ID NO: 246745

SEQ ID NO: 270157 - RNA, 64 nt, Human; identical to SEQ ID NO: 246746

SEQ ID NO: 270158 - RNA, 64 nt, Human; identical to SEQ ID NO: 246747

SEQ ID NO: 270159 - RNA, 64 nt, Human; identical to SEQ ID NO: 246748

SEQ ID NO: 270160 - RNA, 64 nt, Human; identical to SEQ ID NO: 246753

SEQ ID NO: 270161 - RNA, 64 nt, Human; identical to SEQ ID NO: 246754

SEQ ID NO: 270162 - RNA, 64 nt, Human; identical to SEQ ID NO: 246755

SEQ ID NO: 270163 - RNA, 64 nt, Human; identical to SEQ ID NO: 143134

SEQ ID NO: 270164 - RNA, 64 nt, Human; identical to SEQ ID NO: 143140

SEQ ID NO: 270165 - RNA, 64 nt, Human; identical to SEQ ID NO: 143141

SEQ ID NO: 270166 - RNA, 64 nt, Human; identical to SEQ ID NO: 143142

SEQ ID NO: 270167 - RNA, 64 nt, Human; identical to SEQ ID NO: 246756

SEQ ID NO: 270168 - RNA, 64 nt, Human; identical to SEQ ID NO: 246757

SEQ ID NO: 270169 - RNA, 64 nt, Human; identical to SEQ ID NO: 246758

SEQ ID NO: 270170 - RNA, 64 nt, Human; identical to SEQ ID NO: 246759

SEQ ID NO: 270171 - RNA, 64 nt, Human; identical to SEQ ID NO: 246760

SEQ ID NO: 270172 - RNA, 64 nt, Human; identical to SEQ ID NO: 246761

SEQ ID NO: 270173 - RNA, 64 nt, Human; identical to SEQ ID NO: 246762

SEQ ID NO: 270174 - RNA, 64 nt, Human; identical to SEQ ID NO: 246763

SEQ ID NO: 270175 - RNA, 64 nt, Human; identical to SEQ ID NO: 246764

SEQ ID NO: 270176 - RNA, 64 nt, Human; identical to SEQ ID NO: 246765

SEQ ID NO: 270177 - RNA, 64 nt, Human; identical to SEQ ID NO: 246766

SEQ ID NO: 270178 - RNA, 64 nt, Human; identical to SEQ ID NO: 246767

SEQ ID NO: 270179 - RNA, 64 nt, Human; identical to SEQ ID NO: 246768

SEQ ID NO: 270180 - RNA, 64 nt, Human; identical to SEQ ID NO: 246773

SEQ ID NO: 270181 - RNA, 64 nt, Human; identical to SEQ ID NO: 246774

SEQ ID NO: 270182 - RNA, 64 nt, Human
gcuuuguaacaauugcauacccauauuuuaagggacaggugaauuuacuacuuucuaaaguuua

SEQ ID NO: 270183 - RNA, 64 nt, Human
acauuuucauugacuuaaaugcuuuagagguugaacaggugauuccauuaccuagucaugaaga

SEQ ID NO: 270184 - RNA, 64 nt, Human
augcaagcugggcugggucuagucccucccccccacaggugacaugaguacagacccuccucaa

SEQ ID NO: 270185 - RNA, 64 nt, Human
cccuggugacccggcgggaccugcgggcgcgcggcccgacgaccagagggcgagccugcuccuc

SEQ ID NO: 270186 - RNA, 64 nt, Human
cucagacuuuuugaaagucuaccuucuaaauugccccgacgaucuagauucuacauguuaccau

SEQ ID NO: 270187 - RNA, 64 nt, Human
gcggcaacauugaagacguggacggaggaggggccccgacgacagguggcaacaaugccccgag

SEQ ID NO: 270188 - RNA, 64 nt, Human
ccugagaagguagccaacaucaucuguacccaaccccgacgaaucucugcaaucucuguugcug

SEQ ID NO: 270189 - RNA, 64 nt, Human
cuccagaaguggcuggauguacccugccugaggccccgacgaggagggguaugcaggcuggcag

SEQ ID NO: 270190 - RNA, 64 nt, Human
ucucuucaugcuugacauaccuaccaguauuauucccgacgacacauauacauaugagaauaua

SEQ ID NO: 270191 - RNA, 64 nt, Human
ggagcugcggcggcugcacccaggccacgugcugcccgacgaggagcugcaguggguguucgug

SEQ ID NO: 270192 - RNA, 64 nt, Human
agaaaagcagagaaccccaaagugggcaggcaaccccgacgagagcuuaucccuguggcggcau

SEQ ID NO: 270193 - RNA, 64 nt, Human
ccucuucccucagcagccccggaagccugccucacccgacgaggacagcgagcggcccggcucc

SEQ ID NO: 270194 - RNA, 64 nt, Human
uuguggugcccccccggcagcucccggcacugcccccgacgaacggaaacucuucugugaaaua

SEQ ID NO: 270195 - RNA, 64 nt, Human
ucauggguuugggauuuguaacggcaaauuccugcccgacgacagggugucuuaugcaaaggcu

SEQ ID NO: 270196 - RNA, 64 nt, Human
gauguagcuauuaugcgcccgucuacagggggugcccgacgaugacggugccuucgcagucaaa

SEQ ID NO: 270197 - RNA, 64 nt, Human
ucccagcucucuuacccucccuuuacuccaccagcccgacgacccaugacugaggaggggauuu

SEQ ID NO: 270198 - RNA, 64 nt, Human
ccaccccaagcaggaaccccaggagaucaauuuucccgacgaucuuccuggcuccaacacugcu

SEQ ID NO: 270199 - RNA, 64 nt, Human; identical to SEQ ID NO: 143149

SEQ ID NO: 270200 - RNA, 64 nt, Human; identical to SEQ ID NO: 143150

SEQ ID NO: 270201 - RNA, 64 nt, Human; identical to SEQ ID NO: 143151

SEQ ID NO: 270202 - RNA, 64 nt, Human
cgcccgugugugcacaguuuguucuuggacgaggacucgugaggaucgagggcuggggaccccg

SEQ ID NO: 270203 - RNA, 64 nt, Human
aagagcuuuggggaagaugagguaaggaaagaugacucgugaaguuaauaggaugucucuaauu

SEQ ID NO: 270204 - RNA, 64 nt, Human; identical to SEQ ID NO: 143158

SEQ ID NO: 270205 - RNA, 64 nt, Human; identical to SEQ ID NO: 143159

SEQ ID NO: 270206 - RNA, 64 nt, Human; identical to SEQ ID NO: 143160

SEQ ID NO: 270207 - RNA, 64 nt, Human; identical to SEQ ID NO: 143161

SEQ ID NO: 270208 - RNA, 64 nt, Human
acacacucuuccccaccugccccccagcucagagacucgugaccaaauggccuuggucccgcag

SEQ ID NO: 270209 - RNA, 64 nt, Human
aaaaauuagguucaggggguacaugugcagguaaacucgugacaaggggguuuguuauacagau

SEQ ID NO: 270210 - RNA, 64 nt, Human
cuggcagacuuggaaguacucuugagaaaagaagacucgugaccaaauucucccacagauuugu

SEQ ID NO: 270211 - RNA, 64 nt, Human
ugggguuucaccauguuggccaggcuggucucgaacucgugaccgcaggugauccucccgccuc

SEQ ID NO: 270212 - RNA, 64 nt, Human
uuauaaauuggugaugcuuguuugcaaauugcccacucgugauaagucaacagccaauauuuaa

SEQ ID NO: 270213 - RNA, 64 nt, Human
caacggggaguguggaugggccgaccuggcugggacucgugaaucuggagaagagcuggagaau

SEQ ID NO: 270214 - RNA, 64 nt, Human
gacucuuacccagcgcaugucuuuaucaguguguacucgugacgauuugugugaaaauagacuu

SEQ ID NO: 270215 - RNA, 64 nt, Human
caggguuucaccauguugcccagucuguucucaaacucgugagcuaaagcuacucgcccaccug

SEQ ID NO: 270216 - RNA, 64 nt, Human
uccucuggccuaggguuaagugugcaagauaacuacucgugaguauucagaauguuguuccuaa

SEQ ID NO: 270217 - RNA, 64 nt, Human
ccaugagcugaucauuguugaagcuaggugauggacucgugaaaguuuauuauaccauuuuguc

SEQ ID NO: 270218 - RNA, 64 nt, Human
ugggguuucaccauguuggucaggcuagucucgaacucgugaccgcaagcgauucacccaccuc

SEQ ID NO: 270219 - RNA, 64 nt, Human
aaagcaaagcagugacccagugaccaggcacauuacucgugagcgagguauucccagucuuccu

SEQ ID NO: 270220 - RNA, 64 nt, Human
gccgggcauggugguaggggccuguaacccagcuacucgugaggccaaggcaggagaauugcuu

SEQ ID NO: 270221 - RNA, 64 nt, Human
uugugugaguugagcccaggccucugguugcaggacucgugaauggagcaguucugagaaccac

SEQ ID NO: 270222 - RNA, 64 nt, Human
cucagagaggugaugacgugcccaaggugacgcaacucgugaacagccgugccugccuugggcg

SEQ ID NO: 270223 - RNA, 64 nt, Human
ugaacucuucaagaaacaugcauuuuggcacaagacucgugacaucacacacuucauucgcuuu

SEQ ID NO: 270224 - RNA, 64 nt, Human; identical to SEQ ID NO: 143168

SEQ ID NO: 270225 - RNA, 64 nt, Human; identical to SEQ ID NO: 143169

SEQ ID NO: 270226 - RNA, 64 nt, Human; identical to SEQ ID NO: 143170

SEQ ID NO: 270227 - RNA, 64 nt, Human
gcgcauggcugcccuggcucacgaggcagucgggacucgugacuugcuggcugcuggcugcugc

SEQ ID NO: 270228 - RNA, 64 nt, Human
aguugccccuaggacaagacuuaccaaagguaauacucgugaguagguggcagauguagcaaaa

SEQ ID NO: 270229 - RNA, 64 nt, Human
gcuugguaccuuaauuuuuuauaccugauuugucacucgugacaguauguagacugccauucuc

SEQ ID NO: 270230 - RNA, 64 nt, Human
auuuaacugaaacaaguuuuaccaaacaguauuuacucgugaugugcguagugcauucugauau

SEQ ID NO: 270231 - RNA, 64 nt, Human
aaacuauuugccuguuguacaaagaaauguuaagacucgugaaaagaauuacuauaagguacug

SEQ ID NO: 270232 - RNA, 55 nt, Human
aaaaagcaaaacucuucuaagucccacucgugaauggcaauuagagaaaggacug

SEQ ID NO: 270233 - RNA, 64 nt, Human
uuucugaaaauaaaguuuugugcuuuggagaaugacucgugagcacaucuuuagggaccaagag

SEQ ID NO: 270234 - RNA, 64 nt, Human
caaggaaaccgcuggcagacgauaaccagucgaaacucgugacuucgguuuguugaacuuuggc

SEQ ID NO: 270235 - RNA, 64 nt, Human
uguaaauuuucaguuucuacacacuuuaucauccacucgugauuuuuuaauuaaagcguuuuaa

SEQ ID NO: 270236 - RNA, 64 nt, Human
acuuuuuuacauacauucgauacauucagcagggacucgugaaacagcaggauggugaguguuc

SEQ ID NO: 270237 - RNA, 64 nt, Human
auuuucuuuguggcagucauuuauuaaggauucaacucgugauacaccaaaagaagaguugacu

SEQ ID NO: 270238 - RNA, 64 nt, Human
agucuguuaucaaaccagacaguaggggaguucaacucgugauggaaccacaaaaggucacaca

SEQ ID NO: 270239 - RNA, 64 nt, Human
guuuguaacaagggugccaugguauuuuuagauaacucgugauuaucuuaagagagguaaauuu

SEQ ID NO: 270240 - RNA, 64 nt, Human
ggugacucugaucccuacucaugacacggaggugacucgugagugguaccaacaaacucaugag

SEQ ID NO: 270241 - RNA, 62 nt, Human
uggacuuguauuagguaauaaagcuggaccugggacucgugaggaaggaaugugcuuggggc

SEQ ID NO: 270242 - RNA, 64 nt, Human
ggaggccauuugcugcccuggggcaucaugggcaacucgugacagccucugacucaccacgaug

SEQ ID NO: 270243 - RNA, 64 nt, Human; identical to SEQ ID NO: 143124

SEQ ID NO: 270244 - RNA, 64 nt, Human
uuucgggaccagccugagguguaagggcagacaaacaggugagggugaguguggcacccagaga

SEQ ID NO: 270245 - RNA, 64 nt, Human
aacaccuuccaacuacuuauguguguccuguaacacaggugauugaacguaugagagggaaagg

SEQ ID NO: 270246 - RNA, 64 nt, Human
gccgcggcucucacuaucugucaggggagguuguacaggugaaugagccggggggcucauguuc

SEQ ID NO: 270247 - RNA, 64 nt, Human
gacaagaggagaagucaguggacacauggaaguuacucgugaccaccagcuugcucagauauuc

SEQ ID NO: 270248 - RNA, 64 nt, Human
ugcacggcccagacccaggauuccaaacuugugaacucgugacaaucacaaacuuggcggcaaa

SEQ ID NO: 270249 - RNA, 64 nt, Human
cugaaacaugaacccaaaaagagacccacaauaaacucgugacuuguccccucaucaugccguu

SEQ ID NO: 270250 - RNA, 64 nt, Human
ugagggcuguccucgcugcugagaagagccacuaacucgugaccuccagccugccccuugcugc

SEQ ID NO: 270251 - RNA, 64 nt, Human
cuucuaugaaggagaauucgucaugucauucaacacucgugaggccaggaagcuauuaaaggga

SEQ ID NO: 270252 - RNA, 64 nt, Human
cucccgggcugugggcagccgcaucugugaggugacucgugaaaguaggugauuccuuugcaga

SEQ ID NO: 270253 - RNA, 64 nt, Human
guccccucagucuuggucccaggagaugggggccacucgugaggcuggccaugcuguggcuucu

SEQ ID NO: 270254 - RNA, 64 nt, Human
caggugagacuguggagaugagaaggugguggacacucgugauggaauggaaaucguccuaccg

SEQ ID NO: 270255 - RNA, 64 nt, Human
ggggccuccgagcuccagcuccguucccaaggauacucgugaagaccccaucuguguucauggc

SEQ ID NO: 270256 - RNA, 64 nt, Human
cagcuucucagcucgcuggauggcggaagcugcuacucgugagcgccagugcgggugcagacaa

SEQ ID NO: 270257 - RNA, 64 nt, Human
uauauggcuucaaagccaccuacggcagggacacacucgugagcauguguggccugcaguucag

SEQ ID NO: 270258 - RNA, 64 nt, Human
aagagccaugaaaaucacuuggccagggucaaggacucgugacuccuagcucuuuucacugcau

SEQ ID NO: 270259 - RNA, 64 nt, Human; identical to SEQ ID NO: 143106

SEQ ID NO: 270260 - RNA, 64 nt, Human; identical to SEQ ID NO: 143107

SEQ ID NO: 270261 - RNA, 64 nt, Human; identical to SEQ ID NO: 143108

SEQ ID NO: 270262 - RNA, 64 nt, Human; identical to SEQ ID NO: 143109

SEQ ID NO: 270263 - RNA, 64 nt, Human; identical to SEQ ID NO: 143110

SEQ ID NO: 270264 - RNA, 64 nt, Human; identical to SEQ ID NO: 143111

SEQ ID NO: 270265 - RNA, 64 nt, Human; identical to SEQ ID NO: 143112

SEQ ID NO: 270266 - RNA, 64 nt, Human; identical to SEQ ID NO: 143113

SEQ ID NO: 270267 - RNA, 64 nt, Human
uaggcagggcgcccugggcugcaggccugcccgaggcugggaugggaagugugccugcccucgu

SEQ ID NO: 270268 - RNA, 64 nt, Human
gccccagccccagccagccaggcccugguggaaaggcugggagccgcacagcccuccccuccug

SEQ ID NO: 270269 - RNA, 64 nt, Human
agggcagggugcccuggaacacugguaguucuggggcugggagggagaggggcuccggcuuucu

SEQ ID NO: 270270 - RNA, 64 nt, Human
gggcaccuauagucccagcuacucagaagccugaggcugggaaaucguuugaacccgggaagcg

SEQ ID NO: 270271 - RNA, 64 nt, Human
accgccccuggggcccccugccagccccuucccaggcugggagacggcagaagagauagaauca

SEQ ID NO: 270272 - RNA, 64 nt, Human
uugucucuaacuguacaggagacuucucugccugggcugggaaaggggccuuucuuuuguuuug

SEQ ID NO: 270273 - RNA, 64 nt, Human
ccugggacccucuagagguuggaaagagaagagaggcugggagcggauggaaagcaugacugca

SEQ ID NO: 270274 - RNA, 64 nt, Human
gaggaauugcccauggacagugacgcaaggacuaggcugggagggagcgugccaaccccuuuug

SEQ ID NO: 270275 - RNA, 64 nt, Human
uccccaugccuguggcugcgcuuccuauuucuagggcugggaaacacuccuugcaucaaggggu

SEQ ID NO: 270276 - RNA, 64 nt, Human
ugauucugucaacagaaaauugcaaucaugcaggggcugggaggguuaggaugaaaaaacuggg

SEQ ID NO: 270277 - RNA, 64 nt, Human
aagaaccccuggaagcagcgccuccuucaggguuggcugggagcucggcccauccaccucuugg

SEQ ID NO: 270278 - RNA, 64 nt, Human
cggcugggcuccucauuuuuacggguaacagugaggcugggaaggggaacacagaccaggaagc

SEQ ID NO: 270279 - RNA, 64 nt, Human
ugguugguuuuggcucauuucacaaucagcccaaggcugggaaagcuggaaugggaugggaacc

SEQ ID NO: 270280 - RNA, 64 nt, Human
ugaggcagauacacuuucuuacugcucacaucuuacaggugaguacucauaauuggccagcauc

SEQ ID NO: 270281 - RNA, 64 nt, Human
cauuaaguuaucuuuuaauauuuuuuucuagaaaacaggugacauuuguaucuacgauaaaaau

SEQ ID NO: 270282 - RNA, 64 nt, Human
guggacuucaucgagguguguguucgcggaacggacaggugagauggagaccccuggggccgug

SEQ ID NO: 270283 - RNA, 64 nt, Human
uaagccuuuuuaaccuuccaagacugaagacugcacaggugacaagcgucacuucuccugcugc

SEQ ID NO: 270284 - RNA, 64 nt, Human
cccaguagacucugcucccuagcccugagcaggaggcugggagcagcucuguuuccuaauucag

SEQ ID NO: 270285 - RNA, 64 nt, Human
uugaggaggcccaagaggaaaaggauguggcucaggcugggagggacuucaguuagcauggugg

SEQ ID NO: 270286 - RNA, 64 nt, Human
ccuuugcaugacccuacuuucagcagggcuuugaggcugggaaacugaucugcugggugacuuu

SEQ ID NO: 270287 - RNA, 64 nt, Human
uuuaucccuuuuguuaaaacaggaggcagccaugggcugggagaucauagcccuuccuaggcag

SEQ ID NO: 270288 - RNA, 64 nt, Human
cgguagacucuguccugcuggucccaccacacauggcugggacaucuguucccagcuguaggcc

SEQ ID NO: 270289 - RNA, 64 nt, Human
aggcagcgucuccacagggagaggggcaacaggaggcugggaaaugguggggaguggggccgua

SEQ ID NO: 270290 - RNA, 64 nt, Human
accuggauguccugggcuagggggccggcccaggggcugggagugguuagccggaauacugggg

SEQ ID NO: 270291 - RNA, 64 nt, Human
auucacccucagcaugugggaagggacaggugggggcugggaguagaggauguuccugcuucuc

SEQ ID NO: 270292 - RNA, 64 nt, Human
cuacucagaaggaugaggugggaggaucucuugaggcugggaggcagagguugcagugagcuga

SEQ ID NO: 270293 - RNA, 64 nt, Human
uuuuuaauauuuugaaauaaaguuuagugucuagggcugggagccaggacugaucuuccauuuc

SEQ ID NO: 270294 - RNA, 64 nt, Human
uccucucccacuuagcacaugugugcuugaggguggcugggaaugugauauacagcacccugau

SEQ ID NO: 270295 - RNA, 64 nt, Human
gaauugcuggaggaaccagaggcacuuccaccuuggcugggaagacuauggugcugccuugcuu

SEQ ID NO: 270296 - RNA, 64 nt, Human
ucucuccguccacagugcccaucaucugagccugggcugggaugacucaacuuagcaaagacgg

SEQ ID NO: 270297 - RNA, 64 nt, Human
gcuuucugggggaggagugggccuccuuagggagacaggugacccugggugccaccccugcccc

SEQ ID NO: 270298 - RNA, 64 nt, Human
aauauacauuucacagauaaacuguaacaggugaacaggugaacacaaacaugagggaggguug

SEQ ID NO: 270299 - RNA, 64 nt, Human
cccauaccuacauucccuaaugauacagccaaugacaggugaaacccagacacucuccuuagag

SEQ ID NO: 270300 - RNA, 64 nt, Human
cagaaauggagcuauacagccaugaagcgguguuacaggugaggaguguaauccuaggaagcau

SEQ ID NO: 270301 - RNA, 64 nt, Human
ugcuuugagaggcugagguaggagcaucaccuggggcugggagggaguuggagaccagccugga

SEQ ID NO: 270302 - RNA, 64 nt, Human
gcaaccuccaccaggaccaggauccugggccacaggcugggaugguccuuccaagaaaggguca

SEQ ID NO: 270303 - RNA, 64 nt, Human
aguuccugcccccauucucuuggggucagggaggggcugggaagggcuacugaaggccccauuc

SEQ ID NO: 270304 - RNA, 64 nt, Human
cuacugaaggccccauucucccacaggauggugaggcugggaggaggaagacugagguagagau

SEQ ID NO: 270305 - RNA, 64 nt, Human
ccuggggaggcugagacugcagaggagccaccugggcugggagaaggugcuugggcuucugcgg

SEQ ID NO: 270306 - RNA, 64 nt, Human
gacagcaccaugccaucggcgcuccagucugucuggcugggaggaaagugcugggcaucuuaca

SEQ ID NO: 270307 - RNA, 64 nt, Human
ccaagcggcugagaaccagcgccccgaugccugaggcugggagccugagccccuucagcuuuga

SEQ ID NO: 270308 - RNA, 64 nt, Human
gcccuuccauuccauuuagccuuuggaucauccuggcugggagaagugggaccgagccacccag

SEQ ID NO: 270309 - RNA, 64 nt, Human
ucugccuugguucuggccaccccagagugggagaggcugggagguugggaggcuguggagagaa

SEQ ID NO: 270310 - RNA, 64 nt, Human
cuugucccugugcucccacgguucccaggggccaggcugggagcccacagccaccccacuaugc

SEQ ID NO: 270311 - RNA, 64 nt, Human
ggagucccacuccuccagggcucugcucgucgggggcugggagauguuccuggaggaggacacu

SEQ ID NO: 270312 - RNA, 64 nt, Human
cuuuuuuugcauuucuaaagaagcgugagaaaugggcugggagugcuucuguccugcugacacc

SEQ ID NO: 270313 - RNA, 64 nt, Human
gugcagaggcuagacaacugaaaggggcuaccaaggcugggaaaaaaaugcaauuguugcugug

SEQ ID NO: 270314 - RNA, 64 nt, Human
ggaugcagacaaguggcuacaaacuuuccauacaacaggugaagauaacgagacuuugggucgg

SEQ ID NO: 270315 - RNA, 64 nt, Human
augaauacauuuuuacacacuaacauuagcauuaacaggugauaguugccauggauauaaugga

SEQ ID NO: 270316 - RNA, 64 nt, Human
ccagagccauacugcguccacccugagcucggggacaggugacaguggcugcucugggaagggg

SEQ ID NO: 270317 - RNA, 64 nt, Human
uauucugagauaggaaucuguuggaaggauuugaacaggugauugaauauguuaggaacuuuga

SEQ ID NO: 270318 - RNA, 64 nt, Human
gggggcccagcacuguccaggccugcuggggccuggcugggaguccugugggcagcauggaaca

SEQ ID NO: 270319 - RNA, 64 nt, Human
agccccgccccagccccugcucaggucugaguauggcugggagucgggggccacaggccucuag

SEQ ID NO: 270320 - RNA, 64 nt, Human
caggcuacauccuugguuuccccacuguggugggggcugggacucugaggggcuguccagucug

SEQ ID NO: 270321 - RNA, 64 nt, Human
cccagggcuccuggaauuucccuugauccagcuaggcugggacacucccuaaaucagcugcgug

SEQ ID NO: 270322 - RNA, 64 nt, Human
cuguucuaagcaggacuagggcccaggaggcuaaggcugggagagaaagggugccaacaggucc

SEQ ID NO: 270323 - RNA, 64 nt, Human
aauggcuauaggguugugggguggagggaggaagggcugggagggaguggggaggaauugcuag

SEQ ID NO: 270324 - RNA, 64 nt, Human
ugaaagagaagauggcgaaaagggccugagccagggcugggaauguguccacuuuggugggaga

SEQ ID NO: 270325 - RNA, 64 nt, Human
caaggaggcccaggaguaggaggcugcagcgcccggcugggacggucucuccauaccccagccc

SEQ ID NO: 270326 - RNA, 64 nt, Human
gaucugagggacagaccucuaucaaauagaagagggcugggagaaggggugauuagaagcagag

SEQ ID NO: 270327 - RNA, 64 nt, Human
uuccucugucuaaaugggagguugccagagcgcuggcugggacuaggauguguaacuaagauuu

SEQ ID NO: 270328 - RNA, 64 nt, Human
gccaaccacggcuauaagauuauuucagagguggggcugggaagugccacuugcuccuuagagu

SEQ ID NO: 270329 - RNA, 64 nt, Human
uuccuucacacccagcuucuggaaggcaugggguggcugggauuuaaggacuucugggggacca

SEQ ID NO: 270330 - RNA, 64 nt, Human
aagacccugcucugguggagcugacaaccuuugaggcugggaggagagcagccucugggcaucg

SEQ ID NO: 270331 - RNA, 64 nt, Human
ccaggcaaucaaaaugagugcagguugaaagaaaacaggugaauuuuaguggcauauggaugau

SEQ ID NO: 270332 - RNA, 64 nt, Human
ugaccauuaaaagcucaccacuagaguuccugaaacaggugaaaccuguaugacagcccuucca

SEQ ID NO: 270333 - RNA, 64 nt, Human
agcucucugccucucugcccuuuggucuguguucacaggugacccgugucagccugcaucgcaa

SEQ ID NO: 270334 - RNA, 64 nt, Human
auuaaaaaaaucaaaauaauauucugugacaaugacaggugaaauuuauaugugacaagugaaa

SEQ ID NO: 270335 - RNA, 64 nt, Human
cugcagccaggauugccucagcuccucccccucaggcugggaggauagcacaggcuaggggcuc

SEQ ID NO: 270336 - RNA, 64 nt, Human
gcugcucagaggcugcagggagggcccaggagccggcugggaggguggggucccuuuguugcca

SEQ ID NO: 270337 - RNA, 64 nt, Human
auucuuccucaaguaagggggaacuccugcuuugggcugggacauaaguuuuucugcuuucaga

SEQ ID NO: 270338 - RNA, 64 nt, Human
ugucucugagcucuguguccuccguucauuccauggcugggagucacugaugcugccucugccu

SEQ ID NO: 270339 - RNA, 64 nt, Human
aucccaucacccccuaaauaggucaggugagggaggcugggaagaggugggaggaggggcagaa

SEQ ID NO: 270340 - RNA, 64 nt, Human
acuccuacgcccacucccaugcuugggagaauggggcugggacaugcacugaguguugcacuuu

SEQ ID NO: 270341 - RNA, 64 nt, Human
uggaauagcucccucuucugguccuggcucagggggcugggauuuugauauauuuucuaauaaa

SEQ ID NO: 270342 - RNA, 64 nt, Human
uccaugugcccaguuaaucuugcuuucuuuguuuggcugggauagaggggucaaguuauuaauu

SEQ ID NO: 270343 - RNA, 64 nt, Human
aauggugcugagguugagaaaaccugacuuaaggggcugggaugcuuuugaacuagcuuaaggc

SEQ ID NO: 270344 - RNA, 64 nt, Human
gucuuugcuaauuggaauuauguauugucuguugggcugggaaaugucucuuucauauuguaag

SEQ ID NO: 270345 - RNA, 64 nt, Human
acucagccagcuccuucccagcccagccucuuggggcugggacuuucucacccugcggcaggca

SEQ ID NO: 270346 - RNA, 58 nt, Human
uccugggcaagaacaaguagacagcagcggcugggaccccacaccuuucacggacacu

SEQ ID NO: 270347 - RNA, 64 nt, Human
acuauuacacuuccacacuauuuauuuggggaugggcugggagugacaguagccuaguaguuca

SEQ ID NO: 270348 - RNA, 64 nt, Human
cccuuuuauacuaggacuccuuaggaggagugagacaggugauaauggauccuuaacagaugaa

SEQ ID NO: 270349 - RNA, 64 nt, Human
caucaggugcuauauuguauagcauucacauuccacaggugaggaaacaggcucagaggaauaa

SEQ ID NO: 270350 - RNA, 64 nt, Human
ccuaaaaaaagauguuuuauuuugccaguuggacacaggugauuggcuccuggguuucauguuc

SEQ ID NO: 270351 - RNA, 51 nt, Human
cuccuuucaggcccuacugagacaggugaugggaauuuuuucuuuauuuuu

SEQ ID NO: 270352 - RNA, 64 nt, Human
aagaacaccuacuaauuccucugcacuccuucauggcugggacaguuacugguucauaugcaag

SEQ ID NO: 270353 - RNA, 64 nt, Human
acccugcguacgcugcucaguugguggagacuggggcugggacuggagucagcccagcugggag

SEQ ID NO: 270354 - RNA, 64 nt, Human
agagcccagggggccggccggguuccuggucccuggcugggagcagggcuuucugguaguuggg

SEQ ID NO: 270355 - RNA, 64 nt, Human
cccucagaccucuccugcuggucccuggaccucuggcugggagcgcucauucuugugacuggca

SEQ ID NO: 270356 - RNA, 64 nt, Human
ucugcugaaaccaugcaaaauugagcuuugguggggcugggaggggguuauguauucaugggac

SEQ ID NO: 270357 - RNA, 64 nt, Human
gccgccucuuuucugcugggucugggaggagggaggcugggaggccgcucggggcccagcgugc

SEQ ID NO: 270358 - RNA, 64 nt, Human
accucuggcccuguguaggggcagggauggggguggcugggacuccuggugccccucgccagcu

SEQ ID NO: 270359 - RNA, 64 nt, Human
agaaagggcccuuuucagcacccaaagcugggcuggcugggaugccucuggcuggugaaguucu

SEQ ID NO: 270360 - RNA, 64 nt, Human
ucuccuuccuucagaaucuaccaccccucccccaggcugggagaaggggcuccugggugucugu

SEQ ID NO: 270361 - RNA, 64 nt, Human
agugggcuggagagaccuagagggcccagcauguggcugggaaacuguugguggccagugggua

SEQ ID NO: 270362 - RNA, 64 nt, Human
gggcugugagagggaggcuggggugccugggcggggcugggagugggaccugagaucccugccc

SEQ ID NO: 270363 - RNA, 64 nt, Human
acuugguucuggguccuuaaaaccagguuuccuaggcugggacccuguacauaguugguguuua

SEQ ID NO: 270364 - RNA, 64 nt, Human
aagauggcugugccucugccugucucccccaccgggcugggagcucugcagagcaggaaacaug

SEQ ID NO: 270365 - RNA, 64 nt, Human
gggccacaagaaugagaaagggggcaauggagugacaggugaccugcucaggugccccucccca

SEQ ID NO: 270366 - RNA, 64 nt, Human
aauaauccuacuuacuauuguuuauucucaauuuacaggugaggaaacugagacauagaaagcu

SEQ ID NO: 270367 - RNA, 64 nt, Human
ucaggauuacacugaaaguaauggccucguaaguacaggugaugguuuuggacacgucaggaau

SEQ ID NO: 270368 - RNA, 64 nt, Human
agaaucccaauugcaccuucuguuucugacagucacaggugacagcugugauucuauaauacag

SEQ ID NO: 270369 - RNA, 64 nt, Human
uggauuaucgggccugugcaagauuguuaacuaaggcugggaaauaauaagauuuagaguccua

SEQ ID NO: 270370 - RNA, 64 nt, Human
agacugugaggccaaaagaagggggccuguuggaggcugggaaccccgcagcgcgaggcugccu

SEQ ID NO: 270371 - RNA, 64 nt, Human
ggggagaccucuggcuaggcccacaccagggccuggcugggaguggcauguaugacgugacugg

SEQ ID NO: 270372 - RNA, 64 nt, Human
uuccccgcccagcuuucccaggggcacagcucuaggcugggaggggagaaccagccccuccccc

SEQ ID NO: 270373 - RNA, 62 nt, Human
ugcugugggcacaguacugacggggcucucagggcugggaggaccccagugcccuccucaga

SEQ ID NO: 270374 - RNA, 64 nt, Human
caagcagggacugcucuuuaggaaggggagcagcggcugggagugagcagggcagggugggggc

SEQ ID NO: 270375 - RNA, 64 nt, Human
gauagggauacaugcucuuagaaaauucacuauuggcugggagugguggcucaugccuguaauc

SEQ ID NO: 270376 - RNA, 64 nt, Human
cuagagggacugugcagaaccaggcugggagaagggcugggaaaacugggaguggaggguggau

SEQ ID NO: 270377 - RNA, 64 nt, Human
agaggacacaggcuagagggacugugcagaaccaggcugggagaagggcugggaaaacugggag

SEQ ID NO: 270378 - RNA, 64 nt, Human
ugagacucaggauucagaucagagguucgacuguggcugggacaggaguuguguguagaaauuc

SEQ ID NO: 270379 - RNA, 60 nt, Human
aucaucucauuagcagguagugaaagccauggcugggaaaauggaagugaagcugccgac

SEQ ID NO: 270380 - RNA, 64 nt, Human
cuguauguuggccccuuucagccauggcuggaguggcugggacacaagacaccaagucccuagg

SEQ ID NO: 270381 - RNA, 64 nt, Human
agcuugaggugccuuuacgagaaaaccgagcuggggcugggagaggacaguuauugacacugau

SEQ ID NO: 270382 - RNA, 64 nt, Human
uguguccacccucccuggucccuacccccaagucacaggugacucagcagugacccugugugcc

SEQ ID NO: 270383 - RNA, 64 nt, Human
gguuagcuuuuacguuuucuucuccacccacggcacaggugauaaaauaggauccuuggugcgg

SEQ ID NO: 270384 - RNA, 64 nt, Human
ugaugguuuuuauauauaucaauucuagacuguuacaggugacggacgccucaagagagagaag

SEQ ID NO: 270385 - RNA, 64 nt, Human
agcucgcugccuggugcuugucugggcgagauggacaggugaggucgaggacgcagagggcaga

SEQ ID NO: 270386 - RNA, 64 nt, Human
ugggucugguccaggugaggggcagggggcauggggcugggaggucucaggggccuucccuggg

SEQ ID NO: 270387 - RNA, 64 nt, Human
cagaccacugggguuuccugcugcaggaauugggggcugggaacagcagaggggauagaagucu

SEQ ID NO: 270388 - RNA, 64 nt, Human
agugguauuuuauacuugccuucuuccuguacagggcugggaaaggcugugugaggggagagaa

SEQ ID NO: 270389 - RNA, 64 nt, Human
uaagagggauuagggagagaagauagcagggcauggcugggaacccaaguccaagcauaccaac

SEQ ID NO: 270390 - RNA, 64 nt, Human
gccuuuguuccuuucuggcugagcaagcuccugaggcugggagagacuaggaaggcuugguagg

SEQ ID NO: 270391 - RNA, 64 nt, Human
cuaccccaauguuauguugucauuuaaugggaaaggcugggaucauauguauuucuauguucug

SEQ ID NO: 270392 - RNA, 64 nt, Human
uugaaguguaauccccaauguuagagguggggccggcugggaggcgacuggaucauggguguga

SEQ ID NO: 270393 - RNA, 64 nt, Human
ucuuguccuccugagaggaagcccuggcuuccaaggcugggagcuggaggaugaccuucggucg

SEQ ID NO: 270394 - RNA, 64 nt, Human
cuuuuucuuccuuugcaaaggccuugggggcacuggcugggagucagcaagcgagcacuuuaua

SEQ ID NO: 270395 - RNA, 64 nt, Human
cuuuuuuguggacacaggagcuccuccaggagcaggcugggaucccaacuaucgcuuguugccu

SEQ ID NO: 270396 - RNA, 64 nt, Human
agcuucagugccucaucuugccaucucccggccaggcugggaacgggcaccaagcagccgccuc

SEQ ID NO: 270397 - RNA, 64 nt, Human
aaagcagugcuuagcaacauuggugauagcauguggcugggacccagggcccuuccccacucuu

SEQ ID NO: 270398 - RNA, 64 nt, Human
cuccuuagcuuucccugugccacuuugacucagaggcugggagcauagcagaggggccaggccc

SEQ ID NO: 270399 - RNA, 64 nt, Human
gcuugcuagggaaccugcaugccuaguaagcgccacaggugacucugaugcaggcgccacagcc

SEQ ID NO: 270400 - RNA, 64 nt, Human
ugcgguuccgggaagaagccacaccccagaggugacaggugagccccugccacaccccagccuc

SEQ ID NO: 270401 - RNA, 64 nt, Human
ucccucagcuauacuuuuucauaacagaauuuguacaggugagaagccuaaugaaagcccgaua

SEQ ID NO: 270402 - RNA, 64 nt, Human
uugccaugucgcacguccguuagaucuugauuuuacaggugagggugguugccaaaggugauaa

SEQ ID NO: 270403 - RNA, 64 nt, Human
gaccccuguccugucccuucaccaguccuggggaggcugggacucccccugccacaagccuggg

SEQ ID NO: 270404 - RNA, 64 nt, Human
caggcucaagcccuagagaugggcagggccuaggggcugggagcugccugcugccauagcagca

SEQ ID NO: 270405 - RNA, 64 nt, Human
cgcagccuaguuccuuccuggccccucucucacuggcugggaaacccuagaccaugucagauag

SEQ ID NO: 270406 - RNA, 63 nt, Human
acggccgaggggagcagugaggggcaacgaggcggcugggaugccgcccucaguaagcagcuu

SEQ ID NO: 270407 - RNA, 64 nt, Human
uggaacaugggcacagagaggggccugugggaggggcugggaaaauaaaguccaaggucgagac

SEQ ID NO: 270408 - RNA, 64 nt, Human
ggccaagugauccucccaccucagccucucaaguggcugggaccacagaagugcaccaccaugc

SEQ ID NO: 270409 - RNA, 64 nt, Human
ggcugggcuguuuuuuucaguagccccuagcauuggcugggauuccuguuccugggugcgccuc

SEQ ID NO: 270410 - RNA, 64 nt, Human
uugaaacagaguuaagagguuuuuaagccaggcgggcugggaagcuugaagugcaccuugagca

SEQ ID NO: 270411 - RNA, 64 nt, Human
agucuggauggaggcugcccuggaagcagccccgggcugggaaagggcugagugucaacaggcc

SEQ ID NO: 270412 - RNA, 64 nt, Human
cuuugggugugauugagugcccuccuggcuccugggcugggacaagugaggaacuagcugcaga

SEQ ID NO: 270413 - RNA, 64 nt, Human
auuuuuuuuggagacggggucuugcucucacccaggcugggagugcaguggcacacugacuaca

SEQ ID NO: 270414 - RNA, 64 nt, Human
cuaguuccuaugaaagaaccagagcugggaagauggcugggaagccaggccaaagugggggcaa

SEQ ID NO: 270415 - RNA, 64 nt, Human
auuuuauaauuacuauacuuguguuuuguuugggggcugggaaauguauuuuuacauuguagcc

SEQ ID NO: 270416 - RNA, 64 nt, Human
uuuguggagcugucaucagcucagcuuuaacaacacaggugacucuuucccuugauaaagucau

SEQ ID NO: 270417 - RNA, 64 nt, Human
aaaaggcugugggccguuaggaccauccuccaggacaggugaccucuaugaggucaccuacggc

SEQ ID NO: 270418 - RNA, 64 nt, Human
aguccaucacccaaauauguuauagacgccauagacaggugauguuuggucaccuaugguaacu

SEQ ID NO: 270419 - RNA, 64 nt, Human
aaugaaugacuuccccaauaucuugcuugaacuuacaggugauuaacuuggaugaguuuuggga

SEQ ID NO: 270420 - RNA, 64 nt, Human
ucagagcaucaugcuuugagguuuggggugcucaggcugggaggguagaaugccauuccagagg

SEQ ID NO: 270421 - RNA, 64 nt, Human
gcugacaagguggggaacaauccuugccagagugggcugggaccagacuuuguucucuuccuca

SEQ ID NO: 270422 - RNA, 64 nt, Human
ucagcuuuucugucuccugggggguuugaggcugggcugggagggggagggagauagagggaga

SEQ ID NO: 270423 - RNA, 64 nt, Human
uggugccacuggugggcagguucccauucuuuggggcugggagggacagcuugccuguuucugg

SEQ ID NO: 270424 - RNA, 64 nt, Human
ucccagggugaugcaagcaugccgcagcccuggaggcugggaauguggaggcucugugagcccu

SEQ ID NO: 270425 - RNA, 64 nt, Human
gagaugucacuguggcccccagcuagaggcccagggcugggagcauucuccaggagcagagguu

SEQ ID NO: 270426 - RNA, 64 nt, Human
guucacaccauucuccugccucaaccucccgaauggcugggacuacaggcacccaccaccacgc

SEQ ID NO: 270427 - RNA, 64 nt, Human
gguuuuuuguuuuuguuuuguugccgguggggagggcugggagggggagggaacuuuuauuuau

SEQ ID NO: 270428 - RNA, 64 nt, Human
cucaaaugcacaucucauggcagcuaagccacauggcugggauuuaaagccuuuagagccagcc

SEQ ID NO: 270429 - RNA, 64 nt, Human
gcaaacucuguucucuggaaugcucugaaguuauggcugggaccuauccccucacaucuaauga

SEQ ID NO: 270430 - RNA, 64 nt, Human
ggagcacuucucuaaucaugcccucccgaagacuggcugggagaagguuuaaaaacaaaaaauc

SEQ ID NO: 270431 - RNA, 64 nt, Human
gggcccugcggugaacacuggucaagcucucuccggcugggaugaucacacccucugcuuccug

SEQ ID NO: 270432 - RNA, 64 nt, Human
gggggccccacugcccuuccggcccuuaaaacugggcugggagagaagacggggaaguguguga

SEQ ID NO: 270433 - RNA, 60 nt, Human
uggagaacggggaugcguagggccacagccacacgccaccuucaucuccuccgccgcccc

SEQ ID NO: 270434 - RNA, 64 nt, Human
gcgagauuugggggugcuaauccaggacagcauuacacgccacaacuccaguguucccuucugg

SEQ ID NO: 270435 - RNA, 64 nt, Human
ugucucagccuccugaguagcugggacuacaggcacacgccaccucgcccggcccgaucuuucu

SEQ ID NO: 270436 - RNA, 64 nt, Human
cauuuuuccccuuucauagauaacauuucuugaaggcugggaggggaaggagggccuggcagau

SEQ ID NO: 270437 - RNA, 64 nt, Human
ugaggcagggccugugaguggacagagcaccccuggcugggaagaagaagaugggguaggagga

SEQ ID NO: 270438 - RNA, 64 nt, Human
cagaggcacuugcucuucugcaugguguucaauaggcugggaguuuuauuuaucucuucaaacu

SEQ ID NO: 270439 - RNA, 64 nt, Human
gaacgucacacgccuggacugucgggggguggggggcugggagagggauaguguuaggagaaau

SEQ ID NO: 270440 - RNA, 64 nt, Human
gccccccagccuucacugacagccgcugcuuccuggcugggaacaacuucaguccaacugucaa

SEQ ID NO: 270441 - RNA, 64 nt, Human
cucccggggauggagcaaggccaaggcugcgggaggcugggagcccugcccugcccaucccucc

SEQ ID NO: 270442 - RNA, 64 nt, Human
gaagaugccgccccaccuucuacuuggguagcugggcugggacgcugggacaggaccccguccu

SEQ ID NO: 270443 - RNA, 64 nt, Human
acacugguccccccaucacacucaccccuaagugggcugggagccaggcagggccagggcagcu

SEQ ID NO: 270444 - RNA, 64 nt, Human
aguaacagaucaggacccaaacuugggcagucugggcugggagcccacaccccacucaccaguu

SEQ ID NO: 270445 - RNA, 64 nt, Human
cagacuucaacggggaguguggaugggccgaccuggcugggacucgugaaucuggagaagagcu

SEQ ID NO: 270446 - RNA, 64 nt, Human
uucaugacauuauguggaauccuaaaccuuugguggcugggauaugauggguuagaagcaagga

SEQ ID NO: 270447 - RNA, 64 nt, Human
uagucacaugggcacaccaccuaucugcauggaaggcugggaaauguugaucgguagggcagcc

SEQ ID NO: 270448 - RNA, 64 nt, Human
aaaagagagagagagaauaaauagaaaagaauguggcugggaauugugaaucagaagauuauac

SEQ ID NO: 270449 - RNA, 64 nt, Human
ugccucagccucccaaguagcugggacuacaggcacacgccaccacacccaacuaauuuuugua

SEQ ID NO: 270450 - RNA, 64 nt, Human
uggcccugggguaaagggggccuggaguugcuugacacgccaguuguucaaaagaagcaagaac

SEQ ID NO: 270451 - RNA, 64 nt, Human
aaacugucuuuuguaaccuccugucccuccuaaaacacgccaaccccugcagucaaaucacauu

SEQ ID NO: 270452 - RNA, 64 nt, Human
uugaaaauaggauuugcacugcuuuauuuuagguggcugggaguuuugauugcauauuuuguua

SEQ ID NO: 270453 - RNA, 64 nt, Human
cauagaaguaaaaaauaaaacagaggauacuacaggcugggaaagcugcagcaaagggagacua

SEQ ID NO: 270454 - RNA, 64 nt, Human
aagaaaagaaauuuauuuucuuccuaguucuggaggcugggaaggcgaagggcauggcacugac

SEQ ID NO: 270455 - RNA, 64 nt, Human
gaacgagagugccuccccuucuuguguccuggcuggcugggaugcugguggcucuucagaggag

SEQ ID NO: 270456 - RNA, 64 nt, Human
gaaggaguacauugaagggagauuggcaccuaguggcugggagcuugccaggaacccaguggcc

SEQ ID NO: 270457 - RNA, 64 nt, Human
agacugcuggaggaaauguagcagacagcauggaggcugggacccagcagcuacuuugggucau

SEQ ID NO: 270458 - RNA, 64 nt, Human
gcucaagugauccucccaccucugccucccaaagggcugggacugcaggugcaugcacuaccau

SEQ ID NO: 270459 - RNA, 64 nt, Human
agcugccccacccacucucccucacauggugcuaggcugggagcugcccugagagcugggaugc

SEQ ID NO: 270460 - RNA, 64 nt, Human
gaaggcccaggcugagaggcccuggcucuggccaggcugggaucugggugggaggcuggggcuc

SEQ ID NO: 270461 - RNA, 64 nt, Human
gcccccgccuuggcuccugggggcagccagcccuggcugggagagcgggagcuggcagaggagc

SEQ ID NO: 270462 - RNA, 64 nt, Human
cucugguucugacacuuucugcuggaagcugucaggcugggacaggcuuugauuuugaggguua

SEQ ID NO: 270463 - RNA, 64 nt, Human
auggggaggaccuggcaggcagcuuccacggcagggcugggaaguucagugccuggaaauaaag

SEQ ID NO: 270464 - RNA, 64 nt, Human
ucagagccagucucaccuucaaccgcggcuucaaggcugggaggaacaugcgucgcaaacucuu

SEQ ID NO: 270465 - RNA, 64 nt, Human
cgcggacauguuuaccagcacacggcucuucuucccacggcacuuucugauguaacaaucgagu

SEQ ID NO: 270466 - RNA, 64 nt, Human
uagauggggguuggcagagggagaaauaagccagccacggcagucgcuugguuucccaggugga

SEQ ID NO: 270467 - RNA, 64 nt, Human
uggcuacauaccaauggauugauucucuuaauugccacggcaagggggcgauccuaucaugacu

SEQ ID NO: 270468 - RNA, 64 nt, Human
uccucauccaccgugaugagaagcgcugcuguggccacggcacacugcuuggcuuggguggcgg

SEQ ID NO: 270469 - RNA, 64 nt, Human
ugugaagauccccugggacugcgaugcggcgugaggcugggacugcgagugcugacgccaccuu

SEQ ID NO: 270470 - RNA, 64 nt, Human
uuuugaaugcagaaaacaaagucguggacaaccaggcugggacccagggccagcugaaggugcu

SEQ ID NO: 270471 - RNA, 64 nt, Human
ugaacccagaccacccagugccauggccacuuagggcugggaacccgaaccuggugacuuugaa

SEQ ID NO: 270472 - RNA, 64 nt, Human
aagaauaguggcagaugcagccagcgcuggcuagggcugggaggguuuugcucuccuaugcaau

SEQ ID NO: 270473 - RNA, 64 nt, Human
uaaaaacuuccuucaaucuucauuuuggaggcagggcugggaagggagcgcucucuugauucug

SEQ ID NO: 270474 - RNA, 64 nt, Human
uaaacugugggauggguaagaaauccccuucuuuggcugggaaucuccaccuuaauccuuaaag

SEQ ID NO: 270475 - RNA, 64 nt, Human
gauaagugggugaacuuauuguucuuggccaugaggcugggagccuagucacggaguuuagcua

SEQ ID NO: 270476 - RNA, 64 nt, Human
uuucuuccugucucguagggggugaguugaguguggcugggagagugggagggaagcccucagc

SEQ ID NO: 270477 - RNA, 64 nt, Human
ccacaaccagugaagggucugaaagguugggggaggcugggagaggggaacgugggaauagcac

SEQ ID NO: 270478 - RNA, 64 nt, Human
guucaagcgauucuccugccucagccuccugaguggcugggauuacaggcaugcaccaccaugc

SEQ ID NO: 270479 - RNA, 64 nt, Human
cccggggcauggacagggccaggguugcggucgcggcugggagccucgccccuccaguguugcc

SEQ ID NO: 270480 - RNA, 64 nt, Human
ggcccggcagggcgggcagagggcuggaggcccaggcugggaacucaucugguugaacucuggu

SEQ ID NO: 270481 - RNA, 64 nt, Human
agagcccuguggccgacucugcacucuccacccuggcugggaucagagcaggagcauccucugc

SEQ ID NO: 270482 - RNA, 64 nt, Human
cggccucuguuugaguccuucaacgggaugguguccacggcaagugugcacacccuccgccaga

SEQ ID NO: 270483 - RNA, 64 nt, Human
gacccuccccgggcucgagggcagggacucgcgcccacggcaccucugggagcugggaugauaa

SEQ ID NO: 270484 - RNA, 64 nt, Human
gugccgugagacuucaaggcuuggcccuucuugaccacggcagccuccugucuucuaggagcua

SEQ ID NO: 270485 - RNA, 64 nt, Human
ggccauccccaagccuucaacagaagcugugcugccacggcaggcccaggccagccagugcccg

SEQ ID NO: 270486 - RNA, 64 nt, Human
ccuuccccaaucaccuuuccuguuccagaaaaggggcugggaugucuccgucucugucucaaau

SEQ ID NO: 270487 - RNA, 64 nt, Human
uuuuuuuuuuuuugcuuggcgaaaacacuacaaaggcugggaauguauguuuuuauaauuuguu

SEQ ID NO: 270488 - RNA, 64 nt, Human
ugcuuagacagugauuccugcaacuugaccuucaggcugggagagguggagagccaugccuguu

SEQ ID NO: 270489 - RNA, 64 nt, Human
cuauggacagggcaugccacgugggcucauauggggcugggaguaguugucuuuccuggcacua

SEQ ID NO: 270490 - RNA, 64 nt, Human
uaucuucugccuuucacuugcauccaacuccuggggcugggaccguaguagcugcgggggggaa

SEQ ID NO: 270491 - RNA, 64 nt, Human
cccugcugagauagccccuacccccaccuccacaggcugggacagccccguccccaccauccuc

SEQ ID NO: 270492 - RNA, 64 nt, Human
ggcaggcagaugaugaaguacuggcagauuugcaggcugggaaggcuagacuuccucagcccga

SEQ ID NO: 270493 - RNA, 64 nt, Human
ggaggcaggcccuccacagaagcucugcagcaggggcugggagagcagaagggcaggcccugca

SEQ ID NO: 270494 - RNA, 64 nt, Human
gcugggagagcagaagggcaggcccugcaacucaggcugggaguaucgaacccucugccuaggg

SEQ ID NO: 270495 - RNA, 64 nt, Human
ugcuugagaacaggaaauuggaucucucccuucaggcugggauuucacuaagggcuggagaagg

SEQ ID NO: 270496 - RNA, 64 nt, Human
uaucuguuugagaaagucagauucuugcaucccuggcugggauccacgacgcuuaaauacagcu

SEQ ID NO: 270497 - RNA, 64 nt, Human
gguuuuauuuucuguuaacacuguguccugggggggcugggaaguccccugcaucccaugguac

SEQ ID NO: 270498 - RNA, 64 nt, Human
uauuaauuggaggaagauuuaugguuaugggucuggcugggaagaagacaacuauaaauacaua

SEQ ID NO: 270499 - RNA, 64 nt, Human
accguuacuguaagcuugcaggccucagcuguggccacggcaggcccgcucucucaggcccuca

SEQ ID NO: 270500 - RNA, 64 nt, Human
gaagaggcuggggaggguuuuccccacgacagccccacggcacagcagaucaugcggcugcuuc

SEQ ID NO: 270501 - RNA, 64 nt, Human
ucacuucccuuugcaucugagauccugcuggaaaccacggcaaccuguauccacuauuaggagg

SEQ ID NO: 270502 - RNA, 64 nt, Human
gcccaugccgacagauaucguggggcugacagguccacggcaggcuugcuuucuuuuauaaaau

SEQ ID NO: 270503 - RNA, 64 nt, Human
uaacuuguggugaaggaagugugugacucagcuuggcugggaagugcuccucaccuguguggcc

SEQ ID NO: 270504 - RNA, 64 nt, Human
cucuaucuccagucugucucuguguacugguagaggcugggaggaguagggggcagccuguucc

SEQ ID NO: 270505 - RNA, 64 nt, Human
auacugguuucuccacaggaauaugguuccauuaggcugggagcaaaaacaauguuuuuuaaga

SEQ ID NO: 270506 - RNA, 64 nt, Human
aaauggggaggacucgggugggggaggacgucccggcugggaugaagucugguggugggucgua

SEQ ID NO: 270507 - RNA, 64 nt, Human
agcagcugacaguuggagggaaagccagccugggggcugggaggauccuggagaaguggguggg

SEQ ID NO: 270508 - RNA, 64 nt, Human
cuccgcaggcgcuccgcugaaggggcaggggcuaggcugggagacgacgaaggaacaggcguuu

SEQ ID NO: 270509 - RNA, 64 nt, Human
cagcuauccucucuugagaaggggaggauaaguaggcugggaaacuucaaagccuucccagucc

SEQ ID NO: 270510 - RNA, 64 nt, Human
ucacuccagaccuguucccacaacuggggagguaggcugggagcaaaaggagagggugggaccc

SEQ ID NO: 270511 - RNA, 64 nt, Human
guaagggggaucccaggcacccaucucaaggaguggcugggagucuuuucccuaacuugugggg

SEQ ID NO: 270512 - RNA, 64 nt, Human
cagccccgccucccugccaggaugcuagauuauuggcugggaggugggcaaguggcagcccagc

SEQ ID NO: 270513 - RNA, 64 nt, Human
cuguacccacaggauuacagccauugcuugggaaggcugggaggccucccauccaggacacugg

SEQ ID NO: 270514 - RNA, 64 nt, Human
uuacuuuagcgggcugcaaugccgccgauaugauggcugggagcucuggcagccauacggcacc

SEQ ID NO: 270515 - RNA, 64 nt, Human
ugccccugugccagggaacaggggccggccugggggcugggagggccaggggcaccucccuccc

SEQ ID NO: 270516 - RNA, 64 nt, Human
guuccuagaggcagggguuguggggcacucccagccacggcacuguuaccuugguggugggacu

SEQ ID NO: 270517 - RNA, 62 nt, Human
gggagaccgacguccuuuagcccucccaggccccacggcagcacuuaugguagcggcacugu

SEQ ID NO: 270518 - RNA, 64 nt, Human
accagcugcuucggccuucaggugaccucccuccccacggcauccugcucuccggguggaagag

SEQ ID NO: 270519 - RNA, 64 nt, Human
uggugcuccgcggccccgccuacacgcgucuucuccacggcaucgccgccgcccgcguagacgc

SEQ ID NO: 270520 - RNA, 64 nt, Human
gcacaguaucaaguauaguaccuccaaggaccagggcugggaagucuuuagugcuaacaucccc

SEQ ID NO: 270521 - RNA, 64 nt, Human
cuuuagaaagcaguuacccaacagaaacauucugggcugggaaccagggaggcgcccugguuug

SEQ ID NO: 270522 - RNA, 64 nt, Human
uuauuucucuggaagcggcuaagggacgguugggggcugggagcccugggcguguaguguaacu

SEQ ID NO: 270523 - RNA, 64 nt, Human
cuccgagcccuccuggugggaagacagcuggaaaggcugggaggagaagggaggggcugggggu

SEQ ID NO: 270524 - RNA, 64 nt, Human
auguguacaguacacgcacuggacggcagcgggaggcugggacuuuccauuacaaauagagacu

SEQ ID NO: 270525 - RNA, 64 nt, Human
auaaacccccgcguggcacugcugaguccucucuggcugggaaggggggaagguaggaggguga

SEQ ID NO: 270526 - RNA, 64 nt, Human
cuggguggccaggcaggaagugcccagcccgagaggcugggagguuuguugaggguguggggug

SEQ ID NO: 270527 - RNA, 64 nt, Human
gguugaguuuuaugacaguauguaguugaguggaggcugggaguuuuaagcauaaaucccuguu

SEQ ID NO: 270528 - RNA, 64 nt, Human
augagggccgacuggggccaggcucaggggcagaggcugggacacaaggggcuggcgagggcug

SEQ ID NO: 270529 - RNA, 64 nt, Human
ccccccgagcagccuuuguacucugcuugcggagggcugggagacccuccaggacauucccacc

SEQ ID NO: 270530 - RNA, 64 nt, Human
guauggggaaagaccaauccaacuguccaucuguggcugggacagcccagggggugugcccacg

SEQ ID NO: 270531 - RNA, 64 nt, Human
ccucacuguggcaucaagguugcuuuuggcuuuuggcugggaugcgugugcuguggugaauauc

SEQ ID NO: 270532 - RNA, 64 nt, Human
cuuguccuugucguguugccaugggguucugagaggcugggaguucacagaccucagacacagc

SEQ ID NO: 270533 - RNA, 64 nt, Human
acccaaagaguccccacuuaacaauaccccccccccacggcaagaaugcccaaauccgaaugac

SEQ ID NO: 270534 - RNA, 64 nt, Human
gugcuggguccuucccucugcucccuacuccccaccacggcagagaauaggcuuucuaagaugc

SEQ ID NO: 270535 - RNA, 63 nt, Human
cgcacccucccuagcucugaaaucaacucucuucggucguauccaccuugcacccgcaaguca

SEQ ID NO: 270536 - RNA, 64 nt, Human
ccugcgggccugggaagcauugcucaggguggggggcugggaccauggcccgcagaggcacugc

SEQ ID NO: 270537 - RNA, 64 nt, Human
uccagccccagacaacagcccaggcaucuccuugggcugggacuucuuacccaaagcacaugcu

SEQ ID NO: 270538 - RNA, 64 nt, Human
gggugacuaaacgggcgccaagacucaggggaucggcugggaacugggccagcagagcauguug

SEQ ID NO: 270539 - RNA, 64 nt, Human
guugcugccagucaaggccacccaggagucugaaggcugggagcucuuggggcugggcuggucc

SEQ ID NO: 270540 - RNA, 64 nt, Human
ccuaaggccccagcucgcuggccucgcgcugggcggcugggaauuccaccugagaacaaguccc

SEQ ID NO: 270541 - RNA, 64 nt, Human
auguguagacaacacccuuacaaggauccgccagggcugggaaaggaacucaaaacacuagaaa

SEQ ID NO: 270542 - RNA, 64 nt, Human
ggguuggagacuggguggggaggguuggagacugggcugggaggagagcaagcaggaacaggga

SEQ ID NO: 270543 - RNA, 64 nt, Human
ggaagucacgcgcagagaggagagucuuacggagggcugggagcuuaaaaggaaaacaaugucc

SEQ ID NO: 270544 - RNA, 64 nt, Human
guccauuuccuaugaacuaaugacaacuugagaaggcugggaggauuguguauuuugcaaguca

SEQ ID NO: 270545 - RNA, 64 nt, Human
uccuacuacuuuaaucccuaaaagaacgcuguguggcugggaccuuuaggaaagugaaaugcag

SEQ ID NO: 270546 - RNA, 64 nt, Human
uuccuaagaaugcaaacugccuuuuccacacaaaggcugggaauaaaauucuggguauucucgu

SEQ ID NO: 270547 - RNA, 64 nt, Human
uaugcugcaugaggaccuuucuaucuuacauuauggcugggaaucuuacucuuucaucugauac

SEQ ID NO: 270548 - RNA, 64 nt, Human
uuaaaucuaguaaaagaagaaaguuguacuuccuggcugggaguauuaggagaugggaguagag

SEQ ID NO: 270549 - RNA, 62 nt, Human
uauggaauaagaccuuuuauucucccucagucucgagauaaauagccagccuagagcacaac

SEQ ID NO: 270550 - RNA, 62 nt, Human
ugaugugugaucugggacuggcagguuauuaaucgagauacacuuguuaggagggacagggu

SEQ ID NO: 270551 - RNA, 62 nt, Human
cugaacuccuauuugaccagaacuuuuuccucucgagauaguuuuuucuuuuuaaugaaaaa

SEQ ID NO: 270552 - RNA, 64 nt, Human
guucaaaugauucuccugccucagccucuugaguggcugggauuacaggcacaugccaccacac

SEQ ID NO: 270553 - RNA, 64 nt, Human
gggcaguaccugcugggcuuaggacagcgccugaggcugggaauaccugucucugcucuagcag

SEQ ID NO: 270554 - RNA, 64 nt, Human
uaaacaacagaaauuuauguuuuacaguucuggaggcugggaaguccaagaugagggugucaac

SEQ ID NO: 270555 - RNA, 64 nt, Human
augugcucuucuggaagugagaucugccuguccgggcugggacagagacuccccaaggacccca

SEQ ID NO: 270556 - RNA, 64 nt, Human
ccugcaggcagagcuggagcccccagcagaggcaggcugggacggaccagcaucuggaagaugu

SEQ ID NO: 270557 - RNA, 64 nt, Human
agggagccuccccaucuguccagcuggggccagaggcugggagucccuaccugcuucacguugg

SEQ ID NO: 270558 - RNA, 64 nt, Human
ucucauuugcacccauagcccccaucuauggacaggcugggacagaggcagauggguuagauca

SEQ ID NO: 270559 - RNA, 64 nt, Human
caaggcauuguguguuuuguuccgggacugguuuggcugggacaaaguuagaacugccugaagu

SEQ ID NO: 270560 - RNA, 64 nt, Human
ucuugcuucucggugcggacuaaugucagcuuguggcugggaaagagggaugugcagugacgug

SEQ ID NO: 270561 - RNA, 64 nt, Human
cagagauuuacccaucggguaagaugcuccugguggcugggaggcaucaguugcuauauauuaa

SEQ ID NO: 270562 - RNA, 64 nt, Human
ucccgggggccacggcaggggggccgcacagcgcggcugggaccgauucggugacggcccaagg

SEQ ID NO: 270563 - RNA, 64 nt, Human
gacccaguggggaggcggacguuccagccggcauggcugggaacugcagaccuguccuccuggu

SEQ ID NO: 270564 - RNA, 64 nt, Human
caugguggugaauucuguuucuuuccuuuccuaaggcugggacauggugggcaucagggacuuu

SEQ ID NO: 270565 - RNA, 62 nt, Human
cgggaccaaauggauucacugaugugcauuuuucgagauacuuaagguagaaaugauaccaa

SEQ ID NO: 270566 - RNA, 62 nt, Human
aaaaauuugcaagucaaauagaaauguacaaaucgagauaacauuuacauuucuaucauauu

SEQ ID NO: 270567 - RNA, 64 nt, Human; identical to SEQ ID NO: 143553

SEQ ID NO: 270568 - RNA, 63 nt, Human
cucucuuccacaucauccagaagacacacauuugcuauggaaugauuguggaggugagaguau

SEQ ID NO: 270569 - RNA, 64 nt, Human
ugaagcccuggcccaacaggacugugguacuaggggcugggaugugggguuaccacauggagag

SEQ ID NO: 270570 - RNA, 64 nt, Human
aggggaaggaucccucuccucucugccauuucuuggcugggagcugugguccaccucaaaaaaa

SEQ ID NO: 270571 - RNA, 64 nt, Human
auggccuaagacagcaaagacagcacuguuccugggcugggacgcaaggaaugagguccuuuau

SEQ ID NO: 270572 - RNA, 64 nt, Human
ggauagaugugggugugucucaguggggcccccaggcugggaacacacucggaagaucccgugu

SEQ ID NO: 270573 - RNA, 64 nt, Human
ggcagcccuagcaagcuaauacagugguuugagaggcugggaggguugaggggaagauaaacuu

SEQ ID NO: 270574 - RNA, 64 nt, Human
auggaccucugaaucucuuuagggagacacagauggcugggaucccuccccuguacccuucuca

SEQ ID NO: 270575 - RNA, 64 nt, Human
ccaguccgcaaauauuuauugggggccagcccagggcugggacugggcaugagguggucaccag

SEQ ID NO: 270576 - RNA, 64 nt, Human
aggacauggcacuggauggcuggcagagagcccuggcugggaguuagggagcccuggguuggaa

SEQ ID NO: 270577 - RNA, 64 nt, Human
cugcacugucgcgacgcagagaggcuucugugcaggcugggaucgggccccaugucugugcugu

SEQ ID NO: 270578 - RNA, 64 nt, Human
guguuugccgcagcauggaaaacagggcgccuaaggcugggagcuggaagaaggggcauugggu

SEQ ID NO: 270579 - RNA, 64 nt, Human
augguguccuucccuggccuucucuuggcucaaaggcugggagggagggaaggagagaagaguu

SEQ ID NO: 270580 - RNA, 64 nt, Human
ugggcugccuuaguuaguuaugagaacagggaagggcugggaagagacagccuccaaggucaac

SEQ ID NO: 270581 - RNA, 64 nt, Human
ucaccccuccucacugccucuccucucugggacaggcugggaccuuugaggaagauaaagccuu

SEQ ID NO: 270582 - RNA, 63 nt, Human
ccaaaggcgauacuuccagaguucuaguaggcugcuauggaauuucuggcaugaaaauucuug

SEQ ID NO: 270583 - RNA, 63 nt, Human
cagcccgacaccugcuguaauuggggugcaugagcuauggagucagauaguuguugggagggg

SEQ ID NO: 270584 - RNA, 63 nt, Human
aauuuauaauuacaauauguauuuaugucuuuugcuauggagcaaauccaggaaggcaagaga

SEQ ID NO: 270585 - RNA, 63 nt, Human
ucacugcacuuagcuguuggaauguuguuaaaugcuauggaaauacauuuagaaccugcauuu

SEQ ID NO: 270586 - RNA, 64 nt, Human
cgacagcggugaggaucggagggcgcuaugucguggcugggaagaugagcaucuccccuaacac

SEQ ID NO: 270587 - RNA, 64 nt, Human
aucccucauguauacuuggauauggcggggggagggcugggacuguuucguuucugcuucuaga

SEQ ID NO: 270588 - RNA, 64 nt, Human
ugaccgguggguaaaaguccaggccuuugggggaggcugggagagguugggugcucuccugcug

SEQ ID NO: 270589 - RNA, 64 nt, Human
ccucgggaggcuccccagacccuggcaugggaugggcugggaucuucucugugaauccaccccu

SEQ ID NO: 270590 - RNA, 64 nt, Human
acccuagccagggaccggacaccugccccgcccaggcugggacaggcugcaggucucaggauau

SEQ ID NO: 270591 - RNA, 64 nt, Human
ggacgcagccuccauauuuggugcacucaggcauggcugggacaagccagcugccccaggguuc

SEQ ID NO: 270592 - RNA, 64 nt, Human
gggcaguugcugagcagaccgccccacccuccccggcugggagggcucuggagggcccuggagg

SEQ ID NO: 270593 - RNA, 64 nt, Human
ugggaaaaagauuggugcuccugauaaagcaaagggcugggaauacaauggaaaggauuaaaua

SEQ ID NO: 270594 - RNA, 64 nt, Human
agcugccaucugggcuauucugggguagaaggaaggcugggaguggugggaauuuuauaaauau

SEQ ID NO: 270595 - RNA, 64 nt, Human
cucuguguaggucacuggaaagugauugccauagggcugggagagaagcauugcacucuugagg

SEQ ID NO: 270596 - RNA, 64 nt, Human
uggguuugucauagauguauucucuggugaggguggcugggauauaccugacccaccaucuuca

SEQ ID NO: 270597 - RNA, 64 nt, Human
acaggcuuuugggaaguaggguggauguggguagggcugggaggagggggccacagcuuagguu

SEQ ID NO: 270598 - RNA, 64 nt, Human
aggaggagcagaaauugccaacauugcacagccaggcugggagcagccuagggagagcccccau

SEQ ID NO: 270599 - RNA, 63 nt, Human
gcaccaugacugcccaucgagaugccaagaagggcuauggaacuaugcagguggcuagugguc

SEQ ID NO: 270600 - RNA, 63 nt, Human
agguuggaggcccuaggcgcgguucaggucagggcuauggauggggcccaggggcuuuggugg

SEQ ID NO: 270601 - RNA, 63 nt, Human
ggacucagaaaagcugagucuggcuagaccagggcuauggagaucaauuuuuccaacagguca

SEQ ID NO: 270602 - RNA, 63 nt, Human
gcuaugaaauaaaacacgucccuuaacugcauugcuauggaauuaauuuuuuuuccccaggga

SEQ ID NO: 270603 - RNA, 64 nt, Human
acauaacacguagugcagaaacucaugugacauaggcugggaacuuguuucccuuauccauuuc

SEQ ID NO: 270604 - RNA, 64 nt, Human
caagcaccagcuuuucacacaaggagagauguggggcugggaguccucuccccauccuauugca

SEQ ID NO: 270605 - RNA, 64 nt, Human
gcacuuuaaccucucucaucagggcccaagggcuggcugggauuuuuuuuuuuuuuuucccacu

SEQ ID NO: 270606 - RNA, 64 nt, Human
uugaccgaaggcuacauacagaucugugaaucuuggcugggacuuccucugagugaugccugag

SEQ ID NO: 270607 - RNA, 64 nt, Human
caaccuggagucgggggcacagccuuuggggccuggcugggagagggucuuggagcauuagggg

SEQ ID NO: 270608 - RNA, 64 nt, Human
ugaccccaccccuaggaacccccagggaaaaccaggcugggacagcccccuguuccugagaugg

SEQ ID NO: 270609 - RNA, 64 nt, Human
cuguugauuuuuuuuauugcauuuaugauucaguggcugggaauugagaauuuauuugaaauag

SEQ ID NO: 270610 - RNA, 64 nt, Human
gcacaaagaacaacuccucaccaguucauccugaggcugggaggaccgggaugcuggauucugu

SEQ ID NO: 270611 - RNA, 64 nt, Human
ucucucucugggaggggugcaggugcccuccccaggcugggaggguuccuucccuagcucccca

SEQ ID NO: 270612 - RNA, 64 nt, Human
ggcacauggggaggagguucuaauaauuauuuggggcugggaaacuuauuuauugauagcauag

SEQ ID NO: 270613 - RNA, 64 nt, Human
aagcucuugguuuucugggcuggggccuaggcagggcugggaugaggcuuguacaacccccacc

SEQ ID NO: 270614 - RNA, 64 nt, Human
cacccagcaucacacccaggcuugugcggggccaggcugggagcccaugcaguagggcagaagg

SEQ ID NO: 270615 - RNA, 64 nt, Human
acaaaacacuucucuaucaugcagccggagagcuggcugggagcccuuuuguuuuagaacacac

SEQ ID NO: 270616 - RNA, 63 nt, Human
ugauaucuuuaaaacaucuacccuaaaccaucugcuauggacccauaauaagaggccuguugu

SEQ ID NO: 270617 - RNA, 63 nt, Human
auaugucaauguacauuuugaacauauuuaugugcuauggaaggaaaugcuggugacuaaaau

SEQ ID NO: 270618 - RNA, 63 nt, Human
agauuaaccaaaguccaugaucaguucuggaccgcuauggauuccagauccaccuuacguagc

SEQ ID NO: 270619 - RNA, 63 nt, Human
ucuguggaucugcugauguacagugccuuugcugcuauggaucaaaaucaaaagaaccgugua

SEQ ID NO: 270620 - RNA, 64 nt, Human
uccaaugaguccccagcacagaucucaggcuuguggcugggaauaagcccagcugagcaggugg

SEQ ID NO: 270621 - RNA, 64 nt, Human
cccaaaucaaauaucaaccuaccaacaacugccuggcugggaagucuggggaagggauacagag

SEQ ID NO: 270622 - RNA, 64 nt, Human
ccccacgcaggccuggggugucugaggugcucuuggcugggagcggcccugaggggugcuggcc

SEQ ID NO: 270623 - RNA, 64 nt, Human
cuggugucuucuaguuucccccacugggaaugcuggcugggagagccaugacuaccagacuuuu

SEQ ID NO: 270624 - RNA, 64 nt, Human
cucccuccucuguuccccauguggaggucggaggggcugggacuggggagggggcagccaccuc

SEQ ID NO: 270625 - RNA, 64 nt, Human
aggaacaucucccuuccagcaucugcugguagcaggcugggacagucccuuccuucccugaaac

SEQ ID NO: 270626 - RNA, 64 nt, Human
ugaagcccauucuuggaacuaugcaaagggcagaggcugggaguuuggacgcuuagcuccuacc

SEQ ID NO: 270627 - RNA, 64 nt, Human
agagagauguguuuuaaaagcccccaaggaaggaggcugggacugugcccugacaugauucuug

SEQ ID NO: 270628 - RNA, 64 nt, Human
gucuuggugcacuuaggucacuguaagguucuagggcugggagcugggauuugaaccaggaucu

SEQ ID NO: 270629 - RNA, 64 nt, Human
ggaauuccagauccgaauccgacuguggggggcgggcugggaggugggagccgcgucucaggcc

SEQ ID NO: 270630 - RNA, 64 nt, Human
cccagccuacucuguuccacccgugucggggguaggcugggacccucauuucuucugacagauu

SEQ ID NO: 270631 - RNA, 64 nt, Human
gugagcuggggagcuguugaucuuucacuauacaggcugggaaguguguugaugaccacugagc

SEQ ID NO: 270632 - RNA, 64 nt, Human
agccugggcugcgaggcuccauaggagggcugguggcugggaggucgcguccgcacacuucugg

SEQ ID NO: 270633 - RNA, 63 nt, Human
guaaauuuauuuuguguuguucauugaacuuuugcuauggaaacuuuuguacuuguuuauucu

SEQ ID NO: 270634 - RNA, 63 nt, Human
gaacguaaaaugguucagcugcuguuggaaaacgcuauggagguucgucacaaaauucaacau

SEQ ID NO: 270635 - RNA, 63 nt, Human
cccugggaagcauccaguucucaaaucguuuuugcuauggauuuauacuaacaagaacauucc

SEQ ID NO: 270636 - RNA, 63 nt, Human
ggcugccccuguuccuugguccauaacuggugagcuauggagacccaggccaacaaauuaucc

SEQ ID NO: 270637 - RNA, 64 nt, Human
agcaagaaggugaggcaucagggaacgggaaucaggcugggacugaucagaggugaagggacag

SEQ ID NO: 270638 - RNA, 64 nt, Human
caagaacauucauguaggagcccgaggaccagcaggcugggaauggggagcaagucacgucagc

SEQ ID NO: 270639 - RNA, 64 nt, Human
cuggagggagacuggauuugccugcacucuggaaggcugggaaacuccuggaagacaugauaac

SEQ ID NO: 270640 - RNA, 64 nt, Human
gugugagugugcauggcauguguguggcacagauggcugggacgggugacagugugagugcaug

SEQ ID NO: 270641 - RNA, 64 nt, Human
uugacccugaguuuuaaauucgaaaauaaaguggggcugggacacacgaccuccugagccuccg

SEQ ID NO: 270642 - RNA, 64 nt, Human
ugucauaggcaaacuugaauuugauuuaaaauagggcugggaaaaauauucaauaacuguaagc

SEQ ID NO: 270643 - RNA, 64 nt, Human
ucauguuuacauugugacauccagccccaaggauggcugggaguugcucaggcauccaggaaaa

SEQ ID NO: 270644 - RNA, 64 nt, Human
aguggguggcucucgcugcagcuucaaggcugguggcugggacccuccaggggugagaaggaag

SEQ ID NO: 270645 - RNA, 64 nt, Human
ggccacguguagccccagcugucugcaggcaccaggcugggaugagcugugugcuugcgggugc

SEQ ID NO: 270646 - RNA, 64 nt, Human
ggcaccagagccuucccagcaggccaggccgcugggcugggaucaguguuauuuauuugccguu

SEQ ID NO: 270647 - RNA, 64 nt, Human
gccuuggccccagggcgccucucugugccagggaggcugggagagcagcaagggggaccaggug

SEQ ID NO: 270648 - RNA, 64 nt, Human
cugcacugugagaugcaaaguauacagaaucuguggcugggagaaaauuucaucaaauagacaa

SEQ ID NO: 270649 - RNA, 64 nt, Human
ucuaauaucuuucuauuacagaaggggaaacugaggcugggaaaggcuaaaugacuuauccucc

SEQ ID NO: 270650 - RNA, 63 nt, Human
gcuaccuucccagagcaagcaggcugcauuuuagcuauggaagugaccugcugugacacugug

SEQ ID NO: 270651 - RNA, 63 nt, Human
gaacuggcuuuggaaauagcuaucugcccccuagcuauggacucuucacaguuauuuccaguu

SEQ ID NO: 270652 - RNA, 63 nt, Human
uuaaugggcguaaaacagcaucauuguacuuaagcuauggauguuuuuauuuuauauuuucuu

SEQ ID NO: 270653 - RNA, 63 nt, Human
gucaucgcuuauugauauuccuuguuccacagugcuauggaucuuccucagaagaacaugaag

SEQ ID NO: 270654 - RNA, 64 nt, Human
augaaacgugucauugguggaggucugaaugugaggcugggacagagggagagaacaaggccuc

SEQ ID NO: 270655 - RNA, 64 nt, Human
aaacaacagaaacguauugcucacaguccuggggggcugggacgcccaagaucaagaggccagc

SEQ ID NO: 270656 - RNA, 64 nt, Human
uuuuuuuuggagucuuuguugcuauauuuuguggggcugggagagagagauuagauuauuuuga

SEQ ID NO: 270657 - RNA, 64 nt, Human
cccuaccucagcuuaggacccccagagccaagguggcugggaucuggccccacagauggggaaa

SEQ ID NO: 270658 - RNA, 64 nt, Human
gagaccucuguccacugcccagggaggggccuggggcugggagcagucccgguuuagccugagg

SEQ ID NO: 270659 - RNA, 64 nt, Human
cagaccagacuugcuggccugaccacaagggaguggcugggaacucacagccagcauagggaca

SEQ ID NO: 270660 - RNA, 64 nt, Human
uguggagccgccucccggcucggggaggccccggggcugggaacgccugugccuuccugcgccg

SEQ ID NO: 270661 - RNA, 64 nt, Human
gucugugucuagaggagugaaacucccaggguugggcugggaguauuuggugcacgcgguaugg

SEQ ID NO: 270662 - RNA, 64 nt, Human
acaugagaaaugugaacugugauggggugggcagggcugggagaacuuuguacaguggagaaau

SEQ ID NO: 270663 - RNA, 64 nt, Human
cagcuccuucuggucauuuucucagcugguuagaggcugggaggacacgcaaguucagcuccag

SEQ ID NO: 270664 - RNA, 64 nt, Human
agaugagaacuugcgauacuagccugcacccacuggcugggaagaucucuuccugcucccacgc

SEQ ID NO: 270665 - RNA, 64 nt, Human
gaauuaaaugggaguucauuugggcugggguggaggcugggaucagaccguggugggccuucaa

SEQ ID NO: 270666 - RNA, 64 nt, Human
cccaaggaguugcugcaguucuggagccucaucuggcugggaucuccaaggggccuccuggauu

SEQ ID NO: 270667 - RNA, 63 nt, Human
uuucaccccuuuucuuccuucagcagaggccaggcuauggagcagggccacugaauuugcugu

SEQ ID NO: 270668 - RNA, 63 nt, Human
uuuguaauagcuaaagauuagaaacaauuaauugcuauggaacccuuaaaaaagguggcucua

SEQ ID NO: 270669 - RNA, 63 nt, Human
cauguacagcacaaagcguuugcucuaaugugagcuauggacuuuaguuaauaguaacguguc

SEQ ID NO: 270670 - RNA, 63 nt, Human
aagacaaauacacauacauauauacauuuugcagcuauggacaauuuaccacaggaugcauau

SEQ ID NO: 270671 - RNA, 64 nt, Human
aagaaaagagauuuauuuggaucaugguucuggaggcugggagguccaagagcaugguaccagc

SEQ ID NO: 270672 - RNA, 64 nt, Human
ucucccaaacuuguuuuuauagcucugcuugaagggcugggagaugaggugggucuggaucuuu

SEQ ID NO: 270673 - RNA, 64 nt, Human
cacccggugccgaggacauggacgagggacugguggcugggagggagaggagggcccuguccgg

SEQ ID NO: 270674 - RNA, 64 nt, Human
gaaauacugugcuaccuuccagaguucccacaugggcugggauuuuuuuuucuuuuucuuuuuu

SEQ ID NO: 270675 - RNA, 64 nt, Human
gggauuacaggugugagccaccgcgccuggccugggcugggaaucuuuguugacuucuuuggga

SEQ ID NO: 270676 - RNA, 64 nt, Human
gaaggaguggacugcagccuuggccuagccacugggcugggaucuucugggucaugugacugug

SEQ ID NO: 270677 - RNA, 64 nt, Human
cggggcagcggacguuggaagggcgcugggccucggcugggaccguucauguagcagcaaccgg

SEQ ID NO: 270678 - RNA, 64 nt, Human
ccgggcuucggcagucuucuccacugagggacugggcugggaaguccugcguuucaguggagcg

SEQ ID NO: 270679 - RNA, 51 nt, Human
ugcuggugcaggcccugugagggcugggacuaagucacagggaucugcugc

SEQ ID NO: 270680 - RNA, 64 nt, Human
ggacagacauuggggugauuggacaagagggucuggcugggaggugggccagaccuggcagcac

SEQ ID NO: 270681 - RNA, 64 nt, Human
cacagcccccaauggagaccauuguaagugguggggcugggagaggaggaacagaaggaaagcc

SEQ ID NO: 270682 - RNA, 64 nt, Human
gacacccagaagacagugacagauguguuugcaaggcugggauggcucucucaucauacucuug

SEQ ID NO: 270683 - RNA, 64 nt, Human
ccaggaauuagaaguggcaggagagaacaacaggggcugggaauggaggggagaauuucuaggg

SEQ ID NO: 270684 - RNA, 63 nt, Human
ggggucccucaccagcaccucccugacaccugggcuauggagagguuggcgccugucagugac

SEQ ID NO: 270685 - RNA, 63 nt, Human
uccagcccugggacagggcaaacaacugaacuugcuauggaaaggacagugugggaggcuggg

SEQ ID NO: 270686 - RNA, 63 nt, Human
auuacacggagcuggggaaguggcugugucacugcuauggacacggaguggggcgggcaucug

SEQ ID NO: 270687 - RNA, 63 nt, Human
caccuccagacaccagugcgugcucccgaugcugcuauggaaggugcuacuugaccuaaggga

SEQ ID NO: 270688 - RNA, 64 nt, Human
augacugcuucucugagagaacuugcccaucaggggcugggacauggggguguggguaaagaca

SEQ ID NO: 270689 - RNA, 50 nt, Human
agacccuugugguugacuagggcugggagcagagagaagccuggcgcccu

SEQ ID NO: 270690 - RNA, 64 nt, Human
aauaaacagaaauguauuggcucagagcucuggaggcugggaaguccauaguggagggcccaga

SEQ ID NO: 270691 - RNA, 64 nt, Human
agagaaagaggcuaccugcccagggucacagcaaggcugggaccauggcaagcuuggaaccagg

SEQ ID NO: 270692 - RNA, 64 nt, Human
gccuccuucucccugggcuggggacuccagggguggcugggagacugggcagccaccagcaaac

SEQ ID NO: 270693 - RNA, 58 nt, Human
accgugugucuaugaucuaacacgagagggcugggacgguggaagaccaagacaccug

SEQ ID NO: 270694 - RNA, 64 nt, Human
uaaaagaugaccgcguugaaggccaccuccuucuggcugggaggggcagaacuguggacagauu

SEQ ID NO: 270695 - RNA, 64 nt, Human
cucuuucucacuagagacucaaugacagaagagaggcugggacuugguugggcaugcugugguu

SEQ ID NO: 270696 - RNA, 64 nt, Human
uguagguuauuuauuaguauuggaugaaggcgaaggcugggagugucuuucccaccagcccuug

SEQ ID NO: 270697 - RNA, 64 nt, Human
cuggggucacuugggaagaggacuucgggguagaggcugggaggagccccuggacaugccuguc

SEQ ID NO: 270698 - RNA, 64 nt, Human
ggguaaccacccucgccugggcaggggcagccaaggcugggaaaugaggaggccaugcacaggg

SEQ ID NO: 270699 - RNA, 64 nt, Human
gcggucugcggccaguggcccgggggaaagcuggggcugggaagcccgggcgcggcgcgcuggg

SEQ ID NO: 270700 - RNA, 64 nt, Human
ggucugaggaggagggacucuggaguagcagaggggcugggaaagagggggcaggggcugcugg

SEQ ID NO: 270701 - RNA, 63 nt, Human
guggcagaaggaggccccgaguuagaaaaaguagcuauggaggacuacaaggauaacccagca

SEQ ID NO: 270702 - RNA, 63 nt, Human
aauuaaaacuaaugaaguguggccuugucaaaggcuauggagauguuccgggcauacugcugu

SEQ ID NO: 270703 - RNA, 63 nt, Human
cccucugcccaggugaugggcauucccuaagcugcuauggaaucugcucccuuugggguuuug

SEQ ID NO: 270704 - RNA, 62 nt, Human
aucuguuuucaaucuccacugauugcccccuugcuggccagcccaggggccuuuaccauguu

SEQ ID NO: 270705 - RNA, 64 nt, Human
uuuauaaaaucccagaguagaucauaugacuauuggcugggauuaucuccugaagaagauucca

SEQ ID NO: 270706 - RNA, 64 nt, Human
agcucaggcuguagcugcugcccggccugccuggggcugggagccccagacaccgacacccuga

SEQ ID NO: 270707 - RNA, 64 nt, Human
uuuuaguagagacaggguuucaccauauuggccaggcugggacucgaacuccugaccuugugau

SEQ ID NO: 270708 - RNA, 64 nt, Human
auggcacagaaguaggggaagaugggauaggacaggcugggaacagguaaucaggccccuccca

SEQ ID NO: 270709 - RNA, 64 nt, Human
uauaaagauauauagagaugcauucacagggguuggcugggaggaggaagaccauucugugacc

SEQ ID NO: 270710 - RNA, 64 nt, Human
auccagggcugagaaaucguagagcagugaggcaggcugggagcauggaggacagcuuauggaa

SEQ ID NO: 270711 - RNA, 64 nt, Human
guccggagcccuuugccuccuuccucuccccuggggcugggaggcuccauccgaccaaugucug

SEQ ID NO: 270712 - RNA, 64 nt, Human
uuauacccuaguuaguguuuugccucaccuaauaggcugggagacugaagacucagcccgggug

SEQ ID NO: 270713 - RNA, 64 nt, Human
uuccuccuucuuggugugucuggagggugggcaaggcugggagggauaucaacuuggaggagaa

SEQ ID NO: 270714 - RNA, 64 nt, Human
caggaguucuuaaguggggauaguauugguuaguggcugggauaaacuuugaaguuguuugcaa

SEQ ID NO: 270715 - RNA, 64 nt, Human
aguuuacuuuacaugagauggaaucaggcagagaggcugggaugauggagaaagcucgagguga

SEQ ID NO: 270716 - RNA, 64 nt, Human
aguaaaagcacagaauacaaaacccaggggauggggcugggaggggcugugaggggcuggcacc

SEQ ID NO: 270717 - RNA, 64 nt, Human
uggccuccugccucuacugggaaggcuacuucggggcugggaagucguccuuacuccuguggga

SEQ ID NO: 270718 - RNA, 62 nt, Human
acugugauuuuuacaccgaaaagccaaaaggagcuggccauccagggccuagggagaccagc

SEQ ID NO: 270719 - RNA, 62 nt, Human
gucaucaauggcaguucucaugcugucaccaagcuggccaugcaggaguucaugguccuccc

SEQ ID NO: 270720 - RNA, 62 nt, Human
gagcugccaguccauucccaggccaggcugucgcuggccauccauucagucgauucagucau

SEQ ID NO: 270721 - RNA, 62 nt, Human
cccaguaaacccaaaaaaagcaaauggauaaugcuggccauuuugccuuucugacauuuccu

SEQ ID NO: 270722 - RNA, 64 nt, Human
ggcugucuccuuaaggcacugagugggcgggggaggcugggagccggcggcaggauuagcuggu

SEQ ID NO: 270723 - RNA, 64 nt, Human
gagcccaaggagagcggcaggaggggugggaccaggcugggaggacagagccagcagcugccau

SEQ ID NO: 270724 - RNA, 64 nt, Human
agacgggcugaagcgagcccucaggugagcgcggggcugggagucuaaccugcgucauuucagc

SEQ ID NO: 270725 - RNA, 64 nt, Human
gugggauaagcccaggugcaaggggaggagggcaggcugggaacagagcggagaaugcccaugg

SEQ ID NO: 270726 - RNA, 64 nt, Human
uagaaaaccuggccacugguaggagcuagggaggggcugggaagauggcagcucacucaguacu

SEQ ID NO: 270727 - RNA, 64 nt, Human
cagugauuuccuacaguguuguucccucccucaaggcugggaggagauaaacaccaacccagga

SEQ ID NO: 270728 - RNA, 55 nt, Human
cccgagagcuggagccaugaggaggggcugggacuggagcuggagcaggcacuug

SEQ ID NO: 270729 - RNA, 64 nt, Human
uaaugaggccagggcuccuuaucagcuuccaggcggcugggaucucaggcagggugugcgucag

SEQ ID NO: 270730 - RNA, 64 nt, Human
ggagaaagucccuccccagcagcccccuccuccuggcugggaagaauggucccccagcaagcac

SEQ ID NO: 270731 - RNA, 64 nt, Human
uucucuuccagguguugcaguaucucaacaaaauggcugggaaugaauacauggguuucagcaa

SEQ ID NO: 270732 - RNA, 64 nt, Human
ccccauaggccucaggagucaucccagaagcaguggcugggaggugguguccuaaguaaggauc

SEQ ID NO: 270733 - RNA, 64 nt, Human
accucucccagccagggcugagaggauucgagguggcugggaggguuuccaggcccccugcccc

SEQ ID NO: 270734 - RNA, 64 nt, Human
cugcuggugcuggugcaaggacuucuguuccaaaggcugggaaaaacuaagcugucccagcccc

SEQ ID NO: 270735 - RNA, 62 nt, Human
gccgcggccuugggagcaugucacuguguacagcuggccacacacagggaaggagcagcauc

SEQ ID NO: 270736 - RNA, 62 nt, Human
ucugacgacgcugcagccgcagggagggaggggcuggccagagggagaggcagcagggaacg

SEQ ID NO: 270737 - RNA, 62 nt, Human
uguguauuuucagcagagacgggguuugccaugcuggccaggcuggucucgaacugcuggau

SEQ ID NO: 270738 - RNA, 62 nt, Human
cagacggaccagaagccaccuuuuucucccccgcuggccaggggcuccacacagacuaacgu

SEQ ID NO: 270739 - RNA, 64 nt, Human
acacauguauuuugaaacacugaagagcaaaaggggcugggacacucugaacuccugcacucuc

SEQ ID NO: 270740 - RNA, 64 nt, Human
cugaaucaggaaggugguaaucaauaaguauucuggcugggaaagaccgugggcccaaugauca

SEQ ID NO: 270741 - RNA, 64 nt, Human
cugggaaaacccagggugagguucagccugugagggcugggauggguuucgugggcccaagggc

SEQ ID NO: 270742 - RNA, 64 nt, Human
cccggugugguggcuccccaugcaggacgggccaggcugggagugccgccuuccugugccaaau

SEQ ID NO: 270743 - RNA, 64 nt, Human
gcagcaggcugaacaauuccuggaacucaugcagggcugggaauaguuuauguucucagcagcc

SEQ ID NO: 270744 - RNA, 64 nt, Human
aauaagaaugugggagaaccaagagaaaaaguggggcugggagaguggaguucccguagggcau

SEQ ID NO: 270745 - RNA, 64 nt, Human
acggcucugugcuaccccuagguagcaagagagaggcugggaaaaguguggacguggccagagc

SEQ ID NO: 270746 - RNA, 64 nt, Human
auucaggcaacacuccugccucagccucccacguggcugggauuacaggugccugcccccaugg

SEQ ID NO: 270747 - RNA, 64 nt, Human
uaaggagauagagaguagaaugaugguuaccagaggcugggaggcauugaagggauggggaggg

SEQ ID NO: 270748 - RNA, 53 nt, Human
aauucucugccacuuacugagggggcugggaggugucgggcgggacagaaugg

SEQ ID NO: 270749 - RNA, 64 nt, Human
guucaaguaauucuccugccucagccucccgaguggcugggauuagcggcaugcaccaccacgc

SEQ ID NO: 270750 - RNA, 64 nt, Human
uucguuugauuccuggcugaggggucaguuuuauggcugggaggugcagaauuacacagaaguc

SEQ ID NO: 270751 - RNA, 64 nt, Human
acuugcgugcagcuucuccucucagcacacuuugggcugggauggcaguggggcauaauggagc

SEQ ID NO: 270752 - RNA, 62 nt, Human
cgggucaguugaggucaggaguucaagaccaggcuggccaacaugguaaaacccugucucua

SEQ ID NO: 270753 - RNA, 62 nt, Human
ggcaaauaaacucuuuaacaggcaauuauauugcuggccaaaauaugcuauauuuguauaca

SEQ ID NO: 270754 - RNA, 62 nt, Human
ugagaagacagagcacugacaaugagcuggcagcuggccaggaucagggcugucucaagcuu

SEQ ID NO: 270755 - RNA, 62 nt, Human
ugccuggcuccuagauggcucugugggcaggugcuggccaaggacaucaucuaggcaggggg

SEQ ID NO: 270756 - RNA, 64 nt, Human
aaggaggcccagaaguuggaaagagauggaauguggcugggaacauugcaucccaaagagcuuc

SEQ ID NO: 270757 - RNA, 64 nt, Human
gucuugauggccuacgagaggccaaguuccacugggcugggaaaagucacuuugucugucuugu

SEQ ID NO: 270758 - RNA, 64 nt, Human
guucaagcaauucuccugccucagccuucggaguggcugggauuacaggugugcgccaccaugc

SEQ ID NO: 270759 - RNA, 64 nt, Human
aucugaucagacaaggaaugaagcaaugacugugggcugggaaacuguaccuaccucucuuccc

SEQ ID NO: 270760 - RNA, 55 nt, Human
agcagcucgagaagaagugaccaugggcugggaggagguggaggaggaggaagag

SEQ ID NO: 270761 - RNA, 64 nt, Human
caucuguuccaagcaggaggauguggcaggggagggcugggagugaguagcucuguguuuagag

SEQ ID NO: 270762 - RNA, 64 nt, Human
cauuuuguggauauaguuauaaucugaugggccuggcugggaguggaagaagggaagccuuuug

SEQ ID NO: 270763 - RNA, 64 nt, Human
ugaggggaguccuaggcagagcugcugauuguggggcugggagguggagggccccugauucgaa

SEQ ID NO: 270764 - RNA, 64 nt, Human
ggaggcagcgcuggucgucaccugggcggccagaggcugggaucugcgaaguugaacccagaac

SEQ ID NO: 270765 - RNA, 64 nt, Human
acgcaccugugaucccagcuacuuaggagguugaggcugggaggaucacuugagcccaggaguc

SEQ ID NO: 270766 - RNA, 64 nt, Human
uggccccaccagugcuguuuggccuaggaacuguggcugggaaggugccuccaacaaugggauc

SEQ ID NO: 270767 - RNA, 64 nt, Human
ggguagggagugcuaaggaucuggggaaaccaugggcugggaagcugcucuugcucuccucgug

SEQ ID NO: 270768 - RNA, 64 nt, Human
ggaccagggagaaugaccauagggcacuaaguaaggcugggauuggaucagcagaaauccaacc

SEQ ID NO: 270769 - RNA, 62 nt, Human
uuucuuucaauccucauuaucuuuagcccucagcuggccaguacuuauugcuaaagaaaggg

SEQ ID NO: 270770 - RNA, 62 nt, Human
uuguauuuucaguagagacaggguuucacaaugcuggccaggcuguucucgaacuccugagc

SEQ ID NO: 270771 - RNA, 62 nt, Human
aaguuccgaaucccccaugugucucuuucagagcuggccagaccggaaauaaaucauucuca

SEQ ID NO: 270772 - RNA, 62 nt, Human
aacaauuuauuuguggcuuauuuuacccaugagcuggccaauacuuccuggccuagaaaaau

SEQ ID NO: 270773 - RNA, 64 nt, Human
gcucaaaugauccuuccaccucagccucccauguggcugggacuauaggugcaugccaccacac

SEQ ID NO: 270774 - RNA, 64 nt, Human
cccccucuguucugcugauuguagggaugugcagggcugggaguuggcacuccccccgaguggg

SEQ ID NO: 270775 - RNA, 64 nt, Human
cagggcagccgucaccccugccucccgcccccuuggcugggacgucugggguccuguggggccc

SEQ ID NO: 270776 - RNA, 64 nt, Human
uggcaggagaggaggagcagagagcuggguccugggcugggauucgagcccugggcggggguca

SEQ ID NO: 270777 - RNA, 64 nt, Human
cccucucuuuugggagcuucucugggcagaauugggcugggaccucucuccccaacugcccugc

SEQ ID NO: 270778 - RNA, 64 nt, Human
ggcccugcuuccugcuugccaaggcagaggccugggcugggaaaaacuuuggaaccagacucuu

SEQ ID NO: 270779 - RNA, 64 nt, Human
ccucccgagcuccucuuccaugcugugcgcccagggcugggaggaaggacuucccuguguaguu

SEQ ID NO: 270780 - RNA, 64 nt, Human
gcucagguggcacggucccaggguccaggcugagggcugggagcucccuugcgccucagcaguu

SEQ ID NO: 270781 - RNA, 64 nt, Human
uggcuaucuggccuggccucugggcuggggcuggggcugggagcacacacgcugggaccuaugu

SEQ ID NO: 270782 - RNA, 64 nt, Human
uucccugggguaguaggauaauggggaacaguggggcugggaccgggugggagaaagaguucuc

SEQ ID NO: 270783 - RNA, 64 nt, Human
uguggggccauaaguuaaacagugcugccugguaggcugggaacugaagagacuugugguauuc

SEQ ID NO: 270784 - RNA, 64 nt, Human
gacuccgagcgauggagagaaggcacccuagccuggcugggauccucaggaccugaggcuccac

SEQ ID NO: 270785 - RNA, 64 nt, Human
ugucuuucccaguagcuacucaccugccucugguggcugggauucagaugccacaaaacuguca

SEQ ID NO: 270786 - RNA, 62 nt, Human
uuguauuuucaguagagacgggguuucuccaugcuggccaggcuggucucgaacuccugacc

SEQ ID NO: 270787 - RNA, 62 nt, Human
agagggaccaaauugcuucuaggagucaacuggcuggccagucugggucuggguuuggaucu

SEQ ID NO: 270788 - RNA, 62 nt, Human
gugcuuccucacaguuaccaagaauaaagaaagcuggccaccauuguucauugugguuuguu

SEQ ID NO: 270789 - RNA, 62 nt, Human
ccccacagcugagggccuggccuugggguacugcuggccagggguaggauaguauaggaagu

SEQ ID NO: 270790 - RNA, 64 nt, Human
uggcaucagcuggcgucaugcaaagucaugcaaaggcugggaccacgugagaucauucacucau

SEQ ID NO: 270791 - RNA, 64 nt, Human
agaucauucacucauacaucuggccguugauguuggcugggaacucaccuggggcugcuggccu

SEQ ID NO: 270792 - RNA, 50 nt, Human
uccgaaagcggcaucggugaggcugggacccccuucucaagcugguggcc

SEQ ID NO: 270793 - RNA, 64 nt, Human
uccucucugcaacccagcccucuccugagcucuaggcugggauuacacccgcuggagggacacu

SEQ ID NO: 270794 - RNA, 64 nt, Human
ugauuuuacagccccagggaagacagugguaucaggcugggagcggccuccucuggccuccccc

SEQ ID NO: 270795 - RNA, 64 nt, Human
gcccuuucugccugugucagggccaggaaguagaggcugggaacucuucugguccccaguaugg

SEQ ID NO: 270796 - RNA, 64 nt, Human
guauuugcuuggacugacauuugagggaggaggaggcugggauccucuggcugagaaucuccuc

SEQ ID NO: 270797 - RNA, 64 nt, Human
cccaaaugccaacuaggugaaguugugaccaucuggcugggaagcccagguccacacaguguag

SEQ ID NO: 270798 - RNA, 64 nt, Human
gucagugucugccccugaggucuuuuaaguugagggcugggaaugaaaccuauagccuuugugc

SEQ ID NO: 270799 - RNA, 64 nt, Human
uaaucugcaguggauuuggcucucggcacucccaggcugggagcuggauaccugcccuggcagc

SEQ ID NO: 270800 - RNA, 64 nt, Human
uuggccacauuggagaaaaacaggcucaaaguggggcugggaccuggugggugaaccugagcuc

SEQ ID NO: 270801 - RNA, 64 nt, Human
auggccugcccuacugccaaagaggugacaggaaggcugggagcagcuuuguuaaauuguguuc

SEQ ID NO: 270802 - RNA, 64 nt, Human
cgcgggcuccguccucucggcuuccccaugugugggcugggaccgcccacggggugcagaucuc

SEQ ID NO: 270803 - RNA, 62 nt, Human
caggcuuccugaccuaccgccaguggccccuugcuggccacccuauaggguccuccuucccu

SEQ ID NO: 270804 - RNA, 62 nt, Human
gggugaaauccauacuguagacacucugacaagcuggccaaagucacuuccccaagaucugc

SEQ ID NO: 270805 - RNA, 62 nt, Human
gagcccgcgggagccugugaauguugauacgagcuggccaguccugggcccagcucacuugu

SEQ ID NO: 270806 - RNA, 62 nt, Human
gagccaacaugacuguccuuuaaacuccaguggcuggccaggcacgguagcucacgccugua

SEQ ID NO: 270807 - RNA, 64 nt, Human
augacagcugcuuggagacccgugccuuccagauggcugggagaugccucuguggggaugaaau

SEQ ID NO: 270808 - RNA, 64 nt, Human
guccugagcgccugagcugaauacagagggaagaggcugggagcaaggccgggugcuggggccg

SEQ ID NO: 270809 - RNA, 64 nt, Human
ccugacggggaggaaccacugcaccaccgagagaggcugggaugggccugcuuccugucuuugg

SEQ ID NO: 270810 - RNA, 64 nt, Human
gauggcagggcaccuuggggaaggccaagugggaggcugggaggcugccccacccaccgacucu

SEQ ID NO: 270811 - RNA, 64 nt, Human
guuuguuucugaaagggacgcuacccgggaagggggcugggacaugggaaaggggaaguuguag

SEQ ID NO: 270812 - RNA, 64 nt, Human
agugggcccaaugcacuuuguucuggcucuuccaggcugggagagccuuccaggggugggacac

SEQ ID NO: 270813 - RNA, 64 nt, Human
cucaaccucugacugacagggacaugcccuguguggcugggacccagacugucugaccuggggg

SEQ ID NO: 270814 - RNA, 64 nt, Human
cagcaucucagggccacugcuccauugcucugggggcugggaugccuggcuaagcaggggcuga

SEQ ID NO: 270815 - RNA, 64 nt, Human
cccuggaaaggguugacagccagccuuggcauauggcugggagucccuuagcaaggccaacccu

SEQ ID NO: 270816 - RNA, 64 nt, Human
gugcucacagcuguaaucccagcacuuugagguuggcugggaguucaagaccagccuggccaac

SEQ ID NO: 270817 - RNA, 64 nt, Human
cugaccaggcgcccgggauccagcucauccccuuggcugggaacauccuccacugacuuccucc

SEQ ID NO: 270818 - RNA, 64 nt, Human
gaugcuggcaaaucucagcuguugcugaggagggggcugggaccccuucccaucccaaccuuga

SEQ ID NO: 270819 - RNA, 64 nt, Human
ggugagcuacugcccccaaccuacccucuagaggggcugggaagggccguucugggcucaccug

SEQ ID NO: 270820 - RNA, 62 nt, Human
ccaugacucuagcugggcaccuuggaccuccagcuggccaauagaagagacaggagacagga

SEQ ID NO: 270821 - RNA, 62 nt, Human
gucuaagguggggcgggcgacgcgguagacgggcuggccacgcggcucguucccccgcuccu

SEQ ID NO: 270822 - RNA, 62 nt, Human
cccauggucaggagcuauucggguggcaccucgcuggccaggcucucccgagucguggcacc

SEQ ID NO: 270823 - RNA, 62 nt, Human
gcuaagccauguggcagggaccgucuugcccugcuggccacacucuggagaagcacuucuca

SEQ ID NO: 270824 - RNA, 64 nt, Human
ccucagagcguggaauugcugcccuguggacacuggcugggaaggcaggucuuccccuagcaca

SEQ ID NO: 270825 - RNA, 64 nt, Human
ggcccguccggagggagccaucucuugcucccgaggcugggacaguccuuucugugggggcucu

SEQ ID NO: 270826 - RNA, 64 nt, Human
accugacugacuucccaguggaacugccuucuugggcugggacagccccuuuccucugucccuu

SEQ ID NO: 270827 - RNA, 64 nt, Human
ucuugugcuuuugggaggugccaggggagggaagggcugggaugcugggaccuguuguugcugg

SEQ ID NO: 270828 - RNA, 64 nt, Human
cuuaaccauggggcugugaugggaggagaggagaggcugggaaagccgggucucuggggacgug

SEQ ID NO: 270829 - RNA, 64 nt, Human
aauugcaaauaguauuaggcucacuggaaaauguggcugggaagacuguuucauccucuggggg

SEQ ID NO: 270830 - RNA, 64 nt, Human
guggccccuccgcaggcaggacaucccaaccccuggcugggacugaaccacccagagcggagcg

SEQ ID NO: 270831 - RNA, 64 nt, Human
caacccuagcaaaagugcaagauggggagugagaggcugggaauggaggggcagagccaggaag

SEQ ID NO: 270832 - RNA, 64 nt, Human
ccguccccugcccagggcacagcggagccaugggggcugggaguccccaucagaggcagugagg

SEQ ID NO: 270833 - RNA, 64 nt, Human
agagccggccucaugccgaugcggcuuguggcacggcugggaugugagggaggacucagaucua

SEQ ID NO: 270834 - RNA, 64 nt, Human
agggccgcuagccucccugagcuuucuggcuucaggcugggaggcacaguucaggguggacugu

SEQ ID NO: 270835 - RNA, 64 nt, Human
uguaacuucugcacaggcuccuuccugcuuuguaggcugggaagaugccccugggguaggggug

SEQ ID NO: 270836 - RNA, 64 nt, Human
uggugugaaaggcagggauugucagcccaccugaggcugggaggaagcaggaccaggccuagga

SEQ ID NO: 270837 - RNA, 62 nt, Human
cacacaacacgcagagaggacucaagacucccgcuggccauggaguggccugaaagagagca

SEQ ID NO: 270838 - RNA, 62 nt, Human
cguggccauugccaggagcccacccuggucacgcuggccacagcacaaagaacaacuccuca

SEQ ID NO: 270839 - RNA, 62 nt, Human
cccuucucccaacuuuuugaugucccuguagggcuggccagucaggcccagccaaagccccc

SEQ ID NO: 270840 - RNA, 62 nt, Human
uugaugccagcugccauaggaagagggugcuggcuggccaugguggcacacaccuguccucc

SEQ ID NO: 270841 - RNA, 64 nt, Human
cgcgccuggcaucugcuguuucuuucagaagcugggcugggaugagaauuuugggcaaccuccu

SEQ ID NO: 270842 - RNA, 64 nt, Human
cauccugcagcagcugagggggugcccuggcacuggcugggaguggagaggcacuguggugaaa

SEQ ID NO: 270843 - RNA, 64 nt, Human
ggcuggacacccucugccgaguaaugacguguguggcugggaccuucuuuauucuguguuaaug

SEQ ID NO: 270844 - RNA, 64 nt, Human
accucuuggggaguuuaggguggggggggggcgcggcugggaggagggcaggcaucggggagcc

SEQ ID NO: 270845 - RNA, 64 nt, Human
gcaaugucaggcguggcaguggggaagccauggaggcugggaagggcaaaguguggagagagga

SEQ ID NO: 270846 - RNA, 64 nt, Human
agccagauuguuucugaggagagagcuagcuaggggcugggaaaggggagagauuggaguccug

SEQ ID NO: 270847 - RNA, 64 nt, Human
gcauccguguucagguguggacgggacagugaguggcugggaggaagccagaaucaacagcucc

SEQ ID NO: 270848 - RNA, 64 nt, Human
cugggaggcuguggcugccucccucccucagcccggcugggacugucucccggaccccagugcu

SEQ ID NO: 270849 - RNA, 64 nt, Human
uuccgugguauucuaaaauuaggccagcagugggggcugggagggcaucuguguuaguccuuuc

SEQ ID NO: 270850 - RNA, 64 nt, Human
ccugcccacaccaucuaugcucuugguuggugcuggcugggauggcgguucugcccaguggugu

SEQ ID NO: 270851 - RNA, 64 nt, Human
gggggccugcuccucggacucugguuaccucugaggcugggaaaggccuggcugcccacugccu

SEQ ID NO: 270852 - RNA, 64 nt, Human
uccagacccucaccgaccaccuguccugggaccaggcugggaggggaguguggcagggaggagg

SEQ ID NO: 270853 - RNA, 64 nt, Human
accauauacaugccugucugucaauuucugguugggcugggaggccacacacacacacugacau

SEQ ID NO: 270854 - RNA, 62 nt, Human
ggagacaaaagauguacagaaaugauuuccuggcuggccaacugguggccagugggagguga

SEQ ID NO: 270855 - RNA, 62 nt, Human
gaagacuuaugccaucccggcagcgaggcugggcuggccagccaccacugacuauaccaacu

SEQ ID NO: 270856 - RNA, 62 nt, Human
uggccugccacguguggggccaccucuccucagcuggccacccugcacguugugcacugacc

SEQ ID NO: 270857 - RNA, 62 nt, Human
ugugauucgacucuggaugcugugagcuugaugcuggccagggaagcagaggaugugagagg

SEQ ID NO: 270858 - RNA, 64 nt, Human
gugacuucuaggauggacggaaccaugcacagcaggcugggaaaugugguuugguuccugaccu

SEQ ID NO: 270859 - RNA, 64 nt, Human
gaggagguggcuccccuuccccacaccuuagaguggcugggaggguaacaaagagggccugccc

SEQ ID NO: 270860 - RNA, 64 nt, Human
uuaagugacauuuggauuuuuauuugggugggagggcugggacaguuuuucuucuagaaauguc

SEQ ID NO: 270861 - RNA, 64 nt, Human
uucuccaccaccuguccagcuucuuccuggucagggcugggacccccaggaauauuauguugcc

SEQ ID NO: 270862 - RNA, 64 nt, Human
cccucuuuaaggugcuaugccaaccagcccuggaggcugggaucugccgcucccuccagccacc

SEQ ID NO: 270863 - RNA, 64 nt, Human
guugggacuugggccggggccuggaagaaugauuggcugggaggccgcgggagggaggccagga

SEQ ID NO: 270864 - RNA, 64 nt, Human
uggcugccuugugaaggaauuauucccaugaguuggcugggaauaagugccaggauggaaugau

SEQ ID NO: 270865 - RNA, 64 nt, Human
ugcuccugguuucugcuuaggagguggggacuugggcugggauggggacggcauaccccuccca

SEQ ID NO: 270866 - RNA, 64 nt, Human
acuugucuuaggcuccacagcugggaacaaguggggcugggaagcugacuucgugcucuucacc

SEQ ID NO: 270867 - RNA, 64 nt, Human
ccaggacccaggcaguccaccugcaccccuucugggcugggaggaaaccagcuccagauggguu

SEQ ID NO: 270868 - RNA, 64 nt, Human
caucucaggacucacaggccaacauguguuccauggcugggaauugccuaccacccacaucagc

SEQ ID NO: 270869 - RNA, 64 nt, Human
uguccauuugccuuaugcuuuguggagcugauuaggcugggauuugaggugauaauccaguaag

SEQ ID NO: 270870 - RNA, 64 nt, Human
cuccaguguccugagcucagcguggagggguaggggcugggaacagugugcaaggcagccgugg

SEQ ID NO: 270871 - RNA, 62 nt, Human
ccuggcagagaagagaccaagcuuguuucccugcuggccaaagucaguaggagaggaugcac

SEQ ID NO: 270872 - RNA, 62 nt, Human
cuuccauuggggcggagucggggauggagggagcuggccacaacccacugcucugaugggug

SEQ ID NO: 270873 - RNA, 62 nt, Human
augcgagcuggguugcuucccugagggcccccgcuggccaaggccuguggacgacgcuggcg

SEQ ID NO: 270874 - RNA, 62 nt, Human
aagguccuggcaggcagacccggcauguagccgcuggccaucuugaauccuagggcaugaag

SEQ ID NO: 270875 - RNA, 64 nt, Human
accaaaaaaggcgccuggauccccaaaaaaccgaggcugggagcuaguggcccuuuugcuuucu

SEQ ID NO: 270876 - RNA, 64 nt, Human
gcacaguuguaacugcucuuggggaugucagugaggcugggagcagggagccacgggaugcuga

SEQ ID NO: 270877 - RNA, 64 nt, Human
cauugguguuugggauguggacagaggggcagggggcugggagaaggcuaagccgagggguccu

SEQ ID NO: 270878 - RNA, 64 nt, Human
gguagggguucccucuaugucgggcagugcugagggcugggaugcucugugaccccagcuggag

SEQ ID NO: 270879 - RNA, 64 nt, Human
guguuuuaccuuuugauguucagaguggcucacuggcugggaguccuuaccucggggagagggg

SEQ ID NO: 270880 - RNA, 64 nt, Human
gaagccucugguuuuaccaauugcaggucggcuuggcugggagagauggauggcgggaaagggg

SEQ ID NO: 270881 - RNA, 64 nt, Human
uucccugcucugcagcucuggcccaggagcugcaggcugggagggggcagccaagaagccggag

SEQ ID NO: 270882 - RNA, 64 nt, Human
uugagugggagcugacuccaacaugcccugcccuggcugggacuaggcaugcuuccagcccuuc

SEQ ID NO: 270883 - RNA, 64 nt, Human
ccagggugcagagaccuccccacccccgguucugggcugggacccuggcuccagggccaugucc

SEQ ID NO: 270884 - RNA, 64 nt, Human
ccauagucccacuguggguccugcaaugagcaggggcugggaguagaggguuucuggggccuca

SEQ ID NO: 270885 - RNA, 64 nt, Human
cccccagauggcucugucuucuuguguauggcagggcugggacugcugucccuuguacaguuuu

SEQ ID NO: 270886 - RNA, 64 nt, Human
agccacaugagggagcagaggacaaucucugcagggcugggaguggguagggacugaaggucuc

SEQ ID NO: 270887 - RNA, 64 nt, Human
acggcugcccugaccccaggaggcuccaguucugggcugggagcugugaccuccccaacgcuca

SEQ ID NO: 270888 - RNA, 62 nt, Human
ugcuggggcuucagcccgccgcagacuucacagcuggccacaacgagccuguagccaacggc

SEQ ID NO: 270889 - RNA, 62 nt, Human
uggcuagaauccccuuugacuucuagccauaagcuggccacauuggacaucuuggucacugc

SEQ ID NO: 270890 - RNA, 62 nt, Human
cuagggugcucaugccuuaccuaagagaagaggcuggccaagccacaguucugacgcugaca

SEQ ID NO: 270891 - RNA, 62 nt, Human
gcagcuguggaaauaaagcuugugagcccucugcuggccacagugaggaaaguagcacaaau

SEQ ID NO: 270892 - RNA, 64 nt, Human
ccccagcugcugagaaggccuugagggaaguagaggcugggagcaaaugccccaugcggugaga

SEQ ID NO: 270893 - RNA, 64 nt, Human
cguguauguuucugguggaaaccaaguucacccuggcugggagcaucucugaugaggcaugcug

SEQ ID NO: 270894 - RNA, 64 nt, Human
gccaaaguuggccuaaaauuggcgcuggaauuugggcugggaaaaaucuugugguuauuuccuu

SEQ ID NO: 270895 - RNA, 64 nt, Human
agcacaccucaugcugagcgcuguguuaggcacaggcugggauggagcacuucuucugguccuu

SEQ ID NO: 270896 - RNA, 64 nt, Human
cccuuucccacaccuuuguuccucaauagcugggggcugggacugaggccuccugcagguaccu

SEQ ID NO: 270897 - RNA, 64 nt, Human
ccacuuuucuccugggggcugggcuggggguuagggcugggacugugcccccacacugcgccuc

SEQ ID NO: 270898 - RNA, 64 nt, Human
agaggcuagguuguuucugugggugccuuaucagggcugggauacuucugauucuggcuuccuu

SEQ ID NO: 270899 - RNA, 64 nt, Human
cagaaaauuagggucccagaagggggcagcagcaggcugggaguuaggagggagagcagggugc

SEQ ID NO: 270900 - RNA, 64 nt, Human
agcugcccuguguccauggugggugugccgggcuggcugggaacaaggagcaguauguugagua

SEQ ID NO: 270901 - RNA, 64 nt, Human
cggagaggcagguguggcguaaggccucacucccggcugggaaggucucugaucacacagaagc

SEQ ID NO: 270902 - RNA, 64 nt, Human
aaugugccuuuuucagaguuggccaggagcuccuggcugggacacggagaggcagguguggcgu

SEQ ID NO: 270903 - RNA, 64 nt, Human
ccagccaaggucugggagcuauaugggaagugggggcugggaucugggugggaauauguguuug

SEQ ID NO: 270904 - RNA, 64 nt, Human
uuaauaagagugugguagcauuuuucuccaauuuggcugggauuauucaaaguaggguguguau

SEQ ID NO: 270905 - RNA, 62 nt, Human
aucugaacuagacaauggaaauaaugcugcaugcuggccauggcccauucuucaucauuugu

SEQ ID NO: 270906 - RNA, 62 nt, Human
cagccagucugguggagcucagcgucuggcuggcuggccagccugugggucuguugggagca

SEQ ID NO: 270907 - RNA, 62 nt, Human
ccuuugacgcaggcuucucagaaccugguggugcuggccagggaggaugcuggagcggagaa

SEQ ID NO: 270908 - RNA, 62 nt, Human
uaguagagacgggguuucaccaugcaagcccagcuggccacguagguuuuaaagcaaggggc

SEQ ID NO: 270909 - RNA, 64 nt, Human
uuuuuuucagacggaguuucgcucuuguugcccaggcugggagggcaauggcaccgucuuggcu

SEQ ID NO: 270910 - RNA, 64 nt, Human
guuuccucucccaggcucacccaggcucugcucaggcugggaggcagagggcacaaaccuuaua

SEQ ID NO: 270911 - RNA, 64 nt, Human
gugcauguggaggccaggguaaggugaauggggaggcugggaggacugguguugcccuuuggag

SEQ ID NO: 270912 - RNA, 64 nt, Human
aaaaccugauuggccacuggauccugcugcuuugggcugggauggugacuccugaaaccucuuc

SEQ ID NO: 270913 - RNA, 64 nt, Human
gcuaucacuuaucuuuuuaaaacuaaccaaaaaaggcugggauuacaggcaugagccacugcac

SEQ ID NO: 270914 - RNA, 64 nt, Human
cagggggcacagagagagcagggucagcucccucggcugggaccucccuggcauugggagagcc

SEQ ID NO: 270915 - RNA, 64 nt, Human
cagggcuuggguggcgucggggcagggccgccgaggcugggaggaagcccuucugccuuuugcu

SEQ ID NO: 270916 - RNA, 64 nt, Human
guugcagaaggagcaauuaggcugccugccugugggcugggagacagggacaauggggaaaagu

SEQ ID NO: 270917 - RNA, 64 nt, Human
ugugucuggggcuucgauccuugggugcaggcagggcugggacacgcggcuucccucccagucc

SEQ ID NO: 270918 - RNA, 64 nt, Human
uuuuuguuuggccucccugcccccauguuuuucuggcugggagcuccugguuacccccuugucu

SEQ ID NO: 270919 - RNA, 64 nt, Human
guucccuccacucccgaguggccacaggcucgcgggcugggaaggauucacucucuuuagcccc

SEQ ID NO: 270920 - RNA, 64 nt, Human
acugcggccccccacgugaacucgguuguaacggggcugggaagaaaagcagagagagaauugc

SEQ ID NO: 270921 - RNA, 64 nt, Human
uccuggccccaccgccagggggcagcgcaggccgggcugggaggcggcggcggcggcucgggcu

SEQ ID NO: 270922 - RNA, 62 nt, Human
cccugaaccagcccuggaccuuucugagccaggcuggccacaugggguggucucgggguuuc

SEQ ID NO: 270923 - RNA, 62 nt, Human
ccugagcgcaucguccuguguugccccaagcagcuggccaacauguguagagacaggaugcu

SEQ ID NO: 270924 - RNA, 62 nt, Human
uggugcaugagugaucucagccuagcgaugccgcuggccagaccgugaccaugcugccagug

SEQ ID NO: 270925 - RNA, 62 nt, Human
ugguugugguuuuucuaucagggaagucaauggcuggccaguguagugugaagucccagcuu

SEQ ID NO: 270926 - RNA, 64 nt, Human
gccccgggggccgagguagggucgggggcuuagaggcugggauggcuccuggccccaccgccag

SEQ ID NO: 270927 - RNA, 64 nt, Human
ccugagcuugccacagaggcuccgucugacugugggcugggaggagggaggcaggggagagccg

SEQ ID NO: 270928 - RNA, 64 nt, Human
uuaagagaguucauugacaguguuaggaugugaaggcugggaaacacuuauuuugcuucaagag

SEQ ID NO: 270929 - RNA, 64 nt, Human
ucccuaaagcaugcaauaggaaaaagaaccuccuggcugggacugcccaacucuguucugauca

SEQ ID NO: 270930 - RNA, 64 nt, Human
ccuggagcacugggaacaacuggucuccugugauggcugggacuccucgcgggaggggacugcg

SEQ ID NO: 270931 - RNA, 61 nt, Human
aaggcggggccaaggcuugagcgccccccauggcugggagcccgaagcucggagccagggc

SEQ ID NO: 270932 - RNA, 64 nt, Human
cacacacugcgccagugacacauaguuacuuccuggcugggacggcaccuauagaaacuagggu

SEQ ID NO: 270933 - RNA, 63 nt, Human
ggcgcaccggggacagcugaucccuuacccccaggcugggaugcggccacaaagcacgucuau

SEQ ID NO: 270934 - RNA, 64 nt, Human
cccugggcccuuccuaucagaaggacauggugaaggcugggaacgugaggagaggcaauggcca

SEQ ID NO: 270935 - RNA, 64 nt, Human
ucacuuucauucuguauucuuccccccaccauguggcugggaggacuugggagggggaugggga

SEQ ID NO: 270936 - RNA, 64 nt, Human
cuguggggugucucagggugggcaguggggguggggcugggacgcuguuugugcucagcgggga

SEQ ID NO: 270937 - RNA, 64 nt, Human
agccugggucccugccuccgcucugccccuggguggcugggaggagaggcccucucggggguga

SEQ ID NO: 270938 - RNA, 60 nt, Human
ggcagccggaauucgugugagcugggguggggcugggaccacagguggcuucucucuugc

SEQ ID NO: 270939 - RNA, 62 nt, Human
gugguacuggcacccaaguucagcauggcagagcuggccaacagcuugugguccccgaucug

SEQ ID NO: 270940 - RNA, 62 nt, Human
ggcauaacaugaguguacuaacuaccuucuaugcuggccaugcuacagauuuucuggaggua

SEQ ID NO: 270941 - RNA, 62 nt, Human
aacagcucauggucaugcaugagagagaaguggcuggccacagccagagggaacaguaacag

SEQ ID NO: 270942 - RNA, 62 nt, Human
gucuguaaacugauucugggagaaaccaagcugcuggccauaggguguccuuggguacaucc

SEQ ID NO: 270943 - RNA, 64 nt, Human
gaggggcucggcugccucauccccuggcgggggaggcugggagcugggccuccugcguggggug

SEQ ID NO: 270944 - RNA, 64 nt, Human
ccccuucauuccugcugcuaccccuggucccgagggcugggaguaccuggggccccaucccccc

SEQ ID NO: 270945 - RNA, 64 nt, Human
gcuccacugugaaucggcggcacgcgccgcaggaggcugggacugguccaguuuguacugucga

SEQ ID NO: 270946 - RNA, 64 nt, Human
uccccggggucugggcggagagaacaggaggaauggcugggaaguggcugagggagccaggagg

SEQ ID NO: 270947 - RNA, 64 nt, Human
auguggaccucacugcucccccaacccagcgucaggcugggacacgccaacgcuguuccggguu

SEQ ID NO: 270948 - RNA, 64 nt, Human
uugagcugauagagaaaaaacggccuucagcccaggcugggaagcgccuucuccaggugccucu

SEQ ID NO: 270949 - RNA, 64 nt, Human
gccaccgucacacaguauuuauuguucccacaauggcugggagggggcccuuccagauuggggg

SEQ ID NO: 270950 - RNA, 64 nt, Human
cugcaggagagugccuggcaaaaagaucaaauggggcugggacuucucauuggccaaccugccu

SEQ ID NO: 270951 - RNA, 64 nt, Human
ugggagugugugugcccaggugggggugucuccuggcugggaaggagggaaagggagggagagu

SEQ ID NO: 270952 - RNA, 64 nt, Human
aggucccagauaccaaguggcgccucccaggaaaggcugggagaagagguggccuggaguaccc

SEQ ID NO: 270953 - RNA, 64 nt, Human
ccagccugggggggacucuaccaaggucuucuugggcugggaaagcccauguagggcaggccuu

SEQ ID NO: 270954 - RNA, 64 nt, Human
gggggcgcuggaggacugcggggaucuagggccuggcugggaagaggcggggagaugucucugu

SEQ ID NO: 270955 - RNA, 64 nt, Human
agacccugcugugguuggcuugggguggccaaugggcugggacccuccaugagaguuuuggaca

SEQ ID NO: 270956 - RNA, 62 nt, Human
agagacuaucuguucaaguagaaaacccaagagcuggccaggugugguggcucaugccugua

SEQ ID NO: 270957 - RNA, 62 nt, Human
uaagggggugcagcagugagggguauaucugggcuggccaguuggaaccacggagaucuccu

SEQ ID NO: 270958 - RNA, 62 nt, Human
ugcagcuggagggcaacaggcugccgggccccgcuggccacgccgcucccaucaccgcaggc

SEQ ID NO: 270959 - RNA, 62 nt, Human
aggcaggagcagucgccuuucccacccacagcgcuggccacagggcucccugcagggucagg

SEQ ID NO: 270960 - RNA, 64 nt, Human
ugcccugaaaauuggacuuaagaugccaugucuuggcugggauuacaggcaugagccacugcac

SEQ ID NO: 270961 - RNA, 64 nt, Human
ccgggccguccacccacccgcccgcccagggcugggcugggaucggaggccgugagccucccgc

SEQ ID NO: 270962 - RNA, 64 nt, Human
cuagaccagaguguuugaaccuccuuugcaggagggcugggaauccucuuuagagcacuuaauc

SEQ ID NO: 270963 - RNA, 64 nt, Human
ccguccaccgucucuccuuuguuucccagcaucuggcugggaugugaagggcagcacucccugu

SEQ ID NO: 270964 - RNA, 64 nt, Human
ccagcaaacugcaguggcagaaaggagguucagaggcugggaaagugggccuccccuugcaacu

SEQ ID NO: 270965 - RNA, 64 nt, Human
aggugggccaugaaaggagaggauggauagggauggcugggaaauggagaucacugaaguacac

SEQ ID NO: 270966 - RNA, 64 nt, Human
guucucuuuuuguauuuugcaucugaccccggggggcugggacagauuggcaaugggccguccc

SEQ ID NO: 270967 - RNA, 64 nt, Human
auccaccugggucacuuugagaguugugcaggggggcugggagcacugguguucacgugggacc

SEQ ID NO: 270968 - RNA, 64 nt, Human
ggauucccacgcccaccacugucccccaccccauggcugggaggggccucugaacggaacagug

SEQ ID NO: 270969 - RNA, 64 nt, Human
gcacagcuucacgcccuggauccaggcccacgggggcugggagggcauccuggcuguuucaccc

SEQ ID NO: 270970 - RNA, 64 nt, Human
uuucuccucucccuugauucggccuccuggccagggcugggacauccucccugcuguccucucu

SEQ ID NO: 270971 - RNA, 64 nt, Human
ccuugcugcagucccuccggagaggaucuggacuggcugggaguggggagggcguggagacagu

SEQ ID NO: 270972 - RNA, 64 nt, Human
gggccucgacuugccauugguuggggucguacggggcugggagcccugcguuuugaggcagacc

SEQ ID NO: 270973 - RNA, 62 nt, Human
uucacugagcaccaagcuuaugccaggucugugcuggccacucucauauaccucuucagauc

SEQ ID NO: 270974 - RNA, 62 nt, Human
gucaccuuguccaucuggaggugaugucaauggcuggccaugcaggaggggugggguagcug

SEQ ID NO: 270975 - RNA, 62 nt, Human
uggccccggagccccauccugggccugcccuggcuggccaggaccccagcgguucuuggucc

SEQ ID NO: 270976 - RNA, 62 nt, Human
ucugccucugaacuucaaaguggagguggagugcuggccacgucuccaccuaacaacccucu

SEQ ID NO: 270977 - RNA, 64 nt, Human
ugaugucugcaaagucugugcuguccgugccccaggcugggagagcuaucuggggagggggaga

SEQ ID NO: 270978 - RNA, 64 nt, Human
cacccgcggagagcgcugaaccuggacaagcagcggcugggaaggacagguccaauaaacgccc

SEQ ID NO: 270979 - RNA, 64 nt, Human
uggggaccacgucuuccugagguuggugcccacuggcugggacccuuugcagugggguggccuc

SEQ ID NO: 270980 - RNA, 64 nt, Human
ucaaacugucacauuagggauacaaaaaugaacaggcugggagugguggcucagccuacaaucc

SEQ ID NO: 270981 - RNA, 64 nt, Human
agaggcucccggagacugcagccuccugugguugggcugggagccggcaggguuuggggugugg

SEQ ID NO: 270982 - RNA, 64 nt, Human
cgcccaguguguuuuaagcaugaggcauccgcguggcugggagaggcuuugaccauccuuggcu

SEQ ID NO: 270983 - RNA, 64 nt, Human
ccccaugcucuucccuccccucgaguguggguagggcugggacugccgugcgugucacuccugc

SEQ ID NO: 270984 - RNA, 64 nt, Human
ugcauugggccucacccggagcagacgagggcagggcugggaaggauggggagggacauagagg

SEQ ID NO: 270985 - RNA, 64 nt, Human
ccuuuuacaggugaaacucggggcuguccauagcggcugggaccccguuucauccauccaugcu

SEQ ID NO: 270986 - RNA, 64 nt, Human
acacucuccaggcaccaugggcggaggcgccagaggcugggaagaaauaauguuuuaguuaaga

SEQ ID NO: 270987 - RNA, 64 nt, Human
uguuguagauuucaucugcuuccuccuuagggaaggcugggauaugaugagagauuccagccca

SEQ ID NO: 270988 - RNA, 64 nt, Human
cccagaguuaagcacuggaugucuccugaucccaggcugggaccccuacccccacccccuuuga

SEQ ID NO: 270989 - RNA, 64 nt, Human
cucagcggagccccgggaguguccaagacagccuggcugggaaaggggguguggaaagagcagg

SEQ ID NO: 270990 - RNA, 62 nt, Human
ugagcugauucacauucugaaggaccucucuagcuggccagugcugaggagguuggagagag

SEQ ID NO: 270991 - RNA, 62 nt, Human
uccacggacccagcucuguggagggcaugacugcuggccagaagcuagugguccuggggccc

SEQ ID NO: 270992 - RNA, 62 nt, Human
uggagaagaaccugcagauucuuccauccucagcuggccauggcccacagcucugcaucugc

SEQ ID NO: 270993 - RNA, 62 nt, Human
aaucacagauaauacauggccaguaaucccaggcuggccauucauucagguuuuuuaaagga

SEQ ID NO: 270994 - RNA, 64 nt, Human
acccgccccuuccucaccucuuccuuauuccauaggcugggagagaaacucucucugcuucccu

SEQ ID NO: 270995 - RNA, 64 nt, Human
gggacaguuccauggcccuucccggacugcacuaggcugggagcucuguuguguggaggggugg

SEQ ID NO: 270996 - RNA, 64 nt, Human
uuucgcggcggcggcggcggcagccccggagggcggcugggagcugagcguggcgcaagcgggc

SEQ ID NO: 270997 - RNA, 64 nt, Human
gaagggagguggccucccgccaacgcaucacuggggcugggagcagggaaggacggcuugguuc

SEQ ID NO: 270998 - RNA, 64 nt, Human
guucaagccauucuccucccucagacuuccgaguggcugggauuacaggcgcccgccaccacac

SEQ ID NO: 270999 - RNA, 64 nt, Human
gugaaccucaccuccuggggcuuccgagcuacagggcugggaccaggucaugcagcugaaaguc

SEQ ID NO: 271000 - RNA, 64 nt, Human
agccugacugugccuuccagggccugggaccauuggcugggaccccucauuaaccaaccaagca

SEQ ID NO: 271001 - RNA, 64 nt, Human
gccagggguggcugaguuggagggcaagggcuggggcugggaugggagggugaagaugcccaag

SEQ ID NO: 271002 - RNA, 64 nt, Human
cacccuuccacuuccaucugggagccccaagaggggcugggaaggggggccauagcccaucaag

SEQ ID NO: 271003 - RNA, 64 nt, Human
aucagugcucucuuaaggaggaaaaaaacggugcggcugggagcgguggcucacgccuguaauc

SEQ ID NO: 271004 - RNA, 64 nt, Human
aggggcccccaaaacuugguuggagagcugaacaggcugggacugaggaaaggauaaaccccga

SEQ ID NO: 271005 - RNA, 64 nt, Human
cccgccccuuccccccagguuagcaauugggaauggcugggaggggguguccccaagacacugg

SEQ ID NO: 271006 - RNA, 64 nt, Human
guuuaaaaugucuuuggacucccagggcugagugggcugggaucucguguccucaaaguggaug

SEQ ID NO: 271007 - RNA, 62 nt, Human
guuccaaacaacaccaccgagaucucccucaggcuggccagguuuugcagcuggaauucucc

SEQ ID NO: 271008 - RNA, 62 nt, Human
cuaucaaauaccuaaggaguccccaggagcuggcuggccaucgugauaggaucugucugucc

SEQ ID NO: 271009 - RNA, 62 nt, Human
cacccaccccacgacccgugacuacugugcaagcuggccaggagguagguggagggcaaggc

SEQ ID NO: 271010 - RNA, 62 nt, Human
cuuugcaggaccugaugagugacccuucuggagcuggccagguccucugcagcaggcaagac

SEQ ID NO: 271011 - RNA, 64 nt, Human
ggggcaagggauucugcucauguguuugcagaccggcugggauagccuccccaccccuuaucag

SEQ ID NO: 271012 - RNA, 64 nt, Human
cccagccuuccaaggugaggccaucucaucugcaggcugggaggcagggcuggacucaggaacc

SEQ ID NO: 271013 - RNA, 64 nt, Human
ggugccaugcccugaagaggcaggguacacauggggcugggagggcaaagauggggcggggccu

SEQ ID NO: 271014 - RNA, 64 nt, Human
ucaggucagccacucccuggagacacagccuucuggcugggacugacuuggccauguucucagc

SEQ ID NO: 271015 - RNA, 64 nt, Human
ugcauccccagcugucucccugaggcuccgcccuggcugggagccucuggcggccccuccccuc

SEQ ID NO: 271016 - RNA, 64 nt, Human
cccagggcagccucguuaggacaaggcugugccaggcugggaggcucggggcuccccacgcccc

SEQ ID NO: 271017 - RNA, 64 nt, Human
uccugccuccugggcuauuccucuccacccagaaggcugggaaucccagcugauucccugacag

SEQ ID NO: 271018 - RNA, 64 nt, Human
ggaggaggacacagcacaagggcacauugcccauggcugggaacaugacccagccugaaagaua

SEQ ID NO: 271019 - RNA, 64 nt, Human
aucucacuaaccacccaccccuaccuggaauggaggcugggagauguggcuuauuugcugggua

SEQ ID NO: 271020 - RNA, 55 nt, Human
cacaaaacagugccuucuagagccgggcugggaauggggacacgguguccaccau

SEQ ID NO: 271021 - RNA, 61 nt, Human
uuugcaugagcauccugugagugggagagugggcugggaugugcauccugcuucccaacuc

SEQ ID NO: 271022 - RNA, 64 nt, Human
ugacucacuuaacccgucuccuuuaagugagcugggcugggaggcuuccuacaggggaagaggc

SEQ ID NO: 271023 - RNA, 64 nt, Human
aggauaucaucuuuucuaaucucuuuuuucaacuggcugggacauuuucggaagggggaagucu

SEQ ID NO: 271024 - RNA, 62 nt, Human
uggcucuccucuggcuagagugggaagagggggcuggccauggggcccucccagaaccucag

SEQ ID NO: 271025 - RNA, 62 nt, Human
aauuaggagugcugauaagaaugaauauagaugcuggccagcauuuucauucauuuuaagga

SEQ ID NO: 271026 - RNA, 62 nt, Human
cguggaggaagcugggguacaaggggcccagugcuggccacacagcagcgcagccgagcccc

SEQ ID NO: 271027 - RNA, 62 nt, Human
gcauggcccgccacagccacucaggccuccgugcuggccagccccccaaguggugaugccca

SEQ ID NO: 271028 - RNA, 64 nt, Human
agucagcugccagcccugcggaaccagagccucaggcugggauggggaggccucccugcuucca

SEQ ID NO: 271029 - RNA, 64 nt, Human
uguggacucugggaccugcagcucugccuuugcuggcugggaggugcacacgcgagguauaggc

SEQ ID NO: 271030 - RNA, 64 nt, Human
aagcuuugucugccucucgggaggaaggccguggggcugggacccuguggugggcaagugggug

SEQ ID NO: 271031 - RNA, 64 nt, Human
gaguuugcaaccacaguauuccuuugucugucgaggcugggaggguagccgugagcgugguggg

SEQ ID NO: 271032 - RNA, 64 nt, Human
ggugaucaagugaaggaaaaaccugagccuaucuggcugggaugguggaauuaagcacaagguc

SEQ ID NO: 271033 - RNA, 64 nt, Human
cuggcuuacacuggcaaugguaguuucugugguuggcugggaaaucgagugccgcaucucacag

SEQ ID NO: 271034 - RNA, 64 nt, Human
gucaccuauugcccccagaggccucugaaccccaggcugggaccccagcacagaggcaauaaag

SEQ ID NO: 271035 - RNA, 64 nt, Human
cgcgcagcucaguuagagacggagaaagggaagaggcugggauggucucugcugcucuugccuc

SEQ ID NO: 271036 - RNA, 64 nt, Human
agugugcccaggagucugaucugcugggguacagggcugggagaaccccuagcucucccggggu

SEQ ID NO: 271037 - RNA, 64 nt, Human
agugcuuaggcccaauaucugacagccucaggugggcugggaccuaggaagcuccaucuugaag

SEQ ID NO: 271038 - RNA, 64 nt, Human
accaauagacgaggggagaccccauggauccucuggcugggaagccacugaccagguggccagg

SEQ ID NO: 271039 - RNA, 64 nt, Human
aaccguagcuucccaccaggcugccaccugugugggcugggaaauguuuaagaggucucauagu

SEQ ID NO: 271040 - RNA, 61 nt, Human
uuuguaugagcauccuaugagugggagagugggcugggaugugcauccugcucccugaacc

SEQ ID NO: 271041 - RNA, 64 nt, Human
auauaauugccugcuuacugcaugccaggcauugggcugggaauuuuuauauuggaucuaaaau

SEQ ID NO: 271042 - RNA, 64 nt, Human
cgguuuccguggcaacccucagcugccucaucguggcugggaagggaaggaagcaagccggcag

SEQ ID NO: 271043 - RNA, 64 nt, Human
acaaugaaugaccuacaacagcuaaauuuucuggggcugggaguaauacugacaauccauuuac

SEQ ID NO: 271044 - RNA, 64 nt, Human
aacgcauaaagaaaaauggccgggccaggucauuggcugggaagucucagccaugcacggacuc

SEQ ID NO: 271045 - RNA, 64 nt, Human
aaucacaguccgugagucuuccagcugccaccacggcugggacacgcugggggagggcuccucc

SEQ ID NO: 271046 - RNA, 64 nt, Human
uucagaauuaauucccaaucccccauuccaccagggcugggagcccauucccagugcuucccaa

SEQ ID NO: 271047 - RNA, 64 nt, Human
uuuugugggacucagaaagggaagcagaacugagggcugggauauuccucaugguggcagcgcu

SEQ ID NO: 271048 - RNA, 64 nt, Human
auuauccccuauaaccaacacucaacuacaaauaggcugggauucaauguggagugguggauuu

SEQ ID NO: 271049 - RNA, 64 nt, Human
accucagaguggagaggcagaaaccaugugcagaggcugggagaugcugcuguuuccagaggcg

SEQ ID NO: 271050 - RNA, 64 nt, Human
gcaccuccugucaaaaccaugccugagaggucccggcugggagugacagggugcuucuuagauu

SEQ ID NO: 271051 - RNA, 64 nt, Human
aggacaccuccuuccucaguccuggaagccggccggcugggaucaagaaggggacagcgccacc

SEQ ID NO: 271052 - RNA, 64 nt, Human
agccucccauccagggcccccaucucaugccccuggcugggacguggcucagccagcacuuguc

SEQ ID NO: 271053 - RNA, 64 nt, Human
aggaggaggaagaggcagagaaggaggagaccagggcugggaaagaaacuucucaagcaaugaa

SEQ ID NO: 271054 - RNA, 64 nt, Human
gggguguugaccucgccucaccuuucacagaccagaccggcacaggcuuugagcucauuauaac

SEQ ID NO: 271055 - RNA, 64 nt, Human
ggcaggcgggauguguuggccacagggagaggcggaccggcacccggugggaccuccuaggacu

SEQ ID NO: 271056 - RNA, 64 nt, Human
gggccugagugaccuccuucugcaaaguggcagggaccggcagagcucuacaggccugcagccc

SEQ ID NO: 271057 - RNA, 64 nt, Human
aucauucucguggggcugccaugagcguccccaaggcugggagcaugggcccucgugugaucgu

SEQ ID NO: 271058 - RNA, 64 nt, Human
gccuguagccguucccugcugguugagaguugggggcugggaagggcggggcccugccugggga

SEQ ID NO: 271059 - RNA, 64 nt, Human
ccuugucguccuggacaccacaggggcaccugcaggcugggagaccagguccucugugcauggg

SEQ ID NO: 271060 - RNA, 64 nt, Human
gauuccaggccugggguuagcagccugugcccccggcugggagaucagacccgguguugguccu

SEQ ID NO: 271061 - RNA, 64 nt, Human
aaggaaaguggaugcuccuuugaggcaggcgaggggcugggaguggguagccgucauguugucc

SEQ ID NO: 271062 - RNA, 64 nt, Human
acccuucaacaugccugguuuaggcagcagcuugggcugggaagaggugguggcagagucucaa

SEQ ID NO: 271063 - RNA, 64 nt, Human
ugcagcccagguccccacugcucucacacccuuaggcugggaccucccucccuccucugguguu

SEQ ID NO: 271064 - RNA, 64 nt, Human
accggcuccuugguccaguucugcaccgggguggggcugggacccggggaagguuugagggccc

SEQ ID NO: 271065 - RNA, 64 nt, Human
aggcucugagcccugaaccaaagucccagagcugggcugggacgugaccugugcugagggcugu

SEQ ID NO: 271066 - RNA, 64 nt, Human
uaggagacuuaggacagagcugacccuugcaccaggcugggaggcugcagcccuuuuagaugcc

SEQ ID NO: 271067 - RNA, 64 nt, Human
cuuacccucuggggccucagcuuucccuccggaaggcugggaggaggugggcuagaugaucuuu

SEQ ID NO: 271068 - RNA, 64 nt, Human
uaacuauuucaguugugagccuucuagggccccaggcugggaggcucagaggacugaaucuggg

SEQ ID NO: 271069 - RNA, 64 nt, Human
acuaaaucucugguguccauguuccgagcccgguggcugggaugguggcucgaugugucuccuc

SEQ ID NO: 271070 - RNA, 64 nt, Human
cuuucccaugguccucacuggccucagucucccugaccggcagugugaggggauguagcuauag

SEQ ID NO: 271071 - RNA, 60 nt, Human
ucauccuggagaucgagugaucuugccccagaccggcagccuggccauccccaagccuuc

SEQ ID NO: 271072 - RNA, 64 nt, Human
gggugagcagagugggaggccggagacugcccuugaccggcaaaugcccugcaacgguggcucc

SEQ ID NO: 271073 - RNA, 64 nt, Human
gggacaugggaccuuacgcuugugggggucugcgggcugggaacucucguccucgguccccagg

SEQ ID NO: 271074 - RNA, 64 nt, Human
ugaaagcccugguccugaugcucccuguaaagguggcugggagagaagccagccaggcugcacu

SEQ ID NO: 271075 - RNA, 64 nt, Human
gcccaguugugaauaucaaggugacccugccccuggcugggagcuccccuggggcucuggaacc

SEQ ID NO: 271076 - RNA, 64 nt, Human
cuggcgccaggggcaggcagcuaggcagggagggggcugggaaagaacuuggacuucuaaaggc

SEQ ID NO: 271077 - RNA, 64 nt, Human
cgugggcaccgggccgucucagccguguucccagggcugggaggacagcucuggcccuucuuag

SEQ ID NO: 271078 - RNA, 64 nt, Human
gagaacagaggggacaugaacuccuuggaggcagggcugggaagggacccugggcugugucucc

SEQ ID NO: 271079 - RNA, 64 nt, Human
agcaaugaaaccuguucaugucuaagagcagcugggcugggaaucuuccccuuuguucaaggcc

SEQ ID NO: 271080 - RNA, 64 nt, Human
aggagcuguaggugccggcagaggggcagagcuaggcugggaggagcccagggccugcaccacc

SEQ ID NO: 271081 - RNA, 64 nt, Human
ggugggagcugggcagaccccucuaccuccuccaggcugggagacagagucaggcuguugcgcu

SEQ ID NO: 271082 - RNA, 64 nt, Human
gcucaagugauccucuuaccuuagccuccugcguggcugggacuacagauguuugccaccaugc

SEQ ID NO: 271083 - RNA, 64 nt, Human
uuuugccagccuguucucugacuaacgccauccaggcugggaggggaagagugcucugcuacac

SEQ ID NO: 271084 - RNA, 64 nt, Human
guucaagcgauucuucugccucagccucccuaguggcugggauuacaggcgccugcuaccaugc

SEQ ID NO: 271085 - RNA, 64 nt, Human
cccacucccucugcccucugcuccguucccugggggcugggacuaaagaaauggguguccccca

SEQ ID NO: 271086 - RNA, 64 nt, Human
gagugcaccgaggagggaaggauggcuaagcugggaccggcaguccucacagggugccugugag

SEQ ID NO: 271087 - RNA, 64 nt, Human
ggauagcggguggugagggaaggggcacgugcuagaccggcacgcccucgccgcgugcugcgcu

SEQ ID NO: 271088 - RNA, 64 nt, Human
cuaaccccgccuuccagcacuuucugucauuccaggcugggaaagucuagagcccccuuuggcc

SEQ ID NO: 271089 - RNA, 64 nt, Human
augccaaggacaggacuuggaccgcuucagccugggcugggagcagcccuaagguagaggccuc

SEQ ID NO: 271090 - RNA, 64 nt, Human
ccucugguggcuccuccuaggaaaccagcucgugggcugggaaugggggagagaagggaaaaga

SEQ ID NO: 271091 - RNA, 64 nt, Human
uguagcucucuggcucaagacgggguggggaaggggcugggagccaggguacuccaaugcgugg

SEQ ID NO: 271092 - RNA, 64 nt, Human
ucagggcuugacaggcccaggcucagcccgccguggcugggaagguucccugcagugccagugc

SEQ ID NO: 271093 - RNA, 64 nt, Human
cucucugaccucagcuccuagacccuggacccuuggcugggacucagcauuuuccagucuuuuu

SEQ ID NO: 271094 - RNA, 64 nt, Human
augggaacacgagaaguuugauggcuuugcccugggcugggaauaccucacccacgcccaguuc

SEQ ID NO: 271095 - RNA, 64 nt, Human
cugccucaucacggcggcgaggcuacgacaauccggcugggagcaugaccuuggcgucuguucu

SEQ ID NO: 271096 - RNA, 64 nt, Human
acggucccgacccgcgggcgaggccggguaccugggcugggauccggagcaagcgggcgagggc

SEQ ID NO: 271097 - RNA, 64 nt, Human
ccugggaaguuggagcaagaggggcauacuauugggcugggaggauuugacagcauuuccccag

SEQ ID NO: 271098 - RNA, 64 nt, Human
gugaaccaugucggaauuguuagguagaaaccugggcugggaggccucggaccccaggcuccau

SEQ ID NO: 271099 - RNA, 64 nt, Human
acugauuuuuaaaaagaaguaauuuuucucccugggcugggaaaacccuaaugaacugaaacac

SEQ ID NO: 271100 - RNA, 64 nt, Human
ccauccuggggcagggaaggacagaguguuggauggcugggacggggccuugcucuugucggcc

SEQ ID NO: 271101 - RNA, 64 nt, Human
ggagggguagccauuagggucuuucaaaacucuuuggaucuaagcauuugucucuccuuaagug

SEQ ID NO: 271102 - RNA, 64 nt, Human
gcuauugaguuugcuguguugaagcuauuaaacauggaucuauaagcagcaggaagauuuuuuc

SEQ ID NO: 271103 - RNA, 64 nt, Human
ggggaggaugcugagugagcaguuuccuaccccguggaucuagcaagccauggagacagguagc

SEQ ID NO: 271104 - RNA, 64 nt, Human
ucaaauugagguggugacuuuuguuggaaaauugggcugggaucacguccuguuuuguaauaaa

SEQ ID NO: 271105 - RNA, 64 nt, Human
acuucuaaauuuugggagcuccuccaucuccaauggcugggauuuguggcagggauuccacuca

SEQ ID NO: 271106 - RNA, 64 nt, Human
gaaggcagugcagagcuggccagcccuggagguaggcugggaccaagcucugccuucacagugc

SEQ ID NO: 271107 - RNA, 64 nt, Human
ugccccaccugggaccaucacacgugaagcaccaggcugggagaugaggugcacacaguugcag

SEQ ID NO: 271108 - RNA, 64 nt, Human
ucagggcacuuuccagaauucucucauauuugugggcugggaucaagccugcagcuugaggaaa

SEQ ID NO: 271109 - RNA, 64 nt, Human
ggcagauguaaaguuauucuugaagucagauugaggcugggagacagccguaguagauguucua

SEQ ID NO: 271110 - RNA, 64 nt, Human
cccguggagaauuggccagagccuguggccccgaggcugggacacuguguggcccuggacaagc

SEQ ID NO: 271111 - RNA, 64 nt, Human
cagcccugcucaugaggcagcaaacccugcaaagggcugggacugguggccuuaugucaguugu

SEQ ID NO: 271112 - RNA, 64 nt, Human
acaucacuucucucuucuaguuuuucugaacacuggcugggaaauguaaacuguguaugcauau

SEQ ID NO: 271113 - RNA, 64 nt, Human
uuguauucagucuuuuaggugauacaccagagggggcugggaauugucucuuuguuccuauaag

SEQ ID NO: 271114 - RNA, 64 nt, Human
cuaagaaggagaguugagauuuccuccucccucuggcugggauauggagcuuuggagguucaga

SEQ ID NO: 271115 - RNA, 64 nt, Human
cauggauauagagaguagaaggaugguuacuaguggcugggaaaaggggugugcgaggggaacu

SEQ ID NO: 271116 - RNA, 64 nt, Human
caaaguaauauucaaaggggauguuuggggguggggcugggaccggguggcuuuauauugauaa

SEQ ID NO: 271117 - RNA, 64 nt, Human
uauucuaucauuugguuuuaaaauaugagugccuuggaucuauuaaaaccacaucgaugguucu

SEQ ID NO: 271118 - RNA, 64 nt, Human
uuauuaacuggcuacugggaaauuacuuauuuucuggaucuaucuguauuuucauuuaacuaca

SEQ ID NO: 271119 - RNA, 64 nt, Human
caccaccaacagccauucaucaucugaucucugcuggaucuacagacaccgaugcagaccacuc

SEQ ID NO: 271120 - RNA, 64 nt, Human
ucaugauuagaauuagacugcaaagcacgucaugggcugggauugagaacuccauguugcucug

SEQ ID NO: 271121 - RNA, 64 nt, Human
ugaagugccuuuucccgaggcuggggcuggggguggcugggaggggaagggaagggagaggcaa

SEQ ID NO: 271122 - RNA, 64 nt, Human
cuugccccacgccgcugcuccuuucaccuuuguaggcugggaaucgcuguguuauuugcaaaga

SEQ ID NO: 271123 - RNA, 64 nt, Human
ucauggucucugacuuuggacucuccaaaauccaggcugggaacaugcuaggcaccgccugugg

SEQ ID NO: 271124 - RNA, 64 nt, Human
gccuggcagaaguggaacuccccucuccacugauggcugggaagggaguuggggaggaagagug

SEQ ID NO: 271125 - RNA, 64 nt, Human
cuucccccucccccagccacuccccagccagccuggcugggacugggaacagaacucggugucc

SEQ ID NO: 271126 - RNA, 64 nt, Human
uccucuccaaagaacagaggucaggaaaaacacuggcugggacgcuagaagggucauguguuaa

SEQ ID NO: 271127 - RNA, 64 nt, Human
gaaacuauuuugaauguuuccaacuggcucaauuggcugggaaaacaugggaacaagagaagcu

SEQ ID NO: 271128 - RNA, 64 nt, Human
auguccccagagaggcacccccaggcaagcucgagggggccacaccgugucccagggagcccag

SEQ ID NO: 271129 - RNA, 64 nt, Human
ggcgaggccugacacaggccagccuuggcacgaggggggccagggguucugagaagcgcugccc

SEQ ID NO: 271130 - RNA, 64 nt, Human
uccagccuggcguccagggccacagccauggccugggggccaagccucacccugcggugcccua

SEQ ID NO: 271131 - RNA, 64 nt, Human
ucuuagcuuccacucccuuguguguauucuggcugggggccagauuggggaagcccuucucccc

SEQ ID NO: 271132 - RNA, 64 nt, Human
guggguguaguacaacaaagugauauuaaauuacuggaucuaguaacaugaaacacacaacgua

SEQ ID NO: 271133 - RNA, 64 nt, Human
uuaacagaccuaggguuuugagccauauugccauuggaucuaguaugucugucuugaccccuca

SEQ ID NO: 271134 - RNA, 64 nt, Human
gcugaugaguaggacauuuagagguggcagugucuggaucuaccuugguaggagggagucagua

SEQ ID NO: 271135 - RNA, 64 nt, Human
gacaccuccagccauacagaaaccaacacugugugggggccaaggucugauccuuauguuaaua

SEQ ID NO: 271136 - RNA, 64 nt, Human
guaggaaucuccccaaccaaucugugaauuucaugggggccaaaacuguauuuugcucacugcu

SEQ ID NO: 271137 - RNA, 64 nt, Human
ccaggcacuaccugcuggcucccaccuaugguuugggggccauaccuguuccagcucuguuccc

SEQ ID NO: 271138 - RNA, 64 nt, Human
gucugagcccagccucaggaggggccaagaaccagggggccaucaaaagcaucgggauuuggca

SEQ ID NO: 271139 - RNA, 64 nt, Human
gcaugccagcuaugugguagggccagcccaccaugggggccaagaccugcacaggacaagggcc

SEQ ID NO: 271140 - RNA, 64 nt, Human
ggauggggacggcugcgggcaucugcaggguggagggggccaccauccaguguagggcacaacc

SEQ ID NO: 271141 - RNA, 64 nt, Human
ccuuguggcucugguaauguuugguaccaaacuugggggccaaaaagggcagugcucaggacuc

SEQ ID NO: 271142 - RNA, 64 nt, Human
aguacuaauccuguucuucucuccucuaauccccgggggccaagcuggggagggauguggaggg

SEQ ID NO: 271143 - RNA, 64 nt, Human
gugaccagcuuccuccagaccccuguggcagaccgggggccagacacagauacauggggaacug

SEQ ID NO: 271144 - RNA, 64 nt, Human
ugccgggaccauguguuggugaagcuggugcugugggggccacucacucgaaugacaccuggag

SEQ ID NO: 271145 - RNA, 64 nt, Human
cgacccgcacacacacccacacugcugcccuggcgggggccaugggggugaugaaugacccucc

SEQ ID NO: 271146 - RNA, 64 nt, Human
cucauaauuccugaaauguguggugccagggcaagggggccaucacugcagucaggcccucaga

SEQ ID NO: 271147 - RNA, 64 nt, Human
cuucauagcuucucugcuuggcaaagagaugggagggggccagauacugacuaccugggguagg

SEQ ID NO: 271148 - RNA, 64 nt, Human
uacccagcuguuauacauguuuucaguucucuuugggggccauguccuacauuugcauggaugg

SEQ ID NO: 271149 - RNA, 64 nt, Human
gccgcaugcagagcucgcgugggcuugccuucgugggggccaggacgggaggcagggugggggg

SEQ ID NO: 271150 - RNA, 64 nt, Human
ugauuaaaaaaucagagaacuuucccauucuguuuggaucuauagaacauccagaguaagugau

SEQ ID NO: 271151 - RNA, 64 nt, Human
uauuuuguuagcaacuucuagauguuuaucuucauggaucuaugauugaccuccuaguaaaauu

SEQ ID NO: 271152 - RNA, 64 nt, Human
uggagccagguugucgggccccgaaugucacugguggaucuaagaagggcugaguggucugaca

SEQ ID NO: 271153 - RNA, 64 nt, Human
cucagcuccuuggagagggccugccugggacugagggggccagggcugggucaggauucaccag

SEQ ID NO: 271154 - RNA, 64 nt, Human
agccccugcucaggucugaguauggcugggagucgggggccacaggccucuagcugugcugcuc

SEQ ID NO: 271155 - RNA, 64 nt, Human
aggaugaagacaugcuugaggagccacggaguuugggggccacagcaccugggcacacacccga

SEQ ID NO: 271156 - RNA, 64 nt, Human
uucccaaugucugcuuacucugaggcuuggcacugggggccagggccugccccagggcuccugg

SEQ ID NO: 271157 - RNA, 64 nt, Human
cccagcacaagcugccaggccugagcuacuugaagggggccaucuagguccccaacccauggac

SEQ ID NO: 271158 - RNA, 64 nt, Human
cuacugcugacuaacaugaugcacauaaccaaaugggggccaauggcacaguaccuuacucauc

SEQ ID NO: 271159 - RNA, 64 nt, Human
auggugugugauuuuuauuuucuucuuuggucaugggggccaaggagaaaggcaugaaucuucc

SEQ ID NO: 271160 - RNA, 64 nt, Human
aaggaaaauuuuaagccaggauaguuaaccguuagggggccagugggagaaugcuugccuugca

SEQ ID NO: 271161 - RNA, 64 nt, Human
cagaauuaaagacaccagaaguagcagagaagcagggggccagagcuacaacaguauucuucuc

SEQ ID NO: 271162 - RNA, 64 nt, Human
gcugugaacuggcuggcagguucugcacgugggugggggccagggccugggcuuuacucaauug

SEQ ID NO: 271163 - RNA, 64 nt, Human
gggagaggaacagcccucuguucccaagucccuggggggccaaacuuuugcagugaauauuggg

SEQ ID NO: 271164 - RNA, 64 nt, Human
gcugcaacguagcccucuguucugcacacagcacgggggccaaggaugccccgucccccucugg

SEQ ID NO: 271165 - RNA, 64 nt, Human
cuggaaugacuagagggagccaagaggauggggugggggccagggccccccagggccuaucgug

SEQ ID NO: 271166 - RNA, 64 nt, Human
cugacacauggauguaccuaucuuggugaugggugggggccaagaauugagcaugacaucuucc

SEQ ID NO: 271167 - RNA, 64 nt, Human
cagaguccacauugccuguuucuuguguacaugggggggccacagagaccuggaaagagaacuc

SEQ ID NO: 271168 - RNA, 64 nt, Human
uaugcauuuauauucaucagugcugcccucacuuuggaucuauuguauucuuacaguuuaauca

SEQ ID NO: 271169 - RNA, 64 nt, Human
uuuggaauuuaaugcuugacuucuuuguucauuuuggaucuaaacuucucuuuucuuccuuccc

SEQ ID NO: 271170 - RNA, 64 nt, Human
ccccuuuugaaacucaguuuugugccaaguccucuggaucuaauuaccuuaaacaagcagauuu

SEQ ID NO: 271171 - RNA, 64 nt, Human
ugugcaaagcuguaaucucauggacuagaggagagggggccaaggggauggacaggagaaguca

SEQ ID NO: 271172 - RNA, 64 nt, Human
aauuuccaaagcagccugugaaguccuaggggcugggggccacucuugcggcaagcagaaggcc

SEQ ID NO: 271173 - RNA, 64 nt, Human
gggagagaaagguggugcugcagugguggcccuggggggccauucgauucgccucaguugcugc

SEQ ID NO: 271174 - RNA, 64 nt, Human
cugauucaaccaaauggcgaagucagagacuaucgggggccauggagacacucugggccauuuu

SEQ ID NO: 271175 - RNA, 57 nt, Human
aaaaccagucugcgguuuagggggucagggggccacagagaaggggcagcugagccc

SEQ ID NO: 271176 - RNA, 64 nt, Human
gauggccuccucuugacaggcggacagggggugagggggccagggggcaucuccaaaggaagcu

SEQ ID NO: 271177 - RNA, 64 nt, Human
uccagccgagcuuaggaauucgcuuccaggccgugggggccacauuucaccuccuuaguccccc

SEQ ID NO: 271178 - RNA, 55 nt, Human
gucuguacacaggcgagugagcucagggggccaccugugcuccccccgcuacccu

SEQ ID NO: 271179 - RNA, 64 nt, Human
ggaguuaaccaaguuuggugcaggagcaggggcagggggccacuguagugagcguggagaaauu

SEQ ID NO: 271180 - RNA, 64 nt, Human
cacgggaagccuccgucaggagagacgcagcccugggggccagcuggugcugcaaggaagggug

SEQ ID NO: 271181 - RNA, 64 nt, Human
uccugauuuaagaagccuggguuucuucaugguggggggccauuuggaaugacagccucacuuc

SEQ ID NO: 271182 - RNA, 64 nt, Human
gaugauuauugauugugagauagguuagguuuuggggggccaguaguucagugagaauguuuau

SEQ ID NO: 271183 - RNA, 51 nt, Human
cuguccacucagaguucugaagggggccagauguugggugcagauguagaa

SEQ ID NO: 271184 - RNA, 64 nt, Human
aagccugugugacuguggcagugccggaggccaagggggccaagaggaaaagcaucuguggucu

SEQ ID NO: 271185 - RNA, 64 nt, Human
ggaaauauacugggguccccagauucugcucuaagggggccagacccucugccaggcuggauug

SEQ ID NO: 271186 - RNA, 64 nt, Human
aagguauguuuuucuuuuuuaaaaaagcugcuguuggaucuagaaggugaagaauuuuuuuaug

SEQ ID NO: 271187 - RNA, 64 nt, Human
ggggugcguggaggagaggccugggcuccucuacuggaucuacacucugucccagguuuuuaga

SEQ ID NO: 271188 - RNA, 64 nt, Human
gauauacauuuauuugaauaauguguaacuauuauggaucuauuuuaaugaacaauuuuuacca

SEQ ID NO: 271189 - RNA, 60 nt, Human
gcagccggaaucggcaaugacccccacccagggggccagcgggagcagggccugcaugag

SEQ ID NO: 271190 - RNA, 64 nt, Human
augugcucugguggaacaaguugggagaggcugggggggccaagggcacagguuacggggguuc

SEQ ID NO: 271191 - RNA, 64 nt, Human
ggauugcagggggcggcugagagaaaaccuccuugggggccagggauucccuuucccacucuga

SEQ ID NO: 271192 - RNA, 53 nt, Human
gcaaggaggccuacaucuagggugggggccacucaccgacccgacacucucac

SEQ ID NO: 271193 - RNA, 64 nt, Human
cuagcgcuaaccuaggaaccgccgcugccugcuggggggccacgccccucaugcccuuguccca

SEQ ID NO: 271194 - RNA, 64 nt, Human
cuaggaacaccuguacuugaaguggaggaggcuagggggccacaguugcugcuucauuaacaua

SEQ ID NO: 271195 - RNA, 64 nt, Human
acugagggggugggcuuacucccugggcagucuugggggccagagcugaggccaguccauauua

SEQ ID NO: 271196 - RNA, 64 nt, Human
gagccaggcccccagaaccccuggcuccaggccagggggccagucccugaggcagguccccaga

SEQ ID NO: 271197 - RNA, 64 nt, Human
uaauucucugaaagaugaauucacauaugaaaaagggggccaccuuaucuuaguuccagaauuu

SEQ ID NO: 271198 - RNA, 64 nt, Human
uauacaccucaugcuuaugcaaugggaagaauaugggggccagggggugugguacuaccuucag

SEQ ID NO: 271199 - RNA, 64 nt, Human
uuaggaacagcuuuuugcccuuagcacuaugcuugggggccauuuuaaacagugaaaucaaaaa

SEQ ID NO: 271200 - RNA, 64 nt, Human
aacugaagcaugccuuggagagagcagacacugugggggccagggccaucucccuuuaaugugu

SEQ ID NO: 271201 - RNA, 64 nt, Human
cauguccauaacacaagagagcgcugcauuguuugggggccaggcauuacuacuaucaugaaga

SEQ ID NO: 271202 - RNA, 64 nt, Human
uuggugggacaugaggccucaguggguggugagagggggccaugggccuugugggaggauaucu

SEQ ID NO: 271203 - RNA, 64 nt, Human
ugucccaaaacuggcacuagaaguggcugggcaggggggccagagucauaggaagggucuugga

SEQ ID NO: 271204 - RNA, 64 nt, Human
uuugugauauuuuaucauuuucuagauucuuauguggaucuaauaacgaccacuugaacccagu

SEQ ID NO: 271205 - RNA, 64 nt, Human
ggaggccacccucuacaaagcuuuauagaacuucuggaucuaacucacaaacaagcuuccagaa

SEQ ID NO: 271206 - RNA, 64 nt, Human
uuuaaccacccaguaccauacuuuuuucuugaucuggaucuacuugucaauuucuucuuuauuu

SEQ ID NO: 271207 - RNA, 64 nt, Human
cuccuugcccaggcaggaggcuggggugcugugugggggccaaugcacugaaccuggacuuggg

SEQ ID NO: 271208 - RNA, 64 nt, Human
aauaccccaccccggcuccucugcacccagagcugggggccaccucagaagugucaucucucuc

SEQ ID NO: 271209 - RNA, 64 nt, Human
accuggcugccccucaccuugggcugggggacuggggggccauuuccuuuucucugcccuuuuu

SEQ ID NO: 271210 - RNA, 64 nt, Human
auucuggucauuucccccaaaggcaucccagccugggggccaguggggaacugagggcaagggg

SEQ ID NO: 271211 - RNA, 64 nt, Human
cacagccuccucuuggucugaguaggcaucaugugggggccagaucugccugcuguuuccaugg

SEQ ID NO: 271212 - RNA, 64 nt, Human
aguccacaugacaguguccugccugguuggcagcgggggccaucaccuguggccucugagaccg

SEQ ID NO: 271213 - RNA, 64 nt, Human
uugcacugagggaagggaaagggugaggauuuuggggggccacccaagucauaguccaaucucu

SEQ ID NO: 271214 - RNA, 64 nt, Human
ggcugguuagcggaugugggaggcugugaccccagggggccauagggugcgguggaacugcagg

SEQ ID NO: 271215 - RNA, 64 nt, Human
gguuagggcucuggaggugcuuucacucaaccaagggggccacagcacuggggagugaaacugc

SEQ ID NO: 271216 - RNA, 64 nt, Human
cuaaaagcacacagggucugcuauuccugaggcugggggccagagaagcuuuuacgcauggaaa

SEQ ID NO: 271217 - RNA, 64 nt, Human
uucugauuuggaaaaagagagggagguauggacugggggccagaguccuuuccaaggcuucucc

SEQ ID NO: 271218 - RNA, 64 nt, Human
auuaaugaaagaugaaaauaggaagugcccuggagggggccagcaggucacggggcagaaucuc

SEQ ID NO: 271219 - RNA, 64 nt, Human
ggcaaaguugguuugcagcaagaagauagugggagggggccaggcugcaggagaaggagaaaag

SEQ ID NO: 271220 - RNA, 64 nt, Human
uuagaaaaccagaacggauuucauuucuaauggagggggccagagaugggaaaauuucuuguuc

SEQ ID NO: 271221 - RNA, 64 nt, Human
ugcugagcccacucucccgagggcgcauccaagcgggggccacuugagaagugaauaaaugggg

SEQ ID NO: 271222 - RNA, 64 nt, Human
aacugucaaagacgacacuggagaagagccaagcuggaucuauaaggaauugcauaugagaugg

SEQ ID NO: 271223 - RNA, 64 nt, Human
ugcaugccaggcauugggcugggaauuuuuauauuggaucuaaaauaacucuuaaguuaggcau

SEQ ID NO: 271224 - RNA, 64 nt, Human
agugcauuuucauuauuuggguaggugaccugcuuggaucuagacagcaucuguucaaaguugu

SEQ ID NO: 271225 - RNA, 64 nt, Human
uguugggcacuagggcagguuccgugccagagucgggggccacacgagggccuggugccgguga

SEQ ID NO: 271226 - RNA, 64 nt, Human
auguucuugccucugacaguagcuuauuugcucugggggccaggaauuggauucaguuuacacu

SEQ ID NO: 271227 - RNA, 64 nt, Human
uggggcgaggggauaggccgaguuccggguguaagggggccauuagggagagcagagcgaggca

SEQ ID NO: 271228 - RNA, 64 nt, Human
guagugagcaggacggguaccaugcugcccugaagggggccacagccuggguggaaggcagacc

SEQ ID NO: 271229 - RNA, 64 nt, Human
aggaggccuugcauuaccucacugggaccuguuugggggccaucccugcgguccacccucugaa

SEQ ID NO: 271230 - RNA, 64 nt, Human
ccauccugaaagccaagaacgcagggaugucgcugggggccaagggcgccgccggcccucugcc

SEQ ID NO: 271231 - RNA, 64 nt, Human
ugugagacaggacgcagcgggccccugguggccugggggccagacccgugggcagguggggcau

SEQ ID NO: 271232 - RNA, 64 nt, Human
caaagguugaggggagggcaggauucgugcaucugggggccaaacacauguuccgucuugauug

SEQ ID NO: 271233 - RNA, 64 nt, Human
ucuugugcuucuacuuuguaccaaacuuuaaaaggggggccagggauauauaaagauaaauaug

SEQ ID NO: 271234 - RNA, 64 nt, Human
acauuuuuuaccuggugguuaugagcauggacuugggggccacagugacugaguuugauucccg

SEQ ID NO: 271235 - RNA, 64 nt, Human
gauucuccuuccuccugcuacugauaccaggcgagggggccaaggguggaucccucagagagag

SEQ ID NO: 271236 - RNA, 64 nt, Human
acucccuccccacccagaacccagaugggguggagggggccaccggggcagggagggggcggca

SEQ ID NO: 271237 - RNA, 64 nt, Human
cagugcuggugucagggcacucaacaccgagugugggggccacgccccuugccaugcccacggc

SEQ ID NO: 271238 - RNA, 64 nt, Human
ccuaacugaagggaaugggggcccugcucaagaagggggccaggcagcuggaaucaggggagug

SEQ ID NO: 271239 - RNA, 64 nt, Human
aguuuugguauuugguaguggaggguggggggaugggggccagcagcugucauccuccugggaa

SEQ ID NO: 271240 - RNA, 64 nt, Human
ggcucugcaaauaaaauaauguaaccuauuaucauggaucuaauguacuguaacuuuaucagug

SEQ ID NO: 271241 - RNA, 64 nt, Human
caggaagcccagagagggcaaagggccuaccucggggcgcgaaccaugccccagacuauuaucu

SEQ ID NO: 271242 - RNA, 64 nt, Human
ggaagggccgcucacugcacgguggggcgaugcugggcgcgagccguguuuccgucuauuguug

SEQ ID NO: 271243 - RNA, 64 nt, Human
aucaccugaaggugccaaggaggaaggcugagaggggggccaccccauuucugguacccaauuu

SEQ ID NO: 271244 - RNA, 64 nt, Human
ggcugggucaaaagagcccuggcucugccccucagggggccagcuggggagaugggggcuucuu

SEQ ID NO: 271245 - RNA, 64 nt, Human
acgcagcacgggugccagugugcaugcgugugcugggggccaaaugacagaaccccgguugaaa

SEQ ID NO: 271246 - RNA, 64 nt, Human
auccaagagggacuccaagcccuggggcaggguggggggccauguucccagaaccuugaugggg

SEQ ID NO: 271247 - RNA, 64 nt, Human
cccuuguccccuucagguuggugaaaaggacuccgggggccaggugcuguauagcagcuuaugg

SEQ ID NO: 271248 - RNA, 64 nt, Human
cccuggugggggggcagccucggaacugggaguggggggccaggggccuuccuaaccuuccauc

SEQ ID NO: 271249 - RNA, 64 nt, Human
cacaguggcucacacauguaaucacagcacuuuggggggccaagguggguggauugcuuaagcc

SEQ ID NO: 271250 - RNA, 64 nt, Human
agccuguguccaccuccagucucggcuuuccccggggggccaagcgcacugggcugccgucugu

SEQ ID NO: 271251 - RNA, 64 nt, Human
aacuuaaaaguaagaaguagugguucauccaucagggggccagaagcagcaacuguuuuucaua

SEQ ID NO: 271252 - RNA, 64 nt, Human
gcuaccacgggucugccaugcucuggaggagcaagggggccacauccccaccccagcuguuacc

SEQ ID NO: 271253 - RNA, 64 nt, Human
ucucugccgccucaguuugucugcuggucucuuggggggccaggcccugcacgucucuccuacc

SEQ ID NO: 271254 - RNA, 64 nt, Human
cuugggcugugccugcaaagcuugugcaggaccugggggccaggucgaccuucaaguggcuuuu

SEQ ID NO: 271255 - RNA, 64 nt, Human
uggagaaggggcccaauguguguugacgauggcugggggccagguguuucuguuagaggccaag

SEQ ID NO: 271256 - RNA, 64 nt, Human
ggugcuguaaacagguuugggcaguggugggggagggggccagagaggcggcucagguugccca

SEQ ID NO: 271257 - RNA, 64 nt, Human
ccagcagggugguggggacuccugagcccagccugggggccagagcaccccaggaccccggggg

SEQ ID NO: 271258 - RNA, 60 nt, Human
ucauagaccguggcuauaaccauaacgagaccgcccuagagaaaaagauucugaaggaac

SEQ ID NO: 271259 - RNA, 60 nt, Human
uuaguuuugcauggcuguuugacugccuuuccgcccuaugaaaaucaagaaaaucuuuuu

SEQ ID NO: 271260 - RNA, 60 nt, Human
cauuauacuccauaccugcuuuucccauggccgcccuacggaaaaucccauccacagagg

SEQ ID NO: 271261 - RNA, 64 nt, Human
gugcuguggggcauaacgaugaggcgcuggccuugggggccacaccaggucgcagcaaauggcu

SEQ ID NO: 271262 - RNA, 64 nt, Human
gugugguggcucaugccuguaaucccagcacuuugggggccaaggaggguggaucacuugagau

SEQ ID NO: 271263 - RNA, 64 nt, Human
cagccaagggggacugcaagggacagggaugagugggggccaccaggcucagcgcaagaggaag

SEQ ID NO: 271264 - RNA, 64 nt, Human
aguaugaagccaaagcaggaccucggccgguguggggggccaacuguagcucaggagccucguu

SEQ ID NO: 271265 - RNA, 64 nt, Human
agcccgaacucccagagcucacccgcgggugaccgggggccagcccaggagggcgggugguuug

SEQ ID NO: 271266 - RNA, 64 nt, Human
agcccccucuuccucccugggggccccaggaugggggggccacacgcugcaccuaaagccuacc

SEQ ID NO: 271267 - RNA, 64 nt, Human
gaaauagggugggcuccuuuccucagguagaguggggggccaaaaccucugcaguccccggcag

SEQ ID NO: 271268 - RNA, 58 nt, Human
cccacccaccugcagagugacggagggugggggccaccugccugcgucuuccgccccu

SEQ ID NO: 271269 - RNA, 64 nt, Human
cucccaccccgccuacuguccaugcggccucacugggggccaucagccucaccagcaaagcaga

SEQ ID NO: 271270 - RNA, 64 nt, Human
ugugcagugcacgugagagcacguggcggcuucugggggccauguuuggggagggaggugugcc

SEQ ID NO: 271271 - RNA, 64 nt, Human
gcucccccugacuguagcacggaguguuggggcugggggccagcuccaggagggcuugagagcu

SEQ ID NO: 271272 - RNA, 64 nt, Human
cgcagaggcgccccccuccauccucccccaucccgggggccacggcaggggggccgcacagcgc

SEQ ID NO: 271273 - RNA, 62 nt, Human
uugaugggauuauucguuaaaugcgaguguuugggggccacggagagaagggagagcucgug

SEQ ID NO: 271274 - RNA, 64 nt, Human
cuacacaagcugacagcggaugguaugacucauugggggccauugauggaacaaucuuaccaca

SEQ ID NO: 271275 - RNA, 64 nt, Human
cuagaacaagccagagccgcacccuggcuggaaugggggccaggcugagccgaucuggucucgu

SEQ ID NO: 271276 - RNA, 60 nt, Human
caaggaaaagaggaaaaaaaaaacagaggcccgcccuaccccacuccugccccuccguuu

SEQ ID NO: 271277 - RNA, 60 nt, Human
gcaggaaugaaugacguccuuccuaacaguccgcccuacuucccccgcuuuggacaggug

SEQ ID NO: 271278 - RNA, 64 nt, Human
ccacaggagggccgcccgccaccaagccucaccugggggccacagggacacugcucugccugcc

SEQ ID NO: 271279 - RNA, 64 nt, Human
ccugugcucagagaaaugauaagacuacaaaugcgggggccagggcucaaggcucccaggauag

SEQ ID NO: 271280 - RNA, 64 nt, Human
cacaguggcccaugccuguaaucccagcacuuuggggggccaaggcaggcuggaucaccugagg

SEQ ID NO: 271281 - RNA, 64 nt, Human
agcaggacacagccuuggaucaggacagagacuugggggccauccugccccuccaacccgacau

SEQ ID NO: 271282 - RNA, 64 nt, Human; identical to SEQ ID NO: 271281

SEQ ID NO: 271283 - RNA, 64 nt, Human
cuccugcaacugacccaguccgcaaauauuuauugggggccagcccagggcugggacugggcau

SEQ ID NO: 271284 - RNA, 64 nt, Human
cuggcucgacccaggacuuggguugaggaugcacgggggccaccuugcccggggccacuggugg

SEQ ID NO: 271285 - RNA, 64 nt, Human
gccaccgccccugcaggagcuuggguccucaucugggggccaugcacaggcccgucccacccug

SEQ ID NO: 271286 - RNA, 64 nt, Human
cuguugcaacuccucccagccagccagguuugcugggggccaggcuggguguccucacaggagu

SEQ ID NO: 271287 - RNA, 64 nt, Human
aacaugauaggauuccuuaagauguuaccacccagggggccacaagccagccugcugucucagg

SEQ ID NO: 271288 - RNA, 64 nt, Human
guuccagaaaacucuaaauauaacagacccuacagggggccaccuggaguuugucaccuauuua

SEQ ID NO: 271289 - RNA, 64 nt, Human
caccuccccaggcagagggagccucuguucuggugggggccaccucccucagaggcucugcuag

SEQ ID NO: 271290 - RNA, 64 nt, Human
ggaaguaggguggauguggguagggcugggaggagggggccacagcuuagguuuggagcucugg

SEQ ID NO: 271291 - RNA, 64 nt, Human
guacacgggccuggugaggcaacagcuguggagugggggccaaacacauggaugguggaguacg

SEQ ID NO: 271292 - RNA, 64 nt, Human
aacuucuggcaaaagggggcagcccuugggagcugggggccaggggauugacuugguucccuga

SEQ ID NO: 271293 - RNA, 64 nt, Human; identical to SEQ ID NO: 233927

SEQ ID NO: 271294 - RNA, 64 nt, Human; identical to SEQ ID NO: 233931

SEQ ID NO: 271295 - RNA, 64 nt, Human; identical to SEQ ID NO: 233937

SEQ ID NO: 271296 - RNA, 64 nt, Human
cagagcugcguaaaguuaccccggggugauauaggggggccagacgugugccccguucacccac

SEQ ID NO: 271297 - RNA, 64 nt, Human
acuggggaguuuuccugaucuuggguccucuuuagggggccagacaagaaaggccuacgguuuc

SEQ ID NO: 271298 - RNA, 64 nt, Human
gccuugcuccguuguucccuugcccugguggugggggggccagaccaccuccggaauccugcca

SEQ ID NO: 271299 - RNA, 64 nt, Human
gguggcugcugugggcaaggaccggcccuucauggggggccagaagccgaaucucgcugauuug

SEQ ID NO: 271300 - RNA, 64 nt, Human
uccuucuugcgcuaggucaagguccccgccuggagggggccaaacccccaguggcugggccucu

SEQ ID NO: 271301 - RNA, 64 nt, Human
gcugcacacacaagcaucucacucggcccacggagggggccaggcuuccuuugccugaagcugu

SEQ ID NO: 271302 - RNA, 64 nt, Human
uuggggcuggggggcaccccagccugaaguuugugggggccaaaccugggaccccgagcuuccu

SEQ ID NO: 271303 - RNA, 64 nt, Human
acccucagauucuguuaaccaaaauugcagaauggggggccaggccugugugguggcucacacc

SEQ ID NO: 271304 - RNA, 64 nt, Human
gaagcuuaauaaauuauuguguccuggugccaaagggggccagccagaacugaggugcuggcua

SEQ ID NO: 271305 - RNA, 64 nt, Human
gccuuugaagaugagaagagagugcaggagggcugggggccauggaggaaaggccuaaaguuuc

SEQ ID NO: 271306 - RNA, 64 nt, Human
aaagcacaaaccucugggaaagacaacgucucucgggggccaggggucaucgguuugaccccug

SEQ ID NO: 271307 - RNA, 64 nt, Human
gagaaaagacaagucaagagagaaagugggaccagggggccaaugcuaguauggaggcugugaa

SEQ ID NO: 271308 - RNA, 64 nt, Human
cuguaaagggccaaacaguaaauauuuuagggcugggggccauaaaauauguugcaaccaccca

SEQ ID NO: 271309 - RNA, 64 nt, Human
ccucuauccuacaaggccuaugaguauggauugggggggccaaaaggaaaaagcuccaugugcc

SEQ ID NO: 271310 - RNA, 64 nt, Human
cacaguacuggagagagacacacagaucuaagucgggggccagagggagcucccucaacuaggc

SEQ ID NO: 271311 - RNA, 64 nt, Human
uccugugcauugguggcaucacagaccccagcuggggcgcgaugucaaaggucgggacagcugu

SEQ ID NO: 271312 - RNA, 64 nt, Human
uguuuggaaucccgccccacauucuccaaauucagggcgcgaucuggcaaaggcucccuccccc

SEQ ID NO: 271313 - RNA, 64 nt, Human
agccccgaagcccgccagccacccugccggacucgggcgcgaccugcuggcgcgcgccggaugu

SEQ ID NO: 271314 - RNA, 64 nt, Human
gggccuuucuccgaccuucugguguggccgcccugggggccaggcccucgccauccuccccauc

SEQ ID NO: 271315 - RNA, 64 nt, Human
auucuauuccuaucuguggauguguaaauggcuggggggccagcccuggauagguuuuuauggg

SEQ ID NO: 271316 - RNA, 64 nt, Human
cugccaugacagccccuaggccaggaaccaucaggggggccagccggcauccaauuccugcgga

SEQ ID NO: 271317 - RNA, 64 nt, Human
caugguggcaggugcuuauaaucccagcuacucugggggccaaggcaggagaauugcuugagcc

SEQ ID NO: 271318 - RNA, 64 nt, Human
uugauuggauuuaauugauuauguagaacaauuugggggccauuugacaucauuaaaauauuca

SEQ ID NO: 271319 - RNA, 64 nt, Human
gcauaaucaccagcaacacccgggacaauaauacgggggccaccuacccccaccugaacuucag

SEQ ID NO: 271320 - RNA, 64 nt, Human
ugcagcgugugugcgugugccugugugugaaccugggggccauccugguggccugggagcguga

SEQ ID NO: 271321 - RNA, 64 nt, Human
cagcccccugcccacagaagggaaggccugcagagggggccaggaucuaccuaaccauuucccc

SEQ ID NO: 271322 - RNA, 64 nt, Human
acuaccagcagcaaccaggacgucuguucuuugugggggccagaucagaagagagaggccccug

SEQ ID NO: 271323 - RNA, 64 nt, Human
ugggacuaaagccaggaacagggaccagcuccccgggggccaacucacccuuggcccaucccgc

SEQ ID NO: 271324 - RNA, 64 nt, Human
gaauaagagacuguccagugacuggugggucccugggggccagcugccuucucauccugggagg

SEQ ID NO: 271325 - RNA, 64 nt, Human
cugguggugggggcugucagggagggccuggggugggggccaggggccaucugcuaugucaggg

SEQ ID NO: 271326 - RNA, 64 nt, Human
gagccaggagcuaacucagaccccaaagcaagcagggggccaguggcggggcccagcgcccagc

SEQ ID NO: 271327 - RNA, 64 nt, Human
ugcagugcccccuaagugacccggacacuuccgagggggccaucaccgccuguguauauaacgu

SEQ ID NO: 271328 - RNA, 64 nt, Human
aaacuuuuaaaccauauauuuagccugugaccaggggggccaaacccuaagauuucugguaaac

SEQ ID NO: 271329 - RNA, 64 nt, Human
ggcagguucugccugcuuuggcgggcagacacgcgggcgcgaucccacacaggcuggcgggggc

SEQ ID NO: 271330 - RNA, 64 nt, Human
gcagaggcggggagaggaggcggcgagggucccggggcgcgaggaaggcgccugcccucuccca

SEQ ID NO: 271331 - RNA, 64 nt, Human
ggcugcugugugccuucgcgguggaaggcccgaggggcgcgaucuugacccuaagaccggcggc

SEQ ID NO: 271332 - RNA, 64 nt, Human
guaagugucaagugggaggauacugcccccuugugggggccagacgggucggacacggcugugc

SEQ ID NO: 271333 - RNA, 64 nt, Human
ucuguaacaucccacaucugccagggaagggucugggggccaguggaggccugaggugucccuc

SEQ ID NO: 271334 - RNA, 64 nt, Human
uccuuuugguuuuguggggagaggggaaggaucagggggccaggccagcagcucgggggccaca

SEQ ID NO: 271335 - RNA, 64 nt, Human
gaggggaaggaucagggggccaggccagcagcucgggggccacaaggagauggauaaugugccu

SEQ ID NO: 271336 - RNA, 64 nt, Human
cuguccuccagggcgagcacuuuccacuuccagagggggccagagggacuuugccugcccaguc

SEQ ID NO: 271337 - RNA, 64 nt, Human
gagcugggcuauguucuggaacccagugaaucuugggggccaggcacugugcuaggcaccagca

SEQ ID NO: 271338 - RNA, 64 nt, Human
acauaccagagucuggagcugagcuaccuggggugggggccaagucacagguuggccagaaaac

SEQ ID NO: 271339 - RNA, 64 nt, Human
gguuacugcagucagaugccaucucauccccugugggggccaaaguuuuuaugugggcagaugc

SEQ ID NO: 271340 - RNA, 64 nt, Human
auuugcgauauuaaaaugccugcagauugaaaaugggggccacucauuucagaacugcaggaau

SEQ ID NO: 271341 - RNA, 64 nt, Human
cucccaccccagagugcaggaucauagggacagcgggggccagggcagcggcgucgcuccucug

SEQ ID NO: 271342 - RNA, 64 nt, Human
cggcacguggccccuggguugcaccuggagcuucgggggccacagcugugggcccggcgcaugg

SEQ ID NO: 271343 - RNA, 55 nt, Human
uccugguccggaaaaaauaauaccugggggccaggcggggggcacggagccacuu

SEQ ID NO: 271344 - RNA, 64 nt, Human
cagcccgugugggggcccgagggacccacacagugggggccagccucgcuggagggagagcaac

SEQ ID NO: 271345 - RNA, 64 nt, Human
uaugaaguccaguggaguucuuagggccuaaauugggggccagaguuucaaaggcaucacuaug

SEQ ID NO: 271346 - RNA, 64 nt, Human
ucuuccagaauccaaauuaaagguugccccugaugggggccagguuccgccacagaacaucuua

SEQ ID NO: 271347 - RNA, 64 nt, Human
uggcgacucaaccuugggggggggggcggggggagggcgcgaggcuuuuggagcggcugugggu

SEQ ID NO: 271348 - RNA, 64 nt, Human
gcagcccccugaaucuucuccgugcagccccuuggggcgcgaccuugugcgaggcccucggggc

SEQ ID NO: 271349 - RNA, 64 nt, Human
acauuguccgggagcccuucauuuaggacaaaacgggcgcgaugaugcccuggcuuucagggug

SEQ ID NO: 271350 - RNA, 64 nt, Human
gaacucagcucagaguucuaaggaccagcauucugggggccauuuucucuacaggcaaauggaa

SEQ ID NO: 271351 - RNA, 64 nt, Human
cugugaagugacuggaagggagcagaggccagcugggggccagugggggagguuguuuccacua

SEQ ID NO: 271352 - RNA, 64 nt, Human
ggagaccaggugggggcaggacuguggcccuugugggggccaaggcacacuccuguagcucugu

SEQ ID NO: 271353 - RNA, 50 nt, Human
acaacguggaacugaccuaggggggccaaauuggggagacugcccacucc

SEQ ID NO: 271354 - RNA, 64 nt, Human
gucacuuaugccaaacucuaauaaaauggagucggggggccacauagaagcccucacacacaca

SEQ ID NO: 271355 - RNA, 64 nt, Human
gguucgccagcccuccccuccccagggucauagagggggccaugaggcuggaauuggccaguga

SEQ ID NO: 271356 - RNA, 64 nt, Human
ggaugaggccagacuggaagagcagcuccagguagggggccauguuucccagcggggacccacc

SEQ ID NO: 271357 - RNA, 64 nt, Human
cucccaggguccauggccagggccucuguguuuggggggccacuugcccuucauccugccaggc

SEQ ID NO: 271358 - RNA, 64 nt, Human
uaaauuaaguguucugauuaguaagaacuaagcagggggccacaugcucucaauggagacaaua

SEQ ID NO: 271359 - RNA, 64 nt, Human
uccacgguucacuagcuccuaccugaagaggaaagggggccauuugaccugacaugucaggaaa

SEQ ID NO: 271360 - RNA, 64 nt, Human
aaaguuucagcacaccuauacccccgaucucagagggggccaccaauaucuagcuauggaucgu

SEQ ID NO: 271361 - RNA, 64 nt, Human
gugggagcuggggcagggggagagccaggcaaucgggggccaaagaugggggugcucgccuaca

SEQ ID NO: 271362 - RNA, 64 nt, Human
ugccagccccuccucuuauuuaauucugaguuuugggggccagccuagagggaauuccuuuuuu

SEQ ID NO: 271363 - RNA, 64 nt, Human
uuaauacauaguuccaguaauacuauuucugauagggggccauugauugaggguagcuuguugc

SEQ ID NO: 271364 - RNA, 64 nt, Human
agaaaagggugugaaguagaggugcaguuaaguggggggccacuagucuaacagacggucacaa

SEQ ID NO: 271365 - RNA, 64 nt, Human
uccgggagccuccugggggcuccggcggcggcgcgggcgcgacccaucccgcuggcgcuccccg

SEQ ID NO: 271366 - RNA, 64 nt, Human
gcuggcugaacugcuacgggcagcgcugggcggcgggcgcgacgugaucguggaccugugggag

SEQ ID NO: 271367 - RNA, 64 nt, Human
ccuagguccucccacaccugcccccuaauaaagugggcgcgagaggaggcugcuguguguuucc

SEQ ID NO: 271368 - RNA, 64 nt, Human
cagcuccagguccaccuccuguugggaggcgguggggggccaaaguggggccacacacucgcug

SEQ ID NO: 271369 - RNA, 64 nt, Human
gacuuuuucaaguucacauggggacccccuucuugggggccagagauaugacuaaaaccuuauc

SEQ ID NO: 271370 - RNA, 64 nt, Human
cauuuuugucuguuucuaugaagauaaaauaauugggggccaucuagaaauagaaaggcagugg

SEQ ID NO: 271371 - RNA, 64 nt, Human
aguccuuuuugugccaaaucccuaagugccguucgggggccaugugugcagcaugacucucccu

SEQ ID NO: 271372 - RNA, 64 nt, Human
ucucccacacaucucacaucauggggaggccagagggggccacacgagagcuccaggcucuggg

SEQ ID NO: 271373 - RNA, 64 nt, Human
cugcgucaaagcacagaggcuccccggacucggagggggccagagacugagcucuggucaccug

SEQ ID NO: 271374 - RNA, 64 nt, Human
acugcuggugguccaggucagcauccucuacuacgggggccaccuugucaucucaggccagaug

SEQ ID NO: 271375 - RNA, 52 nt, Human
gccagccuguguacguguagaugggggccaggcacccccaccacucgcugcc

SEQ ID NO: 271376 - RNA, 64 nt, Human
ggcuggggccgggcaggccaggccaagccaagcagggggccacagggugggcuguggagcucuc

SEQ ID NO: 271377 - RNA, 64 nt, Human
gaaaguccagggccagguggggcuagguguggcugggggccaggagagcaggaacagaacagag

SEQ ID NO: 271378 - RNA, 64 nt, Human
ggggcucagaggcuccuugacugggaccaggauugggggccagggcuugaguaggccucuccac

SEQ ID NO: 271379 - RNA, 64 nt, Human
cuccuuggaguuccgccccugcaaggcuggauuugggggccauuaucugagcagcuucaaagac

SEQ ID NO: 271380 - RNA, 64 nt, Human
gcccccaaaccuccccuuccuuucccccuccuccgggggccaaggacaggguggccuuacucag

SEQ ID NO: 271381 - RNA, 64 nt, Human
auuugaaguuuugccauuuguguuuauggguuuagggggccauuuguguggaccaaucuacucg

SEQ ID NO: 271382 - RNA, 64 nt, Human
uagggggcacugcuugaagcacagcacuugguuagggggccacagaggccuaaguuugcuggcc

SEQ ID NO: 271383 - RNA, 64 nt, Human
uuaauuuaaguauuuaauuuucaucuuccuucuuuggaucuauuuggccucucaaaugaacuga

SEQ ID NO: 271384 - RNA, 64 nt, Human
cuuuuucccccccucucuauguguauauuucuaauggaucuauaagaacagcaacaagagaguu

SEQ ID NO: 271385 - RNA, 64 nt, Human; identical to SEQ ID NO: 233943

SEQ ID NO: 271386 - RNA, 64 nt, Human
ucuguagccucccccuugcccucaaagggggagugggggccagcuuuaccucacccacugugac

SEQ ID NO: 271387 - RNA, 64 nt, Human
cggcgacaguugggcccaaaucagaaaggagagagggggccaaugagggcagggccuccugugg

SEQ ID NO: 271388 - RNA, 64 nt, Human
ccagcagcaggcuggcagggagugguugaggucugggggccaggccacauggcuggagaggaau

SEQ ID NO: 271389 - RNA, 64 nt, Human
ccagugaccccagagacagagccaggacaggagugggggccagccugaggacccccgccuacca

SEQ ID NO: 271390 - RNA, 64 nt, Human
gaagacaccaccauucugaggccagggagcgagugggggccagccacggggacucagcccuugu

SEQ ID NO: 271391 - RNA, 64 nt, Human
ccagccucaccccaaccaugaccuuggcaagucagggggccacucugccucauuuaugcaaaug

SEQ ID NO: 271392 - RNA, 64 nt, Human
gaacaaaguuuuccaggaggccuugcggaacaucgggggccagauucaggagaagguaugugag

SEQ ID NO: 271393 - RNA, 64 nt, Human
agaaaaugccuugccucucaagagagggcagagggggggccaggugcaguggcucacgccugua

SEQ ID NO: 271394 - RNA, 64 nt, Human
uggagugaggcuccagaggagacuuugaguugaugggggccaggacaccaguccagguaguguu

SEQ ID NO: 271395 - RNA, 64 nt, Human
caggaacagcaaggacguugauugguuggggcaggggggccagaguagcugauguaggaguacu

SEQ ID NO: 271396 - RNA, 64 nt, Human
gggguggaugggcugccugcacagccccuggagagggggccaggcacacccucagaggagcugc

SEQ ID NO: 271397 - RNA, 64 nt, Human
aggggaggggggugcccuccuuccuagaggcccugggggccaggcugacuuggggggcagacuu

SEQ ID NO: 271398 - RNA, 64 nt, Human
gaaauacuaagaacaccuagggugugcucacugugggggccaguuucuccucggaacaugacaa

SEQ ID NO: 271399 - RNA, 64 nt, Human
aagcccugcaggcugggugggcaggacacguggugggggccacugaaaccaggccuaggaggga

SEQ ID NO: 271400 - RNA, 64 nt, Human
gcagcagucaccacuagggggugauggagaggaagggggccaccccagggccauuaacaaccag

SEQ ID NO: 271401 - RNA, 64 nt, Human
cgcaauucuccaagugagggcgggccugggccuggggcgcgaccucggcccggccucccuucgc

SEQ ID NO: 271402 - RNA, 64 nt, Human
cuccuugaggggcucuucuggucagccccacccugggggccauuuccccauuaacuacccccag

SEQ ID NO: 271403 - RNA, 64 nt, Human
agaggggcgugugcaugggaguguggcucaucucgggggccauggggccuccugagguacaccu

SEQ ID NO: 271404 - RNA, 64 nt, Human
cuccuuacaaccccugggcccagcccucauugcugggggccaggccuuggaucuugagggucug

SEQ ID NO: 271405 - RNA, 64 nt, Human
gccccacugcugcuaccuggggaauggggcaccugggggccaaggcagagggaaggggguccuc

SEQ ID NO: 271406 - RNA, 64 nt, Human
acuguaugauuuuccuauugccaaaagaaagaaagggggccaaacagcucugaaauuuccaaaa

SEQ ID NO: 271407 - RNA, 54 nt, Human
gugcugaggaggggcugugagccugggggccacuguggacagacgugggcuuca

SEQ ID NO: 271408 - RNA, 64 nt, Human
gguggggaagggaagccagauccagcacccccuggggggccaucgggaguguggcuggggguga

SEQ ID NO: 271409 - RNA, 61 nt, Human
uggugggcaccccgacguagcugccccccuggggggccacagcccagagaaccagccuagg

SEQ ID NO: 271410 - RNA, 64 nt, Human
cccgccccugccagccaccaagcgcaggugcagcgggggccagacuccugccggccucagagga

SEQ ID NO: 271411 - RNA, 64 nt, Human
ggagggcggaucucccuggccagcagggaugggagggggccauuugcuguuccucugaguaaag

SEQ ID NO: 271412 - RNA, 56 nt, Human
aggcccuggagcgacacugacagccagggggccagaaggacugacaccacagauga

SEQ ID NO: 271413 - RNA, 64 nt, Human
guagggaagggcugaagccuuguuucccuugcaggggggccagccauugucucccacuugggga

SEQ ID NO: 271414 - RNA, 64 nt, Human
caccgucccugagacugggguugaggggacugacgggggccaccaccgccccgcccuccagcgc

SEQ ID NO: 271415 - RNA, 64 nt, Human
cuccacccaugcugguuggugcuggcuaggcugagggggccaccacuuuuccuggcuagaagcu

SEQ ID NO: 271416 - RNA, 64 nt, Human
ccuaggcccagucucaaaggaagccacaaggcgcgggggccacugaggaaggaaauguucauuu

SEQ ID NO: 271417 - RNA, 64 nt, Human
cuugucacccauugagcugcaagagggaccaagagggggccacgcagccagccagaugccuggc

SEQ ID NO: 271418 - RNA, 64 nt, Human
cccucaguucucacgccuuccuguccaguggaaugggggccaggagugcuggcuccucguguuu

SEQ ID NO: 271419 - RNA, 64 nt, Human
ggcuggggcagcuccuggggagcaucagggaagagggggccaugagccggccagcaguggagac

SEQ ID NO: 271420 - RNA, 64 nt, Human
ccaccaagcuccucccccagaacccugaggccaagggggccacuggcuaccccuacugcgcggc

SEQ ID NO: 271421 - RNA, 64 nt, Human
ccagcccugcccccgggcacugcacagccugucugggggccagaccaccccauuguccauccuu

SEQ ID NO: 271422 - RNA, 64 nt, Human
uuaucucuuacagugccauucaggaauucugagugggggccauuacaucacuuaugccaaaaac

SEQ ID NO: 271423 - RNA, 64 nt, Human
gaggggguggaggacucuccccugccucuggggagggggccaucugcugcgcccggccccacug

SEQ ID NO: 271424 - RNA, 64 nt, Human
aguaugcaccuuguguugagagagaggcaacccugggggccaguucaggugguccccaaccaua

SEQ ID NO: 271425 - RNA, 64 nt, Human
uaucacaggcucagggcaaagaaguggccuccuggggggccaggccacgagggccagggcuucu

SEQ ID NO: 271426 - RNA, 64 nt, Human
uggcagagacagugggcacuaaggguggagaguugggggccagcacagcugaggacccucagcc

SEQ ID NO: 271427 - RNA, 64 nt, Human
ccagccccucccaccacagcaggugucauauauggggggccaacaccagggaugguacuagggg

SEQ ID NO: 271428 - RNA, 64 nt, Human
gcaaaggacuguuuuuuccugagcuuggccagaagggggccaugaggccucaguggacuuucca

SEQ ID NO: 271429 - RNA, 64 nt, Human
ugagcugagauggaacccuuuuggcccccgagcugggggccaugagcuccagacccccagcaac

SEQ ID NO: 271430 - RNA, 64 nt, Human
accccccgccucccuccagggcauuaaccugucugggggccagcggcagcgggucagucuggcu

SEQ ID NO: 271431 - RNA, 64 nt, Human
cucgcccuugccaggaggggaguggcagugaggagggggccaggucaggcaccaccaucaagag

SEQ ID NO: 271432 - RNA, 64 nt, Human
agauugacacgcugucauuuuccauuuccguuccuggaucuacggagucuucuaagagauuuug

SEQ ID NO: 271433 - RNA, 64 nt, Human
gugguagcgguaguugggacgagaagcgggguaguggaucuagguaguuccucaaugccccacg

SEQ ID NO: 271434 - RNA, 64 nt, Human
ugaagagagugccaaagcggagaucuguucaccugggggccauggaggggggacccacuaaaga

SEQ ID NO: 271435 - RNA, 64 nt, Human
ugugugggguucucagugccggaggccuuggggugggggccaggccucgcacuugcagaggagc

SEQ ID NO: 271436 - RNA, 64 nt, Human
ccgcuauuaucugcguucucugccaaagacucgugggggccaucacaccugcccugugcagcgg

SEQ ID NO: 271437 - RNA, 64 nt, Human
guuugcuuccccugugcccacugcuguaugaucugggggccaccacccugugccgguggccucu

SEQ ID NO: 271438 - RNA, 64 nt, Human
cauggcuucguugagggccauccauaugccagcugggggccagcccacaguggccauauuggcu

SEQ ID NO: 271439 - RNA, 64 nt, Human
aggagcguggggcggagggguggggccccacagugggggccaggccugccuuggucuccccuuc

SEQ ID NO: 271440 - RNA, 64 nt, Human
ccaaagaaggcagggaaugccuggaggguaacuggggggccaccaugaccccuucucucuccag

SEQ ID NO: 271441 - RNA, 64 nt, Human
cuuaccucggggagagggggagguugguuccuuggggggccaaagaaggcagggaaugccugga

SEQ ID NO: 271442 - RNA, 64 nt, Human
auugguagggauggcugugggguggcuuccaggagggggccaccauugccgcaucuacuucuag

SEQ ID NO: 271443 - RNA, 64 nt, Human
cauaccccuuauugcugccaaaaccacaugggcugggggccagggcuggauggacagacaccuc

SEQ ID NO: 271444 - RNA, 64 nt, Human
aucacacuccaaguaugggcagugauggcgcucugggggccacagugggcuaucuaggcccucc

SEQ ID NO: 271445 - RNA, 64 nt, Human
ccccaccugcccccaaugcacacacagacccaccgggggccaccugcccucccccauccucucc

SEQ ID NO: 271446 - RNA, 64 nt, Human
cuacauauggccuauucugggcuagaccagauuugggggccaggagggaagaacuccauauggg

SEQ ID NO: 271447 - RNA, 64 nt, Human
cccaccagcucucuccccaucccgcuucuucccugggggccaggcccuaccugugugguggugg

SEQ ID NO: 271448 - RNA, 64 nt, Human
gcucgcuucgucagcacaccccgaauauugaagagggggccaaaaaacaaccacauggauuuuu

SEQ ID NO: 271449 - RNA, 64 nt, Human
cuugauuuuuccuguccaucuuuauggauuuuucuggaucuauauuuucuucaauuauucuuuc

SEQ ID NO: 271450 - RNA, 64 nt, Human
ccccccaguggacaccauuggaccccacccagccuggaucuaccccaggagacucugggaacuu

SEQ ID NO: 271451 - RNA, 64 nt, Human; identical to SEQ ID NO: 233949

SEQ ID NO: 271452 - RNA, 64 nt, Human
ggguagaguguagauggcuugguuccagaggugagggggccagggcugcugccauccuggccug

SEQ ID NO: 271453 - RNA, 64 nt, Human
ggcuucagggguuggaaguucagcccaaacugaagggggccaugccuuguccagcacuguucug

SEQ ID NO: 271454 - RNA, 64 nt, Human
aauaaagcauuuccacgccagaguaguuugggcugggggccaggguugggugguccugucccuc

SEQ ID NO: 271455 - RNA, 64 nt, Human
ggaaaucuggagccccuuggagcugagcuggacggggggccagcugcgagcaugugcacuaaac

SEQ ID NO: 271456 - RNA, 64 nt, Human
ggcaggggggcaggggagcucaggccuggggucugggggccaccugccuugcgugcuuuucugg

SEQ ID NO: 271457 - RNA, 64 nt, Human
ugccuccuggccuuccuguuccagccacuggggugggggccagguucacugggaccagggcuac

SEQ ID NO: 271458 - RNA, 64 nt, Human
ggugagcagaugaggccccaagcucaucacaccagggggccauccuucucaauacagccugccc

SEQ ID NO: 271459 - RNA, 64 nt, Human
agacugaaaggacccgugcaucuuacuguaacccgggggccaggccggcucucucgcuguacau

SEQ ID NO: 271460 - RNA, 64 nt, Human
aaucuaaggaugaaagguauauauaaaacaauuugggggccaggcacgauggcucaaaccugua

SEQ ID NO: 271461 - RNA, 64 nt, Human
agcuguuagaguccaacguggggcagcacagagagggggccaccuccccaggccguggcugccc

SEQ ID NO: 271462 - RNA, 64 nt, Human
ccgcaaugugcccccagacgcacgugggucuucagggggccaggugcacagacgucccuccacg

SEQ ID NO: 271463 - RNA, 64 nt, Human
ugagcucacuuucgccuucuccauccccugccgugggggccacagccacaccucaccgcccagu

SEQ ID NO: 271464 - RNA, 64 nt, Human
cccaggggaguguacgucaggcuuugcggggcacgggggccacucagcagcgcuggggcaggug

SEQ ID NO: 271465 - RNA, 64 nt, Human
ccuccccugaaacacugacucaggagguuugguugggggccaggagucuguuccuaaauauucc

SEQ ID NO: 271466 - RNA, 64 nt, Human
uucagguagcugcuuggcggcggccagccccacagggggccaggggcauggccacaggcccccc

SEQ ID NO: 271467 - RNA, 64 nt, Human
aggaguauacaccaaggucucagccuaucucaacuggaucuacaaugucuggaagguaagguac

SEQ ID NO: 271468 - RNA, 64 nt, Human
auauuuaaacaagguuauaauuuagcaucuucccuggaucuaaauaguauauuauauccugaaa

SEQ ID NO: 271469 - RNA, 64 nt, Human
guccuugggccuggccagucuuccucuuagccucuggaucuagaagggaccauaagaggaguag

SEQ ID NO: 271470 - RNA, 64 nt, Human
ggagcugggcuggggcugcugcucuggggucuccgggggccacagcuuggggugaguugaagac

SEQ ID NO: 271471 - RNA, 64 nt, Human
guccccaagccccacugugccuuguugucugcuggggggccauagcuggcacugcccaccguaa

SEQ ID NO: 271472 - RNA, 64 nt, Human
ucgggggcugagccaggcggauagcuugagcucagggggccaaggcugcagugagucaugaucg

SEQ ID NO: 271473 - RNA, 64 nt, Human
cugcagugaucaggguccugcaagcaguggggaagggggccaagguauuggaggacucccuccc

SEQ ID NO: 271474 - RNA, 64 nt, Human
gucccaaagcccccuugggggaacuguggcugcugggggccaauaaagcuguguaacuugaucg

SEQ ID NO: 271475 - RNA, 64 nt, Human
agccagggccccucgccuuccuccccuggaccuggggggccaggcgggggugguggacguggcc

SEQ ID NO: 271476 - RNA, 64 nt, Human
ucuccaggggcagggggauuuuaggagauggggugggggccagccccuacuggacccuuguaau

SEQ ID NO: 271477 - RNA, 64 nt, Human
gugcucccccacuuccaggccuuaguuggggugggggggccagcuccugggccuggggucuucu

SEQ ID NO: 271478 - RNA, 64 nt, Human
cauuuacacgucgaggcuggcaccuggcgcgcucgggggccacuguagcgucugccugcucccu

SEQ ID NO: 271479 - RNA, 64 nt, Human
cucuuggcagaaacucuauaagccagaagagagugggggccaauauucaacauucuuaaagaaa

SEQ ID NO: 271480 - RNA, 64 nt, Human
gacagggugcugaugggaaggaggggagccuuuggggggccacccggggccuggaccuaugcag

SEQ ID NO: 271481 - RNA, 64 nt, Human
cuggaugggcugcagcagaggcacugggggcagcgggggccagggaaguccccgaguuucccca

SEQ ID NO: 271482 - RNA, 64 nt, Human
cccccgggucacccccgccccacugaggccaguagggggccaggccucccacuccucccagccc

SEQ ID NO: 271483 - RNA, 64 nt, Human
ccccagcuccuaacugggacucugugucuaugcagggggccagcaccccuggguuaucuggggc

SEQ ID NO: 271484 - RNA, 64 nt, Human
uuuaugcaauaacugagcuugaugggggugggcagggggccaguugagccaagcccccagcccc

SEQ ID NO: 271485 - RNA, 64 nt, Human
aaagcugguuagauggaacagaaaaugggcauucuggaucuaaaccgccacaggggccugagag

SEQ ID NO: 271486 - RNA, 64 nt, Human
uuuuuaaaagaauuucauagauauuuuauauguauggaucuauauuuucagagcuuaucucuga

SEQ ID NO: 271487 - RNA, 64 nt, Human
uuaaggucaccaaucaguuuuuguucuuuuuuccuggaucuacccucauggucguuuucaacau

SEQ ID NO: 271488 - RNA, 64 nt, Human
ccacggugacccgggccaucucaguauugccugugggggccaccccuccacccccacccccaag

SEQ ID NO: 271489 - RNA, 64 nt, Human
cuguggagaggacugugagagagaaggucccagcgggggccagugaagcucaggcaggaucugc

SEQ ID NO: 271490 - RNA, 64 nt, Human
guuaccugagaucugggaugcugaguggcuguuugggggccagagaaacacacacucaacugcc

SEQ ID NO: 271491 - RNA, 64 nt, Human
ggcguugacuggauguggcccaggagggggucgagggggccaacucacagaaggggacugacag

SEQ ID NO: 271492 - RNA, 64 nt, Human
ccuguuccucaugaugucaggagcgccagacaccgggggccagggugggggugggggugggggu

SEQ ID NO: 271493 - RNA, 64 nt, Human
uacccgacccggcgcccuggcccaucccaugccggggggccaguggaaagaagacaggccgucc

SEQ ID NO: 271494 - RNA, 64 nt, Human
gaacccuggagagcaagaauaaucugauuuuccugggggccagcacccaaauaagccuggcaug

SEQ ID NO: 271495 - RNA, 64 nt, Human
auggcccuucauggcagggacagaaagguggacugggggccauuugcuuccuguggccuucagc

SEQ ID NO: 271496 - RNA, 64 nt, Human
ccuccugcggggugggggugggacagaccccagugggggccagggccacacucagcgcagugug

SEQ ID NO: 271497 - RNA, 64 nt, Human
gcuccccgcccccuccacguggagacauggccuagggggccaggcccggcuccacaggagucuc

SEQ ID NO: 271498 - RNA, 64 nt, Human
caggcaggggaggcuuggacgccgguggggaauggggggccacagcugcagaccuaagcccucc

SEQ ID NO: 271499 - RNA, 64 nt, Human
gcgggcccguccagcgugggccaccacuggggccgggggccacgggcugcaugcugggcgggcc

SEQ ID NO: 271500 - RNA, 64 nt, Human
ugcagucucgaccauaagagauggcuacacccaggggggccaguucagagacccacucccaggu

SEQ ID NO: 271501 - RNA, 64 nt, Human
ugucaccaugugauuuauucuuggauaccugggagggggccaaugggggccucagggggaggcc

SEQ ID NO: 271502 - RNA, 64 nt, Human
aggcccccucccuggaggccagccccuccccgcagggggccaggccggggcucccaggcgaggg

SEQ ID NO: 271503 - RNA, 64 nt, Human
ugcggcuuuaaacugacaguacccgacuguuuauuggaucuauugauuugaaaagaauuuguua

SEQ ID NO: 271504 - RNA, 58 nt, Human
uuauuuguaucuguugcagaaauuccaguggaucuauccaacacagaaacugaacaaa

SEQ ID NO: 271505 - RNA, 64 nt, Human
uuugcuuuuacaguaacaaauguggcaauuauuuuggaucuaucaccugucaucauaacuggcu

SEQ ID NO: 271506 - RNA, 64 nt, Human
agcaauaagggcuggguuugucccccacccuggggggggccaggcuccagagagggggcaccuc

SEQ ID NO: 271507 - RNA, 64 nt, Human
augaauauauuuuacaugugaugacauggauuuugggggccagagguguaauguuuuggcugag

SEQ ID NO: 271508 - RNA, 64 nt, Human
ggccgagccucuggccggagaucggccgcccacggggggccacagcagcggccgcucgcccagg

SEQ ID NO: 271509 - RNA, 64 nt, Human
cagcgaguccugcagggcccaucuagaggacuuugggggccaucagcugcaauccaggucuguc

SEQ ID NO: 271510 - RNA, 64 nt, Human
ugcugugccuagucuagugucccccaaagcaucggggggccacgcaagugugggugugugagug

SEQ ID NO: 271511 - RNA, 64 nt, Human
aggccugcccugcuauuucaggcccucagcugucgggggccacuguguuucugugcuccaaguu

SEQ ID NO: 271512 - RNA, 64 nt, Human
ucagacugacacacagccagcuggcucacuuacugggggccacgucccaccccucagauauuuc

SEQ ID NO: 271513 - RNA, 64 nt, Human
uuccucugcgccggacuuggugcgucuaagaugagggggccaggcgguggcuucucccugcgag

SEQ ID NO: 271514 - RNA, 64 nt, Human
gcgagggugggcugaggcugaaguugcccacacugggggccagagcuaggguggggggcgaggg

SEQ ID NO: 271515 - RNA, 64 nt, Human
cuuccaucugggagccccaagaggggcugggaaggggggccauagcccaucaagcuccugcccu

SEQ ID NO: 271516 - RNA, 64 nt, Human
ccucagccccagcccugccugcccugccccuccagggggccaugagugccuagguuucucauac

SEQ ID NO: 271517 - RNA, 64 nt, Human
gccauuaaacuguuuauguuaagaggauugcacugggggccauggcucaugccuguaauuccag

SEQ ID NO: 271518 - RNA, 64 nt, Human
ggacugggaggggagcagaguccccaggagccgagggggccacccgaggccaggauggaggugg

SEQ ID NO: 271519 - RNA, 64 nt, Human
ggcccugaaaugaggggacccugacuggagaggugggggccaccaaaaacccacaaaggccccg

SEQ ID NO: 271520 - RNA, 55 nt, Human
agcaacccauggaaacauaaugguugggggccacaugagucuuccaguucacucu

SEQ ID NO: 271521 - RNA, 64 nt, Human; identical to SEQ ID NO: 233953

SEQ ID NO: 271522 - RNA, 64 nt, Human; identical to SEQ ID NO: 233959

SEQ ID NO: 271523 - RNA, 64 nt, Human; identical to SEQ ID NO: 233962

SEQ ID NO: 271524 - RNA, 64 nt, Human
ccacaagcccuggcauccccugcaaauauuuauugggggccauggguagggguuuggggggcgg

SEQ ID NO: 271525 - RNA, 64 nt, Human
cuuaguugcuacaagaaaauccccuggaaguacugggggccagguuccccagacagcaggaauu

SEQ ID NO: 271526 - RNA, 64 nt, Human
cucccaggcuuggguuuuuucuauagguuuggcggggggccacagggaggggacccugacaaua

SEQ ID NO: 271527 - RNA, 64 nt, Human
uagauuuaucaaggguguuaugggcccagcuuuggggggccagucccgaugcacuuugaggggu

SEQ ID NO: 271528 - RNA, 64 nt, Human
gcaugugucccaggagcaggaccuacuaggagaggggggccaagguccugcucaacucuacccc

SEQ ID NO: 271529 - RNA, 64 nt, Human
aagugugcacuccagcuucggagggccccugugugggggccagucaggcugcagaggcaccuca

SEQ ID NO: 271530 - RNA, 64 nt, Human
auggguggucagaugguggggugggcccucuccagggggccaguucagggccccagcugccccc

SEQ ID NO: 271531 - RNA, 64 nt, Human
gaucauggauuugcggccagcucuccuggggguagggggccaccaggacucaccucccucuuca

SEQ ID NO: 271532 - RNA, 64 nt, Human
gguuuuuauucuuaccuaugucaaugaaaugcuagggggccagggaaacaaaauuuuaaaaaua

SEQ ID NO: 271533 - RNA, 64 nt, Human
aaccccucaaccucuaucucauagaugugaaucugggggccaggcuggaggcagggauggggac

SEQ ID NO: 271534 - RNA, 64 nt, Human
ccaguggggagagcaguggcagugggaggcaucugggggccaaaggucaguggcaggggguauu

SEQ ID NO: 271535 - RNA, 64 nt, Human
ccuccccaucccacccaggcccccagcuccccgcgggggccaccgcagggccugugggcugggu

SEQ ID NO: 271536 - RNA, 62 nt, Human
gaaucgccaggauccccugaagggucugggaugggggccaggagauuagcaacaaggauuca

SEQ ID NO: 271537 - RNA, 64 nt, Human
cagauguuucaugcugugaggccuugcaccaggugggggccacagcaccagcagcaucuuugcu

SEQ ID NO: 271538 - RNA, 64 nt, Human
uccuccgaugaaggcagccccugcccuggcaugggggggccacuagaugcaccugggagccccc

SEQ ID NO: 271539 - RNA, 64 nt, Human
uggguguucugcacaccaggcagcugcaccucacuggaucuaguguugcugcgagugaccucac

SEQ ID NO: 271540 - RNA, 64 nt, Human
uacagcauucaugugugauauuuuccagauuuguuggaucuauuugguuuaaaaaguauucuau

SEQ ID NO: 271541 - RNA, 64 nt, Human
auguuuugguuuguuucuacugaccugaauguguuggaucuacacguguuguuuuguuuuugcu

SEQ ID NO: 271542 - RNA, 64 nt, Human
ugucccucuucgggcccugaauuuucuguucccugggggccagccagggcccuuugugccccuc

SEQ ID NO: 271543 - RNA, 64 nt, Human
gccaggguguccgggggcuggccagucagagaaagggggccauggacugcuguggcaaauaggg

SEQ ID NO: 271544 - RNA, 64 nt, Human
cccagggcaugugccccgcaggggccuagagggugggggccagggguauuugcauucauacauu

SEQ ID NO: 271545 - RNA, 64 nt, Human
gccuaggguccccucagucuuggucccaggagaugggggccacucgugaggcuggccaugcugu

SEQ ID NO: 271546 - RNA, 64 nt, Human
ucugaguuauagcccuggagcagcucagggcucagggggccacaaggaggcaggucgggaggaa

SEQ ID NO: 271547 - RNA, 64 nt, Human
uuuguggagugccucaucacaggacggugacucugggggccagccagagcccuggccguccgag

SEQ ID NO: 271548 - RNA, 64 nt, Human
ugggaaaugaguugagaccauggacuugggaguugggggccagaguugagccuggacuugacca

SEQ ID NO: 271549 - RNA, 64 nt, Human
cgcccgggagcaggugcugcagccagaguuacgcgggggccacgcgggccggcggggguggggg

SEQ ID NO: 271550 - RNA, 64 nt, Human
uucucacccacauucgcugaagcgauggagagucgggggccaguagccagccaaccccgugggg

SEQ ID NO: 271551 - RNA, 64 nt, Human
ugguugcugcaaggagcguaguucugccaugucugggggccagguuccacucugcacaugaaua

SEQ ID NO: 271552 - RNA, 64 nt, Human
acgugcaggaggcgcgguggggcugcguggaggagggggccacgugugagagagaagaaaaugg

SEQ ID NO: 271553 - RNA, 64 nt, Human
aucucacaaguauauuguaaacccuucggugggugggggccauauccuagaccucucuguaucc

SEQ ID NO: 271554 - RNA, 58 nt, Human
cccugaacauagaaacuuaagaacuucagggggccauucuuaccaguucuguuucugu

SEQ ID NO: 271555 - RNA, 64 nt, Human
augguugacucuggguuccuauggccuuguuggagggggccaggcucuagaacgucuaacacag

SEQ ID NO: 271556 - RNA, 64 nt, Human
agguuaaguaagacucgagaguaaaggcaaggaggggggccagccucugaaugcggccacggau

SEQ ID NO: 271557 - RNA, 64 nt, Human
ucaaaucaaaagccuucaaaacacgaggcacucuuggaucuacccugaguauccuccaaacugu

SEQ ID NO: 271558 - RNA, 64 nt, Human
cacucagaacaacucucuugaugaccauucugucuggaucuacugacauaagauggccuguagc

SEQ ID NO: 271559 - RNA, 64 nt, Human
cuaccuccagcuuccuccagccucaaaccgccucuggaucuagcuguccuucuccgaguggcac

SEQ ID NO: 271560 - RNA, 64 nt, Human
cagccugccuccagcuuuacugagcacaggaugcgggggccaagaugaugcugaggccugauga

SEQ ID NO: 271561 - RNA, 64 nt, Human
ugccuguguccuacagaugcacacuccggacaucgggggccagggcacaacaucugaagccauc

SEQ ID NO: 271562 - RNA, 64 nt, Human
aauggcaauguuuugcuuuugcucgaugcagacagggggccagaacaccacacauuucacuguc

SEQ ID NO: 271563 - RNA, 64 nt, Human
aauuaacuaucaucaguccugcauuucuuugguggggggccaggagggugcauccaauuuaacu

SEQ ID NO: 271564 - RNA, 64 nt, Human
ucaaaccaccccucccccagaugguacuucaguuuggaucuauugggggaguguggccacagac

SEQ ID NO: 271565 - RNA, 64 nt, Human
guacaaauuuuucauuccuuuugcucuuugugguuggaucuaacacuaacuguauuguuuuguu

SEQ ID NO: 271566 - RNA, 64 nt, Human
auaggugaaauauuuuauagcgagauuuuuaugguggaucuaucaaacuggccaccucugaacc

SEQ ID NO: 271567 - RNA, 61 nt, Human
ggaaacucagaucccaaaagucccuaaagcagucguagagucucaccaucuccaaggauug

SEQ ID NO: 271568 - RNA, 61 nt, Human
guugcugucugucucaguacaauccaaauuugucguagacuugugcaauauauacuguugu

SEQ ID NO: 271569 - RNA, 61 nt, Human
uacccucacccuuuaccuuccucagguaacagucguagauaccagcuuuuuuuuuuuuuuu

SEQ ID NO: 271570 - RNA, 61 nt, Human
uuccaucauuucuauucugaaaugacucacugucguagaaggaaguuuauuauauaaccaa

SEQ ID NO: 271571 - RNA, 61 nt, Human
uugucaugcuuauugucccaauauccauccugucguagaucuuaauguuuuugaucguugc

SEQ ID NO: 271572 - RNA, 61 nt, Human
gugcagacaugcugugugaaucucacaaugcgucguagaugucgcguguuggaagggagca

SEQ ID NO: 271573 - RNA, 61 nt, Human
guucggaaaaaaaaaguugaucuuuuuuuuugucguagauuugucuguaaaagugcaggaa

SEQ ID NO: 271574 - RNA, 61 nt, Human
ccagccccaugcaugcugcugccucugggcagucguagaaucucccacuucaguuucucgu

SEQ ID NO: 271575 - RNA, 61 nt, Human
uucucuaacagagaaauucuuagugacuccagucguagaaaaacgucuuuacaaccugaau

SEQ ID NO: 271576 - RNA, 61 nt, Human
uccaucuggacacaaagagagaccugugggagucguagaggguacuguuagccccggucca

SEQ ID NO: 271577 - RNA, 61 nt, Human
aaauucuauauacguugugucuguuacaaaugucguagaagaaaucaugcagcuaaacgau

SEQ ID NO: 271578 - RNA, 61 nt, Human
guuaagaaugugcccuaagggagaggaucuugucguagagucuaauguuuuuuaaaauugg

SEQ ID NO: 271579 - RNA, 64 nt, Human; identical to SEQ ID NO: 233968

SEQ ID NO: 271580 - RNA, 64 nt, Human; identical to SEQ ID NO: 233972

SEQ ID NO: 271581 - RNA, 64 nt, Human; identical to SEQ ID NO: 233976

SEQ ID NO: 271582 - RNA, 61 nt, Human
ucaauucacaaaggcuaauuguugaacuggugucguagaagaaauugucuacaggagccaa

SEQ ID NO: 271583 - RNA, 61 nt, Human
gaauaagcagaaaauauaacugcagcuguaugucguagacacaagaauugaaacugugcag

SEQ ID NO: 271584 - RNA, 61 nt, Human
cuuguucauuuugaguauuuuuaaaaaauaugucguagaauuccuucgaaaggccuucaga

SEQ ID NO: 271585 - RNA, 61 nt, Human
gcagggcucuggggccagaauggcuguccuugucguagagcccuccacauuuucuuuuucu

SEQ ID NO: 271586 - RNA, 61 nt, Human
guuuauauaacaugcuucccauuuuuuuuaugucguagaaauuggaaguuagggaguacug

SEQ ID NO: 271587 - RNA, 61 nt, Human
cuccuuccaacaaaagaaggucaaacugugggucguagagccuugacaauguuguccuccu

SEQ ID NO: 271588 - RNA, 61 nt, Human
cgcauugcagagcgggaggccaggaggacucgucguagacaagccagagaacaaaccggua

SEQ ID NO: 271589 - RNA, 61 nt, Human
ugcugcacucaccggcuucuucucacucucugucguagacacaccgauaggaccaauggcc

SEQ ID NO: 271590 - RNA, 64 nt, Human
cacaagaccauuguacugcaauacuugaguauuuguguagcaaacagccucuuagguuggagag

SEQ ID NO: 271591 - RNA, 63 nt, Human
uauugauacaaucuaauaaauaauguguuugacaguguagcagaaauaaugcuauguguucac

SEQ ID NO: 271592 - RNA, 64 nt, Human
uuacuccuuugucgcuuauccagaaugaugcuauguguagcaucuugcuguaaauccuguacaa

SEQ ID NO: 271593 - RNA, 64 nt, Human
uuucugcauuuaauagguuagaauguaaauuaaaguguagcaauagcaacaaaauauuuauucu

SEQ ID NO: 271594 - RNA, 64 nt, Human
auugcagaaaaggcuucccuuggcucccaaggagguguagcaggugugagcaauauuagugcca

SEQ ID NO: 271595 - RNA, 64 nt, Human
uugugaacuaugucuuacaugucuagaguucugcuggaucuagggaaaggaggagcuaucgaag

SEQ ID NO: 271596 - RNA, 64 nt, Human
agaucgucucuaauguuaggucaagcuauuucucuggaucuaugauuuuaagauagaacaggcu

SEQ ID NO: 271597 - RNA, 64 nt, Human
gaaauauaaaggguuugggagcaaaaagagggaguggaucuauuuuagaugagcccagguaaga

SEQ ID NO: 271598 - RNA, 64 nt, Human
aauucuuccauacacaggugugcuucuagucaguguguagcaaggaaagccccguucacugcuc

SEQ ID NO: 271599 - RNA, 64 nt, Human
caagauauuuggggaauaaaaauaacagcuugguguguagcaucugcagccacuuggcaaauga

SEQ ID NO: 271600 - RNA, 64 nt, Human
ugaaaccugugacucagguuuaugaaugguguuuguguagcaacacauugugugcuauguuuau

SEQ ID NO: 271601 - RNA, 64 nt, Human
uggcagcccccagcuccccucagugcugcugucaguguagcaaauaaagucaugauauuuuccu

SEQ ID NO: 271602 - RNA, 64 nt, Human
ggguguggugaggguucuaggggaucucagauguguguagcacggagccugcuguguccugggu

SEQ ID NO: 271603 - RNA, 64 nt, Human
agcaggccauacuguguuggggcaaaggugucccguguagcacucagauaaguauacagcgaca

SEQ ID NO: 271604 - RNA, 64 nt, Human
caaccaaucguagauguuuuugcuguuccauucuguguagcaccauucaccacagcaggauagg

SEQ ID NO: 271605 - RNA, 64 nt, Human
ugcugugcuggguuaacagcuuccuucccuuucuguguagcagucuugaaauguucuguuuaaa

SEQ ID NO: 271606 - RNA, 64 nt, Human
aacacgagcacacucucuucgaacccaauuguggguguagcaaugaaagcaauaugauaugcug

SEQ ID NO: 271607 - RNA, 64 nt, Human
uuuuuuuaccaacagcauacuuaacagacuugcuguguagcaguuuuuuucugguggaguugcu

SEQ ID NO: 271608 - RNA, 64 nt, Human
gcaguauagaucugugcauagauauaugcauuaaguguagcaaaucgugauguaaauuuuuuac

SEQ ID NO: 271609 - RNA, 64 nt, Human
uacuagcaaagacaugggcaccggaguaggucccguguagcaugcgggugcuguagagaaaauu

SEQ ID NO: 271610 - RNA, 64 nt, Human
auaguaguuguuccuuagagcaauauguuguuacguguagcagaaauaaaguuuucuuugcuua

SEQ ID NO: 271611 - RNA, 64 nt, Human
uuauaguuuaauaguaagggagauaacacagcauguguagcaccaguugauaauuggucucuag

SEQ ID NO: 271612 - RNA, 64 nt, Human
aguguuauugaacuguaauucucucaauaacucaguguagcacuuuaaagucugaaggacagca

SEQ ID NO: 271613 - RNA, 64 nt, Human
acuaagcauuuaaaagagaaucuaauuuuuaaagguguagcaccuuuuuuuuauucuucccaca

SEQ ID NO: 271614 - RNA, 64 nt, Human
caagggcugugucucuacccccuagccugggcguuggaucuacuggaaugagcagcagccgcuu

SEQ ID NO: 271615 - RNA, 64 nt, Human
gcaaagucuuuuggaccgaugaugucucuacuacuggaucuaucuguauuaacagcaauguuac

SEQ ID NO: 271616 - RNA, 64 nt, Human
gggacugcaugcuacugucuagagcuugucucaauggaucuagaacuucaucgcccucugaucg

SEQ ID NO: 271617 - RNA, 64 nt, Human
auagucacuguuuaaggaaaaaaguaauuaugagguguagcagauugcagaaaaacaggauuag

SEQ ID NO: 271618 - RNA, 64 nt, Human
uagaaguguacggucacggucgccucaugaaaguguguagcagguggcucucaggaaaaauacc

SEQ ID NO: 271619 - RNA, 64 nt, Human
uaggacaaacauagauaugacauuugcugccucaguguagcaauuggaaauauuuauaaguuau

SEQ ID NO: 271620 - RNA, 64 nt, Human
uuuuuacuugaaauuaaauuuggcucuaaaguugguguagcagcaguugaucagacugaaaaac

SEQ ID NO: 271621 - RNA, 64 nt, Human
uacuguauuuauaaacuuuguaccacaagagagaguguagcacccauuuuacagugccaugcac

SEQ ID NO: 271622 - RNA, 64 nt, Human
ugcaugccuuucuaaagguaugcuagagucaccuguguagcauuguaauuauguacuaucaaac

SEQ ID NO: 271623 - RNA, 64 nt, Human
agugaguuaucgugagaucugguaguuuaaaaguguguagcaccuccccacucucucuuucucc

SEQ ID NO: 271624 - RNA, 64 nt, Human
gguacaaaggcaaaaggaccacagcaccacuuagguguagcauggauuuuaaacugcagucagu

SEQ ID NO: 271625 - RNA, 64 nt, Human
uagguaacauguuaaugagggaaaauguuuaccaguguagcauuggaucaaaaaguuuaucaca

SEQ ID NO: 271626 - RNA, 64 nt, Human
gacugugugcaccagucccagacacuuggcagaaguguagcagcguuacacaugugugcgaagc

SEQ ID NO: 271627 - RNA, 64 nt, Human
ggcguguaucugguccuagugaagaggaaggccuguguagcagaaaggcuuugggccugagagg

SEQ ID NO: 271628 - RNA, 64 nt, Human
uccugaaucuugggcccuuuugauugugaauacuguguagcaggaucuugagaguccuuguucu

SEQ ID NO: 271629 - RNA, 64 nt, Human
gggacggguggugcuuaaaagaggaaggggaccaguguagcaacuugccagggaccccaccccu

SEQ ID NO: 271630 - RNA, 64 nt, Human
gagauggaauucaagagagaagugucuccuccucguguagcagcuugagaagaggcuugggagu

SEQ ID NO: 271631 - RNA, 64 nt, Human
agccucuuuccccgugucccguuggaucugagcuguguagcacuuguugcauuacaaagaaaaa

SEQ ID NO: 271632 - RNA, 64 nt, Human
uguuuuaugguuucauguaacauacauauuccugguguagcacuuaacuccuuuuccacuuuaa

SEQ ID NO: 271633 - RNA, 64 nt, Human
aaaagguuccuggauacugacuaacuuggguggguggaucuagccaggagaaagacaguaacau

SEQ ID NO: 271634 - RNA, 64 nt, Human
ggcacccaacccuuuuccaccugugcuuaucgccuggaucuaucauuacugcaaaaaccugcuc

SEQ ID NO: 271635 - RNA, 64 nt, Human
gugaggucuuuaaaguuucaaugaaaguuucuucuggaucuacagaaaaaauuuuuuuuuuuca

SEQ ID NO: 271636 - RNA, 64 nt, Human
agguguauuacaucagguuuucaaaccagcccugguguagcagacacugcaacagaugccuccu

SEQ ID NO: 271637 - RNA, 64 nt, Human
agagggcagaauccgcagcucucaucauugugauguguagcaugucugcccucugacuggacau

SEQ ID NO: 271638 - RNA, 64 nt, Human
agaugagcccaaacuuucgaucuaggugggugauguguagcaguucaagggaagggugcugugu

SEQ ID NO: 271639 - RNA, 64 nt, Human
aaugaacaguaauugccugguagguuugguguguguguagcauuguguguccaucuguuauaug

SEQ ID NO: 271640 - RNA, 64 nt, Human
auuaaaagaaaacagcacagagaaguuaaaugcgguguagcaaaguuauggggucugcuugagg

SEQ ID NO: 271641 - RNA, 64 nt, Human
uguccucuuccuuauuccucuagugguugaagcuguguagcauuuuaacauauauauauucaca

SEQ ID NO: 271642 - RNA, 64 nt, Human
aacaucccaaggcugucccauaggguuggaaguuguguagcauucacucccuuaccuacuggca

SEQ ID NO: 271643 - RNA, 64 nt, Human
auaucugaagcucucguucauuaauuuuaguccuguguagcagaauucaauuacgggaacuacc

SEQ ID NO: 271644 - RNA, 64 nt, Human
cuuuuauuaucuaauacuaucuuacgucuaauuaguguagcauuuacaagaaagaaaaauuaag

SEQ ID NO: 271645 - RNA, 64 nt, Human
cuguguacugcaguugguaugaccccucuaaggaguguagcaacuacagucuaaagcugguuua

SEQ ID NO: 271646 - RNA, 64 nt, Human
ugauuuuuauccaugcgucaguuuuucccacccaguguagcauccuaaagauaaagccagaagc

SEQ ID NO: 271647 - RNA, 64 nt, Human
uucagcagcaucuaucauguagauaaauucccagguguagcauuacagcuucugacuaauauag

SEQ ID NO: 271648 - RNA, 64 nt, Human
ccuaggcagggcuggcuuucuuagcguguaacuuguguagcagcacagggcccacacuuagaag

SEQ ID NO: 271649 - RNA, 64 nt, Human
aaaggaggccacaggagauuccugggagcacuggguguagcaaaacaaagccacucucugcuuc

SEQ ID NO: 271650 - RNA, 64 nt, Human
gaagaagccuguaacacuccucugcgucuauccuguguagcauacuggcuucaccaucaauccu

SEQ ID NO: 271651 - RNA, 64 nt, Human
uguaaauacaacagaacauuaauaaauaucucuuguguagcaccuuuuacuguagauuagugcu

SEQ ID NO: 271652 - RNA, 64 nt, Human
augggcacuagucccuuacagaugaccaugcugauggaucuauucaucuauuuauuuaaaucuu

SEQ ID NO: 271653 - RNA, 64 nt, Human
caauuagaacacaacaggccaacucauacucauuuggaucuauuuagacaacguuaaccaauau

SEQ ID NO: 271654 - RNA, 64 nt, Human
gcguaaggugccucgcugaagggagcucgaggccuggaucuagggcagacacacaaccuccucc

SEQ ID NO: 271655 - RNA, 64 nt, Human
cugggacuaugguacuaaauccaguagaugggcuguguagcaacucucccagggaacacacuag

SEQ ID NO: 271656 - RNA, 64 nt, Human
gcggcuuccccaucgccuucuggggaggggcuccguguagcaacccagguguuguccgugucug

SEQ ID NO: 271657 - RNA, 64 nt, Human
cuauaucaggaacaucccugagaaacgguuuuaaguguagcaacuacucuuccuuaauggacag

SEQ ID NO: 271658 - RNA, 64 nt, Human
auauauucuguaaagugccauagucuuuuuuuauguguagcauauuuaaaaauauauauguaua

SEQ ID NO: 271659 - RNA, 64 nt, Human
ccacaugcaaacacacacagccacauauauacauguguagcacagcgcuaaacacuguggaggc

SEQ ID NO: 271660 - RNA, 64 nt, Human
cgaaggaaccauccuugguucucccagcuugguuguguagcaaucccucagcauuguuuuucuc

SEQ ID NO: 271661 - RNA, 64 nt, Human
gugauuguaguuuaauacaggaacacacagggcuguguagcaugauaccaggcccaggagauca

SEQ ID NO: 271662 - RNA, 64 nt, Human
acuggagagguccacagccuuguccagaguuccuguguagcacggggagcaaugauggagggag

SEQ ID NO: 271663 - RNA, 64 nt, Human
cuugcugucugucucucucucaguacaguucaagguguagcaaguguacccacacagauagcau

SEQ ID NO: 271664 - RNA, 64 nt, Human
uguuaauaagaccaaauuaaaaaggcuaguggcuguguagcauccucagugcaaaacccagcuc

SEQ ID NO: 271665 - RNA, 64 nt, Human
ugcuaagcccaaagauuacauguugguguucaaaguguagcaaaaaaugauguauauuuauaaa

SEQ ID NO: 271666 - RNA, 64 nt, Human
aaaggaaaaaaaaaucuucagaugcaaugguuuuguguagcaucuugucuaucauguuuuguaa

SEQ ID NO: 271667 - RNA, 64 nt, Human
ucagugguauuuugcauuggaaaaaggaagcacuguguagcagugaauugucugcuuuccaccg

SEQ ID NO: 271668 - RNA, 64 nt, Human
cgaggcucccagagcagccucugucaccgcuucuguguagcaaacauuaacgaugacaggggua

SEQ ID NO: 271669 - RNA, 64 nt, Human
uauuuugaucaaacugugcaaacaguaguaccacguguagcauuuugaaacauuauuuuuuuuu

SEQ ID NO: 271670 - RNA, 64 nt, Human
auucauaguaaaguucguuuuuuauauguuuccaguguagcagaucucuauauaaauauauaaa

SEQ ID NO: 271671 - RNA, 64 nt, Human
cuuggaugaaaaaaguagaaaaguaggucauucuuggaucuacuuuuuuuuagccuuauuaaua

SEQ ID NO: 271672 - RNA, 64 nt, Human
acaagucuugaagaucuuggucauuuuaugacaauggaucuaaaaugucagcaucaugcaaagu

SEQ ID NO: 271673 - RNA, 64 nt, Human
uaauagaguuuugaaacaguacugugcaauccgauggaucuaauuaaaaaaaaggcaauauuuu

SEQ ID NO: 271674 - RNA, 64 nt, Human
auuugauuuuucuaaacuaucuaccauauuuuaaguguagcagcuuugacuuugcaauaacgug

SEQ ID NO: 271675 - RNA, 64 nt, Human
agggucuggacaugcaucuccuaaaggaagaacuguguagcaccauugaucacaauguaacauu

SEQ ID NO: 271676 - RNA, 64 nt, Human
gggaagucccuuauuuggaagagagaaaggauguguguagcacacacucaucauggauugcuca

SEQ ID NO: 271677 - RNA, 64 nt, Human
ggaaauccauucagaaaugagcuaacagucuccaguguagcaggagagccagucacuucccucc

SEQ ID NO: 271678 - RNA, 64 nt, Human
ggugacuguauaaaguuagugguauucagggacaguguagcaaguagcuuacaaggggacaauu

SEQ ID NO: 271679 - RNA, 64 nt, Human
uuaggaauauuuuucucccccuaccccauaaauuguguagcacuuuuuauuccauuugcuuuca

SEQ ID NO: 271680 - RNA, 64 nt, Human
ucauaccuaguuuuauaagcuguucuguaacauaguguagcaaaaaaaaaaguucaagucaugu

SEQ ID NO: 271681 - RNA, 64 nt, Human
uuaaagucauuuguaauguuauuguauaguuauuguguagcacauaugguuugcacuguauagu

SEQ ID NO: 271682 - RNA, 64 nt, Human
aauggaacaaaacucaucuggcugcaucccagguguguagcaaaguccacauguaaauuuauag

SEQ ID NO: 271683 - RNA, 64 nt, Human
gcuguucuuggggagaaggagggaggucucgggaguguagcaccaugccaaccagcccugcgcg

SEQ ID NO: 271684 - RNA, 64 nt, Human
cuuucuugcacauuaggaagcagaauauccuccaguguagcacagggggagaagugagaagugu

SEQ ID NO: 271685 - RNA, 64 nt, Human
ggggucuuuucagucuucccucuccucaaaccuuguguagcauugcacaauauagaucucaguc

SEQ ID NO: 271686 - RNA, 64 nt, Human
agacuuaggacucaugugcaguaaauauaaauaaguguagcaucagaagcaguaggaauggccg

SEQ ID NO: 271687 - RNA, 64 nt, Human
uaaguugucuaugggcacaaaguuuucuucauuuguguagcaaacuucuugugaauguggauua

SEQ ID NO: 271688 - RNA, 64 nt, Human
gcaaaaggcccugcucucuggaguguuguauauaguguagcaaaagaguauuuauacaucccac

SEQ ID NO: 271689 - RNA, 64 nt, Human
agguguaugcaguugugaccccauguguggggaaguguagcaaggacggcugguggagggggaa

SEQ ID NO: 271690 - RNA, 64 nt, Human
uaguuuccuuuuuaauaugcuuaaaauaagcagguggaucuauuucauguuuuugaucaaaaac

SEQ ID NO: 271691 - RNA, 64 nt, Human
gucuguggcagggcuccucuggcccgcaguggccuggaucuaucugggccaugagugacgggca

SEQ ID NO: 271692 - RNA, 64 nt, Human
aagugaaaacugauuucccauuuuaaagaagaaguggaucuaaauggaagcaucugcuguuuaa

SEQ ID NO: 271693 - RNA, 64 nt, Human
guauauguaaugguuauauguacucauguuccugguguagcaacgugugguauggcuacacaga

SEQ ID NO: 271694 - RNA, 51 nt, Human
acuuugcccuggccgagugagguguagcagaaaaaggcugugcugcccuga

SEQ ID NO: 271695 - RNA, 64 nt, Human
gcaaaaaaaauuuuuuagcaauuuuuguaaaacuguguagcauuuaaauuuccuauaccuucug

SEQ ID NO: 271696 - RNA, 64 nt, Human
ccagaagaugucugcauuacucauugcuaaaaauguguagcacagaacugcacuaggauuaauu

SEQ ID NO: 271697 - RNA, 64 nt, Human
uuuugagccaauuaagaaaauugccauuuuuaaaguguagcauuucaggguaaagacccaugaa

SEQ ID NO: 271698 - RNA, 64 nt, Human
cuuaggggccaacaaggcuuccagcuggauguguguguagcauguaccuuauuauuuuuguuac

SEQ ID NO: 271699 - RNA, 64 nt, Human
uguuuccccuuacugauaagcggccacuuuaggaguguagcaaauauagauugagcuauguuag

SEQ ID NO: 271700 - RNA, 64 nt, Human
cuuggguguggguuccucuuguuuugguuauuuuguguagcaguuuaaucaguggauaacugag

SEQ ID NO: 271701 - RNA, 64 nt, Human
gauucuggacagucagcucuucaucugcccaacuguguagcaucugcauugcccagucuuucau

SEQ ID NO: 271702 - RNA, 64 nt, Human
uuucuguccuagcuggagguguaaaaugcacaauguguagcagguagaauacagcuccuuaucg

SEQ ID NO: 271703 - RNA, 64 nt, Human
gagauaagaaacauaguuuuauacauuauguacaguguagcagugguuuugccuaguguuccaa

SEQ ID NO: 271704 - RNA, 64 nt, Human
ccuuuaaagauacagugugaaaauuugcucggguguguagcaguaauuacacgaggcaaacagu

SEQ ID NO: 271705 - RNA, 64 nt, Human
ugugguaagcuagguucauuccucaucaaggaauguguagcagauuguucacuguggaggaguu

SEQ ID NO: 271706 - RNA, 64 nt, Human
cccaaguucagcuuuggaggcagaucuggaaacaguguagcagcauugguuuuccaaaaaaugu

SEQ ID NO: 271707 - RNA, 58 nt, Human
aagaucugacucaagacugacucugauaguguagcauuuucccugggggaguuuuggu

SEQ ID NO: 271708 - RNA, 64 nt, Human
aaaugauugucacacaugucacuguagccucuugguguagcaagcucacauacaaaauacuuuu

SEQ ID NO: 271709 - RNA, 64 nt, Human; identical to SEQ ID NO: 233981

SEQ ID NO: 271710 - RNA, 64 nt, Human; identical to SEQ ID NO: 233987

SEQ ID NO: 271711 - RNA, 64 nt, Human; identical to SEQ ID NO: 233991

SEQ ID NO: 271712 - RNA, 64 nt, Human
uaaugaucaguuuacuuucaguggauucagaauuguguagcaggauaaccuuguauuuuuccau

SEQ ID NO: 271713 - RNA, 64 nt, Human
ggcgcucacuuaccucugacugccugggcgcugcguguagcaucuuggccuacaggacagauuu

SEQ ID NO: 271714 - RNA, 64 nt, Human
caccggggccacuuccggcugccucuuugcuacuguguagcaccugcugcaacguugccugcug

SEQ ID NO: 271715 - RNA, 64 nt, Human
gcugugaaguuuuaaggaauaaauaauauaauugguguagcacagugccuugcaugcaguaggc

SEQ ID NO: 271716 - RNA, 64 nt, Human
accuuuuuuucucuccuaagacaccugcaauaaaguguagcacccugguacaucugugauguuu

SEQ ID NO: 271717 - RNA, 64 nt, Human
cuuuucuuugaaauacaauaauuuauauagaaauguguagcagcaaauuauauuggggauuaga

SEQ ID NO: 271718 - RNA, 64 nt, Human
ccaaccuggauggggguuuggggaaggagggcauguguagcagagaacuuaggggggccuccuu

SEQ ID NO: 271719 - RNA, 64 nt, Human
cacuguagcuauuagcggcuccucgcccccaccaguguagcaucuuccucugcagaauaaaauc

SEQ ID NO: 271720 - RNA, 64 nt, Human
cucaauaaauggccuauaugugcaaagaaagaauguguagcaaaugaaaauaccagaccaagaa

SEQ ID NO: 271721 - RNA, 64 nt, Human
uccuuuucccuccaugcuccagguccaugcacagguguagcauguccugcuuccguuuuucaua

SEQ ID NO: 271722 - RNA, 64 nt, Human
cugccauucccuucuacugcacugcccaagguguguguagcacaaacaguucucauuacaaagg

SEQ ID NO: 271723 - RNA, 64 nt, Human
uacgagggcagucuuaacuuguguuaaggccuguguguagcauugaagguaaguaugaaggagu

SEQ ID NO: 271724 - RNA, 64 nt, Human
gaauuacacugugggaaaacuaccauuguaauaaguguagcaaaaucuccuuagauaucugaaa

SEQ ID NO: 271725 - RNA, 64 nt, Human
gagagaaugagagugaaagggacaaauaacaucuguguagcaguauuaugaaaauagcuugacc

SEQ ID NO: 271726 - RNA, 64 nt, Human
caucagaaguuacaauaggcauaugggcaaaaugguguagcaggcucacuggccguuuguuuuu

SEQ ID NO: 271727 - RNA, 64 nt, Human
uagaauuuucucccuuuauguaucucuaucgauuguguagcaauugacagagaauaacucagaa

SEQ ID NO: 271728 - RNA, 64 nt, Human
guguuagucauuaacuuagucaccuguuguauucuggaucuacacaaaauuauuuuaacugcuc

SEQ ID NO: 271729 - RNA, 64 nt, Human
uggcuuugggguucagagaccuggaauagaaacuuggaucuaugcacuacguuuaucugacaau

SEQ ID NO: 271730 - RNA, 64 nt, Human
auuaauagugguguuuuuaccuaugaaauuauucuggaucuaauaggacauuuuacaaaauggc

SEQ ID NO: 271731 - RNA, 64 nt, Human
aagauacucaucuuucuacauagacgggaacacgguguagcauggagauuaagcgugcuaacug

SEQ ID NO: 271732 - RNA, 64 nt, Human
ugauauguaagcuugaccuaaagucaaaggaccuguguagcauuucagauugagcacuucacua

SEQ ID NO: 271733 - RNA, 64 nt, Human
uucaccagugacagaugguuuccccauccacugaguguagcauccucagagguaggcaaguuug

SEQ ID NO: 271734 - RNA, 64 nt, Human
auggacuucaggagcccuuacuugguuuugaucaguguagcaaauuagggaugaagaguucaaa

SEQ ID NO: 271735 - RNA, 64 nt, Human
ggcuuuuucuaaagaggauggcagaacuuccaacguguagcaauacuauaagaaccaagguagc

SEQ ID NO: 271736 - RNA, 64 nt, Human
uguuuuauagcuccaaaugguuuuuuuauucucaguguagcaacuguuugauuucuuucuggau

SEQ ID NO: 271737 - RNA, 64 nt, Human
uacuuauaaugaaacuucauuaagguuucauucaguguagcaauuacugucuuuaaaaauuaag

SEQ ID NO: 271738 - RNA, 64 nt, Human
uuuaaaacuguaaagcuguguauagaacuguuuuguguagcauggaaauauucugucagcuuuu

SEQ ID NO: 271739 - RNA, 64 nt, Human
augaaaagguuuauauucacuauucuuuauuucaguguagcacuuuuagagccaaaaaaacuca

SEQ ID NO: 271740 - RNA, 64 nt, Human
acagugaagggaaaagagucugugaaggugaucaguguagcaguaagacaucuaaaaucaagac

SEQ ID NO: 271741 - RNA, 64 nt, Human
cagccauaacaaguuuacuuguggaaaagaaaagguguagcacuuucagaagaggcuaucaaag

SEQ ID NO: 271742 - RNA, 64 nt, Human
guaugaaaacacugagaaggagaugaaggaguguguguagcauggggguguguacaacuuaaca

SEQ ID NO: 271743 - RNA, 64 nt, Human
auugaaguaucagcuuguuugguacuaggugcaaguguagcaugucacaugugaccauguugga

SEQ ID NO: 271744 - RNA, 64 nt, Human
cugagaaguggguucaggcgaagggugaagccauguguagcaguuccugccagugcagaucugg

SEQ ID NO: 271745 - RNA, 64 nt, Human
acgucaguauuguuuuaaaguuucugucuguaaaguguagcaucauauauaaaaagaguuucgc

SEQ ID NO: 271746 - RNA, 53 nt, Human
gcaggcccccuccccgcuaauagguguagcagagaucucgcuccuguguuucc

SEQ ID NO: 271747 - RNA, 64 nt, Human
guggaguuuuaacuguaaggugcuacaaugccccuggaucuaccagcauaaauaucuucugauu

SEQ ID NO: 271748 - RNA, 64 nt, Human
acucccgaggauguguccuagacuccgggucgcguggaucuacccucuaguuuacuugcucggg

SEQ ID NO: 271749 - RNA, 64 nt, Human
guggagccuccuggcugagaaauuguuuugcaaauggaucuauuuuuguaugaaaaaaaaaauu

SEQ ID NO: 271750 - RNA, 64 nt, Human
uuuaauuguaaaaugagaaccgauuuucaguuuaguguagcagcacacuuguucagguuugcau

SEQ ID NO: 271751 - RNA, 64 nt, Human
cugugaaguuucugucauucguccagaucuguguguguagcaugugcugaggaagcacgugcug

SEQ ID NO: 271752 - RNA, 64 nt, Human
aggaaaaucacaauuacaccacuuuagacccuauguguagcaggucacaacuuacccuugugug

SEQ ID NO: 271753 - RNA, 64 nt, Human
acugcugugaggcagaggaaugauggagaaucuaguguagcagccuccaggcaggauucagcac

SEQ ID NO: 271754 - RNA, 64 nt, Human
aaaagauuuauuagaaaauucucacgcugaacugguguagcauguggugcagcauucagugaaa

SEQ ID NO: 271755 - RNA, 64 nt, Human
gaccuguggucuccaugccugugcccucacacagguguagcacacgcaugugcagauggcacca

SEQ ID NO: 271756 - RNA, 64 nt, Human
guggaaccguuccugaaaggccaccaggcgcccaguguagcacggaagaugcccacgugccuga

SEQ ID NO: 271757 - RNA, 64 nt, Human
ucacuggggucuguguggugcccaugaggacaaaguguagcagccuccugccugcuccaagaaa

SEQ ID NO: 271758 - RNA, 64 nt, Human
gaauaagugaauguuucuuuauugcauaacuggcguguagcacaaagaaaaagccccuucucca

SEQ ID NO: 271759 - RNA, 64 nt, Human
uucucuuauguauuuuugugcacuaggcgcaguuguguagcaguugaguaaugcugguuagcug

SEQ ID NO: 271760 - RNA, 64 nt, Human
uuuugcagaaacuuuugagggucguugcaagacuguguagcaggccuaccaggucccuuucauc

SEQ ID NO: 271761 - RNA, 64 nt, Human
acuguugcuaaaaaaagucauguaguuucauguaguguagcauccuuggcaucguuuuccaaaa

SEQ ID NO: 271762 - RNA, 64 nt, Human
caucaacaggggagcuaaaguugaagccagcuguguguagcagcuguuaccugaagacgugcua

SEQ ID NO: 271763 - RNA, 64 nt, Human
ggucuuaugcucauaagcaguucaugagugacaaguguagcaaaagccagccauauauuuucag

SEQ ID NO: 271764 - RNA, 64 nt, Human
gcugugaauccccugggcagggggcgacaacuccguguagcauuaacccccguggcgggguccg

SEQ ID NO: 271765 - RNA, 64 nt, Human
cagacuuacagaagaaguggcccuccauagacauguguagcaucaaaacacaaaggcccacacu

SEQ ID NO: 271766 - RNA, 64 nt, Human
acaguuggcaugguaguauacaaaaagauuguaguggaucuaauuuuuaagaaauuuugccuuu

SEQ ID NO: 271767 - RNA, 53 nt, Human
uggaggugauggagauuuaaccguggaucuauagcuguggccaaucagucaga

SEQ ID NO: 271768 - RNA, 64 nt, Human
guuuucuacuuugucuuugaacugaaaauaaacauggaucuagaaaaccaaccagcaaguuuuc

SEQ ID NO: 271769 - RNA, 64 nt, Human
ugcaggccgguggguccacuccaacucccccugaguguagcagcacacuuuccauacaccaggu

SEQ ID NO: 271770 - RNA, 64 nt, Human
aagucaauggagaagacagaaagguaaaaaucacguguagcaagaacaacucuuauuucacaaa

SEQ ID NO: 271771 - RNA, 64 nt, Human
ucauugccauagcaucaugaugcaacacaucuacguguagcacuacgacguuauguuuggguaa

SEQ ID NO: 271772 - RNA, 64 nt, Human
ugaacccagguuaggggcagaucagaagggcugcguguagcacccuuauggucuugcagaacac

SEQ ID NO: 271773 - RNA, 64 nt, Human
cagucauucauccaggccacguuuccucugcggaguguagcagcccugccuuucauagcaggga

SEQ ID NO: 271774 - RNA, 64 nt, Human
auuugcucucuacugauuggcugaaauccccgagguguagcaucuucucucccuugaaggcuga

SEQ ID NO: 271775 - RNA, 64 nt, Human
uuacuuucagggggcugcuuuccugggccaggcuguguagcacuucccacccucaggcaugagu

SEQ ID NO: 271776 - RNA, 64 nt, Human
cucugcucuugggaguguaaaaguugggaguguaguguagcaucuggggagacagcaggaucac

SEQ ID NO: 271777 - RNA, 64 nt, Human
ccccaaccucccugacuuccuucaguaacugacaguguagcauuguucuugauuaguuuggcac

SEQ ID NO: 271778 - RNA, 64 nt, Human
cuggaauauuguguaaacuaucugucuuacauuaguguagcauuuugcaauuuggggaacaucu

SEQ ID NO: 271779 - RNA, 64 nt, Human
aagguggaugcacuucccgcaccuccagucuucuguguagcagcuuuaacccacguuugucugu

SEQ ID NO: 271780 - RNA, 64 nt, Human
uguccugggcccugccacccgucugggcuccuuuguguagcauuaucagccucggucuggccuc

SEQ ID NO: 271781 - RNA, 64 nt, Human
ccgguuucaacacacacagacaaacacagccacacgcgcacacaaguauaagacuuuuuguauu

SEQ ID NO: 271782 - RNA, 64 nt, Human
caacccccaggucugcagcuccagguacauaucacgcgcacagccuggcagccuggcccuccug

SEQ ID NO: 271783 - RNA, 64 nt, Human
auauauauagaaauauauacgaacaaaacacacgcgcgcacacacacacauacacgaaagagag

SEQ ID NO: 271784 - RNA, 64 nt, Human
cauaaccguucccagguguacgcacgcgcgcgcgcgcgcacagacacacacacacacacacaca

SEQ ID NO: 271785 - RNA, 64 nt, Human
agugaauaugugacuaguaaagcuuaaauauguuuggaucuaauagagcucaugaaauacugua

SEQ ID NO: 271786 - RNA, 64 nt, Human
uaagacuugugcuuacaauauuuuugaccuggaguggaucuauuuacauagucauuuaggaucc

SEQ ID NO: 271787 - RNA, 64 nt, Human
guaaaugguccaaguacuccuagcuaguaaggaauggaucuacagccugccucccagguuucug

SEQ ID NO: 271788 - RNA, 64 nt, Human
agaccgagagaggaauggagagacagagggggcgcgcgcacaggagccugacuccgcugggaga

SEQ ID NO: 271789 - RNA, 64 nt, Human
ucagguggcccguccuuggugagugcacacacugcgcgcacacaucgcggccuuccuggcuucu

SEQ ID NO: 271790 - RNA, 64 nt, Human
cuaggcccgccggaggagcgcguccccagccuuccgcgcacagagccgcaucccgccccgcccu

SEQ ID NO: 271791 - RNA, 64 nt, Human
uaggacgaacaucugccccuucagggaggacccccgcgcacaccagaaccucuggcaagccgcc

SEQ ID NO: 271792 - RNA, 64 nt, Human
uaaaggugguccuuccuaccucuguggugugugucgcgcacacagcuuagaagugcuauaaaaa

SEQ ID NO: 271793 - RNA, 64 nt, Human
gccccgcaucucgcgccugcuacaucaaagggcccgcgcacaaagcaguguuucuucgccacgg

SEQ ID NO: 271794 - RNA, 64 nt, Human
acacacugccuggaugcauguaugcacacacaugcgcgcacacgugcucccugaaggcacacgu

SEQ ID NO: 271795 - RNA, 64 nt, Human
gacacauacauucaccgcccccccgcccccccaacgcgcacacacacguccucuccucccagga

SEQ ID NO: 271796 - RNA, 64 nt, Human
cauaccagucaguauucccagccuugagcgcacgcgcgcacacacacacacacauacacacacg

SEQ ID NO: 271797 - RNA, 64 nt, Human
gcacucucgcucacgcucagacgcuacacacgcgcgcgcacagacacggugcaccuaggucaca

SEQ ID NO: 271798 - RNA, 64 nt, Human
gugagcagauuuuuuagaagggauaggagacacacgcgcacacacacacacacacgaaacuuga

SEQ ID NO: 271799 - RNA, 64 nt, Human
uaaugaaccauguuguugcugguuguccuggcaucgcgcacacuguauguacauacuggcaacg

SEQ ID NO: 271800 - RNA, 64 nt, Human
auucucuuuucaaacacacacacacacgcgcgcgcgcgcacacacacucuucaaguuuuuuuca

SEQ ID NO: 271801 - RNA, 64 nt, Human
acauaaugccgagugcguaaggaaaccguggcgucgcgcacagugggucugcuugucaaggcca

SEQ ID NO: 271802 - RNA, 64 nt, Human
ccauuacaauuaacagucaaggauaaaacaagcacgcgcacaaucaaggagcuggaacacacuc

SEQ ID NO: 271803 - RNA, 64 nt, Human
aucuauauguguauuauguaugcgugcaugcgugcgcgcacacacacacacacacacacacacu

SEQ ID NO: 271804 - RNA, 64 nt, Human
uaauaaauguaauuucuuuccuuuuuuggacacuuggaucuaaaugauguaaagcaaaacagca

SEQ ID NO: 271805 - RNA, 64 nt, Human
ggcugaagucagucugacuugaaggggccugguuuggaucuaagcaaacacccagaugggguuc

SEQ ID NO: 271806 - RNA, 64 nt, Human
uuugguuuauuaccaacccuucccagaauugcguuggaucuaaaacuacuagaucucaucccau

SEQ ID NO: 271807 - RNA, 64 nt, Human
ugcacacccagacacacgcacgcacacacacgcgcgcgcacacacaugcuuuuuucuguucccc

SEQ ID NO: 271808 - RNA, 64 nt, Human
aaagaccgagcaggccacagaggcucggucuccccgcgcacagcguaggcacccgguguacucu

SEQ ID NO: 271809 - RNA, 64 nt, Human
gggauguuuucaaaagugccuugccauguaccuucgcgcacacacugguucuccucuuuugggu

SEQ ID NO: 271810 - RNA, 64 nt, Human
ucagccauggauauggaacagaaagacuaugacucgcgcacagcucugcauguugcugcagcug

SEQ ID NO: 271811 - RNA, 64 nt, Human
ucugagacacaccccaacaugccugcaccugcagcgcgcacacgcacgcacacacacauacaga

SEQ ID NO: 271812 - RNA, 64 nt, Human
gaugguuuuacuccuuuuuuuaaaaacacaugcgcgcgcacacacacaugcuuuacaaguuuua

SEQ ID NO: 271813 - RNA, 64 nt, Human
cagguggaacuguaguguagcgaccucacugcugcgcgcacagucucccgggacuuggacucga

SEQ ID NO: 271814 - RNA, 64 nt, Human
caaaaaagcaagagcgagagagaguacgugcacacgcgcacaaaagagagaaacggacaccaga

SEQ ID NO: 271815 - RNA, 64 nt, Human
acagagccgggagggucggcgucuggggucagggcgcgcacagcccagcagcccgaggccgccc

SEQ ID NO: 271816 - RNA, 64 nt, Human
gagcaaaggcugagaacacugugaaaacauuuugcgcgcacaauaguaaccuggguaaaugcag

SEQ ID NO: 271817 - RNA, 64 nt, Human
ucuuucuuuaccuaccccucaguuuuccuuaaaacgcgcacacaacucuagagaguguuaagaa

SEQ ID NO: 271818 - RNA, 64 nt, Human
acuggccccggcgggaugaggagaccaugccgggcgcgcacacacggcagcuucuguuugaaaa

SEQ ID NO: 271819 - RNA, 64 nt, Human
caccgccaucucuuuucuuuaaggcuucaggcagcgcgcacaggcucuggcagccgucucaggc

SEQ ID NO: 271820 - RNA, 64 nt, Human
acaaaucagaaucacguuuuuaguugugcgugugcgcgcacacguguguaaaaagcacuuucga

SEQ ID NO: 271821 - RNA, 64 nt, Human
ccugugcacacacacacacaugcacacacacgcgcgcgcacacacacacacacacauccacccc

SEQ ID NO: 271822 - RNA, 64 nt, Human
acagccgcugcccgaaccucugugugaagcuuuacgcgcacacggacaaaaugcccaaacugga

SEQ ID NO: 271823 - RNA, 64 nt, Human
ggggacuuagcuuccugauacuagguagugaugguggaucuagagacauucacuugaagagcaa

SEQ ID NO: 271824 - RNA, 64 nt, Human
ucgguaaggcccugcaacgcagagccugcuuauguggaucuauuuaugggaacuucuuaaaagg

SEQ ID NO: 271825 - RNA, 64 nt, Human
uuuuuuauaagcaaaaacgugccguuuaaaccacuggaucuaucuaaaugccgauuugaguucg

SEQ ID NO: 271826 - RNA, 64 nt, Human
ccgaaagcugagacccucgccacggggagggggacgcgcacacacaccggucaccgagacggcu

SEQ ID NO: 271827 - RNA, 64 nt, Human
cccuccccccgccaagugcucacacacaaccucacgcgcacacacacacacgcagauggaggcg

SEQ ID NO: 271828 - RNA, 64 nt, Human
uaacaaaaggacguaugccauggagaaacacacccgcgcacacagcugcucucuacagaggcug

SEQ ID NO: 271829 - RNA, 64 nt, Human
gucucugggacugugagaccuggccucgcacaggcgcgcacacaccgccaagcagcucagcauu

SEQ ID NO: 271830 - RNA, 64 nt, Human
cugccucagccucccaaguagcugggacugcaggcgcgcacaccacgcccagcuaauuuuugua

SEQ ID NO: 271831 - RNA, 64 nt, Human
ugugugugugugugugugugcgcgcgcgcgcgcacgcgcacacacucacgcacacacaagcaga

SEQ ID NO: 271832 - RNA, 64 nt, Human
acacacaugccacacagacacacaugcgcgcgcgcgcgcacacacacacacacacacacacaca

SEQ ID NO: 271833 - RNA, 64 nt, Human
cccccacccauccacacacaccuacacucacacacgcgcacaugggcgcgcacgaacuaccauu

SEQ ID NO: 271834 - RNA, 64 nt, Human
cccaucuuccuucccuccucugucccugccucggccaccccacgcgggaacccagcgccguccu

SEQ ID NO: 271835 - RNA, 64 nt, Human
ccuugaguaucuacuuggcuucucgugguuuuucccaccccagcugccccagcacgcgggaccc

SEQ ID NO: 271836 - RNA, 64 nt, Human
cggcccccucuggcuuggagagcauuccaagcccccaccccaccccuagaacugccauucccaa

SEQ ID NO: 271837 - RNA, 64 nt, Human
aaaaacaaaaagaaauguagauucuugggccccaccaccccacgccuacugagccagaaucucu

SEQ ID NO: 271838 - RNA, 64 nt, Human
ugcaucccuguugugcccuuuaagagacauguuuccaccccacccccaaccuugucccaagugc

SEQ ID NO: 271839 - RNA, 64 nt, Human
ccuuucuuccccccucacugugaaaaauaacaguccaccccaagucauacacuggacccagugc

SEQ ID NO: 271840 - RNA, 64 nt, Human
acuccaguuguaaugcauauuuuuaaagacaauuuggaucuaaauauguauuucauaauucucc

SEQ ID NO: 271841 - RNA, 64 nt, Human
gcagcagcaacacgagacccuccagcuuugggagccaccccacaccuggccaacgcuggcggcc

SEQ ID NO: 271842 - RNA, 64 nt, Human
uguacagccagcagggcccaggcagccaccaagcccaccccaggucaugccagcggcagaggac

SEQ ID NO: 271843 - RNA, 64 nt, Human
aacacgaucugggggggggauccugucuuccuccccaccccaccccacucuuacccaauuucug

SEQ ID NO: 271844 - RNA, 64 nt, Human
gaucugggggggggauccugucuuccuccccaccccaccccacucuuacccaauuucugggcuc

SEQ ID NO: 271845 - RNA, 64 nt, Human
aaauuacugaagugucuaaaaagaacagaaggacccaccccagccauaaugcagacuuucccau

SEQ ID NO: 271846 - RNA, 64 nt, Human
ucagcccauuucagacugcagaugccgcccacucccaccccacuccuaggcugccuuggagggu

SEQ ID NO: 271847 - RNA, 64 nt, Human
agcaacacagguggcagcuucucccccuuccuucccaccccagucccucuucccaccccucucu

SEQ ID NO: 271848 - RNA, 64 nt, Human
cuugugaggucaaggugguggccaaggacaccagccaccccacugacccucugaccuccuuccu

SEQ ID NO: 271849 - RNA, 64 nt, Human
uggagaacacuugaguugugaagguuuugggcauccaccccagaaagugggaauuugauuuuau

SEQ ID NO: 271850 - RNA, 64 nt, Human
uccuggaaagacucaauagugagaauauagccucccaccccauuaacuucgcucccaugggaga

SEQ ID NO: 271851 - RNA, 64 nt, Human
agccaggacaccucaagucuccagccccacuaccccaccccacuccuguauucuuuuuuuuuuu

SEQ ID NO: 271852 - RNA, 64 nt, Human
ugggugccuggccuccagugucccaccuccuucaccaccccacuuggcuccuuugccaucuuga

SEQ ID NO: 271853 - RNA, 64 nt, Human
guuauuucuguaaagaugguuauuuaacccuccuccaccccaucacgguggcccugagggcuga

SEQ ID NO: 271854 - RNA, 64 nt, Human
aguuggagaaagaggcuuccuugagccacccuucccaccccagcccuugcuggucccuaggcca

SEQ ID NO: 271855 - RNA, 64 nt, Human
gguaagaccuggcccuccccugcugcccugaagaccaccccagucuaccucggugcuggccagg

SEQ ID NO: 271856 - RNA, 64 nt, Human
cucucacugugccuucacaccauccauguguaauccaccccaucagcagugguucuccuacuuu

SEQ ID NO: 271857 - RNA, 64 nt, Human
gaucugagacaaaauuuaaugcacaacagugaguuggaucuagcaauaaagucuccuugguacu

SEQ ID NO: 271858 - RNA, 64 nt, Human
uuguuaaauggcaaauggcccaauuuaagggcuuuggaucuaauuugccucugauguuuccuuu

SEQ ID NO: 271859 - RNA, 64 nt, Human
ccauucaugacuuagaguccugccguggcucagguggaucuaaaacucaagaacaaauucuauu

SEQ ID NO: 271860 - RNA, 59 nt, Human
augccaagcaucggaaauaacugcuucucccaccccaucccuaaggggcucccaggccc

SEQ ID NO: 271861 - RNA, 64 nt, Human
agagaaacugaaguguuagacacuaugugucccaccaccccauuacagagacauaugacaaugu

SEQ ID NO: 271862 - RNA, 64 nt, Human
ccacuugugagcgcccccagcuuugcggcgccccccaccccagcgcugucugugggucccuugc

SEQ ID NO: 271863 - RNA, 64 nt, Human
cacccaccggaagcgcucuuuacuuggucgcuggccaccccaguguuuggaaaaaaaucucugg

SEQ ID NO: 271864 - RNA, 64 nt, Human
cagguuucaagucuggguucugguguccacucacccaccccaccccccaaaaucagacaaaugc

SEQ ID NO: 271865 - RNA, 64 nt, Human
aaggaccagguccuguuccucuuucuccccgacuccaccccagcucccugugaagagagaguua

SEQ ID NO: 271866 - RNA, 64 nt, Human
gggcugcuuuucugcccuuccucacccccacgccccaccccacucccccagaguacuccccacu

SEQ ID NO: 271867 - RNA, 64 nt, Human
agaugcacucuuuuguuguaccaaauagggcuccccaccccaccccugcgacaagugcucuucu

SEQ ID NO: 271868 - RNA, 62 nt, Human
gcagggcugaagacaugugagacuucccugccccaccccacaugacauccgaggaucugaga

SEQ ID NO: 271869 - RNA, 64 nt, Human
ugcugccuucucuaugcagccugcccuccaucauccaccccagaauugcucucuuuccucucuu

SEQ ID NO: 271870 - RNA, 64 nt, Human
ccccacuuaucccucuccauaaccccacccuugcccaccccacccccacccccaccaagggcgc

SEQ ID NO: 271871 - RNA, 64 nt, Human
ugggggguuuccgcugccccccacccccagcggcccaccccaugccucagcuucaugucugucc

SEQ ID NO: 271872 - RNA, 64 nt, Human
ucuuuggggcagcuggucccggagaggccucgacccaccccagugcuuguuccucucaucuccc

SEQ ID NO: 271873 - RNA, 64 nt, Human
aaguuaacuacaguguuuuccuuugcaccgauccccaccccaauucaaucccggaagggacuua

SEQ ID NO: 271874 - RNA, 64 nt, Human
uagaaguaaacaguucauccaugaucucacuuaaccaccccaauaaaucugauucuuuauuuuc

SEQ ID NO: 271875 - RNA, 64 nt, Human
ucuucugggcuuccccugguuucuguccuaguucccaccccaaguuuaagaagacuuagauuca

SEQ ID NO: 271876 - RNA, 64 nt, Human
cuuuugcucauggccuugacagugcucuaguugcuggaucuaauggccugucuugguuucuauc

SEQ ID NO: 271877 - RNA, 64 nt, Human
cauaauugucucuacagucugauauuaaaggcauuggaucuaucuuggauaucauacaugguca

SEQ ID NO: 271878 - RNA, 64 nt, Human
uagaaaaacuauuguguaacacauaaugaaauaauggaucuaggcaugauucucuguacagguu

SEQ ID NO: 271879 - RNA, 64 nt, Human
uuaaagaaaugaugacaauccucuuggcaucaccccaccccacauucuccccgauguuccucuc

SEQ ID NO: 271880 - RNA, 64 nt, Human
uccuuugugcucugagagguuggagacaucugguccaccccauugccccugccccuggcaagcc

SEQ ID NO: 271881 - RNA, 64 nt, Human
aggcucagagcagcuaguguggagcucagcauccccaccccaccccuccucccuguagagcuga

SEQ ID NO: 271882 - RNA, 64 nt, Human
accugaucccaauaccagcuucccccagccccugccaccccagagggcggccacgacagggaga

SEQ ID NO: 271883 - RNA, 64 nt, Human
cugcaucagugacugaauucugccuugguucuggccaccccagagugggagaggcugggagguu

SEQ ID NO: 271884 - RNA, 64 nt, Human
cacgguucccaggggccaggcugggagcccacagccaccccacuaugccgcaggccgcccuacc

SEQ ID NO: 271885 - RNA, 64 nt, Human
aaacuugucuuucccugcaguaaggcugguuuccccaccccagaaacauguaacgguugguacc

SEQ ID NO: 271886 - RNA, 64 nt, Human
aggccuguggcggucagggcaggggucugugucuccaccccaagggcugauggucccuccccug

SEQ ID NO: 271887 - RNA, 64 nt, Human
acuggauggaguggaggaggcccaggccacaguaccaccccaccugcccaggcagccccucguc

SEQ ID NO: 271888 - RNA, 64 nt, Human
cugauguggaaugcaguccucaucuccagccuccccaccccagugggaacugugcaaagggcug

SEQ ID NO: 271889 - RNA, 64 nt, Human
accucccccuuccccuacccaacccugcccugccccaccccaccucacagcuacucaguggggc

SEQ ID NO: 271890 - RNA, 61 nt, Human
gcgcucauaaaggcagcugagggggcaccugccaccccacugaugcccaaacugucagacu

SEQ ID NO: 271891 - RNA, 64 nt, Human
auaaagugguuugauggugacuuccucgccucucccaccccaugcauuaaauuuuaagguagaa

SEQ ID NO: 271892 - RNA, 64 nt, Human
ggacagacagucccccgagguaggcuacauccccccaccccagcuggucugcuuggauuuccua

SEQ ID NO: 271893 - RNA, 64 nt, Human
augauguaguuguuguugcuuuuuucccuauuuuccaccccagucgcuccuuaccgugacuccu

SEQ ID NO: 271894 - RNA, 64 nt, Human
uggguuaaagggaucugcaguggggccaaggaugccaccccacccucagcuguaggcaagcuug

SEQ ID NO: 271895 - RNA, 64 nt, Human
cuuccauggagcaggaggaacauaccacagaacauggaucuauuaaagucacagaaugacagac

SEQ ID NO: 271896 - RNA, 64 nt, Human
gcggcuuuuccaggugcacggugcaagcuguugguggaucuaccauucuggggucuggaggacg

SEQ ID NO: 271897 - RNA, 64 nt, Human
gaaacagcagaauuccagccaaggcaaauucaguuggaucuagggcuugaaaacugcccaagau

SEQ ID NO: 271898 - RNA, 64 nt, Human
cucuggccaccagcugggcgacgucacccugcucccaccccacccccaaguucuaaggucucuu

SEQ ID NO: 271899 - RNA, 64 nt, Human
ucccccuaccgcauggcagcugggcccacagcccccaccccagcacagcuccuccccugccgcc

SEQ ID NO: 271900 - RNA, 64 nt, Human
ccugcuucgaaggacucauucuuuccucccacuuccaccccaacauagaguaguauuugcuuuu

SEQ ID NO: 271901 - RNA, 64 nt, Human
cccuaccccaacccuucaacuaccagaaucugggccaccccagcaguauuuuuauuuaaaaugu

SEQ ID NO: 271902 - RNA, 64 nt, Human
cuugaaaguggacuguucucaggcuugaccugccccaccccauccccgcgguugaggcuguggg

SEQ ID NO: 271903 - RNA, 64 nt, Human
ugcagcuggccacacugagggcccucugggaaccccaccccacuggagccgcuccggcagcucu

SEQ ID NO: 271904 - RNA, 64 nt, Human
ugggggcauucuucuaggaaugaggggcaucagcccaccccaggcaccucagugggguuccggg

SEQ ID NO: 271905 - RNA, 64 nt, Human
ccuccugacccuccccgcugugguuggcagccacccaccccagaggcuggcagagggaaagggg

SEQ ID NO: 271906 - RNA, 64 nt, Human
agagugugcccugccccucaugcucagaccucucccaccccaaacccucucccgggacucaguc

SEQ ID NO: 271907 - RNA, 64 nt, Human
gcaauaaugucacuguggacccagucucacuccuccaccccacacacugaagcaguagcuucug

SEQ ID NO: 271908 - RNA, 64 nt, Human
gagcuggcaggcagcuauuaccccgguucuuuccccaccccaggucugucucuugccuuuucuu

SEQ ID NO: 271909 - RNA, 64 nt, Human
cagggcagccugcagcuguguccaggcccaggccccaccccauaacagguggccucagccacac

SEQ ID NO: 271910 - RNA, 64 nt, Human
acagccaggccaugacccaggggagccagcgcugccaccccacccagcgcugccagggagccgc

SEQ ID NO: 271911 - RNA, 64 nt, Human
aaauuuuuuuaaauggaagcuucuagcaagccccccaccccaaucaaccucuaugcuuucuucu

SEQ ID NO: 271912 - RNA, 64 nt, Human
gggagggcaucucccugcuccccucaacccccucccaccccauccacgcccccuaccuuuccca

SEQ ID NO: 271913 - RNA, 64 nt, Human
cacucaucccucuuuuucuuucuuccaccacuccccaccccagcuguaguuaauuucagugccu

SEQ ID NO: 271914 - RNA, 64 nt, Human
cuuguguuguucccugcuguccuccguauuacgugaccggcaaauaaaucucauagcaguuaau

SEQ ID NO: 271915 - RNA, 64 nt, Human
cgucagcagggacuucguggccagcggggcggaggaccggcacggcuacaucugggaccgccac

SEQ ID NO: 271916 - RNA, 64 nt, Human
uaauuuuuaugcaugcuuuaaaaguauauaucgggaccggcagaaauggaaguauccauacauu

SEQ ID NO: 271917 - RNA, 64 nt, Human
ugccccuuccuccuucaugccugggccugcaggcccaccccagccaccacugaguccacucgga

SEQ ID NO: 271918 - RNA, 64 nt, Human
caggauacggaggggagcccagggccauccauacccaccccaggguaacggggcuggccuggca

SEQ ID NO: 271919 - RNA, 64 nt, Human
gacacaggcuguugagaauucuuugccacuuuucccaccccaaaacagcauggggccugacauc

SEQ ID NO: 271920 - RNA, 64 nt, Human
cccuggguucuuccacagcacaaacacaccucugccaccccagguuuuucaucugaaaagcagu

SEQ ID NO: 271921 - RNA, 64 nt, Human
uacacccuucugcccucucuccauugccugcaccccaccccagccacucaacuccugcuuguuu

SEQ ID NO: 271922 - RNA, 64 nt, Human
uacgguaagagauuaaauauaaacacagcaaguuccaccccaguccuauuuguccaaggcugca

SEQ ID NO: 271923 - RNA, 64 nt, Human
guaagugacuuugaaaaguuuuguggcaccugacccaccccagacacuagggcuaucagaaggu

SEQ ID NO: 271924 - RNA, 64 nt, Human
gcuggucucaaacuccugaccucaggugauccacccaccccagccucccaaagugcuaagauua

SEQ ID NO: 271925 - RNA, 64 nt, Human
guacaggugugacauuuguuaccacccauuucucccaccccacccugcuuuuuuguuuguuugu

SEQ ID NO: 271926 - RNA, 64 nt, Human
gucaaccaggcagagucccuuucuuuucugcuccccaccccaacccugccccuauguacaggaa

SEQ ID NO: 271927 - RNA, 64 nt, Human
guccacugaucuugggucuggggugauccaaauaccaccccagcuccagcugucuucuaccacu

SEQ ID NO: 271928 - RNA, 64 nt, Human
uuugaaacuuugcuuuggguuuguggcacccuggccaccccaucuggcugugacagccucugca

SEQ ID NO: 271929 - RNA, 64 nt, Human
ggucuugacucaucuuuauuuuuauucgcacaucccaccccauccccugaacuacuugggaggu

SEQ ID NO: 271930 - RNA, 64 nt, Human
gaccagaaccuacugguacuuuauagcauuugccccaccccacagcuuagguuuuucugucauc

SEQ ID NO: 271931 - RNA, 64 nt, Human
gggcucgggguggagggucucagcucugcugcccccaccccaguacuagccuagcuucccaagc

SEQ ID NO: 271932 - RNA, 64 nt, Human
aggacaggugccgagcccugcauguggagcccucccaccccacccccagauagagggaaauaac

SEQ ID NO: 271933 - RNA, 64 nt, Human
acuccgucccugcccaccugcgacgggaucccccgaccggcacgggccacgccgagcucccggc

SEQ ID NO: 271934 - RNA, 64 nt, Human
cguaucauaccaccuguuccuguggagagggaaugaccggcacugaagguaccuuacaacuggc

SEQ ID NO: 271935 - RNA, 64 nt, Human
cagaggcaguucuuuguucaagcguuccucuggggaccggcagcagaggcaccguguucucuca

SEQ ID NO: 271936 - RNA, 64 nt, Human
acuggccauggccugcaaacugggaaccccuuucccaccccaaccugcucuccucuucuacuca

SEQ ID NO: 271937 - RNA, 52 nt, Human
ugccacgccagauccucugaucccaccccaggccuugccccugcccucccac

SEQ ID NO: 271938 - RNA, 64 nt, Human
ugggccugaacucggacaagugaucgccacccccccaccccaggcccugccagagcagggggac

SEQ ID NO: 271939 - RNA, 64 nt, Human
cuagcuuaaggcccaggacuguggaguguguggaccaccccacagaggagggacucagauuuau

SEQ ID NO: 271940 - RNA, 64 nt, Human
uggcucccuuugguuugggggucugccugaggucccaccccacuaaagggcuccccaggccugg

SEQ ID NO: 271941 - RNA, 64 nt, Human
gugauccaggaaagaugucccacagggaccacauccaccccagccccacugcccuccagggcca

SEQ ID NO: 271942 - RNA, 64 nt, Human
caggccucaccucccagggcuacacagacccugcccaccccaucccuggcugaccugcugugga

SEQ ID NO: 271943 - RNA, 64 nt, Human
caagcgucagccuuggagaugccaaagugaccagccaccccaucccuccccuacccaucugucu

SEQ ID NO: 271944 - RNA, 64 nt, Human
uuugaaauuuuucuuuuguuccccugucccuccuccaccccacacucccaccucuuucuaggac

SEQ ID NO: 271945 - RNA, 64 nt, Human
gcccuggccgcaauggacaagccuccugcucacuccaccccacccaccucugcccuguccuugg

SEQ ID NO: 271946 - RNA, 64 nt, Human
aguuguauuuagcuuugaguuucucugcaucuguccaccccauguguauauaacccagccccug

SEQ ID NO: 271947 - RNA, 64 nt, Human
ggaccaaggugugugugucuggaggaaccacugcccaccccaccaccccggggucucuggggaa

SEQ ID NO: 271948 - RNA, 64 nt, Human
gggugccuugggagaaccaguccuuccuuuugacccaccccaggaagauggagugcucuuuucu

SEQ ID NO: 271949 - RNA, 64 nt, Human
cggcuucccaaagugcuggaauuacaggccugagccaccccacccggccuauuuucuuaaaggg

SEQ ID NO: 271950 - RNA, 64 nt, Human
gaucaagugcuuucucuuuuacacuccccuguccccaccccagugcacucuucuggcccaggca

SEQ ID NO: 271951 - RNA, 64 nt, Human
aaaacaaagucuucaucucucucuccaguuucacccaccccacccuuugcuuucauuucaggug

SEQ ID NO: 271952 - RNA, 64 nt, Human
ccuagaggaccagcuguccaggggaggugguauugaccggcacucaguggguggagaggaagca

SEQ ID NO: 271953 - RNA, 64 nt, Human
guucucgcagauguuaccuaaaacugcugaacuugaccggcagaauguucugccguuuucugcu

SEQ ID NO: 271954 - RNA, 64 nt, Human
aaugaagagaaugccgauacucagacugcagcuggaccggcaagcuggcuguguacaggaaaau

SEQ ID NO: 271955 - RNA, 64 nt, Human
cagcaagugcugcuuuacuaacugacguguuggaccaccccaccgcuuaauggggcacgcacgg

SEQ ID NO: 271956 - RNA, 64 nt, Human
ucugauaaacugagguuuguuuuggcaccuucugccaccccagcagaagccuucauacaaguaa

SEQ ID NO: 271957 - RNA, 64 nt, Human
ccaaccauacacacauacaaguccacacacacucccaccccagccaaaaauauauaaaaaacaa

SEQ ID NO: 271958 - RNA, 64 nt, Human
aucaacaacccccaaccaccaucuaccacuacggccaccccaaaggaccccgacgccaacagac

SEQ ID NO: 271959 - RNA, 64 nt, Human
uggaauucaguuuuucaauuguggaaauuuccugccaccccaacaguauuuuuguguguuaauu

SEQ ID NO: 271960 - RNA, 64 nt, Human
aaaaugcugcacugcagcaaaaacaaaaccaccaccaccccagagaaaaccauguacuaauugg

SEQ ID NO: 271961 - RNA, 64 nt, Human
gggcugcaucugcugaagcgagaaccccauucugccaccccaccaggaugcccauucuccagga

SEQ ID NO: 271962 - RNA, 64 nt, Human
cuguuuugacugcuggcagucuaaaacaguccacccaccccauggcacugccgcgugauucccg

SEQ ID NO: 271963 - RNA, 64 nt, Human
accuacccucggcucccgggucuccccucccucgccaccccaaccagcggcuucugcgccgccc

SEQ ID NO: 271964 - RNA, 64 nt, Human
ucuccugcugagggaucccagagagggcaggugcccaccccacaggcccuuuccuggaccaugg

SEQ ID NO: 271965 - RNA, 64 nt, Human
cuccagaggaccuugguguuugcucucccuugacccaccccagugagugccaaagggcagcccc

SEQ ID NO: 271966 - RNA, 64 nt, Human
cggcagcccccaucuucaagggcugcuucuacacccaccccaccgaggugcugaagccugucag

SEQ ID NO: 271967 - RNA, 64 nt, Human
agcccuccacgccggcucuuccccacccucagccccaccccagguccugcagucuggcugagcc

SEQ ID NO: 271968 - RNA, 64 nt, Human
guguaucucccaaugcuaucccuccccccuccccccaccccacaacaguccccagagugugaug

SEQ ID NO: 271969 - RNA, 64 nt, Human
ggcuugugcugugguggguucgauuuaucccugcccaccccacccccacaacuucccuuuugcu

SEQ ID NO: 271970 - RNA, 64 nt, Human
agaggccacucccagggacccagggaggcgauggccaccccagaggccaccuuuugcuccacgg

SEQ ID NO: 271971 - RNA, 64 nt, Human
auuaaugaucuuucuuaaauauucuauauuuuaauggaucuacugacauuagcacuuuguacag

SEQ ID NO: 271972 - RNA, 64 nt, Human
agcagcaaaaacuacauuuugcaacuuguugguguggaucuauuggcugaucuaugccuuucaa

SEQ ID NO: 271973 - RNA, 64 nt, Human
aacucagcaagaagggacuguuucuaggugggcugggcgcgagcagggacugucccgagcggua

SEQ ID NO: 271974 - RNA, 64 nt, Human
ucuauaaacuauaaccucuccuucaugacagccuccaccccacaacccaaaagguuuaagaaau

SEQ ID NO: 271975 - RNA, 64 nt, Human
cugcgguaugagccccggccccuccccaccuuucccaccccagcccucuugcaagaggagaggc

SEQ ID NO: 271976 - RNA, 64 nt, Human
cucuuugugaucccuucuuacuuaauccuccuugccaccccaccaucaccagaccacugaucug

SEQ ID NO: 271977 - RNA, 64 nt, Human
ccugccggcccggacccgucccagccuccccuccccaccccaugcagcccccagggggauagcc

SEQ ID NO: 271978 - RNA, 64 nt, Human
cuccuuucacuucucugccuaugggcuacccuccccaccccacuucuaucucaauaaagaacac

SEQ ID NO: 271979 - RNA, 64 nt, Human
uaaacagcugacuguggcuucaaggacaucagggccaccccaaguccucaguguccuacuccug

SEQ ID NO: 271980 - RNA, 64 nt, Human
cccaccauauaaccuucgauugugcuucucaacuccaccccauaauuucucccagagaccaucu

SEQ ID NO: 271981 - RNA, 64 nt, Human
guuuugggaucaggagcccccaacacaggcaaguccaccccauaauaacccugccagugccagg

SEQ ID NO: 271982 - RNA, 64 nt, Human
ugcaucagcacugccggcccagugacaccgaguuccaccccaucggcuuccauaucuuccaggc

SEQ ID NO: 271983 - RNA, 64 nt, Human
uuguagaaauuuuacagucugccauuuugggugcccaccccaauuuuuaccuuuuaguaaguug

SEQ ID NO: 271984 - RNA, 64 nt, Human
ccagugaaggaggauggggcaggacaggacgcggccaccccaggccuuuccagagcaaaccugg

SEQ ID NO: 271985 - RNA, 64 nt, Human
ucuguuuugcccccauucuacuacccaccacugcccaccccacccccacaucacacacucuucg

SEQ ID NO: 271986 - RNA, 64 nt, Human
gguuuggggcugcgaaaacguugaccccuuucccccaccccagaguugggaugcggggcagagc

SEQ ID NO: 271987 - RNA, 64 nt, Human
aguguuucacaaagcuuagaccuuuaccuuccagccaccccacagugcuugauauuucagaguc

SEQ ID NO: 271988 - RNA, 64 nt, Human
aaaguuaggaagaaggacgagagagccucucuccccaccccaaucuaaauauggaauuugguaa

SEQ ID NO: 271989 - RNA, 64 nt, Human
ccucccgacuagcuggcauuacaggcgugcagcaccaccccaggcuaauuuaaaaaacuuuuuu

SEQ ID NO: 271990 - RNA, 64 nt, Human
ucaggucaggugcacauugcagggauaagcccaggaccggcagagagugguugccuuuccauuu

SEQ ID NO: 271991 - RNA, 64 nt, Human
uccuucaagcucaaacaccaccucccuuauucaggaccggcacuucuuaauguuuguggcuuuc

SEQ ID NO: 271992 - RNA, 64 nt, Human
ugcacggccgcaagucuccuggaaaggcuggagugaccggcaugccgggauugggagauuagga

SEQ ID NO: 271993 - RNA, 61 nt, Human
ugaaagagaagaggagguaggggccaagcccccaccccaucccacuccccuucccucccca

SEQ ID NO: 271994 - RNA, 64 nt, Human
aaaacaaaagcgaauuaaaacacaacaaaaaaccccaccccacaaccuucaggacagucuaucu

SEQ ID NO: 271995 - RNA, 64 nt, Human
ccaguuuguuuccucauacaccuuccucacuaccccaccccacaugguugacucuuucccucag

SEQ ID NO: 271996 - RNA, 64 nt, Human
ccugccagcugccacagcugcaugaccugcuuccccaccccacggugucguuuuguuuuuaaag

SEQ ID NO: 271997 - RNA, 64 nt, Human
uggggaggguggcuggcccggccuccacagcaccccaccccauaucuucuuuccauuuauuucg

SEQ ID NO: 271998 - RNA, 64 nt, Human
cccuugagaaggugcuuuguaauauucuccccacccaccccacgcccgcacccccgcacccuua

SEQ ID NO: 271999 - RNA, 64 nt, Human
ggccuuugcugaugacacauuagcuggaucuuagccaccccagaaaggguuugauuugaagcug

SEQ ID NO: 272000 - RNA, 64 nt, Human
ugcauugaggaccccugcuuccugguucucagucccaccccaaaaccuggcacccagaacaguu

SEQ ID NO: 272001 - RNA, 64 nt, Human
cauggggacaucuaacucuggucugggaagccacccaccccagggcaaugcugcugugaugugc

SEQ ID NO: 272002 - RNA, 64 nt, Human
gaccucuuuugccugcugcugugaagguauagcaccaccccagguccuccugcagugcggcauc

SEQ ID NO: 272003 - RNA, 64 nt, Human
uugagcucaugaagcaggcaaggaccgaacaccuccaccccaacguagaccugcaggugcugcc

SEQ ID NO: 272004 - RNA, 64 nt, Human
uaucucucuacacugaaaauaaaaccucuuccacccaccccauucgguucuucugccugaccuu

SEQ ID NO: 272005 - RNA, 64 nt, Human
gcucacccaucuguagcucccucaaagucagggcccaccccaucugaggcagagaagacucgag

SEQ ID NO: 272006 - RNA, 64 nt, Human
accuguggcggcuucagaucuccaaucccugccaccaccccaacucaaauuaaauacagauucc

SEQ ID NO: 272007 - RNA, 64 nt, Human
agggaggcccuuuucugaucaugccccuucucucccaccccaucuccccaccaccaccucugug

SEQ ID NO: 272008 - RNA, 64 nt, Human
ugagcccaacagguccacgauggauccaccagucccaccccagccuuuuccuuucaucugaaca

SEQ ID NO: 272009 - RNA, 64 nt, Human
gugcuggggccaguggggcuggggaccggcgggggaccggcagagcccaccugggggccccacc

SEQ ID NO: 272010 - RNA, 64 nt, Human
uccuggugcaggcaggcgggucacagggacccuggaccggcacaagaaacugcuuucuucucga

SEQ ID NO: 272011 - RNA, 64 nt, Human
cacccccagccccgacuccagccagcgccucccuccaccccaggacgccacucauuucaucuca

SEQ ID NO: 272012 - RNA, 64 nt, Human
acccuguccccgugggccguggcauggccacaccccaccccacuucucccccaaaaccagagcc

SEQ ID NO: 272013 - RNA, 64 nt, Human
gcugcuuucauuaauuacccuacuuucauuccucccaccccaagcaaaucccaacauuucucuu

SEQ ID NO: 272014 - RNA, 64 nt, Human
caggaaugcuacuaggaauuggaaucaaacaaugccaccccaagcguaauuuuagccagcaguu

SEQ ID NO: 272015 - RNA, 64 nt, Human
cuuauucuaguucagggucgugcguggccagaguccaccccagcaacucagugugcagggcagg

SEQ ID NO: 272016 - RNA, 64 nt, Human
gagccagaaggcgacuuauuuuuucucuccuaugccaccccagguggggagggagggagguuuc

SEQ ID NO: 272017 - RNA, 64 nt, Human
uucggucuccuuaaacuaccacccucgcugccacccaccccaagcugcugccgccucaccuucc

SEQ ID NO: 272018 - RNA, 64 nt, Human
agggcuccagaaagucagcagugugccugggcacccaccccauccucuaccugccacaccucag

SEQ ID NO: 272019 - RNA, 64 nt, Human
ccacuccuccacaaaccgugacccauagccgcccccaccccauaccuugaucuaccauccaucc

SEQ ID NO: 272020 - RNA, 64 nt, Human
uauuauuaaugccauuaucccugaaucccccuugccaccccacccucccuggaguguggcugag

SEQ ID NO: 272021 - RNA, 64 nt, Human
ccuccccgaggaagaaggcuucuggucaggacccccaccccaaggcuggggacuccaggcuccu

SEQ ID NO: 272022 - RNA, 64 nt, Human
aauggaaaaucgucuaacuggagaagggcgguauccaccccacauucggaucccaggguccuga

SEQ ID NO: 272023 - RNA, 64 nt, Human
agaaaggcacaauguggagccuggggugucucccccaccccaggaccgucagguuuaccagugu

SEQ ID NO: 272024 - RNA, 64 nt, Human
uccuuugccuuuacccuauaccucucugcacgucccaccccauuuugcugugugcucaccccca

SEQ ID NO: 272025 - RNA, 64 nt, Human
gcuuuguccuaacaguccacaguccugccccgacccaccccaucccuuuucucuggcacuccag

SEQ ID NO: 272026 - RNA, 64 nt, Human
uggauagauacacucauaaaacccccaccccuccccaccccaccccugcucccauugugugugu

SEQ ID NO: 272027 - RNA, 64 nt, Human
caguguggaauuuccucuuugaggagccugggcuuggaucuauccugaucuggugaugaagcca

SEQ ID NO: 272028 - RNA, 64 nt, Human
auauccuaaaugucauuaaaauccuccaacaugauggaucuacuuauggucuuguuuguugaca

SEQ ID NO: 272029 - RNA, 64 nt, Human
ccccuucuccccuccccgccuggccagggcagggccaccccacucuaccuccuuagcuuucccu

SEQ ID NO: 272030 - RNA, 64 nt, Human
agaagcugagauacugggcacaggguuguggccuccaccccagcucuggucugugcagacucau

SEQ ID NO: 272031 - RNA, 64 nt, Human
agggccuuuccuggcugaucagagcuuaccagccccaccccaccaugguagccuuagggugcug

SEQ ID NO: 272032 - RNA, 64 nt, Human
aucacuccaggucugaaaagcaagucccccagccccaccccagggagccagagaggcuugcacu

SEQ ID NO: 272033 - RNA, 64 nt, Human
cugaggcugguagcagaaugcacauuggaagcucccaccccauauuguucuucaaaguggaggu

SEQ ID NO: 272034 - RNA, 64 nt, Human
uuucagacuucuuuuuucucaaaccucaaaacuuccaccccaaacuucgcucucagcuggugac

SEQ ID NO: 272035 - RNA, 64 nt, Human
ugauccacagaaauacaugaaaugucuggucuguccaccccaucaacaagucuugaaacaagca

SEQ ID NO: 272036 - RNA, 64 nt, Human
uuuauauaaggcaguauuauugagcucuauuuccccaccccacuauccucacucccauaagcua

SEQ ID NO: 272037 - RNA, 64 nt, Human
gucuuagcacuuuccuucuccagauccccccuacccaccccagucccaaauccaguccucuggc

SEQ ID NO: 272038 - RNA, 64 nt, Human
ccugagacuccgagacuaucagaagggaauugacccaccccagucuagcaccacccugccuuca

SEQ ID NO: 272039 - RNA, 64 nt, Human
uaucagagccccagacagcacugccucuuccuccccaccccacugcccccaccuuaaugugaau

SEQ ID NO: 272040 - RNA, 64 nt, Human
uagugaaaagugugggaguuguaauuaggaucauccaccccagacauggaauccccccucccug

SEQ ID NO: 272041 - RNA, 64 nt, Human
ugagcagggccccucccccagcuccauuccgcucccaccccagccggcugcguuccucucucca

SEQ ID NO: 272042 - RNA, 64 nt, Human
ccauuuauucagcuacaucaucccucuauuaaccccaccccaucaggcacgugugcaaaccucu

SEQ ID NO: 272043 - RNA, 64 nt, Human
cugaagaucucgugacuauacuggcauuucagauccaccccacccccagacucaucccacucuc

SEQ ID NO: 272044 - RNA, 64 nt, Human
uucuccaucaggcauuaaaugaauggucucuuggccaccccagccugggaagaacauuuuccug

SEQ ID NO: 272045 - RNA, 64 nt, Human
gccugccgcuggggccgccgcacccugcaccuuggaccggcauccguagccauggacagagguc

SEQ ID NO: 272046 - RNA, 64 nt, Human
ugugcugagagaccaugugcccgagcaucugguugaccggcaugaaguacaucagccugucuua

SEQ ID NO: 272047 - RNA, 64 nt, Human
aaugagaaacuuuauacuucaguuuucagauauauggaucuagaucccaaauaaaugauuaauc

SEQ ID NO: 272048 - RNA, 64 nt, Human
uggggaacccuucauaggaaauccccacccccguccaccccagagacccugcccuuccacccgg

SEQ ID NO: 272049 - RNA, 64 nt, Human
uucuuuccuguuguaggggaggaagcuguucuccccaccccaggugccuuuggagguuaaggcu

SEQ ID NO: 272050 - RNA, 64 nt, Human
ccuggucgcuuugauucuuccugcacagcucagcccaccccaucuguacuggaagggacccugg

SEQ ID NO: 272051 - RNA, 64 nt, Human
acguuuuccuuuguuucaucugcuuccucucucaccaccccaucucccucucuuccccagcaag

SEQ ID NO: 272052 - RNA, 64 nt, Human
caggcugugcuuaccugugacagcagcucuguccccaccccaugggccucaugaauaaauggcu

SEQ ID NO: 272053 - RNA, 64 nt, Human
ugaagccacacauggcuggcggaacccagagcccccaccccagcccaccuggcucuuuguugac

SEQ ID NO: 272054 - RNA, 64 nt, Human
ugggggguggucugugcagacaccuccucacccaccaccccaugcauacucuugggaagcagcu

SEQ ID NO: 272055 - RNA, 64 nt, Human
uaccucauccuccuggaggguguggcuacccucgccaccccaaauuccaugucaauaaagaaca

SEQ ID NO: 272056 - RNA, 64 nt, Human
aacacaggcgcugaguauggagcagccuggagacccaccccaccugcagggcugcccugagcgc

SEQ ID NO: 272057 - RNA, 64 nt, Human
accaaguucccuugccuaagaaggccacucccucccaccccacugaagugggggauagucggug

SEQ ID NO: 272058 - RNA, 64 nt, Human
gcuccggccauggccgcuguguccgccgcaccagccaccccaaagcccuccuccuccuuaaccc

SEQ ID NO: 272059 - RNA, 60 nt, Human
acgccucucgccgccucugagcacccugccccaccccaccuccacucccaccucacccgg

SEQ ID NO: 272060 - RNA, 64 nt, Human
gggcagcaugcagccacuucacccuggggggccuccaccccaccaucuuccgccaggugugccu

SEQ ID NO: 272061 - RNA, 64 nt, Human
agguauccuucauuauccaccccaucccagacucccaccccagggauugcccgugaagacuuug

SEQ ID NO: 272062 - RNA, 64 nt, Human
ccccacuucugcaaccccagguauccuucauuauccaccccaucccagacucccaccccaggga

SEQ ID NO: 272063 - RNA, 64 nt, Human
ccccaccuccuguggacugaugccccagggauucccaccccacuucugcaaccccagguauccu

SEQ ID NO: 272064 - RNA, 64 nt, Human
ucagcugaagagacaagugaacuaaacuauaagcuggaucuaaagaaauuacccagugagcagu

SEQ ID NO: 272065 - RNA, 51 nt, Human
aauccacagaugcagaauaacuggaucuaacuggguaccugagauauuuua

SEQ ID NO: 272066 - RNA, 64 nt, Human
cuuugacauuuuuuuuuuuagaggaaauguaacuuggaucuaguuuaauuuuuuuuuuugcaac

SEQ ID NO: 272067 - RNA, 64 nt, Human
auuuuguuagaaaaacuuuuuuuuuuuuuucucaccaccccaagccccauuugugcccugccac

SEQ ID NO: 272068 - RNA, 64 nt, Human
cgccaaauaaaagagaggcccauugauuccucccccaccccaacacuuuucuuuuaaagcuuuu

SEQ ID NO: 272069 - RNA, 64 nt, Human
cauggguaaagcaggaagagagugggaaagagaaccaccccacucugucuucauauuugcauuu

SEQ ID NO: 272070 - RNA, 64 nt, Human
uguuccugacuccuucccaaugaacaccucucugccaccccaagcucugcucuccuccucugug

SEQ ID NO: 272071 - RNA, 64 nt, Human
cccugaaccccagccuguccgucaccccggauccccaccccauccccauuuuuuuaagcaauaa

SEQ ID NO: 272072 - RNA, 64 nt, Human
ccugggccuagccugcccuucucaggugccaauaccaccccagcccugcccuuggccucacuuu

SEQ ID NO: 272073 - RNA, 64 nt, Human
ggccuugccccuaguacccccuggcaggagcaacccaccccauggucgagguuccccuaccccu

SEQ ID NO: 272074 - RNA, 64 nt, Human
uccuucccccgccgccacugugccccccgucccuccaccccagaagcccugaccucauuugggc

SEQ ID NO: 272075 - RNA, 64 nt, Human
ucaaagccuuuucucaaagcccuuucaguuacaaccaccccacuauggaaucaguauuuaguua

SEQ ID NO: 272076 - RNA, 64 nt, Human
cccuggccucuacccacuaggugccaggaaugcgccaccccauccuccaccccgcccccaaauc

SEQ ID NO: 272077 - RNA, 64 nt, Human
gcugugugaucuugagaaagcuccuuccacucacccaccccacuucccagucuguugggaucag

SEQ ID NO: 272078 - RNA, 64 nt, Human
augaccacaccccguccaggccagacaccaccccccaccccacugucgugguggccccagaucu

SEQ ID NO: 272079 - RNA, 64 nt, Human
ggagagggacacgcgagaggcaggccaggcugcaccaccccaagagccacgccccucgcuggcg

SEQ ID NO: 272080 - RNA, 64 nt, Human
agccccgggcugacccagugugugcucagcagccccaccccacccugccccuuguccucucaga

SEQ ID NO: 272081 - RNA, 64 nt, Human
cucugcacuccacggcccuucucagccacacuucccaccccagggggugcccccaggcugaucu

SEQ ID NO: 272082 - RNA, 52 nt, Human
acagcuaccuggugagcugaugccaccccagcaucugucuuuucacccacgg

SEQ ID NO: 272083 - RNA, 64 nt, Human
aaccuaucacaacagugacuauaucacucagcauuggaucuaaauauaaaaguggugcuuucag

SEQ ID NO: 272084 - RNA, 64 nt, Human
aaggacaccuuugcagggauucuuguccugcuggccaccccacccacaccugucccuggccagc

SEQ ID NO: 272085 - RNA, 64 nt, Human
cccugagguaccuuuccacccagacccuccuuccccaccccauaagcccugagacucccgccuu

SEQ ID NO: 272086 - RNA, 64 nt, Human
cugccccgcgucuucagcuguuucgcauccaccgccaccccacugagagcugcuccuuuggggg

SEQ ID NO: 272087 - RNA, 64 nt, Human
auucucaaccaggaggugauuuugcccccugacuccaccccagggacauucaaaaaugucuggu

SEQ ID NO: 272088 - RNA, 64 nt, Human
augcacagcacaaccuacaacagcaaagaaucauccaccccaaaauaucaguagugccgagauu

SEQ ID NO: 272089 - RNA, 64 nt, Human
cacuucuugggguuuucaguaugaaccuaacuccccaccccaacaucucccucccacauuguca

SEQ ID NO: 272090 - RNA, 64 nt, Human
cccuuuuccuucuuucccccuauccuuuuucucuccaccccauccccccccccauuucguuuug

SEQ ID NO: 272091 - RNA, 64 nt, Human
guaguauuuuuuaaaauaauuuuauaucuguguaccaccccauauauuucauauuacuguuuca

SEQ ID NO: 272092 - RNA, 64 nt, Human
gcuuggcuuccacucagcaucagcguggcagucaccaccccagugaggaccucgauguccagcu

SEQ ID NO: 272093 - RNA, 64 nt, Human
cauuucucuauuucugugacgcgcccccaugcccccaccccaccacaagaggcaggagggccca

SEQ ID NO: 272094 - RNA, 64 nt, Human
uaaaaggauuugcuccuuguaugauguaaguggcccaccccaauuuuguaacaugaugcaagug

SEQ ID NO: 272095 - RNA, 64 nt, Human
gucacggggaagagcucccugcugugugccugcaccaccccacugccuuccuucagcaccuuua

SEQ ID NO: 272096 - RNA, 64 nt, Human
gaagauuuucaugagucagcccccccgcccgcccccaccccacacccacauccucucuuuucca

SEQ ID NO: 272097 - RNA, 64 nt, Human
uucaguuuuaaauguaccuucagaauaagcuuccccaccccaguuuuuguugcuugaaaauauu

SEQ ID NO: 272098 - RNA, 64 nt, Human
gagucgauuaaccugcaugcagcaacacccaaguccaccccaauuaacugaagcaaauaccaaa

SEQ ID NO: 272099 - RNA, 64 nt, Human
cguccugccauccccccccgccguccugccuuccccaccccacccuuaggucccagguaguugc

SEQ ID NO: 272100 - RNA, 64 nt, Human
ccugcggcuccgugcccgcugggaaagugcccuggaccggcagcuggcgcaccaggcccagcag

SEQ ID NO: 272101 - RNA, 64 nt, Human
auucuagaccagccaauuggugggacagcgugaugaccggcaggguucaacagaccagggcauc

SEQ ID NO: 272102 - RNA, 64 nt, Human
accaacgaauuauuccagguagauccuaaguugcuggaucuaguugauauuuaaacaauaucua

SEQ ID NO: 272103 - RNA, 64 nt, Human
uugcaauguaagggccucagcuuccuuggagaagccaccccagguuuccagacauagauguuga

SEQ ID NO: 272104 - RNA, 64 nt, Human
ugagcugcacccacagucccgagacugggaucccccaccccaacagugauuuuggaaaaaaaaa

SEQ ID NO: 272105 - RNA, 64 nt, Human
guggccaggauggucuaucucuugaccucgugauccaccccacucagccucccaaauugcuggg

SEQ ID NO: 272106 - RNA, 64 nt, Human
aaucaggcccauccaucccaugccucccuccuccccaccccacuccaacaguuccucuuucccg

SEQ ID NO: 272107 - RNA, 64 nt, Human
uauaagcgcuucucuucgcauagucacguagcucccaccccacccucuuccugugucucacgca

SEQ ID NO: 272108 - RNA, 64 nt, Human
cugggcugauuucugguuggggucugcuccuaccccaccccauuuaacaaugugaagugacuga

SEQ ID NO: 272109 - RNA, 64 nt, Human
cuacuuccugaagggcccucccaaggcuacauccccaccccacaguucucccugagagagauca

SEQ ID NO: 272110 - RNA, 64 nt, Human
gggugccgagcacuagcuagacuuccacauagucccaccccaagugggcggcaguguuccuggc

SEQ ID NO: 272111 - RNA, 64 nt, Human
cuugaaaaauauuuucuccagcguugguuacugaccaccccacccucccaccacacacacacac

SEQ ID NO: 272112 - RNA, 64 nt, Human
uuacuauugacagucaccccguaagguucacaaaccaccccauugaacagaugaggaacugagg

SEQ ID NO: 272113 - RNA, 64 nt, Human
cagugagaggagugguguguaccccuaaauccucccaccccagcacugcccaucuguaaaaucu

SEQ ID NO: 272114 - RNA, 64 nt, Human
aaccccagguagggacgccccuuguuccucacccccaccccacuuagguccugggcccccacug

SEQ ID NO: 272115 - RNA, 64 nt, Human
ccccuaucagggggacagcuggugggcaaagcagccaccccacagccuuguggcuagaguacag

SEQ ID NO: 272116 - RNA, 64 nt, Human
uuggaucuaguaugucugucuugaccccucacccccaccccauucagaccucaguaguccccag

SEQ ID NO: 272117 - RNA, 64 nt, Human
cauucuggaaagcucucccaggaggaagcauuccccaccccaccuugccucuguccugcgcugg

SEQ ID NO: 272118 - RNA, 64 nt, Human
cauucuccuguggcccucuaguccaccccccgccccaccccagccccuggcaaccacugaucug

SEQ ID NO: 272119 - RNA, 64 nt, Human
cuaaaaaaaaaaacuguuguagaaauucuuaauuuggaucuauuuauuagucagaguuucagcu

SEQ ID NO: 272120 - RNA, 64 nt, Human
cugggaagagaagagggcccagcccagagccaccuggaucuaucccugcggccuccacaccuga

SEQ ID NO: 272121 - RNA, 64 nt, Human
caugcucucaaagcucagagggaggaaaaggaaauggaucuaaauggaauuccaggucccacgc

SEQ ID NO: 272122 - RNA, 64 nt, Human
ggacccucagaucuucuuuucuaauagccauuugccaccccaagugguaugucggccauuucuc

SEQ ID NO: 272123 - RNA, 64 nt, Human
uuuuccagcacucaaccaaggagcaaagcucaucccaccccacaccccucccaggucugcucac

SEQ ID NO: 272124 - RNA, 64 nt, Human
ccacgacagccaggacugcccuccccaccccaccccaccccaggagcacggcacacaguucagc

SEQ ID NO: 272125 - RNA, 64 nt, Human
acagcccacgacagccaggacugcccuccccaccccaccccaccccaggagcacggcacacagu

SEQ ID NO: 272126 - RNA, 64 nt, Human
ccccgacagcccacgacagccaggacugcccuccccaccccaccccaccccaggagcacggcac

SEQ ID NO: 272127 - RNA, 64 nt, Human
ccgucuucacuuccccacaggcuggcgcucggcuccaccccagggccagcuuuuccucaccagg

SEQ ID NO: 272128 - RNA, 64 nt, Human
aucaucaccaauaccuuugaggucccugaguaauccaccccagcuaaaggcaaacccuucaauc

SEQ ID NO: 272129 - RNA, 64 nt, Human
acaaagguccuccuguagggguguggccacuuccccaccccaggacagcgcuucuccguccaau

SEQ ID NO: 272130 - RNA, 64 nt, Human
uucuuucuaacuacaugcaucucuccacucaacuccaccccaucccaucccaccuugaaaauca

SEQ ID NO: 272131 - RNA, 64 nt, Human
ugcauuucgaagcugcucuuucugguccuccccaccaccccacccccaagacuuguguuuguua

SEQ ID NO: 272132 - RNA, 64 nt, Human
gggacuuuuuuagacagaucuucaugaccuguucccaccccaguucaucaucaucucuuuuaca

SEQ ID NO: 272133 - RNA, 64 nt, Human
cuccagauccuuacugguccaguccucauucccuccaccccaucuccacuucugauucaugcug

SEQ ID NO: 272134 - RNA, 64 nt, Human
uggcccaccucuuuccccacccuggcuccaugacccaccccacucuggaugccagggucacugg

SEQ ID NO: 272135 - RNA, 64 nt, Human
cccaacuucauuucccccucacuguagcccauuuccaccccaccacaaaguugccacagguuuu

SEQ ID NO: 272136 - RNA, 64 nt, Human
ucuucuauaccuucuucuccuuccccaucucacuccaccccacuuugucccugaugucuugggg

SEQ ID NO: 272137 - RNA, 64 nt, Human
cuucuggugaaguccaccuccaacauuaaccugcccaccccacccccgucaucccuggagaauu

SEQ ID NO: 272138 - RNA, 64 nt, Human
cuuuggagaacagaugaacauuauucaccaugaauggaucuauacuguguggucaugaguugug

SEQ ID NO: 272139 - RNA, 64 nt, Human
uuuauuguaaagaaguguaaugacuagcucucuguggaucuaugccaaaaucaugggccaucuu

SEQ ID NO: 272140 - RNA, 64 nt, Human
aaccuaucccaacagugacuauaucacucagcauuggaucuaaauauaaaaguggugcuuucag

SEQ ID NO: 272141 - RNA, 64 nt, Human
cucacugcaaggcugaggcugagcuucugauucaccaccccagggccuccuuauaguucucugc

SEQ ID NO: 272142 - RNA, 64 nt, Human
ucugaaguggagugaagccucaagcccaugaaugccaccccagucaucucuggugucagcugcu

SEQ ID NO: 272143 - RNA, 64 nt, Human
cugugccagcucaaauccagccccucgcccugugccaccccaacugugccugauagaccugccc

SEQ ID NO: 272144 - RNA, 64 nt, Human
gcucccugggcccugccccacccaccuuauccucccaccccacucccuccaccaccacagcaca

SEQ ID NO: 272145 - RNA, 64 nt, Human
ccuucaccucacugaaaacaucuggaaggggaucccaccccauuuucugugggcaggccucgaa

SEQ ID NO: 272146 - RNA, 64 nt, Human
agcuuccggcucccucuucuccccccucuacccgccaccccaccccaccccacccccgcccacu

SEQ ID NO: 272147 - RNA, 64 nt, Human
ccggcucccucuucuccccccucuacccgccaccccaccccaccccacccccgcccacucguug

SEQ ID NO: 272148 - RNA, 64 nt, Human
ucccucuucuccccccucuacccgccaccccaccccaccccacccccgcccacucguugccuga

SEQ ID NO: 272149 - RNA, 58 nt, Human
agccucuacuggcaaccugaaaccuuucccaccccaguucuucuugucugauuuaugc

SEQ ID NO: 272150 - RNA, 64 nt, Human
gaucuuguguuugggagcccaugggggagcucacccaccccacaauuccuccucuggccacauc

SEQ ID NO: 272151 - RNA, 64 nt, Human
guucguguaggcauaaugugaggagguggggagaccaccccacccccauguccaccaugacccu

SEQ ID NO: 272152 - RNA, 64 nt, Human
uuuuuauuuggccagcagucucacccacugaucuccaccccagaccuucccugauuggugucuc

SEQ ID NO: 272153 - RNA, 64 nt, Human
cacugugacucuccuacuggugcuugguucagcuccaccccaaaucuuaccccaccacuggcac

SEQ ID NO: 272154 - RNA, 64 nt, Human
aagcagucaucuucagcauuuuccagcccuauagccaccccaaguguggauaugccucuucgau

SEQ ID NO: 272155 - RNA, 64 nt, Human
uaccuguuuuauuuuguuuucucguucucccuccccaccccacucccagccuuaucuauccccc

SEQ ID NO: 272156 - RNA, 64 nt, Human
cuggccccucaaaucguccagcgaccuuccucauccaccccaucccuccccaguucauugcacu

SEQ ID NO: 272157 - RNA, 62 nt, Human
cacaucaugcgcaaugggcuggauuauaaugagcuggccaugcacuuugaccgccuugugcg

SEQ ID NO: 272158 - RNA, 62 nt, Human
gccacugagcagugagaggaaggcagugcagagcuggccagcccuggagguaggcugggacc

SEQ ID NO: 272159 - RNA, 62 nt, Human
uggccagcacuaguaaaggaggaauagugcuugcuggccacaaggaaaaggaggaggugucu

SEQ ID NO: 272160 - RNA, 64 nt, Human
cugaaggugccaaggaggaaggcugagaggggggccaccccauuucugguacccaauuugguuc

SEQ ID NO: 272161 - RNA, 64 nt, Human
uuucauggauucggaugaugcaaggagacacaugccaccccagcaguacacaaagcacuuaccu

SEQ ID NO: 272162 - RNA, 64 nt, Human
gacagcaguuguauccccucaccuuccucccgucccaccccagauauccuaaaugagagagaaa

SEQ ID NO: 272163 - RNA, 64 nt, Human
cgccuucuuuuccguacugugaagaaagaacucuccaccccagcucccacccugcccuggccug

SEQ ID NO: 272164 - RNA, 64 nt, Human
accucucccugcuccuggugccugccucucuccuccaccccaggcuuagaggacagaaaaaugu

SEQ ID NO: 272165 - RNA, 64 nt, Human
cuccccagaacuggcugggccccuggggacagagccaccccaugagcucgggguccaccagugu

SEQ ID NO: 272166 - RNA, 64 nt, Human
aggggaggacuccuggguggacagccuuugacguccaccccacgcugaugcagaagcucccaga

SEQ ID NO: 272167 - RNA, 64 nt, Human
gucacugcauggccucugcccauccugcaccuguccaccccaccccaacacccuggaagccacu

SEQ ID NO: 272168 - RNA, 64 nt, Human
ugcauggccucugcccauccugcaccuguccaccccaccccaacacccuggaagccacugucaa

SEQ ID NO: 272169 - RNA, 64 nt, Human
ggggagggaggggcccuggaggccacauccugccccaccccacccccacucccacggacacuaa

SEQ ID NO: 272170 - RNA, 64 nt, Human
uggaucuggggcuguuccccccccuccguuuuuuccaccccacaguuccuccugggaucuggcc

SEQ ID NO: 272171 - RNA, 64 nt, Human
guggggauggggagaggcuuugccuccaccauucccaccccacccuccccuuaaacccucugcc

SEQ ID NO: 272172 - RNA, 64 nt, Human
uaucauguuaguaauaccucuaauaguauaaaccccaccccaaaauuagccaguaauccuguag

SEQ ID NO: 272173 - RNA, 64 nt, Human
uguucccuucccaccuccaaccuagcccuacugcccaccccaccccaacccaccccaugcccag

SEQ ID NO: 272174 - RNA, 64 nt, Human
ccuucccaccuccaaccuagcccuacugcccaccccaccccaacccaccccaugcccagugguc

SEQ ID NO: 272175 - RNA, 64 nt, Human
uccaaccuagcccuacugcccaccccaccccaacccaccccaugcccaguggucucaguagaua

SEQ ID NO: 272176 - RNA, 62 nt, Human
acacagccgggcuugggggcagucaggaggaagcuggccauccguggaggaggggccggucc

SEQ ID NO: 272177 - RNA, 62 nt, Human
uuggaugaugaggaauauuaccgcauggaguugcuggccaaagaauuccaggacaagacugc

SEQ ID NO: 272178 - RNA, 62 nt, Human
gugauuguugaccccggguacaguuuaaagaagcuggccauaagaaaaauauauauugaugu

SEQ ID NO: 272179 - RNA, 64 nt, Human
ugcuaaauuaccaucacaguuaugugccaucuccccaccccauuuuuuuuuuuuuuuuuuugau

SEQ ID NO: 272180 - RNA, 64 nt, Human
uggaaaaagaagccccagcccagccugccucaucccaccccaaugcuuccuuucugccaucauc

SEQ ID NO: 272181 - RNA, 64 nt, Human
gaugucaggauacccuuccaucaccccaccaccgccaccccaacuugacuuucaagaacacauu

SEQ ID NO: 272182 - RNA, 64 nt, Human
aucccaaggcaucuugucauaaaacagcuuucccccaccccauaucaugggaaaagggggagaa

SEQ ID NO: 272183 - RNA, 64 nt, Human
uugacauuacugaggucauucugaguuuuaggucccaccccauuggcccgucaccuccaucagc

SEQ ID NO: 272184 - RNA, 64 nt, Human
cguggacauuauucuccugauccuccuaccugguccaccccagggcuaccggaagguaaaaucu

SEQ ID NO: 272185 - RNA, 64 nt, Human
uccgucuucacacacaaauaagaaaacggcaaacccaccccauuuuuuaauuuuauuauuauua

SEQ ID NO: 272186 - RNA, 64 nt, Human
cuguccagcaggggucucccaacaagugcucuuuccaccccaaaggggccucuccuuuucucca

SEQ ID NO: 272187 - RNA, 64 nt, Human
gcccaccuucccuggcauuuuaaacagaccuaccccaccccaacucagaguuaagcauacaugg

SEQ ID NO: 272188 - RNA, 64 nt, Human
gcuuuuggacugaccuggggguaucuccccucugccaccccaauugugaauaaagauuguuugc

SEQ ID NO: 272189 - RNA, 64 nt, Human
agcggucccaugucagccuucugaugaucccacuccaccccaccucaacuuauuuaacuuccua

SEQ ID NO: 272190 - RNA, 64 nt, Human
aaggagacacuacugcccccaccccugacagcccccaccccauggcuuccaucuuuugcaucac

SEQ ID NO: 272191 - RNA, 64 nt, Human
uguuucucuccugggcucccccacuuucccuuccccaccccacuuguaugcucuggaaucugug

SEQ ID NO: 272192 - RNA, 64 nt, Human
cagccccaagggcacaugaggcagggccggcuccccaccccaccuuugauggccucuucccccc

SEQ ID NO: 272193 - RNA, 64 nt, Human
guggaagagaaaguacaggacacugggucuguccccaccccaauucccuuacaaguaauggagc

SEQ ID NO: 272194 - RNA, 64 nt, Human
cucacaagcccuuggccacaacuauacuccugucccaccccaccacgauggccuggucccucca

SEQ ID NO: 272195 - RNA, 62 nt, Human
ugaauaauuaauugauuuacagccuuguugccgcuggccagaccaccagguggcccauuacu

SEQ ID NO: 272196 - RNA, 62 nt, Human
uuaagaaaauagaugaaaaauuaggguacacagcuggccaccaaaugcgaagucaaucugcu

SEQ ID NO: 272197 - RNA, 62 nt, Human
gaacucuucuggagccucagcucaggauagcugcuggccacuccuguccuguggauugugca

SEQ ID NO: 272198 - RNA, 64 nt, Human
cagaaggcuaaaugaauauuaucccuaauaccugccaccccacucuuaaucagugguggaagaa

SEQ ID NO: 272199 - RNA, 64 nt, Human
aaugggcuccagaucucuuauugcccuuauuccuccaccccacuucuuuuagcaaggucugaaa

SEQ ID NO: 272200 - RNA, 64 nt, Human
ucuauauacucaucuaaaaauaugggaaaacauuccaccccauguaaauauguacaagugcauc

SEQ ID NO: 272201 - RNA, 64 nt, Human
uggggcaugcauucauaauuuuucauuuucuuccccaccccaacccccaugagcucuuaaauuu

SEQ ID NO: 272202 - RNA, 64 nt, Human
ucacaaagugcugagccccucuuccccguguggcccaccccaggcacggcucauuccuccagaa

SEQ ID NO: 272203 - RNA, 64 nt, Human
caguaccguccgcaccgccaggcucagccccugcccaccccacuuccacauggcccucgucccu

SEQ ID NO: 272204 - RNA, 64 nt, Human
cucccagcccuggguccucccacccucucuccucccaccccacagcucggacugcucugggagg

SEQ ID NO: 272205 - RNA, 64 nt, Human
cagcggcagccacuagaccgcgcccggcagccacccaccccacgugccaacuuccccuccccgu

SEQ ID NO: 272206 - RNA, 64 nt, Human
auguuugcugugcuucccgccguggagggcagagccaccccacaucaggaucggacgugcuacc

SEQ ID NO: 272207 - RNA, 64 nt, Human
gguuuacccccccggccugggcaucugaccucccccaccccagugugauuuaacauccaggaac

SEQ ID NO: 272208 - RNA, 64 nt, Human
ugccaugcucuggaggagcaagggggccacauccccaccccagcuguuacccagcccggggcag

SEQ ID NO: 272209 - RNA, 64 nt, Human
guuaacccuccaccuccucucuuggacucccuccccaccccaaccacucuuucuuucuccuuua

SEQ ID NO: 272210 - RNA, 64 nt, Human
cagcccagccguguguggugucagguuccucuccccaccccagcuucaagcagaggccucgggg

SEQ ID NO: 272211 - RNA, 64 nt, Human
uacagcuguguuuuuuaaagccaccucucugucuccaccccaugggcccacacccagguggggg

SEQ ID NO: 272212 - RNA, 64 nt, Human
gaucauuccuucuguagcucaggagagcaccccuccaccccauuugcucgcaguauccuagaau

SEQ ID NO: 272213 - RNA, 64 nt, Human
ccgcuuccacaugagcuaaagcccucccgcgcccccaccccagaccccgagccaccccaggaaa

SEQ ID NO: 272214 - RNA, 62 nt, Human
acauucuuugggcuggcugcccuugcaaagcagcuggccaaggcuuauuaaaugugaaccca

SEQ ID NO: 272215 - RNA, 62 nt, Human
acccaguaaacccaaaaaagcaaauggauaaugcuggccauuuugccuuucugacauuuccu

SEQ ID NO: 272216 - RNA, 62 nt, Human
ccgggggggcgguuucccaugggaugugaaaggcuggccauuauuaagucccuguaacucaa

SEQ ID NO: 272217 - RNA, 64 nt, Human
aaagcccucccgcgcccccaccccagaccccgagccaccccaggaaaagcacaaggacugccgc

SEQ ID NO: 272218 - RNA, 64 nt, Human
ugcccgcccccagaucuucccucugugcucccugccaccccagcagcuguugauuucagaaccc

SEQ ID NO: 272219 - RNA, 64 nt, Human
uguaaacaguguuuuaaacucuccuagucaauauccaccccauccaauuuaucaaggaagaaau

SEQ ID NO: 272220 - RNA, 64 nt, Human
aacacggaacaugaugggggauuuaccugaccagccaccccauagccccuggcugaagaagaaa

SEQ ID NO: 272221 - RNA, 64 nt, Human
uggacguguggagcuaggggccugccugccccacccaccccacagacuccggccuguaaucagc

SEQ ID NO: 272222 - RNA, 64 nt, Human
auucuauccucuaaacuuaucuggugcauucuccccaccccacccccauuauauaagggcuauu

SEQ ID NO: 272223 - RNA, 64 nt, Human
ucugaccuuguuucagcaaaguaaacagcacuccccaccccacccuccuuuuuuuacucaucuu

SEQ ID NO: 272224 - RNA, 64 nt, Human
uuuugcucaaacuguagaaugcccuacauuccccccaccccaauuugcuauuuccuuauuaaaa

SEQ ID NO: 272225 - RNA, 64 nt, Human
ccuccggaccugagcuccgugcucaacccccagcccaccccacccucccugggcagggucuuga

SEQ ID NO: 272226 - RNA, 64 nt, Human
ccugccuugggggugaagugaaggcccagccuccccaccccaccgcgccccagggguuggagga

SEQ ID NO: 272227 - RNA, 64 nt, Human
gagggugcagugguggcguggaagcccugucaccccaccccaggccacccucucccagaggacg

SEQ ID NO: 272228 - RNA, 64 nt, Human
cguuguuacaggaagucccuugccauccuaaaagccaccccacuucucucuaaggagaauggcc

SEQ ID NO: 272229 - RNA, 64 nt, Human
guccuugagaaguuaagagacuguuuccugcuucccaccccaccccguuuuuugucccuccguu

SEQ ID NO: 272230 - RNA, 64 nt, Human
cagguuuguuaucacaauguauaauuguguuuuuccaccccacauuuuuaaggcaauuaaauau

SEQ ID NO: 272231 - RNA, 64 nt, Human
ucaguagaaaugauuuuuacuaaucaaguuaaucccaccccaucaaaagguauuccuagaaaug

SEQ ID NO: 272232 - RNA, 64 nt, Human
ggugggaagaauuggccacguuggagaccccaugccaccccaccauggugagugcucugugccu

SEQ ID NO: 272233 - RNA, 64 nt, Human
acacacagucacgcaagcuaguucccaugacuccuggaucuauguguaugcagaaggcuacaua

SEQ ID NO: 272234 - RNA, 64 nt, Human
gucuaucccuucaccuccauugaaaucagcauuuuggaucuaggucuucauggaauccuugaga

SEQ ID NO: 272235 - RNA, 64 nt, Human
guguguguguguguguguguguguguguguguguuggaucuacuaacauguuuagcaaauggcu

SEQ ID NO: 272236 - RNA, 64 nt, Human
ucuuuuuugcaccccaaguuggcuggagcaucggccaccccaagauucaucugugaccuccagg

SEQ ID NO: 272237 - RNA, 64 nt, Human
accaagcgggaggaugggggcuacaccuucacagccaccccagaggacuucccuaaaaagcaca

SEQ ID NO: 272238 - RNA, 64 nt, Human
cucuggaaggggcuggcuggugcccuauuuccagccaccccagcagcuagggaggcaaagcagg

SEQ ID NO: 272239 - RNA, 64 nt, Human
acgucugugccccgcaaguguuugaguuuggccuccaccccauugaugcggugacggggcggaa

SEQ ID NO: 272240 - RNA, 64 nt, Human
acgaugggaaaaucauccaggaaacccccuacccccaccccagagggaccacagucagcgugaa

SEQ ID NO: 272241 - RNA, 64 nt, Human
caguuucuacgaugguuuguuugguccuuuugaaccaccccaaagaacucaacauggcaaagca

SEQ ID NO: 272242 - RNA, 64 nt, Human
aaauaccacugaagaggacacacucugcacccccccaccccacgaccuuggcccgagccccucc

SEQ ID NO: 272243 - RNA, 64 nt, Human
ggacccaaaaaaucaucucaccuugagcccacccccaccccauugucuaaucuguagaagcuaa

SEQ ID NO: 272244 - RNA, 64 nt, Human
gaccggccccgcaguacugaccugcaggaacuccccaccccagggacaccgccuccccauuuuc

SEQ ID NO: 272245 - RNA, 64 nt, Human
uauaacacagacgagccccagacucugcccauccccaccccaccccgacgucccccggggcucc

SEQ ID NO: 272246 - RNA, 64 nt, Human
gggagggagaacggggccccaggagacccggccgccaccccacccgcuacccuugggugccaca

SEQ ID NO: 272247 - RNA, 64 nt, Human
gucuuucuugcugcagccugcuccagccuggcccccaccccaggggcaggcggccccuccuggc

SEQ ID NO: 272248 - RNA, 64 nt, Human
cagaugagccuuagguuccagccgccugcagaccccaccccagcaggcucacucagcaaggagc

SEQ ID NO: 272249 - RNA, 64 nt, Human
uggccuccagcagcaccacagagcuccagaccaaccaccccaagugccguuuggauggggaagg

SEQ ID NO: 272250 - RNA, 64 nt, Human
uaaaaacaggccagccugcuugggcgcucggucuccaccccagggucauaaguggggagagagc

SEQ ID NO: 272251 - RNA, 64 nt, Human
gggaugcaaguggacuugggcagaggaggucacaccaccccaccaagguagacuuagauuagag

SEQ ID NO: 272252 - RNA, 64 nt, Human
cuauacguaauuuaaacaaauuuagaagaaaaaaccaccccauuaaaaagugggcaaaggacau

SEQ ID NO: 272253 - RNA, 64 nt, Human
gugagcggcagccucaggggccucaggggagcccccaccccacggauguugucaggaaucauga

SEQ ID NO: 272254 - RNA, 64 nt, Human
ucaaaguaaaagcggacugcgauuuaagauguuuccaccccaauaccuggucuuccuucccggc

SEQ ID NO: 272255 - RNA, 64 nt, Human
guguucucccugcaugcccuccguggcugggcugccaccccacccggcccgaaucugucuugac

SEQ ID NO: 272256 - RNA, 64 nt, Human
caggcauuccucccacagcccuuucauuuccuccccaccccacuccccaaauacagaggucugc

SEQ ID NO: 272257 - RNA, 64 nt, Human
uggggggaagcuuugauauccaugccacguccauccaccccaccccuuuucgucacgagcacaa

SEQ ID NO: 272258 - RNA, 64 nt, Human
agccucaguagagucaaguccugcugcagcugccccaccccaaguuucuaucauuuccucuuua

SEQ ID NO: 272259 - RNA, 64 nt, Human
auaccuccuugugccuccacugaugcaggagcugccaccccaaggggagugaccccugccagca

SEQ ID NO: 272260 - RNA, 64 nt, Human
guauaucuccuaaagcuaucccuccccccuccccccaccccacaacaguccccagagugugaug

SEQ ID NO: 272261 - RNA, 64 nt, Human
auucccuacguuagccgggaggacuugucacccuccaccccacauugcugagcugccucuugug

SEQ ID NO: 272262 - RNA, 64 nt, Human
ucaggcaccucuucccccaggaagccuucccugcccaccccaucuaugacuugagccaggucug

SEQ ID NO: 272263 - RNA, 64 nt, Human
ucuacucauuguugcaugagcccugucugccagcccaccccagggacugggggcagcaccaggu

SEQ ID NO: 272264 - RNA, 64 nt, Human
acaugguggugccaccuccgcgggagcacugguaccaccccauccuccggcugcaggaggccaa

SEQ ID NO: 272265 - RNA, 64 nt, Human
ccaagaguucccuuccagcucccacugcugcuuuccaccccaucuccuuuauguccaagcuuug

SEQ ID NO: 272266 - RNA, 64 nt, Human
aucuagugggauggaaguuuuugcuacauguuauccaccccaggccagguggaaguaacugaau

SEQ ID NO: 272267 - RNA, 64 nt, Human
aagaugcagaggaaaggggaauaaucuuagguacccaccccacuuccuucucggaaggccagcu

SEQ ID NO: 272268 - RNA, 64 nt, Human
ucucugcaguggugccgucagcccuuuaaauggcccaccccaggcagacucagacacagggaag

SEQ ID NO: 272269 - RNA, 64 nt, Human
accaagcggaccuaggagacaucuacagaacgcuccaccccaaaucaacagaauauacauucuu

SEQ ID NO: 272270 - RNA, 64 nt, Human
ugcccauccgagaccucuguccuuacaccacuagccaccccacgugggacuuccauggcuucug

SEQ ID NO: 272271 - RNA, 64 nt, Human
ggagcaggccccacagaccccacagaggaugaagccaccccacagaggaugcagcccccagcug

SEQ ID NO: 272272 - RNA, 64 nt, Human
ccuggucuuccucccccaagccaggccccuguccccaccccaccaccuuccagggugccaggca

SEQ ID NO: 272273 - RNA, 64 nt, Human
cacaggaguucuggccugugacuaacuaacugccccaccccagccgagaccucggcgagacugu

SEQ ID NO: 272274 - RNA, 64 nt, Human
ggauauauuguguguguugcuguuggaaauagccccaccccauccucccaauccaaaacguaac

SEQ ID NO: 272275 - RNA, 64 nt, Human
ggggaauuuccagcccuuuuaugccugugugaucccaccccacccccauaguuguauaaagguc

SEQ ID NO: 272276 - RNA, 64 nt, Human
aguaugcuuguccugaagagagguuuggcuauccccaccccaccccaccccacccuguuccuuu

SEQ ID NO: 272277 - RNA, 64 nt, Human
gcuuguccugaagagagguuuggcuauccccaccccaccccaccccacccuguuccuuuuuuau

SEQ ID NO: 272278 - RNA, 64 nt, Human
uccugaagagagguuuggcuauccccaccccaccccaccccacccuguuccuuuuuuaucagga

SEQ ID NO: 272279 - RNA, 64 nt, Human
uuggucugggaggaagagagaacucgcuccucaaccaccccagacacuggagugucaggaaagc

SEQ ID NO: 272280 - RNA, 64 nt, Human
uccccagggcuccaucuccgccucaggggcuucuccaccccaagucuggcuccauuccuggccu

SEQ ID NO: 272281 - RNA, 64 nt, Human
ccagauaucaaggaauugggaaauccuggccaaaccaccccaagaugauuacacugaaauguag

SEQ ID NO: 272282 - RNA, 64 nt, Human
cuaccuuccccuuggcggcucuccuccccaacccccaccccacaauuuuaugacuuccauuugg

SEQ ID NO: 272283 - RNA, 64 nt, Human
gucucuugucuuuggccagcccccucagcccagcccaccccacccgcuguccggccacauucca

SEQ ID NO: 272284 - RNA, 64 nt, Human
cucccuugcaaauguauaauuaaggccuuucuucccaccccaaguccaagaacaaaugccagcc

SEQ ID NO: 272285 - RNA, 64 nt, Human
gccacccaggccacaguuccugugccugccuuccccaccccagcaguggccccuccccaucccc

SEQ ID NO: 272286 - RNA, 64 nt, Human
gcccugaggaccccgccuggacuccccagccuucccaccccauaccucccucccgaucuugcug

SEQ ID NO: 272287 - RNA, 64 nt, Human
uucuggcuauaacaggcagagucggagcugccucccaccccagucagaagccuggcacccccuc

SEQ ID NO: 272288 - RNA, 51 nt, Human
cugucaccagugauccguagaccaccccagacaaggccccgcuuccucacg

SEQ ID NO: 272289 - RNA, 64 nt, Human
cagagcauuugauaagcaagaaagauuucaucucccaccccagccucaaguaggaguuuuauau

SEQ ID NO: 272290 - RNA, 64 nt, Human
ccuccuguuccaccucagguuuucacaggugcucccaccccaguugaggcucccacccacaggg

SEQ ID NO: 272291 - RNA, 64 nt, Human
aagccccuucuccacuguagcaaaauaagcacccccaccccaucugccuucaggucuucuucac

SEQ ID NO: 272292 - RNA, 64 nt, Human
caguugaaagcuccgaguuugggccaguuuaccaccaccccaaguacacagcagaauaguacaa

SEQ ID NO: 272293 - RNA, 64 nt, Human
cccucaccaaugcaucuaucugucugccaccagcccaccccacccugcccccacccucacccac

SEQ ID NO: 272294 - RNA, 64 nt, Human
cgaguggggggaucacaaagccaggggcuuggccccaccccagcgaagccaugaacucccaagc

SEQ ID NO: 272295 - RNA, 64 nt, Human
ugcuggccuugccacacucuuucuccugcuuuaaccaccccaucugcauucccagcucuacccu

SEQ ID NO: 272296 - RNA, 64 nt, Human
aagaaggaggcuaugcucaggggcccuggagcagccaccccaugcuggccuugccacacucuuu

SEQ ID NO: 272297 - RNA, 64 nt, Human
uggcugccuuggugcagcagggucaucuguagggccaccccacagcucuuuccuuccccuccuc

SEQ ID NO: 272298 - RNA, 64 nt, Human
guccuccagcugucugacuauccauccaucauaaccaccccagccugggaaggagagcuugcuu

SEQ ID NO: 272299 - RNA, 64 nt, Human
ccucucugugucuuuccaccuaauuaaagaggauccaccccaggguuauuuugaggauucaaaa

SEQ ID NO: 272300 - RNA, 64 nt, Human
uucuugugaccggggcaggaugugucuucugcuggaccggcaccuuuuguuugucccauuggug

SEQ ID NO: 272301 - RNA, 64 nt, Human
gagagggcaggacaagccuugucccgaugccuuugaccggcagcucuguguauugguggauaga

SEQ ID NO: 272302 - RNA, 64 nt, Human
auagcacaaggccuaaugaggucacccugacuccccaccccagcauuucauucauaccagauaa

SEQ ID NO: 272303 - RNA, 64 nt, Human
cuuagccccagucuucucuuuucuauaaugagacccaccccagcuugccucccucccuggcuuc

SEQ ID NO: 272304 - RNA, 64 nt, Human
acagcugcguaacauccauccugcuacaacucuuccaccccaaacaaaagggcucaggcuacac

SEQ ID NO: 272305 - RNA, 64 nt, Human
gccuugucuguggagcugcucucucucccucaucccaccccaaauacuuaaaaugacacuacac

SEQ ID NO: 272306 - RNA, 64 nt, Human
ggucaagccaggaugggcccaggccugggaucccccaccccaggacccccaggcccccuccccu

SEQ ID NO: 272307 - RNA, 64 nt, Human
ugccuccuuggucgggcaccauaccuccuccccuccaccccacacccuguguccauaucaagcc

SEQ ID NO: 272308 - RNA, 64 nt, Human
ugcagccacuggcuuggaacaccuuggggucccuccaccccacagaaccuucaacccagugggu

SEQ ID NO: 272309 - RNA, 64 nt, Human
uguggguggcucaggcccaagcagaccccgggcuccaccccagccccgcccaggcugcugccag

SEQ ID NO: 272310 - RNA, 64 nt, Human
cuccacugccaagcaggacuuggcacaugagcacccaccccacagcaccaucaggcagcaccca

SEQ ID NO: 272311 - RNA, 64 nt, Human
gcccccaaggugcugucugucuagacaggcugucccaccccaggguggcuaguggccauaugca

SEQ ID NO: 272312 - RNA, 64 nt, Human
cagcagucucugucaucccgucgccccuuaccccccaccccaggccacugggccccucccacac

SEQ ID NO: 272313 - RNA, 64 nt, Human
uccuguggucacugacuggaaggcagucucuaauccaccccaauccucccagaaagcaaaccug

SEQ ID NO: 272314 - RNA, 64 nt, Human
aauucucuaagccccucagggucuccuccucaccccaccccaggcccuugguguccaggcugca

SEQ ID NO: 272315 - RNA, 64 nt, Human
aucuguguccuccuggcagccccucaaacacacaccaccccaugucacacggguauccagagca

SEQ ID NO: 272316 - RNA, 64 nt, Human
accgcuccaccccaccacugucuucuccauccuuccaccccacccucagcgucucugccccuaa

SEQ ID NO: 272317 - RNA, 64 nt, Human
gcauuccuccacccacccucuaucccccaccgcuccaccccaccacugucuucuccauccuucc

SEQ ID NO: 272318 - RNA, 64 nt, Human
aaaccuucaugguagguagaguuuuagguaaaaguggaucuaggguuacuuucuuuauuaacau

SEQ ID NO: 272319 - RNA, 64 nt, Human
ugaacuuuuggcgucuacugauuccuccaacucuccaccccacaaaauaacggggaccaauauu

SEQ ID NO: 272320 - RNA, 64 nt, Human
uuccccagggaauucucuagcagagggaggggacccaccccagugaggaaguagauugcugccu

SEQ ID NO: 272321 - RNA, 64 nt, Human
uggagccugucaccacuccccucccuauauacccccaccccacaaagauuuucuucagguuaaa

SEQ ID NO: 272322 - RNA, 64 nt, Human
guuuuuacugcccuucacccaaccucucccaccuccaccccacaaugaauguauuuauugugag

SEQ ID NO: 272323 - RNA, 64 nt, Human
cagccucccugcgacugcccaggcacacugcccaccaccccacccccgaaacaaugccagcccg

SEQ ID NO: 272324 - RNA, 64 nt, Human
gguugcuaccacucaggcugccacucaguggacuccaccccagggacacggcagggucugcaga

SEQ ID NO: 272325 - RNA, 64 nt, Human
gaagauaagccacaaaugaagagaaaagccaugcccaccccagccccagagaaaccaauaagaa

SEQ ID NO: 272326 - RNA, 64 nt, Human
caaagugcgcucauuuuaggccuccucucugccaccaccccauaaucucauucaaagaauacua

SEQ ID NO: 272327 - RNA, 64 nt, Human
cccaucuuccuggaccugaaguucaugcucccagccaccccaccccugagcugaauaaagauga

SEQ ID NO: 272328 - RNA, 64 nt, Human
acugauuccaggcaaauuguuuucuuccuucuacccaccccaaccccuacccaucaccuuuuaa

SEQ ID NO: 272329 - RNA, 64 nt, Human
cuagaaucuucaaucaaccugggcucuccccaccccaccccagauaaccuccucaguucccuag

SEQ ID NO: 272330 - RNA, 64 nt, Human
auucacuagaaucuucaaucaaccugggcucuccccaccccaccccagauaaccuccucaguuc

SEQ ID NO: 272331 - RNA, 64 nt, Human
ucuucaccggcacccucaccugugacaccaagacccaccccaaucccagacuucacacaguauu

SEQ ID NO: 272332 - RNA, 64 nt, Human
ccugcuuggcccaguuuugauugcuggcaucuugccaccccagguaucccugguauuguccuaa

SEQ ID NO: 272333 - RNA, 64 nt, Human
acugaaucuuaauacuuucuuuucacaggugucaccaccccaauaaacuuagacaaugauaaau

SEQ ID NO: 272334 - RNA, 64 nt, Human
uugacuggagggaguagacccuaucuauaaggugccaccccaucauccaagcugccacacugcc

SEQ ID NO: 272335 - RNA, 64 nt, Human
aguuuccuacaccuggagguugcauggacuguacgaccggcaugacuuuauauuguauacagau

SEQ ID NO: 272336 - RNA, 64 nt, Human
cugugaugcccgcaauucucaaaggaggacuaaggaccggcacuguggagcacccuggcuuugc

SEQ ID NO: 272337 - RNA, 58 nt, Human
cguaccaguauguggucugaaggaccccgaccggcauggccacucagacacaagucca

SEQ ID NO: 272338 - RNA, 64 nt, Human
agaaacaagaaacacgauaccauucuggccuuccccaccccacauccucucuuggccuuacuga

SEQ ID NO: 272339 - RNA, 64 nt, Human
gaguagcuucugacaugugugccucagaucuguuccaccccacucacagugguucuguuugcuc

SEQ ID NO: 272340 - RNA, 64 nt, Human
uuacccgagagguauuuugccuguuccaaucaaaccaccccauucagguccaucagccucugau

SEQ ID NO: 272341 - RNA, 64 nt, Human
ggcugauggagcaaggguccagacuaggagccuuccaccccagcugugucuggcgccccuagau

SEQ ID NO: 272342 - RNA, 64 nt, Human
gucuucggccggguccccagcccccgcuccugccccaccccaccuccuccgggcuuccucccgg

SEQ ID NO: 272343 - RNA, 64 nt, Human
cucaccacccaaaggguggugggcacugcugugaccaccccagcugcagagucagugcccuggg

SEQ ID NO: 272344 - RNA, 64 nt, Human
guggguccugggaccucuaaugugggcaugucguccaccccaggacgagccaucagggacagac

SEQ ID NO: 272345 - RNA, 64 nt, Human
cuugaaggaugggccugcugcacgucucccuccuccaccccauaccacacuggggggucugagc

SEQ ID NO: 272346 - RNA, 64 nt, Human
agccagcccaaaccuugggcccuggaagaguccuccaccccaucacuagagugcucugacccug

SEQ ID NO: 272347 - RNA, 64 nt, Human
ugauccccaagggacuguccuuuccucuccuaccccaccccacucccagacagagcagaaguau

SEQ ID NO: 272348 - RNA, 64 nt, Human
ggagucagccggccaaacuaacacucccccuccuccaccccagccugcugcugcuacugcugcc

SEQ ID NO: 272349 - RNA, 64 nt, Human
ugccaagccucgccuccuaccacaccacaccaggccaccccagcugcaagugccuuccuuggag

SEQ ID NO: 272350 - RNA, 64 nt, Human
cucggucacccuccugguucugcccugucccauuccaccccaccccagggggaacaguagcuuc

SEQ ID NO: 272351 - RNA, 64 nt, Human
ucacccuccugguucugcccugucccauuccaccccaccccagggggaacaguagcuucaccuu

SEQ ID NO: 272352 - RNA, 64 nt, Human
ccagcacucgugcuuguucacauaauuagguuucccaccccagccuacccgacuuacuugcuag

SEQ ID NO: 272353 - RNA, 64 nt, Human
gugcccgugugcauguccuuugcgccugugaccaccaccccaacaaaccauccagugacaaacc

SEQ ID NO: 272354 - RNA, 61 nt, Human
cgggagaagaacuguccuaagggccuguagugaccggcagggcuggggugagaccccuccc

SEQ ID NO: 272355 - RNA, 64 nt, Human
ccuggaauagugaugaagagcaucaguggaaaacccaccccacacgccauggaccucagggcac

SEQ ID NO: 272356 - RNA, 64 nt, Human
ccggcccuuaaaaaccuucccaucacuccaaaucccaccccagugcaagucuggggaagguagg

SEQ ID NO: 272357 - RNA, 64 nt, Human
ggguuugcuaaucugcucccagcccaaccuauuaccaccccaccucgcugggaccuacugcucg

SEQ ID NO: 272358 - RNA, 64 nt, Human
gauauuuugaugacagauaaacagagucuaauucccaccccaaauuuugcugagguuuucuuaa

SEQ ID NO: 272359 - RNA, 64 nt, Human
agcaacugguccaagaucuagaccagguacucaaccaccccacuccacaugcaacuguccccaa

SEQ ID NO: 272360 - RNA, 64 nt, Human
cccugguccuuggauccccuucgucccaccugguccaccccagaugcugaggaugggggagcuc

SEQ ID NO: 272361 - RNA, 64 nt, Human
cagcauccaaguguggcauggccugcuguauaccccaccccaguacuccacagcaccuuguaca

SEQ ID NO: 272362 - RNA, 64 nt, Human
gcugccccuggcucugaccgaaacagcgcuggguccaccccaugucaccggauccugggugguc

SEQ ID NO: 272363 - RNA, 64 nt, Human
gcagucuaguaugguccccauuugcccuuccacuccaccccacccuaaaccaugcgcucccaau

SEQ ID NO: 272364 - RNA, 64 nt, Human
gcugcucccuuuuccacuuuucuauguccuccuuccaccccaagucccggaucacucgcuguuu

SEQ ID NO: 272365 - RNA, 64 nt, Human
cccaaauguguacaccugcggggccacccaucguccaccccagugugcacgccugcaggcugga

SEQ ID NO: 272366 - RNA, 64 nt, Human
cgcagcaucuuuccagguguggcucugcgcuaggccaccccagguggccccgcuuucuccauuc

SEQ ID NO: 272367 - RNA, 53 nt, Human
uguccaaggaugauauguagcucccaccccagagugcaggaucauagggacag

SEQ ID NO: 272368 - RNA, 64 nt, Human
gaggugggcggacccccaggcuccgccagccccuccaccccagccugccugcugccucggaacu

SEQ ID NO: 272369 - RNA, 64 nt, Human
ccacugugggacuuucuggugggcuccucagcucccaccccaggcuggggcccagauugugagg

SEQ ID NO: 272370 - RNA, 64 nt, Human
ugcaggacccccaggccugagcccagcacccgcuccaccccagccagcugggcagggccggugu

SEQ ID NO: 272371 - RNA, 64 nt, Human
ucugugaaaaacaguggacagcaccccgagggccacaggugagggacacuaccacuggaucgug

SEQ ID NO: 272372 - RNA, 64 nt, Human
agugauuuugucuuauaugaguaaguuacuacuuacaggugauaacuugcauacuauuggaaga

SEQ ID NO: 272373 - RNA, 64 nt, Human
ugauuaucuuuuagagaaguauacugaaaaauguacaggugaaaugauauguuacugguauucg

SEQ ID NO: 272374 - RNA, 64 nt, Human
uuggaugggagccccacagaggcagguccuggaaccaccccacccccacaccuggacgcucgcu

SEQ ID NO: 272375 - RNA, 64 nt, Human
uucagugcagcagggggacacagaccugcccaagccaccccacugccguucccucucugagcac

SEQ ID NO: 272376 - RNA, 64 nt, Human
ggccuacugacucauaauucacuugucccaaaagccaccccacaagccugagccaaccugcugc

SEQ ID NO: 272377 - RNA, 64 nt, Human
gccccgcuucugugugcuuguccuccuccuccucccaccccauaacuguuccuaagccuucacc

SEQ ID NO: 272378 - RNA, 64 nt, Human
ccuagaagguuuuaggaauagugacagagucaggccaccccaagggccaugggagccagcugac

SEQ ID NO: 272379 - RNA, 64 nt, Human
cagcauccuacuccuggcaacaucaggccaacguccaccccagccucacauugccagauguugg

SEQ ID NO: 272380 - RNA, 64 nt, Human
acuguucuggguggcuggaucuccaggguacccuccaccccagcugccaagcccugggccagca

SEQ ID NO: 272381 - RNA, 64 nt, Human
ggccugaaggggagcucugagacagagcaaacacccaccccagaacaagccgacacacagggag

SEQ ID NO: 272382 - RNA, 58 nt, Human
acccagcaauugaggugugauggcggccccaccccaacuaccaccucuuuucaggcac

SEQ ID NO: 272383 - RNA, 64 nt, Human
cgccaaugcugauaguccccucuccugcaucccuccaccccaguccccgggaaaggccgguggg

SEQ ID NO: 272384 - RNA, 64 nt, Human
uaagagcagcgggccuguccaggggcuccccgccccaccccacgccuuagcugcaggcccuuuu

SEQ ID NO: 272385 - RNA, 64 nt, Human
uugagccccgccccuuucuuuccccggagucccuccaccccauaacaauaccucgaauuuccaa

SEQ ID NO: 272386 - RNA, 64 nt, Human
agaccuccguccucugcuuuccgggcagcucucaccaccccaggccccggcaugaggccuuucc

SEQ ID NO: 272387 - RNA, 64 nt, Human
caggaaaacaaagaauguguuaagggaugcucccccaccccacaucuuaagucagugugccaag

SEQ ID NO: 272388 - RNA, 64 nt, Human
aucaccacgccaacaggaccacagcgcacuggcuccaccccaucucugccaucuccacuccccu

SEQ ID NO: 272389 - RNA, 64 nt, Human
aguaaugugcgagaaagugaaaaugccacucucuccaccccauuuuacagaggagaacaccaag

SEQ ID NO: 272390 - RNA, 64 nt, Human
cagugugcucgugggaauggaaaggacagcaagcacaggugagacuguggagaugagaaggugg

SEQ ID NO: 272391 - RNA, 64 nt, Human
agaaacguuuuugucauuuugacuuuuaacagguacaggugaucucuuccuuuguucuuucagu

SEQ ID NO: 272392 - RNA, 64 nt, Human
gaugugaacccagugaucaguggaauugucaaguacaggugagcacuucuguguucccaagaag

SEQ ID NO: 272393 - RNA, 64 nt, Human
ggcacaaagaauuugacaguacaagucaaaucccccaccccacaaaauauguguggagauauau

SEQ ID NO: 272394 - RNA, 64 nt, Human
auuauauauacaaauaucaaacaucucaccacacccaccccaaaaguuacacugugugugugug

SEQ ID NO: 272395 - RNA, 64 nt, Human
cugaagagguguuuauuuuuuaacuaacagccucccaccccauuaagacucaccaggagagguc

SEQ ID NO: 272396 - RNA, 64 nt, Human
cagaagccucacaccucgucaccaccaccaccccccaccccauccugaggcacugccuggcaga

SEQ ID NO: 272397 - RNA, 64 nt, Human
ucccgcucucugcuggcacgcgaggcuuccccuuccaccccauguggguauucccacaacaggu

SEQ ID NO: 272398 - RNA, 64 nt, Human
cugucuggagcauaacccacaggcguuuuuucugccaccccaucccugcaugccugauccccag

SEQ ID NO: 272399 - RNA, 64 nt, Human
aucccgguugcaaucucacucagacaucacaguaccaccccagggguggcaguagacaacaacc

SEQ ID NO: 272400 - RNA, 64 nt, Human
ucccuaauagcuaggauuacagguguguggccucccaccccaccccacccuucacaccuggcug

SEQ ID NO: 272401 - RNA, 64 nt, Human
aauagcuaggauuacagguguguggccucccaccccaccccacccuucacaccuggcugauuuu

SEQ ID NO: 272402 - RNA, 64 nt, Human
ucucacucuccccaguccucaggcagcagcuuuuccaccccaggaaucucuguuccuucucugu

SEQ ID NO: 272403 - RNA, 64 nt, Human
agcccagcauggaugugucucaggcaccucauccccaccccaccucaccccaacaaacuccucu

SEQ ID NO: 272404 - RNA, 64 nt, Human
agggaagccuccucccaggugcuugccccagcucccaccccacagcccacucucaggcaggaac

SEQ ID NO: 272405 - RNA, 64 nt, Human
uguaggcuacauccugauaccuauaaguucacccccaccccacagcugcuggagagaaauccca

SEQ ID NO: 272406 - RNA, 64 nt, Human
aucucuguauauacuuucccagcccugucugucuccaccccauccccucuugucucugagaacc

SEQ ID NO: 272407 - RNA, 64 nt, Human
accccauccccucuugucucugagaaccauucucccaccccaaguuccaccuucuauguuucua

SEQ ID NO: 272408 - RNA, 64 nt, Human
acagugguacucugugucuggcaggcuacucugcccaccccagcaucagcacagcucuccuccu

SEQ ID NO: 272409 - RNA, 64 nt, Human
uugguuauugguugguuguucauuuuuuuuuucaacaggugaaaaagcaggaaguggugguaga

SEQ ID NO: 272410 - RNA, 62 nt, Human
cugggggcuggggaggggaggcccagaggagggcuggccaugugagcaccccaugaagggac

SEQ ID NO: 272411 - RNA, 62 nt, Human
cuuggucccaggagaugggggccacucgugaggcuggccaugcuguggcuucucacagcugu

SEQ ID NO: 272412 - RNA, 64 nt, Human
accagguuauaaaacauaacucacaccccugcccccaccccaugcccccacccuccccucacac

SEQ ID NO: 272413 - RNA, 64 nt, Human
cuaagcaauacauuuuggggguucccucagccccccaccccagaucuuagcuggcaggucuggg

SEQ ID NO: 272414 - RNA, 64 nt, Human
ggaccgccagcagagcggggggaucucccugcccccaccccaguuccccaacccacucccuucc

SEQ ID NO: 272415 - RNA, 64 nt, Human
aucuccauggcccagcaaggccaagauaaaucuaccaccccaggcaccugugagccaacagguu

SEQ ID NO: 272416 - RNA, 64 nt, Human
ggaaaggauggaguguuuuaguucuugggggaggccaccccaaaccccagccccaacuccaggg

SEQ ID NO: 272417 - RNA, 64 nt, Human
augccagaagaaaggggcuguagaccccuauuccccaccccauggccacagggcaucuggcaau

SEQ ID NO: 272418 - RNA, 64 nt, Human
aacgcgguguguaacacuguguacaccucaaauaccaccccaacccacucccuguagugaaucc

SEQ ID NO: 272419 - RNA, 64 nt, Human
agaaacgaguuggugucuuucgucucaguagcccccaccccaauaagcuguagacauugguuua

SEQ ID NO: 272420 - RNA, 64 nt, Human
gcugugaauacugaaauuaugccuugucuccuccccaccccagggggaugccguuuugcagugu

SEQ ID NO: 272421 - RNA, 64 nt, Human
cuacuucccucacccacuuuggccuccguucaccccaccccaccccaccucuccccaccuuacc

SEQ ID NO: 272422 - RNA, 64 nt, Human
ucccucacccacuuuggccuccguucaccccaccccaccccaccucuccccaccuuacccccgc

SEQ ID NO: 272423 - RNA, 64 nt, Human
uguguuuagggacacagggcuuuugagagcagcaccaccccacuggggcauccccagacuuggg

SEQ ID NO: 272424 - RNA, 64 nt, Human
uggggaagcaagggccaaacauucuuuaucccucccaccccagggaaaacauuuggaaaauagu

SEQ ID NO: 272425 - RNA, 64 nt, Human
caggacugcgggaaggcgcgggagccaggggccuccaccccaaccccggcucagagacugggcg

SEQ ID NO: 272426 - RNA, 64 nt, Human
cagagccagcagcugccaugcccuccugcuccccccaccccagcccuagcccuuuagccuuuca

SEQ ID NO: 272427 - RNA, 64 nt, Human
cuuguucguaaggcacaggcugacaguuccacucccaccccacacaacgcagacggugcgccug

SEQ ID NO: 272428 - RNA, 64 nt, Human
uaucucagccucccaaguagcugggacuauaggcacacgccaccacgcccagcuaauuuuuaua

SEQ ID NO: 272429 - RNA, 64 nt, Human
uagugaugaagagcaucaguggaaaacccaccccacacgccauggaccucagggcacucuccuc

SEQ ID NO: 272430 - RNA, 64 nt, Human
cagugccaagcaugcgauauucagagucuccccagaccggcagucaucauggcaguuucagcgu

SEQ ID NO: 272431 - RNA, 64 nt, Human
ggggcucugcucccggucuugggcccugggaaccccaccccaccccaccccacaggcguuguaa

SEQ ID NO: 272432 - RNA, 64 nt, Human
ucugcucccggucuugggcccugggaaccccaccccaccccaccccacaggcguuguaaccuug

SEQ ID NO: 272433 - RNA, 64 nt, Human
ucccggucuugggcccugggaaccccaccccaccccaccccacaggcguuguaaccuugaaucu

SEQ ID NO: 272434 - RNA, 64 nt, Human
ucugcugacugcuguccuuguccaucacccaauaccaccccaaacacaacucaacuucccacac

SEQ ID NO: 272435 - RNA, 64 nt, Human
ccuuuugagggauuggaaccccacuggggucucuccaccccagagucucaggcaccgcgagcau

SEQ ID NO: 272436 - RNA, 64 nt, Human
cucucuuuuccucuacagcuccaucuuguuucacccaccccacaucucacacauccagaauucc

SEQ ID NO: 272437 - RNA, 64 nt, Human
guacauucggaguuccuguuuugcucaucccgcaccaccccacccuccacacacuaacaucccu

SEQ ID NO: 272438 - RNA, 64 nt, Human
guuucuggggccucccccaccauagcucugauucccaccccacauaggaguagccugacugagg

SEQ ID NO: 272439 - RNA, 64 nt, Human
ugccuacucacgauaaauaaucggcccacagcucccaccccacccccuucagugcccaccaaca

SEQ ID NO: 272440 - RNA, 64 nt, Human
uaugugaguccuugugcuccugcuccucagcucuccaccccagguugccucucuccugugggcc

SEQ ID NO: 272441 - RNA, 64 nt, Human
accugcauccccagcacugguccugggcacuuccccaccccagccaggugucccuccuaugcac

SEQ ID NO: 272442 - RNA, 64 nt, Human
ccagcuuucugcuuccugaggacucccgcuccccccaccccaaaguuugucugugguguuauag

SEQ ID NO: 272443 - RNA, 64 nt, Human
uucuagagcccgccgggcccaucuuuguacucauccaccccagccggcuugggacucagacacc

SEQ ID NO: 272444 - RNA, 64 nt, Human
ccccuucucucacacuuuuaucuacuggcaucacccaccccacauggcauauaccacccaucuc

SEQ ID NO: 272445 - RNA, 64 nt, Human
auuucucugugugaucccccacuucugggcucugccaccccacagugggaaaggccacccuaga

SEQ ID NO: 272446 - RNA, 64 nt, Human
guuuucccaaaucuaaaucaucaaaacagaauccccaccccaaucccaaauuuuguuuugguuc

SEQ ID NO: 272447 - RNA, 62 nt, Human
gggaucaccugaggucucgaguucgagaccaggcuggccaacacggugaaacgcugucucua

SEQ ID NO: 272448 - RNA, 62 nt, Human
cucugcuugggaucaaauuaauguuugacagagcuggccaggcgugguggcucauguaugua

SEQ ID NO: 272449 - RNA, 62 nt, Human
cacuucugugccacccccggucuaugucgagagcuggccaaagagccuuuccaaagaggagc

SEQ ID NO: 272450 - RNA, 64 nt, Human
uccccacgcccccauauuggcaacacccccagcgccaccccaugcuccccaagaacgcggcucu

SEQ ID NO: 272451 - RNA, 64 nt, Human
acuugcuggagaucugagccggguggaaggucucccaccccagggcugcccugacagucucucu

SEQ ID NO: 272452 - RNA, 64 nt, Human
uagagcuguggcuaagggcaagccccuuccugccccaccccauuccuuauauucagcaagcaac

SEQ ID NO: 272453 - RNA, 64 nt, Human
ccuugacuuuaguguagugguggggucuuucccaccaccccacuaagccuuggcaaccucauuu

SEQ ID NO: 272454 - RNA, 64 nt, Human
uuugaugacauauuacccgcugacccagccccagccaccccauggacucaggacucaggucucc

SEQ ID NO: 272455 - RNA, 64 nt, Human
cagccucccaaguagcugagauuacaggcgccugccaccccaccuggcugauuuuuguaauuuu

SEQ ID NO: 272456 - RNA, 64 nt, Human
uuggauaugucucaagacacucaugugaaucaugccaccccaaauccuggcuuaucaaguccca

SEQ ID NO: 272457 - RNA, 64 nt, Human
uuguguaaauuuauuuauauuuauuguggcccauccaccccacuucugcaaacccaucccgagg

SEQ ID NO: 272458 - RNA, 64 nt, Human
gagcuguguccucuaggcugccagcucacagcccccaccccagggcccuguaagcugugcagug

SEQ ID NO: 272459 - RNA, 64 nt, Human
acacagggagcuagaaccccugcucccccuguccccaccccaggagaguaaggggacgagggcc

SEQ ID NO: 272460 - RNA, 64 nt, Human
ugagguuugauuggcacagcagcaaaaguugaggccaccccacuuguguccacuguuuuuagaa

SEQ ID NO: 272461 - RNA, 64 nt, Human
ucuccauccuccccagggguagaggcugggggcuccaccccagcccauguacguccccacgaac

SEQ ID NO: 272462 - RNA, 64 nt, Human
acuuagcuucccucucccucauucccggacccuuccaccccacugggcccaaccaugggcucag

SEQ ID NO: 272463 - RNA, 64 nt, Human
cccugcuuuuauuuauuuuggauuagccgguugcccaccccagcccucugguccaucccucccu

SEQ ID NO: 272464 - RNA, 64 nt, Human
acaggcugcagccuggcacccaccccucccaucuccaccccacauggaagacuugucuucaacu

SEQ ID NO: 272465 - RNA, 57 nt, Human
ggguggugcccggcauguaagccccgcccaccccacggaggccacagccacacagcc

SEQ ID NO: 272466 - RNA, 62 nt, Human
aguccccuuuccucuaacucacugccuaggaggcuggccaagguguccaggguccucuagcc

SEQ ID NO: 272467 - RNA, 62 nt, Human
gccgccaugagcaaccuggugccccccguggagcuggccaaccccgagaaccaguucagagu

SEQ ID NO: 272468 - RNA, 62 nt, Human
cugaccucccucaccaguggaggcuggguagugcuggccaucccaaaagggcucuguccugg

SEQ ID NO: 272469 - RNA, 64 nt, Human
gugugccaucuccaauauuucuauaguauaccaaccaccccaggaaugcacuuuaacaauauca

SEQ ID NO: 272470 - RNA, 64 nt, Human
acaagcccaagucauucuugauccaccccuucucccaccccagaucccagggacucauccugug

SEQ ID NO: 272471 - RNA, 64 nt, Human
uuuuuguuuaaaagagugcuuuugaaauaagcauccaccccaaauguugguuguauuuaugcug

SEQ ID NO: 272472 - RNA, 64 nt, Human
ccagugagaugggugcuguucuugagcagcuugaccaccccaacagggaucugggcagagaguc

SEQ ID NO: 272473 - RNA, 64 nt, Human
gaacugcaauaucacugagccugcgaucuauacaccaccccacauuuuguugguuucacagucu

SEQ ID NO: 272474 - RNA, 64 nt, Human
ugacgggucggggccucucucccucucccuguccccaccccagcgcagcagcccuccccgcagc

SEQ ID NO: 272475 - RNA, 64 nt, Human
gaguaccacaaaacaguguguccccagcagcuccccaccccagagccaaaugacaguagugcac

SEQ ID NO: 272476 - RNA, 64 nt, Human
ggaccuccugaaccgagagaacccagaggaacccccaccccacccccaccuaccacuccaugcu

SEQ ID NO: 272477 - RNA, 64 nt, Human
cugucugcguguuuaauuuuucccucucucaccuccaccccauccauauccucuuuauuuccuc

SEQ ID NO: 272478 - RNA, 64 nt, Human
cgcugacuccaccgaagaggugcgccacugggagccaccccagcgccaggcgcccguccaggga

SEQ ID NO: 272479 - RNA, 64 nt, Human
acacguacacacacugucuuagaguacugugagcccaccccacauuggucaucuucccuaucac

SEQ ID NO: 272480 - RNA, 64 nt, Human
cuccugccugcuccuguccagccaggucuaccacccaccccaccccucuucuccggcucccugc

SEQ ID NO: 272481 - RNA, 64 nt, Human
ccuugggauucacuagcccccagcccgccaaaccccaccccagcccuacacagcagucuggccu

SEQ ID NO: 272482 - RNA, 64 nt, Human
uucagguuggaagaagaaaaauagccucaaucucccaccccauguaggcacuaccuccccaauu

SEQ ID NO: 272483 - RNA, 64 nt, Human
gcucuuuugcccagagcguucccuguagccacccccaccccacuugcccuugguucuuuagaag

SEQ ID NO: 272484 - RNA, 64 nt, Human
uguucaauuaucugagguugucugggaccugccuccaccccauccagggaugagaauggcagcc

SEQ ID NO: 272485 - RNA, 62 nt, Human
cauggcccgggccuuauccagucaaagcggaugcuggccacagaaaggccacucaggauguc

SEQ ID NO: 272486 - RNA, 62 nt, Human
gugugagcauacgaggcugaugacugcccugugcuggccaaaagauuuuuauuuuaaaugaa

SEQ ID NO: 272487 - RNA, 62 nt, Human
ugugcaucaaccaggaagaguucuauccccaagcuggccacuaucacauaugcuuacucuug

SEQ ID NO: 272488 - RNA, 64 nt, Human
ccaggccaggcucccgaccccauccaccuauccaccaccccacccaccuuugcagggaauaccu

SEQ ID NO: 272489 - RNA, 64 nt, Human
gcuccucaggccauuccccaugagucccccacacccaccccauccucggucuuugcaaagaagg

SEQ ID NO: 272490 - RNA, 64 nt, Human
gcggguugacgacgguguccucgcagugucgccgccaccccagcguaguccaagucagacuauu

SEQ ID NO: 272491 - RNA, 64 nt, Human
aggcccagacucuggaggccuucacugaucccagccaccccagaaaagcugcagccugcaggca

SEQ ID NO: 272492 - RNA, 64 nt, Human
ggauggugucucccagcuuccccgcccagcuugcccaccccauaguuggugagaugccaaguuu

SEQ ID NO: 272493 - RNA, 64 nt, Human
cccucuuuccugccccuccccaucauaccugcacccaccccagccagggcucccuguccagaau

SEQ ID NO: 272494 - RNA, 64 nt, Human
ugaauacaaacaagcaacagcaacaaauccaccuccaccccaucucccccucauaucccugacc

SEQ ID NO: 272495 - RNA, 64 nt, Human
cucucugcauagccagauuugaagugacugauacccaccccaaaccuugcuguucacagucucc

SEQ ID NO: 272496 - RNA, 64 nt, Human
uucauucagaagacugguggcccacgugccaggaccaccccaccucucuugcugccuuuucucc

SEQ ID NO: 272497 - RNA, 64 nt, Human
cuaaagaccuccagcucagucccccaccuucaucccaccccacagaugauaaaauucagaccuc

SEQ ID NO: 272498 - RNA, 64 nt, Human
aggcugagcccggcgcagcaccugggcaguguccccaccccaggcccuccacauccuccucccu

SEQ ID NO: 272499 - RNA, 64 nt, Human
ucggcacugaguggcccagcaccgccuagcccugccaccccacugcccuccugggccuucugcu

SEQ ID NO: 272500 - RNA, 51 nt, Human
agaccccgcuguacaucuaggccaccccagccuggccacgcagccaggaca

SEQ ID NO: 272501 - RNA, 64 nt, Human
cauaguguguguguuuuguauacacuguaugaccccaccccaaaucuuuguauuguccacauuc

SEQ ID NO: 272502 - RNA, 52 nt, Human
agcagaccuccaccugcugagcccaccccaaguaugccugccaccuacgccc

SEQ ID NO: 272503 - RNA, 64 nt, Human
gccagggacccuguggcucugaucccccauuuauccaccccaugugccucaggacuagagugag

SEQ ID NO: 272504 - RNA, 62 nt, Human
ccuuaacuccuugcccuuugagaguguccauugcuggccauggucacuaaauuugaaguucc

SEQ ID NO: 272505 - RNA, 54 nt, Human; identical to SEQ ID NO: 50930

SEQ ID NO: 272506 - RNA, 62 nt, Human
cugccaguuccuuuauugaaagaggugugcuggcuggccacgguggcuuacaccuguaaucc

SEQ ID NO: 272507 - RNA, 64 nt, Human
uccuacagagugaaaugaaaacgggcugaaaauaccaccccaggagaggaccucgccccaagca

SEQ ID NO: 272508 - RNA, 64 nt, Human
accaggaggguuugguuagcucacaggacuucccccaccccagaagauuagcaucccauacuag

SEQ ID NO: 272509 - RNA, 64 nt, Human
caugggaggggacaaauaagggaauaaaaucuggccaccccagccagcagcagcaaccuguuca

SEQ ID NO: 272510 - RNA, 64 nt, Human
uguguauucaguuaaugacaccaaaaggcucagcccaccccaacccuaucucauguucagucug

SEQ ID NO: 272511 - RNA, 64 nt, Human
cagguggccuugccuggggagccccauguguggcccaccccaccaggccauccccauaccuucu

SEQ ID NO: 272512 - RNA, 64 nt, Human
uuggacugauucccaggcccugcugcucccauccccaccccagaucgaaugaacuuggcagaaa

SEQ ID NO: 272513 - RNA, 64 nt, Human
ucuggagacccccugccggcagccccuuucccugccaccccaggagccaggcuuccccucagcu

SEQ ID NO: 272514 - RNA, 64 nt, Human
uggcugaucuugggugucugaacagcuauuggguccaccccagucccuuucagcugcugcuuaa

SEQ ID NO: 272515 - RNA, 64 nt, Human
cuugucacuuuccuacccugauggucacacuagcccaccccaagcuccgacauugagguuuuca

SEQ ID NO: 272516 - RNA, 64 nt, Human
agguuuucaucucugcagggagagguuccaauguccaccccacccccagguacccgccucuucc

SEQ ID NO: 272517 - RNA, 64 nt, Human
ugugagaacaagaacugagggaaagcaccuucccccaccccagacguuuuuaucugaaugcaua

SEQ ID NO: 272518 - RNA, 64 nt, Human
cucugcugggugccuccuugccuugggaccauggccaccccagagccauccgaucgauggaugg

SEQ ID NO: 272519 - RNA, 64 nt, Human
ccuuccucagcucagcugggccacuccucuucacccaccccauggagacaauaaacagcugaac

SEQ ID NO: 272520 - RNA, 64 nt, Human
gucaguggagagagccaggggcuggagguggggcccaccccagccucuggucccagcucugcug

SEQ ID NO: 272521 - RNA, 64 nt, Human
uuugagcugaagugauccucucgucucuguuuccccaccccauuuguauuaauccuucauacaa

SEQ ID NO: 272522 - RNA, 64 nt, Human
aaagaaccaggguguccccgggacaggccgucccccaccccauccuguagaaguccauuccccu

SEQ ID NO: 272523 - RNA, 62 nt, Human
uuugagcagagagggaaagauuaauuuacacugcuggccaccgaaggcagguguuuccuggg

SEQ ID NO: 272524 - RNA, 62 nt, Human
aacuugcagcucugcuccucacaccaggcccggcuggccacccacccucgcccccacuggcc

SEQ ID NO: 272525 - RNA, 64 nt, Human
agaggcuccuggauuauagccugcacaaggagaggaccggcagcaaucgauuugccaagguugg

SEQ ID NO: 272526 - RNA, 64 nt, Human
gcauccacccagccugaggcucaagcugcccuuaccaccccaucccccacgcaggaccaacuac

SEQ ID NO: 272527 - RNA, 64 nt, Human
ucccaaaccacuuacuucccuguucaccucugccccaccccagcccagaggaguuugagccacc

SEQ ID NO: 272528 - RNA, 64 nt, Human
gcucaccccgggguggcccuggaggccccugaccccaccccacccacagagcacgagggccccg

SEQ ID NO: 272529 - RNA, 64 nt, Human
caucaucagaggacgccccgugcgcugucaccuuccaccccacaaggccaaccuuuuucugugg

SEQ ID NO: 272530 - RNA, 64 nt, Human
gccuggccaggagcaggcacgggugguccccguuccaccccaagagaacucgcgcucaguaaac

SEQ ID NO: 272531 - RNA, 64 nt, Human
ugaguccaucagcugccagccccggcccuggcccccaccccaaguucccugaagcauccuccag

SEQ ID NO: 272532 - RNA, 64 nt, Human
ccuccccgucgucaagccucuauccugucuguccccaccccagcuguccccugcccagggagcu

SEQ ID NO: 272533 - RNA, 64 nt, Human
ggggcagucaccgagugaccaccaagaggaagacccaccccacggcggggacagaugcggggua

SEQ ID NO: 272534 - RNA, 64 nt, Human
uagcggcuggcaggcacagaccagggcuccaaggccaccccaccaacgcaggccccagggucuc

SEQ ID NO: 272535 - RNA, 64 nt, Human
guagugacacucaggauccaaaagcuagcccugcccaccccagccccuggaccugcuuaccugg

SEQ ID NO: 272536 - RNA, 64 nt, Human
uuucguggcauuucuguggcucugcaguguuccuccaccccaggaccaauauguucaggccaca

SEQ ID NO: 272537 - RNA, 64 nt, Human
uggugauccuugucaggauguacaguccuugcucccaccccauccgggauggccgccugucccu

SEQ ID NO: 272538 - RNA, 64 nt, Human
cacucggaccgagcaucucccacgcaccucuaccccaccccaagcaccucucuccccccaugca

SEQ ID NO: 272539 - RNA, 64 nt, Human
uacccacugcucugguuaucuaauauguaacaagccaccccaaaucauaguggcuuaaaacaac

SEQ ID NO: 272540 - RNA, 64 nt, Human
ggcaggccacuucccucccagugccagucuccauccaccccagagaggaacaggcgggugggcc

SEQ ID NO: 272541 - RNA, 51 nt, Human
gaaccgaccaccucccaugacccaccccagcccccugaacccccuucaugg

SEQ ID NO: 272542 - RNA, 62 nt, Human
augccacaguggauacgccagcaggccacauggcuggccaagcaauuauuauuauggauccc

SEQ ID NO: 272543 - RNA, 62 nt, Human
uugcaggcggcuuggagaaagggcagugggacgcuggccacggccaggguggugucgggagc

SEQ ID NO: 272544 - RNA, 62 nt, Human
aaguguugacuuuguaaaucugcccacacccagcuggccauauccaccccucgacgccggga

SEQ ID NO: 272545 - RNA, 64 nt, Human
agucaccacuagggggugauggagaggaagggggccaccccagggccauuaacaaccaguacuc

SEQ ID NO: 272546 - RNA, 64 nt, Human
ccuaccugcacaucugccacagcuggcccugggcccaccccacgaagggccugggccuaacccc

SEQ ID NO: 272547 - RNA, 64 nt, Human
gagaauccccugccggggucccuggaaacagugcccaccccacaucacuacauucccucggccc

SEQ ID NO: 272548 - RNA, 64 nt, Human
cauggacccugggggcugugcccccaucuccuccccaccccaggucuaguggccccacccucca

SEQ ID NO: 272549 - RNA, 64 nt, Human
ccagagccagggagcccuuagccucaacucugccccaccccagccucuuccaggagagcacccu

SEQ ID NO: 272550 - RNA, 64 nt, Human
uuugucccgccgaguacuauguauuaccagccccccaccccacagaucaguuuuccuagucuuu

SEQ ID NO: 272551 - RNA, 64 nt, Human
uacaaccucgaccuccuggguucaagcgauucucccaccccagccucccaaguagcugggauua

SEQ ID NO: 272552 - RNA, 64 nt, Human
cugcaggcagccaggccacaagacccuuguggucccaccccacacacgccagauucuuuccuga

SEQ ID NO: 272553 - RNA, 64 nt, Human
cugagcgagcugggccgguuaguguaugucacccccaccccaccccuaaguagucaucaaugca

SEQ ID NO: 272554 - RNA, 64 nt, Human
cucgcuccccucugccggucccccaugccaccacccaccccaaacuuccagguuccauccacca

SEQ ID NO: 272555 - RNA, 64 nt, Human
agaugugucgccuccgccaguccgacugcccuccccaccccacccccgccaccccccacaugug

SEQ ID NO: 272556 - RNA, 64 nt, Human
acaaguaugggcaggaggcauggggcaggguggcccaccccagugggcaguagccuggccuuuu

SEQ ID NO: 272557 - RNA, 64 nt, Human
ggacacuccgucugcuccaaugacugagcagcauccaccccaccccaucuuugcugccagcucu

SEQ ID NO: 272558 - RNA, 64 nt, Human
cuccgucugcuccaaugacugagcagcauccaccccaccccaucuuugcugccagcucucagga

SEQ ID NO: 272559 - RNA, 64 nt, Human
ggaugaggcugcagagauggggaccagaagccccccaccccagcuuuccugggucugcauccca

SEQ ID NO: 272560 - RNA, 64 nt, Human
cugcuggggugcgcaggugggcgcucgcgucuccccaccccagggcuccccccgugcugaggcu

SEQ ID NO: 272561 - RNA, 61 nt, Human
uuuuuuuuuuuuuuaaucuacugacaaguugcucuaguaacccaaagaagugaaggagaaa

SEQ ID NO: 272562 - RNA, 61 nt, Human
aaucucgugcccucguuuuauggugcagcuucucuaguauuucuggggcuggggggcgggg

SEQ ID NO: 272563 - RNA, 61 nt, Human
ucauaaucuguuaacauuccaaaguguuuaacucuaguauuucguucucuucuucacaauu

SEQ ID NO: 272564 - RNA, 64 nt, Human
cuccuccagggcccaggugggcgggcuucuggccccaccccacagcgcuuggagcaucccuuug

SEQ ID NO: 272565 - RNA, 64 nt, Human
ugccucccagggucacuaggcgggcagcccacacccaccccagacggccaccacacugaggcca

SEQ ID NO: 272566 - RNA, 64 nt, Human
ggcccccucuccaggggcugugcaggcagcccauccaccccaguggaguucccacggacgcuuc

SEQ ID NO: 272567 - RNA, 64 nt, Human
gccucgaggccaagaugccuaaaaaagcuaaaggccaccccaccccccacccaccaccuccugc

SEQ ID NO: 272568 - RNA, 64 nt, Human
guguuuuggccaccuggggccgcccccaaccuccccaccccaagaggggucugagugggaccuc

SEQ ID NO: 272569 - RNA, 64 nt, Human
cccagcccccaccucugccuccaggucucaucuuccaccccaaaaaugucugucucucucuuuu

SEQ ID NO: 272570 - RNA, 64 nt, Human
cuucacauccagaaauucuguuggacacucacuuccaccccaaacuccucaaaucaaaagccuu

SEQ ID NO: 272571 - RNA, 64 nt, Human
agaagaacuuacuucugaaaugaagggaaaaaaaccaccccaucguucccuacuccuccccacc

SEQ ID NO: 272572 - RNA, 64 nt, Human
ccugugggcagagggacaggucagacacccaggcccaccccagagacccuccaugaacugugcu

SEQ ID NO: 272573 - RNA, 64 nt, Human
aacccaauguuuacauucucuucugucucugcccccaccccaugcagcgcuuugaggaauugga

SEQ ID NO: 272574 - RNA, 64 nt, Human
auccccaaggguuccucauguguuuucaccaaaaccaccccagugccugagauugaaaauauug

SEQ ID NO: 272575 - RNA, 64 nt, Human
accagcacaaagaucugaaugaugcaccccacccccaccccaauaaagaaauaacagaaaaccc

SEQ ID NO: 272576 - RNA, 64 nt, Human
ucgcaagaagagacagcgugaugccucccacaguccaccccagacccuggggcagccccucugg

SEQ ID NO: 272577 - RNA, 64 nt, Human
ugauagacugggucgugugugagacgcaugugcuccaccccacuccuuuugggggaagccaggc

SEQ ID NO: 272578 - RNA, 64 nt, Human
cggaucaucugugucugugcggaagacuacugccccaccccagaggccacaccccaggccgggc

SEQ ID NO: 272579 - RNA, 64 nt, Human
gccucucccugugucccacagggaguagcaagacccaccccacacugccuucaccaucuacacc

SEQ ID NO: 272580 - RNA, 61 nt, Human
gcaguaguguaaggcauuucauacuagucuccucuaguagaccugugacuuacuguguugg

SEQ ID NO: 272581 - RNA, 61 nt, Human
aauuauuaacuauauuuuacuaacuaaaaaacucuaguauucuuuaccuaaagucaauugg

SEQ ID NO: 272582 - RNA, 61 nt, Human
auuguggaauguuggauaaggaauuauagaccucuaguagcugaaaugcaagaccccaaga

SEQ ID NO: 272583 - RNA, 64 nt, Human
uguaccucuguguaucuguacagccucgcuccugccaccccacccuugcguucugcauuaggua

SEQ ID NO: 272584 - RNA, 64 nt, Human
ccccgggcacugcacagccugucugggggccagaccaccccauuguccauccuuguuguccgug

SEQ ID NO: 272585 - RNA, 64 nt, Human
guccccuguugccuauagcccuuuacccugagcaccaccccaacagacuggggaccagcccccu

SEQ ID NO: 272586 - RNA, 62 nt, Human
uccgcaucaacaaaaccugaggccccuuccucccaccccaucucucuccuguggaugcuccu

SEQ ID NO: 272587 - RNA, 64 nt, Human
gaaugucccugacccugccugaucccucccucacccaccccaaagguauuuuugauaacagagc

SEQ ID NO: 272588 - RNA, 64 nt, Human
aaaaugggggccuuauggggaaggcucugacacuccaccccagcucaggccaugggcagcaggg

SEQ ID NO: 272589 - RNA, 64 nt, Human
gugacugagccagggccugcauuuuugguuuuccccaccccacacauucucaaccauaguccuu

SEQ ID NO: 272590 - RNA, 64 nt, Human
ccuggacuuaauaccagccggauaccucuggcccccaccccauuacuguaccucuggagucacu

SEQ ID NO: 272591 - RNA, 64 nt, Human
ccccugggaaaaaacccaaagaaccaaaaacaaaccaccccaaggauaauaauagcuacacugc

SEQ ID NO: 272592 - RNA, 54 nt, Human
uuuugcagaggcugccguaguaauccaccccaacggccggaggagccgccggag

SEQ ID NO: 272593 - RNA, 64 nt, Human
gcucccggaaccggacggcacagggcguucuugcccaccccaggggccaggcuugcggaggggg

SEQ ID NO: 272594 - RNA, 64 nt, Human
acgacguggcacacauuccacgugggugcugccgccaccccagucggucguggcgugcagcugg

SEQ ID NO: 272595 - RNA, 64 nt, Human
cccuuuggccucuguuuguccccuuuccaguccuccaccccaccccuggagcccagccugggag

SEQ ID NO: 272596 - RNA, 64 nt, Human
agcugcacuacaugcaggaaucuccagggaccagccaccccaugcucagguuugacuauguccc

SEQ ID NO: 272597 - RNA, 64 nt, Human
ccaugcucaguccccucccaucccccacgcagcuccaccccagucccaagccaccagcugucug

SEQ ID NO: 272598 - RNA, 64 nt, Human
ccuaucucccauccuguggaacccgccccauuggccaccccaugcugcugcugccugggucucu

SEQ ID NO: 272599 - RNA, 61 nt, Human
uuugaauaacucccuugacgaaaacagacuccucuaguacuuggagaucuuggacguacac

SEQ ID NO: 272600 - RNA, 61 nt, Human
uuguagcugauuccuuaacuuucuuguaugccucuaguaauuucagagauuaaauauugcu

SEQ ID NO: 272601 - RNA, 61 nt, Human
uauacuauuugguaacauaauggauuaacaucucuaguaaucucuuuugcuaguggcuuug

SEQ ID NO: 272602 - RNA, 64 nt, Human
ggcuggggcacagccuggccaugcccaggaagacccaccccauucccacuccucugagcccgga

SEQ ID NO: 272603 - RNA, 64 nt, Human
cgccucccaucugcuccccaauucuugaucucucccaccccaucccucuccccagucuuggaua

SEQ ID NO: 272604 - RNA, 64 nt, Human
ugucugagaagugaggagccccuccgcccggcagccaccccaucugggaagugaggagcgucua

SEQ ID NO: 272605 - RNA, 64 nt, Human
cuacugggaagugaggagccccucugccuggccaccaccccaucugggaggugugcccagcagc

SEQ ID NO: 272606 - RNA, 64 nt, Human
ggcuagcauuguuugcacaaaaaguuggugauucccaccccaaauaguaauaaaauuacuucug

SEQ ID NO: 272607 - RNA, 64 nt, Human
gucuuugccuggugucuuccuuucccguguccgcccaccccagcgucuguugguacuuaccugu

SEQ ID NO: 272608 - RNA, 64 nt, Human
cccaacaccagucagcccuauacccuaacucacuccaccccauuuucuccggcugccuggccgg

SEQ ID NO: 272609 - RNA, 64 nt, Human
ggguauuuuguuuuuguucucaccugcugcccccccaccccaccaccccagggauaaauuggau

SEQ ID NO: 272610 - RNA, 64 nt, Human
uguuuuuguucucaccugcugcccccccaccccaccaccccagggauaaauuggauauaaacac

SEQ ID NO: 272611 - RNA, 64 nt, Human
auccuagaaccaagcuucagagccuagccaccucccaccccacuccagcccuguccccugaaaa

SEQ ID NO: 272612 - RNA, 64 nt, Human
cugcccucggucuucggcauugguucccuuugcuccaccccacucacagagacacagggcaucc

SEQ ID NO: 272613 - RNA, 64 nt, Human
cugcuuuuuccagauucuuccacuggcuccacauccaccccacuggaucuucagaaggcuagag

SEQ ID NO: 272614 - RNA, 64 nt, Human
agcuucacagggacgcuuccuucccuccccgcaaccaccccaggcuccccugggaggcugcagu

SEQ ID NO: 272615 - RNA, 64 nt, Human
acccugcaggccaggccagcuuccccucacuuaaccaccccauaccagucaccuccugcuccuu

SEQ ID NO: 272616 - RNA, 64 nt, Human
gcugagguggggagccuucuacggcgaaagccugccaccccacaaugaauccacccugcuccac

SEQ ID NO: 272617 - RNA, 64 nt, Human
guggccucaacccucccucagccccucuugccccccaccccagccuaagaugaagaggaucgga

SEQ ID NO: 272618 - RNA, 61 nt, Human
cuaagcccuaaucuguugacaucccuuggggcucuaguagaaggcagguauuuggcaauuu

SEQ ID NO: 272619 - RNA, 62 nt, Human
gccguggggacaucagagagugucaucacgcagcuggccagcugaguucuguuguuguuuuc

SEQ ID NO: 272620 - RNA, 62 nt, Human
agcucucccucccuacucccugggagccacgugcuggccauguggccagggacggcaugagc

SEQ ID NO: 272621 - RNA, 64 nt, Human
gccacagcccauccgcgugcugugugucccucuuccaccccaaccccugcuggcuccucuggga

SEQ ID NO: 272622 - RNA, 64 nt, Human
acacuugaauguagaauaggcagggggcccugccccaccccauccagccagaccccacgcugac

SEQ ID NO: 272623 - RNA, 64 nt, Human
cucccugcccccucccuggccuucuuccaccuauccaccccaaugccucucagcaaacugggcg

SEQ ID NO: 272624 - RNA, 64 nt, Human
cucuguuacucucagccuggaauccccaccuugcccaccccaguggaaaguaagcagugcccug

SEQ ID NO: 272625 - RNA, 64 nt, Human
uaguaacaugagcacugugauuggcuggcuauaaccaccccaguuaaaccauuuucauaauuag

SEQ ID NO: 272626 - RNA, 64 nt, Human
aguccgcacucugccacccuccugccccuuccacccaccccagcucuaugucugugucugaauu

SEQ ID NO: 272627 - RNA, 64 nt, Human
gccacccagugacuggcagggccgagccagcauuccaccccaccuuuuuccuucuccccaauua

SEQ ID NO: 272628 - RNA, 64 nt, Human
gcaccagcccugguaacugcaucuucuccccuugccaccccauggccccggcugaaagcuucgg

SEQ ID NO: 272629 - RNA, 64 nt, Human
uuacaggcaagcccugcuccugggagggcuccugccaccccacccuuccucuguguguuaucuc

SEQ ID NO: 272630 - RNA, 64 nt, Human
ccuauguaaggccuucuaguuuguucugagacccccaccccacgaaccaaauccaaauaaagug

SEQ ID NO: 272631 - RNA, 64 nt, Human
ccaguugcccuguccacuuacccuagguagccccccaccccaucagugccgaguccuugucccu

SEQ ID NO: 272632 - RNA, 64 nt, Human
ccaagucauuuccguccccccccaggcccucccaccaccccauuuuauuuuauaugauuuucuc

SEQ ID NO: 272633 - RNA, 64 nt, Human
guacauccauguguggcucugcuccaccccugugccaccccagagcccugggggguggucucca

SEQ ID NO: 272634 - RNA, 64 nt, Human
cggugucuccacggugcucucgcccugcccauggccaccccagacucugaucuccaggaacccc

SEQ ID NO: 272635 - RNA, 64 nt, Human
ggccgcacacggacauuccaaagaccuccagagaccaccccacccccacauuccuuugaccagc

SEQ ID NO: 272636 - RNA, 64 nt, Human
ccugaagcugacccucaccuccgagcccccacucccaccccagccgcacaguucccaccuccug

SEQ ID NO: 272637 - RNA, 61 nt, Human
ccuuuaaaacucauguuuuaaagaauaauaacucuaguaauaacucuuccugcuauucaga

SEQ ID NO: 272638 - RNA, 61 nt, Human
uuggaauuuggaggcaguaguugagcauauucucuaguauauagcuacaccuuuaauaaaa

SEQ ID NO: 272639 - RNA, 61 nt, Human
auacauuucuuugaaaagcaauucauucucucucuaguaauuguaauuaauccccccaaaa

SEQ ID NO: 272640 - RNA, 64 nt, Human
uggagaggcagaugagguuccugccuacugugugccaccccaagaagguagccccccaacagcc

SEQ ID NO: 272641 - RNA, 64 nt, Human
aacagcagcccugggcccccaccucuucuaccauccaccccagacuuaccacacacccuuccug

SEQ ID NO: 272642 - RNA, 64 nt, Human
ccaggucaccauccucagaggcugagcccuguacccaccccagcacagccaccuccgccagacc

SEQ ID NO: 272643 - RNA, 64 nt, Human
gaguuguaguucugggcccucgauuccuuucccaccaccccacaggcuuuacccuuugagaaaa

SEQ ID NO: 272644 - RNA, 64 nt, Human
ugccaaaccuaccuugcuuugggagcugccugcaccaccccagagaaggccccaccuucuucau

SEQ ID NO: 272645 - RNA, 64 nt, Human
gucccagaagaacuaccugaagcaccaaagcuccccaccccagccugguggcagaggaagcagg

SEQ ID NO: 272646 - RNA, 64 nt, Human
ucuucuagguuuucuuggcccagcacugcccaucccaccccaugaggcucacucauugcagauc

SEQ ID NO: 272647 - RNA, 64 nt, Human
uggccccugagccugggcagguggggacccaacuccaccccaccugucuucaucgugaggcugc

SEQ ID NO: 272648 - RNA, 64 nt, Human
agcucuuaccuccuccugguugcuuuucuugcccccaccccaaguuuauuuuuguuuucccccg

SEQ ID NO: 272649 - RNA, 64 nt, Human
ugaccaucagauuauaucuucaacaccacaccccccaccccaucgugggugaggguauccccug

SEQ ID NO: 272650 - RNA, 64 nt, Human
auauuaucccaguguccccugccccccucuucccccaccccaugcccccaauucuguggcgcau

SEQ ID NO: 272651 - RNA, 64 nt, Human
acacacacgcgcgcgcacacacacacacacacauccaccccagggccaagagaaaggccugcac

SEQ ID NO: 272652 - RNA, 64 nt, Human
aaguguguguguggaccauccgcaccuccagcccccaccccacccucuuugucucagcguguua

SEQ ID NO: 272653 - RNA, 64 nt, Human
gccauaggagcugggccacuccagacauuaauccccaccccaacagagccacuggcacaagugc

SEQ ID NO: 272654 - RNA, 64 nt, Human
agcucagggaggcucugcucagaguucggcggacccaccccaacccaacucccagccgccagcc

SEQ ID NO: 272655 - RNA, 64 nt, Human
caguuucaccccuccuccuguacccaacccauccccaccccauaugggagaugcuugcccaugu

SEQ ID NO: 272656 - RNA, 62 nt, Human
agcccacacugccagucgaggccuggcuggaggcuggccacaguggaaauucugccgagccu

SEQ ID NO: 272657 - RNA, 62 nt, Human
ccugcucugcugcauggggccccauggcuuuggcuggccacugaggguaggguguggaggug

SEQ ID NO: 272658 - RNA, 62 nt, Human
cuaggcugucccugcagccaggguguccgggggcuggccagucagagaaagggggccaugga

SEQ ID NO: 272659 - RNA, 64 nt, Human
uguaaccuccaccucccaggcucaagugauccucccaccccagccuccugaguagcugggacua

SEQ ID NO: 272660 - RNA, 64 nt, Human
cuuugaugaagugaugggcugcuucucugacuccccaccccagagucccacauucccugaggca

SEQ ID NO: 272661 - RNA, 64 nt, Human
ugccauuucuccccucucuuccuucaucuccaccccaccccacccuacucuccagacgcccuga

SEQ ID NO: 272662 - RNA, 64 nt, Human
acuccugccauuucuccccucucuuccuucaucuccaccccaccccacccuacucuccagacgc

SEQ ID NO: 272663 - RNA, 64 nt, Human
cucucauguggcagccacauguggcguugugaggccaccccauguggggucuguggugagaguc

SEQ ID NO: 272664 - RNA, 64 nt, Human
cuuggaggagcugggcucuaucccacacccacccccaccccacccccacccagccuccagaagc

SEQ ID NO: 272665 - RNA, 64 nt, Human
gcuggcaaaccaccugcuacaggaccaccugcugccaccccagcuauugcauuuccagcugcug

SEQ ID NO: 272666 - RNA, 64 nt, Human
ucagacuugauacacuuucagguugggaguggacccaccccagggccugcugaggacagagcag

SEQ ID NO: 272667 - RNA, 64 nt, Human
agagcgacagcgacugagccgcccccgcugccacccaccccauuccucgcuccuuccgaacuuc

SEQ ID NO: 272668 - RNA, 64 nt, Human
gugugaagugcgauuucugcuuuuguguaccccaccaccccauuaccacagcugccuuugugug

SEQ ID NO: 272669 - RNA, 64 nt, Human
guaaucauucacauguaaaaauaaccccaccuccccaccccaaaaagggcaagagcuguggaaa

SEQ ID NO: 272670 - RNA, 64 nt, Human
augacuaaggacugagcccccuacccaacuacccccaccccaaucccaccuucacccucuuccu

SEQ ID NO: 272671 - RNA, 64 nt, Human
cccagucaccaguucuccucuggacuggccacacccaccccauuccuggacuccucccaccucu

SEQ ID NO: 272672 - RNA, 64 nt, Human
ccucagacagucccucccacagucuacucugucuccaccccaaggucugguucugaaucauuca

SEQ ID NO: 272673 - RNA, 64 nt, Human
cuaucagacuaagccagcaccggaccagccuggcccaccccacccacuucugcacuugcgguuc

SEQ ID NO: 272674 - RNA, 59 nt, Human
cagacucugacuccaacugaggcucagccccaccccagggcagccagggagagcccagg

SEQ ID NO: 272675 - RNA, 64 nt, Human
ucuuaaaagaucuaguguccuuuuuguacacuaaacaggugaaugcugacuuuuuucauucucc

SEQ ID NO: 272676 - RNA, 64 nt, Human
uucggauuaguuaagauaaaagcauacauuguccacaggugagaagauuaaaucagaauaguug

SEQ ID NO: 272677 - RNA, 64 nt, Human
caguucuaaguuaggacguucuuggcuccguuagacaggugaggaaacuggggcacagagaggu

SEQ ID NO: 272678 - RNA, 64 nt, Human
cagccuggaggccgggugcucagggcugacacguccaccccagugcacccacucugcuuugacu

SEQ ID NO: 272679 - RNA, 64 nt, Human
ccccaguaagccacugccacacgucugacccucuccaccccauagugaccggcugcuuuucccu

SEQ ID NO: 272680 - RNA, 64 nt, Human
cugcuggcacauuuccccagaccugagcuccccaccaccccagcugcuccccucccuccucugu

SEQ ID NO: 272681 - RNA, 64 nt, Human
uaggacuguuuacugcccaccuccgccugccagcccaccccagccuggggagaggucgcggcgg

SEQ ID NO: 272682 - RNA, 64 nt, Human
agcuuguggucugaugggugaggcugacccaagcccaccccauugccaacagggccagggcaag

SEQ ID NO: 272683 - RNA, 64 nt, Human
ggcgaccccgguuccucuguguccucuuuacuccccaccccagugcgucucgccugcugagccc

SEQ ID NO: 272684 - RNA, 64 nt, Human
acugaucaucaaaaguucccacucccuacuucugccaccccaccaacgccuuggacuccucucu

SEQ ID NO: 272685 - RNA, 64 nt, Human
cccgaugauucuuaacacagccuuccuucugcucccaccccagaaaucacugugaaauuucaug

SEQ ID NO: 272686 - RNA, 64 nt, Human
gacacugggguaccccuccagauguggggacauuccaccccaguggggacagccauuccccuac

SEQ ID NO: 272687 - RNA, 64 nt, Human
ccacaggaacaucauuccucucccgcaaccacucccaccccagggaggcccuggccuccagugc

SEQ ID NO: 272688 - RNA, 64 nt, Human
gggagacggucuugccucucagccccucccugccccaccccagcuccugcccuggaaaucugga

SEQ ID NO: 272689 - RNA, 64 nt, Human
accgggagcucuuggcugcaucuucucccugcccccaccccacuaugaccuuugacccuacggc

SEQ ID NO: 272690 - RNA, 64 nt, Human
agggaagaguuugggcugccuccccuccucccguccaccccagaggggaaguuccucagccaga

SEQ ID NO: 272691 - RNA, 64 nt, Human
aaguagaccucagguagaacgacacugggcggagccaccccagggccugcucccagggagugcu

SEQ ID NO: 272692 - RNA, 64 nt, Human
ucucacccucagcuccgagggccgagggcuuuccccaccccacccuccuccuggccggcagucg

SEQ ID NO: 272693 - RNA, 64 nt, Human
gcgggcuggcgaaggaaauggucacaccccccgcccaccccaggcgaggauccuggugacaugc

SEQ ID NO: 272694 - RNA, 62 nt, Human
ccucgccccauccacuccggugccuccauuuagcuggccaaucagcccaggaggggcagguu

SEQ ID NO: 272695 - RNA, 53 nt, Human; identical to SEQ ID NO: 50908

SEQ ID NO: 272696 - RNA, 64 nt, Human
uccccgcagcagcgccuccucccggcgcccgagagaccggcacgccacggccccucccccaagg

SEQ ID NO: 272697 - RNA, 64 nt, Human
ggccuuuuggcuggucccgucccugaugucacccccaccccaccagccccuuucaucccuccuu

SEQ ID NO: 272698 - RNA, 64 nt, Human
cgcccccccaagagcccucgauggacagccucacccaccccaccugggcccagccaggagcccc

SEQ ID NO: 272699 - RNA, 64 nt, Human
ccaccggaggucacuccaccauccccaccccaccccaccccacccccgccaugcaacgggauug

SEQ ID NO: 272700 - RNA, 64 nt, Human
gccugccaccggaggucacuccaccauccccaccccaccccaccccacccccgccaugcaacgg

SEQ ID NO: 272701 - RNA, 64 nt, Human
cccccgccugccaccggaggucacuccaccauccccaccccaccccaccccacccccgccaugc

SEQ ID NO: 272702 - RNA, 64 nt, Human
cucaucaaacccacagacccggacucccuuucugccaccccaggcugguccggccccaggugug

SEQ ID NO: 272703 - RNA, 64 nt, Human
agaaucaggaucucuuucucauucaaggggggaaccaccccaggucagcgcugcgccugcugug

SEQ ID NO: 272704 - RNA, 64 nt, Human
auuccuuuccuuugaaugauagcugugauucaccccaccccauuuucuuguuucugguccaucc

SEQ ID NO: 272705 - RNA, 64 nt, Human
cagggcugcucaguucacaggaggcucccagcagccaccccacauccagccuacacagaacuuc

SEQ ID NO: 272706 - RNA, 64 nt, Human
uaagcaauaaauauggagugucaguagucuccuuccaccccagaaauguguugguguaacauuc

SEQ ID NO: 272707 - RNA, 64 nt, Human
ucuuuucuucauuucuuuccagaacaacucuuucccaccccaacaccacugccaccaccccucu

SEQ ID NO: 272708 - RNA, 64 nt, Human
uagcaggugcaacaaaaacaagaaacaaaugugcccaccccacuuuccgcuuaacugaaaagcu

SEQ ID NO: 272709 - RNA, 64 nt, Human
augaaauuaauaucuagacuugaccacuaucugcccaccccauuggcacucccaucuuagggca

SEQ ID NO: 272710 - RNA, 64 nt, Human
ccuuccucacaccagauuguucccaggggccugcccaccccagugccauccaguggcacggccg

SEQ ID NO: 272711 - RNA, 64 nt, Human
accgucugcaaggagcaagcaacgguggcccuguccaccccagcaaauaagaagcauaucugua

SEQ ID NO: 272712 - RNA, 64 nt, Human
aguuguauuuacuuguuucuguacucaccuacucccaccccaagggaaaauuuuagacaugaac

SEQ ID NO: 272713 - RNA, 61 nt, Human
gcuuugaccugcucagcccuguguguuaauccucuaguagccaauuaacuacucuggggug

SEQ ID NO: 272714 - RNA, 64 nt, Human
cauuggccucuugucccuuggcacacuuguacccacaggugaggggcaggaccugaagguauug

SEQ ID NO: 272715 - RNA, 64 nt, Human
gaaacuguaucaaagggggaagaaaauguauuuaacaggugaaucaaaucaggaaucuugucug

SEQ ID NO: 272716 - RNA, 64 nt, Human
guuggugggucuacaggagccucagccaggcagcccaccccacccuggggcccugccucaccaa

SEQ ID NO: 272717 - RNA, 64 nt, Human
ccaucaugugagccggcccccgagaccccggcccccaccccacaccacagacacccaccagccc

SEQ ID NO: 272718 - RNA, 64 nt, Human
uacagaugaggggaggggccgcagugcgcagaacccaccccaccccccagugcagacuucgggg

SEQ ID NO: 272719 - RNA, 64 nt, Human
cccaccccaccccccagugcagacuucggggucuccaccccaggccagcagcgcccacugggcu

SEQ ID NO: 272720 - RNA, 64 nt, Human
ggcgcgcgccuggucugucugauuccccuagccgccaccccacguuucuguaccgggucucugc

SEQ ID NO: 272721 - RNA, 64 nt, Human
ugcagcuucaacuuccugggcucaaguaauccucccaccccagccucccagguagcuaguacua

SEQ ID NO: 272722 - RNA, 64 nt, Human
gggcuucccauggucacccuggacaaggaggcaaccaccccaccuccccguaggagcagagagc

SEQ ID NO: 272723 - RNA, 64 nt, Human
cccccaguuccucccuagccuuccaucccucuguccaccccagggggagguaaccccgcacuca

SEQ ID NO: 272724 - RNA, 64 nt, Human
accaaaggguucaccucacacuugaauguacaacccaccccacugucgggaaggccuccguccu

SEQ ID NO: 272725 - RNA, 64 nt, Human
agcaaagcccccagagcccaggcucggccugcccccaccccauucccgcagugggagcaaacug

SEQ ID NO: 272726 - RNA, 64 nt, Human
aagggcuaacaucagcucauugucaaggccacccccaccccagaacagaaccgugucucugaua

SEQ ID NO: 272727 - RNA, 64 nt, Human
ccgaccaggagggggagagcagccuccacuuaccccaccccacccuugggcuaaaagcccccag

SEQ ID NO: 272728 - RNA, 64 nt, Human
ccgaggggcaccccagccccgccucugcucccccccaccccacccacccucggggcgccccccu

SEQ ID NO: 272729 - RNA, 64 nt, Human
gggggcuguugccccucccuccaucuccccacacccaccccaccccacagcagggcuccuggcc

SEQ ID NO: 272730 - RNA, 64 nt, Human
cuguugccccucccuccaucuccccacacccaccccaccccacagcagggcuccuggcccccac

SEQ ID NO: 272731 - RNA, 64 nt, Human
agucaccccuccucuccccccgccuccuggccugccaccccaccccagcguuuaccccaaagca

SEQ ID NO: 272732 - RNA, 61 nt, Human
ucagugcagagguccucagaggcuccagcaucucuaguacuaccugaaggcucuccuaacc

SEQ ID NO: 272733 - RNA, 64 nt, Human
ugcaagugcccugccaggcucuaaggcccgaagaacaggugauaucgggggcgcugcagagcug

SEQ ID NO: 272734 - RNA, 64 nt, Human
cuggccagggccccuguggcuuccugcacacuggacaggugacuguaugguagagacugugauc

SEQ ID NO: 272735 - RNA, 64 nt, Human
ccccuccucuccccccgccuccuggccugccaccccaccccagcguuuaccccaaagcacaaug

SEQ ID NO: 272736 - RNA, 64 nt, Human
augaguuugacagaugcauacaugcauguaaccaccaccccauuccagauauagaauguuucua

SEQ ID NO: 272737 - RNA, 64 nt, Human
agggucucccucgaugacgacgacgacgacgccaccaccccagcccccgucugugacugaaggc

SEQ ID NO: 272738 - RNA, 64 nt, Human
cacccccugcccuccugccggacccuggggccucccaccccagccucccugaggcccauacucc

SEQ ID NO: 272739 - RNA, 64 nt, Human
ccugucucucuccauguuggggguccuaacucccccaccccauaucuacguguccuccgggcau

SEQ ID NO: 272740 - RNA, 64 nt, Human
uuaugcaucccaugaagcccagauacacaaaauuccaccccaugaucaagaauccugcuccacu

SEQ ID NO: 272741 - RNA, 64 nt, Human
ugguagugccccugcccugggucccacuccugccccaccccacccuugucccuggccauugccu

SEQ ID NO: 272742 - RNA, 64 nt, Human
accaagcggaccuaauagacaucuacagaacucuccaccccaaauuaacagaauauacauuuuu

SEQ ID NO: 272743 - RNA, 50 nt, Human
gcgggccggaaauggcgugaccaccccauccuucuccaccaaagacaguu

SEQ ID NO: 272744 - RNA, 64 nt, Human
gccugcccgcccagagcuguggggaugaguguccccaccccagggccacuuagcugacaccagc

SEQ ID NO: 272745 - RNA, 64 nt, Human
cgccgggagcgcuccccggaaugagccgccccacccaccccaaggcuggagccgcugcacccug

SEQ ID NO: 272746 - RNA, 64 nt, Human
cccggggccuggaccuaugcagggaggccacgucccaccccaccucuuguuucugggucccugc

SEQ ID NO: 272747 - RNA, 64 nt, Human
ggauggugaagggggaccugguacccagugauccccaccccaggauccuaaaucaugacuuacc

SEQ ID NO: 272748 - RNA, 64 nt, Human
guucacagcagccgcagccaaacccggcugccucccaccccagccucaaaaccucuuccugacg

SEQ ID NO: 272749 - RNA, 64 nt, Human
uagccauaucucggccccuucccacucaccacccccaccccaggugcugggggucccuuauuuu

SEQ ID NO: 272750 - RNA, 64 nt, Human
cugccacuggggaaaacuccaccuucccacuuucccaccccacgccuuauccccacuugcagcc

SEQ ID NO: 272751 - RNA, 64 nt, Human
ccugcuguucuauuuccuuugaguguaaagacucacaggugaccugcuaucgagauagccagag

SEQ ID NO: 272752 - RNA, 64 nt, Human
gcggauuggggugauaaggggccuugcucugagcacaggugacagaucauaggaaguggcuggu

SEQ ID NO: 272753 - RNA, 64 nt, Human
uucuucugcuucagucucccaaguagcuuggauuacaggugagcacuaccacgcccggcuaauu

SEQ ID NO: 272754 - RNA, 64 nt, Human
cuuacugagucccucugggcagcagcucccuucuccaccccaccccagcacccgucccaaaugu

SEQ ID NO: 272755 - RNA, 64 nt, Human
ugagucccucugggcagcagcucccuucuccaccccaccccagcacccgucccaaauguggccu

SEQ ID NO: 272756 - RNA, 64 nt, Human
agcucaacccauaaccucaaccacaucuuauccuccaccccacaucccaccacauccaccucca

SEQ ID NO: 272757 - RNA, 64 nt, Human
gggucgggggggacauuggaaaggagggaccccgccaccccagcagcugaggaggggauucugg

SEQ ID NO: 272758 - RNA, 64 nt, Human
ggaugucucaccgggcugggggugagauauccccccaccccagggacuccccuucccucuggcu

SEQ ID NO: 272759 - RNA, 64 nt, Human
ccugaugaccccuauggccaacaucaacccggcaccaccccaaggcuggcuggggaacccuuca

SEQ ID NO: 272760 - RNA, 64 nt, Human
cuguucauuucaucuggcuccccccaccaccuccccaccccaccccccacccccugcuuccccu

SEQ ID NO: 272761 - RNA, 64 nt, Human
uggcuccagugcccucccucuguucccuggaccaccaccccacguagcugcucacaccagccuc

SEQ ID NO: 272762 - RNA, 64 nt, Human
uuccuggccucuuuggcagcuccacccuguccccccaccccacaaaggggggcuacgcagucac

SEQ ID NO: 272763 - RNA, 64 nt, Human
ugcucgcugggauucccacgcccaccacugucccccaccccauggcugggaggggccucugaac

SEQ ID NO: 272764 - RNA, 64 nt, Human
agucuguguguaugugucuuccccggaauccacaccaccccacccuccuccugucccgugguuu

SEQ ID NO: 272765 - RNA, 64 nt, Human
gcgggggcacggccuggcauuucacgcauugcugccaccccagguccaccugucuccacuuuca

SEQ ID NO: 272766 - RNA, 64 nt, Human
agaggggccagggaaguggaugucuccuccccucccaccccacccuguuguagccccuccuacc

SEQ ID NO: 272767 - RNA, 64 nt, Human
cgccugccgugcauggcuccugucuggcucggacccaccccaacucuccccagugccugccacu

SEQ ID NO: 272768 - RNA, 64 nt, Human
ccuccccagggagcaaagccauaaggggcaggggccaccccacggcaucuccccagaaguacag

SEQ ID NO: 272769 - RNA, 64 nt, Human
cuggggcccacucacacuacacccucuuccuuucccaccccaccuccccggagagaaacuggac

SEQ ID NO: 272770 - RNA, 61 nt, Human
ucuggccucugcccccuucucuagccacagccucuaguacacuuuagcaauaccaccagac

SEQ ID NO: 272771 - RNA, 61 nt, Human
acagcauguguagcaccaguugauaauuggucucuaguagcuuacugucaaaauguucaau

SEQ ID NO: 272772 - RNA, 61 nt, Human
uuuaaggcauacuuuuaccucaggaaacuuacucuaguauguucucauauauugaauucuc

SEQ ID NO: 272773 - RNA, 64 nt, Human
cccgcugggagacccacagagugugcaucagucaccaccccaacaugcucagggaggcagaguu

SEQ ID NO: 272774 - RNA, 64 nt, Human
uccgaaagaagcuaaaccuugcacaucccaacacccaccccagggagaguucccgugugugccu

SEQ ID NO: 272775 - RNA, 64 nt, Human
aucacugaguuuauccaccgccauccaccucuauccaccccauaaggucccuacagcaaguggg

SEQ ID NO: 272776 - RNA, 64 nt, Human
uaaggcuaugugugacacccuccugaggaccuccccaccccaguguaauggcccuucauggcag

SEQ ID NO: 272777 - RNA, 64 nt, Human
gcugcucaggagccagcacaggacaccccccaccccaccccaccauguccccauuacaccagag

SEQ ID NO: 272778 - RNA, 64 nt, Human
aggaugcugcucaggagccagcacaggacaccccccaccccaccccaccauguccccauuacac

SEQ ID NO: 272779 - RNA, 64 nt, Human
ugucaggcaggcagguggcaggcagcucacccacccaccccaugggaucccccagcccuucacc

SEQ ID NO: 272780 - RNA, 64 nt, Human
gggaacgagccaacaugugaccggcgagcgcgggccaccccacccuguucauuuccauaaacgu

SEQ ID NO: 272781 - RNA, 64 nt, Human
gccacuucgccgcugccccggagacuuuucaaucccaccccacuccucaucucaccauuugguc

SEQ ID NO: 272782 - RNA, 64 nt, Human
aggcaggggcuucuggggccaucuuggagucuguccaccccaacuccugacagcaucauccucu

SEQ ID NO: 272783 - RNA, 64 nt, Human
uucaccaugguacugucuccacagcccucaguccccaccccaggagaggcgccugccaccuccu

SEQ ID NO: 272784 - RNA, 64 nt, Human
caccuccagggccuuagaaccaccgccccucuccccaccccaggcaccccucuuuuuacucaaa

SEQ ID NO: 272785 - RNA, 64 nt, Human
gccuccaacccugccugcggccuccccccgucgcccaccccacgucuccuggccacugagacac

SEQ ID NO: 272786 - RNA, 64 nt, Human
gggccccggcccucccuggcuccccuuccccccaccaccccaucgcuggguuucggggcuuggu

SEQ ID NO: 272787 - RNA, 64 nt, Human
ucuggcacaagcugccaccaccagccacccacacccaccccagcacaccucacacgggaccaca

SEQ ID NO: 272788 - RNA, 64 nt, Human
ggucugucucaugcucucccuguuccucuccccgccaccccagggccuccaagccaccucugga

SEQ ID NO: 272789 - RNA, 59 nt, Human
cagaccuccauacuuuauaaguuguuggacucuaguaccaagaaacaacaacaaacgag

SEQ ID NO: 272790 - RNA, 61 nt, Human
gaaaauuuccaauuucuacuacguucaccaucucuaguaagaucugacauaugcugaaguu

SEQ ID NO: 272791 - RNA, 61 nt, Human
caaucuaaaaguguguuucaauugaguaucucucuaguagaauaggaguucauccugaaaa

SEQ ID NO: 272792 - RNA, 64 nt, Human
uucuggccucugagguugggggacuacuuguuucccaccccagguuccuccaggccaagucaug

SEQ ID NO: 272793 - RNA, 64 nt, Human
ugcuuuguccgucuauccacccgcccacccgcccccaccccaccggcagcguccaggugcgggg

SEQ ID NO: 272794 - RNA, 64 nt, Human
cagucugaggccagggacacaugaagggauguccccaccccagcacuaucagggccuccccagg

SEQ ID NO: 272795 - RNA, 64 nt, Human
aauucagcugacaggaggccucuauccugucccuccaccccacccuccaccucaauccccuccc

SEQ ID NO: 272796 - RNA, 64 nt, Human
ugacacccuccccugaccugacuagggggaggauccaccccaaccucugcccugcccgccccag

SEQ ID NO: 272797 - RNA, 64 nt, Human
ccacauccacuccaaggggacuauucccccgaccccaccccagucuccccacacggaccuuugc

SEQ ID NO: 272798 - RNA, 64 nt, Human
ccccgucuccucccuguucccguuccucccuggcccaccccacucacacuccccaaggcccacg

SEQ ID NO: 272799 - RNA, 64 nt, Human
aggccggagccccugggagcccucgcaccgcuccccaccccacucagcggccccaucggaacug

SEQ ID NO: 272800 - RNA, 64 nt, Human
gcccauagcaucccacaggcccaggcaggaggucccaccccagacccugccccagacgcucccu

SEQ ID NO: 272801 - RNA, 64 nt, Human
gugcccggggaucccccgccccauccuccugcccccaccccaggcugggcuguucacucucucg

SEQ ID NO: 272802 - RNA, 64 nt, Human
acauuccauaaauuagcugggugucccugcacgcccaccccaugaaacucgagcaggucucugg

SEQ ID NO: 272803 - RNA, 64 nt, Human
ggagaccacgcuucuccuccgugccgugcgacccccaccccaugacuauugugcgauucgugag

SEQ ID NO: 272804 - RNA, 64 nt, Human
gccccagcgucuucuccccagccccguccucccaccaccccagggggcaggcaggcaggccccc

SEQ ID NO: 272805 - RNA, 64 nt, Human
ucucguaauagaaaaguggggagccgcuggggagccaccccauucauccccguauuucccccuc

SEQ ID NO: 272806 - RNA, 64 nt, Human
agggccccagaguuccuugcaucuaauuucacccccaccccacccuccaggguuagggggagca

SEQ ID NO: 272807 - RNA, 64 nt, Human
ccccaaccuaaccagaccuggugccuugacgcccccaccccagcugggacgguacagagaaggg

SEQ ID NO: 272808 - RNA, 61 nt, Human
uggaaggcagaccugaaucacaacgggccagcucuaguaauacgaaggugaggucugggau

SEQ ID NO: 272809 - RNA, 61 nt, Human
aguaaauucuguugaaccaccuguguagucucucuaguaguuaaaacagcuauuuuaguaa

SEQ ID NO: 272810 - RNA, 61 nt, Human
guucuggguaagugaguuauaagaguacaugcucuaguaacucugguagucacugugacuc

SEQ ID NO: 272811 - RNA, 64 nt, Human
gccaggggucgggggaguguugggagccuccuccccaccccaccucccucacuucacugcauuc

SEQ ID NO: 272812 - RNA, 64 nt, Human
uucaccucuguaaguugaguccuccgccuccgggccaccccacucccuuccgcuugcagcuucc

SEQ ID NO: 272813 - RNA, 64 nt, Human
gagaggagugggguuuguugaugaaccuccacccccaccccacccccgcacgccuguaauccca

SEQ ID NO: 272814 - RNA, 64 nt, Human
cauggauaccacacauuucucaucucauuggcccccaccccagagaccuccaccucaacuucug

SEQ ID NO: 272815 - RNA, 64 nt, Human
uuccacgccucucccaccucccuccgcacacaccccaccccagccugcuauaggcugggcuucc

SEQ ID NO: 272816 - RNA, 64 nt, Human
cuagaacacccaacaccaaacuguacagacucucccaccccaaccuccccagacucugcacgga

SEQ ID NO: 272817 - RNA, 64 nt, Human
acccucaagaaacccccagugccuuguaugaagcccaccccacauggcccacagcuccugugcu

SEQ ID NO: 272818 - RNA, 64 nt, Human
aguagcagugccucccucaagggccuggguucuaccaccccacuccuagggaucucuugaaccu

SEQ ID NO: 272819 - RNA, 64 nt, Human
ugccccaaacucuuccccgggaagggggacagacccaccccagcccagggcccucacccaccuc

SEQ ID NO: 272820 - RNA, 64 nt, Human
ugcuuaggggcucuccugggccccacaccagugcccaccccaaaucuggucgucuccucccccc

SEQ ID NO: 272821 - RNA, 64 nt, Human
ucucuacaagugccugcuaucccucucccacuccccaccccagcaccgguccaaccccuucauc

SEQ ID NO: 272822 - RNA, 58 nt, Human
aagaggaauucuucaucugacccuauccccaccccaggccuaggccugggccugggcu

SEQ ID NO: 272823 - RNA, 64 nt, Human
cucccuggcaggguccucuucuuuucccagagcuccaccccaaccaggagcucuaguuaaugga

SEQ ID NO: 272824 - RNA, 64 nt, Human
cuccaaucugcguccacuuaggaggcccaacugcccaccccaaguccccaggggauggcccucc

SEQ ID NO: 272825 - RNA, 64 nt, Human
cuguuggugaccgucuauaucccuggggaaauuuccaccccaguccccuccccagggaaccacc

SEQ ID NO: 272826 - RNA, 64 nt, Human
uagacccugggcccuggagcuuaggggauucuccccaccccagccccacaccugcuccuucccu

SEQ ID NO: 272827 - RNA, 61 nt, Human
ccuuuucaccuuuucaggaaaauaacuuagacucuaguauuuauggguggauuuauccuuu

SEQ ID NO: 272828 - RNA, 64 nt, Human
uagggaagguggaggcacacuccucuucuguuggacaggugagcucugagggcaagcccugggc

SEQ ID NO: 272829 - RNA, 64 nt, Human
ucugaggcuggugacuccucccugcuggggccccacaggugaggcagaacagcuagagggccuc

SEQ ID NO: 272830 - RNA, 64 nt, Human
cauuucuacuuggggcccccuuccuaggacucucccaccccaaacuccaaccuguaucagaugc

SEQ ID NO: 272831 - RNA, 64 nt, Human
ugacccugacaugugacaucuaccucccgaccuaccaccccacuggcugguuccagaacgucuc

SEQ ID NO: 272832 - RNA, 64 nt, Human
gaauuuauuugugucagaaaauacuccagaacaaccaccccauauuaugauuagcucuuuuccu

SEQ ID NO: 272833 - RNA, 64 nt, Human
ucaacuuugagacuguagagucaggucccuaaguccaccccaggggcuggaaaccuggaguuca

SEQ ID NO: 272834 - RNA, 64 nt, Human
agcacguuguauacauguacugcaauauugcuguccaccccauaaauauguacaauucuguaua

SEQ ID NO: 272835 - RNA, 64 nt, Human
aagcuuccucugacgguuacccuccccccaccuuccaccccaaccaucugaaccauuccugucu

SEQ ID NO: 272836 - RNA, 53 nt, Human
ggcugcugccugcgcccugacucccaccccaagcccccggccaagccuggacu

SEQ ID NO: 272837 - RNA, 64 nt, Human
aacccacugggguagggaucaaagccagccacccccaccccaacacacucggugucccuuucau

SEQ ID NO: 272838 - RNA, 64 nt, Human
cacccucgaagcgcgccacucgcuucccccauagccaccccagaaauggugaaaauaaaauaaa

SEQ ID NO: 272839 - RNA, 64 nt, Human
ccaaggucagcuuaugaaggaccccacuugcaccccaccccagccauggaagagcagcuggagg

SEQ ID NO: 272840 - RNA, 64 nt, Human
gucauacucacuucuuuagccagccccauccccuccaccccacaccugaguucuugccuccucc

SEQ ID NO: 272841 - RNA, 64 nt, Human
ccucuucccucaucuccccccuccuuccucugccccaccccagcggggagcagacugcuccucc

SEQ ID NO: 272842 - RNA, 64 nt, Human
ugccaacaccugcuggucagaugucccccuacccccaccccacuguccuccaaggcuacaggac

SEQ ID NO: 272843 - RNA, 64 nt, Human
ugucucggcucccuccucccccuucccccuucccccaccccacacccuucacccucuguguccu

SEQ ID NO: 272844 - RNA, 51 nt, Human
ccaaggauaaagacgacuaggccaccccagcccccugacaccccagccccc

SEQ ID NO: 272845 - RNA, 64 nt, Human
uggaaggggagagguucucagcaucaggccaccuccaccccaaugccaggauagauguauucua

SEQ ID NO: 272846 - RNA, 61 nt, Human
caaaugucaugauagcuugcauaaauggugacucuaguagauuugacucaagcacuucuag

SEQ ID NO: 272847 - RNA, 61 nt, Human
cuguaguuuauuggaaucuguuaaugccuuccucuaguaguuaaagguuuaucaguauuuc

SEQ ID NO: 272848 - RNA, 61 nt, Human
uuagacuuaauagcaaagcauauuuauugaacucuaguagggcuauuuguugguaagcucu

SEQ ID NO: 272849 - RNA, 64 nt, Human
ggggagagcggggaagucucugcauccaugccacccaccccagucgggucucacuuuccugugc

SEQ ID NO: 272850 - RNA, 56 nt, Human
gccaagaagccaaccaauaaggccccccaccccaagcaggaaccccaggagaucaa

SEQ ID NO: 272851 - RNA, 64 nt, Human
caggacaaaggcugacagacucacugggaagcucccaccccacucaggggaccccacuccccuc

SEQ ID NO: 272852 - RNA, 64 nt, Human
cccauggauuguguugagugugcagacagggaggccaccccaauaggaauucgucuccaggauu

SEQ ID NO: 272853 - RNA, 64 nt, Human
ggaaggagagggaagcagcggccucggccaaggcccaccccauacucuuggcucuguagcauuu

SEQ ID NO: 272854 - RNA, 64 nt, Human
ccacagagggccgagggucacccgucggccgccgccaccccaggcgaggccggaggaaggauca

SEQ ID NO: 272855 - RNA, 64 nt, Human
cuugccuguuccgacuccaccugugcagccggggccaccccaggagaaaguguccagguggggg

SEQ ID NO: 272856 - RNA, 64 nt, Human
gaccuagcugugcccccaaccuagauuggcagcaccaccccagggcagaggacucucugggcac

SEQ ID NO: 272857 - RNA, 53 nt, Human
uuccagacuuugaugacuagcacccaccccauagcugaggaggagucacagug

SEQ ID NO: 272858 - RNA, 64 nt, Human
uaugucuacguggauuuuugguuuucagcuucccccaccccacuggcucuucuuaauuagaagu

SEQ ID NO: 272859 - RNA, 64 nt, Human
cagagacgcaagggagaagaaauccauaacacccccaccccaacacccccaagacagcagucuu

SEQ ID NO: 272860 - RNA, 64 nt, Human
augggagcugguuagaaaugcagaauccuaggcuccaccccauccaguucaugagaaucuauau

SEQ ID NO: 272861 - RNA, 64 nt, Human
agguuggcgucuuccuacgucccagaagcagcccccaccccacacaugacccacaccgcccuca

SEQ ID NO: 272862 - RNA, 64 nt, Human
ggcuccugaggggcaucugccccucccccaacccccaccccacacuuguuccagcucuuugaaa

SEQ ID NO: 272863 - RNA, 64 nt, Human
uguggcugcuggcugaggguucugcuguccugugccaccccauuaaagugcaguucccuccggg

SEQ ID NO: 272864 - RNA, 64 nt, Human
aucccuggcagaacacccagagugcccguggcucccaccccagggucuggccggugugcuggau

SEQ ID NO: 272865 - RNA, 61 nt, Human
ccaucuuaaaauuucaccuuaaguaaauggccucuaguagaugauaagccuaaaaaaagca

SEQ ID NO: 272866 - RNA, 61 nt, Human
cuuucuuaaauucuucuauucucagacacugcucuaguaccauuccuuccucuuagcccca

SEQ ID NO: 272867 - RNA, 61 nt, Human
augaguaauuuuuuuggcuucuucuccuccacucuaguauuuccacccucaguaaggaaug

SEQ ID NO: 272868 - RNA, 64 nt, Human
gccaacaccaccacccccagggggucuccccaccccaccccauuuacagggugagcucagccug

SEQ ID NO: 272869 - RNA, 64 nt, Human
ccggagccaacaccaccacccccagggggucuccccaccccaccccauuuacagggugagcuca

SEQ ID NO: 272870 - RNA, 64 nt, Human
agaaugcuggagggagcacgccgcugagaugcccccaccccagguuucccccaucagaguuaag

SEQ ID NO: 272871 - RNA, 64 nt, Human
ucugggacuagcagugaaucgggacacaaaccacccaccccauugggagaaaaacccagacgcc

SEQ ID NO: 272872 - RNA, 64 nt, Human
uuuaacauugugagccagcuagacccccagugcaccaccccauauugaaaaacaguugucuggc

SEQ ID NO: 272873 - RNA, 64 nt, Human
agcaagaaggcuggugagggaagggcucagcuucccaccccacguacagcaagggacuccccag

SEQ ID NO: 272874 - RNA, 64 nt, Human
ccaaagccaggggcccaccccgccccaccccaccccaccccacccucugaaaugugaaaagccu

SEQ ID NO: 272875 - RNA, 64 nt, Human
gcagcccaaagccaggggcccaccccgccccaccccaccccaccccacccucugaaaugugaaa

SEQ ID NO: 272876 - RNA, 64 nt, Human
ggagggcagcccaaagccaggggcccaccccgccccaccccaccccaccccacccucugaaaug

SEQ ID NO: 272877 - RNA, 64 nt, Human
ggucugguagcagccugucacuccagacuguccuccaccccagacuuccgcaaacugaugggcu

SEQ ID NO: 272878 - RNA, 64 nt, Human
uguguguggaaauggccaccaccauucuccuuccccaccccaccacaaaaagagaagcuguguc

SEQ ID NO: 272879 - RNA, 54 nt, Human
ucagauuuaaggaacagugacaccccaccccagucccguggagggggucugggc

SEQ ID NO: 272880 - RNA, 64 nt, Human
ucuuuauaagaacccuggucauugaauuuaaggcccaccccaaguccagaaugaccucgcaaga

SEQ ID NO: 272881 - RNA, 64 nt, Human
aaggcucagcuaucuguucaaacgucaccuguucccaccccagacccaaagagguugauucagu

SEQ ID NO: 272882 - RNA, 64 nt, Human
aacacagcaauaacugggcuuccuguccccacccccaccccagcagugcucucuggcacuggga

SEQ ID NO: 272883 - RNA, 64 nt, Human
accgcuaugccagccaguggacccucaaccgaccccaccccaccaucucagcacacacccucac

SEQ ID NO: 272884 - RNA, 61 nt, Human
ugugaaacugaaggacaguguuaaagcugggcucuaguauauugaugauuucugcauaagu

SEQ ID NO: 272885 - RNA, 61 nt, Human
aaaugaagcagaagcugggagucggccuuuccucuaguaaccaccacauggcucagcaucu

SEQ ID NO: 272886 - RNA, 61 nt, Human
uaaauaguauuuugucuaggagaugcuuucucucuaguaguuagaaauuaaaucuguguca

SEQ ID NO: 272887 - RNA, 64 nt, Human
ccaaggguauuacugguggaauaauauccgccccccaccccaguuucuaauuugcuguaggcug

SEQ ID NO: 272888 - RNA, 64 nt, Human
gaguggggguucucgccaauucccuaaugagauuccaccccaauaucaucaggcaccuuucccc

SEQ ID NO: 272889 - RNA, 64 nt, Human
guggcucccccggcccccaccacccucagcagccccaccccacucaacccugaggguccccagg

SEQ ID NO: 272890 - RNA, 64 nt, Human
cugaggcccaggacccaccccccugccaccccucccaccccacucccugcucaguaccuggcgu

SEQ ID NO: 272891 - RNA, 64 nt, Human
ggggguggccauuuagggaucguggggacgggguccaccccaagaagaaagaaaggcccgucca

SEQ ID NO: 272892 - RNA, 64 nt, Human
guccccgccuccuccgcugcccaaucucucagacccaccccaccugcaggcccagaccacgugg

SEQ ID NO: 272893 - RNA, 64 nt, Human
uccccaccaacuucucugccccagggacccgaggccaccccagccugguguggacccaucggcg

SEQ ID NO: 272894 - RNA, 64 nt, Human
agcccucaggcccucccugccaaacuggagaaccccaccccaaggcaugccacguccgcagccc

SEQ ID NO: 272895 - RNA, 64 nt, Human
uuggucccagggcggggcagggaauucuaaguguccaccccagggaggcaaggggcugcuuucc

SEQ ID NO: 272896 - RNA, 64 nt, Human
uauuauggaucccuugggcugugggccuucccauccaccccaccacaacugcccagguagcugg

SEQ ID NO: 272897 - RNA, 64 nt, Human
ucugguggguccccacuccuggggcccccuaaccccaccccaggcagcggaaggggcugacugg

SEQ ID NO: 272898 - RNA, 64 nt, Human
acacauuccauuuguugagccccaguccugccccccaccccacccucccuaccccuccccaguc

SEQ ID NO: 272899 - RNA, 64 nt, Human
cgggaacccgccgcacgcuguguucuaggcccgcccaccccaaccuucugguggggagaaauaa

SEQ ID NO: 272900 - RNA, 64 nt, Human
ggccuucuuugaagagcucuagcaggugacccagccaccccaggaccugccacuucuccugcua

SEQ ID NO: 272901 - RNA, 64 nt, Human
accagaggcccagcuaccaaggccacauuguccaccaccccagccuagagccuagaacuguagu

SEQ ID NO: 272902 - RNA, 64 nt, Human
uggccagccuggcccugcaggucucccaugaaggccaccccauggucugaugggcaugaagcau

SEQ ID NO: 272903 - RNA, 61 nt, Human
gacgagggcaagaaagcaacauugcugaucucucuaguaugaaagauuuggagggaguguu

SEQ ID NO: 272904 - RNA, 61 nt, Human
augaagagaacgcuggaaggcugcgagaggacucuaguaugagucuccaacauuuggaacg

SEQ ID NO: 272905 - RNA, 64 nt, Human
aauuguauugguuaauugacuguuuaaggccuuaacaggugaaucuagagccuacuuuuauuuu

SEQ ID NO: 272906 - RNA, 64 nt, Human
gcugcagugggaucuggcugcucugccuccuuucccaccccagcugaccaugagacuuugcuga

SEQ ID NO: 272907 - RNA, 64 nt, Human
ccuccuugagccuuaguccagggggucacuccucccaccccaccuaccucacaggguuguugug

SEQ ID NO: 272908 - RNA, 64 nt, Human
gucccaucgccugcagcaccuggagacccaccucccaccccagugcacucuuuugggccacaga

SEQ ID NO: 272909 - RNA, 64 nt, Human
ccaagggucccaccacagccagcgggcuggccucccaccccagcauccauacacguaggccugu

SEQ ID NO: 272910 - RNA, 64 nt, Human
gcuuuugucugaugcucugggauucuggccagacccaccccagggcacauguccugcgggggcg

SEQ ID NO: 272911 - RNA, 64 nt, Human
ccagccuuucgcgucaccuggaggccacaucuucccaccccaccugccagccccugucucuccu

SEQ ID NO: 272912 - RNA, 64 nt, Human
uuaggcuguaggggggugagaaggagagaagggaccaccccauucuucucaagcaaggauugcc

SEQ ID NO: 272913 - RNA, 64 nt, Human
gucugugcuuguggcuaugagcgugugccuccacccaccccacgacccgugacuacugugcaag

SEQ ID NO: 272914 - RNA, 64 nt, Human
gggcuucugguccaagcuguguugacugucauccccaccccaccccuaccucacgccugcccca

SEQ ID NO: 272915 - RNA, 64 nt, Human
cuggccucugcccacccuuugagcugcaccugccccaccccagcucauccaugugcuuguaccc

SEQ ID NO: 272916 - RNA, 64 nt, Human
ggcggagcggagagggcggccgugguggaggccuccaccccaggagcaccccgcgcacccucgg

SEQ ID NO: 272917 - RNA, 64 nt, Human
uccugugggagccccggccggcacccggcuggucccaccccaaauaccucagccauggagacca

SEQ ID NO: 272918 - RNA, 64 nt, Human
ggaggccagggaggggaacucagcaguucaggagccaccccaaaccauucugggacagggacac

SEQ ID NO: 272919 - RNA, 64 nt, Human
ccacagggacaagaggggcccccucgccccagccccaccccacauggagcucagggggaagcag

SEQ ID NO: 272920 - RNA, 64 nt, Human
cgcugcuagcgcaccccugcaguccagcgugcauccaccccacgcacgccccgugcuguguucc

SEQ ID NO: 272921 - RNA, 64 nt, Human
ucugcagcccagcucuguggcaggaggccugaccccaccccaucagucccucucccagcauugc

SEQ ID NO: 272922 - RNA, 61 nt, Human
cugccuuauaagugguuuagugcucaguuggcucuaguaaccagaggacacagaaaguauc

SEQ ID NO: 272923 - RNA, 61 nt, Human
gaccagccuagccaagauggugaaaccccgucucuaguaaagauaacaaaaaauuagcugg

SEQ ID NO: 272924 - RNA, 61 nt, Human
gaaauaaguugcaguauggucguacuuuuaacucuaguauccuuugcuugcuucuuacgcc

SEQ ID NO: 272925 - RNA, 64 nt, Human
ccaagccugacuuuggggacacccuccugcccccccaccccacuccccccauccuaccuaacuc

SEQ ID NO: 272926 - RNA, 64 nt, Human
ccugauggacgccugccgcccgccacccccaucuccaccccaucauguuuacaggguucggcgg

SEQ ID NO: 272927 - RNA, 64 nt, Human
gcgcgcagcucccucagcuucgcagcgccgcccgccaccccacaccucccacgcuaccgggcac

SEQ ID NO: 272928 - RNA, 64 nt, Human
gagccuggugcgccuaggcccucggaccccauccccaccccagccgggcccgcucaggaugccc

SEQ ID NO: 272929 - RNA, 64 nt, Human
agagaucucacagcugaacgugacugaacauuuuccaccccaagcagggccacucuaagaauug

SEQ ID NO: 272930 - RNA, 64 nt, Human
aacgccacuggccauguggaauccauggccuggaccaccccagaucccacauccccugacgaag

SEQ ID NO: 272931 - RNA, 64 nt, Human
gaccauccucaagaacugagaccccggccagcgcccaccccagccuucugcccgccccaucgag

SEQ ID NO: 272932 - RNA, 64 nt, Human
acugcuaggacaagcucagcuguugaggacacccccaccccaaauuucaguucuuacgugauuu

SEQ ID NO: 272933 - RNA, 64 nt, Human
cucccagcagggugaagaguccaagaagccagcaccaccccauccgcaucucaaguaagugcuu

SEQ ID NO: 272934 - RNA, 64 nt, Human
ucccucugcccugccucuccuucagcuccgaaccccaccccacucaguacauggccccccaaca

SEQ ID NO: 272935 - RNA, 64 nt, Human
aggcagaucacguugcaauggcucaaacaacauuccaccccagcaggacagugaccccaguccc

SEQ ID NO: 272936 - RNA, 64 nt, Human
cgcauguggaagcaucuacccguucacuccagucccaccccacgccugacuccccucuggaaac

SEQ ID NO: 272937 - RNA, 64 nt, Human
cccugggggcugggacuaaagaaaugggugucccccaccccaucagcugggaaagcccaggccg

SEQ ID NO: 272938 - RNA, 64 nt, Human
acuacucucuucaccccuuuauuccagcugccugccaccccagacccccaccucccacccugac

SEQ ID NO: 272939 - RNA, 64 nt, Human
uuccuuuaugcaacacccaaacaucuuggcauccccaccccaggaagugcggggaggagguuau

SEQ ID NO: 272940 - RNA, 64 nt, Human
aaaaaaauaauaauaaucuuaaagaugagaaaagccaccccaucuggcaccacagcugcaucuu

SEQ ID NO: 272941 - RNA, 61 nt, Human
ugacugacauacauacucaaauauaggcugucucuaguaaaucuuaaaaucuugaagcuaa

SEQ ID NO: 272942 - RNA, 61 nt, Human
gcuuuuauaucuguauguauuagugauauuucucuaguaguuaaaaaaaaaaaaaggaaaa

SEQ ID NO: 272943 - RNA, 61 nt, Human
agaugguaugaaguccucuuuggggcagggacucuaguagaucuucuugucagagaagcug

SEQ ID NO: 272944 - RNA, 64 nt, Human
gggggcccuccugcccgaagucauacucuugcucccaccccacccuugcccccagcccucucuc

SEQ ID NO: 272945 - RNA, 64 nt, Human
gcauuggaaggcccaaacccucucccuugaguggccaccccagccugguuggcugguuuucccc

SEQ ID NO: 272946 - RNA, 64 nt, Human
cuagugaaacuccuuucaucucuguccuauggccccaccccaccauucccucuaggcccagacc

SEQ ID NO: 272947 - RNA, 64 nt, Human
ccagcaccucagccugcucuucucucugguggcuccaccccaaccccuacuucuuuuccuuuau

SEQ ID NO: 272948 - RNA, 64 nt, Human
uuugcucauuuguaaaaugggcaggucaaucuucccaccccaccgugugggcugccccaacccc

SEQ ID NO: 272949 - RNA, 64 nt, Human
accuuucccuuuuccuugaguugugcugaaugccccaccccagcucucuuucccuucugggugu

SEQ ID NO: 272950 - RNA, 64 nt, Human
cacaugggcagcccaaagcugcaggugccagggcccaccccagccucgccugucacccccacuc

SEQ ID NO: 272951 - RNA, 64 nt, Human
gccuggggagccguuugggggcagccccuucugcccaccccauccuucuuccucuccagagaug

SEQ ID NO: 272952 - RNA, 64 nt, Human
uucuguuacacuguauaguaguccuauggcacccccaccccaucccuuucgugccacucccguc

SEQ ID NO: 272953 - RNA, 64 nt, Human
ccccaucccuuucgugccacucccguccccacccccaccccaguguguauaagcuggcauuucg

SEQ ID NO: 272954 - RNA, 64 nt, Human
cacaaaaucacaccauuuucaugccugucaauccccaccccaccacaaggcaggaagggggugg

SEQ ID NO: 272955 - RNA, 64 nt, Human
gucccugccaccuguaccaccaaugggccugcccccaccccaggaguuuggccgggggaaccca

SEQ ID NO: 272956 - RNA, 64 nt, Human
cugcaaauaacuccuccauugaaauaacuccuccccaccccaacaacaacauucccagcagacc

SEQ ID NO: 272957 - RNA, 64 nt, Human
ccacacccagugaagcauuggaaacccuauuuccccaccccagcucaugcccccuuucagaugu

SEQ ID NO: 272958 - RNA, 64 nt, Human
aguauucccugacuuggguuucacacuuuaucgaccaccccaugggguccuguguagccuuugg

SEQ ID NO: 272959 - RNA, 64 nt, Human
ccauccaccuccacacugccuccuggccagcugcccaccccagugccaggugggagagggagca

SEQ ID NO: 272960 - RNA, 61 nt, Human
uuuagagcacuugacuuuuuuuucucucucucucuaguauucuaaacugaccccaugacca

SEQ ID NO: 272961 - RNA, 61 nt, Human
caaauuuuaugguuuaucuccagcaacauuucucuaguacuugcacuuauuaucuuuuguc

SEQ ID NO: 272962 - RNA, 61 nt, Human
ccagaaaugaagguucaguuaugaggcaacccucuaguaaggcauuguaaaaguuacugga

SEQ ID NO: 272963 - RNA, 64 nt, Human
aaugggggaaugacacaucccccccaaccuacccccaccccaaaagcagcuccaacagaauggc

SEQ ID NO: 272964 - RNA, 64 nt, Human
ucacuccaccucaaagucauuugacugcccccauccaccccaccacccuaaucuuccaccaccu

SEQ ID NO: 272965 - RNA, 64 nt, Human
gcaccugccagggaggccaucuggggcuccuucuccaccccagcccccaaagcagcccuucccc

SEQ ID NO: 272966 - RNA, 64 nt, Human
ucuuuucuuccucauuuccuucuuuuauuccuccccaccccaaccccuuaaaaaaaaggucaga

SEQ ID NO: 272967 - RNA, 64 nt, Human
agaagccauuuuggaaauucacgaaaguacugcuccaccccaguugaguuauuuagaauuuuau

SEQ ID NO: 272968 - RNA, 64 nt, Human
uagaguaacuucugaggcuuuuugagaauaaaauccaccccacccuuguuuccccuugguauuu

SEQ ID NO: 272969 - RNA, 64 nt, Human
uuuaaagaaguaugggaaaugagaggcauuucccccaccccauuucucuccucacacacagacu

SEQ ID NO: 272970 - RNA, 64 nt, Human
gcauuucaauuucaaugguguuggcuuccccuccccaccccacgcgugcauaaaaacugguucu

SEQ ID NO: 272971 - RNA, 64 nt, Human
ggcccugcagggggaggggugacagggcgagcccccaccccagcagcagcaauacccccacccu

SEQ ID NO: 272972 - RNA, 64 nt, Human
aggcuuauccccucucaucuuccuccccuaaaccccaccccaguuuaggagauuaucaagcugg

SEQ ID NO: 272973 - RNA, 64 nt, Human
ugcacccaucagccaacacuccccaacccaucggccaccccaagcccucugcaaccacgaaucg

SEQ ID NO: 272974 - RNA, 64 nt, Human
cugcguccauaaggguccugcacguugccucccaccaccccagcucugccagaauaaaauuguu

SEQ ID NO: 272975 - RNA, 64 nt, Human
guggggaaguagccaggaaaugagaaacuuccucccaccccagacauuuuuccuggugggagcu

SEQ ID NO: 272976 - RNA, 64 nt, Human
auuuuuuuauugcuccgcauacugagaaucuaggccaccccaaccucuguuccccacccaguuc

SEQ ID NO: 272977 - RNA, 64 nt, Human
gccccugggaucuguacccaggaccuggagaauaccaccccacccccagcccauaauugggacc

SEQ ID NO: 272978 - RNA, 64 nt, Human
cccccagucaccauugucaccacacucacccaucccaccccaccccuccuauccaccccucccc

SEQ ID NO: 272979 - RNA, 61 nt, Human
uauauaacuuagugcuagcuagcgccacagacucuaguagauaauauuaucaucauaaugg

SEQ ID NO: 272980 - RNA, 61 nt, Human
uucuaccucuggggauaaggauucacauucgcucuaguacgaugggcucuuucaccccacu

SEQ ID NO: 272981 - RNA, 61 nt, Human
aauucuuggggcugagcugggagcccggcaacucuaguauuuaggauaaccuugugccuug

SEQ ID NO: 272982 - RNA, 64 nt, Human
ccaaggaccgggcccugccccgccacccuaccucccaccccagcagcccucucuucccccaccu

SEQ ID NO: 272983 - RNA, 64 nt, Human
accuucucuccccuuuccaugccguccaugauccccaccccauguguuuuaaaaaggcaguagc

SEQ ID NO: 272984 - RNA, 64 nt, Human
aagaccuagaggguuugggacaaacugggagcccccaccccacacucuaguugcccaugucuga

SEQ ID NO: 272985 - RNA, 64 nt, Human
ccuaaauuucccuuuggcucaugucccccccgccccaccccaccuucuccuuuuuggcaugucu

SEQ ID NO: 272986 - RNA, 64 nt, Human
aaaugccaccuccuccaugaagccuucccuaauuccaccccaaacccccaccuucaacaauauu

SEQ ID NO: 272987 - RNA, 64 nt, Human
gucuccuguaucccagucacuaguccucccugguccaccccacccucauccucaggagccacag

SEQ ID NO: 272988 - RNA, 64 nt, Human
cacagucaccuugcagucaggcuggaaucuugggccaccccaaagugcuuugcugaaggauuua

SEQ ID NO: 272989 - RNA, 64 nt, Human
guaaaaugccagacaugucccagcccgaacucccccaccccauggccuggagguuucuagaugg

SEQ ID NO: 272990 - RNA, 64 nt, Human
ccuugagcagucaccucucauuuucucccagugcccaccccauccccgagccccuggcaaccac

SEQ ID NO: 272991 - RNA, 64 nt, Human
cuuaaacuuggccaauuuggaaagggggaaggagccaccccaaaacggugguucagcuuguaga

SEQ ID NO: 272992 - RNA, 64 nt, Human
acucuggcagcaccgccucuucccgccgcccagcccaccccauggccggcuuucaggagcucca

SEQ ID NO: 272993 - RNA, 64 nt, Human
gaggcugggggaucugcuuggaguuuucugccccccaccccaaacuucugucgaggagcaaggc

SEQ ID NO: 272994 - RNA, 64 nt, Human
uacagcaaugcggagugggauagggauaaaauacccaccccaaaaugaccuuggccaccugucu

SEQ ID NO: 272995 - RNA, 64 nt, Human
guuuggauuaaacucuuccccuccugcuuuagugccaccccaaacugcauuuauaauuuuguga

SEQ ID NO: 272996 - RNA, 61 nt, Human
aauuguagacuaaaaccacucuuagcaucuccucuaguauuuuccauguaucaggacagag

SEQ ID NO: 272997 - RNA, 61 nt, Human
agugacuacagguuuucuuuacaaccauggccucuaguauacuuaaaauaagcguccaguu

SEQ ID NO: 272998 - RNA, 61 nt, Human
uuugaaagaugaaaauuaguaucaaacagcucucuaguagaauuucauuauuuuucaccag

SEQ ID NO: 272999 - RNA, 64 nt, Human
ucagccacgcccuggggaggauccacuggaucaccgccgucacugccuguucccggcggccucu

SEQ ID NO: 273000 - RNA, 64 nt, Human
gacgaggccuccugcggacaccagcuccucucuccgccgucaccggggaggccggggauccuug

SEQ ID NO: 273001 - RNA, 64 nt, Human
cugcaggcagcuucccccccaugccagggcucugcgccgucaugugagacuuaaaaaaaaaguu

SEQ ID NO: 273002 - RNA, 64 nt, Human
auggaaugauugaggaggucuggucacccucaagcgccgucaucgccuuguuuccaugggcuuc

SEQ ID NO: 273003 - RNA, 64 nt, Human
ugggcucuuggccguggcauuuccguggacagcccgccgucaggguggcuggggcuggcacggg

SEQ ID NO: 273004 - RNA, 64 nt, Human
ggccucccguugucaugccuuacgguuuccaaugcgccgucaccaucuccaccugccaccaaac

SEQ ID NO: 273005 - RNA, 64 nt, Human
auuggcuguguauuguccauugauuccugauugacgccgucaaaaacaaaugcuuguuaagccc

SEQ ID NO: 273006 - RNA, 64 nt, Human
gugcuaggaggcugccgccuccgccagcgccugucgccgucacucuccacccagccaguaccuc

SEQ ID NO: 273007 - RNA, 64 nt, Human
gagcggauggagaagcagcagguucgagucuccacgccgucagcugagaagagugagggugagc

SEQ ID NO: 273008 - RNA, 64 nt, Human
cagacgccuccauuggcaacgugacgggcagcaacgccgucaaugucuuccugggcaucggccu

SEQ ID NO: 273009 - RNA, 64 nt, Human
ccuaacuugcucugcaugcugucagcggcugccccgccgucauagacuuaaaggacugcaauaa

SEQ ID NO: 273010 - RNA, 64 nt, Human
gggucugauggggagcuccgucucaccggccacccgccgucaccauggcagaugcccuuggccg

SEQ ID NO: 273011 - RNA, 64 nt, Human
gaaccuguguuucacgugacucagcagugcccgccgccgucaccagcuaugcauucacuccguu

SEQ ID NO: 273012 - RNA, 61 nt, Human
gcacucaacucugagcccauacuuuuggcuccucuaguaagaugcacugaaaacuuagcca

SEQ ID NO: 273013 - RNA, 61 nt, Human
cuugaacuucuuacuggaacaauguuugauacucuaguauguaagcuguauuuauguaaua

SEQ ID NO: 273014 - RNA, 61 nt, Human
aaaaugaccuaaacuuuugagauagauuuggcucuaguaaguauuuaguuauaucacuugc

SEQ ID NO: 273015 - RNA, 61 nt, Human
gcggcgguggggcugggugccguguuacuaacucuaguauguuucugugucaaucgcugug

SEQ ID NO: 273016 - RNA, 61 nt, Human
ucggagagccuggggagggugccaaccccaccucuaguauuuugggagauagggaaaguga

SEQ ID NO: 273017 - RNA, 61 nt, Human
caaaacaaucaaaacaaaaaagaccuguggacucuaguagauuuugaauccugccucugcc

SEQ ID NO: 273018 - RNA, 61 nt, Human
gagcaaaacuuuuuaguacgcguauauaucccucuaguaaucacaacauuuuaggauuuag

SEQ ID NO: 273019 - RNA, 61 nt, Human
cagcaaauacagaggugguuuaaucaaacagcucuaguaugaagcaagaguaaagacuaag

SEQ ID NO: 273020 - RNA, 61 nt, Human
gcauuuauaaauccaagucugaaacucugcgcucuaguacugcuguuaagauacacaacuu

SEQ ID NO: 273021 - RNA, 61 nt, Human
cuuuuauuugugauauuuucagagacauuugcucuaguaugguguauuuaaauaauaaaaa

SEQ ID NO: 273022 - RNA, 61 nt, Human
caauuuuuuuaauguagccauuugggguuaucucuaguaaggcagauacccacguugguaa

SEQ ID NO: 273023 - RNA, 61 nt, Human
uuuucccccaaggggggaaauuuuacuuaaccucuaguauuugaacaacucaauauuugaa

SEQ ID NO: 273024 - RNA, 61 nt, Human
uauuuuucaccugagagaggaagagaaauuucucuaguaacacaaagagugaguucuaaaa

SEQ ID NO: 273025 - RNA, 61 nt, Human
aagucucaaauaaugccuuuuuaauuguauccucuaguauuauagauauaggacaguacug

SEQ ID NO: 273026 - RNA, 61 nt, Human
aggagaugccaauguugaaugaagucugaaacucuaguaugugcauaguuugacgugcagc

SEQ ID NO: 273027 - RNA, 61 nt, Human
caagugguaguagagugguuuaacgucuuuccucuaguacuaccaguauucauaaauguau

SEQ ID NO: 273028 - RNA, 61 nt, Human
acucuacaauccuuuccucgaccaacgcaaccucuaguaccuuuccagccgaaaacaggag

SEQ ID NO: 273029 - RNA, 61 nt, Human
guuugaacccgaaauaaggguucuuugguaccucuaguagauaguguguucauuucccugc

SEQ ID NO: 273030 - RNA, 61 nt, Human
auaccuucaggcaacacagcccaguuuuaaccucuaguauccaugaccaaacuaucccuga

SEQ ID NO: 273031 - RNA, 61 nt, Human
cgugaguaaauaaugcagcucagaugcugagcucuaguaggaaaugcuggcaugcugauua

SEQ ID NO: 273032 - RNA, 61 nt, Human
ugguccuguuuuuggguaggugacacguggacucuaguauguaaauguuacuugaaucugu

SEQ ID NO: 273033 - RNA, 61 nt, Human
gaccauccuggcaaacauggugaaaccccaucucuaguaaaaauacaaaaauuagcugggc

SEQ ID NO: 273034 - RNA, 64 nt, Human; identical to SEQ ID NO: 76682

SEQ ID NO: 273035 - RNA, 64 nt, Human; identical to SEQ ID NO: 76683

SEQ ID NO: 273036 - RNA, 64 nt, Human; identical to SEQ ID NO: 76684

SEQ ID NO: 273037 - RNA, 64 nt, Human; identical to SEQ ID NO: 76685

SEQ ID NO: 273038 - RNA, 64 nt, Human; identical to SEQ ID NO: 76686

SEQ ID NO: 273039 - RNA, 64 nt, Human; identical to SEQ ID NO: 76687

SEQ ID NO: 273040 - RNA, 64 nt, Human; identical to SEQ ID NO: 76688

SEQ ID NO: 273041 - RNA, 64 nt, Human; identical to SEQ ID NO: 76689

SEQ ID NO: 273042 - RNA, 64 nt, Human; identical to SEQ ID NO: 76690

SEQ ID NO: 273043 - RNA, 64 nt, Human; identical to SEQ ID NO: 76691

SEQ ID NO: 273044 - RNA, 64 nt, Human; identical to SEQ ID NO: 76692

SEQ ID NO: 273045 - RNA, 64 nt, Human; identical to SEQ ID NO: 76693

SEQ ID NO: 273046 - RNA, 64 nt, Human; identical to SEQ ID NO: 76694

SEQ ID NO: 273047 - RNA, 62 nt, Human; identical to SEQ ID NO: 76695

SEQ ID NO: 273048 - RNA, 64 nt, Human; identical to SEQ ID NO: 76696

SEQ ID NO: 273049 - RNA, 64 nt, Human; identical to SEQ ID NO: 76697

SEQ ID NO: 273050 - RNA, 64 nt, Human
cugccccauauucuugccgugucuuggaaaagucacaggugacagcccuccugaggcccacacu

SEQ ID NO: 273051 - RNA, 64 nt, Human
auuuacgaugaauuucuugugagcagaggacgaaacaggugaauucucaccagacucaaaccag

SEQ ID NO: 273052 - RNA, 62 nt, Human
cggggagaaguggggccgugguucgagggagggcuggccaggggugggacccuuaugagacu

SEQ ID NO: 273053 - RNA, 64 nt, Human; identical to SEQ ID NO: 76698

SEQ ID NO: 273054 - RNA, 64 nt, Human; identical to SEQ ID NO: 76699

SEQ ID NO: 273055 - RNA, 64 nt, Human; identical to SEQ ID NO: 76700

SEQ ID NO: 273056 - RNA, 64 nt, Human; identical to SEQ ID NO: 76701

SEQ ID NO: 273057 - RNA, 64 nt, Human; identical to SEQ ID NO: 76702

SEQ ID NO: 273058 - RNA, 64 nt, Human; identical to SEQ ID NO: 76703

SEQ ID NO: 273059 - RNA, 64 nt, Human; identical to SEQ ID NO: 76704

SEQ ID NO: 273060 - RNA, 64 nt, Human; identical to SEQ ID NO: 76705

SEQ ID NO: 273061 - RNA, 64 nt, Human; identical to SEQ ID NO: 76706

SEQ ID NO: 273062 - RNA, 64 nt, Human; identical to SEQ ID NO: 76707

SEQ ID NO: 273063 - RNA, 64 nt, Human; identical to SEQ ID NO: 76708

SEQ ID NO: 273064 - RNA, 64 nt, Human; identical to SEQ ID NO: 76709

SEQ ID NO: 273065 - RNA, 64 nt, Human; identical to SEQ ID NO: 76710

SEQ ID NO: 273066 - RNA, 64 nt, Human; identical to SEQ ID NO: 76711

SEQ ID NO: 273067 - RNA, 64 nt, Human; identical to SEQ ID NO: 76712

SEQ ID NO: 273068 - RNA, 64 nt, Human; identical to SEQ ID NO: 76713

SEQ ID NO: 273069 - RNA, 64 nt, Human
accuuggacagaggucaauccuugaugcuccagcacaggugacgucacuaauugucacuuucca

SEQ ID NO: 273070 - RNA, 64 nt, Human
aagagcaucccuuucuauacauaagagaggucauacaggugagagacaccaaguauauuaaaug

SEQ ID NO: 273071 - RNA, 64 nt, Human
aaggcugacuauacauaaagugacuggaauuuuaacaggugaaccugcauauguauaugcaggu

SEQ ID NO: 273072 - RNA, 64 nt, Human; identical to SEQ ID NO: 76714

SEQ ID NO: 273073 - RNA, 64 nt, Human; identical to SEQ ID NO: 76715

SEQ ID NO: 273074 - RNA, 64 nt, Human; identical to SEQ ID NO: 76716

SEQ ID NO: 273075 - RNA, 64 nt, Human; identical to SEQ ID NO: 76717

SEQ ID NO: 273076 - RNA, 64 nt, Human; identical to SEQ ID NO: 76718

SEQ ID NO: 273077 - RNA, 64 nt, Human; identical to SEQ ID NO: 76719

SEQ ID NO: 273078 - RNA, 64 nt, Human; identical to SEQ ID NO: 76720

SEQ ID NO: 273079 - RNA, 64 nt, Human; identical to SEQ ID NO: 76721

SEQ ID NO: 273080 - RNA, 64 nt, Human; identical to SEQ ID NO: 76722

SEQ ID NO: 273081 - RNA, 64 nt, Human; identical to SEQ ID NO: 76723

SEQ ID NO: 273082 - RNA, 64 nt, Human; identical to SEQ ID NO: 76724

SEQ ID NO: 273083 - RNA, 64 nt, Human; identical to SEQ ID NO: 76725

SEQ ID NO: 273084 - RNA, 64 nt, Human; identical to SEQ ID NO: 76726

SEQ ID NO: 273085 - RNA, 64 nt, Human; identical to SEQ ID NO: 76727

SEQ ID NO: 273086 - RNA, 64 nt, Human; identical to SEQ ID NO: 76728

SEQ ID NO: 273087 - RNA, 64 nt, Human; identical to SEQ ID NO: 76729

SEQ ID NO: 273088 - RNA, 64 nt, Human
aaauuaaaauuaaaaacaaauaauccugccuuuuacaggugaaacucggggcuguccauagcgg

SEQ ID NO: 273089 - RNA, 64 nt, Human
uuaucugaauccuaucaauuauucugaugcugggacaggugagaagaaacugugaaguauauga

SEQ ID NO: 273090 - RNA, 64 nt, Human
acacuauaacuguauuuggacauaggguuuucaaacaggugaguaacuucaaaugagguuguug

SEQ ID NO: 273091 - RNA, 64 nt, Human; identical to SEQ ID NO: 76730

SEQ ID NO: 273092 - RNA, 64 nt, Human; identical to SEQ ID NO: 76731

SEQ ID NO: 273093 - RNA, 50 nt, Human; identical to SEQ ID NO: 76732

SEQ ID NO: 273094 - RNA, 64 nt, Human; identical to SEQ ID NO: 76733

SEQ ID NO: 273095 - RNA, 64 nt, Human; identical to SEQ ID NO: 76734

SEQ ID NO: 273096 - RNA, 64 nt, Human; identical to SEQ ID NO: 76735

SEQ ID NO: 273097 - RNA, 64 nt, Human; identical to SEQ ID NO: 76736

SEQ ID NO: 273098 - RNA, 64 nt, Human; identical to SEQ ID NO: 76737

SEQ ID NO: 273099 - RNA, 64 nt, Human; identical to SEQ ID NO: 76738

SEQ ID NO: 273100 - RNA, 64 nt, Human; identical to SEQ ID NO: 76739

SEQ ID NO: 273101 - RNA, 64 nt, Human; identical to SEQ ID NO: 76740

SEQ ID NO: 273102 - RNA, 64 nt, Human; identical to SEQ ID NO: 76741

SEQ ID NO: 273103 - RNA, 64 nt, Human; identical to SEQ ID NO: 76742

SEQ ID NO: 273104 - RNA, 64 nt, Human; identical to SEQ ID NO: 76743

SEQ ID NO: 273105 - RNA, 64 nt, Human; identical to SEQ ID NO: 76744

SEQ ID NO: 273106 - RNA, 64 nt, Human; identical to SEQ ID NO: 76745

SEQ ID NO: 273107 - RNA, 64 nt, Human
gcucgcuucagucagcacuucaucucaggcaaccacaggugacaguuaaacaugaugaaaccgc

SEQ ID NO: 273108 - RNA, 64 nt, Human
uagcugagccauccugcccauuccuggagguccuacaggugaaacugcaggagcucagcauaga

SEQ ID NO: 273109 - RNA, 64 nt, Human
ccagcugauucccugacaggagccgacuucacacacaggugacucucaggcauuggcucauguu

SEQ ID NO: 273110 - RNA, 64 nt, Human; identical to SEQ ID NO: 76746

SEQ ID NO: 273111 - RNA, 64 nt, Human; identical to SEQ ID NO: 76747

SEQ ID NO: 273112 - RNA, 64 nt, Human; identical to SEQ ID NO: 76748

SEQ ID NO: 273113 - RNA, 64 nt, Human; identical to SEQ ID NO: 76749

SEQ ID NO: 273114 - RNA, 64 nt, Human; identical to SEQ ID NO: 76750

SEQ ID NO: 273115 - RNA, 64 nt, Human; identical to SEQ ID NO: 76751

SEQ ID NO: 273116 - RNA, 64 nt, Human; identical to SEQ ID NO: 76752

SEQ ID NO: 273117 - RNA, 64 nt, Human; identical to SEQ ID NO: 76753

SEQ ID NO: 273118 - RNA, 64 nt, Human; identical to SEQ ID NO: 76754

SEQ ID NO: 273119 - RNA, 64 nt, Human; identical to SEQ ID NO: 76755

SEQ ID NO: 273120 - RNA, 64 nt, Human; identical to SEQ ID NO: 76756

SEQ ID NO: 273121 - RNA, 63 nt, Human; identical to SEQ ID NO: 76757

SEQ ID NO: 273122 - RNA, 64 nt, Human; identical to SEQ ID NO: 76758

SEQ ID NO: 273123 - RNA, 64 nt, Human; identical to SEQ ID NO: 76759

SEQ ID NO: 273124 - RNA, 64 nt, Human; identical to SEQ ID NO: 76760

SEQ ID NO: 273125 - RNA, 64 nt, Human; identical to SEQ ID NO: 76761

SEQ ID NO: 273126 - RNA, 64 nt, Human
cuccuuauagacacuugcucccaacccauucacuacaggugaaggcucucacccccaucccugg

SEQ ID NO: 273127 - RNA, 64 nt, Human
uuugagauguaaguacuguuaucauccccauuucacaggugaagaaacagaagcacagagaugu

SEQ ID NO: 273128 - RNA, 64 nt, Human
aucccuccccucagccuccugaguagcugagacuacaggugagugccaccacacucagcuaauu

SEQ ID NO: 273129 - RNA, 64 nt, Human; identical to SEQ ID NO: 76762

SEQ ID NO: 273130 - RNA, 64 nt, Human; identical to SEQ ID NO: 76763

SEQ ID NO: 273131 - RNA, 64 nt, Human; identical to SEQ ID NO: 76764

SEQ ID NO: 273132 - RNA, 64 nt, Human; identical to SEQ ID NO: 76765

SEQ ID NO: 273133 - RNA, 64 nt, Human; identical to SEQ ID NO: 76766

SEQ ID NO: 273134 - RNA, 64 nt, Human; identical to SEQ ID NO: 76767

SEQ ID NO: 273135 - RNA, 64 nt, Human; identical to SEQ ID NO: 76768

SEQ ID NO: 273136 - RNA, 64 nt, Human; identical to SEQ ID NO: 76769

SEQ ID NO: 273137 - RNA, 64 nt, Human; identical to SEQ ID NO: 76770

SEQ ID NO: 273138 - RNA, 64 nt, Human; identical to SEQ ID NO: 76771

SEQ ID NO: 273139 - RNA, 64 nt, Human; identical to SEQ ID NO: 76772

SEQ ID NO: 273140 - RNA, 64 nt, Human; identical to SEQ ID NO: 76773

SEQ ID NO: 273141 - RNA, 64 nt, Human; identical to SEQ ID NO: 76774

SEQ ID NO: 273142 - RNA, 64 nt, Human; identical to SEQ ID NO: 76775

SEQ ID NO: 273143 - RNA, 64 nt, Human; identical to SEQ ID NO: 76776

SEQ ID NO: 273144 - RNA, 64 nt, Human; identical to SEQ ID NO: 76777

SEQ ID NO: 273145 - RNA, 64 nt, Human
cucuccugccucagccucccgaguaguugggauuacaggugacugccaccgugcccggcuaaug

SEQ ID NO: 273146 - RNA, 64 nt, Human
uagggaggacagacugucacuugcuguuacaggcacaggugauuaaaaugcuaaauauugcaaa

SEQ ID NO: 273147 - RNA, 62 nt, Human
ccagggccccaggggcggggaaggcauggcuugcuggccaggauauucagagguaggcagcc

SEQ ID NO: 273148 - RNA, 64 nt, Human; identical to SEQ ID NO: 76778

SEQ ID NO: 273149 - RNA, 64 nt, Human; identical to SEQ ID NO: 76779

SEQ ID NO: 273150 - RNA, 64 nt, Human; identical to SEQ ID NO: 76780

SEQ ID NO: 273151 - RNA, 64 nt, Human; identical to SEQ ID NO: 76781

SEQ ID NO: 273152 - RNA, 64 nt, Human; identical to SEQ ID NO: 76782

SEQ ID NO: 273153 - RNA, 64 nt, Human; identical to SEQ ID NO: 76783

SEQ ID NO: 273154 - RNA, 64 nt, Human; identical to SEQ ID NO: 76784

SEQ ID NO: 273155 - RNA, 64 nt, Human; identical to SEQ ID NO: 76785

SEQ ID NO: 273156 - RNA, 64 nt, Human; identical to SEQ ID NO: 76786

SEQ ID NO: 273157 - RNA, 64 nt, Human; identical to SEQ ID NO: 76787

SEQ ID NO: 273158 - RNA, 64 nt, Human; identical to SEQ ID NO: 76788

SEQ ID NO: 273159 - RNA, 64 nt, Human; identical to SEQ ID NO: 76789

SEQ ID NO: 273160 - RNA, 64 nt, Human; identical to SEQ ID NO: 76790

SEQ ID NO: 273161 - RNA, 64 nt, Human; identical to SEQ ID NO: 76791

SEQ ID NO: 273162 - RNA, 64 nt, Human; identical to SEQ ID NO: 76792

SEQ ID NO: 273163 - RNA, 57 nt, Human; identical to SEQ ID NO: 76793

SEQ ID NO: 273164 - RNA, 64 nt, Human
cuguuucuuuaacaguagcagggaaauguaaacuacaggugacaaaaaauacccagguaaacac

SEQ ID NO: 273165 - RNA, 64 nt, Human
gcagcaagcagguuuuuccucccuguugagcaagacaggugagcaagauaggacuuggcuuucu

SEQ ID NO: 273166 - RNA, 64 nt, Human
agaugagagagcacgagcuaaaguaaaauaucuaacaggugaaaaaggugugaggauugaacuc

SEQ ID NO: 273167 - RNA, 64 nt, Human; identical to SEQ ID NO: 76794

SEQ ID NO: 273168 - RNA, 64 nt, Human; identical to SEQ ID NO: 76795

SEQ ID NO: 273169 - RNA, 64 nt, Human; identical to SEQ ID NO: 76796

SEQ ID NO: 273170 - RNA, 64 nt, Human; identical to SEQ ID NO: 76797

SEQ ID NO: 273171 - RNA, 64 nt, Human; identical to SEQ ID NO: 76798

SEQ ID NO: 273172 - RNA, 64 nt, Human; identical to SEQ ID NO: 76799

SEQ ID NO: 273173 - RNA, 64 nt, Human; identical to SEQ ID NO: 76800

SEQ ID NO: 273174 - RNA, 64 nt, Human; identical to SEQ ID NO: 76801

SEQ ID NO: 273175 - RNA, 64 nt, Human; identical to SEQ ID NO: 76802

SEQ ID NO: 273176 - RNA, 64 nt, Human; identical to SEQ ID NO: 76803

SEQ ID NO: 273177 - RNA, 64 nt, Human; identical to SEQ ID NO: 76804

SEQ ID NO: 273178 - RNA, 64 nt, Human; identical to SEQ ID NO: 76805

SEQ ID NO: 273179 - RNA, 64 nt, Human; identical to SEQ ID NO: 76806

SEQ ID NO: 273180 - RNA, 64 nt, Human; identical to SEQ ID NO: 76807

SEQ ID NO: 273181 - RNA, 64 nt, Human; identical to SEQ ID NO: 76808

SEQ ID NO: 273182 - RNA, 64 nt, Human; identical to SEQ ID NO: 76809

SEQ ID NO: 273183 - RNA, 64 nt, Human
uuuucuccauguaccugcugggccagcccauuucacaggugaggaacccgaggcucagggcccc

SEQ ID NO: 273184 - RNA, 64 nt, Human
gucuggggccagccuaguaauuguuacuaggcacacaggugaugcugacucgauggccugagac

SEQ ID NO: 273185 - RNA, 64 nt, Human
agcucacagguugccaggcagagcuuuugagcucacaggugacaggcucaggguucucauccug

SEQ ID NO: 273186 - RNA, 64 nt, Human; identical to SEQ ID NO: 76810

SEQ ID NO: 273187 - RNA, 64 nt, Human; identical to SEQ ID NO: 76811

SEQ ID NO: 273188 - RNA, 64 nt, Human; identical to SEQ ID NO: 76812

SEQ ID NO: 273189 - RNA, 64 nt, Human; identical to SEQ ID NO: 76813

SEQ ID NO: 273190 - RNA, 64 nt, Human; identical to SEQ ID NO: 76814

SEQ ID NO: 273191 - RNA, 64 nt, Human; identical to SEQ ID NO: 76815

SEQ ID NO: 273192 - RNA, 64 nt, Human; identical to SEQ ID NO: 76816

SEQ ID NO: 273193 - RNA, 64 nt, Human; identical to SEQ ID NO: 76817

SEQ ID NO: 273194 - RNA, 64 nt, Human; identical to SEQ ID NO: 76818

SEQ ID NO: 273195 - RNA, 64 nt, Human; identical to SEQ ID NO: 76819

SEQ ID NO: 273196 - RNA, 64 nt, Human; identical to SEQ ID NO: 76820

SEQ ID NO: 273197 - RNA, 62 nt, Human; identical to SEQ ID NO: 76821

SEQ ID NO: 273198 - RNA, 64 nt, Human; identical to SEQ ID NO: 76822

SEQ ID NO: 273199 - RNA, 64 nt, Human; identical to SEQ ID NO: 76823

SEQ ID NO: 273200 - RNA, 59 nt, Human; identical to SEQ ID NO: 76824

SEQ ID NO: 273201 - RNA, 64 nt, Human; identical to SEQ ID NO: 76825

SEQ ID NO: 273202 - RNA, 64 nt, Human
caggugggguaucaucugcucgguggggccacccacaggugacagcauggacccucaggcuggc

SEQ ID NO: 273203 - RNA, 64 nt, Human
aauugagcugaaccuggggaccccugguuggggaacaggugaguucuauuugagacuuccagcc

SEQ ID NO: 273204 - RNA, 64 nt, Human
cccucuuacuuggcgaccacugaugagaucaacaacaggugaacuauaaaccuauuauuuauug

SEQ ID NO: 273205 - RNA, 64 nt, Human; identical to SEQ ID NO: 76826

SEQ ID NO: 273206 - RNA, 64 nt, Human; identical to SEQ ID NO: 76827

SEQ ID NO: 273207 - RNA, 64 nt, Human; identical to SEQ ID NO: 76828

SEQ ID NO: 273208 - RNA, 64 nt, Human; identical to SEQ ID NO: 76829

SEQ ID NO: 273209 - RNA, 64 nt, Human; identical to SEQ ID NO: 76830

SEQ ID NO: 273210 - RNA, 64 nt, Human; identical to SEQ ID NO: 76831

SEQ ID NO: 273211 - RNA, 61 nt, Human; identical to SEQ ID NO: 76832

SEQ ID NO: 273212 - RNA, 64 nt, Human; identical to SEQ ID NO: 76833

SEQ ID NO: 273213 - RNA, 64 nt, Human; identical to SEQ ID NO: 76834

SEQ ID NO: 273214 - RNA, 64 nt, Human; identical to SEQ ID NO: 76835

SEQ ID NO: 273215 - RNA, 64 nt, Human; identical to SEQ ID NO: 76836

SEQ ID NO: 273216 - RNA, 64 nt, Human; identical to SEQ ID NO: 76837

SEQ ID NO: 273217 - RNA, 64 nt, Human; identical to SEQ ID NO: 76838

SEQ ID NO: 273218 - RNA, 64 nt, Human; identical to SEQ ID NO: 76839

SEQ ID NO: 273219 - RNA, 64 nt, Human; identical to SEQ ID NO: 76840

SEQ ID NO: 273220 - RNA, 64 nt, Human; identical to SEQ ID NO: 76841

SEQ ID NO: 273221 - RNA, 64 nt, Human
guaaaauccaggagucugcaguuucuaaaaucacacaggugagugggcaugguggcucaugccu

SEQ ID NO: 273222 - RNA, 64 nt, Human
guggcuugguuacugugacuguagcuggaguggcacaggugacccaggcguccuuucagcucca

SEQ ID NO: 273223 - RNA, 62 nt, Human
cguggaccaaggggcauggagcuucacuccuugcuggccagggaguuggggacucagaggga

SEQ ID NO: 273224 - RNA, 64 nt, Human; identical to SEQ ID NO: 76842

SEQ ID NO: 273225 - RNA, 64 nt, Human; identical to SEQ ID NO: 76843

SEQ ID NO: 273226 - RNA, 64 nt, Human; identical to SEQ ID NO: 76844

SEQ ID NO: 273227 - RNA, 64 nt, Human; identical to SEQ ID NO: 76845

SEQ ID NO: 273228 - RNA, 64 nt, Human; identical to SEQ ID NO: 76846

SEQ ID NO: 273229 - RNA, 64 nt, Human; identical to SEQ ID NO: 76847

SEQ ID NO: 273230 - RNA, 64 nt, Human; identical to SEQ ID NO: 76848

SEQ ID NO: 273231 - RNA, 64 nt, Human; identical to SEQ ID NO: 76849

SEQ ID NO: 273232 - RNA, 64 nt, Human; identical to SEQ ID NO: 76850

SEQ ID NO: 273233 - RNA, 64 nt, Human; identical to SEQ ID NO: 76851

SEQ ID NO: 273234 - RNA, 64 nt, Human; identical to SEQ ID NO: 76852

SEQ ID NO: 273235 - RNA, 64 nt, Human; identical to SEQ ID NO: 76853

SEQ ID NO: 273236 - RNA, 64 nt, Human; identical to SEQ ID NO: 76854

SEQ ID NO: 273237 - RNA, 64 nt, Human; identical to SEQ ID NO: 76855

SEQ ID NO: 273238 - RNA, 64 nt, Human; identical to SEQ ID NO: 76856

SEQ ID NO: 273239 - RNA, 64 nt, Human; identical to SEQ ID NO: 76857

SEQ ID NO: 273240 - RNA, 64 nt, Human
cuguugaccugcaagagaauauacuuuugcauauacaggugaaaguuuugcaauuuauguauac

SEQ ID NO: 273241 - RNA, 64 nt, Human
cauuuccaaucccagaacacauggagggaaucggacaggugaugccagcaguuccugcuccucu

SEQ ID NO: 273242 - RNA, 64 nt, Human
cagugguucauaacaguagaggauuuugagcuuuacaggugauagguaccuaaugucuccuaca

SEQ ID NO: 273243 - RNA, 64 nt, Human; identical to SEQ ID NO: 76858

SEQ ID NO: 273244 - RNA, 64 nt, Human; identical to SEQ ID NO: 76859

SEQ ID NO: 273245 - RNA, 64 nt, Human; identical to SEQ ID NO: 76860

SEQ ID NO: 273246 - RNA, 64 nt, Human; identical to SEQ ID NO: 76861

SEQ ID NO: 273247 - RNA, 64 nt, Human; identical to SEQ ID NO: 76862

SEQ ID NO: 273248 - RNA, 64 nt, Human; identical to SEQ ID NO: 76863

SEQ ID NO: 273249 - RNA, 64 nt, Human; identical to SEQ ID NO: 76864

SEQ ID NO: 273250 - RNA, 64 nt, Human; identical to SEQ ID NO: 76865

SEQ ID NO: 273251 - RNA, 64 nt, Human; identical to SEQ ID NO: 76866

SEQ ID NO: 273252 - RNA, 64 nt, Human; identical to SEQ ID NO: 76867

SEQ ID NO: 273253 - RNA, 64 nt, Human; identical to SEQ ID NO: 76868

SEQ ID NO: 273254 - RNA, 64 nt, Human; identical to SEQ ID NO: 76869

SEQ ID NO: 273255 - RNA, 64 nt, Human; identical to SEQ ID NO: 76870

SEQ ID NO: 273256 - RNA, 64 nt, Human; identical to SEQ ID NO: 76871

SEQ ID NO: 273257 - RNA, 64 nt, Human; identical to SEQ ID NO: 76872

SEQ ID NO: 273258 - RNA, 64 nt, Human; identical to SEQ ID NO: 76873

SEQ ID NO: 273259 - RNA, 64 nt, Human
aggagucaggcaaggauugugcuucccccauuauacaggugacaaaacugaguccuggggaaag

SEQ ID NO: 273260 - RNA, 64 nt, Human
agccagaagacaggcaguaguuuuaauuucaggaacaggugauccacucuguaaaacagcaggu

SEQ ID NO: 273261 - RNA, 64 nt, Human
gacuccuccuuuuuccaugcccuaaacagaccugacaggugaggucuguuccuuuuauauaagu

SEQ ID NO: 273262 - RNA, 64 nt, Human; identical to SEQ ID NO: 76874

SEQ ID NO: 273263 - RNA, 64 nt, Human; identical to SEQ ID NO: 76875

SEQ ID NO: 273264 - RNA, 64 nt, Human; identical to SEQ ID NO: 76876

SEQ ID NO: 273265 - RNA, 64 nt, Human; identical to SEQ ID NO: 76877

SEQ ID NO: 273266 - RNA, 64 nt, Human; identical to SEQ ID NO: 76878

SEQ ID NO: 273267 - RNA, 64 nt, Human; identical to SEQ ID NO: 76879

SEQ ID NO: 273268 - RNA, 64 nt, Human; identical to SEQ ID NO: 76880

SEQ ID NO: 273269 - RNA, 64 nt, Human; identical to SEQ ID NO: 76881

SEQ ID NO: 273270 - RNA, 64 nt, Human; identical to SEQ ID NO: 76882

SEQ ID NO: 273271 - RNA, 64 nt, Human; identical to SEQ ID NO: 76883

SEQ ID NO: 273272 - RNA, 64 nt, Human; identical to SEQ ID NO: 76884

SEQ ID NO: 273273 - RNA, 64 nt, Human; identical to SEQ ID NO: 76885

SEQ ID NO: 273274 - RNA, 64 nt, Human; identical to SEQ ID NO: 76886

SEQ ID NO: 273275 - RNA, 64 nt, Human; identical to SEQ ID NO: 76887

SEQ ID NO: 273276 - RNA, 64 nt, Human; identical to SEQ ID NO: 76888

SEQ ID NO: 273277 - RNA, 64 nt, Human; identical to SEQ ID NO: 76889

SEQ ID NO: 273278 - RNA, 64 nt, Human
uuggcuuuuaguaaucauguuggcuggucuggucacaggugacugugaaacagaugcccugguc

SEQ ID NO: 273279 - RNA, 64 nt, Human
acugggucuuagcauccuccuguguauggaagagacaggugaccgcuccagguugggugcucac

SEQ ID NO: 273280 - RNA, 64 nt, Human
uccucccaggguuuccagggaaacaacaugaaaaacaggugacaugaacuacagacuaaagauu

SEQ ID NO: 273281 - RNA, 64 nt, Human; identical to SEQ ID NO: 76890

SEQ ID NO: 273282 - RNA, 64 nt, Human; identical to SEQ ID NO: 76891

SEQ ID NO: 273283 - RNA, 64 nt, Human; identical to SEQ ID NO: 76892

SEQ ID NO: 273284 - RNA, 64 nt, Human; identical to SEQ ID NO: 76893

SEQ ID NO: 273285 - RNA, 64 nt, Human; identical to SEQ ID NO: 76894

SEQ ID NO: 273286 - RNA, 64 nt, Human; identical to SEQ ID NO: 76895

SEQ ID NO: 273287 - RNA, 64 nt, Human; identical to SEQ ID NO: 76896

SEQ ID NO: 273288 - RNA, 64 nt, Human; identical to SEQ ID NO: 76897

SEQ ID NO: 273289 - RNA, 64 nt, Human; identical to SEQ ID NO: 76898

SEQ ID NO: 273290 - RNA, 64 nt, Human; identical to SEQ ID NO: 76899

SEQ ID NO: 273291 - RNA, 64 nt, Human; identical to SEQ ID NO: 76900

SEQ ID NO: 273292 - RNA, 64 nt, Human; identical to SEQ ID NO: 76901

SEQ ID NO: 273293 - RNA, 64 nt, Human; identical to SEQ ID NO: 76902

SEQ ID NO: 273294 - RNA, 64 nt, Human; identical to SEQ ID NO: 76903

SEQ ID NO: 273295 - RNA, 64 nt, Human; identical to SEQ ID NO: 76904

SEQ ID NO: 273296 - RNA, 64 nt, Human; identical to SEQ ID NO: 76905

SEQ ID NO: 273297 - RNA, 64 nt, Human
ugaacuuaacaaaacuguucauccugaaacaggcacaggugaugcauucuccugcuguugcuuc

SEQ ID NO: 273298 - RNA, 64 nt, Human
acccucccaucaucugcuucccccaaggccucccacaggugacagaauguucugccuucccuuc

SEQ ID NO: 273299 - RNA, 64 nt, Human
gaucaccucuuggggacccugccuaucccacuucacaggugaggcauggcaauucuggaagcug

SEQ ID NO: 273300 - RNA, 64 nt, Human; identical to SEQ ID NO: 76906

SEQ ID NO: 273301 - RNA, 64 nt, Human; identical to SEQ ID NO: 76907

SEQ ID NO: 273302 - RNA, 64 nt, Human; identical to SEQ ID NO: 76908

SEQ ID NO: 273303 - RNA, 54 nt, Human; identical to SEQ ID NO: 76909

SEQ ID NO: 273304 - RNA, 64 nt, Human; identical to SEQ ID NO: 76910

SEQ ID NO: 273305 - RNA, 64 nt, Human; identical to SEQ ID NO: 76911

SEQ ID NO: 273306 - RNA, 64 nt, Human; identical to SEQ ID NO: 76912

SEQ ID NO: 273307 - RNA, 64 nt, Human; identical to SEQ ID NO: 76913

SEQ ID NO: 273308 - RNA, 64 nt, Human; identical to SEQ ID NO: 76914

SEQ ID NO: 273309 - RNA, 64 nt, Human; identical to SEQ ID NO: 76915

SEQ ID NO: 273310 - RNA, 64 nt, Human; identical to SEQ ID NO: 76916

SEQ ID NO: 273311 - RNA, 64 nt, Human; identical to SEQ ID NO: 76917

SEQ ID NO: 273312 - RNA, 64 nt, Human; identical to SEQ ID NO: 76918

SEQ ID NO: 273313 - RNA, 64 nt, Human; identical to SEQ ID NO: 76919

SEQ ID NO: 273314 - RNA, 64 nt, Human; identical to SEQ ID NO: 76920

SEQ ID NO: 273315 - RNA, 64 nt, Human; identical to SEQ ID NO: 76921

SEQ ID NO: 273316 - RNA, 64 nt, Human
acuuaacccaaggucaagcagaugaguagugaacacaggugaucgaguguuggcucugaacacu

SEQ ID NO: 273317 - RNA, 64 nt, Human
auugucaaagaacaaagcgguguuuuucuuuuaaacaggugaucacguuucguguucauacuca

SEQ ID NO: 273318 - RNA, 64 nt, Human
cuuuuuuacaaaaagugccguauauacauauguaacaggugaguguguguuuaacauaauuuau

SEQ ID NO: 273319 - RNA, 64 nt, Human; identical to SEQ ID NO: 76922

SEQ ID NO: 273320 - RNA, 64 nt, Human; identical to SEQ ID NO: 76923

SEQ ID NO: 273321 - RNA, 64 nt, Human; identical to SEQ ID NO: 76924

SEQ ID NO: 273322 - RNA, 64 nt, Human; identical to SEQ ID NO: 76925

SEQ ID NO: 273323 - RNA, 64 nt, Human; identical to SEQ ID NO: 76926

SEQ ID NO: 273324 - RNA, 64 nt, Human; identical to SEQ ID NO: 76927

SEQ ID NO: 273325 - RNA, 64 nt, Human; identical to SEQ ID NO: 76928

SEQ ID NO: 273326 - RNA, 64 nt, Human; identical to SEQ ID NO: 76929

SEQ ID NO: 273327 - RNA, 64 nt, Human; identical to SEQ ID NO: 76930

SEQ ID NO: 273328 - RNA, 64 nt, Human; identical to SEQ ID NO: 76931

SEQ ID NO: 273329 - RNA, 64 nt, Human; identical to SEQ ID NO: 76932

SEQ ID NO: 273330 - RNA, 64 nt, Human; identical to SEQ ID NO: 76933

SEQ ID NO: 273331 - RNA, 64 nt, Human; identical to SEQ ID NO: 76934

SEQ ID NO: 273332 - RNA, 64 nt, Human; identical to SEQ ID NO: 76935

SEQ ID NO: 273333 - RNA, 64 nt, Human; identical to SEQ ID NO: 76936

SEQ ID NO: 273334 - RNA, 64 nt, Human; identical to SEQ ID NO: 76937

SEQ ID NO: 273335 - RNA, 64 nt, Human
agcacaugaaaugcuugugaguuguugacauuggacaggugaacaguagggcauuacauuugug

SEQ ID NO: 273336 - RNA, 64 nt, Human
ccucuggcccagccaccacugccucucagcuucaacaggugacaggcugcuuucgugacuugau

SEQ ID NO: 273337 - RNA, 64 nt, Human
gccacccuuuguuucccucauccucggcucccacacaggugacagacccagcagauagcuucuc

SEQ ID NO: 273338 - RNA, 64 nt, Human; identical to SEQ ID NO: 76938

SEQ ID NO: 273339 - RNA, 64 nt, Human; identical to SEQ ID NO: 76939

SEQ ID NO: 273340 - RNA, 64 nt, Human; identical to SEQ ID NO: 76940

SEQ ID NO: 273341 - RNA, 64 nt, Human; identical to SEQ ID NO: 76941

SEQ ID NO: 273342 - RNA, 64 nt, Human; identical to SEQ ID NO: 76942

SEQ ID NO: 273343 - RNA, 64 nt, Human; identical to SEQ ID NO: 76943

SEQ ID NO: 273344 - RNA, 64 nt, Human; identical to SEQ ID NO: 76944

SEQ ID NO: 273345 - RNA, 64 nt, Human; identical to SEQ ID NO: 76945

SEQ ID NO: 273346 - RNA, 64 nt, Human; identical to SEQ ID NO: 76946

SEQ ID NO: 273347 - RNA, 64 nt, Human; identical to SEQ ID NO: 76947

SEQ ID NO: 273348 - RNA, 64 nt, Human; identical to SEQ ID NO: 76948

SEQ ID NO: 273349 - RNA, 64 nt, Human; identical to SEQ ID NO: 76949

SEQ ID NO: 273350 - RNA, 64 nt, Human; identical to SEQ ID NO: 76950

SEQ ID NO: 273351 - RNA, 64 nt, Human; identical to SEQ ID NO: 76951

SEQ ID NO: 273352 - RNA, 64 nt, Human; identical to SEQ ID NO: 76952

SEQ ID NO: 273353 - RNA, 64 nt, Human; identical to SEQ ID NO: 76953

SEQ ID NO: 273354 - RNA, 64 nt, Human
gauaaggaguaccugcuggucagccuugagaugcacaggugaagguuagggugagaugagaaca

SEQ ID NO: 273355 - RNA, 64 nt, Human
ugucaggugagacuguguaugcaaaaugaauggcacaggugaugccagggccucuugcuugggu

SEQ ID NO: 273356 - RNA, 64 nt, Human
ucacugaggcuaugucaacaugauauuuagaccaacaggugaucaauguuuggaaaauacaaca

SEQ ID NO: 273357 - RNA, 64 nt, Human; identical to SEQ ID NO: 76954

SEQ ID NO: 273358 - RNA, 64 nt, Human; identical to SEQ ID NO: 76955

SEQ ID NO: 273359 - RNA, 64 nt, Human; identical to SEQ ID NO: 76956

SEQ ID NO: 273360 - RNA, 64 nt, Human; identical to SEQ ID NO: 76957

SEQ ID NO: 273361 - RNA, 64 nt, Human; identical to SEQ ID NO: 76958

SEQ ID NO: 273362 - RNA, 64 nt, Human; identical to SEQ ID NO: 76959

SEQ ID NO: 273363 - RNA, 64 nt, Human; identical to SEQ ID NO: 76960

SEQ ID NO: 273364 - RNA, 64 nt, Human; identical to SEQ ID NO: 76961

SEQ ID NO: 273365 - RNA, 64 nt, Human; identical to SEQ ID NO: 76962

SEQ ID NO: 273366 - RNA, 64 nt, Human; identical to SEQ ID NO: 76963

SEQ ID NO: 273367 - RNA, 64 nt, Human; identical to SEQ ID NO: 76964

SEQ ID NO: 273368 - RNA, 64 nt, Human; identical to SEQ ID NO: 76965

SEQ ID NO: 273369 - RNA, 55 nt, Human; identical to SEQ ID NO: 76966

SEQ ID NO: 273370 - RNA, 64 nt, Human; identical to SEQ ID NO: 76967

SEQ ID NO: 273371 - RNA, 64 nt, Human; identical to SEQ ID NO: 76968

SEQ ID NO: 273372 - RNA, 64 nt, Human; identical to SEQ ID NO: 76969

SEQ ID NO: 273373 - RNA, 63 nt, Human
auggcccaccacccaccuaacccacuggggcacacaggugacuuucuccuccaaccuccauca

SEQ ID NO: 273374 - RNA, 64 nt, Human
uggugcuaccuggcucuccugucucugcagcucuacaggugaggcccagcagagggaguagggc

SEQ ID NO: 273375 - RNA, 64 nt, Human
agggaagggugguggagccaguaaacagaggaguacaggugaagcaccaagcucaaagcgugga

SEQ ID NO: 273376 - RNA, 64 nt, Human; identical to SEQ ID NO: 76970

SEQ ID NO: 273377 - RNA, 64 nt, Human; identical to SEQ ID NO: 76971

SEQ ID NO: 273378 - RNA, 64 nt, Human; identical to SEQ ID NO: 76972

SEQ ID NO: 273379 - RNA, 64 nt, Human; identical to SEQ ID NO: 76973

SEQ ID NO: 273380 - RNA, 64 nt, Human; identical to SEQ ID NO: 76974

SEQ ID NO: 273381 - RNA, 64 nt, Human; identical to SEQ ID NO: 76975

SEQ ID NO: 273382 - RNA, 64 nt, Human; identical to SEQ ID NO: 76976

SEQ ID NO: 273383 - RNA, 64 nt, Human; identical to SEQ ID NO: 76977

SEQ ID NO: 273384 - RNA, 64 nt, Human; identical to SEQ ID NO: 76978

SEQ ID NO: 273385 - RNA, 64 nt, Human; identical to SEQ ID NO: 76979

SEQ ID NO: 273386 - RNA, 64 nt, Human; identical to SEQ ID NO: 76980

SEQ ID NO: 273387 - RNA, 64 nt, Human; identical to SEQ ID NO: 76981

SEQ ID NO: 273388 - RNA, 64 nt, Human; identical to SEQ ID NO: 76982

SEQ ID NO: 273389 - RNA, 64 nt, Human; identical to SEQ ID NO: 76983
